United States Patent 7,314,750 (ADDRESSABLE OLIGONUCLEOTIDE ARRAY OF THE RAT GENOME) - sequence listing, part 5

SEQ ID NO: 151327 - DNA, 25 bp, Rattus norvegicus
aggtatactctgagggctctcagga

SEQ ID NO: 151328 - DNA, 25 bp, Rattus norvegicus
aggtatactctgtgggctctcagga

SEQ ID NO: 151329 - DNA, 25 bp, Rattus norvegicus
aggtatagccttcttcttgaggaaa

SEQ ID NO: 151330 - DNA, 25 bp, Rattus norvegicus
aggtatagccttgttcttgaggaaa

SEQ ID NO: 151331 - DNA, 25 bp, Rattus norvegicus
aggtatagctggaccattctccaca

SEQ ID NO: 151332 - DNA, 25 bp, Rattus norvegicus
aggtatagctggtccattctccaca

SEQ ID NO: 151333 - DNA, 25 bp, Rattus norvegicus
aggtatatccataaggcactgtcta

SEQ ID NO: 151334 - DNA, 25 bp, Rattus norvegicus
aggtatatccattaggcactgtcta

SEQ ID NO: 151335 - DNA, 25 bp, Rattus norvegicus
aggtatatctccagcctcaacaggt

SEQ ID NO: 151336 - DNA, 25 bp, Rattus norvegicus
aggtatatctcctgcctcaacaggt

SEQ ID NO: 151337 - DNA, 25 bp, Rattus norvegicus
aggtatatgtgtacctgccaccgga

SEQ ID NO: 151338 - DNA, 25 bp, Rattus norvegicus
aggtatatgtgttcctgccaccgga

SEQ ID NO: 151339 - DNA, 25 bp, Rattus norvegicus
aggtatcaagtcatagcactggcga

SEQ ID NO: 151340 - DNA, 25 bp, Rattus norvegicus
aggtatcaagtcttagcactggcga

SEQ ID NO: 151341 - DNA, 25 bp, Rattus norvegicus
aggtatcatatccactctgtcagac

SEQ ID NO: 151342 - DNA, 25 bp, Rattus norvegicus
aggtatcatatcgactctgtcagac

SEQ ID NO: 151343 - DNA, 25 bp, Rattus norvegicus
aggtatcatctcatgtagtcactct

SEQ ID NO: 151344 - DNA, 25 bp, Rattus norvegicus
aggtatcatctcttgtagtcactct

SEQ ID NO: 151345 - DNA, 25 bp, Rattus norvegicus
aggtatccagggatgcctcatctca

SEQ ID NO: 151346 - DNA, 25 bp, Rattus norvegicus
aggtatccagggttgcctcatctca

SEQ ID NO: 151347 - DNA, 25 bp, Rattus norvegicus
aggtatcctaagactctaatatttc

SEQ ID NO: 151348 - DNA, 25 bp, Rattus norvegicus
aggtatcctaagtctctaatatttc

SEQ ID NO: 151349 - DNA, 25 bp, Rattus norvegicus
aggtatcctcccagggcaacgttga

SEQ ID NO: 151350 - DNA, 25 bp, Rattus norvegicus
aggtatcctccctgggcaacgttga

SEQ ID NO: 151351 - DNA, 25 bp, Rattus norvegicus
aggtatcctctgcttgccatgcata

SEQ ID NO: 151352 - DNA, 25 bp, Rattus norvegicus
aggtatcctctggttgccatgcata

SEQ ID NO: 151353 - DNA, 25 bp, Rattus norvegicus
aggtatcctggtcgtggtcttgccc

SEQ ID NO: 151354 - DNA, 25 bp, Rattus norvegicus
aggtatcctggtggtggtcttgccc

SEQ ID NO: 151355 - DNA, 25 bp, Rattus norvegicus
aggtatcctttgattcatgtctttg

SEQ ID NO: 151356 - DNA, 25 bp, Rattus norvegicus
aggtatcctttgtttcatgtctttg

SEQ ID NO: 151357 - DNA, 25 bp, Rattus norvegicus
aggtatcgtccgaatgtccttctgg

SEQ ID NO: 151358 - DNA, 25 bp, Rattus norvegicus
aggtatcgtccgtatgtccttctgg

SEQ ID NO: 151359 - DNA, 25 bp, Rattus norvegicus
aggtatctatctcttctctactgat

SEQ ID NO: 151360 - DNA, 25 bp, Rattus norvegicus
aggtatctatctgttctctactgat

SEQ ID NO: 151361 - DNA, 25 bp, Rattus norvegicus
aggtatctgggcaacactggttcat

SEQ ID NO: 151362 - DNA, 25 bp, Rattus norvegicus
aggtatctgggctacactggttcat

SEQ ID NO: 151363 - DNA, 25 bp, Rattus norvegicus
aggtatctgtcacctgctcatttca

SEQ ID NO: 151364 - DNA, 25 bp, Rattus norvegicus
aggtatctgtcagctgctcatttca

SEQ ID NO: 151365 - DNA, 25 bp, Rattus norvegicus
aggtatcttataagcaactgctatg

SEQ ID NO: 151366 - DNA, 25 bp, Rattus norvegicus
aggtatcttatatgcaactgctatg

SEQ ID NO: 151367 - DNA, 25 bp, Rattus norvegicus
aggtatgagccaccattcccagaaa

SEQ ID NO: 151368 - DNA, 25 bp, Rattus norvegicus
aggtatgagccagcattcccagaaa

SEQ ID NO: 151369 - DNA, 25 bp, Rattus norvegicus
aggtatgcacctccctgaatgcaat

SEQ ID NO: 151370 - DNA, 25 bp, Rattus norvegicus
aggtatgcacctgcctgaatgcaat

SEQ ID NO: 151371 - DNA, 25 bp, Rattus norvegicus
aggtatgcctatctgtgaccaccaa

SEQ ID NO: 151372 - DNA, 25 bp, Rattus norvegicus
aggtatgcctatgtgtgaccaccaa

SEQ ID NO: 151373 - DNA, 25 bp, Rattus norvegicus
aggtatgcctgtcttgacttttcag

SEQ ID NO: 151374 - DNA, 25 bp, Rattus norvegicus
aggtatgcctgtgttgacttttcag

SEQ ID NO: 151375 - DNA, 25 bp, Rattus norvegicus
aggtatgcctttctagcttagctag

SEQ ID NO: 151376 - DNA, 25 bp, Rattus norvegicus
aggtatgcctttgtagcttagctag

SEQ ID NO: 151377 - DNA, 25 bp, Rattus norvegicus
aggtatggactgacaacttctcccc

SEQ ID NO: 151378 - DNA, 25 bp, Rattus norvegicus
aggtatggactgtcaacttctcccc

SEQ ID NO: 151379 - DNA, 25 bp, Rattus norvegicus
aggtatggcaccacatgggcttctt

SEQ ID NO: 151380 - DNA, 25 bp, Rattus norvegicus
aggtatggcacctcatgggcttctt

SEQ ID NO: 151381 - DNA, 25 bp, Rattus norvegicus
aggtatggctgaacctcaagaggac

SEQ ID NO: 151382 - DNA, 25 bp, Rattus norvegicus
aggtatggctgatcctcaagaggac

SEQ ID NO: 151383 - DNA, 25 bp, Rattus norvegicus
aggtatggcttcatcaacggaccaa

SEQ ID NO: 151384 - DNA, 25 bp, Rattus norvegicus
aggtatggcttcttcaacggaccaa

SEQ ID NO: 151385 - DNA, 25 bp, Rattus norvegicus
aggtatggtggcacagctctttatc

SEQ ID NO: 151386 - DNA, 25 bp, Rattus norvegicus
aggtatggtggctcagctctttatc

SEQ ID NO: 151387 - DNA, 25 bp, Rattus norvegicus
aggtatggtgggaatgccttaacac

SEQ ID NO: 151388 - DNA, 25 bp, Rattus norvegicus
aggtatggtgggtatgccttaacac

SEQ ID NO: 151389 - DNA, 25 bp, Rattus norvegicus
aggtatgtacccaacatctgctttt

SEQ ID NO: 151390 - DNA, 25 bp, Rattus norvegicus
aggtatgtaccctacatctgctttt

SEQ ID NO: 151391 - DNA, 25 bp, Rattus norvegicus
aggtatgtgatgacgtatgcactgg

SEQ ID NO: 151392 - DNA, 25 bp, Rattus norvegicus
aggtatgtgatgtcgtatgcactgg

SEQ ID NO: 151393 - DNA, 25 bp, Rattus norvegicus
aggtatgtgctacctgccagagtga

SEQ ID NO: 151394 - DNA, 25 bp, Rattus norvegicus
aggtatgtgctagctgccagagtga

SEQ ID NO: 151395 - DNA, 25 bp, Rattus norvegicus
aggtatgtgcttcactgcttcgaat

SEQ ID NO: 151396 - DNA, 25 bp, Rattus norvegicus
aggtatgtgcttccctacccgtggt

SEQ ID NO: 151397 - DNA, 25 bp, Rattus norvegicus
aggtatgtgcttgactgcttcgaat

SEQ ID NO: 151398 - DNA, 25 bp, Rattus norvegicus
aggtatgtgcttgcctacccgtggt

SEQ ID NO: 151399 - DNA, 25 bp, Rattus norvegicus
aggtatgtgtgcaggccgtcatccc

SEQ ID NO: 151400 - DNA, 25 bp, Rattus norvegicus
aggtatgtgtgctggccgtcatccc

SEQ ID NO: 151401 - DNA, 25 bp, Rattus norvegicus
aggtatgtgtgtccatccccgtaat

SEQ ID NO: 151402 - DNA, 25 bp, Rattus norvegicus
aggtatgtgtgtgcatccccgtaat

SEQ ID NO: 151403 - DNA, 25 bp, Rattus norvegicus
aggtattcagtgcagctgctgaccc

SEQ ID NO: 151404 - DNA, 25 bp, Rattus norvegicus
aggtattcagtggagctgctgaccc

SEQ ID NO: 151405 - DNA, 25 bp, Rattus norvegicus
aggtattccaggacatcaacatgaa

SEQ ID NO: 151406 - DNA, 25 bp, Rattus norvegicus
aggtattccaggtcatcaacatgaa

SEQ ID NO: 151407 - DNA, 25 bp, Rattus norvegicus
aggtattcctacagccacatgagca

SEQ ID NO: 151408 - DNA, 25 bp, Rattus norvegicus
aggtattcctactgccacatgagca

SEQ ID NO: 151409 - DNA, 25 bp, Rattus norvegicus
aggtattctgagacccttggcatca

SEQ ID NO: 151410 - DNA, 25 bp, Rattus norvegicus
aggtattctgagtcccttggcatca

SEQ ID NO: 151411 - DNA, 25 bp, Rattus norvegicus
aggtattcttgtactgccttggtcc

SEQ ID NO: 151412 - DNA, 25 bp, Rattus norvegicus
aggtattcttgttctgccttggtcc

SEQ ID NO: 151413 - DNA, 25 bp, Rattus norvegicus
aggtattggacaacagaccccactg

SEQ ID NO: 151414 - DNA, 25 bp, Rattus norvegicus
aggtattggacatcagaccccactg

SEQ ID NO: 151415 - DNA, 25 bp, Rattus norvegicus
aggtattgtctgatcacatctgaaa

SEQ ID NO: 151416 - DNA, 25 bp, Rattus norvegicus
aggtattgtctgttcacatctgaaa

SEQ ID NO: 151417 - DNA, 25 bp, Rattus norvegicus
aggtattgttacattgttgcagaga

SEQ ID NO: 151418 - DNA, 25 bp, Rattus norvegicus
aggtattgttactttgttgcagaga

SEQ ID NO: 151419 - DNA, 25 bp, Rattus norvegicus
aggtatttaaaactctcagctcaaa

SEQ ID NO: 151420 - DNA, 25 bp, Rattus norvegicus
aggtatttaaaagtctcagctcaaa

SEQ ID NO: 151421 - DNA, 25 bp, Rattus norvegicus
aggtatttaagcagtctcatccaga

SEQ ID NO: 151422 - DNA, 25 bp, Rattus norvegicus
aggtatttaagctgtctcatccaga

SEQ ID NO: 151423 - DNA, 25 bp, Rattus norvegicus
aggtatttactgacaaggcttcaag

SEQ ID NO: 151424 - DNA, 25 bp, Rattus norvegicus
aggtatttactgtcaaggcttcaag

SEQ ID NO: 151425 - DNA, 25 bp, Rattus norvegicus
aggtatttatctccgtggaaccaca

SEQ ID NO: 151426 - DNA, 25 bp, Rattus norvegicus
aggtatttatctgcgtggaaccaca

SEQ ID NO: 151427 - DNA, 25 bp, Rattus norvegicus
aggtatttgatgattactgcctaca

SEQ ID NO: 151428 - DNA, 25 bp, Rattus norvegicus
aggtatttgatgtttactgcctaca

SEQ ID NO: 151429 - DNA, 25 bp, Rattus norvegicus
aggtattttaaactgtcacttcatt

SEQ ID NO: 151430 - DNA, 25 bp, Rattus norvegicus
aggtattttaaagtgtcacttcatt

SEQ ID NO: 151431 - DNA, 25 bp, Rattus norvegicus
aggtattttattctgcacgctgagc

SEQ ID NO: 151432 - DNA, 25 bp, Rattus norvegicus
aggtattttattgtgcacgctgagc

SEQ ID NO: 151433 - DNA, 25 bp, Rattus norvegicus
aggtattttcaccaccccagtggct

SEQ ID NO: 151434 - DNA, 25 bp, Rattus norvegicus
aggtattttcacgaccccagtggct

SEQ ID NO: 151435 - DNA, 25 bp, Rattus norvegicus
aggtattttcggaccagggctatga

SEQ ID NO: 151436 - DNA, 25 bp, Rattus norvegicus
aggtattttcggtccagggctatga

SEQ ID NO: 151437 - DNA, 25 bp, Rattus norvegicus
aggtattttgacattgtgcaggaca

SEQ ID NO: 151438 - DNA, 25 bp, Rattus norvegicus
aggtattttgactttgtgcaggaca

SEQ ID NO: 151439 - DNA, 25 bp, Rattus norvegicus
aggtattttgcgaagcatccccgaa

SEQ ID NO: 151440 - DNA, 25 bp, Rattus norvegicus
aggtattttgcgtagcatccccgaa

SEQ ID NO: 151441 - DNA, 25 bp, Rattus norvegicus
aggtcaaaaccaactaccgcaatga

SEQ ID NO: 151442 - DNA, 25 bp, Rattus norvegicus
aggtcaaaaccatctaccgcaatga

SEQ ID NO: 151443 - DNA, 25 bp, Rattus norvegicus
aggtcaaaactacccctgactcttg

SEQ ID NO: 151444 - DNA, 25 bp, Rattus norvegicus
aggtcaaaactagccctgactcttg

SEQ ID NO: 151445 - DNA, 25 bp, Rattus norvegicus
aggtcaaaagccacgagcctgaatg

SEQ ID NO: 151446 - DNA, 25 bp, Rattus norvegicus
aggtcaaaagcctcgagcctgaatg

SEQ ID NO: 151447 - DNA, 25 bp, Rattus norvegicus
aggtcaaacacaactcctaggttct

SEQ ID NO: 151448 - DNA, 25 bp, Rattus norvegicus
aggtcaaacacatctcctaggttct

SEQ ID NO: 151449 - DNA, 25 bp, Rattus norvegicus
aggtcaaacagaacacaccactttt

SEQ ID NO: 151450 - DNA, 25 bp, Rattus norvegicus
aggtcaaacagatcacaccactttt

SEQ ID NO: 151451 - DNA, 25 bp, Rattus norvegicus
aggtcaaaccgcaaattactcagtg

SEQ ID NO: 151452 - DNA, 25 bp, Rattus norvegicus
aggtcaaaccgctaattactcagtg

SEQ ID NO: 151453 - DNA, 25 bp, Rattus norvegicus
aggtcaacacctatatccatggcaa

SEQ ID NO: 151454 - DNA, 25 bp, Rattus norvegicus
aggtcaacacctttatccatggcaa

SEQ ID NO: 151455 - DNA, 25 bp, Rattus norvegicus
aggtcaacatccactgcccgtgcgg

SEQ ID NO: 151456 - DNA, 25 bp, Rattus norvegicus
aggtcaacatcctctgcccgtgcgg

SEQ ID NO: 151457 - DNA, 25 bp, Rattus norvegicus
aggtcaaccatcaagaagcccggct

SEQ ID NO: 151458 - DNA, 25 bp, Rattus norvegicus
aggtcaaccatctagaagcccggct

SEQ ID NO: 151459 - DNA, 25 bp, Rattus norvegicus
aggtcaacccaactctgagctgtca

SEQ ID NO: 151460 - DNA, 25 bp, Rattus norvegicus
aggtcaacccaagtctgagctgtca

SEQ ID NO: 151461 - DNA, 25 bp, Rattus norvegicus
aggtcaacccatagccctttcagta

SEQ ID NO: 151462 - DNA, 25 bp, Rattus norvegicus
aggtcaacccattgccctttcagta

SEQ ID NO: 151463 - DNA, 25 bp, Rattus norvegicus
aggtcaacgtccagcacagcatgaa

SEQ ID NO: 151464 - DNA, 25 bp, Rattus norvegicus
aggtcaacgtcctgcacagcatgaa

SEQ ID NO: 151465 - DNA, 25 bp, Rattus norvegicus
aggtcaactagtctttgcactggaa

SEQ ID NO: 151466 - DNA, 25 bp, Rattus norvegicus
aggtcaactagtgtttgcactggaa

SEQ ID NO: 151467 - DNA, 25 bp, Rattus norvegicus
aggtcaacttgaacttcatagtgaa

SEQ ID NO: 151468 - DNA, 25 bp, Rattus norvegicus
aggtcaacttgatcttcatagtgaa

SEQ ID NO: 151469 - DNA, 25 bp, Rattus norvegicus
aggtcaagagctcctttcccacgag

SEQ ID NO: 151470 - DNA, 25 bp, Rattus norvegicus
aggtcaagagctgctttcccacgag

SEQ ID NO: 151471 - DNA, 25 bp, Rattus norvegicus
aggtcaagcccgagactggcacgaa

SEQ ID NO: 151472 - DNA, 25 bp, Rattus norvegicus
aggtcaagcccgtgactggcacgaa

SEQ ID NO: 151473 - DNA, 25 bp, Rattus norvegicus
aggtcaagccctcctagtgggtgct

SEQ ID NO: 151474 - DNA, 25 bp, Rattus norvegicus
aggtcaagccctgctagtgggtgct

SEQ ID NO: 151475 - DNA, 25 bp, Rattus norvegicus
aggtcaagcctgagcagtgtagcaa

SEQ ID NO: 151476 - DNA, 25 bp, Rattus norvegicus
aggtcaagcctgtgcagtgtagcaa

SEQ ID NO: 151477 - DNA, 25 bp, Rattus norvegicus
aggtcaaggctcacggcaagaaggt

SEQ ID NO: 151478 - DNA, 25 bp, Rattus norvegicus
aggtcaaggctctcggcaagaaggt

SEQ ID NO: 151479 - DNA, 25 bp, Rattus norvegicus
aggtcaagggcccatagctgtccac

SEQ ID NO: 151480 - DNA, 25 bp, Rattus norvegicus
aggtcaagggccctgtgcactccaa

SEQ ID NO: 151481 - DNA, 25 bp, Rattus norvegicus
aggtcaagggccgatagctgtccac

SEQ ID NO: 151482 - DNA, 25 bp, Rattus norvegicus
aggtcaagggccgtgtgcactccaa

SEQ ID NO: 151483 - DNA, 25 bp, Rattus norvegicus
aggtcaatccctaccatattttatg

SEQ ID NO: 151484 - DNA, 25 bp, Rattus norvegicus
aggtcaatcccttccatattttatg

SEQ ID NO: 151485 - DNA, 25 bp, Rattus norvegicus
aggtcaatcctgagcacatgctctt

SEQ ID NO: 151486 - DNA, 25 bp, Rattus norvegicus
aggtcaatcctgtgcacatgctctt

SEQ ID NO: 151487 - DNA, 25 bp, Rattus norvegicus
aggtcaatgcgcagaggtcgtgccc

SEQ ID NO: 151488 - DNA, 25 bp, Rattus norvegicus
aggtcaatgcgctgaggtcgtgccc

SEQ ID NO: 151489 - DNA, 25 bp, Rattus norvegicus
aggtcaatgctaaagactccccatt

SEQ ID NO: 151490 - DNA, 25 bp, Rattus norvegicus
aggtcaatgctatagactccccatt

SEQ ID NO: 151491 - DNA, 25 bp, Rattus norvegicus
aggtcaatgtgtaacttttctagga

SEQ ID NO: 151492 - DNA, 25 bp, Rattus norvegicus
aggtcaatgtgttacttttctagga

SEQ ID NO: 151493 - DNA, 25 bp, Rattus norvegicus
aggtcaattccaagtctagtcttta

SEQ ID NO: 151494 - DNA, 25 bp, Rattus norvegicus
aggtcaattccatgtctagtcttta

SEQ ID NO: 151495 - DNA, 25 bp, Rattus norvegicus
aggtcacaaagtacttggcgctcgt

SEQ ID NO: 151496 - DNA, 25 bp, Rattus norvegicus
aggtcacaaagttcttggcgctcgt

SEQ ID NO: 151497 - DNA, 25 bp, Rattus norvegicus
aggtcacaatgtaccaaccttgtaa

SEQ ID NO: 151498 - DNA, 25 bp, Rattus norvegicus
aggtcacaatgttccaaccttgtaa

SEQ ID NO: 151499 - DNA, 25 bp, Rattus norvegicus
aggtcacacagcaagctgctagggt

SEQ ID NO: 151500 - DNA, 25 bp, Rattus norvegicus
aggtcacacagctagctgctagggt

SEQ ID NO: 151501 - DNA, 25 bp, Rattus norvegicus
aggtcacaccaacctccgagtcaga

SEQ ID NO: 151502 - DNA, 25 bp, Rattus norvegicus
aggtcacaccaagctccgagtcaga

SEQ ID NO: 151503 - DNA, 25 bp, Rattus norvegicus
aggtcacaccctccttggattttag

SEQ ID NO: 151504 - DNA, 25 bp, Rattus norvegicus
aggtcacaccctgcttggattttag

SEQ ID NO: 151505 - DNA, 25 bp, Rattus norvegicus
aggtcacagactccagcctaacctg

SEQ ID NO: 151506 - DNA, 25 bp, Rattus norvegicus
aggtcacagactgcagcctaacctg

SEQ ID NO: 151507 - DNA, 25 bp, Rattus norvegicus
aggtcacagattcgcctctttcggg

SEQ ID NO: 151508 - DNA, 25 bp, Rattus norvegicus
aggtcacagattggcctctttcggg

SEQ ID NO: 151509 - DNA, 25 bp, Rattus norvegicus
aggtcacaggacatagccattgctc

SEQ ID NO: 151510 - DNA, 25 bp, Rattus norvegicus
aggtcacaggacttagccattgctc

SEQ ID NO: 151511 - DNA, 25 bp, Rattus norvegicus
aggtcacaggctcgtgccagctgca

SEQ ID NO: 151512 - DNA, 25 bp, Rattus norvegicus
aggtcacaggctcgttgatgtcccc

SEQ ID NO: 151513 - DNA, 25 bp, Rattus norvegicus
aggtcacaggctggtgccagctgca

SEQ ID NO: 151514 - DNA, 25 bp, Rattus norvegicus
aggtcacaggctggttgatgtcccc

SEQ ID NO: 151515 - DNA, 25 bp, Rattus norvegicus
aggtcacaggtcagatcacaggcag

SEQ ID NO: 151516 - DNA, 25 bp, Rattus norvegicus
aggtcacaggtctgatcacaggcag

SEQ ID NO: 151517 - DNA, 25 bp, Rattus norvegicus
aggtcacagtcaatttctagaagga

SEQ ID NO: 151518 - DNA, 25 bp, Rattus norvegicus
aggtcacagtcattttctagaagga

SEQ ID NO: 151519 - DNA, 25 bp, Rattus norvegicus
aggtcacagtccagcttactcagtg

SEQ ID NO: 151520 - DNA, 25 bp, Rattus norvegicus
aggtcacagtcctgcttactcagtg

SEQ ID NO: 151521 - DNA, 25 bp, Rattus norvegicus
aggtcacagttcacttccatttgag

SEQ ID NO: 151522 - DNA, 25 bp, Rattus norvegicus
aggtcacagttctcttccatttgag

SEQ ID NO: 151523 - DNA, 25 bp, Rattus norvegicus
aggtcacagtttcaaggccacactt

SEQ ID NO: 151524 - DNA, 25 bp, Rattus norvegicus
aggtcacagtttcactttcgcttgt

SEQ ID NO: 151525 - DNA, 25 bp, Rattus norvegicus
aggtcacagtttgaaggccacactt

SEQ ID NO: 151526 - DNA, 25 bp, Rattus norvegicus
aggtcacagtttgactttcgcttgt

SEQ ID NO: 151527 - DNA, 25 bp, Rattus norvegicus
aggtcacataccacaggcttaggcc

SEQ ID NO: 151528 - DNA, 25 bp, Rattus norvegicus
aggtcacatacctcaggcttaggcc

SEQ ID NO: 151529 - DNA, 25 bp, Rattus norvegicus
aggtcacatgccagtatttgtatag

SEQ ID NO: 151530 - DNA, 25 bp, Rattus norvegicus
aggtcacatgcctgtatttgtatag

SEQ ID NO: 151531 - DNA, 25 bp, Rattus norvegicus
aggtcacattgcagtcagacatggc

SEQ ID NO: 151532 - DNA, 25 bp, Rattus norvegicus
aggtcacattgctgtcagacatggc

SEQ ID NO: 151533 - DNA, 25 bp, Rattus norvegicus
aggtcaccaactagttaactcgcca

SEQ ID NO: 151534 - DNA, 25 bp, Rattus norvegicus
aggtcaccaacttgttaactcgcca

SEQ ID NO: 151535 - DNA, 25 bp, Rattus norvegicus
aggtcaccactgacttatgggcagg

SEQ ID NO: 151536 - DNA, 25 bp, Rattus norvegicus
aggtcaccactgtcttatgggcagg

SEQ ID NO: 151537 - DNA, 25 bp, Rattus norvegicus
aggtcaccagagcactttctgacgt

SEQ ID NO: 151538 - DNA, 25 bp, Rattus norvegicus
aggtcaccagaggactttctgacgt

SEQ ID NO: 151539 - DNA, 25 bp, Rattus norvegicus
aggtcaccagcccaagccagggaac

SEQ ID NO: 151540 - DNA, 25 bp, Rattus norvegicus
aggtcaccagccgaagccagggaac

SEQ ID NO: 151541 - DNA, 25 bp, Rattus norvegicus
aggtcaccaggcaatgcagatgctt

SEQ ID NO: 151542 - DNA, 25 bp, Rattus norvegicus
aggtcaccaggctatgcagatgctt

SEQ ID NO: 151543 - DNA, 25 bp, Rattus norvegicus
aggtcaccatcaactgtgcggagag

SEQ ID NO: 151544 - DNA, 25 bp, Rattus norvegicus
aggtcaccatcatctgtgcggagag

SEQ ID NO: 151545 - DNA, 25 bp, Rattus norvegicus
aggtcaccatgcaactgtgtcttca

SEQ ID NO: 151546 - DNA, 25 bp, Rattus norvegicus
aggtcaccatgctactgtgtcttca

SEQ ID NO: 151547 - DNA, 25 bp, Rattus norvegicus
aggtcaccatttagcacatctacta

SEQ ID NO: 151548 - DNA, 25 bp, Rattus norvegicus
aggtcaccattttgcacatctacta

SEQ ID NO: 151549 - DNA, 25 bp, Rattus norvegicus
aggtcacccagccagagctaggaga

SEQ ID NO: 151550 - DNA, 25 bp, Rattus norvegicus
aggtcacccagcgagagctaggaga

SEQ ID NO: 151551 - DNA, 25 bp, Rattus norvegicus
aggtcacccggaagtgtccacagtg

SEQ ID NO: 151552 - DNA, 25 bp, Rattus norvegicus
aggtcacccggatgtgtccacagtg

SEQ ID NO: 151553 - DNA, 25 bp, Rattus norvegicus
aggtcaccctctctggtgagcgcac

SEQ ID NO: 151554 - DNA, 25 bp, Rattus norvegicus
aggtcaccctctgtggtgagcgcac

SEQ ID NO: 151555 - DNA, 25 bp, Rattus norvegicus
aggtcaccctgaaagcttgttccat

SEQ ID NO: 151556 - DNA, 25 bp, Rattus norvegicus
aggtcaccctgatagcttgttccat

SEQ ID NO: 151557 - DNA, 25 bp, Rattus norvegicus
aggtcaccctgtaacaaatctattt

SEQ ID NO: 151558 - DNA, 25 bp, Rattus norvegicus
aggtcaccctgttacaaatctattt

SEQ ID NO: 151559 - DNA, 25 bp, Rattus norvegicus
aggtcacccttcaggagctgggctc

SEQ ID NO: 151560 - DNA, 25 bp, Rattus norvegicus
aggtcacccttctggagctgggctc

SEQ ID NO: 151561 - DNA, 25 bp, Rattus norvegicus
aggtcaccctttcaaagttttgatg

SEQ ID NO: 151562 - DNA, 25 bp, Rattus norvegicus
aggtcaccctttctcatgacaggat

SEQ ID NO: 151563 - DNA, 25 bp, Rattus norvegicus
aggtcaccctttgaaagttttgatg

SEQ ID NO: 151564 - DNA, 25 bp, Rattus norvegicus
aggtcaccctttgtcatgacaggat

SEQ ID NO: 151565 - DNA, 25 bp, Rattus norvegicus
aggtcaccgggtaagtcatcaagat

SEQ ID NO: 151566 - DNA, 25 bp, Rattus norvegicus
aggtcaccgggttagtcatcaagat

SEQ ID NO: 151567 - DNA, 25 bp, Rattus norvegicus
aggtcacctcacaagatactcagct

SEQ ID NO: 151568 - DNA, 25 bp, Rattus norvegicus
aggtcacctcactagatactcagct

SEQ ID NO: 151569 - DNA, 25 bp, Rattus norvegicus
aggtcacctcggagaggtccctccg

SEQ ID NO: 151570 - DNA, 25 bp, Rattus norvegicus
aggtcacctcggtgaggtccctccg

SEQ ID NO: 151571 - DNA, 25 bp, Rattus norvegicus
aggtcacctgcactggaatacacac

SEQ ID NO: 151572 - DNA, 25 bp, Rattus norvegicus
aggtcacctgcagtggaatacacac

SEQ ID NO: 151573 - DNA, 25 bp, Rattus norvegicus
aggtcacctgggaacttgtctgtac

SEQ ID NO: 151574 - DNA, 25 bp, Rattus norvegicus
aggtcacctgggtacttgtctgtac

SEQ ID NO: 151575 - DNA, 25 bp, Rattus norvegicus
aggtcaccttcaatgctgacgttca

SEQ ID NO: 151576 - DNA, 25 bp, Rattus norvegicus
aggtcaccttcattgctgacgttca

SEQ ID NO: 151577 - DNA, 25 bp, Rattus norvegicus
aggtcacctttgacatcgatgccaa

SEQ ID NO: 151578 - DNA, 25 bp, Rattus norvegicus
aggtcacctttgtcatcgatgccaa

SEQ ID NO: 151579 - DNA, 25 bp, Rattus norvegicus
aggtcacgggttatgaacctcagct

SEQ ID NO: 151580 - DNA, 25 bp, Rattus norvegicus
aggtcacgggttttgaacctcagct

SEQ ID NO: 151581 - DNA, 25 bp, Rattus norvegicus
aggtcacgtaccagcagatctgcaa

SEQ ID NO: 151582 - DNA, 25 bp, Rattus norvegicus
aggtcacgtacctgcagatctgcaa

SEQ ID NO: 151583 - DNA, 25 bp, Rattus norvegicus
aggtcacgtcacaaaaggtacacag

SEQ ID NO: 151584 - DNA, 25 bp, Rattus norvegicus
aggtcacgtcactaaaggtacacag

SEQ ID NO: 151585 - DNA, 25 bp, Rattus norvegicus
aggtcactacatccatgaactcagc

SEQ ID NO: 151586 - DNA, 25 bp, Rattus norvegicus
aggtcactacatgcatgaactcagc

SEQ ID NO: 151587 - DNA, 25 bp, Rattus norvegicus
aggtcactacctcagatgttattct

SEQ ID NO: 151588 - DNA, 25 bp, Rattus norvegicus
aggtcactacctgagatgttattct

SEQ ID NO: 151589 - DNA, 25 bp, Rattus norvegicus
aggtcactagttcaatcgatcccaa

SEQ ID NO: 151590 - DNA, 25 bp, Rattus norvegicus
aggtcactagttgaatcgatcccaa

SEQ ID NO: 151591 - DNA, 25 bp, Rattus norvegicus
aggtcactatggactcatcttggga

SEQ ID NO: 151592 - DNA, 25 bp, Rattus norvegicus
aggtcactatggtctcatcttggga

SEQ ID NO: 151593 - DNA, 25 bp, Rattus norvegicus
aggtcactcaatctactatgactgt

SEQ ID NO: 151594 - DNA, 25 bp, Rattus norvegicus
aggtcactcaatgtactatgactgt

SEQ ID NO: 151595 - DNA, 25 bp, Rattus norvegicus
aggtcactcagaaggaggcctcaga

SEQ ID NO: 151596 - DNA, 25 bp, Rattus norvegicus
aggtcactcagatggaggcctcaga

SEQ ID NO: 151597 - DNA, 25 bp, Rattus norvegicus
aggtcactcttcacacttgaactta

SEQ ID NO: 151598 - DNA, 25 bp, Rattus norvegicus
aggtcactcttctcacttgaactta

SEQ ID NO: 151599 - DNA, 25 bp, Rattus norvegicus
aggtcactgaacactaggccagcat

SEQ ID NO: 151600 - DNA, 25 bp, Rattus norvegicus
aggtcactgaactctaggccagcat

SEQ ID NO: 151601 - DNA, 25 bp, Rattus norvegicus
aggtcactgacccaagtgttgccaa

SEQ ID NO: 151602 - DNA, 25 bp, Rattus norvegicus
aggtcactgaccgaagtgttgccaa

SEQ ID NO: 151603 - DNA, 25 bp, Rattus norvegicus
aggtcactgacgattgcttatcttt

SEQ ID NO: 151604 - DNA, 25 bp, Rattus norvegicus
aggtcactgacgtttgcttatcttt

SEQ ID NO: 151605 - DNA, 25 bp, Rattus norvegicus
aggtcactgctcagttaagagttct

SEQ ID NO: 151606 - DNA, 25 bp, Rattus norvegicus
aggtcactgctctgttaagagttct

SEQ ID NO: 151607 - DNA, 25 bp, Rattus norvegicus
aggtcactggcaagactactgcacc

SEQ ID NO: 151608 - DNA, 25 bp, Rattus norvegicus
aggtcactggcatgactactgcacc

SEQ ID NO: 151609 - DNA, 25 bp, Rattus norvegicus
aggtcactgggcacattctagtttc

SEQ ID NO: 151610 - DNA, 25 bp, Rattus norvegicus
aggtcactgggctcattctagtttc

SEQ ID NO: 151611 - DNA, 25 bp, Rattus norvegicus
aggtcacttcctcaatccagatcag

SEQ ID NO: 151612 - DNA, 25 bp, Rattus norvegicus
aggtcacttcctgaatccagatcag

SEQ ID NO: 151613 - DNA, 25 bp, Rattus norvegicus
aggtcacttgtcaagaggctgcaaa

SEQ ID NO: 151614 - DNA, 25 bp, Rattus norvegicus
aggtcacttgtctagaggctgcaaa

SEQ ID NO: 151615 - DNA, 25 bp, Rattus norvegicus
aggtcacttgtgcagcactgtgcat

SEQ ID NO: 151616 - DNA, 25 bp, Rattus norvegicus
aggtcacttgtggagcactgtgcat

SEQ ID NO: 151617 - DNA, 25 bp, Rattus norvegicus
aggtcactttggcatacaaggtaag

SEQ ID NO: 151618 - DNA, 25 bp, Rattus norvegicus
aggtcactttgggatacaaggtaag

SEQ ID NO: 151619 - DNA, 25 bp, Rattus norvegicus
aggtcacttttacccttagctcctg

SEQ ID NO: 151620 - DNA, 25 bp, Rattus norvegicus
aggtcacttttagccttagctcctg

SEQ ID NO: 151621 - DNA, 25 bp, Rattus norvegicus
aggtcagaaatcaaatccccagtcc

SEQ ID NO: 151622 - DNA, 25 bp, Rattus norvegicus
aggtcagaaatctaatccccagtcc

SEQ ID NO: 151623 - DNA, 25 bp, Rattus norvegicus
aggtcagaactgacccgtgaagcaa

SEQ ID NO: 151624 - DNA, 25 bp, Rattus norvegicus
aggtcagaactgtcccgtgaagcaa

SEQ ID NO: 151625 - DNA, 25 bp, Rattus norvegicus
aggtcagaacttccagctccttggt

SEQ ID NO: 151626 - DNA, 25 bp, Rattus norvegicus
aggtcagaacttgcagctccttggt

SEQ ID NO: 151627 - DNA, 25 bp, Rattus norvegicus
aggtcagaagccagagtccttagct

SEQ ID NO: 151628 - DNA, 25 bp, Rattus norvegicus
aggtcagaagcctgagtccttagct

SEQ ID NO: 151629 - DNA, 25 bp, Rattus norvegicus
aggtcagaagtgcagagccctcctc

SEQ ID NO: 151630 - DNA, 25 bp, Rattus norvegicus
aggtcagaagtggagagccctcctc

SEQ ID NO: 151631 - DNA, 25 bp, Rattus norvegicus
aggtcagacagcatccgatgcagat

SEQ ID NO: 151632 - DNA, 25 bp, Rattus norvegicus
aggtcagacagcttccgatgcagat

SEQ ID NO: 151633 - DNA, 25 bp, Rattus norvegicus
aggtcagacagtagctcatagagcc

SEQ ID NO: 151634 - DNA, 25 bp, Rattus norvegicus
aggtcagacagttgctcatagagcc

SEQ ID NO: 151635 - DNA, 25 bp, Rattus norvegicus
aggtcagacatgaccagctttccgc

SEQ ID NO: 151636 - DNA, 25 bp, Rattus norvegicus
aggtcagacatgtccagctttccgc

SEQ ID NO: 151637 - DNA, 25 bp, Rattus norvegicus
aggtcagaccgcagcacatgtcgat

SEQ ID NO: 151638 - DNA, 25 bp, Rattus norvegicus
aggtcagaccgctgcacatgtcgat

SEQ ID NO: 151639 - DNA, 25 bp, Rattus norvegicus
aggtcagacgctagctctgggcacc

SEQ ID NO: 151640 - DNA, 25 bp, Rattus norvegicus
aggtcagacgcttgctctgggcacc

SEQ ID NO: 151641 - DNA, 25 bp, Rattus norvegicus
aggtcagagcttcccaagactggtc

SEQ ID NO: 151642 - DNA, 25 bp, Rattus norvegicus
aggtcagagcttgccaagactggtc

SEQ ID NO: 151643 - DNA, 25 bp, Rattus norvegicus
aggtcagatcatcacctgtagggtg

SEQ ID NO: 151644 - DNA, 25 bp, Rattus norvegicus
aggtcagatcatgacctgtagggtg

SEQ ID NO: 151645 - DNA, 25 bp, Rattus norvegicus
aggtcagattcactaacagtgccga

SEQ ID NO: 151646 - DNA, 25 bp, Rattus norvegicus
aggtcagattcagtaacagtgccga

SEQ ID NO: 151647 - DNA, 25 bp, Rattus norvegicus
aggtcagattgcatgggattcaggc

SEQ ID NO: 151648 - DNA, 25 bp, Rattus norvegicus
aggtcagattgcttgggattcaggc

SEQ ID NO: 151649 - DNA, 25 bp, Rattus norvegicus
aggtcagcaagaaagctcatccaat

SEQ ID NO: 151650 - DNA, 25 bp, Rattus norvegicus
aggtcagcaagatagctcatccaat

SEQ ID NO: 151651 - DNA, 25 bp, Rattus norvegicus
aggtcagcaagtatgtaggcagtct

SEQ ID NO: 151652 - DNA, 25 bp, Rattus norvegicus
aggtcagcaagtttgtaggcagtct

SEQ ID NO: 151653 - DNA, 25 bp, Rattus norvegicus
aggtcagcaggcacaagtggacagc

SEQ ID NO: 151654 - DNA, 25 bp, Rattus norvegicus
aggtcagcaggctcaagtggacagc

SEQ ID NO: 151655 - DNA, 25 bp, Rattus norvegicus
aggtcagcagttaggaccattgact

SEQ ID NO: 151656 - DNA, 25 bp, Rattus norvegicus
aggtcagcagtttggaccattgact

SEQ ID NO: 151657 - DNA, 25 bp, Rattus norvegicus
aggtcagcatgacaccagagcttgc

SEQ ID NO: 151658 - DNA, 25 bp, Rattus norvegicus
aggtcagcatgagaccagagcttgc

SEQ ID NO: 151659 - DNA, 25 bp, Rattus norvegicus
aggtcagcattgatcagcgcgctaa

SEQ ID NO: 151660 - DNA, 25 bp, Rattus norvegicus
aggtcagcattgttcagcgcgctaa

SEQ ID NO: 151661 - DNA, 25 bp, Rattus norvegicus
aggtcagcatttaacaccaatcatt

SEQ ID NO: 151662 - DNA, 25 bp, Rattus norvegicus
aggtcagcattttacaccaatcatt

SEQ ID NO: 151663 - DNA, 25 bp, Rattus norvegicus
aggtcagcccgacctacatgaaact

SEQ ID NO: 151664 - DNA, 25 bp, Rattus norvegicus
aggtcagcccgagctacatgaaact

SEQ ID NO: 151665 - DNA, 25 bp, Rattus norvegicus
aggtcagccgtacctcctggagaca

SEQ ID NO: 151666 - DNA, 25 bp, Rattus norvegicus
aggtcagccgtagctcctggagaca

SEQ ID NO: 151667 - DNA, 25 bp, Rattus norvegicus
aggtcagcctagattcacacacctt

SEQ ID NO: 151668 - DNA, 25 bp, Rattus norvegicus
aggtcagcctagtttcacacacctt

SEQ ID NO: 151669 - DNA, 25 bp, Rattus norvegicus
aggtcagcctgtccattgcggtcat

SEQ ID NO: 151670 - DNA, 25 bp, Rattus norvegicus
aggtcagcctgtgcattgcggtcat

SEQ ID NO: 151671 - DNA, 25 bp, Rattus norvegicus
aggtcagccttcagactcacagtgg

SEQ ID NO: 151672 - DNA, 25 bp, Rattus norvegicus
aggtcagccttctgactcacagtgg

SEQ ID NO: 151673 - DNA, 25 bp, Rattus norvegicus
aggtcagcgcaaacagcccactcag

SEQ ID NO: 151674 - DNA, 25 bp, Rattus norvegicus
aggtcagcgcaatcagcccactcag

SEQ ID NO: 151675 - DNA, 25 bp, Rattus norvegicus
aggtcagcgtggcaggatatcctcc

SEQ ID NO: 151676 - DNA, 25 bp, Rattus norvegicus
aggtcagcgtgggaggatatcctcc

SEQ ID NO: 151677 - DNA, 25 bp, Rattus norvegicus
aggtcagcgttgaacagcttgccgt

SEQ ID NO: 151678 - DNA, 25 bp, Rattus norvegicus
aggtcagcgttgtacagcttgccgt

SEQ ID NO: 151679 - DNA, 25 bp, Rattus norvegicus
aggtcagctaccctgaatgagccgt

SEQ ID NO: 151680 - DNA, 25 bp, Rattus norvegicus
aggtcagctaccgtgaatgagccgt

SEQ ID NO: 151681 - DNA, 25 bp, Rattus norvegicus
aggtcagctgacactggcaacacag

SEQ ID NO: 151682 - DNA, 25 bp, Rattus norvegicus
aggtcagctgactctggcaacacag

SEQ ID NO: 151683 - DNA, 25 bp, Rattus norvegicus
aggtcaggacccagtcatgagacag

SEQ ID NO: 151684 - DNA, 25 bp, Rattus norvegicus
aggtcaggaccctgtcatgagacag

SEQ ID NO: 151685 - DNA, 25 bp, Rattus norvegicus
aggtcaggagctactggattctgtt

SEQ ID NO: 151686 - DNA, 25 bp, Rattus norvegicus
aggtcaggagcttctggattctgtt

SEQ ID NO: 151687 - DNA, 25 bp, Rattus norvegicus
aggtcaggaggtccagacaaatcac

SEQ ID NO: 151688 - DNA, 25 bp, Rattus norvegicus
aggtcaggaggtgcagacaaatcac

SEQ ID NO: 151689 - DNA, 25 bp, Rattus norvegicus
aggtcaggatccatgtccagcagtt

SEQ ID NO: 151690 - DNA, 25 bp, Rattus norvegicus
aggtcaggatccttgtccagcagtt

SEQ ID NO: 151691 - DNA, 25 bp, Rattus norvegicus
aggtcaggccggcagatgcttcatc

SEQ ID NO: 151692 - DNA, 25 bp, Rattus norvegicus
aggtcaggccgggagatgcttcatc

SEQ ID NO: 151693 - DNA, 25 bp, Rattus norvegicus
aggtcaggctcaccaacacgttgag

SEQ ID NO: 151694 - DNA, 25 bp, Rattus norvegicus
aggtcaggctcagcaacacgttgag

SEQ ID NO: 151695 - DNA, 25 bp, Rattus norvegicus
aggtcaggctcccacataggaagca

SEQ ID NO: 151696 - DNA, 25 bp, Rattus norvegicus
aggtcaggctccgacataggaagca

SEQ ID NO: 151697 - DNA, 25 bp, Rattus norvegicus
aggtcagggaccaaatcctctattc

SEQ ID NO: 151698 - DNA, 25 bp, Rattus norvegicus
aggtcagggacctaatcctctattc

SEQ ID NO: 151699 - DNA, 25 bp, Rattus norvegicus
aggtcagggatgaacacagctcact

SEQ ID NO: 151700 - DNA, 25 bp, Rattus norvegicus
aggtcagggatgtacacagctcact

SEQ ID NO: 151701 - DNA, 25 bp, Rattus norvegicus
aggtcagggattcaggcccaccttc

SEQ ID NO: 151702 - DNA, 25 bp, Rattus norvegicus
aggtcagggattgaggcccaccttc

SEQ ID NO: 151703 - DNA, 25 bp, Rattus norvegicus
aggtcagtacctcttgccaagggta

SEQ ID NO: 151704 - DNA, 25 bp, Rattus norvegicus
aggtcagtacctgttgccaagggta

SEQ ID NO: 151705 - DNA, 25 bp, Rattus norvegicus
aggtcagtcatcaccctcctataag

SEQ ID NO: 151706 - DNA, 25 bp, Rattus norvegicus
aggtcagtcatcctcactcgcagcg

SEQ ID NO: 151707 - DNA, 25 bp, Rattus norvegicus
aggtcagtcatcgtcactcgcagcg

SEQ ID NO: 151708 - DNA, 25 bp, Rattus norvegicus
aggtcagtcatctccctcctataag

SEQ ID NO: 151709 - DNA, 25 bp, Rattus norvegicus
aggtcagtgacaactctcagagcgg

SEQ ID NO: 151710 - DNA, 25 bp, Rattus norvegicus
aggtcagtgacatctctcagagcgg

SEQ ID NO: 151711 - DNA, 25 bp, Rattus norvegicus
aggtcagtgacgacacatccgacat

SEQ ID NO: 151712 - DNA, 25 bp, Rattus norvegicus
aggtcagtgacgtcacatccgacat

SEQ ID NO: 151713 - DNA, 25 bp, Rattus norvegicus
aggtcagtgcccagcatgtcatcga

SEQ ID NO: 151714 - DNA, 25 bp, Rattus norvegicus
aggtcagtgccctgcatgtcatcga

SEQ ID NO: 151715 - DNA, 25 bp, Rattus norvegicus
aggtcagtgccgatgtgcccgatac

SEQ ID NO: 151716 - DNA, 25 bp, Rattus norvegicus
aggtcagtgccgttgtgcccgatac

SEQ ID NO: 151717 - DNA, 25 bp, Rattus norvegicus
aggtcagtgtccaccatgaagttag

SEQ ID NO: 151718 - DNA, 25 bp, Rattus norvegicus
aggtcagtgtcctccatgaagttag

SEQ ID NO: 151719 - DNA, 25 bp, Rattus norvegicus
aggtcagtgtctacgtcaaagtctt

SEQ ID NO: 151720 - DNA, 25 bp, Rattus norvegicus
aggtcagtgtctccgttcagttgaa

SEQ ID NO: 151721 - DNA, 25 bp, Rattus norvegicus
aggtcagtgtctgcgttcagttgaa

SEQ ID NO: 151722 - DNA, 25 bp, Rattus norvegicus
aggtcagtgtcttcgtcaaagtctt

SEQ ID NO: 151723 - DNA, 25 bp, Rattus norvegicus
aggtcagttgttccaagctacagaa

SEQ ID NO: 151724 - DNA, 25 bp, Rattus norvegicus
aggtcagttgttgcaagctacagaa

SEQ ID NO: 151725 - DNA, 25 bp, Rattus norvegicus
aggtcatacctacagcttctttgaa

SEQ ID NO: 151726 - DNA, 25 bp, Rattus norvegicus
aggtcatacctagagcttctttgaa

SEQ ID NO: 151727 - DNA, 25 bp, Rattus norvegicus
aggtcatactgtctgttgcttttgt

SEQ ID NO: 151728 - DNA, 25 bp, Rattus norvegicus
aggtcatactgtgtgttgcttttgt

SEQ ID NO: 151729 - DNA, 25 bp, Rattus norvegicus
aggtcatacttcagtctcttgaaca

SEQ ID NO: 151730 - DNA, 25 bp, Rattus norvegicus
aggtcatacttctgtctcttgaaca

SEQ ID NO: 151731 - DNA, 25 bp, Rattus norvegicus
aggtcataggttacgcctaccctgt

SEQ ID NO: 151732 - DNA, 25 bp, Rattus norvegicus
aggtcataggtttcgcctaccctgt

SEQ ID NO: 151733 - DNA, 25 bp, Rattus norvegicus
aggtcatagtgaatctcgagggcgt

SEQ ID NO: 151734 - DNA, 25 bp, Rattus norvegicus
aggtcatagtgattctcgagggcgt

SEQ ID NO: 151735 - DNA, 25 bp, Rattus norvegicus
aggtcatcaagacccgctgtcactg

SEQ ID NO: 151736 - DNA, 25 bp, Rattus norvegicus
aggtcatcaagagccgctgtcactg

SEQ ID NO: 151737 - DNA, 25 bp, Rattus norvegicus
aggtcatcaaggacttcccctggat

SEQ ID NO: 151738 - DNA, 25 bp, Rattus norvegicus
aggtcatcaaggtcttcccctggat

SEQ ID NO: 151739 - DNA, 25 bp, Rattus norvegicus
aggtcatcaagtcatttccagcttc

SEQ ID NO: 151740 - DNA, 25 bp, Rattus norvegicus
aggtcatcaagtgatttccagcttc

SEQ ID NO: 151741 - DNA, 25 bp, Rattus norvegicus
aggtcatcactacgcatagtacaca

SEQ ID NO: 151742 - DNA, 25 bp, Rattus norvegicus
aggtcatcactaggcatagtacaca

SEQ ID NO: 151743 - DNA, 25 bp, Rattus norvegicus
aggtcatccataattcatcggcgtc

SEQ ID NO: 151744 - DNA, 25 bp, Rattus norvegicus
aggtcatccatatttcatcggcgtc

SEQ ID NO: 151745 - DNA, 25 bp, Rattus norvegicus
aggtcatccatcattgcactgaagt

SEQ ID NO: 151746 - DNA, 25 bp, Rattus norvegicus
aggtcatccatctttgcactgaagt

SEQ ID NO: 151747 - DNA, 25 bp, Rattus norvegicus
aggtcatccatgaggttctcggcca

SEQ ID NO: 151748 - DNA, 25 bp, Rattus norvegicus
aggtcatccatgtggttctcggcca

SEQ ID NO: 151749 - DNA, 25 bp, Rattus norvegicus
aggtcatccctgataacgaatgcaa

SEQ ID NO: 151750 - DNA, 25 bp, Rattus norvegicus
aggtcatccctgttaacgaatgcaa

SEQ ID NO: 151751 - DNA, 25 bp, Rattus norvegicus
aggtcatcgtggctctgctaggttc

SEQ ID NO: 151752 - DNA, 25 bp, Rattus norvegicus
aggtcatcgtgggtctgctaggttc

SEQ ID NO: 151753 - DNA, 25 bp, Rattus norvegicus
aggtcatctctgatctaaaggccaa

SEQ ID NO: 151754 - DNA, 25 bp, Rattus norvegicus
aggtcatctctgttctaaaggccaa

SEQ ID NO: 151755 - DNA, 25 bp, Rattus norvegicus
aggtcatctcttctttggtcttcta

SEQ ID NO: 151756 - DNA, 25 bp, Rattus norvegicus
aggtcatctcttgtttggtcttcta

SEQ ID NO: 151757 - DNA, 25 bp, Rattus norvegicus
aggtcatctgtaagttgttctggta

SEQ ID NO: 151758 - DNA, 25 bp, Rattus norvegicus
aggtcatctgtatgttgttctggta

SEQ ID NO: 151759 - DNA, 25 bp, Rattus norvegicus
aggtcatcttcccttgaggacacgt

SEQ ID NO: 151760 - DNA, 25 bp, Rattus norvegicus
aggtcatcttccgttgaggacacgt

SEQ ID NO: 151761 - DNA, 25 bp, Rattus norvegicus
aggtcatgacccattttcctggagc

SEQ ID NO: 151762 - DNA, 25 bp, Rattus norvegicus
aggtcatgaccctttttcctggagc

SEQ ID NO: 151763 - DNA, 25 bp, Rattus norvegicus
aggtcatgacggcacttctctgata

SEQ ID NO: 151764 - DNA, 25 bp, Rattus norvegicus
aggtcatgacgggacttctctgata

SEQ ID NO: 151765 - DNA, 25 bp, Rattus norvegicus
aggtcatgaggcagccagcccctgg

SEQ ID NO: 151766 - DNA, 25 bp, Rattus norvegicus
aggtcatgaggctgccagcccctgg

SEQ ID NO: 151767 - DNA, 25 bp, Rattus norvegicus
aggtcatgcagccttgcagagccca

SEQ ID NO: 151768 - DNA, 25 bp, Rattus norvegicus
aggtcatgcagcgttgcagagccca

SEQ ID NO: 151769 - DNA, 25 bp, Rattus norvegicus
aggtcatgcctgatctttacttcta

SEQ ID NO: 151770 - DNA, 25 bp, Rattus norvegicus
aggtcatgcctgttctttacttcta

SEQ ID NO: 151771 - DNA, 25 bp, Rattus norvegicus
aggtcatgctcacgactggagcctc

SEQ ID NO: 151772 - DNA, 25 bp, Rattus norvegicus
aggtcatgctcaggactggagcctc

SEQ ID NO: 151773 - DNA, 25 bp, Rattus norvegicus
aggtcatggacacccgcatacatct

SEQ ID NO: 151774 - DNA, 25 bp, Rattus norvegicus
aggtcatggacagccgcatacatct

SEQ ID NO: 151775 - DNA, 25 bp, Rattus norvegicus
aggtcatgtaccacgatggctatga

SEQ ID NO: 151776 - DNA, 25 bp, Rattus norvegicus
aggtcatgtacctcgatggctatga

SEQ ID NO: 151777 - DNA, 25 bp, Rattus norvegicus
aggtcatgtataccttgtggaaatc

SEQ ID NO: 151778 - DNA, 25 bp, Rattus norvegicus
aggtcatgtatagcttgtggaaatc

SEQ ID NO: 151779 - DNA, 25 bp, Rattus norvegicus
aggtcatgtgacacctgctaagtgc

SEQ ID NO: 151780 - DNA, 25 bp, Rattus norvegicus
aggtcatgtgactcctgctaagtgc

SEQ ID NO: 151781 - DNA, 25 bp, Rattus norvegicus
aggtcatgttctcccatgtaggcct

SEQ ID NO: 151782 - DNA, 25 bp, Rattus norvegicus
aggtcatgttctgccatgtaggcct

SEQ ID NO: 151783 - DNA, 25 bp, Rattus norvegicus
aggtcatgtttccttcagtcagtga

SEQ ID NO: 151784 - DNA, 25 bp, Rattus norvegicus
aggtcatgtttcgttcagtcagtga

SEQ ID NO: 151785 - DNA, 25 bp, Rattus norvegicus
aggtcattaacccttggctatatgg

SEQ ID NO: 151786 - DNA, 25 bp, Rattus norvegicus
aggtcattaaccgttggctatatgg

SEQ ID NO: 151787 - DNA, 25 bp, Rattus norvegicus
aggtcattattcactgtacttaggg

SEQ ID NO: 151788 - DNA, 25 bp, Rattus norvegicus
aggtcattattctctgtacttaggg

SEQ ID NO: 151789 - DNA, 25 bp, Rattus norvegicus
aggtcattattgagcttccccttaa

SEQ ID NO: 151790 - DNA, 25 bp, Rattus norvegicus
aggtcattattgtgcttccccttaa

SEQ ID NO: 151791 - DNA, 25 bp, Rattus norvegicus
aggtcattcattactctgggctcta

SEQ ID NO: 151792 - DNA, 25 bp, Rattus norvegicus
aggtcattcatttctctgggctcta

SEQ ID NO: 151793 - DNA, 25 bp, Rattus norvegicus
aggtcattcctaccagttactgtaa

SEQ ID NO: 151794 - DNA, 25 bp, Rattus norvegicus
aggtcattcctagcagttactgtaa

SEQ ID NO: 151795 - DNA, 25 bp, Rattus norvegicus
aggtcattcctgagctaacactaaa

SEQ ID NO: 151796 - DNA, 25 bp, Rattus norvegicus
aggtcattcctgcatttgctgggcc

SEQ ID NO: 151797 - DNA, 25 bp, Rattus norvegicus
aggtcattcctggatttgctgggcc

SEQ ID NO: 151798 - DNA, 25 bp, Rattus norvegicus
aggtcattcctgtgctaacactaaa

SEQ ID NO: 151799 - DNA, 25 bp, Rattus norvegicus
aggtcattctagctgcagcaacatc

SEQ ID NO: 151800 - DNA, 25 bp, Rattus norvegicus
aggtcattctaggtgcagcaacatc

SEQ ID NO: 151801 - DNA, 25 bp, Rattus norvegicus
aggtcattcttactcgtgtgtggga

SEQ ID NO: 151802 - DNA, 25 bp, Rattus norvegicus
aggtcattcttagtcgtgtgtggga

SEQ ID NO: 151803 - DNA, 25 bp, Rattus norvegicus
aggtcattgaggctgctgctcactg

SEQ ID NO: 151804 - DNA, 25 bp, Rattus norvegicus
aggtcattgagggtgctgctcactg

SEQ ID NO: 151805 - DNA, 25 bp, Rattus norvegicus
aggtcattgcagagaagtcggctca

SEQ ID NO: 151806 - DNA, 25 bp, Rattus norvegicus
aggtcattgcagtgaagtcggctca

SEQ ID NO: 151807 - DNA, 25 bp, Rattus norvegicus
aggtcattgctcaccactctgggtg

SEQ ID NO: 151808 - DNA, 25 bp, Rattus norvegicus
aggtcattgctctccactctgggtg

SEQ ID NO: 151809 - DNA, 25 bp, Rattus norvegicus
aggtcattgctgagcgcatcggtga

SEQ ID NO: 151810 - DNA, 25 bp, Rattus norvegicus
aggtcattgctgtgcgcatcggtga

SEQ ID NO: 151811 - DNA, 25 bp, Rattus norvegicus
aggtcattggcacagtgtcttgtct

SEQ ID NO: 151812 - DNA, 25 bp, Rattus norvegicus
aggtcattggcagagtgtcttgtct

SEQ ID NO: 151813 - DNA, 25 bp, Rattus norvegicus
aggtcattgtgtctctcgtttgtac

SEQ ID NO: 151814 - DNA, 25 bp, Rattus norvegicus
aggtcattgtgtgtctcgtttgtac

SEQ ID NO: 151815 - DNA, 25 bp, Rattus norvegicus
aggtcatttcctctttttggtcaga

SEQ ID NO: 151816 - DNA, 25 bp, Rattus norvegicus
aggtcatttcctgtttttggtcaga

SEQ ID NO: 151817 - DNA, 25 bp, Rattus norvegicus
aggtcatttgctaatcgctttcaca

SEQ ID NO: 151818 - DNA, 25 bp, Rattus norvegicus
aggtcatttgcttatcgctttcaca

SEQ ID NO: 151819 - DNA, 25 bp, Rattus norvegicus
aggtcatttgtgctgggttcctcat

SEQ ID NO: 151820 - DNA, 25 bp, Rattus norvegicus
aggtcatttgtggtgggttcctcat

SEQ ID NO: 151821 - DNA, 25 bp, Rattus norvegicus
aggtccaacaacacataccagagag

SEQ ID NO: 151822 - DNA, 25 bp, Rattus norvegicus
aggtccaacaactcataccagagag

SEQ ID NO: 151823 - DNA, 25 bp, Rattus norvegicus
aggtccaagcgtagtccccagagag

SEQ ID NO: 151824 - DNA, 25 bp, Rattus norvegicus
aggtccaagcgttgtccccagagag

SEQ ID NO: 151825 - DNA, 25 bp, Rattus norvegicus
aggtccaaggcactacagcgatctg

SEQ ID NO: 151826 - DNA, 25 bp, Rattus norvegicus
aggtccaaggcagtacagcgatctg

SEQ ID NO: 151827 - DNA, 25 bp, Rattus norvegicus
aggtccaatacacgctccagtacag

SEQ ID NO: 151828 - DNA, 25 bp, Rattus norvegicus
aggtccaatacaggctccagtacag

SEQ ID NO: 151829 - DNA, 25 bp, Rattus norvegicus
aggtccaatcccatatcaacttata

SEQ ID NO: 151830 - DNA, 25 bp, Rattus norvegicus
aggtccaatcccttatcaacttata

SEQ ID NO: 151831 - DNA, 25 bp, Rattus norvegicus
aggtccaatgatccacttacttttg

SEQ ID NO: 151832 - DNA, 25 bp, Rattus norvegicus
aggtccaatgatgcacttacttttg

SEQ ID NO: 151833 - DNA, 25 bp, Rattus norvegicus
aggtccacaactagccttccagtca

SEQ ID NO: 151834 - DNA, 25 bp, Rattus norvegicus
aggtccacaacttgccttccagtca

SEQ ID NO: 151835 - DNA, 25 bp, Rattus norvegicus
aggtccacagacatgctgcagttga

SEQ ID NO: 151836 - DNA, 25 bp, Rattus norvegicus
aggtccacagacttgctgcagttga

SEQ ID NO: 151837 - DNA, 25 bp, Rattus norvegicus
aggtccacagagctcattctcaaca

SEQ ID NO: 151838 - DNA, 25 bp, Rattus norvegicus
aggtccacagaggtcattctcaaca

SEQ ID NO: 151839 - DNA, 25 bp, Rattus norvegicus
aggtccacattcacctgtgataatc

SEQ ID NO: 151840 - DNA, 25 bp, Rattus norvegicus
aggtccacattctcctgtgataatc

SEQ ID NO: 151841 - DNA, 25 bp, Rattus norvegicus
aggtccacgttgagggctccatcaa

SEQ ID NO: 151842 - DNA, 25 bp, Rattus norvegicus
aggtccacgttgagtccggtcttgg

SEQ ID NO: 151843 - DNA, 25 bp, Rattus norvegicus
aggtccacgttgtgggctccatcaa

SEQ ID NO: 151844 - DNA, 25 bp, Rattus norvegicus
aggtccacgttgtgtccggtcttgg

SEQ ID NO: 151845 - DNA, 25 bp, Rattus norvegicus
aggtccactcatcgctgtggctttc

SEQ ID NO: 151846 - DNA, 25 bp, Rattus norvegicus
aggtccactcatggctgtggctttc

SEQ ID NO: 151847 - DNA, 25 bp, Rattus norvegicus
aggtccagaactccctgaaaaggga

SEQ ID NO: 151848 - DNA, 25 bp, Rattus norvegicus
aggtccagaactgcctgaaaaggga

SEQ ID NO: 151849 - DNA, 25 bp, Rattus norvegicus
aggtccagagcccaatgacagactc

SEQ ID NO: 151850 - DNA, 25 bp, Rattus norvegicus
aggtccagagccgaatgacagactc

SEQ ID NO: 151851 - DNA, 25 bp, Rattus norvegicus
aggtccagcaccagctcaaaggaag

SEQ ID NO: 151852 - DNA, 25 bp, Rattus norvegicus
aggtccagcacctgctcaaaggaag

SEQ ID NO: 151853 - DNA, 25 bp, Rattus norvegicus
aggtccagcagcaacatttacacat

SEQ ID NO: 151854 - DNA, 25 bp, Rattus norvegicus
aggtccagcagctacatttacacat

SEQ ID NO: 151855 - DNA, 25 bp, Rattus norvegicus
aggtccagcctaatccctgaatacc

SEQ ID NO: 151856 - DNA, 25 bp, Rattus norvegicus
aggtccagcctattccctgaatacc

SEQ ID NO: 151857 - DNA, 25 bp, Rattus norvegicus
aggtccagctcaccttagcagtgac

SEQ ID NO: 151858 - DNA, 25 bp, Rattus norvegicus
aggtccagctcagcttagcagtgac

SEQ ID NO: 151859 - DNA, 25 bp, Rattus norvegicus
aggtccagctttcacgtggcaacag

SEQ ID NO: 151860 - DNA, 25 bp, Rattus norvegicus
aggtccagctttgacgtggcaacag

SEQ ID NO: 151861 - DNA, 25 bp, Rattus norvegicus
aggtccaggctcccgctatcaggga

SEQ ID NO: 151862 - DNA, 25 bp, Rattus norvegicus
aggtccaggctcgcgctatcaggga

SEQ ID NO: 151863 - DNA, 25 bp, Rattus norvegicus
aggtccaggtcaccctgttctacat

SEQ ID NO: 151864 - DNA, 25 bp, Rattus norvegicus
aggtccaggtcagcctgttctacat

SEQ ID NO: 151865 - DNA, 25 bp, Rattus norvegicus
aggtccagtcttaaatggttcatca

SEQ ID NO: 151866 - DNA, 25 bp, Rattus norvegicus
aggtccagtctttaatggttcatca

SEQ ID NO: 151867 - DNA, 25 bp, Rattus norvegicus
aggtccatatcccaggccgctggat

SEQ ID NO: 151868 - DNA, 25 bp, Rattus norvegicus
aggtccatatccgaggccgctggat

SEQ ID NO: 151869 - DNA, 25 bp, Rattus norvegicus
aggtccatccctactggaagaggct

SEQ ID NO: 151870 - DNA, 25 bp, Rattus norvegicus
aggtccatcccttctggaagaggct

SEQ ID NO: 151871 - DNA, 25 bp, Rattus norvegicus
aggtccatccgacccatgggagctc

SEQ ID NO: 151872 - DNA, 25 bp, Rattus norvegicus
aggtccatccgagccatgggagctc

SEQ ID NO: 151873 - DNA, 25 bp, Rattus norvegicus
aggtccatctggcagtggcttctac

SEQ ID NO: 151874 - DNA, 25 bp, Rattus norvegicus
aggtccatctgggagtggcttctac

SEQ ID NO: 151875 - DNA, 25 bp, Rattus norvegicus
aggtccatcttgagtagtcatctga

SEQ ID NO: 151876 - DNA, 25 bp, Rattus norvegicus
aggtccatcttgtgtagtcatctga

SEQ ID NO: 151877 - DNA, 25 bp, Rattus norvegicus
aggtccatgaaacgtctccagctca

SEQ ID NO: 151878 - DNA, 25 bp, Rattus norvegicus
aggtccatgaaaggtctccagctca

SEQ ID NO: 151879 - DNA, 25 bp, Rattus norvegicus
aggtccatgactacctgcggagtaa

SEQ ID NO: 151880 - DNA, 25 bp, Rattus norvegicus
aggtccatgacttcctgcggagtaa

SEQ ID NO: 151881 - DNA, 25 bp, Rattus norvegicus
aggtccatggcacggtgttcctcag

SEQ ID NO: 151882 - DNA, 25 bp, Rattus norvegicus
aggtccatggcagggtgttcctcag

SEQ ID NO: 151883 - DNA, 25 bp, Rattus norvegicus
aggtccatggctctgggtcgctgtg

SEQ ID NO: 151884 - DNA, 25 bp, Rattus norvegicus
aggtccatggctgtgggtcgctgtg

SEQ ID NO: 151885 - DNA, 25 bp, Rattus norvegicus
aggtccatgggcactttggtgaaca

SEQ ID NO: 151886 - DNA, 25 bp, Rattus norvegicus
aggtccatgggctctttggtgaaca

SEQ ID NO: 151887 - DNA, 25 bp, Rattus norvegicus
aggtccatttctaactcacttgtga

SEQ ID NO: 151888 - DNA, 25 bp, Rattus norvegicus
aggtccatttcttactcacttgtga

SEQ ID NO: 151889 - DNA, 25 bp, Rattus norvegicus
aggtccattttaatctcttcacaat

SEQ ID NO: 151890 - DNA, 25 bp, Rattus norvegicus
aggtccattttattctcttcacaat

SEQ ID NO: 151891 - DNA, 25 bp, Rattus norvegicus
aggtcccaactgaatgtctgccaac

SEQ ID NO: 151892 - DNA, 25 bp, Rattus norvegicus
aggtcccaactgtatgtctgccaac

SEQ ID NO: 151893 - DNA, 25 bp, Rattus norvegicus
aggtcccaatgccagtttgccactt

SEQ ID NO: 151894 - DNA, 25 bp, Rattus norvegicus
aggtcccaatgcgagtttgccactt

SEQ ID NO: 151895 - DNA, 25 bp, Rattus norvegicus
aggtcccacaagagcccacaatgga

SEQ ID NO: 151896 - DNA, 25 bp, Rattus norvegicus
aggtcccacaagtgcccacaatgga

SEQ ID NO: 151897 - DNA, 25 bp, Rattus norvegicus
aggtcccaccaacaggtgctcagag

SEQ ID NO: 151898 - DNA, 25 bp, Rattus norvegicus
aggtcccaccaagaggtgctcagag

SEQ ID NO: 151899 - DNA, 25 bp, Rattus norvegicus
aggtcccagggaacaggctctatgt

SEQ ID NO: 151900 - DNA, 25 bp, Rattus norvegicus
aggtcccagggatcaggctctatgt

SEQ ID NO: 151901 - DNA, 25 bp, Rattus norvegicus
aggtcccatctgaaacattgcatag

SEQ ID NO: 151902 - DNA, 25 bp, Rattus norvegicus
aggtcccatctgtaacattgcatag

SEQ ID NO: 151903 - DNA, 25 bp, Rattus norvegicus
aggtccccaagaccggcaagggcaa

SEQ ID NO: 151904 - DNA, 25 bp, Rattus norvegicus
aggtccccaagagcggcaagggcaa

SEQ ID NO: 151905 - DNA, 25 bp, Rattus norvegicus
aggtccccactgaggaggcgtgcat

SEQ ID NO: 151906 - DNA, 25 bp, Rattus norvegicus
aggtccccactgtggaggcgtgcat

SEQ ID NO: 151907 - DNA, 25 bp, Rattus norvegicus
aggtccccacttagtcaggcctgag

SEQ ID NO: 151908 - DNA, 25 bp, Rattus norvegicus
aggtccccactttgtcaggcctgag

SEQ ID NO: 151909 - DNA, 25 bp, Rattus norvegicus
aggtccccagaacatgacaagtatc

SEQ ID NO: 151910 - DNA, 25 bp, Rattus norvegicus
aggtccccagaagatgacaagtatc

SEQ ID NO: 151911 - DNA, 25 bp, Rattus norvegicus
aggtccccaggcatcaagcaaataa

SEQ ID NO: 151912 - DNA, 25 bp, Rattus norvegicus
aggtccccaggccagctagattctt

SEQ ID NO: 151913 - DNA, 25 bp, Rattus norvegicus
aggtccccaggcgagctagattctt

SEQ ID NO: 151914 - DNA, 25 bp, Rattus norvegicus
aggtccccaggcttcaagcaaataa

SEQ ID NO: 151915 - DNA, 25 bp, Rattus norvegicus
aggtccccggataacttgtacagag

SEQ ID NO: 151916 - DNA, 25 bp, Rattus norvegicus
aggtccccggattacttgtacagag

SEQ ID NO: 151917 - DNA, 25 bp, Rattus norvegicus
aggtccccgtagaccatgggctggt

SEQ ID NO: 151918 - DNA, 25 bp, Rattus norvegicus
aggtccccgtagtccatgggctggt

SEQ ID NO: 151919 - DNA, 25 bp, Rattus norvegicus
aggtcccctggtatgcggtggtcac

SEQ ID NO: 151920 - DNA, 25 bp, Rattus norvegicus
aggtcccctggtttgcggtggtcac

SEQ ID NO: 151921 - DNA, 25 bp, Rattus norvegicus
aggtcccctgtgctgatgggctatc

SEQ ID NO: 151922 - DNA, 25 bp, Rattus norvegicus
aggtcccctgtggtgatgggctatc

SEQ ID NO: 151923 - DNA, 25 bp, Rattus norvegicus
aggtccccttgaatgaggacttcac

SEQ ID NO: 151924 - DNA, 25 bp, Rattus norvegicus
aggtccccttgattgaggacttcac

SEQ ID NO: 151925 - DNA, 25 bp, Rattus norvegicus
aggtcccgagtcagcagctgctgct

SEQ ID NO: 151926 - DNA, 25 bp, Rattus norvegicus
aggtcccgagtctgcagctgctgct

SEQ ID NO: 151927 - DNA, 25 bp, Rattus norvegicus
aggtcccgcaagagccagtggagca

SEQ ID NO: 151928 - DNA, 25 bp, Rattus norvegicus
aggtcccgcaagtgccagtggagca

SEQ ID NO: 151929 - DNA, 25 bp, Rattus norvegicus
aggtcccgctgcaaactcggacgaa

SEQ ID NO: 151930 - DNA, 25 bp, Rattus norvegicus
aggtcccgctgcatggaagccacat

SEQ ID NO: 151931 - DNA, 25 bp, Rattus norvegicus
aggtcccgctgctaactcggacgaa

SEQ ID NO: 151932 - DNA, 25 bp, Rattus norvegicus
aggtcccgctgcttggaagccacat

SEQ ID NO: 151933 - DNA, 25 bp, Rattus norvegicus
aggtcccgctttaacgaacaccatg

SEQ ID NO: 151934 - DNA, 25 bp, Rattus norvegicus
aggtcccgcttttacgaacaccatg

SEQ ID NO: 151935 - DNA, 25 bp, Rattus norvegicus
aggtccctccccaaggttagatgag

SEQ ID NO: 151936 - DNA, 25 bp, Rattus norvegicus
aggtccctcccctaggttagatgag

SEQ ID NO: 151937 - DNA, 25 bp, Rattus norvegicus
aggtccctccttatgttgatctgaa

SEQ ID NO: 151938 - DNA, 25 bp, Rattus norvegicus
aggtccctccttttgttgatctgaa

SEQ ID NO: 151939 - DNA, 25 bp, Rattus norvegicus
aggtccctgaagatgtcacttgaaa

SEQ ID NO: 151940 - DNA, 25 bp, Rattus norvegicus
aggtccctgaagttgtcacttgaaa

SEQ ID NO: 151941 - DNA, 25 bp, Rattus norvegicus
aggtccctgcagaagcactttatct

SEQ ID NO: 151942 - DNA, 25 bp, Rattus norvegicus
aggtccctgcagtagcactttatct

SEQ ID NO: 151943 - DNA, 25 bp, Rattus norvegicus
aggtccctgcctatgaagatgtctt

SEQ ID NO: 151944 - DNA, 25 bp, Rattus norvegicus
aggtccctgcctattatactgcagg

SEQ ID NO: 151945 - DNA, 25 bp, Rattus norvegicus
aggtccctgcctttgaagatgtctt

SEQ ID NO: 151946 - DNA, 25 bp, Rattus norvegicus
aggtccctgccttttatactgcagg

SEQ ID NO: 151947 - DNA, 25 bp, Rattus norvegicus
aggtccctgcttatgcagattcttc

SEQ ID NO: 151948 - DNA, 25 bp, Rattus norvegicus
aggtccctgcttttgcagattcttc

SEQ ID NO: 151949 - DNA, 25 bp, Rattus norvegicus
aggtcccttcacagctgtgttgaac

SEQ ID NO: 151950 - DNA, 25 bp, Rattus norvegicus
aggtcccttcactgctgtgttgaac

SEQ ID NO: 151951 - DNA, 25 bp, Rattus norvegicus
aggtcccttcatatgtactctggag

SEQ ID NO: 151952 - DNA, 25 bp, Rattus norvegicus
aggtcccttcatttgtactctggag

SEQ ID NO: 151953 - DNA, 25 bp, Rattus norvegicus
aggtcccttcttaaactgtgactat

SEQ ID NO: 151954 - DNA, 25 bp, Rattus norvegicus
aggtcccttctttaactgtgactat

SEQ ID NO: 151955 - DNA, 25 bp, Rattus norvegicus
aggtccgaccctatttgtctgtgag

SEQ ID NO: 151956 - DNA, 25 bp, Rattus norvegicus
aggtccgaccctttttgtctgtgag

SEQ ID NO: 151957 - DNA, 25 bp, Rattus norvegicus
aggtccgagctgatcatttttatca

SEQ ID NO: 151958 - DNA, 25 bp, Rattus norvegicus
aggtccgagctgttcatttttatca

SEQ ID NO: 151959 - DNA, 25 bp, Rattus norvegicus
aggtccgatttgagcctgataacaa

SEQ ID NO: 151960 - DNA, 25 bp, Rattus norvegicus
aggtccgatttgtgcctgataacaa

SEQ ID NO: 151961 - DNA, 25 bp, Rattus norvegicus
aggtccgcacagatcgagcacacag

SEQ ID NO: 151962 - DNA, 25 bp, Rattus norvegicus
aggtccgcacagttcgagcacacag

SEQ ID NO: 151963 - DNA, 25 bp, Rattus norvegicus
aggtccgcatcaaccctgtggagtt

SEQ ID NO: 151964 - DNA, 25 bp, Rattus norvegicus
aggtccgcatcatccctgtggagtt

SEQ ID NO: 151965 - DNA, 25 bp, Rattus norvegicus
aggtccgccgccatcttatggtggg

SEQ ID NO: 151966 - DNA, 25 bp, Rattus norvegicus
aggtccgccgccttcttatggtggg

SEQ ID NO: 151967 - DNA, 25 bp, Rattus norvegicus
aggtccgcgtgcacttttgcatttg

SEQ ID NO: 151968 - DNA, 25 bp, Rattus norvegicus
aggtccgcgtgctcttttgcatttg

SEQ ID NO: 151969 - DNA, 25 bp, Rattus norvegicus
aggtccgctaggatccgagctacca

SEQ ID NO: 151970 - DNA, 25 bp, Rattus norvegicus
aggtccgctaggttccgagctacca

SEQ ID NO: 151971 - DNA, 25 bp, Rattus norvegicus
aggtccgctccgctatccggaagag

SEQ ID NO: 151972 - DNA, 25 bp, Rattus norvegicus
aggtccgctccggtatccggaagag

SEQ ID NO: 151973 - DNA, 25 bp, Rattus norvegicus
aggtccgctcgaccgccaagcccgg

SEQ ID NO: 151974 - DNA, 25 bp, Rattus norvegicus
aggtccgctcgagcgccaagcccgg

SEQ ID NO: 151975 - DNA, 25 bp, Rattus norvegicus
aggtccgctgtaccaggtacctcta

SEQ ID NO: 151976 - DNA, 25 bp, Rattus norvegicus
aggtccgctgtagcaggtacctcta

SEQ ID NO: 151977 - DNA, 25 bp, Rattus norvegicus
aggtccggctgaccactctggagaa

SEQ ID NO: 151978 - DNA, 25 bp, Rattus norvegicus
aggtccggctgagcactctggagaa

SEQ ID NO: 151979 - DNA, 25 bp, Rattus norvegicus
aggtccgttgtcctcataggtagag

SEQ ID NO: 151980 - DNA, 25 bp, Rattus norvegicus
aggtccgttgtcgtcataggtagag

SEQ ID NO: 151981 - DNA, 25 bp, Rattus norvegicus
aggtcctaagtcctgaaggctctga

SEQ ID NO: 151982 - DNA, 25 bp, Rattus norvegicus
aggtcctaagtcgtgaaggctctga

SEQ ID NO: 151983 - DNA, 25 bp, Rattus norvegicus
aggtcctacctgctttgagttcctg

SEQ ID NO: 151984 - DNA, 25 bp, Rattus norvegicus
aggtcctacctggtttgagttcctg

SEQ ID NO: 151985 - DNA, 25 bp, Rattus norvegicus
aggtcctaccttacaatatcaaaat

SEQ ID NO: 151986 - DNA, 25 bp, Rattus norvegicus
aggtcctacctttcaatatcaaaat

SEQ ID NO: 151987 - DNA, 25 bp, Rattus norvegicus
aggtcctagaatcctaccgtttcct

SEQ ID NO: 151988 - DNA, 25 bp, Rattus norvegicus
aggtcctagaatgctaccgtttcct

SEQ ID NO: 151989 - DNA, 25 bp, Rattus norvegicus
aggtcctatggaagaacggcaataa

SEQ ID NO: 151990 - DNA, 25 bp, Rattus norvegicus
aggtcctatggatgaacggcaataa

SEQ ID NO: 151991 - DNA, 25 bp, Rattus norvegicus
aggtcctattccacctgaatgagag

SEQ ID NO: 151992 - DNA, 25 bp, Rattus norvegicus
aggtcctattcctcctgaatgagag

SEQ ID NO: 151993 - DNA, 25 bp, Rattus norvegicus
aggtcctcaatgatgatgtctgtat

SEQ ID NO: 151994 - DNA, 25 bp, Rattus norvegicus
aggtcctcaatgttgatgtctgtat

SEQ ID NO: 151995 - DNA, 25 bp, Rattus norvegicus
aggtcctcacaaaactaacacactc

SEQ ID NO: 151996 - DNA, 25 bp, Rattus norvegicus
aggtcctcacaatactaacacactc

SEQ ID NO: 151997 - DNA, 25 bp, Rattus norvegicus
aggtcctcacagatctggtagtcag

SEQ ID NO: 151998 - DNA, 25 bp, Rattus norvegicus
aggtcctcacagttctggtagtcag

SEQ ID NO: 151999 - DNA, 25 bp, Rattus norvegicus
aggtcctcacctatatcaagttctt

SEQ ID NO: 152000 - DNA, 25 bp, Rattus norvegicus
aggtcctcacctatgtgcaagagta

SEQ ID NO: 152001 - DNA, 25 bp, Rattus norvegicus
aggtcctcacctttatcaagttctt

SEQ ID NO: 152002 - DNA, 25 bp, Rattus norvegicus
aggtcctcacctttgtgcaagagta

SEQ ID NO: 152003 - DNA, 25 bp, Rattus norvegicus
aggtcctcactgagtccaaagtctt

SEQ ID NO: 152004 - DNA, 25 bp, Rattus norvegicus
aggtcctcactgtgtccaaagtctt

SEQ ID NO: 152005 - DNA, 25 bp, Rattus norvegicus
aggtcctcagctatgtcgagacaaa

SEQ ID NO: 152006 - DNA, 25 bp, Rattus norvegicus
aggtcctcagctttgtcgagacaaa

SEQ ID NO: 152007 - DNA, 25 bp, Rattus norvegicus
aggtcctcaggtcgccagatttgga

SEQ ID NO: 152008 - DNA, 25 bp, Rattus norvegicus
aggtcctcaggtggccagatttgga

SEQ ID NO: 152009 - DNA, 25 bp, Rattus norvegicus
aggtcctcattcagcctctttatgt

SEQ ID NO: 152010 - DNA, 25 bp, Rattus norvegicus
aggtcctcattctgcctctttatgt

SEQ ID NO: 152011 - DNA, 25 bp, Rattus norvegicus
aggtcctccaaaagggcagccagtg

SEQ ID NO: 152012 - DNA, 25 bp, Rattus norvegicus
aggtcctccaaatgggcagccagtg

SEQ ID NO: 152013 - DNA, 25 bp, Rattus norvegicus
aggtcctccctaagatgacatcaca

SEQ ID NO: 152014 - DNA, 25 bp, Rattus norvegicus
aggtcctccctactcatttgtttgc

SEQ ID NO: 152015 - DNA, 25 bp, Rattus norvegicus
aggtcctccctagtcatttgtttgc

SEQ ID NO: 152016 - DNA, 25 bp, Rattus norvegicus
aggtcctccctatgatgacatcaca

SEQ ID NO: 152017 - DNA, 25 bp, Rattus norvegicus
aggtcctcctctaacagtggagagt

SEQ ID NO: 152018 - DNA, 25 bp, Rattus norvegicus
aggtcctcctcttacagtggagagt

SEQ ID NO: 152019 - DNA, 25 bp, Rattus norvegicus
aggtcctcctgaagactctgggaga

SEQ ID NO: 152020 - DNA, 25 bp, Rattus norvegicus
aggtcctcctgatgactctgggaga

SEQ ID NO: 152021 - DNA, 25 bp, Rattus norvegicus
aggtcctcggagagcttcagttcaa

SEQ ID NO: 152022 - DNA, 25 bp, Rattus norvegicus
aggtcctcggagtgcttcagttcaa

SEQ ID NO: 152023 - DNA, 25 bp, Rattus norvegicus
aggtcctcgtcgagctagccaaagg

SEQ ID NO: 152024 - DNA, 25 bp, Rattus norvegicus
aggtcctcgtcgtgctagccaaagg

SEQ ID NO: 152025 - DNA, 25 bp, Rattus norvegicus
aggtcctctcggatttgcatgagaa

SEQ ID NO: 152026 - DNA, 25 bp, Rattus norvegicus
aggtcctctcggttttgcatgagaa

SEQ ID NO: 152027 - DNA, 25 bp, Rattus norvegicus
aggtcctctctaaggtaagccctat

SEQ ID NO: 152028 - DNA, 25 bp, Rattus norvegicus
aggtcctctctatggtaagccctat

SEQ ID NO: 152029 - DNA, 25 bp, Rattus norvegicus
aggtcctctctgaatagcctgcaaa

SEQ ID NO: 152030 - DNA, 25 bp, Rattus norvegicus
aggtcctctctgtatagcctgcaaa

SEQ ID NO: 152031 - DNA, 25 bp, Rattus norvegicus
aggtcctctgcgctttctaatggat

SEQ ID NO: 152032 - DNA, 25 bp, Rattus norvegicus
aggtcctctgcggtttctaatggat

SEQ ID NO: 152033 - DNA, 25 bp, Rattus norvegicus
aggtcctctgggagtgaagctgttc

SEQ ID NO: 152034 - DNA, 25 bp, Rattus norvegicus
aggtcctctgggtgtgaagctgttc

SEQ ID NO: 152035 - DNA, 25 bp, Rattus norvegicus
aggtcctcttaaatgtggctgcttt

SEQ ID NO: 152036 - DNA, 25 bp, Rattus norvegicus
aggtcctcttaattgtggctgcttt

SEQ ID NO: 152037 - DNA, 25 bp, Rattus norvegicus
aggtcctcttcaacaacttagcaag

SEQ ID NO: 152038 - DNA, 25 bp, Rattus norvegicus
aggtcctcttcatcaacttagcaag

SEQ ID NO: 152039 - DNA, 25 bp, Rattus norvegicus
aggtcctcttctactggacggatga

SEQ ID NO: 152040 - DNA, 25 bp, Rattus norvegicus
aggtcctcttctcagtttcgtttca

SEQ ID NO: 152041 - DNA, 25 bp, Rattus norvegicus
aggtcctcttctgagtttcgtttca

SEQ ID NO: 152042 - DNA, 25 bp, Rattus norvegicus
aggtcctcttcttctggacggatga

SEQ ID NO: 152043 - DNA, 25 bp, Rattus norvegicus
aggtcctgaaaacctctggagagga

SEQ ID NO: 152044 - DNA, 25 bp, Rattus norvegicus
aggtcctgaaaagctctggagagga

SEQ ID NO: 152045 - DNA, 25 bp, Rattus norvegicus
aggtcctgaaatatcctcttggatt

SEQ ID NO: 152046 - DNA, 25 bp, Rattus norvegicus
aggtcctgaaatttcctcttggatt

SEQ ID NO: 152047 - DNA, 25 bp, Rattus norvegicus
aggtcctgaagcctcagcctcatct

SEQ ID NO: 152048 - DNA, 25 bp, Rattus norvegicus
aggtcctgaagcgtcagcctcatct

SEQ ID NO: 152049 - DNA, 25 bp, Rattus norvegicus
aggtcctgaatgaactttcccactt

SEQ ID NO: 152050 - DNA, 25 bp, Rattus norvegicus
aggtcctgaatgtactttcccactt

SEQ ID NO: 152051 - DNA, 25 bp, Rattus norvegicus
aggtcctgacagctcttggcccttg

SEQ ID NO: 152052 - DNA, 25 bp, Rattus norvegicus
aggtcctgacaggtcttggcccttg

SEQ ID NO: 152053 - DNA, 25 bp, Rattus norvegicus
aggtcctgagcaacggcagttcacg

SEQ ID NO: 152054 - DNA, 25 bp, Rattus norvegicus
aggtcctgagcatcggcagttcacg

SEQ ID NO: 152055 - DNA, 25 bp, Rattus norvegicus
aggtcctgagtaagacttctggtca

SEQ ID NO: 152056 - DNA, 25 bp, Rattus norvegicus
aggtcctgagtatgacttctggtca

SEQ ID NO: 152057 - DNA, 25 bp, Rattus norvegicus
aggtcctgatgtatgccaccccaga

SEQ ID NO: 152058 - DNA, 25 bp, Rattus norvegicus
aggtcctgatgtttgccaccccaga

SEQ ID NO: 152059 - DNA, 25 bp, Rattus norvegicus
aggtcctgcagaacaatcggcggct

SEQ ID NO: 152060 - DNA, 25 bp, Rattus norvegicus
aggtcctgcagacgcttggctttag

SEQ ID NO: 152061 - DNA, 25 bp, Rattus norvegicus
aggtcctgcagaggcttggctttag

SEQ ID NO: 152062 - DNA, 25 bp, Rattus norvegicus
aggtcctgcagatcaatcggcggct

SEQ ID NO: 152063 - DNA, 25 bp, Rattus norvegicus
aggtcctgcagccaagcctggagca

SEQ ID NO: 152064 - DNA, 25 bp, Rattus norvegicus
aggtcctgcagcgaagcctggagca

SEQ ID NO: 152065 - DNA, 25 bp, Rattus norvegicus
aggtcctgccggctaaactctgagg

SEQ ID NO: 152066 - DNA, 25 bp, Rattus norvegicus
aggtcctgccgggtaaactctgagg

SEQ ID NO: 152067 - DNA, 25 bp, Rattus norvegicus
aggtcctgcgcaccaagaactaagg

SEQ ID NO: 152068 - DNA, 25 bp, Rattus norvegicus
aggtcctgcgcagcaagaactaagg

SEQ ID NO: 152069 - DNA, 25 bp, Rattus norvegicus
aggtcctgcttcaggtgatgtctct

SEQ ID NO: 152070 - DNA, 25 bp, Rattus norvegicus
aggtcctgcttctggtgatgtctct

SEQ ID NO: 152071 - DNA, 25 bp, Rattus norvegicus
aggtcctggcagcatatctgctcct

SEQ ID NO: 152072 - DNA, 25 bp, Rattus norvegicus
aggtcctggcaggatatctgctcct

SEQ ID NO: 152073 - DNA, 25 bp, Rattus norvegicus
aggtcctggcttagctggccacgga

SEQ ID NO: 152074 - DNA, 25 bp, Rattus norvegicus
aggtcctggctttgctggccacgga

SEQ ID NO: 152075 - DNA, 25 bp, Rattus norvegicus
aggtcctgggccagtcttgttaggc

SEQ ID NO: 152076 - DNA, 25 bp, Rattus norvegicus
aggtcctgggcctgtcttgttaggc

SEQ ID NO: 152077 - DNA, 25 bp, Rattus norvegicus
aggtcctgggttcagactcctgcac

SEQ ID NO: 152078 - DNA, 25 bp, Rattus norvegicus
aggtcctgggttgagactcctgcac

SEQ ID NO: 152079 - DNA, 25 bp, Rattus norvegicus
aggtcctgtaggacttcgactctat

SEQ ID NO: 152080 - DNA, 25 bp, Rattus norvegicus
aggtcctgtaggtcttcgactctat

SEQ ID NO: 152081 - DNA, 25 bp, Rattus norvegicus
aggtcctgtgctctgtctgtactca

SEQ ID NO: 152082 - DNA, 25 bp, Rattus norvegicus
aggtcctgtgctgtgtctgtactca

SEQ ID NO: 152083 - DNA, 25 bp, Rattus norvegicus
aggtcctgttgactggcgtctttct

SEQ ID NO: 152084 - DNA, 25 bp, Rattus norvegicus
aggtcctgttgagtggcgtctttct

SEQ ID NO: 152085 - DNA, 25 bp, Rattus norvegicus
aggtccttcaccactgtgtacttta

SEQ ID NO: 152086 - DNA, 25 bp, Rattus norvegicus
aggtccttcacctctgtgtacttta

SEQ ID NO: 152087 - DNA, 25 bp, Rattus norvegicus
aggtccttcactaccttgagtatta

SEQ ID NO: 152088 - DNA, 25 bp, Rattus norvegicus
aggtccttcacttccttgagtatta

SEQ ID NO: 152089 - DNA, 25 bp, Rattus norvegicus
aggtccttccccagaaatgcagctg

SEQ ID NO: 152090 - DNA, 25 bp, Rattus norvegicus
aggtccttcccctgaaatgcagctg

SEQ ID NO: 152091 - DNA, 25 bp, Rattus norvegicus
aggtccttgaccaggtgcttaccag

SEQ ID NO: 152092 - DNA, 25 bp, Rattus norvegicus
aggtccttgacctggtgcttaccag

SEQ ID NO: 152093 - DNA, 25 bp, Rattus norvegicus
aggtccttgctcacacaagtaagca

SEQ ID NO: 152094 - DNA, 25 bp, Rattus norvegicus
aggtccttgctctcacaagtaagca

SEQ ID NO: 152095 - DNA, 25 bp, Rattus norvegicus
aggtccttgtctatgtatgttctgt

SEQ ID NO: 152096 - DNA, 25 bp, Rattus norvegicus
aggtccttgtctttgtatgttctgt

SEQ ID NO: 152097 - DNA, 25 bp, Rattus norvegicus
aggtcctttactcgcatccaattga

SEQ ID NO: 152098 - DNA, 25 bp, Rattus norvegicus
aggtcctttactggcatccaattga

SEQ ID NO: 152099 - DNA, 25 bp, Rattus norvegicus
aggtcctttctacatctcttttaag

SEQ ID NO: 152100 - DNA, 25 bp, Rattus norvegicus
aggtcctttctagatctcttttaag

SEQ ID NO: 152101 - DNA, 25 bp, Rattus norvegicus
aggtcctttgacataaactaactga

SEQ ID NO: 152102 - DNA, 25 bp, Rattus norvegicus
aggtcctttgacttaaactaactga

SEQ ID NO: 152103 - DNA, 25 bp, Rattus norvegicus
aggtcctttggaacatagccgggca

SEQ ID NO: 152104 - DNA, 25 bp, Rattus norvegicus
aggtcctttggatcatagccgggca

SEQ ID NO: 152105 - DNA, 25 bp, Rattus norvegicus
aggtccttttcaacctgagagggtc

SEQ ID NO: 152106 - DNA, 25 bp, Rattus norvegicus
aggtccttttcatcctgagagggtc

SEQ ID NO: 152107 - DNA, 25 bp, Rattus norvegicus
aggtcgaagtccaccaccagaatct

SEQ ID NO: 152108 - DNA, 25 bp, Rattus norvegicus
aggtcgaagtcctccaccagaatct

SEQ ID NO: 152109 - DNA, 25 bp, Rattus norvegicus
aggtcgaccataaggaagagctccc

SEQ ID NO: 152110 - DNA, 25 bp, Rattus norvegicus
aggtcgaccatatggaagagctccc

SEQ ID NO: 152111 - DNA, 25 bp, Rattus norvegicus
aggtcgagcgacactctcaagatta

SEQ ID NO: 152112 - DNA, 25 bp, Rattus norvegicus
aggtcgagcgactctctcaagatta

SEQ ID NO: 152113 - DNA, 25 bp, Rattus norvegicus
aggtcgagtctcattctttacttca

SEQ ID NO: 152114 - DNA, 25 bp, Rattus norvegicus
aggtcgagtctctttctttacttca

SEQ ID NO: 152115 - DNA, 25 bp, Rattus norvegicus
aggtcgatgggcatcacatcatctc

SEQ ID NO: 152116 - DNA, 25 bp, Rattus norvegicus
aggtcgatgggcttcacatcatctc

SEQ ID NO: 152117 - DNA, 25 bp, Rattus norvegicus
aggtcgatttaactagaagtgcgtt

SEQ ID NO: 152118 - DNA, 25 bp, Rattus norvegicus
aggtcgatttaagtagaagtgcgtt

SEQ ID NO: 152119 - DNA, 25 bp, Rattus norvegicus
aggtcgcacgcgagaggtctgtcca

SEQ ID NO: 152120 - DNA, 25 bp, Rattus norvegicus
aggtcgcacgcgtgaggtctgtcca

SEQ ID NO: 152121 - DNA, 25 bp, Rattus norvegicus
aggtcgcatgatacccaccgtggca

SEQ ID NO: 152122 - DNA, 25 bp, Rattus norvegicus
aggtcgcatgattcccaccgtggca

SEQ ID NO: 152123 - DNA, 25 bp, Rattus norvegicus
aggtcgccatgacccctgacaatgc

SEQ ID NO: 152124 - DNA, 25 bp, Rattus norvegicus
aggtcgccatgagccctgacaatgc

SEQ ID NO: 152125 - DNA, 25 bp, Rattus norvegicus
aggtcgccatgcaagtagacggtga

SEQ ID NO: 152126 - DNA, 25 bp, Rattus norvegicus
aggtcgccatgctagtagacggtga

SEQ ID NO: 152127 - DNA, 25 bp, Rattus norvegicus
aggtcgccggcgaaagccacagaca

SEQ ID NO: 152128 - DNA, 25 bp, Rattus norvegicus
aggtcgccggcgtaagccacagaca

SEQ ID NO: 152129 - DNA, 25 bp, Rattus norvegicus
aggtcgcgcatcagggcacgcagct

SEQ ID NO: 152130 - DNA, 25 bp, Rattus norvegicus
aggtcgcgcatctgggcacgcagct

SEQ ID NO: 152131 - DNA, 25 bp, Rattus norvegicus
aggtcgctatgcatttcaaatctgg

SEQ ID NO: 152132 - DNA, 25 bp, Rattus norvegicus
aggtcgctatgcttttcaaatctgg

SEQ ID NO: 152133 - DNA, 25 bp, Rattus norvegicus
aggtcgctttgtattcacgtttgtc

SEQ ID NO: 152134 - DNA, 25 bp, Rattus norvegicus
aggtcgctttgttttcacgtttgtc

SEQ ID NO: 152135 - DNA, 25 bp, Rattus norvegicus
aggtcggaagtcacctcagttgctg

SEQ ID NO: 152136 - DNA, 25 bp, Rattus norvegicus
aggtcggaagtctcctcagttgctg

SEQ ID NO: 152137 - DNA, 25 bp, Rattus norvegicus
aggtcggatctgctcaggctgtctc

SEQ ID NO: 152138 - DNA, 25 bp, Rattus norvegicus
aggtcggatctggtcaggctgtctc

SEQ ID NO: 152139 - DNA, 25 bp, Rattus norvegicus
aggtcggcttgcagaatggcactct

SEQ ID NO: 152140 - DNA, 25 bp, Rattus norvegicus
aggtcggcttgcagattgctgatgc

SEQ ID NO: 152141 - DNA, 25 bp, Rattus norvegicus
aggtcggcttgctgaatggcactct

SEQ ID NO: 152142 - DNA, 25 bp, Rattus norvegicus
aggtcggcttgctgattgctgatgc

SEQ ID NO: 152143 - DNA, 25 bp, Rattus norvegicus
aggtcgggactgctgttgactccat

SEQ ID NO: 152144 - DNA, 25 bp, Rattus norvegicus
aggtcgggactggtgttgactccat

SEQ ID NO: 152145 - DNA, 25 bp, Rattus norvegicus
aggtcggtacatcgtctttcatcag

SEQ ID NO: 152146 - DNA, 25 bp, Rattus norvegicus
aggtcggtacatggtctttcatcag

SEQ ID NO: 152147 - DNA, 25 bp, Rattus norvegicus
aggtcggtctctaaggcttgagcat

SEQ ID NO: 152148 - DNA, 25 bp, Rattus norvegicus
aggtcggtctcttaggcttgagcat

SEQ ID NO: 152149 - DNA, 25 bp, Rattus norvegicus
aggtcggttagtcggctctgtacca

SEQ ID NO: 152150 - DNA, 25 bp, Rattus norvegicus
aggtcggttagtgggctctgtacca

SEQ ID NO: 152151 - DNA, 25 bp, Rattus norvegicus
aggtcggttcttctgctggtgaatc

SEQ ID NO: 152152 - DNA, 25 bp, Rattus norvegicus
aggtcggttcttgtgctggtgaatc

SEQ ID NO: 152153 - DNA, 25 bp, Rattus norvegicus
aggtcgtacaacagtcagtgcttga

SEQ ID NO: 152154 - DNA, 25 bp, Rattus norvegicus
aggtcgtacaactgtcagtgcttga

SEQ ID NO: 152155 - DNA, 25 bp, Rattus norvegicus
aggtcgtacggccacaggaatctcg

SEQ ID NO: 152156 - DNA, 25 bp, Rattus norvegicus
aggtcgtacggcgacaggaatctcg

SEQ ID NO: 152157 - DNA, 25 bp, Rattus norvegicus
aggtcgtcatggacagacttgtctt

SEQ ID NO: 152158 - DNA, 25 bp, Rattus norvegicus
aggtcgtcatggtcagacttgtctt

SEQ ID NO: 152159 - DNA, 25 bp, Rattus norvegicus
aggtcgtcctagaaagcactcgcaa

SEQ ID NO: 152160 - DNA, 25 bp, Rattus norvegicus
aggtcgtcctagtaagcactcgcaa

SEQ ID NO: 152161 - DNA, 25 bp, Rattus norvegicus
aggtcgtctaagaggcatccgggaa

SEQ ID NO: 152162 - DNA, 25 bp, Rattus norvegicus
aggtcgtctaagtggcatccgggaa

SEQ ID NO: 152163 - DNA, 25 bp, Rattus norvegicus
aggtcgtctctacctacacaaggga

SEQ ID NO: 152164 - DNA, 25 bp, Rattus norvegicus
aggtcgtctctagctacacaaggga

SEQ ID NO: 152165 - DNA, 25 bp, Rattus norvegicus
aggtcgtctgcccaagttctgggaa

SEQ ID NO: 152166 - DNA, 25 bp, Rattus norvegicus
aggtcgtctgccgaagttctgggaa

SEQ ID NO: 152167 - DNA, 25 bp, Rattus norvegicus
aggtcgtgctgtacgtatcctcaga

SEQ ID NO: 152168 - DNA, 25 bp, Rattus norvegicus
aggtcgtgctgttcgtatcctcaga

SEQ ID NO: 152169 - DNA, 25 bp, Rattus norvegicus
aggtcgtgtaccagaacacctgtct

SEQ ID NO: 152170 - DNA, 25 bp, Rattus norvegicus
aggtcgtgtacctgaacacctgtct

SEQ ID NO: 152171 - DNA, 25 bp, Rattus norvegicus
aggtcgttggtcatctcacatcaca

SEQ ID NO: 152172 - DNA, 25 bp, Rattus norvegicus
aggtcgttggtcttctcacatcaca

SEQ ID NO: 152173 - DNA, 25 bp, Rattus norvegicus
aggtcgttgttcaaagctctctctg

SEQ ID NO: 152174 - DNA, 25 bp, Rattus norvegicus
aggtcgttgttctaagctctctctg

SEQ ID NO: 152175 - DNA, 25 bp, Rattus norvegicus
aggtctaaaatgatctctctgcccc

SEQ ID NO: 152176 - DNA, 25 bp, Rattus norvegicus
aggtctaaaatgttctctctgcccc

SEQ ID NO: 152177 - DNA, 25 bp, Rattus norvegicus
aggtctaaaccgacagcagggctga

SEQ ID NO: 152178 - DNA, 25 bp, Rattus norvegicus
aggtctaaaccgtcagcagggctga

SEQ ID NO: 152179 - DNA, 25 bp, Rattus norvegicus
aggtctaaccaactcggctgcttaa

SEQ ID NO: 152180 - DNA, 25 bp, Rattus norvegicus
aggtctaaccaagtcggctgcttaa

SEQ ID NO: 152181 - DNA, 25 bp, Rattus norvegicus
aggtctaaccatccctagcatctct

SEQ ID NO: 152182 - DNA, 25 bp, Rattus norvegicus
aggtctaaccatgcctagcatctct

SEQ ID NO: 152183 - DNA, 25 bp, Rattus norvegicus
aggtctaactccagcaccactgaag

SEQ ID NO: 152184 - DNA, 25 bp, Rattus norvegicus
aggtctaactcctgcaccactgaag

SEQ ID NO: 152185 - DNA, 25 bp, Rattus norvegicus
aggtctaagctaagtaccctacttt

SEQ ID NO: 152186 - DNA, 25 bp, Rattus norvegicus
aggtctaagctatgtaccctacttt

SEQ ID NO: 152187 - DNA, 25 bp, Rattus norvegicus
aggtctaatcaccacaattgttgga

SEQ ID NO: 152188 - DNA, 25 bp, Rattus norvegicus
aggtctaatcacgacaattgttgga

SEQ ID NO: 152189 - DNA, 25 bp, Rattus norvegicus
aggtctacagctcactgcaggatgc

SEQ ID NO: 152190 - DNA, 25 bp, Rattus norvegicus
aggtctacagctgactgcaggatgc

SEQ ID NO: 152191 - DNA, 25 bp, Rattus norvegicus
aggtctacgcgactgtgcctagcct

SEQ ID NO: 152192 - DNA, 25 bp, Rattus norvegicus
aggtctacgcgagtgtgcctagcct

SEQ ID NO: 152193 - DNA, 25 bp, Rattus norvegicus
aggtctacgtgtcgctttgtttcct

SEQ ID NO: 152194 - DNA, 25 bp, Rattus norvegicus
aggtctacgtgtggctttgtttcct

SEQ ID NO: 152195 - DNA, 25 bp, Rattus norvegicus
aggtctactcagaaggctcggctag

SEQ ID NO: 152196 - DNA, 25 bp, Rattus norvegicus
aggtctactcagtaggctcggctag

SEQ ID NO: 152197 - DNA, 25 bp, Rattus norvegicus
aggtctactctcacttctcaaatga

SEQ ID NO: 152198 - DNA, 25 bp, Rattus norvegicus
aggtctactctctcttctcaaatga

SEQ ID NO: 152199 - DNA, 25 bp, Rattus norvegicus
aggtctactcttctgctggcgcgag

SEQ ID NO: 152200 - DNA, 25 bp, Rattus norvegicus
aggtctactcttgtgctggcgcgag

SEQ ID NO: 152201 - DNA, 25 bp, Rattus norvegicus
aggtctactgccactactttgtgaa

SEQ ID NO: 152202 - DNA, 25 bp, Rattus norvegicus
aggtctactgcctctactttgtgaa

SEQ ID NO: 152203 - DNA, 25 bp, Rattus norvegicus
aggtctagatcccacgtttagcaac

SEQ ID NO: 152204 - DNA, 25 bp, Rattus norvegicus
aggtctagatccgacgtttagcaac

SEQ ID NO: 152205 - DNA, 25 bp, Rattus norvegicus
aggtctaggctgaccgctagttaca

SEQ ID NO: 152206 - DNA, 25 bp, Rattus norvegicus
aggtctaggctgtccgctagttaca

SEQ ID NO: 152207 - DNA, 25 bp, Rattus norvegicus
aggtctatatctcagtccatcagtg

SEQ ID NO: 152208 - DNA, 25 bp, Rattus norvegicus
aggtctatatctgagtccatcagtg

SEQ ID NO: 152209 - DNA, 25 bp, Rattus norvegicus
aggtctatatttattactgcacatc

SEQ ID NO: 152210 - DNA, 25 bp, Rattus norvegicus
aggtctatattttttactgcacatc

SEQ ID NO: 152211 - DNA, 25 bp, Rattus norvegicus
aggtctatccatctgttactgtgct

SEQ ID NO: 152212 - DNA, 25 bp, Rattus norvegicus
aggtctatccatgtgttactgtgct

SEQ ID NO: 152213 - DNA, 25 bp, Rattus norvegicus
aggtctatgggcagatggacaacct

SEQ ID NO: 152214 - DNA, 25 bp, Rattus norvegicus
aggtctatgggctgatggacaacct

SEQ ID NO: 152215 - DNA, 25 bp, Rattus norvegicus
aggtctatttctactgtagtgcctc

SEQ ID NO: 152216 - DNA, 25 bp, Rattus norvegicus
aggtctatttcttctgtagtgcctc

SEQ ID NO: 152217 - DNA, 25 bp, Rattus norvegicus
aggtctcaaagtactggaccctgga

SEQ ID NO: 152218 - DNA, 25 bp, Rattus norvegicus
aggtctcaaagttctggaccctgga

SEQ ID NO: 152219 - DNA, 25 bp, Rattus norvegicus
aggtctcacactattcccacgagcg

SEQ ID NO: 152220 - DNA, 25 bp, Rattus norvegicus
aggtctcacacttttcccacgagcg

SEQ ID NO: 152221 - DNA, 25 bp, Rattus norvegicus
aggtctcaccagactttcatggttt

SEQ ID NO: 152222 - DNA, 25 bp, Rattus norvegicus
aggtctcaccagtctttcatggttt

SEQ ID NO: 152223 - DNA, 25 bp, Rattus norvegicus
aggtctcactcaaggtgtcacagaa

SEQ ID NO: 152224 - DNA, 25 bp, Rattus norvegicus
aggtctcactcatggtgtcacagaa

SEQ ID NO: 152225 - DNA, 25 bp, Rattus norvegicus
aggtctcactgtccatcctgaggac

SEQ ID NO: 152226 - DNA, 25 bp, Rattus norvegicus
aggtctcactgtgcatcctgaggac

SEQ ID NO: 152227 - DNA, 25 bp, Rattus norvegicus
aggtctcagaaactgcaagagagct

SEQ ID NO: 152228 - DNA, 25 bp, Rattus norvegicus
aggtctcagaaagtgcaagagagct

SEQ ID NO: 152229 - DNA, 25 bp, Rattus norvegicus
aggtctcagagcctgttacccatgt

SEQ ID NO: 152230 - DNA, 25 bp, Rattus norvegicus
aggtctcagagcgtgttacccatgt

SEQ ID NO: 152231 - DNA, 25 bp, Rattus norvegicus
aggtctcagagtctagccaaagcta

SEQ ID NO: 152232 - DNA, 25 bp, Rattus norvegicus
aggtctcagagtgtagccaaagcta

SEQ ID NO: 152233 - DNA, 25 bp, Rattus norvegicus
aggtctcagcacaagaccgcttcct

SEQ ID NO: 152234 - DNA, 25 bp, Rattus norvegicus
aggtctcagcactagaccgcttcct

SEQ ID NO: 152235 - DNA, 25 bp, Rattus norvegicus
aggtctcaggtacccaactctgcct

SEQ ID NO: 152236 - DNA, 25 bp, Rattus norvegicus
aggtctcaggtagccaactctgcct

SEQ ID NO: 152237 - DNA, 25 bp, Rattus norvegicus
aggtctcagttcagtgttgggtact

SEQ ID NO: 152238 - DNA, 25 bp, Rattus norvegicus
aggtctcagttctgtgttgggtact

SEQ ID NO: 152239 - DNA, 25 bp, Rattus norvegicus
aggtctcatataactgatcaggctt

SEQ ID NO: 152240 - DNA, 25 bp, Rattus norvegicus
aggtctcatatatctgatcaggctt

SEQ ID NO: 152241 - DNA, 25 bp, Rattus norvegicus
aggtctcatgtactgcctttgtcga

SEQ ID NO: 152242 - DNA, 25 bp, Rattus norvegicus
aggtctcatgtagtgcctttgtcga

SEQ ID NO: 152243 - DNA, 25 bp, Rattus norvegicus
aggtctcattcaaatctgacatttg

SEQ ID NO: 152244 - DNA, 25 bp, Rattus norvegicus
aggtctcattcatatctgacatttg

SEQ ID NO: 152245 - DNA, 25 bp, Rattus norvegicus
aggtctcattggcaacgtacggatc

SEQ ID NO: 152246 - DNA, 25 bp, Rattus norvegicus
aggtctcattgggaacgtacggatc

SEQ ID NO: 152247 - DNA, 25 bp, Rattus norvegicus
aggtctccaaatcattttcctgcat

SEQ ID NO: 152248 - DNA, 25 bp, Rattus norvegicus
aggtctccaaatgattttcctgcat

SEQ ID NO: 152249 - DNA, 25 bp, Rattus norvegicus
aggtctccaaccagtgagctttgct

SEQ ID NO: 152250 - DNA, 25 bp, Rattus norvegicus
aggtctccaacctgtgagctttgct

SEQ ID NO: 152251 - DNA, 25 bp, Rattus norvegicus
aggtctccaagcatgtggtccatga

SEQ ID NO: 152252 - DNA, 25 bp, Rattus norvegicus
aggtctccaagcttgtggtccatga

SEQ ID NO: 152253 - DNA, 25 bp, Rattus norvegicus
aggtctccacctaaagattcttata

SEQ ID NO: 152254 - DNA, 25 bp, Rattus norvegicus
aggtctccaccttaagattcttata

SEQ ID NO: 152255 - DNA, 25 bp, Rattus norvegicus
aggtctccactaacatttgtctatc

SEQ ID NO: 152256 - DNA, 25 bp, Rattus norvegicus
aggtctccactatcatttgtctatc

SEQ ID NO: 152257 - DNA, 25 bp, Rattus norvegicus
aggtctccactcatcaaataatttg

SEQ ID NO: 152258 - DNA, 25 bp, Rattus norvegicus
aggtctccactcttcaaataatttg

SEQ ID NO: 152259 - DNA, 25 bp, Rattus norvegicus
aggtctccatgcaggatctactctg

SEQ ID NO: 152260 - DNA, 25 bp, Rattus norvegicus
aggtctccatgctggatctactctg

SEQ ID NO: 152261 - DNA, 25 bp, Rattus norvegicus
aggtctcccacaaatacttccagga

SEQ ID NO: 152262 - DNA, 25 bp, Rattus norvegicus
aggtctcccacatatacttccagga

SEQ ID NO: 152263 - DNA, 25 bp, Rattus norvegicus
aggtctcccgctctggtgagaacct

SEQ ID NO: 152264 - DNA, 25 bp, Rattus norvegicus
aggtctcccgctgtggtgagaacct

SEQ ID NO: 152265 - DNA, 25 bp, Rattus norvegicus
aggtctcctaggacactcagcaagt

SEQ ID NO: 152266 - DNA, 25 bp, Rattus norvegicus
aggtctcctaggtcactcagcaagt

SEQ ID NO: 152267 - DNA, 25 bp, Rattus norvegicus
aggtctcctcggcaagtgggacaca

SEQ ID NO: 152268 - DNA, 25 bp, Rattus norvegicus
aggtctcctcgggaagtgggacaca

SEQ ID NO: 152269 - DNA, 25 bp, Rattus norvegicus
aggtctcctcgtcatgtgccatttg

SEQ ID NO: 152270 - DNA, 25 bp, Rattus norvegicus
aggtctcctcgtgatgtgccatttg

SEQ ID NO: 152271 - DNA, 25 bp, Rattus norvegicus
aggtctcctctcagttgtctacaga

SEQ ID NO: 152272 - DNA, 25 bp, Rattus norvegicus
aggtctcctctctgttgtctacaga

SEQ ID NO: 152273 - DNA, 25 bp, Rattus norvegicus
aggtctcctgagaccccttacactg

SEQ ID NO: 152274 - DNA, 25 bp, Rattus norvegicus
aggtctcctgagtccccttacactg

SEQ ID NO: 152275 - DNA, 25 bp, Rattus norvegicus
aggtctcctgatcccttatgggaaa

SEQ ID NO: 152276 - DNA, 25 bp, Rattus norvegicus
aggtctcctgatgccttatgggaaa

SEQ ID NO: 152277 - DNA, 25 bp, Rattus norvegicus
aggtctcctttcagtgcatgttctg

SEQ ID NO: 152278 - DNA, 25 bp, Rattus norvegicus
aggtctcctttctgtgcatgttctg

SEQ ID NO: 152279 - DNA, 25 bp, Rattus norvegicus
aggtctcgtgtaattttgtccctat

SEQ ID NO: 152280 - DNA, 25 bp, Rattus norvegicus
aggtctcgtgtatttttgtccctat

SEQ ID NO: 152281 - DNA, 25 bp, Rattus norvegicus
aggtctctctggagaattctggtca

SEQ ID NO: 152282 - DNA, 25 bp, Rattus norvegicus
aggtctctctggtgaattctggtca

SEQ ID NO: 152283 - DNA, 25 bp, Rattus norvegicus
aggtctctgagcagcagcttgactt

SEQ ID NO: 152284 - DNA, 25 bp, Rattus norvegicus
aggtctctgagctgcagcttgactt

SEQ ID NO: 152285 - DNA, 25 bp, Rattus norvegicus
aggtctctggtcacttgggtatagc

SEQ ID NO: 152286 - DNA, 25 bp, Rattus norvegicus
aggtctctggtctcttgggtatagc

SEQ ID NO: 152287 - DNA, 25 bp, Rattus norvegicus
aggtctcttaacaatctttggtctt

SEQ ID NO: 152288 - DNA, 25 bp, Rattus norvegicus
aggtctcttaactatctttggtctt

SEQ ID NO: 152289 - DNA, 25 bp, Rattus norvegicus
aggtctcttactattgtgctttgta

SEQ ID NO: 152290 - DNA, 25 bp, Rattus norvegicus
aggtctcttacttttgtgctttgta

SEQ ID NO: 152291 - DNA, 25 bp, Rattus norvegicus
aggtctcttcataaccaaggagggt

SEQ ID NO: 152292 - DNA, 25 bp, Rattus norvegicus
aggtctcttcattaccaaggagggt

SEQ ID NO: 152293 - DNA, 25 bp, Rattus norvegicus
aggtctgaagacatcccctagtcct

SEQ ID NO: 152294 - DNA, 25 bp, Rattus norvegicus
aggtctgaagacttcccctagtcct

SEQ ID NO: 152295 - DNA, 25 bp, Rattus norvegicus
aggtctgaagctagcaattctcctg

SEQ ID NO: 152296 - DNA, 25 bp, Rattus norvegicus
aggtctgaagcttgcaattctcctg

SEQ ID NO: 152297 - DNA, 25 bp, Rattus norvegicus
aggtctgaaggcagtccacgtgtac

SEQ ID NO: 152298 - DNA, 25 bp, Rattus norvegicus
aggtctgaaggctgtccacgtgtac

SEQ ID NO: 152299 - DNA, 25 bp, Rattus norvegicus
aggtctgaatctccttgggttggta

SEQ ID NO: 152300 - DNA, 25 bp, Rattus norvegicus
aggtctgaatctgcttgggttggta

SEQ ID NO: 152301 - DNA, 25 bp, Rattus norvegicus
aggtctgacactaagcgatgatttg

SEQ ID NO: 152302 - DNA, 25 bp, Rattus norvegicus
aggtctgacacttagcgatgatttg

SEQ ID NO: 152303 - DNA, 25 bp, Rattus norvegicus
aggtctgacagcacagatcctctgg

SEQ ID NO: 152304 - DNA, 25 bp, Rattus norvegicus
aggtctgacagctcagatcctctgg

SEQ ID NO: 152305 - DNA, 25 bp, Rattus norvegicus
aggtctgaccatactgcttgttgtt

SEQ ID NO: 152306 - DNA, 25 bp, Rattus norvegicus
aggtctgaccattctgcttgttgtt

SEQ ID NO: 152307 - DNA, 25 bp, Rattus norvegicus
aggtctgacctgactgtcatgcaga

SEQ ID NO: 152308 - DNA, 25 bp, Rattus norvegicus
aggtctgacctgtctgtcatgcaga

SEQ ID NO: 152309 - DNA, 25 bp, Rattus norvegicus
aggtctgaccttcctttctttacag

SEQ ID NO: 152310 - DNA, 25 bp, Rattus norvegicus
aggtctgaccttgctttctttacag

SEQ ID NO: 152311 - DNA, 25 bp, Rattus norvegicus
aggtctgactctcgcatcttagtta

SEQ ID NO: 152312 - DNA, 25 bp, Rattus norvegicus
aggtctgactctggcatcttagtta

SEQ ID NO: 152313 - DNA, 25 bp, Rattus norvegicus
aggtctgagctcaggacagtccagg

SEQ ID NO: 152314 - DNA, 25 bp, Rattus norvegicus
aggtctgagctctggacagtccagg

SEQ ID NO: 152315 - DNA, 25 bp, Rattus norvegicus
aggtctgaggctcccctggagaacc

SEQ ID NO: 152316 - DNA, 25 bp, Rattus norvegicus
aggtctgaggctgccctggagaacc

SEQ ID NO: 152317 - DNA, 25 bp, Rattus norvegicus
aggtctgatgacagggctatgagct

SEQ ID NO: 152318 - DNA, 25 bp, Rattus norvegicus
aggtctgatgactgggctatgagct

SEQ ID NO: 152319 - DNA, 25 bp, Rattus norvegicus
aggtctgatttaaaattcccctcaa

SEQ ID NO: 152320 - DNA, 25 bp, Rattus norvegicus
aggtctgatttataattcccctcaa

SEQ ID NO: 152321 - DNA, 25 bp, Rattus norvegicus
aggtctgatttgatcattccggcat

SEQ ID NO: 152322 - DNA, 25 bp, Rattus norvegicus
aggtctgatttgcagctctttggca

SEQ ID NO: 152323 - DNA, 25 bp, Rattus norvegicus
aggtctgatttggagctctttggca

SEQ ID NO: 152324 - DNA, 25 bp, Rattus norvegicus
aggtctgatttgttcattccggcat

SEQ ID NO: 152325 - DNA, 25 bp, Rattus norvegicus
aggtctgcaaaaacaccctgcggct

SEQ ID NO: 152326 - DNA, 25 bp, Rattus norvegicus
aggtctgcaaaatcaccctgcggct

SEQ ID NO: 152327 - DNA, 25 bp, Rattus norvegicus
aggtctgcaaatctgctgtgttcag

SEQ ID NO: 152328 - DNA, 25 bp, Rattus norvegicus
aggtctgcaaatgtgctgtgttcag

SEQ ID NO: 152329 - DNA, 25 bp, Rattus norvegicus
aggtctgcagcaagtatgttcttac

SEQ ID NO: 152330 - DNA, 25 bp, Rattus norvegicus
aggtctgcagcaccctccaagagct

SEQ ID NO: 152331 - DNA, 25 bp, Rattus norvegicus
aggtctgcagcagcctccaagagct

SEQ ID NO: 152332 - DNA, 25 bp, Rattus norvegicus
aggtctgcagcatgtatgttcttac

SEQ ID NO: 152333 - DNA, 25 bp, Rattus norvegicus
aggtctgcagctactgtcaacggtt

SEQ ID NO: 152334 - DNA, 25 bp, Rattus norvegicus
aggtctgcagcttctgtcaacggtt

SEQ ID NO: 152335 - DNA, 25 bp, Rattus norvegicus
aggtctgcaggtctacggtcacctg

SEQ ID NO: 152336 - DNA, 25 bp, Rattus norvegicus
aggtctgcaggtgtacggtcacctg

SEQ ID NO: 152337 - DNA, 25 bp, Rattus norvegicus
aggtctgcagttactcactttggat

SEQ ID NO: 152338 - DNA, 25 bp, Rattus norvegicus
aggtctgcagtttctcactttggat

SEQ ID NO: 152339 - DNA, 25 bp, Rattus norvegicus
aggtctgcatgcaaatctgccctta

SEQ ID NO: 152340 - DNA, 25 bp, Rattus norvegicus
aggtctgcatgctaatctgccctta

SEQ ID NO: 152341 - DNA, 25 bp, Rattus norvegicus
aggtctgcctgtcttggaagccaat

SEQ ID NO: 152342 - DNA, 25 bp, Rattus norvegicus
aggtctgcctgtgttggaagccaat

SEQ ID NO: 152343 - DNA, 25 bp, Rattus norvegicus
aggtctgcggaaaatccaccactga

SEQ ID NO: 152344 - DNA, 25 bp, Rattus norvegicus
aggtctgcggaatatccaccactga

SEQ ID NO: 152345 - DNA, 25 bp, Rattus norvegicus
aggtctgcgtgccataggactcatc

SEQ ID NO: 152346 - DNA, 25 bp, Rattus norvegicus
aggtctgcgtgcgataggactcatc

SEQ ID NO: 152347 - DNA, 25 bp, Rattus norvegicus
aggtctgctcagctaaactttggga

SEQ ID NO: 152348 - DNA, 25 bp, Rattus norvegicus
aggtctgctcaggtaaactttggga

SEQ ID NO: 152349 - DNA, 25 bp, Rattus norvegicus
aggtctgctgccagcaatacctgca

SEQ ID NO: 152350 - DNA, 25 bp, Rattus norvegicus
aggtctgctgcctgcaatacctgca

SEQ ID NO: 152351 - DNA, 25 bp, Rattus norvegicus
aggtctgctggaacacatggtacaa

SEQ ID NO: 152352 - DNA, 25 bp, Rattus norvegicus
aggtctgctggatcacatggtacaa

SEQ ID NO: 152353 - DNA, 25 bp, Rattus norvegicus
aggtctgctggcagacactctaatc

SEQ ID NO: 152354 - DNA, 25 bp, Rattus norvegicus
aggtctgctggctgacactctaatc

SEQ ID NO: 152355 - DNA, 25 bp, Rattus norvegicus
aggtctgcttacagttggtcgctct

SEQ ID NO: 152356 - DNA, 25 bp, Rattus norvegicus
aggtctgcttactgttggtcgctct

SEQ ID NO: 152357 - DNA, 25 bp, Rattus norvegicus
aggtctgcttcccattgctacaatg

SEQ ID NO: 152358 - DNA, 25 bp, Rattus norvegicus
aggtctgcttccgattgctacaatg

SEQ ID NO: 152359 - DNA, 25 bp, Rattus norvegicus
aggtctgctttcagcccgagtccca

SEQ ID NO: 152360 - DNA, 25 bp, Rattus norvegicus
aggtctgctttctgcccgagtccca

SEQ ID NO: 152361 - DNA, 25 bp, Rattus norvegicus
aggtctgctttgacgaggctccagc

SEQ ID NO: 152362 - DNA, 25 bp, Rattus norvegicus
aggtctgctttgtcgaggctccagc

SEQ ID NO: 152363 - DNA, 25 bp, Rattus norvegicus
aggtctggaataaccgagtcctgaa

SEQ ID NO: 152364 - DNA, 25 bp, Rattus norvegicus
aggtctggaatatccgagtcctgaa

SEQ ID NO: 152365 - DNA, 25 bp, Rattus norvegicus
aggtctggactaacgtgatttcatt

SEQ ID NO: 152366 - DNA, 25 bp, Rattus norvegicus
aggtctggactatcgtgatttcatt

SEQ ID NO: 152367 - DNA, 25 bp, Rattus norvegicus
aggtctggagcacagccttctggac

SEQ ID NO: 152368 - DNA, 25 bp, Rattus norvegicus
aggtctggagcagagccttctggac

SEQ ID NO: 152369 - DNA, 25 bp, Rattus norvegicus
aggtctggagttcgcttactcggaa

SEQ ID NO: 152370 - DNA, 25 bp, Rattus norvegicus
aggtctggagttggcttactcggaa

SEQ ID NO: 152371 - DNA, 25 bp, Rattus norvegicus
aggtctggatccagccacatgtgga

SEQ ID NO: 152372 - DNA, 25 bp, Rattus norvegicus
aggtctggatcctgccacatgtgga

SEQ ID NO: 152373 - DNA, 25 bp, Rattus norvegicus
aggtctgggaaaacaaacttggctc

SEQ ID NO: 152374 - DNA, 25 bp, Rattus norvegicus
aggtctgggaaatcaaacttggctc

SEQ ID NO: 152375 - DNA, 25 bp, Rattus norvegicus
aggtctgggagccagagcctctcta

SEQ ID NO: 152376 - DNA, 25 bp, Rattus norvegicus
aggtctgggagcgagagcctctcta

SEQ ID NO: 152377 - DNA, 25 bp, Rattus norvegicus
aggtctgggcccaggaagtcctgct

SEQ ID NO: 152378 - DNA, 25 bp, Rattus norvegicus
aggtctgggccctggaagtcctgct

SEQ ID NO: 152379 - DNA, 25 bp, Rattus norvegicus
aggtctgggcctatgtttctgagct

SEQ ID NO: 152380 - DNA, 25 bp, Rattus norvegicus
aggtctgggcctttgtttctgagct

SEQ ID NO: 152381 - DNA, 25 bp, Rattus norvegicus
aggtctgggtctacatgcatgggca

SEQ ID NO: 152382 - DNA, 25 bp, Rattus norvegicus
aggtctgggtcttcatgcatgggca

SEQ ID NO: 152383 - DNA, 25 bp, Rattus norvegicus
aggtctggtatcagtcacaccatgt

SEQ ID NO: 152384 - DNA, 25 bp, Rattus norvegicus
aggtctggtatctgtcacaccatgt

SEQ ID NO: 152385 - DNA, 25 bp, Rattus norvegicus
aggtctggtccacaaacctgtccgg

SEQ ID NO: 152386 - DNA, 25 bp, Rattus norvegicus
aggtctggtccagaaacctgtccgg

SEQ ID NO: 152387 - DNA, 25 bp, Rattus norvegicus
aggtctggtgcgatggtgcacacct

SEQ ID NO: 152388 - DNA, 25 bp, Rattus norvegicus
aggtctggtgcgttggtgcacacct

SEQ ID NO: 152389 - DNA, 25 bp, Rattus norvegicus
aggtctggtggcacacaaaccttta

SEQ ID NO: 152390 - DNA, 25 bp, Rattus norvegicus
aggtctggtggctcacaaaccttta

SEQ ID NO: 152391 - DNA, 25 bp, Rattus norvegicus
aggtctgtaaagaggcagccaccat

SEQ ID NO: 152392 - DNA, 25 bp, Rattus norvegicus
aggtctgtaaagtggcagccaccat

SEQ ID NO: 152393 - DNA, 25 bp, Rattus norvegicus
aggtctgtacgccaggaaacacaag

SEQ ID NO: 152394 - DNA, 25 bp, Rattus norvegicus
aggtctgtacgcgaggaaacacaag

SEQ ID NO: 152395 - DNA, 25 bp, Rattus norvegicus
aggtctgtcatgatttgcactgggt

SEQ ID NO: 152396 - DNA, 25 bp, Rattus norvegicus
aggtctgtcatgctcaatcacttaa

SEQ ID NO: 152397 - DNA, 25 bp, Rattus norvegicus
aggtctgtcatggtcaatcacttaa

SEQ ID NO: 152398 - DNA, 25 bp, Rattus norvegicus
aggtctgtcatgttttgcactgggt

SEQ ID NO: 152399 - DNA, 25 bp, Rattus norvegicus
aggtctgtctgcagtgtggatgtcc

SEQ ID NO: 152400 - DNA, 25 bp, Rattus norvegicus
aggtctgtctgctgtgtggatgtcc

SEQ ID NO: 152401 - DNA, 25 bp, Rattus norvegicus
aggtctgtctggatttccgtactaa

SEQ ID NO: 152402 - DNA, 25 bp, Rattus norvegicus
aggtctgtctggttttccgtactaa

SEQ ID NO: 152403 - DNA, 25 bp, Rattus norvegicus
aggtctgtgacaccatccgagtaaa

SEQ ID NO: 152404 - DNA, 25 bp, Rattus norvegicus
aggtctgtgacagcatccgagtaaa

SEQ ID NO: 152405 - DNA, 25 bp, Rattus norvegicus
aggtctgtgaccaacagccaatcta

SEQ ID NO: 152406 - DNA, 25 bp, Rattus norvegicus
aggtctgtgacctacagccaatcta

SEQ ID NO: 152407 - DNA, 25 bp, Rattus norvegicus
aggtctgtgccactgccagccatgg

SEQ ID NO: 152408 - DNA, 25 bp, Rattus norvegicus
aggtctgtgccagtgccagccatgg

SEQ ID NO: 152409 - DNA, 25 bp, Rattus norvegicus
aggtctgtggatcaacgccctccat

SEQ ID NO: 152410 - DNA, 25 bp, Rattus norvegicus
aggtctgtggatgaacgccctccat

SEQ ID NO: 152411 - DNA, 25 bp, Rattus norvegicus
aggtctgtggcgagcctcaaatggc

SEQ ID NO: 152412 - DNA, 25 bp, Rattus norvegicus
aggtctgtggcgtgcctcaaatggc

SEQ ID NO: 152413 - DNA, 25 bp, Rattus norvegicus
aggtctgtgggactcggtcatccaa

SEQ ID NO: 152414 - DNA, 25 bp, Rattus norvegicus
aggtctgtgggagtcggtcatccaa

SEQ ID NO: 152415 - DNA, 25 bp, Rattus norvegicus
aggtctgtggtcctggtcctccagt

SEQ ID NO: 152416 - DNA, 25 bp, Rattus norvegicus
aggtctgtggtcgtggtcctccagt

SEQ ID NO: 152417 - DNA, 25 bp, Rattus norvegicus
aggtctgttcctctgtaagtcatgt

SEQ ID NO: 152418 - DNA, 25 bp, Rattus norvegicus
aggtctgttcctgtgtaagtcatgt

SEQ ID NO: 152419 - DNA, 25 bp, Rattus norvegicus
aggtctgttcttccgcagaggaatc

SEQ ID NO: 152420 - DNA, 25 bp, Rattus norvegicus
aggtctgttcttgcgcagaggaatc

SEQ ID NO: 152421 - DNA, 25 bp, Rattus norvegicus
aggtctgttgacatactgtgaattc

SEQ ID NO: 152422 - DNA, 25 bp, Rattus norvegicus
aggtctgttgacttactgtgaattc

SEQ ID NO: 152423 - DNA, 25 bp, Rattus norvegicus
aggtctgtttacatggtgtctccat

SEQ ID NO: 152424 - DNA, 25 bp, Rattus norvegicus
aggtctgtttacttggtgtctccat

SEQ ID NO: 152425 - DNA, 25 bp, Rattus norvegicus
aggtcttaaattcttgtctccccag

SEQ ID NO: 152426 - DNA, 25 bp, Rattus norvegicus
aggtcttaaattgttgtctccccag

SEQ ID NO: 152427 - DNA, 25 bp, Rattus norvegicus
aggtcttaagtgagagctcagagca

SEQ ID NO: 152428 - DNA, 25 bp, Rattus norvegicus
aggtcttaagtgtgagctcagagca

SEQ ID NO: 152429 - DNA, 25 bp, Rattus norvegicus
aggtcttaatctcgagttctcgggt

SEQ ID NO: 152430 - DNA, 25 bp, Rattus norvegicus
aggtcttaatctggagttctcgggt

SEQ ID NO: 152431 - DNA, 25 bp, Rattus norvegicus
aggtcttaggccataatgctttagt

SEQ ID NO: 152432 - DNA, 25 bp, Rattus norvegicus
aggtcttaggccttaatgctttagt

SEQ ID NO: 152433 - DNA, 25 bp, Rattus norvegicus
aggtcttagtccagtattcacctgg

SEQ ID NO: 152434 - DNA, 25 bp, Rattus norvegicus
aggtcttagtcctgtattcacctgg

SEQ ID NO: 152435 - DNA, 25 bp, Rattus norvegicus
aggtcttatttcaccctcagatgag

SEQ ID NO: 152436 - DNA, 25 bp, Rattus norvegicus
aggtcttatttctccctcagatgag

SEQ ID NO: 152437 - DNA, 25 bp, Rattus norvegicus
aggtcttcaaaaccctgtcaatgat

SEQ ID NO: 152438 - DNA, 25 bp, Rattus norvegicus
aggtcttcaaaagcctgtcaatgat

SEQ ID NO: 152439 - DNA, 25 bp, Rattus norvegicus
aggtcttcaactcagctgggtttcc

SEQ ID NO: 152440 - DNA, 25 bp, Rattus norvegicus
aggtcttcaactgagctgggtttcc

SEQ ID NO: 152441 - DNA, 25 bp, Rattus norvegicus
aggtcttcaatgaggctcccgggat

SEQ ID NO: 152442 - DNA, 25 bp, Rattus norvegicus
aggtcttcaatgtggctcccgggat

SEQ ID NO: 152443 - DNA, 25 bp, Rattus norvegicus
aggtcttcaccaaagacgacactct

SEQ ID NO: 152444 - DNA, 25 bp, Rattus norvegicus
aggtcttcaccatagacgacactct

SEQ ID NO: 152445 - DNA, 25 bp, Rattus norvegicus
aggtcttcagtcattatcctgtctt

SEQ ID NO: 152446 - DNA, 25 bp, Rattus norvegicus
aggtcttcagtctttatcctgtctt

SEQ ID NO: 152447 - DNA, 25 bp, Rattus norvegicus
aggtcttcatgcagtcgctgacatc

SEQ ID NO: 152448 - DNA, 25 bp, Rattus norvegicus
aggtcttcatgctgtcgctgacatc

SEQ ID NO: 152449 - DNA, 25 bp, Rattus norvegicus
aggtcttccacaacatactgcacag

SEQ ID NO: 152450 - DNA, 25 bp, Rattus norvegicus
aggtcttccacatcatactgcacag

SEQ ID NO: 152451 - DNA, 25 bp, Rattus norvegicus
aggtcttccagacgcccgctttggt

SEQ ID NO: 152452 - DNA, 25 bp, Rattus norvegicus
aggtcttccagaggcccgctttggt

SEQ ID NO: 152453 - DNA, 25 bp, Rattus norvegicus
aggtcttcccaaaatctatgtcttc

SEQ ID NO: 152454 - DNA, 25 bp, Rattus norvegicus
aggtcttcccaatatctatgtcttc

SEQ ID NO: 152455 - DNA, 25 bp, Rattus norvegicus
aggtcttcctgtaagggagcaccac

SEQ ID NO: 152456 - DNA, 25 bp, Rattus norvegicus
aggtcttcctgttagggagcaccac

SEQ ID NO: 152457 - DNA, 25 bp, Rattus norvegicus
aggtcttcgcctatgccagggcttt

SEQ ID NO: 152458 - DNA, 25 bp, Rattus norvegicus
aggtcttcgcctttgccagggcttt

SEQ ID NO: 152459 - DNA, 25 bp, Rattus norvegicus
aggtcttcgtggctaccaagggcat

SEQ ID NO: 152460 - DNA, 25 bp, Rattus norvegicus
aggtcttcgtgggtaccaagggcat

SEQ ID NO: 152461 - DNA, 25 bp, Rattus norvegicus
aggtcttctcccctgagagtgactc

SEQ ID NO: 152462 - DNA, 25 bp, Rattus norvegicus
aggtcttctcccgtgagagtgactc

SEQ ID NO: 152463 - DNA, 25 bp, Rattus norvegicus
aggtcttctgcaaaccagtgtacag

SEQ ID NO: 152464 - DNA, 25 bp, Rattus norvegicus
aggtcttctgcataccagtgtacag

SEQ ID NO: 152465 - DNA, 25 bp, Rattus norvegicus
aggtcttctgtgcttttgctttggg

SEQ ID NO: 152466 - DNA, 25 bp, Rattus norvegicus
aggtcttctgtggttttgctttggg

SEQ ID NO: 152467 - DNA, 25 bp, Rattus norvegicus
aggtcttcttcgagcctggacggct

SEQ ID NO: 152468 - DNA, 25 bp, Rattus norvegicus
aggtcttcttcgtgcctggacggct

SEQ ID NO: 152469 - DNA, 25 bp, Rattus norvegicus
aggtcttcttgcagtctcagtggaa

SEQ ID NO: 152470 - DNA, 25 bp, Rattus norvegicus
aggtcttcttgctgtctcagtggaa

SEQ ID NO: 152471 - DNA, 25 bp, Rattus norvegicus
aggtcttcttgtatggtctcttcac

SEQ ID NO: 152472 - DNA, 25 bp, Rattus norvegicus
aggtcttcttgtttggtctcttcac

SEQ ID NO: 152473 - DNA, 25 bp, Rattus norvegicus
aggtcttgaactcgtgggaatactc

SEQ ID NO: 152474 - DNA, 25 bp, Rattus norvegicus
aggtcttgaactggtgggaatactc

SEQ ID NO: 152475 - DNA, 25 bp, Rattus norvegicus
aggtcttgagaacccggtcggctaa

SEQ ID NO: 152476 - DNA, 25 bp, Rattus norvegicus
aggtcttgagaagccggtcggctaa

SEQ ID NO: 152477 - DNA, 25 bp, Rattus norvegicus
aggtcttgagctcatgcccgggaca

SEQ ID NO: 152478 - DNA, 25 bp, Rattus norvegicus
aggtcttgagctgatgcccgggaca

SEQ ID NO: 152479 - DNA, 25 bp, Rattus norvegicus
aggtcttgatccactctgcaggaac

SEQ ID NO: 152480 - DNA, 25 bp, Rattus norvegicus
aggtcttgatcctctctgcaggaac

SEQ ID NO: 152481 - DNA, 25 bp, Rattus norvegicus
aggtcttgcaagagctcttaaccac

SEQ ID NO: 152482 - DNA, 25 bp, Rattus norvegicus
aggtcttgcaagtgctcttaaccac

SEQ ID NO: 152483 - DNA, 25 bp, Rattus norvegicus
aggtcttgcccgatgtagtcaagga

SEQ ID NO: 152484 - DNA, 25 bp, Rattus norvegicus
aggtcttgcccgttgtagtcaagga

SEQ ID NO: 152485 - DNA, 25 bp, Rattus norvegicus
aggtcttgcctacgaaactctgtaa

SEQ ID NO: 152486 - DNA, 25 bp, Rattus norvegicus
aggtcttgcctaggaaactctgtaa

SEQ ID NO: 152487 - DNA, 25 bp, Rattus norvegicus
aggtcttgccttagggtgacataga

SEQ ID NO: 152488 - DNA, 25 bp, Rattus norvegicus
aggtcttgcctttgggtgacataga

SEQ ID NO: 152489 - DNA, 25 bp, Rattus norvegicus
aggtcttgcttgatggccactatga

SEQ ID NO: 152490 - DNA, 25 bp, Rattus norvegicus
aggtcttgcttgttggccactatga

SEQ ID NO: 152491 - DNA, 25 bp, Rattus norvegicus
aggtcttggagtatgcacctttttg

SEQ ID NO: 152492 - DNA, 25 bp, Rattus norvegicus
aggtcttggagtttgcacctttttg

SEQ ID NO: 152493 - DNA, 25 bp, Rattus norvegicus
aggtcttggcccaatctcccaaccg

SEQ ID NO: 152494 - DNA, 25 bp, Rattus norvegicus
aggtcttggccctatctcccaaccg

SEQ ID NO: 152495 - DNA, 25 bp, Rattus norvegicus
aggtcttgggccactcaaacacaag

SEQ ID NO: 152496 - DNA, 25 bp, Rattus norvegicus
aggtcttgggcctctcaaacacaag

SEQ ID NO: 152497 - DNA, 25 bp, Rattus norvegicus
aggtcttgtcatctcaactgctatt

SEQ ID NO: 152498 - DNA, 25 bp, Rattus norvegicus
aggtcttgtcatgtcaactgctatt

SEQ ID NO: 152499 - DNA, 25 bp, Rattus norvegicus
aggtctttaagcctcacttctaact

SEQ ID NO: 152500 - DNA, 25 bp, Rattus norvegicus
aggtctttaagcgtcacttctaact

SEQ ID NO: 152501 - DNA, 25 bp, Rattus norvegicus
aggtctttaaggacacatgtctgga

SEQ ID NO: 152502 - DNA, 25 bp, Rattus norvegicus
aggtctttaaggtcacatgtctgga

SEQ ID NO: 152503 - DNA, 25 bp, Rattus norvegicus
aggtctttattcatggtcttctgtc

SEQ ID NO: 152504 - DNA, 25 bp, Rattus norvegicus
aggtctttattcttggtcttctgtc

SEQ ID NO: 152505 - DNA, 25 bp, Rattus norvegicus
aggtctttcagtcttctaacatcgt

SEQ ID NO: 152506 - DNA, 25 bp, Rattus norvegicus
aggtctttcagtgttctaacatcgt

SEQ ID NO: 152507 - DNA, 25 bp, Rattus norvegicus
aggtctttccagctcagcgtgacta

SEQ ID NO: 152508 - DNA, 25 bp, Rattus norvegicus
aggtctttccaggtcagcgtgacta

SEQ ID NO: 152509 - DNA, 25 bp, Rattus norvegicus
aggtctttccgcagtctttctaaca

SEQ ID NO: 152510 - DNA, 25 bp, Rattus norvegicus
aggtctttccgctgtctttctaaca

SEQ ID NO: 152511 - DNA, 25 bp, Rattus norvegicus
aggtctttcctcaggccacaaggtt

SEQ ID NO: 152512 - DNA, 25 bp, Rattus norvegicus
aggtctttcctctggccacaaggtt

SEQ ID NO: 152513 - DNA, 25 bp, Rattus norvegicus
aggtctttctggcttttacatatgt

SEQ ID NO: 152514 - DNA, 25 bp, Rattus norvegicus
aggtctttctgggttttacatatgt

SEQ ID NO: 152515 - DNA, 25 bp, Rattus norvegicus
aggtctttctgtcagctctttgggc

SEQ ID NO: 152516 - DNA, 25 bp, Rattus norvegicus
aggtctttctgtgagctctttgggc

SEQ ID NO: 152517 - DNA, 25 bp, Rattus norvegicus
aggtctttgaacagccatagggcgc

SEQ ID NO: 152518 - DNA, 25 bp, Rattus norvegicus
aggtctttgaactgccatagggcgc

SEQ ID NO: 152519 - DNA, 25 bp, Rattus norvegicus
aggtctttgcagagtgcctcagtga

SEQ ID NO: 152520 - DNA, 25 bp, Rattus norvegicus
aggtctttgcagtgtgcctcagtga

SEQ ID NO: 152521 - DNA, 25 bp, Rattus norvegicus
aggtctttgcatatgccagggctct

SEQ ID NO: 152522 - DNA, 25 bp, Rattus norvegicus
aggtctttgcatttgccagggctct

SEQ ID NO: 152523 - DNA, 25 bp, Rattus norvegicus
aggtctttgcgcaagaccgcttcct

SEQ ID NO: 152524 - DNA, 25 bp, Rattus norvegicus
aggtctttgcgctagaccgcttcct

SEQ ID NO: 152525 - DNA, 25 bp, Rattus norvegicus
aggtctttgcttcgttattgacaca

SEQ ID NO: 152526 - DNA, 25 bp, Rattus norvegicus
aggtctttgcttggttattgacaca

SEQ ID NO: 152527 - DNA, 25 bp, Rattus norvegicus
aggtcttttctgcttgttcatgtgt

SEQ ID NO: 152528 - DNA, 25 bp, Rattus norvegicus
aggtcttttctggttgttcatgtgt

SEQ ID NO: 152529 - DNA, 25 bp, Rattus norvegicus
aggtcttttgtgatcttagttttca

SEQ ID NO: 152530 - DNA, 25 bp, Rattus norvegicus
aggtcttttgtgttcttagttttca

SEQ ID NO: 152531 - DNA, 25 bp, Rattus norvegicus
aggtgaaaaaggcagctatgctcat

SEQ ID NO: 152532 - DNA, 25 bp, Rattus norvegicus
aggtgaaaaagggagctatgctcat

SEQ ID NO: 152533 - DNA, 25 bp, Rattus norvegicus
aggtgaaaatcaagccctgttcctt

SEQ ID NO: 152534 - DNA, 25 bp, Rattus norvegicus
aggtgaaaatcatgccctgttcctt

SEQ ID NO: 152535 - DNA, 25 bp, Rattus norvegicus
aggtgaaaccagaaatgctttgctt

SEQ ID NO: 152536 - DNA, 25 bp, Rattus norvegicus
aggtgaaaccagtaatgctttgctt

SEQ ID NO: 152537 - DNA, 25 bp, Rattus norvegicus
aggtgaaacctgaatgtggcctgtt

SEQ ID NO: 152538 - DNA, 25 bp, Rattus norvegicus
aggtgaaacctgtatgtggcctgtt

SEQ ID NO: 152539 - DNA, 25 bp, Rattus norvegicus
aggtgaaactctatgccaggcattg

SEQ ID NO: 152540 - DNA, 25 bp, Rattus norvegicus
aggtgaaactctttgccaggcattg

SEQ ID NO: 152541 - DNA, 25 bp, Rattus norvegicus
aggtgaaagagtccctccgcagcat

SEQ ID NO: 152542 - DNA, 25 bp, Rattus norvegicus
aggtgaaagagtgcctccgcagcat

SEQ ID NO: 152543 - DNA, 25 bp, Rattus norvegicus
aggtgaaagcaacccctcaaggatg

SEQ ID NO: 152544 - DNA, 25 bp, Rattus norvegicus
aggtgaaagcaagccctcaaggatg

SEQ ID NO: 152545 - DNA, 25 bp, Rattus norvegicus
aggtgaaagctgagaccatccgcag

SEQ ID NO: 152546 - DNA, 25 bp, Rattus norvegicus
aggtgaaagctgtgaccatccgcag

SEQ ID NO: 152547 - DNA, 25 bp, Rattus norvegicus
aggtgaacaacccacagatccagca

SEQ ID NO: 152548 - DNA, 25 bp, Rattus norvegicus
aggtgaacaaccgacagatccagca

SEQ ID NO: 152549 - DNA, 25 bp, Rattus norvegicus
aggtgaacaagcagggtctattaca

SEQ ID NO: 152550 - DNA, 25 bp, Rattus norvegicus
aggtgaacaagctgggtctattaca

SEQ ID NO: 152551 - DNA, 25 bp, Rattus norvegicus
aggtgaacacggaaggcctttgtgt

SEQ ID NO: 152552 - DNA, 25 bp, Rattus norvegicus
aggtgaacacggtaggcctttgtgt

SEQ ID NO: 152553 - DNA, 25 bp, Rattus norvegicus
aggtgaacagccaccagacagtctg

SEQ ID NO: 152554 - DNA, 25 bp, Rattus norvegicus
aggtgaacagcctccagacagtctg

SEQ ID NO: 152555 - DNA, 25 bp, Rattus norvegicus
aggtgaacagtcagtccatcatgga

SEQ ID NO: 152556 - DNA, 25 bp, Rattus norvegicus
aggtgaacagtctgtccatcatgga

SEQ ID NO: 152557 - DNA, 25 bp, Rattus norvegicus
aggtgaacatgaatactatacggtg

SEQ ID NO: 152558 - DNA, 25 bp, Rattus norvegicus
aggtgaacatgattactatacggtg

SEQ ID NO: 152559 - DNA, 25 bp, Rattus norvegicus
aggtgaaccactccatccgtgcatc

SEQ ID NO: 152560 - DNA, 25 bp, Rattus norvegicus
aggtgaaccactgcatccgtgcatc

SEQ ID NO: 152561 - DNA, 25 bp, Rattus norvegicus
aggtgaacctatacatcccgaaatt

SEQ ID NO: 152562 - DNA, 25 bp, Rattus norvegicus
aggtgaacctattcatcccgaaatt

SEQ ID NO: 152563 - DNA, 25 bp, Rattus norvegicus
aggtgaacgctaccattttctcatt

SEQ ID NO: 152564 - DNA, 25 bp, Rattus norvegicus
aggtgaacgctagcattttctcatt

SEQ ID NO: 152565 - DNA, 25 bp, Rattus norvegicus
aggtgaacgtgtcccaatctccgta

SEQ ID NO: 152566 - DNA, 25 bp, Rattus norvegicus
aggtgaacgtgtgccaatctccgta

SEQ ID NO: 152567 - DNA, 25 bp, Rattus norvegicus
aggtgaactaagagagagtcttgtc

SEQ ID NO: 152568 - DNA, 25 bp, Rattus norvegicus
aggtgaactaagtgagagtcttgtc

SEQ ID NO: 152569 - DNA, 25 bp, Rattus norvegicus
aggtgaactcacatggcacactgca

SEQ ID NO: 152570 - DNA, 25 bp, Rattus norvegicus
aggtgaactcacttggcacactgca

SEQ ID NO: 152571 - DNA, 25 bp, Rattus norvegicus
aggtgaactgctccaaaggctctgt

SEQ ID NO: 152572 - DNA, 25 bp, Rattus norvegicus
aggtgaactgctgcaaaggctctgt

SEQ ID NO: 152573 - DNA, 25 bp, Rattus norvegicus
aggtgaagaaccatccatgcaggaa

SEQ ID NO: 152574 - DNA, 25 bp, Rattus norvegicus
aggtgaagaaccttccatgcaggaa

SEQ ID NO: 152575 - DNA, 25 bp, Rattus norvegicus
aggtgaagatgtcactctcggtctt

SEQ ID NO: 152576 - DNA, 25 bp, Rattus norvegicus
aggtgaagatgtgactctcggtctt

SEQ ID NO: 152577 - DNA, 25 bp, Rattus norvegicus
aggtgaagcatgagactccagcctc

SEQ ID NO: 152578 - DNA, 25 bp, Rattus norvegicus
aggtgaagcatgtgactccagcctc

SEQ ID NO: 152579 - DNA, 25 bp, Rattus norvegicus
aggtgaagccatccgagagcctcct

SEQ ID NO: 152580 - DNA, 25 bp, Rattus norvegicus
aggtgaagccatgcgagagcctcct

SEQ ID NO: 152581 - DNA, 25 bp, Rattus norvegicus
aggtgaagccttaggccgcttctct

SEQ ID NO: 152582 - DNA, 25 bp, Rattus norvegicus
aggtgaagcctttggccgcttctct

SEQ ID NO: 152583 - DNA, 25 bp, Rattus norvegicus
aggtgaagcgccacaagactcagcc

SEQ ID NO: 152584 - DNA, 25 bp, Rattus norvegicus
aggtgaagcgcctcaagactcagcc

SEQ ID NO: 152585 - DNA, 25 bp, Rattus norvegicus
aggtgaaggaggaccccatctgtct

SEQ ID NO: 152586 - DNA, 25 bp, Rattus norvegicus
aggtgaaggaggtccccatctgtct

SEQ ID NO: 152587 - DNA, 25 bp, Rattus norvegicus
aggtgaagggccagctcactgctag

SEQ ID NO: 152588 - DNA, 25 bp, Rattus norvegicus
aggtgaagggcctgctcactgctag

SEQ ID NO: 152589 - DNA, 25 bp, Rattus norvegicus
aggtgaaggttgatcctggccaaca

SEQ ID NO: 152590 - DNA, 25 bp, Rattus norvegicus
aggtgaaggttgttcctggccaaca

SEQ ID NO: 152591 - DNA, 25 bp, Rattus norvegicus
aggtgaagtcccacaaggttctaat

SEQ ID NO: 152592 - DNA, 25 bp, Rattus norvegicus
aggtgaagtcccactcatcagagag

SEQ ID NO: 152593 - DNA, 25 bp, Rattus norvegicus
aggtgaagtccctcaaggttctaat

SEQ ID NO: 152594 - DNA, 25 bp, Rattus norvegicus
aggtgaagtccctctcatcagagag

SEQ ID NO: 152595 - DNA, 25 bp, Rattus norvegicus
aggtgaatattaattccctctctcc

SEQ ID NO: 152596 - DNA, 25 bp, Rattus norvegicus
aggtgaatattatttccctctctcc

SEQ ID NO: 152597 - DNA, 25 bp, Rattus norvegicus
aggtgaatctaaaggccgctttccc

SEQ ID NO: 152598 - DNA, 25 bp, Rattus norvegicus
aggtgaatctaatggccgctttccc

SEQ ID NO: 152599 - DNA, 25 bp, Rattus norvegicus
aggtgaatgaggaccagccgaaggt

SEQ ID NO: 152600 - DNA, 25 bp, Rattus norvegicus
aggtgaatgaggtccagccgaaggt

SEQ ID NO: 152601 - DNA, 25 bp, Rattus norvegicus
aggtgaatgctgctgctcaacctac

SEQ ID NO: 152602 - DNA, 25 bp, Rattus norvegicus
aggtgaatgctggtgctcaacctac

SEQ ID NO: 152603 - DNA, 25 bp, Rattus norvegicus
aggtgaatggatccactcctgtgtc

SEQ ID NO: 152604 - DNA, 25 bp, Rattus norvegicus
aggtgaatggatgcactcctgtgtc

SEQ ID NO: 152605 - DNA, 25 bp, Rattus norvegicus
aggtgaattcccaggagtgtttctt

SEQ ID NO: 152606 - DNA, 25 bp, Rattus norvegicus
aggtgaattccctggagtgtttctt

SEQ ID NO: 152607 - DNA, 25 bp, Rattus norvegicus
aggtgacaacctccgggagtcagtt

SEQ ID NO: 152608 - DNA, 25 bp, Rattus norvegicus
aggtgacaacctgcgggagtcagtt

SEQ ID NO: 152609 - DNA, 25 bp, Rattus norvegicus
aggtgacaagagctgctgctttttt

SEQ ID NO: 152610 - DNA, 25 bp, Rattus norvegicus
aggtgacaagaggtgctgctttttt

SEQ ID NO: 152611 - DNA, 25 bp, Rattus norvegicus
aggtgacaatccctctttttgatca

SEQ ID NO: 152612 - DNA, 25 bp, Rattus norvegicus
aggtgacaatccgtctttttgatca

SEQ ID NO: 152613 - DNA, 25 bp, Rattus norvegicus
aggtgacacaacctacagctgaggt

SEQ ID NO: 152614 - DNA, 25 bp, Rattus norvegicus
aggtgacacaacgtacagctgaggt

SEQ ID NO: 152615 - DNA, 25 bp, Rattus norvegicus
aggtgacacagcagcctctgcaagg

SEQ ID NO: 152616 - DNA, 25 bp, Rattus norvegicus
aggtgacacagctgcctctgcaagg

SEQ ID NO: 152617 - DNA, 25 bp, Rattus norvegicus
aggtgacacctaacattggcatggt

SEQ ID NO: 152618 - DNA, 25 bp, Rattus norvegicus
aggtgacacctatcattggcatggt

SEQ ID NO: 152619 - DNA, 25 bp, Rattus norvegicus
aggtgacactgcagcgggttcagct

SEQ ID NO: 152620 - DNA, 25 bp, Rattus norvegicus
aggtgacactgctgcgggttcagct

SEQ ID NO: 152621 - DNA, 25 bp, Rattus norvegicus
aggtgacactgtaacactgtagcct

SEQ ID NO: 152622 - DNA, 25 bp, Rattus norvegicus
aggtgacactgtaggagtctcttct

SEQ ID NO: 152623 - DNA, 25 bp, Rattus norvegicus
aggtgacactgttacactgtagcct

SEQ ID NO: 152624 - DNA, 25 bp, Rattus norvegicus
aggtgacactgttggagtctcttct

SEQ ID NO: 152625 - DNA, 25 bp, Rattus norvegicus
aggtgacacttactcctgcataagg

SEQ ID NO: 152626 - DNA, 25 bp, Rattus norvegicus
aggtgacacttagtcctgcataagg

SEQ ID NO: 152627 - DNA, 25 bp, Rattus norvegicus
aggtgacagaggagtccagcttcca

SEQ ID NO: 152628 - DNA, 25 bp, Rattus norvegicus
aggtgacagaggtgtccagcttcca

SEQ ID NO: 152629 - DNA, 25 bp, Rattus norvegicus
aggtgacagcccaactctcaaaaag

SEQ ID NO: 152630 - DNA, 25 bp, Rattus norvegicus
aggtgacagccctactctcaaaaag

SEQ ID NO: 152631 - DNA, 25 bp, Rattus norvegicus
aggtgacagctgagcctcaatcaag

SEQ ID NO: 152632 - DNA, 25 bp, Rattus norvegicus
aggtgacagctgtgcctcaatcaag

SEQ ID NO: 152633 - DNA, 25 bp, Rattus norvegicus
aggtgacatcacacattcacacgct

SEQ ID NO: 152634 - DNA, 25 bp, Rattus norvegicus
aggtgacatcactcattcacacgct

SEQ ID NO: 152635 - DNA, 25 bp, Rattus norvegicus
aggtgacatcgaacaccactccctt

SEQ ID NO: 152636 - DNA, 25 bp, Rattus norvegicus
aggtgacatcgatcaccactccctt

SEQ ID NO: 152637 - DNA, 25 bp, Rattus norvegicus
aggtgacatgcgagttccagcggac

SEQ ID NO: 152638 - DNA, 25 bp, Rattus norvegicus
aggtgacatgcgtgttccagcggac

SEQ ID NO: 152639 - DNA, 25 bp, Rattus norvegicus
aggtgaccaccaattcctgcaaaca

SEQ ID NO: 152640 - DNA, 25 bp, Rattus norvegicus
aggtgaccaccatttcctgcaaaca

SEQ ID NO: 152641 - DNA, 25 bp, Rattus norvegicus
aggtgacccagaaaaatgcagagac

SEQ ID NO: 152642 - DNA, 25 bp, Rattus norvegicus
aggtgacccagataaatgcagagac

SEQ ID NO: 152643 - DNA, 25 bp, Rattus norvegicus
aggtgaccccacaatgcttgattgt

SEQ ID NO: 152644 - DNA, 25 bp, Rattus norvegicus
aggtgaccccactatgcttgattgt

SEQ ID NO: 152645 - DNA, 25 bp, Rattus norvegicus
aggtgaccccgacgccttcaaggct

SEQ ID NO: 152646 - DNA, 25 bp, Rattus norvegicus
aggtgaccccgaggccttcaaggct

SEQ ID NO: 152647 - DNA, 25 bp, Rattus norvegicus
aggtgacccttcattgctacttaag

SEQ ID NO: 152648 - DNA, 25 bp, Rattus norvegicus
aggtgacccttctttgctacttaag

SEQ ID NO: 152649 - DNA, 25 bp, Rattus norvegicus
aggtgacccttgaaggtgactgctc

SEQ ID NO: 152650 - DNA, 25 bp, Rattus norvegicus
aggtgacccttgtaggtgactgctc

SEQ ID NO: 152651 - DNA, 25 bp, Rattus norvegicus
aggtgaccctttactgtcccaggag

SEQ ID NO: 152652 - DNA, 25 bp, Rattus norvegicus
aggtgacccttttctgtcccaggag

SEQ ID NO: 152653 - DNA, 25 bp, Rattus norvegicus
aggtgaccgattacatcaagtttgg

SEQ ID NO: 152654 - DNA, 25 bp, Rattus norvegicus
aggtgaccgatttcatcaagtttgg

SEQ ID NO: 152655 - DNA, 25 bp, Rattus norvegicus
aggtgaccgggcagcaagttcttgc

SEQ ID NO: 152656 - DNA, 25 bp, Rattus norvegicus
aggtgaccgggctgcaagttcttgc

SEQ ID NO: 152657 - DNA, 25 bp, Rattus norvegicus
aggtgacctaatctctgagcgtctt

SEQ ID NO: 152658 - DNA, 25 bp, Rattus norvegicus
aggtgacctaatgtctgagcgtctt

SEQ ID NO: 152659 - DNA, 25 bp, Rattus norvegicus
aggtgacctcgaacagtgccattta

SEQ ID NO: 152660 - DNA, 25 bp, Rattus norvegicus
aggtgacctcgatcagtgccattta

SEQ ID NO: 152661 - DNA, 25 bp, Rattus norvegicus
aggtgacctctcctgggacatgttc

SEQ ID NO: 152662 - DNA, 25 bp, Rattus norvegicus
aggtgacctctcgtgggacatgttc

SEQ ID NO: 152663 - DNA, 25 bp, Rattus norvegicus
aggtgacctgctagaggaggcttca

SEQ ID NO: 152664 - DNA, 25 bp, Rattus norvegicus
aggtgacctgcttgaggaggcttca

SEQ ID NO: 152665 - DNA, 25 bp, Rattus norvegicus
aggtgacctggtcctgtcggactaa

SEQ ID NO: 152666 - DNA, 25 bp, Rattus norvegicus
aggtgacctggtgctgtcggactaa

SEQ ID NO: 152667 - DNA, 25 bp, Rattus norvegicus
aggtgaccttctccagtccctctga

SEQ ID NO: 152668 - DNA, 25 bp, Rattus norvegicus
aggtgaccttctgcagtccctctga

SEQ ID NO: 152669 - DNA, 25 bp, Rattus norvegicus
aggtgaccttttctgggctggcact

SEQ ID NO: 152670 - DNA, 25 bp, Rattus norvegicus
aggtgaccttttgtgggctggcact

SEQ ID NO: 152671 - DNA, 25 bp, Rattus norvegicus
aggtgacgcagtacaagaagggcaa

SEQ ID NO: 152672 - DNA, 25 bp, Rattus norvegicus
aggtgacgcagttcaagaagggcaa

SEQ ID NO: 152673 - DNA, 25 bp, Rattus norvegicus
aggtgacgtcacatctcttaaacgc

SEQ ID NO: 152674 - DNA, 25 bp, Rattus norvegicus
aggtgacgtcacttctcttaaacgc

SEQ ID NO: 152675 - DNA, 25 bp, Rattus norvegicus
aggtgacgtccacggatcaatgctt

SEQ ID NO: 152676 - DNA, 25 bp, Rattus norvegicus
aggtgacgtccagggatcaatgctt

SEQ ID NO: 152677 - DNA, 25 bp, Rattus norvegicus
aggtgactacttagggatcctcaag

SEQ ID NO: 152678 - DNA, 25 bp, Rattus norvegicus
aggtgactactttgggatcctcaag

SEQ ID NO: 152679 - DNA, 25 bp, Rattus norvegicus
aggtgactatgaccatctcccggaa

SEQ ID NO: 152680 - DNA, 25 bp, Rattus norvegicus
aggtgactatgagcatctcccggaa

SEQ ID NO: 152681 - DNA, 25 bp, Rattus norvegicus
aggtgactcacaccccaagagccgt

SEQ ID NO: 152682 - DNA, 25 bp, Rattus norvegicus
aggtgactcacagcccaagagccgt

SEQ ID NO: 152683 - DNA, 25 bp, Rattus norvegicus
aggtgactcatcctgggaactggct

SEQ ID NO: 152684 - DNA, 25 bp, Rattus norvegicus
aggtgactcatcgtgggaactggct

SEQ ID NO: 152685 - DNA, 25 bp, Rattus norvegicus
aggtgactccataatcttgtgctgc

SEQ ID NO: 152686 - DNA, 25 bp, Rattus norvegicus
aggtgactccattatcttgtgctgc

SEQ ID NO: 152687 - DNA, 25 bp, Rattus norvegicus
aggtgactcctgaagagccaatcag

SEQ ID NO: 152688 - DNA, 25 bp, Rattus norvegicus
aggtgactcctgagattctgtcctt

SEQ ID NO: 152689 - DNA, 25 bp, Rattus norvegicus
aggtgactcctgtagagccaatcag

SEQ ID NO: 152690 - DNA, 25 bp, Rattus norvegicus
aggtgactcctgtgattctgtcctt

SEQ ID NO: 152691 - DNA, 25 bp, Rattus norvegicus
aggtgactccttctagctggcattt

SEQ ID NO: 152692 - DNA, 25 bp, Rattus norvegicus
aggtgactccttgtagctggcattt

SEQ ID NO: 152693 - DNA, 25 bp, Rattus norvegicus
aggtgactctcacagccagaacatt

SEQ ID NO: 152694 - DNA, 25 bp, Rattus norvegicus
aggtgactctcagagccagaacatt

SEQ ID NO: 152695 - DNA, 25 bp, Rattus norvegicus
aggtgactctgccatggccttagca

SEQ ID NO: 152696 - DNA, 25 bp, Rattus norvegicus
aggtgactctgcgatggccttagca

SEQ ID NO: 152697 - DNA, 25 bp, Rattus norvegicus
aggtgactcttacgccccagaacca

SEQ ID NO: 152698 - DNA, 25 bp, Rattus norvegicus
aggtgactcttaggccccagaacca

SEQ ID NO: 152699 - DNA, 25 bp, Rattus norvegicus
aggtgactctttatccagcatgtgg

SEQ ID NO: 152700 - DNA, 25 bp, Rattus norvegicus
aggtgactctttttccagcatgtgg

SEQ ID NO: 152701 - DNA, 25 bp, Rattus norvegicus
aggtgactgaccaccagtggatggt

SEQ ID NO: 152702 - DNA, 25 bp, Rattus norvegicus
aggtgactgacctccagtggatggt

SEQ ID NO: 152703 - DNA, 25 bp, Rattus norvegicus
aggtgactgcctcgatttctgtgtc

SEQ ID NO: 152704 - DNA, 25 bp, Rattus norvegicus
aggtgactgcctggatttctgtgtc

SEQ ID NO: 152705 - DNA, 25 bp, Rattus norvegicus
aggtgactgcgtacgcggcgacggt

SEQ ID NO: 152706 - DNA, 25 bp, Rattus norvegicus
aggtgactgcgttcgcggcgacggt

SEQ ID NO: 152707 - DNA, 25 bp, Rattus norvegicus
aggtgactgtgaagctggtggtggt

SEQ ID NO: 152708 - DNA, 25 bp, Rattus norvegicus
aggtgactgtgatgctggtggtggt

SEQ ID NO: 152709 - DNA, 25 bp, Rattus norvegicus
aggtgactgtttagtgccagcctcg

SEQ ID NO: 152710 - DNA, 25 bp, Rattus norvegicus
aggtgactgttttgtgccagcctcg

SEQ ID NO: 152711 - DNA, 25 bp, Rattus norvegicus
aggtgacttcataccgctccaaaga

SEQ ID NO: 152712 - DNA, 25 bp, Rattus norvegicus
aggtgacttcattccgctccaaaga

SEQ ID NO: 152713 - DNA, 25 bp, Rattus norvegicus
aggtgacttggccatctagccacag

SEQ ID NO: 152714 - DNA, 25 bp, Rattus norvegicus
aggtgacttggcgatctagccacag

SEQ ID NO: 152715 - DNA, 25 bp, Rattus norvegicus
aggtgactttagatgggcttgccca

SEQ ID NO: 152716 - DNA, 25 bp, Rattus norvegicus
aggtgactttagttgggcttgccca

SEQ ID NO: 152717 - DNA, 25 bp, Rattus norvegicus
aggtgactttgcaagtaaaactgac

SEQ ID NO: 152718 - DNA, 25 bp, Rattus norvegicus
aggtgactttgctagtaaaactgac

SEQ ID NO: 152719 - DNA, 25 bp, Rattus norvegicus
aggtgacttttcaaatgctgggttt

SEQ ID NO: 152720 - DNA, 25 bp, Rattus norvegicus
aggtgacttttctaatgctgggttt

SEQ ID NO: 152721 - DNA, 25 bp, Rattus norvegicus
aggtgagaacagcaagcccggcctt

SEQ ID NO: 152722 - DNA, 25 bp, Rattus norvegicus
aggtgagaacaggaagcccggcctt

SEQ ID NO: 152723 - DNA, 25 bp, Rattus norvegicus
aggtgagaaggacccagctctgact

SEQ ID NO: 152724 - DNA, 25 bp, Rattus norvegicus
aggtgagaaggagccagctctgact

SEQ ID NO: 152725 - DNA, 25 bp, Rattus norvegicus
aggtgagaatgaccctccctacatt

SEQ ID NO: 152726 - DNA, 25 bp, Rattus norvegicus
aggtgagaatgagcctccctacatt

SEQ ID NO: 152727 - DNA, 25 bp, Rattus norvegicus
aggtgagaatgcaccttctctcgga

SEQ ID NO: 152728 - DNA, 25 bp, Rattus norvegicus
aggtgagaatgctccttctctcgga

SEQ ID NO: 152729 - DNA, 25 bp, Rattus norvegicus
aggtgagacctgagctgtcccagtg

SEQ ID NO: 152730 - DNA, 25 bp, Rattus norvegicus
aggtgagacctgtgctgtcccagtg

SEQ ID NO: 152731 - DNA, 25 bp, Rattus norvegicus
aggtgagagaccctcttcattactc

SEQ ID NO: 152732 - DNA, 25 bp, Rattus norvegicus
aggtgagagaccgtcttcattactc

SEQ ID NO: 152733 - DNA, 25 bp, Rattus norvegicus
aggtgagaggccataccgctgtcct

SEQ ID NO: 152734 - DNA, 25 bp, Rattus norvegicus
aggtgagaggccttaccgctgtcct

SEQ ID NO: 152735 - DNA, 25 bp, Rattus norvegicus
aggtgagattccagtttccagacaa

SEQ ID NO: 152736 - DNA, 25 bp, Rattus norvegicus
aggtgagattcctgtttccagacaa

SEQ ID NO: 152737 - DNA, 25 bp, Rattus norvegicus
aggtgagattgcacaacatccgcct

SEQ ID NO: 152738 - DNA, 25 bp, Rattus norvegicus
aggtgagattgctcaacatccgcct

SEQ ID NO: 152739 - DNA, 25 bp, Rattus norvegicus
aggtgagcaacgagactcgcaccgc

SEQ ID NO: 152740 - DNA, 25 bp, Rattus norvegicus
aggtgagcaacgtgactcgcaccgc

SEQ ID NO: 152741 - DNA, 25 bp, Rattus norvegicus
aggtgagcacgacgcggttcccttc

SEQ ID NO: 152742 - DNA, 25 bp, Rattus norvegicus
aggtgagcacgaggcggttcccttc

SEQ ID NO: 152743 - DNA, 25 bp, Rattus norvegicus
aggtgagcactcatctgaaggctcc

SEQ ID NO: 152744 - DNA, 25 bp, Rattus norvegicus
aggtgagcactcttctgaaggctcc

SEQ ID NO: 152745 - DNA, 25 bp, Rattus norvegicus
aggtgagcacttagctacggagcct

SEQ ID NO: 152746 - DNA, 25 bp, Rattus norvegicus
aggtgagcactttgctacggagcct

SEQ ID NO: 152747 - DNA, 25 bp, Rattus norvegicus
aggtgagcagccacaagcagtctga

SEQ ID NO: 152748 - DNA, 25 bp, Rattus norvegicus
aggtgagcagcctcaagcagtctga

SEQ ID NO: 152749 - DNA, 25 bp, Rattus norvegicus
aggtgagcagctatcagccgatgca

SEQ ID NO: 152750 - DNA, 25 bp, Rattus norvegicus
aggtgagcagctttcagccgatgca

SEQ ID NO: 152751 - DNA, 25 bp, Rattus norvegicus
aggtgagccagaccgcccagctgct

SEQ ID NO: 152752 - DNA, 25 bp, Rattus norvegicus
aggtgagccagagcgcccagctgct

SEQ ID NO: 152753 - DNA, 25 bp, Rattus norvegicus
aggtgagcctcaagactaagccaga

SEQ ID NO: 152754 - DNA, 25 bp, Rattus norvegicus
aggtgagcctcatgactaagccaga

SEQ ID NO: 152755 - DNA, 25 bp, Rattus norvegicus
aggtgagcctgcaaccaagtcagta

SEQ ID NO: 152756 - DNA, 25 bp, Rattus norvegicus
aggtgagcctgctaccaagtcagta

SEQ ID NO: 152757 - DNA, 25 bp, Rattus norvegicus
aggtgagcctgtcttttgatagtgt

SEQ ID NO: 152758 - DNA, 25 bp, Rattus norvegicus
aggtgagcctgtgttttgatagtgt

SEQ ID NO: 152759 - DNA, 25 bp, Rattus norvegicus
aggtgagcgtgcctctgtaatccct

SEQ ID NO: 152760 - DNA, 25 bp, Rattus norvegicus
aggtgagcgtgcgtctgtaatccct

SEQ ID NO: 152761 - DNA, 25 bp, Rattus norvegicus
aggtgagcgtttcaagctgtctcca

SEQ ID NO: 152762 - DNA, 25 bp, Rattus norvegicus
aggtgagcgtttgaagctgtctcca

SEQ ID NO: 152763 - DNA, 25 bp, Rattus norvegicus
aggtgagctagccacgcttactgac

SEQ ID NO: 152764 - DNA, 25 bp, Rattus norvegicus
aggtgagctagcgacgcttactgac

SEQ ID NO: 152765 - DNA, 25 bp, Rattus norvegicus
aggtgagctctgagactcctgagta

SEQ ID NO: 152766 - DNA, 25 bp, Rattus norvegicus
aggtgagctctgtgactcctgagta

SEQ ID NO: 152767 - DNA, 25 bp, Rattus norvegicus
aggtgagcttgtacagccacagccg

SEQ ID NO: 152768 - DNA, 25 bp, Rattus norvegicus
aggtgagcttgttcagccacagccg

SEQ ID NO: 152769 - DNA, 25 bp, Rattus norvegicus
aggtgaggaactaccagcagccttc

SEQ ID NO: 152770 - DNA, 25 bp, Rattus norvegicus
aggtgaggaacttccagcagccttc

SEQ ID NO: 152771 - DNA, 25 bp, Rattus norvegicus
aggtgaggacctcctcctcaatgct

SEQ ID NO: 152772 - DNA, 25 bp, Rattus norvegicus
aggtgaggacctgctcctcaatgct

SEQ ID NO: 152773 - DNA, 25 bp, Rattus norvegicus
aggtgaggcagaatgacgcttgttc

SEQ ID NO: 152774 - DNA, 25 bp, Rattus norvegicus
aggtgaggcagattgacgcttgttc

SEQ ID NO: 152775 - DNA, 25 bp, Rattus norvegicus
aggtgaggcagtcctttgaccttcg

SEQ ID NO: 152776 - DNA, 25 bp, Rattus norvegicus
aggtgaggcagtgctttgaccttcg

SEQ ID NO: 152777 - DNA, 25 bp, Rattus norvegicus
aggtgaggcgccagagttcgaatct

SEQ ID NO: 152778 - DNA, 25 bp, Rattus norvegicus
aggtgaggcgcctgagttcgaatct

SEQ ID NO: 152779 - DNA, 25 bp, Rattus norvegicus
aggtgaggcttcctttgtgtcttcc

SEQ ID NO: 152780 - DNA, 25 bp, Rattus norvegicus
aggtgaggcttcgtttgtgtcttcc

SEQ ID NO: 152781 - DNA, 25 bp, Rattus norvegicus
aggtgagggcccaacagtcaggtct

SEQ ID NO: 152782 - DNA, 25 bp, Rattus norvegicus
aggtgagggccctacagtcaggtct

SEQ ID NO: 152783 - DNA, 25 bp, Rattus norvegicus
aggtgagggctcctttcagcacata

SEQ ID NO: 152784 - DNA, 25 bp, Rattus norvegicus
aggtgagggctcgtttcagcacata

SEQ ID NO: 152785 - DNA, 25 bp, Rattus norvegicus
aggtgaggtactcctttcatgaccc

SEQ ID NO: 152786 - DNA, 25 bp, Rattus norvegicus
aggtgaggtactgctttcatgaccc

SEQ ID NO: 152787 - DNA, 25 bp, Rattus norvegicus
aggtgaggtttcagttcctgggctc

SEQ ID NO: 152788 - DNA, 25 bp, Rattus norvegicus
aggtgaggtttctgttcctgggctc

SEQ ID NO: 152789 - DNA, 25 bp, Rattus norvegicus
aggtgagtccataatcgtcgtggca

SEQ ID NO: 152790 - DNA, 25 bp, Rattus norvegicus
aggtgagtccattatcgtcgtggca

SEQ ID NO: 152791 - DNA, 25 bp, Rattus norvegicus
aggtgagtccccatagagcttgtaa

SEQ ID NO: 152792 - DNA, 25 bp, Rattus norvegicus
aggtgagtccccttagagcttgtaa

SEQ ID NO: 152793 - DNA, 25 bp, Rattus norvegicus
aggtgagtccttacctcagctgtga

SEQ ID NO: 152794 - DNA, 25 bp, Rattus norvegicus
aggtgagtcctttcctcagctgtga

SEQ ID NO: 152795 - DNA, 25 bp, Rattus norvegicus
aggtgagtgcataagctactggcta

SEQ ID NO: 152796 - DNA, 25 bp, Rattus norvegicus
aggtgagtgcattagctactggcta

SEQ ID NO: 152797 - DNA, 25 bp, Rattus norvegicus
aggtgagtggatcctttttctccaa

SEQ ID NO: 152798 - DNA, 25 bp, Rattus norvegicus
aggtgagtggatgctttttctccaa

SEQ ID NO: 152799 - DNA, 25 bp, Rattus norvegicus
aggtgagttctgaactgtccattct

SEQ ID NO: 152800 - DNA, 25 bp, Rattus norvegicus
aggtgagttctgtactgtccattct

SEQ ID NO: 152801 - DNA, 25 bp, Rattus norvegicus
aggtgagttgaccatccactgagga

SEQ ID NO: 152802 - DNA, 25 bp, Rattus norvegicus
aggtgagttgacgatccactgagga

SEQ ID NO: 152803 - DNA, 25 bp, Rattus norvegicus
aggtgagttgtaaatcctctctgca

SEQ ID NO: 152804 - DNA, 25 bp, Rattus norvegicus
aggtgagttgtatatcctctctgca

SEQ ID NO: 152805 - DNA, 25 bp, Rattus norvegicus
aggtgataccagatgagaccccgtc

SEQ ID NO: 152806 - DNA, 25 bp, Rattus norvegicus
aggtgataccagttgagaccccgtc

SEQ ID NO: 152807 - DNA, 25 bp, Rattus norvegicus
aggtgatactacagaggtgccccaa

SEQ ID NO: 152808 - DNA, 25 bp, Rattus norvegicus
aggtgatactactgaggtgccccaa

SEQ ID NO: 152809 - DNA, 25 bp, Rattus norvegicus
aggtgatagccaagcacagccagtt

SEQ ID NO: 152810 - DNA, 25 bp, Rattus norvegicus
aggtgatagccatgcacagccagtt

SEQ ID NO: 152811 - DNA, 25 bp, Rattus norvegicus
aggtgatcaataccagccgacccgc

SEQ ID NO: 152812 - DNA, 25 bp, Rattus norvegicus
aggtgatcaatagcagccgacccgc

SEQ ID NO: 152813 - DNA, 25 bp, Rattus norvegicus
aggtgatcactgacattgcaattgc

SEQ ID NO: 152814 - DNA, 25 bp, Rattus norvegicus
aggtgatcactgtcattgcaattgc

SEQ ID NO: 152815 - DNA, 25 bp, Rattus norvegicus
aggtgatcatatacttccatccaca

SEQ ID NO: 152816 - DNA, 25 bp, Rattus norvegicus
aggtgatcatattcttccatccaca

SEQ ID NO: 152817 - DNA, 25 bp, Rattus norvegicus
aggtgatcattcaggaatcctcaaa

SEQ ID NO: 152818 - DNA, 25 bp, Rattus norvegicus
aggtgatcattctggaatcctcaaa

SEQ ID NO: 152819 - DNA, 25 bp, Rattus norvegicus
aggtgatccaatacccttgttgggc

SEQ ID NO: 152820 - DNA, 25 bp, Rattus norvegicus
aggtgatccaattcccttgttgggc

SEQ ID NO: 152821 - DNA, 25 bp, Rattus norvegicus
aggtgatcgtatcaggtcgccaaga

SEQ ID NO: 152822 - DNA, 25 bp, Rattus norvegicus
aggtgatcgtatgaggtcgccaaga

SEQ ID NO: 152823 - DNA, 25 bp, Rattus norvegicus
aggtgatcgtgcagcgtggacttct

SEQ ID NO: 152824 - DNA, 25 bp, Rattus norvegicus
aggtgatcgtgctgcgtggacttct

SEQ ID NO: 152825 - DNA, 25 bp, Rattus norvegicus
aggtgatctccacctattcggacat

SEQ ID NO: 152826 - DNA, 25 bp, Rattus norvegicus
aggtgatctccagctattcggacat

SEQ ID NO: 152827 - DNA, 25 bp, Rattus norvegicus
aggtgatctcgaactggaacgggtt

SEQ ID NO: 152828 - DNA, 25 bp, Rattus norvegicus
aggtgatctcgatctggaacgggtt

SEQ ID NO: 152829 - DNA, 25 bp, Rattus norvegicus
aggtgatctggaacgtagcctccaa

SEQ ID NO: 152830 - DNA, 25 bp, Rattus norvegicus
aggtgatctggatcgtagcctccaa

SEQ ID NO: 152831 - DNA, 25 bp, Rattus norvegicus
aggtgatgatttctttttagcagac

SEQ ID NO: 152832 - DNA, 25 bp, Rattus norvegicus
aggtgatgatttgtttttagcagac

SEQ ID NO: 152833 - DNA, 25 bp, Rattus norvegicus
aggtgatgcacacgctggctgtcta

SEQ ID NO: 152834 - DNA, 25 bp, Rattus norvegicus
aggtgatgcacaggctggctgtcta

SEQ ID NO: 152835 - DNA, 25 bp, Rattus norvegicus
aggtgatgctacagttgttattaac

SEQ ID NO: 152836 - DNA, 25 bp, Rattus norvegicus
aggtgatgctactgttgttattaac

SEQ ID NO: 152837 - DNA, 25 bp, Rattus norvegicus
aggtgatggatgatttcctccggtt

SEQ ID NO: 152838 - DNA, 25 bp, Rattus norvegicus
aggtgatggatgttttcctccggtt

SEQ ID NO: 152839 - DNA, 25 bp, Rattus norvegicus
aggtgatggccaacccggaacagat

SEQ ID NO: 152840 - DNA, 25 bp, Rattus norvegicus
aggtgatggccatcccggaacagat

SEQ ID NO: 152841 - DNA, 25 bp, Rattus norvegicus
aggtgatgggcccttttcctgagca

SEQ ID NO: 152842 - DNA, 25 bp, Rattus norvegicus
aggtgatgggccgttttcctgagca

SEQ ID NO: 152843 - DNA, 25 bp, Rattus norvegicus
aggtgatgtagcatctccacggcgg

SEQ ID NO: 152844 - DNA, 25 bp, Rattus norvegicus
aggtgatgtagcttctccacggcgg

SEQ ID NO: 152845 - DNA, 25 bp, Rattus norvegicus
aggtgatgtcatccaccctggtgac

SEQ ID NO: 152846 - DNA, 25 bp, Rattus norvegicus
aggtgatgtcatgcaccctggtgac

SEQ ID NO: 152847 - DNA, 25 bp, Rattus norvegicus
aggtgattataacctccctgtgacc

SEQ ID NO: 152848 - DNA, 25 bp, Rattus norvegicus
aggtgattataagctccctgtgacc

SEQ ID NO: 152849 - DNA, 25 bp, Rattus norvegicus
aggtgattcacacgcatacacatcc

SEQ ID NO: 152850 - DNA, 25 bp, Rattus norvegicus
aggtgattcacaggcatacacatcc

SEQ ID NO: 152851 - DNA, 25 bp, Rattus norvegicus
aggtgattccatatcaacgcggctg

SEQ ID NO: 152852 - DNA, 25 bp, Rattus norvegicus
aggtgattccatttcaacgcggctg

SEQ ID NO: 152853 - DNA, 25 bp, Rattus norvegicus
aggtgattcccaatatctgagcagt

SEQ ID NO: 152854 - DNA, 25 bp, Rattus norvegicus
aggtgattcccattatctgagcagt

SEQ ID NO: 152855 - DNA, 25 bp, Rattus norvegicus
aggtgattcgaaattctgccagaag

SEQ ID NO: 152856 - DNA, 25 bp, Rattus norvegicus
aggtgattcgaatttctgccagaag

SEQ ID NO: 152857 - DNA, 25 bp, Rattus norvegicus
aggtgattctgacagggtccccaaa

SEQ ID NO: 152858 - DNA, 25 bp, Rattus norvegicus
aggtgattctgagagggtccccaaa

SEQ ID NO: 152859 - DNA, 25 bp, Rattus norvegicus
aggtgattgctgacaaccccgaagg

SEQ ID NO: 152860 - DNA, 25 bp, Rattus norvegicus
aggtgattgctgtcaaccccgaagg

SEQ ID NO: 152861 - DNA, 25 bp, Rattus norvegicus
aggtgattgggtctcatagcctttc

SEQ ID NO: 152862 - DNA, 25 bp, Rattus norvegicus
aggtgattgggtgtcatagcctttc

SEQ ID NO: 152863 - DNA, 25 bp, Rattus norvegicus
aggtgatttgctcagtttcctgtgc

SEQ ID NO: 152864 - DNA, 25 bp, Rattus norvegicus
aggtgatttgctgagtttcctgtgc

SEQ ID NO: 152865 - DNA, 25 bp, Rattus norvegicus
aggtgcaaactgaggtccttcagaa

SEQ ID NO: 152866 - DNA, 25 bp, Rattus norvegicus
aggtgcaaactgtggtccttcagaa

SEQ ID NO: 152867 - DNA, 25 bp, Rattus norvegicus
aggtgcaaagcccagcgactctgag

SEQ ID NO: 152868 - DNA, 25 bp, Rattus norvegicus
aggtgcaaagccgagcgactctgag

SEQ ID NO: 152869 - DNA, 25 bp, Rattus norvegicus
aggtgcaaatcaaccctcagattct

SEQ ID NO: 152870 - DNA, 25 bp, Rattus norvegicus
aggtgcaaatcatccctcagattct

SEQ ID NO: 152871 - DNA, 25 bp, Rattus norvegicus
aggtgcaacaagcaccctaccagag

SEQ ID NO: 152872 - DNA, 25 bp, Rattus norvegicus
aggtgcaacaaggaccctaccagag

SEQ ID NO: 152873 - DNA, 25 bp, Rattus norvegicus
aggtgcaaccaactgttcggctctg

SEQ ID NO: 152874 - DNA, 25 bp, Rattus norvegicus
aggtgcaaccaagtgttcggctctg

SEQ ID NO: 152875 - DNA, 25 bp, Rattus norvegicus
aggtgcaaccttataatgtgacgaa

SEQ ID NO: 152876 - DNA, 25 bp, Rattus norvegicus
aggtgcaaccttttaatgtgacgaa

SEQ ID NO: 152877 - DNA, 25 bp, Rattus norvegicus
aggtgcaagcaccagtttgccacca

SEQ ID NO: 152878 - DNA, 25 bp, Rattus norvegicus
aggtgcaagcacgagtttgccacca

SEQ ID NO: 152879 - DNA, 25 bp, Rattus norvegicus
aggtgcaaggacagagccacttcac

SEQ ID NO: 152880 - DNA, 25 bp, Rattus norvegicus
aggtgcaaggactgagccacttcac

SEQ ID NO: 152881 - DNA, 25 bp, Rattus norvegicus
aggtgcaaggcaactttttctggcc

SEQ ID NO: 152882 - DNA, 25 bp, Rattus norvegicus
aggtgcaaggcatctttttctggcc

SEQ ID NO: 152883 - DNA, 25 bp, Rattus norvegicus
aggtgcaaggctcctagcatgtagt

SEQ ID NO: 152884 - DNA, 25 bp, Rattus norvegicus
aggtgcaaggctgctagcatgtagt

SEQ ID NO: 152885 - DNA, 25 bp, Rattus norvegicus
aggtgcaatcaaagctactagtttt

SEQ ID NO: 152886 - DNA, 25 bp, Rattus norvegicus
aggtgcaatcaatgctactagtttt

SEQ ID NO: 152887 - DNA, 25 bp, Rattus norvegicus
aggtgcaattgaacgtttggttaac

SEQ ID NO: 152888 - DNA, 25 bp, Rattus norvegicus
aggtgcaattgatcgtttggttaac

SEQ ID NO: 152889 - DNA, 25 bp, Rattus norvegicus
aggtgcacaggtctataatcccagc

SEQ ID NO: 152890 - DNA, 25 bp, Rattus norvegicus
aggtgcacaggtgtataatcccagc

SEQ ID NO: 152891 - DNA, 25 bp, Rattus norvegicus
aggtgcacatacaagccttcatctt

SEQ ID NO: 152892 - DNA, 25 bp, Rattus norvegicus
aggtgcacatactagccttcatctt

SEQ ID NO: 152893 - DNA, 25 bp, Rattus norvegicus
aggtgcaccacgaactgggtcttca

SEQ ID NO: 152894 - DNA, 25 bp, Rattus norvegicus
aggtgcaccacgtactgggtcttca

SEQ ID NO: 152895 - DNA, 25 bp, Rattus norvegicus
aggtgcaccattccagatcatccga

SEQ ID NO: 152896 - DNA, 25 bp, Rattus norvegicus
aggtgcaccattgcagatcatccga

SEQ ID NO: 152897 - DNA, 25 bp, Rattus norvegicus
aggtgcacccttcaaatacggcttt

SEQ ID NO: 152898 - DNA, 25 bp, Rattus norvegicus
aggtgcacccttgaaatacggcttt

SEQ ID NO: 152899 - DNA, 25 bp, Rattus norvegicus
aggtgcaccggcatggaccgaaaga

SEQ ID NO: 152900 - DNA, 25 bp, Rattus norvegicus
aggtgcaccggcttggaccgaaaga

SEQ ID NO: 152901 - DNA, 25 bp, Rattus norvegicus
aggtgcacctgaagactgccccgga

SEQ ID NO: 152902 - DNA, 25 bp, Rattus norvegicus
aggtgcacctgatgactgccccgga

SEQ ID NO: 152903 - DNA, 25 bp, Rattus norvegicus
aggtgcacgccaccctttgctggag

SEQ ID NO: 152904 - DNA, 25 bp, Rattus norvegicus
aggtgcacgccagcctttgctggag

SEQ ID NO: 152905 - DNA, 25 bp, Rattus norvegicus
aggtgcactctgaccggaacgtcta

SEQ ID NO: 152906 - DNA, 25 bp, Rattus norvegicus
aggtgcactctgtccggaacgtcta

SEQ ID NO: 152907 - DNA, 25 bp, Rattus norvegicus
aggtgcactgtcagtataaattact

SEQ ID NO: 152908 - DNA, 25 bp, Rattus norvegicus
aggtgcactgtctgtataaattact

SEQ ID NO: 152909 - DNA, 25 bp, Rattus norvegicus
aggtgcacttcaacgcactgtgctt

SEQ ID NO: 152910 - DNA, 25 bp, Rattus norvegicus
aggtgcacttcatcgcactgtgctt

SEQ ID NO: 152911 - DNA, 25 bp, Rattus norvegicus
aggtgcacttgtcctcacagcaggg

SEQ ID NO: 152912 - DNA, 25 bp, Rattus norvegicus
aggtgcacttgtgctcacagcaggg

SEQ ID NO: 152913 - DNA, 25 bp, Rattus norvegicus
aggtgcagacacaggagttcccaca

SEQ ID NO: 152914 - DNA, 25 bp, Rattus norvegicus
aggtgcagacactggagttcccaca

SEQ ID NO: 152915 - DNA, 25 bp, Rattus norvegicus
aggtgcagacccctagctctgatga

SEQ ID NO: 152916 - DNA, 25 bp, Rattus norvegicus
aggtgcagacccgtagctctgatga

SEQ ID NO: 152917 - DNA, 25 bp, Rattus norvegicus
aggtgcagagctactagccctggta

SEQ ID NO: 152918 - DNA, 25 bp, Rattus norvegicus
aggtgcagagcttctagccctggta

SEQ ID NO: 152919 - DNA, 25 bp, Rattus norvegicus
aggtgcagatgtactcagtggtaga

SEQ ID NO: 152920 - DNA, 25 bp, Rattus norvegicus
aggtgcagatgttctcagtggtaga

SEQ ID NO: 152921 - DNA, 25 bp, Rattus norvegicus
aggtgcagcagaccattgccatgag

SEQ ID NO: 152922 - DNA, 25 bp, Rattus norvegicus
aggtgcagcagagcattgccatgag

SEQ ID NO: 152923 - DNA, 25 bp, Rattus norvegicus
aggtgcagccccaagtggacgtgtt

SEQ ID NO: 152924 - DNA, 25 bp, Rattus norvegicus
aggtgcagcccctagtggacgtgtt

SEQ ID NO: 152925 - DNA, 25 bp, Rattus norvegicus
aggtgcagctttccccagcagctca

SEQ ID NO: 152926 - DNA, 25 bp, Rattus norvegicus
aggtgcagctttgcccagcagctca

SEQ ID NO: 152927 - DNA, 25 bp, Rattus norvegicus
aggtgcaggcgcatctgcaggacta

SEQ ID NO: 152928 - DNA, 25 bp, Rattus norvegicus
aggtgcaggcgcttctgcaggacta

SEQ ID NO: 152929 - DNA, 25 bp, Rattus norvegicus
aggtgcagtccaagtccaggccgga

SEQ ID NO: 152930 - DNA, 25 bp, Rattus norvegicus
aggtgcagtccatgtccaggccgga

SEQ ID NO: 152931 - DNA, 25 bp, Rattus norvegicus
aggtgcagtgcacaaggtctctaag

SEQ ID NO: 152932 - DNA, 25 bp, Rattus norvegicus
aggtgcagtgcagaaggtctctaag

SEQ ID NO: 152933 - DNA, 25 bp, Rattus norvegicus
aggtgcatcactcaggatgggcttt

SEQ ID NO: 152934 - DNA, 25 bp, Rattus norvegicus
aggtgcatcactgaggatgggcttt

SEQ ID NO: 152935 - DNA, 25 bp, Rattus norvegicus
aggtgcatgccacctcctgggaagc

SEQ ID NO: 152936 - DNA, 25 bp, Rattus norvegicus
aggtgcatgccagctcctgggaagc

SEQ ID NO: 152937 - DNA, 25 bp, Rattus norvegicus
aggtgcatgcctaatcgttgtgata

SEQ ID NO: 152938 - DNA, 25 bp, Rattus norvegicus
aggtgcatgcctatgttaattaact

SEQ ID NO: 152939 - DNA, 25 bp, Rattus norvegicus
aggtgcatgccttatcgttgtgata

SEQ ID NO: 152940 - DNA, 25 bp, Rattus norvegicus
aggtgcatgcctttgttaattaact

SEQ ID NO: 152941 - DNA, 25 bp, Rattus norvegicus
aggtgcattgccattcagactcagt

SEQ ID NO: 152942 - DNA, 25 bp, Rattus norvegicus
aggtgcattgcctttcagactcagt

SEQ ID NO: 152943 - DNA, 25 bp, Rattus norvegicus
aggtgcattgttctcttttccttta

SEQ ID NO: 152944 - DNA, 25 bp, Rattus norvegicus
aggtgcattgttgtcttttccttta

SEQ ID NO: 152945 - DNA, 25 bp, Rattus norvegicus
aggtgccaaacccattcttagattt

SEQ ID NO: 152946 - DNA, 25 bp, Rattus norvegicus
aggtgccaaaccgattcttagattt

SEQ ID NO: 152947 - DNA, 25 bp, Rattus norvegicus
aggtgccaacagacaattgaggaaa

SEQ ID NO: 152948 - DNA, 25 bp, Rattus norvegicus
aggtgccaacagtcaattgaggaaa

SEQ ID NO: 152949 - DNA, 25 bp, Rattus norvegicus
aggtgccaacgacacactttgttcc

SEQ ID NO: 152950 - DNA, 25 bp, Rattus norvegicus
aggtgccaacgagacactttgttcc

SEQ ID NO: 152951 - DNA, 25 bp, Rattus norvegicus
aggtgccaaggcaggcacgagccta

SEQ ID NO: 152952 - DNA, 25 bp, Rattus norvegicus
aggtgccaaggctggcacgagccta

SEQ ID NO: 152953 - DNA, 25 bp, Rattus norvegicus
aggtgccaagggacggattctcaga

SEQ ID NO: 152954 - DNA, 25 bp, Rattus norvegicus
aggtgccaagggattttgtcctctg

SEQ ID NO: 152955 - DNA, 25 bp, Rattus norvegicus
aggtgccaagggtcggattctcaga

SEQ ID NO: 152956 - DNA, 25 bp, Rattus norvegicus
aggtgccaagggtttttgtcctctg

SEQ ID NO: 152957 - DNA, 25 bp, Rattus norvegicus
aggtgccactgaaggtgctgctgcc

SEQ ID NO: 152958 - DNA, 25 bp, Rattus norvegicus
aggtgccactgatggtgctgctgcc

SEQ ID NO: 152959 - DNA, 25 bp, Rattus norvegicus
aggtgccacttcatgtaggctggtc

SEQ ID NO: 152960 - DNA, 25 bp, Rattus norvegicus
aggtgccacttcttgtaggctggtc

SEQ ID NO: 152961 - DNA, 25 bp, Rattus norvegicus
aggtgccagaccatgtggacagcga

SEQ ID NO: 152962 - DNA, 25 bp, Rattus norvegicus
aggtgccagaccttgtggacagcga

SEQ ID NO: 152963 - DNA, 25 bp, Rattus norvegicus
aggtgccagcacaatacatctttac

SEQ ID NO: 152964 - DNA, 25 bp, Rattus norvegicus
aggtgccagcactatacatctttac

SEQ ID NO: 152965 - DNA, 25 bp, Rattus norvegicus
aggtgccagccaatcagtttttcaa

SEQ ID NO: 152966 - DNA, 25 bp, Rattus norvegicus
aggtgccagccattcagtttttcaa

SEQ ID NO: 152967 - DNA, 25 bp, Rattus norvegicus
aggtgccaggaaccagtatctgccc

SEQ ID NO: 152968 - DNA, 25 bp, Rattus norvegicus
aggtgccaggaagcagtatctgccc

SEQ ID NO: 152969 - DNA, 25 bp, Rattus norvegicus
aggtgccataacacagttttccaga

SEQ ID NO: 152970 - DNA, 25 bp, Rattus norvegicus
aggtgccataactcagttttccaga

SEQ ID NO: 152971 - DNA, 25 bp, Rattus norvegicus
aggtgccattgaaaacgctgctctt

SEQ ID NO: 152972 - DNA, 25 bp, Rattus norvegicus
aggtgccattgaacactatgtgaca

SEQ ID NO: 152973 - DNA, 25 bp, Rattus norvegicus
aggtgccattgataacgctgctctt

SEQ ID NO: 152974 - DNA, 25 bp, Rattus norvegicus
aggtgccattgatcactatgtgaca

SEQ ID NO: 152975 - DNA, 25 bp, Rattus norvegicus
aggtgccatttcacagaaggccact

SEQ ID NO: 152976 - DNA, 25 bp, Rattus norvegicus
aggtgccatttctcagaaggccact

SEQ ID NO: 152977 - DNA, 25 bp, Rattus norvegicus
aggtgcccaaggagccatccaaaga

SEQ ID NO: 152978 - DNA, 25 bp, Rattus norvegicus
aggtgcccaaggtgccatccaaaga

SEQ ID NO: 152979 - DNA, 25 bp, Rattus norvegicus
aggtgcccaagtactcagccaaggg

SEQ ID NO: 152980 - DNA, 25 bp, Rattus norvegicus
aggtgcccaagttctcagccaaggg

SEQ ID NO: 152981 - DNA, 25 bp, Rattus norvegicus
aggtgcccagaaactccaaactgta

SEQ ID NO: 152982 - DNA, 25 bp, Rattus norvegicus
aggtgcccagaatctccaaactgta

SEQ ID NO: 152983 - DNA, 25 bp, Rattus norvegicus
aggtgcccagggaagtgcattcgtt

SEQ ID NO: 152984 - DNA, 25 bp, Rattus norvegicus
aggtgcccagggtagtgcattcgtt

SEQ ID NO: 152985 - DNA, 25 bp, Rattus norvegicus
aggtgcccaggtcaaagccacagca

SEQ ID NO: 152986 - DNA, 25 bp, Rattus norvegicus
aggtgcccaggtgaaagccacagca

SEQ ID NO: 152987 - DNA, 25 bp, Rattus norvegicus
aggtgcccattgagagttggtccta

SEQ ID NO: 152988 - DNA, 25 bp, Rattus norvegicus
aggtgcccattgtgagttggtccta

SEQ ID NO: 152989 - DNA, 25 bp, Rattus norvegicus
aggtgcccctatagtgctatcagat

SEQ ID NO: 152990 - DNA, 25 bp, Rattus norvegicus
aggtgcccctattgtgctatcagat

SEQ ID NO: 152991 - DNA, 25 bp, Rattus norvegicus
aggtgcccctgaaacagtgctaaca

SEQ ID NO: 152992 - DNA, 25 bp, Rattus norvegicus
aggtgcccctgatacagtgctaaca

SEQ ID NO: 152993 - DNA, 25 bp, Rattus norvegicus
aggtgcccgtgcacaggcgctataa

SEQ ID NO: 152994 - DNA, 25 bp, Rattus norvegicus
aggtgcccgtgctcaggcgctataa

SEQ ID NO: 152995 - DNA, 25 bp, Rattus norvegicus
aggtgcccgttcatatactaatggt

SEQ ID NO: 152996 - DNA, 25 bp, Rattus norvegicus
aggtgcccgttcttatactaatggt

SEQ ID NO: 152997 - DNA, 25 bp, Rattus norvegicus
aggtgccctaccaaaggaacagctc

SEQ ID NO: 152998 - DNA, 25 bp, Rattus norvegicus
aggtgccctacctaaggaacagctc

SEQ ID NO: 152999 - DNA, 25 bp, Rattus norvegicus
aggtgccctgtgaccaggtgcagaa

SEQ ID NO: 153000 - DNA, 25 bp, Rattus norvegicus
aggtgccctgtgtccaggtgcagaa

SEQ ID NO: 153001 - DNA, 25 bp, Rattus norvegicus
aggtgccgatgccttcttcgaggaa

SEQ ID NO: 153002 - DNA, 25 bp, Rattus norvegicus
aggtgccgatgcgttcttcgaggaa

SEQ ID NO: 153003 - DNA, 25 bp, Rattus norvegicus
aggtgccgcatgactcctgtgtgtg

SEQ ID NO: 153004 - DNA, 25 bp, Rattus norvegicus
aggtgccgcatgtctcctgtgtgtg

SEQ ID NO: 153005 - DNA, 25 bp, Rattus norvegicus
aggtgccgcttgcttcccaggaaag

SEQ ID NO: 153006 - DNA, 25 bp, Rattus norvegicus
aggtgccgcttggttcccaggaaag

SEQ ID NO: 153007 - DNA, 25 bp, Rattus norvegicus
aggtgccgggccagatgtctcaagc

SEQ ID NO: 153008 - DNA, 25 bp, Rattus norvegicus
aggtgccgggcctgatgtctcaagc

SEQ ID NO: 153009 - DNA, 25 bp, Rattus norvegicus
aggtgccgtcaaacagagtctctga

SEQ ID NO: 153010 - DNA, 25 bp, Rattus norvegicus
aggtgccgtcaatcagagtctctga

SEQ ID NO: 153011 - DNA, 25 bp, Rattus norvegicus
aggtgcctacctcgatggacatgct

SEQ ID NO: 153012 - DNA, 25 bp, Rattus norvegicus
aggtgcctacctggatggacatgct

SEQ ID NO: 153013 - DNA, 25 bp, Rattus norvegicus
aggtgcctcaggctttgcgtctcac

SEQ ID NO: 153014 - DNA, 25 bp, Rattus norvegicus
aggtgcctcagggtttgcgtctcac

SEQ ID NO: 153015 - DNA, 25 bp, Rattus norvegicus
aggtgcctcatgatttgtttcatcc

SEQ ID NO: 153016 - DNA, 25 bp, Rattus norvegicus
aggtgcctcatgttttgtttcatcc

SEQ ID NO: 153017 - DNA, 25 bp, Rattus norvegicus
aggtgcctccaaatggtgcttcagc

SEQ ID NO: 153018 - DNA, 25 bp, Rattus norvegicus
aggtgcctccaattggtgcttcagc

SEQ ID NO: 153019 - DNA, 25 bp, Rattus norvegicus
aggtgcctccatatgactcgcatga

SEQ ID NO: 153020 - DNA, 25 bp, Rattus norvegicus
aggtgcctccatttgactcgcatga

SEQ ID NO: 153021 - DNA, 25 bp, Rattus norvegicus
aggtgcctcctcatgtcagggtgac

SEQ ID NO: 153022 - DNA, 25 bp, Rattus norvegicus
aggtgcctcctcttgtcagggtgac

SEQ ID NO: 153023 - DNA, 25 bp, Rattus norvegicus
aggtgcctcttgcacttggacttgc

SEQ ID NO: 153024 - DNA, 25 bp, Rattus norvegicus
aggtgcctcttggacttggacttgc

SEQ ID NO: 153025 - DNA, 25 bp, Rattus norvegicus
aggtgcctgaacatgctatgctgcg

SEQ ID NO: 153026 - DNA, 25 bp, Rattus norvegicus
aggtgcctgaacttgctatgctgcg

SEQ ID NO: 153027 - DNA, 25 bp, Rattus norvegicus
aggtgcctgcgaagcctccatcaag

SEQ ID NO: 153028 - DNA, 25 bp, Rattus norvegicus
aggtgcctgcgatgcctccatcaag

SEQ ID NO: 153029 - DNA, 25 bp, Rattus norvegicus
aggtgcctgctgatgaactcttgag

SEQ ID NO: 153030 - DNA, 25 bp, Rattus norvegicus
aggtgcctgctgttgaactcttgag

SEQ ID NO: 153031 - DNA, 25 bp, Rattus norvegicus
aggtgccttaccaacgtgtgctctt

SEQ ID NO: 153032 - DNA, 25 bp, Rattus norvegicus
aggtgccttacctacgtgtgctctt

SEQ ID NO: 153033 - DNA, 25 bp, Rattus norvegicus
aggtgccttgctatcagggtcatcg

SEQ ID NO: 153034 - DNA, 25 bp, Rattus norvegicus
aggtgccttgctttcagggtcatcg

SEQ ID NO: 153035 - DNA, 25 bp, Rattus norvegicus
aggtgccttggtagccactgataaa

SEQ ID NO: 153036 - DNA, 25 bp, Rattus norvegicus
aggtgccttggttgccactgataaa

SEQ ID NO: 153037 - DNA, 25 bp, Rattus norvegicus
aggtgcgaccacagaaatcccagga

SEQ ID NO: 153038 - DNA, 25 bp, Rattus norvegicus
aggtgcgaccactgaaatcccagga

SEQ ID NO: 153039 - DNA, 25 bp, Rattus norvegicus
aggtgcgagccgagctcgcttccct

SEQ ID NO: 153040 - DNA, 25 bp, Rattus norvegicus
aggtgcgagccgtgctcgcttccct

SEQ ID NO: 153041 - DNA, 25 bp, Rattus norvegicus
aggtgcgatcacagctgaaactcag

SEQ ID NO: 153042 - DNA, 25 bp, Rattus norvegicus
aggtgcgatcactgctgaaactcag

SEQ ID NO: 153043 - DNA, 25 bp, Rattus norvegicus
aggtgcgcagctagctcgttagcca

SEQ ID NO: 153044 - DNA, 25 bp, Rattus norvegicus
aggtgcgcagcttgctcgttagcca

SEQ ID NO: 153045 - DNA, 25 bp, Rattus norvegicus
aggtgcgcccgtactgctggtcgaa

SEQ ID NO: 153046 - DNA, 25 bp, Rattus norvegicus
aggtgcgcccgttctgctggtcgaa

SEQ ID NO: 153047 - DNA, 25 bp, Rattus norvegicus
aggtgcgcctctattgaagcctgaa

SEQ ID NO: 153048 - DNA, 25 bp, Rattus norvegicus
aggtgcgcctcttttgaagcctgaa

SEQ ID NO: 153049 - DNA, 25 bp, Rattus norvegicus
aggtgcgcgcccacgacctgcaaag

SEQ ID NO: 153050 - DNA, 25 bp, Rattus norvegicus
aggtgcgcgccctcgacctgcaaag

SEQ ID NO: 153051 - DNA, 25 bp, Rattus norvegicus
aggtgcgcttacagtcttgtccatg

SEQ ID NO: 153052 - DNA, 25 bp, Rattus norvegicus
aggtgcgcttactgtcttgtccatg

SEQ ID NO: 153053 - DNA, 25 bp, Rattus norvegicus
aggtgcggaagcaagcccactgttt

SEQ ID NO: 153054 - DNA, 25 bp, Rattus norvegicus
aggtgcggaagctagcccactgttt

SEQ ID NO: 153055 - DNA, 25 bp, Rattus norvegicus
aggtgcgggtgcatccgtatccatt

SEQ ID NO: 153056 - DNA, 25 bp, Rattus norvegicus
aggtgcgggtgcttccgtatccatt

SEQ ID NO: 153057 - DNA, 25 bp, Rattus norvegicus
aggtgcggtgctcagatctattaaa

SEQ ID NO: 153058 - DNA, 25 bp, Rattus norvegicus
aggtgcggtgctgagatctattaaa

SEQ ID NO: 153059 - DNA, 25 bp, Rattus norvegicus
aggtgcggtggactcctccgcaact

SEQ ID NO: 153060 - DNA, 25 bp, Rattus norvegicus
aggtgcggtggagtcctccgcaact

SEQ ID NO: 153061 - DNA, 25 bp, Rattus norvegicus
aggtgcgtgcaaattagcctccgct

SEQ ID NO: 153062 - DNA, 25 bp, Rattus norvegicus
aggtgcgtgcaatttagcctccgct

SEQ ID NO: 153063 - DNA, 25 bp, Rattus norvegicus
aggtgcgtgctgacttttctgggtc

SEQ ID NO: 153064 - DNA, 25 bp, Rattus norvegicus
aggtgcgtgctgtcttttctgggtc

SEQ ID NO: 153065 - DNA, 25 bp, Rattus norvegicus
aggtgcgtggagagttcctgaacca

SEQ ID NO: 153066 - DNA, 25 bp, Rattus norvegicus
aggtgcgtggagtgttcctgaacca

SEQ ID NO: 153067 - DNA, 25 bp, Rattus norvegicus
aggtgctaacctcatgatcccaagt

SEQ ID NO: 153068 - DNA, 25 bp, Rattus norvegicus
aggtgctaacctgatgatcccaagt

SEQ ID NO: 153069 - DNA, 25 bp, Rattus norvegicus
aggtgctaagatctcaagtctgcta

SEQ ID NO: 153070 - DNA, 25 bp, Rattus norvegicus
aggtgctaagatgtcaagtctgcta

SEQ ID NO: 153071 - DNA, 25 bp, Rattus norvegicus
aggtgctaagctccttgagctccac

SEQ ID NO: 153072 - DNA, 25 bp, Rattus norvegicus
aggtgctaagctgcttgagctccac

SEQ ID NO: 153073 - DNA, 25 bp, Rattus norvegicus
aggtgctaaggtcagtccactccaa

SEQ ID NO: 153074 - DNA, 25 bp, Rattus norvegicus
aggtgctaaggtgagtccactccaa

SEQ ID NO: 153075 - DNA, 25 bp, Rattus norvegicus
aggtgctacttaccaaacactctgc

SEQ ID NO: 153076 - DNA, 25 bp, Rattus norvegicus
aggtgctacttagcaaacactctgc

SEQ ID NO: 153077 - DNA, 25 bp, Rattus norvegicus
aggtgctataggagagatctccgta

SEQ ID NO: 153078 - DNA, 25 bp, Rattus norvegicus
aggtgctataggtgagatctccgta

SEQ ID NO: 153079 - DNA, 25 bp, Rattus norvegicus
aggtgctatcctctaacttggcttt

SEQ ID NO: 153080 - DNA, 25 bp, Rattus norvegicus
aggtgctatcctgtaacttggcttt

SEQ ID NO: 153081 - DNA, 25 bp, Rattus norvegicus
aggtgctcaactcgatgctgcgcaa

SEQ ID NO: 153082 - DNA, 25 bp, Rattus norvegicus
aggtgctcaactggatgctgcgcaa

SEQ ID NO: 153083 - DNA, 25 bp, Rattus norvegicus
aggtgctcacctcgctcaggagaaa

SEQ ID NO: 153084 - DNA, 25 bp, Rattus norvegicus
aggtgctcacctggctcaggagaaa

SEQ ID NO: 153085 - DNA, 25 bp, Rattus norvegicus
aggtgctcacgactatctataaatc

SEQ ID NO: 153086 - DNA, 25 bp, Rattus norvegicus
aggtgctcacgagtatctataaatc

SEQ ID NO: 153087 - DNA, 25 bp, Rattus norvegicus
aggtgctcatggacctgcctctgag

SEQ ID NO: 153088 - DNA, 25 bp, Rattus norvegicus
aggtgctcatggtcctgcctctgag

SEQ ID NO: 153089 - DNA, 25 bp, Rattus norvegicus
aggtgctccaagcacctctgaggga

SEQ ID NO: 153090 - DNA, 25 bp, Rattus norvegicus
aggtgctccaaggacctctgaggga

SEQ ID NO: 153091 - DNA, 25 bp, Rattus norvegicus
aggtgctcccagcaagtcctcacag

SEQ ID NO: 153092 - DNA, 25 bp, Rattus norvegicus
aggtgctcccaggaagtcctcacag

SEQ ID NO: 153093 - DNA, 25 bp, Rattus norvegicus
aggtgctcggctcaggcgcatacca

SEQ ID NO: 153094 - DNA, 25 bp, Rattus norvegicus
aggtgctcggctgaggcgcatacca

SEQ ID NO: 153095 - DNA, 25 bp, Rattus norvegicus
aggtgctctatacctagcatagccc

SEQ ID NO: 153096 - DNA, 25 bp, Rattus norvegicus
aggtgctctatagctagcatagccc

SEQ ID NO: 153097 - DNA, 25 bp, Rattus norvegicus
aggtgctctgccaaacagcgtaagg

SEQ ID NO: 153098 - DNA, 25 bp, Rattus norvegicus
aggtgctctgcctaacagcgtaagg

SEQ ID NO: 153099 - DNA, 25 bp, Rattus norvegicus
aggtgctgaggcaacttcccaaatt

SEQ ID NO: 153100 - DNA, 25 bp, Rattus norvegicus
aggtgctgaggcagcttcttggtcc

SEQ ID NO: 153101 - DNA, 25 bp, Rattus norvegicus
aggtgctgaggctacttcccaaatt

SEQ ID NO: 153102 - DNA, 25 bp, Rattus norvegicus
aggtgctgaggctgcttcttggtcc

SEQ ID NO: 153103 - DNA, 25 bp, Rattus norvegicus
aggtgctgagggactccttcattgg

SEQ ID NO: 153104 - DNA, 25 bp, Rattus norvegicus
aggtgctgagggtctccttcattgg

SEQ ID NO: 153105 - DNA, 25 bp, Rattus norvegicus
aggtgctgagtcatcgctggctctc

SEQ ID NO: 153106 - DNA, 25 bp, Rattus norvegicus
aggtgctgagtcttcgctggctctc

SEQ ID NO: 153107 - DNA, 25 bp, Rattus norvegicus
aggtgctgcaggcttcactgagctt

SEQ ID NO: 153108 - DNA, 25 bp, Rattus norvegicus
aggtgctgcagggttcactgagctt

SEQ ID NO: 153109 - DNA, 25 bp, Rattus norvegicus
aggtgctgcccaaagggtccagctg

SEQ ID NO: 153110 - DNA, 25 bp, Rattus norvegicus
aggtgctgcccatagggtccagctg

SEQ ID NO: 153111 - DNA, 25 bp, Rattus norvegicus
aggtgctgccctacggcgacgagaa

SEQ ID NO: 153112 - DNA, 25 bp, Rattus norvegicus
aggtgctgcccttcggcgacgagaa

SEQ ID NO: 153113 - DNA, 25 bp, Rattus norvegicus
aggtgctgccgtccctttatgctaa

SEQ ID NO: 153114 - DNA, 25 bp, Rattus norvegicus
aggtgctgccgtgcctttatgctaa

SEQ ID NO: 153115 - DNA, 25 bp, Rattus norvegicus
aggtgctgcctaattccattagctt

SEQ ID NO: 153116 - DNA, 25 bp, Rattus norvegicus
aggtgctgcctatttccattagctt

SEQ ID NO: 153117 - DNA, 25 bp, Rattus norvegicus
aggtgctgctaaatggatgacttca

SEQ ID NO: 153118 - DNA, 25 bp, Rattus norvegicus
aggtgctgctaattggatgacttca

SEQ ID NO: 153119 - DNA, 25 bp, Rattus norvegicus
aggtgctgctccagaagctaaccca

SEQ ID NO: 153120 - DNA, 25 bp, Rattus norvegicus
aggtgctgctcctgaagctaaccca

SEQ ID NO: 153121 - DNA, 25 bp, Rattus norvegicus
aggtgctgcttgagaacccgacgct

SEQ ID NO: 153122 - DNA, 25 bp, Rattus norvegicus
aggtgctgcttgtgaacccgacgct

SEQ ID NO: 153123 - DNA, 25 bp, Rattus norvegicus
aggtgctggcggcagggacatctgt

SEQ ID NO: 153124 - DNA, 25 bp, Rattus norvegicus
aggtgctggcgggagggacatctgt

SEQ ID NO: 153125 - DNA, 25 bp, Rattus norvegicus
aggtgctgggctactgctcagagca

SEQ ID NO: 153126 - DNA, 25 bp, Rattus norvegicus
aggtgctgggcttctgctcagagca

SEQ ID NO: 153127 - DNA, 25 bp, Rattus norvegicus
aggtgctgtatcaccaaggtgctga

SEQ ID NO: 153128 - DNA, 25 bp, Rattus norvegicus
aggtgctgtatctccaaggtgctga

SEQ ID NO: 153129 - DNA, 25 bp, Rattus norvegicus
aggtgctgtgcccagactattacag

SEQ ID NO: 153130 - DNA, 25 bp, Rattus norvegicus
aggtgctgtgccgagactattacag

SEQ ID NO: 153131 - DNA, 25 bp, Rattus norvegicus
aggtgctgtggaagcttcgctgtct

SEQ ID NO: 153132 - DNA, 25 bp, Rattus norvegicus
aggtgctgtggatgcttcgctgtct

SEQ ID NO: 153133 - DNA, 25 bp, Rattus norvegicus
aggtgcttaccaccaacactggatt

SEQ ID NO: 153134 - DNA, 25 bp, Rattus norvegicus
aggtgcttaccagcaacactggatt

SEQ ID NO: 153135 - DNA, 25 bp, Rattus norvegicus
aggtgcttagagagctcttcttggt

SEQ ID NO: 153136 - DNA, 25 bp, Rattus norvegicus
aggtgcttagagtgctcttcttggt

SEQ ID NO: 153137 - DNA, 25 bp, Rattus norvegicus
aggtgcttatgcactgcaggtcaca

SEQ ID NO: 153138 - DNA, 25 bp, Rattus norvegicus
aggtgcttatgctctgcaggtcaca

SEQ ID NO: 153139 - DNA, 25 bp, Rattus norvegicus
aggtgcttcagccagcacagcaaat

SEQ ID NO: 153140 - DNA, 25 bp, Rattus norvegicus
aggtgcttcagcgagcacagcaaat

SEQ ID NO: 153141 - DNA, 25 bp, Rattus norvegicus
aggtgcttccccagacttagggtgg

SEQ ID NO: 153142 - DNA, 25 bp, Rattus norvegicus
aggtgcttcccctgacttagggtgg

SEQ ID NO: 153143 - DNA, 25 bp, Rattus norvegicus
aggtgcttccctcccaagtggatgg

SEQ ID NO: 153144 - DNA, 25 bp, Rattus norvegicus
aggtgcttccctgccaagtggatgg

SEQ ID NO: 153145 - DNA, 25 bp, Rattus norvegicus
aggtgcttcggaactgtccagtgaa

SEQ ID NO: 153146 - DNA, 25 bp, Rattus norvegicus
aggtgcttcggatctgtccagtgaa

SEQ ID NO: 153147 - DNA, 25 bp, Rattus norvegicus
aggtgcttggaaacactccctgact

SEQ ID NO: 153148 - DNA, 25 bp, Rattus norvegicus
aggtgcttggaatcactccctgact

SEQ ID NO: 153149 - DNA, 25 bp, Rattus norvegicus
aggtgcttggatctattctttgcaa

SEQ ID NO: 153150 - DNA, 25 bp, Rattus norvegicus
aggtgcttggatgtattctttgcaa

SEQ ID NO: 153151 - DNA, 25 bp, Rattus norvegicus
aggtgctttaccatttctgcaagat

SEQ ID NO: 153152 - DNA, 25 bp, Rattus norvegicus
aggtgctttaccttttctgcaagat

SEQ ID NO: 153153 - DNA, 25 bp, Rattus norvegicus
aggtgctttcctatcttatattttg

SEQ ID NO: 153154 - DNA, 25 bp, Rattus norvegicus
aggtgctttcctttcttatattttg

SEQ ID NO: 153155 - DNA, 25 bp, Rattus norvegicus
aggtgctttctactaatcttttatc

SEQ ID NO: 153156 - DNA, 25 bp, Rattus norvegicus
aggtgctttctagtaatcttttatc

SEQ ID NO: 153157 - DNA, 25 bp, Rattus norvegicus
aggtgctttgctaggcacggtaagc

SEQ ID NO: 153158 - DNA, 25 bp, Rattus norvegicus
aggtgctttgcttggcacggtaagc

SEQ ID NO: 153159 - DNA, 25 bp, Rattus norvegicus
aggtgctttgtgcttatgagtatca

SEQ ID NO: 153160 - DNA, 25 bp, Rattus norvegicus
aggtgctttgtggttatgagtatca

SEQ ID NO: 153161 - DNA, 25 bp, Rattus norvegicus
aggtgcttttggagcctgccaggtt

SEQ ID NO: 153162 - DNA, 25 bp, Rattus norvegicus
aggtgcttttggcaggctcctgccc

SEQ ID NO: 153163 - DNA, 25 bp, Rattus norvegicus
aggtgcttttgggaggctcctgccc

SEQ ID NO: 153164 - DNA, 25 bp, Rattus norvegicus
aggtgcttttggtgcctgccaggtt

SEQ ID NO: 153165 - DNA, 25 bp, Rattus norvegicus
aggtggaagaccagcttcgggccct

SEQ ID NO: 153166 - DNA, 25 bp, Rattus norvegicus
aggtggaagacctgcttcgggccct

SEQ ID NO: 153167 - DNA, 25 bp, Rattus norvegicus
aggtggaagcccagggtcttgctac

SEQ ID NO: 153168 - DNA, 25 bp, Rattus norvegicus
aggtggaagccctgggtcttgctac

SEQ ID NO: 153169 - DNA, 25 bp, Rattus norvegicus
aggtggaaggccacggttcctgctc

SEQ ID NO: 153170 - DNA, 25 bp, Rattus norvegicus
aggtggaaggcctcggttcctgctc

SEQ ID NO: 153171 - DNA, 25 bp, Rattus norvegicus
aggtggacaactagcctgtggagac

SEQ ID NO: 153172 - DNA, 25 bp, Rattus norvegicus
aggtggacaacttgcctgtggagac

SEQ ID NO: 153173 - DNA, 25 bp, Rattus norvegicus
aggtggacaagcaccagctgcaaca

SEQ ID NO: 153174 - DNA, 25 bp, Rattus norvegicus
aggtggacaagctccagctgcaaca

SEQ ID NO: 153175 - DNA, 25 bp, Rattus norvegicus
aggtggacacaactggacttctgct

SEQ ID NO: 153176 - DNA, 25 bp, Rattus norvegicus
aggtggacacaagtggacttctgct

SEQ ID NO: 153177 - DNA, 25 bp, Rattus norvegicus
aggtggacacctagagcgaagcaga

SEQ ID NO: 153178 - DNA, 25 bp, Rattus norvegicus
aggtggacaccttgagcgaagcaga

SEQ ID NO: 153179 - DNA, 25 bp, Rattus norvegicus
aggtggacacttcggagttgtcact

SEQ ID NO: 153180 - DNA, 25 bp, Rattus norvegicus
aggtggacacttgggagttgtcact

SEQ ID NO: 153181 - DNA, 25 bp, Rattus norvegicus
aggtggaccaatactcaactctttt

SEQ ID NO: 153182 - DNA, 25 bp, Rattus norvegicus
aggtggaccaattctcaactctttt

SEQ ID NO: 153183 - DNA, 25 bp, Rattus norvegicus
aggtggaccagcacaagaaggaagt

SEQ ID NO: 153184 - DNA, 25 bp, Rattus norvegicus
aggtggaccagctcaagaaggaagt

SEQ ID NO: 153185 - DNA, 25 bp, Rattus norvegicus
aggtggaccattctcccttgtgggt

SEQ ID NO: 153186 - DNA, 25 bp, Rattus norvegicus
aggtggaccattgtcccttgtgggt

SEQ ID NO: 153187 - DNA, 25 bp, Rattus norvegicus
aggtggaccccactgaggacttgcc

SEQ ID NO: 153188 - DNA, 25 bp, Rattus norvegicus
aggtggaccccagtgaggacttgcc

SEQ ID NO: 153189 - DNA, 25 bp, Rattus norvegicus
aggtggacctacagacccagtgcat

SEQ ID NO: 153190 - DNA, 25 bp, Rattus norvegicus
aggtggacctactgacccagtgcat

SEQ ID NO: 153191 - DNA, 25 bp, Rattus norvegicus
aggtggacctgtattatctccagca

SEQ ID NO: 153192 - DNA, 25 bp, Rattus norvegicus
aggtggacctgttttatctccagca

SEQ ID NO: 153193 - DNA, 25 bp, Rattus norvegicus
aggtggactccgatcgtgacaagtt

SEQ ID NO: 153194 - DNA, 25 bp, Rattus norvegicus
aggtggactccgttcgtgacaagtt

SEQ ID NO: 153195 - DNA, 25 bp, Rattus norvegicus
aggtggactgccactttctgcagct

SEQ ID NO: 153196 - DNA, 25 bp, Rattus norvegicus
aggtggactgcctctttctgcagct

SEQ ID NO: 153197 - DNA, 25 bp, Rattus norvegicus
aggtggactggtacctgtttggctc

SEQ ID NO: 153198 - DNA, 25 bp, Rattus norvegicus
aggtggactggttcctgtttggctc

SEQ ID NO: 153199 - DNA, 25 bp, Rattus norvegicus
aggtggacttccctgaacgcagcaa

SEQ ID NO: 153200 - DNA, 25 bp, Rattus norvegicus
aggtggacttccgtgaacgcagcaa

SEQ ID NO: 153201 - DNA, 25 bp, Rattus norvegicus
aggtggacttctcgagctaccttcc

SEQ ID NO: 153202 - DNA, 25 bp, Rattus norvegicus
aggtggacttctggagctaccttcc

SEQ ID NO: 153203 - DNA, 25 bp, Rattus norvegicus
aggtggagcacacgctttccctggt

SEQ ID NO: 153204 - DNA, 25 bp, Rattus norvegicus
aggtggagcacaggctttccctggt

SEQ ID NO: 153205 - DNA, 25 bp, Rattus norvegicus
aggtggagcaccctgaaaaagccgt

SEQ ID NO: 153206 - DNA, 25 bp, Rattus norvegicus
aggtggagcaccgtgaaaaagccgt

SEQ ID NO: 153207 - DNA, 25 bp, Rattus norvegicus
aggtggagcctaatgagaggtcatt

SEQ ID NO: 153208 - DNA, 25 bp, Rattus norvegicus
aggtggagcctattgagaggtcatt

SEQ ID NO: 153209 - DNA, 25 bp, Rattus norvegicus
aggtggagctttcgcccaggtcttc

SEQ ID NO: 153210 - DNA, 25 bp, Rattus norvegicus
aggtggagctttggcccaggtcttc

SEQ ID NO: 153211 - DNA, 25 bp, Rattus norvegicus
aggtggaggccaactagatccgcat

SEQ ID NO: 153212 - DNA, 25 bp, Rattus norvegicus
aggtggaggccatctagatccgcat

SEQ ID NO: 153213 - DNA, 25 bp, Rattus norvegicus
aggtggaggcctcacaatctgtaac

SEQ ID NO: 153214 - DNA, 25 bp, Rattus norvegicus
aggtggaggcctgacaatctgtaac

SEQ ID NO: 153215 - DNA, 25 bp, Rattus norvegicus
aggtggaggctcatcagtgcccatc

SEQ ID NO: 153216 - DNA, 25 bp, Rattus norvegicus
aggtggaggctcttcagtgcccatc

SEQ ID NO: 153217 - DNA, 25 bp, Rattus norvegicus
aggtggagtccgctccattgatgat

SEQ ID NO: 153218 - DNA, 25 bp, Rattus norvegicus
aggtggagtccggtccattgatgat

SEQ ID NO: 153219 - DNA, 25 bp, Rattus norvegicus
aggtggatccacatgctttattagc

SEQ ID NO: 153220 - DNA, 25 bp, Rattus norvegicus
aggtggatccacttgctttattagc

SEQ ID NO: 153221 - DNA, 25 bp, Rattus norvegicus
aggtggatcgaaagtcctttccttg

SEQ ID NO: 153222 - DNA, 25 bp, Rattus norvegicus
aggtggatcgaatgtcctttccttg

SEQ ID NO: 153223 - DNA, 25 bp, Rattus norvegicus
aggtggatcgtgacttttgctttca

SEQ ID NO: 153224 - DNA, 25 bp, Rattus norvegicus
aggtggatcgtgtcttttgctttca

SEQ ID NO: 153225 - DNA, 25 bp, Rattus norvegicus
aggtggatgactacttcttcctcca

SEQ ID NO: 153226 - DNA, 25 bp, Rattus norvegicus
aggtggatgacttcttcttcctcca

SEQ ID NO: 153227 - DNA, 25 bp, Rattus norvegicus
aggtggatgccaagctgtgtactct

SEQ ID NO: 153228 - DNA, 25 bp, Rattus norvegicus
aggtggatgccatgctgtgtactct

SEQ ID NO: 153229 - DNA, 25 bp, Rattus norvegicus
aggtggatgcccacaattccgagag

SEQ ID NO: 153230 - DNA, 25 bp, Rattus norvegicus
aggtggatgccctcaattccgagag

SEQ ID NO: 153231 - DNA, 25 bp, Rattus norvegicus
aggtggatgttaagatccctctctg

SEQ ID NO: 153232 - DNA, 25 bp, Rattus norvegicus
aggtggatgttatgatccctctctg

SEQ ID NO: 153233 - DNA, 25 bp, Rattus norvegicus
aggtggattaaaccctcctggaaga

SEQ ID NO: 153234 - DNA, 25 bp, Rattus norvegicus
aggtggattaaagcctcctggaaga

SEQ ID NO: 153235 - DNA, 25 bp, Rattus norvegicus
aggtggattacaactgtctaactac

SEQ ID NO: 153236 - DNA, 25 bp, Rattus norvegicus
aggtggattacatctgtctaactac

SEQ ID NO: 153237 - DNA, 25 bp, Rattus norvegicus
aggtggcacatacagccgtggtttt

SEQ ID NO: 153238 - DNA, 25 bp, Rattus norvegicus
aggtggcacatagagccgtggtttt

SEQ ID NO: 153239 - DNA, 25 bp, Rattus norvegicus
aggtggcagccgacaatgcgatctc

SEQ ID NO: 153240 - DNA, 25 bp, Rattus norvegicus
aggtggcagccgtcaatgcgatctc

SEQ ID NO: 153241 - DNA, 25 bp, Rattus norvegicus
aggtggcaggcaaccttcattggtt

SEQ ID NO: 153242 - DNA, 25 bp, Rattus norvegicus
aggtggcaggcatccttcattggtt

SEQ ID NO: 153243 - DNA, 25 bp, Rattus norvegicus
aggtggcagtgaactccttgtcaca

SEQ ID NO: 153244 - DNA, 25 bp, Rattus norvegicus
aggtggcagtgatctccttgtcaca

SEQ ID NO: 153245 - DNA, 25 bp, Rattus norvegicus
aggtggcagtggcacacacttgcct

SEQ ID NO: 153246 - DNA, 25 bp, Rattus norvegicus
aggtggcagtgggacacacttgcct

SEQ ID NO: 153247 - DNA, 25 bp, Rattus norvegicus
aggtggcatctcaagcctccagagg

SEQ ID NO: 153248 - DNA, 25 bp, Rattus norvegicus
aggtggcatctctagcctccagagg

SEQ ID NO: 153249 - DNA, 25 bp, Rattus norvegicus
aggtggccaaacatcgactgctctt

SEQ ID NO: 153250 - DNA, 25 bp, Rattus norvegicus
aggtggccaaacttcgactgctctt

SEQ ID NO: 153251 - DNA, 25 bp, Rattus norvegicus
aggtggccaaggagttcgtcaagct

SEQ ID NO: 153252 - DNA, 25 bp, Rattus norvegicus
aggtggccaaggtgttcgtcaagct

SEQ ID NO: 153253 - DNA, 25 bp, Rattus norvegicus
aggtggccatgaccttgtgcacgat

SEQ ID NO: 153254 - DNA, 25 bp, Rattus norvegicus
aggtggccatgagcttgtgcacgat

SEQ ID NO: 153255 - DNA, 25 bp, Rattus norvegicus
aggtggccatgcagacagtcttcag

SEQ ID NO: 153256 - DNA, 25 bp, Rattus norvegicus
aggtggccatgctgacagtcttcag

SEQ ID NO: 153257 - DNA, 25 bp, Rattus norvegicus
aggtggccattgcttgactcactgg

SEQ ID NO: 153258 - DNA, 25 bp, Rattus norvegicus
aggtggccattggttgactcactgg

SEQ ID NO: 153259 - DNA, 25 bp, Rattus norvegicus
aggtggcccacactcctgtagatgg

SEQ ID NO: 153260 - DNA, 25 bp, Rattus norvegicus
aggtggcccacagtcctgtagatgg

SEQ ID NO: 153261 - DNA, 25 bp, Rattus norvegicus
aggtggcccagaagcggacaccgca

SEQ ID NO: 153262 - DNA, 25 bp, Rattus norvegicus
aggtggcccagatgcggacaccgca

SEQ ID NO: 153263 - DNA, 25 bp, Rattus norvegicus
aggtggcccagtatcatgtcattct

SEQ ID NO: 153264 - DNA, 25 bp, Rattus norvegicus
aggtggcccagtttcatgtcattct

SEQ ID NO: 153265 - DNA, 25 bp, Rattus norvegicus
aggtggccccaaagtaccagcagag

SEQ ID NO: 153266 - DNA, 25 bp, Rattus norvegicus
aggtggccccaatgtaccagcagag

SEQ ID NO: 153267 - DNA, 25 bp, Rattus norvegicus
aggtggccccagcttatttatattt

SEQ ID NO: 153268 - DNA, 25 bp, Rattus norvegicus
aggtggccccaggttatttatattt

SEQ ID NO: 153269 - DNA, 25 bp, Rattus norvegicus
aggtggcccctgaatgttgtacatc

SEQ ID NO: 153270 - DNA, 25 bp, Rattus norvegicus
aggtggcccctgtatgttgtacatc

SEQ ID NO: 153271 - DNA, 25 bp, Rattus norvegicus
aggtggcccgtaagctggtcatcat

SEQ ID NO: 153272 - DNA, 25 bp, Rattus norvegicus
aggtggcccgtatgctggtcatcat

SEQ ID NO: 153273 - DNA, 25 bp, Rattus norvegicus
aggtggcccgttattgaatcgagtt

SEQ ID NO: 153274 - DNA, 25 bp, Rattus norvegicus
aggtggcccgtttttgaatcgagtt

SEQ ID NO: 153275 - DNA, 25 bp, Rattus norvegicus
aggtggccctgtcaaggaagtctcc

SEQ ID NO: 153276 - DNA, 25 bp, Rattus norvegicus
aggtggccctgtgaaggaagtctcc

SEQ ID NO: 153277 - DNA, 25 bp, Rattus norvegicus
aggtggccgaaaaccttccagactt

SEQ ID NO: 153278 - DNA, 25 bp, Rattus norvegicus
aggtggccgaaatccttccagactt

SEQ ID NO: 153279 - DNA, 25 bp, Rattus norvegicus
aggtggccggctaccaggatagcat

SEQ ID NO: 153280 - DNA, 25 bp, Rattus norvegicus
aggtggccggcttccaggatagcat

SEQ ID NO: 153281 - DNA, 25 bp, Rattus norvegicus
aggtggccgtccaggatgccagtat

SEQ ID NO: 153282 - DNA, 25 bp, Rattus norvegicus
aggtggccgtcctggatgccagtat

SEQ ID NO: 153283 - DNA, 25 bp, Rattus norvegicus
aggtggccgtctcccacttgtcact

SEQ ID NO: 153284 - DNA, 25 bp, Rattus norvegicus
aggtggccgtctgccacttgtcact

SEQ ID NO: 153285 - DNA, 25 bp, Rattus norvegicus
aggtggccgtgtccctgaaaatgca

SEQ ID NO: 153286 - DNA, 25 bp, Rattus norvegicus
aggtggccgtgtgcctgaaaatgca

SEQ ID NO: 153287 - DNA, 25 bp, Rattus norvegicus
aggtggccttaaatcctttgagcag

SEQ ID NO: 153288 - DNA, 25 bp, Rattus norvegicus
aggtggccttaattcctttgagcag

SEQ ID NO: 153289 - DNA, 25 bp, Rattus norvegicus
aggtggccttatcacaggttccttt

SEQ ID NO: 153290 - DNA, 25 bp, Rattus norvegicus
aggtggccttatgacaggttccttt

SEQ ID NO: 153291 - DNA, 25 bp, Rattus norvegicus
aggtggccttcgaaactatcttcta

SEQ ID NO: 153292 - DNA, 25 bp, Rattus norvegicus
aggtggccttcgtaactatcttcta

SEQ ID NO: 153293 - DNA, 25 bp, Rattus norvegicus
aggtggcgatctagggagccatatt

SEQ ID NO: 153294 - DNA, 25 bp, Rattus norvegicus
aggtggcgatcttgggagccatatt

SEQ ID NO: 153295 - DNA, 25 bp, Rattus norvegicus
aggtggcgtttcaaattctctctaa

SEQ ID NO: 153296 - DNA, 25 bp, Rattus norvegicus
aggtggcgtttctaattctctctaa

SEQ ID NO: 153297 - DNA, 25 bp, Rattus norvegicus
aggtggctaacacgtagttctccct

SEQ ID NO: 153298 - DNA, 25 bp, Rattus norvegicus
aggtggctaacaggtagttctccct

SEQ ID NO: 153299 - DNA, 25 bp, Rattus norvegicus
aggtggctacccaccattgagaaga

SEQ ID NO: 153300 - DNA, 25 bp, Rattus norvegicus
aggtggctaccctccattgagaaga

SEQ ID NO: 153301 - DNA, 25 bp, Rattus norvegicus
aggtggctagagatccggttcagtc

SEQ ID NO: 153302 - DNA, 25 bp, Rattus norvegicus
aggtggctagagttccggttcagtc

SEQ ID NO: 153303 - DNA, 25 bp, Rattus norvegicus
aggtggctatccactgtgctctgtg

SEQ ID NO: 153304 - DNA, 25 bp, Rattus norvegicus
aggtggctatcctctgtgctctgtg

SEQ ID NO: 153305 - DNA, 25 bp, Rattus norvegicus
aggtggctcacccagaagttcttgc

SEQ ID NO: 153306 - DNA, 25 bp, Rattus norvegicus
aggtggctcaccgagaagttcttgc

SEQ ID NO: 153307 - DNA, 25 bp, Rattus norvegicus
aggtggctcagaaagcagaatcaca

SEQ ID NO: 153308 - DNA, 25 bp, Rattus norvegicus
aggtggctcagatagcagaatcaca

SEQ ID NO: 153309 - DNA, 25 bp, Rattus norvegicus
aggtggctcatacgtcatcctgctc

SEQ ID NO: 153310 - DNA, 25 bp, Rattus norvegicus
aggtggctcataggtcatcctgctc

SEQ ID NO: 153311 - DNA, 25 bp, Rattus norvegicus
aggtggctccggaggctcctttcac

SEQ ID NO: 153312 - DNA, 25 bp, Rattus norvegicus
aggtggctccggtggctcctttcac

SEQ ID NO: 153313 - DNA, 25 bp, Rattus norvegicus
aggtggctcctcactgagtgaagag

SEQ ID NO: 153314 - DNA, 25 bp, Rattus norvegicus
aggtggctcctctctgagtgaagag

SEQ ID NO: 153315 - DNA, 25 bp, Rattus norvegicus
aggtggctcctgacgagacgcatcc

SEQ ID NO: 153316 - DNA, 25 bp, Rattus norvegicus
aggtggctcctgtcgagacgcatcc

SEQ ID NO: 153317 - DNA, 25 bp, Rattus norvegicus
aggtggctctccagagctcgagtca

SEQ ID NO: 153318 - DNA, 25 bp, Rattus norvegicus
aggtggctctcctgagctcgagtca

SEQ ID NO: 153319 - DNA, 25 bp, Rattus norvegicus
aggtggctcttcaatttgacttatc

SEQ ID NO: 153320 - DNA, 25 bp, Rattus norvegicus
aggtggctcttctatttgacttatc

SEQ ID NO: 153321 - DNA, 25 bp, Rattus norvegicus
aggtggctgactccatctgcttaat

SEQ ID NO: 153322 - DNA, 25 bp, Rattus norvegicus
aggtggctgactgcatctgcttaat

SEQ ID NO: 153323 - DNA, 25 bp, Rattus norvegicus
aggtggctggatctcagtctctgtc

SEQ ID NO: 153324 - DNA, 25 bp, Rattus norvegicus
aggtggctggatgtcagtctctgtc

SEQ ID NO: 153325 - DNA, 25 bp, Rattus norvegicus
aggtggctgggccatcttatccact

SEQ ID NO: 153326 - DNA, 25 bp, Rattus norvegicus
aggtggctgggcgatcttatccact

SEQ ID NO: 153327 - DNA, 25 bp, Rattus norvegicus
aggtggctgggtccatcttgtcctc

SEQ ID NO: 153328 - DNA, 25 bp, Rattus norvegicus
aggtggctgggtgcatcttgtcctc

SEQ ID NO: 153329 - DNA, 25 bp, Rattus norvegicus
aggtggctgtcaactatgcaggcgt

SEQ ID NO: 153330 - DNA, 25 bp, Rattus norvegicus
aggtggctgtcatctatgcaggcgt

SEQ ID NO: 153331 - DNA, 25 bp, Rattus norvegicus
aggtggcttcagatgtcacaggcta

SEQ ID NO: 153332 - DNA, 25 bp, Rattus norvegicus
aggtggcttcagttgtcacaggcta

SEQ ID NO: 153333 - DNA, 25 bp, Rattus norvegicus
aggtggcttcggatggaatctactt

SEQ ID NO: 153334 - DNA, 25 bp, Rattus norvegicus
aggtggcttcggttggaatctactt

SEQ ID NO: 153335 - DNA, 25 bp, Rattus norvegicus
aggtgggaaagaagccctgttcctg

SEQ ID NO: 153336 - DNA, 25 bp, Rattus norvegicus
aggtgggaaagatgccctgttcctg

SEQ ID NO: 153337 - DNA, 25 bp, Rattus norvegicus
aggtgggaacagaccgtcctgcttt

SEQ ID NO: 153338 - DNA, 25 bp, Rattus norvegicus
aggtgggaacagtccgtcctgcttt

SEQ ID NO: 153339 - DNA, 25 bp, Rattus norvegicus
aggtgggacacaaactccgcagaaa

SEQ ID NO: 153340 - DNA, 25 bp, Rattus norvegicus
aggtgggacacatactccgcagaaa

SEQ ID NO: 153341 - DNA, 25 bp, Rattus norvegicus
aggtgggaccacagctgctatggcc

SEQ ID NO: 153342 - DNA, 25 bp, Rattus norvegicus
aggtgggaccactgctgctatggcc

SEQ ID NO: 153343 - DNA, 25 bp, Rattus norvegicus
aggtgggagagacccaacttcacaa

SEQ ID NO: 153344 - DNA, 25 bp, Rattus norvegicus
aggtgggagagagccaacttcacaa

SEQ ID NO: 153345 - DNA, 25 bp, Rattus norvegicus
aggtgggagcctagctgttcttgta

SEQ ID NO: 153346 - DNA, 25 bp, Rattus norvegicus
aggtgggagccttgctgttcttgta

SEQ ID NO: 153347 - DNA, 25 bp, Rattus norvegicus
aggtgggatcttagcctctgataga

SEQ ID NO: 153348 - DNA, 25 bp, Rattus norvegicus
aggtgggatctttgcctctgataga

SEQ ID NO: 153349 - DNA, 25 bp, Rattus norvegicus
aggtgggatgctacctactggttat

SEQ ID NO: 153350 - DNA, 25 bp, Rattus norvegicus
aggtgggatgcttcctactggttat

SEQ ID NO: 153351 - DNA, 25 bp, Rattus norvegicus
aggtgggattccagttctctaagga

SEQ ID NO: 153352 - DNA, 25 bp, Rattus norvegicus
aggtgggattcctgttctctaagga

SEQ ID NO: 153353 - DNA, 25 bp, Rattus norvegicus
aggtgggcaatcaccagtgagagca

SEQ ID NO: 153354 - DNA, 25 bp, Rattus norvegicus
aggtgggcaatctccagtgagagca

SEQ ID NO: 153355 - DNA, 25 bp, Rattus norvegicus
aggtgggcaccgagaaccaaatcac

SEQ ID NO: 153356 - DNA, 25 bp, Rattus norvegicus
aggtgggcaccgtgaaccaaatcac

SEQ ID NO: 153357 - DNA, 25 bp, Rattus norvegicus
aggtgggcagctatcttatgccatt

SEQ ID NO: 153358 - DNA, 25 bp, Rattus norvegicus
aggtgggcagctttcttatgccatt

SEQ ID NO: 153359 - DNA, 25 bp, Rattus norvegicus
aggtgggcagttaccatttgtagac

SEQ ID NO: 153360 - DNA, 25 bp, Rattus norvegicus
aggtgggcagtttccatttgtagac

SEQ ID NO: 153361 - DNA, 25 bp, Rattus norvegicus
aggtgggccaacagattagccttag

SEQ ID NO: 153362 - DNA, 25 bp, Rattus norvegicus
aggtgggccaactgattagccttag

SEQ ID NO: 153363 - DNA, 25 bp, Rattus norvegicus
aggtgggccccaaatcacagtggtc

SEQ ID NO: 153364 - DNA, 25 bp, Rattus norvegicus
aggtgggccccatatcacagtggtc

SEQ ID NO: 153365 - DNA, 25 bp, Rattus norvegicus
aggtgggcgttcatgagcatcatag

SEQ ID NO: 153366 - DNA, 25 bp, Rattus norvegicus
aggtgggcgttcttgagcatcatag

SEQ ID NO: 153367 - DNA, 25 bp, Rattus norvegicus
aggtgggctcacaggctgaagtaaa

SEQ ID NO: 153368 - DNA, 25 bp, Rattus norvegicus
aggtgggctcactggctgaagtaaa

SEQ ID NO: 153369 - DNA, 25 bp, Rattus norvegicus
aggtgggctctaaccaagtggaatc

SEQ ID NO: 153370 - DNA, 25 bp, Rattus norvegicus
aggtgggctctaccatcccagcttt

SEQ ID NO: 153371 - DNA, 25 bp, Rattus norvegicus
aggtgggctctacctgcaagcgttt

SEQ ID NO: 153372 - DNA, 25 bp, Rattus norvegicus
aggtgggctctagcatcccagcttt

SEQ ID NO: 153373 - DNA, 25 bp, Rattus norvegicus
aggtgggctctagctgcaagcgttt

SEQ ID NO: 153374 - DNA, 25 bp, Rattus norvegicus
aggtgggctctatccaagtggaatc

SEQ ID NO: 153375 - DNA, 25 bp, Rattus norvegicus
aggtgggctctgcagtcgctactca

SEQ ID NO: 153376 - DNA, 25 bp, Rattus norvegicus
aggtgggctctggagtcgctactca

SEQ ID NO: 153377 - DNA, 25 bp, Rattus norvegicus
aggtgggcttcacaggcttctacaa

SEQ ID NO: 153378 - DNA, 25 bp, Rattus norvegicus
aggtgggcttcagaggcttctacaa

SEQ ID NO: 153379 - DNA, 25 bp, Rattus norvegicus
aggtgggcttttcccagcagagctc

SEQ ID NO: 153380 - DNA, 25 bp, Rattus norvegicus
aggtgggcttttgccagcagagctc

SEQ ID NO: 153381 - DNA, 25 bp, Rattus norvegicus
aggtgggtatctcggatccctacca

SEQ ID NO: 153382 - DNA, 25 bp, Rattus norvegicus
aggtgggtatctgggatccctacca

SEQ ID NO: 153383 - DNA, 25 bp, Rattus norvegicus
aggtgggtcaatcatccagatccaa

SEQ ID NO: 153384 - DNA, 25 bp, Rattus norvegicus
aggtgggtcaatgatccagatccaa

SEQ ID NO: 153385 - DNA, 25 bp, Rattus norvegicus
aggtgggtcacccctgtcctctcta

SEQ ID NO: 153386 - DNA, 25 bp, Rattus norvegicus
aggtgggtcaccgctgtcctctcta

SEQ ID NO: 153387 - DNA, 25 bp, Rattus norvegicus
aggtgggtctccaagttccaggaca

SEQ ID NO: 153388 - DNA, 25 bp, Rattus norvegicus
aggtgggtctcctagttccaggaca

SEQ ID NO: 153389 - DNA, 25 bp, Rattus norvegicus
aggtgggtgtcaaccccagatgaga

SEQ ID NO: 153390 - DNA, 25 bp, Rattus norvegicus
aggtgggtgtcatccccagatgaga

SEQ ID NO: 153391 - DNA, 25 bp, Rattus norvegicus
aggtggtacaccagtgagctgctct

SEQ ID NO: 153392 - DNA, 25 bp, Rattus norvegicus
aggtggtacacctgtgagctgctct

SEQ ID NO: 153393 - DNA, 25 bp, Rattus norvegicus
aggtggtaccaaaattcctggcgct

SEQ ID NO: 153394 - DNA, 25 bp, Rattus norvegicus
aggtggtaccaatattcctggcgct

SEQ ID NO: 153395 - DNA, 25 bp, Rattus norvegicus
aggtggtaccacaagttcctgccac

SEQ ID NO: 153396 - DNA, 25 bp, Rattus norvegicus
aggtggtaccactagttcctgccac

SEQ ID NO: 153397 - DNA, 25 bp, Rattus norvegicus
aggtggtaccttagtgatgccagcc

SEQ ID NO: 153398 - DNA, 25 bp, Rattus norvegicus
aggtggtacctttgtgatgccagcc

SEQ ID NO: 153399 - DNA, 25 bp, Rattus norvegicus
aggtggtactagcacactcctttaa

SEQ ID NO: 153400 - DNA, 25 bp, Rattus norvegicus
aggtggtactaggacactcctttaa

SEQ ID NO: 153401 - DNA, 25 bp, Rattus norvegicus
aggtggtactatattcatcttatga

SEQ ID NO: 153402 - DNA, 25 bp, Rattus norvegicus
aggtggtactattttcatcttatga

SEQ ID NO: 153403 - DNA, 25 bp, Rattus norvegicus
aggtggtactttagctcctgtagct

SEQ ID NO: 153404 - DNA, 25 bp, Rattus norvegicus
aggtggtacttttgctcctgtagct

SEQ ID NO: 153405 - DNA, 25 bp, Rattus norvegicus
aggtggtagcccagcacctcaggaa

SEQ ID NO: 153406 - DNA, 25 bp, Rattus norvegicus
aggtggtagccctgcacctcaggaa

SEQ ID NO: 153407 - DNA, 25 bp, Rattus norvegicus
aggtggtatggaccctctgctagct

SEQ ID NO: 153408 - DNA, 25 bp, Rattus norvegicus
aggtggtatggagcctctgctagct

SEQ ID NO: 153409 - DNA, 25 bp, Rattus norvegicus
aggtggtcacgcagctcaatgagct

SEQ ID NO: 153410 - DNA, 25 bp, Rattus norvegicus
aggtggtcacgctgctcaatgagct

SEQ ID NO: 153411 - DNA, 25 bp, Rattus norvegicus
aggtggtcattgagagccatcttcc

SEQ ID NO: 153412 - DNA, 25 bp, Rattus norvegicus
aggtggtcattgtgagccatcttcc

SEQ ID NO: 153413 - DNA, 25 bp, Rattus norvegicus
aggtggtccaggacctcgccgtcaa

SEQ ID NO: 153414 - DNA, 25 bp, Rattus norvegicus
aggtggtccaggtcctcgccgtcaa

SEQ ID NO: 153415 - DNA, 25 bp, Rattus norvegicus
aggtggtcccggagcatctcagaac

SEQ ID NO: 153416 - DNA, 25 bp, Rattus norvegicus
aggtggtcccggtgcatctcagaac

SEQ ID NO: 153417 - DNA, 25 bp, Rattus norvegicus
aggtggtcctcaagtgcctgtacct

SEQ ID NO: 153418 - DNA, 25 bp, Rattus norvegicus
aggtggtcctcatgtgcctgtacct

SEQ ID NO: 153419 - DNA, 25 bp, Rattus norvegicus
aggtggtcgaagacctggacagctc

SEQ ID NO: 153420 - DNA, 25 bp, Rattus norvegicus
aggtggtcgaagtcctggacagctc

SEQ ID NO: 153421 - DNA, 25 bp, Rattus norvegicus
aggtggtctagcatctttccagtcc

SEQ ID NO: 153422 - DNA, 25 bp, Rattus norvegicus
aggtggtctagcttctttccagtcc

SEQ ID NO: 153423 - DNA, 25 bp, Rattus norvegicus
aggtggtctccgatgagtttcatgg

SEQ ID NO: 153424 - DNA, 25 bp, Rattus norvegicus
aggtggtctccgttgagtttcatgg

SEQ ID NO: 153425 - DNA, 25 bp, Rattus norvegicus
aggtggtctgtcagcgtgtttatcc

SEQ ID NO: 153426 - DNA, 25 bp, Rattus norvegicus
aggtggtctgtctgcgtgtttatcc

SEQ ID NO: 153427 - DNA, 25 bp, Rattus norvegicus
aggtggtgaaacacaagagccctgt

SEQ ID NO: 153428 - DNA, 25 bp, Rattus norvegicus
aggtggtgaaactcaagagccctgt

SEQ ID NO: 153429 - DNA, 25 bp, Rattus norvegicus
aggtggtgaccaaccatgcaggctt

SEQ ID NO: 153430 - DNA, 25 bp, Rattus norvegicus
aggtggtgaccactggctccagaaa

SEQ ID NO: 153431 - DNA, 25 bp, Rattus norvegicus
aggtggtgaccagtggctccagaaa

SEQ ID NO: 153432 - DNA, 25 bp, Rattus norvegicus
aggtggtgaccatccatgcaggctt

SEQ ID NO: 153433 - DNA, 25 bp, Rattus norvegicus
aggtggtgacgtagcctctgctgct

SEQ ID NO: 153434 - DNA, 25 bp, Rattus norvegicus
aggtggtgacgttgcctctgctgct

SEQ ID NO: 153435 - DNA, 25 bp, Rattus norvegicus
aggtggtgagcgacactggctctct

SEQ ID NO: 153436 - DNA, 25 bp, Rattus norvegicus
aggtggtgagcgtcactggctctct

SEQ ID NO: 153437 - DNA, 25 bp, Rattus norvegicus
aggtggtgatcccactgccaggtca

SEQ ID NO: 153438 - DNA, 25 bp, Rattus norvegicus
aggtggtgatccgactgccaggtca

SEQ ID NO: 153439 - DNA, 25 bp, Rattus norvegicus
aggtggtgcaccagccaggcagcac

SEQ ID NO: 153440 - DNA, 25 bp, Rattus norvegicus
aggtggtgcacctgccaggcagcac

SEQ ID NO: 153441 - DNA, 25 bp, Rattus norvegicus
aggtggtgcactcgtactaccggcc

SEQ ID NO: 153442 - DNA, 25 bp, Rattus norvegicus
aggtggtgcactggtactaccggcc

SEQ ID NO: 153443 - DNA, 25 bp, Rattus norvegicus
aggtggtgccagaccatgcaggatc

SEQ ID NO: 153444 - DNA, 25 bp, Rattus norvegicus
aggtggtgccagtccatgcaggatc

SEQ ID NO: 153445 - DNA, 25 bp, Rattus norvegicus
aggtggtgcctaatcaccagcagga

SEQ ID NO: 153446 - DNA, 25 bp, Rattus norvegicus
aggtggtgcctattcaccagcagga

SEQ ID NO: 153447 - DNA, 25 bp, Rattus norvegicus
aggtggtgtactcctcaatccagga

SEQ ID NO: 153448 - DNA, 25 bp, Rattus norvegicus
aggtggtgtactgctcaatccagga

SEQ ID NO: 153449 - DNA, 25 bp, Rattus norvegicus
aggtggtgtctcaggaagtaatgac

SEQ ID NO: 153450 - DNA, 25 bp, Rattus norvegicus
aggtggtgtctctggaagtaatgac

SEQ ID NO: 153451 - DNA, 25 bp, Rattus norvegicus
aggtggttactgcagcccataccta

SEQ ID NO: 153452 - DNA, 25 bp, Rattus norvegicus
aggtggttactggagcccataccta

SEQ ID NO: 153453 - DNA, 25 bp, Rattus norvegicus
aggtggttccccagaggatgcatca

SEQ ID NO: 153454 - DNA, 25 bp, Rattus norvegicus
aggtggttcccctgaggatgcatca

SEQ ID NO: 153455 - DNA, 25 bp, Rattus norvegicus
aggtggttctatctctgcagctgca

SEQ ID NO: 153456 - DNA, 25 bp, Rattus norvegicus
aggtggttctatgtctgcagctgca

SEQ ID NO: 153457 - DNA, 25 bp, Rattus norvegicus
aggtggttgcttcctcattgattca

SEQ ID NO: 153458 - DNA, 25 bp, Rattus norvegicus
aggtggttgcttgctcattgattca

SEQ ID NO: 153459 - DNA, 25 bp, Rattus norvegicus
aggtggttgtgacctttccatcgtc

SEQ ID NO: 153460 - DNA, 25 bp, Rattus norvegicus
aggtggttgtgagctttccatcgtc

SEQ ID NO: 153461 - DNA, 25 bp, Rattus norvegicus
aggtggtttccacaggcttgttatt

SEQ ID NO: 153462 - DNA, 25 bp, Rattus norvegicus
aggtggtttccagaggcttgttatt

SEQ ID NO: 153463 - DNA, 25 bp, Rattus norvegicus
aggtggtttcttcgctcctgagtca

SEQ ID NO: 153464 - DNA, 25 bp, Rattus norvegicus
aggtggtttcttggctcctgagtca

SEQ ID NO: 153465 - DNA, 25 bp, Rattus norvegicus
aggtgtaagactcacgctctggctt

SEQ ID NO: 153466 - DNA, 25 bp, Rattus norvegicus
aggtgtaagactgacgctctggctt

SEQ ID NO: 153467 - DNA, 25 bp, Rattus norvegicus
aggtgtaagcccaactgccaataaa

SEQ ID NO: 153468 - DNA, 25 bp, Rattus norvegicus
aggtgtaagccctactgccaataaa

SEQ ID NO: 153469 - DNA, 25 bp, Rattus norvegicus
aggtgtaatgaaccctgacagctat

SEQ ID NO: 153470 - DNA, 25 bp, Rattus norvegicus
aggtgtaatgaagcctgacagctat

SEQ ID NO: 153471 - DNA, 25 bp, Rattus norvegicus
aggtgtacaccaagggcttctgggc

SEQ ID NO: 153472 - DNA, 25 bp, Rattus norvegicus
aggtgtacaccatgggcttctgggc

SEQ ID NO: 153473 - DNA, 25 bp, Rattus norvegicus
aggtgtacatccatggccgggagtc

SEQ ID NO: 153474 - DNA, 25 bp, Rattus norvegicus
aggtgtacatccttggccgggagtc

SEQ ID NO: 153475 - DNA, 25 bp, Rattus norvegicus
aggtgtaccacacagctctgatatt

SEQ ID NO: 153476 - DNA, 25 bp, Rattus norvegicus
aggtgtaccacagagctctgatatt

SEQ ID NO: 153477 - DNA, 25 bp, Rattus norvegicus
aggtgtaccttcctggagcaagtat

SEQ ID NO: 153478 - DNA, 25 bp, Rattus norvegicus
aggtgtaccttcgtggagcaagtat

SEQ ID NO: 153479 - DNA, 25 bp, Rattus norvegicus
aggtgtacgcatactatagtggcaa

SEQ ID NO: 153480 - DNA, 25 bp, Rattus norvegicus
aggtgtacgcattctatagtggcaa

SEQ ID NO: 153481 - DNA, 25 bp, Rattus norvegicus
aggtgtactgatccacggcatatac

SEQ ID NO: 153482 - DNA, 25 bp, Rattus norvegicus
aggtgtactgatgcacggcatatac

SEQ ID NO: 153483 - DNA, 25 bp, Rattus norvegicus
aggtgtactgcactcgctatgtcaa

SEQ ID NO: 153484 - DNA, 25 bp, Rattus norvegicus
aggtgtactgcagtcgctatgtcaa

SEQ ID NO: 153485 - DNA, 25 bp, Rattus norvegicus
aggtgtagacagaccgtcagttccg

SEQ ID NO: 153486 - DNA, 25 bp, Rattus norvegicus
aggtgtagacagtccgtcagttccg

SEQ ID NO: 153487 - DNA, 25 bp, Rattus norvegicus
aggtgtagcaagatgcacgggcata

SEQ ID NO: 153488 - DNA, 25 bp, Rattus norvegicus
aggtgtagcaagttgcacgggcata

SEQ ID NO: 153489 - DNA, 25 bp, Rattus norvegicus
aggtgtagcccaatgtgtctgtcag

SEQ ID NO: 153490 - DNA, 25 bp, Rattus norvegicus
aggtgtagcccattgtgtctgtcag

SEQ ID NO: 153491 - DNA, 25 bp, Rattus norvegicus
aggtgtagctgcagcccactgtgta

SEQ ID NO: 153492 - DNA, 25 bp, Rattus norvegicus
aggtgtagctgctgcccactgtgta

SEQ ID NO: 153493 - DNA, 25 bp, Rattus norvegicus
aggtgtagcttactaccagccaagc

SEQ ID NO: 153494 - DNA, 25 bp, Rattus norvegicus
aggtgtagcttagtaccagccaagc

SEQ ID NO: 153495 - DNA, 25 bp, Rattus norvegicus
aggtgtaggcatctggcaccacatc

SEQ ID NO: 153496 - DNA, 25 bp, Rattus norvegicus
aggtgtaggcatgtggcaccacatc

SEQ ID NO: 153497 - DNA, 25 bp, Rattus norvegicus
aggtgtagtccacgccacttgtctc

SEQ ID NO: 153498 - DNA, 25 bp, Rattus norvegicus
aggtgtagtccaggccacttgtctc

SEQ ID NO: 153499 - DNA, 25 bp, Rattus norvegicus
aggtgtagtgttcggtctctgctaa

SEQ ID NO: 153500 - DNA, 25 bp, Rattus norvegicus
aggtgtagtgttgggtctctgctaa

SEQ ID NO: 153501 - DNA, 25 bp, Rattus norvegicus
aggtgtataggcacacgccgcccac

SEQ ID NO: 153502 - DNA, 25 bp, Rattus norvegicus
aggtgtataggctcacgccgcccac

SEQ ID NO: 153503 - DNA, 25 bp, Rattus norvegicus
aggtgtatatcaacatcagtgctat

SEQ ID NO: 153504 - DNA, 25 bp, Rattus norvegicus
aggtgtatatcatcatcagtgctat

SEQ ID NO: 153505 - DNA, 25 bp, Rattus norvegicus
aggtgtatcccgcttcaccatggga

SEQ ID NO: 153506 - DNA, 25 bp, Rattus norvegicus
aggtgtatcccggttcaccatggga

SEQ ID NO: 153507 - DNA, 25 bp, Rattus norvegicus
aggtgtatcctcagcccaagagtta

SEQ ID NO: 153508 - DNA, 25 bp, Rattus norvegicus
aggtgtatcctctgcccaagagtta

SEQ ID NO: 153509 - DNA, 25 bp, Rattus norvegicus
aggtgtatttacatggaccccagct

SEQ ID NO: 153510 - DNA, 25 bp, Rattus norvegicus
aggtgtatttacttggaccccagct

SEQ ID NO: 153511 - DNA, 25 bp, Rattus norvegicus
aggtgtcaattaacactcgccttgt

SEQ ID NO: 153512 - DNA, 25 bp, Rattus norvegicus
aggtgtcaattatcactcgccttgt

SEQ ID NO: 153513 - DNA, 25 bp, Rattus norvegicus
aggtgtcacaccagaatgccctgga

SEQ ID NO: 153514 - DNA, 25 bp, Rattus norvegicus
aggtgtcacacctgaatgccctgga

SEQ ID NO: 153515 - DNA, 25 bp, Rattus norvegicus
aggtgtcacagcattagttcccaac

SEQ ID NO: 153516 - DNA, 25 bp, Rattus norvegicus
aggtgtcacagctttagttcccaac

SEQ ID NO: 153517 - DNA, 25 bp, Rattus norvegicus
aggtgtcacatgactgcaactggag

SEQ ID NO: 153518 - DNA, 25 bp, Rattus norvegicus
aggtgtcacatgtctgcaactggag

SEQ ID NO: 153519 - DNA, 25 bp, Rattus norvegicus
aggtgtcaccaccattttgcaatga

SEQ ID NO: 153520 - DNA, 25 bp, Rattus norvegicus
aggtgtcaccacgattttgcaatga

SEQ ID NO: 153521 - DNA, 25 bp, Rattus norvegicus
aggtgtcaccataattccccaggag

SEQ ID NO: 153522 - DNA, 25 bp, Rattus norvegicus
aggtgtcaccattattccccaggag

SEQ ID NO: 153523 - DNA, 25 bp, Rattus norvegicus
aggtgtcactgacaaaccctcagac

SEQ ID NO: 153524 - DNA, 25 bp, Rattus norvegicus
aggtgtcactgagaaaccctcagac

SEQ ID NO: 153525 - DNA, 25 bp, Rattus norvegicus
aggtgtcactttctccggaatttgt

SEQ ID NO: 153526 - DNA, 25 bp, Rattus norvegicus
aggtgtcactttgtccggaatttgt

SEQ ID NO: 153527 - DNA, 25 bp, Rattus norvegicus
aggtgtcagtcaatttagctatttc

SEQ ID NO: 153528 - DNA, 25 bp, Rattus norvegicus
aggtgtcagtcacttcagggctcca

SEQ ID NO: 153529 - DNA, 25 bp, Rattus norvegicus
aggtgtcagtcagttcagggctcca

SEQ ID NO: 153530 - DNA, 25 bp, Rattus norvegicus
aggtgtcagtcattttagctatttc

SEQ ID NO: 153531 - DNA, 25 bp, Rattus norvegicus
aggtgtcatccaacagagggctcca

SEQ ID NO: 153532 - DNA, 25 bp, Rattus norvegicus
aggtgtcatccatcagagggctcca

SEQ ID NO: 153533 - DNA, 25 bp, Rattus norvegicus
aggtgtcatgtacttccttcaagtt

SEQ ID NO: 153534 - DNA, 25 bp, Rattus norvegicus
aggtgtcatgtagttccttcaagtt

SEQ ID NO: 153535 - DNA, 25 bp, Rattus norvegicus
aggtgtcatgtcagctgggacgcct

SEQ ID NO: 153536 - DNA, 25 bp, Rattus norvegicus
aggtgtcatgtctgctgggacgcct

SEQ ID NO: 153537 - DNA, 25 bp, Rattus norvegicus
aggtgtcattctatgttaccatttg

SEQ ID NO: 153538 - DNA, 25 bp, Rattus norvegicus
aggtgtcattctttgttaccatttg

SEQ ID NO: 153539 - DNA, 25 bp, Rattus norvegicus
aggtgtcattgtccccaagtataca

SEQ ID NO: 153540 - DNA, 25 bp, Rattus norvegicus
aggtgtcattgtgcccaagtataca

SEQ ID NO: 153541 - DNA, 25 bp, Rattus norvegicus
aggtgtcatttcaaatcattccaag

SEQ ID NO: 153542 - DNA, 25 bp, Rattus norvegicus
aggtgtcatttctaatcattccaag

SEQ ID NO: 153543 - DNA, 25 bp, Rattus norvegicus
aggtgtccacacaggcacaattaac

SEQ ID NO: 153544 - DNA, 25 bp, Rattus norvegicus
aggtgtccacactggcacaattaac

SEQ ID NO: 153545 - DNA, 25 bp, Rattus norvegicus
aggtgtccacatagggtggcctgct

SEQ ID NO: 153546 - DNA, 25 bp, Rattus norvegicus
aggtgtccacattgggtggcctgct

SEQ ID NO: 153547 - DNA, 25 bp, Rattus norvegicus
aggtgtccagccaagagcaagaagt

SEQ ID NO: 153548 - DNA, 25 bp, Rattus norvegicus
aggtgtccagcctagagcaagaagt

SEQ ID NO: 153549 - DNA, 25 bp, Rattus norvegicus
aggtgtccagcgcaaaccagcattc

SEQ ID NO: 153550 - DNA, 25 bp, Rattus norvegicus
aggtgtccagcggaaaccagcattc

SEQ ID NO: 153551 - DNA, 25 bp, Rattus norvegicus
aggtgtcccacaagcttattaaaat

SEQ ID NO: 153552 - DNA, 25 bp, Rattus norvegicus
aggtgtcccacatgcttattaaaat

SEQ ID NO: 153553 - DNA, 25 bp, Rattus norvegicus
aggtgtcccaggagctgactcagag

SEQ ID NO: 153554 - DNA, 25 bp, Rattus norvegicus
aggtgtcccaggtgctgactcagag

SEQ ID NO: 153555 - DNA, 25 bp, Rattus norvegicus
aggtgtccctctcgagatcgagctg

SEQ ID NO: 153556 - DNA, 25 bp, Rattus norvegicus
aggtgtccctctggagatcgagctg

SEQ ID NO: 153557 - DNA, 25 bp, Rattus norvegicus
aggtgtccgaagctccagtagtaac

SEQ ID NO: 153558 - DNA, 25 bp, Rattus norvegicus
aggtgtccgaaggtccagtagtaac

SEQ ID NO: 153559 - DNA, 25 bp, Rattus norvegicus
aggtgtcctcgccaaattgttgggc

SEQ ID NO: 153560 - DNA, 25 bp, Rattus norvegicus
aggtgtcctcgcgaaattgttgggc

SEQ ID NO: 153561 - DNA, 25 bp, Rattus norvegicus
aggtgtcctgaaatccctcaatgca

SEQ ID NO: 153562 - DNA, 25 bp, Rattus norvegicus
aggtgtcctgaattccctcaatgca

SEQ ID NO: 153563 - DNA, 25 bp, Rattus norvegicus
aggtgtccttagacatagcctggga

SEQ ID NO: 153564 - DNA, 25 bp, Rattus norvegicus
aggtgtccttagtcatagcctggga

SEQ ID NO: 153565 - DNA, 25 bp, Rattus norvegicus
aggtgtctaacaaggtaaagggcat

SEQ ID NO: 153566 - DNA, 25 bp, Rattus norvegicus
aggtgtctaacatggtaaagggcat

SEQ ID NO: 153567 - DNA, 25 bp, Rattus norvegicus
aggtgtctacacaaaacttattaag

SEQ ID NO: 153568 - DNA, 25 bp, Rattus norvegicus
aggtgtctacactaaacttattaag

SEQ ID NO: 153569 - DNA, 25 bp, Rattus norvegicus
aggtgtctacatccgtgtggcttct

SEQ ID NO: 153570 - DNA, 25 bp, Rattus norvegicus
aggtgtctacatgcgtgtggcttct

SEQ ID NO: 153571 - DNA, 25 bp, Rattus norvegicus
aggtgtctaccaccccactataggg

SEQ ID NO: 153572 - DNA, 25 bp, Rattus norvegicus
aggtgtctaccagcccactataggg

SEQ ID NO: 153573 - DNA, 25 bp, Rattus norvegicus
aggtgtctacgactttattccagca

SEQ ID NO: 153574 - DNA, 25 bp, Rattus norvegicus
aggtgtctacgagtttattccagca

SEQ ID NO: 153575 - DNA, 25 bp, Rattus norvegicus
aggtgtctccgaattacaacctggg

SEQ ID NO: 153576 - DNA, 25 bp, Rattus norvegicus
aggtgtctccgatttacaacctggg

SEQ ID NO: 153577 - DNA, 25 bp, Rattus norvegicus
aggtgtctcctgatttgtgactctt

SEQ ID NO: 153578 - DNA, 25 bp, Rattus norvegicus
aggtgtctcctgttttgtgactctt

SEQ ID NO: 153579 - DNA, 25 bp, Rattus norvegicus
aggtgtctcttactgtttaccacaa

SEQ ID NO: 153580 - DNA, 25 bp, Rattus norvegicus
aggtgtctcttagtgtttaccacaa

SEQ ID NO: 153581 - DNA, 25 bp, Rattus norvegicus
aggtgtctgactaagctaggctcca

SEQ ID NO: 153582 - DNA, 25 bp, Rattus norvegicus
aggtgtctgacttagctaggctcca

SEQ ID NO: 153583 - DNA, 25 bp, Rattus norvegicus
aggtgtctgcacacataggcacaca

SEQ ID NO: 153584 - DNA, 25 bp, Rattus norvegicus
aggtgtctgcactcataggcacaca

SEQ ID NO: 153585 - DNA, 25 bp, Rattus norvegicus
aggtgtctgcagcatgtgactctat

SEQ ID NO: 153586 - DNA, 25 bp, Rattus norvegicus
aggtgtctgcaggatgtgactctat

SEQ ID NO: 153587 - DNA, 25 bp, Rattus norvegicus
aggtgtctgctaaaggtatgtttct

SEQ ID NO: 153588 - DNA, 25 bp, Rattus norvegicus
aggtgtctgctataggtatgtttct

SEQ ID NO: 153589 - DNA, 25 bp, Rattus norvegicus
aggtgtctggcaaatctggttctag

SEQ ID NO: 153590 - DNA, 25 bp, Rattus norvegicus
aggtgtctggcatatctggttctag

SEQ ID NO: 153591 - DNA, 25 bp, Rattus norvegicus
aggtgtctggtccagcctgtgaaca

SEQ ID NO: 153592 - DNA, 25 bp, Rattus norvegicus
aggtgtctggtcgagcctgtgaaca

SEQ ID NO: 153593 - DNA, 25 bp, Rattus norvegicus
aggtgtctgtctctaagcacaccat

SEQ ID NO: 153594 - DNA, 25 bp, Rattus norvegicus
aggtgtctgtctgtaagcacaccat

SEQ ID NO: 153595 - DNA, 25 bp, Rattus norvegicus
aggtgtctgtgcaggcctcccggac

SEQ ID NO: 153596 - DNA, 25 bp, Rattus norvegicus
aggtgtctgtgctggcctcccggac

SEQ ID NO: 153597 - DNA, 25 bp, Rattus norvegicus
aggtgtcttaatcctggcttggcgc

SEQ ID NO: 153598 - DNA, 25 bp, Rattus norvegicus
aggtgtcttaatgctggcttggcgc

SEQ ID NO: 153599 - DNA, 25 bp, Rattus norvegicus
aggtgtcttgaccattgcattgccg

SEQ ID NO: 153600 - DNA, 25 bp, Rattus norvegicus
aggtgtcttgacgattgcattgccg

SEQ ID NO: 153601 - DNA, 25 bp, Rattus norvegicus
aggtgtctttttccaaatgctgctc

SEQ ID NO: 153602 - DNA, 25 bp, Rattus norvegicus
aggtgtctttttgcaaatgctgctc

SEQ ID NO: 153603 - DNA, 25 bp, Rattus norvegicus
aggtgtgaacctcagtgactgcaga

SEQ ID NO: 153604 - DNA, 25 bp, Rattus norvegicus
aggtgtgaacctgagtgactgcaga

SEQ ID NO: 153605 - DNA, 25 bp, Rattus norvegicus
aggtgtgacatccaagtttcttcat

SEQ ID NO: 153606 - DNA, 25 bp, Rattus norvegicus
aggtgtgacatcgaagtttcttcat

SEQ ID NO: 153607 - DNA, 25 bp, Rattus norvegicus
aggtgtgagcacatccgcaaggatt

SEQ ID NO: 153608 - DNA, 25 bp, Rattus norvegicus
aggtgtgagcacttccgcaaggatt

SEQ ID NO: 153609 - DNA, 25 bp, Rattus norvegicus
aggtgtgagttcacacctttgacct

SEQ ID NO: 153610 - DNA, 25 bp, Rattus norvegicus
aggtgtgagttctcacctttgacct

SEQ ID NO: 153611 - DNA, 25 bp, Rattus norvegicus
aggtgtgagtttcgttcccactgca

SEQ ID NO: 153612 - DNA, 25 bp, Rattus norvegicus
aggtgtgagtttggttcccactgca

SEQ ID NO: 153613 - DNA, 25 bp, Rattus norvegicus
aggtgtgatatgcagcctggtatac

SEQ ID NO: 153614 - DNA, 25 bp, Rattus norvegicus
aggtgtgatatggagcctggtatac

SEQ ID NO: 153615 - DNA, 25 bp, Rattus norvegicus
aggtgtgatggcaatctcaccctga

SEQ ID NO: 153616 - DNA, 25 bp, Rattus norvegicus
aggtgtgatggctatctcaccctga

SEQ ID NO: 153617 - DNA, 25 bp, Rattus norvegicus
aggtgtgattttaccagagcgctct

SEQ ID NO: 153618 - DNA, 25 bp, Rattus norvegicus
aggtgtgatttttccagagcgctct

SEQ ID NO: 153619 - DNA, 25 bp, Rattus norvegicus
aggtgtgcaacgagccagctggcta

SEQ ID NO: 153620 - DNA, 25 bp, Rattus norvegicus
aggtgtgcaacgtgccagctggcta

SEQ ID NO: 153621 - DNA, 25 bp, Rattus norvegicus
aggtgtgcaagaagccatttcccca

SEQ ID NO: 153622 - DNA, 25 bp, Rattus norvegicus
aggtgtgcaagatgccatttcccca

SEQ ID NO: 153623 - DNA, 25 bp, Rattus norvegicus
aggtgtgcaagcacaggctggtccc

SEQ ID NO: 153624 - DNA, 25 bp, Rattus norvegicus
aggtgtgcaagctcaggctggtccc

SEQ ID NO: 153625 - DNA, 25 bp, Rattus norvegicus
aggtgtgcaccaacaaacttggtta

SEQ ID NO: 153626 - DNA, 25 bp, Rattus norvegicus
aggtgtgcaccatcaaacttggtta

SEQ ID NO: 153627 - DNA, 25 bp, Rattus norvegicus
aggtgtgcacgtcggtcccatgtcc

SEQ ID NO: 153628 - DNA, 25 bp, Rattus norvegicus
aggtgtgcacgtgggtcccatgtcc

SEQ ID NO: 153629 - DNA, 25 bp, Rattus norvegicus
aggtgtgcactaacatttcctcacg

SEQ ID NO: 153630 - DNA, 25 bp, Rattus norvegicus
aggtgtgcactatcatttcctcacg

SEQ ID NO: 153631 - DNA, 25 bp, Rattus norvegicus
aggtgtgcagtaaacgttgagcttt

SEQ ID NO: 153632 - DNA, 25 bp, Rattus norvegicus
aggtgtgcagtatacgttgagcttt

SEQ ID NO: 153633 - DNA, 25 bp, Rattus norvegicus
aggtgtgcatccctgagtgaccctc

SEQ ID NO: 153634 - DNA, 25 bp, Rattus norvegicus
aggtgtgcatccgtgagtgaccctc

SEQ ID NO: 153635 - DNA, 25 bp, Rattus norvegicus
aggtgtgcatttagatcccaggccc

SEQ ID NO: 153636 - DNA, 25 bp, Rattus norvegicus
aggtgtgcattttgatcccaggccc

SEQ ID NO: 153637 - DNA, 25 bp, Rattus norvegicus
aggtgtgccaccaactgagccacat

SEQ ID NO: 153638 - DNA, 25 bp, Rattus norvegicus
aggtgtgccacctactgagccacat

SEQ ID NO: 153639 - DNA, 25 bp, Rattus norvegicus
aggtgtgccagaccgcttattcgca

SEQ ID NO: 153640 - DNA, 25 bp, Rattus norvegicus
aggtgtgccagagcgcttattcgca

SEQ ID NO: 153641 - DNA, 25 bp, Rattus norvegicus
aggtgtgccagcctcgcctgctgct

SEQ ID NO: 153642 - DNA, 25 bp, Rattus norvegicus
aggtgtgccagcgtcgcctgctgct

SEQ ID NO: 153643 - DNA, 25 bp, Rattus norvegicus
aggtgtgccaggagagccagctcat

SEQ ID NO: 153644 - DNA, 25 bp, Rattus norvegicus
aggtgtgccaggtgagccagctcat

SEQ ID NO: 153645 - DNA, 25 bp, Rattus norvegicus
aggtgtgccatccacatagtgcttt

SEQ ID NO: 153646 - DNA, 25 bp, Rattus norvegicus
aggtgtgccatcgacatagtgcttt

SEQ ID NO: 153647 - DNA, 25 bp, Rattus norvegicus
aggtgtgcccaaagtgcagcgagca

SEQ ID NO: 153648 - DNA, 25 bp, Rattus norvegicus
aggtgtgcccaatgtgcagcgagca

SEQ ID NO: 153649 - DNA, 25 bp, Rattus norvegicus
aggtgtgcccctaagtgagtcaact

SEQ ID NO: 153650 - DNA, 25 bp, Rattus norvegicus
aggtgtgccccttagtgagtcaact

SEQ ID NO: 153651 - DNA, 25 bp, Rattus norvegicus
aggtgtgcctctccatgttcagaaa

SEQ ID NO: 153652 - DNA, 25 bp, Rattus norvegicus
aggtgtgcctctgcatgttcagaaa

SEQ ID NO: 153653 - DNA, 25 bp, Rattus norvegicus
aggtgtgcggcaagcgcttcagcaa

SEQ ID NO: 153654 - DNA, 25 bp, Rattus norvegicus
aggtgtgcggcatgcgcttcagcaa

SEQ ID NO: 153655 - DNA, 25 bp, Rattus norvegicus
aggtgtgcgggcaggacttcctctt

SEQ ID NO: 153656 - DNA, 25 bp, Rattus norvegicus
aggtgtgcgggctggacttcctctt

SEQ ID NO: 153657 - DNA, 25 bp, Rattus norvegicus
aggtgtgctcttcacaggctctgta

SEQ ID NO: 153658 - DNA, 25 bp, Rattus norvegicus
aggtgtgctcttccaagaactccaa

SEQ ID NO: 153659 - DNA, 25 bp, Rattus norvegicus
aggtgtgctcttgacaggctctgta

SEQ ID NO: 153660 - DNA, 25 bp, Rattus norvegicus
aggtgtgctcttgcaagaactccaa

SEQ ID NO: 153661 - DNA, 25 bp, Rattus norvegicus
aggtgtggatgcactctatttagcg

SEQ ID NO: 153662 - DNA, 25 bp, Rattus norvegicus
aggtgtggatgctctctatttagcg

SEQ ID NO: 153663 - DNA, 25 bp, Rattus norvegicus
aggtgtggcaggagatatcgcccca

SEQ ID NO: 153664 - DNA, 25 bp, Rattus norvegicus
aggtgtggcaggtgatatcgcccca

SEQ ID NO: 153665 - DNA, 25 bp, Rattus norvegicus
aggtgtggcctccagattctctgta

SEQ ID NO: 153666 - DNA, 25 bp, Rattus norvegicus
aggtgtggcctcgagattctctgta

SEQ ID NO: 153667 - DNA, 25 bp, Rattus norvegicus
aggtgtggctggctcctaaatcata

SEQ ID NO: 153668 - DNA, 25 bp, Rattus norvegicus
aggtgtggctgggtcctaaatcata

SEQ ID NO: 153669 - DNA, 25 bp, Rattus norvegicus
aggtgtgggcaactccttgactgac

SEQ ID NO: 153670 - DNA, 25 bp, Rattus norvegicus
aggtgtgggcaagtccttgactgac

SEQ ID NO: 153671 - DNA, 25 bp, Rattus norvegicus
aggtgtgggcacagaagtcctacaa

SEQ ID NO: 153672 - DNA, 25 bp, Rattus norvegicus
aggtgtgggcactgaagtcctacaa

SEQ ID NO: 153673 - DNA, 25 bp, Rattus norvegicus
aggtgtgggcttcatccacactgaa

SEQ ID NO: 153674 - DNA, 25 bp, Rattus norvegicus
aggtgtgggcttgatccacactgaa

SEQ ID NO: 153675 - DNA, 25 bp, Rattus norvegicus
aggtgtgggtccagactgacaacca

SEQ ID NO: 153676 - DNA, 25 bp, Rattus norvegicus
aggtgtgggtcctgactgacaacca

SEQ ID NO: 153677 - DNA, 25 bp, Rattus norvegicus
aggtgtggtctgcacttactataga

SEQ ID NO: 153678 - DNA, 25 bp, Rattus norvegicus
aggtgtggtctggacttactataga

SEQ ID NO: 153679 - DNA, 25 bp, Rattus norvegicus
aggtgtggtgagcaagctccctccc

SEQ ID NO: 153680 - DNA, 25 bp, Rattus norvegicus
aggtgtggtgaggaagctccctccc

SEQ ID NO: 153681 - DNA, 25 bp, Rattus norvegicus
aggtgtggtgatcgctgcctcacca

SEQ ID NO: 153682 - DNA, 25 bp, Rattus norvegicus
aggtgtggtgatggctgcctcacca

SEQ ID NO: 153683 - DNA, 25 bp, Rattus norvegicus
aggtgtggttctccaggactgaccc

SEQ ID NO: 153684 - DNA, 25 bp, Rattus norvegicus
aggtgtggttctgcaggactgaccc

SEQ ID NO: 153685 - DNA, 25 bp, Rattus norvegicus
aggtgtgtaaccatcttcagctttg

SEQ ID NO: 153686 - DNA, 25 bp, Rattus norvegicus
aggtgtgtaaccttcttcagctttg

SEQ ID NO: 153687 - DNA, 25 bp, Rattus norvegicus
aggtgtgtaggcctttactttgtag

SEQ ID NO: 153688 - DNA, 25 bp, Rattus norvegicus
aggtgtgtaggcgtttactttgtag

SEQ ID NO: 153689 - DNA, 25 bp, Rattus norvegicus
aggtgtgtcatccactaaccagtct

SEQ ID NO: 153690 - DNA, 25 bp, Rattus norvegicus
aggtgtgtcatcgactaaccagtct

SEQ ID NO: 153691 - DNA, 25 bp, Rattus norvegicus
aggtgtgtcatgatgtccagtgccc

SEQ ID NO: 153692 - DNA, 25 bp, Rattus norvegicus
aggtgtgtcatgttgtccagtgccc

SEQ ID NO: 153693 - DNA, 25 bp, Rattus norvegicus
aggtgtgtccatctcaaggactcca

SEQ ID NO: 153694 - DNA, 25 bp, Rattus norvegicus
aggtgtgtccatgtcaaggactcca

SEQ ID NO: 153695 - DNA, 25 bp, Rattus norvegicus
aggtgtgtctaccacaatgtctggc

SEQ ID NO: 153696 - DNA, 25 bp, Rattus norvegicus
aggtgtgtctacgacaatgtctggc

SEQ ID NO: 153697 - DNA, 25 bp, Rattus norvegicus
aggtgtgtctgacctctggagctca

SEQ ID NO: 153698 - DNA, 25 bp, Rattus norvegicus
aggtgtgtctgagctctggagctca

SEQ ID NO: 153699 - DNA, 25 bp, Rattus norvegicus
aggtgtgtgacaactcaggacccca

SEQ ID NO: 153700 - DNA, 25 bp, Rattus norvegicus
aggtgtgtgacatctcaggacccca

SEQ ID NO: 153701 - DNA, 25 bp, Rattus norvegicus
aggtgtgtgctacttactgtaccca

SEQ ID NO: 153702 - DNA, 25 bp, Rattus norvegicus
aggtgtgtgctagttactgtaccca

SEQ ID NO: 153703 - DNA, 25 bp, Rattus norvegicus
aggtgtgtggacagcccttcagtta

SEQ ID NO: 153704 - DNA, 25 bp, Rattus norvegicus
aggtgtgtggactgcccttcagtta

SEQ ID NO: 153705 - DNA, 25 bp, Rattus norvegicus
aggtgtgtgggaatgccctcatgaa

SEQ ID NO: 153706 - DNA, 25 bp, Rattus norvegicus
aggtgtgtgggattgccctcatgaa

SEQ ID NO: 153707 - DNA, 25 bp, Rattus norvegicus
aggtgtgtgtccatgtagctgaaag

SEQ ID NO: 153708 - DNA, 25 bp, Rattus norvegicus
aggtgtgtgtccttgtagctgaaag

SEQ ID NO: 153709 - DNA, 25 bp, Rattus norvegicus
aggtgtgttagccacggttcccctg

SEQ ID NO: 153710 - DNA, 25 bp, Rattus norvegicus
aggtgtgttagcgacggttcccctg

SEQ ID NO: 153711 - DNA, 25 bp, Rattus norvegicus
aggtgtgttatgactgctttttgtt

SEQ ID NO: 153712 - DNA, 25 bp, Rattus norvegicus
aggtgtgttatgtctgctttttgtt

SEQ ID NO: 153713 - DNA, 25 bp, Rattus norvegicus
aggtgtgtttacattcatcgaggac

SEQ ID NO: 153714 - DNA, 25 bp, Rattus norvegicus
aggtgtgtttactttcatcgaggac

SEQ ID NO: 153715 - DNA, 25 bp, Rattus norvegicus
aggtgttatcctctcatatgtttaa

SEQ ID NO: 153716 - DNA, 25 bp, Rattus norvegicus
aggtgttatcctgtcatatgtttaa

SEQ ID NO: 153717 - DNA, 25 bp, Rattus norvegicus
aggtgttatctcatcagctgggcgg

SEQ ID NO: 153718 - DNA, 25 bp, Rattus norvegicus
aggtgttatctcttcagctgggcgg

SEQ ID NO: 153719 - DNA, 25 bp, Rattus norvegicus
aggtgttcacacacatgcctggctt

SEQ ID NO: 153720 - DNA, 25 bp, Rattus norvegicus
aggtgttcacactcatgcctggctt

SEQ ID NO: 153721 - DNA, 25 bp, Rattus norvegicus
aggtgttcacggacctgtgggcaca

SEQ ID NO: 153722 - DNA, 25 bp, Rattus norvegicus
aggtgttcacggtcctgtgggcaca

SEQ ID NO: 153723 - DNA, 25 bp, Rattus norvegicus
aggtgttcacttcggaaagcatccc

SEQ ID NO: 153724 - DNA, 25 bp, Rattus norvegicus
aggtgttcacttgggaaagcatccc

SEQ ID NO: 153725 - DNA, 25 bp, Rattus norvegicus
aggtgttccactattgtttccatca

SEQ ID NO: 153726 - DNA, 25 bp, Rattus norvegicus
aggtgttccacttttgtttccatca

SEQ ID NO: 153727 - DNA, 25 bp, Rattus norvegicus
aggtgttccggcattccgtcagagc

SEQ ID NO: 153728 - DNA, 25 bp, Rattus norvegicus
aggtgttccggctttccgtcagagc

SEQ ID NO: 153729 - DNA, 25 bp, Rattus norvegicus
aggtgttcctatatttctccaaaga

SEQ ID NO: 153730 - DNA, 25 bp, Rattus norvegicus
aggtgttcctatttttctccaaaga

SEQ ID NO: 153731 - DNA, 25 bp, Rattus norvegicus
aggtgttcctgcagaacagcccaga

SEQ ID NO: 153732 - DNA, 25 bp, Rattus norvegicus
aggtgttcctgctgaacagcccaga

SEQ ID NO: 153733 - DNA, 25 bp, Rattus norvegicus
aggtgttcctgtcatcctcagagag

SEQ ID NO: 153734 - DNA, 25 bp, Rattus norvegicus
aggtgttcctgtgatcctcagagag

SEQ ID NO: 153735 - DNA, 25 bp, Rattus norvegicus
aggtgttccttgacagactctttcc

SEQ ID NO: 153736 - DNA, 25 bp, Rattus norvegicus
aggtgttccttgtcagactctttcc

SEQ ID NO: 153737 - DNA, 25 bp, Rattus norvegicus
aggtgttctctgctgcaaaggcttt

SEQ ID NO: 153738 - DNA, 25 bp, Rattus norvegicus
aggtgttctctggtgcaaaggcttt

SEQ ID NO: 153739 - DNA, 25 bp, Rattus norvegicus
aggtgttctgtaacttgttctttga

SEQ ID NO: 153740 - DNA, 25 bp, Rattus norvegicus
aggtgttctgtatcttgttctttga

SEQ ID NO: 153741 - DNA, 25 bp, Rattus norvegicus
aggtgttctttcaggcctaatgtat

SEQ ID NO: 153742 - DNA, 25 bp, Rattus norvegicus
aggtgttctttctggcctaatgtat

SEQ ID NO: 153743 - DNA, 25 bp, Rattus norvegicus
aggtgttgacttaccaagaggccag

SEQ ID NO: 153744 - DNA, 25 bp, Rattus norvegicus
aggtgttgactttccaagaggccag

SEQ ID NO: 153745 - DNA, 25 bp, Rattus norvegicus
aggtgttgccaacagggtcagccca

SEQ ID NO: 153746 - DNA, 25 bp, Rattus norvegicus
aggtgttgccaagagggtcagccca

SEQ ID NO: 153747 - DNA, 25 bp, Rattus norvegicus
aggtgttgctctctggtacagcact

SEQ ID NO: 153748 - DNA, 25 bp, Rattus norvegicus
aggtgttgctctgtggtacagcact

SEQ ID NO: 153749 - DNA, 25 bp, Rattus norvegicus
aggtgttgcttgatctgtctctcaa

SEQ ID NO: 153750 - DNA, 25 bp, Rattus norvegicus
aggtgttgcttgttctgtctctcaa

SEQ ID NO: 153751 - DNA, 25 bp, Rattus norvegicus
aggtgttggaacctcacataacttt

SEQ ID NO: 153752 - DNA, 25 bp, Rattus norvegicus
aggtgttggaacgtcacataacttt

SEQ ID NO: 153753 - DNA, 25 bp, Rattus norvegicus
aggtgttggcctaatggtcagatct

SEQ ID NO: 153754 - DNA, 25 bp, Rattus norvegicus
aggtgttggccttatggtcagatct

SEQ ID NO: 153755 - DNA, 25 bp, Rattus norvegicus
aggtgttggctcatagtctctgtag

SEQ ID NO: 153756 - DNA, 25 bp, Rattus norvegicus
aggtgttggctcttagtctctgtag

SEQ ID NO: 153757 - DNA, 25 bp, Rattus norvegicus
aggtgttggcttagatggccagctc

SEQ ID NO: 153758 - DNA, 25 bp, Rattus norvegicus
aggtgttggctttgatggccagctc

SEQ ID NO: 153759 - DNA, 25 bp, Rattus norvegicus
aggtgttggtacatctaggccagct

SEQ ID NO: 153760 - DNA, 25 bp, Rattus norvegicus
aggtgttggtacttctaggccagct

SEQ ID NO: 153761 - DNA, 25 bp, Rattus norvegicus
aggtgttggtcccagagatccatct

SEQ ID NO: 153762 - DNA, 25 bp, Rattus norvegicus
aggtgttggtccgagagatccatct

SEQ ID NO: 153763 - DNA, 25 bp, Rattus norvegicus
aggtgttgttgcagtctacgaggac

SEQ ID NO: 153764 - DNA, 25 bp, Rattus norvegicus
aggtgttgttgctgtctacgaggac

SEQ ID NO: 153765 - DNA, 25 bp, Rattus norvegicus
aggtgtttaccccagagtggataat

SEQ ID NO: 153766 - DNA, 25 bp, Rattus norvegicus
aggtgtttacccgagagtggataat

SEQ ID NO: 153767 - DNA, 25 bp, Rattus norvegicus
aggtgtttactgacttgtctccagc

SEQ ID NO: 153768 - DNA, 25 bp, Rattus norvegicus
aggtgtttactgtcttgtctccagc

SEQ ID NO: 153769 - DNA, 25 bp, Rattus norvegicus
aggtgtttatcaccagtaggagttc

SEQ ID NO: 153770 - DNA, 25 bp, Rattus norvegicus
aggtgtttatcagcagtaggagttc

SEQ ID NO: 153771 - DNA, 25 bp, Rattus norvegicus
aggtgtttatggcagtctggaccaa

SEQ ID NO: 153772 - DNA, 25 bp, Rattus norvegicus
aggtgtttatgggagtctggaccaa

SEQ ID NO: 153773 - DNA, 25 bp, Rattus norvegicus
aggtgtttccgcagctccaggagaa

SEQ ID NO: 153774 - DNA, 25 bp, Rattus norvegicus
aggtgtttccgctgctccaggagaa

SEQ ID NO: 153775 - DNA, 25 bp, Rattus norvegicus
aggtgtttcctacgcatggacatat

SEQ ID NO: 153776 - DNA, 25 bp, Rattus norvegicus
aggtgtttcctaggcatggacatat

SEQ ID NO: 153777 - DNA, 25 bp, Rattus norvegicus
aggtgtttcttccttggagccataa

SEQ ID NO: 153778 - DNA, 25 bp, Rattus norvegicus
aggtgtttcttcgttggagccataa

SEQ ID NO: 153779 - DNA, 25 bp, Rattus norvegicus
aggtgtttgcccatctgtgaaggtg

SEQ ID NO: 153780 - DNA, 25 bp, Rattus norvegicus
aggtgtttgcccttctgtgaaggtg

SEQ ID NO: 153781 - DNA, 25 bp, Rattus norvegicus
aggtgtttgtcacctacaacctctc

SEQ ID NO: 153782 - DNA, 25 bp, Rattus norvegicus
aggtgtttgtcagctacaacctctc

SEQ ID NO: 153783 - DNA, 25 bp, Rattus norvegicus
aggtgtttgttcacttgccaccgca

SEQ ID NO: 153784 - DNA, 25 bp, Rattus norvegicus
aggtgtttgttctcttgccaccgca

SEQ ID NO: 153785 - DNA, 25 bp, Rattus norvegicus
aggtgttttacgaccagccatgacg

SEQ ID NO: 153786 - DNA, 25 bp, Rattus norvegicus
aggtgttttacgtccagccatgacg

SEQ ID NO: 153787 - DNA, 25 bp, Rattus norvegicus
aggtgttttcccctccatacatttg

SEQ ID NO: 153788 - DNA, 25 bp, Rattus norvegicus
aggtgttttcccgtccatacatttg

SEQ ID NO: 153789 - DNA, 25 bp, Rattus norvegicus
aggtgttttctactacgcacgccat

SEQ ID NO: 153790 - DNA, 25 bp, Rattus norvegicus
aggtgttttctagtacgcacgccat

SEQ ID NO: 153791 - DNA, 25 bp, Rattus norvegicus
aggttaaacacaccccatgcacaaa

SEQ ID NO: 153792 - DNA, 25 bp, Rattus norvegicus
aggttaaacacagcccatgcacaaa

SEQ ID NO: 153793 - DNA, 25 bp, Rattus norvegicus
aggttaaatgtgagtctgcttacca

SEQ ID NO: 153794 - DNA, 25 bp, Rattus norvegicus
aggttaaatgtgtgtctgcttacca

SEQ ID NO: 153795 - DNA, 25 bp, Rattus norvegicus
aggttaacacttcagacctgtgcat

SEQ ID NO: 153796 - DNA, 25 bp, Rattus norvegicus
aggttaacacttgagacctgtgcat

SEQ ID NO: 153797 - DNA, 25 bp, Rattus norvegicus
aggttaacggtgaactctcaacatt

SEQ ID NO: 153798 - DNA, 25 bp, Rattus norvegicus
aggttaacggtgtactctcaacatt

SEQ ID NO: 153799 - DNA, 25 bp, Rattus norvegicus
aggttaactcgacgctgtccataga

SEQ ID NO: 153800 - DNA, 25 bp, Rattus norvegicus
aggttaactcgaggctgtccataga

SEQ ID NO: 153801 - DNA, 25 bp, Rattus norvegicus
aggttaaggtttcctctgtcagagg

SEQ ID NO: 153802 - DNA, 25 bp, Rattus norvegicus
aggttaaggtttgctctgtcagagg

SEQ ID NO: 153803 - DNA, 25 bp, Rattus norvegicus
aggttaagtcctccccggatgccat

SEQ ID NO: 153804 - DNA, 25 bp, Rattus norvegicus
aggttaagtcctgcccggatgccat

SEQ ID NO: 153805 - DNA, 25 bp, Rattus norvegicus
aggttaatacctctagtgcctctat

SEQ ID NO: 153806 - DNA, 25 bp, Rattus norvegicus
aggttaatacctgtagtgcctctat

SEQ ID NO: 153807 - DNA, 25 bp, Rattus norvegicus
aggttaatgcttactgattctgtga

SEQ ID NO: 153808 - DNA, 25 bp, Rattus norvegicus
aggttaatgcttaggctggttccca

SEQ ID NO: 153809 - DNA, 25 bp, Rattus norvegicus
aggttaatgctttctgattctgtga

SEQ ID NO: 153810 - DNA, 25 bp, Rattus norvegicus
aggttaatgctttggctggttccca

SEQ ID NO: 153811 - DNA, 25 bp, Rattus norvegicus
aggttaatggcgactcttatttgga

SEQ ID NO: 153812 - DNA, 25 bp, Rattus norvegicus
aggttaatggcgtctcttatttgga

SEQ ID NO: 153813 - DNA, 25 bp, Rattus norvegicus
aggttacactttctacctctggcat

SEQ ID NO: 153814 - DNA, 25 bp, Rattus norvegicus
aggttacactttgtacctctggcat

SEQ ID NO: 153815 - DNA, 25 bp, Rattus norvegicus
aggttacagaaacaagactcatatt

SEQ ID NO: 153816 - DNA, 25 bp, Rattus norvegicus
aggttacagaaagaagactcatatt

SEQ ID NO: 153817 - DNA, 25 bp, Rattus norvegicus
aggttacagaccacaggccaacgta

SEQ ID NO: 153818 - DNA, 25 bp, Rattus norvegicus
aggttacagacctcaggccaacgta

SEQ ID NO: 153819 - DNA, 25 bp, Rattus norvegicus
aggttacatagaacctctcttaaag

SEQ ID NO: 153820 - DNA, 25 bp, Rattus norvegicus
aggttacatagatcctctcttaaag

SEQ ID NO: 153821 - DNA, 25 bp, Rattus norvegicus
aggttacatctaacttcctctatgc

SEQ ID NO: 153822 - DNA, 25 bp, Rattus norvegicus
aggttacatctatcttcctctatgc

SEQ ID NO: 153823 - DNA, 25 bp, Rattus norvegicus
aggttaccatcactggatctgctgc

SEQ ID NO: 153824 - DNA, 25 bp, Rattus norvegicus
aggttaccatcagtggatctgctgc

SEQ ID NO: 153825 - DNA, 25 bp, Rattus norvegicus
aggttaccgatactagcattctctc

SEQ ID NO: 153826 - DNA, 25 bp, Rattus norvegicus
aggttaccgatagtagcattctctc

SEQ ID NO: 153827 - DNA, 25 bp, Rattus norvegicus
aggttacctacaactcatacttgct

SEQ ID NO: 153828 - DNA, 25 bp, Rattus norvegicus
aggttacctacatctcatacttgct

SEQ ID NO: 153829 - DNA, 25 bp, Rattus norvegicus
aggttacctctcacaaaggccaagg

SEQ ID NO: 153830 - DNA, 25 bp, Rattus norvegicus
aggttacctctctcaaaggccaagg

SEQ ID NO: 153831 - DNA, 25 bp, Rattus norvegicus
aggttacctggaacagtcccagcag

SEQ ID NO: 153832 - DNA, 25 bp, Rattus norvegicus
aggttacctggatcagtcccagcag

SEQ ID NO: 153833 - DNA, 25 bp, Rattus norvegicus
aggttacctgtgactgggatagctt

SEQ ID NO: 153834 - DNA, 25 bp, Rattus norvegicus
aggttacctgtgtctgggatagctt

SEQ ID NO: 153835 - DNA, 25 bp, Rattus norvegicus
aggttaccttttcagccaagggcat

SEQ ID NO: 153836 - DNA, 25 bp, Rattus norvegicus
aggttaccttttgagccaagggcat

SEQ ID NO: 153837 - DNA, 25 bp, Rattus norvegicus
aggttacgcctcagcaggtgactct

SEQ ID NO: 153838 - DNA, 25 bp, Rattus norvegicus
aggttacgcctctgcaggtgactct

SEQ ID NO: 153839 - DNA, 25 bp, Rattus norvegicus
aggttactcaccaaatttcttcagt

SEQ ID NO: 153840 - DNA, 25 bp, Rattus norvegicus
aggttactcaccaacttctgttatc

SEQ ID NO: 153841 - DNA, 25 bp, Rattus norvegicus
aggttactcacctaatttcttcagt

SEQ ID NO: 153842 - DNA, 25 bp, Rattus norvegicus
aggttactcacctacttctgttatc

SEQ ID NO: 153843 - DNA, 25 bp, Rattus norvegicus
aggttactcagaaccgcctggagga

SEQ ID NO: 153844 - DNA, 25 bp, Rattus norvegicus
aggttactcagatccgcctggagga

SEQ ID NO: 153845 - DNA, 25 bp, Rattus norvegicus
aggttactctgaaagcccatcgcag

SEQ ID NO: 153846 - DNA, 25 bp, Rattus norvegicus
aggttactctgatagcccatcgcag

SEQ ID NO: 153847 - DNA, 25 bp, Rattus norvegicus
aggttactcttcctatttctgtgca

SEQ ID NO: 153848 - DNA, 25 bp, Rattus norvegicus
aggttactcttcgtatttctgtgca

SEQ ID NO: 153849 - DNA, 25 bp, Rattus norvegicus
aggttactggccatctatctccaga

SEQ ID NO: 153850 - DNA, 25 bp, Rattus norvegicus
aggttactggccttctatctccaga

SEQ ID NO: 153851 - DNA, 25 bp, Rattus norvegicus
aggttactgtatcctgcggaactct

SEQ ID NO: 153852 - DNA, 25 bp, Rattus norvegicus
aggttactgtatgctgcggaactct

SEQ ID NO: 153853 - DNA, 25 bp, Rattus norvegicus
aggttactttttctcagacttgcct

SEQ ID NO: 153854 - DNA, 25 bp, Rattus norvegicus
aggttactttttgtcagacttgcct

SEQ ID NO: 153855 - DNA, 25 bp, Rattus norvegicus
aggttagactctagctagacccctt

SEQ ID NO: 153856 - DNA, 25 bp, Rattus norvegicus
aggttagactcttgctagacccctt

SEQ ID NO: 153857 - DNA, 25 bp, Rattus norvegicus
aggttagccacactctcagcttagt

SEQ ID NO: 153858 - DNA, 25 bp, Rattus norvegicus
aggttagccacagtctcagcttagt

SEQ ID NO: 153859 - DNA, 25 bp, Rattus norvegicus
aggttagcgctcactgttgggcaca

SEQ ID NO: 153860 - DNA, 25 bp, Rattus norvegicus
aggttagcgctctctgttgggcaca

SEQ ID NO: 153861 - DNA, 25 bp, Rattus norvegicus
aggttaggagataccggctctgccc

SEQ ID NO: 153862 - DNA, 25 bp, Rattus norvegicus
aggttaggagattccggctctgccc

SEQ ID NO: 153863 - DNA, 25 bp, Rattus norvegicus
aggttaggagcacgccctgccttgt

SEQ ID NO: 153864 - DNA, 25 bp, Rattus norvegicus
aggttaggagcaggccctgccttgt

SEQ ID NO: 153865 - DNA, 25 bp, Rattus norvegicus
aggttagggacactgtcccactgtc

SEQ ID NO: 153866 - DNA, 25 bp, Rattus norvegicus
aggttagggacagtgtcccactgtc

SEQ ID NO: 153867 - DNA, 25 bp, Rattus norvegicus
aggttaggtgccaagtgcggcccca

SEQ ID NO: 153868 - DNA, 25 bp, Rattus norvegicus
aggttaggtgcctagtgcggcccca

SEQ ID NO: 153869 - DNA, 25 bp, Rattus norvegicus
aggttagtagatctcagcattccta

SEQ ID NO: 153870 - DNA, 25 bp, Rattus norvegicus
aggttagtagatgtcagcattccta

SEQ ID NO: 153871 - DNA, 25 bp, Rattus norvegicus
aggttagtcctgaccaaattctctt

SEQ ID NO: 153872 - DNA, 25 bp, Rattus norvegicus
aggttagtcctgtccaaattctctt

SEQ ID NO: 153873 - DNA, 25 bp, Rattus norvegicus
aggttagtgcctcatcactcagaaa

SEQ ID NO: 153874 - DNA, 25 bp, Rattus norvegicus
aggttagtgcctgatcactcagaaa

SEQ ID NO: 153875 - DNA, 25 bp, Rattus norvegicus
aggttagttgtactctccatcctag

SEQ ID NO: 153876 - DNA, 25 bp, Rattus norvegicus
aggttagttgtagtctccatcctag

SEQ ID NO: 153877 - DNA, 25 bp, Rattus norvegicus
aggttatccataaggccgtcaaagt

SEQ ID NO: 153878 - DNA, 25 bp, Rattus norvegicus
aggttatccatatggccgtcaaagt

SEQ ID NO: 153879 - DNA, 25 bp, Rattus norvegicus
aggttatccatgctgctcatacgtc

SEQ ID NO: 153880 - DNA, 25 bp, Rattus norvegicus
aggttatccatggtgctcatacgtc

SEQ ID NO: 153881 - DNA, 25 bp, Rattus norvegicus
aggttatccttgatgcacagtagca

SEQ ID NO: 153882 - DNA, 25 bp, Rattus norvegicus
aggttatccttgttgcacagtagca

SEQ ID NO: 153883 - DNA, 25 bp, Rattus norvegicus
aggttatgggtcactgtcttcactg

SEQ ID NO: 153884 - DNA, 25 bp, Rattus norvegicus
aggttatgggtctctgtcttcactg

SEQ ID NO: 153885 - DNA, 25 bp, Rattus norvegicus
aggttatggtccctgcgatgctcac

SEQ ID NO: 153886 - DNA, 25 bp, Rattus norvegicus
aggttatggtccgtgcgatgctcac

SEQ ID NO: 153887 - DNA, 25 bp, Rattus norvegicus
aggttattacctccttcctttcatt

SEQ ID NO: 153888 - DNA, 25 bp, Rattus norvegicus
aggttattacctgcttcctttcatt

SEQ ID NO: 153889 - DNA, 25 bp, Rattus norvegicus
aggttattcagacctgttctgcctc

SEQ ID NO: 153890 - DNA, 25 bp, Rattus norvegicus
aggttattcagagctgttctgcctc

SEQ ID NO: 153891 - DNA, 25 bp, Rattus norvegicus
aggttattcagtcctcctagctgaa

SEQ ID NO: 153892 - DNA, 25 bp, Rattus norvegicus
aggttattcagtgctcctagctgaa

SEQ ID NO: 153893 - DNA, 25 bp, Rattus norvegicus
aggttattgtagcttcatttaccaa

SEQ ID NO: 153894 - DNA, 25 bp, Rattus norvegicus
aggttattgtaggttcatttaccaa

SEQ ID NO: 153895 - DNA, 25 bp, Rattus norvegicus
aggttatttcccattcatctttctt

SEQ ID NO: 153896 - DNA, 25 bp, Rattus norvegicus
aggttatttccctttcatctttctt

SEQ ID NO: 153897 - DNA, 25 bp, Rattus norvegicus
aggttcaacgagagggcaaggtaca

SEQ ID NO: 153898 - DNA, 25 bp, Rattus norvegicus
aggttcaacgagtgggcaaggtaca

SEQ ID NO: 153899 - DNA, 25 bp, Rattus norvegicus
aggttcaagattaccgtggtcttca

SEQ ID NO: 153900 - DNA, 25 bp, Rattus norvegicus
aggttcaagatttccgtggtcttca

SEQ ID NO: 153901 - DNA, 25 bp, Rattus norvegicus
aggttcaagttaagcagtgccttca

SEQ ID NO: 153902 - DNA, 25 bp, Rattus norvegicus
aggttcaagttatgcagtgccttca

SEQ ID NO: 153903 - DNA, 25 bp, Rattus norvegicus
aggttcaataacagggcctctgcca

SEQ ID NO: 153904 - DNA, 25 bp, Rattus norvegicus
aggttcaataactgggcctctgcca

SEQ ID NO: 153905 - DNA, 25 bp, Rattus norvegicus
aggttcaatcacatcctgtttgctg

SEQ ID NO: 153906 - DNA, 25 bp, Rattus norvegicus
aggttcaatcacttcctgtttgctg

SEQ ID NO: 153907 - DNA, 25 bp, Rattus norvegicus
aggttcaatcccagacacttagtca

SEQ ID NO: 153908 - DNA, 25 bp, Rattus norvegicus
aggttcaatccctgacacttagtca

SEQ ID NO: 153909 - DNA, 25 bp, Rattus norvegicus
aggttcacacacaaagctagctctg

SEQ ID NO: 153910 - DNA, 25 bp, Rattus norvegicus
aggttcacacactaagctagctctg

SEQ ID NO: 153911 - DNA, 25 bp, Rattus norvegicus
aggttcacagctctacttaaaatgg

SEQ ID NO: 153912 - DNA, 25 bp, Rattus norvegicus
aggttcacagctgtacttaaaatgg

SEQ ID NO: 153913 - DNA, 25 bp, Rattus norvegicus
aggttcacctgaagtctccctttga

SEQ ID NO: 153914 - DNA, 25 bp, Rattus norvegicus
aggttcacctgatgtctccctttga

SEQ ID NO: 153915 - DNA, 25 bp, Rattus norvegicus
aggttcacgccacagttcatgtcat

SEQ ID NO: 153916 - DNA, 25 bp, Rattus norvegicus
aggttcacgccagagttcatgtcat

SEQ ID NO: 153917 - DNA, 25 bp, Rattus norvegicus
aggttcacgtctcaggtcgccatga

SEQ ID NO: 153918 - DNA, 25 bp, Rattus norvegicus
aggttcacgtctgaggtcgccatga

SEQ ID NO: 153919 - DNA, 25 bp, Rattus norvegicus
aggttcactgctcatgtccgatcgg

SEQ ID NO: 153920 - DNA, 25 bp, Rattus norvegicus
aggttcactgctgatgtccgatcgg

SEQ ID NO: 153921 - DNA, 25 bp, Rattus norvegicus
aggttcactggccattagacccagg

SEQ ID NO: 153922 - DNA, 25 bp, Rattus norvegicus
aggttcactggcgattagacccagg

SEQ ID NO: 153923 - DNA, 25 bp, Rattus norvegicus
aggttcacttgtcctgcttttctaa

SEQ ID NO: 153924 - DNA, 25 bp, Rattus norvegicus
aggttcacttgtgctgcttttctaa

SEQ ID NO: 153925 - DNA, 25 bp, Rattus norvegicus
aggttcagaaacatgtggtaggcca

SEQ ID NO: 153926 - DNA, 25 bp, Rattus norvegicus
aggttcagaaacttgtggtaggcca

SEQ ID NO: 153927 - DNA, 25 bp, Rattus norvegicus
aggttcagacccatatagctcagaa

SEQ ID NO: 153928 - DNA, 25 bp, Rattus norvegicus
aggttcagacccttatagctcagaa

SEQ ID NO: 153929 - DNA, 25 bp, Rattus norvegicus
aggttcagcacaaaccagccaggtg

SEQ ID NO: 153930 - DNA, 25 bp, Rattus norvegicus
aggttcagcacataccagccaggtg

SEQ ID NO: 153931 - DNA, 25 bp, Rattus norvegicus
aggttcagcttcagggccaagggct

SEQ ID NO: 153932 - DNA, 25 bp, Rattus norvegicus
aggttcagcttctgggccaagggct

SEQ ID NO: 153933 - DNA, 25 bp, Rattus norvegicus
aggttcaggccgaccagcaaacatg

SEQ ID NO: 153934 - DNA, 25 bp, Rattus norvegicus
aggttcaggccgtccagcaaacatg

SEQ ID NO: 153935 - DNA, 25 bp, Rattus norvegicus
aggttcaggcttctgtacagggcat

SEQ ID NO: 153936 - DNA, 25 bp, Rattus norvegicus
aggttcaggcttgtgtacagggcat

SEQ ID NO: 153937 - DNA, 25 bp, Rattus norvegicus
aggttcaggtctacaggcctcagtc

SEQ ID NO: 153938 - DNA, 25 bp, Rattus norvegicus
aggttcaggtcttcaggcctcagtc

SEQ ID NO: 153939 - DNA, 25 bp, Rattus norvegicus
aggttcagtttcagggcatgcttta

SEQ ID NO: 153940 - DNA, 25 bp, Rattus norvegicus
aggttcagtttctgggcatgcttta

SEQ ID NO: 153941 - DNA, 25 bp, Rattus norvegicus
aggttcatataacttctctgtggtt

SEQ ID NO: 153942 - DNA, 25 bp, Rattus norvegicus
aggttcatataagttctctgtggtt

SEQ ID NO: 153943 - DNA, 25 bp, Rattus norvegicus
aggttcatcactatgtgtggccggg

SEQ ID NO: 153944 - DNA, 25 bp, Rattus norvegicus
aggttcatcactttgtgtggccggg

SEQ ID NO: 153945 - DNA, 25 bp, Rattus norvegicus
aggttcatcagccacgtcaagtgca

SEQ ID NO: 153946 - DNA, 25 bp, Rattus norvegicus
aggttcatcagcgacgtcaagtgca

SEQ ID NO: 153947 - DNA, 25 bp, Rattus norvegicus
aggttcatccgcaggatctgttagc

SEQ ID NO: 153948 - DNA, 25 bp, Rattus norvegicus
aggttcatccgctggatctgttagc

SEQ ID NO: 153949 - DNA, 25 bp, Rattus norvegicus
aggttcatcgtgaccagcctgggca

SEQ ID NO: 153950 - DNA, 25 bp, Rattus norvegicus
aggttcatcgtgtccagcctgggca

SEQ ID NO: 153951 - DNA, 25 bp, Rattus norvegicus
aggttcatctgaactcaagtcaata

SEQ ID NO: 153952 - DNA, 25 bp, Rattus norvegicus
aggttcatctgatctcaagtcaata

SEQ ID NO: 153953 - DNA, 25 bp, Rattus norvegicus
aggttcatctggacatctgctcttc

SEQ ID NO: 153954 - DNA, 25 bp, Rattus norvegicus
aggttcatctggtcatctgctcttc

SEQ ID NO: 153955 - DNA, 25 bp, Rattus norvegicus
aggttcatcttcactgactgagtct

SEQ ID NO: 153956 - DNA, 25 bp, Rattus norvegicus
aggttcatcttctctgactgagtct

SEQ ID NO: 153957 - DNA, 25 bp, Rattus norvegicus
aggttcatcttgattgtgcacgctg

SEQ ID NO: 153958 - DNA, 25 bp, Rattus norvegicus
aggttcatcttgtttgtgcacgctg

SEQ ID NO: 153959 - DNA, 25 bp, Rattus norvegicus
aggttcatgccgagaaggtcgttct

SEQ ID NO: 153960 - DNA, 25 bp, Rattus norvegicus
aggttcatgccgtgaaggtcgttct

SEQ ID NO: 153961 - DNA, 25 bp, Rattus norvegicus
aggttcatgtctctggacgctcagt

SEQ ID NO: 153962 - DNA, 25 bp, Rattus norvegicus
aggttcatgtctgtggacgctcagt

SEQ ID NO: 153963 - DNA, 25 bp, Rattus norvegicus
aggttcatgtggacatttctaaaat

SEQ ID NO: 153964 - DNA, 25 bp, Rattus norvegicus
aggttcatgtggtcatttctaaaat

SEQ ID NO: 153965 - DNA, 25 bp, Rattus norvegicus
aggttcattctacggcaggagcatc

SEQ ID NO: 153966 - DNA, 25 bp, Rattus norvegicus
aggttcattctagggcaggagcatc

SEQ ID NO: 153967 - DNA, 25 bp, Rattus norvegicus
aggttcattggcctggagtccatat

SEQ ID NO: 153968 - DNA, 25 bp, Rattus norvegicus
aggttcattggcgtggagtccatat

SEQ ID NO: 153969 - DNA, 25 bp, Rattus norvegicus
aggttcatttgtcgccactcagggc

SEQ ID NO: 153970 - DNA, 25 bp, Rattus norvegicus
aggttcatttgtggccactcagggc

SEQ ID NO: 153971 - DNA, 25 bp, Rattus norvegicus
aggttccaacacatggacctcggaa

SEQ ID NO: 153972 - DNA, 25 bp, Rattus norvegicus
aggttccaacacttggacctcggaa

SEQ ID NO: 153973 - DNA, 25 bp, Rattus norvegicus
aggttccaatgtctttctctgctgt

SEQ ID NO: 153974 - DNA, 25 bp, Rattus norvegicus
aggttccaatgtgtttctctgctgt

SEQ ID NO: 153975 - DNA, 25 bp, Rattus norvegicus
aggttccacgtgatgggctgagcca

SEQ ID NO: 153976 - DNA, 25 bp, Rattus norvegicus
aggttccacgtgttgggctgagcca

SEQ ID NO: 153977 - DNA, 25 bp, Rattus norvegicus
aggttccagacaataagcgctttct

SEQ ID NO: 153978 - DNA, 25 bp, Rattus norvegicus
aggttccagacattaagcgctttct

SEQ ID NO: 153979 - DNA, 25 bp, Rattus norvegicus
aggttccagcttcttgagcccagag

SEQ ID NO: 153980 - DNA, 25 bp, Rattus norvegicus
aggttccagcttgttgagcccagag

SEQ ID NO: 153981 - DNA, 25 bp, Rattus norvegicus
aggttccagtgcacggccctgagga

SEQ ID NO: 153982 - DNA, 25 bp, Rattus norvegicus
aggttccagtgctcggccctgagga

SEQ ID NO: 153983 - DNA, 25 bp, Rattus norvegicus
aggttccatcctccaggtgggttga

SEQ ID NO: 153984 - DNA, 25 bp, Rattus norvegicus
aggttccatcctgcaggtgggttga

SEQ ID NO: 153985 - DNA, 25 bp, Rattus norvegicus
aggttcccaaagacagactggtgcc

SEQ ID NO: 153986 - DNA, 25 bp, Rattus norvegicus
aggttcccaaagtcagactggtgcc

SEQ ID NO: 153987 - DNA, 25 bp, Rattus norvegicus
aggttcccacagcatgcgtctgtat

SEQ ID NO: 153988 - DNA, 25 bp, Rattus norvegicus
aggttcccacaggatgcgtctgtat

SEQ ID NO: 153989 - DNA, 25 bp, Rattus norvegicus
aggttcccagaaacccagagtgctc

SEQ ID NO: 153990 - DNA, 25 bp, Rattus norvegicus
aggttcccagaatcccagagtgctc

SEQ ID NO: 153991 - DNA, 25 bp, Rattus norvegicus
aggttcccagtcaagactcagttca

SEQ ID NO: 153992 - DNA, 25 bp, Rattus norvegicus
aggttcccagtctagactcagttca

SEQ ID NO: 153993 - DNA, 25 bp, Rattus norvegicus
aggttcccatccagacgacaaggct

SEQ ID NO: 153994 - DNA, 25 bp, Rattus norvegicus
aggttcccatcctgacgacaaggct

SEQ ID NO: 153995 - DNA, 25 bp, Rattus norvegicus
aggttccccaaacatgtctctccat

SEQ ID NO: 153996 - DNA, 25 bp, Rattus norvegicus
aggttccccaaagatgtctctccat

SEQ ID NO: 153997 - DNA, 25 bp, Rattus norvegicus
aggttccccttgaggcaggcactgt

SEQ ID NO: 153998 - DNA, 25 bp, Rattus norvegicus
aggttccccttgtggcaggcactgt

SEQ ID NO: 153999 - DNA, 25 bp, Rattus norvegicus
aggttccctatcatgagctggagct

SEQ ID NO: 154000 - DNA, 25 bp, Rattus norvegicus
aggttccctatcttgagctggagct

SEQ ID NO: 154001 - DNA, 25 bp, Rattus norvegicus
aggttccctctccttagaagactct

SEQ ID NO: 154002 - DNA, 25 bp, Rattus norvegicus
aggttccctctcgttagaagactct

SEQ ID NO: 154003 - DNA, 25 bp, Rattus norvegicus
aggttcccttcactgcacacaactg

SEQ ID NO: 154004 - DNA, 25 bp, Rattus norvegicus
aggttcccttcagtgcacacaactg

SEQ ID NO: 154005 - DNA, 25 bp, Rattus norvegicus
aggttccgaaaccagctggtccaca

SEQ ID NO: 154006 - DNA, 25 bp, Rattus norvegicus
aggttccgaaacgagctggtccaca

SEQ ID NO: 154007 - DNA, 25 bp, Rattus norvegicus
aggttccgtagcagaatgccattgt

SEQ ID NO: 154008 - DNA, 25 bp, Rattus norvegicus
aggttccgtagctgaatgccattgt

SEQ ID NO: 154009 - DNA, 25 bp, Rattus norvegicus
aggttcctagataggataccatcca

SEQ ID NO: 154010 - DNA, 25 bp, Rattus norvegicus
aggttcctagattggataccatcca

SEQ ID NO: 154011 - DNA, 25 bp, Rattus norvegicus
aggttcctaggtattctgtcagtgc

SEQ ID NO: 154012 - DNA, 25 bp, Rattus norvegicus
aggttcctaggttttctgtcagtgc

SEQ ID NO: 154013 - DNA, 25 bp, Rattus norvegicus
aggttcctagtaatttctggccatc

SEQ ID NO: 154014 - DNA, 25 bp, Rattus norvegicus
aggttcctagtattttctggccatc

SEQ ID NO: 154015 - DNA, 25 bp, Rattus norvegicus
aggttcctccatcaaggtgcctgtg

SEQ ID NO: 154016 - DNA, 25 bp, Rattus norvegicus
aggttcctccatgaaggtgcctgtg

SEQ ID NO: 154017 - DNA, 25 bp, Rattus norvegicus
aggttcctctttccacataaatgct

SEQ ID NO: 154018 - DNA, 25 bp, Rattus norvegicus
aggttcctctttgcacataaatgct

SEQ ID NO: 154019 - DNA, 25 bp, Rattus norvegicus
aggttcctgaatccaaggtccttct

SEQ ID NO: 154020 - DNA, 25 bp, Rattus norvegicus
aggttcctgaatgcaaggtccttct

SEQ ID NO: 154021 - DNA, 25 bp, Rattus norvegicus
aggttcctgcacattgctgattgag

SEQ ID NO: 154022 - DNA, 25 bp, Rattus norvegicus
aggttcctgcactttgctgattgag

SEQ ID NO: 154023 - DNA, 25 bp, Rattus norvegicus
aggttcctggaccatgagcgcatgc

SEQ ID NO: 154024 - DNA, 25 bp, Rattus norvegicus
aggttcctggacgatgagcgcatgc

SEQ ID NO: 154025 - DNA, 25 bp, Rattus norvegicus
aggttcctgtggagtgctcatgctc

SEQ ID NO: 154026 - DNA, 25 bp, Rattus norvegicus
aggttcctgtggtgtgctcatgctc

SEQ ID NO: 154027 - DNA, 25 bp, Rattus norvegicus
aggttcctgttcctgaagatcatgg

SEQ ID NO: 154028 - DNA, 25 bp, Rattus norvegicus
aggttcctgttcgtgaagatcatgg

SEQ ID NO: 154029 - DNA, 25 bp, Rattus norvegicus
aggttccttaacatgatgtgcctcc

SEQ ID NO: 154030 - DNA, 25 bp, Rattus norvegicus
aggttccttaacttgatgtgcctcc

SEQ ID NO: 154031 - DNA, 25 bp, Rattus norvegicus
aggttccttaggcaacgttctgtat

SEQ ID NO: 154032 - DNA, 25 bp, Rattus norvegicus
aggttccttagggaacgttctgtat

SEQ ID NO: 154033 - DNA, 25 bp, Rattus norvegicus
aggttccttctgaattctgtatctt

SEQ ID NO: 154034 - DNA, 25 bp, Rattus norvegicus
aggttccttctgtattctgtatctt

SEQ ID NO: 154035 - DNA, 25 bp, Rattus norvegicus
aggttcctttaaactgttccactga

SEQ ID NO: 154036 - DNA, 25 bp, Rattus norvegicus
aggttcctttaatctgttccactga

SEQ ID NO: 154037 - DNA, 25 bp, Rattus norvegicus
aggttcgaagacagatgcgtgcccg

SEQ ID NO: 154038 - DNA, 25 bp, Rattus norvegicus
aggttcgaagactgatgcgtgcccg

SEQ ID NO: 154039 - DNA, 25 bp, Rattus norvegicus
aggttcgaatacagctgcctccaag

SEQ ID NO: 154040 - DNA, 25 bp, Rattus norvegicus
aggttcgaatactgctgcctccaag

SEQ ID NO: 154041 - DNA, 25 bp, Rattus norvegicus
aggttcgacgtcagtgccaggagaa

SEQ ID NO: 154042 - DNA, 25 bp, Rattus norvegicus
aggttcgacgtctgtgccaggagaa

SEQ ID NO: 154043 - DNA, 25 bp, Rattus norvegicus
aggttcgaggccatgcaactgagct

SEQ ID NO: 154044 - DNA, 25 bp, Rattus norvegicus
aggttcgaggccttgcaactgagct

SEQ ID NO: 154045 - DNA, 25 bp, Rattus norvegicus
aggttcgcaaccctgacttcaggag

SEQ ID NO: 154046 - DNA, 25 bp, Rattus norvegicus
aggttcgcaaccgtgacttcaggag

SEQ ID NO: 154047 - DNA, 25 bp, Rattus norvegicus
aggttcgcatccattttcagattct

SEQ ID NO: 154048 - DNA, 25 bp, Rattus norvegicus
aggttcgcatcctttttcagattct

SEQ ID NO: 154049 - DNA, 25 bp, Rattus norvegicus
aggttcgcctctaacgcaatggaga

SEQ ID NO: 154050 - DNA, 25 bp, Rattus norvegicus
aggttcgcctcttacgcaatggaga

SEQ ID NO: 154051 - DNA, 25 bp, Rattus norvegicus
aggttcgctgtccaactgcaagagc

SEQ ID NO: 154052 - DNA, 25 bp, Rattus norvegicus
aggttcgctgtcgaactgcaagagc

SEQ ID NO: 154053 - DNA, 25 bp, Rattus norvegicus
aggttcggagccacagacacaacaa

SEQ ID NO: 154054 - DNA, 25 bp, Rattus norvegicus
aggttcggagcctcagacacaacaa

SEQ ID NO: 154055 - DNA, 25 bp, Rattus norvegicus
aggttcggcccgagatcgagcacaa

SEQ ID NO: 154056 - DNA, 25 bp, Rattus norvegicus
aggttcggcccgtgatcgagcacaa

SEQ ID NO: 154057 - DNA, 25 bp, Rattus norvegicus
aggttctaataacccggaccgccag

SEQ ID NO: 154058 - DNA, 25 bp, Rattus norvegicus
aggttctaataagccggaccgccag

SEQ ID NO: 154059 - DNA, 25 bp, Rattus norvegicus
aggttctacagtcttcgtctttgaa

SEQ ID NO: 154060 - DNA, 25 bp, Rattus norvegicus
aggttctacagtgttcgtctttgaa

SEQ ID NO: 154061 - DNA, 25 bp, Rattus norvegicus
aggttctacctccttgtgcaaaggg

SEQ ID NO: 154062 - DNA, 25 bp, Rattus norvegicus
aggttctacctcgttgtgcaaaggg

SEQ ID NO: 154063 - DNA, 25 bp, Rattus norvegicus
aggttctagatcatctctgcagcaa

SEQ ID NO: 154064 - DNA, 25 bp, Rattus norvegicus
aggttctagatcttctctgcagcaa

SEQ ID NO: 154065 - DNA, 25 bp, Rattus norvegicus
aggttctaggaaacttacactggta

SEQ ID NO: 154066 - DNA, 25 bp, Rattus norvegicus
aggttctaggaacgtcactcaatgt

SEQ ID NO: 154067 - DNA, 25 bp, Rattus norvegicus
aggttctaggaaggtcactcaatgt

SEQ ID NO: 154068 - DNA, 25 bp, Rattus norvegicus
aggttctaggaatcttacactggta

SEQ ID NO: 154069 - DNA, 25 bp, Rattus norvegicus
aggttctaggtcattctctaggctt

SEQ ID NO: 154070 - DNA, 25 bp, Rattus norvegicus
aggttctaggtctttctctaggctt

SEQ ID NO: 154071 - DNA, 25 bp, Rattus norvegicus
aggttctattctagccatattctct

SEQ ID NO: 154072 - DNA, 25 bp, Rattus norvegicus
aggttctattcttgccatattctct

SEQ ID NO: 154073 - DNA, 25 bp, Rattus norvegicus
aggttctcagaaatcaagtcacagg

SEQ ID NO: 154074 - DNA, 25 bp, Rattus norvegicus
aggttctcagaaccacagacatgta

SEQ ID NO: 154075 - DNA, 25 bp, Rattus norvegicus
aggttctcagaagcacagacatgta

SEQ ID NO: 154076 - DNA, 25 bp, Rattus norvegicus
aggttctcagaattcaagtcacagg

SEQ ID NO: 154077 - DNA, 25 bp, Rattus norvegicus
aggttctcagccacaggactgtaat

SEQ ID NO: 154078 - DNA, 25 bp, Rattus norvegicus
aggttctcagcctcaggactgtaat

SEQ ID NO: 154079 - DNA, 25 bp, Rattus norvegicus
aggttctcatagatcccaggaagtg

SEQ ID NO: 154080 - DNA, 25 bp, Rattus norvegicus
aggttctcatagttcccaggaagtg

SEQ ID NO: 154081 - DNA, 25 bp, Rattus norvegicus
aggttctcatgtatgtgacacccac

SEQ ID NO: 154082 - DNA, 25 bp, Rattus norvegicus
aggttctcatgtcggtaccggtcct

SEQ ID NO: 154083 - DNA, 25 bp, Rattus norvegicus
aggttctcatgtgggtaccggtcct

SEQ ID NO: 154084 - DNA, 25 bp, Rattus norvegicus
aggttctcatgtttgtgacacccac

SEQ ID NO: 154085 - DNA, 25 bp, Rattus norvegicus
aggttctccactatttgtcttgtta

SEQ ID NO: 154086 - DNA, 25 bp, Rattus norvegicus
aggttctccactcagaagcttacat

SEQ ID NO: 154087 - DNA, 25 bp, Rattus norvegicus
aggttctccactgagaagcttacat

SEQ ID NO: 154088 - DNA, 25 bp, Rattus norvegicus
aggttctccactttttgtcttgtta

SEQ ID NO: 154089 - DNA, 25 bp, Rattus norvegicus
aggttctccccaaagctgcttagag

SEQ ID NO: 154090 - DNA, 25 bp, Rattus norvegicus
aggttctccccatagctgcttagag

SEQ ID NO: 154091 - DNA, 25 bp, Rattus norvegicus
aggttctcccccataatagtcatag

SEQ ID NO: 154092 - DNA, 25 bp, Rattus norvegicus
aggttctcccccttaatagtcatag

SEQ ID NO: 154093 - DNA, 25 bp, Rattus norvegicus
aggttctccctgatcacatgacaat

SEQ ID NO: 154094 - DNA, 25 bp, Rattus norvegicus
aggttctccctgttcacatgacaat

SEQ ID NO: 154095 - DNA, 25 bp, Rattus norvegicus
aggttctcctcacagcacgtccatt

SEQ ID NO: 154096 - DNA, 25 bp, Rattus norvegicus
aggttctcctcagagcacgtccatt

SEQ ID NO: 154097 - DNA, 25 bp, Rattus norvegicus
aggttctctcatactagggctgctt

SEQ ID NO: 154098 - DNA, 25 bp, Rattus norvegicus
aggttctctcattctagggctgctt

SEQ ID NO: 154099 - DNA, 25 bp, Rattus norvegicus
aggttctctcctcatgacggcagag

SEQ ID NO: 154100 - DNA, 25 bp, Rattus norvegicus
aggttctctcctctgtccacagaga

SEQ ID NO: 154101 - DNA, 25 bp, Rattus norvegicus
aggttctctcctgatgacggcagag

SEQ ID NO: 154102 - DNA, 25 bp, Rattus norvegicus
aggttctctcctgtgtccacagaga

SEQ ID NO: 154103 - DNA, 25 bp, Rattus norvegicus
aggttctctcgccatgacttgattg

SEQ ID NO: 154104 - DNA, 25 bp, Rattus norvegicus
aggttctctcgcgatgacttgattg

SEQ ID NO: 154105 - DNA, 25 bp, Rattus norvegicus
aggttctctgctcaaggctggctgt

SEQ ID NO: 154106 - DNA, 25 bp, Rattus norvegicus
aggttctctgctgaaggctggctgt

SEQ ID NO: 154107 - DNA, 25 bp, Rattus norvegicus
aggttctcttccacttgcagacgga

SEQ ID NO: 154108 - DNA, 25 bp, Rattus norvegicus
aggttctcttcctcttgcagacgga

SEQ ID NO: 154109 - DNA, 25 bp, Rattus norvegicus
aggttctcttggctaccttgagcct

SEQ ID NO: 154110 - DNA, 25 bp, Rattus norvegicus
aggttctcttgggtaccttgagcct

SEQ ID NO: 154111 - DNA, 25 bp, Rattus norvegicus
aggttctgacaactgctgctactgc

SEQ ID NO: 154112 - DNA, 25 bp, Rattus norvegicus
aggttctgacaagtgctgctactgc

SEQ ID NO: 154113 - DNA, 25 bp, Rattus norvegicus
aggttctgaggtatgactctcccct

SEQ ID NO: 154114 - DNA, 25 bp, Rattus norvegicus
aggttctgaggtttgactctcccct

SEQ ID NO: 154115 - DNA, 25 bp, Rattus norvegicus
aggttctgattccattccatgtcca

SEQ ID NO: 154116 - DNA, 25 bp, Rattus norvegicus
aggttctgattcgattccatgtcca

SEQ ID NO: 154117 - DNA, 25 bp, Rattus norvegicus
aggttctgattgcaggatttaccag

SEQ ID NO: 154118 - DNA, 25 bp, Rattus norvegicus
aggttctgattggaggatttaccag

SEQ ID NO: 154119 - DNA, 25 bp, Rattus norvegicus
aggttctgcaaaccacagagcctgt

SEQ ID NO: 154120 - DNA, 25 bp, Rattus norvegicus
aggttctgcaaagcacagagcctgt

SEQ ID NO: 154121 - DNA, 25 bp, Rattus norvegicus
aggttctgcattatactctcgtctt

SEQ ID NO: 154122 - DNA, 25 bp, Rattus norvegicus
aggttctgcattttactctcgtctt

SEQ ID NO: 154123 - DNA, 25 bp, Rattus norvegicus
aggttctgcctcaaactgtttattc

SEQ ID NO: 154124 - DNA, 25 bp, Rattus norvegicus
aggttctgcctctaactgtttattc

SEQ ID NO: 154125 - DNA, 25 bp, Rattus norvegicus
aggttctgctatcacaggtccagtt

SEQ ID NO: 154126 - DNA, 25 bp, Rattus norvegicus
aggttctgctatgacaggtccagtt

SEQ ID NO: 154127 - DNA, 25 bp, Rattus norvegicus
aggttctgctgacttctgtcacttg

SEQ ID NO: 154128 - DNA, 25 bp, Rattus norvegicus
aggttctgctgagttctgtcacttg

SEQ ID NO: 154129 - DNA, 25 bp, Rattus norvegicus
aggttctggaaaacactgctctaga

SEQ ID NO: 154130 - DNA, 25 bp, Rattus norvegicus
aggttctggaaatcactgctctaga

SEQ ID NO: 154131 - DNA, 25 bp, Rattus norvegicus
aggttctggagaacacagtcccaag

SEQ ID NO: 154132 - DNA, 25 bp, Rattus norvegicus
aggttctggagatcacagtcccaag

SEQ ID NO: 154133 - DNA, 25 bp, Rattus norvegicus
aggttctggccaacggtctagacaa

SEQ ID NO: 154134 - DNA, 25 bp, Rattus norvegicus
aggttctggccatcggtctagacaa

SEQ ID NO: 154135 - DNA, 25 bp, Rattus norvegicus
aggttctgggtcactgcttacaaga

SEQ ID NO: 154136 - DNA, 25 bp, Rattus norvegicus
aggttctgggtctctgcttacaaga

SEQ ID NO: 154137 - DNA, 25 bp, Rattus norvegicus
aggttctggtctcagcacctttata

SEQ ID NO: 154138 - DNA, 25 bp, Rattus norvegicus
aggttctggtctgagcacctttata

SEQ ID NO: 154139 - DNA, 25 bp, Rattus norvegicus
aggttctgtagaagttggctttgac

SEQ ID NO: 154140 - DNA, 25 bp, Rattus norvegicus
aggttctgtagatgttggctttgac

SEQ ID NO: 154141 - DNA, 25 bp, Rattus norvegicus
aggttctgtctacgatcccatggaa

SEQ ID NO: 154142 - DNA, 25 bp, Rattus norvegicus
aggttctgtctaggatcccatggaa

SEQ ID NO: 154143 - DNA, 25 bp, Rattus norvegicus
aggttctgtgggaataggccctcat

SEQ ID NO: 154144 - DNA, 25 bp, Rattus norvegicus
aggttctgtgggtataggccctcat

SEQ ID NO: 154145 - DNA, 25 bp, Rattus norvegicus
aggttctgtgtgcttgattgcccgt

SEQ ID NO: 154146 - DNA, 25 bp, Rattus norvegicus
aggttctgtgtggttgattgcccgt

SEQ ID NO: 154147 - DNA, 25 bp, Rattus norvegicus
aggttcttacccagcagatgagcgg

SEQ ID NO: 154148 - DNA, 25 bp, Rattus norvegicus
aggttcttaccctgcagatgagcgg

SEQ ID NO: 154149 - DNA, 25 bp, Rattus norvegicus
aggttcttcaataacttcatgtgga

SEQ ID NO: 154150 - DNA, 25 bp, Rattus norvegicus
aggttcttcaattacttcatgtgga

SEQ ID NO: 154151 - DNA, 25 bp, Rattus norvegicus
aggttcttcactacgcgcagtatgt

SEQ ID NO: 154152 - DNA, 25 bp, Rattus norvegicus
aggttcttcacttcgcgcagtatgt

SEQ ID NO: 154153 - DNA, 25 bp, Rattus norvegicus
aggttcttcctacagtaggactcaa

SEQ ID NO: 154154 - DNA, 25 bp, Rattus norvegicus
aggttcttcctagagtaggactcaa

SEQ ID NO: 154155 - DNA, 25 bp, Rattus norvegicus
aggttcttcgggatctgatgtgaga

SEQ ID NO: 154156 - DNA, 25 bp, Rattus norvegicus
aggttcttcgggttctgatgtgaga

SEQ ID NO: 154157 - DNA, 25 bp, Rattus norvegicus
aggttcttgagaaggctccgcctgt

SEQ ID NO: 154158 - DNA, 25 bp, Rattus norvegicus
aggttcttgagatggctccgcctgt

SEQ ID NO: 154159 - DNA, 25 bp, Rattus norvegicus
aggttcttgctgattgctgctcttc

SEQ ID NO: 154160 - DNA, 25 bp, Rattus norvegicus
aggttcttgctgtttgctgctcttc

SEQ ID NO: 154161 - DNA, 25 bp, Rattus norvegicus
aggttcttgtggaatccatttggga

SEQ ID NO: 154162 - DNA, 25 bp, Rattus norvegicus
aggttcttgtggtatccatttggga

SEQ ID NO: 154163 - DNA, 25 bp, Rattus norvegicus
aggttctttaacacagtgcggcttt

SEQ ID NO: 154164 - DNA, 25 bp, Rattus norvegicus
aggttctttaactcagtgcggcttt

SEQ ID NO: 154165 - DNA, 25 bp, Rattus norvegicus
aggttctttctcattatctctggaa

SEQ ID NO: 154166 - DNA, 25 bp, Rattus norvegicus
aggttctttctctttatctctggaa

SEQ ID NO: 154167 - DNA, 25 bp, Rattus norvegicus
aggttctttcttccaggtcattctc

SEQ ID NO: 154168 - DNA, 25 bp, Rattus norvegicus
aggttctttcttgcaggtcattctc

SEQ ID NO: 154169 - DNA, 25 bp, Rattus norvegicus
aggttcttttgaagtccctgctctg

SEQ ID NO: 154170 - DNA, 25 bp, Rattus norvegicus
aggttcttttgatgtccctgctctg

SEQ ID NO: 154171 - DNA, 25 bp, Rattus norvegicus
aggttgaaatttcacctgcccatct

SEQ ID NO: 154172 - DNA, 25 bp, Rattus norvegicus
aggttgaaatttgacctgcccatct

SEQ ID NO: 154173 - DNA, 25 bp, Rattus norvegicus
aggttgaacactcaacgccggcggt

SEQ ID NO: 154174 - DNA, 25 bp, Rattus norvegicus
aggttgaacactgaacgccggcggt

SEQ ID NO: 154175 - DNA, 25 bp, Rattus norvegicus
aggttgaaccctcggacactataga

SEQ ID NO: 154176 - DNA, 25 bp, Rattus norvegicus
aggttgaaccctgggacactataga

SEQ ID NO: 154177 - DNA, 25 bp, Rattus norvegicus
aggttgaatgatccctttcacaggg

SEQ ID NO: 154178 - DNA, 25 bp, Rattus norvegicus
aggttgaatgatgcctttcacaggg

SEQ ID NO: 154179 - DNA, 25 bp, Rattus norvegicus
aggttgaatgttacgactccctcac

SEQ ID NO: 154180 - DNA, 25 bp, Rattus norvegicus
aggttgaatgtttcgactccctcac

SEQ ID NO: 154181 - DNA, 25 bp, Rattus norvegicus
aggttgacctgtctgctctctgtac

SEQ ID NO: 154182 - DNA, 25 bp, Rattus norvegicus
aggttgacctgtgtgctctctgtac

SEQ ID NO: 154183 - DNA, 25 bp, Rattus norvegicus
aggttgacgtcgctcttgctgaaga

SEQ ID NO: 154184 - DNA, 25 bp, Rattus norvegicus
aggttgacgtcggtcttgctgaaga

SEQ ID NO: 154185 - DNA, 25 bp, Rattus norvegicus
aggttgactgagaaaccctctcaaa

SEQ ID NO: 154186 - DNA, 25 bp, Rattus norvegicus
aggttgactgagtaaccctctcaaa

SEQ ID NO: 154187 - DNA, 25 bp, Rattus norvegicus
aggttgactggcaggacactcgcga

SEQ ID NO: 154188 - DNA, 25 bp, Rattus norvegicus
aggttgactggctggacactcgcga

SEQ ID NO: 154189 - DNA, 25 bp, Rattus norvegicus
aggttgaggctcaccattctctggt

SEQ ID NO: 154190 - DNA, 25 bp, Rattus norvegicus
aggttgaggctctccattctctggt

SEQ ID NO: 154191 - DNA, 25 bp, Rattus norvegicus
aggttgaggcttctattgctccctg

SEQ ID NO: 154192 - DNA, 25 bp, Rattus norvegicus
aggttgaggcttgtattgctccctg

SEQ ID NO: 154193 - DNA, 25 bp, Rattus norvegicus
aggttgagttgtccgtatttttcca

SEQ ID NO: 154194 - DNA, 25 bp, Rattus norvegicus
aggttgagttgtgcgtatttttcca

SEQ ID NO: 154195 - DNA, 25 bp, Rattus norvegicus
aggttgatgaaacctcctgaggttc

SEQ ID NO: 154196 - DNA, 25 bp, Rattus norvegicus
aggttgatgaaagctcctgaggttc

SEQ ID NO: 154197 - DNA, 25 bp, Rattus norvegicus
aggttgatgcttcgcagcaactcca

SEQ ID NO: 154198 - DNA, 25 bp, Rattus norvegicus
aggttgatgcttggcagcaactcca

SEQ ID NO: 154199 - DNA, 25 bp, Rattus norvegicus
aggttgatggttatgacactgagaa

SEQ ID NO: 154200 - DNA, 25 bp, Rattus norvegicus
aggttgatggttttgacactgagaa

SEQ ID NO: 154201 - DNA, 25 bp, Rattus norvegicus
aggttgattcagacagtgggtccat

SEQ ID NO: 154202 - DNA, 25 bp, Rattus norvegicus
aggttgattcagtcagtgggtccat

SEQ ID NO: 154203 - DNA, 25 bp, Rattus norvegicus
aggttgattcctagcagccacatgg

SEQ ID NO: 154204 - DNA, 25 bp, Rattus norvegicus
aggttgattccttgcagccacatgg

SEQ ID NO: 154205 - DNA, 25 bp, Rattus norvegicus
aggttgattcgcacatactgttaat

SEQ ID NO: 154206 - DNA, 25 bp, Rattus norvegicus
aggttgattcgctcatactgttaat

SEQ ID NO: 154207 - DNA, 25 bp, Rattus norvegicus
aggttgatttgaagttgaccataat

SEQ ID NO: 154208 - DNA, 25 bp, Rattus norvegicus
aggttgatttgatgttgaccataat

SEQ ID NO: 154209 - DNA, 25 bp, Rattus norvegicus
aggttgcaaccactcccggttaatg

SEQ ID NO: 154210 - DNA, 25 bp, Rattus norvegicus
aggttgcaaccagtcccggttaatg

SEQ ID NO: 154211 - DNA, 25 bp, Rattus norvegicus
aggttgcaagtgactctccaaggcc

SEQ ID NO: 154212 - DNA, 25 bp, Rattus norvegicus
aggttgcaagtgtctctccaaggcc

SEQ ID NO: 154213 - DNA, 25 bp, Rattus norvegicus
aggttgcaatcccaaaatgtcttta

SEQ ID NO: 154214 - DNA, 25 bp, Rattus norvegicus
aggttgcaatccgaaaatgtcttta

SEQ ID NO: 154215 - DNA, 25 bp, Rattus norvegicus
aggttgcaccatagtcactgcattg

SEQ ID NO: 154216 - DNA, 25 bp, Rattus norvegicus
aggttgcaccattgtcactgcattg

SEQ ID NO: 154217 - DNA, 25 bp, Rattus norvegicus
aggttgcagtaaatgtcacagctct

SEQ ID NO: 154218 - DNA, 25 bp, Rattus norvegicus
aggttgcagtaattgtcacagctct

SEQ ID NO: 154219 - DNA, 25 bp, Rattus norvegicus
aggttgcattgacccctgaacacgg

SEQ ID NO: 154220 - DNA, 25 bp, Rattus norvegicus
aggttgcattgagccctgaacacgg

SEQ ID NO: 154221 - DNA, 25 bp, Rattus norvegicus
aggttgccaccaagccagacataca

SEQ ID NO: 154222 - DNA, 25 bp, Rattus norvegicus
aggttgccaccatgccagacataca

SEQ ID NO: 154223 - DNA, 25 bp, Rattus norvegicus
aggttgccagagattgtctcctcat

SEQ ID NO: 154224 - DNA, 25 bp, Rattus norvegicus
aggttgccagagtttgtctcctcat

SEQ ID NO: 154225 - DNA, 25 bp, Rattus norvegicus
aggttgccagccatcagaacattga

SEQ ID NO: 154226 - DNA, 25 bp, Rattus norvegicus
aggttgccagccttcagaacattga

SEQ ID NO: 154227 - DNA, 25 bp, Rattus norvegicus
aggttgcccgagcttctaaggctca

SEQ ID NO: 154228 - DNA, 25 bp, Rattus norvegicus
aggttgcccgaggttctaaggctca

SEQ ID NO: 154229 - DNA, 25 bp, Rattus norvegicus
aggttgccctggacagtagctgctc

SEQ ID NO: 154230 - DNA, 25 bp, Rattus norvegicus
aggttgccctggtcagtagctgctc

SEQ ID NO: 154231 - DNA, 25 bp, Rattus norvegicus
aggttgcccttgaatgccattctag

SEQ ID NO: 154232 - DNA, 25 bp, Rattus norvegicus
aggttgcccttgtatgccattctag

SEQ ID NO: 154233 - DNA, 25 bp, Rattus norvegicus
aggttgccggaaatcagcctgcata

SEQ ID NO: 154234 - DNA, 25 bp, Rattus norvegicus
aggttgccggaactactcatccaca

SEQ ID NO: 154235 - DNA, 25 bp, Rattus norvegicus
aggttgccggaagtactcatccaca

SEQ ID NO: 154236 - DNA, 25 bp, Rattus norvegicus
aggttgccggaattcagcctgcata

SEQ ID NO: 154237 - DNA, 25 bp, Rattus norvegicus
aggttgccgggtatacagtcatcta

SEQ ID NO: 154238 - DNA, 25 bp, Rattus norvegicus
aggttgccgggtttacagtcatcta

SEQ ID NO: 154239 - DNA, 25 bp, Rattus norvegicus
aggttgccgtggagcaaagcccaga

SEQ ID NO: 154240 - DNA, 25 bp, Rattus norvegicus
aggttgccgtggtgcaaagcccaga

SEQ ID NO: 154241 - DNA, 25 bp, Rattus norvegicus
aggttgcctggaaccgtgtcgccac

SEQ ID NO: 154242 - DNA, 25 bp, Rattus norvegicus
aggttgcctggatccgtgtcgccac

SEQ ID NO: 154243 - DNA, 25 bp, Rattus norvegicus
aggttgccttaactgatctctgatc

SEQ ID NO: 154244 - DNA, 25 bp, Rattus norvegicus
aggttgccttaagtgatctctgatc

SEQ ID NO: 154245 - DNA, 25 bp, Rattus norvegicus
aggttgcggtcaatgatgttcatct

SEQ ID NO: 154246 - DNA, 25 bp, Rattus norvegicus
aggttgcggtcattgatgttcatct

SEQ ID NO: 154247 - DNA, 25 bp, Rattus norvegicus
aggttgctcattagggtatttcaca

SEQ ID NO: 154248 - DNA, 25 bp, Rattus norvegicus
aggttgctcatttgggtatttcaca

SEQ ID NO: 154249 - DNA, 25 bp, Rattus norvegicus
aggttgctcgctactaagagattga

SEQ ID NO: 154250 - DNA, 25 bp, Rattus norvegicus
aggttgctcgcttctaagagattga

SEQ ID NO: 154251 - DNA, 25 bp, Rattus norvegicus
aggttgctctctacctgcctgaagg

SEQ ID NO: 154252 - DNA, 25 bp, Rattus norvegicus
aggttgctctcttcctgcctgaagg

SEQ ID NO: 154253 - DNA, 25 bp, Rattus norvegicus
aggttgctctggaactcactgtctg

SEQ ID NO: 154254 - DNA, 25 bp, Rattus norvegicus
aggttgctctggtactcactgtctg

SEQ ID NO: 154255 - DNA, 25 bp, Rattus norvegicus
aggttgctcttgacaggatacttta

SEQ ID NO: 154256 - DNA, 25 bp, Rattus norvegicus
aggttgctcttgtcaggatacttta

SEQ ID NO: 154257 - DNA, 25 bp, Rattus norvegicus
aggttgctggctctatgccccacat

SEQ ID NO: 154258 - DNA, 25 bp, Rattus norvegicus
aggttgctggctgtatgccccacat

SEQ ID NO: 154259 - DNA, 25 bp, Rattus norvegicus
aggttgcttcctagatgctccagcg

SEQ ID NO: 154260 - DNA, 25 bp, Rattus norvegicus
aggttgcttccttgatgctccagcg

SEQ ID NO: 154261 - DNA, 25 bp, Rattus norvegicus
aggttgctttggaagtctgtggcta

SEQ ID NO: 154262 - DNA, 25 bp, Rattus norvegicus
aggttgctttggtagtctgtggcta

SEQ ID NO: 154263 - DNA, 25 bp, Rattus norvegicus
aggttggacttgaatgcttgatctc

SEQ ID NO: 154264 - DNA, 25 bp, Rattus norvegicus
aggttggacttgtatgcttgatctc

SEQ ID NO: 154265 - DNA, 25 bp, Rattus norvegicus
aggttggagacaccgttgactgcct

SEQ ID NO: 154266 - DNA, 25 bp, Rattus norvegicus
aggttggagacagcgttgactgcct

SEQ ID NO: 154267 - DNA, 25 bp, Rattus norvegicus
aggttggagcctaagctcctggctt

SEQ ID NO: 154268 - DNA, 25 bp, Rattus norvegicus
aggttggagccttagctcctggctt

SEQ ID NO: 154269 - DNA, 25 bp, Rattus norvegicus
aggttggaggtcaccacctgtggaa

SEQ ID NO: 154270 - DNA, 25 bp, Rattus norvegicus
aggttggaggtctccacctgtggaa

SEQ ID NO: 154271 - DNA, 25 bp, Rattus norvegicus
aggttggatcctcctacgaaagtaa

SEQ ID NO: 154272 - DNA, 25 bp, Rattus norvegicus
aggttggatcctgctacgaaagtaa

SEQ ID NO: 154273 - DNA, 25 bp, Rattus norvegicus
aggttggatctgaagccttcccctg

SEQ ID NO: 154274 - DNA, 25 bp, Rattus norvegicus
aggttggatctgtagccttcccctg

SEQ ID NO: 154275 - DNA, 25 bp, Rattus norvegicus
aggttggatgtcacacagctccttc

SEQ ID NO: 154276 - DNA, 25 bp, Rattus norvegicus
aggttggatgtctcacagctccttc

SEQ ID NO: 154277 - DNA, 25 bp, Rattus norvegicus
aggttggattctctttgtcactgga

SEQ ID NO: 154278 - DNA, 25 bp, Rattus norvegicus
aggttggattctgtttgtcactgga

SEQ ID NO: 154279 - DNA, 25 bp, Rattus norvegicus
aggttggccaccagcaggctggcct

SEQ ID NO: 154280 - DNA, 25 bp, Rattus norvegicus
aggttggccacctgcaggctggcct

SEQ ID NO: 154281 - DNA, 25 bp, Rattus norvegicus
aggttggccgctactaagactggga

SEQ ID NO: 154282 - DNA, 25 bp, Rattus norvegicus
aggttggccgcttctaagactggga

SEQ ID NO: 154283 - DNA, 25 bp, Rattus norvegicus
aggttggcctgtcgcatcattgcac

SEQ ID NO: 154284 - DNA, 25 bp, Rattus norvegicus
aggttggcctgtggcatcattgcac

SEQ ID NO: 154285 - DNA, 25 bp, Rattus norvegicus
aggttggccttaattcagtctgtag

SEQ ID NO: 154286 - DNA, 25 bp, Rattus norvegicus
aggttggccttatttcagtctgtag

SEQ ID NO: 154287 - DNA, 25 bp, Rattus norvegicus
aggttggctagcaattctgatttcc

SEQ ID NO: 154288 - DNA, 25 bp, Rattus norvegicus
aggttggctagctattctgatttcc

SEQ ID NO: 154289 - DNA, 25 bp, Rattus norvegicus
aggttggctgcaccatctgggttcc

SEQ ID NO: 154290 - DNA, 25 bp, Rattus norvegicus
aggttggctgcagcatctgggttcc

SEQ ID NO: 154291 - DNA, 25 bp, Rattus norvegicus
aggttggctgtaaactgtgccttct

SEQ ID NO: 154292 - DNA, 25 bp, Rattus norvegicus
aggttggctgtatactgtgccttct

SEQ ID NO: 154293 - DNA, 25 bp, Rattus norvegicus
aggttgggcctcactggatacccat

SEQ ID NO: 154294 - DNA, 25 bp, Rattus norvegicus
aggttgggcctctctggatacccat

SEQ ID NO: 154295 - DNA, 25 bp, Rattus norvegicus
aggttgggcggcaccccatgtctgc

SEQ ID NO: 154296 - DNA, 25 bp, Rattus norvegicus
aggttgggcggctccccatgtctgc

SEQ ID NO: 154297 - DNA, 25 bp, Rattus norvegicus
aggttgggctacaacacacgagctt

SEQ ID NO: 154298 - DNA, 25 bp, Rattus norvegicus
aggttgggctactacacacgagctt

SEQ ID NO: 154299 - DNA, 25 bp, Rattus norvegicus
aggttggtaagcattcagacaggtt

SEQ ID NO: 154300 - DNA, 25 bp, Rattus norvegicus
aggttggtaagctttcagacaggtt

SEQ ID NO: 154301 - DNA, 25 bp, Rattus norvegicus
aggttggtcttcagggcagctttca

SEQ ID NO: 154302 - DNA, 25 bp, Rattus norvegicus
aggttggtcttctgggcagctttca

SEQ ID NO: 154303 - DNA, 25 bp, Rattus norvegicus
aggttggttcagactcacagcacaa

SEQ ID NO: 154304 - DNA, 25 bp, Rattus norvegicus
aggttggttcagtctcacagcacaa

SEQ ID NO: 154305 - DNA, 25 bp, Rattus norvegicus
aggttgtaaaccacatactggaaca

SEQ ID NO: 154306 - DNA, 25 bp, Rattus norvegicus
aggttgtaaacctcatactggaaca

SEQ ID NO: 154307 - DNA, 25 bp, Rattus norvegicus
aggttgtaacctacgcccagttgtg

SEQ ID NO: 154308 - DNA, 25 bp, Rattus norvegicus
aggttgtaaccttcgcccagttgtg

SEQ ID NO: 154309 - DNA, 25 bp, Rattus norvegicus
aggttgtcaaaaatgctgccactca

SEQ ID NO: 154310 - DNA, 25 bp, Rattus norvegicus
aggttgtcaaaattgctgccactca

SEQ ID NO: 154311 - DNA, 25 bp, Rattus norvegicus
aggttgtcacctatgagctgggcga

SEQ ID NO: 154312 - DNA, 25 bp, Rattus norvegicus
aggttgtcacctttgagctgggcga

SEQ ID NO: 154313 - DNA, 25 bp, Rattus norvegicus
aggttgtcagatatgacctttgata

SEQ ID NO: 154314 - DNA, 25 bp, Rattus norvegicus
aggttgtcagatttgacctttgata

SEQ ID NO: 154315 - DNA, 25 bp, Rattus norvegicus
aggttgtcctgccacttgcactgtg

SEQ ID NO: 154316 - DNA, 25 bp, Rattus norvegicus
aggttgtcctgcgacttgcactgtg

SEQ ID NO: 154317 - DNA, 25 bp, Rattus norvegicus
aggttgtcctggaatgcctgagcca

SEQ ID NO: 154318 - DNA, 25 bp, Rattus norvegicus
aggttgtcctggtatgcctgagcca

SEQ ID NO: 154319 - DNA, 25 bp, Rattus norvegicus
aggttgtcgacaatcctagcttttt

SEQ ID NO: 154320 - DNA, 25 bp, Rattus norvegicus
aggttgtcgacattcctagcttttt

SEQ ID NO: 154321 - DNA, 25 bp, Rattus norvegicus
aggttgtctgatagcacagtgcccc

SEQ ID NO: 154322 - DNA, 25 bp, Rattus norvegicus
aggttgtctgattgcacagtgcccc

SEQ ID NO: 154323 - DNA, 25 bp, Rattus norvegicus
aggttgtctggaatcactgacctct

SEQ ID NO: 154324 - DNA, 25 bp, Rattus norvegicus
aggttgtctggattcactgacctct

SEQ ID NO: 154325 - DNA, 25 bp, Rattus norvegicus
aggttgtctgtcacaggtgcgctca

SEQ ID NO: 154326 - DNA, 25 bp, Rattus norvegicus
aggttgtctgtctcaggtgcgctca

SEQ ID NO: 154327 - DNA, 25 bp, Rattus norvegicus
aggttgtcttaacagcctcacagag

SEQ ID NO: 154328 - DNA, 25 bp, Rattus norvegicus
aggttgtcttaagagcctcacagag

SEQ ID NO: 154329 - DNA, 25 bp, Rattus norvegicus
aggttgtcttgaacagtctgtattg

SEQ ID NO: 154330 - DNA, 25 bp, Rattus norvegicus
aggttgtcttgatcagtctgtattg

SEQ ID NO: 154331 - DNA, 25 bp, Rattus norvegicus
aggttgtgacctacctgtacttggg

SEQ ID NO: 154332 - DNA, 25 bp, Rattus norvegicus
aggttgtgaccttcctgtacttggg

SEQ ID NO: 154333 - DNA, 25 bp, Rattus norvegicus
aggttgtgactcagacagggccatc

SEQ ID NO: 154334 - DNA, 25 bp, Rattus norvegicus
aggttgtgactctgacagggccatc

SEQ ID NO: 154335 - DNA, 25 bp, Rattus norvegicus
aggttgtgccctactagtctttaat

SEQ ID NO: 154336 - DNA, 25 bp, Rattus norvegicus
aggttgtgcccttctagtctttaat

SEQ ID NO: 154337 - DNA, 25 bp, Rattus norvegicus
aggttgtgcctcaccaccaggtgga

SEQ ID NO: 154338 - DNA, 25 bp, Rattus norvegicus
aggttgtgcctctccaccaggtgga

SEQ ID NO: 154339 - DNA, 25 bp, Rattus norvegicus
aggttgtgctaactctctgctttac

SEQ ID NO: 154340 - DNA, 25 bp, Rattus norvegicus
aggttgtgctaagtctctgctttac

SEQ ID NO: 154341 - DNA, 25 bp, Rattus norvegicus
aggttgtgtctcatgctcatagcaa

SEQ ID NO: 154342 - DNA, 25 bp, Rattus norvegicus
aggttgtgtctcttgctcatagcaa

SEQ ID NO: 154343 - DNA, 25 bp, Rattus norvegicus
aggttgttaggaccgccctctctgg

SEQ ID NO: 154344 - DNA, 25 bp, Rattus norvegicus
aggttgttaggagcgccctctctgg

SEQ ID NO: 154345 - DNA, 25 bp, Rattus norvegicus
aggttgttgtgaaccttgggaccaa

SEQ ID NO: 154346 - DNA, 25 bp, Rattus norvegicus
aggttgttgtgatccttgggaccaa

SEQ ID NO: 154347 - DNA, 25 bp, Rattus norvegicus
aggttgtttagccatggtctccaaa

SEQ ID NO: 154348 - DNA, 25 bp, Rattus norvegicus
aggttgtttagcgatggtctccaaa

SEQ ID NO: 154349 - DNA, 25 bp, Rattus norvegicus
aggtttaaactgacagctgctctag

SEQ ID NO: 154350 - DNA, 25 bp, Rattus norvegicus
aggtttaaactgtcagctgctctag

SEQ ID NO: 154351 - DNA, 25 bp, Rattus norvegicus
aggtttaacttgctgagcttgcaga

SEQ ID NO: 154352 - DNA, 25 bp, Rattus norvegicus
aggtttaacttggtgagcttgcaga

SEQ ID NO: 154353 - DNA, 25 bp, Rattus norvegicus
aggtttaagacccacatttgctgta

SEQ ID NO: 154354 - DNA, 25 bp, Rattus norvegicus
aggtttaagaccgacatttgctgta

SEQ ID NO: 154355 - DNA, 25 bp, Rattus norvegicus
aggtttaagcatactcccttggcat

SEQ ID NO: 154356 - DNA, 25 bp, Rattus norvegicus
aggtttaagcattctcccttggcat

SEQ ID NO: 154357 - DNA, 25 bp, Rattus norvegicus
aggtttaagcccctttcctgctgct

SEQ ID NO: 154358 - DNA, 25 bp, Rattus norvegicus
aggtttaagcccgtttcctgctgct

SEQ ID NO: 154359 - DNA, 25 bp, Rattus norvegicus
aggtttaaggtcaccctcagctagc

SEQ ID NO: 154360 - DNA, 25 bp, Rattus norvegicus
aggtttaaggtctccctcagctagc

SEQ ID NO: 154361 - DNA, 25 bp, Rattus norvegicus
aggtttacagcacaagcccggcttc

SEQ ID NO: 154362 - DNA, 25 bp, Rattus norvegicus
aggtttacagcagaagcccggcttc

SEQ ID NO: 154363 - DNA, 25 bp, Rattus norvegicus
aggtttaccttgagaccacctcaag

SEQ ID NO: 154364 - DNA, 25 bp, Rattus norvegicus
aggtttaccttgtgaccacctcaag

SEQ ID NO: 154365 - DNA, 25 bp, Rattus norvegicus
aggtttacgcaaaagcgacgcgctg

SEQ ID NO: 154366 - DNA, 25 bp, Rattus norvegicus
aggtttacgcaatagcgacgcgctg

SEQ ID NO: 154367 - DNA, 25 bp, Rattus norvegicus
aggtttagctcaagggatacacaca

SEQ ID NO: 154368 - DNA, 25 bp, Rattus norvegicus
aggtttagctcatgggatacacaca

SEQ ID NO: 154369 - DNA, 25 bp, Rattus norvegicus
aggtttagtagcctgctgcactcct

SEQ ID NO: 154370 - DNA, 25 bp, Rattus norvegicus
aggtttagtagcgtgctgcactcct

SEQ ID NO: 154371 - DNA, 25 bp, Rattus norvegicus
aggtttatcctgctcatctttgaaa

SEQ ID NO: 154372 - DNA, 25 bp, Rattus norvegicus
aggtttatcctggtcatctttgaaa

SEQ ID NO: 154373 - DNA, 25 bp, Rattus norvegicus
aggtttatctctcagtttgcggcca

SEQ ID NO: 154374 - DNA, 25 bp, Rattus norvegicus
aggtttatctctgagtttgcggcca

SEQ ID NO: 154375 - DNA, 25 bp, Rattus norvegicus
aggtttatcttactccttgaacact

SEQ ID NO: 154376 - DNA, 25 bp, Rattus norvegicus
aggtttatcttagtccttgaacact

SEQ ID NO: 154377 - DNA, 25 bp, Rattus norvegicus
aggtttatgcctatgtgtcccatgc

SEQ ID NO: 154378 - DNA, 25 bp, Rattus norvegicus
aggtttatgcctttgtgtcccatgc

SEQ ID NO: 154379 - DNA, 25 bp, Rattus norvegicus
aggtttattcttacctccaggcaat

SEQ ID NO: 154380 - DNA, 25 bp, Rattus norvegicus
aggtttattctttcctccaggcaat

SEQ ID NO: 154381 - DNA, 25 bp, Rattus norvegicus
aggtttattgaacccttgttggact

SEQ ID NO: 154382 - DNA, 25 bp, Rattus norvegicus
aggtttattgaagccttgttggact

SEQ ID NO: 154383 - DNA, 25 bp, Rattus norvegicus
aggtttattggcattccctgtgcac

SEQ ID NO: 154384 - DNA, 25 bp, Rattus norvegicus
aggtttattggctttccctgtgcac

SEQ ID NO: 154385 - DNA, 25 bp, Rattus norvegicus
aggtttatttctacaggatgctgac

SEQ ID NO: 154386 - DNA, 25 bp, Rattus norvegicus
aggtttatttcttcaggatgctgac

SEQ ID NO: 154387 - DNA, 25 bp, Rattus norvegicus
aggtttcaaaccctgtggcaggcac

SEQ ID NO: 154388 - DNA, 25 bp, Rattus norvegicus
aggtttcaaaccgtgtggcaggcac

SEQ ID NO: 154389 - DNA, 25 bp, Rattus norvegicus
aggtttcaacagctcagccccggga

SEQ ID NO: 154390 - DNA, 25 bp, Rattus norvegicus
aggtttcaacaggtcagccccggga

SEQ ID NO: 154391 - DNA, 25 bp, Rattus norvegicus
aggtttcacatcatttgctagttag

SEQ ID NO: 154392 - DNA, 25 bp, Rattus norvegicus
aggtttcacatcttttgctagttag

SEQ ID NO: 154393 - DNA, 25 bp, Rattus norvegicus
aggtttcaccagcatgtgccatgct

SEQ ID NO: 154394 - DNA, 25 bp, Rattus norvegicus
aggtttcaccaggatgtgccatgct

SEQ ID NO: 154395 - DNA, 25 bp, Rattus norvegicus
aggtttcactccaaattatcagaat

SEQ ID NO: 154396 - DNA, 25 bp, Rattus norvegicus
aggtttcactcctaattatcagaat

SEQ ID NO: 154397 - DNA, 25 bp, Rattus norvegicus
aggtttcaggttcacagggatccaa

SEQ ID NO: 154398 - DNA, 25 bp, Rattus norvegicus
aggtttcaggttgacagggatccaa

SEQ ID NO: 154399 - DNA, 25 bp, Rattus norvegicus
aggtttcatctacccctgtggattt

SEQ ID NO: 154400 - DNA, 25 bp, Rattus norvegicus
aggtttcatctagccctgtggattt

SEQ ID NO: 154401 - DNA, 25 bp, Rattus norvegicus
aggtttccaaagctatgttttctat

SEQ ID NO: 154402 - DNA, 25 bp, Rattus norvegicus
aggtttccaaaggtatgttttctat

SEQ ID NO: 154403 - DNA, 25 bp, Rattus norvegicus
aggtttccaaccactgttagctagg

SEQ ID NO: 154404 - DNA, 25 bp, Rattus norvegicus
aggtttccaacctctgttagctagg

SEQ ID NO: 154405 - DNA, 25 bp, Rattus norvegicus
aggtttccaaggctgttgctgatgc

SEQ ID NO: 154406 - DNA, 25 bp, Rattus norvegicus
aggtttccaagggtgttgctgatgc

SEQ ID NO: 154407 - DNA, 25 bp, Rattus norvegicus
aggtttccactcctgaagtcaggtc

SEQ ID NO: 154408 - DNA, 25 bp, Rattus norvegicus
aggtttccactcgtgaagtcaggtc

SEQ ID NO: 154409 - DNA, 25 bp, Rattus norvegicus
aggtttccagctatcttgagctgtc

SEQ ID NO: 154410 - DNA, 25 bp, Rattus norvegicus
aggtttccagctttcttgagctgtc

SEQ ID NO: 154411 - DNA, 25 bp, Rattus norvegicus
aggtttccagtgcttgctcattaaa

SEQ ID NO: 154412 - DNA, 25 bp, Rattus norvegicus
aggtttccagtggttgctcattaaa

SEQ ID NO: 154413 - DNA, 25 bp, Rattus norvegicus
aggtttccagttagttatcaccgag

SEQ ID NO: 154414 - DNA, 25 bp, Rattus norvegicus
aggtttccagtttgttatcaccgag

SEQ ID NO: 154415 - DNA, 25 bp, Rattus norvegicus
aggtttcccagcatttgtgctctgt

SEQ ID NO: 154416 - DNA, 25 bp, Rattus norvegicus
aggtttcccagcttttgtgctctgt

SEQ ID NO: 154417 - DNA, 25 bp, Rattus norvegicus
aggtttcccctaactcagatgcaat

SEQ ID NO: 154418 - DNA, 25 bp, Rattus norvegicus
aggtttcccctatctcagatgcaat

SEQ ID NO: 154419 - DNA, 25 bp, Rattus norvegicus
aggtttccctacagagcatctagaa

SEQ ID NO: 154420 - DNA, 25 bp, Rattus norvegicus
aggtttccctactgagcatctagaa

SEQ ID NO: 154421 - DNA, 25 bp, Rattus norvegicus
aggtttccgcaaaatctgcgcgggc

SEQ ID NO: 154422 - DNA, 25 bp, Rattus norvegicus
aggtttccgcaatatctgcgcgggc

SEQ ID NO: 154423 - DNA, 25 bp, Rattus norvegicus
aggtttcctgcaaacatcttctggg

SEQ ID NO: 154424 - DNA, 25 bp, Rattus norvegicus
aggtttcctgcatacatcttctggg

SEQ ID NO: 154425 - DNA, 25 bp, Rattus norvegicus
aggtttcctgtgattctgtgtccac

SEQ ID NO: 154426 - DNA, 25 bp, Rattus norvegicus
aggtttcctgtgtttctgtgtccac

SEQ ID NO: 154427 - DNA, 25 bp, Rattus norvegicus
aggtttccttatctatcctatccca

SEQ ID NO: 154428 - DNA, 25 bp, Rattus norvegicus
aggtttccttatgtatcctatccca

SEQ ID NO: 154429 - DNA, 25 bp, Rattus norvegicus
aggtttcgcataccagggatggccc

SEQ ID NO: 154430 - DNA, 25 bp, Rattus norvegicus
aggtttcgcatagcagggatggccc

SEQ ID NO: 154431 - DNA, 25 bp, Rattus norvegicus
aggtttcgtgctatgaaaacttcat

SEQ ID NO: 154432 - DNA, 25 bp, Rattus norvegicus
aggtttcgtgctttgaaaacttcat

SEQ ID NO: 154433 - DNA, 25 bp, Rattus norvegicus
aggtttctaattccaggacctagat

SEQ ID NO: 154434 - DNA, 25 bp, Rattus norvegicus
aggtttctaattgcaggacctagat

SEQ ID NO: 154435 - DNA, 25 bp, Rattus norvegicus
aggtttctaccgcaagcagcagtgt

SEQ ID NO: 154436 - DNA, 25 bp, Rattus norvegicus
aggtttctaccggaagcagcagtgt

SEQ ID NO: 154437 - DNA, 25 bp, Rattus norvegicus
aggtttctacttctggaggatcagt

SEQ ID NO: 154438 - DNA, 25 bp, Rattus norvegicus
aggtttctacttgtggaggatcagt

SEQ ID NO: 154439 - DNA, 25 bp, Rattus norvegicus
aggtttctccacaaatggctggcca

SEQ ID NO: 154440 - DNA, 25 bp, Rattus norvegicus
aggtttctccactaatggctggcca

SEQ ID NO: 154441 - DNA, 25 bp, Rattus norvegicus
aggtttctctctcgtgattcgagga

SEQ ID NO: 154442 - DNA, 25 bp, Rattus norvegicus
aggtttctctctggtgattcgagga

SEQ ID NO: 154443 - DNA, 25 bp, Rattus norvegicus
aggtttctctgtcaagttcccttgc

SEQ ID NO: 154444 - DNA, 25 bp, Rattus norvegicus
aggtttctctgtgaagttcccttgc

SEQ ID NO: 154445 - DNA, 25 bp, Rattus norvegicus
aggtttctgcccagatgtcctaagg

SEQ ID NO: 154446 - DNA, 25 bp, Rattus norvegicus
aggtttctgccctgatgtcctaagg

SEQ ID NO: 154447 - DNA, 25 bp, Rattus norvegicus
aggtttctggcgattgaagtcaaag

SEQ ID NO: 154448 - DNA, 25 bp, Rattus norvegicus
aggtttctggcgtttgaagtcaaag

SEQ ID NO: 154449 - DNA, 25 bp, Rattus norvegicus
aggtttctgtaactttggtgactag

SEQ ID NO: 154450 - DNA, 25 bp, Rattus norvegicus
aggtttctgtaagtttggtgactag

SEQ ID NO: 154451 - DNA, 25 bp, Rattus norvegicus
aggtttgaaccaccagtcctgatgg

SEQ ID NO: 154452 - DNA, 25 bp, Rattus norvegicus
aggtttgaaccagcagtcctgatgg

SEQ ID NO: 154453 - DNA, 25 bp, Rattus norvegicus
aggtttgatcctcacagcctcatcc

SEQ ID NO: 154454 - DNA, 25 bp, Rattus norvegicus
aggtttgatcctgacagcctcatcc

SEQ ID NO: 154455 - DNA, 25 bp, Rattus norvegicus
aggtttgatggacctctctctttgc

SEQ ID NO: 154456 - DNA, 25 bp, Rattus norvegicus
aggtttgatggagctctctctttgc

SEQ ID NO: 154457 - DNA, 25 bp, Rattus norvegicus
aggtttgcacctattctcaatacag

SEQ ID NO: 154458 - DNA, 25 bp, Rattus norvegicus
aggtttgcaccttttctcaatacag

SEQ ID NO: 154459 - DNA, 25 bp, Rattus norvegicus
aggtttgcactaacaccacctggca

SEQ ID NO: 154460 - DNA, 25 bp, Rattus norvegicus
aggtttgcactatcaccacctggca

SEQ ID NO: 154461 - DNA, 25 bp, Rattus norvegicus
aggtttgcagtacagccccatatga

SEQ ID NO: 154462 - DNA, 25 bp, Rattus norvegicus
aggtttgcagtagagccccatatga

SEQ ID NO: 154463 - DNA, 25 bp, Rattus norvegicus
aggtttgcagttacctgtgggacgt

SEQ ID NO: 154464 - DNA, 25 bp, Rattus norvegicus
aggtttgcagtttcctgtgggacgt

SEQ ID NO: 154465 - DNA, 25 bp, Rattus norvegicus
aggtttgccaagcttctgctgcgcc

SEQ ID NO: 154466 - DNA, 25 bp, Rattus norvegicus
aggtttgccaaggttctgctgcgcc

SEQ ID NO: 154467 - DNA, 25 bp, Rattus norvegicus
aggtttgccactcgtctgggctgct

SEQ ID NO: 154468 - DNA, 25 bp, Rattus norvegicus
aggtttgccactggtctgggctgct

SEQ ID NO: 154469 - DNA, 25 bp, Rattus norvegicus
aggtttgccgtgcagctcaacgagt

SEQ ID NO: 154470 - DNA, 25 bp, Rattus norvegicus
aggtttgccgtggagctcaacgagt

SEQ ID NO: 154471 - DNA, 25 bp, Rattus norvegicus
aggtttgccttgctgtgtggcacat

SEQ ID NO: 154472 - DNA, 25 bp, Rattus norvegicus
aggtttgccttggtgtgtggcacat

SEQ ID NO: 154473 - DNA, 25 bp, Rattus norvegicus
aggtttgcgattctttcccttcact

SEQ ID NO: 154474 - DNA, 25 bp, Rattus norvegicus
aggtttgcgattgtttcccttcact

SEQ ID NO: 154475 - DNA, 25 bp, Rattus norvegicus
aggtttgcgcccaccaagatgaggt

SEQ ID NO: 154476 - DNA, 25 bp, Rattus norvegicus
aggtttgcgccctccaagatgaggt

SEQ ID NO: 154477 - DNA, 25 bp, Rattus norvegicus
aggtttgcggtgatctaattaggag

SEQ ID NO: 154478 - DNA, 25 bp, Rattus norvegicus
aggtttgcggtgttctaattaggag

SEQ ID NO: 154479 - DNA, 25 bp, Rattus norvegicus
aggtttgctccactccgctaccaga

SEQ ID NO: 154480 - DNA, 25 bp, Rattus norvegicus
aggtttgctccagtccgctaccaga

SEQ ID NO: 154481 - DNA, 25 bp, Rattus norvegicus
aggtttgctctcagttggcattgat

SEQ ID NO: 154482 - DNA, 25 bp, Rattus norvegicus
aggtttgctctcatcagcatgaaac

SEQ ID NO: 154483 - DNA, 25 bp, Rattus norvegicus
aggtttgctctctgttggcattgat

SEQ ID NO: 154484 - DNA, 25 bp, Rattus norvegicus
aggtttgctctcttcagcatgaaac

SEQ ID NO: 154485 - DNA, 25 bp, Rattus norvegicus
aggtttgggctgaaggtctcatctc

SEQ ID NO: 154486 - DNA, 25 bp, Rattus norvegicus
aggtttgggctgtaggtctcatctc

SEQ ID NO: 154487 - DNA, 25 bp, Rattus norvegicus
aggtttggtctcaagcacggcataa

SEQ ID NO: 154488 - DNA, 25 bp, Rattus norvegicus
aggtttggtctctagcacggcataa

SEQ ID NO: 154489 - DNA, 25 bp, Rattus norvegicus
aggtttggtgacaggcctctagcca

SEQ ID NO: 154490 - DNA, 25 bp, Rattus norvegicus
aggtttggtgactggcctctagcca

SEQ ID NO: 154491 - DNA, 25 bp, Rattus norvegicus
aggtttggtgcacctcgctgtgaaa

SEQ ID NO: 154492 - DNA, 25 bp, Rattus norvegicus
aggtttggtgcagctcgctgtgaaa

SEQ ID NO: 154493 - DNA, 25 bp, Rattus norvegicus
aggtttgtactcatgcatctgttaa

SEQ ID NO: 154494 - DNA, 25 bp, Rattus norvegicus
aggtttgtactcttgcatctgttaa

SEQ ID NO: 154495 - DNA, 25 bp, Rattus norvegicus
aggtttgtctccaacatctattgtt

SEQ ID NO: 154496 - DNA, 25 bp, Rattus norvegicus
aggtttgtctcctacatctattgtt

SEQ ID NO: 154497 - DNA, 25 bp, Rattus norvegicus
aggtttgtgaaacccactcacctga

SEQ ID NO: 154498 - DNA, 25 bp, Rattus norvegicus
aggtttgtgaaagccactcacctga

SEQ ID NO: 154499 - DNA, 25 bp, Rattus norvegicus
aggtttgttaccagtacagtcatat

SEQ ID NO: 154500 - DNA, 25 bp, Rattus norvegicus
aggtttgttacctgtacagtcatat

SEQ ID NO: 154501 - DNA, 25 bp, Rattus norvegicus
aggtttgttcataccagtgcaatca

SEQ ID NO: 154502 - DNA, 25 bp, Rattus norvegicus
aggtttgttcattccagtgcaatca

SEQ ID NO: 154503 - DNA, 25 bp, Rattus norvegicus
aggtttgttctgaagcttcatgtca

SEQ ID NO: 154504 - DNA, 25 bp, Rattus norvegicus
aggtttgttctgtagcttcatgtca

SEQ ID NO: 154505 - DNA, 25 bp, Rattus norvegicus
aggtttgttgagcatctccttttcc

SEQ ID NO: 154506 - DNA, 25 bp, Rattus norvegicus
aggtttgttgaggatctccttttcc

SEQ ID NO: 154507 - DNA, 25 bp, Rattus norvegicus
aggtttgtttctcatgatctgtcag

SEQ ID NO: 154508 - DNA, 25 bp, Rattus norvegicus
aggtttgtttctgatgatctgtcag

SEQ ID NO: 154509 - DNA, 25 bp, Rattus norvegicus
aggtttgttttcacttcatgctaaa

SEQ ID NO: 154510 - DNA, 25 bp, Rattus norvegicus
aggtttgttttctcttcatgctaaa

SEQ ID NO: 154511 - DNA, 25 bp, Rattus norvegicus
aggttttactctctggtactgtgaa

SEQ ID NO: 154512 - DNA, 25 bp, Rattus norvegicus
aggttttactctgtggtactgtgaa

SEQ ID NO: 154513 - DNA, 25 bp, Rattus norvegicus
aggttttacttcatgctacactggc

SEQ ID NO: 154514 - DNA, 25 bp, Rattus norvegicus
aggttttacttcttgctacactggc

SEQ ID NO: 154515 - DNA, 25 bp, Rattus norvegicus
aggttttacttgctctgatttctga

SEQ ID NO: 154516 - DNA, 25 bp, Rattus norvegicus
aggttttacttggtctgatttctga

SEQ ID NO: 154517 - DNA, 25 bp, Rattus norvegicus
aggttttagtcactgcttcctagga

SEQ ID NO: 154518 - DNA, 25 bp, Rattus norvegicus
aggttttagtcagtgcttcctagga

SEQ ID NO: 154519 - DNA, 25 bp, Rattus norvegicus
aggttttatcctcggcaacatgtat

SEQ ID NO: 154520 - DNA, 25 bp, Rattus norvegicus
aggttttatcctgggcaacatgtat

SEQ ID NO: 154521 - DNA, 25 bp, Rattus norvegicus
aggttttcacagaggttccttcctg

SEQ ID NO: 154522 - DNA, 25 bp, Rattus norvegicus
aggttttcacagtggttccttcctg

SEQ ID NO: 154523 - DNA, 25 bp, Rattus norvegicus
aggttttcagagcatcgcctgggca

SEQ ID NO: 154524 - DNA, 25 bp, Rattus norvegicus
aggttttcagaggatcgcctgggca

SEQ ID NO: 154525 - DNA, 25 bp, Rattus norvegicus
aggttttcaggcagacggctgtgaa

SEQ ID NO: 154526 - DNA, 25 bp, Rattus norvegicus
aggttttcaggctgacggctgtgaa

SEQ ID NO: 154527 - DNA, 25 bp, Rattus norvegicus
aggttttcattgatcttgtgtagca

SEQ ID NO: 154528 - DNA, 25 bp, Rattus norvegicus
aggttttcattgttcttgtgtagca

SEQ ID NO: 154529 - DNA, 25 bp, Rattus norvegicus
aggttttccatgctgctgcccagga

SEQ ID NO: 154530 - DNA, 25 bp, Rattus norvegicus
aggttttccatggtgctgcccagga

SEQ ID NO: 154531 - DNA, 25 bp, Rattus norvegicus
aggttttcccataggtgctgggagc

SEQ ID NO: 154532 - DNA, 25 bp, Rattus norvegicus
aggttttcccattggtgctgggagc

SEQ ID NO: 154533 - DNA, 25 bp, Rattus norvegicus
aggttttccctgagacaggcagtgt

SEQ ID NO: 154534 - DNA, 25 bp, Rattus norvegicus
aggttttccctgtgacaggcagtgt

SEQ ID NO: 154535 - DNA, 25 bp, Rattus norvegicus
aggttttcgcctactcaatctgaaa

SEQ ID NO: 154536 - DNA, 25 bp, Rattus norvegicus
aggttttcgccttctcaatctgaaa

SEQ ID NO: 154537 - DNA, 25 bp, Rattus norvegicus
aggttttctatgcttgtcactgcca

SEQ ID NO: 154538 - DNA, 25 bp, Rattus norvegicus
aggttttctatggttgtcactgcca

SEQ ID NO: 154539 - DNA, 25 bp, Rattus norvegicus
aggttttctgttcttcatgatccca

SEQ ID NO: 154540 - DNA, 25 bp, Rattus norvegicus
aggttttctgttgttcatgatccca

SEQ ID NO: 154541 - DNA, 25 bp, Rattus norvegicus
aggttttgaactagctctaccactg

SEQ ID NO: 154542 - DNA, 25 bp, Rattus norvegicus
aggttttgaacttgctctaccactg

SEQ ID NO: 154543 - DNA, 25 bp, Rattus norvegicus
aggttttgaagacccaagcattcca

SEQ ID NO: 154544 - DNA, 25 bp, Rattus norvegicus
aggttttgaagagccaagcattcca

SEQ ID NO: 154545 - DNA, 25 bp, Rattus norvegicus
aggttttgcaccaaggcacatgcac

SEQ ID NO: 154546 - DNA, 25 bp, Rattus norvegicus
aggttttgcacctaggcacatgcac

SEQ ID NO: 154547 - DNA, 25 bp, Rattus norvegicus
aggttttgccctatcagagcctgta

SEQ ID NO: 154548 - DNA, 25 bp, Rattus norvegicus
aggttttgccctttcagagcctgta

SEQ ID NO: 154549 - DNA, 25 bp, Rattus norvegicus
aggttttggagtaccggatgctgtc

SEQ ID NO: 154550 - DNA, 25 bp, Rattus norvegicus
aggttttggagttccggatgctgtc

SEQ ID NO: 154551 - DNA, 25 bp, Rattus norvegicus
aggttttgtcacatagcattggctg

SEQ ID NO: 154552 - DNA, 25 bp, Rattus norvegicus
aggttttgtcacttagcattggctg

SEQ ID NO: 154553 - DNA, 25 bp, Rattus norvegicus
aggttttgtgttctatgcttcctct

SEQ ID NO: 154554 - DNA, 25 bp, Rattus norvegicus
aggttttgtgttgtatgcttcctct

SEQ ID NO: 154555 - DNA, 25 bp, Rattus norvegicus
aggttttgttggctgagttttctca

SEQ ID NO: 154556 - DNA, 25 bp, Rattus norvegicus
aggttttgttgggtgagttttctca

SEQ ID NO: 154557 - DNA, 25 bp, Rattus norvegicus
aggtttttctacaccatacagtcca

SEQ ID NO: 154558 - DNA, 25 bp, Rattus norvegicus
aggtttttctactccatacagtcca

SEQ ID NO: 154559 - DNA, 25 bp, Rattus norvegicus
aggtttttctcccaagttccagcat

SEQ ID NO: 154560 - DNA, 25 bp, Rattus norvegicus
aggtttttctccgaagttccagcat

SEQ ID NO: 154561 - DNA, 25 bp, Rattus norvegicus
aggtttttgaccaagctcacagtac

SEQ ID NO: 154562 - DNA, 25 bp, Rattus norvegicus
aggtttttgacctagctcacagtac

SEQ ID NO: 154563 - DNA, 25 bp, Rattus norvegicus
aggtttttgcatcgctcatcagagc

SEQ ID NO: 154564 - DNA, 25 bp, Rattus norvegicus
aggtttttgcatggctcatcagagc

SEQ ID NO: 154565 - DNA, 25 bp, Rattus norvegicus
aggttttttgctcgtgttggtgatt

SEQ ID NO: 154566 - DNA, 25 bp, Rattus norvegicus
aggttttttgctggtgttggtgatt

SEQ ID NO: 154567 - DNA, 25 bp, Rattus norvegicus
agtaaaaatgtgaccctgtcctgtt

SEQ ID NO: 154568 - DNA, 25 bp, Rattus norvegicus
agtaaaaatgtgtccctgtcctgtt

SEQ ID NO: 154569 - DNA, 25 bp, Rattus norvegicus
agtaaaactgaccagagtcccaggg

SEQ ID NO: 154570 - DNA, 25 bp, Rattus norvegicus
agtaaaactgacgagagtcccaggg

SEQ ID NO: 154571 - DNA, 25 bp, Rattus norvegicus
agtaaaacttaacccctgcctctag

SEQ ID NO: 154572 - DNA, 25 bp, Rattus norvegicus
agtaaaacttaagccctgcctctag

SEQ ID NO: 154573 - DNA, 25 bp, Rattus norvegicus
agtaaaacttctccacttcccagat

SEQ ID NO: 154574 - DNA, 25 bp, Rattus norvegicus
agtaaaacttctgcacttcccagat

SEQ ID NO: 154575 - DNA, 25 bp, Rattus norvegicus
agtaaaagagatcaactccctctcc

SEQ ID NO: 154576 - DNA, 25 bp, Rattus norvegicus
agtaaaagagatgaactccctctcc

SEQ ID NO: 154577 - DNA, 25 bp, Rattus norvegicus
agtaaaagcagtctgcctgtcctct

SEQ ID NO: 154578 - DNA, 25 bp, Rattus norvegicus
agtaaaagcagtgtgcctgtcctct

SEQ ID NO: 154579 - DNA, 25 bp, Rattus norvegicus
agtaaaatcctgactgtcctaccga

SEQ ID NO: 154580 - DNA, 25 bp, Rattus norvegicus
agtaaaatcctgtctgtcctaccga

SEQ ID NO: 154581 - DNA, 25 bp, Rattus norvegicus
agtaaaatcgatcccatgtcccgag

SEQ ID NO: 154582 - DNA, 25 bp, Rattus norvegicus
agtaaaatcgatgccatgtcccgag

SEQ ID NO: 154583 - DNA, 25 bp, Rattus norvegicus
agtaaaatgtgcatcgtgcttgcta

SEQ ID NO: 154584 - DNA, 25 bp, Rattus norvegicus
agtaaaatgtgcttcgtgcttgcta

SEQ ID NO: 154585 - DNA, 25 bp, Rattus norvegicus
agtaaacaatgcatttccttctctg

SEQ ID NO: 154586 - DNA, 25 bp, Rattus norvegicus
agtaaacaatgcttttccttctctg

SEQ ID NO: 154587 - DNA, 25 bp, Rattus norvegicus
agtaaacagtccacagcgaagccgc

SEQ ID NO: 154588 - DNA, 25 bp, Rattus norvegicus
agtaaacagtcctcagcgaagccgc

SEQ ID NO: 154589 - DNA, 25 bp, Rattus norvegicus
agtaaaccatgcagtcctggctgtt

SEQ ID NO: 154590 - DNA, 25 bp, Rattus norvegicus
agtaaaccatgctgtcctggctgtt

SEQ ID NO: 154591 - DNA, 25 bp, Rattus norvegicus
agtaaacctcgcagacaggcaggac

SEQ ID NO: 154592 - DNA, 25 bp, Rattus norvegicus
agtaaacctcgctgacaggcaggac

SEQ ID NO: 154593 - DNA, 25 bp, Rattus norvegicus
agtaaacctgtcagaatgtacctgt

SEQ ID NO: 154594 - DNA, 25 bp, Rattus norvegicus
agtaaacctgtctgaatgtacctgt

SEQ ID NO: 154595 - DNA, 25 bp, Rattus norvegicus
agtaaactccagattccacagttcc

SEQ ID NO: 154596 - DNA, 25 bp, Rattus norvegicus
agtaaactccagtttccacagttcc

SEQ ID NO: 154597 - DNA, 25 bp, Rattus norvegicus
agtaaactggatacctctcattttg

SEQ ID NO: 154598 - DNA, 25 bp, Rattus norvegicus
agtaaactggattcctctcattttg

SEQ ID NO: 154599 - DNA, 25 bp, Rattus norvegicus
agtaaactgtggagcaggcctgcta

SEQ ID NO: 154600 - DNA, 25 bp, Rattus norvegicus
agtaaactgtggtgcaggcctgcta

SEQ ID NO: 154601 - DNA, 25 bp, Rattus norvegicus
agtaaactgttcagtcttatctccc

SEQ ID NO: 154602 - DNA, 25 bp, Rattus norvegicus
agtaaactgttctgtcttatctccc

SEQ ID NO: 154603 - DNA, 25 bp, Rattus norvegicus
agtaaagaacctccagcctgccatt

SEQ ID NO: 154604 - DNA, 25 bp, Rattus norvegicus
agtaaagaacctgcagcctgccatt

SEQ ID NO: 154605 - DNA, 25 bp, Rattus norvegicus
agtaaagacagacttgtgttcccaa

SEQ ID NO: 154606 - DNA, 25 bp, Rattus norvegicus
agtaaagacagagttgtgttcccaa

SEQ ID NO: 154607 - DNA, 25 bp, Rattus norvegicus
agtaaagattgcaggccacacccac

SEQ ID NO: 154608 - DNA, 25 bp, Rattus norvegicus
agtaaagattgctggccacacccac

SEQ ID NO: 154609 - DNA, 25 bp, Rattus norvegicus
agtaaagcccagagccacatagtaa

SEQ ID NO: 154610 - DNA, 25 bp, Rattus norvegicus
agtaaagcccagtgccacatagtaa

SEQ ID NO: 154611 - DNA, 25 bp, Rattus norvegicus
agtaaagcctagaccgagatcccag

SEQ ID NO: 154612 - DNA, 25 bp, Rattus norvegicus
agtaaagcctagtccgagatcccag

SEQ ID NO: 154613 - DNA, 25 bp, Rattus norvegicus
agtaaagcgctacttctgtcggaag

SEQ ID NO: 154614 - DNA, 25 bp, Rattus norvegicus
agtaaagcgctagttctgtcggaag

SEQ ID NO: 154615 - DNA, 25 bp, Rattus norvegicus
agtaaagcttcaccatcccgtgagc

SEQ ID NO: 154616 - DNA, 25 bp, Rattus norvegicus
agtaaagcttcagcatcccgtgagc

SEQ ID NO: 154617 - DNA, 25 bp, Rattus norvegicus
agtaaaggctggctgtgacaaacat

SEQ ID NO: 154618 - DNA, 25 bp, Rattus norvegicus
agtaaaggctgggtgtgacaaacat

SEQ ID NO: 154619 - DNA, 25 bp, Rattus norvegicus
agtaaaggtgttctaccctcatcac

SEQ ID NO: 154620 - DNA, 25 bp, Rattus norvegicus
agtaaaggtgttgtaccctcatcac

SEQ ID NO: 154621 - DNA, 25 bp, Rattus norvegicus
agtaaagtacctccacgttctcatt

SEQ ID NO: 154622 - DNA, 25 bp, Rattus norvegicus
agtaaagtacctgcacgttctcatt

SEQ ID NO: 154623 - DNA, 25 bp, Rattus norvegicus
agtaaagtcagtctggttccatcag

SEQ ID NO: 154624 - DNA, 25 bp, Rattus norvegicus
agtaaagtcagtgtggttccatcag

SEQ ID NO: 154625 - DNA, 25 bp, Rattus norvegicus
agtaaagtccccagatgccatctat

SEQ ID NO: 154626 - DNA, 25 bp, Rattus norvegicus
agtaaagtcccctgatgccatctat

SEQ ID NO: 154627 - DNA, 25 bp, Rattus norvegicus
agtaaagtgacaacggccttctgtt

SEQ ID NO: 154628 - DNA, 25 bp, Rattus norvegicus
agtaaagtgacatcggccttctgtt

SEQ ID NO: 154629 - DNA, 25 bp, Rattus norvegicus
agtaaagtgtgtcctgtcacccctt

SEQ ID NO: 154630 - DNA, 25 bp, Rattus norvegicus
agtaaagtgtgtgctgtcacccctt

SEQ ID NO: 154631 - DNA, 25 bp, Rattus norvegicus
agtaaagttcagcaaccactccggt

SEQ ID NO: 154632 - DNA, 25 bp, Rattus norvegicus
agtaaagttcaggaaccactccggt

SEQ ID NO: 154633 - DNA, 25 bp, Rattus norvegicus
agtaaagttggactctcttcagccc

SEQ ID NO: 154634 - DNA, 25 bp, Rattus norvegicus
agtaaagttggagtctcttcagccc

SEQ ID NO: 154635 - DNA, 25 bp, Rattus norvegicus
agtaaataaaccagcatcctgccgc

SEQ ID NO: 154636 - DNA, 25 bp, Rattus norvegicus
agtaaataaacctgcatcctgccgc

SEQ ID NO: 154637 - DNA, 25 bp, Rattus norvegicus
agtaaataagctctgggacaaccca

SEQ ID NO: 154638 - DNA, 25 bp, Rattus norvegicus
agtaaataagctgtgggacaaccca

SEQ ID NO: 154639 - DNA, 25 bp, Rattus norvegicus
agtaaatacacccatggtctttggg

SEQ ID NO: 154640 - DNA, 25 bp, Rattus norvegicus
agtaaatacaccgatggtctttggg

SEQ ID NO: 154641 - DNA, 25 bp, Rattus norvegicus
agtaaataccccactgtgagcagct

SEQ ID NO: 154642 - DNA, 25 bp, Rattus norvegicus
agtaaatacccctctgtgagcagct

SEQ ID NO: 154643 - DNA, 25 bp, Rattus norvegicus
agtaaatatctacccggagctgggc

SEQ ID NO: 154644 - DNA, 25 bp, Rattus norvegicus
agtaaatatctagccggagctgggc

SEQ ID NO: 154645 - DNA, 25 bp, Rattus norvegicus
agtaaatcaccacagcggcagacaa

SEQ ID NO: 154646 - DNA, 25 bp, Rattus norvegicus
agtaaatcaccagagcggcagacaa

SEQ ID NO: 154647 - DNA, 25 bp, Rattus norvegicus
agtaaatcacccagcctcagaatga

SEQ ID NO: 154648 - DNA, 25 bp, Rattus norvegicus
agtaaatcaccctgcctcagaatga

SEQ ID NO: 154649 - DNA, 25 bp, Rattus norvegicus
agtaaatccagacaccgcggcctct

SEQ ID NO: 154650 - DNA, 25 bp, Rattus norvegicus
agtaaatccagagaccgcggcctct

SEQ ID NO: 154651 - DNA, 25 bp, Rattus norvegicus
agtaaatccctcatgactggctcaa

SEQ ID NO: 154652 - DNA, 25 bp, Rattus norvegicus
agtaaatccctcttgactggctcaa

SEQ ID NO: 154653 - DNA, 25 bp, Rattus norvegicus
agtaaatccttgcatggactcctta

SEQ ID NO: 154654 - DNA, 25 bp, Rattus norvegicus
agtaaatccttggatggactcctta

SEQ ID NO: 154655 - DNA, 25 bp, Rattus norvegicus
agtaaatgccggcttaccatctcta

SEQ ID NO: 154656 - DNA, 25 bp, Rattus norvegicus
agtaaatgccgggttaccatctcta

SEQ ID NO: 154657 - DNA, 25 bp, Rattus norvegicus
agtaaatgctctatgggttgatgcc

SEQ ID NO: 154658 - DNA, 25 bp, Rattus norvegicus
agtaaatgctctttgggttgatgcc

SEQ ID NO: 154659 - DNA, 25 bp, Rattus norvegicus
agtaaatggcttacctccatgcttc

SEQ ID NO: 154660 - DNA, 25 bp, Rattus norvegicus
agtaaatggctttcctccatgcttc

SEQ ID NO: 154661 - DNA, 25 bp, Rattus norvegicus
agtaaatggttaatctgcttttggg

SEQ ID NO: 154662 - DNA, 25 bp, Rattus norvegicus
agtaaatggttattctgcttttggg

SEQ ID NO: 154663 - DNA, 25 bp, Rattus norvegicus
agtaaattccacagtccatttgtgt

SEQ ID NO: 154664 - DNA, 25 bp, Rattus norvegicus
agtaaattccactgtccatttgtgt

SEQ ID NO: 154665 - DNA, 25 bp, Rattus norvegicus
agtaaattgtgtcacctttccctgg

SEQ ID NO: 154666 - DNA, 25 bp, Rattus norvegicus
agtaaattgtgtgacctttccctgg

SEQ ID NO: 154667 - DNA, 25 bp, Rattus norvegicus
agtaaatttccactgttcatttgta

SEQ ID NO: 154668 - DNA, 25 bp, Rattus norvegicus
agtaaatttccagtgttcatttgta

SEQ ID NO: 154669 - DNA, 25 bp, Rattus norvegicus
agtaacaaagtcctgtgtctcccat

SEQ ID NO: 154670 - DNA, 25 bp, Rattus norvegicus
agtaacaaagtcgtgtgtctcccat

SEQ ID NO: 154671 - DNA, 25 bp, Rattus norvegicus
agtaacaagggcaggtacaccccat

SEQ ID NO: 154672 - DNA, 25 bp, Rattus norvegicus
agtaacaagggctggtacaccccat

SEQ ID NO: 154673 - DNA, 25 bp, Rattus norvegicus
agtaacaataccacaagttgacctt

SEQ ID NO: 154674 - DNA, 25 bp, Rattus norvegicus
agtaacaatacctcaagttgacctt

SEQ ID NO: 154675 - DNA, 25 bp, Rattus norvegicus
agtaacacagcccaaggtgcttcgg

SEQ ID NO: 154676 - DNA, 25 bp, Rattus norvegicus
agtaacacagccgaaggtgcttcgg

SEQ ID NO: 154677 - DNA, 25 bp, Rattus norvegicus
agtaacacatctataatccgcctaa

SEQ ID NO: 154678 - DNA, 25 bp, Rattus norvegicus
agtaacacatctttaatccgcctaa

SEQ ID NO: 154679 - DNA, 25 bp, Rattus norvegicus
agtaacagagttctcagttcctcaa

SEQ ID NO: 154680 - DNA, 25 bp, Rattus norvegicus
agtaacagagttgtcagttcctcaa

SEQ ID NO: 154681 - DNA, 25 bp, Rattus norvegicus
agtaacagtgagcagctcctgccag

SEQ ID NO: 154682 - DNA, 25 bp, Rattus norvegicus
agtaacagtgaggagctcctgccag

SEQ ID NO: 154683 - DNA, 25 bp, Rattus norvegicus
agtaacagttatctgaggccctctt

SEQ ID NO: 154684 - DNA, 25 bp, Rattus norvegicus
agtaacagttatgtgaggccctctt

SEQ ID NO: 154685 - DNA, 25 bp, Rattus norvegicus
agtaacatcgttctcttcccctacg

SEQ ID NO: 154686 - DNA, 25 bp, Rattus norvegicus
agtaacatcgttgtcttcccctacg

SEQ ID NO: 154687 - DNA, 25 bp, Rattus norvegicus
agtaacatgaacactggccctccaa

SEQ ID NO: 154688 - DNA, 25 bp, Rattus norvegicus
agtaacatgaactctggccctccaa

SEQ ID NO: 154689 - DNA, 25 bp, Rattus norvegicus
agtaacatgcccattggagaaccag

SEQ ID NO: 154690 - DNA, 25 bp, Rattus norvegicus
agtaacatgccctttggagaaccag

SEQ ID NO: 154691 - DNA, 25 bp, Rattus norvegicus
agtaacattggaaagactcggactt

SEQ ID NO: 154692 - DNA, 25 bp, Rattus norvegicus
agtaacattggatagactcggactt

SEQ ID NO: 154693 - DNA, 25 bp, Rattus norvegicus
agtaaccaaggacacctgcccagaa

SEQ ID NO: 154694 - DNA, 25 bp, Rattus norvegicus
agtaaccaaggagacctgcccagaa

SEQ ID NO: 154695 - DNA, 25 bp, Rattus norvegicus
agtaaccaatggatgagttcctgta

SEQ ID NO: 154696 - DNA, 25 bp, Rattus norvegicus
agtaaccaatggttgagttcctgta

SEQ ID NO: 154697 - DNA, 25 bp, Rattus norvegicus
agtaaccatccccttcaaatgtatg

SEQ ID NO: 154698 - DNA, 25 bp, Rattus norvegicus
agtaaccatcccgttcaaatgtatg

SEQ ID NO: 154699 - DNA, 25 bp, Rattus norvegicus
agtaaccattttaccatgctgcagg

SEQ ID NO: 154700 - DNA, 25 bp, Rattus norvegicus
agtaaccatttttccatgctgcagg

SEQ ID NO: 154701 - DNA, 25 bp, Rattus norvegicus
agtaaccccgtccacgagattcaga

SEQ ID NO: 154702 - DNA, 25 bp, Rattus norvegicus
agtaaccccgtcgacgagattcaga

SEQ ID NO: 154703 - DNA, 25 bp, Rattus norvegicus
agtaaccctcgcagtagtcctggtg

SEQ ID NO: 154704 - DNA, 25 bp, Rattus norvegicus
agtaaccctcgctgtagtcctggtg

SEQ ID NO: 154705 - DNA, 25 bp, Rattus norvegicus
agtaaccgtctaaaagtgcatccag

SEQ ID NO: 154706 - DNA, 25 bp, Rattus norvegicus
agtaaccgtctataagtgcatccag

SEQ ID NO: 154707 - DNA, 25 bp, Rattus norvegicus
agtaacctagccctgctgcagaagg

SEQ ID NO: 154708 - DNA, 25 bp, Rattus norvegicus
agtaacctagccgtgctgcagaagg

SEQ ID NO: 154709 - DNA, 25 bp, Rattus norvegicus
agtaacctcaatccctatatcacat

SEQ ID NO: 154710 - DNA, 25 bp, Rattus norvegicus
agtaacctcaatgcctatatcacat

SEQ ID NO: 154711 - DNA, 25 bp, Rattus norvegicus
agtaacctcagtccgtgcgtcagaa

SEQ ID NO: 154712 - DNA, 25 bp, Rattus norvegicus
agtaacctcagtgcgtgcgtcagaa

SEQ ID NO: 154713 - DNA, 25 bp, Rattus norvegicus
agtaaccttgtgcagggccccttgt

SEQ ID NO: 154714 - DNA, 25 bp, Rattus norvegicus
agtaaccttgtggagggccccttgt

SEQ ID NO: 154715 - DNA, 25 bp, Rattus norvegicus
agtaacgaacagatgccttcggttt

SEQ ID NO: 154716 - DNA, 25 bp, Rattus norvegicus
agtaacgaacagttgccttcggttt

SEQ ID NO: 154717 - DNA, 25 bp, Rattus norvegicus
agtaacgaaggcctgtcacgctgta

SEQ ID NO: 154718 - DNA, 25 bp, Rattus norvegicus
agtaacgaaggcgtgtcacgctgta

SEQ ID NO: 154719 - DNA, 25 bp, Rattus norvegicus
agtaacgattgcctccgtgctgaag

SEQ ID NO: 154720 - DNA, 25 bp, Rattus norvegicus
agtaacgattgcgtccgtgctgaag

SEQ ID NO: 154721 - DNA, 25 bp, Rattus norvegicus
agtaacgcagaactgacagcagatt

SEQ ID NO: 154722 - DNA, 25 bp, Rattus norvegicus
agtaacgcagaagtgacagcagatt

SEQ ID NO: 154723 - DNA, 25 bp, Rattus norvegicus
agtaacgggcatcgagcacacctgt

SEQ ID NO: 154724 - DNA, 25 bp, Rattus norvegicus
agtaacgggcatggagcacacctgt

SEQ ID NO: 154725 - DNA, 25 bp, Rattus norvegicus
agtaacgtccatccggtaatgtctg

SEQ ID NO: 154726 - DNA, 25 bp, Rattus norvegicus
agtaacgtccatgcggtaatgtctg

SEQ ID NO: 154727 - DNA, 25 bp, Rattus norvegicus
agtaacgtctgaattgggccttcac

SEQ ID NO: 154728 - DNA, 25 bp, Rattus norvegicus
agtaacgtctgacatcctgttctct

SEQ ID NO: 154729 - DNA, 25 bp, Rattus norvegicus
agtaacgtctgagatcctgttctct

SEQ ID NO: 154730 - DNA, 25 bp, Rattus norvegicus
agtaacgtctgatttgggccttcac

SEQ ID NO: 154731 - DNA, 25 bp, Rattus norvegicus
agtaacgttgagagacgcgtcccct

SEQ ID NO: 154732 - DNA, 25 bp, Rattus norvegicus
agtaacgttgagtgacgcgtcccct

SEQ ID NO: 154733 - DNA, 25 bp, Rattus norvegicus
agtaactacagtacacccagcttgt

SEQ ID NO: 154734 - DNA, 25 bp, Rattus norvegicus
agtaactacagtcccgcccaggaga

SEQ ID NO: 154735 - DNA, 25 bp, Rattus norvegicus
agtaactacagtgccgcccaggaga

SEQ ID NO: 154736 - DNA, 25 bp, Rattus norvegicus
agtaactacagttcacccagcttgt

SEQ ID NO: 154737 - DNA, 25 bp, Rattus norvegicus
agtaactcagaaatgcggctctctc

SEQ ID NO: 154738 - DNA, 25 bp, Rattus norvegicus
agtaactcagaattgcggctctctc

SEQ ID NO: 154739 - DNA, 25 bp, Rattus norvegicus
agtaactccgagagctaaagcacag

SEQ ID NO: 154740 - DNA, 25 bp, Rattus norvegicus
agtaactccgagtgctaaagcacag

SEQ ID NO: 154741 - DNA, 25 bp, Rattus norvegicus
agtaactcgggaaccgcggccatgg

SEQ ID NO: 154742 - DNA, 25 bp, Rattus norvegicus
agtaactcgggatccgcggccatgg

SEQ ID NO: 154743 - DNA, 25 bp, Rattus norvegicus
agtaactctcacacacctggtaatt

SEQ ID NO: 154744 - DNA, 25 bp, Rattus norvegicus
agtaactctcactcacctggtaatt

SEQ ID NO: 154745 - DNA, 25 bp, Rattus norvegicus
agtaactctggcaatctcaatgatt

SEQ ID NO: 154746 - DNA, 25 bp, Rattus norvegicus
agtaactctggctatctcaatgatt

SEQ ID NO: 154747 - DNA, 25 bp, Rattus norvegicus
agtaactcttcacccatatttctgt

SEQ ID NO: 154748 - DNA, 25 bp, Rattus norvegicus
agtaactcttcagccatatttctgt

SEQ ID NO: 154749 - DNA, 25 bp, Rattus norvegicus
agtaactcttccacagtccactgaa

SEQ ID NO: 154750 - DNA, 25 bp, Rattus norvegicus
agtaactcttcctcagtccactgaa

SEQ ID NO: 154751 - DNA, 25 bp, Rattus norvegicus
agtaactgatgacaggctcctccct

SEQ ID NO: 154752 - DNA, 25 bp, Rattus norvegicus
agtaactgatgagaggctcctccct

SEQ ID NO: 154753 - DNA, 25 bp, Rattus norvegicus
agtaactgatgtaagcggctcccag

SEQ ID NO: 154754 - DNA, 25 bp, Rattus norvegicus
agtaactgatgttagcggctcccag

SEQ ID NO: 154755 - DNA, 25 bp, Rattus norvegicus
agtaactgcaacagcacgctggctc

SEQ ID NO: 154756 - DNA, 25 bp, Rattus norvegicus
agtaactgcaactgcacgctggctc

SEQ ID NO: 154757 - DNA, 25 bp, Rattus norvegicus
agtaactgcagaaccctggaggcaa

SEQ ID NO: 154758 - DNA, 25 bp, Rattus norvegicus
agtaactgcagatccctggaggcaa

SEQ ID NO: 154759 - DNA, 25 bp, Rattus norvegicus
agtaactgccaaactgtcatatgtt

SEQ ID NO: 154760 - DNA, 25 bp, Rattus norvegicus
agtaactgccaatctgtcatatgtt

SEQ ID NO: 154761 - DNA, 25 bp, Rattus norvegicus
agtaactgctccagcagggaggccc

SEQ ID NO: 154762 - DNA, 25 bp, Rattus norvegicus
agtaactgctcctgcagggaggccc

SEQ ID NO: 154763 - DNA, 25 bp, Rattus norvegicus
agtaactggcacagtagtccttcac

SEQ ID NO: 154764 - DNA, 25 bp, Rattus norvegicus
agtaactggcactgtagtccttcac

SEQ ID NO: 154765 - DNA, 25 bp, Rattus norvegicus
agtaactggtaacccaagcttcatt

SEQ ID NO: 154766 - DNA, 25 bp, Rattus norvegicus
agtaactggtaagccaagcttcatt

SEQ ID NO: 154767 - DNA, 25 bp, Rattus norvegicus
agtaactggtacagagcagccgctc

SEQ ID NO: 154768 - DNA, 25 bp, Rattus norvegicus
agtaactggtactgagcagccgctc

SEQ ID NO: 154769 - DNA, 25 bp, Rattus norvegicus
agtaactgttaaactgctgacccct

SEQ ID NO: 154770 - DNA, 25 bp, Rattus norvegicus
agtaactgttaatctgctgacccct

SEQ ID NO: 154771 - DNA, 25 bp, Rattus norvegicus
agtaactgttctaggttcccttcag

SEQ ID NO: 154772 - DNA, 25 bp, Rattus norvegicus
agtaactgttcttggttcccttcag

SEQ ID NO: 154773 - DNA, 25 bp, Rattus norvegicus
agtaactgttgacccactgggaagt

SEQ ID NO: 154774 - DNA, 25 bp, Rattus norvegicus
agtaactgttgagccactgggaagt

SEQ ID NO: 154775 - DNA, 25 bp, Rattus norvegicus
agtaactttgcacggctctataaat

SEQ ID NO: 154776 - DNA, 25 bp, Rattus norvegicus
agtaactttgcagggctctataaat

SEQ ID NO: 154777 - DNA, 25 bp, Rattus norvegicus
agtaagaacactccacccatgactt

SEQ ID NO: 154778 - DNA, 25 bp, Rattus norvegicus
agtaagaacactgcacccatgactt

SEQ ID NO: 154779 - DNA, 25 bp, Rattus norvegicus
agtaagaagacaacgacaagcaccc

SEQ ID NO: 154780 - DNA, 25 bp, Rattus norvegicus
agtaagaagacatcgacaagcaccc

SEQ ID NO: 154781 - DNA, 25 bp, Rattus norvegicus
agtaagaagactcgctctcctggag

SEQ ID NO: 154782 - DNA, 25 bp, Rattus norvegicus
agtaagaagactggctctcctggag

SEQ ID NO: 154783 - DNA, 25 bp, Rattus norvegicus
agtaagaagagcacctctgtccact

SEQ ID NO: 154784 - DNA, 25 bp, Rattus norvegicus
agtaagaagagctcctctgtccact

SEQ ID NO: 154785 - DNA, 25 bp, Rattus norvegicus
agtaagaccacaaggcacaacccct

SEQ ID NO: 154786 - DNA, 25 bp, Rattus norvegicus
agtaagaccacatggcacaacccct

SEQ ID NO: 154787 - DNA, 25 bp, Rattus norvegicus
agtaagactttcaggcacttcttcc

SEQ ID NO: 154788 - DNA, 25 bp, Rattus norvegicus
agtaagactttctggcacttcttcc

SEQ ID NO: 154789 - DNA, 25 bp, Rattus norvegicus
agtaagagcccaaagcacagcactt

SEQ ID NO: 154790 - DNA, 25 bp, Rattus norvegicus
agtaagagcccatagcacagcactt

SEQ ID NO: 154791 - DNA, 25 bp, Rattus norvegicus
agtaagaggcagctggcatctacct

SEQ ID NO: 154792 - DNA, 25 bp, Rattus norvegicus
agtaagaggcaggtggcatctacct

SEQ ID NO: 154793 - DNA, 25 bp, Rattus norvegicus
agtaagagggcaccaaccccacaca

SEQ ID NO: 154794 - DNA, 25 bp, Rattus norvegicus
agtaagagggcagcaaccccacaca

SEQ ID NO: 154795 - DNA, 25 bp, Rattus norvegicus
agtaagagtggcatgcctgaccgca

SEQ ID NO: 154796 - DNA, 25 bp, Rattus norvegicus
agtaagagtggcttgcctgaccgca

SEQ ID NO: 154797 - DNA, 25 bp, Rattus norvegicus
agtaagagttctcagtcaccatccc

SEQ ID NO: 154798 - DNA, 25 bp, Rattus norvegicus
agtaagagttctgagtcaccatccc

SEQ ID NO: 154799 - DNA, 25 bp, Rattus norvegicus
agtaagatgctgatttcccacctct

SEQ ID NO: 154800 - DNA, 25 bp, Rattus norvegicus
agtaagatgctgttttcccacctct

SEQ ID NO: 154801 - DNA, 25 bp, Rattus norvegicus
agtaagatggctcagcttcttccgc

SEQ ID NO: 154802 - DNA, 25 bp, Rattus norvegicus
agtaagatggctgagcttcttccgc

SEQ ID NO: 154803 - DNA, 25 bp, Rattus norvegicus
agtaagatgtctaggcagtttagcc

SEQ ID NO: 154804 - DNA, 25 bp, Rattus norvegicus
agtaagatgtcttggcagtttagcc

SEQ ID NO: 154805 - DNA, 25 bp, Rattus norvegicus
agtaagattcgtactggattgtcca

SEQ ID NO: 154806 - DNA, 25 bp, Rattus norvegicus
agtaagattcgttctggattgtcca

SEQ ID NO: 154807 - DNA, 25 bp, Rattus norvegicus
agtaagcaagcacacatggttctag

SEQ ID NO: 154808 - DNA, 25 bp, Rattus norvegicus
agtaagcaagcagacatggttctag

SEQ ID NO: 154809 - DNA, 25 bp, Rattus norvegicus
agtaagcaagggactcgtctctcca

SEQ ID NO: 154810 - DNA, 25 bp, Rattus norvegicus
agtaagcaagggtctcgtctctcca

SEQ ID NO: 154811 - DNA, 25 bp, Rattus norvegicus
agtaagcaccttcgtgtgctacctc

SEQ ID NO: 154812 - DNA, 25 bp, Rattus norvegicus
agtaagcaccttggtgtgctacctc

SEQ ID NO: 154813 - DNA, 25 bp, Rattus norvegicus
agtaagcactggctatattcaagac

SEQ ID NO: 154814 - DNA, 25 bp, Rattus norvegicus
agtaagcactgggtatattcaagac

SEQ ID NO: 154815 - DNA, 25 bp, Rattus norvegicus
agtaagcattttcccctgattcctt

SEQ ID NO: 154816 - DNA, 25 bp, Rattus norvegicus
agtaagcattttgccctgattcctt

SEQ ID NO: 154817 - DNA, 25 bp, Rattus norvegicus
agtaagccacccagttagaagaagg

SEQ ID NO: 154818 - DNA, 25 bp, Rattus norvegicus
agtaagccaccctgttagaagaagg

SEQ ID NO: 154819 - DNA, 25 bp, Rattus norvegicus
agtaagcgaacacccgtttgggaat

SEQ ID NO: 154820 - DNA, 25 bp, Rattus norvegicus
agtaagcgaacagccgtttgggaat

SEQ ID NO: 154821 - DNA, 25 bp, Rattus norvegicus
agtaagctcttgagggctgcacaga

SEQ ID NO: 154822 - DNA, 25 bp, Rattus norvegicus
agtaagctcttgtgggctgcacaga

SEQ ID NO: 154823 - DNA, 25 bp, Rattus norvegicus
agtaaggactctcatctctctctgc

SEQ ID NO: 154824 - DNA, 25 bp, Rattus norvegicus
agtaaggactctgatctctctctgc

SEQ ID NO: 154825 - DNA, 25 bp, Rattus norvegicus
agtaaggagctaccttggttgagtc

SEQ ID NO: 154826 - DNA, 25 bp, Rattus norvegicus
agtaaggagctagcttggttgagtc

SEQ ID NO: 154827 - DNA, 25 bp, Rattus norvegicus
agtaaggagctgagcatccttccaa

SEQ ID NO: 154828 - DNA, 25 bp, Rattus norvegicus
agtaaggagctgtgcatccttccaa

SEQ ID NO: 154829 - DNA, 25 bp, Rattus norvegicus
agtaaggatatgctgcagcttcagg

SEQ ID NO: 154830 - DNA, 25 bp, Rattus norvegicus
agtaaggatatggtgcagcttcagg

SEQ ID NO: 154831 - DNA, 25 bp, Rattus norvegicus
agtaaggcagccacaggtcctcgat

SEQ ID NO: 154832 - DNA, 25 bp, Rattus norvegicus
agtaaggcagcctcaggtcctcgat

SEQ ID NO: 154833 - DNA, 25 bp, Rattus norvegicus
agtaaggccaggacctagcgtctcc

SEQ ID NO: 154834 - DNA, 25 bp, Rattus norvegicus
agtaaggccaggtcctagcgtctcc

SEQ ID NO: 154835 - DNA, 25 bp, Rattus norvegicus
agtaaggcgtccattgctgcactgc

SEQ ID NO: 154836 - DNA, 25 bp, Rattus norvegicus
agtaaggcgtcctttgctgcactgc

SEQ ID NO: 154837 - DNA, 25 bp, Rattus norvegicus
agtaagggtgatcacctgcttcctg

SEQ ID NO: 154838 - DNA, 25 bp, Rattus norvegicus
agtaagggtgatgacctgcttcctg

SEQ ID NO: 154839 - DNA, 25 bp, Rattus norvegicus
agtaaggtccttcctgcaagaggtc

SEQ ID NO: 154840 - DNA, 25 bp, Rattus norvegicus
agtaaggtccttgctgcaagaggtc

SEQ ID NO: 154841 - DNA, 25 bp, Rattus norvegicus
agtaaggtctggacagccgctgtac

SEQ ID NO: 154842 - DNA, 25 bp, Rattus norvegicus
agtaaggtctggtcagccgctgtac

SEQ ID NO: 154843 - DNA, 25 bp, Rattus norvegicus
agtaaggtgggtccctcagctttcc

SEQ ID NO: 154844 - DNA, 25 bp, Rattus norvegicus
agtaaggtgggtgcctcagctttcc

SEQ ID NO: 154845 - DNA, 25 bp, Rattus norvegicus
agtaaggtttccaggaccacaagca

SEQ ID NO: 154846 - DNA, 25 bp, Rattus norvegicus
agtaaggtttcctggaccacaagca

SEQ ID NO: 154847 - DNA, 25 bp, Rattus norvegicus
agtaagtacttcctgcatttgtgca

SEQ ID NO: 154848 - DNA, 25 bp, Rattus norvegicus
agtaagtacttcgtgcatttgtgca

SEQ ID NO: 154849 - DNA, 25 bp, Rattus norvegicus
agtaagtactttccagctctcctgt

SEQ ID NO: 154850 - DNA, 25 bp, Rattus norvegicus
agtaagtactttgcagctctcctgt

SEQ ID NO: 154851 - DNA, 25 bp, Rattus norvegicus
agtaagtccgagaccaggtgtggca

SEQ ID NO: 154852 - DNA, 25 bp, Rattus norvegicus
agtaagtccgagtccaggtgtggca

SEQ ID NO: 154853 - DNA, 25 bp, Rattus norvegicus
agtaagtcggatcagcccgtctgtg

SEQ ID NO: 154854 - DNA, 25 bp, Rattus norvegicus
agtaagtcggatgagcccgtctgtg

SEQ ID NO: 154855 - DNA, 25 bp, Rattus norvegicus
agtaagtctcccagagaaggcccct

SEQ ID NO: 154856 - DNA, 25 bp, Rattus norvegicus
agtaagtctccctgagaaggcccct

SEQ ID NO: 154857 - DNA, 25 bp, Rattus norvegicus
agtaagtcttaacgcggtcacggct

SEQ ID NO: 154858 - DNA, 25 bp, Rattus norvegicus
agtaagtcttaaggcggtcacggct

SEQ ID NO: 154859 - DNA, 25 bp, Rattus norvegicus
agtaagtgaccgctgcctttcacaa

SEQ ID NO: 154860 - DNA, 25 bp, Rattus norvegicus
agtaagtgaccggtgcctttcacaa

SEQ ID NO: 154861 - DNA, 25 bp, Rattus norvegicus
agtaagtggcctagttttgctgtat

SEQ ID NO: 154862 - DNA, 25 bp, Rattus norvegicus
agtaagtggccttgttttgctgtat

SEQ ID NO: 154863 - DNA, 25 bp, Rattus norvegicus
agtaagtggcgtacgtgcagcgacc

SEQ ID NO: 154864 - DNA, 25 bp, Rattus norvegicus
agtaagtggcgttcgtgcagcgacc

SEQ ID NO: 154865 - DNA, 25 bp, Rattus norvegicus
agtaagtgtgtgagatttgttcctc

SEQ ID NO: 154866 - DNA, 25 bp, Rattus norvegicus
agtaagtgtgtgtgatttgttcctc

SEQ ID NO: 154867 - DNA, 25 bp, Rattus norvegicus
agtaagttacggaagcagctggctg

SEQ ID NO: 154868 - DNA, 25 bp, Rattus norvegicus
agtaagttacggtagcagctggctg

SEQ ID NO: 154869 - DNA, 25 bp, Rattus norvegicus
agtaagttctccaggctgcggatgc

SEQ ID NO: 154870 - DNA, 25 bp, Rattus norvegicus
agtaagttctcctggctgcggatgc

SEQ ID NO: 154871 - DNA, 25 bp, Rattus norvegicus
agtaagttcttccacaagctatccc

SEQ ID NO: 154872 - DNA, 25 bp, Rattus norvegicus
agtaagttcttcgacaagctatccc

SEQ ID NO: 154873 - DNA, 25 bp, Rattus norvegicus
agtaagttggcgctcagctctgcag

SEQ ID NO: 154874 - DNA, 25 bp, Rattus norvegicus
agtaagttggcggtcagctctgcag

SEQ ID NO: 154875 - DNA, 25 bp, Rattus norvegicus
agtaagttgtctacgtcaaagccaa

SEQ ID NO: 154876 - DNA, 25 bp, Rattus norvegicus
agtaagttgtcttcgtcaaagccaa

SEQ ID NO: 154877 - DNA, 25 bp, Rattus norvegicus
agtaataaatctctcctgcatggta

SEQ ID NO: 154878 - DNA, 25 bp, Rattus norvegicus
agtaataaatctgtcctgcatggta

SEQ ID NO: 154879 - DNA, 25 bp, Rattus norvegicus
agtaataacagtcctgtactcccag

SEQ ID NO: 154880 - DNA, 25 bp, Rattus norvegicus
agtaataacagtgctgtactcccag

SEQ ID NO: 154881 - DNA, 25 bp, Rattus norvegicus
agtaatacccagagactctcagtga

SEQ ID NO: 154882 - DNA, 25 bp, Rattus norvegicus
agtaatacccagtgactctcagtga

SEQ ID NO: 154883 - DNA, 25 bp, Rattus norvegicus
agtaataccccaagtcttctgactt

SEQ ID NO: 154884 - DNA, 25 bp, Rattus norvegicus
agtaataccccatgtcttctgactt

SEQ ID NO: 154885 - DNA, 25 bp, Rattus norvegicus
agtaataccgaactgctggcacctt

SEQ ID NO: 154886 - DNA, 25 bp, Rattus norvegicus
agtaataccgaagtgctggcacctt

SEQ ID NO: 154887 - DNA, 25 bp, Rattus norvegicus
agtaatacctacagctgtgtgccac

SEQ ID NO: 154888 - DNA, 25 bp, Rattus norvegicus
agtaatacctactgctgtgtgccac

SEQ ID NO: 154889 - DNA, 25 bp, Rattus norvegicus
agtaatacctggctcacggagataa

SEQ ID NO: 154890 - DNA, 25 bp, Rattus norvegicus
agtaatacctgggtcacggagataa

SEQ ID NO: 154891 - DNA, 25 bp, Rattus norvegicus
agtaatagcacccagcttccagttt

SEQ ID NO: 154892 - DNA, 25 bp, Rattus norvegicus
agtaatagcaccgagcttccagttt

SEQ ID NO: 154893 - DNA, 25 bp, Rattus norvegicus
agtaatagccatctgcacgtctttc

SEQ ID NO: 154894 - DNA, 25 bp, Rattus norvegicus
agtaatagccatgtgcacgtctttc

SEQ ID NO: 154895 - DNA, 25 bp, Rattus norvegicus
agtaataggagtctcggcctcttgc

SEQ ID NO: 154896 - DNA, 25 bp, Rattus norvegicus
agtaataggagtgtcggcctcttgc

SEQ ID NO: 154897 - DNA, 25 bp, Rattus norvegicus
agtaatagtctgagcaccttctctt

SEQ ID NO: 154898 - DNA, 25 bp, Rattus norvegicus
agtaatagtctgtgcaccttctctt

SEQ ID NO: 154899 - DNA, 25 bp, Rattus norvegicus
agtaatcagtgtatcccaacggaga

SEQ ID NO: 154900 - DNA, 25 bp, Rattus norvegicus
agtaatcagtgtttcccaacggaga

SEQ ID NO: 154901 - DNA, 25 bp, Rattus norvegicus
agtaatcatgatagtcccctttagt

SEQ ID NO: 154902 - DNA, 25 bp, Rattus norvegicus
agtaatcatgattgtcccctttagt

SEQ ID NO: 154903 - DNA, 25 bp, Rattus norvegicus
agtaatcatggtctgctcccttcac

SEQ ID NO: 154904 - DNA, 25 bp, Rattus norvegicus
agtaatcatggtgtgctcccttcac

SEQ ID NO: 154905 - DNA, 25 bp, Rattus norvegicus
agtaatcctccaagacagtatcaga

SEQ ID NO: 154906 - DNA, 25 bp, Rattus norvegicus
agtaatcctccatgacagtatcaga

SEQ ID NO: 154907 - DNA, 25 bp, Rattus norvegicus
agtaatccttcaacactttgtcact

SEQ ID NO: 154908 - DNA, 25 bp, Rattus norvegicus
agtaatccttcatcactttgtcact

SEQ ID NO: 154909 - DNA, 25 bp, Rattus norvegicus
agtaatcctttaccatattcccaga

SEQ ID NO: 154910 - DNA, 25 bp, Rattus norvegicus
agtaatcctttagcatattcccaga

SEQ ID NO: 154911 - DNA, 25 bp, Rattus norvegicus
agtaatctacatcgcagctcctgag

SEQ ID NO: 154912 - DNA, 25 bp, Rattus norvegicus
agtaatctacatggcagctcctgag

SEQ ID NO: 154913 - DNA, 25 bp, Rattus norvegicus
agtaatctgcccattcctttagaaa

SEQ ID NO: 154914 - DNA, 25 bp, Rattus norvegicus
agtaatctgccctttcctttagaaa

SEQ ID NO: 154915 - DNA, 25 bp, Rattus norvegicus
agtaatgacacgatggtcaccctct

SEQ ID NO: 154916 - DNA, 25 bp, Rattus norvegicus
agtaatgacacgttggtcaccctct

SEQ ID NO: 154917 - DNA, 25 bp, Rattus norvegicus
agtaatgaccctcaacctttggctc

SEQ ID NO: 154918 - DNA, 25 bp, Rattus norvegicus
agtaatgaccctgaacctttggctc

SEQ ID NO: 154919 - DNA, 25 bp, Rattus norvegicus
agtaatgactccactctttaaaatt

SEQ ID NO: 154920 - DNA, 25 bp, Rattus norvegicus
agtaatgactcctctctttaaaatt

SEQ ID NO: 154921 - DNA, 25 bp, Rattus norvegicus
agtaatgagataaccccgcctgtaa

SEQ ID NO: 154922 - DNA, 25 bp, Rattus norvegicus
agtaatgagatatccccgcctgtaa

SEQ ID NO: 154923 - DNA, 25 bp, Rattus norvegicus
agtaatgcaactccggcacatgcta

SEQ ID NO: 154924 - DNA, 25 bp, Rattus norvegicus
agtaatgcaactgcggcacatgcta

SEQ ID NO: 154925 - DNA, 25 bp, Rattus norvegicus
agtaatgcacatatccatctccctt

SEQ ID NO: 154926 - DNA, 25 bp, Rattus norvegicus
agtaatgcacatttccatctccctt

SEQ ID NO: 154927 - DNA, 25 bp, Rattus norvegicus
agtaatgccctcagagtagcttctt

SEQ ID NO: 154928 - DNA, 25 bp, Rattus norvegicus
agtaatgccctctgagtagcttctt

SEQ ID NO: 154929 - DNA, 25 bp, Rattus norvegicus
agtaatgctaatcctactttgcagc

SEQ ID NO: 154930 - DNA, 25 bp, Rattus norvegicus
agtaatgctaatgctactttgcagc

SEQ ID NO: 154931 - DNA, 25 bp, Rattus norvegicus
agtaatgctcttcgtaatagtcaca

SEQ ID NO: 154932 - DNA, 25 bp, Rattus norvegicus
agtaatgctcttggtaatagtcaca

SEQ ID NO: 154933 - DNA, 25 bp, Rattus norvegicus
agtaatgctgtgagactttctggag

SEQ ID NO: 154934 - DNA, 25 bp, Rattus norvegicus
agtaatgctgtgtgactttctggag

SEQ ID NO: 154935 - DNA, 25 bp, Rattus norvegicus
agtaatggagaaccttcctggttga

SEQ ID NO: 154936 - DNA, 25 bp, Rattus norvegicus
agtaatggagaagcttcctggttga

SEQ ID NO: 154937 - DNA, 25 bp, Rattus norvegicus
agtaatggagagatcccatgtctca

SEQ ID NO: 154938 - DNA, 25 bp, Rattus norvegicus
agtaatggagagttcccatgtctca

SEQ ID NO: 154939 - DNA, 25 bp, Rattus norvegicus
agtaatggatggctccagtccagag

SEQ ID NO: 154940 - DNA, 25 bp, Rattus norvegicus
agtaatggatgggtccagtccagag

SEQ ID NO: 154941 - DNA, 25 bp, Rattus norvegicus
agtaatggattcaccttctagggat

SEQ ID NO: 154942 - DNA, 25 bp, Rattus norvegicus
agtaatggattctccttctagggat

SEQ ID NO: 154943 - DNA, 25 bp, Rattus norvegicus
agtaatggccaactcgcctgagcct

SEQ ID NO: 154944 - DNA, 25 bp, Rattus norvegicus
agtaatggccaagtcgcctgagcct

SEQ ID NO: 154945 - DNA, 25 bp, Rattus norvegicus
agtaatgggtctctcaccttgtcac

SEQ ID NO: 154946 - DNA, 25 bp, Rattus norvegicus
agtaatgggtctgtcaccttgtcac

SEQ ID NO: 154947 - DNA, 25 bp, Rattus norvegicus
agtaatggtcggaacccagcaggta

SEQ ID NO: 154948 - DNA, 25 bp, Rattus norvegicus
agtaatggtcggtacccagcaggta

SEQ ID NO: 154949 - DNA, 25 bp, Rattus norvegicus
agtaatggtgccaccgttccgtgtg

SEQ ID NO: 154950 - DNA, 25 bp, Rattus norvegicus
agtaatggtgcctccgttccgtgtg

SEQ ID NO: 154951 - DNA, 25 bp, Rattus norvegicus
agtaatgtaggaaggccacggccct

SEQ ID NO: 154952 - DNA, 25 bp, Rattus norvegicus
agtaatgtaggatggccacggccct

SEQ ID NO: 154953 - DNA, 25 bp, Rattus norvegicus
agtaatgtcgttctttctcatgaaa

SEQ ID NO: 154954 - DNA, 25 bp, Rattus norvegicus
agtaatgtcgttgtttctcatgaaa

SEQ ID NO: 154955 - DNA, 25 bp, Rattus norvegicus
agtaatgtttccctttcactacgat

SEQ ID NO: 154956 - DNA, 25 bp, Rattus norvegicus
agtaatgtttccgtttcactacgat

SEQ ID NO: 154957 - DNA, 25 bp, Rattus norvegicus
agtaattaaactcctgatcccaaag

SEQ ID NO: 154958 - DNA, 25 bp, Rattus norvegicus
agtaattaaactgctgatcccaaag

SEQ ID NO: 154959 - DNA, 25 bp, Rattus norvegicus
agtaattaccataccccaagcggca

SEQ ID NO: 154960 - DNA, 25 bp, Rattus norvegicus
agtaattaccattccccaagcggca

SEQ ID NO: 154961 - DNA, 25 bp, Rattus norvegicus
agtaattatgaaacctccctttggg

SEQ ID NO: 154962 - DNA, 25 bp, Rattus norvegicus
agtaattatgaatcctccctttggg

SEQ ID NO: 154963 - DNA, 25 bp, Rattus norvegicus
agtaattcactacagacgcttgttg

SEQ ID NO: 154964 - DNA, 25 bp, Rattus norvegicus
agtaattcactagagacgcttgttg

SEQ ID NO: 154965 - DNA, 25 bp, Rattus norvegicus
agtaattccagtatgttgacagatt

SEQ ID NO: 154966 - DNA, 25 bp, Rattus norvegicus
agtaattccagtttgttgacagatt

SEQ ID NO: 154967 - DNA, 25 bp, Rattus norvegicus
agtaattcccctatttatatgtcag

SEQ ID NO: 154968 - DNA, 25 bp, Rattus norvegicus
agtaattcccctttttatatgtcag

SEQ ID NO: 154969 - DNA, 25 bp, Rattus norvegicus
agtaattcctccaagtggtctccat

SEQ ID NO: 154970 - DNA, 25 bp, Rattus norvegicus
agtaattcctcctagtggtctccat

SEQ ID NO: 154971 - DNA, 25 bp, Rattus norvegicus
agtaattcggttacagcgtgcacca

SEQ ID NO: 154972 - DNA, 25 bp, Rattus norvegicus
agtaattcggtttcagcgtgcacca

SEQ ID NO: 154973 - DNA, 25 bp, Rattus norvegicus
agtaattctgtaacactctctggaa

SEQ ID NO: 154974 - DNA, 25 bp, Rattus norvegicus
agtaattctgtatcactctctggaa

SEQ ID NO: 154975 - DNA, 25 bp, Rattus norvegicus
agtaattcttatctcgtcttcctaa

SEQ ID NO: 154976 - DNA, 25 bp, Rattus norvegicus
agtaattcttatgtcgtcttcctaa

SEQ ID NO: 154977 - DNA, 25 bp, Rattus norvegicus
agtaattgcctgattcagagcgagg

SEQ ID NO: 154978 - DNA, 25 bp, Rattus norvegicus
agtaattgcctgtttcagagcgagg

SEQ ID NO: 154979 - DNA, 25 bp, Rattus norvegicus
agtaattgtcttatctgttttgata

SEQ ID NO: 154980 - DNA, 25 bp, Rattus norvegicus
agtaattgtcttttctgttttgata

SEQ ID NO: 154981 - DNA, 25 bp, Rattus norvegicus
agtaattttgccactgttctgcctg

SEQ ID NO: 154982 - DNA, 25 bp, Rattus norvegicus
agtaattttgcctctgttctgcctg

SEQ ID NO: 154983 - DNA, 25 bp, Rattus norvegicus
agtaatttttatagcactttcaata

SEQ ID NO: 154984 - DNA, 25 bp, Rattus norvegicus
agtaatttttattgcactttcaata

SEQ ID NO: 154985 - DNA, 25 bp, Rattus norvegicus
agtacaaagccacggtttaagcaat

SEQ ID NO: 154986 - DNA, 25 bp, Rattus norvegicus
agtacaaagccagggtttaagcaat

SEQ ID NO: 154987 - DNA, 25 bp, Rattus norvegicus
agtacaacaccccaatcagcatgta

SEQ ID NO: 154988 - DNA, 25 bp, Rattus norvegicus
agtacaacacccgaatcagcatgta

SEQ ID NO: 154989 - DNA, 25 bp, Rattus norvegicus
agtacaacagccacctctatgggac

SEQ ID NO: 154990 - DNA, 25 bp, Rattus norvegicus
agtacaacagcctcctctatgggac

SEQ ID NO: 154991 - DNA, 25 bp, Rattus norvegicus
agtacaacatgcagtggcatgctgg

SEQ ID NO: 154992 - DNA, 25 bp, Rattus norvegicus
agtacaacatgctgtggcatgctgg

SEQ ID NO: 154993 - DNA, 25 bp, Rattus norvegicus
agtacaacccttcgcaagaaagatg

SEQ ID NO: 154994 - DNA, 25 bp, Rattus norvegicus
agtacaacccttggcaagaaagatg

SEQ ID NO: 154995 - DNA, 25 bp, Rattus norvegicus
agtacaacgagcagcttcattccct

SEQ ID NO: 154996 - DNA, 25 bp, Rattus norvegicus
agtacaacgagctgcttcattccct

SEQ ID NO: 154997 - DNA, 25 bp, Rattus norvegicus
agtacaacttcacatgcgatcgctg

SEQ ID NO: 154998 - DNA, 25 bp, Rattus norvegicus
agtacaacttcagatgcgatcgctg

SEQ ID NO: 154999 - DNA, 25 bp, Rattus norvegicus
agtacaagaggccacatctacaagt

SEQ ID NO: 155000 - DNA, 25 bp, Rattus norvegicus
agtacaagaggcgacatctacaagt

SEQ ID NO: 155001 - DNA, 25 bp, Rattus norvegicus
agtacaagcgccagttatccagcag

SEQ ID NO: 155002 - DNA, 25 bp, Rattus norvegicus
agtacaagcgcctgttatccagcag

SEQ ID NO: 155003 - DNA, 25 bp, Rattus norvegicus
agtacaagctcaagtgctcgcactt

SEQ ID NO: 155004 - DNA, 25 bp, Rattus norvegicus
agtacaagctcatgtgctcgcactt

SEQ ID NO: 155005 - DNA, 25 bp, Rattus norvegicus
agtacaaggtgaccatgctgctgtg

SEQ ID NO: 155006 - DNA, 25 bp, Rattus norvegicus
agtacaaggtgagcatgctgctgtg

SEQ ID NO: 155007 - DNA, 25 bp, Rattus norvegicus
agtacaagtaagcacacacacaccc

SEQ ID NO: 155008 - DNA, 25 bp, Rattus norvegicus
agtacaagtaaggacacacacaccc

SEQ ID NO: 155009 - DNA, 25 bp, Rattus norvegicus
agtacaagtgtacctcttcagccaa

SEQ ID NO: 155010 - DNA, 25 bp, Rattus norvegicus
agtacaagtgtagctcttcagccaa

SEQ ID NO: 155011 - DNA, 25 bp, Rattus norvegicus
agtacaatctacagtgagcaccgaa

SEQ ID NO: 155012 - DNA, 25 bp, Rattus norvegicus
agtacaatctactgtgagcaccgaa

SEQ ID NO: 155013 - DNA, 25 bp, Rattus norvegicus
agtacaatcttacctttcgctgaag

SEQ ID NO: 155014 - DNA, 25 bp, Rattus norvegicus
agtacaatcttagctttcgctgaag

SEQ ID NO: 155015 - DNA, 25 bp, Rattus norvegicus
agtacaatgagcaccacatgcctgt

SEQ ID NO: 155016 - DNA, 25 bp, Rattus norvegicus
agtacaatgagctccacatgcctgt

SEQ ID NO: 155017 - DNA, 25 bp, Rattus norvegicus
agtacaatgtagacagcgctcccct

SEQ ID NO: 155018 - DNA, 25 bp, Rattus norvegicus
agtacaatgtagtcagcgctcccct

SEQ ID NO: 155019 - DNA, 25 bp, Rattus norvegicus
agtacaatgtgcacccagaacaagg

SEQ ID NO: 155020 - DNA, 25 bp, Rattus norvegicus
agtacaatgtgctcccagaacaagg

SEQ ID NO: 155021 - DNA, 25 bp, Rattus norvegicus
agtacaatgttgctctccattcctg

SEQ ID NO: 155022 - DNA, 25 bp, Rattus norvegicus
agtacaatgttggtctccattcctg

SEQ ID NO: 155023 - DNA, 25 bp, Rattus norvegicus
agtacacaatccaaatatgactcag

SEQ ID NO: 155024 - DNA, 25 bp, Rattus norvegicus
agtacacaatcctaatatgactcag

SEQ ID NO: 155025 - DNA, 25 bp, Rattus norvegicus
agtacacaccctagccttctggatc

SEQ ID NO: 155026 - DNA, 25 bp, Rattus norvegicus
agtacacacccttgccttctggatc

SEQ ID NO: 155027 - DNA, 25 bp, Rattus norvegicus
agtacacagcgacagcctctggcga

SEQ ID NO: 155028 - DNA, 25 bp, Rattus norvegicus
agtacacagcgagagcctctggcga

SEQ ID NO: 155029 - DNA, 25 bp, Rattus norvegicus
agtacacagcttccgtctttaagga

SEQ ID NO: 155030 - DNA, 25 bp, Rattus norvegicus
agtacacagcttgcgtctttaagga

SEQ ID NO: 155031 - DNA, 25 bp, Rattus norvegicus
agtacacatcctaaatcctggcact

SEQ ID NO: 155032 - DNA, 25 bp, Rattus norvegicus
agtacacatccttaatcctggcact

SEQ ID NO: 155033 - DNA, 25 bp, Rattus norvegicus
agtacacatgtgactcccaaagcat

SEQ ID NO: 155034 - DNA, 25 bp, Rattus norvegicus
agtacacatgtgtctcccaaagcat

SEQ ID NO: 155035 - DNA, 25 bp, Rattus norvegicus
agtacacattgtctgttgcttccta

SEQ ID NO: 155036 - DNA, 25 bp, Rattus norvegicus
agtacacattgtgtgttgcttccta

SEQ ID NO: 155037 - DNA, 25 bp, Rattus norvegicus
agtacaccgaatctattgcttcccc

SEQ ID NO: 155038 - DNA, 25 bp, Rattus norvegicus
agtacaccgaatgtattgcttcccc

SEQ ID NO: 155039 - DNA, 25 bp, Rattus norvegicus
agtacaccgacaccttcaatgacac

SEQ ID NO: 155040 - DNA, 25 bp, Rattus norvegicus
agtacaccgacagcttcaatgacac

SEQ ID NO: 155041 - DNA, 25 bp, Rattus norvegicus
agtacaccgatcaagccgaggctga

SEQ ID NO: 155042 - DNA, 25 bp, Rattus norvegicus
agtacaccgatctagccgaggctga

SEQ ID NO: 155043 - DNA, 25 bp, Rattus norvegicus
agtacacctgtgaaggttcacgccg

SEQ ID NO: 155044 - DNA, 25 bp, Rattus norvegicus
agtacacctgtgtaggttcacgccg

SEQ ID NO: 155045 - DNA, 25 bp, Rattus norvegicus
agtacaccttatcgccggtcgcttt

SEQ ID NO: 155046 - DNA, 25 bp, Rattus norvegicus
agtacaccttatggccggtcgcttt

SEQ ID NO: 155047 - DNA, 25 bp, Rattus norvegicus
agtacacgaagaacttggcagtcat

SEQ ID NO: 155048 - DNA, 25 bp, Rattus norvegicus
agtacacgaagatcttggcagtcat

SEQ ID NO: 155049 - DNA, 25 bp, Rattus norvegicus
agtacacgtctgattctggcaagga

SEQ ID NO: 155050 - DNA, 25 bp, Rattus norvegicus
agtacacgtctgtttctggcaagga

SEQ ID NO: 155051 - DNA, 25 bp, Rattus norvegicus
agtacacgtgggatccagacaccct

SEQ ID NO: 155052 - DNA, 25 bp, Rattus norvegicus
agtacacgtgggttccagacaccct

SEQ ID NO: 155053 - DNA, 25 bp, Rattus norvegicus
agtacacgttttatgcagaaggctc

SEQ ID NO: 155054 - DNA, 25 bp, Rattus norvegicus
agtacacgttttttgcagaaggctc

SEQ ID NO: 155055 - DNA, 25 bp, Rattus norvegicus
agtacactccctctgcttgagcggc

SEQ ID NO: 155056 - DNA, 25 bp, Rattus norvegicus
agtacactccctgtgcttgagcggc

SEQ ID NO: 155057 - DNA, 25 bp, Rattus norvegicus
agtacactcctcattattattccat

SEQ ID NO: 155058 - DNA, 25 bp, Rattus norvegicus
agtacactcctctttattattccat

SEQ ID NO: 155059 - DNA, 25 bp, Rattus norvegicus
agtacactcctgattggacctgaga

SEQ ID NO: 155060 - DNA, 25 bp, Rattus norvegicus
agtacactcctgtttggacctgaga

SEQ ID NO: 155061 - DNA, 25 bp, Rattus norvegicus
agtacactctataaaatctcaggat

SEQ ID NO: 155062 - DNA, 25 bp, Rattus norvegicus
agtacactctattaaatctcaggat

SEQ ID NO: 155063 - DNA, 25 bp, Rattus norvegicus
agtacactctctcctttgtgctttg

SEQ ID NO: 155064 - DNA, 25 bp, Rattus norvegicus
agtacactctctgctttgtgctttg

SEQ ID NO: 155065 - DNA, 25 bp, Rattus norvegicus
agtacactgaagaccaagccacctc

SEQ ID NO: 155066 - DNA, 25 bp, Rattus norvegicus
agtacactgaagtccaagccacctc

SEQ ID NO: 155067 - DNA, 25 bp, Rattus norvegicus
agtacactgttccatgtggttctcc

SEQ ID NO: 155068 - DNA, 25 bp, Rattus norvegicus
agtacactgttcgatgtggttctcc

SEQ ID NO: 155069 - DNA, 25 bp, Rattus norvegicus
agtacacttgccatgtccgaagccc

SEQ ID NO: 155070 - DNA, 25 bp, Rattus norvegicus
agtacacttgccttgtccgaagccc

SEQ ID NO: 155071 - DNA, 25 bp, Rattus norvegicus
agtacacttgctccttctgtggcaa

SEQ ID NO: 155072 - DNA, 25 bp, Rattus norvegicus
agtacacttgctgcttctgtggcaa

SEQ ID NO: 155073 - DNA, 25 bp, Rattus norvegicus
agtacagaaagcacccagacttctc

SEQ ID NO: 155074 - DNA, 25 bp, Rattus norvegicus
agtacagaaagctcccagacttctc

SEQ ID NO: 155075 - DNA, 25 bp, Rattus norvegicus
agtacagacagtcatgagatgccat

SEQ ID NO: 155076 - DNA, 25 bp, Rattus norvegicus
agtacagacagtgatgagatgccat

SEQ ID NO: 155077 - DNA, 25 bp, Rattus norvegicus
agtacagaccgtacaccgtgtatct

SEQ ID NO: 155078 - DNA, 25 bp, Rattus norvegicus
agtacagaccgttcaccgtgtatct

SEQ ID NO: 155079 - DNA, 25 bp, Rattus norvegicus
agtacagactggagtcctggctgat

SEQ ID NO: 155080 - DNA, 25 bp, Rattus norvegicus
agtacagactggtgtcctggctgat

SEQ ID NO: 155081 - DNA, 25 bp, Rattus norvegicus
agtacagacttgacagcaccttggc

SEQ ID NO: 155082 - DNA, 25 bp, Rattus norvegicus
agtacagacttgtcagcaccttggc

SEQ ID NO: 155083 - DNA, 25 bp, Rattus norvegicus
agtacagagcacctctatcaagttg

SEQ ID NO: 155084 - DNA, 25 bp, Rattus norvegicus
agtacagagcacgtctatcaagttg

SEQ ID NO: 155085 - DNA, 25 bp, Rattus norvegicus
agtacagatccgcttcctacagctg

SEQ ID NO: 155086 - DNA, 25 bp, Rattus norvegicus
agtacagatccggttcctacagctg

SEQ ID NO: 155087 - DNA, 25 bp, Rattus norvegicus
agtacagattttcctgttccaggac

SEQ ID NO: 155088 - DNA, 25 bp, Rattus norvegicus
agtacagattttgctgttccaggac

SEQ ID NO: 155089 - DNA, 25 bp, Rattus norvegicus
agtacagcagcaatccaggtcagta

SEQ ID NO: 155090 - DNA, 25 bp, Rattus norvegicus
agtacagcagcattccaggtcagta

SEQ ID NO: 155091 - DNA, 25 bp, Rattus norvegicus
agtacagcatgaagagaatcccaga

SEQ ID NO: 155092 - DNA, 25 bp, Rattus norvegicus
agtacagcatgatgagaatcccaga

SEQ ID NO: 155093 - DNA, 25 bp, Rattus norvegicus
agtacagcgaggaccagcaggccat

SEQ ID NO: 155094 - DNA, 25 bp, Rattus norvegicus
agtacagcgaggtccagcaggccat

SEQ ID NO: 155095 - DNA, 25 bp, Rattus norvegicus
agtacagcgtaacccactcagcatg

SEQ ID NO: 155096 - DNA, 25 bp, Rattus norvegicus
agtacagcgtaagccactcagcatg

SEQ ID NO: 155097 - DNA, 25 bp, Rattus norvegicus
agtacagctacgacgatggctcttg

SEQ ID NO: 155098 - DNA, 25 bp, Rattus norvegicus
agtacagctacgtcgatggctcttg

SEQ ID NO: 155099 - DNA, 25 bp, Rattus norvegicus
agtacagctggacgcagctcctgta

SEQ ID NO: 155100 - DNA, 25 bp, Rattus norvegicus
agtacagctggaggcagctcctgta

SEQ ID NO: 155101 - DNA, 25 bp, Rattus norvegicus
agtacagctgttcctccaggcaggg

SEQ ID NO: 155102 - DNA, 25 bp, Rattus norvegicus
agtacagctgttgctccaggcaggg

SEQ ID NO: 155103 - DNA, 25 bp, Rattus norvegicus
agtacagctttcaagcaaccttctg

SEQ ID NO: 155104 - DNA, 25 bp, Rattus norvegicus
agtacagctttctagcaaccttctg

SEQ ID NO: 155105 - DNA, 25 bp, Rattus norvegicus
agtacaggatgaccctgcatttttt

SEQ ID NO: 155106 - DNA, 25 bp, Rattus norvegicus
agtacaggatgagcctgcatttttt

SEQ ID NO: 155107 - DNA, 25 bp, Rattus norvegicus
agtacaggctctagtgcaggtctga

SEQ ID NO: 155108 - DNA, 25 bp, Rattus norvegicus
agtacaggctcttgtgcaggtctga

SEQ ID NO: 155109 - DNA, 25 bp, Rattus norvegicus
agtacagggattacatgtgctcacc

SEQ ID NO: 155110 - DNA, 25 bp, Rattus norvegicus
agtacagggatttcatgtgctcacc

SEQ ID NO: 155111 - DNA, 25 bp, Rattus norvegicus
agtacagtacgcctgtgcttcagtt

SEQ ID NO: 155112 - DNA, 25 bp, Rattus norvegicus
agtacagtacgcgtgtgcttcagtt

SEQ ID NO: 155113 - DNA, 25 bp, Rattus norvegicus
agtacagtcagcaaggctctggtga

SEQ ID NO: 155114 - DNA, 25 bp, Rattus norvegicus
agtacagtcagctaggctctggtga

SEQ ID NO: 155115 - DNA, 25 bp, Rattus norvegicus
agtacagtcatgatgtgcctcttgc

SEQ ID NO: 155116 - DNA, 25 bp, Rattus norvegicus
agtacagtcatgttgtgcctcttgc

SEQ ID NO: 155117 - DNA, 25 bp, Rattus norvegicus
agtacagtctgtacccagttctgtt

SEQ ID NO: 155118 - DNA, 25 bp, Rattus norvegicus
agtacagtctgttcccagttctgtt

SEQ ID NO: 155119 - DNA, 25 bp, Rattus norvegicus
agtacagtgcctcccagatgaagct

SEQ ID NO: 155120 - DNA, 25 bp, Rattus norvegicus
agtacagtgcctgccagatgaagct

SEQ ID NO: 155121 - DNA, 25 bp, Rattus norvegicus
agtacagtgctgctttctgacagag

SEQ ID NO: 155122 - DNA, 25 bp, Rattus norvegicus
agtacagtgctggtttctgacagag

SEQ ID NO: 155123 - DNA, 25 bp, Rattus norvegicus
agtacagttctgagtggcctgctat

SEQ ID NO: 155124 - DNA, 25 bp, Rattus norvegicus
agtacagttctgtgtggcctgctat

SEQ ID NO: 155125 - DNA, 25 bp, Rattus norvegicus
agtacatatagacgtctccagccag

SEQ ID NO: 155126 - DNA, 25 bp, Rattus norvegicus
agtacatatagaggtctccagccag

SEQ ID NO: 155127 - DNA, 25 bp, Rattus norvegicus
agtacatcaagtatctttggtgaaa

SEQ ID NO: 155128 - DNA, 25 bp, Rattus norvegicus
agtacatcaagtttctttggtgaaa

SEQ ID NO: 155129 - DNA, 25 bp, Rattus norvegicus
agtacatcccctaggaccagataga

SEQ ID NO: 155130 - DNA, 25 bp, Rattus norvegicus
agtacatccccttggaccagataga

SEQ ID NO: 155131 - DNA, 25 bp, Rattus norvegicus
agtacatccctcaagtgaagccaaa

SEQ ID NO: 155132 - DNA, 25 bp, Rattus norvegicus
agtacatccctctagtgaagccaaa

SEQ ID NO: 155133 - DNA, 25 bp, Rattus norvegicus
agtacatctctcctaggcatcatct

SEQ ID NO: 155134 - DNA, 25 bp, Rattus norvegicus
agtacatctctcgtaggcatcatct

SEQ ID NO: 155135 - DNA, 25 bp, Rattus norvegicus
agtacatctgagacaaccccaggca

SEQ ID NO: 155136 - DNA, 25 bp, Rattus norvegicus
agtacatctgagtcaaccccaggca

SEQ ID NO: 155137 - DNA, 25 bp, Rattus norvegicus
agtacatcttctaacaccagtgcat

SEQ ID NO: 155138 - DNA, 25 bp, Rattus norvegicus
agtacatcttcttacaccagtgcat

SEQ ID NO: 155139 - DNA, 25 bp, Rattus norvegicus
agtacatgattcctcagtgtggatc

SEQ ID NO: 155140 - DNA, 25 bp, Rattus norvegicus
agtacatgattcgtcagtgtggatc

SEQ ID NO: 155141 - DNA, 25 bp, Rattus norvegicus
agtacatgcggtcctactcggcgag

SEQ ID NO: 155142 - DNA, 25 bp, Rattus norvegicus
agtacatgcggtgctactcggcgag

SEQ ID NO: 155143 - DNA, 25 bp, Rattus norvegicus
agtacatgcgtgaggtcaccaccat

SEQ ID NO: 155144 - DNA, 25 bp, Rattus norvegicus
agtacatgcgtgtggtcaccaccat

SEQ ID NO: 155145 - DNA, 25 bp, Rattus norvegicus
agtacatggagcctgcatcttcctg

SEQ ID NO: 155146 - DNA, 25 bp, Rattus norvegicus
agtacatggagcgtgcatcttcctg

SEQ ID NO: 155147 - DNA, 25 bp, Rattus norvegicus
agtacatgtctgcatatcttaggtc

SEQ ID NO: 155148 - DNA, 25 bp, Rattus norvegicus
agtacatgtctggatatcttaggtc

SEQ ID NO: 155149 - DNA, 25 bp, Rattus norvegicus
agtacattacaactggttagtgcca

SEQ ID NO: 155150 - DNA, 25 bp, Rattus norvegicus
agtacattacaagtggttagtgcca

SEQ ID NO: 155151 - DNA, 25 bp, Rattus norvegicus
agtacattacctcttcgtcaagtca

SEQ ID NO: 155152 - DNA, 25 bp, Rattus norvegicus
agtacattacctgttcgtcaagtca

SEQ ID NO: 155153 - DNA, 25 bp, Rattus norvegicus
agtacattagtacacggccatccta

SEQ ID NO: 155154 - DNA, 25 bp, Rattus norvegicus
agtacattagtagacggccatccta

SEQ ID NO: 155155 - DNA, 25 bp, Rattus norvegicus
agtacattagttatccactcctcat

SEQ ID NO: 155156 - DNA, 25 bp, Rattus norvegicus
agtacattagttttccactcctcat

SEQ ID NO: 155157 - DNA, 25 bp, Rattus norvegicus
agtacattatacactctggatggga

SEQ ID NO: 155158 - DNA, 25 bp, Rattus norvegicus
agtacattatactctctggatggga

SEQ ID NO: 155159 - DNA, 25 bp, Rattus norvegicus
agtacattatatactttcaagtgct

SEQ ID NO: 155160 - DNA, 25 bp, Rattus norvegicus
agtacattatattctttcaagtgct

SEQ ID NO: 155161 - DNA, 25 bp, Rattus norvegicus
agtacattcaacagctttcctcata

SEQ ID NO: 155162 - DNA, 25 bp, Rattus norvegicus
agtacattcaactgctttcctcata

SEQ ID NO: 155163 - DNA, 25 bp, Rattus norvegicus
agtacattgtctcttccttgaggga

SEQ ID NO: 155164 - DNA, 25 bp, Rattus norvegicus
agtacattgtctgttccttgaggga

SEQ ID NO: 155165 - DNA, 25 bp, Rattus norvegicus
agtacatttctgagcaggctagccc

SEQ ID NO: 155166 - DNA, 25 bp, Rattus norvegicus
agtacatttctgtgcaggctagccc

SEQ ID NO: 155167 - DNA, 25 bp, Rattus norvegicus
agtacatttgcaaaccagcctttca

SEQ ID NO: 155168 - DNA, 25 bp, Rattus norvegicus
agtacatttgcataccagcctttca

SEQ ID NO: 155169 - DNA, 25 bp, Rattus norvegicus
agtacatttgttaatattagatcac

SEQ ID NO: 155170 - DNA, 25 bp, Rattus norvegicus
agtacatttgtttatattagatcac

SEQ ID NO: 155171 - DNA, 25 bp, Rattus norvegicus
agtaccaaagtgcactcttcaatgt

SEQ ID NO: 155172 - DNA, 25 bp, Rattus norvegicus
agtaccaaagtggactcttcaatgt

SEQ ID NO: 155173 - DNA, 25 bp, Rattus norvegicus
agtaccaagtcaccctgcatgctgc

SEQ ID NO: 155174 - DNA, 25 bp, Rattus norvegicus
agtaccaagtcactgttgcctcatc

SEQ ID NO: 155175 - DNA, 25 bp, Rattus norvegicus
agtaccaagtcagcctgcatgctgc

SEQ ID NO: 155176 - DNA, 25 bp, Rattus norvegicus
agtaccaagtcagtgttgcctcatc

SEQ ID NO: 155177 - DNA, 25 bp, Rattus norvegicus
agtaccaagtgcattgctctgaggc

SEQ ID NO: 155178 - DNA, 25 bp, Rattus norvegicus
agtaccaagtgctttgctctgaggc

SEQ ID NO: 155179 - DNA, 25 bp, Rattus norvegicus
agtaccaatgccaatgagcccaaag

SEQ ID NO: 155180 - DNA, 25 bp, Rattus norvegicus
agtaccaatgcctatgagcccaaag

SEQ ID NO: 155181 - DNA, 25 bp, Rattus norvegicus
agtaccaattgaactgggcctcgtc

SEQ ID NO: 155182 - DNA, 25 bp, Rattus norvegicus
agtaccaattgatctgggcctcgtc

SEQ ID NO: 155183 - DNA, 25 bp, Rattus norvegicus
agtaccaccctaacctgtgtagata

SEQ ID NO: 155184 - DNA, 25 bp, Rattus norvegicus
agtaccaccctatcctgtgtagata

SEQ ID NO: 155185 - DNA, 25 bp, Rattus norvegicus
agtaccacccttcaagctggagttg

SEQ ID NO: 155186 - DNA, 25 bp, Rattus norvegicus
agtaccacccttgaagctggagttg

SEQ ID NO: 155187 - DNA, 25 bp, Rattus norvegicus
agtaccacctacaatagccactaag

SEQ ID NO: 155188 - DNA, 25 bp, Rattus norvegicus
agtaccacctactatagccactaag

SEQ ID NO: 155189 - DNA, 25 bp, Rattus norvegicus
agtaccacctgtctggagacccaca

SEQ ID NO: 155190 - DNA, 25 bp, Rattus norvegicus
agtaccacctgtgtggagacccaca

SEQ ID NO: 155191 - DNA, 25 bp, Rattus norvegicus
agtaccactcctaggacgtgattgg

SEQ ID NO: 155192 - DNA, 25 bp, Rattus norvegicus
agtaccactcctagtgctgtgacta

SEQ ID NO: 155193 - DNA, 25 bp, Rattus norvegicus
agtaccactccttggacgtgattgg

SEQ ID NO: 155194 - DNA, 25 bp, Rattus norvegicus
agtaccactccttgtgctgtgacta

SEQ ID NO: 155195 - DNA, 25 bp, Rattus norvegicus
agtaccactgagcaagccgctgtct

SEQ ID NO: 155196 - DNA, 25 bp, Rattus norvegicus
agtaccactgaggaagccgctgtct

SEQ ID NO: 155197 - DNA, 25 bp, Rattus norvegicus
agtaccactgggaatcagccttcat

SEQ ID NO: 155198 - DNA, 25 bp, Rattus norvegicus
agtaccactgggtatcagccttcat

SEQ ID NO: 155199 - DNA, 25 bp, Rattus norvegicus
agtaccactgttagtatcttaaaga

SEQ ID NO: 155200 - DNA, 25 bp, Rattus norvegicus
agtaccactgtttgtatcttaaaga

SEQ ID NO: 155201 - DNA, 25 bp, Rattus norvegicus
agtaccacttctcagagcggcagat

SEQ ID NO: 155202 - DNA, 25 bp, Rattus norvegicus
agtaccacttctgagagcggcagat

SEQ ID NO: 155203 - DNA, 25 bp, Rattus norvegicus
agtaccagaagtccctgctattgca

SEQ ID NO: 155204 - DNA, 25 bp, Rattus norvegicus
agtaccagaagtgcctgctattgca

SEQ ID NO: 155205 - DNA, 25 bp, Rattus norvegicus
agtaccagctcccttgacaagtgtg

SEQ ID NO: 155206 - DNA, 25 bp, Rattus norvegicus
agtaccagctccgttgacaagtgtg

SEQ ID NO: 155207 - DNA, 25 bp, Rattus norvegicus
agtaccaggacacccgagagaccct

SEQ ID NO: 155208 - DNA, 25 bp, Rattus norvegicus
agtaccaggacagccgagagaccct

SEQ ID NO: 155209 - DNA, 25 bp, Rattus norvegicus
agtaccaggattactttaggctaat

SEQ ID NO: 155210 - DNA, 25 bp, Rattus norvegicus
agtaccaggatttctttaggctaat

SEQ ID NO: 155211 - DNA, 25 bp, Rattus norvegicus
agtaccaggcagagacagctactct

SEQ ID NO: 155212 - DNA, 25 bp, Rattus norvegicus
agtaccaggcagtgacagctactct

SEQ ID NO: 155213 - DNA, 25 bp, Rattus norvegicus
agtaccaggccactgcgttcgggaa

SEQ ID NO: 155214 - DNA, 25 bp, Rattus norvegicus
agtaccaggccagtgcgttcgggaa

SEQ ID NO: 155215 - DNA, 25 bp, Rattus norvegicus
agtaccagggcccagtgcacttcgc

SEQ ID NO: 155216 - DNA, 25 bp, Rattus norvegicus
agtaccagggccgagtgcacttcgc

SEQ ID NO: 155217 - DNA, 25 bp, Rattus norvegicus
agtaccaggtctaccagtacacggg

SEQ ID NO: 155218 - DNA, 25 bp, Rattus norvegicus
agtaccaggtcttccagtacacggg

SEQ ID NO: 155219 - DNA, 25 bp, Rattus norvegicus
agtaccagtcagaattctccatgag

SEQ ID NO: 155220 - DNA, 25 bp, Rattus norvegicus
agtaccagtcagtattctccatgag

SEQ ID NO: 155221 - DNA, 25 bp, Rattus norvegicus
agtaccatcgccatcagagcaaggt

SEQ ID NO: 155222 - DNA, 25 bp, Rattus norvegicus
agtaccatcgccttcagagcaaggt

SEQ ID NO: 155223 - DNA, 25 bp, Rattus norvegicus
agtaccatcgggacctgggaagttg

SEQ ID NO: 155224 - DNA, 25 bp, Rattus norvegicus
agtaccatcgggtcctgggaagttg

SEQ ID NO: 155225 - DNA, 25 bp, Rattus norvegicus
agtaccatgcaaagtgccagctctg

SEQ ID NO: 155226 - DNA, 25 bp, Rattus norvegicus
agtaccatgcaatgtgccagctctg

SEQ ID NO: 155227 - DNA, 25 bp, Rattus norvegicus
agtaccatgctcacagagcctcggg

SEQ ID NO: 155228 - DNA, 25 bp, Rattus norvegicus
agtaccatgctctcagagcctcggg

SEQ ID NO: 155229 - DNA, 25 bp, Rattus norvegicus
agtaccatgttgcatgtggcttcct

SEQ ID NO: 155230 - DNA, 25 bp, Rattus norvegicus
agtaccatgttggatgtggcttcct

SEQ ID NO: 155231 - DNA, 25 bp, Rattus norvegicus
agtaccattcacctggctggatgag

SEQ ID NO: 155232 - DNA, 25 bp, Rattus norvegicus
agtaccattcacgtggctggatgag

SEQ ID NO: 155233 - DNA, 25 bp, Rattus norvegicus
agtaccattttccacaaactcactg

SEQ ID NO: 155234 - DNA, 25 bp, Rattus norvegicus
agtaccattttcgacaaactcactg

SEQ ID NO: 155235 - DNA, 25 bp, Rattus norvegicus
agtaccatttttcctgtcccattag

SEQ ID NO: 155236 - DNA, 25 bp, Rattus norvegicus
agtaccatttttgctgtcccattag

SEQ ID NO: 155237 - DNA, 25 bp, Rattus norvegicus
agtacccaactcacagtgtgggagt

SEQ ID NO: 155238 - DNA, 25 bp, Rattus norvegicus
agtacccaactctcagtgtgggagt

SEQ ID NO: 155239 - DNA, 25 bp, Rattus norvegicus
agtacccaaggtccccagatgaaat

SEQ ID NO: 155240 - DNA, 25 bp, Rattus norvegicus
agtacccaaggtgcccagatgaaat

SEQ ID NO: 155241 - DNA, 25 bp, Rattus norvegicus
agtacccacataaagagccttgaag

SEQ ID NO: 155242 - DNA, 25 bp, Rattus norvegicus
agtacccacataacgagtcaggaat

SEQ ID NO: 155243 - DNA, 25 bp, Rattus norvegicus
agtacccacatatagagccttgaag

SEQ ID NO: 155244 - DNA, 25 bp, Rattus norvegicus
agtacccacatatcgagtcaggaat

SEQ ID NO: 155245 - DNA, 25 bp, Rattus norvegicus
agtacccaccaaagatgtccagttc

SEQ ID NO: 155246 - DNA, 25 bp, Rattus norvegicus
agtacccaccaatgatgtccagttc

SEQ ID NO: 155247 - DNA, 25 bp, Rattus norvegicus
agtacccagctgactacgctaagat

SEQ ID NO: 155248 - DNA, 25 bp, Rattus norvegicus
agtacccagctgtctacgctaagat

SEQ ID NO: 155249 - DNA, 25 bp, Rattus norvegicus
agtacccagggcagcttgctagcac

SEQ ID NO: 155250 - DNA, 25 bp, Rattus norvegicus
agtacccagggctgcttgctagcac

SEQ ID NO: 155251 - DNA, 25 bp, Rattus norvegicus
agtacccatcgtatttagtgctcac

SEQ ID NO: 155252 - DNA, 25 bp, Rattus norvegicus
agtacccatcgtttttagtgctcac

SEQ ID NO: 155253 - DNA, 25 bp, Rattus norvegicus
agtacccatggtccttgaattgaaa

SEQ ID NO: 155254 - DNA, 25 bp, Rattus norvegicus
agtacccatggtgcttgaattgaaa

SEQ ID NO: 155255 - DNA, 25 bp, Rattus norvegicus
agtacccatgttcaatacccgtgtg

SEQ ID NO: 155256 - DNA, 25 bp, Rattus norvegicus
agtacccatgttgaatacccgtgtg

SEQ ID NO: 155257 - DNA, 25 bp, Rattus norvegicus
agtaccccaactaggcagggaagag

SEQ ID NO: 155258 - DNA, 25 bp, Rattus norvegicus
agtaccccaacttggcagggaagag

SEQ ID NO: 155259 - DNA, 25 bp, Rattus norvegicus
agtaccccgtccagagcactgtgag

SEQ ID NO: 155260 - DNA, 25 bp, Rattus norvegicus
agtaccccgtcctgagcactgtgag

SEQ ID NO: 155261 - DNA, 25 bp, Rattus norvegicus
agtacccgtaccagaggctggtctg

SEQ ID NO: 155262 - DNA, 25 bp, Rattus norvegicus
agtacccgtacctgaggctggtctg

SEQ ID NO: 155263 - DNA, 25 bp, Rattus norvegicus
agtacccgtataatcctgcacatat

SEQ ID NO: 155264 - DNA, 25 bp, Rattus norvegicus
agtacccgtatattcctgcacatat

SEQ ID NO: 155265 - DNA, 25 bp, Rattus norvegicus
agtacccgtcggcatcatgaaggct

SEQ ID NO: 155266 - DNA, 25 bp, Rattus norvegicus
agtacccgtcgggatcatgaaggct

SEQ ID NO: 155267 - DNA, 25 bp, Rattus norvegicus
agtaccctactgctcttcaaaggag

SEQ ID NO: 155268 - DNA, 25 bp, Rattus norvegicus
agtaccctactggtcttcaaaggag

SEQ ID NO: 155269 - DNA, 25 bp, Rattus norvegicus
agtaccctcaacagataccactgac

SEQ ID NO: 155270 - DNA, 25 bp, Rattus norvegicus
agtaccctcaactgataccactgac

SEQ ID NO: 155271 - DNA, 25 bp, Rattus norvegicus
agtaccctcgctagttctgctggac

SEQ ID NO: 155272 - DNA, 25 bp, Rattus norvegicus
agtaccctcgcttgttctgctggac

SEQ ID NO: 155273 - DNA, 25 bp, Rattus norvegicus
agtaccctctacagactaacagtga

SEQ ID NO: 155274 - DNA, 25 bp, Rattus norvegicus
agtaccctctactgactaacagtga

SEQ ID NO: 155275 - DNA, 25 bp, Rattus norvegicus
agtaccctgccaccacaggaggtga

SEQ ID NO: 155276 - DNA, 25 bp, Rattus norvegicus
agtaccctgccagcacaggaggtga

SEQ ID NO: 155277 - DNA, 25 bp, Rattus norvegicus
agtaccctttagagtgtgtgcctga

SEQ ID NO: 155278 - DNA, 25 bp, Rattus norvegicus
agtaccctttagtgtgtgtgcctga

SEQ ID NO: 155279 - DNA, 25 bp, Rattus norvegicus
agtaccctttctaagcagcagcaag

SEQ ID NO: 155280 - DNA, 25 bp, Rattus norvegicus
agtaccctttcttagcagcagcaag

SEQ ID NO: 155281 - DNA, 25 bp, Rattus norvegicus
agtaccgatccaatttattgctgag

SEQ ID NO: 155282 - DNA, 25 bp, Rattus norvegicus
agtaccgatccattttattgctgag

SEQ ID NO: 155283 - DNA, 25 bp, Rattus norvegicus
agtaccgcctagatggacctgggca

SEQ ID NO: 155284 - DNA, 25 bp, Rattus norvegicus
agtaccgcctagttggacctgggca

SEQ ID NO: 155285 - DNA, 25 bp, Rattus norvegicus
agtaccgctactacagaggctgctt

SEQ ID NO: 155286 - DNA, 25 bp, Rattus norvegicus
agtaccgctacttcagaggctgctt

SEQ ID NO: 155287 - DNA, 25 bp, Rattus norvegicus
agtaccggcgatactcgcggtcgta

SEQ ID NO: 155288 - DNA, 25 bp, Rattus norvegicus
agtaccggcgattctcgcggtcgta

SEQ ID NO: 155289 - DNA, 25 bp, Rattus norvegicus
agtaccgggaggacgctgcttttgc

SEQ ID NO: 155290 - DNA, 25 bp, Rattus norvegicus
agtaccgggaggtcgctgcttttgc

SEQ ID NO: 155291 - DNA, 25 bp, Rattus norvegicus
agtaccgggagtaccacagactgta

SEQ ID NO: 155292 - DNA, 25 bp, Rattus norvegicus
agtaccgggagttccacagactgta

SEQ ID NO: 155293 - DNA, 25 bp, Rattus norvegicus
agtaccgggtggcagtgttcaaact

SEQ ID NO: 155294 - DNA, 25 bp, Rattus norvegicus
agtaccgggtgggagtgttcaaact

SEQ ID NO: 155295 - DNA, 25 bp, Rattus norvegicus
agtaccgtacttatttctgtggctg

SEQ ID NO: 155296 - DNA, 25 bp, Rattus norvegicus
agtaccgtacttttttctgtggctg

SEQ ID NO: 155297 - DNA, 25 bp, Rattus norvegicus
agtaccgtgactatgacattccagc

SEQ ID NO: 155298 - DNA, 25 bp, Rattus norvegicus
agtaccgtgactttgacattccagc

SEQ ID NO: 155299 - DNA, 25 bp, Rattus norvegicus
agtaccgtggtacgtgcacacctga

SEQ ID NO: 155300 - DNA, 25 bp, Rattus norvegicus
agtaccgtggtaggtgcacacctga

SEQ ID NO: 155301 - DNA, 25 bp, Rattus norvegicus
agtaccgtgtttatgtctcgcaaag

SEQ ID NO: 155302 - DNA, 25 bp, Rattus norvegicus
agtaccgtgtttttgtctcgcaaag

SEQ ID NO: 155303 - DNA, 25 bp, Rattus norvegicus
agtaccgtttgtctatagactgaca

SEQ ID NO: 155304 - DNA, 25 bp, Rattus norvegicus
agtaccgtttgtgtatagactgaca

SEQ ID NO: 155305 - DNA, 25 bp, Rattus norvegicus
agtacctaaattagacccacttgag

SEQ ID NO: 155306 - DNA, 25 bp, Rattus norvegicus
agtacctaaatttgacccacttgag

SEQ ID NO: 155307 - DNA, 25 bp, Rattus norvegicus
agtacctaccagcaattagcaccca

SEQ ID NO: 155308 - DNA, 25 bp, Rattus norvegicus
agtacctaccaggaattagcaccca

SEQ ID NO: 155309 - DNA, 25 bp, Rattus norvegicus
agtacctacctcattctgcagagga

SEQ ID NO: 155310 - DNA, 25 bp, Rattus norvegicus
agtacctacctctttctgcagagga

SEQ ID NO: 155311 - DNA, 25 bp, Rattus norvegicus
agtacctactttattgctgaatcca

SEQ ID NO: 155312 - DNA, 25 bp, Rattus norvegicus
agtacctacttttttgctgaatcca

SEQ ID NO: 155313 - DNA, 25 bp, Rattus norvegicus
agtacctagagtattcagtgcttag

SEQ ID NO: 155314 - DNA, 25 bp, Rattus norvegicus
agtacctagagttttcagtgcttag

SEQ ID NO: 155315 - DNA, 25 bp, Rattus norvegicus
agtacctagatcatctgcttaaccc

SEQ ID NO: 155316 - DNA, 25 bp, Rattus norvegicus
agtacctagatcttctgcttaaccc

SEQ ID NO: 155317 - DNA, 25 bp, Rattus norvegicus
agtacctatatgcatcttattttga

SEQ ID NO: 155318 - DNA, 25 bp, Rattus norvegicus
agtacctatatggatcttattttga

SEQ ID NO: 155319 - DNA, 25 bp, Rattus norvegicus
agtacctcaccaatggcatcatgtg

SEQ ID NO: 155320 - DNA, 25 bp, Rattus norvegicus
agtacctcaccattggcatcatgtg

SEQ ID NO: 155321 - DNA, 25 bp, Rattus norvegicus
agtacctcagtaccacagcacagag

SEQ ID NO: 155322 - DNA, 25 bp, Rattus norvegicus
agtacctcagtagcacagcacagag

SEQ ID NO: 155323 - DNA, 25 bp, Rattus norvegicus
agtacctcagtgcatggcctcatgg

SEQ ID NO: 155324 - DNA, 25 bp, Rattus norvegicus
agtacctcagtggatggcctcatgg

SEQ ID NO: 155325 - DNA, 25 bp, Rattus norvegicus
agtacctcattgaattctctattgt

SEQ ID NO: 155326 - DNA, 25 bp, Rattus norvegicus
agtacctcattgtattctctattgt

SEQ ID NO: 155327 - DNA, 25 bp, Rattus norvegicus
agtacctccagcactatagaaaccc

SEQ ID NO: 155328 - DNA, 25 bp, Rattus norvegicus
agtacctccagctctatagaaaccc

SEQ ID NO: 155329 - DNA, 25 bp, Rattus norvegicus
agtacctccataccgtgactagcaa

SEQ ID NO: 155330 - DNA, 25 bp, Rattus norvegicus
agtacctccatagcgtgactagcaa

SEQ ID NO: 155331 - DNA, 25 bp, Rattus norvegicus
agtacctccatcagattgcctatag

SEQ ID NO: 155332 - DNA, 25 bp, Rattus norvegicus
agtacctccatctgattgcctatag

SEQ ID NO: 155333 - DNA, 25 bp, Rattus norvegicus
agtacctcgtttaaattattgcctg

SEQ ID NO: 155334 - DNA, 25 bp, Rattus norvegicus
agtacctcgttttaattattgcctg

SEQ ID NO: 155335 - DNA, 25 bp, Rattus norvegicus
agtacctctcagagttctcgctgaa

SEQ ID NO: 155336 - DNA, 25 bp, Rattus norvegicus
agtacctctcagtgttctcgctgaa

SEQ ID NO: 155337 - DNA, 25 bp, Rattus norvegicus
agtacctcttctcaaagtgcacttt

SEQ ID NO: 155338 - DNA, 25 bp, Rattus norvegicus
agtacctcttctgaaagtgcacttt

SEQ ID NO: 155339 - DNA, 25 bp, Rattus norvegicus
agtacctctttgagctcccagagac

SEQ ID NO: 155340 - DNA, 25 bp, Rattus norvegicus
agtacctctttgtgctcccagagac

SEQ ID NO: 155341 - DNA, 25 bp, Rattus norvegicus
agtacctgaatcagtgtctcttcac

SEQ ID NO: 155342 - DNA, 25 bp, Rattus norvegicus
agtacctgaatctgtgtctcttcac

SEQ ID NO: 155343 - DNA, 25 bp, Rattus norvegicus
agtacctgaggtaggccttgtcttc

SEQ ID NO: 155344 - DNA, 25 bp, Rattus norvegicus
agtacctgaggtctgtggacatccc

SEQ ID NO: 155345 - DNA, 25 bp, Rattus norvegicus
agtacctgaggtgtgtggacatccc

SEQ ID NO: 155346 - DNA, 25 bp, Rattus norvegicus
agtacctgaggttggccttgtcttc

SEQ ID NO: 155347 - DNA, 25 bp, Rattus norvegicus
agtacctgatggagcggcgcttccc

SEQ ID NO: 155348 - DNA, 25 bp, Rattus norvegicus
agtacctgatggagctgaccctcgt

SEQ ID NO: 155349 - DNA, 25 bp, Rattus norvegicus
agtacctgatggtgcggcgcttccc

SEQ ID NO: 155350 - DNA, 25 bp, Rattus norvegicus
agtacctgatggtgctgaccctcgt

SEQ ID NO: 155351 - DNA, 25 bp, Rattus norvegicus
agtacctgccaaccatagaaacaca

SEQ ID NO: 155352 - DNA, 25 bp, Rattus norvegicus
agtacctgccaagcatagaaacaca

SEQ ID NO: 155353 - DNA, 25 bp, Rattus norvegicus
agtacctgccccactgtcatttggg

SEQ ID NO: 155354 - DNA, 25 bp, Rattus norvegicus
agtacctgcccctctgtcatttggg

SEQ ID NO: 155355 - DNA, 25 bp, Rattus norvegicus
agtacctggaatatgtctgccacgc

SEQ ID NO: 155356 - DNA, 25 bp, Rattus norvegicus
agtacctggaatttgtctgccacgc

SEQ ID NO: 155357 - DNA, 25 bp, Rattus norvegicus
agtacctggtctcagtcatgggtcc

SEQ ID NO: 155358 - DNA, 25 bp, Rattus norvegicus
agtacctggtctgagtcatgggtcc

SEQ ID NO: 155359 - DNA, 25 bp, Rattus norvegicus
agtacctgtcacacatctggctaca

SEQ ID NO: 155360 - DNA, 25 bp, Rattus norvegicus
agtacctgtcactcatctggctaca

SEQ ID NO: 155361 - DNA, 25 bp, Rattus norvegicus
agtacctgtgcaagcggacggagct

SEQ ID NO: 155362 - DNA, 25 bp, Rattus norvegicus
agtacctgtgcatgcggacggagct

SEQ ID NO: 155363 - DNA, 25 bp, Rattus norvegicus
agtacctgtgttatattttctgtgt

SEQ ID NO: 155364 - DNA, 25 bp, Rattus norvegicus
agtacctgtgttttattttctgtgt

SEQ ID NO: 155365 - DNA, 25 bp, Rattus norvegicus
agtaccttccatagctactgtatgt

SEQ ID NO: 155366 - DNA, 25 bp, Rattus norvegicus
agtaccttccattgctactgtatgt

SEQ ID NO: 155367 - DNA, 25 bp, Rattus norvegicus
agtaccttcggcagctgtttcaaag

SEQ ID NO: 155368 - DNA, 25 bp, Rattus norvegicus
agtaccttcggctgctgtttcaaag

SEQ ID NO: 155369 - DNA, 25 bp, Rattus norvegicus
agtaccttctctcgatttctcgtct

SEQ ID NO: 155370 - DNA, 25 bp, Rattus norvegicus
agtaccttctctggatttctcgtct

SEQ ID NO: 155371 - DNA, 25 bp, Rattus norvegicus
agtaccttctgcatcaatgatgcct

SEQ ID NO: 155372 - DNA, 25 bp, Rattus norvegicus
agtaccttctgcttcaatgatgcct

SEQ ID NO: 155373 - DNA, 25 bp, Rattus norvegicus
agtaccttctggattcctctatgtg

SEQ ID NO: 155374 - DNA, 25 bp, Rattus norvegicus
agtaccttctggtttcctctatgtg

SEQ ID NO: 155375 - DNA, 25 bp, Rattus norvegicus
agtaccttctttagttgttgcttgt

SEQ ID NO: 155376 - DNA, 25 bp, Rattus norvegicus
agtaccttcttttgttgttgcttgt

SEQ ID NO: 155377 - DNA, 25 bp, Rattus norvegicus
agtaccttgtatataacaccttgtg

SEQ ID NO: 155378 - DNA, 25 bp, Rattus norvegicus
agtaccttgtatttaacaccttgtg

SEQ ID NO: 155379 - DNA, 25 bp, Rattus norvegicus
agtacctttaccaggaccgaatctg

SEQ ID NO: 155380 - DNA, 25 bp, Rattus norvegicus
agtacctttacctggaccgaatctg

SEQ ID NO: 155381 - DNA, 25 bp, Rattus norvegicus
agtacgaagaagaaatggaggccaa

SEQ ID NO: 155382 - DNA, 25 bp, Rattus norvegicus
agtacgaagaagtaatggaggccaa

SEQ ID NO: 155383 - DNA, 25 bp, Rattus norvegicus
agtacgaatggacccctatgacctt

SEQ ID NO: 155384 - DNA, 25 bp, Rattus norvegicus
agtacgaatggagccctatgacctt

SEQ ID NO: 155385 - DNA, 25 bp, Rattus norvegicus
agtacgactcttccagcttttgaga

SEQ ID NO: 155386 - DNA, 25 bp, Rattus norvegicus
agtacgactcttgcagcttttgaga

SEQ ID NO: 155387 - DNA, 25 bp, Rattus norvegicus
agtacgcataggaaattaacatagt

SEQ ID NO: 155388 - DNA, 25 bp, Rattus norvegicus
agtacgcataggtaattaacatagt

SEQ ID NO: 155389 - DNA, 25 bp, Rattus norvegicus
agtacgcgctgcctggtaagagcaa

SEQ ID NO: 155390 - DNA, 25 bp, Rattus norvegicus
agtacgcgctgcgtggtaagagcaa

SEQ ID NO: 155391 - DNA, 25 bp, Rattus norvegicus
agtacgcgctggacagtatcaggct

SEQ ID NO: 155392 - DNA, 25 bp, Rattus norvegicus
agtacgcgctggtcagtatcaggct

SEQ ID NO: 155393 - DNA, 25 bp, Rattus norvegicus
agtacgctgaatccataggtgccct

SEQ ID NO: 155394 - DNA, 25 bp, Rattus norvegicus
agtacgctgaatgcataggtgccct

SEQ ID NO: 155395 - DNA, 25 bp, Rattus norvegicus
agtacgctgatgaacgcgtgctgca

SEQ ID NO: 155396 - DNA, 25 bp, Rattus norvegicus
agtacgctgatgtacgcgtgctgca

SEQ ID NO: 155397 - DNA, 25 bp, Rattus norvegicus
agtacggacactcttccttgaacta

SEQ ID NO: 155398 - DNA, 25 bp, Rattus norvegicus
agtacggacactgttccttgaacta

SEQ ID NO: 155399 - DNA, 25 bp, Rattus norvegicus
agtacggagttcacctgttccccag

SEQ ID NO: 155400 - DNA, 25 bp, Rattus norvegicus
agtacggagttctcctgttccccag

SEQ ID NO: 155401 - DNA, 25 bp, Rattus norvegicus
agtacggccatcagcaatcctgacg

SEQ ID NO: 155402 - DNA, 25 bp, Rattus norvegicus
agtacggccatctgcaatcctgacg

SEQ ID NO: 155403 - DNA, 25 bp, Rattus norvegicus
agtacggcccagacatcgaatgtga

SEQ ID NO: 155404 - DNA, 25 bp, Rattus norvegicus
agtacggcccagtcatcgaatgtga

SEQ ID NO: 155405 - DNA, 25 bp, Rattus norvegicus
agtacggcgcctcattgacaactgt

SEQ ID NO: 155406 - DNA, 25 bp, Rattus norvegicus
agtacggcgcctgattgacaactgt

SEQ ID NO: 155407 - DNA, 25 bp, Rattus norvegicus
agtacggctgccaggacacatccct

SEQ ID NO: 155408 - DNA, 25 bp, Rattus norvegicus
agtacggctgcctggacacatccct

SEQ ID NO: 155409 - DNA, 25 bp, Rattus norvegicus
agtacggctgtcaggtgaagatatg

SEQ ID NO: 155410 - DNA, 25 bp, Rattus norvegicus
agtacggctgtctggtgaagatatg

SEQ ID NO: 155411 - DNA, 25 bp, Rattus norvegicus
agtacggctgttcatctcatctgta

SEQ ID NO: 155412 - DNA, 25 bp, Rattus norvegicus
agtacggctgttgatctcatctgta

SEQ ID NO: 155413 - DNA, 25 bp, Rattus norvegicus
agtacgggctcacagacagcgttga

SEQ ID NO: 155414 - DNA, 25 bp, Rattus norvegicus
agtacgggctcagagacagcgttga

SEQ ID NO: 155415 - DNA, 25 bp, Rattus norvegicus
agtacggtgcctatgtgaagccagc

SEQ ID NO: 155416 - DNA, 25 bp, Rattus norvegicus
agtacggtgcctttgtgaagccagc

SEQ ID NO: 155417 - DNA, 25 bp, Rattus norvegicus
agtacggtggctcttgcagaagcaa

SEQ ID NO: 155418 - DNA, 25 bp, Rattus norvegicus
agtacggtggctgttgcagaagcaa

SEQ ID NO: 155419 - DNA, 25 bp, Rattus norvegicus
agtacggttactctgatttggctcc

SEQ ID NO: 155420 - DNA, 25 bp, Rattus norvegicus
agtacggttactgtgatttggctcc

SEQ ID NO: 155421 - DNA, 25 bp, Rattus norvegicus
agtacgtaatgtctgctgcaacctc

SEQ ID NO: 155422 - DNA, 25 bp, Rattus norvegicus
agtacgtaatgtgtgctgcaacctc

SEQ ID NO: 155423 - DNA, 25 bp, Rattus norvegicus
agtacgtcacttcctgcttggagtt

SEQ ID NO: 155424 - DNA, 25 bp, Rattus norvegicus
agtacgtcacttgctgcttggagtt

SEQ ID NO: 155425 - DNA, 25 bp, Rattus norvegicus
agtacgtccccacaattgtgtttgt

SEQ ID NO: 155426 - DNA, 25 bp, Rattus norvegicus
agtacgtccccagaattgtgtttgt

SEQ ID NO: 155427 - DNA, 25 bp, Rattus norvegicus
agtacgtgactgacttgagctcctg

SEQ ID NO: 155428 - DNA, 25 bp, Rattus norvegicus
agtacgtgactgtcttgagctcctg

SEQ ID NO: 155429 - DNA, 25 bp, Rattus norvegicus
agtacgtgcagaaggccaactttgt

SEQ ID NO: 155430 - DNA, 25 bp, Rattus norvegicus
agtacgtgcagatggccaactttgt

SEQ ID NO: 155431 - DNA, 25 bp, Rattus norvegicus
agtacgtgccatacaagttgttcat

SEQ ID NO: 155432 - DNA, 25 bp, Rattus norvegicus
agtacgtgccattcaagttgttcat

SEQ ID NO: 155433 - DNA, 25 bp, Rattus norvegicus
agtacgtgtgccaggagcagccatc

SEQ ID NO: 155434 - DNA, 25 bp, Rattus norvegicus
agtacgtgtgcctggagcagccatc

SEQ ID NO: 155435 - DNA, 25 bp, Rattus norvegicus
agtactaagcttagggtgctgcaaa

SEQ ID NO: 155436 - DNA, 25 bp, Rattus norvegicus
agtactaagctttgggtgctgcaaa

SEQ ID NO: 155437 - DNA, 25 bp, Rattus norvegicus
agtactacacagcatgggccctggg

SEQ ID NO: 155438 - DNA, 25 bp, Rattus norvegicus
agtactacacaggatgggccctggg

SEQ ID NO: 155439 - DNA, 25 bp, Rattus norvegicus
agtactacatgacacttggcctggt

SEQ ID NO: 155440 - DNA, 25 bp, Rattus norvegicus
agtactacatgagacttggcctggt

SEQ ID NO: 155441 - DNA, 25 bp, Rattus norvegicus
agtactacccagatggccacagtga

SEQ ID NO: 155442 - DNA, 25 bp, Rattus norvegicus
agtactacccagttggccacagtga

SEQ ID NO: 155443 - DNA, 25 bp, Rattus norvegicus
agtactacctggacttgaattcgga

SEQ ID NO: 155444 - DNA, 25 bp, Rattus norvegicus
agtactacctggtcttgaattcgga

SEQ ID NO: 155445 - DNA, 25 bp, Rattus norvegicus
agtactacgctgacagagtacactg

SEQ ID NO: 155446 - DNA, 25 bp, Rattus norvegicus
agtactacgctgtcagagtacactg

SEQ ID NO: 155447 - DNA, 25 bp, Rattus norvegicus
agtactactccacccagatagatga

SEQ ID NO: 155448 - DNA, 25 bp, Rattus norvegicus
agtactactccagccagatagatga

SEQ ID NO: 155449 - DNA, 25 bp, Rattus norvegicus
agtactagaggtcccttttacctgt

SEQ ID NO: 155450 - DNA, 25 bp, Rattus norvegicus
agtactagaggtgccttttacctgt

SEQ ID NO: 155451 - DNA, 25 bp, Rattus norvegicus
agtactaggttcaagcttccttcct

SEQ ID NO: 155452 - DNA, 25 bp, Rattus norvegicus
agtactaggttctagcttccttcct

SEQ ID NO: 155453 - DNA, 25 bp, Rattus norvegicus
agtactatccagagggaagcccatg

SEQ ID NO: 155454 - DNA, 25 bp, Rattus norvegicus
agtactatccagtgggaagcccatg

SEQ ID NO: 155455 - DNA, 25 bp, Rattus norvegicus
agtactatgcctagggacacctcta

SEQ ID NO: 155456 - DNA, 25 bp, Rattus norvegicus
agtactatgccttgggacacctcta

SEQ ID NO: 155457 - DNA, 25 bp, Rattus norvegicus
agtactatggccagtctttgcctga

SEQ ID NO: 155458 - DNA, 25 bp, Rattus norvegicus
agtactatggcctgtctttgcctga

SEQ ID NO: 155459 - DNA, 25 bp, Rattus norvegicus
agtactatgttcacctcattgctga

SEQ ID NO: 155460 - DNA, 25 bp, Rattus norvegicus
agtactatgttctcctcattgctga

SEQ ID NO: 155461 - DNA, 25 bp, Rattus norvegicus
agtactcagagcacggcagagggaa

SEQ ID NO: 155462 - DNA, 25 bp, Rattus norvegicus
agtactcagagctcggcagagggaa

SEQ ID NO: 155463 - DNA, 25 bp, Rattus norvegicus
agtactcagatgctcacttcagcga

SEQ ID NO: 155464 - DNA, 25 bp, Rattus norvegicus
agtactcagatggtcacttcagcga

SEQ ID NO: 155465 - DNA, 25 bp, Rattus norvegicus
agtactcatgtacaatcctgcggct

SEQ ID NO: 155466 - DNA, 25 bp, Rattus norvegicus
agtactcatgtagaatcctgcggct

SEQ ID NO: 155467 - DNA, 25 bp, Rattus norvegicus
agtactcattctcctgttctcatcc

SEQ ID NO: 155468 - DNA, 25 bp, Rattus norvegicus
agtactcattctgctgttctcatcc

SEQ ID NO: 155469 - DNA, 25 bp, Rattus norvegicus
agtactcatttactcctgtgcccag

SEQ ID NO: 155470 - DNA, 25 bp, Rattus norvegicus
agtactcatttagtcctgtgcccag

SEQ ID NO: 155471 - DNA, 25 bp, Rattus norvegicus
agtactccatcaccacttcgtagct

SEQ ID NO: 155472 - DNA, 25 bp, Rattus norvegicus
agtactccatcagcacttcgtagct

SEQ ID NO: 155473 - DNA, 25 bp, Rattus norvegicus
agtactccctcccagacctattgag

SEQ ID NO: 155474 - DNA, 25 bp, Rattus norvegicus
agtactccctccgagacctattgag

SEQ ID NO: 155475 - DNA, 25 bp, Rattus norvegicus
agtactccgtgtaacgtttcctcag

SEQ ID NO: 155476 - DNA, 25 bp, Rattus norvegicus
agtactccgtgttacgtttcctcag

SEQ ID NO: 155477 - DNA, 25 bp, Rattus norvegicus
agtactcctgcaaggtgggccacga

SEQ ID NO: 155478 - DNA, 25 bp, Rattus norvegicus
agtactcctgcatggtgggccacga

SEQ ID NO: 155479 - DNA, 25 bp, Rattus norvegicus
agtactcgtttcatacatttgtgcg

SEQ ID NO: 155480 - DNA, 25 bp, Rattus norvegicus
agtactcgtttcttacatttgtgcg

SEQ ID NO: 155481 - DNA, 25 bp, Rattus norvegicus
agtactctaaggcaccatctcctcg

SEQ ID NO: 155482 - DNA, 25 bp, Rattus norvegicus
agtactctaagggaccatctcctcg

SEQ ID NO: 155483 - DNA, 25 bp, Rattus norvegicus
agtactctactcctaccacgtagtt

SEQ ID NO: 155484 - DNA, 25 bp, Rattus norvegicus
agtactctactcgtaccacgtagtt

SEQ ID NO: 155485 - DNA, 25 bp, Rattus norvegicus
agtactctcacgacagtgtttttaa

SEQ ID NO: 155486 - DNA, 25 bp, Rattus norvegicus
agtactctcacgtcagtgtttttaa

SEQ ID NO: 155487 - DNA, 25 bp, Rattus norvegicus
agtactctcccaaggctattgaaga

SEQ ID NO: 155488 - DNA, 25 bp, Rattus norvegicus
agtactctcccatggctattgaaga

SEQ ID NO: 155489 - DNA, 25 bp, Rattus norvegicus
agtactctggcaaggagggtgacaa

SEQ ID NO: 155490 - DNA, 25 bp, Rattus norvegicus
agtactctggcatggagggtgacaa

SEQ ID NO: 155491 - DNA, 25 bp, Rattus norvegicus
agtactctgtatccctaagcgtgct

SEQ ID NO: 155492 - DNA, 25 bp, Rattus norvegicus
agtactctgtatgcctaagcgtgct

SEQ ID NO: 155493 - DNA, 25 bp, Rattus norvegicus
agtactctgtctccttgatttggaa

SEQ ID NO: 155494 - DNA, 25 bp, Rattus norvegicus
agtactctgtctgcttgatttggaa

SEQ ID NO: 155495 - DNA, 25 bp, Rattus norvegicus
agtactctgtgaagctgtccctcct

SEQ ID NO: 155496 - DNA, 25 bp, Rattus norvegicus
agtactctgtgatgctgtccctcct

SEQ ID NO: 155497 - DNA, 25 bp, Rattus norvegicus
agtactcttcccagctttgaaggga

SEQ ID NO: 155498 - DNA, 25 bp, Rattus norvegicus
agtactcttccctgctttgaaggga

SEQ ID NO: 155499 - DNA, 25 bp, Rattus norvegicus
agtactcttctgacctgtgaaatgg

SEQ ID NO: 155500 - DNA, 25 bp, Rattus norvegicus
agtactcttctgtcctgtgaaatgg

SEQ ID NO: 155501 - DNA, 25 bp, Rattus norvegicus
agtactgagcccaggagtgtggtat

SEQ ID NO: 155502 - DNA, 25 bp, Rattus norvegicus
agtactgagccctggagtgtggtat

SEQ ID NO: 155503 - DNA, 25 bp, Rattus norvegicus
agtactgaggccacaagaccaggtt

SEQ ID NO: 155504 - DNA, 25 bp, Rattus norvegicus
agtactgaggcctcaagaccaggtt

SEQ ID NO: 155505 - DNA, 25 bp, Rattus norvegicus
agtactgaggtcagtggatgagcca

SEQ ID NO: 155506 - DNA, 25 bp, Rattus norvegicus
agtactgaggtctgtggatgagcca

SEQ ID NO: 155507 - DNA, 25 bp, Rattus norvegicus
agtactgatcttagctagttttagc

SEQ ID NO: 155508 - DNA, 25 bp, Rattus norvegicus
agtactgatctttgctagttttagc

SEQ ID NO: 155509 - DNA, 25 bp, Rattus norvegicus
agtactgatgggagattctcgatgt

SEQ ID NO: 155510 - DNA, 25 bp, Rattus norvegicus
agtactgatgggtgattctcgatgt

SEQ ID NO: 155511 - DNA, 25 bp, Rattus norvegicus
agtactgcaaccaggtgtcctttgt

SEQ ID NO: 155512 - DNA, 25 bp, Rattus norvegicus
agtactgcaacctggtgtcctttgt

SEQ ID NO: 155513 - DNA, 25 bp, Rattus norvegicus
agtactgcacaactgggacccttga

SEQ ID NO: 155514 - DNA, 25 bp, Rattus norvegicus
agtactgcacaagtgggacccttga

SEQ ID NO: 155515 - DNA, 25 bp, Rattus norvegicus
agtactgcacgtcggctgggcaact

SEQ ID NO: 155516 - DNA, 25 bp, Rattus norvegicus
agtactgcacgtgggctgggcaact

SEQ ID NO: 155517 - DNA, 25 bp, Rattus norvegicus
agtactgcccttcagaacggactat

SEQ ID NO: 155518 - DNA, 25 bp, Rattus norvegicus
agtactgcccttgagaacggactat

SEQ ID NO: 155519 - DNA, 25 bp, Rattus norvegicus
agtactgccgctactacgccaagga

SEQ ID NO: 155520 - DNA, 25 bp, Rattus norvegicus
agtactgccgcttctacgccaagga

SEQ ID NO: 155521 - DNA, 25 bp, Rattus norvegicus
agtactgcggcaaggtcttcaaaaa

SEQ ID NO: 155522 - DNA, 25 bp, Rattus norvegicus
agtactgcggcatggtcttcaaaaa

SEQ ID NO: 155523 - DNA, 25 bp, Rattus norvegicus
agtactgctcccatagaacactgtg

SEQ ID NO: 155524 - DNA, 25 bp, Rattus norvegicus
agtactgctcccttagaacactgtg

SEQ ID NO: 155525 - DNA, 25 bp, Rattus norvegicus
agtactgctctactttttcatctga

SEQ ID NO: 155526 - DNA, 25 bp, Rattus norvegicus
agtactgctctagtttttcatctga

SEQ ID NO: 155527 - DNA, 25 bp, Rattus norvegicus
agtactgctgcaagtgttttaccaa

SEQ ID NO: 155528 - DNA, 25 bp, Rattus norvegicus
agtactgctgcatgtgttttaccaa

SEQ ID NO: 155529 - DNA, 25 bp, Rattus norvegicus
agtactgctgtgcttatgtctgctt

SEQ ID NO: 155530 - DNA, 25 bp, Rattus norvegicus
agtactgctgtggttatgtctgctt

SEQ ID NO: 155531 - DNA, 25 bp, Rattus norvegicus
agtactggagaccactactacacgg

SEQ ID NO: 155532 - DNA, 25 bp, Rattus norvegicus
agtactggagacgactactacacgg

SEQ ID NO: 155533 - DNA, 25 bp, Rattus norvegicus
agtactggagttctgccttttctaa

SEQ ID NO: 155534 - DNA, 25 bp, Rattus norvegicus
agtactggagttgtgccttttctaa

SEQ ID NO: 155535 - DNA, 25 bp, Rattus norvegicus
agtactggcctgaggacctggccca

SEQ ID NO: 155536 - DNA, 25 bp, Rattus norvegicus
agtactggcctgtggacctggccca

SEQ ID NO: 155537 - DNA, 25 bp, Rattus norvegicus
agtactggctgtactttgcgacttg

SEQ ID NO: 155538 - DNA, 25 bp, Rattus norvegicus
agtactggctgttctttgcgacttg

SEQ ID NO: 155539 - DNA, 25 bp, Rattus norvegicus
agtactgggctaatcatcttcctga

SEQ ID NO: 155540 - DNA, 25 bp, Rattus norvegicus
agtactgggctattcatcttcctga

SEQ ID NO: 155541 - DNA, 25 bp, Rattus norvegicus
agtactggtataagccatcctgcct

SEQ ID NO: 155542 - DNA, 25 bp, Rattus norvegicus
agtactggtatatgccatcctgcct

SEQ ID NO: 155543 - DNA, 25 bp, Rattus norvegicus
agtactggtatcacctgcaggcatg

SEQ ID NO: 155544 - DNA, 25 bp, Rattus norvegicus
agtactggtatctcctgcaggcatg

SEQ ID NO: 155545 - DNA, 25 bp, Rattus norvegicus
agtactggttagagccgatctggcc

SEQ ID NO: 155546 - DNA, 25 bp, Rattus norvegicus
agtactggttagtgccgatctggcc

SEQ ID NO: 155547 - DNA, 25 bp, Rattus norvegicus
agtactgtatttagatctttagagc

SEQ ID NO: 155548 - DNA, 25 bp, Rattus norvegicus
agtactgtattttgatctttagagc

SEQ ID NO: 155549 - DNA, 25 bp, Rattus norvegicus
agtactgtcattaccatcctggaga

SEQ ID NO: 155550 - DNA, 25 bp, Rattus norvegicus
agtactgtcatttccatcctggaga

SEQ ID NO: 155551 - DNA, 25 bp, Rattus norvegicus
agtactgtccaactagcctgggaat

SEQ ID NO: 155552 - DNA, 25 bp, Rattus norvegicus
agtactgtccaagtagcctgggaat

SEQ ID NO: 155553 - DNA, 25 bp, Rattus norvegicus
agtactgtctctccctgaccagatt

SEQ ID NO: 155554 - DNA, 25 bp, Rattus norvegicus
agtactgtctctgcctgaccagatt

SEQ ID NO: 155555 - DNA, 25 bp, Rattus norvegicus
agtactgtcttcaccatagcaaggt

SEQ ID NO: 155556 - DNA, 25 bp, Rattus norvegicus
agtactgtcttctccatagcaaggt

SEQ ID NO: 155557 - DNA, 25 bp, Rattus norvegicus
agtactgtggatcattccccagaga

SEQ ID NO: 155558 - DNA, 25 bp, Rattus norvegicus
agtactgtggatgattccccagaga

SEQ ID NO: 155559 - DNA, 25 bp, Rattus norvegicus
agtactgtgtccagacttactgtca

SEQ ID NO: 155560 - DNA, 25 bp, Rattus norvegicus
agtactgtgtcctgacttactgtca

SEQ ID NO: 155561 - DNA, 25 bp, Rattus norvegicus
agtactgtgtgtctgtgctgagtca

SEQ ID NO: 155562 - DNA, 25 bp, Rattus norvegicus
agtactgtgtgtgtgtgctgagtca

SEQ ID NO: 155563 - DNA, 25 bp, Rattus norvegicus
agtactgttattattgtgttagcaa

SEQ ID NO: 155564 - DNA, 25 bp, Rattus norvegicus
agtactgttatttttgtgttagcaa

SEQ ID NO: 155565 - DNA, 25 bp, Rattus norvegicus
agtactgttgatctagctcttggta

SEQ ID NO: 155566 - DNA, 25 bp, Rattus norvegicus
agtactgttgatgtagctcttggta

SEQ ID NO: 155567 - DNA, 25 bp, Rattus norvegicus
agtactgttgttactgatgcaatca

SEQ ID NO: 155568 - DNA, 25 bp, Rattus norvegicus
agtactgttgtttctgatgcaatca

SEQ ID NO: 155569 - DNA, 25 bp, Rattus norvegicus
agtactgtttagatctgtctccctc

SEQ ID NO: 155570 - DNA, 25 bp, Rattus norvegicus
agtactgtttagttctgtctccctc

SEQ ID NO: 155571 - DNA, 25 bp, Rattus norvegicus
agtacttaaagcatggtccccagtg

SEQ ID NO: 155572 - DNA, 25 bp, Rattus norvegicus
agtacttaaagcttggtccccagtg

SEQ ID NO: 155573 - DNA, 25 bp, Rattus norvegicus
agtacttacacacggttgctcacaa

SEQ ID NO: 155574 - DNA, 25 bp, Rattus norvegicus
agtacttacacagggttgctcacaa

SEQ ID NO: 155575 - DNA, 25 bp, Rattus norvegicus
agtacttaggttaggctcttgtctt

SEQ ID NO: 155576 - DNA, 25 bp, Rattus norvegicus
agtacttaggtttggctcttgtctt

SEQ ID NO: 155577 - DNA, 25 bp, Rattus norvegicus
agtacttagtaacccatcacaccaa

SEQ ID NO: 155578 - DNA, 25 bp, Rattus norvegicus
agtacttagtaagccatcacaccaa

SEQ ID NO: 155579 - DNA, 25 bp, Rattus norvegicus
agtacttatgttatgctccactcag

SEQ ID NO: 155580 - DNA, 25 bp, Rattus norvegicus
agtacttatgttttgctccactcag

SEQ ID NO: 155581 - DNA, 25 bp, Rattus norvegicus
agtacttattgtaattttattctga

SEQ ID NO: 155582 - DNA, 25 bp, Rattus norvegicus
agtacttattgttattttattctga

SEQ ID NO: 155583 - DNA, 25 bp, Rattus norvegicus
agtacttcaaaaagcctgcgggcct

SEQ ID NO: 155584 - DNA, 25 bp, Rattus norvegicus
agtacttcaaaatgcctgcgggcct

SEQ ID NO: 155585 - DNA, 25 bp, Rattus norvegicus
agtacttcactgacgcaggactgaa

SEQ ID NO: 155586 - DNA, 25 bp, Rattus norvegicus
agtacttcactgtcgcaggactgaa

SEQ ID NO: 155587 - DNA, 25 bp, Rattus norvegicus
agtacttcagatagctctcacatgc

SEQ ID NO: 155588 - DNA, 25 bp, Rattus norvegicus
agtacttcagattgctctcacatgc

SEQ ID NO: 155589 - DNA, 25 bp, Rattus norvegicus
agtacttcagtaatcgtccagggcc

SEQ ID NO: 155590 - DNA, 25 bp, Rattus norvegicus
agtacttcagtattcgtccagggcc

SEQ ID NO: 155591 - DNA, 25 bp, Rattus norvegicus
agtacttccacaagactgtctcgga

SEQ ID NO: 155592 - DNA, 25 bp, Rattus norvegicus
agtacttccacatgactgtctcgga

SEQ ID NO: 155593 - DNA, 25 bp, Rattus norvegicus
agtacttcctgacctttgttttgtt

SEQ ID NO: 155594 - DNA, 25 bp, Rattus norvegicus
agtacttcctgagctttgttttgtt

SEQ ID NO: 155595 - DNA, 25 bp, Rattus norvegicus
agtacttcctttctagatgatgcga

SEQ ID NO: 155596 - DNA, 25 bp, Rattus norvegicus
agtacttcctttgtagatgatgcga

SEQ ID NO: 155597 - DNA, 25 bp, Rattus norvegicus
agtacttcgagacttcaccaaggcc

SEQ ID NO: 155598 - DNA, 25 bp, Rattus norvegicus
agtacttcgagagttcaccaaggcc

SEQ ID NO: 155599 - DNA, 25 bp, Rattus norvegicus
agtacttctatcagactttttgtta

SEQ ID NO: 155600 - DNA, 25 bp, Rattus norvegicus
agtacttctatctgactttttgtta

SEQ ID NO: 155601 - DNA, 25 bp, Rattus norvegicus
agtacttctgaaacagctcgctggc

SEQ ID NO: 155602 - DNA, 25 bp, Rattus norvegicus
agtacttctgaatcagctcgctggc

SEQ ID NO: 155603 - DNA, 25 bp, Rattus norvegicus
agtacttgaagcagagcctctatgt

SEQ ID NO: 155604 - DNA, 25 bp, Rattus norvegicus
agtacttgaagctgagcctctatgt

SEQ ID NO: 155605 - DNA, 25 bp, Rattus norvegicus
agtacttgaggtaggtgcgcccgtt

SEQ ID NO: 155606 - DNA, 25 bp, Rattus norvegicus
agtacttgaggttggtgcgcccgtt

SEQ ID NO: 155607 - DNA, 25 bp, Rattus norvegicus
agtacttgctgtatctttagaggac

SEQ ID NO: 155608 - DNA, 25 bp, Rattus norvegicus
agtacttgctgtttctttagaggac

SEQ ID NO: 155609 - DNA, 25 bp, Rattus norvegicus
agtacttggatcacagaggcacaga

SEQ ID NO: 155610 - DNA, 25 bp, Rattus norvegicus
agtacttggatctcagaggcacaga

SEQ ID NO: 155611 - DNA, 25 bp, Rattus norvegicus
agtacttggcaaatgtcccagaccc

SEQ ID NO: 155612 - DNA, 25 bp, Rattus norvegicus
agtacttggcaattgtcccagaccc

SEQ ID NO: 155613 - DNA, 25 bp, Rattus norvegicus
agtacttggcgcacggcgtccaggt

SEQ ID NO: 155614 - DNA, 25 bp, Rattus norvegicus
agtacttggcgctcggcgtccaggt

SEQ ID NO: 155615 - DNA, 25 bp, Rattus norvegicus
agtacttggctgcacaacactgcaa

SEQ ID NO: 155616 - DNA, 25 bp, Rattus norvegicus
agtacttggctggacaacactgcaa

SEQ ID NO: 155617 - DNA, 25 bp, Rattus norvegicus
agtacttgggttatgcatcaggcca

SEQ ID NO: 155618 - DNA, 25 bp, Rattus norvegicus
agtacttgggttttgcatcaggcca

SEQ ID NO: 155619 - DNA, 25 bp, Rattus norvegicus
agtacttgtctacgcactttgagag

SEQ ID NO: 155620 - DNA, 25 bp, Rattus norvegicus
agtacttgtctaggcactttgagag

SEQ ID NO: 155621 - DNA, 25 bp, Rattus norvegicus
agtactttctcaaatttcacaattt

SEQ ID NO: 155622 - DNA, 25 bp, Rattus norvegicus
agtactttctcatatttcacaattt

SEQ ID NO: 155623 - DNA, 25 bp, Rattus norvegicus
agtactttctctcgcgttcaatgag

SEQ ID NO: 155624 - DNA, 25 bp, Rattus norvegicus
agtactttctctggcgttcaatgag

SEQ ID NO: 155625 - DNA, 25 bp, Rattus norvegicus
agtactttcttgcagttcatttgaa

SEQ ID NO: 155626 - DNA, 25 bp, Rattus norvegicus
agtactttcttggagttcatttgaa

SEQ ID NO: 155627 - DNA, 25 bp, Rattus norvegicus
agtactttgctcactcttcatccgt

SEQ ID NO: 155628 - DNA, 25 bp, Rattus norvegicus
agtactttgctctctcttcatccgt

SEQ ID NO: 155629 - DNA, 25 bp, Rattus norvegicus
agtactttgggcagtctgagtttat

SEQ ID NO: 155630 - DNA, 25 bp, Rattus norvegicus
agtactttgggctgtctgagtttat

SEQ ID NO: 155631 - DNA, 25 bp, Rattus norvegicus
agtactttgtctagtcaggcctgga

SEQ ID NO: 155632 - DNA, 25 bp, Rattus norvegicus
agtactttgtcttgtcaggcctgga

SEQ ID NO: 155633 - DNA, 25 bp, Rattus norvegicus
agtactttgttcactacactctgcc

SEQ ID NO: 155634 - DNA, 25 bp, Rattus norvegicus
agtactttgttctctacactctgcc

SEQ ID NO: 155635 - DNA, 25 bp, Rattus norvegicus
agtacttttacccactgcaccattt

SEQ ID NO: 155636 - DNA, 25 bp, Rattus norvegicus
agtacttttaccgactgcaccattt

SEQ ID NO: 155637 - DNA, 25 bp, Rattus norvegicus
agtacttttcaacgccttcactctt

SEQ ID NO: 155638 - DNA, 25 bp, Rattus norvegicus
agtacttttcaaggccttcactctt

SEQ ID NO: 155639 - DNA, 25 bp, Rattus norvegicus
agtacttttcttcaaatctgcccca

SEQ ID NO: 155640 - DNA, 25 bp, Rattus norvegicus
agtacttttcttgaaatctgcccca

SEQ ID NO: 155641 - DNA, 25 bp, Rattus norvegicus
agtagaaaacatcacctataccggg

SEQ ID NO: 155642 - DNA, 25 bp, Rattus norvegicus
agtagaaaacatgacctataccggg

SEQ ID NO: 155643 - DNA, 25 bp, Rattus norvegicus
agtagaaaatccatttgacttcatg

SEQ ID NO: 155644 - DNA, 25 bp, Rattus norvegicus
agtagaaaatccttttgacttcatg

SEQ ID NO: 155645 - DNA, 25 bp, Rattus norvegicus
agtagaaacccactggccagttcca

SEQ ID NO: 155646 - DNA, 25 bp, Rattus norvegicus
agtagaaacccagtggccagttcca

SEQ ID NO: 155647 - DNA, 25 bp, Rattus norvegicus
agtagaaagcagatgcctgcccctc

SEQ ID NO: 155648 - DNA, 25 bp, Rattus norvegicus
agtagaaagcagttgcctgcccctc

SEQ ID NO: 155649 - DNA, 25 bp, Rattus norvegicus
agtagaaagcatctctctccagtgt

SEQ ID NO: 155650 - DNA, 25 bp, Rattus norvegicus
agtagaaagcatgtctctccagtgt

SEQ ID NO: 155651 - DNA, 25 bp, Rattus norvegicus
agtagaaattctctccgctgcaagg

SEQ ID NO: 155652 - DNA, 25 bp, Rattus norvegicus
agtagaaattctgtccgctgcaagg

SEQ ID NO: 155653 - DNA, 25 bp, Rattus norvegicus
agtagaaccagcctcaagaacgccc

SEQ ID NO: 155654 - DNA, 25 bp, Rattus norvegicus
agtagaaccagcgtcaagaacgccc

SEQ ID NO: 155655 - DNA, 25 bp, Rattus norvegicus
agtagaactaagaccctttcagcct

SEQ ID NO: 155656 - DNA, 25 bp, Rattus norvegicus
agtagaactaagtccctttcagcct

SEQ ID NO: 155657 - DNA, 25 bp, Rattus norvegicus
agtagaactatccagatggcctccc

SEQ ID NO: 155658 - DNA, 25 bp, Rattus norvegicus
agtagaactatcgagatggcctccc

SEQ ID NO: 155659 - DNA, 25 bp, Rattus norvegicus
agtagaactccaaacctgggctgga

SEQ ID NO: 155660 - DNA, 25 bp, Rattus norvegicus
agtagaactccatacctgggctgga

SEQ ID NO: 155661 - DNA, 25 bp, Rattus norvegicus
agtagaactctcctgtagcctgtag

SEQ ID NO: 155662 - DNA, 25 bp, Rattus norvegicus
agtagaactctcgtgtagcctgtag

SEQ ID NO: 155663 - DNA, 25 bp, Rattus norvegicus
agtagaagatgcacctccagccttg

SEQ ID NO: 155664 - DNA, 25 bp, Rattus norvegicus
agtagaagatgctcctccagccttg

SEQ ID NO: 155665 - DNA, 25 bp, Rattus norvegicus
agtagaagccatcattcccagggtg

SEQ ID NO: 155666 - DNA, 25 bp, Rattus norvegicus
agtagaagccatgattcccagggtg

SEQ ID NO: 155667 - DNA, 25 bp, Rattus norvegicus
agtagaaggctacagggctcagaaa

SEQ ID NO: 155668 - DNA, 25 bp, Rattus norvegicus
agtagaaggctagagggctcagaaa

SEQ ID NO: 155669 - DNA, 25 bp, Rattus norvegicus
agtagaagtcatagcccttccggca

SEQ ID NO: 155670 - DNA, 25 bp, Rattus norvegicus
agtagaagtcattgcccttccggca

SEQ ID NO: 155671 - DNA, 25 bp, Rattus norvegicus
agtagaagtcggacttgtcgcccga

SEQ ID NO: 155672 - DNA, 25 bp, Rattus norvegicus
agtagaagtcggtcttgtcgcccga

SEQ ID NO: 155673 - DNA, 25 bp, Rattus norvegicus
agtagaatctctatttgctctcctt

SEQ ID NO: 155674 - DNA, 25 bp, Rattus norvegicus
agtagaatctctttttgctctcctt

SEQ ID NO: 155675 - DNA, 25 bp, Rattus norvegicus
agtagaatgggccactgtgtcctct

SEQ ID NO: 155676 - DNA, 25 bp, Rattus norvegicus
agtagaatgggcgactgtgtcctct

SEQ ID NO: 155677 - DNA, 25 bp, Rattus norvegicus
agtagaatttccatgggttccagac

SEQ ID NO: 155678 - DNA, 25 bp, Rattus norvegicus
agtagaatttccttgggttccagac

SEQ ID NO: 155679 - DNA, 25 bp, Rattus norvegicus
agtagaccagcacgagtttgattct

SEQ ID NO: 155680 - DNA, 25 bp, Rattus norvegicus
agtagaccagcaggagtttgattct

SEQ ID NO: 155681 - DNA, 25 bp, Rattus norvegicus
agtagacccacacacttaagcctgt

SEQ ID NO: 155682 - DNA, 25 bp, Rattus norvegicus
agtagacccacagacttaagcctgt

SEQ ID NO: 155683 - DNA, 25 bp, Rattus norvegicus
agtagaccccgtcctggtatcggct

SEQ ID NO: 155684 - DNA, 25 bp, Rattus norvegicus
agtagaccccgtgctggtatcggct

SEQ ID NO: 155685 - DNA, 25 bp, Rattus norvegicus
agtagaccctcactacagtctgtgg

SEQ ID NO: 155686 - DNA, 25 bp, Rattus norvegicus
agtagaccctcagtacagtctgtgg

SEQ ID NO: 155687 - DNA, 25 bp, Rattus norvegicus
agtagacctccgagagccagtggat

SEQ ID NO: 155688 - DNA, 25 bp, Rattus norvegicus
agtagacctccgtgagccagtggat

SEQ ID NO: 155689 - DNA, 25 bp, Rattus norvegicus
agtagacctgcgaacagcggtgctg

SEQ ID NO: 155690 - DNA, 25 bp, Rattus norvegicus
agtagacctgcgtacagcggtgctg

SEQ ID NO: 155691 - DNA, 25 bp, Rattus norvegicus
agtagacctgtgaagctctggcctg

SEQ ID NO: 155692 - DNA, 25 bp, Rattus norvegicus
agtagacctgtgtagctctggcctg

SEQ ID NO: 155693 - DNA, 25 bp, Rattus norvegicus
agtagactatttaatcttccaaatg

SEQ ID NO: 155694 - DNA, 25 bp, Rattus norvegicus
agtagactattttatcttccaaatg

SEQ ID NO: 155695 - DNA, 25 bp, Rattus norvegicus
agtagactccagattcataatagag

SEQ ID NO: 155696 - DNA, 25 bp, Rattus norvegicus
agtagactccagtttcataatagag

SEQ ID NO: 155697 - DNA, 25 bp, Rattus norvegicus
agtagactcctgactgggcttcgcc

SEQ ID NO: 155698 - DNA, 25 bp, Rattus norvegicus
agtagactcctgtctgggcttcgcc

SEQ ID NO: 155699 - DNA, 25 bp, Rattus norvegicus
agtagactgcacatggcccagcact

SEQ ID NO: 155700 - DNA, 25 bp, Rattus norvegicus
agtagactgcacttggcccagcact

SEQ ID NO: 155701 - DNA, 25 bp, Rattus norvegicus
agtagactgtttccttcgtgtgcac

SEQ ID NO: 155702 - DNA, 25 bp, Rattus norvegicus
agtagactgtttgcttcgtgtgcac

SEQ ID NO: 155703 - DNA, 25 bp, Rattus norvegicus
agtagacttagtctcttccagcctg

SEQ ID NO: 155704 - DNA, 25 bp, Rattus norvegicus
agtagacttagtgtcttccagcctg

SEQ ID NO: 155705 - DNA, 25 bp, Rattus norvegicus
agtagactttctatgggctagccca

SEQ ID NO: 155706 - DNA, 25 bp, Rattus norvegicus
agtagactttctttgggctagccca

SEQ ID NO: 155707 - DNA, 25 bp, Rattus norvegicus
agtagagacggcacggccagagtta

SEQ ID NO: 155708 - DNA, 25 bp, Rattus norvegicus
agtagagacggctcggccagagtta

SEQ ID NO: 155709 - DNA, 25 bp, Rattus norvegicus
agtagagagctgacacctttttcca

SEQ ID NO: 155710 - DNA, 25 bp, Rattus norvegicus
agtagagagctgtcacctttttcca

SEQ ID NO: 155711 - DNA, 25 bp, Rattus norvegicus
agtagagcacgtcgccgagatgaag

SEQ ID NO: 155712 - DNA, 25 bp, Rattus norvegicus
agtagagcacgtggccgagatgaag

SEQ ID NO: 155713 - DNA, 25 bp, Rattus norvegicus
agtagagcacttatgatcacaaatt

SEQ ID NO: 155714 - DNA, 25 bp, Rattus norvegicus
agtagagcacttttgatcacaaatt

SEQ ID NO: 155715 - DNA, 25 bp, Rattus norvegicus
agtagagccagactgtagcacccag

SEQ ID NO: 155716 - DNA, 25 bp, Rattus norvegicus
agtagagccagagtgtagcacccag

SEQ ID NO: 155717 - DNA, 25 bp, Rattus norvegicus
agtagagccataccctggcgtccaa

SEQ ID NO: 155718 - DNA, 25 bp, Rattus norvegicus
agtagagccatagcctggcgtccaa

SEQ ID NO: 155719 - DNA, 25 bp, Rattus norvegicus
agtagagctctaaggtgttcctgaa

SEQ ID NO: 155720 - DNA, 25 bp, Rattus norvegicus
agtagagctctatggtgttcctgaa

SEQ ID NO: 155721 - DNA, 25 bp, Rattus norvegicus
agtagagctctcaacagtatgtttg

SEQ ID NO: 155722 - DNA, 25 bp, Rattus norvegicus
agtagagctctctacagtatgtttg

SEQ ID NO: 155723 - DNA, 25 bp, Rattus norvegicus
agtagagctgctattgtacccttag

SEQ ID NO: 155724 - DNA, 25 bp, Rattus norvegicus
agtagagctgctccggtagcatgct

SEQ ID NO: 155725 - DNA, 25 bp, Rattus norvegicus
agtagagctgctgcggtagcatgct

SEQ ID NO: 155726 - DNA, 25 bp, Rattus norvegicus
agtagagctgcttttgtacccttag

SEQ ID NO: 155727 - DNA, 25 bp, Rattus norvegicus
agtagaggaagcactggctcaccct

SEQ ID NO: 155728 - DNA, 25 bp, Rattus norvegicus
agtagaggaagctctggctcaccct

SEQ ID NO: 155729 - DNA, 25 bp, Rattus norvegicus
agtagaggacagatgggaccagccc

SEQ ID NO: 155730 - DNA, 25 bp, Rattus norvegicus
agtagaggacagttgggaccagccc

SEQ ID NO: 155731 - DNA, 25 bp, Rattus norvegicus
agtagaggacttacttcagggcccg

SEQ ID NO: 155732 - DNA, 25 bp, Rattus norvegicus
agtagaggactttcttcagggcccg

SEQ ID NO: 155733 - DNA, 25 bp, Rattus norvegicus
agtagaggcctgaagactggtagca

SEQ ID NO: 155734 - DNA, 25 bp, Rattus norvegicus
agtagaggcctgtagactggtagca

SEQ ID NO: 155735 - DNA, 25 bp, Rattus norvegicus
agtagaggctgactactgttcctcc

SEQ ID NO: 155736 - DNA, 25 bp, Rattus norvegicus
agtagaggctgagtactgttcctcc

SEQ ID NO: 155737 - DNA, 25 bp, Rattus norvegicus
agtagagtcaccattcttcagtttg

SEQ ID NO: 155738 - DNA, 25 bp, Rattus norvegicus
agtagagtcacctttcttcagtttg

SEQ ID NO: 155739 - DNA, 25 bp, Rattus norvegicus
agtagagtcttcattagtgcccgtc

SEQ ID NO: 155740 - DNA, 25 bp, Rattus norvegicus
agtagagtcttctttagtgcccgtc

SEQ ID NO: 155741 - DNA, 25 bp, Rattus norvegicus
agtagagtgcttccagctcagtcct

SEQ ID NO: 155742 - DNA, 25 bp, Rattus norvegicus
agtagagtgcttgcagctcagtcct

SEQ ID NO: 155743 - DNA, 25 bp, Rattus norvegicus
agtagagtggtgactgtctgtcgac

SEQ ID NO: 155744 - DNA, 25 bp, Rattus norvegicus
agtagagtggtgtctgtctgtcgac

SEQ ID NO: 155745 - DNA, 25 bp, Rattus norvegicus
agtagataagcgagcgaggacaagc

SEQ ID NO: 155746 - DNA, 25 bp, Rattus norvegicus
agtagataagcgtgcgaggacaagc

SEQ ID NO: 155747 - DNA, 25 bp, Rattus norvegicus
agtagataccgcagtgccacttaac

SEQ ID NO: 155748 - DNA, 25 bp, Rattus norvegicus
agtagataccgctgtgccacttaac

SEQ ID NO: 155749 - DNA, 25 bp, Rattus norvegicus
agtagataggacaccccagggacat

SEQ ID NO: 155750 - DNA, 25 bp, Rattus norvegicus
agtagataggactccccagggacat

SEQ ID NO: 155751 - DNA, 25 bp, Rattus norvegicus
agtagatatctcatggtccatattt

SEQ ID NO: 155752 - DNA, 25 bp, Rattus norvegicus
agtagatatctcttggtccatattt

SEQ ID NO: 155753 - DNA, 25 bp, Rattus norvegicus
agtagatatggtatcgttccgattc

SEQ ID NO: 155754 - DNA, 25 bp, Rattus norvegicus
agtagatatggtttcgttccgattc

SEQ ID NO: 155755 - DNA, 25 bp, Rattus norvegicus
agtagatcagcacatttcggcctca

SEQ ID NO: 155756 - DNA, 25 bp, Rattus norvegicus
agtagatcagcagatttcggcctca

SEQ ID NO: 155757 - DNA, 25 bp, Rattus norvegicus
agtagatccatgcttatcaccttgc

SEQ ID NO: 155758 - DNA, 25 bp, Rattus norvegicus
agtagatccatggttatcaccttgc

SEQ ID NO: 155759 - DNA, 25 bp, Rattus norvegicus
agtagatcccaaaaaccgtgccgcg

SEQ ID NO: 155760 - DNA, 25 bp, Rattus norvegicus
agtagatcccaataaccgtgccgcg

SEQ ID NO: 155761 - DNA, 25 bp, Rattus norvegicus
agtagatcttgtcctacccaaccct

SEQ ID NO: 155762 - DNA, 25 bp, Rattus norvegicus
agtagatcttgtgctacccaaccct

SEQ ID NO: 155763 - DNA, 25 bp, Rattus norvegicus
agtagatgaagaccggatccccaac

SEQ ID NO: 155764 - DNA, 25 bp, Rattus norvegicus
agtagatgaagagcggatccccaac

SEQ ID NO: 155765 - DNA, 25 bp, Rattus norvegicus
agtagatgactcctggctccagcat

SEQ ID NO: 155766 - DNA, 25 bp, Rattus norvegicus
agtagatgactcgtggctccagcat

SEQ ID NO: 155767 - DNA, 25 bp, Rattus norvegicus
agtagatgggttcatcctcctcctc

SEQ ID NO: 155768 - DNA, 25 bp, Rattus norvegicus
agtagatgggttgatcctcctcctc

SEQ ID NO: 155769 - DNA, 25 bp, Rattus norvegicus
agtagatggtatcaccacctgccag

SEQ ID NO: 155770 - DNA, 25 bp, Rattus norvegicus
agtagatggtatgaccacctgccag

SEQ ID NO: 155771 - DNA, 25 bp, Rattus norvegicus
agtagattcctgatggttggccaag

SEQ ID NO: 155772 - DNA, 25 bp, Rattus norvegicus
agtagattcctgttggttggccaag

SEQ ID NO: 155773 - DNA, 25 bp, Rattus norvegicus
agtagatttggcacagggactgtca

SEQ ID NO: 155774 - DNA, 25 bp, Rattus norvegicus
agtagatttggctcagggactgtca

SEQ ID NO: 155775 - DNA, 25 bp, Rattus norvegicus
agtagattttcaccctctcagcagc

SEQ ID NO: 155776 - DNA, 25 bp, Rattus norvegicus
agtagattttcagcctctcagcagc

SEQ ID NO: 155777 - DNA, 25 bp, Rattus norvegicus
agtagcaaatacattgatcccagca

SEQ ID NO: 155778 - DNA, 25 bp, Rattus norvegicus
agtagcaaatactttgatcccagca

SEQ ID NO: 155779 - DNA, 25 bp, Rattus norvegicus
agtagcaaccacaaccatttaaaag

SEQ ID NO: 155780 - DNA, 25 bp, Rattus norvegicus
agtagcaaccactaccatttaaaag

SEQ ID NO: 155781 - DNA, 25 bp, Rattus norvegicus
agtagcaacctcagatatcctgaat

SEQ ID NO: 155782 - DNA, 25 bp, Rattus norvegicus
agtagcaacctctgatatcctgaat

SEQ ID NO: 155783 - DNA, 25 bp, Rattus norvegicus
agtagcaagagaccaaacccacctt

SEQ ID NO: 155784 - DNA, 25 bp, Rattus norvegicus
agtagcaagagagcaaacccacctt

SEQ ID NO: 155785 - DNA, 25 bp, Rattus norvegicus
agtagcacataccttcaagctcttt

SEQ ID NO: 155786 - DNA, 25 bp, Rattus norvegicus
agtagcacatacgttcaagctcttt

SEQ ID NO: 155787 - DNA, 25 bp, Rattus norvegicus
agtagcacgatgctgttctcttgta

SEQ ID NO: 155788 - DNA, 25 bp, Rattus norvegicus
agtagcacgatggtgttctcttgta

SEQ ID NO: 155789 - DNA, 25 bp, Rattus norvegicus
agtagcactgcacccattactgaca

SEQ ID NO: 155790 - DNA, 25 bp, Rattus norvegicus
agtagcactgcagccattactgaca

SEQ ID NO: 155791 - DNA, 25 bp, Rattus norvegicus
agtagcactgctcaacgttggtttt

SEQ ID NO: 155792 - DNA, 25 bp, Rattus norvegicus
agtagcactgctgaacgttggtttt

SEQ ID NO: 155793 - DNA, 25 bp, Rattus norvegicus
agtagcagagcccacgacgaagaaa

SEQ ID NO: 155794 - DNA, 25 bp, Rattus norvegicus
agtagcagagccgacgacgaagaaa

SEQ ID NO: 155795 - DNA, 25 bp, Rattus norvegicus
agtagcagcagactggactgcacag

SEQ ID NO: 155796 - DNA, 25 bp, Rattus norvegicus
agtagcagcagagtggactgcacag

SEQ ID NO: 155797 - DNA, 25 bp, Rattus norvegicus
agtagcagcatcacctttcaataaa

SEQ ID NO: 155798 - DNA, 25 bp, Rattus norvegicus
agtagcagcatctcctttcaataaa

SEQ ID NO: 155799 - DNA, 25 bp, Rattus norvegicus
agtagcagccatcctgccgttcttg

SEQ ID NO: 155800 - DNA, 25 bp, Rattus norvegicus
agtagcagccatgctgccgttcttg

SEQ ID NO: 155801 - DNA, 25 bp, Rattus norvegicus
agtagcagccccatctgggatctgt

SEQ ID NO: 155802 - DNA, 25 bp, Rattus norvegicus
agtagcagccccttctgggatctgt

SEQ ID NO: 155803 - DNA, 25 bp, Rattus norvegicus
agtagcaggaagcagctccgccatt

SEQ ID NO: 155804 - DNA, 25 bp, Rattus norvegicus
agtagcaggaaggagctccgccatt

SEQ ID NO: 155805 - DNA, 25 bp, Rattus norvegicus
agtagcaggcgaagactcagactct

SEQ ID NO: 155806 - DNA, 25 bp, Rattus norvegicus
agtagcaggcgatgactcagactct

SEQ ID NO: 155807 - DNA, 25 bp, Rattus norvegicus
agtagcagggttcagccttcccgtc

SEQ ID NO: 155808 - DNA, 25 bp, Rattus norvegicus
agtagcagggttgagccttcccgtc

SEQ ID NO: 155809 - DNA, 25 bp, Rattus norvegicus
agtagcagtggtacttcttccagac

SEQ ID NO: 155810 - DNA, 25 bp, Rattus norvegicus
agtagcagtggttcttcttccagac

SEQ ID NO: 155811 - DNA, 25 bp, Rattus norvegicus
agtagcagttttaccctgcaacctt

SEQ ID NO: 155812 - DNA, 25 bp, Rattus norvegicus
agtagcagtttttccctgcaacctt

SEQ ID NO: 155813 - DNA, 25 bp, Rattus norvegicus
agtagcatcagcatcatcttcgtcc

SEQ ID NO: 155814 - DNA, 25 bp, Rattus norvegicus
agtagcatcagcttcatcttcgtcc

SEQ ID NO: 155815 - DNA, 25 bp, Rattus norvegicus
agtagcatccttataaccgttcaga

SEQ ID NO: 155816 - DNA, 25 bp, Rattus norvegicus
agtagcatccttttaaccgttcaga

SEQ ID NO: 155817 - DNA, 25 bp, Rattus norvegicus
agtagcatgatgctttatctgtcca

SEQ ID NO: 155818 - DNA, 25 bp, Rattus norvegicus
agtagcatgatggtttatctgtcca

SEQ ID NO: 155819 - DNA, 25 bp, Rattus norvegicus
agtagcatggaacaacgcccaggct

SEQ ID NO: 155820 - DNA, 25 bp, Rattus norvegicus
agtagcatggaagaacgcccaggct

SEQ ID NO: 155821 - DNA, 25 bp, Rattus norvegicus
agtagcatggcacgatctcctacca

SEQ ID NO: 155822 - DNA, 25 bp, Rattus norvegicus
agtagcatggcaggatctcctacca

SEQ ID NO: 155823 - DNA, 25 bp, Rattus norvegicus
agtagcatggcccattaagtcccac

SEQ ID NO: 155824 - DNA, 25 bp, Rattus norvegicus
agtagcatggccgattaagtcccac

SEQ ID NO: 155825 - DNA, 25 bp, Rattus norvegicus
agtagcatttctcgacgcctgagct

SEQ ID NO: 155826 - DNA, 25 bp, Rattus norvegicus
agtagcatttctctgtgtctgtgtt

SEQ ID NO: 155827 - DNA, 25 bp, Rattus norvegicus
agtagcatttctggacgcctgagct

SEQ ID NO: 155828 - DNA, 25 bp, Rattus norvegicus
agtagcatttctgtgtgtctgtgtt

SEQ ID NO: 155829 - DNA, 25 bp, Rattus norvegicus
agtagcatttgcacggatgaattca

SEQ ID NO: 155830 - DNA, 25 bp, Rattus norvegicus
agtagcatttgctcggatgaattca

SEQ ID NO: 155831 - DNA, 25 bp, Rattus norvegicus
agtagcattttaagttcccactctg

SEQ ID NO: 155832 - DNA, 25 bp, Rattus norvegicus
agtagcattttatgttcccactctg

SEQ ID NO: 155833 - DNA, 25 bp, Rattus norvegicus
agtagccaaatccattctcgtgtct

SEQ ID NO: 155834 - DNA, 25 bp, Rattus norvegicus
agtagccaaatcgattctcgtgtct

SEQ ID NO: 155835 - DNA, 25 bp, Rattus norvegicus
agtagccaacatcagcagcggtcct

SEQ ID NO: 155836 - DNA, 25 bp, Rattus norvegicus
agtagccaacatccagctctttgtc

SEQ ID NO: 155837 - DNA, 25 bp, Rattus norvegicus
agtagccaacatgagcagcggtcct

SEQ ID NO: 155838 - DNA, 25 bp, Rattus norvegicus
agtagccaacatgcagctctttgtc

SEQ ID NO: 155839 - DNA, 25 bp, Rattus norvegicus
agtagccaacttattccagatcaaa

SEQ ID NO: 155840 - DNA, 25 bp, Rattus norvegicus
agtagccaactttttccagatcaaa

SEQ ID NO: 155841 - DNA, 25 bp, Rattus norvegicus
agtagccaagcccatctctcaggga

SEQ ID NO: 155842 - DNA, 25 bp, Rattus norvegicus
agtagccaagccgatctctcaggga

SEQ ID NO: 155843 - DNA, 25 bp, Rattus norvegicus
agtagccaaggaagttgccaccttc

SEQ ID NO: 155844 - DNA, 25 bp, Rattus norvegicus
agtagccaaggatgttgccaccttc

SEQ ID NO: 155845 - DNA, 25 bp, Rattus norvegicus
agtagccaaggtctttcttccagcc

SEQ ID NO: 155846 - DNA, 25 bp, Rattus norvegicus
agtagccaaggtgtttcttccagcc

SEQ ID NO: 155847 - DNA, 25 bp, Rattus norvegicus
agtagccaccgtccaatctctgtag

SEQ ID NO: 155848 - DNA, 25 bp, Rattus norvegicus
agtagccaccgtgcaatctctgtag

SEQ ID NO: 155849 - DNA, 25 bp, Rattus norvegicus
agtagccagcccaagtatttactgc

SEQ ID NO: 155850 - DNA, 25 bp, Rattus norvegicus
agtagccagccctagtatttactgc

SEQ ID NO: 155851 - DNA, 25 bp, Rattus norvegicus
agtagccaggaaagcaatgcccatt

SEQ ID NO: 155852 - DNA, 25 bp, Rattus norvegicus
agtagccaggaatgcaatgcccatt

SEQ ID NO: 155853 - DNA, 25 bp, Rattus norvegicus
agtagccaggctagaactcttgaat

SEQ ID NO: 155854 - DNA, 25 bp, Rattus norvegicus
agtagccaggcttgaactcttgaat

SEQ ID NO: 155855 - DNA, 25 bp, Rattus norvegicus
agtagccagggccagtcagcatcct

SEQ ID NO: 155856 - DNA, 25 bp, Rattus norvegicus
agtagccagggcgagtcagcatcct

SEQ ID NO: 155857 - DNA, 25 bp, Rattus norvegicus
agtagccagtacacactagcgttat

SEQ ID NO: 155858 - DNA, 25 bp, Rattus norvegicus
agtagccagtactcactagcgttat

SEQ ID NO: 155859 - DNA, 25 bp, Rattus norvegicus
agtagccatactaccatttttaatt

SEQ ID NO: 155860 - DNA, 25 bp, Rattus norvegicus
agtagccatacttccatttttaatt

SEQ ID NO: 155861 - DNA, 25 bp, Rattus norvegicus
agtagccatgggagtactcttctgt

SEQ ID NO: 155862 - DNA, 25 bp, Rattus norvegicus
agtagccatgggtgtactcttctgt

SEQ ID NO: 155863 - DNA, 25 bp, Rattus norvegicus
agtagccattagattatcaggagac

SEQ ID NO: 155864 - DNA, 25 bp, Rattus norvegicus
agtagccattagtttatcaggagac

SEQ ID NO: 155865 - DNA, 25 bp, Rattus norvegicus
agtagccccaagctcacagaactaa

SEQ ID NO: 155866 - DNA, 25 bp, Rattus norvegicus
agtagccccaaggtcacagaactaa

SEQ ID NO: 155867 - DNA, 25 bp, Rattus norvegicus
agtagccccagtctacaagatttgc

SEQ ID NO: 155868 - DNA, 25 bp, Rattus norvegicus
agtagccccagtgtacaagatttgc

SEQ ID NO: 155869 - DNA, 25 bp, Rattus norvegicus
agtagccctagcaacacaggcccaa

SEQ ID NO: 155870 - DNA, 25 bp, Rattus norvegicus
agtagccctagctacacaggcccaa

SEQ ID NO: 155871 - DNA, 25 bp, Rattus norvegicus
agtagccctcttaatcatcttgttt

SEQ ID NO: 155872 - DNA, 25 bp, Rattus norvegicus
agtagccctctttatcatcttgttt

SEQ ID NO: 155873 - DNA, 25 bp, Rattus norvegicus
agtagccctgcactgtgtggtagat

SEQ ID NO: 155874 - DNA, 25 bp, Rattus norvegicus
agtagccctgcagtgtgtggtagat

SEQ ID NO: 155875 - DNA, 25 bp, Rattus norvegicus
agtagccctggcacttgacagcctg

SEQ ID NO: 155876 - DNA, 25 bp, Rattus norvegicus
agtagccctggctcttgacagcctg

SEQ ID NO: 155877 - DNA, 25 bp, Rattus norvegicus
agtagcccttccattcttgaaatga

SEQ ID NO: 155878 - DNA, 25 bp, Rattus norvegicus
agtagcccttcctttcttgaaatga

SEQ ID NO: 155879 - DNA, 25 bp, Rattus norvegicus
agtagccgaactcatgctgggaccc

SEQ ID NO: 155880 - DNA, 25 bp, Rattus norvegicus
agtagccgaactgatgctgggaccc

SEQ ID NO: 155881 - DNA, 25 bp, Rattus norvegicus
agtagcctacttacctctgtgtgag

SEQ ID NO: 155882 - DNA, 25 bp, Rattus norvegicus
agtagcctactttcctctgtgtgag

SEQ ID NO: 155883 - DNA, 25 bp, Rattus norvegicus
agtagcctatctcgagcacagcctg

SEQ ID NO: 155884 - DNA, 25 bp, Rattus norvegicus
agtagcctatctggagcacagcctg

SEQ ID NO: 155885 - DNA, 25 bp, Rattus norvegicus
agtagcctcaagatcttaaccgctc

SEQ ID NO: 155886 - DNA, 25 bp, Rattus norvegicus
agtagcctcaagttcttaaccgctc

SEQ ID NO: 155887 - DNA, 25 bp, Rattus norvegicus
agtagcctcagaatgcagggagcca

SEQ ID NO: 155888 - DNA, 25 bp, Rattus norvegicus
agtagcctcagattgcagggagcca

SEQ ID NO: 155889 - DNA, 25 bp, Rattus norvegicus
agtagcctcctcattcacaggcgag

SEQ ID NO: 155890 - DNA, 25 bp, Rattus norvegicus
agtagcctcctctttcacaggcgag

SEQ ID NO: 155891 - DNA, 25 bp, Rattus norvegicus
agtagccttaagcagtcaccgttta

SEQ ID NO: 155892 - DNA, 25 bp, Rattus norvegicus
agtagccttaaggagtcaccgttta

SEQ ID NO: 155893 - DNA, 25 bp, Rattus norvegicus
agtagccttacaattaacgtccgag

SEQ ID NO: 155894 - DNA, 25 bp, Rattus norvegicus
agtagccttacatttaacgtccgag

SEQ ID NO: 155895 - DNA, 25 bp, Rattus norvegicus
agtagccttagcattcacaggtgcc

SEQ ID NO: 155896 - DNA, 25 bp, Rattus norvegicus
agtagccttagctttcacaggtgcc

SEQ ID NO: 155897 - DNA, 25 bp, Rattus norvegicus
agtagccttccaactgtcagtctgt

SEQ ID NO: 155898 - DNA, 25 bp, Rattus norvegicus
agtagccttccatctgtcagtctgt

SEQ ID NO: 155899 - DNA, 25 bp, Rattus norvegicus
agtagccttctaatcagttctttct

SEQ ID NO: 155900 - DNA, 25 bp, Rattus norvegicus
agtagccttctattcagttctttct

SEQ ID NO: 155901 - DNA, 25 bp, Rattus norvegicus
agtagccttggcagagatctcatgg

SEQ ID NO: 155902 - DNA, 25 bp, Rattus norvegicus
agtagccttggctgagatctcatgg

SEQ ID NO: 155903 - DNA, 25 bp, Rattus norvegicus
agtagcctttggacaagggccctgt

SEQ ID NO: 155904 - DNA, 25 bp, Rattus norvegicus
agtagcctttggtcaagggccctgt

SEQ ID NO: 155905 - DNA, 25 bp, Rattus norvegicus
agtagcgaccctccggagtgtaaag

SEQ ID NO: 155906 - DNA, 25 bp, Rattus norvegicus
agtagcgaccctgcggagtgtaaag

SEQ ID NO: 155907 - DNA, 25 bp, Rattus norvegicus
agtagcgcagttccctgttttaggg

SEQ ID NO: 155908 - DNA, 25 bp, Rattus norvegicus
agtagcgcagttgcctgttttaggg

SEQ ID NO: 155909 - DNA, 25 bp, Rattus norvegicus
agtagcgcccacaaaatcctgggta

SEQ ID NO: 155910 - DNA, 25 bp, Rattus norvegicus
agtagcgcccactaaatcctgggta

SEQ ID NO: 155911 - DNA, 25 bp, Rattus norvegicus
agtagcgcgcagcacttggaagtca

SEQ ID NO: 155912 - DNA, 25 bp, Rattus norvegicus
agtagcgcgcaggacttggaagtca

SEQ ID NO: 155913 - DNA, 25 bp, Rattus norvegicus
agtagcggcttgaagcggctcagca

SEQ ID NO: 155914 - DNA, 25 bp, Rattus norvegicus
agtagcggcttgtagcggctcagca

SEQ ID NO: 155915 - DNA, 25 bp, Rattus norvegicus
agtagcgtcctaattttggcaacta

SEQ ID NO: 155916 - DNA, 25 bp, Rattus norvegicus
agtagcgtcctatttttggcaacta

SEQ ID NO: 155917 - DNA, 25 bp, Rattus norvegicus
agtagcgtgagaactgccacacata

SEQ ID NO: 155918 - DNA, 25 bp, Rattus norvegicus
agtagcgtgagatctgccacacata

SEQ ID NO: 155919 - DNA, 25 bp, Rattus norvegicus
agtagctaagcaccccgtgaacgag

SEQ ID NO: 155920 - DNA, 25 bp, Rattus norvegicus
agtagctaagcagcccgtgaacgag

SEQ ID NO: 155921 - DNA, 25 bp, Rattus norvegicus
agtagctaaggaaccagggccacaa

SEQ ID NO: 155922 - DNA, 25 bp, Rattus norvegicus
agtagctaaggatccagggccacaa

SEQ ID NO: 155923 - DNA, 25 bp, Rattus norvegicus
agtagctagtctcggctttcaagaa

SEQ ID NO: 155924 - DNA, 25 bp, Rattus norvegicus
agtagctagtctgggctttcaagaa

SEQ ID NO: 155925 - DNA, 25 bp, Rattus norvegicus
agtagctcaccacagtgggttccgc

SEQ ID NO: 155926 - DNA, 25 bp, Rattus norvegicus
agtagctcaccagagtgggttccgc

SEQ ID NO: 155927 - DNA, 25 bp, Rattus norvegicus
agtagctcacctcgaagcacagggc

SEQ ID NO: 155928 - DNA, 25 bp, Rattus norvegicus
agtagctcacctggaagcacagggc

SEQ ID NO: 155929 - DNA, 25 bp, Rattus norvegicus
agtagctcagccaaacgtctttcgt

SEQ ID NO: 155930 - DNA, 25 bp, Rattus norvegicus
agtagctcagcctaacgtctttcgt

SEQ ID NO: 155931 - DNA, 25 bp, Rattus norvegicus
agtagctcaggtcttagtgtcttag

SEQ ID NO: 155932 - DNA, 25 bp, Rattus norvegicus
agtagctcaggtgttagtgtcttag

SEQ ID NO: 155933 - DNA, 25 bp, Rattus norvegicus
agtagctcatttcaccaattattgt

SEQ ID NO: 155934 - DNA, 25 bp, Rattus norvegicus
agtagctcatttgaccaattattgt

SEQ ID NO: 155935 - DNA, 25 bp, Rattus norvegicus
agtagctccattatgatcttccttc

SEQ ID NO: 155936 - DNA, 25 bp, Rattus norvegicus
agtagctccattttgatcttccttc

SEQ ID NO: 155937 - DNA, 25 bp, Rattus norvegicus
agtagctccttgagctgtgacagca

SEQ ID NO: 155938 - DNA, 25 bp, Rattus norvegicus
agtagctccttgtgctgtgacagca

SEQ ID NO: 155939 - DNA, 25 bp, Rattus norvegicus
agtagctcctttcccttttgaagat

SEQ ID NO: 155940 - DNA, 25 bp, Rattus norvegicus
agtagctcctttgccttttgaagat

SEQ ID NO: 155941 - DNA, 25 bp, Rattus norvegicus
agtagctctaagaaacccattcctc

SEQ ID NO: 155942 - DNA, 25 bp, Rattus norvegicus
agtagctctaagtaacccattcctc

SEQ ID NO: 155943 - DNA, 25 bp, Rattus norvegicus
agtagctctgttccaagaaccaggg

SEQ ID NO: 155944 - DNA, 25 bp, Rattus norvegicus
agtagctctgttgcaagaaccaggg

SEQ ID NO: 155945 - DNA, 25 bp, Rattus norvegicus
agtagctgagccctcctgctgcgaa

SEQ ID NO: 155946 - DNA, 25 bp, Rattus norvegicus
agtagctgagccgtcctgctgcgaa

SEQ ID NO: 155947 - DNA, 25 bp, Rattus norvegicus
agtagctgataccagctgcacctga

SEQ ID NO: 155948 - DNA, 25 bp, Rattus norvegicus
agtagctgatacgagctgcacctga

SEQ ID NO: 155949 - DNA, 25 bp, Rattus norvegicus
agtagctgatgcagtcacgtaccag

SEQ ID NO: 155950 - DNA, 25 bp, Rattus norvegicus
agtagctgatgctgtcacgtaccag

SEQ ID NO: 155951 - DNA, 25 bp, Rattus norvegicus
agtagctgcatgatctgttatcaag

SEQ ID NO: 155952 - DNA, 25 bp, Rattus norvegicus
agtagctgcatgttctgttatcaag

SEQ ID NO: 155953 - DNA, 25 bp, Rattus norvegicus
agtagctgccacatctgttcaacct

SEQ ID NO: 155954 - DNA, 25 bp, Rattus norvegicus
agtagctgccacttctgttcaacct

SEQ ID NO: 155955 - DNA, 25 bp, Rattus norvegicus
agtagctgccggctgatgctaacac

SEQ ID NO: 155956 - DNA, 25 bp, Rattus norvegicus
agtagctgccgggtgatgctaacac

SEQ ID NO: 155957 - DNA, 25 bp, Rattus norvegicus
agtagctgctatactccttgcctgt

SEQ ID NO: 155958 - DNA, 25 bp, Rattus norvegicus
agtagctgctattctccttgcctgt

SEQ ID NO: 155959 - DNA, 25 bp, Rattus norvegicus
agtagctggcacatggctctgtctc

SEQ ID NO: 155960 - DNA, 25 bp, Rattus norvegicus
agtagctggcacttggctctgtctc

SEQ ID NO: 155961 - DNA, 25 bp, Rattus norvegicus
agtagctgtaataggcctggccaca

SEQ ID NO: 155962 - DNA, 25 bp, Rattus norvegicus
agtagctgtaattggcctggccaca

SEQ ID NO: 155963 - DNA, 25 bp, Rattus norvegicus
agtagctgtagactcctcggtcggt

SEQ ID NO: 155964 - DNA, 25 bp, Rattus norvegicus
agtagctgtagagtcctcggtcggt

SEQ ID NO: 155965 - DNA, 25 bp, Rattus norvegicus
agtagctgtcatcgtcactgcattc

SEQ ID NO: 155966 - DNA, 25 bp, Rattus norvegicus
agtagctgtcatggtcactgcattc

SEQ ID NO: 155967 - DNA, 25 bp, Rattus norvegicus
agtagctgtctcaatttcattttta

SEQ ID NO: 155968 - DNA, 25 bp, Rattus norvegicus
agtagctgtctctatttcattttta

SEQ ID NO: 155969 - DNA, 25 bp, Rattus norvegicus
agtagctgtttacactgctggtccc

SEQ ID NO: 155970 - DNA, 25 bp, Rattus norvegicus
agtagctgtttagactgctggtccc

SEQ ID NO: 155971 - DNA, 25 bp, Rattus norvegicus
agtagctgtttgaaatccccgcctg

SEQ ID NO: 155972 - DNA, 25 bp, Rattus norvegicus
agtagctgtttgtaatccccgcctg

SEQ ID NO: 155973 - DNA, 25 bp, Rattus norvegicus
agtagcttacgtcggctttcctctg

SEQ ID NO: 155974 - DNA, 25 bp, Rattus norvegicus
agtagcttacgtgggctttcctctg

SEQ ID NO: 155975 - DNA, 25 bp, Rattus norvegicus
agtagcttcatgcacactaaccaac

SEQ ID NO: 155976 - DNA, 25 bp, Rattus norvegicus
agtagcttcatggacactaaccaac

SEQ ID NO: 155977 - DNA, 25 bp, Rattus norvegicus
agtagcttcctgaattaacagcggt

SEQ ID NO: 155978 - DNA, 25 bp, Rattus norvegicus
agtagcttcctgtattaacagcggt

SEQ ID NO: 155979 - DNA, 25 bp, Rattus norvegicus
agtagcttgcttaggaattcactgt

SEQ ID NO: 155980 - DNA, 25 bp, Rattus norvegicus
agtagcttgcttctgctttccctgg

SEQ ID NO: 155981 - DNA, 25 bp, Rattus norvegicus
agtagcttgcttgtgctttccctgg

SEQ ID NO: 155982 - DNA, 25 bp, Rattus norvegicus
agtagcttgctttggaattcactgt

SEQ ID NO: 155983 - DNA, 25 bp, Rattus norvegicus
agtagcttggtaacacagtgtattc

SEQ ID NO: 155984 - DNA, 25 bp, Rattus norvegicus
agtagcttggtatcacagtgtattc

SEQ ID NO: 155985 - DNA, 25 bp, Rattus norvegicus
agtagcttgtgtatggaggcagacc

SEQ ID NO: 155986 - DNA, 25 bp, Rattus norvegicus
agtagcttgtgtttggaggcagacc

SEQ ID NO: 155987 - DNA, 25 bp, Rattus norvegicus
agtagctttagcatcttagaccctt

SEQ ID NO: 155988 - DNA, 25 bp, Rattus norvegicus
agtagctttagcttcttagaccctt

SEQ ID NO: 155989 - DNA, 25 bp, Rattus norvegicus
agtagctttcagcaaggcccctatg

SEQ ID NO: 155990 - DNA, 25 bp, Rattus norvegicus
agtagctttcaggaaggcccctatg

SEQ ID NO: 155991 - DNA, 25 bp, Rattus norvegicus
agtagctttgctattcgagatttgt

SEQ ID NO: 155992 - DNA, 25 bp, Rattus norvegicus
agtagctttgcttttcgagatttgt

SEQ ID NO: 155993 - DNA, 25 bp, Rattus norvegicus
agtagcttttttcatctcttagtga

SEQ ID NO: 155994 - DNA, 25 bp, Rattus norvegicus
agtagcttttttgatctcttagtga

SEQ ID NO: 155995 - DNA, 25 bp, Rattus norvegicus
agtaggaaaactcccttctgtgaag

SEQ ID NO: 155996 - DNA, 25 bp, Rattus norvegicus
agtaggaaaactgccttctgtgaag

SEQ ID NO: 155997 - DNA, 25 bp, Rattus norvegicus
agtaggaactggaggatccctttct

SEQ ID NO: 155998 - DNA, 25 bp, Rattus norvegicus
agtaggaactggtggatccctttct

SEQ ID NO: 155999 - DNA, 25 bp, Rattus norvegicus
agtaggacacttagcaggccaaccc

SEQ ID NO: 156000 - DNA, 25 bp, Rattus norvegicus
agtaggacactttgcaggccaaccc

SEQ ID NO: 156001 - DNA, 25 bp, Rattus norvegicus
agtaggacagtcctttgtcatcctt

SEQ ID NO: 156002 - DNA, 25 bp, Rattus norvegicus
agtaggacagtcgtttgtcatcctt

SEQ ID NO: 156003 - DNA, 25 bp, Rattus norvegicus
agtaggacatgtccagtcccacctg

SEQ ID NO: 156004 - DNA, 25 bp, Rattus norvegicus
agtaggacatgtgcagtcccacctg

SEQ ID NO: 156005 - DNA, 25 bp, Rattus norvegicus
agtaggaccccaacatagctagaac

SEQ ID NO: 156006 - DNA, 25 bp, Rattus norvegicus
agtaggaccccatcatagctagaac

SEQ ID NO: 156007 - DNA, 25 bp, Rattus norvegicus
agtaggactggactcaggccacatc

SEQ ID NO: 156008 - DNA, 25 bp, Rattus norvegicus
agtaggactggagtcaggccacatc

SEQ ID NO: 156009 - DNA, 25 bp, Rattus norvegicus
agtaggagccccatcttccaggact

SEQ ID NO: 156010 - DNA, 25 bp, Rattus norvegicus
agtaggagccccttcttccaggact

SEQ ID NO: 156011 - DNA, 25 bp, Rattus norvegicus
agtaggagcggcagttgtacctctc

SEQ ID NO: 156012 - DNA, 25 bp, Rattus norvegicus
agtaggagcggccatgcatcatcct

SEQ ID NO: 156013 - DNA, 25 bp, Rattus norvegicus
agtaggagcggcgatgcatcatcct

SEQ ID NO: 156014 - DNA, 25 bp, Rattus norvegicus
agtaggagcggctgttgtacctctc

SEQ ID NO: 156015 - DNA, 25 bp, Rattus norvegicus
agtaggagctatcagtgctctgctc

SEQ ID NO: 156016 - DNA, 25 bp, Rattus norvegicus
agtaggagctatgagtgctctgctc

SEQ ID NO: 156017 - DNA, 25 bp, Rattus norvegicus
agtaggagctgcaaagtcccgcgca

SEQ ID NO: 156018 - DNA, 25 bp, Rattus norvegicus
agtaggagctgctaagtcccgcgca

SEQ ID NO: 156019 - DNA, 25 bp, Rattus norvegicus
agtaggagggatactgctcttgcct

SEQ ID NO: 156020 - DNA, 25 bp, Rattus norvegicus
agtaggagggattctgctcttgcct

SEQ ID NO: 156021 - DNA, 25 bp, Rattus norvegicus
agtaggatactgacttttcttaaga

SEQ ID NO: 156022 - DNA, 25 bp, Rattus norvegicus
agtaggatactgtcttttcttaaga

SEQ ID NO: 156023 - DNA, 25 bp, Rattus norvegicus
agtaggatctttcgcgtggcatcta

SEQ ID NO: 156024 - DNA, 25 bp, Rattus norvegicus
agtaggatctttggcgtggcatcta

SEQ ID NO: 156025 - DNA, 25 bp, Rattus norvegicus
agtaggatgaagacagctgctgtgt

SEQ ID NO: 156026 - DNA, 25 bp, Rattus norvegicus
agtaggatgaagtcagctgctgtgt

SEQ ID NO: 156027 - DNA, 25 bp, Rattus norvegicus
agtaggatggaccagtggccctttt

SEQ ID NO: 156028 - DNA, 25 bp, Rattus norvegicus
agtaggatggacgagtggccctttt

SEQ ID NO: 156029 - DNA, 25 bp, Rattus norvegicus
agtaggcacagcaaatttcttcggt

SEQ ID NO: 156030 - DNA, 25 bp, Rattus norvegicus
agtaggcacagctaatttcttcggt

SEQ ID NO: 156031 - DNA, 25 bp, Rattus norvegicus
agtaggcagaaaacccagctctcag

SEQ ID NO: 156032 - DNA, 25 bp, Rattus norvegicus
agtaggcagaaactgcagccccagc

SEQ ID NO: 156033 - DNA, 25 bp, Rattus norvegicus
agtaggcagaaagtgcagccccagc

SEQ ID NO: 156034 - DNA, 25 bp, Rattus norvegicus
agtaggcagaaatcccagctctcag

SEQ ID NO: 156035 - DNA, 25 bp, Rattus norvegicus
agtaggcagtgccttgcacaccggt

SEQ ID NO: 156036 - DNA, 25 bp, Rattus norvegicus
agtaggcagtgcgttgcacaccggt

SEQ ID NO: 156037 - DNA, 25 bp, Rattus norvegicus
agtaggccatgtagaggttcctcca

SEQ ID NO: 156038 - DNA, 25 bp, Rattus norvegicus
agtaggccatgttgaggttcctcca

SEQ ID NO: 156039 - DNA, 25 bp, Rattus norvegicus
agtaggcccagtaactcagctgcgg

SEQ ID NO: 156040 - DNA, 25 bp, Rattus norvegicus
agtaggcccagttactcagctgcgg

SEQ ID NO: 156041 - DNA, 25 bp, Rattus norvegicus
agtaggcccctgagcttacttacac

SEQ ID NO: 156042 - DNA, 25 bp, Rattus norvegicus
agtaggcccctgtgcttacttacac

SEQ ID NO: 156043 - DNA, 25 bp, Rattus norvegicus
agtaggcctggccaagcagtgttct

SEQ ID NO: 156044 - DNA, 25 bp, Rattus norvegicus
agtaggcctggcgaagcagtgttct

SEQ ID NO: 156045 - DNA, 25 bp, Rattus norvegicus
agtaggccttgtatttcagctttct

SEQ ID NO: 156046 - DNA, 25 bp, Rattus norvegicus
agtaggccttgtttttcagctttct

SEQ ID NO: 156047 - DNA, 25 bp, Rattus norvegicus
agtaggcgagaacccagtctcattt

SEQ ID NO: 156048 - DNA, 25 bp, Rattus norvegicus
agtaggcgagaagccagtctcattt

SEQ ID NO: 156049 - DNA, 25 bp, Rattus norvegicus
agtaggctacagactgtgccatgtt

SEQ ID NO: 156050 - DNA, 25 bp, Rattus norvegicus
agtaggctacagtctgtgccatgtt

SEQ ID NO: 156051 - DNA, 25 bp, Rattus norvegicus
agtaggctactgatctgtgctcttg

SEQ ID NO: 156052 - DNA, 25 bp, Rattus norvegicus
agtaggctactgttctgtgctcttg

SEQ ID NO: 156053 - DNA, 25 bp, Rattus norvegicus
agtaggctatcaattctttgaaaac

SEQ ID NO: 156054 - DNA, 25 bp, Rattus norvegicus
agtaggctatcatttctttgaaaac

SEQ ID NO: 156055 - DNA, 25 bp, Rattus norvegicus
agtaggctcaagaggtggcttacct

SEQ ID NO: 156056 - DNA, 25 bp, Rattus norvegicus
agtaggctcaagtggtggcttacct

SEQ ID NO: 156057 - DNA, 25 bp, Rattus norvegicus
agtaggctctctagccaccccaggg

SEQ ID NO: 156058 - DNA, 25 bp, Rattus norvegicus
agtaggctctcttgccaccccaggg

SEQ ID NO: 156059 - DNA, 25 bp, Rattus norvegicus
agtaggcttacacatatgtcccctt

SEQ ID NO: 156060 - DNA, 25 bp, Rattus norvegicus
agtaggcttacagatatgtcccctt

SEQ ID NO: 156061 - DNA, 25 bp, Rattus norvegicus
agtaggcttcgtcccgaactggccg

SEQ ID NO: 156062 - DNA, 25 bp, Rattus norvegicus
agtaggcttcgtgccgaactggccg

SEQ ID NO: 156063 - DNA, 25 bp, Rattus norvegicus
agtagggacggtatcgtggacgctg

SEQ ID NO: 156064 - DNA, 25 bp, Rattus norvegicus
agtagggacggtttcgtggacgctg

SEQ ID NO: 156065 - DNA, 25 bp, Rattus norvegicus
agtagggactccacagacatcttga

SEQ ID NO: 156066 - DNA, 25 bp, Rattus norvegicus
agtagggactcctcagacatcttga

SEQ ID NO: 156067 - DNA, 25 bp, Rattus norvegicus
agtagggactttcggtgtacacatt

SEQ ID NO: 156068 - DNA, 25 bp, Rattus norvegicus
agtagggactttgggtgtacacatt

SEQ ID NO: 156069 - DNA, 25 bp, Rattus norvegicus
agtagggagcagacgccgctgttcc

SEQ ID NO: 156070 - DNA, 25 bp, Rattus norvegicus
agtagggagcagtcgccgctgttcc

SEQ ID NO: 156071 - DNA, 25 bp, Rattus norvegicus
agtagggagcccaagctgcccatag

SEQ ID NO: 156072 - DNA, 25 bp, Rattus norvegicus
agtagggagccctagctgcccatag

SEQ ID NO: 156073 - DNA, 25 bp, Rattus norvegicus
agtagggaggctctcctcctggaaa

SEQ ID NO: 156074 - DNA, 25 bp, Rattus norvegicus
agtagggaggctgtcctcctggaaa

SEQ ID NO: 156075 - DNA, 25 bp, Rattus norvegicus
agtagggatgtgagggcctcaactc

SEQ ID NO: 156076 - DNA, 25 bp, Rattus norvegicus
agtagggatgtgtgggcctcaactc

SEQ ID NO: 156077 - DNA, 25 bp, Rattus norvegicus
agtagggcagccacacagaccagag

SEQ ID NO: 156078 - DNA, 25 bp, Rattus norvegicus
agtagggcagcctcacagaccagag

SEQ ID NO: 156079 - DNA, 25 bp, Rattus norvegicus
agtagggcagtcagcacctggcacc

SEQ ID NO: 156080 - DNA, 25 bp, Rattus norvegicus
agtagggcagtctgcacctggcacc

SEQ ID NO: 156081 - DNA, 25 bp, Rattus norvegicus
agtagggccagacgcaagcgtcacc

SEQ ID NO: 156082 - DNA, 25 bp, Rattus norvegicus
agtagggccagaggcaagcgtcacc

SEQ ID NO: 156083 - DNA, 25 bp, Rattus norvegicus
agtagggccctcagtgaaatcatcc

SEQ ID NO: 156084 - DNA, 25 bp, Rattus norvegicus
agtagggccctctgtgaaatcatcc

SEQ ID NO: 156085 - DNA, 25 bp, Rattus norvegicus
agtagggccttaccagataatgttt

SEQ ID NO: 156086 - DNA, 25 bp, Rattus norvegicus
agtagggccttagcagataatgttt

SEQ ID NO: 156087 - DNA, 25 bp, Rattus norvegicus
agtagggcttcacgaggctcacatg

SEQ ID NO: 156088 - DNA, 25 bp, Rattus norvegicus
agtagggcttcaggaggctcacatg

SEQ ID NO: 156089 - DNA, 25 bp, Rattus norvegicus
agtagggtacatcgtctggagtcat

SEQ ID NO: 156090 - DNA, 25 bp, Rattus norvegicus
agtagggtacatggtctggagtcat

SEQ ID NO: 156091 - DNA, 25 bp, Rattus norvegicus
agtagggtcatcatccagtgcaagc

SEQ ID NO: 156092 - DNA, 25 bp, Rattus norvegicus
agtagggtcatcttccagtgcaagc

SEQ ID NO: 156093 - DNA, 25 bp, Rattus norvegicus
agtagggtgctgatggcaggctcag

SEQ ID NO: 156094 - DNA, 25 bp, Rattus norvegicus
agtagggtgctgttggcaggctcag

SEQ ID NO: 156095 - DNA, 25 bp, Rattus norvegicus
agtaggtatggcacttggagctcac

SEQ ID NO: 156096 - DNA, 25 bp, Rattus norvegicus
agtaggtatggctcttggagctcac

SEQ ID NO: 156097 - DNA, 25 bp, Rattus norvegicus
agtaggtcctagaatcctccgaagc

SEQ ID NO: 156098 - DNA, 25 bp, Rattus norvegicus
agtaggtcctagtatcctccgaagc

SEQ ID NO: 156099 - DNA, 25 bp, Rattus norvegicus
agtaggtccttcaatctgccgtgat

SEQ ID NO: 156100 - DNA, 25 bp, Rattus norvegicus
agtaggtccttctatctgccgtgat

SEQ ID NO: 156101 - DNA, 25 bp, Rattus norvegicus
agtaggtctggcacactctggaaga

SEQ ID NO: 156102 - DNA, 25 bp, Rattus norvegicus
agtaggtctggctcactctggaaga

SEQ ID NO: 156103 - DNA, 25 bp, Rattus norvegicus
agtaggtgctagagtccgttcacac

SEQ ID NO: 156104 - DNA, 25 bp, Rattus norvegicus
agtaggtgctagtgtccgttcacac

SEQ ID NO: 156105 - DNA, 25 bp, Rattus norvegicus
agtaggtgctgtatgataatgtgtc

SEQ ID NO: 156106 - DNA, 25 bp, Rattus norvegicus
agtaggtgctgtttgataatgtgtc

SEQ ID NO: 156107 - DNA, 25 bp, Rattus norvegicus
agtaggtggctcattgtgtcttaag

SEQ ID NO: 156108 - DNA, 25 bp, Rattus norvegicus
agtaggtggctctttgtgtcttaag

SEQ ID NO: 156109 - DNA, 25 bp, Rattus norvegicus
agtaggtgtcaacttcacatatgaa

SEQ ID NO: 156110 - DNA, 25 bp, Rattus norvegicus
agtaggtgtcaagttcacatatgaa

SEQ ID NO: 156111 - DNA, 25 bp, Rattus norvegicus
agtaggtgtcacaattgctttggaa

SEQ ID NO: 156112 - DNA, 25 bp, Rattus norvegicus
agtaggtgtcactattgctttggaa

SEQ ID NO: 156113 - DNA, 25 bp, Rattus norvegicus
agtaggttgcccagaaatctcttct

SEQ ID NO: 156114 - DNA, 25 bp, Rattus norvegicus
agtaggttgccctgaaatctcttct

SEQ ID NO: 156115 - DNA, 25 bp, Rattus norvegicus
agtagtaaccagctctagccaaggt

SEQ ID NO: 156116 - DNA, 25 bp, Rattus norvegicus
agtagtaaccaggtctagccaaggt

SEQ ID NO: 156117 - DNA, 25 bp, Rattus norvegicus
agtagtaactcccagctgtactctg

SEQ ID NO: 156118 - DNA, 25 bp, Rattus norvegicus
agtagtaactccgagctgtactctg

SEQ ID NO: 156119 - DNA, 25 bp, Rattus norvegicus
agtagtaagagtagtccttccacca

SEQ ID NO: 156120 - DNA, 25 bp, Rattus norvegicus
agtagtaagagttgtccttccacca

SEQ ID NO: 156121 - DNA, 25 bp, Rattus norvegicus
agtagtaattcaagcttagctcttt

SEQ ID NO: 156122 - DNA, 25 bp, Rattus norvegicus
agtagtaattcatgcttagctcttt

SEQ ID NO: 156123 - DNA, 25 bp, Rattus norvegicus
agtagtacacatcctaaatcctggc

SEQ ID NO: 156124 - DNA, 25 bp, Rattus norvegicus
agtagtacacatgctaaatcctggc

SEQ ID NO: 156125 - DNA, 25 bp, Rattus norvegicus
agtagtacagccaagcccacacttt

SEQ ID NO: 156126 - DNA, 25 bp, Rattus norvegicus
agtagtacagcctagcccacacttt

SEQ ID NO: 156127 - DNA, 25 bp, Rattus norvegicus
agtagtaccagccagtcggagaaag

SEQ ID NO: 156128 - DNA, 25 bp, Rattus norvegicus
agtagtaccagcgagtcggagaaag

SEQ ID NO: 156129 - DNA, 25 bp, Rattus norvegicus
agtagtactgacacgtgtttcctag

SEQ ID NO: 156130 - DNA, 25 bp, Rattus norvegicus
agtagtactgactcgtgtttcctag

SEQ ID NO: 156131 - DNA, 25 bp, Rattus norvegicus
agtagtacttggctgcatacctttc

SEQ ID NO: 156132 - DNA, 25 bp, Rattus norvegicus
agtagtacttgggtgcatacctttc

SEQ ID NO: 156133 - DNA, 25 bp, Rattus norvegicus
agtagtagccacattgggttcctgt

SEQ ID NO: 156134 - DNA, 25 bp, Rattus norvegicus
agtagtagccactttgggttcctgt

SEQ ID NO: 156135 - DNA, 25 bp, Rattus norvegicus
agtagtaggctactggcccagcatg

SEQ ID NO: 156136 - DNA, 25 bp, Rattus norvegicus
agtagtaggctagtggcccagcatg

SEQ ID NO: 156137 - DNA, 25 bp, Rattus norvegicus
agtagtagttttcgtgctctgacaa

SEQ ID NO: 156138 - DNA, 25 bp, Rattus norvegicus
agtagtagttttggtgctctgacaa

SEQ ID NO: 156139 - DNA, 25 bp, Rattus norvegicus
agtagtatagggaccttccgcacaa

SEQ ID NO: 156140 - DNA, 25 bp, Rattus norvegicus
agtagtatagggtccttccgcacaa

SEQ ID NO: 156141 - DNA, 25 bp, Rattus norvegicus
agtagtatggccctcccagagccca

SEQ ID NO: 156142 - DNA, 25 bp, Rattus norvegicus
agtagtatggccgtcccagagccca

SEQ ID NO: 156143 - DNA, 25 bp, Rattus norvegicus
agtagtattgatccagccacactgc

SEQ ID NO: 156144 - DNA, 25 bp, Rattus norvegicus
agtagtattgatgcagccacactgc

SEQ ID NO: 156145 - DNA, 25 bp, Rattus norvegicus
agtagtatttgaacactccctccat

SEQ ID NO: 156146 - DNA, 25 bp, Rattus norvegicus
agtagtatttgatcactccctccat

SEQ ID NO: 156147 - DNA, 25 bp, Rattus norvegicus
agtagtcaaactacagcttcattta

SEQ ID NO: 156148 - DNA, 25 bp, Rattus norvegicus
agtagtcaaacttcagcttcattta

SEQ ID NO: 156149 - DNA, 25 bp, Rattus norvegicus
agtagtcacctgagtctgtggttaa

SEQ ID NO: 156150 - DNA, 25 bp, Rattus norvegicus
agtagtcacctgtgtctgtggttaa

SEQ ID NO: 156151 - DNA, 25 bp, Rattus norvegicus
agtagtcaggtcacctggtccagga

SEQ ID NO: 156152 - DNA, 25 bp, Rattus norvegicus
agtagtcaggtctcctggtccagga

SEQ ID NO: 156153 - DNA, 25 bp, Rattus norvegicus
agtagtcccaaaagccttaggcctg

SEQ ID NO: 156154 - DNA, 25 bp, Rattus norvegicus
agtagtcccaaatgccttaggcctg

SEQ ID NO: 156155 - DNA, 25 bp, Rattus norvegicus
agtagtccccttactttggcttcat

SEQ ID NO: 156156 - DNA, 25 bp, Rattus norvegicus
agtagtcccctttctttggcttcat

SEQ ID NO: 156157 - DNA, 25 bp, Rattus norvegicus
agtagtcctcttatccaccttagag

SEQ ID NO: 156158 - DNA, 25 bp, Rattus norvegicus
agtagtcctcttttccaccttagag

SEQ ID NO: 156159 - DNA, 25 bp, Rattus norvegicus
agtagtcgagatactattgtcctgt

SEQ ID NO: 156160 - DNA, 25 bp, Rattus norvegicus
agtagtcgagattctattgtcctgt

SEQ ID NO: 156161 - DNA, 25 bp, Rattus norvegicus
agtagtcgtgtcacctggcaaccaa

SEQ ID NO: 156162 - DNA, 25 bp, Rattus norvegicus
agtagtcgtgtctcctggcaaccaa

SEQ ID NO: 156163 - DNA, 25 bp, Rattus norvegicus
agtagtctagaccatgcctgctgca

SEQ ID NO: 156164 - DNA, 25 bp, Rattus norvegicus
agtagtctagacgatgcctgctgca

SEQ ID NO: 156165 - DNA, 25 bp, Rattus norvegicus
agtagtctatacctcccaggttata

SEQ ID NO: 156166 - DNA, 25 bp, Rattus norvegicus
agtagtctatacgtcccaggttata

SEQ ID NO: 156167 - DNA, 25 bp, Rattus norvegicus
agtagtctatgaagcagcctcggtt

SEQ ID NO: 156168 - DNA, 25 bp, Rattus norvegicus
agtagtctatgatgcagcctcggtt

SEQ ID NO: 156169 - DNA, 25 bp, Rattus norvegicus
agtagtctcaaaactttcctcataa

SEQ ID NO: 156170 - DNA, 25 bp, Rattus norvegicus
agtagtctcaaatctttcctcataa

SEQ ID NO: 156171 - DNA, 25 bp, Rattus norvegicus
agtagtctcccaaggctggctgaca

SEQ ID NO: 156172 - DNA, 25 bp, Rattus norvegicus
agtagtctcccatggctggctgaca

SEQ ID NO: 156173 - DNA, 25 bp, Rattus norvegicus
agtagtctctgacctctgaatcact

SEQ ID NO: 156174 - DNA, 25 bp, Rattus norvegicus
agtagtctctgagctctgaatcact

SEQ ID NO: 156175 - DNA, 25 bp, Rattus norvegicus
agtagtctgggtccttctacatcaa

SEQ ID NO: 156176 - DNA, 25 bp, Rattus norvegicus
agtagtctgggtgcttctacatcaa

SEQ ID NO: 156177 - DNA, 25 bp, Rattus norvegicus
agtagtctgtttctttgtcacccaa

SEQ ID NO: 156178 - DNA, 25 bp, Rattus norvegicus
agtagtctgtttgtttgtcacccaa

SEQ ID NO: 156179 - DNA, 25 bp, Rattus norvegicus
agtagtcttatgacctcactgctag

SEQ ID NO: 156180 - DNA, 25 bp, Rattus norvegicus
agtagtcttatgtcctcactgctag

SEQ ID NO: 156181 - DNA, 25 bp, Rattus norvegicus
agtagtcttcgtaaccatctaaaat

SEQ ID NO: 156182 - DNA, 25 bp, Rattus norvegicus
agtagtcttcgttaccatctaaaat

SEQ ID NO: 156183 - DNA, 25 bp, Rattus norvegicus
agtagtcttttaaatgccactcttg

SEQ ID NO: 156184 - DNA, 25 bp, Rattus norvegicus
agtagtcttttatatgccactcttg

SEQ ID NO: 156185 - DNA, 25 bp, Rattus norvegicus
agtagtgaaccacccatcgacttaa

SEQ ID NO: 156186 - DNA, 25 bp, Rattus norvegicus
agtagtgaaccagccatcgacttaa

SEQ ID NO: 156187 - DNA, 25 bp, Rattus norvegicus
agtagtgacgccagcctctaggagc

SEQ ID NO: 156188 - DNA, 25 bp, Rattus norvegicus
agtagtgacgcctgcctctaggagc

SEQ ID NO: 156189 - DNA, 25 bp, Rattus norvegicus
agtagtgatcacagctcgtgtccac

SEQ ID NO: 156190 - DNA, 25 bp, Rattus norvegicus
agtagtgatcactgctcgtgtccac

SEQ ID NO: 156191 - DNA, 25 bp, Rattus norvegicus
agtagtgatgacacccatgggccgg

SEQ ID NO: 156192 - DNA, 25 bp, Rattus norvegicus
agtagtgatgactcccatgggccgg

SEQ ID NO: 156193 - DNA, 25 bp, Rattus norvegicus
agtagtgatggcatcttcctcagca

SEQ ID NO: 156194 - DNA, 25 bp, Rattus norvegicus
agtagtgatggcttcttcctcagca

SEQ ID NO: 156195 - DNA, 25 bp, Rattus norvegicus
agtagtgatgtcatcctgtttatgc

SEQ ID NO: 156196 - DNA, 25 bp, Rattus norvegicus
agtagtgatgtcttcctgtttatgc

SEQ ID NO: 156197 - DNA, 25 bp, Rattus norvegicus
agtagtgattatccctgctgtgtga

SEQ ID NO: 156198 - DNA, 25 bp, Rattus norvegicus
agtagtgattatgcctgctgtgtga

SEQ ID NO: 156199 - DNA, 25 bp, Rattus norvegicus
agtagtgcattacagggctatggaa

SEQ ID NO: 156200 - DNA, 25 bp, Rattus norvegicus
agtagtgcattagagggctatggaa

SEQ ID NO: 156201 - DNA, 25 bp, Rattus norvegicus
agtagtgctaagagacacgccaaga

SEQ ID NO: 156202 - DNA, 25 bp, Rattus norvegicus
agtagtgctaagtgacacgccaaga

SEQ ID NO: 156203 - DNA, 25 bp, Rattus norvegicus
agtagtgctcctaaggtctttctgc

SEQ ID NO: 156204 - DNA, 25 bp, Rattus norvegicus
agtagtgctccttaggtctttctgc

SEQ ID NO: 156205 - DNA, 25 bp, Rattus norvegicus
agtagtgcttacatttcaggctgac

SEQ ID NO: 156206 - DNA, 25 bp, Rattus norvegicus
agtagtgcttacttttcaggctgac

SEQ ID NO: 156207 - DNA, 25 bp, Rattus norvegicus
agtagtgctttcatcttgtctcaca

SEQ ID NO: 156208 - DNA, 25 bp, Rattus norvegicus
agtagtgctttcttcttgtctcaca

SEQ ID NO: 156209 - DNA, 25 bp, Rattus norvegicus
agtagtggatgccacccagtgtgta

SEQ ID NO: 156210 - DNA, 25 bp, Rattus norvegicus
agtagtggatgcgacccagtgtgta

SEQ ID NO: 156211 - DNA, 25 bp, Rattus norvegicus
agtagtggcaaacggctgtggccta

SEQ ID NO: 156212 - DNA, 25 bp, Rattus norvegicus
agtagtggcaaagggctgtggccta

SEQ ID NO: 156213 - DNA, 25 bp, Rattus norvegicus
agtagtgtagacacatctgctcaaa

SEQ ID NO: 156214 - DNA, 25 bp, Rattus norvegicus
agtagtgtagactcatctgctcaaa

SEQ ID NO: 156215 - DNA, 25 bp, Rattus norvegicus
agtagtgtcccacatccttaggtgt

SEQ ID NO: 156216 - DNA, 25 bp, Rattus norvegicus
agtagtgtcccagatccttaggtgt

SEQ ID NO: 156217 - DNA, 25 bp, Rattus norvegicus
agtagtgtctccaaccaagcacgga

SEQ ID NO: 156218 - DNA, 25 bp, Rattus norvegicus
agtagtgtctcctaccaagcacgga

SEQ ID NO: 156219 - DNA, 25 bp, Rattus norvegicus
agtagtgtctctaagtctctgcttc

SEQ ID NO: 156220 - DNA, 25 bp, Rattus norvegicus
agtagtgtctcttagtctctgcttc

SEQ ID NO: 156221 - DNA, 25 bp, Rattus norvegicus
agtagtgtgtaacttgctccacctg

SEQ ID NO: 156222 - DNA, 25 bp, Rattus norvegicus
agtagtgtgtaagttgctccacctg

SEQ ID NO: 156223 - DNA, 25 bp, Rattus norvegicus
agtagtgtttctacacagtagcaca

SEQ ID NO: 156224 - DNA, 25 bp, Rattus norvegicus
agtagtgtttcttcacagtagcaca

SEQ ID NO: 156225 - DNA, 25 bp, Rattus norvegicus
agtagtgtttttccttgctcaatta

SEQ ID NO: 156226 - DNA, 25 bp, Rattus norvegicus
agtagtgtttttgcttgctcaatta

SEQ ID NO: 156227 - DNA, 25 bp, Rattus norvegicus
agtagttaatcccacacctttcact

SEQ ID NO: 156228 - DNA, 25 bp, Rattus norvegicus
agtagttaatccgacacctttcact

SEQ ID NO: 156229 - DNA, 25 bp, Rattus norvegicus
agtagttagcatcctttcccaggtg

SEQ ID NO: 156230 - DNA, 25 bp, Rattus norvegicus
agtagttagcatgctttcccaggtg

SEQ ID NO: 156231 - DNA, 25 bp, Rattus norvegicus
agtagttatgcactctgagctccct

SEQ ID NO: 156232 - DNA, 25 bp, Rattus norvegicus
agtagttatgcagtctgagctccct

SEQ ID NO: 156233 - DNA, 25 bp, Rattus norvegicus
agtagttcccttcagttcaaatctc

SEQ ID NO: 156234 - DNA, 25 bp, Rattus norvegicus
agtagttcccttgagttcaaatctc

SEQ ID NO: 156235 - DNA, 25 bp, Rattus norvegicus
agtagttggagactcctgacttccc

SEQ ID NO: 156236 - DNA, 25 bp, Rattus norvegicus
agtagttggagagtcctgacttccc

SEQ ID NO: 156237 - DNA, 25 bp, Rattus norvegicus
agtagttggtgacccttattctctg

SEQ ID NO: 156238 - DNA, 25 bp, Rattus norvegicus
agtagttggtgagccttattctctg

SEQ ID NO: 156239 - DNA, 25 bp, Rattus norvegicus
agtagtttctgtcgcagctcccatt

SEQ ID NO: 156240 - DNA, 25 bp, Rattus norvegicus
agtagtttctgtggcagctcccatt

SEQ ID NO: 156241 - DNA, 25 bp, Rattus norvegicus
agtagtttgaatagccagccaccca

SEQ ID NO: 156242 - DNA, 25 bp, Rattus norvegicus
agtagtttgaattgccagccaccca

SEQ ID NO: 156243 - DNA, 25 bp, Rattus norvegicus
agtagtttgctcagcagattcccaa

SEQ ID NO: 156244 - DNA, 25 bp, Rattus norvegicus
agtagtttgctctgcagattcccaa

SEQ ID NO: 156245 - DNA, 25 bp, Rattus norvegicus
agtagtttggaaatggaggcagacc

SEQ ID NO: 156246 - DNA, 25 bp, Rattus norvegicus
agtagtttggaattggaggcagacc

SEQ ID NO: 156247 - DNA, 25 bp, Rattus norvegicus
agtagttttgtcatgctagggccaa

SEQ ID NO: 156248 - DNA, 25 bp, Rattus norvegicus
agtagttttgtcttgctagggccaa

SEQ ID NO: 156249 - DNA, 25 bp, Rattus norvegicus
agtataaccgtcaccagtggcacat

SEQ ID NO: 156250 - DNA, 25 bp, Rattus norvegicus
agtataaccgtctccagtggcacat

SEQ ID NO: 156251 - DNA, 25 bp, Rattus norvegicus
agtataagacatcttttgcctggat

SEQ ID NO: 156252 - DNA, 25 bp, Rattus norvegicus
agtataagacatgttttgcctggat

SEQ ID NO: 156253 - DNA, 25 bp, Rattus norvegicus
agtatacaagaaccattcctccacc

SEQ ID NO: 156254 - DNA, 25 bp, Rattus norvegicus
agtatacaagaagcattcctccacc

SEQ ID NO: 156255 - DNA, 25 bp, Rattus norvegicus
agtatacacaaaacagattctctag

SEQ ID NO: 156256 - DNA, 25 bp, Rattus norvegicus
agtatacacaaatcagattctctag

SEQ ID NO: 156257 - DNA, 25 bp, Rattus norvegicus
agtatacagacacccagttctaccc

SEQ ID NO: 156258 - DNA, 25 bp, Rattus norvegicus
agtatacagacagccagttctaccc

SEQ ID NO: 156259 - DNA, 25 bp, Rattus norvegicus
agtataccaaagcaggccaggccca

SEQ ID NO: 156260 - DNA, 25 bp, Rattus norvegicus
agtataccaaaggaggccaggccca

SEQ ID NO: 156261 - DNA, 25 bp, Rattus norvegicus
agtataccactcaataacccagcgg

SEQ ID NO: 156262 - DNA, 25 bp, Rattus norvegicus
agtataccactctataacccagcgg

SEQ ID NO: 156263 - DNA, 25 bp, Rattus norvegicus
agtataccagtcctcggttcattta

SEQ ID NO: 156264 - DNA, 25 bp, Rattus norvegicus
agtataccagtcgtcggttcattta

SEQ ID NO: 156265 - DNA, 25 bp, Rattus norvegicus
agtatacccttgagccgtcacttct

SEQ ID NO: 156266 - DNA, 25 bp, Rattus norvegicus
agtatacccttgtgccgtcacttct

SEQ ID NO: 156267 - DNA, 25 bp, Rattus norvegicus
agtatacctcatctcagttctgtac

SEQ ID NO: 156268 - DNA, 25 bp, Rattus norvegicus
agtatacctcatgtcagttctgtac

SEQ ID NO: 156269 - DNA, 25 bp, Rattus norvegicus
agtatacgctctagttatcctgtgt

SEQ ID NO: 156270 - DNA, 25 bp, Rattus norvegicus
agtatacgctcttgttatcctgtgt

SEQ ID NO: 156271 - DNA, 25 bp, Rattus norvegicus
agtatacggctgataacctttcgtg

SEQ ID NO: 156272 - DNA, 25 bp, Rattus norvegicus
agtatacggctgttaacctttcgtg

SEQ ID NO: 156273 - DNA, 25 bp, Rattus norvegicus
agtatactaacgacactgctttgcc

SEQ ID NO: 156274 - DNA, 25 bp, Rattus norvegicus
agtatactaacgtcactgctttgcc

SEQ ID NO: 156275 - DNA, 25 bp, Rattus norvegicus
agtatactgccacgttcctctaaac

SEQ ID NO: 156276 - DNA, 25 bp, Rattus norvegicus
agtatactgccaggttcctctaaac

SEQ ID NO: 156277 - DNA, 25 bp, Rattus norvegicus
agtatactggccattctttctgaga

SEQ ID NO: 156278 - DNA, 25 bp, Rattus norvegicus
agtatactggcctttctttctgaga

SEQ ID NO: 156279 - DNA, 25 bp, Rattus norvegicus
agtatactggctccccactcttggg

SEQ ID NO: 156280 - DNA, 25 bp, Rattus norvegicus
agtatactggctgcccactcttggg

SEQ ID NO: 156281 - DNA, 25 bp, Rattus norvegicus
agtatacttgctacaccgactgtct

SEQ ID NO: 156282 - DNA, 25 bp, Rattus norvegicus
agtatacttgcttcaccgactgtct

SEQ ID NO: 156283 - DNA, 25 bp, Rattus norvegicus
agtatactttaaaccttcctcagca

SEQ ID NO: 156284 - DNA, 25 bp, Rattus norvegicus
agtatactttaatccttcctcagca

SEQ ID NO: 156285 - DNA, 25 bp, Rattus norvegicus
agtatagacaatacctttgccaagt

SEQ ID NO: 156286 - DNA, 25 bp, Rattus norvegicus
agtatagacaattcctttgccaagt

SEQ ID NO: 156287 - DNA, 25 bp, Rattus norvegicus
agtatagacctcaactcggccgctg

SEQ ID NO: 156288 - DNA, 25 bp, Rattus norvegicus
agtatagacctctactcggccgctg

SEQ ID NO: 156289 - DNA, 25 bp, Rattus norvegicus
agtatagctaagactatctgcctag

SEQ ID NO: 156290 - DNA, 25 bp, Rattus norvegicus
agtatagctaagtctatctgcctag

SEQ ID NO: 156291 - DNA, 25 bp, Rattus norvegicus
agtatagctaccctgcgggtgccac

SEQ ID NO: 156292 - DNA, 25 bp, Rattus norvegicus
agtatagctaccgtgcgggtgccac

SEQ ID NO: 156293 - DNA, 25 bp, Rattus norvegicus
agtataggaatgagcctcctggcat

SEQ ID NO: 156294 - DNA, 25 bp, Rattus norvegicus
agtataggaatgtgcctcctggcat

SEQ ID NO: 156295 - DNA, 25 bp, Rattus norvegicus
agtatagtaccgacagccttctgaa

SEQ ID NO: 156296 - DNA, 25 bp, Rattus norvegicus
agtatagtaccgtcagccttctgaa

SEQ ID NO: 156297 - DNA, 25 bp, Rattus norvegicus
agtatagtttctctcctctttcatt

SEQ ID NO: 156298 - DNA, 25 bp, Rattus norvegicus
agtatagtttctgtcctctttcatt

SEQ ID NO: 156299 - DNA, 25 bp, Rattus norvegicus
agtatataagtgactctggtgcagg

SEQ ID NO: 156300 - DNA, 25 bp, Rattus norvegicus
agtatataagtgtctctggtgcagg

SEQ ID NO: 156301 - DNA, 25 bp, Rattus norvegicus
agtatatatattatccctcctgcct

SEQ ID NO: 156302 - DNA, 25 bp, Rattus norvegicus
agtatatatattttccctcctgcct

SEQ ID NO: 156303 - DNA, 25 bp, Rattus norvegicus
agtatatcacccatacatcgggcgc

SEQ ID NO: 156304 - DNA, 25 bp, Rattus norvegicus
agtatatcacccttacatcgggcgc

SEQ ID NO: 156305 - DNA, 25 bp, Rattus norvegicus
agtatatcagctacctgcagtctct

SEQ ID NO: 156306 - DNA, 25 bp, Rattus norvegicus
agtatatcagcttcctgcagtctct

SEQ ID NO: 156307 - DNA, 25 bp, Rattus norvegicus
agtatatcgctcattccagcacaat

SEQ ID NO: 156308 - DNA, 25 bp, Rattus norvegicus
agtatatcgctctttccagcacaat

SEQ ID NO: 156309 - DNA, 25 bp, Rattus norvegicus
agtatatgatggaccctaccctggg

SEQ ID NO: 156310 - DNA, 25 bp, Rattus norvegicus
agtatatgatggtccctaccctggg

SEQ ID NO: 156311 - DNA, 25 bp, Rattus norvegicus
agtatatgccaacctgggccttatg

SEQ ID NO: 156312 - DNA, 25 bp, Rattus norvegicus
agtatatgccaagctgggccttatg

SEQ ID NO: 156313 - DNA, 25 bp, Rattus norvegicus
agtatatgtgtgatggccctccaaa

SEQ ID NO: 156314 - DNA, 25 bp, Rattus norvegicus
agtatatgtgtgttggccctccaaa

SEQ ID NO: 156315 - DNA, 25 bp, Rattus norvegicus
agtatattagctcttttcccttcca

SEQ ID NO: 156316 - DNA, 25 bp, Rattus norvegicus
agtatattagctgttttcccttcca

SEQ ID NO: 156317 - DNA, 25 bp, Rattus norvegicus
agtatattccatagttttccctcta

SEQ ID NO: 156318 - DNA, 25 bp, Rattus norvegicus
agtatattccattgttttccctcta

SEQ ID NO: 156319 - DNA, 25 bp, Rattus norvegicus
agtatattctcaagcctttatccct

SEQ ID NO: 156320 - DNA, 25 bp, Rattus norvegicus
agtatattctcatgcctttatccct

SEQ ID NO: 156321 - DNA, 25 bp, Rattus norvegicus
agtatattcttcattcatctgcgcg

SEQ ID NO: 156322 - DNA, 25 bp, Rattus norvegicus
agtatattcttctttcatctgcgcg

SEQ ID NO: 156323 - DNA, 25 bp, Rattus norvegicus
agtatattgggtagctccttctcta

SEQ ID NO: 156324 - DNA, 25 bp, Rattus norvegicus
agtatattgggttgctccttctcta

SEQ ID NO: 156325 - DNA, 25 bp, Rattus norvegicus
agtatatttgttattcagccctaaa

SEQ ID NO: 156326 - DNA, 25 bp, Rattus norvegicus
agtatatttgtttttcagccctaaa

SEQ ID NO: 156327 - DNA, 25 bp, Rattus norvegicus
agtatcaatactaggcctctgttct

SEQ ID NO: 156328 - DNA, 25 bp, Rattus norvegicus
agtatcaatacttggcctctgttct

SEQ ID NO: 156329 - DNA, 25 bp, Rattus norvegicus
agtatcaccatcaccactgtctcgt

SEQ ID NO: 156330 - DNA, 25 bp, Rattus norvegicus
agtatcaccatctccactgtctcgt

SEQ ID NO: 156331 - DNA, 25 bp, Rattus norvegicus
agtatcaccccgatagtctagcatc

SEQ ID NO: 156332 - DNA, 25 bp, Rattus norvegicus
agtatcaccccgttagtctagcatc

SEQ ID NO: 156333 - DNA, 25 bp, Rattus norvegicus
agtatcacgtgaatcccctgcgcaa

SEQ ID NO: 156334 - DNA, 25 bp, Rattus norvegicus
agtatcacgtgattcccctgcgcaa

SEQ ID NO: 156335 - DNA, 25 bp, Rattus norvegicus
agtatcagcattatttctgttttct

SEQ ID NO: 156336 - DNA, 25 bp, Rattus norvegicus
agtatcagcattttttctgttttct

SEQ ID NO: 156337 - DNA, 25 bp, Rattus norvegicus
agtatcaggctacagggcgttcgtt

SEQ ID NO: 156338 - DNA, 25 bp, Rattus norvegicus
agtatcaggctagagggcgttcgtt

SEQ ID NO: 156339 - DNA, 25 bp, Rattus norvegicus
agtatcagtaggacttggtccccag

SEQ ID NO: 156340 - DNA, 25 bp, Rattus norvegicus
agtatcagtaggtcttggtccccag

SEQ ID NO: 156341 - DNA, 25 bp, Rattus norvegicus
agtatcatcagcctgcaggtctctg

SEQ ID NO: 156342 - DNA, 25 bp, Rattus norvegicus
agtatcatcagcgtgcaggtctctg

SEQ ID NO: 156343 - DNA, 25 bp, Rattus norvegicus
agtatcatccagcttcagcattctg

SEQ ID NO: 156344 - DNA, 25 bp, Rattus norvegicus
agtatcatccaggttcagcattctg

SEQ ID NO: 156345 - DNA, 25 bp, Rattus norvegicus
agtatcatctcactggctctgcttt

SEQ ID NO: 156346 - DNA, 25 bp, Rattus norvegicus
agtatcatctcagtggctctgcttt

SEQ ID NO: 156347 - DNA, 25 bp, Rattus norvegicus
agtatcatgcttagaactcactgag

SEQ ID NO: 156348 - DNA, 25 bp, Rattus norvegicus
agtatcatgctttgaactcactgag

SEQ ID NO: 156349 - DNA, 25 bp, Rattus norvegicus
agtatcatgggcagtgtctcctcag

SEQ ID NO: 156350 - DNA, 25 bp, Rattus norvegicus
agtatcatgggctgtgtctcctcag

SEQ ID NO: 156351 - DNA, 25 bp, Rattus norvegicus
agtatccaaagacccctgtgcctga

SEQ ID NO: 156352 - DNA, 25 bp, Rattus norvegicus
agtatccaaagagccctgtgcctga

SEQ ID NO: 156353 - DNA, 25 bp, Rattus norvegicus
agtatccacacccaagcctatgtat

SEQ ID NO: 156354 - DNA, 25 bp, Rattus norvegicus
agtatccacaccgaagcctatgtat

SEQ ID NO: 156355 - DNA, 25 bp, Rattus norvegicus
agtatccagataccgttctaggccc

SEQ ID NO: 156356 - DNA, 25 bp, Rattus norvegicus
agtatccagatagcgttctaggccc

SEQ ID NO: 156357 - DNA, 25 bp, Rattus norvegicus
agtatccaggatcgtttcaggaccc

SEQ ID NO: 156358 - DNA, 25 bp, Rattus norvegicus
agtatccaggatggtttcaggaccc

SEQ ID NO: 156359 - DNA, 25 bp, Rattus norvegicus
agtatccatgctacagctcgaatgc

SEQ ID NO: 156360 - DNA, 25 bp, Rattus norvegicus
agtatccatgcttcagctcgaatgc

SEQ ID NO: 156361 - DNA, 25 bp, Rattus norvegicus
agtatcccaaatcagttatctttaa

SEQ ID NO: 156362 - DNA, 25 bp, Rattus norvegicus
agtatcccaaatgagttatctttaa

SEQ ID NO: 156363 - DNA, 25 bp, Rattus norvegicus
agtatcccacatagactgtcagtca

SEQ ID NO: 156364 - DNA, 25 bp, Rattus norvegicus
agtatcccacattgactgtcagtca

SEQ ID NO: 156365 - DNA, 25 bp, Rattus norvegicus
agtatcccattcactgtggttggct

SEQ ID NO: 156366 - DNA, 25 bp, Rattus norvegicus
agtatcccattctctgtggttggct

SEQ ID NO: 156367 - DNA, 25 bp, Rattus norvegicus
agtatccccaggatcgtctctgcag

SEQ ID NO: 156368 - DNA, 25 bp, Rattus norvegicus
agtatccccaggttcgtctctgcag

SEQ ID NO: 156369 - DNA, 25 bp, Rattus norvegicus
agtatcccttccagacaggtctttg

SEQ ID NO: 156370 - DNA, 25 bp, Rattus norvegicus
agtatcccttcctgacaggtctttg

SEQ ID NO: 156371 - DNA, 25 bp, Rattus norvegicus
agtatccggtgtatgtgggccacaa

SEQ ID NO: 156372 - DNA, 25 bp, Rattus norvegicus
agtatccggtgtttgtgggccacaa

SEQ ID NO: 156373 - DNA, 25 bp, Rattus norvegicus
agtatccgttctccctgagagcata

SEQ ID NO: 156374 - DNA, 25 bp, Rattus norvegicus
agtatccgttctgcctgagagcata

SEQ ID NO: 156375 - DNA, 25 bp, Rattus norvegicus
agtatcctctggattcctctgggaa

SEQ ID NO: 156376 - DNA, 25 bp, Rattus norvegicus
agtatcctctggtttcctctgggaa

SEQ ID NO: 156377 - DNA, 25 bp, Rattus norvegicus
agtatcctgacaccgtaggtatgcc

SEQ ID NO: 156378 - DNA, 25 bp, Rattus norvegicus
agtatcctgacagcgtaggtatgcc

SEQ ID NO: 156379 - DNA, 25 bp, Rattus norvegicus
agtatcctgagtctttggctgccca

SEQ ID NO: 156380 - DNA, 25 bp, Rattus norvegicus
agtatcctgagtgtttggctgccca

SEQ ID NO: 156381 - DNA, 25 bp, Rattus norvegicus
agtatcctgcacagattctctcctt

SEQ ID NO: 156382 - DNA, 25 bp, Rattus norvegicus
agtatcctgcactgattctctcctt

SEQ ID NO: 156383 - DNA, 25 bp, Rattus norvegicus
agtatcctggaaatcattccgggta

SEQ ID NO: 156384 - DNA, 25 bp, Rattus norvegicus
agtatcctggaattcattccgggta

SEQ ID NO: 156385 - DNA, 25 bp, Rattus norvegicus
agtatccttctcaaggtagttggca

SEQ ID NO: 156386 - DNA, 25 bp, Rattus norvegicus
agtatccttctctaggtagttggca

SEQ ID NO: 156387 - DNA, 25 bp, Rattus norvegicus
agtatccttttaaattcagccacag

SEQ ID NO: 156388 - DNA, 25 bp, Rattus norvegicus
agtatccttttatattcagccacag

SEQ ID NO: 156389 - DNA, 25 bp, Rattus norvegicus
agtatcgcaataacagttccctcgg

SEQ ID NO: 156390 - DNA, 25 bp, Rattus norvegicus
agtatcgcaatatcagttccctcgg

SEQ ID NO: 156391 - DNA, 25 bp, Rattus norvegicus
agtatcgccaggcactctgacgaaa

SEQ ID NO: 156392 - DNA, 25 bp, Rattus norvegicus
agtatcgccagggactctgacgaaa

SEQ ID NO: 156393 - DNA, 25 bp, Rattus norvegicus
agtatcgctcagacggaagttcaag

SEQ ID NO: 156394 - DNA, 25 bp, Rattus norvegicus
agtatcgctcagtcggaagttcaag

SEQ ID NO: 156395 - DNA, 25 bp, Rattus norvegicus
agtatctaaaccacatctctcggat

SEQ ID NO: 156396 - DNA, 25 bp, Rattus norvegicus
agtatctaaacctcatctctcggat

SEQ ID NO: 156397 - DNA, 25 bp, Rattus norvegicus
agtatctacctgatcctatagtgga

SEQ ID NO: 156398 - DNA, 25 bp, Rattus norvegicus
agtatctacctgttcctatagtgga

SEQ ID NO: 156399 - DNA, 25 bp, Rattus norvegicus
agtatctatgacctatctgcagaag

SEQ ID NO: 156400 - DNA, 25 bp, Rattus norvegicus
agtatctatgacgtatctgcagaag

SEQ ID NO: 156401 - DNA, 25 bp, Rattus norvegicus
agtatctatggccacagttcaacaa

SEQ ID NO: 156402 - DNA, 25 bp, Rattus norvegicus
agtatctatggcgacagttcaacaa

SEQ ID NO: 156403 - DNA, 25 bp, Rattus norvegicus
agtatctcagataccatcagttggt

SEQ ID NO: 156404 - DNA, 25 bp, Rattus norvegicus
agtatctcagattccatcagttggt

SEQ ID NO: 156405 - DNA, 25 bp, Rattus norvegicus
agtatctcccaaattgccaaacaga

SEQ ID NO: 156406 - DNA, 25 bp, Rattus norvegicus
agtatctcccaatttgccaaacaga

SEQ ID NO: 156407 - DNA, 25 bp, Rattus norvegicus
agtatctctcagaaaacctccacat

SEQ ID NO: 156408 - DNA, 25 bp, Rattus norvegicus
agtatctctcagtaaacctccacat

SEQ ID NO: 156409 - DNA, 25 bp, Rattus norvegicus
agtatctctccaaggttttcagcat

SEQ ID NO: 156410 - DNA, 25 bp, Rattus norvegicus
agtatctctccatggttttcagcat

SEQ ID NO: 156411 - DNA, 25 bp, Rattus norvegicus
agtatctctggtccatgctaacctc

SEQ ID NO: 156412 - DNA, 25 bp, Rattus norvegicus
agtatctctggtgcatgctaacctc

SEQ ID NO: 156413 - DNA, 25 bp, Rattus norvegicus
agtatctgacacaaggccaacctgg

SEQ ID NO: 156414 - DNA, 25 bp, Rattus norvegicus
agtatctgacactaggccaacctgg

SEQ ID NO: 156415 - DNA, 25 bp, Rattus norvegicus
agtatctgacctccaggttggcggc

SEQ ID NO: 156416 - DNA, 25 bp, Rattus norvegicus
agtatctgacctgcaggttggcggc

SEQ ID NO: 156417 - DNA, 25 bp, Rattus norvegicus
agtatctgctggagcccggagactt

SEQ ID NO: 156418 - DNA, 25 bp, Rattus norvegicus
agtatctgctggtgcccggagactt

SEQ ID NO: 156419 - DNA, 25 bp, Rattus norvegicus
agtatctgcttcactgaccagcatg

SEQ ID NO: 156420 - DNA, 25 bp, Rattus norvegicus
agtatctgcttctctgaccagcatg

SEQ ID NO: 156421 - DNA, 25 bp, Rattus norvegicus
agtatctggctaatagtattttaca

SEQ ID NO: 156422 - DNA, 25 bp, Rattus norvegicus
agtatctggctattagtattttaca

SEQ ID NO: 156423 - DNA, 25 bp, Rattus norvegicus
agtatctggttgacccaaacctggg

SEQ ID NO: 156424 - DNA, 25 bp, Rattus norvegicus
agtatctggttgtcccaaacctggg

SEQ ID NO: 156425 - DNA, 25 bp, Rattus norvegicus
agtatctgtcatatgctgaagcatc

SEQ ID NO: 156426 - DNA, 25 bp, Rattus norvegicus
agtatctgtcatttgctgaagcatc

SEQ ID NO: 156427 - DNA, 25 bp, Rattus norvegicus
agtatctgtcttccagaaacctcac

SEQ ID NO: 156428 - DNA, 25 bp, Rattus norvegicus
agtatctgtcttgcagaaacctcac

SEQ ID NO: 156429 - DNA, 25 bp, Rattus norvegicus
agtatctgtggtcagttacctcatg

SEQ ID NO: 156430 - DNA, 25 bp, Rattus norvegicus
agtatctgtggtgagttacctcatg

SEQ ID NO: 156431 - DNA, 25 bp, Rattus norvegicus
agtatctgtttccagaaccgcacac

SEQ ID NO: 156432 - DNA, 25 bp, Rattus norvegicus
agtatctgtttcgagaaccgcacac

SEQ ID NO: 156433 - DNA, 25 bp, Rattus norvegicus
agtatcttagtgaaccctcctgtta

SEQ ID NO: 156434 - DNA, 25 bp, Rattus norvegicus
agtatcttagtgtaccctcctgtta

SEQ ID NO: 156435 - DNA, 25 bp, Rattus norvegicus
agtatcttcactaatgcaacagcag

SEQ ID NO: 156436 - DNA, 25 bp, Rattus norvegicus
agtatcttcacttatgcaacagcag

SEQ ID NO: 156437 - DNA, 25 bp, Rattus norvegicus
agtatcttcttacagctggcctgtt

SEQ ID NO: 156438 - DNA, 25 bp, Rattus norvegicus
agtatcttcttagagctggcctgtt

SEQ ID NO: 156439 - DNA, 25 bp, Rattus norvegicus
agtatcttgcaaatgctgcctcagc

SEQ ID NO: 156440 - DNA, 25 bp, Rattus norvegicus
agtatcttgcaattgctgcctcagc

SEQ ID NO: 156441 - DNA, 25 bp, Rattus norvegicus
agtatctttactaatcctttgacag

SEQ ID NO: 156442 - DNA, 25 bp, Rattus norvegicus
agtatctttacttatcctttgacag

SEQ ID NO: 156443 - DNA, 25 bp, Rattus norvegicus
agtatctttctacatcccgaggatg

SEQ ID NO: 156444 - DNA, 25 bp, Rattus norvegicus
agtatctttctagatcccgaggatg

SEQ ID NO: 156445 - DNA, 25 bp, Rattus norvegicus
agtatcttttggatggcagctccca

SEQ ID NO: 156446 - DNA, 25 bp, Rattus norvegicus
agtatcttttggttggcagctccca

SEQ ID NO: 156447 - DNA, 25 bp, Rattus norvegicus
agtatgaaagcaacagacttctgtt

SEQ ID NO: 156448 - DNA, 25 bp, Rattus norvegicus
agtatgaaagcatcagacttctgtt

SEQ ID NO: 156449 - DNA, 25 bp, Rattus norvegicus
agtatgaacgtgacgtgttatgcag

SEQ ID NO: 156450 - DNA, 25 bp, Rattus norvegicus
agtatgaacgtgtcgtgttatgcag

SEQ ID NO: 156451 - DNA, 25 bp, Rattus norvegicus
agtatgaattacagcttgctcctcc

SEQ ID NO: 156452 - DNA, 25 bp, Rattus norvegicus
agtatgaattactgcttgctcctcc

SEQ ID NO: 156453 - DNA, 25 bp, Rattus norvegicus
agtatgacaaggatcgatggctctc

SEQ ID NO: 156454 - DNA, 25 bp, Rattus norvegicus
agtatgacaaggttcgatggctctc

SEQ ID NO: 156455 - DNA, 25 bp, Rattus norvegicus
agtatgaccgctcaggaaacctgct

SEQ ID NO: 156456 - DNA, 25 bp, Rattus norvegicus
agtatgaccgctgaggaaacctgct

SEQ ID NO: 156457 - DNA, 25 bp, Rattus norvegicus
agtatgacctgaaagtgccccggga

SEQ ID NO: 156458 - DNA, 25 bp, Rattus norvegicus
agtatgacctgatagtgccccggga

SEQ ID NO: 156459 - DNA, 25 bp, Rattus norvegicus
agtatgacgaagctggcccctccat

SEQ ID NO: 156460 - DNA, 25 bp, Rattus norvegicus
agtatgacgaaggtggcccctccat

SEQ ID NO: 156461 - DNA, 25 bp, Rattus norvegicus
agtatgactctacccacggcaagtt

SEQ ID NO: 156462 - DNA, 25 bp, Rattus norvegicus
agtatgactctagccacggcaagtt

SEQ ID NO: 156463 - DNA, 25 bp, Rattus norvegicus
agtatgagaccaagtacgggccctt

SEQ ID NO: 156464 - DNA, 25 bp, Rattus norvegicus
agtatgagaccatgtacgggccctt

SEQ ID NO: 156465 - DNA, 25 bp, Rattus norvegicus
agtatgaggtgaacccttcagcctt

SEQ ID NO: 156466 - DNA, 25 bp, Rattus norvegicus
agtatgaggtgatcccttcagcctt

SEQ ID NO: 156467 - DNA, 25 bp, Rattus norvegicus
agtatgagtgccagcctccctgtga

SEQ ID NO: 156468 - DNA, 25 bp, Rattus norvegicus
agtatgagtgcctgcctccctgtga

SEQ ID NO: 156469 - DNA, 25 bp, Rattus norvegicus
agtatgatagacctggacccagccc

SEQ ID NO: 156470 - DNA, 25 bp, Rattus norvegicus
agtatgatagacgtggacccagccc

SEQ ID NO: 156471 - DNA, 25 bp, Rattus norvegicus
agtatgatcaccctgatgtggccca

SEQ ID NO: 156472 - DNA, 25 bp, Rattus norvegicus
agtatgatcaccgtgatgtggccca

SEQ ID NO: 156473 - DNA, 25 bp, Rattus norvegicus
agtatgatgctgctcatttcctcat

SEQ ID NO: 156474 - DNA, 25 bp, Rattus norvegicus
agtatgatgctggtcatttcctcat

SEQ ID NO: 156475 - DNA, 25 bp, Rattus norvegicus
agtatgatggctatacctcgtgccc

SEQ ID NO: 156476 - DNA, 25 bp, Rattus norvegicus
agtatgatggctttacctcgtgccc

SEQ ID NO: 156477 - DNA, 25 bp, Rattus norvegicus
agtatgattactccaagcccatcga

SEQ ID NO: 156478 - DNA, 25 bp, Rattus norvegicus
agtatgattactgcaagcccatcga

SEQ ID NO: 156479 - DNA, 25 bp, Rattus norvegicus
agtatgcaacttcttcacctatgtg

SEQ ID NO: 156480 - DNA, 25 bp, Rattus norvegicus
agtatgcaacttgttcacctatgtg

SEQ ID NO: 156481 - DNA, 25 bp, Rattus norvegicus
agtatgcaagccatctggagcgcca

SEQ ID NO: 156482 - DNA, 25 bp, Rattus norvegicus
agtatgcaagccttctggagcgcca

SEQ ID NO: 156483 - DNA, 25 bp, Rattus norvegicus
agtatgcacgctaactgcctttaga

SEQ ID NO: 156484 - DNA, 25 bp, Rattus norvegicus
agtatgcacgcttactgcctttaga

SEQ ID NO: 156485 - DNA, 25 bp, Rattus norvegicus
agtatgcagactagaccttggcggg

SEQ ID NO: 156486 - DNA, 25 bp, Rattus norvegicus
agtatgcagacttgaccttggcggg

SEQ ID NO: 156487 - DNA, 25 bp, Rattus norvegicus
agtatgcagcagaaccttcccgtgc

SEQ ID NO: 156488 - DNA, 25 bp, Rattus norvegicus
agtatgcagcagatcctcaggacaa

SEQ ID NO: 156489 - DNA, 25 bp, Rattus norvegicus
agtatgcagcagtaccttcccgtgc

SEQ ID NO: 156490 - DNA, 25 bp, Rattus norvegicus
agtatgcagcagttcctcaggacaa

SEQ ID NO: 156491 - DNA, 25 bp, Rattus norvegicus
agtatgcaggccctgtgccagccct

SEQ ID NO: 156492 - DNA, 25 bp, Rattus norvegicus
agtatgcaggccgtgtgccagccct

SEQ ID NO: 156493 - DNA, 25 bp, Rattus norvegicus
agtatgcatgctcctaccctgtatg

SEQ ID NO: 156494 - DNA, 25 bp, Rattus norvegicus
agtatgcatgctgctaccctgtatg

SEQ ID NO: 156495 - DNA, 25 bp, Rattus norvegicus
agtatgccagtgaccaagtccagag

SEQ ID NO: 156496 - DNA, 25 bp, Rattus norvegicus
agtatgccagtgtccaagtccagag

SEQ ID NO: 156497 - DNA, 25 bp, Rattus norvegicus
agtatgcccacactccagacaggat

SEQ ID NO: 156498 - DNA, 25 bp, Rattus norvegicus
agtatgcccacagtccagacaggat

SEQ ID NO: 156499 - DNA, 25 bp, Rattus norvegicus
agtatgcccgaccaggtttctcaga

SEQ ID NO: 156500 - DNA, 25 bp, Rattus norvegicus
agtatgcccgacgaggtttctcaga

SEQ ID NO: 156501 - DNA, 25 bp, Rattus norvegicus
agtatgcccgccaggagaacggccg

SEQ ID NO: 156502 - DNA, 25 bp, Rattus norvegicus
agtatgcccgcctggagaacggccg

SEQ ID NO: 156503 - DNA, 25 bp, Rattus norvegicus
agtatgccttgcacattgccatcaa

SEQ ID NO: 156504 - DNA, 25 bp, Rattus norvegicus
agtatgccttgctcattgccatcaa

SEQ ID NO: 156505 - DNA, 25 bp, Rattus norvegicus
agtatgctaatcacctgttcctgaa

SEQ ID NO: 156506 - DNA, 25 bp, Rattus norvegicus
agtatgctaatctcctgttcctgaa

SEQ ID NO: 156507 - DNA, 25 bp, Rattus norvegicus
agtatgctatttctctcctaagtgt

SEQ ID NO: 156508 - DNA, 25 bp, Rattus norvegicus
agtatgctatttgtctcctaagtgt

SEQ ID NO: 156509 - DNA, 25 bp, Rattus norvegicus
agtatgctgaaaatctggccgatca

SEQ ID NO: 156510 - DNA, 25 bp, Rattus norvegicus
agtatgctgaaattctggccgatca

SEQ ID NO: 156511 - DNA, 25 bp, Rattus norvegicus
agtatgctgcgtcaggatttcctga

SEQ ID NO: 156512 - DNA, 25 bp, Rattus norvegicus
agtatgctgcgtgaggatttcctga

SEQ ID NO: 156513 - DNA, 25 bp, Rattus norvegicus
agtatgctgtatatccctgtgggac

SEQ ID NO: 156514 - DNA, 25 bp, Rattus norvegicus
agtatgctgtatttccctgtgggac

SEQ ID NO: 156515 - DNA, 25 bp, Rattus norvegicus
agtatgctttagaggctgcctgtgc

SEQ ID NO: 156516 - DNA, 25 bp, Rattus norvegicus
agtatgctttagtggctgcctgtgc

SEQ ID NO: 156517 - DNA, 25 bp, Rattus norvegicus
agtatgcttttgcactgcccttcta

SEQ ID NO: 156518 - DNA, 25 bp, Rattus norvegicus
agtatgcttttggactgcccttcta

SEQ ID NO: 156519 - DNA, 25 bp, Rattus norvegicus
agtatggaaacgacctcacttctgg

SEQ ID NO: 156520 - DNA, 25 bp, Rattus norvegicus
agtatggaaacgtcctcacttctgg

SEQ ID NO: 156521 - DNA, 25 bp, Rattus norvegicus
agtatggacagcaagcctcgaggcc

SEQ ID NO: 156522 - DNA, 25 bp, Rattus norvegicus
agtatggacagctagcctcgaggcc

SEQ ID NO: 156523 - DNA, 25 bp, Rattus norvegicus
agtatggagctcaggttttaaaaag

SEQ ID NO: 156524 - DNA, 25 bp, Rattus norvegicus
agtatggagctctggttttaaaaag

SEQ ID NO: 156525 - DNA, 25 bp, Rattus norvegicus
agtatggatcttacacagccaaggg

SEQ ID NO: 156526 - DNA, 25 bp, Rattus norvegicus
agtatggatctttcacagccaaggg

SEQ ID NO: 156527 - DNA, 25 bp, Rattus norvegicus
agtatggcacttatgagaactggat

SEQ ID NO: 156528 - DNA, 25 bp, Rattus norvegicus
agtatggcacttttgagaactggat

SEQ ID NO: 156529 - DNA, 25 bp, Rattus norvegicus
agtatggccacgaacagatcaacac

SEQ ID NO: 156530 - DNA, 25 bp, Rattus norvegicus
agtatggccacgtacagatcaacac

SEQ ID NO: 156531 - DNA, 25 bp, Rattus norvegicus
agtatggccatgctacgaaggatgt

SEQ ID NO: 156532 - DNA, 25 bp, Rattus norvegicus
agtatggccatggtacgaaggatgt

SEQ ID NO: 156533 - DNA, 25 bp, Rattus norvegicus
agtatggccgcactgctgtctgagc

SEQ ID NO: 156534 - DNA, 25 bp, Rattus norvegicus
agtatggccgcagtgctgtctgagc

SEQ ID NO: 156535 - DNA, 25 bp, Rattus norvegicus
agtatggctacgagggtcaacccaa

SEQ ID NO: 156536 - DNA, 25 bp, Rattus norvegicus
agtatggctacgtgggtcaacccaa

SEQ ID NO: 156537 - DNA, 25 bp, Rattus norvegicus
agtatggctggtcgcctatgtcctg

SEQ ID NO: 156538 - DNA, 25 bp, Rattus norvegicus
agtatggctggtggcctatgtcctg

SEQ ID NO: 156539 - DNA, 25 bp, Rattus norvegicus
agtatggctttgatgcctttggcaa

SEQ ID NO: 156540 - DNA, 25 bp, Rattus norvegicus
agtatggctttgttgcctttggcaa

SEQ ID NO: 156541 - DNA, 25 bp, Rattus norvegicus
agtatgggacatcccagagcacctg

SEQ ID NO: 156542 - DNA, 25 bp, Rattus norvegicus
agtatgggacatgccagagcacctg

SEQ ID NO: 156543 - DNA, 25 bp, Rattus norvegicus
agtatgggcagtacagtggcctgaa

SEQ ID NO: 156544 - DNA, 25 bp, Rattus norvegicus
agtatgggcagttcagtggcctgaa

SEQ ID NO: 156545 - DNA, 25 bp, Rattus norvegicus
agtatgggttgtactgagtgctgcc

SEQ ID NO: 156546 - DNA, 25 bp, Rattus norvegicus
agtatgggttgttctgagtgctgcc

SEQ ID NO: 156547 - DNA, 25 bp, Rattus norvegicus
agtatggtaaagaccctcgctgcca

SEQ ID NO: 156548 - DNA, 25 bp, Rattus norvegicus
agtatggtaaagtccctcgctgcca

SEQ ID NO: 156549 - DNA, 25 bp, Rattus norvegicus
agtatggtatcaacccggagcgcac

SEQ ID NO: 156550 - DNA, 25 bp, Rattus norvegicus
agtatggtatcatcccggagcgcac

SEQ ID NO: 156551 - DNA, 25 bp, Rattus norvegicus
agtatggtcatcaccggaacggaca

SEQ ID NO: 156552 - DNA, 25 bp, Rattus norvegicus
agtatggtcatctccggaacggaca

SEQ ID NO: 156553 - DNA, 25 bp, Rattus norvegicus
agtatggtcctgaggacactcctgt

SEQ ID NO: 156554 - DNA, 25 bp, Rattus norvegicus
agtatggtcctgtggacactcctgt

SEQ ID NO: 156555 - DNA, 25 bp, Rattus norvegicus
agtatggttaccagttgggctctca

SEQ ID NO: 156556 - DNA, 25 bp, Rattus norvegicus
agtatggttacctgttgggctctca

SEQ ID NO: 156557 - DNA, 25 bp, Rattus norvegicus
agtatgtaaccccagttgctgctag

SEQ ID NO: 156558 - DNA, 25 bp, Rattus norvegicus
agtatgtaacccgagttgctgctag

SEQ ID NO: 156559 - DNA, 25 bp, Rattus norvegicus
agtatgtagcggagaccctgtgcac

SEQ ID NO: 156560 - DNA, 25 bp, Rattus norvegicus
agtatgtagcggtgaccctgtgcac

SEQ ID NO: 156561 - DNA, 25 bp, Rattus norvegicus
agtatgtatctgcaccttggagtgt

SEQ ID NO: 156562 - DNA, 25 bp, Rattus norvegicus
agtatgtatctggaccttggagtgt

SEQ ID NO: 156563 - DNA, 25 bp, Rattus norvegicus
agtatgtcacataatctccttggaa

SEQ ID NO: 156564 - DNA, 25 bp, Rattus norvegicus
agtatgtcacattatctccttggaa

SEQ ID NO: 156565 - DNA, 25 bp, Rattus norvegicus
agtatgtcagcaaccggtgactcgg

SEQ ID NO: 156566 - DNA, 25 bp, Rattus norvegicus
agtatgtcagcatccggtgactcgg

SEQ ID NO: 156567 - DNA, 25 bp, Rattus norvegicus
agtatgtcagctccggcatgattga

SEQ ID NO: 156568 - DNA, 25 bp, Rattus norvegicus
agtatgtcagctgcggcatgattga

SEQ ID NO: 156569 - DNA, 25 bp, Rattus norvegicus
agtatgtctagacccttttccagtt

SEQ ID NO: 156570 - DNA, 25 bp, Rattus norvegicus
agtatgtctagagccttttccagtt

SEQ ID NO: 156571 - DNA, 25 bp, Rattus norvegicus
agtatgtgaccaacagactgcatga

SEQ ID NO: 156572 - DNA, 25 bp, Rattus norvegicus
agtatgtgaccatcagactgcatga

SEQ ID NO: 156573 - DNA, 25 bp, Rattus norvegicus
agtatgtgactaccttgaccctcag

SEQ ID NO: 156574 - DNA, 25 bp, Rattus norvegicus
agtatgtgactagcttgaccctcag

SEQ ID NO: 156575 - DNA, 25 bp, Rattus norvegicus
agtatgtgacttactgtcatccctg

SEQ ID NO: 156576 - DNA, 25 bp, Rattus norvegicus
agtatgtgactttctgtcatccctg

SEQ ID NO: 156577 - DNA, 25 bp, Rattus norvegicus
agtatgtggtgtacactttgtcccc

SEQ ID NO: 156578 - DNA, 25 bp, Rattus norvegicus
agtatgtggtgttcactttgtcccc

SEQ ID NO: 156579 - DNA, 25 bp, Rattus norvegicus
agtatgtgtggcacagcgttggcac

SEQ ID NO: 156580 - DNA, 25 bp, Rattus norvegicus
agtatgtgtggctcagcgttggcac

SEQ ID NO: 156581 - DNA, 25 bp, Rattus norvegicus
agtatgttacctatcagattggctt

SEQ ID NO: 156582 - DNA, 25 bp, Rattus norvegicus
agtatgttacctttcagattggctt

SEQ ID NO: 156583 - DNA, 25 bp, Rattus norvegicus
agtatgttcatgcactcacggcttc

SEQ ID NO: 156584 - DNA, 25 bp, Rattus norvegicus
agtatgttcatggactcacggcttc

SEQ ID NO: 156585 - DNA, 25 bp, Rattus norvegicus
agtatgttctacagtatgatctaca

SEQ ID NO: 156586 - DNA, 25 bp, Rattus norvegicus
agtatgttctactgtatgatctaca

SEQ ID NO: 156587 - DNA, 25 bp, Rattus norvegicus
agtatgttctgcctgggtccagcaa

SEQ ID NO: 156588 - DNA, 25 bp, Rattus norvegicus
agtatgttctgcgtgggtccagcaa

SEQ ID NO: 156589 - DNA, 25 bp, Rattus norvegicus
agtattaaaattctctgccttcctt

SEQ ID NO: 156590 - DNA, 25 bp, Rattus norvegicus
agtattaaaattgtctgccttcctt

SEQ ID NO: 156591 - DNA, 25 bp, Rattus norvegicus
agtattaaactgcacttatctgtaa

SEQ ID NO: 156592 - DNA, 25 bp, Rattus norvegicus
agtattaaactggacttatctgtaa

SEQ ID NO: 156593 - DNA, 25 bp, Rattus norvegicus
agtattaaagctaacctcacctctc

SEQ ID NO: 156594 - DNA, 25 bp, Rattus norvegicus
agtattaaagcttacctcacctctc

SEQ ID NO: 156595 - DNA, 25 bp, Rattus norvegicus
agtattaaagttcacccctgcatgg

SEQ ID NO: 156596 - DNA, 25 bp, Rattus norvegicus
agtattaaagttgacccctgcatgg

SEQ ID NO: 156597 - DNA, 25 bp, Rattus norvegicus
agtattaatccccatctgtaccatg

SEQ ID NO: 156598 - DNA, 25 bp, Rattus norvegicus
agtattaatcccgatctgtaccatg

SEQ ID NO: 156599 - DNA, 25 bp, Rattus norvegicus
agtattaatcctacctctgattgcc

SEQ ID NO: 156600 - DNA, 25 bp, Rattus norvegicus
agtattaatccttcctctgattgcc

SEQ ID NO: 156601 - DNA, 25 bp, Rattus norvegicus
agtattacaaaaacgctggcaagtg

SEQ ID NO: 156602 - DNA, 25 bp, Rattus norvegicus
agtattacaaaatcgctggcaagtg

SEQ ID NO: 156603 - DNA, 25 bp, Rattus norvegicus
agtattacacatatccacttctctc

SEQ ID NO: 156604 - DNA, 25 bp, Rattus norvegicus
agtattacacatttccacttctctc

SEQ ID NO: 156605 - DNA, 25 bp, Rattus norvegicus
agtattacaccacgcacttgcaaat

SEQ ID NO: 156606 - DNA, 25 bp, Rattus norvegicus
agtattacaccaggcacttgcaaat

SEQ ID NO: 156607 - DNA, 25 bp, Rattus norvegicus
agtattacatgcaccagtgctgtgc

SEQ ID NO: 156608 - DNA, 25 bp, Rattus norvegicus
agtattacatgctccagtgctgtgc

SEQ ID NO: 156609 - DNA, 25 bp, Rattus norvegicus
agtattaccctgagaagccccttct

SEQ ID NO: 156610 - DNA, 25 bp, Rattus norvegicus
agtattaccctgtgaagccccttct

SEQ ID NO: 156611 - DNA, 25 bp, Rattus norvegicus
agtattactgatccctgtgctattg

SEQ ID NO: 156612 - DNA, 25 bp, Rattus norvegicus
agtattactgatgcctgtgctattg

SEQ ID NO: 156613 - DNA, 25 bp, Rattus norvegicus
agtattactgttatctcagcatgaa

SEQ ID NO: 156614 - DNA, 25 bp, Rattus norvegicus
agtattactgttttctcagcatgaa

SEQ ID NO: 156615 - DNA, 25 bp, Rattus norvegicus
agtattacttttctgttcctcttca

SEQ ID NO: 156616 - DNA, 25 bp, Rattus norvegicus
agtattacttttgtgttcctcttca

SEQ ID NO: 156617 - DNA, 25 bp, Rattus norvegicus
agtattatatctaacggagtgccgt

SEQ ID NO: 156618 - DNA, 25 bp, Rattus norvegicus
agtattatatcttacggagtgccgt

SEQ ID NO: 156619 - DNA, 25 bp, Rattus norvegicus
agtattatctacatgtatcttgtaa

SEQ ID NO: 156620 - DNA, 25 bp, Rattus norvegicus
agtattatctacttgtatcttgtaa

SEQ ID NO: 156621 - DNA, 25 bp, Rattus norvegicus
agtattatctgtaaagtacctgctt

SEQ ID NO: 156622 - DNA, 25 bp, Rattus norvegicus
agtattatctgttaagtacctgctt

SEQ ID NO: 156623 - DNA, 25 bp, Rattus norvegicus
agtattatgtatcagcacccgtcct

SEQ ID NO: 156624 - DNA, 25 bp, Rattus norvegicus
agtattatgtatgagcacccgtcct

SEQ ID NO: 156625 - DNA, 25 bp, Rattus norvegicus
agtattattatcactaccctacaga

SEQ ID NO: 156626 - DNA, 25 bp, Rattus norvegicus
agtattattatctctaccctacaga

SEQ ID NO: 156627 - DNA, 25 bp, Rattus norvegicus
agtattattcatagctgccgggccc

SEQ ID NO: 156628 - DNA, 25 bp, Rattus norvegicus
agtattattcattgctgccgggccc

SEQ ID NO: 156629 - DNA, 25 bp, Rattus norvegicus
agtattattcctctcgaattcctgc

SEQ ID NO: 156630 - DNA, 25 bp, Rattus norvegicus
agtattattcctgtcgaattcctgc

SEQ ID NO: 156631 - DNA, 25 bp, Rattus norvegicus
agtattcaccatattccatgtggca

SEQ ID NO: 156632 - DNA, 25 bp, Rattus norvegicus
agtattcaccattttccatgtggca

SEQ ID NO: 156633 - DNA, 25 bp, Rattus norvegicus
agtattcagcctagtgttcttttct

SEQ ID NO: 156634 - DNA, 25 bp, Rattus norvegicus
agtattcagccttgtgttcttttct

SEQ ID NO: 156635 - DNA, 25 bp, Rattus norvegicus
agtattcagtgaccgatgcccttga

SEQ ID NO: 156636 - DNA, 25 bp, Rattus norvegicus
agtattcagtgagcgatgcccttga

SEQ ID NO: 156637 - DNA, 25 bp, Rattus norvegicus
agtattcatactccagcaccttcca

SEQ ID NO: 156638 - DNA, 25 bp, Rattus norvegicus
agtattcatactgcagcaccttcca

SEQ ID NO: 156639 - DNA, 25 bp, Rattus norvegicus
agtattcatttaacatcctctccat

SEQ ID NO: 156640 - DNA, 25 bp, Rattus norvegicus
agtattcatttatcatcctctccat

SEQ ID NO: 156641 - DNA, 25 bp, Rattus norvegicus
agtattccacgtaactgtcggcagc

SEQ ID NO: 156642 - DNA, 25 bp, Rattus norvegicus
agtattccacgttactgtcggcagc

SEQ ID NO: 156643 - DNA, 25 bp, Rattus norvegicus
agtattccagacaacacctgctttg

SEQ ID NO: 156644 - DNA, 25 bp, Rattus norvegicus
agtattccagactacacctgctttg

SEQ ID NO: 156645 - DNA, 25 bp, Rattus norvegicus
agtattccattgagtgcttcccaga

SEQ ID NO: 156646 - DNA, 25 bp, Rattus norvegicus
agtattccattgtgtgcttcccaga

SEQ ID NO: 156647 - DNA, 25 bp, Rattus norvegicus
agtattcccatacgctaatttctca

SEQ ID NO: 156648 - DNA, 25 bp, Rattus norvegicus
agtattcccataggctaatttctca

SEQ ID NO: 156649 - DNA, 25 bp, Rattus norvegicus
agtattcccctaatcaaccatcagt

SEQ ID NO: 156650 - DNA, 25 bp, Rattus norvegicus
agtattcccctattcaaccatcagt

SEQ ID NO: 156651 - DNA, 25 bp, Rattus norvegicus
agtattcccgccatggcaagcttct

SEQ ID NO: 156652 - DNA, 25 bp, Rattus norvegicus
agtattcccgccttggcaagcttct

SEQ ID NO: 156653 - DNA, 25 bp, Rattus norvegicus
agtattccctgaccaggcgctttgc

SEQ ID NO: 156654 - DNA, 25 bp, Rattus norvegicus
agtattccctgagcaggcgctttgc

SEQ ID NO: 156655 - DNA, 25 bp, Rattus norvegicus
agtattccggacacagcgcattgac

SEQ ID NO: 156656 - DNA, 25 bp, Rattus norvegicus
agtattccggactcagcgcattgac

SEQ ID NO: 156657 - DNA, 25 bp, Rattus norvegicus
agtattcctagcctgtcaacgtaat

SEQ ID NO: 156658 - DNA, 25 bp, Rattus norvegicus
agtattcctagcgtgtcaacgtaat

SEQ ID NO: 156659 - DNA, 25 bp, Rattus norvegicus
agtattcctgagctcaagctgactg

SEQ ID NO: 156660 - DNA, 25 bp, Rattus norvegicus
agtattcctgaggtcaagctgactg

SEQ ID NO: 156661 - DNA, 25 bp, Rattus norvegicus
agtattcctgtcaccaaaggaccgg

SEQ ID NO: 156662 - DNA, 25 bp, Rattus norvegicus
agtattcctgtctccaaaggaccgg

SEQ ID NO: 156663 - DNA, 25 bp, Rattus norvegicus
agtattccttttcatgtttgccggt

SEQ ID NO: 156664 - DNA, 25 bp, Rattus norvegicus
agtattccttttgatgtttgccggt

SEQ ID NO: 156665 - DNA, 25 bp, Rattus norvegicus
agtattcgcaggctacagccaagcc

SEQ ID NO: 156666 - DNA, 25 bp, Rattus norvegicus
agtattcgcagggtacagccaagcc

SEQ ID NO: 156667 - DNA, 25 bp, Rattus norvegicus
agtattcgtcccaggcatagcatca

SEQ ID NO: 156668 - DNA, 25 bp, Rattus norvegicus
agtattcgtccctggcatagcatca

SEQ ID NO: 156669 - DNA, 25 bp, Rattus norvegicus
agtattctaccactgccatcagctt

SEQ ID NO: 156670 - DNA, 25 bp, Rattus norvegicus
agtattctaccagtgccatcagctt

SEQ ID NO: 156671 - DNA, 25 bp, Rattus norvegicus
agtattctactcctagctgggtttc

SEQ ID NO: 156672 - DNA, 25 bp, Rattus norvegicus
agtattctactcgtagctgggtttc

SEQ ID NO: 156673 - DNA, 25 bp, Rattus norvegicus
agtattctccacaggtcatatggga

SEQ ID NO: 156674 - DNA, 25 bp, Rattus norvegicus
agtattctccactggtcatatggga

SEQ ID NO: 156675 - DNA, 25 bp, Rattus norvegicus
agtattctctatcacgtctccaaac

SEQ ID NO: 156676 - DNA, 25 bp, Rattus norvegicus
agtattctctatgacgtctccaaac

SEQ ID NO: 156677 - DNA, 25 bp, Rattus norvegicus
agtattctctctcattcgtgtccaa

SEQ ID NO: 156678 - DNA, 25 bp, Rattus norvegicus
agtattctctctgattcgtgtccaa

SEQ ID NO: 156679 - DNA, 25 bp, Rattus norvegicus
agtattctgatgattctggccttct

SEQ ID NO: 156680 - DNA, 25 bp, Rattus norvegicus
agtattctgatgtttctggccttct

SEQ ID NO: 156681 - DNA, 25 bp, Rattus norvegicus
agtattctggcaaccatcttgggtc

SEQ ID NO: 156682 - DNA, 25 bp, Rattus norvegicus
agtattctggcatccatcttgggtc

SEQ ID NO: 156683 - DNA, 25 bp, Rattus norvegicus
agtattctgtccacggagtgaccag

SEQ ID NO: 156684 - DNA, 25 bp, Rattus norvegicus
agtattctgtcctcggagtgaccag

SEQ ID NO: 156685 - DNA, 25 bp, Rattus norvegicus
agtattcttactacctaatttctgt

SEQ ID NO: 156686 - DNA, 25 bp, Rattus norvegicus
agtattcttacttcctaatttctgt

SEQ ID NO: 156687 - DNA, 25 bp, Rattus norvegicus
agtattcttcctcgtcacgcccttg

SEQ ID NO: 156688 - DNA, 25 bp, Rattus norvegicus
agtattcttcctggtcacgcccttg

SEQ ID NO: 156689 - DNA, 25 bp, Rattus norvegicus
agtattctttctatggtgtctgctt

SEQ ID NO: 156690 - DNA, 25 bp, Rattus norvegicus
agtattctttctttggtgtctgctt

SEQ ID NO: 156691 - DNA, 25 bp, Rattus norvegicus
agtattcttttgcactgttccctct

SEQ ID NO: 156692 - DNA, 25 bp, Rattus norvegicus
agtattcttttggactgttccctct

SEQ ID NO: 156693 - DNA, 25 bp, Rattus norvegicus
agtattgaactgcaaggctgccgaa

SEQ ID NO: 156694 - DNA, 25 bp, Rattus norvegicus
agtattgaactggaaggctgccgaa

SEQ ID NO: 156695 - DNA, 25 bp, Rattus norvegicus
agtattgactatagactggtacata

SEQ ID NO: 156696 - DNA, 25 bp, Rattus norvegicus
agtattgactattgactggtacata

SEQ ID NO: 156697 - DNA, 25 bp, Rattus norvegicus
agtattgagtccagtgccactgctg

SEQ ID NO: 156698 - DNA, 25 bp, Rattus norvegicus
agtattgagtcctgtgccactgctg

SEQ ID NO: 156699 - DNA, 25 bp, Rattus norvegicus
agtattgatcacctgcacttgtgtg

SEQ ID NO: 156700 - DNA, 25 bp, Rattus norvegicus
agtattgatcacgtgcacttgtgtg

SEQ ID NO: 156701 - DNA, 25 bp, Rattus norvegicus
agtattgcagtaagaccagtgtcct

SEQ ID NO: 156702 - DNA, 25 bp, Rattus norvegicus
agtattgcagtatgaccagtgtcct

SEQ ID NO: 156703 - DNA, 25 bp, Rattus norvegicus
agtattgccaccagacagatcccag

SEQ ID NO: 156704 - DNA, 25 bp, Rattus norvegicus
agtattgccacctgacagatcccag

SEQ ID NO: 156705 - DNA, 25 bp, Rattus norvegicus
agtattgccacgagatgtgctgtca

SEQ ID NO: 156706 - DNA, 25 bp, Rattus norvegicus
agtattgccacgtgatgtgctgtca

SEQ ID NO: 156707 - DNA, 25 bp, Rattus norvegicus
agtattgcgaggaggagctcactcc

SEQ ID NO: 156708 - DNA, 25 bp, Rattus norvegicus
agtattgcgaggtggagctcactcc

SEQ ID NO: 156709 - DNA, 25 bp, Rattus norvegicus
agtattgctatgaaagtgcacccta

SEQ ID NO: 156710 - DNA, 25 bp, Rattus norvegicus
agtattgctatgtaagtgcacccta

SEQ ID NO: 156711 - DNA, 25 bp, Rattus norvegicus
agtattgctttgaatcatgaggcca

SEQ ID NO: 156712 - DNA, 25 bp, Rattus norvegicus
agtattgctttgtatcatgaggcca

SEQ ID NO: 156713 - DNA, 25 bp, Rattus norvegicus
agtattggatggaccagcgtctggc

SEQ ID NO: 156714 - DNA, 25 bp, Rattus norvegicus
agtattggatggtccagcgtctggc

SEQ ID NO: 156715 - DNA, 25 bp, Rattus norvegicus
agtattgggcagaggaccatccggc

SEQ ID NO: 156716 - DNA, 25 bp, Rattus norvegicus
agtattgggcagtggaccatccggc

SEQ ID NO: 156717 - DNA, 25 bp, Rattus norvegicus
agtattgggtgcactgatgtggaaa

SEQ ID NO: 156718 - DNA, 25 bp, Rattus norvegicus
agtattgggtgctctgatgtggaaa

SEQ ID NO: 156719 - DNA, 25 bp, Rattus norvegicus
agtattggttttcccatttcaatca

SEQ ID NO: 156720 - DNA, 25 bp, Rattus norvegicus
agtattggttttgccatttcaatca

SEQ ID NO: 156721 - DNA, 25 bp, Rattus norvegicus
agtattgtaactaactgtgctgtaa

SEQ ID NO: 156722 - DNA, 25 bp, Rattus norvegicus
agtattgtaacttactgtgctgtaa

SEQ ID NO: 156723 - DNA, 25 bp, Rattus norvegicus
agtattgtatgtatcctctggattc

SEQ ID NO: 156724 - DNA, 25 bp, Rattus norvegicus
agtattgtatgtttcctctggattc

SEQ ID NO: 156725 - DNA, 25 bp, Rattus norvegicus
agtattgtattccacttcctgctac

SEQ ID NO: 156726 - DNA, 25 bp, Rattus norvegicus
agtattgtattcgacttcctgctac

SEQ ID NO: 156727 - DNA, 25 bp, Rattus norvegicus
agtattgtcccactagtcaggagga

SEQ ID NO: 156728 - DNA, 25 bp, Rattus norvegicus
agtattgtcccagtagtcaggagga

SEQ ID NO: 156729 - DNA, 25 bp, Rattus norvegicus
agtattgtcgtaatgcctctcccaa

SEQ ID NO: 156730 - DNA, 25 bp, Rattus norvegicus
agtattgtcgtattgcctctcccaa

SEQ ID NO: 156731 - DNA, 25 bp, Rattus norvegicus
agtattgtcttcaggttactcacca

SEQ ID NO: 156732 - DNA, 25 bp, Rattus norvegicus
agtattgtcttctggttactcacca

SEQ ID NO: 156733 - DNA, 25 bp, Rattus norvegicus
agtattgtggagatttgttgctgaa

SEQ ID NO: 156734 - DNA, 25 bp, Rattus norvegicus
agtattgtggagttttgttgctgaa

SEQ ID NO: 156735 - DNA, 25 bp, Rattus norvegicus
agtattgttactaatgcgtgtagac

SEQ ID NO: 156736 - DNA, 25 bp, Rattus norvegicus
agtattgttactactggccacatgt

SEQ ID NO: 156737 - DNA, 25 bp, Rattus norvegicus
agtattgttacttatgcgtgtagac

SEQ ID NO: 156738 - DNA, 25 bp, Rattus norvegicus
agtattgttacttctggccacatgt

SEQ ID NO: 156739 - DNA, 25 bp, Rattus norvegicus
agtattgttgccctttccctattag

SEQ ID NO: 156740 - DNA, 25 bp, Rattus norvegicus
agtattgttgccgtttccctattag

SEQ ID NO: 156741 - DNA, 25 bp, Rattus norvegicus
agtattgttttacaggcttctccct

SEQ ID NO: 156742 - DNA, 25 bp, Rattus norvegicus
agtattgttttagaggcttctccct

SEQ ID NO: 156743 - DNA, 25 bp, Rattus norvegicus
agtatttaaacaaccatctcccttg

SEQ ID NO: 156744 - DNA, 25 bp, Rattus norvegicus
agtatttaaacatccatctcccttg

SEQ ID NO: 156745 - DNA, 25 bp, Rattus norvegicus
agtatttaaatgctgtggatatcac

SEQ ID NO: 156746 - DNA, 25 bp, Rattus norvegicus
agtatttaaatggtgtggatatcac

SEQ ID NO: 156747 - DNA, 25 bp, Rattus norvegicus
agtatttaacacagtcttctccctt

SEQ ID NO: 156748 - DNA, 25 bp, Rattus norvegicus
agtatttaacactgtcttctccctt

SEQ ID NO: 156749 - DNA, 25 bp, Rattus norvegicus
agtatttaacatccctgccaagacc

SEQ ID NO: 156750 - DNA, 25 bp, Rattus norvegicus
agtatttaacatgcctgccaagacc

SEQ ID NO: 156751 - DNA, 25 bp, Rattus norvegicus
agtatttaagtcactcccatagccc

SEQ ID NO: 156752 - DNA, 25 bp, Rattus norvegicus
agtatttaagtctctcccatagccc

SEQ ID NO: 156753 - DNA, 25 bp, Rattus norvegicus
agtatttacccaactcaggttcctc

SEQ ID NO: 156754 - DNA, 25 bp, Rattus norvegicus
agtatttacccatctcaggttcctc

SEQ ID NO: 156755 - DNA, 25 bp, Rattus norvegicus
agtatttactccactcgttctggct

SEQ ID NO: 156756 - DNA, 25 bp, Rattus norvegicus
agtatttactcctctcgttctggct

SEQ ID NO: 156757 - DNA, 25 bp, Rattus norvegicus
agtatttacttcatctcgatcactc

SEQ ID NO: 156758 - DNA, 25 bp, Rattus norvegicus
agtatttacttcttctcgatcactc

SEQ ID NO: 156759 - DNA, 25 bp, Rattus norvegicus
agtatttatggccaccccacgtgag

SEQ ID NO: 156760 - DNA, 25 bp, Rattus norvegicus
agtatttatggcgaccccacgtgag

SEQ ID NO: 156761 - DNA, 25 bp, Rattus norvegicus
agtatttattggaagcactgacata

SEQ ID NO: 156762 - DNA, 25 bp, Rattus norvegicus
agtatttattggtagcactgacata

SEQ ID NO: 156763 - DNA, 25 bp, Rattus norvegicus
agtatttcacatctgctgcaatggg

SEQ ID NO: 156764 - DNA, 25 bp, Rattus norvegicus
agtatttcacatgtgctgcaatggg

SEQ ID NO: 156765 - DNA, 25 bp, Rattus norvegicus
agtatttcatcccagccttgtccta

SEQ ID NO: 156766 - DNA, 25 bp, Rattus norvegicus
agtatttcatccgagccttgtccta

SEQ ID NO: 156767 - DNA, 25 bp, Rattus norvegicus
agtatttcatgcctacaaagccagc

SEQ ID NO: 156768 - DNA, 25 bp, Rattus norvegicus
agtatttcatgcgtacaaagccagc

SEQ ID NO: 156769 - DNA, 25 bp, Rattus norvegicus
agtatttccaccatcaactgaggag

SEQ ID NO: 156770 - DNA, 25 bp, Rattus norvegicus
agtatttccaccttcaactgaggag

SEQ ID NO: 156771 - DNA, 25 bp, Rattus norvegicus
agtatttccctaaggcctgcatggg

SEQ ID NO: 156772 - DNA, 25 bp, Rattus norvegicus
agtatttccctatggcctgcatggg

SEQ ID NO: 156773 - DNA, 25 bp, Rattus norvegicus
agtatttccttgctgtggccccatc

SEQ ID NO: 156774 - DNA, 25 bp, Rattus norvegicus
agtatttccttggtgtggccccatc

SEQ ID NO: 156775 - DNA, 25 bp, Rattus norvegicus
agtatttcgtcccatgtgggtgctg

SEQ ID NO: 156776 - DNA, 25 bp, Rattus norvegicus
agtatttcgtccgatgtgggtgctg

SEQ ID NO: 156777 - DNA, 25 bp, Rattus norvegicus
agtatttcgtgaagactccctttct

SEQ ID NO: 156778 - DNA, 25 bp, Rattus norvegicus
agtatttcgtgatgactccctttct

SEQ ID NO: 156779 - DNA, 25 bp, Rattus norvegicus
agtatttcgttcagccttaactcaa

SEQ ID NO: 156780 - DNA, 25 bp, Rattus norvegicus
agtatttcgttctgccttaactcaa

SEQ ID NO: 156781 - DNA, 25 bp, Rattus norvegicus
agtatttctaagctggctggttcca

SEQ ID NO: 156782 - DNA, 25 bp, Rattus norvegicus
agtatttctaaggtggctggttcca

SEQ ID NO: 156783 - DNA, 25 bp, Rattus norvegicus
agtatttctacaactcctctgcaat

SEQ ID NO: 156784 - DNA, 25 bp, Rattus norvegicus
agtatttctacatctcctctgcaat

SEQ ID NO: 156785 - DNA, 25 bp, Rattus norvegicus
agtatttctcagcttactgctaccg

SEQ ID NO: 156786 - DNA, 25 bp, Rattus norvegicus
agtatttctcaggttactgctaccg

SEQ ID NO: 156787 - DNA, 25 bp, Rattus norvegicus
agtatttctctaactccttgctttt

SEQ ID NO: 156788 - DNA, 25 bp, Rattus norvegicus
agtatttctctatctccttgctttt

SEQ ID NO: 156789 - DNA, 25 bp, Rattus norvegicus
agtatttcttttaccatcattccca

SEQ ID NO: 156790 - DNA, 25 bp, Rattus norvegicus
agtatttctttttccatcattccca

SEQ ID NO: 156791 - DNA, 25 bp, Rattus norvegicus
agtatttgccagaatttcgtcccat

SEQ ID NO: 156792 - DNA, 25 bp, Rattus norvegicus
agtatttgccagtatttcgtcccat

SEQ ID NO: 156793 - DNA, 25 bp, Rattus norvegicus
agtatttggtcaacatagctgcccc

SEQ ID NO: 156794 - DNA, 25 bp, Rattus norvegicus
agtatttggtcatcatagctgcccc

SEQ ID NO: 156795 - DNA, 25 bp, Rattus norvegicus
agtattttcaggctttgccacacta

SEQ ID NO: 156796 - DNA, 25 bp, Rattus norvegicus
agtattttcagggtttgccacacta

SEQ ID NO: 156797 - DNA, 25 bp, Rattus norvegicus
agtattttctgcagaacctacctcc

SEQ ID NO: 156798 - DNA, 25 bp, Rattus norvegicus
agtattttctgctgaacctacctcc

SEQ ID NO: 156799 - DNA, 25 bp, Rattus norvegicus
agtattttgatgctgctaccgctga

SEQ ID NO: 156800 - DNA, 25 bp, Rattus norvegicus
agtattttgatggtgctaccgctga

SEQ ID NO: 156801 - DNA, 25 bp, Rattus norvegicus
agtattttgtgaccatcgtcccatg

SEQ ID NO: 156802 - DNA, 25 bp, Rattus norvegicus
agtattttgtgagcatcgtcccatg

SEQ ID NO: 156803 - DNA, 25 bp, Rattus norvegicus
agtatttttcctccacagcgatctt

SEQ ID NO: 156804 - DNA, 25 bp, Rattus norvegicus
agtatttttcctgcacagcgatctt

SEQ ID NO: 156805 - DNA, 25 bp, Rattus norvegicus
agtatttttctcagcagtaaatcaa

SEQ ID NO: 156806 - DNA, 25 bp, Rattus norvegicus
agtatttttctctgcagtaaatcaa

SEQ ID NO: 156807 - DNA, 25 bp, Rattus norvegicus
agtatttttgcaactgtgggaccta

SEQ ID NO: 156808 - DNA, 25 bp, Rattus norvegicus
agtatttttgcatctgtgggaccta

SEQ ID NO: 156809 - DNA, 25 bp, Rattus norvegicus
agtatttttggtatgccactccctg

SEQ ID NO: 156810 - DNA, 25 bp, Rattus norvegicus
agtatttttggtttgccactccctg

SEQ ID NO: 156811 - DNA, 25 bp, Rattus norvegicus
agtcaaaaactgacccctatctata

SEQ ID NO: 156812 - DNA, 25 bp, Rattus norvegicus
agtcaaaaactgtcccctatctata

SEQ ID NO: 156813 - DNA, 25 bp, Rattus norvegicus
agtcaaaaagtcagttgcacatgcg

SEQ ID NO: 156814 - DNA, 25 bp, Rattus norvegicus
agtcaaaaagtctgttgcacatgcg

SEQ ID NO: 156815 - DNA, 25 bp, Rattus norvegicus
agtcaaaacttgagccccaatcatc

SEQ ID NO: 156816 - DNA, 25 bp, Rattus norvegicus
agtcaaaacttgtgccccaatcatc

SEQ ID NO: 156817 - DNA, 25 bp, Rattus norvegicus
agtcaaacacccctactgaaagcag

SEQ ID NO: 156818 - DNA, 25 bp, Rattus norvegicus
agtcaaacacccgtactgaaagcag

SEQ ID NO: 156819 - DNA, 25 bp, Rattus norvegicus
agtcaaagccacaagtttccactgc

SEQ ID NO: 156820 - DNA, 25 bp, Rattus norvegicus
agtcaaagccactagtttccactgc

SEQ ID NO: 156821 - DNA, 25 bp, Rattus norvegicus
agtcaaattcagaccttggtttcct

SEQ ID NO: 156822 - DNA, 25 bp, Rattus norvegicus
agtcaaattcagtccttggtttcct

SEQ ID NO: 156823 - DNA, 25 bp, Rattus norvegicus
agtcaacacctcacagtttgctgat

SEQ ID NO: 156824 - DNA, 25 bp, Rattus norvegicus
agtcaacacctctcagtttgctgat

SEQ ID NO: 156825 - DNA, 25 bp, Rattus norvegicus
agtcaaccaactaatcaccgcattt

SEQ ID NO: 156826 - DNA, 25 bp, Rattus norvegicus
agtcaaccaacttatcaccgcattt

SEQ ID NO: 156827 - DNA, 25 bp, Rattus norvegicus
agtcaaccatggacacggagttctg

SEQ ID NO: 156828 - DNA, 25 bp, Rattus norvegicus
agtcaaccatggtcacggagttctg

SEQ ID NO: 156829 - DNA, 25 bp, Rattus norvegicus
agtcaaccctctctttattctggaa

SEQ ID NO: 156830 - DNA, 25 bp, Rattus norvegicus
agtcaaccctctgtttattctggaa

SEQ ID NO: 156831 - DNA, 25 bp, Rattus norvegicus
agtcaaccctttagagcggctcgga

SEQ ID NO: 156832 - DNA, 25 bp, Rattus norvegicus
agtcaacccttttgagcggctcgga

SEQ ID NO: 156833 - DNA, 25 bp, Rattus norvegicus
agtcaacctataccatgtgcgggag

SEQ ID NO: 156834 - DNA, 25 bp, Rattus norvegicus
agtcaacctatagcatgtgcgggag

SEQ ID NO: 156835 - DNA, 25 bp, Rattus norvegicus
agtcaacctgacatggccctttatg

SEQ ID NO: 156836 - DNA, 25 bp, Rattus norvegicus
agtcaacctgacttggccctttatg

SEQ ID NO: 156837 - DNA, 25 bp, Rattus norvegicus
agtcaaccttagaattctctgcaag

SEQ ID NO: 156838 - DNA, 25 bp, Rattus norvegicus
agtcaaccttagtattctctgcaag

SEQ ID NO: 156839 - DNA, 25 bp, Rattus norvegicus
agtcaacgacctacctgtgggacgc

SEQ ID NO: 156840 - DNA, 25 bp, Rattus norvegicus
agtcaacgaccttcctgtgggacgc

SEQ ID NO: 156841 - DNA, 25 bp, Rattus norvegicus
agtcaacgattcactcagcctttaa

SEQ ID NO: 156842 - DNA, 25 bp, Rattus norvegicus
agtcaacgattctctcagcctttaa

SEQ ID NO: 156843 - DNA, 25 bp, Rattus norvegicus
agtcaactacatctacacctcagag

SEQ ID NO: 156844 - DNA, 25 bp, Rattus norvegicus
agtcaactacatgtacacctcagag

SEQ ID NO: 156845 - DNA, 25 bp, Rattus norvegicus
agtcaactattactgccacccaggc

SEQ ID NO: 156846 - DNA, 25 bp, Rattus norvegicus
agtcaactattagtgccacccaggc

SEQ ID NO: 156847 - DNA, 25 bp, Rattus norvegicus
agtcaactcatacccattaaccaga

SEQ ID NO: 156848 - DNA, 25 bp, Rattus norvegicus
agtcaactcatagccattaaccaga

SEQ ID NO: 156849 - DNA, 25 bp, Rattus norvegicus
agtcaactcctactgtctaagcaga

SEQ ID NO: 156850 - DNA, 25 bp, Rattus norvegicus
agtcaactcctagtgtctaagcaga

SEQ ID NO: 156851 - DNA, 25 bp, Rattus norvegicus
agtcaactctatccttaccaactgc

SEQ ID NO: 156852 - DNA, 25 bp, Rattus norvegicus
agtcaactctatgcttaccaactgc

SEQ ID NO: 156853 - DNA, 25 bp, Rattus norvegicus
agtcaactctgcaaacactggttta

SEQ ID NO: 156854 - DNA, 25 bp, Rattus norvegicus
agtcaactctgctaacactggttta

SEQ ID NO: 156855 - DNA, 25 bp, Rattus norvegicus
agtcaactgacaaggcccaactagc

SEQ ID NO: 156856 - DNA, 25 bp, Rattus norvegicus
agtcaactgacatggcccaactagc

SEQ ID NO: 156857 - DNA, 25 bp, Rattus norvegicus
agtcaactgcatacatcctgggaga

SEQ ID NO: 156858 - DNA, 25 bp, Rattus norvegicus
agtcaactgcattcatcctgggaga

SEQ ID NO: 156859 - DNA, 25 bp, Rattus norvegicus
agtcaactgcctatcaaacgtggtc

SEQ ID NO: 156860 - DNA, 25 bp, Rattus norvegicus
agtcaactgcctttcaaacgtggtc

SEQ ID NO: 156861 - DNA, 25 bp, Rattus norvegicus
agtcaactggctcaactcaacggca

SEQ ID NO: 156862 - DNA, 25 bp, Rattus norvegicus
agtcaactggctgaactcaacggca

SEQ ID NO: 156863 - DNA, 25 bp, Rattus norvegicus
agtcaactgtgtatctcttgtttcc

SEQ ID NO: 156864 - DNA, 25 bp, Rattus norvegicus
agtcaactgtgtttctcttgtttcc

SEQ ID NO: 156865 - DNA, 25 bp, Rattus norvegicus
agtcaacttgcccagatacacgtat

SEQ ID NO: 156866 - DNA, 25 bp, Rattus norvegicus
agtcaacttgccgagatacacgtat

SEQ ID NO: 156867 - DNA, 25 bp, Rattus norvegicus
agtcaagaaaccagtgctatccccg

SEQ ID NO: 156868 - DNA, 25 bp, Rattus norvegicus
agtcaagaaacctgtgctatccccg

SEQ ID NO: 156869 - DNA, 25 bp, Rattus norvegicus
agtcaagaactgactgcagcgccca

SEQ ID NO: 156870 - DNA, 25 bp, Rattus norvegicus
agtcaagaactgtctgcagcgccca

SEQ ID NO: 156871 - DNA, 25 bp, Rattus norvegicus
agtcaagagcctatcgcctggcctc

SEQ ID NO: 156872 - DNA, 25 bp, Rattus norvegicus
agtcaagagcctttcgcctggcctc

SEQ ID NO: 156873 - DNA, 25 bp, Rattus norvegicus
agtcaagatcacagccggctcctgt

SEQ ID NO: 156874 - DNA, 25 bp, Rattus norvegicus
agtcaagatcactgccggctcctgt

SEQ ID NO: 156875 - DNA, 25 bp, Rattus norvegicus
agtcaagcacagctagatctctatg

SEQ ID NO: 156876 - DNA, 25 bp, Rattus norvegicus
agtcaagcacaggtagatctctatg

SEQ ID NO: 156877 - DNA, 25 bp, Rattus norvegicus
agtcaagcacctaccagagcagaac

SEQ ID NO: 156878 - DNA, 25 bp, Rattus norvegicus
agtcaagcaccttccagagcagaac

SEQ ID NO: 156879 - DNA, 25 bp, Rattus norvegicus
agtcaagcagcacccggtacaactg

SEQ ID NO: 156880 - DNA, 25 bp, Rattus norvegicus
agtcaagcagcagccggtacaactg

SEQ ID NO: 156881 - DNA, 25 bp, Rattus norvegicus
agtcaagccagaacaccgagtattt

SEQ ID NO: 156882 - DNA, 25 bp, Rattus norvegicus
agtcaagccagatcaccgagtattt

SEQ ID NO: 156883 - DNA, 25 bp, Rattus norvegicus
agtcaagccaggactcctttgttgc

SEQ ID NO: 156884 - DNA, 25 bp, Rattus norvegicus
agtcaagccaggtctcctttgttgc

SEQ ID NO: 156885 - DNA, 25 bp, Rattus norvegicus
agtcaagccagtctgatctacagag

SEQ ID NO: 156886 - DNA, 25 bp, Rattus norvegicus
agtcaagccagtgtgatctacagag

SEQ ID NO: 156887 - DNA, 25 bp, Rattus norvegicus
agtcaagccctcagttcagaatcaa

SEQ ID NO: 156888 - DNA, 25 bp, Rattus norvegicus
agtcaagccctctgttcagaatcaa

SEQ ID NO: 156889 - DNA, 25 bp, Rattus norvegicus
agtcaagcctgcatgttgtggtttc

SEQ ID NO: 156890 - DNA, 25 bp, Rattus norvegicus
agtcaagcctgcttgttgtggtttc

SEQ ID NO: 156891 - DNA, 25 bp, Rattus norvegicus
agtcaagctactcaaactgtcttct

SEQ ID NO: 156892 - DNA, 25 bp, Rattus norvegicus
agtcaagctactgaaactgtcttct

SEQ ID NO: 156893 - DNA, 25 bp, Rattus norvegicus
agtcaaggacttcagaatagcagtt

SEQ ID NO: 156894 - DNA, 25 bp, Rattus norvegicus
agtcaaggacttgagaatagcagtt

SEQ ID NO: 156895 - DNA, 25 bp, Rattus norvegicus
agtcaaggccatcttttgcctgggc

SEQ ID NO: 156896 - DNA, 25 bp, Rattus norvegicus
agtcaaggccatgttttgcctgggc

SEQ ID NO: 156897 - DNA, 25 bp, Rattus norvegicus
agtcaaggccccagtagtcttctga

SEQ ID NO: 156898 - DNA, 25 bp, Rattus norvegicus
agtcaaggcccctgtagtcttctga

SEQ ID NO: 156899 - DNA, 25 bp, Rattus norvegicus
agtcaagggtatctgtactgtaatt

SEQ ID NO: 156900 - DNA, 25 bp, Rattus norvegicus
agtcaagggtatgtgtactgtaatt

SEQ ID NO: 156901 - DNA, 25 bp, Rattus norvegicus
agtcaagtctctaacagaaccctgc

SEQ ID NO: 156902 - DNA, 25 bp, Rattus norvegicus
agtcaagtctcttacagaaccctgc

SEQ ID NO: 156903 - DNA, 25 bp, Rattus norvegicus
agtcaagtgcagactctgaccgtca

SEQ ID NO: 156904 - DNA, 25 bp, Rattus norvegicus
agtcaagtgcagtctctgaccgtca

SEQ ID NO: 156905 - DNA, 25 bp, Rattus norvegicus
agtcaagtggacagcacccgaggct

SEQ ID NO: 156906 - DNA, 25 bp, Rattus norvegicus
agtcaagtggactgcacccgaggct

SEQ ID NO: 156907 - DNA, 25 bp, Rattus norvegicus
agtcaagtgtgccactgagtaacac

SEQ ID NO: 156908 - DNA, 25 bp, Rattus norvegicus
agtcaagtgtgcgactgagtaacac

SEQ ID NO: 156909 - DNA, 25 bp, Rattus norvegicus
agtcaagttagcatgctttctcctg

SEQ ID NO: 156910 - DNA, 25 bp, Rattus norvegicus
agtcaagttagcttgctttctcctg

SEQ ID NO: 156911 - DNA, 25 bp, Rattus norvegicus
agtcaagttctcctgtttaccaata

SEQ ID NO: 156912 - DNA, 25 bp, Rattus norvegicus
agtcaagttctcgtgtttaccaata

SEQ ID NO: 156913 - DNA, 25 bp, Rattus norvegicus
agtcaagttctgcactgatgcgtta

SEQ ID NO: 156914 - DNA, 25 bp, Rattus norvegicus
agtcaagttctggactgatgcgtta

SEQ ID NO: 156915 - DNA, 25 bp, Rattus norvegicus
agtcaagttcttcctgtgcgtgaaa

SEQ ID NO: 156916 - DNA, 25 bp, Rattus norvegicus
agtcaagttcttgctgtgcgtgaaa

SEQ ID NO: 156917 - DNA, 25 bp, Rattus norvegicus
agtcaagttggtagaggctgcccag

SEQ ID NO: 156918 - DNA, 25 bp, Rattus norvegicus
agtcaagttggttgaggctgcccag

SEQ ID NO: 156919 - DNA, 25 bp, Rattus norvegicus
agtcaagttgtcagcaaagacccct

SEQ ID NO: 156920 - DNA, 25 bp, Rattus norvegicus
agtcaagttgtctgcaaagacccct

SEQ ID NO: 156921 - DNA, 25 bp, Rattus norvegicus
agtcaagtttacacagccttgccta

SEQ ID NO: 156922 - DNA, 25 bp, Rattus norvegicus
agtcaagtttactcagccttgccta

SEQ ID NO: 156923 - DNA, 25 bp, Rattus norvegicus
agtcaatagtataccctctactgcc

SEQ ID NO: 156924 - DNA, 25 bp, Rattus norvegicus
agtcaatagtattccctctactgcc

SEQ ID NO: 156925 - DNA, 25 bp, Rattus norvegicus
agtcaatcaatcactctgttaggag

SEQ ID NO: 156926 - DNA, 25 bp, Rattus norvegicus
agtcaatcaatctctctgttaggag

SEQ ID NO: 156927 - DNA, 25 bp, Rattus norvegicus
agtcaatcacttcttctttctcttt

SEQ ID NO: 156928 - DNA, 25 bp, Rattus norvegicus
agtcaatcacttgttctttctcttt

SEQ ID NO: 156929 - DNA, 25 bp, Rattus norvegicus
agtcaatcgaagacgttcgtaatgg

SEQ ID NO: 156930 - DNA, 25 bp, Rattus norvegicus
agtcaatcgaagtcgttcgtaatgg

SEQ ID NO: 156931 - DNA, 25 bp, Rattus norvegicus
agtcaatctcttatccttttgtgtc

SEQ ID NO: 156932 - DNA, 25 bp, Rattus norvegicus
agtcaatctcttttccttttgtgtc

SEQ ID NO: 156933 - DNA, 25 bp, Rattus norvegicus
agtcaatctgcaccgaaagcccaag

SEQ ID NO: 156934 - DNA, 25 bp, Rattus norvegicus
agtcaatctgcagcgaaagcccaag

SEQ ID NO: 156935 - DNA, 25 bp, Rattus norvegicus
agtcaatctgtcatgctctgcactg

SEQ ID NO: 156936 - DNA, 25 bp, Rattus norvegicus
agtcaatctgtcttgctctgcactg

SEQ ID NO: 156937 - DNA, 25 bp, Rattus norvegicus
agtcaatcttagatacacaccaccg

SEQ ID NO: 156938 - DNA, 25 bp, Rattus norvegicus
agtcaatcttagttacacaccaccg

SEQ ID NO: 156939 - DNA, 25 bp, Rattus norvegicus
agtcaatggctactttttcctaatt

SEQ ID NO: 156940 - DNA, 25 bp, Rattus norvegicus
agtcaatggctagtttttcctaatt

SEQ ID NO: 156941 - DNA, 25 bp, Rattus norvegicus
agtcaattagggagtgccaagtgaa

SEQ ID NO: 156942 - DNA, 25 bp, Rattus norvegicus
agtcaattagggtgtgccaagtgaa

SEQ ID NO: 156943 - DNA, 25 bp, Rattus norvegicus
agtcaattccttatccatgttttta

SEQ ID NO: 156944 - DNA, 25 bp, Rattus norvegicus
agtcaattccttttccatgttttta

SEQ ID NO: 156945 - DNA, 25 bp, Rattus norvegicus
agtcaatttgccaaattagttatga

SEQ ID NO: 156946 - DNA, 25 bp, Rattus norvegicus
agtcaatttgcctaattagttatga

SEQ ID NO: 156947 - DNA, 25 bp, Rattus norvegicus
agtcaatttgctaggcatgctcctt

SEQ ID NO: 156948 - DNA, 25 bp, Rattus norvegicus
agtcaatttgcttggcatgctcctt

SEQ ID NO: 156949 - DNA, 25 bp, Rattus norvegicus
agtcaattttccctcttgggatctc

SEQ ID NO: 156950 - DNA, 25 bp, Rattus norvegicus
agtcaattttccgtcttgggatctc

SEQ ID NO: 156951 - DNA, 25 bp, Rattus norvegicus
agtcacaaagtcatctgagcctgct

SEQ ID NO: 156952 - DNA, 25 bp, Rattus norvegicus
agtcacaaagtcttctgagcctgct

SEQ ID NO: 156953 - DNA, 25 bp, Rattus norvegicus
agtcacaacaccaagcgtgctttcc

SEQ ID NO: 156954 - DNA, 25 bp, Rattus norvegicus
agtcacaacacctagcgtgctttcc

SEQ ID NO: 156955 - DNA, 25 bp, Rattus norvegicus
agtcacaaccatccactgggtttag

SEQ ID NO: 156956 - DNA, 25 bp, Rattus norvegicus
agtcacaaccatgcactgggtttag

SEQ ID NO: 156957 - DNA, 25 bp, Rattus norvegicus
agtcacaagggaccagttccacttt

SEQ ID NO: 156958 - DNA, 25 bp, Rattus norvegicus
agtcacaagggagcagttccacttt

SEQ ID NO: 156959 - DNA, 25 bp, Rattus norvegicus
agtcacaagtggatatgagctgcct

SEQ ID NO: 156960 - DNA, 25 bp, Rattus norvegicus
agtcacaagtggttatgagctgcct

SEQ ID NO: 156961 - DNA, 25 bp, Rattus norvegicus
agtcacaatgtaatccgttttcagg

SEQ ID NO: 156962 - DNA, 25 bp, Rattus norvegicus
agtcacaatgtattccgttttcagg

SEQ ID NO: 156963 - DNA, 25 bp, Rattus norvegicus
agtcacaatgtcagccttactggct

SEQ ID NO: 156964 - DNA, 25 bp, Rattus norvegicus
agtcacaatgtctgccttactggct

SEQ ID NO: 156965 - DNA, 25 bp, Rattus norvegicus
agtcacaatttaactgccgctgttg

SEQ ID NO: 156966 - DNA, 25 bp, Rattus norvegicus
agtcacaatttatctgccgctgttg

SEQ ID NO: 156967 - DNA, 25 bp, Rattus norvegicus
agtcacacatagatatatcccaccg

SEQ ID NO: 156968 - DNA, 25 bp, Rattus norvegicus
agtcacacatagttatatcccaccg

SEQ ID NO: 156969 - DNA, 25 bp, Rattus norvegicus
agtcacacatgccaggccctggaaa

SEQ ID NO: 156970 - DNA, 25 bp, Rattus norvegicus
agtcacacatgcgaggccctggaaa

SEQ ID NO: 156971 - DNA, 25 bp, Rattus norvegicus
agtcacacccctactgagactgggt

SEQ ID NO: 156972 - DNA, 25 bp, Rattus norvegicus
agtcacaccccttctgagactgggt

SEQ ID NO: 156973 - DNA, 25 bp, Rattus norvegicus
agtcacacctgcagaagctgcttca

SEQ ID NO: 156974 - DNA, 25 bp, Rattus norvegicus
agtcacacctgctgaagctgcttca

SEQ ID NO: 156975 - DNA, 25 bp, Rattus norvegicus
agtcacactgaacagccgtcacatt

SEQ ID NO: 156976 - DNA, 25 bp, Rattus norvegicus
agtcacactgaagagccgtcacatt

SEQ ID NO: 156977 - DNA, 25 bp, Rattus norvegicus
agtcacagaggaaaaccccacacag

SEQ ID NO: 156978 - DNA, 25 bp, Rattus norvegicus
agtcacagaggataaccccacacag

SEQ ID NO: 156979 - DNA, 25 bp, Rattus norvegicus
agtcacagaggtagcgtctatccag

SEQ ID NO: 156980 - DNA, 25 bp, Rattus norvegicus
agtcacagaggttgcgtctatccag

SEQ ID NO: 156981 - DNA, 25 bp, Rattus norvegicus
agtcacagctgcactgcttcttttg

SEQ ID NO: 156982 - DNA, 25 bp, Rattus norvegicus
agtcacagctgctctgcttcttttg

SEQ ID NO: 156983 - DNA, 25 bp, Rattus norvegicus
agtcacaggagcatcaccaagatgt

SEQ ID NO: 156984 - DNA, 25 bp, Rattus norvegicus
agtcacaggagcttcaccaagatgt

SEQ ID NO: 156985 - DNA, 25 bp, Rattus norvegicus
agtcacaggcacagaggaagcccgt

SEQ ID NO: 156986 - DNA, 25 bp, Rattus norvegicus
agtcacaggcactgaggaagcccgt

SEQ ID NO: 156987 - DNA, 25 bp, Rattus norvegicus
agtcacaggtgaagcagggcttcat

SEQ ID NO: 156988 - DNA, 25 bp, Rattus norvegicus
agtcacaggtgatgcagggcttcat

SEQ ID NO: 156989 - DNA, 25 bp, Rattus norvegicus
agtcacagtctcaaagtcctttggc

SEQ ID NO: 156990 - DNA, 25 bp, Rattus norvegicus
agtcacagtctctaagtcctttggc

SEQ ID NO: 156991 - DNA, 25 bp, Rattus norvegicus
agtcacagtgacacaatcagctcct

SEQ ID NO: 156992 - DNA, 25 bp, Rattus norvegicus
agtcacagtgactcaatcagctcct

SEQ ID NO: 156993 - DNA, 25 bp, Rattus norvegicus
agtcacagtgtaaccggagtcccca

SEQ ID NO: 156994 - DNA, 25 bp, Rattus norvegicus
agtcacagtgtacctgaggtcccca

SEQ ID NO: 156995 - DNA, 25 bp, Rattus norvegicus
agtcacagtgtagctgaggtcccca

SEQ ID NO: 156996 - DNA, 25 bp, Rattus norvegicus
agtcacagtgtatccggagtcccca

SEQ ID NO: 156997 - DNA, 25 bp, Rattus norvegicus
agtcacatacacataccagtcagat

SEQ ID NO: 156998 - DNA, 25 bp, Rattus norvegicus
agtcacatacacttaccagtcagat

SEQ ID NO: 156999 - DNA, 25 bp, Rattus norvegicus
agtcacatagcaataccacactcta

SEQ ID NO: 157000 - DNA, 25 bp, Rattus norvegicus
agtcacatagcattaccacactcta

SEQ ID NO: 157001 - DNA, 25 bp, Rattus norvegicus
agtcacatagggatgtctcctcaaa

SEQ ID NO: 157002 - DNA, 25 bp, Rattus norvegicus
agtcacatagggttgtctcctcaaa

SEQ ID NO: 157003 - DNA, 25 bp, Rattus norvegicus
agtcacatatttagctcactcactg

SEQ ID NO: 157004 - DNA, 25 bp, Rattus norvegicus
agtcacatattttgctcactcactg

SEQ ID NO: 157005 - DNA, 25 bp, Rattus norvegicus
agtcacatcattcgtgctcctgcga

SEQ ID NO: 157006 - DNA, 25 bp, Rattus norvegicus
agtcacatcattggtgctcctgcga

SEQ ID NO: 157007 - DNA, 25 bp, Rattus norvegicus
agtcacatcctcagggactagggtt

SEQ ID NO: 157008 - DNA, 25 bp, Rattus norvegicus
agtcacatcctctgggactagggtt

SEQ ID NO: 157009 - DNA, 25 bp, Rattus norvegicus
agtcacatcttgacttccaccatag

SEQ ID NO: 157010 - DNA, 25 bp, Rattus norvegicus
agtcacatcttgtcttccaccatag

SEQ ID NO: 157011 - DNA, 25 bp, Rattus norvegicus
agtcacatgcacctgccctttgctg

SEQ ID NO: 157012 - DNA, 25 bp, Rattus norvegicus
agtcacatgcacgtgccctttgctg

SEQ ID NO: 157013 - DNA, 25 bp, Rattus norvegicus
agtcacatgcccacgagaagtatga

SEQ ID NO: 157014 - DNA, 25 bp, Rattus norvegicus
agtcacatgccctcgagaagtatga

SEQ ID NO: 157015 - DNA, 25 bp, Rattus norvegicus
agtcacatggacatctgtcatcggc

SEQ ID NO: 157016 - DNA, 25 bp, Rattus norvegicus
agtcacatggacttctgtcatcggc

SEQ ID NO: 157017 - DNA, 25 bp, Rattus norvegicus
agtcacatggatatgccgacccagg

SEQ ID NO: 157018 - DNA, 25 bp, Rattus norvegicus
agtcacatggatttgccgacccagg

SEQ ID NO: 157019 - DNA, 25 bp, Rattus norvegicus
agtcacatggcacacttacattcac

SEQ ID NO: 157020 - DNA, 25 bp, Rattus norvegicus
agtcacatggcagacttacattcac

SEQ ID NO: 157021 - DNA, 25 bp, Rattus norvegicus
agtcacatgtagctcggatctcata

SEQ ID NO: 157022 - DNA, 25 bp, Rattus norvegicus
agtcacatgtaggtcggatctcata

SEQ ID NO: 157023 - DNA, 25 bp, Rattus norvegicus
agtcacattaccaacttgcatgaag

SEQ ID NO: 157024 - DNA, 25 bp, Rattus norvegicus
agtcacattacctacttgcatgaag

SEQ ID NO: 157025 - DNA, 25 bp, Rattus norvegicus
agtcacattcaacacctgggctggc

SEQ ID NO: 157026 - DNA, 25 bp, Rattus norvegicus
agtcacattcaagacctgggctggc

SEQ ID NO: 157027 - DNA, 25 bp, Rattus norvegicus
agtcacattccacatctgtttcaaa

SEQ ID NO: 157028 - DNA, 25 bp, Rattus norvegicus
agtcacattccagatctgtttcaaa

SEQ ID NO: 157029 - DNA, 25 bp, Rattus norvegicus
agtcacattctacacaagtctgagg

SEQ ID NO: 157030 - DNA, 25 bp, Rattus norvegicus
agtcacattctagacaagtctgagg

SEQ ID NO: 157031 - DNA, 25 bp, Rattus norvegicus
agtcacatttcccatgaggtgtttg

SEQ ID NO: 157032 - DNA, 25 bp, Rattus norvegicus
agtcacatttccgatgaggtgtttg

SEQ ID NO: 157033 - DNA, 25 bp, Rattus norvegicus
agtcacatttgaccctaaccatatt

SEQ ID NO: 157034 - DNA, 25 bp, Rattus norvegicus
agtcacatttgagcctaaccatatt

SEQ ID NO: 157035 - DNA, 25 bp, Rattus norvegicus
agtcaccaacttcacttcttcaagt

SEQ ID NO: 157036 - DNA, 25 bp, Rattus norvegicus
agtcaccaacttgacttcttcaagt

SEQ ID NO: 157037 - DNA, 25 bp, Rattus norvegicus
agtcaccaattgagttaatccttga

SEQ ID NO: 157038 - DNA, 25 bp, Rattus norvegicus
agtcaccaattgtgttaatccttga

SEQ ID NO: 157039 - DNA, 25 bp, Rattus norvegicus
agtcaccacatgatctgctattgca

SEQ ID NO: 157040 - DNA, 25 bp, Rattus norvegicus
agtcaccacatgttctgctattgca

SEQ ID NO: 157041 - DNA, 25 bp, Rattus norvegicus
agtcaccaccctatgaggatggctc

SEQ ID NO: 157042 - DNA, 25 bp, Rattus norvegicus
agtcaccaccctttgaggatggctc

SEQ ID NO: 157043 - DNA, 25 bp, Rattus norvegicus
agtcaccacgctaatcctcggagga

SEQ ID NO: 157044 - DNA, 25 bp, Rattus norvegicus
agtcaccacgcttatcctcggagga

SEQ ID NO: 157045 - DNA, 25 bp, Rattus norvegicus
agtcaccactatacttctcaactgt

SEQ ID NO: 157046 - DNA, 25 bp, Rattus norvegicus
agtcaccactattcttctcaactgt

SEQ ID NO: 157047 - DNA, 25 bp, Rattus norvegicus
agtcaccactggacatatcagacga

SEQ ID NO: 157048 - DNA, 25 bp, Rattus norvegicus
agtcaccactggtcatatcagacga

SEQ ID NO: 157049 - DNA, 25 bp, Rattus norvegicus
agtcaccacttcaatccttgttatt

SEQ ID NO: 157050 - DNA, 25 bp, Rattus norvegicus
agtcaccacttctatccttgttatt

SEQ ID NO: 157051 - DNA, 25 bp, Rattus norvegicus
agtcaccagctgatgttatttcttg

SEQ ID NO: 157052 - DNA, 25 bp, Rattus norvegicus
agtcaccagctgttgttatttcttg

SEQ ID NO: 157053 - DNA, 25 bp, Rattus norvegicus
agtcaccagggacggaacgccaact

SEQ ID NO: 157054 - DNA, 25 bp, Rattus norvegicus
agtcaccagggagggaacgccaact

SEQ ID NO: 157055 - DNA, 25 bp, Rattus norvegicus
agtcaccaggtcatgttgagtttca

SEQ ID NO: 157056 - DNA, 25 bp, Rattus norvegicus
agtcaccaggtcttgttgagtttca

SEQ ID NO: 157057 - DNA, 25 bp, Rattus norvegicus
agtcaccatccacacatgaactgtc

SEQ ID NO: 157058 - DNA, 25 bp, Rattus norvegicus
agtcaccatccagacatgaactgtc

SEQ ID NO: 157059 - DNA, 25 bp, Rattus norvegicus
agtcaccatctaaattccaaggaaa

SEQ ID NO: 157060 - DNA, 25 bp, Rattus norvegicus
agtcaccatctatattccaaggaaa

SEQ ID NO: 157061 - DNA, 25 bp, Rattus norvegicus
agtcaccattctcgcaaaacttcag

SEQ ID NO: 157062 - DNA, 25 bp, Rattus norvegicus
agtcaccattctggcaaaacttcag

SEQ ID NO: 157063 - DNA, 25 bp, Rattus norvegicus
agtcacccacaaacttggcgtgtga

SEQ ID NO: 157064 - DNA, 25 bp, Rattus norvegicus
agtcacccacaatcttggcgtgtga

SEQ ID NO: 157065 - DNA, 25 bp, Rattus norvegicus
agtcacccatccataggctcaggtt

SEQ ID NO: 157066 - DNA, 25 bp, Rattus norvegicus
agtcacccatccttaggctcaggtt

SEQ ID NO: 157067 - DNA, 25 bp, Rattus norvegicus
agtcaccccattctctatacttgga

SEQ ID NO: 157068 - DNA, 25 bp, Rattus norvegicus
agtcaccccattgtctatacttgga

SEQ ID NO: 157069 - DNA, 25 bp, Rattus norvegicus
agtcacccctaaaagcactgaagaa

SEQ ID NO: 157070 - DNA, 25 bp, Rattus norvegicus
agtcacccctaatagcactgaagaa

SEQ ID NO: 157071 - DNA, 25 bp, Rattus norvegicus
agtcaccccttcaaagaattctgtc

SEQ ID NO: 157072 - DNA, 25 bp, Rattus norvegicus
agtcaccccttctaagaattctgtc

SEQ ID NO: 157073 - DNA, 25 bp, Rattus norvegicus
agtcaccctagaccatccattaaga

SEQ ID NO: 157074 - DNA, 25 bp, Rattus norvegicus
agtcaccctagagcatccattaaga

SEQ ID NO: 157075 - DNA, 25 bp, Rattus norvegicus
agtcaccctgccagagtttgcatgg

SEQ ID NO: 157076 - DNA, 25 bp, Rattus norvegicus
agtcaccctgcctgagtttgcatgg

SEQ ID NO: 157077 - DNA, 25 bp, Rattus norvegicus
agtcaccctggcattggctgttggc

SEQ ID NO: 157078 - DNA, 25 bp, Rattus norvegicus
agtcaccctggctttggctgttggc

SEQ ID NO: 157079 - DNA, 25 bp, Rattus norvegicus
agtcaccgaaggacagcagccatta

SEQ ID NO: 157080 - DNA, 25 bp, Rattus norvegicus
agtcaccgaaggtcagcagccatta

SEQ ID NO: 157081 - DNA, 25 bp, Rattus norvegicus
agtcaccgtggcaacagggagtcat

SEQ ID NO: 157082 - DNA, 25 bp, Rattus norvegicus
agtcaccgtggctacagggagtcat

SEQ ID NO: 157083 - DNA, 25 bp, Rattus norvegicus
agtcaccgttccctagtttctgaag

SEQ ID NO: 157084 - DNA, 25 bp, Rattus norvegicus
agtcaccgttccgtagtttctgaag

SEQ ID NO: 157085 - DNA, 25 bp, Rattus norvegicus
agtcacctaaggcttcgttggcgct

SEQ ID NO: 157086 - DNA, 25 bp, Rattus norvegicus
agtcacctaagggttcgttggcgct

SEQ ID NO: 157087 - DNA, 25 bp, Rattus norvegicus
agtcacctagcacaaaatccctatg

SEQ ID NO: 157088 - DNA, 25 bp, Rattus norvegicus
agtcacctagcagaaaatccctatg

SEQ ID NO: 157089 - DNA, 25 bp, Rattus norvegicus
agtcacctcactctgctttggaaga

SEQ ID NO: 157090 - DNA, 25 bp, Rattus norvegicus
agtcacctcactgtgctttggaaga

SEQ ID NO: 157091 - DNA, 25 bp, Rattus norvegicus
agtcacctccccagtaatgcatgta

SEQ ID NO: 157092 - DNA, 25 bp, Rattus norvegicus
agtcacctcccctgtaatgcatgta

SEQ ID NO: 157093 - DNA, 25 bp, Rattus norvegicus
agtcacctcgtcacagtggtgggaa

SEQ ID NO: 157094 - DNA, 25 bp, Rattus norvegicus
agtcacctcgtccacagtgtgtgta

SEQ ID NO: 157095 - DNA, 25 bp, Rattus norvegicus
agtcacctcgtcgacagtgtgtgta

SEQ ID NO: 157096 - DNA, 25 bp, Rattus norvegicus
agtcacctcgtctcagtggtgggaa

SEQ ID NO: 157097 - DNA, 25 bp, Rattus norvegicus
agtcacctgaaacggacactcttca

SEQ ID NO: 157098 - DNA, 25 bp, Rattus norvegicus
agtcacctgaaagggacactcttca

SEQ ID NO: 157099 - DNA, 25 bp, Rattus norvegicus
agtcacctgcagcttgttttctgta

SEQ ID NO: 157100 - DNA, 25 bp, Rattus norvegicus
agtcacctgcaggttgttttctgta

SEQ ID NO: 157101 - DNA, 25 bp, Rattus norvegicus
agtcacctgctgcactacatgagat

SEQ ID NO: 157102 - DNA, 25 bp, Rattus norvegicus
agtcacctgctggactacatgagat

SEQ ID NO: 157103 - DNA, 25 bp, Rattus norvegicus
agtcacctgggtcttgacgagactt

SEQ ID NO: 157104 - DNA, 25 bp, Rattus norvegicus
agtcacctgggtgttgacgagactt

SEQ ID NO: 157105 - DNA, 25 bp, Rattus norvegicus
agtcacctgttcacgagctgttaga

SEQ ID NO: 157106 - DNA, 25 bp, Rattus norvegicus
agtcacctgttctcgagctgttaga

SEQ ID NO: 157107 - DNA, 25 bp, Rattus norvegicus
agtcaccttagacatggatcccatc

SEQ ID NO: 157108 - DNA, 25 bp, Rattus norvegicus
agtcaccttagagatggatcccatc

SEQ ID NO: 157109 - DNA, 25 bp, Rattus norvegicus
agtcaccttctgctctaatcgggaa

SEQ ID NO: 157110 - DNA, 25 bp, Rattus norvegicus
agtcaccttctggtctaatcgggaa

SEQ ID NO: 157111 - DNA, 25 bp, Rattus norvegicus
agtcaccttgtgactctcatataat

SEQ ID NO: 157112 - DNA, 25 bp, Rattus norvegicus
agtcaccttgtgtctctcatataat

SEQ ID NO: 157113 - DNA, 25 bp, Rattus norvegicus
agtcacctttgcaaatgttgcctta

SEQ ID NO: 157114 - DNA, 25 bp, Rattus norvegicus
agtcacctttgctaatgttgcctta

SEQ ID NO: 157115 - DNA, 25 bp, Rattus norvegicus
agtcacgacctccatacgctttgat

SEQ ID NO: 157116 - DNA, 25 bp, Rattus norvegicus
agtcacgacctcgatacgctttgat

SEQ ID NO: 157117 - DNA, 25 bp, Rattus norvegicus
agtcacgagcagatacagaggatcc

SEQ ID NO: 157118 - DNA, 25 bp, Rattus norvegicus
agtcacgagcagttacagaggatcc

SEQ ID NO: 157119 - DNA, 25 bp, Rattus norvegicus
agtcacgatgacctcttgttttccc

SEQ ID NO: 157120 - DNA, 25 bp, Rattus norvegicus
agtcacgatgacgtcttgttttccc

SEQ ID NO: 157121 - DNA, 25 bp, Rattus norvegicus
agtcacgctgacactgaggtctcag

SEQ ID NO: 157122 - DNA, 25 bp, Rattus norvegicus
agtcacgctgactctgaggtctcag

SEQ ID NO: 157123 - DNA, 25 bp, Rattus norvegicus
agtcacggccccacagggcttggag

SEQ ID NO: 157124 - DNA, 25 bp, Rattus norvegicus
agtcacggcccctcagggcttggag

SEQ ID NO: 157125 - DNA, 25 bp, Rattus norvegicus
agtcacgggccgagtgcacccaggg

SEQ ID NO: 157126 - DNA, 25 bp, Rattus norvegicus
agtcacgggccgtgtgcacccaggg

SEQ ID NO: 157127 - DNA, 25 bp, Rattus norvegicus
agtcacgggctcactggagtttgag

SEQ ID NO: 157128 - DNA, 25 bp, Rattus norvegicus
agtcacgggctctctggagtttgag

SEQ ID NO: 157129 - DNA, 25 bp, Rattus norvegicus
agtcacgtcaatcaaaggcactgtt

SEQ ID NO: 157130 - DNA, 25 bp, Rattus norvegicus
agtcacgtcaatgaaaggcactgtt

SEQ ID NO: 157131 - DNA, 25 bp, Rattus norvegicus
agtcacgtccttaactgtgcagtaa

SEQ ID NO: 157132 - DNA, 25 bp, Rattus norvegicus
agtcacgtcctttactgtgcagtaa

SEQ ID NO: 157133 - DNA, 25 bp, Rattus norvegicus
agtcacgtgctgcagagccaccaca

SEQ ID NO: 157134 - DNA, 25 bp, Rattus norvegicus
agtcacgtgctggagagccaccaca

SEQ ID NO: 157135 - DNA, 25 bp, Rattus norvegicus
agtcacgttctgcagttgtttacct

SEQ ID NO: 157136 - DNA, 25 bp, Rattus norvegicus
agtcacgttctggagttgtttacct

SEQ ID NO: 157137 - DNA, 25 bp, Rattus norvegicus
agtcacgtttatccccaggagtcag

SEQ ID NO: 157138 - DNA, 25 bp, Rattus norvegicus
agtcacgtttatgcccaggagtcag

SEQ ID NO: 157139 - DNA, 25 bp, Rattus norvegicus
agtcactaccgacagctcaatgaga

SEQ ID NO: 157140 - DNA, 25 bp, Rattus norvegicus
agtcactaccgagagctcaatgaga

SEQ ID NO: 157141 - DNA, 25 bp, Rattus norvegicus
agtcactatgtgataccccagaaat

SEQ ID NO: 157142 - DNA, 25 bp, Rattus norvegicus
agtcactatgtgttaccccagaaat

SEQ ID NO: 157143 - DNA, 25 bp, Rattus norvegicus
agtcactattaacccacaacctttc

SEQ ID NO: 157144 - DNA, 25 bp, Rattus norvegicus
agtcactattaagccacaacctttc

SEQ ID NO: 157145 - DNA, 25 bp, Rattus norvegicus
agtcactattttagctcttggccta

SEQ ID NO: 157146 - DNA, 25 bp, Rattus norvegicus
agtcactatttttgctcttggccta

SEQ ID NO: 157147 - DNA, 25 bp, Rattus norvegicus
agtcactcagtgcttatcccctgag

SEQ ID NO: 157148 - DNA, 25 bp, Rattus norvegicus
agtcactcagtggttatcccctgag

SEQ ID NO: 157149 - DNA, 25 bp, Rattus norvegicus
agtcactcagttcgcgtcttaacac

SEQ ID NO: 157150 - DNA, 25 bp, Rattus norvegicus
agtcactcagttggcgtcttaacac

SEQ ID NO: 157151 - DNA, 25 bp, Rattus norvegicus
agtcactccaaacttcaccaaattg

SEQ ID NO: 157152 - DNA, 25 bp, Rattus norvegicus
agtcactccaaagttcaccaaattg

SEQ ID NO: 157153 - DNA, 25 bp, Rattus norvegicus
agtcactcctatagtcattctttgt

SEQ ID NO: 157154 - DNA, 25 bp, Rattus norvegicus
agtcactcctattgtcattctttgt

SEQ ID NO: 157155 - DNA, 25 bp, Rattus norvegicus
agtcactccttgaggccgggaaagt

SEQ ID NO: 157156 - DNA, 25 bp, Rattus norvegicus
agtcactccttgtggccgggaaagt

SEQ ID NO: 157157 - DNA, 25 bp, Rattus norvegicus
agtcactcgaggcatcaccaaaggt

SEQ ID NO: 157158 - DNA, 25 bp, Rattus norvegicus
agtcactcgagggatcaccaaaggt

SEQ ID NO: 157159 - DNA, 25 bp, Rattus norvegicus
agtcactcgggtagcatcttgcaaa

SEQ ID NO: 157160 - DNA, 25 bp, Rattus norvegicus
agtcactcgggttgcatcttgcaaa

SEQ ID NO: 157161 - DNA, 25 bp, Rattus norvegicus
agtcactcgtcacacattcagttat

SEQ ID NO: 157162 - DNA, 25 bp, Rattus norvegicus
agtcactcgtcagacattcagttat

SEQ ID NO: 157163 - DNA, 25 bp, Rattus norvegicus
agtcactctaggatctgcactgaat

SEQ ID NO: 157164 - DNA, 25 bp, Rattus norvegicus
agtcactctaggttctgcactgaat

SEQ ID NO: 157165 - DNA, 25 bp, Rattus norvegicus
agtcactctcaacatccagtctagt

SEQ ID NO: 157166 - DNA, 25 bp, Rattus norvegicus
agtcactctcaagatccagtctagt

SEQ ID NO: 157167 - DNA, 25 bp, Rattus norvegicus
agtcactctccaagatcctggatgt

SEQ ID NO: 157168 - DNA, 25 bp, Rattus norvegicus
agtcactctccatgatcctggatgt

SEQ ID NO: 157169 - DNA, 25 bp, Rattus norvegicus
agtcactctgtgaaatcccggaatc

SEQ ID NO: 157170 - DNA, 25 bp, Rattus norvegicus
agtcactctgtgtaatcccggaatc

SEQ ID NO: 157171 - DNA, 25 bp, Rattus norvegicus
agtcactcttgaaatttctcccaca

SEQ ID NO: 157172 - DNA, 25 bp, Rattus norvegicus
agtcactcttgatatttctcccaca

SEQ ID NO: 157173 - DNA, 25 bp, Rattus norvegicus
agtcactcttttcagatggcttctc

SEQ ID NO: 157174 - DNA, 25 bp, Rattus norvegicus
agtcactcttttgagatggcttctc

SEQ ID NO: 157175 - DNA, 25 bp, Rattus norvegicus
agtcactgaagactctgcctcgtga

SEQ ID NO: 157176 - DNA, 25 bp, Rattus norvegicus
agtcactgaagagtctgcctcgtga

SEQ ID NO: 157177 - DNA, 25 bp, Rattus norvegicus
agtcactgactgagggacaatggtt

SEQ ID NO: 157178 - DNA, 25 bp, Rattus norvegicus
agtcactgactgtgggacaatggtt

SEQ ID NO: 157179 - DNA, 25 bp, Rattus norvegicus
agtcactgagacagcttcaccaaag

SEQ ID NO: 157180 - DNA, 25 bp, Rattus norvegicus
agtcactgagactgcttcaccaaag

SEQ ID NO: 157181 - DNA, 25 bp, Rattus norvegicus
agtcactgagctacactttttggtc

SEQ ID NO: 157182 - DNA, 25 bp, Rattus norvegicus
agtcactgagcttcactttttggtc

SEQ ID NO: 157183 - DNA, 25 bp, Rattus norvegicus
agtcactgatctcacttcagggctc

SEQ ID NO: 157184 - DNA, 25 bp, Rattus norvegicus
agtcactgatctgacttcagggctc

SEQ ID NO: 157185 - DNA, 25 bp, Rattus norvegicus
agtcactgccaaatactcactgaga

SEQ ID NO: 157186 - DNA, 25 bp, Rattus norvegicus
agtcactgccaattactcactgaga

SEQ ID NO: 157187 - DNA, 25 bp, Rattus norvegicus
agtcactgcctgctacttctgtatt

SEQ ID NO: 157188 - DNA, 25 bp, Rattus norvegicus
agtcactgcctggtacttctgtatt

SEQ ID NO: 157189 - DNA, 25 bp, Rattus norvegicus
agtcactgccttactttgagtcatt

SEQ ID NO: 157190 - DNA, 25 bp, Rattus norvegicus
agtcactgcctttctttgagtcatt

SEQ ID NO: 157191 - DNA, 25 bp, Rattus norvegicus
agtcactgcgacagctggatgttga

SEQ ID NO: 157192 - DNA, 25 bp, Rattus norvegicus
agtcactgcgactgctggatgttga

SEQ ID NO: 157193 - DNA, 25 bp, Rattus norvegicus
agtcactggcccaggtaggttcttt

SEQ ID NO: 157194 - DNA, 25 bp, Rattus norvegicus
agtcactggccctggtaggttcttt

SEQ ID NO: 157195 - DNA, 25 bp, Rattus norvegicus
agtcactgggaaatccagtcaggca

SEQ ID NO: 157196 - DNA, 25 bp, Rattus norvegicus
agtcactgggaattccagtcaggca

SEQ ID NO: 157197 - DNA, 25 bp, Rattus norvegicus
agtcactgggacctctggagacttc

SEQ ID NO: 157198 - DNA, 25 bp, Rattus norvegicus
agtcactgggacgtctggagacttc

SEQ ID NO: 157199 - DNA, 25 bp, Rattus norvegicus
agtcactgtataaccttcacctagg

SEQ ID NO: 157200 - DNA, 25 bp, Rattus norvegicus
agtcactgtatatccttcacctagg

SEQ ID NO: 157201 - DNA, 25 bp, Rattus norvegicus
agtcactgtcagcaatgccatccta

SEQ ID NO: 157202 - DNA, 25 bp, Rattus norvegicus
agtcactgtcaggaatgccatccta

SEQ ID NO: 157203 - DNA, 25 bp, Rattus norvegicus
agtcactgtgacaaagggcttggga

SEQ ID NO: 157204 - DNA, 25 bp, Rattus norvegicus
agtcactgtgactaagggcttggga

SEQ ID NO: 157205 - DNA, 25 bp, Rattus norvegicus
agtcactgtttcattattccatggg

SEQ ID NO: 157206 - DNA, 25 bp, Rattus norvegicus
agtcactgtttctttattccatggg

SEQ ID NO: 157207 - DNA, 25 bp, Rattus norvegicus
agtcacttagctagacccaggtcat

SEQ ID NO: 157208 - DNA, 25 bp, Rattus norvegicus
agtcacttagcttgacccaggtcat

SEQ ID NO: 157209 - DNA, 25 bp, Rattus norvegicus
agtcacttctgactcgatcaagttt

SEQ ID NO: 157210 - DNA, 25 bp, Rattus norvegicus
agtcacttctgagtcgatcaagttt

SEQ ID NO: 157211 - DNA, 25 bp, Rattus norvegicus
agtcacttctttatctttatgggag

SEQ ID NO: 157212 - DNA, 25 bp, Rattus norvegicus
agtcacttctttttctttatgggag

SEQ ID NO: 157213 - DNA, 25 bp, Rattus norvegicus
agtcactttaaacctctctggagga

SEQ ID NO: 157214 - DNA, 25 bp, Rattus norvegicus
agtcactttaaagctctctggagga

SEQ ID NO: 157215 - DNA, 25 bp, Rattus norvegicus
agtcactttcgaaactgtacttcag

SEQ ID NO: 157216 - DNA, 25 bp, Rattus norvegicus
agtcactttcgatactgtacttcag

SEQ ID NO: 157217 - DNA, 25 bp, Rattus norvegicus
agtcactttcttcaaccattttttg

SEQ ID NO: 157218 - DNA, 25 bp, Rattus norvegicus
agtcactttcttgaaccattttttg

SEQ ID NO: 157219 - DNA, 25 bp, Rattus norvegicus
agtcactttgcaaacatctctgatg

SEQ ID NO: 157220 - DNA, 25 bp, Rattus norvegicus
agtcactttgcatacatctctgatg

SEQ ID NO: 157221 - DNA, 25 bp, Rattus norvegicus
agtcacttttctctcttgagtatgt

SEQ ID NO: 157222 - DNA, 25 bp, Rattus norvegicus
agtcacttttctgtcttgagtatgt

SEQ ID NO: 157223 - DNA, 25 bp, Rattus norvegicus
agtcacttttgaaatcgatgtccag

SEQ ID NO: 157224 - DNA, 25 bp, Rattus norvegicus
agtcacttttgatatcgatgtccag

SEQ ID NO: 157225 - DNA, 25 bp, Rattus norvegicus
agtcacttttgcaggaatgtccgct

SEQ ID NO: 157226 - DNA, 25 bp, Rattus norvegicus
agtcacttttgctggaatgtccgct

SEQ ID NO: 157227 - DNA, 25 bp, Rattus norvegicus
agtcagaaattccttatgtgtgtat

SEQ ID NO: 157228 - DNA, 25 bp, Rattus norvegicus
agtcagaaattcgttatgtgtgtat

SEQ ID NO: 157229 - DNA, 25 bp, Rattus norvegicus
agtcagaagcttatggctgggtcca

SEQ ID NO: 157230 - DNA, 25 bp, Rattus norvegicus
agtcagaagcttttggctgggtcca

SEQ ID NO: 157231 - DNA, 25 bp, Rattus norvegicus
agtcagacagccctgtatcatgccg

SEQ ID NO: 157232 - DNA, 25 bp, Rattus norvegicus
agtcagacagccgtgtatcatgccg

SEQ ID NO: 157233 - DNA, 25 bp, Rattus norvegicus
agtcagagaaggacgtctgcttccc

SEQ ID NO: 157234 - DNA, 25 bp, Rattus norvegicus
agtcagagaaggtcgtctgcttccc

SEQ ID NO: 157235 - DNA, 25 bp, Rattus norvegicus
agtcagagccgcagcaggagcagca

SEQ ID NO: 157236 - DNA, 25 bp, Rattus norvegicus
agtcagagccgctgcaggagcagca

SEQ ID NO: 157237 - DNA, 25 bp, Rattus norvegicus
agtcagagcctgagtgcctgcggct

SEQ ID NO: 157238 - DNA, 25 bp, Rattus norvegicus
agtcagagcctgtgtgcctgcggct

SEQ ID NO: 157239 - DNA, 25 bp, Rattus norvegicus
agtcagagcttgaagactgccctca

SEQ ID NO: 157240 - DNA, 25 bp, Rattus norvegicus
agtcagagcttgtagactgccctca

SEQ ID NO: 157241 - DNA, 25 bp, Rattus norvegicus
agtcagagtgttctctttgtctcct

SEQ ID NO: 157242 - DNA, 25 bp, Rattus norvegicus
agtcagagtgttgtctttgtctcct

SEQ ID NO: 157243 - DNA, 25 bp, Rattus norvegicus
agtcagagttctcagactcctccct

SEQ ID NO: 157244 - DNA, 25 bp, Rattus norvegicus
agtcagagttctgagactcctccct

SEQ ID NO: 157245 - DNA, 25 bp, Rattus norvegicus
agtcagagttgacctcactggccta

SEQ ID NO: 157246 - DNA, 25 bp, Rattus norvegicus
agtcagagttgagctcactggccta

SEQ ID NO: 157247 - DNA, 25 bp, Rattus norvegicus
agtcagagttggactggtggctcca

SEQ ID NO: 157248 - DNA, 25 bp, Rattus norvegicus
agtcagagttggtctggtggctcca

SEQ ID NO: 157249 - DNA, 25 bp, Rattus norvegicus
agtcagatacaaccagttcccggtc

SEQ ID NO: 157250 - DNA, 25 bp, Rattus norvegicus
agtcagatacaagcagttcccggtc

SEQ ID NO: 157251 - DNA, 25 bp, Rattus norvegicus
agtcagatcagtcctacttgcttca

SEQ ID NO: 157252 - DNA, 25 bp, Rattus norvegicus
agtcagatcagtgctacttgcttca

SEQ ID NO: 157253 - DNA, 25 bp, Rattus norvegicus
agtcagatctcgctggagcaggtct

SEQ ID NO: 157254 - DNA, 25 bp, Rattus norvegicus
agtcagatctcggtggagcaggtct

SEQ ID NO: 157255 - DNA, 25 bp, Rattus norvegicus
agtcagatgcaaagaaattccctca

SEQ ID NO: 157256 - DNA, 25 bp, Rattus norvegicus
agtcagatgcaatgaaattccctca

SEQ ID NO: 157257 - DNA, 25 bp, Rattus norvegicus
agtcagatgctgagtccaccatcat

SEQ ID NO: 157258 - DNA, 25 bp, Rattus norvegicus
agtcagatgctgtgtccaccatcat

SEQ ID NO: 157259 - DNA, 25 bp, Rattus norvegicus
agtcagatggctcaactctgtctcc

SEQ ID NO: 157260 - DNA, 25 bp, Rattus norvegicus
agtcagatggctgaactctgtctcc

SEQ ID NO: 157261 - DNA, 25 bp, Rattus norvegicus
agtcagatgtctaagggagcccgct

SEQ ID NO: 157262 - DNA, 25 bp, Rattus norvegicus
agtcagatgtcttagggagcccgct

SEQ ID NO: 157263 - DNA, 25 bp, Rattus norvegicus
agtcagatttccaccatctttcaag

SEQ ID NO: 157264 - DNA, 25 bp, Rattus norvegicus
agtcagatttcctccatctttcaag

SEQ ID NO: 157265 - DNA, 25 bp, Rattus norvegicus
agtcagatttgcacaatgcactgga

SEQ ID NO: 157266 - DNA, 25 bp, Rattus norvegicus
agtcagatttgctcaatgcactgga

SEQ ID NO: 157267 - DNA, 25 bp, Rattus norvegicus
agtcagcaatgacgcaaattcgtga

SEQ ID NO: 157268 - DNA, 25 bp, Rattus norvegicus
agtcagcaatgaggcaaattcgtga

SEQ ID NO: 157269 - DNA, 25 bp, Rattus norvegicus
agtcagcaatggaagtgccctgtaa

SEQ ID NO: 157270 - DNA, 25 bp, Rattus norvegicus
agtcagcaatggtagtgccctgtaa

SEQ ID NO: 157271 - DNA, 25 bp, Rattus norvegicus
agtcagcacggcaggagatactagt

SEQ ID NO: 157272 - DNA, 25 bp, Rattus norvegicus
agtcagcacggctggagatactagt

SEQ ID NO: 157273 - DNA, 25 bp, Rattus norvegicus
agtcagcactatctacaaccagaga

SEQ ID NO: 157274 - DNA, 25 bp, Rattus norvegicus
agtcagcactatgtacaaccagaga

SEQ ID NO: 157275 - DNA, 25 bp, Rattus norvegicus
agtcagcaggctcgaatatttgttg

SEQ ID NO: 157276 - DNA, 25 bp, Rattus norvegicus
agtcagcaggctggaatatttgttg

SEQ ID NO: 157277 - DNA, 25 bp, Rattus norvegicus
agtcagcatcacatcggtctgtgtt

SEQ ID NO: 157278 - DNA, 25 bp, Rattus norvegicus
agtcagcatcacttcggtctgtgtt

SEQ ID NO: 157279 - DNA, 25 bp, Rattus norvegicus
agtcagcatgatcgcaatcccttca

SEQ ID NO: 157280 - DNA, 25 bp, Rattus norvegicus
agtcagcatgatggcaatcccttca

SEQ ID NO: 157281 - DNA, 25 bp, Rattus norvegicus
agtcagcatgccagggtcatcccgt

SEQ ID NO: 157282 - DNA, 25 bp, Rattus norvegicus
agtcagcatgcctgggtcatcccgt

SEQ ID NO: 157283 - DNA, 25 bp, Rattus norvegicus
agtcagcatttccatcagtttgtcc

SEQ ID NO: 157284 - DNA, 25 bp, Rattus norvegicus
agtcagcatttcgatcagtttgtcc

SEQ ID NO: 157285 - DNA, 25 bp, Rattus norvegicus
agtcagccactgagccccaagagga

SEQ ID NO: 157286 - DNA, 25 bp, Rattus norvegicus
agtcagccactgtgccccaagagga

SEQ ID NO: 157287 - DNA, 25 bp, Rattus norvegicus
agtcagccagaaacctctgattcca

SEQ ID NO: 157288 - DNA, 25 bp, Rattus norvegicus
agtcagccagaatcctctgattcca

SEQ ID NO: 157289 - DNA, 25 bp, Rattus norvegicus
agtcagccagagatctgatcacctg

SEQ ID NO: 157290 - DNA, 25 bp, Rattus norvegicus
agtcagccagagttctgatcacctg

SEQ ID NO: 157291 - DNA, 25 bp, Rattus norvegicus
agtcagccagtgaacacgaggtgtc

SEQ ID NO: 157292 - DNA, 25 bp, Rattus norvegicus
agtcagccagtgtacacgaggtgtc

SEQ ID NO: 157293 - DNA, 25 bp, Rattus norvegicus
agtcagcccaagaaactctatcctc

SEQ ID NO: 157294 - DNA, 25 bp, Rattus norvegicus
agtcagcccaagtaactctatcctc

SEQ ID NO: 157295 - DNA, 25 bp, Rattus norvegicus
agtcagcccacaactggcttggaag

SEQ ID NO: 157296 - DNA, 25 bp, Rattus norvegicus
agtcagcccacatctggcttggaag

SEQ ID NO: 157297 - DNA, 25 bp, Rattus norvegicus
agtcagcccatgaattatctagcag

SEQ ID NO: 157298 - DNA, 25 bp, Rattus norvegicus
agtcagcccatgtattatctagcag

SEQ ID NO: 157299 - DNA, 25 bp, Rattus norvegicus
agtcagccccaaattccacaggcag

SEQ ID NO: 157300 - DNA, 25 bp, Rattus norvegicus
agtcagccccaatttccacaggcag

SEQ ID NO: 157301 - DNA, 25 bp, Rattus norvegicus
agtcagcccgctattccatagccgg

SEQ ID NO: 157302 - DNA, 25 bp, Rattus norvegicus
agtcagcccgcttttccatagccgg

SEQ ID NO: 157303 - DNA, 25 bp, Rattus norvegicus
agtcagccctggaaattagatcaca

SEQ ID NO: 157304 - DNA, 25 bp, Rattus norvegicus
agtcagccctggtaattagatcaca

SEQ ID NO: 157305 - DNA, 25 bp, Rattus norvegicus
agtcagccgtttccttgtaatgtct

SEQ ID NO: 157306 - DNA, 25 bp, Rattus norvegicus
agtcagccgtttgcttgtaatgtct

SEQ ID NO: 157307 - DNA, 25 bp, Rattus norvegicus
agtcagccttaaagaagcccagtgg

SEQ ID NO: 157308 - DNA, 25 bp, Rattus norvegicus
agtcagccttaatgaagcccagtgg

SEQ ID NO: 157309 - DNA, 25 bp, Rattus norvegicus
agtcagccttaccttccataacttt

SEQ ID NO: 157310 - DNA, 25 bp, Rattus norvegicus
agtcagccttacgttccataacttt

SEQ ID NO: 157311 - DNA, 25 bp, Rattus norvegicus
agtcagccttgtcgagtatcttaat

SEQ ID NO: 157312 - DNA, 25 bp, Rattus norvegicus
agtcagccttgtggagtatcttaat

SEQ ID NO: 157313 - DNA, 25 bp, Rattus norvegicus
agtcagcgctgaagcctgttgattc

SEQ ID NO: 157314 - DNA, 25 bp, Rattus norvegicus
agtcagcgctgatgcctgttgattc

SEQ ID NO: 157315 - DNA, 25 bp, Rattus norvegicus
agtcagcggcagaccatctggaaga

SEQ ID NO: 157316 - DNA, 25 bp, Rattus norvegicus
agtcagcggcagtccatctggaaga

SEQ ID NO: 157317 - DNA, 25 bp, Rattus norvegicus
agtcagctacaactgtttcatcgcc

SEQ ID NO: 157318 - DNA, 25 bp, Rattus norvegicus
agtcagctacaagtgtttcatcgcc

SEQ ID NO: 157319 - DNA, 25 bp, Rattus norvegicus
agtcagctcgcacttacctggagag

SEQ ID NO: 157320 - DNA, 25 bp, Rattus norvegicus
agtcagctcgcagttacctggagag

SEQ ID NO: 157321 - DNA, 25 bp, Rattus norvegicus
agtcagctgatgactctgcctgcct

SEQ ID NO: 157322 - DNA, 25 bp, Rattus norvegicus
agtcagctgatgtctctgcctgcct

SEQ ID NO: 157323 - DNA, 25 bp, Rattus norvegicus
agtcagctggaaatcatgagacaac

SEQ ID NO: 157324 - DNA, 25 bp, Rattus norvegicus
agtcagctggaattcatgagacaac

SEQ ID NO: 157325 - DNA, 25 bp, Rattus norvegicus
agtcagcttatgagcaaggttgcga

SEQ ID NO: 157326 - DNA, 25 bp, Rattus norvegicus
agtcagcttatgtgcaaggttgcga

SEQ ID NO: 157327 - DNA, 25 bp, Rattus norvegicus
agtcagcttcgtaaggagtgtggaa

SEQ ID NO: 157328 - DNA, 25 bp, Rattus norvegicus
agtcagcttcgttaggagtgtggaa

SEQ ID NO: 157329 - DNA, 25 bp, Rattus norvegicus
agtcagcttgctctgcagtccatgt

SEQ ID NO: 157330 - DNA, 25 bp, Rattus norvegicus
agtcagcttgctgtgcagtccatgt

SEQ ID NO: 157331 - DNA, 25 bp, Rattus norvegicus
agtcagcttggccaatatatcccaa

SEQ ID NO: 157332 - DNA, 25 bp, Rattus norvegicus
agtcagcttggcgaatatatcccaa

SEQ ID NO: 157333 - DNA, 25 bp, Rattus norvegicus
agtcagctttcacggcattatgtct

SEQ ID NO: 157334 - DNA, 25 bp, Rattus norvegicus
agtcagctttcagggcattatgtct

SEQ ID NO: 157335 - DNA, 25 bp, Rattus norvegicus
agtcagcttttgatgatatcccaat

SEQ ID NO: 157336 - DNA, 25 bp, Rattus norvegicus
agtcagcttttgttgatatcccaat

SEQ ID NO: 157337 - DNA, 25 bp, Rattus norvegicus
agtcaggactgcattcatatgcata

SEQ ID NO: 157338 - DNA, 25 bp, Rattus norvegicus
agtcaggactgctttcatatgcata

SEQ ID NO: 157339 - DNA, 25 bp, Rattus norvegicus
agtcaggagacaccagggctcactc

SEQ ID NO: 157340 - DNA, 25 bp, Rattus norvegicus
agtcaggagacagcagggctcactc

SEQ ID NO: 157341 - DNA, 25 bp, Rattus norvegicus
agtcaggatccaattatgttacatt

SEQ ID NO: 157342 - DNA, 25 bp, Rattus norvegicus
agtcaggatccatttatgttacatt

SEQ ID NO: 157343 - DNA, 25 bp, Rattus norvegicus
agtcaggatgtgactgcttggctcc

SEQ ID NO: 157344 - DNA, 25 bp, Rattus norvegicus
agtcaggatgtgtctgcttggctcc

SEQ ID NO: 157345 - DNA, 25 bp, Rattus norvegicus
agtcaggattgacggtgctgccctt

SEQ ID NO: 157346 - DNA, 25 bp, Rattus norvegicus
agtcaggattgagggtgctgccctt

SEQ ID NO: 157347 - DNA, 25 bp, Rattus norvegicus
agtcaggccttgaacccggcagaca

SEQ ID NO: 157348 - DNA, 25 bp, Rattus norvegicus
agtcaggccttgcaccagtgttgga

SEQ ID NO: 157349 - DNA, 25 bp, Rattus norvegicus
agtcaggccttggaccagtgttgga

SEQ ID NO: 157350 - DNA, 25 bp, Rattus norvegicus
agtcaggccttgtacccggcagaca

SEQ ID NO: 157351 - DNA, 25 bp, Rattus norvegicus
agtcaggcgagcatcctcgggagat

SEQ ID NO: 157352 - DNA, 25 bp, Rattus norvegicus
agtcaggcgagcttcctcgggagat

SEQ ID NO: 157353 - DNA, 25 bp, Rattus norvegicus
agtcaggcggtacaggctctacaag

SEQ ID NO: 157354 - DNA, 25 bp, Rattus norvegicus
agtcaggcggtagaggctctacaag

SEQ ID NO: 157355 - DNA, 25 bp, Rattus norvegicus
agtcaggcggtcatgtcgctgccca

SEQ ID NO: 157356 - DNA, 25 bp, Rattus norvegicus
agtcaggcggtcttgtcgctgccca

SEQ ID NO: 157357 - DNA, 25 bp, Rattus norvegicus
agtcaggcgtccatagcacttgaaa

SEQ ID NO: 157358 - DNA, 25 bp, Rattus norvegicus
agtcaggcgtccttagcacttgaaa

SEQ ID NO: 157359 - DNA, 25 bp, Rattus norvegicus
agtcaggctctcagctacgtaacag

SEQ ID NO: 157360 - DNA, 25 bp, Rattus norvegicus
agtcaggctctctgctacgtaacag

SEQ ID NO: 157361 - DNA, 25 bp, Rattus norvegicus
agtcaggctgcaagattcctccaaa

SEQ ID NO: 157362 - DNA, 25 bp, Rattus norvegicus
agtcaggctgcatgattcctccaaa

SEQ ID NO: 157363 - DNA, 25 bp, Rattus norvegicus
agtcaggcttgaaaaactggcttca

SEQ ID NO: 157364 - DNA, 25 bp, Rattus norvegicus
agtcaggcttgataaactggcttca

SEQ ID NO: 157365 - DNA, 25 bp, Rattus norvegicus
agtcaggctttcatggtaacatagt

SEQ ID NO: 157366 - DNA, 25 bp, Rattus norvegicus
agtcaggctttcttggtaacatagt

SEQ ID NO: 157367 - DNA, 25 bp, Rattus norvegicus
agtcagggcacacaccaaccaggga

SEQ ID NO: 157368 - DNA, 25 bp, Rattus norvegicus
agtcagggcacagaccaaccaggga

SEQ ID NO: 157369 - DNA, 25 bp, Rattus norvegicus
agtcagggcatcatgagggcgcatc

SEQ ID NO: 157370 - DNA, 25 bp, Rattus norvegicus
agtcagggcatcttgagggcgcatc

SEQ ID NO: 157371 - DNA, 25 bp, Rattus norvegicus
agtcagggccagacgcctacaatag

SEQ ID NO: 157372 - DNA, 25 bp, Rattus norvegicus
agtcagggccagtcgcctacaatag

SEQ ID NO: 157373 - DNA, 25 bp, Rattus norvegicus
agtcagggctcaacaggcttagcag

SEQ ID NO: 157374 - DNA, 25 bp, Rattus norvegicus
agtcagggctcatcaggcttagcag

SEQ ID NO: 157375 - DNA, 25 bp, Rattus norvegicus
agtcagggctgtcgtcttacatccg

SEQ ID NO: 157376 - DNA, 25 bp, Rattus norvegicus
agtcagggctgtggtcttacatccg

SEQ ID NO: 157377 - DNA, 25 bp, Rattus norvegicus
agtcagggtcacaggttggccactg

SEQ ID NO: 157378 - DNA, 25 bp, Rattus norvegicus
agtcagggtcactggttggccactg

SEQ ID NO: 157379 - DNA, 25 bp, Rattus norvegicus
agtcagggtcgcatgtagtccagtc

SEQ ID NO: 157380 - DNA, 25 bp, Rattus norvegicus
agtcagggtcgcttgtagtccagtc

SEQ ID NO: 157381 - DNA, 25 bp, Rattus norvegicus
agtcagggtgagctttagttctttc

SEQ ID NO: 157382 - DNA, 25 bp, Rattus norvegicus
agtcagggtgaggtttagttctttc

SEQ ID NO: 157383 - DNA, 25 bp, Rattus norvegicus
agtcagggtggcagctatggctatc

SEQ ID NO: 157384 - DNA, 25 bp, Rattus norvegicus
agtcagggtggctgctatggctatc

SEQ ID NO: 157385 - DNA, 25 bp, Rattus norvegicus
agtcagggtttcatcttgcctattt

SEQ ID NO: 157386 - DNA, 25 bp, Rattus norvegicus
agtcagggtttcttcttgcctattt

SEQ ID NO: 157387 - DNA, 25 bp, Rattus norvegicus
agtcaggtaatcacatctctgccct

SEQ ID NO: 157388 - DNA, 25 bp, Rattus norvegicus
agtcaggtaatctcatctctgccct

SEQ ID NO: 157389 - DNA, 25 bp, Rattus norvegicus
agtcaggtcagactcagccatttct

SEQ ID NO: 157390 - DNA, 25 bp, Rattus norvegicus
agtcaggtcagagtcagccatttct

SEQ ID NO: 157391 - DNA, 25 bp, Rattus norvegicus
agtcaggtcccaccgtcaagagcaa

SEQ ID NO: 157392 - DNA, 25 bp, Rattus norvegicus
agtcaggtcccagcgtcaagagcaa

SEQ ID NO: 157393 - DNA, 25 bp, Rattus norvegicus
agtcaggtcctgattcatgatgtga

SEQ ID NO: 157394 - DNA, 25 bp, Rattus norvegicus
agtcaggtcctgtttcatgatgtga

SEQ ID NO: 157395 - DNA, 25 bp, Rattus norvegicus
agtcaggtgggtccaccatagccac

SEQ ID NO: 157396 - DNA, 25 bp, Rattus norvegicus
agtcaggtgggtgcaccatagccac

SEQ ID NO: 157397 - DNA, 25 bp, Rattus norvegicus
agtcaggtgtctcggactcagaaga

SEQ ID NO: 157398 - DNA, 25 bp, Rattus norvegicus
agtcaggtgtctgggactcagaaga

SEQ ID NO: 157399 - DNA, 25 bp, Rattus norvegicus
agtcaggtgtttcatcccacgaaga

SEQ ID NO: 157400 - DNA, 25 bp, Rattus norvegicus
agtcaggtgtttgatcccacgaaga

SEQ ID NO: 157401 - DNA, 25 bp, Rattus norvegicus
agtcagtaagtcagcaattgttttc

SEQ ID NO: 157402 - DNA, 25 bp, Rattus norvegicus
agtcagtaagtctgcaattgttttc

SEQ ID NO: 157403 - DNA, 25 bp, Rattus norvegicus
agtcagtagactcacttaataacta

SEQ ID NO: 157404 - DNA, 25 bp, Rattus norvegicus
agtcagtagactgacttaataacta

SEQ ID NO: 157405 - DNA, 25 bp, Rattus norvegicus
agtcagtatgtgcagtggcgtctaa

SEQ ID NO: 157406 - DNA, 25 bp, Rattus norvegicus
agtcagtatgtggagtggcgtctaa

SEQ ID NO: 157407 - DNA, 25 bp, Rattus norvegicus
agtcagtcagcgacaaggctcccag

SEQ ID NO: 157408 - DNA, 25 bp, Rattus norvegicus
agtcagtcagcgtcaaggctcccag

SEQ ID NO: 157409 - DNA, 25 bp, Rattus norvegicus
agtcagtccaaacccatgaaatact

SEQ ID NO: 157410 - DNA, 25 bp, Rattus norvegicus
agtcagtccaaagccatgaaatact

SEQ ID NO: 157411 - DNA, 25 bp, Rattus norvegicus
agtcagtccctgactagtttcctgc

SEQ ID NO: 157412 - DNA, 25 bp, Rattus norvegicus
agtcagtccctgtctagtttcctgc

SEQ ID NO: 157413 - DNA, 25 bp, Rattus norvegicus
agtcagtcctagacggtcaggtcat

SEQ ID NO: 157414 - DNA, 25 bp, Rattus norvegicus
agtcagtcctagtcggtcaggtcat

SEQ ID NO: 157415 - DNA, 25 bp, Rattus norvegicus
agtcagtctaaacacttctgccagt

SEQ ID NO: 157416 - DNA, 25 bp, Rattus norvegicus
agtcagtctaaagacttctgccagt

SEQ ID NO: 157417 - DNA, 25 bp, Rattus norvegicus
agtcagtctaccacacattttgttt

SEQ ID NO: 157418 - DNA, 25 bp, Rattus norvegicus
agtcagtctacctcacattttgttt

SEQ ID NO: 157419 - DNA, 25 bp, Rattus norvegicus
agtcagtctctcacagagtggccag

SEQ ID NO: 157420 - DNA, 25 bp, Rattus norvegicus
agtcagtctctcacatagtggcagt

SEQ ID NO: 157421 - DNA, 25 bp, Rattus norvegicus
agtcagtctctctcagagtggccag

SEQ ID NO: 157422 - DNA, 25 bp, Rattus norvegicus
agtcagtctctctcatagtggcagt

SEQ ID NO: 157423 - DNA, 25 bp, Rattus norvegicus
agtcagtctgctaccctgggagtca

SEQ ID NO: 157424 - DNA, 25 bp, Rattus norvegicus
agtcagtctgcttccctgggagtca

SEQ ID NO: 157425 - DNA, 25 bp, Rattus norvegicus
agtcagtgcaacctctacatggcag

SEQ ID NO: 157426 - DNA, 25 bp, Rattus norvegicus
agtcagtgcaacgtctacatggcag

SEQ ID NO: 157427 - DNA, 25 bp, Rattus norvegicus
agtcagtgtttaagagtgctcggca

SEQ ID NO: 157428 - DNA, 25 bp, Rattus norvegicus
agtcagtgtttatgagtgctcggca

SEQ ID NO: 157429 - DNA, 25 bp, Rattus norvegicus
agtcagttatctctagccctgggca

SEQ ID NO: 157430 - DNA, 25 bp, Rattus norvegicus
agtcagttatctgtagccctgggca

SEQ ID NO: 157431 - DNA, 25 bp, Rattus norvegicus
agtcagttccatccctacttgtaaa

SEQ ID NO: 157432 - DNA, 25 bp, Rattus norvegicus
agtcagttccatgcctacttgtaaa

SEQ ID NO: 157433 - DNA, 25 bp, Rattus norvegicus
agtcagttcttaaaccatgtaggtc

SEQ ID NO: 157434 - DNA, 25 bp, Rattus norvegicus
agtcagttcttataccatgtaggtc

SEQ ID NO: 157435 - DNA, 25 bp, Rattus norvegicus
agtcagttgggaatcctggattgtc

SEQ ID NO: 157436 - DNA, 25 bp, Rattus norvegicus
agtcagttgggattcctggattgtc

SEQ ID NO: 157437 - DNA, 25 bp, Rattus norvegicus
agtcagttgtatattctctctctct

SEQ ID NO: 157438 - DNA, 25 bp, Rattus norvegicus
agtcagttgtattttctctctctct

SEQ ID NO: 157439 - DNA, 25 bp, Rattus norvegicus
agtcagtttcccacgcggcggcggc

SEQ ID NO: 157440 - DNA, 25 bp, Rattus norvegicus
agtcagtttccctcgcggcggcggc

SEQ ID NO: 157441 - DNA, 25 bp, Rattus norvegicus
agtcagtttgtcacttcgtgccctt

SEQ ID NO: 157442 - DNA, 25 bp, Rattus norvegicus
agtcagtttgtctcttcgtgccctt

SEQ ID NO: 157443 - DNA, 25 bp, Rattus norvegicus
agtcataactgacctgtaccaagaa

SEQ ID NO: 157444 - DNA, 25 bp, Rattus norvegicus
agtcataactgagctgtaccaagaa

SEQ ID NO: 157445 - DNA, 25 bp, Rattus norvegicus
agtcatacactacagctgtcagtcc

SEQ ID NO: 157446 - DNA, 25 bp, Rattus norvegicus
agtcatacactagagctgtcagtcc

SEQ ID NO: 157447 - DNA, 25 bp, Rattus norvegicus
agtcataccaggacacagttgccgt

SEQ ID NO: 157448 - DNA, 25 bp, Rattus norvegicus
agtcataccaggtcacagttgccgt

SEQ ID NO: 157449 - DNA, 25 bp, Rattus norvegicus
agtcataccgcaccgacgggttcat

SEQ ID NO: 157450 - DNA, 25 bp, Rattus norvegicus
agtcataccgcagcgacgggttcat

SEQ ID NO: 157451 - DNA, 25 bp, Rattus norvegicus
agtcatactggtagctgtgcagcat

SEQ ID NO: 157452 - DNA, 25 bp, Rattus norvegicus
agtcatactggttgctgtgcagcat

SEQ ID NO: 157453 - DNA, 25 bp, Rattus norvegicus
agtcatagcaagctcatgccgctgt

SEQ ID NO: 157454 - DNA, 25 bp, Rattus norvegicus
agtcatagcaaggtcatgccgctgt

SEQ ID NO: 157455 - DNA, 25 bp, Rattus norvegicus
agtcatagctccacaaagaatccct

SEQ ID NO: 157456 - DNA, 25 bp, Rattus norvegicus
agtcatagctcctcaaagaatccct

SEQ ID NO: 157457 - DNA, 25 bp, Rattus norvegicus
agtcataggcacattgcccagcgca

SEQ ID NO: 157458 - DNA, 25 bp, Rattus norvegicus
agtcataggcactttgcccagcgca

SEQ ID NO: 157459 - DNA, 25 bp, Rattus norvegicus
agtcataggcagcttcattcaggta

SEQ ID NO: 157460 - DNA, 25 bp, Rattus norvegicus
agtcataggcaggttcattcaggta

SEQ ID NO: 157461 - DNA, 25 bp, Rattus norvegicus
agtcataggcccatgcagtcaggaa

SEQ ID NO: 157462 - DNA, 25 bp, Rattus norvegicus
agtcataggcccttgcagtcaggaa

SEQ ID NO: 157463 - DNA, 25 bp, Rattus norvegicus
agtcatatgcaaatgtggtctccat

SEQ ID NO: 157464 - DNA, 25 bp, Rattus norvegicus
agtcatatgcaattgtggtctccat

SEQ ID NO: 157465 - DNA, 25 bp, Rattus norvegicus
agtcatattgctatgggtctctggc

SEQ ID NO: 157466 - DNA, 25 bp, Rattus norvegicus
agtcatattgctttgggtctctggc

SEQ ID NO: 157467 - DNA, 25 bp, Rattus norvegicus
agtcatcaaatgacagctgctcgga

SEQ ID NO: 157468 - DNA, 25 bp, Rattus norvegicus
agtcatcaaatgtcagctgctcgga

SEQ ID NO: 157469 - DNA, 25 bp, Rattus norvegicus
agtcatcacagcacccggagctagg

SEQ ID NO: 157470 - DNA, 25 bp, Rattus norvegicus
agtcatcacagctcccggagctagg

SEQ ID NO: 157471 - DNA, 25 bp, Rattus norvegicus
agtcatcaccacagtcatagccatg

SEQ ID NO: 157472 - DNA, 25 bp, Rattus norvegicus
agtcatcaccactgtcatagccatg

SEQ ID NO: 157473 - DNA, 25 bp, Rattus norvegicus
agtcatcatcagcatacacgtgtca

SEQ ID NO: 157474 - DNA, 25 bp, Rattus norvegicus
agtcatcatcaggatacacgtgtca

SEQ ID NO: 157475 - DNA, 25 bp, Rattus norvegicus
agtcatcatgtcaatccgaaccaag

SEQ ID NO: 157476 - DNA, 25 bp, Rattus norvegicus
agtcatcatgtctatccgaaccaag

SEQ ID NO: 157477 - DNA, 25 bp, Rattus norvegicus
agtcatccaaatactcgtgttcttt

SEQ ID NO: 157478 - DNA, 25 bp, Rattus norvegicus
agtcatccaaattctcgtgttcttt

SEQ ID NO: 157479 - DNA, 25 bp, Rattus norvegicus
agtcatccagcgcaggctacagaac

SEQ ID NO: 157480 - DNA, 25 bp, Rattus norvegicus
agtcatccagcggaggctacagaac

SEQ ID NO: 157481 - DNA, 25 bp, Rattus norvegicus
agtcatccaggaatgggcccagctg

SEQ ID NO: 157482 - DNA, 25 bp, Rattus norvegicus
agtcatccaggattgggcccagctg

SEQ ID NO: 157483 - DNA, 25 bp, Rattus norvegicus
agtcatcccagtaccgtgcgcgcgt

SEQ ID NO: 157484 - DNA, 25 bp, Rattus norvegicus
agtcatcccagttccgtgcgcgcgt

SEQ ID NO: 157485 - DNA, 25 bp, Rattus norvegicus
agtcatccccggaggtgtggctgat

SEQ ID NO: 157486 - DNA, 25 bp, Rattus norvegicus
agtcatccccggtggtgtggctgat

SEQ ID NO: 157487 - DNA, 25 bp, Rattus norvegicus
agtcatccctgcacagtgcgactca

SEQ ID NO: 157488 - DNA, 25 bp, Rattus norvegicus
agtcatccctgctcagtgcgactca

SEQ ID NO: 157489 - DNA, 25 bp, Rattus norvegicus
agtcatccgtagctccaaggctgag

SEQ ID NO: 157490 - DNA, 25 bp, Rattus norvegicus
agtcatccgtaggtccaaggctgag

SEQ ID NO: 157491 - DNA, 25 bp, Rattus norvegicus
agtcatcctcccagctggacatggg

SEQ ID NO: 157492 - DNA, 25 bp, Rattus norvegicus
agtcatcctccctgctggacatggg

SEQ ID NO: 157493 - DNA, 25 bp, Rattus norvegicus
agtcatcctcggcaaaggcgtcaag

SEQ ID NO: 157494 - DNA, 25 bp, Rattus norvegicus
agtcatcctcgggaaaggcgtcaag

SEQ ID NO: 157495 - DNA, 25 bp, Rattus norvegicus
agtcatcctgacaaagttgtcgctg

SEQ ID NO: 157496 - DNA, 25 bp, Rattus norvegicus
agtcatcctgactaagttgtcgctg

SEQ ID NO: 157497 - DNA, 25 bp, Rattus norvegicus
agtcatcctgatcgcgtgggttaaa

SEQ ID NO: 157498 - DNA, 25 bp, Rattus norvegicus
agtcatcctgatggcgtgggttaaa

SEQ ID NO: 157499 - DNA, 25 bp, Rattus norvegicus
agtcatcctggactggtggtctctt

SEQ ID NO: 157500 - DNA, 25 bp, Rattus norvegicus
agtcatcctggagtggtggtctctt

SEQ ID NO: 157501 - DNA, 25 bp, Rattus norvegicus
agtcatccttccatctctttaagat

SEQ ID NO: 157502 - DNA, 25 bp, Rattus norvegicus
agtcatccttccttctctttaagat

SEQ ID NO: 157503 - DNA, 25 bp, Rattus norvegicus
agtcatccttgcaccattcatggtt

SEQ ID NO: 157504 - DNA, 25 bp, Rattus norvegicus
agtcatccttgctccattcatggtt

SEQ ID NO: 157505 - DNA, 25 bp, Rattus norvegicus
agtcatcgaaatcccttaaagcaaa

SEQ ID NO: 157506 - DNA, 25 bp, Rattus norvegicus
agtcatcgaaatgccttaaagcaaa

SEQ ID NO: 157507 - DNA, 25 bp, Rattus norvegicus
agtcatcgccccaaatgagtttcag

SEQ ID NO: 157508 - DNA, 25 bp, Rattus norvegicus
agtcatcgcccctaatgagtttcag

SEQ ID NO: 157509 - DNA, 25 bp, Rattus norvegicus
agtcatcgtataaatcctggtggta

SEQ ID NO: 157510 - DNA, 25 bp, Rattus norvegicus
agtcatcgtatatatcctggtggta

SEQ ID NO: 157511 - DNA, 25 bp, Rattus norvegicus
agtcatcgtgaaagggcagcatttt

SEQ ID NO: 157512 - DNA, 25 bp, Rattus norvegicus
agtcatcgtgaatgggcagcatttt

SEQ ID NO: 157513 - DNA, 25 bp, Rattus norvegicus
agtcatctatttcaaggcagcctta

SEQ ID NO: 157514 - DNA, 25 bp, Rattus norvegicus
agtcatctatttgaaggcagcctta

SEQ ID NO: 157515 - DNA, 25 bp, Rattus norvegicus
agtcatctcaagaacaacttctccg

SEQ ID NO: 157516 - DNA, 25 bp, Rattus norvegicus
agtcatctcaagctagtggagtgga

SEQ ID NO: 157517 - DNA, 25 bp, Rattus norvegicus
agtcatctcaaggtagtggagtgga

SEQ ID NO: 157518 - DNA, 25 bp, Rattus norvegicus
agtcatctcaagtacaacttctccg

SEQ ID NO: 157519 - DNA, 25 bp, Rattus norvegicus
agtcatctccaaagggttcgccaga

SEQ ID NO: 157520 - DNA, 25 bp, Rattus norvegicus
agtcatctccaatgggttcgccaga

SEQ ID NO: 157521 - DNA, 25 bp, Rattus norvegicus
agtcatctctcgctcagtaggtccg

SEQ ID NO: 157522 - DNA, 25 bp, Rattus norvegicus
agtcatctctcggtcagtaggtccg

SEQ ID NO: 157523 - DNA, 25 bp, Rattus norvegicus
agtcatctcttgagcttgtattccc

SEQ ID NO: 157524 - DNA, 25 bp, Rattus norvegicus
agtcatctcttgtgcttgtattccc

SEQ ID NO: 157525 - DNA, 25 bp, Rattus norvegicus
agtcatctggacatcacgtttctac

SEQ ID NO: 157526 - DNA, 25 bp, Rattus norvegicus
agtcatctggacttcacgtttctac

SEQ ID NO: 157527 - DNA, 25 bp, Rattus norvegicus
agtcatctggtacccaaagcatctc

SEQ ID NO: 157528 - DNA, 25 bp, Rattus norvegicus
agtcatctggtagccaaagcatctc

SEQ ID NO: 157529 - DNA, 25 bp, Rattus norvegicus
agtcatctgttgctggtatcttacc

SEQ ID NO: 157530 - DNA, 25 bp, Rattus norvegicus
agtcatctgttgcttacggccacac

SEQ ID NO: 157531 - DNA, 25 bp, Rattus norvegicus
agtcatctgttggtggtatcttacc

SEQ ID NO: 157532 - DNA, 25 bp, Rattus norvegicus
agtcatctgttggttacggccacac

SEQ ID NO: 157533 - DNA, 25 bp, Rattus norvegicus
agtcatcttgccaccagggaaggaa

SEQ ID NO: 157534 - DNA, 25 bp, Rattus norvegicus
agtcatcttgcctccagggaaggaa

SEQ ID NO: 157535 - DNA, 25 bp, Rattus norvegicus
agtcatcttggcctattgagaacat

SEQ ID NO: 157536 - DNA, 25 bp, Rattus norvegicus
agtcatcttggcgtattgagaacat

SEQ ID NO: 157537 - DNA, 25 bp, Rattus norvegicus
agtcatgacacactggcctgctaga

SEQ ID NO: 157538 - DNA, 25 bp, Rattus norvegicus
agtcatgacacagtggcctgctaga

SEQ ID NO: 157539 - DNA, 25 bp, Rattus norvegicus
agtcatgaggcaccaggtctcctga

SEQ ID NO: 157540 - DNA, 25 bp, Rattus norvegicus
agtcatgaggcagcaggtctcctga

SEQ ID NO: 157541 - DNA, 25 bp, Rattus norvegicus
agtcatgataccctgtgctggcaac

SEQ ID NO: 157542 - DNA, 25 bp, Rattus norvegicus
agtcatgataccgtgtgctggcaac

SEQ ID NO: 157543 - DNA, 25 bp, Rattus norvegicus
agtcatgatgctcctgcagtcagaa

SEQ ID NO: 157544 - DNA, 25 bp, Rattus norvegicus
agtcatgatgctgctgcagtcagaa

SEQ ID NO: 157545 - DNA, 25 bp, Rattus norvegicus
agtcatgcactaacacacacagatt

SEQ ID NO: 157546 - DNA, 25 bp, Rattus norvegicus
agtcatgcactatcacacacagatt

SEQ ID NO: 157547 - DNA, 25 bp, Rattus norvegicus
agtcatgccatgctgcctagactag

SEQ ID NO: 157548 - DNA, 25 bp, Rattus norvegicus
agtcatgccatggtgcctagactag

SEQ ID NO: 157549 - DNA, 25 bp, Rattus norvegicus
agtcatgccgaaccacgagttctct

SEQ ID NO: 157550 - DNA, 25 bp, Rattus norvegicus
agtcatgccgaagcacgagttctct

SEQ ID NO: 157551 - DNA, 25 bp, Rattus norvegicus
agtcatgcctaacagaatttcaaat

SEQ ID NO: 157552 - DNA, 25 bp, Rattus norvegicus
agtcatgcctaagagaatttcaaat

SEQ ID NO: 157553 - DNA, 25 bp, Rattus norvegicus
agtcatgcctttccttgatgtgcag

SEQ ID NO: 157554 - DNA, 25 bp, Rattus norvegicus
agtcatgcctttgcttgatgtgcag

SEQ ID NO: 157555 - DNA, 25 bp, Rattus norvegicus
agtcatgcggataatccactcgcca

SEQ ID NO: 157556 - DNA, 25 bp, Rattus norvegicus
agtcatgcggattatccactcgcca

SEQ ID NO: 157557 - DNA, 25 bp, Rattus norvegicus
agtcatgctcagattatttcttcat

SEQ ID NO: 157558 - DNA, 25 bp, Rattus norvegicus
agtcatgctcagtttatttcttcat

SEQ ID NO: 157559 - DNA, 25 bp, Rattus norvegicus
agtcatggacataagctcaccacca

SEQ ID NO: 157560 - DNA, 25 bp, Rattus norvegicus
agtcatggacattagctcaccacca

SEQ ID NO: 157561 - DNA, 25 bp, Rattus norvegicus
agtcatggacgtcagcgtgctttcc

SEQ ID NO: 157562 - DNA, 25 bp, Rattus norvegicus
agtcatggacgtgagcgtgctttcc

SEQ ID NO: 157563 - DNA, 25 bp, Rattus norvegicus
agtcatggagttagccttggcgctg

SEQ ID NO: 157564 - DNA, 25 bp, Rattus norvegicus
agtcatggagtttgccttggcgctg

SEQ ID NO: 157565 - DNA, 25 bp, Rattus norvegicus
agtcatggatcgaggctactcctat

SEQ ID NO: 157566 - DNA, 25 bp, Rattus norvegicus
agtcatggatcgtggctactcctat

SEQ ID NO: 157567 - DNA, 25 bp, Rattus norvegicus
agtcatggcaaacacaccctctaaa

SEQ ID NO: 157568 - DNA, 25 bp, Rattus norvegicus
agtcatggcaaagacaccctctaaa

SEQ ID NO: 157569 - DNA, 25 bp, Rattus norvegicus
agtcatggccttaggtagttacctc

SEQ ID NO: 157570 - DNA, 25 bp, Rattus norvegicus
agtcatggcctttggtagttacctc

SEQ ID NO: 157571 - DNA, 25 bp, Rattus norvegicus
agtcatggggaactgctgcaatata

SEQ ID NO: 157572 - DNA, 25 bp, Rattus norvegicus
agtcatggggaagtgctgcaatata

SEQ ID NO: 157573 - DNA, 25 bp, Rattus norvegicus
agtcatggtaaccttccagggctac

SEQ ID NO: 157574 - DNA, 25 bp, Rattus norvegicus
agtcatggtaacgttccagggctac

SEQ ID NO: 157575 - DNA, 25 bp, Rattus norvegicus
agtcatggtgacagtttctcttctc

SEQ ID NO: 157576 - DNA, 25 bp, Rattus norvegicus
agtcatggtgactgtttctcttctc

SEQ ID NO: 157577 - DNA, 25 bp, Rattus norvegicus
agtcatgtaaggacttccggcagct

SEQ ID NO: 157578 - DNA, 25 bp, Rattus norvegicus
agtcatgtaaggtcttccggcagct

SEQ ID NO: 157579 - DNA, 25 bp, Rattus norvegicus
agtcatgtacttacagaggacctca

SEQ ID NO: 157580 - DNA, 25 bp, Rattus norvegicus
agtcatgtactttcagaggacctca

SEQ ID NO: 157581 - DNA, 25 bp, Rattus norvegicus
agtcatgtatcacccaactgtatgt

SEQ ID NO: 157582 - DNA, 25 bp, Rattus norvegicus
agtcatgtatcagccaactgtatgt

SEQ ID NO: 157583 - DNA, 25 bp, Rattus norvegicus
agtcatgtccatatcttaattttca

SEQ ID NO: 157584 - DNA, 25 bp, Rattus norvegicus
agtcatgtccatttcttaattttca

SEQ ID NO: 157585 - DNA, 25 bp, Rattus norvegicus
agtcatgtgactagccttcatagaa

SEQ ID NO: 157586 - DNA, 25 bp, Rattus norvegicus
agtcatgtgactcgctttaccctct

SEQ ID NO: 157587 - DNA, 25 bp, Rattus norvegicus
agtcatgtgactctacctggctacg

SEQ ID NO: 157588 - DNA, 25 bp, Rattus norvegicus
agtcatgtgactggctttaccctct

SEQ ID NO: 157589 - DNA, 25 bp, Rattus norvegicus
agtcatgtgactgtacctggctacg

SEQ ID NO: 157590 - DNA, 25 bp, Rattus norvegicus
agtcatgtgacttgccttcatagaa

SEQ ID NO: 157591 - DNA, 25 bp, Rattus norvegicus
agtcatgtgctcagtggcctgggaa

SEQ ID NO: 157592 - DNA, 25 bp, Rattus norvegicus
agtcatgtgctctgtggcctgggaa

SEQ ID NO: 157593 - DNA, 25 bp, Rattus norvegicus
agtcatgttatcacacagagcccaa

SEQ ID NO: 157594 - DNA, 25 bp, Rattus norvegicus
agtcatgttatctcacagagcccaa

SEQ ID NO: 157595 - DNA, 25 bp, Rattus norvegicus
agtcatgttcatcccctgattttat

SEQ ID NO: 157596 - DNA, 25 bp, Rattus norvegicus
agtcatgttcatgccctgattttat

SEQ ID NO: 157597 - DNA, 25 bp, Rattus norvegicus
agtcatgttcttagttccccttgaa

SEQ ID NO: 157598 - DNA, 25 bp, Rattus norvegicus
agtcatgttctttgttccccttgaa

SEQ ID NO: 157599 - DNA, 25 bp, Rattus norvegicus
agtcatgtttttacagcagctcgca

SEQ ID NO: 157600 - DNA, 25 bp, Rattus norvegicus
agtcatgttttttcagcagctcgca

SEQ ID NO: 157601 - DNA, 25 bp, Rattus norvegicus
agtcattaagctctgaacccacact

SEQ ID NO: 157602 - DNA, 25 bp, Rattus norvegicus
agtcattaagctgtgaacccacact

SEQ ID NO: 157603 - DNA, 25 bp, Rattus norvegicus
agtcattactttcaacgcctccctt

SEQ ID NO: 157604 - DNA, 25 bp, Rattus norvegicus
agtcattactttgaacgcctccctt

SEQ ID NO: 157605 - DNA, 25 bp, Rattus norvegicus
agtcattagaccattgtccttccag

SEQ ID NO: 157606 - DNA, 25 bp, Rattus norvegicus
agtcattagacctttgtccttccag

SEQ ID NO: 157607 - DNA, 25 bp, Rattus norvegicus
agtcattagctcagggcagcgtgct

SEQ ID NO: 157608 - DNA, 25 bp, Rattus norvegicus
agtcattagctctgggcagcgtgct

SEQ ID NO: 157609 - DNA, 25 bp, Rattus norvegicus
agtcattaggcactgtggcttcttc

SEQ ID NO: 157610 - DNA, 25 bp, Rattus norvegicus
agtcattaggcagtgtggcttcttc

SEQ ID NO: 157611 - DNA, 25 bp, Rattus norvegicus
agtcattagtgtcaccctgtataat

SEQ ID NO: 157612 - DNA, 25 bp, Rattus norvegicus
agtcattagtgtgaccctgtataat

SEQ ID NO: 157613 - DNA, 25 bp, Rattus norvegicus
agtcattcactgcaactttgcacaa

SEQ ID NO: 157614 - DNA, 25 bp, Rattus norvegicus
agtcattcactggaactttgcacaa

SEQ ID NO: 157615 - DNA, 25 bp, Rattus norvegicus
agtcattcacttaccagtcaagctg

SEQ ID NO: 157616 - DNA, 25 bp, Rattus norvegicus
agtcattcactttccagtcaagctg

SEQ ID NO: 157617 - DNA, 25 bp, Rattus norvegicus
agtcattcagagcacagtttgcctg

SEQ ID NO: 157618 - DNA, 25 bp, Rattus norvegicus
agtcattcagaggacagtttgcctg

SEQ ID NO: 157619 - DNA, 25 bp, Rattus norvegicus
agtcattcatctaagtggtcaccat

SEQ ID NO: 157620 - DNA, 25 bp, Rattus norvegicus
agtcattcatcttagtggtcaccat

SEQ ID NO: 157621 - DNA, 25 bp, Rattus norvegicus
agtcattcatggatgctcacttgca

SEQ ID NO: 157622 - DNA, 25 bp, Rattus norvegicus
agtcattcatggttgctcacttgca

SEQ ID NO: 157623 - DNA, 25 bp, Rattus norvegicus
agtcattccaccctgtcctgatgtg

SEQ ID NO: 157624 - DNA, 25 bp, Rattus norvegicus
agtcattccaccgtgtcctgatgtg

SEQ ID NO: 157625 - DNA, 25 bp, Rattus norvegicus
agtcattctctacttctttttctaa

SEQ ID NO: 157626 - DNA, 25 bp, Rattus norvegicus
agtcattctctagttctttttctaa

SEQ ID NO: 157627 - DNA, 25 bp, Rattus norvegicus
agtcattctctcacaagtgtctttc

SEQ ID NO: 157628 - DNA, 25 bp, Rattus norvegicus
agtcattctctctcaagtgtctttc

SEQ ID NO: 157629 - DNA, 25 bp, Rattus norvegicus
agtcattctgatcgctcttctagtc

SEQ ID NO: 157630 - DNA, 25 bp, Rattus norvegicus
agtcattctgatggctcttctagtc

SEQ ID NO: 157631 - DNA, 25 bp, Rattus norvegicus
agtcattctgtgcttttactctcaa

SEQ ID NO: 157632 - DNA, 25 bp, Rattus norvegicus
agtcattctgtggttttactctcaa

SEQ ID NO: 157633 - DNA, 25 bp, Rattus norvegicus
agtcattcttgcacctgtgataatc

SEQ ID NO: 157634 - DNA, 25 bp, Rattus norvegicus
agtcattcttgctcctgtgataatc

SEQ ID NO: 157635 - DNA, 25 bp, Rattus norvegicus
agtcattcttgtcccttcattagga

SEQ ID NO: 157636 - DNA, 25 bp, Rattus norvegicus
agtcattcttgtgccttcattagga

SEQ ID NO: 157637 - DNA, 25 bp, Rattus norvegicus
agtcattctttcaccccacaaaatg

SEQ ID NO: 157638 - DNA, 25 bp, Rattus norvegicus
agtcattctttctccccacaaaatg

SEQ ID NO: 157639 - DNA, 25 bp, Rattus norvegicus
agtcattctttgcatctgatttggc

SEQ ID NO: 157640 - DNA, 25 bp, Rattus norvegicus
agtcattctttggatctgatttggc

SEQ ID NO: 157641 - DNA, 25 bp, Rattus norvegicus
agtcattgaagccaccactgaaggt

SEQ ID NO: 157642 - DNA, 25 bp, Rattus norvegicus
agtcattgaagcgaccactgaaggt

SEQ ID NO: 157643 - DNA, 25 bp, Rattus norvegicus
agtcattgcgaacgccctctgtgga

SEQ ID NO: 157644 - DNA, 25 bp, Rattus norvegicus
agtcattgcgaaggccctctgtgga

SEQ ID NO: 157645 - DNA, 25 bp, Rattus norvegicus
agtcattgctcaccgggacggtgaa

SEQ ID NO: 157646 - DNA, 25 bp, Rattus norvegicus
agtcattgctcagcgggacggtgaa

SEQ ID NO: 157647 - DNA, 25 bp, Rattus norvegicus
agtcattggagcagcctcataacct

SEQ ID NO: 157648 - DNA, 25 bp, Rattus norvegicus
agtcattggagctgcctcataacct

SEQ ID NO: 157649 - DNA, 25 bp, Rattus norvegicus
agtcattgggtcctgtccccaagga

SEQ ID NO: 157650 - DNA, 25 bp, Rattus norvegicus
agtcattgggtcgtgtccccaagga

SEQ ID NO: 157651 - DNA, 25 bp, Rattus norvegicus
agtcattggtaaagtccacgcttcc

SEQ ID NO: 157652 - DNA, 25 bp, Rattus norvegicus
agtcattggtaatgtccacgcttcc

SEQ ID NO: 157653 - DNA, 25 bp, Rattus norvegicus
agtcattggttaagcagtgtagtcc

SEQ ID NO: 157654 - DNA, 25 bp, Rattus norvegicus
agtcattggttatgcagtgtagtcc

SEQ ID NO: 157655 - DNA, 25 bp, Rattus norvegicus
agtcattgtagcaacactcctaact

SEQ ID NO: 157656 - DNA, 25 bp, Rattus norvegicus
agtcattgtagctacactcctaact

SEQ ID NO: 157657 - DNA, 25 bp, Rattus norvegicus
agtcattgtgttctgtgttccggtc

SEQ ID NO: 157658 - DNA, 25 bp, Rattus norvegicus
agtcattgtgttgtgtgttccggtc

SEQ ID NO: 157659 - DNA, 25 bp, Rattus norvegicus
agtcatttaatcagtgcctcacaca

SEQ ID NO: 157660 - DNA, 25 bp, Rattus norvegicus
agtcatttaatctgtgcctcacaca

SEQ ID NO: 157661 - DNA, 25 bp, Rattus norvegicus
agtcatttacccagaacccagggct

SEQ ID NO: 157662 - DNA, 25 bp, Rattus norvegicus
agtcatttaccctgaacccagggct

SEQ ID NO: 157663 - DNA, 25 bp, Rattus norvegicus
agtcatttactgcagtcttctcaat

SEQ ID NO: 157664 - DNA, 25 bp, Rattus norvegicus
agtcatttactggagtcttctcaat

SEQ ID NO: 157665 - DNA, 25 bp, Rattus norvegicus
agtcatttatttcctttctgtatta

SEQ ID NO: 157666 - DNA, 25 bp, Rattus norvegicus
agtcatttatttgctttctgtatta

SEQ ID NO: 157667 - DNA, 25 bp, Rattus norvegicus
agtcatttcaacaacttgtacccag

SEQ ID NO: 157668 - DNA, 25 bp, Rattus norvegicus
agtcatttcaactacttgtacccag

SEQ ID NO: 157669 - DNA, 25 bp, Rattus norvegicus
agtcatttcaagagcgtttgcctcc

SEQ ID NO: 157670 - DNA, 25 bp, Rattus norvegicus
agtcatttcaagtgcgtttgcctcc

SEQ ID NO: 157671 - DNA, 25 bp, Rattus norvegicus
agtcatttcatcaaagtgcttaacc

SEQ ID NO: 157672 - DNA, 25 bp, Rattus norvegicus
agtcatttcatctaagtgcttaacc

SEQ ID NO: 157673 - DNA, 25 bp, Rattus norvegicus
agtcatttcccgacggccaaggtgc

SEQ ID NO: 157674 - DNA, 25 bp, Rattus norvegicus
agtcatttcccgtcggccaaggtgc

SEQ ID NO: 157675 - DNA, 25 bp, Rattus norvegicus
agtcatttccctagaacttcacttt

SEQ ID NO: 157676 - DNA, 25 bp, Rattus norvegicus
agtcatttccctcaataatccctca

SEQ ID NO: 157677 - DNA, 25 bp, Rattus norvegicus
agtcatttccctgaataatccctca

SEQ ID NO: 157678 - DNA, 25 bp, Rattus norvegicus
agtcatttcccttgaacttcacttt

SEQ ID NO: 157679 - DNA, 25 bp, Rattus norvegicus
agtcatttcctgcactacacagggc

SEQ ID NO: 157680 - DNA, 25 bp, Rattus norvegicus
agtcatttcctggactacacagggc

SEQ ID NO: 157681 - DNA, 25 bp, Rattus norvegicus
agtcatttccttctgccacaatagt

SEQ ID NO: 157682 - DNA, 25 bp, Rattus norvegicus
agtcatttccttgtgccacaatagt

SEQ ID NO: 157683 - DNA, 25 bp, Rattus norvegicus
agtcatttgagtcagttcttcccca

SEQ ID NO: 157684 - DNA, 25 bp, Rattus norvegicus
agtcatttgagtgagttcttcccca

SEQ ID NO: 157685 - DNA, 25 bp, Rattus norvegicus
agtcatttgccccatttgtctctct

SEQ ID NO: 157686 - DNA, 25 bp, Rattus norvegicus
agtcatttgcccgatttgtctctct

SEQ ID NO: 157687 - DNA, 25 bp, Rattus norvegicus
agtcatttgctgaccataactgtgg

SEQ ID NO: 157688 - DNA, 25 bp, Rattus norvegicus
agtcatttgctgtccataactgtgg

SEQ ID NO: 157689 - DNA, 25 bp, Rattus norvegicus
agtcatttggacagcattgctgctg

SEQ ID NO: 157690 - DNA, 25 bp, Rattus norvegicus
agtcatttggactgcattgctgctg

SEQ ID NO: 157691 - DNA, 25 bp, Rattus norvegicus
agtcatttgtcaactctgaggtgga

SEQ ID NO: 157692 - DNA, 25 bp, Rattus norvegicus
agtcatttgtcatctctgaggtgga

SEQ ID NO: 157693 - DNA, 25 bp, Rattus norvegicus
agtcatttgtgtatgggctttctct

SEQ ID NO: 157694 - DNA, 25 bp, Rattus norvegicus
agtcatttgtgtttgggctttctct

SEQ ID NO: 157695 - DNA, 25 bp, Rattus norvegicus
agtcatttgtttccttgtgctcttc

SEQ ID NO: 157696 - DNA, 25 bp, Rattus norvegicus
agtcatttgtttgcttgtgctcttc

SEQ ID NO: 157697 - DNA, 25 bp, Rattus norvegicus
agtcattttcacacacaactccata

SEQ ID NO: 157698 - DNA, 25 bp, Rattus norvegicus
agtcattttcactcacaactccata

SEQ ID NO: 157699 - DNA, 25 bp, Rattus norvegicus
agtcattttccaactgggtgcatca

SEQ ID NO: 157700 - DNA, 25 bp, Rattus norvegicus
agtcattttccatctgggtgcatca

SEQ ID NO: 157701 - DNA, 25 bp, Rattus norvegicus
agtcattttcctatcctaaacacac

SEQ ID NO: 157702 - DNA, 25 bp, Rattus norvegicus
agtcattttcctcgatttgccagag

SEQ ID NO: 157703 - DNA, 25 bp, Rattus norvegicus
agtcattttcctggatttgccagag

SEQ ID NO: 157704 - DNA, 25 bp, Rattus norvegicus
agtcattttcctttcctaaacacac

SEQ ID NO: 157705 - DNA, 25 bp, Rattus norvegicus
agtcattttctcagatacgttctca

SEQ ID NO: 157706 - DNA, 25 bp, Rattus norvegicus
agtcattttctctgatacgttctca

SEQ ID NO: 157707 - DNA, 25 bp, Rattus norvegicus
agtcattttgttccgcactttaaag

SEQ ID NO: 157708 - DNA, 25 bp, Rattus norvegicus
agtcattttgttgcgcactttaaag

SEQ ID NO: 157709 - DNA, 25 bp, Rattus norvegicus
agtccaaaactacccgtatgtcttc

SEQ ID NO: 157710 - DNA, 25 bp, Rattus norvegicus
agtccaaaactagccgtatgtcttc

SEQ ID NO: 157711 - DNA, 25 bp, Rattus norvegicus
agtccaaaggctccacaggcaagtt

SEQ ID NO: 157712 - DNA, 25 bp, Rattus norvegicus
agtccaaaggctgcacaggcaagtt

SEQ ID NO: 157713 - DNA, 25 bp, Rattus norvegicus
agtccaaagtccagagcgctgtgga

SEQ ID NO: 157714 - DNA, 25 bp, Rattus norvegicus
agtccaaagtcctgagcgctgtgga

SEQ ID NO: 157715 - DNA, 25 bp, Rattus norvegicus
agtccaaatccaatcagcagggcaa

SEQ ID NO: 157716 - DNA, 25 bp, Rattus norvegicus
agtccaaatccattcagcagggcaa

SEQ ID NO: 157717 - DNA, 25 bp, Rattus norvegicus
agtccaaatttgactccatttctga

SEQ ID NO: 157718 - DNA, 25 bp, Rattus norvegicus
agtccaaatttgtctccatttctga

SEQ ID NO: 157719 - DNA, 25 bp, Rattus norvegicus
agtccaacagttcttcaatccacca

SEQ ID NO: 157720 - DNA, 25 bp, Rattus norvegicus
agtccaacagttgttcaatccacca

SEQ ID NO: 157721 - DNA, 25 bp, Rattus norvegicus
agtccaaccagacagccgattttag

SEQ ID NO: 157722 - DNA, 25 bp, Rattus norvegicus
agtccaaccagagagccgattttag

SEQ ID NO: 157723 - DNA, 25 bp, Rattus norvegicus
agtccaacctatcatgtgtcttcca

SEQ ID NO: 157724 - DNA, 25 bp, Rattus norvegicus
agtccaacctatgatgtgtcttcca

SEQ ID NO: 157725 - DNA, 25 bp, Rattus norvegicus
agtccaacggatcccagcctgagtc

SEQ ID NO: 157726 - DNA, 25 bp, Rattus norvegicus
agtccaacggatgccagcctgagtc

SEQ ID NO: 157727 - DNA, 25 bp, Rattus norvegicus
agtccaactctgattttgcttttct

SEQ ID NO: 157728 - DNA, 25 bp, Rattus norvegicus
agtccaactctgtttttgcttttct

SEQ ID NO: 157729 - DNA, 25 bp, Rattus norvegicus
agtccaactgagatgctctgtgcct

SEQ ID NO: 157730 - DNA, 25 bp, Rattus norvegicus
agtccaactgagttgctctgtgcct

SEQ ID NO: 157731 - DNA, 25 bp, Rattus norvegicus
agtccaagagatctcgtcgtagcca

SEQ ID NO: 157732 - DNA, 25 bp, Rattus norvegicus
agtccaagagatgtcgtcgtagcca

SEQ ID NO: 157733 - DNA, 25 bp, Rattus norvegicus
agtccaagagccacttcatcctggg

SEQ ID NO: 157734 - DNA, 25 bp, Rattus norvegicus
agtccaagagcctcttcatcctggg

SEQ ID NO: 157735 - DNA, 25 bp, Rattus norvegicus
agtccaagcaccagtgtctacggag

SEQ ID NO: 157736 - DNA, 25 bp, Rattus norvegicus
agtccaagcacctgtgtctacggag

SEQ ID NO: 157737 - DNA, 25 bp, Rattus norvegicus
agtccaagtacaacggcacgggcca

SEQ ID NO: 157738 - DNA, 25 bp, Rattus norvegicus
agtccaagtacatcggcacgggcca

SEQ ID NO: 157739 - DNA, 25 bp, Rattus norvegicus
agtccaagtccaagaggcaccttag

SEQ ID NO: 157740 - DNA, 25 bp, Rattus norvegicus
agtccaagtccacgccggaggaaga

SEQ ID NO: 157741 - DNA, 25 bp, Rattus norvegicus
agtccaagtccaggccggaggaaga

SEQ ID NO: 157742 - DNA, 25 bp, Rattus norvegicus
agtccaagtccatgaggcaccttag

SEQ ID NO: 157743 - DNA, 25 bp, Rattus norvegicus
agtccaagtctgagacatggaactt

SEQ ID NO: 157744 - DNA, 25 bp, Rattus norvegicus
agtccaagtctgtgacatggaactt

SEQ ID NO: 157745 - DNA, 25 bp, Rattus norvegicus
agtccaatatccaggcaacaggagg

SEQ ID NO: 157746 - DNA, 25 bp, Rattus norvegicus
agtccaatatcctggcaacaggagg

SEQ ID NO: 157747 - DNA, 25 bp, Rattus norvegicus
agtccaatcaaaaacagccatgcag

SEQ ID NO: 157748 - DNA, 25 bp, Rattus norvegicus
agtccaatcaaatacagccatgcag

SEQ ID NO: 157749 - DNA, 25 bp, Rattus norvegicus
agtccaatcagcacgtgttctccct

SEQ ID NO: 157750 - DNA, 25 bp, Rattus norvegicus
agtccaatcagctcgtgttctccct

SEQ ID NO: 157751 - DNA, 25 bp, Rattus norvegicus
agtccaatcatcatgtgcatctaga

SEQ ID NO: 157752 - DNA, 25 bp, Rattus norvegicus
agtccaatcatcttgtgcatctaga

SEQ ID NO: 157753 - DNA, 25 bp, Rattus norvegicus
agtccaatcttactctatttaccca

SEQ ID NO: 157754 - DNA, 25 bp, Rattus norvegicus
agtccaatcttagtctatttaccca

SEQ ID NO: 157755 - DNA, 25 bp, Rattus norvegicus
agtccaatggtaccgtctttgttcg

SEQ ID NO: 157756 - DNA, 25 bp, Rattus norvegicus
agtccaatggtagcgtctttgttcg

SEQ ID NO: 157757 - DNA, 25 bp, Rattus norvegicus
agtccaatgtatcctgtctccaaag

SEQ ID NO: 157758 - DNA, 25 bp, Rattus norvegicus
agtccaatgtatgctgtctccaaag

SEQ ID NO: 157759 - DNA, 25 bp, Rattus norvegicus
agtccaattcccagatggaggccga

SEQ ID NO: 157760 - DNA, 25 bp, Rattus norvegicus
agtccaattccctgatggaggccga

SEQ ID NO: 157761 - DNA, 25 bp, Rattus norvegicus
agtccaattcctaatattcctgcgg

SEQ ID NO: 157762 - DNA, 25 bp, Rattus norvegicus
agtccaattccttatattcctgcgg

SEQ ID NO: 157763 - DNA, 25 bp, Rattus norvegicus
agtccaattgagacaccacatttta

SEQ ID NO: 157764 - DNA, 25 bp, Rattus norvegicus
agtccaattgagtcaccacatttta

SEQ ID NO: 157765 - DNA, 25 bp, Rattus norvegicus
agtccaattgctacgtatcacggaa

SEQ ID NO: 157766 - DNA, 25 bp, Rattus norvegicus
agtccaattgcttcgtatcacggaa

SEQ ID NO: 157767 - DNA, 25 bp, Rattus norvegicus
agtccaattttaacaccggcgctgg

SEQ ID NO: 157768 - DNA, 25 bp, Rattus norvegicus
agtccaattttatcaccggcgctgg

SEQ ID NO: 157769 - DNA, 25 bp, Rattus norvegicus
agtccacaagccatgtttccatgct

SEQ ID NO: 157770 - DNA, 25 bp, Rattus norvegicus
agtccacaagccttgtttccatgct

SEQ ID NO: 157771 - DNA, 25 bp, Rattus norvegicus
agtccacaattacctttcagattca

SEQ ID NO: 157772 - DNA, 25 bp, Rattus norvegicus
agtccacaattagctttcagattca

SEQ ID NO: 157773 - DNA, 25 bp, Rattus norvegicus
agtccacactggcttagtatatatg

SEQ ID NO: 157774 - DNA, 25 bp, Rattus norvegicus
agtccacactgggttagtatatatg

SEQ ID NO: 157775 - DNA, 25 bp, Rattus norvegicus
agtccacagactatctgccttgtga

SEQ ID NO: 157776 - DNA, 25 bp, Rattus norvegicus
agtccacagactttctgccttgtga

SEQ ID NO: 157777 - DNA, 25 bp, Rattus norvegicus
agtccacagcagagtgagctccagg

SEQ ID NO: 157778 - DNA, 25 bp, Rattus norvegicus
agtccacagcagtgtgagctccagg

SEQ ID NO: 157779 - DNA, 25 bp, Rattus norvegicus
agtccacagggacgtttcttacacg

SEQ ID NO: 157780 - DNA, 25 bp, Rattus norvegicus
agtccacagggaggtttcttacacg

SEQ ID NO: 157781 - DNA, 25 bp, Rattus norvegicus
agtccacagtgtacaagtacctcag

SEQ ID NO: 157782 - DNA, 25 bp, Rattus norvegicus
agtccacagtgttcaagtacctcag

SEQ ID NO: 157783 - DNA, 25 bp, Rattus norvegicus
agtccacataaacccagtgtttcag

SEQ ID NO: 157784 - DNA, 25 bp, Rattus norvegicus
agtccacataaagccagtgtttcag

SEQ ID NO: 157785 - DNA, 25 bp, Rattus norvegicus
agtccacataacacaagacggctcc

SEQ ID NO: 157786 - DNA, 25 bp, Rattus norvegicus
agtccacataactcaagacggctcc

SEQ ID NO: 157787 - DNA, 25 bp, Rattus norvegicus
agtccacatttccacagttgttttc

SEQ ID NO: 157788 - DNA, 25 bp, Rattus norvegicus
agtccacatttcgacagttgttttc

SEQ ID NO: 157789 - DNA, 25 bp, Rattus norvegicus
agtccaccatgcctgtggtatttag

SEQ ID NO: 157790 - DNA, 25 bp, Rattus norvegicus
agtccaccatgcgtgtggtatttag

SEQ ID NO: 157791 - DNA, 25 bp, Rattus norvegicus
agtccaccgactatcagagaagctg

SEQ ID NO: 157792 - DNA, 25 bp, Rattus norvegicus
agtccaccgactttcagagaagctg

SEQ ID NO: 157793 - DNA, 25 bp, Rattus norvegicus
agtccaccgcttccaagaagggaga

SEQ ID NO: 157794 - DNA, 25 bp, Rattus norvegicus
agtccaccgcttgcaagaagggaga

SEQ ID NO: 157795 - DNA, 25 bp, Rattus norvegicus
agtccacctcacctatgtgtggtac

SEQ ID NO: 157796 - DNA, 25 bp, Rattus norvegicus
agtccacctcacgtatgtgtggtac

SEQ ID NO: 157797 - DNA, 25 bp, Rattus norvegicus
agtccacctgttctgatttgagcag

SEQ ID NO: 157798 - DNA, 25 bp, Rattus norvegicus
agtccacctgttgtgatttgagcag

SEQ ID NO: 157799 - DNA, 25 bp, Rattus norvegicus
agtccacgacacagaggcggtcttt

SEQ ID NO: 157800 - DNA, 25 bp, Rattus norvegicus
agtccacgacactgaggcggtcttt

SEQ ID NO: 157801 - DNA, 25 bp, Rattus norvegicus
agtccacggcttactgcaaaacaaa

SEQ ID NO: 157802 - DNA, 25 bp, Rattus norvegicus
agtccacggctttctgcaaaacaaa

SEQ ID NO: 157803 - DNA, 25 bp, Rattus norvegicus
agtccacgtgtgctcaatcggtcac

SEQ ID NO: 157804 - DNA, 25 bp, Rattus norvegicus
agtccacgtgtggtcaatcggtcac

SEQ ID NO: 157805 - DNA, 25 bp, Rattus norvegicus
agtccactaatcacagaggttgcca

SEQ ID NO: 157806 - DNA, 25 bp, Rattus norvegicus
agtccactaatctcagaggttgcca

SEQ ID NO: 157807 - DNA, 25 bp, Rattus norvegicus
agtccactctctaaaggcaactcaa

SEQ ID NO: 157808 - DNA, 25 bp, Rattus norvegicus
agtccactctcttaaggcaactcaa

SEQ ID NO: 157809 - DNA, 25 bp, Rattus norvegicus
agtccactgaacatctgattcgcaa

SEQ ID NO: 157810 - DNA, 25 bp, Rattus norvegicus
agtccactgaacttctgattcgcaa

SEQ ID NO: 157811 - DNA, 25 bp, Rattus norvegicus
agtccactgcggaattcacacacta

SEQ ID NO: 157812 - DNA, 25 bp, Rattus norvegicus
agtccactgcggtattcacacacta

SEQ ID NO: 157813 - DNA, 25 bp, Rattus norvegicus
agtccactgggcagaacgtctggca

SEQ ID NO: 157814 - DNA, 25 bp, Rattus norvegicus
agtccactgggctgaacgtctggca

SEQ ID NO: 157815 - DNA, 25 bp, Rattus norvegicus
agtccactttcaataatgccctgag

SEQ ID NO: 157816 - DNA, 25 bp, Rattus norvegicus
agtccactttcattaatgccctgag

SEQ ID NO: 157817 - DNA, 25 bp, Rattus norvegicus
agtccagacaggctgcactgcaata

SEQ ID NO: 157818 - DNA, 25 bp, Rattus norvegicus
agtccagacagggtgcactgcaata

SEQ ID NO: 157819 - DNA, 25 bp, Rattus norvegicus
agtccagacctacagtgccatcgaa

SEQ ID NO: 157820 - DNA, 25 bp, Rattus norvegicus
agtccagacctagagtgccatcgaa

SEQ ID NO: 157821 - DNA, 25 bp, Rattus norvegicus
agtccagagacccaaactagccaag

SEQ ID NO: 157822 - DNA, 25 bp, Rattus norvegicus
agtccagagaccgaaactagccaag

SEQ ID NO: 157823 - DNA, 25 bp, Rattus norvegicus
agtccagagagtactcctgcaccag

SEQ ID NO: 157824 - DNA, 25 bp, Rattus norvegicus
agtccagagagtccatgatccagct

SEQ ID NO: 157825 - DNA, 25 bp, Rattus norvegicus
agtccagagagtgcatgatccagct

SEQ ID NO: 157826 - DNA, 25 bp, Rattus norvegicus
agtccagagagttctcctgcaccag

SEQ ID NO: 157827 - DNA, 25 bp, Rattus norvegicus
agtccagagatgacgggtctgccac

SEQ ID NO: 157828 - DNA, 25 bp, Rattus norvegicus
agtccagagatgtcgggtctgccac

SEQ ID NO: 157829 - DNA, 25 bp, Rattus norvegicus
agtccagagccgagtccacgcgagg

SEQ ID NO: 157830 - DNA, 25 bp, Rattus norvegicus
agtccagagccgtgtccacgcgagg

SEQ ID NO: 157831 - DNA, 25 bp, Rattus norvegicus
agtccagagctcacatattcaagag

SEQ ID NO: 157832 - DNA, 25 bp, Rattus norvegicus
agtccagagctctcatattcaagag

SEQ ID NO: 157833 - DNA, 25 bp, Rattus norvegicus
agtccagagggacagctcaggccca

SEQ ID NO: 157834 - DNA, 25 bp, Rattus norvegicus
agtccagagggagagctcaggccca

SEQ ID NO: 157835 - DNA, 25 bp, Rattus norvegicus
agtccagatggccagagagtagcaa

SEQ ID NO: 157836 - DNA, 25 bp, Rattus norvegicus
agtccagatggcgagagagtagcaa

SEQ ID NO: 157837 - DNA, 25 bp, Rattus norvegicus
agtccagattcacctgtgccgtgac

SEQ ID NO: 157838 - DNA, 25 bp, Rattus norvegicus
agtccagattcagctgtgccgtgac

SEQ ID NO: 157839 - DNA, 25 bp, Rattus norvegicus
agtccagcagaaatcatggctctga

SEQ ID NO: 157840 - DNA, 25 bp, Rattus norvegicus
agtccagcagaattcatggctctga

SEQ ID NO: 157841 - DNA, 25 bp, Rattus norvegicus
agtccagccagtcctgagttgtaaa

SEQ ID NO: 157842 - DNA, 25 bp, Rattus norvegicus
agtccagccagtgctgagttgtaaa

SEQ ID NO: 157843 - DNA, 25 bp, Rattus norvegicus
agtccagcctatcagccgagagcag

SEQ ID NO: 157844 - DNA, 25 bp, Rattus norvegicus
agtccagcctatgagccgagagcag

SEQ ID NO: 157845 - DNA, 25 bp, Rattus norvegicus
agtccagcctcactggcttcctgag

SEQ ID NO: 157846 - DNA, 25 bp, Rattus norvegicus
agtccagcctcagtggcttcctgag

SEQ ID NO: 157847 - DNA, 25 bp, Rattus norvegicus
agtccagcctctcgcatttgtgttt

SEQ ID NO: 157848 - DNA, 25 bp, Rattus norvegicus
agtccagcctctggcatttgtgttt

SEQ ID NO: 157849 - DNA, 25 bp, Rattus norvegicus
agtccagcctgcagttcatctgata

SEQ ID NO: 157850 - DNA, 25 bp, Rattus norvegicus
agtccagcctgctgttcatctgata

SEQ ID NO: 157851 - DNA, 25 bp, Rattus norvegicus
agtccagcgagcagtgttttctttc

SEQ ID NO: 157852 - DNA, 25 bp, Rattus norvegicus
agtccagcgagctgtgttttctttc

SEQ ID NO: 157853 - DNA, 25 bp, Rattus norvegicus
agtccagcgatcacgatgtctttga

SEQ ID NO: 157854 - DNA, 25 bp, Rattus norvegicus
agtccagcgatctcgatgtctttga

SEQ ID NO: 157855 - DNA, 25 bp, Rattus norvegicus
agtccagcgtcccaggcaagaaagt

SEQ ID NO: 157856 - DNA, 25 bp, Rattus norvegicus
agtccagcgtccgaggcaagaaagt

SEQ ID NO: 157857 - DNA, 25 bp, Rattus norvegicus
agtccagcgtgaagggccacagccc

SEQ ID NO: 157858 - DNA, 25 bp, Rattus norvegicus
agtccagcgtgatgggccacagccc

SEQ ID NO: 157859 - DNA, 25 bp, Rattus norvegicus
agtccagctggcatatatggctaga

SEQ ID NO: 157860 - DNA, 25 bp, Rattus norvegicus
agtccagctggcttatatggctaga

SEQ ID NO: 157861 - DNA, 25 bp, Rattus norvegicus
agtccagctgttagttagcctttct

SEQ ID NO: 157862 - DNA, 25 bp, Rattus norvegicus
agtccagctgtttgttagcctttct

SEQ ID NO: 157863 - DNA, 25 bp, Rattus norvegicus
agtccagcttagaaacctcttcact

SEQ ID NO: 157864 - DNA, 25 bp, Rattus norvegicus
agtccagcttagtaacctcttcact

SEQ ID NO: 157865 - DNA, 25 bp, Rattus norvegicus
agtccagcttttcactcctgccttt

SEQ ID NO: 157866 - DNA, 25 bp, Rattus norvegicus
agtccagcttttgactcctgccttt

SEQ ID NO: 157867 - DNA, 25 bp, Rattus norvegicus
agtccaggaagccaccaggtaggtc

SEQ ID NO: 157868 - DNA, 25 bp, Rattus norvegicus
agtccaggaagcgaccaggtaggtc

SEQ ID NO: 157869 - DNA, 25 bp, Rattus norvegicus
agtccaggaaggatcctgacaggaa

SEQ ID NO: 157870 - DNA, 25 bp, Rattus norvegicus
agtccaggaaggttcctgacaggaa

SEQ ID NO: 157871 - DNA, 25 bp, Rattus norvegicus
agtccaggactgaggctgtcccagt

SEQ ID NO: 157872 - DNA, 25 bp, Rattus norvegicus
agtccaggactgtggctgtcccagt

SEQ ID NO: 157873 - DNA, 25 bp, Rattus norvegicus
agtccaggattaatctcccaacgtc

SEQ ID NO: 157874 - DNA, 25 bp, Rattus norvegicus
agtccaggattattctcccaacgtc

SEQ ID NO: 157875 - DNA, 25 bp, Rattus norvegicus
agtccaggcatacctggccctgttc

SEQ ID NO: 157876 - DNA, 25 bp, Rattus norvegicus
agtccaggcatagctggccctgttc

SEQ ID NO: 157877 - DNA, 25 bp, Rattus norvegicus
agtccaggccctatgtgggaaggca

SEQ ID NO: 157878 - DNA, 25 bp, Rattus norvegicus
agtccaggccctttgtgggaaggca

SEQ ID NO: 157879 - DNA, 25 bp, Rattus norvegicus
agtccaggcctgagatctttgagga

SEQ ID NO: 157880 - DNA, 25 bp, Rattus norvegicus
agtccaggcctgtgatctttgagga

SEQ ID NO: 157881 - DNA, 25 bp, Rattus norvegicus
agtccaggctggcaagcgctctacc

SEQ ID NO: 157882 - DNA, 25 bp, Rattus norvegicus
agtccaggctgggaagcgctctacc

SEQ ID NO: 157883 - DNA, 25 bp, Rattus norvegicus
agtccaggctgtctggcctagtagt

SEQ ID NO: 157884 - DNA, 25 bp, Rattus norvegicus
agtccaggctgtgtggcctagtagt

SEQ ID NO: 157885 - DNA, 25 bp, Rattus norvegicus
agtccagggaatcagatgtcctctt

SEQ ID NO: 157886 - DNA, 25 bp, Rattus norvegicus
agtccagggaatgagatgtcctctt

SEQ ID NO: 157887 - DNA, 25 bp, Rattus norvegicus
agtccagggagtcccgcgacaaaca

SEQ ID NO: 157888 - DNA, 25 bp, Rattus norvegicus
agtccagggagtgccgcgacaaaca

SEQ ID NO: 157889 - DNA, 25 bp, Rattus norvegicus
agtccagggtctcgatgggactccc

SEQ ID NO: 157890 - DNA, 25 bp, Rattus norvegicus
agtccagggtctggatgggactccc

SEQ ID NO: 157891 - DNA, 25 bp, Rattus norvegicus
agtccaggtcctactgtctgaagaa

SEQ ID NO: 157892 - DNA, 25 bp, Rattus norvegicus
agtccaggtccttctgtctgaagaa

SEQ ID NO: 157893 - DNA, 25 bp, Rattus norvegicus
agtccaggtctgagttaccacatag

SEQ ID NO: 157894 - DNA, 25 bp, Rattus norvegicus
agtccaggtctgtgttaccacatag

SEQ ID NO: 157895 - DNA, 25 bp, Rattus norvegicus
agtccagtaaatcatggccgttcat

SEQ ID NO: 157896 - DNA, 25 bp, Rattus norvegicus
agtccagtaaatgatggccgttcat

SEQ ID NO: 157897 - DNA, 25 bp, Rattus norvegicus
agtccagtacgaattgcctttaaca

SEQ ID NO: 157898 - DNA, 25 bp, Rattus norvegicus
agtccagtacgatttgcctttaaca

SEQ ID NO: 157899 - DNA, 25 bp, Rattus norvegicus
agtccagtaggacacagccctgcaa

SEQ ID NO: 157900 - DNA, 25 bp, Rattus norvegicus
agtccagtaggagacagccctgcaa

SEQ ID NO: 157901 - DNA, 25 bp, Rattus norvegicus
agtccagtcccaattaccatgaaga

SEQ ID NO: 157902 - DNA, 25 bp, Rattus norvegicus
agtccagtcccatttaccatgaaga

SEQ ID NO: 157903 - DNA, 25 bp, Rattus norvegicus
agtccagtctgtcccattagcagat

SEQ ID NO: 157904 - DNA, 25 bp, Rattus norvegicus
agtccagtctgtgccattagcagat

SEQ ID NO: 157905 - DNA, 25 bp, Rattus norvegicus
agtccagtgaccactctaaaagcaa

SEQ ID NO: 157906 - DNA, 25 bp, Rattus norvegicus
agtccagtgacctctctaaaagcaa

SEQ ID NO: 157907 - DNA, 25 bp, Rattus norvegicus
agtccagtggaaagcttcctgtgct

SEQ ID NO: 157908 - DNA, 25 bp, Rattus norvegicus
agtccagtggaatgcttcctgtgct

SEQ ID NO: 157909 - DNA, 25 bp, Rattus norvegicus
agtccagtgtctcctgttggcaaag

SEQ ID NO: 157910 - DNA, 25 bp, Rattus norvegicus
agtccagtgtctgctgttggcaaag

SEQ ID NO: 157911 - DNA, 25 bp, Rattus norvegicus
agtccagtgtgacattgaagagctt

SEQ ID NO: 157912 - DNA, 25 bp, Rattus norvegicus
agtccagtgtgagattgaagagctt

SEQ ID NO: 157913 - DNA, 25 bp, Rattus norvegicus
agtccagttcttctcgttgatgcca

SEQ ID NO: 157914 - DNA, 25 bp, Rattus norvegicus
agtccagttcttgtcgttgatgcca

SEQ ID NO: 157915 - DNA, 25 bp, Rattus norvegicus
agtccagttggtacacacgttttga

SEQ ID NO: 157916 - DNA, 25 bp, Rattus norvegicus
agtccagttggttcacacgttttga

SEQ ID NO: 157917 - DNA, 25 bp, Rattus norvegicus
agtccataattccaaatgtcacttg

SEQ ID NO: 157918 - DNA, 25 bp, Rattus norvegicus
agtccataattcgaaatgtcacttg

SEQ ID NO: 157919 - DNA, 25 bp, Rattus norvegicus
agtccatatttcaacagcacgattt

SEQ ID NO: 157920 - DNA, 25 bp, Rattus norvegicus
agtccatatttctacagcacgattt

SEQ ID NO: 157921 - DNA, 25 bp, Rattus norvegicus
agtccatcacctatgggttaagtca

SEQ ID NO: 157922 - DNA, 25 bp, Rattus norvegicus
agtccatcacctttgggttaagtca

SEQ ID NO: 157923 - DNA, 25 bp, Rattus norvegicus
agtccatcagcgagtggttcaccag

SEQ ID NO: 157924 - DNA, 25 bp, Rattus norvegicus
agtccatcagcgtgtggttcaccag

SEQ ID NO: 157925 - DNA, 25 bp, Rattus norvegicus
agtccatcagtgataactccctgag

SEQ ID NO: 157926 - DNA, 25 bp, Rattus norvegicus
agtccatcagtgttaactccctgag

SEQ ID NO: 157927 - DNA, 25 bp, Rattus norvegicus
agtccatcagttcactctgtcagca

SEQ ID NO: 157928 - DNA, 25 bp, Rattus norvegicus
agtccatcagttgactctgtcagca

SEQ ID NO: 157929 - DNA, 25 bp, Rattus norvegicus
agtccatcatttagctgccttgaaa

SEQ ID NO: 157930 - DNA, 25 bp, Rattus norvegicus
agtccatcattttgctgccttgaaa

SEQ ID NO: 157931 - DNA, 25 bp, Rattus norvegicus
agtccatccacgaatcccaggatga

SEQ ID NO: 157932 - DNA, 25 bp, Rattus norvegicus
agtccatccacgtatcccaggatga

SEQ ID NO: 157933 - DNA, 25 bp, Rattus norvegicus
agtccatccagccaagttgttgcaa

SEQ ID NO: 157934 - DNA, 25 bp, Rattus norvegicus
agtccatccagcgaagttgttgcaa

SEQ ID NO: 157935 - DNA, 25 bp, Rattus norvegicus
agtccatccaggctgctgtaagcgt

SEQ ID NO: 157936 - DNA, 25 bp, Rattus norvegicus
agtccatccagggtgctgtaagcgt

SEQ ID NO: 157937 - DNA, 25 bp, Rattus norvegicus
agtccatccgtgctgtcctcatctt

SEQ ID NO: 157938 - DNA, 25 bp, Rattus norvegicus
agtccatccgtggtgtcctcatctt

SEQ ID NO: 157939 - DNA, 25 bp, Rattus norvegicus
agtccatctttgatgttccttaggc

SEQ ID NO: 157940 - DNA, 25 bp, Rattus norvegicus
agtccatctttgttgttccttaggc

SEQ ID NO: 157941 - DNA, 25 bp, Rattus norvegicus
agtccatgactccacttgactttgg

SEQ ID NO: 157942 - DNA, 25 bp, Rattus norvegicus
agtccatgactcgacttgactttgg

SEQ ID NO: 157943 - DNA, 25 bp, Rattus norvegicus
agtccatgacttctggcttgtgctg

SEQ ID NO: 157944 - DNA, 25 bp, Rattus norvegicus
agtccatgacttgtggcttgtgctg

SEQ ID NO: 157945 - DNA, 25 bp, Rattus norvegicus
agtccatgcaataatcttcagatca

SEQ ID NO: 157946 - DNA, 25 bp, Rattus norvegicus
agtccatgcaattatcttcagatca

SEQ ID NO: 157947 - DNA, 25 bp, Rattus norvegicus
agtccatgcagaccagtggcaaagc

SEQ ID NO: 157948 - DNA, 25 bp, Rattus norvegicus
agtccatgcagagcagtggcaaagc

SEQ ID NO: 157949 - DNA, 25 bp, Rattus norvegicus
agtccatgccccaatcttgtagtca

SEQ ID NO: 157950 - DNA, 25 bp, Rattus norvegicus
agtccatgcccctatcttgtagtca

SEQ ID NO: 157951 - DNA, 25 bp, Rattus norvegicus
agtccatgcctgatcttagtctgca

SEQ ID NO: 157952 - DNA, 25 bp, Rattus norvegicus
agtccatgcctgttcttagtctgca

SEQ ID NO: 157953 - DNA, 25 bp, Rattus norvegicus
agtccatgccttagaggatctctct

SEQ ID NO: 157954 - DNA, 25 bp, Rattus norvegicus
agtccatgcctttgaggatctctct

SEQ ID NO: 157955 - DNA, 25 bp, Rattus norvegicus
agtccatgctcccgctggcagggac

SEQ ID NO: 157956 - DNA, 25 bp, Rattus norvegicus
agtccatgctccggctggcagggac

SEQ ID NO: 157957 - DNA, 25 bp, Rattus norvegicus
agtccatggcctctaaaattcttat

SEQ ID NO: 157958 - DNA, 25 bp, Rattus norvegicus
agtccatggcctgtaaaattcttat

SEQ ID NO: 157959 - DNA, 25 bp, Rattus norvegicus
agtccatgggtcagttgcctacaca

SEQ ID NO: 157960 - DNA, 25 bp, Rattus norvegicus
agtccatgggtctgttgcctacaca

SEQ ID NO: 157961 - DNA, 25 bp, Rattus norvegicus
agtccatgtacaagatcttcccaca

SEQ ID NO: 157962 - DNA, 25 bp, Rattus norvegicus
agtccatgtacatgatcttcccaca

SEQ ID NO: 157963 - DNA, 25 bp, Rattus norvegicus
agtccatgtcctaccttttcagaaa

SEQ ID NO: 157964 - DNA, 25 bp, Rattus norvegicus
agtccatgtccttccttttcagaaa

SEQ ID NO: 157965 - DNA, 25 bp, Rattus norvegicus
agtccatgtgatccgcacgttagcc

SEQ ID NO: 157966 - DNA, 25 bp, Rattus norvegicus
agtccatgtgatgcgcacgttagcc

SEQ ID NO: 157967 - DNA, 25 bp, Rattus norvegicus
agtccatgtttacttagcacccagg

SEQ ID NO: 157968 - DNA, 25 bp, Rattus norvegicus
agtccatgtttagttagcacccagg

SEQ ID NO: 157969 - DNA, 25 bp, Rattus norvegicus
agtccatgttttctgagccatccaa

SEQ ID NO: 157970 - DNA, 25 bp, Rattus norvegicus
agtccatgttttgtgagccatccaa

SEQ ID NO: 157971 - DNA, 25 bp, Rattus norvegicus
agtccattccaacaggccattgtct

SEQ ID NO: 157972 - DNA, 25 bp, Rattus norvegicus
agtccattccaagaggccattgtct

SEQ ID NO: 157973 - DNA, 25 bp, Rattus norvegicus
agtccattccatagcttgtttctca

SEQ ID NO: 157974 - DNA, 25 bp, Rattus norvegicus
agtccattccattgcttgtttctca

SEQ ID NO: 157975 - DNA, 25 bp, Rattus norvegicus
agtccattccttcgctaggagtcag

SEQ ID NO: 157976 - DNA, 25 bp, Rattus norvegicus
agtccattccttggctaggagtcag

SEQ ID NO: 157977 - DNA, 25 bp, Rattus norvegicus
agtccattctgtcttcatgttccaa

SEQ ID NO: 157978 - DNA, 25 bp, Rattus norvegicus
agtccattctgtgttcatgttccaa

SEQ ID NO: 157979 - DNA, 25 bp, Rattus norvegicus
agtccattgtgaacttgcttccggg

SEQ ID NO: 157980 - DNA, 25 bp, Rattus norvegicus
agtccattgtgatcttgcttccggg

SEQ ID NO: 157981 - DNA, 25 bp, Rattus norvegicus
agtccatttcacaatcagcaggctc

SEQ ID NO: 157982 - DNA, 25 bp, Rattus norvegicus
agtccatttcactatcagcaggctc

SEQ ID NO: 157983 - DNA, 25 bp, Rattus norvegicus
agtccatttgctcgctttgatccat

SEQ ID NO: 157984 - DNA, 25 bp, Rattus norvegicus
agtccatttgctggctttgatccat

SEQ ID NO: 157985 - DNA, 25 bp, Rattus norvegicus
agtcccaaggtgcagtgtgtaccaa

SEQ ID NO: 157986 - DNA, 25 bp, Rattus norvegicus
agtcccaaggtggagtgtgtaccaa

SEQ ID NO: 157987 - DNA, 25 bp, Rattus norvegicus
agtcccaatgacaccagtagtgtct

SEQ ID NO: 157988 - DNA, 25 bp, Rattus norvegicus
agtcccaatgactccagtagtgtct

SEQ ID NO: 157989 - DNA, 25 bp, Rattus norvegicus
agtcccaattttctcttatttgcca

SEQ ID NO: 157990 - DNA, 25 bp, Rattus norvegicus
agtcccaattttgtcttatttgcca

SEQ ID NO: 157991 - DNA, 25 bp, Rattus norvegicus
agtcccacaagcacacaaacatagt

SEQ ID NO: 157992 - DNA, 25 bp, Rattus norvegicus
agtcccacaagctcacaaacatagt

SEQ ID NO: 157993 - DNA, 25 bp, Rattus norvegicus
agtcccacatctaccttacatgtaa

SEQ ID NO: 157994 - DNA, 25 bp, Rattus norvegicus
agtcccacatcttccttacatgtaa

SEQ ID NO: 157995 - DNA, 25 bp, Rattus norvegicus
agtcccaccacaatccagtttggaa

SEQ ID NO: 157996 - DNA, 25 bp, Rattus norvegicus
agtcccaccacattccagtttggaa

SEQ ID NO: 157997 - DNA, 25 bp, Rattus norvegicus
agtcccaccaggcagcatctgagga

SEQ ID NO: 157998 - DNA, 25 bp, Rattus norvegicus
agtcccaccagggagcatctgagga

SEQ ID NO: 157999 - DNA, 25 bp, Rattus norvegicus
agtcccacccaacatgtcagaggat

SEQ ID NO: 158000 - DNA, 25 bp, Rattus norvegicus
agtcccacccaactagcaagtttag

SEQ ID NO: 158001 - DNA, 25 bp, Rattus norvegicus
agtcccacccaagatgtcagaggat

SEQ ID NO: 158002 - DNA, 25 bp, Rattus norvegicus
agtcccacccaagtagcaagtttag

SEQ ID NO: 158003 - DNA, 25 bp, Rattus norvegicus
agtcccaccttgcagcatttatgta

SEQ ID NO: 158004 - DNA, 25 bp, Rattus norvegicus
agtcccaccttggagcatttatgta

SEQ ID NO: 158005 - DNA, 25 bp, Rattus norvegicus
agtcccacgcatcctgtttcaataa

SEQ ID NO: 158006 - DNA, 25 bp, Rattus norvegicus
agtcccacgcatgctgtttcaataa

SEQ ID NO: 158007 - DNA, 25 bp, Rattus norvegicus
agtcccagagcaagccctagaaatg

SEQ ID NO: 158008 - DNA, 25 bp, Rattus norvegicus
agtcccagagcatgccctagaaatg

SEQ ID NO: 158009 - DNA, 25 bp, Rattus norvegicus
agtcccagcagcattaattactcct

SEQ ID NO: 158010 - DNA, 25 bp, Rattus norvegicus
agtcccagcagctttaattactcct

SEQ ID NO: 158011 - DNA, 25 bp, Rattus norvegicus
agtcccagcctactttggtgctcaa

SEQ ID NO: 158012 - DNA, 25 bp, Rattus norvegicus
agtcccagcctagtttggtgctcaa

SEQ ID NO: 158013 - DNA, 25 bp, Rattus norvegicus
agtcccagcctgctctgaagctttg

SEQ ID NO: 158014 - DNA, 25 bp, Rattus norvegicus
agtcccagcctggtctgaagctttg

SEQ ID NO: 158015 - DNA, 25 bp, Rattus norvegicus
agtcccagctagacggtacacttgg

SEQ ID NO: 158016 - DNA, 25 bp, Rattus norvegicus
agtcccagctagtcggtacacttgg

SEQ ID NO: 158017 - DNA, 25 bp, Rattus norvegicus
agtcccagcttcagacaggtgttta

SEQ ID NO: 158018 - DNA, 25 bp, Rattus norvegicus
agtcccagcttctgacaggtgttta

SEQ ID NO: 158019 - DNA, 25 bp, Rattus norvegicus
agtcccaggagacccagtgtccttt

SEQ ID NO: 158020 - DNA, 25 bp, Rattus norvegicus
agtcccaggagagccagtgtccttt

SEQ ID NO: 158021 - DNA, 25 bp, Rattus norvegicus
agtcccaggatgctcccaagaaatg

SEQ ID NO: 158022 - DNA, 25 bp, Rattus norvegicus
agtcccaggatggtcccaagaaatg

SEQ ID NO: 158023 - DNA, 25 bp, Rattus norvegicus
agtcccagggtgagattttccgaca

SEQ ID NO: 158024 - DNA, 25 bp, Rattus norvegicus
agtcccagggtgtgattttccgaca

SEQ ID NO: 158025 - DNA, 25 bp, Rattus norvegicus
agtcccatactgcttgtgttggtca

SEQ ID NO: 158026 - DNA, 25 bp, Rattus norvegicus
agtcccatactggttgtgttggtca

SEQ ID NO: 158027 - DNA, 25 bp, Rattus norvegicus
agtcccatagacagtaagcccctgt

SEQ ID NO: 158028 - DNA, 25 bp, Rattus norvegicus
agtcccatagactgtaagcccctgt

SEQ ID NO: 158029 - DNA, 25 bp, Rattus norvegicus
agtcccatatttctgtactccaaga

SEQ ID NO: 158030 - DNA, 25 bp, Rattus norvegicus
agtcccatatttgtgtactccaaga

SEQ ID NO: 158031 - DNA, 25 bp, Rattus norvegicus
agtcccatcattacataaggttctt

SEQ ID NO: 158032 - DNA, 25 bp, Rattus norvegicus
agtcccatcatttcataaggttctt

SEQ ID NO: 158033 - DNA, 25 bp, Rattus norvegicus
agtcccatctggcatttattaaagg

SEQ ID NO: 158034 - DNA, 25 bp, Rattus norvegicus
agtcccatctgggatttattaaagg

SEQ ID NO: 158035 - DNA, 25 bp, Rattus norvegicus
agtcccatcttcagcacaggcaaaa

SEQ ID NO: 158036 - DNA, 25 bp, Rattus norvegicus
agtcccatcttctgcacaggcaaaa

SEQ ID NO: 158037 - DNA, 25 bp, Rattus norvegicus
agtcccatgacccttcttgtaaagg

SEQ ID NO: 158038 - DNA, 25 bp, Rattus norvegicus
agtcccatgaccgttcttgtaaagg

SEQ ID NO: 158039 - DNA, 25 bp, Rattus norvegicus
agtcccatggctactctttttctat

SEQ ID NO: 158040 - DNA, 25 bp, Rattus norvegicus
agtcccatggcttctctttttctat

SEQ ID NO: 158041 - DNA, 25 bp, Rattus norvegicus
agtcccatgggcctggatgttcacc

SEQ ID NO: 158042 - DNA, 25 bp, Rattus norvegicus
agtcccatgggcgtggatgttcacc

SEQ ID NO: 158043 - DNA, 25 bp, Rattus norvegicus
agtcccatggttagtatgctcttgc

SEQ ID NO: 158044 - DNA, 25 bp, Rattus norvegicus
agtcccatggtttgtatgctcttgc

SEQ ID NO: 158045 - DNA, 25 bp, Rattus norvegicus
agtcccatgtccagtgaagcgttta

SEQ ID NO: 158046 - DNA, 25 bp, Rattus norvegicus
agtcccatgtcctgtgaagcgttta

SEQ ID NO: 158047 - DNA, 25 bp, Rattus norvegicus
agtcccatttgccttttctagcaaa

SEQ ID NO: 158048 - DNA, 25 bp, Rattus norvegicus
agtcccatttgcgttttctagcaaa

SEQ ID NO: 158049 - DNA, 25 bp, Rattus norvegicus
agtcccattttgaccaccgaataga

SEQ ID NO: 158050 - DNA, 25 bp, Rattus norvegicus
agtcccattttgagtgttgtgtgtc

SEQ ID NO: 158051 - DNA, 25 bp, Rattus norvegicus
agtcccattttgtccaccgaataga

SEQ ID NO: 158052 - DNA, 25 bp, Rattus norvegicus
agtcccattttgtgtgttgtgtgtc

SEQ ID NO: 158053 - DNA, 25 bp, Rattus norvegicus
agtccccaaactatgaatacactag

SEQ ID NO: 158054 - DNA, 25 bp, Rattus norvegicus
agtccccaaactttgaatacactag

SEQ ID NO: 158055 - DNA, 25 bp, Rattus norvegicus
agtccccaaggcctttaagcagaag

SEQ ID NO: 158056 - DNA, 25 bp, Rattus norvegicus
agtccccaaggcgtttaagcagaag

SEQ ID NO: 158057 - DNA, 25 bp, Rattus norvegicus
agtccccagaggagacacgtaggaa

SEQ ID NO: 158058 - DNA, 25 bp, Rattus norvegicus
agtccccagaggtgacacgtaggaa

SEQ ID NO: 158059 - DNA, 25 bp, Rattus norvegicus
agtccccagcagactgttttcagaa

SEQ ID NO: 158060 - DNA, 25 bp, Rattus norvegicus
agtccccagcagtctgttttcagaa

SEQ ID NO: 158061 - DNA, 25 bp, Rattus norvegicus
agtccccagcccaagaagagtgtca

SEQ ID NO: 158062 - DNA, 25 bp, Rattus norvegicus
agtccccagccctagaagagtgtca

SEQ ID NO: 158063 - DNA, 25 bp, Rattus norvegicus
agtccccagcgcagatctgaaaatg

SEQ ID NO: 158064 - DNA, 25 bp, Rattus norvegicus
agtccccagcgctgatctgaaaatg

SEQ ID NO: 158065 - DNA, 25 bp, Rattus norvegicus
agtccccagctgagactgtgtttgg

SEQ ID NO: 158066 - DNA, 25 bp, Rattus norvegicus
agtccccagctgtgactgtgtttgg

SEQ ID NO: 158067 - DNA, 25 bp, Rattus norvegicus
agtccccagggaatgccgcagcatc

SEQ ID NO: 158068 - DNA, 25 bp, Rattus norvegicus
agtccccagggattgccgcagcatc

SEQ ID NO: 158069 - DNA, 25 bp, Rattus norvegicus
agtccccagttcatgagcagttcct

SEQ ID NO: 158070 - DNA, 25 bp, Rattus norvegicus
agtccccagttcttgagcagttcct

SEQ ID NO: 158071 - DNA, 25 bp, Rattus norvegicus
agtccccagtttcaaagcagtctct

SEQ ID NO: 158072 - DNA, 25 bp, Rattus norvegicus
agtccccagtttgaaagcagtctct

SEQ ID NO: 158073 - DNA, 25 bp, Rattus norvegicus
agtccccatcctagtgtgttcattt

SEQ ID NO: 158074 - DNA, 25 bp, Rattus norvegicus
agtccccatccttgtgtgttcattt

SEQ ID NO: 158075 - DNA, 25 bp, Rattus norvegicus
agtccccatctcctagtgaggtggt

SEQ ID NO: 158076 - DNA, 25 bp, Rattus norvegicus
agtccccatctcgtagtgaggtggt

SEQ ID NO: 158077 - DNA, 25 bp, Rattus norvegicus
agtccccatgataaccttctaacta

SEQ ID NO: 158078 - DNA, 25 bp, Rattus norvegicus
agtccccatgattaccttctaacta

SEQ ID NO: 158079 - DNA, 25 bp, Rattus norvegicus
agtccccatttcatcttgtcatatg

SEQ ID NO: 158080 - DNA, 25 bp, Rattus norvegicus
agtccccatttcttcttgtcatatg

SEQ ID NO: 158081 - DNA, 25 bp, Rattus norvegicus
agtccccgggctatgtgagctggtc

SEQ ID NO: 158082 - DNA, 25 bp, Rattus norvegicus
agtccccgggctttgtgagctggtc

SEQ ID NO: 158083 - DNA, 25 bp, Rattus norvegicus
agtccccgtaaaacagttctcaaga

SEQ ID NO: 158084 - DNA, 25 bp, Rattus norvegicus
agtccccgtaaatcagttctcaaga

SEQ ID NO: 158085 - DNA, 25 bp, Rattus norvegicus
agtcccctcaagctggtcaaggcaa

SEQ ID NO: 158086 - DNA, 25 bp, Rattus norvegicus
agtcccctcaaggtggtcaaggcaa

SEQ ID NO: 158087 - DNA, 25 bp, Rattus norvegicus
agtcccctcagcacaggttgtaaga

SEQ ID NO: 158088 - DNA, 25 bp, Rattus norvegicus
agtcccctcagctcaggttgtaaga

SEQ ID NO: 158089 - DNA, 25 bp, Rattus norvegicus
agtcccctcatgatatccaggacag

SEQ ID NO: 158090 - DNA, 25 bp, Rattus norvegicus
agtcccctcatgttatccaggacag

SEQ ID NO: 158091 - DNA, 25 bp, Rattus norvegicus
agtcccctctgactccagtgttagc

SEQ ID NO: 158092 - DNA, 25 bp, Rattus norvegicus
agtcccctctgagtccagtgttagc

SEQ ID NO: 158093 - DNA, 25 bp, Rattus norvegicus
agtcccctggaaatgtatcttgaac

SEQ ID NO: 158094 - DNA, 25 bp, Rattus norvegicus
agtcccctggaattgtatcttgaac

SEQ ID NO: 158095 - DNA, 25 bp, Rattus norvegicus
agtcccctggccatggaatatgtta

SEQ ID NO: 158096 - DNA, 25 bp, Rattus norvegicus
agtcccctggccttggaatatgtta

SEQ ID NO: 158097 - DNA, 25 bp, Rattus norvegicus
agtcccctgtccaggtcaggatcta

SEQ ID NO: 158098 - DNA, 25 bp, Rattus norvegicus
agtcccctgtcctggtcaggatcta

SEQ ID NO: 158099 - DNA, 25 bp, Rattus norvegicus
agtcccctgtggaagagcttgtaga

SEQ ID NO: 158100 - DNA, 25 bp, Rattus norvegicus
agtcccctgtggtagagcttgtaga

SEQ ID NO: 158101 - DNA, 25 bp, Rattus norvegicus
agtccccttctcagatggccaaatg

SEQ ID NO: 158102 - DNA, 25 bp, Rattus norvegicus
agtccccttctctgatggccaaatg

SEQ ID NO: 158103 - DNA, 25 bp, Rattus norvegicus
agtccccttgtgcttttggtaaatg

SEQ ID NO: 158104 - DNA, 25 bp, Rattus norvegicus
agtccccttgtggttttggtaaatg

SEQ ID NO: 158105 - DNA, 25 bp, Rattus norvegicus
agtcccctttacaccatcttgtgga

SEQ ID NO: 158106 - DNA, 25 bp, Rattus norvegicus
agtcccctttactccatcttgtgga

SEQ ID NO: 158107 - DNA, 25 bp, Rattus norvegicus
agtcccctttccaggattagtcaca

SEQ ID NO: 158108 - DNA, 25 bp, Rattus norvegicus
agtcccctttcctggattagtcaca

SEQ ID NO: 158109 - DNA, 25 bp, Rattus norvegicus
agtcccgaaaagaccttgcagtagt

SEQ ID NO: 158110 - DNA, 25 bp, Rattus norvegicus
agtcccgaaaagtccttgcagtagt

SEQ ID NO: 158111 - DNA, 25 bp, Rattus norvegicus
agtcccgatatgcatgtcacctgtc

SEQ ID NO: 158112 - DNA, 25 bp, Rattus norvegicus
agtcccgatatggatgtcacctgtc

SEQ ID NO: 158113 - DNA, 25 bp, Rattus norvegicus
agtcccgcatcgaggagcaggagaa

SEQ ID NO: 158114 - DNA, 25 bp, Rattus norvegicus
agtcccgcatcgtggagcaggagaa

SEQ ID NO: 158115 - DNA, 25 bp, Rattus norvegicus
agtcccggagatctgcaacgcacga

SEQ ID NO: 158116 - DNA, 25 bp, Rattus norvegicus
agtcccggagatgtgcaacgcacga

SEQ ID NO: 158117 - DNA, 25 bp, Rattus norvegicus
agtcccggcaaaatcatctctttta

SEQ ID NO: 158118 - DNA, 25 bp, Rattus norvegicus
agtcccggcaaattcatctctttta

SEQ ID NO: 158119 - DNA, 25 bp, Rattus norvegicus
agtcccggcgctctgacagatgcag

SEQ ID NO: 158120 - DNA, 25 bp, Rattus norvegicus
agtcccggcgctgtgacagatgcag

SEQ ID NO: 158121 - DNA, 25 bp, Rattus norvegicus
agtcccggtatcaaaaggccaactg

SEQ ID NO: 158122 - DNA, 25 bp, Rattus norvegicus
agtcccggtatctaaaggccaactg

SEQ ID NO: 158123 - DNA, 25 bp, Rattus norvegicus
agtcccggtcttcatttcttgatac

SEQ ID NO: 158124 - DNA, 25 bp, Rattus norvegicus
agtcccggtcttgatttcttgatac

SEQ ID NO: 158125 - DNA, 25 bp, Rattus norvegicus
agtcccgtcgctatgactggtgaag

SEQ ID NO: 158126 - DNA, 25 bp, Rattus norvegicus
agtcccgtcgctttgactggtgaag

SEQ ID NO: 158127 - DNA, 25 bp, Rattus norvegicus
agtcccgtgactcagggtgttagaa

SEQ ID NO: 158128 - DNA, 25 bp, Rattus norvegicus
agtcccgtgactgagggtgttagaa

SEQ ID NO: 158129 - DNA, 25 bp, Rattus norvegicus
agtcccgtgcgtcacagtgtgctga

SEQ ID NO: 158130 - DNA, 25 bp, Rattus norvegicus
agtcccgtgcgtgacagtgtgctga

SEQ ID NO: 158131 - DNA, 25 bp, Rattus norvegicus
agtcccgttgcccagagatggatga

SEQ ID NO: 158132 - DNA, 25 bp, Rattus norvegicus
agtcccgttgccgagagatggatga

SEQ ID NO: 158133 - DNA, 25 bp, Rattus norvegicus
agtcccgtttccatgtaggcaggtg

SEQ ID NO: 158134 - DNA, 25 bp, Rattus norvegicus
agtcccgtttccttgtaggcaggtg

SEQ ID NO: 158135 - DNA, 25 bp, Rattus norvegicus
agtccctagaaaagtttatgctcag

SEQ ID NO: 158136 - DNA, 25 bp, Rattus norvegicus
agtccctagaaatgtttatgctcag

SEQ ID NO: 158137 - DNA, 25 bp, Rattus norvegicus
agtccctagggcaatatctgttatg

SEQ ID NO: 158138 - DNA, 25 bp, Rattus norvegicus
agtccctagggcaggattcactgtc

SEQ ID NO: 158139 - DNA, 25 bp, Rattus norvegicus
agtccctagggctatatctgttatg

SEQ ID NO: 158140 - DNA, 25 bp, Rattus norvegicus
agtccctagggctggattcactgtc

SEQ ID NO: 158141 - DNA, 25 bp, Rattus norvegicus
agtccctagggtactgtagcctctc

SEQ ID NO: 158142 - DNA, 25 bp, Rattus norvegicus
agtccctagggttctgtagcctctc

SEQ ID NO: 158143 - DNA, 25 bp, Rattus norvegicus
agtccctatctccattctgtggtga

SEQ ID NO: 158144 - DNA, 25 bp, Rattus norvegicus
agtccctatctcgattctgtggtga

SEQ ID NO: 158145 - DNA, 25 bp, Rattus norvegicus
agtccctatgcacacattagctttt

SEQ ID NO: 158146 - DNA, 25 bp, Rattus norvegicus
agtccctatgcagacattagctttt

SEQ ID NO: 158147 - DNA, 25 bp, Rattus norvegicus
agtccctcacaccatctgtggatca

SEQ ID NO: 158148 - DNA, 25 bp, Rattus norvegicus
agtccctcacacgatctgtggatca

SEQ ID NO: 158149 - DNA, 25 bp, Rattus norvegicus
agtccctcagagctggaagtttgag

SEQ ID NO: 158150 - DNA, 25 bp, Rattus norvegicus
agtccctcagaggtggaagtttgag

SEQ ID NO: 158151 - DNA, 25 bp, Rattus norvegicus
agtccctcagtacttggtaaccaga

SEQ ID NO: 158152 - DNA, 25 bp, Rattus norvegicus
agtccctcagtagttggtaaccaga

SEQ ID NO: 158153 - DNA, 25 bp, Rattus norvegicus
agtccctccctaagattggcagtca

SEQ ID NO: 158154 - DNA, 25 bp, Rattus norvegicus
agtccctccctatgattggcagtca

SEQ ID NO: 158155 - DNA, 25 bp, Rattus norvegicus
agtccctcctgaaagtgtgtgccca

SEQ ID NO: 158156 - DNA, 25 bp, Rattus norvegicus
agtccctcctgatagtgtgtgccca

SEQ ID NO: 158157 - DNA, 25 bp, Rattus norvegicus
agtccctccttgagtgtatcctgtg

SEQ ID NO: 158158 - DNA, 25 bp, Rattus norvegicus
agtccctccttgtgtgtatcctgtg

SEQ ID NO: 158159 - DNA, 25 bp, Rattus norvegicus
agtccctcgattctattgacagcca

SEQ ID NO: 158160 - DNA, 25 bp, Rattus norvegicus
agtccctcgattgtattgacagcca

SEQ ID NO: 158161 - DNA, 25 bp, Rattus norvegicus
agtccctcggagagaccaggtcaga

SEQ ID NO: 158162 - DNA, 25 bp, Rattus norvegicus
agtccctcggagtgaccaggtcaga

SEQ ID NO: 158163 - DNA, 25 bp, Rattus norvegicus
agtccctctgaacctggctgctggg

SEQ ID NO: 158164 - DNA, 25 bp, Rattus norvegicus
agtccctctgaagctggctgctggg

SEQ ID NO: 158165 - DNA, 25 bp, Rattus norvegicus
agtccctgacatcgtccacatagtg

SEQ ID NO: 158166 - DNA, 25 bp, Rattus norvegicus
agtccctgacatggtccacatagtg

SEQ ID NO: 158167 - DNA, 25 bp, Rattus norvegicus
agtccctgagacacatttcctaact

SEQ ID NO: 158168 - DNA, 25 bp, Rattus norvegicus
agtccctgagactcatttcctaact

SEQ ID NO: 158169 - DNA, 25 bp, Rattus norvegicus
agtccctgaggacattgaggtctta

SEQ ID NO: 158170 - DNA, 25 bp, Rattus norvegicus
agtccctgaggagattgaggtctta

SEQ ID NO: 158171 - DNA, 25 bp, Rattus norvegicus
agtccctgatggctgtgctttttgc

SEQ ID NO: 158172 - DNA, 25 bp, Rattus norvegicus
agtccctgatgggtgtgctttttgc

SEQ ID NO: 158173 - DNA, 25 bp, Rattus norvegicus
agtccctgattgctgttttccagaa

SEQ ID NO: 158174 - DNA, 25 bp, Rattus norvegicus
agtccctgattggtgttttccagaa

SEQ ID NO: 158175 - DNA, 25 bp, Rattus norvegicus
agtccctgcagaagccaaccaaggt

SEQ ID NO: 158176 - DNA, 25 bp, Rattus norvegicus
agtccctgcagatgccaaccaaggt

SEQ ID NO: 158177 - DNA, 25 bp, Rattus norvegicus
agtccctgccccattgatgagtcat

SEQ ID NO: 158178 - DNA, 25 bp, Rattus norvegicus
agtccctgcccctttgatgagtcat

SEQ ID NO: 158179 - DNA, 25 bp, Rattus norvegicus
agtccctgctctacatgctggagaa

SEQ ID NO: 158180 - DNA, 25 bp, Rattus norvegicus
agtccctgctcttcatgctggagaa

SEQ ID NO: 158181 - DNA, 25 bp, Rattus norvegicus
agtccctgggaccaggatcagtgaa

SEQ ID NO: 158182 - DNA, 25 bp, Rattus norvegicus
agtccctgggacgaggatcagtgaa

SEQ ID NO: 158183 - DNA, 25 bp, Rattus norvegicus
agtccctggtcacagaatcacatca

SEQ ID NO: 158184 - DNA, 25 bp, Rattus norvegicus
agtccctggtcagagaatcacatca

SEQ ID NO: 158185 - DNA, 25 bp, Rattus norvegicus
agtccctgtgatctggctaaagccc

SEQ ID NO: 158186 - DNA, 25 bp, Rattus norvegicus
agtccctgtgatgtggctaaagccc

SEQ ID NO: 158187 - DNA, 25 bp, Rattus norvegicus
agtccctgtgccaataaaccttaga

SEQ ID NO: 158188 - DNA, 25 bp, Rattus norvegicus
agtccctgtgcctataaaccttaga

SEQ ID NO: 158189 - DNA, 25 bp, Rattus norvegicus
agtccctgtgctaattgttgctaac

SEQ ID NO: 158190 - DNA, 25 bp, Rattus norvegicus
agtccctgtgcttattgttgctaac

SEQ ID NO: 158191 - DNA, 25 bp, Rattus norvegicus
agtcccttcaggaagttagcagcct

SEQ ID NO: 158192 - DNA, 25 bp, Rattus norvegicus
agtcccttcaggtagttagcagcct

SEQ ID NO: 158193 - DNA, 25 bp, Rattus norvegicus
agtcccttccttcttcgatgatgca

SEQ ID NO: 158194 - DNA, 25 bp, Rattus norvegicus
agtcccttccttgttcgatgatgca

SEQ ID NO: 158195 - DNA, 25 bp, Rattus norvegicus
agtcccttgccacaacgttggagat

SEQ ID NO: 158196 - DNA, 25 bp, Rattus norvegicus
agtcccttgccagaacgttggagat

SEQ ID NO: 158197 - DNA, 25 bp, Rattus norvegicus
agtcccttgggacttgtggtctcat

SEQ ID NO: 158198 - DNA, 25 bp, Rattus norvegicus
agtcccttgggagttgtggtctcat

SEQ ID NO: 158199 - DNA, 25 bp, Rattus norvegicus
agtcccttggtacatgacctcattc

SEQ ID NO: 158200 - DNA, 25 bp, Rattus norvegicus
agtcccttggtagatgacctcattc

SEQ ID NO: 158201 - DNA, 25 bp, Rattus norvegicus
agtcccttgtcacttctaacatttt

SEQ ID NO: 158202 - DNA, 25 bp, Rattus norvegicus
agtcccttgtcagttctaacatttt

SEQ ID NO: 158203 - DNA, 25 bp, Rattus norvegicus
agtcccttgttcctgttctgaagtg

SEQ ID NO: 158204 - DNA, 25 bp, Rattus norvegicus
agtcccttgttcgtgttctgaagtg

SEQ ID NO: 158205 - DNA, 25 bp, Rattus norvegicus
agtccctttaaaagtgtgcctatcc

SEQ ID NO: 158206 - DNA, 25 bp, Rattus norvegicus
agtccctttaaatgtgtgcctatcc

SEQ ID NO: 158207 - DNA, 25 bp, Rattus norvegicus
agtccctttcatacttaatctcttc

SEQ ID NO: 158208 - DNA, 25 bp, Rattus norvegicus
agtccctttcattcttaatctcttc

SEQ ID NO: 158209 - DNA, 25 bp, Rattus norvegicus
agtccctttcttctctgtgtatagg

SEQ ID NO: 158210 - DNA, 25 bp, Rattus norvegicus
agtccctttcttgtctgtgtatagg

SEQ ID NO: 158211 - DNA, 25 bp, Rattus norvegicus
agtccctttgaacctctgtgcaggg

SEQ ID NO: 158212 - DNA, 25 bp, Rattus norvegicus
agtccctttgaagctctgtgcaggg

SEQ ID NO: 158213 - DNA, 25 bp, Rattus norvegicus
agtccgaagcccaacctaggtggag

SEQ ID NO: 158214 - DNA, 25 bp, Rattus norvegicus
agtccgaagccctacctaggtggag

SEQ ID NO: 158215 - DNA, 25 bp, Rattus norvegicus
agtccgacgtgtctctctccttggg

SEQ ID NO: 158216 - DNA, 25 bp, Rattus norvegicus
agtccgacgtgtgtctctccttggg

SEQ ID NO: 158217 - DNA, 25 bp, Rattus norvegicus
agtccgactgctagtatgtgccatg

SEQ ID NO: 158218 - DNA, 25 bp, Rattus norvegicus
agtccgactgcttgtatgtgccatg

SEQ ID NO: 158219 - DNA, 25 bp, Rattus norvegicus
agtccgaggtatcacgcggctccgg

SEQ ID NO: 158220 - DNA, 25 bp, Rattus norvegicus
agtccgaggtatgacgcggctccgg

SEQ ID NO: 158221 - DNA, 25 bp, Rattus norvegicus
agtccgatgtttctcactagtttcc

SEQ ID NO: 158222 - DNA, 25 bp, Rattus norvegicus
agtccgatgtttgtcactagtttcc

SEQ ID NO: 158223 - DNA, 25 bp, Rattus norvegicus
agtccgcagaggactatctgttagc

SEQ ID NO: 158224 - DNA, 25 bp, Rattus norvegicus
agtccgcagaggacttgatgttagc

SEQ ID NO: 158225 - DNA, 25 bp, Rattus norvegicus
agtccgcagaggtctatctgttagc

SEQ ID NO: 158226 - DNA, 25 bp, Rattus norvegicus
agtccgcagaggtcttgatgttagc

SEQ ID NO: 158227 - DNA, 25 bp, Rattus norvegicus
agtccgcagccaataaagtcggtga

SEQ ID NO: 158228 - DNA, 25 bp, Rattus norvegicus
agtccgcagccattaaagtcggtga

SEQ ID NO: 158229 - DNA, 25 bp, Rattus norvegicus
agtccgcatgctagctgcacaaagg

SEQ ID NO: 158230 - DNA, 25 bp, Rattus norvegicus
agtccgcatgcttgctgcacaaagg

SEQ ID NO: 158231 - DNA, 25 bp, Rattus norvegicus
agtccgcggtgtccttggaaagaca

SEQ ID NO: 158232 - DNA, 25 bp, Rattus norvegicus
agtccgcggtgtgcttggaaagaca

SEQ ID NO: 158233 - DNA, 25 bp, Rattus norvegicus
agtccgctcgttctgacaggtgtaa

SEQ ID NO: 158234 - DNA, 25 bp, Rattus norvegicus
agtccgctcgttgtgacaggtgtaa

SEQ ID NO: 158235 - DNA, 25 bp, Rattus norvegicus
agtccgcttcagatcctgatctgag

SEQ ID NO: 158236 - DNA, 25 bp, Rattus norvegicus
agtccgcttcagttcctgatctgag

SEQ ID NO: 158237 - DNA, 25 bp, Rattus norvegicus
agtccggaaacactcagaccaggct

SEQ ID NO: 158238 - DNA, 25 bp, Rattus norvegicus
agtccggaaacagtcagaccaggct

SEQ ID NO: 158239 - DNA, 25 bp, Rattus norvegicus
agtccggaccgcagggactcagcct

SEQ ID NO: 158240 - DNA, 25 bp, Rattus norvegicus
agtccggaccgctgggactcagcct

SEQ ID NO: 158241 - DNA, 25 bp, Rattus norvegicus
agtccggagtgcacaggagccagta

SEQ ID NO: 158242 - DNA, 25 bp, Rattus norvegicus
agtccggagtgctcaggagccagta

SEQ ID NO: 158243 - DNA, 25 bp, Rattus norvegicus
agtccggattgtccggctgttgctt

SEQ ID NO: 158244 - DNA, 25 bp, Rattus norvegicus
agtccggattgtgcggctgttgctt

SEQ ID NO: 158245 - DNA, 25 bp, Rattus norvegicus
agtccggcctagacacatggttttc

SEQ ID NO: 158246 - DNA, 25 bp, Rattus norvegicus
agtccggcctagtcacatggttttc

SEQ ID NO: 158247 - DNA, 25 bp, Rattus norvegicus
agtccggcctgacactctgggacca

SEQ ID NO: 158248 - DNA, 25 bp, Rattus norvegicus
agtccggcctgagactctgggacca

SEQ ID NO: 158249 - DNA, 25 bp, Rattus norvegicus
agtccggctcaaattacgtggcttg

SEQ ID NO: 158250 - DNA, 25 bp, Rattus norvegicus
agtccggctcaatttacgtggcttg

SEQ ID NO: 158251 - DNA, 25 bp, Rattus norvegicus
agtccggctgatattgctttaccac

SEQ ID NO: 158252 - DNA, 25 bp, Rattus norvegicus
agtccggctgattttgctttaccac

SEQ ID NO: 158253 - DNA, 25 bp, Rattus norvegicus
agtccggctgctctgaagagtgtta

SEQ ID NO: 158254 - DNA, 25 bp, Rattus norvegicus
agtccggctgctgtgaagagtgtta

SEQ ID NO: 158255 - DNA, 25 bp, Rattus norvegicus
agtccgggcctgaatcagcgtctag

SEQ ID NO: 158256 - DNA, 25 bp, Rattus norvegicus
agtccgggcctgtatcagcgtctag

SEQ ID NO: 158257 - DNA, 25 bp, Rattus norvegicus
agtccggtctcgatggctaggacag

SEQ ID NO: 158258 - DNA, 25 bp, Rattus norvegicus
agtccggtctcgttggctaggacag

SEQ ID NO: 158259 - DNA, 25 bp, Rattus norvegicus
agtccggtgtcaatcctgtaataac

SEQ ID NO: 158260 - DNA, 25 bp, Rattus norvegicus
agtccggtgtcattcctgtaataac

SEQ ID NO: 158261 - DNA, 25 bp, Rattus norvegicus
agtccggttcggaggtggtgcagac

SEQ ID NO: 158262 - DNA, 25 bp, Rattus norvegicus
agtccggttcggtggtggtgcagac

SEQ ID NO: 158263 - DNA, 25 bp, Rattus norvegicus
agtccggttctcagggaatcagtct

SEQ ID NO: 158264 - DNA, 25 bp, Rattus norvegicus
agtccggttctctgggaatcagtct

SEQ ID NO: 158265 - DNA, 25 bp, Rattus norvegicus
agtccgtaacgaagtttgcagcctc

SEQ ID NO: 158266 - DNA, 25 bp, Rattus norvegicus
agtccgtaacgatgtttgcagcctc

SEQ ID NO: 158267 - DNA, 25 bp, Rattus norvegicus
agtccgtaagcgacagagctgccca

SEQ ID NO: 158268 - DNA, 25 bp, Rattus norvegicus
agtccgtaagcgtcagagctgccca

SEQ ID NO: 158269 - DNA, 25 bp, Rattus norvegicus
agtccgtagcatcttgtctgtatgc

SEQ ID NO: 158270 - DNA, 25 bp, Rattus norvegicus
agtccgtagcatgttgtctgtatgc

SEQ ID NO: 158271 - DNA, 25 bp, Rattus norvegicus
agtccgtatctgcacttgcttatag

SEQ ID NO: 158272 - DNA, 25 bp, Rattus norvegicus
agtccgtatctggacttgcttatag

SEQ ID NO: 158273 - DNA, 25 bp, Rattus norvegicus
agtccgtcccggactatgagatgaa

SEQ ID NO: 158274 - DNA, 25 bp, Rattus norvegicus
agtccgtcccggtctatgagatgaa

SEQ ID NO: 158275 - DNA, 25 bp, Rattus norvegicus
agtccgtcctgacatgtttccagtg

SEQ ID NO: 158276 - DNA, 25 bp, Rattus norvegicus
agtccgtcctgagatgtttccagtg

SEQ ID NO: 158277 - DNA, 25 bp, Rattus norvegicus
agtccgtgatgcagtactcgtgaga

SEQ ID NO: 158278 - DNA, 25 bp, Rattus norvegicus
agtccgtgatgctgtactcgtgaga

SEQ ID NO: 158279 - DNA, 25 bp, Rattus norvegicus
agtccgtgcattacagcgcgcacag

SEQ ID NO: 158280 - DNA, 25 bp, Rattus norvegicus
agtccgtgcatttcagcgcgcacag

SEQ ID NO: 158281 - DNA, 25 bp, Rattus norvegicus
agtccgtgctccaatatttttcatt

SEQ ID NO: 158282 - DNA, 25 bp, Rattus norvegicus
agtccgtgctcctatatttttcatt

SEQ ID NO: 158283 - DNA, 25 bp, Rattus norvegicus
agtccgtgtggtatttatctttctg

SEQ ID NO: 158284 - DNA, 25 bp, Rattus norvegicus
agtccgtgtggtttttatctttctg

SEQ ID NO: 158285 - DNA, 25 bp, Rattus norvegicus
agtccgtgttttaacaaggttgcag

SEQ ID NO: 158286 - DNA, 25 bp, Rattus norvegicus
agtccgtgtttttacaaggttgcag

SEQ ID NO: 158287 - DNA, 25 bp, Rattus norvegicus
agtccgttccagatgctcgtggcaa

SEQ ID NO: 158288 - DNA, 25 bp, Rattus norvegicus
agtccgttccagttgctcgtggcaa

SEQ ID NO: 158289 - DNA, 25 bp, Rattus norvegicus
agtccgttctggaagcactaggtgt

SEQ ID NO: 158290 - DNA, 25 bp, Rattus norvegicus
agtccgttctggtagcactaggtgt

SEQ ID NO: 158291 - DNA, 25 bp, Rattus norvegicus
agtccgttgtggcatactattcaaa

SEQ ID NO: 158292 - DNA, 25 bp, Rattus norvegicus
agtccgttgtgggatactattcaaa

SEQ ID NO: 158293 - DNA, 25 bp, Rattus norvegicus
agtccgttgttaagacaccaccaaa

SEQ ID NO: 158294 - DNA, 25 bp, Rattus norvegicus
agtccgttgttatgacaccaccaaa

SEQ ID NO: 158295 - DNA, 25 bp, Rattus norvegicus
agtccgtttgacaggcagactgcct

SEQ ID NO: 158296 - DNA, 25 bp, Rattus norvegicus
agtccgtttgactggcagactgcct

SEQ ID NO: 158297 - DNA, 25 bp, Rattus norvegicus
agtcctaaagtcctgggtaccatag

SEQ ID NO: 158298 - DNA, 25 bp, Rattus norvegicus
agtcctaaagtcgtgggtaccatag

SEQ ID NO: 158299 - DNA, 25 bp, Rattus norvegicus
agtcctaacactccgattccttttg

SEQ ID NO: 158300 - DNA, 25 bp, Rattus norvegicus
agtcctaacactgcgattccttttg

SEQ ID NO: 158301 - DNA, 25 bp, Rattus norvegicus
agtcctaacctcaatttatattatg

SEQ ID NO: 158302 - DNA, 25 bp, Rattus norvegicus
agtcctaacctctatttatattatg

SEQ ID NO: 158303 - DNA, 25 bp, Rattus norvegicus
agtcctaaggagcagaccctgtcac

SEQ ID NO: 158304 - DNA, 25 bp, Rattus norvegicus
agtcctaaggaggagaccctgtcac

SEQ ID NO: 158305 - DNA, 25 bp, Rattus norvegicus
agtcctaaggtaacgcctgctctgt

SEQ ID NO: 158306 - DNA, 25 bp, Rattus norvegicus
agtcctaaggtatcgcctgctctgt

SEQ ID NO: 158307 - DNA, 25 bp, Rattus norvegicus
agtcctaagtggaggtggctatctc

SEQ ID NO: 158308 - DNA, 25 bp, Rattus norvegicus
agtcctaagtggtggtggctatctc

SEQ ID NO: 158309 - DNA, 25 bp, Rattus norvegicus
agtcctaagtttatgatgccagcct

SEQ ID NO: 158310 - DNA, 25 bp, Rattus norvegicus
agtcctaagtttttgatgccagcct

SEQ ID NO: 158311 - DNA, 25 bp, Rattus norvegicus
agtcctacaaatctccagtggtggg

SEQ ID NO: 158312 - DNA, 25 bp, Rattus norvegicus
agtcctacaaatgtccagtggtggg

SEQ ID NO: 158313 - DNA, 25 bp, Rattus norvegicus
agtcctacaaggaggcttgcatcag

SEQ ID NO: 158314 - DNA, 25 bp, Rattus norvegicus
agtcctacaaggtggcttgcatcag

SEQ ID NO: 158315 - DNA, 25 bp, Rattus norvegicus
agtcctacgctgctgctaacgacaa

SEQ ID NO: 158316 - DNA, 25 bp, Rattus norvegicus
agtcctacgctggtgctaacgacaa

SEQ ID NO: 158317 - DNA, 25 bp, Rattus norvegicus
agtcctacggacagcagttttttga

SEQ ID NO: 158318 - DNA, 25 bp, Rattus norvegicus
agtcctacggactgcagttttttga

SEQ ID NO: 158319 - DNA, 25 bp, Rattus norvegicus
agtcctactcggctccacagattga

SEQ ID NO: 158320 - DNA, 25 bp, Rattus norvegicus
agtcctactcgggtccacagattga

SEQ ID NO: 158321 - DNA, 25 bp, Rattus norvegicus
agtcctactcttcggaatagcttcc

SEQ ID NO: 158322 - DNA, 25 bp, Rattus norvegicus
agtcctactcttgggaatagcttcc

SEQ ID NO: 158323 - DNA, 25 bp, Rattus norvegicus
agtcctactgctcggagcccctttt

SEQ ID NO: 158324 - DNA, 25 bp, Rattus norvegicus
agtcctactgctgggagcccctttt

SEQ ID NO: 158325 - DNA, 25 bp, Rattus norvegicus
agtcctacttccatcagcaaactaa

SEQ ID NO: 158326 - DNA, 25 bp, Rattus norvegicus
agtcctacttccttcagcaaactaa

SEQ ID NO: 158327 - DNA, 25 bp, Rattus norvegicus
agtcctactttgatgtactaaatgt

SEQ ID NO: 158328 - DNA, 25 bp, Rattus norvegicus
agtcctactttgttgtactaaatgt

SEQ ID NO: 158329 - DNA, 25 bp, Rattus norvegicus
agtcctagaactacttgcctatcaa

SEQ ID NO: 158330 - DNA, 25 bp, Rattus norvegicus
agtcctagaacttcttgcctatcaa

SEQ ID NO: 158331 - DNA, 25 bp, Rattus norvegicus
agtcctagaattacagctcccttgg

SEQ ID NO: 158332 - DNA, 25 bp, Rattus norvegicus
agtcctagaatttcagctcccttgg

SEQ ID NO: 158333 - DNA, 25 bp, Rattus norvegicus
agtcctagactcagagaggcgaagg

SEQ ID NO: 158334 - DNA, 25 bp, Rattus norvegicus
agtcctagactctgagaggcgaagg

SEQ ID NO: 158335 - DNA, 25 bp, Rattus norvegicus
agtcctagagtactggagtttacaa

SEQ ID NO: 158336 - DNA, 25 bp, Rattus norvegicus
agtcctagagtagtggagtttacaa

SEQ ID NO: 158337 - DNA, 25 bp, Rattus norvegicus
agtcctagcctgatgttcctggatg

SEQ ID NO: 158338 - DNA, 25 bp, Rattus norvegicus
agtcctagcctgttgttcctggatg

SEQ ID NO: 158339 - DNA, 25 bp, Rattus norvegicus
agtcctagctttctgcctgagtgac

SEQ ID NO: 158340 - DNA, 25 bp, Rattus norvegicus
agtcctagctttgtgcctgagtgac

SEQ ID NO: 158341 - DNA, 25 bp, Rattus norvegicus
agtcctatacctaagctgttaccgt

SEQ ID NO: 158342 - DNA, 25 bp, Rattus norvegicus
agtcctataccttagctgttaccgt

SEQ ID NO: 158343 - DNA, 25 bp, Rattus norvegicus
agtcctatccaacacctgggtcaag

SEQ ID NO: 158344 - DNA, 25 bp, Rattus norvegicus
agtcctatccaagacctgggtcaag

SEQ ID NO: 158345 - DNA, 25 bp, Rattus norvegicus
agtcctatcctgagaggtctaccag

SEQ ID NO: 158346 - DNA, 25 bp, Rattus norvegicus
agtcctatcctgtgaggtctaccag

SEQ ID NO: 158347 - DNA, 25 bp, Rattus norvegicus
agtcctatggaaaaccttctcattg

SEQ ID NO: 158348 - DNA, 25 bp, Rattus norvegicus
agtcctatggaataccttctcattg

SEQ ID NO: 158349 - DNA, 25 bp, Rattus norvegicus
agtcctattacaagccaaacattgc

SEQ ID NO: 158350 - DNA, 25 bp, Rattus norvegicus
agtcctattacatgccaaacattgc

SEQ ID NO: 158351 - DNA, 25 bp, Rattus norvegicus
agtcctatttctactttcagttcat

SEQ ID NO: 158352 - DNA, 25 bp, Rattus norvegicus
agtcctatttcttctttcagttcat

SEQ ID NO: 158353 - DNA, 25 bp, Rattus norvegicus
agtcctcaaaacagaactcacgcca

SEQ ID NO: 158354 - DNA, 25 bp, Rattus norvegicus
agtcctcaaaactgaactcacgcca

SEQ ID NO: 158355 - DNA, 25 bp, Rattus norvegicus
agtcctcaaaatcctgtgcctctta

SEQ ID NO: 158356 - DNA, 25 bp, Rattus norvegicus
agtcctcaaaatgctgtgcctctta

SEQ ID NO: 158357 - DNA, 25 bp, Rattus norvegicus
agtcctcaaagacttcttcgtgcgg

SEQ ID NO: 158358 - DNA, 25 bp, Rattus norvegicus
agtcctcaaagagttcttcgtgcgg

SEQ ID NO: 158359 - DNA, 25 bp, Rattus norvegicus
agtcctcaaagcctccaagaacttc

SEQ ID NO: 158360 - DNA, 25 bp, Rattus norvegicus
agtcctcaaagcgtccaagaacttc

SEQ ID NO: 158361 - DNA, 25 bp, Rattus norvegicus
agtcctcaaggcattgcttccagag

SEQ ID NO: 158362 - DNA, 25 bp, Rattus norvegicus
agtcctcaaggctttgcttccagag

SEQ ID NO: 158363 - DNA, 25 bp, Rattus norvegicus
agtcctcaagtgaccagtcttctga

SEQ ID NO: 158364 - DNA, 25 bp, Rattus norvegicus
agtcctcaagtgtccagtcttctga

SEQ ID NO: 158365 - DNA, 25 bp, Rattus norvegicus
agtcctcaatggacttatgtcagtg

SEQ ID NO: 158366 - DNA, 25 bp, Rattus norvegicus
agtcctcaatggtcttatgtcagtg

SEQ ID NO: 158367 - DNA, 25 bp, Rattus norvegicus
agtcctcacaggagaccttgctgag

SEQ ID NO: 158368 - DNA, 25 bp, Rattus norvegicus
agtcctcacaggtgaccttgctgag

SEQ ID NO: 158369 - DNA, 25 bp, Rattus norvegicus
agtcctcaccagctagatggcttga

SEQ ID NO: 158370 - DNA, 25 bp, Rattus norvegicus
agtcctcaccaggtagatggcttga

SEQ ID NO: 158371 - DNA, 25 bp, Rattus norvegicus
agtcctcagcccactgggttgtgtc

SEQ ID NO: 158372 - DNA, 25 bp, Rattus norvegicus
agtcctcagccctctgggttgtgtc

SEQ ID NO: 158373 - DNA, 25 bp, Rattus norvegicus
agtcctcagctaaagttcctggagt

SEQ ID NO: 158374 - DNA, 25 bp, Rattus norvegicus
agtcctcagctatagttcctggagt

SEQ ID NO: 158375 - DNA, 25 bp, Rattus norvegicus
agtcctcaggaccaaactagggcca

SEQ ID NO: 158376 - DNA, 25 bp, Rattus norvegicus
agtcctcaggacgaaactagggcca

SEQ ID NO: 158377 - DNA, 25 bp, Rattus norvegicus
agtcctcaggtcaaatctcagtaaa

SEQ ID NO: 158378 - DNA, 25 bp, Rattus norvegicus
agtcctcaggtctaatctcagtaaa

SEQ ID NO: 158379 - DNA, 25 bp, Rattus norvegicus
agtcctcaggttcagcaagtcctga

SEQ ID NO: 158380 - DNA, 25 bp, Rattus norvegicus
agtcctcaggttgagcaagtcctga

SEQ ID NO: 158381 - DNA, 25 bp, Rattus norvegicus
agtcctcagtaccaggcgaccgaaa

SEQ ID NO: 158382 - DNA, 25 bp, Rattus norvegicus
agtcctcagtacgaggcgaccgaaa

SEQ ID NO: 158383 - DNA, 25 bp, Rattus norvegicus
agtcctcatcgaatacccttaatga

SEQ ID NO: 158384 - DNA, 25 bp, Rattus norvegicus
agtcctcatcgattacccttaatga

SEQ ID NO: 158385 - DNA, 25 bp, Rattus norvegicus
agtcctccaaggcttcgagtccatg

SEQ ID NO: 158386 - DNA, 25 bp, Rattus norvegicus
agtcctccaagggttcgagtccatg

SEQ ID NO: 158387 - DNA, 25 bp, Rattus norvegicus
agtcctccagagcagtttactgctg

SEQ ID NO: 158388 - DNA, 25 bp, Rattus norvegicus
agtcctccagaggagtttactgctg

SEQ ID NO: 158389 - DNA, 25 bp, Rattus norvegicus
agtcctccataacaactggttccaa

SEQ ID NO: 158390 - DNA, 25 bp, Rattus norvegicus
agtcctccataagaactggttccaa

SEQ ID NO: 158391 - DNA, 25 bp, Rattus norvegicus
agtcctcccctcctggtaagataga

SEQ ID NO: 158392 - DNA, 25 bp, Rattus norvegicus
agtcctcccctcgtggtaagataga

SEQ ID NO: 158393 - DNA, 25 bp, Rattus norvegicus
agtcctcccgagagccaatttaggc

SEQ ID NO: 158394 - DNA, 25 bp, Rattus norvegicus
agtcctcccgagtgccaatttaggc

SEQ ID NO: 158395 - DNA, 25 bp, Rattus norvegicus
agtcctccgaaaccctggcgagtgg

SEQ ID NO: 158396 - DNA, 25 bp, Rattus norvegicus
agtcctccgaaagcctggcgagtgg

SEQ ID NO: 158397 - DNA, 25 bp, Rattus norvegicus
agtcctccgtagacatgtgcctgtc

SEQ ID NO: 158398 - DNA, 25 bp, Rattus norvegicus
agtcctccgtagtcatgtgcctgtc

SEQ ID NO: 158399 - DNA, 25 bp, Rattus norvegicus
agtcctccgtgaacttcaacctgag

SEQ ID NO: 158400 - DNA, 25 bp, Rattus norvegicus
agtcctccgtgatcttcaacctgag

SEQ ID NO: 158401 - DNA, 25 bp, Rattus norvegicus
agtcctcctcatcgagaagcaaaag

SEQ ID NO: 158402 - DNA, 25 bp, Rattus norvegicus
agtcctcctcatcgagagctgtatg

SEQ ID NO: 158403 - DNA, 25 bp, Rattus norvegicus
agtcctcctcatggagaagcaaaag

SEQ ID NO: 158404 - DNA, 25 bp, Rattus norvegicus
agtcctcctcatggagagctgtatg

SEQ ID NO: 158405 - DNA, 25 bp, Rattus norvegicus
agtcctcgctcactgctgttgtgaa

SEQ ID NO: 158406 - DNA, 25 bp, Rattus norvegicus
agtcctcgctcagtgctgttgtgaa

SEQ ID NO: 158407 - DNA, 25 bp, Rattus norvegicus
agtcctcggaatcatggcggtagcc

SEQ ID NO: 158408 - DNA, 25 bp, Rattus norvegicus
agtcctcggaatgatggcggtagcc

SEQ ID NO: 158409 - DNA, 25 bp, Rattus norvegicus
agtcctctagcactctggaacccaa

SEQ ID NO: 158410 - DNA, 25 bp, Rattus norvegicus
agtcctctagcagtctggaacccaa

SEQ ID NO: 158411 - DNA, 25 bp, Rattus norvegicus
agtcctctagtgagaaatgctgggt

SEQ ID NO: 158412 - DNA, 25 bp, Rattus norvegicus
agtcctctagtgtgaaatgctgggt

SEQ ID NO: 158413 - DNA, 25 bp, Rattus norvegicus
agtcctctcagaaatcattccggca

SEQ ID NO: 158414 - DNA, 25 bp, Rattus norvegicus
agtcctctcagatatcattccggca

SEQ ID NO: 158415 - DNA, 25 bp, Rattus norvegicus
agtcctctccctagtaggcgatggt

SEQ ID NO: 158416 - DNA, 25 bp, Rattus norvegicus
agtcctctcccttgtaggcgatggt

SEQ ID NO: 158417 - DNA, 25 bp, Rattus norvegicus
agtcctctctcgagaactgagggcc

SEQ ID NO: 158418 - DNA, 25 bp, Rattus norvegicus
agtcctctctcgtgaactgagggcc

SEQ ID NO: 158419 - DNA, 25 bp, Rattus norvegicus
agtcctctctctcgaactgtgtgag

SEQ ID NO: 158420 - DNA, 25 bp, Rattus norvegicus
agtcctctctctggaactgtgtgag

SEQ ID NO: 158421 - DNA, 25 bp, Rattus norvegicus
agtcctctctttccactatgtgggt

SEQ ID NO: 158422 - DNA, 25 bp, Rattus norvegicus
agtcctctctttgcactatgtgggt

SEQ ID NO: 158423 - DNA, 25 bp, Rattus norvegicus
agtcctctggagatagcttaccctg

SEQ ID NO: 158424 - DNA, 25 bp, Rattus norvegicus
agtcctctggagttagcttaccctg

SEQ ID NO: 158425 - DNA, 25 bp, Rattus norvegicus
agtcctctgggcaggtcatataaaa

SEQ ID NO: 158426 - DNA, 25 bp, Rattus norvegicus
agtcctctgggctggtcatataaaa

SEQ ID NO: 158427 - DNA, 25 bp, Rattus norvegicus
agtcctctgggtcggaaagctgacc

SEQ ID NO: 158428 - DNA, 25 bp, Rattus norvegicus
agtcctctgggtgggaaagctgacc

SEQ ID NO: 158429 - DNA, 25 bp, Rattus norvegicus
agtcctctgttgatttactcagtcc

SEQ ID NO: 158430 - DNA, 25 bp, Rattus norvegicus
agtcctctgttgttttactcagtcc

SEQ ID NO: 158431 - DNA, 25 bp, Rattus norvegicus
agtcctcttagtaagcattgctagc

SEQ ID NO: 158432 - DNA, 25 bp, Rattus norvegicus
agtcctcttagttagcattgctagc

SEQ ID NO: 158433 - DNA, 25 bp, Rattus norvegicus
agtcctcttgctccaagcgaaaatc

SEQ ID NO: 158434 - DNA, 25 bp, Rattus norvegicus
agtcctcttgctgcaagcgaaaatc

SEQ ID NO: 158435 - DNA, 25 bp, Rattus norvegicus
agtcctgaacccaacaagcatttgt

SEQ ID NO: 158436 - DNA, 25 bp, Rattus norvegicus
agtcctgaaccctacaagcatttgt

SEQ ID NO: 158437 - DNA, 25 bp, Rattus norvegicus
agtcctgaagaactgctgtccaaca

SEQ ID NO: 158438 - DNA, 25 bp, Rattus norvegicus
agtcctgaagaagtgctgtccaaca

SEQ ID NO: 158439 - DNA, 25 bp, Rattus norvegicus
agtcctgaaggaccagcaccggctc

SEQ ID NO: 158440 - DNA, 25 bp, Rattus norvegicus
agtcctgaaggagcagcaccggctc

SEQ ID NO: 158441 - DNA, 25 bp, Rattus norvegicus
agtcctgaagtgacaatccttccat

SEQ ID NO: 158442 - DNA, 25 bp, Rattus norvegicus
agtcctgaagtgtcaatccttccat

SEQ ID NO: 158443 - DNA, 25 bp, Rattus norvegicus
agtcctgacactctattagcactga

SEQ ID NO: 158444 - DNA, 25 bp, Rattus norvegicus
agtcctgacactgtattagcactga

SEQ ID NO: 158445 - DNA, 25 bp, Rattus norvegicus
agtcctgaccgcagctgctaggagg

SEQ ID NO: 158446 - DNA, 25 bp, Rattus norvegicus
agtcctgaccgctgctgctaggagg

SEQ ID NO: 158447 - DNA, 25 bp, Rattus norvegicus
agtcctgagcagactaacccaagag

SEQ ID NO: 158448 - DNA, 25 bp, Rattus norvegicus
agtcctgagcagtctaacccaagag

SEQ ID NO: 158449 - DNA, 25 bp, Rattus norvegicus
agtcctgatcttctacgtggtttgg

SEQ ID NO: 158450 - DNA, 25 bp, Rattus norvegicus
agtcctgatcttgtacgtggtttgg

SEQ ID NO: 158451 - DNA, 25 bp, Rattus norvegicus
agtcctgatgcacatgattctctgt

SEQ ID NO: 158452 - DNA, 25 bp, Rattus norvegicus
agtcctgatgcagatgattctctgt

SEQ ID NO: 158453 - DNA, 25 bp, Rattus norvegicus
agtcctgatttcaaacttcagccta

SEQ ID NO: 158454 - DNA, 25 bp, Rattus norvegicus
agtcctgatttctaacttcagccta

SEQ ID NO: 158455 - DNA, 25 bp, Rattus norvegicus
agtcctgcagttccctggcagagaa

SEQ ID NO: 158456 - DNA, 25 bp, Rattus norvegicus
agtcctgcagttctcaatcctactc

SEQ ID NO: 158457 - DNA, 25 bp, Rattus norvegicus
agtcctgcagttgcctggcagagaa

SEQ ID NO: 158458 - DNA, 25 bp, Rattus norvegicus
agtcctgcagttgtcaatcctactc

SEQ ID NO: 158459 - DNA, 25 bp, Rattus norvegicus
agtcctgcatctataggtccatagc

SEQ ID NO: 158460 - DNA, 25 bp, Rattus norvegicus
agtcctgcatctttaggtccatagc

SEQ ID NO: 158461 - DNA, 25 bp, Rattus norvegicus
agtcctgcattcctactgagggttg

SEQ ID NO: 158462 - DNA, 25 bp, Rattus norvegicus
agtcctgcattcgtactgagggttg

SEQ ID NO: 158463 - DNA, 25 bp, Rattus norvegicus
agtcctgccagtcaccagatacttc

SEQ ID NO: 158464 - DNA, 25 bp, Rattus norvegicus
agtcctgccagtgaccagatacttc

SEQ ID NO: 158465 - DNA, 25 bp, Rattus norvegicus
agtcctgccattcctgtggttcgaa

SEQ ID NO: 158466 - DNA, 25 bp, Rattus norvegicus
agtcctgccattgctgtggttcgaa

SEQ ID NO: 158467 - DNA, 25 bp, Rattus norvegicus
agtcctgcccagattatgtacaatg

SEQ ID NO: 158468 - DNA, 25 bp, Rattus norvegicus
agtcctgcccagtttatgtacaatg

SEQ ID NO: 158469 - DNA, 25 bp, Rattus norvegicus
agtcctgccctacctcagcagggag

SEQ ID NO: 158470 - DNA, 25 bp, Rattus norvegicus
agtcctgccctagctcagcagggag

SEQ ID NO: 158471 - DNA, 25 bp, Rattus norvegicus
agtcctgccggaatctgactcagaa

SEQ ID NO: 158472 - DNA, 25 bp, Rattus norvegicus
agtcctgccggattctgactcagaa

SEQ ID NO: 158473 - DNA, 25 bp, Rattus norvegicus
agtcctgcctaccatacagtgagag

SEQ ID NO: 158474 - DNA, 25 bp, Rattus norvegicus
agtcctgcctacgatacagtgagag

SEQ ID NO: 158475 - DNA, 25 bp, Rattus norvegicus
agtcctgccttgattactttgtgtg

SEQ ID NO: 158476 - DNA, 25 bp, Rattus norvegicus
agtcctgccttgtttactttgtgtg

SEQ ID NO: 158477 - DNA, 25 bp, Rattus norvegicus
agtcctgcgcataattacgtgaagt

SEQ ID NO: 158478 - DNA, 25 bp, Rattus norvegicus
agtcctgcgcattattacgtgaagt

SEQ ID NO: 158479 - DNA, 25 bp, Rattus norvegicus
agtcctgcgcttcctgaacatttga

SEQ ID NO: 158480 - DNA, 25 bp, Rattus norvegicus
agtcctgcgcttgctgaacatttga

SEQ ID NO: 158481 - DNA, 25 bp, Rattus norvegicus
agtcctgcggctagtgctagtctag

SEQ ID NO: 158482 - DNA, 25 bp, Rattus norvegicus
agtcctgcggcttgtgctagtctag

SEQ ID NO: 158483 - DNA, 25 bp, Rattus norvegicus
agtcctgctaacagttaagcccaaa

SEQ ID NO: 158484 - DNA, 25 bp, Rattus norvegicus
agtcctgctaactgttaagcccaaa

SEQ ID NO: 158485 - DNA, 25 bp, Rattus norvegicus
agtcctgctcatatcagtctgtcac

SEQ ID NO: 158486 - DNA, 25 bp, Rattus norvegicus
agtcctgctcatttcagtctgtcac

SEQ ID NO: 158487 - DNA, 25 bp, Rattus norvegicus
agtcctgctcctcgatatttgtcaa

SEQ ID NO: 158488 - DNA, 25 bp, Rattus norvegicus
agtcctgctcctggatatttgtcaa

SEQ ID NO: 158489 - DNA, 25 bp, Rattus norvegicus
agtcctgctcttcgcctgtgaatgt

SEQ ID NO: 158490 - DNA, 25 bp, Rattus norvegicus
agtcctgctcttggcctgtgaatgt

SEQ ID NO: 158491 - DNA, 25 bp, Rattus norvegicus
agtcctgctgacctgtagataatta

SEQ ID NO: 158492 - DNA, 25 bp, Rattus norvegicus
agtcctgctgacgtgtagataatta

SEQ ID NO: 158493 - DNA, 25 bp, Rattus norvegicus
agtcctgctggaatattcctttccc

SEQ ID NO: 158494 - DNA, 25 bp, Rattus norvegicus
agtcctgctggattattcctttccc

SEQ ID NO: 158495 - DNA, 25 bp, Rattus norvegicus
agtcctgctgttctagattgtacaa

SEQ ID NO: 158496 - DNA, 25 bp, Rattus norvegicus
agtcctgctgttgtagattgtacaa

SEQ ID NO: 158497 - DNA, 25 bp, Rattus norvegicus
agtcctggaaagaagtctggccctt

SEQ ID NO: 158498 - DNA, 25 bp, Rattus norvegicus
agtcctggaaagtagtctggccctt

SEQ ID NO: 158499 - DNA, 25 bp, Rattus norvegicus
agtcctggaacgatcagtcccgata

SEQ ID NO: 158500 - DNA, 25 bp, Rattus norvegicus
agtcctggaacgttcagtcccgata

SEQ ID NO: 158501 - DNA, 25 bp, Rattus norvegicus
agtcctggcatacctgtcgggttct

SEQ ID NO: 158502 - DNA, 25 bp, Rattus norvegicus
agtcctggcatagctgtcgggttct

SEQ ID NO: 158503 - DNA, 25 bp, Rattus norvegicus
agtcctggctccagacgctgggcat

SEQ ID NO: 158504 - DNA, 25 bp, Rattus norvegicus
agtcctggctcctgacgctgggcat

SEQ ID NO: 158505 - DNA, 25 bp, Rattus norvegicus
agtcctggcttcagactactgctga

SEQ ID NO: 158506 - DNA, 25 bp, Rattus norvegicus
agtcctggcttccaacctgagggaa

SEQ ID NO: 158507 - DNA, 25 bp, Rattus norvegicus
agtcctggcttcgaacctgagggaa

SEQ ID NO: 158508 - DNA, 25 bp, Rattus norvegicus
agtcctggcttctgactactgctga

SEQ ID NO: 158509 - DNA, 25 bp, Rattus norvegicus
agtcctgggagaccttatcgcacca

SEQ ID NO: 158510 - DNA, 25 bp, Rattus norvegicus
agtcctgggagagcttatcgcacca

SEQ ID NO: 158511 - DNA, 25 bp, Rattus norvegicus
agtcctgggagcactttaaagtatg

SEQ ID NO: 158512 - DNA, 25 bp, Rattus norvegicus
agtcctgggagctctttaaagtatg

SEQ ID NO: 158513 - DNA, 25 bp, Rattus norvegicus
agtcctgggcatagacctcaggtca

SEQ ID NO: 158514 - DNA, 25 bp, Rattus norvegicus
agtcctgggcattgacctcaggtca

SEQ ID NO: 158515 - DNA, 25 bp, Rattus norvegicus
agtcctgggccaaatctagccctgg

SEQ ID NO: 158516 - DNA, 25 bp, Rattus norvegicus
agtcctgggccaatgtgtacatgtt

SEQ ID NO: 158517 - DNA, 25 bp, Rattus norvegicus
agtcctgggccatatctagccctgg

SEQ ID NO: 158518 - DNA, 25 bp, Rattus norvegicus
agtcctgggccattgtgtacatgtt

SEQ ID NO: 158519 - DNA, 25 bp, Rattus norvegicus
agtcctgggcctcttattgtctggc

SEQ ID NO: 158520 - DNA, 25 bp, Rattus norvegicus
agtcctgggcctgttattgtctggc

SEQ ID NO: 158521 - DNA, 25 bp, Rattus norvegicus
agtcctgggctaagctctagagtgc

SEQ ID NO: 158522 - DNA, 25 bp, Rattus norvegicus
agtcctgggctatgctctagagtgc

SEQ ID NO: 158523 - DNA, 25 bp, Rattus norvegicus
agtcctgggctcacaagaattcgct

SEQ ID NO: 158524 - DNA, 25 bp, Rattus norvegicus
agtcctgggctctcaagaattcgct

SEQ ID NO: 158525 - DNA, 25 bp, Rattus norvegicus
agtcctggtagacccggtcaacaaa

SEQ ID NO: 158526 - DNA, 25 bp, Rattus norvegicus
agtcctggtagagccggtcaacaaa

SEQ ID NO: 158527 - DNA, 25 bp, Rattus norvegicus
agtcctggtggactctcccagagaa

SEQ ID NO: 158528 - DNA, 25 bp, Rattus norvegicus
agtcctggtggagtctcccagagaa

SEQ ID NO: 158529 - DNA, 25 bp, Rattus norvegicus
agtcctggtggcctctcagatgaag

SEQ ID NO: 158530 - DNA, 25 bp, Rattus norvegicus
agtcctggtggcgtctcagatgaag

SEQ ID NO: 158531 - DNA, 25 bp, Rattus norvegicus
agtcctggtggtctcggctaagttc

SEQ ID NO: 158532 - DNA, 25 bp, Rattus norvegicus
agtcctggtggtgtcggctaagttc

SEQ ID NO: 158533 - DNA, 25 bp, Rattus norvegicus
agtcctggtgtcattgccattttga

SEQ ID NO: 158534 - DNA, 25 bp, Rattus norvegicus
agtcctggtgtctttgccattttga

SEQ ID NO: 158535 - DNA, 25 bp, Rattus norvegicus
agtcctggttgcaacagcatcatca

SEQ ID NO: 158536 - DNA, 25 bp, Rattus norvegicus
agtcctggttgctacagcatcatca

SEQ ID NO: 158537 - DNA, 25 bp, Rattus norvegicus
agtcctgtacctaatgttgcgggct

SEQ ID NO: 158538 - DNA, 25 bp, Rattus norvegicus
agtcctgtaccttatgttgcgggct

SEQ ID NO: 158539 - DNA, 25 bp, Rattus norvegicus
agtcctgtagttaatttagtgcctg

SEQ ID NO: 158540 - DNA, 25 bp, Rattus norvegicus
agtcctgtagtttatttagtgcctg

SEQ ID NO: 158541 - DNA, 25 bp, Rattus norvegicus
agtcctgtatcgctgactggctgac

SEQ ID NO: 158542 - DNA, 25 bp, Rattus norvegicus
agtcctgtatcggtgactggctgac

SEQ ID NO: 158543 - DNA, 25 bp, Rattus norvegicus
agtcctgtcagaaccgtgtgtagaa

SEQ ID NO: 158544 - DNA, 25 bp, Rattus norvegicus
agtcctgtcagatccgtgtgtagaa

SEQ ID NO: 158545 - DNA, 25 bp, Rattus norvegicus
agtcctgtcaggagagtgactttta

SEQ ID NO: 158546 - DNA, 25 bp, Rattus norvegicus
agtcctgtcaggtgagtgactttta

SEQ ID NO: 158547 - DNA, 25 bp, Rattus norvegicus
agtcctgtccacatctgaaactctt

SEQ ID NO: 158548 - DNA, 25 bp, Rattus norvegicus
agtcctgtccacttctgaaactctt

SEQ ID NO: 158549 - DNA, 25 bp, Rattus norvegicus
agtcctgtcgccctcagaaggtgga

SEQ ID NO: 158550 - DNA, 25 bp, Rattus norvegicus
agtcctgtcgccgtcagaaggtgga

SEQ ID NO: 158551 - DNA, 25 bp, Rattus norvegicus
agtcctgtctgacctctaacaatag

SEQ ID NO: 158552 - DNA, 25 bp, Rattus norvegicus
agtcctgtctgagctctaacaatag

SEQ ID NO: 158553 - DNA, 25 bp, Rattus norvegicus
agtcctgtctgtccacatatgtaca

SEQ ID NO: 158554 - DNA, 25 bp, Rattus norvegicus
agtcctgtctgtgcacatatgtaca

SEQ ID NO: 158555 - DNA, 25 bp, Rattus norvegicus
agtcctgtgaaaattagccttgatc

SEQ ID NO: 158556 - DNA, 25 bp, Rattus norvegicus
agtcctgtgaaatttagccttgatc

SEQ ID NO: 158557 - DNA, 25 bp, Rattus norvegicus
agtcctgtgatccatggcagtgcca

SEQ ID NO: 158558 - DNA, 25 bp, Rattus norvegicus
agtcctgtgatcgatggcagtgcca

SEQ ID NO: 158559 - DNA, 25 bp, Rattus norvegicus
agtcctgtgcatagtgggcggaata

SEQ ID NO: 158560 - DNA, 25 bp, Rattus norvegicus
agtcctgtgcattgtgggcggaata

SEQ ID NO: 158561 - DNA, 25 bp, Rattus norvegicus
agtcctgtggaacacttcctgtcca

SEQ ID NO: 158562 - DNA, 25 bp, Rattus norvegicus
agtcctgtggaagacttcctgtcca

SEQ ID NO: 158563 - DNA, 25 bp, Rattus norvegicus
agtcctgtggacacactttctgtga

SEQ ID NO: 158564 - DNA, 25 bp, Rattus norvegicus
agtcctgtggactcactttctgtga

SEQ ID NO: 158565 - DNA, 25 bp, Rattus norvegicus
agtcctgtggctcttaacttattgc

SEQ ID NO: 158566 - DNA, 25 bp, Rattus norvegicus
agtcctgtggctgttaacttattgc

SEQ ID NO: 158567 - DNA, 25 bp, Rattus norvegicus
agtcctgtgggacaacatcttgcta

SEQ ID NO: 158568 - DNA, 25 bp, Rattus norvegicus
agtcctgtgggagaacatcttgcta

SEQ ID NO: 158569 - DNA, 25 bp, Rattus norvegicus
agtcctgtggtaagtttgtggtata

SEQ ID NO: 158570 - DNA, 25 bp, Rattus norvegicus
agtcctgtggtaccaacggcgtcga

SEQ ID NO: 158571 - DNA, 25 bp, Rattus norvegicus
agtcctgtggtagcaacggcgtcga

SEQ ID NO: 158572 - DNA, 25 bp, Rattus norvegicus
agtcctgtggtatgtttgtggtata

SEQ ID NO: 158573 - DNA, 25 bp, Rattus norvegicus
agtcctgtggtcacccagcttgaag

SEQ ID NO: 158574 - DNA, 25 bp, Rattus norvegicus
agtcctgtggtctcccagcttgaag

SEQ ID NO: 158575 - DNA, 25 bp, Rattus norvegicus
agtcctgtgtctcagccatgagctg

SEQ ID NO: 158576 - DNA, 25 bp, Rattus norvegicus
agtcctgtgtctgagccatgagctg

SEQ ID NO: 158577 - DNA, 25 bp, Rattus norvegicus
agtcctgtgttaccgttagaattcc

SEQ ID NO: 158578 - DNA, 25 bp, Rattus norvegicus
agtcctgtgttagcgttagaattcc

SEQ ID NO: 158579 - DNA, 25 bp, Rattus norvegicus
agtcctgttaggaagcttgggctag

SEQ ID NO: 158580 - DNA, 25 bp, Rattus norvegicus
agtcctgttaggtagcttgggctag

SEQ ID NO: 158581 - DNA, 25 bp, Rattus norvegicus
agtcctgttcaccatttttgtctca

SEQ ID NO: 158582 - DNA, 25 bp, Rattus norvegicus
agtcctgttcacgatttttgtctca

SEQ ID NO: 158583 - DNA, 25 bp, Rattus norvegicus
agtcctgttctgacccaagcagcat

SEQ ID NO: 158584 - DNA, 25 bp, Rattus norvegicus
agtcctgttctgtcccaagcagcat

SEQ ID NO: 158585 - DNA, 25 bp, Rattus norvegicus
agtcctgttgatactagatatccca

SEQ ID NO: 158586 - DNA, 25 bp, Rattus norvegicus
agtcctgttgattctagatatccca

SEQ ID NO: 158587 - DNA, 25 bp, Rattus norvegicus
agtcctgttgggatgttgatacgta

SEQ ID NO: 158588 - DNA, 25 bp, Rattus norvegicus
agtcctgttgggttgttgatacgta

SEQ ID NO: 158589 - DNA, 25 bp, Rattus norvegicus
agtcctgtttacagagagcgccggg

SEQ ID NO: 158590 - DNA, 25 bp, Rattus norvegicus
agtcctgtttactgagagcgccggg

SEQ ID NO: 158591 - DNA, 25 bp, Rattus norvegicus
agtcctgtttcaatgtatctcctat

SEQ ID NO: 158592 - DNA, 25 bp, Rattus norvegicus
agtcctgtttcattgtatctcctat

SEQ ID NO: 158593 - DNA, 25 bp, Rattus norvegicus
agtcctgtttgaagacacctcctat

SEQ ID NO: 158594 - DNA, 25 bp, Rattus norvegicus
agtcctgtttgatgacacctcctat

SEQ ID NO: 158595 - DNA, 25 bp, Rattus norvegicus
agtccttacaaaagttggccttgag

SEQ ID NO: 158596 - DNA, 25 bp, Rattus norvegicus
agtccttacaaatgttggccttgag

SEQ ID NO: 158597 - DNA, 25 bp, Rattus norvegicus
agtccttacagtctcccttgatggt

SEQ ID NO: 158598 - DNA, 25 bp, Rattus norvegicus
agtccttacagtgtcccttgatggt

SEQ ID NO: 158599 - DNA, 25 bp, Rattus norvegicus
agtccttacgagaatcctggcccgg

SEQ ID NO: 158600 - DNA, 25 bp, Rattus norvegicus
agtccttacgagtatcctggcccgg

SEQ ID NO: 158601 - DNA, 25 bp, Rattus norvegicus
agtccttacgcgctacgggcagtgc

SEQ ID NO: 158602 - DNA, 25 bp, Rattus norvegicus
agtccttacgcggtacgggcagtgc

SEQ ID NO: 158603 - DNA, 25 bp, Rattus norvegicus
agtccttagagcagtcacatccata

SEQ ID NO: 158604 - DNA, 25 bp, Rattus norvegicus
agtccttagagctgtcacatccata

SEQ ID NO: 158605 - DNA, 25 bp, Rattus norvegicus
agtccttatgacatgctggagagca

SEQ ID NO: 158606 - DNA, 25 bp, Rattus norvegicus
agtccttatgacttgctggagagca

SEQ ID NO: 158607 - DNA, 25 bp, Rattus norvegicus
agtccttcaaatcatgtgtggttca

SEQ ID NO: 158608 - DNA, 25 bp, Rattus norvegicus
agtccttcaaatgatgtgtggttca

SEQ ID NO: 158609 - DNA, 25 bp, Rattus norvegicus
agtccttcagacaattccgtgcttt

SEQ ID NO: 158610 - DNA, 25 bp, Rattus norvegicus
agtccttcagactattccgtgcttt

SEQ ID NO: 158611 - DNA, 25 bp, Rattus norvegicus
agtccttcaggcatcattcctatgc

SEQ ID NO: 158612 - DNA, 25 bp, Rattus norvegicus
agtccttcaggcttcattcctatgc

SEQ ID NO: 158613 - DNA, 25 bp, Rattus norvegicus
agtccttcatgtccaccagcatgaa

SEQ ID NO: 158614 - DNA, 25 bp, Rattus norvegicus
agtccttcatgtgcaccagcatgaa

SEQ ID NO: 158615 - DNA, 25 bp, Rattus norvegicus
agtccttccaccacgaggtttacat

SEQ ID NO: 158616 - DNA, 25 bp, Rattus norvegicus
agtccttccacctcgaggtttacat

SEQ ID NO: 158617 - DNA, 25 bp, Rattus norvegicus
agtccttcccatcagtctcgggagg

SEQ ID NO: 158618 - DNA, 25 bp, Rattus norvegicus
agtccttcccatgagtctcgggagg

SEQ ID NO: 158619 - DNA, 25 bp, Rattus norvegicus
agtccttcccgtaggcttagattat

SEQ ID NO: 158620 - DNA, 25 bp, Rattus norvegicus
agtccttcccgttggcttagattat

SEQ ID NO: 158621 - DNA, 25 bp, Rattus norvegicus
agtccttccgcaaggcaatgggaaa

SEQ ID NO: 158622 - DNA, 25 bp, Rattus norvegicus
agtccttccgcatggcaatgggaaa

SEQ ID NO: 158623 - DNA, 25 bp, Rattus norvegicus
agtccttcctaacatctaactacta

SEQ ID NO: 158624 - DNA, 25 bp, Rattus norvegicus
agtccttcctaagatctaactacta

SEQ ID NO: 158625 - DNA, 25 bp, Rattus norvegicus
agtccttcctcaaaataaccctgga

SEQ ID NO: 158626 - DNA, 25 bp, Rattus norvegicus
agtccttcctcataataaccctgga

SEQ ID NO: 158627 - DNA, 25 bp, Rattus norvegicus
agtccttcctctacaggcgggagaa

SEQ ID NO: 158628 - DNA, 25 bp, Rattus norvegicus
agtccttcctcttcaggcgggagaa

SEQ ID NO: 158629 - DNA, 25 bp, Rattus norvegicus
agtccttcctgacgcaggctcaact

SEQ ID NO: 158630 - DNA, 25 bp, Rattus norvegicus
agtccttcctgaggcaggctcaact

SEQ ID NO: 158631 - DNA, 25 bp, Rattus norvegicus
agtccttccttccagaccgaatttg

SEQ ID NO: 158632 - DNA, 25 bp, Rattus norvegicus
agtccttccttcgagaccgaatttg

SEQ ID NO: 158633 - DNA, 25 bp, Rattus norvegicus
agtccttctaatcatcctggaactg

SEQ ID NO: 158634 - DNA, 25 bp, Rattus norvegicus
agtccttctaatgatcctggaactg

SEQ ID NO: 158635 - DNA, 25 bp, Rattus norvegicus
agtccttcttctattgcgcaatgta

SEQ ID NO: 158636 - DNA, 25 bp, Rattus norvegicus
agtccttcttcttttgcgcaatgta

SEQ ID NO: 158637 - DNA, 25 bp, Rattus norvegicus
agtccttgaccaaatttggccttag

SEQ ID NO: 158638 - DNA, 25 bp, Rattus norvegicus
agtccttgaccatatttggccttag

SEQ ID NO: 158639 - DNA, 25 bp, Rattus norvegicus
agtccttgagcccacagatcaccaa

SEQ ID NO: 158640 - DNA, 25 bp, Rattus norvegicus
agtccttgagccgacagatcaccaa

SEQ ID NO: 158641 - DNA, 25 bp, Rattus norvegicus
agtccttgaggacctttgacctagc

SEQ ID NO: 158642 - DNA, 25 bp, Rattus norvegicus
agtccttgaggagctttgacctagc

SEQ ID NO: 158643 - DNA, 25 bp, Rattus norvegicus
agtccttgatggacgcggcggacaa

SEQ ID NO: 158644 - DNA, 25 bp, Rattus norvegicus
agtccttgatggtcgcggcggacaa

SEQ ID NO: 158645 - DNA, 25 bp, Rattus norvegicus
agtccttgcactctttaacatgttc

SEQ ID NO: 158646 - DNA, 25 bp, Rattus norvegicus
agtccttgcactgtttaacatgttc

SEQ ID NO: 158647 - DNA, 25 bp, Rattus norvegicus
agtccttgctctaaagtgcttttta

SEQ ID NO: 158648 - DNA, 25 bp, Rattus norvegicus
agtccttgctcttaagtgcttttta

SEQ ID NO: 158649 - DNA, 25 bp, Rattus norvegicus
agtccttgcttaacatgggctgtgc

SEQ ID NO: 158650 - DNA, 25 bp, Rattus norvegicus
agtccttgcttatcatgggctgtgc

SEQ ID NO: 158651 - DNA, 25 bp, Rattus norvegicus
agtccttggagcagactcaagcgtc

SEQ ID NO: 158652 - DNA, 25 bp, Rattus norvegicus
agtccttggagctgactcaagcgtc

SEQ ID NO: 158653 - DNA, 25 bp, Rattus norvegicus
agtccttggcatagtattctttgtg

SEQ ID NO: 158654 - DNA, 25 bp, Rattus norvegicus
agtccttggcattgtattctttgtg

SEQ ID NO: 158655 - DNA, 25 bp, Rattus norvegicus
agtccttggtgtctctgattgctct

SEQ ID NO: 158656 - DNA, 25 bp, Rattus norvegicus
agtccttggtgtgtctgattgctct

SEQ ID NO: 158657 - DNA, 25 bp, Rattus norvegicus
agtccttgtgcccaggaacaattct

SEQ ID NO: 158658 - DNA, 25 bp, Rattus norvegicus
agtccttgtgccgaggaacaattct

SEQ ID NO: 158659 - DNA, 25 bp, Rattus norvegicus
agtccttgtggacctcagacagttt

SEQ ID NO: 158660 - DNA, 25 bp, Rattus norvegicus
agtccttgtggagctcagacagttt

SEQ ID NO: 158661 - DNA, 25 bp, Rattus norvegicus
agtccttgtggcatctattctagga

SEQ ID NO: 158662 - DNA, 25 bp, Rattus norvegicus
agtccttgtggcttctattctagga

SEQ ID NO: 158663 - DNA, 25 bp, Rattus norvegicus
agtccttgttgtcacactgtggctg

SEQ ID NO: 158664 - DNA, 25 bp, Rattus norvegicus
agtccttgttgtgacactgtggctg

SEQ ID NO: 158665 - DNA, 25 bp, Rattus norvegicus
agtcctttaacaaccagaactccat

SEQ ID NO: 158666 - DNA, 25 bp, Rattus norvegicus
agtcctttaacatccagaactccat

SEQ ID NO: 158667 - DNA, 25 bp, Rattus norvegicus
agtcctttatttagctgaagcctgt

SEQ ID NO: 158668 - DNA, 25 bp, Rattus norvegicus
agtcctttattttgctgaagcctgt

SEQ ID NO: 158669 - DNA, 25 bp, Rattus norvegicus
agtcctttcatcaagaggttcctca

SEQ ID NO: 158670 - DNA, 25 bp, Rattus norvegicus
agtcctttcatctagaggttcctca

SEQ ID NO: 158671 - DNA, 25 bp, Rattus norvegicus
agtcctttcctaactgcggcaataa

SEQ ID NO: 158672 - DNA, 25 bp, Rattus norvegicus
agtcctttcctatctgcggcaataa

SEQ ID NO: 158673 - DNA, 25 bp, Rattus norvegicus
agtcctttctacaacagcagtctac

SEQ ID NO: 158674 - DNA, 25 bp, Rattus norvegicus
agtcctttctactacagcagtctac

SEQ ID NO: 158675 - DNA, 25 bp, Rattus norvegicus
agtcctttctctagtgttcaggcag

SEQ ID NO: 158676 - DNA, 25 bp, Rattus norvegicus
agtcctttctcttgtgttcaggcag

SEQ ID NO: 158677 - DNA, 25 bp, Rattus norvegicus
agtcctttcttcctctcacctggaa

SEQ ID NO: 158678 - DNA, 25 bp, Rattus norvegicus
agtcctttcttcgtctcacctggaa

SEQ ID NO: 158679 - DNA, 25 bp, Rattus norvegicus
agtcctttgactagtttgctgccct

SEQ ID NO: 158680 - DNA, 25 bp, Rattus norvegicus
agtcctttgacttgtttgctgccct

SEQ ID NO: 158681 - DNA, 25 bp, Rattus norvegicus
agtcctttgcgtctgatgtgggtca

SEQ ID NO: 158682 - DNA, 25 bp, Rattus norvegicus
agtcctttgcgtgtgatgtgggtca

SEQ ID NO: 158683 - DNA, 25 bp, Rattus norvegicus
agtcctttgctgctatccactgtga

SEQ ID NO: 158684 - DNA, 25 bp, Rattus norvegicus
agtcctttgctggtatccactgtga

SEQ ID NO: 158685 - DNA, 25 bp, Rattus norvegicus
agtcctttggctaagtcatgtttcc

SEQ ID NO: 158686 - DNA, 25 bp, Rattus norvegicus
agtcctttggcttagtcatgtttcc

SEQ ID NO: 158687 - DNA, 25 bp, Rattus norvegicus
agtcctttgtcgacatcatggtcat

SEQ ID NO: 158688 - DNA, 25 bp, Rattus norvegicus
agtcctttgtcgtcatcatggtcat

SEQ ID NO: 158689 - DNA, 25 bp, Rattus norvegicus
agtccttttaatctcagaactctgg

SEQ ID NO: 158690 - DNA, 25 bp, Rattus norvegicus
agtccttttaatgtcagaactctgg

SEQ ID NO: 158691 - DNA, 25 bp, Rattus norvegicus
agtccttttatactgaactccaatg

SEQ ID NO: 158692 - DNA, 25 bp, Rattus norvegicus
agtccttttatagtgaactccaatg

SEQ ID NO: 158693 - DNA, 25 bp, Rattus norvegicus
agtccttttatgaacctggttcctg

SEQ ID NO: 158694 - DNA, 25 bp, Rattus norvegicus
agtccttttatgtacctggttcctg

SEQ ID NO: 158695 - DNA, 25 bp, Rattus norvegicus
agtccttttgacacaagtgtgcaag

SEQ ID NO: 158696 - DNA, 25 bp, Rattus norvegicus
agtccttttgactcaagtgtgcaag

SEQ ID NO: 158697 - DNA, 25 bp, Rattus norvegicus
agtccttttgagagtctgcacacac

SEQ ID NO: 158698 - DNA, 25 bp, Rattus norvegicus
agtccttttgagtgtctgcacacac

SEQ ID NO: 158699 - DNA, 25 bp, Rattus norvegicus
agtccttttggaacgcattgctctt

SEQ ID NO: 158700 - DNA, 25 bp, Rattus norvegicus
agtccttttggatcgcattgctctt

SEQ ID NO: 158701 - DNA, 25 bp, Rattus norvegicus
agtcgaactgcacaccatttttagt

SEQ ID NO: 158702 - DNA, 25 bp, Rattus norvegicus
agtcgaactgcagaccatttttagt

SEQ ID NO: 158703 - DNA, 25 bp, Rattus norvegicus
agtcgaaggagccactctgctgccg

SEQ ID NO: 158704 - DNA, 25 bp, Rattus norvegicus
agtcgaaggagcgactctgctgccg

SEQ ID NO: 158705 - DNA, 25 bp, Rattus norvegicus
agtcgaaggataactcgcatctcct

SEQ ID NO: 158706 - DNA, 25 bp, Rattus norvegicus
agtcgaaggatatctcgcatctcct

SEQ ID NO: 158707 - DNA, 25 bp, Rattus norvegicus
agtcgaagtaaaccctgtctcccaa

SEQ ID NO: 158708 - DNA, 25 bp, Rattus norvegicus
agtcgaagtaaagcctgtctcccaa

SEQ ID NO: 158709 - DNA, 25 bp, Rattus norvegicus
agtcgaagtcgtccaccagcccgga

SEQ ID NO: 158710 - DNA, 25 bp, Rattus norvegicus
agtcgaagtcgtgcaccagcccgga

SEQ ID NO: 158711 - DNA, 25 bp, Rattus norvegicus
agtcgaatcagcactgggcctagga

SEQ ID NO: 158712 - DNA, 25 bp, Rattus norvegicus
agtcgaatcagctctgggcctagga

SEQ ID NO: 158713 - DNA, 25 bp, Rattus norvegicus
agtcgaatccaaagccgtagctgcg

SEQ ID NO: 158714 - DNA, 25 bp, Rattus norvegicus
agtcgaatccaatgccgtagctgcg

SEQ ID NO: 158715 - DNA, 25 bp, Rattus norvegicus
agtcgaatgtcacactccattccac

SEQ ID NO: 158716 - DNA, 25 bp, Rattus norvegicus
agtcgaatgtcagactccattccac

SEQ ID NO: 158717 - DNA, 25 bp, Rattus norvegicus
agtcgacacacgagtttctcaggtg

SEQ ID NO: 158718 - DNA, 25 bp, Rattus norvegicus
agtcgacacacgtgtttctcaggtg

SEQ ID NO: 158719 - DNA, 25 bp, Rattus norvegicus
agtcgacagcttcctccaaacaaac

SEQ ID NO: 158720 - DNA, 25 bp, Rattus norvegicus
agtcgacagcttgctccaaacaaac

SEQ ID NO: 158721 - DNA, 25 bp, Rattus norvegicus
agtcgaccgagcaggagcacagaga

SEQ ID NO: 158722 - DNA, 25 bp, Rattus norvegicus
agtcgaccgagctggagcacagaga

SEQ ID NO: 158723 - DNA, 25 bp, Rattus norvegicus
agtcgactacatattctactctgca

SEQ ID NO: 158724 - DNA, 25 bp, Rattus norvegicus
agtcgactacattttctactctgca

SEQ ID NO: 158725 - DNA, 25 bp, Rattus norvegicus
agtcgactataaaccccagatctaa

SEQ ID NO: 158726 - DNA, 25 bp, Rattus norvegicus
agtcgactataatccccagatctaa

SEQ ID NO: 158727 - DNA, 25 bp, Rattus norvegicus
agtcgagcctttactgctgagtcaa

SEQ ID NO: 158728 - DNA, 25 bp, Rattus norvegicus
agtcgagccttttctgctgagtcaa

SEQ ID NO: 158729 - DNA, 25 bp, Rattus norvegicus
agtcgagcggtcacccggtatcctg

SEQ ID NO: 158730 - DNA, 25 bp, Rattus norvegicus
agtcgagcggtctcccggtatcctg

SEQ ID NO: 158731 - DNA, 25 bp, Rattus norvegicus
agtcgaggcagcaagtctgtccggc

SEQ ID NO: 158732 - DNA, 25 bp, Rattus norvegicus
agtcgaggcagctagtctgtccggc

SEQ ID NO: 158733 - DNA, 25 bp, Rattus norvegicus
agtcgaggcgctcatcagcaatagc

SEQ ID NO: 158734 - DNA, 25 bp, Rattus norvegicus
agtcgaggcgctgatcagcaatagc

SEQ ID NO: 158735 - DNA, 25 bp, Rattus norvegicus
agtcgagggcagagatgctcagatt

SEQ ID NO: 158736 - DNA, 25 bp, Rattus norvegicus
agtcgagggcagtgatgctcagatt

SEQ ID NO: 158737 - DNA, 25 bp, Rattus norvegicus
agtcgaggtgcacacgtaccagccg

SEQ ID NO: 158738 - DNA, 25 bp, Rattus norvegicus
agtcgaggtgcagacgtaccagccg

SEQ ID NO: 158739 - DNA, 25 bp, Rattus norvegicus
agtcgagtacatagaccggccgcga

SEQ ID NO: 158740 - DNA, 25 bp, Rattus norvegicus
agtcgagtacattgaccggccgcga

SEQ ID NO: 158741 - DNA, 25 bp, Rattus norvegicus
agtcgataacagatcagctgcctct

SEQ ID NO: 158742 - DNA, 25 bp, Rattus norvegicus
agtcgataacagttcagctgcctct

SEQ ID NO: 158743 - DNA, 25 bp, Rattus norvegicus
agtcgatggcgaattaatatagaac

SEQ ID NO: 158744 - DNA, 25 bp, Rattus norvegicus
agtcgatggcgatttaatatagaac

SEQ ID NO: 158745 - DNA, 25 bp, Rattus norvegicus
agtcgatgtcataccagtcaccctt

SEQ ID NO: 158746 - DNA, 25 bp, Rattus norvegicus
agtcgatgtcattccagtcaccctt

SEQ ID NO: 158747 - DNA, 25 bp, Rattus norvegicus
agtcgcaaggctctggtctcataca

SEQ ID NO: 158748 - DNA, 25 bp, Rattus norvegicus
agtcgcaaggctgtggtctcataca

SEQ ID NO: 158749 - DNA, 25 bp, Rattus norvegicus
agtcgcagcaagctttccaggcaga

SEQ ID NO: 158750 - DNA, 25 bp, Rattus norvegicus
agtcgcagcaaggtttccaggcaga

SEQ ID NO: 158751 - DNA, 25 bp, Rattus norvegicus
agtcgcaggtttcccctgaatgcag

SEQ ID NO: 158752 - DNA, 25 bp, Rattus norvegicus
agtcgcaggtttgccctgaatgcag

SEQ ID NO: 158753 - DNA, 25 bp, Rattus norvegicus
agtcgcagttggatttcctgtcaga

SEQ ID NO: 158754 - DNA, 25 bp, Rattus norvegicus
agtcgcagttggttttcctgtcaga

SEQ ID NO: 158755 - DNA, 25 bp, Rattus norvegicus
agtcgcatctcactgcaggagcggc

SEQ ID NO: 158756 - DNA, 25 bp, Rattus norvegicus
agtcgcatctcagtgcaggagcggc

SEQ ID NO: 158757 - DNA, 25 bp, Rattus norvegicus
agtcgcatgatgctggctcagtcca

SEQ ID NO: 158758 - DNA, 25 bp, Rattus norvegicus
agtcgcatgatggtggctcagtcca

SEQ ID NO: 158759 - DNA, 25 bp, Rattus norvegicus
agtcgccaagacagacataaacgat

SEQ ID NO: 158760 - DNA, 25 bp, Rattus norvegicus
agtcgccaagactgacataaacgat

SEQ ID NO: 158761 - DNA, 25 bp, Rattus norvegicus
agtcgccaatggaatgtacccctgc

SEQ ID NO: 158762 - DNA, 25 bp, Rattus norvegicus
agtcgccaatggtatgtacccctgc

SEQ ID NO: 158763 - DNA, 25 bp, Rattus norvegicus
agtcgccactttcttaatccattga

SEQ ID NO: 158764 - DNA, 25 bp, Rattus norvegicus
agtcgccactttgttaatccattga

SEQ ID NO: 158765 - DNA, 25 bp, Rattus norvegicus
agtcgccagaggatcagatgacgca

SEQ ID NO: 158766 - DNA, 25 bp, Rattus norvegicus
agtcgccagaggttcagatgacgca

SEQ ID NO: 158767 - DNA, 25 bp, Rattus norvegicus
agtcgccagcggaactgcttcttcg

SEQ ID NO: 158768 - DNA, 25 bp, Rattus norvegicus
agtcgccagcggtactgcttcttcg

SEQ ID NO: 158769 - DNA, 25 bp, Rattus norvegicus
agtcgcccgcgcagctgttcgcggt

SEQ ID NO: 158770 - DNA, 25 bp, Rattus norvegicus
agtcgcccgcgctgctgttcgcggt

SEQ ID NO: 158771 - DNA, 25 bp, Rattus norvegicus
agtcgcctcagtacaggccacagtg

SEQ ID NO: 158772 - DNA, 25 bp, Rattus norvegicus
agtcgcctcagttcaggccacagtg

SEQ ID NO: 158773 - DNA, 25 bp, Rattus norvegicus
agtcgcctgtccacctagttgtatc

SEQ ID NO: 158774 - DNA, 25 bp, Rattus norvegicus
agtcgcctgtcctcctagttgtatc

SEQ ID NO: 158775 - DNA, 25 bp, Rattus norvegicus
agtcgcgacccgaccaagggcagcg

SEQ ID NO: 158776 - DNA, 25 bp, Rattus norvegicus
agtcgcgacccgtccaagggcagcg

SEQ ID NO: 158777 - DNA, 25 bp, Rattus norvegicus
agtcgcgcgaaaactgactggattt

SEQ ID NO: 158778 - DNA, 25 bp, Rattus norvegicus
agtcgcgcgaaatctgactggattt

SEQ ID NO: 158779 - DNA, 25 bp, Rattus norvegicus
agtcgcgctggaaaagaactttcat

SEQ ID NO: 158780 - DNA, 25 bp, Rattus norvegicus
agtcgcgctggataagaactttcat

SEQ ID NO: 158781 - DNA, 25 bp, Rattus norvegicus
agtcgctaccaccaagaccggtgta

SEQ ID NO: 158782 - DNA, 25 bp, Rattus norvegicus
agtcgctaccacgaagaccggtgta

SEQ ID NO: 158783 - DNA, 25 bp, Rattus norvegicus
agtcgctaccttagtctacctttgt

SEQ ID NO: 158784 - DNA, 25 bp, Rattus norvegicus
agtcgctacctttgtctacctttgt

SEQ ID NO: 158785 - DNA, 25 bp, Rattus norvegicus
agtcgctagtccatgtcattcaggt

SEQ ID NO: 158786 - DNA, 25 bp, Rattus norvegicus
agtcgctagtccttgtcattcaggt

SEQ ID NO: 158787 - DNA, 25 bp, Rattus norvegicus
agtcgctccagccttaatttgaaag

SEQ ID NO: 158788 - DNA, 25 bp, Rattus norvegicus
agtcgctccagcgttaatttgaaag

SEQ ID NO: 158789 - DNA, 25 bp, Rattus norvegicus
agtcgctcgagcacatgcagtatct

SEQ ID NO: 158790 - DNA, 25 bp, Rattus norvegicus
agtcgctcgagctcatgcagtatct

SEQ ID NO: 158791 - DNA, 25 bp, Rattus norvegicus
agtcgctctacactttgcaagccgc

SEQ ID NO: 158792 - DNA, 25 bp, Rattus norvegicus
agtcgctctacagtttgcaagccgc

SEQ ID NO: 158793 - DNA, 25 bp, Rattus norvegicus
agtcgctgaaaaccctccattcttc

SEQ ID NO: 158794 - DNA, 25 bp, Rattus norvegicus
agtcgctgaaaagcctccattcttc

SEQ ID NO: 158795 - DNA, 25 bp, Rattus norvegicus
agtcgctgaggtatgagagccccac

SEQ ID NO: 158796 - DNA, 25 bp, Rattus norvegicus
agtcgctgaggtttgagagccccac

SEQ ID NO: 158797 - DNA, 25 bp, Rattus norvegicus
agtcgctgcctaagctctttggaga

SEQ ID NO: 158798 - DNA, 25 bp, Rattus norvegicus
agtcgctgcctatgctctttggaga

SEQ ID NO: 158799 - DNA, 25 bp, Rattus norvegicus
agtcgctggaagaccagcaagtact

SEQ ID NO: 158800 - DNA, 25 bp, Rattus norvegicus
agtcgctggaagtccagcaagtact

SEQ ID NO: 158801 - DNA, 25 bp, Rattus norvegicus
agtcgctggaccagggctggaaact

SEQ ID NO: 158802 - DNA, 25 bp, Rattus norvegicus
agtcgctggacctgggctggaaact

SEQ ID NO: 158803 - DNA, 25 bp, Rattus norvegicus
agtcgctgtacaaggacacacgcac

SEQ ID NO: 158804 - DNA, 25 bp, Rattus norvegicus
agtcgctgtacatggacacacgcac

SEQ ID NO: 158805 - DNA, 25 bp, Rattus norvegicus
agtcgctgtgctatttgccccagca

SEQ ID NO: 158806 - DNA, 25 bp, Rattus norvegicus
agtcgctgtgctttttgccccagca

SEQ ID NO: 158807 - DNA, 25 bp, Rattus norvegicus
agtcggaaggcaacccgctgctgga

SEQ ID NO: 158808 - DNA, 25 bp, Rattus norvegicus
agtcggaaggcatcccgctgctgga

SEQ ID NO: 158809 - DNA, 25 bp, Rattus norvegicus
agtcggaccacacaccggtgagtgt

SEQ ID NO: 158810 - DNA, 25 bp, Rattus norvegicus
agtcggaccacagaccggtgagtgt

SEQ ID NO: 158811 - DNA, 25 bp, Rattus norvegicus
agtcggaccgatctacccatagctg

SEQ ID NO: 158812 - DNA, 25 bp, Rattus norvegicus
agtcggaccgatgtacccatagctg

SEQ ID NO: 158813 - DNA, 25 bp, Rattus norvegicus
agtcggacgatcacagacccagcac

SEQ ID NO: 158814 - DNA, 25 bp, Rattus norvegicus
agtcggacgatctcagacccagcac

SEQ ID NO: 158815 - DNA, 25 bp, Rattus norvegicus
agtcggacgcttctagtttccttat

SEQ ID NO: 158816 - DNA, 25 bp, Rattus norvegicus
agtcggacgcttgtagtttccttat

SEQ ID NO: 158817 - DNA, 25 bp, Rattus norvegicus
agtcggaggatcagaggtgaccctt

SEQ ID NO: 158818 - DNA, 25 bp, Rattus norvegicus
agtcggaggatctgaggtgaccctt

SEQ ID NO: 158819 - DNA, 25 bp, Rattus norvegicus
agtcggaggccacaagccacacact

SEQ ID NO: 158820 - DNA, 25 bp, Rattus norvegicus
agtcggaggccagaagccacacact

SEQ ID NO: 158821 - DNA, 25 bp, Rattus norvegicus
agtcggatagtcattccttcatatg

SEQ ID NO: 158822 - DNA, 25 bp, Rattus norvegicus
agtcggatagtctttccttcatatg

SEQ ID NO: 158823 - DNA, 25 bp, Rattus norvegicus
agtcggatccagatgcatgtcctgt

SEQ ID NO: 158824 - DNA, 25 bp, Rattus norvegicus
agtcggatccagttgcatgtcctgt

SEQ ID NO: 158825 - DNA, 25 bp, Rattus norvegicus
agtcggatgaccaccagtgacacac

SEQ ID NO: 158826 - DNA, 25 bp, Rattus norvegicus
agtcggatgacctccagtgacacac

SEQ ID NO: 158827 - DNA, 25 bp, Rattus norvegicus
agtcggattctgaagcagctgacat

SEQ ID NO: 158828 - DNA, 25 bp, Rattus norvegicus
agtcggattctgtagcagctgacat

SEQ ID NO: 158829 - DNA, 25 bp, Rattus norvegicus
agtcggattgaccattgctgctgca

SEQ ID NO: 158830 - DNA, 25 bp, Rattus norvegicus
agtcggattgacgattgctgctgca

SEQ ID NO: 158831 - DNA, 25 bp, Rattus norvegicus
agtcggatttcactgagtttctgtc

SEQ ID NO: 158832 - DNA, 25 bp, Rattus norvegicus
agtcggatttcagtgagtttctgtc

SEQ ID NO: 158833 - DNA, 25 bp, Rattus norvegicus
agtcggcactttattgaggcagccc

SEQ ID NO: 158834 - DNA, 25 bp, Rattus norvegicus
agtcggcacttttttgaggcagccc

SEQ ID NO: 158835 - DNA, 25 bp, Rattus norvegicus
agtcggcatcctcgtcctgaagtta

SEQ ID NO: 158836 - DNA, 25 bp, Rattus norvegicus
agtcggcatcctggtcctgaagtta

SEQ ID NO: 158837 - DNA, 25 bp, Rattus norvegicus
agtcggccaaaaatccagtgaggat

SEQ ID NO: 158838 - DNA, 25 bp, Rattus norvegicus
agtcggccaaaattccagtgaggat

SEQ ID NO: 158839 - DNA, 25 bp, Rattus norvegicus
agtcggccaggcagtctttgaagtg

SEQ ID NO: 158840 - DNA, 25 bp, Rattus norvegicus
agtcggccaggctgtctttgaagtg

SEQ ID NO: 158841 - DNA, 25 bp, Rattus norvegicus
agtcggcccaggctcctcatcgaag

SEQ ID NO: 158842 - DNA, 25 bp, Rattus norvegicus
agtcggcccagggtcctcatcgaag

SEQ ID NO: 158843 - DNA, 25 bp, Rattus norvegicus
agtcggcctcagcagaagttcttca

SEQ ID NO: 158844 - DNA, 25 bp, Rattus norvegicus
agtcggcctcaggagaagttcttca

SEQ ID NO: 158845 - DNA, 25 bp, Rattus norvegicus
agtcggcctgctacatactgggtga

SEQ ID NO: 158846 - DNA, 25 bp, Rattus norvegicus
agtcggcctgcttcatactgggtga

SEQ ID NO: 158847 - DNA, 25 bp, Rattus norvegicus
agtcggctagacacccgaactgaaa

SEQ ID NO: 158848 - DNA, 25 bp, Rattus norvegicus
agtcggctagactcccgaactgaaa

SEQ ID NO: 158849 - DNA, 25 bp, Rattus norvegicus
agtcggctcagtcctgtgttttatt

SEQ ID NO: 158850 - DNA, 25 bp, Rattus norvegicus
agtcggctcagtgctgtgttttatt

SEQ ID NO: 158851 - DNA, 25 bp, Rattus norvegicus
agtcggctctggcaaccctgagttt

SEQ ID NO: 158852 - DNA, 25 bp, Rattus norvegicus
agtcggctctgggaaccctgagttt

SEQ ID NO: 158853 - DNA, 25 bp, Rattus norvegicus
agtcggcttaaaaccttgtatcata

SEQ ID NO: 158854 - DNA, 25 bp, Rattus norvegicus
agtcggcttaaatccttgtatcata

SEQ ID NO: 158855 - DNA, 25 bp, Rattus norvegicus
agtcggcttccactggcctaactat

SEQ ID NO: 158856 - DNA, 25 bp, Rattus norvegicus
agtcggcttccagtggcctaactat

SEQ ID NO: 158857 - DNA, 25 bp, Rattus norvegicus
agtcgggacacacatagggcttctc

SEQ ID NO: 158858 - DNA, 25 bp, Rattus norvegicus
agtcgggacacagatagggcttctc

SEQ ID NO: 158859 - DNA, 25 bp, Rattus norvegicus
agtcgggagtgtctctcccctcata

SEQ ID NO: 158860 - DNA, 25 bp, Rattus norvegicus
agtcgggagtgtgtctcccctcata

SEQ ID NO: 158861 - DNA, 25 bp, Rattus norvegicus
agtcgggctcagaggttgttctgta

SEQ ID NO: 158862 - DNA, 25 bp, Rattus norvegicus
agtcgggctcagtggttgttctgta

SEQ ID NO: 158863 - DNA, 25 bp, Rattus norvegicus
agtcgggtgaacacaccagccagaa

SEQ ID NO: 158864 - DNA, 25 bp, Rattus norvegicus
agtcgggtgaactcaccagccagaa

SEQ ID NO: 158865 - DNA, 25 bp, Rattus norvegicus
agtcgggttactccatttcttgttc

SEQ ID NO: 158866 - DNA, 25 bp, Rattus norvegicus
agtcgggttactgcatttcttgttc

SEQ ID NO: 158867 - DNA, 25 bp, Rattus norvegicus
agtcggtacatcaccattcggcgca

SEQ ID NO: 158868 - DNA, 25 bp, Rattus norvegicus
agtcggtacatctccattcggcgca

SEQ ID NO: 158869 - DNA, 25 bp, Rattus norvegicus
agtcggtatgagatgggctttgtaa

SEQ ID NO: 158870 - DNA, 25 bp, Rattus norvegicus
agtcggtatgagttgggctttgtaa

SEQ ID NO: 158871 - DNA, 25 bp, Rattus norvegicus
agtcggtcatctctaatctgtggga

SEQ ID NO: 158872 - DNA, 25 bp, Rattus norvegicus
agtcggtcatctgtaatctgtggga

SEQ ID NO: 158873 - DNA, 25 bp, Rattus norvegicus
agtcggtcattacccttgtgcttgg

SEQ ID NO: 158874 - DNA, 25 bp, Rattus norvegicus
agtcggtcattagccttgtgcttgg

SEQ ID NO: 158875 - DNA, 25 bp, Rattus norvegicus
agtcggtgagacagacacagcgata

SEQ ID NO: 158876 - DNA, 25 bp, Rattus norvegicus
agtcggtgagactgacacagcgata

SEQ ID NO: 158877 - DNA, 25 bp, Rattus norvegicus
agtcggtgcgcacgtcctcgtcgtc

SEQ ID NO: 158878 - DNA, 25 bp, Rattus norvegicus
agtcggtgcgcaggtcctcgtcgtc

SEQ ID NO: 158879 - DNA, 25 bp, Rattus norvegicus
agtcggtgctagagcccacttctcg

SEQ ID NO: 158880 - DNA, 25 bp, Rattus norvegicus
agtcggtgctagtgcccacttctcg

SEQ ID NO: 158881 - DNA, 25 bp, Rattus norvegicus
agtcggtgttgcctgtagtcatcct

SEQ ID NO: 158882 - DNA, 25 bp, Rattus norvegicus
agtcggtgttgcgtgtagtcatcct

SEQ ID NO: 158883 - DNA, 25 bp, Rattus norvegicus
agtcggttaatgaccatgtcctgca

SEQ ID NO: 158884 - DNA, 25 bp, Rattus norvegicus
agtcggttaatgtccatgtcctgca

SEQ ID NO: 158885 - DNA, 25 bp, Rattus norvegicus
agtcgtaagctgagaaccctaaaga

SEQ ID NO: 158886 - DNA, 25 bp, Rattus norvegicus
agtcgtaagctgtgaaccctaaaga

SEQ ID NO: 158887 - DNA, 25 bp, Rattus norvegicus
agtcgtacgaggagctgcagacaca

SEQ ID NO: 158888 - DNA, 25 bp, Rattus norvegicus
agtcgtacgaggtgctgcagacaca

SEQ ID NO: 158889 - DNA, 25 bp, Rattus norvegicus
agtcgtagcccaagttcctaaatta

SEQ ID NO: 158890 - DNA, 25 bp, Rattus norvegicus
agtcgtagcccatgttcctaaatta

SEQ ID NO: 158891 - DNA, 25 bp, Rattus norvegicus
agtcgtatagtaactggctttgtac

SEQ ID NO: 158892 - DNA, 25 bp, Rattus norvegicus
agtcgtatagtatctggctttgtac

SEQ ID NO: 158893 - DNA, 25 bp, Rattus norvegicus
agtcgtatcaagctggccctcaaga

SEQ ID NO: 158894 - DNA, 25 bp, Rattus norvegicus
agtcgtatcaaggtggccctcaaga

SEQ ID NO: 158895 - DNA, 25 bp, Rattus norvegicus
agtcgtattacaaaggacttcctaa

SEQ ID NO: 158896 - DNA, 25 bp, Rattus norvegicus
agtcgtattacataggacttcctaa

SEQ ID NO: 158897 - DNA, 25 bp, Rattus norvegicus
agtcgtcactaaccctccatatgaa

SEQ ID NO: 158898 - DNA, 25 bp, Rattus norvegicus
agtcgtcactaagcctccatatgaa

SEQ ID NO: 158899 - DNA, 25 bp, Rattus norvegicus
agtcgtcagcctatattagcaccag

SEQ ID NO: 158900 - DNA, 25 bp, Rattus norvegicus
agtcgtcagcctttattagcaccag

SEQ ID NO: 158901 - DNA, 25 bp, Rattus norvegicus
agtcgtcctactctgctgaagtaac

SEQ ID NO: 158902 - DNA, 25 bp, Rattus norvegicus
agtcgtcctactgtgctgaagtaac

SEQ ID NO: 158903 - DNA, 25 bp, Rattus norvegicus
agtcgtcctctgacaggcctgaaga

SEQ ID NO: 158904 - DNA, 25 bp, Rattus norvegicus
agtcgtcctctgtcaggcctgaaga

SEQ ID NO: 158905 - DNA, 25 bp, Rattus norvegicus
agtcgtcctgcccagtgctggatcc

SEQ ID NO: 158906 - DNA, 25 bp, Rattus norvegicus
agtcgtcctgccgagtgctggatcc

SEQ ID NO: 158907 - DNA, 25 bp, Rattus norvegicus
agtcgtcctggcacatgtgggattc

SEQ ID NO: 158908 - DNA, 25 bp, Rattus norvegicus
agtcgtcctggctcatgtgggattc

SEQ ID NO: 158909 - DNA, 25 bp, Rattus norvegicus
agtcgtcgctggacaaatattgttc

SEQ ID NO: 158910 - DNA, 25 bp, Rattus norvegicus
agtcgtcgctggtcaaatattgttc

SEQ ID NO: 158911 - DNA, 25 bp, Rattus norvegicus
agtcgtctcataaacgtctgatgac

SEQ ID NO: 158912 - DNA, 25 bp, Rattus norvegicus
agtcgtctcatatacgtctgatgac

SEQ ID NO: 158913 - DNA, 25 bp, Rattus norvegicus
agtcgtctgcacagttgggttcttc

SEQ ID NO: 158914 - DNA, 25 bp, Rattus norvegicus
agtcgtctgcactgttgggttcttc

SEQ ID NO: 158915 - DNA, 25 bp, Rattus norvegicus
agtcgtcttcaactgcagagaaaaa

SEQ ID NO: 158916 - DNA, 25 bp, Rattus norvegicus
agtcgtcttcaagtgcagagaaaaa

SEQ ID NO: 158917 - DNA, 25 bp, Rattus norvegicus
agtcgtgcacgacccgcgggaagga

SEQ ID NO: 158918 - DNA, 25 bp, Rattus norvegicus
agtcgtgcacgagccgcgggaagga

SEQ ID NO: 158919 - DNA, 25 bp, Rattus norvegicus
agtcgtggaaatccttgtgtcgttt

SEQ ID NO: 158920 - DNA, 25 bp, Rattus norvegicus
agtcgtggaaatgcttgtgtcgttt

SEQ ID NO: 158921 - DNA, 25 bp, Rattus norvegicus
agtcgtgggcatcactagccagtga

SEQ ID NO: 158922 - DNA, 25 bp, Rattus norvegicus
agtcgtgggcatgactagccagtga

SEQ ID NO: 158923 - DNA, 25 bp, Rattus norvegicus
agtcgtggtgtgctcagtcctgcaa

SEQ ID NO: 158924 - DNA, 25 bp, Rattus norvegicus
agtcgtggtgtggtcagtcctgcaa

SEQ ID NO: 158925 - DNA, 25 bp, Rattus norvegicus
agtcgtgtaagcactgcacagggtt

SEQ ID NO: 158926 - DNA, 25 bp, Rattus norvegicus
agtcgtgtaagctctgcacagggtt

SEQ ID NO: 158927 - DNA, 25 bp, Rattus norvegicus
agtcgtgtacttcaggtgcaccgga

SEQ ID NO: 158928 - DNA, 25 bp, Rattus norvegicus
agtcgtgtacttgaggtgcaccgga

SEQ ID NO: 158929 - DNA, 25 bp, Rattus norvegicus
agtcgtgtctgtataactctccggt

SEQ ID NO: 158930 - DNA, 25 bp, Rattus norvegicus
agtcgtgtctgtttaactctccggt

SEQ ID NO: 158931 - DNA, 25 bp, Rattus norvegicus
agtcgtgtgatacgcgcgtgtcttc

SEQ ID NO: 158932 - DNA, 25 bp, Rattus norvegicus
agtcgtgtgataggcgcgtgtcttc

SEQ ID NO: 158933 - DNA, 25 bp, Rattus norvegicus
agtcgtgtgtccaggcatggcttat

SEQ ID NO: 158934 - DNA, 25 bp, Rattus norvegicus
agtcgtgtgtcctggcatggcttat

SEQ ID NO: 158935 - DNA, 25 bp, Rattus norvegicus
agtcgtgttggacaccatcaagcag

SEQ ID NO: 158936 - DNA, 25 bp, Rattus norvegicus
agtcgtgttggagaccatcaagcag

SEQ ID NO: 158937 - DNA, 25 bp, Rattus norvegicus
agtcgttacgatccactgcaataaa

SEQ ID NO: 158938 - DNA, 25 bp, Rattus norvegicus
agtcgttacgatgcactgcaataaa

SEQ ID NO: 158939 - DNA, 25 bp, Rattus norvegicus
agtcgttagcctcagtttgaatttc

SEQ ID NO: 158940 - DNA, 25 bp, Rattus norvegicus
agtcgttagcctgagtttgaatttc

SEQ ID NO: 158941 - DNA, 25 bp, Rattus norvegicus
agtcgttcctctagaggcctcaagg

SEQ ID NO: 158942 - DNA, 25 bp, Rattus norvegicus
agtcgttcctcttgaggcctcaagg

SEQ ID NO: 158943 - DNA, 25 bp, Rattus norvegicus
agtcgttcttgcacttcgagggcga

SEQ ID NO: 158944 - DNA, 25 bp, Rattus norvegicus
agtcgttcttgctcttcgagggcga

SEQ ID NO: 158945 - DNA, 25 bp, Rattus norvegicus
agtcgttgacgaagatctggtttac

SEQ ID NO: 158946 - DNA, 25 bp, Rattus norvegicus
agtcgttgacgatgatctggtttac

SEQ ID NO: 158947 - DNA, 25 bp, Rattus norvegicus
agtcgttgagctctgtatccacctt

SEQ ID NO: 158948 - DNA, 25 bp, Rattus norvegicus
agtcgttgagctgtgtatccacctt

SEQ ID NO: 158949 - DNA, 25 bp, Rattus norvegicus
agtcgttgtcacagtgagctgctgt

SEQ ID NO: 158950 - DNA, 25 bp, Rattus norvegicus
agtcgttgtcactgtgagctgctgt

SEQ ID NO: 158951 - DNA, 25 bp, Rattus norvegicus
agtcgtttacaaatggcgcccagtg

SEQ ID NO: 158952 - DNA, 25 bp, Rattus norvegicus
agtcgtttacaattggcgcccagtg

SEQ ID NO: 158953 - DNA, 25 bp, Rattus norvegicus
agtcgtttagctcctggcgcaggtt

SEQ ID NO: 158954 - DNA, 25 bp, Rattus norvegicus
agtcgtttagctgctggcgcaggtt

SEQ ID NO: 158955 - DNA, 25 bp, Rattus norvegicus
agtcgtttatgtcatcccttcttct

SEQ ID NO: 158956 - DNA, 25 bp, Rattus norvegicus
agtcgtttatgtgatcccttcttct

SEQ ID NO: 158957 - DNA, 25 bp, Rattus norvegicus
agtctaaacccaagatccagtctct

SEQ ID NO: 158958 - DNA, 25 bp, Rattus norvegicus
agtctaaacccatgatccagtctct

SEQ ID NO: 158959 - DNA, 25 bp, Rattus norvegicus
agtctaaatcaaaaggccagcccga

SEQ ID NO: 158960 - DNA, 25 bp, Rattus norvegicus
agtctaaatcaataggccagcccga

SEQ ID NO: 158961 - DNA, 25 bp, Rattus norvegicus
agtctaacctacccgagatacgtct

SEQ ID NO: 158962 - DNA, 25 bp, Rattus norvegicus
agtctaacctacgcgagatacgtct

SEQ ID NO: 158963 - DNA, 25 bp, Rattus norvegicus
agtctaacgtggactcctttcgcct

SEQ ID NO: 158964 - DNA, 25 bp, Rattus norvegicus
agtctaacgtggtctcctttcgcct

SEQ ID NO: 158965 - DNA, 25 bp, Rattus norvegicus
agtctaactgacattctgtttccca

SEQ ID NO: 158966 - DNA, 25 bp, Rattus norvegicus
agtctaactgactttctgtttccca

SEQ ID NO: 158967 - DNA, 25 bp, Rattus norvegicus
agtctaacttcactgcacagcctag

SEQ ID NO: 158968 - DNA, 25 bp, Rattus norvegicus
agtctaacttcagtgcacagcctag

SEQ ID NO: 158969 - DNA, 25 bp, Rattus norvegicus
agtctaagcaaaccgcgactcggct

SEQ ID NO: 158970 - DNA, 25 bp, Rattus norvegicus
agtctaagcaaagcgcgactcggct

SEQ ID NO: 158971 - DNA, 25 bp, Rattus norvegicus
agtctaagcccactaatttgttcag

SEQ ID NO: 158972 - DNA, 25 bp, Rattus norvegicus
agtctaagcccagtaatttgttcag

SEQ ID NO: 158973 - DNA, 25 bp, Rattus norvegicus
agtctaagtattatgccccacgttg

SEQ ID NO: 158974 - DNA, 25 bp, Rattus norvegicus
agtctaagtattttgccccacgttg

SEQ ID NO: 158975 - DNA, 25 bp, Rattus norvegicus
agtctaagttgcaaaatggctgctt

SEQ ID NO: 158976 - DNA, 25 bp, Rattus norvegicus
agtctaagttgctaaatggctgctt

SEQ ID NO: 158977 - DNA, 25 bp, Rattus norvegicus
agtctaatcagcagcagcatgcgca

SEQ ID NO: 158978 - DNA, 25 bp, Rattus norvegicus
agtctaatcagctgcagcatgcgca

SEQ ID NO: 158979 - DNA, 25 bp, Rattus norvegicus
agtctaatctgtcttgcttccacga

SEQ ID NO: 158980 - DNA, 25 bp, Rattus norvegicus
agtctaatctgtgttgcttccacga

SEQ ID NO: 158981 - DNA, 25 bp, Rattus norvegicus
agtctacaacctctcgagctgcctg

SEQ ID NO: 158982 - DNA, 25 bp, Rattus norvegicus
agtctacaacctgtcgagctgcctg

SEQ ID NO: 158983 - DNA, 25 bp, Rattus norvegicus
agtctacaccccagctctagtgaca

SEQ ID NO: 158984 - DNA, 25 bp, Rattus norvegicus
agtctacacccctgctctagtgaca

SEQ ID NO: 158985 - DNA, 25 bp, Rattus norvegicus
agtctacatgttactgcatccagat

SEQ ID NO: 158986 - DNA, 25 bp, Rattus norvegicus
agtctacatgtttctgcatccagat

SEQ ID NO: 158987 - DNA, 25 bp, Rattus norvegicus
agtctaccacgcattaaatcccaag

SEQ ID NO: 158988 - DNA, 25 bp, Rattus norvegicus
agtctaccacgctttaaatcccaag

SEQ ID NO: 158989 - DNA, 25 bp, Rattus norvegicus
agtctaccctttatgctgggacagt

SEQ ID NO: 158990 - DNA, 25 bp, Rattus norvegicus
agtctaccctttttgctgggacagt

SEQ ID NO: 158991 - DNA, 25 bp, Rattus norvegicus
agtctaccgtcccaatgtttgaagg

SEQ ID NO: 158992 - DNA, 25 bp, Rattus norvegicus
agtctaccgtccgaatgtttgaagg

SEQ ID NO: 158993 - DNA, 25 bp, Rattus norvegicus
agtctacgaggtctctcccatgata

SEQ ID NO: 158994 - DNA, 25 bp, Rattus norvegicus
agtctacgaggtgtctcccatgata

SEQ ID NO: 158995 - DNA, 25 bp, Rattus norvegicus
agtctacgtagtctggcacccgagt

SEQ ID NO: 158996 - DNA, 25 bp, Rattus norvegicus
agtctacgtagtgtggcacccgagt

SEQ ID NO: 158997 - DNA, 25 bp, Rattus norvegicus
agtctacgtcgaactttctttgcta

SEQ ID NO: 158998 - DNA, 25 bp, Rattus norvegicus
agtctacgtcgatctttctttgcta

SEQ ID NO: 158999 - DNA, 25 bp, Rattus norvegicus
agtctactaagcaccgacaatccta

SEQ ID NO: 159000 - DNA, 25 bp, Rattus norvegicus
agtctactaagctccgacaatccta

SEQ ID NO: 159001 - DNA, 25 bp, Rattus norvegicus
agtctactatgtcccctgtattttc

SEQ ID NO: 159002 - DNA, 25 bp, Rattus norvegicus
agtctactatgtgccctgtattttc

SEQ ID NO: 159003 - DNA, 25 bp, Rattus norvegicus
agtctactccgccatcaggaaatgt

SEQ ID NO: 159004 - DNA, 25 bp, Rattus norvegicus
agtctactccgcgatcaggaaatgt

SEQ ID NO: 159005 - DNA, 25 bp, Rattus norvegicus
agtctactgagtacatttctcattg

SEQ ID NO: 159006 - DNA, 25 bp, Rattus norvegicus
agtctactgagttcatttctcattg

SEQ ID NO: 159007 - DNA, 25 bp, Rattus norvegicus
agtctactgtatatgctcacctata

SEQ ID NO: 159008 - DNA, 25 bp, Rattus norvegicus
agtctactgtatttgctcacctata

SEQ ID NO: 159009 - DNA, 25 bp, Rattus norvegicus
agtctactttctaatccactgagga

SEQ ID NO: 159010 - DNA, 25 bp, Rattus norvegicus
agtctactttcttatccactgagga

SEQ ID NO: 159011 - DNA, 25 bp, Rattus norvegicus
agtctagacccaacctttggaggaa

SEQ ID NO: 159012 - DNA, 25 bp, Rattus norvegicus
agtctagacccatcctttggaggaa

SEQ ID NO: 159013 - DNA, 25 bp, Rattus norvegicus
agtctagcagcacgcacatgtttgt

SEQ ID NO: 159014 - DNA, 25 bp, Rattus norvegicus
agtctagcagcaggcacatgtttgt

SEQ ID NO: 159015 - DNA, 25 bp, Rattus norvegicus
agtctagcagtaccactggcatggt

SEQ ID NO: 159016 - DNA, 25 bp, Rattus norvegicus
agtctagcagtagcactggcatggt

SEQ ID NO: 159017 - DNA, 25 bp, Rattus norvegicus
agtctagccatgaactcttgaccct

SEQ ID NO: 159018 - DNA, 25 bp, Rattus norvegicus
agtctagccatgtactcttgaccct

SEQ ID NO: 159019 - DNA, 25 bp, Rattus norvegicus
agtctagccgctcggctgcatgttg

SEQ ID NO: 159020 - DNA, 25 bp, Rattus norvegicus
agtctagccgctgggctgcatgttg

SEQ ID NO: 159021 - DNA, 25 bp, Rattus norvegicus
agtctagccgttcagggccggccta

SEQ ID NO: 159022 - DNA, 25 bp, Rattus norvegicus
agtctagccgttgagggccggccta

SEQ ID NO: 159023 - DNA, 25 bp, Rattus norvegicus
agtctagcctggacgctctggtggt

SEQ ID NO: 159024 - DNA, 25 bp, Rattus norvegicus
agtctagcctggtcgctctggtggt

SEQ ID NO: 159025 - DNA, 25 bp, Rattus norvegicus
agtctagcgctacaaagctctgcaa

SEQ ID NO: 159026 - DNA, 25 bp, Rattus norvegicus
agtctagcgctagaaagctctgcaa

SEQ ID NO: 159027 - DNA, 25 bp, Rattus norvegicus
agtctagcggatcgcccaacgacgt

SEQ ID NO: 159028 - DNA, 25 bp, Rattus norvegicus
agtctagcggatggcccaacgacgt

SEQ ID NO: 159029 - DNA, 25 bp, Rattus norvegicus
agtctagctcagactaacttagtgc

SEQ ID NO: 159030 - DNA, 25 bp, Rattus norvegicus
agtctagctcagtctaacttagtgc

SEQ ID NO: 159031 - DNA, 25 bp, Rattus norvegicus
agtctagctccaagttcagtctcaa

SEQ ID NO: 159032 - DNA, 25 bp, Rattus norvegicus
agtctagctccatgttcagtctcaa

SEQ ID NO: 159033 - DNA, 25 bp, Rattus norvegicus
agtctagctgcgcacataacctcat

SEQ ID NO: 159034 - DNA, 25 bp, Rattus norvegicus
agtctagctgcggacataacctcat

SEQ ID NO: 159035 - DNA, 25 bp, Rattus norvegicus
agtctagctgtccataccagaagag

SEQ ID NO: 159036 - DNA, 25 bp, Rattus norvegicus
agtctagctgtcgataccagaagag

SEQ ID NO: 159037 - DNA, 25 bp, Rattus norvegicus
agtctaggatgtaggtacacaccga

SEQ ID NO: 159038 - DNA, 25 bp, Rattus norvegicus
agtctaggatgttggtacacaccga

SEQ ID NO: 159039 - DNA, 25 bp, Rattus norvegicus
agtctaggccccaggagccagagca

SEQ ID NO: 159040 - DNA, 25 bp, Rattus norvegicus
agtctaggcccctggagccagagca

SEQ ID NO: 159041 - DNA, 25 bp, Rattus norvegicus
agtctagtccgacctgtctagcatg

SEQ ID NO: 159042 - DNA, 25 bp, Rattus norvegicus
agtctagtccgagctgtctagcatg

SEQ ID NO: 159043 - DNA, 25 bp, Rattus norvegicus
agtctagtttctaaccgtgcatttt

SEQ ID NO: 159044 - DNA, 25 bp, Rattus norvegicus
agtctagtttcttaccgtgcatttt

SEQ ID NO: 159045 - DNA, 25 bp, Rattus norvegicus
agtctataagctctctgttggttcc

SEQ ID NO: 159046 - DNA, 25 bp, Rattus norvegicus
agtctataagctgtctgttggttcc

SEQ ID NO: 159047 - DNA, 25 bp, Rattus norvegicus
agtctatacactagctggattttat

SEQ ID NO: 159048 - DNA, 25 bp, Rattus norvegicus
agtctatacacttgctggattttat

SEQ ID NO: 159049 - DNA, 25 bp, Rattus norvegicus
agtctatacagaaaccttgggcttg

SEQ ID NO: 159050 - DNA, 25 bp, Rattus norvegicus
agtctatacagataccttgggcttg

SEQ ID NO: 159051 - DNA, 25 bp, Rattus norvegicus
agtctataccaactcatgctgatgc

SEQ ID NO: 159052 - DNA, 25 bp, Rattus norvegicus
agtctataccaagtcatgctgatgc

SEQ ID NO: 159053 - DNA, 25 bp, Rattus norvegicus
agtctatacctgagaatatacccaa

SEQ ID NO: 159054 - DNA, 25 bp, Rattus norvegicus
agtctatacctgtgaatatacccaa

SEQ ID NO: 159055 - DNA, 25 bp, Rattus norvegicus
agtctatatgacacacctgctctag

SEQ ID NO: 159056 - DNA, 25 bp, Rattus norvegicus
agtctatatgactcacctgctctag

SEQ ID NO: 159057 - DNA, 25 bp, Rattus norvegicus
agtctatcaactccgctatatccca

SEQ ID NO: 159058 - DNA, 25 bp, Rattus norvegicus
agtctatcaactgcgctatatccca

SEQ ID NO: 159059 - DNA, 25 bp, Rattus norvegicus
agtctatccctactgtccaacagga

SEQ ID NO: 159060 - DNA, 25 bp, Rattus norvegicus
agtctatccctagtgtccaacagga

SEQ ID NO: 159061 - DNA, 25 bp, Rattus norvegicus
agtctatcctgcaatgcctcggaga

SEQ ID NO: 159062 - DNA, 25 bp, Rattus norvegicus
agtctatcctgctatgcctcggaga

SEQ ID NO: 159063 - DNA, 25 bp, Rattus norvegicus
agtctatctagaacaacacatttgg

SEQ ID NO: 159064 - DNA, 25 bp, Rattus norvegicus
agtctatctagatcaacacatttgg

SEQ ID NO: 159065 - DNA, 25 bp, Rattus norvegicus
agtctatgaggtcctttgctactgc

SEQ ID NO: 159066 - DNA, 25 bp, Rattus norvegicus
agtctatgaggtgctttgctactgc

SEQ ID NO: 159067 - DNA, 25 bp, Rattus norvegicus
agtctatgcttcactcacgcagact

SEQ ID NO: 159068 - DNA, 25 bp, Rattus norvegicus
agtctatgcttctctcacgcagact

SEQ ID NO: 159069 - DNA, 25 bp, Rattus norvegicus
agtctatggcagctgagtctcttaa

SEQ ID NO: 159070 - DNA, 25 bp, Rattus norvegicus
agtctatggcaggtgagtctcttaa

SEQ ID NO: 159071 - DNA, 25 bp, Rattus norvegicus
agtctatgtagacgcttatattttg

SEQ ID NO: 159072 - DNA, 25 bp, Rattus norvegicus
agtctatgtagaggcttatattttg

SEQ ID NO: 159073 - DNA, 25 bp, Rattus norvegicus
agtctattagatatgcgctgctgga

SEQ ID NO: 159074 - DNA, 25 bp, Rattus norvegicus
agtctattagatttgcgctgctgga

SEQ ID NO: 159075 - DNA, 25 bp, Rattus norvegicus
agtctattccttatgtcagatttac

SEQ ID NO: 159076 - DNA, 25 bp, Rattus norvegicus
agtctattccttttgtcagatttac

SEQ ID NO: 159077 - DNA, 25 bp, Rattus norvegicus
agtctattgaccaggaaccttcaca

SEQ ID NO: 159078 - DNA, 25 bp, Rattus norvegicus
agtctattgacctggaaccttcaca

SEQ ID NO: 159079 - DNA, 25 bp, Rattus norvegicus
agtctatttataactgcctgcctac

SEQ ID NO: 159080 - DNA, 25 bp, Rattus norvegicus
agtctatttatatctgcctgcctac

SEQ ID NO: 159081 - DNA, 25 bp, Rattus norvegicus
agtctatttattaaccgggctctgt

SEQ ID NO: 159082 - DNA, 25 bp, Rattus norvegicus
agtctatttatttaccgggctctgt

SEQ ID NO: 159083 - DNA, 25 bp, Rattus norvegicus
agtctattttcacgtctccttgggt

SEQ ID NO: 159084 - DNA, 25 bp, Rattus norvegicus
agtctattttcaggtctccttgggt

SEQ ID NO: 159085 - DNA, 25 bp, Rattus norvegicus
agtctcaaaagaatccatgttcagg

SEQ ID NO: 159086 - DNA, 25 bp, Rattus norvegicus
agtctcaaaagattccatgttcagg

SEQ ID NO: 159087 - DNA, 25 bp, Rattus norvegicus
agtctcaaccatcaagcctggctta

SEQ ID NO: 159088 - DNA, 25 bp, Rattus norvegicus
agtctcaaccatgaagcctggctta

SEQ ID NO: 159089 - DNA, 25 bp, Rattus norvegicus
agtctcaagtccagtgcgagtgctt

SEQ ID NO: 159090 - DNA, 25 bp, Rattus norvegicus
agtctcaagtcctgtgcgagtgctt

SEQ ID NO: 159091 - DNA, 25 bp, Rattus norvegicus
agtctcacaagacgtgcctgcctat

SEQ ID NO: 159092 - DNA, 25 bp, Rattus norvegicus
agtctcacaagaggtgcctgcctat

SEQ ID NO: 159093 - DNA, 25 bp, Rattus norvegicus
agtctcacacgtccagttttgttga

SEQ ID NO: 159094 - DNA, 25 bp, Rattus norvegicus
agtctcacacgtgcagttttgttga

SEQ ID NO: 159095 - DNA, 25 bp, Rattus norvegicus
agtctcacagagaacattagcttta

SEQ ID NO: 159096 - DNA, 25 bp, Rattus norvegicus
agtctcacagagtacattagcttta

SEQ ID NO: 159097 - DNA, 25 bp, Rattus norvegicus
agtctcacagctcgttgctggtgga

SEQ ID NO: 159098 - DNA, 25 bp, Rattus norvegicus
agtctcacagctggttgctggtgga

SEQ ID NO: 159099 - DNA, 25 bp, Rattus norvegicus
agtctcacagttactctttttattc

SEQ ID NO: 159100 - DNA, 25 bp, Rattus norvegicus
agtctcacagtttctctttttattc

SEQ ID NO: 159101 - DNA, 25 bp, Rattus norvegicus
agtctcacgagtctctgtggagcca

SEQ ID NO: 159102 - DNA, 25 bp, Rattus norvegicus
agtctcacgagtgtctgtggagcca

SEQ ID NO: 159103 - DNA, 25 bp, Rattus norvegicus
agtctcacgggacctgtgtgttcta

SEQ ID NO: 159104 - DNA, 25 bp, Rattus norvegicus
agtctcacgggagctgtgtgttcta

SEQ ID NO: 159105 - DNA, 25 bp, Rattus norvegicus
agtctcacgggtatacttatacaga

SEQ ID NO: 159106 - DNA, 25 bp, Rattus norvegicus
agtctcacgggtttacttatacaga

SEQ ID NO: 159107 - DNA, 25 bp, Rattus norvegicus
agtctcactacgaagccctggtggc

SEQ ID NO: 159108 - DNA, 25 bp, Rattus norvegicus
agtctcactacgtagccctggtggc

SEQ ID NO: 159109 - DNA, 25 bp, Rattus norvegicus
agtctcactgtacaagacctcgtcg

SEQ ID NO: 159110 - DNA, 25 bp, Rattus norvegicus
agtctcactgtagaagacctcgtcg

SEQ ID NO: 159111 - DNA, 25 bp, Rattus norvegicus
agtctcactttccagcttaacaatg

SEQ ID NO: 159112 - DNA, 25 bp, Rattus norvegicus
agtctcactttcgagcttaacaatg

SEQ ID NO: 159113 - DNA, 25 bp, Rattus norvegicus
agtctcagaagtctatggtccccga

SEQ ID NO: 159114 - DNA, 25 bp, Rattus norvegicus
agtctcagaagtgtatggtccccga

SEQ ID NO: 159115 - DNA, 25 bp, Rattus norvegicus
agtctcagagttaccatacatcaat

SEQ ID NO: 159116 - DNA, 25 bp, Rattus norvegicus
agtctcagagtttccatacatcaat

SEQ ID NO: 159117 - DNA, 25 bp, Rattus norvegicus
agtctcagatcaattttcctgctct

SEQ ID NO: 159118 - DNA, 25 bp, Rattus norvegicus
agtctcagatcatttttcctgctct

SEQ ID NO: 159119 - DNA, 25 bp, Rattus norvegicus
agtctcagatgtattgctgcattta

SEQ ID NO: 159120 - DNA, 25 bp, Rattus norvegicus
agtctcagatgttttgctgcattta

SEQ ID NO: 159121 - DNA, 25 bp, Rattus norvegicus
agtctcagattgctgggccgttcca

SEQ ID NO: 159122 - DNA, 25 bp, Rattus norvegicus
agtctcagattggtgggccgttcca

SEQ ID NO: 159123 - DNA, 25 bp, Rattus norvegicus
agtctcagctagacctgtgcagaga

SEQ ID NO: 159124 - DNA, 25 bp, Rattus norvegicus
agtctcagctagtcctgtgcagaga

SEQ ID NO: 159125 - DNA, 25 bp, Rattus norvegicus
agtctcagctcactggtctctagtt

SEQ ID NO: 159126 - DNA, 25 bp, Rattus norvegicus
agtctcagctcagtggtctctagtt

SEQ ID NO: 159127 - DNA, 25 bp, Rattus norvegicus
agtctcagctctaggaacctactta

SEQ ID NO: 159128 - DNA, 25 bp, Rattus norvegicus
agtctcagctcttggaacctactta

SEQ ID NO: 159129 - DNA, 25 bp, Rattus norvegicus
agtctcagctttacagggtcactta

SEQ ID NO: 159130 - DNA, 25 bp, Rattus norvegicus
agtctcagctttcctgcaagaccag

SEQ ID NO: 159131 - DNA, 25 bp, Rattus norvegicus
agtctcagctttgctgcaagaccag

SEQ ID NO: 159132 - DNA, 25 bp, Rattus norvegicus
agtctcagcttttcagggtcactta

SEQ ID NO: 159133 - DNA, 25 bp, Rattus norvegicus
agtctcaggctaccgatttgtcggc

SEQ ID NO: 159134 - DNA, 25 bp, Rattus norvegicus
agtctcaggctagcgatttgtcggc

SEQ ID NO: 159135 - DNA, 25 bp, Rattus norvegicus
agtctcagggcgagggctggacgag

SEQ ID NO: 159136 - DNA, 25 bp, Rattus norvegicus
agtctcagggcgtgggctggacgag

SEQ ID NO: 159137 - DNA, 25 bp, Rattus norvegicus
agtctcagggttagtgctctaggga

SEQ ID NO: 159138 - DNA, 25 bp, Rattus norvegicus
agtctcagggtttgtgctctaggga

SEQ ID NO: 159139 - DNA, 25 bp, Rattus norvegicus
agtctcagtagtcatctctcaggca

SEQ ID NO: 159140 - DNA, 25 bp, Rattus norvegicus
agtctcagtagtgatctctcaggca

SEQ ID NO: 159141 - DNA, 25 bp, Rattus norvegicus
agtctcagtcttattactgcagaat

SEQ ID NO: 159142 - DNA, 25 bp, Rattus norvegicus
agtctcagtctttttactgcagaat

SEQ ID NO: 159143 - DNA, 25 bp, Rattus norvegicus
agtctcagtttcattctcagtatgg

SEQ ID NO: 159144 - DNA, 25 bp, Rattus norvegicus
agtctcagtttctttctcagtatgg

SEQ ID NO: 159145 - DNA, 25 bp, Rattus norvegicus
agtctcatcattagggttcccatgg

SEQ ID NO: 159146 - DNA, 25 bp, Rattus norvegicus
agtctcatcatttgggttcccatgg

SEQ ID NO: 159147 - DNA, 25 bp, Rattus norvegicus
agtctcatgcccagtgtagacacta

SEQ ID NO: 159148 - DNA, 25 bp, Rattus norvegicus
agtctcatgcccctgaaattatggt

SEQ ID NO: 159149 - DNA, 25 bp, Rattus norvegicus
agtctcatgcccgtgaaattatggt

SEQ ID NO: 159150 - DNA, 25 bp, Rattus norvegicus
agtctcatgccctgtgtagacacta

SEQ ID NO: 159151 - DNA, 25 bp, Rattus norvegicus
agtctcatggacctagtgacacacc

SEQ ID NO: 159152 - DNA, 25 bp, Rattus norvegicus
agtctcatggacgtagtgacacacc

SEQ ID NO: 159153 - DNA, 25 bp, Rattus norvegicus
agtctcattcttaatcgggcattca

SEQ ID NO: 159154 - DNA, 25 bp, Rattus norvegicus
agtctcattctttatcgggcattca

SEQ ID NO: 159155 - DNA, 25 bp, Rattus norvegicus
agtctcatttgcatcaaggtctctc

SEQ ID NO: 159156 - DNA, 25 bp, Rattus norvegicus
agtctcatttgcttcaaggtctctc

SEQ ID NO: 159157 - DNA, 25 bp, Rattus norvegicus
agtctcatttttcaaccatctcagc

SEQ ID NO: 159158 - DNA, 25 bp, Rattus norvegicus
agtctcatttttgaaccatctcagc

SEQ ID NO: 159159 - DNA, 25 bp, Rattus norvegicus
agtctccaaaacagtagcatttcac

SEQ ID NO: 159160 - DNA, 25 bp, Rattus norvegicus
agtctccaaaactgtagcatttcac

SEQ ID NO: 159161 - DNA, 25 bp, Rattus norvegicus
agtctccaaagacccattggacaga

SEQ ID NO: 159162 - DNA, 25 bp, Rattus norvegicus
agtctccaaagagccattggacaga

SEQ ID NO: 159163 - DNA, 25 bp, Rattus norvegicus
agtctccaaatactgaaggccccat

SEQ ID NO: 159164 - DNA, 25 bp, Rattus norvegicus
agtctccaaatagtgaaggccccat

SEQ ID NO: 159165 - DNA, 25 bp, Rattus norvegicus
agtctccaaggtatccttgtctgcc

SEQ ID NO: 159166 - DNA, 25 bp, Rattus norvegicus
agtctccaaggtttccttgtctgcc

SEQ ID NO: 159167 - DNA, 25 bp, Rattus norvegicus
agtctccacagaacccagaggaagg

SEQ ID NO: 159168 - DNA, 25 bp, Rattus norvegicus
agtctccacagatcccagaggaagg

SEQ ID NO: 159169 - DNA, 25 bp, Rattus norvegicus
agtctccacatcctaaaggctttta

SEQ ID NO: 159170 - DNA, 25 bp, Rattus norvegicus
agtctccacatcgtaaaggctttta

SEQ ID NO: 159171 - DNA, 25 bp, Rattus norvegicus
agtctccactggaccctgtaggtgt

SEQ ID NO: 159172 - DNA, 25 bp, Rattus norvegicus
agtctccactggtccctgtaggtgt

SEQ ID NO: 159173 - DNA, 25 bp, Rattus norvegicus
agtctccagaacaatccacgatgca

SEQ ID NO: 159174 - DNA, 25 bp, Rattus norvegicus
agtctccagaaccactgcactggct

SEQ ID NO: 159175 - DNA, 25 bp, Rattus norvegicus
agtctccagaacgactgcactggct

SEQ ID NO: 159176 - DNA, 25 bp, Rattus norvegicus
agtctccagaactatccacgatgca

SEQ ID NO: 159177 - DNA, 25 bp, Rattus norvegicus
agtctccagaatcttcccgttcctt

SEQ ID NO: 159178 - DNA, 25 bp, Rattus norvegicus
agtctccagaatgttcccgttcctt

SEQ ID NO: 159179 - DNA, 25 bp, Rattus norvegicus
agtctccagagtatctagttctgcc

SEQ ID NO: 159180 - DNA, 25 bp, Rattus norvegicus
agtctccagagtttctagttctgcc

SEQ ID NO: 159181 - DNA, 25 bp, Rattus norvegicus
agtctccagggacagcattgcttcc

SEQ ID NO: 159182 - DNA, 25 bp, Rattus norvegicus
agtctccagggagagcattgcttcc

SEQ ID NO: 159183 - DNA, 25 bp, Rattus norvegicus
agtctccatggcaccacagggtcac

SEQ ID NO: 159184 - DNA, 25 bp, Rattus norvegicus
agtctccatggctccacagggtcac

SEQ ID NO: 159185 - DNA, 25 bp, Rattus norvegicus
agtctccatttcatactgtctgttg

SEQ ID NO: 159186 - DNA, 25 bp, Rattus norvegicus
agtctccatttcttactgtctgttg

SEQ ID NO: 159187 - DNA, 25 bp, Rattus norvegicus
agtctcccaagaccaattctggctg

SEQ ID NO: 159188 - DNA, 25 bp, Rattus norvegicus
agtctcccaagagcaattctggctg

SEQ ID NO: 159189 - DNA, 25 bp, Rattus norvegicus
agtctcccaagcctacttactgaaa

SEQ ID NO: 159190 - DNA, 25 bp, Rattus norvegicus
agtctcccaagcgtacttactgaaa

SEQ ID NO: 159191 - DNA, 25 bp, Rattus norvegicus
agtctcccaagtcctgatattacag

SEQ ID NO: 159192 - DNA, 25 bp, Rattus norvegicus
agtctcccaagtgctgatattacag

SEQ ID NO: 159193 - DNA, 25 bp, Rattus norvegicus
agtctcccaggtatgtgttcaaggt

SEQ ID NO: 159194 - DNA, 25 bp, Rattus norvegicus
agtctcccaggtttgtgttcaaggt

SEQ ID NO: 159195 - DNA, 25 bp, Rattus norvegicus
agtctccctctgcagtgtccagtga

SEQ ID NO: 159196 - DNA, 25 bp, Rattus norvegicus
agtctccctctggagtgtccagtga

SEQ ID NO: 159197 - DNA, 25 bp, Rattus norvegicus
agtctccctgcaactgtaatattgt

SEQ ID NO: 159198 - DNA, 25 bp, Rattus norvegicus
agtctccctgcaaggctactgtgtt

SEQ ID NO: 159199 - DNA, 25 bp, Rattus norvegicus
agtctccctgcatctgtaatattgt

SEQ ID NO: 159200 - DNA, 25 bp, Rattus norvegicus
agtctccctgcatggctactgtgtt

SEQ ID NO: 159201 - DNA, 25 bp, Rattus norvegicus
agtctccctgctaatgataccaagt

SEQ ID NO: 159202 - DNA, 25 bp, Rattus norvegicus
agtctccctgcttatgataccaagt

SEQ ID NO: 159203 - DNA, 25 bp, Rattus norvegicus
agtctccctggtcatatgtgcacat

SEQ ID NO: 159204 - DNA, 25 bp, Rattus norvegicus
agtctccctggtgatatgtgcacat

SEQ ID NO: 159205 - DNA, 25 bp, Rattus norvegicus
agtctccctgttctagcactgggca

SEQ ID NO: 159206 - DNA, 25 bp, Rattus norvegicus
agtctccctgttgtagcactgggca

SEQ ID NO: 159207 - DNA, 25 bp, Rattus norvegicus
agtctcccttggatggtggccttaa

SEQ ID NO: 159208 - DNA, 25 bp, Rattus norvegicus
agtctcccttggttggtggccttaa

SEQ ID NO: 159209 - DNA, 25 bp, Rattus norvegicus
agtctccctttgcttttgttacgtg

SEQ ID NO: 159210 - DNA, 25 bp, Rattus norvegicus
agtctccctttggttttgttacgtg

SEQ ID NO: 159211 - DNA, 25 bp, Rattus norvegicus
agtctccgcaagacacctcaaagag

SEQ ID NO: 159212 - DNA, 25 bp, Rattus norvegicus
agtctccgcaagtcacctcaaagag

SEQ ID NO: 159213 - DNA, 25 bp, Rattus norvegicus
agtctccggcgaaaagtctggtgtg

SEQ ID NO: 159214 - DNA, 25 bp, Rattus norvegicus
agtctccggcgataagtctggtgtg

SEQ ID NO: 159215 - DNA, 25 bp, Rattus norvegicus
agtctccgtaatcacatctggcctc

SEQ ID NO: 159216 - DNA, 25 bp, Rattus norvegicus
agtctccgtaatgacatctggcctc

SEQ ID NO: 159217 - DNA, 25 bp, Rattus norvegicus
agtctccgtgaacctgaaaatgacg

SEQ ID NO: 159218 - DNA, 25 bp, Rattus norvegicus
agtctccgtgaagctgaaaatgacg

SEQ ID NO: 159219 - DNA, 25 bp, Rattus norvegicus
agtctccgtgacagggctaggaaaa

SEQ ID NO: 159220 - DNA, 25 bp, Rattus norvegicus
agtctccgtgactgggctaggaaaa

SEQ ID NO: 159221 - DNA, 25 bp, Rattus norvegicus
agtctccgttatcaactccttgagg

SEQ ID NO: 159222 - DNA, 25 bp, Rattus norvegicus
agtctccgttatgaactccttgagg

SEQ ID NO: 159223 - DNA, 25 bp, Rattus norvegicus
agtctcctaagccagtgtctctgag

SEQ ID NO: 159224 - DNA, 25 bp, Rattus norvegicus
agtctcctaagcgagtgtctctgag

SEQ ID NO: 159225 - DNA, 25 bp, Rattus norvegicus
agtctcctacacacactgaagatga

SEQ ID NO: 159226 - DNA, 25 bp, Rattus norvegicus
agtctcctacactcactgaagatga

SEQ ID NO: 159227 - DNA, 25 bp, Rattus norvegicus
agtctcctaccaagcccatcagaag

SEQ ID NO: 159228 - DNA, 25 bp, Rattus norvegicus
agtctcctaccatgcccatcagaag

SEQ ID NO: 159229 - DNA, 25 bp, Rattus norvegicus
agtctcctcgacaacacattgagtt

SEQ ID NO: 159230 - DNA, 25 bp, Rattus norvegicus
agtctcctcgactacacattgagtt

SEQ ID NO: 159231 - DNA, 25 bp, Rattus norvegicus
agtctcctctcacggcttctagtaa

SEQ ID NO: 159232 - DNA, 25 bp, Rattus norvegicus
agtctcctctcagggcttctagtaa

SEQ ID NO: 159233 - DNA, 25 bp, Rattus norvegicus
agtctcctctttctttctaaattca

SEQ ID NO: 159234 - DNA, 25 bp, Rattus norvegicus
agtctcctctttgtttctaaattca

SEQ ID NO: 159235 - DNA, 25 bp, Rattus norvegicus
agtctcctgagcctgaacatcgaat

SEQ ID NO: 159236 - DNA, 25 bp, Rattus norvegicus
agtctcctgagcgtgaacatcgaat

SEQ ID NO: 159237 - DNA, 25 bp, Rattus norvegicus
agtctcctgcctctcttaagatagt

SEQ ID NO: 159238 - DNA, 25 bp, Rattus norvegicus
agtctcctgcctgtcttaagatagt

SEQ ID NO: 159239 - DNA, 25 bp, Rattus norvegicus
agtctcctggagatgccttttttct

SEQ ID NO: 159240 - DNA, 25 bp, Rattus norvegicus
agtctcctggagttgccttttttct

SEQ ID NO: 159241 - DNA, 25 bp, Rattus norvegicus
agtctcctgggtccttagcatgtgg

SEQ ID NO: 159242 - DNA, 25 bp, Rattus norvegicus
agtctcctgggtgcttagcatgtgg

SEQ ID NO: 159243 - DNA, 25 bp, Rattus norvegicus
agtctcctgtgcaaagattcacttt

SEQ ID NO: 159244 - DNA, 25 bp, Rattus norvegicus
agtctcctgtgctaagattcacttt

SEQ ID NO: 159245 - DNA, 25 bp, Rattus norvegicus
agtctcctgtggaaccagctcacag

SEQ ID NO: 159246 - DNA, 25 bp, Rattus norvegicus
agtctcctgtggtaccagctcacag

SEQ ID NO: 159247 - DNA, 25 bp, Rattus norvegicus
agtctccttactagtagcttctgtg

SEQ ID NO: 159248 - DNA, 25 bp, Rattus norvegicus
agtctccttacttgtagcttctgtg

SEQ ID NO: 159249 - DNA, 25 bp, Rattus norvegicus
agtctcctttgcagacagctactag

SEQ ID NO: 159250 - DNA, 25 bp, Rattus norvegicus
agtctcctttgctgacagctactag

SEQ ID NO: 159251 - DNA, 25 bp, Rattus norvegicus
agtctcctttgtctctttgttcaga

SEQ ID NO: 159252 - DNA, 25 bp, Rattus norvegicus
agtctcctttgtgtctttgttcaga

SEQ ID NO: 159253 - DNA, 25 bp, Rattus norvegicus
agtctccttttcatttcttacgtct

SEQ ID NO: 159254 - DNA, 25 bp, Rattus norvegicus
agtctccttttcttttcttacgtct

SEQ ID NO: 159255 - DNA, 25 bp, Rattus norvegicus
agtctcgaactcactgtacagtttg

SEQ ID NO: 159256 - DNA, 25 bp, Rattus norvegicus
agtctcgaactctctgtacagtttg

SEQ ID NO: 159257 - DNA, 25 bp, Rattus norvegicus
agtctcgccgacctgcaatagcatt

SEQ ID NO: 159258 - DNA, 25 bp, Rattus norvegicus
agtctcgccgacgtgcaatagcatt

SEQ ID NO: 159259 - DNA, 25 bp, Rattus norvegicus
agtctcgccgagaatccctggatag

SEQ ID NO: 159260 - DNA, 25 bp, Rattus norvegicus
agtctcgccgagtatccctggatag

SEQ ID NO: 159261 - DNA, 25 bp, Rattus norvegicus
agtctcgctgccaatgagttgagct

SEQ ID NO: 159262 - DNA, 25 bp, Rattus norvegicus
agtctcgctgcctatgagttgagct

SEQ ID NO: 159263 - DNA, 25 bp, Rattus norvegicus
agtctcggcactcacacacacttgg

SEQ ID NO: 159264 - DNA, 25 bp, Rattus norvegicus
agtctcggcactgacacacacttgg

SEQ ID NO: 159265 - DNA, 25 bp, Rattus norvegicus
agtctcggcgacctgtgcagccaga

SEQ ID NO: 159266 - DNA, 25 bp, Rattus norvegicus
agtctcggcgacgtgtgcagccaga

SEQ ID NO: 159267 - DNA, 25 bp, Rattus norvegicus
agtctcgggcttagtctggaggaca

SEQ ID NO: 159268 - DNA, 25 bp, Rattus norvegicus
agtctcgggctttgtctggaggaca

SEQ ID NO: 159269 - DNA, 25 bp, Rattus norvegicus
agtctcgtagtcacgttactttaga

SEQ ID NO: 159270 - DNA, 25 bp, Rattus norvegicus
agtctcgtagtctcgttactttaga

SEQ ID NO: 159271 - DNA, 25 bp, Rattus norvegicus
agtctcgtggaaccgaagatcccca

SEQ ID NO: 159272 - DNA, 25 bp, Rattus norvegicus
agtctcgtggaagcgaagatcccca

SEQ ID NO: 159273 - DNA, 25 bp, Rattus norvegicus
agtctcgtgtttattattccttaag

SEQ ID NO: 159274 - DNA, 25 bp, Rattus norvegicus
agtctcgtgttttttattccttaag

SEQ ID NO: 159275 - DNA, 25 bp, Rattus norvegicus
agtctcgttacaactatatcctgtg

SEQ ID NO: 159276 - DNA, 25 bp, Rattus norvegicus
agtctcgttacatctatatcctgtg

SEQ ID NO: 159277 - DNA, 25 bp, Rattus norvegicus
agtctctaaagccaaatccgccctt

SEQ ID NO: 159278 - DNA, 25 bp, Rattus norvegicus
agtctctaaagcgaaatccgccctt

SEQ ID NO: 159279 - DNA, 25 bp, Rattus norvegicus
agtctctagagtccagtgtgtcttc

SEQ ID NO: 159280 - DNA, 25 bp, Rattus norvegicus
agtctctagagtgcagtgtgtcttc

SEQ ID NO: 159281 - DNA, 25 bp, Rattus norvegicus
agtctctagccaccctgagttatgt

SEQ ID NO: 159282 - DNA, 25 bp, Rattus norvegicus
agtctctagccagcctgagttatgt

SEQ ID NO: 159283 - DNA, 25 bp, Rattus norvegicus
agtctctatgacacttctgtttgtg

SEQ ID NO: 159284 - DNA, 25 bp, Rattus norvegicus
agtctctatgactcttctgtttgtg

SEQ ID NO: 159285 - DNA, 25 bp, Rattus norvegicus
agtctctatgagacctgtctgaaga

SEQ ID NO: 159286 - DNA, 25 bp, Rattus norvegicus
agtctctatgagtcctgtctgaaga

SEQ ID NO: 159287 - DNA, 25 bp, Rattus norvegicus
agtctctatgccatgggtatctatc

SEQ ID NO: 159288 - DNA, 25 bp, Rattus norvegicus
agtctctatgccttgggtatctatc

SEQ ID NO: 159289 - DNA, 25 bp, Rattus norvegicus
agtctctcaaacagtctggtttttt

SEQ ID NO: 159290 - DNA, 25 bp, Rattus norvegicus
agtctctcaaacatctctcaacagc

SEQ ID NO: 159291 - DNA, 25 bp, Rattus norvegicus
agtctctcaaactgtctggtttttt

SEQ ID NO: 159292 - DNA, 25 bp, Rattus norvegicus
agtctctcaaacttctctcaacagc

SEQ ID NO: 159293 - DNA, 25 bp, Rattus norvegicus
agtctctcaatcatgccatatattt

SEQ ID NO: 159294 - DNA, 25 bp, Rattus norvegicus
agtctctcaatcttgccatatattt

SEQ ID NO: 159295 - DNA, 25 bp, Rattus norvegicus
agtctctcactcagtttgtagccta

SEQ ID NO: 159296 - DNA, 25 bp, Rattus norvegicus
agtctctcactctgtttgtagccta

SEQ ID NO: 159297 - DNA, 25 bp, Rattus norvegicus
agtctctcagtcatgtgccacaggc

SEQ ID NO: 159298 - DNA, 25 bp, Rattus norvegicus
agtctctcagtcttgtgccacaggc

SEQ ID NO: 159299 - DNA, 25 bp, Rattus norvegicus
agtctctcatagaggcttgtgtcag

SEQ ID NO: 159300 - DNA, 25 bp, Rattus norvegicus
agtctctcatagtggcttgtgtcag

SEQ ID NO: 159301 - DNA, 25 bp, Rattus norvegicus
agtctctcatgcacttcgactccat

SEQ ID NO: 159302 - DNA, 25 bp, Rattus norvegicus
agtctctcatgctcttcgactccat

SEQ ID NO: 159303 - DNA, 25 bp, Rattus norvegicus
agtctctccattcgaaagcgtgcag

SEQ ID NO: 159304 - DNA, 25 bp, Rattus norvegicus
agtctctccattggaaagcgtgcag

SEQ ID NO: 159305 - DNA, 25 bp, Rattus norvegicus
agtctctccccactgatcaacaggg

SEQ ID NO: 159306 - DNA, 25 bp, Rattus norvegicus
agtctctccccagtgatcaacaggg

SEQ ID NO: 159307 - DNA, 25 bp, Rattus norvegicus
agtctctccgacagaactgcctctg

SEQ ID NO: 159308 - DNA, 25 bp, Rattus norvegicus
agtctctccgactgaactgcctctg

SEQ ID NO: 159309 - DNA, 25 bp, Rattus norvegicus
agtctctcctgactgctttcaacag

SEQ ID NO: 159310 - DNA, 25 bp, Rattus norvegicus
agtctctcctgagtgctttcaacag

SEQ ID NO: 159311 - DNA, 25 bp, Rattus norvegicus
agtctctctgatactttcctgccag

SEQ ID NO: 159312 - DNA, 25 bp, Rattus norvegicus
agtctctctgattctttcctgccag

SEQ ID NO: 159313 - DNA, 25 bp, Rattus norvegicus
agtctctctgcgaactgtatgcatg

SEQ ID NO: 159314 - DNA, 25 bp, Rattus norvegicus
agtctctctgcgtactgtatgcatg

SEQ ID NO: 159315 - DNA, 25 bp, Rattus norvegicus
agtctctgacccaaacatgttttct

SEQ ID NO: 159316 - DNA, 25 bp, Rattus norvegicus
agtctctgaccctaacatgttttct

SEQ ID NO: 159317 - DNA, 25 bp, Rattus norvegicus
agtctctgacctaaacatgcgtgta

SEQ ID NO: 159318 - DNA, 25 bp, Rattus norvegicus
agtctctgaccttaacatgcgtgta

SEQ ID NO: 159319 - DNA, 25 bp, Rattus norvegicus
agtctctgactgagcacccatatgc

SEQ ID NO: 159320 - DNA, 25 bp, Rattus norvegicus
agtctctgactgtgcacccatatgc

SEQ ID NO: 159321 - DNA, 25 bp, Rattus norvegicus
agtctctgagatagggcctctctga

SEQ ID NO: 159322 - DNA, 25 bp, Rattus norvegicus
agtctctgagattgggcctctctga

SEQ ID NO: 159323 - DNA, 25 bp, Rattus norvegicus
agtctctgaggtagccatgtctgcc

SEQ ID NO: 159324 - DNA, 25 bp, Rattus norvegicus
agtctctgaggttgccatgtctgcc

SEQ ID NO: 159325 - DNA, 25 bp, Rattus norvegicus
agtctctgagtgacccagcttcatg

SEQ ID NO: 159326 - DNA, 25 bp, Rattus norvegicus
agtctctgagtgtcccagcttcatg

SEQ ID NO: 159327 - DNA, 25 bp, Rattus norvegicus
agtctctgcaggacctgagacctat

SEQ ID NO: 159328 - DNA, 25 bp, Rattus norvegicus
agtctctgcaggtcctgagacctat

SEQ ID NO: 159329 - DNA, 25 bp, Rattus norvegicus
agtctctgcctgagggacatcatga

SEQ ID NO: 159330 - DNA, 25 bp, Rattus norvegicus
agtctctgcctgtgggacatcatga

SEQ ID NO: 159331 - DNA, 25 bp, Rattus norvegicus
agtctctgcggtccgtatggccacg

SEQ ID NO: 159332 - DNA, 25 bp, Rattus norvegicus
agtctctgcggtgcgtatggccacg

SEQ ID NO: 159333 - DNA, 25 bp, Rattus norvegicus
agtctctgctctcgtatgattctga

SEQ ID NO: 159334 - DNA, 25 bp, Rattus norvegicus
agtctctgctctggtatgattctga

SEQ ID NO: 159335 - DNA, 25 bp, Rattus norvegicus
agtctctgctgcctttactgttgct

SEQ ID NO: 159336 - DNA, 25 bp, Rattus norvegicus
agtctctgctgcgtttactgttgct

SEQ ID NO: 159337 - DNA, 25 bp, Rattus norvegicus
agtctctgcttgaaccaggtagttc

SEQ ID NO: 159338 - DNA, 25 bp, Rattus norvegicus
agtctctgcttgtaccaggtagttc

SEQ ID NO: 159339 - DNA, 25 bp, Rattus norvegicus
agtctctggaggctttgtctcacca

SEQ ID NO: 159340 - DNA, 25 bp, Rattus norvegicus
agtctctggagggtttgtctcacca

SEQ ID NO: 159341 - DNA, 25 bp, Rattus norvegicus
agtctctggatgacacacatacctg

SEQ ID NO: 159342 - DNA, 25 bp, Rattus norvegicus
agtctctggatgtcacacatacctg

SEQ ID NO: 159343 - DNA, 25 bp, Rattus norvegicus
agtctctgggcgattgactgggcca

SEQ ID NO: 159344 - DNA, 25 bp, Rattus norvegicus
agtctctgggcgtttgactgggcca

SEQ ID NO: 159345 - DNA, 25 bp, Rattus norvegicus
agtctctgtagcctgattctttgtg

SEQ ID NO: 159346 - DNA, 25 bp, Rattus norvegicus
agtctctgtagcgtgattctttgtg

SEQ ID NO: 159347 - DNA, 25 bp, Rattus norvegicus
agtctctgtccccttacagtttagg

SEQ ID NO: 159348 - DNA, 25 bp, Rattus norvegicus
agtctctgtcccgttacagtttagg

SEQ ID NO: 159349 - DNA, 25 bp, Rattus norvegicus
agtctctgtctcaagctgcccaggg

SEQ ID NO: 159350 - DNA, 25 bp, Rattus norvegicus
agtctctgtctctagctgcccaggg

SEQ ID NO: 159351 - DNA, 25 bp, Rattus norvegicus
agtctctgtgctctcaacatagtca

SEQ ID NO: 159352 - DNA, 25 bp, Rattus norvegicus
agtctctgtgctgtcaacatagtca

SEQ ID NO: 159353 - DNA, 25 bp, Rattus norvegicus
agtctctgttccatgatcaggttta

SEQ ID NO: 159354 - DNA, 25 bp, Rattus norvegicus
agtctctgttccttgatcaggttta

SEQ ID NO: 159355 - DNA, 25 bp, Rattus norvegicus
agtctcttaagaacctgccctagaa

SEQ ID NO: 159356 - DNA, 25 bp, Rattus norvegicus
agtctcttaagatcctgccctagaa

SEQ ID NO: 159357 - DNA, 25 bp, Rattus norvegicus
agtctcttaagtcacagccaactac

SEQ ID NO: 159358 - DNA, 25 bp, Rattus norvegicus
agtctcttaagtgacagccaactac

SEQ ID NO: 159359 - DNA, 25 bp, Rattus norvegicus
agtctcttagaaccactctgttggc

SEQ ID NO: 159360 - DNA, 25 bp, Rattus norvegicus
agtctcttagaagcactctgttggc

SEQ ID NO: 159361 - DNA, 25 bp, Rattus norvegicus
agtctcttcacgagagtctgccaga

SEQ ID NO: 159362 - DNA, 25 bp, Rattus norvegicus
agtctcttcacgtgagtctgccaga

SEQ ID NO: 159363 - DNA, 25 bp, Rattus norvegicus
agtctcttcagccttcaccacaggt

SEQ ID NO: 159364 - DNA, 25 bp, Rattus norvegicus
agtctcttcagcgttcaccacaggt

SEQ ID NO: 159365 - DNA, 25 bp, Rattus norvegicus
agtctcttccctaatttagccaatt

SEQ ID NO: 159366 - DNA, 25 bp, Rattus norvegicus
agtctcttcccttatttagccaatt

SEQ ID NO: 159367 - DNA, 25 bp, Rattus norvegicus
agtctcttctctctattatcatgtt

SEQ ID NO: 159368 - DNA, 25 bp, Rattus norvegicus
agtctcttctctgtattatcatgtt

SEQ ID NO: 159369 - DNA, 25 bp, Rattus norvegicus
agtctcttctggctatgctcaggaa

SEQ ID NO: 159370 - DNA, 25 bp, Rattus norvegicus
agtctcttctgggtatgctcaggaa

SEQ ID NO: 159371 - DNA, 25 bp, Rattus norvegicus
agtctcttgcacattgctatatatc

SEQ ID NO: 159372 - DNA, 25 bp, Rattus norvegicus
agtctcttgcactttgctatatatc

SEQ ID NO: 159373 - DNA, 25 bp, Rattus norvegicus
agtctcttgggaccctgactgacaa

SEQ ID NO: 159374 - DNA, 25 bp, Rattus norvegicus
agtctcttgggagcctgactgacaa

SEQ ID NO: 159375 - DNA, 25 bp, Rattus norvegicus
agtctcttgggtagagccctggcag

SEQ ID NO: 159376 - DNA, 25 bp, Rattus norvegicus
agtctcttgggttgagccctggcag

SEQ ID NO: 159377 - DNA, 25 bp, Rattus norvegicus
agtctcttgtcaacagatgcctgca

SEQ ID NO: 159378 - DNA, 25 bp, Rattus norvegicus
agtctcttgtcatcagatgcctgca

SEQ ID NO: 159379 - DNA, 25 bp, Rattus norvegicus
agtctcttgttcagttggcgtgcca

SEQ ID NO: 159380 - DNA, 25 bp, Rattus norvegicus
agtctcttgttctgttggcgtgcca

SEQ ID NO: 159381 - DNA, 25 bp, Rattus norvegicus
agtctctttatccatcacctttcaa

SEQ ID NO: 159382 - DNA, 25 bp, Rattus norvegicus
agtctctttatcgatcacctttcaa

SEQ ID NO: 159383 - DNA, 25 bp, Rattus norvegicus
agtctctttgtgacactgaagccct

SEQ ID NO: 159384 - DNA, 25 bp, Rattus norvegicus
agtctctttgtgtcactgaagccct

SEQ ID NO: 159385 - DNA, 25 bp, Rattus norvegicus
agtctcttttccaaaataccatttg

SEQ ID NO: 159386 - DNA, 25 bp, Rattus norvegicus
agtctcttttcctaaataccatttg

SEQ ID NO: 159387 - DNA, 25 bp, Rattus norvegicus
agtctcttttgcctcatcttaaaaa

SEQ ID NO: 159388 - DNA, 25 bp, Rattus norvegicus
agtctcttttgcgtcatcttaaaaa

SEQ ID NO: 159389 - DNA, 25 bp, Rattus norvegicus
agtctcttttttccagtgtttcgca

SEQ ID NO: 159390 - DNA, 25 bp, Rattus norvegicus
agtctcttttttgcagtgtttcgca

SEQ ID NO: 159391 - DNA, 25 bp, Rattus norvegicus
agtctgaagggcagggctttaacca

SEQ ID NO: 159392 - DNA, 25 bp, Rattus norvegicus
agtctgaagggctgggctttaacca

SEQ ID NO: 159393 - DNA, 25 bp, Rattus norvegicus
agtctgaatggcctcaattcctgca

SEQ ID NO: 159394 - DNA, 25 bp, Rattus norvegicus
agtctgaatggcgtcaattcctgca

SEQ ID NO: 159395 - DNA, 25 bp, Rattus norvegicus
agtctgaatgtaactttctccccat

SEQ ID NO: 159396 - DNA, 25 bp, Rattus norvegicus
agtctgaatgtatctttctccccat

SEQ ID NO: 159397 - DNA, 25 bp, Rattus norvegicus
agtctgacaagcagtagccctatca

SEQ ID NO: 159398 - DNA, 25 bp, Rattus norvegicus
agtctgacaagctgtagccctatca

SEQ ID NO: 159399 - DNA, 25 bp, Rattus norvegicus
agtctgacaggcaggactggcctct

SEQ ID NO: 159400 - DNA, 25 bp, Rattus norvegicus
agtctgacaggctggactggcctct

SEQ ID NO: 159401 - DNA, 25 bp, Rattus norvegicus
agtctgacgtgcatgctgctctgag

SEQ ID NO: 159402 - DNA, 25 bp, Rattus norvegicus
agtctgacgtgcttgctgctctgag

SEQ ID NO: 159403 - DNA, 25 bp, Rattus norvegicus
agtctgactactctggatggaagca

SEQ ID NO: 159404 - DNA, 25 bp, Rattus norvegicus
agtctgactactgtggatggaagca

SEQ ID NO: 159405 - DNA, 25 bp, Rattus norvegicus
agtctgactagtacatcatgcgtgt

SEQ ID NO: 159406 - DNA, 25 bp, Rattus norvegicus
agtctgactagttcatcatgcgtgt

SEQ ID NO: 159407 - DNA, 25 bp, Rattus norvegicus
agtctgactctccatttgtcttcat

SEQ ID NO: 159408 - DNA, 25 bp, Rattus norvegicus
agtctgactctcgatttgtcttcat

SEQ ID NO: 159409 - DNA, 25 bp, Rattus norvegicus
agtctgacttgacggtgagagcaac

SEQ ID NO: 159410 - DNA, 25 bp, Rattus norvegicus
agtctgacttgagggtgagagcaac

SEQ ID NO: 159411 - DNA, 25 bp, Rattus norvegicus
agtctgagcgacagggtagttcaca

SEQ ID NO: 159412 - DNA, 25 bp, Rattus norvegicus
agtctgagcgactgggtagttcaca

SEQ ID NO: 159413 - DNA, 25 bp, Rattus norvegicus
agtctgagctcactgccggtgctga

SEQ ID NO: 159414 - DNA, 25 bp, Rattus norvegicus
agtctgagctcagtgccggtgctga

SEQ ID NO: 159415 - DNA, 25 bp, Rattus norvegicus
agtctgagctgcacctgtccaggga

SEQ ID NO: 159416 - DNA, 25 bp, Rattus norvegicus
agtctgagctgctcctgtccaggga

SEQ ID NO: 159417 - DNA, 25 bp, Rattus norvegicus
agtctgagctggcttctggtgttca

SEQ ID NO: 159418 - DNA, 25 bp, Rattus norvegicus
agtctgagctgggttctggtgttca

SEQ ID NO: 159419 - DNA, 25 bp, Rattus norvegicus
agtctgagcttacctctggtgccgg

SEQ ID NO: 159420 - DNA, 25 bp, Rattus norvegicus
agtctgagcttagctctggtgccgg

SEQ ID NO: 159421 - DNA, 25 bp, Rattus norvegicus
agtctgaggaatctcctgccttctt

SEQ ID NO: 159422 - DNA, 25 bp, Rattus norvegicus
agtctgaggaatgtcctgccttctt

SEQ ID NO: 159423 - DNA, 25 bp, Rattus norvegicus
agtctgaggcagatttcttgagttt

SEQ ID NO: 159424 - DNA, 25 bp, Rattus norvegicus
agtctgaggcagttttcttgagttt

SEQ ID NO: 159425 - DNA, 25 bp, Rattus norvegicus
agtctgaggccactgcactataaaa

SEQ ID NO: 159426 - DNA, 25 bp, Rattus norvegicus
agtctgaggccagtgcactataaaa

SEQ ID NO: 159427 - DNA, 25 bp, Rattus norvegicus
agtctgaggtggagctttttgccca

SEQ ID NO: 159428 - DNA, 25 bp, Rattus norvegicus
agtctgaggtggtgctttttgccca

SEQ ID NO: 159429 - DNA, 25 bp, Rattus norvegicus
agtctgagtagcctagtctagcacc

SEQ ID NO: 159430 - DNA, 25 bp, Rattus norvegicus
agtctgagtagcgtagtctagcacc

SEQ ID NO: 159431 - DNA, 25 bp, Rattus norvegicus
agtctgagtccgaggaccccagggt

SEQ ID NO: 159432 - DNA, 25 bp, Rattus norvegicus
agtctgagtccgaggccaacctgca

SEQ ID NO: 159433 - DNA, 25 bp, Rattus norvegicus
agtctgagtccgtggaccccagggt

SEQ ID NO: 159434 - DNA, 25 bp, Rattus norvegicus
agtctgagtccgtggccaacctgca

SEQ ID NO: 159435 - DNA, 25 bp, Rattus norvegicus
agtctgagtctacatgctgttccta

SEQ ID NO: 159436 - DNA, 25 bp, Rattus norvegicus
agtctgagtctagatgctgttccta

SEQ ID NO: 159437 - DNA, 25 bp, Rattus norvegicus
agtctgagtctccaagtcttggaac

SEQ ID NO: 159438 - DNA, 25 bp, Rattus norvegicus
agtctgagtctcgaagtcttggaac

SEQ ID NO: 159439 - DNA, 25 bp, Rattus norvegicus
agtctgagtgtgcacatgctgaccc

SEQ ID NO: 159440 - DNA, 25 bp, Rattus norvegicus
agtctgagtgtggacatgctgaccc

SEQ ID NO: 159441 - DNA, 25 bp, Rattus norvegicus
agtctgataaggctttctcccctgt

SEQ ID NO: 159442 - DNA, 25 bp, Rattus norvegicus
agtctgataagggtttctcccctgt

SEQ ID NO: 159443 - DNA, 25 bp, Rattus norvegicus
agtctgatagtccttcacatgcttc

SEQ ID NO: 159444 - DNA, 25 bp, Rattus norvegicus
agtctgatagtcgttcacatgcttc

SEQ ID NO: 159445 - DNA, 25 bp, Rattus norvegicus
agtctgatcccacgtacaaggcctt

SEQ ID NO: 159446 - DNA, 25 bp, Rattus norvegicus
agtctgatcccaggtacaaggcctt

SEQ ID NO: 159447 - DNA, 25 bp, Rattus norvegicus
agtctgatctaaagcccctattgga

SEQ ID NO: 159448 - DNA, 25 bp, Rattus norvegicus
agtctgatctaatgcccctattgga

SEQ ID NO: 159449 - DNA, 25 bp, Rattus norvegicus
agtctgatgacaattctccctccag

SEQ ID NO: 159450 - DNA, 25 bp, Rattus norvegicus
agtctgatgacatttctccctccag

SEQ ID NO: 159451 - DNA, 25 bp, Rattus norvegicus
agtctgatgtctctaccgcacatgt

SEQ ID NO: 159452 - DNA, 25 bp, Rattus norvegicus
agtctgatgtctcttctggcaatag

SEQ ID NO: 159453 - DNA, 25 bp, Rattus norvegicus
agtctgatgtctgtaccgcacatgt

SEQ ID NO: 159454 - DNA, 25 bp, Rattus norvegicus
agtctgatgtctgttctggcaatag

SEQ ID NO: 159455 - DNA, 25 bp, Rattus norvegicus
agtctgattcctcgcggcgggcctc

SEQ ID NO: 159456 - DNA, 25 bp, Rattus norvegicus
agtctgattcctggcggcgggcctc

SEQ ID NO: 159457 - DNA, 25 bp, Rattus norvegicus
agtctgattggcctttgaggtcctc

SEQ ID NO: 159458 - DNA, 25 bp, Rattus norvegicus
agtctgattggcgtttgaggtcctc

SEQ ID NO: 159459 - DNA, 25 bp, Rattus norvegicus
agtctgcaacacagaggtcttgccc

SEQ ID NO: 159460 - DNA, 25 bp, Rattus norvegicus
agtctgcaacactgaggtcttgccc

SEQ ID NO: 159461 - DNA, 25 bp, Rattus norvegicus
agtctgcacatcaccttggaagagc

SEQ ID NO: 159462 - DNA, 25 bp, Rattus norvegicus
agtctgcacatctccttggaagagc

SEQ ID NO: 159463 - DNA, 25 bp, Rattus norvegicus
agtctgcactacagcacccaagagg

SEQ ID NO: 159464 - DNA, 25 bp, Rattus norvegicus
agtctgcactactgcacccaagagg

SEQ ID NO: 159465 - DNA, 25 bp, Rattus norvegicus
agtctgcactctcggagtcgctgaa

SEQ ID NO: 159466 - DNA, 25 bp, Rattus norvegicus
agtctgcactctgggagtcgctgaa

SEQ ID NO: 159467 - DNA, 25 bp, Rattus norvegicus
agtctgcactttaaggcttctggtc

SEQ ID NO: 159468 - DNA, 25 bp, Rattus norvegicus
agtctgcacttttaggcttctggtc

SEQ ID NO: 159469 - DNA, 25 bp, Rattus norvegicus
agtctgcagacaacgttctccaaaa

SEQ ID NO: 159470 - DNA, 25 bp, Rattus norvegicus
agtctgcagacatcgttctccaaaa

SEQ ID NO: 159471 - DNA, 25 bp, Rattus norvegicus
agtctgcagataatctgaggctctg

SEQ ID NO: 159472 - DNA, 25 bp, Rattus norvegicus
agtctgcagatattctgaggctctg

SEQ ID NO: 159473 - DNA, 25 bp, Rattus norvegicus
agtctgcagcggcttccttttgtgc

SEQ ID NO: 159474 - DNA, 25 bp, Rattus norvegicus
agtctgcagcgggttccttttgtgc

SEQ ID NO: 159475 - DNA, 25 bp, Rattus norvegicus
agtctgcagtccagggacgggaacc

SEQ ID NO: 159476 - DNA, 25 bp, Rattus norvegicus
agtctgcagtcctgggacgggaacc

SEQ ID NO: 159477 - DNA, 25 bp, Rattus norvegicus
agtctgcatcatcccgctccgaagg

SEQ ID NO: 159478 - DNA, 25 bp, Rattus norvegicus
agtctgcatcatgccgctccgaagg

SEQ ID NO: 159479 - DNA, 25 bp, Rattus norvegicus
agtctgcattctacagtttcccaga

SEQ ID NO: 159480 - DNA, 25 bp, Rattus norvegicus
agtctgcattcttcagtttcccaga

SEQ ID NO: 159481 - DNA, 25 bp, Rattus norvegicus
agtctgccaaatactgtcctacatt

SEQ ID NO: 159482 - DNA, 25 bp, Rattus norvegicus
agtctgccaaattctgtcctacatt

SEQ ID NO: 159483 - DNA, 25 bp, Rattus norvegicus
agtctgccaagaccaggttctggaa

SEQ ID NO: 159484 - DNA, 25 bp, Rattus norvegicus
agtctgccaagagcaggttctggaa

SEQ ID NO: 159485 - DNA, 25 bp, Rattus norvegicus
agtctgccacgcaaggttttggcat

SEQ ID NO: 159486 - DNA, 25 bp, Rattus norvegicus
agtctgccacgctaggttttggcat

SEQ ID NO: 159487 - DNA, 25 bp, Rattus norvegicus
agtctgccccaactctgaaatagga

SEQ ID NO: 159488 - DNA, 25 bp, Rattus norvegicus
agtctgccccaagtctgaaatagga

SEQ ID NO: 159489 - DNA, 25 bp, Rattus norvegicus
agtctgccgttgatgctagctagaa

SEQ ID NO: 159490 - DNA, 25 bp, Rattus norvegicus
agtctgccgttgttgctagctagaa

SEQ ID NO: 159491 - DNA, 25 bp, Rattus norvegicus
agtctgcctaatcgtgggacctaga

SEQ ID NO: 159492 - DNA, 25 bp, Rattus norvegicus
agtctgcctaatggtgggacctaga

SEQ ID NO: 159493 - DNA, 25 bp, Rattus norvegicus
agtctgcctatgaatacctttttga

SEQ ID NO: 159494 - DNA, 25 bp, Rattus norvegicus
agtctgcctatgtatacctttttga

SEQ ID NO: 159495 - DNA, 25 bp, Rattus norvegicus
agtctgcctcacagtgtagcattgg

SEQ ID NO: 159496 - DNA, 25 bp, Rattus norvegicus
agtctgcctcactgtgtagcattgg

SEQ ID NO: 159497 - DNA, 25 bp, Rattus norvegicus
agtctgcctcagacgcatggtattt

SEQ ID NO: 159498 - DNA, 25 bp, Rattus norvegicus
agtctgcctcagtcgcatggtattt

SEQ ID NO: 159499 - DNA, 25 bp, Rattus norvegicus
agtctgcctgttctggaagctaaga

SEQ ID NO: 159500 - DNA, 25 bp, Rattus norvegicus
agtctgcctgttgtggaagctaaga

SEQ ID NO: 159501 - DNA, 25 bp, Rattus norvegicus
agtctgccttgcagagccatcaagt

SEQ ID NO: 159502 - DNA, 25 bp, Rattus norvegicus
agtctgccttgctgagccatcaagt

SEQ ID NO: 159503 - DNA, 25 bp, Rattus norvegicus
agtctgcgtatgaacagccactctc

SEQ ID NO: 159504 - DNA, 25 bp, Rattus norvegicus
agtctgcgtatgtacagccactctc

SEQ ID NO: 159505 - DNA, 25 bp, Rattus norvegicus
agtctgcgtctgagggtagcgttcc

SEQ ID NO: 159506 - DNA, 25 bp, Rattus norvegicus
agtctgcgtctgtgggtagcgttcc

SEQ ID NO: 159507 - DNA, 25 bp, Rattus norvegicus
agtctgcgtcttcctttctgtttct

SEQ ID NO: 159508 - DNA, 25 bp, Rattus norvegicus
agtctgcgtcttgctttctgtttct

SEQ ID NO: 159509 - DNA, 25 bp, Rattus norvegicus
agtctgcgtggacgaaggcgctacg

SEQ ID NO: 159510 - DNA, 25 bp, Rattus norvegicus
agtctgcgtggaggaaggcgctacg

SEQ ID NO: 159511 - DNA, 25 bp, Rattus norvegicus
agtctgctactactgcggtagagca

SEQ ID NO: 159512 - DNA, 25 bp, Rattus norvegicus
agtctgctactagtgcggtagagca

SEQ ID NO: 159513 - DNA, 25 bp, Rattus norvegicus
agtctgctagtgcaaacttctctac

SEQ ID NO: 159514 - DNA, 25 bp, Rattus norvegicus
agtctgctagtggaaacttctctac

SEQ ID NO: 159515 - DNA, 25 bp, Rattus norvegicus
agtctgctcatcaggaaggtgagat

SEQ ID NO: 159516 - DNA, 25 bp, Rattus norvegicus
agtctgctcatctggaaggtgagat

SEQ ID NO: 159517 - DNA, 25 bp, Rattus norvegicus
agtctgctccacatgtgtgtccata

SEQ ID NO: 159518 - DNA, 25 bp, Rattus norvegicus
agtctgctccacttgtgtgtccata

SEQ ID NO: 159519 - DNA, 25 bp, Rattus norvegicus
agtctgctcctgatttcagcaggcc

SEQ ID NO: 159520 - DNA, 25 bp, Rattus norvegicus
agtctgctcctgttttcagcaggcc

SEQ ID NO: 159521 - DNA, 25 bp, Rattus norvegicus
agtctgctgctcagtggatctggag

SEQ ID NO: 159522 - DNA, 25 bp, Rattus norvegicus
agtctgctgctctgtggatctggag

SEQ ID NO: 159523 - DNA, 25 bp, Rattus norvegicus
agtctgctgctgctgggtaatgaaa

SEQ ID NO: 159524 - DNA, 25 bp, Rattus norvegicus
agtctgctgctggtgggtaatgaaa

SEQ ID NO: 159525 - DNA, 25 bp, Rattus norvegicus
agtctgctggcaatgggcctatcaa

SEQ ID NO: 159526 - DNA, 25 bp, Rattus norvegicus
agtctgctggcattgggcctatcaa

SEQ ID NO: 159527 - DNA, 25 bp, Rattus norvegicus
agtctgctggttaggtgggcctcca

SEQ ID NO: 159528 - DNA, 25 bp, Rattus norvegicus
agtctgctggtttggtgggcctcca

SEQ ID NO: 159529 - DNA, 25 bp, Rattus norvegicus
agtctgcttcatcttctgtagttga

SEQ ID NO: 159530 - DNA, 25 bp, Rattus norvegicus
agtctgcttcatgttctgtagttga

SEQ ID NO: 159531 - DNA, 25 bp, Rattus norvegicus
agtctgcttcggcctgggatggtct

SEQ ID NO: 159532 - DNA, 25 bp, Rattus norvegicus
agtctgcttcgggctgggatggtct

SEQ ID NO: 159533 - DNA, 25 bp, Rattus norvegicus
agtctgcttgttaggttcctctaga

SEQ ID NO: 159534 - DNA, 25 bp, Rattus norvegicus
agtctgcttgtttggttcctctaga

SEQ ID NO: 159535 - DNA, 25 bp, Rattus norvegicus
agtctgctttgtcttcacgctgctt

SEQ ID NO: 159536 - DNA, 25 bp, Rattus norvegicus
agtctgctttgtgttcacgctgctt

SEQ ID NO: 159537 - DNA, 25 bp, Rattus norvegicus
agtctggaacttagcttcttcttgg

SEQ ID NO: 159538 - DNA, 25 bp, Rattus norvegicus
agtctggaactttgcttcttcttgg

SEQ ID NO: 159539 - DNA, 25 bp, Rattus norvegicus
agtctggaagtgatggcatgtgccc

SEQ ID NO: 159540 - DNA, 25 bp, Rattus norvegicus
agtctggaagtgttggcatgtgccc

SEQ ID NO: 159541 - DNA, 25 bp, Rattus norvegicus
agtctggaataaagccctgtcacct

SEQ ID NO: 159542 - DNA, 25 bp, Rattus norvegicus
agtctggaataatgccctgtcacct

SEQ ID NO: 159543 - DNA, 25 bp, Rattus norvegicus
agtctggacacaattctgtctcctt

SEQ ID NO: 159544 - DNA, 25 bp, Rattus norvegicus
agtctggacacatttctgtctcctt

SEQ ID NO: 159545 - DNA, 25 bp, Rattus norvegicus
agtctggaccatcttcgagcattca

SEQ ID NO: 159546 - DNA, 25 bp, Rattus norvegicus
agtctggaccatgttcgagcattca

SEQ ID NO: 159547 - DNA, 25 bp, Rattus norvegicus
agtctggacctgatctgagcctgga

SEQ ID NO: 159548 - DNA, 25 bp, Rattus norvegicus
agtctggacctgttctgagcctgga

SEQ ID NO: 159549 - DNA, 25 bp, Rattus norvegicus
agtctggacggccacacaaggacag

SEQ ID NO: 159550 - DNA, 25 bp, Rattus norvegicus
agtctggacggcgacacaaggacag

SEQ ID NO: 159551 - DNA, 25 bp, Rattus norvegicus
agtctggactctcccaaagtgaatg

SEQ ID NO: 159552 - DNA, 25 bp, Rattus norvegicus
agtctggactctgccaaagtgaatg

SEQ ID NO: 159553 - DNA, 25 bp, Rattus norvegicus
agtctggactttcgcccttcaactg

SEQ ID NO: 159554 - DNA, 25 bp, Rattus norvegicus
agtctggactttggcccttcaactg

SEQ ID NO: 159555 - DNA, 25 bp, Rattus norvegicus
agtctggagcatcacctagctgcac

SEQ ID NO: 159556 - DNA, 25 bp, Rattus norvegicus
agtctggagcatgacctagctgcac

SEQ ID NO: 159557 - DNA, 25 bp, Rattus norvegicus
agtctggagcccctaatcctgccgt

SEQ ID NO: 159558 - DNA, 25 bp, Rattus norvegicus
agtctggagcccgtaatcctgccgt

SEQ ID NO: 159559 - DNA, 25 bp, Rattus norvegicus
agtctggagtgccatatgttcccta

SEQ ID NO: 159560 - DNA, 25 bp, Rattus norvegicus
agtctggagtgcgatatgttcccta

SEQ ID NO: 159561 - DNA, 25 bp, Rattus norvegicus
agtctggatgccacactctgaagca

SEQ ID NO: 159562 - DNA, 25 bp, Rattus norvegicus
agtctggatgcctcactctgaagca

SEQ ID NO: 159563 - DNA, 25 bp, Rattus norvegicus
agtctggccagcctttcaggaggtc

SEQ ID NO: 159564 - DNA, 25 bp, Rattus norvegicus
agtctggccagcgtttcaggaggtc

SEQ ID NO: 159565 - DNA, 25 bp, Rattus norvegicus
agtctggcccagcacttctcagttg

SEQ ID NO: 159566 - DNA, 25 bp, Rattus norvegicus
agtctggcccaggacttctcagttg

SEQ ID NO: 159567 - DNA, 25 bp, Rattus norvegicus
agtctggcctacatagtgggctcta

SEQ ID NO: 159568 - DNA, 25 bp, Rattus norvegicus
agtctggcctacttagtgggctcta

SEQ ID NO: 159569 - DNA, 25 bp, Rattus norvegicus
agtctggcctagaccctaggtgagg

SEQ ID NO: 159570 - DNA, 25 bp, Rattus norvegicus
agtctggcctagtccctaggtgagg

SEQ ID NO: 159571 - DNA, 25 bp, Rattus norvegicus
agtctggcctggctgggatctccct

SEQ ID NO: 159572 - DNA, 25 bp, Rattus norvegicus
agtctggcctgggtgggatctccct

SEQ ID NO: 159573 - DNA, 25 bp, Rattus norvegicus
agtctggccttgctctgaccagaga

SEQ ID NO: 159574 - DNA, 25 bp, Rattus norvegicus
agtctggccttggtctgaccagaga

SEQ ID NO: 159575 - DNA, 25 bp, Rattus norvegicus
agtctggcgatcaccaggaggaaaa

SEQ ID NO: 159576 - DNA, 25 bp, Rattus norvegicus
agtctggcgatctccaggaggaaaa

SEQ ID NO: 159577 - DNA, 25 bp, Rattus norvegicus
agtctggcgggcatcccggcccgtt

SEQ ID NO: 159578 - DNA, 25 bp, Rattus norvegicus
agtctggcgggcttcccggcccgtt

SEQ ID NO: 159579 - DNA, 25 bp, Rattus norvegicus
agtctggctaatcttcctcatctga

SEQ ID NO: 159580 - DNA, 25 bp, Rattus norvegicus
agtctggctaatgttcctcatctga

SEQ ID NO: 159581 - DNA, 25 bp, Rattus norvegicus
agtctggctgttaccttggagagaa

SEQ ID NO: 159582 - DNA, 25 bp, Rattus norvegicus
agtctggctgtttccttggagagaa

SEQ ID NO: 159583 - DNA, 25 bp, Rattus norvegicus
agtctgggcagtcttgcaagtcctt

SEQ ID NO: 159584 - DNA, 25 bp, Rattus norvegicus
agtctgggcagtgttgcaagtcctt

SEQ ID NO: 159585 - DNA, 25 bp, Rattus norvegicus
agtctgggccctatctcgatggcat

SEQ ID NO: 159586 - DNA, 25 bp, Rattus norvegicus
agtctgggccctttctcgatggcat

SEQ ID NO: 159587 - DNA, 25 bp, Rattus norvegicus
agtctgggcctcataggagcatgaa

SEQ ID NO: 159588 - DNA, 25 bp, Rattus norvegicus
agtctgggcctcttaggagcatgaa

SEQ ID NO: 159589 - DNA, 25 bp, Rattus norvegicus
agtctgggcgaaatcctatctgtaa

SEQ ID NO: 159590 - DNA, 25 bp, Rattus norvegicus
agtctgggcgaattcctatctgtaa

SEQ ID NO: 159591 - DNA, 25 bp, Rattus norvegicus
agtctgggtagtactgtgctctgtc

SEQ ID NO: 159592 - DNA, 25 bp, Rattus norvegicus
agtctgggtagttctgtgctctgtc

SEQ ID NO: 159593 - DNA, 25 bp, Rattus norvegicus
agtctggtacccagtgtcctctgaa

SEQ ID NO: 159594 - DNA, 25 bp, Rattus norvegicus
agtctggtaccctgtgtcctctgaa

SEQ ID NO: 159595 - DNA, 25 bp, Rattus norvegicus
agtctggtagacagatggcttctta

SEQ ID NO: 159596 - DNA, 25 bp, Rattus norvegicus
agtctggtagactgatggcttctta

SEQ ID NO: 159597 - DNA, 25 bp, Rattus norvegicus
agtctggtctccaagtggcacagtg

SEQ ID NO: 159598 - DNA, 25 bp, Rattus norvegicus
agtctggtctcctagtggcacagtg

SEQ ID NO: 159599 - DNA, 25 bp, Rattus norvegicus
agtctggtcttacgtgtactctaga

SEQ ID NO: 159600 - DNA, 25 bp, Rattus norvegicus
agtctggtcttaggtgtactctaga

SEQ ID NO: 159601 - DNA, 25 bp, Rattus norvegicus
agtctggtgagcagctttgtgtctc

SEQ ID NO: 159602 - DNA, 25 bp, Rattus norvegicus
agtctggtgagctgctttgtgtctc

SEQ ID NO: 159603 - DNA, 25 bp, Rattus norvegicus
agtctggtgtacagggtgaattcct

SEQ ID NO: 159604 - DNA, 25 bp, Rattus norvegicus
agtctggtgtactgggtgaattcct

SEQ ID NO: 159605 - DNA, 25 bp, Rattus norvegicus
agtctggttctgaatcatgtcgtaa

SEQ ID NO: 159606 - DNA, 25 bp, Rattus norvegicus
agtctggttctgtatcatgtcgtaa

SEQ ID NO: 159607 - DNA, 25 bp, Rattus norvegicus
agtctggtttcaaattcccctgcag

SEQ ID NO: 159608 - DNA, 25 bp, Rattus norvegicus
agtctggtttcatattcccctgcag

SEQ ID NO: 159609 - DNA, 25 bp, Rattus norvegicus
agtctggtttgtagagctctattaa

SEQ ID NO: 159610 - DNA, 25 bp, Rattus norvegicus
agtctggtttgttgagctctattaa

SEQ ID NO: 159611 - DNA, 25 bp, Rattus norvegicus
agtctgtaaactaggctttttgcca

SEQ ID NO: 159612 - DNA, 25 bp, Rattus norvegicus
agtctgtaaacttggctttttgcca

SEQ ID NO: 159613 - DNA, 25 bp, Rattus norvegicus
agtctgtaatggatgtttgctgtta

SEQ ID NO: 159614 - DNA, 25 bp, Rattus norvegicus
agtctgtaatggttgtttgctgtta

SEQ ID NO: 159615 - DNA, 25 bp, Rattus norvegicus
agtctgtacacgcttctggaggaga

SEQ ID NO: 159616 - DNA, 25 bp, Rattus norvegicus
agtctgtacacggttctggaggaga

SEQ ID NO: 159617 - DNA, 25 bp, Rattus norvegicus
agtctgtaccacaactgaatccttg

SEQ ID NO: 159618 - DNA, 25 bp, Rattus norvegicus
agtctgtaccactactgaatccttg

SEQ ID NO: 159619 - DNA, 25 bp, Rattus norvegicus
agtctgtactgacgagggcgctcct

SEQ ID NO: 159620 - DNA, 25 bp, Rattus norvegicus
agtctgtactgaggagggcgctcct

SEQ ID NO: 159621 - DNA, 25 bp, Rattus norvegicus
agtctgtacttaatcttgctttaaa

SEQ ID NO: 159622 - DNA, 25 bp, Rattus norvegicus
agtctgtacttattcttgctttaaa

SEQ ID NO: 159623 - DNA, 25 bp, Rattus norvegicus
agtctgtagatgctcaacactgtaa

SEQ ID NO: 159624 - DNA, 25 bp, Rattus norvegicus
agtctgtagatggtcaacactgtaa

SEQ ID NO: 159625 - DNA, 25 bp, Rattus norvegicus
agtctgtatgacactggctgcctgg

SEQ ID NO: 159626 - DNA, 25 bp, Rattus norvegicus
agtctgtatgactctggctgcctgg

SEQ ID NO: 159627 - DNA, 25 bp, Rattus norvegicus
agtctgtcacagatactcatattaa

SEQ ID NO: 159628 - DNA, 25 bp, Rattus norvegicus
agtctgtcacagttactcatattaa

SEQ ID NO: 159629 - DNA, 25 bp, Rattus norvegicus
agtctgtcacctattgatgtccagc

SEQ ID NO: 159630 - DNA, 25 bp, Rattus norvegicus
agtctgtcaccttttgatgtccagc

SEQ ID NO: 159631 - DNA, 25 bp, Rattus norvegicus
agtctgtcactgagagggaacccaa

SEQ ID NO: 159632 - DNA, 25 bp, Rattus norvegicus
agtctgtcactgtgagggaacccaa

SEQ ID NO: 159633 - DNA, 25 bp, Rattus norvegicus
agtctgtcagcactgcatacttatg

SEQ ID NO: 159634 - DNA, 25 bp, Rattus norvegicus
agtctgtcagcagtgcatacttatg

SEQ ID NO: 159635 - DNA, 25 bp, Rattus norvegicus
agtctgtcaggccatattttgatat

SEQ ID NO: 159636 - DNA, 25 bp, Rattus norvegicus
agtctgtcaggcgatattttgatat

SEQ ID NO: 159637 - DNA, 25 bp, Rattus norvegicus
agtctgtcattcaaagggcttactt

SEQ ID NO: 159638 - DNA, 25 bp, Rattus norvegicus
agtctgtcattctaagggcttactt

SEQ ID NO: 159639 - DNA, 25 bp, Rattus norvegicus
agtctgtccatcagtgatgctctag

SEQ ID NO: 159640 - DNA, 25 bp, Rattus norvegicus
agtctgtccatctgtgatgctctag

SEQ ID NO: 159641 - DNA, 25 bp, Rattus norvegicus
agtctgtccccactgtgtgctattt

SEQ ID NO: 159642 - DNA, 25 bp, Rattus norvegicus
agtctgtccccagtgtgtgctattt

SEQ ID NO: 159643 - DNA, 25 bp, Rattus norvegicus
agtctgtccttcacacctgtgataa

SEQ ID NO: 159644 - DNA, 25 bp, Rattus norvegicus
agtctgtccttctcacctgtgataa

SEQ ID NO: 159645 - DNA, 25 bp, Rattus norvegicus
agtctgtcctttagtaatgcctttg

SEQ ID NO: 159646 - DNA, 25 bp, Rattus norvegicus
agtctgtccttttgtaatgcctttg

SEQ ID NO: 159647 - DNA, 25 bp, Rattus norvegicus
agtctgtcgctactgggcagaagct

SEQ ID NO: 159648 - DNA, 25 bp, Rattus norvegicus
agtctgtcgctagtgggcagaagct

SEQ ID NO: 159649 - DNA, 25 bp, Rattus norvegicus
agtctgtcggacacctggcatatgg

SEQ ID NO: 159650 - DNA, 25 bp, Rattus norvegicus
agtctgtcggaccttgttaccagga

SEQ ID NO: 159651 - DNA, 25 bp, Rattus norvegicus
agtctgtcggacgttgttaccagga

SEQ ID NO: 159652 - DNA, 25 bp, Rattus norvegicus
agtctgtcggactcctggcatatgg

SEQ ID NO: 159653 - DNA, 25 bp, Rattus norvegicus
agtctgtcggttacttacttgtgaa

SEQ ID NO: 159654 - DNA, 25 bp, Rattus norvegicus
agtctgtcggtttcttacttgtgaa

SEQ ID NO: 159655 - DNA, 25 bp, Rattus norvegicus
agtctgtctcctcttatgacctcaa

SEQ ID NO: 159656 - DNA, 25 bp, Rattus norvegicus
agtctgtctcctgttatgacctcaa

SEQ ID NO: 159657 - DNA, 25 bp, Rattus norvegicus
agtctgtctcttaggtgctgtcata

SEQ ID NO: 159658 - DNA, 25 bp, Rattus norvegicus
agtctgtctctttggtgctgtcata

SEQ ID NO: 159659 - DNA, 25 bp, Rattus norvegicus
agtctgtctgctatgactcctctga

SEQ ID NO: 159660 - DNA, 25 bp, Rattus norvegicus
agtctgtctgctttgactcctctga

SEQ ID NO: 159661 - DNA, 25 bp, Rattus norvegicus
agtctgtctgtcatcacttgaatgt

SEQ ID NO: 159662 - DNA, 25 bp, Rattus norvegicus
agtctgtctgtcctctgcatagtct

SEQ ID NO: 159663 - DNA, 25 bp, Rattus norvegicus
agtctgtctgtcgtctgcatagtct

SEQ ID NO: 159664 - DNA, 25 bp, Rattus norvegicus
agtctgtctgtcttcacttgaatgt

SEQ ID NO: 159665 - DNA, 25 bp, Rattus norvegicus
agtctgtcttgcagacatcgatgca

SEQ ID NO: 159666 - DNA, 25 bp, Rattus norvegicus
agtctgtcttgctgacatcgatgca

SEQ ID NO: 159667 - DNA, 25 bp, Rattus norvegicus
agtctgtgacaccagcacgtattgc

SEQ ID NO: 159668 - DNA, 25 bp, Rattus norvegicus
agtctgtgacacgagcacgtattgc

SEQ ID NO: 159669 - DNA, 25 bp, Rattus norvegicus
agtctgtgacgccagcacgtataca

SEQ ID NO: 159670 - DNA, 25 bp, Rattus norvegicus
agtctgtgacgcgagcacgtataca

SEQ ID NO: 159671 - DNA, 25 bp, Rattus norvegicus
agtctgtgagtgcatggatccctgc

SEQ ID NO: 159672 - DNA, 25 bp, Rattus norvegicus
agtctgtgagtggatggatccctgc

SEQ ID NO: 159673 - DNA, 25 bp, Rattus norvegicus
agtctgtgcatcaggctggtgtcca

SEQ ID NO: 159674 - DNA, 25 bp, Rattus norvegicus
agtctgtgcatctggctggtgtcca

SEQ ID NO: 159675 - DNA, 25 bp, Rattus norvegicus
agtctgtgccctctattatgttgta

SEQ ID NO: 159676 - DNA, 25 bp, Rattus norvegicus
agtctgtgccctgtattatgttgta

SEQ ID NO: 159677 - DNA, 25 bp, Rattus norvegicus
agtctgtgcgtcaactcaagggaga

SEQ ID NO: 159678 - DNA, 25 bp, Rattus norvegicus
agtctgtgcgtctactcaagggaga

SEQ ID NO: 159679 - DNA, 25 bp, Rattus norvegicus
agtctgtgctctcttcagttcccaa

SEQ ID NO: 159680 - DNA, 25 bp, Rattus norvegicus
agtctgtgctctgttcagttcccaa

SEQ ID NO: 159681 - DNA, 25 bp, Rattus norvegicus
agtctgtggattacttttgtattat

SEQ ID NO: 159682 - DNA, 25 bp, Rattus norvegicus
agtctgtggatttcttttgtattat

SEQ ID NO: 159683 - DNA, 25 bp, Rattus norvegicus
agtctgtggcttctttaaacctgtg

SEQ ID NO: 159684 - DNA, 25 bp, Rattus norvegicus
agtctgtggcttgtttaaacctgtg

SEQ ID NO: 159685 - DNA, 25 bp, Rattus norvegicus
agtctgtgtagacctgttctcttgc

SEQ ID NO: 159686 - DNA, 25 bp, Rattus norvegicus
agtctgtgtagagctgttctcttgc

SEQ ID NO: 159687 - DNA, 25 bp, Rattus norvegicus
agtctgtgtcatagactccgagcca

SEQ ID NO: 159688 - DNA, 25 bp, Rattus norvegicus
agtctgtgtcattgactccgagcca

SEQ ID NO: 159689 - DNA, 25 bp, Rattus norvegicus
agtctgtgtctgaggcattcgcatt

SEQ ID NO: 159690 - DNA, 25 bp, Rattus norvegicus
agtctgtgtctgtggcattcgcatt

SEQ ID NO: 159691 - DNA, 25 bp, Rattus norvegicus
agtctgtgtgcgacctgtgtcatca

SEQ ID NO: 159692 - DNA, 25 bp, Rattus norvegicus
agtctgtgtgcgtcctgtgtcatca

SEQ ID NO: 159693 - DNA, 25 bp, Rattus norvegicus
agtctgttactcacgtgggtgggct

SEQ ID NO: 159694 - DNA, 25 bp, Rattus norvegicus
agtctgttactctcgtgggtgggct

SEQ ID NO: 159695 - DNA, 25 bp, Rattus norvegicus
agtctgttagacacctttccaagga

SEQ ID NO: 159696 - DNA, 25 bp, Rattus norvegicus
agtctgttagactcctttccaagga

SEQ ID NO: 159697 - DNA, 25 bp, Rattus norvegicus
agtctgttagtcatgctttcttatc

SEQ ID NO: 159698 - DNA, 25 bp, Rattus norvegicus
agtctgttagtcttgctttcttatc

SEQ ID NO: 159699 - DNA, 25 bp, Rattus norvegicus
agtctgttatctaacatgctccttc

SEQ ID NO: 159700 - DNA, 25 bp, Rattus norvegicus
agtctgttatcttacatgctccttc

SEQ ID NO: 159701 - DNA, 25 bp, Rattus norvegicus
agtctgttatgcactgtggtttcag

SEQ ID NO: 159702 - DNA, 25 bp, Rattus norvegicus
agtctgttatgctctgtggtttcag

SEQ ID NO: 159703 - DNA, 25 bp, Rattus norvegicus
agtctgttccagctgagctcaatat

SEQ ID NO: 159704 - DNA, 25 bp, Rattus norvegicus
agtctgttccaggtgagctcaatat

SEQ ID NO: 159705 - DNA, 25 bp, Rattus norvegicus
agtctgttccgaactcatgggttaa

SEQ ID NO: 159706 - DNA, 25 bp, Rattus norvegicus
agtctgttccgatctcatgggttaa

SEQ ID NO: 159707 - DNA, 25 bp, Rattus norvegicus
agtctgttccttcgttagatgccgc

SEQ ID NO: 159708 - DNA, 25 bp, Rattus norvegicus
agtctgttccttggttagatgccgc

SEQ ID NO: 159709 - DNA, 25 bp, Rattus norvegicus
agtctgttctaactattgcttcacc

SEQ ID NO: 159710 - DNA, 25 bp, Rattus norvegicus
agtctgttctaagtattgcttcacc

SEQ ID NO: 159711 - DNA, 25 bp, Rattus norvegicus
agtctgttgagtaccatgatcctat

SEQ ID NO: 159712 - DNA, 25 bp, Rattus norvegicus
agtctgttgagttccatgatcctat

SEQ ID NO: 159713 - DNA, 25 bp, Rattus norvegicus
agtctgttggagaaactttgcacaa

SEQ ID NO: 159714 - DNA, 25 bp, Rattus norvegicus
agtctgttggagtaactttgcacaa

SEQ ID NO: 159715 - DNA, 25 bp, Rattus norvegicus
agtctgtttaatcttacccgtgcat

SEQ ID NO: 159716 - DNA, 25 bp, Rattus norvegicus
agtctgtttaatgttacccgtgcat

SEQ ID NO: 159717 - DNA, 25 bp, Rattus norvegicus
agtctgtttgccaatgctgtgctcc

SEQ ID NO: 159718 - DNA, 25 bp, Rattus norvegicus
agtctgtttgcctatgctgtgctcc

SEQ ID NO: 159719 - DNA, 25 bp, Rattus norvegicus
agtctgttttgtcacgggttatcta

SEQ ID NO: 159720 - DNA, 25 bp, Rattus norvegicus
agtctgttttgtcactgctcccgaa

SEQ ID NO: 159721 - DNA, 25 bp, Rattus norvegicus
agtctgttttgtgacgggttatcta

SEQ ID NO: 159722 - DNA, 25 bp, Rattus norvegicus
agtctgttttgtgactgctcccgaa

SEQ ID NO: 159723 - DNA, 25 bp, Rattus norvegicus
agtcttaactttcctcttggattta

SEQ ID NO: 159724 - DNA, 25 bp, Rattus norvegicus
agtcttaactttgctcttggattta

SEQ ID NO: 159725 - DNA, 25 bp, Rattus norvegicus
agtcttaaggataccatctccactc

SEQ ID NO: 159726 - DNA, 25 bp, Rattus norvegicus
agtcttaaggattccatctccactc

SEQ ID NO: 159727 - DNA, 25 bp, Rattus norvegicus
agtcttaaggtcagcagccggcaat

SEQ ID NO: 159728 - DNA, 25 bp, Rattus norvegicus
agtcttaaggtctgcagccggcaat

SEQ ID NO: 159729 - DNA, 25 bp, Rattus norvegicus
agtcttaccatcagcagtgtcgttc

SEQ ID NO: 159730 - DNA, 25 bp, Rattus norvegicus
agtcttaccatctgcagtgtcgttc

SEQ ID NO: 159731 - DNA, 25 bp, Rattus norvegicus
agtcttactgccatggcttctcaag

SEQ ID NO: 159732 - DNA, 25 bp, Rattus norvegicus
agtcttactgccttggcttctcaag

SEQ ID NO: 159733 - DNA, 25 bp, Rattus norvegicus
agtcttactggcaagttcctaaagt

SEQ ID NO: 159734 - DNA, 25 bp, Rattus norvegicus
agtcttactggctagttcctaaagt

SEQ ID NO: 159735 - DNA, 25 bp, Rattus norvegicus
agtcttactgttcgctcctggattc

SEQ ID NO: 159736 - DNA, 25 bp, Rattus norvegicus
agtcttactgttggctcctggattc

SEQ ID NO: 159737 - DNA, 25 bp, Rattus norvegicus
agtcttagcgtgacacagggcggtc

SEQ ID NO: 159738 - DNA, 25 bp, Rattus norvegicus
agtcttagcgtgtcacagggcggtc

SEQ ID NO: 159739 - DNA, 25 bp, Rattus norvegicus
agtcttatcaaaacgtgtctctggg

SEQ ID NO: 159740 - DNA, 25 bp, Rattus norvegicus
agtcttatcaaatcgtgtctctggg

SEQ ID NO: 159741 - DNA, 25 bp, Rattus norvegicus
agtcttatgactagtgctgcggtaa

SEQ ID NO: 159742 - DNA, 25 bp, Rattus norvegicus
agtcttatgacttgtgctgcggtaa

SEQ ID NO: 159743 - DNA, 25 bp, Rattus norvegicus
agtcttattaatctcccgctgctgt

SEQ ID NO: 159744 - DNA, 25 bp, Rattus norvegicus
agtcttattaatgtcccgctgctgt

SEQ ID NO: 159745 - DNA, 25 bp, Rattus norvegicus
agtcttcaactgatagtgcctgtgc

SEQ ID NO: 159746 - DNA, 25 bp, Rattus norvegicus
agtcttcaactgttagtgcctgtgc

SEQ ID NO: 159747 - DNA, 25 bp, Rattus norvegicus
agtcttcaagatcgttggcccctcc

SEQ ID NO: 159748 - DNA, 25 bp, Rattus norvegicus
agtcttcaagatggttggcccctcc

SEQ ID NO: 159749 - DNA, 25 bp, Rattus norvegicus
agtcttcacaaaagcatgcctacca

SEQ ID NO: 159750 - DNA, 25 bp, Rattus norvegicus
agtcttcacaaatgcatgcctacca

SEQ ID NO: 159751 - DNA, 25 bp, Rattus norvegicus
agtcttcaccgtcgactgaaaattc

SEQ ID NO: 159752 - DNA, 25 bp, Rattus norvegicus
agtcttcaccgtggactgaaaattc

SEQ ID NO: 159753 - DNA, 25 bp, Rattus norvegicus
agtcttcacggacgatcgggcacgc

SEQ ID NO: 159754 - DNA, 25 bp, Rattus norvegicus
agtcttcacggaggatcgggcacgc

SEQ ID NO: 159755 - DNA, 25 bp, Rattus norvegicus
agtcttcactggcagttgctggtac

SEQ ID NO: 159756 - DNA, 25 bp, Rattus norvegicus
agtcttcactgggagttgctggtac

SEQ ID NO: 159757 - DNA, 25 bp, Rattus norvegicus
agtcttcagatgcaacgctgacccc

SEQ ID NO: 159758 - DNA, 25 bp, Rattus norvegicus
agtcttcagatggaacgctgacccc

SEQ ID NO: 159759 - DNA, 25 bp, Rattus norvegicus
agtcttcagattcttcctgtctttg

SEQ ID NO: 159760 - DNA, 25 bp, Rattus norvegicus
agtcttcagattgttcctgtctttg

SEQ ID NO: 159761 - DNA, 25 bp, Rattus norvegicus
agtcttcatcatctcatttacttga

SEQ ID NO: 159762 - DNA, 25 bp, Rattus norvegicus
agtcttcatcatgtcatttacttga

SEQ ID NO: 159763 - DNA, 25 bp, Rattus norvegicus
agtcttcatgacatgagccgtgttt

SEQ ID NO: 159764 - DNA, 25 bp, Rattus norvegicus
agtcttcatgacttgagccgtgttt

SEQ ID NO: 159765 - DNA, 25 bp, Rattus norvegicus
agtcttccaaatatgcttctcctta

SEQ ID NO: 159766 - DNA, 25 bp, Rattus norvegicus
agtcttccaaatttgcttctcctta

SEQ ID NO: 159767 - DNA, 25 bp, Rattus norvegicus
agtcttccaggaatcatggtgcctc

SEQ ID NO: 159768 - DNA, 25 bp, Rattus norvegicus
agtcttccaggacgtggcccagaaa

SEQ ID NO: 159769 - DNA, 25 bp, Rattus norvegicus
agtcttccaggaggtggcccagaaa

SEQ ID NO: 159770 - DNA, 25 bp, Rattus norvegicus
agtcttccaggattcatggtgcctc

SEQ ID NO: 159771 - DNA, 25 bp, Rattus norvegicus
agtcttccagtacttacagcttcta

SEQ ID NO: 159772 - DNA, 25 bp, Rattus norvegicus
agtcttccagtagttacagcttcta

SEQ ID NO: 159773 - DNA, 25 bp, Rattus norvegicus
agtcttcccagaatttgttgcaccc

SEQ ID NO: 159774 - DNA, 25 bp, Rattus norvegicus
agtcttcccagattttgttgcaccc

SEQ ID NO: 159775 - DNA, 25 bp, Rattus norvegicus
agtcttcccatcctcttcttaagtc

SEQ ID NO: 159776 - DNA, 25 bp, Rattus norvegicus
agtcttcccatcgtcttcttaagtc

SEQ ID NO: 159777 - DNA, 25 bp, Rattus norvegicus
agtcttccccgacgtgcagtcaaag

SEQ ID NO: 159778 - DNA, 25 bp, Rattus norvegicus
agtcttccccgaggtgcagtcaaag

SEQ ID NO: 159779 - DNA, 25 bp, Rattus norvegicus
agtcttcctgacaggtgaggtggct

SEQ ID NO: 159780 - DNA, 25 bp, Rattus norvegicus
agtcttcctgactggtgaggtggct

SEQ ID NO: 159781 - DNA, 25 bp, Rattus norvegicus
agtcttcctgcccttttcattttgt

SEQ ID NO: 159782 - DNA, 25 bp, Rattus norvegicus
agtcttcctgccgttttcattttgt

SEQ ID NO: 159783 - DNA, 25 bp, Rattus norvegicus
agtcttccttgtcgttctgaatttt

SEQ ID NO: 159784 - DNA, 25 bp, Rattus norvegicus
agtcttccttgtggttctgaatttt

SEQ ID NO: 159785 - DNA, 25 bp, Rattus norvegicus
agtcttcgatttatggcttcctttg

SEQ ID NO: 159786 - DNA, 25 bp, Rattus norvegicus
agtcttcgatttttggcttcctttg

SEQ ID NO: 159787 - DNA, 25 bp, Rattus norvegicus
agtcttcgcgtcagatgccaagttt

SEQ ID NO: 159788 - DNA, 25 bp, Rattus norvegicus
agtcttcgcgtctgatgccaagttt

SEQ ID NO: 159789 - DNA, 25 bp, Rattus norvegicus
agtcttcgtggtcgccagtgatgac

SEQ ID NO: 159790 - DNA, 25 bp, Rattus norvegicus
agtcttcgtggtggccagtgatgac

SEQ ID NO: 159791 - DNA, 25 bp, Rattus norvegicus
agtcttctagaactcaccactacgc

SEQ ID NO: 159792 - DNA, 25 bp, Rattus norvegicus
agtcttctagaagtcaccactacgc

SEQ ID NO: 159793 - DNA, 25 bp, Rattus norvegicus
agtcttctcccactggaccgtgagt

SEQ ID NO: 159794 - DNA, 25 bp, Rattus norvegicus
agtcttctcccagtggaccgtgagt

SEQ ID NO: 159795 - DNA, 25 bp, Rattus norvegicus
agtcttctcctcatttaactgattc

SEQ ID NO: 159796 - DNA, 25 bp, Rattus norvegicus
agtcttctcctcttttaactgattc

SEQ ID NO: 159797 - DNA, 25 bp, Rattus norvegicus
agtcttctccttccttctggatgaa

SEQ ID NO: 159798 - DNA, 25 bp, Rattus norvegicus
agtcttctccttgcttctggatgaa

SEQ ID NO: 159799 - DNA, 25 bp, Rattus norvegicus
agtcttctcgctccattatttcaga

SEQ ID NO: 159800 - DNA, 25 bp, Rattus norvegicus
agtcttctcgctgcattatttcaga

SEQ ID NO: 159801 - DNA, 25 bp, Rattus norvegicus
agtcttctctcgctagcaatgtatc

SEQ ID NO: 159802 - DNA, 25 bp, Rattus norvegicus
agtcttctctcggtagcaatgtatc

SEQ ID NO: 159803 - DNA, 25 bp, Rattus norvegicus
agtcttctgaggcttgcatcaccaa

SEQ ID NO: 159804 - DNA, 25 bp, Rattus norvegicus
agtcttctgagggttgcatcaccaa

SEQ ID NO: 159805 - DNA, 25 bp, Rattus norvegicus
agtcttctgatgaatcttcaggcga

SEQ ID NO: 159806 - DNA, 25 bp, Rattus norvegicus
agtcttctgatgtatcttcaggcga

SEQ ID NO: 159807 - DNA, 25 bp, Rattus norvegicus
agtcttctgcctagaaagctgtctg

SEQ ID NO: 159808 - DNA, 25 bp, Rattus norvegicus
agtcttctgccttgaaagctgtctg

SEQ ID NO: 159809 - DNA, 25 bp, Rattus norvegicus
agtcttctggcaaatgctgcagcga

SEQ ID NO: 159810 - DNA, 25 bp, Rattus norvegicus
agtcttctggcatatgctgcagcga

SEQ ID NO: 159811 - DNA, 25 bp, Rattus norvegicus
agtcttctggtcaaccctccacaaa

SEQ ID NO: 159812 - DNA, 25 bp, Rattus norvegicus
agtcttctggtctaccctccacaaa

SEQ ID NO: 159813 - DNA, 25 bp, Rattus norvegicus
agtcttctgtgaatggagccatctc

SEQ ID NO: 159814 - DNA, 25 bp, Rattus norvegicus
agtcttctgtgattggagccatctc

SEQ ID NO: 159815 - DNA, 25 bp, Rattus norvegicus
agtcttctgtgtactcaggtgtcac

SEQ ID NO: 159816 - DNA, 25 bp, Rattus norvegicus
agtcttctgtgttctcaggtgtcac

SEQ ID NO: 159817 - DNA, 25 bp, Rattus norvegicus
agtcttctgttacaaatggctgagc

SEQ ID NO: 159818 - DNA, 25 bp, Rattus norvegicus
agtcttctgttagaaatggctgagc

SEQ ID NO: 159819 - DNA, 25 bp, Rattus norvegicus
agtcttctgtttagtccttagtaca

SEQ ID NO: 159820 - DNA, 25 bp, Rattus norvegicus
agtcttctgttttgtccttagtaca

SEQ ID NO: 159821 - DNA, 25 bp, Rattus norvegicus
agtcttcttaaccaagcaccttgtt

SEQ ID NO: 159822 - DNA, 25 bp, Rattus norvegicus
agtcttcttaacgaagcaccttgtt

SEQ ID NO: 159823 - DNA, 25 bp, Rattus norvegicus
agtcttcttccccaatcctgaagaa

SEQ ID NO: 159824 - DNA, 25 bp, Rattus norvegicus
agtcttcttcccgaatcctgaagaa

SEQ ID NO: 159825 - DNA, 25 bp, Rattus norvegicus
agtcttcttctgagttgagctgcga

SEQ ID NO: 159826 - DNA, 25 bp, Rattus norvegicus
agtcttcttctgtgttgagctgcga

SEQ ID NO: 159827 - DNA, 25 bp, Rattus norvegicus
agtcttcttggtaacgcatgtttaa

SEQ ID NO: 159828 - DNA, 25 bp, Rattus norvegicus
agtcttcttggttacgcatgtttaa

SEQ ID NO: 159829 - DNA, 25 bp, Rattus norvegicus
agtcttctttttacgttggctctca

SEQ ID NO: 159830 - DNA, 25 bp, Rattus norvegicus
agtcttcttttttcgttggctctca

SEQ ID NO: 159831 - DNA, 25 bp, Rattus norvegicus
agtcttgacccacagatgtcaccat

SEQ ID NO: 159832 - DNA, 25 bp, Rattus norvegicus
agtcttgacccagagatgtcaccat

SEQ ID NO: 159833 - DNA, 25 bp, Rattus norvegicus
agtcttgactgcctgcatttcttgg

SEQ ID NO: 159834 - DNA, 25 bp, Rattus norvegicus
agtcttgactgcgtgcatttcttgg

SEQ ID NO: 159835 - DNA, 25 bp, Rattus norvegicus
agtcttgactgtctgctttatgcct

SEQ ID NO: 159836 - DNA, 25 bp, Rattus norvegicus
agtcttgactgtgtgctttatgcct

SEQ ID NO: 159837 - DNA, 25 bp, Rattus norvegicus
agtcttgagagcaccatgggctgcc

SEQ ID NO: 159838 - DNA, 25 bp, Rattus norvegicus
agtcttgagagctccatgggctgcc

SEQ ID NO: 159839 - DNA, 25 bp, Rattus norvegicus
agtcttgagggtcccattctgtcag

SEQ ID NO: 159840 - DNA, 25 bp, Rattus norvegicus
agtcttgagggtgccattctgtcag

SEQ ID NO: 159841 - DNA, 25 bp, Rattus norvegicus
agtcttgattacaggcctaggtttc

SEQ ID NO: 159842 - DNA, 25 bp, Rattus norvegicus
agtcttgattactggcctaggtttc

SEQ ID NO: 159843 - DNA, 25 bp, Rattus norvegicus
agtcttgcacaaccctttattcaat

SEQ ID NO: 159844 - DNA, 25 bp, Rattus norvegicus
agtcttgcacaagcctttattcaat

SEQ ID NO: 159845 - DNA, 25 bp, Rattus norvegicus
agtcttgcacagcattggtatcgca

SEQ ID NO: 159846 - DNA, 25 bp, Rattus norvegicus
agtcttgcacaggattggtatcgca

SEQ ID NO: 159847 - DNA, 25 bp, Rattus norvegicus
agtcttgcacccaatgttgaaccag

SEQ ID NO: 159848 - DNA, 25 bp, Rattus norvegicus
agtcttgcaccctatgttgaaccag

SEQ ID NO: 159849 - DNA, 25 bp, Rattus norvegicus
agtcttgcagcaaaagcccagcgtc

SEQ ID NO: 159850 - DNA, 25 bp, Rattus norvegicus
agtcttgcagcataagcccagcgtc

SEQ ID NO: 159851 - DNA, 25 bp, Rattus norvegicus
agtcttgccaggcagaacagccaca

SEQ ID NO: 159852 - DNA, 25 bp, Rattus norvegicus
agtcttgccagggagaacagccaca

SEQ ID NO: 159853 - DNA, 25 bp, Rattus norvegicus
agtcttgcctatactacttgtgttg

SEQ ID NO: 159854 - DNA, 25 bp, Rattus norvegicus
agtcttgcctattctacttgtgttg

SEQ ID NO: 159855 - DNA, 25 bp, Rattus norvegicus
agtcttgcctgaccatgggccagag

SEQ ID NO: 159856 - DNA, 25 bp, Rattus norvegicus
agtcttgcctgagcatgggccagag

SEQ ID NO: 159857 - DNA, 25 bp, Rattus norvegicus
agtcttgcgtttactacattttgaa

SEQ ID NO: 159858 - DNA, 25 bp, Rattus norvegicus
agtcttgcgttttctacattttgaa

SEQ ID NO: 159859 - DNA, 25 bp, Rattus norvegicus
agtcttgctactcggtccacgggac

SEQ ID NO: 159860 - DNA, 25 bp, Rattus norvegicus
agtcttgctactgggtccacgggac

SEQ ID NO: 159861 - DNA, 25 bp, Rattus norvegicus
agtcttgctctgaaatgttgaggca

SEQ ID NO: 159862 - DNA, 25 bp, Rattus norvegicus
agtcttgctctgtaatgttgaggca

SEQ ID NO: 159863 - DNA, 25 bp, Rattus norvegicus
agtcttgctgtcacttggctgagaa

SEQ ID NO: 159864 - DNA, 25 bp, Rattus norvegicus
agtcttgctgtcagtgaagagtctt

SEQ ID NO: 159865 - DNA, 25 bp, Rattus norvegicus
agtcttgctgtctcttggctgagaa

SEQ ID NO: 159866 - DNA, 25 bp, Rattus norvegicus
agtcttgctgtctgtgaagagtctt

SEQ ID NO: 159867 - DNA, 25 bp, Rattus norvegicus
agtcttgctttcattcctttgcaaa

SEQ ID NO: 159868 - DNA, 25 bp, Rattus norvegicus
agtcttgctttctttcctttgcaaa

SEQ ID NO: 159869 - DNA, 25 bp, Rattus norvegicus
agtcttggaagtctctcggcaaccg

SEQ ID NO: 159870 - DNA, 25 bp, Rattus norvegicus
agtcttggaagtgtctcggcaaccg

SEQ ID NO: 159871 - DNA, 25 bp, Rattus norvegicus
agtcttggacctcctgagtctgctg

SEQ ID NO: 159872 - DNA, 25 bp, Rattus norvegicus
agtcttggacctgctgagtctgctg

SEQ ID NO: 159873 - DNA, 25 bp, Rattus norvegicus
agtcttggcatacggacacggccga

SEQ ID NO: 159874 - DNA, 25 bp, Rattus norvegicus
agtcttggcatagggacacggccga

SEQ ID NO: 159875 - DNA, 25 bp, Rattus norvegicus
agtcttggccctcaacaatgtgtgc

SEQ ID NO: 159876 - DNA, 25 bp, Rattus norvegicus
agtcttggccctgaacaatgtgtgc

SEQ ID NO: 159877 - DNA, 25 bp, Rattus norvegicus
agtcttggcctgagcttgtctagca

SEQ ID NO: 159878 - DNA, 25 bp, Rattus norvegicus
agtcttggcctgtgcttgtctagca

SEQ ID NO: 159879 - DNA, 25 bp, Rattus norvegicus
agtcttggctgcacgcatgagcgaa

SEQ ID NO: 159880 - DNA, 25 bp, Rattus norvegicus
agtcttggctgctcgcatgagcgaa

SEQ ID NO: 159881 - DNA, 25 bp, Rattus norvegicus
agtcttgggaagcaggctcgtccac

SEQ ID NO: 159882 - DNA, 25 bp, Rattus norvegicus
agtcttgggaaggaggctcgtccac

SEQ ID NO: 159883 - DNA, 25 bp, Rattus norvegicus
agtcttgggaatcacggtctccatc

SEQ ID NO: 159884 - DNA, 25 bp, Rattus norvegicus
agtcttgggaatgacggtctccatc

SEQ ID NO: 159885 - DNA, 25 bp, Rattus norvegicus
agtcttgggagacgtggctctctca

SEQ ID NO: 159886 - DNA, 25 bp, Rattus norvegicus
agtcttgggagaggtggctctctca

SEQ ID NO: 159887 - DNA, 25 bp, Rattus norvegicus
agtcttgggagtcctgggcccatta

SEQ ID NO: 159888 - DNA, 25 bp, Rattus norvegicus
agtcttgggagtgctgggcccatta

SEQ ID NO: 159889 - DNA, 25 bp, Rattus norvegicus
agtcttggtcatatattttcttgtt

SEQ ID NO: 159890 - DNA, 25 bp, Rattus norvegicus
agtcttggtcatttattttcttgtt

SEQ ID NO: 159891 - DNA, 25 bp, Rattus norvegicus
agtcttggtcctcatgccaccagga

SEQ ID NO: 159892 - DNA, 25 bp, Rattus norvegicus
agtcttggtcctgatgccaccagga

SEQ ID NO: 159893 - DNA, 25 bp, Rattus norvegicus
agtcttggttggacttgccctgttc

SEQ ID NO: 159894 - DNA, 25 bp, Rattus norvegicus
agtcttggttggtcttgccctgttc

SEQ ID NO: 159895 - DNA, 25 bp, Rattus norvegicus
agtcttgtaattcttccacactggg

SEQ ID NO: 159896 - DNA, 25 bp, Rattus norvegicus
agtcttgtaattgttccacactggg

SEQ ID NO: 159897 - DNA, 25 bp, Rattus norvegicus
agtcttgtatttagggtgggtgcct

SEQ ID NO: 159898 - DNA, 25 bp, Rattus norvegicus
agtcttgtattttgggtgggtgcct

SEQ ID NO: 159899 - DNA, 25 bp, Rattus norvegicus
agtcttgtgcccatgactgggtgta

SEQ ID NO: 159900 - DNA, 25 bp, Rattus norvegicus
agtcttgtgcccttgactgggtgta

SEQ ID NO: 159901 - DNA, 25 bp, Rattus norvegicus
agtcttgttcacaaggacatgcaca

SEQ ID NO: 159902 - DNA, 25 bp, Rattus norvegicus
agtcttgttcactaggacatgcaca

SEQ ID NO: 159903 - DNA, 25 bp, Rattus norvegicus
agtcttgttttgagagaatgtctgc

SEQ ID NO: 159904 - DNA, 25 bp, Rattus norvegicus
agtcttgttttgtgagaatgtctgc

SEQ ID NO: 159905 - DNA, 25 bp, Rattus norvegicus
agtctttaagatacggctctgggcc

SEQ ID NO: 159906 - DNA, 25 bp, Rattus norvegicus
agtctttaagattcggctctgggcc

SEQ ID NO: 159907 - DNA, 25 bp, Rattus norvegicus
agtctttaatccatgcaattgggac

SEQ ID NO: 159908 - DNA, 25 bp, Rattus norvegicus
agtctttaatccttgcaattgggac

SEQ ID NO: 159909 - DNA, 25 bp, Rattus norvegicus
agtctttactgaatgccgccttgtt

SEQ ID NO: 159910 - DNA, 25 bp, Rattus norvegicus
agtctttactgattgccgccttgtt

SEQ ID NO: 159911 - DNA, 25 bp, Rattus norvegicus
agtctttagaatagcttcgcctcct

SEQ ID NO: 159912 - DNA, 25 bp, Rattus norvegicus
agtctttagaattgcttcgcctcct

SEQ ID NO: 159913 - DNA, 25 bp, Rattus norvegicus
agtctttatctcagtatccttcttg

SEQ ID NO: 159914 - DNA, 25 bp, Rattus norvegicus
agtctttatctctgtatccttcttg

SEQ ID NO: 159915 - DNA, 25 bp, Rattus norvegicus
agtctttatgctatctaggtctctc

SEQ ID NO: 159916 - DNA, 25 bp, Rattus norvegicus
agtctttatgctttctaggtctctc

SEQ ID NO: 159917 - DNA, 25 bp, Rattus norvegicus
agtctttcaagaccctgacactaaa

SEQ ID NO: 159918 - DNA, 25 bp, Rattus norvegicus
agtctttcaagagcctgacactaaa

SEQ ID NO: 159919 - DNA, 25 bp, Rattus norvegicus
agtctttcaagccattctaaaccaa

SEQ ID NO: 159920 - DNA, 25 bp, Rattus norvegicus
agtctttcaagcgattctaaaccaa

SEQ ID NO: 159921 - DNA, 25 bp, Rattus norvegicus
agtctttcaatgctgacatgtcaca

SEQ ID NO: 159922 - DNA, 25 bp, Rattus norvegicus
agtctttcaatggtgacatgtcaca

SEQ ID NO: 159923 - DNA, 25 bp, Rattus norvegicus
agtctttcacctcctttaaatctgg

SEQ ID NO: 159924 - DNA, 25 bp, Rattus norvegicus
agtctttcacctgctttaaatctgg

SEQ ID NO: 159925 - DNA, 25 bp, Rattus norvegicus
agtctttcactcacacacatttagt

SEQ ID NO: 159926 - DNA, 25 bp, Rattus norvegicus
agtctttcactctcacacatttagt

SEQ ID NO: 159927 - DNA, 25 bp, Rattus norvegicus
agtctttcagctactgttttctggg

SEQ ID NO: 159928 - DNA, 25 bp, Rattus norvegicus
agtctttcagcttctgttttctggg

SEQ ID NO: 159929 - DNA, 25 bp, Rattus norvegicus
agtctttcatgcacgaacactgata

SEQ ID NO: 159930 - DNA, 25 bp, Rattus norvegicus
agtctttcatgctcgaacactgata

SEQ ID NO: 159931 - DNA, 25 bp, Rattus norvegicus
agtctttccaaacagcttgctgcaa

SEQ ID NO: 159932 - DNA, 25 bp, Rattus norvegicus
agtctttccaaagagcttgctgcaa

SEQ ID NO: 159933 - DNA, 25 bp, Rattus norvegicus
agtctttcccaccatggatactcca

SEQ ID NO: 159934 - DNA, 25 bp, Rattus norvegicus
agtctttcccacgatggatactcca

SEQ ID NO: 159935 - DNA, 25 bp, Rattus norvegicus
agtctttccctgactgggctgtagg

SEQ ID NO: 159936 - DNA, 25 bp, Rattus norvegicus
agtctttccctgtctgggctgtagg

SEQ ID NO: 159937 - DNA, 25 bp, Rattus norvegicus
agtctttcctaaccatttatcaacg

SEQ ID NO: 159938 - DNA, 25 bp, Rattus norvegicus
agtctttcctaagcatttatcaacg

SEQ ID NO: 159939 - DNA, 25 bp, Rattus norvegicus
agtctttcctgcagtatttcttgct

SEQ ID NO: 159940 - DNA, 25 bp, Rattus norvegicus
agtctttcctgctgtatttcttgct

SEQ ID NO: 159941 - DNA, 25 bp, Rattus norvegicus
agtctttctacaagtcctcagcggg

SEQ ID NO: 159942 - DNA, 25 bp, Rattus norvegicus
agtctttctacatgtcctcagcggg

SEQ ID NO: 159943 - DNA, 25 bp, Rattus norvegicus
agtctttctcctctgtcagaatctt

SEQ ID NO: 159944 - DNA, 25 bp, Rattus norvegicus
agtctttctcctgtgtcagaatctt

SEQ ID NO: 159945 - DNA, 25 bp, Rattus norvegicus
agtctttctgatcgaccctttcaaa

SEQ ID NO: 159946 - DNA, 25 bp, Rattus norvegicus
agtctttctgatggaccctttcaaa

SEQ ID NO: 159947 - DNA, 25 bp, Rattus norvegicus
agtctttctggtagtggacggccca

SEQ ID NO: 159948 - DNA, 25 bp, Rattus norvegicus
agtctttctggttgtggacggccca

SEQ ID NO: 159949 - DNA, 25 bp, Rattus norvegicus
agtctttctgtgactttatttgcaa

SEQ ID NO: 159950 - DNA, 25 bp, Rattus norvegicus
agtctttctgtgtctttatttgcaa

SEQ ID NO: 159951 - DNA, 25 bp, Rattus norvegicus
agtctttcttatcagtctcatggcc

SEQ ID NO: 159952 - DNA, 25 bp, Rattus norvegicus
agtctttcttatgagtctcatggcc

SEQ ID NO: 159953 - DNA, 25 bp, Rattus norvegicus
agtctttgagagagcagccttcgcc

SEQ ID NO: 159954 - DNA, 25 bp, Rattus norvegicus
agtctttgagagtgcagccttcgcc

SEQ ID NO: 159955 - DNA, 25 bp, Rattus norvegicus
agtctttgcaagatctgggtgttca

SEQ ID NO: 159956 - DNA, 25 bp, Rattus norvegicus
agtctttgcaagttctgggtgttca

SEQ ID NO: 159957 - DNA, 25 bp, Rattus norvegicus
agtctttgccagagtcacctttgac

SEQ ID NO: 159958 - DNA, 25 bp, Rattus norvegicus
agtctttgccagtgtcacctttgac

SEQ ID NO: 159959 - DNA, 25 bp, Rattus norvegicus
agtctttgcttcattgctctaacgc

SEQ ID NO: 159960 - DNA, 25 bp, Rattus norvegicus
agtctttgcttctttgctctaacgc

SEQ ID NO: 159961 - DNA, 25 bp, Rattus norvegicus
agtctttgtgggatcctgtgttaag

SEQ ID NO: 159962 - DNA, 25 bp, Rattus norvegicus
agtctttgtgggttcctgtgttaag

SEQ ID NO: 159963 - DNA, 25 bp, Rattus norvegicus
agtcttttaattctcaccttacatg

SEQ ID NO: 159964 - DNA, 25 bp, Rattus norvegicus
agtcttttaattgtcaccttacatg

SEQ ID NO: 159965 - DNA, 25 bp, Rattus norvegicus
agtcttttctccaggtttgattatg

SEQ ID NO: 159966 - DNA, 25 bp, Rattus norvegicus
agtcttttctcctggtttgattatg

SEQ ID NO: 159967 - DNA, 25 bp, Rattus norvegicus
agtcttttctctatcggaatccgat

SEQ ID NO: 159968 - DNA, 25 bp, Rattus norvegicus
agtcttttctctttcggaatccgat

SEQ ID NO: 159969 - DNA, 25 bp, Rattus norvegicus
agtcttttgactcctcacatgagca

SEQ ID NO: 159970 - DNA, 25 bp, Rattus norvegicus
agtcttttgactgctcacatgagca

SEQ ID NO: 159971 - DNA, 25 bp, Rattus norvegicus
agtcttttggatatgaagtctggat

SEQ ID NO: 159972 - DNA, 25 bp, Rattus norvegicus
agtcttttggatttgaagtctggat

SEQ ID NO: 159973 - DNA, 25 bp, Rattus norvegicus
agtcttttgtccacagtgacacaga

SEQ ID NO: 159974 - DNA, 25 bp, Rattus norvegicus
agtcttttgtcctcagtgacacaga

SEQ ID NO: 159975 - DNA, 25 bp, Rattus norvegicus
agtcttttgtgccattgtctctcac

SEQ ID NO: 159976 - DNA, 25 bp, Rattus norvegicus
agtcttttgtgcgattgtctctcac

SEQ ID NO: 159977 - DNA, 25 bp, Rattus norvegicus
agtctttttctaccaactcctggga

SEQ ID NO: 159978 - DNA, 25 bp, Rattus norvegicus
agtctttttctagcaactcctggga

SEQ ID NO: 159979 - DNA, 25 bp, Rattus norvegicus
agtctttttctcagagaggctcctt

SEQ ID NO: 159980 - DNA, 25 bp, Rattus norvegicus
agtctttttctctgagaggctcctt

SEQ ID NO: 159981 - DNA, 25 bp, Rattus norvegicus
agtgaaaacagaacgccctttgcca

SEQ ID NO: 159982 - DNA, 25 bp, Rattus norvegicus
agtgaaaacagatcgccctttgcca

SEQ ID NO: 159983 - DNA, 25 bp, Rattus norvegicus
agtgaaaacattccagccccatcga

SEQ ID NO: 159984 - DNA, 25 bp, Rattus norvegicus
agtgaaaacattgcagccccatcga

SEQ ID NO: 159985 - DNA, 25 bp, Rattus norvegicus
agtgaaaagcccatcagctgtcggt

SEQ ID NO: 159986 - DNA, 25 bp, Rattus norvegicus
agtgaaaagcccttcagctgtcggt

SEQ ID NO: 159987 - DNA, 25 bp, Rattus norvegicus
agtgaaaagggtattctcgaaagct

SEQ ID NO: 159988 - DNA, 25 bp, Rattus norvegicus
agtgaaaagggttttctcgaaagct

SEQ ID NO: 159989 - DNA, 25 bp, Rattus norvegicus
agtgaaaataggctctgcctcccca

SEQ ID NO: 159990 - DNA, 25 bp, Rattus norvegicus
agtgaaaatagggtctgcctcccca

SEQ ID NO: 159991 - DNA, 25 bp, Rattus norvegicus
agtgaaacatcaacaccacctttgt

SEQ ID NO: 159992 - DNA, 25 bp, Rattus norvegicus
agtgaaacatcatcaccacctttgt

SEQ ID NO: 159993 - DNA, 25 bp, Rattus norvegicus
agtgaaacattaccacgtccccaca

SEQ ID NO: 159994 - DNA, 25 bp, Rattus norvegicus
agtgaaacattagcacgtccccaca

SEQ ID NO: 159995 - DNA, 25 bp, Rattus norvegicus
agtgaaaccaggacgcttgttgcct

SEQ ID NO: 159996 - DNA, 25 bp, Rattus norvegicus
agtgaaaccaggtcgcttgttgcct

SEQ ID NO: 159997 - DNA, 25 bp, Rattus norvegicus
agtgaaacctacatgatctcctatt

SEQ ID NO: 159998 - DNA, 25 bp, Rattus norvegicus
agtgaaacctacttgatctcctatt

SEQ ID NO: 159999 - DNA, 25 bp, Rattus norvegicus
agtgaaactcgactgtccttccttc

SEQ ID NO: 160000 - DNA, 25 bp, Rattus norvegicus
agtgaaactcgagtgtccttccttc

SEQ ID NO: 160001 - DNA, 25 bp, Rattus norvegicus
agtgaaactgttagcctcggttcta

SEQ ID NO: 160002 - DNA, 25 bp, Rattus norvegicus
agtgaaactgtttgcctcggttcta

SEQ ID NO: 160003 - DNA, 25 bp, Rattus norvegicus
agtgaaacttgaccaacctgccaat

SEQ ID NO: 160004 - DNA, 25 bp, Rattus norvegicus
agtgaaacttgagcaacctgccaat

SEQ ID NO: 160005 - DNA, 25 bp, Rattus norvegicus
agtgaaagcataagccaccaggcca

SEQ ID NO: 160006 - DNA, 25 bp, Rattus norvegicus
agtgaaagcatatgccaccaggcca

SEQ ID NO: 160007 - DNA, 25 bp, Rattus norvegicus
agtgaaagcctacaagagacaagca

SEQ ID NO: 160008 - DNA, 25 bp, Rattus norvegicus
agtgaaagcctagaagagacaagca

SEQ ID NO: 160009 - DNA, 25 bp, Rattus norvegicus
agtgaaaggcacactggttcccggt

SEQ ID NO: 160010 - DNA, 25 bp, Rattus norvegicus
agtgaaaggcactctggttcccggt

SEQ ID NO: 160011 - DNA, 25 bp, Rattus norvegicus
agtgaaagtcaactcctacaagagg

SEQ ID NO: 160012 - DNA, 25 bp, Rattus norvegicus
agtgaaagtcaagtcctacaagagg

SEQ ID NO: 160013 - DNA, 25 bp, Rattus norvegicus
agtgaaagtgctcacagactttctc

SEQ ID NO: 160014 - DNA, 25 bp, Rattus norvegicus
agtgaaagtgctgacagactttctc

SEQ ID NO: 160015 - DNA, 25 bp, Rattus norvegicus
agtgaaagtggtctcctggcatgaa

SEQ ID NO: 160016 - DNA, 25 bp, Rattus norvegicus
agtgaaagtggtgtcctggcatgaa

SEQ ID NO: 160017 - DNA, 25 bp, Rattus norvegicus
agtgaaagtgtcattcaacccgcaa

SEQ ID NO: 160018 - DNA, 25 bp, Rattus norvegicus
agtgaaagtgtctttcaacccgcaa

SEQ ID NO: 160019 - DNA, 25 bp, Rattus norvegicus
agtgaaagttcaaccgggcctgcag

SEQ ID NO: 160020 - DNA, 25 bp, Rattus norvegicus
agtgaaagttcatccgggcctgcag

SEQ ID NO: 160021 - DNA, 25 bp, Rattus norvegicus
agtgaaatccaaaagctccttcctg

SEQ ID NO: 160022 - DNA, 25 bp, Rattus norvegicus
agtgaaatccaatagctccttcctg

SEQ ID NO: 160023 - DNA, 25 bp, Rattus norvegicus
agtgaaatccctcactggccactta

SEQ ID NO: 160024 - DNA, 25 bp, Rattus norvegicus
agtgaaatccctgactggccactta

SEQ ID NO: 160025 - DNA, 25 bp, Rattus norvegicus
agtgaaatcgccagagaaccgcttc

SEQ ID NO: 160026 - DNA, 25 bp, Rattus norvegicus
agtgaaatcgcctgagaaccgcttc

SEQ ID NO: 160027 - DNA, 25 bp, Rattus norvegicus
agtgaaatgcccaatttttgccctt

SEQ ID NO: 160028 - DNA, 25 bp, Rattus norvegicus
agtgaaatgccctatttttgccctt

SEQ ID NO: 160029 - DNA, 25 bp, Rattus norvegicus
agtgaaatgtgtcaccttccttctc

SEQ ID NO: 160030 - DNA, 25 bp, Rattus norvegicus
agtgaaatgtgtgaccttccttctc

SEQ ID NO: 160031 - DNA, 25 bp, Rattus norvegicus
agtgaaattgacaccatttccccac

SEQ ID NO: 160032 - DNA, 25 bp, Rattus norvegicus
agtgaaattgactccatttccccac

SEQ ID NO: 160033 - DNA, 25 bp, Rattus norvegicus
agtgaacaaggcctaccacgcttac

SEQ ID NO: 160034 - DNA, 25 bp, Rattus norvegicus
agtgaacaaggcgtaccacgcttac

SEQ ID NO: 160035 - DNA, 25 bp, Rattus norvegicus
agtgaacaagggagccaccacaatt

SEQ ID NO: 160036 - DNA, 25 bp, Rattus norvegicus
agtgaacaagggtgccaccacaatt

SEQ ID NO: 160037 - DNA, 25 bp, Rattus norvegicus
agtgaacacgtgcttattttaaatc

SEQ ID NO: 160038 - DNA, 25 bp, Rattus norvegicus
agtgaacacgtggttattttaaatc

SEQ ID NO: 160039 - DNA, 25 bp, Rattus norvegicus
agtgaacactgtcccttgactctgt

SEQ ID NO: 160040 - DNA, 25 bp, Rattus norvegicus
agtgaacactgtgccttgactctgt

SEQ ID NO: 160041 - DNA, 25 bp, Rattus norvegicus
agtgaacagactcggctagacctgg

SEQ ID NO: 160042 - DNA, 25 bp, Rattus norvegicus
agtgaacagactgggctagacctgg

SEQ ID NO: 160043 - DNA, 25 bp, Rattus norvegicus
agtgaacagcagagagagtctccct

SEQ ID NO: 160044 - DNA, 25 bp, Rattus norvegicus
agtgaacagcagtgagagtctccct

SEQ ID NO: 160045 - DNA, 25 bp, Rattus norvegicus
agtgaacatcgacgtgtagccacca

SEQ ID NO: 160046 - DNA, 25 bp, Rattus norvegicus
agtgaacatcgaggtgtagccacca

SEQ ID NO: 160047 - DNA, 25 bp, Rattus norvegicus
agtgaacatttcatacgtgccattt

SEQ ID NO: 160048 - DNA, 25 bp, Rattus norvegicus
agtgaacatttcttacgtgccattt

SEQ ID NO: 160049 - DNA, 25 bp, Rattus norvegicus
agtgaaccaccgcaagtacttgcag

SEQ ID NO: 160050 - DNA, 25 bp, Rattus norvegicus
agtgaaccaccggaagtacttgcag

SEQ ID NO: 160051 - DNA, 25 bp, Rattus norvegicus
agtgaaccagttatcagacccagcc

SEQ ID NO: 160052 - DNA, 25 bp, Rattus norvegicus
agtgaaccagttttcagacccagcc

SEQ ID NO: 160053 - DNA, 25 bp, Rattus norvegicus
agtgaacccaaccaagagcagcttc

SEQ ID NO: 160054 - DNA, 25 bp, Rattus norvegicus
agtgaacccaacgaagagcagcttc

SEQ ID NO: 160055 - DNA, 25 bp, Rattus norvegicus
agtgaaccccaaccccagagagaag

SEQ ID NO: 160056 - DNA, 25 bp, Rattus norvegicus
agtgaaccccaagcccagagagaag

SEQ ID NO: 160057 - DNA, 25 bp, Rattus norvegicus
agtgaaccccagcttcgacctgagg

SEQ ID NO: 160058 - DNA, 25 bp, Rattus norvegicus
agtgaaccccaggttcgacctgagg

SEQ ID NO: 160059 - DNA, 25 bp, Rattus norvegicus
agtgaaccctgactctctatgagac

SEQ ID NO: 160060 - DNA, 25 bp, Rattus norvegicus
agtgaaccctgagtctctatgagac

SEQ ID NO: 160061 - DNA, 25 bp, Rattus norvegicus
agtgaacctttgacttagctctgct

SEQ ID NO: 160062 - DNA, 25 bp, Rattus norvegicus
agtgaacctttgtcttagctctgct

SEQ ID NO: 160063 - DNA, 25 bp, Rattus norvegicus
agtgaacgagcccactccacgggag

SEQ ID NO: 160064 - DNA, 25 bp, Rattus norvegicus
agtgaacgagccgactccacgggag

SEQ ID NO: 160065 - DNA, 25 bp, Rattus norvegicus
agtgaacgctttatccagctaggct

SEQ ID NO: 160066 - DNA, 25 bp, Rattus norvegicus
agtgaacgctttttccagctaggct

SEQ ID NO: 160067 - DNA, 25 bp, Rattus norvegicus
agtgaacgggtcagctcaacagcca

SEQ ID NO: 160068 - DNA, 25 bp, Rattus norvegicus
agtgaacgggtctgctcaacagcca

SEQ ID NO: 160069 - DNA, 25 bp, Rattus norvegicus
agtgaactaatcactgcccatggga

SEQ ID NO: 160070 - DNA, 25 bp, Rattus norvegicus
agtgaactaatctctgcccatggga

SEQ ID NO: 160071 - DNA, 25 bp, Rattus norvegicus
agtgaactactcagcaacctactcg

SEQ ID NO: 160072 - DNA, 25 bp, Rattus norvegicus
agtgaactactctgcaacctactcg

SEQ ID NO: 160073 - DNA, 25 bp, Rattus norvegicus
agtgaactcaaacccactgacctct

SEQ ID NO: 160074 - DNA, 25 bp, Rattus norvegicus
agtgaactcaaagccactgacctct

SEQ ID NO: 160075 - DNA, 25 bp, Rattus norvegicus
agtgaactcgggatgctttcctcct

SEQ ID NO: 160076 - DNA, 25 bp, Rattus norvegicus
agtgaactcgggttgctttcctcct

SEQ ID NO: 160077 - DNA, 25 bp, Rattus norvegicus
agtgaactgaaaacggctgctatgt

SEQ ID NO: 160078 - DNA, 25 bp, Rattus norvegicus
agtgaactgaaatcggctgctatgt

SEQ ID NO: 160079 - DNA, 25 bp, Rattus norvegicus
agtgaactgaacagctcttttttgc

SEQ ID NO: 160080 - DNA, 25 bp, Rattus norvegicus
agtgaactgaactgctcttttttgc

SEQ ID NO: 160081 - DNA, 25 bp, Rattus norvegicus
agtgaactgtccagctttctttctc

SEQ ID NO: 160082 - DNA, 25 bp, Rattus norvegicus
agtgaactgtcctgctttctttctc

SEQ ID NO: 160083 - DNA, 25 bp, Rattus norvegicus
agtgaacttcacagtccagaccatg

SEQ ID NO: 160084 - DNA, 25 bp, Rattus norvegicus
agtgaacttcactgtccagaccatg

SEQ ID NO: 160085 - DNA, 25 bp, Rattus norvegicus
agtgaacttcatcgtctcgctggac

SEQ ID NO: 160086 - DNA, 25 bp, Rattus norvegicus
agtgaacttcatggtctcgctggac

SEQ ID NO: 160087 - DNA, 25 bp, Rattus norvegicus
agtgaacttgcacctttgtgtccag

SEQ ID NO: 160088 - DNA, 25 bp, Rattus norvegicus
agtgaacttgcagctttgtgtccag

SEQ ID NO: 160089 - DNA, 25 bp, Rattus norvegicus
agtgaagaaccaactgcgcttcctt

SEQ ID NO: 160090 - DNA, 25 bp, Rattus norvegicus
agtgaagaaccatctgcgcttcctt

SEQ ID NO: 160091 - DNA, 25 bp, Rattus norvegicus
agtgaagaagtgaccccacctcaga

SEQ ID NO: 160092 - DNA, 25 bp, Rattus norvegicus
agtgaagaagtgtccccacctcaga

SEQ ID NO: 160093 - DNA, 25 bp, Rattus norvegicus
agtgaagacgctcaccatgcagcca

SEQ ID NO: 160094 - DNA, 25 bp, Rattus norvegicus
agtgaagacgctgaccatgcagcca

SEQ ID NO: 160095 - DNA, 25 bp, Rattus norvegicus
agtgaagactagcagtccctctggc

SEQ ID NO: 160096 - DNA, 25 bp, Rattus norvegicus
agtgaagactaggagtccctctggc

SEQ ID NO: 160097 - DNA, 25 bp, Rattus norvegicus
agtgaagactcacctgtcaccctga

SEQ ID NO: 160098 - DNA, 25 bp, Rattus norvegicus
agtgaagactcagctgtcaccctga

SEQ ID NO: 160099 - DNA, 25 bp, Rattus norvegicus
agtgaagagatgacactgtctgtgg

SEQ ID NO: 160100 - DNA, 25 bp, Rattus norvegicus
agtgaagagatgtcactgtctgtgg

SEQ ID NO: 160101 - DNA, 25 bp, Rattus norvegicus
agtgaagagctgacttgctgctgca

SEQ ID NO: 160102 - DNA, 25 bp, Rattus norvegicus
agtgaagagctgtcttgctgctgca

SEQ ID NO: 160103 - DNA, 25 bp, Rattus norvegicus
agtgaagattctcctcacagcaggc

SEQ ID NO: 160104 - DNA, 25 bp, Rattus norvegicus
agtgaagattctgctcacagcaggc

SEQ ID NO: 160105 - DNA, 25 bp, Rattus norvegicus
agtgaagcacttcccgcagatgcca

SEQ ID NO: 160106 - DNA, 25 bp, Rattus norvegicus
agtgaagcacttgccgcagatgcca

SEQ ID NO: 160107 - DNA, 25 bp, Rattus norvegicus
agtgaagcatccatatccagcagac

SEQ ID NO: 160108 - DNA, 25 bp, Rattus norvegicus
agtgaagcatccttatccagcagac

SEQ ID NO: 160109 - DNA, 25 bp, Rattus norvegicus
agtgaagcattgagccctactctgg

SEQ ID NO: 160110 - DNA, 25 bp, Rattus norvegicus
agtgaagcattgtgccctactctgg

SEQ ID NO: 160111 - DNA, 25 bp, Rattus norvegicus
agtgaagccagtctgtctgccgaac

SEQ ID NO: 160112 - DNA, 25 bp, Rattus norvegicus
agtgaagccagtgtgtctgccgaac

SEQ ID NO: 160113 - DNA, 25 bp, Rattus norvegicus
agtgaagcggcaccgccgggtgagc

SEQ ID NO: 160114 - DNA, 25 bp, Rattus norvegicus
agtgaagcggcagcgccgggtgagc

SEQ ID NO: 160115 - DNA, 25 bp, Rattus norvegicus
agtgaagctgacaggcatggcctgt

SEQ ID NO: 160116 - DNA, 25 bp, Rattus norvegicus
agtgaagctgactggcatggcctgt

SEQ ID NO: 160117 - DNA, 25 bp, Rattus norvegicus
agtgaagcttgcagggtgctcccat

SEQ ID NO: 160118 - DNA, 25 bp, Rattus norvegicus
agtgaagcttgctgggtgctcccat

SEQ ID NO: 160119 - DNA, 25 bp, Rattus norvegicus
agtgaaggaggcagcgcccctcttc

SEQ ID NO: 160120 - DNA, 25 bp, Rattus norvegicus
agtgaaggaggctgcgcccctcttc

SEQ ID NO: 160121 - DNA, 25 bp, Rattus norvegicus
agtgaaggcagcaccctcgtgggtt

SEQ ID NO: 160122 - DNA, 25 bp, Rattus norvegicus
agtgaaggcagctccctcgtgggtt

SEQ ID NO: 160123 - DNA, 25 bp, Rattus norvegicus
agtgaaggcttacgtctgggacaat

SEQ ID NO: 160124 - DNA, 25 bp, Rattus norvegicus
agtgaaggcttaggtctgggacaat

SEQ ID NO: 160125 - DNA, 25 bp, Rattus norvegicus
agtgaaggtctcagtgtctgcagcc

SEQ ID NO: 160126 - DNA, 25 bp, Rattus norvegicus
agtgaaggtctctgtgtctgcagcc

SEQ ID NO: 160127 - DNA, 25 bp, Rattus norvegicus
agtgaaggtggtatgcagccctcat

SEQ ID NO: 160128 - DNA, 25 bp, Rattus norvegicus
agtgaaggtggtttgcagccctcat

SEQ ID NO: 160129 - DNA, 25 bp, Rattus norvegicus
agtgaagtccccataagccgacaag

SEQ ID NO: 160130 - DNA, 25 bp, Rattus norvegicus
agtgaagtccccttaagccgacaag

SEQ ID NO: 160131 - DNA, 25 bp, Rattus norvegicus
agtgaagtcgtacctctccatacta

SEQ ID NO: 160132 - DNA, 25 bp, Rattus norvegicus
agtgaagtcgtagctctccatacta

SEQ ID NO: 160133 - DNA, 25 bp, Rattus norvegicus
agtgaagtcgtgaaagcagctgctt

SEQ ID NO: 160134 - DNA, 25 bp, Rattus norvegicus
agtgaagtcgtgtaagcagctgctt

SEQ ID NO: 160135 - DNA, 25 bp, Rattus norvegicus
agtgaagtgactcatcctgagaaag

SEQ ID NO: 160136 - DNA, 25 bp, Rattus norvegicus
agtgaagtgactgatcctgagaaag

SEQ ID NO: 160137 - DNA, 25 bp, Rattus norvegicus
agtgaagtgcttctagcctcgtagc

SEQ ID NO: 160138 - DNA, 25 bp, Rattus norvegicus
agtgaagtgcttgtagcctcgtagc

SEQ ID NO: 160139 - DNA, 25 bp, Rattus norvegicus
agtgaagtggcaccgcagacctctg

SEQ ID NO: 160140 - DNA, 25 bp, Rattus norvegicus
agtgaagtggcagcgcagacctctg

SEQ ID NO: 160141 - DNA, 25 bp, Rattus norvegicus
agtgaagtggccactcttgacagtc

SEQ ID NO: 160142 - DNA, 25 bp, Rattus norvegicus
agtgaagtggcctctcttgacagtc

SEQ ID NO: 160143 - DNA, 25 bp, Rattus norvegicus
agtgaagtggtcacctacccatgat

SEQ ID NO: 160144 - DNA, 25 bp, Rattus norvegicus
agtgaagtggtctcctacccatgat

SEQ ID NO: 160145 - DNA, 25 bp, Rattus norvegicus
agtgaatacatcatgacccagcctg

SEQ ID NO: 160146 - DNA, 25 bp, Rattus norvegicus
agtgaatacatcttgacccagcctg

SEQ ID NO: 160147 - DNA, 25 bp, Rattus norvegicus
agtgaatatgtcctagaccctctgg

SEQ ID NO: 160148 - DNA, 25 bp, Rattus norvegicus
agtgaatatgtcgtagaccctctgg

SEQ ID NO: 160149 - DNA, 25 bp, Rattus norvegicus
agtgaatatgttacaggtgctcctg

SEQ ID NO: 160150 - DNA, 25 bp, Rattus norvegicus
agtgaatatgtttcaggtgctcctg

SEQ ID NO: 160151 - DNA, 25 bp, Rattus norvegicus
agtgaatcacacatacatctttggt

SEQ ID NO: 160152 - DNA, 25 bp, Rattus norvegicus
agtgaatcacacttacatctttggt

SEQ ID NO: 160153 - DNA, 25 bp, Rattus norvegicus
agtgaatcactgaaggtctgggacc

SEQ ID NO: 160154 - DNA, 25 bp, Rattus norvegicus
agtgaatcactgtaggtctgggacc

SEQ ID NO: 160155 - DNA, 25 bp, Rattus norvegicus
agtgaatctcataccaggtcctgct

SEQ ID NO: 160156 - DNA, 25 bp, Rattus norvegicus
agtgaatctcattccaggtcctgct

SEQ ID NO: 160157 - DNA, 25 bp, Rattus norvegicus
agtgaatgatcccatgttgcccaac

SEQ ID NO: 160158 - DNA, 25 bp, Rattus norvegicus
agtgaatgatccgatgttgcccaac

SEQ ID NO: 160159 - DNA, 25 bp, Rattus norvegicus
agtgaatgcaccctcaggctgagtg

SEQ ID NO: 160160 - DNA, 25 bp, Rattus norvegicus
agtgaatgcaccgtcaggctgagtg

SEQ ID NO: 160161 - DNA, 25 bp, Rattus norvegicus
agtgaatgcctcagctatgagcaga

SEQ ID NO: 160162 - DNA, 25 bp, Rattus norvegicus
agtgaatgcctctgctatgagcaga

SEQ ID NO: 160163 - DNA, 25 bp, Rattus norvegicus
agtgaatgccttctttgagacgtta

SEQ ID NO: 160164 - DNA, 25 bp, Rattus norvegicus
agtgaatgccttgtttgagacgtta

SEQ ID NO: 160165 - DNA, 25 bp, Rattus norvegicus
agtgaatgctcacaatcctgccgat

SEQ ID NO: 160166 - DNA, 25 bp, Rattus norvegicus
agtgaatgctcagaatcctgccgat

SEQ ID NO: 160167 - DNA, 25 bp, Rattus norvegicus
agtgaatgggccctttgatccacac

SEQ ID NO: 160168 - DNA, 25 bp, Rattus norvegicus
agtgaatgggccgtttgatccacac

SEQ ID NO: 160169 - DNA, 25 bp, Rattus norvegicus
agtgaatggttcatcgtttgtcctc

SEQ ID NO: 160170 - DNA, 25 bp, Rattus norvegicus
agtgaatggttcatgtctgtcttcc

SEQ ID NO: 160171 - DNA, 25 bp, Rattus norvegicus
agtgaatggttcttcgtttgtcctc

SEQ ID NO: 160172 - DNA, 25 bp, Rattus norvegicus
agtgaatggttcttgtctgtcttcc

SEQ ID NO: 160173 - DNA, 25 bp, Rattus norvegicus
agtgaatgtcacaccgtgttctgtc

SEQ ID NO: 160174 - DNA, 25 bp, Rattus norvegicus
agtgaatgtcactccgtgttctgtc

SEQ ID NO: 160175 - DNA, 25 bp, Rattus norvegicus
agtgaatgtgctcgcgcagattctc

SEQ ID NO: 160176 - DNA, 25 bp, Rattus norvegicus
agtgaatgtgctggcgcagattctc

SEQ ID NO: 160177 - DNA, 25 bp, Rattus norvegicus
agtgaatgttcgaacactggctcct

SEQ ID NO: 160178 - DNA, 25 bp, Rattus norvegicus
agtgaatgttcgtacactggctcct

SEQ ID NO: 160179 - DNA, 25 bp, Rattus norvegicus
agtgaattaaacagtcgcttggaag

SEQ ID NO: 160180 - DNA, 25 bp, Rattus norvegicus
agtgaattaaactgtcgcttggaag

SEQ ID NO: 160181 - DNA, 25 bp, Rattus norvegicus
agtgaattaaggcacccttgccccg

SEQ ID NO: 160182 - DNA, 25 bp, Rattus norvegicus
agtgaattaagggacccttgccccg

SEQ ID NO: 160183 - DNA, 25 bp, Rattus norvegicus
agtgaattccaacggcctgtctcta

SEQ ID NO: 160184 - DNA, 25 bp, Rattus norvegicus
agtgaattccaagggcctgtctcta

SEQ ID NO: 160185 - DNA, 25 bp, Rattus norvegicus
agtgaattccagcaccctcagggct

SEQ ID NO: 160186 - DNA, 25 bp, Rattus norvegicus
agtgaattccaggaccctcagggct

SEQ ID NO: 160187 - DNA, 25 bp, Rattus norvegicus
agtgaattccgtcctgggctactgg

SEQ ID NO: 160188 - DNA, 25 bp, Rattus norvegicus
agtgaattccgtgctgggctactgg

SEQ ID NO: 160189 - DNA, 25 bp, Rattus norvegicus
agtgaattgcagacccagccaaagg

SEQ ID NO: 160190 - DNA, 25 bp, Rattus norvegicus
agtgaattgcagtcccagccaaagg

SEQ ID NO: 160191 - DNA, 25 bp, Rattus norvegicus
agtgaatttcctctaatgcccctgc

SEQ ID NO: 160192 - DNA, 25 bp, Rattus norvegicus
agtgaatttcctgtaatgcccctgc

SEQ ID NO: 160193 - DNA, 25 bp, Rattus norvegicus
agtgaatttctacctctgtatctgc

SEQ ID NO: 160194 - DNA, 25 bp, Rattus norvegicus
agtgaatttctagctctgtatctgc

SEQ ID NO: 160195 - DNA, 25 bp, Rattus norvegicus
agtgaatttctcattctctgttgga

SEQ ID NO: 160196 - DNA, 25 bp, Rattus norvegicus
agtgaatttctctttctctgttgga

SEQ ID NO: 160197 - DNA, 25 bp, Rattus norvegicus
agtgacaaacccagtaggaacgcag

SEQ ID NO: 160198 - DNA, 25 bp, Rattus norvegicus
agtgacaaaccctgtaggaacgcag

SEQ ID NO: 160199 - DNA, 25 bp, Rattus norvegicus
agtgacaacagccagatgcatctgc

SEQ ID NO: 160200 - DNA, 25 bp, Rattus norvegicus
agtgacaacagcgagatgcatctgc

SEQ ID NO: 160201 - DNA, 25 bp, Rattus norvegicus
agtgacaacgcaattaacttcgaag

SEQ ID NO: 160202 - DNA, 25 bp, Rattus norvegicus
agtgacaacgcatttaacttcgaag

SEQ ID NO: 160203 - DNA, 25 bp, Rattus norvegicus
agtgacaactggacatcctcagcag

SEQ ID NO: 160204 - DNA, 25 bp, Rattus norvegicus
agtgacaactggtcatcctcagcag

SEQ ID NO: 160205 - DNA, 25 bp, Rattus norvegicus
agtgacaactgtcctagcctctgtt

SEQ ID NO: 160206 - DNA, 25 bp, Rattus norvegicus
agtgacaactgtgctagcctctgtt

SEQ ID NO: 160207 - DNA, 25 bp, Rattus norvegicus
agtgacaaggcccacgacagagctc

SEQ ID NO: 160208 - DNA, 25 bp, Rattus norvegicus
agtgacaaggccgacgacagagctc

SEQ ID NO: 160209 - DNA, 25 bp, Rattus norvegicus
agtgacaatcggatggtagtgaaaa

SEQ ID NO: 160210 - DNA, 25 bp, Rattus norvegicus
agtgacaatcggttggtagtgaaaa

SEQ ID NO: 160211 - DNA, 25 bp, Rattus norvegicus
agtgacaatgcccaagacctgctta

SEQ ID NO: 160212 - DNA, 25 bp, Rattus norvegicus
agtgacaatgccgaagacctgctta

SEQ ID NO: 160213 - DNA, 25 bp, Rattus norvegicus
agtgacaattatcgcaggcctgcct

SEQ ID NO: 160214 - DNA, 25 bp, Rattus norvegicus
agtgacaattatggcaggcctgcct

SEQ ID NO: 160215 - DNA, 25 bp, Rattus norvegicus
agtgacaattgcaaagctcccacca

SEQ ID NO: 160216 - DNA, 25 bp, Rattus norvegicus
agtgacaattgctaagctcccacca

SEQ ID NO: 160217 - DNA, 25 bp, Rattus norvegicus
agtgacacacagagcacgtgaggtg

SEQ ID NO: 160218 - DNA, 25 bp, Rattus norvegicus
agtgacacacagtgcacgtgaggtg

SEQ ID NO: 160219 - DNA, 25 bp, Rattus norvegicus
agtgacacagccctacacttggtaa

SEQ ID NO: 160220 - DNA, 25 bp, Rattus norvegicus
agtgacacagccgtacacttggtaa

SEQ ID NO: 160221 - DNA, 25 bp, Rattus norvegicus
agtgacaccctcaagccttaaaatt

SEQ ID NO: 160222 - DNA, 25 bp, Rattus norvegicus
agtgacaccctctagccttaaaatt

SEQ ID NO: 160223 - DNA, 25 bp, Rattus norvegicus
agtgacaccctgatcatggacaatt

SEQ ID NO: 160224 - DNA, 25 bp, Rattus norvegicus
agtgacaccctgttcatggacaatt

SEQ ID NO: 160225 - DNA, 25 bp, Rattus norvegicus
agtgacactattatcagcacccagg

SEQ ID NO: 160226 - DNA, 25 bp, Rattus norvegicus
agtgacactattttcagcacccagg

SEQ ID NO: 160227 - DNA, 25 bp, Rattus norvegicus
agtgacacttttaagggctttagag

SEQ ID NO: 160228 - DNA, 25 bp, Rattus norvegicus
agtgacactttttagggctttagag

SEQ ID NO: 160229 - DNA, 25 bp, Rattus norvegicus
agtgacagacatatcccagaggctc

SEQ ID NO: 160230 - DNA, 25 bp, Rattus norvegicus
agtgacagacatttcccagaggctc

SEQ ID NO: 160231 - DNA, 25 bp, Rattus norvegicus
agtgacagctggacctgcgcagatg

SEQ ID NO: 160232 - DNA, 25 bp, Rattus norvegicus
agtgacagctggtcctgcgcagatg

SEQ ID NO: 160233 - DNA, 25 bp, Rattus norvegicus
agtgacaggcgtcgccactaccaat

SEQ ID NO: 160234 - DNA, 25 bp, Rattus norvegicus
agtgacaggcgtggccactaccaat

SEQ ID NO: 160235 - DNA, 25 bp, Rattus norvegicus
agtgacagggtcacctatctggccc

SEQ ID NO: 160236 - DNA, 25 bp, Rattus norvegicus
agtgacagggtctcctatctggccc

SEQ ID NO: 160237 - DNA, 25 bp, Rattus norvegicus
agtgacaggtggagctccgcaacat

SEQ ID NO: 160238 - DNA, 25 bp, Rattus norvegicus
agtgacaggtggtgctccgcaacat

SEQ ID NO: 160239 - DNA, 25 bp, Rattus norvegicus
agtgacagtaacaccggctcagaga

SEQ ID NO: 160240 - DNA, 25 bp, Rattus norvegicus
agtgacagtaactccggctcagaga

SEQ ID NO: 160241 - DNA, 25 bp, Rattus norvegicus
agtgacagttacagccgggtgtcca

SEQ ID NO: 160242 - DNA, 25 bp, Rattus norvegicus
agtgacagttacatcagcgctctat

SEQ ID NO: 160243 - DNA, 25 bp, Rattus norvegicus
agtgacagttactgccgggtgtcca

SEQ ID NO: 160244 - DNA, 25 bp, Rattus norvegicus
agtgacagttacttcagcgctctat

SEQ ID NO: 160245 - DNA, 25 bp, Rattus norvegicus
agtgacatcacacccagattatctt

SEQ ID NO: 160246 - DNA, 25 bp, Rattus norvegicus
agtgacatcacagccagattatctt

SEQ ID NO: 160247 - DNA, 25 bp, Rattus norvegicus
agtgacatcactcggccactgggct

SEQ ID NO: 160248 - DNA, 25 bp, Rattus norvegicus
agtgacatcactgggccactgggct

SEQ ID NO: 160249 - DNA, 25 bp, Rattus norvegicus
agtgacatctgaaccgatacgagag

SEQ ID NO: 160250 - DNA, 25 bp, Rattus norvegicus
agtgacatctgatccgatacgagag

SEQ ID NO: 160251 - DNA, 25 bp, Rattus norvegicus
agtgacatggacagtgcctcacagc

SEQ ID NO: 160252 - DNA, 25 bp, Rattus norvegicus
agtgacatggactgtgcctcacagc

SEQ ID NO: 160253 - DNA, 25 bp, Rattus norvegicus
agtgacatgggtacctcctcctgga

SEQ ID NO: 160254 - DNA, 25 bp, Rattus norvegicus
agtgacatgggttcctcctcctgga

SEQ ID NO: 160255 - DNA, 25 bp, Rattus norvegicus
agtgacatgtagatcctggttggca

SEQ ID NO: 160256 - DNA, 25 bp, Rattus norvegicus
agtgacatgtagttcctggttggca

SEQ ID NO: 160257 - DNA, 25 bp, Rattus norvegicus
agtgacatgtccacaaatgccgatc

SEQ ID NO: 160258 - DNA, 25 bp, Rattus norvegicus
agtgacatgtcctcaaatgccgatc

SEQ ID NO: 160259 - DNA, 25 bp, Rattus norvegicus
agtgacattaagatctgtgctctag

SEQ ID NO: 160260 - DNA, 25 bp, Rattus norvegicus
agtgacattaagttctgtgctctag

SEQ ID NO: 160261 - DNA, 25 bp, Rattus norvegicus
agtgacattatactttctcgcctca

SEQ ID NO: 160262 - DNA, 25 bp, Rattus norvegicus
agtgacattatagtttctcgcctca

SEQ ID NO: 160263 - DNA, 25 bp, Rattus norvegicus
agtgacattcgacagttggtgccca

SEQ ID NO: 160264 - DNA, 25 bp, Rattus norvegicus
agtgacattcgagagttggtgccca

SEQ ID NO: 160265 - DNA, 25 bp, Rattus norvegicus
agtgacattgtcaatgccatcatgg

SEQ ID NO: 160266 - DNA, 25 bp, Rattus norvegicus
agtgacattgtctatgccatcatgg

SEQ ID NO: 160267 - DNA, 25 bp, Rattus norvegicus
agtgaccaaaacctctctcgaatga

SEQ ID NO: 160268 - DNA, 25 bp, Rattus norvegicus
agtgaccaaaacgtctctcgaatga

SEQ ID NO: 160269 - DNA, 25 bp, Rattus norvegicus
agtgaccaaatgatacccacaccta

SEQ ID NO: 160270 - DNA, 25 bp, Rattus norvegicus
agtgaccaaatgttacccacaccta

SEQ ID NO: 160271 - DNA, 25 bp, Rattus norvegicus
agtgaccaaattatctgtgcagtta

SEQ ID NO: 160272 - DNA, 25 bp, Rattus norvegicus
agtgaccaaattttctgtgcagtta

SEQ ID NO: 160273 - DNA, 25 bp, Rattus norvegicus
agtgaccaacatcacagtctgctgc

SEQ ID NO: 160274 - DNA, 25 bp, Rattus norvegicus
agtgaccaacatgacagtctgctgc

SEQ ID NO: 160275 - DNA, 25 bp, Rattus norvegicus
agtgaccaacttccaggtgggccca

SEQ ID NO: 160276 - DNA, 25 bp, Rattus norvegicus
agtgaccaacttgcaggtgggccca

SEQ ID NO: 160277 - DNA, 25 bp, Rattus norvegicus
agtgaccaagatcagctttgacctt

SEQ ID NO: 160278 - DNA, 25 bp, Rattus norvegicus
agtgaccaagatgagctttgacctt

SEQ ID NO: 160279 - DNA, 25 bp, Rattus norvegicus
agtgaccaagcacttaagtgttcct

SEQ ID NO: 160280 - DNA, 25 bp, Rattus norvegicus
agtgaccaagcagttaagtgttcct

SEQ ID NO: 160281 - DNA, 25 bp, Rattus norvegicus
agtgaccaaggaacatttgcaattg

SEQ ID NO: 160282 - DNA, 25 bp, Rattus norvegicus
agtgaccaaggatcatttgcaattg

SEQ ID NO: 160283 - DNA, 25 bp, Rattus norvegicus
agtgaccaatacctgcataacctca

SEQ ID NO: 160284 - DNA, 25 bp, Rattus norvegicus
agtgaccaatacgtgcataacctca

SEQ ID NO: 160285 - DNA, 25 bp, Rattus norvegicus
agtgaccaatgacagatcagcccct

SEQ ID NO: 160286 - DNA, 25 bp, Rattus norvegicus
agtgaccaatgagagatcagcccct

SEQ ID NO: 160287 - DNA, 25 bp, Rattus norvegicus
agtgaccacacacggtgactctggg

SEQ ID NO: 160288 - DNA, 25 bp, Rattus norvegicus
agtgaccacacagggtgactctggg

SEQ ID NO: 160289 - DNA, 25 bp, Rattus norvegicus
agtgaccacagcattgccagcacat

SEQ ID NO: 160290 - DNA, 25 bp, Rattus norvegicus
agtgaccacagctttgccagcacat

SEQ ID NO: 160291 - DNA, 25 bp, Rattus norvegicus
agtgaccacatcattgtatgtccaa

SEQ ID NO: 160292 - DNA, 25 bp, Rattus norvegicus
agtgaccacatctttgtatgtccaa

SEQ ID NO: 160293 - DNA, 25 bp, Rattus norvegicus
agtgaccactacatttcccaagagt

SEQ ID NO: 160294 - DNA, 25 bp, Rattus norvegicus
agtgaccactacttttcccaagagt

SEQ ID NO: 160295 - DNA, 25 bp, Rattus norvegicus
agtgaccagcagagagaaggacccc

SEQ ID NO: 160296 - DNA, 25 bp, Rattus norvegicus
agtgaccagcagtgagaaggacccc

SEQ ID NO: 160297 - DNA, 25 bp, Rattus norvegicus
agtgaccaggttatattgcaggcaa

SEQ ID NO: 160298 - DNA, 25 bp, Rattus norvegicus
agtgaccaggttttattgcaggcaa

SEQ ID NO: 160299 - DNA, 25 bp, Rattus norvegicus
agtgaccagtcgctgcagctaccaa

SEQ ID NO: 160300 - DNA, 25 bp, Rattus norvegicus
agtgaccagtcggtgcagctaccaa

SEQ ID NO: 160301 - DNA, 25 bp, Rattus norvegicus
agtgaccagtctaccaaggacatgt

SEQ ID NO: 160302 - DNA, 25 bp, Rattus norvegicus
agtgaccagtcttccaaggacatgt

SEQ ID NO: 160303 - DNA, 25 bp, Rattus norvegicus
agtgaccatggacgctaggcactca

SEQ ID NO: 160304 - DNA, 25 bp, Rattus norvegicus
agtgaccatggaggctaggcactca

SEQ ID NO: 160305 - DNA, 25 bp, Rattus norvegicus
agtgacccaagaactctcatacaaa

SEQ ID NO: 160306 - DNA, 25 bp, Rattus norvegicus
agtgacccaagatctctcatacaaa

SEQ ID NO: 160307 - DNA, 25 bp, Rattus norvegicus
agtgacccactcattgctgtgagtc

SEQ ID NO: 160308 - DNA, 25 bp, Rattus norvegicus
agtgacccactctttgctgtgagtc

SEQ ID NO: 160309 - DNA, 25 bp, Rattus norvegicus
agtgacccactgactgtgtttgaac

SEQ ID NO: 160310 - DNA, 25 bp, Rattus norvegicus
agtgacccactgtctgtgtttgaac

SEQ ID NO: 160311 - DNA, 25 bp, Rattus norvegicus
agtgacccatcaagaagcccatgac

SEQ ID NO: 160312 - DNA, 25 bp, Rattus norvegicus
agtgacccatcatgaagcccatgac

SEQ ID NO: 160313 - DNA, 25 bp, Rattus norvegicus
agtgaccccactatatgtttcttgc

SEQ ID NO: 160314 - DNA, 25 bp, Rattus norvegicus
agtgaccccactccgacagtcatgt

SEQ ID NO: 160315 - DNA, 25 bp, Rattus norvegicus
agtgaccccactgcgacagtcatgt

SEQ ID NO: 160316 - DNA, 25 bp, Rattus norvegicus
agtgaccccactttatgtttcttgc

SEQ ID NO: 160317 - DNA, 25 bp, Rattus norvegicus
agtgaccccaggatctttcatgcag

SEQ ID NO: 160318 - DNA, 25 bp, Rattus norvegicus
agtgaccccaggttctttcatgcag

SEQ ID NO: 160319 - DNA, 25 bp, Rattus norvegicus
agtgacccctaacgtcgccaagaag

SEQ ID NO: 160320 - DNA, 25 bp, Rattus norvegicus
agtgacccctaaggtcgccaagaag

SEQ ID NO: 160321 - DNA, 25 bp, Rattus norvegicus
agtgacccctggactctgagcagag

SEQ ID NO: 160322 - DNA, 25 bp, Rattus norvegicus
agtgacccctggtctctgagcagag

SEQ ID NO: 160323 - DNA, 25 bp, Rattus norvegicus
agtgacccctgtaggacgagctgag

SEQ ID NO: 160324 - DNA, 25 bp, Rattus norvegicus
agtgacccctgttggacgagctgag

SEQ ID NO: 160325 - DNA, 25 bp, Rattus norvegicus
agtgaccctactactcatggagcct

SEQ ID NO: 160326 - DNA, 25 bp, Rattus norvegicus
agtgaccctacttctcatggagcct

SEQ ID NO: 160327 - DNA, 25 bp, Rattus norvegicus
agtgaccctggcctcagcgtggcaa

SEQ ID NO: 160328 - DNA, 25 bp, Rattus norvegicus
agtgaccctggcgtcagcgtggcaa

SEQ ID NO: 160329 - DNA, 25 bp, Rattus norvegicus
agtgaccctggtattgtgaggagca

SEQ ID NO: 160330 - DNA, 25 bp, Rattus norvegicus
agtgaccctggttttgtgaggagca

SEQ ID NO: 160331 - DNA, 25 bp, Rattus norvegicus
agtgacccttagctgcagtgtcaga

SEQ ID NO: 160332 - DNA, 25 bp, Rattus norvegicus
agtgacccttaggtgcagtgtcaga

SEQ ID NO: 160333 - DNA, 25 bp, Rattus norvegicus
agtgaccgagtacagttcttccctg

SEQ ID NO: 160334 - DNA, 25 bp, Rattus norvegicus
agtgaccgagtagagttcttccctg

SEQ ID NO: 160335 - DNA, 25 bp, Rattus norvegicus
agtgaccgatttactattcctttgc

SEQ ID NO: 160336 - DNA, 25 bp, Rattus norvegicus
agtgaccgattttctattcctttgc

SEQ ID NO: 160337 - DNA, 25 bp, Rattus norvegicus
agtgaccgctgtattgttttagaca

SEQ ID NO: 160338 - DNA, 25 bp, Rattus norvegicus
agtgaccgctgttttgttttagaca

SEQ ID NO: 160339 - DNA, 25 bp, Rattus norvegicus
agtgaccgtgagactatctgttcca

SEQ ID NO: 160340 - DNA, 25 bp, Rattus norvegicus
agtgaccgtgagtctatctgttcca

SEQ ID NO: 160341 - DNA, 25 bp, Rattus norvegicus
agtgacctaaccagatgtcctgtgc

SEQ ID NO: 160342 - DNA, 25 bp, Rattus norvegicus
agtgacctaacctgatgtcctgtgc

SEQ ID NO: 160343 - DNA, 25 bp, Rattus norvegicus
agtgacctcaatacgctcactggtg

SEQ ID NO: 160344 - DNA, 25 bp, Rattus norvegicus
agtgacctcaattcgctcactggtg

SEQ ID NO: 160345 - DNA, 25 bp, Rattus norvegicus
agtgacctcacacctgccttgggac

SEQ ID NO: 160346 - DNA, 25 bp, Rattus norvegicus
agtgacctcacagctgccttgggac

SEQ ID NO: 160347 - DNA, 25 bp, Rattus norvegicus
agtgacctcaccagcagcataaaag

SEQ ID NO: 160348 - DNA, 25 bp, Rattus norvegicus
agtgacctcacctgcagcataaaag

SEQ ID NO: 160349 - DNA, 25 bp, Rattus norvegicus
agtgacctcccactgtgggctacag

SEQ ID NO: 160350 - DNA, 25 bp, Rattus norvegicus
agtgacctcccagtgtgggctacag

SEQ ID NO: 160351 - DNA, 25 bp, Rattus norvegicus
agtgacctccccatgcaatggtggg

SEQ ID NO: 160352 - DNA, 25 bp, Rattus norvegicus
agtgacctccccttgcaatggtggg

SEQ ID NO: 160353 - DNA, 25 bp, Rattus norvegicus
agtgacctgaggaccatagagcaaa

SEQ ID NO: 160354 - DNA, 25 bp, Rattus norvegicus
agtgacctgaggtccatagagcaaa

SEQ ID NO: 160355 - DNA, 25 bp, Rattus norvegicus
agtgacctgattctgatccccaaaa

SEQ ID NO: 160356 - DNA, 25 bp, Rattus norvegicus
agtgacctgattgtgatccccaaaa

SEQ ID NO: 160357 - DNA, 25 bp, Rattus norvegicus
agtgacctggcacagctttgggcat

SEQ ID NO: 160358 - DNA, 25 bp, Rattus norvegicus
agtgacctggcagagctttgggcat

SEQ ID NO: 160359 - DNA, 25 bp, Rattus norvegicus
agtgacctggcgcatctcatgctgc

SEQ ID NO: 160360 - DNA, 25 bp, Rattus norvegicus
agtgacctggcggatctcatgctgc

SEQ ID NO: 160361 - DNA, 25 bp, Rattus norvegicus
agtgacctgtgccatggcttttgtt

SEQ ID NO: 160362 - DNA, 25 bp, Rattus norvegicus
agtgacctgtgcgatggcttttgtt

SEQ ID NO: 160363 - DNA, 25 bp, Rattus norvegicus
agtgaccttctaaccgcaacaggcc

SEQ ID NO: 160364 - DNA, 25 bp, Rattus norvegicus
agtgaccttctatccgcaacaggcc

SEQ ID NO: 160365 - DNA, 25 bp, Rattus norvegicus
agtgaccttctcacagaagtctgag

SEQ ID NO: 160366 - DNA, 25 bp, Rattus norvegicus
agtgaccttctctcagaagtctgag

SEQ ID NO: 160367 - DNA, 25 bp, Rattus norvegicus
agtgacctttcaattttctttcttg

SEQ ID NO: 160368 - DNA, 25 bp, Rattus norvegicus
agtgacctttcatttttctttcttg

SEQ ID NO: 160369 - DNA, 25 bp, Rattus norvegicus
agtgacctttgtaagctaccggctg

SEQ ID NO: 160370 - DNA, 25 bp, Rattus norvegicus
agtgacctttgttagctaccggctg

SEQ ID NO: 160371 - DNA, 25 bp, Rattus norvegicus
agtgacgaatcgctccttctttcag

SEQ ID NO: 160372 - DNA, 25 bp, Rattus norvegicus
agtgacgaatcggtccttctttcag

SEQ ID NO: 160373 - DNA, 25 bp, Rattus norvegicus
agtgacgacagcctagtggactacg

SEQ ID NO: 160374 - DNA, 25 bp, Rattus norvegicus
agtgacgacagcgtagtggactacg

SEQ ID NO: 160375 - DNA, 25 bp, Rattus norvegicus
agtgacgagcttaaggctttcctac

SEQ ID NO: 160376 - DNA, 25 bp, Rattus norvegicus
agtgacgagctttaggctttcctac

SEQ ID NO: 160377 - DNA, 25 bp, Rattus norvegicus
agtgacgaggacaacaagcccctgc

SEQ ID NO: 160378 - DNA, 25 bp, Rattus norvegicus
agtgacgaggactacaagcccctgc

SEQ ID NO: 160379 - DNA, 25 bp, Rattus norvegicus
agtgacgagttccacacctacatca

SEQ ID NO: 160380 - DNA, 25 bp, Rattus norvegicus
agtgacgagttcgacacctacatca

SEQ ID NO: 160381 - DNA, 25 bp, Rattus norvegicus
agtgacgatcgacccaaatctgttt

SEQ ID NO: 160382 - DNA, 25 bp, Rattus norvegicus
agtgacgatcgagccaaatctgttt

SEQ ID NO: 160383 - DNA, 25 bp, Rattus norvegicus
agtgacgatctcatgatcttcaatg

SEQ ID NO: 160384 - DNA, 25 bp, Rattus norvegicus
agtgacgatctcttgatcttcaatg

SEQ ID NO: 160385 - DNA, 25 bp, Rattus norvegicus
agtgacgatgaaactccaaactcca

SEQ ID NO: 160386 - DNA, 25 bp, Rattus norvegicus
agtgacgatgaatctccaaactcca

SEQ ID NO: 160387 - DNA, 25 bp, Rattus norvegicus
agtgacgattataatggagcaaaga

SEQ ID NO: 160388 - DNA, 25 bp, Rattus norvegicus
agtgacgattattatggagcaaaga

SEQ ID NO: 160389 - DNA, 25 bp, Rattus norvegicus
agtgacgccaggaaagtgcttttta

SEQ ID NO: 160390 - DNA, 25 bp, Rattus norvegicus
agtgacgccaggtaagtgcttttta

SEQ ID NO: 160391 - DNA, 25 bp, Rattus norvegicus
agtgacgcctgaagttgcttccatt

SEQ ID NO: 160392 - DNA, 25 bp, Rattus norvegicus
agtgacgcctgatgttgcttccatt

SEQ ID NO: 160393 - DNA, 25 bp, Rattus norvegicus
agtgacgctccgactctagagttta

SEQ ID NO: 160394 - DNA, 25 bp, Rattus norvegicus
agtgacgctccgtctctagagttta

SEQ ID NO: 160395 - DNA, 25 bp, Rattus norvegicus
agtgacggcagtaccagtgactact

SEQ ID NO: 160396 - DNA, 25 bp, Rattus norvegicus
agtgacggcagttccagtgactact

SEQ ID NO: 160397 - DNA, 25 bp, Rattus norvegicus
agtgacggccggcaacccaaagctg

SEQ ID NO: 160398 - DNA, 25 bp, Rattus norvegicus
agtgacggccgggaacccaaagctg

SEQ ID NO: 160399 - DNA, 25 bp, Rattus norvegicus
agtgacgggagaccctctgcagcct

SEQ ID NO: 160400 - DNA, 25 bp, Rattus norvegicus
agtgacgggagagcctctgcagcct

SEQ ID NO: 160401 - DNA, 25 bp, Rattus norvegicus
agtgacggtcttcattgtgttgttc

SEQ ID NO: 160402 - DNA, 25 bp, Rattus norvegicus
agtgacggtcttgattgtgttgttc

SEQ ID NO: 160403 - DNA, 25 bp, Rattus norvegicus
agtgacggtgcaatggaccctggct

SEQ ID NO: 160404 - DNA, 25 bp, Rattus norvegicus
agtgacggtgcattggaccctggct

SEQ ID NO: 160405 - DNA, 25 bp, Rattus norvegicus
agtgacgtactcatatgttcagaag

SEQ ID NO: 160406 - DNA, 25 bp, Rattus norvegicus
agtgacgtactcttatgttcagaag

SEQ ID NO: 160407 - DNA, 25 bp, Rattus norvegicus
agtgacgtcagaagcttcatccctg

SEQ ID NO: 160408 - DNA, 25 bp, Rattus norvegicus
agtgacgtcagatgcttcatccctg

SEQ ID NO: 160409 - DNA, 25 bp, Rattus norvegicus
agtgacgtgaccagtttacagttct

SEQ ID NO: 160410 - DNA, 25 bp, Rattus norvegicus
agtgacgtgacctgtttacagttct

SEQ ID NO: 160411 - DNA, 25 bp, Rattus norvegicus
agtgacgtggtgatcgatcggcctc

SEQ ID NO: 160412 - DNA, 25 bp, Rattus norvegicus
agtgacgtggtgttcgatcggcctc

SEQ ID NO: 160413 - DNA, 25 bp, Rattus norvegicus
agtgacgttgaaactggtggccaag

SEQ ID NO: 160414 - DNA, 25 bp, Rattus norvegicus
agtgacgttgaatctggtggccaag

SEQ ID NO: 160415 - DNA, 25 bp, Rattus norvegicus
agtgacgtttgtactatggattagt

SEQ ID NO: 160416 - DNA, 25 bp, Rattus norvegicus
agtgacgtttgttctatggattagt

SEQ ID NO: 160417 - DNA, 25 bp, Rattus norvegicus
agtgactaccttcacttcctttatt

SEQ ID NO: 160418 - DNA, 25 bp, Rattus norvegicus
agtgactaccttgacttcctttatt

SEQ ID NO: 160419 - DNA, 25 bp, Rattus norvegicus
agtgactactgacaagcctccccag

SEQ ID NO: 160420 - DNA, 25 bp, Rattus norvegicus
agtgactactgaccctctggtgcca

SEQ ID NO: 160421 - DNA, 25 bp, Rattus norvegicus
agtgactactgagaagcctccccag

SEQ ID NO: 160422 - DNA, 25 bp, Rattus norvegicus
agtgactactgagcctctggtgcca

SEQ ID NO: 160423 - DNA, 25 bp, Rattus norvegicus
agtgactaggtgactctgggctgtt

SEQ ID NO: 160424 - DNA, 25 bp, Rattus norvegicus
agtgactaggtgtctctgggctgtt

SEQ ID NO: 160425 - DNA, 25 bp, Rattus norvegicus
agtgactatgttaaagagcacgtaa

SEQ ID NO: 160426 - DNA, 25 bp, Rattus norvegicus
agtgactatgtttaagagcacgtaa

SEQ ID NO: 160427 - DNA, 25 bp, Rattus norvegicus
agtgactcactaaagcatgcagctt

SEQ ID NO: 160428 - DNA, 25 bp, Rattus norvegicus
agtgactcactatagcatgcagctt

SEQ ID NO: 160429 - DNA, 25 bp, Rattus norvegicus
agtgactcactgcaatgacggttta

SEQ ID NO: 160430 - DNA, 25 bp, Rattus norvegicus
agtgactcactggaatgacggttta

SEQ ID NO: 160431 - DNA, 25 bp, Rattus norvegicus
agtgactcagaacggatctcatcca

SEQ ID NO: 160432 - DNA, 25 bp, Rattus norvegicus
agtgactcagaagggatctcatcca

SEQ ID NO: 160433 - DNA, 25 bp, Rattus norvegicus
agtgactcagagatgcaacaagcat

SEQ ID NO: 160434 - DNA, 25 bp, Rattus norvegicus
agtgactcagagttgcaacaagcat

SEQ ID NO: 160435 - DNA, 25 bp, Rattus norvegicus
agtgactcagatccctgcccaggag

SEQ ID NO: 160436 - DNA, 25 bp, Rattus norvegicus
agtgactcagatgcctgcccaggag

SEQ ID NO: 160437 - DNA, 25 bp, Rattus norvegicus
agtgactcaggacatgaccagtgct

SEQ ID NO: 160438 - DNA, 25 bp, Rattus norvegicus
agtgactcaggagatgaccagtgct

SEQ ID NO: 160439 - DNA, 25 bp, Rattus norvegicus
agtgactccaatatgcccgaagatt

SEQ ID NO: 160440 - DNA, 25 bp, Rattus norvegicus
agtgactccaatttgcccgaagatt

SEQ ID NO: 160441 - DNA, 25 bp, Rattus norvegicus
agtgactcccaacttaaatctcctc

SEQ ID NO: 160442 - DNA, 25 bp, Rattus norvegicus
agtgactcccaagttaaatctcctc

SEQ ID NO: 160443 - DNA, 25 bp, Rattus norvegicus
agtgactcctacaatctgcaggcag

SEQ ID NO: 160444 - DNA, 25 bp, Rattus norvegicus
agtgactcctactatctgcaggcag

SEQ ID NO: 160445 - DNA, 25 bp, Rattus norvegicus
agtgactcggagaaggcctcggcct

SEQ ID NO: 160446 - DNA, 25 bp, Rattus norvegicus
agtgactcggagtaggcctcggcct

SEQ ID NO: 160447 - DNA, 25 bp, Rattus norvegicus
agtgactcgtaccttggcctgtgga

SEQ ID NO: 160448 - DNA, 25 bp, Rattus norvegicus
agtgactcgtacgttggcctgtgga

SEQ ID NO: 160449 - DNA, 25 bp, Rattus norvegicus
agtgactctaagcatccctcggtct

SEQ ID NO: 160450 - DNA, 25 bp, Rattus norvegicus
agtgactctaaggatccctcggtct

SEQ ID NO: 160451 - DNA, 25 bp, Rattus norvegicus
agtgactctgccatgaccttgatga

SEQ ID NO: 160452 - DNA, 25 bp, Rattus norvegicus
agtgactctgccttgaccttgatga

SEQ ID NO: 160453 - DNA, 25 bp, Rattus norvegicus
agtgactctggcaccagatgggtct

SEQ ID NO: 160454 - DNA, 25 bp, Rattus norvegicus
agtgactctggccatcagctgttcc

SEQ ID NO: 160455 - DNA, 25 bp, Rattus norvegicus
agtgactctggcgatcagctgttcc

SEQ ID NO: 160456 - DNA, 25 bp, Rattus norvegicus
agtgactctggctccagatgggtct

SEQ ID NO: 160457 - DNA, 25 bp, Rattus norvegicus
agtgactctttcaccatagctttgg

SEQ ID NO: 160458 - DNA, 25 bp, Rattus norvegicus
agtgactctttctccatagctttgg

SEQ ID NO: 160459 - DNA, 25 bp, Rattus norvegicus
agtgactcttttcaggtccctgtac

SEQ ID NO: 160460 - DNA, 25 bp, Rattus norvegicus
agtgactcttttgaggtccctgtac

SEQ ID NO: 160461 - DNA, 25 bp, Rattus norvegicus
agtgactgaccaagcactgcatttg

SEQ ID NO: 160462 - DNA, 25 bp, Rattus norvegicus
agtgactgaccatgcactgcatttg

SEQ ID NO: 160463 - DNA, 25 bp, Rattus norvegicus
agtgactgaggtcatgccatcttga

SEQ ID NO: 160464 - DNA, 25 bp, Rattus norvegicus
agtgactgaggtgatgccatcttga

SEQ ID NO: 160465 - DNA, 25 bp, Rattus norvegicus
agtgactgcagcaactgagccctca

SEQ ID NO: 160466 - DNA, 25 bp, Rattus norvegicus
agtgactgcagctactgagccctca

SEQ ID NO: 160467 - DNA, 25 bp, Rattus norvegicus
agtgactgctagagcctgccctcct

SEQ ID NO: 160468 - DNA, 25 bp, Rattus norvegicus
agtgactgctagtgcctgccctcct

SEQ ID NO: 160469 - DNA, 25 bp, Rattus norvegicus
agtgactgctcaccactgttaccca

SEQ ID NO: 160470 - DNA, 25 bp, Rattus norvegicus
agtgactgctcagcactgttaccca

SEQ ID NO: 160471 - DNA, 25 bp, Rattus norvegicus
agtgactggattactcctgggagcc

SEQ ID NO: 160472 - DNA, 25 bp, Rattus norvegicus
agtgactggatttctcctgggagcc

SEQ ID NO: 160473 - DNA, 25 bp, Rattus norvegicus
agtgactggcctacatctaacttgt

SEQ ID NO: 160474 - DNA, 25 bp, Rattus norvegicus
agtgactggccttcatctaacttgt

SEQ ID NO: 160475 - DNA, 25 bp, Rattus norvegicus
agtgactgggtcacttctggaaatg

SEQ ID NO: 160476 - DNA, 25 bp, Rattus norvegicus
agtgactgggtctcttctggaaatg

SEQ ID NO: 160477 - DNA, 25 bp, Rattus norvegicus
agtgactgtatgaacacctcctact

SEQ ID NO: 160478 - DNA, 25 bp, Rattus norvegicus
agtgactgtatgtacacctcctact

SEQ ID NO: 160479 - DNA, 25 bp, Rattus norvegicus
agtgactgtccacgacctctgaggc

SEQ ID NO: 160480 - DNA, 25 bp, Rattus norvegicus
agtgactgtccaggacctctgaggc

SEQ ID NO: 160481 - DNA, 25 bp, Rattus norvegicus
agtgactgtggtctcttccaagcct

SEQ ID NO: 160482 - DNA, 25 bp, Rattus norvegicus
agtgactgtggtgtcttccaagcct

SEQ ID NO: 160483 - DNA, 25 bp, Rattus norvegicus
agtgactgtgtcaccttgactatca

SEQ ID NO: 160484 - DNA, 25 bp, Rattus norvegicus
agtgactgtgtctccttgactatca

SEQ ID NO: 160485 - DNA, 25 bp, Rattus norvegicus
agtgactgttaacatgctctgtgct

SEQ ID NO: 160486 - DNA, 25 bp, Rattus norvegicus
agtgactgttaagatgctctgtgct

SEQ ID NO: 160487 - DNA, 25 bp, Rattus norvegicus
agtgacttaaggaggttgctgctaa

SEQ ID NO: 160488 - DNA, 25 bp, Rattus norvegicus
agtgacttaaggtggttgctgctaa

SEQ ID NO: 160489 - DNA, 25 bp, Rattus norvegicus
agtgacttccagattagttggtctc

SEQ ID NO: 160490 - DNA, 25 bp, Rattus norvegicus
agtgacttccagtttagttggtctc

SEQ ID NO: 160491 - DNA, 25 bp, Rattus norvegicus
agtgacttcctgatgtatgtggcct

SEQ ID NO: 160492 - DNA, 25 bp, Rattus norvegicus
agtgacttcctgttgtatgtggcct

SEQ ID NO: 160493 - DNA, 25 bp, Rattus norvegicus
agtgacttctgccaagttcccggtc

SEQ ID NO: 160494 - DNA, 25 bp, Rattus norvegicus
agtgacttctgcgaagttcccggtc

SEQ ID NO: 160495 - DNA, 25 bp, Rattus norvegicus
agtgacttgcctctattgtttgtaa

SEQ ID NO: 160496 - DNA, 25 bp, Rattus norvegicus
agtgacttgcctgtattgtttgtaa

SEQ ID NO: 160497 - DNA, 25 bp, Rattus norvegicus
agtgactttattaatacctctgcat

SEQ ID NO: 160498 - DNA, 25 bp, Rattus norvegicus
agtgactttattagccttctagaat

SEQ ID NO: 160499 - DNA, 25 bp, Rattus norvegicus
agtgactttatttatacctctgcat

SEQ ID NO: 160500 - DNA, 25 bp, Rattus norvegicus
agtgactttatttgccttctagaat

SEQ ID NO: 160501 - DNA, 25 bp, Rattus norvegicus
agtgactttcacatgggaactcaga

SEQ ID NO: 160502 - DNA, 25 bp, Rattus norvegicus
agtgactttcacttgggaactcaga

SEQ ID NO: 160503 - DNA, 25 bp, Rattus norvegicus
agtgactttccacaaactcgagttg

SEQ ID NO: 160504 - DNA, 25 bp, Rattus norvegicus
agtgactttccagaaactcgagttg

SEQ ID NO: 160505 - DNA, 25 bp, Rattus norvegicus
agtgactttccgaggccacaggcca

SEQ ID NO: 160506 - DNA, 25 bp, Rattus norvegicus
agtgactttccgtggccacaggcca

SEQ ID NO: 160507 - DNA, 25 bp, Rattus norvegicus
agtgactttgacatgggtgccagga

SEQ ID NO: 160508 - DNA, 25 bp, Rattus norvegicus
agtgactttgacttgggtgccagga

SEQ ID NO: 160509 - DNA, 25 bp, Rattus norvegicus
agtgactttggtcacaggctcctgt

SEQ ID NO: 160510 - DNA, 25 bp, Rattus norvegicus
agtgactttggtgacaggctcctgt

SEQ ID NO: 160511 - DNA, 25 bp, Rattus norvegicus
agtgactttgtgatccatgggacca

SEQ ID NO: 160512 - DNA, 25 bp, Rattus norvegicus
agtgactttgtgttccatgggacca

SEQ ID NO: 160513 - DNA, 25 bp, Rattus norvegicus
agtgagaacacaccgttgtacccca

SEQ ID NO: 160514 - DNA, 25 bp, Rattus norvegicus
agtgagaacacagcgttgtacccca

SEQ ID NO: 160515 - DNA, 25 bp, Rattus norvegicus
agtgagaaccacctgtagggcttat

SEQ ID NO: 160516 - DNA, 25 bp, Rattus norvegicus
agtgagaaccacgtgtagggcttat

SEQ ID NO: 160517 - DNA, 25 bp, Rattus norvegicus
agtgagaactctcccagtcttccag

SEQ ID NO: 160518 - DNA, 25 bp, Rattus norvegicus
agtgagaactctgccagtcttccag

SEQ ID NO: 160519 - DNA, 25 bp, Rattus norvegicus
agtgagaactttccctactgtgttt

SEQ ID NO: 160520 - DNA, 25 bp, Rattus norvegicus
agtgagaactttgcctactgtgttt

SEQ ID NO: 160521 - DNA, 25 bp, Rattus norvegicus
agtgagaagggcaacctcttggctc

SEQ ID NO: 160522 - DNA, 25 bp, Rattus norvegicus
agtgagaagggctacctcttggctc

SEQ ID NO: 160523 - DNA, 25 bp, Rattus norvegicus
agtgagaccacgaacagcggctttc

SEQ ID NO: 160524 - DNA, 25 bp, Rattus norvegicus
agtgagaccacgtacagcggctttc

SEQ ID NO: 160525 - DNA, 25 bp, Rattus norvegicus
agtgagaccgaacggacgcccaagt

SEQ ID NO: 160526 - DNA, 25 bp, Rattus norvegicus
agtgagaccgaagggacgcccaagt

SEQ ID NO: 160527 - DNA, 25 bp, Rattus norvegicus
agtgagaccggcaaggcgctgattc

SEQ ID NO: 160528 - DNA, 25 bp, Rattus norvegicus
agtgagaccggcagctccttttaag

SEQ ID NO: 160529 - DNA, 25 bp, Rattus norvegicus
agtgagaccggctaggcgctgattc

SEQ ID NO: 160530 - DNA, 25 bp, Rattus norvegicus
agtgagaccggctgctccttttaag

SEQ ID NO: 160531 - DNA, 25 bp, Rattus norvegicus
agtgagacgaggaccaggctagccc

SEQ ID NO: 160532 - DNA, 25 bp, Rattus norvegicus
agtgagacgaggtccaggctagccc

SEQ ID NO: 160533 - DNA, 25 bp, Rattus norvegicus
agtgagactgaacttcctccaccgg

SEQ ID NO: 160534 - DNA, 25 bp, Rattus norvegicus
agtgagactgaagttcctccaccgg

SEQ ID NO: 160535 - DNA, 25 bp, Rattus norvegicus
agtgagagcaagaccagtccccagg

SEQ ID NO: 160536 - DNA, 25 bp, Rattus norvegicus
agtgagagcaagtccagtccccagg

SEQ ID NO: 160537 - DNA, 25 bp, Rattus norvegicus
agtgagagctctcgtgggctcttca

SEQ ID NO: 160538 - DNA, 25 bp, Rattus norvegicus
agtgagagctctggtgggctcttca

SEQ ID NO: 160539 - DNA, 25 bp, Rattus norvegicus
agtgagagctgaacccggtccgctg

SEQ ID NO: 160540 - DNA, 25 bp, Rattus norvegicus
agtgagagctgatcccggtccgctg

SEQ ID NO: 160541 - DNA, 25 bp, Rattus norvegicus
agtgagagcttgcattctggatcaa

SEQ ID NO: 160542 - DNA, 25 bp, Rattus norvegicus
agtgagagcttggattctggatcaa

SEQ ID NO: 160543 - DNA, 25 bp, Rattus norvegicus
agtgagagctttccctcgggccctt

SEQ ID NO: 160544 - DNA, 25 bp, Rattus norvegicus
agtgagagctttgcctcgggccctt

SEQ ID NO: 160545 - DNA, 25 bp, Rattus norvegicus
agtgagaggatgcatgtcccagtcc

SEQ ID NO: 160546 - DNA, 25 bp, Rattus norvegicus
agtgagaggatggatgtcccagtcc

SEQ ID NO: 160547 - DNA, 25 bp, Rattus norvegicus
agtgagagtttgatcacgcctgtct

SEQ ID NO: 160548 - DNA, 25 bp, Rattus norvegicus
agtgagagtttgttcacgcctgtct

SEQ ID NO: 160549 - DNA, 25 bp, Rattus norvegicus
agtgagatcactatcccagctgtca

SEQ ID NO: 160550 - DNA, 25 bp, Rattus norvegicus
agtgagatcactttcccagctgtca

SEQ ID NO: 160551 - DNA, 25 bp, Rattus norvegicus
agtgagatgagtagccctgcccaca

SEQ ID NO: 160552 - DNA, 25 bp, Rattus norvegicus
agtgagatgagttgccctgcccaca

SEQ ID NO: 160553 - DNA, 25 bp, Rattus norvegicus
agtgagatgcgcatgtcttcagatc

SEQ ID NO: 160554 - DNA, 25 bp, Rattus norvegicus
agtgagatgcgcttgtcttcagatc

SEQ ID NO: 160555 - DNA, 25 bp, Rattus norvegicus
agtgagatgcggacgccagagaaca

SEQ ID NO: 160556 - DNA, 25 bp, Rattus norvegicus
agtgagatgcggtcgccagagaaca

SEQ ID NO: 160557 - DNA, 25 bp, Rattus norvegicus
agtgagatgtccctgtctcccatca

SEQ ID NO: 160558 - DNA, 25 bp, Rattus norvegicus
agtgagatgtccgtgtctcccatca

SEQ ID NO: 160559 - DNA, 25 bp, Rattus norvegicus
agtgagattcacacttccacatttg

SEQ ID NO: 160560 - DNA, 25 bp, Rattus norvegicus
agtgagattcactcttccacatttg

SEQ ID NO: 160561 - DNA, 25 bp, Rattus norvegicus
agtgagatttacagactttcccaga

SEQ ID NO: 160562 - DNA, 25 bp, Rattus norvegicus
agtgagatttactgactttcccaga

SEQ ID NO: 160563 - DNA, 25 bp, Rattus norvegicus
agtgagcaaaccctggctggacctg

SEQ ID NO: 160564 - DNA, 25 bp, Rattus norvegicus
agtgagcaaaccgtggctggacctg

SEQ ID NO: 160565 - DNA, 25 bp, Rattus norvegicus
agtgagcacattctattttccttcc

SEQ ID NO: 160566 - DNA, 25 bp, Rattus norvegicus
agtgagcacattgtattttccttcc

SEQ ID NO: 160567 - DNA, 25 bp, Rattus norvegicus
agtgagcactcacgcctgcagagta

SEQ ID NO: 160568 - DNA, 25 bp, Rattus norvegicus
agtgagcactcaggcctgcagagta

SEQ ID NO: 160569 - DNA, 25 bp, Rattus norvegicus
agtgagcatgagatgtcggatgact

SEQ ID NO: 160570 - DNA, 25 bp, Rattus norvegicus
agtgagcatgagttgtcggatgact

SEQ ID NO: 160571 - DNA, 25 bp, Rattus norvegicus
agtgagcatggcagttctccgggac

SEQ ID NO: 160572 - DNA, 25 bp, Rattus norvegicus
agtgagcatggctgttctccgggac

SEQ ID NO: 160573 - DNA, 25 bp, Rattus norvegicus
agtgagcattagatcttttccctgg

SEQ ID NO: 160574 - DNA, 25 bp, Rattus norvegicus
agtgagcattagttcttttccctgg

SEQ ID NO: 160575 - DNA, 25 bp, Rattus norvegicus
agtgagccagacagggtggcccaaa

SEQ ID NO: 160576 - DNA, 25 bp, Rattus norvegicus
agtgagccagactgggtggcccaaa

SEQ ID NO: 160577 - DNA, 25 bp, Rattus norvegicus
agtgagccagtgagagcgtacgttt

SEQ ID NO: 160578 - DNA, 25 bp, Rattus norvegicus
agtgagccagtgtgagcgtacgttt

SEQ ID NO: 160579 - DNA, 25 bp, Rattus norvegicus
agtgagcccactccagagcacagaa

SEQ ID NO: 160580 - DNA, 25 bp, Rattus norvegicus
agtgagcccactgcagagcacagaa

SEQ ID NO: 160581 - DNA, 25 bp, Rattus norvegicus
agtgagcccagtaccagtctggacc

SEQ ID NO: 160582 - DNA, 25 bp, Rattus norvegicus
agtgagcccagttccagtctggacc

SEQ ID NO: 160583 - DNA, 25 bp, Rattus norvegicus
agtgagcccatcatgtgtttataaa

SEQ ID NO: 160584 - DNA, 25 bp, Rattus norvegicus
agtgagcccatcttgtgtttataaa

SEQ ID NO: 160585 - DNA, 25 bp, Rattus norvegicus
agtgagcccctcacacggacagtga

SEQ ID NO: 160586 - DNA, 25 bp, Rattus norvegicus
agtgagcccctctcacggacagtga

SEQ ID NO: 160587 - DNA, 25 bp, Rattus norvegicus
agtgagccctccagtgttgtagtgc

SEQ ID NO: 160588 - DNA, 25 bp, Rattus norvegicus
agtgagccctcctgtgttgtagtgc

SEQ ID NO: 160589 - DNA, 25 bp, Rattus norvegicus
agtgagcctaagaagttccccttgg

SEQ ID NO: 160590 - DNA, 25 bp, Rattus norvegicus
agtgagcctaagtagttccccttgg

SEQ ID NO: 160591 - DNA, 25 bp, Rattus norvegicus
agtgagcctctgacagcttgtgaac

SEQ ID NO: 160592 - DNA, 25 bp, Rattus norvegicus
agtgagcctctgtcagcttgtgaac

SEQ ID NO: 160593 - DNA, 25 bp, Rattus norvegicus
agtgagcctgctccagagaaaaaga

SEQ ID NO: 160594 - DNA, 25 bp, Rattus norvegicus
agtgagcctgctgcagagaaaaaga

SEQ ID NO: 160595 - DNA, 25 bp, Rattus norvegicus
agtgagcctgtcagggtagagtcct

SEQ ID NO: 160596 - DNA, 25 bp, Rattus norvegicus
agtgagcctgtctgggtagagtcct

SEQ ID NO: 160597 - DNA, 25 bp, Rattus norvegicus
agtgagcgcactaacccttcgtggg

SEQ ID NO: 160598 - DNA, 25 bp, Rattus norvegicus
agtgagcgcacttacccttcgtggg

SEQ ID NO: 160599 - DNA, 25 bp, Rattus norvegicus
agtgagcgctttcggacgtgtcctt

SEQ ID NO: 160600 - DNA, 25 bp, Rattus norvegicus
agtgagcgctttgggacgtgtcctt

SEQ ID NO: 160601 - DNA, 25 bp, Rattus norvegicus
agtgagcggagacctcttctgctga

SEQ ID NO: 160602 - DNA, 25 bp, Rattus norvegicus
agtgagcggagagctcttctgctga

SEQ ID NO: 160603 - DNA, 25 bp, Rattus norvegicus
agtgagcggcttcaccctggcttaa

SEQ ID NO: 160604 - DNA, 25 bp, Rattus norvegicus
agtgagcggcttgaccctggcttaa

SEQ ID NO: 160605 - DNA, 25 bp, Rattus norvegicus
agtgagcgtgtaacagcctctggcc

SEQ ID NO: 160606 - DNA, 25 bp, Rattus norvegicus
agtgagcgtgtatcagcctctggcc

SEQ ID NO: 160607 - DNA, 25 bp, Rattus norvegicus
agtgagctaatgacctgaatccaaa

SEQ ID NO: 160608 - DNA, 25 bp, Rattus norvegicus
agtgagctaatgtcctgaatccaaa

SEQ ID NO: 160609 - DNA, 25 bp, Rattus norvegicus
agtgagctacttcccatgcgaggtc

SEQ ID NO: 160610 - DNA, 25 bp, Rattus norvegicus
agtgagctacttgccatgcgaggtc

SEQ ID NO: 160611 - DNA, 25 bp, Rattus norvegicus
agtgagctatgtcgagcttgcctcc

SEQ ID NO: 160612 - DNA, 25 bp, Rattus norvegicus
agtgagctatgtggagcttgcctcc

SEQ ID NO: 160613 - DNA, 25 bp, Rattus norvegicus
agtgagctcagcactagccagccaa

SEQ ID NO: 160614 - DNA, 25 bp, Rattus norvegicus
agtgagctcagctctagccagccaa

SEQ ID NO: 160615 - DNA, 25 bp, Rattus norvegicus
agtgagctgcacatttggtgacccc

SEQ ID NO: 160616 - DNA, 25 bp, Rattus norvegicus
agtgagctgcacttttggtgacccc

SEQ ID NO: 160617 - DNA, 25 bp, Rattus norvegicus
agtgagctgcccctgagaacgtgtt

SEQ ID NO: 160618 - DNA, 25 bp, Rattus norvegicus
agtgagctgcccgtgagaacgtgtt

SEQ ID NO: 160619 - DNA, 25 bp, Rattus norvegicus
agtgagctgctgactcggagaaaag

SEQ ID NO: 160620 - DNA, 25 bp, Rattus norvegicus
agtgagctgctgtctcggagaaaag

SEQ ID NO: 160621 - DNA, 25 bp, Rattus norvegicus
agtgagcttagacctgagcacaccc

SEQ ID NO: 160622 - DNA, 25 bp, Rattus norvegicus
agtgagcttagagctgagcacaccc

SEQ ID NO: 160623 - DNA, 25 bp, Rattus norvegicus
agtgagcttgatcttcatgttgtca

SEQ ID NO: 160624 - DNA, 25 bp, Rattus norvegicus
agtgagcttgatgttcatgttgtca

SEQ ID NO: 160625 - DNA, 25 bp, Rattus norvegicus
agtgagcttgctcgctagtccagta

SEQ ID NO: 160626 - DNA, 25 bp, Rattus norvegicus
agtgagcttgctggctagtccagta

SEQ ID NO: 160627 - DNA, 25 bp, Rattus norvegicus
agtgagctttcacttttagtttgca

SEQ ID NO: 160628 - DNA, 25 bp, Rattus norvegicus
agtgagctttcagttttagtttgca

SEQ ID NO: 160629 - DNA, 25 bp, Rattus norvegicus
agtgagcttttccacagagccttat

SEQ ID NO: 160630 - DNA, 25 bp, Rattus norvegicus
agtgagcttttcgacagagccttat

SEQ ID NO: 160631 - DNA, 25 bp, Rattus norvegicus
agtgaggaaccccaagcgtgcccta

SEQ ID NO: 160632 - DNA, 25 bp, Rattus norvegicus
agtgaggaacccgaagcgtgcccta

SEQ ID NO: 160633 - DNA, 25 bp, Rattus norvegicus
agtgaggaatccagatctctcgccc

SEQ ID NO: 160634 - DNA, 25 bp, Rattus norvegicus
agtgaggaatcctgatctctcgccc

SEQ ID NO: 160635 - DNA, 25 bp, Rattus norvegicus
agtgaggacactatctaccggacag

SEQ ID NO: 160636 - DNA, 25 bp, Rattus norvegicus
agtgaggacactttctaccggacag

SEQ ID NO: 160637 - DNA, 25 bp, Rattus norvegicus
agtgaggacccactcctagggtaat

SEQ ID NO: 160638 - DNA, 25 bp, Rattus norvegicus
agtgaggacccagtcctagggtaat

SEQ ID NO: 160639 - DNA, 25 bp, Rattus norvegicus
agtgaggacgccaacacagtgctga

SEQ ID NO: 160640 - DNA, 25 bp, Rattus norvegicus
agtgaggacgcctacacagtgctga

SEQ ID NO: 160641 - DNA, 25 bp, Rattus norvegicus
agtgaggactggactgctcgttctc

SEQ ID NO: 160642 - DNA, 25 bp, Rattus norvegicus
agtgaggactggtctgctcgttctc

SEQ ID NO: 160643 - DNA, 25 bp, Rattus norvegicus
agtgaggagccaagaccaccttaac

SEQ ID NO: 160644 - DNA, 25 bp, Rattus norvegicus
agtgaggagccatgaccaccttaac

SEQ ID NO: 160645 - DNA, 25 bp, Rattus norvegicus
agtgaggattctccagatttctgac

SEQ ID NO: 160646 - DNA, 25 bp, Rattus norvegicus
agtgaggattctgcagatttctgac

SEQ ID NO: 160647 - DNA, 25 bp, Rattus norvegicus
agtgaggcaggaacagatgtctttc

SEQ ID NO: 160648 - DNA, 25 bp, Rattus norvegicus
agtgaggcaggatcagatgtctttc

SEQ ID NO: 160649 - DNA, 25 bp, Rattus norvegicus
agtgaggcccctacaagtgtgtgtc

SEQ ID NO: 160650 - DNA, 25 bp, Rattus norvegicus
agtgaggccccttcaagtgtgtgtc

SEQ ID NO: 160651 - DNA, 25 bp, Rattus norvegicus
agtgaggcccttaattcatggcaaa

SEQ ID NO: 160652 - DNA, 25 bp, Rattus norvegicus
agtgaggccctttattcatggcaaa

SEQ ID NO: 160653 - DNA, 25 bp, Rattus norvegicus
agtgaggcctgtaccccacaagtgg

SEQ ID NO: 160654 - DNA, 25 bp, Rattus norvegicus
agtgaggcctgttccccacaagtgg

SEQ ID NO: 160655 - DNA, 25 bp, Rattus norvegicus
agtgaggcggcccttccaacgatga

SEQ ID NO: 160656 - DNA, 25 bp, Rattus norvegicus
agtgaggcggccgttccaacgatga

SEQ ID NO: 160657 - DNA, 25 bp, Rattus norvegicus
agtgaggcttctcggtgcataccag

SEQ ID NO: 160658 - DNA, 25 bp, Rattus norvegicus
agtgaggcttctgggtgcataccag

SEQ ID NO: 160659 - DNA, 25 bp, Rattus norvegicus
agtgagggaatgctcgaccccgctc

SEQ ID NO: 160660 - DNA, 25 bp, Rattus norvegicus
agtgagggaatggtcgaccccgctc

SEQ ID NO: 160661 - DNA, 25 bp, Rattus norvegicus
agtgagggcaccagagcacacgtgt

SEQ ID NO: 160662 - DNA, 25 bp, Rattus norvegicus
agtgagggcacctgagcacacgtgt

SEQ ID NO: 160663 - DNA, 25 bp, Rattus norvegicus
agtgagggcagcaatctgctgcacc

SEQ ID NO: 160664 - DNA, 25 bp, Rattus norvegicus
agtgagggcagctatctgctgcacc

SEQ ID NO: 160665 - DNA, 25 bp, Rattus norvegicus
agtgagggtccccatttgacacctg

SEQ ID NO: 160666 - DNA, 25 bp, Rattus norvegicus
agtgagggtcccgatttgacacctg

SEQ ID NO: 160667 - DNA, 25 bp, Rattus norvegicus
agtgagggtttcagctatttagttc

SEQ ID NO: 160668 - DNA, 25 bp, Rattus norvegicus
agtgagggtttctgctatttagttc

SEQ ID NO: 160669 - DNA, 25 bp, Rattus norvegicus
agtgaggtaggccaccatgacttcc

SEQ ID NO: 160670 - DNA, 25 bp, Rattus norvegicus
agtgaggtaggcgaccatgacttcc

SEQ ID NO: 160671 - DNA, 25 bp, Rattus norvegicus
agtgaggtcatgatctctctgtatt

SEQ ID NO: 160672 - DNA, 25 bp, Rattus norvegicus
agtgaggtcatgttctctctgtatt

SEQ ID NO: 160673 - DNA, 25 bp, Rattus norvegicus
agtgaggtctgaagggctcctccgt

SEQ ID NO: 160674 - DNA, 25 bp, Rattus norvegicus
agtgaggtctgatgggctcctccgt

SEQ ID NO: 160675 - DNA, 25 bp, Rattus norvegicus
agtgaggttcctcttactttggctt

SEQ ID NO: 160676 - DNA, 25 bp, Rattus norvegicus
agtgaggttcctgttactttggctt

SEQ ID NO: 160677 - DNA, 25 bp, Rattus norvegicus
agtgaggttgcaccaggtttgatcc

SEQ ID NO: 160678 - DNA, 25 bp, Rattus norvegicus
agtgaggttgcagcaggtttgatcc

SEQ ID NO: 160679 - DNA, 25 bp, Rattus norvegicus
agtgagtaagccattgcccacggct

SEQ ID NO: 160680 - DNA, 25 bp, Rattus norvegicus
agtgagtaagcctttgcccacggct

SEQ ID NO: 160681 - DNA, 25 bp, Rattus norvegicus
agtgagtactctctgcagcagacca

SEQ ID NO: 160682 - DNA, 25 bp, Rattus norvegicus
agtgagtactctgtgcagcagacca

SEQ ID NO: 160683 - DNA, 25 bp, Rattus norvegicus
agtgagtatcacagtctgcctcacc

SEQ ID NO: 160684 - DNA, 25 bp, Rattus norvegicus
agtgagtatcactgtctgcctcacc

SEQ ID NO: 160685 - DNA, 25 bp, Rattus norvegicus
agtgagtcaatgagtcactggctga

SEQ ID NO: 160686 - DNA, 25 bp, Rattus norvegicus
agtgagtcaatgtgtcactggctga

SEQ ID NO: 160687 - DNA, 25 bp, Rattus norvegicus
agtgagtcacgactgcacaggcaaa

SEQ ID NO: 160688 - DNA, 25 bp, Rattus norvegicus
agtgagtcacgagtgcacaggcaaa

SEQ ID NO: 160689 - DNA, 25 bp, Rattus norvegicus
agtgagtcattgatctgtaccttcc

SEQ ID NO: 160690 - DNA, 25 bp, Rattus norvegicus
agtgagtcattgttctgtaccttcc

SEQ ID NO: 160691 - DNA, 25 bp, Rattus norvegicus
agtgagtccaacacctcatgggttg

SEQ ID NO: 160692 - DNA, 25 bp, Rattus norvegicus
agtgagtccaactcctcatgggttg

SEQ ID NO: 160693 - DNA, 25 bp, Rattus norvegicus
agtgagtccattcacatcagcgcct

SEQ ID NO: 160694 - DNA, 25 bp, Rattus norvegicus
agtgagtccattgacatcagcgcct

SEQ ID NO: 160695 - DNA, 25 bp, Rattus norvegicus
agtgagtccctcatggagaatctct

SEQ ID NO: 160696 - DNA, 25 bp, Rattus norvegicus
agtgagtccctcttggagaatctct

SEQ ID NO: 160697 - DNA, 25 bp, Rattus norvegicus
agtgagtcctggagctccgtgcaca

SEQ ID NO: 160698 - DNA, 25 bp, Rattus norvegicus
agtgagtcctggtgctccgtgcaca

SEQ ID NO: 160699 - DNA, 25 bp, Rattus norvegicus
agtgagtcttgacttcccttttctc

SEQ ID NO: 160700 - DNA, 25 bp, Rattus norvegicus
agtgagtcttgagttcccttttctc

SEQ ID NO: 160701 - DNA, 25 bp, Rattus norvegicus
agtgagtgacaccaagcatctttgc

SEQ ID NO: 160702 - DNA, 25 bp, Rattus norvegicus
agtgagtgacacgaagcatctttgc

SEQ ID NO: 160703 - DNA, 25 bp, Rattus norvegicus
agtgagtgactaatctggacgtaga

SEQ ID NO: 160704 - DNA, 25 bp, Rattus norvegicus
agtgagtgactattctggacgtaga

SEQ ID NO: 160705 - DNA, 25 bp, Rattus norvegicus
agtgagtgcaacaccacctgagggc

SEQ ID NO: 160706 - DNA, 25 bp, Rattus norvegicus
agtgagtgcaactccacctgagggc

SEQ ID NO: 160707 - DNA, 25 bp, Rattus norvegicus
agtgagtgctctctgcgtgcctttc

SEQ ID NO: 160708 - DNA, 25 bp, Rattus norvegicus
agtgagtgctctgtgcgtgcctttc

SEQ ID NO: 160709 - DNA, 25 bp, Rattus norvegicus
agtgagtggagcagtgtccgcacct

SEQ ID NO: 160710 - DNA, 25 bp, Rattus norvegicus
agtgagtggagctgtgtccgcacct

SEQ ID NO: 160711 - DNA, 25 bp, Rattus norvegicus
agtgagtggcccaaccatggaggaa

SEQ ID NO: 160712 - DNA, 25 bp, Rattus norvegicus
agtgagtggcccagggtccaaccta

SEQ ID NO: 160713 - DNA, 25 bp, Rattus norvegicus
agtgagtggccctaccatggaggaa

SEQ ID NO: 160714 - DNA, 25 bp, Rattus norvegicus
agtgagtggccctgggtccaaccta

SEQ ID NO: 160715 - DNA, 25 bp, Rattus norvegicus
agtgagtgtgggagttactccgttt

SEQ ID NO: 160716 - DNA, 25 bp, Rattus norvegicus
agtgagtgtgggtgttactccgttt

SEQ ID NO: 160717 - DNA, 25 bp, Rattus norvegicus
agtgagtgttctaagctggctgtta

SEQ ID NO: 160718 - DNA, 25 bp, Rattus norvegicus
agtgagtgttcttagctggctgtta

SEQ ID NO: 160719 - DNA, 25 bp, Rattus norvegicus
agtgagttctagcacggccataatg

SEQ ID NO: 160720 - DNA, 25 bp, Rattus norvegicus
agtgagttctaggacggccataatg

SEQ ID NO: 160721 - DNA, 25 bp, Rattus norvegicus
agtgagttctggagcctgtgcttac

SEQ ID NO: 160722 - DNA, 25 bp, Rattus norvegicus
agtgagttctggtgcctgtgcttac

SEQ ID NO: 160723 - DNA, 25 bp, Rattus norvegicus
agtgagtttctcagtcaggagttcc

SEQ ID NO: 160724 - DNA, 25 bp, Rattus norvegicus
agtgagtttctctgtcaggagttcc

SEQ ID NO: 160725 - DNA, 25 bp, Rattus norvegicus
agtgagtttgacatcatgctgttca

SEQ ID NO: 160726 - DNA, 25 bp, Rattus norvegicus
agtgagtttgacttcatgctgttca

SEQ ID NO: 160727 - DNA, 25 bp, Rattus norvegicus
agtgagttttcaatcctgtaccttc

SEQ ID NO: 160728 - DNA, 25 bp, Rattus norvegicus
agtgagttttcattcctgtaccttc

SEQ ID NO: 160729 - DNA, 25 bp, Rattus norvegicus
agtgagttttctcccacctggacta

SEQ ID NO: 160730 - DNA, 25 bp, Rattus norvegicus
agtgagttttctcccctcagagcag

SEQ ID NO: 160731 - DNA, 25 bp, Rattus norvegicus
agtgagttttctgccacctggacta

SEQ ID NO: 160732 - DNA, 25 bp, Rattus norvegicus
agtgagttttctgccctcagagcag

SEQ ID NO: 160733 - DNA, 25 bp, Rattus norvegicus
agtgagtttttgacaccttgtgctg

SEQ ID NO: 160734 - DNA, 25 bp, Rattus norvegicus
agtgagtttttgtcaccttgtgctg

SEQ ID NO: 160735 - DNA, 25 bp, Rattus norvegicus
agtgataacctcagtcgacatgaca

SEQ ID NO: 160736 - DNA, 25 bp, Rattus norvegicus
agtgataacctctgtcgacatgaca

SEQ ID NO: 160737 - DNA, 25 bp, Rattus norvegicus
agtgataagcctagagcaccccagt

SEQ ID NO: 160738 - DNA, 25 bp, Rattus norvegicus
agtgataagccttgagcaccccagt

SEQ ID NO: 160739 - DNA, 25 bp, Rattus norvegicus
agtgataaggccaccccatgggcaa

SEQ ID NO: 160740 - DNA, 25 bp, Rattus norvegicus
agtgataaggcctccccatgggcaa

SEQ ID NO: 160741 - DNA, 25 bp, Rattus norvegicus
agtgataatacacgtctttaatccc

SEQ ID NO: 160742 - DNA, 25 bp, Rattus norvegicus
agtgataatacaggtctttaatccc

SEQ ID NO: 160743 - DNA, 25 bp, Rattus norvegicus
agtgataattaaaggcctgcttgtt

SEQ ID NO: 160744 - DNA, 25 bp, Rattus norvegicus
agtgataattaatggcctgcttgtt

SEQ ID NO: 160745 - DNA, 25 bp, Rattus norvegicus
agtgatacaataagcccctttggga

SEQ ID NO: 160746 - DNA, 25 bp, Rattus norvegicus
agtgatacaatatgcccctttggga

SEQ ID NO: 160747 - DNA, 25 bp, Rattus norvegicus
agtgatacacctaggcgctgaggat

SEQ ID NO: 160748 - DNA, 25 bp, Rattus norvegicus
agtgatacacctcaaaaatcttaag

SEQ ID NO: 160749 - DNA, 25 bp, Rattus norvegicus
agtgatacacctgaaaaatcttaag

SEQ ID NO: 160750 - DNA, 25 bp, Rattus norvegicus
agtgatacaccttggcgctgaggat

SEQ ID NO: 160751 - DNA, 25 bp, Rattus norvegicus
agtgataccaacatgggcgtccccg

SEQ ID NO: 160752 - DNA, 25 bp, Rattus norvegicus
agtgataccaacttgggcgtccccg

SEQ ID NO: 160753 - DNA, 25 bp, Rattus norvegicus
agtgatacccatcttcccatgcctt

SEQ ID NO: 160754 - DNA, 25 bp, Rattus norvegicus
agtgatacccatgttcccatgcctt

SEQ ID NO: 160755 - DNA, 25 bp, Rattus norvegicus
agtgatacccttcggatgtcggtcc

SEQ ID NO: 160756 - DNA, 25 bp, Rattus norvegicus
agtgatacccttgggatgtcggtcc

SEQ ID NO: 160757 - DNA, 25 bp, Rattus norvegicus
agtgatactgtgaagcttccccgag

SEQ ID NO: 160758 - DNA, 25 bp, Rattus norvegicus
agtgatactgtgacttggtcctgca

SEQ ID NO: 160759 - DNA, 25 bp, Rattus norvegicus
agtgatactgtgtagcttccccgag

SEQ ID NO: 160760 - DNA, 25 bp, Rattus norvegicus
agtgatactgtgtcttggtcctgca

SEQ ID NO: 160761 - DNA, 25 bp, Rattus norvegicus
agtgatagataccacagcctctgca

SEQ ID NO: 160762 - DNA, 25 bp, Rattus norvegicus
agtgatagatacgacagcctctgca

SEQ ID NO: 160763 - DNA, 25 bp, Rattus norvegicus
agtgatagccacatggttccattga

SEQ ID NO: 160764 - DNA, 25 bp, Rattus norvegicus
agtgatagccacttggttccattga

SEQ ID NO: 160765 - DNA, 25 bp, Rattus norvegicus
agtgatagtctgatcccaggtacaa

SEQ ID NO: 160766 - DNA, 25 bp, Rattus norvegicus
agtgatagtctgttcccaggtacaa

SEQ ID NO: 160767 - DNA, 25 bp, Rattus norvegicus
agtgatatcaccattacaaccgttc

SEQ ID NO: 160768 - DNA, 25 bp, Rattus norvegicus
agtgatatcacctttacaaccgttc

SEQ ID NO: 160769 - DNA, 25 bp, Rattus norvegicus
agtgatatccaactcctcttgatct

SEQ ID NO: 160770 - DNA, 25 bp, Rattus norvegicus
agtgatatccaagtcctcttgatct

SEQ ID NO: 160771 - DNA, 25 bp, Rattus norvegicus
agtgatatctcacactccatcatgt

SEQ ID NO: 160772 - DNA, 25 bp, Rattus norvegicus
agtgatatctcagactccatcatgt

SEQ ID NO: 160773 - DNA, 25 bp, Rattus norvegicus
agtgatatgccccagctcagtgtgc

SEQ ID NO: 160774 - DNA, 25 bp, Rattus norvegicus
agtgatatgcccgagctcagtgtgc

SEQ ID NO: 160775 - DNA, 25 bp, Rattus norvegicus
agtgatattactagatgccattgca

SEQ ID NO: 160776 - DNA, 25 bp, Rattus norvegicus
agtgatattacttgatgccattgca

SEQ ID NO: 160777 - DNA, 25 bp, Rattus norvegicus
agtgatccacttaatgtatgtctgt

SEQ ID NO: 160778 - DNA, 25 bp, Rattus norvegicus
agtgatccactttatgtatgtctgt

SEQ ID NO: 160779 - DNA, 25 bp, Rattus norvegicus
agtgatcccactaccgtggtgccag

SEQ ID NO: 160780 - DNA, 25 bp, Rattus norvegicus
agtgatcccacttccgtggtgccag

SEQ ID NO: 160781 - DNA, 25 bp, Rattus norvegicus
agtgatccccgcaaatgaaaacgca

SEQ ID NO: 160782 - DNA, 25 bp, Rattus norvegicus
agtgatccccgctaatgaaaacgca

SEQ ID NO: 160783 - DNA, 25 bp, Rattus norvegicus
agtgatcctagcaagtctggccatg

SEQ ID NO: 160784 - DNA, 25 bp, Rattus norvegicus
agtgatcctagctagtctggccatg

SEQ ID NO: 160785 - DNA, 25 bp, Rattus norvegicus
agtgatccttctacgagggtgtcat

SEQ ID NO: 160786 - DNA, 25 bp, Rattus norvegicus
agtgatccttcttcgagggtgtcat

SEQ ID NO: 160787 - DNA, 25 bp, Rattus norvegicus
agtgatcgctaccttggattccaga

SEQ ID NO: 160788 - DNA, 25 bp, Rattus norvegicus
agtgatcgctacgttggattccaga

SEQ ID NO: 160789 - DNA, 25 bp, Rattus norvegicus
agtgatcggtacagctcggctttca

SEQ ID NO: 160790 - DNA, 25 bp, Rattus norvegicus
agtgatcggtactgctcggctttca

SEQ ID NO: 160791 - DNA, 25 bp, Rattus norvegicus
agtgatcgtcgtagtggctgctgct

SEQ ID NO: 160792 - DNA, 25 bp, Rattus norvegicus
agtgatcgtcgttgtggctgctgct

SEQ ID NO: 160793 - DNA, 25 bp, Rattus norvegicus
agtgatctaacaacccagcttcata

SEQ ID NO: 160794 - DNA, 25 bp, Rattus norvegicus
agtgatctaacatcccagcttcata

SEQ ID NO: 160795 - DNA, 25 bp, Rattus norvegicus
agtgatctacaaaggttgctctaac

SEQ ID NO: 160796 - DNA, 25 bp, Rattus norvegicus
agtgatctacaatggttgctctaac

SEQ ID NO: 160797 - DNA, 25 bp, Rattus norvegicus
agtgatctagatctgcagtgtctgc

SEQ ID NO: 160798 - DNA, 25 bp, Rattus norvegicus
agtgatctagatgtgcagtgtctgc

SEQ ID NO: 160799 - DNA, 25 bp, Rattus norvegicus
agtgatctccagagtcgcttggaat

SEQ ID NO: 160800 - DNA, 25 bp, Rattus norvegicus
agtgatctccagcagagggctttga

SEQ ID NO: 160801 - DNA, 25 bp, Rattus norvegicus
agtgatctccaggagagggctttga

SEQ ID NO: 160802 - DNA, 25 bp, Rattus norvegicus
agtgatctccagtgtcgcttggaat

SEQ ID NO: 160803 - DNA, 25 bp, Rattus norvegicus
agtgatctgactacatccctcataa

SEQ ID NO: 160804 - DNA, 25 bp, Rattus norvegicus
agtgatctgacttcatccctcataa

SEQ ID NO: 160805 - DNA, 25 bp, Rattus norvegicus
agtgatctgcccaaggtgtccaccc

SEQ ID NO: 160806 - DNA, 25 bp, Rattus norvegicus
agtgatctgccctaggtgtccaccc

SEQ ID NO: 160807 - DNA, 25 bp, Rattus norvegicus
agtgatctggctagagctgtttgct

SEQ ID NO: 160808 - DNA, 25 bp, Rattus norvegicus
agtgatctggcttgagctgtttgct

SEQ ID NO: 160809 - DNA, 25 bp, Rattus norvegicus
agtgatcttactccagactggcagc

SEQ ID NO: 160810 - DNA, 25 bp, Rattus norvegicus
agtgatcttactgcagactggcagc

SEQ ID NO: 160811 - DNA, 25 bp, Rattus norvegicus
agtgatcttttgaatgttccaggta

SEQ ID NO: 160812 - DNA, 25 bp, Rattus norvegicus
agtgatcttttgtatgttccaggta

SEQ ID NO: 160813 - DNA, 25 bp, Rattus norvegicus
agtgatgaagagctgcccttgtctc

SEQ ID NO: 160814 - DNA, 25 bp, Rattus norvegicus
agtgatgaagaggtgcccttgtctc

SEQ ID NO: 160815 - DNA, 25 bp, Rattus norvegicus
agtgatgaagccagccctgggatcc

SEQ ID NO: 160816 - DNA, 25 bp, Rattus norvegicus
agtgatgaagccagctcggaccaca

SEQ ID NO: 160817 - DNA, 25 bp, Rattus norvegicus
agtgatgaagcctgccctgggatcc

SEQ ID NO: 160818 - DNA, 25 bp, Rattus norvegicus
agtgatgaagcctgctcggaccaca

SEQ ID NO: 160819 - DNA, 25 bp, Rattus norvegicus
agtgatgaagttattggcctcctcc

SEQ ID NO: 160820 - DNA, 25 bp, Rattus norvegicus
agtgatgaagtttttggcctcctcc

SEQ ID NO: 160821 - DNA, 25 bp, Rattus norvegicus
agtgatgacagacgatctcgccctg

SEQ ID NO: 160822 - DNA, 25 bp, Rattus norvegicus
agtgatgacagaggatctcgccctg

SEQ ID NO: 160823 - DNA, 25 bp, Rattus norvegicus
agtgatgacatgacctggtgccgga

SEQ ID NO: 160824 - DNA, 25 bp, Rattus norvegicus
agtgatgacatgcaggcccaccgtt

SEQ ID NO: 160825 - DNA, 25 bp, Rattus norvegicus
agtgatgacatggaggcccaccgtt

SEQ ID NO: 160826 - DNA, 25 bp, Rattus norvegicus
agtgatgacatgtcctggtgccgga

SEQ ID NO: 160827 - DNA, 25 bp, Rattus norvegicus
agtgatgactttactgccccaggac

SEQ ID NO: 160828 - DNA, 25 bp, Rattus norvegicus
agtgatgacttttctgccccaggac

SEQ ID NO: 160829 - DNA, 25 bp, Rattus norvegicus
agtgatgagagtcttcctggcctct

SEQ ID NO: 160830 - DNA, 25 bp, Rattus norvegicus
agtgatgagagtgttcctggcctct

SEQ ID NO: 160831 - DNA, 25 bp, Rattus norvegicus
agtgatgatggcctcttgttctttc

SEQ ID NO: 160832 - DNA, 25 bp, Rattus norvegicus
agtgatgatggcgtcttgttctttc

SEQ ID NO: 160833 - DNA, 25 bp, Rattus norvegicus
agtgatgcacacagggcagctgcca

SEQ ID NO: 160834 - DNA, 25 bp, Rattus norvegicus
agtgatgcacactgggcagctgcca

SEQ ID NO: 160835 - DNA, 25 bp, Rattus norvegicus
agtgatgcatgacctcctcaggcat

SEQ ID NO: 160836 - DNA, 25 bp, Rattus norvegicus
agtgatgcatgagctcctcaggcat

SEQ ID NO: 160837 - DNA, 25 bp, Rattus norvegicus
agtgatgccagtcaccactaagcca

SEQ ID NO: 160838 - DNA, 25 bp, Rattus norvegicus
agtgatgccagtgaccactaagcca

SEQ ID NO: 160839 - DNA, 25 bp, Rattus norvegicus
agtgatgccgacacttcctatgagg

SEQ ID NO: 160840 - DNA, 25 bp, Rattus norvegicus
agtgatgccgactcttcctatgagg

SEQ ID NO: 160841 - DNA, 25 bp, Rattus norvegicus
agtgatgccgcacatctttgatccc

SEQ ID NO: 160842 - DNA, 25 bp, Rattus norvegicus
agtgatgccgcagatctttgatccc

SEQ ID NO: 160843 - DNA, 25 bp, Rattus norvegicus
agtgatgctcaaacagactcctgtg

SEQ ID NO: 160844 - DNA, 25 bp, Rattus norvegicus
agtgatgctcaatcagactcctgtg

SEQ ID NO: 160845 - DNA, 25 bp, Rattus norvegicus
agtgatgctcatactttctgataac

SEQ ID NO: 160846 - DNA, 25 bp, Rattus norvegicus
agtgatgctcattctttctgataac

SEQ ID NO: 160847 - DNA, 25 bp, Rattus norvegicus
agtgatgctctcatctgggtcagat

SEQ ID NO: 160848 - DNA, 25 bp, Rattus norvegicus
agtgatgctctcttctgggtcagat

SEQ ID NO: 160849 - DNA, 25 bp, Rattus norvegicus
agtgatgctggtagcacacttccca

SEQ ID NO: 160850 - DNA, 25 bp, Rattus norvegicus
agtgatgctggttgcacacttccca

SEQ ID NO: 160851 - DNA, 25 bp, Rattus norvegicus
agtgatgctgttctgtcccaggtac

SEQ ID NO: 160852 - DNA, 25 bp, Rattus norvegicus
agtgatgctgttgtgtcccaggtac

SEQ ID NO: 160853 - DNA, 25 bp, Rattus norvegicus
agtgatgcttaacacttgcccagca

SEQ ID NO: 160854 - DNA, 25 bp, Rattus norvegicus
agtgatgcttaagacttgcccagca

SEQ ID NO: 160855 - DNA, 25 bp, Rattus norvegicus
agtgatgctttactgccattgctaa

SEQ ID NO: 160856 - DNA, 25 bp, Rattus norvegicus
agtgatgctttagtgccattgctaa

SEQ ID NO: 160857 - DNA, 25 bp, Rattus norvegicus
agtgatggactcagacggttctttc

SEQ ID NO: 160858 - DNA, 25 bp, Rattus norvegicus
agtgatggactctgacggttctttc

SEQ ID NO: 160859 - DNA, 25 bp, Rattus norvegicus
agtgatggagatcttccccgagccc

SEQ ID NO: 160860 - DNA, 25 bp, Rattus norvegicus
agtgatggagatgttccccgagccc

SEQ ID NO: 160861 - DNA, 25 bp, Rattus norvegicus
agtgatggccccaagtcctttgtga

SEQ ID NO: 160862 - DNA, 25 bp, Rattus norvegicus
agtgatggcccctagtcctttgtga

SEQ ID NO: 160863 - DNA, 25 bp, Rattus norvegicus
agtgatggctacaacgtggccctgg

SEQ ID NO: 160864 - DNA, 25 bp, Rattus norvegicus
agtgatggctactacgtggccctgg

SEQ ID NO: 160865 - DNA, 25 bp, Rattus norvegicus
agtgatggctgtagtgactgtctgc

SEQ ID NO: 160866 - DNA, 25 bp, Rattus norvegicus
agtgatggctgttgtgactgtctgc

SEQ ID NO: 160867 - DNA, 25 bp, Rattus norvegicus
agtgatggctttctctgctgagaat

SEQ ID NO: 160868 - DNA, 25 bp, Rattus norvegicus
agtgatggctttgtctgctgagaat

SEQ ID NO: 160869 - DNA, 25 bp, Rattus norvegicus
agtgatgggagtctgaacccacctc

SEQ ID NO: 160870 - DNA, 25 bp, Rattus norvegicus
agtgatgggagtgtgaacccacctc

SEQ ID NO: 160871 - DNA, 25 bp, Rattus norvegicus
agtgatggtcgcaccctttagaagc

SEQ ID NO: 160872 - DNA, 25 bp, Rattus norvegicus
agtgatggtcgctccctttagaagc

SEQ ID NO: 160873 - DNA, 25 bp, Rattus norvegicus
agtgatggttccagtgtggagctct

SEQ ID NO: 160874 - DNA, 25 bp, Rattus norvegicus
agtgatggttcctgtgtggagctct

SEQ ID NO: 160875 - DNA, 25 bp, Rattus norvegicus
agtgatgtacatacttcgcctactc

SEQ ID NO: 160876 - DNA, 25 bp, Rattus norvegicus
agtgatgtacattcttcgcctactc

SEQ ID NO: 160877 - DNA, 25 bp, Rattus norvegicus
agtgatgtacgtccgcatcgcgcgc

SEQ ID NO: 160878 - DNA, 25 bp, Rattus norvegicus
agtgatgtacgtgcgcatcgcgcgc

SEQ ID NO: 160879 - DNA, 25 bp, Rattus norvegicus
agtgatgtcactagcctgtaaacca

SEQ ID NO: 160880 - DNA, 25 bp, Rattus norvegicus
agtgatgtcacttgcctgtaaacca

SEQ ID NO: 160881 - DNA, 25 bp, Rattus norvegicus
agtgatgtcatcacctctaggtgat

SEQ ID NO: 160882 - DNA, 25 bp, Rattus norvegicus
agtgatgtcatcctatcgtgcactc

SEQ ID NO: 160883 - DNA, 25 bp, Rattus norvegicus
agtgatgtcatcgtatcgtgcactc

SEQ ID NO: 160884 - DNA, 25 bp, Rattus norvegicus
agtgatgtcatctcctctaggtgat

SEQ ID NO: 160885 - DNA, 25 bp, Rattus norvegicus
agtgatgtctcacgtctttaatccc

SEQ ID NO: 160886 - DNA, 25 bp, Rattus norvegicus
agtgatgtctcaggtctttaatccc

SEQ ID NO: 160887 - DNA, 25 bp, Rattus norvegicus
agtgatgtctgccttgggatttctt

SEQ ID NO: 160888 - DNA, 25 bp, Rattus norvegicus
agtgatgtctgcgttgggatttctt

SEQ ID NO: 160889 - DNA, 25 bp, Rattus norvegicus
agtgatgtgacacccaacttataac

SEQ ID NO: 160890 - DNA, 25 bp, Rattus norvegicus
agtgatgtgacagccaacttataac

SEQ ID NO: 160891 - DNA, 25 bp, Rattus norvegicus
agtgatgtgccaccatgcagcgagc

SEQ ID NO: 160892 - DNA, 25 bp, Rattus norvegicus
agtgatgtgccagcatgcagcgagc

SEQ ID NO: 160893 - DNA, 25 bp, Rattus norvegicus
agtgatgtgttccttgggtttctac

SEQ ID NO: 160894 - DNA, 25 bp, Rattus norvegicus
agtgatgtgttcgttgggtttctac

SEQ ID NO: 160895 - DNA, 25 bp, Rattus norvegicus
agtgatgttacgaggcctcgggcca

SEQ ID NO: 160896 - DNA, 25 bp, Rattus norvegicus
agtgatgttacgtggcctcgggcca

SEQ ID NO: 160897 - DNA, 25 bp, Rattus norvegicus
agtgatgttgagactcttcagcccc

SEQ ID NO: 160898 - DNA, 25 bp, Rattus norvegicus
agtgatgttgagtctcttcagcccc

SEQ ID NO: 160899 - DNA, 25 bp, Rattus norvegicus
agtgatgttgatacccatgccgttt

SEQ ID NO: 160900 - DNA, 25 bp, Rattus norvegicus
agtgatgttgattcccatgccgttt

SEQ ID NO: 160901 - DNA, 25 bp, Rattus norvegicus
agtgatgtttgtctctagtgttcta

SEQ ID NO: 160902 - DNA, 25 bp, Rattus norvegicus
agtgatgtttgtgtctagtgttcta

SEQ ID NO: 160903 - DNA, 25 bp, Rattus norvegicus
agtgattaagaccttcggcacctca

SEQ ID NO: 160904 - DNA, 25 bp, Rattus norvegicus
agtgattaagacgttcggcacctca

SEQ ID NO: 160905 - DNA, 25 bp, Rattus norvegicus
agtgattacatcaaaggacctccag

SEQ ID NO: 160906 - DNA, 25 bp, Rattus norvegicus
agtgattacatctaaggacctccag

SEQ ID NO: 160907 - DNA, 25 bp, Rattus norvegicus
agtgattagctgacattactctgaa

SEQ ID NO: 160908 - DNA, 25 bp, Rattus norvegicus
agtgattagctgtcattactctgaa

SEQ ID NO: 160909 - DNA, 25 bp, Rattus norvegicus
agtgattattatctccgtccttcat

SEQ ID NO: 160910 - DNA, 25 bp, Rattus norvegicus
agtgattattatgtccgtccttcat

SEQ ID NO: 160911 - DNA, 25 bp, Rattus norvegicus
agtgattcaacacgtatctccagaa

SEQ ID NO: 160912 - DNA, 25 bp, Rattus norvegicus
agtgattcaacaggtatctccagaa

SEQ ID NO: 160913 - DNA, 25 bp, Rattus norvegicus
agtgattcagaaaccagtggttata

SEQ ID NO: 160914 - DNA, 25 bp, Rattus norvegicus
agtgattcagaatccagtggttata

SEQ ID NO: 160915 - DNA, 25 bp, Rattus norvegicus
agtgattcagtcacccagtacagag

SEQ ID NO: 160916 - DNA, 25 bp, Rattus norvegicus
agtgattcagtctcccagtacagag

SEQ ID NO: 160917 - DNA, 25 bp, Rattus norvegicus
agtgattcattcagagccccaggct

SEQ ID NO: 160918 - DNA, 25 bp, Rattus norvegicus
agtgattcattctgagccccaggct

SEQ ID NO: 160919 - DNA, 25 bp, Rattus norvegicus
agtgattcccaaatctgtcaaccca

SEQ ID NO: 160920 - DNA, 25 bp, Rattus norvegicus
agtgattcccaattctgtcaaccca

SEQ ID NO: 160921 - DNA, 25 bp, Rattus norvegicus
agtgattcctgaaatctggccgagg

SEQ ID NO: 160922 - DNA, 25 bp, Rattus norvegicus
agtgattcctgatatctggccgagg

SEQ ID NO: 160923 - DNA, 25 bp, Rattus norvegicus
agtgattcctgtctttaccatttgt

SEQ ID NO: 160924 - DNA, 25 bp, Rattus norvegicus
agtgattcctgtgtttaccatttgt

SEQ ID NO: 160925 - DNA, 25 bp, Rattus norvegicus
agtgattccttgaccagtgagctgc

SEQ ID NO: 160926 - DNA, 25 bp, Rattus norvegicus
agtgattccttgtccagtgagctgc

SEQ ID NO: 160927 - DNA, 25 bp, Rattus norvegicus
agtgattctgagatctgcattcgca

SEQ ID NO: 160928 - DNA, 25 bp, Rattus norvegicus
agtgattctgagttctgcattcgca

SEQ ID NO: 160929 - DNA, 25 bp, Rattus norvegicus
agtgattcttagcaccacccgattg

SEQ ID NO: 160930 - DNA, 25 bp, Rattus norvegicus
agtgattcttaggaccacccgattg

SEQ ID NO: 160931 - DNA, 25 bp, Rattus norvegicus
agtgattgacaacgcgtcgtcccgc

SEQ ID NO: 160932 - DNA, 25 bp, Rattus norvegicus
agtgattgacaaggcgtcgtcccgc

SEQ ID NO: 160933 - DNA, 25 bp, Rattus norvegicus
agtgattgctgtaactgaacgttgc

SEQ ID NO: 160934 - DNA, 25 bp, Rattus norvegicus
agtgattgctgttactgaacgttgc

SEQ ID NO: 160935 - DNA, 25 bp, Rattus norvegicus
agtgattggacacacactgggacag

SEQ ID NO: 160936 - DNA, 25 bp, Rattus norvegicus
agtgattggacagacactgggacag

SEQ ID NO: 160937 - DNA, 25 bp, Rattus norvegicus
agtgattgggcaatgtctcccattc

SEQ ID NO: 160938 - DNA, 25 bp, Rattus norvegicus
agtgattgggcattgtctcccattc

SEQ ID NO: 160939 - DNA, 25 bp, Rattus norvegicus
agtgattgtcatcccaggcttcctg

SEQ ID NO: 160940 - DNA, 25 bp, Rattus norvegicus
agtgattgtcatgccaggcttcctg

SEQ ID NO: 160941 - DNA, 25 bp, Rattus norvegicus
agtgattgtcttctcttctgattat

SEQ ID NO: 160942 - DNA, 25 bp, Rattus norvegicus
agtgattgtcttgtcttctgattat

SEQ ID NO: 160943 - DNA, 25 bp, Rattus norvegicus
agtgattgtggtcaccgtcgatccc

SEQ ID NO: 160944 - DNA, 25 bp, Rattus norvegicus
agtgattgtggtgaccgtcgatccc

SEQ ID NO: 160945 - DNA, 25 bp, Rattus norvegicus
agtgattgtgtgctctcttcaacat

SEQ ID NO: 160946 - DNA, 25 bp, Rattus norvegicus
agtgattgtgtggtctcttcaacat

SEQ ID NO: 160947 - DNA, 25 bp, Rattus norvegicus
agtgattgttctacagcaccacgaa

SEQ ID NO: 160948 - DNA, 25 bp, Rattus norvegicus
agtgattgttcttcagcaccacgaa

SEQ ID NO: 160949 - DNA, 25 bp, Rattus norvegicus
agtgatttgcggatgctcagtgtaa

SEQ ID NO: 160950 - DNA, 25 bp, Rattus norvegicus
agtgatttgcggttgctcagtgtaa

SEQ ID NO: 160951 - DNA, 25 bp, Rattus norvegicus
agtgatttgctcagggtcacacaac

SEQ ID NO: 160952 - DNA, 25 bp, Rattus norvegicus
agtgatttgctctgggtcacacaac

SEQ ID NO: 160953 - DNA, 25 bp, Rattus norvegicus
agtgatttggacatctggcttggat

SEQ ID NO: 160954 - DNA, 25 bp, Rattus norvegicus
agtgatttggacttctggcttggat

SEQ ID NO: 160955 - DNA, 25 bp, Rattus norvegicus
agtgatttgtacacatgccggcaag

SEQ ID NO: 160956 - DNA, 25 bp, Rattus norvegicus
agtgatttgtactcatgccggcaag

SEQ ID NO: 160957 - DNA, 25 bp, Rattus norvegicus
agtgattttaatccccaggacaggc

SEQ ID NO: 160958 - DNA, 25 bp, Rattus norvegicus
agtgattttaatgcccaggacaggc

SEQ ID NO: 160959 - DNA, 25 bp, Rattus norvegicus
agtgcaaaaacccttgtcagcctta

SEQ ID NO: 160960 - DNA, 25 bp, Rattus norvegicus
agtgcaaaaaccgttgtcagcctta

SEQ ID NO: 160961 - DNA, 25 bp, Rattus norvegicus
agtgcaaaagttactgactaccaag

SEQ ID NO: 160962 - DNA, 25 bp, Rattus norvegicus
agtgcaaaagtttctgactaccaag

SEQ ID NO: 160963 - DNA, 25 bp, Rattus norvegicus
agtgcaaacacaatcttcatctata

SEQ ID NO: 160964 - DNA, 25 bp, Rattus norvegicus
agtgcaaacacattcttcatctata

SEQ ID NO: 160965 - DNA, 25 bp, Rattus norvegicus
agtgcaaacatcatcatgggtcaag

SEQ ID NO: 160966 - DNA, 25 bp, Rattus norvegicus
agtgcaaacatcttcatgggtcaag

SEQ ID NO: 160967 - DNA, 25 bp, Rattus norvegicus
agtgcaaacgcgacagctttcccaa

SEQ ID NO: 160968 - DNA, 25 bp, Rattus norvegicus
agtgcaaacgcgtcagctttcccaa

SEQ ID NO: 160969 - DNA, 25 bp, Rattus norvegicus
agtgcaaacgctacaacaccttcat

SEQ ID NO: 160970 - DNA, 25 bp, Rattus norvegicus
agtgcaaacgcttcaacaccttcat

SEQ ID NO: 160971 - DNA, 25 bp, Rattus norvegicus
agtgcaaactccagcgggacgcgct

SEQ ID NO: 160972 - DNA, 25 bp, Rattus norvegicus
agtgcaaactcctgcgggacgcgct

SEQ ID NO: 160973 - DNA, 25 bp, Rattus norvegicus
agtgcaaaggttactagcctctgat

SEQ ID NO: 160974 - DNA, 25 bp, Rattus norvegicus
agtgcaaaggtttctagcctctgat

SEQ ID NO: 160975 - DNA, 25 bp, Rattus norvegicus
agtgcaaataccatacacccatcgg

SEQ ID NO: 160976 - DNA, 25 bp, Rattus norvegicus
agtgcaaataccttacacccatcgg

SEQ ID NO: 160977 - DNA, 25 bp, Rattus norvegicus
agtgcaaatactcgaagcttcaagg

SEQ ID NO: 160978 - DNA, 25 bp, Rattus norvegicus
agtgcaaatactggaagcttcaagg

SEQ ID NO: 160979 - DNA, 25 bp, Rattus norvegicus
agtgcaacaagcagctggctgccaa

SEQ ID NO: 160980 - DNA, 25 bp, Rattus norvegicus
agtgcaacaagccatctttctccga

SEQ ID NO: 160981 - DNA, 25 bp, Rattus norvegicus
agtgcaacaagcgatctttctccga

SEQ ID NO: 160982 - DNA, 25 bp, Rattus norvegicus
agtgcaacaagctgctggctgccaa

SEQ ID NO: 160983 - DNA, 25 bp, Rattus norvegicus
agtgcaacacttcctctaggcagcc

SEQ ID NO: 160984 - DNA, 25 bp, Rattus norvegicus
agtgcaacacttgctctaggcagcc

SEQ ID NO: 160985 - DNA, 25 bp, Rattus norvegicus
agtgcaacagcactggctctctcca

SEQ ID NO: 160986 - DNA, 25 bp, Rattus norvegicus
agtgcaacagcagtggctctctcca

SEQ ID NO: 160987 - DNA, 25 bp, Rattus norvegicus
agtgcaaccagtcgactcgcgtggc

SEQ ID NO: 160988 - DNA, 25 bp, Rattus norvegicus
agtgcaaccagtggactcgcgtggc

SEQ ID NO: 160989 - DNA, 25 bp, Rattus norvegicus
agtgcaacccggctatgcttggctc

SEQ ID NO: 160990 - DNA, 25 bp, Rattus norvegicus
agtgcaacccgggtatgcttggctc

SEQ ID NO: 160991 - DNA, 25 bp, Rattus norvegicus
agtgcaacctgcacagggtcagcag

SEQ ID NO: 160992 - DNA, 25 bp, Rattus norvegicus
agtgcaacctgctcagggtcagcag

SEQ ID NO: 160993 - DNA, 25 bp, Rattus norvegicus
agtgcaacttgcaggatccggttct

SEQ ID NO: 160994 - DNA, 25 bp, Rattus norvegicus
agtgcaacttgctggatccggttct

SEQ ID NO: 160995 - DNA, 25 bp, Rattus norvegicus
agtgcaagcagtatcctttacagcc

SEQ ID NO: 160996 - DNA, 25 bp, Rattus norvegicus
agtgcaagcagtttcctttacagcc

SEQ ID NO: 160997 - DNA, 25 bp, Rattus norvegicus
agtgcaagctggatttctgtttgtt

SEQ ID NO: 160998 - DNA, 25 bp, Rattus norvegicus
agtgcaagctggttttctgtttgtt

SEQ ID NO: 160999 - DNA, 25 bp, Rattus norvegicus
agtgcaagggctaggtaactaccaa

SEQ ID NO: 161000 - DNA, 25 bp, Rattus norvegicus
agtgcaagggcttggtaactaccaa

SEQ ID NO: 161001 - DNA, 25 bp, Rattus norvegicus
agtgcaagttaaagcctgtgccctg

SEQ ID NO: 161002 - DNA, 25 bp, Rattus norvegicus
agtgcaagttaatgcctgtgccctg

SEQ ID NO: 161003 - DNA, 25 bp, Rattus norvegicus
agtgcaatacagatcgaggcgtctt

SEQ ID NO: 161004 - DNA, 25 bp, Rattus norvegicus
agtgcaatacagttcgaggcgtctt

SEQ ID NO: 161005 - DNA, 25 bp, Rattus norvegicus
agtgcaatgcctatatcttatttta

SEQ ID NO: 161006 - DNA, 25 bp, Rattus norvegicus
agtgcaatgcctttatcttatttta

SEQ ID NO: 161007 - DNA, 25 bp, Rattus norvegicus
agtgcaattattacatcgctctaaa

SEQ ID NO: 161008 - DNA, 25 bp, Rattus norvegicus
agtgcaattatttcatcgctctaaa

SEQ ID NO: 161009 - DNA, 25 bp, Rattus norvegicus
agtgcaattcaacgtgtatcttact

SEQ ID NO: 161010 - DNA, 25 bp, Rattus norvegicus
agtgcaattcaaggtgtatcttact

SEQ ID NO: 161011 - DNA, 25 bp, Rattus norvegicus
agtgcaattcctcctgttgtggttg

SEQ ID NO: 161012 - DNA, 25 bp, Rattus norvegicus
agtgcaattcctgctgttgtggttg

SEQ ID NO: 161013 - DNA, 25 bp, Rattus norvegicus
agtgcacaaaagcacctctgcactc

SEQ ID NO: 161014 - DNA, 25 bp, Rattus norvegicus
agtgcacaaaaggacctctgcactc

SEQ ID NO: 161015 - DNA, 25 bp, Rattus norvegicus
agtgcacacctcaggttttgtgtta

SEQ ID NO: 161016 - DNA, 25 bp, Rattus norvegicus
agtgcacacctctggttttgtgtta

SEQ ID NO: 161017 - DNA, 25 bp, Rattus norvegicus
agtgcacacgctctggccacgggat

SEQ ID NO: 161018 - DNA, 25 bp, Rattus norvegicus
agtgcacacgctgtggccacgggat

SEQ ID NO: 161019 - DNA, 25 bp, Rattus norvegicus
agtgcacagaaaacatacttgagct

SEQ ID NO: 161020 - DNA, 25 bp, Rattus norvegicus
agtgcacagaaatcatacttgagct

SEQ ID NO: 161021 - DNA, 25 bp, Rattus norvegicus
agtgcacagtggagtttatagttgt

SEQ ID NO: 161022 - DNA, 25 bp, Rattus norvegicus
agtgcacagtggtgtttatagttgt

SEQ ID NO: 161023 - DNA, 25 bp, Rattus norvegicus
agtgcacagtgtccagccactgaaa

SEQ ID NO: 161024 - DNA, 25 bp, Rattus norvegicus
agtgcacagtgtgcagccactgaaa

SEQ ID NO: 161025 - DNA, 25 bp, Rattus norvegicus
agtgcacagttgaggagtccttctc

SEQ ID NO: 161026 - DNA, 25 bp, Rattus norvegicus
agtgcacagttgtggagtccttctc

SEQ ID NO: 161027 - DNA, 25 bp, Rattus norvegicus
agtgcacatcatcttctctgtaaac

SEQ ID NO: 161028 - DNA, 25 bp, Rattus norvegicus
agtgcacatcatgttctctgtaaac

SEQ ID NO: 161029 - DNA, 25 bp, Rattus norvegicus
agtgcacatccgacagtgttcctgc

SEQ ID NO: 161030 - DNA, 25 bp, Rattus norvegicus
agtgcacatccgtcagtgttcctgc

SEQ ID NO: 161031 - DNA, 25 bp, Rattus norvegicus
agtgcacatgtgagaccggtgctgt

SEQ ID NO: 161032 - DNA, 25 bp, Rattus norvegicus
agtgcacatgtgtgaccggtgctgt

SEQ ID NO: 161033 - DNA, 25 bp, Rattus norvegicus
agtgcacattgcattctggaccaac

SEQ ID NO: 161034 - DNA, 25 bp, Rattus norvegicus
agtgcacattgctttctggaccaac

SEQ ID NO: 161035 - DNA, 25 bp, Rattus norvegicus
agtgcacatttgcagggactctgag

SEQ ID NO: 161036 - DNA, 25 bp, Rattus norvegicus
agtgcacatttggagggactctgag

SEQ ID NO: 161037 - DNA, 25 bp, Rattus norvegicus
agtgcaccacacctcagtttaaaag

SEQ ID NO: 161038 - DNA, 25 bp, Rattus norvegicus
agtgcaccacacgtcagtttaaaag

SEQ ID NO: 161039 - DNA, 25 bp, Rattus norvegicus
agtgcaccacagaagggcttgctga

SEQ ID NO: 161040 - DNA, 25 bp, Rattus norvegicus
agtgcaccacagtagggcttgctga

SEQ ID NO: 161041 - DNA, 25 bp, Rattus norvegicus
agtgcaccacggctttgaagttgtc

SEQ ID NO: 161042 - DNA, 25 bp, Rattus norvegicus
agtgcaccacgggtttgaagttgtc

SEQ ID NO: 161043 - DNA, 25 bp, Rattus norvegicus
agtgcaccagcgactctaaggacag

SEQ ID NO: 161044 - DNA, 25 bp, Rattus norvegicus
agtgcaccagcgtctctaaggacag

SEQ ID NO: 161045 - DNA, 25 bp, Rattus norvegicus
agtgcaccatggaatgctcactctt

SEQ ID NO: 161046 - DNA, 25 bp, Rattus norvegicus
agtgcaccatggtatgctcactctt

SEQ ID NO: 161047 - DNA, 25 bp, Rattus norvegicus
agtgcaccccagacatggctgttga

SEQ ID NO: 161048 - DNA, 25 bp, Rattus norvegicus
agtgcaccccagtcatggctgttga

SEQ ID NO: 161049 - DNA, 25 bp, Rattus norvegicus
agtgcacccctccacaagaaaggtg

SEQ ID NO: 161050 - DNA, 25 bp, Rattus norvegicus
agtgcacccctcgacaagaaaggtg

SEQ ID NO: 161051 - DNA, 25 bp, Rattus norvegicus
agtgcaccccttactgatgatcaga

SEQ ID NO: 161052 - DNA, 25 bp, Rattus norvegicus
agtgcacccctttctgatgatcaga

SEQ ID NO: 161053 - DNA, 25 bp, Rattus norvegicus
agtgcaccgctgcaacagtaatcaa

SEQ ID NO: 161054 - DNA, 25 bp, Rattus norvegicus
agtgcaccgctggaacagtaatcaa

SEQ ID NO: 161055 - DNA, 25 bp, Rattus norvegicus
agtgcacctcagatgtttaggttat

SEQ ID NO: 161056 - DNA, 25 bp, Rattus norvegicus
agtgcacctcagttgtttaggttat

SEQ ID NO: 161057 - DNA, 25 bp, Rattus norvegicus
agtgcacctcatcgagacactgctt

SEQ ID NO: 161058 - DNA, 25 bp, Rattus norvegicus
agtgcacctcatggagacactgctt

SEQ ID NO: 161059 - DNA, 25 bp, Rattus norvegicus
agtgcacctctgcaacttgggcatg

SEQ ID NO: 161060 - DNA, 25 bp, Rattus norvegicus
agtgcacctctggaacttgggcatg

SEQ ID NO: 161061 - DNA, 25 bp, Rattus norvegicus
agtgcacctgatcgcttgtagttca

SEQ ID NO: 161062 - DNA, 25 bp, Rattus norvegicus
agtgcacctgatggcttgtagttca

SEQ ID NO: 161063 - DNA, 25 bp, Rattus norvegicus
agtgcacctgcaatttcagtgctag

SEQ ID NO: 161064 - DNA, 25 bp, Rattus norvegicus
agtgcacctgcattttcagtgctag

SEQ ID NO: 161065 - DNA, 25 bp, Rattus norvegicus
agtgcacctgtacgacgcatgccgt

SEQ ID NO: 161066 - DNA, 25 bp, Rattus norvegicus
agtgcacctgtaggacgcatgccgt

SEQ ID NO: 161067 - DNA, 25 bp, Rattus norvegicus
agtgcacgaccacctccaaaggaga

SEQ ID NO: 161068 - DNA, 25 bp, Rattus norvegicus
agtgcacgaccagctccaaaggaga

SEQ ID NO: 161069 - DNA, 25 bp, Rattus norvegicus
agtgcacgcgtgagtgcgccaccag

SEQ ID NO: 161070 - DNA, 25 bp, Rattus norvegicus
agtgcacgcgtgtgtgcgccaccag

SEQ ID NO: 161071 - DNA, 25 bp, Rattus norvegicus
agtgcacgtgtcctgtttcagcaaa

SEQ ID NO: 161072 - DNA, 25 bp, Rattus norvegicus
agtgcacgtgtcgtgtttcagcaaa

SEQ ID NO: 161073 - DNA, 25 bp, Rattus norvegicus
agtgcactacctccagttcaaggaa

SEQ ID NO: 161074 - DNA, 25 bp, Rattus norvegicus
agtgcactacctgcagttcaaggaa

SEQ ID NO: 161075 - DNA, 25 bp, Rattus norvegicus
agtgcactccttcgttttatttcat

SEQ ID NO: 161076 - DNA, 25 bp, Rattus norvegicus
agtgcactccttggttttatttcat

SEQ ID NO: 161077 - DNA, 25 bp, Rattus norvegicus
agtgcactgcaactgtgccagggaa

SEQ ID NO: 161078 - DNA, 25 bp, Rattus norvegicus
agtgcactgcaagtgtgccagggaa

SEQ ID NO: 161079 - DNA, 25 bp, Rattus norvegicus
agtgcactgctgaagttcctctgtg

SEQ ID NO: 161080 - DNA, 25 bp, Rattus norvegicus
agtgcactgctgtagttcctctgtg

SEQ ID NO: 161081 - DNA, 25 bp, Rattus norvegicus
agtgcactgtagctcgcaccatgta

SEQ ID NO: 161082 - DNA, 25 bp, Rattus norvegicus
agtgcactgtaggtcgcaccatgta

SEQ ID NO: 161083 - DNA, 25 bp, Rattus norvegicus
agtgcacttcaacgtcagccctgga

SEQ ID NO: 161084 - DNA, 25 bp, Rattus norvegicus
agtgcacttcaaggtcagccctgga

SEQ ID NO: 161085 - DNA, 25 bp, Rattus norvegicus
agtgcacttccacacaggcaaaacg

SEQ ID NO: 161086 - DNA, 25 bp, Rattus norvegicus
agtgcacttccagacaggcaaaacg

SEQ ID NO: 161087 - DNA, 25 bp, Rattus norvegicus
agtgcacttgctacagatcgtcaga

SEQ ID NO: 161088 - DNA, 25 bp, Rattus norvegicus
agtgcacttgcttcagatcgtcaga

SEQ ID NO: 161089 - DNA, 25 bp, Rattus norvegicus
agtgcactttgtcctcaggcagagc

SEQ ID NO: 161090 - DNA, 25 bp, Rattus norvegicus
agtgcactttgtgctcaggcagagc

SEQ ID NO: 161091 - DNA, 25 bp, Rattus norvegicus
agtgcagaaaacagcccagggcagc

SEQ ID NO: 161092 - DNA, 25 bp, Rattus norvegicus
agtgcagaaaactgcccagggcagc

SEQ ID NO: 161093 - DNA, 25 bp, Rattus norvegicus
agtgcagaaatcatggcccttgtga

SEQ ID NO: 161094 - DNA, 25 bp, Rattus norvegicus
agtgcagaaatcttggcccttgtga

SEQ ID NO: 161095 - DNA, 25 bp, Rattus norvegicus
agtgcagaagatagaggaggtcctc

SEQ ID NO: 161096 - DNA, 25 bp, Rattus norvegicus
agtgcagaagattgaggaggtcctc

SEQ ID NO: 161097 - DNA, 25 bp, Rattus norvegicus
agtgcagaagcgatccatatgtcaa

SEQ ID NO: 161098 - DNA, 25 bp, Rattus norvegicus
agtgcagaagcgttccatatgtcaa

SEQ ID NO: 161099 - DNA, 25 bp, Rattus norvegicus
agtgcagacactatttggaaaatcc

SEQ ID NO: 161100 - DNA, 25 bp, Rattus norvegicus
agtgcagacactttttggaaaatcc

SEQ ID NO: 161101 - DNA, 25 bp, Rattus norvegicus
agtgcagacgccataattctcacgg

SEQ ID NO: 161102 - DNA, 25 bp, Rattus norvegicus
agtgcagacgccttaattctcacgg

SEQ ID NO: 161103 - DNA, 25 bp, Rattus norvegicus
agtgcagactcgatgtacagggaca

SEQ ID NO: 161104 - DNA, 25 bp, Rattus norvegicus
agtgcagactcgttgtacagggaca

SEQ ID NO: 161105 - DNA, 25 bp, Rattus norvegicus
agtgcagagcttacctccttaccag

SEQ ID NO: 161106 - DNA, 25 bp, Rattus norvegicus
agtgcagagctttcctccttaccag

SEQ ID NO: 161107 - DNA, 25 bp, Rattus norvegicus
agtgcagaggttcaggcctgtccct

SEQ ID NO: 161108 - DNA, 25 bp, Rattus norvegicus
agtgcagaggttgaggcctgtccct

SEQ ID NO: 161109 - DNA, 25 bp, Rattus norvegicus
agtgcagagtccagtcattaccatt

SEQ ID NO: 161110 - DNA, 25 bp, Rattus norvegicus
agtgcagagtcctgtcattaccatt

SEQ ID NO: 161111 - DNA, 25 bp, Rattus norvegicus
agtgcagagtgcatggctgtttcct

SEQ ID NO: 161112 - DNA, 25 bp, Rattus norvegicus
agtgcagagtgcttggctgtttcct

SEQ ID NO: 161113 - DNA, 25 bp, Rattus norvegicus
agtgcagagtttatatttagctaaa

SEQ ID NO: 161114 - DNA, 25 bp, Rattus norvegicus
agtgcagagtttttatttagctaaa

SEQ ID NO: 161115 - DNA, 25 bp, Rattus norvegicus
agtgcagatctgaccttatagccat

SEQ ID NO: 161116 - DNA, 25 bp, Rattus norvegicus
agtgcagatctgtccttatagccat

SEQ ID NO: 161117 - DNA, 25 bp, Rattus norvegicus
agtgcagcagcaaacagtagaaaca

SEQ ID NO: 161118 - DNA, 25 bp, Rattus norvegicus
agtgcagcagcaaatacccttggtc

SEQ ID NO: 161119 - DNA, 25 bp, Rattus norvegicus
agtgcagcagcatacagtagaaaca

SEQ ID NO: 161120 - DNA, 25 bp, Rattus norvegicus
agtgcagcagcatatacccttggtc

SEQ ID NO: 161121 - DNA, 25 bp, Rattus norvegicus
agtgcagccaccaataatcagaatg

SEQ ID NO: 161122 - DNA, 25 bp, Rattus norvegicus
agtgcagccacctataatcagaatg

SEQ ID NO: 161123 - DNA, 25 bp, Rattus norvegicus
agtgcagccttgaagcagtagctcc

SEQ ID NO: 161124 - DNA, 25 bp, Rattus norvegicus
agtgcagccttgattgcctagtgac

SEQ ID NO: 161125 - DNA, 25 bp, Rattus norvegicus
agtgcagccttgtagcagtagctcc

SEQ ID NO: 161126 - DNA, 25 bp, Rattus norvegicus
agtgcagccttgtttgcctagtgac

SEQ ID NO: 161127 - DNA, 25 bp, Rattus norvegicus
agtgcagcgcctaatttgagtaccc

SEQ ID NO: 161128 - DNA, 25 bp, Rattus norvegicus
agtgcagcgccttatttgagtaccc

SEQ ID NO: 161129 - DNA, 25 bp, Rattus norvegicus
agtgcagctcgacaagcttctgtct

SEQ ID NO: 161130 - DNA, 25 bp, Rattus norvegicus
agtgcagctcgagaagcttctgtct

SEQ ID NO: 161131 - DNA, 25 bp, Rattus norvegicus
agtgcagctctgatcatgggaatgt

SEQ ID NO: 161132 - DNA, 25 bp, Rattus norvegicus
agtgcagctctgttcatgggaatgt

SEQ ID NO: 161133 - DNA, 25 bp, Rattus norvegicus
agtgcagctgaacggcttctcgcct

SEQ ID NO: 161134 - DNA, 25 bp, Rattus norvegicus
agtgcagctgaagggcttctcgcct

SEQ ID NO: 161135 - DNA, 25 bp, Rattus norvegicus
agtgcagcttaaagaccctctgtgt

SEQ ID NO: 161136 - DNA, 25 bp, Rattus norvegicus
agtgcagcttaatgaccctctgtgt

SEQ ID NO: 161137 - DNA, 25 bp, Rattus norvegicus
agtgcaggacaccattttggatcaa

SEQ ID NO: 161138 - DNA, 25 bp, Rattus norvegicus
agtgcaggacacgattttggatcaa

SEQ ID NO: 161139 - DNA, 25 bp, Rattus norvegicus
agtgcaggacgcaggcggccctact

SEQ ID NO: 161140 - DNA, 25 bp, Rattus norvegicus
agtgcaggacgctggcggccctact

SEQ ID NO: 161141 - DNA, 25 bp, Rattus norvegicus
agtgcaggagtcaggctccgtagct

SEQ ID NO: 161142 - DNA, 25 bp, Rattus norvegicus
agtgcaggagtctggctccgtagct

SEQ ID NO: 161143 - DNA, 25 bp, Rattus norvegicus
agtgcaggagttattggtcttcttc

SEQ ID NO: 161144 - DNA, 25 bp, Rattus norvegicus
agtgcaggagtttttggtcttcttc

SEQ ID NO: 161145 - DNA, 25 bp, Rattus norvegicus
agtgcaggcactcaggtcacagcta

SEQ ID NO: 161146 - DNA, 25 bp, Rattus norvegicus
agtgcaggcactgaggtcacagcta

SEQ ID NO: 161147 - DNA, 25 bp, Rattus norvegicus
agtgcaggccctccaggtcggacac

SEQ ID NO: 161148 - DNA, 25 bp, Rattus norvegicus
agtgcaggccctgcaggtcggacac

SEQ ID NO: 161149 - DNA, 25 bp, Rattus norvegicus
agtgcaggccttcctaccggagcag

SEQ ID NO: 161150 - DNA, 25 bp, Rattus norvegicus
agtgcaggccttgctaccggagcag

SEQ ID NO: 161151 - DNA, 25 bp, Rattus norvegicus
agtgcaggctggctgccctcttttg

SEQ ID NO: 161152 - DNA, 25 bp, Rattus norvegicus
agtgcaggctgggtgccctcttttg

SEQ ID NO: 161153 - DNA, 25 bp, Rattus norvegicus
agtgcagggaacaagggaccagcca

SEQ ID NO: 161154 - DNA, 25 bp, Rattus norvegicus
agtgcagggaactagggaccagcca

SEQ ID NO: 161155 - DNA, 25 bp, Rattus norvegicus
agtgcagggatcacgcagaactgat

SEQ ID NO: 161156 - DNA, 25 bp, Rattus norvegicus
agtgcagggatctcgcagaactgat

SEQ ID NO: 161157 - DNA, 25 bp, Rattus norvegicus
agtgcaggtgcacccagctgtaaca

SEQ ID NO: 161158 - DNA, 25 bp, Rattus norvegicus
agtgcaggtgcagccagctgtaaca

SEQ ID NO: 161159 - DNA, 25 bp, Rattus norvegicus
agtgcagtaagtactattgggtaca

SEQ ID NO: 161160 - DNA, 25 bp, Rattus norvegicus
agtgcagtaagttctattgggtaca

SEQ ID NO: 161161 - DNA, 25 bp, Rattus norvegicus
agtgcagtcactcctgctttgagtg

SEQ ID NO: 161162 - DNA, 25 bp, Rattus norvegicus
agtgcagtcactgctgctttgagtg

SEQ ID NO: 161163 - DNA, 25 bp, Rattus norvegicus
agtgcagtcattaattagcctagta

SEQ ID NO: 161164 - DNA, 25 bp, Rattus norvegicus
agtgcagtcatttattagcctagta

SEQ ID NO: 161165 - DNA, 25 bp, Rattus norvegicus
agtgcagtccccagagatgtggaag

SEQ ID NO: 161166 - DNA, 25 bp, Rattus norvegicus
agtgcagtcccctgagatgtggaag

SEQ ID NO: 161167 - DNA, 25 bp, Rattus norvegicus
agtgcagtcgtcaggcaagcagcgt

SEQ ID NO: 161168 - DNA, 25 bp, Rattus norvegicus
agtgcagtcgtctggcaagcagcgt

SEQ ID NO: 161169 - DNA, 25 bp, Rattus norvegicus
agtgcagtgactacattgtgccctg

SEQ ID NO: 161170 - DNA, 25 bp, Rattus norvegicus
agtgcagtgactactagccttttga

SEQ ID NO: 161171 - DNA, 25 bp, Rattus norvegicus
agtgcagtgacttcattgtgccctg

SEQ ID NO: 161172 - DNA, 25 bp, Rattus norvegicus
agtgcagtgacttctagccttttga

SEQ ID NO: 161173 - DNA, 25 bp, Rattus norvegicus
agtgcagtgctccttatacaaatac

SEQ ID NO: 161174 - DNA, 25 bp, Rattus norvegicus
agtgcagtgctcgttatacaaatac

SEQ ID NO: 161175 - DNA, 25 bp, Rattus norvegicus
agtgcagtgcttctcagacatgcgc

SEQ ID NO: 161176 - DNA, 25 bp, Rattus norvegicus
agtgcagtgcttcttatacaggcca

SEQ ID NO: 161177 - DNA, 25 bp, Rattus norvegicus
agtgcagtgcttgtcagacatgcgc

SEQ ID NO: 161178 - DNA, 25 bp, Rattus norvegicus
agtgcagtgcttgttatacaggcca

SEQ ID NO: 161179 - DNA, 25 bp, Rattus norvegicus
agtgcagtgggcagacttggtcatc

SEQ ID NO: 161180 - DNA, 25 bp, Rattus norvegicus
agtgcagtgggctgacttggtcatc

SEQ ID NO: 161181 - DNA, 25 bp, Rattus norvegicus
agtgcagtgtgaaggagacttcccc

SEQ ID NO: 161182 - DNA, 25 bp, Rattus norvegicus
agtgcagtgtgatggagacttcccc

SEQ ID NO: 161183 - DNA, 25 bp, Rattus norvegicus
agtgcagtgtggaggttgtaacaca

SEQ ID NO: 161184 - DNA, 25 bp, Rattus norvegicus
agtgcagtgtggtggttgtaacaca

SEQ ID NO: 161185 - DNA, 25 bp, Rattus norvegicus
agtgcagttcagagtctcaatcctc

SEQ ID NO: 161186 - DNA, 25 bp, Rattus norvegicus
agtgcagttcagtgtctcaatcctc

SEQ ID NO: 161187 - DNA, 25 bp, Rattus norvegicus
agtgcagttctacggttgttctcta

SEQ ID NO: 161188 - DNA, 25 bp, Rattus norvegicus
agtgcagttctagggttgttctcta

SEQ ID NO: 161189 - DNA, 25 bp, Rattus norvegicus
agtgcataccgtctgtgttacctca

SEQ ID NO: 161190 - DNA, 25 bp, Rattus norvegicus
agtgcataccgtgtgtgttacctca

SEQ ID NO: 161191 - DNA, 25 bp, Rattus norvegicus
agtgcatacgtgacatgtggtacat

SEQ ID NO: 161192 - DNA, 25 bp, Rattus norvegicus
agtgcatacgtgtcatgtggtacat

SEQ ID NO: 161193 - DNA, 25 bp, Rattus norvegicus
agtgcatactgaccatctgtgccgg

SEQ ID NO: 161194 - DNA, 25 bp, Rattus norvegicus
agtgcatactgagcatctgtgccgg

SEQ ID NO: 161195 - DNA, 25 bp, Rattus norvegicus
agtgcatatctacttagccctgatg

SEQ ID NO: 161196 - DNA, 25 bp, Rattus norvegicus
agtgcatatctagttagccctgatg

SEQ ID NO: 161197 - DNA, 25 bp, Rattus norvegicus
agtgcatcactcaatctgttatctg

SEQ ID NO: 161198 - DNA, 25 bp, Rattus norvegicus
agtgcatcactctatctgttatctg

SEQ ID NO: 161199 - DNA, 25 bp, Rattus norvegicus
agtgcatcagataccccagtgggaa

SEQ ID NO: 161200 - DNA, 25 bp, Rattus norvegicus
agtgcatcagattccccagtgggaa

SEQ ID NO: 161201 - DNA, 25 bp, Rattus norvegicus
agtgcatccaatcaggccgggtctt

SEQ ID NO: 161202 - DNA, 25 bp, Rattus norvegicus
agtgcatccaatgaggccgggtctt

SEQ ID NO: 161203 - DNA, 25 bp, Rattus norvegicus
agtgcatccccacttgtagcagcaa

SEQ ID NO: 161204 - DNA, 25 bp, Rattus norvegicus
agtgcatccccagttgtagcagcaa

SEQ ID NO: 161205 - DNA, 25 bp, Rattus norvegicus
agtgcatccgagagtaaatataaaa

SEQ ID NO: 161206 - DNA, 25 bp, Rattus norvegicus
agtgcatccgagtgtaaatataaaa

SEQ ID NO: 161207 - DNA, 25 bp, Rattus norvegicus
agtgcatcctagatacagtcctgaa

SEQ ID NO: 161208 - DNA, 25 bp, Rattus norvegicus
agtgcatcctagttacagtcctgaa

SEQ ID NO: 161209 - DNA, 25 bp, Rattus norvegicus
agtgcatcctggagagttgctggca

SEQ ID NO: 161210 - DNA, 25 bp, Rattus norvegicus
agtgcatcctggtgagttgctggca

SEQ ID NO: 161211 - DNA, 25 bp, Rattus norvegicus
agtgcatcgttcaggagctagagtt

SEQ ID NO: 161212 - DNA, 25 bp, Rattus norvegicus
agtgcatcgttctggagctagagtt

SEQ ID NO: 161213 - DNA, 25 bp, Rattus norvegicus
agtgcatctcaacagtgtgtgctgt

SEQ ID NO: 161214 - DNA, 25 bp, Rattus norvegicus
agtgcatctcaagagtgtgtgctgt

SEQ ID NO: 161215 - DNA, 25 bp, Rattus norvegicus
agtgcatctctgactatttattggg

SEQ ID NO: 161216 - DNA, 25 bp, Rattus norvegicus
agtgcatctctgtctatttattggg

SEQ ID NO: 161217 - DNA, 25 bp, Rattus norvegicus
agtgcatctgaactgttctgggact

SEQ ID NO: 161218 - DNA, 25 bp, Rattus norvegicus
agtgcatctgaagtgttctgggact

SEQ ID NO: 161219 - DNA, 25 bp, Rattus norvegicus
agtgcatcttcaatgacttcctctt

SEQ ID NO: 161220 - DNA, 25 bp, Rattus norvegicus
agtgcatcttcattgacttcctctt

SEQ ID NO: 161221 - DNA, 25 bp, Rattus norvegicus
agtgcatgatggctgctggtcatca

SEQ ID NO: 161222 - DNA, 25 bp, Rattus norvegicus
agtgcatgatgggtgctggtcatca

SEQ ID NO: 161223 - DNA, 25 bp, Rattus norvegicus
agtgcatgcatacagtatcctcatt

SEQ ID NO: 161224 - DNA, 25 bp, Rattus norvegicus
agtgcatgcatagagtatcctcatt

SEQ ID NO: 161225 - DNA, 25 bp, Rattus norvegicus
agtgcatgcatgctgtaaggtcatc

SEQ ID NO: 161226 - DNA, 25 bp, Rattus norvegicus
agtgcatgcatggtgtaaggtcatc

SEQ ID NO: 161227 - DNA, 25 bp, Rattus norvegicus
agtgcatgctgcatgggcaaaggta

SEQ ID NO: 161228 - DNA, 25 bp, Rattus norvegicus
agtgcatgctgcctgttgttcctgt

SEQ ID NO: 161229 - DNA, 25 bp, Rattus norvegicus
agtgcatgctgcgtgttgttcctgt

SEQ ID NO: 161230 - DNA, 25 bp, Rattus norvegicus
agtgcatgctgcttgggcaaaggta

SEQ ID NO: 161231 - DNA, 25 bp, Rattus norvegicus
agtgcatggataagcctgggcctaa

SEQ ID NO: 161232 - DNA, 25 bp, Rattus norvegicus
agtgcatggatatgcctgggcctaa

SEQ ID NO: 161233 - DNA, 25 bp, Rattus norvegicus
agtgcatggcggagtttattcctca

SEQ ID NO: 161234 - DNA, 25 bp, Rattus norvegicus
agtgcatggcggtgtttattcctca

SEQ ID NO: 161235 - DNA, 25 bp, Rattus norvegicus
agtgcatgggtcattggcttttcct

SEQ ID NO: 161236 - DNA, 25 bp, Rattus norvegicus
agtgcatgggtctttggcttttcct

SEQ ID NO: 161237 - DNA, 25 bp, Rattus norvegicus
agtgcatgtcagctgttaacaagtg

SEQ ID NO: 161238 - DNA, 25 bp, Rattus norvegicus
agtgcatgtcaggtgttaacaagtg

SEQ ID NO: 161239 - DNA, 25 bp, Rattus norvegicus
agtgcatgtgctagtctgtataaac

SEQ ID NO: 161240 - DNA, 25 bp, Rattus norvegicus
agtgcatgtgcttgtctgtataaac

SEQ ID NO: 161241 - DNA, 25 bp, Rattus norvegicus
agtgcatgtggtcactgcctctcta

SEQ ID NO: 161242 - DNA, 25 bp, Rattus norvegicus
agtgcatgtggtgactgcctctcta

SEQ ID NO: 161243 - DNA, 25 bp, Rattus norvegicus
agtgcatgttgacggcatctccagt

SEQ ID NO: 161244 - DNA, 25 bp, Rattus norvegicus
agtgcatgttgagggcatctccagt

SEQ ID NO: 161245 - DNA, 25 bp, Rattus norvegicus
agtgcattatttcggttgctttacc

SEQ ID NO: 161246 - DNA, 25 bp, Rattus norvegicus
agtgcattatttgggttgctttacc

SEQ ID NO: 161247 - DNA, 25 bp, Rattus norvegicus
agtgcattcaggcttaggctcccag

SEQ ID NO: 161248 - DNA, 25 bp, Rattus norvegicus
agtgcattcagggttaggctcccag

SEQ ID NO: 161249 - DNA, 25 bp, Rattus norvegicus
agtgcattccatctccttggtgcaa

SEQ ID NO: 161250 - DNA, 25 bp, Rattus norvegicus
agtgcattccatgtccttggtgcaa

SEQ ID NO: 161251 - DNA, 25 bp, Rattus norvegicus
agtgcattcgcacgactatcagtct

SEQ ID NO: 161252 - DNA, 25 bp, Rattus norvegicus
agtgcattcgcaggactatcagtct

SEQ ID NO: 161253 - DNA, 25 bp, Rattus norvegicus
agtgcattgatcagtagggccgcct

SEQ ID NO: 161254 - DNA, 25 bp, Rattus norvegicus
agtgcattgatctgtagggccgcct

SEQ ID NO: 161255 - DNA, 25 bp, Rattus norvegicus
agtgcattgggcctgaatctctgaa

SEQ ID NO: 161256 - DNA, 25 bp, Rattus norvegicus
agtgcattgggcgtgaatctctgaa

SEQ ID NO: 161257 - DNA, 25 bp, Rattus norvegicus
agtgcattgtgcatgtggccacctg

SEQ ID NO: 161258 - DNA, 25 bp, Rattus norvegicus
agtgcattgtgcttgtggccacctg

SEQ ID NO: 161259 - DNA, 25 bp, Rattus norvegicus
agtgcatttgtcaaactccacatcc

SEQ ID NO: 161260 - DNA, 25 bp, Rattus norvegicus
agtgcatttgtccagccccagattc

SEQ ID NO: 161261 - DNA, 25 bp, Rattus norvegicus
agtgcatttgtcgagccccagattc

SEQ ID NO: 161262 - DNA, 25 bp, Rattus norvegicus
agtgcatttgtctaactccacatcc

SEQ ID NO: 161263 - DNA, 25 bp, Rattus norvegicus
agtgcatttgttcccttgattgttt

SEQ ID NO: 161264 - DNA, 25 bp, Rattus norvegicus
agtgcatttgttgccttgattgttt

SEQ ID NO: 161265 - DNA, 25 bp, Rattus norvegicus
agtgcattttatacagaaggtctca

SEQ ID NO: 161266 - DNA, 25 bp, Rattus norvegicus
agtgcattttattcagaaggtctca

SEQ ID NO: 161267 - DNA, 25 bp, Rattus norvegicus
agtgcattttgcacacccactggtg

SEQ ID NO: 161268 - DNA, 25 bp, Rattus norvegicus
agtgcattttgctcacccactggtg

SEQ ID NO: 161269 - DNA, 25 bp, Rattus norvegicus
agtgccaaattactccattttaaag

SEQ ID NO: 161270 - DNA, 25 bp, Rattus norvegicus
agtgccaaattagtccattttaaag

SEQ ID NO: 161271 - DNA, 25 bp, Rattus norvegicus
agtgccaacgggactgtgctcaaga

SEQ ID NO: 161272 - DNA, 25 bp, Rattus norvegicus
agtgccaacgggtctgtgctcaaga

SEQ ID NO: 161273 - DNA, 25 bp, Rattus norvegicus
agtgccaagaatcccaccaatgttg

SEQ ID NO: 161274 - DNA, 25 bp, Rattus norvegicus
agtgccaagaatgccaccaatgttg

SEQ ID NO: 161275 - DNA, 25 bp, Rattus norvegicus
agtgccaaggcaagtccagaaacta

SEQ ID NO: 161276 - DNA, 25 bp, Rattus norvegicus
agtgccaaggcatgtccagaaacta

SEQ ID NO: 161277 - DNA, 25 bp, Rattus norvegicus
agtgccaagggaatcaatgccctct

SEQ ID NO: 161278 - DNA, 25 bp, Rattus norvegicus
agtgccaagggattcaatgccctct

SEQ ID NO: 161279 - DNA, 25 bp, Rattus norvegicus
agtgccaagttgagcgagagtcatc

SEQ ID NO: 161280 - DNA, 25 bp, Rattus norvegicus
agtgccaagttgctcagaaagtctg

SEQ ID NO: 161281 - DNA, 25 bp, Rattus norvegicus
agtgccaagttggtcagaaagtctg

SEQ ID NO: 161282 - DNA, 25 bp, Rattus norvegicus
agtgccaagttgtgcgagagtcatc

SEQ ID NO: 161283 - DNA, 25 bp, Rattus norvegicus
agtgccaatggcacgtagacccctg

SEQ ID NO: 161284 - DNA, 25 bp, Rattus norvegicus
agtgccaatggctcgtagacccctg

SEQ ID NO: 161285 - DNA, 25 bp, Rattus norvegicus
agtgccaatgtcaatgtgcccctgc

SEQ ID NO: 161286 - DNA, 25 bp, Rattus norvegicus
agtgccaatgtctatgtgcccctgc

SEQ ID NO: 161287 - DNA, 25 bp, Rattus norvegicus
agtgccaattctcgagactattttt

SEQ ID NO: 161288 - DNA, 25 bp, Rattus norvegicus
agtgccaattctggagactattttt

SEQ ID NO: 161289 - DNA, 25 bp, Rattus norvegicus
agtgccacacgcaggaacttttcct

SEQ ID NO: 161290 - DNA, 25 bp, Rattus norvegicus
agtgccacacgctggaacttttcct

SEQ ID NO: 161291 - DNA, 25 bp, Rattus norvegicus
agtgccacactgcaggattctgggc

SEQ ID NO: 161292 - DNA, 25 bp, Rattus norvegicus
agtgccacactggaggattctgggc

SEQ ID NO: 161293 - DNA, 25 bp, Rattus norvegicus
agtgccacagccaagacagtagtcc

SEQ ID NO: 161294 - DNA, 25 bp, Rattus norvegicus
agtgccacagcctagacagtagtcc

SEQ ID NO: 161295 - DNA, 25 bp, Rattus norvegicus
agtgccacatggataatgctacccc

SEQ ID NO: 161296 - DNA, 25 bp, Rattus norvegicus
agtgccacatggttaatgctacccc

SEQ ID NO: 161297 - DNA, 25 bp, Rattus norvegicus
agtgccaccaaacctgacgacaagg

SEQ ID NO: 161298 - DNA, 25 bp, Rattus norvegicus
agtgccaccaaagctgacgacaagg

SEQ ID NO: 161299 - DNA, 25 bp, Rattus norvegicus
agtgccaccgccagctataaaatcg

SEQ ID NO: 161300 - DNA, 25 bp, Rattus norvegicus
agtgccaccgcctgctataaaatcg

SEQ ID NO: 161301 - DNA, 25 bp, Rattus norvegicus
agtgccacctcaacttcagtgatga

SEQ ID NO: 161302 - DNA, 25 bp, Rattus norvegicus
agtgccacctcaataacctttttag

SEQ ID NO: 161303 - DNA, 25 bp, Rattus norvegicus
agtgccacctcatcttcagtgatga

SEQ ID NO: 161304 - DNA, 25 bp, Rattus norvegicus
agtgccacctcattaacctttttag

SEQ ID NO: 161305 - DNA, 25 bp, Rattus norvegicus
agtgccacctctccagaacatggag

SEQ ID NO: 161306 - DNA, 25 bp, Rattus norvegicus
agtgccacctctgcagaacatggag

SEQ ID NO: 161307 - DNA, 25 bp, Rattus norvegicus
agtgccacctgccactgaagaagta

SEQ ID NO: 161308 - DNA, 25 bp, Rattus norvegicus
agtgccacctgcgactgaagaagta

SEQ ID NO: 161309 - DNA, 25 bp, Rattus norvegicus
agtgccactagtcccgacttggatg

SEQ ID NO: 161310 - DNA, 25 bp, Rattus norvegicus
agtgccactagtgccgacttggatg

SEQ ID NO: 161311 - DNA, 25 bp, Rattus norvegicus
agtgccactcatacctcagatcaag

SEQ ID NO: 161312 - DNA, 25 bp, Rattus norvegicus
agtgccactcattcctcagatcaag

SEQ ID NO: 161313 - DNA, 25 bp, Rattus norvegicus
agtgccactcctccagtgacttgga

SEQ ID NO: 161314 - DNA, 25 bp, Rattus norvegicus
agtgccactcctgcagtgacttgga

SEQ ID NO: 161315 - DNA, 25 bp, Rattus norvegicus
agtgccactgcaagtttatgtttag

SEQ ID NO: 161316 - DNA, 25 bp, Rattus norvegicus
agtgccactgcatgtttatgtttag

SEQ ID NO: 161317 - DNA, 25 bp, Rattus norvegicus
agtgccagcctgacttgagaccaag

SEQ ID NO: 161318 - DNA, 25 bp, Rattus norvegicus
agtgccagcctgtcttgagaccaag

SEQ ID NO: 161319 - DNA, 25 bp, Rattus norvegicus
agtgccagctccagtttaatcagtg

SEQ ID NO: 161320 - DNA, 25 bp, Rattus norvegicus
agtgccagctcctgtttaatcagtg

SEQ ID NO: 161321 - DNA, 25 bp, Rattus norvegicus
agtgccagctggaggttctttgcca

SEQ ID NO: 161322 - DNA, 25 bp, Rattus norvegicus
agtgccagctggtggttctttgcca

SEQ ID NO: 161323 - DNA, 25 bp, Rattus norvegicus
agtgccaggtaaccctcttcctaac

SEQ ID NO: 161324 - DNA, 25 bp, Rattus norvegicus
agtgccaggtaagcctcttcctaac

SEQ ID NO: 161325 - DNA, 25 bp, Rattus norvegicus
agtgccaggtggagctcaacaggaa

SEQ ID NO: 161326 - DNA, 25 bp, Rattus norvegicus
agtgccaggtggtgctcaacaggaa

SEQ ID NO: 161327 - DNA, 25 bp, Rattus norvegicus
agtgccagtccgatgccagctggga

SEQ ID NO: 161328 - DNA, 25 bp, Rattus norvegicus
agtgccagtccgttgccagctggga

SEQ ID NO: 161329 - DNA, 25 bp, Rattus norvegicus
agtgccagtgctcgtaccagtgtca

SEQ ID NO: 161330 - DNA, 25 bp, Rattus norvegicus
agtgccagtgctctgatctgcttct

SEQ ID NO: 161331 - DNA, 25 bp, Rattus norvegicus
agtgccagtgctggtaccagtgtca

SEQ ID NO: 161332 - DNA, 25 bp, Rattus norvegicus
agtgccagtgctgtgatctgcttct

SEQ ID NO: 161333 - DNA, 25 bp, Rattus norvegicus
agtgccagtgtcaaggagagccttc

SEQ ID NO: 161334 - DNA, 25 bp, Rattus norvegicus
agtgccagtgtcagtgcccttggat

SEQ ID NO: 161335 - DNA, 25 bp, Rattus norvegicus
agtgccagtgtctaggagagccttc

SEQ ID NO: 161336 - DNA, 25 bp, Rattus norvegicus
agtgccagtgtctgtgcccttggat

SEQ ID NO: 161337 - DNA, 25 bp, Rattus norvegicus
agtgccagttctcttagctgatact

SEQ ID NO: 161338 - DNA, 25 bp, Rattus norvegicus
agtgccagttctgttagctgatact

SEQ ID NO: 161339 - DNA, 25 bp, Rattus norvegicus
agtgccatatagattcagaatctgt

SEQ ID NO: 161340 - DNA, 25 bp, Rattus norvegicus
agtgccatatagtttcagaatctgt

SEQ ID NO: 161341 - DNA, 25 bp, Rattus norvegicus
agtgccatcaggctgctgggaacat

SEQ ID NO: 161342 - DNA, 25 bp, Rattus norvegicus
agtgccatcagggtgctgggaacat

SEQ ID NO: 161343 - DNA, 25 bp, Rattus norvegicus
agtgccatcatcaaagctgccaatg

SEQ ID NO: 161344 - DNA, 25 bp, Rattus norvegicus
agtgccatcatctaagctgccaatg

SEQ ID NO: 161345 - DNA, 25 bp, Rattus norvegicus
agtgccatccttcgaagccagaagc

SEQ ID NO: 161346 - DNA, 25 bp, Rattus norvegicus
agtgccatccttggaagccagaagc

SEQ ID NO: 161347 - DNA, 25 bp, Rattus norvegicus
agtgccatcgatactacctgtgtgc

SEQ ID NO: 161348 - DNA, 25 bp, Rattus norvegicus
agtgccatcgattctacctgtgtgc

SEQ ID NO: 161349 - DNA, 25 bp, Rattus norvegicus
agtgccatgaacaaatcttcccaac

SEQ ID NO: 161350 - DNA, 25 bp, Rattus norvegicus
agtgccatgaactaatcttcccaac

SEQ ID NO: 161351 - DNA, 25 bp, Rattus norvegicus
agtgccatgacaaaggatgccctgt

SEQ ID NO: 161352 - DNA, 25 bp, Rattus norvegicus
agtgccatgacataggatgccctgt

SEQ ID NO: 161353 - DNA, 25 bp, Rattus norvegicus
agtgccatgagaagtggtatcccgt

SEQ ID NO: 161354 - DNA, 25 bp, Rattus norvegicus
agtgccatgagatgtggtatcccgt

SEQ ID NO: 161355 - DNA, 25 bp, Rattus norvegicus
agtgccatgcgtacgctgaaaggca

SEQ ID NO: 161356 - DNA, 25 bp, Rattus norvegicus
agtgccatgcgttcgctgaaaggca

SEQ ID NO: 161357 - DNA, 25 bp, Rattus norvegicus
agtgccatggcaacctttcaaaagc

SEQ ID NO: 161358 - DNA, 25 bp, Rattus norvegicus
agtgccatggcatcctttcaaaagc

SEQ ID NO: 161359 - DNA, 25 bp, Rattus norvegicus
agtgccatggcgactgcagaagtct

SEQ ID NO: 161360 - DNA, 25 bp, Rattus norvegicus
agtgccatggcgtctgcagaagtct

SEQ ID NO: 161361 - DNA, 25 bp, Rattus norvegicus
agtgccattaagatttacggagcca

SEQ ID NO: 161362 - DNA, 25 bp, Rattus norvegicus
agtgccattaagttttacggagcca

SEQ ID NO: 161363 - DNA, 25 bp, Rattus norvegicus
agtgccattactagtgttcctctta

SEQ ID NO: 161364 - DNA, 25 bp, Rattus norvegicus
agtgccattacttgtgttcctctta

SEQ ID NO: 161365 - DNA, 25 bp, Rattus norvegicus
agtgccattgaactgttacctcatg

SEQ ID NO: 161366 - DNA, 25 bp, Rattus norvegicus
agtgccattgaagtgttacctcatg

SEQ ID NO: 161367 - DNA, 25 bp, Rattus norvegicus
agtgccattggcagtgtgctaagaa

SEQ ID NO: 161368 - DNA, 25 bp, Rattus norvegicus
agtgccattggctgtgtgctaagaa

SEQ ID NO: 161369 - DNA, 25 bp, Rattus norvegicus
agtgcccaaatgagtttactggtga

SEQ ID NO: 161370 - DNA, 25 bp, Rattus norvegicus
agtgcccaaatgtgtttactggtga

SEQ ID NO: 161371 - DNA, 25 bp, Rattus norvegicus
agtgcccaacagagcattgcagtgg

SEQ ID NO: 161372 - DNA, 25 bp, Rattus norvegicus
agtgcccaacagtgcattgcagtgg

SEQ ID NO: 161373 - DNA, 25 bp, Rattus norvegicus
agtgcccaacttccttagaagccag

SEQ ID NO: 161374 - DNA, 25 bp, Rattus norvegicus
agtgcccaacttgcttagaagccag

SEQ ID NO: 161375 - DNA, 25 bp, Rattus norvegicus
agtgcccaagcgaaggcctcatgtt

SEQ ID NO: 161376 - DNA, 25 bp, Rattus norvegicus
agtgcccaagcgtaggcctcatgtt

SEQ ID NO: 161377 - DNA, 25 bp, Rattus norvegicus
agtgcccaaggtaatcccagcacag

SEQ ID NO: 161378 - DNA, 25 bp, Rattus norvegicus
agtgcccaaggttatcccagcacag

SEQ ID NO: 161379 - DNA, 25 bp, Rattus norvegicus
agtgcccacaccaggtggctcacaa

SEQ ID NO: 161380 - DNA, 25 bp, Rattus norvegicus
agtgcccacacctggtggctcacaa

SEQ ID NO: 161381 - DNA, 25 bp, Rattus norvegicus
agtgcccacgagacatctgtagcat

SEQ ID NO: 161382 - DNA, 25 bp, Rattus norvegicus
agtgcccacgagtcatctgtagcat

SEQ ID NO: 161383 - DNA, 25 bp, Rattus norvegicus
agtgcccactacatgtggcaggcat

SEQ ID NO: 161384 - DNA, 25 bp, Rattus norvegicus
agtgcccactacttgtggcaggcat

SEQ ID NO: 161385 - DNA, 25 bp, Rattus norvegicus
agtgcccactatccctccaaatgga

SEQ ID NO: 161386 - DNA, 25 bp, Rattus norvegicus
agtgcccactatgcctccaaatgga

SEQ ID NO: 161387 - DNA, 25 bp, Rattus norvegicus
agtgcccactgacgctgttgctgga

SEQ ID NO: 161388 - DNA, 25 bp, Rattus norvegicus
agtgcccactgaggctgttgctgga

SEQ ID NO: 161389 - DNA, 25 bp, Rattus norvegicus
agtgcccactgtccagacagtcatg

SEQ ID NO: 161390 - DNA, 25 bp, Rattus norvegicus
agtgcccactgtgcagacagtcatg

SEQ ID NO: 161391 - DNA, 25 bp, Rattus norvegicus
agtgcccagcagaagagcgcccgct

SEQ ID NO: 161392 - DNA, 25 bp, Rattus norvegicus
agtgcccagcagtagagcgcccgct

SEQ ID NO: 161393 - DNA, 25 bp, Rattus norvegicus
agtgcccagcctctgatgtgatgga

SEQ ID NO: 161394 - DNA, 25 bp, Rattus norvegicus
agtgcccagcctgtgatgtgatgga

SEQ ID NO: 161395 - DNA, 25 bp, Rattus norvegicus
agtgcccagcttccaagtggccctt

SEQ ID NO: 161396 - DNA, 25 bp, Rattus norvegicus
agtgcccagcttgcaagtggccctt

SEQ ID NO: 161397 - DNA, 25 bp, Rattus norvegicus
agtgcccataacatagtactcctca

SEQ ID NO: 161398 - DNA, 25 bp, Rattus norvegicus
agtgcccataacttagtactcctca

SEQ ID NO: 161399 - DNA, 25 bp, Rattus norvegicus
agtgcccatcccatacaactgaggt

SEQ ID NO: 161400 - DNA, 25 bp, Rattus norvegicus
agtgcccatcccttacaactgaggt

SEQ ID NO: 161401 - DNA, 25 bp, Rattus norvegicus
agtgcccatgctcggaaaatggtct

SEQ ID NO: 161402 - DNA, 25 bp, Rattus norvegicus
agtgcccatgctgggaaaatggtct

SEQ ID NO: 161403 - DNA, 25 bp, Rattus norvegicus
agtgcccatgtccttgtgagtctta

SEQ ID NO: 161404 - DNA, 25 bp, Rattus norvegicus
agtgcccatgtcgttgtgagtctta

SEQ ID NO: 161405 - DNA, 25 bp, Rattus norvegicus
agtgcccatgtgatcaagactcttc

SEQ ID NO: 161406 - DNA, 25 bp, Rattus norvegicus
agtgcccatgtgttcaagactcttc

SEQ ID NO: 161407 - DNA, 25 bp, Rattus norvegicus
agtgcccatttcaactggttacgta

SEQ ID NO: 161408 - DNA, 25 bp, Rattus norvegicus
agtgcccatttctactggttacgta

SEQ ID NO: 161409 - DNA, 25 bp, Rattus norvegicus
agtgccccagagaccagtaagtcgg

SEQ ID NO: 161410 - DNA, 25 bp, Rattus norvegicus
agtgccccagagtccagtaagtcgg

SEQ ID NO: 161411 - DNA, 25 bp, Rattus norvegicus
agtgccccatctaaacagtcacgat

SEQ ID NO: 161412 - DNA, 25 bp, Rattus norvegicus
agtgccccatcttaacagtcacgat

SEQ ID NO: 161413 - DNA, 25 bp, Rattus norvegicus
agtgccccggataacgcgctgttca

SEQ ID NO: 161414 - DNA, 25 bp, Rattus norvegicus
agtgccccggattacgcgctgttca

SEQ ID NO: 161415 - DNA, 25 bp, Rattus norvegicus
agtgcccctgtgcagctcatagtct

SEQ ID NO: 161416 - DNA, 25 bp, Rattus norvegicus
agtgcccctgtggagctcatagtct

SEQ ID NO: 161417 - DNA, 25 bp, Rattus norvegicus
agtgccccttctatctgcttggaat

SEQ ID NO: 161418 - DNA, 25 bp, Rattus norvegicus
agtgccccttctttctgcttggaat

SEQ ID NO: 161419 - DNA, 25 bp, Rattus norvegicus
agtgccccttgtacaggtgcttgac

SEQ ID NO: 161420 - DNA, 25 bp, Rattus norvegicus
agtgccccttgttcaggtgcttgac

SEQ ID NO: 161421 - DNA, 25 bp, Rattus norvegicus
agtgcccgagttagtgcctgttaaa

SEQ ID NO: 161422 - DNA, 25 bp, Rattus norvegicus
agtgcccgagtttgtgcctgttaaa

SEQ ID NO: 161423 - DNA, 25 bp, Rattus norvegicus
agtgcccgatctcctggtcattgca

SEQ ID NO: 161424 - DNA, 25 bp, Rattus norvegicus
agtgcccgatctgctggtcattgca

SEQ ID NO: 161425 - DNA, 25 bp, Rattus norvegicus
agtgcccgattccaagtgtgtctac

SEQ ID NO: 161426 - DNA, 25 bp, Rattus norvegicus
agtgcccgattcgaagtgtgtctac

SEQ ID NO: 161427 - DNA, 25 bp, Rattus norvegicus
agtgcccgttctcaggactgccgtg

SEQ ID NO: 161428 - DNA, 25 bp, Rattus norvegicus
agtgcccgttctgaggactgccgtg

SEQ ID NO: 161429 - DNA, 25 bp, Rattus norvegicus
agtgccctacctcacttctaagaga

SEQ ID NO: 161430 - DNA, 25 bp, Rattus norvegicus
agtgccctacctgacttctaagaga

SEQ ID NO: 161431 - DNA, 25 bp, Rattus norvegicus
agtgccctcaaccactaactgttga

SEQ ID NO: 161432 - DNA, 25 bp, Rattus norvegicus
agtgccctcaacgactaactgttga

SEQ ID NO: 161433 - DNA, 25 bp, Rattus norvegicus
agtgccctcagaaccacacggtggc

SEQ ID NO: 161434 - DNA, 25 bp, Rattus norvegicus
agtgccctcagatccacacggtggc

SEQ ID NO: 161435 - DNA, 25 bp, Rattus norvegicus
agtgccctcctcagagatatttaac

SEQ ID NO: 161436 - DNA, 25 bp, Rattus norvegicus
agtgccctcctctgagatatttaac

SEQ ID NO: 161437 - DNA, 25 bp, Rattus norvegicus
agtgccctcgggacagacagaacca

SEQ ID NO: 161438 - DNA, 25 bp, Rattus norvegicus
agtgccctcgggtcagacagaacca

SEQ ID NO: 161439 - DNA, 25 bp, Rattus norvegicus
agtgccctgaatacattctccagtg

SEQ ID NO: 161440 - DNA, 25 bp, Rattus norvegicus
agtgccctgaattcattctccagtg

SEQ ID NO: 161441 - DNA, 25 bp, Rattus norvegicus
agtgccctgattaccaggttctcca

SEQ ID NO: 161442 - DNA, 25 bp, Rattus norvegicus
agtgccctgatttccaggttctcca

SEQ ID NO: 161443 - DNA, 25 bp, Rattus norvegicus
agtgccctgcagaatgaagacgtga

SEQ ID NO: 161444 - DNA, 25 bp, Rattus norvegicus
agtgccctgcagtatgaagacgtga

SEQ ID NO: 161445 - DNA, 25 bp, Rattus norvegicus
agtgccctgggtagcagaactctgg

SEQ ID NO: 161446 - DNA, 25 bp, Rattus norvegicus
agtgccctgggttgcagaactctgg

SEQ ID NO: 161447 - DNA, 25 bp, Rattus norvegicus
agtgccctgtctcgaatgtagaacc

SEQ ID NO: 161448 - DNA, 25 bp, Rattus norvegicus
agtgccctgtctggaatgtagaacc

SEQ ID NO: 161449 - DNA, 25 bp, Rattus norvegicus
agtgccctgtggaagtttattctta

SEQ ID NO: 161450 - DNA, 25 bp, Rattus norvegicus
agtgccctgtggtagtttattctta

SEQ ID NO: 161451 - DNA, 25 bp, Rattus norvegicus
agtgccctgtgtactgggttttaat

SEQ ID NO: 161452 - DNA, 25 bp, Rattus norvegicus
agtgccctgtgttctgggttttaat

SEQ ID NO: 161453 - DNA, 25 bp, Rattus norvegicus
agtgcccttaaacgcgatcagatct

SEQ ID NO: 161454 - DNA, 25 bp, Rattus norvegicus
agtgcccttaaaggcgatcagatct

SEQ ID NO: 161455 - DNA, 25 bp, Rattus norvegicus
agtgcccttaggactgtcatcatta

SEQ ID NO: 161456 - DNA, 25 bp, Rattus norvegicus
agtgcccttaggtctgtcatcatta

SEQ ID NO: 161457 - DNA, 25 bp, Rattus norvegicus
agtgcccttctcacagtgaattcag

SEQ ID NO: 161458 - DNA, 25 bp, Rattus norvegicus
agtgcccttctctcagtgaattcag

SEQ ID NO: 161459 - DNA, 25 bp, Rattus norvegicus
agtgcccttctgagtcacacgggaa

SEQ ID NO: 161460 - DNA, 25 bp, Rattus norvegicus
agtgcccttctgtgtcacacgggaa

SEQ ID NO: 161461 - DNA, 25 bp, Rattus norvegicus
agtgccctttagagctctttataat

SEQ ID NO: 161462 - DNA, 25 bp, Rattus norvegicus
agtgccctttagtgctctttataat

SEQ ID NO: 161463 - DNA, 25 bp, Rattus norvegicus
agtgccctttatatcttccaggaag

SEQ ID NO: 161464 - DNA, 25 bp, Rattus norvegicus
agtgccctttatttcttccaggaag

SEQ ID NO: 161465 - DNA, 25 bp, Rattus norvegicus
agtgccctttgtccggaatgttgag

SEQ ID NO: 161466 - DNA, 25 bp, Rattus norvegicus
agtgccctttgtgcggaatgttgag

SEQ ID NO: 161467 - DNA, 25 bp, Rattus norvegicus
agtgcccttttcagctgcatttagc

SEQ ID NO: 161468 - DNA, 25 bp, Rattus norvegicus
agtgcccttttctgctgcatttagc

SEQ ID NO: 161469 - DNA, 25 bp, Rattus norvegicus
agtgccgaaacaatgctcagctcct

SEQ ID NO: 161470 - DNA, 25 bp, Rattus norvegicus
agtgccgaaacattgctcagctcct

SEQ ID NO: 161471 - DNA, 25 bp, Rattus norvegicus
agtgccgaagtgcatgcactacctg

SEQ ID NO: 161472 - DNA, 25 bp, Rattus norvegicus
agtgccgaagtggatgcactacctg

SEQ ID NO: 161473 - DNA, 25 bp, Rattus norvegicus
agtgccgacctgcatagtcagtgaa

SEQ ID NO: 161474 - DNA, 25 bp, Rattus norvegicus
agtgccgacctggatagtcagtgaa

SEQ ID NO: 161475 - DNA, 25 bp, Rattus norvegicus
agtgccgcaattatcttcgggtaga

SEQ ID NO: 161476 - DNA, 25 bp, Rattus norvegicus
agtgccgcaattttcttcgggtaga

SEQ ID NO: 161477 - DNA, 25 bp, Rattus norvegicus
agtgccgcacaaatgagccatgaaa

SEQ ID NO: 161478 - DNA, 25 bp, Rattus norvegicus
agtgccgcacaattgagccatgaaa

SEQ ID NO: 161479 - DNA, 25 bp, Rattus norvegicus
agtgccgccagcagcgcctctagtc

SEQ ID NO: 161480 - DNA, 25 bp, Rattus norvegicus
agtgccgccagctgcgcctctagtc

SEQ ID NO: 161481 - DNA, 25 bp, Rattus norvegicus
agtgccgccgggatctgagccctta

SEQ ID NO: 161482 - DNA, 25 bp, Rattus norvegicus
agtgccgccgggttctgagccctta

SEQ ID NO: 161483 - DNA, 25 bp, Rattus norvegicus
agtgccgctgcgaccgcaagtggct

SEQ ID NO: 161484 - DNA, 25 bp, Rattus norvegicus
agtgccgctgcgtccgcaagtggct

SEQ ID NO: 161485 - DNA, 25 bp, Rattus norvegicus
agtgccgctgggatgactcggtcac

SEQ ID NO: 161486 - DNA, 25 bp, Rattus norvegicus
agtgccgctgggttgactcggtcac

SEQ ID NO: 161487 - DNA, 25 bp, Rattus norvegicus
agtgccgcttcaactgagcaggtca

SEQ ID NO: 161488 - DNA, 25 bp, Rattus norvegicus
agtgccgcttcatctgagcaggtca

SEQ ID NO: 161489 - DNA, 25 bp, Rattus norvegicus
agtgccgctttcattggaccctgac

SEQ ID NO: 161490 - DNA, 25 bp, Rattus norvegicus
agtgccgctttctttggaccctgac

SEQ ID NO: 161491 - DNA, 25 bp, Rattus norvegicus
agtgccggagcacgccttgtagaaa

SEQ ID NO: 161492 - DNA, 25 bp, Rattus norvegicus
agtgccggagcaggccttgtagaaa

SEQ ID NO: 161493 - DNA, 25 bp, Rattus norvegicus
agtgccggcccaataagtcttggga

SEQ ID NO: 161494 - DNA, 25 bp, Rattus norvegicus
agtgccggcccattaagtcttggga

SEQ ID NO: 161495 - DNA, 25 bp, Rattus norvegicus
agtgccgggtgcacacgtttgcctg

SEQ ID NO: 161496 - DNA, 25 bp, Rattus norvegicus
agtgccgggtgctcacgtttgcctg

SEQ ID NO: 161497 - DNA, 25 bp, Rattus norvegicus
agtgccgtaaccctagtcggatgca

SEQ ID NO: 161498 - DNA, 25 bp, Rattus norvegicus
agtgccgtaaccgtagtcggatgca

SEQ ID NO: 161499 - DNA, 25 bp, Rattus norvegicus
agtgccgtaggtagactgagtctcc

SEQ ID NO: 161500 - DNA, 25 bp, Rattus norvegicus
agtgccgtaggttgactgagtctcc

SEQ ID NO: 161501 - DNA, 25 bp, Rattus norvegicus
agtgccgtgcgcagcctgcagaagc

SEQ ID NO: 161502 - DNA, 25 bp, Rattus norvegicus
agtgccgtgcgctgcctgcagaagc

SEQ ID NO: 161503 - DNA, 25 bp, Rattus norvegicus
agtgccgttaggaagacgaatacca

SEQ ID NO: 161504 - DNA, 25 bp, Rattus norvegicus
agtgccgttaggtagacgaatacca

SEQ ID NO: 161505 - DNA, 25 bp, Rattus norvegicus
agtgccgttggtaccagcaaagtca

SEQ ID NO: 161506 - DNA, 25 bp, Rattus norvegicus
agtgccgttggttccagcaaagtca

SEQ ID NO: 161507 - DNA, 25 bp, Rattus norvegicus
agtgccgtttctagtatactcctgt

SEQ ID NO: 161508 - DNA, 25 bp, Rattus norvegicus
agtgccgtttcttgtatactcctgt

SEQ ID NO: 161509 - DNA, 25 bp, Rattus norvegicus
agtgcctaagtgattaccgaggcgg

SEQ ID NO: 161510 - DNA, 25 bp, Rattus norvegicus
agtgcctaagtgtttaccgaggcgg

SEQ ID NO: 161511 - DNA, 25 bp, Rattus norvegicus
agtgcctacagcatttcgtgtgtaa

SEQ ID NO: 161512 - DNA, 25 bp, Rattus norvegicus
agtgcctacagcttttcgtgtgtaa

SEQ ID NO: 161513 - DNA, 25 bp, Rattus norvegicus
agtgcctaccagacaattgactcgt

SEQ ID NO: 161514 - DNA, 25 bp, Rattus norvegicus
agtgcctaccagtcaattgactcgt

SEQ ID NO: 161515 - DNA, 25 bp, Rattus norvegicus
agtgcctacctgacgtgggcaatac

SEQ ID NO: 161516 - DNA, 25 bp, Rattus norvegicus
agtgcctacctgtcgtgggcaatac

SEQ ID NO: 161517 - DNA, 25 bp, Rattus norvegicus
agtgcctaccttcccagggcaggta

SEQ ID NO: 161518 - DNA, 25 bp, Rattus norvegicus
agtgcctaccttgccagggcaggta

SEQ ID NO: 161519 - DNA, 25 bp, Rattus norvegicus
agtgcctacgtgcagacacatctgt

SEQ ID NO: 161520 - DNA, 25 bp, Rattus norvegicus
agtgcctacgtggagacacatctgt

SEQ ID NO: 161521 - DNA, 25 bp, Rattus norvegicus
agtgcctactctccagtgatcaaac

SEQ ID NO: 161522 - DNA, 25 bp, Rattus norvegicus
agtgcctactctgcagtgatcaaac

SEQ ID NO: 161523 - DNA, 25 bp, Rattus norvegicus
agtgcctacttgcatgtacttttga

SEQ ID NO: 161524 - DNA, 25 bp, Rattus norvegicus
agtgcctacttggatgtacttttga

SEQ ID NO: 161525 - DNA, 25 bp, Rattus norvegicus
agtgcctagattctggctgctattt

SEQ ID NO: 161526 - DNA, 25 bp, Rattus norvegicus
agtgcctagattgtggctgctattt

SEQ ID NO: 161527 - DNA, 25 bp, Rattus norvegicus
agtgcctagcagctatctccacagg

SEQ ID NO: 161528 - DNA, 25 bp, Rattus norvegicus
agtgcctagcaggtatctccacagg

SEQ ID NO: 161529 - DNA, 25 bp, Rattus norvegicus
agtgcctataagaatcagatgcctg

SEQ ID NO: 161530 - DNA, 25 bp, Rattus norvegicus
agtgcctataagtatcagatgcctg

SEQ ID NO: 161531 - DNA, 25 bp, Rattus norvegicus
agtgcctcactcacgggacagcgaa

SEQ ID NO: 161532 - DNA, 25 bp, Rattus norvegicus
agtgcctcactcactctgaaagtgt

SEQ ID NO: 161533 - DNA, 25 bp, Rattus norvegicus
agtgcctcactctcgggacagcgaa

SEQ ID NO: 161534 - DNA, 25 bp, Rattus norvegicus
agtgcctcactctctctgaaagtgt

SEQ ID NO: 161535 - DNA, 25 bp, Rattus norvegicus
agtgcctcagacaacgcagggttga

SEQ ID NO: 161536 - DNA, 25 bp, Rattus norvegicus
agtgcctcagaccttattgctttaa

SEQ ID NO: 161537 - DNA, 25 bp, Rattus norvegicus
agtgcctcagacgttattgctttaa

SEQ ID NO: 161538 - DNA, 25 bp, Rattus norvegicus
agtgcctcagactacgcagggttga

SEQ ID NO: 161539 - DNA, 25 bp, Rattus norvegicus
agtgcctcagccatcgttacagtaa

SEQ ID NO: 161540 - DNA, 25 bp, Rattus norvegicus
agtgcctcagccttcgttacagtaa

SEQ ID NO: 161541 - DNA, 25 bp, Rattus norvegicus
agtgcctccgtgattcccttaagaa

SEQ ID NO: 161542 - DNA, 25 bp, Rattus norvegicus
agtgcctccgtgtttcccttaagaa

SEQ ID NO: 161543 - DNA, 25 bp, Rattus norvegicus
agtgcctccttgagcatagaacttc

SEQ ID NO: 161544 - DNA, 25 bp, Rattus norvegicus
agtgcctccttgtgcatagaacttc

SEQ ID NO: 161545 - DNA, 25 bp, Rattus norvegicus
agtgcctcggctctgagattcagat

SEQ ID NO: 161546 - DNA, 25 bp, Rattus norvegicus
agtgcctcggctgtgagattcagat

SEQ ID NO: 161547 - DNA, 25 bp, Rattus norvegicus
agtgcctcgtgtccatgtccagccg

SEQ ID NO: 161548 - DNA, 25 bp, Rattus norvegicus
agtgcctcgtgtgcatgtccagccg

SEQ ID NO: 161549 - DNA, 25 bp, Rattus norvegicus
agtgcctctaggaacttttgctagt

SEQ ID NO: 161550 - DNA, 25 bp, Rattus norvegicus
agtgcctctaggtacttttgctagt

SEQ ID NO: 161551 - DNA, 25 bp, Rattus norvegicus
agtgcctctcctcatgttaggctta

SEQ ID NO: 161552 - DNA, 25 bp, Rattus norvegicus
agtgcctctcctgatgttaggctta

SEQ ID NO: 161553 - DNA, 25 bp, Rattus norvegicus
agtgcctctcttagaaggtgctatt

SEQ ID NO: 161554 - DNA, 25 bp, Rattus norvegicus
agtgcctctcttatctgtttcctaa

SEQ ID NO: 161555 - DNA, 25 bp, Rattus norvegicus
agtgcctctctttgaaggtgctatt

SEQ ID NO: 161556 - DNA, 25 bp, Rattus norvegicus
agtgcctctcttttctgtttcctaa

SEQ ID NO: 161557 - DNA, 25 bp, Rattus norvegicus
agtgcctctgcccaaagttgtacaa

SEQ ID NO: 161558 - DNA, 25 bp, Rattus norvegicus
agtgcctctgccgaaagttgtacaa

SEQ ID NO: 161559 - DNA, 25 bp, Rattus norvegicus
agtgcctctggaaggactgggtcac

SEQ ID NO: 161560 - DNA, 25 bp, Rattus norvegicus
agtgcctctggacaacggcgagatc

SEQ ID NO: 161561 - DNA, 25 bp, Rattus norvegicus
agtgcctctggagaacggcgagatc

SEQ ID NO: 161562 - DNA, 25 bp, Rattus norvegicus
agtgcctctggatggactgggtcac

SEQ ID NO: 161563 - DNA, 25 bp, Rattus norvegicus
agtgcctctggccatcttgggcaac

SEQ ID NO: 161564 - DNA, 25 bp, Rattus norvegicus
agtgcctctggcgatcttgggcaac

SEQ ID NO: 161565 - DNA, 25 bp, Rattus norvegicus
agtgcctcttgaaaaaccttaagct

SEQ ID NO: 161566 - DNA, 25 bp, Rattus norvegicus
agtgcctcttgataaaccttaagct

SEQ ID NO: 161567 - DNA, 25 bp, Rattus norvegicus
agtgcctgacttaacctattatatt

SEQ ID NO: 161568 - DNA, 25 bp, Rattus norvegicus
agtgcctgactttacctattatatt

SEQ ID NO: 161569 - DNA, 25 bp, Rattus norvegicus
agtgcctgagcaagtttgtgcctct

SEQ ID NO: 161570 - DNA, 25 bp, Rattus norvegicus
agtgcctgagcatgtttgtgcctct

SEQ ID NO: 161571 - DNA, 25 bp, Rattus norvegicus
agtgcctgattcaaatgccgcagcc

SEQ ID NO: 161572 - DNA, 25 bp, Rattus norvegicus
agtgcctgattctaatgccgcagcc

SEQ ID NO: 161573 - DNA, 25 bp, Rattus norvegicus
agtgcctgcactcgaaagctccaat

SEQ ID NO: 161574 - DNA, 25 bp, Rattus norvegicus
agtgcctgcactggaaagctccaat

SEQ ID NO: 161575 - DNA, 25 bp, Rattus norvegicus
agtgcctgcattccggagtccagtg

SEQ ID NO: 161576 - DNA, 25 bp, Rattus norvegicus
agtgcctgcattgcggagtccagtg

SEQ ID NO: 161577 - DNA, 25 bp, Rattus norvegicus
agtgcctgctacaaagaatgttcca

SEQ ID NO: 161578 - DNA, 25 bp, Rattus norvegicus
agtgcctgctactaagaatgttcca

SEQ ID NO: 161579 - DNA, 25 bp, Rattus norvegicus
agtgcctgctcactgagttctgtct

SEQ ID NO: 161580 - DNA, 25 bp, Rattus norvegicus
agtgcctgctcagtgagttctgtct

SEQ ID NO: 161581 - DNA, 25 bp, Rattus norvegicus
agtgcctgctctcggtggataagta

SEQ ID NO: 161582 - DNA, 25 bp, Rattus norvegicus
agtgcctgctctgggtggataagta

SEQ ID NO: 161583 - DNA, 25 bp, Rattus norvegicus
agtgcctgcttacgagctctgctag

SEQ ID NO: 161584 - DNA, 25 bp, Rattus norvegicus
agtgcctgcttaggagctctgctag

SEQ ID NO: 161585 - DNA, 25 bp, Rattus norvegicus
agtgcctgcttcaggattgtcgctc

SEQ ID NO: 161586 - DNA, 25 bp, Rattus norvegicus
agtgcctgcttctggattgtcgctc

SEQ ID NO: 161587 - DNA, 25 bp, Rattus norvegicus
agtgcctgctttccgttaagcgtga

SEQ ID NO: 161588 - DNA, 25 bp, Rattus norvegicus
agtgcctgctttgcgttaagcgtga

SEQ ID NO: 161589 - DNA, 25 bp, Rattus norvegicus
agtgcctggatcctctgtgggatta

SEQ ID NO: 161590 - DNA, 25 bp, Rattus norvegicus
agtgcctggatcgtctgtgggatta

SEQ ID NO: 161591 - DNA, 25 bp, Rattus norvegicus
agtgcctggcacagatctcaaagga

SEQ ID NO: 161592 - DNA, 25 bp, Rattus norvegicus
agtgcctggcactgatctcaaagga

SEQ ID NO: 161593 - DNA, 25 bp, Rattus norvegicus
agtgcctggctgaatttaatttgtg

SEQ ID NO: 161594 - DNA, 25 bp, Rattus norvegicus
agtgcctggctgtatttaatttgtg

SEQ ID NO: 161595 - DNA, 25 bp, Rattus norvegicus
agtgcctgggctaaggatcttgcct

SEQ ID NO: 161596 - DNA, 25 bp, Rattus norvegicus
agtgcctgggcttaggatcttgcct

SEQ ID NO: 161597 - DNA, 25 bp, Rattus norvegicus
agtgcctgtattatctgcagtcttc

SEQ ID NO: 161598 - DNA, 25 bp, Rattus norvegicus
agtgcctgtattttctgcagtcttc

SEQ ID NO: 161599 - DNA, 25 bp, Rattus norvegicus
agtgcctgtggaaacctgaaatggt

SEQ ID NO: 161600 - DNA, 25 bp, Rattus norvegicus
agtgcctgtggatacctgaaatggt

SEQ ID NO: 161601 - DNA, 25 bp, Rattus norvegicus
agtgcctgtggcaagaccaatctgg

SEQ ID NO: 161602 - DNA, 25 bp, Rattus norvegicus
agtgcctgtggcctgtggttttcca

SEQ ID NO: 161603 - DNA, 25 bp, Rattus norvegicus
agtgcctgtggcgtgtggttttcca

SEQ ID NO: 161604 - DNA, 25 bp, Rattus norvegicus
agtgcctgtggctagaccaatctgg

SEQ ID NO: 161605 - DNA, 25 bp, Rattus norvegicus
agtgcctgttctcatgggtgttagt

SEQ ID NO: 161606 - DNA, 25 bp, Rattus norvegicus
agtgcctgttctgatgggtgttagt

SEQ ID NO: 161607 - DNA, 25 bp, Rattus norvegicus
agtgccttactgatttgtgtctcct

SEQ ID NO: 161608 - DNA, 25 bp, Rattus norvegicus
agtgccttactgttttgtgtctcct

SEQ ID NO: 161609 - DNA, 25 bp, Rattus norvegicus
agtgccttagatactcccttagatg

SEQ ID NO: 161610 - DNA, 25 bp, Rattus norvegicus
agtgccttagattctcccttagatg

SEQ ID NO: 161611 - DNA, 25 bp, Rattus norvegicus
agtgccttaggcctgtgagccacaa

SEQ ID NO: 161612 - DNA, 25 bp, Rattus norvegicus
agtgccttaggcgtgtgagccacaa

SEQ ID NO: 161613 - DNA, 25 bp, Rattus norvegicus
agtgccttagtaaattcctttgtgg

SEQ ID NO: 161614 - DNA, 25 bp, Rattus norvegicus
agtgccttagtatattcctttgtgg

SEQ ID NO: 161615 - DNA, 25 bp, Rattus norvegicus
agtgccttatcccttggtgcgggaa

SEQ ID NO: 161616 - DNA, 25 bp, Rattus norvegicus
agtgccttatccgttggtgcgggaa

SEQ ID NO: 161617 - DNA, 25 bp, Rattus norvegicus
agtgccttcaaactcagctgttcca

SEQ ID NO: 161618 - DNA, 25 bp, Rattus norvegicus
agtgccttcaaagtcagctgttcca

SEQ ID NO: 161619 - DNA, 25 bp, Rattus norvegicus
agtgccttcaacatagctgtctctt

SEQ ID NO: 161620 - DNA, 25 bp, Rattus norvegicus
agtgccttcaacttagctgtctctt

SEQ ID NO: 161621 - DNA, 25 bp, Rattus norvegicus
agtgccttcacgacctctgatgttg

SEQ ID NO: 161622 - DNA, 25 bp, Rattus norvegicus
agtgccttcacgtcctctgatgttg

SEQ ID NO: 161623 - DNA, 25 bp, Rattus norvegicus
agtgccttcagaacaccctagtaag

SEQ ID NO: 161624 - DNA, 25 bp, Rattus norvegicus
agtgccttcagatcaccctagtaag

SEQ ID NO: 161625 - DNA, 25 bp, Rattus norvegicus
agtgccttcagtaacttttgtccca

SEQ ID NO: 161626 - DNA, 25 bp, Rattus norvegicus
agtgccttcagttacttttgtccca

SEQ ID NO: 161627 - DNA, 25 bp, Rattus norvegicus
agtgccttcccgaaagggtaatgct

SEQ ID NO: 161628 - DNA, 25 bp, Rattus norvegicus
agtgccttcccgtaagggtaatgct

SEQ ID NO: 161629 - DNA, 25 bp, Rattus norvegicus
agtgccttcgttattgagcctggga

SEQ ID NO: 161630 - DNA, 25 bp, Rattus norvegicus
agtgccttcgtttttgagcctggga

SEQ ID NO: 161631 - DNA, 25 bp, Rattus norvegicus
agtgccttctggaagcttgtaactg

SEQ ID NO: 161632 - DNA, 25 bp, Rattus norvegicus
agtgccttctggtagcttgtaactg

SEQ ID NO: 161633 - DNA, 25 bp, Rattus norvegicus
agtgccttgactagtgtgttccttt

SEQ ID NO: 161634 - DNA, 25 bp, Rattus norvegicus
agtgccttgactcttatttgctagc

SEQ ID NO: 161635 - DNA, 25 bp, Rattus norvegicus
agtgccttgactgttatttgctagc

SEQ ID NO: 161636 - DNA, 25 bp, Rattus norvegicus
agtgccttgacttgtgtgttccttt

SEQ ID NO: 161637 - DNA, 25 bp, Rattus norvegicus
agtgccttgtgaattctgctctcag

SEQ ID NO: 161638 - DNA, 25 bp, Rattus norvegicus
agtgccttgtgatttctgctctcag

SEQ ID NO: 161639 - DNA, 25 bp, Rattus norvegicus
agtgcctttaaactgtggtccttag

SEQ ID NO: 161640 - DNA, 25 bp, Rattus norvegicus
agtgcctttaaagtgtggtccttag

SEQ ID NO: 161641 - DNA, 25 bp, Rattus norvegicus
agtgcctttactatcagacctggat

SEQ ID NO: 161642 - DNA, 25 bp, Rattus norvegicus
agtgcctttactttcagacctggat

SEQ ID NO: 161643 - DNA, 25 bp, Rattus norvegicus
agtgcctttcctctgaggcttggat

SEQ ID NO: 161644 - DNA, 25 bp, Rattus norvegicus
agtgcctttcctgtgaggcttggat

SEQ ID NO: 161645 - DNA, 25 bp, Rattus norvegicus
agtgcctttctcaaaatttgtccaa

SEQ ID NO: 161646 - DNA, 25 bp, Rattus norvegicus
agtgcctttctccagtagctgataa

SEQ ID NO: 161647 - DNA, 25 bp, Rattus norvegicus
agtgcctttctcgagtagctgataa

SEQ ID NO: 161648 - DNA, 25 bp, Rattus norvegicus
agtgcctttctctaaatttgtccaa

SEQ ID NO: 161649 - DNA, 25 bp, Rattus norvegicus
agtgccttttatactcatacagtaa

SEQ ID NO: 161650 - DNA, 25 bp, Rattus norvegicus
agtgccttttattctcatacagtaa

SEQ ID NO: 161651 - DNA, 25 bp, Rattus norvegicus
agtgccttttggacagtagactgtt

SEQ ID NO: 161652 - DNA, 25 bp, Rattus norvegicus
agtgccttttggtcagtagactgtt

SEQ ID NO: 161653 - DNA, 25 bp, Rattus norvegicus
agtgccttttttcggagctttgtct

SEQ ID NO: 161654 - DNA, 25 bp, Rattus norvegicus
agtgccttttttgggagctttgtct

SEQ ID NO: 161655 - DNA, 25 bp, Rattus norvegicus
agtgcgaacagtagtgctcctgggc

SEQ ID NO: 161656 - DNA, 25 bp, Rattus norvegicus
agtgcgaacagttgtgctcctgggc

SEQ ID NO: 161657 - DNA, 25 bp, Rattus norvegicus
agtgcgaattgtatgccagctctga

SEQ ID NO: 161658 - DNA, 25 bp, Rattus norvegicus
agtgcgaattgtttgccagctctga

SEQ ID NO: 161659 - DNA, 25 bp, Rattus norvegicus
agtgcgacacctcggttactctgct

SEQ ID NO: 161660 - DNA, 25 bp, Rattus norvegicus
agtgcgacacctgggttactctgct

SEQ ID NO: 161661 - DNA, 25 bp, Rattus norvegicus
agtgcgacactgaggaagtgagctt

SEQ ID NO: 161662 - DNA, 25 bp, Rattus norvegicus
agtgcgacactgtggaagtgagctt

SEQ ID NO: 161663 - DNA, 25 bp, Rattus norvegicus
agtgcgacatcgacatcaggaagga

SEQ ID NO: 161664 - DNA, 25 bp, Rattus norvegicus
agtgcgacatcgtcatcaggaagga

SEQ ID NO: 161665 - DNA, 25 bp, Rattus norvegicus
agtgcgacatgtctataaccccagc

SEQ ID NO: 161666 - DNA, 25 bp, Rattus norvegicus
agtgcgacatgtgtataaccccagc

SEQ ID NO: 161667 - DNA, 25 bp, Rattus norvegicus
agtgcgaccccgagaatcatgccaa

SEQ ID NO: 161668 - DNA, 25 bp, Rattus norvegicus
agtgcgaccccgtgaatcatgccaa

SEQ ID NO: 161669 - DNA, 25 bp, Rattus norvegicus
agtgcgaccgatattcccaggagga

SEQ ID NO: 161670 - DNA, 25 bp, Rattus norvegicus
agtgcgaccgattttcccaggagga

SEQ ID NO: 161671 - DNA, 25 bp, Rattus norvegicus
agtgcgacctcccatagtcaagcag

SEQ ID NO: 161672 - DNA, 25 bp, Rattus norvegicus
agtgcgacctccgatagtcaagcag

SEQ ID NO: 161673 - DNA, 25 bp, Rattus norvegicus
agtgcgaggtacagctgatctcctt

SEQ ID NO: 161674 - DNA, 25 bp, Rattus norvegicus
agtgcgaggtactgctgatctcctt

SEQ ID NO: 161675 - DNA, 25 bp, Rattus norvegicus
agtgcgatcccgaggagatcatcgt

SEQ ID NO: 161676 - DNA, 25 bp, Rattus norvegicus
agtgcgatcccgtggagatcatcgt

SEQ ID NO: 161677 - DNA, 25 bp, Rattus norvegicus
agtgcgatgtgtctgggatcaccac

SEQ ID NO: 161678 - DNA, 25 bp, Rattus norvegicus
agtgcgatgtgtgtgggatcaccac

SEQ ID NO: 161679 - DNA, 25 bp, Rattus norvegicus
agtgcgatgttgatttgtgctattt

SEQ ID NO: 161680 - DNA, 25 bp, Rattus norvegicus
agtgcgatgttgttttgtgctattt

SEQ ID NO: 161681 - DNA, 25 bp, Rattus norvegicus
agtgcgattcttactgtagtgacca

SEQ ID NO: 161682 - DNA, 25 bp, Rattus norvegicus
agtgcgattctttctgtagtgacca

SEQ ID NO: 161683 - DNA, 25 bp, Rattus norvegicus
agtgcgcagccaactccagtagaga

SEQ ID NO: 161684 - DNA, 25 bp, Rattus norvegicus
agtgcgcagccatctccagtagaga

SEQ ID NO: 161685 - DNA, 25 bp, Rattus norvegicus
agtgcgcagccgacgaccgggagga

SEQ ID NO: 161686 - DNA, 25 bp, Rattus norvegicus
agtgcgcagccgtcgaccgggagga

SEQ ID NO: 161687 - DNA, 25 bp, Rattus norvegicus
agtgcgcatgcgacgatatcacacg

SEQ ID NO: 161688 - DNA, 25 bp, Rattus norvegicus
agtgcgcatgcgtcgatatcacacg

SEQ ID NO: 161689 - DNA, 25 bp, Rattus norvegicus
agtgcgccgcaactgggaattctaa

SEQ ID NO: 161690 - DNA, 25 bp, Rattus norvegicus
agtgcgccgcaagtgggaattctaa

SEQ ID NO: 161691 - DNA, 25 bp, Rattus norvegicus
agtgcgcgactgagagtttctcagc

SEQ ID NO: 161692 - DNA, 25 bp, Rattus norvegicus
agtgcgcgactgtgagtttctcagc

SEQ ID NO: 161693 - DNA, 25 bp, Rattus norvegicus
agtgcgcgatgccgggatcaaagtc

SEQ ID NO: 161694 - DNA, 25 bp, Rattus norvegicus
agtgcgcgatgcggggatcaaagtc

SEQ ID NO: 161695 - DNA, 25 bp, Rattus norvegicus
agtgcgctactcaggcgttggagaa

SEQ ID NO: 161696 - DNA, 25 bp, Rattus norvegicus
agtgcgctactctggcgttggagaa

SEQ ID NO: 161697 - DNA, 25 bp, Rattus norvegicus
agtgcgctcaacactctgatgacaa

SEQ ID NO: 161698 - DNA, 25 bp, Rattus norvegicus
agtgcgctcaactctctgatgacaa

SEQ ID NO: 161699 - DNA, 25 bp, Rattus norvegicus
agtgcgctcctgaggcggatagccc

SEQ ID NO: 161700 - DNA, 25 bp, Rattus norvegicus
agtgcgctcctgtggcggatagccc

SEQ ID NO: 161701 - DNA, 25 bp, Rattus norvegicus
agtgcgctgacgacctgtgacagtg

SEQ ID NO: 161702 - DNA, 25 bp, Rattus norvegicus
agtgcgctgacgtcctgtgacagtg

SEQ ID NO: 161703 - DNA, 25 bp, Rattus norvegicus
agtgcgctgctgatgctgaagcgaa

SEQ ID NO: 161704 - DNA, 25 bp, Rattus norvegicus
agtgcgctgctgctgttttattaac

SEQ ID NO: 161705 - DNA, 25 bp, Rattus norvegicus
agtgcgctgctggtgttttattaac

SEQ ID NO: 161706 - DNA, 25 bp, Rattus norvegicus
agtgcgctgctgttgctgaagcgaa

SEQ ID NO: 161707 - DNA, 25 bp, Rattus norvegicus
agtgcgcttagcagggtcataacga

SEQ ID NO: 161708 - DNA, 25 bp, Rattus norvegicus
agtgcgcttagctgggtcataacga

SEQ ID NO: 161709 - DNA, 25 bp, Rattus norvegicus
agtgcgcttccacttgtcagagcaa

SEQ ID NO: 161710 - DNA, 25 bp, Rattus norvegicus
agtgcgcttccagttgtcagagcaa

SEQ ID NO: 161711 - DNA, 25 bp, Rattus norvegicus
agtgcggaacccctccgaggccagt

SEQ ID NO: 161712 - DNA, 25 bp, Rattus norvegicus
agtgcggaacccgtccgaggccagt

SEQ ID NO: 161713 - DNA, 25 bp, Rattus norvegicus
agtgcggacactaggatcagattca

SEQ ID NO: 161714 - DNA, 25 bp, Rattus norvegicus
agtgcggacacttggatcagattca

SEQ ID NO: 161715 - DNA, 25 bp, Rattus norvegicus
agtgcggagtagcaactgctcagtc

SEQ ID NO: 161716 - DNA, 25 bp, Rattus norvegicus
agtgcggagtaggaactgctcagtc

SEQ ID NO: 161717 - DNA, 25 bp, Rattus norvegicus
agtgcggcaaagagttcaggcgaaa

SEQ ID NO: 161718 - DNA, 25 bp, Rattus norvegicus
agtgcggcaaagtgttcaggcgaaa

SEQ ID NO: 161719 - DNA, 25 bp, Rattus norvegicus
agtgcggcagcaccagcttataact

SEQ ID NO: 161720 - DNA, 25 bp, Rattus norvegicus
agtgcggcagcagcagcttataact

SEQ ID NO: 161721 - DNA, 25 bp, Rattus norvegicus
agtgcggctgttactaggttgacca

SEQ ID NO: 161722 - DNA, 25 bp, Rattus norvegicus
agtgcggctgtttctaggttgacca

SEQ ID NO: 161723 - DNA, 25 bp, Rattus norvegicus
agtgcgggcattctgttatttcctc

SEQ ID NO: 161724 - DNA, 25 bp, Rattus norvegicus
agtgcgggcattgtgttatttcctc

SEQ ID NO: 161725 - DNA, 25 bp, Rattus norvegicus
agtgcggtgattcttactctccctg

SEQ ID NO: 161726 - DNA, 25 bp, Rattus norvegicus
agtgcggtgattgttactctccctg

SEQ ID NO: 161727 - DNA, 25 bp, Rattus norvegicus
agtgcggtgcgcacatttgtggttt

SEQ ID NO: 161728 - DNA, 25 bp, Rattus norvegicus
agtgcggtgcgctcatttgtggttt

SEQ ID NO: 161729 - DNA, 25 bp, Rattus norvegicus
agtgcggttcctctactgactggct

SEQ ID NO: 161730 - DNA, 25 bp, Rattus norvegicus
agtgcggttcctgtactgactggct

SEQ ID NO: 161731 - DNA, 25 bp, Rattus norvegicus
agtgcggtttgcaaattcctctcaa

SEQ ID NO: 161732 - DNA, 25 bp, Rattus norvegicus
agtgcggtttgctaattcctctcaa

SEQ ID NO: 161733 - DNA, 25 bp, Rattus norvegicus
agtgcgtatgtcatgaacctccaga

SEQ ID NO: 161734 - DNA, 25 bp, Rattus norvegicus
agtgcgtatgtcttgaacctccaga

SEQ ID NO: 161735 - DNA, 25 bp, Rattus norvegicus
agtgcgtcctgtctactaccagtaa

SEQ ID NO: 161736 - DNA, 25 bp, Rattus norvegicus
agtgcgtcctgtgtactaccagtaa

SEQ ID NO: 161737 - DNA, 25 bp, Rattus norvegicus
agtgcgtctgatataatcctgccca

SEQ ID NO: 161738 - DNA, 25 bp, Rattus norvegicus
agtgcgtctgatttaatcctgccca

SEQ ID NO: 161739 - DNA, 25 bp, Rattus norvegicus
agtgcgtcttgtcgagcgtgccctg

SEQ ID NO: 161740 - DNA, 25 bp, Rattus norvegicus
agtgcgtcttgtggagcgtgccctg

SEQ ID NO: 161741 - DNA, 25 bp, Rattus norvegicus
agtgcgtgagcaacaagcccctgac

SEQ ID NO: 161742 - DNA, 25 bp, Rattus norvegicus
agtgcgtgagcatcaagcccctgac

SEQ ID NO: 161743 - DNA, 25 bp, Rattus norvegicus
agtgcgtgagcgacagcagcatctt

SEQ ID NO: 161744 - DNA, 25 bp, Rattus norvegicus
agtgcgtgagcgtcagcagcatctt

SEQ ID NO: 161745 - DNA, 25 bp, Rattus norvegicus
agtgcgtggatcatttgagcctgga

SEQ ID NO: 161746 - DNA, 25 bp, Rattus norvegicus
agtgcgtggatcttttgagcctgga

SEQ ID NO: 161747 - DNA, 25 bp, Rattus norvegicus
agtgcgtgggtgcagactttcttaa

SEQ ID NO: 161748 - DNA, 25 bp, Rattus norvegicus
agtgcgtgggtggagactttcttaa

SEQ ID NO: 161749 - DNA, 25 bp, Rattus norvegicus
agtgcgttatttctgttattgctga

SEQ ID NO: 161750 - DNA, 25 bp, Rattus norvegicus
agtgcgttatttgtgttattgctga

SEQ ID NO: 161751 - DNA, 25 bp, Rattus norvegicus
agtgcgttcctccttgatgatggga

SEQ ID NO: 161752 - DNA, 25 bp, Rattus norvegicus
agtgcgttcctcgttgatgatggga

SEQ ID NO: 161753 - DNA, 25 bp, Rattus norvegicus
agtgcgttctgtcatcgccaagttc

SEQ ID NO: 161754 - DNA, 25 bp, Rattus norvegicus
agtgcgttctgtgatcgccaagttc

SEQ ID NO: 161755 - DNA, 25 bp, Rattus norvegicus
agtgcgttgctaaatctccctggga

SEQ ID NO: 161756 - DNA, 25 bp, Rattus norvegicus
agtgcgttgctatatctccctggga

SEQ ID NO: 161757 - DNA, 25 bp, Rattus norvegicus
agtgcgttggcaagcagtggctcca

SEQ ID NO: 161758 - DNA, 25 bp, Rattus norvegicus
agtgcgttggcatgcagtggctcca

SEQ ID NO: 161759 - DNA, 25 bp, Rattus norvegicus
agtgcgttgttcagggcatccagat

SEQ ID NO: 161760 - DNA, 25 bp, Rattus norvegicus
agtgcgttgttctgggcatccagat

SEQ ID NO: 161761 - DNA, 25 bp, Rattus norvegicus
agtgcgtttatacagattgctagaa

SEQ ID NO: 161762 - DNA, 25 bp, Rattus norvegicus
agtgcgtttatagagattgctagaa

SEQ ID NO: 161763 - DNA, 25 bp, Rattus norvegicus
agtgcgttttccactgttctttacg

SEQ ID NO: 161764 - DNA, 25 bp, Rattus norvegicus
agtgcgttttcctctgttctttacg

SEQ ID NO: 161765 - DNA, 25 bp, Rattus norvegicus
agtgctaaatttactccaacacatt

SEQ ID NO: 161766 - DNA, 25 bp, Rattus norvegicus
agtgctaaattttctccaacacatt

SEQ ID NO: 161767 - DNA, 25 bp, Rattus norvegicus
agtgctaacatcaggcaagggccta

SEQ ID NO: 161768 - DNA, 25 bp, Rattus norvegicus
agtgctaacatctggcaagggccta

SEQ ID NO: 161769 - DNA, 25 bp, Rattus norvegicus
agtgctaaccaactgagggctgctt

SEQ ID NO: 161770 - DNA, 25 bp, Rattus norvegicus
agtgctaaccaagtgagggctgctt

SEQ ID NO: 161771 - DNA, 25 bp, Rattus norvegicus
agtgctaacccacacgagcagtgaa

SEQ ID NO: 161772 - DNA, 25 bp, Rattus norvegicus
agtgctaacccagacgagcagtgaa

SEQ ID NO: 161773 - DNA, 25 bp, Rattus norvegicus
agtgctaacgcaaatctacctcagg

SEQ ID NO: 161774 - DNA, 25 bp, Rattus norvegicus
agtgctaacgcatatctacctcagg

SEQ ID NO: 161775 - DNA, 25 bp, Rattus norvegicus
agtgctaacgctcggtttccacagt

SEQ ID NO: 161776 - DNA, 25 bp, Rattus norvegicus
agtgctaacgctgggtttccacagt

SEQ ID NO: 161777 - DNA, 25 bp, Rattus norvegicus
agtgctaacggtagagcaggacctt

SEQ ID NO: 161778 - DNA, 25 bp, Rattus norvegicus
agtgctaacggttgagcaggacctt

SEQ ID NO: 161779 - DNA, 25 bp, Rattus norvegicus
agtgctaataccatcgctcccactg

SEQ ID NO: 161780 - DNA, 25 bp, Rattus norvegicus
agtgctaataccttcgctcccactg

SEQ ID NO: 161781 - DNA, 25 bp, Rattus norvegicus
agtgctaatgctcggatctttcacc

SEQ ID NO: 161782 - DNA, 25 bp, Rattus norvegicus
agtgctaatgctgggatctttcacc

SEQ ID NO: 161783 - DNA, 25 bp, Rattus norvegicus
agtgctacattcatgccagtggtga

SEQ ID NO: 161784 - DNA, 25 bp, Rattus norvegicus
agtgctacattcttgccagtggtga

SEQ ID NO: 161785 - DNA, 25 bp, Rattus norvegicus
agtgctaccacgagctcaagtttag

SEQ ID NO: 161786 - DNA, 25 bp, Rattus norvegicus
agtgctaccacgtgctcaagtttag

SEQ ID NO: 161787 - DNA, 25 bp, Rattus norvegicus
agtgctaccaggactgtaagccgct

SEQ ID NO: 161788 - DNA, 25 bp, Rattus norvegicus
agtgctaccaggtctgtaagccgct

SEQ ID NO: 161789 - DNA, 25 bp, Rattus norvegicus
agtgctacccatctgagtgtgtgaa

SEQ ID NO: 161790 - DNA, 25 bp, Rattus norvegicus
agtgctacccatgtgagtgtgtgaa

SEQ ID NO: 161791 - DNA, 25 bp, Rattus norvegicus
agtgctacgcctctgttggtagttc

SEQ ID NO: 161792 - DNA, 25 bp, Rattus norvegicus
agtgctacgcctgtgttggtagttc

SEQ ID NO: 161793 - DNA, 25 bp, Rattus norvegicus
agtgctacgggtaccacagacatca

SEQ ID NO: 161794 - DNA, 25 bp, Rattus norvegicus
agtgctacgggttccacagacatca

SEQ ID NO: 161795 - DNA, 25 bp, Rattus norvegicus
agtgctactattatggtgagggctc

SEQ ID NO: 161796 - DNA, 25 bp, Rattus norvegicus
agtgctactattttggtgagggctc

SEQ ID NO: 161797 - DNA, 25 bp, Rattus norvegicus
agtgctactctgcttttaaccatgt

SEQ ID NO: 161798 - DNA, 25 bp, Rattus norvegicus
agtgctactctggttttaaccatgt

SEQ ID NO: 161799 - DNA, 25 bp, Rattus norvegicus
agtgctactgctactgtggaggccc

SEQ ID NO: 161800 - DNA, 25 bp, Rattus norvegicus
agtgctactgcttctgtggaggccc

SEQ ID NO: 161801 - DNA, 25 bp, Rattus norvegicus
agtgctactgtgatccatggcaggg

SEQ ID NO: 161802 - DNA, 25 bp, Rattus norvegicus
agtgctactgtgttccatggcaggg

SEQ ID NO: 161803 - DNA, 25 bp, Rattus norvegicus
agtgctacttggaatgctctgccct

SEQ ID NO: 161804 - DNA, 25 bp, Rattus norvegicus
agtgctacttggtatgctctgccct

SEQ ID NO: 161805 - DNA, 25 bp, Rattus norvegicus
agtgctagaactcaaacctccagaa

SEQ ID NO: 161806 - DNA, 25 bp, Rattus norvegicus
agtgctagaactgaaacctccagaa

SEQ ID NO: 161807 - DNA, 25 bp, Rattus norvegicus
agtgctagaggcatggttgttcccc

SEQ ID NO: 161808 - DNA, 25 bp, Rattus norvegicus
agtgctagaggcttggttgttcccc

SEQ ID NO: 161809 - DNA, 25 bp, Rattus norvegicus
agtgctagatctcaacagccacaag

SEQ ID NO: 161810 - DNA, 25 bp, Rattus norvegicus
agtgctagatctgaacagccacaag

SEQ ID NO: 161811 - DNA, 25 bp, Rattus norvegicus
agtgctagcaccacagttgtgacga

SEQ ID NO: 161812 - DNA, 25 bp, Rattus norvegicus
agtgctagcacctcagttgtgacga

SEQ ID NO: 161813 - DNA, 25 bp, Rattus norvegicus
agtgctagtcctcagtctgacctat

SEQ ID NO: 161814 - DNA, 25 bp, Rattus norvegicus
agtgctagtcctgagtctgacctat

SEQ ID NO: 161815 - DNA, 25 bp, Rattus norvegicus
agtgctatacaccaatgttctcatt

SEQ ID NO: 161816 - DNA, 25 bp, Rattus norvegicus
agtgctatacacgaatgttctcatt

SEQ ID NO: 161817 - DNA, 25 bp, Rattus norvegicus
agtgctatcctaatggtgtttccct

SEQ ID NO: 161818 - DNA, 25 bp, Rattus norvegicus
agtgctatcctattggtgtttccct

SEQ ID NO: 161819 - DNA, 25 bp, Rattus norvegicus
agtgctatctgtactgtctgcagag

SEQ ID NO: 161820 - DNA, 25 bp, Rattus norvegicus
agtgctatctgttctgtctgcagag

SEQ ID NO: 161821 - DNA, 25 bp, Rattus norvegicus
agtgctattatcagtgtcttttgta

SEQ ID NO: 161822 - DNA, 25 bp, Rattus norvegicus
agtgctattatctgtgtcttttgta

SEQ ID NO: 161823 - DNA, 25 bp, Rattus norvegicus
agtgctattcagacagaagttgcca

SEQ ID NO: 161824 - DNA, 25 bp, Rattus norvegicus
agtgctattcagtcagaagttgcca

SEQ ID NO: 161825 - DNA, 25 bp, Rattus norvegicus
agtgctattgctcatgggtatcctc

SEQ ID NO: 161826 - DNA, 25 bp, Rattus norvegicus
agtgctattgctgatgggtatcctc

SEQ ID NO: 161827 - DNA, 25 bp, Rattus norvegicus
agtgctatttgaagtacctgtaaca

SEQ ID NO: 161828 - DNA, 25 bp, Rattus norvegicus
agtgctatttgatgtacctgtaaca

SEQ ID NO: 161829 - DNA, 25 bp, Rattus norvegicus
agtgctcaaagacgccgtcccggtt

SEQ ID NO: 161830 - DNA, 25 bp, Rattus norvegicus
agtgctcaaagaggccgtcccggtt

SEQ ID NO: 161831 - DNA, 25 bp, Rattus norvegicus
agtgctcaaagcatccaacatcgaa

SEQ ID NO: 161832 - DNA, 25 bp, Rattus norvegicus
agtgctcaaagcttccaacatcgaa

SEQ ID NO: 161833 - DNA, 25 bp, Rattus norvegicus
agtgctcaactgatactgtcattca

SEQ ID NO: 161834 - DNA, 25 bp, Rattus norvegicus
agtgctcaactgttactgtcattca

SEQ ID NO: 161835 - DNA, 25 bp, Rattus norvegicus
agtgctcacacacacctgagtatgg

SEQ ID NO: 161836 - DNA, 25 bp, Rattus norvegicus
agtgctcacacagacctgagtatgg

SEQ ID NO: 161837 - DNA, 25 bp, Rattus norvegicus
agtgctcacatgctcttctgaagaa

SEQ ID NO: 161838 - DNA, 25 bp, Rattus norvegicus
agtgctcacatggtcttctgaagaa

SEQ ID NO: 161839 - DNA, 25 bp, Rattus norvegicus
agtgctcaccgaagctgtgacagtg

SEQ ID NO: 161840 - DNA, 25 bp, Rattus norvegicus
agtgctcaccgatgctgtgacagtg

SEQ ID NO: 161841 - DNA, 25 bp, Rattus norvegicus
agtgctcacgcaacaagctagtctg

SEQ ID NO: 161842 - DNA, 25 bp, Rattus norvegicus
agtgctcacgcatcaagctagtctg

SEQ ID NO: 161843 - DNA, 25 bp, Rattus norvegicus
agtgctcactgtagggacaacccac

SEQ ID NO: 161844 - DNA, 25 bp, Rattus norvegicus
agtgctcactgttgggacaacccac

SEQ ID NO: 161845 - DNA, 25 bp, Rattus norvegicus
agtgctcaggagcacgtcatgctct

SEQ ID NO: 161846 - DNA, 25 bp, Rattus norvegicus
agtgctcaggaggacgtcatgctct

SEQ ID NO: 161847 - DNA, 25 bp, Rattus norvegicus
agtgctcataggatccacgcacatt

SEQ ID NO: 161848 - DNA, 25 bp, Rattus norvegicus
agtgctcataggttccacgcacatt

SEQ ID NO: 161849 - DNA, 25 bp, Rattus norvegicus
agtgctcatctgactgctggagtac

SEQ ID NO: 161850 - DNA, 25 bp, Rattus norvegicus
agtgctcatctgtctgctggagtac

SEQ ID NO: 161851 - DNA, 25 bp, Rattus norvegicus
agtgctcatcttcttctgaattcag

SEQ ID NO: 161852 - DNA, 25 bp, Rattus norvegicus
agtgctcatcttgttctgaattcag

SEQ ID NO: 161853 - DNA, 25 bp, Rattus norvegicus
agtgctcatggacctcaaagccttg

SEQ ID NO: 161854 - DNA, 25 bp, Rattus norvegicus
agtgctcatggagctcaaagccttg

SEQ ID NO: 161855 - DNA, 25 bp, Rattus norvegicus
agtgctcatgggaagtggcctccac

SEQ ID NO: 161856 - DNA, 25 bp, Rattus norvegicus
agtgctcatgggtagtggcctccac

SEQ ID NO: 161857 - DNA, 25 bp, Rattus norvegicus
agtgctcattttagtggtttcccca

SEQ ID NO: 161858 - DNA, 25 bp, Rattus norvegicus
agtgctcatttttgtggtttcccca

SEQ ID NO: 161859 - DNA, 25 bp, Rattus norvegicus
agtgctccaaatatcactctatcca

SEQ ID NO: 161860 - DNA, 25 bp, Rattus norvegicus
agtgctccaaatttcactctatcca

SEQ ID NO: 161861 - DNA, 25 bp, Rattus norvegicus
agtgctccaaggaaggcatccctag

SEQ ID NO: 161862 - DNA, 25 bp, Rattus norvegicus
agtgctccaaggtaggcatccctag

SEQ ID NO: 161863 - DNA, 25 bp, Rattus norvegicus
agtgctccatttatatccctgagtt

SEQ ID NO: 161864 - DNA, 25 bp, Rattus norvegicus
agtgctccatttttatccctgagtt

SEQ ID NO: 161865 - DNA, 25 bp, Rattus norvegicus
agtgctccccgtagtcaacgacaag

SEQ ID NO: 161866 - DNA, 25 bp, Rattus norvegicus
agtgctccccgttgtcaacgacaag

SEQ ID NO: 161867 - DNA, 25 bp, Rattus norvegicus
agtgctccgagaactgaggcaacca

SEQ ID NO: 161868 - DNA, 25 bp, Rattus norvegicus
agtgctccgagatctgaggcaacca

SEQ ID NO: 161869 - DNA, 25 bp, Rattus norvegicus
agtgctccgcctagagttttatacc

SEQ ID NO: 161870 - DNA, 25 bp, Rattus norvegicus
agtgctccgccttgagttttatacc

SEQ ID NO: 161871 - DNA, 25 bp, Rattus norvegicus
agtgctccgtgcagtatgcgtgtgc

SEQ ID NO: 161872 - DNA, 25 bp, Rattus norvegicus
agtgctccgtgctgtatgcgtgtgc

SEQ ID NO: 161873 - DNA, 25 bp, Rattus norvegicus
agtgctcctccgagtgtgtttgaaa

SEQ ID NO: 161874 - DNA, 25 bp, Rattus norvegicus
agtgctcctccgtgtgtgtttgaaa

SEQ ID NO: 161875 - DNA, 25 bp, Rattus norvegicus
agtgctcctgttaccccagatatag

SEQ ID NO: 161876 - DNA, 25 bp, Rattus norvegicus
agtgctcctgtttccccagatatag

SEQ ID NO: 161877 - DNA, 25 bp, Rattus norvegicus
agtgctcgagagactgccatacata

SEQ ID NO: 161878 - DNA, 25 bp, Rattus norvegicus
agtgctcgagagtctgccatacata

SEQ ID NO: 161879 - DNA, 25 bp, Rattus norvegicus
agtgctcgagcacagatccaccttc

SEQ ID NO: 161880 - DNA, 25 bp, Rattus norvegicus
agtgctcgagcagagatccaccttc

SEQ ID NO: 161881 - DNA, 25 bp, Rattus norvegicus
agtgctcgaggtcccctgtgaaaaa

SEQ ID NO: 161882 - DNA, 25 bp, Rattus norvegicus
agtgctcgaggtgccctgtgaaaaa

SEQ ID NO: 161883 - DNA, 25 bp, Rattus norvegicus
agtgctcgagtgcatgcgcctgtcc

SEQ ID NO: 161884 - DNA, 25 bp, Rattus norvegicus
agtgctcgagtggatgcgcctgtcc

SEQ ID NO: 161885 - DNA, 25 bp, Rattus norvegicus
agtgctcgccgcagtactggtcgag

SEQ ID NO: 161886 - DNA, 25 bp, Rattus norvegicus
agtgctcgccgctgtactggtcgag

SEQ ID NO: 161887 - DNA, 25 bp, Rattus norvegicus
agtgctcggcgtaaattctgtggga

SEQ ID NO: 161888 - DNA, 25 bp, Rattus norvegicus
agtgctcggcgttaattctgtggga

SEQ ID NO: 161889 - DNA, 25 bp, Rattus norvegicus
agtgctctaaaaatactcggtattt

SEQ ID NO: 161890 - DNA, 25 bp, Rattus norvegicus
agtgctctaaaattactcggtattt

SEQ ID NO: 161891 - DNA, 25 bp, Rattus norvegicus
agtgctctaagcatggctccctgga

SEQ ID NO: 161892 - DNA, 25 bp, Rattus norvegicus
agtgctctaagccattgaattaaaa

SEQ ID NO: 161893 - DNA, 25 bp, Rattus norvegicus
agtgctctaagcgattgaattaaaa

SEQ ID NO: 161894 - DNA, 25 bp, Rattus norvegicus
agtgctctaagcttggctccctgga

SEQ ID NO: 161895 - DNA, 25 bp, Rattus norvegicus
agtgctctcactccctgtgtaggct

SEQ ID NO: 161896 - DNA, 25 bp, Rattus norvegicus
agtgctctcactccttccatatgca

SEQ ID NO: 161897 - DNA, 25 bp, Rattus norvegicus
agtgctctcactgcctgtgtaggct

SEQ ID NO: 161898 - DNA, 25 bp, Rattus norvegicus
agtgctctcactgcttccatatgca

SEQ ID NO: 161899 - DNA, 25 bp, Rattus norvegicus
agtgctctctgtctactctatctag

SEQ ID NO: 161900 - DNA, 25 bp, Rattus norvegicus
agtgctctctgtgtactctatctag

SEQ ID NO: 161901 - DNA, 25 bp, Rattus norvegicus
agtgctctgcatatctttaaagaca

SEQ ID NO: 161902 - DNA, 25 bp, Rattus norvegicus
agtgctctgcatttctttaaagaca

SEQ ID NO: 161903 - DNA, 25 bp, Rattus norvegicus
agtgctctgccgatgagttacacca

SEQ ID NO: 161904 - DNA, 25 bp, Rattus norvegicus
agtgctctgccgttgagttacacca

SEQ ID NO: 161905 - DNA, 25 bp, Rattus norvegicus
agtgctctggaacctaattccttat

SEQ ID NO: 161906 - DNA, 25 bp, Rattus norvegicus
agtgctctggaagctaattccttat

SEQ ID NO: 161907 - DNA, 25 bp, Rattus norvegicus
agtgctctggctaatggcaaatgac

SEQ ID NO: 161908 - DNA, 25 bp, Rattus norvegicus
agtgctctggctattagcttcccat

SEQ ID NO: 161909 - DNA, 25 bp, Rattus norvegicus
agtgctctggcttatggcaaatgac

SEQ ID NO: 161910 - DNA, 25 bp, Rattus norvegicus
agtgctctggcttttagcttcccat

SEQ ID NO: 161911 - DNA, 25 bp, Rattus norvegicus
agtgctctgggaagccaccgtgaaa

SEQ ID NO: 161912 - DNA, 25 bp, Rattus norvegicus
agtgctctgggatgccaccgtgaaa

SEQ ID NO: 161913 - DNA, 25 bp, Rattus norvegicus
agtgctctgggcaaggtggctacta

SEQ ID NO: 161914 - DNA, 25 bp, Rattus norvegicus
agtgctctgggctaggtggctacta

SEQ ID NO: 161915 - DNA, 25 bp, Rattus norvegicus
agtgctctgtcacggtctgtggtcc

SEQ ID NO: 161916 - DNA, 25 bp, Rattus norvegicus
agtgctctgtcagggtctgtggtcc

SEQ ID NO: 161917 - DNA, 25 bp, Rattus norvegicus
agtgctctgttgacatagctgatgt

SEQ ID NO: 161918 - DNA, 25 bp, Rattus norvegicus
agtgctctgttgtcatagctgatgt

SEQ ID NO: 161919 - DNA, 25 bp, Rattus norvegicus
agtgctcttaagagccgagccattt

SEQ ID NO: 161920 - DNA, 25 bp, Rattus norvegicus
agtgctcttaagtgccgagccattt

SEQ ID NO: 161921 - DNA, 25 bp, Rattus norvegicus
agtgctcttcgtccagaagcatggc

SEQ ID NO: 161922 - DNA, 25 bp, Rattus norvegicus
agtgctcttcgtgcagaagcatggc

SEQ ID NO: 161923 - DNA, 25 bp, Rattus norvegicus
agtgctcttgaaaggtctgtattaa

SEQ ID NO: 161924 - DNA, 25 bp, Rattus norvegicus
agtgctcttgaatggtctgtattaa

SEQ ID NO: 161925 - DNA, 25 bp, Rattus norvegicus
agtgctcttgacagttcagccttct

SEQ ID NO: 161926 - DNA, 25 bp, Rattus norvegicus
agtgctcttgactgttcagccttct

SEQ ID NO: 161927 - DNA, 25 bp, Rattus norvegicus
agtgctcttgtaattcggtaccctt

SEQ ID NO: 161928 - DNA, 25 bp, Rattus norvegicus
agtgctcttgtatttcggtaccctt

SEQ ID NO: 161929 - DNA, 25 bp, Rattus norvegicus
agtgctcttgtgaaaggtggtccct

SEQ ID NO: 161930 - DNA, 25 bp, Rattus norvegicus
agtgctcttgtgtaaggtggtccct

SEQ ID NO: 161931 - DNA, 25 bp, Rattus norvegicus
agtgctcttttacgcatgctctgag

SEQ ID NO: 161932 - DNA, 25 bp, Rattus norvegicus
agtgctcttttaggcatgctctgag

SEQ ID NO: 161933 - DNA, 25 bp, Rattus norvegicus
agtgctgaacgtattgggcctttgc

SEQ ID NO: 161934 - DNA, 25 bp, Rattus norvegicus
agtgctgaacgttttgggcctttgc

SEQ ID NO: 161935 - DNA, 25 bp, Rattus norvegicus
agtgctgaaggtcctcttgagtgct

SEQ ID NO: 161936 - DNA, 25 bp, Rattus norvegicus
agtgctgaaggtgctcttgagtgct

SEQ ID NO: 161937 - DNA, 25 bp, Rattus norvegicus
agtgctgaagttcctattaaaaaca

SEQ ID NO: 161938 - DNA, 25 bp, Rattus norvegicus
agtgctgaagttgctattaaaaaca

SEQ ID NO: 161939 - DNA, 25 bp, Rattus norvegicus
agtgctgaccaaaaaagcttctgtg

SEQ ID NO: 161940 - DNA, 25 bp, Rattus norvegicus
agtgctgaccaataaagcttctgtg

SEQ ID NO: 161941 - DNA, 25 bp, Rattus norvegicus
agtgctgaccagctgttctactgag

SEQ ID NO: 161942 - DNA, 25 bp, Rattus norvegicus
agtgctgaccaggtgttctactgag

SEQ ID NO: 161943 - DNA, 25 bp, Rattus norvegicus
agtgctgaccatagctatgcctgtg

SEQ ID NO: 161944 - DNA, 25 bp, Rattus norvegicus
agtgctgaccattgctatgcctgtg

SEQ ID NO: 161945 - DNA, 25 bp, Rattus norvegicus
agtgctgactcacccatagcctgca

SEQ ID NO: 161946 - DNA, 25 bp, Rattus norvegicus
agtgctgactcagccatagcctgca

SEQ ID NO: 161947 - DNA, 25 bp, Rattus norvegicus
agtgctgacttgactactgttatac

SEQ ID NO: 161948 - DNA, 25 bp, Rattus norvegicus
agtgctgacttgtctactgttatac

SEQ ID NO: 161949 - DNA, 25 bp, Rattus norvegicus
agtgctgagactccctgctgatgtt

SEQ ID NO: 161950 - DNA, 25 bp, Rattus norvegicus
agtgctgagactgcctgctgatgtt

SEQ ID NO: 161951 - DNA, 25 bp, Rattus norvegicus
agtgctgagcctcccgggttccaaa

SEQ ID NO: 161952 - DNA, 25 bp, Rattus norvegicus
agtgctgagcctgccgggttccaaa

SEQ ID NO: 161953 - DNA, 25 bp, Rattus norvegicus
agtgctgaggacaacgaatacccat

SEQ ID NO: 161954 - DNA, 25 bp, Rattus norvegicus
agtgctgaggacctgtgtcacgatt

SEQ ID NO: 161955 - DNA, 25 bp, Rattus norvegicus
agtgctgaggacgtgtgtcacgatt

SEQ ID NO: 161956 - DNA, 25 bp, Rattus norvegicus
agtgctgaggactacgaatacccat

SEQ ID NO: 161957 - DNA, 25 bp, Rattus norvegicus
agtgctgagtggagtccggcataca

SEQ ID NO: 161958 - DNA, 25 bp, Rattus norvegicus
agtgctgagtggtgtccggcataca

SEQ ID NO: 161959 - DNA, 25 bp, Rattus norvegicus
agtgctgagtgtaaagtgctccctc

SEQ ID NO: 161960 - DNA, 25 bp, Rattus norvegicus
agtgctgagtgttaagtgctccctc

SEQ ID NO: 161961 - DNA, 25 bp, Rattus norvegicus
agtgctgatgacattgtggaggaca

SEQ ID NO: 161962 - DNA, 25 bp, Rattus norvegicus
agtgctgatgactttgtggaggaca

SEQ ID NO: 161963 - DNA, 25 bp, Rattus norvegicus
agtgctgatgagactggcctttgag

SEQ ID NO: 161964 - DNA, 25 bp, Rattus norvegicus
agtgctgatgagtctggcctttgag

SEQ ID NO: 161965 - DNA, 25 bp, Rattus norvegicus
agtgctgatggactttgatgccctg

SEQ ID NO: 161966 - DNA, 25 bp, Rattus norvegicus
agtgctgatggagtttgatgccctg

SEQ ID NO: 161967 - DNA, 25 bp, Rattus norvegicus
agtgctgatgttctgtacctctggc

SEQ ID NO: 161968 - DNA, 25 bp, Rattus norvegicus
agtgctgatgttgtgtacctctggc

SEQ ID NO: 161969 - DNA, 25 bp, Rattus norvegicus
agtgctgattgaagcccgtgactgc

SEQ ID NO: 161970 - DNA, 25 bp, Rattus norvegicus
agtgctgattgatgcccgtgactgc

SEQ ID NO: 161971 - DNA, 25 bp, Rattus norvegicus
agtgctgattgccatcactgcctgg

SEQ ID NO: 161972 - DNA, 25 bp, Rattus norvegicus
agtgctgattgcgatcactgcctgg

SEQ ID NO: 161973 - DNA, 25 bp, Rattus norvegicus
agtgctgattggctagttcctctat

SEQ ID NO: 161974 - DNA, 25 bp, Rattus norvegicus
agtgctgattgggtagttcctctat

SEQ ID NO: 161975 - DNA, 25 bp, Rattus norvegicus
agtgctgattgtccagtctgctctg

SEQ ID NO: 161976 - DNA, 25 bp, Rattus norvegicus
agtgctgattgtgcagtctgctctg

SEQ ID NO: 161977 - DNA, 25 bp, Rattus norvegicus
agtgctgcaattctggagtacctca

SEQ ID NO: 161978 - DNA, 25 bp, Rattus norvegicus
agtgctgcaattgtggagtacctca

SEQ ID NO: 161979 - DNA, 25 bp, Rattus norvegicus
agtgctgcacatctgtcctaggtaa

SEQ ID NO: 161980 - DNA, 25 bp, Rattus norvegicus
agtgctgcacatgtgtcctaggtaa

SEQ ID NO: 161981 - DNA, 25 bp, Rattus norvegicus
agtgctgcactgaaatctatcatat

SEQ ID NO: 161982 - DNA, 25 bp, Rattus norvegicus
agtgctgcactgtaatctatcatat

SEQ ID NO: 161983 - DNA, 25 bp, Rattus norvegicus
agtgctgcagctacttctaccacag

SEQ ID NO: 161984 - DNA, 25 bp, Rattus norvegicus
agtgctgcagcttcttctaccacag

SEQ ID NO: 161985 - DNA, 25 bp, Rattus norvegicus
agtgctgcaggacccctgagagcta

SEQ ID NO: 161986 - DNA, 25 bp, Rattus norvegicus
agtgctgcaggagccctgagagcta

SEQ ID NO: 161987 - DNA, 25 bp, Rattus norvegicus
agtgctgcatctatatgggctgctc

SEQ ID NO: 161988 - DNA, 25 bp, Rattus norvegicus
agtgctgcatctttatgggctgctc

SEQ ID NO: 161989 - DNA, 25 bp, Rattus norvegicus
agtgctgcatgacttcggtctggaa

SEQ ID NO: 161990 - DNA, 25 bp, Rattus norvegicus
agtgctgcatgagttcggtctggaa

SEQ ID NO: 161991 - DNA, 25 bp, Rattus norvegicus
agtgctgcatgtctgtgtcgcgtac

SEQ ID NO: 161992 - DNA, 25 bp, Rattus norvegicus
agtgctgcatgtgtgtgtcgcgtac

SEQ ID NO: 161993 - DNA, 25 bp, Rattus norvegicus
agtgctgccaagaccctgagggctt

SEQ ID NO: 161994 - DNA, 25 bp, Rattus norvegicus
agtgctgccaagtccctgagggctt

SEQ ID NO: 161995 - DNA, 25 bp, Rattus norvegicus
agtgctgccagaacctgtgactgcc

SEQ ID NO: 161996 - DNA, 25 bp, Rattus norvegicus
agtgctgccagatcctgtgactgcc

SEQ ID NO: 161997 - DNA, 25 bp, Rattus norvegicus
agtgctgcgagcaccagcccaggtt

SEQ ID NO: 161998 - DNA, 25 bp, Rattus norvegicus
agtgctgcgagctccagcccaggtt

SEQ ID NO: 161999 - DNA, 25 bp, Rattus norvegicus
agtgctgcgcgccaccggcaggcag

SEQ ID NO: 162000 - DNA, 25 bp, Rattus norvegicus
agtgctgcgcgcgaccggcaggcag

SEQ ID NO: 162001 - DNA, 25 bp, Rattus norvegicus
agtgctgcggtaagaggcctttatc

SEQ ID NO: 162002 - DNA, 25 bp, Rattus norvegicus
agtgctgcggtatgaggcctttatc

SEQ ID NO: 162003 - DNA, 25 bp, Rattus norvegicus
agtgctgcgtggcaacagttaaatt

SEQ ID NO: 162004 - DNA, 25 bp, Rattus norvegicus
agtgctgcgtgggaacagttaaatt

SEQ ID NO: 162005 - DNA, 25 bp, Rattus norvegicus
agtgctgcgtgtccacagtcagaag

SEQ ID NO: 162006 - DNA, 25 bp, Rattus norvegicus
agtgctgcgtgtgcacagtcagaag

SEQ ID NO: 162007 - DNA, 25 bp, Rattus norvegicus
agtgctgctactaacttcagtgtct

SEQ ID NO: 162008 - DNA, 25 bp, Rattus norvegicus
agtgctgctacttacttcagtgtct

SEQ ID NO: 162009 - DNA, 25 bp, Rattus norvegicus
agtgctgctcataagctgactagct

SEQ ID NO: 162010 - DNA, 25 bp, Rattus norvegicus
agtgctgctcattagctgactagct

SEQ ID NO: 162011 - DNA, 25 bp, Rattus norvegicus
agtgctgctctgagctgcaactcct

SEQ ID NO: 162012 - DNA, 25 bp, Rattus norvegicus
agtgctgctctgtgctgcaactcct

SEQ ID NO: 162013 - DNA, 25 bp, Rattus norvegicus
agtgctgctgaacctgtatactgcc

SEQ ID NO: 162014 - DNA, 25 bp, Rattus norvegicus
agtgctgctgaagctgtatactgcc

SEQ ID NO: 162015 - DNA, 25 bp, Rattus norvegicus
agtgctgctgagctgcgtcacgtca

SEQ ID NO: 162016 - DNA, 25 bp, Rattus norvegicus
agtgctgctgaggtgcgtcacgtca

SEQ ID NO: 162017 - DNA, 25 bp, Rattus norvegicus
agtgctgctgatcccgtctagggaa

SEQ ID NO: 162018 - DNA, 25 bp, Rattus norvegicus
agtgctgctgatgccgtctagggaa

SEQ ID NO: 162019 - DNA, 25 bp, Rattus norvegicus
agtgctgctgcactcttaggagagt

SEQ ID NO: 162020 - DNA, 25 bp, Rattus norvegicus
agtgctgctgcagtcttaggagagt

SEQ ID NO: 162021 - DNA, 25 bp, Rattus norvegicus
agtgctgctgctatggtgtagatat

SEQ ID NO: 162022 - DNA, 25 bp, Rattus norvegicus
agtgctgctgctttggtgtagatat

SEQ ID NO: 162023 - DNA, 25 bp, Rattus norvegicus
agtgctgctggactcacatcccaag

SEQ ID NO: 162024 - DNA, 25 bp, Rattus norvegicus
agtgctgctggagtcacatcccaag

SEQ ID NO: 162025 - DNA, 25 bp, Rattus norvegicus
agtgctgcttcaaactgtctctgtg

SEQ ID NO: 162026 - DNA, 25 bp, Rattus norvegicus
agtgctgcttcatactgtctctgtg

SEQ ID NO: 162027 - DNA, 25 bp, Rattus norvegicus
agtgctgcttctcagaatcacctgc

SEQ ID NO: 162028 - DNA, 25 bp, Rattus norvegicus
agtgctgcttctgagaatcacctgc

SEQ ID NO: 162029 - DNA, 25 bp, Rattus norvegicus
agtgctggaaggctcccaatctcta

SEQ ID NO: 162030 - DNA, 25 bp, Rattus norvegicus
agtgctggaagggtcccaatctcta

SEQ ID NO: 162031 - DNA, 25 bp, Rattus norvegicus
agtgctggaccgagtctgtttccta

SEQ ID NO: 162032 - DNA, 25 bp, Rattus norvegicus
agtgctggaccgtgtctgtttccta

SEQ ID NO: 162033 - DNA, 25 bp, Rattus norvegicus
agtgctggacctccgctcaggagcc

SEQ ID NO: 162034 - DNA, 25 bp, Rattus norvegicus
agtgctggacctgcgctcaggagcc

SEQ ID NO: 162035 - DNA, 25 bp, Rattus norvegicus
agtgctggagagctgatttccatga

SEQ ID NO: 162036 - DNA, 25 bp, Rattus norvegicus
agtgctggagaggtgatttccatga

SEQ ID NO: 162037 - DNA, 25 bp, Rattus norvegicus
agtgctggagcgctcttttagacaa

SEQ ID NO: 162038 - DNA, 25 bp, Rattus norvegicus
agtgctggagcggtcttttagacaa

SEQ ID NO: 162039 - DNA, 25 bp, Rattus norvegicus
agtgctggatccagtaaagtctcaa

SEQ ID NO: 162040 - DNA, 25 bp, Rattus norvegicus
agtgctggatcctgtaaagtctcaa

SEQ ID NO: 162041 - DNA, 25 bp, Rattus norvegicus
agtgctggcattcagctgctttcaa

SEQ ID NO: 162042 - DNA, 25 bp, Rattus norvegicus
agtgctggcattgagctgctttcaa

SEQ ID NO: 162043 - DNA, 25 bp, Rattus norvegicus
agtgctggctcacgatccaggaagc

SEQ ID NO: 162044 - DNA, 25 bp, Rattus norvegicus
agtgctggctcaggatccaggaagc

SEQ ID NO: 162045 - DNA, 25 bp, Rattus norvegicus
agtgctgggaacacaccatgtggaa

SEQ ID NO: 162046 - DNA, 25 bp, Rattus norvegicus
agtgctgggaactcaccatgtggaa

SEQ ID NO: 162047 - DNA, 25 bp, Rattus norvegicus
agtgctgggaagaatgtcatgaagt

SEQ ID NO: 162048 - DNA, 25 bp, Rattus norvegicus
agtgctgggaagtatgtcatgaagt

SEQ ID NO: 162049 - DNA, 25 bp, Rattus norvegicus
agtgctgggactagaggcatgcctc

SEQ ID NO: 162050 - DNA, 25 bp, Rattus norvegicus
agtgctgggacttgaggcatgcctc

SEQ ID NO: 162051 - DNA, 25 bp, Rattus norvegicus
agtgctgggcacctactctgtgacg

SEQ ID NO: 162052 - DNA, 25 bp, Rattus norvegicus
agtgctgggcacgtactctgtgacg

SEQ ID NO: 162053 - DNA, 25 bp, Rattus norvegicus
agtgctgggcatcactgctatatat

SEQ ID NO: 162054 - DNA, 25 bp, Rattus norvegicus
agtgctgggcatgactgctatatat

SEQ ID NO: 162055 - DNA, 25 bp, Rattus norvegicus
agtgctgggtatacttgatgcctct

SEQ ID NO: 162056 - DNA, 25 bp, Rattus norvegicus
agtgctgggtattcttgatgcctct

SEQ ID NO: 162057 - DNA, 25 bp, Rattus norvegicus
agtgctggtatcaatctcacgggaa

SEQ ID NO: 162058 - DNA, 25 bp, Rattus norvegicus
agtgctggtatctatctcacgggaa

SEQ ID NO: 162059 - DNA, 25 bp, Rattus norvegicus
agtgctggtcatcccatttcatatg

SEQ ID NO: 162060 - DNA, 25 bp, Rattus norvegicus
agtgctggtcatgccatttcatatg

SEQ ID NO: 162061 - DNA, 25 bp, Rattus norvegicus
agtgctggtcccacagcatgtgtgt

SEQ ID NO: 162062 - DNA, 25 bp, Rattus norvegicus
agtgctggtccctcagcatgtgtgt

SEQ ID NO: 162063 - DNA, 25 bp, Rattus norvegicus
agtgctggtcgtccatgatggcttt

SEQ ID NO: 162064 - DNA, 25 bp, Rattus norvegicus
agtgctggtcgtgcatgatggcttt

SEQ ID NO: 162065 - DNA, 25 bp, Rattus norvegicus
agtgctgtaccaacagcagccttaa

SEQ ID NO: 162066 - DNA, 25 bp, Rattus norvegicus
agtgctgtaccatcagcagccttaa

SEQ ID NO: 162067 - DNA, 25 bp, Rattus norvegicus
agtgctgtactgagaggcttgcgaa

SEQ ID NO: 162068 - DNA, 25 bp, Rattus norvegicus
agtgctgtactgtgaggcttgcgaa

SEQ ID NO: 162069 - DNA, 25 bp, Rattus norvegicus
agtgctgtagcaatcaccaccacca

SEQ ID NO: 162070 - DNA, 25 bp, Rattus norvegicus
agtgctgtagcattcaccaccacca

SEQ ID NO: 162071 - DNA, 25 bp, Rattus norvegicus
agtgctgtatgaaagctaccgccct

SEQ ID NO: 162072 - DNA, 25 bp, Rattus norvegicus
agtgctgtatgatagctaccgccct

SEQ ID NO: 162073 - DNA, 25 bp, Rattus norvegicus
agtgctgtatttcttggttggccta

SEQ ID NO: 162074 - DNA, 25 bp, Rattus norvegicus
agtgctgtatttgttggttggccta

SEQ ID NO: 162075 - DNA, 25 bp, Rattus norvegicus
agtgctgtcagcacacagatggtct

SEQ ID NO: 162076 - DNA, 25 bp, Rattus norvegicus
agtgctgtcagctcacagatggtct

SEQ ID NO: 162077 - DNA, 25 bp, Rattus norvegicus
agtgctgtccatccttttcatgtcg

SEQ ID NO: 162078 - DNA, 25 bp, Rattus norvegicus
agtgctgtccatgcttttcatgtcg

SEQ ID NO: 162079 - DNA, 25 bp, Rattus norvegicus
agtgctgtccctcaaagtccttggg

SEQ ID NO: 162080 - DNA, 25 bp, Rattus norvegicus
agtgctgtccctgaaagtccttggg

SEQ ID NO: 162081 - DNA, 25 bp, Rattus norvegicus
agtgctgtcgctcaaccaataacat

SEQ ID NO: 162082 - DNA, 25 bp, Rattus norvegicus
agtgctgtcgctgaaccaataacat

SEQ ID NO: 162083 - DNA, 25 bp, Rattus norvegicus
agtgctgtctgcagactgtcaagtc

SEQ ID NO: 162084 - DNA, 25 bp, Rattus norvegicus
agtgctgtctgctgactgtcaagtc

SEQ ID NO: 162085 - DNA, 25 bp, Rattus norvegicus
agtgctgtcttacccatttgttgac

SEQ ID NO: 162086 - DNA, 25 bp, Rattus norvegicus
agtgctgtcttagccatttgttgac

SEQ ID NO: 162087 - DNA, 25 bp, Rattus norvegicus
agtgctgtgaagacgcgtacctgat

SEQ ID NO: 162088 - DNA, 25 bp, Rattus norvegicus
agtgctgtgaagagcgtcctctgag

SEQ ID NO: 162089 - DNA, 25 bp, Rattus norvegicus
agtgctgtgaagtcgcgtacctgat

SEQ ID NO: 162090 - DNA, 25 bp, Rattus norvegicus
agtgctgtgaagtgcgtcctctgag

SEQ ID NO: 162091 - DNA, 25 bp, Rattus norvegicus
agtgctgtggaaccagctacctgcc

SEQ ID NO: 162092 - DNA, 25 bp, Rattus norvegicus
agtgctgtggaagcagctacctgcc

SEQ ID NO: 162093 - DNA, 25 bp, Rattus norvegicus
agtgctgtggtcacactaggcttca

SEQ ID NO: 162094 - DNA, 25 bp, Rattus norvegicus
agtgctgtggtctcactaggcttca

SEQ ID NO: 162095 - DNA, 25 bp, Rattus norvegicus
agtgctgtgtggagcaaatatccca

SEQ ID NO: 162096 - DNA, 25 bp, Rattus norvegicus
agtgctgtgtggtgcaaatatccca

SEQ ID NO: 162097 - DNA, 25 bp, Rattus norvegicus
agtgctgtgttcacacttctgtaaa

SEQ ID NO: 162098 - DNA, 25 bp, Rattus norvegicus
agtgctgtgttctcacttctgtaaa

SEQ ID NO: 162099 - DNA, 25 bp, Rattus norvegicus
agtgctgtgtttagtgctgtgtcca

SEQ ID NO: 162100 - DNA, 25 bp, Rattus norvegicus
agtgctgtgttttgtgctgtgtcca

SEQ ID NO: 162101 - DNA, 25 bp, Rattus norvegicus
agtgctgttaatatgctttgtataa

SEQ ID NO: 162102 - DNA, 25 bp, Rattus norvegicus
agtgctgttaatttgctttgtataa

SEQ ID NO: 162103 - DNA, 25 bp, Rattus norvegicus
agtgctgttagcatctatccggcaa

SEQ ID NO: 162104 - DNA, 25 bp, Rattus norvegicus
agtgctgttagcttctatccggcaa

SEQ ID NO: 162105 - DNA, 25 bp, Rattus norvegicus
agtgctgttcctagaatcctggcaa

SEQ ID NO: 162106 - DNA, 25 bp, Rattus norvegicus
agtgctgttccttgaatcctggcaa

SEQ ID NO: 162107 - DNA, 25 bp, Rattus norvegicus
agtgctgttctaaagtatgtatttt

SEQ ID NO: 162108 - DNA, 25 bp, Rattus norvegicus
agtgctgttctatagtatgtatttt

SEQ ID NO: 162109 - DNA, 25 bp, Rattus norvegicus
agtgctgttgatcagttctctttaa

SEQ ID NO: 162110 - DNA, 25 bp, Rattus norvegicus
agtgctgttgatgagttctctttaa

SEQ ID NO: 162111 - DNA, 25 bp, Rattus norvegicus
agtgctgttggaagtttccagccct

SEQ ID NO: 162112 - DNA, 25 bp, Rattus norvegicus
agtgctgttggatgtttccagccct

SEQ ID NO: 162113 - DNA, 25 bp, Rattus norvegicus
agtgctgtttgccactgcagtgcat

SEQ ID NO: 162114 - DNA, 25 bp, Rattus norvegicus
agtgctgtttgcgactgcagtgcat

SEQ ID NO: 162115 - DNA, 25 bp, Rattus norvegicus
agtgcttaacctcattctttagtaa

SEQ ID NO: 162116 - DNA, 25 bp, Rattus norvegicus
agtgcttaacctgattctttagtaa

SEQ ID NO: 162117 - DNA, 25 bp, Rattus norvegicus
agtgcttaagatctctgtcctctgt

SEQ ID NO: 162118 - DNA, 25 bp, Rattus norvegicus
agtgcttaagatgtctgtcctctgt

SEQ ID NO: 162119 - DNA, 25 bp, Rattus norvegicus
agtgcttaatcgctgaatcattggc

SEQ ID NO: 162120 - DNA, 25 bp, Rattus norvegicus
agtgcttaatcggtgaatcattggc

SEQ ID NO: 162121 - DNA, 25 bp, Rattus norvegicus
agtgcttaccagaccatgtccctgg

SEQ ID NO: 162122 - DNA, 25 bp, Rattus norvegicus
agtgcttaccagtccatgtccctgg

SEQ ID NO: 162123 - DNA, 25 bp, Rattus norvegicus
agtgcttactgtactgggtctgaga

SEQ ID NO: 162124 - DNA, 25 bp, Rattus norvegicus
agtgcttactgttctgggtctgaga

SEQ ID NO: 162125 - DNA, 25 bp, Rattus norvegicus
agtgcttagaaaaccatgtgaccaa

SEQ ID NO: 162126 - DNA, 25 bp, Rattus norvegicus
agtgcttagaaatccatgtgaccaa

SEQ ID NO: 162127 - DNA, 25 bp, Rattus norvegicus
agtgcttagaacaccagtcctatgg

SEQ ID NO: 162128 - DNA, 25 bp, Rattus norvegicus
agtgcttagaactccagtcctatgg

SEQ ID NO: 162129 - DNA, 25 bp, Rattus norvegicus
agtgcttagataatgtgtcctagtt

SEQ ID NO: 162130 - DNA, 25 bp, Rattus norvegicus
agtgcttagatattgtgtcctagtt

SEQ ID NO: 162131 - DNA, 25 bp, Rattus norvegicus
agtgcttagcaacttgtattttcta

SEQ ID NO: 162132 - DNA, 25 bp, Rattus norvegicus
agtgcttagcaagttgtattttcta

SEQ ID NO: 162133 - DNA, 25 bp, Rattus norvegicus
agtgcttatgtcaagggcagtgtaa

SEQ ID NO: 162134 - DNA, 25 bp, Rattus norvegicus
agtgcttatgtctagggcagtgtaa

SEQ ID NO: 162135 - DNA, 25 bp, Rattus norvegicus
agtgcttattgcacaaacctggcca

SEQ ID NO: 162136 - DNA, 25 bp, Rattus norvegicus
agtgcttattgctcaaacctggcca

SEQ ID NO: 162137 - DNA, 25 bp, Rattus norvegicus
agtgcttcaagtacatctagggcct

SEQ ID NO: 162138 - DNA, 25 bp, Rattus norvegicus
agtgcttcaagttcatctagggcct

SEQ ID NO: 162139 - DNA, 25 bp, Rattus norvegicus
agtgcttcacagatttcacactcag

SEQ ID NO: 162140 - DNA, 25 bp, Rattus norvegicus
agtgcttcacagttttcacactcag

SEQ ID NO: 162141 - DNA, 25 bp, Rattus norvegicus
agtgcttcagcaagtggttcttcgg

SEQ ID NO: 162142 - DNA, 25 bp, Rattus norvegicus
agtgcttcagcatgtggttcttcgg

SEQ ID NO: 162143 - DNA, 25 bp, Rattus norvegicus
agtgcttcagtacgtgtctggctgc

SEQ ID NO: 162144 - DNA, 25 bp, Rattus norvegicus
agtgcttcagtaggtgtctggctgc

SEQ ID NO: 162145 - DNA, 25 bp, Rattus norvegicus
agtgcttcatcaaactgcccaaggg

SEQ ID NO: 162146 - DNA, 25 bp, Rattus norvegicus
agtgcttcatcatactgcccaaggg

SEQ ID NO: 162147 - DNA, 25 bp, Rattus norvegicus
agtgcttcatggatggctggtgact

SEQ ID NO: 162148 - DNA, 25 bp, Rattus norvegicus
agtgcttcatggttggctggtgact

SEQ ID NO: 162149 - DNA, 25 bp, Rattus norvegicus
agtgcttccagaacggactctgaaa

SEQ ID NO: 162150 - DNA, 25 bp, Rattus norvegicus
agtgcttccagatcggactctgaaa

SEQ ID NO: 162151 - DNA, 25 bp, Rattus norvegicus
agtgcttccctgctgttctaatgca

SEQ ID NO: 162152 - DNA, 25 bp, Rattus norvegicus
agtgcttccctggtgttctaatgca

SEQ ID NO: 162153 - DNA, 25 bp, Rattus norvegicus
agtgcttccgtaatcattgtactgc

SEQ ID NO: 162154 - DNA, 25 bp, Rattus norvegicus
agtgcttccgtattcattgtactgc

SEQ ID NO: 162155 - DNA, 25 bp, Rattus norvegicus
agtgcttcctttatcagagttgctt

SEQ ID NO: 162156 - DNA, 25 bp, Rattus norvegicus
agtgcttcctttttcagagttgctt

SEQ ID NO: 162157 - DNA, 25 bp, Rattus norvegicus
agtgcttctcaacgtacctaaggct

SEQ ID NO: 162158 - DNA, 25 bp, Rattus norvegicus
agtgcttctcaaggtacctaaggct

SEQ ID NO: 162159 - DNA, 25 bp, Rattus norvegicus
agtgcttctcatacattaacccatt

SEQ ID NO: 162160 - DNA, 25 bp, Rattus norvegicus
agtgcttctcattcattaacccatt

SEQ ID NO: 162161 - DNA, 25 bp, Rattus norvegicus
agtgcttctgcaaactgtgttatgt

SEQ ID NO: 162162 - DNA, 25 bp, Rattus norvegicus
agtgcttctgcatactgtgttatgt

SEQ ID NO: 162163 - DNA, 25 bp, Rattus norvegicus
agtgcttctgcgcatgtactggcca

SEQ ID NO: 162164 - DNA, 25 bp, Rattus norvegicus
agtgcttctgcggatgtactggcca

SEQ ID NO: 162165 - DNA, 25 bp, Rattus norvegicus
agtgcttctgtcactaacccaagta

SEQ ID NO: 162166 - DNA, 25 bp, Rattus norvegicus
agtgcttctgtctctaacccaagta

SEQ ID NO: 162167 - DNA, 25 bp, Rattus norvegicus
agtgcttcttcaactccaacagtga

SEQ ID NO: 162168 - DNA, 25 bp, Rattus norvegicus
agtgcttcttcatctccaacagtga

SEQ ID NO: 162169 - DNA, 25 bp, Rattus norvegicus
agtgcttcttgtatataaacgccta

SEQ ID NO: 162170 - DNA, 25 bp, Rattus norvegicus
agtgcttcttgtttataaacgccta

SEQ ID NO: 162171 - DNA, 25 bp, Rattus norvegicus
agtgcttgaggactcctgcccgatt

SEQ ID NO: 162172 - DNA, 25 bp, Rattus norvegicus
agtgcttgaggagtcctgcccgatt

SEQ ID NO: 162173 - DNA, 25 bp, Rattus norvegicus
agtgcttgcaatctctaaccattaa

SEQ ID NO: 162174 - DNA, 25 bp, Rattus norvegicus
agtgcttgcaatgtctaaccattaa

SEQ ID NO: 162175 - DNA, 25 bp, Rattus norvegicus
agtgcttgccgacgctgttgacctc

SEQ ID NO: 162176 - DNA, 25 bp, Rattus norvegicus
agtgcttgccgaggctgttgacctc

SEQ ID NO: 162177 - DNA, 25 bp, Rattus norvegicus
agtgcttgctctcgttctgtgggat

SEQ ID NO: 162178 - DNA, 25 bp, Rattus norvegicus
agtgcttgctctggttctgtgggat

SEQ ID NO: 162179 - DNA, 25 bp, Rattus norvegicus
agtgcttgctgtctcatcagttctt

SEQ ID NO: 162180 - DNA, 25 bp, Rattus norvegicus
agtgcttgctgtgtcatcagttctt

SEQ ID NO: 162181 - DNA, 25 bp, Rattus norvegicus
agtgcttgcttgagtggcctgcctg

SEQ ID NO: 162182 - DNA, 25 bp, Rattus norvegicus
agtgcttgcttgtgtggcctgcctg

SEQ ID NO: 162183 - DNA, 25 bp, Rattus norvegicus
agtgcttggaatctactgcgtccag

SEQ ID NO: 162184 - DNA, 25 bp, Rattus norvegicus
agtgcttggaatgtactgcgtccag

SEQ ID NO: 162185 - DNA, 25 bp, Rattus norvegicus
agtgcttgtattagtattctccata

SEQ ID NO: 162186 - DNA, 25 bp, Rattus norvegicus
agtgcttgtatttgtattctccata

SEQ ID NO: 162187 - DNA, 25 bp, Rattus norvegicus
agtgctttaaaactctgacgtctga

SEQ ID NO: 162188 - DNA, 25 bp, Rattus norvegicus
agtgctttaaaagtctgacgtctga

SEQ ID NO: 162189 - DNA, 25 bp, Rattus norvegicus
agtgctttactgaagacacctccct

SEQ ID NO: 162190 - DNA, 25 bp, Rattus norvegicus
agtgctttactgtagacacctccct

SEQ ID NO: 162191 - DNA, 25 bp, Rattus norvegicus
agtgctttagaaagccgtcctggtc

SEQ ID NO: 162192 - DNA, 25 bp, Rattus norvegicus
agtgctttagaatgccgtcctggtc

SEQ ID NO: 162193 - DNA, 25 bp, Rattus norvegicus
agtgctttagacacacccaagactg

SEQ ID NO: 162194 - DNA, 25 bp, Rattus norvegicus
agtgctttagactcacccaagactg

SEQ ID NO: 162195 - DNA, 25 bp, Rattus norvegicus
agtgctttagccaaattccatatgt

SEQ ID NO: 162196 - DNA, 25 bp, Rattus norvegicus
agtgctttagccagactcaggaagg

SEQ ID NO: 162197 - DNA, 25 bp, Rattus norvegicus
agtgctttagccaggctcgctgtgc

SEQ ID NO: 162198 - DNA, 25 bp, Rattus norvegicus
agtgctttagcctaattccatatgt

SEQ ID NO: 162199 - DNA, 25 bp, Rattus norvegicus
agtgctttagcctgactcaggaagg

SEQ ID NO: 162200 - DNA, 25 bp, Rattus norvegicus
agtgctttagcctggctcgctgtgc

SEQ ID NO: 162201 - DNA, 25 bp, Rattus norvegicus
agtgctttatctctggctatctgcc

SEQ ID NO: 162202 - DNA, 25 bp, Rattus norvegicus
agtgctttatctgtggctatctgcc

SEQ ID NO: 162203 - DNA, 25 bp, Rattus norvegicus
agtgctttattaagacttttcccag

SEQ ID NO: 162204 - DNA, 25 bp, Rattus norvegicus
agtgctttattatgacttttcccag

SEQ ID NO: 162205 - DNA, 25 bp, Rattus norvegicus
agtgctttcaacactaggcatctgg

SEQ ID NO: 162206 - DNA, 25 bp, Rattus norvegicus
agtgctttcaactctaggcatctgg

SEQ ID NO: 162207 - DNA, 25 bp, Rattus norvegicus
agtgctttcactatccttagttatt

SEQ ID NO: 162208 - DNA, 25 bp, Rattus norvegicus
agtgctttcactttccttagttatt

SEQ ID NO: 162209 - DNA, 25 bp, Rattus norvegicus
agtgctttccagaaaatgcttgcgt

SEQ ID NO: 162210 - DNA, 25 bp, Rattus norvegicus
agtgctttccagcaggaacacccga

SEQ ID NO: 162211 - DNA, 25 bp, Rattus norvegicus
agtgctttccaggaggaacacccga

SEQ ID NO: 162212 - DNA, 25 bp, Rattus norvegicus
agtgctttccagtaaatgcttgcgt

SEQ ID NO: 162213 - DNA, 25 bp, Rattus norvegicus
agtgctttcctacctaagtggtctt

SEQ ID NO: 162214 - DNA, 25 bp, Rattus norvegicus
agtgctttcctagctaagtggtctt

SEQ ID NO: 162215 - DNA, 25 bp, Rattus norvegicus
agtgctttcgcaccagttgtcagac

SEQ ID NO: 162216 - DNA, 25 bp, Rattus norvegicus
agtgctttcgcagcagttgtcagac

SEQ ID NO: 162217 - DNA, 25 bp, Rattus norvegicus
agtgctttctgaagcagcagagccc

SEQ ID NO: 162218 - DNA, 25 bp, Rattus norvegicus
agtgctttctgatgcagcagagccc

SEQ ID NO: 162219 - DNA, 25 bp, Rattus norvegicus
agtgctttgaccctgagcctgttct

SEQ ID NO: 162220 - DNA, 25 bp, Rattus norvegicus
agtgctttgaccgtgagcctgttct

SEQ ID NO: 162221 - DNA, 25 bp, Rattus norvegicus
agtgctttgagaaagcttcctgttt

SEQ ID NO: 162222 - DNA, 25 bp, Rattus norvegicus
agtgctttgagatagcttcctgttt

SEQ ID NO: 162223 - DNA, 25 bp, Rattus norvegicus
agtgctttgagtacacttgcagaac

SEQ ID NO: 162224 - DNA, 25 bp, Rattus norvegicus
agtgctttgagttcacttgcagaac

SEQ ID NO: 162225 - DNA, 25 bp, Rattus norvegicus
agtgctttgatgacggtgccattcc

SEQ ID NO: 162226 - DNA, 25 bp, Rattus norvegicus
agtgctttgatgtcggtgccattcc

SEQ ID NO: 162227 - DNA, 25 bp, Rattus norvegicus
agtgctttgattcctgctctgacct

SEQ ID NO: 162228 - DNA, 25 bp, Rattus norvegicus
agtgctttgattgctgctctgacct

SEQ ID NO: 162229 - DNA, 25 bp, Rattus norvegicus
agtgctttgcacagtcttgagaagg

SEQ ID NO: 162230 - DNA, 25 bp, Rattus norvegicus
agtgctttgcactgtcttgagaagg

SEQ ID NO: 162231 - DNA, 25 bp, Rattus norvegicus
agtgctttggccattttattataga

SEQ ID NO: 162232 - DNA, 25 bp, Rattus norvegicus
agtgctttggcctttttattataga

SEQ ID NO: 162233 - DNA, 25 bp, Rattus norvegicus
agtgctttgggaaccattgacattt

SEQ ID NO: 162234 - DNA, 25 bp, Rattus norvegicus
agtgctttgggatccattgacattt

SEQ ID NO: 162235 - DNA, 25 bp, Rattus norvegicus
agtgctttggtgatcacagtcttgt

SEQ ID NO: 162236 - DNA, 25 bp, Rattus norvegicus
agtgctttggtgttcacagtcttgt

SEQ ID NO: 162237 - DNA, 25 bp, Rattus norvegicus
agtgctttggttcaaatccctggga

SEQ ID NO: 162238 - DNA, 25 bp, Rattus norvegicus
agtgctttggttgaaatccctggga

SEQ ID NO: 162239 - DNA, 25 bp, Rattus norvegicus
agtgctttgtcacgcagcgcaggaa

SEQ ID NO: 162240 - DNA, 25 bp, Rattus norvegicus
agtgctttgtcaggcagcgcaggaa

SEQ ID NO: 162241 - DNA, 25 bp, Rattus norvegicus
agtgctttttagatttgtatatcag

SEQ ID NO: 162242 - DNA, 25 bp, Rattus norvegicus
agtgctttttagttttgtatatcag

SEQ ID NO: 162243 - DNA, 25 bp, Rattus norvegicus
agtggaaaattaaaccctatctagt

SEQ ID NO: 162244 - DNA, 25 bp, Rattus norvegicus
agtggaaaattataccctatctagt

SEQ ID NO: 162245 - DNA, 25 bp, Rattus norvegicus
agtggaaacaaaccttcctctgtgc

SEQ ID NO: 162246 - DNA, 25 bp, Rattus norvegicus
agtggaaacaaagcttcctctgtgc

SEQ ID NO: 162247 - DNA, 25 bp, Rattus norvegicus
agtggaaactatcgccttagggctt

SEQ ID NO: 162248 - DNA, 25 bp, Rattus norvegicus
agtggaaactatggccttagggctt

SEQ ID NO: 162249 - DNA, 25 bp, Rattus norvegicus
agtggaaactgccacatgcacctct

SEQ ID NO: 162250 - DNA, 25 bp, Rattus norvegicus
agtggaaactgcgacatgcacctct

SEQ ID NO: 162251 - DNA, 25 bp, Rattus norvegicus
agtggaaactgtagcttgctccctc

SEQ ID NO: 162252 - DNA, 25 bp, Rattus norvegicus
agtggaaactgttgcttgctccctc

SEQ ID NO: 162253 - DNA, 25 bp, Rattus norvegicus
agtggaaagcacacaactgaaagtc

SEQ ID NO: 162254 - DNA, 25 bp, Rattus norvegicus
agtggaaagcacacctactcgattg

SEQ ID NO: 162255 - DNA, 25 bp, Rattus norvegicus
agtggaaagcactcaactgaaagtc

SEQ ID NO: 162256 - DNA, 25 bp, Rattus norvegicus
agtggaaagcactcctactcgattg

SEQ ID NO: 162257 - DNA, 25 bp, Rattus norvegicus
agtggaaatcccaactcttgtacct

SEQ ID NO: 162258 - DNA, 25 bp, Rattus norvegicus
agtggaaatccctactcttgtacct

SEQ ID NO: 162259 - DNA, 25 bp, Rattus norvegicus
agtggaacacgacagagccctcaag

SEQ ID NO: 162260 - DNA, 25 bp, Rattus norvegicus
agtggaacacgacccaacagcagtt

SEQ ID NO: 162261 - DNA, 25 bp, Rattus norvegicus
agtggaacacgagagagccctcaag

SEQ ID NO: 162262 - DNA, 25 bp, Rattus norvegicus
agtggaacacgagccaacagcagtt

SEQ ID NO: 162263 - DNA, 25 bp, Rattus norvegicus
agtggaacatgtagtcaccccagca

SEQ ID NO: 162264 - DNA, 25 bp, Rattus norvegicus
agtggaacatgttgtcaccccagca

SEQ ID NO: 162265 - DNA, 25 bp, Rattus norvegicus
agtggaaccaaactccaagagcttc

SEQ ID NO: 162266 - DNA, 25 bp, Rattus norvegicus
agtggaaccaaagtccaagagcttc

SEQ ID NO: 162267 - DNA, 25 bp, Rattus norvegicus
agtggaacccagaacactttcctgt

SEQ ID NO: 162268 - DNA, 25 bp, Rattus norvegicus
agtggaacccagtacactttcctgt

SEQ ID NO: 162269 - DNA, 25 bp, Rattus norvegicus
agtggaactcaacaccaggcagcat

SEQ ID NO: 162270 - DNA, 25 bp, Rattus norvegicus
agtggaactcaagaccaggcagcat

SEQ ID NO: 162271 - DNA, 25 bp, Rattus norvegicus
agtggaacttcacaggctttccttg

SEQ ID NO: 162272 - DNA, 25 bp, Rattus norvegicus
agtggaacttcagaggctttccttg

SEQ ID NO: 162273 - DNA, 25 bp, Rattus norvegicus
agtggaagaccacacgtacttactt

SEQ ID NO: 162274 - DNA, 25 bp, Rattus norvegicus
agtggaagaccagacgtacttactt

SEQ ID NO: 162275 - DNA, 25 bp, Rattus norvegicus
agtggaagagataccttgtaggagt

SEQ ID NO: 162276 - DNA, 25 bp, Rattus norvegicus
agtggaagagattccttgtaggagt

SEQ ID NO: 162277 - DNA, 25 bp, Rattus norvegicus
agtggaagcaacacccagacacgag

SEQ ID NO: 162278 - DNA, 25 bp, Rattus norvegicus
agtggaagcaactcccagacacgag

SEQ ID NO: 162279 - DNA, 25 bp, Rattus norvegicus
agtggaagcagcagccagtcctggc

SEQ ID NO: 162280 - DNA, 25 bp, Rattus norvegicus
agtggaagcagctgccagtcctggc

SEQ ID NO: 162281 - DNA, 25 bp, Rattus norvegicus
agtggaagccaccatctgcgagaag

SEQ ID NO: 162282 - DNA, 25 bp, Rattus norvegicus
agtggaagccacgatctgcgagaag

SEQ ID NO: 162283 - DNA, 25 bp, Rattus norvegicus
agtggaagcggcacaggcagttctc

SEQ ID NO: 162284 - DNA, 25 bp, Rattus norvegicus
agtggaagcggctcaggcagttctc

SEQ ID NO: 162285 - DNA, 25 bp, Rattus norvegicus
agtggaaggaccagaagactcctgg

SEQ ID NO: 162286 - DNA, 25 bp, Rattus norvegicus
agtggaaggacctgaagactcctgg

SEQ ID NO: 162287 - DNA, 25 bp, Rattus norvegicus
agtggaagtcatccagagtctgtgt

SEQ ID NO: 162288 - DNA, 25 bp, Rattus norvegicus
agtggaagtcatgcagagtctgtgt

SEQ ID NO: 162289 - DNA, 25 bp, Rattus norvegicus
agtggaagtctgactccttagccgt

SEQ ID NO: 162290 - DNA, 25 bp, Rattus norvegicus
agtggaagtctgtctccttagccgt

SEQ ID NO: 162291 - DNA, 25 bp, Rattus norvegicus
agtggaagtgccactcacgcgcgcc

SEQ ID NO: 162292 - DNA, 25 bp, Rattus norvegicus
agtggaagtgcctctcacgcgcgcc

SEQ ID NO: 162293 - DNA, 25 bp, Rattus norvegicus
agtggaagttccatctacctttcgg

SEQ ID NO: 162294 - DNA, 25 bp, Rattus norvegicus
agtggaagttccttctacctttcgg

SEQ ID NO: 162295 - DNA, 25 bp, Rattus norvegicus
agtggaatgacgacccctgcaacta

SEQ ID NO: 162296 - DNA, 25 bp, Rattus norvegicus
agtggaatgacgtcccctgcaacta

SEQ ID NO: 162297 - DNA, 25 bp, Rattus norvegicus
agtggaatgcagaagccctctgggc

SEQ ID NO: 162298 - DNA, 25 bp, Rattus norvegicus
agtggaatgcagtagccctctgggc

SEQ ID NO: 162299 - DNA, 25 bp, Rattus norvegicus
agtggaattctaactgaatcctcag

SEQ ID NO: 162300 - DNA, 25 bp, Rattus norvegicus
agtggaattctatctgaatcctcag

SEQ ID NO: 162301 - DNA, 25 bp, Rattus norvegicus
agtggaattctgctctcattgtgac

SEQ ID NO: 162302 - DNA, 25 bp, Rattus norvegicus
agtggaattctggtctcattgtgac

SEQ ID NO: 162303 - DNA, 25 bp, Rattus norvegicus
agtggacaacagctatcctgggttt

SEQ ID NO: 162304 - DNA, 25 bp, Rattus norvegicus
agtggacaacaggtatcctgggttt

SEQ ID NO: 162305 - DNA, 25 bp, Rattus norvegicus
agtggacaatgtacagccctcggtt

SEQ ID NO: 162306 - DNA, 25 bp, Rattus norvegicus
agtggacaatgttcagccctcggtt

SEQ ID NO: 162307 - DNA, 25 bp, Rattus norvegicus
agtggacacaccatgataggcctgt

SEQ ID NO: 162308 - DNA, 25 bp, Rattus norvegicus
agtggacacaccttgataggcctgt

SEQ ID NO: 162309 - DNA, 25 bp, Rattus norvegicus
agtggacaccacactgttagcttac

SEQ ID NO: 162310 - DNA, 25 bp, Rattus norvegicus
agtggacaccactctgttagcttac

SEQ ID NO: 162311 - DNA, 25 bp, Rattus norvegicus
agtggacacgctctaatttcaactt

SEQ ID NO: 162312 - DNA, 25 bp, Rattus norvegicus
agtggacacgctgtaatttcaactt

SEQ ID NO: 162313 - DNA, 25 bp, Rattus norvegicus
agtggacactcgcaggctgttgcca

SEQ ID NO: 162314 - DNA, 25 bp, Rattus norvegicus
agtggacactcggaggctgttgcca

SEQ ID NO: 162315 - DNA, 25 bp, Rattus norvegicus
agtggacagagacactggcctccgt

SEQ ID NO: 162316 - DNA, 25 bp, Rattus norvegicus
agtggacagagagactggcctccgt

SEQ ID NO: 162317 - DNA, 25 bp, Rattus norvegicus
agtggacagcgcctttcctgtatat

SEQ ID NO: 162318 - DNA, 25 bp, Rattus norvegicus
agtggacagcgcgtttcctgtatat

SEQ ID NO: 162319 - DNA, 25 bp, Rattus norvegicus
agtggacaggcaattgtcctctgcc

SEQ ID NO: 162320 - DNA, 25 bp, Rattus norvegicus
agtggacaggcatttgtcctctgcc

SEQ ID NO: 162321 - DNA, 25 bp, Rattus norvegicus
agtggacatgccataaagctggaga

SEQ ID NO: 162322 - DNA, 25 bp, Rattus norvegicus
agtggacatgccttaaagctggaga

SEQ ID NO: 162323 - DNA, 25 bp, Rattus norvegicus
agtggaccacgaatgtctcactacc

SEQ ID NO: 162324 - DNA, 25 bp, Rattus norvegicus
agtggaccacgattgtctcactacc

SEQ ID NO: 162325 - DNA, 25 bp, Rattus norvegicus
agtggaccatgcatatgtcaccagc

SEQ ID NO: 162326 - DNA, 25 bp, Rattus norvegicus
agtggaccatgcttatgtcaccagc

SEQ ID NO: 162327 - DNA, 25 bp, Rattus norvegicus
agtggaccatggaagcagctgttaa

SEQ ID NO: 162328 - DNA, 25 bp, Rattus norvegicus
agtggaccatggtagcagctgttaa

SEQ ID NO: 162329 - DNA, 25 bp, Rattus norvegicus
agtggacccagtcgccctgaggcat

SEQ ID NO: 162330 - DNA, 25 bp, Rattus norvegicus
agtggacccagtggccctgaggcat

SEQ ID NO: 162331 - DNA, 25 bp, Rattus norvegicus
agtggaccccagctatgctgtgtaa

SEQ ID NO: 162332 - DNA, 25 bp, Rattus norvegicus
agtggaccccaggtatgctgtgtaa

SEQ ID NO: 162333 - DNA, 25 bp, Rattus norvegicus
agtggaccctgacaaagtacctgaa

SEQ ID NO: 162334 - DNA, 25 bp, Rattus norvegicus
agtggaccctgagaaagtacctgaa

SEQ ID NO: 162335 - DNA, 25 bp, Rattus norvegicus
agtggaccctggattctaatgtcaa

SEQ ID NO: 162336 - DNA, 25 bp, Rattus norvegicus
agtggaccctggtttctaatgtcaa

SEQ ID NO: 162337 - DNA, 25 bp, Rattus norvegicus
agtggacctccacaacaccaagtgg

SEQ ID NO: 162338 - DNA, 25 bp, Rattus norvegicus
agtggacctccagaacaccaagtgg

SEQ ID NO: 162339 - DNA, 25 bp, Rattus norvegicus
agtggacctgtgaaatgccgttatc

SEQ ID NO: 162340 - DNA, 25 bp, Rattus norvegicus
agtggacctgtgaactaccagcacc

SEQ ID NO: 162341 - DNA, 25 bp, Rattus norvegicus
agtggacctgtgtaatgccgttatc

SEQ ID NO: 162342 - DNA, 25 bp, Rattus norvegicus
agtggacctgtgtactaccagcacc

SEQ ID NO: 162343 - DNA, 25 bp, Rattus norvegicus
agtggaccttctagagaactccctt

SEQ ID NO: 162344 - DNA, 25 bp, Rattus norvegicus
agtggaccttcttgagaactccctt

SEQ ID NO: 162345 - DNA, 25 bp, Rattus norvegicus
agtggacgctcaccttctttgaaaa

SEQ ID NO: 162346 - DNA, 25 bp, Rattus norvegicus
agtggacgctcagcttctttgaaaa

SEQ ID NO: 162347 - DNA, 25 bp, Rattus norvegicus
agtggacgtattccatttcgccaac

SEQ ID NO: 162348 - DNA, 25 bp, Rattus norvegicus
agtggacgtattgcatttcgccaac

SEQ ID NO: 162349 - DNA, 25 bp, Rattus norvegicus
agtggactagacacattcctttcaa

SEQ ID NO: 162350 - DNA, 25 bp, Rattus norvegicus
agtggactagactcattcctttcaa

SEQ ID NO: 162351 - DNA, 25 bp, Rattus norvegicus
agtggactagttcccaattctttgt

SEQ ID NO: 162352 - DNA, 25 bp, Rattus norvegicus
agtggactagttgccaattctttgt

SEQ ID NO: 162353 - DNA, 25 bp, Rattus norvegicus
agtggactcctgacatggactgtgg

SEQ ID NO: 162354 - DNA, 25 bp, Rattus norvegicus
agtggactcctgtcatggactgtgg

SEQ ID NO: 162355 - DNA, 25 bp, Rattus norvegicus
agtggactctcccttatttatgacc

SEQ ID NO: 162356 - DNA, 25 bp, Rattus norvegicus
agtggactctccgttatttatgacc

SEQ ID NO: 162357 - DNA, 25 bp, Rattus norvegicus
agtggactgcataagtgttataatc

SEQ ID NO: 162358 - DNA, 25 bp, Rattus norvegicus
agtggactgcattagtgttataatc

SEQ ID NO: 162359 - DNA, 25 bp, Rattus norvegicus
agtggactgcttctgtctcaggtat

SEQ ID NO: 162360 - DNA, 25 bp, Rattus norvegicus
agtggactgcttgtgtctcaggtat

SEQ ID NO: 162361 - DNA, 25 bp, Rattus norvegicus
agtggactgggacctccgtgatcaa

SEQ ID NO: 162362 - DNA, 25 bp, Rattus norvegicus
agtggactgggagctccgtgatcaa

SEQ ID NO: 162363 - DNA, 25 bp, Rattus norvegicus
agtggactgggcacacggctatttc

SEQ ID NO: 162364 - DNA, 25 bp, Rattus norvegicus
agtggactgggctcacggctatttc

SEQ ID NO: 162365 - DNA, 25 bp, Rattus norvegicus
agtggactgtgaccttcgggtacac

SEQ ID NO: 162366 - DNA, 25 bp, Rattus norvegicus
agtggactgtgagcttcgggtacac

SEQ ID NO: 162367 - DNA, 25 bp, Rattus norvegicus
agtggactgtgtaaacctggcatca

SEQ ID NO: 162368 - DNA, 25 bp, Rattus norvegicus
agtggactgtgttaacctggcatca

SEQ ID NO: 162369 - DNA, 25 bp, Rattus norvegicus
agtggacttatcacacgaccagagt

SEQ ID NO: 162370 - DNA, 25 bp, Rattus norvegicus
agtggacttatctcacgaccagagt

SEQ ID NO: 162371 - DNA, 25 bp, Rattus norvegicus
agtggacttcttaacaccaagctct

SEQ ID NO: 162372 - DNA, 25 bp, Rattus norvegicus
agtggacttctttacaccaagctct

SEQ ID NO: 162373 - DNA, 25 bp, Rattus norvegicus
agtggagaaaccctttgccattgcc

SEQ ID NO: 162374 - DNA, 25 bp, Rattus norvegicus
agtggagaaaccgtttgccattgcc

SEQ ID NO: 162375 - DNA, 25 bp, Rattus norvegicus
agtggagaactacaaccctcggcag

SEQ ID NO: 162376 - DNA, 25 bp, Rattus norvegicus
agtggagaactagaaccctcggcag

SEQ ID NO: 162377 - DNA, 25 bp, Rattus norvegicus
agtggagaagaaaccctggcacctt

SEQ ID NO: 162378 - DNA, 25 bp, Rattus norvegicus
agtggagaagaatccctggcacctt

SEQ ID NO: 162379 - DNA, 25 bp, Rattus norvegicus
agtggagacagtactccatccacct

SEQ ID NO: 162380 - DNA, 25 bp, Rattus norvegicus
agtggagacagttctccatccacct

SEQ ID NO: 162381 - DNA, 25 bp, Rattus norvegicus
agtggagaccacagcactccctaag

SEQ ID NO: 162382 - DNA, 25 bp, Rattus norvegicus
agtggagaccactgcactccctaag

SEQ ID NO: 162383 - DNA, 25 bp, Rattus norvegicus
agtggagaccatcctcgatcggtac

SEQ ID NO: 162384 - DNA, 25 bp, Rattus norvegicus
agtggagaccatgctcgatcggtac

SEQ ID NO: 162385 - DNA, 25 bp, Rattus norvegicus
agtggagaccttcctagtgtgagaa

SEQ ID NO: 162386 - DNA, 25 bp, Rattus norvegicus
agtggagaccttgctagtgtgagaa

SEQ ID NO: 162387 - DNA, 25 bp, Rattus norvegicus
agtggagactgcattccctcttgaa

SEQ ID NO: 162388 - DNA, 25 bp, Rattus norvegicus
agtggagactgctttccctcttgaa

SEQ ID NO: 162389 - DNA, 25 bp, Rattus norvegicus
agtggagactttccctcttgagatg

SEQ ID NO: 162390 - DNA, 25 bp, Rattus norvegicus
agtggagactttgcctcttgagatg

SEQ ID NO: 162391 - DNA, 25 bp, Rattus norvegicus
agtggagagctgacctgtcgctgac

SEQ ID NO: 162392 - DNA, 25 bp, Rattus norvegicus
agtggagagctgtcctgtcgctgac

SEQ ID NO: 162393 - DNA, 25 bp, Rattus norvegicus
agtggagagtccctttcagccaaca

SEQ ID NO: 162394 - DNA, 25 bp, Rattus norvegicus
agtggagagtccgtttcagccaaca

SEQ ID NO: 162395 - DNA, 25 bp, Rattus norvegicus
agtggagatccaacgttttacaagt

SEQ ID NO: 162396 - DNA, 25 bp, Rattus norvegicus
agtggagatccatcgttttacaagt

SEQ ID NO: 162397 - DNA, 25 bp, Rattus norvegicus
agtggagatgttacgttgccacccc

SEQ ID NO: 162398 - DNA, 25 bp, Rattus norvegicus
agtggagatgtttcgttgccacccc

SEQ ID NO: 162399 - DNA, 25 bp, Rattus norvegicus
agtggagcagacagacctttctctc

SEQ ID NO: 162400 - DNA, 25 bp, Rattus norvegicus
agtggagcagactgacctttctctc

SEQ ID NO: 162401 - DNA, 25 bp, Rattus norvegicus
agtggagcagccactaggacgagct

SEQ ID NO: 162402 - DNA, 25 bp, Rattus norvegicus
agtggagcagcctctaggacgagct

SEQ ID NO: 162403 - DNA, 25 bp, Rattus norvegicus
agtggagcaggcacggctgccccac

SEQ ID NO: 162404 - DNA, 25 bp, Rattus norvegicus
agtggagcaggctcggctgccccac

SEQ ID NO: 162405 - DNA, 25 bp, Rattus norvegicus
agtggagcatagaggccgaacctga

SEQ ID NO: 162406 - DNA, 25 bp, Rattus norvegicus
agtggagcatagtggccgaacctga

SEQ ID NO: 162407 - DNA, 25 bp, Rattus norvegicus
agtggagccaacacctgatggagat

SEQ ID NO: 162408 - DNA, 25 bp, Rattus norvegicus
agtggagccaactcctgatggagat

SEQ ID NO: 162409 - DNA, 25 bp, Rattus norvegicus
agtggagccacgagctgccgtgtta

SEQ ID NO: 162410 - DNA, 25 bp, Rattus norvegicus
agtggagccacgtgctgccgtgtta

SEQ ID NO: 162411 - DNA, 25 bp, Rattus norvegicus
agtggagccagcctttgcatcttgc

SEQ ID NO: 162412 - DNA, 25 bp, Rattus norvegicus
agtggagccagcgtttgcatcttgc

SEQ ID NO: 162413 - DNA, 25 bp, Rattus norvegicus
agtggagcccacatgcgatcatcag

SEQ ID NO: 162414 - DNA, 25 bp, Rattus norvegicus
agtggagcccacttgcgatcatcag

SEQ ID NO: 162415 - DNA, 25 bp, Rattus norvegicus
agtggagccgtgaactaccgtgtta

SEQ ID NO: 162416 - DNA, 25 bp, Rattus norvegicus
agtggagccgtgtactaccgtgtta

SEQ ID NO: 162417 - DNA, 25 bp, Rattus norvegicus
agtggagcctgactccgacgaactg

SEQ ID NO: 162418 - DNA, 25 bp, Rattus norvegicus
agtggagcctgagtccgacgaactg

SEQ ID NO: 162419 - DNA, 25 bp, Rattus norvegicus
agtggagcctgtatgctctggccta

SEQ ID NO: 162420 - DNA, 25 bp, Rattus norvegicus
agtggagcctgtttgctctggccta

SEQ ID NO: 162421 - DNA, 25 bp, Rattus norvegicus
agtggagcgcttccgtgacttacgt

SEQ ID NO: 162422 - DNA, 25 bp, Rattus norvegicus
agtggagcgcttgcgtgacttacgt

SEQ ID NO: 162423 - DNA, 25 bp, Rattus norvegicus
agtggagctgagacctgtcctgaaa

SEQ ID NO: 162424 - DNA, 25 bp, Rattus norvegicus
agtggagctgagtcctgtcctgaaa

SEQ ID NO: 162425 - DNA, 25 bp, Rattus norvegicus
agtggagctgttctctgctgcagtc

SEQ ID NO: 162426 - DNA, 25 bp, Rattus norvegicus
agtggagctgttgtctgctgcagtc

SEQ ID NO: 162427 - DNA, 25 bp, Rattus norvegicus
agtggaggacccatggaagagccct

SEQ ID NO: 162428 - DNA, 25 bp, Rattus norvegicus
agtggaggacccttggaagagccct

SEQ ID NO: 162429 - DNA, 25 bp, Rattus norvegicus
agtggaggagctcgcttacagacct

SEQ ID NO: 162430 - DNA, 25 bp, Rattus norvegicus
agtggaggagctggcttacagacct

SEQ ID NO: 162431 - DNA, 25 bp, Rattus norvegicus
agtggaggcaacagaaccccgggct

SEQ ID NO: 162432 - DNA, 25 bp, Rattus norvegicus
agtggaggcaactgaaccccgggct

SEQ ID NO: 162433 - DNA, 25 bp, Rattus norvegicus
agtggaggcagcatcggctactgct

SEQ ID NO: 162434 - DNA, 25 bp, Rattus norvegicus
agtggaggcagcatgtctgacccat

SEQ ID NO: 162435 - DNA, 25 bp, Rattus norvegicus
agtggaggcagcttcggctactgct

SEQ ID NO: 162436 - DNA, 25 bp, Rattus norvegicus
agtggaggcagcttgtctgacccat

SEQ ID NO: 162437 - DNA, 25 bp, Rattus norvegicus
agtggaggccaaactctcaggacct

SEQ ID NO: 162438 - DNA, 25 bp, Rattus norvegicus
agtggaggccaatctctcaggacct

SEQ ID NO: 162439 - DNA, 25 bp, Rattus norvegicus
agtggaggctatccttccccttcag

SEQ ID NO: 162440 - DNA, 25 bp, Rattus norvegicus
agtggaggctatgcttccccttcag

SEQ ID NO: 162441 - DNA, 25 bp, Rattus norvegicus
agtggaggctccacctttaatccgg

SEQ ID NO: 162442 - DNA, 25 bp, Rattus norvegicus
agtggaggctccataggaccttcct

SEQ ID NO: 162443 - DNA, 25 bp, Rattus norvegicus
agtggaggctcctcctttaatccgg

SEQ ID NO: 162444 - DNA, 25 bp, Rattus norvegicus
agtggaggctccttaggaccttcct

SEQ ID NO: 162445 - DNA, 25 bp, Rattus norvegicus
agtggagggattagtcacagcactt

SEQ ID NO: 162446 - DNA, 25 bp, Rattus norvegicus
agtggagggatttgtcacagcactt

SEQ ID NO: 162447 - DNA, 25 bp, Rattus norvegicus
agtggagggccaagtcagccattat

SEQ ID NO: 162448 - DNA, 25 bp, Rattus norvegicus
agtggagggccatgtcagccattat

SEQ ID NO: 162449 - DNA, 25 bp, Rattus norvegicus
agtggagggcttctgtcctccattg

SEQ ID NO: 162450 - DNA, 25 bp, Rattus norvegicus
agtggagggcttgtgtcctccattg

SEQ ID NO: 162451 - DNA, 25 bp, Rattus norvegicus
agtggaggtagccagatcttcccac

SEQ ID NO: 162452 - DNA, 25 bp, Rattus norvegicus
agtggaggtagcgagatcttcccac

SEQ ID NO: 162453 - DNA, 25 bp, Rattus norvegicus
agtggaggtccactgtgtttctaga

SEQ ID NO: 162454 - DNA, 25 bp, Rattus norvegicus
agtggaggtccagtgtgtttctaga

SEQ ID NO: 162455 - DNA, 25 bp, Rattus norvegicus
agtggagtcagactcgtcctcagct

SEQ ID NO: 162456 - DNA, 25 bp, Rattus norvegicus
agtggagtcagagtcgtcctcagct

SEQ ID NO: 162457 - DNA, 25 bp, Rattus norvegicus
agtggagtcgcacacatgaagttat

SEQ ID NO: 162458 - DNA, 25 bp, Rattus norvegicus
agtggagtcgcagacatgaagttat

SEQ ID NO: 162459 - DNA, 25 bp, Rattus norvegicus
agtggagtgtatcctatccctggtt

SEQ ID NO: 162460 - DNA, 25 bp, Rattus norvegicus
agtggagtgtatgctatccctggtt

SEQ ID NO: 162461 - DNA, 25 bp, Rattus norvegicus
agtggagtgtcccagccattgtctg

SEQ ID NO: 162462 - DNA, 25 bp, Rattus norvegicus
agtggagtgtccgagccattgtctg

SEQ ID NO: 162463 - DNA, 25 bp, Rattus norvegicus
agtggagtgtctcacaccctgccct

SEQ ID NO: 162464 - DNA, 25 bp, Rattus norvegicus
agtggagtgtctgacaccctgccct

SEQ ID NO: 162465 - DNA, 25 bp, Rattus norvegicus
agtggagttaaacgcgtgcttctaa

SEQ ID NO: 162466 - DNA, 25 bp, Rattus norvegicus
agtggagttaaaggcgtgcttctaa

SEQ ID NO: 162467 - DNA, 25 bp, Rattus norvegicus
agtggagtttgcagtacccttgtgt

SEQ ID NO: 162468 - DNA, 25 bp, Rattus norvegicus
agtggagtttgctgtacccttgtgt

SEQ ID NO: 162469 - DNA, 25 bp, Rattus norvegicus
agtggataaaccatcttccttgtgg

SEQ ID NO: 162470 - DNA, 25 bp, Rattus norvegicus
agtggataaaccttcttccttgtgg

SEQ ID NO: 162471 - DNA, 25 bp, Rattus norvegicus
agtggataacttcagacccttcttg

SEQ ID NO: 162472 - DNA, 25 bp, Rattus norvegicus
agtggataacttgagacccttcttg

SEQ ID NO: 162473 - DNA, 25 bp, Rattus norvegicus
agtggataagtcatggctctccagc

SEQ ID NO: 162474 - DNA, 25 bp, Rattus norvegicus
agtggataagtcttggctctccagc

SEQ ID NO: 162475 - DNA, 25 bp, Rattus norvegicus
agtggatagacacacctccagggcc

SEQ ID NO: 162476 - DNA, 25 bp, Rattus norvegicus
agtggatagacagacctccagggcc

SEQ ID NO: 162477 - DNA, 25 bp, Rattus norvegicus
agtggatatcccatcacagcataat

SEQ ID NO: 162478 - DNA, 25 bp, Rattus norvegicus
agtggatatcccttcacagcataat

SEQ ID NO: 162479 - DNA, 25 bp, Rattus norvegicus
agtggatatcttcccataattggag

SEQ ID NO: 162480 - DNA, 25 bp, Rattus norvegicus
agtggatatcttgccataattggag

SEQ ID NO: 162481 - DNA, 25 bp, Rattus norvegicus
agtggatcaagcaaagcccagctcc

SEQ ID NO: 162482 - DNA, 25 bp, Rattus norvegicus
agtggatcaagctaagcccagctcc

SEQ ID NO: 162483 - DNA, 25 bp, Rattus norvegicus
agtggatccacgagcccaagggcta

SEQ ID NO: 162484 - DNA, 25 bp, Rattus norvegicus
agtggatccacgtgcccaagggcta

SEQ ID NO: 162485 - DNA, 25 bp, Rattus norvegicus
agtggatcccatcggaacccaggtt

SEQ ID NO: 162486 - DNA, 25 bp, Rattus norvegicus
agtggatcccatgggaacccaggtt

SEQ ID NO: 162487 - DNA, 25 bp, Rattus norvegicus
agtggatccctgactattcaaaaag

SEQ ID NO: 162488 - DNA, 25 bp, Rattus norvegicus
agtggatccctgtctattcaaaaag

SEQ ID NO: 162489 - DNA, 25 bp, Rattus norvegicus
agtggatcctttagaggcccagtgg

SEQ ID NO: 162490 - DNA, 25 bp, Rattus norvegicus
agtggatccttttgaggcccagtgg

SEQ ID NO: 162491 - DNA, 25 bp, Rattus norvegicus
agtggatgaagcacctgggaagaca

SEQ ID NO: 162492 - DNA, 25 bp, Rattus norvegicus
agtggatgaagctcctgggaagaca

SEQ ID NO: 162493 - DNA, 25 bp, Rattus norvegicus
agtggatggcccaactgccacgaat

SEQ ID NO: 162494 - DNA, 25 bp, Rattus norvegicus
agtggatggccctactgccacgaat

SEQ ID NO: 162495 - DNA, 25 bp, Rattus norvegicus
agtggatgtcccaactcggcagaac

SEQ ID NO: 162496 - DNA, 25 bp, Rattus norvegicus
agtggatgtccctactcggcagaac

SEQ ID NO: 162497 - DNA, 25 bp, Rattus norvegicus
agtggatgttccagcatcctggcca

SEQ ID NO: 162498 - DNA, 25 bp, Rattus norvegicus
agtggatgttcctgcatcctggcca

SEQ ID NO: 162499 - DNA, 25 bp, Rattus norvegicus
agtggattacaaccggctaggctac

SEQ ID NO: 162500 - DNA, 25 bp, Rattus norvegicus
agtggattacaagcggctaggctac

SEQ ID NO: 162501 - DNA, 25 bp, Rattus norvegicus
agtggattacctcggtcttgatgac

SEQ ID NO: 162502 - DNA, 25 bp, Rattus norvegicus
agtggattacctgggtcttgatgac

SEQ ID NO: 162503 - DNA, 25 bp, Rattus norvegicus
agtggattctaacatgggctctgca

SEQ ID NO: 162504 - DNA, 25 bp, Rattus norvegicus
agtggattctaagatgggctctgca

SEQ ID NO: 162505 - DNA, 25 bp, Rattus norvegicus
agtggattgaggacgggatccccaa

SEQ ID NO: 162506 - DNA, 25 bp, Rattus norvegicus
agtggattgaggtcgggatccccaa

SEQ ID NO: 162507 - DNA, 25 bp, Rattus norvegicus
agtggattgcttcgtcagtagctaa

SEQ ID NO: 162508 - DNA, 25 bp, Rattus norvegicus
agtggattgcttggtcagtagctaa

SEQ ID NO: 162509 - DNA, 25 bp, Rattus norvegicus
agtggatttgtacatcttatggcga

SEQ ID NO: 162510 - DNA, 25 bp, Rattus norvegicus
agtggatttgtagatcttatggcga

SEQ ID NO: 162511 - DNA, 25 bp, Rattus norvegicus
agtggcaaatacctctctatcctgt

SEQ ID NO: 162512 - DNA, 25 bp, Rattus norvegicus
agtggcaaatacgtctctatcctgt

SEQ ID NO: 162513 - DNA, 25 bp, Rattus norvegicus
agtggcaacagcctgcccagtcctg

SEQ ID NO: 162514 - DNA, 25 bp, Rattus norvegicus
agtggcaacagcgtgcccagtcctg

SEQ ID NO: 162515 - DNA, 25 bp, Rattus norvegicus
agtggcaacagtaccaggccagtat

SEQ ID NO: 162516 - DNA, 25 bp, Rattus norvegicus
agtggcaacagttccaggccagtat

SEQ ID NO: 162517 - DNA, 25 bp, Rattus norvegicus
agtggcaaccctattgtggctgttc

SEQ ID NO: 162518 - DNA, 25 bp, Rattus norvegicus
agtggcaacccttttgtggctgttc

SEQ ID NO: 162519 - DNA, 25 bp, Rattus norvegicus
agtggcaacttcataggaccggatt

SEQ ID NO: 162520 - DNA, 25 bp, Rattus norvegicus
agtggcaacttcttaggaccggatt

SEQ ID NO: 162521 - DNA, 25 bp, Rattus norvegicus
agtggcaagcacctgcaggtcaccg

SEQ ID NO: 162522 - DNA, 25 bp, Rattus norvegicus
agtggcaagcacgtgcaggtcaccg

SEQ ID NO: 162523 - DNA, 25 bp, Rattus norvegicus
agtggcaagtctccaagcccaagga

SEQ ID NO: 162524 - DNA, 25 bp, Rattus norvegicus
agtggcaagtctgcaagcccaagga

SEQ ID NO: 162525 - DNA, 25 bp, Rattus norvegicus
agtggcaagttcacctgcaaggtac

SEQ ID NO: 162526 - DNA, 25 bp, Rattus norvegicus
agtggcaagttctcctgcaaggtac

SEQ ID NO: 162527 - DNA, 25 bp, Rattus norvegicus
agtggcaattccagagtagttagtt

SEQ ID NO: 162528 - DNA, 25 bp, Rattus norvegicus
agtggcaattcctgagtagttagtt

SEQ ID NO: 162529 - DNA, 25 bp, Rattus norvegicus
agtggcacaagtaccctgtatggtt

SEQ ID NO: 162530 - DNA, 25 bp, Rattus norvegicus
agtggcacaagttccctgtatggtt

SEQ ID NO: 162531 - DNA, 25 bp, Rattus norvegicus
agtggcacacatcctccatcaaggc

SEQ ID NO: 162532 - DNA, 25 bp, Rattus norvegicus
agtggcacacatgctccatcaaggc

SEQ ID NO: 162533 - DNA, 25 bp, Rattus norvegicus
agtggcacactgagcaaatctgcaa

SEQ ID NO: 162534 - DNA, 25 bp, Rattus norvegicus
agtggcacactgcttatttcagcag

SEQ ID NO: 162535 - DNA, 25 bp, Rattus norvegicus
agtggcacactggttatttcagcag

SEQ ID NO: 162536 - DNA, 25 bp, Rattus norvegicus
agtggcacactgtgcaaatctgcaa

SEQ ID NO: 162537 - DNA, 25 bp, Rattus norvegicus
agtggcacagctacatcaaattcaa

SEQ ID NO: 162538 - DNA, 25 bp, Rattus norvegicus
agtggcacagcttcatcaaattcaa

SEQ ID NO: 162539 - DNA, 25 bp, Rattus norvegicus
agtggcacagtgctaaccgggctcc

SEQ ID NO: 162540 - DNA, 25 bp, Rattus norvegicus
agtggcacagtggtaaccgggctcc

SEQ ID NO: 162541 - DNA, 25 bp, Rattus norvegicus
agtggcaccaagatgactcccagca

SEQ ID NO: 162542 - DNA, 25 bp, Rattus norvegicus
agtggcaccaagttgactcccagca

SEQ ID NO: 162543 - DNA, 25 bp, Rattus norvegicus
agtggcacctcaagtggccgtaaaa

SEQ ID NO: 162544 - DNA, 25 bp, Rattus norvegicus
agtggcacctcatgtggccgtaaaa

SEQ ID NO: 162545 - DNA, 25 bp, Rattus norvegicus
agtggcacctcgacccagtgaagaa

SEQ ID NO: 162546 - DNA, 25 bp, Rattus norvegicus
agtggcacctcgtcccagtgaagaa

SEQ ID NO: 162547 - DNA, 25 bp, Rattus norvegicus
agtggcacctgcactgaacaaatgt

SEQ ID NO: 162548 - DNA, 25 bp, Rattus norvegicus
agtggcacctgctctgaacaaatgt

SEQ ID NO: 162549 - DNA, 25 bp, Rattus norvegicus
agtggcacgcacctctcagaaggat

SEQ ID NO: 162550 - DNA, 25 bp, Rattus norvegicus
agtggcacgcacgtctcagaaggat

SEQ ID NO: 162551 - DNA, 25 bp, Rattus norvegicus
agtggcactcggaggcagtctccat

SEQ ID NO: 162552 - DNA, 25 bp, Rattus norvegicus
agtggcactcggtggcagtctccat

SEQ ID NO: 162553 - DNA, 25 bp, Rattus norvegicus
agtggcagaaagacctgtccagccc

SEQ ID NO: 162554 - DNA, 25 bp, Rattus norvegicus
agtggcagaaagtcctgtccagccc

SEQ ID NO: 162555 - DNA, 25 bp, Rattus norvegicus
agtggcagaccaagattgaagctca

SEQ ID NO: 162556 - DNA, 25 bp, Rattus norvegicus
agtggcagaccatgattgaagctca

SEQ ID NO: 162557 - DNA, 25 bp, Rattus norvegicus
agtggcagagccagcatcacggaca

SEQ ID NO: 162558 - DNA, 25 bp, Rattus norvegicus
agtggcagagcctgcatcacggaca

SEQ ID NO: 162559 - DNA, 25 bp, Rattus norvegicus
agtggcagaggtcttgcctagacca

SEQ ID NO: 162560 - DNA, 25 bp, Rattus norvegicus
agtggcagaggtgttgcctagacca

SEQ ID NO: 162561 - DNA, 25 bp, Rattus norvegicus
agtggcagattccaggacggctcca

SEQ ID NO: 162562 - DNA, 25 bp, Rattus norvegicus
agtggcagattcgaggacggctcca

SEQ ID NO: 162563 - DNA, 25 bp, Rattus norvegicus
agtggcagcaacaaccatgacagct

SEQ ID NO: 162564 - DNA, 25 bp, Rattus norvegicus
agtggcagcaactaccatgacagct

SEQ ID NO: 162565 - DNA, 25 bp, Rattus norvegicus
agtggcagccacacctggaaggaag

SEQ ID NO: 162566 - DNA, 25 bp, Rattus norvegicus
agtggcagccactcctggaaggaag

SEQ ID NO: 162567 - DNA, 25 bp, Rattus norvegicus
agtggcagccatacatcgttacctc

SEQ ID NO: 162568 - DNA, 25 bp, Rattus norvegicus
agtggcagccattcatcgttacctc

SEQ ID NO: 162569 - DNA, 25 bp, Rattus norvegicus
agtggcagcctaacctgtagcaaaa

SEQ ID NO: 162570 - DNA, 25 bp, Rattus norvegicus
agtggcagcctatcctgtagcaaaa

SEQ ID NO: 162571 - DNA, 25 bp, Rattus norvegicus
agtggcagcttccttcttcggtcag

SEQ ID NO: 162572 - DNA, 25 bp, Rattus norvegicus
agtggcagcttcgttcttcggtcag

SEQ ID NO: 162573 - DNA, 25 bp, Rattus norvegicus
agtggcagcttgcagaggtccttca

SEQ ID NO: 162574 - DNA, 25 bp, Rattus norvegicus
agtggcagcttggagaggtccttca

SEQ ID NO: 162575 - DNA, 25 bp, Rattus norvegicus
agtggcaggactaccagcagcactg

SEQ ID NO: 162576 - DNA, 25 bp, Rattus norvegicus
agtggcaggacttccagcagcactg

SEQ ID NO: 162577 - DNA, 25 bp, Rattus norvegicus
agtggcaggagcaaggtgtctaccc

SEQ ID NO: 162578 - DNA, 25 bp, Rattus norvegicus
agtggcaggagctaggtgtctaccc

SEQ ID NO: 162579 - DNA, 25 bp, Rattus norvegicus
agtggcagggctatttctgccatgc

SEQ ID NO: 162580 - DNA, 25 bp, Rattus norvegicus
agtggcagggctttttctgccatgc

SEQ ID NO: 162581 - DNA, 25 bp, Rattus norvegicus
agtggcaggtttagggcctctcatc

SEQ ID NO: 162582 - DNA, 25 bp, Rattus norvegicus
agtggcaggttttgggcctctcatc

SEQ ID NO: 162583 - DNA, 25 bp, Rattus norvegicus
agtggcagtacgagttcctcatagc

SEQ ID NO: 162584 - DNA, 25 bp, Rattus norvegicus
agtggcagtacgtgttcctcatagc

SEQ ID NO: 162585 - DNA, 25 bp, Rattus norvegicus
agtggcagtcccaagcagagaggtt

SEQ ID NO: 162586 - DNA, 25 bp, Rattus norvegicus
agtggcagtccctagcagagaggtt

SEQ ID NO: 162587 - DNA, 25 bp, Rattus norvegicus
agtggcagtgagcatttttcctttc

SEQ ID NO: 162588 - DNA, 25 bp, Rattus norvegicus
agtggcagtgaggatttttcctttc

SEQ ID NO: 162589 - DNA, 25 bp, Rattus norvegicus
agtggcagtgttccctatggcccat

SEQ ID NO: 162590 - DNA, 25 bp, Rattus norvegicus
agtggcagtgttgcctatggcccat

SEQ ID NO: 162591 - DNA, 25 bp, Rattus norvegicus
agtggcagttaacctgtacctccgt

SEQ ID NO: 162592 - DNA, 25 bp, Rattus norvegicus
agtggcagttaagctgtacctccgt

SEQ ID NO: 162593 - DNA, 25 bp, Rattus norvegicus
agtggcagtttcagtgctcacagga

SEQ ID NO: 162594 - DNA, 25 bp, Rattus norvegicus
agtggcagtttctgtgctcacagga

SEQ ID NO: 162595 - DNA, 25 bp, Rattus norvegicus
agtggcatacgtccatattataatg

SEQ ID NO: 162596 - DNA, 25 bp, Rattus norvegicus
agtggcatacgtgcatattataatg

SEQ ID NO: 162597 - DNA, 25 bp, Rattus norvegicus
agtggcatcaagacctttccagggt

SEQ ID NO: 162598 - DNA, 25 bp, Rattus norvegicus
agtggcatcaagtcctttccagggt

SEQ ID NO: 162599 - DNA, 25 bp, Rattus norvegicus
agtggcatcattaatagtcctgtaa

SEQ ID NO: 162600 - DNA, 25 bp, Rattus norvegicus
agtggcatcatttatagtcctgtaa

SEQ ID NO: 162601 - DNA, 25 bp, Rattus norvegicus
agtggcatgcctcccaagagacgaa

SEQ ID NO: 162602 - DNA, 25 bp, Rattus norvegicus
agtggcatgcctgccaagagacgaa

SEQ ID NO: 162603 - DNA, 25 bp, Rattus norvegicus
agtggcatgtgcatcaggaccctgg

SEQ ID NO: 162604 - DNA, 25 bp, Rattus norvegicus
agtggcatgtgcttcaggaccctgg

SEQ ID NO: 162605 - DNA, 25 bp, Rattus norvegicus
agtggcatgtttagtgcatttgtaa

SEQ ID NO: 162606 - DNA, 25 bp, Rattus norvegicus
agtggcatgttttgtgcatttgtaa

SEQ ID NO: 162607 - DNA, 25 bp, Rattus norvegicus
agtggcattagcaaccctccaggca

SEQ ID NO: 162608 - DNA, 25 bp, Rattus norvegicus
agtggcattagctaccctccaggca

SEQ ID NO: 162609 - DNA, 25 bp, Rattus norvegicus
agtggcattcacatttcgttcctag

SEQ ID NO: 162610 - DNA, 25 bp, Rattus norvegicus
agtggcattcacttttcgttcctag

SEQ ID NO: 162611 - DNA, 25 bp, Rattus norvegicus
agtggcattggaactacctcttcag

SEQ ID NO: 162612 - DNA, 25 bp, Rattus norvegicus
agtggcattggatctacctcttcag

SEQ ID NO: 162613 - DNA, 25 bp, Rattus norvegicus
agtggcattgttaccatccagcgtg

SEQ ID NO: 162614 - DNA, 25 bp, Rattus norvegicus
agtggcattgtttccatccagcgtg

SEQ ID NO: 162615 - DNA, 25 bp, Rattus norvegicus
agtggcatttaaccccgagcagagg

SEQ ID NO: 162616 - DNA, 25 bp, Rattus norvegicus
agtggcatttaagcccgagcagagg

SEQ ID NO: 162617 - DNA, 25 bp, Rattus norvegicus
agtggcatttatagtgaccgttaac

SEQ ID NO: 162618 - DNA, 25 bp, Rattus norvegicus
agtggcatttattgtgaccgttaac

SEQ ID NO: 162619 - DNA, 25 bp, Rattus norvegicus
agtggccaaatgaaatcctcctatg

SEQ ID NO: 162620 - DNA, 25 bp, Rattus norvegicus
agtggccaaatgtaatcctcctatg

SEQ ID NO: 162621 - DNA, 25 bp, Rattus norvegicus
agtggccaagataccgtcagcagaa

SEQ ID NO: 162622 - DNA, 25 bp, Rattus norvegicus
agtggccaagattccgtcagcagaa

SEQ ID NO: 162623 - DNA, 25 bp, Rattus norvegicus
agtggccaccccagagatattacct

SEQ ID NO: 162624 - DNA, 25 bp, Rattus norvegicus
agtggccacccctgagatattacct

SEQ ID NO: 162625 - DNA, 25 bp, Rattus norvegicus
agtggccaccgaacatggtccgtga

SEQ ID NO: 162626 - DNA, 25 bp, Rattus norvegicus
agtggccaccgatcatggtccgtga

SEQ ID NO: 162627 - DNA, 25 bp, Rattus norvegicus
agtggccacctgcttaaacctgcca

SEQ ID NO: 162628 - DNA, 25 bp, Rattus norvegicus
agtggccacctggttaaacctgcca

SEQ ID NO: 162629 - DNA, 25 bp, Rattus norvegicus
agtggccagagcagaagatcgaaca

SEQ ID NO: 162630 - DNA, 25 bp, Rattus norvegicus
agtggccagagctgaagatcgaaca

SEQ ID NO: 162631 - DNA, 25 bp, Rattus norvegicus
agtggccagagtagcactctccaaa

SEQ ID NO: 162632 - DNA, 25 bp, Rattus norvegicus
agtggccagagttgcactctccaaa

SEQ ID NO: 162633 - DNA, 25 bp, Rattus norvegicus
agtggccagcatatcagctgtggct

SEQ ID NO: 162634 - DNA, 25 bp, Rattus norvegicus
agtggccagcatttcagctgtggct

SEQ ID NO: 162635 - DNA, 25 bp, Rattus norvegicus
agtggccagcccaaaatacaaacga

SEQ ID NO: 162636 - DNA, 25 bp, Rattus norvegicus
agtggccagccctaaatacaaacga

SEQ ID NO: 162637 - DNA, 25 bp, Rattus norvegicus
agtggccagcggaaacaatgatcaa

SEQ ID NO: 162638 - DNA, 25 bp, Rattus norvegicus
agtggccagcggtaacaatgatcaa

SEQ ID NO: 162639 - DNA, 25 bp, Rattus norvegicus
agtggccaggacacaaccagtggtt

SEQ ID NO: 162640 - DNA, 25 bp, Rattus norvegicus
agtggccaggactcaaccagtggtt

SEQ ID NO: 162641 - DNA, 25 bp, Rattus norvegicus
agtggccaggccaactgactcaaag

SEQ ID NO: 162642 - DNA, 25 bp, Rattus norvegicus
agtggccaggcctactgactcaaag

SEQ ID NO: 162643 - DNA, 25 bp, Rattus norvegicus
agtggccagtgtagaaacttcttca

SEQ ID NO: 162644 - DNA, 25 bp, Rattus norvegicus
agtggccagtgttgaaacttcttca

SEQ ID NO: 162645 - DNA, 25 bp, Rattus norvegicus
agtggccatggcagtgtacaccagc

SEQ ID NO: 162646 - DNA, 25 bp, Rattus norvegicus
agtggccatggctgtgtacaccagc

SEQ ID NO: 162647 - DNA, 25 bp, Rattus norvegicus
agtggccatgtccttcaggaacaca

SEQ ID NO: 162648 - DNA, 25 bp, Rattus norvegicus
agtggccatgtcgttcaggaacaca

SEQ ID NO: 162649 - DNA, 25 bp, Rattus norvegicus
agtggccatttgatgtgtccctcag

SEQ ID NO: 162650 - DNA, 25 bp, Rattus norvegicus
agtggccatttgttgtgtccctcag

SEQ ID NO: 162651 - DNA, 25 bp, Rattus norvegicus
agtggcccaaagagtgctgtccctg

SEQ ID NO: 162652 - DNA, 25 bp, Rattus norvegicus
agtggcccaaagtgtgctgtccctg

SEQ ID NO: 162653 - DNA, 25 bp, Rattus norvegicus
agtggcccaactccgctgaagaaca

SEQ ID NO: 162654 - DNA, 25 bp, Rattus norvegicus
agtggcccaactgcgctgaagaaca

SEQ ID NO: 162655 - DNA, 25 bp, Rattus norvegicus
agtggcccacagaaccatgttggga

SEQ ID NO: 162656 - DNA, 25 bp, Rattus norvegicus
agtggcccacagacattgcgaaggc

SEQ ID NO: 162657 - DNA, 25 bp, Rattus norvegicus
agtggcccacagtaccatgttggga

SEQ ID NO: 162658 - DNA, 25 bp, Rattus norvegicus
agtggcccacagtcattgcgaaggc

SEQ ID NO: 162659 - DNA, 25 bp, Rattus norvegicus
agtggcccagacagatgcctttgga

SEQ ID NO: 162660 - DNA, 25 bp, Rattus norvegicus
agtggcccagactgatgcctttgga

SEQ ID NO: 162661 - DNA, 25 bp, Rattus norvegicus
agtggcccagccaaagaactgtcag

SEQ ID NO: 162662 - DNA, 25 bp, Rattus norvegicus
agtggcccagcctaagaactgtcag

SEQ ID NO: 162663 - DNA, 25 bp, Rattus norvegicus
agtggcccagttactgaaggctgca

SEQ ID NO: 162664 - DNA, 25 bp, Rattus norvegicus
agtggcccagtttctgaaggctgca

SEQ ID NO: 162665 - DNA, 25 bp, Rattus norvegicus
agtggcccattcaacttgccaagga

SEQ ID NO: 162666 - DNA, 25 bp, Rattus norvegicus
agtggcccattcatgtcactctata

SEQ ID NO: 162667 - DNA, 25 bp, Rattus norvegicus
agtggcccattctacttgccaagga

SEQ ID NO: 162668 - DNA, 25 bp, Rattus norvegicus
agtggcccattcttgtcactctata

SEQ ID NO: 162669 - DNA, 25 bp, Rattus norvegicus
agtggccccaagctacagagaacaa

SEQ ID NO: 162670 - DNA, 25 bp, Rattus norvegicus
agtggccccaaggtacagagaacaa

SEQ ID NO: 162671 - DNA, 25 bp, Rattus norvegicus
agtggccccagcaaggcctgtctgt

SEQ ID NO: 162672 - DNA, 25 bp, Rattus norvegicus
agtggccccagctaggcctgtctgt

SEQ ID NO: 162673 - DNA, 25 bp, Rattus norvegicus
agtggcccctacagaatgttcatag

SEQ ID NO: 162674 - DNA, 25 bp, Rattus norvegicus
agtggcccctactgaatgttcatag

SEQ ID NO: 162675 - DNA, 25 bp, Rattus norvegicus
agtggccccttcaattaccaagaga

SEQ ID NO: 162676 - DNA, 25 bp, Rattus norvegicus
agtggccccttctattaccaagaga

SEQ ID NO: 162677 - DNA, 25 bp, Rattus norvegicus
agtggcccgggtactgagtttcagc

SEQ ID NO: 162678 - DNA, 25 bp, Rattus norvegicus
agtggcccgggttctgagtttcagc

SEQ ID NO: 162679 - DNA, 25 bp, Rattus norvegicus
agtggccctaaaaactctcatgtct

SEQ ID NO: 162680 - DNA, 25 bp, Rattus norvegicus
agtggccctaaatactctcatgtct

SEQ ID NO: 162681 - DNA, 25 bp, Rattus norvegicus
agtggccctacccatctgtacaagg

SEQ ID NO: 162682 - DNA, 25 bp, Rattus norvegicus
agtggccctaccgatctgtacaagg

SEQ ID NO: 162683 - DNA, 25 bp, Rattus norvegicus
agtggccctgagcactgtcacagaa

SEQ ID NO: 162684 - DNA, 25 bp, Rattus norvegicus
agtggccctgaggactgtcacagaa

SEQ ID NO: 162685 - DNA, 25 bp, Rattus norvegicus
agtggccctgatctcagtagcccgt

SEQ ID NO: 162686 - DNA, 25 bp, Rattus norvegicus
agtggccctgatgtcagtagcccgt

SEQ ID NO: 162687 - DNA, 25 bp, Rattus norvegicus
agtggccctggaaaagcgagccaga

SEQ ID NO: 162688 - DNA, 25 bp, Rattus norvegicus
agtggccctggataagcgagccaga

SEQ ID NO: 162689 - DNA, 25 bp, Rattus norvegicus
agtggcccttttctggacactgggt

SEQ ID NO: 162690 - DNA, 25 bp, Rattus norvegicus
agtggcccttttgtggacactgggt

SEQ ID NO: 162691 - DNA, 25 bp, Rattus norvegicus
agtggccgcctcattagctggactg

SEQ ID NO: 162692 - DNA, 25 bp, Rattus norvegicus
agtggccgcctctttagctggactg

SEQ ID NO: 162693 - DNA, 25 bp, Rattus norvegicus
agtggcctaagaatggacctcccaa

SEQ ID NO: 162694 - DNA, 25 bp, Rattus norvegicus
agtggcctaagattggacctcccaa

SEQ ID NO: 162695 - DNA, 25 bp, Rattus norvegicus
agtggcctaagtctttgctgcaaag

SEQ ID NO: 162696 - DNA, 25 bp, Rattus norvegicus
agtggcctaagtgtttgctgcaaag

SEQ ID NO: 162697 - DNA, 25 bp, Rattus norvegicus
agtggcctactcctttcaagttgga

SEQ ID NO: 162698 - DNA, 25 bp, Rattus norvegicus
agtggcctactcgtttcaagttgga

SEQ ID NO: 162699 - DNA, 25 bp, Rattus norvegicus
agtggcctccagaaatacccagtga

SEQ ID NO: 162700 - DNA, 25 bp, Rattus norvegicus
agtggcctccagtaatacccagtga

SEQ ID NO: 162701 - DNA, 25 bp, Rattus norvegicus
agtggcctccccaagatggtgctta

SEQ ID NO: 162702 - DNA, 25 bp, Rattus norvegicus
agtggcctcccctagatggtgctta

SEQ ID NO: 162703 - DNA, 25 bp, Rattus norvegicus
agtggcctcgacccactggactctg

SEQ ID NO: 162704 - DNA, 25 bp, Rattus norvegicus
agtggcctcgacgcactggactctg

SEQ ID NO: 162705 - DNA, 25 bp, Rattus norvegicus
agtggcctctggagaccacacatac

SEQ ID NO: 162706 - DNA, 25 bp, Rattus norvegicus
agtggcctctggtgaccacacatac

SEQ ID NO: 162707 - DNA, 25 bp, Rattus norvegicus
agtggcctcttcaaaattcttggtc

SEQ ID NO: 162708 - DNA, 25 bp, Rattus norvegicus
agtggcctcttctaaattcttggtc

SEQ ID NO: 162709 - DNA, 25 bp, Rattus norvegicus
agtggcctcttgaaaatggacccta

SEQ ID NO: 162710 - DNA, 25 bp, Rattus norvegicus
agtggcctcttgtaaatggacccta

SEQ ID NO: 162711 - DNA, 25 bp, Rattus norvegicus
agtggcctgacaagtgtagtcttcc

SEQ ID NO: 162712 - DNA, 25 bp, Rattus norvegicus
agtggcctgacatgtgtagtcttcc

SEQ ID NO: 162713 - DNA, 25 bp, Rattus norvegicus
agtggcctgagcaaggtcactccac

SEQ ID NO: 162714 - DNA, 25 bp, Rattus norvegicus
agtggcctgagctaggtcactccac

SEQ ID NO: 162715 - DNA, 25 bp, Rattus norvegicus
agtggcctggaaccatttgatctgc

SEQ ID NO: 162716 - DNA, 25 bp, Rattus norvegicus
agtggcctggaagcatttgatctgc

SEQ ID NO: 162717 - DNA, 25 bp, Rattus norvegicus
agtggcctgtccagagttcgaattc

SEQ ID NO: 162718 - DNA, 25 bp, Rattus norvegicus
agtggcctgtcctgagttcgaattc

SEQ ID NO: 162719 - DNA, 25 bp, Rattus norvegicus
agtggccttcagattctcaagagct

SEQ ID NO: 162720 - DNA, 25 bp, Rattus norvegicus
agtggccttcagcttgggagccaat

SEQ ID NO: 162721 - DNA, 25 bp, Rattus norvegicus
agtggccttcaggttgggagccaat

SEQ ID NO: 162722 - DNA, 25 bp, Rattus norvegicus
agtggccttcagtttctcaagagct

SEQ ID NO: 162723 - DNA, 25 bp, Rattus norvegicus
agtggccttgatcctgaagctatgc

SEQ ID NO: 162724 - DNA, 25 bp, Rattus norvegicus
agtggccttgatgctgaagctatgc

SEQ ID NO: 162725 - DNA, 25 bp, Rattus norvegicus
agtggccttgtaactgcaactcccg

SEQ ID NO: 162726 - DNA, 25 bp, Rattus norvegicus
agtggccttgtatctgcaactcccg

SEQ ID NO: 162727 - DNA, 25 bp, Rattus norvegicus
agtggccttgttacacatatctgtt

SEQ ID NO: 162728 - DNA, 25 bp, Rattus norvegicus
agtggccttgtttcacatatctgtt

SEQ ID NO: 162729 - DNA, 25 bp, Rattus norvegicus
agtggcctttctagcatcgttatgt

SEQ ID NO: 162730 - DNA, 25 bp, Rattus norvegicus
agtggcctttctctcctaaattggg

SEQ ID NO: 162731 - DNA, 25 bp, Rattus norvegicus
agtggcctttctgtcctaaattggg

SEQ ID NO: 162732 - DNA, 25 bp, Rattus norvegicus
agtggcctttcttgcatcgttatgt

SEQ ID NO: 162733 - DNA, 25 bp, Rattus norvegicus
agtggcgacatgaactagagctgga

SEQ ID NO: 162734 - DNA, 25 bp, Rattus norvegicus
agtggcgacatgtactagagctgga

SEQ ID NO: 162735 - DNA, 25 bp, Rattus norvegicus
agtggcgactggcactgtgggccag

SEQ ID NO: 162736 - DNA, 25 bp, Rattus norvegicus
agtggcgactgggactgtgggccag

SEQ ID NO: 162737 - DNA, 25 bp, Rattus norvegicus
agtggcgaggccatttggcttcgac

SEQ ID NO: 162738 - DNA, 25 bp, Rattus norvegicus
agtggcgaggccttttggcttcgac

SEQ ID NO: 162739 - DNA, 25 bp, Rattus norvegicus
agtggcgcctatagaactaagtggc

SEQ ID NO: 162740 - DNA, 25 bp, Rattus norvegicus
agtggcgcctattgaactaagtggc

SEQ ID NO: 162741 - DNA, 25 bp, Rattus norvegicus
agtggcgtcagcattgcatcatgag

SEQ ID NO: 162742 - DNA, 25 bp, Rattus norvegicus
agtggcgtcagctttgcatcatgag

SEQ ID NO: 162743 - DNA, 25 bp, Rattus norvegicus
agtggcgtcccgagtggcgttcttc

SEQ ID NO: 162744 - DNA, 25 bp, Rattus norvegicus
agtggcgtcccgtgtggcgttcttc

SEQ ID NO: 162745 - DNA, 25 bp, Rattus norvegicus
agtggcgtggagaatactgtccgac

SEQ ID NO: 162746 - DNA, 25 bp, Rattus norvegicus
agtggcgtggagtatactgtccgac

SEQ ID NO: 162747 - DNA, 25 bp, Rattus norvegicus
agtggcgtttaaaccagctcaacaa

SEQ ID NO: 162748 - DNA, 25 bp, Rattus norvegicus
agtggcgtttaatccagctcaacaa

SEQ ID NO: 162749 - DNA, 25 bp, Rattus norvegicus
agtggctaactgctggcttttaaag

SEQ ID NO: 162750 - DNA, 25 bp, Rattus norvegicus
agtggctaactgcttgactcctcga

SEQ ID NO: 162751 - DNA, 25 bp, Rattus norvegicus
agtggctaactggtggcttttaaag

SEQ ID NO: 162752 - DNA, 25 bp, Rattus norvegicus
agtggctaactggttgactcctcga

SEQ ID NO: 162753 - DNA, 25 bp, Rattus norvegicus
agtggctacacccaacttagtatgc

SEQ ID NO: 162754 - DNA, 25 bp, Rattus norvegicus
agtggctacaccgaacttagtatgc

SEQ ID NO: 162755 - DNA, 25 bp, Rattus norvegicus
agtggctaccacctgggatgcagaa

SEQ ID NO: 162756 - DNA, 25 bp, Rattus norvegicus
agtggctaccacgtgggatgcagaa

SEQ ID NO: 162757 - DNA, 25 bp, Rattus norvegicus
agtggctaccagctcggaggacata

SEQ ID NO: 162758 - DNA, 25 bp, Rattus norvegicus
agtggctaccaggtcggaggacata

SEQ ID NO: 162759 - DNA, 25 bp, Rattus norvegicus
agtggctagcctcagtaactctaac

SEQ ID NO: 162760 - DNA, 25 bp, Rattus norvegicus
agtggctagcctgagtaactctaac

SEQ ID NO: 162761 - DNA, 25 bp, Rattus norvegicus
agtggctagtggctctgtgacaaaa

SEQ ID NO: 162762 - DNA, 25 bp, Rattus norvegicus
agtggctagtgggtctgtgacaaaa

SEQ ID NO: 162763 - DNA, 25 bp, Rattus norvegicus
agtggctatattattcctgatcccg

SEQ ID NO: 162764 - DNA, 25 bp, Rattus norvegicus
agtggctatatttttcctgatcccg

SEQ ID NO: 162765 - DNA, 25 bp, Rattus norvegicus
agtggctatgaaacccaggagctta

SEQ ID NO: 162766 - DNA, 25 bp, Rattus norvegicus
agtggctatgaatcccaggagctta

SEQ ID NO: 162767 - DNA, 25 bp, Rattus norvegicus
agtggctatgcaagggcgcttctgt

SEQ ID NO: 162768 - DNA, 25 bp, Rattus norvegicus
agtggctatgcatgggcgcttctgt

SEQ ID NO: 162769 - DNA, 25 bp, Rattus norvegicus
agtggctcaagaccctgaaggctat

SEQ ID NO: 162770 - DNA, 25 bp, Rattus norvegicus
agtggctcaagagcctgaaggctat

SEQ ID NO: 162771 - DNA, 25 bp, Rattus norvegicus
agtggctcacaactgaggactccag

SEQ ID NO: 162772 - DNA, 25 bp, Rattus norvegicus
agtggctcacaagtgaggactccag

SEQ ID NO: 162773 - DNA, 25 bp, Rattus norvegicus
agtggctcaggcattcttaaaacaa

SEQ ID NO: 162774 - DNA, 25 bp, Rattus norvegicus
agtggctcaggctttcttaaaacaa

SEQ ID NO: 162775 - DNA, 25 bp, Rattus norvegicus
agtggctcagggagatcattctcga

SEQ ID NO: 162776 - DNA, 25 bp, Rattus norvegicus
agtggctcagggtgatcattctcga

SEQ ID NO: 162777 - DNA, 25 bp, Rattus norvegicus
agtggctcagttcctgtccgtagta

SEQ ID NO: 162778 - DNA, 25 bp, Rattus norvegicus
agtggctcagttgctgtccgtagta

SEQ ID NO: 162779 - DNA, 25 bp, Rattus norvegicus
agtggctcatccattgaggagctgg

SEQ ID NO: 162780 - DNA, 25 bp, Rattus norvegicus
agtggctcatcctttgaggagctgg

SEQ ID NO: 162781 - DNA, 25 bp, Rattus norvegicus
agtggctccaccctgcaaacagact

SEQ ID NO: 162782 - DNA, 25 bp, Rattus norvegicus
agtggctccaccgtgcaaacagact

SEQ ID NO: 162783 - DNA, 25 bp, Rattus norvegicus
agtggctccagaacaccgtggtgta

SEQ ID NO: 162784 - DNA, 25 bp, Rattus norvegicus
agtggctccagatcaccgtggtgta

SEQ ID NO: 162785 - DNA, 25 bp, Rattus norvegicus
agtggctccagcacagttcacggtt

SEQ ID NO: 162786 - DNA, 25 bp, Rattus norvegicus
agtggctccagctcagttcacggtt

SEQ ID NO: 162787 - DNA, 25 bp, Rattus norvegicus
agtggctcccgtatcatggacacat

SEQ ID NO: 162788 - DNA, 25 bp, Rattus norvegicus
agtggctcccgtttcatggacacat

SEQ ID NO: 162789 - DNA, 25 bp, Rattus norvegicus
agtggctccctgagcagccaaggga

SEQ ID NO: 162790 - DNA, 25 bp, Rattus norvegicus
agtggctccctgtgcagccaaggga

SEQ ID NO: 162791 - DNA, 25 bp, Rattus norvegicus
agtggctccgagctcaacttggcat

SEQ ID NO: 162792 - DNA, 25 bp, Rattus norvegicus
agtggctccgaggtcaacttggcat

SEQ ID NO: 162793 - DNA, 25 bp, Rattus norvegicus
agtggctcctgcacagatagctttt

SEQ ID NO: 162794 - DNA, 25 bp, Rattus norvegicus
agtggctcctgctcagatagctttt

SEQ ID NO: 162795 - DNA, 25 bp, Rattus norvegicus
agtggctcctgtatggatgtccttc

SEQ ID NO: 162796 - DNA, 25 bp, Rattus norvegicus
agtggctcctgtttggatgtccttc

SEQ ID NO: 162797 - DNA, 25 bp, Rattus norvegicus
agtggctctcccacaatcgtggaac

SEQ ID NO: 162798 - DNA, 25 bp, Rattus norvegicus
agtggctctccctcaatcgtggaac

SEQ ID NO: 162799 - DNA, 25 bp, Rattus norvegicus
agtggctctcctatctttgcaggta

SEQ ID NO: 162800 - DNA, 25 bp, Rattus norvegicus
agtggctctcctttctttgcaggta

SEQ ID NO: 162801 - DNA, 25 bp, Rattus norvegicus
agtggctctcttccaataacatctc

SEQ ID NO: 162802 - DNA, 25 bp, Rattus norvegicus
agtggctctcttgcaataacatctc

SEQ ID NO: 162803 - DNA, 25 bp, Rattus norvegicus
agtggctctggaccctgagtcagtc

SEQ ID NO: 162804 - DNA, 25 bp, Rattus norvegicus
agtggctctggagcctgagtcagtc

SEQ ID NO: 162805 - DNA, 25 bp, Rattus norvegicus
agtggctctgggacatcatcgatga

SEQ ID NO: 162806 - DNA, 25 bp, Rattus norvegicus
agtggctctgggtcatcatcgatga

SEQ ID NO: 162807 - DNA, 25 bp, Rattus norvegicus
agtggctcttataagcgcagcttca

SEQ ID NO: 162808 - DNA, 25 bp, Rattus norvegicus
agtggctcttattagcgcagcttca

SEQ ID NO: 162809 - DNA, 25 bp, Rattus norvegicus
agtggctcttgcctgcatagtagaa

SEQ ID NO: 162810 - DNA, 25 bp, Rattus norvegicus
agtggctcttgcgtgcatagtagaa

SEQ ID NO: 162811 - DNA, 25 bp, Rattus norvegicus
agtggctgacacacagtggagcaga

SEQ ID NO: 162812 - DNA, 25 bp, Rattus norvegicus
agtggctgacactcagtggagcaga

SEQ ID NO: 162813 - DNA, 25 bp, Rattus norvegicus
agtggctgaggaattcttgtacgca

SEQ ID NO: 162814 - DNA, 25 bp, Rattus norvegicus
agtggctgaggatttcttgtacgca

SEQ ID NO: 162815 - DNA, 25 bp, Rattus norvegicus
agtggctgcagtacacagagttggc

SEQ ID NO: 162816 - DNA, 25 bp, Rattus norvegicus
agtggctgcagttcacagagttggc

SEQ ID NO: 162817 - DNA, 25 bp, Rattus norvegicus
agtggctgccagaacaagtgtgttt

SEQ ID NO: 162818 - DNA, 25 bp, Rattus norvegicus
agtggctgccagaagcagaatgttt

SEQ ID NO: 162819 - DNA, 25 bp, Rattus norvegicus
agtggctgccagtacaagtgtgttt

SEQ ID NO: 162820 - DNA, 25 bp, Rattus norvegicus
agtggctgccagtagcagaatgttt

SEQ ID NO: 162821 - DNA, 25 bp, Rattus norvegicus
agtggctgccccagagtggagatct

SEQ ID NO: 162822 - DNA, 25 bp, Rattus norvegicus
agtggctgcccctgagtggagatct

SEQ ID NO: 162823 - DNA, 25 bp, Rattus norvegicus
agtggctgcgtcaacaaatgaccct

SEQ ID NO: 162824 - DNA, 25 bp, Rattus norvegicus
agtggctgcgtctacaaatgaccct

SEQ ID NO: 162825 - DNA, 25 bp, Rattus norvegicus
agtggctgctatatggagccctcaa

SEQ ID NO: 162826 - DNA, 25 bp, Rattus norvegicus
agtggctgctatttggagccctcaa

SEQ ID NO: 162827 - DNA, 25 bp, Rattus norvegicus
agtggctgctcccttgagggtcctc

SEQ ID NO: 162828 - DNA, 25 bp, Rattus norvegicus
agtggctgctccgttgagggtcctc

SEQ ID NO: 162829 - DNA, 25 bp, Rattus norvegicus
agtggctgctctcaccaactatggt

SEQ ID NO: 162830 - DNA, 25 bp, Rattus norvegicus
agtggctgctctgaccaactatggt

SEQ ID NO: 162831 - DNA, 25 bp, Rattus norvegicus
agtggctgctttattctattgctgt

SEQ ID NO: 162832 - DNA, 25 bp, Rattus norvegicus
agtggctgcttttttctattgctgt

SEQ ID NO: 162833 - DNA, 25 bp, Rattus norvegicus
agtggctggagcaggatttcaaatg

SEQ ID NO: 162834 - DNA, 25 bp, Rattus norvegicus
agtggctggagctggatttcaaatg

SEQ ID NO: 162835 - DNA, 25 bp, Rattus norvegicus
agtggctggataaggccccatcgaa

SEQ ID NO: 162836 - DNA, 25 bp, Rattus norvegicus
agtggctggatatggccccatcgaa

SEQ ID NO: 162837 - DNA, 25 bp, Rattus norvegicus
agtggctgggtccatttgccgaaat

SEQ ID NO: 162838 - DNA, 25 bp, Rattus norvegicus
agtggctgggtcgatttgccgaaat

SEQ ID NO: 162839 - DNA, 25 bp, Rattus norvegicus
agtggctggtgaaaggacttcctta

SEQ ID NO: 162840 - DNA, 25 bp, Rattus norvegicus
agtggctggtgataggacttcctta

SEQ ID NO: 162841 - DNA, 25 bp, Rattus norvegicus
agtggctgtcacacaaatagatgca

SEQ ID NO: 162842 - DNA, 25 bp, Rattus norvegicus
agtggctgtcacacatcactttgtg

SEQ ID NO: 162843 - DNA, 25 bp, Rattus norvegicus
agtggctgtcactcaaatagatgca

SEQ ID NO: 162844 - DNA, 25 bp, Rattus norvegicus
agtggctgtcactcatcactttgtg

SEQ ID NO: 162845 - DNA, 25 bp, Rattus norvegicus
agtggctgtgagatctggactctca

SEQ ID NO: 162846 - DNA, 25 bp, Rattus norvegicus
agtggctgtgagttctggactctca

SEQ ID NO: 162847 - DNA, 25 bp, Rattus norvegicus
agtggctgtgcccagatgagtcctc

SEQ ID NO: 162848 - DNA, 25 bp, Rattus norvegicus
agtggctgtgccgagatgagtcctc

SEQ ID NO: 162849 - DNA, 25 bp, Rattus norvegicus
agtggctgtggcatgcttccaccaa

SEQ ID NO: 162850 - DNA, 25 bp, Rattus norvegicus
agtggctgtggcttgcttccaccaa

SEQ ID NO: 162851 - DNA, 25 bp, Rattus norvegicus
agtggctgtgggattcctgatgatc

SEQ ID NO: 162852 - DNA, 25 bp, Rattus norvegicus
agtggctgtgggtttcctgatgatc

SEQ ID NO: 162853 - DNA, 25 bp, Rattus norvegicus
agtggctgttatcgtcctcatcagg

SEQ ID NO: 162854 - DNA, 25 bp, Rattus norvegicus
agtggctgttatggtcctcatcagg

SEQ ID NO: 162855 - DNA, 25 bp, Rattus norvegicus
agtggctgttcaagctctgagttta

SEQ ID NO: 162856 - DNA, 25 bp, Rattus norvegicus
agtggctgttcatgctctgagttta

SEQ ID NO: 162857 - DNA, 25 bp, Rattus norvegicus
agtggctgttgcagaattgtcctca

SEQ ID NO: 162858 - DNA, 25 bp, Rattus norvegicus
agtggctgttgctgaattgtcctca

SEQ ID NO: 162859 - DNA, 25 bp, Rattus norvegicus
agtggcttaacactttgccgatcca

SEQ ID NO: 162860 - DNA, 25 bp, Rattus norvegicus
agtggcttaacagtttgccgatcca

SEQ ID NO: 162861 - DNA, 25 bp, Rattus norvegicus
agtggcttaaccctatttctgatcc

SEQ ID NO: 162862 - DNA, 25 bp, Rattus norvegicus
agtggcttaaccgtatttctgatcc

SEQ ID NO: 162863 - DNA, 25 bp, Rattus norvegicus
agtggcttaggacctgcttcttctg

SEQ ID NO: 162864 - DNA, 25 bp, Rattus norvegicus
agtggcttaggagctgcttcttctg

SEQ ID NO: 162865 - DNA, 25 bp, Rattus norvegicus
agtggcttcacaagctgtaccagga

SEQ ID NO: 162866 - DNA, 25 bp, Rattus norvegicus
agtggcttcacatgctgtaccagga

SEQ ID NO: 162867 - DNA, 25 bp, Rattus norvegicus
agtggcttcaccatggagctgcaat

SEQ ID NO: 162868 - DNA, 25 bp, Rattus norvegicus
agtggcttcaccttggagctgcaat

SEQ ID NO: 162869 - DNA, 25 bp, Rattus norvegicus
agtggcttcactattgagctggcct

SEQ ID NO: 162870 - DNA, 25 bp, Rattus norvegicus
agtggcttcacttttgagctggcct

SEQ ID NO: 162871 - DNA, 25 bp, Rattus norvegicus
agtggcttccacagtcttattcaga

SEQ ID NO: 162872 - DNA, 25 bp, Rattus norvegicus
agtggcttccactgtcttattcaga

SEQ ID NO: 162873 - DNA, 25 bp, Rattus norvegicus
agtggcttcctgagtaccatgctca

SEQ ID NO: 162874 - DNA, 25 bp, Rattus norvegicus
agtggcttcctgtgtaccatgctca

SEQ ID NO: 162875 - DNA, 25 bp, Rattus norvegicus
agtggcttcgtcacaggcttagtaa

SEQ ID NO: 162876 - DNA, 25 bp, Rattus norvegicus
agtggcttcgtctcaggcttagtaa

SEQ ID NO: 162877 - DNA, 25 bp, Rattus norvegicus
agtggcttctctctttttggtgtaa

SEQ ID NO: 162878 - DNA, 25 bp, Rattus norvegicus
agtggcttctctgtttttggtgtaa

SEQ ID NO: 162879 - DNA, 25 bp, Rattus norvegicus
agtggcttctgacctggtcttcctg

SEQ ID NO: 162880 - DNA, 25 bp, Rattus norvegicus
agtggcttctgagctggtcttcctg

SEQ ID NO: 162881 - DNA, 25 bp, Rattus norvegicus
agtggcttctggactggcgtctgtc

SEQ ID NO: 162882 - DNA, 25 bp, Rattus norvegicus
agtggcttctggtctggcgtctgtc

SEQ ID NO: 162883 - DNA, 25 bp, Rattus norvegicus
agtggcttcttcagcgtttttggaa

SEQ ID NO: 162884 - DNA, 25 bp, Rattus norvegicus
agtggcttcttctgcgtttttggaa

SEQ ID NO: 162885 - DNA, 25 bp, Rattus norvegicus
agtggcttgaatactacctacctgc

SEQ ID NO: 162886 - DNA, 25 bp, Rattus norvegicus
agtggcttgaattctacctacctgc

SEQ ID NO: 162887 - DNA, 25 bp, Rattus norvegicus
agtggcttgattagaccagagacaa

SEQ ID NO: 162888 - DNA, 25 bp, Rattus norvegicus
agtggcttgatttgaccagagacaa

SEQ ID NO: 162889 - DNA, 25 bp, Rattus norvegicus
agtggcttgcacagttgaactgtgt

SEQ ID NO: 162890 - DNA, 25 bp, Rattus norvegicus
agtggcttgcactgttgaactgtgt

SEQ ID NO: 162891 - DNA, 25 bp, Rattus norvegicus
agtggcttgctacttgtgactggac

SEQ ID NO: 162892 - DNA, 25 bp, Rattus norvegicus
agtggcttgctagttgtgactggac

SEQ ID NO: 162893 - DNA, 25 bp, Rattus norvegicus
agtggcttgtctacattactctgta

SEQ ID NO: 162894 - DNA, 25 bp, Rattus norvegicus
agtggcttgtcttcattactctgta

SEQ ID NO: 162895 - DNA, 25 bp, Rattus norvegicus
agtggcttgtgtatgtgacatcctg

SEQ ID NO: 162896 - DNA, 25 bp, Rattus norvegicus
agtggcttgtgtttgtgacatcctg

SEQ ID NO: 162897 - DNA, 25 bp, Rattus norvegicus
agtggcttgttcaagtggcttttac

SEQ ID NO: 162898 - DNA, 25 bp, Rattus norvegicus
agtggcttgttctagtggcttttac

SEQ ID NO: 162899 - DNA, 25 bp, Rattus norvegicus
agtggctttctcacaaacaagttat

SEQ ID NO: 162900 - DNA, 25 bp, Rattus norvegicus
agtggctttctctcaaacaagttat

SEQ ID NO: 162901 - DNA, 25 bp, Rattus norvegicus
agtggctttgctccaattgtcaggc

SEQ ID NO: 162902 - DNA, 25 bp, Rattus norvegicus
agtggctttgctgcaattgtcaggc

SEQ ID NO: 162903 - DNA, 25 bp, Rattus norvegicus
agtggctttggaactctgcattatg

SEQ ID NO: 162904 - DNA, 25 bp, Rattus norvegicus
agtggctttggatctctgcattatg

SEQ ID NO: 162905 - DNA, 25 bp, Rattus norvegicus
agtggctttgttcaccatttgcacc

SEQ ID NO: 162906 - DNA, 25 bp, Rattus norvegicus
agtggctttgttgaccatttgcacc

SEQ ID NO: 162907 - DNA, 25 bp, Rattus norvegicus
agtggcttttatactgtcctggtca

SEQ ID NO: 162908 - DNA, 25 bp, Rattus norvegicus
agtggcttttattctgtcctggtca

SEQ ID NO: 162909 - DNA, 25 bp, Rattus norvegicus
agtggcttttcaaactgtttctcct

SEQ ID NO: 162910 - DNA, 25 bp, Rattus norvegicus
agtggcttttcatactgtttctcct

SEQ ID NO: 162911 - DNA, 25 bp, Rattus norvegicus
agtggcttttggcagcagctcatcc

SEQ ID NO: 162912 - DNA, 25 bp, Rattus norvegicus
agtggcttttgggagcagctcatcc

SEQ ID NO: 162913 - DNA, 25 bp, Rattus norvegicus
agtgggaaacatcgtcaggacacga

SEQ ID NO: 162914 - DNA, 25 bp, Rattus norvegicus
agtgggaaacatggtcaggacacga

SEQ ID NO: 162915 - DNA, 25 bp, Rattus norvegicus
agtgggaaatatcgctcttatctac

SEQ ID NO: 162916 - DNA, 25 bp, Rattus norvegicus
agtgggaaatatggctcttatctac

SEQ ID NO: 162917 - DNA, 25 bp, Rattus norvegicus
agtgggaaccacagatctagttaat

SEQ ID NO: 162918 - DNA, 25 bp, Rattus norvegicus
agtgggaaccactgatctagttaat

SEQ ID NO: 162919 - DNA, 25 bp, Rattus norvegicus
agtgggaactggcagcatttctctc

SEQ ID NO: 162920 - DNA, 25 bp, Rattus norvegicus
agtgggaactgggagcatttctctc

SEQ ID NO: 162921 - DNA, 25 bp, Rattus norvegicus
agtgggaagatcaacagtcctgccc

SEQ ID NO: 162922 - DNA, 25 bp, Rattus norvegicus
agtgggaagatctacagtcctgccc

SEQ ID NO: 162923 - DNA, 25 bp, Rattus norvegicus
agtgggaatcagaacatagaaacaa

SEQ ID NO: 162924 - DNA, 25 bp, Rattus norvegicus
agtgggaatcagtacatagaaacaa

SEQ ID NO: 162925 - DNA, 25 bp, Rattus norvegicus
agtgggaatctcagaggctcttaga

SEQ ID NO: 162926 - DNA, 25 bp, Rattus norvegicus
agtgggaatctctgaggctcttaga

SEQ ID NO: 162927 - DNA, 25 bp, Rattus norvegicus
agtgggacagccatgctcactcagt

SEQ ID NO: 162928 - DNA, 25 bp, Rattus norvegicus
agtgggacagccttgctcactcagt

SEQ ID NO: 162929 - DNA, 25 bp, Rattus norvegicus
agtgggacagtcagctaacttctgc

SEQ ID NO: 162930 - DNA, 25 bp, Rattus norvegicus
agtgggacagtctgctaacttctgc

SEQ ID NO: 162931 - DNA, 25 bp, Rattus norvegicus
agtgggaccgctactagtgtgagct

SEQ ID NO: 162932 - DNA, 25 bp, Rattus norvegicus
agtgggaccgcttctagtgtgagct

SEQ ID NO: 162933 - DNA, 25 bp, Rattus norvegicus
agtgggactgacaatacacacctcc

SEQ ID NO: 162934 - DNA, 25 bp, Rattus norvegicus
agtgggactgactatacacacctcc

SEQ ID NO: 162935 - DNA, 25 bp, Rattus norvegicus
agtgggacttccatgacagcttctt

SEQ ID NO: 162936 - DNA, 25 bp, Rattus norvegicus
agtgggacttccttgacagcttctt

SEQ ID NO: 162937 - DNA, 25 bp, Rattus norvegicus
agtgggacttttcttctgatcttca

SEQ ID NO: 162938 - DNA, 25 bp, Rattus norvegicus
agtgggacttttgttctgatcttca

SEQ ID NO: 162939 - DNA, 25 bp, Rattus norvegicus
agtgggagaagacccctgccatcag

SEQ ID NO: 162940 - DNA, 25 bp, Rattus norvegicus
agtgggagaagagccctgccatcag

SEQ ID NO: 162941 - DNA, 25 bp, Rattus norvegicus
agtgggagaccccaaacactgtcct

SEQ ID NO: 162942 - DNA, 25 bp, Rattus norvegicus
agtgggagacccgaaacactgtcct

SEQ ID NO: 162943 - DNA, 25 bp, Rattus norvegicus
agtgggagaggcctttaccatcctc

SEQ ID NO: 162944 - DNA, 25 bp, Rattus norvegicus
agtgggagaggcgtttaccatcctc

SEQ ID NO: 162945 - DNA, 25 bp, Rattus norvegicus
agtgggaggaacatcagctctcgcg

SEQ ID NO: 162946 - DNA, 25 bp, Rattus norvegicus
agtgggaggaacttcagctctcgcg

SEQ ID NO: 162947 - DNA, 25 bp, Rattus norvegicus
agtgggaggactcgactccgtccac

SEQ ID NO: 162948 - DNA, 25 bp, Rattus norvegicus
agtgggaggactggactccgtccac

SEQ ID NO: 162949 - DNA, 25 bp, Rattus norvegicus
agtgggaggccacgcccttagcaaa

SEQ ID NO: 162950 - DNA, 25 bp, Rattus norvegicus
agtgggaggccaggcccttagcaaa

SEQ ID NO: 162951 - DNA, 25 bp, Rattus norvegicus
agtgggaggcccatcggaacctgtc

SEQ ID NO: 162952 - DNA, 25 bp, Rattus norvegicus
agtgggaggcccttcggaacctgtc

SEQ ID NO: 162953 - DNA, 25 bp, Rattus norvegicus
agtgggagggcaactccacattttc

SEQ ID NO: 162954 - DNA, 25 bp, Rattus norvegicus
agtgggagggcatctccacattttc

SEQ ID NO: 162955 - DNA, 25 bp, Rattus norvegicus
agtgggagtgaaagacttctgtcca

SEQ ID NO: 162956 - DNA, 25 bp, Rattus norvegicus
agtgggagtgaatgacttctgtcca

SEQ ID NO: 162957 - DNA, 25 bp, Rattus norvegicus
agtgggagtgccatccaccctgaag

SEQ ID NO: 162958 - DNA, 25 bp, Rattus norvegicus
agtgggagtgccttccaccctgaag

SEQ ID NO: 162959 - DNA, 25 bp, Rattus norvegicus
agtgggataagaaccgtgcctgccc

SEQ ID NO: 162960 - DNA, 25 bp, Rattus norvegicus
agtgggataagatccgtgcctgccc

SEQ ID NO: 162961 - DNA, 25 bp, Rattus norvegicus
agtgggatcaccatttgtgccatct

SEQ ID NO: 162962 - DNA, 25 bp, Rattus norvegicus
agtgggatcaccttttgtgccatct

SEQ ID NO: 162963 - DNA, 25 bp, Rattus norvegicus
agtgggatccagatctttctttcca

SEQ ID NO: 162964 - DNA, 25 bp, Rattus norvegicus
agtgggatccagttctttctttcca

SEQ ID NO: 162965 - DNA, 25 bp, Rattus norvegicus
agtgggatgactctgtgcccaagct

SEQ ID NO: 162966 - DNA, 25 bp, Rattus norvegicus
agtgggatgactgtgtgcccaagct

SEQ ID NO: 162967 - DNA, 25 bp, Rattus norvegicus
agtgggatgtgtagctctcatctaa

SEQ ID NO: 162968 - DNA, 25 bp, Rattus norvegicus
agtgggatgtgttgctctcatctaa

SEQ ID NO: 162969 - DNA, 25 bp, Rattus norvegicus
agtgggattgatctctgtctagcct

SEQ ID NO: 162970 - DNA, 25 bp, Rattus norvegicus
agtgggattgatgtctgtctagcct

SEQ ID NO: 162971 - DNA, 25 bp, Rattus norvegicus
agtgggcaaaacctctacagctggc

SEQ ID NO: 162972 - DNA, 25 bp, Rattus norvegicus
agtgggcaaaacgtctacagctggc

SEQ ID NO: 162973 - DNA, 25 bp, Rattus norvegicus
agtgggcaaccacttttccctagct

SEQ ID NO: 162974 - DNA, 25 bp, Rattus norvegicus
agtgggcaaccagttttccctagct

SEQ ID NO: 162975 - DNA, 25 bp, Rattus norvegicus
agtgggcaagctcttgttctgcaga

SEQ ID NO: 162976 - DNA, 25 bp, Rattus norvegicus
agtgggcaagctgttgttctgcaga

SEQ ID NO: 162977 - DNA, 25 bp, Rattus norvegicus
agtgggcaccagaaggccgttgctt

SEQ ID NO: 162978 - DNA, 25 bp, Rattus norvegicus
agtgggcaccagtaggccgttgctt

SEQ ID NO: 162979 - DNA, 25 bp, Rattus norvegicus
agtgggcacctaacagtttctggct

SEQ ID NO: 162980 - DNA, 25 bp, Rattus norvegicus
agtgggcacctatcagtttctggct

SEQ ID NO: 162981 - DNA, 25 bp, Rattus norvegicus
agtgggcacctgagcgtgtaaagac

SEQ ID NO: 162982 - DNA, 25 bp, Rattus norvegicus
agtgggcacctgtgcgtgtaaagac

SEQ ID NO: 162983 - DNA, 25 bp, Rattus norvegicus
agtgggcacgctacgaagccgagaa

SEQ ID NO: 162984 - DNA, 25 bp, Rattus norvegicus
agtgggcacgcttcgaagccgagaa

SEQ ID NO: 162985 - DNA, 25 bp, Rattus norvegicus
agtgggcagcacaccctggtattgc

SEQ ID NO: 162986 - DNA, 25 bp, Rattus norvegicus
agtgggcagcactccctggtattgc

SEQ ID NO: 162987 - DNA, 25 bp, Rattus norvegicus
agtgggcaggctcctgttttactgc

SEQ ID NO: 162988 - DNA, 25 bp, Rattus norvegicus
agtgggcaggctgctgttttactgc

SEQ ID NO: 162989 - DNA, 25 bp, Rattus norvegicus
agtgggcaggtccacctgtctgtct

SEQ ID NO: 162990 - DNA, 25 bp, Rattus norvegicus
agtgggcaggtcgacctgtctgtct

SEQ ID NO: 162991 - DNA, 25 bp, Rattus norvegicus
agtgggcagtccagaggctctcttc

SEQ ID NO: 162992 - DNA, 25 bp, Rattus norvegicus
agtgggcagtcctgaggctctcttc

SEQ ID NO: 162993 - DNA, 25 bp, Rattus norvegicus
agtgggcatacaacaagcatacaag

SEQ ID NO: 162994 - DNA, 25 bp, Rattus norvegicus
agtgggcatacatcaagcatacaag

SEQ ID NO: 162995 - DNA, 25 bp, Rattus norvegicus
agtgggcatgacagtgtctggcctc

SEQ ID NO: 162996 - DNA, 25 bp, Rattus norvegicus
agtgggcatgactgtgtctggcctc

SEQ ID NO: 162997 - DNA, 25 bp, Rattus norvegicus
agtgggcattagataaatcctggga

SEQ ID NO: 162998 - DNA, 25 bp, Rattus norvegicus
agtgggcattagttaaatcctggga

SEQ ID NO: 162999 - DNA, 25 bp, Rattus norvegicus
agtgggcattgcatccatgtggatg

SEQ ID NO: 163000 - DNA, 25 bp, Rattus norvegicus
agtgggcattgcttccatgtggatg

SEQ ID NO: 163001 - DNA, 25 bp, Rattus norvegicus
agtgggccaccaatgagcagctgtg

SEQ ID NO: 163002 - DNA, 25 bp, Rattus norvegicus
agtgggccaccattgagcagctgtg

SEQ ID NO: 163003 - DNA, 25 bp, Rattus norvegicus
agtgggccaccccagatgtgttcaa

SEQ ID NO: 163004 - DNA, 25 bp, Rattus norvegicus
agtgggccacccgagatgtgttcaa

SEQ ID NO: 163005 - DNA, 25 bp, Rattus norvegicus
agtgggccactgacttgacttggaa

SEQ ID NO: 163006 - DNA, 25 bp, Rattus norvegicus
agtgggccactgtcttgacttggaa

SEQ ID NO: 163007 - DNA, 25 bp, Rattus norvegicus
agtgggccagacatgcttatagcta

SEQ ID NO: 163008 - DNA, 25 bp, Rattus norvegicus
agtgggccagacttgcttatagcta

SEQ ID NO: 163009 - DNA, 25 bp, Rattus norvegicus
agtgggccagccagaaggtgacatt

SEQ ID NO: 163010 - DNA, 25 bp, Rattus norvegicus
agtgggccagcctgaaggtgacatt

SEQ ID NO: 163011 - DNA, 25 bp, Rattus norvegicus
agtgggccaggtacacacttttcat

SEQ ID NO: 163012 - DNA, 25 bp, Rattus norvegicus
agtgggccaggttcacacttttcat

SEQ ID NO: 163013 - DNA, 25 bp, Rattus norvegicus
agtgggccagtactaactcgttcag

SEQ ID NO: 163014 - DNA, 25 bp, Rattus norvegicus
agtgggccagtagtaactcgttcag

SEQ ID NO: 163015 - DNA, 25 bp, Rattus norvegicus
agtgggcccagtcacaaccaagaat

SEQ ID NO: 163016 - DNA, 25 bp, Rattus norvegicus
agtgggcccagtgacaaccaagaat

SEQ ID NO: 163017 - DNA, 25 bp, Rattus norvegicus
agtgggcccctcctaatgagtctga

SEQ ID NO: 163018 - DNA, 25 bp, Rattus norvegicus
agtgggcccctcgtaatgagtctga

SEQ ID NO: 163019 - DNA, 25 bp, Rattus norvegicus
agtgggccccttaggagtctctcag

SEQ ID NO: 163020 - DNA, 25 bp, Rattus norvegicus
agtgggcccctttggagtctctcag

SEQ ID NO: 163021 - DNA, 25 bp, Rattus norvegicus
agtgggcccgcaagctgagccgcaa

SEQ ID NO: 163022 - DNA, 25 bp, Rattus norvegicus
agtgggcccgcatgctgagccgcaa

SEQ ID NO: 163023 - DNA, 25 bp, Rattus norvegicus
agtgggcccttgcagaagctgacct

SEQ ID NO: 163024 - DNA, 25 bp, Rattus norvegicus
agtgggcccttggagaagctgacct

SEQ ID NO: 163025 - DNA, 25 bp, Rattus norvegicus
agtgggccgtgtacaggactttttg

SEQ ID NO: 163026 - DNA, 25 bp, Rattus norvegicus
agtgggccgtgttcaggactttttg

SEQ ID NO: 163027 - DNA, 25 bp, Rattus norvegicus
agtgggcctatcaacttcactgtct

SEQ ID NO: 163028 - DNA, 25 bp, Rattus norvegicus
agtgggcctatctacttcactgtct

SEQ ID NO: 163029 - DNA, 25 bp, Rattus norvegicus
agtgggcctgtcagtggagcaccac

SEQ ID NO: 163030 - DNA, 25 bp, Rattus norvegicus
agtgggcctgtctgtggagcaccac

SEQ ID NO: 163031 - DNA, 25 bp, Rattus norvegicus
agtgggcctttccagagtcatgatc

SEQ ID NO: 163032 - DNA, 25 bp, Rattus norvegicus
agtgggcctttcgagagtcatgatc

SEQ ID NO: 163033 - DNA, 25 bp, Rattus norvegicus
agtgggcggcgcctcgggctgggtc

SEQ ID NO: 163034 - DNA, 25 bp, Rattus norvegicus
agtgggcggcgcgtcgggctgggtc

SEQ ID NO: 163035 - DNA, 25 bp, Rattus norvegicus
agtgggcgtaggaactcataagctt

SEQ ID NO: 163036 - DNA, 25 bp, Rattus norvegicus
agtgggcgtaggtactcataagctt

SEQ ID NO: 163037 - DNA, 25 bp, Rattus norvegicus
agtgggctacacatggtctaagaaa

SEQ ID NO: 163038 - DNA, 25 bp, Rattus norvegicus
agtgggctacacttggtctaagaaa

SEQ ID NO: 163039 - DNA, 25 bp, Rattus norvegicus
agtgggctaggccaatgcgactcta

SEQ ID NO: 163040 - DNA, 25 bp, Rattus norvegicus
agtgggctaggcgaatgcgactcta

SEQ ID NO: 163041 - DNA, 25 bp, Rattus norvegicus
agtgggctagggaccagcagctttt

SEQ ID NO: 163042 - DNA, 25 bp, Rattus norvegicus
agtgggctagggtccagcagctttt

SEQ ID NO: 163043 - DNA, 25 bp, Rattus norvegicus
agtgggctatgtcctgttttatctc

SEQ ID NO: 163044 - DNA, 25 bp, Rattus norvegicus
agtgggctatgtgctgttttatctc

SEQ ID NO: 163045 - DNA, 25 bp, Rattus norvegicus
agtgggctcaatatagtgtctgggt

SEQ ID NO: 163046 - DNA, 25 bp, Rattus norvegicus
agtgggctcaatttagtgtctgggt

SEQ ID NO: 163047 - DNA, 25 bp, Rattus norvegicus
agtgggctcacgacatgggctttgc

SEQ ID NO: 163048 - DNA, 25 bp, Rattus norvegicus
agtgggctcacgtcatgggctttgc

SEQ ID NO: 163049 - DNA, 25 bp, Rattus norvegicus
agtgggctcattcggatcccagaaa

SEQ ID NO: 163050 - DNA, 25 bp, Rattus norvegicus
agtgggctcattgggatcccagaaa

SEQ ID NO: 163051 - DNA, 25 bp, Rattus norvegicus
agtgggctctgtcttggaatcctgt

SEQ ID NO: 163052 - DNA, 25 bp, Rattus norvegicus
agtgggctctgtgttggaatcctgt

SEQ ID NO: 163053 - DNA, 25 bp, Rattus norvegicus
agtgggctggctaccatgcacgatg

SEQ ID NO: 163054 - DNA, 25 bp, Rattus norvegicus
agtgggctggcttccatgcacgatg

SEQ ID NO: 163055 - DNA, 25 bp, Rattus norvegicus
agtgggcttattatgatttctcatc

SEQ ID NO: 163056 - DNA, 25 bp, Rattus norvegicus
agtgggcttattttgatttctcatc

SEQ ID NO: 163057 - DNA, 25 bp, Rattus norvegicus
agtgggcttcatagtgacattttat

SEQ ID NO: 163058 - DNA, 25 bp, Rattus norvegicus
agtgggcttcattgtgacattttat

SEQ ID NO: 163059 - DNA, 25 bp, Rattus norvegicus
agtgggcttcccaagacagctccag

SEQ ID NO: 163060 - DNA, 25 bp, Rattus norvegicus
agtgggcttccctagacagctccag

SEQ ID NO: 163061 - DNA, 25 bp, Rattus norvegicus
agtgggcttggcattcctggtagta

SEQ ID NO: 163062 - DNA, 25 bp, Rattus norvegicus
agtgggcttggctttcctggtagta

SEQ ID NO: 163063 - DNA, 25 bp, Rattus norvegicus
agtgggctttgaaacgtgtgcttac

SEQ ID NO: 163064 - DNA, 25 bp, Rattus norvegicus
agtgggctttgatacgtgtgcttac

SEQ ID NO: 163065 - DNA, 25 bp, Rattus norvegicus
agtgggtaagtacacctctgcccct

SEQ ID NO: 163066 - DNA, 25 bp, Rattus norvegicus
agtgggtaagtagacctctgcccct

SEQ ID NO: 163067 - DNA, 25 bp, Rattus norvegicus
agtgggtaatgcagctgtctagctc

SEQ ID NO: 163068 - DNA, 25 bp, Rattus norvegicus
agtgggtaatgctgctgtctagctc

SEQ ID NO: 163069 - DNA, 25 bp, Rattus norvegicus
agtgggtaccgaagctgtcatttat

SEQ ID NO: 163070 - DNA, 25 bp, Rattus norvegicus
agtgggtaccgacgcttcaccaaag

SEQ ID NO: 163071 - DNA, 25 bp, Rattus norvegicus
agtgggtaccgaggcttcaccaaag

SEQ ID NO: 163072 - DNA, 25 bp, Rattus norvegicus
agtgggtaccgatgctgtcatttat

SEQ ID NO: 163073 - DNA, 25 bp, Rattus norvegicus
agtgggtagctcagtcgacgtcatt

SEQ ID NO: 163074 - DNA, 25 bp, Rattus norvegicus
agtgggtagctctgtcgacgtcatt

SEQ ID NO: 163075 - DNA, 25 bp, Rattus norvegicus
agtgggtatagcacagcacctcgtc

SEQ ID NO: 163076 - DNA, 25 bp, Rattus norvegicus
agtgggtatagctcagcacctcgtc

SEQ ID NO: 163077 - DNA, 25 bp, Rattus norvegicus
agtgggtatcatcgccatggcttct

SEQ ID NO: 163078 - DNA, 25 bp, Rattus norvegicus
agtgggtatcatggccatggcttct

SEQ ID NO: 163079 - DNA, 25 bp, Rattus norvegicus
agtgggtcaatgctctcatcctgaa

SEQ ID NO: 163080 - DNA, 25 bp, Rattus norvegicus
agtgggtcaatggtctcatcctgaa

SEQ ID NO: 163081 - DNA, 25 bp, Rattus norvegicus
agtgggtcagcacatccacagcgtt

SEQ ID NO: 163082 - DNA, 25 bp, Rattus norvegicus
agtgggtcagcagatccacagcgtt

SEQ ID NO: 163083 - DNA, 25 bp, Rattus norvegicus
agtgggtccccaatagctgggtgta

SEQ ID NO: 163084 - DNA, 25 bp, Rattus norvegicus
agtgggtccccattagctgggtgta

SEQ ID NO: 163085 - DNA, 25 bp, Rattus norvegicus
agtgggtcctacagcaaggcatctc

SEQ ID NO: 163086 - DNA, 25 bp, Rattus norvegicus
agtgggtcctactgcaaggcatctc

SEQ ID NO: 163087 - DNA, 25 bp, Rattus norvegicus
agtgggtcctggatggctcagactt

SEQ ID NO: 163088 - DNA, 25 bp, Rattus norvegicus
agtgggtcctggttggctcagactt

SEQ ID NO: 163089 - DNA, 25 bp, Rattus norvegicus
agtgggtcgcgtccaccggctgctg

SEQ ID NO: 163090 - DNA, 25 bp, Rattus norvegicus
agtgggtcgcgtgcaccggctgctg

SEQ ID NO: 163091 - DNA, 25 bp, Rattus norvegicus
agtgggtctgtactctatgcttgga

SEQ ID NO: 163092 - DNA, 25 bp, Rattus norvegicus
agtgggtctgtagtctatgcttgga

SEQ ID NO: 163093 - DNA, 25 bp, Rattus norvegicus
agtgggtcttggagggctcaaattt

SEQ ID NO: 163094 - DNA, 25 bp, Rattus norvegicus
agtgggtcttggtgggctcaaattt

SEQ ID NO: 163095 - DNA, 25 bp, Rattus norvegicus
agtgggtgaaggagcccctgctaac

SEQ ID NO: 163096 - DNA, 25 bp, Rattus norvegicus
agtgggtgaaggtgcccctgctaac

SEQ ID NO: 163097 - DNA, 25 bp, Rattus norvegicus
agtgggtgacgtagaggccctctcc

SEQ ID NO: 163098 - DNA, 25 bp, Rattus norvegicus
agtgggtgacgttgaggccctctcc

SEQ ID NO: 163099 - DNA, 25 bp, Rattus norvegicus
agtgggtgcagtccgcttctgtcac

SEQ ID NO: 163100 - DNA, 25 bp, Rattus norvegicus
agtgggtgcagtgcgcttctgtcac

SEQ ID NO: 163101 - DNA, 25 bp, Rattus norvegicus
agtgggtgccccagaaagcagtgcc

SEQ ID NO: 163102 - DNA, 25 bp, Rattus norvegicus
agtgggtgcccctgaaagcagtgcc

SEQ ID NO: 163103 - DNA, 25 bp, Rattus norvegicus
agtgggtgcttcagagtctgctcat

SEQ ID NO: 163104 - DNA, 25 bp, Rattus norvegicus
agtgggtgcttctgagtctgctcat

SEQ ID NO: 163105 - DNA, 25 bp, Rattus norvegicus
agtgggtgtacaccaatgccttcca

SEQ ID NO: 163106 - DNA, 25 bp, Rattus norvegicus
agtgggtgtacagcaatgccttcca

SEQ ID NO: 163107 - DNA, 25 bp, Rattus norvegicus
agtgggtgtagcacgggatccaaca

SEQ ID NO: 163108 - DNA, 25 bp, Rattus norvegicus
agtgggtgtagctcgggatccaaca

SEQ ID NO: 163109 - DNA, 25 bp, Rattus norvegicus
agtgggtgtcgtactccaaggagac

SEQ ID NO: 163110 - DNA, 25 bp, Rattus norvegicus
agtgggtgtcgttctccaaggagac

SEQ ID NO: 163111 - DNA, 25 bp, Rattus norvegicus
agtgggttatgaaccaaccaggtat

SEQ ID NO: 163112 - DNA, 25 bp, Rattus norvegicus
agtgggttatgatccaaccaggtat

SEQ ID NO: 163113 - DNA, 25 bp, Rattus norvegicus
agtgggttccgcatggtctccaatt

SEQ ID NO: 163114 - DNA, 25 bp, Rattus norvegicus
agtgggttccgcttggtctccaatt

SEQ ID NO: 163115 - DNA, 25 bp, Rattus norvegicus
agtgggttcctcagagacctgctgc

SEQ ID NO: 163116 - DNA, 25 bp, Rattus norvegicus
agtgggttcctctgagacctgctgc

SEQ ID NO: 163117 - DNA, 25 bp, Rattus norvegicus
agtgggttgtggaatgcacctttaa

SEQ ID NO: 163118 - DNA, 25 bp, Rattus norvegicus
agtgggttgtggtatgcacctttaa

SEQ ID NO: 163119 - DNA, 25 bp, Rattus norvegicus
agtgggtttcagctactgtacctgg

SEQ ID NO: 163120 - DNA, 25 bp, Rattus norvegicus
agtgggtttcaggtactgtacctgg

SEQ ID NO: 163121 - DNA, 25 bp, Rattus norvegicus
agtgggttttaaactctgggcaaat

SEQ ID NO: 163122 - DNA, 25 bp, Rattus norvegicus
agtgggttttaatctctgggcaaat

SEQ ID NO: 163123 - DNA, 25 bp, Rattus norvegicus
agtggtaaggacaccatctgatgta

SEQ ID NO: 163124 - DNA, 25 bp, Rattus norvegicus
agtggtaaggactccatctgatgta

SEQ ID NO: 163125 - DNA, 25 bp, Rattus norvegicus
agtggtaatgctcctctatctgtgc

SEQ ID NO: 163126 - DNA, 25 bp, Rattus norvegicus
agtggtaatgctgctctatctgtgc

SEQ ID NO: 163127 - DNA, 25 bp, Rattus norvegicus
agtggtacatctccactccatggag

SEQ ID NO: 163128 - DNA, 25 bp, Rattus norvegicus
agtggtacatctgcactccatggag

SEQ ID NO: 163129 - DNA, 25 bp, Rattus norvegicus
agtggtacatgaccctctgcctaag

SEQ ID NO: 163130 - DNA, 25 bp, Rattus norvegicus
agtggtacatgagcctctgcctaag

SEQ ID NO: 163131 - DNA, 25 bp, Rattus norvegicus
agtggtacatgcatttgatcccggt

SEQ ID NO: 163132 - DNA, 25 bp, Rattus norvegicus
agtggtacatgcttttgatcccggt

SEQ ID NO: 163133 - DNA, 25 bp, Rattus norvegicus
agtggtaccagaccatgataaggca

SEQ ID NO: 163134 - DNA, 25 bp, Rattus norvegicus
agtggtaccagagcatgataaggca

SEQ ID NO: 163135 - DNA, 25 bp, Rattus norvegicus
agtggtaccgtgaggccctgaagac

SEQ ID NO: 163136 - DNA, 25 bp, Rattus norvegicus
agtggtaccgtgtggccctgaagac

SEQ ID NO: 163137 - DNA, 25 bp, Rattus norvegicus
agtggtacctcaaggcgggcagaaa

SEQ ID NO: 163138 - DNA, 25 bp, Rattus norvegicus
agtggtacctcatggcgggcagaaa

SEQ ID NO: 163139 - DNA, 25 bp, Rattus norvegicus
agtggtagacacacgccatgaggtc

SEQ ID NO: 163140 - DNA, 25 bp, Rattus norvegicus
agtggtagacactcgccatgaggtc

SEQ ID NO: 163141 - DNA, 25 bp, Rattus norvegicus
agtggtagagaccttgtgcagcctc

SEQ ID NO: 163142 - DNA, 25 bp, Rattus norvegicus
agtggtagagacgttgtgcagcctc

SEQ ID NO: 163143 - DNA, 25 bp, Rattus norvegicus
agtggtagaggactttcctagaaag

SEQ ID NO: 163144 - DNA, 25 bp, Rattus norvegicus
agtggtagaggagtttcctagaaag

SEQ ID NO: 163145 - DNA, 25 bp, Rattus norvegicus
agtggtagagtacaggccccagcac

SEQ ID NO: 163146 - DNA, 25 bp, Rattus norvegicus
agtggtagagtagaggccccagcac

SEQ ID NO: 163147 - DNA, 25 bp, Rattus norvegicus
agtggtagcttgagggtaatgcctt

SEQ ID NO: 163148 - DNA, 25 bp, Rattus norvegicus
agtggtagcttgtgggtaatgcctt

SEQ ID NO: 163149 - DNA, 25 bp, Rattus norvegicus
agtggtaggaacagtacgtgtatgt

SEQ ID NO: 163150 - DNA, 25 bp, Rattus norvegicus
agtggtaggaactgtacgtgtatgt

SEQ ID NO: 163151 - DNA, 25 bp, Rattus norvegicus
agtggtagggatcctactctcgtcc

SEQ ID NO: 163152 - DNA, 25 bp, Rattus norvegicus
agtggtagggatgctactctcgtcc

SEQ ID NO: 163153 - DNA, 25 bp, Rattus norvegicus
agtggtagggtgcttcttagtacat

SEQ ID NO: 163154 - DNA, 25 bp, Rattus norvegicus
agtggtagggtggttcttagtacat

SEQ ID NO: 163155 - DNA, 25 bp, Rattus norvegicus
agtggtatcctaacatctccatatg

SEQ ID NO: 163156 - DNA, 25 bp, Rattus norvegicus
agtggtatcctatcatctccatatg

SEQ ID NO: 163157 - DNA, 25 bp, Rattus norvegicus
agtggtatcttaactctgttgctgt

SEQ ID NO: 163158 - DNA, 25 bp, Rattus norvegicus
agtggtatcttatctctgttgctgt

SEQ ID NO: 163159 - DNA, 25 bp, Rattus norvegicus
agtggtatgcatccccaagcacgca

SEQ ID NO: 163160 - DNA, 25 bp, Rattus norvegicus
agtggtatgcatgcccaagcacgca

SEQ ID NO: 163161 - DNA, 25 bp, Rattus norvegicus
agtggtatgtggaatatgctcgtca

SEQ ID NO: 163162 - DNA, 25 bp, Rattus norvegicus
agtggtatgtggtatatgctcgtca

SEQ ID NO: 163163 - DNA, 25 bp, Rattus norvegicus
agtggtcaagcgactgagctactcc

SEQ ID NO: 163164 - DNA, 25 bp, Rattus norvegicus
agtggtcaagcgtctgagctactcc

SEQ ID NO: 163165 - DNA, 25 bp, Rattus norvegicus
agtggtcaatttctcatgcctttta

SEQ ID NO: 163166 - DNA, 25 bp, Rattus norvegicus
agtggtcaatttgtcatgcctttta

SEQ ID NO: 163167 - DNA, 25 bp, Rattus norvegicus
agtggtcacagcaaagcgtcctctg

SEQ ID NO: 163168 - DNA, 25 bp, Rattus norvegicus
agtggtcacagcatctcagggatca

SEQ ID NO: 163169 - DNA, 25 bp, Rattus norvegicus
agtggtcacagctaagcgtcctctg

SEQ ID NO: 163170 - DNA, 25 bp, Rattus norvegicus
agtggtcacagcttctcagggatca

SEQ ID NO: 163171 - DNA, 25 bp, Rattus norvegicus
agtggtcagactcagctttctgcta

SEQ ID NO: 163172 - DNA, 25 bp, Rattus norvegicus
agtggtcagactgagctttctgcta

SEQ ID NO: 163173 - DNA, 25 bp, Rattus norvegicus
agtggtcagagcagccaagtgtcag

SEQ ID NO: 163174 - DNA, 25 bp, Rattus norvegicus
agtggtcagagctgccaagtgtcag

SEQ ID NO: 163175 - DNA, 25 bp, Rattus norvegicus
agtggtcagcaccatatgacccagg

SEQ ID NO: 163176 - DNA, 25 bp, Rattus norvegicus
agtggtcagcacgatatgacccagg

SEQ ID NO: 163177 - DNA, 25 bp, Rattus norvegicus
agtggtcagcctactcttggcaaga

SEQ ID NO: 163178 - DNA, 25 bp, Rattus norvegicus
agtggtcagccttctcttggcaaga

SEQ ID NO: 163179 - DNA, 25 bp, Rattus norvegicus
agtggtcagctaccagcagctcaca

SEQ ID NO: 163180 - DNA, 25 bp, Rattus norvegicus
agtggtcagctagcagcagctcaca

SEQ ID NO: 163181 - DNA, 25 bp, Rattus norvegicus
agtggtcagcttctgtttagatcct

SEQ ID NO: 163182 - DNA, 25 bp, Rattus norvegicus
agtggtcagcttgtgtttagatcct

SEQ ID NO: 163183 - DNA, 25 bp, Rattus norvegicus
agtggtcagggaatcacacaactcc

SEQ ID NO: 163184 - DNA, 25 bp, Rattus norvegicus
agtggtcagggattcacacaactcc

SEQ ID NO: 163185 - DNA, 25 bp, Rattus norvegicus
agtggtcagggtaccagatgtccat

SEQ ID NO: 163186 - DNA, 25 bp, Rattus norvegicus
agtggtcagggttccagatgtccat

SEQ ID NO: 163187 - DNA, 25 bp, Rattus norvegicus
agtggtcagtcaaagccaggcatgg

SEQ ID NO: 163188 - DNA, 25 bp, Rattus norvegicus
agtggtcagtcatagccaggcatgg

SEQ ID NO: 163189 - DNA, 25 bp, Rattus norvegicus
agtggtcatatccagctaaagcagg

SEQ ID NO: 163190 - DNA, 25 bp, Rattus norvegicus
agtggtcatatcgagctaaagcagg

SEQ ID NO: 163191 - DNA, 25 bp, Rattus norvegicus
agtggtccacatcaaagacaccaag

SEQ ID NO: 163192 - DNA, 25 bp, Rattus norvegicus
agtggtccacatgaaagacaccaag

SEQ ID NO: 163193 - DNA, 25 bp, Rattus norvegicus
agtggtccacgcaagtttctcgaaa

SEQ ID NO: 163194 - DNA, 25 bp, Rattus norvegicus
agtggtccacgctagtttctcgaaa

SEQ ID NO: 163195 - DNA, 25 bp, Rattus norvegicus
agtggtccagagcttgccttagcaa

SEQ ID NO: 163196 - DNA, 25 bp, Rattus norvegicus
agtggtccagaggttgccttagcaa

SEQ ID NO: 163197 - DNA, 25 bp, Rattus norvegicus
agtggtccagtcacctctatttatc

SEQ ID NO: 163198 - DNA, 25 bp, Rattus norvegicus
agtggtccagtctcctctatttatc

SEQ ID NO: 163199 - DNA, 25 bp, Rattus norvegicus
agtggtccagtgatggcacagctct

SEQ ID NO: 163200 - DNA, 25 bp, Rattus norvegicus
agtggtccagtgttggcacagctct

SEQ ID NO: 163201 - DNA, 25 bp, Rattus norvegicus
agtggtcctgcacctcagcgtcaac

SEQ ID NO: 163202 - DNA, 25 bp, Rattus norvegicus
agtggtcctgcagctcagcgtcaac

SEQ ID NO: 163203 - DNA, 25 bp, Rattus norvegicus
agtggtcctggcactcagcagttag

SEQ ID NO: 163204 - DNA, 25 bp, Rattus norvegicus
agtggtcctggctctcagcagttag

SEQ ID NO: 163205 - DNA, 25 bp, Rattus norvegicus
agtggtcctgggagcaatccgtcag

SEQ ID NO: 163206 - DNA, 25 bp, Rattus norvegicus
agtggtcctgggtgcaatccgtcag

SEQ ID NO: 163207 - DNA, 25 bp, Rattus norvegicus
agtggtcgcatgacagatgcttttc

SEQ ID NO: 163208 - DNA, 25 bp, Rattus norvegicus
agtggtcgcatgtcagatgcttttc

SEQ ID NO: 163209 - DNA, 25 bp, Rattus norvegicus
agtggtctaaagactcacctagtcc

SEQ ID NO: 163210 - DNA, 25 bp, Rattus norvegicus
agtggtctaaagtctcacctagtcc

SEQ ID NO: 163211 - DNA, 25 bp, Rattus norvegicus
agtggtctaagtaccttccagatgt

SEQ ID NO: 163212 - DNA, 25 bp, Rattus norvegicus
agtggtctaagttccttccagatgt

SEQ ID NO: 163213 - DNA, 25 bp, Rattus norvegicus
agtggtctatctcccttcgggtaca

SEQ ID NO: 163214 - DNA, 25 bp, Rattus norvegicus
agtggtctatctgccttcgggtaca

SEQ ID NO: 163215 - DNA, 25 bp, Rattus norvegicus
agtggtctccacaggacttgaagac

SEQ ID NO: 163216 - DNA, 25 bp, Rattus norvegicus
agtggtctccacagtgctaaggatc

SEQ ID NO: 163217 - DNA, 25 bp, Rattus norvegicus
agtggtctccactggacttgaagac

SEQ ID NO: 163218 - DNA, 25 bp, Rattus norvegicus
agtggtctccactgtgctaaggatc

SEQ ID NO: 163219 - DNA, 25 bp, Rattus norvegicus
agtggtctctacatggcttgtgtac

SEQ ID NO: 163220 - DNA, 25 bp, Rattus norvegicus
agtggtctctacttggcttgtgtac

SEQ ID NO: 163221 - DNA, 25 bp, Rattus norvegicus
agtggtctctccaaatcccagctga

SEQ ID NO: 163222 - DNA, 25 bp, Rattus norvegicus
agtggtctctccatcctcatttgaa

SEQ ID NO: 163223 - DNA, 25 bp, Rattus norvegicus
agtggtctctcctaatcccagctga

SEQ ID NO: 163224 - DNA, 25 bp, Rattus norvegicus
agtggtctctccttcctcatttgaa

SEQ ID NO: 163225 - DNA, 25 bp, Rattus norvegicus
agtggtctctgacccagcaggtcaa

SEQ ID NO: 163226 - DNA, 25 bp, Rattus norvegicus
agtggtctctgagccagcaggtcaa

SEQ ID NO: 163227 - DNA, 25 bp, Rattus norvegicus
agtggtctctgtcttgctcaaagca

SEQ ID NO: 163228 - DNA, 25 bp, Rattus norvegicus
agtggtctctgtgttgctcaaagca

SEQ ID NO: 163229 - DNA, 25 bp, Rattus norvegicus
agtggtctgcatatgatctcttgaa

SEQ ID NO: 163230 - DNA, 25 bp, Rattus norvegicus
agtggtctgcatttgatctcttgaa

SEQ ID NO: 163231 - DNA, 25 bp, Rattus norvegicus
agtggtctgtgcactgcttcctttg

SEQ ID NO: 163232 - DNA, 25 bp, Rattus norvegicus
agtggtctgtgcatacgggtctgtc

SEQ ID NO: 163233 - DNA, 25 bp, Rattus norvegicus
agtggtctgtgctctgcttcctttg

SEQ ID NO: 163234 - DNA, 25 bp, Rattus norvegicus
agtggtctgtgcttacgggtctgtc

SEQ ID NO: 163235 - DNA, 25 bp, Rattus norvegicus
agtggtctgtggcattccactccca

SEQ ID NO: 163236 - DNA, 25 bp, Rattus norvegicus
agtggtctgtgggattccactccca

SEQ ID NO: 163237 - DNA, 25 bp, Rattus norvegicus
agtggtcttaaaattcttgcttgcg

SEQ ID NO: 163238 - DNA, 25 bp, Rattus norvegicus
agtggtcttaaatttcttgcttgcg

SEQ ID NO: 163239 - DNA, 25 bp, Rattus norvegicus
agtggtcttagcctttgagctgttt

SEQ ID NO: 163240 - DNA, 25 bp, Rattus norvegicus
agtggtcttagcgtttgagctgttt

SEQ ID NO: 163241 - DNA, 25 bp, Rattus norvegicus
agtggtcttatgctatcacgtcctc

SEQ ID NO: 163242 - DNA, 25 bp, Rattus norvegicus
agtggtcttatggtatcacgtcctc

SEQ ID NO: 163243 - DNA, 25 bp, Rattus norvegicus
agtggtcttcccacgtgaagcactt

SEQ ID NO: 163244 - DNA, 25 bp, Rattus norvegicus
agtggtcttccctcgtgaagcactt

SEQ ID NO: 163245 - DNA, 25 bp, Rattus norvegicus
agtggtcttgaaatgccaagatagc

SEQ ID NO: 163246 - DNA, 25 bp, Rattus norvegicus
agtggtcttgaattgccaagatagc

SEQ ID NO: 163247 - DNA, 25 bp, Rattus norvegicus
agtggtgaacgtcattcctgtcatt

SEQ ID NO: 163248 - DNA, 25 bp, Rattus norvegicus
agtggtgaacgtgattcctgtcatt

SEQ ID NO: 163249 - DNA, 25 bp, Rattus norvegicus
agtggtgaaggcagtataaccttgc

SEQ ID NO: 163250 - DNA, 25 bp, Rattus norvegicus
agtggtgaaggctgtataaccttgc

SEQ ID NO: 163251 - DNA, 25 bp, Rattus norvegicus
agtggtgaatctcctgtcctttctc

SEQ ID NO: 163252 - DNA, 25 bp, Rattus norvegicus
agtggtgaatctgctgtcctttctc

SEQ ID NO: 163253 - DNA, 25 bp, Rattus norvegicus
agtggtgacaccatcatctggatgt

SEQ ID NO: 163254 - DNA, 25 bp, Rattus norvegicus
agtggtgacaccttcatctggatgt

SEQ ID NO: 163255 - DNA, 25 bp, Rattus norvegicus
agtggtgacactcggcttctgaagc

SEQ ID NO: 163256 - DNA, 25 bp, Rattus norvegicus
agtggtgacactgggcttctgaagc

SEQ ID NO: 163257 - DNA, 25 bp, Rattus norvegicus
agtggtgaccagacattgccggatc

SEQ ID NO: 163258 - DNA, 25 bp, Rattus norvegicus
agtggtgaccagtcattgccggatc

SEQ ID NO: 163259 - DNA, 25 bp, Rattus norvegicus
agtggtgaccctaaacgatgcgcaa

SEQ ID NO: 163260 - DNA, 25 bp, Rattus norvegicus
agtggtgacccttaacgatgcgcaa

SEQ ID NO: 163261 - DNA, 25 bp, Rattus norvegicus
agtggtgacgctctgttacatcttc

SEQ ID NO: 163262 - DNA, 25 bp, Rattus norvegicus
agtggtgacgctgtgttacatcttc

SEQ ID NO: 163263 - DNA, 25 bp, Rattus norvegicus
agtggtgagcagacctctgtcttca

SEQ ID NO: 163264 - DNA, 25 bp, Rattus norvegicus
agtggtgagcagtcctctgtcttca

SEQ ID NO: 163265 - DNA, 25 bp, Rattus norvegicus
agtggtgagcccagtggtgataata

SEQ ID NO: 163266 - DNA, 25 bp, Rattus norvegicus
agtggtgagccctgtggtgataata

SEQ ID NO: 163267 - DNA, 25 bp, Rattus norvegicus
agtggtgagttcattgcggaccgat

SEQ ID NO: 163268 - DNA, 25 bp, Rattus norvegicus
agtggtgagttctttgcggaccgat

SEQ ID NO: 163269 - DNA, 25 bp, Rattus norvegicus
agtggtgatagtcttcccacttctc

SEQ ID NO: 163270 - DNA, 25 bp, Rattus norvegicus
agtggtgatagtgttcccacttctc

SEQ ID NO: 163271 - DNA, 25 bp, Rattus norvegicus
agtggtgatgacactggcgacctat

SEQ ID NO: 163272 - DNA, 25 bp, Rattus norvegicus
agtggtgatgactctggcgacctat

SEQ ID NO: 163273 - DNA, 25 bp, Rattus norvegicus
agtggtgatgtccacaaaccgggac

SEQ ID NO: 163274 - DNA, 25 bp, Rattus norvegicus
agtggtgatgtcgacaaaccgggac

SEQ ID NO: 163275 - DNA, 25 bp, Rattus norvegicus
agtggtgcaagcagctcatcgcggc

SEQ ID NO: 163276 - DNA, 25 bp, Rattus norvegicus
agtggtgcaagctgctcatcgcggc

SEQ ID NO: 163277 - DNA, 25 bp, Rattus norvegicus
agtggtgcaagtcgctctcagaagt

SEQ ID NO: 163278 - DNA, 25 bp, Rattus norvegicus
agtggtgcaagtggctctcagaagt

SEQ ID NO: 163279 - DNA, 25 bp, Rattus norvegicus
agtggtgcagaaagagactccttaa

SEQ ID NO: 163280 - DNA, 25 bp, Rattus norvegicus
agtggtgcagaatgagactccttaa

SEQ ID NO: 163281 - DNA, 25 bp, Rattus norvegicus
agtggtgcaggtctttgatctcagc

SEQ ID NO: 163282 - DNA, 25 bp, Rattus norvegicus
agtggtgcaggtgtttgatctcagc

SEQ ID NO: 163283 - DNA, 25 bp, Rattus norvegicus
agtggtgccagcacaacagcccgtg

SEQ ID NO: 163284 - DNA, 25 bp, Rattus norvegicus
agtggtgccagctcaacagcccgtg

SEQ ID NO: 163285 - DNA, 25 bp, Rattus norvegicus
agtggtgccaggctcattctagttt

SEQ ID NO: 163286 - DNA, 25 bp, Rattus norvegicus
agtggtgccagggtcattctagttt

SEQ ID NO: 163287 - DNA, 25 bp, Rattus norvegicus
agtggtgcccacatggaaacgtctt

SEQ ID NO: 163288 - DNA, 25 bp, Rattus norvegicus
agtggtgcccacttggaaacgtctt

SEQ ID NO: 163289 - DNA, 25 bp, Rattus norvegicus
agtggtgccccgagatgtgaaactc

SEQ ID NO: 163290 - DNA, 25 bp, Rattus norvegicus
agtggtgccccgtgatgtgaaactc

SEQ ID NO: 163291 - DNA, 25 bp, Rattus norvegicus
agtggtgccctgagcctatgtgaag

SEQ ID NO: 163292 - DNA, 25 bp, Rattus norvegicus
agtggtgccctgcaattactgatgc

SEQ ID NO: 163293 - DNA, 25 bp, Rattus norvegicus
agtggtgccctggaattactgatgc

SEQ ID NO: 163294 - DNA, 25 bp, Rattus norvegicus
agtggtgccctgtgcctatgtgaag

SEQ ID NO: 163295 - DNA, 25 bp, Rattus norvegicus
agtggtgcctccatggtaactggcg

SEQ ID NO: 163296 - DNA, 25 bp, Rattus norvegicus
agtggtgcctccatgtctgccagga

SEQ ID NO: 163297 - DNA, 25 bp, Rattus norvegicus
agtggtgcctccttggtaactggcg

SEQ ID NO: 163298 - DNA, 25 bp, Rattus norvegicus
agtggtgcctccttgtctgccagga

SEQ ID NO: 163299 - DNA, 25 bp, Rattus norvegicus
agtggtgctgctactggagccacct

SEQ ID NO: 163300 - DNA, 25 bp, Rattus norvegicus
agtggtgctgcttctggagccacct

SEQ ID NO: 163301 - DNA, 25 bp, Rattus norvegicus
agtggtgctttgaactgcagctcct

SEQ ID NO: 163302 - DNA, 25 bp, Rattus norvegicus
agtggtgctttgtactgcagctcct

SEQ ID NO: 163303 - DNA, 25 bp, Rattus norvegicus
agtggtggaaacacggcccacggat

SEQ ID NO: 163304 - DNA, 25 bp, Rattus norvegicus
agtggtggaaactcggcccacggat

SEQ ID NO: 163305 - DNA, 25 bp, Rattus norvegicus
agtggtggacacaggcacatcctat

SEQ ID NO: 163306 - DNA, 25 bp, Rattus norvegicus
agtggtggacactggcacatcctat

SEQ ID NO: 163307 - DNA, 25 bp, Rattus norvegicus
agtggtggaggtccaccatctcacc

SEQ ID NO: 163308 - DNA, 25 bp, Rattus norvegicus
agtggtggaggtgcaccatctcacc

SEQ ID NO: 163309 - DNA, 25 bp, Rattus norvegicus
agtggtggcaccattttgtcttggg

SEQ ID NO: 163310 - DNA, 25 bp, Rattus norvegicus
agtggtggcacctttttgtcttggg

SEQ ID NO: 163311 - DNA, 25 bp, Rattus norvegicus
agtggtggcattcctgaacgagtcc

SEQ ID NO: 163312 - DNA, 25 bp, Rattus norvegicus
agtggtggcattgctgaacgagtcc

SEQ ID NO: 163313 - DNA, 25 bp, Rattus norvegicus
agtggtggccccatattgcaggatc

SEQ ID NO: 163314 - DNA, 25 bp, Rattus norvegicus
agtggtggccccttattgcaggatc

SEQ ID NO: 163315 - DNA, 25 bp, Rattus norvegicus
agtggtggctccaacccactcagtg

SEQ ID NO: 163316 - DNA, 25 bp, Rattus norvegicus
agtggtggctcctacccactcagtg

SEQ ID NO: 163317 - DNA, 25 bp, Rattus norvegicus
agtggtggtgcccaagcccctcaga

SEQ ID NO: 163318 - DNA, 25 bp, Rattus norvegicus
agtggtggtgccgaagcccctcaga

SEQ ID NO: 163319 - DNA, 25 bp, Rattus norvegicus
agtggtggttccagacccagagtca

SEQ ID NO: 163320 - DNA, 25 bp, Rattus norvegicus
agtggtggttcctgacccagagtca

SEQ ID NO: 163321 - DNA, 25 bp, Rattus norvegicus
agtggtggttgcacctggccttgta

SEQ ID NO: 163322 - DNA, 25 bp, Rattus norvegicus
agtggtggttgctcctggccttgta

SEQ ID NO: 163323 - DNA, 25 bp, Rattus norvegicus
agtggtgtataaattcattctttga

SEQ ID NO: 163324 - DNA, 25 bp, Rattus norvegicus
agtggtgtataatttcattctttga

SEQ ID NO: 163325 - DNA, 25 bp, Rattus norvegicus
agtggtgtcaccacctggattttga

SEQ ID NO: 163326 - DNA, 25 bp, Rattus norvegicus
agtggtgtcacctcctggattttga

SEQ ID NO: 163327 - DNA, 25 bp, Rattus norvegicus
agtggtgtctgtatgtttgaaaccg

SEQ ID NO: 163328 - DNA, 25 bp, Rattus norvegicus
agtggtgtctgtttgtttgaaaccg

SEQ ID NO: 163329 - DNA, 25 bp, Rattus norvegicus
agtggtgtgccaaatctgagagaaa

SEQ ID NO: 163330 - DNA, 25 bp, Rattus norvegicus
agtggtgtgccatatctgagagaaa

SEQ ID NO: 163331 - DNA, 25 bp, Rattus norvegicus
agtggtgtgctgactcagcctgtga

SEQ ID NO: 163332 - DNA, 25 bp, Rattus norvegicus
agtggtgtgctgtctcagcctgtga

SEQ ID NO: 163333 - DNA, 25 bp, Rattus norvegicus
agtggtgtggatactatgcaatgca

SEQ ID NO: 163334 - DNA, 25 bp, Rattus norvegicus
agtggtgtggattctatgcaatgca

SEQ ID NO: 163335 - DNA, 25 bp, Rattus norvegicus
agtggtgtggtgcatgcctctaatc

SEQ ID NO: 163336 - DNA, 25 bp, Rattus norvegicus
agtggtgtggtggatgcctctaatc

SEQ ID NO: 163337 - DNA, 25 bp, Rattus norvegicus
agtggtgtgttaaccgaagttcatc

SEQ ID NO: 163338 - DNA, 25 bp, Rattus norvegicus
agtggtgtgttatccgaagttcatc

SEQ ID NO: 163339 - DNA, 25 bp, Rattus norvegicus
agtggtgtgttcatgtgctctcagc

SEQ ID NO: 163340 - DNA, 25 bp, Rattus norvegicus
agtggtgtgttcttgtgctctcagc

SEQ ID NO: 163341 - DNA, 25 bp, Rattus norvegicus
agtggtgttacaaatttctcgtgca

SEQ ID NO: 163342 - DNA, 25 bp, Rattus norvegicus
agtggtgttacatatttctcgtgca

SEQ ID NO: 163343 - DNA, 25 bp, Rattus norvegicus
agtggtgttaggacagctctgctac

SEQ ID NO: 163344 - DNA, 25 bp, Rattus norvegicus
agtggtgttaggtcagctctgctac

SEQ ID NO: 163345 - DNA, 25 bp, Rattus norvegicus
agtggtgttattactccatgccctg

SEQ ID NO: 163346 - DNA, 25 bp, Rattus norvegicus
agtggtgttatttctccatgccctg

SEQ ID NO: 163347 - DNA, 25 bp, Rattus norvegicus
agtggtgtttaactatgcatcaagt

SEQ ID NO: 163348 - DNA, 25 bp, Rattus norvegicus
agtggtgtttaagtatgcatcaagt

SEQ ID NO: 163349 - DNA, 25 bp, Rattus norvegicus
agtggttaagaacatgcacggttct

SEQ ID NO: 163350 - DNA, 25 bp, Rattus norvegicus
agtggttaagaagatgcacggttct

SEQ ID NO: 163351 - DNA, 25 bp, Rattus norvegicus
agtggttaagacctcggctcttcaa

SEQ ID NO: 163352 - DNA, 25 bp, Rattus norvegicus
agtggttaagacgtcggctcttcaa

SEQ ID NO: 163353 - DNA, 25 bp, Rattus norvegicus
agtggttacaaaatgatctgctcaa

SEQ ID NO: 163354 - DNA, 25 bp, Rattus norvegicus
agtggttacaaattgatctgctcaa

SEQ ID NO: 163355 - DNA, 25 bp, Rattus norvegicus
agtggttacatgcacttcggtcccg

SEQ ID NO: 163356 - DNA, 25 bp, Rattus norvegicus
agtggttacatggacttcggtcccg

SEQ ID NO: 163357 - DNA, 25 bp, Rattus norvegicus
agtggttacattcccatctggttgc

SEQ ID NO: 163358 - DNA, 25 bp, Rattus norvegicus
agtggttacattgccatctggttgc

SEQ ID NO: 163359 - DNA, 25 bp, Rattus norvegicus
agtggttaccagagcgtgcaccaac

SEQ ID NO: 163360 - DNA, 25 bp, Rattus norvegicus
agtggttaccagagtccaggagact

SEQ ID NO: 163361 - DNA, 25 bp, Rattus norvegicus
agtggttaccagctcatgacaagat

SEQ ID NO: 163362 - DNA, 25 bp, Rattus norvegicus
agtggttaccaggtcatgacaagat

SEQ ID NO: 163363 - DNA, 25 bp, Rattus norvegicus
agtggttaccagtgcgtgcaccaac

SEQ ID NO: 163364 - DNA, 25 bp, Rattus norvegicus
agtggttaccagtgtccaggagact

SEQ ID NO: 163365 - DNA, 25 bp, Rattus norvegicus
agtggttactccagccagtcagaga

SEQ ID NO: 163366 - DNA, 25 bp, Rattus norvegicus
agtggttactcctgccagtcagaga

SEQ ID NO: 163367 - DNA, 25 bp, Rattus norvegicus
agtggttataccactaactgtgcaa

SEQ ID NO: 163368 - DNA, 25 bp, Rattus norvegicus
agtggttatacctctaactgtgcaa

SEQ ID NO: 163369 - DNA, 25 bp, Rattus norvegicus
agtggttatactccagatacccgat

SEQ ID NO: 163370 - DNA, 25 bp, Rattus norvegicus
agtggttatactgcagatacccgat

SEQ ID NO: 163371 - DNA, 25 bp, Rattus norvegicus
agtggttatgatcctattctgtaaa

SEQ ID NO: 163372 - DNA, 25 bp, Rattus norvegicus
agtggttatgatgctattctgtaaa

SEQ ID NO: 163373 - DNA, 25 bp, Rattus norvegicus
agtggttcactccagtagtcacgta

SEQ ID NO: 163374 - DNA, 25 bp, Rattus norvegicus
agtggttcactcgagtagtcacgta

SEQ ID NO: 163375 - DNA, 25 bp, Rattus norvegicus
agtggttcagacacagtactcctta

SEQ ID NO: 163376 - DNA, 25 bp, Rattus norvegicus
agtggttcagactcagtactcctta

SEQ ID NO: 163377 - DNA, 25 bp, Rattus norvegicus
agtggttcccgaccatctgagagtg

SEQ ID NO: 163378 - DNA, 25 bp, Rattus norvegicus
agtggttcccgagcatctgagagtg

SEQ ID NO: 163379 - DNA, 25 bp, Rattus norvegicus
agtggttcccttctgaatccctcta

SEQ ID NO: 163380 - DNA, 25 bp, Rattus norvegicus
agtggttcccttgtgaatccctcta

SEQ ID NO: 163381 - DNA, 25 bp, Rattus norvegicus
agtggttccgagcatctgactgtcg

SEQ ID NO: 163382 - DNA, 25 bp, Rattus norvegicus
agtggttccgaggatctgactgtcg

SEQ ID NO: 163383 - DNA, 25 bp, Rattus norvegicus
agtggttccggcagagctcttctgg

SEQ ID NO: 163384 - DNA, 25 bp, Rattus norvegicus
agtggttccggctgagctcttctgg

SEQ ID NO: 163385 - DNA, 25 bp, Rattus norvegicus
agtggttccgtgacttaattatgcc

SEQ ID NO: 163386 - DNA, 25 bp, Rattus norvegicus
agtggttccgtgtcttaattatgcc

SEQ ID NO: 163387 - DNA, 25 bp, Rattus norvegicus
agtggttccgttactggccattcta

SEQ ID NO: 163388 - DNA, 25 bp, Rattus norvegicus
agtggttccgtttctggccattcta

SEQ ID NO: 163389 - DNA, 25 bp, Rattus norvegicus
agtggttcgtggagctgatcagtca

SEQ ID NO: 163390 - DNA, 25 bp, Rattus norvegicus
agtggttcgtggtgctgatcagtca

SEQ ID NO: 163391 - DNA, 25 bp, Rattus norvegicus
agtggttctcaacccgttgatcacc

SEQ ID NO: 163392 - DNA, 25 bp, Rattus norvegicus
agtggttctcaagccgttgatcacc

SEQ ID NO: 163393 - DNA, 25 bp, Rattus norvegicus
agtggttctctcaggtctgtgtatc

SEQ ID NO: 163394 - DNA, 25 bp, Rattus norvegicus
agtggttctctctggtctgtgtatc

SEQ ID NO: 163395 - DNA, 25 bp, Rattus norvegicus
agtggttcttcacggcgacagtgta

SEQ ID NO: 163396 - DNA, 25 bp, Rattus norvegicus
agtggttcttcagggcgacagtgta

SEQ ID NO: 163397 - DNA, 25 bp, Rattus norvegicus
agtggttctttgaagctttttgcta

SEQ ID NO: 163398 - DNA, 25 bp, Rattus norvegicus
agtggttctttgtagctttttgcta

SEQ ID NO: 163399 - DNA, 25 bp, Rattus norvegicus
agtggttgaaccactgtctgcctga

SEQ ID NO: 163400 - DNA, 25 bp, Rattus norvegicus
agtggttgaacctctgtctgcctga

SEQ ID NO: 163401 - DNA, 25 bp, Rattus norvegicus
agtggttgacacatctccatggagc

SEQ ID NO: 163402 - DNA, 25 bp, Rattus norvegicus
agtggttgacacttctccatggagc

SEQ ID NO: 163403 - DNA, 25 bp, Rattus norvegicus
agtggttgatgacatgctggcccat

SEQ ID NO: 163404 - DNA, 25 bp, Rattus norvegicus
agtggttgatgagatgctggcccat

SEQ ID NO: 163405 - DNA, 25 bp, Rattus norvegicus
agtggttgatgcatgcttcacatgt

SEQ ID NO: 163406 - DNA, 25 bp, Rattus norvegicus
agtggttgatgcttgcttcacatgt

SEQ ID NO: 163407 - DNA, 25 bp, Rattus norvegicus
agtggttggctcagcggctagactc

SEQ ID NO: 163408 - DNA, 25 bp, Rattus norvegicus
agtggttggctctgcggctagactc

SEQ ID NO: 163409 - DNA, 25 bp, Rattus norvegicus
agtggttgtagtatttgctctttaa

SEQ ID NO: 163410 - DNA, 25 bp, Rattus norvegicus
agtggttgtagtttttgctctttaa

SEQ ID NO: 163411 - DNA, 25 bp, Rattus norvegicus
agtggttgttacagcccaaggaggc

SEQ ID NO: 163412 - DNA, 25 bp, Rattus norvegicus
agtggttgttactgcccaaggaggc

SEQ ID NO: 163413 - DNA, 25 bp, Rattus norvegicus
agtggtttaggaaagctcttggcag

SEQ ID NO: 163414 - DNA, 25 bp, Rattus norvegicus
agtggtttaggatagctcttggcag

SEQ ID NO: 163415 - DNA, 25 bp, Rattus norvegicus
agtggtttatcacgcatcttccttc

SEQ ID NO: 163416 - DNA, 25 bp, Rattus norvegicus
agtggtttatcaggcatcttccttc

SEQ ID NO: 163417 - DNA, 25 bp, Rattus norvegicus
agtggtttctatagtgtcctactca

SEQ ID NO: 163418 - DNA, 25 bp, Rattus norvegicus
agtggtttctattgtgtcctactca

SEQ ID NO: 163419 - DNA, 25 bp, Rattus norvegicus
agtggtttctgcctgttcatcaaga

SEQ ID NO: 163420 - DNA, 25 bp, Rattus norvegicus
agtggtttctgcgtgttcatcaaga

SEQ ID NO: 163421 - DNA, 25 bp, Rattus norvegicus
agtggtttgacaacggctgcttggt

SEQ ID NO: 163422 - DNA, 25 bp, Rattus norvegicus
agtggtttgacatcggctgcttggt

SEQ ID NO: 163423 - DNA, 25 bp, Rattus norvegicus
agtggtttggaaagcctgcctccag

SEQ ID NO: 163424 - DNA, 25 bp, Rattus norvegicus
agtggtttggaatgcctgcctccag

SEQ ID NO: 163425 - DNA, 25 bp, Rattus norvegicus
agtggtttgggaatcattttgacta

SEQ ID NO: 163426 - DNA, 25 bp, Rattus norvegicus
agtggtttgggattcattttgacta

SEQ ID NO: 163427 - DNA, 25 bp, Rattus norvegicus
agtggtttgtctctgtcccatcgta

SEQ ID NO: 163428 - DNA, 25 bp, Rattus norvegicus
agtggtttgtctgtgtcccatcgta

SEQ ID NO: 163429 - DNA, 25 bp, Rattus norvegicus
agtggttttcctcaagcagctgggc

SEQ ID NO: 163430 - DNA, 25 bp, Rattus norvegicus
agtggttttcctgaagcagctgggc

SEQ ID NO: 163431 - DNA, 25 bp, Rattus norvegicus
agtggttttcttatccgctgtctct

SEQ ID NO: 163432 - DNA, 25 bp, Rattus norvegicus
agtggttttcttttccgctgtctct

SEQ ID NO: 163433 - DNA, 25 bp, Rattus norvegicus
agtggttttgtcacagttttcctag

SEQ ID NO: 163434 - DNA, 25 bp, Rattus norvegicus
agtggttttgtctcagttttcctag

SEQ ID NO: 163435 - DNA, 25 bp, Rattus norvegicus
agtggttttgtgagctcacagagcc

SEQ ID NO: 163436 - DNA, 25 bp, Rattus norvegicus
agtggttttgtgtgctcacagagcc

SEQ ID NO: 163437 - DNA, 25 bp, Rattus norvegicus
agtggttttgttacctgaggatcct

SEQ ID NO: 163438 - DNA, 25 bp, Rattus norvegicus
agtggttttgtttcctgaggatcct

SEQ ID NO: 163439 - DNA, 25 bp, Rattus norvegicus
agtggtttttctctagcacgtgtgc

SEQ ID NO: 163440 - DNA, 25 bp, Rattus norvegicus
agtggtttttctgtagcacgtgtgc

SEQ ID NO: 163441 - DNA, 25 bp, Rattus norvegicus
agtgtaaactcccttcgatgggctt

SEQ ID NO: 163442 - DNA, 25 bp, Rattus norvegicus
agtgtaaactccgttcgatgggctt

SEQ ID NO: 163443 - DNA, 25 bp, Rattus norvegicus
agtgtaaataaacctgctttcgcag

SEQ ID NO: 163444 - DNA, 25 bp, Rattus norvegicus
agtgtaaataaagctgctttcgcag

SEQ ID NO: 163445 - DNA, 25 bp, Rattus norvegicus
agtgtaacaccgagcctcaagctgg

SEQ ID NO: 163446 - DNA, 25 bp, Rattus norvegicus
agtgtaacaccgtgcctcaagctgg

SEQ ID NO: 163447 - DNA, 25 bp, Rattus norvegicus
agtgtaacagcacccggagcctcga

SEQ ID NO: 163448 - DNA, 25 bp, Rattus norvegicus
agtgtaacagcagccggagcctcga

SEQ ID NO: 163449 - DNA, 25 bp, Rattus norvegicus
agtgtaaggccgacgccgtgtgatt

SEQ ID NO: 163450 - DNA, 25 bp, Rattus norvegicus
agtgtaaggccgtcgccgtgtgatt

SEQ ID NO: 163451 - DNA, 25 bp, Rattus norvegicus
agtgtaatgcccacttttcagctct

SEQ ID NO: 163452 - DNA, 25 bp, Rattus norvegicus
agtgtaatgccctcttttcagctct

SEQ ID NO: 163453 - DNA, 25 bp, Rattus norvegicus
agtgtaatggctctgtttcacctct

SEQ ID NO: 163454 - DNA, 25 bp, Rattus norvegicus
agtgtaatggctgtgtttcacctct

SEQ ID NO: 163455 - DNA, 25 bp, Rattus norvegicus
agtgtaattctcattctagcatcag

SEQ ID NO: 163456 - DNA, 25 bp, Rattus norvegicus
agtgtaattctctttctagcatcag

SEQ ID NO: 163457 - DNA, 25 bp, Rattus norvegicus
agtgtacaactaaaggccatccttt

SEQ ID NO: 163458 - DNA, 25 bp, Rattus norvegicus
agtgtacaactataggccatccttt

SEQ ID NO: 163459 - DNA, 25 bp, Rattus norvegicus
agtgtacaactcattttgcgccaat

SEQ ID NO: 163460 - DNA, 25 bp, Rattus norvegicus
agtgtacaactctttttgcgccaat

SEQ ID NO: 163461 - DNA, 25 bp, Rattus norvegicus
agtgtacacagtaacagccctttct

SEQ ID NO: 163462 - DNA, 25 bp, Rattus norvegicus
agtgtacacagttacagccctttct

SEQ ID NO: 163463 - DNA, 25 bp, Rattus norvegicus
agtgtacacataactcttggtttgc

SEQ ID NO: 163464 - DNA, 25 bp, Rattus norvegicus
agtgtacacatatctcttggtttgc

SEQ ID NO: 163465 - DNA, 25 bp, Rattus norvegicus
agtgtacaccaacccttcagaaatt

SEQ ID NO: 163466 - DNA, 25 bp, Rattus norvegicus
agtgtacaccaagccttcagaaatt

SEQ ID NO: 163467 - DNA, 25 bp, Rattus norvegicus
agtgtacactttctctcattccttt

SEQ ID NO: 163468 - DNA, 25 bp, Rattus norvegicus
agtgtacactttgtctcattccttt

SEQ ID NO: 163469 - DNA, 25 bp, Rattus norvegicus
agtgtacagcggacaactccttgtc

SEQ ID NO: 163470 - DNA, 25 bp, Rattus norvegicus
agtgtacagcggtcaactccttgtc

SEQ ID NO: 163471 - DNA, 25 bp, Rattus norvegicus
agtgtacagcgtcaacacgtggcgc

SEQ ID NO: 163472 - DNA, 25 bp, Rattus norvegicus
agtgtacagcgtgaacacgtggcgc

SEQ ID NO: 163473 - DNA, 25 bp, Rattus norvegicus
agtgtacagtagagtcttcccagcc

SEQ ID NO: 163474 - DNA, 25 bp, Rattus norvegicus
agtgtacagtagtgtcttcccagcc

SEQ ID NO: 163475 - DNA, 25 bp, Rattus norvegicus
agtgtacatcatcattttccaccct

SEQ ID NO: 163476 - DNA, 25 bp, Rattus norvegicus
agtgtacatcatgattttccaccct

SEQ ID NO: 163477 - DNA, 25 bp, Rattus norvegicus
agtgtacattaccaagttccttgtt

SEQ ID NO: 163478 - DNA, 25 bp, Rattus norvegicus
agtgtacattacgaagttccttgtt

SEQ ID NO: 163479 - DNA, 25 bp, Rattus norvegicus
agtgtacattctctcatgcctaaga

SEQ ID NO: 163480 - DNA, 25 bp, Rattus norvegicus
agtgtacattctgtcatgcctaaga

SEQ ID NO: 163481 - DNA, 25 bp, Rattus norvegicus
agtgtaccagggaccaggtgagcac

SEQ ID NO: 163482 - DNA, 25 bp, Rattus norvegicus
agtgtaccagggtccaggtgagcac

SEQ ID NO: 163483 - DNA, 25 bp, Rattus norvegicus
agtgtaccatcaactcatttctgtg

SEQ ID NO: 163484 - DNA, 25 bp, Rattus norvegicus
agtgtaccatcatctcatttctgtg

SEQ ID NO: 163485 - DNA, 25 bp, Rattus norvegicus
agtgtacccagcagtgcaatgacca

SEQ ID NO: 163486 - DNA, 25 bp, Rattus norvegicus
agtgtacccagctgtgcaatgacca

SEQ ID NO: 163487 - DNA, 25 bp, Rattus norvegicus
agtgtaccctctcggaagctggttg

SEQ ID NO: 163488 - DNA, 25 bp, Rattus norvegicus
agtgtaccctctgggaagctggttg

SEQ ID NO: 163489 - DNA, 25 bp, Rattus norvegicus
agtgtaccgcgaactggagctggct

SEQ ID NO: 163490 - DNA, 25 bp, Rattus norvegicus
agtgtaccgcgatctggagctggct

SEQ ID NO: 163491 - DNA, 25 bp, Rattus norvegicus
agtgtaccggaactcagccaaagcc

SEQ ID NO: 163492 - DNA, 25 bp, Rattus norvegicus
agtgtaccggaagtcagccaaagcc

SEQ ID NO: 163493 - DNA, 25 bp, Rattus norvegicus
agtgtacctatactgcttttgccta

SEQ ID NO: 163494 - DNA, 25 bp, Rattus norvegicus
agtgtacctatagtgcttttgccta

SEQ ID NO: 163495 - DNA, 25 bp, Rattus norvegicus
agtgtacctcagatctgctgcaaac

SEQ ID NO: 163496 - DNA, 25 bp, Rattus norvegicus
agtgtacctcagttctgctgcaaac

SEQ ID NO: 163497 - DNA, 25 bp, Rattus norvegicus
agtgtacctggcatcactgaagttt

SEQ ID NO: 163498 - DNA, 25 bp, Rattus norvegicus
agtgtacctggcttcactgaagttt

SEQ ID NO: 163499 - DNA, 25 bp, Rattus norvegicus
agtgtacctgggattgcccagaggc

SEQ ID NO: 163500 - DNA, 25 bp, Rattus norvegicus
agtgtacctgggtttgcccagaggc

SEQ ID NO: 163501 - DNA, 25 bp, Rattus norvegicus
agtgtacgaatgctttccctggact

SEQ ID NO: 163502 - DNA, 25 bp, Rattus norvegicus
agtgtacgaatggtttccctggact

SEQ ID NO: 163503 - DNA, 25 bp, Rattus norvegicus
agtgtactacgaccccaacaagagt

SEQ ID NO: 163504 - DNA, 25 bp, Rattus norvegicus
agtgtactacgagcccaacaagagt

SEQ ID NO: 163505 - DNA, 25 bp, Rattus norvegicus
agtgtactattcaggttccttgtgt

SEQ ID NO: 163506 - DNA, 25 bp, Rattus norvegicus
agtgtactattctggttccttgtgt

SEQ ID NO: 163507 - DNA, 25 bp, Rattus norvegicus
agtgtactcctacttatggacccgc

SEQ ID NO: 163508 - DNA, 25 bp, Rattus norvegicus
agtgtactcctagttatggacccgc

SEQ ID NO: 163509 - DNA, 25 bp, Rattus norvegicus
agtgtacttattactgaggatctga

SEQ ID NO: 163510 - DNA, 25 bp, Rattus norvegicus
agtgtacttatttctgaggatctga

SEQ ID NO: 163511 - DNA, 25 bp, Rattus norvegicus
agtgtacttctgattgtcattgcct

SEQ ID NO: 163512 - DNA, 25 bp, Rattus norvegicus
agtgtacttctgcttggcttctttt

SEQ ID NO: 163513 - DNA, 25 bp, Rattus norvegicus
agtgtacttctggttggcttctttt

SEQ ID NO: 163514 - DNA, 25 bp, Rattus norvegicus
agtgtacttctgtttgtcattgcct

SEQ ID NO: 163515 - DNA, 25 bp, Rattus norvegicus
agtgtagacccaccatccatgcatg

SEQ ID NO: 163516 - DNA, 25 bp, Rattus norvegicus
agtgtagacccagcatccatgcatg

SEQ ID NO: 163517 - DNA, 25 bp, Rattus norvegicus
agtgtagaccgcagttttatttttg

SEQ ID NO: 163518 - DNA, 25 bp, Rattus norvegicus
agtgtagaccgctgttttatttttg

SEQ ID NO: 163519 - DNA, 25 bp, Rattus norvegicus
agtgtagactctctgcgacctgctg

SEQ ID NO: 163520 - DNA, 25 bp, Rattus norvegicus
agtgtagactctgtgcgacctgctg

SEQ ID NO: 163521 - DNA, 25 bp, Rattus norvegicus
agtgtagactgaagcaaggatcctc

SEQ ID NO: 163522 - DNA, 25 bp, Rattus norvegicus
agtgtagactgatgcaaggatcctc

SEQ ID NO: 163523 - DNA, 25 bp, Rattus norvegicus
agtgtagattaccattgtccctgag

SEQ ID NO: 163524 - DNA, 25 bp, Rattus norvegicus
agtgtagattacgattgtccctgag

SEQ ID NO: 163525 - DNA, 25 bp, Rattus norvegicus
agtgtagcatgtcctctgtatttaa

SEQ ID NO: 163526 - DNA, 25 bp, Rattus norvegicus
agtgtagcatgtgctctgtatttaa

SEQ ID NO: 163527 - DNA, 25 bp, Rattus norvegicus
agtgtagcccaaatcagtcttcaga

SEQ ID NO: 163528 - DNA, 25 bp, Rattus norvegicus
agtgtagcccaattcagtcttcaga

SEQ ID NO: 163529 - DNA, 25 bp, Rattus norvegicus
agtgtagcctccacgcattggcatg

SEQ ID NO: 163530 - DNA, 25 bp, Rattus norvegicus
agtgtagcctcccagatgagttctg

SEQ ID NO: 163531 - DNA, 25 bp, Rattus norvegicus
agtgtagcctccgagatgagttctg

SEQ ID NO: 163532 - DNA, 25 bp, Rattus norvegicus
agtgtagcctcctcgcattggcatg

SEQ ID NO: 163533 - DNA, 25 bp, Rattus norvegicus
agtgtagctcagacccagcatgcac

SEQ ID NO: 163534 - DNA, 25 bp, Rattus norvegicus
agtgtagctcagtcccagcatgcac

SEQ ID NO: 163535 - DNA, 25 bp, Rattus norvegicus
agtgtagctgaactccgcatcatca

SEQ ID NO: 163536 - DNA, 25 bp, Rattus norvegicus
agtgtagctgaagtccgcatcatca

SEQ ID NO: 163537 - DNA, 25 bp, Rattus norvegicus
agtgtagctgtgagccttctggaag

SEQ ID NO: 163538 - DNA, 25 bp, Rattus norvegicus
agtgtagctgtgtgccttctggaag

SEQ ID NO: 163539 - DNA, 25 bp, Rattus norvegicus
agtgtaggcccaactcggttccgtg

SEQ ID NO: 163540 - DNA, 25 bp, Rattus norvegicus
agtgtaggcccatctcggttccgtg

SEQ ID NO: 163541 - DNA, 25 bp, Rattus norvegicus
agtgtaggctccagccagattactc

SEQ ID NO: 163542 - DNA, 25 bp, Rattus norvegicus
agtgtaggctcctgccagattactc

SEQ ID NO: 163543 - DNA, 25 bp, Rattus norvegicus
agtgtagtcaccaagatggcctgct

SEQ ID NO: 163544 - DNA, 25 bp, Rattus norvegicus
agtgtagtcacctagatggcctgct

SEQ ID NO: 163545 - DNA, 25 bp, Rattus norvegicus
agtgtagtcggcacctggtcactca

SEQ ID NO: 163546 - DNA, 25 bp, Rattus norvegicus
agtgtagtcggctcctggtcactca

SEQ ID NO: 163547 - DNA, 25 bp, Rattus norvegicus
agtgtagtctttctctgcattgcct

SEQ ID NO: 163548 - DNA, 25 bp, Rattus norvegicus
agtgtagtctttgtctgcattgcct

SEQ ID NO: 163549 - DNA, 25 bp, Rattus norvegicus
agtgtagtgttcacttgctcctgaa

SEQ ID NO: 163550 - DNA, 25 bp, Rattus norvegicus
agtgtagtgttctcttgctcctgaa

SEQ ID NO: 163551 - DNA, 25 bp, Rattus norvegicus
agtgtataatcacaaggactcttca

SEQ ID NO: 163552 - DNA, 25 bp, Rattus norvegicus
agtgtataatcagaaggactcttca

SEQ ID NO: 163553 - DNA, 25 bp, Rattus norvegicus
agtgtatagatgctcttgcggtttc

SEQ ID NO: 163554 - DNA, 25 bp, Rattus norvegicus
agtgtatagatggtcttgcggtttc

SEQ ID NO: 163555 - DNA, 25 bp, Rattus norvegicus
agtgtatattttctcaggcctggct

SEQ ID NO: 163556 - DNA, 25 bp, Rattus norvegicus
agtgtatattttgtcaggcctggct

SEQ ID NO: 163557 - DNA, 25 bp, Rattus norvegicus
agtgtatcacttatgaaatctgccc

SEQ ID NO: 163558 - DNA, 25 bp, Rattus norvegicus
agtgtatcacttttgaaatctgccc

SEQ ID NO: 163559 - DNA, 25 bp, Rattus norvegicus
agtgtatccattatgttgtgcttta

SEQ ID NO: 163560 - DNA, 25 bp, Rattus norvegicus
agtgtatccattttgttgtgcttta

SEQ ID NO: 163561 - DNA, 25 bp, Rattus norvegicus
agtgtatcccatatgcagtgttgct

SEQ ID NO: 163562 - DNA, 25 bp, Rattus norvegicus
agtgtatcccatttgcagtgttgct

SEQ ID NO: 163563 - DNA, 25 bp, Rattus norvegicus
agtgtatccccaagttccagcagtc

SEQ ID NO: 163564 - DNA, 25 bp, Rattus norvegicus
agtgtatccccatgttccagcagtc

SEQ ID NO: 163565 - DNA, 25 bp, Rattus norvegicus
agtgtatcttcacaatttcagagaa

SEQ ID NO: 163566 - DNA, 25 bp, Rattus norvegicus
agtgtatcttcagaatttcagagaa

SEQ ID NO: 163567 - DNA, 25 bp, Rattus norvegicus
agtgtatcttctaggtccttcctgt

SEQ ID NO: 163568 - DNA, 25 bp, Rattus norvegicus
agtgtatcttcttggtccttcctgt

SEQ ID NO: 163569 - DNA, 25 bp, Rattus norvegicus
agtgtatgagcaccgaaccagctgt

SEQ ID NO: 163570 - DNA, 25 bp, Rattus norvegicus
agtgtatgagcagcgaaccagctgt

SEQ ID NO: 163571 - DNA, 25 bp, Rattus norvegicus
agtgtatgagccaaaatccttccct

SEQ ID NO: 163572 - DNA, 25 bp, Rattus norvegicus
agtgtatgagcctaaatccttccct

SEQ ID NO: 163573 - DNA, 25 bp, Rattus norvegicus
agtgtatgggctctgagttcacctt

SEQ ID NO: 163574 - DNA, 25 bp, Rattus norvegicus
agtgtatgggctgtgagttcacctt

SEQ ID NO: 163575 - DNA, 25 bp, Rattus norvegicus
agtgtatgtccaacactattctaaa

SEQ ID NO: 163576 - DNA, 25 bp, Rattus norvegicus
agtgtatgtccatcactattctaaa

SEQ ID NO: 163577 - DNA, 25 bp, Rattus norvegicus
agtgtattaaatatactgctgtgtt

SEQ ID NO: 163578 - DNA, 25 bp, Rattus norvegicus
agtgtattaaatttactgctgtgtt

SEQ ID NO: 163579 - DNA, 25 bp, Rattus norvegicus
agtgtattacctctcaaatctgtga

SEQ ID NO: 163580 - DNA, 25 bp, Rattus norvegicus
agtgtattacctgtcaaatctgtga

SEQ ID NO: 163581 - DNA, 25 bp, Rattus norvegicus
agtgtattatataactccgccagta

SEQ ID NO: 163582 - DNA, 25 bp, Rattus norvegicus
agtgtattatattactccgccagta

SEQ ID NO: 163583 - DNA, 25 bp, Rattus norvegicus
agtgtattcagacccctagtcttgg

SEQ ID NO: 163584 - DNA, 25 bp, Rattus norvegicus
agtgtattcagagccctagtcttgg

SEQ ID NO: 163585 - DNA, 25 bp, Rattus norvegicus
agtgtattcatcctgtgtgtgctgc

SEQ ID NO: 163586 - DNA, 25 bp, Rattus norvegicus
agtgtattcatcgtgtgtgtgctgc

SEQ ID NO: 163587 - DNA, 25 bp, Rattus norvegicus
agtgtattgtctctctattgatgca

SEQ ID NO: 163588 - DNA, 25 bp, Rattus norvegicus
agtgtattgtctgtctattgatgca

SEQ ID NO: 163589 - DNA, 25 bp, Rattus norvegicus
agtgtatttcagaccatcatcttcc

SEQ ID NO: 163590 - DNA, 25 bp, Rattus norvegicus
agtgtatttcagtccatcatcttcc

SEQ ID NO: 163591 - DNA, 25 bp, Rattus norvegicus
agtgtatttcctcatgcttctgtac

SEQ ID NO: 163592 - DNA, 25 bp, Rattus norvegicus
agtgtatttcctgatgcttctgtac

SEQ ID NO: 163593 - DNA, 25 bp, Rattus norvegicus
agtgtattttggcaaatttctagcc

SEQ ID NO: 163594 - DNA, 25 bp, Rattus norvegicus
agtgtattttgggaaatttctagcc

SEQ ID NO: 163595 - DNA, 25 bp, Rattus norvegicus
agtgtcaaactcaatctttccgtgt

SEQ ID NO: 163596 - DNA, 25 bp, Rattus norvegicus
agtgtcaaactctatctttccgtgt

SEQ ID NO: 163597 - DNA, 25 bp, Rattus norvegicus
agtgtcaacaggagctggccaggct

SEQ ID NO: 163598 - DNA, 25 bp, Rattus norvegicus
agtgtcaacaggtgctggccaggct

SEQ ID NO: 163599 - DNA, 25 bp, Rattus norvegicus
agtgtcaacatgactccgacgagat

SEQ ID NO: 163600 - DNA, 25 bp, Rattus norvegicus
agtgtcaacatgtctccgacgagat

SEQ ID NO: 163601 - DNA, 25 bp, Rattus norvegicus
agtgtcaaccatcactttgacctcc

SEQ ID NO: 163602 - DNA, 25 bp, Rattus norvegicus
agtgtcaaccatgactttgacctcc

SEQ ID NO: 163603 - DNA, 25 bp, Rattus norvegicus
agtgtcaactggatgagtaccgagt

SEQ ID NO: 163604 - DNA, 25 bp, Rattus norvegicus
agtgtcaactggttgagtaccgagt

SEQ ID NO: 163605 - DNA, 25 bp, Rattus norvegicus
agtgtcaactgtctcttctcaatgt

SEQ ID NO: 163606 - DNA, 25 bp, Rattus norvegicus
agtgtcaactgtgtcttctcaatgt

SEQ ID NO: 163607 - DNA, 25 bp, Rattus norvegicus
agtgtcaagagtcccagaagacctt

SEQ ID NO: 163608 - DNA, 25 bp, Rattus norvegicus
agtgtcaagagtgccagaagacctt

SEQ ID NO: 163609 - DNA, 25 bp, Rattus norvegicus
agtgtcaattccagggtagtatcca

SEQ ID NO: 163610 - DNA, 25 bp, Rattus norvegicus
agtgtcaattcctgggtagtatcca

SEQ ID NO: 163611 - DNA, 25 bp, Rattus norvegicus
agtgtcacataaaaaccctgggtct

SEQ ID NO: 163612 - DNA, 25 bp, Rattus norvegicus
agtgtcacataataaccctgggtct

SEQ ID NO: 163613 - DNA, 25 bp, Rattus norvegicus
agtgtcacatttatctagttagagg

SEQ ID NO: 163614 - DNA, 25 bp, Rattus norvegicus
agtgtcacatttttctagttagagg

SEQ ID NO: 163615 - DNA, 25 bp, Rattus norvegicus
agtgtcaccattagaacagcccagg

SEQ ID NO: 163616 - DNA, 25 bp, Rattus norvegicus
agtgtcaccatttgaacagcccagg

SEQ ID NO: 163617 - DNA, 25 bp, Rattus norvegicus
agtgtcacccttcttgagactggac

SEQ ID NO: 163618 - DNA, 25 bp, Rattus norvegicus
agtgtcacccttgttgagactggac

SEQ ID NO: 163619 - DNA, 25 bp, Rattus norvegicus
agtgtcaccggcagatgcagcagca

SEQ ID NO: 163620 - DNA, 25 bp, Rattus norvegicus
agtgtcaccggctgatgcagcagca

SEQ ID NO: 163621 - DNA, 25 bp, Rattus norvegicus
agtgtcactcttcaattctgcctta

SEQ ID NO: 163622 - DNA, 25 bp, Rattus norvegicus
agtgtcactcttgaattctgcctta

SEQ ID NO: 163623 - DNA, 25 bp, Rattus norvegicus
agtgtcactgtgagagtccggcttc

SEQ ID NO: 163624 - DNA, 25 bp, Rattus norvegicus
agtgtcactgtgtgagtccggcttc

SEQ ID NO: 163625 - DNA, 25 bp, Rattus norvegicus
agtgtcacttccataatgctctcat

SEQ ID NO: 163626 - DNA, 25 bp, Rattus norvegicus
agtgtcacttccttaatgctctcat

SEQ ID NO: 163627 - DNA, 25 bp, Rattus norvegicus
agtgtcagaatgagggaggaatccc

SEQ ID NO: 163628 - DNA, 25 bp, Rattus norvegicus
agtgtcagaatgtgggaggaatccc

SEQ ID NO: 163629 - DNA, 25 bp, Rattus norvegicus
agtgtcagaggacggttcaaccaca

SEQ ID NO: 163630 - DNA, 25 bp, Rattus norvegicus
agtgtcagaggagggttcaaccaca

SEQ ID NO: 163631 - DNA, 25 bp, Rattus norvegicus
agtgtcagcactcccaattctgcta

SEQ ID NO: 163632 - DNA, 25 bp, Rattus norvegicus
agtgtcagcactgccaattctgcta

SEQ ID NO: 163633 - DNA, 25 bp, Rattus norvegicus
agtgtcagcctcacacaggttaatt

SEQ ID NO: 163634 - DNA, 25 bp, Rattus norvegicus
agtgtcagcctctcacaggttaatt

SEQ ID NO: 163635 - DNA, 25 bp, Rattus norvegicus
agtgtcagctctactagctccaact

SEQ ID NO: 163636 - DNA, 25 bp, Rattus norvegicus
agtgtcagctcttctagctccaact

SEQ ID NO: 163637 - DNA, 25 bp, Rattus norvegicus
agtgtcaggataaattcttgtggaa

SEQ ID NO: 163638 - DNA, 25 bp, Rattus norvegicus
agtgtcaggatatattcttgtggaa

SEQ ID NO: 163639 - DNA, 25 bp, Rattus norvegicus
agtgtcaggctcaagatgaactctt

SEQ ID NO: 163640 - DNA, 25 bp, Rattus norvegicus
agtgtcaggctctagatgaactctt

SEQ ID NO: 163641 - DNA, 25 bp, Rattus norvegicus
agtgtcagggccacagctcaggtct

SEQ ID NO: 163642 - DNA, 25 bp, Rattus norvegicus
agtgtcagggcctcagctcaggtct

SEQ ID NO: 163643 - DNA, 25 bp, Rattus norvegicus
agtgtcaggtttaggttagcagcga

SEQ ID NO: 163644 - DNA, 25 bp, Rattus norvegicus
agtgtcaggttttggttagcagcga

SEQ ID NO: 163645 - DNA, 25 bp, Rattus norvegicus
agtgtcagtaccagtggcactgctg

SEQ ID NO: 163646 - DNA, 25 bp, Rattus norvegicus
agtgtcagtacctgtggcactgctg

SEQ ID NO: 163647 - DNA, 25 bp, Rattus norvegicus
agtgtcagtgatattctcccagaat

SEQ ID NO: 163648 - DNA, 25 bp, Rattus norvegicus
agtgtcagtgattttctcccagaat

SEQ ID NO: 163649 - DNA, 25 bp, Rattus norvegicus
agtgtcatacacagctacctacttg

SEQ ID NO: 163650 - DNA, 25 bp, Rattus norvegicus
agtgtcatacactgctacctacttg

SEQ ID NO: 163651 - DNA, 25 bp, Rattus norvegicus
agtgtcatcacaaagactccgggag

SEQ ID NO: 163652 - DNA, 25 bp, Rattus norvegicus
agtgtcatcacatagactccgggag

SEQ ID NO: 163653 - DNA, 25 bp, Rattus norvegicus
agtgtcatcatcagtcatctaggga

SEQ ID NO: 163654 - DNA, 25 bp, Rattus norvegicus
agtgtcatcatctgtcatctaggga

SEQ ID NO: 163655 - DNA, 25 bp, Rattus norvegicus
agtgtcatccttcaatttatcccag

SEQ ID NO: 163656 - DNA, 25 bp, Rattus norvegicus
agtgtcatccttgaatttatcccag

SEQ ID NO: 163657 - DNA, 25 bp, Rattus norvegicus
agtgtcatcgcaaggcctacatcac

SEQ ID NO: 163658 - DNA, 25 bp, Rattus norvegicus
agtgtcatcgcatggcctacatcac

SEQ ID NO: 163659 - DNA, 25 bp, Rattus norvegicus
agtgtcatctgtccctgagttgctt

SEQ ID NO: 163660 - DNA, 25 bp, Rattus norvegicus
agtgtcatctgtgcctgagttgctt

SEQ ID NO: 163661 - DNA, 25 bp, Rattus norvegicus
agtgtcatgcccagccttgaaggtg

SEQ ID NO: 163662 - DNA, 25 bp, Rattus norvegicus
agtgtcatgccctgccttgaaggtg

SEQ ID NO: 163663 - DNA, 25 bp, Rattus norvegicus
agtgtcatggtcacatggtctccaa

SEQ ID NO: 163664 - DNA, 25 bp, Rattus norvegicus
agtgtcatggtctcatggtctccaa

SEQ ID NO: 163665 - DNA, 25 bp, Rattus norvegicus
agtgtcattgtcactcagtggacca

SEQ ID NO: 163666 - DNA, 25 bp, Rattus norvegicus
agtgtcattgtctctcagtggacca

SEQ ID NO: 163667 - DNA, 25 bp, Rattus norvegicus
agtgtcatttctatgctggcagatc

SEQ ID NO: 163668 - DNA, 25 bp, Rattus norvegicus
agtgtcatttctttgctggcagatc

SEQ ID NO: 163669 - DNA, 25 bp, Rattus norvegicus
agtgtcattttgaattccctcatct

SEQ ID NO: 163670 - DNA, 25 bp, Rattus norvegicus
agtgtcattttgtattccctcatct

SEQ ID NO: 163671 - DNA, 25 bp, Rattus norvegicus
agtgtccaagagcacaggcccaaca

SEQ ID NO: 163672 - DNA, 25 bp, Rattus norvegicus
agtgtccaagaggacaggcccaaca

SEQ ID NO: 163673 - DNA, 25 bp, Rattus norvegicus
agtgtccaaggacctctgtctgatc

SEQ ID NO: 163674 - DNA, 25 bp, Rattus norvegicus
agtgtccaaggagctctgtctgatc

SEQ ID NO: 163675 - DNA, 25 bp, Rattus norvegicus
agtgtccacacgcagcacagaggat

SEQ ID NO: 163676 - DNA, 25 bp, Rattus norvegicus
agtgtccacacggagcacagaggat

SEQ ID NO: 163677 - DNA, 25 bp, Rattus norvegicus
agtgtccaccccatacttgtggagt

SEQ ID NO: 163678 - DNA, 25 bp, Rattus norvegicus
agtgtccaccccttacttgtggagt

SEQ ID NO: 163679 - DNA, 25 bp, Rattus norvegicus
agtgtccaccgcattgctttaagga

SEQ ID NO: 163680 - DNA, 25 bp, Rattus norvegicus
agtgtccaccgctttgctttaagga

SEQ ID NO: 163681 - DNA, 25 bp, Rattus norvegicus
agtgtccacctactctgctgggctg

SEQ ID NO: 163682 - DNA, 25 bp, Rattus norvegicus
agtgtccacctagtctgctgggctg

SEQ ID NO: 163683 - DNA, 25 bp, Rattus norvegicus
agtgtccagagaaggccagcacagg

SEQ ID NO: 163684 - DNA, 25 bp, Rattus norvegicus
agtgtccagagatggccagcacagg

SEQ ID NO: 163685 - DNA, 25 bp, Rattus norvegicus
agtgtccagctcagaggagttccag

SEQ ID NO: 163686 - DNA, 25 bp, Rattus norvegicus
agtgtccagctctgaggagttccag

SEQ ID NO: 163687 - DNA, 25 bp, Rattus norvegicus
agtgtccagtgccatctttcttgac

SEQ ID NO: 163688 - DNA, 25 bp, Rattus norvegicus
agtgtccagtgcgatctttcttgac

SEQ ID NO: 163689 - DNA, 25 bp, Rattus norvegicus
agtgtccagttcacattgctcctga

SEQ ID NO: 163690 - DNA, 25 bp, Rattus norvegicus
agtgtccagttctcattgctcctga

SEQ ID NO: 163691 - DNA, 25 bp, Rattus norvegicus
agtgtccatgtcctggtacggtaat

SEQ ID NO: 163692 - DNA, 25 bp, Rattus norvegicus
agtgtccatgtcgtggtacggtaat

SEQ ID NO: 163693 - DNA, 25 bp, Rattus norvegicus
agtgtcccacagagtccatagtaga

SEQ ID NO: 163694 - DNA, 25 bp, Rattus norvegicus
agtgtcccacagcttcagcagggct

SEQ ID NO: 163695 - DNA, 25 bp, Rattus norvegicus
agtgtcccacaggttcagcagggct

SEQ ID NO: 163696 - DNA, 25 bp, Rattus norvegicus
agtgtcccacagtgtccatagtaga

SEQ ID NO: 163697 - DNA, 25 bp, Rattus norvegicus
agtgtcccaccaaggtctgaaagtc

SEQ ID NO: 163698 - DNA, 25 bp, Rattus norvegicus
agtgtcccaccatggtctgaaagtc

SEQ ID NO: 163699 - DNA, 25 bp, Rattus norvegicus
agtgtcccagaaatcatccctcttg

SEQ ID NO: 163700 - DNA, 25 bp, Rattus norvegicus
agtgtcccagaattcatccctcttg

SEQ ID NO: 163701 - DNA, 25 bp, Rattus norvegicus
agtgtcccagcgcaatcgtcaatga

SEQ ID NO: 163702 - DNA, 25 bp, Rattus norvegicus
agtgtcccagcggaatcgtcaatga

SEQ ID NO: 163703 - DNA, 25 bp, Rattus norvegicus
agtgtcccaggaatgtgagtcccaa

SEQ ID NO: 163704 - DNA, 25 bp, Rattus norvegicus
agtgtcccaggattgtgagtcccaa

SEQ ID NO: 163705 - DNA, 25 bp, Rattus norvegicus
agtgtcccagttagtccacgcagtg

SEQ ID NO: 163706 - DNA, 25 bp, Rattus norvegicus
agtgtcccagtttgtccacgcagtg

SEQ ID NO: 163707 - DNA, 25 bp, Rattus norvegicus
agtgtccccaagacgtgaacgcagc

SEQ ID NO: 163708 - DNA, 25 bp, Rattus norvegicus
agtgtccccaagtcgtgaacgcagc

SEQ ID NO: 163709 - DNA, 25 bp, Rattus norvegicus
agtgtccccacaaaaggctcgtaag

SEQ ID NO: 163710 - DNA, 25 bp, Rattus norvegicus
agtgtccccacataaggctcgtaag

SEQ ID NO: 163711 - DNA, 25 bp, Rattus norvegicus
agtgtccccattaataattatttat

SEQ ID NO: 163712 - DNA, 25 bp, Rattus norvegicus
agtgtccccatttataattatttat

SEQ ID NO: 163713 - DNA, 25 bp, Rattus norvegicus
agtgtccccgaactaagcccagatg

SEQ ID NO: 163714 - DNA, 25 bp, Rattus norvegicus
agtgtccccgaagtaagcccagatg

SEQ ID NO: 163715 - DNA, 25 bp, Rattus norvegicus
agtgtcccctccaatggttaatata

SEQ ID NO: 163716 - DNA, 25 bp, Rattus norvegicus
agtgtcccctcctatggttaatata

SEQ ID NO: 163717 - DNA, 25 bp, Rattus norvegicus
agtgtccccttgctgacccatgcag

SEQ ID NO: 163718 - DNA, 25 bp, Rattus norvegicus
agtgtccccttggtgacccatgcag

SEQ ID NO: 163719 - DNA, 25 bp, Rattus norvegicus
agtgtcccggacactggaggaccag

SEQ ID NO: 163720 - DNA, 25 bp, Rattus norvegicus
agtgtcccggactctggaggaccag

SEQ ID NO: 163721 - DNA, 25 bp, Rattus norvegicus
agtgtcccggatcgcttcttttgtc

SEQ ID NO: 163722 - DNA, 25 bp, Rattus norvegicus
agtgtcccggatggcttcttttgtc

SEQ ID NO: 163723 - DNA, 25 bp, Rattus norvegicus
agtgtcccgtgcctctgatggtgaa

SEQ ID NO: 163724 - DNA, 25 bp, Rattus norvegicus
agtgtcccgtgcgtctgatggtgaa

SEQ ID NO: 163725 - DNA, 25 bp, Rattus norvegicus
agtgtccctaccagttagagagtat

SEQ ID NO: 163726 - DNA, 25 bp, Rattus norvegicus
agtgtccctacctgttagagagtat

SEQ ID NO: 163727 - DNA, 25 bp, Rattus norvegicus
agtgtccctccactctgagcaggaa

SEQ ID NO: 163728 - DNA, 25 bp, Rattus norvegicus
agtgtccctccagtctgagcaggaa

SEQ ID NO: 163729 - DNA, 25 bp, Rattus norvegicus
agtgtccctgctaatggtgtcattt

SEQ ID NO: 163730 - DNA, 25 bp, Rattus norvegicus
agtgtccctgcttatggtgtcattt

SEQ ID NO: 163731 - DNA, 25 bp, Rattus norvegicus
agtgtccctgtacctttctgcagca

SEQ ID NO: 163732 - DNA, 25 bp, Rattus norvegicus
agtgtccctgtagctttctgcagca

SEQ ID NO: 163733 - DNA, 25 bp, Rattus norvegicus
agtgtccctgttcataactgttttt

SEQ ID NO: 163734 - DNA, 25 bp, Rattus norvegicus
agtgtccctgttgataactgttttt

SEQ ID NO: 163735 - DNA, 25 bp, Rattus norvegicus
agtgtcccttggctgtcacctgtcc

SEQ ID NO: 163736 - DNA, 25 bp, Rattus norvegicus
agtgtcccttgggtgtcacctgtcc

SEQ ID NO: 163737 - DNA, 25 bp, Rattus norvegicus
agtgtccgctcaaacattagatgga

SEQ ID NO: 163738 - DNA, 25 bp, Rattus norvegicus
agtgtccgctcatacattagatgga

SEQ ID NO: 163739 - DNA, 25 bp, Rattus norvegicus
agtgtccggagacgctgctagcaca

SEQ ID NO: 163740 - DNA, 25 bp, Rattus norvegicus
agtgtccggagaggctgctagcaca

SEQ ID NO: 163741 - DNA, 25 bp, Rattus norvegicus
agtgtccgggcgactcatgtgtcta

SEQ ID NO: 163742 - DNA, 25 bp, Rattus norvegicus
agtgtccgggcgtctcatgtgtcta

SEQ ID NO: 163743 - DNA, 25 bp, Rattus norvegicus
agtgtccgtttccagcatgttggca

SEQ ID NO: 163744 - DNA, 25 bp, Rattus norvegicus
agtgtccgtttcgagcatgttggca

SEQ ID NO: 163745 - DNA, 25 bp, Rattus norvegicus
agtgtcctaatgctacctctgaaga

SEQ ID NO: 163746 - DNA, 25 bp, Rattus norvegicus
agtgtcctaatggtacctctgaaga

SEQ ID NO: 163747 - DNA, 25 bp, Rattus norvegicus
agtgtcctaggaaagtcccctacag

SEQ ID NO: 163748 - DNA, 25 bp, Rattus norvegicus
agtgtcctaggatagtcccctacag

SEQ ID NO: 163749 - DNA, 25 bp, Rattus norvegicus
agtgtcctaggcagattccatgggt

SEQ ID NO: 163750 - DNA, 25 bp, Rattus norvegicus
agtgtcctaggctgattccatgggt

SEQ ID NO: 163751 - DNA, 25 bp, Rattus norvegicus
agtgtcctcaagagatcaccagaga

SEQ ID NO: 163752 - DNA, 25 bp, Rattus norvegicus
agtgtcctcaagtgatcaccagaga

SEQ ID NO: 163753 - DNA, 25 bp, Rattus norvegicus
agtgtcctcactcggcaggtagtcc

SEQ ID NO: 163754 - DNA, 25 bp, Rattus norvegicus
agtgtcctcactgggcaggtagtcc

SEQ ID NO: 163755 - DNA, 25 bp, Rattus norvegicus
agtgtcctcatgctagctcatgcaa

SEQ ID NO: 163756 - DNA, 25 bp, Rattus norvegicus
agtgtcctcatggtagctcatgcaa

SEQ ID NO: 163757 - DNA, 25 bp, Rattus norvegicus
agtgtcctccatatgtgctatatcg

SEQ ID NO: 163758 - DNA, 25 bp, Rattus norvegicus
agtgtcctccatttgtgctatatcg

SEQ ID NO: 163759 - DNA, 25 bp, Rattus norvegicus
agtgtcctcccaagtccaaggtgac

SEQ ID NO: 163760 - DNA, 25 bp, Rattus norvegicus
agtgtcctcccatgtccaaggtgac

SEQ ID NO: 163761 - DNA, 25 bp, Rattus norvegicus
agtgtcctctgaagtaactgcctgc

SEQ ID NO: 163762 - DNA, 25 bp, Rattus norvegicus
agtgtcctctgatgtaactgcctgc

SEQ ID NO: 163763 - DNA, 25 bp, Rattus norvegicus
agtgtcctgagtccctgttaaattc

SEQ ID NO: 163764 - DNA, 25 bp, Rattus norvegicus
agtgtcctgagtgcctgttaaattc

SEQ ID NO: 163765 - DNA, 25 bp, Rattus norvegicus
agtgtcctgctgcaattctgaccta

SEQ ID NO: 163766 - DNA, 25 bp, Rattus norvegicus
agtgtcctgctggaattctgaccta

SEQ ID NO: 163767 - DNA, 25 bp, Rattus norvegicus
agtgtcctggagatgtgcttgttta

SEQ ID NO: 163768 - DNA, 25 bp, Rattus norvegicus
agtgtcctggagttgtgcttgttta

SEQ ID NO: 163769 - DNA, 25 bp, Rattus norvegicus
agtgtcctgtctcaatgccttcata

SEQ ID NO: 163770 - DNA, 25 bp, Rattus norvegicus
agtgtcctgtctgaatgccttcata

SEQ ID NO: 163771 - DNA, 25 bp, Rattus norvegicus
agtgtccttagccatgacccgagag

SEQ ID NO: 163772 - DNA, 25 bp, Rattus norvegicus
agtgtccttagcgatgacccgagag

SEQ ID NO: 163773 - DNA, 25 bp, Rattus norvegicus
agtgtccttatgaagctgtggtcca

SEQ ID NO: 163774 - DNA, 25 bp, Rattus norvegicus
agtgtccttatgaatgcctgccaga

SEQ ID NO: 163775 - DNA, 25 bp, Rattus norvegicus
agtgtccttatgtagctgtggtcca

SEQ ID NO: 163776 - DNA, 25 bp, Rattus norvegicus
agtgtccttatgtatgcctgccaga

SEQ ID NO: 163777 - DNA, 25 bp, Rattus norvegicus
agtgtccttctcacagaatcagata

SEQ ID NO: 163778 - DNA, 25 bp, Rattus norvegicus
agtgtccttctctcagaatcagata

SEQ ID NO: 163779 - DNA, 25 bp, Rattus norvegicus
agtgtcctttacctctgctgtctga

SEQ ID NO: 163780 - DNA, 25 bp, Rattus norvegicus
agtgtcctttacgtctgctgtctga

SEQ ID NO: 163781 - DNA, 25 bp, Rattus norvegicus
agtgtcgaagtacagctgtcaggct

SEQ ID NO: 163782 - DNA, 25 bp, Rattus norvegicus
agtgtcgaagtagagctgtcaggct

SEQ ID NO: 163783 - DNA, 25 bp, Rattus norvegicus
agtgtcgagaacatcaggagcccat

SEQ ID NO: 163784 - DNA, 25 bp, Rattus norvegicus
agtgtcgagaacttcaggagcccat

SEQ ID NO: 163785 - DNA, 25 bp, Rattus norvegicus
agtgtcgcccttccaaaggcagaaa

SEQ ID NO: 163786 - DNA, 25 bp, Rattus norvegicus
agtgtcgcccttgcaaaggcagaaa

SEQ ID NO: 163787 - DNA, 25 bp, Rattus norvegicus
agtgtcgcttgacccaggtcacgat

SEQ ID NO: 163788 - DNA, 25 bp, Rattus norvegicus
agtgtcgcttgagccaggtcacgat

SEQ ID NO: 163789 - DNA, 25 bp, Rattus norvegicus
agtgtcggcaccaaggtcgtctgct

SEQ ID NO: 163790 - DNA, 25 bp, Rattus norvegicus
agtgtcggcacctaggtcgtctgct

SEQ ID NO: 163791 - DNA, 25 bp, Rattus norvegicus
agtgtcggcatactgttagcagtac

SEQ ID NO: 163792 - DNA, 25 bp, Rattus norvegicus
agtgtcggcatagtgttagcagtac

SEQ ID NO: 163793 - DNA, 25 bp, Rattus norvegicus
agtgtcggccaaagggagatgtctt

SEQ ID NO: 163794 - DNA, 25 bp, Rattus norvegicus
agtgtcggccaatgggagatgtctt

SEQ ID NO: 163795 - DNA, 25 bp, Rattus norvegicus
agtgtcggcgataccacagctgtgt

SEQ ID NO: 163796 - DNA, 25 bp, Rattus norvegicus
agtgtcggcgattccacagctgtgt

SEQ ID NO: 163797 - DNA, 25 bp, Rattus norvegicus
agtgtcggtcttactaatgtagctt

SEQ ID NO: 163798 - DNA, 25 bp, Rattus norvegicus
agtgtcggtctttctaatgtagctt

SEQ ID NO: 163799 - DNA, 25 bp, Rattus norvegicus
agtgtcgtacccctgcccgaagcag

SEQ ID NO: 163800 - DNA, 25 bp, Rattus norvegicus
agtgtcgtacccgtgcccgaagcag

SEQ ID NO: 163801 - DNA, 25 bp, Rattus norvegicus
agtgtcgtcatgaacttgagggtag

SEQ ID NO: 163802 - DNA, 25 bp, Rattus norvegicus
agtgtcgtcatgtacttgagggtag

SEQ ID NO: 163803 - DNA, 25 bp, Rattus norvegicus
agtgtctaaaatcgcttccttccct

SEQ ID NO: 163804 - DNA, 25 bp, Rattus norvegicus
agtgtctaaaatggcttccttccct

SEQ ID NO: 163805 - DNA, 25 bp, Rattus norvegicus
agtgtctaaagaacagtgctgctgt

SEQ ID NO: 163806 - DNA, 25 bp, Rattus norvegicus
agtgtctaaagatcagtgctgctgt

SEQ ID NO: 163807 - DNA, 25 bp, Rattus norvegicus
agtgtctaaagcctaccaggaccgc

SEQ ID NO: 163808 - DNA, 25 bp, Rattus norvegicus
agtgtctaaagcgtaccaggaccgc

SEQ ID NO: 163809 - DNA, 25 bp, Rattus norvegicus
agtgtctaccccagtatttgtgaga

SEQ ID NO: 163810 - DNA, 25 bp, Rattus norvegicus
agtgtctacccctgtatttgtgaga

SEQ ID NO: 163811 - DNA, 25 bp, Rattus norvegicus
agtgtctaggctcttctagggaaga

SEQ ID NO: 163812 - DNA, 25 bp, Rattus norvegicus
agtgtctaggctgttctagggaaga

SEQ ID NO: 163813 - DNA, 25 bp, Rattus norvegicus
agtgtctatgtgctcacttggtcca

SEQ ID NO: 163814 - DNA, 25 bp, Rattus norvegicus
agtgtctatgtggtcacttggtcca

SEQ ID NO: 163815 - DNA, 25 bp, Rattus norvegicus
agtgtctattctaggcgtgggatgc

SEQ ID NO: 163816 - DNA, 25 bp, Rattus norvegicus
agtgtctattcttggcgtgggatgc

SEQ ID NO: 163817 - DNA, 25 bp, Rattus norvegicus
agtgtctcacgtcagcagtcaggct

SEQ ID NO: 163818 - DNA, 25 bp, Rattus norvegicus
agtgtctcacgtgagcagtcaggct

SEQ ID NO: 163819 - DNA, 25 bp, Rattus norvegicus
agtgtctcagcaacgcagagccaag

SEQ ID NO: 163820 - DNA, 25 bp, Rattus norvegicus
agtgtctcagcatcgcagagccaag

SEQ ID NO: 163821 - DNA, 25 bp, Rattus norvegicus
agtgtctcatcgcaaatgtaggcgt

SEQ ID NO: 163822 - DNA, 25 bp, Rattus norvegicus
agtgtctcatcggaaatgtaggcgt

SEQ ID NO: 163823 - DNA, 25 bp, Rattus norvegicus
agtgtctccagtatttcatcctggg

SEQ ID NO: 163824 - DNA, 25 bp, Rattus norvegicus
agtgtctccagtttttcatcctggg

SEQ ID NO: 163825 - DNA, 25 bp, Rattus norvegicus
agtgtctccccgctagcatcgaagg

SEQ ID NO: 163826 - DNA, 25 bp, Rattus norvegicus
agtgtctccccggtagcatcgaagg

SEQ ID NO: 163827 - DNA, 25 bp, Rattus norvegicus
agtgtctccctcatcttactgacta

SEQ ID NO: 163828 - DNA, 25 bp, Rattus norvegicus
agtgtctccctcttcttactgacta

SEQ ID NO: 163829 - DNA, 25 bp, Rattus norvegicus
agtgtctccctgaacttaggtttat

SEQ ID NO: 163830 - DNA, 25 bp, Rattus norvegicus
agtgtctccctgtacttaggtttat

SEQ ID NO: 163831 - DNA, 25 bp, Rattus norvegicus
agtgtctccgagaccctgagaatac

SEQ ID NO: 163832 - DNA, 25 bp, Rattus norvegicus
agtgtctccgagtccctgagaatac

SEQ ID NO: 163833 - DNA, 25 bp, Rattus norvegicus
agtgtctcctcaagcaaagcagcca

SEQ ID NO: 163834 - DNA, 25 bp, Rattus norvegicus
agtgtctcctcatgcaaagcagcca

SEQ ID NO: 163835 - DNA, 25 bp, Rattus norvegicus
agtgtctcctctcggctcaatgaat

SEQ ID NO: 163836 - DNA, 25 bp, Rattus norvegicus
agtgtctcctctgggctcaatgaat

SEQ ID NO: 163837 - DNA, 25 bp, Rattus norvegicus
agtgtctcctgaccagactgtatgc

SEQ ID NO: 163838 - DNA, 25 bp, Rattus norvegicus
agtgtctcctgagcagactgtatgc

SEQ ID NO: 163839 - DNA, 25 bp, Rattus norvegicus
agtgtctccttgctttagatttctg

SEQ ID NO: 163840 - DNA, 25 bp, Rattus norvegicus
agtgtctccttggtttagatttctg

SEQ ID NO: 163841 - DNA, 25 bp, Rattus norvegicus
agtgtctctattatctgtgcctgtt

SEQ ID NO: 163842 - DNA, 25 bp, Rattus norvegicus
agtgtctctattttctgtgcctgtt

SEQ ID NO: 163843 - DNA, 25 bp, Rattus norvegicus
agtgtctctgttaactggcctcgag

SEQ ID NO: 163844 - DNA, 25 bp, Rattus norvegicus
agtgtctctgtttactggcctcgag

SEQ ID NO: 163845 - DNA, 25 bp, Rattus norvegicus
agtgtctctttcagctactgactgt

SEQ ID NO: 163846 - DNA, 25 bp, Rattus norvegicus
agtgtctctttctgctactgactgt

SEQ ID NO: 163847 - DNA, 25 bp, Rattus norvegicus
agtgtctgaacaagatgccgccggg

SEQ ID NO: 163848 - DNA, 25 bp, Rattus norvegicus
agtgtctgaacaccatctgggcctc

SEQ ID NO: 163849 - DNA, 25 bp, Rattus norvegicus
agtgtctgaacagcatctgggcctc

SEQ ID NO: 163850 - DNA, 25 bp, Rattus norvegicus
agtgtctgaacatgatgccgccggg

SEQ ID NO: 163851 - DNA, 25 bp, Rattus norvegicus
agtgtctgaatcacatctcactaga

SEQ ID NO: 163852 - DNA, 25 bp, Rattus norvegicus
agtgtctgaatctcatctcactaga

SEQ ID NO: 163853 - DNA, 25 bp, Rattus norvegicus
agtgtctgaggcaggctcgaccaca

SEQ ID NO: 163854 - DNA, 25 bp, Rattus norvegicus
agtgtctgaggctggctcgaccaca

SEQ ID NO: 163855 - DNA, 25 bp, Rattus norvegicus
agtgtctgatccctagaccaggtcc

SEQ ID NO: 163856 - DNA, 25 bp, Rattus norvegicus
agtgtctgatccgtagaccaggtcc

SEQ ID NO: 163857 - DNA, 25 bp, Rattus norvegicus
agtgtctgatgcacctgtctgattc

SEQ ID NO: 163858 - DNA, 25 bp, Rattus norvegicus
agtgtctgatgctcctgtctgattc

SEQ ID NO: 163859 - DNA, 25 bp, Rattus norvegicus
agtgtctgcctcaaagtcttggaag

SEQ ID NO: 163860 - DNA, 25 bp, Rattus norvegicus
agtgtctgcctcctgatcatttcca

SEQ ID NO: 163861 - DNA, 25 bp, Rattus norvegicus
agtgtctgcctcgtgatcatttcca

SEQ ID NO: 163862 - DNA, 25 bp, Rattus norvegicus
agtgtctgcctctaagtcttggaag

SEQ ID NO: 163863 - DNA, 25 bp, Rattus norvegicus
agtgtctgcctgagttttgggtagc

SEQ ID NO: 163864 - DNA, 25 bp, Rattus norvegicus
agtgtctgcctgtgttttgggtagc

SEQ ID NO: 163865 - DNA, 25 bp, Rattus norvegicus
agtgtctgctccaggcctggattgt

SEQ ID NO: 163866 - DNA, 25 bp, Rattus norvegicus
agtgtctgctcctggcctggattgt

SEQ ID NO: 163867 - DNA, 25 bp, Rattus norvegicus
agtgtctgcttgctttgctagtgaa

SEQ ID NO: 163868 - DNA, 25 bp, Rattus norvegicus
agtgtctgcttggtttgctagtgaa

SEQ ID NO: 163869 - DNA, 25 bp, Rattus norvegicus
agtgtctggaccctatccagataat

SEQ ID NO: 163870 - DNA, 25 bp, Rattus norvegicus
agtgtctggaccgtatccagataat

SEQ ID NO: 163871 - DNA, 25 bp, Rattus norvegicus
agtgtctggagcacctaccgaaaga

SEQ ID NO: 163872 - DNA, 25 bp, Rattus norvegicus
agtgtctggagctcctaccgaaaga

SEQ ID NO: 163873 - DNA, 25 bp, Rattus norvegicus
agtgtctggattacctcaacagccc

SEQ ID NO: 163874 - DNA, 25 bp, Rattus norvegicus
agtgtctggattcaggacttgccct

SEQ ID NO: 163875 - DNA, 25 bp, Rattus norvegicus
agtgtctggattgaggacttgccct

SEQ ID NO: 163876 - DNA, 25 bp, Rattus norvegicus
agtgtctggatttcctcaacagccc

SEQ ID NO: 163877 - DNA, 25 bp, Rattus norvegicus
agtgtctggcacatgagagttctca

SEQ ID NO: 163878 - DNA, 25 bp, Rattus norvegicus
agtgtctggcacttgagagttctca

SEQ ID NO: 163879 - DNA, 25 bp, Rattus norvegicus
agtgtctggctcaagcctgggtttc

SEQ ID NO: 163880 - DNA, 25 bp, Rattus norvegicus
agtgtctggctctagcctgggtttc

SEQ ID NO: 163881 - DNA, 25 bp, Rattus norvegicus
agtgtctgtagaaaggagtcattcc

SEQ ID NO: 163882 - DNA, 25 bp, Rattus norvegicus
agtgtctgtagataggagtcattcc

SEQ ID NO: 163883 - DNA, 25 bp, Rattus norvegicus
agtgtctgtcgcagcaaggccaagg

SEQ ID NO: 163884 - DNA, 25 bp, Rattus norvegicus
agtgtctgtcgctgcaaggccaagg

SEQ ID NO: 163885 - DNA, 25 bp, Rattus norvegicus
agtgtctgtgaaacttccttaagca

SEQ ID NO: 163886 - DNA, 25 bp, Rattus norvegicus
agtgtctgtgaatcttccttaagca

SEQ ID NO: 163887 - DNA, 25 bp, Rattus norvegicus
agtgtctgttatctgttgctgtgta

SEQ ID NO: 163888 - DNA, 25 bp, Rattus norvegicus
agtgtctgttatgtgttgctgtgta

SEQ ID NO: 163889 - DNA, 25 bp, Rattus norvegicus
agtgtcttactcaatgtactcctgg

SEQ ID NO: 163890 - DNA, 25 bp, Rattus norvegicus
agtgtcttactctatgtactcctgg

SEQ ID NO: 163891 - DNA, 25 bp, Rattus norvegicus
agtgtcttcactagagcccttaaaa

SEQ ID NO: 163892 - DNA, 25 bp, Rattus norvegicus
agtgtcttcacttgagcccttaaaa

SEQ ID NO: 163893 - DNA, 25 bp, Rattus norvegicus
agtgtcttcagcacatggtatctcc

SEQ ID NO: 163894 - DNA, 25 bp, Rattus norvegicus
agtgtcttcagctcatggtatctcc

SEQ ID NO: 163895 - DNA, 25 bp, Rattus norvegicus
agtgtcttcctacagcaagccacat

SEQ ID NO: 163896 - DNA, 25 bp, Rattus norvegicus
agtgtcttcctagagcaagccacat

SEQ ID NO: 163897 - DNA, 25 bp, Rattus norvegicus
agtgtcttctggagcgacaggcacc

SEQ ID NO: 163898 - DNA, 25 bp, Rattus norvegicus
agtgtcttctggtgcgacaggcacc

SEQ ID NO: 163899 - DNA, 25 bp, Rattus norvegicus
agtgtcttctttctgagtccctcct

SEQ ID NO: 163900 - DNA, 25 bp, Rattus norvegicus
agtgtcttctttgtgagtccctcct

SEQ ID NO: 163901 - DNA, 25 bp, Rattus norvegicus
agtgtcttgcctctatattgctcca

SEQ ID NO: 163902 - DNA, 25 bp, Rattus norvegicus
agtgtcttgcctgtatattgctcca

SEQ ID NO: 163903 - DNA, 25 bp, Rattus norvegicus
agtgtcttgctaaggctaccctcat

SEQ ID NO: 163904 - DNA, 25 bp, Rattus norvegicus
agtgtcttgctatggctaccctcat

SEQ ID NO: 163905 - DNA, 25 bp, Rattus norvegicus
agtgtcttgtaaagttctttgccaa

SEQ ID NO: 163906 - DNA, 25 bp, Rattus norvegicus
agtgtcttgtaatgttctttgccaa

SEQ ID NO: 163907 - DNA, 25 bp, Rattus norvegicus
agtgtcttgtgtacacctactgatg

SEQ ID NO: 163908 - DNA, 25 bp, Rattus norvegicus
agtgtcttgtgttcacctactgatg

SEQ ID NO: 163909 - DNA, 25 bp, Rattus norvegicus
agtgtcttgttcatggctgcttggg

SEQ ID NO: 163910 - DNA, 25 bp, Rattus norvegicus
agtgtcttgttcttggctgcttggg

SEQ ID NO: 163911 - DNA, 25 bp, Rattus norvegicus
agtgtctttaatacttgatggtgta

SEQ ID NO: 163912 - DNA, 25 bp, Rattus norvegicus
agtgtctttaattcttgatggtgta

SEQ ID NO: 163913 - DNA, 25 bp, Rattus norvegicus
agtgtctttctgaacttcagggtca

SEQ ID NO: 163914 - DNA, 25 bp, Rattus norvegicus
agtgtctttctgtacttcagggtca

SEQ ID NO: 163915 - DNA, 25 bp, Rattus norvegicus
agtgtcttttccctcttttgcaagg

SEQ ID NO: 163916 - DNA, 25 bp, Rattus norvegicus
agtgtcttttccgtcttttgcaagg

SEQ ID NO: 163917 - DNA, 25 bp, Rattus norvegicus
agtgtgaaacggactcctcttggct

SEQ ID NO: 163918 - DNA, 25 bp, Rattus norvegicus
agtgtgaaacggtctcctcttggct

SEQ ID NO: 163919 - DNA, 25 bp, Rattus norvegicus
agtgtgaaactcatggcccgccagt

SEQ ID NO: 163920 - DNA, 25 bp, Rattus norvegicus
agtgtgaaactcttggcccgccagt

SEQ ID NO: 163921 - DNA, 25 bp, Rattus norvegicus
agtgtgaaatgcctgcctgcccgtg

SEQ ID NO: 163922 - DNA, 25 bp, Rattus norvegicus
agtgtgaaatgcgtgcctgcccgtg

SEQ ID NO: 163923 - DNA, 25 bp, Rattus norvegicus
agtgtgaacctccaaatcaactcct

SEQ ID NO: 163924 - DNA, 25 bp, Rattus norvegicus
agtgtgaacctcgaaatcaactcct

SEQ ID NO: 163925 - DNA, 25 bp, Rattus norvegicus
agtgtgaactgaccccattgacttc

SEQ ID NO: 163926 - DNA, 25 bp, Rattus norvegicus
agtgtgaactgagcccattgacttc

SEQ ID NO: 163927 - DNA, 25 bp, Rattus norvegicus
agtgtgaactgcaccttgggacaga

SEQ ID NO: 163928 - DNA, 25 bp, Rattus norvegicus
agtgtgaactgctccttgggacaga

SEQ ID NO: 163929 - DNA, 25 bp, Rattus norvegicus
agtgtgaactggcagcgttctcgcc

SEQ ID NO: 163930 - DNA, 25 bp, Rattus norvegicus
agtgtgaactgggagcgttctcgcc

SEQ ID NO: 163931 - DNA, 25 bp, Rattus norvegicus
agtgtgaagggaagggccttaacca

SEQ ID NO: 163932 - DNA, 25 bp, Rattus norvegicus
agtgtgaagggatgggccttaacca

SEQ ID NO: 163933 - DNA, 25 bp, Rattus norvegicus
agtgtgaagtccactctgaggtggt

SEQ ID NO: 163934 - DNA, 25 bp, Rattus norvegicus
agtgtgaagtcctctctgaggtggt

SEQ ID NO: 163935 - DNA, 25 bp, Rattus norvegicus
agtgtgaattcacctgcctgtgttt

SEQ ID NO: 163936 - DNA, 25 bp, Rattus norvegicus
agtgtgaattcagctgcctgtgttt

SEQ ID NO: 163937 - DNA, 25 bp, Rattus norvegicus
agtgtgacagagcatctgcctggaa

SEQ ID NO: 163938 - DNA, 25 bp, Rattus norvegicus
agtgtgacagaggatctgcctggaa

SEQ ID NO: 163939 - DNA, 25 bp, Rattus norvegicus
agtgtgacagtcaactgcagccgaa

SEQ ID NO: 163940 - DNA, 25 bp, Rattus norvegicus
agtgtgacagtcagctcttctgttg

SEQ ID NO: 163941 - DNA, 25 bp, Rattus norvegicus
agtgtgacagtctactgcagccgaa

SEQ ID NO: 163942 - DNA, 25 bp, Rattus norvegicus
agtgtgacagtctgctcttctgttg

SEQ ID NO: 163943 - DNA, 25 bp, Rattus norvegicus
agtgtgacatccagcactttgtgga

SEQ ID NO: 163944 - DNA, 25 bp, Rattus norvegicus
agtgtgacatcctgcactttgtgga

SEQ ID NO: 163945 - DNA, 25 bp, Rattus norvegicus
agtgtgaccagcagataccttgtgt

SEQ ID NO: 163946 - DNA, 25 bp, Rattus norvegicus
agtgtgaccagctgataccttgtgt

SEQ ID NO: 163947 - DNA, 25 bp, Rattus norvegicus
agtgtgaccatcagagaggccttgc

SEQ ID NO: 163948 - DNA, 25 bp, Rattus norvegicus
agtgtgaccatctgagaggccttgc

SEQ ID NO: 163949 - DNA, 25 bp, Rattus norvegicus
agtgtgaccatgatctgagaaacca

SEQ ID NO: 163950 - DNA, 25 bp, Rattus norvegicus
agtgtgaccatgttctgagaaacca

SEQ ID NO: 163951 - DNA, 25 bp, Rattus norvegicus
agtgtgacccacacaaggtgcggcc

SEQ ID NO: 163952 - DNA, 25 bp, Rattus norvegicus
agtgtgacccactcaaggtgcggcc

SEQ ID NO: 163953 - DNA, 25 bp, Rattus norvegicus
agtgtgaccccacattggtgtcttc

SEQ ID NO: 163954 - DNA, 25 bp, Rattus norvegicus
agtgtgaccccagattggtgtcttc

SEQ ID NO: 163955 - DNA, 25 bp, Rattus norvegicus
agtgtgaccctcctcttagggagga

SEQ ID NO: 163956 - DNA, 25 bp, Rattus norvegicus
agtgtgaccctcgtcttagggagga

SEQ ID NO: 163957 - DNA, 25 bp, Rattus norvegicus
agtgtgacgtagatcctgccttctg

SEQ ID NO: 163958 - DNA, 25 bp, Rattus norvegicus
agtgtgacgtagttcctgccttctg

SEQ ID NO: 163959 - DNA, 25 bp, Rattus norvegicus
agtgtgactataaccctcgtgggct

SEQ ID NO: 163960 - DNA, 25 bp, Rattus norvegicus
agtgtgactatatccctcgtgggct

SEQ ID NO: 163961 - DNA, 25 bp, Rattus norvegicus
agtgtgactatcatctgggtggttt

SEQ ID NO: 163962 - DNA, 25 bp, Rattus norvegicus
agtgtgactatcttctgggtggttt

SEQ ID NO: 163963 - DNA, 25 bp, Rattus norvegicus
agtgtgactctgatacctcgcttat

SEQ ID NO: 163964 - DNA, 25 bp, Rattus norvegicus
agtgtgactctgttacctcgcttat

SEQ ID NO: 163965 - DNA, 25 bp, Rattus norvegicus
agtgtgactgctctattccttctgt

SEQ ID NO: 163966 - DNA, 25 bp, Rattus norvegicus
agtgtgactgctgtattccttctgt

SEQ ID NO: 163967 - DNA, 25 bp, Rattus norvegicus
agtgtgactggcacaacagctacca

SEQ ID NO: 163968 - DNA, 25 bp, Rattus norvegicus
agtgtgactggctcaacagctacca

SEQ ID NO: 163969 - DNA, 25 bp, Rattus norvegicus
agtgtgacttagctcttccctgact

SEQ ID NO: 163970 - DNA, 25 bp, Rattus norvegicus
agtgtgacttaggtcttccctgact

SEQ ID NO: 163971 - DNA, 25 bp, Rattus norvegicus
agtgtgacttgtcctctttgattcc

SEQ ID NO: 163972 - DNA, 25 bp, Rattus norvegicus
agtgtgacttgtgctctttgattcc

SEQ ID NO: 163973 - DNA, 25 bp, Rattus norvegicus
agtgtgagcagcaagtagcccttct

SEQ ID NO: 163974 - DNA, 25 bp, Rattus norvegicus
agtgtgagcagctagtagcccttct

SEQ ID NO: 163975 - DNA, 25 bp, Rattus norvegicus
agtgtgagccaccttggcaagtgcc

SEQ ID NO: 163976 - DNA, 25 bp, Rattus norvegicus
agtgtgagccacgttggcaagtgcc

SEQ ID NO: 163977 - DNA, 25 bp, Rattus norvegicus
agtgtgaggcccatctcagtagaca

SEQ ID NO: 163978 - DNA, 25 bp, Rattus norvegicus
agtgtgaggcccttctcagtagaca

SEQ ID NO: 163979 - DNA, 25 bp, Rattus norvegicus
agtgtgaggcctactatcggagtgt

SEQ ID NO: 163980 - DNA, 25 bp, Rattus norvegicus
agtgtgaggccttctatcggagtgt

SEQ ID NO: 163981 - DNA, 25 bp, Rattus norvegicus
agtgtgagggctacagtcactcttt

SEQ ID NO: 163982 - DNA, 25 bp, Rattus norvegicus
agtgtgagggcttcagtcactcttt

SEQ ID NO: 163983 - DNA, 25 bp, Rattus norvegicus
agtgtgagtcacaggtccagcttcc

SEQ ID NO: 163984 - DNA, 25 bp, Rattus norvegicus
agtgtgagtcactggtccagcttcc

SEQ ID NO: 163985 - DNA, 25 bp, Rattus norvegicus
agtgtgagtcccaacttttcatagc

SEQ ID NO: 163986 - DNA, 25 bp, Rattus norvegicus
agtgtgagtccctacttttcatagc

SEQ ID NO: 163987 - DNA, 25 bp, Rattus norvegicus
agtgtgagtggcagaacctcttcct

SEQ ID NO: 163988 - DNA, 25 bp, Rattus norvegicus
agtgtgagtggctgaacctcttcct

SEQ ID NO: 163989 - DNA, 25 bp, Rattus norvegicus
agtgtgagttgcctcttttgcagac

SEQ ID NO: 163990 - DNA, 25 bp, Rattus norvegicus
agtgtgagttgcgtcttttgcagac

SEQ ID NO: 163991 - DNA, 25 bp, Rattus norvegicus
agtgtgatatttccatcgtatgtct

SEQ ID NO: 163992 - DNA, 25 bp, Rattus norvegicus
agtgtgatatttgcatcgtatgtct

SEQ ID NO: 163993 - DNA, 25 bp, Rattus norvegicus
agtgtgatcccaaacctgagttgat

SEQ ID NO: 163994 - DNA, 25 bp, Rattus norvegicus
agtgtgatcccatacctgagttgat

SEQ ID NO: 163995 - DNA, 25 bp, Rattus norvegicus
agtgtgatcccgaacagggctccaa

SEQ ID NO: 163996 - DNA, 25 bp, Rattus norvegicus
agtgtgatcccgtacagggctccaa

SEQ ID NO: 163997 - DNA, 25 bp, Rattus norvegicus
agtgtgatctcacctgtcagtccca

SEQ ID NO: 163998 - DNA, 25 bp, Rattus norvegicus
agtgtgatctcagctgtcagtccca

SEQ ID NO: 163999 - DNA, 25 bp, Rattus norvegicus
agtgtgatctccctgctgaatgagc

SEQ ID NO: 164000 - DNA, 25 bp, Rattus norvegicus
agtgtgatctccgtgctgaatgagc

SEQ ID NO: 164001 - DNA, 25 bp, Rattus norvegicus
agtgtgatggatcctgctgccgact

SEQ ID NO: 164002 - DNA, 25 bp, Rattus norvegicus
agtgtgatggatgctgctgccgact

SEQ ID NO: 164003 - DNA, 25 bp, Rattus norvegicus
agtgtgcaaacaacagtcctgtcta

SEQ ID NO: 164004 - DNA, 25 bp, Rattus norvegicus
agtgtgcaaacatcagtcctgtcta

SEQ ID NO: 164005 - DNA, 25 bp, Rattus norvegicus
agtgtgcaacccactgcggactgta

SEQ ID NO: 164006 - DNA, 25 bp, Rattus norvegicus
agtgtgcaaccctctgcggactgta

SEQ ID NO: 164007 - DNA, 25 bp, Rattus norvegicus
agtgtgcaaggccttactgcgcttg

SEQ ID NO: 164008 - DNA, 25 bp, Rattus norvegicus
agtgtgcaaggcgttactgcgcttg

SEQ ID NO: 164009 - DNA, 25 bp, Rattus norvegicus
agtgtgcaataaatggttttactct

SEQ ID NO: 164010 - DNA, 25 bp, Rattus norvegicus
agtgtgcaataattggttttactct

SEQ ID NO: 164011 - DNA, 25 bp, Rattus norvegicus
agtgtgcacactccgctgttgctca

SEQ ID NO: 164012 - DNA, 25 bp, Rattus norvegicus
agtgtgcacactgcgctgttgctca

SEQ ID NO: 164013 - DNA, 25 bp, Rattus norvegicus
agtgtgcacaggctactacgtcagg

SEQ ID NO: 164014 - DNA, 25 bp, Rattus norvegicus
agtgtgcacagggtactacgtcagg

SEQ ID NO: 164015 - DNA, 25 bp, Rattus norvegicus
agtgtgcacatgaaccagcttggct

SEQ ID NO: 164016 - DNA, 25 bp, Rattus norvegicus
agtgtgcacatgtaccagcttggct

SEQ ID NO: 164017 - DNA, 25 bp, Rattus norvegicus
agtgtgcaccacacttgcagaggac

SEQ ID NO: 164018 - DNA, 25 bp, Rattus norvegicus
agtgtgcaccactcttgcagaggac

SEQ ID NO: 164019 - DNA, 25 bp, Rattus norvegicus
agtgtgcagataagacaagggctca

SEQ ID NO: 164020 - DNA, 25 bp, Rattus norvegicus
agtgtgcagatatgacaagggctca

SEQ ID NO: 164021 - DNA, 25 bp, Rattus norvegicus
agtgtgcagtccaaacggcggcgat

SEQ ID NO: 164022 - DNA, 25 bp, Rattus norvegicus
agtgtgcagtcccatgatctgttct

SEQ ID NO: 164023 - DNA, 25 bp, Rattus norvegicus
agtgtgcagtccgatgatctgttct

SEQ ID NO: 164024 - DNA, 25 bp, Rattus norvegicus
agtgtgcagtcctaacggcggcgat

SEQ ID NO: 164025 - DNA, 25 bp, Rattus norvegicus
agtgtgcatggacccacagtacctc

SEQ ID NO: 164026 - DNA, 25 bp, Rattus norvegicus
agtgtgcatggagccacagtacctc

SEQ ID NO: 164027 - DNA, 25 bp, Rattus norvegicus
agtgtgccacaaagtagctgcccgt

SEQ ID NO: 164028 - DNA, 25 bp, Rattus norvegicus
agtgtgccacaatgtagctgcccgt

SEQ ID NO: 164029 - DNA, 25 bp, Rattus norvegicus
agtgtgccacctattaacctttgcg

SEQ ID NO: 164030 - DNA, 25 bp, Rattus norvegicus
agtgtgccaccttttaacctttgcg

SEQ ID NO: 164031 - DNA, 25 bp, Rattus norvegicus
agtgtgccaggcactcaccaggcct

SEQ ID NO: 164032 - DNA, 25 bp, Rattus norvegicus
agtgtgccaggcatgactgtcttgt

SEQ ID NO: 164033 - DNA, 25 bp, Rattus norvegicus
agtgtgccaggctctcaccaggcct

SEQ ID NO: 164034 - DNA, 25 bp, Rattus norvegicus
agtgtgccaggcttgactgtcttgt

SEQ ID NO: 164035 - DNA, 25 bp, Rattus norvegicus
agtgtgccatgtccaaggctgtctt

SEQ ID NO: 164036 - DNA, 25 bp, Rattus norvegicus
agtgtgccatgtgcaaggctgtctt

SEQ ID NO: 164037 - DNA, 25 bp, Rattus norvegicus
agtgtgccccacatacagtgtatta

SEQ ID NO: 164038 - DNA, 25 bp, Rattus norvegicus
agtgtgccccacttacagtgtatta

SEQ ID NO: 164039 - DNA, 25 bp, Rattus norvegicus
agtgtgcccctgaagacagccatgt

SEQ ID NO: 164040 - DNA, 25 bp, Rattus norvegicus
agtgtgcccctgtagacagccatgt

SEQ ID NO: 164041 - DNA, 25 bp, Rattus norvegicus
agtgtgcccgtcatgctattaaaaa

SEQ ID NO: 164042 - DNA, 25 bp, Rattus norvegicus
agtgtgcccgtcttgctattaaaaa

SEQ ID NO: 164043 - DNA, 25 bp, Rattus norvegicus
agtgtgccgtgactagacccagcgc

SEQ ID NO: 164044 - DNA, 25 bp, Rattus norvegicus
agtgtgccgtgagtagacccagcgc

SEQ ID NO: 164045 - DNA, 25 bp, Rattus norvegicus
agtgtgcctctgagtgaatcctgtc

SEQ ID NO: 164046 - DNA, 25 bp, Rattus norvegicus
agtgtgcctctgtgtgaatcctgtc

SEQ ID NO: 164047 - DNA, 25 bp, Rattus norvegicus
agtgtgcctggcagctatgaatcat

SEQ ID NO: 164048 - DNA, 25 bp, Rattus norvegicus
agtgtgcctggctgctatgaatcat

SEQ ID NO: 164049 - DNA, 25 bp, Rattus norvegicus
agtgtgcgcacgactctgtatgtgt

SEQ ID NO: 164050 - DNA, 25 bp, Rattus norvegicus
agtgtgcgcacgtctctgtatgtgt

SEQ ID NO: 164051 - DNA, 25 bp, Rattus norvegicus
agtgtgctacatctcctgttaatga

SEQ ID NO: 164052 - DNA, 25 bp, Rattus norvegicus
agtgtgctacatgtcctgttaatga

SEQ ID NO: 164053 - DNA, 25 bp, Rattus norvegicus
agtgtgctacccaaggcagctgcaa

SEQ ID NO: 164054 - DNA, 25 bp, Rattus norvegicus
agtgtgctaccctaggcagctgcaa

SEQ ID NO: 164055 - DNA, 25 bp, Rattus norvegicus
agtgtgctaggaaactgcttgctcc

SEQ ID NO: 164056 - DNA, 25 bp, Rattus norvegicus
agtgtgctaggatactgcttgctcc

SEQ ID NO: 164057 - DNA, 25 bp, Rattus norvegicus
agtgtgctatccactaaactcctaa

SEQ ID NO: 164058 - DNA, 25 bp, Rattus norvegicus
agtgtgctatcctctaaactcctaa

SEQ ID NO: 164059 - DNA, 25 bp, Rattus norvegicus
agtgtgctatttactcttcctttga

SEQ ID NO: 164060 - DNA, 25 bp, Rattus norvegicus
agtgtgctattttctcttcctttga

SEQ ID NO: 164061 - DNA, 25 bp, Rattus norvegicus
agtgtgctcacccagacagagaaat

SEQ ID NO: 164062 - DNA, 25 bp, Rattus norvegicus
agtgtgctcaccgagacagagaaat

SEQ ID NO: 164063 - DNA, 25 bp, Rattus norvegicus
agtgtgctcaggacaagtctctcgc

SEQ ID NO: 164064 - DNA, 25 bp, Rattus norvegicus
agtgtgctcaggtcaagtctctcgc

SEQ ID NO: 164065 - DNA, 25 bp, Rattus norvegicus
agtgtgctcatcaggaggctgcgat

SEQ ID NO: 164066 - DNA, 25 bp, Rattus norvegicus
agtgtgctcatctggaggctgcgat

SEQ ID NO: 164067 - DNA, 25 bp, Rattus norvegicus
agtgtgctcctcaagcattcatgaa

SEQ ID NO: 164068 - DNA, 25 bp, Rattus norvegicus
agtgtgctcctctagcattcatgaa

SEQ ID NO: 164069 - DNA, 25 bp, Rattus norvegicus
agtgtgctcctgcttctgtgtttga

SEQ ID NO: 164070 - DNA, 25 bp, Rattus norvegicus
agtgtgctcctggttctgtgtttga

SEQ ID NO: 164071 - DNA, 25 bp, Rattus norvegicus
agtgtgctcgcactggatcgctgtc

SEQ ID NO: 164072 - DNA, 25 bp, Rattus norvegicus
agtgtgctcgcagtggatcgctgtc

SEQ ID NO: 164073 - DNA, 25 bp, Rattus norvegicus
agtgtgctctctctatactgtgtca

SEQ ID NO: 164074 - DNA, 25 bp, Rattus norvegicus
agtgtgctctctgtatactgtgtca

SEQ ID NO: 164075 - DNA, 25 bp, Rattus norvegicus
agtgtgctctgaccatgacctaggc

SEQ ID NO: 164076 - DNA, 25 bp, Rattus norvegicus
agtgtgctctgagcatgacctaggc

SEQ ID NO: 164077 - DNA, 25 bp, Rattus norvegicus
agtgtgctctggacttaatcctaca

SEQ ID NO: 164078 - DNA, 25 bp, Rattus norvegicus
agtgtgctctggtcttaatcctaca

SEQ ID NO: 164079 - DNA, 25 bp, Rattus norvegicus
agtgtgctctgtaagactcctgcat

SEQ ID NO: 164080 - DNA, 25 bp, Rattus norvegicus
agtgtgctctgttagactcctgcat

SEQ ID NO: 164081 - DNA, 25 bp, Rattus norvegicus
agtgtgctgactcgtctgtgatttc

SEQ ID NO: 164082 - DNA, 25 bp, Rattus norvegicus
agtgtgctgactggtctgtgatttc

SEQ ID NO: 164083 - DNA, 25 bp, Rattus norvegicus
agtgtgctgagcattaccattaaac

SEQ ID NO: 164084 - DNA, 25 bp, Rattus norvegicus
agtgtgctgagctttaccattaaac

SEQ ID NO: 164085 - DNA, 25 bp, Rattus norvegicus
agtgtgctgatgaccagctggtgtc

SEQ ID NO: 164086 - DNA, 25 bp, Rattus norvegicus
agtgtgctgatgtccagctggtgtc

SEQ ID NO: 164087 - DNA, 25 bp, Rattus norvegicus
agtgtgctgcacatgagacatgcgg

SEQ ID NO: 164088 - DNA, 25 bp, Rattus norvegicus
agtgtgctgcacttgagacatgcgg

SEQ ID NO: 164089 - DNA, 25 bp, Rattus norvegicus
agtgtgctgcttatattctgacctt

SEQ ID NO: 164090 - DNA, 25 bp, Rattus norvegicus
agtgtgctgcttttattctgacctt

SEQ ID NO: 164091 - DNA, 25 bp, Rattus norvegicus
agtgtgctgtccagtctgaaagaga

SEQ ID NO: 164092 - DNA, 25 bp, Rattus norvegicus
agtgtgctgtcctgtctgaaagaga

SEQ ID NO: 164093 - DNA, 25 bp, Rattus norvegicus
agtgtgcttaggctttactatgtat

SEQ ID NO: 164094 - DNA, 25 bp, Rattus norvegicus
agtgtgcttagggtttactatgtat

SEQ ID NO: 164095 - DNA, 25 bp, Rattus norvegicus
agtgtgcttagtatttccttttgca

SEQ ID NO: 164096 - DNA, 25 bp, Rattus norvegicus
agtgtgcttagtttttccttttgca

SEQ ID NO: 164097 - DNA, 25 bp, Rattus norvegicus
agtgtgcttgacctgatgggccata

SEQ ID NO: 164098 - DNA, 25 bp, Rattus norvegicus
agtgtgcttgacgtgatgggccata

SEQ ID NO: 164099 - DNA, 25 bp, Rattus norvegicus
agtgtggaacagattctcgcctgtc

SEQ ID NO: 164100 - DNA, 25 bp, Rattus norvegicus
agtgtggaacagtttctcgcctgtc

SEQ ID NO: 164101 - DNA, 25 bp, Rattus norvegicus
agtgtggaagcgagcagcctgtaca

SEQ ID NO: 164102 - DNA, 25 bp, Rattus norvegicus
agtgtggaagcgtgcagcctgtaca

SEQ ID NO: 164103 - DNA, 25 bp, Rattus norvegicus
agtgtggacagcatggacttcacca

SEQ ID NO: 164104 - DNA, 25 bp, Rattus norvegicus
agtgtggacagcttggacttcacca

SEQ ID NO: 164105 - DNA, 25 bp, Rattus norvegicus
agtgtggagctgacgccagactaca

SEQ ID NO: 164106 - DNA, 25 bp, Rattus norvegicus
agtgtggagctgtcgccagactaca

SEQ ID NO: 164107 - DNA, 25 bp, Rattus norvegicus
agtgtggagcttacctggcaggaac

SEQ ID NO: 164108 - DNA, 25 bp, Rattus norvegicus
agtgtggagctttcctggcaggaac

SEQ ID NO: 164109 - DNA, 25 bp, Rattus norvegicus
agtgtggatagtactgttctctcag

SEQ ID NO: 164110 - DNA, 25 bp, Rattus norvegicus
agtgtggatagttctgttctctcag

SEQ ID NO: 164111 - DNA, 25 bp, Rattus norvegicus
agtgtggatccgagccctcggagcc

SEQ ID NO: 164112 - DNA, 25 bp, Rattus norvegicus
agtgtggatccgtgccctcggagcc

SEQ ID NO: 164113 - DNA, 25 bp, Rattus norvegicus
agtgtggattacctagccctggact

SEQ ID NO: 164114 - DNA, 25 bp, Rattus norvegicus
agtgtggattacgtagccctggact

SEQ ID NO: 164115 - DNA, 25 bp, Rattus norvegicus
agtgtggccagcagcagcgcctgtt

SEQ ID NO: 164116 - DNA, 25 bp, Rattus norvegicus
agtgtggccagctgcagcgcctgtt

SEQ ID NO: 164117 - DNA, 25 bp, Rattus norvegicus
agtgtggcccaacattgctgaaata

SEQ ID NO: 164118 - DNA, 25 bp, Rattus norvegicus
agtgtggcccaagattgctgaaata

SEQ ID NO: 164119 - DNA, 25 bp, Rattus norvegicus
agtgtggccgccagcgtcacaagga

SEQ ID NO: 164120 - DNA, 25 bp, Rattus norvegicus
agtgtggccgcctgcgtcacaagga

SEQ ID NO: 164121 - DNA, 25 bp, Rattus norvegicus
agtgtggccgtcacctgaaggcgtt

SEQ ID NO: 164122 - DNA, 25 bp, Rattus norvegicus
agtgtggccgtctcctgaaggcgtt

SEQ ID NO: 164123 - DNA, 25 bp, Rattus norvegicus
agtgtggcctttccagacattactg

SEQ ID NO: 164124 - DNA, 25 bp, Rattus norvegicus
agtgtggcctttgcagacattactg

SEQ ID NO: 164125 - DNA, 25 bp, Rattus norvegicus
agtgtggctcccaaagctgaagctt

SEQ ID NO: 164126 - DNA, 25 bp, Rattus norvegicus
agtgtggctccctaagctgaagctt

SEQ ID NO: 164127 - DNA, 25 bp, Rattus norvegicus
agtgtggctctgattctgcccgcta

SEQ ID NO: 164128 - DNA, 25 bp, Rattus norvegicus
agtgtggctctgcttttattgacca

SEQ ID NO: 164129 - DNA, 25 bp, Rattus norvegicus
agtgtggctctggttttattgacca

SEQ ID NO: 164130 - DNA, 25 bp, Rattus norvegicus
agtgtggctctgtttctgcccgcta

SEQ ID NO: 164131 - DNA, 25 bp, Rattus norvegicus
agtgtggctgccacctgagattgat

SEQ ID NO: 164132 - DNA, 25 bp, Rattus norvegicus
agtgtggctgcctcctgagattgat

SEQ ID NO: 164133 - DNA, 25 bp, Rattus norvegicus
agtgtggctgctcctagagttgcca

SEQ ID NO: 164134 - DNA, 25 bp, Rattus norvegicus
agtgtggctgctgctagagttgcca

SEQ ID NO: 164135 - DNA, 25 bp, Rattus norvegicus
agtgtggctgtgatagcaccttcaa

SEQ ID NO: 164136 - DNA, 25 bp, Rattus norvegicus
agtgtggctgtgttagcaccttcaa

SEQ ID NO: 164137 - DNA, 25 bp, Rattus norvegicus
agtgtggctttgatggccacgacca

SEQ ID NO: 164138 - DNA, 25 bp, Rattus norvegicus
agtgtggctttgttggccacgacca

SEQ ID NO: 164139 - DNA, 25 bp, Rattus norvegicus
agtgtgggacttatgaactctacaa

SEQ ID NO: 164140 - DNA, 25 bp, Rattus norvegicus
agtgtgggacttttgaactctacaa

SEQ ID NO: 164141 - DNA, 25 bp, Rattus norvegicus
agtgtgggaggcatctcctttcacc

SEQ ID NO: 164142 - DNA, 25 bp, Rattus norvegicus
agtgtgggaggcttctcctttcacc

SEQ ID NO: 164143 - DNA, 25 bp, Rattus norvegicus
agtgtgggcaaaacctcattccttt

SEQ ID NO: 164144 - DNA, 25 bp, Rattus norvegicus
agtgtgggcaaatcctcattccttt

SEQ ID NO: 164145 - DNA, 25 bp, Rattus norvegicus
agtgtgggccaccatgtgcattcct

SEQ ID NO: 164146 - DNA, 25 bp, Rattus norvegicus
agtgtgggccacgatgtgcattcct

SEQ ID NO: 164147 - DNA, 25 bp, Rattus norvegicus
agtgtgggctacagccccaccttac

SEQ ID NO: 164148 - DNA, 25 bp, Rattus norvegicus
agtgtgggctactgccccaccttac

SEQ ID NO: 164149 - DNA, 25 bp, Rattus norvegicus
agtgtgggctcaatgttgtctttaa

SEQ ID NO: 164150 - DNA, 25 bp, Rattus norvegicus
agtgtgggctcattgttgtctttaa

SEQ ID NO: 164151 - DNA, 25 bp, Rattus norvegicus
agtgtgggctccatctgcctgggca

SEQ ID NO: 164152 - DNA, 25 bp, Rattus norvegicus
agtgtgggctccttctgcctgggca

SEQ ID NO: 164153 - DNA, 25 bp, Rattus norvegicus
agtgtgggctctctgtagtagggat

SEQ ID NO: 164154 - DNA, 25 bp, Rattus norvegicus
agtgtgggctctgtgtagtagggat

SEQ ID NO: 164155 - DNA, 25 bp, Rattus norvegicus
agtgtgggcttgaagtcctaacgct

SEQ ID NO: 164156 - DNA, 25 bp, Rattus norvegicus
agtgtgggcttgcaaaattcctgtc

SEQ ID NO: 164157 - DNA, 25 bp, Rattus norvegicus
agtgtgggcttggaaaattcctgtc

SEQ ID NO: 164158 - DNA, 25 bp, Rattus norvegicus
agtgtgggcttgtagtcctaacgct

SEQ ID NO: 164159 - DNA, 25 bp, Rattus norvegicus
agtgtgggttctcgcctcatctcta

SEQ ID NO: 164160 - DNA, 25 bp, Rattus norvegicus
agtgtgggttctggcctcatctcta

SEQ ID NO: 164161 - DNA, 25 bp, Rattus norvegicus
agtgtggtacacaggctggccattg

SEQ ID NO: 164162 - DNA, 25 bp, Rattus norvegicus
agtgtggtacactggctggccattg

SEQ ID NO: 164163 - DNA, 25 bp, Rattus norvegicus
agtgtggtccagaacagcgaaagtc

SEQ ID NO: 164164 - DNA, 25 bp, Rattus norvegicus
agtgtggtccagtacagcgaaagtc

SEQ ID NO: 164165 - DNA, 25 bp, Rattus norvegicus
agtgtggtgccaccttcacgtggat

SEQ ID NO: 164166 - DNA, 25 bp, Rattus norvegicus
agtgtggtgccagcttcacgtggat

SEQ ID NO: 164167 - DNA, 25 bp, Rattus norvegicus
agtgtggtgctcactgtatctgtga

SEQ ID NO: 164168 - DNA, 25 bp, Rattus norvegicus
agtgtggtgctctctgtatctgtga

SEQ ID NO: 164169 - DNA, 25 bp, Rattus norvegicus
agtgtggtgtccacctgagtggaaa

SEQ ID NO: 164170 - DNA, 25 bp, Rattus norvegicus
agtgtggtgtcctcctgagtggaaa

SEQ ID NO: 164171 - DNA, 25 bp, Rattus norvegicus
agtgtggtttaccaatcctggcctt

SEQ ID NO: 164172 - DNA, 25 bp, Rattus norvegicus
agtgtggtttacgaatcctggcctt

SEQ ID NO: 164173 - DNA, 25 bp, Rattus norvegicus
agtgtggtttcaattacgtgcccca

SEQ ID NO: 164174 - DNA, 25 bp, Rattus norvegicus
agtgtggtttcatttacgtgcccca

SEQ ID NO: 164175 - DNA, 25 bp, Rattus norvegicus
agtgtgtaccaaagagcgcaggact

SEQ ID NO: 164176 - DNA, 25 bp, Rattus norvegicus
agtgtgtaccaatgagcgcaggact

SEQ ID NO: 164177 - DNA, 25 bp, Rattus norvegicus
agtgtgtaccagaagctccgggagc

SEQ ID NO: 164178 - DNA, 25 bp, Rattus norvegicus
agtgtgtaccagtagctccgggagc

SEQ ID NO: 164179 - DNA, 25 bp, Rattus norvegicus
agtgtgtatatgaggccctgggaaa

SEQ ID NO: 164180 - DNA, 25 bp, Rattus norvegicus
agtgtgtatatgtggccctgggaaa

SEQ ID NO: 164181 - DNA, 25 bp, Rattus norvegicus
agtgtgtcaggcacatgattgttga

SEQ ID NO: 164182 - DNA, 25 bp, Rattus norvegicus
agtgtgtcaggctcatgattgttga

SEQ ID NO: 164183 - DNA, 25 bp, Rattus norvegicus
agtgtgtccagcatcatggcctcgt

SEQ ID NO: 164184 - DNA, 25 bp, Rattus norvegicus
agtgtgtccagcttcatggcctcgt

SEQ ID NO: 164185 - DNA, 25 bp, Rattus norvegicus
agtgtgtccaggagttcatcgacgc

SEQ ID NO: 164186 - DNA, 25 bp, Rattus norvegicus
agtgtgtccaggtgttcatcgacgc

SEQ ID NO: 164187 - DNA, 25 bp, Rattus norvegicus
agtgtgtccccgagcattaatggct

SEQ ID NO: 164188 - DNA, 25 bp, Rattus norvegicus
agtgtgtccccgtgcattaatggct

SEQ ID NO: 164189 - DNA, 25 bp, Rattus norvegicus
agtgtgtccgccacactgagcagag

SEQ ID NO: 164190 - DNA, 25 bp, Rattus norvegicus
agtgtgtccgcctcactgagcagag

SEQ ID NO: 164191 - DNA, 25 bp, Rattus norvegicus
agtgtgtccggacagcttgtactgc

SEQ ID NO: 164192 - DNA, 25 bp, Rattus norvegicus
agtgtgtccggagagcttgtactgc

SEQ ID NO: 164193 - DNA, 25 bp, Rattus norvegicus
agtgtgtccgtgattcgaggttgct

SEQ ID NO: 164194 - DNA, 25 bp, Rattus norvegicus
agtgtgtccgtgtttcgaggttgct

SEQ ID NO: 164195 - DNA, 25 bp, Rattus norvegicus
agtgtgtcctttcgatgcttcttga

SEQ ID NO: 164196 - DNA, 25 bp, Rattus norvegicus
agtgtgtcctttggatgcttcttga

SEQ ID NO: 164197 - DNA, 25 bp, Rattus norvegicus
agtgtgtctctcaatggttccattt

SEQ ID NO: 164198 - DNA, 25 bp, Rattus norvegicus
agtgtgtctctctatggttccattt

SEQ ID NO: 164199 - DNA, 25 bp, Rattus norvegicus
agtgtgtctgtgaccgcaggaatgt

SEQ ID NO: 164200 - DNA, 25 bp, Rattus norvegicus
agtgtgtctgtgtccgcaggaatgt

SEQ ID NO: 164201 - DNA, 25 bp, Rattus norvegicus
agtgtgtcttgtccagttctgtatg

SEQ ID NO: 164202 - DNA, 25 bp, Rattus norvegicus
agtgtgtcttgtgcagttctgtatg

SEQ ID NO: 164203 - DNA, 25 bp, Rattus norvegicus
agtgtgtctttgattcatcatggga

SEQ ID NO: 164204 - DNA, 25 bp, Rattus norvegicus
agtgtgtctttgtttcatcatggga

SEQ ID NO: 164205 - DNA, 25 bp, Rattus norvegicus
agtgtgtgaataaggcctcaggccc

SEQ ID NO: 164206 - DNA, 25 bp, Rattus norvegicus
agtgtgtgaatatggcctcaggccc

SEQ ID NO: 164207 - DNA, 25 bp, Rattus norvegicus
agtgtgtgactcctcaaaccaggtc

SEQ ID NO: 164208 - DNA, 25 bp, Rattus norvegicus
agtgtgtgactcgtcaaaccaggtc

SEQ ID NO: 164209 - DNA, 25 bp, Rattus norvegicus
agtgtgtgatgcagtctactgttga

SEQ ID NO: 164210 - DNA, 25 bp, Rattus norvegicus
agtgtgtgatgctgtctactgttga

SEQ ID NO: 164211 - DNA, 25 bp, Rattus norvegicus
agtgtgtgccacacagcatacctgt

SEQ ID NO: 164212 - DNA, 25 bp, Rattus norvegicus
agtgtgtgccactcagcatacctgt

SEQ ID NO: 164213 - DNA, 25 bp, Rattus norvegicus
agtgtgtgcctcatggtgacagttc

SEQ ID NO: 164214 - DNA, 25 bp, Rattus norvegicus
agtgtgtgcctcttggtgacagttc

SEQ ID NO: 164215 - DNA, 25 bp, Rattus norvegicus
agtgtgtgcctgactgactttgttc

SEQ ID NO: 164216 - DNA, 25 bp, Rattus norvegicus
agtgtgtgcctgtctgactttgttc

SEQ ID NO: 164217 - DNA, 25 bp, Rattus norvegicus
agtgtgtgctggaccacaggccgaa

SEQ ID NO: 164218 - DNA, 25 bp, Rattus norvegicus
agtgtgtgctggtccacaggccgaa

SEQ ID NO: 164219 - DNA, 25 bp, Rattus norvegicus
agtgtgtggatcctctcacctcaag

SEQ ID NO: 164220 - DNA, 25 bp, Rattus norvegicus
agtgtgtggatcgtctcacctcaag

SEQ ID NO: 164221 - DNA, 25 bp, Rattus norvegicus
agtgtgtggcacaccatattctgtg

SEQ ID NO: 164222 - DNA, 25 bp, Rattus norvegicus
agtgtgtggcactccatattctgtg

SEQ ID NO: 164223 - DNA, 25 bp, Rattus norvegicus
agtgtgtggcagcactgtcagcctc

SEQ ID NO: 164224 - DNA, 25 bp, Rattus norvegicus
agtgtgtggcaggactgtcagcctc

SEQ ID NO: 164225 - DNA, 25 bp, Rattus norvegicus
agtgtgtggctacacaccaggcgca

SEQ ID NO: 164226 - DNA, 25 bp, Rattus norvegicus
agtgtgtggctagacaccaggcgca

SEQ ID NO: 164227 - DNA, 25 bp, Rattus norvegicus
agtgtgtggctgatgatttgttttc

SEQ ID NO: 164228 - DNA, 25 bp, Rattus norvegicus
agtgtgtggctgttgatttgttttc

SEQ ID NO: 164229 - DNA, 25 bp, Rattus norvegicus
agtgtgtgggctatcctgttcctaa

SEQ ID NO: 164230 - DNA, 25 bp, Rattus norvegicus
agtgtgtgggctttcctgttcctaa

SEQ ID NO: 164231 - DNA, 25 bp, Rattus norvegicus
agtgtgtggtggctcgcactacaac

SEQ ID NO: 164232 - DNA, 25 bp, Rattus norvegicus
agtgtgtggtgggtcgcactacaac

SEQ ID NO: 164233 - DNA, 25 bp, Rattus norvegicus
agtgtgtgtaccatggatgcctctc

SEQ ID NO: 164234 - DNA, 25 bp, Rattus norvegicus
agtgtgtgtaccttggatgcctctc

SEQ ID NO: 164235 - DNA, 25 bp, Rattus norvegicus
agtgtgtgtcacaagcccactgtgg

SEQ ID NO: 164236 - DNA, 25 bp, Rattus norvegicus
agtgtgtgtcactagcccactgtgg

SEQ ID NO: 164237 - DNA, 25 bp, Rattus norvegicus
agtgtgtgtgagaaacatcgttgtc

SEQ ID NO: 164238 - DNA, 25 bp, Rattus norvegicus
agtgtgtgtgagtaacatcgttgtc

SEQ ID NO: 164239 - DNA, 25 bp, Rattus norvegicus
agtgtgtgtgatcgtgcaccgctca

SEQ ID NO: 164240 - DNA, 25 bp, Rattus norvegicus
agtgtgtgtgatggtgcaccgctca

SEQ ID NO: 164241 - DNA, 25 bp, Rattus norvegicus
agtgtgtgtgtgcaatgttccgttc

SEQ ID NO: 164242 - DNA, 25 bp, Rattus norvegicus
agtgtgtgtgtggaatgttccgttc

SEQ ID NO: 164243 - DNA, 25 bp, Rattus norvegicus
agtgtgtgtgttacctggttgtcag

SEQ ID NO: 164244 - DNA, 25 bp, Rattus norvegicus
agtgtgtgtgtttcctggttgtcag

SEQ ID NO: 164245 - DNA, 25 bp, Rattus norvegicus
agtgtgtgtttgaaatccctgtgcc

SEQ ID NO: 164246 - DNA, 25 bp, Rattus norvegicus
agtgtgtgtttgtaatccctgtgcc

SEQ ID NO: 164247 - DNA, 25 bp, Rattus norvegicus
agtgtgttacacaacttcataagta

SEQ ID NO: 164248 - DNA, 25 bp, Rattus norvegicus
agtgtgttacactacttcataagta

SEQ ID NO: 164249 - DNA, 25 bp, Rattus norvegicus
agtgtgttactgagtgccttggaac

SEQ ID NO: 164250 - DNA, 25 bp, Rattus norvegicus
agtgtgttactgtgtgccttggaac

SEQ ID NO: 164251 - DNA, 25 bp, Rattus norvegicus
agtgtgttatttctggatcctagca

SEQ ID NO: 164252 - DNA, 25 bp, Rattus norvegicus
agtgtgttatttgtggatcctagca

SEQ ID NO: 164253 - DNA, 25 bp, Rattus norvegicus
agtgtgttcctcagactttgtactc

SEQ ID NO: 164254 - DNA, 25 bp, Rattus norvegicus
agtgtgttcctctgactttgtactc

SEQ ID NO: 164255 - DNA, 25 bp, Rattus norvegicus
agtgtgttcctgatccatggccagc

SEQ ID NO: 164256 - DNA, 25 bp, Rattus norvegicus
agtgtgttcctgttccatggccagc

SEQ ID NO: 164257 - DNA, 25 bp, Rattus norvegicus
agtgtgttctgaactgagcttgtgg

SEQ ID NO: 164258 - DNA, 25 bp, Rattus norvegicus
agtgtgttctgatctgagcttgtgg

SEQ ID NO: 164259 - DNA, 25 bp, Rattus norvegicus
agtgtgttgacaagccatccctggc

SEQ ID NO: 164260 - DNA, 25 bp, Rattus norvegicus
agtgtgttgacatgccatccctggc

SEQ ID NO: 164261 - DNA, 25 bp, Rattus norvegicus
agtgtgttgctcagtatcatgctgt

SEQ ID NO: 164262 - DNA, 25 bp, Rattus norvegicus
agtgtgttgctctgtatcatgctgt

SEQ ID NO: 164263 - DNA, 25 bp, Rattus norvegicus
agtgtgttgtttactctgtttcaaa

SEQ ID NO: 164264 - DNA, 25 bp, Rattus norvegicus
agtgtgttgttttctctgtttcaaa

SEQ ID NO: 164265 - DNA, 25 bp, Rattus norvegicus
agtgtgtttcacatctctcaagctc

SEQ ID NO: 164266 - DNA, 25 bp, Rattus norvegicus
agtgtgtttcacttctctcaagctc

SEQ ID NO: 164267 - DNA, 25 bp, Rattus norvegicus
agtgtgtttcataacctcctgctca

SEQ ID NO: 164268 - DNA, 25 bp, Rattus norvegicus
agtgtgtttcattacctcctgctca

SEQ ID NO: 164269 - DNA, 25 bp, Rattus norvegicus
agtgtgtttctgaccagccacacag

SEQ ID NO: 164270 - DNA, 25 bp, Rattus norvegicus
agtgtgtttctgctcttctttaacc

SEQ ID NO: 164271 - DNA, 25 bp, Rattus norvegicus
agtgtgtttctggtcttctttaacc

SEQ ID NO: 164272 - DNA, 25 bp, Rattus norvegicus
agtgtgtttctgtccagccacacag

SEQ ID NO: 164273 - DNA, 25 bp, Rattus norvegicus
agtgtgtttgcacgtgagcgtccta

SEQ ID NO: 164274 - DNA, 25 bp, Rattus norvegicus
agtgtgtttgcaggtgagcgtccta

SEQ ID NO: 164275 - DNA, 25 bp, Rattus norvegicus
agtgtgtttgtgaacagacgtctca

SEQ ID NO: 164276 - DNA, 25 bp, Rattus norvegicus
agtgtgtttgtgtacagacgtctca

SEQ ID NO: 164277 - DNA, 25 bp, Rattus norvegicus
agtgtgtttgttactcagtccctgc

SEQ ID NO: 164278 - DNA, 25 bp, Rattus norvegicus
agtgtgtttgtttctcagtccctgc

SEQ ID NO: 164279 - DNA, 25 bp, Rattus norvegicus
agtgtgttttagctcctgtttcaga

SEQ ID NO: 164280 - DNA, 25 bp, Rattus norvegicus
agtgtgttttaggtcctgtttcaga

SEQ ID NO: 164281 - DNA, 25 bp, Rattus norvegicus
agtgtgtttttcactcaaaggtcta

SEQ ID NO: 164282 - DNA, 25 bp, Rattus norvegicus
agtgtgtttttctctcaaaggtcta

SEQ ID NO: 164283 - DNA, 25 bp, Rattus norvegicus
agtgttaaacacatgtcgtcccagt

SEQ ID NO: 164284 - DNA, 25 bp, Rattus norvegicus
agtgttaaacacttgtcgtcccagt

SEQ ID NO: 164285 - DNA, 25 bp, Rattus norvegicus
agtgttaagcacatggcaatcccaa

SEQ ID NO: 164286 - DNA, 25 bp, Rattus norvegicus
agtgttaagcacttggcaatcccaa

SEQ ID NO: 164287 - DNA, 25 bp, Rattus norvegicus
agtgttaagggcatgatagctcaca

SEQ ID NO: 164288 - DNA, 25 bp, Rattus norvegicus
agtgttaagggcttgatagctcaca

SEQ ID NO: 164289 - DNA, 25 bp, Rattus norvegicus
agtgttaatgacaagccccgacccg

SEQ ID NO: 164290 - DNA, 25 bp, Rattus norvegicus
agtgttaatgactagccccgacccg

SEQ ID NO: 164291 - DNA, 25 bp, Rattus norvegicus
agtgttacaaatcggccctgggtag

SEQ ID NO: 164292 - DNA, 25 bp, Rattus norvegicus
agtgttacaaatgggccctgggtag

SEQ ID NO: 164293 - DNA, 25 bp, Rattus norvegicus
agtgttacaacacactcttccacca

SEQ ID NO: 164294 - DNA, 25 bp, Rattus norvegicus
agtgttacaacagactcttccacca

SEQ ID NO: 164295 - DNA, 25 bp, Rattus norvegicus
agtgttacagttccagtcatcagcc

SEQ ID NO: 164296 - DNA, 25 bp, Rattus norvegicus
agtgttacagttgcagtcatcagcc

SEQ ID NO: 164297 - DNA, 25 bp, Rattus norvegicus
agtgttaccatgcaccctgcgaatc

SEQ ID NO: 164298 - DNA, 25 bp, Rattus norvegicus
agtgttaccatggaccctgcgaatc

SEQ ID NO: 164299 - DNA, 25 bp, Rattus norvegicus
agtgttacccctatcgatctaggct

SEQ ID NO: 164300 - DNA, 25 bp, Rattus norvegicus
agtgttacccctttcgatctaggct

SEQ ID NO: 164301 - DNA, 25 bp, Rattus norvegicus
agtgttaccctcaatcaccaagcag

SEQ ID NO: 164302 - DNA, 25 bp, Rattus norvegicus
agtgttaccctcagggtcgacctga

SEQ ID NO: 164303 - DNA, 25 bp, Rattus norvegicus
agtgttaccctctatcaccaagcag

SEQ ID NO: 164304 - DNA, 25 bp, Rattus norvegicus
agtgttaccctctgggtcgacctga

SEQ ID NO: 164305 - DNA, 25 bp, Rattus norvegicus
agtgttacctgcagtcaccgttcag

SEQ ID NO: 164306 - DNA, 25 bp, Rattus norvegicus
agtgttacctgctgtcaccgttcag

SEQ ID NO: 164307 - DNA, 25 bp, Rattus norvegicus
agtgttacctgtcgcctgttcccaa

SEQ ID NO: 164308 - DNA, 25 bp, Rattus norvegicus
agtgttacctgtggcctgttcccaa

SEQ ID NO: 164309 - DNA, 25 bp, Rattus norvegicus
agtgttacctttccgttccttgaca

SEQ ID NO: 164310 - DNA, 25 bp, Rattus norvegicus
agtgttacctttgcgttccttgaca

SEQ ID NO: 164311 - DNA, 25 bp, Rattus norvegicus
agtgttactcaacccagtcgtttgg

SEQ ID NO: 164312 - DNA, 25 bp, Rattus norvegicus
agtgttactcaagccagtcgtttgg

SEQ ID NO: 164313 - DNA, 25 bp, Rattus norvegicus
agtgttactgccaactggccactga

SEQ ID NO: 164314 - DNA, 25 bp, Rattus norvegicus
agtgttactgcctactggccactga

SEQ ID NO: 164315 - DNA, 25 bp, Rattus norvegicus
agtgttacttagcttctcttggaat

SEQ ID NO: 164316 - DNA, 25 bp, Rattus norvegicus
agtgttacttaggttctcttggaat

SEQ ID NO: 164317 - DNA, 25 bp, Rattus norvegicus
agtgttactttcatcaggtcattgt

SEQ ID NO: 164318 - DNA, 25 bp, Rattus norvegicus
agtgttactttcttcaggtcattgt

SEQ ID NO: 164319 - DNA, 25 bp, Rattus norvegicus
agtgttagacttccgtttttattag

SEQ ID NO: 164320 - DNA, 25 bp, Rattus norvegicus
agtgttagacttgcgtttttattag

SEQ ID NO: 164321 - DNA, 25 bp, Rattus norvegicus
agtgttagggccactccacggtggt

SEQ ID NO: 164322 - DNA, 25 bp, Rattus norvegicus
agtgttagggcctctccacggtggt

SEQ ID NO: 164323 - DNA, 25 bp, Rattus norvegicus
agtgttaggtgtccaccagcagcac

SEQ ID NO: 164324 - DNA, 25 bp, Rattus norvegicus
agtgttaggtgtgcaccagcagcac

SEQ ID NO: 164325 - DNA, 25 bp, Rattus norvegicus
agtgttatcctgcagcctgttgtac

SEQ ID NO: 164326 - DNA, 25 bp, Rattus norvegicus
agtgttatcctggagcctgttgtac

SEQ ID NO: 164327 - DNA, 25 bp, Rattus norvegicus
agtgttatgatcacttccagctgtg

SEQ ID NO: 164328 - DNA, 25 bp, Rattus norvegicus
agtgttatgatcattaggtcttccc

SEQ ID NO: 164329 - DNA, 25 bp, Rattus norvegicus
agtgttatgatctcttccagctgtg

SEQ ID NO: 164330 - DNA, 25 bp, Rattus norvegicus
agtgttatgatctttaggtcttccc

SEQ ID NO: 164331 - DNA, 25 bp, Rattus norvegicus
agtgttcaaaccaatgcccagactg

SEQ ID NO: 164332 - DNA, 25 bp, Rattus norvegicus
agtgttcaaacctatgcccagactg

SEQ ID NO: 164333 - DNA, 25 bp, Rattus norvegicus
agtgttcaaatgacccaacctatgg

SEQ ID NO: 164334 - DNA, 25 bp, Rattus norvegicus
agtgttcaaatgtcccaacctatgg

SEQ ID NO: 164335 - DNA, 25 bp, Rattus norvegicus
agtgttcaagccacctgtacaattg

SEQ ID NO: 164336 - DNA, 25 bp, Rattus norvegicus
agtgttcaagcctcctgtacaattg

SEQ ID NO: 164337 - DNA, 25 bp, Rattus norvegicus
agtgttcaatacagggcagccaaag

SEQ ID NO: 164338 - DNA, 25 bp, Rattus norvegicus
agtgttcaatactgggcagccaaag

SEQ ID NO: 164339 - DNA, 25 bp, Rattus norvegicus
agtgttcacaaaccttatcaccctg

SEQ ID NO: 164340 - DNA, 25 bp, Rattus norvegicus
agtgttcacaaagcttatcaccctg

SEQ ID NO: 164341 - DNA, 25 bp, Rattus norvegicus
agtgttcacaccactgtgatgacag

SEQ ID NO: 164342 - DNA, 25 bp, Rattus norvegicus
agtgttcacacctctgtgatgacag

SEQ ID NO: 164343 - DNA, 25 bp, Rattus norvegicus
agtgttcacactctgagcctcctgc

SEQ ID NO: 164344 - DNA, 25 bp, Rattus norvegicus
agtgttcacactgtgagcctcctgc

SEQ ID NO: 164345 - DNA, 25 bp, Rattus norvegicus
agtgttcaccttaagatctccctgt

SEQ ID NO: 164346 - DNA, 25 bp, Rattus norvegicus
agtgttcacctttagatctccctgt

SEQ ID NO: 164347 - DNA, 25 bp, Rattus norvegicus
agtgttcactaacatcctgcctggg

SEQ ID NO: 164348 - DNA, 25 bp, Rattus norvegicus
agtgttcactaaccctttgcttgaa

SEQ ID NO: 164349 - DNA, 25 bp, Rattus norvegicus
agtgttcactaagatcctgcctggg

SEQ ID NO: 164350 - DNA, 25 bp, Rattus norvegicus
agtgttcactaagcctttgcttgaa

SEQ ID NO: 164351 - DNA, 25 bp, Rattus norvegicus
agtgttcactttaccaaagcatcag

SEQ ID NO: 164352 - DNA, 25 bp, Rattus norvegicus
agtgttcacttttccaaagcatcag

SEQ ID NO: 164353 - DNA, 25 bp, Rattus norvegicus
agtgttcagactacgaagctaaaag

SEQ ID NO: 164354 - DNA, 25 bp, Rattus norvegicus
agtgttcagactcttgacagccttt

SEQ ID NO: 164355 - DNA, 25 bp, Rattus norvegicus
agtgttcagactgttgacagccttt

SEQ ID NO: 164356 - DNA, 25 bp, Rattus norvegicus
agtgttcagacttcgaagctaaaag

SEQ ID NO: 164357 - DNA, 25 bp, Rattus norvegicus
agtgttcagagcactctcctttgag

SEQ ID NO: 164358 - DNA, 25 bp, Rattus norvegicus
agtgttcagagctctctcctttgag

SEQ ID NO: 164359 - DNA, 25 bp, Rattus norvegicus
agtgttcagccacgtgccagtgcgc

SEQ ID NO: 164360 - DNA, 25 bp, Rattus norvegicus
agtgttcagccaggtgccagtgcgc

SEQ ID NO: 164361 - DNA, 25 bp, Rattus norvegicus
agtgttcagcttcggaatgttggaa

SEQ ID NO: 164362 - DNA, 25 bp, Rattus norvegicus
agtgttcagcttgggaatgttggaa

SEQ ID NO: 164363 - DNA, 25 bp, Rattus norvegicus
agtgttcagggtcaaagccgctacc

SEQ ID NO: 164364 - DNA, 25 bp, Rattus norvegicus
agtgttcagggtgaaagccgctacc

SEQ ID NO: 164365 - DNA, 25 bp, Rattus norvegicus
agtgttcagtcccattacgtcactt

SEQ ID NO: 164366 - DNA, 25 bp, Rattus norvegicus
agtgttcagtccgattacgtcactt

SEQ ID NO: 164367 - DNA, 25 bp, Rattus norvegicus
agtgttcagttaattgtgttattcc

SEQ ID NO: 164368 - DNA, 25 bp, Rattus norvegicus
agtgttcagttatttgtgttattcc

SEQ ID NO: 164369 - DNA, 25 bp, Rattus norvegicus
agtgttcatgagagcatggcgttga

SEQ ID NO: 164370 - DNA, 25 bp, Rattus norvegicus
agtgttcatgagtgcatggcgttga

SEQ ID NO: 164371 - DNA, 25 bp, Rattus norvegicus
agtgttcatgctacagtggtctctg

SEQ ID NO: 164372 - DNA, 25 bp, Rattus norvegicus
agtgttcatgcttcagtggtctctg

SEQ ID NO: 164373 - DNA, 25 bp, Rattus norvegicus
agtgttcattttacttacctgcata

SEQ ID NO: 164374 - DNA, 25 bp, Rattus norvegicus
agtgttcatttttcttacctgcata

SEQ ID NO: 164375 - DNA, 25 bp, Rattus norvegicus
agtgttccaaagaacctgcatccca

SEQ ID NO: 164376 - DNA, 25 bp, Rattus norvegicus
agtgttccaaagtacctgcatccca

SEQ ID NO: 164377 - DNA, 25 bp, Rattus norvegicus
agtgttccactcagtacactgggct

SEQ ID NO: 164378 - DNA, 25 bp, Rattus norvegicus
agtgttccactctgtacactgggct

SEQ ID NO: 164379 - DNA, 25 bp, Rattus norvegicus
agtgttccagtacgtcaaggtgctc

SEQ ID NO: 164380 - DNA, 25 bp, Rattus norvegicus
agtgttccagtaggtcaaggtgctc

SEQ ID NO: 164381 - DNA, 25 bp, Rattus norvegicus
agtgttcccatgactgtcttttaca

SEQ ID NO: 164382 - DNA, 25 bp, Rattus norvegicus
agtgttcccatgtctgtcttttaca

SEQ ID NO: 164383 - DNA, 25 bp, Rattus norvegicus
agtgttccctatcactgtgacagcc

SEQ ID NO: 164384 - DNA, 25 bp, Rattus norvegicus
agtgttccctatgactgtgacagcc

SEQ ID NO: 164385 - DNA, 25 bp, Rattus norvegicus
agtgttccgtgcatcaggttcctga

SEQ ID NO: 164386 - DNA, 25 bp, Rattus norvegicus
agtgttccgtgcttcaggttcctga

SEQ ID NO: 164387 - DNA, 25 bp, Rattus norvegicus
agtgttcctccacagtccgcttcag

SEQ ID NO: 164388 - DNA, 25 bp, Rattus norvegicus
agtgttcctccagagtccgcttcag

SEQ ID NO: 164389 - DNA, 25 bp, Rattus norvegicus
agtgttcctctactgcagcctagca

SEQ ID NO: 164390 - DNA, 25 bp, Rattus norvegicus
agtgttcctctagtgcagcctagca

SEQ ID NO: 164391 - DNA, 25 bp, Rattus norvegicus
agtgttccttccacctgtaggagga

SEQ ID NO: 164392 - DNA, 25 bp, Rattus norvegicus
agtgttccttcctcctgtaggagga

SEQ ID NO: 164393 - DNA, 25 bp, Rattus norvegicus
agtgttccttgtcttcgtagcttca

SEQ ID NO: 164394 - DNA, 25 bp, Rattus norvegicus
agtgttccttgtgttcgtagcttca

SEQ ID NO: 164395 - DNA, 25 bp, Rattus norvegicus
agtgttcgctctccctgtgttagaa

SEQ ID NO: 164396 - DNA, 25 bp, Rattus norvegicus
agtgttcgctctgcctgtgttagaa

SEQ ID NO: 164397 - DNA, 25 bp, Rattus norvegicus
agtgttcggctcctggcctcaaaaa

SEQ ID NO: 164398 - DNA, 25 bp, Rattus norvegicus
agtgttcggctcgtggcctcaaaaa

SEQ ID NO: 164399 - DNA, 25 bp, Rattus norvegicus
agtgttcggttcagcagttgttgga

SEQ ID NO: 164400 - DNA, 25 bp, Rattus norvegicus
agtgttcggttctgcagttgttgga

SEQ ID NO: 164401 - DNA, 25 bp, Rattus norvegicus
agtgttctaattcatccctgttggt

SEQ ID NO: 164402 - DNA, 25 bp, Rattus norvegicus
agtgttctaattgatccctgttggt

SEQ ID NO: 164403 - DNA, 25 bp, Rattus norvegicus
agtgttctagcgcattctcttgatt

SEQ ID NO: 164404 - DNA, 25 bp, Rattus norvegicus
agtgttctagcggattctcttgatt

SEQ ID NO: 164405 - DNA, 25 bp, Rattus norvegicus
agtgttctagtccagtagtatttgc

SEQ ID NO: 164406 - DNA, 25 bp, Rattus norvegicus
agtgttctagtcgagtagtatttgc

SEQ ID NO: 164407 - DNA, 25 bp, Rattus norvegicus
agtgttctatctcgcatgcttatac

SEQ ID NO: 164408 - DNA, 25 bp, Rattus norvegicus
agtgttctatctggcatgcttatac

SEQ ID NO: 164409 - DNA, 25 bp, Rattus norvegicus
agtgttctcacgagttggttcccag

SEQ ID NO: 164410 - DNA, 25 bp, Rattus norvegicus
agtgttctcacgtgttggttcccag

SEQ ID NO: 164411 - DNA, 25 bp, Rattus norvegicus
agtgttctccaactgcaaatgtcaa

SEQ ID NO: 164412 - DNA, 25 bp, Rattus norvegicus
agtgttctccaagtgcaaatgtcaa

SEQ ID NO: 164413 - DNA, 25 bp, Rattus norvegicus
agtgttctccgcctctggaaacatg

SEQ ID NO: 164414 - DNA, 25 bp, Rattus norvegicus
agtgttctccgcgtctggaaacatg

SEQ ID NO: 164415 - DNA, 25 bp, Rattus norvegicus
agtgttctctgaatcgactctgaaa

SEQ ID NO: 164416 - DNA, 25 bp, Rattus norvegicus
agtgttctctgattcgactctgaaa

SEQ ID NO: 164417 - DNA, 25 bp, Rattus norvegicus
agtgttctcttaatctgctcattgc

SEQ ID NO: 164418 - DNA, 25 bp, Rattus norvegicus
agtgttctcttattctgctcattgc

SEQ ID NO: 164419 - DNA, 25 bp, Rattus norvegicus
agtgttctgagcacccagtattgta

SEQ ID NO: 164420 - DNA, 25 bp, Rattus norvegicus
agtgttctgagctcccagtattgta

SEQ ID NO: 164421 - DNA, 25 bp, Rattus norvegicus
agtgttctgcctagtcatttagtga

SEQ ID NO: 164422 - DNA, 25 bp, Rattus norvegicus
agtgttctgccttgtcatttagtga

SEQ ID NO: 164423 - DNA, 25 bp, Rattus norvegicus
agtgttctggagagctaaggccccg

SEQ ID NO: 164424 - DNA, 25 bp, Rattus norvegicus
agtgttctggagtgctaaggccccg

SEQ ID NO: 164425 - DNA, 25 bp, Rattus norvegicus
agtgttctgggaaatgctgctctgt

SEQ ID NO: 164426 - DNA, 25 bp, Rattus norvegicus
agtgttctgggatatgctgctctgt

SEQ ID NO: 164427 - DNA, 25 bp, Rattus norvegicus
agtgttctggtgattcctgtgctga

SEQ ID NO: 164428 - DNA, 25 bp, Rattus norvegicus
agtgttctggtgtttcctgtgctga

SEQ ID NO: 164429 - DNA, 25 bp, Rattus norvegicus
agtgttctggttactgggcatcatt

SEQ ID NO: 164430 - DNA, 25 bp, Rattus norvegicus
agtgttctggtttctgggcatcatt

SEQ ID NO: 164431 - DNA, 25 bp, Rattus norvegicus
agtgttctgtgtcacaaccaacctc

SEQ ID NO: 164432 - DNA, 25 bp, Rattus norvegicus
agtgttctgtgtgacaaccaacctc

SEQ ID NO: 164433 - DNA, 25 bp, Rattus norvegicus
agtgttctgttacccaagagcccta

SEQ ID NO: 164434 - DNA, 25 bp, Rattus norvegicus
agtgttctgttagccaagagcccta

SEQ ID NO: 164435 - DNA, 25 bp, Rattus norvegicus
agtgttctgtttcctgagtatgtga

SEQ ID NO: 164436 - DNA, 25 bp, Rattus norvegicus
agtgttctgtttgctgagtatgtga

SEQ ID NO: 164437 - DNA, 25 bp, Rattus norvegicus
agtgttcttcccatgcttttgactc

SEQ ID NO: 164438 - DNA, 25 bp, Rattus norvegicus
agtgttcttcccttgcttttgactc

SEQ ID NO: 164439 - DNA, 25 bp, Rattus norvegicus
agtgttcttcgcacaggttccaggc

SEQ ID NO: 164440 - DNA, 25 bp, Rattus norvegicus
agtgttcttcgctcaggttccaggc

SEQ ID NO: 164441 - DNA, 25 bp, Rattus norvegicus
agtgttcttgctcccaggtacataa

SEQ ID NO: 164442 - DNA, 25 bp, Rattus norvegicus
agtgttcttgctcttagccctgggt

SEQ ID NO: 164443 - DNA, 25 bp, Rattus norvegicus
agtgttcttgctgccaggtacataa

SEQ ID NO: 164444 - DNA, 25 bp, Rattus norvegicus
agtgttcttgctgttagccctgggt

SEQ ID NO: 164445 - DNA, 25 bp, Rattus norvegicus
agtgttcttgtcctgatgttgctcc

SEQ ID NO: 164446 - DNA, 25 bp, Rattus norvegicus
agtgttcttgtcgtgatgttgctcc

SEQ ID NO: 164447 - DNA, 25 bp, Rattus norvegicus
agtgttgaagacacccacaagctcc

SEQ ID NO: 164448 - DNA, 25 bp, Rattus norvegicus
agtgttgaagactcccacaagctcc

SEQ ID NO: 164449 - DNA, 25 bp, Rattus norvegicus
agtgttgaaggactctctgtgccct

SEQ ID NO: 164450 - DNA, 25 bp, Rattus norvegicus
agtgttgaaggagtctctgtgccct

SEQ ID NO: 164451 - DNA, 25 bp, Rattus norvegicus
agtgttgaccttcccatcatggcgc

SEQ ID NO: 164452 - DNA, 25 bp, Rattus norvegicus
agtgttgaccttgccatcatggcgc

SEQ ID NO: 164453 - DNA, 25 bp, Rattus norvegicus
agtgttgactcaattgggctcctat

SEQ ID NO: 164454 - DNA, 25 bp, Rattus norvegicus
agtgttgactcatttgggctcctat

SEQ ID NO: 164455 - DNA, 25 bp, Rattus norvegicus
agtgttgactctcgcctaatggtga

SEQ ID NO: 164456 - DNA, 25 bp, Rattus norvegicus
agtgttgactctggcctaatggtga

SEQ ID NO: 164457 - DNA, 25 bp, Rattus norvegicus
agtgttgagtccatgagattgccag

SEQ ID NO: 164458 - DNA, 25 bp, Rattus norvegicus
agtgttgagtccttgagattgccag

SEQ ID NO: 164459 - DNA, 25 bp, Rattus norvegicus
agtgttgataatatccttctggttg

SEQ ID NO: 164460 - DNA, 25 bp, Rattus norvegicus
agtgttgataatttccttctggttg

SEQ ID NO: 164461 - DNA, 25 bp, Rattus norvegicus
agtgttgatcacatgtcacaaaccc

SEQ ID NO: 164462 - DNA, 25 bp, Rattus norvegicus
agtgttgatcacttgtcacaaaccc

SEQ ID NO: 164463 - DNA, 25 bp, Rattus norvegicus
agtgttgatcatataggcctatatt

SEQ ID NO: 164464 - DNA, 25 bp, Rattus norvegicus
agtgttgatcatttaggcctatatt

SEQ ID NO: 164465 - DNA, 25 bp, Rattus norvegicus
agtgttgcaagcaagcacatctgct

SEQ ID NO: 164466 - DNA, 25 bp, Rattus norvegicus
agtgttgcaagctagcacatctgct

SEQ ID NO: 164467 - DNA, 25 bp, Rattus norvegicus
agtgttgcacatataaagcgttgac

SEQ ID NO: 164468 - DNA, 25 bp, Rattus norvegicus
agtgttgcacatttaaagcgttgac

SEQ ID NO: 164469 - DNA, 25 bp, Rattus norvegicus
agtgttgcacctcagatccacctaa

SEQ ID NO: 164470 - DNA, 25 bp, Rattus norvegicus
agtgttgcacctgagatccacctaa

SEQ ID NO: 164471 - DNA, 25 bp, Rattus norvegicus
agtgttgcagaacctggccatgact

SEQ ID NO: 164472 - DNA, 25 bp, Rattus norvegicus
agtgttgcagaagctggccatgact

SEQ ID NO: 164473 - DNA, 25 bp, Rattus norvegicus
agtgttgcatggattcctcctggaa

SEQ ID NO: 164474 - DNA, 25 bp, Rattus norvegicus
agtgttgcatggtttcctcctggaa

SEQ ID NO: 164475 - DNA, 25 bp, Rattus norvegicus
agtgttgcattcatgtccagcttgg

SEQ ID NO: 164476 - DNA, 25 bp, Rattus norvegicus
agtgttgcattcttgtccagcttgg

SEQ ID NO: 164477 - DNA, 25 bp, Rattus norvegicus
agtgttgccacaacggttgtaccag

SEQ ID NO: 164478 - DNA, 25 bp, Rattus norvegicus
agtgttgccacatcggttgtaccag

SEQ ID NO: 164479 - DNA, 25 bp, Rattus norvegicus
agtgttgcccatccaggtcttgaac

SEQ ID NO: 164480 - DNA, 25 bp, Rattus norvegicus
agtgttgcccatgcaggtcttgaac

SEQ ID NO: 164481 - DNA, 25 bp, Rattus norvegicus
agtgttgccgaaaccggttcacctg

SEQ ID NO: 164482 - DNA, 25 bp, Rattus norvegicus
agtgttgccgaatccggttcacctg

SEQ ID NO: 164483 - DNA, 25 bp, Rattus norvegicus
agtgttgcgcagcaacccgaagctt

SEQ ID NO: 164484 - DNA, 25 bp, Rattus norvegicus
agtgttgcgcaggaacccgaagctt

SEQ ID NO: 164485 - DNA, 25 bp, Rattus norvegicus
agtgttgcgtgaagctggcatccct

SEQ ID NO: 164486 - DNA, 25 bp, Rattus norvegicus
agtgttgcgtgatgctggcatccct

SEQ ID NO: 164487 - DNA, 25 bp, Rattus norvegicus
agtgttgctgcaaactgacgcccag

SEQ ID NO: 164488 - DNA, 25 bp, Rattus norvegicus
agtgttgctgcatactgacgcccag

SEQ ID NO: 164489 - DNA, 25 bp, Rattus norvegicus
agtgttgctgtgaatccttggcatc

SEQ ID NO: 164490 - DNA, 25 bp, Rattus norvegicus
agtgttgctgtgtatccttggcatc

SEQ ID NO: 164491 - DNA, 25 bp, Rattus norvegicus
agtgttgcttgccaaactcttaggt

SEQ ID NO: 164492 - DNA, 25 bp, Rattus norvegicus
agtgttgcttgcgaaactcttaggt

SEQ ID NO: 164493 - DNA, 25 bp, Rattus norvegicus
agtgttgcttgtcatgcttgagtta

SEQ ID NO: 164494 - DNA, 25 bp, Rattus norvegicus
agtgttgcttgtgatgcttgagtta

SEQ ID NO: 164495 - DNA, 25 bp, Rattus norvegicus
agtgttggagacctcacccaggaag

SEQ ID NO: 164496 - DNA, 25 bp, Rattus norvegicus
agtgttggagacgtcacccaggaag

SEQ ID NO: 164497 - DNA, 25 bp, Rattus norvegicus
agtgttggaggacctgtgcacctca

SEQ ID NO: 164498 - DNA, 25 bp, Rattus norvegicus
agtgttggaggagctgtgcacctca

SEQ ID NO: 164499 - DNA, 25 bp, Rattus norvegicus
agtgttggatttaaccttcgagcaa

SEQ ID NO: 164500 - DNA, 25 bp, Rattus norvegicus
agtgttggattttaccttcgagcaa

SEQ ID NO: 164501 - DNA, 25 bp, Rattus norvegicus
agtgttggcatcatgtgtctttaat

SEQ ID NO: 164502 - DNA, 25 bp, Rattus norvegicus
agtgttggcatcttgtgtctttaat

SEQ ID NO: 164503 - DNA, 25 bp, Rattus norvegicus
agtgttggccatcttaccgtgacaa

SEQ ID NO: 164504 - DNA, 25 bp, Rattus norvegicus
agtgttggccatgttaccgtgacaa

SEQ ID NO: 164505 - DNA, 25 bp, Rattus norvegicus
agtgttggctgaacagactccgcca

SEQ ID NO: 164506 - DNA, 25 bp, Rattus norvegicus
agtgttggctgatcagactccgcca

SEQ ID NO: 164507 - DNA, 25 bp, Rattus norvegicus
agtgttggctgtccagattaaccag

SEQ ID NO: 164508 - DNA, 25 bp, Rattus norvegicus
agtgttggctgtgcagattaaccag

SEQ ID NO: 164509 - DNA, 25 bp, Rattus norvegicus
agtgttggctttaccatggtcacaa

SEQ ID NO: 164510 - DNA, 25 bp, Rattus norvegicus
agtgttggctttagtcttgttggca

SEQ ID NO: 164511 - DNA, 25 bp, Rattus norvegicus
agtgttggcttttccatggtcacaa

SEQ ID NO: 164512 - DNA, 25 bp, Rattus norvegicus
agtgttggcttttgtcttgttggca

SEQ ID NO: 164513 - DNA, 25 bp, Rattus norvegicus
agtgttggtgtcatctagaggtgac

SEQ ID NO: 164514 - DNA, 25 bp, Rattus norvegicus
agtgttggtgtcttctagaggtgac

SEQ ID NO: 164515 - DNA, 25 bp, Rattus norvegicus
agtgttgtaaatcgcatttccctcg

SEQ ID NO: 164516 - DNA, 25 bp, Rattus norvegicus
agtgttgtaaatggcatttccctcg

SEQ ID NO: 164517 - DNA, 25 bp, Rattus norvegicus
agtgttgtatctatggagctggaga

SEQ ID NO: 164518 - DNA, 25 bp, Rattus norvegicus
agtgttgtatctttggagctggaga

SEQ ID NO: 164519 - DNA, 25 bp, Rattus norvegicus
agtgttgtatgtaccctctgagata

SEQ ID NO: 164520 - DNA, 25 bp, Rattus norvegicus
agtgttgtatgttccctctgagata

SEQ ID NO: 164521 - DNA, 25 bp, Rattus norvegicus
agtgttgtcaccaactgcaaaatgt

SEQ ID NO: 164522 - DNA, 25 bp, Rattus norvegicus
agtgttgtcacctactgcaaaatgt

SEQ ID NO: 164523 - DNA, 25 bp, Rattus norvegicus
agtgttgtcatcagactggtactta

SEQ ID NO: 164524 - DNA, 25 bp, Rattus norvegicus
agtgttgtcatctgactggtactta

SEQ ID NO: 164525 - DNA, 25 bp, Rattus norvegicus
agtgttgtcattaacacagccccag

SEQ ID NO: 164526 - DNA, 25 bp, Rattus norvegicus
agtgttgtcatttacacagccccag

SEQ ID NO: 164527 - DNA, 25 bp, Rattus norvegicus
agtgttgtccagctttacgtggtac

SEQ ID NO: 164528 - DNA, 25 bp, Rattus norvegicus
agtgttgtccaggtttacgtggtac

SEQ ID NO: 164529 - DNA, 25 bp, Rattus norvegicus
agtgttgtccctcacagctaagagc

SEQ ID NO: 164530 - DNA, 25 bp, Rattus norvegicus
agtgttgtccctgacagctaagagc

SEQ ID NO: 164531 - DNA, 25 bp, Rattus norvegicus
agtgttgtgcacatagccaatgcca

SEQ ID NO: 164532 - DNA, 25 bp, Rattus norvegicus
agtgttgtgcacttagccaatgcca

SEQ ID NO: 164533 - DNA, 25 bp, Rattus norvegicus
agtgttgtgcttctcaaaagatcta

SEQ ID NO: 164534 - DNA, 25 bp, Rattus norvegicus
agtgttgtgcttgtcaaaagatcta

SEQ ID NO: 164535 - DNA, 25 bp, Rattus norvegicus
agtgttgtgtgtccgtaggtcctca

SEQ ID NO: 164536 - DNA, 25 bp, Rattus norvegicus
agtgttgtgtgtgcgtaggtcctca

SEQ ID NO: 164537 - DNA, 25 bp, Rattus norvegicus
agtgttgtgtttcttggtatcctgt

SEQ ID NO: 164538 - DNA, 25 bp, Rattus norvegicus
agtgttgtgtttgttggtatcctgt

SEQ ID NO: 164539 - DNA, 25 bp, Rattus norvegicus
agtgttgttgcccatggtgatctcc

SEQ ID NO: 164540 - DNA, 25 bp, Rattus norvegicus
agtgttgttgccgatggtgatctcc

SEQ ID NO: 164541 - DNA, 25 bp, Rattus norvegicus
agtgtttaaaggctctgttctgcgc

SEQ ID NO: 164542 - DNA, 25 bp, Rattus norvegicus
agtgtttaaagggtctgttctgcgc

SEQ ID NO: 164543 - DNA, 25 bp, Rattus norvegicus
agtgtttaatatcctgtcagcctgc

SEQ ID NO: 164544 - DNA, 25 bp, Rattus norvegicus
agtgtttaatatgctgtcagcctgc

SEQ ID NO: 164545 - DNA, 25 bp, Rattus norvegicus
agtgtttaatgcatcctggctgtag

SEQ ID NO: 164546 - DNA, 25 bp, Rattus norvegicus
agtgtttaatgcttcctggctgtag

SEQ ID NO: 164547 - DNA, 25 bp, Rattus norvegicus
agtgtttaattcatctgctttgttg

SEQ ID NO: 164548 - DNA, 25 bp, Rattus norvegicus
agtgtttaattcttctgctttgttg

SEQ ID NO: 164549 - DNA, 25 bp, Rattus norvegicus
agtgtttaccatcgtgtttcatacc

SEQ ID NO: 164550 - DNA, 25 bp, Rattus norvegicus
agtgtttaccatggtgtttcatacc

SEQ ID NO: 164551 - DNA, 25 bp, Rattus norvegicus
agtgtttaccttatcctgtccatcg

SEQ ID NO: 164552 - DNA, 25 bp, Rattus norvegicus
agtgtttaccttttcctgtccatcg

SEQ ID NO: 164553 - DNA, 25 bp, Rattus norvegicus
agtgtttcactgagatgttgctgca

SEQ ID NO: 164554 - DNA, 25 bp, Rattus norvegicus
agtgtttcactgtgatgttgctgca

SEQ ID NO: 164555 - DNA, 25 bp, Rattus norvegicus
agtgtttccaaaagcttctcttata

SEQ ID NO: 164556 - DNA, 25 bp, Rattus norvegicus
agtgtttccaaatgcttctcttata

SEQ ID NO: 164557 - DNA, 25 bp, Rattus norvegicus
agtgtttccataacctctgtaaatt

SEQ ID NO: 164558 - DNA, 25 bp, Rattus norvegicus
agtgtttccatatcctctgtaaatt

SEQ ID NO: 164559 - DNA, 25 bp, Rattus norvegicus
agtgtttccctccagaagcaggtac

SEQ ID NO: 164560 - DNA, 25 bp, Rattus norvegicus
agtgtttccctcgagaagcaggtac

SEQ ID NO: 164561 - DNA, 25 bp, Rattus norvegicus
agtgtttcccttcagctttgcctac

SEQ ID NO: 164562 - DNA, 25 bp, Rattus norvegicus
agtgtttcccttgagctttgcctac

SEQ ID NO: 164563 - DNA, 25 bp, Rattus norvegicus
agtgtttcctgcagttctcggctgt

SEQ ID NO: 164564 - DNA, 25 bp, Rattus norvegicus
agtgtttcctgcattgggctggcta

SEQ ID NO: 164565 - DNA, 25 bp, Rattus norvegicus
agtgtttcctgctgttctcggctgt

SEQ ID NO: 164566 - DNA, 25 bp, Rattus norvegicus
agtgtttcctgctttgggctggcta

SEQ ID NO: 164567 - DNA, 25 bp, Rattus norvegicus
agtgtttccttcatttctgatatag

SEQ ID NO: 164568 - DNA, 25 bp, Rattus norvegicus
agtgtttccttcttttctgatatag

SEQ ID NO: 164569 - DNA, 25 bp, Rattus norvegicus
agtgtttcctttccactgactacca

SEQ ID NO: 164570 - DNA, 25 bp, Rattus norvegicus
agtgtttcctttgcactgactacca

SEQ ID NO: 164571 - DNA, 25 bp, Rattus norvegicus
agtgtttctaccatgctgtacttga

SEQ ID NO: 164572 - DNA, 25 bp, Rattus norvegicus
agtgtttctaccttgctgtacttga

SEQ ID NO: 164573 - DNA, 25 bp, Rattus norvegicus
agtgtttctgagagactgtctatcc

SEQ ID NO: 164574 - DNA, 25 bp, Rattus norvegicus
agtgtttctgagtgactgtctatcc

SEQ ID NO: 164575 - DNA, 25 bp, Rattus norvegicus
agtgtttcttaaacattgtcttttc

SEQ ID NO: 164576 - DNA, 25 bp, Rattus norvegicus
agtgtttcttaatcattgtcttttc

SEQ ID NO: 164577 - DNA, 25 bp, Rattus norvegicus
agtgtttcttctatgaacgcctgga

SEQ ID NO: 164578 - DNA, 25 bp, Rattus norvegicus
agtgtttcttctttgaacgcctgga

SEQ ID NO: 164579 - DNA, 25 bp, Rattus norvegicus
agtgtttgaccacctacttggacac

SEQ ID NO: 164580 - DNA, 25 bp, Rattus norvegicus
agtgtttgaccacctcattgggtgt

SEQ ID NO: 164581 - DNA, 25 bp, Rattus norvegicus
agtgtttgaccagctacttggacac

SEQ ID NO: 164582 - DNA, 25 bp, Rattus norvegicus
agtgtttgaccagctcattgggtgt

SEQ ID NO: 164583 - DNA, 25 bp, Rattus norvegicus
agtgtttgactgcatcgaggcctat

SEQ ID NO: 164584 - DNA, 25 bp, Rattus norvegicus
agtgtttgactggatcgaggcctat

SEQ ID NO: 164585 - DNA, 25 bp, Rattus norvegicus
agtgtttgctgaactcaacttctcg

SEQ ID NO: 164586 - DNA, 25 bp, Rattus norvegicus
agtgtttgctgatctcaacttctcg

SEQ ID NO: 164587 - DNA, 25 bp, Rattus norvegicus
agtgtttgcttgctccttgggatat

SEQ ID NO: 164588 - DNA, 25 bp, Rattus norvegicus
agtgtttgcttggtccttgggatat

SEQ ID NO: 164589 - DNA, 25 bp, Rattus norvegicus
agtgtttgtattaattccttgagaa

SEQ ID NO: 164590 - DNA, 25 bp, Rattus norvegicus
agtgtttgtatttattccttgagaa

SEQ ID NO: 164591 - DNA, 25 bp, Rattus norvegicus
agtgtttgtcatctgcagctttcca

SEQ ID NO: 164592 - DNA, 25 bp, Rattus norvegicus
agtgtttgtcatgtgcagctttcca

SEQ ID NO: 164593 - DNA, 25 bp, Rattus norvegicus
agtgtttgtctccattgtttttcca

SEQ ID NO: 164594 - DNA, 25 bp, Rattus norvegicus
agtgtttgtctcgattgtttttcca

SEQ ID NO: 164595 - DNA, 25 bp, Rattus norvegicus
agtgtttgtctgactccttattaat

SEQ ID NO: 164596 - DNA, 25 bp, Rattus norvegicus
agtgtttgtctgtctccttattaat

SEQ ID NO: 164597 - DNA, 25 bp, Rattus norvegicus
agtgttttaactcccgtgtacatat

SEQ ID NO: 164598 - DNA, 25 bp, Rattus norvegicus
agtgttttaactgccgtgtacatat

SEQ ID NO: 164599 - DNA, 25 bp, Rattus norvegicus
agtgttttacacatgcacagtatta

SEQ ID NO: 164600 - DNA, 25 bp, Rattus norvegicus
agtgttttacacttgcacagtatta

SEQ ID NO: 164601 - DNA, 25 bp, Rattus norvegicus
agtgttttactaacatccgttgaaa

SEQ ID NO: 164602 - DNA, 25 bp, Rattus norvegicus
agtgttttactatcatccgttgaaa

SEQ ID NO: 164603 - DNA, 25 bp, Rattus norvegicus
agtgttttcaaaatatgctgtcatg

SEQ ID NO: 164604 - DNA, 25 bp, Rattus norvegicus
agtgttttcaaattatgctgtcatg

SEQ ID NO: 164605 - DNA, 25 bp, Rattus norvegicus
agtgttttcaccactgttggttctt

SEQ ID NO: 164606 - DNA, 25 bp, Rattus norvegicus
agtgttttcacctctgttggttctt

SEQ ID NO: 164607 - DNA, 25 bp, Rattus norvegicus
agtgttttcagaatctcctggtgga

SEQ ID NO: 164608 - DNA, 25 bp, Rattus norvegicus
agtgttttcagattctcctggtgga

SEQ ID NO: 164609 - DNA, 25 bp, Rattus norvegicus
agtgttttccttagtgtgcactcac

SEQ ID NO: 164610 - DNA, 25 bp, Rattus norvegicus
agtgttttcctttgtgtgcactcac

SEQ ID NO: 164611 - DNA, 25 bp, Rattus norvegicus
agtgttttgccgacatgtatgtgta

SEQ ID NO: 164612 - DNA, 25 bp, Rattus norvegicus
agtgttttgccgtcatgtatgtgta

SEQ ID NO: 164613 - DNA, 25 bp, Rattus norvegicus
agtgttttgctcacttcttcatgag

SEQ ID NO: 164614 - DNA, 25 bp, Rattus norvegicus
agtgttttgctctcttcttcatgag

SEQ ID NO: 164615 - DNA, 25 bp, Rattus norvegicus
agtgttttgtgtctcttcctattga

SEQ ID NO: 164616 - DNA, 25 bp, Rattus norvegicus
agtgttttgtgtgtcttcctattga

SEQ ID NO: 164617 - DNA, 25 bp, Rattus norvegicus
agtgtttttcacagtcgggatcttg

SEQ ID NO: 164618 - DNA, 25 bp, Rattus norvegicus
agtgtttttcactgtcgggatcttg

SEQ ID NO: 164619 - DNA, 25 bp, Rattus norvegicus
agtgtttttctgctcagggccctgg

SEQ ID NO: 164620 - DNA, 25 bp, Rattus norvegicus
agtgtttttctggtcagggccctgg

SEQ ID NO: 164621 - DNA, 25 bp, Rattus norvegicus
agttaaaactcaactgcctgtctct

SEQ ID NO: 164622 - DNA, 25 bp, Rattus norvegicus
agttaaaactcatctgcctgtctct

SEQ ID NO: 164623 - DNA, 25 bp, Rattus norvegicus
agttaaaagcctcacctacttccag

SEQ ID NO: 164624 - DNA, 25 bp, Rattus norvegicus
agttaaaagcctgacctacttccag

SEQ ID NO: 164625 - DNA, 25 bp, Rattus norvegicus
agttaaacagcgcagcgcctgtctg

SEQ ID NO: 164626 - DNA, 25 bp, Rattus norvegicus
agttaaacagcggagcgcctgtctg

SEQ ID NO: 164627 - DNA, 25 bp, Rattus norvegicus
agttaaagcatgaatcagtttcccc

SEQ ID NO: 164628 - DNA, 25 bp, Rattus norvegicus
agttaaagcatgtatcagtttcccc

SEQ ID NO: 164629 - DNA, 25 bp, Rattus norvegicus
agttaaagctaccagggcacccaca

SEQ ID NO: 164630 - DNA, 25 bp, Rattus norvegicus
agttaaagctacgagggcacccaca

SEQ ID NO: 164631 - DNA, 25 bp, Rattus norvegicus
agttaaagctgaccctccagctaca

SEQ ID NO: 164632 - DNA, 25 bp, Rattus norvegicus
agttaaagctgagcctccagctaca

SEQ ID NO: 164633 - DNA, 25 bp, Rattus norvegicus
agttaaagctgtcccttggcttcca

SEQ ID NO: 164634 - DNA, 25 bp, Rattus norvegicus
agttaaagctgtgccttggcttcca

SEQ ID NO: 164635 - DNA, 25 bp, Rattus norvegicus
agttaaagtactaaagaatcatcat

SEQ ID NO: 164636 - DNA, 25 bp, Rattus norvegicus
agttaaagtacttaagaatcatcat

SEQ ID NO: 164637 - DNA, 25 bp, Rattus norvegicus
agttaaatcaaaatcctctagcagg

SEQ ID NO: 164638 - DNA, 25 bp, Rattus norvegicus
agttaaatcaaattcctctagcagg

SEQ ID NO: 164639 - DNA, 25 bp, Rattus norvegicus
agttaaatctttctgcgtgcttctc

SEQ ID NO: 164640 - DNA, 25 bp, Rattus norvegicus
agttaaatctttgtgcgtgcttctc

SEQ ID NO: 164641 - DNA, 25 bp, Rattus norvegicus
agttaacaagacagccagcggccgg

SEQ ID NO: 164642 - DNA, 25 bp, Rattus norvegicus
agttaacaagactgccagcggccgg

SEQ ID NO: 164643 - DNA, 25 bp, Rattus norvegicus
agttaacagcctcatggtctgtctg

SEQ ID NO: 164644 - DNA, 25 bp, Rattus norvegicus
agttaacagcctgatggtctgtctg

SEQ ID NO: 164645 - DNA, 25 bp, Rattus norvegicus
agttaacatgtaccccgtagactgt

SEQ ID NO: 164646 - DNA, 25 bp, Rattus norvegicus
agttaacatgtagcccgtagactgt

SEQ ID NO: 164647 - DNA, 25 bp, Rattus norvegicus
agttaaccaaacctgtgccttgtct

SEQ ID NO: 164648 - DNA, 25 bp, Rattus norvegicus
agttaaccaaacgtgtgccttgtct

SEQ ID NO: 164649 - DNA, 25 bp, Rattus norvegicus
agttaaccaaccctgcgcaggcagg

SEQ ID NO: 164650 - DNA, 25 bp, Rattus norvegicus
agttaaccaaccgtgcgcaggcagg

SEQ ID NO: 164651 - DNA, 25 bp, Rattus norvegicus
agttaaccactcatggcacgtgtat

SEQ ID NO: 164652 - DNA, 25 bp, Rattus norvegicus
agttaaccactcttggcacgtgtat

SEQ ID NO: 164653 - DNA, 25 bp, Rattus norvegicus
agttaaccatgtagcctttgccact

SEQ ID NO: 164654 - DNA, 25 bp, Rattus norvegicus
agttaaccatgttgcctttgccact

SEQ ID NO: 164655 - DNA, 25 bp, Rattus norvegicus
agttaacccacgataaaattatgct

SEQ ID NO: 164656 - DNA, 25 bp, Rattus norvegicus
agttaacccacgttaaaattatgct

SEQ ID NO: 164657 - DNA, 25 bp, Rattus norvegicus
agttaacccgcaatatacaccactt

SEQ ID NO: 164658 - DNA, 25 bp, Rattus norvegicus
agttaacccgcattatacaccactt

SEQ ID NO: 164659 - DNA, 25 bp, Rattus norvegicus
agttaaccttcgcagatgtctgtaa

SEQ ID NO: 164660 - DNA, 25 bp, Rattus norvegicus
agttaaccttcggagatgtctgtaa

SEQ ID NO: 164661 - DNA, 25 bp, Rattus norvegicus
agttaacgtataacttgcttttgca

SEQ ID NO: 164662 - DNA, 25 bp, Rattus norvegicus
agttaacgtatatcttgcttttgca

SEQ ID NO: 164663 - DNA, 25 bp, Rattus norvegicus
agttaactcacgagtgtctctggct

SEQ ID NO: 164664 - DNA, 25 bp, Rattus norvegicus
agttaactcacgtgtgtctctggct

SEQ ID NO: 164665 - DNA, 25 bp, Rattus norvegicus
agttaactctgcatatttgctgtgt

SEQ ID NO: 164666 - DNA, 25 bp, Rattus norvegicus
agttaactctgcttatttgctgtgt

SEQ ID NO: 164667 - DNA, 25 bp, Rattus norvegicus
agttaactgcgacagactcagctct

SEQ ID NO: 164668 - DNA, 25 bp, Rattus norvegicus
agttaactgcgagagactcagctct

SEQ ID NO: 164669 - DNA, 25 bp, Rattus norvegicus
agttaactggctctgggactttctc

SEQ ID NO: 164670 - DNA, 25 bp, Rattus norvegicus
agttaactggctgtgggactttctc

SEQ ID NO: 164671 - DNA, 25 bp, Rattus norvegicus
agttaagaactcagcgatagccttc

SEQ ID NO: 164672 - DNA, 25 bp, Rattus norvegicus
agttaagaactctgcgatagccttc

SEQ ID NO: 164673 - DNA, 25 bp, Rattus norvegicus
agttaagaagtcctactgctagtcc

SEQ ID NO: 164674 - DNA, 25 bp, Rattus norvegicus
agttaagaagtcgtactgctagtcc

SEQ ID NO: 164675 - DNA, 25 bp, Rattus norvegicus
agttaagagtcaacctcaggctagc

SEQ ID NO: 164676 - DNA, 25 bp, Rattus norvegicus
agttaagagtcatcctcaggctagc

SEQ ID NO: 164677 - DNA, 25 bp, Rattus norvegicus
agttaagagtgcagcctccgttctc

SEQ ID NO: 164678 - DNA, 25 bp, Rattus norvegicus
agttaagagtgctgcctccgttctc

SEQ ID NO: 164679 - DNA, 25 bp, Rattus norvegicus
agttaagatggtagccctaggctcc

SEQ ID NO: 164680 - DNA, 25 bp, Rattus norvegicus
agttaagatggttgccctaggctcc

SEQ ID NO: 164681 - DNA, 25 bp, Rattus norvegicus
agttaagattagagagagagaccct

SEQ ID NO: 164682 - DNA, 25 bp, Rattus norvegicus
agttaagattagtgagagagaccct

SEQ ID NO: 164683 - DNA, 25 bp, Rattus norvegicus
agttaagcaccaacaccaagcactt

SEQ ID NO: 164684 - DNA, 25 bp, Rattus norvegicus
agttaagcaccatcaccaagcactt

SEQ ID NO: 164685 - DNA, 25 bp, Rattus norvegicus
agttaagcactgcatacctcctggt

SEQ ID NO: 164686 - DNA, 25 bp, Rattus norvegicus
agttaagcactggatacctcctggt

SEQ ID NO: 164687 - DNA, 25 bp, Rattus norvegicus
agttaagcatccagacagcggctgc

SEQ ID NO: 164688 - DNA, 25 bp, Rattus norvegicus
agttaagcatcctgacagcggctgc

SEQ ID NO: 164689 - DNA, 25 bp, Rattus norvegicus
agttaagcccagctgttggccttat

SEQ ID NO: 164690 - DNA, 25 bp, Rattus norvegicus
agttaagcccaggtgttggccttat

SEQ ID NO: 164691 - DNA, 25 bp, Rattus norvegicus
agttaagctctgagacaggccggtg

SEQ ID NO: 164692 - DNA, 25 bp, Rattus norvegicus
agttaagctctgtgacaggccggtg

SEQ ID NO: 164693 - DNA, 25 bp, Rattus norvegicus
agttaaggcctgagacctgcgtcct

SEQ ID NO: 164694 - DNA, 25 bp, Rattus norvegicus
agttaaggcctgtgacctgcgtcct

SEQ ID NO: 164695 - DNA, 25 bp, Rattus norvegicus
agttaagggagtccctgggcgtcct

SEQ ID NO: 164696 - DNA, 25 bp, Rattus norvegicus
agttaagggagtgcctgggcgtcct

SEQ ID NO: 164697 - DNA, 25 bp, Rattus norvegicus
agttaaggtttcagcacttgggaga

SEQ ID NO: 164698 - DNA, 25 bp, Rattus norvegicus
agttaaggtttctgcacttgggaga

SEQ ID NO: 164699 - DNA, 25 bp, Rattus norvegicus
agttaagtactgactgcccttccag

SEQ ID NO: 164700 - DNA, 25 bp, Rattus norvegicus
agttaagtactgtctgcccttccag

SEQ ID NO: 164701 - DNA, 25 bp, Rattus norvegicus
agttaagtagctcatgcctgcttct

SEQ ID NO: 164702 - DNA, 25 bp, Rattus norvegicus
agttaagtagctgatgcctgcttct

SEQ ID NO: 164703 - DNA, 25 bp, Rattus norvegicus
agttaatacaagcttttgtggctcc

SEQ ID NO: 164704 - DNA, 25 bp, Rattus norvegicus
agttaatacaaggttttgtggctcc

SEQ ID NO: 164705 - DNA, 25 bp, Rattus norvegicus
agttaatcagatctggcccctctag

SEQ ID NO: 164706 - DNA, 25 bp, Rattus norvegicus
agttaatcagatgtggcccctctag

SEQ ID NO: 164707 - DNA, 25 bp, Rattus norvegicus
agttaatcctacaaatgctttccag

SEQ ID NO: 164708 - DNA, 25 bp, Rattus norvegicus
agttaatcctactaatgctttccag

SEQ ID NO: 164709 - DNA, 25 bp, Rattus norvegicus
agttaatcctgaagagccctttctg

SEQ ID NO: 164710 - DNA, 25 bp, Rattus norvegicus
agttaatcctgatgagccctttctg

SEQ ID NO: 164711 - DNA, 25 bp, Rattus norvegicus
agttaatgcaggaaccgggcccgtg

SEQ ID NO: 164712 - DNA, 25 bp, Rattus norvegicus
agttaatgcaggtaccgggcccgtg

SEQ ID NO: 164713 - DNA, 25 bp, Rattus norvegicus
agttaatggtacattcctcagccct

SEQ ID NO: 164714 - DNA, 25 bp, Rattus norvegicus
agttaatggtactttcctcagccct

SEQ ID NO: 164715 - DNA, 25 bp, Rattus norvegicus
agttaatgtcttctgtttttgtcca

SEQ ID NO: 164716 - DNA, 25 bp, Rattus norvegicus
agttaatgtcttgtgtttttgtcca

SEQ ID NO: 164717 - DNA, 25 bp, Rattus norvegicus
agttaatgtgtaactgccagcaagt

SEQ ID NO: 164718 - DNA, 25 bp, Rattus norvegicus
agttaatgtgtatctgccagcaagt

SEQ ID NO: 164719 - DNA, 25 bp, Rattus norvegicus
agttaattgcgtcgtaccattccct

SEQ ID NO: 164720 - DNA, 25 bp, Rattus norvegicus
agttaattgcgtggtaccattccct

SEQ ID NO: 164721 - DNA, 25 bp, Rattus norvegicus
agttaattgtgtaattccttcagca

SEQ ID NO: 164722 - DNA, 25 bp, Rattus norvegicus
agttaattgtgttattccttcagca

SEQ ID NO: 164723 - DNA, 25 bp, Rattus norvegicus
agttacaaagacactcctcctgagg

SEQ ID NO: 164724 - DNA, 25 bp, Rattus norvegicus
agttacaaagactctcctcctgagg

SEQ ID NO: 164725 - DNA, 25 bp, Rattus norvegicus
agttacaaagcacgactatgtctaa

SEQ ID NO: 164726 - DNA, 25 bp, Rattus norvegicus
agttacaaagcaggactatgtctaa

SEQ ID NO: 164727 - DNA, 25 bp, Rattus norvegicus
agttacaaatgcacgaagtcctggg

SEQ ID NO: 164728 - DNA, 25 bp, Rattus norvegicus
agttacaaatgctcgaagtcctggg

SEQ ID NO: 164729 - DNA, 25 bp, Rattus norvegicus
agttacaagtcgaggctgccagatt

SEQ ID NO: 164730 - DNA, 25 bp, Rattus norvegicus
agttacaagtcgtggctgccagatt

SEQ ID NO: 164731 - DNA, 25 bp, Rattus norvegicus
agttacaattccacattaatgtctc

SEQ ID NO: 164732 - DNA, 25 bp, Rattus norvegicus
agttacaattcctcattaatgtctc

SEQ ID NO: 164733 - DNA, 25 bp, Rattus norvegicus
agttacaattgcaggacgctgcttc

SEQ ID NO: 164734 - DNA, 25 bp, Rattus norvegicus
agttacaattgctggacgctgcttc

SEQ ID NO: 164735 - DNA, 25 bp, Rattus norvegicus
agttacacaaatcccaaacccatga

SEQ ID NO: 164736 - DNA, 25 bp, Rattus norvegicus
agttacacaaatgccaaacccatga

SEQ ID NO: 164737 - DNA, 25 bp, Rattus norvegicus
agttacacaagaatcctggctcgcc

SEQ ID NO: 164738 - DNA, 25 bp, Rattus norvegicus
agttacacaagattcctggctcgcc

SEQ ID NO: 164739 - DNA, 25 bp, Rattus norvegicus
agttacacaatgagtcttccagccg

SEQ ID NO: 164740 - DNA, 25 bp, Rattus norvegicus
agttacacaatgtgtcttccagccg

SEQ ID NO: 164741 - DNA, 25 bp, Rattus norvegicus
agttacacatagcttctcgacacgg

SEQ ID NO: 164742 - DNA, 25 bp, Rattus norvegicus
agttacacataggttctcgacacgg

SEQ ID NO: 164743 - DNA, 25 bp, Rattus norvegicus
agttacaccgtaagaggctgcgcca

SEQ ID NO: 164744 - DNA, 25 bp, Rattus norvegicus
agttacaccgtatgaggctgcgcca

SEQ ID NO: 164745 - DNA, 25 bp, Rattus norvegicus
agttacacgtctcctctatgggttc

SEQ ID NO: 164746 - DNA, 25 bp, Rattus norvegicus
agttacacgtctgctctatgggttc

SEQ ID NO: 164747 - DNA, 25 bp, Rattus norvegicus
agttacagagctcacttggctttct

SEQ ID NO: 164748 - DNA, 25 bp, Rattus norvegicus
agttacagagctgacttggctttct

SEQ ID NO: 164749 - DNA, 25 bp, Rattus norvegicus
agttacagcctgaaccaaggaagat

SEQ ID NO: 164750 - DNA, 25 bp, Rattus norvegicus
agttacagcctgtaccaaggaagat

SEQ ID NO: 164751 - DNA, 25 bp, Rattus norvegicus
agttacagttctcggccctcgagtc

SEQ ID NO: 164752 - DNA, 25 bp, Rattus norvegicus
agttacagttctgggccctcgagtc

SEQ ID NO: 164753 - DNA, 25 bp, Rattus norvegicus
agttacatgaagactttgcccaact

SEQ ID NO: 164754 - DNA, 25 bp, Rattus norvegicus
agttacatgaagtctttgcccaact

SEQ ID NO: 164755 - DNA, 25 bp, Rattus norvegicus
agttacatgtggatagccctgttag

SEQ ID NO: 164756 - DNA, 25 bp, Rattus norvegicus
agttacatgtggttagccctgttag

SEQ ID NO: 164757 - DNA, 25 bp, Rattus norvegicus
agttacattacacctgagagtcagt

SEQ ID NO: 164758 - DNA, 25 bp, Rattus norvegicus
agttacattacagctgagagtcagt

SEQ ID NO: 164759 - DNA, 25 bp, Rattus norvegicus
agttacatttttccttcaaagcaat

SEQ ID NO: 164760 - DNA, 25 bp, Rattus norvegicus
agttacatttttgcttcaaagcaat

SEQ ID NO: 164761 - DNA, 25 bp, Rattus norvegicus
agttaccaccatcctgttgtaccag

SEQ ID NO: 164762 - DNA, 25 bp, Rattus norvegicus
agttaccaccatgctgttgtaccag

SEQ ID NO: 164763 - DNA, 25 bp, Rattus norvegicus
agttaccagtgtagttaccagcatt

SEQ ID NO: 164764 - DNA, 25 bp, Rattus norvegicus
agttaccagtgttgttaccagcatt

SEQ ID NO: 164765 - DNA, 25 bp, Rattus norvegicus
agttacccaagcagctctgcggaag

SEQ ID NO: 164766 - DNA, 25 bp, Rattus norvegicus
agttacccaagctgctctgcggaag

SEQ ID NO: 164767 - DNA, 25 bp, Rattus norvegicus
agttacccagagctgtgcgttcatg

SEQ ID NO: 164768 - DNA, 25 bp, Rattus norvegicus
agttacccagaggtgtgcgttcatg

SEQ ID NO: 164769 - DNA, 25 bp, Rattus norvegicus
agttacccattgactgcagtgttta

SEQ ID NO: 164770 - DNA, 25 bp, Rattus norvegicus
agttacccattgtctgcagtgttta

SEQ ID NO: 164771 - DNA, 25 bp, Rattus norvegicus
agttaccctgtgacttgctagtagg

SEQ ID NO: 164772 - DNA, 25 bp, Rattus norvegicus
agttaccctgtgtcttgctagtagg

SEQ ID NO: 164773 - DNA, 25 bp, Rattus norvegicus
agttaccggactactcgagcattga

SEQ ID NO: 164774 - DNA, 25 bp, Rattus norvegicus
agttaccggacttctcgagcattga

SEQ ID NO: 164775 - DNA, 25 bp, Rattus norvegicus
agttacctagcaccttgggtcttag

SEQ ID NO: 164776 - DNA, 25 bp, Rattus norvegicus
agttacctagcagcttgggtcttag

SEQ ID NO: 164777 - DNA, 25 bp, Rattus norvegicus
agttacctcgccagaggcagcagta

SEQ ID NO: 164778 - DNA, 25 bp, Rattus norvegicus
agttacctcgcctgaggcagcagta

SEQ ID NO: 164779 - DNA, 25 bp, Rattus norvegicus
agttacctctctctggtttagggca

SEQ ID NO: 164780 - DNA, 25 bp, Rattus norvegicus
agttacctctctgtggtttagggca

SEQ ID NO: 164781 - DNA, 25 bp, Rattus norvegicus
agttacctgagaaagccctgagcat

SEQ ID NO: 164782 - DNA, 25 bp, Rattus norvegicus
agttacctgagatagccctgagcat

SEQ ID NO: 164783 - DNA, 25 bp, Rattus norvegicus
agttacctgagcacagagactgata

SEQ ID NO: 164784 - DNA, 25 bp, Rattus norvegicus
agttacctgagctcagagactgata

SEQ ID NO: 164785 - DNA, 25 bp, Rattus norvegicus
agttacctgcgcctcctggtgcggc

SEQ ID NO: 164786 - DNA, 25 bp, Rattus norvegicus
agttacctgcgcgtcctggtgcggc

SEQ ID NO: 164787 - DNA, 25 bp, Rattus norvegicus
agttacctgctgattgctttcatta

SEQ ID NO: 164788 - DNA, 25 bp, Rattus norvegicus
agttacctgctgtttgctttcatta

SEQ ID NO: 164789 - DNA, 25 bp, Rattus norvegicus
agttacctggagctttgctgtccca

SEQ ID NO: 164790 - DNA, 25 bp, Rattus norvegicus
agttacctggaggtttgctgtccca

SEQ ID NO: 164791 - DNA, 25 bp, Rattus norvegicus
agttacctggatatactgaggctgt

SEQ ID NO: 164792 - DNA, 25 bp, Rattus norvegicus
agttacctggatttactgaggctgt

SEQ ID NO: 164793 - DNA, 25 bp, Rattus norvegicus
agttacctgtgtcacctgattgaaa

SEQ ID NO: 164794 - DNA, 25 bp, Rattus norvegicus
agttacctgtgtgacctgattgaaa

SEQ ID NO: 164795 - DNA, 25 bp, Rattus norvegicus
agttaccttcagagcaggctctgag

SEQ ID NO: 164796 - DNA, 25 bp, Rattus norvegicus
agttaccttcagtgcaggctctgag

SEQ ID NO: 164797 - DNA, 25 bp, Rattus norvegicus
agttaccttggtaccttcagtctat

SEQ ID NO: 164798 - DNA, 25 bp, Rattus norvegicus
agttaccttggttccttcagtctat

SEQ ID NO: 164799 - DNA, 25 bp, Rattus norvegicus
agttacgacgtcattcagctggagt

SEQ ID NO: 164800 - DNA, 25 bp, Rattus norvegicus
agttacgacgtctttcagctggagt

SEQ ID NO: 164801 - DNA, 25 bp, Rattus norvegicus
agttacgccttcaaagagcatccta

SEQ ID NO: 164802 - DNA, 25 bp, Rattus norvegicus
agttacgccttctaagagcatccta

SEQ ID NO: 164803 - DNA, 25 bp, Rattus norvegicus
agttacgctcgcagctcttgctgaa

SEQ ID NO: 164804 - DNA, 25 bp, Rattus norvegicus
agttacgctcgctgctcttgctgaa

SEQ ID NO: 164805 - DNA, 25 bp, Rattus norvegicus
agttacgggtgcacgtcagacgaca

SEQ ID NO: 164806 - DNA, 25 bp, Rattus norvegicus
agttacgggtgctcgtcagacgaca

SEQ ID NO: 164807 - DNA, 25 bp, Rattus norvegicus
agttacggtgctcatggcgctttca

SEQ ID NO: 164808 - DNA, 25 bp, Rattus norvegicus
agttacggtgctgatggcgctttca

SEQ ID NO: 164809 - DNA, 25 bp, Rattus norvegicus
agttacgtctgtattcataaggtga

SEQ ID NO: 164810 - DNA, 25 bp, Rattus norvegicus
agttacgtctgttttcataaggtga

SEQ ID NO: 164811 - DNA, 25 bp, Rattus norvegicus
agttacgtgcccattgagatcataa

SEQ ID NO: 164812 - DNA, 25 bp, Rattus norvegicus
agttacgtgccctttgagatcataa

SEQ ID NO: 164813 - DNA, 25 bp, Rattus norvegicus
agttacgtgtgcacagcccttagtg

SEQ ID NO: 164814 - DNA, 25 bp, Rattus norvegicus
agttacgtgtgctcagcccttagtg

SEQ ID NO: 164815 - DNA, 25 bp, Rattus norvegicus
agttactaatggcatcacactgtta

SEQ ID NO: 164816 - DNA, 25 bp, Rattus norvegicus
agttactaatgggatcacactgtta

SEQ ID NO: 164817 - DNA, 25 bp, Rattus norvegicus
agttactacactacaggtgcccttg

SEQ ID NO: 164818 - DNA, 25 bp, Rattus norvegicus
agttactacactactggatttagca

SEQ ID NO: 164819 - DNA, 25 bp, Rattus norvegicus
agttactacacttcaggtgcccttg

SEQ ID NO: 164820 - DNA, 25 bp, Rattus norvegicus
agttactacacttctggatttagca

SEQ ID NO: 164821 - DNA, 25 bp, Rattus norvegicus
agttactattgcatcgctgatgctc

SEQ ID NO: 164822 - DNA, 25 bp, Rattus norvegicus
agttactattgcttcgctgatgctc

SEQ ID NO: 164823 - DNA, 25 bp, Rattus norvegicus
agttactcagcccatccgtgtgtgt

SEQ ID NO: 164824 - DNA, 25 bp, Rattus norvegicus
agttactcagccgatccgtgtgtgt

SEQ ID NO: 164825 - DNA, 25 bp, Rattus norvegicus
agttactcctacatcttcatagacg

SEQ ID NO: 164826 - DNA, 25 bp, Rattus norvegicus
agttactcctacttcttcatagacg

SEQ ID NO: 164827 - DNA, 25 bp, Rattus norvegicus
agttactcctctcaatggtgcctgt

SEQ ID NO: 164828 - DNA, 25 bp, Rattus norvegicus
agttactcctctgaatggtgcctgt

SEQ ID NO: 164829 - DNA, 25 bp, Rattus norvegicus
agttactcggttctctagtgtcgaa

SEQ ID NO: 164830 - DNA, 25 bp, Rattus norvegicus
agttactcggttgtctagtgtcgaa

SEQ ID NO: 164831 - DNA, 25 bp, Rattus norvegicus
agttactcttctcggtgctacaatc

SEQ ID NO: 164832 - DNA, 25 bp, Rattus norvegicus
agttactcttctgggtgctacaatc

SEQ ID NO: 164833 - DNA, 25 bp, Rattus norvegicus
agttactgacagatcctagactcct

SEQ ID NO: 164834 - DNA, 25 bp, Rattus norvegicus
agttactgacagttcctagactcct

SEQ ID NO: 164835 - DNA, 25 bp, Rattus norvegicus
agttactgagctcaagtcacttaga

SEQ ID NO: 164836 - DNA, 25 bp, Rattus norvegicus
agttactgagctgaagtcacttaga

SEQ ID NO: 164837 - DNA, 25 bp, Rattus norvegicus
agttactggctcagatttaggcccc

SEQ ID NO: 164838 - DNA, 25 bp, Rattus norvegicus
agttactggctctgatttaggcccc

SEQ ID NO: 164839 - DNA, 25 bp, Rattus norvegicus
agttactgttgtctcttggcctgtc

SEQ ID NO: 164840 - DNA, 25 bp, Rattus norvegicus
agttactgttgtgtcttggcctgtc

SEQ ID NO: 164841 - DNA, 25 bp, Rattus norvegicus
agttacttgcttctgcttcagattc

SEQ ID NO: 164842 - DNA, 25 bp, Rattus norvegicus
agttacttgcttgtgcttcagattc

SEQ ID NO: 164843 - DNA, 25 bp, Rattus norvegicus
agttagaaatgacctctctcctagc

SEQ ID NO: 164844 - DNA, 25 bp, Rattus norvegicus
agttagaaatgagctctctcctagc

SEQ ID NO: 164845 - DNA, 25 bp, Rattus norvegicus
agttagaagactcccaacgtctggg

SEQ ID NO: 164846 - DNA, 25 bp, Rattus norvegicus
agttagaagactgccaacgtctggg

SEQ ID NO: 164847 - DNA, 25 bp, Rattus norvegicus
agttagaagtggatcaccccagcag

SEQ ID NO: 164848 - DNA, 25 bp, Rattus norvegicus
agttagaagtggttcaccccagcag

SEQ ID NO: 164849 - DNA, 25 bp, Rattus norvegicus
agttagaatgcacgcgtgcaccgcc

SEQ ID NO: 164850 - DNA, 25 bp, Rattus norvegicus
agttagaatgcaggcgtgcaccgcc

SEQ ID NO: 164851 - DNA, 25 bp, Rattus norvegicus
agttagactcacacccagctgtttg

SEQ ID NO: 164852 - DNA, 25 bp, Rattus norvegicus
agttagactcactcccagctgtttg

SEQ ID NO: 164853 - DNA, 25 bp, Rattus norvegicus
agttagactcttcttcgttggcttt

SEQ ID NO: 164854 - DNA, 25 bp, Rattus norvegicus
agttagactcttgttcgttggcttt

SEQ ID NO: 164855 - DNA, 25 bp, Rattus norvegicus
agttagacttgcagtgcgctagccc

SEQ ID NO: 164856 - DNA, 25 bp, Rattus norvegicus
agttagacttgctgtgcgctagccc

SEQ ID NO: 164857 - DNA, 25 bp, Rattus norvegicus
agttagagcccaccctgggatactt

SEQ ID NO: 164858 - DNA, 25 bp, Rattus norvegicus
agttagagcccagcctgggatactt

SEQ ID NO: 164859 - DNA, 25 bp, Rattus norvegicus
agttagaggctaatgttttgtacat

SEQ ID NO: 164860 - DNA, 25 bp, Rattus norvegicus
agttagaggctattgttttgtacat

SEQ ID NO: 164861 - DNA, 25 bp, Rattus norvegicus
agttagaggctcacctgggtggtcc

SEQ ID NO: 164862 - DNA, 25 bp, Rattus norvegicus
agttagaggctctcctgggtggtcc

SEQ ID NO: 164863 - DNA, 25 bp, Rattus norvegicus
agttagatgactccccgagggactc

SEQ ID NO: 164864 - DNA, 25 bp, Rattus norvegicus
agttagatgactgcccgagggactc

SEQ ID NO: 164865 - DNA, 25 bp, Rattus norvegicus
agttagatgaggagcgcctgagagg

SEQ ID NO: 164866 - DNA, 25 bp, Rattus norvegicus
agttagatgaggtgcgcctgagagg

SEQ ID NO: 164867 - DNA, 25 bp, Rattus norvegicus
agttagattgcaaggccgggttgcc

SEQ ID NO: 164868 - DNA, 25 bp, Rattus norvegicus
agttagattgcatggccgggttgcc

SEQ ID NO: 164869 - DNA, 25 bp, Rattus norvegicus
agttagcaaggaacatctccgactt

SEQ ID NO: 164870 - DNA, 25 bp, Rattus norvegicus
agttagcaaggatcatctccgactt

SEQ ID NO: 164871 - DNA, 25 bp, Rattus norvegicus
agttagcaagttcttcatcacttta

SEQ ID NO: 164872 - DNA, 25 bp, Rattus norvegicus
agttagcaagttgttcatcacttta

SEQ ID NO: 164873 - DNA, 25 bp, Rattus norvegicus
agttagcacagtacattttcatgac

SEQ ID NO: 164874 - DNA, 25 bp, Rattus norvegicus
agttagcacagttcattttcatgac

SEQ ID NO: 164875 - DNA, 25 bp, Rattus norvegicus
agttagcactagacagttgatgact

SEQ ID NO: 164876 - DNA, 25 bp, Rattus norvegicus
agttagcactagtcagttgatgact

SEQ ID NO: 164877 - DNA, 25 bp, Rattus norvegicus
agttagcatatcatcctgggaccag

SEQ ID NO: 164878 - DNA, 25 bp, Rattus norvegicus
agttagcatatcttcctgggaccag

SEQ ID NO: 164879 - DNA, 25 bp, Rattus norvegicus
agttagcatggtaggtctcagacaa

SEQ ID NO: 164880 - DNA, 25 bp, Rattus norvegicus
agttagcatggttggtctcagacaa

SEQ ID NO: 164881 - DNA, 25 bp, Rattus norvegicus
agttagcccgtgaacactacatgtt

SEQ ID NO: 164882 - DNA, 25 bp, Rattus norvegicus
agttagcccgtgtacactacatgtt

SEQ ID NO: 164883 - DNA, 25 bp, Rattus norvegicus
agttagccctgtccttcttggtgct

SEQ ID NO: 164884 - DNA, 25 bp, Rattus norvegicus
agttagccctgtgcttcttggtgct

SEQ ID NO: 164885 - DNA, 25 bp, Rattus norvegicus
agttagcctgccagtgactcagtgt

SEQ ID NO: 164886 - DNA, 25 bp, Rattus norvegicus
agttagcctgcctgtgactcagtgt

SEQ ID NO: 164887 - DNA, 25 bp, Rattus norvegicus
agttagcgctatccgctttttggaa

SEQ ID NO: 164888 - DNA, 25 bp, Rattus norvegicus
agttagcgctatgcgctttttggaa

SEQ ID NO: 164889 - DNA, 25 bp, Rattus norvegicus
agttagcggtagatcactgagcttt

SEQ ID NO: 164890 - DNA, 25 bp, Rattus norvegicus
agttagcggtagttcactgagcttt

SEQ ID NO: 164891 - DNA, 25 bp, Rattus norvegicus
agttagctagctctccgcaagactc

SEQ ID NO: 164892 - DNA, 25 bp, Rattus norvegicus
agttagctagctgtccgcaagactc

SEQ ID NO: 164893 - DNA, 25 bp, Rattus norvegicus
agttagctatgtctgtatgcccttc

SEQ ID NO: 164894 - DNA, 25 bp, Rattus norvegicus
agttagctatgtgtgtatgcccttc

SEQ ID NO: 164895 - DNA, 25 bp, Rattus norvegicus
agttagctcagacgttcaggccctg

SEQ ID NO: 164896 - DNA, 25 bp, Rattus norvegicus
agttagctcagaggttcaggccctg

SEQ ID NO: 164897 - DNA, 25 bp, Rattus norvegicus
agttagctcagcaagctcacagcaa

SEQ ID NO: 164898 - DNA, 25 bp, Rattus norvegicus
agttagctcagctagctcacagcaa

SEQ ID NO: 164899 - DNA, 25 bp, Rattus norvegicus
agttagctccctatcagtttagata

SEQ ID NO: 164900 - DNA, 25 bp, Rattus norvegicus
agttagctccctttcagtttagata

SEQ ID NO: 164901 - DNA, 25 bp, Rattus norvegicus
agttagctgtggcttatgtcctgcc

SEQ ID NO: 164902 - DNA, 25 bp, Rattus norvegicus
agttagctgtgggttatgtcctgcc

SEQ ID NO: 164903 - DNA, 25 bp, Rattus norvegicus
agttagcttggtacctcacatctgt

SEQ ID NO: 164904 - DNA, 25 bp, Rattus norvegicus
agttagcttggttcctcacatctgt

SEQ ID NO: 164905 - DNA, 25 bp, Rattus norvegicus
agttaggaatgacccagctcttttt

SEQ ID NO: 164906 - DNA, 25 bp, Rattus norvegicus
agttaggaatgagccagctcttttt

SEQ ID NO: 164907 - DNA, 25 bp, Rattus norvegicus
agttaggacaggacttctctgagcc

SEQ ID NO: 164908 - DNA, 25 bp, Rattus norvegicus
agttaggacaggtcttctctgagcc

SEQ ID NO: 164909 - DNA, 25 bp, Rattus norvegicus
agttaggactgaccacggcgaccgt

SEQ ID NO: 164910 - DNA, 25 bp, Rattus norvegicus
agttaggactgagcacggcgaccgt

SEQ ID NO: 164911 - DNA, 25 bp, Rattus norvegicus
agttaggagactcctgacccttgtt

SEQ ID NO: 164912 - DNA, 25 bp, Rattus norvegicus
agttaggagactgctgacccttgtt

SEQ ID NO: 164913 - DNA, 25 bp, Rattus norvegicus
agttaggccctgagagcactttttc

SEQ ID NO: 164914 - DNA, 25 bp, Rattus norvegicus
agttaggccctgtgagcactttttc

SEQ ID NO: 164915 - DNA, 25 bp, Rattus norvegicus
agttaggctcttcaggcccatatga

SEQ ID NO: 164916 - DNA, 25 bp, Rattus norvegicus
agttaggctcttgaggcccatatga

SEQ ID NO: 164917 - DNA, 25 bp, Rattus norvegicus
agttagggcagacttgcatgccgca

SEQ ID NO: 164918 - DNA, 25 bp, Rattus norvegicus
agttagggcagagttgcatgccgca

SEQ ID NO: 164919 - DNA, 25 bp, Rattus norvegicus
agttaggtcaacaaacctgccttgt

SEQ ID NO: 164920 - DNA, 25 bp, Rattus norvegicus
agttaggtcaactaacctgccttgt

SEQ ID NO: 164921 - DNA, 25 bp, Rattus norvegicus
agttaggtccttcgccagtgtggaa

SEQ ID NO: 164922 - DNA, 25 bp, Rattus norvegicus
agttaggtccttggccagtgtggaa

SEQ ID NO: 164923 - DNA, 25 bp, Rattus norvegicus
agttagtaaaccactgtcttatctg

SEQ ID NO: 164924 - DNA, 25 bp, Rattus norvegicus
agttagtaaacctctgtcttatctg

SEQ ID NO: 164925 - DNA, 25 bp, Rattus norvegicus
agttagtaggagcactgctttccct

SEQ ID NO: 164926 - DNA, 25 bp, Rattus norvegicus
agttagtaggaggactgctttccct

SEQ ID NO: 164927 - DNA, 25 bp, Rattus norvegicus
agttagtcacccaggccaccaacgg

SEQ ID NO: 164928 - DNA, 25 bp, Rattus norvegicus
agttagtcaccctggccaccaacgg

SEQ ID NO: 164929 - DNA, 25 bp, Rattus norvegicus
agttagtcacttagtgtcacccgga

SEQ ID NO: 164930 - DNA, 25 bp, Rattus norvegicus
agttagtcactttgtgtcacccgga

SEQ ID NO: 164931 - DNA, 25 bp, Rattus norvegicus
agttagtcatgaaggactcatcccc

SEQ ID NO: 164932 - DNA, 25 bp, Rattus norvegicus
agttagtcatgatggactcatcccc

SEQ ID NO: 164933 - DNA, 25 bp, Rattus norvegicus
agttagtccatgctgttgtacacat

SEQ ID NO: 164934 - DNA, 25 bp, Rattus norvegicus
agttagtccatggtgttgtacacat

SEQ ID NO: 164935 - DNA, 25 bp, Rattus norvegicus
agttagtcccagctctacttggtca

SEQ ID NO: 164936 - DNA, 25 bp, Rattus norvegicus
agttagtcccaggtctacttggtca

SEQ ID NO: 164937 - DNA, 25 bp, Rattus norvegicus
agttagtcgtggaccctcctcgtca

SEQ ID NO: 164938 - DNA, 25 bp, Rattus norvegicus
agttagtcgtggtccctcctcgtca

SEQ ID NO: 164939 - DNA, 25 bp, Rattus norvegicus
agttagtctggcagtgctactttag

SEQ ID NO: 164940 - DNA, 25 bp, Rattus norvegicus
agttagtctggctgtgctactttag

SEQ ID NO: 164941 - DNA, 25 bp, Rattus norvegicus
agttagtcttgtcttgtgtgccaac

SEQ ID NO: 164942 - DNA, 25 bp, Rattus norvegicus
agttagtcttgtgttgtgtgccaac

SEQ ID NO: 164943 - DNA, 25 bp, Rattus norvegicus
agttagtgtcttacatgtggcctca

SEQ ID NO: 164944 - DNA, 25 bp, Rattus norvegicus
agttagtgtctttcatgtggcctca

SEQ ID NO: 164945 - DNA, 25 bp, Rattus norvegicus
agttagttccctcgtcctgagcgtc

SEQ ID NO: 164946 - DNA, 25 bp, Rattus norvegicus
agttagttccctggtcctgagcgtc

SEQ ID NO: 164947 - DNA, 25 bp, Rattus norvegicus
agttagttctcactgcctcttggtt

SEQ ID NO: 164948 - DNA, 25 bp, Rattus norvegicus
agttagttctcagtgcctcttggtt

SEQ ID NO: 164949 - DNA, 25 bp, Rattus norvegicus
agttagttggccaccggtttgcaca

SEQ ID NO: 164950 - DNA, 25 bp, Rattus norvegicus
agttagttggcctccggtttgcaca

SEQ ID NO: 164951 - DNA, 25 bp, Rattus norvegicus
agttagttgtgaaatgccctgccct

SEQ ID NO: 164952 - DNA, 25 bp, Rattus norvegicus
agttagttgtgatatgccctgccct

SEQ ID NO: 164953 - DNA, 25 bp, Rattus norvegicus
agttagtttccccagttctagtgcg

SEQ ID NO: 164954 - DNA, 25 bp, Rattus norvegicus
agttagtttcccgagttctagtgcg

SEQ ID NO: 164955 - DNA, 25 bp, Rattus norvegicus
agttatacaccaaatgcctcatttt

SEQ ID NO: 164956 - DNA, 25 bp, Rattus norvegicus
agttatacaccatatgcctcatttt

SEQ ID NO: 164957 - DNA, 25 bp, Rattus norvegicus
agttatacagcactgtgtctcccag

SEQ ID NO: 164958 - DNA, 25 bp, Rattus norvegicus
agttatacagcagtgtgtctcccag

SEQ ID NO: 164959 - DNA, 25 bp, Rattus norvegicus
agttataccaccatcacagtcctgg

SEQ ID NO: 164960 - DNA, 25 bp, Rattus norvegicus
agttataccaccttcacagtcctgg

SEQ ID NO: 164961 - DNA, 25 bp, Rattus norvegicus
agttatacgagacagcaggtttagc

SEQ ID NO: 164962 - DNA, 25 bp, Rattus norvegicus
agttatacgagagagcaggtttagc

SEQ ID NO: 164963 - DNA, 25 bp, Rattus norvegicus
agttatatccccactgcctcatttg

SEQ ID NO: 164964 - DNA, 25 bp, Rattus norvegicus
agttatatcccctctgcctcatttg

SEQ ID NO: 164965 - DNA, 25 bp, Rattus norvegicus
agttatattatcattcctcaccctt

SEQ ID NO: 164966 - DNA, 25 bp, Rattus norvegicus
agttatattatctttcctcaccctt

SEQ ID NO: 164967 - DNA, 25 bp, Rattus norvegicus
agttatcacaaacctgactcctgct

SEQ ID NO: 164968 - DNA, 25 bp, Rattus norvegicus
agttatcacaaagctgactcctgct

SEQ ID NO: 164969 - DNA, 25 bp, Rattus norvegicus
agttatcagatcacctgtttccctg

SEQ ID NO: 164970 - DNA, 25 bp, Rattus norvegicus
agttatcagatctcctgtttccctg

SEQ ID NO: 164971 - DNA, 25 bp, Rattus norvegicus
agttatcatggtacggacaccgatc

SEQ ID NO: 164972 - DNA, 25 bp, Rattus norvegicus
agttatcatggttcggacaccgatc

SEQ ID NO: 164973 - DNA, 25 bp, Rattus norvegicus
agttatccactcaattttttctgaa

SEQ ID NO: 164974 - DNA, 25 bp, Rattus norvegicus
agttatccactctattttttctgaa

SEQ ID NO: 164975 - DNA, 25 bp, Rattus norvegicus
agttatccagttagttctgccatcc

SEQ ID NO: 164976 - DNA, 25 bp, Rattus norvegicus
agttatccagtttgttctgccatcc

SEQ ID NO: 164977 - DNA, 25 bp, Rattus norvegicus
agttatcccaagaacttctcattta

SEQ ID NO: 164978 - DNA, 25 bp, Rattus norvegicus
agttatcccaagtacttctcattta

SEQ ID NO: 164979 - DNA, 25 bp, Rattus norvegicus
agttatcccattatgcatgctggaa

SEQ ID NO: 164980 - DNA, 25 bp, Rattus norvegicus
agttatcccattttgcatgctggaa

SEQ ID NO: 164981 - DNA, 25 bp, Rattus norvegicus
agttatcctgccactataagtcctt

SEQ ID NO: 164982 - DNA, 25 bp, Rattus norvegicus
agttatcctgcctctataagtcctt

SEQ ID NO: 164983 - DNA, 25 bp, Rattus norvegicus
agttatcctggcacattgatgtacg

SEQ ID NO: 164984 - DNA, 25 bp, Rattus norvegicus
agttatcctggctcattgatgtacg

SEQ ID NO: 164985 - DNA, 25 bp, Rattus norvegicus
agttatcctgttatatgagcatctt

SEQ ID NO: 164986 - DNA, 25 bp, Rattus norvegicus
agttatcctgttttatgagcatctt

SEQ ID NO: 164987 - DNA, 25 bp, Rattus norvegicus
agttatctaatgaagacaggcccat

SEQ ID NO: 164988 - DNA, 25 bp, Rattus norvegicus
agttatctaatgtagacaggcccat

SEQ ID NO: 164989 - DNA, 25 bp, Rattus norvegicus
agttatctacagacagtcccctttg

SEQ ID NO: 164990 - DNA, 25 bp, Rattus norvegicus
agttatctacagtcagtcccctttg

SEQ ID NO: 164991 - DNA, 25 bp, Rattus norvegicus
agttatctatttcctgtcacaaagg

SEQ ID NO: 164992 - DNA, 25 bp, Rattus norvegicus
agttatctatttgctgtcacaaagg

SEQ ID NO: 164993 - DNA, 25 bp, Rattus norvegicus
agttatctcaggcagcacccttaga

SEQ ID NO: 164994 - DNA, 25 bp, Rattus norvegicus
agttatctcagggagcacccttaga

SEQ ID NO: 164995 - DNA, 25 bp, Rattus norvegicus
agttatctgcatccgtgaaggcctc

SEQ ID NO: 164996 - DNA, 25 bp, Rattus norvegicus
agttatctgcatgcgtgaaggcctc

SEQ ID NO: 164997 - DNA, 25 bp, Rattus norvegicus
agttatctggatcccttatttcccg

SEQ ID NO: 164998 - DNA, 25 bp, Rattus norvegicus
agttatctggatgccttatttcccg

SEQ ID NO: 164999 - DNA, 25 bp, Rattus norvegicus
agttatctgggaagagagacctgta

SEQ ID NO: 165000 - DNA, 25 bp, Rattus norvegicus
agttatctgggatgagagacctgta

SEQ ID NO: 165001 - DNA, 25 bp, Rattus norvegicus
agttatcttctgagagggcctctaa

SEQ ID NO: 165002 - DNA, 25 bp, Rattus norvegicus
agttatcttctgtgagggcctctaa

SEQ ID NO: 165003 - DNA, 25 bp, Rattus norvegicus
agttatctttatccactgctctgtt

SEQ ID NO: 165004 - DNA, 25 bp, Rattus norvegicus
agttatctttatgcactgctctgtt

SEQ ID NO: 165005 - DNA, 25 bp, Rattus norvegicus
agttatgaaactcgcccacacctac

SEQ ID NO: 165006 - DNA, 25 bp, Rattus norvegicus
agttatgaaactggcccacacctac

SEQ ID NO: 165007 - DNA, 25 bp, Rattus norvegicus
agttatgaacacatgcagctcctgc

SEQ ID NO: 165008 - DNA, 25 bp, Rattus norvegicus
agttatgaacacttgcagctcctgc

SEQ ID NO: 165009 - DNA, 25 bp, Rattus norvegicus
agttatgacctcaagaatgtttgtt

SEQ ID NO: 165010 - DNA, 25 bp, Rattus norvegicus
agttatgacctctagaatgtttgtt

SEQ ID NO: 165011 - DNA, 25 bp, Rattus norvegicus
agttatgactctactctttccttta

SEQ ID NO: 165012 - DNA, 25 bp, Rattus norvegicus
agttatgactcttctctttccttta

SEQ ID NO: 165013 - DNA, 25 bp, Rattus norvegicus
agttatgagagtacttcgggctggt

SEQ ID NO: 165014 - DNA, 25 bp, Rattus norvegicus
agttatgagagttcttcgggctggt

SEQ ID NO: 165015 - DNA, 25 bp, Rattus norvegicus
agttatgcaataactacctccagtg

SEQ ID NO: 165016 - DNA, 25 bp, Rattus norvegicus
agttatgcaatatctacctccagtg

SEQ ID NO: 165017 - DNA, 25 bp, Rattus norvegicus
agttatgcaattctcaaggtccctc

SEQ ID NO: 165018 - DNA, 25 bp, Rattus norvegicus
agttatgcaattgtcaaggtccctc

SEQ ID NO: 165019 - DNA, 25 bp, Rattus norvegicus
agttatgcacgaaaccctgggttca

SEQ ID NO: 165020 - DNA, 25 bp, Rattus norvegicus
agttatgcacgataccctgggttca

SEQ ID NO: 165021 - DNA, 25 bp, Rattus norvegicus
agttatgctaacacgggtgtgtaat

SEQ ID NO: 165022 - DNA, 25 bp, Rattus norvegicus
agttatgctaactcgggtgtgtaat

SEQ ID NO: 165023 - DNA, 25 bp, Rattus norvegicus
agttatgctccacccactctgctga

SEQ ID NO: 165024 - DNA, 25 bp, Rattus norvegicus
agttatgctccagccactctgctga

SEQ ID NO: 165025 - DNA, 25 bp, Rattus norvegicus
agttatgctgaccagggaagcctga

SEQ ID NO: 165026 - DNA, 25 bp, Rattus norvegicus
agttatgctgacgagggaagcctga

SEQ ID NO: 165027 - DNA, 25 bp, Rattus norvegicus
agttatgctgtaactgttttccaaa

SEQ ID NO: 165028 - DNA, 25 bp, Rattus norvegicus
agttatgctgtatctgttttccaaa

SEQ ID NO: 165029 - DNA, 25 bp, Rattus norvegicus
agttatggctgtacaatccctgaaa

SEQ ID NO: 165030 - DNA, 25 bp, Rattus norvegicus
agttatggctgttcaatccctgaaa

SEQ ID NO: 165031 - DNA, 25 bp, Rattus norvegicus
agttatggcttcattctacaatgag

SEQ ID NO: 165032 - DNA, 25 bp, Rattus norvegicus
agttatggcttctttctacaatgag

SEQ ID NO: 165033 - DNA, 25 bp, Rattus norvegicus
agttatggttatcatcccagcactt

SEQ ID NO: 165034 - DNA, 25 bp, Rattus norvegicus
agttatggttatgatcccagcactt

SEQ ID NO: 165035 - DNA, 25 bp, Rattus norvegicus
agttatggtttgatggtcctctcat

SEQ ID NO: 165036 - DNA, 25 bp, Rattus norvegicus
agttatggtttgttggtcctctcat

SEQ ID NO: 165037 - DNA, 25 bp, Rattus norvegicus
agttatgtactcatccatctctgtt

SEQ ID NO: 165038 - DNA, 25 bp, Rattus norvegicus
agttatgtactcttccatctctgtt

SEQ ID NO: 165039 - DNA, 25 bp, Rattus norvegicus
agttatgttctgatctcctttcctt

SEQ ID NO: 165040 - DNA, 25 bp, Rattus norvegicus
agttatgttctgttctcctttcctt

SEQ ID NO: 165041 - DNA, 25 bp, Rattus norvegicus
agttatgttgccaggactggttttt

SEQ ID NO: 165042 - DNA, 25 bp, Rattus norvegicus
agttatgttgcctggactggttttt

SEQ ID NO: 165043 - DNA, 25 bp, Rattus norvegicus
agttattaccgtcatcgtgtgatgt

SEQ ID NO: 165044 - DNA, 25 bp, Rattus norvegicus
agttattaccgtgatcgtgtgatgt

SEQ ID NO: 165045 - DNA, 25 bp, Rattus norvegicus
agttattagcttactgcttctcggc

SEQ ID NO: 165046 - DNA, 25 bp, Rattus norvegicus
agttattagctttctgcttctcggc

SEQ ID NO: 165047 - DNA, 25 bp, Rattus norvegicus
agttattcatatatgacactctgtt

SEQ ID NO: 165048 - DNA, 25 bp, Rattus norvegicus
agttattcatatttgacactctgtt

SEQ ID NO: 165049 - DNA, 25 bp, Rattus norvegicus
agttattccaaaagccacccagttg

SEQ ID NO: 165050 - DNA, 25 bp, Rattus norvegicus
agttattccaaatgccacccagttg

SEQ ID NO: 165051 - DNA, 25 bp, Rattus norvegicus
agttattcctgcctgacctaatgaa

SEQ ID NO: 165052 - DNA, 25 bp, Rattus norvegicus
agttattcctgcgtgacctaatgaa

SEQ ID NO: 165053 - DNA, 25 bp, Rattus norvegicus
agttattctaccctggttcataaag

SEQ ID NO: 165054 - DNA, 25 bp, Rattus norvegicus
agttattctaccgtggttcataaag

SEQ ID NO: 165055 - DNA, 25 bp, Rattus norvegicus
agttattctgttatgaagtgtgact

SEQ ID NO: 165056 - DNA, 25 bp, Rattus norvegicus
agttattctgttttgaagtgtgact

SEQ ID NO: 165057 - DNA, 25 bp, Rattus norvegicus
agttattgaattactcagcccatgc

SEQ ID NO: 165058 - DNA, 25 bp, Rattus norvegicus
agttattgaatttctcagcccatgc

SEQ ID NO: 165059 - DNA, 25 bp, Rattus norvegicus
agttattgagatcgcctttccctca

SEQ ID NO: 165060 - DNA, 25 bp, Rattus norvegicus
agttattgagatggcctttccctca

SEQ ID NO: 165061 - DNA, 25 bp, Rattus norvegicus
agttattgcgttcccttagcacttc

SEQ ID NO: 165062 - DNA, 25 bp, Rattus norvegicus
agttattgcgttgccttagcacttc

SEQ ID NO: 165063 - DNA, 25 bp, Rattus norvegicus
agttattggccgagtcattcaaccc

SEQ ID NO: 165064 - DNA, 25 bp, Rattus norvegicus
agttattggccgtgtcattcaaccc

SEQ ID NO: 165065 - DNA, 25 bp, Rattus norvegicus
agttattggtgaatacacaccctgc

SEQ ID NO: 165066 - DNA, 25 bp, Rattus norvegicus
agttattggtgattacacaccctgc

SEQ ID NO: 165067 - DNA, 25 bp, Rattus norvegicus
agttattgtgctcttgtcagctccc

SEQ ID NO: 165068 - DNA, 25 bp, Rattus norvegicus
agttattgtgctcttttctgttata

SEQ ID NO: 165069 - DNA, 25 bp, Rattus norvegicus
agttattgtgctgttgtcagctccc

SEQ ID NO: 165070 - DNA, 25 bp, Rattus norvegicus
agttattgtgctgttttctgttata

SEQ ID NO: 165071 - DNA, 25 bp, Rattus norvegicus
agttattgttacaaggtccacttca

SEQ ID NO: 165072 - DNA, 25 bp, Rattus norvegicus
agttattgttactaggtccacttca

SEQ ID NO: 165073 - DNA, 25 bp, Rattus norvegicus
agttatttaaccactctggagcctc

SEQ ID NO: 165074 - DNA, 25 bp, Rattus norvegicus
agttatttaacctctctggagcctc

SEQ ID NO: 165075 - DNA, 25 bp, Rattus norvegicus
agttatttcagtcggctggacccgt

SEQ ID NO: 165076 - DNA, 25 bp, Rattus norvegicus
agttatttcagtgggctggacccgt

SEQ ID NO: 165077 - DNA, 25 bp, Rattus norvegicus
agttatttcctgaagatccaccctg

SEQ ID NO: 165078 - DNA, 25 bp, Rattus norvegicus
agttatttcctgtagatccaccctg

SEQ ID NO: 165079 - DNA, 25 bp, Rattus norvegicus
agttatttctggagcactgacagcc

SEQ ID NO: 165080 - DNA, 25 bp, Rattus norvegicus
agttatttctggtgcactgacagcc

SEQ ID NO: 165081 - DNA, 25 bp, Rattus norvegicus
agttatttcttcactgtacattgag

SEQ ID NO: 165082 - DNA, 25 bp, Rattus norvegicus
agttatttcttctctgtacattgag

SEQ ID NO: 165083 - DNA, 25 bp, Rattus norvegicus
agttatttgtctatgttgtgtctat

SEQ ID NO: 165084 - DNA, 25 bp, Rattus norvegicus
agttatttgtctttgttgtgtctat

SEQ ID NO: 165085 - DNA, 25 bp, Rattus norvegicus
agttattttattccttctcgtcaca

SEQ ID NO: 165086 - DNA, 25 bp, Rattus norvegicus
agttattttattgcttctcgtcaca

SEQ ID NO: 165087 - DNA, 25 bp, Rattus norvegicus
agttattttctacttcagttcagga

SEQ ID NO: 165088 - DNA, 25 bp, Rattus norvegicus
agttattttctagttcagttcagga

SEQ ID NO: 165089 - DNA, 25 bp, Rattus norvegicus
agttattttcttctgctggacagta

SEQ ID NO: 165090 - DNA, 25 bp, Rattus norvegicus
agttattttcttgtgctggacagta

SEQ ID NO: 165091 - DNA, 25 bp, Rattus norvegicus
agttattttgatcagctgcttcttt

SEQ ID NO: 165092 - DNA, 25 bp, Rattus norvegicus
agttattttgatgagctgcttcttt

SEQ ID NO: 165093 - DNA, 25 bp, Rattus norvegicus
agttcaaacaaaccactctctcaag

SEQ ID NO: 165094 - DNA, 25 bp, Rattus norvegicus
agttcaaacaaagcactctctcaag

SEQ ID NO: 165095 - DNA, 25 bp, Rattus norvegicus
agttcaaagcctcactatggattga

SEQ ID NO: 165096 - DNA, 25 bp, Rattus norvegicus
agttcaaagcctcactgccacatag

SEQ ID NO: 165097 - DNA, 25 bp, Rattus norvegicus
agttcaaagcctgactatggattga

SEQ ID NO: 165098 - DNA, 25 bp, Rattus norvegicus
agttcaaagcctgactgccacatag

SEQ ID NO: 165099 - DNA, 25 bp, Rattus norvegicus
agttcaaaggcaccagttctcactt

SEQ ID NO: 165100 - DNA, 25 bp, Rattus norvegicus
agttcaaaggcagcagttctcactt

SEQ ID NO: 165101 - DNA, 25 bp, Rattus norvegicus
agttcaaaggttatgagcactggct

SEQ ID NO: 165102 - DNA, 25 bp, Rattus norvegicus
agttcaaaggttttgagcactggct

SEQ ID NO: 165103 - DNA, 25 bp, Rattus norvegicus
agttcaaagtacatccctgggtcct

SEQ ID NO: 165104 - DNA, 25 bp, Rattus norvegicus
agttcaaagtacttccctgggtcct

SEQ ID NO: 165105 - DNA, 25 bp, Rattus norvegicus
agttcaaatccaccccttggtcagc

SEQ ID NO: 165106 - DNA, 25 bp, Rattus norvegicus
agttcaaatccagcccttggtcagc

SEQ ID NO: 165107 - DNA, 25 bp, Rattus norvegicus
agttcaaatcccaagcagcgtgtaa

SEQ ID NO: 165108 - DNA, 25 bp, Rattus norvegicus
agttcaaatccctagcagcgtgtaa

SEQ ID NO: 165109 - DNA, 25 bp, Rattus norvegicus
agttcaaattttaatcagctccttc

SEQ ID NO: 165110 - DNA, 25 bp, Rattus norvegicus
agttcaaatttttatcagctccttc

SEQ ID NO: 165111 - DNA, 25 bp, Rattus norvegicus
agttcaacacaaactgcccagagtg

SEQ ID NO: 165112 - DNA, 25 bp, Rattus norvegicus
agttcaacacaatctgcccagagtg

SEQ ID NO: 165113 - DNA, 25 bp, Rattus norvegicus
agttcaacactaacctcagctgcat

SEQ ID NO: 165114 - DNA, 25 bp, Rattus norvegicus
agttcaacactatcctcagctgcat

SEQ ID NO: 165115 - DNA, 25 bp, Rattus norvegicus
agttcaacagctagctctggttcag

SEQ ID NO: 165116 - DNA, 25 bp, Rattus norvegicus
agttcaacagcttgctctggttcag

SEQ ID NO: 165117 - DNA, 25 bp, Rattus norvegicus
agttcaacgttgagaacctgcggcc

SEQ ID NO: 165118 - DNA, 25 bp, Rattus norvegicus
agttcaacgttgtgaacctgcggcc

SEQ ID NO: 165119 - DNA, 25 bp, Rattus norvegicus
agttcaagaaacattacttcagaat

SEQ ID NO: 165120 - DNA, 25 bp, Rattus norvegicus
agttcaagaaactttacttcagaat

SEQ ID NO: 165121 - DNA, 25 bp, Rattus norvegicus
agttcaagaactcatggcattgtag

SEQ ID NO: 165122 - DNA, 25 bp, Rattus norvegicus
agttcaagaactgatggcattgtag

SEQ ID NO: 165123 - DNA, 25 bp, Rattus norvegicus
agttcaagcagtagacccgcagcat

SEQ ID NO: 165124 - DNA, 25 bp, Rattus norvegicus
agttcaagcagttgacccgcagcat

SEQ ID NO: 165125 - DNA, 25 bp, Rattus norvegicus
agttcaagcccaactccagagacag

SEQ ID NO: 165126 - DNA, 25 bp, Rattus norvegicus
agttcaagcccatctccagagacag

SEQ ID NO: 165127 - DNA, 25 bp, Rattus norvegicus
agttcaagcccgattatcctcattg

SEQ ID NO: 165128 - DNA, 25 bp, Rattus norvegicus
agttcaagcccgtttatcctcattg

SEQ ID NO: 165129 - DNA, 25 bp, Rattus norvegicus
agttcaagctggagtccctcggtct

SEQ ID NO: 165130 - DNA, 25 bp, Rattus norvegicus
agttcaagctggtgtccctcggtct

SEQ ID NO: 165131 - DNA, 25 bp, Rattus norvegicus
agttcaaggagaactgcgccttctg

SEQ ID NO: 165132 - DNA, 25 bp, Rattus norvegicus
agttcaaggagatctgcgccttctg

SEQ ID NO: 165133 - DNA, 25 bp, Rattus norvegicus
agttcaaggctaaccagggttacaa

SEQ ID NO: 165134 - DNA, 25 bp, Rattus norvegicus
agttcaaggctacctgattcttctc

SEQ ID NO: 165135 - DNA, 25 bp, Rattus norvegicus
agttcaaggctagctgattcttctc

SEQ ID NO: 165136 - DNA, 25 bp, Rattus norvegicus
agttcaaggctatccagggttacaa

SEQ ID NO: 165137 - DNA, 25 bp, Rattus norvegicus
agttcaaggctgacgcacagctgct

SEQ ID NO: 165138 - DNA, 25 bp, Rattus norvegicus
agttcaaggctgtcgcacagctgct

SEQ ID NO: 165139 - DNA, 25 bp, Rattus norvegicus
agttcaagggctatcagcactctct

SEQ ID NO: 165140 - DNA, 25 bp, Rattus norvegicus
agttcaagggctttcagcactctct

SEQ ID NO: 165141 - DNA, 25 bp, Rattus norvegicus
agttcaaggtcaacccctactacat

SEQ ID NO: 165142 - DNA, 25 bp, Rattus norvegicus
agttcaaggtcatcccctactacat

SEQ ID NO: 165143 - DNA, 25 bp, Rattus norvegicus
agttcaaggtccacctcagttggag

SEQ ID NO: 165144 - DNA, 25 bp, Rattus norvegicus
agttcaaggtcctcctcagttggag

SEQ ID NO: 165145 - DNA, 25 bp, Rattus norvegicus
agttcaaggtggagactcggtccca

SEQ ID NO: 165146 - DNA, 25 bp, Rattus norvegicus
agttcaaggtggtgactcggtccca

SEQ ID NO: 165147 - DNA, 25 bp, Rattus norvegicus
agttcaagtaaccaactctccattg

SEQ ID NO: 165148 - DNA, 25 bp, Rattus norvegicus
agttcaagtaacgaactctccattg

SEQ ID NO: 165149 - DNA, 25 bp, Rattus norvegicus
agttcaagtacgctcttttggctgt

SEQ ID NO: 165150 - DNA, 25 bp, Rattus norvegicus
agttcaagtacggtcttttggctgt

SEQ ID NO: 165151 - DNA, 25 bp, Rattus norvegicus
agttcaagtcttatttccagagctt

SEQ ID NO: 165152 - DNA, 25 bp, Rattus norvegicus
agttcaagtcttttttccagagctt

SEQ ID NO: 165153 - DNA, 25 bp, Rattus norvegicus
agttcaagtgctctccggtggtgcc

SEQ ID NO: 165154 - DNA, 25 bp, Rattus norvegicus
agttcaagtgctgtccggtggtgcc

SEQ ID NO: 165155 - DNA, 25 bp, Rattus norvegicus
agttcaagttggaccagccctcaga

SEQ ID NO: 165156 - DNA, 25 bp, Rattus norvegicus
agttcaagttggtccagccctcaga

SEQ ID NO: 165157 - DNA, 25 bp, Rattus norvegicus
agttcaataccccaaacccatgtgg

SEQ ID NO: 165158 - DNA, 25 bp, Rattus norvegicus
agttcaatacccgaaacccatgtgg

SEQ ID NO: 165159 - DNA, 25 bp, Rattus norvegicus
agttcaatatgtacactgtgcgcaa

SEQ ID NO: 165160 - DNA, 25 bp, Rattus norvegicus
agttcaatatgttcactgtgcgcaa

SEQ ID NO: 165161 - DNA, 25 bp, Rattus norvegicus
agttcaatcaggactcggagttcaa

SEQ ID NO: 165162 - DNA, 25 bp, Rattus norvegicus
agttcaatcaggtctcggagttcaa

SEQ ID NO: 165163 - DNA, 25 bp, Rattus norvegicus
agttcaatccatctcttctctgtta

SEQ ID NO: 165164 - DNA, 25 bp, Rattus norvegicus
agttcaatccatgtcttctctgtta

SEQ ID NO: 165165 - DNA, 25 bp, Rattus norvegicus
agttcaatcttcactacccaggtat

SEQ ID NO: 165166 - DNA, 25 bp, Rattus norvegicus
agttcaatcttctctacccaggtat

SEQ ID NO: 165167 - DNA, 25 bp, Rattus norvegicus
agttcaattttgcttttctgtggtt

SEQ ID NO: 165168 - DNA, 25 bp, Rattus norvegicus
agttcaattttggttttctgtggtt

SEQ ID NO: 165169 - DNA, 25 bp, Rattus norvegicus
agttcacaaagcagttctctggcct

SEQ ID NO: 165170 - DNA, 25 bp, Rattus norvegicus
agttcacaaagctgttctctggcct

SEQ ID NO: 165171 - DNA, 25 bp, Rattus norvegicus
agttcacaaccaacattaatgccag

SEQ ID NO: 165172 - DNA, 25 bp, Rattus norvegicus
agttcacaaccatcattaatgccag

SEQ ID NO: 165173 - DNA, 25 bp, Rattus norvegicus
agttcacaaggaattccaccgcggc

SEQ ID NO: 165174 - DNA, 25 bp, Rattus norvegicus
agttcacaaggatttccaccgcggc

SEQ ID NO: 165175 - DNA, 25 bp, Rattus norvegicus
agttcacacatcaagagccagggtc

SEQ ID NO: 165176 - DNA, 25 bp, Rattus norvegicus
agttcacacatctagagccagggtc

SEQ ID NO: 165177 - DNA, 25 bp, Rattus norvegicus
agttcacagaacatggctgctagtt

SEQ ID NO: 165178 - DNA, 25 bp, Rattus norvegicus
agttcacagaacttggctgctagtt

SEQ ID NO: 165179 - DNA, 25 bp, Rattus norvegicus
agttcacagacacgcctaccaggct

SEQ ID NO: 165180 - DNA, 25 bp, Rattus norvegicus
agttcacagacaggcctaccaggct

SEQ ID NO: 165181 - DNA, 25 bp, Rattus norvegicus
agttcacagactctagccgctgttc

SEQ ID NO: 165182 - DNA, 25 bp, Rattus norvegicus
agttcacagactgtagccgctgttc

SEQ ID NO: 165183 - DNA, 25 bp, Rattus norvegicus
agttcacagcatccctggacagatg

SEQ ID NO: 165184 - DNA, 25 bp, Rattus norvegicus
agttcacagcatcgcctgaccacgg

SEQ ID NO: 165185 - DNA, 25 bp, Rattus norvegicus
agttcacagcatgcctggacagatg

SEQ ID NO: 165186 - DNA, 25 bp, Rattus norvegicus
agttcacagcatggcctgaccacgg

SEQ ID NO: 165187 - DNA, 25 bp, Rattus norvegicus
agttcacagccaagttcagaccagt

SEQ ID NO: 165188 - DNA, 25 bp, Rattus norvegicus
agttcacagccatgttcagaccagt

SEQ ID NO: 165189 - DNA, 25 bp, Rattus norvegicus
agttcacagctaccggagcgaccgt

SEQ ID NO: 165190 - DNA, 25 bp, Rattus norvegicus
agttcacagctagcggagcgaccgt

SEQ ID NO: 165191 - DNA, 25 bp, Rattus norvegicus
agttcacagctcacctttcagaaga

SEQ ID NO: 165192 - DNA, 25 bp, Rattus norvegicus
agttcacagctctcctttcagaaga

SEQ ID NO: 165193 - DNA, 25 bp, Rattus norvegicus
agttcacaggtcagagtgaccctga

SEQ ID NO: 165194 - DNA, 25 bp, Rattus norvegicus
agttcacaggtctgagtgaccctga

SEQ ID NO: 165195 - DNA, 25 bp, Rattus norvegicus
agttcacatggcaccaaaactgctc

SEQ ID NO: 165196 - DNA, 25 bp, Rattus norvegicus
agttcacatggcatttggcagtttc

SEQ ID NO: 165197 - DNA, 25 bp, Rattus norvegicus
agttcacatggctccaaaactgctc

SEQ ID NO: 165198 - DNA, 25 bp, Rattus norvegicus
agttcacatggcttttggcagtttc

SEQ ID NO: 165199 - DNA, 25 bp, Rattus norvegicus
agttcacatgtaaagcctgctggcc

SEQ ID NO: 165200 - DNA, 25 bp, Rattus norvegicus
agttcacatgtatagcctgctggcc

SEQ ID NO: 165201 - DNA, 25 bp, Rattus norvegicus
agttcaccaaaaagcgttcccatct

SEQ ID NO: 165202 - DNA, 25 bp, Rattus norvegicus
agttcaccaaaatgcgttcccatct

SEQ ID NO: 165203 - DNA, 25 bp, Rattus norvegicus
agttcaccacatatccgacaaggaa

SEQ ID NO: 165204 - DNA, 25 bp, Rattus norvegicus
agttcaccacatttccgacaaggaa

SEQ ID NO: 165205 - DNA, 25 bp, Rattus norvegicus
agttcaccagagattctcttcagtc

SEQ ID NO: 165206 - DNA, 25 bp, Rattus norvegicus
agttcaccagagtttctcttcagtc

SEQ ID NO: 165207 - DNA, 25 bp, Rattus norvegicus
agttcaccagcgacattgctatgga

SEQ ID NO: 165208 - DNA, 25 bp, Rattus norvegicus
agttcaccagcgtcattgctatgga

SEQ ID NO: 165209 - DNA, 25 bp, Rattus norvegicus
agttcaccagttatctatgcaccat

SEQ ID NO: 165210 - DNA, 25 bp, Rattus norvegicus
agttcaccagttttctatgcaccat

SEQ ID NO: 165211 - DNA, 25 bp, Rattus norvegicus
agttcaccatagactctgccggcat

SEQ ID NO: 165212 - DNA, 25 bp, Rattus norvegicus
agttcaccatagtctctgccggcat

SEQ ID NO: 165213 - DNA, 25 bp, Rattus norvegicus
agttcacccagcactcatgttgtag

SEQ ID NO: 165214 - DNA, 25 bp, Rattus norvegicus
agttcacccagctctcatgttgtag

SEQ ID NO: 165215 - DNA, 25 bp, Rattus norvegicus
agttcaccgggtcaccagggcagta

SEQ ID NO: 165216 - DNA, 25 bp, Rattus norvegicus
agttcaccgggtgaccagggcagta

SEQ ID NO: 165217 - DNA, 25 bp, Rattus norvegicus
agttcacctaggcatcctcactgga

SEQ ID NO: 165218 - DNA, 25 bp, Rattus norvegicus
agttcacctagggatcctcactgga

SEQ ID NO: 165219 - DNA, 25 bp, Rattus norvegicus
agttcaccttcaatgctgctctgga

SEQ ID NO: 165220 - DNA, 25 bp, Rattus norvegicus
agttcaccttcattgctgctctgga

SEQ ID NO: 165221 - DNA, 25 bp, Rattus norvegicus
agttcaccttgcacattgacattca

SEQ ID NO: 165222 - DNA, 25 bp, Rattus norvegicus
agttcaccttgctcattgacattca

SEQ ID NO: 165223 - DNA, 25 bp, Rattus norvegicus
agttcacgatggactgtgcagcgcc

SEQ ID NO: 165224 - DNA, 25 bp, Rattus norvegicus
agttcacgatggtctgtgcagcgcc

SEQ ID NO: 165225 - DNA, 25 bp, Rattus norvegicus
agttcacgcagtagggagctgtctc

SEQ ID NO: 165226 - DNA, 25 bp, Rattus norvegicus
agttcacgcagttgggagctgtctc

SEQ ID NO: 165227 - DNA, 25 bp, Rattus norvegicus
agttcacgccttcctgggcaggtga

SEQ ID NO: 165228 - DNA, 25 bp, Rattus norvegicus
agttcacgccttgctgggcaggtga

SEQ ID NO: 165229 - DNA, 25 bp, Rattus norvegicus
agttcacgctagcatgacgtcacga

SEQ ID NO: 165230 - DNA, 25 bp, Rattus norvegicus
agttcacgctaggatgacgtcacga

SEQ ID NO: 165231 - DNA, 25 bp, Rattus norvegicus
agttcacgggtgatctggatttcag

SEQ ID NO: 165232 - DNA, 25 bp, Rattus norvegicus
agttcacgggtgttctggatttcag

SEQ ID NO: 165233 - DNA, 25 bp, Rattus norvegicus
agttcactctatccctcaagtcagc

SEQ ID NO: 165234 - DNA, 25 bp, Rattus norvegicus
agttcactctatgcctcaagtcagc

SEQ ID NO: 165235 - DNA, 25 bp, Rattus norvegicus
agttcactgatcagacagccaggcg

SEQ ID NO: 165236 - DNA, 25 bp, Rattus norvegicus
agttcactgatctgacagccaggcg

SEQ ID NO: 165237 - DNA, 25 bp, Rattus norvegicus
agttcactgatgaccagctgcttgt

SEQ ID NO: 165238 - DNA, 25 bp, Rattus norvegicus
agttcactgatgtccagctgcttgt

SEQ ID NO: 165239 - DNA, 25 bp, Rattus norvegicus
agttcactgattactgtgtccagct

SEQ ID NO: 165240 - DNA, 25 bp, Rattus norvegicus
agttcactgatttctgtgtccagct

SEQ ID NO: 165241 - DNA, 25 bp, Rattus norvegicus
agttcactgttgaaaactccacaag

SEQ ID NO: 165242 - DNA, 25 bp, Rattus norvegicus
agttcactgttgtaaactccacaag

SEQ ID NO: 165243 - DNA, 25 bp, Rattus norvegicus
agttcacttcgcataggttagtcct

SEQ ID NO: 165244 - DNA, 25 bp, Rattus norvegicus
agttcacttcgcttaggttagtcct

SEQ ID NO: 165245 - DNA, 25 bp, Rattus norvegicus
agttcacttgatctatccgcaattc

SEQ ID NO: 165246 - DNA, 25 bp, Rattus norvegicus
agttcacttgatgtatccgcaattc

SEQ ID NO: 165247 - DNA, 25 bp, Rattus norvegicus
agttcacttgctctagacacatcca

SEQ ID NO: 165248 - DNA, 25 bp, Rattus norvegicus
agttcacttgctgtagacacatcca

SEQ ID NO: 165249 - DNA, 25 bp, Rattus norvegicus
agttcactttgcacatgatggcctt

SEQ ID NO: 165250 - DNA, 25 bp, Rattus norvegicus
agttcactttgctcatgatggcctt

SEQ ID NO: 165251 - DNA, 25 bp, Rattus norvegicus
agttcactttgtagtgtgcacctgg

SEQ ID NO: 165252 - DNA, 25 bp, Rattus norvegicus
agttcactttgttgtgtgcacctgg

SEQ ID NO: 165253 - DNA, 25 bp, Rattus norvegicus
agttcagaacccaaggaaccagaat

SEQ ID NO: 165254 - DNA, 25 bp, Rattus norvegicus
agttcagaaccctaggaaccagaat

SEQ ID NO: 165255 - DNA, 25 bp, Rattus norvegicus
agttcagaacttagctttgtttcaa

SEQ ID NO: 165256 - DNA, 25 bp, Rattus norvegicus
agttcagaactttgctttgtttcaa

SEQ ID NO: 165257 - DNA, 25 bp, Rattus norvegicus
agttcagaagacaacaacccagcaa

SEQ ID NO: 165258 - DNA, 25 bp, Rattus norvegicus
agttcagaagactacaacccagcaa

SEQ ID NO: 165259 - DNA, 25 bp, Rattus norvegicus
agttcagaagagaacccgtgtctat

SEQ ID NO: 165260 - DNA, 25 bp, Rattus norvegicus
agttcagaagagtacccgtgtctat

SEQ ID NO: 165261 - DNA, 25 bp, Rattus norvegicus
agttcagaatgtcttatggatgcat

SEQ ID NO: 165262 - DNA, 25 bp, Rattus norvegicus
agttcagaatgtgttatggatgcat

SEQ ID NO: 165263 - DNA, 25 bp, Rattus norvegicus
agttcagagaggcaaacgtctcaca

SEQ ID NO: 165264 - DNA, 25 bp, Rattus norvegicus
agttcagagagggaaacgtctcaca

SEQ ID NO: 165265 - DNA, 25 bp, Rattus norvegicus
agttcagagagtcagtcttccttca

SEQ ID NO: 165266 - DNA, 25 bp, Rattus norvegicus
agttcagagagtgagtcttccttca

SEQ ID NO: 165267 - DNA, 25 bp, Rattus norvegicus
agttcagagcacatgtcgctcttac

SEQ ID NO: 165268 - DNA, 25 bp, Rattus norvegicus
agttcagagcacttgtcgctcttac

SEQ ID NO: 165269 - DNA, 25 bp, Rattus norvegicus
agttcagaggcaatcagttccacag

SEQ ID NO: 165270 - DNA, 25 bp, Rattus norvegicus
agttcagaggcattcagttccacag

SEQ ID NO: 165271 - DNA, 25 bp, Rattus norvegicus
agttcagagtcgaagagctctatta

SEQ ID NO: 165272 - DNA, 25 bp, Rattus norvegicus
agttcagagtcgtagagctctatta

SEQ ID NO: 165273 - DNA, 25 bp, Rattus norvegicus
agttcagataacatcgccttaccac

SEQ ID NO: 165274 - DNA, 25 bp, Rattus norvegicus
agttcagataacttcgccttaccac

SEQ ID NO: 165275 - DNA, 25 bp, Rattus norvegicus
agttcagatctaattcgtttgtggt

SEQ ID NO: 165276 - DNA, 25 bp, Rattus norvegicus
agttcagatctatttcgtttgtggt

SEQ ID NO: 165277 - DNA, 25 bp, Rattus norvegicus
agttcagatggtatccacttggccc

SEQ ID NO: 165278 - DNA, 25 bp, Rattus norvegicus
agttcagatggtttccacttggccc

SEQ ID NO: 165279 - DNA, 25 bp, Rattus norvegicus
agttcagattccaggcactggtgta

SEQ ID NO: 165280 - DNA, 25 bp, Rattus norvegicus
agttcagattcctggcactggtgta

SEQ ID NO: 165281 - DNA, 25 bp, Rattus norvegicus
agttcagcactccagttcgcactaa

SEQ ID NO: 165282 - DNA, 25 bp, Rattus norvegicus
agttcagcactcgagttcgcactaa

SEQ ID NO: 165283 - DNA, 25 bp, Rattus norvegicus
agttcagcaggtcaccggccagaaa

SEQ ID NO: 165284 - DNA, 25 bp, Rattus norvegicus
agttcagcaggtgaccggccagaaa

SEQ ID NO: 165285 - DNA, 25 bp, Rattus norvegicus
agttcagcagtgatgtccttatcct

SEQ ID NO: 165286 - DNA, 25 bp, Rattus norvegicus
agttcagcagtgttgtccttatcct

SEQ ID NO: 165287 - DNA, 25 bp, Rattus norvegicus
agttcagcatctctccagaagctca

SEQ ID NO: 165288 - DNA, 25 bp, Rattus norvegicus
agttcagcatctgtccagaagctca

SEQ ID NO: 165289 - DNA, 25 bp, Rattus norvegicus
agttcagccagtacacagacggaca

SEQ ID NO: 165290 - DNA, 25 bp, Rattus norvegicus
agttcagccagttcacagacggaca

SEQ ID NO: 165291 - DNA, 25 bp, Rattus norvegicus
agttcagcctcaatgaccccaaaga

SEQ ID NO: 165292 - DNA, 25 bp, Rattus norvegicus
agttcagcctcattgaccccaaaga

SEQ ID NO: 165293 - DNA, 25 bp, Rattus norvegicus
agttcagcctctacacactgtgggt

SEQ ID NO: 165294 - DNA, 25 bp, Rattus norvegicus
agttcagcctcttcacactgtgggt

SEQ ID NO: 165295 - DNA, 25 bp, Rattus norvegicus
agttcagcgattcctacctcgacag

SEQ ID NO: 165296 - DNA, 25 bp, Rattus norvegicus
agttcagcgattgctacctcgacag

SEQ ID NO: 165297 - DNA, 25 bp, Rattus norvegicus
agttcagcgtggagaagctgcccga

SEQ ID NO: 165298 - DNA, 25 bp, Rattus norvegicus
agttcagcgtggtgaagctgcccga

SEQ ID NO: 165299 - DNA, 25 bp, Rattus norvegicus
agttcagctattatctccttcaaga

SEQ ID NO: 165300 - DNA, 25 bp, Rattus norvegicus
agttcagctattttctccttcaaga

SEQ ID NO: 165301 - DNA, 25 bp, Rattus norvegicus
agttcagctcagcagacttcggcat

SEQ ID NO: 165302 - DNA, 25 bp, Rattus norvegicus
agttcagctcaggagacttcggcat

SEQ ID NO: 165303 - DNA, 25 bp, Rattus norvegicus
agttcagctgagacctgtgtttgag

SEQ ID NO: 165304 - DNA, 25 bp, Rattus norvegicus
agttcagctgagtcctgtgtttgag

SEQ ID NO: 165305 - DNA, 25 bp, Rattus norvegicus
agttcaggagctagtgtacccacag

SEQ ID NO: 165306 - DNA, 25 bp, Rattus norvegicus
agttcaggagctccgttagccttga

SEQ ID NO: 165307 - DNA, 25 bp, Rattus norvegicus
agttcaggagctgcgttagccttga

SEQ ID NO: 165308 - DNA, 25 bp, Rattus norvegicus
agttcaggagcttgtgtacccacag

SEQ ID NO: 165309 - DNA, 25 bp, Rattus norvegicus
agttcaggatacagtcatctgccct

SEQ ID NO: 165310 - DNA, 25 bp, Rattus norvegicus
agttcaggatactgtcatctgccct

SEQ ID NO: 165311 - DNA, 25 bp, Rattus norvegicus
agttcaggcaagaccactgcattgg

SEQ ID NO: 165312 - DNA, 25 bp, Rattus norvegicus
agttcaggcaagtccactgcattgg

SEQ ID NO: 165313 - DNA, 25 bp, Rattus norvegicus
agttcaggcagtccagcacctcaga

SEQ ID NO: 165314 - DNA, 25 bp, Rattus norvegicus
agttcaggcagtgcagcacctcaga

SEQ ID NO: 165315 - DNA, 25 bp, Rattus norvegicus
agttcaggccacatagagaagctta

SEQ ID NO: 165316 - DNA, 25 bp, Rattus norvegicus
agttcaggccacttagagaagctta

SEQ ID NO: 165317 - DNA, 25 bp, Rattus norvegicus
agttcaggccccattaccaaaatgt

SEQ ID NO: 165318 - DNA, 25 bp, Rattus norvegicus
agttcaggcccctttaccaaaatgt

SEQ ID NO: 165319 - DNA, 25 bp, Rattus norvegicus
agttcaggcctcattcaatatgtga

SEQ ID NO: 165320 - DNA, 25 bp, Rattus norvegicus
agttcaggcctctttcaatatgtga

SEQ ID NO: 165321 - DNA, 25 bp, Rattus norvegicus
agttcaggcgtcattggcagcaaac

SEQ ID NO: 165322 - DNA, 25 bp, Rattus norvegicus
agttcaggcgtctttggcagcaaac

SEQ ID NO: 165323 - DNA, 25 bp, Rattus norvegicus
agttcaggctggatgtctgtctgtc

SEQ ID NO: 165324 - DNA, 25 bp, Rattus norvegicus
agttcaggctggttgtctgtctgtc

SEQ ID NO: 165325 - DNA, 25 bp, Rattus norvegicus
agttcagggaaccataccatccagc

SEQ ID NO: 165326 - DNA, 25 bp, Rattus norvegicus
agttcagggaacgataccatccagc

SEQ ID NO: 165327 - DNA, 25 bp, Rattus norvegicus
agttcagggcttcaactcagccttc

SEQ ID NO: 165328 - DNA, 25 bp, Rattus norvegicus
agttcagggcttgaactcagccttc

SEQ ID NO: 165329 - DNA, 25 bp, Rattus norvegicus
agttcaggtcgtcagacttgtgcag

SEQ ID NO: 165330 - DNA, 25 bp, Rattus norvegicus
agttcaggtcgtgagacttgtgcag

SEQ ID NO: 165331 - DNA, 25 bp, Rattus norvegicus
agttcaggttcgctcgccgccatta

SEQ ID NO: 165332 - DNA, 25 bp, Rattus norvegicus
agttcaggttcggtcgccgccatta

SEQ ID NO: 165333 - DNA, 25 bp, Rattus norvegicus
agttcaggttgacttgtgtccttat

SEQ ID NO: 165334 - DNA, 25 bp, Rattus norvegicus
agttcaggttgagttgtgtccttat

SEQ ID NO: 165335 - DNA, 25 bp, Rattus norvegicus
agttcaggttggacagctcttcatc

SEQ ID NO: 165336 - DNA, 25 bp, Rattus norvegicus
agttcaggttggtcagctcttcatc

SEQ ID NO: 165337 - DNA, 25 bp, Rattus norvegicus
agttcaggttgtacgaggacactac

SEQ ID NO: 165338 - DNA, 25 bp, Rattus norvegicus
agttcaggttgttcgaggacactac

SEQ ID NO: 165339 - DNA, 25 bp, Rattus norvegicus
agttcagtatgccattggtcgctct

SEQ ID NO: 165340 - DNA, 25 bp, Rattus norvegicus
agttcagtatgcgattggtcgctct

SEQ ID NO: 165341 - DNA, 25 bp, Rattus norvegicus
agttcagtcaagatacatgtttttc

SEQ ID NO: 165342 - DNA, 25 bp, Rattus norvegicus
agttcagtcaagttacatgtttttc

SEQ ID NO: 165343 - DNA, 25 bp, Rattus norvegicus
agttcagtcagaagatcctcagccg

SEQ ID NO: 165344 - DNA, 25 bp, Rattus norvegicus
agttcagtcagatgatcctcagccg

SEQ ID NO: 165345 - DNA, 25 bp, Rattus norvegicus
agttcagtcagtactacctcaagtt

SEQ ID NO: 165346 - DNA, 25 bp, Rattus norvegicus
agttcagtcagtatgcgccatgtga

SEQ ID NO: 165347 - DNA, 25 bp, Rattus norvegicus
agttcagtcagttctacctcaagtt

SEQ ID NO: 165348 - DNA, 25 bp, Rattus norvegicus
agttcagtcagtttgcgccatgtga

SEQ ID NO: 165349 - DNA, 25 bp, Rattus norvegicus
agttcagtcatcaccatgatgcaga

SEQ ID NO: 165350 - DNA, 25 bp, Rattus norvegicus
agttcagtcatctccatgatgcaga

SEQ ID NO: 165351 - DNA, 25 bp, Rattus norvegicus
agttcagtcatgacacatatctcag

SEQ ID NO: 165352 - DNA, 25 bp, Rattus norvegicus
agttcagtcatgtcacatatctcag

SEQ ID NO: 165353 - DNA, 25 bp, Rattus norvegicus
agttcagtctctccgggatctggca

SEQ ID NO: 165354 - DNA, 25 bp, Rattus norvegicus
agttcagtctctgcgggatctggca

SEQ ID NO: 165355 - DNA, 25 bp, Rattus norvegicus
agttcagtgaagaactccgtgtaac

SEQ ID NO: 165356 - DNA, 25 bp, Rattus norvegicus
agttcagtgaagtactccgtgtaac

SEQ ID NO: 165357 - DNA, 25 bp, Rattus norvegicus
agttcagtgaatacgtcctccgacg

SEQ ID NO: 165358 - DNA, 25 bp, Rattus norvegicus
agttcagtgaattcgtcctccgacg

SEQ ID NO: 165359 - DNA, 25 bp, Rattus norvegicus
agttcagtgcgtcagcatctgtcag

SEQ ID NO: 165360 - DNA, 25 bp, Rattus norvegicus
agttcagtgcgtgagcatctgtcag

SEQ ID NO: 165361 - DNA, 25 bp, Rattus norvegicus
agttcagtggacatctccagtattc

SEQ ID NO: 165362 - DNA, 25 bp, Rattus norvegicus
agttcagtggacttctccagtattc

SEQ ID NO: 165363 - DNA, 25 bp, Rattus norvegicus
agttcagttagacttccactttcgt

SEQ ID NO: 165364 - DNA, 25 bp, Rattus norvegicus
agttcagttagagttccactttcgt

SEQ ID NO: 165365 - DNA, 25 bp, Rattus norvegicus
agttcagttccacattgggcctcag

SEQ ID NO: 165366 - DNA, 25 bp, Rattus norvegicus
agttcagttccagattgggcctcag

SEQ ID NO: 165367 - DNA, 25 bp, Rattus norvegicus
agttcagttctgaccatgtagcctt

SEQ ID NO: 165368 - DNA, 25 bp, Rattus norvegicus
agttcagttctgtccatgtagcctt

SEQ ID NO: 165369 - DNA, 25 bp, Rattus norvegicus
agttcagttgttcttggcccagcca

SEQ ID NO: 165370 - DNA, 25 bp, Rattus norvegicus
agttcagttgttgttggcccagcca

SEQ ID NO: 165371 - DNA, 25 bp, Rattus norvegicus
agttcagtttgacagcctgtttccc

SEQ ID NO: 165372 - DNA, 25 bp, Rattus norvegicus
agttcagtttgagagcctgtttccc

SEQ ID NO: 165373 - DNA, 25 bp, Rattus norvegicus
agttcataacatcccagagtcgctc

SEQ ID NO: 165374 - DNA, 25 bp, Rattus norvegicus
agttcataacatgccagagtcgctc

SEQ ID NO: 165375 - DNA, 25 bp, Rattus norvegicus
agttcataagtgacctgaggtccag

SEQ ID NO: 165376 - DNA, 25 bp, Rattus norvegicus
agttcataagtgtcctgaggtccag

SEQ ID NO: 165377 - DNA, 25 bp, Rattus norvegicus
agttcataccatcttcaaccctttt

SEQ ID NO: 165378 - DNA, 25 bp, Rattus norvegicus
agttcataccatgttcaaccctttt

SEQ ID NO: 165379 - DNA, 25 bp, Rattus norvegicus
agttcatagctaacttccgttacat

SEQ ID NO: 165380 - DNA, 25 bp, Rattus norvegicus
agttcatagctatcttccgttacat

SEQ ID NO: 165381 - DNA, 25 bp, Rattus norvegicus
agttcatatatcatcttctgcttcc

SEQ ID NO: 165382 - DNA, 25 bp, Rattus norvegicus
agttcatatatcttcttctgcttcc

SEQ ID NO: 165383 - DNA, 25 bp, Rattus norvegicus
agttcatatcccagtgtcccttgta

SEQ ID NO: 165384 - DNA, 25 bp, Rattus norvegicus
agttcatatccctgtgtcccttgta

SEQ ID NO: 165385 - DNA, 25 bp, Rattus norvegicus
agttcatcaatcactctcttgggag

SEQ ID NO: 165386 - DNA, 25 bp, Rattus norvegicus
agttcatcaatctctctcttgggag

SEQ ID NO: 165387 - DNA, 25 bp, Rattus norvegicus
agttcatcaccgcagtatcttccta

SEQ ID NO: 165388 - DNA, 25 bp, Rattus norvegicus
agttcatcaccggagtatcttccta

SEQ ID NO: 165389 - DNA, 25 bp, Rattus norvegicus
agttcatcactcagcctgtgtcttg

SEQ ID NO: 165390 - DNA, 25 bp, Rattus norvegicus
agttcatcactctgcctgtgtcttg

SEQ ID NO: 165391 - DNA, 25 bp, Rattus norvegicus
agttcatcacttctccaaaagggaa

SEQ ID NO: 165392 - DNA, 25 bp, Rattus norvegicus
agttcatcacttgtccaaaagggaa

SEQ ID NO: 165393 - DNA, 25 bp, Rattus norvegicus
agttcatcagacagcttactgccat

SEQ ID NO: 165394 - DNA, 25 bp, Rattus norvegicus
agttcatcagactgcttactgccat

SEQ ID NO: 165395 - DNA, 25 bp, Rattus norvegicus
agttcatcagcaaccgcttcccgta

SEQ ID NO: 165396 - DNA, 25 bp, Rattus norvegicus
agttcatcagcatccgcttcccgta

SEQ ID NO: 165397 - DNA, 25 bp, Rattus norvegicus
agttcatcaggcatactggcagatc

SEQ ID NO: 165398 - DNA, 25 bp, Rattus norvegicus
agttcatcaggcttactggcagatc

SEQ ID NO: 165399 - DNA, 25 bp, Rattus norvegicus
agttcatcatggaccgttttccctt

SEQ ID NO: 165400 - DNA, 25 bp, Rattus norvegicus
agttcatcatggtccgttttccctt

SEQ ID NO: 165401 - DNA, 25 bp, Rattus norvegicus
agttcatccagcattccacaaagtt

SEQ ID NO: 165402 - DNA, 25 bp, Rattus norvegicus
agttcatccagctttccacaaagtt

SEQ ID NO: 165403 - DNA, 25 bp, Rattus norvegicus
agttcatccctgctgtcatcagagc

SEQ ID NO: 165404 - DNA, 25 bp, Rattus norvegicus
agttcatccctggtgtcatcagagc

SEQ ID NO: 165405 - DNA, 25 bp, Rattus norvegicus
agttcatcctcgaaatgcttccaat

SEQ ID NO: 165406 - DNA, 25 bp, Rattus norvegicus
agttcatcctcgtaatgcttccaat

SEQ ID NO: 165407 - DNA, 25 bp, Rattus norvegicus
agttcatcgactcactgcctgagaa

SEQ ID NO: 165408 - DNA, 25 bp, Rattus norvegicus
agttcatcgactgactgcctgagaa

SEQ ID NO: 165409 - DNA, 25 bp, Rattus norvegicus
agttcatcggctaatttggctccta

SEQ ID NO: 165410 - DNA, 25 bp, Rattus norvegicus
agttcatcggcttatttggctccta

SEQ ID NO: 165411 - DNA, 25 bp, Rattus norvegicus
agttcatcgtggctgtctctgtata

SEQ ID NO: 165412 - DNA, 25 bp, Rattus norvegicus
agttcatcgtgggtgtctctgtata

SEQ ID NO: 165413 - DNA, 25 bp, Rattus norvegicus
agttcatctaacacatcatcccaga

SEQ ID NO: 165414 - DNA, 25 bp, Rattus norvegicus
agttcatctaactcatcatcccaga

SEQ ID NO: 165415 - DNA, 25 bp, Rattus norvegicus
agttcatctaccacacagtgcaggg

SEQ ID NO: 165416 - DNA, 25 bp, Rattus norvegicus
agttcatctacctcacagtgcaggg

SEQ ID NO: 165417 - DNA, 25 bp, Rattus norvegicus
agttcatctcatacgtcttctgcag

SEQ ID NO: 165418 - DNA, 25 bp, Rattus norvegicus
agttcatctcattcgtcttctgcag

SEQ ID NO: 165419 - DNA, 25 bp, Rattus norvegicus
agttcatctctgaagttttctatta

SEQ ID NO: 165420 - DNA, 25 bp, Rattus norvegicus
agttcatctctgtagttttctatta

SEQ ID NO: 165421 - DNA, 25 bp, Rattus norvegicus
agttcatctgagcaccacgactatg

SEQ ID NO: 165422 - DNA, 25 bp, Rattus norvegicus
agttcatctgaggaccacgactatg

SEQ ID NO: 165423 - DNA, 25 bp, Rattus norvegicus
agttcatctgcacccatcagagttt

SEQ ID NO: 165424 - DNA, 25 bp, Rattus norvegicus
agttcatctgcagccatcagagttt

SEQ ID NO: 165425 - DNA, 25 bp, Rattus norvegicus
agttcatctgggattctgctgtgga

SEQ ID NO: 165426 - DNA, 25 bp, Rattus norvegicus
agttcatctgggtttctgctgtgga

SEQ ID NO: 165427 - DNA, 25 bp, Rattus norvegicus
agttcatcttccatcggctgaatgt

SEQ ID NO: 165428 - DNA, 25 bp, Rattus norvegicus
agttcatcttccctggaatccagtt

SEQ ID NO: 165429 - DNA, 25 bp, Rattus norvegicus
agttcatcttccgtggaatccagtt

SEQ ID NO: 165430 - DNA, 25 bp, Rattus norvegicus
agttcatcttccttcggctgaatgt

SEQ ID NO: 165431 - DNA, 25 bp, Rattus norvegicus
agttcatcttgtactagcactttcc

SEQ ID NO: 165432 - DNA, 25 bp, Rattus norvegicus
agttcatcttgtcgcgacgattccg

SEQ ID NO: 165433 - DNA, 25 bp, Rattus norvegicus
agttcatcttgtggcgacgattccg

SEQ ID NO: 165434 - DNA, 25 bp, Rattus norvegicus
agttcatcttgttctagcactttcc

SEQ ID NO: 165435 - DNA, 25 bp, Rattus norvegicus
agttcatctttgagactcttacctc

SEQ ID NO: 165436 - DNA, 25 bp, Rattus norvegicus
agttcatctttgtgactcttacctc

SEQ ID NO: 165437 - DNA, 25 bp, Rattus norvegicus
agttcatgaatccacctctagagga

SEQ ID NO: 165438 - DNA, 25 bp, Rattus norvegicus
agttcatgaatcgacctctagagga

SEQ ID NO: 165439 - DNA, 25 bp, Rattus norvegicus
agttcatgagtgaatcagcccttct

SEQ ID NO: 165440 - DNA, 25 bp, Rattus norvegicus
agttcatgagtgtatcagcccttct

SEQ ID NO: 165441 - DNA, 25 bp, Rattus norvegicus
agttcatgctatctgtgagaagtca

SEQ ID NO: 165442 - DNA, 25 bp, Rattus norvegicus
agttcatgctatgtgtgagaagtca

SEQ ID NO: 165443 - DNA, 25 bp, Rattus norvegicus
agttcatgtagtacaggtggttgta

SEQ ID NO: 165444 - DNA, 25 bp, Rattus norvegicus
agttcatgtagttcaggtggttgta

SEQ ID NO: 165445 - DNA, 25 bp, Rattus norvegicus
agttcatgtctcaggacccagacga

SEQ ID NO: 165446 - DNA, 25 bp, Rattus norvegicus
agttcatgtctctggacccagacga

SEQ ID NO: 165447 - DNA, 25 bp, Rattus norvegicus
agttcatgttccacagcaagcctga

SEQ ID NO: 165448 - DNA, 25 bp, Rattus norvegicus
agttcatgttcccagggcctaggaa

SEQ ID NO: 165449 - DNA, 25 bp, Rattus norvegicus
agttcatgttccgagggcctaggaa

SEQ ID NO: 165450 - DNA, 25 bp, Rattus norvegicus
agttcatgttcctcagcaagcctga

SEQ ID NO: 165451 - DNA, 25 bp, Rattus norvegicus
agttcattatccaatggtgccctcg

SEQ ID NO: 165452 - DNA, 25 bp, Rattus norvegicus
agttcattatcctatggtgccctcg

SEQ ID NO: 165453 - DNA, 25 bp, Rattus norvegicus
agttcattctcaatttttccttaat

SEQ ID NO: 165454 - DNA, 25 bp, Rattus norvegicus
agttcattctcattttttccttaat

SEQ ID NO: 165455 - DNA, 25 bp, Rattus norvegicus
agttcattgtccctgatgattaaga

SEQ ID NO: 165456 - DNA, 25 bp, Rattus norvegicus
agttcattgtccgtgatgattaaga

SEQ ID NO: 165457 - DNA, 25 bp, Rattus norvegicus
agttcatttattcagcatgattgtg

SEQ ID NO: 165458 - DNA, 25 bp, Rattus norvegicus
agttcatttattgagcatgattgtg

SEQ ID NO: 165459 - DNA, 25 bp, Rattus norvegicus
agttcatttgacagccctgatatgc

SEQ ID NO: 165460 - DNA, 25 bp, Rattus norvegicus
agttcatttgactgccctgatatgc

SEQ ID NO: 165461 - DNA, 25 bp, Rattus norvegicus
agttcattttgacttggccatctac

SEQ ID NO: 165462 - DNA, 25 bp, Rattus norvegicus
agttcattttgagttggccatctac

SEQ ID NO: 165463 - DNA, 25 bp, Rattus norvegicus
agttcatttttacttcctctgcctc

SEQ ID NO: 165464 - DNA, 25 bp, Rattus norvegicus
agttcatttttagttcctctgcctc

SEQ ID NO: 165465 - DNA, 25 bp, Rattus norvegicus
agttcatttttcagtagcccatgga

SEQ ID NO: 165466 - DNA, 25 bp, Rattus norvegicus
agttcatttttctgtagcccatgga

SEQ ID NO: 165467 - DNA, 25 bp, Rattus norvegicus
agttccaaccataaagatccacacc

SEQ ID NO: 165468 - DNA, 25 bp, Rattus norvegicus
agttccaaccattaagatccacacc

SEQ ID NO: 165469 - DNA, 25 bp, Rattus norvegicus
agttccaacttgatgccttaagccg

SEQ ID NO: 165470 - DNA, 25 bp, Rattus norvegicus
agttccaacttgttgccttaagccg

SEQ ID NO: 165471 - DNA, 25 bp, Rattus norvegicus
agttccaagcaccttccatgaagca

SEQ ID NO: 165472 - DNA, 25 bp, Rattus norvegicus
agttccaagcacgttccatgaagca

SEQ ID NO: 165473 - DNA, 25 bp, Rattus norvegicus
agttccaagcgcctaaagtttcaag

SEQ ID NO: 165474 - DNA, 25 bp, Rattus norvegicus
agttccaagcgcgtaaagtttcaag

SEQ ID NO: 165475 - DNA, 25 bp, Rattus norvegicus
agttccaaggcgaccatcacattct

SEQ ID NO: 165476 - DNA, 25 bp, Rattus norvegicus
agttccaaggcgtccatcacattct

SEQ ID NO: 165477 - DNA, 25 bp, Rattus norvegicus
agttccaatggtactgatgtcctct

SEQ ID NO: 165478 - DNA, 25 bp, Rattus norvegicus
agttccaatggttctgatgtcctct

SEQ ID NO: 165479 - DNA, 25 bp, Rattus norvegicus
agttccacaacgcagttggccgcga

SEQ ID NO: 165480 - DNA, 25 bp, Rattus norvegicus
agttccacaacggagttggccgcga

SEQ ID NO: 165481 - DNA, 25 bp, Rattus norvegicus
agttccacatctcacttgggtgttg

SEQ ID NO: 165482 - DNA, 25 bp, Rattus norvegicus
agttccacatctgacttgggtgttg

SEQ ID NO: 165483 - DNA, 25 bp, Rattus norvegicus
agttccacatttctagccgggtttg

SEQ ID NO: 165484 - DNA, 25 bp, Rattus norvegicus
agttccacatttgtagccgggtttg

SEQ ID NO: 165485 - DNA, 25 bp, Rattus norvegicus
agttccaccaatacacagcagtgcc

SEQ ID NO: 165486 - DNA, 25 bp, Rattus norvegicus
agttccaccaattcacagcagtgcc

SEQ ID NO: 165487 - DNA, 25 bp, Rattus norvegicus
agttccacgagaccttcgcagagat

SEQ ID NO: 165488 - DNA, 25 bp, Rattus norvegicus
agttccacgagagcttcgcagagat

SEQ ID NO: 165489 - DNA, 25 bp, Rattus norvegicus
agttccacggccataagaatcacca

SEQ ID NO: 165490 - DNA, 25 bp, Rattus norvegicus
agttccacggccttaagaatcacca

SEQ ID NO: 165491 - DNA, 25 bp, Rattus norvegicus
agttccactaccaatgattgcgcac

SEQ ID NO: 165492 - DNA, 25 bp, Rattus norvegicus
agttccactacctatgattgcgcac

SEQ ID NO: 165493 - DNA, 25 bp, Rattus norvegicus
agttccactgctcttctgacagatc

SEQ ID NO: 165494 - DNA, 25 bp, Rattus norvegicus
agttccactgctgttctgacagatc

SEQ ID NO: 165495 - DNA, 25 bp, Rattus norvegicus
agttccacttcaaccgctacctgtg

SEQ ID NO: 165496 - DNA, 25 bp, Rattus norvegicus
agttccacttcatccgctacctgtg

SEQ ID NO: 165497 - DNA, 25 bp, Rattus norvegicus
agttccagaacaatctctcccttct

SEQ ID NO: 165498 - DNA, 25 bp, Rattus norvegicus
agttccagaacattctctcccttct

SEQ ID NO: 165499 - DNA, 25 bp, Rattus norvegicus
agttccagagatcctacaccttttg

SEQ ID NO: 165500 - DNA, 25 bp, Rattus norvegicus
agttccagagatgctacaccttttg

SEQ ID NO: 165501 - DNA, 25 bp, Rattus norvegicus
agttccagcaacacagcatgtacct

SEQ ID NO: 165502 - DNA, 25 bp, Rattus norvegicus
agttccagcaactcagcatgtacct

SEQ ID NO: 165503 - DNA, 25 bp, Rattus norvegicus
agttccagcaagagttcatcccaga

SEQ ID NO: 165504 - DNA, 25 bp, Rattus norvegicus
agttccagcaagtgttcatcccaga

SEQ ID NO: 165505 - DNA, 25 bp, Rattus norvegicus
agttccagccccaggatagtgcaaa

SEQ ID NO: 165506 - DNA, 25 bp, Rattus norvegicus
agttccagcccctggatagtgcaaa

SEQ ID NO: 165507 - DNA, 25 bp, Rattus norvegicus
agttccagccctagatggttttgaa

SEQ ID NO: 165508 - DNA, 25 bp, Rattus norvegicus
agttccagcccttgatggttttgaa

SEQ ID NO: 165509 - DNA, 25 bp, Rattus norvegicus
agttccagcctgcacctgcttggga

SEQ ID NO: 165510 - DNA, 25 bp, Rattus norvegicus
agttccagcctggacctgcttggga

SEQ ID NO: 165511 - DNA, 25 bp, Rattus norvegicus
agttccagccttctcttgggatgtc

SEQ ID NO: 165512 - DNA, 25 bp, Rattus norvegicus
agttccagccttgtcttgggatgtc

SEQ ID NO: 165513 - DNA, 25 bp, Rattus norvegicus
agttccagctaacggcactaatgca

SEQ ID NO: 165514 - DNA, 25 bp, Rattus norvegicus
agttccagctaagggcactaatgca

SEQ ID NO: 165515 - DNA, 25 bp, Rattus norvegicus
agttccaggaggacttggcaattct

SEQ ID NO: 165516 - DNA, 25 bp, Rattus norvegicus
agttccaggaggcttctctgagcct

SEQ ID NO: 165517 - DNA, 25 bp, Rattus norvegicus
agttccaggagggttctctgagcct

SEQ ID NO: 165518 - DNA, 25 bp, Rattus norvegicus
agttccaggaggtcttggcaattct

SEQ ID NO: 165519 - DNA, 25 bp, Rattus norvegicus
agttccaggatcctccatggatggg

SEQ ID NO: 165520 - DNA, 25 bp, Rattus norvegicus
agttccaggatcgtccatggatggg

SEQ ID NO: 165521 - DNA, 25 bp, Rattus norvegicus
agttccaggatgaccagtgttctct

SEQ ID NO: 165522 - DNA, 25 bp, Rattus norvegicus
agttccaggatgtccagtgttctct

SEQ ID NO: 165523 - DNA, 25 bp, Rattus norvegicus
agttccaggcatctagggtcgctag

SEQ ID NO: 165524 - DNA, 25 bp, Rattus norvegicus
agttccaggcatgtagggtcgctag

SEQ ID NO: 165525 - DNA, 25 bp, Rattus norvegicus
agttccagggcaccctgtctacaga

SEQ ID NO: 165526 - DNA, 25 bp, Rattus norvegicus
agttccagggcagcctgtctacaga

SEQ ID NO: 165527 - DNA, 25 bp, Rattus norvegicus
agttccagggctagcagtttgtccc

SEQ ID NO: 165528 - DNA, 25 bp, Rattus norvegicus
agttccagggcttgcagtttgtccc

SEQ ID NO: 165529 - DNA, 25 bp, Rattus norvegicus
agttccagggtactcattgcccttt

SEQ ID NO: 165530 - DNA, 25 bp, Rattus norvegicus
agttccagggtagtcattgcccttt

SEQ ID NO: 165531 - DNA, 25 bp, Rattus norvegicus
agttccaggtcgcagactcggctac

SEQ ID NO: 165532 - DNA, 25 bp, Rattus norvegicus
agttccaggtcggagactcggctac

SEQ ID NO: 165533 - DNA, 25 bp, Rattus norvegicus
agttccagtcctaatgcttaatgat

SEQ ID NO: 165534 - DNA, 25 bp, Rattus norvegicus
agttccagtccttatgcttaatgat

SEQ ID NO: 165535 - DNA, 25 bp, Rattus norvegicus
agttccagtctcaatattcaccaga

SEQ ID NO: 165536 - DNA, 25 bp, Rattus norvegicus
agttccagtctcaatgccataatca

SEQ ID NO: 165537 - DNA, 25 bp, Rattus norvegicus
agttccagtctctatattcaccaga

SEQ ID NO: 165538 - DNA, 25 bp, Rattus norvegicus
agttccagtctctatgccataatca

SEQ ID NO: 165539 - DNA, 25 bp, Rattus norvegicus
agttccagtgacaactccagtgatt

SEQ ID NO: 165540 - DNA, 25 bp, Rattus norvegicus
agttccagtgactactccagtgatt

SEQ ID NO: 165541 - DNA, 25 bp, Rattus norvegicus
agttccatccacaccattcaaagat

SEQ ID NO: 165542 - DNA, 25 bp, Rattus norvegicus
agttccatccactccattcaaagat

SEQ ID NO: 165543 - DNA, 25 bp, Rattus norvegicus
agttccatccttagactgcaaatga

SEQ ID NO: 165544 - DNA, 25 bp, Rattus norvegicus
agttccatcctttgactgcaaatga

SEQ ID NO: 165545 - DNA, 25 bp, Rattus norvegicus
agttccatctcaagtttttccacag

SEQ ID NO: 165546 - DNA, 25 bp, Rattus norvegicus
agttccatctcatgtttttccacag

SEQ ID NO: 165547 - DNA, 25 bp, Rattus norvegicus
agttccatgggaaccaacaccacct

SEQ ID NO: 165548 - DNA, 25 bp, Rattus norvegicus
agttccatgggatccaacaccacct

SEQ ID NO: 165549 - DNA, 25 bp, Rattus norvegicus
agttccatggtactcaacacttaat

SEQ ID NO: 165550 - DNA, 25 bp, Rattus norvegicus
agttccatggtagtcaacacttaat

SEQ ID NO: 165551 - DNA, 25 bp, Rattus norvegicus
agttccatgtagcacagcagcacat

SEQ ID NO: 165552 - DNA, 25 bp, Rattus norvegicus
agttccatgtaggacagcagcacat

SEQ ID NO: 165553 - DNA, 25 bp, Rattus norvegicus
agttccatgtttagaagctcccttc

SEQ ID NO: 165554 - DNA, 25 bp, Rattus norvegicus
agttccatgttttgaagctcccttc

SEQ ID NO: 165555 - DNA, 25 bp, Rattus norvegicus
agttccattagtcgctgtcctctca

SEQ ID NO: 165556 - DNA, 25 bp, Rattus norvegicus
agttccattagtggctgtcctctca

SEQ ID NO: 165557 - DNA, 25 bp, Rattus norvegicus
agttccattcatccctggtgaggtg

SEQ ID NO: 165558 - DNA, 25 bp, Rattus norvegicus
agttccattcatgcctggtgaggtg

SEQ ID NO: 165559 - DNA, 25 bp, Rattus norvegicus
agttccattgtccagacggccaatt

SEQ ID NO: 165560 - DNA, 25 bp, Rattus norvegicus
agttccattgtcgagacggccaatt

SEQ ID NO: 165561 - DNA, 25 bp, Rattus norvegicus
agttccatttttcttgaggcctcca

SEQ ID NO: 165562 - DNA, 25 bp, Rattus norvegicus
agttccatttttgttgaggcctcca

SEQ ID NO: 165563 - DNA, 25 bp, Rattus norvegicus
agttcccaagacctccttgagaatt

SEQ ID NO: 165564 - DNA, 25 bp, Rattus norvegicus
agttcccaagacgtccttgagaatt

SEQ ID NO: 165565 - DNA, 25 bp, Rattus norvegicus
agttcccaagtaccttgactcctgg

SEQ ID NO: 165566 - DNA, 25 bp, Rattus norvegicus
agttcccaagtagcttgactcctgg

SEQ ID NO: 165567 - DNA, 25 bp, Rattus norvegicus
agttcccacaagctgtatagcccct

SEQ ID NO: 165568 - DNA, 25 bp, Rattus norvegicus
agttcccacaaggtgtatagcccct

SEQ ID NO: 165569 - DNA, 25 bp, Rattus norvegicus
agttcccacgacacacagactataa

SEQ ID NO: 165570 - DNA, 25 bp, Rattus norvegicus
agttcccacgactcacagactataa

SEQ ID NO: 165571 - DNA, 25 bp, Rattus norvegicus
agttcccactggatgtatttgctgt

SEQ ID NO: 165572 - DNA, 25 bp, Rattus norvegicus
agttcccactggttgtatttgctgt

SEQ ID NO: 165573 - DNA, 25 bp, Rattus norvegicus
agttcccactgtcacgtgttcttga

SEQ ID NO: 165574 - DNA, 25 bp, Rattus norvegicus
agttcccactgtgacgtgttcttga

SEQ ID NO: 165575 - DNA, 25 bp, Rattus norvegicus
agttcccagcagacgcttcagaagc

SEQ ID NO: 165576 - DNA, 25 bp, Rattus norvegicus
agttcccagcagtcgcttcagaagc

SEQ ID NO: 165577 - DNA, 25 bp, Rattus norvegicus
agttcccagcatccactgcggcggg

SEQ ID NO: 165578 - DNA, 25 bp, Rattus norvegicus
agttcccagcatgcactgcggcggg

SEQ ID NO: 165579 - DNA, 25 bp, Rattus norvegicus
agttcccagtacacattgtctctaa

SEQ ID NO: 165580 - DNA, 25 bp, Rattus norvegicus
agttcccagtactcattgtctctaa

SEQ ID NO: 165581 - DNA, 25 bp, Rattus norvegicus
agttcccatggaactgaggcgctca

SEQ ID NO: 165582 - DNA, 25 bp, Rattus norvegicus
agttcccatggatctgaggcgctca

SEQ ID NO: 165583 - DNA, 25 bp, Rattus norvegicus
agttcccattctatggtctgaaact

SEQ ID NO: 165584 - DNA, 25 bp, Rattus norvegicus
agttcccattctttggtctgaaact

SEQ ID NO: 165585 - DNA, 25 bp, Rattus norvegicus
agttcccattggcacaacttacctt

SEQ ID NO: 165586 - DNA, 25 bp, Rattus norvegicus
agttcccattgggacaacttacctt

SEQ ID NO: 165587 - DNA, 25 bp, Rattus norvegicus
agttcccatttaccctagcagtttt

SEQ ID NO: 165588 - DNA, 25 bp, Rattus norvegicus
agttcccatttagcctagcagtttt

SEQ ID NO: 165589 - DNA, 25 bp, Rattus norvegicus
agttcccatttgaatgtcctcgaga

SEQ ID NO: 165590 - DNA, 25 bp, Rattus norvegicus
agttcccatttgtatgtcctcgaga

SEQ ID NO: 165591 - DNA, 25 bp, Rattus norvegicus
agttccccaccaccatggttacagt

SEQ ID NO: 165592 - DNA, 25 bp, Rattus norvegicus
agttccccaccagcatggttacagt

SEQ ID NO: 165593 - DNA, 25 bp, Rattus norvegicus
agttccccacggatttgctgaggag

SEQ ID NO: 165594 - DNA, 25 bp, Rattus norvegicus
agttccccacggttttgctgaggag

SEQ ID NO: 165595 - DNA, 25 bp, Rattus norvegicus
agttccccactgacatatccaggaa

SEQ ID NO: 165596 - DNA, 25 bp, Rattus norvegicus
agttccccactgtcatatccaggaa

SEQ ID NO: 165597 - DNA, 25 bp, Rattus norvegicus
agttccccaggaagacttggctcaa

SEQ ID NO: 165598 - DNA, 25 bp, Rattus norvegicus
agttccccaggatgacttggctcaa

SEQ ID NO: 165599 - DNA, 25 bp, Rattus norvegicus
agttccccaggccaagcaggttagg

SEQ ID NO: 165600 - DNA, 25 bp, Rattus norvegicus
agttccccaggcgaagcaggttagg

SEQ ID NO: 165601 - DNA, 25 bp, Rattus norvegicus
agttccccagttctggcagattctg

SEQ ID NO: 165602 - DNA, 25 bp, Rattus norvegicus
agttccccagttgtggcagattctg

SEQ ID NO: 165603 - DNA, 25 bp, Rattus norvegicus
agttcccctaggacttgtaactcag

SEQ ID NO: 165604 - DNA, 25 bp, Rattus norvegicus
agttcccctaggtcttgtaactcag

SEQ ID NO: 165605 - DNA, 25 bp, Rattus norvegicus
agttcccctggaatgacgtggacgc

SEQ ID NO: 165606 - DNA, 25 bp, Rattus norvegicus
agttcccctggattgacgtggacgc

SEQ ID NO: 165607 - DNA, 25 bp, Rattus norvegicus
agttcccctggcaataacaacggca

SEQ ID NO: 165608 - DNA, 25 bp, Rattus norvegicus
agttcccctggctataacaacggca

SEQ ID NO: 165609 - DNA, 25 bp, Rattus norvegicus
agttcccctgggaatgtagctgtct

SEQ ID NO: 165610 - DNA, 25 bp, Rattus norvegicus
agttcccctgggattctgaatatac

SEQ ID NO: 165611 - DNA, 25 bp, Rattus norvegicus
agttcccctgggtatgtagctgtct

SEQ ID NO: 165612 - DNA, 25 bp, Rattus norvegicus
agttcccctgggtttctgaatatac

SEQ ID NO: 165613 - DNA, 25 bp, Rattus norvegicus
agttcccgaaccacagaacggctcg

SEQ ID NO: 165614 - DNA, 25 bp, Rattus norvegicus
agttcccgaacctcagaacggctcg

SEQ ID NO: 165615 - DNA, 25 bp, Rattus norvegicus
agttcccgagacatggcgtcagaga

SEQ ID NO: 165616 - DNA, 25 bp, Rattus norvegicus
agttcccgagacttggcgtcagaga

SEQ ID NO: 165617 - DNA, 25 bp, Rattus norvegicus
agttcccgctcacttgcactacaaa

SEQ ID NO: 165618 - DNA, 25 bp, Rattus norvegicus
agttcccgctcagttgcactacaaa

SEQ ID NO: 165619 - DNA, 25 bp, Rattus norvegicus
agttcccgtatcattctgtgcatga

SEQ ID NO: 165620 - DNA, 25 bp, Rattus norvegicus
agttcccgtatctttctgtgcatga

SEQ ID NO: 165621 - DNA, 25 bp, Rattus norvegicus
agttcccgtgccaatgccattgaga

SEQ ID NO: 165622 - DNA, 25 bp, Rattus norvegicus
agttcccgtgcctatgccattgaga

SEQ ID NO: 165623 - DNA, 25 bp, Rattus norvegicus
agttccctaaacactgctagctcgg

SEQ ID NO: 165624 - DNA, 25 bp, Rattus norvegicus
agttccctaaactctgctagctcgg

SEQ ID NO: 165625 - DNA, 25 bp, Rattus norvegicus
agttccctaacaccctgtgagacag

SEQ ID NO: 165626 - DNA, 25 bp, Rattus norvegicus
agttccctaacagcctgtgagacag

SEQ ID NO: 165627 - DNA, 25 bp, Rattus norvegicus
agttccctaaggcaattcggacaga

SEQ ID NO: 165628 - DNA, 25 bp, Rattus norvegicus
agttccctaagggaattcggacaga

SEQ ID NO: 165629 - DNA, 25 bp, Rattus norvegicus
agttccctaggtccaggctgatcag

SEQ ID NO: 165630 - DNA, 25 bp, Rattus norvegicus
agttccctaggtgcaggctgatcag

SEQ ID NO: 165631 - DNA, 25 bp, Rattus norvegicus
agttccctcccacgacatgatgagt

SEQ ID NO: 165632 - DNA, 25 bp, Rattus norvegicus
agttccctcccaggacatgatgagt

SEQ ID NO: 165633 - DNA, 25 bp, Rattus norvegicus
agttccctctcaatgtcttatatta

SEQ ID NO: 165634 - DNA, 25 bp, Rattus norvegicus
agttccctctcattgtcttatatta

SEQ ID NO: 165635 - DNA, 25 bp, Rattus norvegicus
agttccctcttcaggacagagccaa

SEQ ID NO: 165636 - DNA, 25 bp, Rattus norvegicus
agttccctcttctggacagagccaa

SEQ ID NO: 165637 - DNA, 25 bp, Rattus norvegicus
agttccctgaccactacatacatgt

SEQ ID NO: 165638 - DNA, 25 bp, Rattus norvegicus
agttccctgacctctacatacatgt

SEQ ID NO: 165639 - DNA, 25 bp, Rattus norvegicus
agttccctgaggatggcagtgcacc

SEQ ID NO: 165640 - DNA, 25 bp, Rattus norvegicus
agttccctgaggttggcagtgcacc

SEQ ID NO: 165641 - DNA, 25 bp, Rattus norvegicus
agttccctgatcagcgggcgataca

SEQ ID NO: 165642 - DNA, 25 bp, Rattus norvegicus
agttccctgatctgcgggcgataca

SEQ ID NO: 165643 - DNA, 25 bp, Rattus norvegicus
agttccctgctcactggcaataaag

SEQ ID NO: 165644 - DNA, 25 bp, Rattus norvegicus
agttccctgctctctggcaataaag

SEQ ID NO: 165645 - DNA, 25 bp, Rattus norvegicus
agttccctggctacaaggaggtgcg

SEQ ID NO: 165646 - DNA, 25 bp, Rattus norvegicus
agttccctggcttcaaggaggtgcg

SEQ ID NO: 165647 - DNA, 25 bp, Rattus norvegicus
agttccctgttcactgcatttagaa

SEQ ID NO: 165648 - DNA, 25 bp, Rattus norvegicus
agttccctgttctctgcatttagaa

SEQ ID NO: 165649 - DNA, 25 bp, Rattus norvegicus
agttcccttcaacccagatgtgaca

SEQ ID NO: 165650 - DNA, 25 bp, Rattus norvegicus
agttcccttcaagccagatgtgaca

SEQ ID NO: 165651 - DNA, 25 bp, Rattus norvegicus
agttccgaaaagcagttacagacct

SEQ ID NO: 165652 - DNA, 25 bp, Rattus norvegicus
agttccgaaaaggagttacagacct

SEQ ID NO: 165653 - DNA, 25 bp, Rattus norvegicus
agttccgactggagatcttacagct

SEQ ID NO: 165654 - DNA, 25 bp, Rattus norvegicus
agttccgactggtgatcttacagct

SEQ ID NO: 165655 - DNA, 25 bp, Rattus norvegicus
agttccgagcccatggtgtagtaga

SEQ ID NO: 165656 - DNA, 25 bp, Rattus norvegicus
agttccgagcccttggtgtagtaga

SEQ ID NO: 165657 - DNA, 25 bp, Rattus norvegicus
agttccgcgcggatgctctgaagac

SEQ ID NO: 165658 - DNA, 25 bp, Rattus norvegicus
agttccgcgcggttgctctgaagac

SEQ ID NO: 165659 - DNA, 25 bp, Rattus norvegicus
agttccgcgtcaacctgatagttaa

SEQ ID NO: 165660 - DNA, 25 bp, Rattus norvegicus
agttccgcgtcatcctgatagttaa

SEQ ID NO: 165661 - DNA, 25 bp, Rattus norvegicus
agttccgcgtctcagagcagccagg

SEQ ID NO: 165662 - DNA, 25 bp, Rattus norvegicus
agttccgcgtctgagagcagccagg

SEQ ID NO: 165663 - DNA, 25 bp, Rattus norvegicus
agttccgctaccaccagcagggaga

SEQ ID NO: 165664 - DNA, 25 bp, Rattus norvegicus
agttccgctacctccagcagggaga

SEQ ID NO: 165665 - DNA, 25 bp, Rattus norvegicus
agttccgctctccaccaaagaaagc

SEQ ID NO: 165666 - DNA, 25 bp, Rattus norvegicus
agttccgctctcgaccaaagaaagc

SEQ ID NO: 165667 - DNA, 25 bp, Rattus norvegicus
agttccgggaatcccagggcttcag

SEQ ID NO: 165668 - DNA, 25 bp, Rattus norvegicus
agttccgggaatgccagggcttcag

SEQ ID NO: 165669 - DNA, 25 bp, Rattus norvegicus
agttccgggccaagcaggaatgcat

SEQ ID NO: 165670 - DNA, 25 bp, Rattus norvegicus
agttccgggccatgcaggaatgcat

SEQ ID NO: 165671 - DNA, 25 bp, Rattus norvegicus
agttccgggtgcactttgccaacat

SEQ ID NO: 165672 - DNA, 25 bp, Rattus norvegicus
agttccgggtgctctttgccaacat

SEQ ID NO: 165673 - DNA, 25 bp, Rattus norvegicus
agttccggtatgaggttgcttcact

SEQ ID NO: 165674 - DNA, 25 bp, Rattus norvegicus
agttccggtatgtggttgcttcact

SEQ ID NO: 165675 - DNA, 25 bp, Rattus norvegicus
agttccgtctccaaagcccagagat

SEQ ID NO: 165676 - DNA, 25 bp, Rattus norvegicus
agttccgtctcctaagcccagagat

SEQ ID NO: 165677 - DNA, 25 bp, Rattus norvegicus
agttccgttaatagtcccagctggc

SEQ ID NO: 165678 - DNA, 25 bp, Rattus norvegicus
agttccgttaattgtcccagctggc

SEQ ID NO: 165679 - DNA, 25 bp, Rattus norvegicus
agttcctaaggacagagcaccgagt

SEQ ID NO: 165680 - DNA, 25 bp, Rattus norvegicus
agttcctaaggagagagcaccgagt

SEQ ID NO: 165681 - DNA, 25 bp, Rattus norvegicus
agttcctaagtgatacagctcctgc

SEQ ID NO: 165682 - DNA, 25 bp, Rattus norvegicus
agttcctaagtgttacagctcctgc

SEQ ID NO: 165683 - DNA, 25 bp, Rattus norvegicus
agttcctaccaaactgctctaagag

SEQ ID NO: 165684 - DNA, 25 bp, Rattus norvegicus
agttcctaccaatctgctctaagag

SEQ ID NO: 165685 - DNA, 25 bp, Rattus norvegicus
agttcctaccagacatcagaccttt

SEQ ID NO: 165686 - DNA, 25 bp, Rattus norvegicus
agttcctaccagtcatcagaccttt

SEQ ID NO: 165687 - DNA, 25 bp, Rattus norvegicus
agttcctactgtaactacttcatgg

SEQ ID NO: 165688 - DNA, 25 bp, Rattus norvegicus
agttcctactgttactacttcatgg

SEQ ID NO: 165689 - DNA, 25 bp, Rattus norvegicus
agttcctagcatctgagactttggc

SEQ ID NO: 165690 - DNA, 25 bp, Rattus norvegicus
agttcctagcatgtgagactttggc

SEQ ID NO: 165691 - DNA, 25 bp, Rattus norvegicus
agttcctagtcgatcagttccttac

SEQ ID NO: 165692 - DNA, 25 bp, Rattus norvegicus
agttcctagtcgttcagttccttac

SEQ ID NO: 165693 - DNA, 25 bp, Rattus norvegicus
agttcctagttgaggttgctgtggc

SEQ ID NO: 165694 - DNA, 25 bp, Rattus norvegicus
agttcctagttgtggttgctgtggc

SEQ ID NO: 165695 - DNA, 25 bp, Rattus norvegicus
agttcctatggccttgctgtgtact

SEQ ID NO: 165696 - DNA, 25 bp, Rattus norvegicus
agttcctatggcgttgctgtgtact

SEQ ID NO: 165697 - DNA, 25 bp, Rattus norvegicus
agttcctcaaaacttccctgtatga

SEQ ID NO: 165698 - DNA, 25 bp, Rattus norvegicus
agttcctcaaaagttccctgtatga

SEQ ID NO: 165699 - DNA, 25 bp, Rattus norvegicus
agttcctcaacacgtgtcacttcta

SEQ ID NO: 165700 - DNA, 25 bp, Rattus norvegicus
agttcctcaacaggtgtcacttcta

SEQ ID NO: 165701 - DNA, 25 bp, Rattus norvegicus
agttcctcagtgaagccctggatga

SEQ ID NO: 165702 - DNA, 25 bp, Rattus norvegicus
agttcctcagtgtagccctggatga

SEQ ID NO: 165703 - DNA, 25 bp, Rattus norvegicus
agttcctccaggagaccacatgtgg

SEQ ID NO: 165704 - DNA, 25 bp, Rattus norvegicus
agttcctccaggtgaccacatgtgg

SEQ ID NO: 165705 - DNA, 25 bp, Rattus norvegicus
agttcctcctgactggagtgctgaa

SEQ ID NO: 165706 - DNA, 25 bp, Rattus norvegicus
agttcctcctgagtggagtgctgaa

SEQ ID NO: 165707 - DNA, 25 bp, Rattus norvegicus
agttcctcctggcattctgagaaac

SEQ ID NO: 165708 - DNA, 25 bp, Rattus norvegicus
agttcctcctgggattctgagaaac

SEQ ID NO: 165709 - DNA, 25 bp, Rattus norvegicus
agttcctccttcagtacttaaggcg

SEQ ID NO: 165710 - DNA, 25 bp, Rattus norvegicus
agttcctccttctgtacttaaggcg

SEQ ID NO: 165711 - DNA, 25 bp, Rattus norvegicus
agttcctcgctgatatctctatctt

SEQ ID NO: 165712 - DNA, 25 bp, Rattus norvegicus
agttcctcgctgttatctctatctt

SEQ ID NO: 165713 - DNA, 25 bp, Rattus norvegicus
agttcctcggatccactttatgtgg

SEQ ID NO: 165714 - DNA, 25 bp, Rattus norvegicus
agttcctcggatgcactttatgtgg

SEQ ID NO: 165715 - DNA, 25 bp, Rattus norvegicus
agttcctcggcactgtcatggcaag

SEQ ID NO: 165716 - DNA, 25 bp, Rattus norvegicus
agttcctcggcagtgtcatggcaag

SEQ ID NO: 165717 - DNA, 25 bp, Rattus norvegicus
agttcctctacgaacccaaaagcat

SEQ ID NO: 165718 - DNA, 25 bp, Rattus norvegicus
agttcctctacgtacccaaaagcat

SEQ ID NO: 165719 - DNA, 25 bp, Rattus norvegicus
agttcctctgcaatgacaaccaggt

SEQ ID NO: 165720 - DNA, 25 bp, Rattus norvegicus
agttcctctgcattgacaaccaggt

SEQ ID NO: 165721 - DNA, 25 bp, Rattus norvegicus
agttcctctgctcccactaaaaaca

SEQ ID NO: 165722 - DNA, 25 bp, Rattus norvegicus
agttcctctgctcgctggaagaaga

SEQ ID NO: 165723 - DNA, 25 bp, Rattus norvegicus
agttcctctgctgccactaaaaaca

SEQ ID NO: 165724 - DNA, 25 bp, Rattus norvegicus
agttcctctgctggctggaagaaga

SEQ ID NO: 165725 - DNA, 25 bp, Rattus norvegicus
agttcctcttcgatcatgttcatga

SEQ ID NO: 165726 - DNA, 25 bp, Rattus norvegicus
agttcctcttcgttcatgttcatga

SEQ ID NO: 165727 - DNA, 25 bp, Rattus norvegicus
agttcctgaaggcatctgacctgat

SEQ ID NO: 165728 - DNA, 25 bp, Rattus norvegicus
agttcctgaagggatctgacctgat

SEQ ID NO: 165729 - DNA, 25 bp, Rattus norvegicus
agttcctgactcagcagttgtcaat

SEQ ID NO: 165730 - DNA, 25 bp, Rattus norvegicus
agttcctgactctgcagttgtcaat

SEQ ID NO: 165731 - DNA, 25 bp, Rattus norvegicus
agttcctgacttcggtgttctcact

SEQ ID NO: 165732 - DNA, 25 bp, Rattus norvegicus
agttcctgacttgggtgttctcact

SEQ ID NO: 165733 - DNA, 25 bp, Rattus norvegicus
agttcctgagccagtttgcacagac

SEQ ID NO: 165734 - DNA, 25 bp, Rattus norvegicus
agttcctgagcctgtttgcacagac

SEQ ID NO: 165735 - DNA, 25 bp, Rattus norvegicus
agttcctgatctcagtacctggctt

SEQ ID NO: 165736 - DNA, 25 bp, Rattus norvegicus
agttcctgatctgagtacctggctt

SEQ ID NO: 165737 - DNA, 25 bp, Rattus norvegicus
agttcctgcaccagtcgctgcacag

SEQ ID NO: 165738 - DNA, 25 bp, Rattus norvegicus
agttcctgcacctgtcgctgcacag

SEQ ID NO: 165739 - DNA, 25 bp, Rattus norvegicus
agttcctgccaaaaagcctgggagt

SEQ ID NO: 165740 - DNA, 25 bp, Rattus norvegicus
agttcctgccaataagcctgggagt

SEQ ID NO: 165741 - DNA, 25 bp, Rattus norvegicus
agttcctgcgaactgtgtccgcctc

SEQ ID NO: 165742 - DNA, 25 bp, Rattus norvegicus
agttcctgcgaagtgtgtccgcctc

SEQ ID NO: 165743 - DNA, 25 bp, Rattus norvegicus
agttcctgctccagaaggacttcgt

SEQ ID NO: 165744 - DNA, 25 bp, Rattus norvegicus
agttcctgctccagaccaataagtt

SEQ ID NO: 165745 - DNA, 25 bp, Rattus norvegicus
agttcctgctcctgaaggacttcgt

SEQ ID NO: 165746 - DNA, 25 bp, Rattus norvegicus
agttcctgctcctgaccaataagtt

SEQ ID NO: 165747 - DNA, 25 bp, Rattus norvegicus
agttcctgctgtcgctggaggtaac

SEQ ID NO: 165748 - DNA, 25 bp, Rattus norvegicus
agttcctgctgtggctggaggtaac

SEQ ID NO: 165749 - DNA, 25 bp, Rattus norvegicus
agttcctgctttccgtgtggtcaaa

SEQ ID NO: 165750 - DNA, 25 bp, Rattus norvegicus
agttcctgctttcggtcacatctga

SEQ ID NO: 165751 - DNA, 25 bp, Rattus norvegicus
agttcctgctttgcgtgtggtcaaa

SEQ ID NO: 165752 - DNA, 25 bp, Rattus norvegicus
agttcctgctttgggtcacatctga

SEQ ID NO: 165753 - DNA, 25 bp, Rattus norvegicus
agttcctggaacctgcacaggcgta

SEQ ID NO: 165754 - DNA, 25 bp, Rattus norvegicus
agttcctggaacgtgcacaggcgta

SEQ ID NO: 165755 - DNA, 25 bp, Rattus norvegicus
agttcctggattcccctgccaaggc

SEQ ID NO: 165756 - DNA, 25 bp, Rattus norvegicus
agttcctggattgccctgccaaggc

SEQ ID NO: 165757 - DNA, 25 bp, Rattus norvegicus
agttcctggcacattgcgggtcaag

SEQ ID NO: 165758 - DNA, 25 bp, Rattus norvegicus
agttcctggcactttgcgggtcaag

SEQ ID NO: 165759 - DNA, 25 bp, Rattus norvegicus
agttcctggctccaacactgagaca

SEQ ID NO: 165760 - DNA, 25 bp, Rattus norvegicus
agttcctggctcgaacactgagaca

SEQ ID NO: 165761 - DNA, 25 bp, Rattus norvegicus
agttcctgggttctctggtgtgcca

SEQ ID NO: 165762 - DNA, 25 bp, Rattus norvegicus
agttcctgggttgtctggtgtgcca

SEQ ID NO: 165763 - DNA, 25 bp, Rattus norvegicus
agttcctgtacaagggcttcgatga

SEQ ID NO: 165764 - DNA, 25 bp, Rattus norvegicus
agttcctgtacatgggcttcgatga

SEQ ID NO: 165765 - DNA, 25 bp, Rattus norvegicus
agttcctgtcagctttgtgtccgtg

SEQ ID NO: 165766 - DNA, 25 bp, Rattus norvegicus
agttcctgtcaggtttgtgtccgtg

SEQ ID NO: 165767 - DNA, 25 bp, Rattus norvegicus
agttcctgtcccaccagagcctgga

SEQ ID NO: 165768 - DNA, 25 bp, Rattus norvegicus
agttcctgtccctccagagcctgga

SEQ ID NO: 165769 - DNA, 25 bp, Rattus norvegicus
agttcctgtcctcatttttctcagt

SEQ ID NO: 165770 - DNA, 25 bp, Rattus norvegicus
agttcctgtcctgatttttctcagt

SEQ ID NO: 165771 - DNA, 25 bp, Rattus norvegicus
agttcctgtcttcgattctttttag

SEQ ID NO: 165772 - DNA, 25 bp, Rattus norvegicus
agttcctgtcttggattctttttag

SEQ ID NO: 165773 - DNA, 25 bp, Rattus norvegicus
agttcctgtgatatctacccttcat

SEQ ID NO: 165774 - DNA, 25 bp, Rattus norvegicus
agttcctgtgatttctacccttcat

SEQ ID NO: 165775 - DNA, 25 bp, Rattus norvegicus
agttcctgtggtaggccctgcaaaa

SEQ ID NO: 165776 - DNA, 25 bp, Rattus norvegicus
agttcctgtggttggccctgcaaaa

SEQ ID NO: 165777 - DNA, 25 bp, Rattus norvegicus
agttccttacgactaatatcgctcg

SEQ ID NO: 165778 - DNA, 25 bp, Rattus norvegicus
agttccttacgagtaatatcgctcg

SEQ ID NO: 165779 - DNA, 25 bp, Rattus norvegicus
agttccttactgcttcactggtcgg

SEQ ID NO: 165780 - DNA, 25 bp, Rattus norvegicus
agttccttactggttcactggtcgg

SEQ ID NO: 165781 - DNA, 25 bp, Rattus norvegicus
agttccttcacacttatctgtctga

SEQ ID NO: 165782 - DNA, 25 bp, Rattus norvegicus
agttccttcacagttatctgtctga

SEQ ID NO: 165783 - DNA, 25 bp, Rattus norvegicus
agttccttccatcataccttatata

SEQ ID NO: 165784 - DNA, 25 bp, Rattus norvegicus
agttccttccatgataccttatata

SEQ ID NO: 165785 - DNA, 25 bp, Rattus norvegicus
agttccttccgactctcactgtgtc

SEQ ID NO: 165786 - DNA, 25 bp, Rattus norvegicus
agttccttccgagtctcactgtgtc

SEQ ID NO: 165787 - DNA, 25 bp, Rattus norvegicus
agttccttcctcagcacggatgaat

SEQ ID NO: 165788 - DNA, 25 bp, Rattus norvegicus
agttccttcctctgcacggatgaat

SEQ ID NO: 165789 - DNA, 25 bp, Rattus norvegicus
agttccttccttcttttgcatcgtt

SEQ ID NO: 165790 - DNA, 25 bp, Rattus norvegicus
agttccttccttgttttgcatcgtt

SEQ ID NO: 165791 - DNA, 25 bp, Rattus norvegicus
agttccttctccattgttgatgtaa

SEQ ID NO: 165792 - DNA, 25 bp, Rattus norvegicus
agttccttctcctttgttgatgtaa

SEQ ID NO: 165793 - DNA, 25 bp, Rattus norvegicus
agttccttctctcgaaatctttata

SEQ ID NO: 165794 - DNA, 25 bp, Rattus norvegicus
agttccttctctggaaatctttata

SEQ ID NO: 165795 - DNA, 25 bp, Rattus norvegicus
agttccttgaacactgtggattccc

SEQ ID NO: 165796 - DNA, 25 bp, Rattus norvegicus
agttccttgaactctgtggattccc

SEQ ID NO: 165797 - DNA, 25 bp, Rattus norvegicus
agttccttgcttccagtatttcaac

SEQ ID NO: 165798 - DNA, 25 bp, Rattus norvegicus
agttccttgcttccatctgagaagt

SEQ ID NO: 165799 - DNA, 25 bp, Rattus norvegicus
agttccttgcttgcagtatttcaac

SEQ ID NO: 165800 - DNA, 25 bp, Rattus norvegicus
agttccttgcttgcatctgagaagt

SEQ ID NO: 165801 - DNA, 25 bp, Rattus norvegicus
agttccttggcaacatctgtagcta

SEQ ID NO: 165802 - DNA, 25 bp, Rattus norvegicus
agttccttggcatcatctgtagcta

SEQ ID NO: 165803 - DNA, 25 bp, Rattus norvegicus
agttccttggccacctgagatgaag

SEQ ID NO: 165804 - DNA, 25 bp, Rattus norvegicus
agttccttggcctcctgagatgaag

SEQ ID NO: 165805 - DNA, 25 bp, Rattus norvegicus
agttccttgtgcctgtcatggccag

SEQ ID NO: 165806 - DNA, 25 bp, Rattus norvegicus
agttccttgtgcgtgtcatggccag

SEQ ID NO: 165807 - DNA, 25 bp, Rattus norvegicus
agttcctttcacacctagatagaca

SEQ ID NO: 165808 - DNA, 25 bp, Rattus norvegicus
agttcctttcactcctagatagaca

SEQ ID NO: 165809 - DNA, 25 bp, Rattus norvegicus
agttcctttcagcagttcctttcag

SEQ ID NO: 165810 - DNA, 25 bp, Rattus norvegicus
agttcctttcaggagttcctttcag

SEQ ID NO: 165811 - DNA, 25 bp, Rattus norvegicus
agttcctttccaacattttacagtg

SEQ ID NO: 165812 - DNA, 25 bp, Rattus norvegicus
agttcctttccatcattttacagtg

SEQ ID NO: 165813 - DNA, 25 bp, Rattus norvegicus
agttcctttccccagagatgaagcg

SEQ ID NO: 165814 - DNA, 25 bp, Rattus norvegicus
agttcctttcccgagagatgaagcg

SEQ ID NO: 165815 - DNA, 25 bp, Rattus norvegicus
agttcctttgtaatacactggccta

SEQ ID NO: 165816 - DNA, 25 bp, Rattus norvegicus
agttcctttgtattacactggccta

SEQ ID NO: 165817 - DNA, 25 bp, Rattus norvegicus
agttcctttttaacagtcacctctg

SEQ ID NO: 165818 - DNA, 25 bp, Rattus norvegicus
agttcctttttatcagtcacctctg

SEQ ID NO: 165819 - DNA, 25 bp, Rattus norvegicus
agttcgaaatctcctttgtctagtt

SEQ ID NO: 165820 - DNA, 25 bp, Rattus norvegicus
agttcgaaatctgctttgtctagtt

SEQ ID NO: 165821 - DNA, 25 bp, Rattus norvegicus
agttcgaatcacactgtggcacttt

SEQ ID NO: 165822 - DNA, 25 bp, Rattus norvegicus
agttcgaatcactctgtggcacttt

SEQ ID NO: 165823 - DNA, 25 bp, Rattus norvegicus
agttcgacgatgaggagccgcttcc

SEQ ID NO: 165824 - DNA, 25 bp, Rattus norvegicus
agttcgacgatgtggagccgcttcc

SEQ ID NO: 165825 - DNA, 25 bp, Rattus norvegicus
agttcgagacccactcaattttggt

SEQ ID NO: 165826 - DNA, 25 bp, Rattus norvegicus
agttcgagaccctctcaattttggt

SEQ ID NO: 165827 - DNA, 25 bp, Rattus norvegicus
agttcgagatcaccttcgagtgcat

SEQ ID NO: 165828 - DNA, 25 bp, Rattus norvegicus
agttcgagatcagcttcgagtgcat

SEQ ID NO: 165829 - DNA, 25 bp, Rattus norvegicus
agttcgaggcccagcggagctgctt

SEQ ID NO: 165830 - DNA, 25 bp, Rattus norvegicus
agttcgaggccctgcggagctgctt

SEQ ID NO: 165831 - DNA, 25 bp, Rattus norvegicus
agttcgcacctaaaggcgcatctga

SEQ ID NO: 165832 - DNA, 25 bp, Rattus norvegicus
agttcgcacctataggcgcatctga

SEQ ID NO: 165833 - DNA, 25 bp, Rattus norvegicus
agttcgcatttgagatctgtgtaaa

SEQ ID NO: 165834 - DNA, 25 bp, Rattus norvegicus
agttcgcatttgtgatctgtgtaaa

SEQ ID NO: 165835 - DNA, 25 bp, Rattus norvegicus
agttcgccccttactgtagagatat

SEQ ID NO: 165836 - DNA, 25 bp, Rattus norvegicus
agttcgcccctttctgtagagatat

SEQ ID NO: 165837 - DNA, 25 bp, Rattus norvegicus
agttcgccttatatccctgctgact

SEQ ID NO: 165838 - DNA, 25 bp, Rattus norvegicus
agttcgccttatttccctgctgact

SEQ ID NO: 165839 - DNA, 25 bp, Rattus norvegicus
agttcgcgcagtacttcctgctaaa

SEQ ID NO: 165840 - DNA, 25 bp, Rattus norvegicus
agttcgcgcagttcttcctgctaaa

SEQ ID NO: 165841 - DNA, 25 bp, Rattus norvegicus
agttcgcgtgtcatggactaatcag

SEQ ID NO: 165842 - DNA, 25 bp, Rattus norvegicus
agttcgcgtgtcttggactaatcag

SEQ ID NO: 165843 - DNA, 25 bp, Rattus norvegicus
agttcgctagctctgatgtgctgta

SEQ ID NO: 165844 - DNA, 25 bp, Rattus norvegicus
agttcgctagctgtgatgtgctgta

SEQ ID NO: 165845 - DNA, 25 bp, Rattus norvegicus
agttcgctatccctgtcactttaaa

SEQ ID NO: 165846 - DNA, 25 bp, Rattus norvegicus
agttcgctatccgtgtcactttaaa

SEQ ID NO: 165847 - DNA, 25 bp, Rattus norvegicus
agttcgctctgtcatgtcaagtgca

SEQ ID NO: 165848 - DNA, 25 bp, Rattus norvegicus
agttcgctctgtgatgtcaagtgca

SEQ ID NO: 165849 - DNA, 25 bp, Rattus norvegicus
agttcggacgctcggtgcggctgct

SEQ ID NO: 165850 - DNA, 25 bp, Rattus norvegicus
agttcggacgctgggtgcggctgct

SEQ ID NO: 165851 - DNA, 25 bp, Rattus norvegicus
agttcggcagtaactgttttctctc

SEQ ID NO: 165852 - DNA, 25 bp, Rattus norvegicus
agttcggcagtatctgttttctctc

SEQ ID NO: 165853 - DNA, 25 bp, Rattus norvegicus
agttcggccggtactccgctctgat

SEQ ID NO: 165854 - DNA, 25 bp, Rattus norvegicus
agttcggccggttctccgctctgat

SEQ ID NO: 165855 - DNA, 25 bp, Rattus norvegicus
agttcggcctttcgcacttcaattg

SEQ ID NO: 165856 - DNA, 25 bp, Rattus norvegicus
agttcggcctttggcacttcaattg

SEQ ID NO: 165857 - DNA, 25 bp, Rattus norvegicus
agttcggctactcagagcgcggaca

SEQ ID NO: 165858 - DNA, 25 bp, Rattus norvegicus
agttcggctactccccagggcagca

SEQ ID NO: 165859 - DNA, 25 bp, Rattus norvegicus
agttcggctactgagagcgcggaca

SEQ ID NO: 165860 - DNA, 25 bp, Rattus norvegicus
agttcggctactgcccagggcagca

SEQ ID NO: 165861 - DNA, 25 bp, Rattus norvegicus
agttcgggccctagtttgttgagtg

SEQ ID NO: 165862 - DNA, 25 bp, Rattus norvegicus
agttcgggcccttgtttgttgagtg

SEQ ID NO: 165863 - DNA, 25 bp, Rattus norvegicus
agttcggttttgctgcgacacaaca

SEQ ID NO: 165864 - DNA, 25 bp, Rattus norvegicus
agttcggttttggtgcgacacaaca

SEQ ID NO: 165865 - DNA, 25 bp, Rattus norvegicus
agttcgtacgcgaggacgcaccatg

SEQ ID NO: 165866 - DNA, 25 bp, Rattus norvegicus
agttcgtacgcgtggacgcaccatg

SEQ ID NO: 165867 - DNA, 25 bp, Rattus norvegicus
agttcgtcacaaactctgtttccga

SEQ ID NO: 165868 - DNA, 25 bp, Rattus norvegicus
agttcgtcacaatctctgtttccga

SEQ ID NO: 165869 - DNA, 25 bp, Rattus norvegicus
agttcgtcacccagcacacaactgg

SEQ ID NO: 165870 - DNA, 25 bp, Rattus norvegicus
agttcgtcaccctgcacacaactgg

SEQ ID NO: 165871 - DNA, 25 bp, Rattus norvegicus
agttcgtcagacctagtgttcatgc

SEQ ID NO: 165872 - DNA, 25 bp, Rattus norvegicus
agttcgtcagacgtagtgttcatgc

SEQ ID NO: 165873 - DNA, 25 bp, Rattus norvegicus
agttcgtccattcttcccgaagaag

SEQ ID NO: 165874 - DNA, 25 bp, Rattus norvegicus
agttcgtccattgttcccgaagaag

SEQ ID NO: 165875 - DNA, 25 bp, Rattus norvegicus
agttcgtcctgccagcttcgtgcag

SEQ ID NO: 165876 - DNA, 25 bp, Rattus norvegicus
agttcgtcctgcgagcttcgtgcag

SEQ ID NO: 165877 - DNA, 25 bp, Rattus norvegicus
agttcgtctcgcctggcctctgcat

SEQ ID NO: 165878 - DNA, 25 bp, Rattus norvegicus
agttcgtctcgcgtggcctctgcat

SEQ ID NO: 165879 - DNA, 25 bp, Rattus norvegicus
agttcgtctctaaccgtgcatatga

SEQ ID NO: 165880 - DNA, 25 bp, Rattus norvegicus
agttcgtctctatccgtgcatatga

SEQ ID NO: 165881 - DNA, 25 bp, Rattus norvegicus
agttcgtgctcccaggagtgtagct

SEQ ID NO: 165882 - DNA, 25 bp, Rattus norvegicus
agttcgtgctccgaggagtgtagct

SEQ ID NO: 165883 - DNA, 25 bp, Rattus norvegicus
agttcgtggccaccatgtatcacta

SEQ ID NO: 165884 - DNA, 25 bp, Rattus norvegicus
agttcgtggccagcatgtatcacta

SEQ ID NO: 165885 - DNA, 25 bp, Rattus norvegicus
agttcgtggcgtatgaggagcttcc

SEQ ID NO: 165886 - DNA, 25 bp, Rattus norvegicus
agttcgtggcgtttgaggagcttcc

SEQ ID NO: 165887 - DNA, 25 bp, Rattus norvegicus
agttcgtgtaaacccaacagcgtgt

SEQ ID NO: 165888 - DNA, 25 bp, Rattus norvegicus
agttcgtgtaaagccaacagcgtgt

SEQ ID NO: 165889 - DNA, 25 bp, Rattus norvegicus
agttcgtgtcgaagggcgtaatctc

SEQ ID NO: 165890 - DNA, 25 bp, Rattus norvegicus
agttcgtgtcgatgggcgtaatctc

SEQ ID NO: 165891 - DNA, 25 bp, Rattus norvegicus
agttcgttgtgtacaggacaaacca

SEQ ID NO: 165892 - DNA, 25 bp, Rattus norvegicus
agttcgttgtgttcaggacaaacca

SEQ ID NO: 165893 - DNA, 25 bp, Rattus norvegicus
agttcgtttgacatggaaatccata

SEQ ID NO: 165894 - DNA, 25 bp, Rattus norvegicus
agttcgtttgacttggaaatccata

SEQ ID NO: 165895 - DNA, 25 bp, Rattus norvegicus
agttcgttttgtatatcctgcttct

SEQ ID NO: 165896 - DNA, 25 bp, Rattus norvegicus
agttcgttttgtttatcctgcttct

SEQ ID NO: 165897 - DNA, 25 bp, Rattus norvegicus
agttctaaatggctccggagatgca

SEQ ID NO: 165898 - DNA, 25 bp, Rattus norvegicus
agttctaaatgggtccggagatgca

SEQ ID NO: 165899 - DNA, 25 bp, Rattus norvegicus
agttctaacatcaaccaggcataca

SEQ ID NO: 165900 - DNA, 25 bp, Rattus norvegicus
agttctaacatctaccaggcataca

SEQ ID NO: 165901 - DNA, 25 bp, Rattus norvegicus
agttctaacctcatagggcggtggt

SEQ ID NO: 165902 - DNA, 25 bp, Rattus norvegicus
agttctaacctcttagggcggtggt

SEQ ID NO: 165903 - DNA, 25 bp, Rattus norvegicus
agttctaactgaaggccttgtctgc

SEQ ID NO: 165904 - DNA, 25 bp, Rattus norvegicus
agttctaactgatggccttgtctgc

SEQ ID NO: 165905 - DNA, 25 bp, Rattus norvegicus
agttctaacttgatgctacaggatt

SEQ ID NO: 165906 - DNA, 25 bp, Rattus norvegicus
agttctaacttgttgctacaggatt

SEQ ID NO: 165907 - DNA, 25 bp, Rattus norvegicus
agttctaagacaagcacgacgacaa

SEQ ID NO: 165908 - DNA, 25 bp, Rattus norvegicus
agttctaagacatgcacgacgacaa

SEQ ID NO: 165909 - DNA, 25 bp, Rattus norvegicus
agttctaagccacccaaggtctagt

SEQ ID NO: 165910 - DNA, 25 bp, Rattus norvegicus
agttctaagccagccaaggtctagt

SEQ ID NO: 165911 - DNA, 25 bp, Rattus norvegicus
agttctaaggttctagtattcagga

SEQ ID NO: 165912 - DNA, 25 bp, Rattus norvegicus
agttctaaggttgtagtattcagga

SEQ ID NO: 165913 - DNA, 25 bp, Rattus norvegicus
agttctaatcctagtttctcttcca

SEQ ID NO: 165914 - DNA, 25 bp, Rattus norvegicus
agttctaatccttgtttctcttcca

SEQ ID NO: 165915 - DNA, 25 bp, Rattus norvegicus
agttctaatgtcacgatcccagtac

SEQ ID NO: 165916 - DNA, 25 bp, Rattus norvegicus
agttctaatgtctcgatcccagtac

SEQ ID NO: 165917 - DNA, 25 bp, Rattus norvegicus
agttctaattacatgctccacaagc

SEQ ID NO: 165918 - DNA, 25 bp, Rattus norvegicus
agttctaattacttgctccacaagc

SEQ ID NO: 165919 - DNA, 25 bp, Rattus norvegicus
agttctacaacaacggtcctctgat

SEQ ID NO: 165920 - DNA, 25 bp, Rattus norvegicus
agttctacaacatcggtcctctgat

SEQ ID NO: 165921 - DNA, 25 bp, Rattus norvegicus
agttctacacctagtttggtcggag

SEQ ID NO: 165922 - DNA, 25 bp, Rattus norvegicus
agttctacaccttgtttggtcggag

SEQ ID NO: 165923 - DNA, 25 bp, Rattus norvegicus
agttctacactgacttccctgtgtc

SEQ ID NO: 165924 - DNA, 25 bp, Rattus norvegicus
agttctacactgtcttccctgtgtc

SEQ ID NO: 165925 - DNA, 25 bp, Rattus norvegicus
agttctacagtccacggccagaaaa

SEQ ID NO: 165926 - DNA, 25 bp, Rattus norvegicus
agttctacagtcgacggccagaaaa

SEQ ID NO: 165927 - DNA, 25 bp, Rattus norvegicus
agttctacattcacaaagcctcttt

SEQ ID NO: 165928 - DNA, 25 bp, Rattus norvegicus
agttctacattctcaaagcctcttt

SEQ ID NO: 165929 - DNA, 25 bp, Rattus norvegicus
agttctaccagacttctcagttcat

SEQ ID NO: 165930 - DNA, 25 bp, Rattus norvegicus
agttctaccagagttctcagttcat

SEQ ID NO: 165931 - DNA, 25 bp, Rattus norvegicus
agttctaccagcagccacttaaaac

SEQ ID NO: 165932 - DNA, 25 bp, Rattus norvegicus
agttctaccagctgccacttaaaac

SEQ ID NO: 165933 - DNA, 25 bp, Rattus norvegicus
agttctaccattacacttactcagg

SEQ ID NO: 165934 - DNA, 25 bp, Rattus norvegicus
agttctaccatttcacttactcagg

SEQ ID NO: 165935 - DNA, 25 bp, Rattus norvegicus
agttctacccctcgtcactgtgaat

SEQ ID NO: 165936 - DNA, 25 bp, Rattus norvegicus
agttctacccctggtcactgtgaat

SEQ ID NO: 165937 - DNA, 25 bp, Rattus norvegicus
agttctaccgctctctggtccagaa

SEQ ID NO: 165938 - DNA, 25 bp, Rattus norvegicus
agttctaccgctgtctggtccagaa

SEQ ID NO: 165939 - DNA, 25 bp, Rattus norvegicus
agttctacgatgccaagtcgtgcct

SEQ ID NO: 165940 - DNA, 25 bp, Rattus norvegicus
agttctacgatggcaagtcgtgcct

SEQ ID NO: 165941 - DNA, 25 bp, Rattus norvegicus
agttctactactatgatcctcagga

SEQ ID NO: 165942 - DNA, 25 bp, Rattus norvegicus
agttctactactttgatcctcagga

SEQ ID NO: 165943 - DNA, 25 bp, Rattus norvegicus
agttctactgcgcattcttggatgg

SEQ ID NO: 165944 - DNA, 25 bp, Rattus norvegicus
agttctactgcggattcttggatgg

SEQ ID NO: 165945 - DNA, 25 bp, Rattus norvegicus
agttctacttagacacttgcctcac

SEQ ID NO: 165946 - DNA, 25 bp, Rattus norvegicus
agttctacttagtcacttgcctcac

SEQ ID NO: 165947 - DNA, 25 bp, Rattus norvegicus
agttctactttgcatttgagtgcat

SEQ ID NO: 165948 - DNA, 25 bp, Rattus norvegicus
agttctactttggatttgagtgcat

SEQ ID NO: 165949 - DNA, 25 bp, Rattus norvegicus
agttctagaacaatcttttgcttta

SEQ ID NO: 165950 - DNA, 25 bp, Rattus norvegicus
agttctagaacattcttttgcttta

SEQ ID NO: 165951 - DNA, 25 bp, Rattus norvegicus
agttctagctagagccagtgcctta

SEQ ID NO: 165952 - DNA, 25 bp, Rattus norvegicus
agttctagctagtgccagtgcctta

SEQ ID NO: 165953 - DNA, 25 bp, Rattus norvegicus
agttctagctcactggtccagtttc

SEQ ID NO: 165954 - DNA, 25 bp, Rattus norvegicus
agttctagctcagtggtccagtttc

SEQ ID NO: 165955 - DNA, 25 bp, Rattus norvegicus
agttctaggaatccgactccctctt

SEQ ID NO: 165956 - DNA, 25 bp, Rattus norvegicus
agttctaggaatgcgactccctctt

SEQ ID NO: 165957 - DNA, 25 bp, Rattus norvegicus
agttctaggccgcatggtccactgc

SEQ ID NO: 165958 - DNA, 25 bp, Rattus norvegicus
agttctaggccggatggtccactgc

SEQ ID NO: 165959 - DNA, 25 bp, Rattus norvegicus
agttctagggcaaccaactctctct

SEQ ID NO: 165960 - DNA, 25 bp, Rattus norvegicus
agttctagggcatccaactctctct

SEQ ID NO: 165961 - DNA, 25 bp, Rattus norvegicus
agttctaggtatagattgccctccc

SEQ ID NO: 165962 - DNA, 25 bp, Rattus norvegicus
agttctaggtattgattgccctccc

SEQ ID NO: 165963 - DNA, 25 bp, Rattus norvegicus
agttctaggtgaatcagcgctctcc

SEQ ID NO: 165964 - DNA, 25 bp, Rattus norvegicus
agttctaggtgattcagcgctctcc

SEQ ID NO: 165965 - DNA, 25 bp, Rattus norvegicus
agttctagtctcaaggtggctttat

SEQ ID NO: 165966 - DNA, 25 bp, Rattus norvegicus
agttctagtctctaggtggctttat

SEQ ID NO: 165967 - DNA, 25 bp, Rattus norvegicus
agttctagtgccatacactccagga

SEQ ID NO: 165968 - DNA, 25 bp, Rattus norvegicus
agttctagtgccttacactccagga

SEQ ID NO: 165969 - DNA, 25 bp, Rattus norvegicus
agttctatagacaaggccggcctca

SEQ ID NO: 165970 - DNA, 25 bp, Rattus norvegicus
agttctatagactaggccggcctca

SEQ ID NO: 165971 - DNA, 25 bp, Rattus norvegicus
agttctatccatcgcttcaagctga

SEQ ID NO: 165972 - DNA, 25 bp, Rattus norvegicus
agttctatccatggcttcaagctga

SEQ ID NO: 165973 - DNA, 25 bp, Rattus norvegicus
agttctatccgaagacccagctata

SEQ ID NO: 165974 - DNA, 25 bp, Rattus norvegicus
agttctatccgatgacccagctata

SEQ ID NO: 165975 - DNA, 25 bp, Rattus norvegicus
agttctatcctcaatgcagtgcatg

SEQ ID NO: 165976 - DNA, 25 bp, Rattus norvegicus
agttctatcctctatgcagtgcatg

SEQ ID NO: 165977 - DNA, 25 bp, Rattus norvegicus
agttctatgcaaacccttcatttag

SEQ ID NO: 165978 - DNA, 25 bp, Rattus norvegicus
agttctatgcaatcccttcatttag

SEQ ID NO: 165979 - DNA, 25 bp, Rattus norvegicus
agttctatgtatctccccgggaagc

SEQ ID NO: 165980 - DNA, 25 bp, Rattus norvegicus
agttctatgtatgtccccgggaagc

SEQ ID NO: 165981 - DNA, 25 bp, Rattus norvegicus
agttctattgagcaggttttccttg

SEQ ID NO: 165982 - DNA, 25 bp, Rattus norvegicus
agttctattgaggaggttttccttg

SEQ ID NO: 165983 - DNA, 25 bp, Rattus norvegicus
agttctcaaaggcacttcaaccccg

SEQ ID NO: 165984 - DNA, 25 bp, Rattus norvegicus
agttctcaaagggacttcaaccccg

SEQ ID NO: 165985 - DNA, 25 bp, Rattus norvegicus
agttctcaacgtcataacacttctt

SEQ ID NO: 165986 - DNA, 25 bp, Rattus norvegicus
agttctcaacgtgataacacttctt

SEQ ID NO: 165987 - DNA, 25 bp, Rattus norvegicus
agttctcaagctagattagatctgg

SEQ ID NO: 165988 - DNA, 25 bp, Rattus norvegicus
agttctcaagcttgattagatctgg

SEQ ID NO: 165989 - DNA, 25 bp, Rattus norvegicus
agttctcaatggaacagcctatgtg

SEQ ID NO: 165990 - DNA, 25 bp, Rattus norvegicus
agttctcaatggtacagcctatgtg

SEQ ID NO: 165991 - DNA, 25 bp, Rattus norvegicus
agttctcacatcacatgaatgccag

SEQ ID NO: 165992 - DNA, 25 bp, Rattus norvegicus
agttctcacatctcatgaatgccag

SEQ ID NO: 165993 - DNA, 25 bp, Rattus norvegicus
agttctcagcagcagacactctgta

SEQ ID NO: 165994 - DNA, 25 bp, Rattus norvegicus
agttctcagcaggagacactctgta

SEQ ID NO: 165995 - DNA, 25 bp, Rattus norvegicus
agttctcaggcccagcttagaaggg

SEQ ID NO: 165996 - DNA, 25 bp, Rattus norvegicus
agttctcaggccgagcttagaaggg

SEQ ID NO: 165997 - DNA, 25 bp, Rattus norvegicus
agttctcagggacccaggcataact

SEQ ID NO: 165998 - DNA, 25 bp, Rattus norvegicus
agttctcagggagccaggcataact

SEQ ID NO: 165999 - DNA, 25 bp, Rattus norvegicus
agttctcagttgctcttgtcattgt

SEQ ID NO: 166000 - DNA, 25 bp, Rattus norvegicus
agttctcagttggtcttgtcattgt

SEQ ID NO: 166001 - DNA, 25 bp, Rattus norvegicus
agttctcatcccagagaggaagtgg

SEQ ID NO: 166002 - DNA, 25 bp, Rattus norvegicus
agttctcatccctgagaggaagtgg

SEQ ID NO: 166003 - DNA, 25 bp, Rattus norvegicus
agttctcattacctgactttcatgt

SEQ ID NO: 166004 - DNA, 25 bp, Rattus norvegicus
agttctcattacgtgactttcatgt

SEQ ID NO: 166005 - DNA, 25 bp, Rattus norvegicus
agttctcattataagaaagcccaga

SEQ ID NO: 166006 - DNA, 25 bp, Rattus norvegicus
agttctcattattagaaagcccaga

SEQ ID NO: 166007 - DNA, 25 bp, Rattus norvegicus
agttctccaaaaccagtacctggca

SEQ ID NO: 166008 - DNA, 25 bp, Rattus norvegicus
agttctccaaaagcagtacctggca

SEQ ID NO: 166009 - DNA, 25 bp, Rattus norvegicus
agttctccaagaccgcagcgaaggg

SEQ ID NO: 166010 - DNA, 25 bp, Rattus norvegicus
agttctccaagactgtcaccaagct

SEQ ID NO: 166011 - DNA, 25 bp, Rattus norvegicus
agttctccaagagcgcagcgaaggg

SEQ ID NO: 166012 - DNA, 25 bp, Rattus norvegicus
agttctccaagagtgtcaccaagct

SEQ ID NO: 166013 - DNA, 25 bp, Rattus norvegicus
agttctcccatacgtgactggccac

SEQ ID NO: 166014 - DNA, 25 bp, Rattus norvegicus
agttctcccataggtgactggccac

SEQ ID NO: 166015 - DNA, 25 bp, Rattus norvegicus
agttctcccatcacgtgtacagata

SEQ ID NO: 166016 - DNA, 25 bp, Rattus norvegicus
agttctcccatctcgtgtacagata

SEQ ID NO: 166017 - DNA, 25 bp, Rattus norvegicus
agttctccccagaggcaaactgact

SEQ ID NO: 166018 - DNA, 25 bp, Rattus norvegicus
agttctccccagtggcaaactgact

SEQ ID NO: 166019 - DNA, 25 bp, Rattus norvegicus
agttctcccctaaatcacgtgaaat

SEQ ID NO: 166020 - DNA, 25 bp, Rattus norvegicus
agttctcccctatatcacgtgaaat

SEQ ID NO: 166021 - DNA, 25 bp, Rattus norvegicus
agttctccctctctcttgatagatc

SEQ ID NO: 166022 - DNA, 25 bp, Rattus norvegicus
agttctccctctgtcttgatagatc

SEQ ID NO: 166023 - DNA, 25 bp, Rattus norvegicus
agttctccctgacgaacggcatgta

SEQ ID NO: 166024 - DNA, 25 bp, Rattus norvegicus
agttctccctgaggaacggcatgta

SEQ ID NO: 166025 - DNA, 25 bp, Rattus norvegicus
agttctcctattcacggtcatactg

SEQ ID NO: 166026 - DNA, 25 bp, Rattus norvegicus
agttctcctattgacggtcatactg

SEQ ID NO: 166027 - DNA, 25 bp, Rattus norvegicus
agttctcctccaaaggaccctctat

SEQ ID NO: 166028 - DNA, 25 bp, Rattus norvegicus
agttctcctccataggaccctctat

SEQ ID NO: 166029 - DNA, 25 bp, Rattus norvegicus
agttctcctcccattagaaagcaca

SEQ ID NO: 166030 - DNA, 25 bp, Rattus norvegicus
agttctcctccctttagaaagcaca

SEQ ID NO: 166031 - DNA, 25 bp, Rattus norvegicus
agttctcctctcctttatttagaag

SEQ ID NO: 166032 - DNA, 25 bp, Rattus norvegicus
agttctcctctcgtttatttagaag

SEQ ID NO: 166033 - DNA, 25 bp, Rattus norvegicus
agttctcctgacctggagtctccag

SEQ ID NO: 166034 - DNA, 25 bp, Rattus norvegicus
agttctcctgacgtggagtctccag

SEQ ID NO: 166035 - DNA, 25 bp, Rattus norvegicus
agttctccttatctgctcctggtga

SEQ ID NO: 166036 - DNA, 25 bp, Rattus norvegicus
agttctccttatgtgctcctggtga

SEQ ID NO: 166037 - DNA, 25 bp, Rattus norvegicus
agttctcgatgacgtgtgcctcaag

SEQ ID NO: 166038 - DNA, 25 bp, Rattus norvegicus
agttctcgatgaggtgtgcctcaag

SEQ ID NO: 166039 - DNA, 25 bp, Rattus norvegicus
agttctcgtcaactggtgacatgaa

SEQ ID NO: 166040 - DNA, 25 bp, Rattus norvegicus
agttctcgtcaagtggtgacatgaa

SEQ ID NO: 166041 - DNA, 25 bp, Rattus norvegicus
agttctctacttactccagtgggta

SEQ ID NO: 166042 - DNA, 25 bp, Rattus norvegicus
agttctctactttctccagtgggta

SEQ ID NO: 166043 - DNA, 25 bp, Rattus norvegicus
agttctctcactaacttgccaagaa

SEQ ID NO: 166044 - DNA, 25 bp, Rattus norvegicus
agttctctcacttacttgccaagaa

SEQ ID NO: 166045 - DNA, 25 bp, Rattus norvegicus
agttctctcatgaccgtgtctcgag

SEQ ID NO: 166046 - DNA, 25 bp, Rattus norvegicus
agttctctcatgtccgtgtctcgag

SEQ ID NO: 166047 - DNA, 25 bp, Rattus norvegicus
agttctctcattatgttccagtcac

SEQ ID NO: 166048 - DNA, 25 bp, Rattus norvegicus
agttctctcattttgttccagtcac

SEQ ID NO: 166049 - DNA, 25 bp, Rattus norvegicus
agttctctcctgctgaggtggagca

SEQ ID NO: 166050 - DNA, 25 bp, Rattus norvegicus
agttctctcctggtgaggtggagca

SEQ ID NO: 166051 - DNA, 25 bp, Rattus norvegicus
agttctctccttctatcaagtgggt

SEQ ID NO: 166052 - DNA, 25 bp, Rattus norvegicus
agttctctccttgtatcaagtgggt

SEQ ID NO: 166053 - DNA, 25 bp, Rattus norvegicus
agttctctctacactgtcagccaaa

SEQ ID NO: 166054 - DNA, 25 bp, Rattus norvegicus
agttctctctactctgtcagccaaa

SEQ ID NO: 166055 - DNA, 25 bp, Rattus norvegicus
agttctctgaagatagctctacaca

SEQ ID NO: 166056 - DNA, 25 bp, Rattus norvegicus
agttctctgaagttagctctacaca

SEQ ID NO: 166057 - DNA, 25 bp, Rattus norvegicus
agttctctgataaagcctagctcat

SEQ ID NO: 166058 - DNA, 25 bp, Rattus norvegicus
agttctctgatatagcctagctcat

SEQ ID NO: 166059 - DNA, 25 bp, Rattus norvegicus
agttctctgctgaacctgtctggaa

SEQ ID NO: 166060 - DNA, 25 bp, Rattus norvegicus
agttctctgctgtacctgtctggaa

SEQ ID NO: 166061 - DNA, 25 bp, Rattus norvegicus
agttctctggtactctcaggcagtg

SEQ ID NO: 166062 - DNA, 25 bp, Rattus norvegicus
agttctctggtagtctcaggcagtg

SEQ ID NO: 166063 - DNA, 25 bp, Rattus norvegicus
agttctctggtgattttcttcttgt

SEQ ID NO: 166064 - DNA, 25 bp, Rattus norvegicus
agttctctggtgtttttcttcttgt

SEQ ID NO: 166065 - DNA, 25 bp, Rattus norvegicus
agttctctggttcagcctggaattc

SEQ ID NO: 166066 - DNA, 25 bp, Rattus norvegicus
agttctctggttgagcctggaattc

SEQ ID NO: 166067 - DNA, 25 bp, Rattus norvegicus
agttctctgtaaaactaacctgcca

SEQ ID NO: 166068 - DNA, 25 bp, Rattus norvegicus
agttctctgtaatactaacctgcca

SEQ ID NO: 166069 - DNA, 25 bp, Rattus norvegicus
agttctctgtatcttgctcatgcac

SEQ ID NO: 166070 - DNA, 25 bp, Rattus norvegicus
agttctctgtatgttgctcatgcac

SEQ ID NO: 166071 - DNA, 25 bp, Rattus norvegicus
agttctctgtctatatcagccacag

SEQ ID NO: 166072 - DNA, 25 bp, Rattus norvegicus
agttctctgtctttatcagccacag

SEQ ID NO: 166073 - DNA, 25 bp, Rattus norvegicus
agttctctgtgcctacgagggttag

SEQ ID NO: 166074 - DNA, 25 bp, Rattus norvegicus
agttctctgtgcgtacgagggttag

SEQ ID NO: 166075 - DNA, 25 bp, Rattus norvegicus
agttctcttactcaacacctgaatg

SEQ ID NO: 166076 - DNA, 25 bp, Rattus norvegicus
agttctcttactgaacacctgaatg

SEQ ID NO: 166077 - DNA, 25 bp, Rattus norvegicus
agttctcttcagactgtagtctggg

SEQ ID NO: 166078 - DNA, 25 bp, Rattus norvegicus
agttctcttcagtctgtagtctggg

SEQ ID NO: 166079 - DNA, 25 bp, Rattus norvegicus
agttctcttgtaccatgatgacccc

SEQ ID NO: 166080 - DNA, 25 bp, Rattus norvegicus
agttctcttgtagcatgatgacccc

SEQ ID NO: 166081 - DNA, 25 bp, Rattus norvegicus
agttctctttcacctattgttggtg

SEQ ID NO: 166082 - DNA, 25 bp, Rattus norvegicus
agttctctttcagctattgttggtg

SEQ ID NO: 166083 - DNA, 25 bp, Rattus norvegicus
agttctctttccctgtcataaatgt

SEQ ID NO: 166084 - DNA, 25 bp, Rattus norvegicus
agttctctttccgtgtcataaatgt

SEQ ID NO: 166085 - DNA, 25 bp, Rattus norvegicus
agttctcttttccttgatttctcag

SEQ ID NO: 166086 - DNA, 25 bp, Rattus norvegicus
agttctcttttcgttgatttctcag

SEQ ID NO: 166087 - DNA, 25 bp, Rattus norvegicus
agttctgaaaatcatgccagtgcag

SEQ ID NO: 166088 - DNA, 25 bp, Rattus norvegicus
agttctgaaaatgatgccagtgcag

SEQ ID NO: 166089 - DNA, 25 bp, Rattus norvegicus
agttctgaaccccagagtggccggc

SEQ ID NO: 166090 - DNA, 25 bp, Rattus norvegicus
agttctgaacccgagagtggccggc

SEQ ID NO: 166091 - DNA, 25 bp, Rattus norvegicus
agttctgaatggatttgcctctctg

SEQ ID NO: 166092 - DNA, 25 bp, Rattus norvegicus
agttctgaatggttttgcctctctg

SEQ ID NO: 166093 - DNA, 25 bp, Rattus norvegicus
agttctgaatgtactttggcttctt

SEQ ID NO: 166094 - DNA, 25 bp, Rattus norvegicus
agttctgaatgttctttggcttctt

SEQ ID NO: 166095 - DNA, 25 bp, Rattus norvegicus
agttctgacagtcataaccgatatc

SEQ ID NO: 166096 - DNA, 25 bp, Rattus norvegicus
agttctgacagtgataaccgatatc

SEQ ID NO: 166097 - DNA, 25 bp, Rattus norvegicus
agttctgaccgtatttatccttctg

SEQ ID NO: 166098 - DNA, 25 bp, Rattus norvegicus
agttctgaccgtttttatccttctg

SEQ ID NO: 166099 - DNA, 25 bp, Rattus norvegicus
agttctgacctgcaattgggcctct

SEQ ID NO: 166100 - DNA, 25 bp, Rattus norvegicus
agttctgacctggaattgggcctct

SEQ ID NO: 166101 - DNA, 25 bp, Rattus norvegicus
agttctgagacaacgcctggatgca

SEQ ID NO: 166102 - DNA, 25 bp, Rattus norvegicus
agttctgagacatcgcctggatgca

SEQ ID NO: 166103 - DNA, 25 bp, Rattus norvegicus
agttctgagcccatattgtataaat

SEQ ID NO: 166104 - DNA, 25 bp, Rattus norvegicus
agttctgagcccttattgtataaat

SEQ ID NO: 166105 - DNA, 25 bp, Rattus norvegicus
agttctgagctgaaatttcgcctta

SEQ ID NO: 166106 - DNA, 25 bp, Rattus norvegicus
agttctgagctgtaatttcgcctta

SEQ ID NO: 166107 - DNA, 25 bp, Rattus norvegicus
agttctgaggagatggactctcgtt

SEQ ID NO: 166108 - DNA, 25 bp, Rattus norvegicus
agttctgaggagttggactctcgtt

SEQ ID NO: 166109 - DNA, 25 bp, Rattus norvegicus
agttctgaggcacctagaccaggga

SEQ ID NO: 166110 - DNA, 25 bp, Rattus norvegicus
agttctgaggcagctagaccaggga

SEQ ID NO: 166111 - DNA, 25 bp, Rattus norvegicus
agttctgaggctaaccttaccatct

SEQ ID NO: 166112 - DNA, 25 bp, Rattus norvegicus
agttctgaggcttaccttaccatct

SEQ ID NO: 166113 - DNA, 25 bp, Rattus norvegicus
agttctgagggcagtggttcaaaca

SEQ ID NO: 166114 - DNA, 25 bp, Rattus norvegicus
agttctgagggcctactttcaggca

SEQ ID NO: 166115 - DNA, 25 bp, Rattus norvegicus
agttctgagggcgtactttcaggca

SEQ ID NO: 166116 - DNA, 25 bp, Rattus norvegicus
agttctgagggctgtggttcaaaca

SEQ ID NO: 166117 - DNA, 25 bp, Rattus norvegicus
agttctgagtctctcaacgctgtgt

SEQ ID NO: 166118 - DNA, 25 bp, Rattus norvegicus
agttctgagtctgtcaacgctgtgt

SEQ ID NO: 166119 - DNA, 25 bp, Rattus norvegicus
agttctgagttactttcccgtgtcg

SEQ ID NO: 166120 - DNA, 25 bp, Rattus norvegicus
agttctgagttagtttcccgtgtcg

SEQ ID NO: 166121 - DNA, 25 bp, Rattus norvegicus
agttctgatacaacctgggagctcc

SEQ ID NO: 166122 - DNA, 25 bp, Rattus norvegicus
agttctgatacatcctgggagctcc

SEQ ID NO: 166123 - DNA, 25 bp, Rattus norvegicus
agttctgcaaccctgtgtgccattg

SEQ ID NO: 166124 - DNA, 25 bp, Rattus norvegicus
agttctgcaaccgtgtgtgccattg

SEQ ID NO: 166125 - DNA, 25 bp, Rattus norvegicus
agttctgcaaggagctggcggccat

SEQ ID NO: 166126 - DNA, 25 bp, Rattus norvegicus
agttctgcaaggtgctggcggccat

SEQ ID NO: 166127 - DNA, 25 bp, Rattus norvegicus
agttctgcacaccttgctggtgatt

SEQ ID NO: 166128 - DNA, 25 bp, Rattus norvegicus
agttctgcacacgttgctggtgatt

SEQ ID NO: 166129 - DNA, 25 bp, Rattus norvegicus
agttctgcactgactccaggagtat

SEQ ID NO: 166130 - DNA, 25 bp, Rattus norvegicus
agttctgcactgtctccaggagtat

SEQ ID NO: 166131 - DNA, 25 bp, Rattus norvegicus
agttctgcacttctgttaggttaaa

SEQ ID NO: 166132 - DNA, 25 bp, Rattus norvegicus
agttctgcacttgtgttaggttaaa

SEQ ID NO: 166133 - DNA, 25 bp, Rattus norvegicus
agttctgcaggtcccttctcagaga

SEQ ID NO: 166134 - DNA, 25 bp, Rattus norvegicus
agttctgcaggtgccttctcagaga

SEQ ID NO: 166135 - DNA, 25 bp, Rattus norvegicus
agttctgcatagagctttgcgagca

SEQ ID NO: 166136 - DNA, 25 bp, Rattus norvegicus
agttctgcatagtgctttgcgagca

SEQ ID NO: 166137 - DNA, 25 bp, Rattus norvegicus
agttctgcattactaacctcatccc

SEQ ID NO: 166138 - DNA, 25 bp, Rattus norvegicus
agttctgcattagtaacctcatccc

SEQ ID NO: 166139 - DNA, 25 bp, Rattus norvegicus
agttctgccaaaagctaacggccct

SEQ ID NO: 166140 - DNA, 25 bp, Rattus norvegicus
agttctgccaaatgctaacggccct

SEQ ID NO: 166141 - DNA, 25 bp, Rattus norvegicus
agttctgccagtatacagttcttgg

SEQ ID NO: 166142 - DNA, 25 bp, Rattus norvegicus
agttctgccagtttacagttcttgg

SEQ ID NO: 166143 - DNA, 25 bp, Rattus norvegicus
agttctgcccaacactcagttgttt

SEQ ID NO: 166144 - DNA, 25 bp, Rattus norvegicus
agttctgcccaagactcagttgttt

SEQ ID NO: 166145 - DNA, 25 bp, Rattus norvegicus
agttctgccgaacgaactgtccctt

SEQ ID NO: 166146 - DNA, 25 bp, Rattus norvegicus
agttctgccgaaggaactgtccctt

SEQ ID NO: 166147 - DNA, 25 bp, Rattus norvegicus
agttctgcctttacttcttaggagc

SEQ ID NO: 166148 - DNA, 25 bp, Rattus norvegicus
agttctgccttttcttcttaggagc

SEQ ID NO: 166149 - DNA, 25 bp, Rattus norvegicus
agttctgcgaaacttcttcctgcga

SEQ ID NO: 166150 - DNA, 25 bp, Rattus norvegicus
agttctgcgaaagttcttcctgcga

SEQ ID NO: 166151 - DNA, 25 bp, Rattus norvegicus
agttctgctgagcttactgccttac

SEQ ID NO: 166152 - DNA, 25 bp, Rattus norvegicus
agttctgctgaggttactgccttac

SEQ ID NO: 166153 - DNA, 25 bp, Rattus norvegicus
agttctgctgggactggatatcgag

SEQ ID NO: 166154 - DNA, 25 bp, Rattus norvegicus
agttctgctgggtctggatatcgag

SEQ ID NO: 166155 - DNA, 25 bp, Rattus norvegicus
agttctgctgttcaggcctaaatcc

SEQ ID NO: 166156 - DNA, 25 bp, Rattus norvegicus
agttctgctgttgaggcctaaatcc

SEQ ID NO: 166157 - DNA, 25 bp, Rattus norvegicus
agttctgcttctccggattgatgac

SEQ ID NO: 166158 - DNA, 25 bp, Rattus norvegicus
agttctgcttctgcggattgatgac

SEQ ID NO: 166159 - DNA, 25 bp, Rattus norvegicus
agttctgcttgcatctttggcaaaa

SEQ ID NO: 166160 - DNA, 25 bp, Rattus norvegicus
agttctgcttgcttctttggcaaaa

SEQ ID NO: 166161 - DNA, 25 bp, Rattus norvegicus
agttctgctttgctctggccaatta

SEQ ID NO: 166162 - DNA, 25 bp, Rattus norvegicus
agttctgctttggtctggccaatta

SEQ ID NO: 166163 - DNA, 25 bp, Rattus norvegicus
agttctggaacgctgttactatcta

SEQ ID NO: 166164 - DNA, 25 bp, Rattus norvegicus
agttctggaacggtgttactatcta

SEQ ID NO: 166165 - DNA, 25 bp, Rattus norvegicus
agttctggcagaaaaccgtgttctt

SEQ ID NO: 166166 - DNA, 25 bp, Rattus norvegicus
agttctggcagataaccgtgttctt

SEQ ID NO: 166167 - DNA, 25 bp, Rattus norvegicus
agttctggcagcatttgggatgaca

SEQ ID NO: 166168 - DNA, 25 bp, Rattus norvegicus
agttctggcagcttttgggatgaca

SEQ ID NO: 166169 - DNA, 25 bp, Rattus norvegicus
agttctggcatcacgtgcacggact

SEQ ID NO: 166170 - DNA, 25 bp, Rattus norvegicus
agttctggcatctcgtgcacggact

SEQ ID NO: 166171 - DNA, 25 bp, Rattus norvegicus
agttctggccaaattctccaggcat

SEQ ID NO: 166172 - DNA, 25 bp, Rattus norvegicus
agttctggccaatttctccaggcat

SEQ ID NO: 166173 - DNA, 25 bp, Rattus norvegicus
agttctgggacacccaagactatat

SEQ ID NO: 166174 - DNA, 25 bp, Rattus norvegicus
agttctgggacagccaagactatat

SEQ ID NO: 166175 - DNA, 25 bp, Rattus norvegicus
agttctgggagcagggcagttcaca

SEQ ID NO: 166176 - DNA, 25 bp, Rattus norvegicus
agttctgggagctgggcagttcaca

SEQ ID NO: 166177 - DNA, 25 bp, Rattus norvegicus
agttctgggattacgtgcatgttgc

SEQ ID NO: 166178 - DNA, 25 bp, Rattus norvegicus
agttctgggatttcgtgcatgttgc

SEQ ID NO: 166179 - DNA, 25 bp, Rattus norvegicus
agttctgggtcactgcacacatcta

SEQ ID NO: 166180 - DNA, 25 bp, Rattus norvegicus
agttctgggtcagtgcacacatcta

SEQ ID NO: 166181 - DNA, 25 bp, Rattus norvegicus
agttctgggttgacctgtaagtgct

SEQ ID NO: 166182 - DNA, 25 bp, Rattus norvegicus
agttctgggttgtcctgtaagtgct

SEQ ID NO: 166183 - DNA, 25 bp, Rattus norvegicus
agttctggtctcattgattgcccca

SEQ ID NO: 166184 - DNA, 25 bp, Rattus norvegicus
agttctggtctcctcattttatttc

SEQ ID NO: 166185 - DNA, 25 bp, Rattus norvegicus
agttctggtctcgtcattttatttc

SEQ ID NO: 166186 - DNA, 25 bp, Rattus norvegicus
agttctggtctctttgattgcccca

SEQ ID NO: 166187 - DNA, 25 bp, Rattus norvegicus
agttctggtgttagagctgagctgt

SEQ ID NO: 166188 - DNA, 25 bp, Rattus norvegicus
agttctggtgtttgagctgagctgt

SEQ ID NO: 166189 - DNA, 25 bp, Rattus norvegicus
agttctgtagtgctcccacagtaat

SEQ ID NO: 166190 - DNA, 25 bp, Rattus norvegicus
agttctgtagtggtcccacagtaat

SEQ ID NO: 166191 - DNA, 25 bp, Rattus norvegicus
agttctgtatcgcagctgagctgaa

SEQ ID NO: 166192 - DNA, 25 bp, Rattus norvegicus
agttctgtatcggagctgagctgaa

SEQ ID NO: 166193 - DNA, 25 bp, Rattus norvegicus
agttctgtatttctctcctaagcca

SEQ ID NO: 166194 - DNA, 25 bp, Rattus norvegicus
agttctgtatttgtctcctaagcca

SEQ ID NO: 166195 - DNA, 25 bp, Rattus norvegicus
agttctgtcagacctgcccttgcag

SEQ ID NO: 166196 - DNA, 25 bp, Rattus norvegicus
agttctgtcagagctgcccttgcag

SEQ ID NO: 166197 - DNA, 25 bp, Rattus norvegicus
agttctgtccggcagagcttctccg

SEQ ID NO: 166198 - DNA, 25 bp, Rattus norvegicus
agttctgtccgggagagcttctccg

SEQ ID NO: 166199 - DNA, 25 bp, Rattus norvegicus
agttctgtcgggactgcagggctat

SEQ ID NO: 166200 - DNA, 25 bp, Rattus norvegicus
agttctgtcgggtctgcagggctat

SEQ ID NO: 166201 - DNA, 25 bp, Rattus norvegicus
agttctgtctctaaccatgttgtga

SEQ ID NO: 166202 - DNA, 25 bp, Rattus norvegicus
agttctgtctctatttctctttgta

SEQ ID NO: 166203 - DNA, 25 bp, Rattus norvegicus
agttctgtctcttaccatgttgtga

SEQ ID NO: 166204 - DNA, 25 bp, Rattus norvegicus
agttctgtctctttttctctttgta

SEQ ID NO: 166205 - DNA, 25 bp, Rattus norvegicus
agttctgtcttgaccttgctgagga

SEQ ID NO: 166206 - DNA, 25 bp, Rattus norvegicus
agttctgtcttgtccttgctgagga

SEQ ID NO: 166207 - DNA, 25 bp, Rattus norvegicus
agttctgtgactccgtttctacagc

SEQ ID NO: 166208 - DNA, 25 bp, Rattus norvegicus
agttctgtgactgcgtttctacagc

SEQ ID NO: 166209 - DNA, 25 bp, Rattus norvegicus
agttctgtgagcattggtgcttgtc

SEQ ID NO: 166210 - DNA, 25 bp, Rattus norvegicus
agttctgtgagctttggtgcttgtc

SEQ ID NO: 166211 - DNA, 25 bp, Rattus norvegicus
agttctgtgattagcagttgcccgg

SEQ ID NO: 166212 - DNA, 25 bp, Rattus norvegicus
agttctgtgatttgcagttgcccgg

SEQ ID NO: 166213 - DNA, 25 bp, Rattus norvegicus
agttctgtgggaagtcacctccagg

SEQ ID NO: 166214 - DNA, 25 bp, Rattus norvegicus
agttctgtgggatgtcacctccagg

SEQ ID NO: 166215 - DNA, 25 bp, Rattus norvegicus
agttctgtggtaagtgagatccagc

SEQ ID NO: 166216 - DNA, 25 bp, Rattus norvegicus
agttctgtggtatgtgagatccagc

SEQ ID NO: 166217 - DNA, 25 bp, Rattus norvegicus
agttctgtgtacagttcttgtaaca

SEQ ID NO: 166218 - DNA, 25 bp, Rattus norvegicus
agttctgtgtactgttcttgtaaca

SEQ ID NO: 166219 - DNA, 25 bp, Rattus norvegicus
agttctgtgtggatttgctgagcct

SEQ ID NO: 166220 - DNA, 25 bp, Rattus norvegicus
agttctgtgtggttttgctgagcct

SEQ ID NO: 166221 - DNA, 25 bp, Rattus norvegicus
agttctgtgtgtccctatcgtgcga

SEQ ID NO: 166222 - DNA, 25 bp, Rattus norvegicus
agttctgtgtgtgcctatcgtgcga

SEQ ID NO: 166223 - DNA, 25 bp, Rattus norvegicus
agttctgtgttcacatggtcctcgg

SEQ ID NO: 166224 - DNA, 25 bp, Rattus norvegicus
agttctgtgttctcatggtcctcgg

SEQ ID NO: 166225 - DNA, 25 bp, Rattus norvegicus
agttctgttaggaggcctcttgttg

SEQ ID NO: 166226 - DNA, 25 bp, Rattus norvegicus
agttctgttaggtggcctcttgttg

SEQ ID NO: 166227 - DNA, 25 bp, Rattus norvegicus
agttctgttctgaattctgtgtttt

SEQ ID NO: 166228 - DNA, 25 bp, Rattus norvegicus
agttctgttctgtattctgtgtttt

SEQ ID NO: 166229 - DNA, 25 bp, Rattus norvegicus
agttctgttcttacaacacatggaa

SEQ ID NO: 166230 - DNA, 25 bp, Rattus norvegicus
agttctgttctttcaacacatggaa

SEQ ID NO: 166231 - DNA, 25 bp, Rattus norvegicus
agttctgtttgcaaaggatccgcca

SEQ ID NO: 166232 - DNA, 25 bp, Rattus norvegicus
agttctgtttgctaaggatccgcca

SEQ ID NO: 166233 - DNA, 25 bp, Rattus norvegicus
agttctgttttgatactatgctgca

SEQ ID NO: 166234 - DNA, 25 bp, Rattus norvegicus
agttctgttttgttactatgctgca

SEQ ID NO: 166235 - DNA, 25 bp, Rattus norvegicus
agttcttaactactacaggccacaa

SEQ ID NO: 166236 - DNA, 25 bp, Rattus norvegicus
agttcttaactagtacaggccacaa

SEQ ID NO: 166237 - DNA, 25 bp, Rattus norvegicus
agttcttaagcaatagctatcgttg

SEQ ID NO: 166238 - DNA, 25 bp, Rattus norvegicus
agttcttaagcattagctatcgttg

SEQ ID NO: 166239 - DNA, 25 bp, Rattus norvegicus
agttcttacatcagcatacccacaa

SEQ ID NO: 166240 - DNA, 25 bp, Rattus norvegicus
agttcttacatctgcatacccacaa

SEQ ID NO: 166241 - DNA, 25 bp, Rattus norvegicus
agttcttaccaacctgaggctaatg

SEQ ID NO: 166242 - DNA, 25 bp, Rattus norvegicus
agttcttaccaagctgaggctaatg

SEQ ID NO: 166243 - DNA, 25 bp, Rattus norvegicus
agttcttaccttaatgcgctgacag

SEQ ID NO: 166244 - DNA, 25 bp, Rattus norvegicus
agttcttacctttatgcgctgacag

SEQ ID NO: 166245 - DNA, 25 bp, Rattus norvegicus
agttcttactctccacagtttcagg

SEQ ID NO: 166246 - DNA, 25 bp, Rattus norvegicus
agttcttactctcgtggcattgcac

SEQ ID NO: 166247 - DNA, 25 bp, Rattus norvegicus
agttcttactctgcacagtttcagg

SEQ ID NO: 166248 - DNA, 25 bp, Rattus norvegicus
agttcttactctggtggcattgcac

SEQ ID NO: 166249 - DNA, 25 bp, Rattus norvegicus
agttcttagagtagttagcctgggt

SEQ ID NO: 166250 - DNA, 25 bp, Rattus norvegicus
agttcttagagttgttagcctgggt

SEQ ID NO: 166251 - DNA, 25 bp, Rattus norvegicus
agttcttagtgaacctctcatgtcc

SEQ ID NO: 166252 - DNA, 25 bp, Rattus norvegicus
agttcttagtgatcctctcatgtcc

SEQ ID NO: 166253 - DNA, 25 bp, Rattus norvegicus
agttcttagtgtccgagaagccctt

SEQ ID NO: 166254 - DNA, 25 bp, Rattus norvegicus
agttcttagtgtgcgagaagccctt

SEQ ID NO: 166255 - DNA, 25 bp, Rattus norvegicus
agttcttagttcatcaccagtgacc

SEQ ID NO: 166256 - DNA, 25 bp, Rattus norvegicus
agttcttagttcttcaccagtgacc

SEQ ID NO: 166257 - DNA, 25 bp, Rattus norvegicus
agttcttattccaaccatactacca

SEQ ID NO: 166258 - DNA, 25 bp, Rattus norvegicus
agttcttattcccattctgctgctg

SEQ ID NO: 166259 - DNA, 25 bp, Rattus norvegicus
agttcttattccgattctgctgctg

SEQ ID NO: 166260 - DNA, 25 bp, Rattus norvegicus
agttcttattcctaccatactacca

SEQ ID NO: 166261 - DNA, 25 bp, Rattus norvegicus
agttcttcaaccaaaaagcagccta

SEQ ID NO: 166262 - DNA, 25 bp, Rattus norvegicus
agttcttcaacctaaaagcagccta

SEQ ID NO: 166263 - DNA, 25 bp, Rattus norvegicus
agttcttcacgtaagctgtagcagt

SEQ ID NO: 166264 - DNA, 25 bp, Rattus norvegicus
agttcttcacgttagctgtagcagt

SEQ ID NO: 166265 - DNA, 25 bp, Rattus norvegicus
agttcttcagagaccttgactttga

SEQ ID NO: 166266 - DNA, 25 bp, Rattus norvegicus
agttcttcagagtccttgactttga

SEQ ID NO: 166267 - DNA, 25 bp, Rattus norvegicus
agttcttcagatattgagcgcccga

SEQ ID NO: 166268 - DNA, 25 bp, Rattus norvegicus
agttcttcagattttgagcgcccga

SEQ ID NO: 166269 - DNA, 25 bp, Rattus norvegicus
agttcttcagcccatccagatatac

SEQ ID NO: 166270 - DNA, 25 bp, Rattus norvegicus
agttcttcagccgatccagatatac

SEQ ID NO: 166271 - DNA, 25 bp, Rattus norvegicus
agttcttcagctacaacatcatact

SEQ ID NO: 166272 - DNA, 25 bp, Rattus norvegicus
agttcttcagcttcaacatcatact

SEQ ID NO: 166273 - DNA, 25 bp, Rattus norvegicus
agttcttcagggaccagggccggca

SEQ ID NO: 166274 - DNA, 25 bp, Rattus norvegicus
agttcttcagggtccagggccggca

SEQ ID NO: 166275 - DNA, 25 bp, Rattus norvegicus
agttcttcagttcaagtcccagttc

SEQ ID NO: 166276 - DNA, 25 bp, Rattus norvegicus
agttcttcagttgaagtcccagttc

SEQ ID NO: 166277 - DNA, 25 bp, Rattus norvegicus
agttcttcatcaccaggaatatcag

SEQ ID NO: 166278 - DNA, 25 bp, Rattus norvegicus
agttcttcatcagcaggaatatcag

SEQ ID NO: 166279 - DNA, 25 bp, Rattus norvegicus
agttcttccattattctctttgtgt

SEQ ID NO: 166280 - DNA, 25 bp, Rattus norvegicus
agttcttccatttttctctttgtgt

SEQ ID NO: 166281 - DNA, 25 bp, Rattus norvegicus
agttcttccctgagtacttcagaat

SEQ ID NO: 166282 - DNA, 25 bp, Rattus norvegicus
agttcttccctgtgtacttcagaat

SEQ ID NO: 166283 - DNA, 25 bp, Rattus norvegicus
agttcttccgccagggtgacaagga

SEQ ID NO: 166284 - DNA, 25 bp, Rattus norvegicus
agttcttccgcctgggtgacaagga

SEQ ID NO: 166285 - DNA, 25 bp, Rattus norvegicus
agttcttcctttcaactctagtgac

SEQ ID NO: 166286 - DNA, 25 bp, Rattus norvegicus
agttcttcctttgaactctagtgac

SEQ ID NO: 166287 - DNA, 25 bp, Rattus norvegicus
agttcttcgaggcagctgattattt

SEQ ID NO: 166288 - DNA, 25 bp, Rattus norvegicus
agttcttcgagggagctgattattt

SEQ ID NO: 166289 - DNA, 25 bp, Rattus norvegicus
agttcttcgtttaaaatatgctcac

SEQ ID NO: 166290 - DNA, 25 bp, Rattus norvegicus
agttcttcgttttaaatatgctcac

SEQ ID NO: 166291 - DNA, 25 bp, Rattus norvegicus
agttcttctactaagtttcccagca

SEQ ID NO: 166292 - DNA, 25 bp, Rattus norvegicus
agttcttctacttagtttcccagca

SEQ ID NO: 166293 - DNA, 25 bp, Rattus norvegicus
agttcttctcgtacatctagtctat

SEQ ID NO: 166294 - DNA, 25 bp, Rattus norvegicus
agttcttctcgttcatctagtctat

SEQ ID NO: 166295 - DNA, 25 bp, Rattus norvegicus
agttcttctcttctttacatctagc

SEQ ID NO: 166296 - DNA, 25 bp, Rattus norvegicus
agttcttctcttgtttacatctagc

SEQ ID NO: 166297 - DNA, 25 bp, Rattus norvegicus
agttcttctgcccaccgtatagata

SEQ ID NO: 166298 - DNA, 25 bp, Rattus norvegicus
agttcttctgccgaccgtatagata

SEQ ID NO: 166299 - DNA, 25 bp, Rattus norvegicus
agttcttctggcaattaacctttga

SEQ ID NO: 166300 - DNA, 25 bp, Rattus norvegicus
agttcttctggctattaacctttga

SEQ ID NO: 166301 - DNA, 25 bp, Rattus norvegicus
agttcttctgttccgttgcgaaaag

SEQ ID NO: 166302 - DNA, 25 bp, Rattus norvegicus
agttcttctgttgcgttgcgaaaag

SEQ ID NO: 166303 - DNA, 25 bp, Rattus norvegicus
agttcttgagccagacctagagtcc

SEQ ID NO: 166304 - DNA, 25 bp, Rattus norvegicus
agttcttgagcctgacctagagtcc

SEQ ID NO: 166305 - DNA, 25 bp, Rattus norvegicus
agttcttgaggccttgtgggacaac

SEQ ID NO: 166306 - DNA, 25 bp, Rattus norvegicus
agttcttgaggcgttgtgggacaac

SEQ ID NO: 166307 - DNA, 25 bp, Rattus norvegicus
agttcttgctataccgtggactgta

SEQ ID NO: 166308 - DNA, 25 bp, Rattus norvegicus
agttcttgctattccgtggactgta

SEQ ID NO: 166309 - DNA, 25 bp, Rattus norvegicus
agttcttgctgccacaggcaggtcc

SEQ ID NO: 166310 - DNA, 25 bp, Rattus norvegicus
agttcttgctgcgacaggcaggtcc

SEQ ID NO: 166311 - DNA, 25 bp, Rattus norvegicus
agttcttgtgctctactttgtgcgt

SEQ ID NO: 166312 - DNA, 25 bp, Rattus norvegicus
agttcttgtgctgtactttgtgcgt

SEQ ID NO: 166313 - DNA, 25 bp, Rattus norvegicus
agttcttgttatctcttgtctctaa

SEQ ID NO: 166314 - DNA, 25 bp, Rattus norvegicus
agttcttgttatgtcttgtctctaa

SEQ ID NO: 166315 - DNA, 25 bp, Rattus norvegicus
agttctttaaccagggactctcagc

SEQ ID NO: 166316 - DNA, 25 bp, Rattus norvegicus
agttctttaacctgggactctcagc

SEQ ID NO: 166317 - DNA, 25 bp, Rattus norvegicus
agttctttactgctgtctgtggtgc

SEQ ID NO: 166318 - DNA, 25 bp, Rattus norvegicus
agttctttactggtgtctgtggtgc

SEQ ID NO: 166319 - DNA, 25 bp, Rattus norvegicus
agttctttagccactgtctgctggt

SEQ ID NO: 166320 - DNA, 25 bp, Rattus norvegicus
agttctttagcctctgtctgctggt

SEQ ID NO: 166321 - DNA, 25 bp, Rattus norvegicus
agttctttcaccagcagggaacagt

SEQ ID NO: 166322 - DNA, 25 bp, Rattus norvegicus
agttctttcacctgcagggaacagt

SEQ ID NO: 166323 - DNA, 25 bp, Rattus norvegicus
agttctttcagacggcagcttgcac

SEQ ID NO: 166324 - DNA, 25 bp, Rattus norvegicus
agttctttcagagggcagcttgcac

SEQ ID NO: 166325 - DNA, 25 bp, Rattus norvegicus
agttctttccaaaatgtcttcattt

SEQ ID NO: 166326 - DNA, 25 bp, Rattus norvegicus
agttctttccaatatgtcttcattt

SEQ ID NO: 166327 - DNA, 25 bp, Rattus norvegicus
agttctttcccgaagcaggagacag

SEQ ID NO: 166328 - DNA, 25 bp, Rattus norvegicus
agttctttcccgtagcaggagacag

SEQ ID NO: 166329 - DNA, 25 bp, Rattus norvegicus
agttctttctacacatctagccgtc

SEQ ID NO: 166330 - DNA, 25 bp, Rattus norvegicus
agttctttctactcatctagccgtc

SEQ ID NO: 166331 - DNA, 25 bp, Rattus norvegicus
agttctttcttaatgcagtgtcctg

SEQ ID NO: 166332 - DNA, 25 bp, Rattus norvegicus
agttctttcttattgcagtgtcctg

SEQ ID NO: 166333 - DNA, 25 bp, Rattus norvegicus
agttctttcttcagctgctgcccag

SEQ ID NO: 166334 - DNA, 25 bp, Rattus norvegicus
agttctttcttctgctgctgcccag

SEQ ID NO: 166335 - DNA, 25 bp, Rattus norvegicus
agttctttgcaaatctgttccttcc

SEQ ID NO: 166336 - DNA, 25 bp, Rattus norvegicus
agttctttgcaattctgttccttcc

SEQ ID NO: 166337 - DNA, 25 bp, Rattus norvegicus
agttctttgcttagaatcccctagg

SEQ ID NO: 166338 - DNA, 25 bp, Rattus norvegicus
agttctttgctttgaatcccctagg

SEQ ID NO: 166339 - DNA, 25 bp, Rattus norvegicus
agttctttgtgccacatgccgggag

SEQ ID NO: 166340 - DNA, 25 bp, Rattus norvegicus
agttctttgtgcgacatgccgggag

SEQ ID NO: 166341 - DNA, 25 bp, Rattus norvegicus
agttcttttacgcatcatcgctcac

SEQ ID NO: 166342 - DNA, 25 bp, Rattus norvegicus
agttcttttacggatcatcgctcac

SEQ ID NO: 166343 - DNA, 25 bp, Rattus norvegicus
agttcttttccaactgcactgtgga

SEQ ID NO: 166344 - DNA, 25 bp, Rattus norvegicus
agttcttttccatctgcactgtgga

SEQ ID NO: 166345 - DNA, 25 bp, Rattus norvegicus
agttcttttgaacctgatcctcagt

SEQ ID NO: 166346 - DNA, 25 bp, Rattus norvegicus
agttcttttgaagctgatcctcagt

SEQ ID NO: 166347 - DNA, 25 bp, Rattus norvegicus
agttcttttgttacccatgactgca

SEQ ID NO: 166348 - DNA, 25 bp, Rattus norvegicus
agttcttttgtttcccatgactgca

SEQ ID NO: 166349 - DNA, 25 bp, Rattus norvegicus
agttgaaacctcaacttgactttgt

SEQ ID NO: 166350 - DNA, 25 bp, Rattus norvegicus
agttgaaacctctacttgactttgt

SEQ ID NO: 166351 - DNA, 25 bp, Rattus norvegicus
agttgaaagcttcctcttgacctct

SEQ ID NO: 166352 - DNA, 25 bp, Rattus norvegicus
agttgaaagcttgctcttgacctct

SEQ ID NO: 166353 - DNA, 25 bp, Rattus norvegicus
agttgaaaggtccagccaggcattt

SEQ ID NO: 166354 - DNA, 25 bp, Rattus norvegicus
agttgaaaggtcgagccaggcattt

SEQ ID NO: 166355 - DNA, 25 bp, Rattus norvegicus
agttgaaagtgcagaaacacgacag

SEQ ID NO: 166356 - DNA, 25 bp, Rattus norvegicus
agttgaaagtgctgaaacacgacag

SEQ ID NO: 166357 - DNA, 25 bp, Rattus norvegicus
agttgaaagttacagccagcccaga

SEQ ID NO: 166358 - DNA, 25 bp, Rattus norvegicus
agttgaaagttagagccagcccaga

SEQ ID NO: 166359 - DNA, 25 bp, Rattus norvegicus
agttgaaatgtccactcccactctg

SEQ ID NO: 166360 - DNA, 25 bp, Rattus norvegicus
agttgaaatgtcgactcccactctg

SEQ ID NO: 166361 - DNA, 25 bp, Rattus norvegicus
agttgaaattctctgcgtacctgga

SEQ ID NO: 166362 - DNA, 25 bp, Rattus norvegicus
agttgaaattctgtgcgtacctgga

SEQ ID NO: 166363 - DNA, 25 bp, Rattus norvegicus
agttgaacaactctccccggaagag

SEQ ID NO: 166364 - DNA, 25 bp, Rattus norvegicus
agttgaacaactgtccccggaagag

SEQ ID NO: 166365 - DNA, 25 bp, Rattus norvegicus
agttgaacagttagcatacctagaa

SEQ ID NO: 166366 - DNA, 25 bp, Rattus norvegicus
agttgaacagtttgcatacctagaa

SEQ ID NO: 166367 - DNA, 25 bp, Rattus norvegicus
agttgaacatgcattccgtttgtaa

SEQ ID NO: 166368 - DNA, 25 bp, Rattus norvegicus
agttgaacatgctttccgtttgtaa

SEQ ID NO: 166369 - DNA, 25 bp, Rattus norvegicus
agttgaaccaggctgtctctgcttc

SEQ ID NO: 166370 - DNA, 25 bp, Rattus norvegicus
agttgaaccagggtgtctctgcttc

SEQ ID NO: 166371 - DNA, 25 bp, Rattus norvegicus
agttgaaccataaccattggtgatt

SEQ ID NO: 166372 - DNA, 25 bp, Rattus norvegicus
agttgaaccatatccattggtgatt

SEQ ID NO: 166373 - DNA, 25 bp, Rattus norvegicus
agttgaaccccaattgcatcagcag

SEQ ID NO: 166374 - DNA, 25 bp, Rattus norvegicus
agttgaaccccatttgcatcagcag

SEQ ID NO: 166375 - DNA, 25 bp, Rattus norvegicus
agttgaacgagtatcgcctggacga

SEQ ID NO: 166376 - DNA, 25 bp, Rattus norvegicus
agttgaacgagtttcgcctggacga

SEQ ID NO: 166377 - DNA, 25 bp, Rattus norvegicus
agttgaacggccactgtttcagtag

SEQ ID NO: 166378 - DNA, 25 bp, Rattus norvegicus
agttgaacggcctctgtttcagtag

SEQ ID NO: 166379 - DNA, 25 bp, Rattus norvegicus
agttgaactcttagtttctgtgtaa

SEQ ID NO: 166380 - DNA, 25 bp, Rattus norvegicus
agttgaactctttgtttctgtgtaa

SEQ ID NO: 166381 - DNA, 25 bp, Rattus norvegicus
agttgaactgtgcttagagcctcag

SEQ ID NO: 166382 - DNA, 25 bp, Rattus norvegicus
agttgaactgtggttagagcctcag

SEQ ID NO: 166383 - DNA, 25 bp, Rattus norvegicus
agttgaactttgaactggtcacagt

SEQ ID NO: 166384 - DNA, 25 bp, Rattus norvegicus
agttgaactttgtactggtcacagt

SEQ ID NO: 166385 - DNA, 25 bp, Rattus norvegicus
agttgaagattgactgcctggatca

SEQ ID NO: 166386 - DNA, 25 bp, Rattus norvegicus
agttgaagattgtctgcctggatca

SEQ ID NO: 166387 - DNA, 25 bp, Rattus norvegicus
agttgaagcaccataactcatccac

SEQ ID NO: 166388 - DNA, 25 bp, Rattus norvegicus
agttgaagcaccttaactcatccac

SEQ ID NO: 166389 - DNA, 25 bp, Rattus norvegicus
agttgaagcagcctctgctggacag

SEQ ID NO: 166390 - DNA, 25 bp, Rattus norvegicus
agttgaagcagcgtctgctggacag

SEQ ID NO: 166391 - DNA, 25 bp, Rattus norvegicus
agttgaaggctcagttccgcaggca

SEQ ID NO: 166392 - DNA, 25 bp, Rattus norvegicus
agttgaaggctctgttccgcaggca

SEQ ID NO: 166393 - DNA, 25 bp, Rattus norvegicus
agttgaagtcctctcttactggctt

SEQ ID NO: 166394 - DNA, 25 bp, Rattus norvegicus
agttgaagtcctgtcttactggctt

SEQ ID NO: 166395 - DNA, 25 bp, Rattus norvegicus
agttgaagttgtagcgcgagtcctg

SEQ ID NO: 166396 - DNA, 25 bp, Rattus norvegicus
agttgaagttgttgcgcgagtcctg

SEQ ID NO: 166397 - DNA, 25 bp, Rattus norvegicus
agttgaatactgatagcattcccag

SEQ ID NO: 166398 - DNA, 25 bp, Rattus norvegicus
agttgaatactgttagcattcccag

SEQ ID NO: 166399 - DNA, 25 bp, Rattus norvegicus
agttgaatttctacttcccagatga

SEQ ID NO: 166400 - DNA, 25 bp, Rattus norvegicus
agttgaatttcttcttcccagatga

SEQ ID NO: 166401 - DNA, 25 bp, Rattus norvegicus
agttgaattttcacctcatgcttgt

SEQ ID NO: 166402 - DNA, 25 bp, Rattus norvegicus
agttgaattttctcctcatgcttgt

SEQ ID NO: 166403 - DNA, 25 bp, Rattus norvegicus
agttgacaataacagcaggcctacc

SEQ ID NO: 166404 - DNA, 25 bp, Rattus norvegicus
agttgacaataagagcaggcctacc

SEQ ID NO: 166405 - DNA, 25 bp, Rattus norvegicus
agttgacaatctactgtggcgtttt

SEQ ID NO: 166406 - DNA, 25 bp, Rattus norvegicus
agttgacaatcttctgtggcgtttt

SEQ ID NO: 166407 - DNA, 25 bp, Rattus norvegicus
agttgacacagtcgctgctggttca

SEQ ID NO: 166408 - DNA, 25 bp, Rattus norvegicus
agttgacacagtggctgctggttca

SEQ ID NO: 166409 - DNA, 25 bp, Rattus norvegicus
agttgacacctcatcgctctttgtg

SEQ ID NO: 166410 - DNA, 25 bp, Rattus norvegicus
agttgacacctcttcgctctttgtg

SEQ ID NO: 166411 - DNA, 25 bp, Rattus norvegicus
agttgacactcacttactgtaatga

SEQ ID NO: 166412 - DNA, 25 bp, Rattus norvegicus
agttgacactcagttactgtaatga

SEQ ID NO: 166413 - DNA, 25 bp, Rattus norvegicus
agttgacatctcacctatttttatc

SEQ ID NO: 166414 - DNA, 25 bp, Rattus norvegicus
agttgacatctctcctatttttatc

SEQ ID NO: 166415 - DNA, 25 bp, Rattus norvegicus
agttgacattccaatctgatctgcc

SEQ ID NO: 166416 - DNA, 25 bp, Rattus norvegicus
agttgacattcctatctgatctgcc

SEQ ID NO: 166417 - DNA, 25 bp, Rattus norvegicus
agttgaccactcactcactgtaggt

SEQ ID NO: 166418 - DNA, 25 bp, Rattus norvegicus
agttgaccactctctcactgtaggt

SEQ ID NO: 166419 - DNA, 25 bp, Rattus norvegicus
agttgaccactgagataatccgggc

SEQ ID NO: 166420 - DNA, 25 bp, Rattus norvegicus
agttgaccactgtgataatccgggc

SEQ ID NO: 166421 - DNA, 25 bp, Rattus norvegicus
agttgaccagtgacaatgaccgcct

SEQ ID NO: 166422 - DNA, 25 bp, Rattus norvegicus
agttgaccagtgtcaatgaccgcct

SEQ ID NO: 166423 - DNA, 25 bp, Rattus norvegicus
agttgaccattgagctcctggacac

SEQ ID NO: 166424 - DNA, 25 bp, Rattus norvegicus
agttgaccattgtgctcctggacac

SEQ ID NO: 166425 - DNA, 25 bp, Rattus norvegicus
agttgacccaagctggatgtactct

SEQ ID NO: 166426 - DNA, 25 bp, Rattus norvegicus
agttgacccaaggtggatgtactct

SEQ ID NO: 166427 - DNA, 25 bp, Rattus norvegicus
agttgaccccttctatcgagacgtg

SEQ ID NO: 166428 - DNA, 25 bp, Rattus norvegicus
agttgaccccttgtatcgagacgtg

SEQ ID NO: 166429 - DNA, 25 bp, Rattus norvegicus
agttgaccctccagtctttatataa

SEQ ID NO: 166430 - DNA, 25 bp, Rattus norvegicus
agttgaccctcctgtctttatataa

SEQ ID NO: 166431 - DNA, 25 bp, Rattus norvegicus
agttgacccttcacatgctgtctat

SEQ ID NO: 166432 - DNA, 25 bp, Rattus norvegicus
agttgacccttctcatgctgtctat

SEQ ID NO: 166433 - DNA, 25 bp, Rattus norvegicus
agttgaccgtttctgactctttcct

SEQ ID NO: 166434 - DNA, 25 bp, Rattus norvegicus
agttgaccgtttgtgactctttcct

SEQ ID NO: 166435 - DNA, 25 bp, Rattus norvegicus
agttgacctcttctctgtaaatttg

SEQ ID NO: 166436 - DNA, 25 bp, Rattus norvegicus
agttgacctcttgtctgtaaatttg

SEQ ID NO: 166437 - DNA, 25 bp, Rattus norvegicus
agttgacctggtagctcattaatcc

SEQ ID NO: 166438 - DNA, 25 bp, Rattus norvegicus
agttgacctggttgctcattaatcc

SEQ ID NO: 166439 - DNA, 25 bp, Rattus norvegicus
agttgacctgtactatcgctttgct

SEQ ID NO: 166440 - DNA, 25 bp, Rattus norvegicus
agttgacctgtagtatcgctttgct

SEQ ID NO: 166441 - DNA, 25 bp, Rattus norvegicus
agttgacctttgacctatttgcaaa

SEQ ID NO: 166442 - DNA, 25 bp, Rattus norvegicus
agttgacctttgtcctatttgcaaa

SEQ ID NO: 166443 - DNA, 25 bp, Rattus norvegicus
agttgacgcaaaaccagccagaaca

SEQ ID NO: 166444 - DNA, 25 bp, Rattus norvegicus
agttgacgcaaatccagccagaaca

SEQ ID NO: 166445 - DNA, 25 bp, Rattus norvegicus
agttgactaaaacctgacaaagctc

SEQ ID NO: 166446 - DNA, 25 bp, Rattus norvegicus
agttgactaaaagctgacaaagctc

SEQ ID NO: 166447 - DNA, 25 bp, Rattus norvegicus
agttgactatgccaggtagcttcta

SEQ ID NO: 166448 - DNA, 25 bp, Rattus norvegicus
agttgactatgcgaggtagcttcta

SEQ ID NO: 166449 - DNA, 25 bp, Rattus norvegicus
agttgactcagaatgtcgcccagta

SEQ ID NO: 166450 - DNA, 25 bp, Rattus norvegicus
agttgactcagattgtcgcccagta

SEQ ID NO: 166451 - DNA, 25 bp, Rattus norvegicus
agttgactcatcatcatcctactca

SEQ ID NO: 166452 - DNA, 25 bp, Rattus norvegicus
agttgactcatcttcatcctactca

SEQ ID NO: 166453 - DNA, 25 bp, Rattus norvegicus
agttgactccaaagacagcctgtac

SEQ ID NO: 166454 - DNA, 25 bp, Rattus norvegicus
agttgactccaatgacagcctgtac

SEQ ID NO: 166455 - DNA, 25 bp, Rattus norvegicus
agttgactcgtgaagcactggaaca

SEQ ID NO: 166456 - DNA, 25 bp, Rattus norvegicus
agttgactcgtgtagcactggaaca

SEQ ID NO: 166457 - DNA, 25 bp, Rattus norvegicus
agttgactctagcaatgctgcctga

SEQ ID NO: 166458 - DNA, 25 bp, Rattus norvegicus
agttgactctaggaatgctgcctga

SEQ ID NO: 166459 - DNA, 25 bp, Rattus norvegicus
agttgactctcgatgccttttcaaa

SEQ ID NO: 166460 - DNA, 25 bp, Rattus norvegicus
agttgactctcgttgccttttcaaa

SEQ ID NO: 166461 - DNA, 25 bp, Rattus norvegicus
agttgactgctgcatttagctcacg

SEQ ID NO: 166462 - DNA, 25 bp, Rattus norvegicus
agttgactgctggatttagctcacg

SEQ ID NO: 166463 - DNA, 25 bp, Rattus norvegicus
agttgactggttcatgagctccttc

SEQ ID NO: 166464 - DNA, 25 bp, Rattus norvegicus
agttgactggttgatgagctccttc

SEQ ID NO: 166465 - DNA, 25 bp, Rattus norvegicus
agttgactgtaactgcttccctgtc

SEQ ID NO: 166466 - DNA, 25 bp, Rattus norvegicus
agttgactgtaagtgcttccctgtc

SEQ ID NO: 166467 - DNA, 25 bp, Rattus norvegicus
agttgactgtacatccattctggcc

SEQ ID NO: 166468 - DNA, 25 bp, Rattus norvegicus
agttgactgtacttccattctggcc

SEQ ID NO: 166469 - DNA, 25 bp, Rattus norvegicus
agttgactgtcaccagaggcatgca

SEQ ID NO: 166470 - DNA, 25 bp, Rattus norvegicus
agttgactgtcagcagaggcatgca

SEQ ID NO: 166471 - DNA, 25 bp, Rattus norvegicus
agttgactgtttaccatggactctg

SEQ ID NO: 166472 - DNA, 25 bp, Rattus norvegicus
agttgactgttttccatggactctg

SEQ ID NO: 166473 - DNA, 25 bp, Rattus norvegicus
agttgacttccaaagcctcttcatc

SEQ ID NO: 166474 - DNA, 25 bp, Rattus norvegicus
agttgacttccatagcctcttcatc

SEQ ID NO: 166475 - DNA, 25 bp, Rattus norvegicus
agttgacttcctatccatgagctca

SEQ ID NO: 166476 - DNA, 25 bp, Rattus norvegicus
agttgacttcctttccatgagctca

SEQ ID NO: 166477 - DNA, 25 bp, Rattus norvegicus
agttgacttcttagcctgatgctga

SEQ ID NO: 166478 - DNA, 25 bp, Rattus norvegicus
agttgacttctttgcctgatgctga

SEQ ID NO: 166479 - DNA, 25 bp, Rattus norvegicus
agttgactttatagtctccctccat

SEQ ID NO: 166480 - DNA, 25 bp, Rattus norvegicus
agttgactttattgtctccctccat

SEQ ID NO: 166481 - DNA, 25 bp, Rattus norvegicus
agttgagaacaactcaccctgtggg

SEQ ID NO: 166482 - DNA, 25 bp, Rattus norvegicus
agttgagaacaagtcaccctgtggg

SEQ ID NO: 166483 - DNA, 25 bp, Rattus norvegicus
agttgagaacctcacccatgtagcc

SEQ ID NO: 166484 - DNA, 25 bp, Rattus norvegicus
agttgagaacctgacccatgtagcc

SEQ ID NO: 166485 - DNA, 25 bp, Rattus norvegicus
agttgagacctacagcagcttccct

SEQ ID NO: 166486 - DNA, 25 bp, Rattus norvegicus
agttgagacctagagcagcttccct

SEQ ID NO: 166487 - DNA, 25 bp, Rattus norvegicus
agttgagacttcatcagcgctcagc

SEQ ID NO: 166488 - DNA, 25 bp, Rattus norvegicus
agttgagacttcttcagcgctcagc

SEQ ID NO: 166489 - DNA, 25 bp, Rattus norvegicus
agttgagagagtcctggcccagatt

SEQ ID NO: 166490 - DNA, 25 bp, Rattus norvegicus
agttgagagagtgctggcccagatt

SEQ ID NO: 166491 - DNA, 25 bp, Rattus norvegicus
agttgagcaacgagaccccagggtt

SEQ ID NO: 166492 - DNA, 25 bp, Rattus norvegicus
agttgagcaacgtgaccccagggtt

SEQ ID NO: 166493 - DNA, 25 bp, Rattus norvegicus
agttgagcaactagtccagccagga

SEQ ID NO: 166494 - DNA, 25 bp, Rattus norvegicus
agttgagcaacttgtccagccagga

SEQ ID NO: 166495 - DNA, 25 bp, Rattus norvegicus
agttgagcacgacggtagcgtccta

SEQ ID NO: 166496 - DNA, 25 bp, Rattus norvegicus
agttgagcacgagggtagcgtccta

SEQ ID NO: 166497 - DNA, 25 bp, Rattus norvegicus
agttgagcatctagtctccaagcac

SEQ ID NO: 166498 - DNA, 25 bp, Rattus norvegicus
agttgagcatcttgtctccaagcac

SEQ ID NO: 166499 - DNA, 25 bp, Rattus norvegicus
agttgagccgcgattgcgatgcgct

SEQ ID NO: 166500 - DNA, 25 bp, Rattus norvegicus
agttgagccgcgtttgcgatgcgct

SEQ ID NO: 166501 - DNA, 25 bp, Rattus norvegicus
agttgagcctggagtggtcattcca

SEQ ID NO: 166502 - DNA, 25 bp, Rattus norvegicus
agttgagcctggtgtggtcattcca

SEQ ID NO: 166503 - DNA, 25 bp, Rattus norvegicus
agttgagctttgatccaagcccttc

SEQ ID NO: 166504 - DNA, 25 bp, Rattus norvegicus
agttgagctttgttccaagcccttc

SEQ ID NO: 166505 - DNA, 25 bp, Rattus norvegicus
agttgaggaactctgtcgccaccca

SEQ ID NO: 166506 - DNA, 25 bp, Rattus norvegicus
agttgaggaactgtgtcgccaccca

SEQ ID NO: 166507 - DNA, 25 bp, Rattus norvegicus
agttgaggccatatgttccccagga

SEQ ID NO: 166508 - DNA, 25 bp, Rattus norvegicus
agttgaggccatttgttccccagga

SEQ ID NO: 166509 - DNA, 25 bp, Rattus norvegicus
agttgagggactcacctcgaggtct

SEQ ID NO: 166510 - DNA, 25 bp, Rattus norvegicus
agttgagggactgacctcgaggtct

SEQ ID NO: 166511 - DNA, 25 bp, Rattus norvegicus
agttgagggtacaggcacctgcttg

SEQ ID NO: 166512 - DNA, 25 bp, Rattus norvegicus
agttgagggtactggcacctgcttg

SEQ ID NO: 166513 - DNA, 25 bp, Rattus norvegicus
agttgagggttgagggctcctcttc

SEQ ID NO: 166514 - DNA, 25 bp, Rattus norvegicus
agttgagggttgtgggctcctcttc

SEQ ID NO: 166515 - DNA, 25 bp, Rattus norvegicus
agttgaggtcacatttgcctggcta

SEQ ID NO: 166516 - DNA, 25 bp, Rattus norvegicus
agttgaggtcacttttgcctggcta

SEQ ID NO: 166517 - DNA, 25 bp, Rattus norvegicus
agttgagtatgtctatccagggccc

SEQ ID NO: 166518 - DNA, 25 bp, Rattus norvegicus
agttgagtatgtgtatccagggccc

SEQ ID NO: 166519 - DNA, 25 bp, Rattus norvegicus
agttgagtccttcccactggtgatt

SEQ ID NO: 166520 - DNA, 25 bp, Rattus norvegicus
agttgagtccttgccactggtgatt

SEQ ID NO: 166521 - DNA, 25 bp, Rattus norvegicus
agttgagtcgccaccgcggagctcc

SEQ ID NO: 166522 - DNA, 25 bp, Rattus norvegicus
agttgagtcgcctccgcggagctcc

SEQ ID NO: 166523 - DNA, 25 bp, Rattus norvegicus
agttgagtctgacgtctgcgatcgt

SEQ ID NO: 166524 - DNA, 25 bp, Rattus norvegicus
agttgagtctgaggtctgcgatcgt

SEQ ID NO: 166525 - DNA, 25 bp, Rattus norvegicus
agttgagtgacgcaggtccgaacac

SEQ ID NO: 166526 - DNA, 25 bp, Rattus norvegicus
agttgagtgacggaggtccgaacac

SEQ ID NO: 166527 - DNA, 25 bp, Rattus norvegicus
agttgagtgtgccagaatcctctcc

SEQ ID NO: 166528 - DNA, 25 bp, Rattus norvegicus
agttgagtgtgcgagaatcctctcc

SEQ ID NO: 166529 - DNA, 25 bp, Rattus norvegicus
agttgagttcagaaagccggacttc

SEQ ID NO: 166530 - DNA, 25 bp, Rattus norvegicus
agttgagttcagtaagccggacttc

SEQ ID NO: 166531 - DNA, 25 bp, Rattus norvegicus
agttgagttccacatcctatacaga

SEQ ID NO: 166532 - DNA, 25 bp, Rattus norvegicus
agttgagttccagatcctatacaga

SEQ ID NO: 166533 - DNA, 25 bp, Rattus norvegicus
agttgagttccccatgcccgcatgt

SEQ ID NO: 166534 - DNA, 25 bp, Rattus norvegicus
agttgagttcccgatgcccgcatgt

SEQ ID NO: 166535 - DNA, 25 bp, Rattus norvegicus
agttgagttctgagtccgttcattg

SEQ ID NO: 166536 - DNA, 25 bp, Rattus norvegicus
agttgagttctgtgtccgttcattg

SEQ ID NO: 166537 - DNA, 25 bp, Rattus norvegicus
agttgagtttaaatgtatgtcctaa

SEQ ID NO: 166538 - DNA, 25 bp, Rattus norvegicus
agttgagtttaattgtatgtcctaa

SEQ ID NO: 166539 - DNA, 25 bp, Rattus norvegicus
agttgagtttacatttggccctgcg

SEQ ID NO: 166540 - DNA, 25 bp, Rattus norvegicus
agttgagtttacttttggccctgcg

SEQ ID NO: 166541 - DNA, 25 bp, Rattus norvegicus
agttgagttttcaccctagaatccg

SEQ ID NO: 166542 - DNA, 25 bp, Rattus norvegicus
agttgagttttctccctagaatccg

SEQ ID NO: 166543 - DNA, 25 bp, Rattus norvegicus
agttgataaatcacagcccttctct

SEQ ID NO: 166544 - DNA, 25 bp, Rattus norvegicus
agttgataaatctcagcccttctct

SEQ ID NO: 166545 - DNA, 25 bp, Rattus norvegicus
agttgataacggctggtctctcttt

SEQ ID NO: 166546 - DNA, 25 bp, Rattus norvegicus
agttgataacgggtggtctctcttt

SEQ ID NO: 166547 - DNA, 25 bp, Rattus norvegicus
agttgataagccagtgccagtgcct

SEQ ID NO: 166548 - DNA, 25 bp, Rattus norvegicus
agttgataagcctgtgccagtgcct

SEQ ID NO: 166549 - DNA, 25 bp, Rattus norvegicus
agttgatagtgcctggaatcccttc

SEQ ID NO: 166550 - DNA, 25 bp, Rattus norvegicus
agttgatagtgcgtggaatcccttc

SEQ ID NO: 166551 - DNA, 25 bp, Rattus norvegicus
agttgatccaaacggtacaccccag

SEQ ID NO: 166552 - DNA, 25 bp, Rattus norvegicus
agttgatccaaagggtacaccccag

SEQ ID NO: 166553 - DNA, 25 bp, Rattus norvegicus
agttgatcctgtagtttgctgccat

SEQ ID NO: 166554 - DNA, 25 bp, Rattus norvegicus
agttgatcctgttgtttgctgccat

SEQ ID NO: 166555 - DNA, 25 bp, Rattus norvegicus
agttgatgctaaatctcttacccct

SEQ ID NO: 166556 - DNA, 25 bp, Rattus norvegicus
agttgatgctaattctcttacccct

SEQ ID NO: 166557 - DNA, 25 bp, Rattus norvegicus
agttgatggcgaaatccgtttgctg

SEQ ID NO: 166558 - DNA, 25 bp, Rattus norvegicus
agttgatggcgatatccgtttgctg

SEQ ID NO: 166559 - DNA, 25 bp, Rattus norvegicus
agttgatgggagaggcagcctccat

SEQ ID NO: 166560 - DNA, 25 bp, Rattus norvegicus
agttgatgggagtggcagcctccat

SEQ ID NO: 166561 - DNA, 25 bp, Rattus norvegicus
agttgatggtgacctcccggatcaa

SEQ ID NO: 166562 - DNA, 25 bp, Rattus norvegicus
agttgatggtgagctcccggatcaa

SEQ ID NO: 166563 - DNA, 25 bp, Rattus norvegicus
agttgatgtcatatttccccattgc

SEQ ID NO: 166564 - DNA, 25 bp, Rattus norvegicus
agttgatgtcatttttccccattgc

SEQ ID NO: 166565 - DNA, 25 bp, Rattus norvegicus
agttgatgtcttacacccagatcta

SEQ ID NO: 166566 - DNA, 25 bp, Rattus norvegicus
agttgatgtctttcacccagatcta

SEQ ID NO: 166567 - DNA, 25 bp, Rattus norvegicus
agttgatgtttgattcctgtttgat

SEQ ID NO: 166568 - DNA, 25 bp, Rattus norvegicus
agttgatgtttgtttcctgtttgat

SEQ ID NO: 166569 - DNA, 25 bp, Rattus norvegicus
agttgattccttcctagttctctac

SEQ ID NO: 166570 - DNA, 25 bp, Rattus norvegicus
agttgattccttgctagttctctac

SEQ ID NO: 166571 - DNA, 25 bp, Rattus norvegicus
agttgattgaagaggctggagaccc

SEQ ID NO: 166572 - DNA, 25 bp, Rattus norvegicus
agttgattgaagtggctggagaccc

SEQ ID NO: 166573 - DNA, 25 bp, Rattus norvegicus
agttgatttacgctcacagacttga

SEQ ID NO: 166574 - DNA, 25 bp, Rattus norvegicus
agttgatttacggtcacagacttga

SEQ ID NO: 166575 - DNA, 25 bp, Rattus norvegicus
agttgatttgctagaagagttcatc

SEQ ID NO: 166576 - DNA, 25 bp, Rattus norvegicus
agttgatttgcttgaagagttcatc

SEQ ID NO: 166577 - DNA, 25 bp, Rattus norvegicus
agttgattttcgatctattctcttc

SEQ ID NO: 166578 - DNA, 25 bp, Rattus norvegicus
agttgattttcgttctattctcttc

SEQ ID NO: 166579 - DNA, 25 bp, Rattus norvegicus
agttgattttctacttctgtaacaa

SEQ ID NO: 166580 - DNA, 25 bp, Rattus norvegicus
agttgattttcttcttctgtaacaa

SEQ ID NO: 166581 - DNA, 25 bp, Rattus norvegicus
agttgattttgtagtggtgtgctat

SEQ ID NO: 166582 - DNA, 25 bp, Rattus norvegicus
agttgattttgttgtggtgtgctat

SEQ ID NO: 166583 - DNA, 25 bp, Rattus norvegicus
agttgcaaactcaggacggtctaag

SEQ ID NO: 166584 - DNA, 25 bp, Rattus norvegicus
agttgcaaactctggacggtctaag

SEQ ID NO: 166585 - DNA, 25 bp, Rattus norvegicus
agttgcaaattcatgctatgcacct

SEQ ID NO: 166586 - DNA, 25 bp, Rattus norvegicus
agttgcaaattcttgctatgcacct

SEQ ID NO: 166587 - DNA, 25 bp, Rattus norvegicus
agttgcaatgaactctctccatcat

SEQ ID NO: 166588 - DNA, 25 bp, Rattus norvegicus
agttgcaatgaagtctctccatcat

SEQ ID NO: 166589 - DNA, 25 bp, Rattus norvegicus
agttgcaatggcaatttctattcta

SEQ ID NO: 166590 - DNA, 25 bp, Rattus norvegicus
agttgcaatggctatttctattcta

SEQ ID NO: 166591 - DNA, 25 bp, Rattus norvegicus
agttgcacacacagctgggcctgta

SEQ ID NO: 166592 - DNA, 25 bp, Rattus norvegicus
agttgcacacactgctgggcctgta

SEQ ID NO: 166593 - DNA, 25 bp, Rattus norvegicus
agttgcaccacacccggtttacaga

SEQ ID NO: 166594 - DNA, 25 bp, Rattus norvegicus
agttgcaccacagccggtttacaga

SEQ ID NO: 166595 - DNA, 25 bp, Rattus norvegicus
agttgcacctcacccctaaaaaatg

SEQ ID NO: 166596 - DNA, 25 bp, Rattus norvegicus
agttgcacctcagccctaaaaaatg

SEQ ID NO: 166597 - DNA, 25 bp, Rattus norvegicus
agttgcacttctcgatctcagtcca

SEQ ID NO: 166598 - DNA, 25 bp, Rattus norvegicus
agttgcacttctggatctcagtcca

SEQ ID NO: 166599 - DNA, 25 bp, Rattus norvegicus
agttgcagatgcatgcgcagtgctc

SEQ ID NO: 166600 - DNA, 25 bp, Rattus norvegicus
agttgcagatgcttgcgcagtgctc

SEQ ID NO: 166601 - DNA, 25 bp, Rattus norvegicus
agttgcagcagaaggagtggcccca

SEQ ID NO: 166602 - DNA, 25 bp, Rattus norvegicus
agttgcagcagatggagtggcccca

SEQ ID NO: 166603 - DNA, 25 bp, Rattus norvegicus
agttgcagcaggacggttccactcg

SEQ ID NO: 166604 - DNA, 25 bp, Rattus norvegicus
agttgcagcaggtcggttccactcg

SEQ ID NO: 166605 - DNA, 25 bp, Rattus norvegicus
agttgcagcccccggagtttcatgc

SEQ ID NO: 166606 - DNA, 25 bp, Rattus norvegicus
agttgcagccccgggagtttcatgc

SEQ ID NO: 166607 - DNA, 25 bp, Rattus norvegicus
agttgcagccgtatcttcaaaaggg

SEQ ID NO: 166608 - DNA, 25 bp, Rattus norvegicus
agttgcagccgtttcttcaaaaggg

SEQ ID NO: 166609 - DNA, 25 bp, Rattus norvegicus
agttgcagcctgatcactgtttaaa

SEQ ID NO: 166610 - DNA, 25 bp, Rattus norvegicus
agttgcagcctgttcactgtttaaa

SEQ ID NO: 166611 - DNA, 25 bp, Rattus norvegicus
agttgcagcgatagcaactggcctg

SEQ ID NO: 166612 - DNA, 25 bp, Rattus norvegicus
agttgcagcgattgcaactggcctg

SEQ ID NO: 166613 - DNA, 25 bp, Rattus norvegicus
agttgcagctttcgcaatgccctcg

SEQ ID NO: 166614 - DNA, 25 bp, Rattus norvegicus
agttgcagctttggcaatgccctcg

SEQ ID NO: 166615 - DNA, 25 bp, Rattus norvegicus
agttgcaggccaccgtagtgagaca

SEQ ID NO: 166616 - DNA, 25 bp, Rattus norvegicus
agttgcaggccagcgtagtgagaca

SEQ ID NO: 166617 - DNA, 25 bp, Rattus norvegicus
agttgcagtactcccatgaccccag

SEQ ID NO: 166618 - DNA, 25 bp, Rattus norvegicus
agttgcagtactgccatgaccccag

SEQ ID NO: 166619 - DNA, 25 bp, Rattus norvegicus
agttgcagttccagaatccaggaac

SEQ ID NO: 166620 - DNA, 25 bp, Rattus norvegicus
agttgcagttcctgaatccaggaac

SEQ ID NO: 166621 - DNA, 25 bp, Rattus norvegicus
agttgcagttgtacgctgctgaaaa

SEQ ID NO: 166622 - DNA, 25 bp, Rattus norvegicus
agttgcagttgttcgctgctgaaaa

SEQ ID NO: 166623 - DNA, 25 bp, Rattus norvegicus
agttgcataattagtagcatacccc

SEQ ID NO: 166624 - DNA, 25 bp, Rattus norvegicus
agttgcataatttgtagcatacccc

SEQ ID NO: 166625 - DNA, 25 bp, Rattus norvegicus
agttgcatagtgcactcctgctgag

SEQ ID NO: 166626 - DNA, 25 bp, Rattus norvegicus
agttgcatagtggactcctgctgag

SEQ ID NO: 166627 - DNA, 25 bp, Rattus norvegicus
agttgcatccctaagctgttttatt

SEQ ID NO: 166628 - DNA, 25 bp, Rattus norvegicus
agttgcatcccttagctgttttatt

SEQ ID NO: 166629 - DNA, 25 bp, Rattus norvegicus
agttgcatcctgagtaacctcctag

SEQ ID NO: 166630 - DNA, 25 bp, Rattus norvegicus
agttgcatcctgtgtaacctcctag

SEQ ID NO: 166631 - DNA, 25 bp, Rattus norvegicus
agttgcatccttaggcaatccaagt

SEQ ID NO: 166632 - DNA, 25 bp, Rattus norvegicus
agttgcatcctttggcaatccaagt

SEQ ID NO: 166633 - DNA, 25 bp, Rattus norvegicus
agttgcatgaggcttctgcgtgaca

SEQ ID NO: 166634 - DNA, 25 bp, Rattus norvegicus
agttgcatgagggttctgcgtgaca

SEQ ID NO: 166635 - DNA, 25 bp, Rattus norvegicus
agttgcatggcaaatctatccctac

SEQ ID NO: 166636 - DNA, 25 bp, Rattus norvegicus
agttgcatggcatatctatccctac

SEQ ID NO: 166637 - DNA, 25 bp, Rattus norvegicus
agttgcatgtaaatgactgttgaaa

SEQ ID NO: 166638 - DNA, 25 bp, Rattus norvegicus
agttgcatgtaattgactgttgaaa

SEQ ID NO: 166639 - DNA, 25 bp, Rattus norvegicus
agttgccaattaaccctgtgactgg

SEQ ID NO: 166640 - DNA, 25 bp, Rattus norvegicus
agttgccaattatccctgtgactgg

SEQ ID NO: 166641 - DNA, 25 bp, Rattus norvegicus
agttgccaccaacactgtcatagtg

SEQ ID NO: 166642 - DNA, 25 bp, Rattus norvegicus
agttgccaccaagactgtcatagtg

SEQ ID NO: 166643 - DNA, 25 bp, Rattus norvegicus
agttgccaccacacgataacgaggt

SEQ ID NO: 166644 - DNA, 25 bp, Rattus norvegicus
agttgccaccactcgataacgaggt

SEQ ID NO: 166645 - DNA, 25 bp, Rattus norvegicus
agttgccacgccaacagttagtgtt

SEQ ID NO: 166646 - DNA, 25 bp, Rattus norvegicus
agttgccacgcctacagttagtgtt

SEQ ID NO: 166647 - DNA, 25 bp, Rattus norvegicus
agttgccagcaaaggtgccagccga

SEQ ID NO: 166648 - DNA, 25 bp, Rattus norvegicus
agttgccagcaatggtgccagccga

SEQ ID NO: 166649 - DNA, 25 bp, Rattus norvegicus
agttgccagcttccgttccagagtt

SEQ ID NO: 166650 - DNA, 25 bp, Rattus norvegicus
agttgccagcttgcgttccagagtt

SEQ ID NO: 166651 - DNA, 25 bp, Rattus norvegicus
agttgccaggagcagatgtgcctct

SEQ ID NO: 166652 - DNA, 25 bp, Rattus norvegicus
agttgccaggaggagatgtgcctct

SEQ ID NO: 166653 - DNA, 25 bp, Rattus norvegicus
agttgccagtctacatctaacttgc

SEQ ID NO: 166654 - DNA, 25 bp, Rattus norvegicus
agttgccagtcttcatctaacttgc

SEQ ID NO: 166655 - DNA, 25 bp, Rattus norvegicus
agttgccatgagcagaccactctga

SEQ ID NO: 166656 - DNA, 25 bp, Rattus norvegicus
agttgccatgaggagaccactctga

SEQ ID NO: 166657 - DNA, 25 bp, Rattus norvegicus
agttgccatgtaacctgggagctgc

SEQ ID NO: 166658 - DNA, 25 bp, Rattus norvegicus
agttgccatgtaccgagaaccatct

SEQ ID NO: 166659 - DNA, 25 bp, Rattus norvegicus
agttgccatgtagcgagaaccatct

SEQ ID NO: 166660 - DNA, 25 bp, Rattus norvegicus
agttgccatgtatcctgggagctgc

SEQ ID NO: 166661 - DNA, 25 bp, Rattus norvegicus
agttgcccaatgctttcattccgtc

SEQ ID NO: 166662 - DNA, 25 bp, Rattus norvegicus
agttgcccaatggtttcattccgtc

SEQ ID NO: 166663 - DNA, 25 bp, Rattus norvegicus
agttgcccacagacttgaatcgaac

SEQ ID NO: 166664 - DNA, 25 bp, Rattus norvegicus
agttgcccacagtcttgaatcgaac

SEQ ID NO: 166665 - DNA, 25 bp, Rattus norvegicus
agttgcccagatcttctagatccga

SEQ ID NO: 166666 - DNA, 25 bp, Rattus norvegicus
agttgcccagatgttctagatccga

SEQ ID NO: 166667 - DNA, 25 bp, Rattus norvegicus
agttgcccagcacctttaacgaggc

SEQ ID NO: 166668 - DNA, 25 bp, Rattus norvegicus
agttgcccagcagctttaacgaggc

SEQ ID NO: 166669 - DNA, 25 bp, Rattus norvegicus
agttgcccgaggatggctgccatgc

SEQ ID NO: 166670 - DNA, 25 bp, Rattus norvegicus
agttgcccgaggttggctgccatgc

SEQ ID NO: 166671 - DNA, 25 bp, Rattus norvegicus
agttgccctggaacttactggatta

SEQ ID NO: 166672 - DNA, 25 bp, Rattus norvegicus
agttgccctggatcttactggatta

SEQ ID NO: 166673 - DNA, 25 bp, Rattus norvegicus
agttgccgggcacagcaccaccgct

SEQ ID NO: 166674 - DNA, 25 bp, Rattus norvegicus
agttgccgggcagagcaccaccgct

SEQ ID NO: 166675 - DNA, 25 bp, Rattus norvegicus
agttgccgggccacagtctgataag

SEQ ID NO: 166676 - DNA, 25 bp, Rattus norvegicus
agttgccgggcctcagtctgataag

SEQ ID NO: 166677 - DNA, 25 bp, Rattus norvegicus
agttgccgtattcctttctgagata

SEQ ID NO: 166678 - DNA, 25 bp, Rattus norvegicus
agttgccgtattgctttctgagata

SEQ ID NO: 166679 - DNA, 25 bp, Rattus norvegicus
agttgccgtcccagatctgtttgga

SEQ ID NO: 166680 - DNA, 25 bp, Rattus norvegicus
agttgccgtccctgatctgtttgga

SEQ ID NO: 166681 - DNA, 25 bp, Rattus norvegicus
agttgccgtggaatctttcaaaagc

SEQ ID NO: 166682 - DNA, 25 bp, Rattus norvegicus
agttgccgtggattctttcaaaagc

SEQ ID NO: 166683 - DNA, 25 bp, Rattus norvegicus
agttgcctccaactctggagtgcag

SEQ ID NO: 166684 - DNA, 25 bp, Rattus norvegicus
agttgcctccaagtctggagtgcag

SEQ ID NO: 166685 - DNA, 25 bp, Rattus norvegicus
agttgcctctgcagtggtacggctt

SEQ ID NO: 166686 - DNA, 25 bp, Rattus norvegicus
agttgcctctgctgtggtacggctt

SEQ ID NO: 166687 - DNA, 25 bp, Rattus norvegicus
agttgcctgcaacattacaccatca

SEQ ID NO: 166688 - DNA, 25 bp, Rattus norvegicus
agttgcctgcaagattacaccatca

SEQ ID NO: 166689 - DNA, 25 bp, Rattus norvegicus
agttgcctgcccagcatggacagca

SEQ ID NO: 166690 - DNA, 25 bp, Rattus norvegicus
agttgcctgccctgcatggacagca

SEQ ID NO: 166691 - DNA, 25 bp, Rattus norvegicus
agttgcctgggtccactgtcaatgc

SEQ ID NO: 166692 - DNA, 25 bp, Rattus norvegicus
agttgcctgggtgcactgtcaatgc

SEQ ID NO: 166693 - DNA, 25 bp, Rattus norvegicus
agttgcctgtgaatgttggcctcaa

SEQ ID NO: 166694 - DNA, 25 bp, Rattus norvegicus
agttgcctgtgattgttggcctcaa

SEQ ID NO: 166695 - DNA, 25 bp, Rattus norvegicus
agttgcctgttaatgtggaatttac

SEQ ID NO: 166696 - DNA, 25 bp, Rattus norvegicus
agttgcctgttattgtggaatttac

SEQ ID NO: 166697 - DNA, 25 bp, Rattus norvegicus
agttgccttaatcaacacttgtttc

SEQ ID NO: 166698 - DNA, 25 bp, Rattus norvegicus
agttgccttaatgaacacttgtttc

SEQ ID NO: 166699 - DNA, 25 bp, Rattus norvegicus
agttgccttctgaggacccgtggac

SEQ ID NO: 166700 - DNA, 25 bp, Rattus norvegicus
agttgccttctgtggacccgtggac

SEQ ID NO: 166701 - DNA, 25 bp, Rattus norvegicus
agttgccttgccagctacagagata

SEQ ID NO: 166702 - DNA, 25 bp, Rattus norvegicus
agttgccttgcctgctacagagata

SEQ ID NO: 166703 - DNA, 25 bp, Rattus norvegicus
agttgccttggtcatatggtccctt

SEQ ID NO: 166704 - DNA, 25 bp, Rattus norvegicus
agttgccttggtgatatggtccctt

SEQ ID NO: 166705 - DNA, 25 bp, Rattus norvegicus
agttgccttgtcaatccttatgatt

SEQ ID NO: 166706 - DNA, 25 bp, Rattus norvegicus
agttgccttgtccatggtggtcaga

SEQ ID NO: 166707 - DNA, 25 bp, Rattus norvegicus
agttgccttgtcgatggtggtcaga

SEQ ID NO: 166708 - DNA, 25 bp, Rattus norvegicus
agttgccttgtctatccttatgatt

SEQ ID NO: 166709 - DNA, 25 bp, Rattus norvegicus
agttgcctttgaattttcctctttg

SEQ ID NO: 166710 - DNA, 25 bp, Rattus norvegicus
agttgcctttgatttttcctctttg

SEQ ID NO: 166711 - DNA, 25 bp, Rattus norvegicus
agttgcgatcgcagctggccggaaa

SEQ ID NO: 166712 - DNA, 25 bp, Rattus norvegicus
agttgcgatcgctgctggccggaaa

SEQ ID NO: 166713 - DNA, 25 bp, Rattus norvegicus
agttgcgcagacacgccccaattgc

SEQ ID NO: 166714 - DNA, 25 bp, Rattus norvegicus
agttgcgcagactcgccccaattgc

SEQ ID NO: 166715 - DNA, 25 bp, Rattus norvegicus
agttgcgccaaaccctagagtctaa

SEQ ID NO: 166716 - DNA, 25 bp, Rattus norvegicus
agttgcgccaaagcctagagtctaa

SEQ ID NO: 166717 - DNA, 25 bp, Rattus norvegicus
agttgcgcccatagcccaggactct

SEQ ID NO: 166718 - DNA, 25 bp, Rattus norvegicus
agttgcgcccattgcccaggactct

SEQ ID NO: 166719 - DNA, 25 bp, Rattus norvegicus
agttgcgcctctagtgacttttcag

SEQ ID NO: 166720 - DNA, 25 bp, Rattus norvegicus
agttgcgcctcttgtgacttttcag

SEQ ID NO: 166721 - DNA, 25 bp, Rattus norvegicus
agttgcgcggcacgaaagcactgct

SEQ ID NO: 166722 - DNA, 25 bp, Rattus norvegicus
agttgcgcggcaggaaagcactgct

SEQ ID NO: 166723 - DNA, 25 bp, Rattus norvegicus
agttgcggagtgacctggtgttact

SEQ ID NO: 166724 - DNA, 25 bp, Rattus norvegicus
agttgcggagtgtcctggtgttact

SEQ ID NO: 166725 - DNA, 25 bp, Rattus norvegicus
agttgcgtttctatacagacatcca

SEQ ID NO: 166726 - DNA, 25 bp, Rattus norvegicus
agttgcgtttctttacagacatcca

SEQ ID NO: 166727 - DNA, 25 bp, Rattus norvegicus
agttgctaactgaactgctccctct

SEQ ID NO: 166728 - DNA, 25 bp, Rattus norvegicus
agttgctaactgtactgctccctct

SEQ ID NO: 166729 - DNA, 25 bp, Rattus norvegicus
agttgctaccctacctgaaaggtca

SEQ ID NO: 166730 - DNA, 25 bp, Rattus norvegicus
agttgctacccttcctgaaaggtca

SEQ ID NO: 166731 - DNA, 25 bp, Rattus norvegicus
agttgctacgccagagctactgtga

SEQ ID NO: 166732 - DNA, 25 bp, Rattus norvegicus
agttgctacgcctgagctactgtga

SEQ ID NO: 166733 - DNA, 25 bp, Rattus norvegicus
agttgctagaacatctttgctccca

SEQ ID NO: 166734 - DNA, 25 bp, Rattus norvegicus
agttgctagaacttctttgctccca

SEQ ID NO: 166735 - DNA, 25 bp, Rattus norvegicus
agttgctagatcatcagctgctaat

SEQ ID NO: 166736 - DNA, 25 bp, Rattus norvegicus
agttgctagatcttcagctgctaat

SEQ ID NO: 166737 - DNA, 25 bp, Rattus norvegicus
agttgctagcagctacatgccttac

SEQ ID NO: 166738 - DNA, 25 bp, Rattus norvegicus
agttgctagcaggtacatgccttac

SEQ ID NO: 166739 - DNA, 25 bp, Rattus norvegicus
agttgctattgtagcgttgatttta

SEQ ID NO: 166740 - DNA, 25 bp, Rattus norvegicus
agttgctattgttgcgttgatttta

SEQ ID NO: 166741 - DNA, 25 bp, Rattus norvegicus
agttgctcagaactgctggctaaga

SEQ ID NO: 166742 - DNA, 25 bp, Rattus norvegicus
agttgctcagaagtgctggctaaga

SEQ ID NO: 166743 - DNA, 25 bp, Rattus norvegicus
agttgctcagatatgcatcctgcca

SEQ ID NO: 166744 - DNA, 25 bp, Rattus norvegicus
agttgctcagatttgcatcctgcca

SEQ ID NO: 166745 - DNA, 25 bp, Rattus norvegicus
agttgctcagtaaggtcaagtcccc

SEQ ID NO: 166746 - DNA, 25 bp, Rattus norvegicus
agttgctcagtatggtcaagtcccc

SEQ ID NO: 166747 - DNA, 25 bp, Rattus norvegicus
agttgctcagttacctttaatccca

SEQ ID NO: 166748 - DNA, 25 bp, Rattus norvegicus
agttgctcagtttcctttaatccca

SEQ ID NO: 166749 - DNA, 25 bp, Rattus norvegicus
agttgctccaagatactctgtctga

SEQ ID NO: 166750 - DNA, 25 bp, Rattus norvegicus
agttgctccaagttactctgtctga

SEQ ID NO: 166751 - DNA, 25 bp, Rattus norvegicus
agttgctcctgtctctcacatttgg

SEQ ID NO: 166752 - DNA, 25 bp, Rattus norvegicus
agttgctcctgtgtctcacatttgg

SEQ ID NO: 166753 - DNA, 25 bp, Rattus norvegicus
agttgctcgtctcccagtgttttgt

SEQ ID NO: 166754 - DNA, 25 bp, Rattus norvegicus
agttgctcgtctgccagtgttttgt

SEQ ID NO: 166755 - DNA, 25 bp, Rattus norvegicus
agttgctctactcaaatgtttgatc

SEQ ID NO: 166756 - DNA, 25 bp, Rattus norvegicus
agttgctctactgaaatgtttgatc

SEQ ID NO: 166757 - DNA, 25 bp, Rattus norvegicus
agttgctctgcaatacatttgtctg

SEQ ID NO: 166758 - DNA, 25 bp, Rattus norvegicus
agttgctctgcattacatttgtctg

SEQ ID NO: 166759 - DNA, 25 bp, Rattus norvegicus
agttgctctgtgaggaaagataaaa

SEQ ID NO: 166760 - DNA, 25 bp, Rattus norvegicus
agttgctctgtgtggaaagataaaa

SEQ ID NO: 166761 - DNA, 25 bp, Rattus norvegicus
agttgctctttgacccaagtctagg

SEQ ID NO: 166762 - DNA, 25 bp, Rattus norvegicus
agttgctctttgtcccaagtctagg

SEQ ID NO: 166763 - DNA, 25 bp, Rattus norvegicus
agttgctgactgctggttgatgcta

SEQ ID NO: 166764 - DNA, 25 bp, Rattus norvegicus
agttgctgactggtggttgatgcta

SEQ ID NO: 166765 - DNA, 25 bp, Rattus norvegicus
agttgctgccagatttgattgtttt

SEQ ID NO: 166766 - DNA, 25 bp, Rattus norvegicus
agttgctgccagttttgattgtttt

SEQ ID NO: 166767 - DNA, 25 bp, Rattus norvegicus
agttgctgccatcgtgctgtgagca

SEQ ID NO: 166768 - DNA, 25 bp, Rattus norvegicus
agttgctgccatggtgctgtgagca

SEQ ID NO: 166769 - DNA, 25 bp, Rattus norvegicus
agttgctgcctcacaggagttgtat

SEQ ID NO: 166770 - DNA, 25 bp, Rattus norvegicus
agttgctgcctctcaggagttgtat

SEQ ID NO: 166771 - DNA, 25 bp, Rattus norvegicus
agttgctggaacaatggcttctcgt

SEQ ID NO: 166772 - DNA, 25 bp, Rattus norvegicus
agttgctggaactatggcttctcgt

SEQ ID NO: 166773 - DNA, 25 bp, Rattus norvegicus
agttgctgggcgagttaaacctcat

SEQ ID NO: 166774 - DNA, 25 bp, Rattus norvegicus
agttgctgggcgtgttaaacctcat

SEQ ID NO: 166775 - DNA, 25 bp, Rattus norvegicus
agttgctgtacaataccgtagtccc

SEQ ID NO: 166776 - DNA, 25 bp, Rattus norvegicus
agttgctgtacattaccgtagtccc

SEQ ID NO: 166777 - DNA, 25 bp, Rattus norvegicus
agttgctgtctcaaggtcagggcta

SEQ ID NO: 166778 - DNA, 25 bp, Rattus norvegicus
agttgctgtctctaggtcagggcta

SEQ ID NO: 166779 - DNA, 25 bp, Rattus norvegicus
agttgctgtggtctctttcatttac

SEQ ID NO: 166780 - DNA, 25 bp, Rattus norvegicus
agttgctgtggtgtctttcatttac

SEQ ID NO: 166781 - DNA, 25 bp, Rattus norvegicus
agttgctgttgcataaactacgaca

SEQ ID NO: 166782 - DNA, 25 bp, Rattus norvegicus
agttgctgttgcttaaactacgaca

SEQ ID NO: 166783 - DNA, 25 bp, Rattus norvegicus
agttgctgttttctggaggctgcta

SEQ ID NO: 166784 - DNA, 25 bp, Rattus norvegicus
agttgctgttttgtggaggctgcta

SEQ ID NO: 166785 - DNA, 25 bp, Rattus norvegicus
agttgcttaactagtctttgcccaa

SEQ ID NO: 166786 - DNA, 25 bp, Rattus norvegicus
agttgcttaacttgtctttgcccaa

SEQ ID NO: 166787 - DNA, 25 bp, Rattus norvegicus
agttgcttagcacacatttctcctc

SEQ ID NO: 166788 - DNA, 25 bp, Rattus norvegicus
agttgcttagcagacatttctcctc

SEQ ID NO: 166789 - DNA, 25 bp, Rattus norvegicus
agttgcttagccaatgcatggcctt

SEQ ID NO: 166790 - DNA, 25 bp, Rattus norvegicus
agttgcttagcctatgcatggcctt

SEQ ID NO: 166791 - DNA, 25 bp, Rattus norvegicus
agttgcttcctcatgacagctgaat

SEQ ID NO: 166792 - DNA, 25 bp, Rattus norvegicus
agttgcttcctcttgacagctgaat

SEQ ID NO: 166793 - DNA, 25 bp, Rattus norvegicus
agttgcttcgaaacttccccaaaga

SEQ ID NO: 166794 - DNA, 25 bp, Rattus norvegicus
agttgcttcgaatcttccccaaaga

SEQ ID NO: 166795 - DNA, 25 bp, Rattus norvegicus
agttgcttcgtgagcagcgcagtgc

SEQ ID NO: 166796 - DNA, 25 bp, Rattus norvegicus
agttgcttcgtgtgcagcgcagtgc

SEQ ID NO: 166797 - DNA, 25 bp, Rattus norvegicus
agttgcttcttcaattacgtttcca

SEQ ID NO: 166798 - DNA, 25 bp, Rattus norvegicus
agttgcttcttctattacgtttcca

SEQ ID NO: 166799 - DNA, 25 bp, Rattus norvegicus
agttgcttgcatactaacccgattg

SEQ ID NO: 166800 - DNA, 25 bp, Rattus norvegicus
agttgcttgcattctaacccgattg

SEQ ID NO: 166801 - DNA, 25 bp, Rattus norvegicus
agttgcttgctgattggaattatta

SEQ ID NO: 166802 - DNA, 25 bp, Rattus norvegicus
agttgcttgctgtttggaattatta

SEQ ID NO: 166803 - DNA, 25 bp, Rattus norvegicus
agttgcttggctcttcctccacatt

SEQ ID NO: 166804 - DNA, 25 bp, Rattus norvegicus
agttgcttggctgttcctccacatt

SEQ ID NO: 166805 - DNA, 25 bp, Rattus norvegicus
agttgcttgtggaggttcactgcct

SEQ ID NO: 166806 - DNA, 25 bp, Rattus norvegicus
agttgcttgtggtggttcactgcct

SEQ ID NO: 166807 - DNA, 25 bp, Rattus norvegicus
agttgctttaacattggctcgcctg

SEQ ID NO: 166808 - DNA, 25 bp, Rattus norvegicus
agttgctttaactttggctcgcctg

SEQ ID NO: 166809 - DNA, 25 bp, Rattus norvegicus
agttgctttactacccaagacatct

SEQ ID NO: 166810 - DNA, 25 bp, Rattus norvegicus
agttgctttacttcccaagacatct

SEQ ID NO: 166811 - DNA, 25 bp, Rattus norvegicus
agttgctttccaagagacagaagga

SEQ ID NO: 166812 - DNA, 25 bp, Rattus norvegicus
agttgctttccatgagacagaagga

SEQ ID NO: 166813 - DNA, 25 bp, Rattus norvegicus
agttgcttttgaacttcttcttctt

SEQ ID NO: 166814 - DNA, 25 bp, Rattus norvegicus
agttgcttttgatcttcttcttctt

SEQ ID NO: 166815 - DNA, 25 bp, Rattus norvegicus
agttgcttttttctctgtatttgaa

SEQ ID NO: 166816 - DNA, 25 bp, Rattus norvegicus
agttgcttttttgtctgtatttgaa

SEQ ID NO: 166817 - DNA, 25 bp, Rattus norvegicus
agttggaaacagctcgccatgggct

SEQ ID NO: 166818 - DNA, 25 bp, Rattus norvegicus
agttggaaacaggtcgccatgggct

SEQ ID NO: 166819 - DNA, 25 bp, Rattus norvegicus
agttggaacttcatttcctcatgaa

SEQ ID NO: 166820 - DNA, 25 bp, Rattus norvegicus
agttggaacttcttttcctcatgaa

SEQ ID NO: 166821 - DNA, 25 bp, Rattus norvegicus
agttggacagtccactctctagtgt

SEQ ID NO: 166822 - DNA, 25 bp, Rattus norvegicus
agttggacagtcgactctctagtgt

SEQ ID NO: 166823 - DNA, 25 bp, Rattus norvegicus
agttggacatacctgagtttggaat

SEQ ID NO: 166824 - DNA, 25 bp, Rattus norvegicus
agttggacatacgtgagtttggaat

SEQ ID NO: 166825 - DNA, 25 bp, Rattus norvegicus
agttggaccaccaccgtaagtcata

SEQ ID NO: 166826 - DNA, 25 bp, Rattus norvegicus
agttggaccacctccgtaagtcata

SEQ ID NO: 166827 - DNA, 25 bp, Rattus norvegicus
agttggaccatcactggcagggatc

SEQ ID NO: 166828 - DNA, 25 bp, Rattus norvegicus
agttggaccatctctggcagggatc

SEQ ID NO: 166829 - DNA, 25 bp, Rattus norvegicus
agttggacgcacagctggatgctta

SEQ ID NO: 166830 - DNA, 25 bp, Rattus norvegicus
agttggacgcactgctggatgctta

SEQ ID NO: 166831 - DNA, 25 bp, Rattus norvegicus
agttggactgctaggcttttgtaca

SEQ ID NO: 166832 - DNA, 25 bp, Rattus norvegicus
agttggactgcttggcttttgtaca

SEQ ID NO: 166833 - DNA, 25 bp, Rattus norvegicus
agttggagatgcaaatgtcctcccc

SEQ ID NO: 166834 - DNA, 25 bp, Rattus norvegicus
agttggagatgctaatgtcctcccc

SEQ ID NO: 166835 - DNA, 25 bp, Rattus norvegicus
agttggagattaactcgctcgcctg

SEQ ID NO: 166836 - DNA, 25 bp, Rattus norvegicus
agttggagattatctcgctcgcctg

SEQ ID NO: 166837 - DNA, 25 bp, Rattus norvegicus
agttggagcgatctcattcttctga

SEQ ID NO: 166838 - DNA, 25 bp, Rattus norvegicus
agttggagcgatgtcattcttctga

SEQ ID NO: 166839 - DNA, 25 bp, Rattus norvegicus
agttggagtacccagtgttgcccat

SEQ ID NO: 166840 - DNA, 25 bp, Rattus norvegicus
agttggagtaccgagtgttgcccat

SEQ ID NO: 166841 - DNA, 25 bp, Rattus norvegicus
agttggagtgccatcattcgagtat

SEQ ID NO: 166842 - DNA, 25 bp, Rattus norvegicus
agttggagtgccttcattcgagtat

SEQ ID NO: 166843 - DNA, 25 bp, Rattus norvegicus
agttggagttttctgctgtggaccc

SEQ ID NO: 166844 - DNA, 25 bp, Rattus norvegicus
agttggagttttgtgctgtggaccc

SEQ ID NO: 166845 - DNA, 25 bp, Rattus norvegicus
agttggatataacccacgctcttac

SEQ ID NO: 166846 - DNA, 25 bp, Rattus norvegicus
agttggatataagccacgctcttac

SEQ ID NO: 166847 - DNA, 25 bp, Rattus norvegicus
agttggatatttctctacattcctg

SEQ ID NO: 166848 - DNA, 25 bp, Rattus norvegicus
agttggatatttgtctacattcctg

SEQ ID NO: 166849 - DNA, 25 bp, Rattus norvegicus
agttggatccagcaccagctgctgt

SEQ ID NO: 166850 - DNA, 25 bp, Rattus norvegicus
agttggatccaggaccagctgctgt

SEQ ID NO: 166851 - DNA, 25 bp, Rattus norvegicus
agttggatgaggattcgcccttcct

SEQ ID NO: 166852 - DNA, 25 bp, Rattus norvegicus
agttggatgaggtttcgcccttcct

SEQ ID NO: 166853 - DNA, 25 bp, Rattus norvegicus
agttggatgcatcgcagcaactcca

SEQ ID NO: 166854 - DNA, 25 bp, Rattus norvegicus
agttggatgcatggcagcaactcca

SEQ ID NO: 166855 - DNA, 25 bp, Rattus norvegicus
agttggattcccaagcttttagcaa

SEQ ID NO: 166856 - DNA, 25 bp, Rattus norvegicus
agttggattccctagcttttagcaa

SEQ ID NO: 166857 - DNA, 25 bp, Rattus norvegicus
agttggatttctcctcggctcctaa

SEQ ID NO: 166858 - DNA, 25 bp, Rattus norvegicus
agttggatttctgctcggctcctaa

SEQ ID NO: 166859 - DNA, 25 bp, Rattus norvegicus
agttggcaaagaaactccaggaaga

SEQ ID NO: 166860 - DNA, 25 bp, Rattus norvegicus
agttggcaaagatactccaggaaga

SEQ ID NO: 166861 - DNA, 25 bp, Rattus norvegicus
agttggcaaaggataccgcctcact

SEQ ID NO: 166862 - DNA, 25 bp, Rattus norvegicus
agttggcaaaggttaccgcctcact

SEQ ID NO: 166863 - DNA, 25 bp, Rattus norvegicus
agttggcaaagtctctaacctccct

SEQ ID NO: 166864 - DNA, 25 bp, Rattus norvegicus
agttggcaaagtgtctaacctccct

SEQ ID NO: 166865 - DNA, 25 bp, Rattus norvegicus
agttggcaaccaagcatacttccag

SEQ ID NO: 166866 - DNA, 25 bp, Rattus norvegicus
agttggcaaccatgcatacttccag

SEQ ID NO: 166867 - DNA, 25 bp, Rattus norvegicus
agttggcaacttaactccagcaagt

SEQ ID NO: 166868 - DNA, 25 bp, Rattus norvegicus
agttggcaactttactccagcaagt

SEQ ID NO: 166869 - DNA, 25 bp, Rattus norvegicus
agttggcacactactccagtttgga

SEQ ID NO: 166870 - DNA, 25 bp, Rattus norvegicus
agttggcacacttctccagtttgga

SEQ ID NO: 166871 - DNA, 25 bp, Rattus norvegicus
agttggcagccaaccgtgttctatg

SEQ ID NO: 166872 - DNA, 25 bp, Rattus norvegicus
agttggcagccatccgtgttctatg

SEQ ID NO: 166873 - DNA, 25 bp, Rattus norvegicus
agttggcaggttattcccgtcatcg

SEQ ID NO: 166874 - DNA, 25 bp, Rattus norvegicus
agttggcaggtttttcccgtcatcg

SEQ ID NO: 166875 - DNA, 25 bp, Rattus norvegicus
agttggcatagaagggccccggtga

SEQ ID NO: 166876 - DNA, 25 bp, Rattus norvegicus
agttggcatagatgggccccggtga

SEQ ID NO: 166877 - DNA, 25 bp, Rattus norvegicus
agttggcatgcacacgtgacgtgac

SEQ ID NO: 166878 - DNA, 25 bp, Rattus norvegicus
agttggcatgcagacgtgacgtgac

SEQ ID NO: 166879 - DNA, 25 bp, Rattus norvegicus
agttggccaagtaccccatgatatg

SEQ ID NO: 166880 - DNA, 25 bp, Rattus norvegicus
agttggccaagttccccatgatatg

SEQ ID NO: 166881 - DNA, 25 bp, Rattus norvegicus
agttggccacttatgcaatttgatt

SEQ ID NO: 166882 - DNA, 25 bp, Rattus norvegicus
agttggccacttttgcaatttgatt

SEQ ID NO: 166883 - DNA, 25 bp, Rattus norvegicus
agttggccagagcatactgctttca

SEQ ID NO: 166884 - DNA, 25 bp, Rattus norvegicus
agttggccagaggatactgctttca

SEQ ID NO: 166885 - DNA, 25 bp, Rattus norvegicus
agttggcccaacagctttcctgtct

SEQ ID NO: 166886 - DNA, 25 bp, Rattus norvegicus
agttggcccaactgctttcctgtct

SEQ ID NO: 166887 - DNA, 25 bp, Rattus norvegicus
agttggccctgactacactgtagaa

SEQ ID NO: 166888 - DNA, 25 bp, Rattus norvegicus
agttggccctgagtacactgtagaa

SEQ ID NO: 166889 - DNA, 25 bp, Rattus norvegicus
agttggcccttaagttctgctagca

SEQ ID NO: 166890 - DNA, 25 bp, Rattus norvegicus
agttggcccttatgttctgctagca

SEQ ID NO: 166891 - DNA, 25 bp, Rattus norvegicus
agttggccgaaaaggcaatgctgga

SEQ ID NO: 166892 - DNA, 25 bp, Rattus norvegicus
agttggccgaaatggcaatgctgga

SEQ ID NO: 166893 - DNA, 25 bp, Rattus norvegicus
agttggccggatcctgacttatccc

SEQ ID NO: 166894 - DNA, 25 bp, Rattus norvegicus
agttggccggatgctgacttatccc

SEQ ID NO: 166895 - DNA, 25 bp, Rattus norvegicus
agttggccgtgacgatttgtctcca

SEQ ID NO: 166896 - DNA, 25 bp, Rattus norvegicus
agttggccgtgaggatttgtctcca

SEQ ID NO: 166897 - DNA, 25 bp, Rattus norvegicus
agttggcctctgcttagcctttata

SEQ ID NO: 166898 - DNA, 25 bp, Rattus norvegicus
agttggcctctggttagcctttata

SEQ ID NO: 166899 - DNA, 25 bp, Rattus norvegicus
agttggccttcacactgcgtgcctg

SEQ ID NO: 166900 - DNA, 25 bp, Rattus norvegicus
agttggccttcagactgcgtgcctg

SEQ ID NO: 166901 - DNA, 25 bp, Rattus norvegicus
agttggcgaattcaggagattccca

SEQ ID NO: 166902 - DNA, 25 bp, Rattus norvegicus
agttggcgaattgaggagattccca

SEQ ID NO: 166903 - DNA, 25 bp, Rattus norvegicus
agttggctagcaaatggatttcatt

SEQ ID NO: 166904 - DNA, 25 bp, Rattus norvegicus
agttggctagcatatggatttcatt

SEQ ID NO: 166905 - DNA, 25 bp, Rattus norvegicus
agttggctcactagacaatgctcac

SEQ ID NO: 166906 - DNA, 25 bp, Rattus norvegicus
agttggctcacttgacaatgctcac

SEQ ID NO: 166907 - DNA, 25 bp, Rattus norvegicus
agttggctcatacgttgtgtttgtc

SEQ ID NO: 166908 - DNA, 25 bp, Rattus norvegicus
agttggctcataggttgtgtttgtc

SEQ ID NO: 166909 - DNA, 25 bp, Rattus norvegicus
agttggctctcactttcgcaaggct

SEQ ID NO: 166910 - DNA, 25 bp, Rattus norvegicus
agttggctctcagtttcgcaaggct

SEQ ID NO: 166911 - DNA, 25 bp, Rattus norvegicus
agttggctcttacctagcaatcaag

SEQ ID NO: 166912 - DNA, 25 bp, Rattus norvegicus
agttggctcttagctagcaatcaag

SEQ ID NO: 166913 - DNA, 25 bp, Rattus norvegicus
agttggctgacacaacgtttttgtg

SEQ ID NO: 166914 - DNA, 25 bp, Rattus norvegicus
agttggctgacagaacgtttttgtg

SEQ ID NO: 166915 - DNA, 25 bp, Rattus norvegicus
agttggctgccaacctgaggttata

SEQ ID NO: 166916 - DNA, 25 bp, Rattus norvegicus
agttggctgccatcctgaggttata

SEQ ID NO: 166917 - DNA, 25 bp, Rattus norvegicus
agttggctgctcaacagactctcta

SEQ ID NO: 166918 - DNA, 25 bp, Rattus norvegicus
agttggctgctctacagactctcta

SEQ ID NO: 166919 - DNA, 25 bp, Rattus norvegicus
agttggctgtacagactggtctctc

SEQ ID NO: 166920 - DNA, 25 bp, Rattus norvegicus
agttggctgtactgactggtctctc

SEQ ID NO: 166921 - DNA, 25 bp, Rattus norvegicus
agttggctgttaatacacctgaaaa

SEQ ID NO: 166922 - DNA, 25 bp, Rattus norvegicus
agttggctgttattacacctgaaaa

SEQ ID NO: 166923 - DNA, 25 bp, Rattus norvegicus
agttggcttgctatatctaggacga

SEQ ID NO: 166924 - DNA, 25 bp, Rattus norvegicus
agttggcttgctttatctaggacga

SEQ ID NO: 166925 - DNA, 25 bp, Rattus norvegicus
agttggctttgcatctttcacataa

SEQ ID NO: 166926 - DNA, 25 bp, Rattus norvegicus
agttggctttgcttctttcacataa

SEQ ID NO: 166927 - DNA, 25 bp, Rattus norvegicus
agttggcttttgaccctagaggcga

SEQ ID NO: 166928 - DNA, 25 bp, Rattus norvegicus
agttggcttttgtccctagaggcga

SEQ ID NO: 166929 - DNA, 25 bp, Rattus norvegicus
agttgggaaatgaggcttctgttca

SEQ ID NO: 166930 - DNA, 25 bp, Rattus norvegicus
agttgggaaatgtggcttctgttca

SEQ ID NO: 166931 - DNA, 25 bp, Rattus norvegicus
agttgggacagcctgccagatacca

SEQ ID NO: 166932 - DNA, 25 bp, Rattus norvegicus
agttgggacagcgtgccagatacca

SEQ ID NO: 166933 - DNA, 25 bp, Rattus norvegicus
agttgggactgcagtgcctctgact

SEQ ID NO: 166934 - DNA, 25 bp, Rattus norvegicus
agttgggactgctgtgcctctgact

SEQ ID NO: 166935 - DNA, 25 bp, Rattus norvegicus
agttgggacttcagattacattcgt

SEQ ID NO: 166936 - DNA, 25 bp, Rattus norvegicus
agttgggacttctgattacattcgt

SEQ ID NO: 166937 - DNA, 25 bp, Rattus norvegicus
agttgggagcaccttttgtcatgga

SEQ ID NO: 166938 - DNA, 25 bp, Rattus norvegicus
agttgggagcacgttttgtcatgga

SEQ ID NO: 166939 - DNA, 25 bp, Rattus norvegicus
agttgggagccaccatggtcaccgt

SEQ ID NO: 166940 - DNA, 25 bp, Rattus norvegicus
agttgggagccagcatggtcaccgt

SEQ ID NO: 166941 - DNA, 25 bp, Rattus norvegicus
agttgggatctgaaggcctgtccct

SEQ ID NO: 166942 - DNA, 25 bp, Rattus norvegicus
agttgggatctgtaggcctgtccct

SEQ ID NO: 166943 - DNA, 25 bp, Rattus norvegicus
agttgggcactcactggccaggcca

SEQ ID NO: 166944 - DNA, 25 bp, Rattus norvegicus
agttgggcactctctggccaggcca

SEQ ID NO: 166945 - DNA, 25 bp, Rattus norvegicus
agttgggcactgacagtctcactct

SEQ ID NO: 166946 - DNA, 25 bp, Rattus norvegicus
agttgggcactgtcagtctcactct

SEQ ID NO: 166947 - DNA, 25 bp, Rattus norvegicus
agttgggcacttagtctggcgtagc

SEQ ID NO: 166948 - DNA, 25 bp, Rattus norvegicus
agttgggcactttgtctggcgtagc

SEQ ID NO: 166949 - DNA, 25 bp, Rattus norvegicus
agttgggcagagcactgtcccattg

SEQ ID NO: 166950 - DNA, 25 bp, Rattus norvegicus
agttgggcagaggactgtcccattg

SEQ ID NO: 166951 - DNA, 25 bp, Rattus norvegicus
agttgggcatctatccagctgtgga

SEQ ID NO: 166952 - DNA, 25 bp, Rattus norvegicus
agttgggcatctttccagctgtgga

SEQ ID NO: 166953 - DNA, 25 bp, Rattus norvegicus
agttgggcatgaacccttgcagttc

SEQ ID NO: 166954 - DNA, 25 bp, Rattus norvegicus
agttgggcatgatcccttgcagttc

SEQ ID NO: 166955 - DNA, 25 bp, Rattus norvegicus
agttgggccactctcaccctcagtt

SEQ ID NO: 166956 - DNA, 25 bp, Rattus norvegicus
agttgggccactgtcaccctcagtt

SEQ ID NO: 166957 - DNA, 25 bp, Rattus norvegicus
agttgggcccagatctgagggtctc

SEQ ID NO: 166958 - DNA, 25 bp, Rattus norvegicus
agttgggcccagttctgagggtctc

SEQ ID NO: 166959 - DNA, 25 bp, Rattus norvegicus
agttgggcccctcctcatggtgagc

SEQ ID NO: 166960 - DNA, 25 bp, Rattus norvegicus
agttgggcccctgctcatggtgagc

SEQ ID NO: 166961 - DNA, 25 bp, Rattus norvegicus
agttgggcctggagttacatgcata

SEQ ID NO: 166962 - DNA, 25 bp, Rattus norvegicus
agttgggcctggtgttacatgcata

SEQ ID NO: 166963 - DNA, 25 bp, Rattus norvegicus
agttgggctcacagcctcaggaagg

SEQ ID NO: 166964 - DNA, 25 bp, Rattus norvegicus
agttgggctcactgcctcaggaagg

SEQ ID NO: 166965 - DNA, 25 bp, Rattus norvegicus
agttgggctccgcaatgtccttcac

SEQ ID NO: 166966 - DNA, 25 bp, Rattus norvegicus
agttgggctccggaatgtccttcac

SEQ ID NO: 166967 - DNA, 25 bp, Rattus norvegicus
agttgggctttcagcttgttttata

SEQ ID NO: 166968 - DNA, 25 bp, Rattus norvegicus
agttgggctttctgcttgttttata

SEQ ID NO: 166969 - DNA, 25 bp, Rattus norvegicus
agttgggtaagtatatctgtgcata

SEQ ID NO: 166970 - DNA, 25 bp, Rattus norvegicus
agttgggtaagtttatctgtgcata

SEQ ID NO: 166971 - DNA, 25 bp, Rattus norvegicus
agttgggtccaacagccactttcag

SEQ ID NO: 166972 - DNA, 25 bp, Rattus norvegicus
agttgggtccaagagccactttcag

SEQ ID NO: 166973 - DNA, 25 bp, Rattus norvegicus
agttgggtcttgcaggccaaagcca

SEQ ID NO: 166974 - DNA, 25 bp, Rattus norvegicus
agttgggtcttggaggccaaagcca

SEQ ID NO: 166975 - DNA, 25 bp, Rattus norvegicus
agttgggtgactcgattgctttccc

SEQ ID NO: 166976 - DNA, 25 bp, Rattus norvegicus
agttgggtgactggattgctttccc

SEQ ID NO: 166977 - DNA, 25 bp, Rattus norvegicus
agttggtaaagtcacctgctgccaa

SEQ ID NO: 166978 - DNA, 25 bp, Rattus norvegicus
agttggtaaagtgacctgctgccaa

SEQ ID NO: 166979 - DNA, 25 bp, Rattus norvegicus
agttggtagcatactcagcaccaca

SEQ ID NO: 166980 - DNA, 25 bp, Rattus norvegicus
agttggtagcattctcagcaccaca

SEQ ID NO: 166981 - DNA, 25 bp, Rattus norvegicus
agttggtagccaagcctcaggtaga

SEQ ID NO: 166982 - DNA, 25 bp, Rattus norvegicus
agttggtagccatgcctcaggtaga

SEQ ID NO: 166983 - DNA, 25 bp, Rattus norvegicus
agttggtagtggagcttgccgccaa

SEQ ID NO: 166984 - DNA, 25 bp, Rattus norvegicus
agttggtagtggtgcttgccgccaa

SEQ ID NO: 166985 - DNA, 25 bp, Rattus norvegicus
agttggtcataaatcacccccggct

SEQ ID NO: 166986 - DNA, 25 bp, Rattus norvegicus
agttggtcataattcacccccggct

SEQ ID NO: 166987 - DNA, 25 bp, Rattus norvegicus
agttggtccattaagctgactgttt

SEQ ID NO: 166988 - DNA, 25 bp, Rattus norvegicus
agttggtccatttagctgactgttt

SEQ ID NO: 166989 - DNA, 25 bp, Rattus norvegicus
agttggtcctacactctcagtgtta

SEQ ID NO: 166990 - DNA, 25 bp, Rattus norvegicus
agttggtcctactctctcagtgtta

SEQ ID NO: 166991 - DNA, 25 bp, Rattus norvegicus
agttggtcgccaacaacgtgacgct

SEQ ID NO: 166992 - DNA, 25 bp, Rattus norvegicus
agttggtcgccatcaacgtgacgct

SEQ ID NO: 166993 - DNA, 25 bp, Rattus norvegicus
agttggtctaagatcctggatgaca

SEQ ID NO: 166994 - DNA, 25 bp, Rattus norvegicus
agttggtctaagttcctggatgaca

SEQ ID NO: 166995 - DNA, 25 bp, Rattus norvegicus
agttggtctaatccctttctccatt

SEQ ID NO: 166996 - DNA, 25 bp, Rattus norvegicus
agttggtctaatgcctttctccatt

SEQ ID NO: 166997 - DNA, 25 bp, Rattus norvegicus
agttggtcttggcattaagtgctcc

SEQ ID NO: 166998 - DNA, 25 bp, Rattus norvegicus
agttggtcttgggattaagtgctcc

SEQ ID NO: 166999 - DNA, 25 bp, Rattus norvegicus
agttggtgacacagcagaagcctgt

SEQ ID NO: 167000 - DNA, 25 bp, Rattus norvegicus
agttggtgacactgcagaagcctgt

SEQ ID NO: 167001 - DNA, 25 bp, Rattus norvegicus
agttggtgacagctaaccccagcat

SEQ ID NO: 167002 - DNA, 25 bp, Rattus norvegicus
agttggtgacaggtaaccccagcat

SEQ ID NO: 167003 - DNA, 25 bp, Rattus norvegicus
agttggtgagacctcgaagctttca

SEQ ID NO: 167004 - DNA, 25 bp, Rattus norvegicus
agttggtgagacgtcgaagctttca

SEQ ID NO: 167005 - DNA, 25 bp, Rattus norvegicus
agttggtgccctcatctggagaaga

SEQ ID NO: 167006 - DNA, 25 bp, Rattus norvegicus
agttggtgccctgatctggagaaga

SEQ ID NO: 167007 - DNA, 25 bp, Rattus norvegicus
agttggtgcctacgtatctggattt

SEQ ID NO: 167008 - DNA, 25 bp, Rattus norvegicus
agttggtgcctaggtatctggattt

SEQ ID NO: 167009 - DNA, 25 bp, Rattus norvegicus
agttggtgctgcacaatccgtacgc

SEQ ID NO: 167010 - DNA, 25 bp, Rattus norvegicus
agttggtgctgctcaatccgtacgc

SEQ ID NO: 167011 - DNA, 25 bp, Rattus norvegicus
agttggtggaatccgccatttccca

SEQ ID NO: 167012 - DNA, 25 bp, Rattus norvegicus
agttggtggaatgcgccatttccca

SEQ ID NO: 167013 - DNA, 25 bp, Rattus norvegicus
agttggtggagcacagcacagccct

SEQ ID NO: 167014 - DNA, 25 bp, Rattus norvegicus
agttggtggagctcagcacagccct

SEQ ID NO: 167015 - DNA, 25 bp, Rattus norvegicus
agttggtgtgatagcttctgcagcc

SEQ ID NO: 167016 - DNA, 25 bp, Rattus norvegicus
agttggtgtgattgcttctgcagcc

SEQ ID NO: 167017 - DNA, 25 bp, Rattus norvegicus
agttggtgtgcccaccccaataggg

SEQ ID NO: 167018 - DNA, 25 bp, Rattus norvegicus
agttggtgtgccgaccccaataggg

SEQ ID NO: 167019 - DNA, 25 bp, Rattus norvegicus
agttggttccaaagcagcctggccg

SEQ ID NO: 167020 - DNA, 25 bp, Rattus norvegicus
agttggttccaatgcagcctggccg

SEQ ID NO: 167021 - DNA, 25 bp, Rattus norvegicus
agttggttccctctcagccattgca

SEQ ID NO: 167022 - DNA, 25 bp, Rattus norvegicus
agttggttccctgtcagccattgca

SEQ ID NO: 167023 - DNA, 25 bp, Rattus norvegicus
agttggttgaggctacctttgccct

SEQ ID NO: 167024 - DNA, 25 bp, Rattus norvegicus
agttggttgagggtacctttgccct

SEQ ID NO: 167025 - DNA, 25 bp, Rattus norvegicus
agttggttggaaacactgcccggaa

SEQ ID NO: 167026 - DNA, 25 bp, Rattus norvegicus
agttggttggaatcactgcccggaa

SEQ ID NO: 167027 - DNA, 25 bp, Rattus norvegicus
agttggttgtacctctctagaacga

SEQ ID NO: 167028 - DNA, 25 bp, Rattus norvegicus
agttggttgtacgtctctagaacga

SEQ ID NO: 167029 - DNA, 25 bp, Rattus norvegicus
agttggttttccatctactcagacg

SEQ ID NO: 167030 - DNA, 25 bp, Rattus norvegicus
agttggttttccttctactcagacg

SEQ ID NO: 167031 - DNA, 25 bp, Rattus norvegicus
agttgtaaccagattctgggtctgt

SEQ ID NO: 167032 - DNA, 25 bp, Rattus norvegicus
agttgtaaccagtttctgggtctgt

SEQ ID NO: 167033 - DNA, 25 bp, Rattus norvegicus
agttgtaatctcatgtgtctgcatt

SEQ ID NO: 167034 - DNA, 25 bp, Rattus norvegicus
agttgtaatctcttgtgtctgcatt

SEQ ID NO: 167035 - DNA, 25 bp, Rattus norvegicus
agttgtacatgaatcgcctgggcac

SEQ ID NO: 167036 - DNA, 25 bp, Rattus norvegicus
agttgtacatgattcgcctgggcac

SEQ ID NO: 167037 - DNA, 25 bp, Rattus norvegicus
agttgtaccactcctgggtgttcac

SEQ ID NO: 167038 - DNA, 25 bp, Rattus norvegicus
agttgtaccactgctgggtgttcac

SEQ ID NO: 167039 - DNA, 25 bp, Rattus norvegicus
agttgtaccctactgtgctcagaca

SEQ ID NO: 167040 - DNA, 25 bp, Rattus norvegicus
agttgtaccctagtgtgctcagaca

SEQ ID NO: 167041 - DNA, 25 bp, Rattus norvegicus
agttgtacctaacctgactccaagt

SEQ ID NO: 167042 - DNA, 25 bp, Rattus norvegicus
agttgtacctaagctgactccaagt

SEQ ID NO: 167043 - DNA, 25 bp, Rattus norvegicus
agttgtacctttaccatattgccag

SEQ ID NO: 167044 - DNA, 25 bp, Rattus norvegicus
agttgtaccttttccatattgccag

SEQ ID NO: 167045 - DNA, 25 bp, Rattus norvegicus
agttgtactcatcggccaaggcctg

SEQ ID NO: 167046 - DNA, 25 bp, Rattus norvegicus
agttgtactcatgggccaaggcctg

SEQ ID NO: 167047 - DNA, 25 bp, Rattus norvegicus
agttgtacttgcagatgctgtctct

SEQ ID NO: 167048 - DNA, 25 bp, Rattus norvegicus
agttgtacttgctgatgctgtctct

SEQ ID NO: 167049 - DNA, 25 bp, Rattus norvegicus
agttgtagactgaaggctcctgcct

SEQ ID NO: 167050 - DNA, 25 bp, Rattus norvegicus
agttgtagactgtaggctcctgcct

SEQ ID NO: 167051 - DNA, 25 bp, Rattus norvegicus
agttgtaggactcttgccactggct

SEQ ID NO: 167052 - DNA, 25 bp, Rattus norvegicus
agttgtaggactgttgccactggct

SEQ ID NO: 167053 - DNA, 25 bp, Rattus norvegicus
agttgtagtcaaacactctgtgcaa

SEQ ID NO: 167054 - DNA, 25 bp, Rattus norvegicus
agttgtagtcaatcactctgtgcaa

SEQ ID NO: 167055 - DNA, 25 bp, Rattus norvegicus
agttgtagtcctacttctgtacgga

SEQ ID NO: 167056 - DNA, 25 bp, Rattus norvegicus
agttgtagtccttcttctgtacgga

SEQ ID NO: 167057 - DNA, 25 bp, Rattus norvegicus
agttgtatatgtactgttaccctac

SEQ ID NO: 167058 - DNA, 25 bp, Rattus norvegicus
agttgtatatgttctgttaccctac

SEQ ID NO: 167059 - DNA, 25 bp, Rattus norvegicus
agttgtatccccacctgaaagcagt

SEQ ID NO: 167060 - DNA, 25 bp, Rattus norvegicus
agttgtatcccctcctgaaagcagt

SEQ ID NO: 167061 - DNA, 25 bp, Rattus norvegicus
agttgtatcgatctcttttcggcca

SEQ ID NO: 167062 - DNA, 25 bp, Rattus norvegicus
agttgtatcgatgtcttttcggcca

SEQ ID NO: 167063 - DNA, 25 bp, Rattus norvegicus
agttgtattctgatttgacgtctga

SEQ ID NO: 167064 - DNA, 25 bp, Rattus norvegicus
agttgtattctgttttgacgtctga

SEQ ID NO: 167065 - DNA, 25 bp, Rattus norvegicus
agttgtcacaagcacagcggatgta

SEQ ID NO: 167066 - DNA, 25 bp, Rattus norvegicus
agttgtcacaaggacagcggatgta

SEQ ID NO: 167067 - DNA, 25 bp, Rattus norvegicus
agttgtcacacaaggactgtccagt

SEQ ID NO: 167068 - DNA, 25 bp, Rattus norvegicus
agttgtcacacatggactgtccagt

SEQ ID NO: 167069 - DNA, 25 bp, Rattus norvegicus
agttgtcacatgacctccactgtag

SEQ ID NO: 167070 - DNA, 25 bp, Rattus norvegicus
agttgtcacatgtcctccactgtag

SEQ ID NO: 167071 - DNA, 25 bp, Rattus norvegicus
agttgtcaccccacataaattgatg

SEQ ID NO: 167072 - DNA, 25 bp, Rattus norvegicus
agttgtcacccctcataaattgatg

SEQ ID NO: 167073 - DNA, 25 bp, Rattus norvegicus
agttgtcacctcagtcttgtgagca

SEQ ID NO: 167074 - DNA, 25 bp, Rattus norvegicus
agttgtcacctctgtcttgtgagca

SEQ ID NO: 167075 - DNA, 25 bp, Rattus norvegicus
agttgtcacggcaccgacgatctca

SEQ ID NO: 167076 - DNA, 25 bp, Rattus norvegicus
agttgtcacggctccgacgatctca

SEQ ID NO: 167077 - DNA, 25 bp, Rattus norvegicus
agttgtcactgcatagttcctccac

SEQ ID NO: 167078 - DNA, 25 bp, Rattus norvegicus
agttgtcactgcttagttcctccac

SEQ ID NO: 167079 - DNA, 25 bp, Rattus norvegicus
agttgtcacttacggatggcacacc

SEQ ID NO: 167080 - DNA, 25 bp, Rattus norvegicus
agttgtcacttagggatggcacacc

SEQ ID NO: 167081 - DNA, 25 bp, Rattus norvegicus
agttgtcagaagacgccactgggcc

SEQ ID NO: 167082 - DNA, 25 bp, Rattus norvegicus
agttgtcagaagtcgccactgggcc

SEQ ID NO: 167083 - DNA, 25 bp, Rattus norvegicus
agttgtcagctcaatgcatggtctc

SEQ ID NO: 167084 - DNA, 25 bp, Rattus norvegicus
agttgtcagctctatgcatggtctc

SEQ ID NO: 167085 - DNA, 25 bp, Rattus norvegicus
agttgtcagctgacaattgattttt

SEQ ID NO: 167086 - DNA, 25 bp, Rattus norvegicus
agttgtcagctgtcaattgattttt

SEQ ID NO: 167087 - DNA, 25 bp, Rattus norvegicus
agttgtcagtacagctcgtcagaga

SEQ ID NO: 167088 - DNA, 25 bp, Rattus norvegicus
agttgtcagtactgctcgtcagaga

SEQ ID NO: 167089 - DNA, 25 bp, Rattus norvegicus
agttgtcagtcacagccgttggtgt

SEQ ID NO: 167090 - DNA, 25 bp, Rattus norvegicus
agttgtcagtcacaggagccagcca

SEQ ID NO: 167091 - DNA, 25 bp, Rattus norvegicus
agttgtcagtcagagccgttggtgt

SEQ ID NO: 167092 - DNA, 25 bp, Rattus norvegicus
agttgtcagtcagaggagccagcca

SEQ ID NO: 167093 - DNA, 25 bp, Rattus norvegicus
agttgtcatgatcaactctcttgca

SEQ ID NO: 167094 - DNA, 25 bp, Rattus norvegicus
agttgtcatgatgaactctcttgca

SEQ ID NO: 167095 - DNA, 25 bp, Rattus norvegicus
agttgtcattccattgtaacatatg

SEQ ID NO: 167096 - DNA, 25 bp, Rattus norvegicus
agttgtcattcctttgtaacatatg

SEQ ID NO: 167097 - DNA, 25 bp, Rattus norvegicus
agttgtcattttactcttcactgga

SEQ ID NO: 167098 - DNA, 25 bp, Rattus norvegicus
agttgtcatttttctcttcactgga

SEQ ID NO: 167099 - DNA, 25 bp, Rattus norvegicus
agttgtccccttcgaggcagaggct

SEQ ID NO: 167100 - DNA, 25 bp, Rattus norvegicus
agttgtccccttggaggcagaggct

SEQ ID NO: 167101 - DNA, 25 bp, Rattus norvegicus
agttgtccgtggaaagctggctgct

SEQ ID NO: 167102 - DNA, 25 bp, Rattus norvegicus
agttgtccgtggtaagctggctgct

SEQ ID NO: 167103 - DNA, 25 bp, Rattus norvegicus
agttgtcctatcaaccactaggcgt

SEQ ID NO: 167104 - DNA, 25 bp, Rattus norvegicus
agttgtcctatctaccactaggcgt

SEQ ID NO: 167105 - DNA, 25 bp, Rattus norvegicus
agttgtcctctgatgtgcctagcat

SEQ ID NO: 167106 - DNA, 25 bp, Rattus norvegicus
agttgtcctctgttgtgcctagcat

SEQ ID NO: 167107 - DNA, 25 bp, Rattus norvegicus
agttgtcctgggacctccaaatgcc

SEQ ID NO: 167108 - DNA, 25 bp, Rattus norvegicus
agttgtcctgggtcctccaaatgcc

SEQ ID NO: 167109 - DNA, 25 bp, Rattus norvegicus
agttgtcctgtaatgacagcggcct

SEQ ID NO: 167110 - DNA, 25 bp, Rattus norvegicus
agttgtcctgtattgacagcggcct

SEQ ID NO: 167111 - DNA, 25 bp, Rattus norvegicus
agttgtcctgtgaccgcatatacat

SEQ ID NO: 167112 - DNA, 25 bp, Rattus norvegicus
agttgtcctgtgtccgcatatacat

SEQ ID NO: 167113 - DNA, 25 bp, Rattus norvegicus
agttgtcgtatcagtgtcacctatg

SEQ ID NO: 167114 - DNA, 25 bp, Rattus norvegicus
agttgtcgtatctgtgtcacctatg

SEQ ID NO: 167115 - DNA, 25 bp, Rattus norvegicus
agttgtctatgtagggttggcctgt

SEQ ID NO: 167116 - DNA, 25 bp, Rattus norvegicus
agttgtctatgttgggttggcctgt

SEQ ID NO: 167117 - DNA, 25 bp, Rattus norvegicus
agttgtctcactctgatgatcccta

SEQ ID NO: 167118 - DNA, 25 bp, Rattus norvegicus
agttgtctcactgtgatgatcccta

SEQ ID NO: 167119 - DNA, 25 bp, Rattus norvegicus
agttgtctccgtctgggacatcagt

SEQ ID NO: 167120 - DNA, 25 bp, Rattus norvegicus
agttgtctccgtgtgggacatcagt

SEQ ID NO: 167121 - DNA, 25 bp, Rattus norvegicus
agttgtctctggaagcccaaggcat

SEQ ID NO: 167122 - DNA, 25 bp, Rattus norvegicus
agttgtctctggtagcccaaggcat

SEQ ID NO: 167123 - DNA, 25 bp, Rattus norvegicus
agttgtctcttaacaatgtactgga

SEQ ID NO: 167124 - DNA, 25 bp, Rattus norvegicus
agttgtctcttatcaatgtactgga

SEQ ID NO: 167125 - DNA, 25 bp, Rattus norvegicus
agttgtctgacaactggcatctgcc

SEQ ID NO: 167126 - DNA, 25 bp, Rattus norvegicus
agttgtctgacatctggcatctgcc

SEQ ID NO: 167127 - DNA, 25 bp, Rattus norvegicus
agttgtctgagcaccatggccttca

SEQ ID NO: 167128 - DNA, 25 bp, Rattus norvegicus
agttgtctgagctccatggccttca

SEQ ID NO: 167129 - DNA, 25 bp, Rattus norvegicus
agttgtctgcagaactgtgtgattt

SEQ ID NO: 167130 - DNA, 25 bp, Rattus norvegicus
agttgtctgcagtactgtgtgattt

SEQ ID NO: 167131 - DNA, 25 bp, Rattus norvegicus
agttgtctgcccattataggtcagc

SEQ ID NO: 167132 - DNA, 25 bp, Rattus norvegicus
agttgtctgccctttataggtcagc

SEQ ID NO: 167133 - DNA, 25 bp, Rattus norvegicus
agttgtcttcagatgaacggctcat

SEQ ID NO: 167134 - DNA, 25 bp, Rattus norvegicus
agttgtcttcagttgaacggctcat

SEQ ID NO: 167135 - DNA, 25 bp, Rattus norvegicus
agttgtcttcccacggtagcaaagt

SEQ ID NO: 167136 - DNA, 25 bp, Rattus norvegicus
agttgtcttccctcggtagcaaagt

SEQ ID NO: 167137 - DNA, 25 bp, Rattus norvegicus
agttgtcttcctagctgaatcctca

SEQ ID NO: 167138 - DNA, 25 bp, Rattus norvegicus
agttgtcttccttgctgaatcctca

SEQ ID NO: 167139 - DNA, 25 bp, Rattus norvegicus
agttgtctttgtaggcgctaaccca

SEQ ID NO: 167140 - DNA, 25 bp, Rattus norvegicus
agttgtctttgttggcgctaaccca

SEQ ID NO: 167141 - DNA, 25 bp, Rattus norvegicus
agttgtgaactactgtgggtattaa

SEQ ID NO: 167142 - DNA, 25 bp, Rattus norvegicus
agttgtgaactagtgtgggtattaa

SEQ ID NO: 167143 - DNA, 25 bp, Rattus norvegicus
agttgtgaagccctcaatatcgtca

SEQ ID NO: 167144 - DNA, 25 bp, Rattus norvegicus
agttgtgaagccgtcaatatcgtca

SEQ ID NO: 167145 - DNA, 25 bp, Rattus norvegicus
agttgtgaagtgagtactcctcctc

SEQ ID NO: 167146 - DNA, 25 bp, Rattus norvegicus
agttgtgaagtgtgtactcctcctc

SEQ ID NO: 167147 - DNA, 25 bp, Rattus norvegicus
agttgtgacggcagaggctagtaac

SEQ ID NO: 167148 - DNA, 25 bp, Rattus norvegicus
agttgtgacggctgaggctagtaac

SEQ ID NO: 167149 - DNA, 25 bp, Rattus norvegicus
agttgtgactccaatgttgaacccc

SEQ ID NO: 167150 - DNA, 25 bp, Rattus norvegicus
agttgtgactcctatgttgaacccc

SEQ ID NO: 167151 - DNA, 25 bp, Rattus norvegicus
agttgtgactgcacaaatgtcccca

SEQ ID NO: 167152 - DNA, 25 bp, Rattus norvegicus
agttgtgactgctcaaatgtcccca

SEQ ID NO: 167153 - DNA, 25 bp, Rattus norvegicus
agttgtgagctccaactactctcag

SEQ ID NO: 167154 - DNA, 25 bp, Rattus norvegicus
agttgtgagctcgaactactctcag

SEQ ID NO: 167155 - DNA, 25 bp, Rattus norvegicus
agttgtgatctcatgttgtctttga

SEQ ID NO: 167156 - DNA, 25 bp, Rattus norvegicus
agttgtgatctcttgttgtctttga

SEQ ID NO: 167157 - DNA, 25 bp, Rattus norvegicus
agttgtgcaaagatcgcagcctcac

SEQ ID NO: 167158 - DNA, 25 bp, Rattus norvegicus
agttgtgcaaagttcgcagcctcac

SEQ ID NO: 167159 - DNA, 25 bp, Rattus norvegicus
agttgtgcagaaaacgaggcccagt

SEQ ID NO: 167160 - DNA, 25 bp, Rattus norvegicus
agttgtgcagaatacgaggcccagt

SEQ ID NO: 167161 - DNA, 25 bp, Rattus norvegicus
agttgtgcagacattagctgccctc

SEQ ID NO: 167162 - DNA, 25 bp, Rattus norvegicus
agttgtgcagactttagctgccctc

SEQ ID NO: 167163 - DNA, 25 bp, Rattus norvegicus
agttgtgcagatatgttttgggcaa

SEQ ID NO: 167164 - DNA, 25 bp, Rattus norvegicus
agttgtgcagatttgttttgggcaa

SEQ ID NO: 167165 - DNA, 25 bp, Rattus norvegicus
agttgtgcattaaaggcctgtgaat

SEQ ID NO: 167166 - DNA, 25 bp, Rattus norvegicus
agttgtgcattataggcctgtgaat

SEQ ID NO: 167167 - DNA, 25 bp, Rattus norvegicus
agttgtgccaccagcaatgtaccag

SEQ ID NO: 167168 - DNA, 25 bp, Rattus norvegicus
agttgtgccacctgcaatgtaccag

SEQ ID NO: 167169 - DNA, 25 bp, Rattus norvegicus
agttgtgccaggaggtcagacaccc

SEQ ID NO: 167170 - DNA, 25 bp, Rattus norvegicus
agttgtgccaggtggtcagacaccc

SEQ ID NO: 167171 - DNA, 25 bp, Rattus norvegicus
agttgtgccatccttcatcaacaaa

SEQ ID NO: 167172 - DNA, 25 bp, Rattus norvegicus
agttgtgccatcgttcatcaacaaa

SEQ ID NO: 167173 - DNA, 25 bp, Rattus norvegicus
agttgtgcctaacccagatctcaag

SEQ ID NO: 167174 - DNA, 25 bp, Rattus norvegicus
agttgtgcctaagccagatctcaag

SEQ ID NO: 167175 - DNA, 25 bp, Rattus norvegicus
agttgtgcctagatcttttggtcag

SEQ ID NO: 167176 - DNA, 25 bp, Rattus norvegicus
agttgtgcctagttcttttggtcag

SEQ ID NO: 167177 - DNA, 25 bp, Rattus norvegicus
agttgtgcctggctcttctctgcct

SEQ ID NO: 167178 - DNA, 25 bp, Rattus norvegicus
agttgtgcctgggtcttctctgcct

SEQ ID NO: 167179 - DNA, 25 bp, Rattus norvegicus
agttgtgctaccattacatagtaca

SEQ ID NO: 167180 - DNA, 25 bp, Rattus norvegicus
agttgtgctacctttacatagtaca

SEQ ID NO: 167181 - DNA, 25 bp, Rattus norvegicus
agttgtgctcttacaagcttctgag

SEQ ID NO: 167182 - DNA, 25 bp, Rattus norvegicus
agttgtgctcttactcaagtgtgca

SEQ ID NO: 167183 - DNA, 25 bp, Rattus norvegicus
agttgtgctctttcaagcttctgag

SEQ ID NO: 167184 - DNA, 25 bp, Rattus norvegicus
agttgtgctctttctcaagtgtgca

SEQ ID NO: 167185 - DNA, 25 bp, Rattus norvegicus
agttgtgctgtcagagcactgcctg

SEQ ID NO: 167186 - DNA, 25 bp, Rattus norvegicus
agttgtgctgtctgagcactgcctg

SEQ ID NO: 167187 - DNA, 25 bp, Rattus norvegicus
agttgtgctgttcatgggacatcct

SEQ ID NO: 167188 - DNA, 25 bp, Rattus norvegicus
agttgtgctgttcttttcatcttgg

SEQ ID NO: 167189 - DNA, 25 bp, Rattus norvegicus
agttgtgctgttgatgggacatcct

SEQ ID NO: 167190 - DNA, 25 bp, Rattus norvegicus
agttgtgctgttgttttcatcttgg

SEQ ID NO: 167191 - DNA, 25 bp, Rattus norvegicus
agttgtggaggtaccttatgcccgc

SEQ ID NO: 167192 - DNA, 25 bp, Rattus norvegicus
agttgtggaggttccttatgcccgc

SEQ ID NO: 167193 - DNA, 25 bp, Rattus norvegicus
agttgtggatgaacaccctatctcc

SEQ ID NO: 167194 - DNA, 25 bp, Rattus norvegicus
agttgtggatgatcaccctatctcc

SEQ ID NO: 167195 - DNA, 25 bp, Rattus norvegicus
agttgtggatgcagttcatctgcct

SEQ ID NO: 167196 - DNA, 25 bp, Rattus norvegicus
agttgtggatgctgttcatctgcct

SEQ ID NO: 167197 - DNA, 25 bp, Rattus norvegicus
agttgtggcatcatgttgacatcga

SEQ ID NO: 167198 - DNA, 25 bp, Rattus norvegicus
agttgtggcatcttgttgacatcga

SEQ ID NO: 167199 - DNA, 25 bp, Rattus norvegicus
agttgtggcctgctgctactatagc

SEQ ID NO: 167200 - DNA, 25 bp, Rattus norvegicus
agttgtggcctggtgctactatagc

SEQ ID NO: 167201 - DNA, 25 bp, Rattus norvegicus
agttgtgggcctacatcgtgactaa

SEQ ID NO: 167202 - DNA, 25 bp, Rattus norvegicus
agttgtgggccttcatcgtgactaa

SEQ ID NO: 167203 - DNA, 25 bp, Rattus norvegicus
agttgtggtcacagatggccggtca

SEQ ID NO: 167204 - DNA, 25 bp, Rattus norvegicus
agttgtggtcactgatggccggtca

SEQ ID NO: 167205 - DNA, 25 bp, Rattus norvegicus
agttgtgtatccagggatgggcgag

SEQ ID NO: 167206 - DNA, 25 bp, Rattus norvegicus
agttgtgtatcctgggatgggcgag

SEQ ID NO: 167207 - DNA, 25 bp, Rattus norvegicus
agttgtgtatgtaagaccttctgtc

SEQ ID NO: 167208 - DNA, 25 bp, Rattus norvegicus
agttgtgtatgttagaccttctgtc

SEQ ID NO: 167209 - DNA, 25 bp, Rattus norvegicus
agttgtgtcagaacgacccacagag

SEQ ID NO: 167210 - DNA, 25 bp, Rattus norvegicus
agttgtgtcagatcgacccacagag

SEQ ID NO: 167211 - DNA, 25 bp, Rattus norvegicus
agttgtgtgactactgactgtgttc

SEQ ID NO: 167212 - DNA, 25 bp, Rattus norvegicus
agttgtgtgacttctgactgtgttc

SEQ ID NO: 167213 - DNA, 25 bp, Rattus norvegicus
agttgtgtgatgactatcttgacca

SEQ ID NO: 167214 - DNA, 25 bp, Rattus norvegicus
agttgtgtgatgtctatcttgacca

SEQ ID NO: 167215 - DNA, 25 bp, Rattus norvegicus
agttgtgtgcacagaagggaacctt

SEQ ID NO: 167216 - DNA, 25 bp, Rattus norvegicus
agttgtgtgcactgaagggaacctt

SEQ ID NO: 167217 - DNA, 25 bp, Rattus norvegicus
agttgtgtggtaacttcacgctgct

SEQ ID NO: 167218 - DNA, 25 bp, Rattus norvegicus
agttgtgtggtatcttcacgctgct

SEQ ID NO: 167219 - DNA, 25 bp, Rattus norvegicus
agttgtgtgtttcggtgcctttcca

SEQ ID NO: 167220 - DNA, 25 bp, Rattus norvegicus
agttgtgtgtttgggtgcctttcca

SEQ ID NO: 167221 - DNA, 25 bp, Rattus norvegicus
agttgtgttctgctgttgctgctta

SEQ ID NO: 167222 - DNA, 25 bp, Rattus norvegicus
agttgtgttctggtgttgctgctta

SEQ ID NO: 167223 - DNA, 25 bp, Rattus norvegicus
agttgtgttgtgacagctctgtcct

SEQ ID NO: 167224 - DNA, 25 bp, Rattus norvegicus
agttgtgttgtgtcagctctgtcct

SEQ ID NO: 167225 - DNA, 25 bp, Rattus norvegicus
agttgtgtttctactactgcagaca

SEQ ID NO: 167226 - DNA, 25 bp, Rattus norvegicus
agttgtgtttctcgactgtttcttc

SEQ ID NO: 167227 - DNA, 25 bp, Rattus norvegicus
agttgtgtttctggactgtttcttc

SEQ ID NO: 167228 - DNA, 25 bp, Rattus norvegicus
agttgtgtttcttctactgcagaca

SEQ ID NO: 167229 - DNA, 25 bp, Rattus norvegicus
agttgttaaacaccatccagggaag

SEQ ID NO: 167230 - DNA, 25 bp, Rattus norvegicus
agttgttaaacagcatccagggaag

SEQ ID NO: 167231 - DNA, 25 bp, Rattus norvegicus
agttgttaagacctccgactgctct

SEQ ID NO: 167232 - DNA, 25 bp, Rattus norvegicus
agttgttaagacgtccgactgctct

SEQ ID NO: 167233 - DNA, 25 bp, Rattus norvegicus
agttgttacaaaatcctggcatctc

SEQ ID NO: 167234 - DNA, 25 bp, Rattus norvegicus
agttgttacaaattcctggcatctc

SEQ ID NO: 167235 - DNA, 25 bp, Rattus norvegicus
agttgttacgcacagttccattgtc

SEQ ID NO: 167236 - DNA, 25 bp, Rattus norvegicus
agttgttacgcagagttccattgtc

SEQ ID NO: 167237 - DNA, 25 bp, Rattus norvegicus
agttgttaggccacagtggcactcc

SEQ ID NO: 167238 - DNA, 25 bp, Rattus norvegicus
agttgttaggcctcagtggcactcc

SEQ ID NO: 167239 - DNA, 25 bp, Rattus norvegicus
agttgttatctcaaagcctaactaa

SEQ ID NO: 167240 - DNA, 25 bp, Rattus norvegicus
agttgttatctctaagcctaactaa

SEQ ID NO: 167241 - DNA, 25 bp, Rattus norvegicus
agttgttatggcaaccgggctgtcg

SEQ ID NO: 167242 - DNA, 25 bp, Rattus norvegicus
agttgttatggctaccgggctgtcg

SEQ ID NO: 167243 - DNA, 25 bp, Rattus norvegicus
agttgttattttatgtatacactgg

SEQ ID NO: 167244 - DNA, 25 bp, Rattus norvegicus
agttgttattttttgtatacactgg

SEQ ID NO: 167245 - DNA, 25 bp, Rattus norvegicus
agttgttcaatccaccaggctggat

SEQ ID NO: 167246 - DNA, 25 bp, Rattus norvegicus
agttgttcaatcgaccaggctggat

SEQ ID NO: 167247 - DNA, 25 bp, Rattus norvegicus
agttgttcattcactgaggccattt

SEQ ID NO: 167248 - DNA, 25 bp, Rattus norvegicus
agttgttcattctctgaggccattt

SEQ ID NO: 167249 - DNA, 25 bp, Rattus norvegicus
agttgttcatttaatgcctgttttt

SEQ ID NO: 167250 - DNA, 25 bp, Rattus norvegicus
agttgttcattttatgcctgttttt

SEQ ID NO: 167251 - DNA, 25 bp, Rattus norvegicus
agttgttcctctagtcaggagcaaa

SEQ ID NO: 167252 - DNA, 25 bp, Rattus norvegicus
agttgttcctcttgtcaggagcaaa

SEQ ID NO: 167253 - DNA, 25 bp, Rattus norvegicus
agttgttcctggaatctgacgcctc

SEQ ID NO: 167254 - DNA, 25 bp, Rattus norvegicus
agttgttcctggtatctgacgcctc

SEQ ID NO: 167255 - DNA, 25 bp, Rattus norvegicus
agttgttctgttcatgctaggacca

SEQ ID NO: 167256 - DNA, 25 bp, Rattus norvegicus
agttgttctgttgatgctaggacca

SEQ ID NO: 167257 - DNA, 25 bp, Rattus norvegicus
agttgttgactgaagccttgttttc

SEQ ID NO: 167258 - DNA, 25 bp, Rattus norvegicus
agttgttgactgtagccttgttttc

SEQ ID NO: 167259 - DNA, 25 bp, Rattus norvegicus
agttgttgagacatcggccttggaa

SEQ ID NO: 167260 - DNA, 25 bp, Rattus norvegicus
agttgttgagacttcggccttggaa

SEQ ID NO: 167261 - DNA, 25 bp, Rattus norvegicus
agttgttgatttcctcattgggcca

SEQ ID NO: 167262 - DNA, 25 bp, Rattus norvegicus
agttgttgatttgctcattgggcca

SEQ ID NO: 167263 - DNA, 25 bp, Rattus norvegicus
agttgttgccggagttctggaagcc

SEQ ID NO: 167264 - DNA, 25 bp, Rattus norvegicus
agttgttgccggtgttctggaagcc

SEQ ID NO: 167265 - DNA, 25 bp, Rattus norvegicus
agttgttggcctagcatgcccagag

SEQ ID NO: 167266 - DNA, 25 bp, Rattus norvegicus
agttgttggccttgcatgcccagag

SEQ ID NO: 167267 - DNA, 25 bp, Rattus norvegicus
agttgttggtgcaggcgtccagccc

SEQ ID NO: 167268 - DNA, 25 bp, Rattus norvegicus
agttgttggtgctggcgtccagccc

SEQ ID NO: 167269 - DNA, 25 bp, Rattus norvegicus
agttgttgtcagctctcttcgggcc

SEQ ID NO: 167270 - DNA, 25 bp, Rattus norvegicus
agttgttgtcaggtctcttcgggcc

SEQ ID NO: 167271 - DNA, 25 bp, Rattus norvegicus
agttgttgttgaagccaccgactac

SEQ ID NO: 167272 - DNA, 25 bp, Rattus norvegicus
agttgttgttgatgccaccgactac

SEQ ID NO: 167273 - DNA, 25 bp, Rattus norvegicus
agttgtttacttccactcatgtagt

SEQ ID NO: 167274 - DNA, 25 bp, Rattus norvegicus
agttgtttacttgcactcatgtagt

SEQ ID NO: 167275 - DNA, 25 bp, Rattus norvegicus
agttgtttatggctgaccccagagt

SEQ ID NO: 167276 - DNA, 25 bp, Rattus norvegicus
agttgtttatgggtgaccccagagt

SEQ ID NO: 167277 - DNA, 25 bp, Rattus norvegicus
agttgtttcctaacattcattgaag

SEQ ID NO: 167278 - DNA, 25 bp, Rattus norvegicus
agttgtttcctatcattcattgaag

SEQ ID NO: 167279 - DNA, 25 bp, Rattus norvegicus
agttgtttcttccacacatctggta

SEQ ID NO: 167280 - DNA, 25 bp, Rattus norvegicus
agttgtttcttcgacacatctggta

SEQ ID NO: 167281 - DNA, 25 bp, Rattus norvegicus
agttgtttgaagacaggccttgctt

SEQ ID NO: 167282 - DNA, 25 bp, Rattus norvegicus
agttgtttgaagtcaggccttgctt

SEQ ID NO: 167283 - DNA, 25 bp, Rattus norvegicus
agttgtttgcaccagtctgcctccc

SEQ ID NO: 167284 - DNA, 25 bp, Rattus norvegicus
agttgtttgcacgagtctgcctccc

SEQ ID NO: 167285 - DNA, 25 bp, Rattus norvegicus
agttgtttgggtccctctcagacgg

SEQ ID NO: 167286 - DNA, 25 bp, Rattus norvegicus
agttgtttgggtgcctctcagacgg

SEQ ID NO: 167287 - DNA, 25 bp, Rattus norvegicus
agttgttttactctatggccaggtc

SEQ ID NO: 167288 - DNA, 25 bp, Rattus norvegicus
agttgttttactgtatggccaggtc

SEQ ID NO: 167289 - DNA, 25 bp, Rattus norvegicus
agttgttttatcactatttaccata

SEQ ID NO: 167290 - DNA, 25 bp, Rattus norvegicus
agttgttttatctctatttaccata

SEQ ID NO: 167291 - DNA, 25 bp, Rattus norvegicus
agttgttttcagagcagtctgtcct

SEQ ID NO: 167292 - DNA, 25 bp, Rattus norvegicus
agttgttttcagtgcagtctgtcct

SEQ ID NO: 167293 - DNA, 25 bp, Rattus norvegicus
agttgttttctaaatacgtatccag

SEQ ID NO: 167294 - DNA, 25 bp, Rattus norvegicus
agttgttttctatatacgtatccag

SEQ ID NO: 167295 - DNA, 25 bp, Rattus norvegicus
agtttaaagctgagaccttcacctt

SEQ ID NO: 167296 - DNA, 25 bp, Rattus norvegicus
agtttaaagctgtgaccttcacctt

SEQ ID NO: 167297 - DNA, 25 bp, Rattus norvegicus
agtttaaatcctctgaccctgtgtg

SEQ ID NO: 167298 - DNA, 25 bp, Rattus norvegicus
agtttaaatcctgtgaccctgtgtg

SEQ ID NO: 167299 - DNA, 25 bp, Rattus norvegicus
agtttaacccgcaggcttcaaacat

SEQ ID NO: 167300 - DNA, 25 bp, Rattus norvegicus
agtttaacccgctggcttcaaacat

SEQ ID NO: 167301 - DNA, 25 bp, Rattus norvegicus
agtttaacttctcggatcccatttg

SEQ ID NO: 167302 - DNA, 25 bp, Rattus norvegicus
agtttaacttctgggatcccatttg

SEQ ID NO: 167303 - DNA, 25 bp, Rattus norvegicus
agtttaagcaccatgcccagaggac

SEQ ID NO: 167304 - DNA, 25 bp, Rattus norvegicus
agtttaagcaccatgggcacgctgg

SEQ ID NO: 167305 - DNA, 25 bp, Rattus norvegicus
agtttaagcaccttgcccagaggac

SEQ ID NO: 167306 - DNA, 25 bp, Rattus norvegicus
agtttaagcaccttgggcacgctgg

SEQ ID NO: 167307 - DNA, 25 bp, Rattus norvegicus
agtttaagcttcacccatctttgta

SEQ ID NO: 167308 - DNA, 25 bp, Rattus norvegicus
agtttaagcttctcccatctttgta

SEQ ID NO: 167309 - DNA, 25 bp, Rattus norvegicus
agtttaagtgacactgggctctctt

SEQ ID NO: 167310 - DNA, 25 bp, Rattus norvegicus
agtttaagtgactctgggctctctt

SEQ ID NO: 167311 - DNA, 25 bp, Rattus norvegicus
agtttaatcagtcacaatgcagcga

SEQ ID NO: 167312 - DNA, 25 bp, Rattus norvegicus
agtttaatcagtgacaatgcagcga

SEQ ID NO: 167313 - DNA, 25 bp, Rattus norvegicus
agtttaatgggtagcgtgccggcct

SEQ ID NO: 167314 - DNA, 25 bp, Rattus norvegicus
agtttaatgggttgcgtgccggcct

SEQ ID NO: 167315 - DNA, 25 bp, Rattus norvegicus
agtttaatgtggacagcctcttcct

SEQ ID NO: 167316 - DNA, 25 bp, Rattus norvegicus
agtttaatgtggtcagcctcttcct

SEQ ID NO: 167317 - DNA, 25 bp, Rattus norvegicus
agtttacaacttacgctgaggctga

SEQ ID NO: 167318 - DNA, 25 bp, Rattus norvegicus
agtttacaactttcgctgaggctga

SEQ ID NO: 167319 - DNA, 25 bp, Rattus norvegicus
agtttacaagcccagtatcatgtct

SEQ ID NO: 167320 - DNA, 25 bp, Rattus norvegicus
agtttacaagccgagtatcatgtct

SEQ ID NO: 167321 - DNA, 25 bp, Rattus norvegicus
agtttacaatggaagatctgtctat

SEQ ID NO: 167322 - DNA, 25 bp, Rattus norvegicus
agtttacaatggtagatctgtctat

SEQ ID NO: 167323 - DNA, 25 bp, Rattus norvegicus
agtttacaccagaggcccatcgaat

SEQ ID NO: 167324 - DNA, 25 bp, Rattus norvegicus
agtttacaccagtggcccatcgaat

SEQ ID NO: 167325 - DNA, 25 bp, Rattus norvegicus
agtttacactgtagctcactcttga

SEQ ID NO: 167326 - DNA, 25 bp, Rattus norvegicus
agtttacactgttgctcactcttga

SEQ ID NO: 167327 - DNA, 25 bp, Rattus norvegicus
agtttacagccacggcggtgtcaca

SEQ ID NO: 167328 - DNA, 25 bp, Rattus norvegicus
agtttacagccagggcggtgtcaca

SEQ ID NO: 167329 - DNA, 25 bp, Rattus norvegicus
agtttacagtagcttaggcccacca

SEQ ID NO: 167330 - DNA, 25 bp, Rattus norvegicus
agtttacagtaggttaggcccacca

SEQ ID NO: 167331 - DNA, 25 bp, Rattus norvegicus
agtttaccccatactggttcagctg

SEQ ID NO: 167332 - DNA, 25 bp, Rattus norvegicus
agtttaccccattctggttcagctg

SEQ ID NO: 167333 - DNA, 25 bp, Rattus norvegicus
agtttacctttcctggctcatctta

SEQ ID NO: 167334 - DNA, 25 bp, Rattus norvegicus
agtttacctttcgtggctcatctta

SEQ ID NO: 167335 - DNA, 25 bp, Rattus norvegicus
agtttacctttgcagcacatctgaa

SEQ ID NO: 167336 - DNA, 25 bp, Rattus norvegicus
agtttacctttggagcacatctgaa

SEQ ID NO: 167337 - DNA, 25 bp, Rattus norvegicus
agtttactaatcactgcctcagttt

SEQ ID NO: 167338 - DNA, 25 bp, Rattus norvegicus
agtttactaatctctgcctcagttt

SEQ ID NO: 167339 - DNA, 25 bp, Rattus norvegicus
agtttactataaatacgatgtgatc

SEQ ID NO: 167340 - DNA, 25 bp, Rattus norvegicus
agtttactataattacgatgtgatc

SEQ ID NO: 167341 - DNA, 25 bp, Rattus norvegicus
agtttactcactaggcctggatcaa

SEQ ID NO: 167342 - DNA, 25 bp, Rattus norvegicus
agtttactcacttggcctggatcaa

SEQ ID NO: 167343 - DNA, 25 bp, Rattus norvegicus
agtttactcatgaagctcctggtta

SEQ ID NO: 167344 - DNA, 25 bp, Rattus norvegicus
agtttactcatgtagctcctggtta

SEQ ID NO: 167345 - DNA, 25 bp, Rattus norvegicus
agtttactcgtcagacacctgttga

SEQ ID NO: 167346 - DNA, 25 bp, Rattus norvegicus
agtttactcgtctgacacctgttga

SEQ ID NO: 167347 - DNA, 25 bp, Rattus norvegicus
agtttactgcagctgtgattttaca

SEQ ID NO: 167348 - DNA, 25 bp, Rattus norvegicus
agtttactgcaggtgtgattttaca

SEQ ID NO: 167349 - DNA, 25 bp, Rattus norvegicus
agtttacttggcagtctcctgtgta

SEQ ID NO: 167350 - DNA, 25 bp, Rattus norvegicus
agtttacttggctgtctcctgtgta

SEQ ID NO: 167351 - DNA, 25 bp, Rattus norvegicus
agtttacttgggacagctgtctgcc

SEQ ID NO: 167352 - DNA, 25 bp, Rattus norvegicus
agtttacttgggtcagctgtctgcc

SEQ ID NO: 167353 - DNA, 25 bp, Rattus norvegicus
agtttactttctcatcgagccttct

SEQ ID NO: 167354 - DNA, 25 bp, Rattus norvegicus
agtttactttctgatcgagccttct

SEQ ID NO: 167355 - DNA, 25 bp, Rattus norvegicus
agtttacttttcagtagtccagcag

SEQ ID NO: 167356 - DNA, 25 bp, Rattus norvegicus
agtttacttttctgtagtccagcag

SEQ ID NO: 167357 - DNA, 25 bp, Rattus norvegicus
agtttagaagatcctctgaaccaga

SEQ ID NO: 167358 - DNA, 25 bp, Rattus norvegicus
agtttagaagatgctctgaaccaga

SEQ ID NO: 167359 - DNA, 25 bp, Rattus norvegicus
agtttagactctcaacatgcctttc

SEQ ID NO: 167360 - DNA, 25 bp, Rattus norvegicus
agtttagactctgaacatgcctttc

SEQ ID NO: 167361 - DNA, 25 bp, Rattus norvegicus
agtttagcatgcacataagtgcaag

SEQ ID NO: 167362 - DNA, 25 bp, Rattus norvegicus
agtttagcatgctcataagtgcaag

SEQ ID NO: 167363 - DNA, 25 bp, Rattus norvegicus
agtttagccactctgcacattgtaa

SEQ ID NO: 167364 - DNA, 25 bp, Rattus norvegicus
agtttagccactgtgcacattgtaa

SEQ ID NO: 167365 - DNA, 25 bp, Rattus norvegicus
agtttagccatcagcctggcattgg

SEQ ID NO: 167366 - DNA, 25 bp, Rattus norvegicus
agtttagccatctgcctggcattgg

SEQ ID NO: 167367 - DNA, 25 bp, Rattus norvegicus
agtttagccttaagtatgcctcctt

SEQ ID NO: 167368 - DNA, 25 bp, Rattus norvegicus
agtttagccttatgtatgcctcctt

SEQ ID NO: 167369 - DNA, 25 bp, Rattus norvegicus
agtttagcctttcaacaccttctgc

SEQ ID NO: 167370 - DNA, 25 bp, Rattus norvegicus
agtttagcctttgaacaccttctgc

SEQ ID NO: 167371 - DNA, 25 bp, Rattus norvegicus
agtttagctgtcagccataatggta

SEQ ID NO: 167372 - DNA, 25 bp, Rattus norvegicus
agtttagctgtctgccataatggta

SEQ ID NO: 167373 - DNA, 25 bp, Rattus norvegicus
agtttagcttcacacggtggcactc

SEQ ID NO: 167374 - DNA, 25 bp, Rattus norvegicus
agtttagcttcagacggtggcactc

SEQ ID NO: 167375 - DNA, 25 bp, Rattus norvegicus
agtttaggagaacccaagctgcctt

SEQ ID NO: 167376 - DNA, 25 bp, Rattus norvegicus
agtttaggagaagccaagctgcctt

SEQ ID NO: 167377 - DNA, 25 bp, Rattus norvegicus
agtttagtcattacacactgagtag

SEQ ID NO: 167378 - DNA, 25 bp, Rattus norvegicus
agtttagtcatttcacactgagtag

SEQ ID NO: 167379 - DNA, 25 bp, Rattus norvegicus
agtttagtgtccagtgtgctttttt

SEQ ID NO: 167380 - DNA, 25 bp, Rattus norvegicus
agtttagtgtcctgtgtgctttttt

SEQ ID NO: 167381 - DNA, 25 bp, Rattus norvegicus
agtttagttgctctcatggatgttg

SEQ ID NO: 167382 - DNA, 25 bp, Rattus norvegicus
agtttagttgctgtcatggatgttg

SEQ ID NO: 167383 - DNA, 25 bp, Rattus norvegicus
agtttataaacacctcagaggccaa

SEQ ID NO: 167384 - DNA, 25 bp, Rattus norvegicus
agtttataaacagctcagaggccaa

SEQ ID NO: 167385 - DNA, 25 bp, Rattus norvegicus
agtttatactgtcttctctcattaa

SEQ ID NO: 167386 - DNA, 25 bp, Rattus norvegicus
agtttatactgtgttctctcattaa

SEQ ID NO: 167387 - DNA, 25 bp, Rattus norvegicus
agtttatagatcaccactacactcc

SEQ ID NO: 167388 - DNA, 25 bp, Rattus norvegicus
agtttatagatctccactacactcc

SEQ ID NO: 167389 - DNA, 25 bp, Rattus norvegicus
agtttatagcgactctcttctggcc

SEQ ID NO: 167390 - DNA, 25 bp, Rattus norvegicus
agtttatagcgagtctcttctggcc

SEQ ID NO: 167391 - DNA, 25 bp, Rattus norvegicus
agtttatatctacctcctggaggtt

SEQ ID NO: 167392 - DNA, 25 bp, Rattus norvegicus
agtttatatctagctcctggaggtt

SEQ ID NO: 167393 - DNA, 25 bp, Rattus norvegicus
agtttatatctcaacgtgctccctg

SEQ ID NO: 167394 - DNA, 25 bp, Rattus norvegicus
agtttatatctctacgtgctccctg

SEQ ID NO: 167395 - DNA, 25 bp, Rattus norvegicus
agtttatcaatccacatctttccta

SEQ ID NO: 167396 - DNA, 25 bp, Rattus norvegicus
agtttatcaatcgacatctttccta

SEQ ID NO: 167397 - DNA, 25 bp, Rattus norvegicus
agtttatcccgcctgggctgacttc

SEQ ID NO: 167398 - DNA, 25 bp, Rattus norvegicus
agtttatcccgcgtgggctgacttc

SEQ ID NO: 167399 - DNA, 25 bp, Rattus norvegicus
agtttatctatgacttgggtatttg

SEQ ID NO: 167400 - DNA, 25 bp, Rattus norvegicus
agtttatctatgtcttgggtatttg

SEQ ID NO: 167401 - DNA, 25 bp, Rattus norvegicus
agtttatctggtcctgttacgtccg

SEQ ID NO: 167402 - DNA, 25 bp, Rattus norvegicus
agtttatctggtgctgttacgtccg

SEQ ID NO: 167403 - DNA, 25 bp, Rattus norvegicus
agtttatgagctaacattccccttg

SEQ ID NO: 167404 - DNA, 25 bp, Rattus norvegicus
agtttatgagcttacattccccttg

SEQ ID NO: 167405 - DNA, 25 bp, Rattus norvegicus
agtttatgcattagtgttccctctt

SEQ ID NO: 167406 - DNA, 25 bp, Rattus norvegicus
agtttatgcatttgtgttccctctt

SEQ ID NO: 167407 - DNA, 25 bp, Rattus norvegicus
agtttatgctatacttacccatgga

SEQ ID NO: 167408 - DNA, 25 bp, Rattus norvegicus
agtttatgctattcttacccatgga

SEQ ID NO: 167409 - DNA, 25 bp, Rattus norvegicus
agtttatggtctagtgaagcacagc

SEQ ID NO: 167410 - DNA, 25 bp, Rattus norvegicus
agtttatggtcttgtgaagcacagc

SEQ ID NO: 167411 - DNA, 25 bp, Rattus norvegicus
agtttatgttgtattctggagagac

SEQ ID NO: 167412 - DNA, 25 bp, Rattus norvegicus
agtttatgttgttttctggagagac

SEQ ID NO: 167413 - DNA, 25 bp, Rattus norvegicus
agtttattcacactttgcctctcat

SEQ ID NO: 167414 - DNA, 25 bp, Rattus norvegicus
agtttattcacagtttgcctctcat

SEQ ID NO: 167415 - DNA, 25 bp, Rattus norvegicus
agtttattctacacaccagggcaga

SEQ ID NO: 167416 - DNA, 25 bp, Rattus norvegicus
agtttattctactcaccagggcaga

SEQ ID NO: 167417 - DNA, 25 bp, Rattus norvegicus
agtttattcttaatgctgcgtacct

SEQ ID NO: 167418 - DNA, 25 bp, Rattus norvegicus
agtttattcttattgctgcgtacct

SEQ ID NO: 167419 - DNA, 25 bp, Rattus norvegicus
agtttattgagcctgtcccgggaat

SEQ ID NO: 167420 - DNA, 25 bp, Rattus norvegicus
agtttattgagcgtgtcccgggaat

SEQ ID NO: 167421 - DNA, 25 bp, Rattus norvegicus
agtttatttatgaggccatcgccca

SEQ ID NO: 167422 - DNA, 25 bp, Rattus norvegicus
agtttatttatgtggccatcgccca

SEQ ID NO: 167423 - DNA, 25 bp, Rattus norvegicus
agtttatttcacatttctatcaatt

SEQ ID NO: 167424 - DNA, 25 bp, Rattus norvegicus
agtttatttcacttttctatcaatt

SEQ ID NO: 167425 - DNA, 25 bp, Rattus norvegicus
agtttatttgacatatacatccaga

SEQ ID NO: 167426 - DNA, 25 bp, Rattus norvegicus
agtttatttgacttatacatccaga

SEQ ID NO: 167427 - DNA, 25 bp, Rattus norvegicus
agtttatttggcacacctgttcttt

SEQ ID NO: 167428 - DNA, 25 bp, Rattus norvegicus
agtttatttggctcacctgttcttt

SEQ ID NO: 167429 - DNA, 25 bp, Rattus norvegicus
agtttcaaatacacacaatcctccc

SEQ ID NO: 167430 - DNA, 25 bp, Rattus norvegicus
agtttcaaatactcacaatcctccc

SEQ ID NO: 167431 - DNA, 25 bp, Rattus norvegicus
agtttcaaatgtaggctgcagctta

SEQ ID NO: 167432 - DNA, 25 bp, Rattus norvegicus
agtttcaaatgttggctgcagctta

SEQ ID NO: 167433 - DNA, 25 bp, Rattus norvegicus
agtttcaagctccattcagggcctc

SEQ ID NO: 167434 - DNA, 25 bp, Rattus norvegicus
agtttcaagctcgattcagggcctc

SEQ ID NO: 167435 - DNA, 25 bp, Rattus norvegicus
agtttcaagggcagtctgcccagca

SEQ ID NO: 167436 - DNA, 25 bp, Rattus norvegicus
agtttcaagggctgtctgcccagca

SEQ ID NO: 167437 - DNA, 25 bp, Rattus norvegicus
agtttcaaggtcctctacctaacag

SEQ ID NO: 167438 - DNA, 25 bp, Rattus norvegicus
agtttcaaggtcgtctacctaacag

SEQ ID NO: 167439 - DNA, 25 bp, Rattus norvegicus
agtttcaatgtgcagaccccttgga

SEQ ID NO: 167440 - DNA, 25 bp, Rattus norvegicus
agtttcaatgtggagaccccttgga

SEQ ID NO: 167441 - DNA, 25 bp, Rattus norvegicus
agtttcactagtagaagccacccct

SEQ ID NO: 167442 - DNA, 25 bp, Rattus norvegicus
agtttcactagttgaagccacccct

SEQ ID NO: 167443 - DNA, 25 bp, Rattus norvegicus
agtttcactatgacattttcacgaa

SEQ ID NO: 167444 - DNA, 25 bp, Rattus norvegicus
agtttcactatgtcattttcacgaa

SEQ ID NO: 167445 - DNA, 25 bp, Rattus norvegicus
agtttcactgtgcaggtcctgcttc

SEQ ID NO: 167446 - DNA, 25 bp, Rattus norvegicus
agtttcactgtggaggtcctgcttc

SEQ ID NO: 167447 - DNA, 25 bp, Rattus norvegicus
agtttcactgttagcaattctcatg

SEQ ID NO: 167448 - DNA, 25 bp, Rattus norvegicus
agtttcactgtttgcaattctcatg

SEQ ID NO: 167449 - DNA, 25 bp, Rattus norvegicus
agtttcagaactctctgtctgtctc

SEQ ID NO: 167450 - DNA, 25 bp, Rattus norvegicus
agtttcagaactgtctgtctgtctc

SEQ ID NO: 167451 - DNA, 25 bp, Rattus norvegicus
agtttcagaagcagcacgaccacct

SEQ ID NO: 167452 - DNA, 25 bp, Rattus norvegicus
agtttcagaagctgcacgaccacct

SEQ ID NO: 167453 - DNA, 25 bp, Rattus norvegicus
agtttcagactcacagacttccaac

SEQ ID NO: 167454 - DNA, 25 bp, Rattus norvegicus
agtttcagactctcagacttccaac

SEQ ID NO: 167455 - DNA, 25 bp, Rattus norvegicus
agtttcagatgaccttcgggtggca

SEQ ID NO: 167456 - DNA, 25 bp, Rattus norvegicus
agtttcagatgagcttcgggtggca

SEQ ID NO: 167457 - DNA, 25 bp, Rattus norvegicus
agtttcagcattcgacaggacccta

SEQ ID NO: 167458 - DNA, 25 bp, Rattus norvegicus
agtttcagcattggacaggacccta

SEQ ID NO: 167459 - DNA, 25 bp, Rattus norvegicus
agtttcagccgaacaactcagaggg

SEQ ID NO: 167460 - DNA, 25 bp, Rattus norvegicus
agtttcagccgatcaactcagaggg

SEQ ID NO: 167461 - DNA, 25 bp, Rattus norvegicus
agtttcagggagatgtgagccactt

SEQ ID NO: 167462 - DNA, 25 bp, Rattus norvegicus
agtttcagggagttgtgagccactt

SEQ ID NO: 167463 - DNA, 25 bp, Rattus norvegicus
agtttcagtccgattgcatatggcc

SEQ ID NO: 167464 - DNA, 25 bp, Rattus norvegicus
agtttcagtccgtttgcatatggcc

SEQ ID NO: 167465 - DNA, 25 bp, Rattus norvegicus
agtttcagtcctcgtatctgcttga

SEQ ID NO: 167466 - DNA, 25 bp, Rattus norvegicus
agtttcagtcctggtatctgcttga

SEQ ID NO: 167467 - DNA, 25 bp, Rattus norvegicus
agtttcagtgacacctgggcactca

SEQ ID NO: 167468 - DNA, 25 bp, Rattus norvegicus
agtttcagtgactcctgggcactca

SEQ ID NO: 167469 - DNA, 25 bp, Rattus norvegicus
agtttcagttcccattacctccatg

SEQ ID NO: 167470 - DNA, 25 bp, Rattus norvegicus
agtttcagttccgattacctccatg

SEQ ID NO: 167471 - DNA, 25 bp, Rattus norvegicus
agtttcatattgatttccttttcat

SEQ ID NO: 167472 - DNA, 25 bp, Rattus norvegicus
agtttcatattgttttccttttcat

SEQ ID NO: 167473 - DNA, 25 bp, Rattus norvegicus
agtttcatcctaacactacagtaga

SEQ ID NO: 167474 - DNA, 25 bp, Rattus norvegicus
agtttcatcctatcactacagtaga

SEQ ID NO: 167475 - DNA, 25 bp, Rattus norvegicus
agtttcatcctgacttctagggcta

SEQ ID NO: 167476 - DNA, 25 bp, Rattus norvegicus
agtttcatcctgtcttctagggcta

SEQ ID NO: 167477 - DNA, 25 bp, Rattus norvegicus
agtttcatcttaagcaccacacacg

SEQ ID NO: 167478 - DNA, 25 bp, Rattus norvegicus
agtttcatcttatgcaccacacacg

SEQ ID NO: 167479 - DNA, 25 bp, Rattus norvegicus
agtttcatgccacagaggccagact

SEQ ID NO: 167480 - DNA, 25 bp, Rattus norvegicus
agtttcatgccagagaggccagact

SEQ ID NO: 167481 - DNA, 25 bp, Rattus norvegicus
agtttcatgttgatgccgttttcct

SEQ ID NO: 167482 - DNA, 25 bp, Rattus norvegicus
agtttcatgttgttgccgttttcct

SEQ ID NO: 167483 - DNA, 25 bp, Rattus norvegicus
agtttcatgtttcggcctgtataaa

SEQ ID NO: 167484 - DNA, 25 bp, Rattus norvegicus
agtttcatgtttgggcctgtataaa

SEQ ID NO: 167485 - DNA, 25 bp, Rattus norvegicus
agtttcattacaaccgctacctgac

SEQ ID NO: 167486 - DNA, 25 bp, Rattus norvegicus
agtttcattacatccgctacctgac

SEQ ID NO: 167487 - DNA, 25 bp, Rattus norvegicus
agtttcattcacagcgcgatggacc

SEQ ID NO: 167488 - DNA, 25 bp, Rattus norvegicus
agtttcattcactgcgcgatggacc

SEQ ID NO: 167489 - DNA, 25 bp, Rattus norvegicus
agtttcattgtcatttataccgtca

SEQ ID NO: 167490 - DNA, 25 bp, Rattus norvegicus
agtttcattgtcttttataccgtca

SEQ ID NO: 167491 - DNA, 25 bp, Rattus norvegicus
agtttcatttctattgtgcgtctcc

SEQ ID NO: 167492 - DNA, 25 bp, Rattus norvegicus
agtttcatttcttttgtgcgtctcc

SEQ ID NO: 167493 - DNA, 25 bp, Rattus norvegicus
agtttcatttttctgagcgagcgcc

SEQ ID NO: 167494 - DNA, 25 bp, Rattus norvegicus
agtttcatttttgtgagcgagcgcc

SEQ ID NO: 167495 - DNA, 25 bp, Rattus norvegicus
agtttccaagtcaggtcagccgtga

SEQ ID NO: 167496 - DNA, 25 bp, Rattus norvegicus
agtttccaagtctggtcagccgtga

SEQ ID NO: 167497 - DNA, 25 bp, Rattus norvegicus
agtttccacgacacggccaagtgat

SEQ ID NO: 167498 - DNA, 25 bp, Rattus norvegicus
agtttccacgactcggccaagtgat

SEQ ID NO: 167499 - DNA, 25 bp, Rattus norvegicus
agtttccaggatctgagctgagccc

SEQ ID NO: 167500 - DNA, 25 bp, Rattus norvegicus
agtttccaggatgtgagctgagccc

SEQ ID NO: 167501 - DNA, 25 bp, Rattus norvegicus
agtttccagtacacacacaacctga

SEQ ID NO: 167502 - DNA, 25 bp, Rattus norvegicus
agtttccagtactcacacaacctga

SEQ ID NO: 167503 - DNA, 25 bp, Rattus norvegicus
agtttccagtgtagggctgttccca

SEQ ID NO: 167504 - DNA, 25 bp, Rattus norvegicus
agtttccagtgttgggctgttccca

SEQ ID NO: 167505 - DNA, 25 bp, Rattus norvegicus
agtttccatagcctgtccagcttgg

SEQ ID NO: 167506 - DNA, 25 bp, Rattus norvegicus
agtttccatagcgtgtccagcttgg

SEQ ID NO: 167507 - DNA, 25 bp, Rattus norvegicus
agtttccatgagagcccccaacaga

SEQ ID NO: 167508 - DNA, 25 bp, Rattus norvegicus
agtttccatgagtgcccccaacaga

SEQ ID NO: 167509 - DNA, 25 bp, Rattus norvegicus
agtttccatggtcatgtttacatcc

SEQ ID NO: 167510 - DNA, 25 bp, Rattus norvegicus
agtttccatggtgatgtttacatcc

SEQ ID NO: 167511 - DNA, 25 bp, Rattus norvegicus
agtttcccaagcaggtagcctgagc

SEQ ID NO: 167512 - DNA, 25 bp, Rattus norvegicus
agtttcccaagctggtagcctgagc

SEQ ID NO: 167513 - DNA, 25 bp, Rattus norvegicus
agtttcccacacctggaggagctag

SEQ ID NO: 167514 - DNA, 25 bp, Rattus norvegicus
agtttcccacacgtggaggagctag

SEQ ID NO: 167515 - DNA, 25 bp, Rattus norvegicus
agtttcccactcagatccaaatgga

SEQ ID NO: 167516 - DNA, 25 bp, Rattus norvegicus
agtttcccactctgatccaaatgga

SEQ ID NO: 167517 - DNA, 25 bp, Rattus norvegicus
agtttcccagtcacatagcaggcaa

SEQ ID NO: 167518 - DNA, 25 bp, Rattus norvegicus
agtttcccagtctcatagcaggcaa

SEQ ID NO: 167519 - DNA, 25 bp, Rattus norvegicus
agtttcccatgcagggctctttggg

SEQ ID NO: 167520 - DNA, 25 bp, Rattus norvegicus
agtttcccatgctgggctctttggg

SEQ ID NO: 167521 - DNA, 25 bp, Rattus norvegicus
agtttcccctctaaatgtcaatggc

SEQ ID NO: 167522 - DNA, 25 bp, Rattus norvegicus
agtttcccctcttaatgtcaatggc

SEQ ID NO: 167523 - DNA, 25 bp, Rattus norvegicus
agtttcccctgacacaagctgttaa

SEQ ID NO: 167524 - DNA, 25 bp, Rattus norvegicus
agtttcccctgagacaagctgttaa

SEQ ID NO: 167525 - DNA, 25 bp, Rattus norvegicus
agtttccctctacccagtgaaatat

SEQ ID NO: 167526 - DNA, 25 bp, Rattus norvegicus
agtttccctctagccagtgaaatat

SEQ ID NO: 167527 - DNA, 25 bp, Rattus norvegicus
agtttccctgggatctaacgcatgc

SEQ ID NO: 167528 - DNA, 25 bp, Rattus norvegicus
agtttccctgggttctaacgcatgc

SEQ ID NO: 167529 - DNA, 25 bp, Rattus norvegicus
agtttccgaagcctgctaggtgtac

SEQ ID NO: 167530 - DNA, 25 bp, Rattus norvegicus
agtttccgaagcgtgctaggtgtac

SEQ ID NO: 167531 - DNA, 25 bp, Rattus norvegicus
agtttccgcgcaactgccgtattaa

SEQ ID NO: 167532 - DNA, 25 bp, Rattus norvegicus
agtttccgcgcatctgccgtattaa

SEQ ID NO: 167533 - DNA, 25 bp, Rattus norvegicus
agtttccgcgttagtgtaaatgtca

SEQ ID NO: 167534 - DNA, 25 bp, Rattus norvegicus
agtttccgcgtttgtgtaaatgtca

SEQ ID NO: 167535 - DNA, 25 bp, Rattus norvegicus
agtttccgggacagtgccaccagca

SEQ ID NO: 167536 - DNA, 25 bp, Rattus norvegicus
agtttccgggactgtgccaccagca

SEQ ID NO: 167537 - DNA, 25 bp, Rattus norvegicus
agtttccgtccactatttagccaag

SEQ ID NO: 167538 - DNA, 25 bp, Rattus norvegicus
agtttccgtccagtatttagccaag

SEQ ID NO: 167539 - DNA, 25 bp, Rattus norvegicus
agtttcctcataaaccaaactgaaa

SEQ ID NO: 167540 - DNA, 25 bp, Rattus norvegicus
agtttcctcatataccaaactgaaa

SEQ ID NO: 167541 - DNA, 25 bp, Rattus norvegicus
agtttcctccacctgaccgtcatag

SEQ ID NO: 167542 - DNA, 25 bp, Rattus norvegicus
agtttcctccacgtgaccgtcatag

SEQ ID NO: 167543 - DNA, 25 bp, Rattus norvegicus
agtttcctcccaagcagactggtga

SEQ ID NO: 167544 - DNA, 25 bp, Rattus norvegicus
agtttcctcccatgcagactggtga

SEQ ID NO: 167545 - DNA, 25 bp, Rattus norvegicus
agtttcctcctcatgcattttgttc

SEQ ID NO: 167546 - DNA, 25 bp, Rattus norvegicus
agtttcctcctcttgcattttgttc

SEQ ID NO: 167547 - DNA, 25 bp, Rattus norvegicus
agtttcctctcgcgtttccgctgca

SEQ ID NO: 167548 - DNA, 25 bp, Rattus norvegicus
agtttcctctcgggtttccgctgca

SEQ ID NO: 167549 - DNA, 25 bp, Rattus norvegicus
agtttcctcttcatcactgtgacag

SEQ ID NO: 167550 - DNA, 25 bp, Rattus norvegicus
agtttcctcttcttcactgtgacag

SEQ ID NO: 167551 - DNA, 25 bp, Rattus norvegicus
agtttcctgaatagtcactgtgcat

SEQ ID NO: 167552 - DNA, 25 bp, Rattus norvegicus
agtttcctgaattgtcactgtgcat

SEQ ID NO: 167553 - DNA, 25 bp, Rattus norvegicus
agtttcctgagcatcctttggagca

SEQ ID NO: 167554 - DNA, 25 bp, Rattus norvegicus
agtttcctgagcttcctttggagca

SEQ ID NO: 167555 - DNA, 25 bp, Rattus norvegicus
agtttcctgattactgtcttggaca

SEQ ID NO: 167556 - DNA, 25 bp, Rattus norvegicus
agtttcctgatttctgtcttggaca

SEQ ID NO: 167557 - DNA, 25 bp, Rattus norvegicus
agtttcctgcagaactctggtcttg

SEQ ID NO: 167558 - DNA, 25 bp, Rattus norvegicus
agtttcctgcagtactctggtcttg

SEQ ID NO: 167559 - DNA, 25 bp, Rattus norvegicus
agtttcctgccaagccaagatacta

SEQ ID NO: 167560 - DNA, 25 bp, Rattus norvegicus
agtttcctgccatgccaagatacta

SEQ ID NO: 167561 - DNA, 25 bp, Rattus norvegicus
agtttcctgtggcacgtgtgcaccg

SEQ ID NO: 167562 - DNA, 25 bp, Rattus norvegicus
agtttcctgtgggacgtgtgcaccg

SEQ ID NO: 167563 - DNA, 25 bp, Rattus norvegicus
agtttcctgtgtcctaggccaagta

SEQ ID NO: 167564 - DNA, 25 bp, Rattus norvegicus
agtttcctgtgtgctaggccaagta

SEQ ID NO: 167565 - DNA, 25 bp, Rattus norvegicus
agtttccttcatcctttcgctttaa

SEQ ID NO: 167566 - DNA, 25 bp, Rattus norvegicus
agtttccttcatgctttcgctttaa

SEQ ID NO: 167567 - DNA, 25 bp, Rattus norvegicus
agtttccttcgacttaatgacgcca

SEQ ID NO: 167568 - DNA, 25 bp, Rattus norvegicus
agtttccttcgagttaatgacgcca

SEQ ID NO: 167569 - DNA, 25 bp, Rattus norvegicus
agtttccttctgatgctcctttaga

SEQ ID NO: 167570 - DNA, 25 bp, Rattus norvegicus
agtttccttctgttgctcctttaga

SEQ ID NO: 167571 - DNA, 25 bp, Rattus norvegicus
agtttccttgtaagatgacccctct

SEQ ID NO: 167572 - DNA, 25 bp, Rattus norvegicus
agtttccttgtatgatgacccctct

SEQ ID NO: 167573 - DNA, 25 bp, Rattus norvegicus
agtttccttgtgacttagcctgtcc

SEQ ID NO: 167574 - DNA, 25 bp, Rattus norvegicus
agtttccttgtgtcttagcctgtcc

SEQ ID NO: 167575 - DNA, 25 bp, Rattus norvegicus
agtttcctttcactagtcagccata

SEQ ID NO: 167576 - DNA, 25 bp, Rattus norvegicus
agtttcctttcagtagtcagccata

SEQ ID NO: 167577 - DNA, 25 bp, Rattus norvegicus
agtttcctttctccttcatgatgag

SEQ ID NO: 167578 - DNA, 25 bp, Rattus norvegicus
agtttcctttctgcttcatgatgag

SEQ ID NO: 167579 - DNA, 25 bp, Rattus norvegicus
agtttcgaacccagggtgtgcgtct

SEQ ID NO: 167580 - DNA, 25 bp, Rattus norvegicus
agtttcgaaccctgggtgtgcgtct

SEQ ID NO: 167581 - DNA, 25 bp, Rattus norvegicus
agtttcgccaggcttatggctccat

SEQ ID NO: 167582 - DNA, 25 bp, Rattus norvegicus
agtttcgccagggttatggctccat

SEQ ID NO: 167583 - DNA, 25 bp, Rattus norvegicus
agtttcgctgcaagctactcatggc

SEQ ID NO: 167584 - DNA, 25 bp, Rattus norvegicus
agtttcgctgcatgctactcatggc

SEQ ID NO: 167585 - DNA, 25 bp, Rattus norvegicus
agtttcgctggtattcttgtggctc

SEQ ID NO: 167586 - DNA, 25 bp, Rattus norvegicus
agtttcgctggttttcttgtggctc

SEQ ID NO: 167587 - DNA, 25 bp, Rattus norvegicus
agtttcgtcctcaatggtgtccagt

SEQ ID NO: 167588 - DNA, 25 bp, Rattus norvegicus
agtttcgtcctctatggtgtccagt

SEQ ID NO: 167589 - DNA, 25 bp, Rattus norvegicus
agtttcgtcttactgatgctccagg

SEQ ID NO: 167590 - DNA, 25 bp, Rattus norvegicus
agtttcgtcttagtgatgctccagg

SEQ ID NO: 167591 - DNA, 25 bp, Rattus norvegicus
agtttcgtgcctattgggcgggcac

SEQ ID NO: 167592 - DNA, 25 bp, Rattus norvegicus
agtttcgtgccttttgggcgggcac

SEQ ID NO: 167593 - DNA, 25 bp, Rattus norvegicus
agtttcgtgcgacgcagtcagagtt

SEQ ID NO: 167594 - DNA, 25 bp, Rattus norvegicus
agtttcgtgcgaggcagtcagagtt

SEQ ID NO: 167595 - DNA, 25 bp, Rattus norvegicus
agtttcgtggtactcatggctcatg

SEQ ID NO: 167596 - DNA, 25 bp, Rattus norvegicus
agtttcgtggtagtcatggctcatg

SEQ ID NO: 167597 - DNA, 25 bp, Rattus norvegicus
agtttcgttgttaccagcatctcat

SEQ ID NO: 167598 - DNA, 25 bp, Rattus norvegicus
agtttcgttgtttccagcatctcat

SEQ ID NO: 167599 - DNA, 25 bp, Rattus norvegicus
agtttctaaactccagctaaccagc

SEQ ID NO: 167600 - DNA, 25 bp, Rattus norvegicus
agtttctaaactgcagctaaccagc

SEQ ID NO: 167601 - DNA, 25 bp, Rattus norvegicus
agtttctacccgcagcaagatgatc

SEQ ID NO: 167602 - DNA, 25 bp, Rattus norvegicus
agtttctacccggagcaagatgatc

SEQ ID NO: 167603 - DNA, 25 bp, Rattus norvegicus
agtttctacgaacacttctggccaa

SEQ ID NO: 167604 - DNA, 25 bp, Rattus norvegicus
agtttctacgaagacttctggccaa

SEQ ID NO: 167605 - DNA, 25 bp, Rattus norvegicus
agtttctacgcccaggtcaaggtgg

SEQ ID NO: 167606 - DNA, 25 bp, Rattus norvegicus
agtttctacgccgaggtcaaggtgg

SEQ ID NO: 167607 - DNA, 25 bp, Rattus norvegicus
agtttctagctgacattcttctgcc

SEQ ID NO: 167608 - DNA, 25 bp, Rattus norvegicus
agtttctagctgtcattcttctgcc

SEQ ID NO: 167609 - DNA, 25 bp, Rattus norvegicus
agtttctaggctaatccccaacaag

SEQ ID NO: 167610 - DNA, 25 bp, Rattus norvegicus
agtttctaggcttatccccaacaag

SEQ ID NO: 167611 - DNA, 25 bp, Rattus norvegicus
agtttctagttcacagtcattgcct

SEQ ID NO: 167612 - DNA, 25 bp, Rattus norvegicus
agtttctagttctcagtcattgcct

SEQ ID NO: 167613 - DNA, 25 bp, Rattus norvegicus
agtttctatggcctgatttgtgttt

SEQ ID NO: 167614 - DNA, 25 bp, Rattus norvegicus
agtttctatggcgtgatttgtgttt

SEQ ID NO: 167615 - DNA, 25 bp, Rattus norvegicus
agtttctatgtcactcttttcctct

SEQ ID NO: 167616 - DNA, 25 bp, Rattus norvegicus
agtttctatgtcctggcgcgtttta

SEQ ID NO: 167617 - DNA, 25 bp, Rattus norvegicus
agtttctatgtcgtggcgcgtttta

SEQ ID NO: 167618 - DNA, 25 bp, Rattus norvegicus
agtttctatgtctctcttttcctct

SEQ ID NO: 167619 - DNA, 25 bp, Rattus norvegicus
agtttctattggactgtgttaaaat

SEQ ID NO: 167620 - DNA, 25 bp, Rattus norvegicus
agtttctattggtctgtgttaaaat

SEQ ID NO: 167621 - DNA, 25 bp, Rattus norvegicus
agtttctcagtcaaccacttctgat

SEQ ID NO: 167622 - DNA, 25 bp, Rattus norvegicus
agtttctcagtctaccacttctgat

SEQ ID NO: 167623 - DNA, 25 bp, Rattus norvegicus
agtttctcagttactctgtggtcag

SEQ ID NO: 167624 - DNA, 25 bp, Rattus norvegicus
agtttctcagttacttgcaccttaa

SEQ ID NO: 167625 - DNA, 25 bp, Rattus norvegicus
agtttctcagtttctctgtggtcag

SEQ ID NO: 167626 - DNA, 25 bp, Rattus norvegicus
agtttctcagtttcttgcaccttaa

SEQ ID NO: 167627 - DNA, 25 bp, Rattus norvegicus
agtttctccagcatatagtatattc

SEQ ID NO: 167628 - DNA, 25 bp, Rattus norvegicus
agtttctccagcttatagtatattc

SEQ ID NO: 167629 - DNA, 25 bp, Rattus norvegicus
agtttctccccccatagttgagagg

SEQ ID NO: 167630 - DNA, 25 bp, Rattus norvegicus
agtttctcccccgatagttgagagg

SEQ ID NO: 167631 - DNA, 25 bp, Rattus norvegicus
agtttctcccgacctgacacgtcat

SEQ ID NO: 167632 - DNA, 25 bp, Rattus norvegicus
agtttctcccgagctgacacgtcat

SEQ ID NO: 167633 - DNA, 25 bp, Rattus norvegicus
agtttctccgataaccaagcacaga

SEQ ID NO: 167634 - DNA, 25 bp, Rattus norvegicus
agtttctccgattaccaagcacaga

SEQ ID NO: 167635 - DNA, 25 bp, Rattus norvegicus
agtttctcctttacttggatctgta

SEQ ID NO: 167636 - DNA, 25 bp, Rattus norvegicus
agtttctccttttcttggatctgta

SEQ ID NO: 167637 - DNA, 25 bp, Rattus norvegicus
agtttctctactcccattcaatttg

SEQ ID NO: 167638 - DNA, 25 bp, Rattus norvegicus
agtttctctactgccattcaatttg

SEQ ID NO: 167639 - DNA, 25 bp, Rattus norvegicus
agtttctctctgagatgcggccgaa

SEQ ID NO: 167640 - DNA, 25 bp, Rattus norvegicus
agtttctctctgtgatgcggccgaa

SEQ ID NO: 167641 - DNA, 25 bp, Rattus norvegicus
agtttctctgagaaagtcccctggc

SEQ ID NO: 167642 - DNA, 25 bp, Rattus norvegicus
agtttctctgagtaagtcccctggc

SEQ ID NO: 167643 - DNA, 25 bp, Rattus norvegicus
agtttctctgctagttttcctgtga

SEQ ID NO: 167644 - DNA, 25 bp, Rattus norvegicus
agtttctctgcttgttttcctgtga

SEQ ID NO: 167645 - DNA, 25 bp, Rattus norvegicus
agtttctcttgaatctgttggttaa

SEQ ID NO: 167646 - DNA, 25 bp, Rattus norvegicus
agtttctcttgattctgttggttaa

SEQ ID NO: 167647 - DNA, 25 bp, Rattus norvegicus
agtttctgacctacaagttctccta

SEQ ID NO: 167648 - DNA, 25 bp, Rattus norvegicus
agtttctgaccttcaagttctccta

SEQ ID NO: 167649 - DNA, 25 bp, Rattus norvegicus
agtttctgagctaaagtctggacca

SEQ ID NO: 167650 - DNA, 25 bp, Rattus norvegicus
agtttctgagcttaagtctggacca

SEQ ID NO: 167651 - DNA, 25 bp, Rattus norvegicus
agtttctgcacaaagattactgcca

SEQ ID NO: 167652 - DNA, 25 bp, Rattus norvegicus
agtttctgcacatagattactgcca

SEQ ID NO: 167653 - DNA, 25 bp, Rattus norvegicus
agtttctgcccaagatgcaagccat

SEQ ID NO: 167654 - DNA, 25 bp, Rattus norvegicus
agtttctgcccatgatgcaagccat

SEQ ID NO: 167655 - DNA, 25 bp, Rattus norvegicus
agtttctgccctctttcttagtctg

SEQ ID NO: 167656 - DNA, 25 bp, Rattus norvegicus
agtttctgccctgtttcttagtctg

SEQ ID NO: 167657 - DNA, 25 bp, Rattus norvegicus
agtttctgcgtactaatgtgcgtat

SEQ ID NO: 167658 - DNA, 25 bp, Rattus norvegicus
agtttctgcgtagtaatgtgcgtat

SEQ ID NO: 167659 - DNA, 25 bp, Rattus norvegicus
agtttctgctctaccataactatgg

SEQ ID NO: 167660 - DNA, 25 bp, Rattus norvegicus
agtttctgctcttccataactatgg

SEQ ID NO: 167661 - DNA, 25 bp, Rattus norvegicus
agtttctgctggaccataggcatga

SEQ ID NO: 167662 - DNA, 25 bp, Rattus norvegicus
agtttctgctggtccataggcatga

SEQ ID NO: 167663 - DNA, 25 bp, Rattus norvegicus
agtttctgctgtatctactttaaag

SEQ ID NO: 167664 - DNA, 25 bp, Rattus norvegicus
agtttctgctgtttctactttaaag

SEQ ID NO: 167665 - DNA, 25 bp, Rattus norvegicus
agtttctggagcagctttcaagcaa

SEQ ID NO: 167666 - DNA, 25 bp, Rattus norvegicus
agtttctggagctgctttcaagcaa

SEQ ID NO: 167667 - DNA, 25 bp, Rattus norvegicus
agtttctggcccagtttagagatcc

SEQ ID NO: 167668 - DNA, 25 bp, Rattus norvegicus
agtttctggccctgtttagagatcc

SEQ ID NO: 167669 - DNA, 25 bp, Rattus norvegicus
agtttctgggtaccacaactcgcac

SEQ ID NO: 167670 - DNA, 25 bp, Rattus norvegicus
agtttctgggtagcacaactcgcac

SEQ ID NO: 167671 - DNA, 25 bp, Rattus norvegicus
agtttctgtaccaggtcctcatcga

SEQ ID NO: 167672 - DNA, 25 bp, Rattus norvegicus
agtttctgtacctggtcctcatcga

SEQ ID NO: 167673 - DNA, 25 bp, Rattus norvegicus
agtttctgtcatactgttaggtgtt

SEQ ID NO: 167674 - DNA, 25 bp, Rattus norvegicus
agtttctgtcattctgttaggtgtt

SEQ ID NO: 167675 - DNA, 25 bp, Rattus norvegicus
agtttctgtccgctctggagaagag

SEQ ID NO: 167676 - DNA, 25 bp, Rattus norvegicus
agtttctgtccggtctggagaagag

SEQ ID NO: 167677 - DNA, 25 bp, Rattus norvegicus
agtttctgtcctctttatctgtata

SEQ ID NO: 167678 - DNA, 25 bp, Rattus norvegicus
agtttctgtcctgtttatctgtata

SEQ ID NO: 167679 - DNA, 25 bp, Rattus norvegicus
agtttctgtctcattgttaatccca

SEQ ID NO: 167680 - DNA, 25 bp, Rattus norvegicus
agtttctgtctctttgttaatccca

SEQ ID NO: 167681 - DNA, 25 bp, Rattus norvegicus
agtttctgtgccattaccatccgga

SEQ ID NO: 167682 - DNA, 25 bp, Rattus norvegicus
agtttctgtgcctttaccatccgga

SEQ ID NO: 167683 - DNA, 25 bp, Rattus norvegicus
agtttcttagccacctcggccttgg

SEQ ID NO: 167684 - DNA, 25 bp, Rattus norvegicus
agtttcttagccatattccaagtgc

SEQ ID NO: 167685 - DNA, 25 bp, Rattus norvegicus
agtttcttagcctcctcggccttgg

SEQ ID NO: 167686 - DNA, 25 bp, Rattus norvegicus
agtttcttagccttattccaagtgc

SEQ ID NO: 167687 - DNA, 25 bp, Rattus norvegicus
agtttcttcactactggcgtaattg

SEQ ID NO: 167688 - DNA, 25 bp, Rattus norvegicus
agtttcttcacttctggcgtaattg

SEQ ID NO: 167689 - DNA, 25 bp, Rattus norvegicus
agtttcttcagccacaatccaaatg

SEQ ID NO: 167690 - DNA, 25 bp, Rattus norvegicus
agtttcttcagcgacaatccaaatg

SEQ ID NO: 167691 - DNA, 25 bp, Rattus norvegicus
agtttcttcaggatatcctctggga

SEQ ID NO: 167692 - DNA, 25 bp, Rattus norvegicus
agtttcttcaggttatcctctggga

SEQ ID NO: 167693 - DNA, 25 bp, Rattus norvegicus
agtttcttcatacacttctccttgt

SEQ ID NO: 167694 - DNA, 25 bp, Rattus norvegicus
agtttcttcatagacttctccttgt

SEQ ID NO: 167695 - DNA, 25 bp, Rattus norvegicus
agtttcttctgccagagcatgcaca

SEQ ID NO: 167696 - DNA, 25 bp, Rattus norvegicus
agtttcttctgcgagagcatgcaca

SEQ ID NO: 167697 - DNA, 25 bp, Rattus norvegicus
agtttcttctgtcgtgctacctcag

SEQ ID NO: 167698 - DNA, 25 bp, Rattus norvegicus
agtttcttctgtggtgctacctcag

SEQ ID NO: 167699 - DNA, 25 bp, Rattus norvegicus
agtttcttgagcatttaccctggtc

SEQ ID NO: 167700 - DNA, 25 bp, Rattus norvegicus
agtttcttgagcttttaccctggtc

SEQ ID NO: 167701 - DNA, 25 bp, Rattus norvegicus
agtttcttgcacattaaagccctgt

SEQ ID NO: 167702 - DNA, 25 bp, Rattus norvegicus
agtttcttgcactttaaagccctgt

SEQ ID NO: 167703 - DNA, 25 bp, Rattus norvegicus
agtttcttgggcactggactgcgag

SEQ ID NO: 167704 - DNA, 25 bp, Rattus norvegicus
agtttcttgggctctggactgcgag

SEQ ID NO: 167705 - DNA, 25 bp, Rattus norvegicus
agtttcttgtcgctatcctgagtca

SEQ ID NO: 167706 - DNA, 25 bp, Rattus norvegicus
agtttcttgtcggtatcctgagtca

SEQ ID NO: 167707 - DNA, 25 bp, Rattus norvegicus
agtttctttcatcaggacgccactg

SEQ ID NO: 167708 - DNA, 25 bp, Rattus norvegicus
agtttctttcatgaggacgccactg

SEQ ID NO: 167709 - DNA, 25 bp, Rattus norvegicus
agtttgaacgtgagcggcgactgct

SEQ ID NO: 167710 - DNA, 25 bp, Rattus norvegicus
agtttgaacgtgtgcggcgactgct

SEQ ID NO: 167711 - DNA, 25 bp, Rattus norvegicus
agtttgaactgacgcgcctcaagta

SEQ ID NO: 167712 - DNA, 25 bp, Rattus norvegicus
agtttgaactgaggcgcctcaagta

SEQ ID NO: 167713 - DNA, 25 bp, Rattus norvegicus
agtttgaactgcactctggatctcc

SEQ ID NO: 167714 - DNA, 25 bp, Rattus norvegicus
agtttgaactgctctctggatctcc

SEQ ID NO: 167715 - DNA, 25 bp, Rattus norvegicus
agtttgaagcagcacttcctggtct

SEQ ID NO: 167716 - DNA, 25 bp, Rattus norvegicus
agtttgaagcaggacttcctggtct

SEQ ID NO: 167717 - DNA, 25 bp, Rattus norvegicus
agtttgaattgtacaccgtccttgc

SEQ ID NO: 167718 - DNA, 25 bp, Rattus norvegicus
agtttgaattgttcaccgtccttgc

SEQ ID NO: 167719 - DNA, 25 bp, Rattus norvegicus
agtttgacaaacaggaaccctctct

SEQ ID NO: 167720 - DNA, 25 bp, Rattus norvegicus
agtttgacaaactggaaccctctct

SEQ ID NO: 167721 - DNA, 25 bp, Rattus norvegicus
agtttgaccccgagaacccatgtga

SEQ ID NO: 167722 - DNA, 25 bp, Rattus norvegicus
agtttgaccccgtgaacccatgtga

SEQ ID NO: 167723 - DNA, 25 bp, Rattus norvegicus
agtttgaccgctcggtaccagggca

SEQ ID NO: 167724 - DNA, 25 bp, Rattus norvegicus
agtttgaccgctgggtaccagggca

SEQ ID NO: 167725 - DNA, 25 bp, Rattus norvegicus
agtttgactactatgagcaccttcc

SEQ ID NO: 167726 - DNA, 25 bp, Rattus norvegicus
agtttgactactttgagcaccttcc

SEQ ID NO: 167727 - DNA, 25 bp, Rattus norvegicus
agtttgactaggctggctacctggc

SEQ ID NO: 167728 - DNA, 25 bp, Rattus norvegicus
agtttgactagggtggctacctggc

SEQ ID NO: 167729 - DNA, 25 bp, Rattus norvegicus
agtttgagaaccacagactccatct

SEQ ID NO: 167730 - DNA, 25 bp, Rattus norvegicus
agtttgagaacctcagactccatct

SEQ ID NO: 167731 - DNA, 25 bp, Rattus norvegicus
agtttgagaataacagcctgctgga

SEQ ID NO: 167732 - DNA, 25 bp, Rattus norvegicus
agtttgagaatatcagcctgctgga

SEQ ID NO: 167733 - DNA, 25 bp, Rattus norvegicus
agtttgagactcaatgcccttgaac

SEQ ID NO: 167734 - DNA, 25 bp, Rattus norvegicus
agtttgagactctatgcccttgaac

SEQ ID NO: 167735 - DNA, 25 bp, Rattus norvegicus
agtttgagatgtaggtcccctctga

SEQ ID NO: 167736 - DNA, 25 bp, Rattus norvegicus
agtttgagatgttggtcccctctga

SEQ ID NO: 167737 - DNA, 25 bp, Rattus norvegicus
agtttgagcagaacgtcagcattct

SEQ ID NO: 167738 - DNA, 25 bp, Rattus norvegicus
agtttgagcagatcgtcagcattct

SEQ ID NO: 167739 - DNA, 25 bp, Rattus norvegicus
agtttgagcatcctgaactacgcag

SEQ ID NO: 167740 - DNA, 25 bp, Rattus norvegicus
agtttgagcatcgtgaactacgcag

SEQ ID NO: 167741 - DNA, 25 bp, Rattus norvegicus
agtttgagcccacagtctacatccc

SEQ ID NO: 167742 - DNA, 25 bp, Rattus norvegicus
agtttgagcccagagtctacatccc

SEQ ID NO: 167743 - DNA, 25 bp, Rattus norvegicus
agtttgagccgaccctggtcaacag

SEQ ID NO: 167744 - DNA, 25 bp, Rattus norvegicus
agtttgagccgagcctggtcaacag

SEQ ID NO: 167745 - DNA, 25 bp, Rattus norvegicus
agtttgagcctcagttactgtttta

SEQ ID NO: 167746 - DNA, 25 bp, Rattus norvegicus
agtttgagcctctgttactgtttta

SEQ ID NO: 167747 - DNA, 25 bp, Rattus norvegicus
agtttgaggacaactgcttccagct

SEQ ID NO: 167748 - DNA, 25 bp, Rattus norvegicus
agtttgaggacatctgcttccagct

SEQ ID NO: 167749 - DNA, 25 bp, Rattus norvegicus
agtttgaggccaaccctgtctcaaa

SEQ ID NO: 167750 - DNA, 25 bp, Rattus norvegicus
agtttgaggccatccctgtctcaaa

SEQ ID NO: 167751 - DNA, 25 bp, Rattus norvegicus
agtttgaggtctctgctcgcttcag

SEQ ID NO: 167752 - DNA, 25 bp, Rattus norvegicus
agtttgaggtctgtgctcgcttcag

SEQ ID NO: 167753 - DNA, 25 bp, Rattus norvegicus
agtttgagtcagctgtgctgcacac

SEQ ID NO: 167754 - DNA, 25 bp, Rattus norvegicus
agtttgagtcaggtgtgctgcacac

SEQ ID NO: 167755 - DNA, 25 bp, Rattus norvegicus
agtttgagtctcattctctgggaaa

SEQ ID NO: 167756 - DNA, 25 bp, Rattus norvegicus
agtttgagtctctttctctgggaaa

SEQ ID NO: 167757 - DNA, 25 bp, Rattus norvegicus
agtttgagtctgcacagttccccaa

SEQ ID NO: 167758 - DNA, 25 bp, Rattus norvegicus
agtttgagtctggacagttccccaa

SEQ ID NO: 167759 - DNA, 25 bp, Rattus norvegicus
agtttgataaacacctttccctgtg

SEQ ID NO: 167760 - DNA, 25 bp, Rattus norvegicus
agtttgataaactcctttccctgtg

SEQ ID NO: 167761 - DNA, 25 bp, Rattus norvegicus
agtttgatgtggattgccggtctca

SEQ ID NO: 167762 - DNA, 25 bp, Rattus norvegicus
agtttgatgtggtttgccggtctca

SEQ ID NO: 167763 - DNA, 25 bp, Rattus norvegicus
agtttgattcctagctcacatctgc

SEQ ID NO: 167764 - DNA, 25 bp, Rattus norvegicus
agtttgattccttgctcacatctgc

SEQ ID NO: 167765 - DNA, 25 bp, Rattus norvegicus
agtttgattcggcaatgccctgtgg

SEQ ID NO: 167766 - DNA, 25 bp, Rattus norvegicus
agtttgattcgggaatgccctgtgg

SEQ ID NO: 167767 - DNA, 25 bp, Rattus norvegicus
agtttgatttggcaatgcgcccctc

SEQ ID NO: 167768 - DNA, 25 bp, Rattus norvegicus
agtttgatttgggaatgcgcccctc

SEQ ID NO: 167769 - DNA, 25 bp, Rattus norvegicus
agtttgcaaagtatagctaggcccc

SEQ ID NO: 167770 - DNA, 25 bp, Rattus norvegicus
agtttgcaaagtttagctaggcccc

SEQ ID NO: 167771 - DNA, 25 bp, Rattus norvegicus
agtttgcaatatacctgtttccaac

SEQ ID NO: 167772 - DNA, 25 bp, Rattus norvegicus
agtttgcaatattcctgtttccaac

SEQ ID NO: 167773 - DNA, 25 bp, Rattus norvegicus
agtttgcagattagtctcccagtca

SEQ ID NO: 167774 - DNA, 25 bp, Rattus norvegicus
agtttgcagatttgtctcccagtca

SEQ ID NO: 167775 - DNA, 25 bp, Rattus norvegicus
agtttgcagtacatgacatgtattt

SEQ ID NO: 167776 - DNA, 25 bp, Rattus norvegicus
agtttgcagtacttgacatgtattt

SEQ ID NO: 167777 - DNA, 25 bp, Rattus norvegicus
agtttgcattcaagacctgtcagag

SEQ ID NO: 167778 - DNA, 25 bp, Rattus norvegicus
agtttgcattcatgacctgtcagag

SEQ ID NO: 167779 - DNA, 25 bp, Rattus norvegicus
agtttgcattttacctgctgtatgt

SEQ ID NO: 167780 - DNA, 25 bp, Rattus norvegicus
agtttgcatttttcctgctgtatgt

SEQ ID NO: 167781 - DNA, 25 bp, Rattus norvegicus
agtttgccaccgcagatgcactgga

SEQ ID NO: 167782 - DNA, 25 bp, Rattus norvegicus
agtttgccaccggagatgcactgga

SEQ ID NO: 167783 - DNA, 25 bp, Rattus norvegicus
agtttgccacggctagtgtgtccat

SEQ ID NO: 167784 - DNA, 25 bp, Rattus norvegicus
agtttgccacgggtagtgtgtccat

SEQ ID NO: 167785 - DNA, 25 bp, Rattus norvegicus
agtttgccagacatacttgctgcct

SEQ ID NO: 167786 - DNA, 25 bp, Rattus norvegicus
agtttgccagacttacttgctgcct

SEQ ID NO: 167787 - DNA, 25 bp, Rattus norvegicus
agtttgccaggcagcagtagacaaa

SEQ ID NO: 167788 - DNA, 25 bp, Rattus norvegicus
agtttgccaggctgcagtagacaaa

SEQ ID NO: 167789 - DNA, 25 bp, Rattus norvegicus
agtttgccatcaccgacgtgcatgc

SEQ ID NO: 167790 - DNA, 25 bp, Rattus norvegicus
agtttgccatcagcgacgtgcatgc

SEQ ID NO: 167791 - DNA, 25 bp, Rattus norvegicus
agtttgccattgctgctcccagcga

SEQ ID NO: 167792 - DNA, 25 bp, Rattus norvegicus
agtttgccattggtgctcccagcga

SEQ ID NO: 167793 - DNA, 25 bp, Rattus norvegicus
agtttgcccaccagacctatatcag

SEQ ID NO: 167794 - DNA, 25 bp, Rattus norvegicus
agtttgcccacctgacctatatcag

SEQ ID NO: 167795 - DNA, 25 bp, Rattus norvegicus
agtttgccggcaagtcaggtgacga

SEQ ID NO: 167796 - DNA, 25 bp, Rattus norvegicus
agtttgccggcatgtcaggtgacga

SEQ ID NO: 167797 - DNA, 25 bp, Rattus norvegicus
agtttgcctagtactggctgttcct

SEQ ID NO: 167798 - DNA, 25 bp, Rattus norvegicus
agtttgcctagttctggctgttcct

SEQ ID NO: 167799 - DNA, 25 bp, Rattus norvegicus
agtttgcctcccaacagtcgttgga

SEQ ID NO: 167800 - DNA, 25 bp, Rattus norvegicus
agtttgcctccctacagtcgttgga

SEQ ID NO: 167801 - DNA, 25 bp, Rattus norvegicus
agtttgcctgaaatgcttctttccc

SEQ ID NO: 167802 - DNA, 25 bp, Rattus norvegicus
agtttgcctgaattgcttctttccc

SEQ ID NO: 167803 - DNA, 25 bp, Rattus norvegicus
agtttgcctgcactactgggatact

SEQ ID NO: 167804 - DNA, 25 bp, Rattus norvegicus
agtttgcctgcagtactgggatact

SEQ ID NO: 167805 - DNA, 25 bp, Rattus norvegicus
agtttgcctggcatgctttcagttt

SEQ ID NO: 167806 - DNA, 25 bp, Rattus norvegicus
agtttgcctggcttgctttcagttt

SEQ ID NO: 167807 - DNA, 25 bp, Rattus norvegicus
agtttgcctggtatgactaacctgc

SEQ ID NO: 167808 - DNA, 25 bp, Rattus norvegicus
agtttgcctggtttgactaacctgc

SEQ ID NO: 167809 - DNA, 25 bp, Rattus norvegicus
agtttgctaaacacacactccttct

SEQ ID NO: 167810 - DNA, 25 bp, Rattus norvegicus
agtttgctaaactcacactccttct

SEQ ID NO: 167811 - DNA, 25 bp, Rattus norvegicus
agtttgctagctatgtttctcattt

SEQ ID NO: 167812 - DNA, 25 bp, Rattus norvegicus
agtttgctagctttgtttctcattt

SEQ ID NO: 167813 - DNA, 25 bp, Rattus norvegicus
agtttgctccgccagtttaggtgag

SEQ ID NO: 167814 - DNA, 25 bp, Rattus norvegicus
agtttgctccgcgagtttaggtgag

SEQ ID NO: 167815 - DNA, 25 bp, Rattus norvegicus
agtttgctccttacacctggagcta

SEQ ID NO: 167816 - DNA, 25 bp, Rattus norvegicus
agtttgctcctttcacctggagcta

SEQ ID NO: 167817 - DNA, 25 bp, Rattus norvegicus
agtttgctctcgaacagcaactggg

SEQ ID NO: 167818 - DNA, 25 bp, Rattus norvegicus
agtttgctctcgtacagcaactggg

SEQ ID NO: 167819 - DNA, 25 bp, Rattus norvegicus
agtttgctctgaaacatctgcccaa

SEQ ID NO: 167820 - DNA, 25 bp, Rattus norvegicus
agtttgctctgatacatctgcccaa

SEQ ID NO: 167821 - DNA, 25 bp, Rattus norvegicus
agtttgctgaagaccactcccagtt

SEQ ID NO: 167822 - DNA, 25 bp, Rattus norvegicus
agtttgctgaagtccactcccagtt

SEQ ID NO: 167823 - DNA, 25 bp, Rattus norvegicus
agtttgctgctcagtgcctctgtgg

SEQ ID NO: 167824 - DNA, 25 bp, Rattus norvegicus
agtttgctgctctgtgcctctgtgg

SEQ ID NO: 167825 - DNA, 25 bp, Rattus norvegicus
agtttgctgtgcctagttcatcttc

SEQ ID NO: 167826 - DNA, 25 bp, Rattus norvegicus
agtttgctgtgcgtagttcatcttc

SEQ ID NO: 167827 - DNA, 25 bp, Rattus norvegicus
agtttgcttatgaagtcctgcctta

SEQ ID NO: 167828 - DNA, 25 bp, Rattus norvegicus
agtttgcttatgtagtcctgcctta

SEQ ID NO: 167829 - DNA, 25 bp, Rattus norvegicus
agtttgcttgttacctgtcgtcgcc

SEQ ID NO: 167830 - DNA, 25 bp, Rattus norvegicus
agtttgcttgtttcctgtcgtcgcc

SEQ ID NO: 167831 - DNA, 25 bp, Rattus norvegicus
agtttgctttctctgccaattaaag

SEQ ID NO: 167832 - DNA, 25 bp, Rattus norvegicus
agtttgctttctgtgccaattaaag

SEQ ID NO: 167833 - DNA, 25 bp, Rattus norvegicus
agtttgctttggcattccctcagct

SEQ ID NO: 167834 - DNA, 25 bp, Rattus norvegicus
agtttgctttgggattccctcagct

SEQ ID NO: 167835 - DNA, 25 bp, Rattus norvegicus
agtttggaaattccctgtctctgct

SEQ ID NO: 167836 - DNA, 25 bp, Rattus norvegicus
agtttggaaattgcctgtctctgct

SEQ ID NO: 167837 - DNA, 25 bp, Rattus norvegicus
agtttggaattaagactgtagtctg

SEQ ID NO: 167838 - DNA, 25 bp, Rattus norvegicus
agtttggaattatgactgtagtctg

SEQ ID NO: 167839 - DNA, 25 bp, Rattus norvegicus
agtttggaattgcactcacagaatc

SEQ ID NO: 167840 - DNA, 25 bp, Rattus norvegicus
agtttggaattggactcacagaatc

SEQ ID NO: 167841 - DNA, 25 bp, Rattus norvegicus
agtttggacctacatttctctgtgt

SEQ ID NO: 167842 - DNA, 25 bp, Rattus norvegicus
agtttggacctagatttctctgtgt

SEQ ID NO: 167843 - DNA, 25 bp, Rattus norvegicus
agtttggagggtccttctcattctt

SEQ ID NO: 167844 - DNA, 25 bp, Rattus norvegicus
agtttggagggtgcttctcattctt

SEQ ID NO: 167845 - DNA, 25 bp, Rattus norvegicus
agtttggatctgctggctcacatcg

SEQ ID NO: 167846 - DNA, 25 bp, Rattus norvegicus
agtttggatctggtggctcacatcg

SEQ ID NO: 167847 - DNA, 25 bp, Rattus norvegicus
agtttggatgaaccgcaggccagaa

SEQ ID NO: 167848 - DNA, 25 bp, Rattus norvegicus
agtttggatgaagcgcaggccagaa

SEQ ID NO: 167849 - DNA, 25 bp, Rattus norvegicus
agtttggattgtcgtcgtccagacc

SEQ ID NO: 167850 - DNA, 25 bp, Rattus norvegicus
agtttggattgtggtcgtccagacc

SEQ ID NO: 167851 - DNA, 25 bp, Rattus norvegicus
agtttggcagatacttcaagacaca

SEQ ID NO: 167852 - DNA, 25 bp, Rattus norvegicus
agtttggcagattcttcaagacaca

SEQ ID NO: 167853 - DNA, 25 bp, Rattus norvegicus
agtttggccaacagcctagtggtcc

SEQ ID NO: 167854 - DNA, 25 bp, Rattus norvegicus
agtttggccaactgcctagtggtcc

SEQ ID NO: 167855 - DNA, 25 bp, Rattus norvegicus
agtttggcctgaccaccaacgttag

SEQ ID NO: 167856 - DNA, 25 bp, Rattus norvegicus
agtttggcctgagcaccaacgttag

SEQ ID NO: 167857 - DNA, 25 bp, Rattus norvegicus
agtttggctagtagactggttggct

SEQ ID NO: 167858 - DNA, 25 bp, Rattus norvegicus
agtttggctagttgactggttggct

SEQ ID NO: 167859 - DNA, 25 bp, Rattus norvegicus
agtttggctgccctgatcctgtgcg

SEQ ID NO: 167860 - DNA, 25 bp, Rattus norvegicus
agtttggctgccgtgatcctgtgcg

SEQ ID NO: 167861 - DNA, 25 bp, Rattus norvegicus
agtttggcttaacctggtcactcct

SEQ ID NO: 167862 - DNA, 25 bp, Rattus norvegicus
agtttggcttaagctggtcactcct

SEQ ID NO: 167863 - DNA, 25 bp, Rattus norvegicus
agtttgggtcagaagagtctttaag

SEQ ID NO: 167864 - DNA, 25 bp, Rattus norvegicus
agtttgggtcagtagagtctttaag

SEQ ID NO: 167865 - DNA, 25 bp, Rattus norvegicus
agtttgggtgtcatgtaccacagtt

SEQ ID NO: 167866 - DNA, 25 bp, Rattus norvegicus
agtttgggtgtcttgtaccacagtt

SEQ ID NO: 167867 - DNA, 25 bp, Rattus norvegicus
agtttggtctctagactcttagcaa

SEQ ID NO: 167868 - DNA, 25 bp, Rattus norvegicus
agtttggtctcttgactcttagcaa

SEQ ID NO: 167869 - DNA, 25 bp, Rattus norvegicus
agtttggtctggactggcacgagat

SEQ ID NO: 167870 - DNA, 25 bp, Rattus norvegicus
agtttggtctggtctggcacgagat

SEQ ID NO: 167871 - DNA, 25 bp, Rattus norvegicus
agtttggtgcacacctggaatgacc

SEQ ID NO: 167872 - DNA, 25 bp, Rattus norvegicus
agtttggtgcactcctggaatgacc

SEQ ID NO: 167873 - DNA, 25 bp, Rattus norvegicus
agtttggtgccacagacctggatgt

SEQ ID NO: 167874 - DNA, 25 bp, Rattus norvegicus
agtttggtgccagagacctggatgt

SEQ ID NO: 167875 - DNA, 25 bp, Rattus norvegicus
agtttggttactagtcacctgggct

SEQ ID NO: 167876 - DNA, 25 bp, Rattus norvegicus
agtttggttacttgtcacctgggct

SEQ ID NO: 167877 - DNA, 25 bp, Rattus norvegicus
agtttggttcttccccacacaagag

SEQ ID NO: 167878 - DNA, 25 bp, Rattus norvegicus
agtttggttcttgcccacacaagag

SEQ ID NO: 167879 - DNA, 25 bp, Rattus norvegicus
agtttggtttcgatcttcataacgg

SEQ ID NO: 167880 - DNA, 25 bp, Rattus norvegicus
agtttggtttcgttcttcataacgg

SEQ ID NO: 167881 - DNA, 25 bp, Rattus norvegicus
agtttggttttaacatgtcaatgtg

SEQ ID NO: 167882 - DNA, 25 bp, Rattus norvegicus
agtttggttttatcatgtcaatgtg

SEQ ID NO: 167883 - DNA, 25 bp, Rattus norvegicus
agtttgtaaagcactgctcctacac

SEQ ID NO: 167884 - DNA, 25 bp, Rattus norvegicus
agtttgtaaagctctgctcctacac

SEQ ID NO: 167885 - DNA, 25 bp, Rattus norvegicus
agtttgtaactgctgttgacctcct

SEQ ID NO: 167886 - DNA, 25 bp, Rattus norvegicus
agtttgtaactggtgttgacctcct

SEQ ID NO: 167887 - DNA, 25 bp, Rattus norvegicus
agtttgtacacccttggtggcttga

SEQ ID NO: 167888 - DNA, 25 bp, Rattus norvegicus
agtttgtacaccgttggtggcttga

SEQ ID NO: 167889 - DNA, 25 bp, Rattus norvegicus
agtttgtacctgaagcttctgcctg

SEQ ID NO: 167890 - DNA, 25 bp, Rattus norvegicus
agtttgtacctgtagcttctgcctg

SEQ ID NO: 167891 - DNA, 25 bp, Rattus norvegicus
agtttgtactaccaacgtcacttca

SEQ ID NO: 167892 - DNA, 25 bp, Rattus norvegicus
agtttgtactacgaacgtcacttca

SEQ ID NO: 167893 - DNA, 25 bp, Rattus norvegicus
agtttgtatagtacatctgctcctg

SEQ ID NO: 167894 - DNA, 25 bp, Rattus norvegicus
agtttgtatagttcatctgctcctg

SEQ ID NO: 167895 - DNA, 25 bp, Rattus norvegicus
agtttgtatcacatgtcgcaggaag

SEQ ID NO: 167896 - DNA, 25 bp, Rattus norvegicus
agtttgtatcacttgtcgcaggaag

SEQ ID NO: 167897 - DNA, 25 bp, Rattus norvegicus
agtttgtatcatacctttgcatata

SEQ ID NO: 167898 - DNA, 25 bp, Rattus norvegicus
agtttgtatcattcctttgcatata

SEQ ID NO: 167899 - DNA, 25 bp, Rattus norvegicus
agtttgtcaattacagttagccctg

SEQ ID NO: 167900 - DNA, 25 bp, Rattus norvegicus
agtttgtcaatttcagttagccctg

SEQ ID NO: 167901 - DNA, 25 bp, Rattus norvegicus
agtttgtcattactcagcttgtgga

SEQ ID NO: 167902 - DNA, 25 bp, Rattus norvegicus
agtttgtcattagtcagcttgtgga

SEQ ID NO: 167903 - DNA, 25 bp, Rattus norvegicus
agtttgtcccatcgcttattttcta

SEQ ID NO: 167904 - DNA, 25 bp, Rattus norvegicus
agtttgtcccatggcttattttcta

SEQ ID NO: 167905 - DNA, 25 bp, Rattus norvegicus
agtttgtccctaattgtgtgtgttc

SEQ ID NO: 167906 - DNA, 25 bp, Rattus norvegicus
agtttgtccctatttgtgtgtgttc

SEQ ID NO: 167907 - DNA, 25 bp, Rattus norvegicus
agtttgtcctaaattctgtgctggg

SEQ ID NO: 167908 - DNA, 25 bp, Rattus norvegicus
agtttgtcctaatttctgtgctggg

SEQ ID NO: 167909 - DNA, 25 bp, Rattus norvegicus
agtttgtcgacacatctcatggtct

SEQ ID NO: 167910 - DNA, 25 bp, Rattus norvegicus
agtttgtcgacagatctcatggtct

SEQ ID NO: 167911 - DNA, 25 bp, Rattus norvegicus
agtttgtctcatcacccaatacctc

SEQ ID NO: 167912 - DNA, 25 bp, Rattus norvegicus
agtttgtctcatgacccaatacctc

SEQ ID NO: 167913 - DNA, 25 bp, Rattus norvegicus
agtttgtctgaccaaggctatggac

SEQ ID NO: 167914 - DNA, 25 bp, Rattus norvegicus
agtttgtctgacgaaggctatggac

SEQ ID NO: 167915 - DNA, 25 bp, Rattus norvegicus
agtttgtctgtcacaagttcctcat

SEQ ID NO: 167916 - DNA, 25 bp, Rattus norvegicus
agtttgtctgtctcaagttcctcat

SEQ ID NO: 167917 - DNA, 25 bp, Rattus norvegicus
agtttgtcttaaatggtctcaacat

SEQ ID NO: 167918 - DNA, 25 bp, Rattus norvegicus
agtttgtcttaattggtctcaacat

SEQ ID NO: 167919 - DNA, 25 bp, Rattus norvegicus
agtttgtcttctctgagtcgagccc

SEQ ID NO: 167920 - DNA, 25 bp, Rattus norvegicus
agtttgtcttctgtgagtcgagccc

SEQ ID NO: 167921 - DNA, 25 bp, Rattus norvegicus
agtttgtgccagagcttgtcaggaa

SEQ ID NO: 167922 - DNA, 25 bp, Rattus norvegicus
agtttgtgccagtgcttgtcaggaa

SEQ ID NO: 167923 - DNA, 25 bp, Rattus norvegicus
agtttgtgcgtgcacccatttccca

SEQ ID NO: 167924 - DNA, 25 bp, Rattus norvegicus
agtttgtgcgtggacccatttccca

SEQ ID NO: 167925 - DNA, 25 bp, Rattus norvegicus
agtttgtgctggagagagctgacca

SEQ ID NO: 167926 - DNA, 25 bp, Rattus norvegicus
agtttgtgctggtgagagctgacca

SEQ ID NO: 167927 - DNA, 25 bp, Rattus norvegicus
agtttgtggactctacgttctatct

SEQ ID NO: 167928 - DNA, 25 bp, Rattus norvegicus
agtttgtggactgtacgttctatct

SEQ ID NO: 167929 - DNA, 25 bp, Rattus norvegicus
agtttgtgggtgaatatctctaagc

SEQ ID NO: 167930 - DNA, 25 bp, Rattus norvegicus
agtttgtgggtgtatatctctaagc

SEQ ID NO: 167931 - DNA, 25 bp, Rattus norvegicus
agtttgtgtgatcgtcagttttgac

SEQ ID NO: 167932 - DNA, 25 bp, Rattus norvegicus
agtttgtgtgatggtcagttttgac

SEQ ID NO: 167933 - DNA, 25 bp, Rattus norvegicus
agtttgtgtgctcttgcctggatgc

SEQ ID NO: 167934 - DNA, 25 bp, Rattus norvegicus
agtttgtgtgctgttgcctggatgc

SEQ ID NO: 167935 - DNA, 25 bp, Rattus norvegicus
agtttgttaacaatctgcgacctct

SEQ ID NO: 167936 - DNA, 25 bp, Rattus norvegicus
agtttgttaacattctgcgacctct

SEQ ID NO: 167937 - DNA, 25 bp, Rattus norvegicus
agtttgttaactagctactccgtgg

SEQ ID NO: 167938 - DNA, 25 bp, Rattus norvegicus
agtttgttaacttgctactccgtgg

SEQ ID NO: 167939 - DNA, 25 bp, Rattus norvegicus
agtttgttacccaggatgtgtctca

SEQ ID NO: 167940 - DNA, 25 bp, Rattus norvegicus
agtttgttaccctggatgtgtctca

SEQ ID NO: 167941 - DNA, 25 bp, Rattus norvegicus
agtttgttagcacctctctgtccct

SEQ ID NO: 167942 - DNA, 25 bp, Rattus norvegicus
agtttgttagcagctctctgtccct

SEQ ID NO: 167943 - DNA, 25 bp, Rattus norvegicus
agtttgttcccactgtttgcaacgg

SEQ ID NO: 167944 - DNA, 25 bp, Rattus norvegicus
agtttgttcccagtgtttgcaacgg

SEQ ID NO: 167945 - DNA, 25 bp, Rattus norvegicus
agtttgttctgtatctccatagctc

SEQ ID NO: 167946 - DNA, 25 bp, Rattus norvegicus
agtttgttctgtttctccatagctc

SEQ ID NO: 167947 - DNA, 25 bp, Rattus norvegicus
agtttgttgctcagtatacccttcc

SEQ ID NO: 167948 - DNA, 25 bp, Rattus norvegicus
agtttgttgctctgtatacccttcc

SEQ ID NO: 167949 - DNA, 25 bp, Rattus norvegicus
agtttgttggtactgcatgcttctg

SEQ ID NO: 167950 - DNA, 25 bp, Rattus norvegicus
agtttgttggtagtgcatgcttctg

SEQ ID NO: 167951 - DNA, 25 bp, Rattus norvegicus
agtttgtttcaaatgggctcctgct

SEQ ID NO: 167952 - DNA, 25 bp, Rattus norvegicus
agtttgtttcaattgggctcctgct

SEQ ID NO: 167953 - DNA, 25 bp, Rattus norvegicus
agtttgtttctccaccatgtcgttg

SEQ ID NO: 167954 - DNA, 25 bp, Rattus norvegicus
agtttgtttctcgaccatgtcgttg

SEQ ID NO: 167955 - DNA, 25 bp, Rattus norvegicus
agtttgtttgacaccactcatgaat

SEQ ID NO: 167956 - DNA, 25 bp, Rattus norvegicus
agtttgtttgactccactcatgaat

SEQ ID NO: 167957 - DNA, 25 bp, Rattus norvegicus
agtttgtttgagattcgcctcccaa

SEQ ID NO: 167958 - DNA, 25 bp, Rattus norvegicus
agtttgtttgagtttcgcctcccaa

SEQ ID NO: 167959 - DNA, 25 bp, Rattus norvegicus
agttttaaacaacatccagcccagc

SEQ ID NO: 167960 - DNA, 25 bp, Rattus norvegicus
agttttaaacaagatccagcccagc

SEQ ID NO: 167961 - DNA, 25 bp, Rattus norvegicus
agttttaagttgcagcgtctgagaa

SEQ ID NO: 167962 - DNA, 25 bp, Rattus norvegicus
agttttaagttggagcgtctgagaa

SEQ ID NO: 167963 - DNA, 25 bp, Rattus norvegicus
agttttaatcccatcacccaggagg

SEQ ID NO: 167964 - DNA, 25 bp, Rattus norvegicus
agttttaatcccttcacccaggagg

SEQ ID NO: 167965 - DNA, 25 bp, Rattus norvegicus
agttttaattctccccattttcacg

SEQ ID NO: 167966 - DNA, 25 bp, Rattus norvegicus
agttttaattctgcccattttcacg

SEQ ID NO: 167967 - DNA, 25 bp, Rattus norvegicus
agttttaattgtcctcaccatccct

SEQ ID NO: 167968 - DNA, 25 bp, Rattus norvegicus
agttttaattgtgctcaccatccct

SEQ ID NO: 167969 - DNA, 25 bp, Rattus norvegicus
agttttacagccacaatgatgcctc

SEQ ID NO: 167970 - DNA, 25 bp, Rattus norvegicus
agttttacagcctcaatgatgcctc

SEQ ID NO: 167971 - DNA, 25 bp, Rattus norvegicus
agttttacctatcgctctttggcct

SEQ ID NO: 167972 - DNA, 25 bp, Rattus norvegicus
agttttacctatggctctttggcct

SEQ ID NO: 167973 - DNA, 25 bp, Rattus norvegicus
agttttacggaaatggctcgcgcct

SEQ ID NO: 167974 - DNA, 25 bp, Rattus norvegicus
agttttacggaattggctcgcgcct

SEQ ID NO: 167975 - DNA, 25 bp, Rattus norvegicus
agttttactctaaggtcaccctgaa

SEQ ID NO: 167976 - DNA, 25 bp, Rattus norvegicus
agttttactctatggtcaccctgaa

SEQ ID NO: 167977 - DNA, 25 bp, Rattus norvegicus
agttttacttctccttgtaccttca

SEQ ID NO: 167978 - DNA, 25 bp, Rattus norvegicus
agttttacttctgcttgtaccttca

SEQ ID NO: 167979 - DNA, 25 bp, Rattus norvegicus
agttttagaacgctctcagccccag

SEQ ID NO: 167980 - DNA, 25 bp, Rattus norvegicus
agttttagaacggtctcagccccag

SEQ ID NO: 167981 - DNA, 25 bp, Rattus norvegicus
agttttagacctaggcagatcttta

SEQ ID NO: 167982 - DNA, 25 bp, Rattus norvegicus
agttttagaccttggcagatcttta

SEQ ID NO: 167983 - DNA, 25 bp, Rattus norvegicus
agttttagccagacacaatcttatt

SEQ ID NO: 167984 - DNA, 25 bp, Rattus norvegicus
agttttagccagtcacaatcttatt

SEQ ID NO: 167985 - DNA, 25 bp, Rattus norvegicus
agttttagccccagaccaggagtca

SEQ ID NO: 167986 - DNA, 25 bp, Rattus norvegicus
agttttagcccctgaccaggagtca

SEQ ID NO: 167987 - DNA, 25 bp, Rattus norvegicus
agttttaggtgcaggtggcttctcc

SEQ ID NO: 167988 - DNA, 25 bp, Rattus norvegicus
agttttaggtgctggtggcttctcc

SEQ ID NO: 167989 - DNA, 25 bp, Rattus norvegicus
agttttagtggtccccaagcatgct

SEQ ID NO: 167990 - DNA, 25 bp, Rattus norvegicus
agttttagtggtgcccaagcatgct

SEQ ID NO: 167991 - DNA, 25 bp, Rattus norvegicus
agttttatctgtacagttgtgcaag

SEQ ID NO: 167992 - DNA, 25 bp, Rattus norvegicus
agttttatctgttcagttgtgcaag

SEQ ID NO: 167993 - DNA, 25 bp, Rattus norvegicus
agttttatgatgatgcaggcagtac

SEQ ID NO: 167994 - DNA, 25 bp, Rattus norvegicus
agttttatgatgttgcaggcagtac

SEQ ID NO: 167995 - DNA, 25 bp, Rattus norvegicus
agttttatggccagaatggtgcccc

SEQ ID NO: 167996 - DNA, 25 bp, Rattus norvegicus
agttttatggcctgaatggtgcccc

SEQ ID NO: 167997 - DNA, 25 bp, Rattus norvegicus
agttttatgtttcgctcttcatctc

SEQ ID NO: 167998 - DNA, 25 bp, Rattus norvegicus
agttttatgtttggctcttcatctc

SEQ ID NO: 167999 - DNA, 25 bp, Rattus norvegicus
agttttcactccagctaacacttac

SEQ ID NO: 168000 - DNA, 25 bp, Rattus norvegicus
agttttcactcctgctaacacttac

SEQ ID NO: 168001 - DNA, 25 bp, Rattus norvegicus
agttttcagattcacctgtgcgtgt

SEQ ID NO: 168002 - DNA, 25 bp, Rattus norvegicus
agttttcagattgacctgtgcgtgt

SEQ ID NO: 168003 - DNA, 25 bp, Rattus norvegicus
agttttcagcatatactacacatga

SEQ ID NO: 168004 - DNA, 25 bp, Rattus norvegicus
agttttcagcatttactacacatga

SEQ ID NO: 168005 - DNA, 25 bp, Rattus norvegicus
agttttcagcgccagccacattaaa

SEQ ID NO: 168006 - DNA, 25 bp, Rattus norvegicus
agttttcagcgcgagccacattaaa

SEQ ID NO: 168007 - DNA, 25 bp, Rattus norvegicus
agttttcagtccaggctagtggctt

SEQ ID NO: 168008 - DNA, 25 bp, Rattus norvegicus
agttttcagtcctggctagtggctt

SEQ ID NO: 168009 - DNA, 25 bp, Rattus norvegicus
agttttcatctacccatatctgccc

SEQ ID NO: 168010 - DNA, 25 bp, Rattus norvegicus
agttttcatctagccatatctgccc

SEQ ID NO: 168011 - DNA, 25 bp, Rattus norvegicus
agttttcatgcacagctcccatgaa

SEQ ID NO: 168012 - DNA, 25 bp, Rattus norvegicus
agttttcatgcagagctcccatgaa

SEQ ID NO: 168013 - DNA, 25 bp, Rattus norvegicus
agttttcattacatcctgtcgctga

SEQ ID NO: 168014 - DNA, 25 bp, Rattus norvegicus
agttttcattacttcctgtcgctga

SEQ ID NO: 168015 - DNA, 25 bp, Rattus norvegicus
agttttcattccagtggtcgacggc

SEQ ID NO: 168016 - DNA, 25 bp, Rattus norvegicus
agttttcattcctgtggtcgacggc

SEQ ID NO: 168017 - DNA, 25 bp, Rattus norvegicus
agttttcatttcattgtctattgtt

SEQ ID NO: 168018 - DNA, 25 bp, Rattus norvegicus
agttttcatttctttgtctattgtt

SEQ ID NO: 168019 - DNA, 25 bp, Rattus norvegicus
agttttccaaacagcagctgagtcc

SEQ ID NO: 168020 - DNA, 25 bp, Rattus norvegicus
agttttccaaactgcagctgagtcc

SEQ ID NO: 168021 - DNA, 25 bp, Rattus norvegicus
agttttccagagaattcccagccct

SEQ ID NO: 168022 - DNA, 25 bp, Rattus norvegicus
agttttccagagtattcccagccct

SEQ ID NO: 168023 - DNA, 25 bp, Rattus norvegicus
agttttccagtcagagtcaccagtg

SEQ ID NO: 168024 - DNA, 25 bp, Rattus norvegicus
agttttccagtctgagtcaccagtg

SEQ ID NO: 168025 - DNA, 25 bp, Rattus norvegicus
agttttcccacgcagcagctgaggc

SEQ ID NO: 168026 - DNA, 25 bp, Rattus norvegicus
agttttcccacggagcagctgaggc

SEQ ID NO: 168027 - DNA, 25 bp, Rattus norvegicus
agttttcccttgatggaccgagcat

SEQ ID NO: 168028 - DNA, 25 bp, Rattus norvegicus
agttttcccttgttggaccgagcat

SEQ ID NO: 168029 - DNA, 25 bp, Rattus norvegicus
agttttccgactattggatgcctgt

SEQ ID NO: 168030 - DNA, 25 bp, Rattus norvegicus
agttttccgactccagtttgatgaa

SEQ ID NO: 168031 - DNA, 25 bp, Rattus norvegicus
agttttccgactgcagtttgatgaa

SEQ ID NO: 168032 - DNA, 25 bp, Rattus norvegicus
agttttccgacttttggatgcctgt

SEQ ID NO: 168033 - DNA, 25 bp, Rattus norvegicus
agttttcctgctatgttctcgtgaa

SEQ ID NO: 168034 - DNA, 25 bp, Rattus norvegicus
agttttcctgctttgttctcgtgaa

SEQ ID NO: 168035 - DNA, 25 bp, Rattus norvegicus
agttttcgctatattgttatgtcaa

SEQ ID NO: 168036 - DNA, 25 bp, Rattus norvegicus
agttttcgctattttgttatgtcaa

SEQ ID NO: 168037 - DNA, 25 bp, Rattus norvegicus
agttttctaggtcagcttcattccc

SEQ ID NO: 168038 - DNA, 25 bp, Rattus norvegicus
agttttctaggtgagcttcattccc

SEQ ID NO: 168039 - DNA, 25 bp, Rattus norvegicus
agttttctcacgctcggagcatcag

SEQ ID NO: 168040 - DNA, 25 bp, Rattus norvegicus
agttttctcacggtcggagcatcag

SEQ ID NO: 168041 - DNA, 25 bp, Rattus norvegicus
agttttctcctaattgtagtgtcta

SEQ ID NO: 168042 - DNA, 25 bp, Rattus norvegicus
agttttctcctacgtgacactgttg

SEQ ID NO: 168043 - DNA, 25 bp, Rattus norvegicus
agttttctcctaggtgacactgttg

SEQ ID NO: 168044 - DNA, 25 bp, Rattus norvegicus
agttttctcctatttgtagtgtcta

SEQ ID NO: 168045 - DNA, 25 bp, Rattus norvegicus
agttttctctatacagccttgggtg

SEQ ID NO: 168046 - DNA, 25 bp, Rattus norvegicus
agttttctctattcagccttgggtg

SEQ ID NO: 168047 - DNA, 25 bp, Rattus norvegicus
agttttctctggctggctggacata

SEQ ID NO: 168048 - DNA, 25 bp, Rattus norvegicus
agttttctctgggtggctggacata

SEQ ID NO: 168049 - DNA, 25 bp, Rattus norvegicus
agttttctgagtcccaattcctagt

SEQ ID NO: 168050 - DNA, 25 bp, Rattus norvegicus
agttttctgagtgccaattcctagt

SEQ ID NO: 168051 - DNA, 25 bp, Rattus norvegicus
agttttctgccaccctgcacgtgga

SEQ ID NO: 168052 - DNA, 25 bp, Rattus norvegicus
agttttctgccagcctgcacgtgga

SEQ ID NO: 168053 - DNA, 25 bp, Rattus norvegicus
agttttctggatctttgtgctcggc

SEQ ID NO: 168054 - DNA, 25 bp, Rattus norvegicus
agttttctggatgtttgtgctcggc

SEQ ID NO: 168055 - DNA, 25 bp, Rattus norvegicus
agttttctgtctactttcctcagga

SEQ ID NO: 168056 - DNA, 25 bp, Rattus norvegicus
agttttctgtcttctttcctcagga

SEQ ID NO: 168057 - DNA, 25 bp, Rattus norvegicus
agttttcttcatccaacggagactg

SEQ ID NO: 168058 - DNA, 25 bp, Rattus norvegicus
agttttcttcatgcaacggagactg

SEQ ID NO: 168059 - DNA, 25 bp, Rattus norvegicus
agttttcttctcatttaatctgtgt

SEQ ID NO: 168060 - DNA, 25 bp, Rattus norvegicus
agttttcttctcttttaatctgtgt

SEQ ID NO: 168061 - DNA, 25 bp, Rattus norvegicus
agttttcttgctacactatccaata

SEQ ID NO: 168062 - DNA, 25 bp, Rattus norvegicus
agttttcttgcttcactatccaata

SEQ ID NO: 168063 - DNA, 25 bp, Rattus norvegicus
agttttctttcaccacttcttgaga

SEQ ID NO: 168064 - DNA, 25 bp, Rattus norvegicus
agttttctttcagcacttcttgaga

SEQ ID NO: 168065 - DNA, 25 bp, Rattus norvegicus
agttttcttttgagcactgtcctca

SEQ ID NO: 168066 - DNA, 25 bp, Rattus norvegicus
agttttcttttgcaagatggctatt

SEQ ID NO: 168067 - DNA, 25 bp, Rattus norvegicus
agttttcttttggaagatggctatt

SEQ ID NO: 168068 - DNA, 25 bp, Rattus norvegicus
agttttcttttgtgcactgtcctca

SEQ ID NO: 168069 - DNA, 25 bp, Rattus norvegicus
agttttgaccaccttctttctatgt

SEQ ID NO: 168070 - DNA, 25 bp, Rattus norvegicus
agttttgaccacgttctttctatgt

SEQ ID NO: 168071 - DNA, 25 bp, Rattus norvegicus
agttttgagcacagctgccatgcag

SEQ ID NO: 168072 - DNA, 25 bp, Rattus norvegicus
agttttgagcactgctgccatgcag

SEQ ID NO: 168073 - DNA, 25 bp, Rattus norvegicus
agttttgaggcaatgctgctgttgc

SEQ ID NO: 168074 - DNA, 25 bp, Rattus norvegicus
agttttgaggcattgctgctgttgc

SEQ ID NO: 168075 - DNA, 25 bp, Rattus norvegicus
agttttgaggctaggcggactatcc

SEQ ID NO: 168076 - DNA, 25 bp, Rattus norvegicus
agttttgaggcttggcggactatcc

SEQ ID NO: 168077 - DNA, 25 bp, Rattus norvegicus
agttttgatactcgataccctgccc

SEQ ID NO: 168078 - DNA, 25 bp, Rattus norvegicus
agttttgatactggataccctgccc

SEQ ID NO: 168079 - DNA, 25 bp, Rattus norvegicus
agttttgatagcatccatgcctctc

SEQ ID NO: 168080 - DNA, 25 bp, Rattus norvegicus
agttttgatagcttccatgcctctc

SEQ ID NO: 168081 - DNA, 25 bp, Rattus norvegicus
agttttgatgtcaaggtcaccacgc

SEQ ID NO: 168082 - DNA, 25 bp, Rattus norvegicus
agttttgatgtctaggtcaccacgc

SEQ ID NO: 168083 - DNA, 25 bp, Rattus norvegicus
agttttgatgtgactgatgtcctgg

SEQ ID NO: 168084 - DNA, 25 bp, Rattus norvegicus
agttttgatgtgtctgatgtcctgg

SEQ ID NO: 168085 - DNA, 25 bp, Rattus norvegicus
agttttgcagccaagactgccttga

SEQ ID NO: 168086 - DNA, 25 bp, Rattus norvegicus
agttttgcagcccttcagtttaatg

SEQ ID NO: 168087 - DNA, 25 bp, Rattus norvegicus
agttttgcagccgttcagtttaatg

SEQ ID NO: 168088 - DNA, 25 bp, Rattus norvegicus
agttttgcagcctagactgccttga

SEQ ID NO: 168089 - DNA, 25 bp, Rattus norvegicus
agttttgcatatacttgtgctgcac

SEQ ID NO: 168090 - DNA, 25 bp, Rattus norvegicus
agttttgcatattcttgtgctgcac

SEQ ID NO: 168091 - DNA, 25 bp, Rattus norvegicus
agttttgcatctaatctgggctccg

SEQ ID NO: 168092 - DNA, 25 bp, Rattus norvegicus
agttttgcatctaccatatcttatg

SEQ ID NO: 168093 - DNA, 25 bp, Rattus norvegicus
agttttgcatcttatctgggctccg

SEQ ID NO: 168094 - DNA, 25 bp, Rattus norvegicus
agttttgcatcttccatatcttatg

SEQ ID NO: 168095 - DNA, 25 bp, Rattus norvegicus
agttttgcatttcacctttgtaagt

SEQ ID NO: 168096 - DNA, 25 bp, Rattus norvegicus
agttttgcatttgacctttgtaagt

SEQ ID NO: 168097 - DNA, 25 bp, Rattus norvegicus
agttttgcctcaacctgagcacatc

SEQ ID NO: 168098 - DNA, 25 bp, Rattus norvegicus
agttttgcctcatcctgagcacatc

SEQ ID NO: 168099 - DNA, 25 bp, Rattus norvegicus
agttttgcctgacaattacctccaa

SEQ ID NO: 168100 - DNA, 25 bp, Rattus norvegicus
agttttgcctgagaattacctccaa

SEQ ID NO: 168101 - DNA, 25 bp, Rattus norvegicus
agttttgcctttcctctagatacta

SEQ ID NO: 168102 - DNA, 25 bp, Rattus norvegicus
agttttgcctttgctctagatacta

SEQ ID NO: 168103 - DNA, 25 bp, Rattus norvegicus
agttttgcggcaagggctttcacca

SEQ ID NO: 168104 - DNA, 25 bp, Rattus norvegicus
agttttgcggcatgggctttcacca

SEQ ID NO: 168105 - DNA, 25 bp, Rattus norvegicus
agttttgctatgctgctgccttcac

SEQ ID NO: 168106 - DNA, 25 bp, Rattus norvegicus
agttttgctatggtgctgccttcac

SEQ ID NO: 168107 - DNA, 25 bp, Rattus norvegicus
agttttgctgtcaggtttgctgtcc

SEQ ID NO: 168108 - DNA, 25 bp, Rattus norvegicus
agttttgctgtctggtttgctgtcc

SEQ ID NO: 168109 - DNA, 25 bp, Rattus norvegicus
agttttggccagcaagtgacgccat

SEQ ID NO: 168110 - DNA, 25 bp, Rattus norvegicus
agttttggccaggaagtgacgccat

SEQ ID NO: 168111 - DNA, 25 bp, Rattus norvegicus
agttttggctacatgtcatctcagc

SEQ ID NO: 168112 - DNA, 25 bp, Rattus norvegicus
agttttggctacttgtcatctcagc

SEQ ID NO: 168113 - DNA, 25 bp, Rattus norvegicus
agttttgggtgcaactcctgggatc

SEQ ID NO: 168114 - DNA, 25 bp, Rattus norvegicus
agttttgggtgctactcctgggatc

SEQ ID NO: 168115 - DNA, 25 bp, Rattus norvegicus
agttttggtcatctgcttacttaaa

SEQ ID NO: 168116 - DNA, 25 bp, Rattus norvegicus
agttttggtcatgtgcttacttaaa

SEQ ID NO: 168117 - DNA, 25 bp, Rattus norvegicus
agttttgtacgtacctcagtagtca

SEQ ID NO: 168118 - DNA, 25 bp, Rattus norvegicus
agttttgtacgttcctcagtagtca

SEQ ID NO: 168119 - DNA, 25 bp, Rattus norvegicus
agttttgtatccatttgtctctctc

SEQ ID NO: 168120 - DNA, 25 bp, Rattus norvegicus
agttttgtatccttttgtctctctc

SEQ ID NO: 168121 - DNA, 25 bp, Rattus norvegicus
agttttgtcatgagggtcttcttta

SEQ ID NO: 168122 - DNA, 25 bp, Rattus norvegicus
agttttgtcatgtgggtcttcttta

SEQ ID NO: 168123 - DNA, 25 bp, Rattus norvegicus
agttttgtggtcaaaggctgtgaaa

SEQ ID NO: 168124 - DNA, 25 bp, Rattus norvegicus
agttttgtggtctaaggctgtgaaa

SEQ ID NO: 168125 - DNA, 25 bp, Rattus norvegicus
agttttgtgtggctcttatactcag

SEQ ID NO: 168126 - DNA, 25 bp, Rattus norvegicus
agttttgtgtgggtcttatactcag

SEQ ID NO: 168127 - DNA, 25 bp, Rattus norvegicus
agttttgttatcagtcaccatccca

SEQ ID NO: 168128 - DNA, 25 bp, Rattus norvegicus
agttttgttatctgtcaccatccca

SEQ ID NO: 168129 - DNA, 25 bp, Rattus norvegicus
agttttgttgccattaagttgcctg

SEQ ID NO: 168130 - DNA, 25 bp, Rattus norvegicus
agttttgttgcctttaagttgcctg

SEQ ID NO: 168131 - DNA, 25 bp, Rattus norvegicus
agtttttaagagaccctgctcctgc

SEQ ID NO: 168132 - DNA, 25 bp, Rattus norvegicus
agtttttaagagtccctgctcctgc

SEQ ID NO: 168133 - DNA, 25 bp, Rattus norvegicus
agtttttaagcactcctcgttcatg

SEQ ID NO: 168134 - DNA, 25 bp, Rattus norvegicus
agtttttaagcagtcctcgttcatg

SEQ ID NO: 168135 - DNA, 25 bp, Rattus norvegicus
agtttttactttctggctgaatcca

SEQ ID NO: 168136 - DNA, 25 bp, Rattus norvegicus
agtttttactttgtggctgaatcca

SEQ ID NO: 168137 - DNA, 25 bp, Rattus norvegicus
agtttttagttgactagtacctcag

SEQ ID NO: 168138 - DNA, 25 bp, Rattus norvegicus
agtttttagttgtctagtacctcag

SEQ ID NO: 168139 - DNA, 25 bp, Rattus norvegicus
agtttttatcccctttgctctgtag

SEQ ID NO: 168140 - DNA, 25 bp, Rattus norvegicus
agtttttatcccgtttgctctgtag

SEQ ID NO: 168141 - DNA, 25 bp, Rattus norvegicus
agtttttcaagtccctaaagcatca

SEQ ID NO: 168142 - DNA, 25 bp, Rattus norvegicus
agtttttcaagtgcctaaagcatca

SEQ ID NO: 168143 - DNA, 25 bp, Rattus norvegicus
agtttttcacaacaacgcccacctg

SEQ ID NO: 168144 - DNA, 25 bp, Rattus norvegicus
agtttttcacaagaacgcccacctg

SEQ ID NO: 168145 - DNA, 25 bp, Rattus norvegicus
agtttttcagttcttgtcaatttca

SEQ ID NO: 168146 - DNA, 25 bp, Rattus norvegicus
agtttttcagttgttgtcaatttca

SEQ ID NO: 168147 - DNA, 25 bp, Rattus norvegicus
agtttttcatccatacaatcctgtc

SEQ ID NO: 168148 - DNA, 25 bp, Rattus norvegicus
agtttttcatccttacaatcctgtc

SEQ ID NO: 168149 - DNA, 25 bp, Rattus norvegicus
agtttttcatcgatacctccatcat

SEQ ID NO: 168150 - DNA, 25 bp, Rattus norvegicus
agtttttcatcgttacctccatcat

SEQ ID NO: 168151 - DNA, 25 bp, Rattus norvegicus
agtttttccttgatccagtgtctct

SEQ ID NO: 168152 - DNA, 25 bp, Rattus norvegicus
agtttttccttgttccagtgtctct

SEQ ID NO: 168153 - DNA, 25 bp, Rattus norvegicus
agtttttctaacactgaaatcatgt

SEQ ID NO: 168154 - DNA, 25 bp, Rattus norvegicus
agtttttctaactctgaaatcatgt

SEQ ID NO: 168155 - DNA, 25 bp, Rattus norvegicus
agtttttctactcttcttgtcgtgc

SEQ ID NO: 168156 - DNA, 25 bp, Rattus norvegicus
agtttttctactgttcttgtcgtgc

SEQ ID NO: 168157 - DNA, 25 bp, Rattus norvegicus
agtttttctgaacggtgacctgagt

SEQ ID NO: 168158 - DNA, 25 bp, Rattus norvegicus
agtttttctgaagggtgacctgagt

SEQ ID NO: 168159 - DNA, 25 bp, Rattus norvegicus
agtttttctggtcatctgtcatctt

SEQ ID NO: 168160 - DNA, 25 bp, Rattus norvegicus
agtttttctggtgatctgtcatctt

SEQ ID NO: 168161 - DNA, 25 bp, Rattus norvegicus
agtttttgaggccacagcttctgca

SEQ ID NO: 168162 - DNA, 25 bp, Rattus norvegicus
agtttttgaggcgacagcttctgca

SEQ ID NO: 168163 - DNA, 25 bp, Rattus norvegicus
agtttttgatgcctttctctctgct

SEQ ID NO: 168164 - DNA, 25 bp, Rattus norvegicus
agtttttgatgcgtttctctctgct

SEQ ID NO: 168165 - DNA, 25 bp, Rattus norvegicus
agtttttgcctacatcttgggttgt

SEQ ID NO: 168166 - DNA, 25 bp, Rattus norvegicus
agtttttgcctagatcttgggttgt

SEQ ID NO: 168167 - DNA, 25 bp, Rattus norvegicus
agttttttcctgctagcttcaacag

SEQ ID NO: 168168 - DNA, 25 bp, Rattus norvegicus
agttttttcctggtagcttcaacag

SEQ ID NO: 168169 - DNA, 25 bp, Rattus norvegicus
agttttttgctaacattctgccttc

SEQ ID NO: 168170 - DNA, 25 bp, Rattus norvegicus
agttttttgctatcattctgccttc

SEQ ID NO: 168171 - DNA, 25 bp, Rattus norvegicus
agttttttgcttcacatttgtccgt

SEQ ID NO: 168172 - DNA, 25 bp, Rattus norvegicus
agttttttgcttgacatttgtccgt

SEQ ID NO: 168173 - DNA, 25 bp, Rattus norvegicus
ataaaaacacccatcaacttcacgt

SEQ ID NO: 168174 - DNA, 25 bp, Rattus norvegicus
ataaaaacacccttcaacttcacgt

SEQ ID NO: 168175 - DNA, 25 bp, Rattus norvegicus
ataaaaaccgacagcctggctagtt

SEQ ID NO: 168176 - DNA, 25 bp, Rattus norvegicus
ataaaaaccgactgcctggctagtt

SEQ ID NO: 168177 - DNA, 25 bp, Rattus norvegicus
ataaaaacgcccatctatccagagg

SEQ ID NO: 168178 - DNA, 25 bp, Rattus norvegicus
ataaaaacgcccttctatccagagg

SEQ ID NO: 168179 - DNA, 25 bp, Rattus norvegicus
ataaaaagtgcaaagctgccacctg

SEQ ID NO: 168180 - DNA, 25 bp, Rattus norvegicus
ataaaaagtgcatagctgccacctg

SEQ ID NO: 168181 - DNA, 25 bp, Rattus norvegicus
ataaaaatacccctgacttctgtgt

SEQ ID NO: 168182 - DNA, 25 bp, Rattus norvegicus
ataaaaatacccgtgacttctgtgt

SEQ ID NO: 168183 - DNA, 25 bp, Rattus norvegicus
ataaaaatacttctgctctgtctag

SEQ ID NO: 168184 - DNA, 25 bp, Rattus norvegicus
ataaaaatacttgtgctctgtctag

SEQ ID NO: 168185 - DNA, 25 bp, Rattus norvegicus
ataaaaatcaccaccgtctcattgt

SEQ ID NO: 168186 - DNA, 25 bp, Rattus norvegicus
ataaaaatcacctccgtctcattgt

SEQ ID NO: 168187 - DNA, 25 bp, Rattus norvegicus
ataaaaatggctccaactgcctcgc

SEQ ID NO: 168188 - DNA, 25 bp, Rattus norvegicus
ataaaaatggctgcaactgcctcgc

SEQ ID NO: 168189 - DNA, 25 bp, Rattus norvegicus
ataaaaattcacatacctccctcat

SEQ ID NO: 168190 - DNA, 25 bp, Rattus norvegicus
ataaaaattcacttacctccctcat

SEQ ID NO: 168191 - DNA, 25 bp, Rattus norvegicus
ataaaaccagcactgagtcgctcct

SEQ ID NO: 168192 - DNA, 25 bp, Rattus norvegicus
ataaaaccagcagtgagtcgctcct

SEQ ID NO: 168193 - DNA, 25 bp, Rattus norvegicus
ataaaaccaggtcccaggacaatgt

SEQ ID NO: 168194 - DNA, 25 bp, Rattus norvegicus
ataaaaccaggtgccaggacaatgt

SEQ ID NO: 168195 - DNA, 25 bp, Rattus norvegicus
ataaaaccatctctccactatatgt

SEQ ID NO: 168196 - DNA, 25 bp, Rattus norvegicus
ataaaaccatctgtccactatatgt

SEQ ID NO: 168197 - DNA, 25 bp, Rattus norvegicus
ataaaacccaatcacaactctgttg

SEQ ID NO: 168198 - DNA, 25 bp, Rattus norvegicus
ataaaacccaatgacaactctgttg

SEQ ID NO: 168199 - DNA, 25 bp, Rattus norvegicus
ataaaacccatcatgtgtgtgcaca

SEQ ID NO: 168200 - DNA, 25 bp, Rattus norvegicus
ataaaacccatcttgtgtgtgcaca

SEQ ID NO: 168201 - DNA, 25 bp, Rattus norvegicus
ataaaaccgcagacatctggagtga

SEQ ID NO: 168202 - DNA, 25 bp, Rattus norvegicus
ataaaaccgcagatctgtcctttgc

SEQ ID NO: 168203 - DNA, 25 bp, Rattus norvegicus
ataaaaccgcagtcatctggagtga

SEQ ID NO: 168204 - DNA, 25 bp, Rattus norvegicus
ataaaaccgcagttctgtcctttgc

SEQ ID NO: 168205 - DNA, 25 bp, Rattus norvegicus
ataaaacctttcagatttcacagtc

SEQ ID NO: 168206 - DNA, 25 bp, Rattus norvegicus
ataaaacctttctgatttcacagtc

SEQ ID NO: 168207 - DNA, 25 bp, Rattus norvegicus
ataaaactccccaggcttctcatgt

SEQ ID NO: 168208 - DNA, 25 bp, Rattus norvegicus
ataaaactcccctggcttctcatgt

SEQ ID NO: 168209 - DNA, 25 bp, Rattus norvegicus
ataaaactccctcggctcaacatct

SEQ ID NO: 168210 - DNA, 25 bp, Rattus norvegicus
ataaaactccctgggctcaacatct

SEQ ID NO: 168211 - DNA, 25 bp, Rattus norvegicus
ataaaactctccagggtagcggcgc

SEQ ID NO: 168212 - DNA, 25 bp, Rattus norvegicus
ataaaactctcctgggtagcggcgc

SEQ ID NO: 168213 - DNA, 25 bp, Rattus norvegicus
ataaaactgatccaaagccaagcca

SEQ ID NO: 168214 - DNA, 25 bp, Rattus norvegicus
ataaaactgatcgaaagccaagcca

SEQ ID NO: 168215 - DNA, 25 bp, Rattus norvegicus
ataaaacttcccctagcactgtggc

SEQ ID NO: 168216 - DNA, 25 bp, Rattus norvegicus
ataaaacttcccgtagcactgtggc

SEQ ID NO: 168217 - DNA, 25 bp, Rattus norvegicus
ataaaagaagtccacctctacccat

SEQ ID NO: 168218 - DNA, 25 bp, Rattus norvegicus
ataaaagaagtcgacctctacccat

SEQ ID NO: 168219 - DNA, 25 bp, Rattus norvegicus
ataaaagaatgacccgccacatccg

SEQ ID NO: 168220 - DNA, 25 bp, Rattus norvegicus
ataaaagaatgagccgccacatccg

SEQ ID NO: 168221 - DNA, 25 bp, Rattus norvegicus
ataaaagacgttagctgcctctcgt

SEQ ID NO: 168222 - DNA, 25 bp, Rattus norvegicus
ataaaagacgtttgctgcctctcgt

SEQ ID NO: 168223 - DNA, 25 bp, Rattus norvegicus
ataaaagactagatgctggatgaag

SEQ ID NO: 168224 - DNA, 25 bp, Rattus norvegicus
ataaaagactagttgctggatgaag

SEQ ID NO: 168225 - DNA, 25 bp, Rattus norvegicus
ataaaagagtgacggtccagtcctc

SEQ ID NO: 168226 - DNA, 25 bp, Rattus norvegicus
ataaaagagtgagggtccagtcctc

SEQ ID NO: 168227 - DNA, 25 bp, Rattus norvegicus
ataaaagccacgctaggacccaact

SEQ ID NO: 168228 - DNA, 25 bp, Rattus norvegicus
ataaaagccacggtaggacccaact

SEQ ID NO: 168229 - DNA, 25 bp, Rattus norvegicus
ataaaagccctgattcttgattttt

SEQ ID NO: 168230 - DNA, 25 bp, Rattus norvegicus
ataaaagccctgtttcttgattttt

SEQ ID NO: 168231 - DNA, 25 bp, Rattus norvegicus
ataaaagcctgcaggttccctgttt

SEQ ID NO: 168232 - DNA, 25 bp, Rattus norvegicus
ataaaagcctgctggttccctgttt

SEQ ID NO: 168233 - DNA, 25 bp, Rattus norvegicus
ataaaagctctgactttgccctgta

SEQ ID NO: 168234 - DNA, 25 bp, Rattus norvegicus
ataaaagctctgtctttgccctgta

SEQ ID NO: 168235 - DNA, 25 bp, Rattus norvegicus
ataaaaggaatgagaccctccttca

SEQ ID NO: 168236 - DNA, 25 bp, Rattus norvegicus
ataaaaggaatgtgaccctccttca

SEQ ID NO: 168237 - DNA, 25 bp, Rattus norvegicus
ataaaaggatcaagccccgtccaga

SEQ ID NO: 168238 - DNA, 25 bp, Rattus norvegicus
ataaaaggatcatgccccgtccaga

SEQ ID NO: 168239 - DNA, 25 bp, Rattus norvegicus
ataaaaggccacaagaagctgagaa

SEQ ID NO: 168240 - DNA, 25 bp, Rattus norvegicus
ataaaaggccactagaagctgagaa

SEQ ID NO: 168241 - DNA, 25 bp, Rattus norvegicus
ataaaaggcctaactcggagtctca

SEQ ID NO: 168242 - DNA, 25 bp, Rattus norvegicus
ataaaaggcctatctcggagtctca

SEQ ID NO: 168243 - DNA, 25 bp, Rattus norvegicus
ataaaaggcgtgaccgacgtctgca

SEQ ID NO: 168244 - DNA, 25 bp, Rattus norvegicus
ataaaaggcgtgtccgacgtctgca

SEQ ID NO: 168245 - DNA, 25 bp, Rattus norvegicus
ataaaaggtactacctctccacgtg

SEQ ID NO: 168246 - DNA, 25 bp, Rattus norvegicus
ataaaaggtacttcctctccacgtg

SEQ ID NO: 168247 - DNA, 25 bp, Rattus norvegicus
ataaaaggttgacccctgcatgctc

SEQ ID NO: 168248 - DNA, 25 bp, Rattus norvegicus
ataaaaggttgagccctgcatgctc

SEQ ID NO: 168249 - DNA, 25 bp, Rattus norvegicus
ataaaagtacttcgatcttctgccc

SEQ ID NO: 168250 - DNA, 25 bp, Rattus norvegicus
ataaaagtacttggatcttctgccc

SEQ ID NO: 168251 - DNA, 25 bp, Rattus norvegicus
ataaaagtctatcttggcagtgatg

SEQ ID NO: 168252 - DNA, 25 bp, Rattus norvegicus
ataaaagtctatgttggcagtgatg

SEQ ID NO: 168253 - DNA, 25 bp, Rattus norvegicus
ataaaagtgttgaccgagcccagtg

SEQ ID NO: 168254 - DNA, 25 bp, Rattus norvegicus
ataaaagtgttgtccgagcccagtg

SEQ ID NO: 168255 - DNA, 25 bp, Rattus norvegicus
ataaaagtttcaatgggtcatcacc

SEQ ID NO: 168256 - DNA, 25 bp, Rattus norvegicus
ataaaagtttcattgggtcatcacc

SEQ ID NO: 168257 - DNA, 25 bp, Rattus norvegicus
ataaaatacactcttcagcctacct

SEQ ID NO: 168258 - DNA, 25 bp, Rattus norvegicus
ataaaatacactgttcagcctacct

SEQ ID NO: 168259 - DNA, 25 bp, Rattus norvegicus
ataaaatcacctcagatctgcccca

SEQ ID NO: 168260 - DNA, 25 bp, Rattus norvegicus
ataaaatcacctgagatctgcccca

SEQ ID NO: 168261 - DNA, 25 bp, Rattus norvegicus
ataaaatcccagaccacattctctt

SEQ ID NO: 168262 - DNA, 25 bp, Rattus norvegicus
ataaaatcccagtccacattctctt

SEQ ID NO: 168263 - DNA, 25 bp, Rattus norvegicus
ataaaatccctgcagttccttgttt

SEQ ID NO: 168264 - DNA, 25 bp, Rattus norvegicus
ataaaatccctggagttccttgttt

SEQ ID NO: 168265 - DNA, 25 bp, Rattus norvegicus
ataaaatcctggctgaggccgcctc

SEQ ID NO: 168266 - DNA, 25 bp, Rattus norvegicus
ataaaatcctgggtgaggccgcctc

SEQ ID NO: 168267 - DNA, 25 bp, Rattus norvegicus
ataaaatctacacacatgcctccaa

SEQ ID NO: 168268 - DNA, 25 bp, Rattus norvegicus
ataaaatctacagacatgcctccaa

SEQ ID NO: 168269 - DNA, 25 bp, Rattus norvegicus
ataaaatctagacccattcacctgg

SEQ ID NO: 168270 - DNA, 25 bp, Rattus norvegicus
ataaaatctagagccattcacctgg

SEQ ID NO: 168271 - DNA, 25 bp, Rattus norvegicus
ataaaatctcccatggtttatgagc

SEQ ID NO: 168272 - DNA, 25 bp, Rattus norvegicus
ataaaatctcccttggtttatgagc

SEQ ID NO: 168273 - DNA, 25 bp, Rattus norvegicus
ataaaatcttcccagccgtgatgtc

SEQ ID NO: 168274 - DNA, 25 bp, Rattus norvegicus
ataaaatcttccgagccgtgatgtc

SEQ ID NO: 168275 - DNA, 25 bp, Rattus norvegicus
ataaaatgacttcaccctgaggcag

SEQ ID NO: 168276 - DNA, 25 bp, Rattus norvegicus
ataaaatgacttgaccctgaggcag

SEQ ID NO: 168277 - DNA, 25 bp, Rattus norvegicus
ataaaatgagcaccactatcccacc

SEQ ID NO: 168278 - DNA, 25 bp, Rattus norvegicus
ataaaatgagcagcactatcccacc

SEQ ID NO: 168279 - DNA, 25 bp, Rattus norvegicus
ataaaatgccaactgtttcgtgctg

SEQ ID NO: 168280 - DNA, 25 bp, Rattus norvegicus
ataaaatgccaagtgtttcgtgctg

SEQ ID NO: 168281 - DNA, 25 bp, Rattus norvegicus
ataaaatggtccagccttttgccaa

SEQ ID NO: 168282 - DNA, 25 bp, Rattus norvegicus
ataaaatggtcctgccttttgccaa

SEQ ID NO: 168283 - DNA, 25 bp, Rattus norvegicus
ataaaatgtcctcttcacttgaaag

SEQ ID NO: 168284 - DNA, 25 bp, Rattus norvegicus
ataaaatgtcctgttcacttgaaag

SEQ ID NO: 168285 - DNA, 25 bp, Rattus norvegicus
ataaaattgaccatagttcgtggag

SEQ ID NO: 168286 - DNA, 25 bp, Rattus norvegicus
ataaaattgaccttagttcgtggag

SEQ ID NO: 168287 - DNA, 25 bp, Rattus norvegicus
ataaacaaccccactgcagtagcag

SEQ ID NO: 168288 - DNA, 25 bp, Rattus norvegicus
ataaacaacccctctgcagtagcag

SEQ ID NO: 168289 - DNA, 25 bp, Rattus norvegicus
ataaacaactgtacggtggcattga

SEQ ID NO: 168290 - DNA, 25 bp, Rattus norvegicus
ataaacaactgttcggtggcattga

SEQ ID NO: 168291 - DNA, 25 bp, Rattus norvegicus
ataaacaagagacagcctggtctgg

SEQ ID NO: 168292 - DNA, 25 bp, Rattus norvegicus
ataaacaagagagagcctggtctgg

SEQ ID NO: 168293 - DNA, 25 bp, Rattus norvegicus
ataaacacaaccagcgggtcttggg

SEQ ID NO: 168294 - DNA, 25 bp, Rattus norvegicus
ataaacacaacctgcgggtcttggg

SEQ ID NO: 168295 - DNA, 25 bp, Rattus norvegicus
ataaacacaactcgcttaggctggc

SEQ ID NO: 168296 - DNA, 25 bp, Rattus norvegicus
ataaacacaactggcttaggctggc

SEQ ID NO: 168297 - DNA, 25 bp, Rattus norvegicus
ataaacacatctcgcctgttggtcc

SEQ ID NO: 168298 - DNA, 25 bp, Rattus norvegicus
ataaacacatctggcctgttggtcc

SEQ ID NO: 168299 - DNA, 25 bp, Rattus norvegicus
ataaacacattcctacattcccagc

SEQ ID NO: 168300 - DNA, 25 bp, Rattus norvegicus
ataaacacattcgtacattcccagc

SEQ ID NO: 168301 - DNA, 25 bp, Rattus norvegicus
ataaacaccacacagcaatctttcc

SEQ ID NO: 168302 - DNA, 25 bp, Rattus norvegicus
ataaacaccacagagcaatctttcc

SEQ ID NO: 168303 - DNA, 25 bp, Rattus norvegicus
ataaacactaacatctgcactacag

SEQ ID NO: 168304 - DNA, 25 bp, Rattus norvegicus
ataaacactaacttctgcactacag

SEQ ID NO: 168305 - DNA, 25 bp, Rattus norvegicus
ataaacactgtaacgccccaggtgg

SEQ ID NO: 168306 - DNA, 25 bp, Rattus norvegicus
ataaacactgtatcgccccaggtgg

SEQ ID NO: 168307 - DNA, 25 bp, Rattus norvegicus
ataaacaggactatcttccctcatg

SEQ ID NO: 168308 - DNA, 25 bp, Rattus norvegicus
ataaacaggactttcttccctcatg

SEQ ID NO: 168309 - DNA, 25 bp, Rattus norvegicus
ataaacagtaggagtccctccagcc

SEQ ID NO: 168310 - DNA, 25 bp, Rattus norvegicus
ataaacagtaggtgtccctccagcc

SEQ ID NO: 168311 - DNA, 25 bp, Rattus norvegicus
ataaacagtcggacgtttgcggtca

SEQ ID NO: 168312 - DNA, 25 bp, Rattus norvegicus
ataaacagtcggtcgtttgcggtca

SEQ ID NO: 168313 - DNA, 25 bp, Rattus norvegicus
ataaacagtggtcattcacctccca

SEQ ID NO: 168314 - DNA, 25 bp, Rattus norvegicus
ataaacagtggtgattcacctccca

SEQ ID NO: 168315 - DNA, 25 bp, Rattus norvegicus
ataaacagttctcactcaggtcctc

SEQ ID NO: 168316 - DNA, 25 bp, Rattus norvegicus
ataaacagttctgactcaggtcctc

SEQ ID NO: 168317 - DNA, 25 bp, Rattus norvegicus
ataaacatcctcaacagctactatg

SEQ ID NO: 168318 - DNA, 25 bp, Rattus norvegicus
ataaacatcctctacagctactatg

SEQ ID NO: 168319 - DNA, 25 bp, Rattus norvegicus
ataaacatctccatctctggtgtct

SEQ ID NO: 168320 - DNA, 25 bp, Rattus norvegicus
ataaacatctccttctctggtgtct

SEQ ID NO: 168321 - DNA, 25 bp, Rattus norvegicus
ataaacattgcaccactccgcaggg

SEQ ID NO: 168322 - DNA, 25 bp, Rattus norvegicus
ataaacattgcagcactccgcaggg

SEQ ID NO: 168323 - DNA, 25 bp, Rattus norvegicus
ataaaccaaggtcctcactttgagg

SEQ ID NO: 168324 - DNA, 25 bp, Rattus norvegicus
ataaaccaaggtgctcactttgagg

SEQ ID NO: 168325 - DNA, 25 bp, Rattus norvegicus
ataaaccacagcacacctaggaggc

SEQ ID NO: 168326 - DNA, 25 bp, Rattus norvegicus
ataaaccacagctcacctaggaggc

SEQ ID NO: 168327 - DNA, 25 bp, Rattus norvegicus
ataaaccacttcaagctgcttccat

SEQ ID NO: 168328 - DNA, 25 bp, Rattus norvegicus
ataaaccacttctagctgcttccat

SEQ ID NO: 168329 - DNA, 25 bp, Rattus norvegicus
ataaaccagtttacccacacagaag

SEQ ID NO: 168330 - DNA, 25 bp, Rattus norvegicus
ataaaccagttttcccacacagaag

SEQ ID NO: 168331 - DNA, 25 bp, Rattus norvegicus
ataaaccatcctctttcatccattc

SEQ ID NO: 168332 - DNA, 25 bp, Rattus norvegicus
ataaaccatcctgtttcatccattc

SEQ ID NO: 168333 - DNA, 25 bp, Rattus norvegicus
ataaaccatctgagtttgtggagat

SEQ ID NO: 168334 - DNA, 25 bp, Rattus norvegicus
ataaaccatctgtgtttgtggagat

SEQ ID NO: 168335 - DNA, 25 bp, Rattus norvegicus
ataaaccatggtcaattcgaggtgt

SEQ ID NO: 168336 - DNA, 25 bp, Rattus norvegicus
ataaaccatggtgaattcgaggtgt

SEQ ID NO: 168337 - DNA, 25 bp, Rattus norvegicus
ataaaccatttcagctcttgtcatc

SEQ ID NO: 168338 - DNA, 25 bp, Rattus norvegicus
ataaaccatttctgctcttgtcatc

SEQ ID NO: 168339 - DNA, 25 bp, Rattus norvegicus
ataaacccagagctcgtcttacaaa

SEQ ID NO: 168340 - DNA, 25 bp, Rattus norvegicus
ataaacccagaggtcgtcttacaaa

SEQ ID NO: 168341 - DNA, 25 bp, Rattus norvegicus
ataaacccaggcctgttggcacaag

SEQ ID NO: 168342 - DNA, 25 bp, Rattus norvegicus
ataaacccaggcgtgttggcacaag

SEQ ID NO: 168343 - DNA, 25 bp, Rattus norvegicus
ataaaccctgaaagaccgggctctc

SEQ ID NO: 168344 - DNA, 25 bp, Rattus norvegicus
ataaaccctgaatgaccgggctctc

SEQ ID NO: 168345 - DNA, 25 bp, Rattus norvegicus
ataaaccgcatccaggacctgctga

SEQ ID NO: 168346 - DNA, 25 bp, Rattus norvegicus
ataaaccgcatcgaggacctgctga

SEQ ID NO: 168347 - DNA, 25 bp, Rattus norvegicus
ataaaccgcgacacacttagtacca

SEQ ID NO: 168348 - DNA, 25 bp, Rattus norvegicus
ataaaccgcgactcacttagtacca

SEQ ID NO: 168349 - DNA, 25 bp, Rattus norvegicus
ataaaccggagcctacgtgtggccg

SEQ ID NO: 168350 - DNA, 25 bp, Rattus norvegicus
ataaaccggagcgtacgtgtggccg

SEQ ID NO: 168351 - DNA, 25 bp, Rattus norvegicus
ataaaccgggccctgccgcagatgc

SEQ ID NO: 168352 - DNA, 25 bp, Rattus norvegicus
ataaaccgggccgtgccgcagatgc

SEQ ID NO: 168353 - DNA, 25 bp, Rattus norvegicus
ataaaccgggggcatccactatggg

SEQ ID NO: 168354 - DNA, 25 bp, Rattus norvegicus
ataaaccggggggatccactatggg

SEQ ID NO: 168355 - DNA, 25 bp, Rattus norvegicus
ataaacctatttacagtgtggaaca

SEQ ID NO: 168356 - DNA, 25 bp, Rattus norvegicus
ataaacctattttcagtgtggaaca

SEQ ID NO: 168357 - DNA, 25 bp, Rattus norvegicus
ataaacctctaaaatgcctggcaga

SEQ ID NO: 168358 - DNA, 25 bp, Rattus norvegicus
ataaacctctaatatgcctggcaga

SEQ ID NO: 168359 - DNA, 25 bp, Rattus norvegicus
ataaacctgcctattttgctgaaag

SEQ ID NO: 168360 - DNA, 25 bp, Rattus norvegicus
ataaacctgccttttttgctgaaag

SEQ ID NO: 168361 - DNA, 25 bp, Rattus norvegicus
ataaacctggtcacacacctattag

SEQ ID NO: 168362 - DNA, 25 bp, Rattus norvegicus
ataaacctggtctcacacctattag

SEQ ID NO: 168363 - DNA, 25 bp, Rattus norvegicus
ataaaccttgtaagtgtacagccaa

SEQ ID NO: 168364 - DNA, 25 bp, Rattus norvegicus
ataaaccttgtatgtgtacagccaa

SEQ ID NO: 168365 - DNA, 25 bp, Rattus norvegicus
ataaacgccatcaggcagggccctc

SEQ ID NO: 168366 - DNA, 25 bp, Rattus norvegicus
ataaacgccatctggcagggccctc

SEQ ID NO: 168367 - DNA, 25 bp, Rattus norvegicus
ataaacggatggctcctgctgtgtc

SEQ ID NO: 168368 - DNA, 25 bp, Rattus norvegicus
ataaacggatgggtcctgctgtgtc

SEQ ID NO: 168369 - DNA, 25 bp, Rattus norvegicus
ataaacgtccctattttgcagtggt

SEQ ID NO: 168370 - DNA, 25 bp, Rattus norvegicus
ataaacgtcccttttttgcagtggt

SEQ ID NO: 168371 - DNA, 25 bp, Rattus norvegicus
ataaacgtgttcatcagtgcagtcg

SEQ ID NO: 168372 - DNA, 25 bp, Rattus norvegicus
ataaacgtgttcttcagtgcagtcg

SEQ ID NO: 168373 - DNA, 25 bp, Rattus norvegicus
ataaactaagaaacacccatctggt

SEQ ID NO: 168374 - DNA, 25 bp, Rattus norvegicus
ataaactaagaatcacccatctggt

SEQ ID NO: 168375 - DNA, 25 bp, Rattus norvegicus
ataaactacaggagcgcagaggact

SEQ ID NO: 168376 - DNA, 25 bp, Rattus norvegicus
ataaactacaggtgcgcagaggact

SEQ ID NO: 168377 - DNA, 25 bp, Rattus norvegicus
ataaactaccacagtaagccaccac

SEQ ID NO: 168378 - DNA, 25 bp, Rattus norvegicus
ataaactaccactgtaagccaccac

SEQ ID NO: 168379 - DNA, 25 bp, Rattus norvegicus
ataaactagcatcgccttagggcag

SEQ ID NO: 168380 - DNA, 25 bp, Rattus norvegicus
ataaactagcatggccttagggcag

SEQ ID NO: 168381 - DNA, 25 bp, Rattus norvegicus
ataaactagcgtcagcctacttggg

SEQ ID NO: 168382 - DNA, 25 bp, Rattus norvegicus
ataaactagcgtgagcctacttggg

SEQ ID NO: 168383 - DNA, 25 bp, Rattus norvegicus
ataaactagctaccggttgctgaac

SEQ ID NO: 168384 - DNA, 25 bp, Rattus norvegicus
ataaactagctagcggttgctgaac

SEQ ID NO: 168385 - DNA, 25 bp, Rattus norvegicus
ataaactagttcagagagcctcgat

SEQ ID NO: 168386 - DNA, 25 bp, Rattus norvegicus
ataaactagttctgagagcctcgat

SEQ ID NO: 168387 - DNA, 25 bp, Rattus norvegicus
ataaactatttactcgactggtcgg

SEQ ID NO: 168388 - DNA, 25 bp, Rattus norvegicus
ataaactatttagtcgactggtcgg

SEQ ID NO: 168389 - DNA, 25 bp, Rattus norvegicus
ataaactcaagcaggctcttctgtc

SEQ ID NO: 168390 - DNA, 25 bp, Rattus norvegicus
ataaactcaagctggctcttctgtc

SEQ ID NO: 168391 - DNA, 25 bp, Rattus norvegicus
ataaactcccatagtgtgaccctta

SEQ ID NO: 168392 - DNA, 25 bp, Rattus norvegicus
ataaactcccattgtgtgaccctta

SEQ ID NO: 168393 - DNA, 25 bp, Rattus norvegicus
ataaactccgcgctggtatctgttc

SEQ ID NO: 168394 - DNA, 25 bp, Rattus norvegicus
ataaactccgcggtggtatctgttc

SEQ ID NO: 168395 - DNA, 25 bp, Rattus norvegicus
ataaactcctgcaactcatggagcc

SEQ ID NO: 168396 - DNA, 25 bp, Rattus norvegicus
ataaactcctgctactcatggagcc

SEQ ID NO: 168397 - DNA, 25 bp, Rattus norvegicus
ataaactctaaaagccttacctggc

SEQ ID NO: 168398 - DNA, 25 bp, Rattus norvegicus
ataaactctaaatgccttacctggc

SEQ ID NO: 168399 - DNA, 25 bp, Rattus norvegicus
ataaactctgtgcttctgtggttcg

SEQ ID NO: 168400 - DNA, 25 bp, Rattus norvegicus
ataaactctgtggttctgtggttcg

SEQ ID NO: 168401 - DNA, 25 bp, Rattus norvegicus
ataaactgagttcccaaattaccag

SEQ ID NO: 168402 - DNA, 25 bp, Rattus norvegicus
ataaactgagttgccaaattaccag

SEQ ID NO: 168403 - DNA, 25 bp, Rattus norvegicus
ataaactgatttccatcgggcgctg

SEQ ID NO: 168404 - DNA, 25 bp, Rattus norvegicus
ataaactgatttgcatcgggcgctg

SEQ ID NO: 168405 - DNA, 25 bp, Rattus norvegicus
ataaactggctgacagctcccaggg

SEQ ID NO: 168406 - DNA, 25 bp, Rattus norvegicus
ataaactggctgtcagctcccaggg

SEQ ID NO: 168407 - DNA, 25 bp, Rattus norvegicus
ataaactgggtcacacaaatttcct

SEQ ID NO: 168408 - DNA, 25 bp, Rattus norvegicus
ataaactgggtctcacaaatttcct

SEQ ID NO: 168409 - DNA, 25 bp, Rattus norvegicus
ataaactggtaacctcaacgccaca

SEQ ID NO: 168410 - DNA, 25 bp, Rattus norvegicus
ataaactggtaagctcaacgccaca

SEQ ID NO: 168411 - DNA, 25 bp, Rattus norvegicus
ataaactgtacaaaggtgcgcatct

SEQ ID NO: 168412 - DNA, 25 bp, Rattus norvegicus
ataaactgtacataggtgcgcatct

SEQ ID NO: 168413 - DNA, 25 bp, Rattus norvegicus
ataaactgtagtccctcagcgtagg

SEQ ID NO: 168414 - DNA, 25 bp, Rattus norvegicus
ataaactgtagtgcctcagcgtagg

SEQ ID NO: 168415 - DNA, 25 bp, Rattus norvegicus
ataaactgtcccctgcattcgatgt

SEQ ID NO: 168416 - DNA, 25 bp, Rattus norvegicus
ataaactgtcccgtgcattcgatgt

SEQ ID NO: 168417 - DNA, 25 bp, Rattus norvegicus
ataaactgtcttcccaccgtgggag

SEQ ID NO: 168418 - DNA, 25 bp, Rattus norvegicus
ataaactgtcttgccaccgtgggag

SEQ ID NO: 168419 - DNA, 25 bp, Rattus norvegicus
ataaactgttctagtgcccgggcac

SEQ ID NO: 168420 - DNA, 25 bp, Rattus norvegicus
ataaactgttcttgtgcccgggcac

SEQ ID NO: 168421 - DNA, 25 bp, Rattus norvegicus
ataaacttatcactcaactgctgag

SEQ ID NO: 168422 - DNA, 25 bp, Rattus norvegicus
ataaacttatcagtcaactgctgag

SEQ ID NO: 168423 - DNA, 25 bp, Rattus norvegicus
ataaacttctcccagaatacccagg

SEQ ID NO: 168424 - DNA, 25 bp, Rattus norvegicus
ataaacttctccgagaatacccagg

SEQ ID NO: 168425 - DNA, 25 bp, Rattus norvegicus
ataaacttgctccttttggtctgtt

SEQ ID NO: 168426 - DNA, 25 bp, Rattus norvegicus
ataaacttgctcgttttggtctgtt

SEQ ID NO: 168427 - DNA, 25 bp, Rattus norvegicus
ataaacttggcacctcttgatccat

SEQ ID NO: 168428 - DNA, 25 bp, Rattus norvegicus
ataaacttggcagctcttgatccat

SEQ ID NO: 168429 - DNA, 25 bp, Rattus norvegicus
ataaacttgtttatctggactggca

SEQ ID NO: 168430 - DNA, 25 bp, Rattus norvegicus
ataaacttgtttttctggactggca

SEQ ID NO: 168431 - DNA, 25 bp, Rattus norvegicus
ataaagaactctcactgaacttcac

SEQ ID NO: 168432 - DNA, 25 bp, Rattus norvegicus
ataaagaactctgactgaacttcac

SEQ ID NO: 168433 - DNA, 25 bp, Rattus norvegicus
ataaagaatcggctccagggaggct

SEQ ID NO: 168434 - DNA, 25 bp, Rattus norvegicus
ataaagaatcgggtccagggaggct

SEQ ID NO: 168435 - DNA, 25 bp, Rattus norvegicus
ataaagacagcaaccgcagtggcgg

SEQ ID NO: 168436 - DNA, 25 bp, Rattus norvegicus
ataaagacagcatccgcagtggcgg

SEQ ID NO: 168437 - DNA, 25 bp, Rattus norvegicus
ataaagacgctgaagttattttcaa

SEQ ID NO: 168438 - DNA, 25 bp, Rattus norvegicus
ataaagacgctgtagttattttcaa

SEQ ID NO: 168439 - DNA, 25 bp, Rattus norvegicus
ataaagacggcgagatcgtccccat

SEQ ID NO: 168440 - DNA, 25 bp, Rattus norvegicus
ataaagacggcgtgatcgtccccat

SEQ ID NO: 168441 - DNA, 25 bp, Rattus norvegicus
ataaagactcacaccgaagctaccg

SEQ ID NO: 168442 - DNA, 25 bp, Rattus norvegicus
ataaagactcactccgaagctaccg

SEQ ID NO: 168443 - DNA, 25 bp, Rattus norvegicus
ataaagactcgaaaccccatgttgg

SEQ ID NO: 168444 - DNA, 25 bp, Rattus norvegicus
ataaagactcgataccccatgttgg

SEQ ID NO: 168445 - DNA, 25 bp, Rattus norvegicus
ataaagacttgaccaccaccagtgg

SEQ ID NO: 168446 - DNA, 25 bp, Rattus norvegicus
ataaagacttgagcaccaccagtgg

SEQ ID NO: 168447 - DNA, 25 bp, Rattus norvegicus
ataaagacttgtagatgcccctcca

SEQ ID NO: 168448 - DNA, 25 bp, Rattus norvegicus
ataaagacttgttgatgcccctcca

SEQ ID NO: 168449 - DNA, 25 bp, Rattus norvegicus
ataaagagcccaagttctttgcaag

SEQ ID NO: 168450 - DNA, 25 bp, Rattus norvegicus
ataaagagcccatgttctttgcaag

SEQ ID NO: 168451 - DNA, 25 bp, Rattus norvegicus
ataaagagtgcaatccaatgggttt

SEQ ID NO: 168452 - DNA, 25 bp, Rattus norvegicus
ataaagagtgcattccaatgggttt

SEQ ID NO: 168453 - DNA, 25 bp, Rattus norvegicus
ataaagatcatcagctcggcctttc

SEQ ID NO: 168454 - DNA, 25 bp, Rattus norvegicus
ataaagatcatctgctcggcctttc

SEQ ID NO: 168455 - DNA, 25 bp, Rattus norvegicus
ataaagatgaccactgtctctcacc

SEQ ID NO: 168456 - DNA, 25 bp, Rattus norvegicus
ataaagatgacctctgtctctcacc

SEQ ID NO: 168457 - DNA, 25 bp, Rattus norvegicus
ataaagatgccccatcctttgggtt

SEQ ID NO: 168458 - DNA, 25 bp, Rattus norvegicus
ataaagatgcccgatcctttgggtt

SEQ ID NO: 168459 - DNA, 25 bp, Rattus norvegicus
ataaagatgccgacagccaatagct

SEQ ID NO: 168460 - DNA, 25 bp, Rattus norvegicus
ataaagatgccgtcagccaatagct

SEQ ID NO: 168461 - DNA, 25 bp, Rattus norvegicus
ataaagattctcacacccatctatc

SEQ ID NO: 168462 - DNA, 25 bp, Rattus norvegicus
ataaagattctcaccatcactcagt

SEQ ID NO: 168463 - DNA, 25 bp, Rattus norvegicus
ataaagattctctcacccatctatc

SEQ ID NO: 168464 - DNA, 25 bp, Rattus norvegicus
ataaagattctctccatcactcagt

SEQ ID NO: 168465 - DNA, 25 bp, Rattus norvegicus
ataaagattcttaggcattcagtga

SEQ ID NO: 168466 - DNA, 25 bp, Rattus norvegicus
ataaagattctttggcattcagtga

SEQ ID NO: 168467 - DNA, 25 bp, Rattus norvegicus
ataaagattgccctgtaaccgccat

SEQ ID NO: 168468 - DNA, 25 bp, Rattus norvegicus
ataaagattgccgtgtaaccgccat

SEQ ID NO: 168469 - DNA, 25 bp, Rattus norvegicus
ataaagcaagtcatcccctgaacag

SEQ ID NO: 168470 - DNA, 25 bp, Rattus norvegicus
ataaagcaagtcttcccctgaacag

SEQ ID NO: 168471 - DNA, 25 bp, Rattus norvegicus
ataaagcacccgctggaatgcgccc

SEQ ID NO: 168472 - DNA, 25 bp, Rattus norvegicus
ataaagcacccggtggaatgcgccc

SEQ ID NO: 168473 - DNA, 25 bp, Rattus norvegicus
ataaagcagagtccttctctggccc

SEQ ID NO: 168474 - DNA, 25 bp, Rattus norvegicus
ataaagcagagtgcttctctggccc

SEQ ID NO: 168475 - DNA, 25 bp, Rattus norvegicus
ataaagcagtgcacacttggccacc

SEQ ID NO: 168476 - DNA, 25 bp, Rattus norvegicus
ataaagcagtgctcacttggccacc

SEQ ID NO: 168477 - DNA, 25 bp, Rattus norvegicus
ataaagcatgctatctcctgtcttg

SEQ ID NO: 168478 - DNA, 25 bp, Rattus norvegicus
ataaagcatgctttctcctgtcttg

SEQ ID NO: 168479 - DNA, 25 bp, Rattus norvegicus
ataaagcattgtatctactaggtag

SEQ ID NO: 168480 - DNA, 25 bp, Rattus norvegicus
ataaagcattgtttctactaggtag

SEQ ID NO: 168481 - DNA, 25 bp, Rattus norvegicus
ataaagccacacagggccactggga

SEQ ID NO: 168482 - DNA, 25 bp, Rattus norvegicus
ataaagccacactgggccactggga

SEQ ID NO: 168483 - DNA, 25 bp, Rattus norvegicus
ataaagccacagacatttctacaaa

SEQ ID NO: 168484 - DNA, 25 bp, Rattus norvegicus
ataaagccacagtcatttctacaaa

SEQ ID NO: 168485 - DNA, 25 bp, Rattus norvegicus
ataaagcccagcagggttgtcgcca

SEQ ID NO: 168486 - DNA, 25 bp, Rattus norvegicus
ataaagcccagctgggttgtcgcca

SEQ ID NO: 168487 - DNA, 25 bp, Rattus norvegicus
ataaagccccagatattccagaaaa

SEQ ID NO: 168488 - DNA, 25 bp, Rattus norvegicus
ataaagccccagttattccagaaaa

SEQ ID NO: 168489 - DNA, 25 bp, Rattus norvegicus
ataaagcccttgatatacccacagc

SEQ ID NO: 168490 - DNA, 25 bp, Rattus norvegicus
ataaagcccttgttatacccacagc

SEQ ID NO: 168491 - DNA, 25 bp, Rattus norvegicus
ataaagcctcctatgaaaccaaacg

SEQ ID NO: 168492 - DNA, 25 bp, Rattus norvegicus
ataaagcctcctttgaaaccaaacg

SEQ ID NO: 168493 - DNA, 25 bp, Rattus norvegicus
ataaagcctgaccttttgcccttgg

SEQ ID NO: 168494 - DNA, 25 bp, Rattus norvegicus
ataaagcctgacgttttgcccttgg

SEQ ID NO: 168495 - DNA, 25 bp, Rattus norvegicus
ataaagcctgtaagcatcccgtgac

SEQ ID NO: 168496 - DNA, 25 bp, Rattus norvegicus
ataaagcctgtatgcatcccgtgac

SEQ ID NO: 168497 - DNA, 25 bp, Rattus norvegicus
ataaagcctgttcttcacttgctct

SEQ ID NO: 168498 - DNA, 25 bp, Rattus norvegicus
ataaagcctgttgttcacttgctct

SEQ ID NO: 168499 - DNA, 25 bp, Rattus norvegicus
ataaagccttgtcctacttccgagc

SEQ ID NO: 168500 - DNA, 25 bp, Rattus norvegicus
ataaagccttgtgctacttccgagc

SEQ ID NO: 168501 - DNA, 25 bp, Rattus norvegicus
ataaagcgatctactaacccttcag

SEQ ID NO: 168502 - DNA, 25 bp, Rattus norvegicus
ataaagcgatcttctaacccttcag

SEQ ID NO: 168503 - DNA, 25 bp, Rattus norvegicus
ataaagctatccaagggctccaggc

SEQ ID NO: 168504 - DNA, 25 bp, Rattus norvegicus
ataaagctatcctagggctccaggc

SEQ ID NO: 168505 - DNA, 25 bp, Rattus norvegicus
ataaagctctctctacctgttcatc

SEQ ID NO: 168506 - DNA, 25 bp, Rattus norvegicus
ataaagctctctgtacctgttcatc

SEQ ID NO: 168507 - DNA, 25 bp, Rattus norvegicus
ataaagctgcacctggaccagagcg

SEQ ID NO: 168508 - DNA, 25 bp, Rattus norvegicus
ataaagctgcacgtggaccagagcg

SEQ ID NO: 168509 - DNA, 25 bp, Rattus norvegicus
ataaagctgggaaaacaagagaagt

SEQ ID NO: 168510 - DNA, 25 bp, Rattus norvegicus
ataaagctgggataacaagagaagt

SEQ ID NO: 168511 - DNA, 25 bp, Rattus norvegicus
ataaagctgtccaccagctggttgc

SEQ ID NO: 168512 - DNA, 25 bp, Rattus norvegicus
ataaagctgtcctccagctggttgc

SEQ ID NO: 168513 - DNA, 25 bp, Rattus norvegicus
ataaagcttccgacgccggtggaga

SEQ ID NO: 168514 - DNA, 25 bp, Rattus norvegicus
ataaagcttccgtcgccggtggaga

SEQ ID NO: 168515 - DNA, 25 bp, Rattus norvegicus
ataaagctttgtcctctatcttgta

SEQ ID NO: 168516 - DNA, 25 bp, Rattus norvegicus
ataaagctttgtgctctatcttgta

SEQ ID NO: 168517 - DNA, 25 bp, Rattus norvegicus
ataaaggagtgtccctctgtcctct

SEQ ID NO: 168518 - DNA, 25 bp, Rattus norvegicus
ataaaggagtgtgcctctgtcctct

SEQ ID NO: 168519 - DNA, 25 bp, Rattus norvegicus
ataaaggcactcattaccaacccta

SEQ ID NO: 168520 - DNA, 25 bp, Rattus norvegicus
ataaaggcactcattttcttccttc

SEQ ID NO: 168521 - DNA, 25 bp, Rattus norvegicus
ataaaggcactctttaccaacccta

SEQ ID NO: 168522 - DNA, 25 bp, Rattus norvegicus
ataaaggcactctttttcttccttc

SEQ ID NO: 168523 - DNA, 25 bp, Rattus norvegicus
ataaaggcacttcgtcctcttgtca

SEQ ID NO: 168524 - DNA, 25 bp, Rattus norvegicus
ataaaggcacttggtcctcttgtca

SEQ ID NO: 168525 - DNA, 25 bp, Rattus norvegicus
ataaaggcagcaaacctggcgtctt

SEQ ID NO: 168526 - DNA, 25 bp, Rattus norvegicus
ataaaggcagcatacctggcgtctt

SEQ ID NO: 168527 - DNA, 25 bp, Rattus norvegicus
ataaaggcagttcggaccctggcca

SEQ ID NO: 168528 - DNA, 25 bp, Rattus norvegicus
ataaaggcagttgggaccctggcca

SEQ ID NO: 168529 - DNA, 25 bp, Rattus norvegicus
ataaaggcatttcccgattcctgag

SEQ ID NO: 168530 - DNA, 25 bp, Rattus norvegicus
ataaaggcatttgccgattcctgag

SEQ ID NO: 168531 - DNA, 25 bp, Rattus norvegicus
ataaaggccaagaggtgtccatcac

SEQ ID NO: 168532 - DNA, 25 bp, Rattus norvegicus
ataaaggccaagtggtgtccatcac

SEQ ID NO: 168533 - DNA, 25 bp, Rattus norvegicus
ataaaggcgagcaccgtcaggaacg

SEQ ID NO: 168534 - DNA, 25 bp, Rattus norvegicus
ataaaggcgagctccgtcaggaacg

SEQ ID NO: 168535 - DNA, 25 bp, Rattus norvegicus
ataaaggctgccactctgcatgttg

SEQ ID NO: 168536 - DNA, 25 bp, Rattus norvegicus
ataaaggctgcctctctgcatgttg

SEQ ID NO: 168537 - DNA, 25 bp, Rattus norvegicus
ataaaggctgggactggtggcacaa

SEQ ID NO: 168538 - DNA, 25 bp, Rattus norvegicus
ataaaggctgggtctggtggcacaa

SEQ ID NO: 168539 - DNA, 25 bp, Rattus norvegicus
ataaagggactcagccttcactttc

SEQ ID NO: 168540 - DNA, 25 bp, Rattus norvegicus
ataaagggactctgccttcactttc

SEQ ID NO: 168541 - DNA, 25 bp, Rattus norvegicus
ataaagggcactcggccaaagagcc

SEQ ID NO: 168542 - DNA, 25 bp, Rattus norvegicus
ataaagggcactgggccaaagagcc

SEQ ID NO: 168543 - DNA, 25 bp, Rattus norvegicus
ataaaggttgctagctccctttccg

SEQ ID NO: 168544 - DNA, 25 bp, Rattus norvegicus
ataaaggttgcttgctccctttccg

SEQ ID NO: 168545 - DNA, 25 bp, Rattus norvegicus
ataaagtacccactgggctggccgt

SEQ ID NO: 168546 - DNA, 25 bp, Rattus norvegicus
ataaagtacccagtgggctggccgt

SEQ ID NO: 168547 - DNA, 25 bp, Rattus norvegicus
ataaagtcatttactccaagcaggg

SEQ ID NO: 168548 - DNA, 25 bp, Rattus norvegicus
ataaagtcattttctccaagcaggg

SEQ ID NO: 168549 - DNA, 25 bp, Rattus norvegicus
ataaagtccagcatgtcccctcaat

SEQ ID NO: 168550 - DNA, 25 bp, Rattus norvegicus
ataaagtccagcttgtcccctcaat

SEQ ID NO: 168551 - DNA, 25 bp, Rattus norvegicus
ataaagtcccctccagaatctgtag

SEQ ID NO: 168552 - DNA, 25 bp, Rattus norvegicus
ataaagtcccctgcagaatctgtag

SEQ ID NO: 168553 - DNA, 25 bp, Rattus norvegicus
ataaagtctcatatggtctctctct

SEQ ID NO: 168554 - DNA, 25 bp, Rattus norvegicus
ataaagtctcatttggtctctctct

SEQ ID NO: 168555 - DNA, 25 bp, Rattus norvegicus
ataaagtctctgaatctggattcat

SEQ ID NO: 168556 - DNA, 25 bp, Rattus norvegicus
ataaagtctctgtatctggattcat

SEQ ID NO: 168557 - DNA, 25 bp, Rattus norvegicus
ataaagtctcttattgcatctggaa

SEQ ID NO: 168558 - DNA, 25 bp, Rattus norvegicus
ataaagtctctttttgcatctggaa

SEQ ID NO: 168559 - DNA, 25 bp, Rattus norvegicus
ataaagtgtcacaaccacacagccc

SEQ ID NO: 168560 - DNA, 25 bp, Rattus norvegicus
ataaagtgtcactaccacacagccc

SEQ ID NO: 168561 - DNA, 25 bp, Rattus norvegicus
ataaagttacggaccatgctgcccc

SEQ ID NO: 168562 - DNA, 25 bp, Rattus norvegicus
ataaagttacggtccatgctgcccc

SEQ ID NO: 168563 - DNA, 25 bp, Rattus norvegicus
ataaagttactcagccttgggcgtt

SEQ ID NO: 168564 - DNA, 25 bp, Rattus norvegicus
ataaagttactctgccttgggcgtt

SEQ ID NO: 168565 - DNA, 25 bp, Rattus norvegicus
ataaagttccatagtgtgcattcac

SEQ ID NO: 168566 - DNA, 25 bp, Rattus norvegicus
ataaagttccattgtgtgcattcac

SEQ ID NO: 168567 - DNA, 25 bp, Rattus norvegicus
ataaagttcttccttgctggaccca

SEQ ID NO: 168568 - DNA, 25 bp, Rattus norvegicus
ataaagttcttcgttgctggaccca

SEQ ID NO: 168569 - DNA, 25 bp, Rattus norvegicus
ataaagttgtggcagttgagctaaa

SEQ ID NO: 168570 - DNA, 25 bp, Rattus norvegicus
ataaagttgtgggagttgagctaaa

SEQ ID NO: 168571 - DNA, 25 bp, Rattus norvegicus
ataaataaaggtccctgaagggtcg

SEQ ID NO: 168572 - DNA, 25 bp, Rattus norvegicus
ataaataaaggtgcctgaagggtcg

SEQ ID NO: 168573 - DNA, 25 bp, Rattus norvegicus
ataaataacaccacacacctacaac

SEQ ID NO: 168574 - DNA, 25 bp, Rattus norvegicus
ataaataacacctcacacctacaac

SEQ ID NO: 168575 - DNA, 25 bp, Rattus norvegicus
ataaataacccacgccatcccaaag

SEQ ID NO: 168576 - DNA, 25 bp, Rattus norvegicus
ataaataacccaggccatcccaaag

SEQ ID NO: 168577 - DNA, 25 bp, Rattus norvegicus
ataaataagtgtcaacgcccgccct

SEQ ID NO: 168578 - DNA, 25 bp, Rattus norvegicus
ataaataagtgtgaacgcccgccct

SEQ ID NO: 168579 - DNA, 25 bp, Rattus norvegicus
ataaatacaatcacgccacaggcac

SEQ ID NO: 168580 - DNA, 25 bp, Rattus norvegicus
ataaatacaatctcgccacaggcac

SEQ ID NO: 168581 - DNA, 25 bp, Rattus norvegicus
ataaatatctgaagatcttgggcaa

SEQ ID NO: 168582 - DNA, 25 bp, Rattus norvegicus
ataaatatctgatgatcttgggcaa

SEQ ID NO: 168583 - DNA, 25 bp, Rattus norvegicus
ataaatatcttcatccatccacgtg

SEQ ID NO: 168584 - DNA, 25 bp, Rattus norvegicus
ataaatatcttcttccatccacgtg

SEQ ID NO: 168585 - DNA, 25 bp, Rattus norvegicus
ataaatatggctatctcgtgtcctt

SEQ ID NO: 168586 - DNA, 25 bp, Rattus norvegicus
ataaatatggctttctcgtgtcctt

SEQ ID NO: 168587 - DNA, 25 bp, Rattus norvegicus
ataaatatgggacaccctctgcctc

SEQ ID NO: 168588 - DNA, 25 bp, Rattus norvegicus
ataaatatgggagaccctctgcctc

SEQ ID NO: 168589 - DNA, 25 bp, Rattus norvegicus
ataaatattcttaatctggccccaa

SEQ ID NO: 168590 - DNA, 25 bp, Rattus norvegicus
ataaatattctttatctggccccaa

SEQ ID NO: 168591 - DNA, 25 bp, Rattus norvegicus
ataaatcactcacagtggctcgcac

SEQ ID NO: 168592 - DNA, 25 bp, Rattus norvegicus
ataaatcactcagagtggctcgcac

SEQ ID NO: 168593 - DNA, 25 bp, Rattus norvegicus
ataaatccaaataccttcaaggcag

SEQ ID NO: 168594 - DNA, 25 bp, Rattus norvegicus
ataaatccaaattccttcaaggcag

SEQ ID NO: 168595 - DNA, 25 bp, Rattus norvegicus
ataaatccacaaccaacaagcctag

SEQ ID NO: 168596 - DNA, 25 bp, Rattus norvegicus
ataaatccacaagcaacaagcctag

SEQ ID NO: 168597 - DNA, 25 bp, Rattus norvegicus
ataaatccagagaggctggccctga

SEQ ID NO: 168598 - DNA, 25 bp, Rattus norvegicus
ataaatccagagtggctggccctga

SEQ ID NO: 168599 - DNA, 25 bp, Rattus norvegicus
ataaatcccaatcgcctgggtgctc

SEQ ID NO: 168600 - DNA, 25 bp, Rattus norvegicus
ataaatcccaatggcctgggtgctc

SEQ ID NO: 168601 - DNA, 25 bp, Rattus norvegicus
ataaatcccagaattgttgagtagg

SEQ ID NO: 168602 - DNA, 25 bp, Rattus norvegicus
ataaatcccagatttgttgagtagg

SEQ ID NO: 168603 - DNA, 25 bp, Rattus norvegicus
ataaatcgctatatccacgtactgt

SEQ ID NO: 168604 - DNA, 25 bp, Rattus norvegicus
ataaatcgctatttccacgtactgt

SEQ ID NO: 168605 - DNA, 25 bp, Rattus norvegicus
ataaatcgggtcatttcaactaatg

SEQ ID NO: 168606 - DNA, 25 bp, Rattus norvegicus
ataaatcgggtcttttcaactaatg

SEQ ID NO: 168607 - DNA, 25 bp, Rattus norvegicus
ataaatctcaaacccttcgtcactc

SEQ ID NO: 168608 - DNA, 25 bp, Rattus norvegicus
ataaatctcaaagccttcgtcactc

SEQ ID NO: 168609 - DNA, 25 bp, Rattus norvegicus
ataaatctcagactccatattccgc

SEQ ID NO: 168610 - DNA, 25 bp, Rattus norvegicus
ataaatctcagagtccatattccgc

SEQ ID NO: 168611 - DNA, 25 bp, Rattus norvegicus
ataaatctggcacgctctggatccg

SEQ ID NO: 168612 - DNA, 25 bp, Rattus norvegicus
ataaatctggcaggctctggatccg

SEQ ID NO: 168613 - DNA, 25 bp, Rattus norvegicus
ataaatctttagctgcgggcgtatg

SEQ ID NO: 168614 - DNA, 25 bp, Rattus norvegicus
ataaatctttaggtgcgggcgtatg

SEQ ID NO: 168615 - DNA, 25 bp, Rattus norvegicus
ataaatctttgacacctgtgggttc

SEQ ID NO: 168616 - DNA, 25 bp, Rattus norvegicus
ataaatctttgagacctgtgggttc

SEQ ID NO: 168617 - DNA, 25 bp, Rattus norvegicus
ataaatgaactcacctcagatccca

SEQ ID NO: 168618 - DNA, 25 bp, Rattus norvegicus
ataaatgaactctcctcagatccca

SEQ ID NO: 168619 - DNA, 25 bp, Rattus norvegicus
ataaatgatcctatccaaaaccact

SEQ ID NO: 168620 - DNA, 25 bp, Rattus norvegicus
ataaatgatcctttccaaaaccact

SEQ ID NO: 168621 - DNA, 25 bp, Rattus norvegicus
ataaatgatcttcctgttggccgct

SEQ ID NO: 168622 - DNA, 25 bp, Rattus norvegicus
ataaatgatcttgctgttggccgct

SEQ ID NO: 168623 - DNA, 25 bp, Rattus norvegicus
ataaatgatgagcagcagcctcctg

SEQ ID NO: 168624 - DNA, 25 bp, Rattus norvegicus
ataaatgatgaggagcagcctcctg

SEQ ID NO: 168625 - DNA, 25 bp, Rattus norvegicus
ataaatgcacacatggttttctaaa

SEQ ID NO: 168626 - DNA, 25 bp, Rattus norvegicus
ataaatgcacacttggttttctaaa

SEQ ID NO: 168627 - DNA, 25 bp, Rattus norvegicus
ataaatgcactcactggaaacctag

SEQ ID NO: 168628 - DNA, 25 bp, Rattus norvegicus
ataaatgcactctctggaaacctag

SEQ ID NO: 168629 - DNA, 25 bp, Rattus norvegicus
ataaatgcatccattgcatgccacc

SEQ ID NO: 168630 - DNA, 25 bp, Rattus norvegicus
ataaatgcatcctttgcatgccacc

SEQ ID NO: 168631 - DNA, 25 bp, Rattus norvegicus
ataaatgccaaaagcagccctccct

SEQ ID NO: 168632 - DNA, 25 bp, Rattus norvegicus
ataaatgccaaatgcagccctccct

SEQ ID NO: 168633 - DNA, 25 bp, Rattus norvegicus
ataaatgcccatctatctctctttg

SEQ ID NO: 168634 - DNA, 25 bp, Rattus norvegicus
ataaatgcccatgtatctctctttg

SEQ ID NO: 168635 - DNA, 25 bp, Rattus norvegicus
ataaatgcctgtagtactccttagc

SEQ ID NO: 168636 - DNA, 25 bp, Rattus norvegicus
ataaatgcctgttgtactccttagc

SEQ ID NO: 168637 - DNA, 25 bp, Rattus norvegicus
ataaatgcctttcgtgggcttctca

SEQ ID NO: 168638 - DNA, 25 bp, Rattus norvegicus
ataaatgcctttggtgggcttctca

SEQ ID NO: 168639 - DNA, 25 bp, Rattus norvegicus
ataaatgctaatcaacctgttaagt

SEQ ID NO: 168640 - DNA, 25 bp, Rattus norvegicus
ataaatgctaatgaacctgttaagt

SEQ ID NO: 168641 - DNA, 25 bp, Rattus norvegicus
ataaatgctctacgctcgagggtcg

SEQ ID NO: 168642 - DNA, 25 bp, Rattus norvegicus
ataaatgctctaggctcgagggtcg

SEQ ID NO: 168643 - DNA, 25 bp, Rattus norvegicus
ataaatgctgtcactactgtgaaaa

SEQ ID NO: 168644 - DNA, 25 bp, Rattus norvegicus
ataaatgctgtctctactgtgaaaa

SEQ ID NO: 168645 - DNA, 25 bp, Rattus norvegicus
ataaatgctttcatccttgagtgga

SEQ ID NO: 168646 - DNA, 25 bp, Rattus norvegicus
ataaatgctttcttccttgagtgga

SEQ ID NO: 168647 - DNA, 25 bp, Rattus norvegicus
ataaatggagccagactttccctca

SEQ ID NO: 168648 - DNA, 25 bp, Rattus norvegicus
ataaatggagcctgactttccctca

SEQ ID NO: 168649 - DNA, 25 bp, Rattus norvegicus
ataaatggcaatacctccgtgtctt

SEQ ID NO: 168650 - DNA, 25 bp, Rattus norvegicus
ataaatggcaattcctccgtgtctt

SEQ ID NO: 168651 - DNA, 25 bp, Rattus norvegicus
ataaatggcttaaccttggcttcct

SEQ ID NO: 168652 - DNA, 25 bp, Rattus norvegicus
ataaatggcttatccttggcttcct

SEQ ID NO: 168653 - DNA, 25 bp, Rattus norvegicus
ataaatggcttgcacggtcttccct

SEQ ID NO: 168654 - DNA, 25 bp, Rattus norvegicus
ataaatggcttgcttgagcacaact

SEQ ID NO: 168655 - DNA, 25 bp, Rattus norvegicus
ataaatggcttggacggtcttccct

SEQ ID NO: 168656 - DNA, 25 bp, Rattus norvegicus
ataaatggcttggttgagcacaact

SEQ ID NO: 168657 - DNA, 25 bp, Rattus norvegicus
ataaatgggacactttgccctctac

SEQ ID NO: 168658 - DNA, 25 bp, Rattus norvegicus
ataaatgggacagtttgccctctac

SEQ ID NO: 168659 - DNA, 25 bp, Rattus norvegicus
ataaatgggcatctcttggtctagt

SEQ ID NO: 168660 - DNA, 25 bp, Rattus norvegicus
ataaatgggcatgtcttggtctagt

SEQ ID NO: 168661 - DNA, 25 bp, Rattus norvegicus
ataaatgggtccatctacgtgtctc

SEQ ID NO: 168662 - DNA, 25 bp, Rattus norvegicus
ataaatgggtccttctacgtgtctc

SEQ ID NO: 168663 - DNA, 25 bp, Rattus norvegicus
ataaatggtccaactagcgcttctg

SEQ ID NO: 168664 - DNA, 25 bp, Rattus norvegicus
ataaatggtccatctagcgcttctg

SEQ ID NO: 168665 - DNA, 25 bp, Rattus norvegicus
ataaatggtggcaggcttcccataa

SEQ ID NO: 168666 - DNA, 25 bp, Rattus norvegicus
ataaatggtggctggcttcccataa

SEQ ID NO: 168667 - DNA, 25 bp, Rattus norvegicus
ataaatgtcgctccttatgttagac

SEQ ID NO: 168668 - DNA, 25 bp, Rattus norvegicus
ataaatgtcgctgcttatgttagac

SEQ ID NO: 168669 - DNA, 25 bp, Rattus norvegicus
ataaatgtcgttaggctcctgggca

SEQ ID NO: 168670 - DNA, 25 bp, Rattus norvegicus
ataaatgtcgtttggctcctgggca

SEQ ID NO: 168671 - DNA, 25 bp, Rattus norvegicus
ataaatgtctgcctggccaaaacca

SEQ ID NO: 168672 - DNA, 25 bp, Rattus norvegicus
ataaatgtctgcgtggccaaaacca

SEQ ID NO: 168673 - DNA, 25 bp, Rattus norvegicus
ataaatgtgcaaacggtttctcccg

SEQ ID NO: 168674 - DNA, 25 bp, Rattus norvegicus
ataaatgtgcaatcggtttctcccg

SEQ ID NO: 168675 - DNA, 25 bp, Rattus norvegicus
ataaatgtgcgaatcatgttgttaa

SEQ ID NO: 168676 - DNA, 25 bp, Rattus norvegicus
ataaatgtgcgattcatgttgttaa

SEQ ID NO: 168677 - DNA, 25 bp, Rattus norvegicus
ataaatgttagcaccgtgcttcgca

SEQ ID NO: 168678 - DNA, 25 bp, Rattus norvegicus
ataaatgttagcattgaccagggaa

SEQ ID NO: 168679 - DNA, 25 bp, Rattus norvegicus
ataaatgttagctccgtgcttcgca

SEQ ID NO: 168680 - DNA, 25 bp, Rattus norvegicus
ataaatgttagctttgaccagggaa

SEQ ID NO: 168681 - DNA, 25 bp, Rattus norvegicus
ataaatgtttctcagctgcctgtgt

SEQ ID NO: 168682 - DNA, 25 bp, Rattus norvegicus
ataaatgtttctgagctgcctgtgt

SEQ ID NO: 168683 - DNA, 25 bp, Rattus norvegicus
ataaatgtttgaatcccttcctgct

SEQ ID NO: 168684 - DNA, 25 bp, Rattus norvegicus
ataaatgtttgattcccttcctgct

SEQ ID NO: 168685 - DNA, 25 bp, Rattus norvegicus
ataaatgtttgccagtgttcagtac

SEQ ID NO: 168686 - DNA, 25 bp, Rattus norvegicus
ataaatgtttgcgagtgttcagtac

SEQ ID NO: 168687 - DNA, 25 bp, Rattus norvegicus
ataaattatcccacgctcatgaaga

SEQ ID NO: 168688 - DNA, 25 bp, Rattus norvegicus
ataaattatccctcgctcatgaaga

SEQ ID NO: 168689 - DNA, 25 bp, Rattus norvegicus
ataaattcagcactaacgggcttat

SEQ ID NO: 168690 - DNA, 25 bp, Rattus norvegicus
ataaattcagcagtaacgggcttat

SEQ ID NO: 168691 - DNA, 25 bp, Rattus norvegicus
ataaattcatcacccacacaaccaa

SEQ ID NO: 168692 - DNA, 25 bp, Rattus norvegicus
ataaattcatcagccacacaaccaa

SEQ ID NO: 168693 - DNA, 25 bp, Rattus norvegicus
ataaattcatccatacaagtgcaag

SEQ ID NO: 168694 - DNA, 25 bp, Rattus norvegicus
ataaattcatccttacaagtgcaag

SEQ ID NO: 168695 - DNA, 25 bp, Rattus norvegicus
ataaattcatggctcgtttctctgg

SEQ ID NO: 168696 - DNA, 25 bp, Rattus norvegicus
ataaattcatgggtcgtttctctgg

SEQ ID NO: 168697 - DNA, 25 bp, Rattus norvegicus
ataaattcccagcaacagttcacac

SEQ ID NO: 168698 - DNA, 25 bp, Rattus norvegicus
ataaattcccaggaacagttcacac

SEQ ID NO: 168699 - DNA, 25 bp, Rattus norvegicus
ataaattcccatacttacatagtaa

SEQ ID NO: 168700 - DNA, 25 bp, Rattus norvegicus
ataaattcccattcttacatagtaa

SEQ ID NO: 168701 - DNA, 25 bp, Rattus norvegicus
ataaattctcaacttcccttgcttt

SEQ ID NO: 168702 - DNA, 25 bp, Rattus norvegicus
ataaattctcaagttcccttgcttt

SEQ ID NO: 168703 - DNA, 25 bp, Rattus norvegicus
ataaattctccgacggctccgcggc

SEQ ID NO: 168704 - DNA, 25 bp, Rattus norvegicus
ataaattctccgtcggctccgcggc

SEQ ID NO: 168705 - DNA, 25 bp, Rattus norvegicus
ataaattctcttaacccactgttgg

SEQ ID NO: 168706 - DNA, 25 bp, Rattus norvegicus
ataaattctctttacccactgttgg

SEQ ID NO: 168707 - DNA, 25 bp, Rattus norvegicus
ataaattctgttacctgcatgtgtg

SEQ ID NO: 168708 - DNA, 25 bp, Rattus norvegicus
ataaattctgtttcctgcatgtgtg

SEQ ID NO: 168709 - DNA, 25 bp, Rattus norvegicus
ataaattgcctccttatccttaaga

SEQ ID NO: 168710 - DNA, 25 bp, Rattus norvegicus
ataaattgcctcgttatccttaaga

SEQ ID NO: 168711 - DNA, 25 bp, Rattus norvegicus
ataaattgctctactgggcagtcgc

SEQ ID NO: 168712 - DNA, 25 bp, Rattus norvegicus
ataaattgctcttctgggcagtcgc

SEQ ID NO: 168713 - DNA, 25 bp, Rattus norvegicus
ataaattgctttatcctgctcacta

SEQ ID NO: 168714 - DNA, 25 bp, Rattus norvegicus
ataaattgctttttcctgctcacta

SEQ ID NO: 168715 - DNA, 25 bp, Rattus norvegicus
ataaattggtatagctgccgtcctg

SEQ ID NO: 168716 - DNA, 25 bp, Rattus norvegicus
ataaattggtattgctgccgtcctg

SEQ ID NO: 168717 - DNA, 25 bp, Rattus norvegicus
ataaattggttcaaggctggccctg

SEQ ID NO: 168718 - DNA, 25 bp, Rattus norvegicus
ataaattggttctaggctggccctg

SEQ ID NO: 168719 - DNA, 25 bp, Rattus norvegicus
ataaattgtcaccactttttctgat

SEQ ID NO: 168720 - DNA, 25 bp, Rattus norvegicus
ataaattgtcacgactttttctgat

SEQ ID NO: 168721 - DNA, 25 bp, Rattus norvegicus
ataaatttcctgaagagccctcctg

SEQ ID NO: 168722 - DNA, 25 bp, Rattus norvegicus
ataaatttcctgtagagccctcctg

SEQ ID NO: 168723 - DNA, 25 bp, Rattus norvegicus
ataaatttcttcattcctttgctat

SEQ ID NO: 168724 - DNA, 25 bp, Rattus norvegicus
ataaatttcttctttcctttgctat

SEQ ID NO: 168725 - DNA, 25 bp, Rattus norvegicus
ataaatttgataagcagcccctgtg

SEQ ID NO: 168726 - DNA, 25 bp, Rattus norvegicus
ataaatttgatatgcagcccctgtg

SEQ ID NO: 168727 - DNA, 25 bp, Rattus norvegicus
ataaatttgcttcctcctttggagg

SEQ ID NO: 168728 - DNA, 25 bp, Rattus norvegicus
ataaatttgcttgctcctttggagg

SEQ ID NO: 168729 - DNA, 25 bp, Rattus norvegicus
ataacaaatactccccgatggtcct

SEQ ID NO: 168730 - DNA, 25 bp, Rattus norvegicus
ataacaaatactgcccgatggtcct

SEQ ID NO: 168731 - DNA, 25 bp, Rattus norvegicus
ataacaacactcagttcctggttct

SEQ ID NO: 168732 - DNA, 25 bp, Rattus norvegicus
ataacaacactctgttcctggttct

SEQ ID NO: 168733 - DNA, 25 bp, Rattus norvegicus
ataacaacccctagtagcattaaag

SEQ ID NO: 168734 - DNA, 25 bp, Rattus norvegicus
ataacaaccccttgtagcattaaag

SEQ ID NO: 168735 - DNA, 25 bp, Rattus norvegicus
ataacaacctctatgtgcctttgcc

SEQ ID NO: 168736 - DNA, 25 bp, Rattus norvegicus
ataacaacctctttgtgcctttgcc

SEQ ID NO: 168737 - DNA, 25 bp, Rattus norvegicus
ataacaacgagtccttaccacagtg

SEQ ID NO: 168738 - DNA, 25 bp, Rattus norvegicus
ataacaacgagtgcttaccacagtg

SEQ ID NO: 168739 - DNA, 25 bp, Rattus norvegicus
ataacaagtgacatgctccttaggg

SEQ ID NO: 168740 - DNA, 25 bp, Rattus norvegicus
ataacaagtgacttgctccttaggg

SEQ ID NO: 168741 - DNA, 25 bp, Rattus norvegicus
ataacaatcgcaacgggttcgcctt

SEQ ID NO: 168742 - DNA, 25 bp, Rattus norvegicus
ataacaatcgcatcgggttcgcctt

SEQ ID NO: 168743 - DNA, 25 bp, Rattus norvegicus
ataacaatgtcaattagcccctctc

SEQ ID NO: 168744 - DNA, 25 bp, Rattus norvegicus
ataacaatgtcatttagcccctctc

SEQ ID NO: 168745 - DNA, 25 bp, Rattus norvegicus
ataacaatgtttactccaccgactt

SEQ ID NO: 168746 - DNA, 25 bp, Rattus norvegicus
ataacaatgttttctccaccgactt

SEQ ID NO: 168747 - DNA, 25 bp, Rattus norvegicus
ataacaattattccacataagagca

SEQ ID NO: 168748 - DNA, 25 bp, Rattus norvegicus
ataacaattattgcacataagagca

SEQ ID NO: 168749 - DNA, 25 bp, Rattus norvegicus
ataacacaccacatttccttgactt

SEQ ID NO: 168750 - DNA, 25 bp, Rattus norvegicus
ataacacaccacttttccttgactt

SEQ ID NO: 168751 - DNA, 25 bp, Rattus norvegicus
ataacacacgatccgctgacatatt

SEQ ID NO: 168752 - DNA, 25 bp, Rattus norvegicus
ataacacacgatgcgctgacatatt

SEQ ID NO: 168753 - DNA, 25 bp, Rattus norvegicus
ataacacactggcaatatctacctg

SEQ ID NO: 168754 - DNA, 25 bp, Rattus norvegicus
ataacacactgggaatatctacctg

SEQ ID NO: 168755 - DNA, 25 bp, Rattus norvegicus
ataacacagtccaagaagcttttcc

SEQ ID NO: 168756 - DNA, 25 bp, Rattus norvegicus
ataacacagtcctagaagcttttcc

SEQ ID NO: 168757 - DNA, 25 bp, Rattus norvegicus
ataacacattgcactgtcaattcag

SEQ ID NO: 168758 - DNA, 25 bp, Rattus norvegicus
ataacacattgctctgtcaattcag

SEQ ID NO: 168759 - DNA, 25 bp, Rattus norvegicus
ataacacctaggatgtcatggttac

SEQ ID NO: 168760 - DNA, 25 bp, Rattus norvegicus
ataacacctaggttgtcatggttac

SEQ ID NO: 168761 - DNA, 25 bp, Rattus norvegicus
ataacaccttgaaagcccagatctg

SEQ ID NO: 168762 - DNA, 25 bp, Rattus norvegicus
ataacaccttgatagcccagatctg

SEQ ID NO: 168763 - DNA, 25 bp, Rattus norvegicus
ataacacgactgaagggccatgaaa

SEQ ID NO: 168764 - DNA, 25 bp, Rattus norvegicus
ataacacgactgtagggccatgaaa

SEQ ID NO: 168765 - DNA, 25 bp, Rattus norvegicus
ataacactatacactttcttgacag

SEQ ID NO: 168766 - DNA, 25 bp, Rattus norvegicus
ataacactatactctttcttgacag

SEQ ID NO: 168767 - DNA, 25 bp, Rattus norvegicus
ataacactatagcactagatacaca

SEQ ID NO: 168768 - DNA, 25 bp, Rattus norvegicus
ataacactataggactagatacaca

SEQ ID NO: 168769 - DNA, 25 bp, Rattus norvegicus
ataacactccggaagctcagatctc

SEQ ID NO: 168770 - DNA, 25 bp, Rattus norvegicus
ataacactccggtagctcagatctc

SEQ ID NO: 168771 - DNA, 25 bp, Rattus norvegicus
ataacactctctatgtgtgcctcaa

SEQ ID NO: 168772 - DNA, 25 bp, Rattus norvegicus
ataacactctctttgtgtgcctcaa

SEQ ID NO: 168773 - DNA, 25 bp, Rattus norvegicus
ataacactgagaccattttccacca

SEQ ID NO: 168774 - DNA, 25 bp, Rattus norvegicus
ataacactgagagcattttccacca

SEQ ID NO: 168775 - DNA, 25 bp, Rattus norvegicus
ataacactgcagcttattttgtagc

SEQ ID NO: 168776 - DNA, 25 bp, Rattus norvegicus
ataacactgcaggttattttgtagc

SEQ ID NO: 168777 - DNA, 25 bp, Rattus norvegicus
ataacacttgtcagtgcacgtcccg

SEQ ID NO: 168778 - DNA, 25 bp, Rattus norvegicus
ataacacttgtctgtgcacgtcccg

SEQ ID NO: 168779 - DNA, 25 bp, Rattus norvegicus
ataacacttgtgcatttggtacagt

SEQ ID NO: 168780 - DNA, 25 bp, Rattus norvegicus
ataacacttgtggatttggtacagt

SEQ ID NO: 168781 - DNA, 25 bp, Rattus norvegicus
ataacactttcaatgccactagctt

SEQ ID NO: 168782 - DNA, 25 bp, Rattus norvegicus
ataacactttcattgccactagctt

SEQ ID NO: 168783 - DNA, 25 bp, Rattus norvegicus
ataacagacaggagcttcagcttta

SEQ ID NO: 168784 - DNA, 25 bp, Rattus norvegicus
ataacagacaggtgcttcagcttta

SEQ ID NO: 168785 - DNA, 25 bp, Rattus norvegicus
ataacagaccttacaatacctcact

SEQ ID NO: 168786 - DNA, 25 bp, Rattus norvegicus
ataacagacctttcaatacctcact

SEQ ID NO: 168787 - DNA, 25 bp, Rattus norvegicus
ataacagagtctcctcttgccttgg

SEQ ID NO: 168788 - DNA, 25 bp, Rattus norvegicus
ataacagagtctgctcttgccttgg

SEQ ID NO: 168789 - DNA, 25 bp, Rattus norvegicus
ataacagagtgtaccttccttcttc

SEQ ID NO: 168790 - DNA, 25 bp, Rattus norvegicus
ataacagagtgttccttccttcttc

SEQ ID NO: 168791 - DNA, 25 bp, Rattus norvegicus
ataacagataaccaaccactccctg

SEQ ID NO: 168792 - DNA, 25 bp, Rattus norvegicus
ataacagataacgaaccactccctg

SEQ ID NO: 168793 - DNA, 25 bp, Rattus norvegicus
ataacagcagacatggtacaacggt

SEQ ID NO: 168794 - DNA, 25 bp, Rattus norvegicus
ataacagcagacttggtacaacggt

SEQ ID NO: 168795 - DNA, 25 bp, Rattus norvegicus
ataacagcatacatcactcctcttc

SEQ ID NO: 168796 - DNA, 25 bp, Rattus norvegicus
ataacagcatacttcactcctcttc

SEQ ID NO: 168797 - DNA, 25 bp, Rattus norvegicus
ataacagcattgcttgtcctgatgc

SEQ ID NO: 168798 - DNA, 25 bp, Rattus norvegicus
ataacagcattggttgtcctgatgc

SEQ ID NO: 168799 - DNA, 25 bp, Rattus norvegicus
ataacagccaaaactgctcgagcag

SEQ ID NO: 168800 - DNA, 25 bp, Rattus norvegicus
ataacagccaaatctgctcgagcag

SEQ ID NO: 168801 - DNA, 25 bp, Rattus norvegicus
ataacagccaccaggcgagctggac

SEQ ID NO: 168802 - DNA, 25 bp, Rattus norvegicus
ataacagccacctggcgagctggac

SEQ ID NO: 168803 - DNA, 25 bp, Rattus norvegicus
ataacagccagcagacaggtcacta

SEQ ID NO: 168804 - DNA, 25 bp, Rattus norvegicus
ataacagccagctgacaggtcacta

SEQ ID NO: 168805 - DNA, 25 bp, Rattus norvegicus
ataacagcgggtcactgagcctcgc

SEQ ID NO: 168806 - DNA, 25 bp, Rattus norvegicus
ataacagcgggtgactgagcctcgc

SEQ ID NO: 168807 - DNA, 25 bp, Rattus norvegicus
ataacaggcaagagctaccaggcct

SEQ ID NO: 168808 - DNA, 25 bp, Rattus norvegicus
ataacaggcaagtgctaccaggcct

SEQ ID NO: 168809 - DNA, 25 bp, Rattus norvegicus
ataacaggctctcaggaacacgctc

SEQ ID NO: 168810 - DNA, 25 bp, Rattus norvegicus
ataacaggctctgaggaacacgctc

SEQ ID NO: 168811 - DNA, 25 bp, Rattus norvegicus
ataacaggtgatcaagcccgtactt

SEQ ID NO: 168812 - DNA, 25 bp, Rattus norvegicus
ataacaggtgatgaagcccgtactt

SEQ ID NO: 168813 - DNA, 25 bp, Rattus norvegicus
ataacagtccacagagggcagcttg

SEQ ID NO: 168814 - DNA, 25 bp, Rattus norvegicus
ataacagtccactgagggcagcttg

SEQ ID NO: 168815 - DNA, 25 bp, Rattus norvegicus
ataacagttctacggcaggtatgcc

SEQ ID NO: 168816 - DNA, 25 bp, Rattus norvegicus
ataacagttctagggcaggtatgcc

SEQ ID NO: 168817 - DNA, 25 bp, Rattus norvegicus
ataacagttgtgatctttgctctcg

SEQ ID NO: 168818 - DNA, 25 bp, Rattus norvegicus
ataacagttgtgttctttgctctcg

SEQ ID NO: 168819 - DNA, 25 bp, Rattus norvegicus
ataacagtttgcatcgaccacgcag

SEQ ID NO: 168820 - DNA, 25 bp, Rattus norvegicus
ataacagtttgcttcgaccacgcag

SEQ ID NO: 168821 - DNA, 25 bp, Rattus norvegicus
ataacataacttacgctgttccctg

SEQ ID NO: 168822 - DNA, 25 bp, Rattus norvegicus
ataacataactttcgctgttccctg

SEQ ID NO: 168823 - DNA, 25 bp, Rattus norvegicus
ataacatagttaaccacagctgcgt

SEQ ID NO: 168824 - DNA, 25 bp, Rattus norvegicus
ataacatagttatccacagctgcgt

SEQ ID NO: 168825 - DNA, 25 bp, Rattus norvegicus
ataacatattgtacctctctgccaa

SEQ ID NO: 168826 - DNA, 25 bp, Rattus norvegicus
ataacatattgttcctctctgccaa

SEQ ID NO: 168827 - DNA, 25 bp, Rattus norvegicus
ataacatcatggagctggtatctac

SEQ ID NO: 168828 - DNA, 25 bp, Rattus norvegicus
ataacatcatggtgctggtatctac

SEQ ID NO: 168829 - DNA, 25 bp, Rattus norvegicus
ataacatctggaatgcccggctcga

SEQ ID NO: 168830 - DNA, 25 bp, Rattus norvegicus
ataacatctggattgcccggctcga

SEQ ID NO: 168831 - DNA, 25 bp, Rattus norvegicus
ataacatctttaacactagtggcag

SEQ ID NO: 168832 - DNA, 25 bp, Rattus norvegicus
ataacatctttatcactagtggcag

SEQ ID NO: 168833 - DNA, 25 bp, Rattus norvegicus
ataacatgaactatcccttctggaa

SEQ ID NO: 168834 - DNA, 25 bp, Rattus norvegicus
ataacatgaactttcccttctggaa

SEQ ID NO: 168835 - DNA, 25 bp, Rattus norvegicus
ataacatgcactatctgggtttttt

SEQ ID NO: 168836 - DNA, 25 bp, Rattus norvegicus
ataacatgcactttctgggtttttt

SEQ ID NO: 168837 - DNA, 25 bp, Rattus norvegicus
ataacatgccgtacagagctcacac

SEQ ID NO: 168838 - DNA, 25 bp, Rattus norvegicus
ataacatgccgttcagagctcacac

SEQ ID NO: 168839 - DNA, 25 bp, Rattus norvegicus
ataacatgccttctattctatcctc

SEQ ID NO: 168840 - DNA, 25 bp, Rattus norvegicus
ataacatgccttgtattctatcctc

SEQ ID NO: 168841 - DNA, 25 bp, Rattus norvegicus
ataacatgcgcgaccattagatggc

SEQ ID NO: 168842 - DNA, 25 bp, Rattus norvegicus
ataacatgcgcgtccattagatggc

SEQ ID NO: 168843 - DNA, 25 bp, Rattus norvegicus
ataacatgtattacagttcctggag

SEQ ID NO: 168844 - DNA, 25 bp, Rattus norvegicus
ataacatgtatttcagttcctggag

SEQ ID NO: 168845 - DNA, 25 bp, Rattus norvegicus
ataacatgtgtgatgcaccttccat

SEQ ID NO: 168846 - DNA, 25 bp, Rattus norvegicus
ataacatgtgtgttgcaccttccat

SEQ ID NO: 168847 - DNA, 25 bp, Rattus norvegicus
ataacattaaaactccccatcccag

SEQ ID NO: 168848 - DNA, 25 bp, Rattus norvegicus
ataacattaaaagtccccatcccag

SEQ ID NO: 168849 - DNA, 25 bp, Rattus norvegicus
ataacattccttctcctagcttaag

SEQ ID NO: 168850 - DNA, 25 bp, Rattus norvegicus
ataacattccttgtcctagcttaag

SEQ ID NO: 168851 - DNA, 25 bp, Rattus norvegicus
ataaccaaagtacatgcaccagccc

SEQ ID NO: 168852 - DNA, 25 bp, Rattus norvegicus
ataaccaaagtagatgcaccagccc

SEQ ID NO: 168853 - DNA, 25 bp, Rattus norvegicus
ataaccaacccaaaacgctgcgtag

SEQ ID NO: 168854 - DNA, 25 bp, Rattus norvegicus
ataaccaacccataacgctgcgtag

SEQ ID NO: 168855 - DNA, 25 bp, Rattus norvegicus
ataaccaaccccatgtttcagcaaa

SEQ ID NO: 168856 - DNA, 25 bp, Rattus norvegicus
ataaccaaccccttgtttcagcaaa

SEQ ID NO: 168857 - DNA, 25 bp, Rattus norvegicus
ataaccaacctgagaaaactgcaat

SEQ ID NO: 168858 - DNA, 25 bp, Rattus norvegicus
ataaccaacctgtgaaaactgcaat

SEQ ID NO: 168859 - DNA, 25 bp, Rattus norvegicus
ataaccaactaccagggcatcctga

SEQ ID NO: 168860 - DNA, 25 bp, Rattus norvegicus
ataaccaactacgagggcatcctga

SEQ ID NO: 168861 - DNA, 25 bp, Rattus norvegicus
ataaccaagtgtagcccttataagt

SEQ ID NO: 168862 - DNA, 25 bp, Rattus norvegicus
ataaccaagtgttgcccttataagt

SEQ ID NO: 168863 - DNA, 25 bp, Rattus norvegicus
ataaccacaattccagcattgccgc

SEQ ID NO: 168864 - DNA, 25 bp, Rattus norvegicus
ataaccacaattgcagcattgccgc

SEQ ID NO: 168865 - DNA, 25 bp, Rattus norvegicus
ataaccacactgaatcctgtaaatg

SEQ ID NO: 168866 - DNA, 25 bp, Rattus norvegicus
ataaccacactgtatcctgtaaatg

SEQ ID NO: 168867 - DNA, 25 bp, Rattus norvegicus
ataaccacagaaatcagataccatg

SEQ ID NO: 168868 - DNA, 25 bp, Rattus norvegicus
ataaccacagaattcagataccatg

SEQ ID NO: 168869 - DNA, 25 bp, Rattus norvegicus
ataaccacccatcctgtgtactttt

SEQ ID NO: 168870 - DNA, 25 bp, Rattus norvegicus
ataaccacccatgctgtgtactttt

SEQ ID NO: 168871 - DNA, 25 bp, Rattus norvegicus
ataaccaccctcagggattcttcag

SEQ ID NO: 168872 - DNA, 25 bp, Rattus norvegicus
ataaccaccctctgggattcttcag

SEQ ID NO: 168873 - DNA, 25 bp, Rattus norvegicus
ataaccactctcagggagatgtctt

SEQ ID NO: 168874 - DNA, 25 bp, Rattus norvegicus
ataaccactctctgggagatgtctt

SEQ ID NO: 168875 - DNA, 25 bp, Rattus norvegicus
ataaccactggaacactacactaaa

SEQ ID NO: 168876 - DNA, 25 bp, Rattus norvegicus
ataaccactggatcactacactaaa

SEQ ID NO: 168877 - DNA, 25 bp, Rattus norvegicus
ataaccactggcaggtactgtccta

SEQ ID NO: 168878 - DNA, 25 bp, Rattus norvegicus
ataaccactggctggtactgtccta

SEQ ID NO: 168879 - DNA, 25 bp, Rattus norvegicus
ataaccactgggacactgagttgta

SEQ ID NO: 168880 - DNA, 25 bp, Rattus norvegicus
ataaccactgggtcactgagttgta

SEQ ID NO: 168881 - DNA, 25 bp, Rattus norvegicus
ataaccactttcaaaacgctgctgt

SEQ ID NO: 168882 - DNA, 25 bp, Rattus norvegicus
ataaccactttctaaacgctgctgt

SEQ ID NO: 168883 - DNA, 25 bp, Rattus norvegicus
ataaccagaacactaagagccctcc

SEQ ID NO: 168884 - DNA, 25 bp, Rattus norvegicus
ataaccagaacagtaagagccctcc

SEQ ID NO: 168885 - DNA, 25 bp, Rattus norvegicus
ataaccagagcacaactgtcgttcc

SEQ ID NO: 168886 - DNA, 25 bp, Rattus norvegicus
ataaccagagcagaactgtcgttcc

SEQ ID NO: 168887 - DNA, 25 bp, Rattus norvegicus
ataaccagaggtcaggaacccgcct

SEQ ID NO: 168888 - DNA, 25 bp, Rattus norvegicus
ataaccagaggtgaggaacccgcct

SEQ ID NO: 168889 - DNA, 25 bp, Rattus norvegicus
ataaccaggaaaacgactctcattt

SEQ ID NO: 168890 - DNA, 25 bp, Rattus norvegicus
ataaccaggaaatcgactctcattt

SEQ ID NO: 168891 - DNA, 25 bp, Rattus norvegicus
ataaccaggcctagtgaacatccag

SEQ ID NO: 168892 - DNA, 25 bp, Rattus norvegicus
ataaccaggccttgtgaacatccag

SEQ ID NO: 168893 - DNA, 25 bp, Rattus norvegicus
ataaccagtataccgagggcgtgca

SEQ ID NO: 168894 - DNA, 25 bp, Rattus norvegicus
ataaccagtatagcgagggcgtgca

SEQ ID NO: 168895 - DNA, 25 bp, Rattus norvegicus
ataaccatatagacgcatcctgcca

SEQ ID NO: 168896 - DNA, 25 bp, Rattus norvegicus
ataaccatatagtcgcatcctgcca

SEQ ID NO: 168897 - DNA, 25 bp, Rattus norvegicus
ataaccatattcctccatgttgtgt

SEQ ID NO: 168898 - DNA, 25 bp, Rattus norvegicus
ataaccatattcgtccatgttgtgt

SEQ ID NO: 168899 - DNA, 25 bp, Rattus norvegicus
ataaccatggtcactgggctgttga

SEQ ID NO: 168900 - DNA, 25 bp, Rattus norvegicus
ataaccatggtctctgggctgttga

SEQ ID NO: 168901 - DNA, 25 bp, Rattus norvegicus
ataaccattctaacagccgatgagg

SEQ ID NO: 168902 - DNA, 25 bp, Rattus norvegicus
ataaccattctactgtggcttcctg

SEQ ID NO: 168903 - DNA, 25 bp, Rattus norvegicus
ataaccattctagtgtggcttcctg

SEQ ID NO: 168904 - DNA, 25 bp, Rattus norvegicus
ataaccattctatcagccgatgagg

SEQ ID NO: 168905 - DNA, 25 bp, Rattus norvegicus
ataaccattgtcagctctttgtctg

SEQ ID NO: 168906 - DNA, 25 bp, Rattus norvegicus
ataaccattgtctgctctttgtctg

SEQ ID NO: 168907 - DNA, 25 bp, Rattus norvegicus
ataacccaagtacagtcccacgttg

SEQ ID NO: 168908 - DNA, 25 bp, Rattus norvegicus
ataacccaagtagagtcccacgttg

SEQ ID NO: 168909 - DNA, 25 bp, Rattus norvegicus
ataacccaagtcatgacagcccttg

SEQ ID NO: 168910 - DNA, 25 bp, Rattus norvegicus
ataacccaagtcctgctgagctgtc

SEQ ID NO: 168911 - DNA, 25 bp, Rattus norvegicus
ataacccaagtcgtgctgagctgtc

SEQ ID NO: 168912 - DNA, 25 bp, Rattus norvegicus
ataacccaagtcttgacagcccttg

SEQ ID NO: 168913 - DNA, 25 bp, Rattus norvegicus
ataacccaggtgaagatgtgtcttt

SEQ ID NO: 168914 - DNA, 25 bp, Rattus norvegicus
ataacccaggtgtagatgtgtcttt

SEQ ID NO: 168915 - DNA, 25 bp, Rattus norvegicus
ataaccccagtgatttatttgctgt

SEQ ID NO: 168916 - DNA, 25 bp, Rattus norvegicus
ataaccccagtgttttatttgctgt

SEQ ID NO: 168917 - DNA, 25 bp, Rattus norvegicus
ataaccccatgtacagcgagcctgt

SEQ ID NO: 168918 - DNA, 25 bp, Rattus norvegicus
ataaccccatgttcagcgagcctgt

SEQ ID NO: 168919 - DNA, 25 bp, Rattus norvegicus
ataaccccgaggatccaatcttgcg

SEQ ID NO: 168920 - DNA, 25 bp, Rattus norvegicus
ataaccccgaggttccaatcttgcg

SEQ ID NO: 168921 - DNA, 25 bp, Rattus norvegicus
ataacccctacccagtgagatgaga

SEQ ID NO: 168922 - DNA, 25 bp, Rattus norvegicus
ataacccctaccgagtgagatgaga

SEQ ID NO: 168923 - DNA, 25 bp, Rattus norvegicus
ataacccgcctgcagtggaaagtgt

SEQ ID NO: 168924 - DNA, 25 bp, Rattus norvegicus
ataacccgcctggagtggaaagtgt

SEQ ID NO: 168925 - DNA, 25 bp, Rattus norvegicus
ataaccctagtactattcttcccag

SEQ ID NO: 168926 - DNA, 25 bp, Rattus norvegicus
ataaccctagtagtattcttcccag

SEQ ID NO: 168927 - DNA, 25 bp, Rattus norvegicus
ataaccctattgctgagtctttgag

SEQ ID NO: 168928 - DNA, 25 bp, Rattus norvegicus
ataaccctattggtgagtctttgag

SEQ ID NO: 168929 - DNA, 25 bp, Rattus norvegicus
ataaccctcagtaggtcacatgtct

SEQ ID NO: 168930 - DNA, 25 bp, Rattus norvegicus
ataaccctcagttggtcacatgtct

SEQ ID NO: 168931 - DNA, 25 bp, Rattus norvegicus
ataaccctcggtccaagtgctctgg

SEQ ID NO: 168932 - DNA, 25 bp, Rattus norvegicus
ataaccctcggtgcaagtgctctgg

SEQ ID NO: 168933 - DNA, 25 bp, Rattus norvegicus
ataaccctgaacagacttttatgaa

SEQ ID NO: 168934 - DNA, 25 bp, Rattus norvegicus
ataaccctgaactgacttttatgaa

SEQ ID NO: 168935 - DNA, 25 bp, Rattus norvegicus
ataaccctggctatgcattgagaag

SEQ ID NO: 168936 - DNA, 25 bp, Rattus norvegicus
ataaccctggctttgcattgagaag

SEQ ID NO: 168937 - DNA, 25 bp, Rattus norvegicus
ataacccttgaccatagcactgttg

SEQ ID NO: 168938 - DNA, 25 bp, Rattus norvegicus
ataacccttgacgatagcactgttg

SEQ ID NO: 168939 - DNA, 25 bp, Rattus norvegicus
ataaccctttaacaatggattccag

SEQ ID NO: 168940 - DNA, 25 bp, Rattus norvegicus
ataaccctttaagaatggattccag

SEQ ID NO: 168941 - DNA, 25 bp, Rattus norvegicus
ataaccctttgtatcacataattgg

SEQ ID NO: 168942 - DNA, 25 bp, Rattus norvegicus
ataaccctttgtttcacataattgg

SEQ ID NO: 168943 - DNA, 25 bp, Rattus norvegicus
ataaccgaaaccatatcacacaggg

SEQ ID NO: 168944 - DNA, 25 bp, Rattus norvegicus
ataaccgaaaccttatcacacaggg

SEQ ID NO: 168945 - DNA, 25 bp, Rattus norvegicus
ataaccgaggtaccagagctgcgtc

SEQ ID NO: 168946 - DNA, 25 bp, Rattus norvegicus
ataaccgaggtagcagagctgcgtc

SEQ ID NO: 168947 - DNA, 25 bp, Rattus norvegicus
ataaccgcaagaaaactccgctcat

SEQ ID NO: 168948 - DNA, 25 bp, Rattus norvegicus
ataaccgcaagataactccgctcat

SEQ ID NO: 168949 - DNA, 25 bp, Rattus norvegicus
ataaccgcacaccattacacaatgt

SEQ ID NO: 168950 - DNA, 25 bp, Rattus norvegicus
ataaccgcacacgattacacaatgt

SEQ ID NO: 168951 - DNA, 25 bp, Rattus norvegicus
ataaccgcacggctattcagccaag

SEQ ID NO: 168952 - DNA, 25 bp, Rattus norvegicus
ataaccgcacgggtattcagccaag

SEQ ID NO: 168953 - DNA, 25 bp, Rattus norvegicus
ataaccgccttgagcctgtgagtaa

SEQ ID NO: 168954 - DNA, 25 bp, Rattus norvegicus
ataaccgccttgcacatgatttaaa

SEQ ID NO: 168955 - DNA, 25 bp, Rattus norvegicus
ataaccgccttggacatgatttaaa

SEQ ID NO: 168956 - DNA, 25 bp, Rattus norvegicus
ataaccgccttgtgcctgtgagtaa

SEQ ID NO: 168957 - DNA, 25 bp, Rattus norvegicus
ataaccgctctaacagacgtgtgcg

SEQ ID NO: 168958 - DNA, 25 bp, Rattus norvegicus
ataaccgctctatcagacgtgtgcg

SEQ ID NO: 168959 - DNA, 25 bp, Rattus norvegicus
ataaccgctggtacaacgggcaggc

SEQ ID NO: 168960 - DNA, 25 bp, Rattus norvegicus
ataaccgctggttcaacgggcaggc

SEQ ID NO: 168961 - DNA, 25 bp, Rattus norvegicus
ataaccgctttcctttcaaatgatt

SEQ ID NO: 168962 - DNA, 25 bp, Rattus norvegicus
ataaccgctttcgtttcaaatgatt

SEQ ID NO: 168963 - DNA, 25 bp, Rattus norvegicus
ataaccggcacaaggcctcctgtga

SEQ ID NO: 168964 - DNA, 25 bp, Rattus norvegicus
ataaccggcacatggcctcctgtga

SEQ ID NO: 168965 - DNA, 25 bp, Rattus norvegicus
ataaccggtttcaagttgctactgt

SEQ ID NO: 168966 - DNA, 25 bp, Rattus norvegicus
ataaccggtttctagttgctactgt

SEQ ID NO: 168967 - DNA, 25 bp, Rattus norvegicus
ataaccggtttgcaaaggactcgag

SEQ ID NO: 168968 - DNA, 25 bp, Rattus norvegicus
ataaccggtttggaaaggactcgag

SEQ ID NO: 168969 - DNA, 25 bp, Rattus norvegicus
ataaccgtggagacaggcagtgtac

SEQ ID NO: 168970 - DNA, 25 bp, Rattus norvegicus
ataaccgtggagtcaggcagtgtac

SEQ ID NO: 168971 - DNA, 25 bp, Rattus norvegicus
ataacctacctcaaatctgtcgttg

SEQ ID NO: 168972 - DNA, 25 bp, Rattus norvegicus
ataacctacctctaatctgtcgttg

SEQ ID NO: 168973 - DNA, 25 bp, Rattus norvegicus
ataacctaggccctccacagactgg

SEQ ID NO: 168974 - DNA, 25 bp, Rattus norvegicus
ataacctaggccgtccacagactgg

SEQ ID NO: 168975 - DNA, 25 bp, Rattus norvegicus
ataacctcaagcactctacgggaat

SEQ ID NO: 168976 - DNA, 25 bp, Rattus norvegicus
ataacctcaagctctctacgggaat

SEQ ID NO: 168977 - DNA, 25 bp, Rattus norvegicus
ataacctcatctaatttccatgcac

SEQ ID NO: 168978 - DNA, 25 bp, Rattus norvegicus
ataacctcatcttatttccatgcac

SEQ ID NO: 168979 - DNA, 25 bp, Rattus norvegicus
ataacctccagacactgcccagaga

SEQ ID NO: 168980 - DNA, 25 bp, Rattus norvegicus
ataacctccagagactgcccagaga

SEQ ID NO: 168981 - DNA, 25 bp, Rattus norvegicus
ataacctctgaactgagtgcctttg

SEQ ID NO: 168982 - DNA, 25 bp, Rattus norvegicus
ataacctctgaagtgagtgcctttg

SEQ ID NO: 168983 - DNA, 25 bp, Rattus norvegicus
ataacctcttccctgagaatacgtg

SEQ ID NO: 168984 - DNA, 25 bp, Rattus norvegicus
ataacctcttccgtgagaatacgtg

SEQ ID NO: 168985 - DNA, 25 bp, Rattus norvegicus
ataacctgaattcttgctcttccta

SEQ ID NO: 168986 - DNA, 25 bp, Rattus norvegicus
ataacctgaattgttgctcttccta

SEQ ID NO: 168987 - DNA, 25 bp, Rattus norvegicus
ataacctgaggtaggagaggaccac

SEQ ID NO: 168988 - DNA, 25 bp, Rattus norvegicus
ataacctgaggttggagaggaccac

SEQ ID NO: 168989 - DNA, 25 bp, Rattus norvegicus
ataacctgccatcgtgtccagaata

SEQ ID NO: 168990 - DNA, 25 bp, Rattus norvegicus
ataacctgccatggtgtccagaata

SEQ ID NO: 168991 - DNA, 25 bp, Rattus norvegicus
ataacctggattaacctggaactca

SEQ ID NO: 168992 - DNA, 25 bp, Rattus norvegicus
ataacctggatttacctggaactca

SEQ ID NO: 168993 - DNA, 25 bp, Rattus norvegicus
ataacctggcagacttactgggcct

SEQ ID NO: 168994 - DNA, 25 bp, Rattus norvegicus
ataacctggcagtcttactgggcct

SEQ ID NO: 168995 - DNA, 25 bp, Rattus norvegicus
ataacctggcctcatccaagatcta

SEQ ID NO: 168996 - DNA, 25 bp, Rattus norvegicus
ataacctggcctgatccaagatcta

SEQ ID NO: 168997 - DNA, 25 bp, Rattus norvegicus
ataacctgggcaactgctgctgcat

SEQ ID NO: 168998 - DNA, 25 bp, Rattus norvegicus
ataacctgggcatctgctgctgcat

SEQ ID NO: 168999 - DNA, 25 bp, Rattus norvegicus
ataacctggtaaaagactgggctga

SEQ ID NO: 169000 - DNA, 25 bp, Rattus norvegicus
ataacctggtaatagactgggctga

SEQ ID NO: 169001 - DNA, 25 bp, Rattus norvegicus
ataacctggtcccatctttctagga

SEQ ID NO: 169002 - DNA, 25 bp, Rattus norvegicus
ataacctggtccgatctttctagga

SEQ ID NO: 169003 - DNA, 25 bp, Rattus norvegicus
ataacctgtcctaacgtacaagcat

SEQ ID NO: 169004 - DNA, 25 bp, Rattus norvegicus
ataacctgtcctagcactgtggagt

SEQ ID NO: 169005 - DNA, 25 bp, Rattus norvegicus
ataacctgtccttacgtacaagcat

SEQ ID NO: 169006 - DNA, 25 bp, Rattus norvegicus
ataacctgtccttgcactgtggagt

SEQ ID NO: 169007 - DNA, 25 bp, Rattus norvegicus
ataacctgtgacagagaaatgccct

SEQ ID NO: 169008 - DNA, 25 bp, Rattus norvegicus
ataacctgtgactgagaaatgccct

SEQ ID NO: 169009 - DNA, 25 bp, Rattus norvegicus
ataacctgtggcacggtcatggtaa

SEQ ID NO: 169010 - DNA, 25 bp, Rattus norvegicus
ataacctgtggcatcagtcactgca

SEQ ID NO: 169011 - DNA, 25 bp, Rattus norvegicus
ataacctgtggctcggtcatggtaa

SEQ ID NO: 169012 - DNA, 25 bp, Rattus norvegicus
ataacctgtggcttcagtcactgca

SEQ ID NO: 169013 - DNA, 25 bp, Rattus norvegicus
ataacctgtggtccctgctgtgtaa

SEQ ID NO: 169014 - DNA, 25 bp, Rattus norvegicus
ataacctgtggtgcctgctgtgtaa

SEQ ID NO: 169015 - DNA, 25 bp, Rattus norvegicus
ataaccttactgacttttcaccttg

SEQ ID NO: 169016 - DNA, 25 bp, Rattus norvegicus
ataaccttactgtcttttcaccttg

SEQ ID NO: 169017 - DNA, 25 bp, Rattus norvegicus
ataaccttatctctagctgcatcaa

SEQ ID NO: 169018 - DNA, 25 bp, Rattus norvegicus
ataaccttatctgtagctgcatcaa

SEQ ID NO: 169019 - DNA, 25 bp, Rattus norvegicus
ataaccttcaacatctgactctgct

SEQ ID NO: 169020 - DNA, 25 bp, Rattus norvegicus
ataaccttcaacttctgactctgct

SEQ ID NO: 169021 - DNA, 25 bp, Rattus norvegicus
ataaccttcctgctagacaccacaa

SEQ ID NO: 169022 - DNA, 25 bp, Rattus norvegicus
ataaccttcctggtagacaccacaa

SEQ ID NO: 169023 - DNA, 25 bp, Rattus norvegicus
ataaccttggccaggtggctgctca

SEQ ID NO: 169024 - DNA, 25 bp, Rattus norvegicus
ataaccttggcctggtggctgctca

SEQ ID NO: 169025 - DNA, 25 bp, Rattus norvegicus
ataaccttgtctcgtggatgagaag

SEQ ID NO: 169026 - DNA, 25 bp, Rattus norvegicus
ataaccttgtctggtggatgagaag

SEQ ID NO: 169027 - DNA, 25 bp, Rattus norvegicus
ataacctttcagaggtcaagctccc

SEQ ID NO: 169028 - DNA, 25 bp, Rattus norvegicus
ataacctttcagtggtcaagctccc

SEQ ID NO: 169029 - DNA, 25 bp, Rattus norvegicus
ataacgaaaggaaccacccagtgaa

SEQ ID NO: 169030 - DNA, 25 bp, Rattus norvegicus
ataacgaaaggatccacccagtgaa

SEQ ID NO: 169031 - DNA, 25 bp, Rattus norvegicus
ataacgaacgacagcacgaggctgt

SEQ ID NO: 169032 - DNA, 25 bp, Rattus norvegicus
ataacgaacgactgcacgaggctgt

SEQ ID NO: 169033 - DNA, 25 bp, Rattus norvegicus
ataacgacaggccattctgagcaat

SEQ ID NO: 169034 - DNA, 25 bp, Rattus norvegicus
ataacgacaggcgattctgagcaat

SEQ ID NO: 169035 - DNA, 25 bp, Rattus norvegicus
ataacgacattgacagattaatttc

SEQ ID NO: 169036 - DNA, 25 bp, Rattus norvegicus
ataacgacattgtcagattaatttc

SEQ ID NO: 169037 - DNA, 25 bp, Rattus norvegicus
ataacgaccaaaccccgatgggatt

SEQ ID NO: 169038 - DNA, 25 bp, Rattus norvegicus
ataacgaccaaagcccgatgggatt

SEQ ID NO: 169039 - DNA, 25 bp, Rattus norvegicus
ataacgactcccaggcggtacctag

SEQ ID NO: 169040 - DNA, 25 bp, Rattus norvegicus
ataacgactccctggcggtacctag

SEQ ID NO: 169041 - DNA, 25 bp, Rattus norvegicus
ataacgcatcccctgagaaagcaca

SEQ ID NO: 169042 - DNA, 25 bp, Rattus norvegicus
ataacgcatcccgtgagaaagcaca

SEQ ID NO: 169043 - DNA, 25 bp, Rattus norvegicus
ataacgccaagtatgcagtgtcgat

SEQ ID NO: 169044 - DNA, 25 bp, Rattus norvegicus
ataacgccaagtttgcagtgtcgat

SEQ ID NO: 169045 - DNA, 25 bp, Rattus norvegicus
ataacgccctggaggcttttatcag

SEQ ID NO: 169046 - DNA, 25 bp, Rattus norvegicus
ataacgccctggtggcttttatcag

SEQ ID NO: 169047 - DNA, 25 bp, Rattus norvegicus
ataacgcgcgcaagcagttcgtcat

SEQ ID NO: 169048 - DNA, 25 bp, Rattus norvegicus
ataacgcgcgcatgcagttcgtcat

SEQ ID NO: 169049 - DNA, 25 bp, Rattus norvegicus
ataacgcggcgtaagctgccatcgc

SEQ ID NO: 169050 - DNA, 25 bp, Rattus norvegicus
ataacgcggcgttagctgccatcgc

SEQ ID NO: 169051 - DNA, 25 bp, Rattus norvegicus
ataacgctaactatgtatggatgac

SEQ ID NO: 169052 - DNA, 25 bp, Rattus norvegicus
ataacgctaactttgtatggatgac

SEQ ID NO: 169053 - DNA, 25 bp, Rattus norvegicus
ataacgctggtgctgtccatatgtc

SEQ ID NO: 169054 - DNA, 25 bp, Rattus norvegicus
ataacgctggtggtgtccatatgtc

SEQ ID NO: 169055 - DNA, 25 bp, Rattus norvegicus
ataacgtacatgacacctgctaaga

SEQ ID NO: 169056 - DNA, 25 bp, Rattus norvegicus
ataacgtacatgtcacctgctaaga

SEQ ID NO: 169057 - DNA, 25 bp, Rattus norvegicus
ataacgtcctatctggtcctatgag

SEQ ID NO: 169058 - DNA, 25 bp, Rattus norvegicus
ataacgtcctatgtggtcctatgag

SEQ ID NO: 169059 - DNA, 25 bp, Rattus norvegicus
ataacgtctttacctcttcctttga

SEQ ID NO: 169060 - DNA, 25 bp, Rattus norvegicus
ataacgtctttagctcttcctttga

SEQ ID NO: 169061 - DNA, 25 bp, Rattus norvegicus
ataacgtgcactcaagacctacctc

SEQ ID NO: 169062 - DNA, 25 bp, Rattus norvegicus
ataacgtgcactgaagacctacctc

SEQ ID NO: 169063 - DNA, 25 bp, Rattus norvegicus
ataacgtggtgaatcctcaggctac

SEQ ID NO: 169064 - DNA, 25 bp, Rattus norvegicus
ataacgtggtgattcctcaggctac

SEQ ID NO: 169065 - DNA, 25 bp, Rattus norvegicus
ataacgtgtcacaaatcatttaagt

SEQ ID NO: 169066 - DNA, 25 bp, Rattus norvegicus
ataacgtgtcactaatcatttaagt

SEQ ID NO: 169067 - DNA, 25 bp, Rattus norvegicus
ataactaaagctcggtgccttctca

SEQ ID NO: 169068 - DNA, 25 bp, Rattus norvegicus
ataactaaagctgggtgccttctca

SEQ ID NO: 169069 - DNA, 25 bp, Rattus norvegicus
ataactacaacacttaccggtcacg

SEQ ID NO: 169070 - DNA, 25 bp, Rattus norvegicus
ataactacaacagttaccggtcacg

SEQ ID NO: 169071 - DNA, 25 bp, Rattus norvegicus
ataactacagtacatctctgaggaa

SEQ ID NO: 169072 - DNA, 25 bp, Rattus norvegicus
ataactacagtagatctctgaggaa

SEQ ID NO: 169073 - DNA, 25 bp, Rattus norvegicus
ataactacagtcaagacctcctggc

SEQ ID NO: 169074 - DNA, 25 bp, Rattus norvegicus
ataactacagtctagacctcctggc

SEQ ID NO: 169075 - DNA, 25 bp, Rattus norvegicus
ataactaccacacacttgcttacaa

SEQ ID NO: 169076 - DNA, 25 bp, Rattus norvegicus
ataactaccacagacttgcttacaa

SEQ ID NO: 169077 - DNA, 25 bp, Rattus norvegicus
ataactaccgtgactgtgcttttca

SEQ ID NO: 169078 - DNA, 25 bp, Rattus norvegicus
ataactaccgtgtctgtgcttttca

SEQ ID NO: 169079 - DNA, 25 bp, Rattus norvegicus
ataactacctgtattgccgggtcag

SEQ ID NO: 169080 - DNA, 25 bp, Rattus norvegicus
ataactacctgttttgccgggtcag

SEQ ID NO: 169081 - DNA, 25 bp, Rattus norvegicus
ataactactcagacttcttcctgat

SEQ ID NO: 169082 - DNA, 25 bp, Rattus norvegicus
ataactactcagtcttcttcctgat

SEQ ID NO: 169083 - DNA, 25 bp, Rattus norvegicus
ataactagacagagaaacgaactct

SEQ ID NO: 169084 - DNA, 25 bp, Rattus norvegicus
ataactagacagtgaaacgaactct

SEQ ID NO: 169085 - DNA, 25 bp, Rattus norvegicus
ataactagcaatcctcttccagagc

SEQ ID NO: 169086 - DNA, 25 bp, Rattus norvegicus
ataactagcaatgctcttccagagc

SEQ ID NO: 169087 - DNA, 25 bp, Rattus norvegicus
ataactagggtacctgaggccccgc

SEQ ID NO: 169088 - DNA, 25 bp, Rattus norvegicus
ataactagggtagctgaggccccgc

SEQ ID NO: 169089 - DNA, 25 bp, Rattus norvegicus
ataactatcgctccaaattactcct

SEQ ID NO: 169090 - DNA, 25 bp, Rattus norvegicus
ataactatcgctgcaaattactcct

SEQ ID NO: 169091 - DNA, 25 bp, Rattus norvegicus
ataactattcatcccaacccgtttg

SEQ ID NO: 169092 - DNA, 25 bp, Rattus norvegicus
ataactattcatgccaacccgtttg

SEQ ID NO: 169093 - DNA, 25 bp, Rattus norvegicus
ataactattgatatgtcttcagagt

SEQ ID NO: 169094 - DNA, 25 bp, Rattus norvegicus
ataactattgatttgtcttcagagt

SEQ ID NO: 169095 - DNA, 25 bp, Rattus norvegicus
ataactcaattcatttgctcaagga

SEQ ID NO: 169096 - DNA, 25 bp, Rattus norvegicus
ataactcaattcttttgctcaagga

SEQ ID NO: 169097 - DNA, 25 bp, Rattus norvegicus
ataactcacatgatgagaaccactg

SEQ ID NO: 169098 - DNA, 25 bp, Rattus norvegicus
ataactcacatgttgagaaccactg

SEQ ID NO: 169099 - DNA, 25 bp, Rattus norvegicus
ataactcactgcaacacttgcaact

SEQ ID NO: 169100 - DNA, 25 bp, Rattus norvegicus
ataactcactgctacacttgcaact

SEQ ID NO: 169101 - DNA, 25 bp, Rattus norvegicus
ataactcagctgaacacttcacgtg

SEQ ID NO: 169102 - DNA, 25 bp, Rattus norvegicus
ataactcagctgtacacttcacgtg

SEQ ID NO: 169103 - DNA, 25 bp, Rattus norvegicus
ataactcagtgaaaacagatttttt

SEQ ID NO: 169104 - DNA, 25 bp, Rattus norvegicus
ataactcagtgataacagatttttt

SEQ ID NO: 169105 - DNA, 25 bp, Rattus norvegicus
ataactcatcagctctcgcctcttt

SEQ ID NO: 169106 - DNA, 25 bp, Rattus norvegicus
ataactcatcaggtctcgcctcttt

SEQ ID NO: 169107 - DNA, 25 bp, Rattus norvegicus
ataactcatgctcatgtcaccttaa

SEQ ID NO: 169108 - DNA, 25 bp, Rattus norvegicus
ataactcatgctgatgtcaccttaa

SEQ ID NO: 169109 - DNA, 25 bp, Rattus norvegicus
ataactcattacactctttaagatc

SEQ ID NO: 169110 - DNA, 25 bp, Rattus norvegicus
ataactcattactctctttaagatc

SEQ ID NO: 169111 - DNA, 25 bp, Rattus norvegicus
ataactccaaggctgtgtgtgacac

SEQ ID NO: 169112 - DNA, 25 bp, Rattus norvegicus
ataactccaagggtgtgtgtgacac

SEQ ID NO: 169113 - DNA, 25 bp, Rattus norvegicus
ataactccagttctatgggatccca

SEQ ID NO: 169114 - DNA, 25 bp, Rattus norvegicus
ataactccagttgtatgggatccca

SEQ ID NO: 169115 - DNA, 25 bp, Rattus norvegicus
ataactcccattccagtgacccagt

SEQ ID NO: 169116 - DNA, 25 bp, Rattus norvegicus
ataactcccattgcagtgacccagt

SEQ ID NO: 169117 - DNA, 25 bp, Rattus norvegicus
ataactccctcaacaaaggtttatg

SEQ ID NO: 169118 - DNA, 25 bp, Rattus norvegicus
ataactccctcatcaaaggtttatg

SEQ ID NO: 169119 - DNA, 25 bp, Rattus norvegicus
ataactcctactaaagtgcctgaca

SEQ ID NO: 169120 - DNA, 25 bp, Rattus norvegicus
ataactcctacttaagtgcctgaca

SEQ ID NO: 169121 - DNA, 25 bp, Rattus norvegicus
ataactcctcaccatactgatttac

SEQ ID NO: 169122 - DNA, 25 bp, Rattus norvegicus
ataactcctcacgatactgatttac

SEQ ID NO: 169123 - DNA, 25 bp, Rattus norvegicus
ataactcctgtacctcactgtacat

SEQ ID NO: 169124 - DNA, 25 bp, Rattus norvegicus
ataactcctgtagctcactgtacat

SEQ ID NO: 169125 - DNA, 25 bp, Rattus norvegicus
ataactccttcccaagttaagagtg

SEQ ID NO: 169126 - DNA, 25 bp, Rattus norvegicus
ataactccttccgaagttaagagtg

SEQ ID NO: 169127 - DNA, 25 bp, Rattus norvegicus
ataactcggcatctgacctgaagca

SEQ ID NO: 169128 - DNA, 25 bp, Rattus norvegicus
ataactcggcatgtgacctgaagca

SEQ ID NO: 169129 - DNA, 25 bp, Rattus norvegicus
ataactcgtattccagctctaatag

SEQ ID NO: 169130 - DNA, 25 bp, Rattus norvegicus
ataactcgtattgcagctctaatag

SEQ ID NO: 169131 - DNA, 25 bp, Rattus norvegicus
ataactctagaccaattatgagcca

SEQ ID NO: 169132 - DNA, 25 bp, Rattus norvegicus
ataactctagacgaattatgagcca

SEQ ID NO: 169133 - DNA, 25 bp, Rattus norvegicus
ataactctctacacaatcaggcgat

SEQ ID NO: 169134 - DNA, 25 bp, Rattus norvegicus
ataactctctactcaatcaggcgat

SEQ ID NO: 169135 - DNA, 25 bp, Rattus norvegicus
ataactctcttaacttccacatttc

SEQ ID NO: 169136 - DNA, 25 bp, Rattus norvegicus
ataactctcttatcttccacatttc

SEQ ID NO: 169137 - DNA, 25 bp, Rattus norvegicus
ataactcttaataatcctgcccatc

SEQ ID NO: 169138 - DNA, 25 bp, Rattus norvegicus
ataactcttaattatcctgcccatc

SEQ ID NO: 169139 - DNA, 25 bp, Rattus norvegicus
ataactctttacagcttttgccttg

SEQ ID NO: 169140 - DNA, 25 bp, Rattus norvegicus
ataactctttactgcttttgccttg

SEQ ID NO: 169141 - DNA, 25 bp, Rattus norvegicus
ataactctttctcattaggccactt

SEQ ID NO: 169142 - DNA, 25 bp, Rattus norvegicus
ataactctttctgattaggccactt

SEQ ID NO: 169143 - DNA, 25 bp, Rattus norvegicus
ataactgaacatctctgccacttct

SEQ ID NO: 169144 - DNA, 25 bp, Rattus norvegicus
ataactgaacatgtctgccacttct

SEQ ID NO: 169145 - DNA, 25 bp, Rattus norvegicus
ataactgaatggaccctggcaatgg

SEQ ID NO: 169146 - DNA, 25 bp, Rattus norvegicus
ataactgaatggtccctggcaatgg

SEQ ID NO: 169147 - DNA, 25 bp, Rattus norvegicus
ataactgacgcgaagcttctgtatc

SEQ ID NO: 169148 - DNA, 25 bp, Rattus norvegicus
ataactgacgcgtagcttctgtatc

SEQ ID NO: 169149 - DNA, 25 bp, Rattus norvegicus
ataactgagcacatggacttcttag

SEQ ID NO: 169150 - DNA, 25 bp, Rattus norvegicus
ataactgagcacttggacttcttag

SEQ ID NO: 169151 - DNA, 25 bp, Rattus norvegicus
ataactgatgttacctggcgattgg

SEQ ID NO: 169152 - DNA, 25 bp, Rattus norvegicus
ataactgatgtttcctggcgattgg

SEQ ID NO: 169153 - DNA, 25 bp, Rattus norvegicus
ataactgatttccttgcttaacaaa

SEQ ID NO: 169154 - DNA, 25 bp, Rattus norvegicus
ataactgatttcgttgcttaacaaa

SEQ ID NO: 169155 - DNA, 25 bp, Rattus norvegicus
ataactgcagagacggctgctctgt

SEQ ID NO: 169156 - DNA, 25 bp, Rattus norvegicus
ataactgcagagtcggctgctctgt

SEQ ID NO: 169157 - DNA, 25 bp, Rattus norvegicus
ataactgcaggtccttatggtgccg

SEQ ID NO: 169158 - DNA, 25 bp, Rattus norvegicus
ataactgcaggtgcttatggtgccg

SEQ ID NO: 169159 - DNA, 25 bp, Rattus norvegicus
ataactgcccaaattttggtgctga

SEQ ID NO: 169160 - DNA, 25 bp, Rattus norvegicus
ataactgcccaatttttggtgctga

SEQ ID NO: 169161 - DNA, 25 bp, Rattus norvegicus
ataactgcctagaggcctgaggccc

SEQ ID NO: 169162 - DNA, 25 bp, Rattus norvegicus
ataactgcctagtggcctgaggccc

SEQ ID NO: 169163 - DNA, 25 bp, Rattus norvegicus
ataactgctcatattctatcctggc

SEQ ID NO: 169164 - DNA, 25 bp, Rattus norvegicus
ataactgctcattttctatcctggc

SEQ ID NO: 169165 - DNA, 25 bp, Rattus norvegicus
ataactgctctcctagagatcctga

SEQ ID NO: 169166 - DNA, 25 bp, Rattus norvegicus
ataactgctctcgtagagatcctga

SEQ ID NO: 169167 - DNA, 25 bp, Rattus norvegicus
ataactgctgcacctttcaccaatg

SEQ ID NO: 169168 - DNA, 25 bp, Rattus norvegicus
ataactgctgcagctttcaccaatg

SEQ ID NO: 169169 - DNA, 25 bp, Rattus norvegicus
ataactgctgctaatgagcccaagt

SEQ ID NO: 169170 - DNA, 25 bp, Rattus norvegicus
ataactgctgcttatgagcccaagt

SEQ ID NO: 169171 - DNA, 25 bp, Rattus norvegicus
ataactgcttacctgcagctagcct

SEQ ID NO: 169172 - DNA, 25 bp, Rattus norvegicus
ataactgcttacgtgcagctagcct

SEQ ID NO: 169173 - DNA, 25 bp, Rattus norvegicus
ataactgcttcacatttcacatgcc

SEQ ID NO: 169174 - DNA, 25 bp, Rattus norvegicus
ataactgcttcagatttcacatgcc

SEQ ID NO: 169175 - DNA, 25 bp, Rattus norvegicus
ataactgctttcatacctagctagg

SEQ ID NO: 169176 - DNA, 25 bp, Rattus norvegicus
ataactgctttcttacctagctagg

SEQ ID NO: 169177 - DNA, 25 bp, Rattus norvegicus
ataactggagaacagtgtcctaaac

SEQ ID NO: 169178 - DNA, 25 bp, Rattus norvegicus
ataactggagaagagtgtcctaaac

SEQ ID NO: 169179 - DNA, 25 bp, Rattus norvegicus
ataactggcttcataggtggcttct

SEQ ID NO: 169180 - DNA, 25 bp, Rattus norvegicus
ataactggcttcttaggtggcttct

SEQ ID NO: 169181 - DNA, 25 bp, Rattus norvegicus
ataactgggcagaggagtacccttt

SEQ ID NO: 169182 - DNA, 25 bp, Rattus norvegicus
ataactgggcagtggagtacccttt

SEQ ID NO: 169183 - DNA, 25 bp, Rattus norvegicus
ataactggttatctctggtgtcaca

SEQ ID NO: 169184 - DNA, 25 bp, Rattus norvegicus
ataactggttatgtctggtgtcaca

SEQ ID NO: 169185 - DNA, 25 bp, Rattus norvegicus
ataactgtacagagctcaccttaag

SEQ ID NO: 169186 - DNA, 25 bp, Rattus norvegicus
ataactgtacagtgctcaccttaag

SEQ ID NO: 169187 - DNA, 25 bp, Rattus norvegicus
ataactgtccagagatgcctgacca

SEQ ID NO: 169188 - DNA, 25 bp, Rattus norvegicus
ataactgtccagtgatgcctgacca

SEQ ID NO: 169189 - DNA, 25 bp, Rattus norvegicus
ataactgtcccaagagaagctttgt

SEQ ID NO: 169190 - DNA, 25 bp, Rattus norvegicus
ataactgtcccatgagaagctttgt

SEQ ID NO: 169191 - DNA, 25 bp, Rattus norvegicus
ataactgtctggcaggtcactcact

SEQ ID NO: 169192 - DNA, 25 bp, Rattus norvegicus
ataactgtctgggaggtcactcact

SEQ ID NO: 169193 - DNA, 25 bp, Rattus norvegicus
ataactgtcttcacagagctactgt

SEQ ID NO: 169194 - DNA, 25 bp, Rattus norvegicus
ataactgtcttctcagagctactgt

SEQ ID NO: 169195 - DNA, 25 bp, Rattus norvegicus
ataactgtgaaccaccatatgggtg

SEQ ID NO: 169196 - DNA, 25 bp, Rattus norvegicus
ataactgtgaacgaccatatgggtg

SEQ ID NO: 169197 - DNA, 25 bp, Rattus norvegicus
ataactgttctcagaaagaccccct

SEQ ID NO: 169198 - DNA, 25 bp, Rattus norvegicus
ataactgttctctgaaagaccccct

SEQ ID NO: 169199 - DNA, 25 bp, Rattus norvegicus
ataactgttttgaccgtttgctgtg

SEQ ID NO: 169200 - DNA, 25 bp, Rattus norvegicus
ataactgttttgtccgtttgctgtg

SEQ ID NO: 169201 - DNA, 25 bp, Rattus norvegicus
ataacttacagaactcctcttcagt

SEQ ID NO: 169202 - DNA, 25 bp, Rattus norvegicus
ataacttacagatctcctcttcagt

SEQ ID NO: 169203 - DNA, 25 bp, Rattus norvegicus
ataacttatatgatgccttcaatgc

SEQ ID NO: 169204 - DNA, 25 bp, Rattus norvegicus
ataacttatatgttgccttcaatgc

SEQ ID NO: 169205 - DNA, 25 bp, Rattus norvegicus
ataacttatcaactccatcttccaa

SEQ ID NO: 169206 - DNA, 25 bp, Rattus norvegicus
ataacttatcaagtccatcttccaa

SEQ ID NO: 169207 - DNA, 25 bp, Rattus norvegicus
ataacttattccaaactacatatag

SEQ ID NO: 169208 - DNA, 25 bp, Rattus norvegicus
ataacttattcctaactacatatag

SEQ ID NO: 169209 - DNA, 25 bp, Rattus norvegicus
ataacttatttcatatatggccaag

SEQ ID NO: 169210 - DNA, 25 bp, Rattus norvegicus
ataacttatttcttatatggccaag

SEQ ID NO: 169211 - DNA, 25 bp, Rattus norvegicus
ataacttatttgcacacctttcttg

SEQ ID NO: 169212 - DNA, 25 bp, Rattus norvegicus
ataacttatttggacacctttcttg

SEQ ID NO: 169213 - DNA, 25 bp, Rattus norvegicus
ataacttccagactttgtacaacat

SEQ ID NO: 169214 - DNA, 25 bp, Rattus norvegicus
ataacttccagagtttgtacaacat

SEQ ID NO: 169215 - DNA, 25 bp, Rattus norvegicus
ataacttgatgaagagcctggacaa

SEQ ID NO: 169216 - DNA, 25 bp, Rattus norvegicus
ataacttgatgatgagcctggacaa

SEQ ID NO: 169217 - DNA, 25 bp, Rattus norvegicus
ataacttgcctgagcacagtgctgc

SEQ ID NO: 169218 - DNA, 25 bp, Rattus norvegicus
ataacttgcctgtgcacagtgctgc

SEQ ID NO: 169219 - DNA, 25 bp, Rattus norvegicus
ataacttgctctccattttccttca

SEQ ID NO: 169220 - DNA, 25 bp, Rattus norvegicus
ataacttgctctccctgctgcgttg

SEQ ID NO: 169221 - DNA, 25 bp, Rattus norvegicus
ataacttgctctgcattttccttca

SEQ ID NO: 169222 - DNA, 25 bp, Rattus norvegicus
ataacttgctctgcctgctgcgttg

SEQ ID NO: 169223 - DNA, 25 bp, Rattus norvegicus
ataacttggcttcacattcttcgga

SEQ ID NO: 169224 - DNA, 25 bp, Rattus norvegicus
ataacttggcttgacattcttcgga

SEQ ID NO: 169225 - DNA, 25 bp, Rattus norvegicus
ataacttgggttacacggactgtgc

SEQ ID NO: 169226 - DNA, 25 bp, Rattus norvegicus
ataacttgggtttcacggactgtgc

SEQ ID NO: 169227 - DNA, 25 bp, Rattus norvegicus
ataacttgtatactgcctcctctgt

SEQ ID NO: 169228 - DNA, 25 bp, Rattus norvegicus
ataacttgtatagtgcctcctctgt

SEQ ID NO: 169229 - DNA, 25 bp, Rattus norvegicus
ataacttgtccaagtttgccatcac

SEQ ID NO: 169230 - DNA, 25 bp, Rattus norvegicus
ataacttgtccatgtttgccatcac

SEQ ID NO: 169231 - DNA, 25 bp, Rattus norvegicus
ataactttagtcattccacccagct

SEQ ID NO: 169232 - DNA, 25 bp, Rattus norvegicus
ataactttagtctttccacccagct

SEQ ID NO: 169233 - DNA, 25 bp, Rattus norvegicus
ataactttccttcaagtgagctgct

SEQ ID NO: 169234 - DNA, 25 bp, Rattus norvegicus
ataactttccttcccaaagctctgg

SEQ ID NO: 169235 - DNA, 25 bp, Rattus norvegicus
ataactttccttctgggtatgcgtg

SEQ ID NO: 169236 - DNA, 25 bp, Rattus norvegicus
ataactttccttgaagtgagctgct

SEQ ID NO: 169237 - DNA, 25 bp, Rattus norvegicus
ataactttccttgccaaagctctgg

SEQ ID NO: 169238 - DNA, 25 bp, Rattus norvegicus
ataactttccttgtgggtatgcgtg

SEQ ID NO: 169239 - DNA, 25 bp, Rattus norvegicus
ataactttcttaagaggcagattta

SEQ ID NO: 169240 - DNA, 25 bp, Rattus norvegicus
ataactttcttaccactttctctgt

SEQ ID NO: 169241 - DNA, 25 bp, Rattus norvegicus
ataactttcttagcactttctctgt

SEQ ID NO: 169242 - DNA, 25 bp, Rattus norvegicus
ataactttcttatgaggcagattta

SEQ ID NO: 169243 - DNA, 25 bp, Rattus norvegicus
ataactttgaaactccggcgcgtcg

SEQ ID NO: 169244 - DNA, 25 bp, Rattus norvegicus
ataactttgaaagtccggcgcgtcg

SEQ ID NO: 169245 - DNA, 25 bp, Rattus norvegicus
ataactttgcaactgtaatcctgta

SEQ ID NO: 169246 - DNA, 25 bp, Rattus norvegicus
ataactttgcaagtgtaatcctgta

SEQ ID NO: 169247 - DNA, 25 bp, Rattus norvegicus
ataactttgctcatattatctgatg

SEQ ID NO: 169248 - DNA, 25 bp, Rattus norvegicus
ataactttgctcttattatctgatg

SEQ ID NO: 169249 - DNA, 25 bp, Rattus norvegicus
ataacttttatactgtggcgcctgt

SEQ ID NO: 169250 - DNA, 25 bp, Rattus norvegicus
ataacttttatagtgtggcgcctgt

SEQ ID NO: 169251 - DNA, 25 bp, Rattus norvegicus
ataagaaatctacgcttctctcctt

SEQ ID NO: 169252 - DNA, 25 bp, Rattus norvegicus
ataagaaatctaggcttctctcctt

SEQ ID NO: 169253 - DNA, 25 bp, Rattus norvegicus
ataagaacagcaacgagtaccgggt

SEQ ID NO: 169254 - DNA, 25 bp, Rattus norvegicus
ataagaacagcatcgagtaccgggt

SEQ ID NO: 169255 - DNA, 25 bp, Rattus norvegicus
ataagaaccaacagccatctgcctt

SEQ ID NO: 169256 - DNA, 25 bp, Rattus norvegicus
ataagaaccaactgccatctgcctt

SEQ ID NO: 169257 - DNA, 25 bp, Rattus norvegicus
ataagaaccaagactcagggctttt

SEQ ID NO: 169258 - DNA, 25 bp, Rattus norvegicus
ataagaaccaagactgccacatcag

SEQ ID NO: 169259 - DNA, 25 bp, Rattus norvegicus
ataagaaccaagtctcagggctttt

SEQ ID NO: 169260 - DNA, 25 bp, Rattus norvegicus
ataagaaccaagtctgccacatcag

SEQ ID NO: 169261 - DNA, 25 bp, Rattus norvegicus
ataagaactccacatcctcatcttc

SEQ ID NO: 169262 - DNA, 25 bp, Rattus norvegicus
ataagaactccagatcctcatcttc

SEQ ID NO: 169263 - DNA, 25 bp, Rattus norvegicus
ataagaaggcatccgcttcgggact

SEQ ID NO: 169264 - DNA, 25 bp, Rattus norvegicus
ataagaaggcatgcgcttcgggact

SEQ ID NO: 169265 - DNA, 25 bp, Rattus norvegicus
ataagaagtctccaggtgaccctgt

SEQ ID NO: 169266 - DNA, 25 bp, Rattus norvegicus
ataagaagtctcgaggtgaccctgt

SEQ ID NO: 169267 - DNA, 25 bp, Rattus norvegicus
ataagaatgcccacagttcagctca

SEQ ID NO: 169268 - DNA, 25 bp, Rattus norvegicus
ataagaatgcccacccctggaatct

SEQ ID NO: 169269 - DNA, 25 bp, Rattus norvegicus
ataagaatgccctcagttcagctca

SEQ ID NO: 169270 - DNA, 25 bp, Rattus norvegicus
ataagaatgccctcccctggaatct

SEQ ID NO: 169271 - DNA, 25 bp, Rattus norvegicus
ataagaatgtagagacccgggagca

SEQ ID NO: 169272 - DNA, 25 bp, Rattus norvegicus
ataagaatgtagtgacccgggagca

SEQ ID NO: 169273 - DNA, 25 bp, Rattus norvegicus
ataagaattagtatggccttttgcc

SEQ ID NO: 169274 - DNA, 25 bp, Rattus norvegicus
ataagaattagtttggccttttgcc

SEQ ID NO: 169275 - DNA, 25 bp, Rattus norvegicus
ataagacagcatcggattccctggg

SEQ ID NO: 169276 - DNA, 25 bp, Rattus norvegicus
ataagacagcatgggattccctggg

SEQ ID NO: 169277 - DNA, 25 bp, Rattus norvegicus
ataagacatacgcagcactgctgca

SEQ ID NO: 169278 - DNA, 25 bp, Rattus norvegicus
ataagacatacggagcactgctgca

SEQ ID NO: 169279 - DNA, 25 bp, Rattus norvegicus
ataagacatgtgagccaccccagag

SEQ ID NO: 169280 - DNA, 25 bp, Rattus norvegicus
ataagacatgtgtgccaccccagag

SEQ ID NO: 169281 - DNA, 25 bp, Rattus norvegicus
ataagaccagtgactctcctgtagt

SEQ ID NO: 169282 - DNA, 25 bp, Rattus norvegicus
ataagaccagtgtctctcctgtagt

SEQ ID NO: 169283 - DNA, 25 bp, Rattus norvegicus
ataagaccctacacagtttcagctc

SEQ ID NO: 169284 - DNA, 25 bp, Rattus norvegicus
ataagaccctactcagtttcagctc

SEQ ID NO: 169285 - DNA, 25 bp, Rattus norvegicus
ataagacctgcgagtctacctacaa

SEQ ID NO: 169286 - DNA, 25 bp, Rattus norvegicus
ataagacctgcgtgtctacctacaa

SEQ ID NO: 169287 - DNA, 25 bp, Rattus norvegicus
ataagactcgaccaagaccggctgc

SEQ ID NO: 169288 - DNA, 25 bp, Rattus norvegicus
ataagactcgacgaagaccggctgc

SEQ ID NO: 169289 - DNA, 25 bp, Rattus norvegicus
ataagactgccaccgaccaagcaac

SEQ ID NO: 169290 - DNA, 25 bp, Rattus norvegicus
ataagactgccagcgaccaagcaac

SEQ ID NO: 169291 - DNA, 25 bp, Rattus norvegicus
ataagactgggtccagcctgttgac

SEQ ID NO: 169292 - DNA, 25 bp, Rattus norvegicus
ataagactgggtgcagcctgttgac

SEQ ID NO: 169293 - DNA, 25 bp, Rattus norvegicus
ataagacttgtaaagcagtgccagc

SEQ ID NO: 169294 - DNA, 25 bp, Rattus norvegicus
ataagacttgtatagcagtgccagc

SEQ ID NO: 169295 - DNA, 25 bp, Rattus norvegicus
ataagacttgtccagccggtaccag

SEQ ID NO: 169296 - DNA, 25 bp, Rattus norvegicus
ataagacttgtcgagccggtaccag

SEQ ID NO: 169297 - DNA, 25 bp, Rattus norvegicus
ataagactttttcccatcatatggt

SEQ ID NO: 169298 - DNA, 25 bp, Rattus norvegicus
ataagactttttgccatcatatggt

SEQ ID NO: 169299 - DNA, 25 bp, Rattus norvegicus
ataagagaactgactccgtctggga

SEQ ID NO: 169300 - DNA, 25 bp, Rattus norvegicus
ataagagaactgtctccgtctggga

SEQ ID NO: 169301 - DNA, 25 bp, Rattus norvegicus
ataagagaagctccgcagcatgagg

SEQ ID NO: 169302 - DNA, 25 bp, Rattus norvegicus
ataagagaagctgcgcagcatgagg

SEQ ID NO: 169303 - DNA, 25 bp, Rattus norvegicus
ataagagaccctcgctgcctttaac

SEQ ID NO: 169304 - DNA, 25 bp, Rattus norvegicus
ataagagaccctggctgcctttaac

SEQ ID NO: 169305 - DNA, 25 bp, Rattus norvegicus
ataagagaggctccctcttcccaca

SEQ ID NO: 169306 - DNA, 25 bp, Rattus norvegicus
ataagagaggctgcctcttcccaca

SEQ ID NO: 169307 - DNA, 25 bp, Rattus norvegicus
ataagagcaggcctaccgactgaac

SEQ ID NO: 169308 - DNA, 25 bp, Rattus norvegicus
ataagagcaggcgtaccgactgaac

SEQ ID NO: 169309 - DNA, 25 bp, Rattus norvegicus
ataagagccagacccgaggcaacat

SEQ ID NO: 169310 - DNA, 25 bp, Rattus norvegicus
ataagagccagagccgaggcaacat

SEQ ID NO: 169311 - DNA, 25 bp, Rattus norvegicus
ataagagcccctcacatttcacaga

SEQ ID NO: 169312 - DNA, 25 bp, Rattus norvegicus
ataagagcccctgacatttcacaga

SEQ ID NO: 169313 - DNA, 25 bp, Rattus norvegicus
ataagagcccttcgcgttcagaatt

SEQ ID NO: 169314 - DNA, 25 bp, Rattus norvegicus
ataagagcccttggcgttcagaatt

SEQ ID NO: 169315 - DNA, 25 bp, Rattus norvegicus
ataagagcttaaatgggccagatca

SEQ ID NO: 169316 - DNA, 25 bp, Rattus norvegicus
ataagagcttaattgggccagatca

SEQ ID NO: 169317 - DNA, 25 bp, Rattus norvegicus
ataagagcttgtccttctcttgccg

SEQ ID NO: 169318 - DNA, 25 bp, Rattus norvegicus
ataagagcttgtgcttctcttgccg

SEQ ID NO: 169319 - DNA, 25 bp, Rattus norvegicus
ataagaggagccatattgacatttg

SEQ ID NO: 169320 - DNA, 25 bp, Rattus norvegicus
ataagaggagcccattgcccgtccc

SEQ ID NO: 169321 - DNA, 25 bp, Rattus norvegicus
ataagaggagccgattgcccgtccc

SEQ ID NO: 169322 - DNA, 25 bp, Rattus norvegicus
ataagaggagccttattgacatttg

SEQ ID NO: 169323 - DNA, 25 bp, Rattus norvegicus
ataagagggactacgttccccgctg

SEQ ID NO: 169324 - DNA, 25 bp, Rattus norvegicus
ataagagggacttcgttccccgctg

SEQ ID NO: 169325 - DNA, 25 bp, Rattus norvegicus
ataagagggccactaccgaggaccg

SEQ ID NO: 169326 - DNA, 25 bp, Rattus norvegicus
ataagagggccagtaccgaggaccg

SEQ ID NO: 169327 - DNA, 25 bp, Rattus norvegicus
ataagagtaccacatcatcatccct

SEQ ID NO: 169328 - DNA, 25 bp, Rattus norvegicus
ataagagtaccagatcatcatccct

SEQ ID NO: 169329 - DNA, 25 bp, Rattus norvegicus
ataagagtcagaaaggacctcaggg

SEQ ID NO: 169330 - DNA, 25 bp, Rattus norvegicus
ataagagtcagataggacctcaggg

SEQ ID NO: 169331 - DNA, 25 bp, Rattus norvegicus
ataagagtcttcatctcttctcttc

SEQ ID NO: 169332 - DNA, 25 bp, Rattus norvegicus
ataagagtcttcttctcttctcttc

SEQ ID NO: 169333 - DNA, 25 bp, Rattus norvegicus
ataagagtgaccaggcccgttcccg

SEQ ID NO: 169334 - DNA, 25 bp, Rattus norvegicus
ataagagtgacctggcccgttcccg

SEQ ID NO: 169335 - DNA, 25 bp, Rattus norvegicus
ataagagtgtgacctgttccccaga

SEQ ID NO: 169336 - DNA, 25 bp, Rattus norvegicus
ataagagtgtgagctgttccccaga

SEQ ID NO: 169337 - DNA, 25 bp, Rattus norvegicus
ataagatcccacactggaagcaaag

SEQ ID NO: 169338 - DNA, 25 bp, Rattus norvegicus
ataagatcccactctggaagcaaag

SEQ ID NO: 169339 - DNA, 25 bp, Rattus norvegicus
ataagatcccctagcttctaatgtt

SEQ ID NO: 169340 - DNA, 25 bp, Rattus norvegicus
ataagatccccttgcttctaatgtt

SEQ ID NO: 169341 - DNA, 25 bp, Rattus norvegicus
ataagatctggactgaaagtgggaa

SEQ ID NO: 169342 - DNA, 25 bp, Rattus norvegicus
ataagatctggagtgaaagtgggaa

SEQ ID NO: 169343 - DNA, 25 bp, Rattus norvegicus
ataagatgccctcctgctggtgtgc

SEQ ID NO: 169344 - DNA, 25 bp, Rattus norvegicus
ataagatgccctgctgctggtgtgc

SEQ ID NO: 169345 - DNA, 25 bp, Rattus norvegicus
ataagatggagccacacccgtatct

SEQ ID NO: 169346 - DNA, 25 bp, Rattus norvegicus
ataagatggagcgacacccgtatct

SEQ ID NO: 169347 - DNA, 25 bp, Rattus norvegicus
ataagatgtctcagggcaaccccag

SEQ ID NO: 169348 - DNA, 25 bp, Rattus norvegicus
ataagatgtctctgggcaaccccag

SEQ ID NO: 169349 - DNA, 25 bp, Rattus norvegicus
ataagatgtttgagcctccttttcc

SEQ ID NO: 169350 - DNA, 25 bp, Rattus norvegicus
ataagatgtttgtgcctccttttcc

SEQ ID NO: 169351 - DNA, 25 bp, Rattus norvegicus
ataagattcctcctggtttgcatct

SEQ ID NO: 169352 - DNA, 25 bp, Rattus norvegicus
ataagattcctcgtggtttgcatct

SEQ ID NO: 169353 - DNA, 25 bp, Rattus norvegicus
ataagattcgcgacctacaacgtca

SEQ ID NO: 169354 - DNA, 25 bp, Rattus norvegicus
ataagattcgcgtcctacaacgtca

SEQ ID NO: 169355 - DNA, 25 bp, Rattus norvegicus
ataagattctatcaggaactcaaag

SEQ ID NO: 169356 - DNA, 25 bp, Rattus norvegicus
ataagattctatgaggaactcaaag

SEQ ID NO: 169357 - DNA, 25 bp, Rattus norvegicus
ataagattgatcacccgcaggccag

SEQ ID NO: 169358 - DNA, 25 bp, Rattus norvegicus
ataagattgatctcccgcaggccag

SEQ ID NO: 169359 - DNA, 25 bp, Rattus norvegicus
ataagcaaagttcatgttcattcag

SEQ ID NO: 169360 - DNA, 25 bp, Rattus norvegicus
ataagcaaagttgatgttcattcag

SEQ ID NO: 169361 - DNA, 25 bp, Rattus norvegicus
ataagcaagttcatttgggcccata

SEQ ID NO: 169362 - DNA, 25 bp, Rattus norvegicus
ataagcaagttcttttgggcccata

SEQ ID NO: 169363 - DNA, 25 bp, Rattus norvegicus
ataagcaatcagactacagtgtcta

SEQ ID NO: 169364 - DNA, 25 bp, Rattus norvegicus
ataagcaatcagtctacagtgtcta

SEQ ID NO: 169365 - DNA, 25 bp, Rattus norvegicus
ataagcacacaacctccatctttga

SEQ ID NO: 169366 - DNA, 25 bp, Rattus norvegicus
ataagcacacaagctccatctttga

SEQ ID NO: 169367 - DNA, 25 bp, Rattus norvegicus
ataagcacactgatagctccttccg

SEQ ID NO: 169368 - DNA, 25 bp, Rattus norvegicus
ataagcacactgttagctccttccg

SEQ ID NO: 169369 - DNA, 25 bp, Rattus norvegicus
ataagcacaggtaatccttcagctg

SEQ ID NO: 169370 - DNA, 25 bp, Rattus norvegicus
ataagcacaggttatccttcagctg

SEQ ID NO: 169371 - DNA, 25 bp, Rattus norvegicus
ataagcacagttcgttgttccgtct

SEQ ID NO: 169372 - DNA, 25 bp, Rattus norvegicus
ataagcacagttggttgttccgtct

SEQ ID NO: 169373 - DNA, 25 bp, Rattus norvegicus
ataagcaccctgaagctaggcccaa

SEQ ID NO: 169374 - DNA, 25 bp, Rattus norvegicus
ataagcaccctgtagctaggcccaa

SEQ ID NO: 169375 - DNA, 25 bp, Rattus norvegicus
ataagcacctacaggactcggacat

SEQ ID NO: 169376 - DNA, 25 bp, Rattus norvegicus
ataagcacctactggactcggacat

SEQ ID NO: 169377 - DNA, 25 bp, Rattus norvegicus
ataagcacctgtatttcttggcacc

SEQ ID NO: 169378 - DNA, 25 bp, Rattus norvegicus
ataagcacctgtttttcttggcacc

SEQ ID NO: 169379 - DNA, 25 bp, Rattus norvegicus
ataagcactcgtacaacaacttccg

SEQ ID NO: 169380 - DNA, 25 bp, Rattus norvegicus
ataagcactcgttcaacaacttccg

SEQ ID NO: 169381 - DNA, 25 bp, Rattus norvegicus
ataagcactcttacatgtatacaat

SEQ ID NO: 169382 - DNA, 25 bp, Rattus norvegicus
ataagcactctttcatgtatacaat

SEQ ID NO: 169383 - DNA, 25 bp, Rattus norvegicus
ataagcactgacaacttggcactgc

SEQ ID NO: 169384 - DNA, 25 bp, Rattus norvegicus
ataagcactgactacttggcactgc

SEQ ID NO: 169385 - DNA, 25 bp, Rattus norvegicus
ataagcacttctactacttcgtcac

SEQ ID NO: 169386 - DNA, 25 bp, Rattus norvegicus
ataagcacttcttctacttcgtcac

SEQ ID NO: 169387 - DNA, 25 bp, Rattus norvegicus
ataagcagaccacccttagccaggg

SEQ ID NO: 169388 - DNA, 25 bp, Rattus norvegicus
ataagcagaccagccttagccaggg

SEQ ID NO: 169389 - DNA, 25 bp, Rattus norvegicus
ataagcagcagcactgatccctaat

SEQ ID NO: 169390 - DNA, 25 bp, Rattus norvegicus
ataagcagcagctctgatccctaat

SEQ ID NO: 169391 - DNA, 25 bp, Rattus norvegicus
ataagcagcctcaaggagctcgagc

SEQ ID NO: 169392 - DNA, 25 bp, Rattus norvegicus
ataagcagcctctaggagctcgagc

SEQ ID NO: 169393 - DNA, 25 bp, Rattus norvegicus
ataagcagcggtattgtttgcttgg

SEQ ID NO: 169394 - DNA, 25 bp, Rattus norvegicus
ataagcagcggttttgtttgcttgg

SEQ ID NO: 169395 - DNA, 25 bp, Rattus norvegicus
ataagcagctccattcttgtattta

SEQ ID NO: 169396 - DNA, 25 bp, Rattus norvegicus
ataagcagctcctttcttgtattta

SEQ ID NO: 169397 - DNA, 25 bp, Rattus norvegicus
ataagcagggccatctgtgctgtgc

SEQ ID NO: 169398 - DNA, 25 bp, Rattus norvegicus
ataagcagggccttctgtgctgtgc

SEQ ID NO: 169399 - DNA, 25 bp, Rattus norvegicus
ataagcagtctcacgtgagggatgt

SEQ ID NO: 169400 - DNA, 25 bp, Rattus norvegicus
ataagcagtctctcgtgagggatgt

SEQ ID NO: 169401 - DNA, 25 bp, Rattus norvegicus
ataagcagtggtcggcaagcatttg

SEQ ID NO: 169402 - DNA, 25 bp, Rattus norvegicus
ataagcagtggtgggcaagcatttg

SEQ ID NO: 169403 - DNA, 25 bp, Rattus norvegicus
ataagcatccagcatattcggcatg

SEQ ID NO: 169404 - DNA, 25 bp, Rattus norvegicus
ataagcatccaggatattcggcatg

SEQ ID NO: 169405 - DNA, 25 bp, Rattus norvegicus
ataagcatcctgatgcctgtgatct

SEQ ID NO: 169406 - DNA, 25 bp, Rattus norvegicus
ataagcatcctgttgcctgtgatct

SEQ ID NO: 169407 - DNA, 25 bp, Rattus norvegicus
ataagcatctcaacagtggccacat

SEQ ID NO: 169408 - DNA, 25 bp, Rattus norvegicus
ataagcatctcatcagtggccacat

SEQ ID NO: 169409 - DNA, 25 bp, Rattus norvegicus
ataagcatctctacttcgagtccga

SEQ ID NO: 169410 - DNA, 25 bp, Rattus norvegicus
ataagcatctcttcttcgagtccga

SEQ ID NO: 169411 - DNA, 25 bp, Rattus norvegicus
ataagcatgactagccccgaagggt

SEQ ID NO: 169412 - DNA, 25 bp, Rattus norvegicus
ataagcatgacttgccccgaagggt

SEQ ID NO: 169413 - DNA, 25 bp, Rattus norvegicus
ataagccacagaccctgagttcttt

SEQ ID NO: 169414 - DNA, 25 bp, Rattus norvegicus
ataagccacagagcctgagttcttt

SEQ ID NO: 169415 - DNA, 25 bp, Rattus norvegicus
ataagccacagtctctctttgctcc

SEQ ID NO: 169416 - DNA, 25 bp, Rattus norvegicus
ataagccacagtgtctctttgctcc

SEQ ID NO: 169417 - DNA, 25 bp, Rattus norvegicus
ataagccacttcagtcactgaaagc

SEQ ID NO: 169418 - DNA, 25 bp, Rattus norvegicus
ataagccacttctgtcactgaaagc

SEQ ID NO: 169419 - DNA, 25 bp, Rattus norvegicus
ataagccagactaaaggccagaccg

SEQ ID NO: 169420 - DNA, 25 bp, Rattus norvegicus
ataagccagacttaaggccagaccg

SEQ ID NO: 169421 - DNA, 25 bp, Rattus norvegicus
ataagccagctacagatgcacgcgt

SEQ ID NO: 169422 - DNA, 25 bp, Rattus norvegicus
ataagccagctagagatgcacgcgt

SEQ ID NO: 169423 - DNA, 25 bp, Rattus norvegicus
ataagccaggccaaagccattttat

SEQ ID NO: 169424 - DNA, 25 bp, Rattus norvegicus
ataagccaggcctaagccattttat

SEQ ID NO: 169425 - DNA, 25 bp, Rattus norvegicus
ataagccatgttctcaggcgtgaga

SEQ ID NO: 169426 - DNA, 25 bp, Rattus norvegicus
ataagccatgttgtcaggcgtgaga

SEQ ID NO: 169427 - DNA, 25 bp, Rattus norvegicus
ataagccattttacgtctcttcaca

SEQ ID NO: 169428 - DNA, 25 bp, Rattus norvegicus
ataagccatttttcgtctcttcaca

SEQ ID NO: 169429 - DNA, 25 bp, Rattus norvegicus
ataagcccatttatggaccgctctg

SEQ ID NO: 169430 - DNA, 25 bp, Rattus norvegicus
ataagcccatttttggaccgctctg

SEQ ID NO: 169431 - DNA, 25 bp, Rattus norvegicus
ataagccctacacgtggttctcact

SEQ ID NO: 169432 - DNA, 25 bp, Rattus norvegicus
ataagccctacaggtggttctcact

SEQ ID NO: 169433 - DNA, 25 bp, Rattus norvegicus
ataagccctagaattgatgttcaac

SEQ ID NO: 169434 - DNA, 25 bp, Rattus norvegicus
ataagccctagatttgatgttcaac

SEQ ID NO: 169435 - DNA, 25 bp, Rattus norvegicus
ataagccctcttctggaccagagca

SEQ ID NO: 169436 - DNA, 25 bp, Rattus norvegicus
ataagccctcttgtggaccagagca

SEQ ID NO: 169437 - DNA, 25 bp, Rattus norvegicus
ataagcccttacactttatggatct

SEQ ID NO: 169438 - DNA, 25 bp, Rattus norvegicus
ataagcccttactctttatggatct

SEQ ID NO: 169439 - DNA, 25 bp, Rattus norvegicus
ataagcccttgtaaacgtgaaattg

SEQ ID NO: 169440 - DNA, 25 bp, Rattus norvegicus
ataagcccttgttaacgtgaaattg

SEQ ID NO: 169441 - DNA, 25 bp, Rattus norvegicus
ataagccggcttaggttgtatacat

SEQ ID NO: 169442 - DNA, 25 bp, Rattus norvegicus
ataagccggctttggttgtatacat

SEQ ID NO: 169443 - DNA, 25 bp, Rattus norvegicus
ataagcctacggctcagagtgtgaa

SEQ ID NO: 169444 - DNA, 25 bp, Rattus norvegicus
ataagcctacgggtcagagtgtgaa

SEQ ID NO: 169445 - DNA, 25 bp, Rattus norvegicus
ataagcctcaccattcattttaaag

SEQ ID NO: 169446 - DNA, 25 bp, Rattus norvegicus
ataagcctcacctttcattttaaag

SEQ ID NO: 169447 - DNA, 25 bp, Rattus norvegicus
ataagcctcattactacttgaactt

SEQ ID NO: 169448 - DNA, 25 bp, Rattus norvegicus
ataagcctcatttctacttgaactt

SEQ ID NO: 169449 - DNA, 25 bp, Rattus norvegicus
ataagcctccttattgcacaaagaa

SEQ ID NO: 169450 - DNA, 25 bp, Rattus norvegicus
ataagcctcctttttgcacaaagaa

SEQ ID NO: 169451 - DNA, 25 bp, Rattus norvegicus
ataagcctctgcaatgttctcttgt

SEQ ID NO: 169452 - DNA, 25 bp, Rattus norvegicus
ataagcctctgctatgttctcttgt

SEQ ID NO: 169453 - DNA, 25 bp, Rattus norvegicus
ataagcctcttcaggacacatgcag

SEQ ID NO: 169454 - DNA, 25 bp, Rattus norvegicus
ataagcctcttctggacacatgcag

SEQ ID NO: 169455 - DNA, 25 bp, Rattus norvegicus
ataagcctcttgaccccaaaagaag

SEQ ID NO: 169456 - DNA, 25 bp, Rattus norvegicus
ataagcctcttgtccccaaaagaag

SEQ ID NO: 169457 - DNA, 25 bp, Rattus norvegicus
ataagcctggttaatttctgtaaca

SEQ ID NO: 169458 - DNA, 25 bp, Rattus norvegicus
ataagcctggtttatttctgtaaca

SEQ ID NO: 169459 - DNA, 25 bp, Rattus norvegicus
ataagcctgtgtatacagacccacc

SEQ ID NO: 169460 - DNA, 25 bp, Rattus norvegicus
ataagcctgtgtttacagacccacc

SEQ ID NO: 169461 - DNA, 25 bp, Rattus norvegicus
ataagccttgtgattttgatcctgt

SEQ ID NO: 169462 - DNA, 25 bp, Rattus norvegicus
ataagccttgtgtttttgatcctgt

SEQ ID NO: 169463 - DNA, 25 bp, Rattus norvegicus
ataagccttttaccttgtctgatag

SEQ ID NO: 169464 - DNA, 25 bp, Rattus norvegicus
ataagccttttagcttgtctgatag

SEQ ID NO: 169465 - DNA, 25 bp, Rattus norvegicus
ataagcgacacgaggtatattcagt

SEQ ID NO: 169466 - DNA, 25 bp, Rattus norvegicus
ataagcgacacgtggtatattcagt

SEQ ID NO: 169467 - DNA, 25 bp, Rattus norvegicus
ataagcgcttttacccaacggagtg

SEQ ID NO: 169468 - DNA, 25 bp, Rattus norvegicus
ataagcgctttttcccaacggagtg

SEQ ID NO: 169469 - DNA, 25 bp, Rattus norvegicus
ataagcggctataaagtctcagggt

SEQ ID NO: 169470 - DNA, 25 bp, Rattus norvegicus
ataagcggctattaagtctcagggt

SEQ ID NO: 169471 - DNA, 25 bp, Rattus norvegicus
ataagcgtccgtccaaagaattaca

SEQ ID NO: 169472 - DNA, 25 bp, Rattus norvegicus
ataagcgtccgtgcaaagaattaca

SEQ ID NO: 169473 - DNA, 25 bp, Rattus norvegicus
ataagcgtcttgaacctggaggtgg

SEQ ID NO: 169474 - DNA, 25 bp, Rattus norvegicus
ataagcgtcttgtacctggaggtgg

SEQ ID NO: 169475 - DNA, 25 bp, Rattus norvegicus
ataagcgtgacgcactaactctgcc

SEQ ID NO: 169476 - DNA, 25 bp, Rattus norvegicus
ataagcgtgacggactaactctgcc

SEQ ID NO: 169477 - DNA, 25 bp, Rattus norvegicus
ataagctatgctagctacctcgtac

SEQ ID NO: 169478 - DNA, 25 bp, Rattus norvegicus
ataagctatgcttgctacctcgtac

SEQ ID NO: 169479 - DNA, 25 bp, Rattus norvegicus
ataagctatggccacactctttgtt

SEQ ID NO: 169480 - DNA, 25 bp, Rattus norvegicus
ataagctatggcgacactctttgtt

SEQ ID NO: 169481 - DNA, 25 bp, Rattus norvegicus
ataagctcaacccacggacaccttt

SEQ ID NO: 169482 - DNA, 25 bp, Rattus norvegicus
ataagctcaaccgacggacaccttt

SEQ ID NO: 169483 - DNA, 25 bp, Rattus norvegicus
ataagctcagctaattcaggacact

SEQ ID NO: 169484 - DNA, 25 bp, Rattus norvegicus
ataagctcagcttattcaggacact

SEQ ID NO: 169485 - DNA, 25 bp, Rattus norvegicus
ataagctcatccaggctgtgagtgc

SEQ ID NO: 169486 - DNA, 25 bp, Rattus norvegicus
ataagctcatcctggctgtgagtgc

SEQ ID NO: 169487 - DNA, 25 bp, Rattus norvegicus
ataagctcattaataactccacaga

SEQ ID NO: 169488 - DNA, 25 bp, Rattus norvegicus
ataagctcattattaactccacaga

SEQ ID NO: 169489 - DNA, 25 bp, Rattus norvegicus
ataagctcattgctgattcccagtt

SEQ ID NO: 169490 - DNA, 25 bp, Rattus norvegicus
ataagctcattggtgattcccagtt

SEQ ID NO: 169491 - DNA, 25 bp, Rattus norvegicus
ataagctccaggaccactcattgat

SEQ ID NO: 169492 - DNA, 25 bp, Rattus norvegicus
ataagctccaggtccactcattgat

SEQ ID NO: 169493 - DNA, 25 bp, Rattus norvegicus
ataagctcctctcgaccgactggat

SEQ ID NO: 169494 - DNA, 25 bp, Rattus norvegicus
ataagctcctctggaccgactggat

SEQ ID NO: 169495 - DNA, 25 bp, Rattus norvegicus
ataagctccttacattggtctgaga

SEQ ID NO: 169496 - DNA, 25 bp, Rattus norvegicus
ataagctccttagattggtctgaga

SEQ ID NO: 169497 - DNA, 25 bp, Rattus norvegicus
ataagctcctttccatcattaacaa

SEQ ID NO: 169498 - DNA, 25 bp, Rattus norvegicus
ataagctcctttgcatcattaacaa

SEQ ID NO: 169499 - DNA, 25 bp, Rattus norvegicus
ataagctcgatcatgggcctataca

SEQ ID NO: 169500 - DNA, 25 bp, Rattus norvegicus
ataagctcgatcttgggcctataca

SEQ ID NO: 169501 - DNA, 25 bp, Rattus norvegicus
ataagctcggcgcatgtgcactggc

SEQ ID NO: 169502 - DNA, 25 bp, Rattus norvegicus
ataagctcggcggatgtgcactggc

SEQ ID NO: 169503 - DNA, 25 bp, Rattus norvegicus
ataagctcggtgacatatgcataaa

SEQ ID NO: 169504 - DNA, 25 bp, Rattus norvegicus
ataagctcggtgtcatatgcataaa

SEQ ID NO: 169505 - DNA, 25 bp, Rattus norvegicus
ataagctctcctacagacggtgagg

SEQ ID NO: 169506 - DNA, 25 bp, Rattus norvegicus
ataagctctcctatacacatgttct

SEQ ID NO: 169507 - DNA, 25 bp, Rattus norvegicus
ataagctctccttcagacggtgagg

SEQ ID NO: 169508 - DNA, 25 bp, Rattus norvegicus
ataagctctcctttacacatgttct

SEQ ID NO: 169509 - DNA, 25 bp, Rattus norvegicus
ataagctcttccagttttgtctcaa

SEQ ID NO: 169510 - DNA, 25 bp, Rattus norvegicus
ataagctcttcctgttttgtctcaa

SEQ ID NO: 169511 - DNA, 25 bp, Rattus norvegicus
ataagctcttttcgcctgggtacag

SEQ ID NO: 169512 - DNA, 25 bp, Rattus norvegicus
ataagctcttttggcctgggtacag

SEQ ID NO: 169513 - DNA, 25 bp, Rattus norvegicus
ataagctgaagtccaccaaagagga

SEQ ID NO: 169514 - DNA, 25 bp, Rattus norvegicus
ataagctgaagtccctgtgccccag

SEQ ID NO: 169515 - DNA, 25 bp, Rattus norvegicus
ataagctgaagtgcaccaaagagga

SEQ ID NO: 169516 - DNA, 25 bp, Rattus norvegicus
ataagctgaagtgcctgtgccccag

SEQ ID NO: 169517 - DNA, 25 bp, Rattus norvegicus
ataagctgaatgaccctgtgcgcca

SEQ ID NO: 169518 - DNA, 25 bp, Rattus norvegicus
ataagctgaatgtccctgtgcgcca

SEQ ID NO: 169519 - DNA, 25 bp, Rattus norvegicus
ataagctgcctgcttgataatcact

SEQ ID NO: 169520 - DNA, 25 bp, Rattus norvegicus
ataagctgcctggttgataatcact

SEQ ID NO: 169521 - DNA, 25 bp, Rattus norvegicus
ataagctgcttaattcctggagaat

SEQ ID NO: 169522 - DNA, 25 bp, Rattus norvegicus
ataagctgcttatttcctggagaat

SEQ ID NO: 169523 - DNA, 25 bp, Rattus norvegicus
ataagctggctcaccagtatggctg

SEQ ID NO: 169524 - DNA, 25 bp, Rattus norvegicus
ataagctggctctccagtatggctg

SEQ ID NO: 169525 - DNA, 25 bp, Rattus norvegicus
ataagctgtacaatcgtttcatcat

SEQ ID NO: 169526 - DNA, 25 bp, Rattus norvegicus
ataagctgtacattcgtttcatcat

SEQ ID NO: 169527 - DNA, 25 bp, Rattus norvegicus
ataagctgtcagaaacccgatgccc

SEQ ID NO: 169528 - DNA, 25 bp, Rattus norvegicus
ataagctgtcagtaacccgatgccc

SEQ ID NO: 169529 - DNA, 25 bp, Rattus norvegicus
ataagcttaagaaagccagaattaa

SEQ ID NO: 169530 - DNA, 25 bp, Rattus norvegicus
ataagcttaagatagccagaattaa

SEQ ID NO: 169531 - DNA, 25 bp, Rattus norvegicus
ataagcttagcccttgcagcaacag

SEQ ID NO: 169532 - DNA, 25 bp, Rattus norvegicus
ataagcttagccgttgcagcaacag

SEQ ID NO: 169533 - DNA, 25 bp, Rattus norvegicus
ataagcttcactcttcgacttcaca

SEQ ID NO: 169534 - DNA, 25 bp, Rattus norvegicus
ataagcttcactgttcgacttcaca

SEQ ID NO: 169535 - DNA, 25 bp, Rattus norvegicus
ataagcttctgcatctatctgcatt

SEQ ID NO: 169536 - DNA, 25 bp, Rattus norvegicus
ataagcttctgcttctatctgcatt

SEQ ID NO: 169537 - DNA, 25 bp, Rattus norvegicus
ataagcttctgtatgggcacataaa

SEQ ID NO: 169538 - DNA, 25 bp, Rattus norvegicus
ataagcttctgtttgggcacataaa

SEQ ID NO: 169539 - DNA, 25 bp, Rattus norvegicus
ataagcttgaggatgacgttttaat

SEQ ID NO: 169540 - DNA, 25 bp, Rattus norvegicus
ataagcttgaggttgacgttttaat

SEQ ID NO: 169541 - DNA, 25 bp, Rattus norvegicus
ataagcttgctgaggtctatgctcc

SEQ ID NO: 169542 - DNA, 25 bp, Rattus norvegicus
ataagcttgctgtggtctatgctcc

SEQ ID NO: 169543 - DNA, 25 bp, Rattus norvegicus
ataagcttgtgccttacccttgtgg

SEQ ID NO: 169544 - DNA, 25 bp, Rattus norvegicus
ataagcttgtgcgttacccttgtgg

SEQ ID NO: 169545 - DNA, 25 bp, Rattus norvegicus
ataagctttctgcttgtgtaccaag

SEQ ID NO: 169546 - DNA, 25 bp, Rattus norvegicus
ataagctttctggttgtgtaccaag

SEQ ID NO: 169547 - DNA, 25 bp, Rattus norvegicus
ataagctttgcacacactctcgatt

SEQ ID NO: 169548 - DNA, 25 bp, Rattus norvegicus
ataagctttgcagacactctcgatt

SEQ ID NO: 169549 - DNA, 25 bp, Rattus norvegicus
ataagctttgttctcttgctgtgtg

SEQ ID NO: 169550 - DNA, 25 bp, Rattus norvegicus
ataagctttgttgtcttgctgtgtg

SEQ ID NO: 169551 - DNA, 25 bp, Rattus norvegicus
ataaggaacttgaggccggcctgga

SEQ ID NO: 169552 - DNA, 25 bp, Rattus norvegicus
ataaggaacttgtggccggcctgga

SEQ ID NO: 169553 - DNA, 25 bp, Rattus norvegicus
ataaggaatccaacagcattactgt

SEQ ID NO: 169554 - DNA, 25 bp, Rattus norvegicus
ataaggaatccatcagcattactgt

SEQ ID NO: 169555 - DNA, 25 bp, Rattus norvegicus
ataaggaatttaagctggcccacca

SEQ ID NO: 169556 - DNA, 25 bp, Rattus norvegicus
ataaggaatttatgctggcccacca

SEQ ID NO: 169557 - DNA, 25 bp, Rattus norvegicus
ataaggacagagctgccctgcttcg

SEQ ID NO: 169558 - DNA, 25 bp, Rattus norvegicus
ataaggacagaggtgccctgcttcg

SEQ ID NO: 169559 - DNA, 25 bp, Rattus norvegicus
ataaggacagcactcctggagtcag

SEQ ID NO: 169560 - DNA, 25 bp, Rattus norvegicus
ataaggacagcagtcctggagtcag

SEQ ID NO: 169561 - DNA, 25 bp, Rattus norvegicus
ataaggacagggaccttgccatcct

SEQ ID NO: 169562 - DNA, 25 bp, Rattus norvegicus
ataaggacagggtccttgccatcct

SEQ ID NO: 169563 - DNA, 25 bp, Rattus norvegicus
ataaggacgtgacccgactgctact

SEQ ID NO: 169564 - DNA, 25 bp, Rattus norvegicus
ataaggacgtgagccgactgctact

SEQ ID NO: 169565 - DNA, 25 bp, Rattus norvegicus
ataaggagaccaacaccgttctggc

SEQ ID NO: 169566 - DNA, 25 bp, Rattus norvegicus
ataaggagaccatcaccgttctggc

SEQ ID NO: 169567 - DNA, 25 bp, Rattus norvegicus
ataaggagacgaccaggcaccagcg

SEQ ID NO: 169568 - DNA, 25 bp, Rattus norvegicus
ataaggagacgagcaggcaccagcg

SEQ ID NO: 169569 - DNA, 25 bp, Rattus norvegicus
ataaggagccccaaagagcacacgg

SEQ ID NO: 169570 - DNA, 25 bp, Rattus norvegicus
ataaggagcccctaagagcacacgg

SEQ ID NO: 169571 - DNA, 25 bp, Rattus norvegicus
ataaggaggactatctagggctgag

SEQ ID NO: 169572 - DNA, 25 bp, Rattus norvegicus
ataaggaggactttctagggctgag

SEQ ID NO: 169573 - DNA, 25 bp, Rattus norvegicus
ataaggaggccccatcgcttacttt

SEQ ID NO: 169574 - DNA, 25 bp, Rattus norvegicus
ataaggaggcccgatcgcttacttt

SEQ ID NO: 169575 - DNA, 25 bp, Rattus norvegicus
ataaggagggctctggccctgccca

SEQ ID NO: 169576 - DNA, 25 bp, Rattus norvegicus
ataaggagggctgtggccctgccca

SEQ ID NO: 169577 - DNA, 25 bp, Rattus norvegicus
ataaggagtcggacccagcaagaac

SEQ ID NO: 169578 - DNA, 25 bp, Rattus norvegicus
ataaggagtcggtcccagcaagaac

SEQ ID NO: 169579 - DNA, 25 bp, Rattus norvegicus
ataaggagtctgaacaccattgtgc

SEQ ID NO: 169580 - DNA, 25 bp, Rattus norvegicus
ataaggagtctgtacaccattgtgc

SEQ ID NO: 169581 - DNA, 25 bp, Rattus norvegicus
ataaggatctgcacacctatgggcc

SEQ ID NO: 169582 - DNA, 25 bp, Rattus norvegicus
ataaggatctgctcacctatgggcc

SEQ ID NO: 169583 - DNA, 25 bp, Rattus norvegicus
ataaggatgaggcagccgcggcccc

SEQ ID NO: 169584 - DNA, 25 bp, Rattus norvegicus
ataaggatgagggagccgcggcccc

SEQ ID NO: 169585 - DNA, 25 bp, Rattus norvegicus
ataaggatgctgcttcacacggcta

SEQ ID NO: 169586 - DNA, 25 bp, Rattus norvegicus
ataaggatgctggttcacacggcta

SEQ ID NO: 169587 - DNA, 25 bp, Rattus norvegicus
ataaggatgggcctcatggctcatc

SEQ ID NO: 169588 - DNA, 25 bp, Rattus norvegicus
ataaggatgggcgtcatggctcatc

SEQ ID NO: 169589 - DNA, 25 bp, Rattus norvegicus
ataaggcacgctactgagctttctt

SEQ ID NO: 169590 - DNA, 25 bp, Rattus norvegicus
ataaggcacgcttctgagctttctt

SEQ ID NO: 169591 - DNA, 25 bp, Rattus norvegicus
ataaggccacaactattgctctaat

SEQ ID NO: 169592 - DNA, 25 bp, Rattus norvegicus
ataaggccacaagtattgctctaat

SEQ ID NO: 169593 - DNA, 25 bp, Rattus norvegicus
ataaggccacatcgtcttgcagcat

SEQ ID NO: 169594 - DNA, 25 bp, Rattus norvegicus
ataaggccacatggtcttgcagcat

SEQ ID NO: 169595 - DNA, 25 bp, Rattus norvegicus
ataaggccagccaggagagcctgcc

SEQ ID NO: 169596 - DNA, 25 bp, Rattus norvegicus
ataaggccagcctggagagcctgcc

SEQ ID NO: 169597 - DNA, 25 bp, Rattus norvegicus
ataaggccattgactgtctcaactg

SEQ ID NO: 169598 - DNA, 25 bp, Rattus norvegicus
ataaggccattgtctgtctcaactg

SEQ ID NO: 169599 - DNA, 25 bp, Rattus norvegicus
ataaggcccattatgcaacagccac

SEQ ID NO: 169600 - DNA, 25 bp, Rattus norvegicus
ataaggcccattttgcaacagccac

SEQ ID NO: 169601 - DNA, 25 bp, Rattus norvegicus
ataaggccctgcctacttctgtggg

SEQ ID NO: 169602 - DNA, 25 bp, Rattus norvegicus
ataaggccctgcctctgactgacgt

SEQ ID NO: 169603 - DNA, 25 bp, Rattus norvegicus
ataaggccctgcgtacttctgtggg

SEQ ID NO: 169604 - DNA, 25 bp, Rattus norvegicus
ataaggccctgcgtctgactgacgt

SEQ ID NO: 169605 - DNA, 25 bp, Rattus norvegicus
ataaggcccttgactgtttcattcc

SEQ ID NO: 169606 - DNA, 25 bp, Rattus norvegicus
ataaggcccttgtctgtttcattcc

SEQ ID NO: 169607 - DNA, 25 bp, Rattus norvegicus
ataaggcgagctacctgaacactgc

SEQ ID NO: 169608 - DNA, 25 bp, Rattus norvegicus
ataaggcgagcttcctgaacactgc

SEQ ID NO: 169609 - DNA, 25 bp, Rattus norvegicus
ataaggcgcctgctttgagggccct

SEQ ID NO: 169610 - DNA, 25 bp, Rattus norvegicus
ataaggcgcctggtttgagggccct

SEQ ID NO: 169611 - DNA, 25 bp, Rattus norvegicus
ataaggcgccttaccaaggagacca

SEQ ID NO: 169612 - DNA, 25 bp, Rattus norvegicus
ataaggcgcctttccaaggagacca

SEQ ID NO: 169613 - DNA, 25 bp, Rattus norvegicus
ataaggctaattactgctctggaga

SEQ ID NO: 169614 - DNA, 25 bp, Rattus norvegicus
ataaggctaatttctgctctggaga

SEQ ID NO: 169615 - DNA, 25 bp, Rattus norvegicus
ataaggctccacaatatatctgtga

SEQ ID NO: 169616 - DNA, 25 bp, Rattus norvegicus
ataaggctccactatatatctgtga

SEQ ID NO: 169617 - DNA, 25 bp, Rattus norvegicus
ataaggctgctaattttgcaagtat

SEQ ID NO: 169618 - DNA, 25 bp, Rattus norvegicus
ataaggctgctatttttgcaagtat

SEQ ID NO: 169619 - DNA, 25 bp, Rattus norvegicus
ataaggctgtcaatctgcagggctc

SEQ ID NO: 169620 - DNA, 25 bp, Rattus norvegicus
ataaggctgtcattctgcagggctc

SEQ ID NO: 169621 - DNA, 25 bp, Rattus norvegicus
ataaggctgtgcaggagttgaaccc

SEQ ID NO: 169622 - DNA, 25 bp, Rattus norvegicus
ataaggctgtgctggagttgaaccc

SEQ ID NO: 169623 - DNA, 25 bp, Rattus norvegicus
ataaggcttctactaccacaccaaa

SEQ ID NO: 169624 - DNA, 25 bp, Rattus norvegicus
ataaggcttctagtaccacaccaaa

SEQ ID NO: 169625 - DNA, 25 bp, Rattus norvegicus
ataaggcttgctataatgtccatcc

SEQ ID NO: 169626 - DNA, 25 bp, Rattus norvegicus
ataaggcttgctttaatgtccatcc

SEQ ID NO: 169627 - DNA, 25 bp, Rattus norvegicus
ataaggctttgtaagttcactgtac

SEQ ID NO: 169628 - DNA, 25 bp, Rattus norvegicus
ataaggctttgttagttcactgtac

SEQ ID NO: 169629 - DNA, 25 bp, Rattus norvegicus
ataagggaccagcagtgtcagactg

SEQ ID NO: 169630 - DNA, 25 bp, Rattus norvegicus
ataagggaccaggagtgtcagactg

SEQ ID NO: 169631 - DNA, 25 bp, Rattus norvegicus
ataagggactagaccttgatggcta

SEQ ID NO: 169632 - DNA, 25 bp, Rattus norvegicus
ataagggactagtccttgatggcta

SEQ ID NO: 169633 - DNA, 25 bp, Rattus norvegicus
ataagggagtccaggtgcagaccaa

SEQ ID NO: 169634 - DNA, 25 bp, Rattus norvegicus
ataagggagtcctggtgcagaccaa

SEQ ID NO: 169635 - DNA, 25 bp, Rattus norvegicus
ataagggatcccatcagagccactc

SEQ ID NO: 169636 - DNA, 25 bp, Rattus norvegicus
ataagggatcccttcagagccactc

SEQ ID NO: 169637 - DNA, 25 bp, Rattus norvegicus
ataagggcacctctgtttcaaaaat

SEQ ID NO: 169638 - DNA, 25 bp, Rattus norvegicus
ataagggcacctgtgtttcaaaaat

SEQ ID NO: 169639 - DNA, 25 bp, Rattus norvegicus
ataagggccataatttcatctcatc

SEQ ID NO: 169640 - DNA, 25 bp, Rattus norvegicus
ataagggccatattttcatctcatc

SEQ ID NO: 169641 - DNA, 25 bp, Rattus norvegicus
ataagggcctgaccctatgccagag

SEQ ID NO: 169642 - DNA, 25 bp, Rattus norvegicus
ataagggcctgagcctatgccagag

SEQ ID NO: 169643 - DNA, 25 bp, Rattus norvegicus
ataagggcgtgaaccaggctatcca

SEQ ID NO: 169644 - DNA, 25 bp, Rattus norvegicus
ataagggcgtgatccaggctatcca

SEQ ID NO: 169645 - DNA, 25 bp, Rattus norvegicus
ataagggctatgacgacgaccctcg

SEQ ID NO: 169646 - DNA, 25 bp, Rattus norvegicus
ataagggctatgtcgacgaccctcg

SEQ ID NO: 169647 - DNA, 25 bp, Rattus norvegicus
ataagggtgcacacctttggccaca

SEQ ID NO: 169648 - DNA, 25 bp, Rattus norvegicus
ataagggtgcactcctttggccaca

SEQ ID NO: 169649 - DNA, 25 bp, Rattus norvegicus
ataagggtggacacctcttatcctc

SEQ ID NO: 169650 - DNA, 25 bp, Rattus norvegicus
ataagggtggactcctcttatcctc

SEQ ID NO: 169651 - DNA, 25 bp, Rattus norvegicus
ataagggtggcgcttttcatgcccc

SEQ ID NO: 169652 - DNA, 25 bp, Rattus norvegicus
ataagggtggcggttttcatgcccc

SEQ ID NO: 169653 - DNA, 25 bp, Rattus norvegicus
ataagggtggctctcctgggccttc

SEQ ID NO: 169654 - DNA, 25 bp, Rattus norvegicus
ataagggtggctgtcctgggccttc

SEQ ID NO: 169655 - DNA, 25 bp, Rattus norvegicus
ataagggttcttcatggtgctaaat

SEQ ID NO: 169656 - DNA, 25 bp, Rattus norvegicus
ataagggttcttgatggtgctaaat

SEQ ID NO: 169657 - DNA, 25 bp, Rattus norvegicus
ataaggtacaacctccacctggcac

SEQ ID NO: 169658 - DNA, 25 bp, Rattus norvegicus
ataaggtacaacgtccacctggcac

SEQ ID NO: 169659 - DNA, 25 bp, Rattus norvegicus
ataaggtatacaagccctgaagata

SEQ ID NO: 169660 - DNA, 25 bp, Rattus norvegicus
ataaggtatacatgccctgaagata

SEQ ID NO: 169661 - DNA, 25 bp, Rattus norvegicus
ataaggtcaactacttccgcatggt

SEQ ID NO: 169662 - DNA, 25 bp, Rattus norvegicus
ataaggtcaacttcttccgcatggt

SEQ ID NO: 169663 - DNA, 25 bp, Rattus norvegicus
ataaggtcagagcaaccctgggcca

SEQ ID NO: 169664 - DNA, 25 bp, Rattus norvegicus
ataaggtcagaggaaccctgggcca

SEQ ID NO: 169665 - DNA, 25 bp, Rattus norvegicus
ataaggtcatcaaaagtgtgggcaa

SEQ ID NO: 169666 - DNA, 25 bp, Rattus norvegicus
ataaggtcatcataagtgtgggcaa

SEQ ID NO: 169667 - DNA, 25 bp, Rattus norvegicus
ataaggtcatttcaccctgctgtcc

SEQ ID NO: 169668 - DNA, 25 bp, Rattus norvegicus
ataaggtcatttgaccctgctgtcc

SEQ ID NO: 169669 - DNA, 25 bp, Rattus norvegicus
ataaggtccagcacccttgaagtct

SEQ ID NO: 169670 - DNA, 25 bp, Rattus norvegicus
ataaggtccagctcccttgaagtct

SEQ ID NO: 169671 - DNA, 25 bp, Rattus norvegicus
ataaggtccaggcttcatttccagc

SEQ ID NO: 169672 - DNA, 25 bp, Rattus norvegicus
ataaggtccagggttcatttccagc

SEQ ID NO: 169673 - DNA, 25 bp, Rattus norvegicus
ataaggtctcggagtccagcacctc

SEQ ID NO: 169674 - DNA, 25 bp, Rattus norvegicus
ataaggtctcggtgtccagcacctc

SEQ ID NO: 169675 - DNA, 25 bp, Rattus norvegicus
ataaggtgcaacctggctccagttc

SEQ ID NO: 169676 - DNA, 25 bp, Rattus norvegicus
ataaggtgcaacgtggctccagttc

SEQ ID NO: 169677 - DNA, 25 bp, Rattus norvegicus
ataaggtgcatcattgcctctgttt

SEQ ID NO: 169678 - DNA, 25 bp, Rattus norvegicus
ataaggtgcatctttgcctctgttt

SEQ ID NO: 169679 - DNA, 25 bp, Rattus norvegicus
ataaggtgcattcttctccaaccaa

SEQ ID NO: 169680 - DNA, 25 bp, Rattus norvegicus
ataaggtgcattgttctccaaccaa

SEQ ID NO: 169681 - DNA, 25 bp, Rattus norvegicus
ataaggtggccaaccagctcaacga

SEQ ID NO: 169682 - DNA, 25 bp, Rattus norvegicus
ataaggtggccatccagctcaacga

SEQ ID NO: 169683 - DNA, 25 bp, Rattus norvegicus
ataaggtgttcaccgctcgtcttcg

SEQ ID NO: 169684 - DNA, 25 bp, Rattus norvegicus
ataaggtgttcagcgctcgtcttcg

SEQ ID NO: 169685 - DNA, 25 bp, Rattus norvegicus
ataaggttattgctgtgcccactgt

SEQ ID NO: 169686 - DNA, 25 bp, Rattus norvegicus
ataaggttattggtgtgcccactgt

SEQ ID NO: 169687 - DNA, 25 bp, Rattus norvegicus
ataaggttatttcctggctattgtc

SEQ ID NO: 169688 - DNA, 25 bp, Rattus norvegicus
ataaggttatttgctggctattgtc

SEQ ID NO: 169689 - DNA, 25 bp, Rattus norvegicus
ataaggtttctcagccttgtgtaag

SEQ ID NO: 169690 - DNA, 25 bp, Rattus norvegicus
ataaggtttctctgccttgtgtaag

SEQ ID NO: 169691 - DNA, 25 bp, Rattus norvegicus
ataaggtttttgctggctgcatgac

SEQ ID NO: 169692 - DNA, 25 bp, Rattus norvegicus
ataaggtttttggtggctgcatgac

SEQ ID NO: 169693 - DNA, 25 bp, Rattus norvegicus
ataagtaatccaaagcgggctgtcg

SEQ ID NO: 169694 - DNA, 25 bp, Rattus norvegicus
ataagtaatccatagcgggctgtcg

SEQ ID NO: 169695 - DNA, 25 bp, Rattus norvegicus
ataagtacacacagtagccactccc

SEQ ID NO: 169696 - DNA, 25 bp, Rattus norvegicus
ataagtacacactgtagccactccc

SEQ ID NO: 169697 - DNA, 25 bp, Rattus norvegicus
ataagtaccggcaccccgagtgctt

SEQ ID NO: 169698 - DNA, 25 bp, Rattus norvegicus
ataagtaccggctccccgagtgctt

SEQ ID NO: 169699 - DNA, 25 bp, Rattus norvegicus
ataagtacgtgcatgacgacggcag

SEQ ID NO: 169700 - DNA, 25 bp, Rattus norvegicus
ataagtacgtgcttgacgacggcag

SEQ ID NO: 169701 - DNA, 25 bp, Rattus norvegicus
ataagtactggcaacagggacacag

SEQ ID NO: 169702 - DNA, 25 bp, Rattus norvegicus
ataagtactggctacagggacacag

SEQ ID NO: 169703 - DNA, 25 bp, Rattus norvegicus
ataagtactgttcgactctctgttc

SEQ ID NO: 169704 - DNA, 25 bp, Rattus norvegicus
ataagtactgttggactctctgttc

SEQ ID NO: 169705 - DNA, 25 bp, Rattus norvegicus
ataagtacttttacagcaagattgt

SEQ ID NO: 169706 - DNA, 25 bp, Rattus norvegicus
ataagtactttttcagcaagattgt

SEQ ID NO: 169707 - DNA, 25 bp, Rattus norvegicus
ataagtagtggcagcccaggcctgc

SEQ ID NO: 169708 - DNA, 25 bp, Rattus norvegicus
ataagtagtggctgcccaggcctgc

SEQ ID NO: 169709 - DNA, 25 bp, Rattus norvegicus
ataagtatagcaacgccctcagagc

SEQ ID NO: 169710 - DNA, 25 bp, Rattus norvegicus
ataagtatagcatcgccctcagagc

SEQ ID NO: 169711 - DNA, 25 bp, Rattus norvegicus
ataagtatgcttctgctcttttcct

SEQ ID NO: 169712 - DNA, 25 bp, Rattus norvegicus
ataagtatgcttgtgctcttttcct

SEQ ID NO: 169713 - DNA, 25 bp, Rattus norvegicus
ataagtatgtttatatgacaggaat

SEQ ID NO: 169714 - DNA, 25 bp, Rattus norvegicus
ataagtatgtttttatgacaggaat

SEQ ID NO: 169715 - DNA, 25 bp, Rattus norvegicus
ataagtcatccacacaggaccctgc

SEQ ID NO: 169716 - DNA, 25 bp, Rattus norvegicus
ataagtcatccagacaggaccctgc

SEQ ID NO: 169717 - DNA, 25 bp, Rattus norvegicus
ataagtccatgcacagtgtgtatac

SEQ ID NO: 169718 - DNA, 25 bp, Rattus norvegicus
ataagtccatgctcagtgtgtatac

SEQ ID NO: 169719 - DNA, 25 bp, Rattus norvegicus
ataagtccccatatgttggcccctg

SEQ ID NO: 169720 - DNA, 25 bp, Rattus norvegicus
ataagtccccatttgttggcccctg

SEQ ID NO: 169721 - DNA, 25 bp, Rattus norvegicus
ataagtcccgaaactgatggcccca

SEQ ID NO: 169722 - DNA, 25 bp, Rattus norvegicus
ataagtcccgaatctgatggcccca

SEQ ID NO: 169723 - DNA, 25 bp, Rattus norvegicus
ataagtccctacacacggatgaaga

SEQ ID NO: 169724 - DNA, 25 bp, Rattus norvegicus
ataagtccctactcacggatgaaga

SEQ ID NO: 169725 - DNA, 25 bp, Rattus norvegicus
ataagtcctccactcgacgcttctt

SEQ ID NO: 169726 - DNA, 25 bp, Rattus norvegicus
ataagtcctccagtcgacgcttctt

SEQ ID NO: 169727 - DNA, 25 bp, Rattus norvegicus
ataagtcctgacaagagcggcccgc

SEQ ID NO: 169728 - DNA, 25 bp, Rattus norvegicus
ataagtcctgactagagcggcccgc

SEQ ID NO: 169729 - DNA, 25 bp, Rattus norvegicus
ataagtctctctactacctgattcc

SEQ ID NO: 169730 - DNA, 25 bp, Rattus norvegicus
ataagtctctcttctacctgattcc

SEQ ID NO: 169731 - DNA, 25 bp, Rattus norvegicus
ataagtctctggcttttaaccgaag

SEQ ID NO: 169732 - DNA, 25 bp, Rattus norvegicus
ataagtctctgggttttaaccgaag

SEQ ID NO: 169733 - DNA, 25 bp, Rattus norvegicus
ataagtctgccaagagaacctctgt

SEQ ID NO: 169734 - DNA, 25 bp, Rattus norvegicus
ataagtctgccatgagaacctctgt

SEQ ID NO: 169735 - DNA, 25 bp, Rattus norvegicus
ataagtcttactcttgttctcctgg

SEQ ID NO: 169736 - DNA, 25 bp, Rattus norvegicus
ataagtcttactgttgttctcctgg

SEQ ID NO: 169737 - DNA, 25 bp, Rattus norvegicus
ataagtctttcacacgtgccttcct

SEQ ID NO: 169738 - DNA, 25 bp, Rattus norvegicus
ataagtctttcagacgtgccttcct

SEQ ID NO: 169739 - DNA, 25 bp, Rattus norvegicus
ataagtgaacacatgccatgcatgc

SEQ ID NO: 169740 - DNA, 25 bp, Rattus norvegicus
ataagtgaacacttgccatgcatgc

SEQ ID NO: 169741 - DNA, 25 bp, Rattus norvegicus
ataagtgaccccattttctgaagat

SEQ ID NO: 169742 - DNA, 25 bp, Rattus norvegicus
ataagtgacccctttttctgaagat

SEQ ID NO: 169743 - DNA, 25 bp, Rattus norvegicus
ataagtgattgtactttccccatca

SEQ ID NO: 169744 - DNA, 25 bp, Rattus norvegicus
ataagtgattgttctttccccatca

SEQ ID NO: 169745 - DNA, 25 bp, Rattus norvegicus
ataagtgcattcagttgtttccaac

SEQ ID NO: 169746 - DNA, 25 bp, Rattus norvegicus
ataagtgcattctgttgtttccaac

SEQ ID NO: 169747 - DNA, 25 bp, Rattus norvegicus
ataagtgcccagctttggccaaggt

SEQ ID NO: 169748 - DNA, 25 bp, Rattus norvegicus
ataagtgcccaggtttggccaaggt

SEQ ID NO: 169749 - DNA, 25 bp, Rattus norvegicus
ataagtgcctggagcgatcgctaca

SEQ ID NO: 169750 - DNA, 25 bp, Rattus norvegicus
ataagtgcctggtgcgatcgctaca

SEQ ID NO: 169751 - DNA, 25 bp, Rattus norvegicus
ataagtgctgcgagatctcctggac

SEQ ID NO: 169752 - DNA, 25 bp, Rattus norvegicus
ataagtgctgcgtgatctcctggac

SEQ ID NO: 169753 - DNA, 25 bp, Rattus norvegicus
ataagtgctgggacaaggtcattct

SEQ ID NO: 169754 - DNA, 25 bp, Rattus norvegicus
ataagtgctgggtcaaggtcattct

SEQ ID NO: 169755 - DNA, 25 bp, Rattus norvegicus
ataagtggccagctctgcatgtctt

SEQ ID NO: 169756 - DNA, 25 bp, Rattus norvegicus
ataagtggccaggtctgcatgtctt

SEQ ID NO: 169757 - DNA, 25 bp, Rattus norvegicus
ataagtggctacctcttgtctctct

SEQ ID NO: 169758 - DNA, 25 bp, Rattus norvegicus
ataagtggctacgtcttgtctctct

SEQ ID NO: 169759 - DNA, 25 bp, Rattus norvegicus
ataagtgggacccttactgtgccat

SEQ ID NO: 169760 - DNA, 25 bp, Rattus norvegicus
ataagtgggaccgttactgtgccat

SEQ ID NO: 169761 - DNA, 25 bp, Rattus norvegicus
ataagtggtgccatgggtgtcatca

SEQ ID NO: 169762 - DNA, 25 bp, Rattus norvegicus
ataagtggtgccttgggtgtcatca

SEQ ID NO: 169763 - DNA, 25 bp, Rattus norvegicus
ataagtggttctctgcctctagctt

SEQ ID NO: 169764 - DNA, 25 bp, Rattus norvegicus
ataagtggttctgtgcctctagctt

SEQ ID NO: 169765 - DNA, 25 bp, Rattus norvegicus
ataagtgtcgacactgcttcaagca

SEQ ID NO: 169766 - DNA, 25 bp, Rattus norvegicus
ataagtgtcgactctgcttcaagca

SEQ ID NO: 169767 - DNA, 25 bp, Rattus norvegicus
ataagtgtttcacacacgcttcctc

SEQ ID NO: 169768 - DNA, 25 bp, Rattus norvegicus
ataagtgtttcagacacgcttcctc

SEQ ID NO: 169769 - DNA, 25 bp, Rattus norvegicus
ataagttactaacagccctttgaat

SEQ ID NO: 169770 - DNA, 25 bp, Rattus norvegicus
ataagttactaagagccctttgaat

SEQ ID NO: 169771 - DNA, 25 bp, Rattus norvegicus
ataagttagtgtccagaccatgacc

SEQ ID NO: 169772 - DNA, 25 bp, Rattus norvegicus
ataagttagtgtgcagaccatgacc

SEQ ID NO: 169773 - DNA, 25 bp, Rattus norvegicus
ataagttcaacaaggctctggtgca

SEQ ID NO: 169774 - DNA, 25 bp, Rattus norvegicus
ataagttcaacatggctctggtgca

SEQ ID NO: 169775 - DNA, 25 bp, Rattus norvegicus
ataagttccaagcttcagaggcctc

SEQ ID NO: 169776 - DNA, 25 bp, Rattus norvegicus
ataagttccaaggttcagaggcctc

SEQ ID NO: 169777 - DNA, 25 bp, Rattus norvegicus
ataagttcgaccacatgtatgccaa

SEQ ID NO: 169778 - DNA, 25 bp, Rattus norvegicus
ataagttcgacctcatgtatgccaa

SEQ ID NO: 169779 - DNA, 25 bp, Rattus norvegicus
ataagttcgtagatgccatgctgag

SEQ ID NO: 169780 - DNA, 25 bp, Rattus norvegicus
ataagttcgtagttgccatgctgag

SEQ ID NO: 169781 - DNA, 25 bp, Rattus norvegicus
ataagttgtaggacagccacggtct

SEQ ID NO: 169782 - DNA, 25 bp, Rattus norvegicus
ataagttgtaggtcagccacggtct

SEQ ID NO: 169783 - DNA, 25 bp, Rattus norvegicus
ataagttgtcctaagtctcttgtgc

SEQ ID NO: 169784 - DNA, 25 bp, Rattus norvegicus
ataagttgtccttagtctcttgtgc

SEQ ID NO: 169785 - DNA, 25 bp, Rattus norvegicus
ataagttgtcttccttgtgatgtaa

SEQ ID NO: 169786 - DNA, 25 bp, Rattus norvegicus
ataagttgtcttgcttgtgatgtaa

SEQ ID NO: 169787 - DNA, 25 bp, Rattus norvegicus
ataagttgtgtaacctgggatgggc

SEQ ID NO: 169788 - DNA, 25 bp, Rattus norvegicus
ataagttgtgtatcctgggatgggc

SEQ ID NO: 169789 - DNA, 25 bp, Rattus norvegicus
ataagtttaaacagcaacctttctg

SEQ ID NO: 169790 - DNA, 25 bp, Rattus norvegicus
ataagtttaaactgcaacctttctg

SEQ ID NO: 169791 - DNA, 25 bp, Rattus norvegicus
ataagtttaaggatgcccgcagtgt

SEQ ID NO: 169792 - DNA, 25 bp, Rattus norvegicus
ataagtttaaggttgcccgcagtgt

SEQ ID NO: 169793 - DNA, 25 bp, Rattus norvegicus
ataagtttcaccatatattctgcaa

SEQ ID NO: 169794 - DNA, 25 bp, Rattus norvegicus
ataagtttcaccttatattctgcaa

SEQ ID NO: 169795 - DNA, 25 bp, Rattus norvegicus
ataagtttctgaagccacaacccca

SEQ ID NO: 169796 - DNA, 25 bp, Rattus norvegicus
ataagtttctgatgccacaacccca

SEQ ID NO: 169797 - DNA, 25 bp, Rattus norvegicus
ataagtttctttccttctctcctcc

SEQ ID NO: 169798 - DNA, 25 bp, Rattus norvegicus
ataagtttctttgcttctctcctcc

SEQ ID NO: 169799 - DNA, 25 bp, Rattus norvegicus
ataagtttgatgctagcctgatcta

SEQ ID NO: 169800 - DNA, 25 bp, Rattus norvegicus
ataagtttgatggtagcctgatcta

SEQ ID NO: 169801 - DNA, 25 bp, Rattus norvegicus
ataagtttggatcctgcgtgccaca

SEQ ID NO: 169802 - DNA, 25 bp, Rattus norvegicus
ataagtttggatgctgcgtgccaca

SEQ ID NO: 169803 - DNA, 25 bp, Rattus norvegicus
ataagttttatacaccagcccagtg

SEQ ID NO: 169804 - DNA, 25 bp, Rattus norvegicus
ataagttttatagaccagcccagtg

SEQ ID NO: 169805 - DNA, 25 bp, Rattus norvegicus
ataataaaagtgctgtgagtcctca

SEQ ID NO: 169806 - DNA, 25 bp, Rattus norvegicus
ataataaaagtggtgtgagtcctca

SEQ ID NO: 169807 - DNA, 25 bp, Rattus norvegicus
ataataagccacctctgtactgtct

SEQ ID NO: 169808 - DNA, 25 bp, Rattus norvegicus
ataataagccacgtctgtactgtct

SEQ ID NO: 169809 - DNA, 25 bp, Rattus norvegicus
ataatacacagaagtcagggacccc

SEQ ID NO: 169810 - DNA, 25 bp, Rattus norvegicus
ataatacacagatgtcagggacccc

SEQ ID NO: 169811 - DNA, 25 bp, Rattus norvegicus
ataatacactccatcctctctagat

SEQ ID NO: 169812 - DNA, 25 bp, Rattus norvegicus
ataatacactccttcctctctagat

SEQ ID NO: 169813 - DNA, 25 bp, Rattus norvegicus
ataatacatgatcacccctctacta

SEQ ID NO: 169814 - DNA, 25 bp, Rattus norvegicus
ataatacatgatgacccctctacta

SEQ ID NO: 169815 - DNA, 25 bp, Rattus norvegicus
ataatacattgtccactcttagtga

SEQ ID NO: 169816 - DNA, 25 bp, Rattus norvegicus
ataatacattgtgcactcttagtga

SEQ ID NO: 169817 - DNA, 25 bp, Rattus norvegicus
ataatacatttccagctgcaccacc

SEQ ID NO: 169818 - DNA, 25 bp, Rattus norvegicus
ataatacatttcgagctgcaccacc

SEQ ID NO: 169819 - DNA, 25 bp, Rattus norvegicus
ataatacgatacattggcccttaag

SEQ ID NO: 169820 - DNA, 25 bp, Rattus norvegicus
ataatacgatactttggcccttaag

SEQ ID NO: 169821 - DNA, 25 bp, Rattus norvegicus
ataatacgtggactggtaccagccc

SEQ ID NO: 169822 - DNA, 25 bp, Rattus norvegicus
ataatacgtggagtggtaccagccc

SEQ ID NO: 169823 - DNA, 25 bp, Rattus norvegicus
ataatactctgtccattccttaact

SEQ ID NO: 169824 - DNA, 25 bp, Rattus norvegicus
ataatactctgtgcattccttaact

SEQ ID NO: 169825 - DNA, 25 bp, Rattus norvegicus
ataatactgttaaataccccatgct

SEQ ID NO: 169826 - DNA, 25 bp, Rattus norvegicus
ataatactgttatataccccatgct

SEQ ID NO: 169827 - DNA, 25 bp, Rattus norvegicus
ataatactgttccttctgatggctc

SEQ ID NO: 169828 - DNA, 25 bp, Rattus norvegicus
ataatactgttcgttctgatggctc

SEQ ID NO: 169829 - DNA, 25 bp, Rattus norvegicus
ataatactgtttccgctcatttgct

SEQ ID NO: 169830 - DNA, 25 bp, Rattus norvegicus
ataatactgtttgcgctcatttgct

SEQ ID NO: 169831 - DNA, 25 bp, Rattus norvegicus
ataatacttcatcatctcgtcggag

SEQ ID NO: 169832 - DNA, 25 bp, Rattus norvegicus
ataatacttcatgatctcgtcggag

SEQ ID NO: 169833 - DNA, 25 bp, Rattus norvegicus
ataatacttctgacttcgttactta

SEQ ID NO: 169834 - DNA, 25 bp, Rattus norvegicus
ataatacttctgtcttcgttactta

SEQ ID NO: 169835 - DNA, 25 bp, Rattus norvegicus
ataatagagcagatcctgccaccca

SEQ ID NO: 169836 - DNA, 25 bp, Rattus norvegicus
ataatagagcagttcctgccaccca

SEQ ID NO: 169837 - DNA, 25 bp, Rattus norvegicus
ataatagagcccacggttgtggccc

SEQ ID NO: 169838 - DNA, 25 bp, Rattus norvegicus
ataatagagccctcggttgtggccc

SEQ ID NO: 169839 - DNA, 25 bp, Rattus norvegicus
ataatagccaacatcccatgggaaa

SEQ ID NO: 169840 - DNA, 25 bp, Rattus norvegicus
ataatagccaacttcccatgggaaa

SEQ ID NO: 169841 - DNA, 25 bp, Rattus norvegicus
ataatagcgcagactttgccttttg

SEQ ID NO: 169842 - DNA, 25 bp, Rattus norvegicus
ataatagcgcagtctttgccttttg

SEQ ID NO: 169843 - DNA, 25 bp, Rattus norvegicus
ataatagctgccatcgtcctcagga

SEQ ID NO: 169844 - DNA, 25 bp, Rattus norvegicus
ataatagctgccttcgtcctcagga

SEQ ID NO: 169845 - DNA, 25 bp, Rattus norvegicus
ataatagcttttccttggacacaaa

SEQ ID NO: 169846 - DNA, 25 bp, Rattus norvegicus
ataatagcttttgcttggacacaaa

SEQ ID NO: 169847 - DNA, 25 bp, Rattus norvegicus
ataataggctgtctccacccagaca

SEQ ID NO: 169848 - DNA, 25 bp, Rattus norvegicus
ataataggctgtgtccacccagaca

SEQ ID NO: 169849 - DNA, 25 bp, Rattus norvegicus
ataatagggcttatccccgatgtaa

SEQ ID NO: 169850 - DNA, 25 bp, Rattus norvegicus
ataatagggcttttccccgatgtaa

SEQ ID NO: 169851 - DNA, 25 bp, Rattus norvegicus
ataataggtctccaggtgcgctacg

SEQ ID NO: 169852 - DNA, 25 bp, Rattus norvegicus
ataataggtctcgaggtgcgctacg

SEQ ID NO: 169853 - DNA, 25 bp, Rattus norvegicus
ataatagtctgcctgcttctcgtga

SEQ ID NO: 169854 - DNA, 25 bp, Rattus norvegicus
ataatagtctgcgtgcttctcgtga

SEQ ID NO: 169855 - DNA, 25 bp, Rattus norvegicus
ataatagtgttcaactgcaggctag

SEQ ID NO: 169856 - DNA, 25 bp, Rattus norvegicus
ataatagtgttctactgcaggctag

SEQ ID NO: 169857 - DNA, 25 bp, Rattus norvegicus
ataatatcagcgaccttggcctgga

SEQ ID NO: 169858 - DNA, 25 bp, Rattus norvegicus
ataatatcagcgtccttggcctgga

SEQ ID NO: 169859 - DNA, 25 bp, Rattus norvegicus
ataatatcggctcgctgcttgtaca

SEQ ID NO: 169860 - DNA, 25 bp, Rattus norvegicus
ataatatcggctggctgcttgtaca

SEQ ID NO: 169861 - DNA, 25 bp, Rattus norvegicus
ataatatctcatcaacaaccgtaac

SEQ ID NO: 169862 - DNA, 25 bp, Rattus norvegicus
ataatatctcatgaacaaccgtaac

SEQ ID NO: 169863 - DNA, 25 bp, Rattus norvegicus
ataatatctcttaatgcccctcatc

SEQ ID NO: 169864 - DNA, 25 bp, Rattus norvegicus
ataatatctctttatgcccctcatc

SEQ ID NO: 169865 - DNA, 25 bp, Rattus norvegicus
ataatatggtgtcctctgtgccagt

SEQ ID NO: 169866 - DNA, 25 bp, Rattus norvegicus
ataatatggtgtgctctgtgccagt

SEQ ID NO: 169867 - DNA, 25 bp, Rattus norvegicus
ataatatgttgtcagtgagtcacct

SEQ ID NO: 169868 - DNA, 25 bp, Rattus norvegicus
ataatatgttgtgagtgagtcacct

SEQ ID NO: 169869 - DNA, 25 bp, Rattus norvegicus
ataatattaaacacaggctggcctg

SEQ ID NO: 169870 - DNA, 25 bp, Rattus norvegicus
ataatattaaactcaggctggcctg

SEQ ID NO: 169871 - DNA, 25 bp, Rattus norvegicus
ataatattctggatccttctcattc

SEQ ID NO: 169872 - DNA, 25 bp, Rattus norvegicus
ataatattctggttccttctcattc

SEQ ID NO: 169873 - DNA, 25 bp, Rattus norvegicus
ataatatttgttctgcttgcttggg

SEQ ID NO: 169874 - DNA, 25 bp, Rattus norvegicus
ataatatttgttgtgcttgcttggg

SEQ ID NO: 169875 - DNA, 25 bp, Rattus norvegicus
ataatattttgcaacctttgtgggt

SEQ ID NO: 169876 - DNA, 25 bp, Rattus norvegicus
ataatattttgctacctttgtgggt

SEQ ID NO: 169877 - DNA, 25 bp, Rattus norvegicus
ataatcaaatgtctttctgtggaac

SEQ ID NO: 169878 - DNA, 25 bp, Rattus norvegicus
ataatcaaatgtgtttctgtggaac

SEQ ID NO: 169879 - DNA, 25 bp, Rattus norvegicus
ataatcaatttgacagcagaagcag

SEQ ID NO: 169880 - DNA, 25 bp, Rattus norvegicus
ataatcaatttgtcagcagaagcag

SEQ ID NO: 169881 - DNA, 25 bp, Rattus norvegicus
ataatcacatacaatctgcctgcct

SEQ ID NO: 169882 - DNA, 25 bp, Rattus norvegicus
ataatcacatactatctgcctgcct

SEQ ID NO: 169883 - DNA, 25 bp, Rattus norvegicus
ataatcacgatactcttgggtggta

SEQ ID NO: 169884 - DNA, 25 bp, Rattus norvegicus
ataatcacgatagtcttgggtggta

SEQ ID NO: 169885 - DNA, 25 bp, Rattus norvegicus
ataatcacgtggacaactgcctgca

SEQ ID NO: 169886 - DNA, 25 bp, Rattus norvegicus
ataatcacgtggtcaactgcctgca

SEQ ID NO: 169887 - DNA, 25 bp, Rattus norvegicus
ataatcactctaaacgtaagcctgt

SEQ ID NO: 169888 - DNA, 25 bp, Rattus norvegicus
ataatcactctatacgtaagcctgt

SEQ ID NO: 169889 - DNA, 25 bp, Rattus norvegicus
ataatcactgaaaccttctgccttc

SEQ ID NO: 169890 - DNA, 25 bp, Rattus norvegicus
ataatcactgaatccttctgccttc

SEQ ID NO: 169891 - DNA, 25 bp, Rattus norvegicus
ataatcagcattaaccctggcaggg

SEQ ID NO: 169892 - DNA, 25 bp, Rattus norvegicus
ataatcagcatttaccctggcaggg

SEQ ID NO: 169893 - DNA, 25 bp, Rattus norvegicus
ataatcagtcatatccttcattccc

SEQ ID NO: 169894 - DNA, 25 bp, Rattus norvegicus
ataatcagtcatttccttcattccc

SEQ ID NO: 169895 - DNA, 25 bp, Rattus norvegicus
ataatcagtgcactccaatgggcct

SEQ ID NO: 169896 - DNA, 25 bp, Rattus norvegicus
ataatcagtgcactgtttgagacca

SEQ ID NO: 169897 - DNA, 25 bp, Rattus norvegicus
ataatcagtgcagtccaatgggcct

SEQ ID NO: 169898 - DNA, 25 bp, Rattus norvegicus
ataatcagtgcagtgtttgagacca

SEQ ID NO: 169899 - DNA, 25 bp, Rattus norvegicus
ataatcataagccaagccttgtcct

SEQ ID NO: 169900 - DNA, 25 bp, Rattus norvegicus
ataatcataagcgaagccttgtcct

SEQ ID NO: 169901 - DNA, 25 bp, Rattus norvegicus
ataatcatgaagatgtatctctcaa

SEQ ID NO: 169902 - DNA, 25 bp, Rattus norvegicus
ataatcatgaagttgtatctctcaa

SEQ ID NO: 169903 - DNA, 25 bp, Rattus norvegicus
ataatcatggcaatcctgtatcaat

SEQ ID NO: 169904 - DNA, 25 bp, Rattus norvegicus
ataatcatggcattcctgtatcaat

SEQ ID NO: 169905 - DNA, 25 bp, Rattus norvegicus
ataatcatgtgactggtctccttat

SEQ ID NO: 169906 - DNA, 25 bp, Rattus norvegicus
ataatcatgtgagtggtctccttat

SEQ ID NO: 169907 - DNA, 25 bp, Rattus norvegicus
ataatcattctgagtatactttggg

SEQ ID NO: 169908 - DNA, 25 bp, Rattus norvegicus
ataatcattctgtgtatactttggg

SEQ ID NO: 169909 - DNA, 25 bp, Rattus norvegicus
ataatccaagtacgtggctctttgt

SEQ ID NO: 169910 - DNA, 25 bp, Rattus norvegicus
ataatccaagtaggtggctctttgt

SEQ ID NO: 169911 - DNA, 25 bp, Rattus norvegicus
ataatccacactatgaccgtgacct

SEQ ID NO: 169912 - DNA, 25 bp, Rattus norvegicus
ataatccacactttgaccgtgacct

SEQ ID NO: 169913 - DNA, 25 bp, Rattus norvegicus
ataatccaccctaaacagtgctaaa

SEQ ID NO: 169914 - DNA, 25 bp, Rattus norvegicus
ataatccacccttaacagtgctaaa

SEQ ID NO: 169915 - DNA, 25 bp, Rattus norvegicus
ataatccagggactcaaaatacaga

SEQ ID NO: 169916 - DNA, 25 bp, Rattus norvegicus
ataatccagggagtcaaaatacaga

SEQ ID NO: 169917 - DNA, 25 bp, Rattus norvegicus
ataatccagggcattccaggcttct

SEQ ID NO: 169918 - DNA, 25 bp, Rattus norvegicus
ataatccagggctttccaggcttct

SEQ ID NO: 169919 - DNA, 25 bp, Rattus norvegicus
ataatccataaaacctaaccagtgt

SEQ ID NO: 169920 - DNA, 25 bp, Rattus norvegicus
ataatccataaatcctaaccagtgt

SEQ ID NO: 169921 - DNA, 25 bp, Rattus norvegicus
ataatccatgccagggactgacaga

SEQ ID NO: 169922 - DNA, 25 bp, Rattus norvegicus
ataatccatgcctgggactgacaga

SEQ ID NO: 169923 - DNA, 25 bp, Rattus norvegicus
ataatccattacatctcaggctctg

SEQ ID NO: 169924 - DNA, 25 bp, Rattus norvegicus
ataatccattacttctcaggctctg

SEQ ID NO: 169925 - DNA, 25 bp, Rattus norvegicus
ataatcccagatcccataagccgag

SEQ ID NO: 169926 - DNA, 25 bp, Rattus norvegicus
ataatcccagatgccataagccgag

SEQ ID NO: 169927 - DNA, 25 bp, Rattus norvegicus
ataatcccagccatcggcaagtgga

SEQ ID NO: 169928 - DNA, 25 bp, Rattus norvegicus
ataatcccagccttcggcaagtgga

SEQ ID NO: 169929 - DNA, 25 bp, Rattus norvegicus
ataatccccaaaccgcatgactgcg

SEQ ID NO: 169930 - DNA, 25 bp, Rattus norvegicus
ataatccccaaagcgcatgactgcg

SEQ ID NO: 169931 - DNA, 25 bp, Rattus norvegicus
ataatccctatcacaagcttcttaa

SEQ ID NO: 169932 - DNA, 25 bp, Rattus norvegicus
ataatccctatctcaagcttcttaa

SEQ ID NO: 169933 - DNA, 25 bp, Rattus norvegicus
ataatccctgatattccactatgaa

SEQ ID NO: 169934 - DNA, 25 bp, Rattus norvegicus
ataatccctgatctgtttcccttga

SEQ ID NO: 169935 - DNA, 25 bp, Rattus norvegicus
ataatccctgatgtgtttcccttga

SEQ ID NO: 169936 - DNA, 25 bp, Rattus norvegicus
ataatccctgattttccactatgaa

SEQ ID NO: 169937 - DNA, 25 bp, Rattus norvegicus
ataatcccttcacgtacaggccagt

SEQ ID NO: 169938 - DNA, 25 bp, Rattus norvegicus
ataatcccttcaggtacaggccagt

SEQ ID NO: 169939 - DNA, 25 bp, Rattus norvegicus
ataatccgggttcctttgccctgtg

SEQ ID NO: 169940 - DNA, 25 bp, Rattus norvegicus
ataatccgggttgctttgccctgtg

SEQ ID NO: 169941 - DNA, 25 bp, Rattus norvegicus
ataatccgtcagattggcggtaaga

SEQ ID NO: 169942 - DNA, 25 bp, Rattus norvegicus
ataatccgtcagtttggcggtaaga

SEQ ID NO: 169943 - DNA, 25 bp, Rattus norvegicus
ataatcctcatccttcccctgtgtt

SEQ ID NO: 169944 - DNA, 25 bp, Rattus norvegicus
ataatcctcatcgttcccctgtgtt

SEQ ID NO: 169945 - DNA, 25 bp, Rattus norvegicus
ataatcctgtataaacggagactgt

SEQ ID NO: 169946 - DNA, 25 bp, Rattus norvegicus
ataatcctgtattaacggagactgt

SEQ ID NO: 169947 - DNA, 25 bp, Rattus norvegicus
ataatcctgtgaagtctccagtagg

SEQ ID NO: 169948 - DNA, 25 bp, Rattus norvegicus
ataatcctgtgatgtctccagtagg

SEQ ID NO: 169949 - DNA, 25 bp, Rattus norvegicus
ataatcctgtgcctaaagagtctgg

SEQ ID NO: 169950 - DNA, 25 bp, Rattus norvegicus
ataatcctgtgcgtaaagagtctgg

SEQ ID NO: 169951 - DNA, 25 bp, Rattus norvegicus
ataatcctttcaacacacttcttta

SEQ ID NO: 169952 - DNA, 25 bp, Rattus norvegicus
ataatcctttcatcacacttcttta

SEQ ID NO: 169953 - DNA, 25 bp, Rattus norvegicus
ataatccttttaaagctgcagcaaa

SEQ ID NO: 169954 - DNA, 25 bp, Rattus norvegicus
ataatccttttatagctgcagcaaa

SEQ ID NO: 169955 - DNA, 25 bp, Rattus norvegicus
ataatcgagcttatgttacataatg

SEQ ID NO: 169956 - DNA, 25 bp, Rattus norvegicus
ataatcgagcttttgttacataatg

SEQ ID NO: 169957 - DNA, 25 bp, Rattus norvegicus
ataatcgatccaacccagagggact

SEQ ID NO: 169958 - DNA, 25 bp, Rattus norvegicus
ataatcgatccatcccagagggact

SEQ ID NO: 169959 - DNA, 25 bp, Rattus norvegicus
ataatcgcaacaccctcccgggagt

SEQ ID NO: 169960 - DNA, 25 bp, Rattus norvegicus
ataatcgcaacagcctcccgggagt

SEQ ID NO: 169961 - DNA, 25 bp, Rattus norvegicus
ataatcggattcacacgctcagcag

SEQ ID NO: 169962 - DNA, 25 bp, Rattus norvegicus
ataatcggattctcacgctcagcag

SEQ ID NO: 169963 - DNA, 25 bp, Rattus norvegicus
ataatcggccttagcaaggcgccac

SEQ ID NO: 169964 - DNA, 25 bp, Rattus norvegicus
ataatcggcctttgcaaggcgccac

SEQ ID NO: 169965 - DNA, 25 bp, Rattus norvegicus
ataatcgtagcccttcatgttgcac

SEQ ID NO: 169966 - DNA, 25 bp, Rattus norvegicus
ataatcgtagccgttcatgttgcac

SEQ ID NO: 169967 - DNA, 25 bp, Rattus norvegicus
ataatcgttatgaaccttcaggtgt

SEQ ID NO: 169968 - DNA, 25 bp, Rattus norvegicus
ataatcgttatgtaccttcaggtgt

SEQ ID NO: 169969 - DNA, 25 bp, Rattus norvegicus
ataatctaacatatcacctcgtctc

SEQ ID NO: 169970 - DNA, 25 bp, Rattus norvegicus
ataatctaacatttcacctcgtctc

SEQ ID NO: 169971 - DNA, 25 bp, Rattus norvegicus
ataatctagtccaccctgtattggc

SEQ ID NO: 169972 - DNA, 25 bp, Rattus norvegicus
ataatctagtcctccctgtattggc

SEQ ID NO: 169973 - DNA, 25 bp, Rattus norvegicus
ataatctatacactgcatgctggga

SEQ ID NO: 169974 - DNA, 25 bp, Rattus norvegicus
ataatctatacagtgcatgctggga

SEQ ID NO: 169975 - DNA, 25 bp, Rattus norvegicus
ataatctcagatccataaacgggaa

SEQ ID NO: 169976 - DNA, 25 bp, Rattus norvegicus
ataatctcagatgcataaacgggaa

SEQ ID NO: 169977 - DNA, 25 bp, Rattus norvegicus
ataatctcaggactgaccggcttca

SEQ ID NO: 169978 - DNA, 25 bp, Rattus norvegicus
ataatctcaggagtgaccggcttca

SEQ ID NO: 169979 - DNA, 25 bp, Rattus norvegicus
ataatctccatcaggtctcaagtgc

SEQ ID NO: 169980 - DNA, 25 bp, Rattus norvegicus
ataatctccatctggtctcaagtgc

SEQ ID NO: 169981 - DNA, 25 bp, Rattus norvegicus
ataatctccccacttctgttaaggg

SEQ ID NO: 169982 - DNA, 25 bp, Rattus norvegicus
ataatctccccagttctgttaaggg

SEQ ID NO: 169983 - DNA, 25 bp, Rattus norvegicus
ataatctccgtgattggcttcgtgt

SEQ ID NO: 169984 - DNA, 25 bp, Rattus norvegicus
ataatctccgtgtttggcttcgtgt

SEQ ID NO: 169985 - DNA, 25 bp, Rattus norvegicus
ataatctctccgagagataccggca

SEQ ID NO: 169986 - DNA, 25 bp, Rattus norvegicus
ataatctctccgtgagataccggca

SEQ ID NO: 169987 - DNA, 25 bp, Rattus norvegicus
ataatctgacctatgagtttcatca

SEQ ID NO: 169988 - DNA, 25 bp, Rattus norvegicus
ataatctgacctttgagtttcatca

SEQ ID NO: 169989 - DNA, 25 bp, Rattus norvegicus
ataatctgagatctgttccaagcaa

SEQ ID NO: 169990 - DNA, 25 bp, Rattus norvegicus
ataatctgagatgtgttccaagcaa

SEQ ID NO: 169991 - DNA, 25 bp, Rattus norvegicus
ataatctggatgaggctggctgact

SEQ ID NO: 169992 - DNA, 25 bp, Rattus norvegicus
ataatctggatgtggctggctgact

SEQ ID NO: 169993 - DNA, 25 bp, Rattus norvegicus
ataatctgtcccaggctgcccaggg

SEQ ID NO: 169994 - DNA, 25 bp, Rattus norvegicus
ataatctgtccctggctgcccaggg

SEQ ID NO: 169995 - DNA, 25 bp, Rattus norvegicus
ataatcttcaacactgacatccagc

SEQ ID NO: 169996 - DNA, 25 bp, Rattus norvegicus
ataatcttcaactctgacatccagc

SEQ ID NO: 169997 - DNA, 25 bp, Rattus norvegicus
ataatcttcattcctctgtaggagt

SEQ ID NO: 169998 - DNA, 25 bp, Rattus norvegicus
ataatcttcattgctctgtaggagt

SEQ ID NO: 169999 - DNA, 25 bp, Rattus norvegicus
ataatcttcggtaacctctggttct

SEQ ID NO: 170000 - DNA, 25 bp, Rattus norvegicus
ataatcttcggttacctctggttct

SEQ ID NO: 170001 - DNA, 25 bp, Rattus norvegicus
ataatcttcttgcattagtccacaa

SEQ ID NO: 170002 - DNA, 25 bp, Rattus norvegicus
ataatcttcttggattagtccacaa

SEQ ID NO: 170003 - DNA, 25 bp, Rattus norvegicus
ataatcttgattaatgccctcccct

SEQ ID NO: 170004 - DNA, 25 bp, Rattus norvegicus
ataatcttgatttatgccctcccct

SEQ ID NO: 170005 - DNA, 25 bp, Rattus norvegicus
ataatctttcttagccttgaccgag

SEQ ID NO: 170006 - DNA, 25 bp, Rattus norvegicus
ataatctttctttgccttgaccgag

SEQ ID NO: 170007 - DNA, 25 bp, Rattus norvegicus
ataatgaaccaccagagactctaca

SEQ ID NO: 170008 - DNA, 25 bp, Rattus norvegicus
ataatgaaccacgagagactctaca

SEQ ID NO: 170009 - DNA, 25 bp, Rattus norvegicus
ataatgaatcctcgcctagtcctca

SEQ ID NO: 170010 - DNA, 25 bp, Rattus norvegicus
ataatgaatcctggcctagtcctca

SEQ ID NO: 170011 - DNA, 25 bp, Rattus norvegicus
ataatgacacagctgggaaccactc

SEQ ID NO: 170012 - DNA, 25 bp, Rattus norvegicus
ataatgacacaggtgggaaccactc

SEQ ID NO: 170013 - DNA, 25 bp, Rattus norvegicus
ataatgacctttatgagacccagtc

SEQ ID NO: 170014 - DNA, 25 bp, Rattus norvegicus
ataatgacctttttgagacccagtc

SEQ ID NO: 170015 - DNA, 25 bp, Rattus norvegicus
ataatgacggttacctagctacaaa

SEQ ID NO: 170016 - DNA, 25 bp, Rattus norvegicus
ataatgacggtttcctagctacaaa

SEQ ID NO: 170017 - DNA, 25 bp, Rattus norvegicus
ataatgacgtcaacgctacactcac

SEQ ID NO: 170018 - DNA, 25 bp, Rattus norvegicus
ataatgacgtcatcgctacactcac

SEQ ID NO: 170019 - DNA, 25 bp, Rattus norvegicus
ataatgagcgcgattattgtgctaa

SEQ ID NO: 170020 - DNA, 25 bp, Rattus norvegicus
ataatgagcgcgtttattgtgctaa

SEQ ID NO: 170021 - DNA, 25 bp, Rattus norvegicus
ataatgataaacacctcacgcctca

SEQ ID NO: 170022 - DNA, 25 bp, Rattus norvegicus
ataatgataaactcctcacgcctca

SEQ ID NO: 170023 - DNA, 25 bp, Rattus norvegicus
ataatgatctctctttcttgtaaag

SEQ ID NO: 170024 - DNA, 25 bp, Rattus norvegicus
ataatgatctctgtttcttgtaaag

SEQ ID NO: 170025 - DNA, 25 bp, Rattus norvegicus
ataatgatgtttctccctctaactc

SEQ ID NO: 170026 - DNA, 25 bp, Rattus norvegicus
ataatgatgtttgtccctctaactc

SEQ ID NO: 170027 - DNA, 25 bp, Rattus norvegicus
ataatgcaatacctgttcttcctct

SEQ ID NO: 170028 - DNA, 25 bp, Rattus norvegicus
ataatgcaatacgtgttcttcctct

SEQ ID NO: 170029 - DNA, 25 bp, Rattus norvegicus
ataatgcatgttcttctcctgtggg

SEQ ID NO: 170030 - DNA, 25 bp, Rattus norvegicus
ataatgcatgttgttctcctgtggg

SEQ ID NO: 170031 - DNA, 25 bp, Rattus norvegicus
ataatgcattaacgctgaccaggag

SEQ ID NO: 170032 - DNA, 25 bp, Rattus norvegicus
ataatgcattaaggctgaccaggag

SEQ ID NO: 170033 - DNA, 25 bp, Rattus norvegicus
ataatgccagcaaccaaaccacgtc

SEQ ID NO: 170034 - DNA, 25 bp, Rattus norvegicus
ataatgccagcatccaaaccacgtc

SEQ ID NO: 170035 - DNA, 25 bp, Rattus norvegicus
ataatgcctctgactagcatgccaa

SEQ ID NO: 170036 - DNA, 25 bp, Rattus norvegicus
ataatgcctctgacttccagtgcca

SEQ ID NO: 170037 - DNA, 25 bp, Rattus norvegicus
ataatgcctctgtctagcatgccaa

SEQ ID NO: 170038 - DNA, 25 bp, Rattus norvegicus
ataatgcctctgtcttccagtgcca

SEQ ID NO: 170039 - DNA, 25 bp, Rattus norvegicus
ataatgcctgccatggacttgggaa

SEQ ID NO: 170040 - DNA, 25 bp, Rattus norvegicus
ataatgcctgccttggacttgggaa

SEQ ID NO: 170041 - DNA, 25 bp, Rattus norvegicus
ataatgcctgcgatctttttgccgt

SEQ ID NO: 170042 - DNA, 25 bp, Rattus norvegicus
ataatgcctgcgttctttttgccgt

SEQ ID NO: 170043 - DNA, 25 bp, Rattus norvegicus
ataatgccttttagtcccattctct

SEQ ID NO: 170044 - DNA, 25 bp, Rattus norvegicus
ataatgcctttttgtcccattctct

SEQ ID NO: 170045 - DNA, 25 bp, Rattus norvegicus
ataatgcgaggcactccgctaaagt

SEQ ID NO: 170046 - DNA, 25 bp, Rattus norvegicus
ataatgcgaggctctccgctaaagt

SEQ ID NO: 170047 - DNA, 25 bp, Rattus norvegicus
ataatgcgcagcagtgtccctaagt

SEQ ID NO: 170048 - DNA, 25 bp, Rattus norvegicus
ataatgcgcagctgtgtccctaagt

SEQ ID NO: 170049 - DNA, 25 bp, Rattus norvegicus
ataatgctcgtccacaagctggcac

SEQ ID NO: 170050 - DNA, 25 bp, Rattus norvegicus
ataatgctcgtcgacaagctggcac

SEQ ID NO: 170051 - DNA, 25 bp, Rattus norvegicus
ataatgctctctcggaggccaacat

SEQ ID NO: 170052 - DNA, 25 bp, Rattus norvegicus
ataatgctctctgggaggccaacat

SEQ ID NO: 170053 - DNA, 25 bp, Rattus norvegicus
ataatgctgacactcctgcggaact

SEQ ID NO: 170054 - DNA, 25 bp, Rattus norvegicus
ataatgctgacagtcctgcggaact

SEQ ID NO: 170055 - DNA, 25 bp, Rattus norvegicus
ataatgctgctaaagtcgccgcacg

SEQ ID NO: 170056 - DNA, 25 bp, Rattus norvegicus
ataatgctgctatagtcgccgcacg

SEQ ID NO: 170057 - DNA, 25 bp, Rattus norvegicus
ataatgctttgcattcccagctgac

SEQ ID NO: 170058 - DNA, 25 bp, Rattus norvegicus
ataatgctttgctttcccagctgac

SEQ ID NO: 170059 - DNA, 25 bp, Rattus norvegicus
ataatggacattaaccacttccccg

SEQ ID NO: 170060 - DNA, 25 bp, Rattus norvegicus
ataatggacatttaccacttccccg

SEQ ID NO: 170061 - DNA, 25 bp, Rattus norvegicus
ataatggacggcctgctgatcacac

SEQ ID NO: 170062 - DNA, 25 bp, Rattus norvegicus
ataatggacggcgtgctgatcacac

SEQ ID NO: 170063 - DNA, 25 bp, Rattus norvegicus
ataatggactcaccctagcctaggg

SEQ ID NO: 170064 - DNA, 25 bp, Rattus norvegicus
ataatggactcagcctagcctaggg

SEQ ID NO: 170065 - DNA, 25 bp, Rattus norvegicus
ataatggagagaattggtgcaaaac

SEQ ID NO: 170066 - DNA, 25 bp, Rattus norvegicus
ataatggagagatttggtgcaaaac

SEQ ID NO: 170067 - DNA, 25 bp, Rattus norvegicus
ataatggagcctatcatcgcgagcc

SEQ ID NO: 170068 - DNA, 25 bp, Rattus norvegicus
ataatggagcctttcatcgcgagcc

SEQ ID NO: 170069 - DNA, 25 bp, Rattus norvegicus
ataatggaggagatcttccgtcagg

SEQ ID NO: 170070 - DNA, 25 bp, Rattus norvegicus
ataatggaggagttcttccgtcagg

SEQ ID NO: 170071 - DNA, 25 bp, Rattus norvegicus
ataatggatcacagggaccctagga

SEQ ID NO: 170072 - DNA, 25 bp, Rattus norvegicus
ataatggatcactgggaccctagga

SEQ ID NO: 170073 - DNA, 25 bp, Rattus norvegicus
ataatggcaccaagggacagtactg

SEQ ID NO: 170074 - DNA, 25 bp, Rattus norvegicus
ataatggcaccatgggacagtactg

SEQ ID NO: 170075 - DNA, 25 bp, Rattus norvegicus
ataatggcagtgaccggtctggcag

SEQ ID NO: 170076 - DNA, 25 bp, Rattus norvegicus
ataatggcagtgtccggtctggcag

SEQ ID NO: 170077 - DNA, 25 bp, Rattus norvegicus
ataatggcccacagcgttatggaag

SEQ ID NO: 170078 - DNA, 25 bp, Rattus norvegicus
ataatggcccactgcgttatggaag

SEQ ID NO: 170079 - DNA, 25 bp, Rattus norvegicus
ataatggctcttcggttggactgct

SEQ ID NO: 170080 - DNA, 25 bp, Rattus norvegicus
ataatggctcttgggttggactgct

SEQ ID NO: 170081 - DNA, 25 bp, Rattus norvegicus
ataatggcttttcctctactgtcgt

SEQ ID NO: 170082 - DNA, 25 bp, Rattus norvegicus
ataatggcttttgctctactgtcgt

SEQ ID NO: 170083 - DNA, 25 bp, Rattus norvegicus
ataatgggcaacagacgctgcttgc

SEQ ID NO: 170084 - DNA, 25 bp, Rattus norvegicus
ataatgggcaactgacgctgcttgc

SEQ ID NO: 170085 - DNA, 25 bp, Rattus norvegicus
ataatgggtcgcatcttggtgtaac

SEQ ID NO: 170086 - DNA, 25 bp, Rattus norvegicus
ataatgggtcgcttcttggtgtaac

SEQ ID NO: 170087 - DNA, 25 bp, Rattus norvegicus
ataatggtactgacagggtcctcct

SEQ ID NO: 170088 - DNA, 25 bp, Rattus norvegicus
ataatggtactgtcagggtcctcct

SEQ ID NO: 170089 - DNA, 25 bp, Rattus norvegicus
ataatggtgccgattccatttggcc

SEQ ID NO: 170090 - DNA, 25 bp, Rattus norvegicus
ataatggtgccgtttccatttggcc

SEQ ID NO: 170091 - DNA, 25 bp, Rattus norvegicus
ataatggtggctcagattctagggc

SEQ ID NO: 170092 - DNA, 25 bp, Rattus norvegicus
ataatggtggctgagattctagggc

SEQ ID NO: 170093 - DNA, 25 bp, Rattus norvegicus
ataatggtgtccctgctctctgatt

SEQ ID NO: 170094 - DNA, 25 bp, Rattus norvegicus
ataatggtgtccgtgctctctgatt

SEQ ID NO: 170095 - DNA, 25 bp, Rattus norvegicus
ataatggtgtttccttaattgctca

SEQ ID NO: 170096 - DNA, 25 bp, Rattus norvegicus
ataatggtgtttgcttaattgctca

SEQ ID NO: 170097 - DNA, 25 bp, Rattus norvegicus
ataatgtacagcagtcctcgttggt

SEQ ID NO: 170098 - DNA, 25 bp, Rattus norvegicus
ataatgtacagctgtcctcgttggt

SEQ ID NO: 170099 - DNA, 25 bp, Rattus norvegicus
ataatgtcactcagttttaagggca

SEQ ID NO: 170100 - DNA, 25 bp, Rattus norvegicus
ataatgtcactctgttttaagggca

SEQ ID NO: 170101 - DNA, 25 bp, Rattus norvegicus
ataatgtcattgagtgttgttgttt

SEQ ID NO: 170102 - DNA, 25 bp, Rattus norvegicus
ataatgtcattgtgtgttgttgttt

SEQ ID NO: 170103 - DNA, 25 bp, Rattus norvegicus
ataatgtcatttactgcaactgttg

SEQ ID NO: 170104 - DNA, 25 bp, Rattus norvegicus
ataatgtcattttctgcaactgttg

SEQ ID NO: 170105 - DNA, 25 bp, Rattus norvegicus
ataatgtccagtcatatcccatcgg

SEQ ID NO: 170106 - DNA, 25 bp, Rattus norvegicus
ataatgtccagtgatatcccatcgg

SEQ ID NO: 170107 - DNA, 25 bp, Rattus norvegicus
ataatgtcccttattctgacttgaa

SEQ ID NO: 170108 - DNA, 25 bp, Rattus norvegicus
ataatgtccctttttctgacttgaa

SEQ ID NO: 170109 - DNA, 25 bp, Rattus norvegicus
ataatgtcgtttactccattccctt

SEQ ID NO: 170110 - DNA, 25 bp, Rattus norvegicus
ataatgtcgttttctccattccctt

SEQ ID NO: 170111 - DNA, 25 bp, Rattus norvegicus
ataatgtgacatcctttagtgctgg

SEQ ID NO: 170112 - DNA, 25 bp, Rattus norvegicus
ataatgtgacatgctttagtgctgg

SEQ ID NO: 170113 - DNA, 25 bp, Rattus norvegicus
ataatgtgatgtaaggccctccgca

SEQ ID NO: 170114 - DNA, 25 bp, Rattus norvegicus
ataatgtgatgttaggccctccgca

SEQ ID NO: 170115 - DNA, 25 bp, Rattus norvegicus
ataatgtgattcagccaggcgatca

SEQ ID NO: 170116 - DNA, 25 bp, Rattus norvegicus
ataatgtgattctgccaggcgatca

SEQ ID NO: 170117 - DNA, 25 bp, Rattus norvegicus
ataatgtgccggctatgatcagtgg

SEQ ID NO: 170118 - DNA, 25 bp, Rattus norvegicus
ataatgtgccgggtatgatcagtgg

SEQ ID NO: 170119 - DNA, 25 bp, Rattus norvegicus
ataatgtgccttatatagtcatggc

SEQ ID NO: 170120 - DNA, 25 bp, Rattus norvegicus
ataatgtgccttttatagtcatggc

SEQ ID NO: 170121 - DNA, 25 bp, Rattus norvegicus
ataatgtgctttctatgcaagcatg

SEQ ID NO: 170122 - DNA, 25 bp, Rattus norvegicus
ataatgtgctttgtatgcaagcatg

SEQ ID NO: 170123 - DNA, 25 bp, Rattus norvegicus
ataatgtgggtgagttcttcccgca

SEQ ID NO: 170124 - DNA, 25 bp, Rattus norvegicus
ataatgtgggtgtgttcttcccgca

SEQ ID NO: 170125 - DNA, 25 bp, Rattus norvegicus
ataatgtgtttaccggatgcccttc

SEQ ID NO: 170126 - DNA, 25 bp, Rattus norvegicus
ataatgtgtttacgtctttctctct

SEQ ID NO: 170127 - DNA, 25 bp, Rattus norvegicus
ataatgtgtttagcggatgcccttc

SEQ ID NO: 170128 - DNA, 25 bp, Rattus norvegicus
ataatgtgtttaggtctttctctct

SEQ ID NO: 170129 - DNA, 25 bp, Rattus norvegicus
ataatgttcaacagagtcctgtaga

SEQ ID NO: 170130 - DNA, 25 bp, Rattus norvegicus
ataatgttcaactgagtcctgtaga

SEQ ID NO: 170131 - DNA, 25 bp, Rattus norvegicus
ataatgttccccaaagtgtccttag

SEQ ID NO: 170132 - DNA, 25 bp, Rattus norvegicus
ataatgttcccctaagtgtccttag

SEQ ID NO: 170133 - DNA, 25 bp, Rattus norvegicus
ataatgttccggcttctctcgtagc

SEQ ID NO: 170134 - DNA, 25 bp, Rattus norvegicus
ataatgttccgggttctctcgtagc

SEQ ID NO: 170135 - DNA, 25 bp, Rattus norvegicus
ataatgttctgcatctccaaatatc

SEQ ID NO: 170136 - DNA, 25 bp, Rattus norvegicus
ataatgttctgcttctccaaatatc

SEQ ID NO: 170137 - DNA, 25 bp, Rattus norvegicus
ataatgttcttacacagccgtctgc

SEQ ID NO: 170138 - DNA, 25 bp, Rattus norvegicus
ataatgttcttagacagccgtctgc

SEQ ID NO: 170139 - DNA, 25 bp, Rattus norvegicus
ataatgttgctaccctgtgttggcc

SEQ ID NO: 170140 - DNA, 25 bp, Rattus norvegicus
ataatgttgctagcctgtgttggcc

SEQ ID NO: 170141 - DNA, 25 bp, Rattus norvegicus
ataatgttggtgaactcggctatga

SEQ ID NO: 170142 - DNA, 25 bp, Rattus norvegicus
ataatgttggtgtactcggctatga

SEQ ID NO: 170143 - DNA, 25 bp, Rattus norvegicus
ataattaactgtccaccagcatgcc

SEQ ID NO: 170144 - DNA, 25 bp, Rattus norvegicus
ataattaactgtgcaccagcatgcc

SEQ ID NO: 170145 - DNA, 25 bp, Rattus norvegicus
ataattacacctccttatgctggtc

SEQ ID NO: 170146 - DNA, 25 bp, Rattus norvegicus
ataattacacctgcttatgctggtc

SEQ ID NO: 170147 - DNA, 25 bp, Rattus norvegicus
ataattacgtttctgctccgccctg

SEQ ID NO: 170148 - DNA, 25 bp, Rattus norvegicus
ataattacgtttgtgctccgccctg

SEQ ID NO: 170149 - DNA, 25 bp, Rattus norvegicus
ataattagaggtcggcagagctgcc

SEQ ID NO: 170150 - DNA, 25 bp, Rattus norvegicus
ataattagaggtgggcagagctgcc

SEQ ID NO: 170151 - DNA, 25 bp, Rattus norvegicus
ataattagcattccaacacctccag

SEQ ID NO: 170152 - DNA, 25 bp, Rattus norvegicus
ataattagcattgcaacacctccag

SEQ ID NO: 170153 - DNA, 25 bp, Rattus norvegicus
ataattagcctgagcgggatcctgg

SEQ ID NO: 170154 - DNA, 25 bp, Rattus norvegicus
ataattagcctgtgcgggatcctgg

SEQ ID NO: 170155 - DNA, 25 bp, Rattus norvegicus
ataattatatgcatactcagcacag

SEQ ID NO: 170156 - DNA, 25 bp, Rattus norvegicus
ataattatatgcttactcagcacag

SEQ ID NO: 170157 - DNA, 25 bp, Rattus norvegicus
ataattatatttacccacacaccaa

SEQ ID NO: 170158 - DNA, 25 bp, Rattus norvegicus
ataattatattttcccacacaccaa

SEQ ID NO: 170159 - DNA, 25 bp, Rattus norvegicus
ataattatcaccaagcacagcacca

SEQ ID NO: 170160 - DNA, 25 bp, Rattus norvegicus
ataattatcacctagcacagcacca

SEQ ID NO: 170161 - DNA, 25 bp, Rattus norvegicus
ataattatgatcactgccgtctgcc

SEQ ID NO: 170162 - DNA, 25 bp, Rattus norvegicus
ataattatgatctctgccgtctgcc

SEQ ID NO: 170163 - DNA, 25 bp, Rattus norvegicus
ataattatgttcaatttgggcctaa

SEQ ID NO: 170164 - DNA, 25 bp, Rattus norvegicus
ataattatgttctatttgggcctaa

SEQ ID NO: 170165 - DNA, 25 bp, Rattus norvegicus
ataattattgctactttttggaggt

SEQ ID NO: 170166 - DNA, 25 bp, Rattus norvegicus
ataattattgcttctttttggaggt

SEQ ID NO: 170167 - DNA, 25 bp, Rattus norvegicus
ataattcaccacagaatccacagca

SEQ ID NO: 170168 - DNA, 25 bp, Rattus norvegicus
ataattcaccactgaatccacagca

SEQ ID NO: 170169 - DNA, 25 bp, Rattus norvegicus
ataattcactggacctgcatcagga

SEQ ID NO: 170170 - DNA, 25 bp, Rattus norvegicus
ataattcactggtcctgcatcagga

SEQ ID NO: 170171 - DNA, 25 bp, Rattus norvegicus
ataattcagccactgcctgctacaa

SEQ ID NO: 170172 - DNA, 25 bp, Rattus norvegicus
ataattcagccagtgcctgctacaa

SEQ ID NO: 170173 - DNA, 25 bp, Rattus norvegicus
ataattcatagaccctgccttaccc

SEQ ID NO: 170174 - DNA, 25 bp, Rattus norvegicus
ataattcatagagcctgccttaccc

SEQ ID NO: 170175 - DNA, 25 bp, Rattus norvegicus
ataattccaagtacgggctggctgc

SEQ ID NO: 170176 - DNA, 25 bp, Rattus norvegicus
ataattccaagttcgggctggctgc

SEQ ID NO: 170177 - DNA, 25 bp, Rattus norvegicus
ataattccattccttccaaatcctg

SEQ ID NO: 170178 - DNA, 25 bp, Rattus norvegicus
ataattccattcgttccaaatcctg

SEQ ID NO: 170179 - DNA, 25 bp, Rattus norvegicus
ataattccccagagacctgtgagac

SEQ ID NO: 170180 - DNA, 25 bp, Rattus norvegicus
ataattccccagtgacctgtgagac

SEQ ID NO: 170181 - DNA, 25 bp, Rattus norvegicus
ataattcctcaccttacacaatggg

SEQ ID NO: 170182 - DNA, 25 bp, Rattus norvegicus
ataattcctcacgttacacaatggg

SEQ ID NO: 170183 - DNA, 25 bp, Rattus norvegicus
ataattccttataggctctgttttg

SEQ ID NO: 170184 - DNA, 25 bp, Rattus norvegicus
ataattccttattggctctgttttg

SEQ ID NO: 170185 - DNA, 25 bp, Rattus norvegicus
ataattccttggagggctgtagctc

SEQ ID NO: 170186 - DNA, 25 bp, Rattus norvegicus
ataattccttggtgggctgtagctc

SEQ ID NO: 170187 - DNA, 25 bp, Rattus norvegicus
ataattcggctcatctcactagctg

SEQ ID NO: 170188 - DNA, 25 bp, Rattus norvegicus
ataattcggctcttctcactagctg

SEQ ID NO: 170189 - DNA, 25 bp, Rattus norvegicus
ataattctacttcctgcaagcctga

SEQ ID NO: 170190 - DNA, 25 bp, Rattus norvegicus
ataattctacttgctgcaagcctga

SEQ ID NO: 170191 - DNA, 25 bp, Rattus norvegicus
ataattctcagcattgagctctcag

SEQ ID NO: 170192 - DNA, 25 bp, Rattus norvegicus
ataattctcagctttgagctctcag

SEQ ID NO: 170193 - DNA, 25 bp, Rattus norvegicus
ataattctcatcattgtcctggctg

SEQ ID NO: 170194 - DNA, 25 bp, Rattus norvegicus
ataattctcatctttgtcctggctg

SEQ ID NO: 170195 - DNA, 25 bp, Rattus norvegicus
ataattctcctgattgggtccaagt

SEQ ID NO: 170196 - DNA, 25 bp, Rattus norvegicus
ataattctcctgtttgggtccaagt

SEQ ID NO: 170197 - DNA, 25 bp, Rattus norvegicus
ataattctcttgagtgtttcctggc

SEQ ID NO: 170198 - DNA, 25 bp, Rattus norvegicus
ataattctcttgtgtgtttcctggc

SEQ ID NO: 170199 - DNA, 25 bp, Rattus norvegicus
ataattctgctacatacaagtcctg

SEQ ID NO: 170200 - DNA, 25 bp, Rattus norvegicus
ataattctgctagatacaagtcctg

SEQ ID NO: 170201 - DNA, 25 bp, Rattus norvegicus
ataattctgctcagaacacggcgtc

SEQ ID NO: 170202 - DNA, 25 bp, Rattus norvegicus
ataattctgctctgaacacggcgtc

SEQ ID NO: 170203 - DNA, 25 bp, Rattus norvegicus
ataattcttagcctagaccccattg

SEQ ID NO: 170204 - DNA, 25 bp, Rattus norvegicus
ataattcttagcgtagaccccattg

SEQ ID NO: 170205 - DNA, 25 bp, Rattus norvegicus
ataattcttattcgcagacagctgc

SEQ ID NO: 170206 - DNA, 25 bp, Rattus norvegicus
ataattcttattggcagacagctgc

SEQ ID NO: 170207 - DNA, 25 bp, Rattus norvegicus
ataattcttgagatgcggccttttt

SEQ ID NO: 170208 - DNA, 25 bp, Rattus norvegicus
ataattcttgagttgcggccttttt

SEQ ID NO: 170209 - DNA, 25 bp, Rattus norvegicus
ataattcttgttaggacttccatcc

SEQ ID NO: 170210 - DNA, 25 bp, Rattus norvegicus
ataattcttgtttggacttccatcc

SEQ ID NO: 170211 - DNA, 25 bp, Rattus norvegicus
ataattgaccatattactcctgaaa

SEQ ID NO: 170212 - DNA, 25 bp, Rattus norvegicus
ataattgaccattttactcctgaaa

SEQ ID NO: 170213 - DNA, 25 bp, Rattus norvegicus
ataattgacttcattctctcgggtt

SEQ ID NO: 170214 - DNA, 25 bp, Rattus norvegicus
ataattgacttctttctctcgggtt

SEQ ID NO: 170215 - DNA, 25 bp, Rattus norvegicus
ataattgaggccctctgactgacca

SEQ ID NO: 170216 - DNA, 25 bp, Rattus norvegicus
ataattgaggccgtctgactgacca

SEQ ID NO: 170217 - DNA, 25 bp, Rattus norvegicus
ataattgcacacatgtacatcacat

SEQ ID NO: 170218 - DNA, 25 bp, Rattus norvegicus
ataattgcacacttgtacatcacat

SEQ ID NO: 170219 - DNA, 25 bp, Rattus norvegicus
ataattgccttgacataatcgttaa

SEQ ID NO: 170220 - DNA, 25 bp, Rattus norvegicus
ataattgccttgtcataatcgttaa

SEQ ID NO: 170221 - DNA, 25 bp, Rattus norvegicus
ataattgctgagagccggacccctg

SEQ ID NO: 170222 - DNA, 25 bp, Rattus norvegicus
ataattgctgagtgccggacccctg

SEQ ID NO: 170223 - DNA, 25 bp, Rattus norvegicus
ataattgctgtacctgctgggcgcc

SEQ ID NO: 170224 - DNA, 25 bp, Rattus norvegicus
ataattgctgtagctgctgggcgcc

SEQ ID NO: 170225 - DNA, 25 bp, Rattus norvegicus
ataattgctgtgacctccttgcgaa

SEQ ID NO: 170226 - DNA, 25 bp, Rattus norvegicus
ataattgctgtgactttcttctacc

SEQ ID NO: 170227 - DNA, 25 bp, Rattus norvegicus
ataattgctgtgtcctccttgcgaa

SEQ ID NO: 170228 - DNA, 25 bp, Rattus norvegicus
ataattgctgtgtctttcttctacc

SEQ ID NO: 170229 - DNA, 25 bp, Rattus norvegicus
ataattgcttttcatcaaattttaa

SEQ ID NO: 170230 - DNA, 25 bp, Rattus norvegicus
ataattgcttttgatcaaattttaa

SEQ ID NO: 170231 - DNA, 25 bp, Rattus norvegicus
ataattggatcactccgtggctgcc

SEQ ID NO: 170232 - DNA, 25 bp, Rattus norvegicus
ataattggatcagtccgtggctgcc

SEQ ID NO: 170233 - DNA, 25 bp, Rattus norvegicus
ataattggctgcagcttaccatcca

SEQ ID NO: 170234 - DNA, 25 bp, Rattus norvegicus
ataattggctgctgcttaccatcca

SEQ ID NO: 170235 - DNA, 25 bp, Rattus norvegicus
ataattgggagcagacacgccttgc

SEQ ID NO: 170236 - DNA, 25 bp, Rattus norvegicus
ataattgggagctgacacgccttgc

SEQ ID NO: 170237 - DNA, 25 bp, Rattus norvegicus
ataattgtacataacctagctggtg

SEQ ID NO: 170238 - DNA, 25 bp, Rattus norvegicus
ataattgtacattacctagctggtg

SEQ ID NO: 170239 - DNA, 25 bp, Rattus norvegicus
ataattgtatggcttccctgccttt

SEQ ID NO: 170240 - DNA, 25 bp, Rattus norvegicus
ataattgtatgggttccctgccttt

SEQ ID NO: 170241 - DNA, 25 bp, Rattus norvegicus
ataattgtattcctcatcagctccc

SEQ ID NO: 170242 - DNA, 25 bp, Rattus norvegicus
ataattgtattcgtcatcagctccc

SEQ ID NO: 170243 - DNA, 25 bp, Rattus norvegicus
ataattgtctgtacacccgctcttg

SEQ ID NO: 170244 - DNA, 25 bp, Rattus norvegicus
ataattgtctgttcacccgctcttg

SEQ ID NO: 170245 - DNA, 25 bp, Rattus norvegicus
ataatttaccctctcttattgcaaa

SEQ ID NO: 170246 - DNA, 25 bp, Rattus norvegicus
ataatttaccctgtcttattgcaaa

SEQ ID NO: 170247 - DNA, 25 bp, Rattus norvegicus
ataatttacctaaactaccagcaat

SEQ ID NO: 170248 - DNA, 25 bp, Rattus norvegicus
ataatttacctatactaccagcaat

SEQ ID NO: 170249 - DNA, 25 bp, Rattus norvegicus
ataatttagcatatatgttgcagaa

SEQ ID NO: 170250 - DNA, 25 bp, Rattus norvegicus
ataatttagcatttatgttgcagaa

SEQ ID NO: 170251 - DNA, 25 bp, Rattus norvegicus
ataatttagcttatcggccctgcag

SEQ ID NO: 170252 - DNA, 25 bp, Rattus norvegicus
ataatttagcttttcggccctgcag

SEQ ID NO: 170253 - DNA, 25 bp, Rattus norvegicus
ataatttaggccaagtgaagcacaa

SEQ ID NO: 170254 - DNA, 25 bp, Rattus norvegicus
ataatttaggcctagtgaagcacaa

SEQ ID NO: 170255 - DNA, 25 bp, Rattus norvegicus
ataatttataccagccccttcgttg

SEQ ID NO: 170256 - DNA, 25 bp, Rattus norvegicus
ataatttatacctgccccttcgttg

SEQ ID NO: 170257 - DNA, 25 bp, Rattus norvegicus
ataatttatcttcgagctactccag

SEQ ID NO: 170258 - DNA, 25 bp, Rattus norvegicus
ataatttatcttggagctactccag

SEQ ID NO: 170259 - DNA, 25 bp, Rattus norvegicus
ataatttatggcctgcagtatctct

SEQ ID NO: 170260 - DNA, 25 bp, Rattus norvegicus
ataatttatggcgtgcagtatctct

SEQ ID NO: 170261 - DNA, 25 bp, Rattus norvegicus
ataatttattcaattctctgtgtgt

SEQ ID NO: 170262 - DNA, 25 bp, Rattus norvegicus
ataatttattcatttctctgtgtgt

SEQ ID NO: 170263 - DNA, 25 bp, Rattus norvegicus
ataatttattgtatccagtgcccag

SEQ ID NO: 170264 - DNA, 25 bp, Rattus norvegicus
ataatttattgtttccagtgcccag

SEQ ID NO: 170265 - DNA, 25 bp, Rattus norvegicus
ataatttatttcacatctctaccag

SEQ ID NO: 170266 - DNA, 25 bp, Rattus norvegicus
ataatttatttctcatctctaccag

SEQ ID NO: 170267 - DNA, 25 bp, Rattus norvegicus
ataatttcaaacagtactgaccttg

SEQ ID NO: 170268 - DNA, 25 bp, Rattus norvegicus
ataatttcaaactgtactgaccttg

SEQ ID NO: 170269 - DNA, 25 bp, Rattus norvegicus
ataatttccttaaccatcacaatgg

SEQ ID NO: 170270 - DNA, 25 bp, Rattus norvegicus
ataatttccttatccatcacaatgg

SEQ ID NO: 170271 - DNA, 25 bp, Rattus norvegicus
ataatttgaagtatcctggacccat

SEQ ID NO: 170272 - DNA, 25 bp, Rattus norvegicus
ataatttgaagtttcctggacccat

SEQ ID NO: 170273 - DNA, 25 bp, Rattus norvegicus
ataatttggtctcctcttggctttg

SEQ ID NO: 170274 - DNA, 25 bp, Rattus norvegicus
ataatttggtctgctcttggctttg

SEQ ID NO: 170275 - DNA, 25 bp, Rattus norvegicus
ataatttgttgtccccactatacct

SEQ ID NO: 170276 - DNA, 25 bp, Rattus norvegicus
ataatttgttgtgcccactatacct

SEQ ID NO: 170277 - DNA, 25 bp, Rattus norvegicus
ataattttcctgattcttctctcca

SEQ ID NO: 170278 - DNA, 25 bp, Rattus norvegicus
ataattttcctgtttcttctctcca

SEQ ID NO: 170279 - DNA, 25 bp, Rattus norvegicus
ataattttgctcattgtttttgggt

SEQ ID NO: 170280 - DNA, 25 bp, Rattus norvegicus
ataattttgctctttgtttttgggt

SEQ ID NO: 170281 - DNA, 25 bp, Rattus norvegicus
atacaaaaactcactgtcgtcccag

SEQ ID NO: 170282 - DNA, 25 bp, Rattus norvegicus
atacaaaaactctctgtcgtcccag

SEQ ID NO: 170283 - DNA, 25 bp, Rattus norvegicus
atacaaaacttcaccaataacttag

SEQ ID NO: 170284 - DNA, 25 bp, Rattus norvegicus
atacaaaacttctccaataacttag

SEQ ID NO: 170285 - DNA, 25 bp, Rattus norvegicus
atacaaacacgacgaggcgctcaag

SEQ ID NO: 170286 - DNA, 25 bp, Rattus norvegicus
atacaaacacgaggaggcgctcaag

SEQ ID NO: 170287 - DNA, 25 bp, Rattus norvegicus
atacaaaccactatttacctcagct

SEQ ID NO: 170288 - DNA, 25 bp, Rattus norvegicus
atacaaaccactttttacctcagct

SEQ ID NO: 170289 - DNA, 25 bp, Rattus norvegicus
atacaaaccagtctacctctgacct

SEQ ID NO: 170290 - DNA, 25 bp, Rattus norvegicus
atacaaaccagtgtacctctgacct

SEQ ID NO: 170291 - DNA, 25 bp, Rattus norvegicus
atacaaacccaacctgttctcaact

SEQ ID NO: 170292 - DNA, 25 bp, Rattus norvegicus
atacaaacccaagctgttctcaact

SEQ ID NO: 170293 - DNA, 25 bp, Rattus norvegicus
atacaaacctgtacaccacatgctg

SEQ ID NO: 170294 - DNA, 25 bp, Rattus norvegicus
atacaaacctgttcaccacatgctg

SEQ ID NO: 170295 - DNA, 25 bp, Rattus norvegicus
atacaaactggtcaaccacatccgc

SEQ ID NO: 170296 - DNA, 25 bp, Rattus norvegicus
atacaaactggtgaaccacatccgc

SEQ ID NO: 170297 - DNA, 25 bp, Rattus norvegicus
atacaaacttctaccacgagtcagg

SEQ ID NO: 170298 - DNA, 25 bp, Rattus norvegicus
atacaaacttcttccacgagtcagg

SEQ ID NO: 170299 - DNA, 25 bp, Rattus norvegicus
atacaaaggcacaagggaacccaga

SEQ ID NO: 170300 - DNA, 25 bp, Rattus norvegicus
atacaaaggcactagggaacccaga

SEQ ID NO: 170301 - DNA, 25 bp, Rattus norvegicus
atacaaatcattactctctcttcct

SEQ ID NO: 170302 - DNA, 25 bp, Rattus norvegicus
atacaaatcatttctctctcttcct

SEQ ID NO: 170303 - DNA, 25 bp, Rattus norvegicus
atacaaatctaaaggtgcttttacc

SEQ ID NO: 170304 - DNA, 25 bp, Rattus norvegicus
atacaaatctaatggtgcttttacc

SEQ ID NO: 170305 - DNA, 25 bp, Rattus norvegicus
atacaaattcatactccttgacccc

SEQ ID NO: 170306 - DNA, 25 bp, Rattus norvegicus
atacaaattcattctccttgacccc

SEQ ID NO: 170307 - DNA, 25 bp, Rattus norvegicus
atacaacactttatgcccttcattc

SEQ ID NO: 170308 - DNA, 25 bp, Rattus norvegicus
atacaacactttttgcccttcattc

SEQ ID NO: 170309 - DNA, 25 bp, Rattus norvegicus
atacaacaggaaagaccatcgagtc

SEQ ID NO: 170310 - DNA, 25 bp, Rattus norvegicus
atacaacaggaatgaccatcgagtc

SEQ ID NO: 170311 - DNA, 25 bp, Rattus norvegicus
atacaaccacacatctttgtcatgt

SEQ ID NO: 170312 - DNA, 25 bp, Rattus norvegicus
atacaaccacacttctttgtcatgt

SEQ ID NO: 170313 - DNA, 25 bp, Rattus norvegicus
atacaaccacccaagtggtgctgtt

SEQ ID NO: 170314 - DNA, 25 bp, Rattus norvegicus
atacaaccaccctagtggtgctgtt

SEQ ID NO: 170315 - DNA, 25 bp, Rattus norvegicus
atacaaccactccactgcaggcaga

SEQ ID NO: 170316 - DNA, 25 bp, Rattus norvegicus
atacaaccactcgactgcaggcaga

SEQ ID NO: 170317 - DNA, 25 bp, Rattus norvegicus
atacaaccattaaagccgtgtccct

SEQ ID NO: 170318 - DNA, 25 bp, Rattus norvegicus
atacaaccattatagccgtgtccct

SEQ ID NO: 170319 - DNA, 25 bp, Rattus norvegicus
atacaacccctcaaggagctgggag

SEQ ID NO: 170320 - DNA, 25 bp, Rattus norvegicus
atacaacccctctaggagctgggag

SEQ ID NO: 170321 - DNA, 25 bp, Rattus norvegicus
atacaacctggtacttcttctgtct

SEQ ID NO: 170322 - DNA, 25 bp, Rattus norvegicus
atacaacctggttcttcttctgtct

SEQ ID NO: 170323 - DNA, 25 bp, Rattus norvegicus
atacaacctttccatgcctgtcaat

SEQ ID NO: 170324 - DNA, 25 bp, Rattus norvegicus
atacaacctttcgatgcctgtcaat

SEQ ID NO: 170325 - DNA, 25 bp, Rattus norvegicus
atacaactatttaccaaattccgat

SEQ ID NO: 170326 - DNA, 25 bp, Rattus norvegicus
atacaactattttccaaattccgat

SEQ ID NO: 170327 - DNA, 25 bp, Rattus norvegicus
atacaactcctcaaagttctggttt

SEQ ID NO: 170328 - DNA, 25 bp, Rattus norvegicus
atacaactcctctaagttctggttt

SEQ ID NO: 170329 - DNA, 25 bp, Rattus norvegicus
atacaacttcatctctttgcttgcc

SEQ ID NO: 170330 - DNA, 25 bp, Rattus norvegicus
atacaacttcatgtctttgcttgcc

SEQ ID NO: 170331 - DNA, 25 bp, Rattus norvegicus
atacaacttctaaatttgcactggg

SEQ ID NO: 170332 - DNA, 25 bp, Rattus norvegicus
atacaacttctatatttgcactggg

SEQ ID NO: 170333 - DNA, 25 bp, Rattus norvegicus
atacaagaaaccagtcacccgctag

SEQ ID NO: 170334 - DNA, 25 bp, Rattus norvegicus
atacaagaaacctgtcacccgctag

SEQ ID NO: 170335 - DNA, 25 bp, Rattus norvegicus
atacaagcctttcacagctcgcaac

SEQ ID NO: 170336 - DNA, 25 bp, Rattus norvegicus
atacaagcctttgacagctcgcaac

SEQ ID NO: 170337 - DNA, 25 bp, Rattus norvegicus
atacaagcgctccactcttaatgaa

SEQ ID NO: 170338 - DNA, 25 bp, Rattus norvegicus
atacaagcgctcgactcttaatgaa

SEQ ID NO: 170339 - DNA, 25 bp, Rattus norvegicus
atacaagctttcattccacatctta

SEQ ID NO: 170340 - DNA, 25 bp, Rattus norvegicus
atacaagctttctttccacatctta

SEQ ID NO: 170341 - DNA, 25 bp, Rattus norvegicus
atacaaggtctgctcatctggttaa

SEQ ID NO: 170342 - DNA, 25 bp, Rattus norvegicus
atacaaggtctggtcatctggttaa

SEQ ID NO: 170343 - DNA, 25 bp, Rattus norvegicus
atacaaggtgctcaagttcccccac

SEQ ID NO: 170344 - DNA, 25 bp, Rattus norvegicus
atacaaggtgctgaagttcccccac

SEQ ID NO: 170345 - DNA, 25 bp, Rattus norvegicus
atacaaggtggactgtgcgtgcctc

SEQ ID NO: 170346 - DNA, 25 bp, Rattus norvegicus
atacaaggtggagtgtgcgtgcctc

SEQ ID NO: 170347 - DNA, 25 bp, Rattus norvegicus
atacaagtgcaactctccagctata

SEQ ID NO: 170348 - DNA, 25 bp, Rattus norvegicus
atacaagtgcaagtctccagctata

SEQ ID NO: 170349 - DNA, 25 bp, Rattus norvegicus
atacaagttaaacctctggcactat

SEQ ID NO: 170350 - DNA, 25 bp, Rattus norvegicus
atacaagttaaagctctggcactat

SEQ ID NO: 170351 - DNA, 25 bp, Rattus norvegicus
atacaagttcatcgagctcagcctc

SEQ ID NO: 170352 - DNA, 25 bp, Rattus norvegicus
atacaagttcatggagctcagcctc

SEQ ID NO: 170353 - DNA, 25 bp, Rattus norvegicus
atacaagttcccacgaggagcacgt

SEQ ID NO: 170354 - DNA, 25 bp, Rattus norvegicus
atacaagttccctcgaggagcacgt

SEQ ID NO: 170355 - DNA, 25 bp, Rattus norvegicus
atacaagttgtccacattcatcctc

SEQ ID NO: 170356 - DNA, 25 bp, Rattus norvegicus
atacaagttgtcgacattcatcctc

SEQ ID NO: 170357 - DNA, 25 bp, Rattus norvegicus
atacaataagacaaggcacctcccc

SEQ ID NO: 170358 - DNA, 25 bp, Rattus norvegicus
atacaataagactaggcacctcccc

SEQ ID NO: 170359 - DNA, 25 bp, Rattus norvegicus
atacaataccagctgccaatatctc

SEQ ID NO: 170360 - DNA, 25 bp, Rattus norvegicus
atacaataccaggtgccaatatctc

SEQ ID NO: 170361 - DNA, 25 bp, Rattus norvegicus
atacaatcacttatgctgggctagc

SEQ ID NO: 170362 - DNA, 25 bp, Rattus norvegicus
atacaatcacttttgctgggctagc

SEQ ID NO: 170363 - DNA, 25 bp, Rattus norvegicus
atacaatcagcacttgtcaccacaa

SEQ ID NO: 170364 - DNA, 25 bp, Rattus norvegicus
atacaatcagcagttgtcaccacaa

SEQ ID NO: 170365 - DNA, 25 bp, Rattus norvegicus
atacaatcggccctctgtacgaggg

SEQ ID NO: 170366 - DNA, 25 bp, Rattus norvegicus
atacaatcggccgtctgtacgaggg

SEQ ID NO: 170367 - DNA, 25 bp, Rattus norvegicus
atacaatctggccaacatcatctac

SEQ ID NO: 170368 - DNA, 25 bp, Rattus norvegicus
atacaatctggcgaacatcatctac

SEQ ID NO: 170369 - DNA, 25 bp, Rattus norvegicus
atacaatcttgccacagagcctgca

SEQ ID NO: 170370 - DNA, 25 bp, Rattus norvegicus
atacaatcttgcgacagagcctgca

SEQ ID NO: 170371 - DNA, 25 bp, Rattus norvegicus
atacaatgcctaagacagtgcgccc

SEQ ID NO: 170372 - DNA, 25 bp, Rattus norvegicus
atacaatgcctatgacagtgcgccc

SEQ ID NO: 170373 - DNA, 25 bp, Rattus norvegicus
atacaatgccttatccccatttaat

SEQ ID NO: 170374 - DNA, 25 bp, Rattus norvegicus
atacaatgccttttccccatttaat

SEQ ID NO: 170375 - DNA, 25 bp, Rattus norvegicus
atacaatggtacctgacagaacttt

SEQ ID NO: 170376 - DNA, 25 bp, Rattus norvegicus
atacaatggtacgtgacagaacttt

SEQ ID NO: 170377 - DNA, 25 bp, Rattus norvegicus
atacaatgtgacctgttgcacctct

SEQ ID NO: 170378 - DNA, 25 bp, Rattus norvegicus
atacaatgtgacgtgttgcacctct

SEQ ID NO: 170379 - DNA, 25 bp, Rattus norvegicus
atacaatgtgtgaaacgctggtaca

SEQ ID NO: 170380 - DNA, 25 bp, Rattus norvegicus
atacaatgtgtgtaacgctggtaca

SEQ ID NO: 170381 - DNA, 25 bp, Rattus norvegicus
atacaattcccacatggtccctgag

SEQ ID NO: 170382 - DNA, 25 bp, Rattus norvegicus
atacaattcccagatggtccctgag

SEQ ID NO: 170383 - DNA, 25 bp, Rattus norvegicus
atacaattctgtagcttccttctgc

SEQ ID NO: 170384 - DNA, 25 bp, Rattus norvegicus
atacaattctgttgcttccttctgc

SEQ ID NO: 170385 - DNA, 25 bp, Rattus norvegicus
atacaattgaaaccaatctactgtg

SEQ ID NO: 170386 - DNA, 25 bp, Rattus norvegicus
atacaattgaaagcaatctactgtg

SEQ ID NO: 170387 - DNA, 25 bp, Rattus norvegicus
atacaatttctgacaggcacctctg

SEQ ID NO: 170388 - DNA, 25 bp, Rattus norvegicus
atacaatttctgtcaggcacctctg

SEQ ID NO: 170389 - DNA, 25 bp, Rattus norvegicus
atacacaacctgcacagcctgatga

SEQ ID NO: 170390 - DNA, 25 bp, Rattus norvegicus
atacacaacctggacagcctgatga

SEQ ID NO: 170391 - DNA, 25 bp, Rattus norvegicus
atacacacacatagactcctctctg

SEQ ID NO: 170392 - DNA, 25 bp, Rattus norvegicus
atacacacacattgactcctctctg

SEQ ID NO: 170393 - DNA, 25 bp, Rattus norvegicus
atacacacacttatttccagattta

SEQ ID NO: 170394 - DNA, 25 bp, Rattus norvegicus
atacacacacttttttccagattta

SEQ ID NO: 170395 - DNA, 25 bp, Rattus norvegicus
atacacacgacaatcactgctacat

SEQ ID NO: 170396 - DNA, 25 bp, Rattus norvegicus
atacacacgacattcactgctacat

SEQ ID NO: 170397 - DNA, 25 bp, Rattus norvegicus
atacacagactcacatgcctaggca

SEQ ID NO: 170398 - DNA, 25 bp, Rattus norvegicus
atacacagactctcatgcctaggca

SEQ ID NO: 170399 - DNA, 25 bp, Rattus norvegicus
atacacagatggcatgttcgcctcc

SEQ ID NO: 170400 - DNA, 25 bp, Rattus norvegicus
atacacagatgggatgttcgcctcc

SEQ ID NO: 170401 - DNA, 25 bp, Rattus norvegicus
atacacagatgtatggtttggccag

SEQ ID NO: 170402 - DNA, 25 bp, Rattus norvegicus
atacacagatgtttggtttggccag

SEQ ID NO: 170403 - DNA, 25 bp, Rattus norvegicus
atacacagcaataagcccttgaaca

SEQ ID NO: 170404 - DNA, 25 bp, Rattus norvegicus
atacacagcaattagcccttgaaca

SEQ ID NO: 170405 - DNA, 25 bp, Rattus norvegicus
atacacagcattcgttgccatcgag

SEQ ID NO: 170406 - DNA, 25 bp, Rattus norvegicus
atacacagcattggttgccatcgag

SEQ ID NO: 170407 - DNA, 25 bp, Rattus norvegicus
atacacagcgggaaggtacagccta

SEQ ID NO: 170408 - DNA, 25 bp, Rattus norvegicus
atacacagcgggtaggtacagccta

SEQ ID NO: 170409 - DNA, 25 bp, Rattus norvegicus
atacacagcgtaatttgccactatg

SEQ ID NO: 170410 - DNA, 25 bp, Rattus norvegicus
atacacagcgtattttgccactatg

SEQ ID NO: 170411 - DNA, 25 bp, Rattus norvegicus
atacacagctatccatgcccattag

SEQ ID NO: 170412 - DNA, 25 bp, Rattus norvegicus
atacacagctatgcatgcccattag

SEQ ID NO: 170413 - DNA, 25 bp, Rattus norvegicus
atacacaggttgacgtgtaccgcct

SEQ ID NO: 170414 - DNA, 25 bp, Rattus norvegicus
atacacaggttgtcgtgtaccgcct

SEQ ID NO: 170415 - DNA, 25 bp, Rattus norvegicus
atacacatcagtaccagacagcttg

SEQ ID NO: 170416 - DNA, 25 bp, Rattus norvegicus
atacacatcagttccagacagcttg

SEQ ID NO: 170417 - DNA, 25 bp, Rattus norvegicus
atacacatcatgacgtcttcacatc

SEQ ID NO: 170418 - DNA, 25 bp, Rattus norvegicus
atacacatcatgtcgtcttcacatc

SEQ ID NO: 170419 - DNA, 25 bp, Rattus norvegicus
atacacatccatatttcttacccat

SEQ ID NO: 170420 - DNA, 25 bp, Rattus norvegicus
atacacatccatttttcttacccat

SEQ ID NO: 170421 - DNA, 25 bp, Rattus norvegicus
atacacatgccaaagcctgaccatg

SEQ ID NO: 170422 - DNA, 25 bp, Rattus norvegicus
atacacatgccatagcctgaccatg

SEQ ID NO: 170423 - DNA, 25 bp, Rattus norvegicus
atacacattatcagtcccatgcagc

SEQ ID NO: 170424 - DNA, 25 bp, Rattus norvegicus
atacacattatctgtcccatgcagc

SEQ ID NO: 170425 - DNA, 25 bp, Rattus norvegicus
atacaccaaggactcaagatctcag

SEQ ID NO: 170426 - DNA, 25 bp, Rattus norvegicus
atacaccaaggagtcaagatctcag

SEQ ID NO: 170427 - DNA, 25 bp, Rattus norvegicus
atacaccacctaatttgcaatgatt

SEQ ID NO: 170428 - DNA, 25 bp, Rattus norvegicus
atacaccacctattttgcaatgatt

SEQ ID NO: 170429 - DNA, 25 bp, Rattus norvegicus
atacaccacggtcatcattctgaag

SEQ ID NO: 170430 - DNA, 25 bp, Rattus norvegicus
atacaccacggtgatcattctgaag

SEQ ID NO: 170431 - DNA, 25 bp, Rattus norvegicus
atacaccaggttcaagccaagccca

SEQ ID NO: 170432 - DNA, 25 bp, Rattus norvegicus
atacaccaggttgaagccaagccca

SEQ ID NO: 170433 - DNA, 25 bp, Rattus norvegicus
atacacccaaacattactggcctgg

SEQ ID NO: 170434 - DNA, 25 bp, Rattus norvegicus
atacacccaaactttactggcctgg

SEQ ID NO: 170435 - DNA, 25 bp, Rattus norvegicus
atacacccatgcatgttacacttgt

SEQ ID NO: 170436 - DNA, 25 bp, Rattus norvegicus
atacacccatgcttgttacacttgt

SEQ ID NO: 170437 - DNA, 25 bp, Rattus norvegicus
atacaccctattagtgtttcaggaa

SEQ ID NO: 170438 - DNA, 25 bp, Rattus norvegicus
atacaccctatttgtgtttcaggaa

SEQ ID NO: 170439 - DNA, 25 bp, Rattus norvegicus
atacacccttgcatagcctaacatt

SEQ ID NO: 170440 - DNA, 25 bp, Rattus norvegicus
atacacccttgcttagcctaacatt

SEQ ID NO: 170441 - DNA, 25 bp, Rattus norvegicus
atacaccggctccaggtagtgacgc

SEQ ID NO: 170442 - DNA, 25 bp, Rattus norvegicus
atacaccggctcgaggtagtgacgc

SEQ ID NO: 170443 - DNA, 25 bp, Rattus norvegicus
atacaccgtggaatatgcctgcagt

SEQ ID NO: 170444 - DNA, 25 bp, Rattus norvegicus
atacaccgtggattatgcctgcagt

SEQ ID NO: 170445 - DNA, 25 bp, Rattus norvegicus
atacacctatacctctgttcttgtt

SEQ ID NO: 170446 - DNA, 25 bp, Rattus norvegicus
atacacctatacgtctgttcttgtt

SEQ ID NO: 170447 - DNA, 25 bp, Rattus norvegicus
atacacctatgcacaaggcacctat

SEQ ID NO: 170448 - DNA, 25 bp, Rattus norvegicus
atacacctatgctcaaggcacctat

SEQ ID NO: 170449 - DNA, 25 bp, Rattus norvegicus
atacacctgccacagcgtgtgaata

SEQ ID NO: 170450 - DNA, 25 bp, Rattus norvegicus
atacacctgccagagcgtgtgaata

SEQ ID NO: 170451 - DNA, 25 bp, Rattus norvegicus
atacacctgtaaacctaacattggg

SEQ ID NO: 170452 - DNA, 25 bp, Rattus norvegicus
atacacctgtaatcctaacattggg

SEQ ID NO: 170453 - DNA, 25 bp, Rattus norvegicus
atacaccttctgcaaaccgtgacca

SEQ ID NO: 170454 - DNA, 25 bp, Rattus norvegicus
atacaccttctggaaaccgtgacca

SEQ ID NO: 170455 - DNA, 25 bp, Rattus norvegicus
atacaccttggtcgtcggtcttggc

SEQ ID NO: 170456 - DNA, 25 bp, Rattus norvegicus
atacaccttggtggtcggtcttggc

SEQ ID NO: 170457 - DNA, 25 bp, Rattus norvegicus
atacaccttgtgcttggaccctgga

SEQ ID NO: 170458 - DNA, 25 bp, Rattus norvegicus
atacaccttgtggttggaccctgga

SEQ ID NO: 170459 - DNA, 25 bp, Rattus norvegicus
atacacgcatcacagattctcctgg

SEQ ID NO: 170460 - DNA, 25 bp, Rattus norvegicus
atacacgcatcagagattctcctgg

SEQ ID NO: 170461 - DNA, 25 bp, Rattus norvegicus
atacacgcggctctggtaggcatca

SEQ ID NO: 170462 - DNA, 25 bp, Rattus norvegicus
atacacgcggctgtggtaggcatca

SEQ ID NO: 170463 - DNA, 25 bp, Rattus norvegicus
atacacggtggtcgacaggtcctca

SEQ ID NO: 170464 - DNA, 25 bp, Rattus norvegicus
atacacggtggtggacaggtcctca

SEQ ID NO: 170465 - DNA, 25 bp, Rattus norvegicus
atacacggttcaagtgtgctcacac

SEQ ID NO: 170466 - DNA, 25 bp, Rattus norvegicus
atacacggttcatgtgtgctcacac

SEQ ID NO: 170467 - DNA, 25 bp, Rattus norvegicus
atacacgtagtcattgcatggctct

SEQ ID NO: 170468 - DNA, 25 bp, Rattus norvegicus
atacacgtagtctttgcatggctct

SEQ ID NO: 170469 - DNA, 25 bp, Rattus norvegicus
atacacgtgaagctcggagcctcca

SEQ ID NO: 170470 - DNA, 25 bp, Rattus norvegicus
atacacgtgaaggtcggagcctcca

SEQ ID NO: 170471 - DNA, 25 bp, Rattus norvegicus
atacactcacgtacttggtgacaca

SEQ ID NO: 170472 - DNA, 25 bp, Rattus norvegicus
atacactcacgttcttggtgacaca

SEQ ID NO: 170473 - DNA, 25 bp, Rattus norvegicus
atacactcagagaagactgtgccag

SEQ ID NO: 170474 - DNA, 25 bp, Rattus norvegicus
atacactcagagtagactgtgccag

SEQ ID NO: 170475 - DNA, 25 bp, Rattus norvegicus
atacactcatctccatggctggtca

SEQ ID NO: 170476 - DNA, 25 bp, Rattus norvegicus
atacactcatctgcatggctggtca

SEQ ID NO: 170477 - DNA, 25 bp, Rattus norvegicus
atacactccatcattctatcagaca

SEQ ID NO: 170478 - DNA, 25 bp, Rattus norvegicus
atacactccatctttctatcagaca

SEQ ID NO: 170479 - DNA, 25 bp, Rattus norvegicus
atacactccccgaggtgctgggcct

SEQ ID NO: 170480 - DNA, 25 bp, Rattus norvegicus
atacactccccgtggtgctgggcct

SEQ ID NO: 170481 - DNA, 25 bp, Rattus norvegicus
atacactgcttcagcgtggtgagac

SEQ ID NO: 170482 - DNA, 25 bp, Rattus norvegicus
atacactgcttctgcgtggtgagac

SEQ ID NO: 170483 - DNA, 25 bp, Rattus norvegicus
atacactggatgaggcccagccttt

SEQ ID NO: 170484 - DNA, 25 bp, Rattus norvegicus
atacactggatgtggcccagccttt

SEQ ID NO: 170485 - DNA, 25 bp, Rattus norvegicus
atacactgggctctagatccgcatc

SEQ ID NO: 170486 - DNA, 25 bp, Rattus norvegicus
atacactgggctgtagatccgcatc

SEQ ID NO: 170487 - DNA, 25 bp, Rattus norvegicus
atacactgtatgagtgatccaccat

SEQ ID NO: 170488 - DNA, 25 bp, Rattus norvegicus
atacactgtatgtgtgatccaccat

SEQ ID NO: 170489 - DNA, 25 bp, Rattus norvegicus
atacactgtcatcgctgtgggtggt

SEQ ID NO: 170490 - DNA, 25 bp, Rattus norvegicus
atacactgtcatggctgtgggtggt

SEQ ID NO: 170491 - DNA, 25 bp, Rattus norvegicus
atacactgtgtgatcctgagagagg

SEQ ID NO: 170492 - DNA, 25 bp, Rattus norvegicus
atacactgtgtgttcctgagagagg

SEQ ID NO: 170493 - DNA, 25 bp, Rattus norvegicus
atacactgttgtcatagaggaggag

SEQ ID NO: 170494 - DNA, 25 bp, Rattus norvegicus
atacactgttgtgatagaggaggag

SEQ ID NO: 170495 - DNA, 25 bp, Rattus norvegicus
atacactgttttcctttcatcggga

SEQ ID NO: 170496 - DNA, 25 bp, Rattus norvegicus
atacactgttttgctttcatcggga

SEQ ID NO: 170497 - DNA, 25 bp, Rattus norvegicus
atacacttgtgtctctctgtcaata

SEQ ID NO: 170498 - DNA, 25 bp, Rattus norvegicus
atacacttgtgtgtctctgtcaata

SEQ ID NO: 170499 - DNA, 25 bp, Rattus norvegicus
atacacttttgaactcagagctcag

SEQ ID NO: 170500 - DNA, 25 bp, Rattus norvegicus
atacacttttgatctcagagctcag

SEQ ID NO: 170501 - DNA, 25 bp, Rattus norvegicus
atacagaatccacgtcagccgaaac

SEQ ID NO: 170502 - DNA, 25 bp, Rattus norvegicus
atacagaatccaggtcagccgaaac

SEQ ID NO: 170503 - DNA, 25 bp, Rattus norvegicus
atacagacaagtagttccccgctgg

SEQ ID NO: 170504 - DNA, 25 bp, Rattus norvegicus
atacagacaagttgttccccgctgg

SEQ ID NO: 170505 - DNA, 25 bp, Rattus norvegicus
atacagacacttctggcctccggga

SEQ ID NO: 170506 - DNA, 25 bp, Rattus norvegicus
atacagacacttgtggcctccggga

SEQ ID NO: 170507 - DNA, 25 bp, Rattus norvegicus
atacagacatacagccttatccact

SEQ ID NO: 170508 - DNA, 25 bp, Rattus norvegicus
atacagacatactgccttatccact

SEQ ID NO: 170509 - DNA, 25 bp, Rattus norvegicus
atacagactcacaactatcggcatt

SEQ ID NO: 170510 - DNA, 25 bp, Rattus norvegicus
atacagactcactactatcggcatt

SEQ ID NO: 170511 - DNA, 25 bp, Rattus norvegicus
atacagactcttacttggaactttg

SEQ ID NO: 170512 - DNA, 25 bp, Rattus norvegicus
atacagactctttcttggaactttg

SEQ ID NO: 170513 - DNA, 25 bp, Rattus norvegicus
atacagactgtacgtccagaaactt

SEQ ID NO: 170514 - DNA, 25 bp, Rattus norvegicus
atacagactgtaggtccagaaactt

SEQ ID NO: 170515 - DNA, 25 bp, Rattus norvegicus
atacagactgtgaccatctctgcag

SEQ ID NO: 170516 - DNA, 25 bp, Rattus norvegicus
atacagactgtgtccatctctgcag

SEQ ID NO: 170517 - DNA, 25 bp, Rattus norvegicus
atacagagagcgaagctgaatctag

SEQ ID NO: 170518 - DNA, 25 bp, Rattus norvegicus
atacagagagcgtagctgaatctag

SEQ ID NO: 170519 - DNA, 25 bp, Rattus norvegicus
atacagagcttgatcattggacaga

SEQ ID NO: 170520 - DNA, 25 bp, Rattus norvegicus
atacagagcttgttcattggacaga

SEQ ID NO: 170521 - DNA, 25 bp, Rattus norvegicus
atacagaggacccaatccttgcttc

SEQ ID NO: 170522 - DNA, 25 bp, Rattus norvegicus
atacagaggaccctgagttcccgcc

SEQ ID NO: 170523 - DNA, 25 bp, Rattus norvegicus
atacagaggaccgaatccttgcttc

SEQ ID NO: 170524 - DNA, 25 bp, Rattus norvegicus
atacagaggaccgtgagttcccgcc

SEQ ID NO: 170525 - DNA, 25 bp, Rattus norvegicus
atacagagggtgaactgtcaagctg

SEQ ID NO: 170526 - DNA, 25 bp, Rattus norvegicus
atacagagggtgtactgtcaagctg

SEQ ID NO: 170527 - DNA, 25 bp, Rattus norvegicus
atacagagtcccatttatggcatac

SEQ ID NO: 170528 - DNA, 25 bp, Rattus norvegicus
atacagagtcccttttatggcatac

SEQ ID NO: 170529 - DNA, 25 bp, Rattus norvegicus
atacagatctccatttcctaaaaga

SEQ ID NO: 170530 - DNA, 25 bp, Rattus norvegicus
atacagatctccttttcctaaaaga

SEQ ID NO: 170531 - DNA, 25 bp, Rattus norvegicus
atacagatctctaggccatcggtag

SEQ ID NO: 170532 - DNA, 25 bp, Rattus norvegicus
atacagatctcttggccatcggtag

SEQ ID NO: 170533 - DNA, 25 bp, Rattus norvegicus
atacagatgcaaatattcacagtga

SEQ ID NO: 170534 - DNA, 25 bp, Rattus norvegicus
atacagatgcaattattcacagtga

SEQ ID NO: 170535 - DNA, 25 bp, Rattus norvegicus
atacagatgctaaaaccaccccagg

SEQ ID NO: 170536 - DNA, 25 bp, Rattus norvegicus
atacagatgctataaccaccccagg

SEQ ID NO: 170537 - DNA, 25 bp, Rattus norvegicus
atacagatgtgtagcttcagagctc

SEQ ID NO: 170538 - DNA, 25 bp, Rattus norvegicus
atacagatgtgttgcttcagagctc

SEQ ID NO: 170539 - DNA, 25 bp, Rattus norvegicus
atacagattaaacctgacacctgcc

SEQ ID NO: 170540 - DNA, 25 bp, Rattus norvegicus
atacagattaaagctgacacctgcc

SEQ ID NO: 170541 - DNA, 25 bp, Rattus norvegicus
atacagatttgtacttccagccaac

SEQ ID NO: 170542 - DNA, 25 bp, Rattus norvegicus
atacagatttgttcttccagccaac

SEQ ID NO: 170543 - DNA, 25 bp, Rattus norvegicus
atacagcaaaagacacccacgggat

SEQ ID NO: 170544 - DNA, 25 bp, Rattus norvegicus
atacagcaaaagtcacccacgggat

SEQ ID NO: 170545 - DNA, 25 bp, Rattus norvegicus
atacagcaatggatccttgttcttc

SEQ ID NO: 170546 - DNA, 25 bp, Rattus norvegicus
atacagcaatggttccttgttcttc

SEQ ID NO: 170547 - DNA, 25 bp, Rattus norvegicus
atacagcagaacatgcccttgtcgc

SEQ ID NO: 170548 - DNA, 25 bp, Rattus norvegicus
atacagcagaacttgcccttgtcgc

SEQ ID NO: 170549 - DNA, 25 bp, Rattus norvegicus
atacagcagatcctaaccaacacag

SEQ ID NO: 170550 - DNA, 25 bp, Rattus norvegicus
atacagcagatcgtaaccaacacag

SEQ ID NO: 170551 - DNA, 25 bp, Rattus norvegicus
atacagcagcatcgtcgactacaac

SEQ ID NO: 170552 - DNA, 25 bp, Rattus norvegicus
atacagcagcatggtcgactacaac

SEQ ID NO: 170553 - DNA, 25 bp, Rattus norvegicus
atacagcagcgaatcttccctaatc

SEQ ID NO: 170554 - DNA, 25 bp, Rattus norvegicus
atacagcagcgattcttccctaatc

SEQ ID NO: 170555 - DNA, 25 bp, Rattus norvegicus
atacagcaggaccttggccaatgca

SEQ ID NO: 170556 - DNA, 25 bp, Rattus norvegicus
atacagcaggacgttggccaatgca

SEQ ID NO: 170557 - DNA, 25 bp, Rattus norvegicus
atacagcaggccagtgacctacaag

SEQ ID NO: 170558 - DNA, 25 bp, Rattus norvegicus
atacagcaggcctgtgacctacaag

SEQ ID NO: 170559 - DNA, 25 bp, Rattus norvegicus
atacagcaggtacggatctcaaaac

SEQ ID NO: 170560 - DNA, 25 bp, Rattus norvegicus
atacagcaggtagggatctcaaaac

SEQ ID NO: 170561 - DNA, 25 bp, Rattus norvegicus
atacagcaggtgatggcccaggcgt

SEQ ID NO: 170562 - DNA, 25 bp, Rattus norvegicus
atacagcaggtgttggcccaggcgt

SEQ ID NO: 170563 - DNA, 25 bp, Rattus norvegicus
atacagcatttgctatgcccacgta

SEQ ID NO: 170564 - DNA, 25 bp, Rattus norvegicus
atacagcatttggtatgcccacgta

SEQ ID NO: 170565 - DNA, 25 bp, Rattus norvegicus
atacagcccgagattctgcagtaga

SEQ ID NO: 170566 - DNA, 25 bp, Rattus norvegicus
atacagcccgagtttctgcagtaga

SEQ ID NO: 170567 - DNA, 25 bp, Rattus norvegicus
atacagcgtctgaggcaatcaccga

SEQ ID NO: 170568 - DNA, 25 bp, Rattus norvegicus
atacagcgtctgtggcaatcaccga

SEQ ID NO: 170569 - DNA, 25 bp, Rattus norvegicus
atacagcgtgtcctgatctggtcca

SEQ ID NO: 170570 - DNA, 25 bp, Rattus norvegicus
atacagcgtgtcgtgatctggtcca

SEQ ID NO: 170571 - DNA, 25 bp, Rattus norvegicus
atacagctcactcaaatgtcccaga

SEQ ID NO: 170572 - DNA, 25 bp, Rattus norvegicus
atacagctcactgaaatgtcccaga

SEQ ID NO: 170573 - DNA, 25 bp, Rattus norvegicus
atacagctcataacttcataaaggc

SEQ ID NO: 170574 - DNA, 25 bp, Rattus norvegicus
atacagctcatatcttcataaaggc

SEQ ID NO: 170575 - DNA, 25 bp, Rattus norvegicus
atacagcttcccctgcaggaacact

SEQ ID NO: 170576 - DNA, 25 bp, Rattus norvegicus
atacagcttcccgtgcaggaacact

SEQ ID NO: 170577 - DNA, 25 bp, Rattus norvegicus
atacagcttggcatccttcagaaaa

SEQ ID NO: 170578 - DNA, 25 bp, Rattus norvegicus
atacagcttggcttccttcagaaaa

SEQ ID NO: 170579 - DNA, 25 bp, Rattus norvegicus
atacagctttgcagggccttttcac

SEQ ID NO: 170580 - DNA, 25 bp, Rattus norvegicus
atacagctttgctgggccttttcac

SEQ ID NO: 170581 - DNA, 25 bp, Rattus norvegicus
atacagcttttgacttccaagccta

SEQ ID NO: 170582 - DNA, 25 bp, Rattus norvegicus
atacagcttttgtcttccaagccta

SEQ ID NO: 170583 - DNA, 25 bp, Rattus norvegicus
atacaggaccttagggagacatgcc

SEQ ID NO: 170584 - DNA, 25 bp, Rattus norvegicus
atacaggacctttgggagacatgcc

SEQ ID NO: 170585 - DNA, 25 bp, Rattus norvegicus
atacaggacttgctttccagctcac

SEQ ID NO: 170586 - DNA, 25 bp, Rattus norvegicus
atacaggacttggtttccagctcac

SEQ ID NO: 170587 - DNA, 25 bp, Rattus norvegicus
atacaggagccaagcacagcgtcac

SEQ ID NO: 170588 - DNA, 25 bp, Rattus norvegicus
atacaggagccatgcacagcgtcac

SEQ ID NO: 170589 - DNA, 25 bp, Rattus norvegicus
atacaggataccatcagtccttcct

SEQ ID NO: 170590 - DNA, 25 bp, Rattus norvegicus
atacaggataccttcagtccttcct

SEQ ID NO: 170591 - DNA, 25 bp, Rattus norvegicus
atacaggcactgatcacaaaacaat

SEQ ID NO: 170592 - DNA, 25 bp, Rattus norvegicus
atacaggcactgttcacaaaacaat

SEQ ID NO: 170593 - DNA, 25 bp, Rattus norvegicus
atacaggcagcccaagcacatatgt

SEQ ID NO: 170594 - DNA, 25 bp, Rattus norvegicus
atacaggcagccgaagcacatatgt

SEQ ID NO: 170595 - DNA, 25 bp, Rattus norvegicus
atacaggcataaaccttccactctt

SEQ ID NO: 170596 - DNA, 25 bp, Rattus norvegicus
atacaggcataatccttccactctt

SEQ ID NO: 170597 - DNA, 25 bp, Rattus norvegicus
atacaggcccctccctgggtcagag

SEQ ID NO: 170598 - DNA, 25 bp, Rattus norvegicus
atacaggcccctgcctgggtcagag

SEQ ID NO: 170599 - DNA, 25 bp, Rattus norvegicus
atacaggcctggctcgaggatacca

SEQ ID NO: 170600 - DNA, 25 bp, Rattus norvegicus
atacaggcctgggtcgaggatacca

SEQ ID NO: 170601 - DNA, 25 bp, Rattus norvegicus
atacaggcgccaatttttaagattt

SEQ ID NO: 170602 - DNA, 25 bp, Rattus norvegicus
atacaggcgccattttttaagattt

SEQ ID NO: 170603 - DNA, 25 bp, Rattus norvegicus
atacaggctctgatgaagatgcata

SEQ ID NO: 170604 - DNA, 25 bp, Rattus norvegicus
atacaggctctgttgaagatgcata

SEQ ID NO: 170605 - DNA, 25 bp, Rattus norvegicus
atacagggagctccaccacggtgta

SEQ ID NO: 170606 - DNA, 25 bp, Rattus norvegicus
atacagggagctgcaccacggtgta

SEQ ID NO: 170607 - DNA, 25 bp, Rattus norvegicus
atacagggcgggatggactctcaaa

SEQ ID NO: 170608 - DNA, 25 bp, Rattus norvegicus
atacagggcgggttggactctcaaa

SEQ ID NO: 170609 - DNA, 25 bp, Rattus norvegicus
atacagggctgcctctttgtttcac

SEQ ID NO: 170610 - DNA, 25 bp, Rattus norvegicus
atacagggctgcgtctttgtttcac

SEQ ID NO: 170611 - DNA, 25 bp, Rattus norvegicus
atacagggtctcaggcggatggata

SEQ ID NO: 170612 - DNA, 25 bp, Rattus norvegicus
atacagggtctctggcggatggata

SEQ ID NO: 170613 - DNA, 25 bp, Rattus norvegicus
atacagggtgaactgctgaaaacac

SEQ ID NO: 170614 - DNA, 25 bp, Rattus norvegicus
atacagggtgaagtgctgaaaacac

SEQ ID NO: 170615 - DNA, 25 bp, Rattus norvegicus
atacaggtcattcgtgtgtcacatg

SEQ ID NO: 170616 - DNA, 25 bp, Rattus norvegicus
atacaggtcattggtgtgtcacatg

SEQ ID NO: 170617 - DNA, 25 bp, Rattus norvegicus
atacaggtcgcaataaggatctcag

SEQ ID NO: 170618 - DNA, 25 bp, Rattus norvegicus
atacaggtcgcattaaggatctcag

SEQ ID NO: 170619 - DNA, 25 bp, Rattus norvegicus
atacaggtcttaacttcctgtttct

SEQ ID NO: 170620 - DNA, 25 bp, Rattus norvegicus
atacaggtcttatcttcctgtttct

SEQ ID NO: 170621 - DNA, 25 bp, Rattus norvegicus
atacaggtgggcaaattatgcaata

SEQ ID NO: 170622 - DNA, 25 bp, Rattus norvegicus
atacaggtgggctaattatgcaata

SEQ ID NO: 170623 - DNA, 25 bp, Rattus norvegicus
atacaggttcttctctgttggcttt

SEQ ID NO: 170624 - DNA, 25 bp, Rattus norvegicus
atacaggttcttgtctgttggcttt

SEQ ID NO: 170625 - DNA, 25 bp, Rattus norvegicus
atacagtaatctaaacgcacctcct

SEQ ID NO: 170626 - DNA, 25 bp, Rattus norvegicus
atacagtaatcttaacgcacctcct

SEQ ID NO: 170627 - DNA, 25 bp, Rattus norvegicus
atacagtaattgacactcaggcaaa

SEQ ID NO: 170628 - DNA, 25 bp, Rattus norvegicus
atacagtaattgtcactcaggcaaa

SEQ ID NO: 170629 - DNA, 25 bp, Rattus norvegicus
atacagtctccaatagtggcggtat

SEQ ID NO: 170630 - DNA, 25 bp, Rattus norvegicus
atacagtctccattagtggcggtat

SEQ ID NO: 170631 - DNA, 25 bp, Rattus norvegicus
atacagtgccacagagagacccctt

SEQ ID NO: 170632 - DNA, 25 bp, Rattus norvegicus
atacagtgccactgagagacccctt

SEQ ID NO: 170633 - DNA, 25 bp, Rattus norvegicus
atacagtgctcaatggaggctcctg

SEQ ID NO: 170634 - DNA, 25 bp, Rattus norvegicus
atacagtgctcattggaggctcctg

SEQ ID NO: 170635 - DNA, 25 bp, Rattus norvegicus
atacagtgctttatgttcctggctt

SEQ ID NO: 170636 - DNA, 25 bp, Rattus norvegicus
atacagtgctttttgttcctggctt

SEQ ID NO: 170637 - DNA, 25 bp, Rattus norvegicus
atacagtgtattatccagcttccct

SEQ ID NO: 170638 - DNA, 25 bp, Rattus norvegicus
atacagtgtattttccagcttccct

SEQ ID NO: 170639 - DNA, 25 bp, Rattus norvegicus
atacagtgtcacattgaacttctaa

SEQ ID NO: 170640 - DNA, 25 bp, Rattus norvegicus
atacagtgtcactttgaacttctaa

SEQ ID NO: 170641 - DNA, 25 bp, Rattus norvegicus
atacagtgtgcgctttgtgccccag

SEQ ID NO: 170642 - DNA, 25 bp, Rattus norvegicus
atacagtgtgcggtttgtgccccag

SEQ ID NO: 170643 - DNA, 25 bp, Rattus norvegicus
atacagtgtgtaccgtcctggtacc

SEQ ID NO: 170644 - DNA, 25 bp, Rattus norvegicus
atacagtgtgtagcgtcctggtacc

SEQ ID NO: 170645 - DNA, 25 bp, Rattus norvegicus
atacagtgttatatatggttcctcc

SEQ ID NO: 170646 - DNA, 25 bp, Rattus norvegicus
atacagtgttatttatggttcctcc

SEQ ID NO: 170647 - DNA, 25 bp, Rattus norvegicus
atacagtgttctccccactttttaa

SEQ ID NO: 170648 - DNA, 25 bp, Rattus norvegicus
atacagtgttctgcccactttttaa

SEQ ID NO: 170649 - DNA, 25 bp, Rattus norvegicus
atacagtgttgcacttctgcttagt

SEQ ID NO: 170650 - DNA, 25 bp, Rattus norvegicus
atacagtgttgctcttctgcttagt

SEQ ID NO: 170651 - DNA, 25 bp, Rattus norvegicus
atacagttcaccactgtctctgtga

SEQ ID NO: 170652 - DNA, 25 bp, Rattus norvegicus
atacagttcacctctgtctctgtga

SEQ ID NO: 170653 - DNA, 25 bp, Rattus norvegicus
atacagttctgccattgaccatctg

SEQ ID NO: 170654 - DNA, 25 bp, Rattus norvegicus
atacagttctgcgattgaccatctg

SEQ ID NO: 170655 - DNA, 25 bp, Rattus norvegicus
atacagttgaacacgccccagaagc

SEQ ID NO: 170656 - DNA, 25 bp, Rattus norvegicus
atacagttgaactcgccccagaagc

SEQ ID NO: 170657 - DNA, 25 bp, Rattus norvegicus
atacagttgcgaacagacctcattg

SEQ ID NO: 170658 - DNA, 25 bp, Rattus norvegicus
atacagttgcgatcagacctcattg

SEQ ID NO: 170659 - DNA, 25 bp, Rattus norvegicus
atacagttgctccaagggcccaggc

SEQ ID NO: 170660 - DNA, 25 bp, Rattus norvegicus
atacagttgctcgaagggcccaggc

SEQ ID NO: 170661 - DNA, 25 bp, Rattus norvegicus
atacagttggatcgctccggctaac

SEQ ID NO: 170662 - DNA, 25 bp, Rattus norvegicus
atacagttggatggctccggctaac

SEQ ID NO: 170663 - DNA, 25 bp, Rattus norvegicus
atacagttgggtatgttcttcaagg

SEQ ID NO: 170664 - DNA, 25 bp, Rattus norvegicus
atacagttgggtttgttcttcaagg

SEQ ID NO: 170665 - DNA, 25 bp, Rattus norvegicus
atacagtttccaaggtgcgtgtgct

SEQ ID NO: 170666 - DNA, 25 bp, Rattus norvegicus
atacagtttccatggtgcgtgtgct

SEQ ID NO: 170667 - DNA, 25 bp, Rattus norvegicus
atacagtttctcatgaagcctgaac

SEQ ID NO: 170668 - DNA, 25 bp, Rattus norvegicus
atacagtttctcttgaagcctgaac

SEQ ID NO: 170669 - DNA, 25 bp, Rattus norvegicus
atacagtttctgagcctggaagatt

SEQ ID NO: 170670 - DNA, 25 bp, Rattus norvegicus
atacagtttctgtgcctggaagatt

SEQ ID NO: 170671 - DNA, 25 bp, Rattus norvegicus
atacagtttgacaccaggctctcac

SEQ ID NO: 170672 - DNA, 25 bp, Rattus norvegicus
atacagtttgactccaggctctcac

SEQ ID NO: 170673 - DNA, 25 bp, Rattus norvegicus
atacagtttttaacccctttgctct

SEQ ID NO: 170674 - DNA, 25 bp, Rattus norvegicus
atacagtttttatcccctttgctct

SEQ ID NO: 170675 - DNA, 25 bp, Rattus norvegicus
atacagtttttgaagctccctttct

SEQ ID NO: 170676 - DNA, 25 bp, Rattus norvegicus
atacagtttttgtagctccctttct

SEQ ID NO: 170677 - DNA, 25 bp, Rattus norvegicus
atacataaacccacacccagaaata

SEQ ID NO: 170678 - DNA, 25 bp, Rattus norvegicus
atacataaaccctcacccagaaata

SEQ ID NO: 170679 - DNA, 25 bp, Rattus norvegicus
atacataacttaaagaacctcgcgt

SEQ ID NO: 170680 - DNA, 25 bp, Rattus norvegicus
atacataacttatagaacctcgcgt

SEQ ID NO: 170681 - DNA, 25 bp, Rattus norvegicus
atacataagccgctcgttttcctgt

SEQ ID NO: 170682 - DNA, 25 bp, Rattus norvegicus
atacataagccggtcgttttcctgt

SEQ ID NO: 170683 - DNA, 25 bp, Rattus norvegicus
atacataatatgagacctctgtcaa

SEQ ID NO: 170684 - DNA, 25 bp, Rattus norvegicus
atacataatatgtgacctctgtcaa

SEQ ID NO: 170685 - DNA, 25 bp, Rattus norvegicus
atacataattacattcctgggacaa

SEQ ID NO: 170686 - DNA, 25 bp, Rattus norvegicus
atacataattactttcctgggacaa

SEQ ID NO: 170687 - DNA, 25 bp, Rattus norvegicus
atacatacaccacatgtcgctcgtt

SEQ ID NO: 170688 - DNA, 25 bp, Rattus norvegicus
atacatacaccagatgtcgctcgtt

SEQ ID NO: 170689 - DNA, 25 bp, Rattus norvegicus
atacatacatgtcccctagttttgg

SEQ ID NO: 170690 - DNA, 25 bp, Rattus norvegicus
atacatacatgtgccctagttttgg

SEQ ID NO: 170691 - DNA, 25 bp, Rattus norvegicus
atacataccaggctcctgacaggaa

SEQ ID NO: 170692 - DNA, 25 bp, Rattus norvegicus
atacataccagggtcctgacaggaa

SEQ ID NO: 170693 - DNA, 25 bp, Rattus norvegicus
atacatacctacatgactcattgga

SEQ ID NO: 170694 - DNA, 25 bp, Rattus norvegicus
atacatacctacttgactcattgga

SEQ ID NO: 170695 - DNA, 25 bp, Rattus norvegicus
atacatactggcatcacaagttcta

SEQ ID NO: 170696 - DNA, 25 bp, Rattus norvegicus
atacatactggcttcacaagttcta

SEQ ID NO: 170697 - DNA, 25 bp, Rattus norvegicus
atacatagattcatgcctcaggaga

SEQ ID NO: 170698 - DNA, 25 bp, Rattus norvegicus
atacatagattcttgcctcaggaga

SEQ ID NO: 170699 - DNA, 25 bp, Rattus norvegicus
atacataggacacttcttgcctgcc

SEQ ID NO: 170700 - DNA, 25 bp, Rattus norvegicus
atacataggacagttcttgcctgcc

SEQ ID NO: 170701 - DNA, 25 bp, Rattus norvegicus
atacatagtgaaacccgatcttgaa

SEQ ID NO: 170702 - DNA, 25 bp, Rattus norvegicus
atacatagtgaatcccgatcttgaa

SEQ ID NO: 170703 - DNA, 25 bp, Rattus norvegicus
atacatagtggaattgaggctagct

SEQ ID NO: 170704 - DNA, 25 bp, Rattus norvegicus
atacatagtggatttgaggctagct

SEQ ID NO: 170705 - DNA, 25 bp, Rattus norvegicus
atacatatacacacgcctaccacat

SEQ ID NO: 170706 - DNA, 25 bp, Rattus norvegicus
atacatatacactcgcctaccacat

SEQ ID NO: 170707 - DNA, 25 bp, Rattus norvegicus
atacatataccaatatccctgtggg

SEQ ID NO: 170708 - DNA, 25 bp, Rattus norvegicus
atacatataccattatccctgtggg

SEQ ID NO: 170709 - DNA, 25 bp, Rattus norvegicus
atacatatacttcctttacccagag

SEQ ID NO: 170710 - DNA, 25 bp, Rattus norvegicus
atacatatacttgctttacccagag

SEQ ID NO: 170711 - DNA, 25 bp, Rattus norvegicus
atacatatttaaccctgcttgacac

SEQ ID NO: 170712 - DNA, 25 bp, Rattus norvegicus
atacatatttaagcctgcttgacac

SEQ ID NO: 170713 - DNA, 25 bp, Rattus norvegicus
atacatcacagcctgagccgagcca

SEQ ID NO: 170714 - DNA, 25 bp, Rattus norvegicus
atacatcacagcgtgagccgagcca

SEQ ID NO: 170715 - DNA, 25 bp, Rattus norvegicus
atacatcacatgagcataccacaca

SEQ ID NO: 170716 - DNA, 25 bp, Rattus norvegicus
atacatcacatgtgcataccacaca

SEQ ID NO: 170717 - DNA, 25 bp, Rattus norvegicus
atacatcaccttcttgcctttcatc

SEQ ID NO: 170718 - DNA, 25 bp, Rattus norvegicus
atacatcaccttgttgcctttcatc

SEQ ID NO: 170719 - DNA, 25 bp, Rattus norvegicus
atacatcatgtacttgtcctagcag

SEQ ID NO: 170720 - DNA, 25 bp, Rattus norvegicus
atacatcatgtagttgtcctagcag

SEQ ID NO: 170721 - DNA, 25 bp, Rattus norvegicus
atacatcctaccagtaaagcccagt

SEQ ID NO: 170722 - DNA, 25 bp, Rattus norvegicus
atacatcctacctgtaaagcccagt

SEQ ID NO: 170723 - DNA, 25 bp, Rattus norvegicus
atacatcctcagctttactcagact

SEQ ID NO: 170724 - DNA, 25 bp, Rattus norvegicus
atacatcctcaggtttactcagact

SEQ ID NO: 170725 - DNA, 25 bp, Rattus norvegicus
atacatcctcatcatgcacacagtg

SEQ ID NO: 170726 - DNA, 25 bp, Rattus norvegicus
atacatcctcatgatgcacacagtg

SEQ ID NO: 170727 - DNA, 25 bp, Rattus norvegicus
atacatcctctgacaggtatctaag

SEQ ID NO: 170728 - DNA, 25 bp, Rattus norvegicus
atacatcctctgtcaggtatctaag

SEQ ID NO: 170729 - DNA, 25 bp, Rattus norvegicus
atacatcctggacttttcctgtctc

SEQ ID NO: 170730 - DNA, 25 bp, Rattus norvegicus
atacatcctggagttttcctgtctc

SEQ ID NO: 170731 - DNA, 25 bp, Rattus norvegicus
atacatcctttaaacggcattcggg

SEQ ID NO: 170732 - DNA, 25 bp, Rattus norvegicus
atacatcctttatacggcattcggg

SEQ ID NO: 170733 - DNA, 25 bp, Rattus norvegicus
atacatcggtgtcctttgcacagtg

SEQ ID NO: 170734 - DNA, 25 bp, Rattus norvegicus
atacatcggtgtgctttgcacagtg

SEQ ID NO: 170735 - DNA, 25 bp, Rattus norvegicus
atacatcgtagtcccttattgcaca

SEQ ID NO: 170736 - DNA, 25 bp, Rattus norvegicus
atacatcgtagtgccttattgcaca

SEQ ID NO: 170737 - DNA, 25 bp, Rattus norvegicus
atacatctaactctgctctaccact

SEQ ID NO: 170738 - DNA, 25 bp, Rattus norvegicus
atacatctaactgtgctctaccact

SEQ ID NO: 170739 - DNA, 25 bp, Rattus norvegicus
atacatctgactcgctcagtggtta

SEQ ID NO: 170740 - DNA, 25 bp, Rattus norvegicus
atacatctgactggctcagtggtta

SEQ ID NO: 170741 - DNA, 25 bp, Rattus norvegicus
atacatctgtctcatcaagcacaca

SEQ ID NO: 170742 - DNA, 25 bp, Rattus norvegicus
atacatctgtctgatcaagcacaca

SEQ ID NO: 170743 - DNA, 25 bp, Rattus norvegicus
atacatcttcatactcaggacctaa

SEQ ID NO: 170744 - DNA, 25 bp, Rattus norvegicus
atacatcttcattctcaggacctaa

SEQ ID NO: 170745 - DNA, 25 bp, Rattus norvegicus
atacatcttctcatgagcttccaaa

SEQ ID NO: 170746 - DNA, 25 bp, Rattus norvegicus
atacatcttctcttgagcttccaaa

SEQ ID NO: 170747 - DNA, 25 bp, Rattus norvegicus
atacatcttgacaatccagggccag

SEQ ID NO: 170748 - DNA, 25 bp, Rattus norvegicus
atacatcttgactatccagggccag

SEQ ID NO: 170749 - DNA, 25 bp, Rattus norvegicus
atacatcttgctacggcttttctta

SEQ ID NO: 170750 - DNA, 25 bp, Rattus norvegicus
atacatcttgcttcggcttttctta

SEQ ID NO: 170751 - DNA, 25 bp, Rattus norvegicus
atacatctttccatggcttcttgaa

SEQ ID NO: 170752 - DNA, 25 bp, Rattus norvegicus
atacatctttccttggcttcttgaa

SEQ ID NO: 170753 - DNA, 25 bp, Rattus norvegicus
atacatgacacacaagctacaccca

SEQ ID NO: 170754 - DNA, 25 bp, Rattus norvegicus
atacatgacacagaagctacaccca

SEQ ID NO: 170755 - DNA, 25 bp, Rattus norvegicus
atacatgagaaccaccctgaggaaa

SEQ ID NO: 170756 - DNA, 25 bp, Rattus norvegicus
atacatgagaacgaccctgaggaaa

SEQ ID NO: 170757 - DNA, 25 bp, Rattus norvegicus
atacatgagacgcagcctcatcttc

SEQ ID NO: 170758 - DNA, 25 bp, Rattus norvegicus
atacatgagacggagcctcatcttc

SEQ ID NO: 170759 - DNA, 25 bp, Rattus norvegicus
atacatgagcttctccatcgtcagt

SEQ ID NO: 170760 - DNA, 25 bp, Rattus norvegicus
atacatgagcttgtccatcgtcagt

SEQ ID NO: 170761 - DNA, 25 bp, Rattus norvegicus
atacatgaggatccaggcccagcag

SEQ ID NO: 170762 - DNA, 25 bp, Rattus norvegicus
atacatgaggatgcaggcccagcag

SEQ ID NO: 170763 - DNA, 25 bp, Rattus norvegicus
atacatgatgccagtttcccaaccc

SEQ ID NO: 170764 - DNA, 25 bp, Rattus norvegicus
atacatgatgcctgtttcccaaccc

SEQ ID NO: 170765 - DNA, 25 bp, Rattus norvegicus
atacatgcacacacatagtagtggg

SEQ ID NO: 170766 - DNA, 25 bp, Rattus norvegicus
atacatgcacactcatagtagtggg

SEQ ID NO: 170767 - DNA, 25 bp, Rattus norvegicus
atacatgcactgacccgtggaggtg

SEQ ID NO: 170768 - DNA, 25 bp, Rattus norvegicus
atacatgcactgtcccgtggaggtg

SEQ ID NO: 170769 - DNA, 25 bp, Rattus norvegicus
atacatgccaacagatcttccagga

SEQ ID NO: 170770 - DNA, 25 bp, Rattus norvegicus
atacatgccaactgatcttccagga

SEQ ID NO: 170771 - DNA, 25 bp, Rattus norvegicus
atacatgccatcaagaaccctggag

SEQ ID NO: 170772 - DNA, 25 bp, Rattus norvegicus
atacatgccatctagaaccctggag

SEQ ID NO: 170773 - DNA, 25 bp, Rattus norvegicus
atacatgcctggatcttcccgtgta

SEQ ID NO: 170774 - DNA, 25 bp, Rattus norvegicus
atacatgcctggttcttcccgtgta

SEQ ID NO: 170775 - DNA, 25 bp, Rattus norvegicus
atacatgcctttccatcaagtgacc

SEQ ID NO: 170776 - DNA, 25 bp, Rattus norvegicus
atacatgcctttgcatcaagtgacc

SEQ ID NO: 170777 - DNA, 25 bp, Rattus norvegicus
atacatgcttttaagtacagctgca

SEQ ID NO: 170778 - DNA, 25 bp, Rattus norvegicus
atacatgctttttagtacagctgca

SEQ ID NO: 170779 - DNA, 25 bp, Rattus norvegicus
atacatggactccttatgagcccat

SEQ ID NO: 170780 - DNA, 25 bp, Rattus norvegicus
atacatggactcgttatgagcccat

SEQ ID NO: 170781 - DNA, 25 bp, Rattus norvegicus
atacatggagacaaaccgaaccgca

SEQ ID NO: 170782 - DNA, 25 bp, Rattus norvegicus
atacatggagactaaccgaaccgca

SEQ ID NO: 170783 - DNA, 25 bp, Rattus norvegicus
atacatggcagcattccactccaag

SEQ ID NO: 170784 - DNA, 25 bp, Rattus norvegicus
atacatggcagctttccactccaag

SEQ ID NO: 170785 - DNA, 25 bp, Rattus norvegicus
atacatggcataacactccttagtt

SEQ ID NO: 170786 - DNA, 25 bp, Rattus norvegicus
atacatggcatatcactccttagtt

SEQ ID NO: 170787 - DNA, 25 bp, Rattus norvegicus
atacatgggcggctttgcagacaat

SEQ ID NO: 170788 - DNA, 25 bp, Rattus norvegicus
atacatgggcgggtttgcagacaat

SEQ ID NO: 170789 - DNA, 25 bp, Rattus norvegicus
atacatggttatactggctatgcaa

SEQ ID NO: 170790 - DNA, 25 bp, Rattus norvegicus
atacatggttattctggctatgcaa

SEQ ID NO: 170791 - DNA, 25 bp, Rattus norvegicus
atacatgtaccaaccttttcttagt

SEQ ID NO: 170792 - DNA, 25 bp, Rattus norvegicus
atacatgtaccatccttttcttagt

SEQ ID NO: 170793 - DNA, 25 bp, Rattus norvegicus
atacatgtacgaactactagagggc

SEQ ID NO: 170794 - DNA, 25 bp, Rattus norvegicus
atacatgtacgatctactagagggc

SEQ ID NO: 170795 - DNA, 25 bp, Rattus norvegicus
atacatgtctgcactgcaacagggt

SEQ ID NO: 170796 - DNA, 25 bp, Rattus norvegicus
atacatgtctgctctgcaacagggt

SEQ ID NO: 170797 - DNA, 25 bp, Rattus norvegicus
atacatgtgataagatggcgcccca

SEQ ID NO: 170798 - DNA, 25 bp, Rattus norvegicus
atacatgtgatatgatggcgcccca

SEQ ID NO: 170799 - DNA, 25 bp, Rattus norvegicus
atacatgttaacacatctgcaggga

SEQ ID NO: 170800 - DNA, 25 bp, Rattus norvegicus
atacatgttaactcatctgcaggga

SEQ ID NO: 170801 - DNA, 25 bp, Rattus norvegicus
atacattatcatccctacatctgcc

SEQ ID NO: 170802 - DNA, 25 bp, Rattus norvegicus
atacattatcatgcctacatctgcc

SEQ ID NO: 170803 - DNA, 25 bp, Rattus norvegicus
atacattcatggaggaggcagtgac

SEQ ID NO: 170804 - DNA, 25 bp, Rattus norvegicus
atacattcatggtggaggcagtgac

SEQ ID NO: 170805 - DNA, 25 bp, Rattus norvegicus
atacattccagcctgttggcagcat

SEQ ID NO: 170806 - DNA, 25 bp, Rattus norvegicus
atacattccagcgtgttggcagcat

SEQ ID NO: 170807 - DNA, 25 bp, Rattus norvegicus
atacattcccaaatgcgcattttcc

SEQ ID NO: 170808 - DNA, 25 bp, Rattus norvegicus
atacattcccaattgcgcattttcc

SEQ ID NO: 170809 - DNA, 25 bp, Rattus norvegicus
atacattccctaattgttcacccat

SEQ ID NO: 170810 - DNA, 25 bp, Rattus norvegicus
atacattccctatttgttcacccat

SEQ ID NO: 170811 - DNA, 25 bp, Rattus norvegicus
atacattctattctgctgccaatgc

SEQ ID NO: 170812 - DNA, 25 bp, Rattus norvegicus
atacattctattgtgctgccaatgc

SEQ ID NO: 170813 - DNA, 25 bp, Rattus norvegicus
atacattgatttagcatgtcatttt

SEQ ID NO: 170814 - DNA, 25 bp, Rattus norvegicus
atacattgattttgcatgtcatttt

SEQ ID NO: 170815 - DNA, 25 bp, Rattus norvegicus
atacattgctgtcactagaactctc

SEQ ID NO: 170816 - DNA, 25 bp, Rattus norvegicus
atacattgctgtgactagaactctc

SEQ ID NO: 170817 - DNA, 25 bp, Rattus norvegicus
atacattgtccaaaagcctgggctt

SEQ ID NO: 170818 - DNA, 25 bp, Rattus norvegicus
atacattgtccataagcctgggctt

SEQ ID NO: 170819 - DNA, 25 bp, Rattus norvegicus
atacatttaaatccattgaagtctg

SEQ ID NO: 170820 - DNA, 25 bp, Rattus norvegicus
atacatttaaatgcattgaagtctg

SEQ ID NO: 170821 - DNA, 25 bp, Rattus norvegicus
atacatttccatactcttaagaggc

SEQ ID NO: 170822 - DNA, 25 bp, Rattus norvegicus
atacatttccattctcttaagaggc

SEQ ID NO: 170823 - DNA, 25 bp, Rattus norvegicus
atacatttcttcaactgtctagcac

SEQ ID NO: 170824 - DNA, 25 bp, Rattus norvegicus
atacatttcttctactgtctagcac

SEQ ID NO: 170825 - DNA, 25 bp, Rattus norvegicus
atacatttcttgcatgggctgcagg

SEQ ID NO: 170826 - DNA, 25 bp, Rattus norvegicus
atacatttcttggatgggctgcagg

SEQ ID NO: 170827 - DNA, 25 bp, Rattus norvegicus
atacatttgataacacatgctcaat

SEQ ID NO: 170828 - DNA, 25 bp, Rattus norvegicus
atacatttgatatcacatgctcaat

SEQ ID NO: 170829 - DNA, 25 bp, Rattus norvegicus
atacatttgtaaaccagctcttgag

SEQ ID NO: 170830 - DNA, 25 bp, Rattus norvegicus
atacatttgtaatccagctcttgag

SEQ ID NO: 170831 - DNA, 25 bp, Rattus norvegicus
atacattttactactatggcctatt

SEQ ID NO: 170832 - DNA, 25 bp, Rattus norvegicus
atacattttacttctatggcctatt

SEQ ID NO: 170833 - DNA, 25 bp, Rattus norvegicus
atacattttattatgcctcagccag

SEQ ID NO: 170834 - DNA, 25 bp, Rattus norvegicus
atacattttattttgcctcagccag

SEQ ID NO: 170835 - DNA, 25 bp, Rattus norvegicus
atacattttcagaggaaaacctggt

SEQ ID NO: 170836 - DNA, 25 bp, Rattus norvegicus
atacattttcagtggaaaacctggt

SEQ ID NO: 170837 - DNA, 25 bp, Rattus norvegicus
atacattttgccagatgagcctgcc

SEQ ID NO: 170838 - DNA, 25 bp, Rattus norvegicus
atacattttgcctgatgagcctgcc

SEQ ID NO: 170839 - DNA, 25 bp, Rattus norvegicus
ataccaaaccttctgactttgccaa

SEQ ID NO: 170840 - DNA, 25 bp, Rattus norvegicus
ataccaaaccttgtgactttgccaa

SEQ ID NO: 170841 - DNA, 25 bp, Rattus norvegicus
ataccaaaggttacactgcaggcgt

SEQ ID NO: 170842 - DNA, 25 bp, Rattus norvegicus
ataccaaaggtttcactgcaggcgt

SEQ ID NO: 170843 - DNA, 25 bp, Rattus norvegicus
ataccaaatactagctttcacactg

SEQ ID NO: 170844 - DNA, 25 bp, Rattus norvegicus
ataccaaatacttgctttcacactg

SEQ ID NO: 170845 - DNA, 25 bp, Rattus norvegicus
ataccaacaccccttcaggaaatgg

SEQ ID NO: 170846 - DNA, 25 bp, Rattus norvegicus
ataccaacacccgttcaggaaatgg

SEQ ID NO: 170847 - DNA, 25 bp, Rattus norvegicus
ataccaacatgtctgtgtctaccga

SEQ ID NO: 170848 - DNA, 25 bp, Rattus norvegicus
ataccaacatgtgtgtgtctaccga

SEQ ID NO: 170849 - DNA, 25 bp, Rattus norvegicus
ataccaacctctctgtaaacgctgt

SEQ ID NO: 170850 - DNA, 25 bp, Rattus norvegicus
ataccaacctctgtgtaaacgctgt

SEQ ID NO: 170851 - DNA, 25 bp, Rattus norvegicus
ataccaacttcaacaacttttccat

SEQ ID NO: 170852 - DNA, 25 bp, Rattus norvegicus
ataccaacttcatcaacttttccat

SEQ ID NO: 170853 - DNA, 25 bp, Rattus norvegicus
ataccaagaggccattgtgcctttg

SEQ ID NO: 170854 - DNA, 25 bp, Rattus norvegicus
ataccaagaggcgattgtgcctttg

SEQ ID NO: 170855 - DNA, 25 bp, Rattus norvegicus
ataccaagccacaattgacggagta

SEQ ID NO: 170856 - DNA, 25 bp, Rattus norvegicus
ataccaagccactattgacggagta

SEQ ID NO: 170857 - DNA, 25 bp, Rattus norvegicus
ataccaagtctgaggtttgtcccat

SEQ ID NO: 170858 - DNA, 25 bp, Rattus norvegicus
ataccaagtctgtggtttgtcccat

SEQ ID NO: 170859 - DNA, 25 bp, Rattus norvegicus
ataccaagtgctattacataatcaa

SEQ ID NO: 170860 - DNA, 25 bp, Rattus norvegicus
ataccaagtgcttttacataatcaa

SEQ ID NO: 170861 - DNA, 25 bp, Rattus norvegicus
ataccaatgcctcggtagcccgtta

SEQ ID NO: 170862 - DNA, 25 bp, Rattus norvegicus
ataccaatgcctgggtagcccgtta

SEQ ID NO: 170863 - DNA, 25 bp, Rattus norvegicus
ataccaattaatattcgaagaatgc

SEQ ID NO: 170864 - DNA, 25 bp, Rattus norvegicus
ataccaattaattttcgaagaatgc

SEQ ID NO: 170865 - DNA, 25 bp, Rattus norvegicus
ataccacacgtcattcacagggaag

SEQ ID NO: 170866 - DNA, 25 bp, Rattus norvegicus
ataccacacgtctttcacagggaag

SEQ ID NO: 170867 - DNA, 25 bp, Rattus norvegicus
ataccacagagaaggccttccaaga

SEQ ID NO: 170868 - DNA, 25 bp, Rattus norvegicus
ataccacagagatggccttccaaga

SEQ ID NO: 170869 - DNA, 25 bp, Rattus norvegicus
ataccacagaggaatgcgcccttat

SEQ ID NO: 170870 - DNA, 25 bp, Rattus norvegicus
ataccacagaggtatgcgcccttat

SEQ ID NO: 170871 - DNA, 25 bp, Rattus norvegicus
ataccacagccgacgcttgtgatgc

SEQ ID NO: 170872 - DNA, 25 bp, Rattus norvegicus
ataccacagccgtcgcttgtgatgc

SEQ ID NO: 170873 - DNA, 25 bp, Rattus norvegicus
ataccacaggccaggtgtttgatct

SEQ ID NO: 170874 - DNA, 25 bp, Rattus norvegicus
ataccacaggcctggtgtttgatct

SEQ ID NO: 170875 - DNA, 25 bp, Rattus norvegicus
ataccacagggcaagcctgatctgt

SEQ ID NO: 170876 - DNA, 25 bp, Rattus norvegicus
ataccacagggctagcctgatctgt

SEQ ID NO: 170877 - DNA, 25 bp, Rattus norvegicus
ataccacattggacttgcccagagg

SEQ ID NO: 170878 - DNA, 25 bp, Rattus norvegicus
ataccacattggtcttgcccagagg

SEQ ID NO: 170879 - DNA, 25 bp, Rattus norvegicus
ataccaccaacaaggtgtctctgtg

SEQ ID NO: 170880 - DNA, 25 bp, Rattus norvegicus
ataccaccaacatggtgtctctgtg

SEQ ID NO: 170881 - DNA, 25 bp, Rattus norvegicus
ataccaccaagcaggtcagactcgg

SEQ ID NO: 170882 - DNA, 25 bp, Rattus norvegicus
ataccaccaagctggtcagactcgg

SEQ ID NO: 170883 - DNA, 25 bp, Rattus norvegicus
ataccaccagagaagttagccttcc

SEQ ID NO: 170884 - DNA, 25 bp, Rattus norvegicus
ataccaccagagtagttagccttcc

SEQ ID NO: 170885 - DNA, 25 bp, Rattus norvegicus
ataccaccagccatggtttggtttg

SEQ ID NO: 170886 - DNA, 25 bp, Rattus norvegicus
ataccaccagccttggtttggtttg

SEQ ID NO: 170887 - DNA, 25 bp, Rattus norvegicus
ataccaccatacatcaatctgatgt

SEQ ID NO: 170888 - DNA, 25 bp, Rattus norvegicus
ataccaccatacttcaatctgatgt

SEQ ID NO: 170889 - DNA, 25 bp, Rattus norvegicus
ataccaccatctctttcctgaaatt

SEQ ID NO: 170890 - DNA, 25 bp, Rattus norvegicus
ataccaccatctgtttcctgaaatt

SEQ ID NO: 170891 - DNA, 25 bp, Rattus norvegicus
ataccacccgtgatgagcgattctc

SEQ ID NO: 170892 - DNA, 25 bp, Rattus norvegicus
ataccacccgtgttgagcgattctc

SEQ ID NO: 170893 - DNA, 25 bp, Rattus norvegicus
ataccacctcttctgcagaggcaaa

SEQ ID NO: 170894 - DNA, 25 bp, Rattus norvegicus
ataccacctcttgtgcagaggcaaa

SEQ ID NO: 170895 - DNA, 25 bp, Rattus norvegicus
ataccacgaatccagccttagtcgg

SEQ ID NO: 170896 - DNA, 25 bp, Rattus norvegicus
ataccacgaatcgagccttagtcgg

SEQ ID NO: 170897 - DNA, 25 bp, Rattus norvegicus
ataccacgggtaagagcctcgtgat

SEQ ID NO: 170898 - DNA, 25 bp, Rattus norvegicus
ataccacgggtacgtgcccagggca

SEQ ID NO: 170899 - DNA, 25 bp, Rattus norvegicus
ataccacgggtaggtgcccagggca

SEQ ID NO: 170900 - DNA, 25 bp, Rattus norvegicus
ataccacgggtatgagcctcgtgat

SEQ ID NO: 170901 - DNA, 25 bp, Rattus norvegicus
ataccacgtctactggaggcgcgct

SEQ ID NO: 170902 - DNA, 25 bp, Rattus norvegicus
ataccacgtctagtggaggcgcgct

SEQ ID NO: 170903 - DNA, 25 bp, Rattus norvegicus
ataccacgttctactggagaccaag

SEQ ID NO: 170904 - DNA, 25 bp, Rattus norvegicus
ataccacgttcttctggagaccaag

SEQ ID NO: 170905 - DNA, 25 bp, Rattus norvegicus
ataccactatgtactttcttcttcc

SEQ ID NO: 170906 - DNA, 25 bp, Rattus norvegicus
ataccactatgttctttcttcttcc

SEQ ID NO: 170907 - DNA, 25 bp, Rattus norvegicus
ataccactcattattgtttagacat

SEQ ID NO: 170908 - DNA, 25 bp, Rattus norvegicus
ataccactcatttttgtttagacat

SEQ ID NO: 170909 - DNA, 25 bp, Rattus norvegicus
ataccactcctcctgttttgtcaat

SEQ ID NO: 170910 - DNA, 25 bp, Rattus norvegicus
ataccactcctcgtgttttgtcaat

SEQ ID NO: 170911 - DNA, 25 bp, Rattus norvegicus
ataccactgccacatctttgggagc

SEQ ID NO: 170912 - DNA, 25 bp, Rattus norvegicus
ataccactgccagatctttgggagc

SEQ ID NO: 170913 - DNA, 25 bp, Rattus norvegicus
ataccactggcgcaaacacctgagg

SEQ ID NO: 170914 - DNA, 25 bp, Rattus norvegicus
ataccactggcggaaacacctgagg

SEQ ID NO: 170915 - DNA, 25 bp, Rattus norvegicus
ataccactgtacatgttttacacca

SEQ ID NO: 170916 - DNA, 25 bp, Rattus norvegicus
ataccactgtacttgttttacacca

SEQ ID NO: 170917 - DNA, 25 bp, Rattus norvegicus
ataccactgtgaagagacgtctgaa

SEQ ID NO: 170918 - DNA, 25 bp, Rattus norvegicus
ataccactgtgatgagacgtctgaa

SEQ ID NO: 170919 - DNA, 25 bp, Rattus norvegicus
ataccactgtttaccgatggctcac

SEQ ID NO: 170920 - DNA, 25 bp, Rattus norvegicus
ataccactgttttccgatggctcac

SEQ ID NO: 170921 - DNA, 25 bp, Rattus norvegicus
ataccacttggtcagacttttcctt

SEQ ID NO: 170922 - DNA, 25 bp, Rattus norvegicus
ataccacttggtgagacttttcctt

SEQ ID NO: 170923 - DNA, 25 bp, Rattus norvegicus
ataccacttgtaagccatctcgata

SEQ ID NO: 170924 - DNA, 25 bp, Rattus norvegicus
ataccacttgtatgccatctcgata

SEQ ID NO: 170925 - DNA, 25 bp, Rattus norvegicus
ataccacttgtgactgattttgtcc

SEQ ID NO: 170926 - DNA, 25 bp, Rattus norvegicus
ataccacttgtgtctgattttgtcc

SEQ ID NO: 170927 - DNA, 25 bp, Rattus norvegicus
ataccagacaagagccgtcctgtgg

SEQ ID NO: 170928 - DNA, 25 bp, Rattus norvegicus
ataccagacaagtgccgtcctgtgg

SEQ ID NO: 170929 - DNA, 25 bp, Rattus norvegicus
ataccagacggtacctatgccagga

SEQ ID NO: 170930 - DNA, 25 bp, Rattus norvegicus
ataccagacggttcctatgccagga

SEQ ID NO: 170931 - DNA, 25 bp, Rattus norvegicus
ataccagactggacacagacacgag

SEQ ID NO: 170932 - DNA, 25 bp, Rattus norvegicus
ataccagactggtcacagacacgag

SEQ ID NO: 170933 - DNA, 25 bp, Rattus norvegicus
ataccagaggttaccgattatcaaa

SEQ ID NO: 170934 - DNA, 25 bp, Rattus norvegicus
ataccagaggtttccgattatcaaa

SEQ ID NO: 170935 - DNA, 25 bp, Rattus norvegicus
ataccagagtgtatgttttcaactt

SEQ ID NO: 170936 - DNA, 25 bp, Rattus norvegicus
ataccagagtgtttgttttcaactt

SEQ ID NO: 170937 - DNA, 25 bp, Rattus norvegicus
ataccagatcgtatcccgtggttgg

SEQ ID NO: 170938 - DNA, 25 bp, Rattus norvegicus
ataccagatcgtttcccgtggttgg

SEQ ID NO: 170939 - DNA, 25 bp, Rattus norvegicus
ataccagccctgaaagaagtaaaga

SEQ ID NO: 170940 - DNA, 25 bp, Rattus norvegicus
ataccagccctgtaagaagtaaaga

SEQ ID NO: 170941 - DNA, 25 bp, Rattus norvegicus
ataccagctaatcacatgtcctctg

SEQ ID NO: 170942 - DNA, 25 bp, Rattus norvegicus
ataccagctaatgacatgtcctctg

SEQ ID NO: 170943 - DNA, 25 bp, Rattus norvegicus
ataccaggaactcaacctctgtcct

SEQ ID NO: 170944 - DNA, 25 bp, Rattus norvegicus
ataccaggaactgaacctctgtcct

SEQ ID NO: 170945 - DNA, 25 bp, Rattus norvegicus
ataccaggaccactttatgtttgtg

SEQ ID NO: 170946 - DNA, 25 bp, Rattus norvegicus
ataccaggaccagtttatgtttgtg

SEQ ID NO: 170947 - DNA, 25 bp, Rattus norvegicus
ataccaggacccaaagttaaatcag

SEQ ID NO: 170948 - DNA, 25 bp, Rattus norvegicus
ataccaggaccctaagttaaatcag

SEQ ID NO: 170949 - DNA, 25 bp, Rattus norvegicus
ataccaggacttcctcaatgtcaaa

SEQ ID NO: 170950 - DNA, 25 bp, Rattus norvegicus
ataccaggacttgctcaatgtcaaa

SEQ ID NO: 170951 - DNA, 25 bp, Rattus norvegicus
ataccaggagtgagcagccacacag

SEQ ID NO: 170952 - DNA, 25 bp, Rattus norvegicus
ataccaggagtgtgcagccacacag

SEQ ID NO: 170953 - DNA, 25 bp, Rattus norvegicus
ataccaggatgaagcatggccgctc

SEQ ID NO: 170954 - DNA, 25 bp, Rattus norvegicus
ataccaggatgatgcatggccgctc

SEQ ID NO: 170955 - DNA, 25 bp, Rattus norvegicus
ataccaggcactctgctagttgaca

SEQ ID NO: 170956 - DNA, 25 bp, Rattus norvegicus
ataccaggcactgtgctagttgaca

SEQ ID NO: 170957 - DNA, 25 bp, Rattus norvegicus
ataccaggcgcccacgcagagcaga

SEQ ID NO: 170958 - DNA, 25 bp, Rattus norvegicus
ataccaggcgccgacgcagagcaga

SEQ ID NO: 170959 - DNA, 25 bp, Rattus norvegicus
ataccaggctggagtgtttgcttcc

SEQ ID NO: 170960 - DNA, 25 bp, Rattus norvegicus
ataccaggctggtgtgtttgcttcc

SEQ ID NO: 170961 - DNA, 25 bp, Rattus norvegicus
ataccagggcctactttcagaacta

SEQ ID NO: 170962 - DNA, 25 bp, Rattus norvegicus
ataccagggccttctttcagaacta

SEQ ID NO: 170963 - DNA, 25 bp, Rattus norvegicus
ataccagggcttctgtgtcaccaat

SEQ ID NO: 170964 - DNA, 25 bp, Rattus norvegicus
ataccagggcttgtgtgtcaccaat

SEQ ID NO: 170965 - DNA, 25 bp, Rattus norvegicus
ataccaggtcgtcacagtttgttgt

SEQ ID NO: 170966 - DNA, 25 bp, Rattus norvegicus
ataccaggtcgtgacagtttgttgt

SEQ ID NO: 170967 - DNA, 25 bp, Rattus norvegicus
ataccaggtgtcagtctgtaagcac

SEQ ID NO: 170968 - DNA, 25 bp, Rattus norvegicus
ataccaggtgtctgtctgtaagcac

SEQ ID NO: 170969 - DNA, 25 bp, Rattus norvegicus
ataccagtacccatatgcaggagtt

SEQ ID NO: 170970 - DNA, 25 bp, Rattus norvegicus
ataccagtacccttatgcaggagtt

SEQ ID NO: 170971 - DNA, 25 bp, Rattus norvegicus
ataccagtcctacggtggactccca

SEQ ID NO: 170972 - DNA, 25 bp, Rattus norvegicus
ataccagtcctagggtggactccca

SEQ ID NO: 170973 - DNA, 25 bp, Rattus norvegicus
ataccagtcctgaggtgaacaaaca

SEQ ID NO: 170974 - DNA, 25 bp, Rattus norvegicus
ataccagtcctgtggtgaacaaaca

SEQ ID NO: 170975 - DNA, 25 bp, Rattus norvegicus
ataccagtgaggatgcccgtctgaa

SEQ ID NO: 170976 - DNA, 25 bp, Rattus norvegicus
ataccagtgaggttgcccgtctgaa

SEQ ID NO: 170977 - DNA, 25 bp, Rattus norvegicus
ataccagtgccgagagttcatttcc

SEQ ID NO: 170978 - DNA, 25 bp, Rattus norvegicus
ataccagtgccgtgagttcatttcc

SEQ ID NO: 170979 - DNA, 25 bp, Rattus norvegicus
ataccagtgcggattgctcttccag

SEQ ID NO: 170980 - DNA, 25 bp, Rattus norvegicus
ataccagtgcggtttgctcttccag

SEQ ID NO: 170981 - DNA, 25 bp, Rattus norvegicus
ataccagttcggctcaccagagtgg

SEQ ID NO: 170982 - DNA, 25 bp, Rattus norvegicus
ataccagttcgggtcaccagagtgg

SEQ ID NO: 170983 - DNA, 25 bp, Rattus norvegicus
ataccagttttcatctagcagttga

SEQ ID NO: 170984 - DNA, 25 bp, Rattus norvegicus
ataccagttttcttctagcagttga

SEQ ID NO: 170985 - DNA, 25 bp, Rattus norvegicus
ataccataggacaccctgtgatctg

SEQ ID NO: 170986 - DNA, 25 bp, Rattus norvegicus
ataccataggactccctgtgatctg

SEQ ID NO: 170987 - DNA, 25 bp, Rattus norvegicus
ataccatatgttatcagctgagctt

SEQ ID NO: 170988 - DNA, 25 bp, Rattus norvegicus
ataccatatgttttcagctgagctt

SEQ ID NO: 170989 - DNA, 25 bp, Rattus norvegicus
ataccatcacggaacttttttatgt

SEQ ID NO: 170990 - DNA, 25 bp, Rattus norvegicus
ataccatcacggtacttttttatgt

SEQ ID NO: 170991 - DNA, 25 bp, Rattus norvegicus
ataccatcccgccacacagggagag

SEQ ID NO: 170992 - DNA, 25 bp, Rattus norvegicus
ataccatcccgcgacacagggagag

SEQ ID NO: 170993 - DNA, 25 bp, Rattus norvegicus
ataccatccttaaaacagttacgtt

SEQ ID NO: 170994 - DNA, 25 bp, Rattus norvegicus
ataccatccttataacagttacgtt

SEQ ID NO: 170995 - DNA, 25 bp, Rattus norvegicus
ataccatcgcgcagtacaagttcgt

SEQ ID NO: 170996 - DNA, 25 bp, Rattus norvegicus
ataccatcgcgctgtacaagttcgt

SEQ ID NO: 170997 - DNA, 25 bp, Rattus norvegicus
ataccatctatcagcgcattatcta

SEQ ID NO: 170998 - DNA, 25 bp, Rattus norvegicus
ataccatctatctgcgcattatcta

SEQ ID NO: 170999 - DNA, 25 bp, Rattus norvegicus
ataccatgaaaactcccacctactg

SEQ ID NO: 171000 - DNA, 25 bp, Rattus norvegicus
ataccatgaaaagtcccacctactg

SEQ ID NO: 171001 - DNA, 25 bp, Rattus norvegicus
ataccatgccaaccctgactctgat

SEQ ID NO: 171002 - DNA, 25 bp, Rattus norvegicus
ataccatgccaagcctgactctgat

SEQ ID NO: 171003 - DNA, 25 bp, Rattus norvegicus
ataccatgcctaatgcagtcagtgc

SEQ ID NO: 171004 - DNA, 25 bp, Rattus norvegicus
ataccatgcctattgcagtcagtgc

SEQ ID NO: 171005 - DNA, 25 bp, Rattus norvegicus
ataccatgcggtccggattcggaaa

SEQ ID NO: 171006 - DNA, 25 bp, Rattus norvegicus
ataccatgcggtgcggattcggaaa

SEQ ID NO: 171007 - DNA, 25 bp, Rattus norvegicus
ataccatgggctcctgcttgtcaat

SEQ ID NO: 171008 - DNA, 25 bp, Rattus norvegicus
ataccatgggctgctgcttgtcaat

SEQ ID NO: 171009 - DNA, 25 bp, Rattus norvegicus
ataccatggtctatgaaacactcag

SEQ ID NO: 171010 - DNA, 25 bp, Rattus norvegicus
ataccatggtctttgaaacactcag

SEQ ID NO: 171011 - DNA, 25 bp, Rattus norvegicus
ataccatgtaggactcagggatcca

SEQ ID NO: 171012 - DNA, 25 bp, Rattus norvegicus
ataccatgtaggtctcagggatcca

SEQ ID NO: 171013 - DNA, 25 bp, Rattus norvegicus
ataccatgtattatctctgtcctag

SEQ ID NO: 171014 - DNA, 25 bp, Rattus norvegicus
ataccatgtattttctctgtcctag

SEQ ID NO: 171015 - DNA, 25 bp, Rattus norvegicus
ataccattaactactactactgaca

SEQ ID NO: 171016 - DNA, 25 bp, Rattus norvegicus
ataccattaacttctactactgaca

SEQ ID NO: 171017 - DNA, 25 bp, Rattus norvegicus
ataccattagctatccatttcctaa

SEQ ID NO: 171018 - DNA, 25 bp, Rattus norvegicus
ataccattagctttccatttcctaa

SEQ ID NO: 171019 - DNA, 25 bp, Rattus norvegicus
ataccattcaaacatgacccaagag

SEQ ID NO: 171020 - DNA, 25 bp, Rattus norvegicus
ataccattcaaagatgacccaagag

SEQ ID NO: 171021 - DNA, 25 bp, Rattus norvegicus
ataccattgtcccataccctgcatt

SEQ ID NO: 171022 - DNA, 25 bp, Rattus norvegicus
ataccattgtccgataccctgcatt

SEQ ID NO: 171023 - DNA, 25 bp, Rattus norvegicus
ataccattgttgaaagcggaccgtt

SEQ ID NO: 171024 - DNA, 25 bp, Rattus norvegicus
ataccattgttgtaagcggaccgtt

SEQ ID NO: 171025 - DNA, 25 bp, Rattus norvegicus
ataccatttccaaaactaagagagg

SEQ ID NO: 171026 - DNA, 25 bp, Rattus norvegicus
ataccatttccataactaagagagg

SEQ ID NO: 171027 - DNA, 25 bp, Rattus norvegicus
ataccatttgaaatactctgggact

SEQ ID NO: 171028 - DNA, 25 bp, Rattus norvegicus
ataccatttgaattactctgggact

SEQ ID NO: 171029 - DNA, 25 bp, Rattus norvegicus
ataccatttttaacggacactgtca

SEQ ID NO: 171030 - DNA, 25 bp, Rattus norvegicus
ataccatttttatcggacactgtca

SEQ ID NO: 171031 - DNA, 25 bp, Rattus norvegicus
atacccaaaagaagtcccaccatgg

SEQ ID NO: 171032 - DNA, 25 bp, Rattus norvegicus
atacccaaaagatgtcccaccatgg

SEQ ID NO: 171033 - DNA, 25 bp, Rattus norvegicus
atacccaaagatatccaatgctcag

SEQ ID NO: 171034 - DNA, 25 bp, Rattus norvegicus
atacccaaagatttccaatgctcag

SEQ ID NO: 171035 - DNA, 25 bp, Rattus norvegicus
atacccaaattccacccagagagag

SEQ ID NO: 171036 - DNA, 25 bp, Rattus norvegicus
atacccaaattcgacccagagagag

SEQ ID NO: 171037 - DNA, 25 bp, Rattus norvegicus
atacccaactccaactctgaagaag

SEQ ID NO: 171038 - DNA, 25 bp, Rattus norvegicus
atacccaactcctactctgaagaag

SEQ ID NO: 171039 - DNA, 25 bp, Rattus norvegicus
atacccaatgggattccagcttgaa

SEQ ID NO: 171040 - DNA, 25 bp, Rattus norvegicus
atacccaatgggtttccagcttgaa

SEQ ID NO: 171041 - DNA, 25 bp, Rattus norvegicus
atacccacactcagaatgctacagt

SEQ ID NO: 171042 - DNA, 25 bp, Rattus norvegicus
atacccacactctgaatgctacagt

SEQ ID NO: 171043 - DNA, 25 bp, Rattus norvegicus
atacccacatggagtactcacgcac

SEQ ID NO: 171044 - DNA, 25 bp, Rattus norvegicus
atacccacatggtgtactcacgcac

SEQ ID NO: 171045 - DNA, 25 bp, Rattus norvegicus
atacccacccaaactgcaaagtcat

SEQ ID NO: 171046 - DNA, 25 bp, Rattus norvegicus
atacccacccaatctgcaaagtcat

SEQ ID NO: 171047 - DNA, 25 bp, Rattus norvegicus
atacccacctgtctaattggcttaa

SEQ ID NO: 171048 - DNA, 25 bp, Rattus norvegicus
atacccacctgtgtaattggcttaa

SEQ ID NO: 171049 - DNA, 25 bp, Rattus norvegicus
atacccagaggcctttatgtgctac

SEQ ID NO: 171050 - DNA, 25 bp, Rattus norvegicus
atacccagaggcgtttatgtgctac

SEQ ID NO: 171051 - DNA, 25 bp, Rattus norvegicus
atacccaggcaccagaatgttctag

SEQ ID NO: 171052 - DNA, 25 bp, Rattus norvegicus
atacccaggcacgagaatgttctag

SEQ ID NO: 171053 - DNA, 25 bp, Rattus norvegicus
atacccaggtccaaactgccaggct

SEQ ID NO: 171054 - DNA, 25 bp, Rattus norvegicus
atacccaggtcctaactgccaggct

SEQ ID NO: 171055 - DNA, 25 bp, Rattus norvegicus
atacccataattacttgtcaggcgt

SEQ ID NO: 171056 - DNA, 25 bp, Rattus norvegicus
atacccataatttcttgtcaggcgt

SEQ ID NO: 171057 - DNA, 25 bp, Rattus norvegicus
atacccatcagtactctgtgacaga

SEQ ID NO: 171058 - DNA, 25 bp, Rattus norvegicus
atacccatcagttctctgtgacaga

SEQ ID NO: 171059 - DNA, 25 bp, Rattus norvegicus
atacccatctcaattctggagttga

SEQ ID NO: 171060 - DNA, 25 bp, Rattus norvegicus
atacccatctcatttctggagttga

SEQ ID NO: 171061 - DNA, 25 bp, Rattus norvegicus
atacccatcttgctacatctctgga

SEQ ID NO: 171062 - DNA, 25 bp, Rattus norvegicus
atacccatcttggtacatctctgga

SEQ ID NO: 171063 - DNA, 25 bp, Rattus norvegicus
atacccatgggcaggttggcaccag

SEQ ID NO: 171064 - DNA, 25 bp, Rattus norvegicus
atacccatgggctggttggcaccag

SEQ ID NO: 171065 - DNA, 25 bp, Rattus norvegicus
atacccatgttcaggtccatctttg

SEQ ID NO: 171066 - DNA, 25 bp, Rattus norvegicus
atacccatgttctggtccatctttg

SEQ ID NO: 171067 - DNA, 25 bp, Rattus norvegicus
atacccattacaaaccacttcaata

SEQ ID NO: 171068 - DNA, 25 bp, Rattus norvegicus
atacccattacataccacttcaata

SEQ ID NO: 171069 - DNA, 25 bp, Rattus norvegicus
atacccattctgctgtgccagcgtg

SEQ ID NO: 171070 - DNA, 25 bp, Rattus norvegicus
atacccattctggtgtgccagcgtg

SEQ ID NO: 171071 - DNA, 25 bp, Rattus norvegicus
atacccattgacctagtgtgctttc

SEQ ID NO: 171072 - DNA, 25 bp, Rattus norvegicus
atacccattgacgtagtgtgctttc

SEQ ID NO: 171073 - DNA, 25 bp, Rattus norvegicus
atacccattgtacccttaggtgcgc

SEQ ID NO: 171074 - DNA, 25 bp, Rattus norvegicus
atacccattgtagccttaggtgcgc

SEQ ID NO: 171075 - DNA, 25 bp, Rattus norvegicus
atacccattttgaagtagcctatac

SEQ ID NO: 171076 - DNA, 25 bp, Rattus norvegicus
atacccattttgtagtagcctatac

SEQ ID NO: 171077 - DNA, 25 bp, Rattus norvegicus
ataccccaaattccttatcaatctg

SEQ ID NO: 171078 - DNA, 25 bp, Rattus norvegicus
ataccccaaattgcttatcaatctg

SEQ ID NO: 171079 - DNA, 25 bp, Rattus norvegicus
ataccccaagatctcgctaaaggag

SEQ ID NO: 171080 - DNA, 25 bp, Rattus norvegicus
ataccccaagatgtcgctaaaggag

SEQ ID NO: 171081 - DNA, 25 bp, Rattus norvegicus
ataccccaatgcctcgtgggaatat

SEQ ID NO: 171082 - DNA, 25 bp, Rattus norvegicus
ataccccaatgcgtcgtgggaatat

SEQ ID NO: 171083 - DNA, 25 bp, Rattus norvegicus
ataccccagagcacagcacagtgga

SEQ ID NO: 171084 - DNA, 25 bp, Rattus norvegicus
ataccccagagctcagcacagtgga

SEQ ID NO: 171085 - DNA, 25 bp, Rattus norvegicus
ataccccagccaaaaatgcacaaaa

SEQ ID NO: 171086 - DNA, 25 bp, Rattus norvegicus
ataccccagccaatttgtaccatta

SEQ ID NO: 171087 - DNA, 25 bp, Rattus norvegicus
ataccccagccataaatgcacaaaa

SEQ ID NO: 171088 - DNA, 25 bp, Rattus norvegicus
ataccccagccattttgtaccatta

SEQ ID NO: 171089 - DNA, 25 bp, Rattus norvegicus
ataccccagctcatgctgaaggagt

SEQ ID NO: 171090 - DNA, 25 bp, Rattus norvegicus
ataccccagctcttgctgaaggagt

SEQ ID NO: 171091 - DNA, 25 bp, Rattus norvegicus
ataccccaggccaggtttgagtgtt

SEQ ID NO: 171092 - DNA, 25 bp, Rattus norvegicus
ataccccaggcctggtttgagtgtt

SEQ ID NO: 171093 - DNA, 25 bp, Rattus norvegicus
ataccccgtggtcaagtctgttgtg

SEQ ID NO: 171094 - DNA, 25 bp, Rattus norvegicus
ataccccgtggtgaagtctgttgtg

SEQ ID NO: 171095 - DNA, 25 bp, Rattus norvegicus
atacccctagttactcactgatgga

SEQ ID NO: 171096 - DNA, 25 bp, Rattus norvegicus
atacccctagtttctcactgatgga

SEQ ID NO: 171097 - DNA, 25 bp, Rattus norvegicus
atacccctgaaaaccatgacttcgg

SEQ ID NO: 171098 - DNA, 25 bp, Rattus norvegicus
atacccctgaaatccatgacttcgg

SEQ ID NO: 171099 - DNA, 25 bp, Rattus norvegicus
atacccctgggtatggcctgtagct

SEQ ID NO: 171100 - DNA, 25 bp, Rattus norvegicus
atacccctgggtctgatttatcaca

SEQ ID NO: 171101 - DNA, 25 bp, Rattus norvegicus
atacccctgggtgtgatttatcaca

SEQ ID NO: 171102 - DNA, 25 bp, Rattus norvegicus
atacccctgggtttggcctgtagct

SEQ ID NO: 171103 - DNA, 25 bp, Rattus norvegicus
ataccccttaataagcatgcacaaa

SEQ ID NO: 171104 - DNA, 25 bp, Rattus norvegicus
ataccccttaattagcatgcacaaa

SEQ ID NO: 171105 - DNA, 25 bp, Rattus norvegicus
ataccccttcatctttacttctgaa

SEQ ID NO: 171106 - DNA, 25 bp, Rattus norvegicus
ataccccttcatgtttacttctgaa

SEQ ID NO: 171107 - DNA, 25 bp, Rattus norvegicus
ataccccttgagacaacgtaagcca

SEQ ID NO: 171108 - DNA, 25 bp, Rattus norvegicus
ataccccttgagtcaacgtaagcca

SEQ ID NO: 171109 - DNA, 25 bp, Rattus norvegicus
ataccccttgtgagcacttgacagg

SEQ ID NO: 171110 - DNA, 25 bp, Rattus norvegicus
ataccccttgtgtgcacttgacagg

SEQ ID NO: 171111 - DNA, 25 bp, Rattus norvegicus
atacccgaacacacaaatgcacaca

SEQ ID NO: 171112 - DNA, 25 bp, Rattus norvegicus
atacccgaacactcaaatgcacaca

SEQ ID NO: 171113 - DNA, 25 bp, Rattus norvegicus
atacccgactaccttctttgatcaa

SEQ ID NO: 171114 - DNA, 25 bp, Rattus norvegicus
atacccgactacgttctttgatcaa

SEQ ID NO: 171115 - DNA, 25 bp, Rattus norvegicus
atacccgagtatcgcatgttccagg

SEQ ID NO: 171116 - DNA, 25 bp, Rattus norvegicus
atacccgagtatggcatgttccagg

SEQ ID NO: 171117 - DNA, 25 bp, Rattus norvegicus
atacccgatgtcaacgcgagttaga

SEQ ID NO: 171118 - DNA, 25 bp, Rattus norvegicus
atacccgatgtctacgcgagttaga

SEQ ID NO: 171119 - DNA, 25 bp, Rattus norvegicus
atacccgcacggcatttgagacaag

SEQ ID NO: 171120 - DNA, 25 bp, Rattus norvegicus
atacccgcacgggatttgagacaag

SEQ ID NO: 171121 - DNA, 25 bp, Rattus norvegicus
atacccgcagtaccagcatgaagaa

SEQ ID NO: 171122 - DNA, 25 bp, Rattus norvegicus
atacccgcagtagcagcatgaagaa

SEQ ID NO: 171123 - DNA, 25 bp, Rattus norvegicus
atacccgcctgaatgtggaacaagt

SEQ ID NO: 171124 - DNA, 25 bp, Rattus norvegicus
atacccgcctgattgtggaacaagt

SEQ ID NO: 171125 - DNA, 25 bp, Rattus norvegicus
atacccgggctgagtctgggaaaga

SEQ ID NO: 171126 - DNA, 25 bp, Rattus norvegicus
atacccgggctgtgtctgggaaaga

SEQ ID NO: 171127 - DNA, 25 bp, Rattus norvegicus
atacccgtggtacgcacactatcct

SEQ ID NO: 171128 - DNA, 25 bp, Rattus norvegicus
atacccgtggtaggcacactatcct

SEQ ID NO: 171129 - DNA, 25 bp, Rattus norvegicus
atacccgtgtgaagtgaccgccaag

SEQ ID NO: 171130 - DNA, 25 bp, Rattus norvegicus
atacccgtgtgatgtgaccgccaag

SEQ ID NO: 171131 - DNA, 25 bp, Rattus norvegicus
ataccctacatcatcatggcactgg

SEQ ID NO: 171132 - DNA, 25 bp, Rattus norvegicus
ataccctacatcttcatggcactgg

SEQ ID NO: 171133 - DNA, 25 bp, Rattus norvegicus
ataccctactgtacttgcctgcaga

SEQ ID NO: 171134 - DNA, 25 bp, Rattus norvegicus
ataccctactgttcttgcctgcaga

SEQ ID NO: 171135 - DNA, 25 bp, Rattus norvegicus
ataccctattatacacacctttact

SEQ ID NO: 171136 - DNA, 25 bp, Rattus norvegicus
ataccctattattcacacctttact

SEQ ID NO: 171137 - DNA, 25 bp, Rattus norvegicus
ataccctcagctactgtacttattt

SEQ ID NO: 171138 - DNA, 25 bp, Rattus norvegicus
ataccctcagcttctgtacttattt

SEQ ID NO: 171139 - DNA, 25 bp, Rattus norvegicus
ataccctcaggcaaaggtggtcggc

SEQ ID NO: 171140 - DNA, 25 bp, Rattus norvegicus
ataccctcaggctaaggtggtcggc

SEQ ID NO: 171141 - DNA, 25 bp, Rattus norvegicus
ataccctcagttcccatttcaggtc

SEQ ID NO: 171142 - DNA, 25 bp, Rattus norvegicus
ataccctcagttgccatttcaggtc

SEQ ID NO: 171143 - DNA, 25 bp, Rattus norvegicus
ataccctcctgacagtctggaagtg

SEQ ID NO: 171144 - DNA, 25 bp, Rattus norvegicus
ataccctcctgagagtctggaagtg

SEQ ID NO: 171145 - DNA, 25 bp, Rattus norvegicus
ataccctcgaaactctgctgagagc

SEQ ID NO: 171146 - DNA, 25 bp, Rattus norvegicus
ataccctcgaaagtctgctgagagc

SEQ ID NO: 171147 - DNA, 25 bp, Rattus norvegicus
ataccctctcccaaatgtccatgga

SEQ ID NO: 171148 - DNA, 25 bp, Rattus norvegicus
ataccctctccctaatgtccatgga

SEQ ID NO: 171149 - DNA, 25 bp, Rattus norvegicus
ataccctctggcaaaataataccag

SEQ ID NO: 171150 - DNA, 25 bp, Rattus norvegicus
ataccctctggctaaataataccag

SEQ ID NO: 171151 - DNA, 25 bp, Rattus norvegicus
ataccctcttgaatgatgtcccagc

SEQ ID NO: 171152 - DNA, 25 bp, Rattus norvegicus
ataccctcttgattgatgtcccagc

SEQ ID NO: 171153 - DNA, 25 bp, Rattus norvegicus
ataccctgcagtaacttagtctgtg

SEQ ID NO: 171154 - DNA, 25 bp, Rattus norvegicus
ataccctgcagttacttagtctgtg

SEQ ID NO: 171155 - DNA, 25 bp, Rattus norvegicus
ataccctggacaaccttggagcagt

SEQ ID NO: 171156 - DNA, 25 bp, Rattus norvegicus
ataccctggacatccttggagcagt

SEQ ID NO: 171157 - DNA, 25 bp, Rattus norvegicus
ataccctggcagatccacggacggg

SEQ ID NO: 171158 - DNA, 25 bp, Rattus norvegicus
ataccctggcagttccacggacggg

SEQ ID NO: 171159 - DNA, 25 bp, Rattus norvegicus
ataccctgggatatgggcagctgag

SEQ ID NO: 171160 - DNA, 25 bp, Rattus norvegicus
ataccctgggatttgggcagctgag

SEQ ID NO: 171161 - DNA, 25 bp, Rattus norvegicus
ataccctggttgcatgcattgctga

SEQ ID NO: 171162 - DNA, 25 bp, Rattus norvegicus
ataccctggttggatgcattgctga

SEQ ID NO: 171163 - DNA, 25 bp, Rattus norvegicus
atacccttaactccaaaccaagaag

SEQ ID NO: 171164 - DNA, 25 bp, Rattus norvegicus
atacccttaactgcaaaccaagaag

SEQ ID NO: 171165 - DNA, 25 bp, Rattus norvegicus
atacccttcaaaatttgacctgagg

SEQ ID NO: 171166 - DNA, 25 bp, Rattus norvegicus
atacccttcaaattttgacctgagg

SEQ ID NO: 171167 - DNA, 25 bp, Rattus norvegicus
atacccttcaagctcatgttcccaa

SEQ ID NO: 171168 - DNA, 25 bp, Rattus norvegicus
atacccttcaagctggcacaggtgg

SEQ ID NO: 171169 - DNA, 25 bp, Rattus norvegicus
atacccttcaaggtcatgttcccaa

SEQ ID NO: 171170 - DNA, 25 bp, Rattus norvegicus
atacccttcaaggtggcacaggtgg

SEQ ID NO: 171171 - DNA, 25 bp, Rattus norvegicus
atacccttccccacataagcaggtg

SEQ ID NO: 171172 - DNA, 25 bp, Rattus norvegicus
atacccttcccctcataagcaggtg

SEQ ID NO: 171173 - DNA, 25 bp, Rattus norvegicus
atacccttcggtatcggaggctctg

SEQ ID NO: 171174 - DNA, 25 bp, Rattus norvegicus
atacccttcggtttcggaggctctg

SEQ ID NO: 171175 - DNA, 25 bp, Rattus norvegicus
atacccttgggcaatcctacaatca

SEQ ID NO: 171176 - DNA, 25 bp, Rattus norvegicus
atacccttgggctatcctacaatca

SEQ ID NO: 171177 - DNA, 25 bp, Rattus norvegicus
ataccctttgagcagtgtcgaaatt

SEQ ID NO: 171178 - DNA, 25 bp, Rattus norvegicus
ataccctttgaggagtgtcgaaatt

SEQ ID NO: 171179 - DNA, 25 bp, Rattus norvegicus
ataccctttgctaaggacccaggag

SEQ ID NO: 171180 - DNA, 25 bp, Rattus norvegicus
ataccctttgcttaggacccaggag

SEQ ID NO: 171181 - DNA, 25 bp, Rattus norvegicus
ataccgaactatctctccggcctga

SEQ ID NO: 171182 - DNA, 25 bp, Rattus norvegicus
ataccgaactatgtctccggcctga

SEQ ID NO: 171183 - DNA, 25 bp, Rattus norvegicus
ataccgaatgcactatcctccggag

SEQ ID NO: 171184 - DNA, 25 bp, Rattus norvegicus
ataccgaatgcagtatcctccggag

SEQ ID NO: 171185 - DNA, 25 bp, Rattus norvegicus
ataccgaggctgaagctgtatcctt

SEQ ID NO: 171186 - DNA, 25 bp, Rattus norvegicus
ataccgaggctgtagctgtatcctt

SEQ ID NO: 171187 - DNA, 25 bp, Rattus norvegicus
ataccgcaagagcatccaaccgtga

SEQ ID NO: 171188 - DNA, 25 bp, Rattus norvegicus
ataccgcaagaggatccaaccgtga

SEQ ID NO: 171189 - DNA, 25 bp, Rattus norvegicus
ataccgcacctaagtttgtgtgaga

SEQ ID NO: 171190 - DNA, 25 bp, Rattus norvegicus
ataccgcacctatgtttgtgtgaga

SEQ ID NO: 171191 - DNA, 25 bp, Rattus norvegicus
ataccgcagtaccatagttattttg

SEQ ID NO: 171192 - DNA, 25 bp, Rattus norvegicus
ataccgcagtacgatagttattttg

SEQ ID NO: 171193 - DNA, 25 bp, Rattus norvegicus
ataccgcatgttaattttggagtct

SEQ ID NO: 171194 - DNA, 25 bp, Rattus norvegicus
ataccgcatgtttattttggagtct

SEQ ID NO: 171195 - DNA, 25 bp, Rattus norvegicus
ataccgcattatcgtgccctgagct

SEQ ID NO: 171196 - DNA, 25 bp, Rattus norvegicus
ataccgcattatggtgccctgagct

SEQ ID NO: 171197 - DNA, 25 bp, Rattus norvegicus
ataccgccgctacgtggacaaggca

SEQ ID NO: 171198 - DNA, 25 bp, Rattus norvegicus
ataccgccgctaggtggacaaggca

SEQ ID NO: 171199 - DNA, 25 bp, Rattus norvegicus
ataccgctatctatgcagcattgca

SEQ ID NO: 171200 - DNA, 25 bp, Rattus norvegicus
ataccgctatctttgcagcattgca

SEQ ID NO: 171201 - DNA, 25 bp, Rattus norvegicus
ataccgctccctaagcaataatctg

SEQ ID NO: 171202 - DNA, 25 bp, Rattus norvegicus
ataccgctcccttagcaataatctg

SEQ ID NO: 171203 - DNA, 25 bp, Rattus norvegicus
ataccgctggtaccaattattttag

SEQ ID NO: 171204 - DNA, 25 bp, Rattus norvegicus
ataccgctggtagcaattattttag

SEQ ID NO: 171205 - DNA, 25 bp, Rattus norvegicus
ataccgctgtgcatcctgtgaggct

SEQ ID NO: 171206 - DNA, 25 bp, Rattus norvegicus
ataccgctgtgcttcctgtgaggct

SEQ ID NO: 171207 - DNA, 25 bp, Rattus norvegicus
ataccgcttcggatgaacctgttgc

SEQ ID NO: 171208 - DNA, 25 bp, Rattus norvegicus
ataccgcttcggttgaacctgttgc

SEQ ID NO: 171209 - DNA, 25 bp, Rattus norvegicus
ataccggccgctagtccttgaagtc

SEQ ID NO: 171210 - DNA, 25 bp, Rattus norvegicus
ataccggccgcttgtccttgaagtc

SEQ ID NO: 171211 - DNA, 25 bp, Rattus norvegicus
ataccgggtctcatggtctgtgggt

SEQ ID NO: 171212 - DNA, 25 bp, Rattus norvegicus
ataccgggtctcttggtctgtgggt

SEQ ID NO: 171213 - DNA, 25 bp, Rattus norvegicus
ataccggtaagtccgtgagatgcat

SEQ ID NO: 171214 - DNA, 25 bp, Rattus norvegicus
ataccggtaagtgcgtgagatgcat

SEQ ID NO: 171215 - DNA, 25 bp, Rattus norvegicus
ataccggtatccagctcgcgagagc

SEQ ID NO: 171216 - DNA, 25 bp, Rattus norvegicus
ataccggtatcctgctcgcgagagc

SEQ ID NO: 171217 - DNA, 25 bp, Rattus norvegicus
ataccggtctgcacagtgactctga

SEQ ID NO: 171218 - DNA, 25 bp, Rattus norvegicus
ataccggtctgctcagtgactctga

SEQ ID NO: 171219 - DNA, 25 bp, Rattus norvegicus
ataccggtgactcggattttcaaca

SEQ ID NO: 171220 - DNA, 25 bp, Rattus norvegicus
ataccggtgactgggattttcaaca

SEQ ID NO: 171221 - DNA, 25 bp, Rattus norvegicus
ataccggttccaataccacggaatg

SEQ ID NO: 171222 - DNA, 25 bp, Rattus norvegicus
ataccggttccattaccacggaatg

SEQ ID NO: 171223 - DNA, 25 bp, Rattus norvegicus
ataccggtttgtagtgtgtgctcac

SEQ ID NO: 171224 - DNA, 25 bp, Rattus norvegicus
ataccggtttgttgtgtgtgctcac

SEQ ID NO: 171225 - DNA, 25 bp, Rattus norvegicus
ataccgtcatggaggatcctgcctt

SEQ ID NO: 171226 - DNA, 25 bp, Rattus norvegicus
ataccgtcatggtggatcctgcctt

SEQ ID NO: 171227 - DNA, 25 bp, Rattus norvegicus
ataccgtctactcttccaccaaggg

SEQ ID NO: 171228 - DNA, 25 bp, Rattus norvegicus
ataccgtctactgttccaccaaggg

SEQ ID NO: 171229 - DNA, 25 bp, Rattus norvegicus
ataccgtctttgatttgatgaccaa

SEQ ID NO: 171230 - DNA, 25 bp, Rattus norvegicus
ataccgtctttgttttgatgaccaa

SEQ ID NO: 171231 - DNA, 25 bp, Rattus norvegicus
ataccgtggattcagaaaacaatga

SEQ ID NO: 171232 - DNA, 25 bp, Rattus norvegicus
ataccgtggattgagaaaacaatga

SEQ ID NO: 171233 - DNA, 25 bp, Rattus norvegicus
ataccgtggtgtatttactgtgcat

SEQ ID NO: 171234 - DNA, 25 bp, Rattus norvegicus
ataccgtggtgtttttactgtgcat

SEQ ID NO: 171235 - DNA, 25 bp, Rattus norvegicus
ataccgtgtcacatgctgcagggct

SEQ ID NO: 171236 - DNA, 25 bp, Rattus norvegicus
ataccgtgtcacttgctgcagggct

SEQ ID NO: 171237 - DNA, 25 bp, Rattus norvegicus
ataccgttgcttctaaccacgaaga

SEQ ID NO: 171238 - DNA, 25 bp, Rattus norvegicus
ataccgttgcttgtaaccacgaaga

SEQ ID NO: 171239 - DNA, 25 bp, Rattus norvegicus
atacctaaggacaacgcatcagcga

SEQ ID NO: 171240 - DNA, 25 bp, Rattus norvegicus
atacctaaggactacgcatcagcga

SEQ ID NO: 171241 - DNA, 25 bp, Rattus norvegicus
atacctacacttctcctactgaaga

SEQ ID NO: 171242 - DNA, 25 bp, Rattus norvegicus
atacctacacttgtcctactgaaga

SEQ ID NO: 171243 - DNA, 25 bp, Rattus norvegicus
atacctactcacatcaggcaggtga

SEQ ID NO: 171244 - DNA, 25 bp, Rattus norvegicus
atacctactcacttcaggcaggtga

SEQ ID NO: 171245 - DNA, 25 bp, Rattus norvegicus
atacctactgaaaaccctctttgtt

SEQ ID NO: 171246 - DNA, 25 bp, Rattus norvegicus
atacctactgaataccctctttgtt

SEQ ID NO: 171247 - DNA, 25 bp, Rattus norvegicus
atacctagaacgcacagcttccttg

SEQ ID NO: 171248 - DNA, 25 bp, Rattus norvegicus
atacctagaacggacagcttccttg

SEQ ID NO: 171249 - DNA, 25 bp, Rattus norvegicus
atacctagaattaccttgcatcgcc

SEQ ID NO: 171250 - DNA, 25 bp, Rattus norvegicus
atacctagaatttccttgcatcgcc

SEQ ID NO: 171251 - DNA, 25 bp, Rattus norvegicus
atacctagccttaatgcctcatggt

SEQ ID NO: 171252 - DNA, 25 bp, Rattus norvegicus
atacctagcctttatgcctcatggt

SEQ ID NO: 171253 - DNA, 25 bp, Rattus norvegicus
atacctagctcgaactgggaagtgt

SEQ ID NO: 171254 - DNA, 25 bp, Rattus norvegicus
atacctagctcgtactgggaagtgt

SEQ ID NO: 171255 - DNA, 25 bp, Rattus norvegicus
atacctagggccacagtatcttacc

SEQ ID NO: 171256 - DNA, 25 bp, Rattus norvegicus
atacctagggcctcagtatcttacc

SEQ ID NO: 171257 - DNA, 25 bp, Rattus norvegicus
atacctagtaggagtctaagatccc

SEQ ID NO: 171258 - DNA, 25 bp, Rattus norvegicus
atacctagtaggtgtctaagatccc

SEQ ID NO: 171259 - DNA, 25 bp, Rattus norvegicus
atacctagtcctaaatatgcttgct

SEQ ID NO: 171260 - DNA, 25 bp, Rattus norvegicus
atacctagtccttaatatgcttgct

SEQ ID NO: 171261 - DNA, 25 bp, Rattus norvegicus
atacctagtgaaaagctggctgtgg

SEQ ID NO: 171262 - DNA, 25 bp, Rattus norvegicus
atacctagtgaatagctggctgtgg

SEQ ID NO: 171263 - DNA, 25 bp, Rattus norvegicus
atacctagtgggaccctgtgtcaca

SEQ ID NO: 171264 - DNA, 25 bp, Rattus norvegicus
atacctagtgggtccctgtgtcaca

SEQ ID NO: 171265 - DNA, 25 bp, Rattus norvegicus
atacctatctgcaacatgtaccagg

SEQ ID NO: 171266 - DNA, 25 bp, Rattus norvegicus
atacctatctgctacatgtaccagg

SEQ ID NO: 171267 - DNA, 25 bp, Rattus norvegicus
atacctatgagtctgcattgtgtga

SEQ ID NO: 171268 - DNA, 25 bp, Rattus norvegicus
atacctatgagtgtgcattgtgtga

SEQ ID NO: 171269 - DNA, 25 bp, Rattus norvegicus
atacctatgggtacgcagatacaca

SEQ ID NO: 171270 - DNA, 25 bp, Rattus norvegicus
atacctatgggttcgcagatacaca

SEQ ID NO: 171271 - DNA, 25 bp, Rattus norvegicus
atacctatgtgaatatggctgagtc

SEQ ID NO: 171272 - DNA, 25 bp, Rattus norvegicus
atacctatgtgattatggctgagtc

SEQ ID NO: 171273 - DNA, 25 bp, Rattus norvegicus
atacctatttaaatgtgtgttttgg

SEQ ID NO: 171274 - DNA, 25 bp, Rattus norvegicus
atacctatttaattgtgtgttttgg

SEQ ID NO: 171275 - DNA, 25 bp, Rattus norvegicus
atacctcacctcacaatcataaaac

SEQ ID NO: 171276 - DNA, 25 bp, Rattus norvegicus
atacctcacctctcaatcataaaac

SEQ ID NO: 171277 - DNA, 25 bp, Rattus norvegicus
atacctcacgctcggaaatggctgc

SEQ ID NO: 171278 - DNA, 25 bp, Rattus norvegicus
atacctcacgctgggaaatggctgc

SEQ ID NO: 171279 - DNA, 25 bp, Rattus norvegicus
atacctcactccagttagggatgaa

SEQ ID NO: 171280 - DNA, 25 bp, Rattus norvegicus
atacctcactcctgttagggatgaa

SEQ ID NO: 171281 - DNA, 25 bp, Rattus norvegicus
atacctcactgtatttctccacagg

SEQ ID NO: 171282 - DNA, 25 bp, Rattus norvegicus
atacctcactgtttttctccacagg

SEQ ID NO: 171283 - DNA, 25 bp, Rattus norvegicus
atacctcagcaccaagtggacagct

SEQ ID NO: 171284 - DNA, 25 bp, Rattus norvegicus
atacctcagcacgaagtggacagct

SEQ ID NO: 171285 - DNA, 25 bp, Rattus norvegicus
atacctcagcatacaggattgccca

SEQ ID NO: 171286 - DNA, 25 bp, Rattus norvegicus
atacctcagcattcaggattgccca

SEQ ID NO: 171287 - DNA, 25 bp, Rattus norvegicus
atacctcagtgcatttgtttctaaa

SEQ ID NO: 171288 - DNA, 25 bp, Rattus norvegicus
atacctcagtgcttttgtttctaaa

SEQ ID NO: 171289 - DNA, 25 bp, Rattus norvegicus
atacctcagtttaaccctgccaggg

SEQ ID NO: 171290 - DNA, 25 bp, Rattus norvegicus
atacctcagttttaccctgccaggg

SEQ ID NO: 171291 - DNA, 25 bp, Rattus norvegicus
atacctcatgtaaatctttacctcg

SEQ ID NO: 171292 - DNA, 25 bp, Rattus norvegicus
atacctcatgtatatctttacctcg

SEQ ID NO: 171293 - DNA, 25 bp, Rattus norvegicus
atacctcatttccactttgttttag

SEQ ID NO: 171294 - DNA, 25 bp, Rattus norvegicus
atacctcatttcgactttgttttag

SEQ ID NO: 171295 - DNA, 25 bp, Rattus norvegicus
atacctccaaagacagtttcacgat

SEQ ID NO: 171296 - DNA, 25 bp, Rattus norvegicus
atacctccaaagtcagtttcacgat

SEQ ID NO: 171297 - DNA, 25 bp, Rattus norvegicus
atacctccaagtatttacactgaag

SEQ ID NO: 171298 - DNA, 25 bp, Rattus norvegicus
atacctccaagtttttacactgaag

SEQ ID NO: 171299 - DNA, 25 bp, Rattus norvegicus
atacctccattaccttgttgaacag

SEQ ID NO: 171300 - DNA, 25 bp, Rattus norvegicus
atacctccattagcttgttgaacag

SEQ ID NO: 171301 - DNA, 25 bp, Rattus norvegicus
atacctcctcagaaagggttgaagg

SEQ ID NO: 171302 - DNA, 25 bp, Rattus norvegicus
atacctcctcagtaagggttgaagg

SEQ ID NO: 171303 - DNA, 25 bp, Rattus norvegicus
atacctcctggacgatcctgtctta

SEQ ID NO: 171304 - DNA, 25 bp, Rattus norvegicus
atacctcctggaggatcctgtctta

SEQ ID NO: 171305 - DNA, 25 bp, Rattus norvegicus
atacctcctgggaatgagagggccc

SEQ ID NO: 171306 - DNA, 25 bp, Rattus norvegicus
atacctcctgggtatgagagggccc

SEQ ID NO: 171307 - DNA, 25 bp, Rattus norvegicus
atacctcctgtgagagtccagactc

SEQ ID NO: 171308 - DNA, 25 bp, Rattus norvegicus
atacctcctgtgtgagtccagactc

SEQ ID NO: 171309 - DNA, 25 bp, Rattus norvegicus
atacctcgggtaccctagcaactgc

SEQ ID NO: 171310 - DNA, 25 bp, Rattus norvegicus
atacctcgggtagcctagcaactgc

SEQ ID NO: 171311 - DNA, 25 bp, Rattus norvegicus
atacctcgtgagcttcagatgcaca

SEQ ID NO: 171312 - DNA, 25 bp, Rattus norvegicus
atacctcgtgaggttcagatgcaca

SEQ ID NO: 171313 - DNA, 25 bp, Rattus norvegicus
atacctctaaccagttcgggaacag

SEQ ID NO: 171314 - DNA, 25 bp, Rattus norvegicus
atacctctaacctgttcgggaacag

SEQ ID NO: 171315 - DNA, 25 bp, Rattus norvegicus
atacctctaactccaggcctagggt

SEQ ID NO: 171316 - DNA, 25 bp, Rattus norvegicus
atacctctaactgcaggcctagggt

SEQ ID NO: 171317 - DNA, 25 bp, Rattus norvegicus
atacctctacatcatccggaacctg

SEQ ID NO: 171318 - DNA, 25 bp, Rattus norvegicus
atacctctacatgatccggaacctg

SEQ ID NO: 171319 - DNA, 25 bp, Rattus norvegicus
atacctctacctatgctattttggg

SEQ ID NO: 171320 - DNA, 25 bp, Rattus norvegicus
atacctctacctttgctattttggg

SEQ ID NO: 171321 - DNA, 25 bp, Rattus norvegicus
atacctctatccagaggcccagtga

SEQ ID NO: 171322 - DNA, 25 bp, Rattus norvegicus
atacctctatcctgaggcccagtga

SEQ ID NO: 171323 - DNA, 25 bp, Rattus norvegicus
atacctctcattccaggctgttgga

SEQ ID NO: 171324 - DNA, 25 bp, Rattus norvegicus
atacctctcattgcaggctgttgga

SEQ ID NO: 171325 - DNA, 25 bp, Rattus norvegicus
atacctctcgttctcatgttgtctt

SEQ ID NO: 171326 - DNA, 25 bp, Rattus norvegicus
atacctctcgttgtcatgttgtctt

SEQ ID NO: 171327 - DNA, 25 bp, Rattus norvegicus
atacctctgatgaaggaatccaaaa

SEQ ID NO: 171328 - DNA, 25 bp, Rattus norvegicus
atacctctgatgtaggaatccaaaa

SEQ ID NO: 171329 - DNA, 25 bp, Rattus norvegicus
atacctctgctgatggacagggctc

SEQ ID NO: 171330 - DNA, 25 bp, Rattus norvegicus
atacctctgctgttggacagggctc

SEQ ID NO: 171331 - DNA, 25 bp, Rattus norvegicus
atacctctgtgcagtgtattgccaa

SEQ ID NO: 171332 - DNA, 25 bp, Rattus norvegicus
atacctctgtgctgtgtattgccaa

SEQ ID NO: 171333 - DNA, 25 bp, Rattus norvegicus
atacctcttgtgaatccttcacttt

SEQ ID NO: 171334 - DNA, 25 bp, Rattus norvegicus
atacctcttgtgtatccttcacttt

SEQ ID NO: 171335 - DNA, 25 bp, Rattus norvegicus
atacctcttttccaagtccttcgag

SEQ ID NO: 171336 - DNA, 25 bp, Rattus norvegicus
atacctcttttcgaagtccttcgag

SEQ ID NO: 171337 - DNA, 25 bp, Rattus norvegicus
atacctgaaaggcactatcctcttc

SEQ ID NO: 171338 - DNA, 25 bp, Rattus norvegicus
atacctgaaagggactatcctcttc

SEQ ID NO: 171339 - DNA, 25 bp, Rattus norvegicus
atacctgaacacatctccctgattt

SEQ ID NO: 171340 - DNA, 25 bp, Rattus norvegicus
atacctgaacacttctccctgattt

SEQ ID NO: 171341 - DNA, 25 bp, Rattus norvegicus
atacctgaagttcgccatggtcaca

SEQ ID NO: 171342 - DNA, 25 bp, Rattus norvegicus
atacctgaagttggccatggtcaca

SEQ ID NO: 171343 - DNA, 25 bp, Rattus norvegicus
atacctgatatgatactcctgagaa

SEQ ID NO: 171344 - DNA, 25 bp, Rattus norvegicus
atacctgatatgttactcctgagaa

SEQ ID NO: 171345 - DNA, 25 bp, Rattus norvegicus
atacctgcaactctagcactcagaa

SEQ ID NO: 171346 - DNA, 25 bp, Rattus norvegicus
atacctgcaactgtagcactcagaa

SEQ ID NO: 171347 - DNA, 25 bp, Rattus norvegicus
atacctgcacagactgtaggacaca

SEQ ID NO: 171348 - DNA, 25 bp, Rattus norvegicus
atacctgcacagtctgtaggacaca

SEQ ID NO: 171349 - DNA, 25 bp, Rattus norvegicus
atacctgcagaaattatttcattgt

SEQ ID NO: 171350 - DNA, 25 bp, Rattus norvegicus
atacctgcagaatttatttcattgt

SEQ ID NO: 171351 - DNA, 25 bp, Rattus norvegicus
atacctgcagataaacgacctccaa

SEQ ID NO: 171352 - DNA, 25 bp, Rattus norvegicus
atacctgcagattaacgacctccaa

SEQ ID NO: 171353 - DNA, 25 bp, Rattus norvegicus
atacctgcatatagtctgccatctt

SEQ ID NO: 171354 - DNA, 25 bp, Rattus norvegicus
atacctgcatattgtctgccatctt

SEQ ID NO: 171355 - DNA, 25 bp, Rattus norvegicus
atacctgcatctccagggtgctgag

SEQ ID NO: 171356 - DNA, 25 bp, Rattus norvegicus
atacctgcatctgcagggtgctgag

SEQ ID NO: 171357 - DNA, 25 bp, Rattus norvegicus
atacctgcatttaacttgtggacta

SEQ ID NO: 171358 - DNA, 25 bp, Rattus norvegicus
atacctgcatttcttactggctaat

SEQ ID NO: 171359 - DNA, 25 bp, Rattus norvegicus
atacctgcatttgttactggctaat

SEQ ID NO: 171360 - DNA, 25 bp, Rattus norvegicus
atacctgcattttacttgtggacta

SEQ ID NO: 171361 - DNA, 25 bp, Rattus norvegicus
atacctgccagtattgtggactaca

SEQ ID NO: 171362 - DNA, 25 bp, Rattus norvegicus
atacctgccagttttgtggactaca

SEQ ID NO: 171363 - DNA, 25 bp, Rattus norvegicus
atacctgccattcccttcgaatgga

SEQ ID NO: 171364 - DNA, 25 bp, Rattus norvegicus
atacctgccattgccttcgaatgga

SEQ ID NO: 171365 - DNA, 25 bp, Rattus norvegicus
atacctgccctacaactgttatgtt

SEQ ID NO: 171366 - DNA, 25 bp, Rattus norvegicus
atacctgccctagaactgttatgtt

SEQ ID NO: 171367 - DNA, 25 bp, Rattus norvegicus
atacctgcctggaggactgcactct

SEQ ID NO: 171368 - DNA, 25 bp, Rattus norvegicus
atacctgcctggtggactgcactct

SEQ ID NO: 171369 - DNA, 25 bp, Rattus norvegicus
atacctgcctgtcttctcaaagaga

SEQ ID NO: 171370 - DNA, 25 bp, Rattus norvegicus
atacctgcctgtgttctcaaagaga

SEQ ID NO: 171371 - DNA, 25 bp, Rattus norvegicus
atacctgcctttcagtctgtttgca

SEQ ID NO: 171372 - DNA, 25 bp, Rattus norvegicus
atacctgcctttgagtctgtttgca

SEQ ID NO: 171373 - DNA, 25 bp, Rattus norvegicus
atacctgcgaatcgacttcttgtta

SEQ ID NO: 171374 - DNA, 25 bp, Rattus norvegicus
atacctgcgaatggacttcttgtta

SEQ ID NO: 171375 - DNA, 25 bp, Rattus norvegicus
atacctgcttgacaaagcccttgtc

SEQ ID NO: 171376 - DNA, 25 bp, Rattus norvegicus
atacctgcttgagaaagcccttgtc

SEQ ID NO: 171377 - DNA, 25 bp, Rattus norvegicus
atacctggacttacatgttgccaag

SEQ ID NO: 171378 - DNA, 25 bp, Rattus norvegicus
atacctggactttcatgttgccaag

SEQ ID NO: 171379 - DNA, 25 bp, Rattus norvegicus
atacctggagaactggtcagttgct

SEQ ID NO: 171380 - DNA, 25 bp, Rattus norvegicus
atacctggagaagtggtcagttgct

SEQ ID NO: 171381 - DNA, 25 bp, Rattus norvegicus
atacctggaggcagctagacctggg

SEQ ID NO: 171382 - DNA, 25 bp, Rattus norvegicus
atacctggaggctgctagacctggg

SEQ ID NO: 171383 - DNA, 25 bp, Rattus norvegicus
atacctggattcatatgctatctat

SEQ ID NO: 171384 - DNA, 25 bp, Rattus norvegicus
atacctggattcttatgctatctat

SEQ ID NO: 171385 - DNA, 25 bp, Rattus norvegicus
atacctggattgcactccatgaccc

SEQ ID NO: 171386 - DNA, 25 bp, Rattus norvegicus
atacctggattggactccatgaccc

SEQ ID NO: 171387 - DNA, 25 bp, Rattus norvegicus
atacctggatttcaagcatggaact

SEQ ID NO: 171388 - DNA, 25 bp, Rattus norvegicus
atacctggatttgaagcatggaact

SEQ ID NO: 171389 - DNA, 25 bp, Rattus norvegicus
atacctggcagacccttggctggag

SEQ ID NO: 171390 - DNA, 25 bp, Rattus norvegicus
atacctggcagagccttggctggag

SEQ ID NO: 171391 - DNA, 25 bp, Rattus norvegicus
atacctggcatgagggcatagctga

SEQ ID NO: 171392 - DNA, 25 bp, Rattus norvegicus
atacctggcatgtgggcatagctga

SEQ ID NO: 171393 - DNA, 25 bp, Rattus norvegicus
atacctggccttagctgggttgact

SEQ ID NO: 171394 - DNA, 25 bp, Rattus norvegicus
atacctggcctttgctgggttgact

SEQ ID NO: 171395 - DNA, 25 bp, Rattus norvegicus
atacctggcgtacaagcagcctggg

SEQ ID NO: 171396 - DNA, 25 bp, Rattus norvegicus
atacctggcgtagaagcagcctggg

SEQ ID NO: 171397 - DNA, 25 bp, Rattus norvegicus
atacctggctgtccaagagctctga

SEQ ID NO: 171398 - DNA, 25 bp, Rattus norvegicus
atacctggctgtgcaagagctctga

SEQ ID NO: 171399 - DNA, 25 bp, Rattus norvegicus
atacctgggcctatgagtttaatag

SEQ ID NO: 171400 - DNA, 25 bp, Rattus norvegicus
atacctgggcctttgagtttaatag

SEQ ID NO: 171401 - DNA, 25 bp, Rattus norvegicus
atacctgggtgtcatattatctttt

SEQ ID NO: 171402 - DNA, 25 bp, Rattus norvegicus
atacctgggtgtgatattatctttt

SEQ ID NO: 171403 - DNA, 25 bp, Rattus norvegicus
atacctggtacaatcttaagagcac

SEQ ID NO: 171404 - DNA, 25 bp, Rattus norvegicus
atacctggtacattcttaagagcac

SEQ ID NO: 171405 - DNA, 25 bp, Rattus norvegicus
atacctggtcaaatcttgagcctaa

SEQ ID NO: 171406 - DNA, 25 bp, Rattus norvegicus
atacctggtcaattcttgagcctaa

SEQ ID NO: 171407 - DNA, 25 bp, Rattus norvegicus
atacctggttttagtattggatcca

SEQ ID NO: 171408 - DNA, 25 bp, Rattus norvegicus
atacctggtttttgtattggatcca

SEQ ID NO: 171409 - DNA, 25 bp, Rattus norvegicus
atacctgtaaggctacccagtctgt

SEQ ID NO: 171410 - DNA, 25 bp, Rattus norvegicus
atacctgtaagggtacccagtctgt

SEQ ID NO: 171411 - DNA, 25 bp, Rattus norvegicus
atacctgtaatacttcagtctgtga

SEQ ID NO: 171412 - DNA, 25 bp, Rattus norvegicus
atacctgtaatagttcagtctgtga

SEQ ID NO: 171413 - DNA, 25 bp, Rattus norvegicus
atacctgtagatccttccttccttt

SEQ ID NO: 171414 - DNA, 25 bp, Rattus norvegicus
atacctgtagatgcttccttccttt

SEQ ID NO: 171415 - DNA, 25 bp, Rattus norvegicus
atacctgtattacgtgttctcccca

SEQ ID NO: 171416 - DNA, 25 bp, Rattus norvegicus
atacctgtattaggtgttctcccca

SEQ ID NO: 171417 - DNA, 25 bp, Rattus norvegicus
atacctgtcaggcagcctctctaag

SEQ ID NO: 171418 - DNA, 25 bp, Rattus norvegicus
atacctgtcagggagcctctctaag

SEQ ID NO: 171419 - DNA, 25 bp, Rattus norvegicus
atacctgtccagctgatgtcattct

SEQ ID NO: 171420 - DNA, 25 bp, Rattus norvegicus
atacctgtccaggtgatgtcattct

SEQ ID NO: 171421 - DNA, 25 bp, Rattus norvegicus
atacctgtcctgcttgctggagggc

SEQ ID NO: 171422 - DNA, 25 bp, Rattus norvegicus
atacctgtcctggttgctggagggc

SEQ ID NO: 171423 - DNA, 25 bp, Rattus norvegicus
atacctgtctatagggtggtctccc

SEQ ID NO: 171424 - DNA, 25 bp, Rattus norvegicus
atacctgtctatcggagagtccgtc

SEQ ID NO: 171425 - DNA, 25 bp, Rattus norvegicus
atacctgtctatgggagagtccgtc

SEQ ID NO: 171426 - DNA, 25 bp, Rattus norvegicus
atacctgtctattgggtggtctccc

SEQ ID NO: 171427 - DNA, 25 bp, Rattus norvegicus
atacctgtggccatgagtcacttca

SEQ ID NO: 171428 - DNA, 25 bp, Rattus norvegicus
atacctgtggccttgagtcacttca

SEQ ID NO: 171429 - DNA, 25 bp, Rattus norvegicus
atacctgtgggcaatgagcactgat

SEQ ID NO: 171430 - DNA, 25 bp, Rattus norvegicus
atacctgtgggctatgagcactgat

SEQ ID NO: 171431 - DNA, 25 bp, Rattus norvegicus
atacctgtggtactgaacgacgagc

SEQ ID NO: 171432 - DNA, 25 bp, Rattus norvegicus
atacctgtggtagtgaacgacgagc

SEQ ID NO: 171433 - DNA, 25 bp, Rattus norvegicus
atacctgtgtctagtagaggcccca

SEQ ID NO: 171434 - DNA, 25 bp, Rattus norvegicus
atacctgtgtcttgtagaggcccca

SEQ ID NO: 171435 - DNA, 25 bp, Rattus norvegicus
atacctgtgttaattcctatgatgt

SEQ ID NO: 171436 - DNA, 25 bp, Rattus norvegicus
atacctgtgttatttcctatgatgt

SEQ ID NO: 171437 - DNA, 25 bp, Rattus norvegicus
atacctgttctgaatggacaccaag

SEQ ID NO: 171438 - DNA, 25 bp, Rattus norvegicus
atacctgttctgtatggacaccaag

SEQ ID NO: 171439 - DNA, 25 bp, Rattus norvegicus
atacctgttgcccagactgaatgtt

SEQ ID NO: 171440 - DNA, 25 bp, Rattus norvegicus
atacctgttgccgagactgaatgtt

SEQ ID NO: 171441 - DNA, 25 bp, Rattus norvegicus
atacctgttgtcatcaaatgctagt

SEQ ID NO: 171442 - DNA, 25 bp, Rattus norvegicus
atacctgttgtccaaggaggtcaga

SEQ ID NO: 171443 - DNA, 25 bp, Rattus norvegicus
atacctgttgtcgaaggaggtcaga

SEQ ID NO: 171444 - DNA, 25 bp, Rattus norvegicus
atacctgttgtcttcaaatgctagt

SEQ ID NO: 171445 - DNA, 25 bp, Rattus norvegicus
atacctgtttctacagctgtacttt

SEQ ID NO: 171446 - DNA, 25 bp, Rattus norvegicus
atacctgtttcttcagctgtacttt

SEQ ID NO: 171447 - DNA, 25 bp, Rattus norvegicus
atacctgttttaatctatctattgg

SEQ ID NO: 171448 - DNA, 25 bp, Rattus norvegicus
atacctgttttattctatctattgg

SEQ ID NO: 171449 - DNA, 25 bp, Rattus norvegicus
atacctgttttgaaagcctttacat

SEQ ID NO: 171450 - DNA, 25 bp, Rattus norvegicus
atacctgttttgtaagcctttacat

SEQ ID NO: 171451 - DNA, 25 bp, Rattus norvegicus
ataccttaggaaacccaaggagcag

SEQ ID NO: 171452 - DNA, 25 bp, Rattus norvegicus
ataccttaggaatcccaaggagcag

SEQ ID NO: 171453 - DNA, 25 bp, Rattus norvegicus
ataccttatataatccccatgtctc

SEQ ID NO: 171454 - DNA, 25 bp, Rattus norvegicus
ataccttatatattccccatgtctc

SEQ ID NO: 171455 - DNA, 25 bp, Rattus norvegicus
ataccttattggagtgttggcatat

SEQ ID NO: 171456 - DNA, 25 bp, Rattus norvegicus
ataccttattggtgtgttggcatat

SEQ ID NO: 171457 - DNA, 25 bp, Rattus norvegicus
ataccttatttcacctttcctatat

SEQ ID NO: 171458 - DNA, 25 bp, Rattus norvegicus
ataccttatttctcctttcctatat

SEQ ID NO: 171459 - DNA, 25 bp, Rattus norvegicus
ataccttcaagccttgtggtcttgc

SEQ ID NO: 171460 - DNA, 25 bp, Rattus norvegicus
ataccttcaagcgttgtggtcttgc

SEQ ID NO: 171461 - DNA, 25 bp, Rattus norvegicus
ataccttcactaccctgtaattgtc

SEQ ID NO: 171462 - DNA, 25 bp, Rattus norvegicus
ataccttcactagcctgtaattgtc

SEQ ID NO: 171463 - DNA, 25 bp, Rattus norvegicus
ataccttcaggaatgggccagggaa

SEQ ID NO: 171464 - DNA, 25 bp, Rattus norvegicus
ataccttcaggattgggccagggaa

SEQ ID NO: 171465 - DNA, 25 bp, Rattus norvegicus
ataccttcctctcagcacctgatgg

SEQ ID NO: 171466 - DNA, 25 bp, Rattus norvegicus
ataccttcctctgagcacctgatgg

SEQ ID NO: 171467 - DNA, 25 bp, Rattus norvegicus
ataccttcctgaagatatgttgtcc

SEQ ID NO: 171468 - DNA, 25 bp, Rattus norvegicus
ataccttcctgatgatatgttgtcc

SEQ ID NO: 171469 - DNA, 25 bp, Rattus norvegicus
ataccttccttactctggtgcttag

SEQ ID NO: 171470 - DNA, 25 bp, Rattus norvegicus
ataccttccttagtctggtgcttag

SEQ ID NO: 171471 - DNA, 25 bp, Rattus norvegicus
ataccttccttgatttcttgtcatg

SEQ ID NO: 171472 - DNA, 25 bp, Rattus norvegicus
ataccttccttgttttcttgtcatg

SEQ ID NO: 171473 - DNA, 25 bp, Rattus norvegicus
ataccttcctttcactgtttgagcc

SEQ ID NO: 171474 - DNA, 25 bp, Rattus norvegicus
ataccttcctttgactgtttgagcc

SEQ ID NO: 171475 - DNA, 25 bp, Rattus norvegicus
ataccttcgatgaggcgcttgcgca

SEQ ID NO: 171476 - DNA, 25 bp, Rattus norvegicus
ataccttcgatgtggcgcttgcgca

SEQ ID NO: 171477 - DNA, 25 bp, Rattus norvegicus
ataccttctgcaaagcccaacttga

SEQ ID NO: 171478 - DNA, 25 bp, Rattus norvegicus
ataccttctgcatagcccaacttga

SEQ ID NO: 171479 - DNA, 25 bp, Rattus norvegicus
ataccttgaagaagggcctcactct

SEQ ID NO: 171480 - DNA, 25 bp, Rattus norvegicus
ataccttgaagatgggcctcactct

SEQ ID NO: 171481 - DNA, 25 bp, Rattus norvegicus
ataccttgacagctgaggagcccaa

SEQ ID NO: 171482 - DNA, 25 bp, Rattus norvegicus
ataccttgacaggtgaggagcccaa

SEQ ID NO: 171483 - DNA, 25 bp, Rattus norvegicus
ataccttgaccacccattgattttc

SEQ ID NO: 171484 - DNA, 25 bp, Rattus norvegicus
ataccttgaccagccattgattttc

SEQ ID NO: 171485 - DNA, 25 bp, Rattus norvegicus
ataccttgagctatttgacagccct

SEQ ID NO: 171486 - DNA, 25 bp, Rattus norvegicus
ataccttgagctttttgacagccct

SEQ ID NO: 171487 - DNA, 25 bp, Rattus norvegicus
ataccttgtcctatattacttgata

SEQ ID NO: 171488 - DNA, 25 bp, Rattus norvegicus
ataccttgtcctttattacttgata

SEQ ID NO: 171489 - DNA, 25 bp, Rattus norvegicus
ataccttgtgggactgggctccagg

SEQ ID NO: 171490 - DNA, 25 bp, Rattus norvegicus
ataccttgtgggtctgggctccagg

SEQ ID NO: 171491 - DNA, 25 bp, Rattus norvegicus
atacctttaatgctgacacctgcgg

SEQ ID NO: 171492 - DNA, 25 bp, Rattus norvegicus
atacctttaatggtgacacctgcgg

SEQ ID NO: 171493 - DNA, 25 bp, Rattus norvegicus
atacctttagctctctgaccgagga

SEQ ID NO: 171494 - DNA, 25 bp, Rattus norvegicus
atacctttagctgtctgaccgagga

SEQ ID NO: 171495 - DNA, 25 bp, Rattus norvegicus
atacctttatgcatcttcaccctgg

SEQ ID NO: 171496 - DNA, 25 bp, Rattus norvegicus
atacctttatgcttcttcaccctgg

SEQ ID NO: 171497 - DNA, 25 bp, Rattus norvegicus
atacctttcaaactcttgggaagct

SEQ ID NO: 171498 - DNA, 25 bp, Rattus norvegicus
atacctttcaaagtcttgggaagct

SEQ ID NO: 171499 - DNA, 25 bp, Rattus norvegicus
atacctttccatcataatatctccc

SEQ ID NO: 171500 - DNA, 25 bp, Rattus norvegicus
atacctttccatgataatatctccc

SEQ ID NO: 171501 - DNA, 25 bp, Rattus norvegicus
atacctttcccacaggctagcctgt

SEQ ID NO: 171502 - DNA, 25 bp, Rattus norvegicus
atacctttcccagaggctagcctgt

SEQ ID NO: 171503 - DNA, 25 bp, Rattus norvegicus
atacctttccttcggacattgctca

SEQ ID NO: 171504 - DNA, 25 bp, Rattus norvegicus
atacctttccttgggacattgctca

SEQ ID NO: 171505 - DNA, 25 bp, Rattus norvegicus
atacctttctcaagcatcagatgct

SEQ ID NO: 171506 - DNA, 25 bp, Rattus norvegicus
atacctttctcatgcatcagatgct

SEQ ID NO: 171507 - DNA, 25 bp, Rattus norvegicus
atacctttctgtaccttgtgtgcat

SEQ ID NO: 171508 - DNA, 25 bp, Rattus norvegicus
atacctttctgtatgttaatctgat

SEQ ID NO: 171509 - DNA, 25 bp, Rattus norvegicus
atacctttctgttccttgtgtgcat

SEQ ID NO: 171510 - DNA, 25 bp, Rattus norvegicus
atacctttctgtttgttaatctgat

SEQ ID NO: 171511 - DNA, 25 bp, Rattus norvegicus
atacctttctttatgcaactcttcc

SEQ ID NO: 171512 - DNA, 25 bp, Rattus norvegicus
atacctttctttttgcaactcttcc

SEQ ID NO: 171513 - DNA, 25 bp, Rattus norvegicus
atacctttgccaatacaactgcctg

SEQ ID NO: 171514 - DNA, 25 bp, Rattus norvegicus
atacctttgccattacaactgcctg

SEQ ID NO: 171515 - DNA, 25 bp, Rattus norvegicus
atacctttgctgcagatacttgtca

SEQ ID NO: 171516 - DNA, 25 bp, Rattus norvegicus
atacctttgctggagatacttgtca

SEQ ID NO: 171517 - DNA, 25 bp, Rattus norvegicus
ataccttttagactgacatatcgaa

SEQ ID NO: 171518 - DNA, 25 bp, Rattus norvegicus
ataccttttagagtgacatatcgaa

SEQ ID NO: 171519 - DNA, 25 bp, Rattus norvegicus
ataccttttccaaactattatagtg

SEQ ID NO: 171520 - DNA, 25 bp, Rattus norvegicus
ataccttttccatactattatagtg

SEQ ID NO: 171521 - DNA, 25 bp, Rattus norvegicus
ataccttttctgacagtgctttccc

SEQ ID NO: 171522 - DNA, 25 bp, Rattus norvegicus
ataccttttctgtcagtgctttccc

SEQ ID NO: 171523 - DNA, 25 bp, Rattus norvegicus
ataccttttttgctcttcatatggc

SEQ ID NO: 171524 - DNA, 25 bp, Rattus norvegicus
ataccttttttggtcttcatatggc

SEQ ID NO: 171525 - DNA, 25 bp, Rattus norvegicus
atacgaaacttgagccacttggaga

SEQ ID NO: 171526 - DNA, 25 bp, Rattus norvegicus
atacgaaacttgtgccacttggaga

SEQ ID NO: 171527 - DNA, 25 bp, Rattus norvegicus
atacgaaaggtccagtcctctcatt

SEQ ID NO: 171528 - DNA, 25 bp, Rattus norvegicus
atacgaaaggtcgagtcctctcatt

SEQ ID NO: 171529 - DNA, 25 bp, Rattus norvegicus
atacgaacccggacagatgcagctg

SEQ ID NO: 171530 - DNA, 25 bp, Rattus norvegicus
atacgaacccggtcagatgcagctg

SEQ ID NO: 171531 - DNA, 25 bp, Rattus norvegicus
atacgaacttggcactttgctgctg

SEQ ID NO: 171532 - DNA, 25 bp, Rattus norvegicus
atacgaacttgggactttgctgctg

SEQ ID NO: 171533 - DNA, 25 bp, Rattus norvegicus
atacgaagaacaccccaacggttgt

SEQ ID NO: 171534 - DNA, 25 bp, Rattus norvegicus
atacgaagaacagcccaacggttgt

SEQ ID NO: 171535 - DNA, 25 bp, Rattus norvegicus
atacgaagagatatacccgcccgat

SEQ ID NO: 171536 - DNA, 25 bp, Rattus norvegicus
atacgaagagatttacccgcccgat

SEQ ID NO: 171537 - DNA, 25 bp, Rattus norvegicus
atacgaagtcttctaaaagctatgt

SEQ ID NO: 171538 - DNA, 25 bp, Rattus norvegicus
atacgaagtcttgtaaaagctatgt

SEQ ID NO: 171539 - DNA, 25 bp, Rattus norvegicus
atacgaagttctatatggttccata

SEQ ID NO: 171540 - DNA, 25 bp, Rattus norvegicus
atacgaagttctttatggttccata

SEQ ID NO: 171541 - DNA, 25 bp, Rattus norvegicus
atacgaattctacgttttgagatac

SEQ ID NO: 171542 - DNA, 25 bp, Rattus norvegicus
atacgaattctaggttttgagatac

SEQ ID NO: 171543 - DNA, 25 bp, Rattus norvegicus
atacgacacgtcattcagggtttga

SEQ ID NO: 171544 - DNA, 25 bp, Rattus norvegicus
atacgacacgtctttcagggtttga

SEQ ID NO: 171545 - DNA, 25 bp, Rattus norvegicus
atacgacaggcaccgacaacaccga

SEQ ID NO: 171546 - DNA, 25 bp, Rattus norvegicus
atacgacaggcagcgacaacaccga

SEQ ID NO: 171547 - DNA, 25 bp, Rattus norvegicus
atacgacatgtgctgctgaccatca

SEQ ID NO: 171548 - DNA, 25 bp, Rattus norvegicus
atacgacatgtggtgctgaccatca

SEQ ID NO: 171549 - DNA, 25 bp, Rattus norvegicus
atacgacctgtgattcggacatttt

SEQ ID NO: 171550 - DNA, 25 bp, Rattus norvegicus
atacgacctgtgtttcggacatttt

SEQ ID NO: 171551 - DNA, 25 bp, Rattus norvegicus
atacgacgtgtacaggataatgcct

SEQ ID NO: 171552 - DNA, 25 bp, Rattus norvegicus
atacgacgtgtagaggataatgcct

SEQ ID NO: 171553 - DNA, 25 bp, Rattus norvegicus
atacgactcctcatttttaatctgg

SEQ ID NO: 171554 - DNA, 25 bp, Rattus norvegicus
atacgactcctcttttttaatctgg

SEQ ID NO: 171555 - DNA, 25 bp, Rattus norvegicus
atacgagacactagagactactaga

SEQ ID NO: 171556 - DNA, 25 bp, Rattus norvegicus
atacgagacacttgagactactaga

SEQ ID NO: 171557 - DNA, 25 bp, Rattus norvegicus
atacgagccatgagcaagggccagt

SEQ ID NO: 171558 - DNA, 25 bp, Rattus norvegicus
atacgagccatgtgcaagggccagt

SEQ ID NO: 171559 - DNA, 25 bp, Rattus norvegicus
atacgagcccctctgtattgtcatg

SEQ ID NO: 171560 - DNA, 25 bp, Rattus norvegicus
atacgagcccctgtgtattgtcatg

SEQ ID NO: 171561 - DNA, 25 bp, Rattus norvegicus
atacgagctctaatttccatttgcc

SEQ ID NO: 171562 - DNA, 25 bp, Rattus norvegicus
atacgagctctattttccatttgcc

SEQ ID NO: 171563 - DNA, 25 bp, Rattus norvegicus
atacgagggaccctgtatccagtcg

SEQ ID NO: 171564 - DNA, 25 bp, Rattus norvegicus
atacgagggaccgtgtatccagtcg

SEQ ID NO: 171565 - DNA, 25 bp, Rattus norvegicus
atacgaggttggctcttgttctgaa

SEQ ID NO: 171566 - DNA, 25 bp, Rattus norvegicus
atacgaggttgggtcttgttctgaa

SEQ ID NO: 171567 - DNA, 25 bp, Rattus norvegicus
atacgagtcactagctttgatcccg

SEQ ID NO: 171568 - DNA, 25 bp, Rattus norvegicus
atacgagtcacttgctttgatcccg

SEQ ID NO: 171569 - DNA, 25 bp, Rattus norvegicus
atacgatacaggctggtccccattc

SEQ ID NO: 171570 - DNA, 25 bp, Rattus norvegicus
atacgatacagggtggtccccattc

SEQ ID NO: 171571 - DNA, 25 bp, Rattus norvegicus
atacgatactcccaaacccaagaag

SEQ ID NO: 171572 - DNA, 25 bp, Rattus norvegicus
atacgatactccgaaacccaagaag

SEQ ID NO: 171573 - DNA, 25 bp, Rattus norvegicus
atacgatagtttctctctttttgga

SEQ ID NO: 171574 - DNA, 25 bp, Rattus norvegicus
atacgatagtttgtctctttttgga

SEQ ID NO: 171575 - DNA, 25 bp, Rattus norvegicus
atacgatccctcattgtgtgtgtgt

SEQ ID NO: 171576 - DNA, 25 bp, Rattus norvegicus
atacgatccctctttgtgtgtgtgt

SEQ ID NO: 171577 - DNA, 25 bp, Rattus norvegicus
atacgatgtgtgaagttcctttatc

SEQ ID NO: 171578 - DNA, 25 bp, Rattus norvegicus
atacgatgtgtgtagttcctttatc

SEQ ID NO: 171579 - DNA, 25 bp, Rattus norvegicus
atacgcaagtctcaggagcctacaa

SEQ ID NO: 171580 - DNA, 25 bp, Rattus norvegicus
atacgcaagtctgaggagcctacaa

SEQ ID NO: 171581 - DNA, 25 bp, Rattus norvegicus
atacgcacactgattctgtctgttt

SEQ ID NO: 171582 - DNA, 25 bp, Rattus norvegicus
atacgcacactgtttctgtctgttt

SEQ ID NO: 171583 - DNA, 25 bp, Rattus norvegicus
atacgcacctttaccctttgatgag

SEQ ID NO: 171584 - DNA, 25 bp, Rattus norvegicus
atacgcaccttttccctttgatgag

SEQ ID NO: 171585 - DNA, 25 bp, Rattus norvegicus
atacgcactgctattgttccatggg

SEQ ID NO: 171586 - DNA, 25 bp, Rattus norvegicus
atacgcactgcttttgttccatggg

SEQ ID NO: 171587 - DNA, 25 bp, Rattus norvegicus
atacgcagagaaacctggaccacag

SEQ ID NO: 171588 - DNA, 25 bp, Rattus norvegicus
atacgcagagaatcctggaccacag

SEQ ID NO: 171589 - DNA, 25 bp, Rattus norvegicus
atacgcagagacacgtgggctttga

SEQ ID NO: 171590 - DNA, 25 bp, Rattus norvegicus
atacgcagagactcgtgggctttga

SEQ ID NO: 171591 - DNA, 25 bp, Rattus norvegicus
atacgcagtcgcatcctatcttacg

SEQ ID NO: 171592 - DNA, 25 bp, Rattus norvegicus
atacgcagtcgcttcctatcttacg

SEQ ID NO: 171593 - DNA, 25 bp, Rattus norvegicus
atacgcatacataccatacattttg

SEQ ID NO: 171594 - DNA, 25 bp, Rattus norvegicus
atacgcatacattccatacattttg

SEQ ID NO: 171595 - DNA, 25 bp, Rattus norvegicus
atacgcatgactacattacaacggg

SEQ ID NO: 171596 - DNA, 25 bp, Rattus norvegicus
atacgcatgacttcattacaacggg

SEQ ID NO: 171597 - DNA, 25 bp, Rattus norvegicus
atacgccatacaatcaggacatagg

SEQ ID NO: 171598 - DNA, 25 bp, Rattus norvegicus
atacgccatacattcaggacatagg

SEQ ID NO: 171599 - DNA, 25 bp, Rattus norvegicus
atacgccgcgagacttttacagaac

SEQ ID NO: 171600 - DNA, 25 bp, Rattus norvegicus
atacgccgcgagtcttttacagaac

SEQ ID NO: 171601 - DNA, 25 bp, Rattus norvegicus
atacgcctcctgcttaaagtctggc

SEQ ID NO: 171602 - DNA, 25 bp, Rattus norvegicus
atacgcctcctggttaaagtctggc

SEQ ID NO: 171603 - DNA, 25 bp, Rattus norvegicus
atacgcctttcgaacccgtagctct

SEQ ID NO: 171604 - DNA, 25 bp, Rattus norvegicus
atacgcctttcgtacccgtagctct

SEQ ID NO: 171605 - DNA, 25 bp, Rattus norvegicus
atacgccttttcatgacgagttata

SEQ ID NO: 171606 - DNA, 25 bp, Rattus norvegicus
atacgccttttcttgacgagttata

SEQ ID NO: 171607 - DNA, 25 bp, Rattus norvegicus
atacgcgtatttcccagttggtcta

SEQ ID NO: 171608 - DNA, 25 bp, Rattus norvegicus
atacgcgtatttgccagttggtcta

SEQ ID NO: 171609 - DNA, 25 bp, Rattus norvegicus
atacgctagagaactgccaggctta

SEQ ID NO: 171610 - DNA, 25 bp, Rattus norvegicus
atacgctagagatctgccaggctta

SEQ ID NO: 171611 - DNA, 25 bp, Rattus norvegicus
atacgctcaggccttcactgaagga

SEQ ID NO: 171612 - DNA, 25 bp, Rattus norvegicus
atacgctcaggcgttcactgaagga

SEQ ID NO: 171613 - DNA, 25 bp, Rattus norvegicus
atacgctcccctatggaaggacatt

SEQ ID NO: 171614 - DNA, 25 bp, Rattus norvegicus
atacgctcccctttggaaggacatt

SEQ ID NO: 171615 - DNA, 25 bp, Rattus norvegicus
atacgctggaaaaagtgcgcgatgc

SEQ ID NO: 171616 - DNA, 25 bp, Rattus norvegicus
atacgctggaaatagtgcgcgatgc

SEQ ID NO: 171617 - DNA, 25 bp, Rattus norvegicus
atacgctggcagcaaactggccctg

SEQ ID NO: 171618 - DNA, 25 bp, Rattus norvegicus
atacgctggcaggaaactggccctg

SEQ ID NO: 171619 - DNA, 25 bp, Rattus norvegicus
atacgctggctgcagttaagtgctg

SEQ ID NO: 171620 - DNA, 25 bp, Rattus norvegicus
atacgctggctggagttaagtgctg

SEQ ID NO: 171621 - DNA, 25 bp, Rattus norvegicus
atacgctgtaacactgtactgctag

SEQ ID NO: 171622 - DNA, 25 bp, Rattus norvegicus
atacgctgtaactctgtactgctag

SEQ ID NO: 171623 - DNA, 25 bp, Rattus norvegicus
atacgctgtatcactttgtaccctg

SEQ ID NO: 171624 - DNA, 25 bp, Rattus norvegicus
atacgctgtatctctttgtaccctg

SEQ ID NO: 171625 - DNA, 25 bp, Rattus norvegicus
atacggaagccccatactctgttgc

SEQ ID NO: 171626 - DNA, 25 bp, Rattus norvegicus
atacggaagcccgatactctgttgc

SEQ ID NO: 171627 - DNA, 25 bp, Rattus norvegicus
atacggaagctgatctgagaaaatg

SEQ ID NO: 171628 - DNA, 25 bp, Rattus norvegicus
atacggaagctgttctgagaaaatg

SEQ ID NO: 171629 - DNA, 25 bp, Rattus norvegicus
atacggactaaacaccaggctgggt

SEQ ID NO: 171630 - DNA, 25 bp, Rattus norvegicus
atacggactaaagaccaggctgggt

SEQ ID NO: 171631 - DNA, 25 bp, Rattus norvegicus
atacggagcaggagcgctcttcggc

SEQ ID NO: 171632 - DNA, 25 bp, Rattus norvegicus
atacggagcaggtgcgctcttcggc

SEQ ID NO: 171633 - DNA, 25 bp, Rattus norvegicus
atacggagctctcgagagcctgcac

SEQ ID NO: 171634 - DNA, 25 bp, Rattus norvegicus
atacggagctctggagagcctgcac

SEQ ID NO: 171635 - DNA, 25 bp, Rattus norvegicus
atacggattcgccaccccggcagtt

SEQ ID NO: 171636 - DNA, 25 bp, Rattus norvegicus
atacggattcgcgaccccggcagtt

SEQ ID NO: 171637 - DNA, 25 bp, Rattus norvegicus
atacggattgggatctgtgtggcca

SEQ ID NO: 171638 - DNA, 25 bp, Rattus norvegicus
atacggattgggttctgtgtggcca

SEQ ID NO: 171639 - DNA, 25 bp, Rattus norvegicus
atacggcaacagacactacattccc

SEQ ID NO: 171640 - DNA, 25 bp, Rattus norvegicus
atacggcaacagtcactacattccc

SEQ ID NO: 171641 - DNA, 25 bp, Rattus norvegicus
atacggcaatgcacgctggctggtc

SEQ ID NO: 171642 - DNA, 25 bp, Rattus norvegicus
atacggcaatgctcgctggctggtc

SEQ ID NO: 171643 - DNA, 25 bp, Rattus norvegicus
atacggccggttatgtgttagcagc

SEQ ID NO: 171644 - DNA, 25 bp, Rattus norvegicus
atacggccggttttgtgttagcagc

SEQ ID NO: 171645 - DNA, 25 bp, Rattus norvegicus
atacggcctcctacaagcacagtga

SEQ ID NO: 171646 - DNA, 25 bp, Rattus norvegicus
atacggcctccttcaagcacagtga

SEQ ID NO: 171647 - DNA, 25 bp, Rattus norvegicus
atacggctatgtcaccaattccaag

SEQ ID NO: 171648 - DNA, 25 bp, Rattus norvegicus
atacggctatgtgaccaattccaag

SEQ ID NO: 171649 - DNA, 25 bp, Rattus norvegicus
atacggctctgtagtcctgagactt

SEQ ID NO: 171650 - DNA, 25 bp, Rattus norvegicus
atacggctctgttgtcctgagactt

SEQ ID NO: 171651 - DNA, 25 bp, Rattus norvegicus
atacggctgtaaaatgctgctcttc

SEQ ID NO: 171652 - DNA, 25 bp, Rattus norvegicus
atacggctgtaatatgctgctcttc

SEQ ID NO: 171653 - DNA, 25 bp, Rattus norvegicus
atacggctgtgccaggcggactttc

SEQ ID NO: 171654 - DNA, 25 bp, Rattus norvegicus
atacggctgtgcgaggcggactttc

SEQ ID NO: 171655 - DNA, 25 bp, Rattus norvegicus
atacggctttctaggaagttgctcc

SEQ ID NO: 171656 - DNA, 25 bp, Rattus norvegicus
atacggctttcttggaagttgctcc

SEQ ID NO: 171657 - DNA, 25 bp, Rattus norvegicus
atacgggacccgctatggtgcctcc

SEQ ID NO: 171658 - DNA, 25 bp, Rattus norvegicus
atacgggacccggtatggtgcctcc

SEQ ID NO: 171659 - DNA, 25 bp, Rattus norvegicus
atacgggatcccataagccagagga

SEQ ID NO: 171660 - DNA, 25 bp, Rattus norvegicus
atacgggatcccttaagccagagga

SEQ ID NO: 171661 - DNA, 25 bp, Rattus norvegicus
atacgggcctcacttggtgcgaaac

SEQ ID NO: 171662 - DNA, 25 bp, Rattus norvegicus
atacgggcctcagttggtgcgaaac

SEQ ID NO: 171663 - DNA, 25 bp, Rattus norvegicus
atacgggttcttcctgcctgagaga

SEQ ID NO: 171664 - DNA, 25 bp, Rattus norvegicus
atacgggttcttgctgcctgagaga

SEQ ID NO: 171665 - DNA, 25 bp, Rattus norvegicus
atacggtaccacctggacgactgac

SEQ ID NO: 171666 - DNA, 25 bp, Rattus norvegicus
atacggtaccacgtggacgactgac

SEQ ID NO: 171667 - DNA, 25 bp, Rattus norvegicus
atacggtatatgcatgagtgttccc

SEQ ID NO: 171668 - DNA, 25 bp, Rattus norvegicus
atacggtatatggatgagtgttccc

SEQ ID NO: 171669 - DNA, 25 bp, Rattus norvegicus
atacggtcccagctgtgctgtagac

SEQ ID NO: 171670 - DNA, 25 bp, Rattus norvegicus
atacggtcccaggtgtgctgtagac

SEQ ID NO: 171671 - DNA, 25 bp, Rattus norvegicus
atacggtcgactcatctacagtggt

SEQ ID NO: 171672 - DNA, 25 bp, Rattus norvegicus
atacggtcgactgatctacagtggt

SEQ ID NO: 171673 - DNA, 25 bp, Rattus norvegicus
atacggtgaagtcggtgcaaatgca

SEQ ID NO: 171674 - DNA, 25 bp, Rattus norvegicus
atacggtgaagtgggtgcaaatgca

SEQ ID NO: 171675 - DNA, 25 bp, Rattus norvegicus
atacggtgacttccaaatgtacaga

SEQ ID NO: 171676 - DNA, 25 bp, Rattus norvegicus
atacggtgacttgcaaatgtacaga

SEQ ID NO: 171677 - DNA, 25 bp, Rattus norvegicus
atacggtgaggcagagtccctgaac

SEQ ID NO: 171678 - DNA, 25 bp, Rattus norvegicus
atacggtgaggctgagtccctgaac

SEQ ID NO: 171679 - DNA, 25 bp, Rattus norvegicus
atacggtgcctcatacctgtcatgt

SEQ ID NO: 171680 - DNA, 25 bp, Rattus norvegicus
atacggtgcctcttacctgtcatgt

SEQ ID NO: 171681 - DNA, 25 bp, Rattus norvegicus
atacggtggagaacacccagcagcc

SEQ ID NO: 171682 - DNA, 25 bp, Rattus norvegicus
atacggtggagatcacccagcagcc

SEQ ID NO: 171683 - DNA, 25 bp, Rattus norvegicus
atacggtggtgccttacatgcaaac

SEQ ID NO: 171684 - DNA, 25 bp, Rattus norvegicus
atacggtggtgcgttacatgcaaac

SEQ ID NO: 171685 - DNA, 25 bp, Rattus norvegicus
atacggtgtcctactgatgctaaga

SEQ ID NO: 171686 - DNA, 25 bp, Rattus norvegicus
atacggtgtccttctgatgctaaga

SEQ ID NO: 171687 - DNA, 25 bp, Rattus norvegicus
atacggttatatattcttctagatc

SEQ ID NO: 171688 - DNA, 25 bp, Rattus norvegicus
atacggttatattttcttctagatc

SEQ ID NO: 171689 - DNA, 25 bp, Rattus norvegicus
atacggtttcttatacggtatcaca

SEQ ID NO: 171690 - DNA, 25 bp, Rattus norvegicus
atacggtttcttctgcagtggtgac

SEQ ID NO: 171691 - DNA, 25 bp, Rattus norvegicus
atacggtttcttgtgcagtggtgac

SEQ ID NO: 171692 - DNA, 25 bp, Rattus norvegicus
atacggtttcttttacggtatcaca

SEQ ID NO: 171693 - DNA, 25 bp, Rattus norvegicus
atacgtaacctgagtttaatcacgg

SEQ ID NO: 171694 - DNA, 25 bp, Rattus norvegicus
atacgtaacctgtgtttaatcacgg

SEQ ID NO: 171695 - DNA, 25 bp, Rattus norvegicus
atacgtacaatcaatttcgccctta

SEQ ID NO: 171696 - DNA, 25 bp, Rattus norvegicus
atacgtacaatctatttcgccctta

SEQ ID NO: 171697 - DNA, 25 bp, Rattus norvegicus
atacgtacacttacacttactccta

SEQ ID NO: 171698 - DNA, 25 bp, Rattus norvegicus
atacgtacactttcacttactccta

SEQ ID NO: 171699 - DNA, 25 bp, Rattus norvegicus
atacgtatgagtaccatgcgccaac

SEQ ID NO: 171700 - DNA, 25 bp, Rattus norvegicus
atacgtatgagttccatgcgccaac

SEQ ID NO: 171701 - DNA, 25 bp, Rattus norvegicus
atacgtatgccacttccagttttca

SEQ ID NO: 171702 - DNA, 25 bp, Rattus norvegicus
atacgtatgccagttccagttttca

SEQ ID NO: 171703 - DNA, 25 bp, Rattus norvegicus
atacgtatggttaacttatagtttg

SEQ ID NO: 171704 - DNA, 25 bp, Rattus norvegicus
atacgtatggtttacttatagtttg

SEQ ID NO: 171705 - DNA, 25 bp, Rattus norvegicus
atacgtattgaacccaggttgccct

SEQ ID NO: 171706 - DNA, 25 bp, Rattus norvegicus
atacgtattgaagccaggttgccct

SEQ ID NO: 171707 - DNA, 25 bp, Rattus norvegicus
atacgtcaaggactttctgatcaat

SEQ ID NO: 171708 - DNA, 25 bp, Rattus norvegicus
atacgtcaaggagtttctgatcaat

SEQ ID NO: 171709 - DNA, 25 bp, Rattus norvegicus
atacgtcatgtacggaggtgctctc

SEQ ID NO: 171710 - DNA, 25 bp, Rattus norvegicus
atacgtcatgtagggaggtgctctc

SEQ ID NO: 171711 - DNA, 25 bp, Rattus norvegicus
atacgtcattggaggttaccccttg

SEQ ID NO: 171712 - DNA, 25 bp, Rattus norvegicus
atacgtcattggtggttaccccttg

SEQ ID NO: 171713 - DNA, 25 bp, Rattus norvegicus
atacgtccagacagtgtgccttaag

SEQ ID NO: 171714 - DNA, 25 bp, Rattus norvegicus
atacgtccagactgtgtgccttaag

SEQ ID NO: 171715 - DNA, 25 bp, Rattus norvegicus
atacgtccctcccatatttaatatt

SEQ ID NO: 171716 - DNA, 25 bp, Rattus norvegicus
atacgtccctccgatatttaatatt

SEQ ID NO: 171717 - DNA, 25 bp, Rattus norvegicus
atacgtcctaatcgttggtcaatag

SEQ ID NO: 171718 - DNA, 25 bp, Rattus norvegicus
atacgtcctaatggttggtcaatag

SEQ ID NO: 171719 - DNA, 25 bp, Rattus norvegicus
atacgtccttctccatggtttctcg

SEQ ID NO: 171720 - DNA, 25 bp, Rattus norvegicus
atacgtccttctgcatggtttctcg

SEQ ID NO: 171721 - DNA, 25 bp, Rattus norvegicus
atacgtctcttcaatcctgagtcgg

SEQ ID NO: 171722 - DNA, 25 bp, Rattus norvegicus
atacgtctcttctatcctgagtcgg

SEQ ID NO: 171723 - DNA, 25 bp, Rattus norvegicus
atacgtgaccacaccagagcatgtg

SEQ ID NO: 171724 - DNA, 25 bp, Rattus norvegicus
atacgtgaccactccagagcatgtg

SEQ ID NO: 171725 - DNA, 25 bp, Rattus norvegicus
atacgtgacgagagtgtgtggcctt

SEQ ID NO: 171726 - DNA, 25 bp, Rattus norvegicus
atacgtgacgagtgtgtgtggcctt

SEQ ID NO: 171727 - DNA, 25 bp, Rattus norvegicus
atacgtgactccactgctccatgga

SEQ ID NO: 171728 - DNA, 25 bp, Rattus norvegicus
atacgtgactcctctgctccatgga

SEQ ID NO: 171729 - DNA, 25 bp, Rattus norvegicus
atacgtgatttcctcagtctttctc

SEQ ID NO: 171730 - DNA, 25 bp, Rattus norvegicus
atacgtgatttcgtcagtctttctc

SEQ ID NO: 171731 - DNA, 25 bp, Rattus norvegicus
atacgtgcattgacccacaggacat

SEQ ID NO: 171732 - DNA, 25 bp, Rattus norvegicus
atacgtgcattgtcccacaggacat

SEQ ID NO: 171733 - DNA, 25 bp, Rattus norvegicus
atacgtgcccatcactgaggacatt

SEQ ID NO: 171734 - DNA, 25 bp, Rattus norvegicus
atacgtgcccatgactgaggacatt

SEQ ID NO: 171735 - DNA, 25 bp, Rattus norvegicus
atacgtgcctctcatgctggtcaat

SEQ ID NO: 171736 - DNA, 25 bp, Rattus norvegicus
atacgtgcctctgatgctggtcaat

SEQ ID NO: 171737 - DNA, 25 bp, Rattus norvegicus
atacgtgccttgagaatgctgctgc

SEQ ID NO: 171738 - DNA, 25 bp, Rattus norvegicus
atacgtgccttgtgaatgctgctgc

SEQ ID NO: 171739 - DNA, 25 bp, Rattus norvegicus
atacgtggcagcacgctggttcgct

SEQ ID NO: 171740 - DNA, 25 bp, Rattus norvegicus
atacgtggcagctcgctggttcgct

SEQ ID NO: 171741 - DNA, 25 bp, Rattus norvegicus
atacgtggcatgaatccctttcggt

SEQ ID NO: 171742 - DNA, 25 bp, Rattus norvegicus
atacgtggcatgtatccctttcggt

SEQ ID NO: 171743 - DNA, 25 bp, Rattus norvegicus
atacgtggctccattggcgcttagg

SEQ ID NO: 171744 - DNA, 25 bp, Rattus norvegicus
atacgtggctcctttggcgcttagg

SEQ ID NO: 171745 - DNA, 25 bp, Rattus norvegicus
atacgtggtgacatgcattggcttt

SEQ ID NO: 171746 - DNA, 25 bp, Rattus norvegicus
atacgtggtgacttgcattggcttt

SEQ ID NO: 171747 - DNA, 25 bp, Rattus norvegicus
atacgtggttccctgatgttcctaa

SEQ ID NO: 171748 - DNA, 25 bp, Rattus norvegicus
atacgtggttccgtgatgttcctaa

SEQ ID NO: 171749 - DNA, 25 bp, Rattus norvegicus
atacgtgtagctccattcggctatc

SEQ ID NO: 171750 - DNA, 25 bp, Rattus norvegicus
atacgtgtagctgcattcggctatc

SEQ ID NO: 171751 - DNA, 25 bp, Rattus norvegicus
atacgtgttacaatcttgccatgag

SEQ ID NO: 171752 - DNA, 25 bp, Rattus norvegicus
atacgtgttacattcttgccatgag

SEQ ID NO: 171753 - DNA, 25 bp, Rattus norvegicus
atacgtgtttccagatcggccaaag

SEQ ID NO: 171754 - DNA, 25 bp, Rattus norvegicus
atacgtgtttcctgatcggccaaag

SEQ ID NO: 171755 - DNA, 25 bp, Rattus norvegicus
atacgttaaaggatagctcaggcta

SEQ ID NO: 171756 - DNA, 25 bp, Rattus norvegicus
atacgttaaaggttagctcaggcta

SEQ ID NO: 171757 - DNA, 25 bp, Rattus norvegicus
atacgttcactaattgctctgtcac

SEQ ID NO: 171758 - DNA, 25 bp, Rattus norvegicus
atacgttcactatttgctctgtcac

SEQ ID NO: 171759 - DNA, 25 bp, Rattus norvegicus
atacgttcctgaatgtacatactgt

SEQ ID NO: 171760 - DNA, 25 bp, Rattus norvegicus
atacgttcctgattgtacatactgt

SEQ ID NO: 171761 - DNA, 25 bp, Rattus norvegicus
atacgttgcatcagtacggaatgaa

SEQ ID NO: 171762 - DNA, 25 bp, Rattus norvegicus
atacgttgcatctgtacggaatgaa

SEQ ID NO: 171763 - DNA, 25 bp, Rattus norvegicus
atacgttgctttaatctttcaggat

SEQ ID NO: 171764 - DNA, 25 bp, Rattus norvegicus
atacgttgcttttatctttcaggat

SEQ ID NO: 171765 - DNA, 25 bp, Rattus norvegicus
atacgtttatagcttgtccctgctt

SEQ ID NO: 171766 - DNA, 25 bp, Rattus norvegicus
atacgtttataggttgtccctgctt

SEQ ID NO: 171767 - DNA, 25 bp, Rattus norvegicus
atacgtttcacaaggctgtgcctga

SEQ ID NO: 171768 - DNA, 25 bp, Rattus norvegicus
atacgtttcacatggctgtgcctga

SEQ ID NO: 171769 - DNA, 25 bp, Rattus norvegicus
atacgtttcctcatttgtttgcaat

SEQ ID NO: 171770 - DNA, 25 bp, Rattus norvegicus
atacgtttcctcttttgtttgcaat

SEQ ID NO: 171771 - DNA, 25 bp, Rattus norvegicus
atacgttttgccacagcggcctcta

SEQ ID NO: 171772 - DNA, 25 bp, Rattus norvegicus
atacgttttgcctcagcggcctcta

SEQ ID NO: 171773 - DNA, 25 bp, Rattus norvegicus
atactaaacagtctctgggctctta

SEQ ID NO: 171774 - DNA, 25 bp, Rattus norvegicus
atactaaacagtgtctgggctctta

SEQ ID NO: 171775 - DNA, 25 bp, Rattus norvegicus
atactaacatctctacttcctacct

SEQ ID NO: 171776 - DNA, 25 bp, Rattus norvegicus
atactaacatctgtacttcctacct

SEQ ID NO: 171777 - DNA, 25 bp, Rattus norvegicus
atactaactgaactggtaagactag

SEQ ID NO: 171778 - DNA, 25 bp, Rattus norvegicus
atactaactgaagtggtaagactag

SEQ ID NO: 171779 - DNA, 25 bp, Rattus norvegicus
atactaagcaagagctctgccgctg

SEQ ID NO: 171780 - DNA, 25 bp, Rattus norvegicus
atactaagcaagtgctctgccgctg

SEQ ID NO: 171781 - DNA, 25 bp, Rattus norvegicus
atactaagcatgcaagacccacggg

SEQ ID NO: 171782 - DNA, 25 bp, Rattus norvegicus
atactaagcatggaagacccacggg

SEQ ID NO: 171783 - DNA, 25 bp, Rattus norvegicus
atactaatcacgatcccaggacagg

SEQ ID NO: 171784 - DNA, 25 bp, Rattus norvegicus
atactaatcacgttcccaggacagg

SEQ ID NO: 171785 - DNA, 25 bp, Rattus norvegicus
atactaatgctgcagaccgtggaca

SEQ ID NO: 171786 - DNA, 25 bp, Rattus norvegicus
atactaatgctggagaccgtggaca

SEQ ID NO: 171787 - DNA, 25 bp, Rattus norvegicus
atactaatgttcatctcatgagcat

SEQ ID NO: 171788 - DNA, 25 bp, Rattus norvegicus
atactaatgttcttctcatgagcat

SEQ ID NO: 171789 - DNA, 25 bp, Rattus norvegicus
atactacaaatgacacccttcactt

SEQ ID NO: 171790 - DNA, 25 bp, Rattus norvegicus
atactacaaatgtcacccttcactt

SEQ ID NO: 171791 - DNA, 25 bp, Rattus norvegicus
atactacaacttatgccttcctcaa

SEQ ID NO: 171792 - DNA, 25 bp, Rattus norvegicus
atactacaacttttgccttcctcaa

SEQ ID NO: 171793 - DNA, 25 bp, Rattus norvegicus
atactacacagccacttcctttttt

SEQ ID NO: 171794 - DNA, 25 bp, Rattus norvegicus
atactacacagcgacttcctttttt

SEQ ID NO: 171795 - DNA, 25 bp, Rattus norvegicus
atactacagcgcatgacgtcttcgg

SEQ ID NO: 171796 - DNA, 25 bp, Rattus norvegicus
atactacagcgcttgacgtcttcgg

SEQ ID NO: 171797 - DNA, 25 bp, Rattus norvegicus
atactacatgatctcccgttcgctg

SEQ ID NO: 171798 - DNA, 25 bp, Rattus norvegicus
atactacatgatgtcccgttcgctg

SEQ ID NO: 171799 - DNA, 25 bp, Rattus norvegicus
atactacccctaagtgtactacaag

SEQ ID NO: 171800 - DNA, 25 bp, Rattus norvegicus
atactacccctatgtgtactacaag

SEQ ID NO: 171801 - DNA, 25 bp, Rattus norvegicus
atactactaaggcagtctccactgg

SEQ ID NO: 171802 - DNA, 25 bp, Rattus norvegicus
atactactaagggagtctccactgg

SEQ ID NO: 171803 - DNA, 25 bp, Rattus norvegicus
atactactacttaagcttgggctct

SEQ ID NO: 171804 - DNA, 25 bp, Rattus norvegicus
atactactactttagcttgggctct

SEQ ID NO: 171805 - DNA, 25 bp, Rattus norvegicus
atactactcaaacccttcaaggtca

SEQ ID NO: 171806 - DNA, 25 bp, Rattus norvegicus
atactactcaaagccttcaaggtca

SEQ ID NO: 171807 - DNA, 25 bp, Rattus norvegicus
atactactgattatggaggaccgtt

SEQ ID NO: 171808 - DNA, 25 bp, Rattus norvegicus
atactactgattttggaggaccgtt

SEQ ID NO: 171809 - DNA, 25 bp, Rattus norvegicus
atactactggccactacaggacaga

SEQ ID NO: 171810 - DNA, 25 bp, Rattus norvegicus
atactactggccatcattgttctaa

SEQ ID NO: 171811 - DNA, 25 bp, Rattus norvegicus
atactactggcctctacaggacaga

SEQ ID NO: 171812 - DNA, 25 bp, Rattus norvegicus
atactactggccttcattgttctaa

SEQ ID NO: 171813 - DNA, 25 bp, Rattus norvegicus
atactactggctctgtgtctttccc

SEQ ID NO: 171814 - DNA, 25 bp, Rattus norvegicus
atactactggctgtgtgtctttccc

SEQ ID NO: 171815 - DNA, 25 bp, Rattus norvegicus
atactacttgggacctgggtgcttg

SEQ ID NO: 171816 - DNA, 25 bp, Rattus norvegicus
atactacttgggtcctgggtgcttg

SEQ ID NO: 171817 - DNA, 25 bp, Rattus norvegicus
atactactttatcttttttctctga

SEQ ID NO: 171818 - DNA, 25 bp, Rattus norvegicus
atactactttatgttttttctctga

SEQ ID NO: 171819 - DNA, 25 bp, Rattus norvegicus
atactagacaccaacattttacggc

SEQ ID NO: 171820 - DNA, 25 bp, Rattus norvegicus
atactagacacctacattttacggc

SEQ ID NO: 171821 - DNA, 25 bp, Rattus norvegicus
atactagaggccctggctttctggc

SEQ ID NO: 171822 - DNA, 25 bp, Rattus norvegicus
atactagaggccgtggctttctggc

SEQ ID NO: 171823 - DNA, 25 bp, Rattus norvegicus
atactagctcggactcaagcttaac

SEQ ID NO: 171824 - DNA, 25 bp, Rattus norvegicus
atactagctcggtctcaagcttaac

SEQ ID NO: 171825 - DNA, 25 bp, Rattus norvegicus
atactagcttatcgatgatgtccta

SEQ ID NO: 171826 - DNA, 25 bp, Rattus norvegicus
atactagcttatggatgatgtccta

SEQ ID NO: 171827 - DNA, 25 bp, Rattus norvegicus
atactaggacttactggctaacaag

SEQ ID NO: 171828 - DNA, 25 bp, Rattus norvegicus
atactaggactttctggctaacaag

SEQ ID NO: 171829 - DNA, 25 bp, Rattus norvegicus
atactaggcaatacagtgagactct

SEQ ID NO: 171830 - DNA, 25 bp, Rattus norvegicus
atactaggcaattcagtgagactct

SEQ ID NO: 171831 - DNA, 25 bp, Rattus norvegicus
atactagggagtcgtacccgttgct

SEQ ID NO: 171832 - DNA, 25 bp, Rattus norvegicus
atactagggagtggtacccgttgct

SEQ ID NO: 171833 - DNA, 25 bp, Rattus norvegicus
atactagtcccaaggtgtacctgct

SEQ ID NO: 171834 - DNA, 25 bp, Rattus norvegicus
atactagtcccatggtgtacctgct

SEQ ID NO: 171835 - DNA, 25 bp, Rattus norvegicus
atactagtgaccatcctcaggacgt

SEQ ID NO: 171836 - DNA, 25 bp, Rattus norvegicus
atactagtgaccttcctcaggacgt

SEQ ID NO: 171837 - DNA, 25 bp, Rattus norvegicus
atactataacatcactgtggagatc

SEQ ID NO: 171838 - DNA, 25 bp, Rattus norvegicus
atactataacatgactgtggagatc

SEQ ID NO: 171839 - DNA, 25 bp, Rattus norvegicus
atactatatgttatcctgcctttgg

SEQ ID NO: 171840 - DNA, 25 bp, Rattus norvegicus
atactatatgttttcctgcctttgg

SEQ ID NO: 171841 - DNA, 25 bp, Rattus norvegicus
atactatcctttcttttgggctcct

SEQ ID NO: 171842 - DNA, 25 bp, Rattus norvegicus
atactatcctttgttttgggctcct

SEQ ID NO: 171843 - DNA, 25 bp, Rattus norvegicus
atactatctaacatcccagacactc

SEQ ID NO: 171844 - DNA, 25 bp, Rattus norvegicus
atactatctaacttcccagacactc

SEQ ID NO: 171845 - DNA, 25 bp, Rattus norvegicus
atactatctgcaccaaggaccacag

SEQ ID NO: 171846 - DNA, 25 bp, Rattus norvegicus
atactatctgcagcaaggaccacag

SEQ ID NO: 171847 - DNA, 25 bp, Rattus norvegicus
atactatgacttactcttcttccag

SEQ ID NO: 171848 - DNA, 25 bp, Rattus norvegicus
atactatgactttctcttcttccag

SEQ ID NO: 171849 - DNA, 25 bp, Rattus norvegicus
atactatgagacatgcgcaacctat

SEQ ID NO: 171850 - DNA, 25 bp, Rattus norvegicus
atactatgagacttgcgcaacctat

SEQ ID NO: 171851 - DNA, 25 bp, Rattus norvegicus
atactatgttaaattcctatgcgta

SEQ ID NO: 171852 - DNA, 25 bp, Rattus norvegicus
atactatgttaatttcctatgcgta

SEQ ID NO: 171853 - DNA, 25 bp, Rattus norvegicus
atactattctgacctccaattcttg

SEQ ID NO: 171854 - DNA, 25 bp, Rattus norvegicus
atactattctgagctccaattcttg

SEQ ID NO: 171855 - DNA, 25 bp, Rattus norvegicus
atactattgattacagcctgggaaa

SEQ ID NO: 171856 - DNA, 25 bp, Rattus norvegicus
atactattgatttcagcctgggaaa

SEQ ID NO: 171857 - DNA, 25 bp, Rattus norvegicus
atactatttacaaaacaggtttcag

SEQ ID NO: 171858 - DNA, 25 bp, Rattus norvegicus
atactatttacataacaggtttcag

SEQ ID NO: 171859 - DNA, 25 bp, Rattus norvegicus
atactatttatgagcctggttctcg

SEQ ID NO: 171860 - DNA, 25 bp, Rattus norvegicus
atactatttatgtgcctggttctcg

SEQ ID NO: 171861 - DNA, 25 bp, Rattus norvegicus
atactcaaaggaattgggcggccct

SEQ ID NO: 171862 - DNA, 25 bp, Rattus norvegicus
atactcaaaggatttgggcggccct

SEQ ID NO: 171863 - DNA, 25 bp, Rattus norvegicus
atactcaagaaactctgccctggcc

SEQ ID NO: 171864 - DNA, 25 bp, Rattus norvegicus
atactcaagaaagtctgccctggcc

SEQ ID NO: 171865 - DNA, 25 bp, Rattus norvegicus
atactcacaaggagtccagcagcag

SEQ ID NO: 171866 - DNA, 25 bp, Rattus norvegicus
atactcacaaggtgtccagcagcag

SEQ ID NO: 171867 - DNA, 25 bp, Rattus norvegicus
atactcacagatcatgctctaccct

SEQ ID NO: 171868 - DNA, 25 bp, Rattus norvegicus
atactcacagatgatgctctaccct

SEQ ID NO: 171869 - DNA, 25 bp, Rattus norvegicus
atactcactcatctcattgcttgga

SEQ ID NO: 171870 - DNA, 25 bp, Rattus norvegicus
atactcactcatgtcattgcttgga

SEQ ID NO: 171871 - DNA, 25 bp, Rattus norvegicus
atactcactggaaaggaccgtacct

SEQ ID NO: 171872 - DNA, 25 bp, Rattus norvegicus
atactcactggataggaccgtacct

SEQ ID NO: 171873 - DNA, 25 bp, Rattus norvegicus
atactcacttcacaggtcaggacac

SEQ ID NO: 171874 - DNA, 25 bp, Rattus norvegicus
atactcacttcagaggtcaggacac

SEQ ID NO: 171875 - DNA, 25 bp, Rattus norvegicus
atactcacttcccaaggctcagagt

SEQ ID NO: 171876 - DNA, 25 bp, Rattus norvegicus
atactcacttccgaaggctcagagt

SEQ ID NO: 171877 - DNA, 25 bp, Rattus norvegicus
atactcactttacttctccatgaag

SEQ ID NO: 171878 - DNA, 25 bp, Rattus norvegicus
atactcactttagttctccatgaag

SEQ ID NO: 171879 - DNA, 25 bp, Rattus norvegicus
atactcagcgttccagttccttaaa

SEQ ID NO: 171880 - DNA, 25 bp, Rattus norvegicus
atactcagcgttgcagttccttaaa

SEQ ID NO: 171881 - DNA, 25 bp, Rattus norvegicus
atactcagcttacttggctatccgc

SEQ ID NO: 171882 - DNA, 25 bp, Rattus norvegicus
atactcagcttagttggctatccgc

SEQ ID NO: 171883 - DNA, 25 bp, Rattus norvegicus
atactcagggttataatggtcaact

SEQ ID NO: 171884 - DNA, 25 bp, Rattus norvegicus
atactcagggttttaatggtcaact

SEQ ID NO: 171885 - DNA, 25 bp, Rattus norvegicus
atactcagtatgctaaccctctgcc

SEQ ID NO: 171886 - DNA, 25 bp, Rattus norvegicus
atactcagtatggtaaccctctgcc

SEQ ID NO: 171887 - DNA, 25 bp, Rattus norvegicus
atactcagtcatacgttgtaacaca

SEQ ID NO: 171888 - DNA, 25 bp, Rattus norvegicus
atactcagtcattcgttgtaacaca

SEQ ID NO: 171889 - DNA, 25 bp, Rattus norvegicus
atactcagtgggaaatatcgctctt

SEQ ID NO: 171890 - DNA, 25 bp, Rattus norvegicus
atactcagtgggtaatatcgctctt

SEQ ID NO: 171891 - DNA, 25 bp, Rattus norvegicus
atactcatgagcagttcgtcatccc

SEQ ID NO: 171892 - DNA, 25 bp, Rattus norvegicus
atactcatgagctgttcgtcatccc

SEQ ID NO: 171893 - DNA, 25 bp, Rattus norvegicus
atactcatgcttcttgtctctaaca

SEQ ID NO: 171894 - DNA, 25 bp, Rattus norvegicus
atactcatgcttgttgtctctaaca

SEQ ID NO: 171895 - DNA, 25 bp, Rattus norvegicus
atactcatggaactgaagggacctt

SEQ ID NO: 171896 - DNA, 25 bp, Rattus norvegicus
atactcatggaagtgaagggacctt

SEQ ID NO: 171897 - DNA, 25 bp, Rattus norvegicus
atactcatgtatctagcttcttttg

SEQ ID NO: 171898 - DNA, 25 bp, Rattus norvegicus
atactcatgtatgtagcttcttttg

SEQ ID NO: 171899 - DNA, 25 bp, Rattus norvegicus
atactcattgccaaaggcaccctag

SEQ ID NO: 171900 - DNA, 25 bp, Rattus norvegicus
atactcattgcctaaggcaccctag

SEQ ID NO: 171901 - DNA, 25 bp, Rattus norvegicus
atactccaactgattgctgcgatgt

SEQ ID NO: 171902 - DNA, 25 bp, Rattus norvegicus
atactccaactgtttgctgcgatgt

SEQ ID NO: 171903 - DNA, 25 bp, Rattus norvegicus
atactccaagctctctactgtgaag

SEQ ID NO: 171904 - DNA, 25 bp, Rattus norvegicus
atactccaagctgtctactgtgaag

SEQ ID NO: 171905 - DNA, 25 bp, Rattus norvegicus
atactccaaggaagctctgtcctac

SEQ ID NO: 171906 - DNA, 25 bp, Rattus norvegicus
atactccaaggatgctctgtcctac

SEQ ID NO: 171907 - DNA, 25 bp, Rattus norvegicus
atactccacaagctcgtccaatagg

SEQ ID NO: 171908 - DNA, 25 bp, Rattus norvegicus
atactccacaaggtcgtccaatagg

SEQ ID NO: 171909 - DNA, 25 bp, Rattus norvegicus
atactccactgtctgctgggaaaac

SEQ ID NO: 171910 - DNA, 25 bp, Rattus norvegicus
atactccactgtgtgctgggaaaac

SEQ ID NO: 171911 - DNA, 25 bp, Rattus norvegicus
atactccatgccaagaacactatta

SEQ ID NO: 171912 - DNA, 25 bp, Rattus norvegicus
atactccatgcctagaacactatta

SEQ ID NO: 171913 - DNA, 25 bp, Rattus norvegicus
atactcccaactaatgtctgacatg

SEQ ID NO: 171914 - DNA, 25 bp, Rattus norvegicus
atactcccaacttatgtctgacatg

SEQ ID NO: 171915 - DNA, 25 bp, Rattus norvegicus
atactcccagcaacgggttacaggg

SEQ ID NO: 171916 - DNA, 25 bp, Rattus norvegicus
atactcccagcatcgggttacaggg

SEQ ID NO: 171917 - DNA, 25 bp, Rattus norvegicus
atactccccagtctcgtggttaatg

SEQ ID NO: 171918 - DNA, 25 bp, Rattus norvegicus
atactccccagtgtcgtggttaatg

SEQ ID NO: 171919 - DNA, 25 bp, Rattus norvegicus
atactcccctgacccaaatgtggga

SEQ ID NO: 171920 - DNA, 25 bp, Rattus norvegicus
atactcccctgagccaaatgtggga

SEQ ID NO: 171921 - DNA, 25 bp, Rattus norvegicus
atactcccgataccatgatgttctg

SEQ ID NO: 171922 - DNA, 25 bp, Rattus norvegicus
atactcccgatagcatgatgttctg

SEQ ID NO: 171923 - DNA, 25 bp, Rattus norvegicus
atactccctacaacctgcatgaaga

SEQ ID NO: 171924 - DNA, 25 bp, Rattus norvegicus
atactccctacatcctgcatgaaga

SEQ ID NO: 171925 - DNA, 25 bp, Rattus norvegicus
atactccctgataccactttgtatg

SEQ ID NO: 171926 - DNA, 25 bp, Rattus norvegicus
atactccctgattccactttgtatg

SEQ ID NO: 171927 - DNA, 25 bp, Rattus norvegicus
atactccgcaggctgcttatgctga

SEQ ID NO: 171928 - DNA, 25 bp, Rattus norvegicus
atactccgcagggtgcttatgctga

SEQ ID NO: 171929 - DNA, 25 bp, Rattus norvegicus
atactcctaacacttcttgggactg

SEQ ID NO: 171930 - DNA, 25 bp, Rattus norvegicus
atactcctaacagttcttgggactg

SEQ ID NO: 171931 - DNA, 25 bp, Rattus norvegicus
atactcctcaacaatgtccgcaaga

SEQ ID NO: 171932 - DNA, 25 bp, Rattus norvegicus
atactcctcaactatgtccgcaaga

SEQ ID NO: 171933 - DNA, 25 bp, Rattus norvegicus
atactcctccacagaccagtgcaaa

SEQ ID NO: 171934 - DNA, 25 bp, Rattus norvegicus
atactcctccactgaccagtgcaaa

SEQ ID NO: 171935 - DNA, 25 bp, Rattus norvegicus
atactcctgattataagctgcctac

SEQ ID NO: 171936 - DNA, 25 bp, Rattus norvegicus
atactcctgattttaagctgcctac

SEQ ID NO: 171937 - DNA, 25 bp, Rattus norvegicus
atactcctgggtcatgtccatggtc

SEQ ID NO: 171938 - DNA, 25 bp, Rattus norvegicus
atactcctgggtgatgtccatggtc

SEQ ID NO: 171939 - DNA, 25 bp, Rattus norvegicus
atactcctgtgtacaccatcctgta

SEQ ID NO: 171940 - DNA, 25 bp, Rattus norvegicus
atactcctgtgttcaccatcctgta

SEQ ID NO: 171941 - DNA, 25 bp, Rattus norvegicus
atactcctgttaagccatttaccac

SEQ ID NO: 171942 - DNA, 25 bp, Rattus norvegicus
atactcctgttatgccatttaccac

SEQ ID NO: 171943 - DNA, 25 bp, Rattus norvegicus
atactcctgttcattacgtctccat

SEQ ID NO: 171944 - DNA, 25 bp, Rattus norvegicus
atactcctgttctttacgtctccat

SEQ ID NO: 171945 - DNA, 25 bp, Rattus norvegicus
atactccttacaagccaattcgcaa

SEQ ID NO: 171946 - DNA, 25 bp, Rattus norvegicus
atactccttacatgccaattcgcaa

SEQ ID NO: 171947 - DNA, 25 bp, Rattus norvegicus
atactcctttgaaggtcgggacgtg

SEQ ID NO: 171948 - DNA, 25 bp, Rattus norvegicus
atactcctttgatggtcgggacgtg

SEQ ID NO: 171949 - DNA, 25 bp, Rattus norvegicus
atactcctttggctggtatctggca

SEQ ID NO: 171950 - DNA, 25 bp, Rattus norvegicus
atactcctttgggtggtatctggca

SEQ ID NO: 171951 - DNA, 25 bp, Rattus norvegicus
atactcgactcactccagctaggaa

SEQ ID NO: 171952 - DNA, 25 bp, Rattus norvegicus
atactcgactcagtccagctaggaa

SEQ ID NO: 171953 - DNA, 25 bp, Rattus norvegicus
atactcgctgttcgtgtcgtcctgg

SEQ ID NO: 171954 - DNA, 25 bp, Rattus norvegicus
atactcgctgttggtgtcgtcctgg

SEQ ID NO: 171955 - DNA, 25 bp, Rattus norvegicus
atactcggctggaagctctttctag

SEQ ID NO: 171956 - DNA, 25 bp, Rattus norvegicus
atactcggctggtagctctttctag

SEQ ID NO: 171957 - DNA, 25 bp, Rattus norvegicus
atactcgtgtaccagcaaatgctag

SEQ ID NO: 171958 - DNA, 25 bp, Rattus norvegicus
atactcgtgtacgagcaaatgctag

SEQ ID NO: 171959 - DNA, 25 bp, Rattus norvegicus
atactctaacgaatggaaaccctgt

SEQ ID NO: 171960 - DNA, 25 bp, Rattus norvegicus
atactctaacgattggaaaccctgt

SEQ ID NO: 171961 - DNA, 25 bp, Rattus norvegicus
atactctacattatcaggctatctt

SEQ ID NO: 171962 - DNA, 25 bp, Rattus norvegicus
atactctacattttcaggctatctt

SEQ ID NO: 171963 - DNA, 25 bp, Rattus norvegicus
atactctagggtctgcaagcctaaa

SEQ ID NO: 171964 - DNA, 25 bp, Rattus norvegicus
atactctagggtgtgcaagcctaaa

SEQ ID NO: 171965 - DNA, 25 bp, Rattus norvegicus
atactctcaagacctctggccgcat

SEQ ID NO: 171966 - DNA, 25 bp, Rattus norvegicus
atactctcaagagctctggccgcat

SEQ ID NO: 171967 - DNA, 25 bp, Rattus norvegicus
atactctcactaagaatcctgtgtg

SEQ ID NO: 171968 - DNA, 25 bp, Rattus norvegicus
atactctcactatgaatcctgtgtg

SEQ ID NO: 171969 - DNA, 25 bp, Rattus norvegicus
atactctcagtcatacaccccagaa

SEQ ID NO: 171970 - DNA, 25 bp, Rattus norvegicus
atactctcagtcttacaccccagaa

SEQ ID NO: 171971 - DNA, 25 bp, Rattus norvegicus
atactctcataccatttcagtgcag

SEQ ID NO: 171972 - DNA, 25 bp, Rattus norvegicus
atactctcatacgatttcagtgcag

SEQ ID NO: 171973 - DNA, 25 bp, Rattus norvegicus
atactctctcgaccaaatgcaacga

SEQ ID NO: 171974 - DNA, 25 bp, Rattus norvegicus
atactctctcgagcaaatgcaacga

SEQ ID NO: 171975 - DNA, 25 bp, Rattus norvegicus
atactctcttaaccggtggcgccca

SEQ ID NO: 171976 - DNA, 25 bp, Rattus norvegicus
atactctcttaagcggtggcgccca

SEQ ID NO: 171977 - DNA, 25 bp, Rattus norvegicus
atactctgaaatctagtcttctaga

SEQ ID NO: 171978 - DNA, 25 bp, Rattus norvegicus
atactctgaaatgtagtcttctaga

SEQ ID NO: 171979 - DNA, 25 bp, Rattus norvegicus
atactctgactgcagtgtattgctg

SEQ ID NO: 171980 - DNA, 25 bp, Rattus norvegicus
atactctgactggagtgtattgctg

SEQ ID NO: 171981 - DNA, 25 bp, Rattus norvegicus
atactctgagctatctcatctcctc

SEQ ID NO: 171982 - DNA, 25 bp, Rattus norvegicus
atactctgagctttctcatctcctc

SEQ ID NO: 171983 - DNA, 25 bp, Rattus norvegicus
atactctgctatctccgtgaagcat

SEQ ID NO: 171984 - DNA, 25 bp, Rattus norvegicus
atactctgctatgtccgtgaagcat

SEQ ID NO: 171985 - DNA, 25 bp, Rattus norvegicus
atactctggcttctggtgtagttca

SEQ ID NO: 171986 - DNA, 25 bp, Rattus norvegicus
atactctggcttgtggtgtagttca

SEQ ID NO: 171987 - DNA, 25 bp, Rattus norvegicus
atactctgggatcctctgcgtacaa

SEQ ID NO: 171988 - DNA, 25 bp, Rattus norvegicus
atactctgggatgctctgcgtacaa

SEQ ID NO: 171989 - DNA, 25 bp, Rattus norvegicus
atactctgtcagaccaggcaagatt

SEQ ID NO: 171990 - DNA, 25 bp, Rattus norvegicus
atactctgtcagtccaggcaagatt

SEQ ID NO: 171991 - DNA, 25 bp, Rattus norvegicus
atactcttaaagacatcccgtctgt

SEQ ID NO: 171992 - DNA, 25 bp, Rattus norvegicus
atactcttaaagtcatcccgtctgt

SEQ ID NO: 171993 - DNA, 25 bp, Rattus norvegicus
atactcttacctctgtgtccatgtt

SEQ ID NO: 171994 - DNA, 25 bp, Rattus norvegicus
atactcttacctgtgtgtccatgtt

SEQ ID NO: 171995 - DNA, 25 bp, Rattus norvegicus
atactcttccccaaggcttgttagt

SEQ ID NO: 171996 - DNA, 25 bp, Rattus norvegicus
atactcttcccctaggcttgttagt

SEQ ID NO: 171997 - DNA, 25 bp, Rattus norvegicus
atactcttccctctagagtctgtga

SEQ ID NO: 171998 - DNA, 25 bp, Rattus norvegicus
atactcttccctgtagagtctgtga

SEQ ID NO: 171999 - DNA, 25 bp, Rattus norvegicus
atactcttctagctcttttgtacac

SEQ ID NO: 172000 - DNA, 25 bp, Rattus norvegicus
atactcttctaggtcttttgtacac

SEQ ID NO: 172001 - DNA, 25 bp, Rattus norvegicus
atactcttctgccttttaagtccag

SEQ ID NO: 172002 - DNA, 25 bp, Rattus norvegicus
atactcttctgcgttttaagtccag

SEQ ID NO: 172003 - DNA, 25 bp, Rattus norvegicus
atactcttgactataccatgcttct

SEQ ID NO: 172004 - DNA, 25 bp, Rattus norvegicus
atactcttgactttaccatgcttct

SEQ ID NO: 172005 - DNA, 25 bp, Rattus norvegicus
atactcttgcatatcattttctcaa

SEQ ID NO: 172006 - DNA, 25 bp, Rattus norvegicus
atactcttgcatttcattttctcaa

SEQ ID NO: 172007 - DNA, 25 bp, Rattus norvegicus
atactctttccgaaatcactcacaa

SEQ ID NO: 172008 - DNA, 25 bp, Rattus norvegicus
atactctttccgtaatcactcacaa

SEQ ID NO: 172009 - DNA, 25 bp, Rattus norvegicus
atactctttggtagggcttttcctg

SEQ ID NO: 172010 - DNA, 25 bp, Rattus norvegicus
atactctttggttgggcttttcctg

SEQ ID NO: 172011 - DNA, 25 bp, Rattus norvegicus
atactcttttgaagggcaacagccc

SEQ ID NO: 172012 - DNA, 25 bp, Rattus norvegicus
atactcttttgatgggcaacagccc

SEQ ID NO: 172013 - DNA, 25 bp, Rattus norvegicus
atactgaactgtcttgtcttcccaa

SEQ ID NO: 172014 - DNA, 25 bp, Rattus norvegicus
atactgaactgtgttgtcttcccaa

SEQ ID NO: 172015 - DNA, 25 bp, Rattus norvegicus
atactgaactttcacctactttgtg

SEQ ID NO: 172016 - DNA, 25 bp, Rattus norvegicus
atactgaactttgacctactttgtg

SEQ ID NO: 172017 - DNA, 25 bp, Rattus norvegicus
atactgaagcacagactccgctgtc

SEQ ID NO: 172018 - DNA, 25 bp, Rattus norvegicus
atactgaagcactgactccgctgtc

SEQ ID NO: 172019 - DNA, 25 bp, Rattus norvegicus
atactgaataaactttccctcgccg

SEQ ID NO: 172020 - DNA, 25 bp, Rattus norvegicus
atactgaataaagtttccctcgccg

SEQ ID NO: 172021 - DNA, 25 bp, Rattus norvegicus
atactgaatgttactgagtcttttc

SEQ ID NO: 172022 - DNA, 25 bp, Rattus norvegicus
atactgaatgtttctgagtcttttc

SEQ ID NO: 172023 - DNA, 25 bp, Rattus norvegicus
atactgacaagcattctgcattgaa

SEQ ID NO: 172024 - DNA, 25 bp, Rattus norvegicus
atactgacaagctttctgcattgaa

SEQ ID NO: 172025 - DNA, 25 bp, Rattus norvegicus
atactgacacttagcctgactggga

SEQ ID NO: 172026 - DNA, 25 bp, Rattus norvegicus
atactgacactttgcctgactggga

SEQ ID NO: 172027 - DNA, 25 bp, Rattus norvegicus
atactgacagaactggtggtttcca

SEQ ID NO: 172028 - DNA, 25 bp, Rattus norvegicus
atactgacagaagtggtggtttcca

SEQ ID NO: 172029 - DNA, 25 bp, Rattus norvegicus
atactgacagcacctttcaccaagg

SEQ ID NO: 172030 - DNA, 25 bp, Rattus norvegicus
atactgacagcagctttcaccaagg

SEQ ID NO: 172031 - DNA, 25 bp, Rattus norvegicus
atactgacagttaatatgatggacc

SEQ ID NO: 172032 - DNA, 25 bp, Rattus norvegicus
atactgacagtttatatgatggacc

SEQ ID NO: 172033 - DNA, 25 bp, Rattus norvegicus
atactgacatgcctgaagacacttc

SEQ ID NO: 172034 - DNA, 25 bp, Rattus norvegicus
atactgacatgcgtgaagacacttc

SEQ ID NO: 172035 - DNA, 25 bp, Rattus norvegicus
atactgacatgtccgagtgccacct

SEQ ID NO: 172036 - DNA, 25 bp, Rattus norvegicus
atactgacatgtgcgagtgccacct

SEQ ID NO: 172037 - DNA, 25 bp, Rattus norvegicus
atactgaccatgacttcgaattgga

SEQ ID NO: 172038 - DNA, 25 bp, Rattus norvegicus
atactgaccatgtcttcgaattgga

SEQ ID NO: 172039 - DNA, 25 bp, Rattus norvegicus
atactgacctttcaaagagctgccc

SEQ ID NO: 172040 - DNA, 25 bp, Rattus norvegicus
atactgacctttgaaagagctgccc

SEQ ID NO: 172041 - DNA, 25 bp, Rattus norvegicus
atactgactggtatcctcaaacctc

SEQ ID NO: 172042 - DNA, 25 bp, Rattus norvegicus
atactgactggtcagacttggtgca

SEQ ID NO: 172043 - DNA, 25 bp, Rattus norvegicus
atactgactggtgagacttggtgca

SEQ ID NO: 172044 - DNA, 25 bp, Rattus norvegicus
atactgactggtttcctcaaacctc

SEQ ID NO: 172045 - DNA, 25 bp, Rattus norvegicus
atactgactgtaaagctaacccaag

SEQ ID NO: 172046 - DNA, 25 bp, Rattus norvegicus
atactgactgtacggtttgctcacc

SEQ ID NO: 172047 - DNA, 25 bp, Rattus norvegicus
atactgactgtagggtttgctcacc

SEQ ID NO: 172048 - DNA, 25 bp, Rattus norvegicus
atactgactgtatagctaacccaag

SEQ ID NO: 172049 - DNA, 25 bp, Rattus norvegicus
atactgacttccaacaaattgtgtt

SEQ ID NO: 172050 - DNA, 25 bp, Rattus norvegicus
atactgacttcctacaaattgtgtt

SEQ ID NO: 172051 - DNA, 25 bp, Rattus norvegicus
atactgacttttaagacctttggtg

SEQ ID NO: 172052 - DNA, 25 bp, Rattus norvegicus
atactgactttttagacctttggtg

SEQ ID NO: 172053 - DNA, 25 bp, Rattus norvegicus
atactgagaactagggcaattgctt

SEQ ID NO: 172054 - DNA, 25 bp, Rattus norvegicus
atactgagaacttgggcaattgctt

SEQ ID NO: 172055 - DNA, 25 bp, Rattus norvegicus
atactgagaagactctctcccactc

SEQ ID NO: 172056 - DNA, 25 bp, Rattus norvegicus
atactgagaagagtctctcccactc

SEQ ID NO: 172057 - DNA, 25 bp, Rattus norvegicus
atactgagatctcagcccctcaagg

SEQ ID NO: 172058 - DNA, 25 bp, Rattus norvegicus
atactgagatctgagcccctcaagg

SEQ ID NO: 172059 - DNA, 25 bp, Rattus norvegicus
atactgagcatgaccatggccttgt

SEQ ID NO: 172060 - DNA, 25 bp, Rattus norvegicus
atactgagcatgtccatggccttgt

SEQ ID NO: 172061 - DNA, 25 bp, Rattus norvegicus
atactgaggatgatgcaccgcaacg

SEQ ID NO: 172062 - DNA, 25 bp, Rattus norvegicus
atactgaggatgttgcaccgcaacg

SEQ ID NO: 172063 - DNA, 25 bp, Rattus norvegicus
atactgaggtggaccaagccctgtg

SEQ ID NO: 172064 - DNA, 25 bp, Rattus norvegicus
atactgaggtggtccaagccctgtg

SEQ ID NO: 172065 - DNA, 25 bp, Rattus norvegicus
atactgaggttgacattggctggaa

SEQ ID NO: 172066 - DNA, 25 bp, Rattus norvegicus
atactgaggttgtcattggctggaa

SEQ ID NO: 172067 - DNA, 25 bp, Rattus norvegicus
atactgagtattacctctgcatcca

SEQ ID NO: 172068 - DNA, 25 bp, Rattus norvegicus
atactgagtatttcctctgcatcca

SEQ ID NO: 172069 - DNA, 25 bp, Rattus norvegicus
atactgagtggaaaacaggcccaaa

SEQ ID NO: 172070 - DNA, 25 bp, Rattus norvegicus
atactgagtggataacaggcccaaa

SEQ ID NO: 172071 - DNA, 25 bp, Rattus norvegicus
atactgatactcctgttcgccgtta

SEQ ID NO: 172072 - DNA, 25 bp, Rattus norvegicus
atactgatactcgtgttcgccgtta

SEQ ID NO: 172073 - DNA, 25 bp, Rattus norvegicus
atactgatcctcctgaagattgcca

SEQ ID NO: 172074 - DNA, 25 bp, Rattus norvegicus
atactgatcctcgtgaagattgcca

SEQ ID NO: 172075 - DNA, 25 bp, Rattus norvegicus
atactgatgttgcttcgcttgatga

SEQ ID NO: 172076 - DNA, 25 bp, Rattus norvegicus
atactgatgttggttcgcttgatga

SEQ ID NO: 172077 - DNA, 25 bp, Rattus norvegicus
atactgattagtaaagcctcttagc

SEQ ID NO: 172078 - DNA, 25 bp, Rattus norvegicus
atactgattagttaagcctcttagc

SEQ ID NO: 172079 - DNA, 25 bp, Rattus norvegicus
atactgatttcaccatttaactgag

SEQ ID NO: 172080 - DNA, 25 bp, Rattus norvegicus
atactgatttcagcatttaactgag

SEQ ID NO: 172081 - DNA, 25 bp, Rattus norvegicus
atactgcaaacaactggaggccctc

SEQ ID NO: 172082 - DNA, 25 bp, Rattus norvegicus
atactgcaaacatctggaggccctc

SEQ ID NO: 172083 - DNA, 25 bp, Rattus norvegicus
atactgcaagtaactccatcacatt

SEQ ID NO: 172084 - DNA, 25 bp, Rattus norvegicus
atactgcaagtatctccatcacatt

SEQ ID NO: 172085 - DNA, 25 bp, Rattus norvegicus
atactgcaagtccaaggctactctg

SEQ ID NO: 172086 - DNA, 25 bp, Rattus norvegicus
atactgcaagtcgaaggctactctg

SEQ ID NO: 172087 - DNA, 25 bp, Rattus norvegicus
atactgcacagcaccgggcaatacc

SEQ ID NO: 172088 - DNA, 25 bp, Rattus norvegicus
atactgcacagctccgggcaatacc

SEQ ID NO: 172089 - DNA, 25 bp, Rattus norvegicus
atactgcactgtacactctgacata

SEQ ID NO: 172090 - DNA, 25 bp, Rattus norvegicus
atactgcactgttcactctgacata

SEQ ID NO: 172091 - DNA, 25 bp, Rattus norvegicus
atactgcagctcaggacctgggagc

SEQ ID NO: 172092 - DNA, 25 bp, Rattus norvegicus
atactgcagctctggacctgggagc

SEQ ID NO: 172093 - DNA, 25 bp, Rattus norvegicus
atactgcattatacatcctttcaaa

SEQ ID NO: 172094 - DNA, 25 bp, Rattus norvegicus
atactgcattattcatcctttcaaa

SEQ ID NO: 172095 - DNA, 25 bp, Rattus norvegicus
atactgcattctcttcctccttttg

SEQ ID NO: 172096 - DNA, 25 bp, Rattus norvegicus
atactgcattctgttcctccttttg

SEQ ID NO: 172097 - DNA, 25 bp, Rattus norvegicus
atactgccagcccataagaggtacc

SEQ ID NO: 172098 - DNA, 25 bp, Rattus norvegicus
atactgccagccgataagaggtacc

SEQ ID NO: 172099 - DNA, 25 bp, Rattus norvegicus
atactgccagtaactatctgtctcc

SEQ ID NO: 172100 - DNA, 25 bp, Rattus norvegicus
atactgccagtatctatctgtctcc

SEQ ID NO: 172101 - DNA, 25 bp, Rattus norvegicus
atactgcccgacatagcctttagct

SEQ ID NO: 172102 - DNA, 25 bp, Rattus norvegicus
atactgcccgacttagcctttagct

SEQ ID NO: 172103 - DNA, 25 bp, Rattus norvegicus
atactgccctttcgagagtgaccgt

SEQ ID NO: 172104 - DNA, 25 bp, Rattus norvegicus
atactgccctttggagagtgaccgt

SEQ ID NO: 172105 - DNA, 25 bp, Rattus norvegicus
atactgcctgctaacctacatgtaa

SEQ ID NO: 172106 - DNA, 25 bp, Rattus norvegicus
atactgcctgcttacctacatgtaa

SEQ ID NO: 172107 - DNA, 25 bp, Rattus norvegicus
atactgcgccatagccagagactgt

SEQ ID NO: 172108 - DNA, 25 bp, Rattus norvegicus
atactgcgccattgccagagactgt

SEQ ID NO: 172109 - DNA, 25 bp, Rattus norvegicus
atactgctacttatatgaccacttg

SEQ ID NO: 172110 - DNA, 25 bp, Rattus norvegicus
atactgctacttttatgaccacttg

SEQ ID NO: 172111 - DNA, 25 bp, Rattus norvegicus
atactgctatttactgtctgttcat

SEQ ID NO: 172112 - DNA, 25 bp, Rattus norvegicus
atactgctattttctgtctgttcat

SEQ ID NO: 172113 - DNA, 25 bp, Rattus norvegicus
atactgctcgaaatctaggtcttca

SEQ ID NO: 172114 - DNA, 25 bp, Rattus norvegicus
atactgctcgaattctaggtcttca

SEQ ID NO: 172115 - DNA, 25 bp, Rattus norvegicus
atactgctcttccagggtccttagt

SEQ ID NO: 172116 - DNA, 25 bp, Rattus norvegicus
atactgctcttcgagggtccttagt

SEQ ID NO: 172117 - DNA, 25 bp, Rattus norvegicus
atactgctgactcacctgaaggaca

SEQ ID NO: 172118 - DNA, 25 bp, Rattus norvegicus
atactgctgactgacctgaaggaca

SEQ ID NO: 172119 - DNA, 25 bp, Rattus norvegicus
atactgctggcccagttgtttagca

SEQ ID NO: 172120 - DNA, 25 bp, Rattus norvegicus
atactgctggccgagttgtttagca

SEQ ID NO: 172121 - DNA, 25 bp, Rattus norvegicus
atactgcttacaagttgggcccgag

SEQ ID NO: 172122 - DNA, 25 bp, Rattus norvegicus
atactgcttacatgttgggcccgag

SEQ ID NO: 172123 - DNA, 25 bp, Rattus norvegicus
atactgcttccgattgactttcaat

SEQ ID NO: 172124 - DNA, 25 bp, Rattus norvegicus
atactgcttccgtttgactttcaat

SEQ ID NO: 172125 - DNA, 25 bp, Rattus norvegicus
atactgcttctgactggagtggtgc

SEQ ID NO: 172126 - DNA, 25 bp, Rattus norvegicus
atactgcttctgtctggagtggtgc

SEQ ID NO: 172127 - DNA, 25 bp, Rattus norvegicus
atactggaaaccctgaaacttgtca

SEQ ID NO: 172128 - DNA, 25 bp, Rattus norvegicus
atactggaaaccgtgaaacttgtca

SEQ ID NO: 172129 - DNA, 25 bp, Rattus norvegicus
atactggaattgatacgcgcgtgac

SEQ ID NO: 172130 - DNA, 25 bp, Rattus norvegicus
atactggaattgttacgcgcgtgac

SEQ ID NO: 172131 - DNA, 25 bp, Rattus norvegicus
atactggagagtacttccgagacca

SEQ ID NO: 172132 - DNA, 25 bp, Rattus norvegicus
atactggagagttcttccgagacca

SEQ ID NO: 172133 - DNA, 25 bp, Rattus norvegicus
atactggagccaccatgtgtaagga

SEQ ID NO: 172134 - DNA, 25 bp, Rattus norvegicus
atactggagccagcatgtgtaagga

SEQ ID NO: 172135 - DNA, 25 bp, Rattus norvegicus
atactggccctgaatacacttggga

SEQ ID NO: 172136 - DNA, 25 bp, Rattus norvegicus
atactggccctgtatacacttggga

SEQ ID NO: 172137 - DNA, 25 bp, Rattus norvegicus
atactggcctctagctcttcacctg

SEQ ID NO: 172138 - DNA, 25 bp, Rattus norvegicus
atactggcctcttgctcttcacctg

SEQ ID NO: 172139 - DNA, 25 bp, Rattus norvegicus
atactggcttatattctaatttaca

SEQ ID NO: 172140 - DNA, 25 bp, Rattus norvegicus
atactggcttattttctaatttaca

SEQ ID NO: 172141 - DNA, 25 bp, Rattus norvegicus
atactgggaatccagctcagagccc

SEQ ID NO: 172142 - DNA, 25 bp, Rattus norvegicus
atactgggaatcgagctcagagccc

SEQ ID NO: 172143 - DNA, 25 bp, Rattus norvegicus
atactgggacccagtaatacagttc

SEQ ID NO: 172144 - DNA, 25 bp, Rattus norvegicus
atactgggaccctgtaatacagttc

SEQ ID NO: 172145 - DNA, 25 bp, Rattus norvegicus
atactgggaggacgtcgccatgcta

SEQ ID NO: 172146 - DNA, 25 bp, Rattus norvegicus
atactgggaggaggtcgccatgcta

SEQ ID NO: 172147 - DNA, 25 bp, Rattus norvegicus
atactgggtaaaatttcttggcaag

SEQ ID NO: 172148 - DNA, 25 bp, Rattus norvegicus
atactgggtaaattttcttggcaag

SEQ ID NO: 172149 - DNA, 25 bp, Rattus norvegicus
atactgggtagaccttccgttctgc

SEQ ID NO: 172150 - DNA, 25 bp, Rattus norvegicus
atactgggtagagcttccgttctgc

SEQ ID NO: 172151 - DNA, 25 bp, Rattus norvegicus
atactgggtctcctttctcaacata

SEQ ID NO: 172152 - DNA, 25 bp, Rattus norvegicus
atactgggtctcgtttctcaacata

SEQ ID NO: 172153 - DNA, 25 bp, Rattus norvegicus
atactgggtgatcatcctgcaacat

SEQ ID NO: 172154 - DNA, 25 bp, Rattus norvegicus
atactgggtgatgatcctgcaacat

SEQ ID NO: 172155 - DNA, 25 bp, Rattus norvegicus
atactgggtgctacatataggaact

SEQ ID NO: 172156 - DNA, 25 bp, Rattus norvegicus
atactgggtgcttcatataggaact

SEQ ID NO: 172157 - DNA, 25 bp, Rattus norvegicus
atactggtacccaaatctgccattt

SEQ ID NO: 172158 - DNA, 25 bp, Rattus norvegicus
atactggtaccctaatctgccattt

SEQ ID NO: 172159 - DNA, 25 bp, Rattus norvegicus
atactggtcatgatcttggttctgt

SEQ ID NO: 172160 - DNA, 25 bp, Rattus norvegicus
atactggtcatgttcttggttctgt

SEQ ID NO: 172161 - DNA, 25 bp, Rattus norvegicus
atactggtctgcatactactgtcac

SEQ ID NO: 172162 - DNA, 25 bp, Rattus norvegicus
atactggtctgcttactactgtcac

SEQ ID NO: 172163 - DNA, 25 bp, Rattus norvegicus
atactggtggaaactctaacttagg

SEQ ID NO: 172164 - DNA, 25 bp, Rattus norvegicus
atactggtggaatctctaacttagg

SEQ ID NO: 172165 - DNA, 25 bp, Rattus norvegicus
atactggtgtgtcagcgacggactc

SEQ ID NO: 172166 - DNA, 25 bp, Rattus norvegicus
atactggtgtgtcctttggtgatgc

SEQ ID NO: 172167 - DNA, 25 bp, Rattus norvegicus
atactggtgtgtgagcgacggactc

SEQ ID NO: 172168 - DNA, 25 bp, Rattus norvegicus
atactggtgtgtgctttggtgatgc

SEQ ID NO: 172169 - DNA, 25 bp, Rattus norvegicus
atactggttgttagcccattttcct

SEQ ID NO: 172170 - DNA, 25 bp, Rattus norvegicus
atactggttgtttgcccattttcct

SEQ ID NO: 172171 - DNA, 25 bp, Rattus norvegicus
atactggttttgcttgaatgactta

SEQ ID NO: 172172 - DNA, 25 bp, Rattus norvegicus
atactggttttggttgaatgactta

SEQ ID NO: 172173 - DNA, 25 bp, Rattus norvegicus
atactgtaccctatattttgcccat

SEQ ID NO: 172174 - DNA, 25 bp, Rattus norvegicus
atactgtaccctttattttgcccat

SEQ ID NO: 172175 - DNA, 25 bp, Rattus norvegicus
atactgtatctactcaagtctccag

SEQ ID NO: 172176 - DNA, 25 bp, Rattus norvegicus
atactgtatctagtcaagtctccag

SEQ ID NO: 172177 - DNA, 25 bp, Rattus norvegicus
atactgtatgttatggtaccattca

SEQ ID NO: 172178 - DNA, 25 bp, Rattus norvegicus
atactgtatgttttggtaccattca

SEQ ID NO: 172179 - DNA, 25 bp, Rattus norvegicus
atactgtcacaactggaggtgtcga

SEQ ID NO: 172180 - DNA, 25 bp, Rattus norvegicus
atactgtcacaagtggaggtgtcga

SEQ ID NO: 172181 - DNA, 25 bp, Rattus norvegicus
atactgtcatccatgggtttctttt

SEQ ID NO: 172182 - DNA, 25 bp, Rattus norvegicus
atactgtcatccttgggtttctttt

SEQ ID NO: 172183 - DNA, 25 bp, Rattus norvegicus
atactgtcccacagatagtgcttat

SEQ ID NO: 172184 - DNA, 25 bp, Rattus norvegicus
atactgtcccactgatagtgcttat

SEQ ID NO: 172185 - DNA, 25 bp, Rattus norvegicus
atactgtccccacagtctggctctg

SEQ ID NO: 172186 - DNA, 25 bp, Rattus norvegicus
atactgtccccagagtctggctctg

SEQ ID NO: 172187 - DNA, 25 bp, Rattus norvegicus
atactgtcccttagcaactcggtgt

SEQ ID NO: 172188 - DNA, 25 bp, Rattus norvegicus
atactgtccctttgcaactcggtgt

SEQ ID NO: 172189 - DNA, 25 bp, Rattus norvegicus
atactgtcctagagcttagtcagaa

SEQ ID NO: 172190 - DNA, 25 bp, Rattus norvegicus
atactgtcctagtgcttagtcagaa

SEQ ID NO: 172191 - DNA, 25 bp, Rattus norvegicus
atactgtcctataacgattctcctg

SEQ ID NO: 172192 - DNA, 25 bp, Rattus norvegicus
atactgtcctattacgattctcctg

SEQ ID NO: 172193 - DNA, 25 bp, Rattus norvegicus
atactgtcgacacaccccaggcttt

SEQ ID NO: 172194 - DNA, 25 bp, Rattus norvegicus
atactgtcgacagaccccaggcttt

SEQ ID NO: 172195 - DNA, 25 bp, Rattus norvegicus
atactgtcgtgtctgaaggcctggc

SEQ ID NO: 172196 - DNA, 25 bp, Rattus norvegicus
atactgtcgtgtgtgaaggcctggc

SEQ ID NO: 172197 - DNA, 25 bp, Rattus norvegicus
atactgtgaggaccatgcccggagc

SEQ ID NO: 172198 - DNA, 25 bp, Rattus norvegicus
atactgtgaggagcatgcccggagc

SEQ ID NO: 172199 - DNA, 25 bp, Rattus norvegicus
atactgtgagtgacccagggctttc

SEQ ID NO: 172200 - DNA, 25 bp, Rattus norvegicus
atactgtgagtgtcccagggctttc

SEQ ID NO: 172201 - DNA, 25 bp, Rattus norvegicus
atactgtgccgtctgttatcgttaa

SEQ ID NO: 172202 - DNA, 25 bp, Rattus norvegicus
atactgtgccgtgtgttatcgttaa

SEQ ID NO: 172203 - DNA, 25 bp, Rattus norvegicus
atactgtggatacctgccttcatgg

SEQ ID NO: 172204 - DNA, 25 bp, Rattus norvegicus
atactgtggatagctgccttcatgg

SEQ ID NO: 172205 - DNA, 25 bp, Rattus norvegicus
atactgtggcagcatttctcataaa

SEQ ID NO: 172206 - DNA, 25 bp, Rattus norvegicus
atactgtggcaggatttctcataaa

SEQ ID NO: 172207 - DNA, 25 bp, Rattus norvegicus
atactgtggtatctgagtgctctca

SEQ ID NO: 172208 - DNA, 25 bp, Rattus norvegicus
atactgtggtatgtgagtgctctca

SEQ ID NO: 172209 - DNA, 25 bp, Rattus norvegicus
atactgtggtcactgagctgtctca

SEQ ID NO: 172210 - DNA, 25 bp, Rattus norvegicus
atactgtggtcagtgagctgtctca

SEQ ID NO: 172211 - DNA, 25 bp, Rattus norvegicus
atactgtgttgcatcagggcttcac

SEQ ID NO: 172212 - DNA, 25 bp, Rattus norvegicus
atactgtgttgcttcagggcttcac

SEQ ID NO: 172213 - DNA, 25 bp, Rattus norvegicus
atactgttacacattcttatcacgg

SEQ ID NO: 172214 - DNA, 25 bp, Rattus norvegicus
atactgttacactttcttatcacgg

SEQ ID NO: 172215 - DNA, 25 bp, Rattus norvegicus
atactgttcgctatcaccaagaggg

SEQ ID NO: 172216 - DNA, 25 bp, Rattus norvegicus
atactgttcgctttcaccaagaggg

SEQ ID NO: 172217 - DNA, 25 bp, Rattus norvegicus
atactgttgcccatattttttcctg

SEQ ID NO: 172218 - DNA, 25 bp, Rattus norvegicus
atactgttgcccttattttttcctg

SEQ ID NO: 172219 - DNA, 25 bp, Rattus norvegicus
atactgtttacaccccactagtcac

SEQ ID NO: 172220 - DNA, 25 bp, Rattus norvegicus
atactgtttacagcccactagtcac

SEQ ID NO: 172221 - DNA, 25 bp, Rattus norvegicus
atactgtttctactacaggactcaa

SEQ ID NO: 172222 - DNA, 25 bp, Rattus norvegicus
atactgtttctagtacaggactcaa

SEQ ID NO: 172223 - DNA, 25 bp, Rattus norvegicus
atactgtttgtactgagaacaccac

SEQ ID NO: 172224 - DNA, 25 bp, Rattus norvegicus
atactgtttgtagtgagaacaccac

SEQ ID NO: 172225 - DNA, 25 bp, Rattus norvegicus
atactgttttgaattttcccctctg

SEQ ID NO: 172226 - DNA, 25 bp, Rattus norvegicus
atactgttttgatttttcccctctg

SEQ ID NO: 172227 - DNA, 25 bp, Rattus norvegicus
atacttacactgaagcctctgggca

SEQ ID NO: 172228 - DNA, 25 bp, Rattus norvegicus
atacttacactgtagcctctgggca

SEQ ID NO: 172229 - DNA, 25 bp, Rattus norvegicus
atacttacagacagtttcagttaga

SEQ ID NO: 172230 - DNA, 25 bp, Rattus norvegicus
atacttacagactgtttcagttaga

SEQ ID NO: 172231 - DNA, 25 bp, Rattus norvegicus
atacttactgcaacattgggtcatt

SEQ ID NO: 172232 - DNA, 25 bp, Rattus norvegicus
atacttactgcatcattgggtcatt

SEQ ID NO: 172233 - DNA, 25 bp, Rattus norvegicus
atacttacttgcacattcttttaaa

SEQ ID NO: 172234 - DNA, 25 bp, Rattus norvegicus
atacttacttgctcattcttttaaa

SEQ ID NO: 172235 - DNA, 25 bp, Rattus norvegicus
atacttagacccacagccatcagtt

SEQ ID NO: 172236 - DNA, 25 bp, Rattus norvegicus
atacttagaccctcagccatcagtt

SEQ ID NO: 172237 - DNA, 25 bp, Rattus norvegicus
atacttagccccagatattttgtgg

SEQ ID NO: 172238 - DNA, 25 bp, Rattus norvegicus
atacttagcccctgatattttgtgg

SEQ ID NO: 172239 - DNA, 25 bp, Rattus norvegicus
atacttagcttaagtttagccccgc

SEQ ID NO: 172240 - DNA, 25 bp, Rattus norvegicus
atacttagcttatgtttagccccgc

SEQ ID NO: 172241 - DNA, 25 bp, Rattus norvegicus
atacttaggatcattctgtccctgg

SEQ ID NO: 172242 - DNA, 25 bp, Rattus norvegicus
atacttaggatctttctgtccctgg

SEQ ID NO: 172243 - DNA, 25 bp, Rattus norvegicus
atacttaggctgctgaaaggtttaa

SEQ ID NO: 172244 - DNA, 25 bp, Rattus norvegicus
atacttaggctggtgaaaggtttaa

SEQ ID NO: 172245 - DNA, 25 bp, Rattus norvegicus
atacttagtttgaatccaccaccgc

SEQ ID NO: 172246 - DNA, 25 bp, Rattus norvegicus
atacttagtttgtatccaccaccgc

SEQ ID NO: 172247 - DNA, 25 bp, Rattus norvegicus
atacttatacagctgcagcaggcaa

SEQ ID NO: 172248 - DNA, 25 bp, Rattus norvegicus
atacttatacaggtgcagcaggcaa

SEQ ID NO: 172249 - DNA, 25 bp, Rattus norvegicus
atacttatactcactttatccctac

SEQ ID NO: 172250 - DNA, 25 bp, Rattus norvegicus
atacttatactctctttatccctac

SEQ ID NO: 172251 - DNA, 25 bp, Rattus norvegicus
atacttatcagcacacaatcctttg

SEQ ID NO: 172252 - DNA, 25 bp, Rattus norvegicus
atacttatcagctcacaatcctttg

SEQ ID NO: 172253 - DNA, 25 bp, Rattus norvegicus
atacttatctcacaagtcttgcttc

SEQ ID NO: 172254 - DNA, 25 bp, Rattus norvegicus
atacttatctcagaagtcttgcttc

SEQ ID NO: 172255 - DNA, 25 bp, Rattus norvegicus
atacttatgaagcagcttatacccc

SEQ ID NO: 172256 - DNA, 25 bp, Rattus norvegicus
atacttatgaaggagcttatacccc

SEQ ID NO: 172257 - DNA, 25 bp, Rattus norvegicus
atacttatgacccaatacttgttat

SEQ ID NO: 172258 - DNA, 25 bp, Rattus norvegicus
atacttatgaccgaatacttgttat

SEQ ID NO: 172259 - DNA, 25 bp, Rattus norvegicus
atacttatgatgaccctgtgcctgc

SEQ ID NO: 172260 - DNA, 25 bp, Rattus norvegicus
atacttatgatgtccctgtgcctgc

SEQ ID NO: 172261 - DNA, 25 bp, Rattus norvegicus
atacttattcccatgagacctgagc

SEQ ID NO: 172262 - DNA, 25 bp, Rattus norvegicus
atacttattcccttgagacctgagc

SEQ ID NO: 172263 - DNA, 25 bp, Rattus norvegicus
atacttcaaagcagatgtctctgca

SEQ ID NO: 172264 - DNA, 25 bp, Rattus norvegicus
atacttcaaagctgatgtctctgca

SEQ ID NO: 172265 - DNA, 25 bp, Rattus norvegicus
atacttcacattccattttgtcgtc

SEQ ID NO: 172266 - DNA, 25 bp, Rattus norvegicus
atacttcacattgcattttgtcgtc

SEQ ID NO: 172267 - DNA, 25 bp, Rattus norvegicus
atacttcaccttaggaatccgtgtt

SEQ ID NO: 172268 - DNA, 25 bp, Rattus norvegicus
atacttcacctttggaatccgtgtt

SEQ ID NO: 172269 - DNA, 25 bp, Rattus norvegicus
atacttcactttcttcatcctgttc

SEQ ID NO: 172270 - DNA, 25 bp, Rattus norvegicus
atacttcactttgttcatcctgttc

SEQ ID NO: 172271 - DNA, 25 bp, Rattus norvegicus
atacttcagaatacaaaggcttagt

SEQ ID NO: 172272 - DNA, 25 bp, Rattus norvegicus
atacttcagaattcaaaggcttagt

SEQ ID NO: 172273 - DNA, 25 bp, Rattus norvegicus
atacttcagcatatctgctcaatgg

SEQ ID NO: 172274 - DNA, 25 bp, Rattus norvegicus
atacttcagcatttctgctcaatgg

SEQ ID NO: 172275 - DNA, 25 bp, Rattus norvegicus
atacttcagtgtcgtgtcctctggc

SEQ ID NO: 172276 - DNA, 25 bp, Rattus norvegicus
atacttcagtgtggtgtcctctggc

SEQ ID NO: 172277 - DNA, 25 bp, Rattus norvegicus
atacttcatctaacccctgagggaa

SEQ ID NO: 172278 - DNA, 25 bp, Rattus norvegicus
atacttcatctatcccctgagggaa

SEQ ID NO: 172279 - DNA, 25 bp, Rattus norvegicus
atacttcatgtaactctctctctgt

SEQ ID NO: 172280 - DNA, 25 bp, Rattus norvegicus
atacttcatgtatctctctctctgt

SEQ ID NO: 172281 - DNA, 25 bp, Rattus norvegicus
atacttccaagcaaggtgttccagc

SEQ ID NO: 172282 - DNA, 25 bp, Rattus norvegicus
atacttccaagctaggtgttccagc

SEQ ID NO: 172283 - DNA, 25 bp, Rattus norvegicus
atacttccacacagtgcctttgaat

SEQ ID NO: 172284 - DNA, 25 bp, Rattus norvegicus
atacttccacactgtgcctttgaat

SEQ ID NO: 172285 - DNA, 25 bp, Rattus norvegicus
atacttccagaaccctacagattag

SEQ ID NO: 172286 - DNA, 25 bp, Rattus norvegicus
atacttccagaagcctacagattag

SEQ ID NO: 172287 - DNA, 25 bp, Rattus norvegicus
atacttccatccatccttaattagc

SEQ ID NO: 172288 - DNA, 25 bp, Rattus norvegicus
atacttccatccttccttaattagc

SEQ ID NO: 172289 - DNA, 25 bp, Rattus norvegicus
atacttccgggcagaggctgtctcc

SEQ ID NO: 172290 - DNA, 25 bp, Rattus norvegicus
atacttccgggctgaggctgtctcc

SEQ ID NO: 172291 - DNA, 25 bp, Rattus norvegicus
atacttcctccgagccacacatggt

SEQ ID NO: 172292 - DNA, 25 bp, Rattus norvegicus
atacttcctccgtgccacacatggt

SEQ ID NO: 172293 - DNA, 25 bp, Rattus norvegicus
atacttcctgagctactgtgtcacc

SEQ ID NO: 172294 - DNA, 25 bp, Rattus norvegicus
atacttcctgaggtactgtgtcacc

SEQ ID NO: 172295 - DNA, 25 bp, Rattus norvegicus
atacttccttccctgtggccattaa

SEQ ID NO: 172296 - DNA, 25 bp, Rattus norvegicus
atacttccttccgtgtggccattaa

SEQ ID NO: 172297 - DNA, 25 bp, Rattus norvegicus
atacttctatgcactgtcttatgat

SEQ ID NO: 172298 - DNA, 25 bp, Rattus norvegicus
atacttctatgctctgtcttatgat

SEQ ID NO: 172299 - DNA, 25 bp, Rattus norvegicus
atacttctcaccagattggcttatc

SEQ ID NO: 172300 - DNA, 25 bp, Rattus norvegicus
atacttctcacctgattggcttatc

SEQ ID NO: 172301 - DNA, 25 bp, Rattus norvegicus
atacttctcatcaagactgatttat

SEQ ID NO: 172302 - DNA, 25 bp, Rattus norvegicus
atacttctcatctagactgatttat

SEQ ID NO: 172303 - DNA, 25 bp, Rattus norvegicus
atacttctctccatatttccgaaat

SEQ ID NO: 172304 - DNA, 25 bp, Rattus norvegicus
atacttctctccttatttccgaaat

SEQ ID NO: 172305 - DNA, 25 bp, Rattus norvegicus
atacttctctgactatgaacactgg

SEQ ID NO: 172306 - DNA, 25 bp, Rattus norvegicus
atacttctctgagtatgaacactgg

SEQ ID NO: 172307 - DNA, 25 bp, Rattus norvegicus
atacttctctggagaggtcggttgc

SEQ ID NO: 172308 - DNA, 25 bp, Rattus norvegicus
atacttctctggtgaggtcggttgc

SEQ ID NO: 172309 - DNA, 25 bp, Rattus norvegicus
atacttctggcgagtgagtttccac

SEQ ID NO: 172310 - DNA, 25 bp, Rattus norvegicus
atacttctggcgtgtgagtttccac

SEQ ID NO: 172311 - DNA, 25 bp, Rattus norvegicus
atacttctgtccctctagttacttt

SEQ ID NO: 172312 - DNA, 25 bp, Rattus norvegicus
atacttctgtccgtctagttacttt

SEQ ID NO: 172313 - DNA, 25 bp, Rattus norvegicus
atacttctgtctacatgctttctca

SEQ ID NO: 172314 - DNA, 25 bp, Rattus norvegicus
atacttctgtcttcatgctttctca

SEQ ID NO: 172315 - DNA, 25 bp, Rattus norvegicus
atacttctgtgaagcaggcaacctg

SEQ ID NO: 172316 - DNA, 25 bp, Rattus norvegicus
atacttctgtgatgcaggcaacctg

SEQ ID NO: 172317 - DNA, 25 bp, Rattus norvegicus
atacttcttaggctgtagttgcaag

SEQ ID NO: 172318 - DNA, 25 bp, Rattus norvegicus
atacttcttagggtgtagttgcaag

SEQ ID NO: 172319 - DNA, 25 bp, Rattus norvegicus
atacttgaacatcaccctgaggtag

SEQ ID NO: 172320 - DNA, 25 bp, Rattus norvegicus
atacttgaacatgaccctgaggtag

SEQ ID NO: 172321 - DNA, 25 bp, Rattus norvegicus
atacttgaatataccgtcttgactt

SEQ ID NO: 172322 - DNA, 25 bp, Rattus norvegicus
atacttgaatattccgtcttgactt

SEQ ID NO: 172323 - DNA, 25 bp, Rattus norvegicus
atacttgacagcatggtgaccacca

SEQ ID NO: 172324 - DNA, 25 bp, Rattus norvegicus
atacttgacagcttggtgaccacca

SEQ ID NO: 172325 - DNA, 25 bp, Rattus norvegicus
atacttgagctcatgacttgtcttc

SEQ ID NO: 172326 - DNA, 25 bp, Rattus norvegicus
atacttgagctcttgacttgtcttc

SEQ ID NO: 172327 - DNA, 25 bp, Rattus norvegicus
atacttgatctaaacagtcttgtct

SEQ ID NO: 172328 - DNA, 25 bp, Rattus norvegicus
atacttgatctatacagtcttgtct

SEQ ID NO: 172329 - DNA, 25 bp, Rattus norvegicus
atacttgcatgtagcttgtgtctcc

SEQ ID NO: 172330 - DNA, 25 bp, Rattus norvegicus
atacttgcatgttgcttgtgtctcc

SEQ ID NO: 172331 - DNA, 25 bp, Rattus norvegicus
atacttgcattcagaacacgccggc

SEQ ID NO: 172332 - DNA, 25 bp, Rattus norvegicus
atacttgcattctgaacacgccggc

SEQ ID NO: 172333 - DNA, 25 bp, Rattus norvegicus
atacttgcattgatgtcagggtcaa

SEQ ID NO: 172334 - DNA, 25 bp, Rattus norvegicus
atacttgcattgttgtcagggtcaa

SEQ ID NO: 172335 - DNA, 25 bp, Rattus norvegicus
atacttgccctgagtgtccagctag

SEQ ID NO: 172336 - DNA, 25 bp, Rattus norvegicus
atacttgccctgtgtgtccagctag

SEQ ID NO: 172337 - DNA, 25 bp, Rattus norvegicus
atacttgccttaattgaacgtttag

SEQ ID NO: 172338 - DNA, 25 bp, Rattus norvegicus
atacttgccttatttgaacgtttag

SEQ ID NO: 172339 - DNA, 25 bp, Rattus norvegicus
atacttgcctttctttatacctcca

SEQ ID NO: 172340 - DNA, 25 bp, Rattus norvegicus
atacttgcctttgtttatacctcca

SEQ ID NO: 172341 - DNA, 25 bp, Rattus norvegicus
atacttgcttcgcaagtgcctggtc

SEQ ID NO: 172342 - DNA, 25 bp, Rattus norvegicus
atacttgcttcggaagtgcctggtc

SEQ ID NO: 172343 - DNA, 25 bp, Rattus norvegicus
atacttggacctccggtggcatcct

SEQ ID NO: 172344 - DNA, 25 bp, Rattus norvegicus
atacttggacctgcggtggcatcct

SEQ ID NO: 172345 - DNA, 25 bp, Rattus norvegicus
atacttggagggattgtgttccttt

SEQ ID NO: 172346 - DNA, 25 bp, Rattus norvegicus
atacttggagggtttgtgttccttt

SEQ ID NO: 172347 - DNA, 25 bp, Rattus norvegicus
atacttggcaaaaccccaggcattt

SEQ ID NO: 172348 - DNA, 25 bp, Rattus norvegicus
atacttggcaaatccccaggcattt

SEQ ID NO: 172349 - DNA, 25 bp, Rattus norvegicus
atacttggcctacgtctgctcacaa

SEQ ID NO: 172350 - DNA, 25 bp, Rattus norvegicus
atacttggcctaggtctgctcacaa

SEQ ID NO: 172351 - DNA, 25 bp, Rattus norvegicus
atacttggctaaccgttcgaaactt

SEQ ID NO: 172352 - DNA, 25 bp, Rattus norvegicus
atacttggctaagcgttcgaaactt

SEQ ID NO: 172353 - DNA, 25 bp, Rattus norvegicus
atacttggtcaacgttctcttcatc

SEQ ID NO: 172354 - DNA, 25 bp, Rattus norvegicus
atacttggtcaaggttctcttcatc

SEQ ID NO: 172355 - DNA, 25 bp, Rattus norvegicus
atacttgtcactaaggtggctcgag

SEQ ID NO: 172356 - DNA, 25 bp, Rattus norvegicus
atacttgtcactccctatctaaaat

SEQ ID NO: 172357 - DNA, 25 bp, Rattus norvegicus
atacttgtcactgcctatctaaaat

SEQ ID NO: 172358 - DNA, 25 bp, Rattus norvegicus
atacttgtcacttaggtggctcgag

SEQ ID NO: 172359 - DNA, 25 bp, Rattus norvegicus
atacttgtcatccagcacacgggaa

SEQ ID NO: 172360 - DNA, 25 bp, Rattus norvegicus
atacttgtcatcgagcacacgggaa

SEQ ID NO: 172361 - DNA, 25 bp, Rattus norvegicus
atacttgtcttacgcgtggaccaca

SEQ ID NO: 172362 - DNA, 25 bp, Rattus norvegicus
atacttgtcttaggcgtggaccaca

SEQ ID NO: 172363 - DNA, 25 bp, Rattus norvegicus
atacttgtcttcctgtctcgattgt

SEQ ID NO: 172364 - DNA, 25 bp, Rattus norvegicus
atacttgtcttcgtgtctcgattgt

SEQ ID NO: 172365 - DNA, 25 bp, Rattus norvegicus
atacttgtgatgacgagctctacct

SEQ ID NO: 172366 - DNA, 25 bp, Rattus norvegicus
atacttgtgatgtcgagctctacct

SEQ ID NO: 172367 - DNA, 25 bp, Rattus norvegicus
atacttgtggtgacagatctggtac

SEQ ID NO: 172368 - DNA, 25 bp, Rattus norvegicus
atacttgtggtgtcagatctggtac

SEQ ID NO: 172369 - DNA, 25 bp, Rattus norvegicus
atacttgttgtaatatcgtcttagg

SEQ ID NO: 172370 - DNA, 25 bp, Rattus norvegicus
atacttgttgtattatcgtcttagg

SEQ ID NO: 172371 - DNA, 25 bp, Rattus norvegicus
atactttacatgaggtagagaccgt

SEQ ID NO: 172372 - DNA, 25 bp, Rattus norvegicus
atactttacatgtggtagagaccgt

SEQ ID NO: 172373 - DNA, 25 bp, Rattus norvegicus
atactttacctaatgctatggcgct

SEQ ID NO: 172374 - DNA, 25 bp, Rattus norvegicus
atactttacctattgctatggcgct

SEQ ID NO: 172375 - DNA, 25 bp, Rattus norvegicus
atactttacttgagcatgtccgtac

SEQ ID NO: 172376 - DNA, 25 bp, Rattus norvegicus
atactttacttgtgcatgtccgtac

SEQ ID NO: 172377 - DNA, 25 bp, Rattus norvegicus
atactttatggtcgcagttcctcct

SEQ ID NO: 172378 - DNA, 25 bp, Rattus norvegicus
atactttatggtggcagttcctcct

SEQ ID NO: 172379 - DNA, 25 bp, Rattus norvegicus
atactttcagacaagctcagtgata

SEQ ID NO: 172380 - DNA, 25 bp, Rattus norvegicus
atactttcagactagctcagtgata

SEQ ID NO: 172381 - DNA, 25 bp, Rattus norvegicus
atactttcttccaaatatcctgagg

SEQ ID NO: 172382 - DNA, 25 bp, Rattus norvegicus
atactttcttcctaatatcctgagg

SEQ ID NO: 172383 - DNA, 25 bp, Rattus norvegicus
atactttcttgcatgtgtgtggccc

SEQ ID NO: 172384 - DNA, 25 bp, Rattus norvegicus
atactttcttgcttgtgtgtggccc

SEQ ID NO: 172385 - DNA, 25 bp, Rattus norvegicus
atactttgcagaacatcacgtggag

SEQ ID NO: 172386 - DNA, 25 bp, Rattus norvegicus
atactttgcagatcatcacgtggag

SEQ ID NO: 172387 - DNA, 25 bp, Rattus norvegicus
atactttgctatcttggcctacctg

SEQ ID NO: 172388 - DNA, 25 bp, Rattus norvegicus
atactttgctatgttggcctacctg

SEQ ID NO: 172389 - DNA, 25 bp, Rattus norvegicus
atactttgcttactttgccttgggt

SEQ ID NO: 172390 - DNA, 25 bp, Rattus norvegicus
atactttgcttagtttgccttgggt

SEQ ID NO: 172391 - DNA, 25 bp, Rattus norvegicus
atactttgctttcttagctcccggt

SEQ ID NO: 172392 - DNA, 25 bp, Rattus norvegicus
atactttgctttgttagctcccggt

SEQ ID NO: 172393 - DNA, 25 bp, Rattus norvegicus
atactttgggaccatcaattttagt

SEQ ID NO: 172394 - DNA, 25 bp, Rattus norvegicus
atactttgggacgatcaattttagt

SEQ ID NO: 172395 - DNA, 25 bp, Rattus norvegicus
atactttgtcccaattcagaacatg

SEQ ID NO: 172396 - DNA, 25 bp, Rattus norvegicus
atactttgtccctattcagaacatg

SEQ ID NO: 172397 - DNA, 25 bp, Rattus norvegicus
atactttgtgtaaggagctgcctgc

SEQ ID NO: 172398 - DNA, 25 bp, Rattus norvegicus
atactttgtgtatggagctgcctgc

SEQ ID NO: 172399 - DNA, 25 bp, Rattus norvegicus
atacttttatctccttaacattaat

SEQ ID NO: 172400 - DNA, 25 bp, Rattus norvegicus
atacttttatctgcttaacattaat

SEQ ID NO: 172401 - DNA, 25 bp, Rattus norvegicus
atacttttcaaaagcatatgtgggt

SEQ ID NO: 172402 - DNA, 25 bp, Rattus norvegicus
atacttttcaaatgcatatgtgggt

SEQ ID NO: 172403 - DNA, 25 bp, Rattus norvegicus
atacttttcaacacttggattctag

SEQ ID NO: 172404 - DNA, 25 bp, Rattus norvegicus
atacttttcaactcttggattctag

SEQ ID NO: 172405 - DNA, 25 bp, Rattus norvegicus
atacttttcaagactttgtctccgt

SEQ ID NO: 172406 - DNA, 25 bp, Rattus norvegicus
atacttttcaagtctttgtctccgt

SEQ ID NO: 172407 - DNA, 25 bp, Rattus norvegicus
atacttttcactaccattttgtgtg

SEQ ID NO: 172408 - DNA, 25 bp, Rattus norvegicus
atacttttcacttccattttgtgtg

SEQ ID NO: 172409 - DNA, 25 bp, Rattus norvegicus
atacttttctttattctgctaccag

SEQ ID NO: 172410 - DNA, 25 bp, Rattus norvegicus
atacttttcttttttctgctaccag

SEQ ID NO: 172411 - DNA, 25 bp, Rattus norvegicus
atacttttgaatattgctctgctag

SEQ ID NO: 172412 - DNA, 25 bp, Rattus norvegicus
atacttttgaattttgctctgctag

SEQ ID NO: 172413 - DNA, 25 bp, Rattus norvegicus
atacttttgaggcatccagccccaa

SEQ ID NO: 172414 - DNA, 25 bp, Rattus norvegicus
atacttttgagggatccagccccaa

SEQ ID NO: 172415 - DNA, 25 bp, Rattus norvegicus
atacttttgcacatactgcctgttg

SEQ ID NO: 172416 - DNA, 25 bp, Rattus norvegicus
atacttttgcacttactgcctgttg

SEQ ID NO: 172417 - DNA, 25 bp, Rattus norvegicus
atactttttacacagattctatgcg

SEQ ID NO: 172418 - DNA, 25 bp, Rattus norvegicus
atactttttacacctcctggctgag

SEQ ID NO: 172419 - DNA, 25 bp, Rattus norvegicus
atactttttacagagattctatgcg

SEQ ID NO: 172420 - DNA, 25 bp, Rattus norvegicus
atactttttacagctcctggctgag

SEQ ID NO: 172421 - DNA, 25 bp, Rattus norvegicus
atactttttagcagccattattttc

SEQ ID NO: 172422 - DNA, 25 bp, Rattus norvegicus
atactttttagctgccattattttc

SEQ ID NO: 172423 - DNA, 25 bp, Rattus norvegicus
atactttttagtctggatttctgcc

SEQ ID NO: 172424 - DNA, 25 bp, Rattus norvegicus
atactttttagtgtggatttctgcc

SEQ ID NO: 172425 - DNA, 25 bp, Rattus norvegicus
atactttttcccaccatggaactga

SEQ ID NO: 172426 - DNA, 25 bp, Rattus norvegicus
atactttttccctccatggaactga

SEQ ID NO: 172427 - DNA, 25 bp, Rattus norvegicus
atactttttgtaatcatgggctagc

SEQ ID NO: 172428 - DNA, 25 bp, Rattus norvegicus
atactttttgtattcatgggctagc

SEQ ID NO: 172429 - DNA, 25 bp, Rattus norvegicus
atactttttgttatgcaaacctgtg

SEQ ID NO: 172430 - DNA, 25 bp, Rattus norvegicus
atactttttgttttgcaaacctgtg

SEQ ID NO: 172431 - DNA, 25 bp, Rattus norvegicus
atacttttttatcctctccttcaca

SEQ ID NO: 172432 - DNA, 25 bp, Rattus norvegicus
atacttttttatgctctccttcaca

SEQ ID NO: 172433 - DNA, 25 bp, Rattus norvegicus
atagaaaagcccacatatgcaacaa

SEQ ID NO: 172434 - DNA, 25 bp, Rattus norvegicus
atagaaaagccctcatatgcaacaa

SEQ ID NO: 172435 - DNA, 25 bp, Rattus norvegicus
atagaaacagctacttctctcgtca

SEQ ID NO: 172436 - DNA, 25 bp, Rattus norvegicus
atagaaacagcttcttctctcgtca

SEQ ID NO: 172437 - DNA, 25 bp, Rattus norvegicus
atagaaacgaccctgctggcacata

SEQ ID NO: 172438 - DNA, 25 bp, Rattus norvegicus
atagaaacgaccgtgctggcacata

SEQ ID NO: 172439 - DNA, 25 bp, Rattus norvegicus
atagaaactccacgcggtcacttga

SEQ ID NO: 172440 - DNA, 25 bp, Rattus norvegicus
atagaaactccaggcggtcacttga

SEQ ID NO: 172441 - DNA, 25 bp, Rattus norvegicus
atagaaactctacctgtgaccagaa

SEQ ID NO: 172442 - DNA, 25 bp, Rattus norvegicus
atagaaactctagctgtgaccagaa

SEQ ID NO: 172443 - DNA, 25 bp, Rattus norvegicus
atagaaactctgaccgcagctgctg

SEQ ID NO: 172444 - DNA, 25 bp, Rattus norvegicus
atagaaactctgtccgcagctgctg

SEQ ID NO: 172445 - DNA, 25 bp, Rattus norvegicus
atagaaactgttcctgcagtgagct

SEQ ID NO: 172446 - DNA, 25 bp, Rattus norvegicus
atagaaactgttgctgcagtgagct

SEQ ID NO: 172447 - DNA, 25 bp, Rattus norvegicus
atagaaagacgacgagcagcagcat

SEQ ID NO: 172448 - DNA, 25 bp, Rattus norvegicus
atagaaagacgaggagcagcagcat

SEQ ID NO: 172449 - DNA, 25 bp, Rattus norvegicus
atagaaagactgcatccccgctcgt

SEQ ID NO: 172450 - DNA, 25 bp, Rattus norvegicus
atagaaagactggatccccgctcgt

SEQ ID NO: 172451 - DNA, 25 bp, Rattus norvegicus
atagaaagcccaattaggtaagcct

SEQ ID NO: 172452 - DNA, 25 bp, Rattus norvegicus
atagaaagcccatttaggtaagcct

SEQ ID NO: 172453 - DNA, 25 bp, Rattus norvegicus
atagaaagccccattccatctctgt

SEQ ID NO: 172454 - DNA, 25 bp, Rattus norvegicus
atagaaagcccctttccatctctgt

SEQ ID NO: 172455 - DNA, 25 bp, Rattus norvegicus
atagaaagccctcgttccacctctt

SEQ ID NO: 172456 - DNA, 25 bp, Rattus norvegicus
atagaaagccctggttccacctctt

SEQ ID NO: 172457 - DNA, 25 bp, Rattus norvegicus
atagaaatcccaccctgtggtggtt

SEQ ID NO: 172458 - DNA, 25 bp, Rattus norvegicus
atagaaatcccagcctgtggtggtt

SEQ ID NO: 172459 - DNA, 25 bp, Rattus norvegicus
atagaacacaacatatcccaggatt

SEQ ID NO: 172460 - DNA, 25 bp, Rattus norvegicus
atagaacacaacttatcccaggatt

SEQ ID NO: 172461 - DNA, 25 bp, Rattus norvegicus
atagaacacgtcaactcccggactt

SEQ ID NO: 172462 - DNA, 25 bp, Rattus norvegicus
atagaacacgtctactcccggactt

SEQ ID NO: 172463 - DNA, 25 bp, Rattus norvegicus
atagaacatccccttccctttgaca

SEQ ID NO: 172464 - DNA, 25 bp, Rattus norvegicus
atagaacatcccgttccctttgaca

SEQ ID NO: 172465 - DNA, 25 bp, Rattus norvegicus
atagaacatgcactgagtgtccctc

SEQ ID NO: 172466 - DNA, 25 bp, Rattus norvegicus
atagaacatgcagtgagtgtccctc

SEQ ID NO: 172467 - DNA, 25 bp, Rattus norvegicus
atagaacattccatctcactctttg

SEQ ID NO: 172468 - DNA, 25 bp, Rattus norvegicus
atagaacattccttctcactctttg

SEQ ID NO: 172469 - DNA, 25 bp, Rattus norvegicus
atagaaccagtcagccatggcaagg

SEQ ID NO: 172470 - DNA, 25 bp, Rattus norvegicus
atagaaccagtctgccatggcaagg

SEQ ID NO: 172471 - DNA, 25 bp, Rattus norvegicus
atagaaccctacaacagtttgttgt

SEQ ID NO: 172472 - DNA, 25 bp, Rattus norvegicus
atagaaccctactacagtttgttgt

SEQ ID NO: 172473 - DNA, 25 bp, Rattus norvegicus
atagaaccgaagaatccaccaccac

SEQ ID NO: 172474 - DNA, 25 bp, Rattus norvegicus
atagaaccgaagtatccaccaccac

SEQ ID NO: 172475 - DNA, 25 bp, Rattus norvegicus
atagaaccgactactctgagctttc

SEQ ID NO: 172476 - DNA, 25 bp, Rattus norvegicus
atagaaccgacttctctgagctttc

SEQ ID NO: 172477 - DNA, 25 bp, Rattus norvegicus
atagaacgcggccacttatttcatt

SEQ ID NO: 172478 - DNA, 25 bp, Rattus norvegicus
atagaacgcggcgacttatttcatt

SEQ ID NO: 172479 - DNA, 25 bp, Rattus norvegicus
atagaactagtgctttactctgctt

SEQ ID NO: 172480 - DNA, 25 bp, Rattus norvegicus
atagaactagtggtttactctgctt

SEQ ID NO: 172481 - DNA, 25 bp, Rattus norvegicus
atagaactccatattttatagcagt

SEQ ID NO: 172482 - DNA, 25 bp, Rattus norvegicus
atagaactccattttttatagcagt

SEQ ID NO: 172483 - DNA, 25 bp, Rattus norvegicus
atagaactggatattttgcctcatt

SEQ ID NO: 172484 - DNA, 25 bp, Rattus norvegicus
atagaactggattttttgcctcatt

SEQ ID NO: 172485 - DNA, 25 bp, Rattus norvegicus
atagaactgtgaataagctcggtat

SEQ ID NO: 172486 - DNA, 25 bp, Rattus norvegicus
atagaactgtgattaagctcggtat

SEQ ID NO: 172487 - DNA, 25 bp, Rattus norvegicus
atagaactgttccagtctctgtctt

SEQ ID NO: 172488 - DNA, 25 bp, Rattus norvegicus
atagaactgttcgagtctctgtctt

SEQ ID NO: 172489 - DNA, 25 bp, Rattus norvegicus
atagaagacagcctttccagccaga

SEQ ID NO: 172490 - DNA, 25 bp, Rattus norvegicus
atagaagacagcgtttccagccaga

SEQ ID NO: 172491 - DNA, 25 bp, Rattus norvegicus
atagaagacatcaactccccggagc

SEQ ID NO: 172492 - DNA, 25 bp, Rattus norvegicus
atagaagacatctactccccggagc

SEQ ID NO: 172493 - DNA, 25 bp, Rattus norvegicus
atagaagaccctcactcctgactgt

SEQ ID NO: 172494 - DNA, 25 bp, Rattus norvegicus
atagaagaccctgactcctgactgt

SEQ ID NO: 172495 - DNA, 25 bp, Rattus norvegicus
atagaagactagaggctggccctcc

SEQ ID NO: 172496 - DNA, 25 bp, Rattus norvegicus
atagaagactagtggctggccctcc

SEQ ID NO: 172497 - DNA, 25 bp, Rattus norvegicus
atagaagactccatgctaaccagca

SEQ ID NO: 172498 - DNA, 25 bp, Rattus norvegicus
atagaagactccttgctaaccagca

SEQ ID NO: 172499 - DNA, 25 bp, Rattus norvegicus
atagaagatacccacatccaccatg

SEQ ID NO: 172500 - DNA, 25 bp, Rattus norvegicus
atagaagataccgacatccaccatg

SEQ ID NO: 172501 - DNA, 25 bp, Rattus norvegicus
atagaagatattatcctgagcccca

SEQ ID NO: 172502 - DNA, 25 bp, Rattus norvegicus
atagaagatattttcctgagcccca

SEQ ID NO: 172503 - DNA, 25 bp, Rattus norvegicus
atagaagcagatcctccagctacgt

SEQ ID NO: 172504 - DNA, 25 bp, Rattus norvegicus
atagaagcagatgctccagctacgt

SEQ ID NO: 172505 - DNA, 25 bp, Rattus norvegicus
atagaagcaggcactcttatttccc

SEQ ID NO: 172506 - DNA, 25 bp, Rattus norvegicus
atagaagcaggctctcttatttccc

SEQ ID NO: 172507 - DNA, 25 bp, Rattus norvegicus
atagaagcccacactgtacagatct

SEQ ID NO: 172508 - DNA, 25 bp, Rattus norvegicus
atagaagcccactctgtacagatct

SEQ ID NO: 172509 - DNA, 25 bp, Rattus norvegicus
atagaagccgctcagctggcagaaa

SEQ ID NO: 172510 - DNA, 25 bp, Rattus norvegicus
atagaagccgctgagctggcagaaa

SEQ ID NO: 172511 - DNA, 25 bp, Rattus norvegicus
atagaagcctgtaggttccgcaaac

SEQ ID NO: 172512 - DNA, 25 bp, Rattus norvegicus
atagaagcctgttggttccgcaaac

SEQ ID NO: 172513 - DNA, 25 bp, Rattus norvegicus
atagaaggcgctctgaatctcctgc

SEQ ID NO: 172514 - DNA, 25 bp, Rattus norvegicus
atagaaggcgctgtgaatctcctgc

SEQ ID NO: 172515 - DNA, 25 bp, Rattus norvegicus
atagaaggctccaccgaccgtggcg

SEQ ID NO: 172516 - DNA, 25 bp, Rattus norvegicus
atagaaggctcctccgaccgtggcg

SEQ ID NO: 172517 - DNA, 25 bp, Rattus norvegicus
atagaagggcccaacagcgagccac

SEQ ID NO: 172518 - DNA, 25 bp, Rattus norvegicus
atagaagggccctacagcgagccac

SEQ ID NO: 172519 - DNA, 25 bp, Rattus norvegicus
atagaaggtgacctggtctctgccc

SEQ ID NO: 172520 - DNA, 25 bp, Rattus norvegicus
atagaaggtgacgtggtctctgccc

SEQ ID NO: 172521 - DNA, 25 bp, Rattus norvegicus
atagaagtcaccacctttgaggatt

SEQ ID NO: 172522 - DNA, 25 bp, Rattus norvegicus
atagaagtcacctcctttgaggatt

SEQ ID NO: 172523 - DNA, 25 bp, Rattus norvegicus
atagaagtcagcagtgggcctgctc

SEQ ID NO: 172524 - DNA, 25 bp, Rattus norvegicus
atagaagtcagctgtgggcctgctc

SEQ ID NO: 172525 - DNA, 25 bp, Rattus norvegicus
atagaagtgaaaacgcaggtcctgg

SEQ ID NO: 172526 - DNA, 25 bp, Rattus norvegicus
atagaagtgaaatcgcaggtcctgg

SEQ ID NO: 172527 - DNA, 25 bp, Rattus norvegicus
atagaagtgtccctgctctgaagtc

SEQ ID NO: 172528 - DNA, 25 bp, Rattus norvegicus
atagaagtgtccgtgctctgaagtc

SEQ ID NO: 172529 - DNA, 25 bp, Rattus norvegicus
atagaagtgtgtcctcatcacctac

SEQ ID NO: 172530 - DNA, 25 bp, Rattus norvegicus
atagaagtgtgtgctcatcacctac

SEQ ID NO: 172531 - DNA, 25 bp, Rattus norvegicus
atagaatcacttagctcttagaagg

SEQ ID NO: 172532 - DNA, 25 bp, Rattus norvegicus
atagaatcactttgctcttagaagg

SEQ ID NO: 172533 - DNA, 25 bp, Rattus norvegicus
atagaatcatgcacacccttgtcat

SEQ ID NO: 172534 - DNA, 25 bp, Rattus norvegicus
atagaatcatgctcacccttgtcat

SEQ ID NO: 172535 - DNA, 25 bp, Rattus norvegicus
atagaatccctgcagcttggcaaaa

SEQ ID NO: 172536 - DNA, 25 bp, Rattus norvegicus
atagaatccctggagcttggcaaaa

SEQ ID NO: 172537 - DNA, 25 bp, Rattus norvegicus
atagaatctcacagctgtttccttg

SEQ ID NO: 172538 - DNA, 25 bp, Rattus norvegicus
atagaatctcactgctgtttccttg

SEQ ID NO: 172539 - DNA, 25 bp, Rattus norvegicus
atagaatgccgcacaagctcaaggg

SEQ ID NO: 172540 - DNA, 25 bp, Rattus norvegicus
atagaatgccgctcaagctcaaggg

SEQ ID NO: 172541 - DNA, 25 bp, Rattus norvegicus
atagaatgcgagctgctttgcctca

SEQ ID NO: 172542 - DNA, 25 bp, Rattus norvegicus
atagaatgcgaggtgctttgcctca

SEQ ID NO: 172543 - DNA, 25 bp, Rattus norvegicus
atagaatgcttcaaagatgctttaa

SEQ ID NO: 172544 - DNA, 25 bp, Rattus norvegicus
atagaatgcttctaagatgctttaa

SEQ ID NO: 172545 - DNA, 25 bp, Rattus norvegicus
atagaatggaacctgtcccctgttg

SEQ ID NO: 172546 - DNA, 25 bp, Rattus norvegicus
atagaatggaacgtgtcccctgttg

SEQ ID NO: 172547 - DNA, 25 bp, Rattus norvegicus
atagaatgtgctccctaatttccga

SEQ ID NO: 172548 - DNA, 25 bp, Rattus norvegicus
atagaatgtgctgcctaatttccga

SEQ ID NO: 172549 - DNA, 25 bp, Rattus norvegicus
atagaattcctcattcacttctggt

SEQ ID NO: 172550 - DNA, 25 bp, Rattus norvegicus
atagaattcctctttcacttctggt

SEQ ID NO: 172551 - DNA, 25 bp, Rattus norvegicus
atagaattctaaccccagctaaaat

SEQ ID NO: 172552 - DNA, 25 bp, Rattus norvegicus
atagaattctaagcccagctaaaat

SEQ ID NO: 172553 - DNA, 25 bp, Rattus norvegicus
atagaattctggagccttgctccct

SEQ ID NO: 172554 - DNA, 25 bp, Rattus norvegicus
atagaattctggtgccttgctccct

SEQ ID NO: 172555 - DNA, 25 bp, Rattus norvegicus
atagaattgatgaccaccctgtgtc

SEQ ID NO: 172556 - DNA, 25 bp, Rattus norvegicus
atagaattgatgtccaccctgtgtc

SEQ ID NO: 172557 - DNA, 25 bp, Rattus norvegicus
atagaattggtccttccttgtgctg

SEQ ID NO: 172558 - DNA, 25 bp, Rattus norvegicus
atagaattggtcgttccttgtgctg

SEQ ID NO: 172559 - DNA, 25 bp, Rattus norvegicus
atagaatttcccctttgctccaaat

SEQ ID NO: 172560 - DNA, 25 bp, Rattus norvegicus
atagaatttcccgtttgctccaaat

SEQ ID NO: 172561 - DNA, 25 bp, Rattus norvegicus
atagacaacaatccttttgcgaaag

SEQ ID NO: 172562 - DNA, 25 bp, Rattus norvegicus
atagacaacaatgcttttgcgaaag

SEQ ID NO: 172563 - DNA, 25 bp, Rattus norvegicus
atagacaattgtcccttttaggagt

SEQ ID NO: 172564 - DNA, 25 bp, Rattus norvegicus
atagacaattgtgccttttaggagt

SEQ ID NO: 172565 - DNA, 25 bp, Rattus norvegicus
atagacaccctgcatgctatcattg

SEQ ID NO: 172566 - DNA, 25 bp, Rattus norvegicus
atagacaccctggatgctatcattg

SEQ ID NO: 172567 - DNA, 25 bp, Rattus norvegicus
atagacacttacatgagcagccacc

SEQ ID NO: 172568 - DNA, 25 bp, Rattus norvegicus
atagacacttacttgagcagccacc

SEQ ID NO: 172569 - DNA, 25 bp, Rattus norvegicus
atagacacttgcctcactggtcagt

SEQ ID NO: 172570 - DNA, 25 bp, Rattus norvegicus
atagacacttgcgtcactggtcagt

SEQ ID NO: 172571 - DNA, 25 bp, Rattus norvegicus
atagacagaagcacttgcagaggtc

SEQ ID NO: 172572 - DNA, 25 bp, Rattus norvegicus
atagacagaagctcttgcagaggtc

SEQ ID NO: 172573 - DNA, 25 bp, Rattus norvegicus
atagacagagtgacctcgtttcctc

SEQ ID NO: 172574 - DNA, 25 bp, Rattus norvegicus
atagacagagtgtcctcgtttcctc

SEQ ID NO: 172575 - DNA, 25 bp, Rattus norvegicus
atagacagatttatgaggacacctt

SEQ ID NO: 172576 - DNA, 25 bp, Rattus norvegicus
atagacagatttttgaggacacctt

SEQ ID NO: 172577 - DNA, 25 bp, Rattus norvegicus
atagacagctacatggagccctgtt

SEQ ID NO: 172578 - DNA, 25 bp, Rattus norvegicus
atagacagctacttggagccctgtt

SEQ ID NO: 172579 - DNA, 25 bp, Rattus norvegicus
atagacagctctagcaggttattca

SEQ ID NO: 172580 - DNA, 25 bp, Rattus norvegicus
atagacagctcttgcaggttattca

SEQ ID NO: 172581 - DNA, 25 bp, Rattus norvegicus
atagacagggtaccataggactcgt

SEQ ID NO: 172582 - DNA, 25 bp, Rattus norvegicus
atagacagggtagcataggactcgt

SEQ ID NO: 172583 - DNA, 25 bp, Rattus norvegicus
atagacagtcacacattacccgatg

SEQ ID NO: 172584 - DNA, 25 bp, Rattus norvegicus
atagacagtcactcattacccgatg

SEQ ID NO: 172585 - DNA, 25 bp, Rattus norvegicus
atagacagtcccaccatacagctgg

SEQ ID NO: 172586 - DNA, 25 bp, Rattus norvegicus
atagacagtccctccatacagctgg

SEQ ID NO: 172587 - DNA, 25 bp, Rattus norvegicus
atagacagttctccggccccgagaa

SEQ ID NO: 172588 - DNA, 25 bp, Rattus norvegicus
atagacagttctgcggccccgagaa

SEQ ID NO: 172589 - DNA, 25 bp, Rattus norvegicus
atagacagtttgacccagtctttcc

SEQ ID NO: 172590 - DNA, 25 bp, Rattus norvegicus
atagacagtttgtcccagtctttcc

SEQ ID NO: 172591 - DNA, 25 bp, Rattus norvegicus
atagacatctcccttcattcttgat

SEQ ID NO: 172592 - DNA, 25 bp, Rattus norvegicus
atagacatctccgttcattcttgat

SEQ ID NO: 172593 - DNA, 25 bp, Rattus norvegicus
atagacatgccacccagcaggaaga

SEQ ID NO: 172594 - DNA, 25 bp, Rattus norvegicus
atagacatgccagccagcaggaaga

SEQ ID NO: 172595 - DNA, 25 bp, Rattus norvegicus
atagacatgggcaaccacatccagc

SEQ ID NO: 172596 - DNA, 25 bp, Rattus norvegicus
atagacatgggctaccacatccagc

SEQ ID NO: 172597 - DNA, 25 bp, Rattus norvegicus
atagacattgagctgcttcctgctt

SEQ ID NO: 172598 - DNA, 25 bp, Rattus norvegicus
atagacattgaggtgcttcctgctt

SEQ ID NO: 172599 - DNA, 25 bp, Rattus norvegicus
atagaccaacatattgtgccagaaa

SEQ ID NO: 172600 - DNA, 25 bp, Rattus norvegicus
atagaccaacattttgtgccagaaa

SEQ ID NO: 172601 - DNA, 25 bp, Rattus norvegicus
atagaccaccgtctcctgggatact

SEQ ID NO: 172602 - DNA, 25 bp, Rattus norvegicus
atagaccaccgtgtcctgggatact

SEQ ID NO: 172603 - DNA, 25 bp, Rattus norvegicus
atagaccacgggagggcttttgtgt

SEQ ID NO: 172604 - DNA, 25 bp, Rattus norvegicus
atagaccacgggtgggcttttgtgt

SEQ ID NO: 172605 - DNA, 25 bp, Rattus norvegicus
atagacccaaccctcaaacttgtgg

SEQ ID NO: 172606 - DNA, 25 bp, Rattus norvegicus
atagacccaaccgtcaaacttgtgg

SEQ ID NO: 172607 - DNA, 25 bp, Rattus norvegicus
atagacccagagcaggctttcagca

SEQ ID NO: 172608 - DNA, 25 bp, Rattus norvegicus
atagacccagaggaggctttcagca

SEQ ID NO: 172609 - DNA, 25 bp, Rattus norvegicus
atagacccccataaatgctatgatt

SEQ ID NO: 172610 - DNA, 25 bp, Rattus norvegicus
atagacccccattaatgctatgatt

SEQ ID NO: 172611 - DNA, 25 bp, Rattus norvegicus
atagacccctcaccaggtcaaggtt

SEQ ID NO: 172612 - DNA, 25 bp, Rattus norvegicus
atagacccctcagcaggtcaaggtt

SEQ ID NO: 172613 - DNA, 25 bp, Rattus norvegicus
atagacccctttctctactactttg

SEQ ID NO: 172614 - DNA, 25 bp, Rattus norvegicus
atagacccctttgtctactactttg

SEQ ID NO: 172615 - DNA, 25 bp, Rattus norvegicus
atagaccctcgaaggctcatagacg

SEQ ID NO: 172616 - DNA, 25 bp, Rattus norvegicus
atagaccctcgatggctcatagacg

SEQ ID NO: 172617 - DNA, 25 bp, Rattus norvegicus
atagacctaagccatttgtacctta

SEQ ID NO: 172618 - DNA, 25 bp, Rattus norvegicus
atagacctaagcgatttgtacctta

SEQ ID NO: 172619 - DNA, 25 bp, Rattus norvegicus
atagacctagacacagactttcact

SEQ ID NO: 172620 - DNA, 25 bp, Rattus norvegicus
atagacctagactcagactttcact

SEQ ID NO: 172621 - DNA, 25 bp, Rattus norvegicus
atagacctctacacaattggaactg

SEQ ID NO: 172622 - DNA, 25 bp, Rattus norvegicus
atagacctctactcaattggaactg

SEQ ID NO: 172623 - DNA, 25 bp, Rattus norvegicus
atagacctctgacctactgcagtgt

SEQ ID NO: 172624 - DNA, 25 bp, Rattus norvegicus
atagacctctgagctactgcagtgt

SEQ ID NO: 172625 - DNA, 25 bp, Rattus norvegicus
atagacctgcagagcgcagctcaga

SEQ ID NO: 172626 - DNA, 25 bp, Rattus norvegicus
atagacctgcagtgcgcagctcaga

SEQ ID NO: 172627 - DNA, 25 bp, Rattus norvegicus
atagacctgccgatgctgattcgtg

SEQ ID NO: 172628 - DNA, 25 bp, Rattus norvegicus
atagacctgccgttgctgattcgtg

SEQ ID NO: 172629 - DNA, 25 bp, Rattus norvegicus
atagacctgtagaaccgaaacgatt

SEQ ID NO: 172630 - DNA, 25 bp, Rattus norvegicus
atagacctgtagtaccgaaacgatt

SEQ ID NO: 172631 - DNA, 25 bp, Rattus norvegicus
atagaccttgtgcttgccgtctgtc

SEQ ID NO: 172632 - DNA, 25 bp, Rattus norvegicus
atagaccttgtggttgccgtctgtc

SEQ ID NO: 172633 - DNA, 25 bp, Rattus norvegicus
atagacggtgtcatagccagtcctg

SEQ ID NO: 172634 - DNA, 25 bp, Rattus norvegicus
atagacggtgtcttagccagtcctg

SEQ ID NO: 172635 - DNA, 25 bp, Rattus norvegicus
atagacgtattaacttggttgttta

SEQ ID NO: 172636 - DNA, 25 bp, Rattus norvegicus
atagacgtattatcttggttgttta

SEQ ID NO: 172637 - DNA, 25 bp, Rattus norvegicus
atagacgtttccacctgcatccgct

SEQ ID NO: 172638 - DNA, 25 bp, Rattus norvegicus
atagacgtttcctcctgcatccgct

SEQ ID NO: 172639 - DNA, 25 bp, Rattus norvegicus
atagactatcagatctgcctcactg

SEQ ID NO: 172640 - DNA, 25 bp, Rattus norvegicus
atagactatcagttctgcctcactg

SEQ ID NO: 172641 - DNA, 25 bp, Rattus norvegicus
atagactatgagcctgcgaaggcag

SEQ ID NO: 172642 - DNA, 25 bp, Rattus norvegicus
atagactatgaggctgcgaaggcag

SEQ ID NO: 172643 - DNA, 25 bp, Rattus norvegicus
atagactcaggaccggtgtgtgccc

SEQ ID NO: 172644 - DNA, 25 bp, Rattus norvegicus
atagactcaggagcggtgtgtgccc

SEQ ID NO: 172645 - DNA, 25 bp, Rattus norvegicus
atagactcatgcactggatggccct

SEQ ID NO: 172646 - DNA, 25 bp, Rattus norvegicus
atagactcatgctctggatggccct

SEQ ID NO: 172647 - DNA, 25 bp, Rattus norvegicus
atagactccctgaagtctccgccat

SEQ ID NO: 172648 - DNA, 25 bp, Rattus norvegicus
atagactccctgtagtctccgccat

SEQ ID NO: 172649 - DNA, 25 bp, Rattus norvegicus
atagactccgtgaagttggcagaca

SEQ ID NO: 172650 - DNA, 25 bp, Rattus norvegicus
atagactccgtgtagttggcagaca

SEQ ID NO: 172651 - DNA, 25 bp, Rattus norvegicus
atagactcctctcgaaggacaagat

SEQ ID NO: 172652 - DNA, 25 bp, Rattus norvegicus
atagactcctctggaaggacaagat

SEQ ID NO: 172653 - DNA, 25 bp, Rattus norvegicus
atagactccttgactggctgctgcg

SEQ ID NO: 172654 - DNA, 25 bp, Rattus norvegicus
atagactccttgtctggctgctgcg

SEQ ID NO: 172655 - DNA, 25 bp, Rattus norvegicus
atagactctctacttcctgaccagg

SEQ ID NO: 172656 - DNA, 25 bp, Rattus norvegicus
atagactctctagttcctgaccagg

SEQ ID NO: 172657 - DNA, 25 bp, Rattus norvegicus
atagactctctccaaagaggcaaga

SEQ ID NO: 172658 - DNA, 25 bp, Rattus norvegicus
atagactctctcgaaagaggcaaga

SEQ ID NO: 172659 - DNA, 25 bp, Rattus norvegicus
atagactctgagaccctgatcaatg

SEQ ID NO: 172660 - DNA, 25 bp, Rattus norvegicus
atagactctgagtccctgatcaatg

SEQ ID NO: 172661 - DNA, 25 bp, Rattus norvegicus
atagactcttatattcctctttcct

SEQ ID NO: 172662 - DNA, 25 bp, Rattus norvegicus
atagactcttattttcctctttcct

SEQ ID NO: 172663 - DNA, 25 bp, Rattus norvegicus
atagactcttcaaggcgctgttacc

SEQ ID NO: 172664 - DNA, 25 bp, Rattus norvegicus
atagactcttcatggcgctgttacc

SEQ ID NO: 172665 - DNA, 25 bp, Rattus norvegicus
atagactcttgacccaggtcgtacg

SEQ ID NO: 172666 - DNA, 25 bp, Rattus norvegicus
atagactcttgagccaggtcgtacg

SEQ ID NO: 172667 - DNA, 25 bp, Rattus norvegicus
atagactcttgtctgctgcagacgc

SEQ ID NO: 172668 - DNA, 25 bp, Rattus norvegicus
atagactcttgtgtgctgcagacgc

SEQ ID NO: 172669 - DNA, 25 bp, Rattus norvegicus
atagactgagctatgactgccgctg

SEQ ID NO: 172670 - DNA, 25 bp, Rattus norvegicus
atagactgagctttgactgccgctg

SEQ ID NO: 172671 - DNA, 25 bp, Rattus norvegicus
atagactgcgtcagtgcgatggctc

SEQ ID NO: 172672 - DNA, 25 bp, Rattus norvegicus
atagactgcgtctgtgcgatggctc

SEQ ID NO: 172673 - DNA, 25 bp, Rattus norvegicus
atagactggatcctggtcaccgtgc

SEQ ID NO: 172674 - DNA, 25 bp, Rattus norvegicus
atagactggatcgtggtcaccgtgc

SEQ ID NO: 172675 - DNA, 25 bp, Rattus norvegicus
atagactggccactaggatcccctg

SEQ ID NO: 172676 - DNA, 25 bp, Rattus norvegicus
atagactggccagtaggatcccctg

SEQ ID NO: 172677 - DNA, 25 bp, Rattus norvegicus
atagactggtggctactcacagaaa

SEQ ID NO: 172678 - DNA, 25 bp, Rattus norvegicus
atagactggtgggtactcacagaaa

SEQ ID NO: 172679 - DNA, 25 bp, Rattus norvegicus
atagactgtcaactctgcccacttt

SEQ ID NO: 172680 - DNA, 25 bp, Rattus norvegicus
atagactgtcaagtctgcccacttt

SEQ ID NO: 172681 - DNA, 25 bp, Rattus norvegicus
atagactgtgcactgttcatcgagg

SEQ ID NO: 172682 - DNA, 25 bp, Rattus norvegicus
atagactgtgcagtgttcatcgagg

SEQ ID NO: 172683 - DNA, 25 bp, Rattus norvegicus
atagactgttttaaagcccgccgtg

SEQ ID NO: 172684 - DNA, 25 bp, Rattus norvegicus
atagactgtttttaagcccgccgtg

SEQ ID NO: 172685 - DNA, 25 bp, Rattus norvegicus
atagacttcgttaagatttatagca

SEQ ID NO: 172686 - DNA, 25 bp, Rattus norvegicus
atagacttcgtttagatttatagca

SEQ ID NO: 172687 - DNA, 25 bp, Rattus norvegicus
atagacttgcacacctcaatcaaaa

SEQ ID NO: 172688 - DNA, 25 bp, Rattus norvegicus
atagacttgcactcctcaatcaaaa

SEQ ID NO: 172689 - DNA, 25 bp, Rattus norvegicus
atagacttgtggagctatgggcatt

SEQ ID NO: 172690 - DNA, 25 bp, Rattus norvegicus
atagacttgtggtgctatgggcatt

SEQ ID NO: 172691 - DNA, 25 bp, Rattus norvegicus
atagacttgtgtatacaccctccac

SEQ ID NO: 172692 - DNA, 25 bp, Rattus norvegicus
atagacttgtgtttacaccctccac

SEQ ID NO: 172693 - DNA, 25 bp, Rattus norvegicus
atagactttatccttcttcactctg

SEQ ID NO: 172694 - DNA, 25 bp, Rattus norvegicus
atagactttatcgttcttcactctg

SEQ ID NO: 172695 - DNA, 25 bp, Rattus norvegicus
atagactttgtcatgcctgtctgta

SEQ ID NO: 172696 - DNA, 25 bp, Rattus norvegicus
atagactttgtcttgcctgtctgta

SEQ ID NO: 172697 - DNA, 25 bp, Rattus norvegicus
atagacttttggaaatttgatttgc

SEQ ID NO: 172698 - DNA, 25 bp, Rattus norvegicus
atagacttttggtaatttgatttgc

SEQ ID NO: 172699 - DNA, 25 bp, Rattus norvegicus
atagagaaaattatacctgcacctg

SEQ ID NO: 172700 - DNA, 25 bp, Rattus norvegicus
atagagaaaattttacctgcacctg

SEQ ID NO: 172701 - DNA, 25 bp, Rattus norvegicus
atagagaatctgctggtcccttata

SEQ ID NO: 172702 - DNA, 25 bp, Rattus norvegicus
atagagaatctggtggtcccttata

SEQ ID NO: 172703 - DNA, 25 bp, Rattus norvegicus
atagagacacagaagggccgatttt

SEQ ID NO: 172704 - DNA, 25 bp, Rattus norvegicus
atagagacacagtagggccgatttt

SEQ ID NO: 172705 - DNA, 25 bp, Rattus norvegicus
atagagacaggcaccgcactgttca

SEQ ID NO: 172706 - DNA, 25 bp, Rattus norvegicus
atagagacaggcagacacttgacgt

SEQ ID NO: 172707 - DNA, 25 bp, Rattus norvegicus
atagagacaggctccgcactgttca

SEQ ID NO: 172708 - DNA, 25 bp, Rattus norvegicus
atagagacaggctgacacttgacgt

SEQ ID NO: 172709 - DNA, 25 bp, Rattus norvegicus
atagagacagtcactcttccttctg

SEQ ID NO: 172710 - DNA, 25 bp, Rattus norvegicus
atagagacagtctctcttccttctg

SEQ ID NO: 172711 - DNA, 25 bp, Rattus norvegicus
atagagacatgtccctgctagccat

SEQ ID NO: 172712 - DNA, 25 bp, Rattus norvegicus
atagagacatgtgcctgctagccat

SEQ ID NO: 172713 - DNA, 25 bp, Rattus norvegicus
atagagaccgtgaggctttgttcgc

SEQ ID NO: 172714 - DNA, 25 bp, Rattus norvegicus
atagagaccgtgtggctttgttcgc

SEQ ID NO: 172715 - DNA, 25 bp, Rattus norvegicus
atagagacctttcaaatgttagtgg

SEQ ID NO: 172716 - DNA, 25 bp, Rattus norvegicus
atagagacctttgaaatgttagtgg

SEQ ID NO: 172717 - DNA, 25 bp, Rattus norvegicus
atagagactcttcaatccactgttc

SEQ ID NO: 172718 - DNA, 25 bp, Rattus norvegicus
atagagactcttgaatccactgttc

SEQ ID NO: 172719 - DNA, 25 bp, Rattus norvegicus
atagagagaggaaggcacgaagccc

SEQ ID NO: 172720 - DNA, 25 bp, Rattus norvegicus
atagagagaggatggcacgaagccc

SEQ ID NO: 172721 - DNA, 25 bp, Rattus norvegicus
atagagagccgcatcgactgtcagc

SEQ ID NO: 172722 - DNA, 25 bp, Rattus norvegicus
atagagagccgcttcgactgtcagc

SEQ ID NO: 172723 - DNA, 25 bp, Rattus norvegicus
atagagagctccagtccgtccatgg

SEQ ID NO: 172724 - DNA, 25 bp, Rattus norvegicus
atagagagctcctgtccgtccatgg

SEQ ID NO: 172725 - DNA, 25 bp, Rattus norvegicus
atagagatgctcagctccaccgagg

SEQ ID NO: 172726 - DNA, 25 bp, Rattus norvegicus
atagagatgctctgctccaccgagg

SEQ ID NO: 172727 - DNA, 25 bp, Rattus norvegicus
atagagattaccactctcctggacg

SEQ ID NO: 172728 - DNA, 25 bp, Rattus norvegicus
atagagattacctctctcctggacg

SEQ ID NO: 172729 - DNA, 25 bp, Rattus norvegicus
atagagattgctcggctctcctact

SEQ ID NO: 172730 - DNA, 25 bp, Rattus norvegicus
atagagattgctgggctctcctact

SEQ ID NO: 172731 - DNA, 25 bp, Rattus norvegicus
atagagcagaggacagcctagcctg

SEQ ID NO: 172732 - DNA, 25 bp, Rattus norvegicus
atagagcagaggtcagcctagcctg

SEQ ID NO: 172733 - DNA, 25 bp, Rattus norvegicus
atagagcagcggaaatagcgacggt

SEQ ID NO: 172734 - DNA, 25 bp, Rattus norvegicus
atagagcagcggtaatagcgacggt

SEQ ID NO: 172735 - DNA, 25 bp, Rattus norvegicus
atagagcaggtacttccagaacagc

SEQ ID NO: 172736 - DNA, 25 bp, Rattus norvegicus
atagagcaggtagttccagaacagc

SEQ ID NO: 172737 - DNA, 25 bp, Rattus norvegicus
atagagcatagcagtaccctagatg

SEQ ID NO: 172738 - DNA, 25 bp, Rattus norvegicus
atagagcatagctgtaccctagatg

SEQ ID NO: 172739 - DNA, 25 bp, Rattus norvegicus
atagagcatcagctgggctgtgcac

SEQ ID NO: 172740 - DNA, 25 bp, Rattus norvegicus
atagagcatcaggtgggctgtgcac

SEQ ID NO: 172741 - DNA, 25 bp, Rattus norvegicus
atagagcccagacagtgcggactgc

SEQ ID NO: 172742 - DNA, 25 bp, Rattus norvegicus
atagagcccagagagtgcggactgc

SEQ ID NO: 172743 - DNA, 25 bp, Rattus norvegicus
atagagcccatgaaggagcaccagg

SEQ ID NO: 172744 - DNA, 25 bp, Rattus norvegicus
atagagcccatgtaggagcaccagg

SEQ ID NO: 172745 - DNA, 25 bp, Rattus norvegicus
atagagcccctcagcaaattaatat

SEQ ID NO: 172746 - DNA, 25 bp, Rattus norvegicus
atagagcccctctgcaaattaatat

SEQ ID NO: 172747 - DNA, 25 bp, Rattus norvegicus
atagagccgtctagggagtagaatc

SEQ ID NO: 172748 - DNA, 25 bp, Rattus norvegicus
atagagccgtcttgggagtagaatc

SEQ ID NO: 172749 - DNA, 25 bp, Rattus norvegicus
atagagcctcctagctgggtagttt

SEQ ID NO: 172750 - DNA, 25 bp, Rattus norvegicus
atagagcctccttgctgggtagttt

SEQ ID NO: 172751 - DNA, 25 bp, Rattus norvegicus
atagagcgagccctatggccaactc

SEQ ID NO: 172752 - DNA, 25 bp, Rattus norvegicus
atagagcgagccgtatggccaactc

SEQ ID NO: 172753 - DNA, 25 bp, Rattus norvegicus
atagagcgccttatggtgacttcac

SEQ ID NO: 172754 - DNA, 25 bp, Rattus norvegicus
atagagcgccttttggtgacttcac

SEQ ID NO: 172755 - DNA, 25 bp, Rattus norvegicus
atagagctattcatccttatttgga

SEQ ID NO: 172756 - DNA, 25 bp, Rattus norvegicus
atagagctattcttccttatttgga

SEQ ID NO: 172757 - DNA, 25 bp, Rattus norvegicus
atagagctcattacaggtcacttgc

SEQ ID NO: 172758 - DNA, 25 bp, Rattus norvegicus
atagagctcatttcaggtcacttgc

SEQ ID NO: 172759 - DNA, 25 bp, Rattus norvegicus
atagagctctagctcctctgtagga

SEQ ID NO: 172760 - DNA, 25 bp, Rattus norvegicus
atagagctctaggtcctctgtagga

SEQ ID NO: 172761 - DNA, 25 bp, Rattus norvegicus
atagagctctctagccataaacacc

SEQ ID NO: 172762 - DNA, 25 bp, Rattus norvegicus
atagagctctcttgccataaacacc

SEQ ID NO: 172763 - DNA, 25 bp, Rattus norvegicus
atagagctgcttcgcctagaattgg

SEQ ID NO: 172764 - DNA, 25 bp, Rattus norvegicus
atagagctgcttggcctagaattgg

SEQ ID NO: 172765 - DNA, 25 bp, Rattus norvegicus
atagagctgggcccctggcaccaag

SEQ ID NO: 172766 - DNA, 25 bp, Rattus norvegicus
atagagctgggcgcctggcaccaag

SEQ ID NO: 172767 - DNA, 25 bp, Rattus norvegicus
atagagcttacacatgtctccctag

SEQ ID NO: 172768 - DNA, 25 bp, Rattus norvegicus
atagagcttacagatgtctccctag

SEQ ID NO: 172769 - DNA, 25 bp, Rattus norvegicus
atagagctttcccatagcaacctga

SEQ ID NO: 172770 - DNA, 25 bp, Rattus norvegicus
atagagctttccgatagcaacctga

SEQ ID NO: 172771 - DNA, 25 bp, Rattus norvegicus
atagagcttttgcagactttgtgtc

SEQ ID NO: 172772 - DNA, 25 bp, Rattus norvegicus
atagagcttttggagactttgtgtc

SEQ ID NO: 172773 - DNA, 25 bp, Rattus norvegicus
atagaggagctcatagctcaccctg

SEQ ID NO: 172774 - DNA, 25 bp, Rattus norvegicus
atagaggagctcttagctcaccctg

SEQ ID NO: 172775 - DNA, 25 bp, Rattus norvegicus
atagaggatagccagcccttgggct

SEQ ID NO: 172776 - DNA, 25 bp, Rattus norvegicus
atagaggatagcgagcccttgggct

SEQ ID NO: 172777 - DNA, 25 bp, Rattus norvegicus
atagaggattccagcctgggattct

SEQ ID NO: 172778 - DNA, 25 bp, Rattus norvegicus
atagaggattcctgcctgggattct

SEQ ID NO: 172779 - DNA, 25 bp, Rattus norvegicus
atagaggccagtcagcatcctaaac

SEQ ID NO: 172780 - DNA, 25 bp, Rattus norvegicus
atagaggccagtgagcatcctaaac

SEQ ID NO: 172781 - DNA, 25 bp, Rattus norvegicus
atagaggcctggagtggttccgaac

SEQ ID NO: 172782 - DNA, 25 bp, Rattus norvegicus
atagaggcctggtgtggttccgaac

SEQ ID NO: 172783 - DNA, 25 bp, Rattus norvegicus
atagaggctaccctgaagcagtgaa

SEQ ID NO: 172784 - DNA, 25 bp, Rattus norvegicus
atagaggctaccgtgaagcagtgaa

SEQ ID NO: 172785 - DNA, 25 bp, Rattus norvegicus
atagaggctcacagcggcataagct

SEQ ID NO: 172786 - DNA, 25 bp, Rattus norvegicus
atagaggctcactgcggcataagct

SEQ ID NO: 172787 - DNA, 25 bp, Rattus norvegicus
atagaggctgaacctaagccccgcc

SEQ ID NO: 172788 - DNA, 25 bp, Rattus norvegicus
atagaggctgaagctaagccccgcc

SEQ ID NO: 172789 - DNA, 25 bp, Rattus norvegicus
atagaggctgcacgtctcacatcgc

SEQ ID NO: 172790 - DNA, 25 bp, Rattus norvegicus
atagaggctgcactgtccagcaata

SEQ ID NO: 172791 - DNA, 25 bp, Rattus norvegicus
atagaggctgcaggtctcacatcgc

SEQ ID NO: 172792 - DNA, 25 bp, Rattus norvegicus
atagaggctgcagtgtccagcaata

SEQ ID NO: 172793 - DNA, 25 bp, Rattus norvegicus
atagaggctgccagtaccctggatc

SEQ ID NO: 172794 - DNA, 25 bp, Rattus norvegicus
atagaggctgcctgtaccctggatc

SEQ ID NO: 172795 - DNA, 25 bp, Rattus norvegicus
atagagggcccactgtgctgctgtc

SEQ ID NO: 172796 - DNA, 25 bp, Rattus norvegicus
atagagggcccagtgtgctgctgtc

SEQ ID NO: 172797 - DNA, 25 bp, Rattus norvegicus
atagagggtctcaccattctgatcc

SEQ ID NO: 172798 - DNA, 25 bp, Rattus norvegicus
atagagggtctctccattctgatcc

SEQ ID NO: 172799 - DNA, 25 bp, Rattus norvegicus
atagagggtgaactaagtcagcctg

SEQ ID NO: 172800 - DNA, 25 bp, Rattus norvegicus
atagagggtgaagtaagtcagcctg

SEQ ID NO: 172801 - DNA, 25 bp, Rattus norvegicus
atagaggtcagtctccgtgctgcta

SEQ ID NO: 172802 - DNA, 25 bp, Rattus norvegicus
atagaggtcagtgtccgtgctgcta

SEQ ID NO: 172803 - DNA, 25 bp, Rattus norvegicus
atagaggtccctctcttcattaggt

SEQ ID NO: 172804 - DNA, 25 bp, Rattus norvegicus
atagaggtccctgtcttcattaggt

SEQ ID NO: 172805 - DNA, 25 bp, Rattus norvegicus
atagaggtgcatctatctacctgcc

SEQ ID NO: 172806 - DNA, 25 bp, Rattus norvegicus
atagaggtgcatgtatctacctgcc

SEQ ID NO: 172807 - DNA, 25 bp, Rattus norvegicus
atagaggtgtgcacctgtgatccca

SEQ ID NO: 172808 - DNA, 25 bp, Rattus norvegicus
atagaggtgtgctcctgtgatccca

SEQ ID NO: 172809 - DNA, 25 bp, Rattus norvegicus
atagagtcagctcggacactgggcc

SEQ ID NO: 172810 - DNA, 25 bp, Rattus norvegicus
atagagtcagctgggacactgggcc

SEQ ID NO: 172811 - DNA, 25 bp, Rattus norvegicus
atagagtcccacatttgctctgtga

SEQ ID NO: 172812 - DNA, 25 bp, Rattus norvegicus
atagagtcccacttttgctctgtga

SEQ ID NO: 172813 - DNA, 25 bp, Rattus norvegicus
atagagtccctcacctggtgatagg

SEQ ID NO: 172814 - DNA, 25 bp, Rattus norvegicus
atagagtccctctcctggtgatagg

SEQ ID NO: 172815 - DNA, 25 bp, Rattus norvegicus
atagagtccttgcagaacattcctt

SEQ ID NO: 172816 - DNA, 25 bp, Rattus norvegicus
atagagtccttggagaacattcctt

SEQ ID NO: 172817 - DNA, 25 bp, Rattus norvegicus
atagagtcggacaccccgagtgtct

SEQ ID NO: 172818 - DNA, 25 bp, Rattus norvegicus
atagagtcggactccccgagtgtct

SEQ ID NO: 172819 - DNA, 25 bp, Rattus norvegicus
atagagtcgtccatcgatccgaaag

SEQ ID NO: 172820 - DNA, 25 bp, Rattus norvegicus
atagagtcgtccttcgatccgaaag

SEQ ID NO: 172821 - DNA, 25 bp, Rattus norvegicus
atagagtctcaacactgatcacaat

SEQ ID NO: 172822 - DNA, 25 bp, Rattus norvegicus
atagagtctcaagactgatcacaat

SEQ ID NO: 172823 - DNA, 25 bp, Rattus norvegicus
atagagtctgatcaggtctccactc

SEQ ID NO: 172824 - DNA, 25 bp, Rattus norvegicus
atagagtctgatgaggtctccactc

SEQ ID NO: 172825 - DNA, 25 bp, Rattus norvegicus
atagagtctgctcccagggagacct

SEQ ID NO: 172826 - DNA, 25 bp, Rattus norvegicus
atagagtctgctgccagggagacct

SEQ ID NO: 172827 - DNA, 25 bp, Rattus norvegicus
atagagtgtctcatcgaggtcactt

SEQ ID NO: 172828 - DNA, 25 bp, Rattus norvegicus
atagagtgtctcttcgaggtcactt

SEQ ID NO: 172829 - DNA, 25 bp, Rattus norvegicus
atagagtgttttcttaggtatatac

SEQ ID NO: 172830 - DNA, 25 bp, Rattus norvegicus
atagagtgttttgttaggtatatac

SEQ ID NO: 172831 - DNA, 25 bp, Rattus norvegicus
atagagttcctaccctcagttgtgt

SEQ ID NO: 172832 - DNA, 25 bp, Rattus norvegicus
atagagttcctagcctcagttgtgt

SEQ ID NO: 172833 - DNA, 25 bp, Rattus norvegicus
atagagttctagattatttgcataa

SEQ ID NO: 172834 - DNA, 25 bp, Rattus norvegicus
atagagttctagtttatttgcataa

SEQ ID NO: 172835 - DNA, 25 bp, Rattus norvegicus
atagagttgactactccagtgtaga

SEQ ID NO: 172836 - DNA, 25 bp, Rattus norvegicus
atagagttgacttctccagtgtaga

SEQ ID NO: 172837 - DNA, 25 bp, Rattus norvegicus
atagagttgcttatctcgggctaga

SEQ ID NO: 172838 - DNA, 25 bp, Rattus norvegicus
atagagttgcttttctcgggctaga

SEQ ID NO: 172839 - DNA, 25 bp, Rattus norvegicus
atagagttggagctggctgccctcc

SEQ ID NO: 172840 - DNA, 25 bp, Rattus norvegicus
atagagttggaggtggctgccctcc

SEQ ID NO: 172841 - DNA, 25 bp, Rattus norvegicus
atagagtttcttacagttgccgtgg

SEQ ID NO: 172842 - DNA, 25 bp, Rattus norvegicus
atagagtttctttcagttgccgtgg

SEQ ID NO: 172843 - DNA, 25 bp, Rattus norvegicus
atagataaggaccttcccactggcc

SEQ ID NO: 172844 - DNA, 25 bp, Rattus norvegicus
atagataaggacgttcccactggcc

SEQ ID NO: 172845 - DNA, 25 bp, Rattus norvegicus
atagataaggatcgtgtgacagtcg

SEQ ID NO: 172846 - DNA, 25 bp, Rattus norvegicus
atagataaggatggtgtgacagtcg

SEQ ID NO: 172847 - DNA, 25 bp, Rattus norvegicus
atagatacctatctggtggaagctg

SEQ ID NO: 172848 - DNA, 25 bp, Rattus norvegicus
atagatacctatgtggtggaagctg

SEQ ID NO: 172849 - DNA, 25 bp, Rattus norvegicus
atagatacctttcggcaacctgtga

SEQ ID NO: 172850 - DNA, 25 bp, Rattus norvegicus
atagatacctttgggcaacctgtga

SEQ ID NO: 172851 - DNA, 25 bp, Rattus norvegicus
atagatacgtaaacattgaccacat

SEQ ID NO: 172852 - DNA, 25 bp, Rattus norvegicus
atagatacgtaatcattgaccacat

SEQ ID NO: 172853 - DNA, 25 bp, Rattus norvegicus
atagatagaagaccctcactcctga

SEQ ID NO: 172854 - DNA, 25 bp, Rattus norvegicus
atagatagaagagcctcactcctga

SEQ ID NO: 172855 - DNA, 25 bp, Rattus norvegicus
atagatagactgagtgtctgtctct

SEQ ID NO: 172856 - DNA, 25 bp, Rattus norvegicus
atagatagactgtgtgtctgtctct

SEQ ID NO: 172857 - DNA, 25 bp, Rattus norvegicus
atagatagccatcccagacatctcc

SEQ ID NO: 172858 - DNA, 25 bp, Rattus norvegicus
atagatagccatgccagacatctcc

SEQ ID NO: 172859 - DNA, 25 bp, Rattus norvegicus
atagatagctacacttcccttcttt

SEQ ID NO: 172860 - DNA, 25 bp, Rattus norvegicus
atagatagctactcttcccttcttt

SEQ ID NO: 172861 - DNA, 25 bp, Rattus norvegicus
atagataggcttctgggatttttgt

SEQ ID NO: 172862 - DNA, 25 bp, Rattus norvegicus
atagataggcttgtgggatttttgt

SEQ ID NO: 172863 - DNA, 25 bp, Rattus norvegicus
atagatagggttccgtggcacccgc

SEQ ID NO: 172864 - DNA, 25 bp, Rattus norvegicus
atagatagggttgcgtggcacccgc

SEQ ID NO: 172865 - DNA, 25 bp, Rattus norvegicus
atagatatcctgcaggccccaagac

SEQ ID NO: 172866 - DNA, 25 bp, Rattus norvegicus
atagatatcctggaggccccaagac

SEQ ID NO: 172867 - DNA, 25 bp, Rattus norvegicus
atagatatccttctactgctccgat

SEQ ID NO: 172868 - DNA, 25 bp, Rattus norvegicus
atagatatccttgtactgctccgat

SEQ ID NO: 172869 - DNA, 25 bp, Rattus norvegicus
atagatatgaacacagggaactggg

SEQ ID NO: 172870 - DNA, 25 bp, Rattus norvegicus
atagatatgaactcagggaactggg

SEQ ID NO: 172871 - DNA, 25 bp, Rattus norvegicus
atagatcaactgagcacctgcagga

SEQ ID NO: 172872 - DNA, 25 bp, Rattus norvegicus
atagatcaactgtgcacctgcagga

SEQ ID NO: 172873 - DNA, 25 bp, Rattus norvegicus
atagatccaggtcccgatccaggga

SEQ ID NO: 172874 - DNA, 25 bp, Rattus norvegicus
atagatccaggtgccgatccaggga

SEQ ID NO: 172875 - DNA, 25 bp, Rattus norvegicus
atagatccagttagtcttctgcact

SEQ ID NO: 172876 - DNA, 25 bp, Rattus norvegicus
atagatccagtttgtcttctgcact

SEQ ID NO: 172877 - DNA, 25 bp, Rattus norvegicus
atagatcccgaaatacagccgtgct

SEQ ID NO: 172878 - DNA, 25 bp, Rattus norvegicus
atagatcccgaattacagccgtgct

SEQ ID NO: 172879 - DNA, 25 bp, Rattus norvegicus
atagatcccgggacttgctaagctc

SEQ ID NO: 172880 - DNA, 25 bp, Rattus norvegicus
atagatcccgggtcttgctaagctc

SEQ ID NO: 172881 - DNA, 25 bp, Rattus norvegicus
atagatcctaccattaggttattgt

SEQ ID NO: 172882 - DNA, 25 bp, Rattus norvegicus
atagatcctacctttaggttattgt

SEQ ID NO: 172883 - DNA, 25 bp, Rattus norvegicus
atagatcctactcaggttgccaggt

SEQ ID NO: 172884 - DNA, 25 bp, Rattus norvegicus
atagatcctactgaggttgccaggt

SEQ ID NO: 172885 - DNA, 25 bp, Rattus norvegicus
atagatcctgctcggcagccttcgt

SEQ ID NO: 172886 - DNA, 25 bp, Rattus norvegicus
atagatcctgctgggcagccttcgt

SEQ ID NO: 172887 - DNA, 25 bp, Rattus norvegicus
atagatcctgggaaactcatcctct

SEQ ID NO: 172888 - DNA, 25 bp, Rattus norvegicus
atagatcctgggtaactcatcctct

SEQ ID NO: 172889 - DNA, 25 bp, Rattus norvegicus
atagatcgcatgatctgctctgttg

SEQ ID NO: 172890 - DNA, 25 bp, Rattus norvegicus
atagatcgcatgttctgctctgttg

SEQ ID NO: 172891 - DNA, 25 bp, Rattus norvegicus
atagatctaagcagctgctgtttcc

SEQ ID NO: 172892 - DNA, 25 bp, Rattus norvegicus
atagatctaagctgctgctgtttcc

SEQ ID NO: 172893 - DNA, 25 bp, Rattus norvegicus
atagatctacaccaggcgccgaggc

SEQ ID NO: 172894 - DNA, 25 bp, Rattus norvegicus
atagatctacacgaggcgccgaggc

SEQ ID NO: 172895 - DNA, 25 bp, Rattus norvegicus
atagatctcgaaatcaggtgtggct

SEQ ID NO: 172896 - DNA, 25 bp, Rattus norvegicus
atagatctcgaattcaggtgtggct

SEQ ID NO: 172897 - DNA, 25 bp, Rattus norvegicus
atagatctctgtaaaccttcatgtg

SEQ ID NO: 172898 - DNA, 25 bp, Rattus norvegicus
atagatctctgttaaccttcatgtg

SEQ ID NO: 172899 - DNA, 25 bp, Rattus norvegicus
atagatctgagaccaaaacgtgttt

SEQ ID NO: 172900 - DNA, 25 bp, Rattus norvegicus
atagatctgagagcaaaacgtgttt

SEQ ID NO: 172901 - DNA, 25 bp, Rattus norvegicus
atagatctgcatctatcaaggaggt

SEQ ID NO: 172902 - DNA, 25 bp, Rattus norvegicus
atagatctgcatgtatcaaggaggt

SEQ ID NO: 172903 - DNA, 25 bp, Rattus norvegicus
atagatctgcttcgttttggtctcc

SEQ ID NO: 172904 - DNA, 25 bp, Rattus norvegicus
atagatctgcttggttttggtctcc

SEQ ID NO: 172905 - DNA, 25 bp, Rattus norvegicus
atagatcttagcacactctcacgga

SEQ ID NO: 172906 - DNA, 25 bp, Rattus norvegicus
atagatcttagctcactctcacgga

SEQ ID NO: 172907 - DNA, 25 bp, Rattus norvegicus
atagatctttggacaggctttcccc

SEQ ID NO: 172908 - DNA, 25 bp, Rattus norvegicus
atagatctttggtcaggctttcccc

SEQ ID NO: 172909 - DNA, 25 bp, Rattus norvegicus
atagatcttttgaacaggcattgac

SEQ ID NO: 172910 - DNA, 25 bp, Rattus norvegicus
atagatcttttgtacaggcattgac

SEQ ID NO: 172911 - DNA, 25 bp, Rattus norvegicus
atagatgactccatcctacactggg

SEQ ID NO: 172912 - DNA, 25 bp, Rattus norvegicus
atagatgactccttcctacactggg

SEQ ID NO: 172913 - DNA, 25 bp, Rattus norvegicus
atagatgatcatagtgtggcaacaa

SEQ ID NO: 172914 - DNA, 25 bp, Rattus norvegicus
atagatgatcattgtgtggcaacaa

SEQ ID NO: 172915 - DNA, 25 bp, Rattus norvegicus
atagatgatctaactcctggccttt

SEQ ID NO: 172916 - DNA, 25 bp, Rattus norvegicus
atagatgatctatctcctggccttt

SEQ ID NO: 172917 - DNA, 25 bp, Rattus norvegicus
atagatgcagttcttgtgaatgtac

SEQ ID NO: 172918 - DNA, 25 bp, Rattus norvegicus
atagatgcagttgttgtgaatgtac

SEQ ID NO: 172919 - DNA, 25 bp, Rattus norvegicus
atagatgcattgactgtttcccagg

SEQ ID NO: 172920 - DNA, 25 bp, Rattus norvegicus
atagatgcattgtctgtttcccagg

SEQ ID NO: 172921 - DNA, 25 bp, Rattus norvegicus
atagatgccatgatttgaatgctgt

SEQ ID NO: 172922 - DNA, 25 bp, Rattus norvegicus
atagatgccatgttttgaatgctgt

SEQ ID NO: 172923 - DNA, 25 bp, Rattus norvegicus
atagatgcccctagctgagggtagc

SEQ ID NO: 172924 - DNA, 25 bp, Rattus norvegicus
atagatgccccttgctgagggtagc

SEQ ID NO: 172925 - DNA, 25 bp, Rattus norvegicus
atagatgccttgcatcctgcctatg

SEQ ID NO: 172926 - DNA, 25 bp, Rattus norvegicus
atagatgccttggatcctgcctatg

SEQ ID NO: 172927 - DNA, 25 bp, Rattus norvegicus
atagatgcggtccttttctaggcaa

SEQ ID NO: 172928 - DNA, 25 bp, Rattus norvegicus
atagatgcggtcgttttctaggcaa

SEQ ID NO: 172929 - DNA, 25 bp, Rattus norvegicus
atagatgctatcagcctgcactggg

SEQ ID NO: 172930 - DNA, 25 bp, Rattus norvegicus
atagatgctatctgcctgcactggg

SEQ ID NO: 172931 - DNA, 25 bp, Rattus norvegicus
atagatgctcaaatcccttatataa

SEQ ID NO: 172932 - DNA, 25 bp, Rattus norvegicus
atagatgctcaattcccttatataa

SEQ ID NO: 172933 - DNA, 25 bp, Rattus norvegicus
atagatgctgccagttgtaagaaga

SEQ ID NO: 172934 - DNA, 25 bp, Rattus norvegicus
atagatgctgcctgttgtaagaaga

SEQ ID NO: 172935 - DNA, 25 bp, Rattus norvegicus
atagatggccccagagtttgcctcg

SEQ ID NO: 172936 - DNA, 25 bp, Rattus norvegicus
atagatggcccctgagtttgcctcg

SEQ ID NO: 172937 - DNA, 25 bp, Rattus norvegicus
atagatgggaagaggccctttctgg

SEQ ID NO: 172938 - DNA, 25 bp, Rattus norvegicus
atagatgggaagtggccctttctgg

SEQ ID NO: 172939 - DNA, 25 bp, Rattus norvegicus
atagatgggcctatcatgtgggctg

SEQ ID NO: 172940 - DNA, 25 bp, Rattus norvegicus
atagatgggcctttcatgtgggctg

SEQ ID NO: 172941 - DNA, 25 bp, Rattus norvegicus
atagatggtgtcagtgatgctccct

SEQ ID NO: 172942 - DNA, 25 bp, Rattus norvegicus
atagatggtgtctgtgatgctccct

SEQ ID NO: 172943 - DNA, 25 bp, Rattus norvegicus
atagatgtaaccctgcacactgcag

SEQ ID NO: 172944 - DNA, 25 bp, Rattus norvegicus
atagatgtaaccgtgcacactgcag

SEQ ID NO: 172945 - DNA, 25 bp, Rattus norvegicus
atagatgtatgaccctttcaggctg

SEQ ID NO: 172946 - DNA, 25 bp, Rattus norvegicus
atagatgtatgagcctttcaggctg

SEQ ID NO: 172947 - DNA, 25 bp, Rattus norvegicus
atagatgtcacacctggtcctgggc

SEQ ID NO: 172948 - DNA, 25 bp, Rattus norvegicus
atagatgtcacagctggtcctgggc

SEQ ID NO: 172949 - DNA, 25 bp, Rattus norvegicus
atagatgtgactcttgaggcccaga

SEQ ID NO: 172950 - DNA, 25 bp, Rattus norvegicus
atagatgtgactgttgaggcccaga

SEQ ID NO: 172951 - DNA, 25 bp, Rattus norvegicus
atagatgtgcagatggaccctctcc

SEQ ID NO: 172952 - DNA, 25 bp, Rattus norvegicus
atagatgtgcagttggaccctctcc

SEQ ID NO: 172953 - DNA, 25 bp, Rattus norvegicus
atagatgtgtgaaactttcaataaa

SEQ ID NO: 172954 - DNA, 25 bp, Rattus norvegicus
atagatgtgtgatactttcaataaa

SEQ ID NO: 172955 - DNA, 25 bp, Rattus norvegicus
atagatgtgtgtctcagtccttcca

SEQ ID NO: 172956 - DNA, 25 bp, Rattus norvegicus
atagatgtgtgtgtcagtccttcca

SEQ ID NO: 172957 - DNA, 25 bp, Rattus norvegicus
atagatgttctactctacctcttgt

SEQ ID NO: 172958 - DNA, 25 bp, Rattus norvegicus
atagatgttctagtctacctcttgt

SEQ ID NO: 172959 - DNA, 25 bp, Rattus norvegicus
atagatgtttaactttcacacctgt

SEQ ID NO: 172960 - DNA, 25 bp, Rattus norvegicus
atagatgtttaagtttcacacctgt

SEQ ID NO: 172961 - DNA, 25 bp, Rattus norvegicus
atagattaacaacctggatatgcag

SEQ ID NO: 172962 - DNA, 25 bp, Rattus norvegicus
atagattaacaagctggatatgcag

SEQ ID NO: 172963 - DNA, 25 bp, Rattus norvegicus
atagattaatgtccagcctcagatt

SEQ ID NO: 172964 - DNA, 25 bp, Rattus norvegicus
atagattaatgtgcagcctcagatt

SEQ ID NO: 172965 - DNA, 25 bp, Rattus norvegicus
atagattcaggtcccattctgggtt

SEQ ID NO: 172966 - DNA, 25 bp, Rattus norvegicus
atagattcaggtgccattctgggtt

SEQ ID NO: 172967 - DNA, 25 bp, Rattus norvegicus
atagattccttcattttcctttgca

SEQ ID NO: 172968 - DNA, 25 bp, Rattus norvegicus
atagattccttctttttcctttgca

SEQ ID NO: 172969 - DNA, 25 bp, Rattus norvegicus
atagattctggtatctcagcctctc

SEQ ID NO: 172970 - DNA, 25 bp, Rattus norvegicus
atagattctggtttctcagcctctc

SEQ ID NO: 172971 - DNA, 25 bp, Rattus norvegicus
atagattctgtcatattttcaatag

SEQ ID NO: 172972 - DNA, 25 bp, Rattus norvegicus
atagattctgtcttattttcaatag

SEQ ID NO: 172973 - DNA, 25 bp, Rattus norvegicus
atagattcttacctaacgccactgt

SEQ ID NO: 172974 - DNA, 25 bp, Rattus norvegicus
atagattcttacgtaacgccactgt

SEQ ID NO: 172975 - DNA, 25 bp, Rattus norvegicus
atagattcttccaacccagaggtga

SEQ ID NO: 172976 - DNA, 25 bp, Rattus norvegicus
atagattcttcctacccagaggtga

SEQ ID NO: 172977 - DNA, 25 bp, Rattus norvegicus
atagattgcacccatggcgtctgtc

SEQ ID NO: 172978 - DNA, 25 bp, Rattus norvegicus
atagattgcaccgatggcgtctgtc

SEQ ID NO: 172979 - DNA, 25 bp, Rattus norvegicus
atagattgcctaatggagctccaaa

SEQ ID NO: 172980 - DNA, 25 bp, Rattus norvegicus
atagattgcctattggagctccaaa

SEQ ID NO: 172981 - DNA, 25 bp, Rattus norvegicus
atagattgtcttagtctctgcccaa

SEQ ID NO: 172982 - DNA, 25 bp, Rattus norvegicus
atagattgtctttgtctctgcccaa

SEQ ID NO: 172983 - DNA, 25 bp, Rattus norvegicus
atagatttgaatcctccaccatcga

SEQ ID NO: 172984 - DNA, 25 bp, Rattus norvegicus
atagatttgaatgctccaccatcga

SEQ ID NO: 172985 - DNA, 25 bp, Rattus norvegicus
atagatttgattatgcctaagaata

SEQ ID NO: 172986 - DNA, 25 bp, Rattus norvegicus
atagatttgattttgcctaagaata

SEQ ID NO: 172987 - DNA, 25 bp, Rattus norvegicus
atagattttgacacctaggccttca

SEQ ID NO: 172988 - DNA, 25 bp, Rattus norvegicus
atagattttgactcctaggccttca

SEQ ID NO: 172989 - DNA, 25 bp, Rattus norvegicus
atagattttgtaaacagcgtgcaca

SEQ ID NO: 172990 - DNA, 25 bp, Rattus norvegicus
atagattttgtatacagcgtgcaca

SEQ ID NO: 172991 - DNA, 25 bp, Rattus norvegicus
atagcaaacactcctgggtctgctc

SEQ ID NO: 172992 - DNA, 25 bp, Rattus norvegicus
atagcaaacactgctgggtctgctc

SEQ ID NO: 172993 - DNA, 25 bp, Rattus norvegicus
atagcaaaccaaacctttgtgagct

SEQ ID NO: 172994 - DNA, 25 bp, Rattus norvegicus
atagcaaaccaatcctttgtgagct

SEQ ID NO: 172995 - DNA, 25 bp, Rattus norvegicus
atagcaaagattactttcccctcca

SEQ ID NO: 172996 - DNA, 25 bp, Rattus norvegicus
atagcaaagatttctttcccctcca

SEQ ID NO: 172997 - DNA, 25 bp, Rattus norvegicus
atagcaaagctgagctcctgatgaa

SEQ ID NO: 172998 - DNA, 25 bp, Rattus norvegicus
atagcaaagctgtgctcctgatgaa

SEQ ID NO: 172999 - DNA, 25 bp, Rattus norvegicus
atagcaaaggtacccctagctgact

SEQ ID NO: 173000 - DNA, 25 bp, Rattus norvegicus
atagcaaaggtagccctagctgact

SEQ ID NO: 173001 - DNA, 25 bp, Rattus norvegicus
atagcaaatcccagttagcaaatta

SEQ ID NO: 173002 - DNA, 25 bp, Rattus norvegicus
atagcaaatccctgttagcaaatta

SEQ ID NO: 173003 - DNA, 25 bp, Rattus norvegicus
atagcaaatggaactgccccttaaa

SEQ ID NO: 173004 - DNA, 25 bp, Rattus norvegicus
atagcaaatggatctgccccttaaa

SEQ ID NO: 173005 - DNA, 25 bp, Rattus norvegicus
atagcaaatgttcacttttgatggg

SEQ ID NO: 173006 - DNA, 25 bp, Rattus norvegicus
atagcaaatgttgacttttgatggg

SEQ ID NO: 173007 - DNA, 25 bp, Rattus norvegicus
atagcaacaagtatccaggcgggct

SEQ ID NO: 173008 - DNA, 25 bp, Rattus norvegicus
atagcaacaagtttccaggcgggct

SEQ ID NO: 173009 - DNA, 25 bp, Rattus norvegicus
atagcaacagcgacccgctggcgct

SEQ ID NO: 173010 - DNA, 25 bp, Rattus norvegicus
atagcaacagcgtcccgctggcgct

SEQ ID NO: 173011 - DNA, 25 bp, Rattus norvegicus
atagcaacagctcccatttaacttc

SEQ ID NO: 173012 - DNA, 25 bp, Rattus norvegicus
atagcaacagctctaccgcggagtg

SEQ ID NO: 173013 - DNA, 25 bp, Rattus norvegicus
atagcaacagctgccatttaacttc

SEQ ID NO: 173014 - DNA, 25 bp, Rattus norvegicus
atagcaacagctgtaccgcggagtg

SEQ ID NO: 173015 - DNA, 25 bp, Rattus norvegicus
atagcaaccttgcatcgattccttt

SEQ ID NO: 173016 - DNA, 25 bp, Rattus norvegicus
atagcaaccttggatcgattccttt

SEQ ID NO: 173017 - DNA, 25 bp, Rattus norvegicus
atagcaactacacaccgaggcccgg

SEQ ID NO: 173018 - DNA, 25 bp, Rattus norvegicus
atagcaactacagaccgaggcccgg

SEQ ID NO: 173019 - DNA, 25 bp, Rattus norvegicus
atagcaagacttcgccgagtatggt

SEQ ID NO: 173020 - DNA, 25 bp, Rattus norvegicus
atagcaagacttggccgagtatggt

SEQ ID NO: 173021 - DNA, 25 bp, Rattus norvegicus
atagcaagagtacgcttccttctcc

SEQ ID NO: 173022 - DNA, 25 bp, Rattus norvegicus
atagcaagagtaggcttccttctcc

SEQ ID NO: 173023 - DNA, 25 bp, Rattus norvegicus
atagcaagcattacctccctcagat

SEQ ID NO: 173024 - DNA, 25 bp, Rattus norvegicus
atagcaagcatttcctccctcagat

SEQ ID NO: 173025 - DNA, 25 bp, Rattus norvegicus
atagcaagcggccagagttcacatc

SEQ ID NO: 173026 - DNA, 25 bp, Rattus norvegicus
atagcaagcggcgagagttcacatc

SEQ ID NO: 173027 - DNA, 25 bp, Rattus norvegicus
atagcaagctcacaggtagcacaag

SEQ ID NO: 173028 - DNA, 25 bp, Rattus norvegicus
atagcaagctcagaggtagcacaag

SEQ ID NO: 173029 - DNA, 25 bp, Rattus norvegicus
atagcaaggacaaggctgatttttt

SEQ ID NO: 173030 - DNA, 25 bp, Rattus norvegicus
atagcaaggacatggctgatttttt

SEQ ID NO: 173031 - DNA, 25 bp, Rattus norvegicus
atagcaagggctcacgctcgtgcag

SEQ ID NO: 173032 - DNA, 25 bp, Rattus norvegicus
atagcaagggctgacgctcgtgcag

SEQ ID NO: 173033 - DNA, 25 bp, Rattus norvegicus
atagcaaggttgacttctgaagagt

SEQ ID NO: 173034 - DNA, 25 bp, Rattus norvegicus
atagcaaggttgtcttctgaagagt

SEQ ID NO: 173035 - DNA, 25 bp, Rattus norvegicus
atagcaagtaccagccaaaggctct

SEQ ID NO: 173036 - DNA, 25 bp, Rattus norvegicus
atagcaagtacctgccaaaggctct

SEQ ID NO: 173037 - DNA, 25 bp, Rattus norvegicus
atagcaagtgtgcagcagtggccta

SEQ ID NO: 173038 - DNA, 25 bp, Rattus norvegicus
atagcaagtgtggagcagtggccta

SEQ ID NO: 173039 - DNA, 25 bp, Rattus norvegicus
atagcaatacttagacttcttcctt

SEQ ID NO: 173040 - DNA, 25 bp, Rattus norvegicus
atagcaatactttgacttcttcctt

SEQ ID NO: 173041 - DNA, 25 bp, Rattus norvegicus
atagcaatatgtcctctgctcgtgt

SEQ ID NO: 173042 - DNA, 25 bp, Rattus norvegicus
atagcaatatgtgctctgctcgtgt

SEQ ID NO: 173043 - DNA, 25 bp, Rattus norvegicus
atagcaatctgtcattttaccttaa

SEQ ID NO: 173044 - DNA, 25 bp, Rattus norvegicus
atagcaatctgtgattttaccttaa

SEQ ID NO: 173045 - DNA, 25 bp, Rattus norvegicus
atagcaatgtagaagccccagcagg

SEQ ID NO: 173046 - DNA, 25 bp, Rattus norvegicus
atagcaatgtagtagccccagcagg

SEQ ID NO: 173047 - DNA, 25 bp, Rattus norvegicus
atagcacaactcaacccccagatgg

SEQ ID NO: 173048 - DNA, 25 bp, Rattus norvegicus
atagcacaactctacccccagatgg

SEQ ID NO: 173049 - DNA, 25 bp, Rattus norvegicus
atagcacaatgtccgtcgtctttaa

SEQ ID NO: 173050 - DNA, 25 bp, Rattus norvegicus
atagcacaatgtgcgtcgtctttaa

SEQ ID NO: 173051 - DNA, 25 bp, Rattus norvegicus
atagcacaattaatgccgagcaagt

SEQ ID NO: 173052 - DNA, 25 bp, Rattus norvegicus
atagcacaattattgccgagcaagt

SEQ ID NO: 173053 - DNA, 25 bp, Rattus norvegicus
atagcacactggctaacttcctagc

SEQ ID NO: 173054 - DNA, 25 bp, Rattus norvegicus
atagcacactgggtaacttcctagc

SEQ ID NO: 173055 - DNA, 25 bp, Rattus norvegicus
atagcacactttatccacagaggga

SEQ ID NO: 173056 - DNA, 25 bp, Rattus norvegicus
atagcacactttttccacagaggga

SEQ ID NO: 173057 - DNA, 25 bp, Rattus norvegicus
atagcacaggccagacagcactccg

SEQ ID NO: 173058 - DNA, 25 bp, Rattus norvegicus
atagcacaggcctgacagcactccg

SEQ ID NO: 173059 - DNA, 25 bp, Rattus norvegicus
atagcacagggtagctgtcggctct

SEQ ID NO: 173060 - DNA, 25 bp, Rattus norvegicus
atagcacagggttgctgtcggctct

SEQ ID NO: 173061 - DNA, 25 bp, Rattus norvegicus
atagcacagtacagaagcaccattt

SEQ ID NO: 173062 - DNA, 25 bp, Rattus norvegicus
atagcacagtactgaagcaccattt

SEQ ID NO: 173063 - DNA, 25 bp, Rattus norvegicus
atagcacagtccatcatgtggccaa

SEQ ID NO: 173064 - DNA, 25 bp, Rattus norvegicus
atagcacagtccttcatgtggccaa

SEQ ID NO: 173065 - DNA, 25 bp, Rattus norvegicus
atagcacattcacatgcacatcaca

SEQ ID NO: 173066 - DNA, 25 bp, Rattus norvegicus
atagcacattcagatgcacatcaca

SEQ ID NO: 173067 - DNA, 25 bp, Rattus norvegicus
atagcaccacataggcgtagctggc

SEQ ID NO: 173068 - DNA, 25 bp, Rattus norvegicus
atagcaccacattggcgtagctggc

SEQ ID NO: 173069 - DNA, 25 bp, Rattus norvegicus
atagcaccaggcactgaggctcagg

SEQ ID NO: 173070 - DNA, 25 bp, Rattus norvegicus
atagcaccaggctctgaggctcagg

SEQ ID NO: 173071 - DNA, 25 bp, Rattus norvegicus
atagcaccatgaaccctatcatcta

SEQ ID NO: 173072 - DNA, 25 bp, Rattus norvegicus
atagcaccatgatccctatcatcta

SEQ ID NO: 173073 - DNA, 25 bp, Rattus norvegicus
atagcaccattcatgtagagtcgca

SEQ ID NO: 173074 - DNA, 25 bp, Rattus norvegicus
atagcaccattcttgtagagtcgca

SEQ ID NO: 173075 - DNA, 25 bp, Rattus norvegicus
atagcacccatgagtctcaagaacc

SEQ ID NO: 173076 - DNA, 25 bp, Rattus norvegicus
atagcacccatgtgtctcaagaacc

SEQ ID NO: 173077 - DNA, 25 bp, Rattus norvegicus
atagcacccgagataccacgttgta

SEQ ID NO: 173078 - DNA, 25 bp, Rattus norvegicus
atagcacccgagttaccacgttgta

SEQ ID NO: 173079 - DNA, 25 bp, Rattus norvegicus
atagcacccgtaactgggcttactg

SEQ ID NO: 173080 - DNA, 25 bp, Rattus norvegicus
atagcacccgtatctgggcttactg

SEQ ID NO: 173081 - DNA, 25 bp, Rattus norvegicus
atagcacccttccttaggctaactt

SEQ ID NO: 173082 - DNA, 25 bp, Rattus norvegicus
atagcacccttcgttaggctaactt

SEQ ID NO: 173083 - DNA, 25 bp, Rattus norvegicus
atagcaccgagtccctcttaaaagc

SEQ ID NO: 173084 - DNA, 25 bp, Rattus norvegicus
atagcaccgagtgcctcttaaaagc

SEQ ID NO: 173085 - DNA, 25 bp, Rattus norvegicus
atagcacctgctctcctaattagaa

SEQ ID NO: 173086 - DNA, 25 bp, Rattus norvegicus
atagcacctgctgtcctaattagaa

SEQ ID NO: 173087 - DNA, 25 bp, Rattus norvegicus
atagcaccttcgaagttttattatg

SEQ ID NO: 173088 - DNA, 25 bp, Rattus norvegicus
atagcaccttcgtagttttattatg

SEQ ID NO: 173089 - DNA, 25 bp, Rattus norvegicus
atagcacgactgagagccatggaca

SEQ ID NO: 173090 - DNA, 25 bp, Rattus norvegicus
atagcacgactgtgagccatggaca

SEQ ID NO: 173091 - DNA, 25 bp, Rattus norvegicus
atagcacgtgctagggcagtgcact

SEQ ID NO: 173092 - DNA, 25 bp, Rattus norvegicus
atagcacgtgcttgggcagtgcact

SEQ ID NO: 173093 - DNA, 25 bp, Rattus norvegicus
atagcactatgaaaggcaccccacc

SEQ ID NO: 173094 - DNA, 25 bp, Rattus norvegicus
atagcactatgataggcaccccacc

SEQ ID NO: 173095 - DNA, 25 bp, Rattus norvegicus
atagcactctatctgtctgcatgca

SEQ ID NO: 173096 - DNA, 25 bp, Rattus norvegicus
atagcactctatgtgtctgcatgca

SEQ ID NO: 173097 - DNA, 25 bp, Rattus norvegicus
atagcactctgtatgtttaactcaa

SEQ ID NO: 173098 - DNA, 25 bp, Rattus norvegicus
atagcactctgtttgtttaactcaa

SEQ ID NO: 173099 - DNA, 25 bp, Rattus norvegicus
atagcactgaaccagggcttacatt

SEQ ID NO: 173100 - DNA, 25 bp, Rattus norvegicus
atagcactgaacgagggcttacatt

SEQ ID NO: 173101 - DNA, 25 bp, Rattus norvegicus
atagcactgatgctagaattggtct

SEQ ID NO: 173102 - DNA, 25 bp, Rattus norvegicus
atagcactgatggtagaattggtct

SEQ ID NO: 173103 - DNA, 25 bp, Rattus norvegicus
atagcactggtgaacgaccctcagc

SEQ ID NO: 173104 - DNA, 25 bp, Rattus norvegicus
atagcactggtgtacgaccctcagc

SEQ ID NO: 173105 - DNA, 25 bp, Rattus norvegicus
atagcactgtgcagtgtgccaacca

SEQ ID NO: 173106 - DNA, 25 bp, Rattus norvegicus
atagcactgtgctgtgtgccaacca

SEQ ID NO: 173107 - DNA, 25 bp, Rattus norvegicus
atagcactgtggctcacacacgggt

SEQ ID NO: 173108 - DNA, 25 bp, Rattus norvegicus
atagcactgtgggtcacacacgggt

SEQ ID NO: 173109 - DNA, 25 bp, Rattus norvegicus
atagcacttctaactttgcacaagt

SEQ ID NO: 173110 - DNA, 25 bp, Rattus norvegicus
atagcacttctatctttgcacaagt

SEQ ID NO: 173111 - DNA, 25 bp, Rattus norvegicus
atagcacttgctactttacctctgt

SEQ ID NO: 173112 - DNA, 25 bp, Rattus norvegicus
atagcacttgcttctttacctctgt

SEQ ID NO: 173113 - DNA, 25 bp, Rattus norvegicus
atagcacttgtacctgtccttgtaa

SEQ ID NO: 173114 - DNA, 25 bp, Rattus norvegicus
atagcacttgtagctgtccttgtaa

SEQ ID NO: 173115 - DNA, 25 bp, Rattus norvegicus
atagcagacacgcatgctgtccctt

SEQ ID NO: 173116 - DNA, 25 bp, Rattus norvegicus
atagcagacacggatgctgtccctt

SEQ ID NO: 173117 - DNA, 25 bp, Rattus norvegicus
atagcagacactcagtcgccagcgg

SEQ ID NO: 173118 - DNA, 25 bp, Rattus norvegicus
atagcagacactgagtcgccagcgg

SEQ ID NO: 173119 - DNA, 25 bp, Rattus norvegicus
atagcagatccgcatgtgaaacatt

SEQ ID NO: 173120 - DNA, 25 bp, Rattus norvegicus
atagcagatccggatgtgaaacatt

SEQ ID NO: 173121 - DNA, 25 bp, Rattus norvegicus
atagcagcaacaatgcagttctgaa

SEQ ID NO: 173122 - DNA, 25 bp, Rattus norvegicus
atagcagcaacattgcagttctgaa

SEQ ID NO: 173123 - DNA, 25 bp, Rattus norvegicus
atagcagcaataatcagtgaccact

SEQ ID NO: 173124 - DNA, 25 bp, Rattus norvegicus
atagcagcaatattcagtgaccact

SEQ ID NO: 173125 - DNA, 25 bp, Rattus norvegicus
atagcagcacatatcatttatggaa

SEQ ID NO: 173126 - DNA, 25 bp, Rattus norvegicus
atagcagcacatttcatttatggaa

SEQ ID NO: 173127 - DNA, 25 bp, Rattus norvegicus
atagcagcactaattgcctgtgata

SEQ ID NO: 173128 - DNA, 25 bp, Rattus norvegicus
atagcagcactatttgcctgtgata

SEQ ID NO: 173129 - DNA, 25 bp, Rattus norvegicus
atagcagcagagatttaggtcccct

SEQ ID NO: 173130 - DNA, 25 bp, Rattus norvegicus
atagcagcagagttttaggtcccct

SEQ ID NO: 173131 - DNA, 25 bp, Rattus norvegicus
atagcagcagttattcgggacaacc

SEQ ID NO: 173132 - DNA, 25 bp, Rattus norvegicus
atagcagcagtttttcgggacaacc

SEQ ID NO: 173133 - DNA, 25 bp, Rattus norvegicus
atagcagccaagaatcaggtcgacc

SEQ ID NO: 173134 - DNA, 25 bp, Rattus norvegicus
atagcagccaagtatcaggtcgacc

SEQ ID NO: 173135 - DNA, 25 bp, Rattus norvegicus
atagcagccagaacgatcccttgtg

SEQ ID NO: 173136 - DNA, 25 bp, Rattus norvegicus
atagcagccagatcgatcccttgtg

SEQ ID NO: 173137 - DNA, 25 bp, Rattus norvegicus
atagcagccccactaagtgcacctc

SEQ ID NO: 173138 - DNA, 25 bp, Rattus norvegicus
atagcagccccagtaagtgcacctc

SEQ ID NO: 173139 - DNA, 25 bp, Rattus norvegicus
atagcagccttcctgtgacgttaga

SEQ ID NO: 173140 - DNA, 25 bp, Rattus norvegicus
atagcagccttcgtgtgacgttaga

SEQ ID NO: 173141 - DNA, 25 bp, Rattus norvegicus
atagcagcgaaaacgaggccccaga

SEQ ID NO: 173142 - DNA, 25 bp, Rattus norvegicus
atagcagcgaaatcgaggccccaga

SEQ ID NO: 173143 - DNA, 25 bp, Rattus norvegicus
atagcagcggccagcttccagagga

SEQ ID NO: 173144 - DNA, 25 bp, Rattus norvegicus
atagcagcggcctgcttccagagga

SEQ ID NO: 173145 - DNA, 25 bp, Rattus norvegicus
atagcagcgtacaggatttaccggc

SEQ ID NO: 173146 - DNA, 25 bp, Rattus norvegicus
atagcagcgtactggatttaccggc

SEQ ID NO: 173147 - DNA, 25 bp, Rattus norvegicus
atagcagctcctattgcctggtgtt

SEQ ID NO: 173148 - DNA, 25 bp, Rattus norvegicus
atagcagctccttttgcctggtgtt

SEQ ID NO: 173149 - DNA, 25 bp, Rattus norvegicus
atagcagctgtgcttgttgtggcct

SEQ ID NO: 173150 - DNA, 25 bp, Rattus norvegicus
atagcagctgtggttgttgtggcct

SEQ ID NO: 173151 - DNA, 25 bp, Rattus norvegicus
atagcagcttctaggtcacccaaag

SEQ ID NO: 173152 - DNA, 25 bp, Rattus norvegicus
atagcagcttcttggtcacccaaag

SEQ ID NO: 173153 - DNA, 25 bp, Rattus norvegicus
atagcagctttacgacaatggttag

SEQ ID NO: 173154 - DNA, 25 bp, Rattus norvegicus
atagcagctttacgctcggaacctc

SEQ ID NO: 173155 - DNA, 25 bp, Rattus norvegicus
atagcagctttaggacaatggttag

SEQ ID NO: 173156 - DNA, 25 bp, Rattus norvegicus
atagcagctttaggctcggaacctc

SEQ ID NO: 173157 - DNA, 25 bp, Rattus norvegicus
atagcagcttttcactctttcattc

SEQ ID NO: 173158 - DNA, 25 bp, Rattus norvegicus
atagcagcttttgactctttcattc

SEQ ID NO: 173159 - DNA, 25 bp, Rattus norvegicus
atagcaggcttcattcacttatcaa

SEQ ID NO: 173160 - DNA, 25 bp, Rattus norvegicus
atagcaggcttctttcacttatcaa

SEQ ID NO: 173161 - DNA, 25 bp, Rattus norvegicus
atagcaggtcaacgccaactcaaat

SEQ ID NO: 173162 - DNA, 25 bp, Rattus norvegicus
atagcaggtcaaggccaactcaaat

SEQ ID NO: 173163 - DNA, 25 bp, Rattus norvegicus
atagcaggtgctaccagaatcatag

SEQ ID NO: 173164 - DNA, 25 bp, Rattus norvegicus
atagcaggtgcttccagaatcatag

SEQ ID NO: 173165 - DNA, 25 bp, Rattus norvegicus
atagcagtaaccaggccagcgttca

SEQ ID NO: 173166 - DNA, 25 bp, Rattus norvegicus
atagcagtaacctggccagcgttca

SEQ ID NO: 173167 - DNA, 25 bp, Rattus norvegicus
atagcagtagccacggagacgaacc

SEQ ID NO: 173168 - DNA, 25 bp, Rattus norvegicus
atagcagtagcctcggagacgaacc

SEQ ID NO: 173169 - DNA, 25 bp, Rattus norvegicus
atagcagtcatcatctctgcgggca

SEQ ID NO: 173170 - DNA, 25 bp, Rattus norvegicus
atagcagtcatcttctctgcgggca

SEQ ID NO: 173171 - DNA, 25 bp, Rattus norvegicus
atagcagtcattcacctggcacttc

SEQ ID NO: 173172 - DNA, 25 bp, Rattus norvegicus
atagcagtcattgacctggcacttc

SEQ ID NO: 173173 - DNA, 25 bp, Rattus norvegicus
atagcagtctgcaaggaggccgctc

SEQ ID NO: 173174 - DNA, 25 bp, Rattus norvegicus
atagcagtctgctaggaggccgctc

SEQ ID NO: 173175 - DNA, 25 bp, Rattus norvegicus
atagcagtgacactgatccgccttg

SEQ ID NO: 173176 - DNA, 25 bp, Rattus norvegicus
atagcagtgacagtgatccgccttg

SEQ ID NO: 173177 - DNA, 25 bp, Rattus norvegicus
atagcagtgcaccttcaataatatc

SEQ ID NO: 173178 - DNA, 25 bp, Rattus norvegicus
atagcagtgcacgttcaataatatc

SEQ ID NO: 173179 - DNA, 25 bp, Rattus norvegicus
atagcagtgcagagttactccagtg

SEQ ID NO: 173180 - DNA, 25 bp, Rattus norvegicus
atagcagtgcagtgttactccagtg

SEQ ID NO: 173181 - DNA, 25 bp, Rattus norvegicus
atagcagtgcccaaacagtgcaacc

SEQ ID NO: 173182 - DNA, 25 bp, Rattus norvegicus
atagcagtgccctaacagtgcaacc

SEQ ID NO: 173183 - DNA, 25 bp, Rattus norvegicus
atagcagtgctgcttgctgagcaac

SEQ ID NO: 173184 - DNA, 25 bp, Rattus norvegicus
atagcagtgctggttgctgagcaac

SEQ ID NO: 173185 - DNA, 25 bp, Rattus norvegicus
atagcagtgggcacgtctgcagcac

SEQ ID NO: 173186 - DNA, 25 bp, Rattus norvegicus
atagcagtgggctcgtctgcagcac

SEQ ID NO: 173187 - DNA, 25 bp, Rattus norvegicus
atagcagtgtccaggccagccggag

SEQ ID NO: 173188 - DNA, 25 bp, Rattus norvegicus
atagcagtgtcctggccagccggag

SEQ ID NO: 173189 - DNA, 25 bp, Rattus norvegicus
atagcagttcacatttttccacagt

SEQ ID NO: 173190 - DNA, 25 bp, Rattus norvegicus
atagcagttcacttttttccacagt

SEQ ID NO: 173191 - DNA, 25 bp, Rattus norvegicus
atagcagtttctaatcccggtctgt

SEQ ID NO: 173192 - DNA, 25 bp, Rattus norvegicus
atagcagtttcttatcccggtctgt

SEQ ID NO: 173193 - DNA, 25 bp, Rattus norvegicus
atagcagttttcattgtgtctcaag

SEQ ID NO: 173194 - DNA, 25 bp, Rattus norvegicus
atagcagttttctttgtgtctcaag

SEQ ID NO: 173195 - DNA, 25 bp, Rattus norvegicus
atagcataactacttttctgttgga

SEQ ID NO: 173196 - DNA, 25 bp, Rattus norvegicus
atagcataactagttttctgttgga

SEQ ID NO: 173197 - DNA, 25 bp, Rattus norvegicus
atagcatagagtcgccataccttcc

SEQ ID NO: 173198 - DNA, 25 bp, Rattus norvegicus
atagcatagagtggccataccttcc

SEQ ID NO: 173199 - DNA, 25 bp, Rattus norvegicus
atagcatagattcctcctcagctag

SEQ ID NO: 173200 - DNA, 25 bp, Rattus norvegicus
atagcatagattgctcctcagctag

SEQ ID NO: 173201 - DNA, 25 bp, Rattus norvegicus
atagcatagccaatcctcaagaatt

SEQ ID NO: 173202 - DNA, 25 bp, Rattus norvegicus
atagcatagccattcctcaagaatt

SEQ ID NO: 173203 - DNA, 25 bp, Rattus norvegicus
atagcatagccgcagccctgtggag

SEQ ID NO: 173204 - DNA, 25 bp, Rattus norvegicus
atagcatagccggagccctgtggag

SEQ ID NO: 173205 - DNA, 25 bp, Rattus norvegicus
atagcatagcttcccatcccaggat

SEQ ID NO: 173206 - DNA, 25 bp, Rattus norvegicus
atagcatagcttgccatcccaggat

SEQ ID NO: 173207 - DNA, 25 bp, Rattus norvegicus
atagcatcaagcctgacctgatcca

SEQ ID NO: 173208 - DNA, 25 bp, Rattus norvegicus
atagcatcaagcgtgacctgatcca

SEQ ID NO: 173209 - DNA, 25 bp, Rattus norvegicus
atagcatcacgaatgcacctttctc

SEQ ID NO: 173210 - DNA, 25 bp, Rattus norvegicus
atagcatcacgattgcacctttctc

SEQ ID NO: 173211 - DNA, 25 bp, Rattus norvegicus
atagcatcctcacaatcagactcat

SEQ ID NO: 173212 - DNA, 25 bp, Rattus norvegicus
atagcatcctcagaatcagactcat

SEQ ID NO: 173213 - DNA, 25 bp, Rattus norvegicus
atagcatctcagaactaccttggtc

SEQ ID NO: 173214 - DNA, 25 bp, Rattus norvegicus
atagcatctcagtactaccttggtc

SEQ ID NO: 173215 - DNA, 25 bp, Rattus norvegicus
atagcatctgctcaaaccacaagga

SEQ ID NO: 173216 - DNA, 25 bp, Rattus norvegicus
atagcatctgctgaaaccacaagga

SEQ ID NO: 173217 - DNA, 25 bp, Rattus norvegicus
atagcatgaaccctacatacaccac

SEQ ID NO: 173218 - DNA, 25 bp, Rattus norvegicus
atagcatgaaccgtacatacaccac

SEQ ID NO: 173219 - DNA, 25 bp, Rattus norvegicus
atagcatgcaggctgagtctccagg

SEQ ID NO: 173220 - DNA, 25 bp, Rattus norvegicus
atagcatgcagggtgagtctccagg

SEQ ID NO: 173221 - DNA, 25 bp, Rattus norvegicus
atagcatgctggctgtgtccgtgca

SEQ ID NO: 173222 - DNA, 25 bp, Rattus norvegicus
atagcatgctgggtgtgtccgtgca

SEQ ID NO: 173223 - DNA, 25 bp, Rattus norvegicus
atagcatgtgagacaggcagggcct

SEQ ID NO: 173224 - DNA, 25 bp, Rattus norvegicus
atagcatgtgagtcaggcagggcct

SEQ ID NO: 173225 - DNA, 25 bp, Rattus norvegicus
atagcattagctcttctgtatagaa

SEQ ID NO: 173226 - DNA, 25 bp, Rattus norvegicus
atagcattagctgttctgtatagaa

SEQ ID NO: 173227 - DNA, 25 bp, Rattus norvegicus
atagcattaggcctgtttatggaca

SEQ ID NO: 173228 - DNA, 25 bp, Rattus norvegicus
atagcattaggcgtgtttatggaca

SEQ ID NO: 173229 - DNA, 25 bp, Rattus norvegicus
atagcattcacgctgttgcccacac

SEQ ID NO: 173230 - DNA, 25 bp, Rattus norvegicus
atagcattcacggtgttgcccacac

SEQ ID NO: 173231 - DNA, 25 bp, Rattus norvegicus
atagcattcccactacttaatcttg

SEQ ID NO: 173232 - DNA, 25 bp, Rattus norvegicus
atagcattcccagtacttaatcttg

SEQ ID NO: 173233 - DNA, 25 bp, Rattus norvegicus
atagcattcttcacatggtcacatg

SEQ ID NO: 173234 - DNA, 25 bp, Rattus norvegicus
atagcattcttctcatggtcacatg

SEQ ID NO: 173235 - DNA, 25 bp, Rattus norvegicus
atagcattggacatctcaggcagac

SEQ ID NO: 173236 - DNA, 25 bp, Rattus norvegicus
atagcattggacttctcaggcagac

SEQ ID NO: 173237 - DNA, 25 bp, Rattus norvegicus
atagcattgttccacagggacccaa

SEQ ID NO: 173238 - DNA, 25 bp, Rattus norvegicus
atagcattgttcgacagggacccaa

SEQ ID NO: 173239 - DNA, 25 bp, Rattus norvegicus
atagcatttaccattcgtttgtgcc

SEQ ID NO: 173240 - DNA, 25 bp, Rattus norvegicus
atagcatttacctttcgtttgtgcc

SEQ ID NO: 173241 - DNA, 25 bp, Rattus norvegicus
atagcatttaggcatctcctgggct

SEQ ID NO: 173242 - DNA, 25 bp, Rattus norvegicus
atagcatttagggatctcctgggct

SEQ ID NO: 173243 - DNA, 25 bp, Rattus norvegicus
atagcatttctaatgcaaccagatg

SEQ ID NO: 173244 - DNA, 25 bp, Rattus norvegicus
atagcatttctattgcaaccagatg

SEQ ID NO: 173245 - DNA, 25 bp, Rattus norvegicus
atagcatttcttacatttacattct

SEQ ID NO: 173246 - DNA, 25 bp, Rattus norvegicus
atagcatttctttcatttacattct

SEQ ID NO: 173247 - DNA, 25 bp, Rattus norvegicus
atagcatttgccatgatcacaccct

SEQ ID NO: 173248 - DNA, 25 bp, Rattus norvegicus
atagcatttgccttgatcacaccct

SEQ ID NO: 173249 - DNA, 25 bp, Rattus norvegicus
atagcatttttaaccagaccacatt

SEQ ID NO: 173250 - DNA, 25 bp, Rattus norvegicus
atagcatttttatccagaccacatt

SEQ ID NO: 173251 - DNA, 25 bp, Rattus norvegicus
atagccaatctcctagcccaaagaa

SEQ ID NO: 173252 - DNA, 25 bp, Rattus norvegicus
atagccaatctcgtagcccaaagaa

SEQ ID NO: 173253 - DNA, 25 bp, Rattus norvegicus
atagccacacccatgattcacagtt

SEQ ID NO: 173254 - DNA, 25 bp, Rattus norvegicus
atagccacacccttgattcacagtt

SEQ ID NO: 173255 - DNA, 25 bp, Rattus norvegicus
atagccacactgaaattgagagttt

SEQ ID NO: 173256 - DNA, 25 bp, Rattus norvegicus
atagccacactgtaattgagagttt

SEQ ID NO: 173257 - DNA, 25 bp, Rattus norvegicus
atagccacagctcaactacttagag

SEQ ID NO: 173258 - DNA, 25 bp, Rattus norvegicus
atagccacagctgaactacttagag

SEQ ID NO: 173259 - DNA, 25 bp, Rattus norvegicus
atagccacccaaatgccgggatcac

SEQ ID NO: 173260 - DNA, 25 bp, Rattus norvegicus
atagccacccaattgccgggatcac

SEQ ID NO: 173261 - DNA, 25 bp, Rattus norvegicus
atagccaccctgcattcattcagat

SEQ ID NO: 173262 - DNA, 25 bp, Rattus norvegicus
atagccaccctggattcattcagat

SEQ ID NO: 173263 - DNA, 25 bp, Rattus norvegicus
atagccactcctcttgtagcaataa

SEQ ID NO: 173264 - DNA, 25 bp, Rattus norvegicus
atagccactcctgttgtagcaataa

SEQ ID NO: 173265 - DNA, 25 bp, Rattus norvegicus
atagccactgtgaaggatacctgcc

SEQ ID NO: 173266 - DNA, 25 bp, Rattus norvegicus
atagccactgtgtaggatacctgcc

SEQ ID NO: 173267 - DNA, 25 bp, Rattus norvegicus
atagccagagtcagcagctcacaga

SEQ ID NO: 173268 - DNA, 25 bp, Rattus norvegicus
atagccagagtctgcagctcacaga

SEQ ID NO: 173269 - DNA, 25 bp, Rattus norvegicus
atagccagcattcagcacacgcaaa

SEQ ID NO: 173270 - DNA, 25 bp, Rattus norvegicus
atagccagcattgagcacacgcaaa

SEQ ID NO: 173271 - DNA, 25 bp, Rattus norvegicus
atagccagccgtcaagccaaactgc

SEQ ID NO: 173272 - DNA, 25 bp, Rattus norvegicus
atagccagccgtgaagccaaactgc

SEQ ID NO: 173273 - DNA, 25 bp, Rattus norvegicus
atagccagctacatcggccagggct

SEQ ID NO: 173274 - DNA, 25 bp, Rattus norvegicus
atagccagctacttcggccagggct

SEQ ID NO: 173275 - DNA, 25 bp, Rattus norvegicus
atagccagctcaaatcggaggtgtc

SEQ ID NO: 173276 - DNA, 25 bp, Rattus norvegicus
atagccagctcatatcggaggtgtc

SEQ ID NO: 173277 - DNA, 25 bp, Rattus norvegicus
atagccagctgtaccaatgaccaga

SEQ ID NO: 173278 - DNA, 25 bp, Rattus norvegicus
atagccagctgttccaatgaccaga

SEQ ID NO: 173279 - DNA, 25 bp, Rattus norvegicus
atagccaggtggaggcaagcctgct

SEQ ID NO: 173280 - DNA, 25 bp, Rattus norvegicus
atagccaggtggtggcaagcctgct

SEQ ID NO: 173281 - DNA, 25 bp, Rattus norvegicus
atagccagtaccagggctggtgtca

SEQ ID NO: 173282 - DNA, 25 bp, Rattus norvegicus
atagccagtacctgggctggtgtca

SEQ ID NO: 173283 - DNA, 25 bp, Rattus norvegicus
atagccagttctactccagctggag

SEQ ID NO: 173284 - DNA, 25 bp, Rattus norvegicus
atagccagttcttctccagctggag

SEQ ID NO: 173285 - DNA, 25 bp, Rattus norvegicus
atagccatcagtccagcaacctatg

SEQ ID NO: 173286 - DNA, 25 bp, Rattus norvegicus
atagccatcagtgcagcaacctatg

SEQ ID NO: 173287 - DNA, 25 bp, Rattus norvegicus
atagccatcctcatccatatagcct

SEQ ID NO: 173288 - DNA, 25 bp, Rattus norvegicus
atagccatcctcttccatatagcct

SEQ ID NO: 173289 - DNA, 25 bp, Rattus norvegicus
atagccatcgttaataccacagaag

SEQ ID NO: 173290 - DNA, 25 bp, Rattus norvegicus
atagccatcgtttataccacagaag

SEQ ID NO: 173291 - DNA, 25 bp, Rattus norvegicus
atagccatcttcattcacagttgcc

SEQ ID NO: 173292 - DNA, 25 bp, Rattus norvegicus
atagccatcttctttcacagttgcc

SEQ ID NO: 173293 - DNA, 25 bp, Rattus norvegicus
atagccatgaatctttctctctcct

SEQ ID NO: 173294 - DNA, 25 bp, Rattus norvegicus
atagccatgaatgtttctctctcct

SEQ ID NO: 173295 - DNA, 25 bp, Rattus norvegicus
atagccatggccagagctcctaagt

SEQ ID NO: 173296 - DNA, 25 bp, Rattus norvegicus
atagccatggcctgagctcctaagt

SEQ ID NO: 173297 - DNA, 25 bp, Rattus norvegicus
atagccattcgtactggaagaccag

SEQ ID NO: 173298 - DNA, 25 bp, Rattus norvegicus
atagccattcgttctggaagaccag

SEQ ID NO: 173299 - DNA, 25 bp, Rattus norvegicus
atagccattctcactgatgacctaa

SEQ ID NO: 173300 - DNA, 25 bp, Rattus norvegicus
atagccattctctctgatgacctaa

SEQ ID NO: 173301 - DNA, 25 bp, Rattus norvegicus
atagccattgctcttggcactgccc

SEQ ID NO: 173302 - DNA, 25 bp, Rattus norvegicus
atagccattgctgttggcactgccc

SEQ ID NO: 173303 - DNA, 25 bp, Rattus norvegicus
atagcccaccccatgaaattgtggc

SEQ ID NO: 173304 - DNA, 25 bp, Rattus norvegicus
atagcccaccccttgaaattgtggc

SEQ ID NO: 173305 - DNA, 25 bp, Rattus norvegicus
atagcccagacactactttgacagt

SEQ ID NO: 173306 - DNA, 25 bp, Rattus norvegicus
atagcccagacagtactttgacagt

SEQ ID NO: 173307 - DNA, 25 bp, Rattus norvegicus
atagcccagcagcgcttttcctgga

SEQ ID NO: 173308 - DNA, 25 bp, Rattus norvegicus
atagcccagcagctagcggatatcg

SEQ ID NO: 173309 - DNA, 25 bp, Rattus norvegicus
atagcccagcagggcttttcctgga

SEQ ID NO: 173310 - DNA, 25 bp, Rattus norvegicus
atagcccagcaggtagcggatatcg

SEQ ID NO: 173311 - DNA, 25 bp, Rattus norvegicus
atagcccagcttaacagttcccgga

SEQ ID NO: 173312 - DNA, 25 bp, Rattus norvegicus
atagcccagctttacagttcccgga

SEQ ID NO: 173313 - DNA, 25 bp, Rattus norvegicus
atagcccaggaaaaatgttcatcaa

SEQ ID NO: 173314 - DNA, 25 bp, Rattus norvegicus
atagcccaggaataatgttcatcaa

SEQ ID NO: 173315 - DNA, 25 bp, Rattus norvegicus
atagcccaggatcgcgatcttccgg

SEQ ID NO: 173316 - DNA, 25 bp, Rattus norvegicus
atagcccaggatggcgatcttccgg

SEQ ID NO: 173317 - DNA, 25 bp, Rattus norvegicus
atagcccaggctaacagtgattctg

SEQ ID NO: 173318 - DNA, 25 bp, Rattus norvegicus
atagcccaggcttacagtgattctg

SEQ ID NO: 173319 - DNA, 25 bp, Rattus norvegicus
atagcccagtgtcccctgtgaggag

SEQ ID NO: 173320 - DNA, 25 bp, Rattus norvegicus
atagcccagtgtgccctgtgaggag

SEQ ID NO: 173321 - DNA, 25 bp, Rattus norvegicus
atagcccattttatcacaggattct

SEQ ID NO: 173322 - DNA, 25 bp, Rattus norvegicus
atagcccattttttcacaggattct

SEQ ID NO: 173323 - DNA, 25 bp, Rattus norvegicus
atagccccaggacagaagtactttc

SEQ ID NO: 173324 - DNA, 25 bp, Rattus norvegicus
atagccccaggagagaagtactttc

SEQ ID NO: 173325 - DNA, 25 bp, Rattus norvegicus
atagccccatataccaatgatctgt

SEQ ID NO: 173326 - DNA, 25 bp, Rattus norvegicus
atagccccatattccaatgatctgt

SEQ ID NO: 173327 - DNA, 25 bp, Rattus norvegicus
atagcccctagaatgtttcagaccc

SEQ ID NO: 173328 - DNA, 25 bp, Rattus norvegicus
atagcccctagattgtttcagaccc

SEQ ID NO: 173329 - DNA, 25 bp, Rattus norvegicus
atagccccttaaagagcactgttga

SEQ ID NO: 173330 - DNA, 25 bp, Rattus norvegicus
atagccccttaatgagcactgttga

SEQ ID NO: 173331 - DNA, 25 bp, Rattus norvegicus
atagccccttgactgtgcattcttc

SEQ ID NO: 173332 - DNA, 25 bp, Rattus norvegicus
atagccccttgagtgtgcattcttc

SEQ ID NO: 173333 - DNA, 25 bp, Rattus norvegicus
atagcccgcagtcgcagtcggagtt

SEQ ID NO: 173334 - DNA, 25 bp, Rattus norvegicus
atagcccgcagtggcagtcggagtt

SEQ ID NO: 173335 - DNA, 25 bp, Rattus norvegicus
atagcccgcatgctgcactggtagc

SEQ ID NO: 173336 - DNA, 25 bp, Rattus norvegicus
atagcccgcatggtgcactggtagc

SEQ ID NO: 173337 - DNA, 25 bp, Rattus norvegicus
atagcccggcacctacgaggttgta

SEQ ID NO: 173338 - DNA, 25 bp, Rattus norvegicus
atagcccggcacgtacgaggttgta

SEQ ID NO: 173339 - DNA, 25 bp, Rattus norvegicus
atagcccgtgctacgtgtttaacag

SEQ ID NO: 173340 - DNA, 25 bp, Rattus norvegicus
atagcccgtgcttcgtgtttaacag

SEQ ID NO: 173341 - DNA, 25 bp, Rattus norvegicus
atagcccgtttcatcagccttaaag

SEQ ID NO: 173342 - DNA, 25 bp, Rattus norvegicus
atagcccgtttcttcagccttaaag

SEQ ID NO: 173343 - DNA, 25 bp, Rattus norvegicus
atagccctcatgagtgtggttccgc

SEQ ID NO: 173344 - DNA, 25 bp, Rattus norvegicus
atagccctcatgtgtgtggttccgc

SEQ ID NO: 173345 - DNA, 25 bp, Rattus norvegicus
atagccctgaggaacaacatggatc

SEQ ID NO: 173346 - DNA, 25 bp, Rattus norvegicus
atagccctgaggtacaacatggatc

SEQ ID NO: 173347 - DNA, 25 bp, Rattus norvegicus
atagccctgcgtcggtgttgtattg

SEQ ID NO: 173348 - DNA, 25 bp, Rattus norvegicus
atagccctgcgtgggtgttgtattg

SEQ ID NO: 173349 - DNA, 25 bp, Rattus norvegicus
atagccctgggcaggctacctgctc

SEQ ID NO: 173350 - DNA, 25 bp, Rattus norvegicus
atagccctgggcaggtgtgcctgca

SEQ ID NO: 173351 - DNA, 25 bp, Rattus norvegicus
atagccctgggcctgtgggacaaac

SEQ ID NO: 173352 - DNA, 25 bp, Rattus norvegicus
atagccctgggcgtgtgggacaaac

SEQ ID NO: 173353 - DNA, 25 bp, Rattus norvegicus
atagccctgggctggctacctgctc

SEQ ID NO: 173354 - DNA, 25 bp, Rattus norvegicus
atagccctgggctggtgtgcctgca

SEQ ID NO: 173355 - DNA, 25 bp, Rattus norvegicus
atagccctggtgcttcagcctgttt

SEQ ID NO: 173356 - DNA, 25 bp, Rattus norvegicus
atagccctggtggttcagcctgttt

SEQ ID NO: 173357 - DNA, 25 bp, Rattus norvegicus
atagccctgtgcaagctcattagct

SEQ ID NO: 173358 - DNA, 25 bp, Rattus norvegicus
atagccctgtgctagctcattagct

SEQ ID NO: 173359 - DNA, 25 bp, Rattus norvegicus
atagcccttgctacaggccagatgg

SEQ ID NO: 173360 - DNA, 25 bp, Rattus norvegicus
atagcccttgctcttcaggaactta

SEQ ID NO: 173361 - DNA, 25 bp, Rattus norvegicus
atagcccttgctgttcaggaactta

SEQ ID NO: 173362 - DNA, 25 bp, Rattus norvegicus
atagcccttgcttcaggccagatgg

SEQ ID NO: 173363 - DNA, 25 bp, Rattus norvegicus
atagcccttggcactttgaggactg

SEQ ID NO: 173364 - DNA, 25 bp, Rattus norvegicus
atagcccttggctctttgaggactg

SEQ ID NO: 173365 - DNA, 25 bp, Rattus norvegicus
atagcccttttgctagtgatggtcc

SEQ ID NO: 173366 - DNA, 25 bp, Rattus norvegicus
atagcccttttggtagtgatggtcc

SEQ ID NO: 173367 - DNA, 25 bp, Rattus norvegicus
atagccgatcgacaggcatgccaga

SEQ ID NO: 173368 - DNA, 25 bp, Rattus norvegicus
atagccgatcgagaggcatgccaga

SEQ ID NO: 173369 - DNA, 25 bp, Rattus norvegicus
atagccgatgacacagggcggagtt

SEQ ID NO: 173370 - DNA, 25 bp, Rattus norvegicus
atagccgatgactcagggcggagtt

SEQ ID NO: 173371 - DNA, 25 bp, Rattus norvegicus
atagccgcctctctgaattcaggag

SEQ ID NO: 173372 - DNA, 25 bp, Rattus norvegicus
atagccgcctctgtgaattcaggag

SEQ ID NO: 173373 - DNA, 25 bp, Rattus norvegicus
atagccgcgatcagtggagacttgc

SEQ ID NO: 173374 - DNA, 25 bp, Rattus norvegicus
atagccgcgatctgtggagacttgc

SEQ ID NO: 173375 - DNA, 25 bp, Rattus norvegicus
atagccgctctgctgaaggaggctt

SEQ ID NO: 173376 - DNA, 25 bp, Rattus norvegicus
atagccgctctggtgaaggaggctt

SEQ ID NO: 173377 - DNA, 25 bp, Rattus norvegicus
atagccgctgcaatcactgtctagc

SEQ ID NO: 173378 - DNA, 25 bp, Rattus norvegicus
atagccgctgcattcactgtctagc

SEQ ID NO: 173379 - DNA, 25 bp, Rattus norvegicus
atagccgctggcatcggaagctgaa

SEQ ID NO: 173380 - DNA, 25 bp, Rattus norvegicus
atagccgctggcttcggaagctgaa

SEQ ID NO: 173381 - DNA, 25 bp, Rattus norvegicus
atagccggcataccatgaatgtacc

SEQ ID NO: 173382 - DNA, 25 bp, Rattus norvegicus
atagccggcatagcatgaatgtacc

SEQ ID NO: 173383 - DNA, 25 bp, Rattus norvegicus
atagccggctctcgctgcgagtcca

SEQ ID NO: 173384 - DNA, 25 bp, Rattus norvegicus
atagccggctctggctgcgagtcca

SEQ ID NO: 173385 - DNA, 25 bp, Rattus norvegicus
atagccggctggaaaacgacaccta

SEQ ID NO: 173386 - DNA, 25 bp, Rattus norvegicus
atagccggctggtaaacgacaccta

SEQ ID NO: 173387 - DNA, 25 bp, Rattus norvegicus
atagccgggatcacgtggcgagact

SEQ ID NO: 173388 - DNA, 25 bp, Rattus norvegicus
atagccgggatctcgtggcgagact

SEQ ID NO: 173389 - DNA, 25 bp, Rattus norvegicus
atagccgggctaatcagaggtaacc

SEQ ID NO: 173390 - DNA, 25 bp, Rattus norvegicus
atagccgggctattcagaggtaacc

SEQ ID NO: 173391 - DNA, 25 bp, Rattus norvegicus
atagccgggttcatcgtgtttgcca

SEQ ID NO: 173392 - DNA, 25 bp, Rattus norvegicus
atagccgggttcttcgtgtttgcca

SEQ ID NO: 173393 - DNA, 25 bp, Rattus norvegicus
atagccgtaattcaccttatttaga

SEQ ID NO: 173394 - DNA, 25 bp, Rattus norvegicus
atagccgtaattgaccttatttaga

SEQ ID NO: 173395 - DNA, 25 bp, Rattus norvegicus
atagccgtatttcccaagagtccgc

SEQ ID NO: 173396 - DNA, 25 bp, Rattus norvegicus
atagccgtatttgccaagagtccgc

SEQ ID NO: 173397 - DNA, 25 bp, Rattus norvegicus
atagccgtctcactaggtttcagaa

SEQ ID NO: 173398 - DNA, 25 bp, Rattus norvegicus
atagccgtctcagtaggtttcagaa

SEQ ID NO: 173399 - DNA, 25 bp, Rattus norvegicus
atagccgtgcatatcatttgtttag

SEQ ID NO: 173400 - DNA, 25 bp, Rattus norvegicus
atagccgtgcatttcatttgtttag

SEQ ID NO: 173401 - DNA, 25 bp, Rattus norvegicus
atagccgtgcgcagggtatcaacat

SEQ ID NO: 173402 - DNA, 25 bp, Rattus norvegicus
atagccgtgcgctgggtatcaacat

SEQ ID NO: 173403 - DNA, 25 bp, Rattus norvegicus
atagcctacaaccacagacgtgtct

SEQ ID NO: 173404 - DNA, 25 bp, Rattus norvegicus
atagcctacaacgacagacgtgtct

SEQ ID NO: 173405 - DNA, 25 bp, Rattus norvegicus
atagcctacactcggcctgaactag

SEQ ID NO: 173406 - DNA, 25 bp, Rattus norvegicus
atagcctacactgggcctgaactag

SEQ ID NO: 173407 - DNA, 25 bp, Rattus norvegicus
atagcctagagcacagttttagttt

SEQ ID NO: 173408 - DNA, 25 bp, Rattus norvegicus
atagcctagagctcagttttagttt

SEQ ID NO: 173409 - DNA, 25 bp, Rattus norvegicus
atagcctaggaccatgatcctggta

SEQ ID NO: 173410 - DNA, 25 bp, Rattus norvegicus
atagcctaggacgatgatcctggta

SEQ ID NO: 173411 - DNA, 25 bp, Rattus norvegicus
atagcctcagacagttagttccttc

SEQ ID NO: 173412 - DNA, 25 bp, Rattus norvegicus
atagcctcagactgttagttccttc

SEQ ID NO: 173413 - DNA, 25 bp, Rattus norvegicus
atagcctccgcgctgtgatggatgc

SEQ ID NO: 173414 - DNA, 25 bp, Rattus norvegicus
atagcctccgcggtgtgatggatgc

SEQ ID NO: 173415 - DNA, 25 bp, Rattus norvegicus
atagcctccggccacaatggtccaa

SEQ ID NO: 173416 - DNA, 25 bp, Rattus norvegicus
atagcctccggcgacaatggtccaa

SEQ ID NO: 173417 - DNA, 25 bp, Rattus norvegicus
atagcctcctctaagaatttctctg

SEQ ID NO: 173418 - DNA, 25 bp, Rattus norvegicus
atagcctcctcttagaatttctctg

SEQ ID NO: 173419 - DNA, 25 bp, Rattus norvegicus
atagcctctcttaaagaatttcaca

SEQ ID NO: 173420 - DNA, 25 bp, Rattus norvegicus
atagcctctcttcagtgttcacaga

SEQ ID NO: 173421 - DNA, 25 bp, Rattus norvegicus
atagcctctcttgagtgttcacaga

SEQ ID NO: 173422 - DNA, 25 bp, Rattus norvegicus
atagcctctctttaagaatttcaca

SEQ ID NO: 173423 - DNA, 25 bp, Rattus norvegicus
atagcctctggtcatgcctgtcctg

SEQ ID NO: 173424 - DNA, 25 bp, Rattus norvegicus
atagcctctggtgatgcctgtcctg

SEQ ID NO: 173425 - DNA, 25 bp, Rattus norvegicus
atagcctgaaaaacgttttgtagat

SEQ ID NO: 173426 - DNA, 25 bp, Rattus norvegicus
atagcctgaaaatcgttttgtagat

SEQ ID NO: 173427 - DNA, 25 bp, Rattus norvegicus
atagcctgacttcaataacaccctc

SEQ ID NO: 173428 - DNA, 25 bp, Rattus norvegicus
atagcctgacttgaataacaccctc

SEQ ID NO: 173429 - DNA, 25 bp, Rattus norvegicus
atagcctgagtaacccaaaagttct

SEQ ID NO: 173430 - DNA, 25 bp, Rattus norvegicus
atagcctgagtatcccaaaagttct

SEQ ID NO: 173431 - DNA, 25 bp, Rattus norvegicus
atagcctggcaacctctacatgtct

SEQ ID NO: 173432 - DNA, 25 bp, Rattus norvegicus
atagcctggcaagctctacatgtct

SEQ ID NO: 173433 - DNA, 25 bp, Rattus norvegicus
atagcctgggagaccatactcgact

SEQ ID NO: 173434 - DNA, 25 bp, Rattus norvegicus
atagcctgggagtccatactcgact

SEQ ID NO: 173435 - DNA, 25 bp, Rattus norvegicus
atagcctgggatctgtttctgaagc

SEQ ID NO: 173436 - DNA, 25 bp, Rattus norvegicus
atagcctgggatgtgtttctgaagc

SEQ ID NO: 173437 - DNA, 25 bp, Rattus norvegicus
atagcctgggcaaattctagcactg

SEQ ID NO: 173438 - DNA, 25 bp, Rattus norvegicus
atagcctgggcatattctagcactg

SEQ ID NO: 173439 - DNA, 25 bp, Rattus norvegicus
atagcctgggtcatgtatctttgta

SEQ ID NO: 173440 - DNA, 25 bp, Rattus norvegicus
atagcctgggtcttgtatctttgta

SEQ ID NO: 173441 - DNA, 25 bp, Rattus norvegicus
atagcctgtcctcagaagcccttcg

SEQ ID NO: 173442 - DNA, 25 bp, Rattus norvegicus
atagcctgtcctgagaagcccttcg

SEQ ID NO: 173443 - DNA, 25 bp, Rattus norvegicus
atagcctgtgctaaggcctggctca

SEQ ID NO: 173444 - DNA, 25 bp, Rattus norvegicus
atagcctgtgcttaggcctggctca

SEQ ID NO: 173445 - DNA, 25 bp, Rattus norvegicus
atagcctgtttgctttgctcactag

SEQ ID NO: 173446 - DNA, 25 bp, Rattus norvegicus
atagcctgtttggtttgctcactag

SEQ ID NO: 173447 - DNA, 25 bp, Rattus norvegicus
atagccttaggaatgcagacggaaa

SEQ ID NO: 173448 - DNA, 25 bp, Rattus norvegicus
atagccttaggattgcagacggaaa

SEQ ID NO: 173449 - DNA, 25 bp, Rattus norvegicus
atagccttatttacccttgttatgg

SEQ ID NO: 173450 - DNA, 25 bp, Rattus norvegicus
atagccttattttcccttgttatgg

SEQ ID NO: 173451 - DNA, 25 bp, Rattus norvegicus
atagccttcagcatttacatatcag

SEQ ID NO: 173452 - DNA, 25 bp, Rattus norvegicus
atagccttcagcttttacatatcag

SEQ ID NO: 173453 - DNA, 25 bp, Rattus norvegicus
atagccttcccgcttgtgggtgcaa

SEQ ID NO: 173454 - DNA, 25 bp, Rattus norvegicus
atagccttcccggttgtgggtgcaa

SEQ ID NO: 173455 - DNA, 25 bp, Rattus norvegicus
atagccttctatatatttctcattg

SEQ ID NO: 173456 - DNA, 25 bp, Rattus norvegicus
atagccttctatttatttctcattg

SEQ ID NO: 173457 - DNA, 25 bp, Rattus norvegicus
atagccttgatcacatgtagaccag

SEQ ID NO: 173458 - DNA, 25 bp, Rattus norvegicus
atagccttgatctcatgtagaccag

SEQ ID NO: 173459 - DNA, 25 bp, Rattus norvegicus
atagccttggtgagtccatgcttcc

SEQ ID NO: 173460 - DNA, 25 bp, Rattus norvegicus
atagccttggtgtgtccatgcttcc

SEQ ID NO: 173461 - DNA, 25 bp, Rattus norvegicus
atagcctttacaatacggacttctg

SEQ ID NO: 173462 - DNA, 25 bp, Rattus norvegicus
atagcctttacattacggacttctg

SEQ ID NO: 173463 - DNA, 25 bp, Rattus norvegicus
atagcctttgcaccaagtctgaatc

SEQ ID NO: 173464 - DNA, 25 bp, Rattus norvegicus
atagcctttgcagcaagtctgaatc

SEQ ID NO: 173465 - DNA, 25 bp, Rattus norvegicus
atagcctttgctatttaactgtccg

SEQ ID NO: 173466 - DNA, 25 bp, Rattus norvegicus
atagcctttgctttttaactgtccg

SEQ ID NO: 173467 - DNA, 25 bp, Rattus norvegicus
atagcctttttcatactgttccttt

SEQ ID NO: 173468 - DNA, 25 bp, Rattus norvegicus
atagcctttttcttactgttccttt

SEQ ID NO: 173469 - DNA, 25 bp, Rattus norvegicus
atagcgaccctgctaaggatgctcg

SEQ ID NO: 173470 - DNA, 25 bp, Rattus norvegicus
atagcgaccctggtaaggatgctcg

SEQ ID NO: 173471 - DNA, 25 bp, Rattus norvegicus
atagcgagagctctgtgtctaggaa

SEQ ID NO: 173472 - DNA, 25 bp, Rattus norvegicus
atagcgagagctgtgtgtctaggaa

SEQ ID NO: 173473 - DNA, 25 bp, Rattus norvegicus
atagcgccatcgacagcgggatcaa

SEQ ID NO: 173474 - DNA, 25 bp, Rattus norvegicus
atagcgccatcgtcagcgggatcaa

SEQ ID NO: 173475 - DNA, 25 bp, Rattus norvegicus
atagcgcccgccaaagagttcggct

SEQ ID NO: 173476 - DNA, 25 bp, Rattus norvegicus
atagcgcccgcctaagagttcggct

SEQ ID NO: 173477 - DNA, 25 bp, Rattus norvegicus
atagcgcggtgcctgaacatcgagt

SEQ ID NO: 173478 - DNA, 25 bp, Rattus norvegicus
atagcgcggtgcgtgaacatcgagt

SEQ ID NO: 173479 - DNA, 25 bp, Rattus norvegicus
atagcgctcagtcggtagatgaata

SEQ ID NO: 173480 - DNA, 25 bp, Rattus norvegicus
atagcgctcagtgggtagatgaata

SEQ ID NO: 173481 - DNA, 25 bp, Rattus norvegicus
atagcgctctgtcagtctcggatgg

SEQ ID NO: 173482 - DNA, 25 bp, Rattus norvegicus
atagcgctctgtgagtctcggatgg

SEQ ID NO: 173483 - DNA, 25 bp, Rattus norvegicus
atagcgctggaaactggactctgtt

SEQ ID NO: 173484 - DNA, 25 bp, Rattus norvegicus
atagcgctggaatctggactctgtt

SEQ ID NO: 173485 - DNA, 25 bp, Rattus norvegicus
atagcgctggccatcaggtggattg

SEQ ID NO: 173486 - DNA, 25 bp, Rattus norvegicus
atagcgctggccttcaggtggattg

SEQ ID NO: 173487 - DNA, 25 bp, Rattus norvegicus
atagcgctgtggctacagaccctag

SEQ ID NO: 173488 - DNA, 25 bp, Rattus norvegicus
atagcgctgtgggtacagaccctag

SEQ ID NO: 173489 - DNA, 25 bp, Rattus norvegicus
atagcggaagaacgcatctgccttc

SEQ ID NO: 173490 - DNA, 25 bp, Rattus norvegicus
atagcggaagaaggcatctgccttc

SEQ ID NO: 173491 - DNA, 25 bp, Rattus norvegicus
atagcgggcaagatccttcatgtgg

SEQ ID NO: 173492 - DNA, 25 bp, Rattus norvegicus
atagcgggcaagttccttcatgtgg

SEQ ID NO: 173493 - DNA, 25 bp, Rattus norvegicus
atagcgggccggcacaccattccgg

SEQ ID NO: 173494 - DNA, 25 bp, Rattus norvegicus
atagcgggccgggacaccattccgg

SEQ ID NO: 173495 - DNA, 25 bp, Rattus norvegicus
atagcgggtgttctcatgtgtttct

SEQ ID NO: 173496 - DNA, 25 bp, Rattus norvegicus
atagcgggtgttgtcatgtgtttct

SEQ ID NO: 173497 - DNA, 25 bp, Rattus norvegicus
atagcggtaactcgttcctctagtg

SEQ ID NO: 173498 - DNA, 25 bp, Rattus norvegicus
atagcggtaactggttcctctagtg

SEQ ID NO: 173499 - DNA, 25 bp, Rattus norvegicus
atagcggtctatctaccctaattct

SEQ ID NO: 173500 - DNA, 25 bp, Rattus norvegicus
atagcggtctatgtaccctaattct

SEQ ID NO: 173501 - DNA, 25 bp, Rattus norvegicus
atagcgtagattattgctcttctgt

SEQ ID NO: 173502 - DNA, 25 bp, Rattus norvegicus
atagcgtagatttttgctcttctgt

SEQ ID NO: 173503 - DNA, 25 bp, Rattus norvegicus
atagcgtattccaactctgtgaagt

SEQ ID NO: 173504 - DNA, 25 bp, Rattus norvegicus
atagcgtattcctactctgtgaagt

SEQ ID NO: 173505 - DNA, 25 bp, Rattus norvegicus
atagcgtcgaggacatccagccact

SEQ ID NO: 173506 - DNA, 25 bp, Rattus norvegicus
atagcgtcgaggtcatccagccact

SEQ ID NO: 173507 - DNA, 25 bp, Rattus norvegicus
atagcgtctgacatttaaggcatcc

SEQ ID NO: 173508 - DNA, 25 bp, Rattus norvegicus
atagcgtctgacttttaaggcatcc

SEQ ID NO: 173509 - DNA, 25 bp, Rattus norvegicus
atagcgtctgttcttagatgcctgc

SEQ ID NO: 173510 - DNA, 25 bp, Rattus norvegicus
atagcgtctgttgttagatgcctgc

SEQ ID NO: 173511 - DNA, 25 bp, Rattus norvegicus
atagcgttctctatccaggcactga

SEQ ID NO: 173512 - DNA, 25 bp, Rattus norvegicus
atagcgttctctttccaggcactga

SEQ ID NO: 173513 - DNA, 25 bp, Rattus norvegicus
atagctaaactaccctctgacccat

SEQ ID NO: 173514 - DNA, 25 bp, Rattus norvegicus
atagctaaactagcctctgacccat

SEQ ID NO: 173515 - DNA, 25 bp, Rattus norvegicus
atagctaatgtcagcagggactcta

SEQ ID NO: 173516 - DNA, 25 bp, Rattus norvegicus
atagctaatgtctgcagggactcta

SEQ ID NO: 173517 - DNA, 25 bp, Rattus norvegicus
atagctaattctcggctggtttcaa

SEQ ID NO: 173518 - DNA, 25 bp, Rattus norvegicus
atagctaattctgggctggtttcaa

SEQ ID NO: 173519 - DNA, 25 bp, Rattus norvegicus
atagctacgtgtctttgatttcagt

SEQ ID NO: 173520 - DNA, 25 bp, Rattus norvegicus
atagctacgtgtgtttgatttcagt

SEQ ID NO: 173521 - DNA, 25 bp, Rattus norvegicus
atagctactgtaagttgtccccagc

SEQ ID NO: 173522 - DNA, 25 bp, Rattus norvegicus
atagctactgtatgttgtccccagc

SEQ ID NO: 173523 - DNA, 25 bp, Rattus norvegicus
atagctacttgtccagaggccacat

SEQ ID NO: 173524 - DNA, 25 bp, Rattus norvegicus
atagctacttgtgcagaggccacat

SEQ ID NO: 173525 - DNA, 25 bp, Rattus norvegicus
atagctacttttaggtcagcccgag

SEQ ID NO: 173526 - DNA, 25 bp, Rattus norvegicus
atagctactttttggtcagcccgag

SEQ ID NO: 173527 - DNA, 25 bp, Rattus norvegicus
atagctagcatacgcctgtgtgttc

SEQ ID NO: 173528 - DNA, 25 bp, Rattus norvegicus
atagctagcataggcctgtgtgttc

SEQ ID NO: 173529 - DNA, 25 bp, Rattus norvegicus
atagctagccacagctggtgtttat

SEQ ID NO: 173530 - DNA, 25 bp, Rattus norvegicus
atagctagccactgctggtgtttat

SEQ ID NO: 173531 - DNA, 25 bp, Rattus norvegicus
atagctagcgttcactctgggcaca

SEQ ID NO: 173532 - DNA, 25 bp, Rattus norvegicus
atagctagcgttgactctgggcaca

SEQ ID NO: 173533 - DNA, 25 bp, Rattus norvegicus
atagctaggcttcttccggtccctt

SEQ ID NO: 173534 - DNA, 25 bp, Rattus norvegicus
atagctaggcttgttccggtccctt

SEQ ID NO: 173535 - DNA, 25 bp, Rattus norvegicus
atagctagtccactactatcctgat

SEQ ID NO: 173536 - DNA, 25 bp, Rattus norvegicus
atagctagtccagtactatcctgat

SEQ ID NO: 173537 - DNA, 25 bp, Rattus norvegicus
atagctatagccatgtcctgggaac

SEQ ID NO: 173538 - DNA, 25 bp, Rattus norvegicus
atagctatagccttgtcctgggaac

SEQ ID NO: 173539 - DNA, 25 bp, Rattus norvegicus
atagctatctttcgtttctacccct

SEQ ID NO: 173540 - DNA, 25 bp, Rattus norvegicus
atagctatctttggtttctacccct

SEQ ID NO: 173541 - DNA, 25 bp, Rattus norvegicus
atagctatgccactgtcagctcttt

SEQ ID NO: 173542 - DNA, 25 bp, Rattus norvegicus
atagctatgccagtgtcagctcttt

SEQ ID NO: 173543 - DNA, 25 bp, Rattus norvegicus
atagctatggcgattccatgcatcc

SEQ ID NO: 173544 - DNA, 25 bp, Rattus norvegicus
atagctatggcgtttccatgcatcc

SEQ ID NO: 173545 - DNA, 25 bp, Rattus norvegicus
atagctattcagagtcatgcctcaa

SEQ ID NO: 173546 - DNA, 25 bp, Rattus norvegicus
atagctattcagtgtcatgcctcaa

SEQ ID NO: 173547 - DNA, 25 bp, Rattus norvegicus
atagctattgctcttttgtccttaa

SEQ ID NO: 173548 - DNA, 25 bp, Rattus norvegicus
atagctattgctgttttgtccttaa

SEQ ID NO: 173549 - DNA, 25 bp, Rattus norvegicus
atagctattgtcataccttgttgaa

SEQ ID NO: 173550 - DNA, 25 bp, Rattus norvegicus
atagctattgtcttaccttgttgaa

SEQ ID NO: 173551 - DNA, 25 bp, Rattus norvegicus
atagctcaaagcaattccacgttta

SEQ ID NO: 173552 - DNA, 25 bp, Rattus norvegicus
atagctcaaagctattccacgttta

SEQ ID NO: 173553 - DNA, 25 bp, Rattus norvegicus
atagctcaacccctggtttctatga

SEQ ID NO: 173554 - DNA, 25 bp, Rattus norvegicus
atagctcaacccgtggtttctatga

SEQ ID NO: 173555 - DNA, 25 bp, Rattus norvegicus
atagctcaaggtccctggtgcagca

SEQ ID NO: 173556 - DNA, 25 bp, Rattus norvegicus
atagctcaaggtgcctggtgcagca

SEQ ID NO: 173557 - DNA, 25 bp, Rattus norvegicus
atagctcacagtcatgggaatcctt

SEQ ID NO: 173558 - DNA, 25 bp, Rattus norvegicus
atagctcacagtgatgggaatcctt

SEQ ID NO: 173559 - DNA, 25 bp, Rattus norvegicus
atagctcagcagctcttgcaaccaa

SEQ ID NO: 173560 - DNA, 25 bp, Rattus norvegicus
atagctcagcaggtcttgcaaccaa

SEQ ID NO: 173561 - DNA, 25 bp, Rattus norvegicus
atagctcaggatcgcatgacacttg

SEQ ID NO: 173562 - DNA, 25 bp, Rattus norvegicus
atagctcaggatggcatgacacttg

SEQ ID NO: 173563 - DNA, 25 bp, Rattus norvegicus
atagctcatctgacctgtagactct

SEQ ID NO: 173564 - DNA, 25 bp, Rattus norvegicus
atagctcatctgtcctgtagactct

SEQ ID NO: 173565 - DNA, 25 bp, Rattus norvegicus
atagctcatgtgcttgcttcacgct

SEQ ID NO: 173566 - DNA, 25 bp, Rattus norvegicus
atagctcatgtggttgcttcacgct

SEQ ID NO: 173567 - DNA, 25 bp, Rattus norvegicus
atagctcattgtacatcaaccatgg

SEQ ID NO: 173568 - DNA, 25 bp, Rattus norvegicus
atagctcattgttcatcaaccatgg

SEQ ID NO: 173569 - DNA, 25 bp, Rattus norvegicus
atagctccagcccatgggaaccgat

SEQ ID NO: 173570 - DNA, 25 bp, Rattus norvegicus
atagctccagccgatgggaaccgat

SEQ ID NO: 173571 - DNA, 25 bp, Rattus norvegicus
atagctccaggaattgtttcaaaca

SEQ ID NO: 173572 - DNA, 25 bp, Rattus norvegicus
atagctccaggatttgtttcaaaca

SEQ ID NO: 173573 - DNA, 25 bp, Rattus norvegicus
atagctccatggattctctgtacat

SEQ ID NO: 173574 - DNA, 25 bp, Rattus norvegicus
atagctccatggtttctctgtacat

SEQ ID NO: 173575 - DNA, 25 bp, Rattus norvegicus
atagctcccaatatcacttactctg

SEQ ID NO: 173576 - DNA, 25 bp, Rattus norvegicus
atagctcccaatttcacttactctg

SEQ ID NO: 173577 - DNA, 25 bp, Rattus norvegicus
atagctccctagatctttcactttt

SEQ ID NO: 173578 - DNA, 25 bp, Rattus norvegicus
atagctccctagttctttcactttt

SEQ ID NO: 173579 - DNA, 25 bp, Rattus norvegicus
atagctcctggcacaaggtgggttc

SEQ ID NO: 173580 - DNA, 25 bp, Rattus norvegicus
atagctcctggctcaaggtgggttc

SEQ ID NO: 173581 - DNA, 25 bp, Rattus norvegicus
atagctcctgttaagaactcagata

SEQ ID NO: 173582 - DNA, 25 bp, Rattus norvegicus
atagctcctgtttagaactcagata

SEQ ID NO: 173583 - DNA, 25 bp, Rattus norvegicus
atagctccttgcatatgcagactgg

SEQ ID NO: 173584 - DNA, 25 bp, Rattus norvegicus
atagctccttgcttatgcagactgg

SEQ ID NO: 173585 - DNA, 25 bp, Rattus norvegicus
atagctcgcctgacaaagcagctta

SEQ ID NO: 173586 - DNA, 25 bp, Rattus norvegicus
atagctcgcctgtcaaagcagctta

SEQ ID NO: 173587 - DNA, 25 bp, Rattus norvegicus
atagctctatagatcttctacccaa

SEQ ID NO: 173588 - DNA, 25 bp, Rattus norvegicus
atagctctatagttcttctacccaa

SEQ ID NO: 173589 - DNA, 25 bp, Rattus norvegicus
atagctctcacaagctgatggaaga

SEQ ID NO: 173590 - DNA, 25 bp, Rattus norvegicus
atagctctcacacacacaggagtgc

SEQ ID NO: 173591 - DNA, 25 bp, Rattus norvegicus
atagctctcacagacacaggagtgc

SEQ ID NO: 173592 - DNA, 25 bp, Rattus norvegicus
atagctctcacatgctgatggaaga

SEQ ID NO: 173593 - DNA, 25 bp, Rattus norvegicus
atagctctctggctgactcggtgta

SEQ ID NO: 173594 - DNA, 25 bp, Rattus norvegicus
atagctctctgggtgactcggtgta

SEQ ID NO: 173595 - DNA, 25 bp, Rattus norvegicus
atagctctgaaaacccattatctgg

SEQ ID NO: 173596 - DNA, 25 bp, Rattus norvegicus
atagctctgaaatcccattatctgg

SEQ ID NO: 173597 - DNA, 25 bp, Rattus norvegicus
atagctctgcacacttggtcagcgg

SEQ ID NO: 173598 - DNA, 25 bp, Rattus norvegicus
atagctctgcactcttggtcagcgg

SEQ ID NO: 173599 - DNA, 25 bp, Rattus norvegicus
atagctctgcagcacaggtaacaat

SEQ ID NO: 173600 - DNA, 25 bp, Rattus norvegicus
atagctctgcaggacaggtaacaat

SEQ ID NO: 173601 - DNA, 25 bp, Rattus norvegicus
atagctctgcatcggcaacctcgag

SEQ ID NO: 173602 - DNA, 25 bp, Rattus norvegicus
atagctctgcatgggcaacctcgag

SEQ ID NO: 173603 - DNA, 25 bp, Rattus norvegicus
atagctctgctaagatctcctgata

SEQ ID NO: 173604 - DNA, 25 bp, Rattus norvegicus
atagctctgctatgatctcctgata

SEQ ID NO: 173605 - DNA, 25 bp, Rattus norvegicus
atagctctgctgaagctgtcatcgc

SEQ ID NO: 173606 - DNA, 25 bp, Rattus norvegicus
atagctctgctgtagctgtcatcgc

SEQ ID NO: 173607 - DNA, 25 bp, Rattus norvegicus
atagctctgtgtactgtgacggcat

SEQ ID NO: 173608 - DNA, 25 bp, Rattus norvegicus
atagctctgtgtctgtcggaaactc

SEQ ID NO: 173609 - DNA, 25 bp, Rattus norvegicus
atagctctgtgtgtgtcggaaactc

SEQ ID NO: 173610 - DNA, 25 bp, Rattus norvegicus
atagctctgtgttctgtgacggcat

SEQ ID NO: 173611 - DNA, 25 bp, Rattus norvegicus
atagctcttaaacttcgggaacagg

SEQ ID NO: 173612 - DNA, 25 bp, Rattus norvegicus
atagctcttaaagttcgggaacagg

SEQ ID NO: 173613 - DNA, 25 bp, Rattus norvegicus
atagctcttgttagtcggcatcgga

SEQ ID NO: 173614 - DNA, 25 bp, Rattus norvegicus
atagctcttgtttgtcggcatcgga

SEQ ID NO: 173615 - DNA, 25 bp, Rattus norvegicus
atagctctttggctgtgtggcaagc

SEQ ID NO: 173616 - DNA, 25 bp, Rattus norvegicus
atagctctttgggtgtgtggcaagc

SEQ ID NO: 173617 - DNA, 25 bp, Rattus norvegicus
atagctgaactgagtttactggaaa

SEQ ID NO: 173618 - DNA, 25 bp, Rattus norvegicus
atagctgaactgtgtttactggaaa

SEQ ID NO: 173619 - DNA, 25 bp, Rattus norvegicus
atagctgacagcaggttggacgccc

SEQ ID NO: 173620 - DNA, 25 bp, Rattus norvegicus
atagctgacagctggttggacgccc

SEQ ID NO: 173621 - DNA, 25 bp, Rattus norvegicus
atagctgacatcacctattctgtgg

SEQ ID NO: 173622 - DNA, 25 bp, Rattus norvegicus
atagctgacatctcctattctgtgg

SEQ ID NO: 173623 - DNA, 25 bp, Rattus norvegicus
atagctgactcactactggtgaagg

SEQ ID NO: 173624 - DNA, 25 bp, Rattus norvegicus
atagctgactcagtactggtgaagg

SEQ ID NO: 173625 - DNA, 25 bp, Rattus norvegicus
atagctgagccccttggtgcttcct

SEQ ID NO: 173626 - DNA, 25 bp, Rattus norvegicus
atagctgagcccgttggtgcttcct

SEQ ID NO: 173627 - DNA, 25 bp, Rattus norvegicus
atagctgaggtcatgggctcttgtc

SEQ ID NO: 173628 - DNA, 25 bp, Rattus norvegicus
atagctgaggtcttgggctcttgtc

SEQ ID NO: 173629 - DNA, 25 bp, Rattus norvegicus
atagctgcaactccattgtttaggg

SEQ ID NO: 173630 - DNA, 25 bp, Rattus norvegicus
atagctgcaactgcattgtttaggg

SEQ ID NO: 173631 - DNA, 25 bp, Rattus norvegicus
atagctgcaagtatatctcctgttt

SEQ ID NO: 173632 - DNA, 25 bp, Rattus norvegicus
atagctgcaagtttatctcctgttt

SEQ ID NO: 173633 - DNA, 25 bp, Rattus norvegicus
atagctgcagcactcatgttgccag

SEQ ID NO: 173634 - DNA, 25 bp, Rattus norvegicus
atagctgcagcagtcatgttgccag

SEQ ID NO: 173635 - DNA, 25 bp, Rattus norvegicus
atagctgccaataagttcctttgtt

SEQ ID NO: 173636 - DNA, 25 bp, Rattus norvegicus
atagctgccaattagttcctttgtt

SEQ ID NO: 173637 - DNA, 25 bp, Rattus norvegicus
atagctgccatcagtgcgggtccta

SEQ ID NO: 173638 - DNA, 25 bp, Rattus norvegicus
atagctgccatctgtgcgggtccta

SEQ ID NO: 173639 - DNA, 25 bp, Rattus norvegicus
atagctgccccgaacagtagtctct

SEQ ID NO: 173640 - DNA, 25 bp, Rattus norvegicus
atagctgccccgtacagtagtctct

SEQ ID NO: 173641 - DNA, 25 bp, Rattus norvegicus
atagctgcgaccagcgtcagcaata

SEQ ID NO: 173642 - DNA, 25 bp, Rattus norvegicus
atagctgcgacctgcgtcagcaata

SEQ ID NO: 173643 - DNA, 25 bp, Rattus norvegicus
atagctgctactagaacagtgctgt

SEQ ID NO: 173644 - DNA, 25 bp, Rattus norvegicus
atagctgctacttgaacagtgctgt

SEQ ID NO: 173645 - DNA, 25 bp, Rattus norvegicus
atagctgctgtaattgagactgtgt

SEQ ID NO: 173646 - DNA, 25 bp, Rattus norvegicus
atagctgctgtatttgagactgtgt

SEQ ID NO: 173647 - DNA, 25 bp, Rattus norvegicus
atagctgctgtcagatgacatctca

SEQ ID NO: 173648 - DNA, 25 bp, Rattus norvegicus
atagctgctgtctgatgacatctca

SEQ ID NO: 173649 - DNA, 25 bp, Rattus norvegicus
atagctgctttgatggtcttgtctc

SEQ ID NO: 173650 - DNA, 25 bp, Rattus norvegicus
atagctgctttgttggtcttgtctc

SEQ ID NO: 173651 - DNA, 25 bp, Rattus norvegicus
atagctggaattacccatcctcatt

SEQ ID NO: 173652 - DNA, 25 bp, Rattus norvegicus
atagctggaatttcccatcctcatt

SEQ ID NO: 173653 - DNA, 25 bp, Rattus norvegicus
atagctggcacaaatctactctcta

SEQ ID NO: 173654 - DNA, 25 bp, Rattus norvegicus
atagctggcacatatctactctcta

SEQ ID NO: 173655 - DNA, 25 bp, Rattus norvegicus
atagctggcagacagctgctcacag

SEQ ID NO: 173656 - DNA, 25 bp, Rattus norvegicus
atagctggcagagagctgctcacag

SEQ ID NO: 173657 - DNA, 25 bp, Rattus norvegicus
atagctggcagcatcctctagagac

SEQ ID NO: 173658 - DNA, 25 bp, Rattus norvegicus
atagctggcagcttcctctagagac

SEQ ID NO: 173659 - DNA, 25 bp, Rattus norvegicus
atagctggcgacaagcaggtagcac

SEQ ID NO: 173660 - DNA, 25 bp, Rattus norvegicus
atagctggcgactagcaggtagcac

SEQ ID NO: 173661 - DNA, 25 bp, Rattus norvegicus
atagctggcttgatggctcaggtcc

SEQ ID NO: 173662 - DNA, 25 bp, Rattus norvegicus
atagctggcttgttggctcaggtcc

SEQ ID NO: 173663 - DNA, 25 bp, Rattus norvegicus
atagctgggacgcagcatcttccta

SEQ ID NO: 173664 - DNA, 25 bp, Rattus norvegicus
atagctgggacggagcatcttccta

SEQ ID NO: 173665 - DNA, 25 bp, Rattus norvegicus
atagctgggctcatcattggtcctt

SEQ ID NO: 173666 - DNA, 25 bp, Rattus norvegicus
atagctgggctcttcattggtcctt

SEQ ID NO: 173667 - DNA, 25 bp, Rattus norvegicus
atagctgggtccacgtcctgggaaa

SEQ ID NO: 173668 - DNA, 25 bp, Rattus norvegicus
atagctgggtcctcgtcctgggaaa

SEQ ID NO: 173669 - DNA, 25 bp, Rattus norvegicus
atagctggtcggcacctcactgact

SEQ ID NO: 173670 - DNA, 25 bp, Rattus norvegicus
atagctggtcgggacctcactgact

SEQ ID NO: 173671 - DNA, 25 bp, Rattus norvegicus
atagctgtacagaagcaggtttatt

SEQ ID NO: 173672 - DNA, 25 bp, Rattus norvegicus
atagctgtacagtagcaggtttatt

SEQ ID NO: 173673 - DNA, 25 bp, Rattus norvegicus
atagctgtaggtctgtgccattact

SEQ ID NO: 173674 - DNA, 25 bp, Rattus norvegicus
atagctgtaggtgtgtgccattact

SEQ ID NO: 173675 - DNA, 25 bp, Rattus norvegicus
atagctgtcagtataacattggcat

SEQ ID NO: 173676 - DNA, 25 bp, Rattus norvegicus
atagctgtcagtttaacattggcat

SEQ ID NO: 173677 - DNA, 25 bp, Rattus norvegicus
atagctgtccatagcttttggcaaa

SEQ ID NO: 173678 - DNA, 25 bp, Rattus norvegicus
atagctgtccattgcttttggcaaa

SEQ ID NO: 173679 - DNA, 25 bp, Rattus norvegicus
atagctgtcttaagcaaccttgtca

SEQ ID NO: 173680 - DNA, 25 bp, Rattus norvegicus
atagctgtcttatgcaaccttgtca

SEQ ID NO: 173681 - DNA, 25 bp, Rattus norvegicus
atagctgtcttgatccagtgctcta

SEQ ID NO: 173682 - DNA, 25 bp, Rattus norvegicus
atagctgtcttgttccagtgctcta

SEQ ID NO: 173683 - DNA, 25 bp, Rattus norvegicus
atagctgtgcttcagtacttccttt

SEQ ID NO: 173684 - DNA, 25 bp, Rattus norvegicus
atagctgtgcttgagtacttccttt

SEQ ID NO: 173685 - DNA, 25 bp, Rattus norvegicus
atagctgtggcgatgttctagaccg

SEQ ID NO: 173686 - DNA, 25 bp, Rattus norvegicus
atagctgtggcgttgttctagaccg

SEQ ID NO: 173687 - DNA, 25 bp, Rattus norvegicus
atagctgtgtggaggcccttagaat

SEQ ID NO: 173688 - DNA, 25 bp, Rattus norvegicus
atagctgtgtggtggcccttagaat

SEQ ID NO: 173689 - DNA, 25 bp, Rattus norvegicus
atagctgttttgagcttggtctgtg

SEQ ID NO: 173690 - DNA, 25 bp, Rattus norvegicus
atagctgttttgtgcttggtctgtg

SEQ ID NO: 173691 - DNA, 25 bp, Rattus norvegicus
atagcttaatgccttctgtagtgga

SEQ ID NO: 173692 - DNA, 25 bp, Rattus norvegicus
atagcttaatgcgttctgtagtgga

SEQ ID NO: 173693 - DNA, 25 bp, Rattus norvegicus
atagcttacactcagacctttcttc

SEQ ID NO: 173694 - DNA, 25 bp, Rattus norvegicus
atagcttacactgagacctttcttc

SEQ ID NO: 173695 - DNA, 25 bp, Rattus norvegicus
atagcttagcccatggtcagtatca

SEQ ID NO: 173696 - DNA, 25 bp, Rattus norvegicus
atagcttagcccttggtcagtatca

SEQ ID NO: 173697 - DNA, 25 bp, Rattus norvegicus
atagcttaggttatccctccaaatg

SEQ ID NO: 173698 - DNA, 25 bp, Rattus norvegicus
atagcttaggttttccctccaaatg

SEQ ID NO: 173699 - DNA, 25 bp, Rattus norvegicus
atagcttcaagcatacacataaact

SEQ ID NO: 173700 - DNA, 25 bp, Rattus norvegicus
atagcttcaagcttacacataaact

SEQ ID NO: 173701 - DNA, 25 bp, Rattus norvegicus
atagcttcataaatagttcttgtgg

SEQ ID NO: 173702 - DNA, 25 bp, Rattus norvegicus
atagcttcataattagttcttgtgg

SEQ ID NO: 173703 - DNA, 25 bp, Rattus norvegicus
atagcttcatcgctcttcctcattc

SEQ ID NO: 173704 - DNA, 25 bp, Rattus norvegicus
atagcttcatcggtcttcctcattc

SEQ ID NO: 173705 - DNA, 25 bp, Rattus norvegicus
atagcttcatggagtaaaggacacc

SEQ ID NO: 173706 - DNA, 25 bp, Rattus norvegicus
atagcttcatggtgtaaaggacacc

SEQ ID NO: 173707 - DNA, 25 bp, Rattus norvegicus
atagcttcatgtcctcgacagtgaa

SEQ ID NO: 173708 - DNA, 25 bp, Rattus norvegicus
atagcttcatgtgctcgacagtgaa

SEQ ID NO: 173709 - DNA, 25 bp, Rattus norvegicus
atagcttcccagatggttttggact

SEQ ID NO: 173710 - DNA, 25 bp, Rattus norvegicus
atagcttcccagttggttttggact

SEQ ID NO: 173711 - DNA, 25 bp, Rattus norvegicus
atagcttccctaagtttgtgtgact

SEQ ID NO: 173712 - DNA, 25 bp, Rattus norvegicus
atagcttccctatgtttgtgtgact

SEQ ID NO: 173713 - DNA, 25 bp, Rattus norvegicus
atagcttccgcacacgggattctgg

SEQ ID NO: 173714 - DNA, 25 bp, Rattus norvegicus
atagcttccgcagacgggattctgg

SEQ ID NO: 173715 - DNA, 25 bp, Rattus norvegicus
atagcttccgctagagacagtgcat

SEQ ID NO: 173716 - DNA, 25 bp, Rattus norvegicus
atagcttccgcttgagacagtgcat

SEQ ID NO: 173717 - DNA, 25 bp, Rattus norvegicus
atagcttcctggaataacgtgggtt

SEQ ID NO: 173718 - DNA, 25 bp, Rattus norvegicus
atagcttcctggtataacgtgggtt

SEQ ID NO: 173719 - DNA, 25 bp, Rattus norvegicus
atagcttcctttcaaactttcttag

SEQ ID NO: 173720 - DNA, 25 bp, Rattus norvegicus
atagcttcctttgaaactttcttag

SEQ ID NO: 173721 - DNA, 25 bp, Rattus norvegicus
atagcttcgtagaggctgtactcct

SEQ ID NO: 173722 - DNA, 25 bp, Rattus norvegicus
atagcttcgtagtggctgtactcct

SEQ ID NO: 173723 - DNA, 25 bp, Rattus norvegicus
atagcttctcacaaccgggatttag

SEQ ID NO: 173724 - DNA, 25 bp, Rattus norvegicus
atagcttctcactaccgggatttag

SEQ ID NO: 173725 - DNA, 25 bp, Rattus norvegicus
atagcttctcttagggctgtctggc

SEQ ID NO: 173726 - DNA, 25 bp, Rattus norvegicus
atagcttctcttctgaccgaattgt

SEQ ID NO: 173727 - DNA, 25 bp, Rattus norvegicus
atagcttctcttgtgaccgaattgt

SEQ ID NO: 173728 - DNA, 25 bp, Rattus norvegicus
atagcttctctttgggctgtctggc

SEQ ID NO: 173729 - DNA, 25 bp, Rattus norvegicus
atagcttctgaaccggcacctgcag

SEQ ID NO: 173730 - DNA, 25 bp, Rattus norvegicus
atagcttctgaagcggcacctgcag

SEQ ID NO: 173731 - DNA, 25 bp, Rattus norvegicus
atagcttgacatctgggtgacctcg

SEQ ID NO: 173732 - DNA, 25 bp, Rattus norvegicus
atagcttgacatgtgggtgacctcg

SEQ ID NO: 173733 - DNA, 25 bp, Rattus norvegicus
atagcttgagtaaggccactgcagc

SEQ ID NO: 173734 - DNA, 25 bp, Rattus norvegicus
atagcttgagtatggccactgcagc

SEQ ID NO: 173735 - DNA, 25 bp, Rattus norvegicus
atagcttgatagatccatttctgaa

SEQ ID NO: 173736 - DNA, 25 bp, Rattus norvegicus
atagcttgatagttccatttctgaa

SEQ ID NO: 173737 - DNA, 25 bp, Rattus norvegicus
atagcttgtgctaactggtctggac

SEQ ID NO: 173738 - DNA, 25 bp, Rattus norvegicus
atagcttgtgcttactggtctggac

SEQ ID NO: 173739 - DNA, 25 bp, Rattus norvegicus
atagcttgtgtgactccaatgcaga

SEQ ID NO: 173740 - DNA, 25 bp, Rattus norvegicus
atagcttgtgtgtctccaatgcaga

SEQ ID NO: 173741 - DNA, 25 bp, Rattus norvegicus
atagcttgttccattttctgggtga

SEQ ID NO: 173742 - DNA, 25 bp, Rattus norvegicus
atagcttgttcctttttctgggtga

SEQ ID NO: 173743 - DNA, 25 bp, Rattus norvegicus
atagctttagccacatcattcatca

SEQ ID NO: 173744 - DNA, 25 bp, Rattus norvegicus
atagctttagcctcatcattcatca

SEQ ID NO: 173745 - DNA, 25 bp, Rattus norvegicus
atagctttatatcccgcagtgtgca

SEQ ID NO: 173746 - DNA, 25 bp, Rattus norvegicus
atagctttatatgccgcagtgtgca

SEQ ID NO: 173747 - DNA, 25 bp, Rattus norvegicus
atagctttcaagagaggacccattg

SEQ ID NO: 173748 - DNA, 25 bp, Rattus norvegicus
atagctttcaagtgaggacccattg

SEQ ID NO: 173749 - DNA, 25 bp, Rattus norvegicus
atagctttcctgaccttggaagagg

SEQ ID NO: 173750 - DNA, 25 bp, Rattus norvegicus
atagctttcctgtccttggaagagg

SEQ ID NO: 173751 - DNA, 25 bp, Rattus norvegicus
atagctttcgaaatttggttcacac

SEQ ID NO: 173752 - DNA, 25 bp, Rattus norvegicus
atagctttcgaattttggttcacac

SEQ ID NO: 173753 - DNA, 25 bp, Rattus norvegicus
atagctttctccacccgtgcctagg

SEQ ID NO: 173754 - DNA, 25 bp, Rattus norvegicus
atagctttctcctcccgtgcctagg

SEQ ID NO: 173755 - DNA, 25 bp, Rattus norvegicus
atagctttctgtatttctacctctg

SEQ ID NO: 173756 - DNA, 25 bp, Rattus norvegicus
atagctttctgtttttctacctctg

SEQ ID NO: 173757 - DNA, 25 bp, Rattus norvegicus
atagctttgctaataggactccaga

SEQ ID NO: 173758 - DNA, 25 bp, Rattus norvegicus
atagctttgctattaggactccaga

SEQ ID NO: 173759 - DNA, 25 bp, Rattus norvegicus
atagctttgtataaatctggtgtta

SEQ ID NO: 173760 - DNA, 25 bp, Rattus norvegicus
atagctttgtattaatctggtgtta

SEQ ID NO: 173761 - DNA, 25 bp, Rattus norvegicus
atagcttttcacataccgtatctcc

SEQ ID NO: 173762 - DNA, 25 bp, Rattus norvegicus
atagcttttcacttaccgtatctcc

SEQ ID NO: 173763 - DNA, 25 bp, Rattus norvegicus
atagcttttctaaatgcgtggtcga

SEQ ID NO: 173764 - DNA, 25 bp, Rattus norvegicus
atagcttttctatatgcgtggtcga

SEQ ID NO: 173765 - DNA, 25 bp, Rattus norvegicus
atagcttttgcaactttattactgg

SEQ ID NO: 173766 - DNA, 25 bp, Rattus norvegicus
atagcttttgcatctttattactgg

SEQ ID NO: 173767 - DNA, 25 bp, Rattus norvegicus
atagcttttgctatctctgacgtgc

SEQ ID NO: 173768 - DNA, 25 bp, Rattus norvegicus
atagcttttgctttctctgacgtgc

SEQ ID NO: 173769 - DNA, 25 bp, Rattus norvegicus
ataggaaaaataacccgcagggtcg

SEQ ID NO: 173770 - DNA, 25 bp, Rattus norvegicus
ataggaaaaatatcccgcagggtcg

SEQ ID NO: 173771 - DNA, 25 bp, Rattus norvegicus
ataggaaaccatagctcactggagc

SEQ ID NO: 173772 - DNA, 25 bp, Rattus norvegicus
ataggaaaccattgctcactggagc

SEQ ID NO: 173773 - DNA, 25 bp, Rattus norvegicus
ataggaaagccgcaaagtcccctga

SEQ ID NO: 173774 - DNA, 25 bp, Rattus norvegicus
ataggaaagccggaaagtcccctga

SEQ ID NO: 173775 - DNA, 25 bp, Rattus norvegicus
ataggaacgcagctcgatttgccca

SEQ ID NO: 173776 - DNA, 25 bp, Rattus norvegicus
ataggaacgcaggtcgatttgccca

SEQ ID NO: 173777 - DNA, 25 bp, Rattus norvegicus
ataggaacggctcccaaagcaccca

SEQ ID NO: 173778 - DNA, 25 bp, Rattus norvegicus
ataggaacggctgccaaagcaccca

SEQ ID NO: 173779 - DNA, 25 bp, Rattus norvegicus
ataggaactatccattggcctccat

SEQ ID NO: 173780 - DNA, 25 bp, Rattus norvegicus
ataggaactatcgattggcctccat

SEQ ID NO: 173781 - DNA, 25 bp, Rattus norvegicus
ataggaactttcagtgtgatattta

SEQ ID NO: 173782 - DNA, 25 bp, Rattus norvegicus
ataggaactttctgtgtgatattta

SEQ ID NO: 173783 - DNA, 25 bp, Rattus norvegicus
ataggaagagacatcaccgggagta

SEQ ID NO: 173784 - DNA, 25 bp, Rattus norvegicus
ataggaagagacttcaccgggagta

SEQ ID NO: 173785 - DNA, 25 bp, Rattus norvegicus
ataggaagcaccatttctggcccac

SEQ ID NO: 173786 - DNA, 25 bp, Rattus norvegicus
ataggaagcaccttttctggcccac

SEQ ID NO: 173787 - DNA, 25 bp, Rattus norvegicus
ataggaagtgtgaagccagcccgct

SEQ ID NO: 173788 - DNA, 25 bp, Rattus norvegicus
ataggaagtgtgtagccagcccgct

SEQ ID NO: 173789 - DNA, 25 bp, Rattus norvegicus
ataggaatcccaactcagtgtgtat

SEQ ID NO: 173790 - DNA, 25 bp, Rattus norvegicus
ataggaatcccatctcagtgtgtat

SEQ ID NO: 173791 - DNA, 25 bp, Rattus norvegicus
ataggaatgcctaccatcaggcctc

SEQ ID NO: 173792 - DNA, 25 bp, Rattus norvegicus
ataggaatgccttccatcaggcctc

SEQ ID NO: 173793 - DNA, 25 bp, Rattus norvegicus
ataggaatgctgaccactgacaatc

SEQ ID NO: 173794 - DNA, 25 bp, Rattus norvegicus
ataggaatgctgtccactgacaatc

SEQ ID NO: 173795 - DNA, 25 bp, Rattus norvegicus
ataggaatgtagcttcactgccacc

SEQ ID NO: 173796 - DNA, 25 bp, Rattus norvegicus
ataggaatgtaggttcactgccacc

SEQ ID NO: 173797 - DNA, 25 bp, Rattus norvegicus
ataggaattatcctcgctggcctca

SEQ ID NO: 173798 - DNA, 25 bp, Rattus norvegicus
ataggaattatcgtcgctggcctca

SEQ ID NO: 173799 - DNA, 25 bp, Rattus norvegicus
ataggaattgacaccggcgtgcaca

SEQ ID NO: 173800 - DNA, 25 bp, Rattus norvegicus
ataggaattgactccggcgtgcaca

SEQ ID NO: 173801 - DNA, 25 bp, Rattus norvegicus
ataggaatttatccacgtcttaggt

SEQ ID NO: 173802 - DNA, 25 bp, Rattus norvegicus
ataggaatttatgcacgtcttaggt

SEQ ID NO: 173803 - DNA, 25 bp, Rattus norvegicus
ataggacaggatatggttttgcaga

SEQ ID NO: 173804 - DNA, 25 bp, Rattus norvegicus
ataggacaggatttggttttgcaga

SEQ ID NO: 173805 - DNA, 25 bp, Rattus norvegicus
ataggacatattcttggtaccacag

SEQ ID NO: 173806 - DNA, 25 bp, Rattus norvegicus
ataggacatattgttggtaccacag

SEQ ID NO: 173807 - DNA, 25 bp, Rattus norvegicus
ataggaccaagtccccatcatgccg

SEQ ID NO: 173808 - DNA, 25 bp, Rattus norvegicus
ataggaccaagtgcccatcatgccg

SEQ ID NO: 173809 - DNA, 25 bp, Rattus norvegicus
ataggacgagccatgtgcctcagtt

SEQ ID NO: 173810 - DNA, 25 bp, Rattus norvegicus
ataggacgagccttgtgcctcagtt

SEQ ID NO: 173811 - DNA, 25 bp, Rattus norvegicus
ataggacgcatgactttcgtgttaa

SEQ ID NO: 173812 - DNA, 25 bp, Rattus norvegicus
ataggacgcatgtctttcgtgttaa

SEQ ID NO: 173813 - DNA, 25 bp, Rattus norvegicus
ataggacgccttctacagatgaaca

SEQ ID NO: 173814 - DNA, 25 bp, Rattus norvegicus
ataggacgccttgtacagatgaaca

SEQ ID NO: 173815 - DNA, 25 bp, Rattus norvegicus
ataggacggcccacctgcataatgg

SEQ ID NO: 173816 - DNA, 25 bp, Rattus norvegicus
ataggacggccctcctgcataatgg

SEQ ID NO: 173817 - DNA, 25 bp, Rattus norvegicus
ataggacggtatccacctgcctaca

SEQ ID NO: 173818 - DNA, 25 bp, Rattus norvegicus
ataggacggtatgcacctgcctaca

SEQ ID NO: 173819 - DNA, 25 bp, Rattus norvegicus
ataggactcatcactgcttccctga

SEQ ID NO: 173820 - DNA, 25 bp, Rattus norvegicus
ataggactcatctctgcttccctga

SEQ ID NO: 173821 - DNA, 25 bp, Rattus norvegicus
ataggactcgtgctagcacccagga

SEQ ID NO: 173822 - DNA, 25 bp, Rattus norvegicus
ataggactcgtggtagcacccagga

SEQ ID NO: 173823 - DNA, 25 bp, Rattus norvegicus
ataggactctcaatccttgggaaaa

SEQ ID NO: 173824 - DNA, 25 bp, Rattus norvegicus
ataggactctcattccttgggaaaa

SEQ ID NO: 173825 - DNA, 25 bp, Rattus norvegicus
ataggactgaccatgttttcgctgc

SEQ ID NO: 173826 - DNA, 25 bp, Rattus norvegicus
ataggactgaccttgttttcgctgc

SEQ ID NO: 173827 - DNA, 25 bp, Rattus norvegicus
ataggactgcttactgtcgtgacat

SEQ ID NO: 173828 - DNA, 25 bp, Rattus norvegicus
ataggactgctttctgtcgtgacat

SEQ ID NO: 173829 - DNA, 25 bp, Rattus norvegicus
ataggactgtaaagtatagaaactc

SEQ ID NO: 173830 - DNA, 25 bp, Rattus norvegicus
ataggactgtaatgtatagaaactc

SEQ ID NO: 173831 - DNA, 25 bp, Rattus norvegicus
ataggactgtctccctagcagccta

SEQ ID NO: 173832 - DNA, 25 bp, Rattus norvegicus
ataggactgtctgcctagcagccta

SEQ ID NO: 173833 - DNA, 25 bp, Rattus norvegicus
ataggacttcccatcagcctcggtc

SEQ ID NO: 173834 - DNA, 25 bp, Rattus norvegicus
ataggacttcccttcagcctcggtc

SEQ ID NO: 173835 - DNA, 25 bp, Rattus norvegicus
ataggacttcctagaggcacctgaa

SEQ ID NO: 173836 - DNA, 25 bp, Rattus norvegicus
ataggacttccttgaggcacctgaa

SEQ ID NO: 173837 - DNA, 25 bp, Rattus norvegicus
ataggagacggcaacttacagtatt

SEQ ID NO: 173838 - DNA, 25 bp, Rattus norvegicus
ataggagacggctacttacagtatt

SEQ ID NO: 173839 - DNA, 25 bp, Rattus norvegicus
ataggagagccgactcttcagtcca

SEQ ID NO: 173840 - DNA, 25 bp, Rattus norvegicus
ataggagagccgtctcttcagtcca

SEQ ID NO: 173841 - DNA, 25 bp, Rattus norvegicus
ataggagatctcattatcgattccc

SEQ ID NO: 173842 - DNA, 25 bp, Rattus norvegicus
ataggagatctctttatcgattccc

SEQ ID NO: 173843 - DNA, 25 bp, Rattus norvegicus
ataggagcctttactgctgcagact

SEQ ID NO: 173844 - DNA, 25 bp, Rattus norvegicus
ataggagccttttctgctgcagact

SEQ ID NO: 173845 - DNA, 25 bp, Rattus norvegicus
ataggagcgggccttcatgtccatg

SEQ ID NO: 173846 - DNA, 25 bp, Rattus norvegicus
ataggagcgggcgttcatgtccatg

SEQ ID NO: 173847 - DNA, 25 bp, Rattus norvegicus
ataggagctcaacgcttggactgaa

SEQ ID NO: 173848 - DNA, 25 bp, Rattus norvegicus
ataggagctcaaggcttggactgaa

SEQ ID NO: 173849 - DNA, 25 bp, Rattus norvegicus
ataggagctgctacagtctgctgta

SEQ ID NO: 173850 - DNA, 25 bp, Rattus norvegicus
ataggagctgcttcagtctgctgta

SEQ ID NO: 173851 - DNA, 25 bp, Rattus norvegicus
ataggagctgtccagaaaggatact

SEQ ID NO: 173852 - DNA, 25 bp, Rattus norvegicus
ataggagctgtcgagaaaggatact

SEQ ID NO: 173853 - DNA, 25 bp, Rattus norvegicus
ataggagctgtgactgattcaaagt

SEQ ID NO: 173854 - DNA, 25 bp, Rattus norvegicus
ataggagctgtgtctgattcaaagt

SEQ ID NO: 173855 - DNA, 25 bp, Rattus norvegicus
ataggaggactcatttaccctccag

SEQ ID NO: 173856 - DNA, 25 bp, Rattus norvegicus
ataggaggactcttttaccctccag

SEQ ID NO: 173857 - DNA, 25 bp, Rattus norvegicus
ataggaggaggcactatccgcattc

SEQ ID NO: 173858 - DNA, 25 bp, Rattus norvegicus
ataggaggaggctctatccgcattc

SEQ ID NO: 173859 - DNA, 25 bp, Rattus norvegicus
ataggaggatcaccactgtagcacc

SEQ ID NO: 173860 - DNA, 25 bp, Rattus norvegicus
ataggaggatcagcactgtagcacc

SEQ ID NO: 173861 - DNA, 25 bp, Rattus norvegicus
ataggaggatcccaggagctccctg

SEQ ID NO: 173862 - DNA, 25 bp, Rattus norvegicus
ataggaggatccgaggagctccctg

SEQ ID NO: 173863 - DNA, 25 bp, Rattus norvegicus
ataggaggcgctcaggcatttgtta

SEQ ID NO: 173864 - DNA, 25 bp, Rattus norvegicus
ataggaggcgctgaggcatttgtta

SEQ ID NO: 173865 - DNA, 25 bp, Rattus norvegicus
ataggagggcccaaggacaccacaa

SEQ ID NO: 173866 - DNA, 25 bp, Rattus norvegicus
ataggagggccctaggacaccacaa

SEQ ID NO: 173867 - DNA, 25 bp, Rattus norvegicus
ataggaggtctgagcatcagtggaa

SEQ ID NO: 173868 - DNA, 25 bp, Rattus norvegicus
ataggaggtctgtgcatcagtggaa

SEQ ID NO: 173869 - DNA, 25 bp, Rattus norvegicus
ataggagtcctgatgtccagggttt

SEQ ID NO: 173870 - DNA, 25 bp, Rattus norvegicus
ataggagtcctgttgtccagggttt

SEQ ID NO: 173871 - DNA, 25 bp, Rattus norvegicus
ataggagtctcgagttgtctgtcaa

SEQ ID NO: 173872 - DNA, 25 bp, Rattus norvegicus
ataggagtctcgtgttgtctgtcaa

SEQ ID NO: 173873 - DNA, 25 bp, Rattus norvegicus
ataggagtgcctccgcacaggtacg

SEQ ID NO: 173874 - DNA, 25 bp, Rattus norvegicus
ataggagtgcctgcgcacaggtacg

SEQ ID NO: 173875 - DNA, 25 bp, Rattus norvegicus
ataggagtgtggctgttttcttcaa

SEQ ID NO: 173876 - DNA, 25 bp, Rattus norvegicus
ataggagtgtgggtgttttcttcaa

SEQ ID NO: 173877 - DNA, 25 bp, Rattus norvegicus
ataggagtttttctgtgtggccccg

SEQ ID NO: 173878 - DNA, 25 bp, Rattus norvegicus
ataggagtttttgtgtgtggccccg

SEQ ID NO: 173879 - DNA, 25 bp, Rattus norvegicus
ataggatatctcagcgctcctctga

SEQ ID NO: 173880 - DNA, 25 bp, Rattus norvegicus
ataggatatctctgcgctcctctga

SEQ ID NO: 173881 - DNA, 25 bp, Rattus norvegicus
ataggatattttagctccggtgcca

SEQ ID NO: 173882 - DNA, 25 bp, Rattus norvegicus
ataggatatttttgctccggtgcca

SEQ ID NO: 173883 - DNA, 25 bp, Rattus norvegicus
ataggatcaaacctctccacttaca

SEQ ID NO: 173884 - DNA, 25 bp, Rattus norvegicus
ataggatcaaacgtctccacttaca

SEQ ID NO: 173885 - DNA, 25 bp, Rattus norvegicus
ataggatccatgctcgtttttgcca

SEQ ID NO: 173886 - DNA, 25 bp, Rattus norvegicus
ataggatccatggtcgtttttgcca

SEQ ID NO: 173887 - DNA, 25 bp, Rattus norvegicus
ataggatcctctaggctgggccaca

SEQ ID NO: 173888 - DNA, 25 bp, Rattus norvegicus
ataggatcctcttggctgggccaca

SEQ ID NO: 173889 - DNA, 25 bp, Rattus norvegicus
ataggatctcctagggcagctgcca

SEQ ID NO: 173890 - DNA, 25 bp, Rattus norvegicus
ataggatctccttgggcagctgcca

SEQ ID NO: 173891 - DNA, 25 bp, Rattus norvegicus
ataggatctctacccatgaagtaac

SEQ ID NO: 173892 - DNA, 25 bp, Rattus norvegicus
ataggatctctagccatgaagtaac

SEQ ID NO: 173893 - DNA, 25 bp, Rattus norvegicus
ataggatctgagcaaagcaactctg

SEQ ID NO: 173894 - DNA, 25 bp, Rattus norvegicus
ataggatctgaggaaagcaactctg

SEQ ID NO: 173895 - DNA, 25 bp, Rattus norvegicus
ataggatgaaatccaatcgctgttc

SEQ ID NO: 173896 - DNA, 25 bp, Rattus norvegicus
ataggatgaaatgcaatcgctgttc

SEQ ID NO: 173897 - DNA, 25 bp, Rattus norvegicus
ataggatgcacaactccattttggg

SEQ ID NO: 173898 - DNA, 25 bp, Rattus norvegicus
ataggatgcacatctccattttggg

SEQ ID NO: 173899 - DNA, 25 bp, Rattus norvegicus
ataggatgcttcagctctgagactc

SEQ ID NO: 173900 - DNA, 25 bp, Rattus norvegicus
ataggatgcttctgctctgagactc

SEQ ID NO: 173901 - DNA, 25 bp, Rattus norvegicus
ataggatggcctatctactgtgtga

SEQ ID NO: 173902 - DNA, 25 bp, Rattus norvegicus
ataggatggcctttctactgtgtga

SEQ ID NO: 173903 - DNA, 25 bp, Rattus norvegicus
ataggatgggctaaacggtgacgct

SEQ ID NO: 173904 - DNA, 25 bp, Rattus norvegicus
ataggatgggcttaacggtgacgct

SEQ ID NO: 173905 - DNA, 25 bp, Rattus norvegicus
ataggatgtattagacgtggtatta

SEQ ID NO: 173906 - DNA, 25 bp, Rattus norvegicus
ataggatgtatttgacgtggtatta

SEQ ID NO: 173907 - DNA, 25 bp, Rattus norvegicus
ataggatgttgacagccgccctgct

SEQ ID NO: 173908 - DNA, 25 bp, Rattus norvegicus
ataggatgttgagagccgccctgct

SEQ ID NO: 173909 - DNA, 25 bp, Rattus norvegicus
ataggattcatcattttattggtat

SEQ ID NO: 173910 - DNA, 25 bp, Rattus norvegicus
ataggattcatctttttattggtat

SEQ ID NO: 173911 - DNA, 25 bp, Rattus norvegicus
ataggattgcctctccagtgaagaa

SEQ ID NO: 173912 - DNA, 25 bp, Rattus norvegicus
ataggattgcctgtccagtgaagaa

SEQ ID NO: 173913 - DNA, 25 bp, Rattus norvegicus
ataggattggcaagcccacctgtct

SEQ ID NO: 173914 - DNA, 25 bp, Rattus norvegicus
ataggattggcatgcccacctgtct

SEQ ID NO: 173915 - DNA, 25 bp, Rattus norvegicus
ataggcaaacacagtcacagacgtc

SEQ ID NO: 173916 - DNA, 25 bp, Rattus norvegicus
ataggcaaacactgtcacagacgtc

SEQ ID NO: 173917 - DNA, 25 bp, Rattus norvegicus
ataggcaaagcacgtggatccccgt

SEQ ID NO: 173918 - DNA, 25 bp, Rattus norvegicus
ataggcaaagcaggtggatccccgt

SEQ ID NO: 173919 - DNA, 25 bp, Rattus norvegicus
ataggcaactgacttgtctgttttc

SEQ ID NO: 173920 - DNA, 25 bp, Rattus norvegicus
ataggcaactgagttgtctgttttc

SEQ ID NO: 173921 - DNA, 25 bp, Rattus norvegicus
ataggcaagaccctcaggcacgcga

SEQ ID NO: 173922 - DNA, 25 bp, Rattus norvegicus
ataggcaagaccgtcaggcacgcga

SEQ ID NO: 173923 - DNA, 25 bp, Rattus norvegicus
ataggcacagcacccagggtccttc

SEQ ID NO: 173924 - DNA, 25 bp, Rattus norvegicus
ataggcacagcagccagggtccttc

SEQ ID NO: 173925 - DNA, 25 bp, Rattus norvegicus
ataggcacaggaaggcctcctccga

SEQ ID NO: 173926 - DNA, 25 bp, Rattus norvegicus
ataggcacaggatggcctcctccga

SEQ ID NO: 173927 - DNA, 25 bp, Rattus norvegicus
ataggcacgtagaattctccagctt

SEQ ID NO: 173928 - DNA, 25 bp, Rattus norvegicus
ataggcacgtagtattctccagctt

SEQ ID NO: 173929 - DNA, 25 bp, Rattus norvegicus
ataggcacttaaagcttctgacaag

SEQ ID NO: 173930 - DNA, 25 bp, Rattus norvegicus
ataggcacttaatgcttctgacaag

SEQ ID NO: 173931 - DNA, 25 bp, Rattus norvegicus
ataggcacttgaaaccacgcaatcc

SEQ ID NO: 173932 - DNA, 25 bp, Rattus norvegicus
ataggcacttgataccacgcaatcc

SEQ ID NO: 173933 - DNA, 25 bp, Rattus norvegicus
ataggcacttggctctttccagtaa

SEQ ID NO: 173934 - DNA, 25 bp, Rattus norvegicus
ataggcacttgggtctttccagtaa

SEQ ID NO: 173935 - DNA, 25 bp, Rattus norvegicus
ataggcagaccactgctatgagaat

SEQ ID NO: 173936 - DNA, 25 bp, Rattus norvegicus
ataggcagaccagtgctatgagaat

SEQ ID NO: 173937 - DNA, 25 bp, Rattus norvegicus
ataggcaggtatccgtgagcagcat

SEQ ID NO: 173938 - DNA, 25 bp, Rattus norvegicus
ataggcaggtatgcgtgagcagcat

SEQ ID NO: 173939 - DNA, 25 bp, Rattus norvegicus
ataggcagttataccctgtccccag

SEQ ID NO: 173940 - DNA, 25 bp, Rattus norvegicus
ataggcagttattccctgtccccag

SEQ ID NO: 173941 - DNA, 25 bp, Rattus norvegicus
ataggcagtttgagagctctggtgc

SEQ ID NO: 173942 - DNA, 25 bp, Rattus norvegicus
ataggcagtttgtgagctctggtgc

SEQ ID NO: 173943 - DNA, 25 bp, Rattus norvegicus
ataggcatccagatctcagaaagct

SEQ ID NO: 173944 - DNA, 25 bp, Rattus norvegicus
ataggcatccagttctcagaaagct

SEQ ID NO: 173945 - DNA, 25 bp, Rattus norvegicus
ataggcatcctacaagcgcttcgtg

SEQ ID NO: 173946 - DNA, 25 bp, Rattus norvegicus
ataggcatcctagaagcgcttcgtg

SEQ ID NO: 173947 - DNA, 25 bp, Rattus norvegicus
ataggcatcgctataatactcatta

SEQ ID NO: 173948 - DNA, 25 bp, Rattus norvegicus
ataggcatcgctttaatactcatta

SEQ ID NO: 173949 - DNA, 25 bp, Rattus norvegicus
ataggcatctgaaatcctgggaatg

SEQ ID NO: 173950 - DNA, 25 bp, Rattus norvegicus
ataggcatctgatatcctgggaatg

SEQ ID NO: 173951 - DNA, 25 bp, Rattus norvegicus
ataggcatgaaacatctggccccac

SEQ ID NO: 173952 - DNA, 25 bp, Rattus norvegicus
ataggcatgaaagatctggccccac

SEQ ID NO: 173953 - DNA, 25 bp, Rattus norvegicus
ataggcattcaccttctgtgtggac

SEQ ID NO: 173954 - DNA, 25 bp, Rattus norvegicus
ataggcattcacgttctgtgtggac

SEQ ID NO: 173955 - DNA, 25 bp, Rattus norvegicus
ataggcattcttatgatgtccatga

SEQ ID NO: 173956 - DNA, 25 bp, Rattus norvegicus
ataggcattcttttgatgtccatga

SEQ ID NO: 173957 - DNA, 25 bp, Rattus norvegicus
ataggccaacacactagcactggga

SEQ ID NO: 173958 - DNA, 25 bp, Rattus norvegicus
ataggccaacactctagcactggga

SEQ ID NO: 173959 - DNA, 25 bp, Rattus norvegicus
ataggccacaccacactttttggaa

SEQ ID NO: 173960 - DNA, 25 bp, Rattus norvegicus
ataggccacacctcactttttggaa

SEQ ID NO: 173961 - DNA, 25 bp, Rattus norvegicus
ataggccacttcaaccggtgtgcaa

SEQ ID NO: 173962 - DNA, 25 bp, Rattus norvegicus
ataggccacttctaccggtgtgcaa

SEQ ID NO: 173963 - DNA, 25 bp, Rattus norvegicus
ataggccagcagatgtcttcatgtt

SEQ ID NO: 173964 - DNA, 25 bp, Rattus norvegicus
ataggccagcagttgtcttcatgtt

SEQ ID NO: 173965 - DNA, 25 bp, Rattus norvegicus
ataggccagcatctcatttatagtc

SEQ ID NO: 173966 - DNA, 25 bp, Rattus norvegicus
ataggccagcatgtcatttatagtc

SEQ ID NO: 173967 - DNA, 25 bp, Rattus norvegicus
ataggccagcccattaggaggaagc

SEQ ID NO: 173968 - DNA, 25 bp, Rattus norvegicus
ataggccagccctttaggaggaagc

SEQ ID NO: 173969 - DNA, 25 bp, Rattus norvegicus
ataggccagtatcccatttggtact

SEQ ID NO: 173970 - DNA, 25 bp, Rattus norvegicus
ataggccagtatgccatttggtact

SEQ ID NO: 173971 - DNA, 25 bp, Rattus norvegicus
ataggccatcacagtgccagggcaa

SEQ ID NO: 173972 - DNA, 25 bp, Rattus norvegicus
ataggccatcactgtgccagggcaa

SEQ ID NO: 173973 - DNA, 25 bp, Rattus norvegicus
ataggccattgtctgtcttgctgac

SEQ ID NO: 173974 - DNA, 25 bp, Rattus norvegicus
ataggccattgtgtgtcttgctgac

SEQ ID NO: 173975 - DNA, 25 bp, Rattus norvegicus
ataggcccacagataggtagatgaa

SEQ ID NO: 173976 - DNA, 25 bp, Rattus norvegicus
ataggcccacagttaggtagatgaa

SEQ ID NO: 173977 - DNA, 25 bp, Rattus norvegicus
ataggcccagaaacttccaaagctg

SEQ ID NO: 173978 - DNA, 25 bp, Rattus norvegicus
ataggcccagaatcttccaaagctg

SEQ ID NO: 173979 - DNA, 25 bp, Rattus norvegicus
ataggcccctaaattgctgctttta

SEQ ID NO: 173980 - DNA, 25 bp, Rattus norvegicus
ataggcccctaatttgctgctttta

SEQ ID NO: 173981 - DNA, 25 bp, Rattus norvegicus
ataggcccctcaaggcaagtggcag

SEQ ID NO: 173982 - DNA, 25 bp, Rattus norvegicus
ataggcccctcatggcaagtggcag

SEQ ID NO: 173983 - DNA, 25 bp, Rattus norvegicus
ataggccctagtcttagctgaactt

SEQ ID NO: 173984 - DNA, 25 bp, Rattus norvegicus
ataggccctagtgttagctgaactt

SEQ ID NO: 173985 - DNA, 25 bp, Rattus norvegicus
ataggccctcttcactttcagaaag

SEQ ID NO: 173986 - DNA, 25 bp, Rattus norvegicus
ataggccctcttgactttcagaaag

SEQ ID NO: 173987 - DNA, 25 bp, Rattus norvegicus
ataggccctgcaccccatgtggagg

SEQ ID NO: 173988 - DNA, 25 bp, Rattus norvegicus
ataggccctgcagcccatgtggagg

SEQ ID NO: 173989 - DNA, 25 bp, Rattus norvegicus
ataggcccttcaccttcaggtctac

SEQ ID NO: 173990 - DNA, 25 bp, Rattus norvegicus
ataggcccttcagcttcaggtctac

SEQ ID NO: 173991 - DNA, 25 bp, Rattus norvegicus
ataggccgagcacgctccaggatgt

SEQ ID NO: 173992 - DNA, 25 bp, Rattus norvegicus
ataggccgagcaggctccaggatgt

SEQ ID NO: 173993 - DNA, 25 bp, Rattus norvegicus
ataggccgtatgatttttgctcacc

SEQ ID NO: 173994 - DNA, 25 bp, Rattus norvegicus
ataggccgtatgttttttgctcacc

SEQ ID NO: 173995 - DNA, 25 bp, Rattus norvegicus
ataggcctcggcagtggagaattaa

SEQ ID NO: 173996 - DNA, 25 bp, Rattus norvegicus
ataggcctcggctgtggagaattaa

SEQ ID NO: 173997 - DNA, 25 bp, Rattus norvegicus
ataggcctctaacggtcgggtctct

SEQ ID NO: 173998 - DNA, 25 bp, Rattus norvegicus
ataggcctctaagggtcgggtctct

SEQ ID NO: 173999 - DNA, 25 bp, Rattus norvegicus
ataggcctctacctgtggactgagt

SEQ ID NO: 174000 - DNA, 25 bp, Rattus norvegicus
ataggcctctacgtgtggactgagt

SEQ ID NO: 174001 - DNA, 25 bp, Rattus norvegicus
ataggcctgatcataattttgttgg

SEQ ID NO: 174002 - DNA, 25 bp, Rattus norvegicus
ataggcctgatcttaattttgttgg

SEQ ID NO: 174003 - DNA, 25 bp, Rattus norvegicus
ataggcctgtccattctgtagctag

SEQ ID NO: 174004 - DNA, 25 bp, Rattus norvegicus
ataggcctgtcctttctgtagctag

SEQ ID NO: 174005 - DNA, 25 bp, Rattus norvegicus
ataggccttggcatagttgttcatt

SEQ ID NO: 174006 - DNA, 25 bp, Rattus norvegicus
ataggccttggcttagttgttcatt

SEQ ID NO: 174007 - DNA, 25 bp, Rattus norvegicus
ataggccttttgcttattatcacaa

SEQ ID NO: 174008 - DNA, 25 bp, Rattus norvegicus
ataggccttttggttattatcacaa

SEQ ID NO: 174009 - DNA, 25 bp, Rattus norvegicus
ataggcgaggcaaccattggttcag

SEQ ID NO: 174010 - DNA, 25 bp, Rattus norvegicus
ataggcgaggcatccattggttcag

SEQ ID NO: 174011 - DNA, 25 bp, Rattus norvegicus
ataggcgatgtcagcccttgtcgag

SEQ ID NO: 174012 - DNA, 25 bp, Rattus norvegicus
ataggcgatgtctgcccttgtcgag

SEQ ID NO: 174013 - DNA, 25 bp, Rattus norvegicus
ataggcgatgttctgtcgcctcctc

SEQ ID NO: 174014 - DNA, 25 bp, Rattus norvegicus
ataggcgatgttgtgtcgcctcctc

SEQ ID NO: 174015 - DNA, 25 bp, Rattus norvegicus
ataggcgtattgctcatacccgcgg

SEQ ID NO: 174016 - DNA, 25 bp, Rattus norvegicus
ataggcgtattggtcatacccgcgg

SEQ ID NO: 174017 - DNA, 25 bp, Rattus norvegicus
ataggcgtcagccacctggatcaca

SEQ ID NO: 174018 - DNA, 25 bp, Rattus norvegicus
ataggcgtcagcgacctggatcaca

SEQ ID NO: 174019 - DNA, 25 bp, Rattus norvegicus
ataggcgtcatgctgctgttcatca

SEQ ID NO: 174020 - DNA, 25 bp, Rattus norvegicus
ataggcgtcatggtgctgttcatca

SEQ ID NO: 174021 - DNA, 25 bp, Rattus norvegicus
ataggcgtctctacagaaaaggctg

SEQ ID NO: 174022 - DNA, 25 bp, Rattus norvegicus
ataggcgtctcttcagaaaaggctg

SEQ ID NO: 174023 - DNA, 25 bp, Rattus norvegicus
ataggcgttcagagacttcccagtg

SEQ ID NO: 174024 - DNA, 25 bp, Rattus norvegicus
ataggcgttcagtgacttcccagtg

SEQ ID NO: 174025 - DNA, 25 bp, Rattus norvegicus
ataggctaagagcaaggcagacatt

SEQ ID NO: 174026 - DNA, 25 bp, Rattus norvegicus
ataggctaagaggaaggcagacatt

SEQ ID NO: 174027 - DNA, 25 bp, Rattus norvegicus
ataggctaatgcactgtaaactggg

SEQ ID NO: 174028 - DNA, 25 bp, Rattus norvegicus
ataggctaatgctctgtaaactggg

SEQ ID NO: 174029 - DNA, 25 bp, Rattus norvegicus
ataggctacgaaagccgaccagtcc

SEQ ID NO: 174030 - DNA, 25 bp, Rattus norvegicus
ataggctacgaatgccgaccagtcc

SEQ ID NO: 174031 - DNA, 25 bp, Rattus norvegicus
ataggctattgcatttcacgggtct

SEQ ID NO: 174032 - DNA, 25 bp, Rattus norvegicus
ataggctattgcttttcacgggtct

SEQ ID NO: 174033 - DNA, 25 bp, Rattus norvegicus
ataggctcactacattccgtgtcaa

SEQ ID NO: 174034 - DNA, 25 bp, Rattus norvegicus
ataggctcactagattccgtgtcaa

SEQ ID NO: 174035 - DNA, 25 bp, Rattus norvegicus
ataggctcaggacctcagtgtttga

SEQ ID NO: 174036 - DNA, 25 bp, Rattus norvegicus
ataggctcaggagctcagtgtttga

SEQ ID NO: 174037 - DNA, 25 bp, Rattus norvegicus
ataggctcagtgatgctgctctgca

SEQ ID NO: 174038 - DNA, 25 bp, Rattus norvegicus
ataggctcagtgttgctgctctgca

SEQ ID NO: 174039 - DNA, 25 bp, Rattus norvegicus
ataggctctataagtgagccccaga

SEQ ID NO: 174040 - DNA, 25 bp, Rattus norvegicus
ataggctctatatgtgagccccaga

SEQ ID NO: 174041 - DNA, 25 bp, Rattus norvegicus
ataggctctgacctctgcagattct

SEQ ID NO: 174042 - DNA, 25 bp, Rattus norvegicus
ataggctctgacgtctgcagattct

SEQ ID NO: 174043 - DNA, 25 bp, Rattus norvegicus
ataggctctgcacacctaagtggtg

SEQ ID NO: 174044 - DNA, 25 bp, Rattus norvegicus
ataggctctgcagacctaagtggtg

SEQ ID NO: 174045 - DNA, 25 bp, Rattus norvegicus
ataggctgaggcatatgatcttcat

SEQ ID NO: 174046 - DNA, 25 bp, Rattus norvegicus
ataggctgaggcttatgatcttcat

SEQ ID NO: 174047 - DNA, 25 bp, Rattus norvegicus
ataggctgcaaaaagcatccccggc

SEQ ID NO: 174048 - DNA, 25 bp, Rattus norvegicus
ataggctgcaaatagcatccccggc

SEQ ID NO: 174049 - DNA, 25 bp, Rattus norvegicus
ataggctgcactcaccgtaacaaga

SEQ ID NO: 174050 - DNA, 25 bp, Rattus norvegicus
ataggctgcactgaccgtaacaaga

SEQ ID NO: 174051 - DNA, 25 bp, Rattus norvegicus
ataggctgccccactgctcactttt

SEQ ID NO: 174052 - DNA, 25 bp, Rattus norvegicus
ataggctgcccctctgctcactttt

SEQ ID NO: 174053 - DNA, 25 bp, Rattus norvegicus
ataggctggaccacaggcaagggaa

SEQ ID NO: 174054 - DNA, 25 bp, Rattus norvegicus
ataggctggacctcaggcaagggaa

SEQ ID NO: 174055 - DNA, 25 bp, Rattus norvegicus
ataggctggccaccaaataccgagt

SEQ ID NO: 174056 - DNA, 25 bp, Rattus norvegicus
ataggctggccagcaaataccgagt

SEQ ID NO: 174057 - DNA, 25 bp, Rattus norvegicus
ataggctggctaatgctcatggcta

SEQ ID NO: 174058 - DNA, 25 bp, Rattus norvegicus
ataggctggctattgctcatggcta

SEQ ID NO: 174059 - DNA, 25 bp, Rattus norvegicus
ataggctgtcacctgtagatccaca

SEQ ID NO: 174060 - DNA, 25 bp, Rattus norvegicus
ataggctgtcacgtgtagatccaca

SEQ ID NO: 174061 - DNA, 25 bp, Rattus norvegicus
ataggctgtcttaagcattgtgcaa

SEQ ID NO: 174062 - DNA, 25 bp, Rattus norvegicus
ataggctgtctttagcattgtgcaa

SEQ ID NO: 174063 - DNA, 25 bp, Rattus norvegicus
ataggcttcacaccctgaattcaga

SEQ ID NO: 174064 - DNA, 25 bp, Rattus norvegicus
ataggcttcacagcctgaattcaga

SEQ ID NO: 174065 - DNA, 25 bp, Rattus norvegicus
ataggcttcacgctacaacagcaaa

SEQ ID NO: 174066 - DNA, 25 bp, Rattus norvegicus
ataggcttcacggtacaacagcaaa

SEQ ID NO: 174067 - DNA, 25 bp, Rattus norvegicus
ataggcttgccccaaaccagcatga

SEQ ID NO: 174068 - DNA, 25 bp, Rattus norvegicus
ataggcttgcccgaaaccagcatga

SEQ ID NO: 174069 - DNA, 25 bp, Rattus norvegicus
ataggctttcagattaggcaatgtc

SEQ ID NO: 174070 - DNA, 25 bp, Rattus norvegicus
ataggctttcagtttaggcaatgtc

SEQ ID NO: 174071 - DNA, 25 bp, Rattus norvegicus
ataggctttcccctggacaaatgca

SEQ ID NO: 174072 - DNA, 25 bp, Rattus norvegicus
ataggctttcccgtggacaaatgca

SEQ ID NO: 174073 - DNA, 25 bp, Rattus norvegicus
ataggctttgaacaccaactggtgc

SEQ ID NO: 174074 - DNA, 25 bp, Rattus norvegicus
ataggctttgaagaccaactggtgc

SEQ ID NO: 174075 - DNA, 25 bp, Rattus norvegicus
atagggaaattgacctgtttgcctt

SEQ ID NO: 174076 - DNA, 25 bp, Rattus norvegicus
atagggaaattgtcctgtttgcctt

SEQ ID NO: 174077 - DNA, 25 bp, Rattus norvegicus
atagggaatctaaccttgaaggaat

SEQ ID NO: 174078 - DNA, 25 bp, Rattus norvegicus
atagggaatctatccttgaaggaat

SEQ ID NO: 174079 - DNA, 25 bp, Rattus norvegicus
atagggacacgtccagttgccaggc

SEQ ID NO: 174080 - DNA, 25 bp, Rattus norvegicus
atagggacacgtgcagttgccaggc

SEQ ID NO: 174081 - DNA, 25 bp, Rattus norvegicus
atagggacagacattctgggcagta

SEQ ID NO: 174082 - DNA, 25 bp, Rattus norvegicus
atagggacagactttctgggcagta

SEQ ID NO: 174083 - DNA, 25 bp, Rattus norvegicus
atagggaccttccttctggagagaa

SEQ ID NO: 174084 - DNA, 25 bp, Rattus norvegicus
atagggaccttcgttctggagagaa

SEQ ID NO: 174085 - DNA, 25 bp, Rattus norvegicus
atagggacgtgtagtctgagctcca

SEQ ID NO: 174086 - DNA, 25 bp, Rattus norvegicus
atagggacgtgttgtctgagctcca

SEQ ID NO: 174087 - DNA, 25 bp, Rattus norvegicus
atagggactctccagtgtgcagatt

SEQ ID NO: 174088 - DNA, 25 bp, Rattus norvegicus
atagggactctcgagtgtgcagatt

SEQ ID NO: 174089 - DNA, 25 bp, Rattus norvegicus
atagggagctacacgtttggctctc

SEQ ID NO: 174090 - DNA, 25 bp, Rattus norvegicus
atagggagctactcgtttggctctc

SEQ ID NO: 174091 - DNA, 25 bp, Rattus norvegicus
atagggaggagccttctcagcttga

SEQ ID NO: 174092 - DNA, 25 bp, Rattus norvegicus
atagggaggagcgttctcagcttga

SEQ ID NO: 174093 - DNA, 25 bp, Rattus norvegicus
atagggaggcccacacctagtggtg

SEQ ID NO: 174094 - DNA, 25 bp, Rattus norvegicus
atagggaggccctcacctagtggtg

SEQ ID NO: 174095 - DNA, 25 bp, Rattus norvegicus
atagggatattaccaaccccatctc

SEQ ID NO: 174096 - DNA, 25 bp, Rattus norvegicus
atagggatattagcaaccccatctc

SEQ ID NO: 174097 - DNA, 25 bp, Rattus norvegicus
atagggatgagcctaccctctcttg

SEQ ID NO: 174098 - DNA, 25 bp, Rattus norvegicus
atagggatgagcgtaccctctcttg

SEQ ID NO: 174099 - DNA, 25 bp, Rattus norvegicus
atagggatgtatcgaaacctgcctt

SEQ ID NO: 174100 - DNA, 25 bp, Rattus norvegicus
atagggatgtatggaaacctgcctt

SEQ ID NO: 174101 - DNA, 25 bp, Rattus norvegicus
atagggatgtgccacaatgcccgac

SEQ ID NO: 174102 - DNA, 25 bp, Rattus norvegicus
atagggatgtgcgacaatgcccgac

SEQ ID NO: 174103 - DNA, 25 bp, Rattus norvegicus
atagggattgagctgcagccccatc

SEQ ID NO: 174104 - DNA, 25 bp, Rattus norvegicus
atagggattgaggtgcagccccatc

SEQ ID NO: 174105 - DNA, 25 bp, Rattus norvegicus
atagggcaatttatgttcagtggat

SEQ ID NO: 174106 - DNA, 25 bp, Rattus norvegicus
atagggcaatttttgttcagtggat

SEQ ID NO: 174107 - DNA, 25 bp, Rattus norvegicus
atagggcacagcagtcagtccatgg

SEQ ID NO: 174108 - DNA, 25 bp, Rattus norvegicus
atagggcacagctgtcagtccatgg

SEQ ID NO: 174109 - DNA, 25 bp, Rattus norvegicus
atagggcagtctcctcagctcagac

SEQ ID NO: 174110 - DNA, 25 bp, Rattus norvegicus
atagggcagtctgctcagctcagac

SEQ ID NO: 174111 - DNA, 25 bp, Rattus norvegicus
atagggcatcctctaggaccatgat

SEQ ID NO: 174112 - DNA, 25 bp, Rattus norvegicus
atagggcatcctgtaggaccatgat

SEQ ID NO: 174113 - DNA, 25 bp, Rattus norvegicus
atagggcatgatcaacaccgcaacc

SEQ ID NO: 174114 - DNA, 25 bp, Rattus norvegicus
atagggcatgatgaacaccgcaacc

SEQ ID NO: 174115 - DNA, 25 bp, Rattus norvegicus
atagggcatggtatggtgacacaca

SEQ ID NO: 174116 - DNA, 25 bp, Rattus norvegicus
atagggcatggtttggtgacacaca

SEQ ID NO: 174117 - DNA, 25 bp, Rattus norvegicus
atagggccacctaggcagacaacag

SEQ ID NO: 174118 - DNA, 25 bp, Rattus norvegicus
atagggccaccttggcagacaacag

SEQ ID NO: 174119 - DNA, 25 bp, Rattus norvegicus
atagggccaggtctacacccatggc

SEQ ID NO: 174120 - DNA, 25 bp, Rattus norvegicus
atagggccaggtgtacacccatggc

SEQ ID NO: 174121 - DNA, 25 bp, Rattus norvegicus
atagggcccaagactgagccactgt

SEQ ID NO: 174122 - DNA, 25 bp, Rattus norvegicus
atagggcccaagtctgagccactgt

SEQ ID NO: 174123 - DNA, 25 bp, Rattus norvegicus
atagggcctctgcacaagtcagtgg

SEQ ID NO: 174124 - DNA, 25 bp, Rattus norvegicus
atagggcctctggacaagtcagtgg

SEQ ID NO: 174125 - DNA, 25 bp, Rattus norvegicus
atagggctcagtcgccagaagctct

SEQ ID NO: 174126 - DNA, 25 bp, Rattus norvegicus
atagggctcagtggccagaagctct

SEQ ID NO: 174127 - DNA, 25 bp, Rattus norvegicus
atagggctgattacattcatgggat

SEQ ID NO: 174128 - DNA, 25 bp, Rattus norvegicus
atagggctgatttcattcatgggat

SEQ ID NO: 174129 - DNA, 25 bp, Rattus norvegicus
atagggctgggtagcttaagcttct

SEQ ID NO: 174130 - DNA, 25 bp, Rattus norvegicus
atagggctgggttgcttaagcttct

SEQ ID NO: 174131 - DNA, 25 bp, Rattus norvegicus
ataggggctgctatcttttctactc

SEQ ID NO: 174132 - DNA, 25 bp, Rattus norvegicus
ataggggctgctttcttttctactc

SEQ ID NO: 174133 - DNA, 25 bp, Rattus norvegicus
atagggggaggcagtcacctgccaa

SEQ ID NO: 174134 - DNA, 25 bp, Rattus norvegicus
atagggggaggctgtcacctgccaa

SEQ ID NO: 174135 - DNA, 25 bp, Rattus norvegicus
atagggtacagcaccatggcctgaa

SEQ ID NO: 174136 - DNA, 25 bp, Rattus norvegicus
atagggtacagctccatggcctgaa

SEQ ID NO: 174137 - DNA, 25 bp, Rattus norvegicus
atagggtaccgacatccctgtttca

SEQ ID NO: 174138 - DNA, 25 bp, Rattus norvegicus
atagggtaccgagatccctgtttca

SEQ ID NO: 174139 - DNA, 25 bp, Rattus norvegicus
atagggtagcccacagtgccatgga

SEQ ID NO: 174140 - DNA, 25 bp, Rattus norvegicus
atagggtagccctcagtgccatgga

SEQ ID NO: 174141 - DNA, 25 bp, Rattus norvegicus
atagggtatgcacaccgagagacct

SEQ ID NO: 174142 - DNA, 25 bp, Rattus norvegicus
atagggtatgcagaccgagagacct

SEQ ID NO: 174143 - DNA, 25 bp, Rattus norvegicus
atagggtcactgctgtgtccttgaa

SEQ ID NO: 174144 - DNA, 25 bp, Rattus norvegicus
atagggtcactggtgtgtccttgaa

SEQ ID NO: 174145 - DNA, 25 bp, Rattus norvegicus
atagggtcagtcctagactcacaca

SEQ ID NO: 174146 - DNA, 25 bp, Rattus norvegicus
atagggtcagtcgtagactcacaca

SEQ ID NO: 174147 - DNA, 25 bp, Rattus norvegicus
atagggtccatgaaatcattatgca

SEQ ID NO: 174148 - DNA, 25 bp, Rattus norvegicus
atagggtccatgtaatcattatgca

SEQ ID NO: 174149 - DNA, 25 bp, Rattus norvegicus
atagggtgcttacttatgtcatggc

SEQ ID NO: 174150 - DNA, 25 bp, Rattus norvegicus
atagggtgcttagttatgtcatggc

SEQ ID NO: 174151 - DNA, 25 bp, Rattus norvegicus
atagggtgctttctcctggattgaa

SEQ ID NO: 174152 - DNA, 25 bp, Rattus norvegicus
atagggtgctttgtcctggattgaa

SEQ ID NO: 174153 - DNA, 25 bp, Rattus norvegicus
atagggttccacatttcagacacac

SEQ ID NO: 174154 - DNA, 25 bp, Rattus norvegicus
atagggttccacttttcagacacac

SEQ ID NO: 174155 - DNA, 25 bp, Rattus norvegicus
atagggtttatgatggtgcttcatt

SEQ ID NO: 174156 - DNA, 25 bp, Rattus norvegicus
atagggtttatgttggtgcttcatt

SEQ ID NO: 174157 - DNA, 25 bp, Rattus norvegicus
atagggtttctaattagtcctggct

SEQ ID NO: 174158 - DNA, 25 bp, Rattus norvegicus
atagggtttctatttagtcctggct

SEQ ID NO: 174159 - DNA, 25 bp, Rattus norvegicus
atagggtttctcacccgtgtggact

SEQ ID NO: 174160 - DNA, 25 bp, Rattus norvegicus
atagggtttctctcccgtgtggact

SEQ ID NO: 174161 - DNA, 25 bp, Rattus norvegicus
atagggtttgtccaatgcttttgaa

SEQ ID NO: 174162 - DNA, 25 bp, Rattus norvegicus
atagggtttgtcgaatgcttttgaa

SEQ ID NO: 174163 - DNA, 25 bp, Rattus norvegicus
ataggtaaattccacaagctaaact

SEQ ID NO: 174164 - DNA, 25 bp, Rattus norvegicus
ataggtaaattcgacaagctaaact

SEQ ID NO: 174165 - DNA, 25 bp, Rattus norvegicus
ataggtaagggcaagtctctgtcaa

SEQ ID NO: 174166 - DNA, 25 bp, Rattus norvegicus
ataggtaagggctagtctctgtcaa

SEQ ID NO: 174167 - DNA, 25 bp, Rattus norvegicus
ataggtaatcagctgcttttccatc

SEQ ID NO: 174168 - DNA, 25 bp, Rattus norvegicus
ataggtaatcaggtgcttttccatc

SEQ ID NO: 174169 - DNA, 25 bp, Rattus norvegicus
ataggtaattccacacacagactcc

SEQ ID NO: 174170 - DNA, 25 bp, Rattus norvegicus
ataggtaattcctcacacagactcc

SEQ ID NO: 174171 - DNA, 25 bp, Rattus norvegicus
ataggtacctctcagattggcagct

SEQ ID NO: 174172 - DNA, 25 bp, Rattus norvegicus
ataggtacctctgagattggcagct

SEQ ID NO: 174173 - DNA, 25 bp, Rattus norvegicus
ataggtacgtccactcaagtgtggg

SEQ ID NO: 174174 - DNA, 25 bp, Rattus norvegicus
ataggtacgtcctctcaagtgtggg

SEQ ID NO: 174175 - DNA, 25 bp, Rattus norvegicus
ataggtactattagcatcggtcccc

SEQ ID NO: 174176 - DNA, 25 bp, Rattus norvegicus
ataggtactatttgcatcggtcccc

SEQ ID NO: 174177 - DNA, 25 bp, Rattus norvegicus
ataggtagaggtatccttccctgat

SEQ ID NO: 174178 - DNA, 25 bp, Rattus norvegicus
ataggtagaggtttccttccctgat

SEQ ID NO: 174179 - DNA, 25 bp, Rattus norvegicus
ataggtatactgctccatgttctgt

SEQ ID NO: 174180 - DNA, 25 bp, Rattus norvegicus
ataggtatactggtccatgttctgt

SEQ ID NO: 174181 - DNA, 25 bp, Rattus norvegicus
ataggtatccacatgaaagctgtcc

SEQ ID NO: 174182 - DNA, 25 bp, Rattus norvegicus
ataggtatccacttgaaagctgtcc

SEQ ID NO: 174183 - DNA, 25 bp, Rattus norvegicus
ataggtatctatccattcctgggaa

SEQ ID NO: 174184 - DNA, 25 bp, Rattus norvegicus
ataggtatctatgcattcctgggaa

SEQ ID NO: 174185 - DNA, 25 bp, Rattus norvegicus
ataggtatttcaagctccaccaatc

SEQ ID NO: 174186 - DNA, 25 bp, Rattus norvegicus
ataggtatttcatgctccaccaatc

SEQ ID NO: 174187 - DNA, 25 bp, Rattus norvegicus
ataggtcaaggtcttttcttcccag

SEQ ID NO: 174188 - DNA, 25 bp, Rattus norvegicus
ataggtcaaggtgttttcttcccag

SEQ ID NO: 174189 - DNA, 25 bp, Rattus norvegicus
ataggtcacactacagagcaggccc

SEQ ID NO: 174190 - DNA, 25 bp, Rattus norvegicus
ataggtcacacttcagagcaggccc

SEQ ID NO: 174191 - DNA, 25 bp, Rattus norvegicus
ataggtcacaggaggcgagtaacac

SEQ ID NO: 174192 - DNA, 25 bp, Rattus norvegicus
ataggtcacaggtggcgagtaacac

SEQ ID NO: 174193 - DNA, 25 bp, Rattus norvegicus
ataggtcaccacatctgatcgtgag

SEQ ID NO: 174194 - DNA, 25 bp, Rattus norvegicus
ataggtcaccacttctgatcgtgag

SEQ ID NO: 174195 - DNA, 25 bp, Rattus norvegicus
ataggtcagggcagggtccctctta

SEQ ID NO: 174196 - DNA, 25 bp, Rattus norvegicus
ataggtcagggctgggtccctctta

SEQ ID NO: 174197 - DNA, 25 bp, Rattus norvegicus
ataggtcaggttatagaaatgtcag

SEQ ID NO: 174198 - DNA, 25 bp, Rattus norvegicus
ataggtcaggttttagaaatgtcag

SEQ ID NO: 174199 - DNA, 25 bp, Rattus norvegicus
ataggtcagtcaagctgtgggtaat

SEQ ID NO: 174200 - DNA, 25 bp, Rattus norvegicus
ataggtcagtcatgctgtgggtaat

SEQ ID NO: 174201 - DNA, 25 bp, Rattus norvegicus
ataggtcatccaacctcttgagtca

SEQ ID NO: 174202 - DNA, 25 bp, Rattus norvegicus
ataggtcatccatcctcttgagtca

SEQ ID NO: 174203 - DNA, 25 bp, Rattus norvegicus
ataggtcccagcataactcgctttg

SEQ ID NO: 174204 - DNA, 25 bp, Rattus norvegicus
ataggtcccagcttaactcgctttg

SEQ ID NO: 174205 - DNA, 25 bp, Rattus norvegicus
ataggtccctgtacaggacactcgt

SEQ ID NO: 174206 - DNA, 25 bp, Rattus norvegicus
ataggtccctgtctgttcctgccct

SEQ ID NO: 174207 - DNA, 25 bp, Rattus norvegicus
ataggtccctgtgtgttcctgccct

SEQ ID NO: 174208 - DNA, 25 bp, Rattus norvegicus
ataggtccctgttcaggacactcgt

SEQ ID NO: 174209 - DNA, 25 bp, Rattus norvegicus
ataggtcctccgacttctacaccat

SEQ ID NO: 174210 - DNA, 25 bp, Rattus norvegicus
ataggtcctccgtcttctacaccat

SEQ ID NO: 174211 - DNA, 25 bp, Rattus norvegicus
ataggtcctgagcaatgggagattc

SEQ ID NO: 174212 - DNA, 25 bp, Rattus norvegicus
ataggtcctgaggaatgggagattc

SEQ ID NO: 174213 - DNA, 25 bp, Rattus norvegicus
ataggtcctgtgctagcattcagtt

SEQ ID NO: 174214 - DNA, 25 bp, Rattus norvegicus
ataggtcctgtggtagcattcagtt

SEQ ID NO: 174215 - DNA, 25 bp, Rattus norvegicus
ataggtcctgttactgtacaatttg

SEQ ID NO: 174216 - DNA, 25 bp, Rattus norvegicus
ataggtcctgtttctgtacaatttg

SEQ ID NO: 174217 - DNA, 25 bp, Rattus norvegicus
ataggtcgacgcctcaaggatgttg

SEQ ID NO: 174218 - DNA, 25 bp, Rattus norvegicus
ataggtcgacgcgtcaaggatgttg

SEQ ID NO: 174219 - DNA, 25 bp, Rattus norvegicus
ataggtctatttcgatgtactttga

SEQ ID NO: 174220 - DNA, 25 bp, Rattus norvegicus
ataggtctatttggatgtactttga

SEQ ID NO: 174221 - DNA, 25 bp, Rattus norvegicus
ataggtctggcaaaccgggacatct

SEQ ID NO: 174222 - DNA, 25 bp, Rattus norvegicus
ataggtctggcataccgggacatct

SEQ ID NO: 174223 - DNA, 25 bp, Rattus norvegicus
ataggtctggctattcacccaagaa

SEQ ID NO: 174224 - DNA, 25 bp, Rattus norvegicus
ataggtctggcttttcacccaagaa

SEQ ID NO: 174225 - DNA, 25 bp, Rattus norvegicus
ataggtctggtgaacaaggcctccc

SEQ ID NO: 174226 - DNA, 25 bp, Rattus norvegicus
ataggtctggtgtacaaggcctccc

SEQ ID NO: 174227 - DNA, 25 bp, Rattus norvegicus
ataggtctgtgtagtttcctgcttc

SEQ ID NO: 174228 - DNA, 25 bp, Rattus norvegicus
ataggtctgtgttgtttcctgcttc

SEQ ID NO: 174229 - DNA, 25 bp, Rattus norvegicus
ataggtcttactccatctgaccctg

SEQ ID NO: 174230 - DNA, 25 bp, Rattus norvegicus
ataggtcttactgcatctgaccctg

SEQ ID NO: 174231 - DNA, 25 bp, Rattus norvegicus
ataggtcttataaccccatatggga

SEQ ID NO: 174232 - DNA, 25 bp, Rattus norvegicus
ataggtcttatatccccatatggga

SEQ ID NO: 174233 - DNA, 25 bp, Rattus norvegicus
ataggtgagccaccaggctgtgaaa

SEQ ID NO: 174234 - DNA, 25 bp, Rattus norvegicus
ataggtgagccagcaggctgtgaaa

SEQ ID NO: 174235 - DNA, 25 bp, Rattus norvegicus
ataggtgagctcaacactcctgcta

SEQ ID NO: 174236 - DNA, 25 bp, Rattus norvegicus
ataggtgagctctacactcctgcta

SEQ ID NO: 174237 - DNA, 25 bp, Rattus norvegicus
ataggtgagtcaacgcaggatggca

SEQ ID NO: 174238 - DNA, 25 bp, Rattus norvegicus
ataggtgagtcatcgcaggatggca

SEQ ID NO: 174239 - DNA, 25 bp, Rattus norvegicus
ataggtgatgtacatatgcaccagg

SEQ ID NO: 174240 - DNA, 25 bp, Rattus norvegicus
ataggtgatgtagatatgcaccagg

SEQ ID NO: 174241 - DNA, 25 bp, Rattus norvegicus
ataggtgcatatcccaaaccatgcc

SEQ ID NO: 174242 - DNA, 25 bp, Rattus norvegicus
ataggtgcatatgccaaaccatgcc

SEQ ID NO: 174243 - DNA, 25 bp, Rattus norvegicus
ataggtgcccctaagactgtggatg

SEQ ID NO: 174244 - DNA, 25 bp, Rattus norvegicus
ataggtgccccttagactgtggatg

SEQ ID NO: 174245 - DNA, 25 bp, Rattus norvegicus
ataggtgccctcctggtggagacaa

SEQ ID NO: 174246 - DNA, 25 bp, Rattus norvegicus
ataggtgccctcgtggtggagacaa

SEQ ID NO: 174247 - DNA, 25 bp, Rattus norvegicus
ataggtgctgccatgctgatttcag

SEQ ID NO: 174248 - DNA, 25 bp, Rattus norvegicus
ataggtgctgccttgctgatttcag

SEQ ID NO: 174249 - DNA, 25 bp, Rattus norvegicus
ataggtgctgtaaatctgtccttgg

SEQ ID NO: 174250 - DNA, 25 bp, Rattus norvegicus
ataggtgctgtatatctgtccttgg

SEQ ID NO: 174251 - DNA, 25 bp, Rattus norvegicus
ataggtgctgtgaagcgcctgccga

SEQ ID NO: 174252 - DNA, 25 bp, Rattus norvegicus
ataggtgctgtgtagcgcctgccga

SEQ ID NO: 174253 - DNA, 25 bp, Rattus norvegicus
ataggtggactgcactatctgctcc

SEQ ID NO: 174254 - DNA, 25 bp, Rattus norvegicus
ataggtggactggactatctgctcc

SEQ ID NO: 174255 - DNA, 25 bp, Rattus norvegicus
ataggtggattgacaccttcctgct

SEQ ID NO: 174256 - DNA, 25 bp, Rattus norvegicus
ataggtggattgtcaccttcctgct

SEQ ID NO: 174257 - DNA, 25 bp, Rattus norvegicus
ataggtggcattcgctagctcaggc

SEQ ID NO: 174258 - DNA, 25 bp, Rattus norvegicus
ataggtggcattggctagctcaggc

SEQ ID NO: 174259 - DNA, 25 bp, Rattus norvegicus
ataggtggcccaccacttaagaata

SEQ ID NO: 174260 - DNA, 25 bp, Rattus norvegicus
ataggtggcccagcacttaagaata

SEQ ID NO: 174261 - DNA, 25 bp, Rattus norvegicus
ataggtggcctgcttgtattcttcc

SEQ ID NO: 174262 - DNA, 25 bp, Rattus norvegicus
ataggtggcctggttgtattcttcc

SEQ ID NO: 174263 - DNA, 25 bp, Rattus norvegicus
ataggtggtctcagtcatgacttct

SEQ ID NO: 174264 - DNA, 25 bp, Rattus norvegicus
ataggtggtctctgtcatgacttct

SEQ ID NO: 174265 - DNA, 25 bp, Rattus norvegicus
ataggtgtacataacgtgctttcgt

SEQ ID NO: 174266 - DNA, 25 bp, Rattus norvegicus
ataggtgtacattacgtgctttcgt

SEQ ID NO: 174267 - DNA, 25 bp, Rattus norvegicus
ataggtgtcactcctagtatcctgg

SEQ ID NO: 174268 - DNA, 25 bp, Rattus norvegicus
ataggtgtcactgctagtatcctgg

SEQ ID NO: 174269 - DNA, 25 bp, Rattus norvegicus
ataggtgtccctctagatttcctta

SEQ ID NO: 174270 - DNA, 25 bp, Rattus norvegicus
ataggtgtccctgtagatttcctta

SEQ ID NO: 174271 - DNA, 25 bp, Rattus norvegicus
ataggtgtccggaggttgcacagta

SEQ ID NO: 174272 - DNA, 25 bp, Rattus norvegicus
ataggtgtccggtggttgcacagta

SEQ ID NO: 174273 - DNA, 25 bp, Rattus norvegicus
ataggtgtctttcatttgcttccca

SEQ ID NO: 174274 - DNA, 25 bp, Rattus norvegicus
ataggtgtctttgatttgcttccca

SEQ ID NO: 174275 - DNA, 25 bp, Rattus norvegicus
ataggtgtgagcatcacactcagga

SEQ ID NO: 174276 - DNA, 25 bp, Rattus norvegicus
ataggtgtgagcttcacactcagga

SEQ ID NO: 174277 - DNA, 25 bp, Rattus norvegicus
ataggtgttcatcctgtggtgcccg

SEQ ID NO: 174278 - DNA, 25 bp, Rattus norvegicus
ataggtgttcatgctgtggtgcccg

SEQ ID NO: 174279 - DNA, 25 bp, Rattus norvegicus
ataggttagagtagcctcatccaga

SEQ ID NO: 174280 - DNA, 25 bp, Rattus norvegicus
ataggttagagttgcctcatccaga

SEQ ID NO: 174281 - DNA, 25 bp, Rattus norvegicus
ataggttcccgccaaggtaggcctg

SEQ ID NO: 174282 - DNA, 25 bp, Rattus norvegicus
ataggttcccgcgaaggtaggcctg

SEQ ID NO: 174283 - DNA, 25 bp, Rattus norvegicus
ataggttccctccatcatcaactac

SEQ ID NO: 174284 - DNA, 25 bp, Rattus norvegicus
ataggttccctcgatcatcaactac

SEQ ID NO: 174285 - DNA, 25 bp, Rattus norvegicus
ataggttcctcaacagagcccaagg

SEQ ID NO: 174286 - DNA, 25 bp, Rattus norvegicus
ataggttcctcatcagagcccaagg

SEQ ID NO: 174287 - DNA, 25 bp, Rattus norvegicus
ataggttcggttctcttcatactgg

SEQ ID NO: 174288 - DNA, 25 bp, Rattus norvegicus
ataggttcggttgtcttcatactgg

SEQ ID NO: 174289 - DNA, 25 bp, Rattus norvegicus
ataggttctcacattccagggatta

SEQ ID NO: 174290 - DNA, 25 bp, Rattus norvegicus
ataggttctcactttccagggatta

SEQ ID NO: 174291 - DNA, 25 bp, Rattus norvegicus
ataggttctcagcttgcatgccaag

SEQ ID NO: 174292 - DNA, 25 bp, Rattus norvegicus
ataggttctcaggttgcatgccaag

SEQ ID NO: 174293 - DNA, 25 bp, Rattus norvegicus
ataggttctctacagatagccctgg

SEQ ID NO: 174294 - DNA, 25 bp, Rattus norvegicus
ataggttctctagagatagccctgg

SEQ ID NO: 174295 - DNA, 25 bp, Rattus norvegicus
ataggttctgagaatccactggaga

SEQ ID NO: 174296 - DNA, 25 bp, Rattus norvegicus
ataggttctgagtatccactggaga

SEQ ID NO: 174297 - DNA, 25 bp, Rattus norvegicus
ataggttgacagcacgaacccttga

SEQ ID NO: 174298 - DNA, 25 bp, Rattus norvegicus
ataggttgacaggacgaacccttga

SEQ ID NO: 174299 - DNA, 25 bp, Rattus norvegicus
ataggttgatgcatttcggttgtcc

SEQ ID NO: 174300 - DNA, 25 bp, Rattus norvegicus
ataggttgatgcttttcggttgtcc

SEQ ID NO: 174301 - DNA, 25 bp, Rattus norvegicus
ataggttgcttaatcagtctgagat

SEQ ID NO: 174302 - DNA, 25 bp, Rattus norvegicus
ataggttgcttattcagtctgagat

SEQ ID NO: 174303 - DNA, 25 bp, Rattus norvegicus
ataggtttcactattcttcgtttag

SEQ ID NO: 174304 - DNA, 25 bp, Rattus norvegicus
ataggtttcacttttcttcgtttag

SEQ ID NO: 174305 - DNA, 25 bp, Rattus norvegicus
ataggtttcggtcagtgcgattcac

SEQ ID NO: 174306 - DNA, 25 bp, Rattus norvegicus
ataggtttcggtgagtgcgattcac

SEQ ID NO: 174307 - DNA, 25 bp, Rattus norvegicus
ataggtttcgttctgtcatgtgagc

SEQ ID NO: 174308 - DNA, 25 bp, Rattus norvegicus
ataggtttcgttgtgtcatgtgagc

SEQ ID NO: 174309 - DNA, 25 bp, Rattus norvegicus
ataggtttgcttctgattgcttcag

SEQ ID NO: 174310 - DNA, 25 bp, Rattus norvegicus
ataggtttgcttgtgattgcttcag

SEQ ID NO: 174311 - DNA, 25 bp, Rattus norvegicus
ataggtttgggcattccagtgcaag

SEQ ID NO: 174312 - DNA, 25 bp, Rattus norvegicus
ataggtttgggctttccagtgcaag

SEQ ID NO: 174313 - DNA, 25 bp, Rattus norvegicus
ataggttttcttcatgggaattcaa

SEQ ID NO: 174314 - DNA, 25 bp, Rattus norvegicus
ataggttttcttgatgggaattcaa

SEQ ID NO: 174315 - DNA, 25 bp, Rattus norvegicus
atagtaaccacgattcttcgcacgg

SEQ ID NO: 174316 - DNA, 25 bp, Rattus norvegicus
atagtaaccacgtttcttcgcacgg

SEQ ID NO: 174317 - DNA, 25 bp, Rattus norvegicus
atagtaacgtagacctcggctcagc

SEQ ID NO: 174318 - DNA, 25 bp, Rattus norvegicus
atagtaacgtagtcctcggctcagc

SEQ ID NO: 174319 - DNA, 25 bp, Rattus norvegicus
atagtaactctaaattctggaagga

SEQ ID NO: 174320 - DNA, 25 bp, Rattus norvegicus
atagtaactctatattctggaagga

SEQ ID NO: 174321 - DNA, 25 bp, Rattus norvegicus
atagtaactgccattgttcccctga

SEQ ID NO: 174322 - DNA, 25 bp, Rattus norvegicus
atagtaactgcctttgttcccctga

SEQ ID NO: 174323 - DNA, 25 bp, Rattus norvegicus
atagtaagctgcctctgatccatgc

SEQ ID NO: 174324 - DNA, 25 bp, Rattus norvegicus
atagtaagctgcgtctgatccatgc

SEQ ID NO: 174325 - DNA, 25 bp, Rattus norvegicus
atagtaagttagatggcagccccgg

SEQ ID NO: 174326 - DNA, 25 bp, Rattus norvegicus
atagtaagttagttggcagccccgg

SEQ ID NO: 174327 - DNA, 25 bp, Rattus norvegicus
atagtaatagctcctttctctttcc

SEQ ID NO: 174328 - DNA, 25 bp, Rattus norvegicus
atagtaatagctgctttctctttcc

SEQ ID NO: 174329 - DNA, 25 bp, Rattus norvegicus
atagtaatcatcacggcagctgccg

SEQ ID NO: 174330 - DNA, 25 bp, Rattus norvegicus
atagtaatcatctcggcagctgccg

SEQ ID NO: 174331 - DNA, 25 bp, Rattus norvegicus
atagtaatgttacccctattgcctc

SEQ ID NO: 174332 - DNA, 25 bp, Rattus norvegicus
atagtaatgttagccctattgcctc

SEQ ID NO: 174333 - DNA, 25 bp, Rattus norvegicus
atagtaattccacctccagtcttta

SEQ ID NO: 174334 - DNA, 25 bp, Rattus norvegicus
atagtaattccagctccagtcttta

SEQ ID NO: 174335 - DNA, 25 bp, Rattus norvegicus
atagtaattcctctgtggcacatat

SEQ ID NO: 174336 - DNA, 25 bp, Rattus norvegicus
atagtaattcctgtgtggcacatat

SEQ ID NO: 174337 - DNA, 25 bp, Rattus norvegicus
atagtacactgcattctgtgaagac

SEQ ID NO: 174338 - DNA, 25 bp, Rattus norvegicus
atagtacactgctttctgtgaagac

SEQ ID NO: 174339 - DNA, 25 bp, Rattus norvegicus
atagtacagctgcatactcttctcc

SEQ ID NO: 174340 - DNA, 25 bp, Rattus norvegicus
atagtacagctggatactcttctcc

SEQ ID NO: 174341 - DNA, 25 bp, Rattus norvegicus
atagtacagtggatcatttccctac

SEQ ID NO: 174342 - DNA, 25 bp, Rattus norvegicus
atagtacagtggttcatttccctac

SEQ ID NO: 174343 - DNA, 25 bp, Rattus norvegicus
atagtaccattactgtctgggcacc

SEQ ID NO: 174344 - DNA, 25 bp, Rattus norvegicus
atagtaccattagtgtctgggcacc

SEQ ID NO: 174345 - DNA, 25 bp, Rattus norvegicus
atagtacctgtgcagcagtcaccag

SEQ ID NO: 174346 - DNA, 25 bp, Rattus norvegicus
atagtacctgtggagcagtcaccag

SEQ ID NO: 174347 - DNA, 25 bp, Rattus norvegicus
atagtacggagtctggccctgctga

SEQ ID NO: 174348 - DNA, 25 bp, Rattus norvegicus
atagtacggagtgtggccctgctga

SEQ ID NO: 174349 - DNA, 25 bp, Rattus norvegicus
atagtactatagaggctagaaagat

SEQ ID NO: 174350 - DNA, 25 bp, Rattus norvegicus
atagtactatagtggctagaaagat

SEQ ID NO: 174351 - DNA, 25 bp, Rattus norvegicus
atagtactcaagattttcccaggga

SEQ ID NO: 174352 - DNA, 25 bp, Rattus norvegicus
atagtactcaagtttttcccaggga

SEQ ID NO: 174353 - DNA, 25 bp, Rattus norvegicus
atagtactcctaacatatgccatga

SEQ ID NO: 174354 - DNA, 25 bp, Rattus norvegicus
atagtactcctatcatatgccatga

SEQ ID NO: 174355 - DNA, 25 bp, Rattus norvegicus
atagtactctgcagagaccctgaga

SEQ ID NO: 174356 - DNA, 25 bp, Rattus norvegicus
atagtactctgctgagaccctgaga

SEQ ID NO: 174357 - DNA, 25 bp, Rattus norvegicus
atagtactggagagggcttcaccca

SEQ ID NO: 174358 - DNA, 25 bp, Rattus norvegicus
atagtactggagtgggcttcaccca

SEQ ID NO: 174359 - DNA, 25 bp, Rattus norvegicus
atagtagaaccgacagtagctgtgt

SEQ ID NO: 174360 - DNA, 25 bp, Rattus norvegicus
atagtagaaccgtcagtagctgtgt

SEQ ID NO: 174361 - DNA, 25 bp, Rattus norvegicus
atagtagaatgtccacacgaagttt

SEQ ID NO: 174362 - DNA, 25 bp, Rattus norvegicus
atagtagaatgtgcacacgaagttt

SEQ ID NO: 174363 - DNA, 25 bp, Rattus norvegicus
atagtagcagggacacgcatcctag

SEQ ID NO: 174364 - DNA, 25 bp, Rattus norvegicus
atagtagcagggtcacgcatcctag

SEQ ID NO: 174365 - DNA, 25 bp, Rattus norvegicus
atagtagccgttcaggccatcattg

SEQ ID NO: 174366 - DNA, 25 bp, Rattus norvegicus
atagtagccgttgaggccatcattg

SEQ ID NO: 174367 - DNA, 25 bp, Rattus norvegicus
atagtagcgtagctcaaaccgtccc

SEQ ID NO: 174368 - DNA, 25 bp, Rattus norvegicus
atagtagcgtaggtcaaaccgtccc

SEQ ID NO: 174369 - DNA, 25 bp, Rattus norvegicus
atagtagcttccaagcacccaatcg

SEQ ID NO: 174370 - DNA, 25 bp, Rattus norvegicus
atagtagcttcctagcacccaatcg

SEQ ID NO: 174371 - DNA, 25 bp, Rattus norvegicus
atagtagtacacatctgcctttgcc

SEQ ID NO: 174372 - DNA, 25 bp, Rattus norvegicus
atagtagtacacttctgcctttgcc

SEQ ID NO: 174373 - DNA, 25 bp, Rattus norvegicus
atagtagtcctgcttagacccctgc

SEQ ID NO: 174374 - DNA, 25 bp, Rattus norvegicus
atagtagtcctggttagacccctgc

SEQ ID NO: 174375 - DNA, 25 bp, Rattus norvegicus
atagtagtggctacaggaggctcct

SEQ ID NO: 174376 - DNA, 25 bp, Rattus norvegicus
atagtagtggcttcaggaggctcct

SEQ ID NO: 174377 - DNA, 25 bp, Rattus norvegicus
atagtagtggtaacttcctgtgcct

SEQ ID NO: 174378 - DNA, 25 bp, Rattus norvegicus
atagtagtggtatcttcctgtgcct

SEQ ID NO: 174379 - DNA, 25 bp, Rattus norvegicus
atagtagtgtgtaagcattccgcct

SEQ ID NO: 174380 - DNA, 25 bp, Rattus norvegicus
atagtagtgtgttagcattccgcct

SEQ ID NO: 174381 - DNA, 25 bp, Rattus norvegicus
atagtatcagatctgggaagcctcg

SEQ ID NO: 174382 - DNA, 25 bp, Rattus norvegicus
atagtatcagatgtgggaagcctcg

SEQ ID NO: 174383 - DNA, 25 bp, Rattus norvegicus
atagtatccctgaacagagcggagg

SEQ ID NO: 174384 - DNA, 25 bp, Rattus norvegicus
atagtatccctgtacagagcggagg

SEQ ID NO: 174385 - DNA, 25 bp, Rattus norvegicus
atagtatgcatcagcccacggtcct

SEQ ID NO: 174386 - DNA, 25 bp, Rattus norvegicus
atagtatgcatctgcccacggtcct

SEQ ID NO: 174387 - DNA, 25 bp, Rattus norvegicus
atagtatgggatctgtcggtgtctc

SEQ ID NO: 174388 - DNA, 25 bp, Rattus norvegicus
atagtatgggatgtgtcggtgtctc

SEQ ID NO: 174389 - DNA, 25 bp, Rattus norvegicus
atagtattagtcacttaacgtcttg

SEQ ID NO: 174390 - DNA, 25 bp, Rattus norvegicus
atagtattagtctcttaacgtcttg

SEQ ID NO: 174391 - DNA, 25 bp, Rattus norvegicus
atagtattattcctttcaaccaaag

SEQ ID NO: 174392 - DNA, 25 bp, Rattus norvegicus
atagtattattcgtttcaaccaaag

SEQ ID NO: 174393 - DNA, 25 bp, Rattus norvegicus
atagtattgccccagacatgcattc

SEQ ID NO: 174394 - DNA, 25 bp, Rattus norvegicus
atagtattgcccgagacatgcattc

SEQ ID NO: 174395 - DNA, 25 bp, Rattus norvegicus
atagtattgctgacactctggcact

SEQ ID NO: 174396 - DNA, 25 bp, Rattus norvegicus
atagtattgctgtcactctggcact

SEQ ID NO: 174397 - DNA, 25 bp, Rattus norvegicus
atagtatttaagattgttgctgtca

SEQ ID NO: 174398 - DNA, 25 bp, Rattus norvegicus
atagtatttaagtttgttgctgtca

SEQ ID NO: 174399 - DNA, 25 bp, Rattus norvegicus
atagtatttggcacctgctgggttc

SEQ ID NO: 174400 - DNA, 25 bp, Rattus norvegicus
atagtatttggctcctgctgggttc

SEQ ID NO: 174401 - DNA, 25 bp, Rattus norvegicus
atagtatttgggagccttgatttac

SEQ ID NO: 174402 - DNA, 25 bp, Rattus norvegicus
atagtatttgggtgccttgatttac

SEQ ID NO: 174403 - DNA, 25 bp, Rattus norvegicus
atagtcaaatctagttctctccctg

SEQ ID NO: 174404 - DNA, 25 bp, Rattus norvegicus
atagtcaaatcttgttctctccctg

SEQ ID NO: 174405 - DNA, 25 bp, Rattus norvegicus
atagtcaactccatagcactttcac

SEQ ID NO: 174406 - DNA, 25 bp, Rattus norvegicus
atagtcaactccttagcactttcac

SEQ ID NO: 174407 - DNA, 25 bp, Rattus norvegicus
atagtcaaggttacccagggctaca

SEQ ID NO: 174408 - DNA, 25 bp, Rattus norvegicus
atagtcaaggtttcccagggctaca

SEQ ID NO: 174409 - DNA, 25 bp, Rattus norvegicus
atagtcaataccaggagcgcctacg

SEQ ID NO: 174410 - DNA, 25 bp, Rattus norvegicus
atagtcaatacctggagcgcctacg

SEQ ID NO: 174411 - DNA, 25 bp, Rattus norvegicus
atagtcacaccccaacagtaatgag

SEQ ID NO: 174412 - DNA, 25 bp, Rattus norvegicus
atagtcacacccgaacagtaatgag

SEQ ID NO: 174413 - DNA, 25 bp, Rattus norvegicus
atagtcacaggtccagtctgccatg

SEQ ID NO: 174414 - DNA, 25 bp, Rattus norvegicus
atagtcacaggtgcagtctgccatg

SEQ ID NO: 174415 - DNA, 25 bp, Rattus norvegicus
atagtcaccaccaggtccatgattg

SEQ ID NO: 174416 - DNA, 25 bp, Rattus norvegicus
atagtcaccacctggtccatgattg

SEQ ID NO: 174417 - DNA, 25 bp, Rattus norvegicus
atagtcacctgtctgtttcttcttg

SEQ ID NO: 174418 - DNA, 25 bp, Rattus norvegicus
atagtcacctgtgtgtttcttcttg

SEQ ID NO: 174419 - DNA, 25 bp, Rattus norvegicus
atagtcactgcaagtcacagcggct

SEQ ID NO: 174420 - DNA, 25 bp, Rattus norvegicus
atagtcactgcatgtcacagcggct

SEQ ID NO: 174421 - DNA, 25 bp, Rattus norvegicus
atagtcactgctacaaagtaacaaa

SEQ ID NO: 174422 - DNA, 25 bp, Rattus norvegicus
atagtcactgcttcaaagtaacaaa

SEQ ID NO: 174423 - DNA, 25 bp, Rattus norvegicus
atagtcacttggctccatgccttcc

SEQ ID NO: 174424 - DNA, 25 bp, Rattus norvegicus
atagtcacttgggtccatgccttcc

SEQ ID NO: 174425 - DNA, 25 bp, Rattus norvegicus
atagtcagatcacagtcccttagca

SEQ ID NO: 174426 - DNA, 25 bp, Rattus norvegicus
atagtcagatcagagtcccttagca

SEQ ID NO: 174427 - DNA, 25 bp, Rattus norvegicus
atagtcagcatacgcgtctacgtca

SEQ ID NO: 174428 - DNA, 25 bp, Rattus norvegicus
atagtcagcataggcgtctacgtca

SEQ ID NO: 174429 - DNA, 25 bp, Rattus norvegicus
atagtcagcctgcagtttgccattg

SEQ ID NO: 174430 - DNA, 25 bp, Rattus norvegicus
atagtcagcctggagtttgccattg

SEQ ID NO: 174431 - DNA, 25 bp, Rattus norvegicus
atagtcagtctaacctctttgttgc

SEQ ID NO: 174432 - DNA, 25 bp, Rattus norvegicus
atagtcagtctatcctctttgttgc

SEQ ID NO: 174433 - DNA, 25 bp, Rattus norvegicus
atagtcagtgttcaggttccacctc

SEQ ID NO: 174434 - DNA, 25 bp, Rattus norvegicus
atagtcagtgttgaggttccacctc

SEQ ID NO: 174435 - DNA, 25 bp, Rattus norvegicus
atagtcatatacatgctgctgtctt

SEQ ID NO: 174436 - DNA, 25 bp, Rattus norvegicus
atagtcatatacttgctgctgtctt

SEQ ID NO: 174437 - DNA, 25 bp, Rattus norvegicus
atagtcatctccctatttatgcctg

SEQ ID NO: 174438 - DNA, 25 bp, Rattus norvegicus
atagtcatctccgtatttatgcctg

SEQ ID NO: 174439 - DNA, 25 bp, Rattus norvegicus
atagtcatctttaccttccaacaga

SEQ ID NO: 174440 - DNA, 25 bp, Rattus norvegicus
atagtcatcttttccttccaacaga

SEQ ID NO: 174441 - DNA, 25 bp, Rattus norvegicus
atagtcatgctcagagctcacatca

SEQ ID NO: 174442 - DNA, 25 bp, Rattus norvegicus
atagtcatgctctgagctcacatca

SEQ ID NO: 174443 - DNA, 25 bp, Rattus norvegicus
atagtcatggtgaaccgtggcctca

SEQ ID NO: 174444 - DNA, 25 bp, Rattus norvegicus
atagtcatggtgtaccgtggcctca

SEQ ID NO: 174445 - DNA, 25 bp, Rattus norvegicus
atagtcattaaaagccatcgaggca

SEQ ID NO: 174446 - DNA, 25 bp, Rattus norvegicus
atagtcattaaatgccatcgaggca

SEQ ID NO: 174447 - DNA, 25 bp, Rattus norvegicus
atagtcattgaaacgggacctttga

SEQ ID NO: 174448 - DNA, 25 bp, Rattus norvegicus
atagtcattgaatcgggacctttga

SEQ ID NO: 174449 - DNA, 25 bp, Rattus norvegicus
atagtcattgcaacgtgacgccctt

SEQ ID NO: 174450 - DNA, 25 bp, Rattus norvegicus
atagtcattgcatcgtgacgccctt

SEQ ID NO: 174451 - DNA, 25 bp, Rattus norvegicus
atagtcattttacgcacatcacagt

SEQ ID NO: 174452 - DNA, 25 bp, Rattus norvegicus
atagtcattttaggcacatcacagt

SEQ ID NO: 174453 - DNA, 25 bp, Rattus norvegicus
atagtccaagaaaattacccaaggg

SEQ ID NO: 174454 - DNA, 25 bp, Rattus norvegicus
atagtccaagaatattacccaaggg

SEQ ID NO: 174455 - DNA, 25 bp, Rattus norvegicus
atagtccaatacagcacagacgtgt

SEQ ID NO: 174456 - DNA, 25 bp, Rattus norvegicus
atagtccaatactgcacagacgtgt

SEQ ID NO: 174457 - DNA, 25 bp, Rattus norvegicus
atagtccaatgcatggctccggccg

SEQ ID NO: 174458 - DNA, 25 bp, Rattus norvegicus
atagtccaatgcttggctccggccg

SEQ ID NO: 174459 - DNA, 25 bp, Rattus norvegicus
atagtccagactcctggctgagacc

SEQ ID NO: 174460 - DNA, 25 bp, Rattus norvegicus
atagtccagactgctggctgagacc

SEQ ID NO: 174461 - DNA, 25 bp, Rattus norvegicus
atagtccatactctggtacacctga

SEQ ID NO: 174462 - DNA, 25 bp, Rattus norvegicus
atagtccatactgtggtacacctga

SEQ ID NO: 174463 - DNA, 25 bp, Rattus norvegicus
atagtcccagttacagggtcagcgt

SEQ ID NO: 174464 - DNA, 25 bp, Rattus norvegicus
atagtcccagttcccagcgaagaga

SEQ ID NO: 174465 - DNA, 25 bp, Rattus norvegicus
atagtcccagttgccagcgaagaga

SEQ ID NO: 174466 - DNA, 25 bp, Rattus norvegicus
atagtcccagtttcagggtcagcgt

SEQ ID NO: 174467 - DNA, 25 bp, Rattus norvegicus
atagtcccatagaccagattcctaa

SEQ ID NO: 174468 - DNA, 25 bp, Rattus norvegicus
atagtcccatagtccagattcctaa

SEQ ID NO: 174469 - DNA, 25 bp, Rattus norvegicus
atagtccccaatagcgtagattttt

SEQ ID NO: 174470 - DNA, 25 bp, Rattus norvegicus
atagtccccaattgcgtagattttt

SEQ ID NO: 174471 - DNA, 25 bp, Rattus norvegicus
atagtccctaccacattaggttgag

SEQ ID NO: 174472 - DNA, 25 bp, Rattus norvegicus
atagtccctacctcattaggttgag

SEQ ID NO: 174473 - DNA, 25 bp, Rattus norvegicus
atagtcctaggcagggcatactcct

SEQ ID NO: 174474 - DNA, 25 bp, Rattus norvegicus
atagtcctaggctgggcatactcct

SEQ ID NO: 174475 - DNA, 25 bp, Rattus norvegicus
atagtcctgaacatacctgatgact

SEQ ID NO: 174476 - DNA, 25 bp, Rattus norvegicus
atagtcctgaacttacctgatgact

SEQ ID NO: 174477 - DNA, 25 bp, Rattus norvegicus
atagtcctgactccaccagatgaca

SEQ ID NO: 174478 - DNA, 25 bp, Rattus norvegicus
atagtcctgactgcaccagatgaca

SEQ ID NO: 174479 - DNA, 25 bp, Rattus norvegicus
atagtcctgggaccaagttcccatt

SEQ ID NO: 174480 - DNA, 25 bp, Rattus norvegicus
atagtcctgggagcaagttcccatt

SEQ ID NO: 174481 - DNA, 25 bp, Rattus norvegicus
atagtcctgtatagagctcagtcag

SEQ ID NO: 174482 - DNA, 25 bp, Rattus norvegicus
atagtcctgtattgagctcagtcag

SEQ ID NO: 174483 - DNA, 25 bp, Rattus norvegicus
atagtcgagtataggatagatcccg

SEQ ID NO: 174484 - DNA, 25 bp, Rattus norvegicus
atagtcgagtattggatagatcccg

SEQ ID NO: 174485 - DNA, 25 bp, Rattus norvegicus
atagtcgctttcatcattatcagag

SEQ ID NO: 174486 - DNA, 25 bp, Rattus norvegicus
atagtcgctttcttcattatcagag

SEQ ID NO: 174487 - DNA, 25 bp, Rattus norvegicus
atagtcggattcattgtgtcctcca

SEQ ID NO: 174488 - DNA, 25 bp, Rattus norvegicus
atagtcggattctttgtgtcctcca

SEQ ID NO: 174489 - DNA, 25 bp, Rattus norvegicus
atagtcgggcaaacctgtgtcgata

SEQ ID NO: 174490 - DNA, 25 bp, Rattus norvegicus
atagtcgggcaatcctgtgtcgata

SEQ ID NO: 174491 - DNA, 25 bp, Rattus norvegicus
atagtctaccatctaagcttccaca

SEQ ID NO: 174492 - DNA, 25 bp, Rattus norvegicus
atagtctaccatgtaagcttccaca

SEQ ID NO: 174493 - DNA, 25 bp, Rattus norvegicus
atagtctagagacgccattgcttgc

SEQ ID NO: 174494 - DNA, 25 bp, Rattus norvegicus
atagtctagagaggccattgcttgc

SEQ ID NO: 174495 - DNA, 25 bp, Rattus norvegicus
atagtctcaagccttacctgcagaa

SEQ ID NO: 174496 - DNA, 25 bp, Rattus norvegicus
atagtctcaagcgttacctgcagaa

SEQ ID NO: 174497 - DNA, 25 bp, Rattus norvegicus
atagtctcactaacttgatgtaact

SEQ ID NO: 174498 - DNA, 25 bp, Rattus norvegicus
atagtctcactatcttgatgtaact

SEQ ID NO: 174499 - DNA, 25 bp, Rattus norvegicus
atagtctccaacatcatctcagctt

SEQ ID NO: 174500 - DNA, 25 bp, Rattus norvegicus
atagtctccaacttcatctcagctt

SEQ ID NO: 174501 - DNA, 25 bp, Rattus norvegicus
atagtctccactaggtccacggtca

SEQ ID NO: 174502 - DNA, 25 bp, Rattus norvegicus
atagtctccacttggtccacggtca

SEQ ID NO: 174503 - DNA, 25 bp, Rattus norvegicus
atagtctcccatccctgtaatataa

SEQ ID NO: 174504 - DNA, 25 bp, Rattus norvegicus
atagtctcccatgcctgtaatataa

SEQ ID NO: 174505 - DNA, 25 bp, Rattus norvegicus
atagtctcctttcctgtggccctca

SEQ ID NO: 174506 - DNA, 25 bp, Rattus norvegicus
atagtctcctttgctgtggccctca

SEQ ID NO: 174507 - DNA, 25 bp, Rattus norvegicus
atagtctctattccatcttcttttc

SEQ ID NO: 174508 - DNA, 25 bp, Rattus norvegicus
atagtctctattgcatcttcttttc

SEQ ID NO: 174509 - DNA, 25 bp, Rattus norvegicus
atagtctctgggactaactcctggg

SEQ ID NO: 174510 - DNA, 25 bp, Rattus norvegicus
atagtctctgggtctaactcctggg

SEQ ID NO: 174511 - DNA, 25 bp, Rattus norvegicus
atagtctctgtacttgtttcctggc

SEQ ID NO: 174512 - DNA, 25 bp, Rattus norvegicus
atagtctctgtagttgtttcctggc

SEQ ID NO: 174513 - DNA, 25 bp, Rattus norvegicus
atagtctgaggcatctgcagtccat

SEQ ID NO: 174514 - DNA, 25 bp, Rattus norvegicus
atagtctgaggcttctgcagtccat

SEQ ID NO: 174515 - DNA, 25 bp, Rattus norvegicus
atagtctgaggtcggattccagcct

SEQ ID NO: 174516 - DNA, 25 bp, Rattus norvegicus
atagtctgaggtgggattccagcct

SEQ ID NO: 174517 - DNA, 25 bp, Rattus norvegicus
atagtctggagccacgaacgctttg

SEQ ID NO: 174518 - DNA, 25 bp, Rattus norvegicus
atagtctggagcgacgaacgctttg

SEQ ID NO: 174519 - DNA, 25 bp, Rattus norvegicus
atagtctgggctattcttcttttca

SEQ ID NO: 174520 - DNA, 25 bp, Rattus norvegicus
atagtctgggcttttcttcttttca

SEQ ID NO: 174521 - DNA, 25 bp, Rattus norvegicus
atagtcttatctcatctcatagcag

SEQ ID NO: 174522 - DNA, 25 bp, Rattus norvegicus
atagtcttatctgatctcatagcag

SEQ ID NO: 174523 - DNA, 25 bp, Rattus norvegicus
atagtcttcatgcagcacatctaaa

SEQ ID NO: 174524 - DNA, 25 bp, Rattus norvegicus
atagtcttcatggagcacatctaaa

SEQ ID NO: 174525 - DNA, 25 bp, Rattus norvegicus
atagtcttctgtatctttattattt

SEQ ID NO: 174526 - DNA, 25 bp, Rattus norvegicus
atagtcttctgtttctttattattt

SEQ ID NO: 174527 - DNA, 25 bp, Rattus norvegicus
atagtcttttcacactgcagctttg

SEQ ID NO: 174528 - DNA, 25 bp, Rattus norvegicus
atagtcttttcagactgcagctttg

SEQ ID NO: 174529 - DNA, 25 bp, Rattus norvegicus
atagtgaaagccatctatgacatga

SEQ ID NO: 174530 - DNA, 25 bp, Rattus norvegicus
atagtgaaagccttctatgacatga

SEQ ID NO: 174531 - DNA, 25 bp, Rattus norvegicus
atagtgaactctctgggcatctcca

SEQ ID NO: 174532 - DNA, 25 bp, Rattus norvegicus
atagtgaactctgtgggcatctcca

SEQ ID NO: 174533 - DNA, 25 bp, Rattus norvegicus
atagtgaattccctgcctaagctgg

SEQ ID NO: 174534 - DNA, 25 bp, Rattus norvegicus
atagtgaattccgtgcctaagctgg

SEQ ID NO: 174535 - DNA, 25 bp, Rattus norvegicus
atagtgacatgtatgactgctcatc

SEQ ID NO: 174536 - DNA, 25 bp, Rattus norvegicus
atagtgacatgtttgactgctcatc

SEQ ID NO: 174537 - DNA, 25 bp, Rattus norvegicus
atagtgacattccactccagtttct

SEQ ID NO: 174538 - DNA, 25 bp, Rattus norvegicus
atagtgacattcgactccagtttct

SEQ ID NO: 174539 - DNA, 25 bp, Rattus norvegicus
atagtgacctataccacttcggtat

SEQ ID NO: 174540 - DNA, 25 bp, Rattus norvegicus
atagtgacctattccacttcggtat

SEQ ID NO: 174541 - DNA, 25 bp, Rattus norvegicus
atagtgacctcacattgtgccctgt

SEQ ID NO: 174542 - DNA, 25 bp, Rattus norvegicus
atagtgacctcagattgtgccctgt

SEQ ID NO: 174543 - DNA, 25 bp, Rattus norvegicus
atagtgacgtatccctttaaaccca

SEQ ID NO: 174544 - DNA, 25 bp, Rattus norvegicus
atagtgacgtatgcctttaaaccca

SEQ ID NO: 174545 - DNA, 25 bp, Rattus norvegicus
atagtgactcatcctgtttccatag

SEQ ID NO: 174546 - DNA, 25 bp, Rattus norvegicus
atagtgactcatgctgtttccatag

SEQ ID NO: 174547 - DNA, 25 bp, Rattus norvegicus
atagtgactcccacctgtacatata

SEQ ID NO: 174548 - DNA, 25 bp, Rattus norvegicus
atagtgactccctcctgtacatata

SEQ ID NO: 174549 - DNA, 25 bp, Rattus norvegicus
atagtgagacccctgcgtgagagac

SEQ ID NO: 174550 - DNA, 25 bp, Rattus norvegicus
atagtgagacccgtgcgtgagagac

SEQ ID NO: 174551 - DNA, 25 bp, Rattus norvegicus
atagtgagattcactccacactctc

SEQ ID NO: 174552 - DNA, 25 bp, Rattus norvegicus
atagtgagattctctccacactctc

SEQ ID NO: 174553 - DNA, 25 bp, Rattus norvegicus
atagtgagcttccagccagagtttt

SEQ ID NO: 174554 - DNA, 25 bp, Rattus norvegicus
atagtgagcttcgagccagagtttt

SEQ ID NO: 174555 - DNA, 25 bp, Rattus norvegicus
atagtgaggccaactgtagggagct

SEQ ID NO: 174556 - DNA, 25 bp, Rattus norvegicus
atagtgaggccatctgtagggagct

SEQ ID NO: 174557 - DNA, 25 bp, Rattus norvegicus
atagtgaggtccagccatgaaggca

SEQ ID NO: 174558 - DNA, 25 bp, Rattus norvegicus
atagtgaggtcctgccatgaaggca

SEQ ID NO: 174559 - DNA, 25 bp, Rattus norvegicus
atagtgagtcccaggctagccaaaa

SEQ ID NO: 174560 - DNA, 25 bp, Rattus norvegicus
atagtgagtccctggctagccaaaa

SEQ ID NO: 174561 - DNA, 25 bp, Rattus norvegicus
atagtgagtttcaggccaacttaac

SEQ ID NO: 174562 - DNA, 25 bp, Rattus norvegicus
atagtgagtttctggccaacttaac

SEQ ID NO: 174563 - DNA, 25 bp, Rattus norvegicus
atagtgatcgccactgggattgggt

SEQ ID NO: 174564 - DNA, 25 bp, Rattus norvegicus
atagtgatcgcctctgggattgggt

SEQ ID NO: 174565 - DNA, 25 bp, Rattus norvegicus
atagtgatgcacaccgttagtccca

SEQ ID NO: 174566 - DNA, 25 bp, Rattus norvegicus
atagtgatgcactccgttagtccca

SEQ ID NO: 174567 - DNA, 25 bp, Rattus norvegicus
atagtgattcggctgcccacggcaa

SEQ ID NO: 174568 - DNA, 25 bp, Rattus norvegicus
atagtgattcgggtgcccacggcaa

SEQ ID NO: 174569 - DNA, 25 bp, Rattus norvegicus
atagtgattgttcgcactgctgtga

SEQ ID NO: 174570 - DNA, 25 bp, Rattus norvegicus
atagtgattgttggcactgctgtga

SEQ ID NO: 174571 - DNA, 25 bp, Rattus norvegicus
atagtgatttcaagtccacctgggc

SEQ ID NO: 174572 - DNA, 25 bp, Rattus norvegicus
atagtgatttcacgcctcttgttta

SEQ ID NO: 174573 - DNA, 25 bp, Rattus norvegicus
atagtgatttcaggcctcttgttta

SEQ ID NO: 174574 - DNA, 25 bp, Rattus norvegicus
atagtgatttcatgtccacctgggc

SEQ ID NO: 174575 - DNA, 25 bp, Rattus norvegicus
atagtgcaacccaggcaggcttctt

SEQ ID NO: 174576 - DNA, 25 bp, Rattus norvegicus
atagtgcaaccctggcaggcttctt

SEQ ID NO: 174577 - DNA, 25 bp, Rattus norvegicus
atagtgcaggctctcgtgtatatcg

SEQ ID NO: 174578 - DNA, 25 bp, Rattus norvegicus
atagtgcaggctgtcgtgtatatcg

SEQ ID NO: 174579 - DNA, 25 bp, Rattus norvegicus
atagtgcattgtatccaccagttat

SEQ ID NO: 174580 - DNA, 25 bp, Rattus norvegicus
atagtgcattgtttccaccagttat

SEQ ID NO: 174581 - DNA, 25 bp, Rattus norvegicus
atagtgccaggcataaagggacatg

SEQ ID NO: 174582 - DNA, 25 bp, Rattus norvegicus
atagtgccaggcttaaagggacatg

SEQ ID NO: 174583 - DNA, 25 bp, Rattus norvegicus
atagtgccctggctgtacgatagcc

SEQ ID NO: 174584 - DNA, 25 bp, Rattus norvegicus
atagtgccctgggtgtacgatagcc

SEQ ID NO: 174585 - DNA, 25 bp, Rattus norvegicus
atagtgcctcccattgccacctata

SEQ ID NO: 174586 - DNA, 25 bp, Rattus norvegicus
atagtgcctccctttgccacctata

SEQ ID NO: 174587 - DNA, 25 bp, Rattus norvegicus
atagtgcctgagaccaagtctcctg

SEQ ID NO: 174588 - DNA, 25 bp, Rattus norvegicus
atagtgcctgagtccaagtctcctg

SEQ ID NO: 174589 - DNA, 25 bp, Rattus norvegicus
atagtgcctttccatttggtctcca

SEQ ID NO: 174590 - DNA, 25 bp, Rattus norvegicus
atagtgcctttcgatttggtctcca

SEQ ID NO: 174591 - DNA, 25 bp, Rattus norvegicus
atagtgctacagagatgccagccct

SEQ ID NO: 174592 - DNA, 25 bp, Rattus norvegicus
atagtgctacagtgatgccagccct

SEQ ID NO: 174593 - DNA, 25 bp, Rattus norvegicus
atagtgctgggaaccatgttctctt

SEQ ID NO: 174594 - DNA, 25 bp, Rattus norvegicus
atagtgctgggatccatgttctctt

SEQ ID NO: 174595 - DNA, 25 bp, Rattus norvegicus
atagtgcttgtacaagcttgccaaa

SEQ ID NO: 174596 - DNA, 25 bp, Rattus norvegicus
atagtgcttgtagaagcttgccaaa

SEQ ID NO: 174597 - DNA, 25 bp, Rattus norvegicus
atagtgctttcacatcggcgatgct

SEQ ID NO: 174598 - DNA, 25 bp, Rattus norvegicus
atagtgctttcagatcggcgatgct

SEQ ID NO: 174599 - DNA, 25 bp, Rattus norvegicus
atagtggaacacatgctcggactct

SEQ ID NO: 174600 - DNA, 25 bp, Rattus norvegicus
atagtggaacacttgctcggactct

SEQ ID NO: 174601 - DNA, 25 bp, Rattus norvegicus
atagtggaatgcatagtcaccaggg

SEQ ID NO: 174602 - DNA, 25 bp, Rattus norvegicus
atagtggaatgcttagtcaccaggg

SEQ ID NO: 174603 - DNA, 25 bp, Rattus norvegicus
atagtggaccagcaagcaccccttg

SEQ ID NO: 174604 - DNA, 25 bp, Rattus norvegicus
atagtggaccaggaagcaccccttg

SEQ ID NO: 174605 - DNA, 25 bp, Rattus norvegicus
atagtggagacacctgccttggcct

SEQ ID NO: 174606 - DNA, 25 bp, Rattus norvegicus
atagtggagacagctgccttggcct

SEQ ID NO: 174607 - DNA, 25 bp, Rattus norvegicus
atagtggccctgactcggagagctc

SEQ ID NO: 174608 - DNA, 25 bp, Rattus norvegicus
atagtggccctgtctcggagagctc

SEQ ID NO: 174609 - DNA, 25 bp, Rattus norvegicus
atagtggctcagaccggccttgtag

SEQ ID NO: 174610 - DNA, 25 bp, Rattus norvegicus
atagtggctcagtccggccttgtag

SEQ ID NO: 174611 - DNA, 25 bp, Rattus norvegicus
atagtggctcctagccctagaggaa

SEQ ID NO: 174612 - DNA, 25 bp, Rattus norvegicus
atagtggctccttgccctagaggaa

SEQ ID NO: 174613 - DNA, 25 bp, Rattus norvegicus
atagtggctttgacagcccacttgt

SEQ ID NO: 174614 - DNA, 25 bp, Rattus norvegicus
atagtggctttgtcagcccacttgt

SEQ ID NO: 174615 - DNA, 25 bp, Rattus norvegicus
atagtgggccagcagaaaccctata

SEQ ID NO: 174616 - DNA, 25 bp, Rattus norvegicus
atagtgggccaggagaaaccctata

SEQ ID NO: 174617 - DNA, 25 bp, Rattus norvegicus
atagtgggctgaacctcacctagag

SEQ ID NO: 174618 - DNA, 25 bp, Rattus norvegicus
atagtgggctgatcctcacctagag

SEQ ID NO: 174619 - DNA, 25 bp, Rattus norvegicus
atagtgggttccatggctctgtggc

SEQ ID NO: 174620 - DNA, 25 bp, Rattus norvegicus
atagtgggttccttggctctgtggc

SEQ ID NO: 174621 - DNA, 25 bp, Rattus norvegicus
atagtggtcactcctcagcgtcatg

SEQ ID NO: 174622 - DNA, 25 bp, Rattus norvegicus
atagtggtcactgctcagcgtcatg

SEQ ID NO: 174623 - DNA, 25 bp, Rattus norvegicus
atagtggtccatctctataatccta

SEQ ID NO: 174624 - DNA, 25 bp, Rattus norvegicus
atagtggtccatgtctataatccta

SEQ ID NO: 174625 - DNA, 25 bp, Rattus norvegicus
atagtggtcccacgtggacttgcct

SEQ ID NO: 174626 - DNA, 25 bp, Rattus norvegicus
atagtggtcccaggtggacttgcct

SEQ ID NO: 174627 - DNA, 25 bp, Rattus norvegicus
atagtggtctctacctcagtggcta

SEQ ID NO: 174628 - DNA, 25 bp, Rattus norvegicus
atagtggtctcttcctcagtggcta

SEQ ID NO: 174629 - DNA, 25 bp, Rattus norvegicus
atagtggtgaacactctggcattcg

SEQ ID NO: 174630 - DNA, 25 bp, Rattus norvegicus
atagtggtgaactctctggcattcg

SEQ ID NO: 174631 - DNA, 25 bp, Rattus norvegicus
atagtggtgcagattgtctcatccc

SEQ ID NO: 174632 - DNA, 25 bp, Rattus norvegicus
atagtggtgcagtttgtctcatccc

SEQ ID NO: 174633 - DNA, 25 bp, Rattus norvegicus
atagtgtcagggactcttactttac

SEQ ID NO: 174634 - DNA, 25 bp, Rattus norvegicus
atagtgtcagggtctcttactttac

SEQ ID NO: 174635 - DNA, 25 bp, Rattus norvegicus
atagtgtctactaggtttctctctc

SEQ ID NO: 174636 - DNA, 25 bp, Rattus norvegicus
atagtgtctacttggtttctctctc

SEQ ID NO: 174637 - DNA, 25 bp, Rattus norvegicus
atagtgtctcacatcctcgggttat

SEQ ID NO: 174638 - DNA, 25 bp, Rattus norvegicus
atagtgtctcacttcctcgggttat

SEQ ID NO: 174639 - DNA, 25 bp, Rattus norvegicus
atagtgtctcatctgtgtgtaggca

SEQ ID NO: 174640 - DNA, 25 bp, Rattus norvegicus
atagtgtctcatgtgtgtgtaggca

SEQ ID NO: 174641 - DNA, 25 bp, Rattus norvegicus
atagtgtctcggaggcagaatagcc

SEQ ID NO: 174642 - DNA, 25 bp, Rattus norvegicus
atagtgtctcggtggcagaatagcc

SEQ ID NO: 174643 - DNA, 25 bp, Rattus norvegicus
atagtgtctctcaggtctgtgtgtc

SEQ ID NO: 174644 - DNA, 25 bp, Rattus norvegicus
atagtgtctctctggtctgtgtgtc

SEQ ID NO: 174645 - DNA, 25 bp, Rattus norvegicus
atagtgtgagcccaatgtttcctgc

SEQ ID NO: 174646 - DNA, 25 bp, Rattus norvegicus
atagtgtgagccgaatgtttcctgc

SEQ ID NO: 174647 - DNA, 25 bp, Rattus norvegicus
atagtgtgccgcacagccgggctgc

SEQ ID NO: 174648 - DNA, 25 bp, Rattus norvegicus
atagtgtgccgctcagccgggctgc

SEQ ID NO: 174649 - DNA, 25 bp, Rattus norvegicus
atagtgtggatcagaactctcccca

SEQ ID NO: 174650 - DNA, 25 bp, Rattus norvegicus
atagtgtggatctgaactctcccca

SEQ ID NO: 174651 - DNA, 25 bp, Rattus norvegicus
atagtgtggctgctagagccctcaa

SEQ ID NO: 174652 - DNA, 25 bp, Rattus norvegicus
atagtgtggctggtagagccctcaa

SEQ ID NO: 174653 - DNA, 25 bp, Rattus norvegicus
atagtgtgggtgaccctgagctcca

SEQ ID NO: 174654 - DNA, 25 bp, Rattus norvegicus
atagtgtgggtgtccctgagctcca

SEQ ID NO: 174655 - DNA, 25 bp, Rattus norvegicus
atagtgtgtctaagggtacccagga

SEQ ID NO: 174656 - DNA, 25 bp, Rattus norvegicus
atagtgtgtctatgggtacccagga

SEQ ID NO: 174657 - DNA, 25 bp, Rattus norvegicus
atagtgtgtgggagacgcctgtcac

SEQ ID NO: 174658 - DNA, 25 bp, Rattus norvegicus
atagtgtgtgggtgacgcctgtcac

SEQ ID NO: 174659 - DNA, 25 bp, Rattus norvegicus
atagtgtgtgtacatctttcgatga

SEQ ID NO: 174660 - DNA, 25 bp, Rattus norvegicus
atagtgtgtgtagatctttcgatga

SEQ ID NO: 174661 - DNA, 25 bp, Rattus norvegicus
atagtgtgttcaactcagtgccgtg

SEQ ID NO: 174662 - DNA, 25 bp, Rattus norvegicus
atagtgtgttcatctcagtgccgtg

SEQ ID NO: 174663 - DNA, 25 bp, Rattus norvegicus
atagtgtgttggacattacaagtcc

SEQ ID NO: 174664 - DNA, 25 bp, Rattus norvegicus
atagtgtgttggtcattacaagtcc

SEQ ID NO: 174665 - DNA, 25 bp, Rattus norvegicus
atagtgttcctcatcactgtgcaaa

SEQ ID NO: 174666 - DNA, 25 bp, Rattus norvegicus
atagtgttcctcttcactgtgcaaa

SEQ ID NO: 174667 - DNA, 25 bp, Rattus norvegicus
atagtgttctagaaggctgccctta

SEQ ID NO: 174668 - DNA, 25 bp, Rattus norvegicus
atagtgttctagtaggctgccctta

SEQ ID NO: 174669 - DNA, 25 bp, Rattus norvegicus
atagtgttgaccacacgcaatggaa

SEQ ID NO: 174670 - DNA, 25 bp, Rattus norvegicus
atagtgttgacctcacgcaatggaa

SEQ ID NO: 174671 - DNA, 25 bp, Rattus norvegicus
atagtgttgccgctgaaggctactc

SEQ ID NO: 174672 - DNA, 25 bp, Rattus norvegicus
atagtgttgccggtgaaggctactc

SEQ ID NO: 174673 - DNA, 25 bp, Rattus norvegicus
atagtgttggacaagccttctccca

SEQ ID NO: 174674 - DNA, 25 bp, Rattus norvegicus
atagtgttggactagccttctccca

SEQ ID NO: 174675 - DNA, 25 bp, Rattus norvegicus
atagtgttggttctacattgtcagt

SEQ ID NO: 174676 - DNA, 25 bp, Rattus norvegicus
atagtgttggttgtacattgtcagt

SEQ ID NO: 174677 - DNA, 25 bp, Rattus norvegicus
atagtgtttcacaaagcttagatct

SEQ ID NO: 174678 - DNA, 25 bp, Rattus norvegicus
atagtgtttcactaagcttagatct

SEQ ID NO: 174679 - DNA, 25 bp, Rattus norvegicus
atagtgtttcagatctgtgtctaca

SEQ ID NO: 174680 - DNA, 25 bp, Rattus norvegicus
atagtgtttcagttctgtgtctaca

SEQ ID NO: 174681 - DNA, 25 bp, Rattus norvegicus
atagtgtttggactcttttcccctg

SEQ ID NO: 174682 - DNA, 25 bp, Rattus norvegicus
atagtgtttggagtcttttcccctg

SEQ ID NO: 174683 - DNA, 25 bp, Rattus norvegicus
atagtgtttgggatgttaatgcaga

SEQ ID NO: 174684 - DNA, 25 bp, Rattus norvegicus
atagtgtttgggttgttaatgcaga

SEQ ID NO: 174685 - DNA, 25 bp, Rattus norvegicus
atagtgtttgttactcgtggctgga

SEQ ID NO: 174686 - DNA, 25 bp, Rattus norvegicus
atagtgtttgtttctcgtggctgga

SEQ ID NO: 174687 - DNA, 25 bp, Rattus norvegicus
atagttaacggaccaacatcttatt

SEQ ID NO: 174688 - DNA, 25 bp, Rattus norvegicus
atagttaacggagcaacatcttatt

SEQ ID NO: 174689 - DNA, 25 bp, Rattus norvegicus
atagttaatcagatccggtgccagg

SEQ ID NO: 174690 - DNA, 25 bp, Rattus norvegicus
atagttaatcagttccggtgccagg

SEQ ID NO: 174691 - DNA, 25 bp, Rattus norvegicus
atagttacactcatctcttgtggcc

SEQ ID NO: 174692 - DNA, 25 bp, Rattus norvegicus
atagttacactcttctcttgtggcc

SEQ ID NO: 174693 - DNA, 25 bp, Rattus norvegicus
atagttacctatcaccatttgtgta

SEQ ID NO: 174694 - DNA, 25 bp, Rattus norvegicus
atagttacctatgaccatttgtgta

SEQ ID NO: 174695 - DNA, 25 bp, Rattus norvegicus
atagttagatacagccccagtctca

SEQ ID NO: 174696 - DNA, 25 bp, Rattus norvegicus
atagttagatactgccccagtctca

SEQ ID NO: 174697 - DNA, 25 bp, Rattus norvegicus
atagttagtgctcaacctcaggctg

SEQ ID NO: 174698 - DNA, 25 bp, Rattus norvegicus
atagttagtgctgaacctcaggctg

SEQ ID NO: 174699 - DNA, 25 bp, Rattus norvegicus
atagttatatatatttaccaggctg

SEQ ID NO: 174700 - DNA, 25 bp, Rattus norvegicus
atagttatatatttttaccaggctg

SEQ ID NO: 174701 - DNA, 25 bp, Rattus norvegicus
atagttatcaccacctgggtggtta

SEQ ID NO: 174702 - DNA, 25 bp, Rattus norvegicus
atagttatcacctcctgggtggtta

SEQ ID NO: 174703 - DNA, 25 bp, Rattus norvegicus
atagttcaattaccccacagtttct

SEQ ID NO: 174704 - DNA, 25 bp, Rattus norvegicus
atagttcaattagcccacagtttct

SEQ ID NO: 174705 - DNA, 25 bp, Rattus norvegicus
atagttcacaaaaggactctgggca

SEQ ID NO: 174706 - DNA, 25 bp, Rattus norvegicus
atagttcacaaatggactctgggca

SEQ ID NO: 174707 - DNA, 25 bp, Rattus norvegicus
atagttcacaatactgctctacctg

SEQ ID NO: 174708 - DNA, 25 bp, Rattus norvegicus
atagttcacaattctgctctacctg

SEQ ID NO: 174709 - DNA, 25 bp, Rattus norvegicus
atagttcacgacactgcgggtgtca

SEQ ID NO: 174710 - DNA, 25 bp, Rattus norvegicus
atagttcacgactctgcgggtgtca

SEQ ID NO: 174711 - DNA, 25 bp, Rattus norvegicus
atagttcagactccgatccccatta

SEQ ID NO: 174712 - DNA, 25 bp, Rattus norvegicus
atagttcagactgcgatccccatta

SEQ ID NO: 174713 - DNA, 25 bp, Rattus norvegicus
atagttcagttgaagagtccttgac

SEQ ID NO: 174714 - DNA, 25 bp, Rattus norvegicus
atagttcagttgtagagtccttgac

SEQ ID NO: 174715 - DNA, 25 bp, Rattus norvegicus
atagttcatcttcccacaggtatta

SEQ ID NO: 174716 - DNA, 25 bp, Rattus norvegicus
atagttcatcttgccacaggtatta

SEQ ID NO: 174717 - DNA, 25 bp, Rattus norvegicus
atagttcattgtccctgtctgtgcc

SEQ ID NO: 174718 - DNA, 25 bp, Rattus norvegicus
atagttcattgtgcctgtctgtgcc

SEQ ID NO: 174719 - DNA, 25 bp, Rattus norvegicus
atagttccaaacacgcagagcagag

SEQ ID NO: 174720 - DNA, 25 bp, Rattus norvegicus
atagttccaaactcgcagagcagag

SEQ ID NO: 174721 - DNA, 25 bp, Rattus norvegicus
atagttccaatgacagctgctgatt

SEQ ID NO: 174722 - DNA, 25 bp, Rattus norvegicus
atagttccaatgtcagctgctgatt

SEQ ID NO: 174723 - DNA, 25 bp, Rattus norvegicus
atagttcccagtatcctttgtctta

SEQ ID NO: 174724 - DNA, 25 bp, Rattus norvegicus
atagttcccagtttcctttgtctta

SEQ ID NO: 174725 - DNA, 25 bp, Rattus norvegicus
atagttcccctaagtttcatcttca

SEQ ID NO: 174726 - DNA, 25 bp, Rattus norvegicus
atagttcccctatgtttcatcttca

SEQ ID NO: 174727 - DNA, 25 bp, Rattus norvegicus
atagttcccgggacacttcgcagct

SEQ ID NO: 174728 - DNA, 25 bp, Rattus norvegicus
atagttcccgggtcacttcgcagct

SEQ ID NO: 174729 - DNA, 25 bp, Rattus norvegicus
atagttccctacagaggcacacagg

SEQ ID NO: 174730 - DNA, 25 bp, Rattus norvegicus
atagttccctactgaggcacacagg

SEQ ID NO: 174731 - DNA, 25 bp, Rattus norvegicus
atagttcctagaagtggtccaggga

SEQ ID NO: 174732 - DNA, 25 bp, Rattus norvegicus
atagttcctagatgtggtccaggga

SEQ ID NO: 174733 - DNA, 25 bp, Rattus norvegicus
atagttcctgtaattcgtactacaa

SEQ ID NO: 174734 - DNA, 25 bp, Rattus norvegicus
atagttcctgtatttcgtactacaa

SEQ ID NO: 174735 - DNA, 25 bp, Rattus norvegicus
atagttccttgtatatattttgcct

SEQ ID NO: 174736 - DNA, 25 bp, Rattus norvegicus
atagttccttgtttatattttgcct

SEQ ID NO: 174737 - DNA, 25 bp, Rattus norvegicus
atagttcgatagatgatttccgagg

SEQ ID NO: 174738 - DNA, 25 bp, Rattus norvegicus
atagttcgatagttgatttccgagg

SEQ ID NO: 174739 - DNA, 25 bp, Rattus norvegicus
atagttctacccaggtccatgagac

SEQ ID NO: 174740 - DNA, 25 bp, Rattus norvegicus
atagttctaccctggtccatgagac

SEQ ID NO: 174741 - DNA, 25 bp, Rattus norvegicus
atagttctcagaaccctgtctgtgg

SEQ ID NO: 174742 - DNA, 25 bp, Rattus norvegicus
atagttctcagatccctgtctgtgg

SEQ ID NO: 174743 - DNA, 25 bp, Rattus norvegicus
atagttctgagccagcaccatctac

SEQ ID NO: 174744 - DNA, 25 bp, Rattus norvegicus
atagttctgagcgagcaccatctac

SEQ ID NO: 174745 - DNA, 25 bp, Rattus norvegicus
atagttcttgtacatctttggctga

SEQ ID NO: 174746 - DNA, 25 bp, Rattus norvegicus
atagttcttgtagatctttggctga

SEQ ID NO: 174747 - DNA, 25 bp, Rattus norvegicus
atagttgacttcaccatggaacccg

SEQ ID NO: 174748 - DNA, 25 bp, Rattus norvegicus
atagttgacttctccatggaacccg

SEQ ID NO: 174749 - DNA, 25 bp, Rattus norvegicus
atagttgacttgcttccatattgga

SEQ ID NO: 174750 - DNA, 25 bp, Rattus norvegicus
atagttgacttggttccatattgga

SEQ ID NO: 174751 - DNA, 25 bp, Rattus norvegicus
atagttgagacaacggctttggccc

SEQ ID NO: 174752 - DNA, 25 bp, Rattus norvegicus
atagttgagacatcggctttggccc

SEQ ID NO: 174753 - DNA, 25 bp, Rattus norvegicus
atagttgagcccagctttgagccag

SEQ ID NO: 174754 - DNA, 25 bp, Rattus norvegicus
atagttgagccctgctttgagccag

SEQ ID NO: 174755 - DNA, 25 bp, Rattus norvegicus
atagttgagtctctttcctttgccc

SEQ ID NO: 174756 - DNA, 25 bp, Rattus norvegicus
atagttgagtctgtttcctttgccc

SEQ ID NO: 174757 - DNA, 25 bp, Rattus norvegicus
atagttgatgacatggtcctgcgaa

SEQ ID NO: 174758 - DNA, 25 bp, Rattus norvegicus
atagttgatgacttggtcctgcgaa

SEQ ID NO: 174759 - DNA, 25 bp, Rattus norvegicus
atagttgctagtctggctggtcaca

SEQ ID NO: 174760 - DNA, 25 bp, Rattus norvegicus
atagttgctagtgtggctggtcaca

SEQ ID NO: 174761 - DNA, 25 bp, Rattus norvegicus
atagttgctctgctgcagtcagtca

SEQ ID NO: 174762 - DNA, 25 bp, Rattus norvegicus
atagttgctctggtgcagtcagtca

SEQ ID NO: 174763 - DNA, 25 bp, Rattus norvegicus
atagttgctggtctagattcggttt

SEQ ID NO: 174764 - DNA, 25 bp, Rattus norvegicus
atagttgctggtgtagattcggttt

SEQ ID NO: 174765 - DNA, 25 bp, Rattus norvegicus
atagttggcaggacacagcctgtgt

SEQ ID NO: 174766 - DNA, 25 bp, Rattus norvegicus
atagttggcaggtcacagcctgtgt

SEQ ID NO: 174767 - DNA, 25 bp, Rattus norvegicus
atagttgtcacaatcttgtcattga

SEQ ID NO: 174768 - DNA, 25 bp, Rattus norvegicus
atagttgtcacattcttgtcattga

SEQ ID NO: 174769 - DNA, 25 bp, Rattus norvegicus
atagttgtctagatctccacacaga

SEQ ID NO: 174770 - DNA, 25 bp, Rattus norvegicus
atagttgtctagttctccacacaga

SEQ ID NO: 174771 - DNA, 25 bp, Rattus norvegicus
atagttgtgtctagccttcagctgt

SEQ ID NO: 174772 - DNA, 25 bp, Rattus norvegicus
atagttgtgtcttgccttcagctgt

SEQ ID NO: 174773 - DNA, 25 bp, Rattus norvegicus
atagttgtgtgcagctaggtccttc

SEQ ID NO: 174774 - DNA, 25 bp, Rattus norvegicus
atagttgtgtgctgctaggtccttc

SEQ ID NO: 174775 - DNA, 25 bp, Rattus norvegicus
atagttgttcccaggtgactctctt

SEQ ID NO: 174776 - DNA, 25 bp, Rattus norvegicus
atagttgttccctggtgactctctt

SEQ ID NO: 174777 - DNA, 25 bp, Rattus norvegicus
atagtttaatctcttttgttgttgt

SEQ ID NO: 174778 - DNA, 25 bp, Rattus norvegicus
atagtttaatctgttttgttgttgt

SEQ ID NO: 174779 - DNA, 25 bp, Rattus norvegicus
atagtttaccaaccagtagcacctc

SEQ ID NO: 174780 - DNA, 25 bp, Rattus norvegicus
atagtttaccaagcagtagcacctc

SEQ ID NO: 174781 - DNA, 25 bp, Rattus norvegicus
atagtttcagacagagcctccacag

SEQ ID NO: 174782 - DNA, 25 bp, Rattus norvegicus
atagtttcagactgagcctccacag

SEQ ID NO: 174783 - DNA, 25 bp, Rattus norvegicus
atagtttctcccaggctaaccatgt

SEQ ID NO: 174784 - DNA, 25 bp, Rattus norvegicus
atagtttctccctggctaaccatgt

SEQ ID NO: 174785 - DNA, 25 bp, Rattus norvegicus
atagtttctcctattgcccttagaa

SEQ ID NO: 174786 - DNA, 25 bp, Rattus norvegicus
atagtttctccttttgcccttagaa

SEQ ID NO: 174787 - DNA, 25 bp, Rattus norvegicus
atagtttctcgacttggcctttaca

SEQ ID NO: 174788 - DNA, 25 bp, Rattus norvegicus
atagtttctcgagttggcctttaca

SEQ ID NO: 174789 - DNA, 25 bp, Rattus norvegicus
atagtttcttccacaccagaagtga

SEQ ID NO: 174790 - DNA, 25 bp, Rattus norvegicus
atagtttcttccactccaggagtct

SEQ ID NO: 174791 - DNA, 25 bp, Rattus norvegicus
atagtttcttcctcaccagaagtga

SEQ ID NO: 174792 - DNA, 25 bp, Rattus norvegicus
atagtttcttcctctccaggagtct

SEQ ID NO: 174793 - DNA, 25 bp, Rattus norvegicus
atagtttgtatcagtcaacagacag

SEQ ID NO: 174794 - DNA, 25 bp, Rattus norvegicus
atagtttgtatctgtcaacagacag

SEQ ID NO: 174795 - DNA, 25 bp, Rattus norvegicus
atagttttaaacctatgctcctggg

SEQ ID NO: 174796 - DNA, 25 bp, Rattus norvegicus
atagttttaaacgtatgctcctggg

SEQ ID NO: 174797 - DNA, 25 bp, Rattus norvegicus
atagttttcaccaatcacagatcag

SEQ ID NO: 174798 - DNA, 25 bp, Rattus norvegicus
atagttttcacctatcacagatcag

SEQ ID NO: 174799 - DNA, 25 bp, Rattus norvegicus
atagttttccctacaggtcagaatt

SEQ ID NO: 174800 - DNA, 25 bp, Rattus norvegicus
atagttttcccttcaggtcagaatt

SEQ ID NO: 174801 - DNA, 25 bp, Rattus norvegicus
atagttttcctcatgcttttttcat

SEQ ID NO: 174802 - DNA, 25 bp, Rattus norvegicus
atagttttcctcttgcttttttcat

SEQ ID NO: 174803 - DNA, 25 bp, Rattus norvegicus
atagttttctagctcactgcttgcc

SEQ ID NO: 174804 - DNA, 25 bp, Rattus norvegicus
atagttttctaggtcactgcttgcc

SEQ ID NO: 174805 - DNA, 25 bp, Rattus norvegicus
atagttttgcaactgctgcgacaaa

SEQ ID NO: 174806 - DNA, 25 bp, Rattus norvegicus
atagttttgcaagtgctgcgacaaa

SEQ ID NO: 174807 - DNA, 25 bp, Rattus norvegicus
atagttttgctactagtgtccaata

SEQ ID NO: 174808 - DNA, 25 bp, Rattus norvegicus
atagttttgctagtagtgtccaata

SEQ ID NO: 174809 - DNA, 25 bp, Rattus norvegicus
atataaaaaccactatttgcttggc

SEQ ID NO: 174810 - DNA, 25 bp, Rattus norvegicus
atataaaaaccagtatttgcttggc

SEQ ID NO: 174811 - DNA, 25 bp, Rattus norvegicus
atataaaactatagtcactgccaca

SEQ ID NO: 174812 - DNA, 25 bp, Rattus norvegicus
atataaaactattgtcactgccaca

SEQ ID NO: 174813 - DNA, 25 bp, Rattus norvegicus
atataaaagctacacgcccataccc

SEQ ID NO: 174814 - DNA, 25 bp, Rattus norvegicus
atataaaagctagacgcccataccc

SEQ ID NO: 174815 - DNA, 25 bp, Rattus norvegicus
atataaaattttctggcggcctcta

SEQ ID NO: 174816 - DNA, 25 bp, Rattus norvegicus
atataaaattttgtggcggcctcta

SEQ ID NO: 174817 - DNA, 25 bp, Rattus norvegicus
atataaacacacatgtagcttggct

SEQ ID NO: 174818 - DNA, 25 bp, Rattus norvegicus
atataaacacacttgtagcttggct

SEQ ID NO: 174819 - DNA, 25 bp, Rattus norvegicus
atataaacccagcagatgaccccaa

SEQ ID NO: 174820 - DNA, 25 bp, Rattus norvegicus
atataaacccaggagatgaccccaa

SEQ ID NO: 174821 - DNA, 25 bp, Rattus norvegicus
atataaaccgctaggccgaccgagt

SEQ ID NO: 174822 - DNA, 25 bp, Rattus norvegicus
atataaaccgcttggccgaccgagt

SEQ ID NO: 174823 - DNA, 25 bp, Rattus norvegicus
atataaactgccatctcattctttc

SEQ ID NO: 174824 - DNA, 25 bp, Rattus norvegicus
atataaactgccttctcattctttc

SEQ ID NO: 174825 - DNA, 25 bp, Rattus norvegicus
atataaagcccgagtggctctctgt

SEQ ID NO: 174826 - DNA, 25 bp, Rattus norvegicus
atataaagcccgtgtggctctctgt

SEQ ID NO: 174827 - DNA, 25 bp, Rattus norvegicus
atataaagctacaccctgttgctgt

SEQ ID NO: 174828 - DNA, 25 bp, Rattus norvegicus
atataaagctactccctgttgctgt

SEQ ID NO: 174829 - DNA, 25 bp, Rattus norvegicus
atataaatatccataagcctggtgg

SEQ ID NO: 174830 - DNA, 25 bp, Rattus norvegicus
atataaatatccttaagcctggtgg

SEQ ID NO: 174831 - DNA, 25 bp, Rattus norvegicus
atataaatccacaagcagcctgatc

SEQ ID NO: 174832 - DNA, 25 bp, Rattus norvegicus
atataaatccactagcagcctgatc

SEQ ID NO: 174833 - DNA, 25 bp, Rattus norvegicus
atataaattctcaggatcacctttg

SEQ ID NO: 174834 - DNA, 25 bp, Rattus norvegicus
atataaattctctggatcacctttg

SEQ ID NO: 174835 - DNA, 25 bp, Rattus norvegicus
atataacatgctatccatatcaggg

SEQ ID NO: 174836 - DNA, 25 bp, Rattus norvegicus
atataacatgctttccatatcaggg

SEQ ID NO: 174837 - DNA, 25 bp, Rattus norvegicus
atataacccaagacgttcctgtgca

SEQ ID NO: 174838 - DNA, 25 bp, Rattus norvegicus
atataacccaagtcgttcctgtgca

SEQ ID NO: 174839 - DNA, 25 bp, Rattus norvegicus
atataacctatcaaagccagcctca

SEQ ID NO: 174840 - DNA, 25 bp, Rattus norvegicus
atataacctatctaagccagcctca

SEQ ID NO: 174841 - DNA, 25 bp, Rattus norvegicus
atataacctggcagactggatctgc

SEQ ID NO: 174842 - DNA, 25 bp, Rattus norvegicus
atataacctggctgactggatctgc

SEQ ID NO: 174843 - DNA, 25 bp, Rattus norvegicus
atataacgacgtagttgttgtgaac

SEQ ID NO: 174844 - DNA, 25 bp, Rattus norvegicus
atataacgacgttgttgttgtgaac

SEQ ID NO: 174845 - DNA, 25 bp, Rattus norvegicus
atataactctctcatatgccaggta

SEQ ID NO: 174846 - DNA, 25 bp, Rattus norvegicus
atataactctctgatatgccaggta

SEQ ID NO: 174847 - DNA, 25 bp, Rattus norvegicus
atataactgctgaaggaaccgatta

SEQ ID NO: 174848 - DNA, 25 bp, Rattus norvegicus
atataactgctgtaggaaccgatta

SEQ ID NO: 174849 - DNA, 25 bp, Rattus norvegicus
atataagaaataaggccaggacaag

SEQ ID NO: 174850 - DNA, 25 bp, Rattus norvegicus
atataagaaatatggccaggacaag

SEQ ID NO: 174851 - DNA, 25 bp, Rattus norvegicus
atataagagggcctggaccgcgcta

SEQ ID NO: 174852 - DNA, 25 bp, Rattus norvegicus
atataagagggcgtggaccgcgcta

SEQ ID NO: 174853 - DNA, 25 bp, Rattus norvegicus
atataagcaactatcacttcagaaa

SEQ ID NO: 174854 - DNA, 25 bp, Rattus norvegicus
atataagcaactttcacttcagaaa

SEQ ID NO: 174855 - DNA, 25 bp, Rattus norvegicus
atataagccaggagccagggctcag

SEQ ID NO: 174856 - DNA, 25 bp, Rattus norvegicus
atataagccaggtgccagggctcag

SEQ ID NO: 174857 - DNA, 25 bp, Rattus norvegicus
atataagcgtcacttcttcccatgg

SEQ ID NO: 174858 - DNA, 25 bp, Rattus norvegicus
atataagcgtcagttcttcccatgg

SEQ ID NO: 174859 - DNA, 25 bp, Rattus norvegicus
atataagcttccatctctatacccc

SEQ ID NO: 174860 - DNA, 25 bp, Rattus norvegicus
atataagcttccttctctatacccc

SEQ ID NO: 174861 - DNA, 25 bp, Rattus norvegicus
atataaggcctgctgacctcagtta

SEQ ID NO: 174862 - DNA, 25 bp, Rattus norvegicus
atataaggcctggtgacctcagtta

SEQ ID NO: 174863 - DNA, 25 bp, Rattus norvegicus
atataagggcttatagggtacagat

SEQ ID NO: 174864 - DNA, 25 bp, Rattus norvegicus
atataagggcttttagggtacagat

SEQ ID NO: 174865 - DNA, 25 bp, Rattus norvegicus
atataagtccacaagacggtagcta

SEQ ID NO: 174866 - DNA, 25 bp, Rattus norvegicus
atataagtccactagacggtagcta

SEQ ID NO: 174867 - DNA, 25 bp, Rattus norvegicus
atataagtctccctccatggtgcat

SEQ ID NO: 174868 - DNA, 25 bp, Rattus norvegicus
atataagtctccgtccatggtgcat

SEQ ID NO: 174869 - DNA, 25 bp, Rattus norvegicus
atataagtgagtcccttgctgttca

SEQ ID NO: 174870 - DNA, 25 bp, Rattus norvegicus
atataagtgagtgccttgctgttca

SEQ ID NO: 174871 - DNA, 25 bp, Rattus norvegicus
atataagtgtgtctgcgcgttcgcg

SEQ ID NO: 174872 - DNA, 25 bp, Rattus norvegicus
atataagtgtgtgtgcgcgttcgcg

SEQ ID NO: 174873 - DNA, 25 bp, Rattus norvegicus
atataataaatcactcctctcacat

SEQ ID NO: 174874 - DNA, 25 bp, Rattus norvegicus
atataataaatctctcctctcacat

SEQ ID NO: 174875 - DNA, 25 bp, Rattus norvegicus
atataatactgcctggcctctgctg

SEQ ID NO: 174876 - DNA, 25 bp, Rattus norvegicus
atataatactgcgtggcctctgctg

SEQ ID NO: 174877 - DNA, 25 bp, Rattus norvegicus
atataatagcctaggtgagctttaa

SEQ ID NO: 174878 - DNA, 25 bp, Rattus norvegicus
atataatagccttggtgagctttaa

SEQ ID NO: 174879 - DNA, 25 bp, Rattus norvegicus
atataatcactacactgtccacctg

SEQ ID NO: 174880 - DNA, 25 bp, Rattus norvegicus
atataatcactagactgtccacctg

SEQ ID NO: 174881 - DNA, 25 bp, Rattus norvegicus
atataatctcctcacaattctgaag

SEQ ID NO: 174882 - DNA, 25 bp, Rattus norvegicus
atataatctcctgacaattctgaag

SEQ ID NO: 174883 - DNA, 25 bp, Rattus norvegicus
atataattacccactcctttacaag

SEQ ID NO: 174884 - DNA, 25 bp, Rattus norvegicus
atataattaccctctcctttacaag

SEQ ID NO: 174885 - DNA, 25 bp, Rattus norvegicus
atataattctggctttttatccaaa

SEQ ID NO: 174886 - DNA, 25 bp, Rattus norvegicus
atataattctgggtttttatccaaa

SEQ ID NO: 174887 - DNA, 25 bp, Rattus norvegicus
atataattgcatactgttccttcac

SEQ ID NO: 174888 - DNA, 25 bp, Rattus norvegicus
atataattgcattctgttccttcac

SEQ ID NO: 174889 - DNA, 25 bp, Rattus norvegicus
atatacaacgccctgaaactcttca

SEQ ID NO: 174890 - DNA, 25 bp, Rattus norvegicus
atatacaacgccgtgaaactcttca

SEQ ID NO: 174891 - DNA, 25 bp, Rattus norvegicus
atatacaattcgctgatctccatga

SEQ ID NO: 174892 - DNA, 25 bp, Rattus norvegicus
atatacaattcggtgatctccatga

SEQ ID NO: 174893 - DNA, 25 bp, Rattus norvegicus
atatacagtgcaccttgctgctagt

SEQ ID NO: 174894 - DNA, 25 bp, Rattus norvegicus
atatacagtgcagcttgctgctagt

SEQ ID NO: 174895 - DNA, 25 bp, Rattus norvegicus
atatacagtgcgaccctgtcttgaa

SEQ ID NO: 174896 - DNA, 25 bp, Rattus norvegicus
atatacagtgcgtccctgtcttgaa

SEQ ID NO: 174897 - DNA, 25 bp, Rattus norvegicus
atatacatatgtctcctttccacta

SEQ ID NO: 174898 - DNA, 25 bp, Rattus norvegicus
atatacatatgtgtcctttccacta

SEQ ID NO: 174899 - DNA, 25 bp, Rattus norvegicus
atatacatcatcactgtcatccggg

SEQ ID NO: 174900 - DNA, 25 bp, Rattus norvegicus
atatacatcatctctgtcatccggg

SEQ ID NO: 174901 - DNA, 25 bp, Rattus norvegicus
atatacatccctcaagacccttttt

SEQ ID NO: 174902 - DNA, 25 bp, Rattus norvegicus
atatacatccctgaagacccttttt

SEQ ID NO: 174903 - DNA, 25 bp, Rattus norvegicus
atatacatgcttatcctgtgcttgg

SEQ ID NO: 174904 - DNA, 25 bp, Rattus norvegicus
atatacatgcttttcctgtgcttgg

SEQ ID NO: 174905 - DNA, 25 bp, Rattus norvegicus
atatacattagtaagtggcgttgaa

SEQ ID NO: 174906 - DNA, 25 bp, Rattus norvegicus
atatacattagttagtggcgttgaa

SEQ ID NO: 174907 - DNA, 25 bp, Rattus norvegicus
atatacattggtctgttgtctgaat

SEQ ID NO: 174908 - DNA, 25 bp, Rattus norvegicus
atatacattggtgtgttgtctgaat

SEQ ID NO: 174909 - DNA, 25 bp, Rattus norvegicus
atataccatggcaatctcctggctg

SEQ ID NO: 174910 - DNA, 25 bp, Rattus norvegicus
atataccatggctatctcctggctg

SEQ ID NO: 174911 - DNA, 25 bp, Rattus norvegicus
atatacccaaatacgctcagctaac

SEQ ID NO: 174912 - DNA, 25 bp, Rattus norvegicus
atatacccaaattcgctcagctaac

SEQ ID NO: 174913 - DNA, 25 bp, Rattus norvegicus
atatacccaatgatagcttgtgctt

SEQ ID NO: 174914 - DNA, 25 bp, Rattus norvegicus
atatacccaatgttagcttgtgctt

SEQ ID NO: 174915 - DNA, 25 bp, Rattus norvegicus
atatacccagacattgtgcgactcc

SEQ ID NO: 174916 - DNA, 25 bp, Rattus norvegicus
atatacccagactttgtgcgactcc

SEQ ID NO: 174917 - DNA, 25 bp, Rattus norvegicus
atatacccagatcccagctgcagga

SEQ ID NO: 174918 - DNA, 25 bp, Rattus norvegicus
atatacccagatgccagctgcagga

SEQ ID NO: 174919 - DNA, 25 bp, Rattus norvegicus
atataccccaaccagacctgaggtt

SEQ ID NO: 174920 - DNA, 25 bp, Rattus norvegicus
atataccccaacgagacctgaggtt

SEQ ID NO: 174921 - DNA, 25 bp, Rattus norvegicus
atataccccgttctgcctgtagcat

SEQ ID NO: 174922 - DNA, 25 bp, Rattus norvegicus
atataccccgttgtgcctgtagcat

SEQ ID NO: 174923 - DNA, 25 bp, Rattus norvegicus
atatacccgatgcacaggtctctgg

SEQ ID NO: 174924 - DNA, 25 bp, Rattus norvegicus
atatacccgatggacaggtctctgg

SEQ ID NO: 174925 - DNA, 25 bp, Rattus norvegicus
atataccgctacatttaagaggcaa

SEQ ID NO: 174926 - DNA, 25 bp, Rattus norvegicus
atataccgctacttttaagaggcaa

SEQ ID NO: 174927 - DNA, 25 bp, Rattus norvegicus
atataccgctatatcctattttacg

SEQ ID NO: 174928 - DNA, 25 bp, Rattus norvegicus
atataccgctatttcctattttacg

SEQ ID NO: 174929 - DNA, 25 bp, Rattus norvegicus
atatacctaagaatccgtccttttg

SEQ ID NO: 174930 - DNA, 25 bp, Rattus norvegicus
atatacctaagattccgtccttttg

SEQ ID NO: 174931 - DNA, 25 bp, Rattus norvegicus
atatacctatggctgctattgctca

SEQ ID NO: 174932 - DNA, 25 bp, Rattus norvegicus
atatacctatgggtgctattgctca

SEQ ID NO: 174933 - DNA, 25 bp, Rattus norvegicus
atatacctatttacattgtcaccaa

SEQ ID NO: 174934 - DNA, 25 bp, Rattus norvegicus
atatacctattttcattgtcaccaa

SEQ ID NO: 174935 - DNA, 25 bp, Rattus norvegicus
atatacctcattctgacacctgtgt

SEQ ID NO: 174936 - DNA, 25 bp, Rattus norvegicus
atatacctcattgtgacacctgtgt

SEQ ID NO: 174937 - DNA, 25 bp, Rattus norvegicus
atatacctccatacctgggagtata

SEQ ID NO: 174938 - DNA, 25 bp, Rattus norvegicus
atatacctccattcctgggagtata

SEQ ID NO: 174939 - DNA, 25 bp, Rattus norvegicus
atatacctcctgaagagctctaacc

SEQ ID NO: 174940 - DNA, 25 bp, Rattus norvegicus
atatacctcctgtagagctctaacc

SEQ ID NO: 174941 - DNA, 25 bp, Rattus norvegicus
atatacctctagaatgccacatgtt

SEQ ID NO: 174942 - DNA, 25 bp, Rattus norvegicus
atatacctctagtatgccacatgtt

SEQ ID NO: 174943 - DNA, 25 bp, Rattus norvegicus
atatacctgcatatctggagccttc

SEQ ID NO: 174944 - DNA, 25 bp, Rattus norvegicus
atatacctgcatttctggagccttc

SEQ ID NO: 174945 - DNA, 25 bp, Rattus norvegicus
atatacctgtggctgtgggtcccag

SEQ ID NO: 174946 - DNA, 25 bp, Rattus norvegicus
atatacctgtgggtgtgggtcccag

SEQ ID NO: 174947 - DNA, 25 bp, Rattus norvegicus
atataccttacccactgaggcacac

SEQ ID NO: 174948 - DNA, 25 bp, Rattus norvegicus
atataccttaccgactgaggcacac

SEQ ID NO: 174949 - DNA, 25 bp, Rattus norvegicus
atatacctttgcattcagtgagatc

SEQ ID NO: 174950 - DNA, 25 bp, Rattus norvegicus
atatacctttgctttcagtgagatc

SEQ ID NO: 174951 - DNA, 25 bp, Rattus norvegicus
atatacgaacagatagccccttcct

SEQ ID NO: 174952 - DNA, 25 bp, Rattus norvegicus
atatacgaacagttagccccttcct

SEQ ID NO: 174953 - DNA, 25 bp, Rattus norvegicus
atatacgaacggcataccttctcca

SEQ ID NO: 174954 - DNA, 25 bp, Rattus norvegicus
atatacgaacgggataccttctcca

SEQ ID NO: 174955 - DNA, 25 bp, Rattus norvegicus
atatacgcacatccattcaatgttg

SEQ ID NO: 174956 - DNA, 25 bp, Rattus norvegicus
atatacgcacatgcattcaatgttg

SEQ ID NO: 174957 - DNA, 25 bp, Rattus norvegicus
atatacgccatcatttcctattcac

SEQ ID NO: 174958 - DNA, 25 bp, Rattus norvegicus
atatacgccatcttttcctattcac

SEQ ID NO: 174959 - DNA, 25 bp, Rattus norvegicus
atatacgtgtttctcttggctctca

SEQ ID NO: 174960 - DNA, 25 bp, Rattus norvegicus
atatacgtgtttgtcttggctctca

SEQ ID NO: 174961 - DNA, 25 bp, Rattus norvegicus
atatacgttttcaggtcttaccctg

SEQ ID NO: 174962 - DNA, 25 bp, Rattus norvegicus
atatacgttttctggtcttaccctg

SEQ ID NO: 174963 - DNA, 25 bp, Rattus norvegicus
atatactatgtgcagtgttccaagt

SEQ ID NO: 174964 - DNA, 25 bp, Rattus norvegicus
atatactatgtggagtgttccaagt

SEQ ID NO: 174965 - DNA, 25 bp, Rattus norvegicus
atatactcttatctccaacccagtc

SEQ ID NO: 174966 - DNA, 25 bp, Rattus norvegicus
atatactcttatgtccaacccagtc

SEQ ID NO: 174967 - DNA, 25 bp, Rattus norvegicus
atatactcttttactctgtaggtcg

SEQ ID NO: 174968 - DNA, 25 bp, Rattus norvegicus
atatactctttttctctgtaggtcg

SEQ ID NO: 174969 - DNA, 25 bp, Rattus norvegicus
atatactgactacttgccttccaga

SEQ ID NO: 174970 - DNA, 25 bp, Rattus norvegicus
atatactgactagttgccttccaga

SEQ ID NO: 174971 - DNA, 25 bp, Rattus norvegicus
atatactgccgtatggaagctggaa

SEQ ID NO: 174972 - DNA, 25 bp, Rattus norvegicus
atatactgccgtttggaagctggaa

SEQ ID NO: 174973 - DNA, 25 bp, Rattus norvegicus
atatactgggacactgtgtctaagg

SEQ ID NO: 174974 - DNA, 25 bp, Rattus norvegicus
atatactgggactctgtgtctaagg

SEQ ID NO: 174975 - DNA, 25 bp, Rattus norvegicus
atatactgggcccttttacctgctc

SEQ ID NO: 174976 - DNA, 25 bp, Rattus norvegicus
atatactgggccgttttacctgctc

SEQ ID NO: 174977 - DNA, 25 bp, Rattus norvegicus
atatactgtgccatatttatgctgc

SEQ ID NO: 174978 - DNA, 25 bp, Rattus norvegicus
atatactgtgccttatttatgctgc

SEQ ID NO: 174979 - DNA, 25 bp, Rattus norvegicus
atatacttcccacatgatgcggtca

SEQ ID NO: 174980 - DNA, 25 bp, Rattus norvegicus
atatacttcccagatgatgcggtca

SEQ ID NO: 174981 - DNA, 25 bp, Rattus norvegicus
atatacttcccgacatctctagatt

SEQ ID NO: 174982 - DNA, 25 bp, Rattus norvegicus
atatacttcccgtcatctctagatt

SEQ ID NO: 174983 - DNA, 25 bp, Rattus norvegicus
atatacttgtcgcaggtctgggcct

SEQ ID NO: 174984 - DNA, 25 bp, Rattus norvegicus
atatacttgtcggaggtctgggcct

SEQ ID NO: 174985 - DNA, 25 bp, Rattus norvegicus
atatactttgtaatggtgcctttaa

SEQ ID NO: 174986 - DNA, 25 bp, Rattus norvegicus
atatactttgtattggtgcctttaa

SEQ ID NO: 174987 - DNA, 25 bp, Rattus norvegicus
atatacttttagaccttgaagctca

SEQ ID NO: 174988 - DNA, 25 bp, Rattus norvegicus
atatacttttagtccttgaagctca

SEQ ID NO: 174989 - DNA, 25 bp, Rattus norvegicus
atatagaaatgcattgtgtgcctgc

SEQ ID NO: 174990 - DNA, 25 bp, Rattus norvegicus
atatagaaatgctttgtgtgcctgc

SEQ ID NO: 174991 - DNA, 25 bp, Rattus norvegicus
atatagaactcacatcctccttcac

SEQ ID NO: 174992 - DNA, 25 bp, Rattus norvegicus
atatagaactcagatcctccttcac

SEQ ID NO: 174993 - DNA, 25 bp, Rattus norvegicus
atatagaagcagctccctagttccc

SEQ ID NO: 174994 - DNA, 25 bp, Rattus norvegicus
atatagaagcaggtccctagttccc

SEQ ID NO: 174995 - DNA, 25 bp, Rattus norvegicus
atatagaagttcctgtcggtccttg

SEQ ID NO: 174996 - DNA, 25 bp, Rattus norvegicus
atatagaagttcgtgtcggtccttg

SEQ ID NO: 174997 - DNA, 25 bp, Rattus norvegicus
atatagacaaaacccattacccatg

SEQ ID NO: 174998 - DNA, 25 bp, Rattus norvegicus
atatagacaaaagccattacccatg

SEQ ID NO: 174999 - DNA, 25 bp, Rattus norvegicus
atatagacacacagggtagggttga

SEQ ID NO: 175000 - DNA, 25 bp, Rattus norvegicus
atatagacacactgggtagggttga

SEQ ID NO: 175001 - DNA, 25 bp, Rattus norvegicus
atatagaccccgagtgccgaatgtt

SEQ ID NO: 175002 - DNA, 25 bp, Rattus norvegicus
atatagaccccgtgtgccgaatgtt

SEQ ID NO: 175003 - DNA, 25 bp, Rattus norvegicus
atatagactatcacaccactcattc

SEQ ID NO: 175004 - DNA, 25 bp, Rattus norvegicus
atatagactatctcaccactcattc

SEQ ID NO: 175005 - DNA, 25 bp, Rattus norvegicus
atatagactgacctggcttcaaaag

SEQ ID NO: 175006 - DNA, 25 bp, Rattus norvegicus
atatagactgacgtggcttcaaaag

SEQ ID NO: 175007 - DNA, 25 bp, Rattus norvegicus
atatagacttatccaacccaaccag

SEQ ID NO: 175008 - DNA, 25 bp, Rattus norvegicus
atatagacttatgcaacccaaccag

SEQ ID NO: 175009 - DNA, 25 bp, Rattus norvegicus
atatagagagctcacccggcaatct

SEQ ID NO: 175010 - DNA, 25 bp, Rattus norvegicus
atatagagagctgacccggcaatct

SEQ ID NO: 175011 - DNA, 25 bp, Rattus norvegicus
atatagagtactctgctgtgtgcag

SEQ ID NO: 175012 - DNA, 25 bp, Rattus norvegicus
atatagagtactgtgctgtgtgcag

SEQ ID NO: 175013 - DNA, 25 bp, Rattus norvegicus
atatagatccatcagggttgagcct

SEQ ID NO: 175014 - DNA, 25 bp, Rattus norvegicus
atatagatccatgagggttgagcct

SEQ ID NO: 175015 - DNA, 25 bp, Rattus norvegicus
atatagatccttaagtgactcacca

SEQ ID NO: 175016 - DNA, 25 bp, Rattus norvegicus
atatagatcctttagtgactcacca

SEQ ID NO: 175017 - DNA, 25 bp, Rattus norvegicus
atatagattctccacttcctttttt

SEQ ID NO: 175018 - DNA, 25 bp, Rattus norvegicus
atatagattctcgacttcctttttt

SEQ ID NO: 175019 - DNA, 25 bp, Rattus norvegicus
atatagcacatgcaaggctctgggt

SEQ ID NO: 175020 - DNA, 25 bp, Rattus norvegicus
atatagcacatggaaggctctgggt

SEQ ID NO: 175021 - DNA, 25 bp, Rattus norvegicus
atatagcacggcattatcaccacgc

SEQ ID NO: 175022 - DNA, 25 bp, Rattus norvegicus
atatagcacggctttatcaccacgc

SEQ ID NO: 175023 - DNA, 25 bp, Rattus norvegicus
atatagcatactacaatctcacaaa

SEQ ID NO: 175024 - DNA, 25 bp, Rattus norvegicus
atatagcatacttcaatctcacaaa

SEQ ID NO: 175025 - DNA, 25 bp, Rattus norvegicus
atatagcatctcactggaaaaccat

SEQ ID NO: 175026 - DNA, 25 bp, Rattus norvegicus
atatagcatctctctggaaaaccat

SEQ ID NO: 175027 - DNA, 25 bp, Rattus norvegicus
atatagcatgtcacatcagtacttg

SEQ ID NO: 175028 - DNA, 25 bp, Rattus norvegicus
atatagcatgtctcatcagtacttg

SEQ ID NO: 175029 - DNA, 25 bp, Rattus norvegicus
atatagccccgacgaatgctgctga

SEQ ID NO: 175030 - DNA, 25 bp, Rattus norvegicus
atatagccccgaggaatgctgctga

SEQ ID NO: 175031 - DNA, 25 bp, Rattus norvegicus
atatagcccgtgacctttaaatcag

SEQ ID NO: 175032 - DNA, 25 bp, Rattus norvegicus
atatagcccgtgtcctttaaatcag

SEQ ID NO: 175033 - DNA, 25 bp, Rattus norvegicus
atatagcctaccattgtatttctta

SEQ ID NO: 175034 - DNA, 25 bp, Rattus norvegicus
atatagcctacctttgtatttctta

SEQ ID NO: 175035 - DNA, 25 bp, Rattus norvegicus
atatagcctgaaccctgctgtggat

SEQ ID NO: 175036 - DNA, 25 bp, Rattus norvegicus
atatagcctgaagcctgctgtggat

SEQ ID NO: 175037 - DNA, 25 bp, Rattus norvegicus
atatagcctgctacatgggatccct

SEQ ID NO: 175038 - DNA, 25 bp, Rattus norvegicus
atatagcctgcttcatgggatccct

SEQ ID NO: 175039 - DNA, 25 bp, Rattus norvegicus
atatagcctgtgcatcttagttaga

SEQ ID NO: 175040 - DNA, 25 bp, Rattus norvegicus
atatagcctgtggatcttagttaga

SEQ ID NO: 175041 - DNA, 25 bp, Rattus norvegicus
atatagccttccctggagcacatag

SEQ ID NO: 175042 - DNA, 25 bp, Rattus norvegicus
atatagccttccgtggagcacatag

SEQ ID NO: 175043 - DNA, 25 bp, Rattus norvegicus
atatagcgtccaagtatctttctct

SEQ ID NO: 175044 - DNA, 25 bp, Rattus norvegicus
atatagcgtccatgtatctttctct

SEQ ID NO: 175045 - DNA, 25 bp, Rattus norvegicus
atatagctacataccacccttgtat

SEQ ID NO: 175046 - DNA, 25 bp, Rattus norvegicus
atatagctacattccacccttgtat

SEQ ID NO: 175047 - DNA, 25 bp, Rattus norvegicus
atatagctcagacagtggagtgcat

SEQ ID NO: 175048 - DNA, 25 bp, Rattus norvegicus
atatagctcagagagtggagtgcat

SEQ ID NO: 175049 - DNA, 25 bp, Rattus norvegicus
atatagctcagcacttcctggaaat

SEQ ID NO: 175050 - DNA, 25 bp, Rattus norvegicus
atatagctcagctcttcctggaaat

SEQ ID NO: 175051 - DNA, 25 bp, Rattus norvegicus
atatagctctcacaaacagggcctc

SEQ ID NO: 175052 - DNA, 25 bp, Rattus norvegicus
atatagctctcagaaacagggcctc

SEQ ID NO: 175053 - DNA, 25 bp, Rattus norvegicus
atatagctgataattggtctcctta

SEQ ID NO: 175054 - DNA, 25 bp, Rattus norvegicus
atatagctgatatttggtctcctta

SEQ ID NO: 175055 - DNA, 25 bp, Rattus norvegicus
atatagctgggaactactgtggcca

SEQ ID NO: 175056 - DNA, 25 bp, Rattus norvegicus
atatagctgggatctactgtggcca

SEQ ID NO: 175057 - DNA, 25 bp, Rattus norvegicus
atatagcttttcactgcagcacgat

SEQ ID NO: 175058 - DNA, 25 bp, Rattus norvegicus
atatagcttttctctgcagcacgat

SEQ ID NO: 175059 - DNA, 25 bp, Rattus norvegicus
atataggaacgacggcccctccaat

SEQ ID NO: 175060 - DNA, 25 bp, Rattus norvegicus
atataggaacgagggcccctccaat

SEQ ID NO: 175061 - DNA, 25 bp, Rattus norvegicus
atataggactctctacgacactggg

SEQ ID NO: 175062 - DNA, 25 bp, Rattus norvegicus
atataggactctgtacgacactggg

SEQ ID NO: 175063 - DNA, 25 bp, Rattus norvegicus
atataggctatgatcactgttcaaa

SEQ ID NO: 175064 - DNA, 25 bp, Rattus norvegicus
atataggctatgttcactgttcaaa

SEQ ID NO: 175065 - DNA, 25 bp, Rattus norvegicus
atataggtcacaatcaagggcctgt

SEQ ID NO: 175066 - DNA, 25 bp, Rattus norvegicus
atataggtcacattcaagggcctgt

SEQ ID NO: 175067 - DNA, 25 bp, Rattus norvegicus
atataggtctccatggcacgaggtg

SEQ ID NO: 175068 - DNA, 25 bp, Rattus norvegicus
atataggtctccttggcacgaggtg

SEQ ID NO: 175069 - DNA, 25 bp, Rattus norvegicus
atataggtctgtcttctttgtctcc

SEQ ID NO: 175070 - DNA, 25 bp, Rattus norvegicus
atataggtctgtgttctttgtctcc

SEQ ID NO: 175071 - DNA, 25 bp, Rattus norvegicus
atataggttcacagctgtacttaaa

SEQ ID NO: 175072 - DNA, 25 bp, Rattus norvegicus
atataggttcactgctgtacttaaa

SEQ ID NO: 175073 - DNA, 25 bp, Rattus norvegicus
atataggttcttagcccggacagct

SEQ ID NO: 175074 - DNA, 25 bp, Rattus norvegicus
atataggttctttgcccggacagct

SEQ ID NO: 175075 - DNA, 25 bp, Rattus norvegicus
atataggtttacctgagacagtctc

SEQ ID NO: 175076 - DNA, 25 bp, Rattus norvegicus
atataggtttacgtgagacagtctc

SEQ ID NO: 175077 - DNA, 25 bp, Rattus norvegicus
atatagtcagaaccctgcttttccc

SEQ ID NO: 175078 - DNA, 25 bp, Rattus norvegicus
atatagtcagaagcctgcttttccc

SEQ ID NO: 175079 - DNA, 25 bp, Rattus norvegicus
atatagtccactctctcttgggcag

SEQ ID NO: 175080 - DNA, 25 bp, Rattus norvegicus
atatagtccactgtctcttgggcag

SEQ ID NO: 175081 - DNA, 25 bp, Rattus norvegicus
atatagtccataagcagccaggccc

SEQ ID NO: 175082 - DNA, 25 bp, Rattus norvegicus
atatagtccatatgcagccaggccc

SEQ ID NO: 175083 - DNA, 25 bp, Rattus norvegicus
atatagtccctcagtattggccaat

SEQ ID NO: 175084 - DNA, 25 bp, Rattus norvegicus
atatagtccctctgtattggccaat

SEQ ID NO: 175085 - DNA, 25 bp, Rattus norvegicus
atatagtctaaacaccagggttcct

SEQ ID NO: 175086 - DNA, 25 bp, Rattus norvegicus
atatagtctaaagaccagggttcct

SEQ ID NO: 175087 - DNA, 25 bp, Rattus norvegicus
atatagtgctacaattcggccgcgt

SEQ ID NO: 175088 - DNA, 25 bp, Rattus norvegicus
atatagtgctactattcggccgcgt

SEQ ID NO: 175089 - DNA, 25 bp, Rattus norvegicus
atatagtggcctatcaggactgtca

SEQ ID NO: 175090 - DNA, 25 bp, Rattus norvegicus
atatagtggcctttcaggactgtca

SEQ ID NO: 175091 - DNA, 25 bp, Rattus norvegicus
atatagtggtgtcggcctactttcc

SEQ ID NO: 175092 - DNA, 25 bp, Rattus norvegicus
atatagtggtgtgggcctactttcc

SEQ ID NO: 175093 - DNA, 25 bp, Rattus norvegicus
atatagtgtcctagagtctcgcaga

SEQ ID NO: 175094 - DNA, 25 bp, Rattus norvegicus
atatagtgtccttgagtctcgcaga

SEQ ID NO: 175095 - DNA, 25 bp, Rattus norvegicus
atatagtgtcttctgtgcggcggcc

SEQ ID NO: 175096 - DNA, 25 bp, Rattus norvegicus
atatagtgtcttgtgtgcggcggcc

SEQ ID NO: 175097 - DNA, 25 bp, Rattus norvegicus
atatagtgtgatcccagcacccagc

SEQ ID NO: 175098 - DNA, 25 bp, Rattus norvegicus
atatagtgtgatgccagcacccagc

SEQ ID NO: 175099 - DNA, 25 bp, Rattus norvegicus
atatagttagttctcttccctcttc

SEQ ID NO: 175100 - DNA, 25 bp, Rattus norvegicus
atatagttagttgtcttccctcttc

SEQ ID NO: 175101 - DNA, 25 bp, Rattus norvegicus
atatagttgctcattttctgtccct

SEQ ID NO: 175102 - DNA, 25 bp, Rattus norvegicus
atatagttgctctttttctgtccct

SEQ ID NO: 175103 - DNA, 25 bp, Rattus norvegicus
atatagttgttaactctcttctttg

SEQ ID NO: 175104 - DNA, 25 bp, Rattus norvegicus
atatagttgttatctctcttctttg

SEQ ID NO: 175105 - DNA, 25 bp, Rattus norvegicus
atatagttgttccacattcccttcc

SEQ ID NO: 175106 - DNA, 25 bp, Rattus norvegicus
atatagttgttcgacattcccttcc

SEQ ID NO: 175107 - DNA, 25 bp, Rattus norvegicus
atatataactggagggctcttccca

SEQ ID NO: 175108 - DNA, 25 bp, Rattus norvegicus
atatataactggtgggctcttccca

SEQ ID NO: 175109 - DNA, 25 bp, Rattus norvegicus
atatataagtgcctctgtgttgtga

SEQ ID NO: 175110 - DNA, 25 bp, Rattus norvegicus
atatataagtgcgtctgtgttgtga

SEQ ID NO: 175111 - DNA, 25 bp, Rattus norvegicus
atatataatctgatcctgtcgtgta

SEQ ID NO: 175112 - DNA, 25 bp, Rattus norvegicus
atatataatctgttcctgtcgtgta

SEQ ID NO: 175113 - DNA, 25 bp, Rattus norvegicus
atatataccagcctttaccaacatc

SEQ ID NO: 175114 - DNA, 25 bp, Rattus norvegicus
atatataccagcgtttaccaacatc

SEQ ID NO: 175115 - DNA, 25 bp, Rattus norvegicus
atatatacccaacatgggcatcttt

SEQ ID NO: 175116 - DNA, 25 bp, Rattus norvegicus
atatatacccaagatgggcatcttt

SEQ ID NO: 175117 - DNA, 25 bp, Rattus norvegicus
atatataccccaagcctgccttaaa

SEQ ID NO: 175118 - DNA, 25 bp, Rattus norvegicus
atatataccccatgcctgccttaaa

SEQ ID NO: 175119 - DNA, 25 bp, Rattus norvegicus
atatataccgtgagggctgcgcgcg

SEQ ID NO: 175120 - DNA, 25 bp, Rattus norvegicus
atatataccgtgtgggctgcgcgcg

SEQ ID NO: 175121 - DNA, 25 bp, Rattus norvegicus
atatatactctaccttcatgactta

SEQ ID NO: 175122 - DNA, 25 bp, Rattus norvegicus
atatatactctagcttcatgactta

SEQ ID NO: 175123 - DNA, 25 bp, Rattus norvegicus
atatatactgatatacctttgtggg

SEQ ID NO: 175124 - DNA, 25 bp, Rattus norvegicus
atatatactgatttacctttgtggg

SEQ ID NO: 175125 - DNA, 25 bp, Rattus norvegicus
atatatagagtcctcctgctttcca

SEQ ID NO: 175126 - DNA, 25 bp, Rattus norvegicus
atatatagagtcgtcctgctttcca

SEQ ID NO: 175127 - DNA, 25 bp, Rattus norvegicus
atatatagccgactcctgggcgtgt

SEQ ID NO: 175128 - DNA, 25 bp, Rattus norvegicus
atatatagccgagtcctgggcgtgt

SEQ ID NO: 175129 - DNA, 25 bp, Rattus norvegicus
atatatagccttccatgatgctgga

SEQ ID NO: 175130 - DNA, 25 bp, Rattus norvegicus
atatatagccttgcatgatgctgga

SEQ ID NO: 175131 - DNA, 25 bp, Rattus norvegicus
atatatagtgtaacccagaccagct

SEQ ID NO: 175132 - DNA, 25 bp, Rattus norvegicus
atatatagtgtatcccagaccagct

SEQ ID NO: 175133 - DNA, 25 bp, Rattus norvegicus
atatatataaaaccgcctggccaag

SEQ ID NO: 175134 - DNA, 25 bp, Rattus norvegicus
atatatataaaagcgcctggccaag

SEQ ID NO: 175135 - DNA, 25 bp, Rattus norvegicus
atatatatacctcctcatcacggcc

SEQ ID NO: 175136 - DNA, 25 bp, Rattus norvegicus
atatatatacctgctcatcacggcc

SEQ ID NO: 175137 - DNA, 25 bp, Rattus norvegicus
atatatatagcccttgactcaccct

SEQ ID NO: 175138 - DNA, 25 bp, Rattus norvegicus
atatatatagccgttgactcaccct

SEQ ID NO: 175139 - DNA, 25 bp, Rattus norvegicus
atatatatataaaagcgcctggcca

SEQ ID NO: 175140 - DNA, 25 bp, Rattus norvegicus
atatatatataatagcgcctggcca

SEQ ID NO: 175141 - DNA, 25 bp, Rattus norvegicus
atatatattcctataggtgtgggct

SEQ ID NO: 175142 - DNA, 25 bp, Rattus norvegicus
atatatattcctttaggtgtgggct

SEQ ID NO: 175143 - DNA, 25 bp, Rattus norvegicus
atatatattcttagctcttggtgag

SEQ ID NO: 175144 - DNA, 25 bp, Rattus norvegicus
atatatattctttgctcttggtgag

SEQ ID NO: 175145 - DNA, 25 bp, Rattus norvegicus
atatatattttgactgtcgtgttta

SEQ ID NO: 175146 - DNA, 25 bp, Rattus norvegicus
atatatattttgtctgtcgtgttta

SEQ ID NO: 175147 - DNA, 25 bp, Rattus norvegicus
atatatcacctaccattgatgtctt

SEQ ID NO: 175148 - DNA, 25 bp, Rattus norvegicus
atatatcacctagcattgatgtctt

SEQ ID NO: 175149 - DNA, 25 bp, Rattus norvegicus
atatatcagagaacaacactaaggg

SEQ ID NO: 175150 - DNA, 25 bp, Rattus norvegicus
atatatcagagatcaacactaaggg

SEQ ID NO: 175151 - DNA, 25 bp, Rattus norvegicus
atatatcatcccactgagttacctc

SEQ ID NO: 175152 - DNA, 25 bp, Rattus norvegicus
atatatcatccctctgagttacctc

SEQ ID NO: 175153 - DNA, 25 bp, Rattus norvegicus
atatatccaaccaacgtccggcatg

SEQ ID NO: 175154 - DNA, 25 bp, Rattus norvegicus
atatatccaacctacgtccggcatg

SEQ ID NO: 175155 - DNA, 25 bp, Rattus norvegicus
atatatccaactctgattgttccga

SEQ ID NO: 175156 - DNA, 25 bp, Rattus norvegicus
atatatccaactgtgattgttccga

SEQ ID NO: 175157 - DNA, 25 bp, Rattus norvegicus
atatatccacctatttaaaattgtc

SEQ ID NO: 175158 - DNA, 25 bp, Rattus norvegicus
atatatccacctttttaaaattgtc

SEQ ID NO: 175159 - DNA, 25 bp, Rattus norvegicus
atatatccatccagaagtccctttt

SEQ ID NO: 175160 - DNA, 25 bp, Rattus norvegicus
atatatccatcctgaagtccctttt

SEQ ID NO: 175161 - DNA, 25 bp, Rattus norvegicus
atatatcccatgctttgactccagt

SEQ ID NO: 175162 - DNA, 25 bp, Rattus norvegicus
atatatcccatggtttgactccagt

SEQ ID NO: 175163 - DNA, 25 bp, Rattus norvegicus
atatatcctgtccatgggtatctaa

SEQ ID NO: 175164 - DNA, 25 bp, Rattus norvegicus
atatatcctgtcgatgggtatctaa

SEQ ID NO: 175165 - DNA, 25 bp, Rattus norvegicus
atatatcgagccatcccaggttttg

SEQ ID NO: 175166 - DNA, 25 bp, Rattus norvegicus
atatatcgagccttcccaggttttg

SEQ ID NO: 175167 - DNA, 25 bp, Rattus norvegicus
atatatcgagctatgtgtccaatgc

SEQ ID NO: 175168 - DNA, 25 bp, Rattus norvegicus
atatatcgagctttgtgtccaatgc

SEQ ID NO: 175169 - DNA, 25 bp, Rattus norvegicus
atatatcgcagcctgttacagtcct

SEQ ID NO: 175170 - DNA, 25 bp, Rattus norvegicus
atatatcgcagcgtgttacagtcct

SEQ ID NO: 175171 - DNA, 25 bp, Rattus norvegicus
atatatctacacctgagcctggaat

SEQ ID NO: 175172 - DNA, 25 bp, Rattus norvegicus
atatatctacacgtgagcctggaat

SEQ ID NO: 175173 - DNA, 25 bp, Rattus norvegicus
atatatctatctaaaccatgggtgc

SEQ ID NO: 175174 - DNA, 25 bp, Rattus norvegicus
atatatctatcttaaccatgggtgc

SEQ ID NO: 175175 - DNA, 25 bp, Rattus norvegicus
atatatctcaccacaattctacagc

SEQ ID NO: 175176 - DNA, 25 bp, Rattus norvegicus
atatatctcacctcaattctacagc

SEQ ID NO: 175177 - DNA, 25 bp, Rattus norvegicus
atatatctgacgataagatacccaa

SEQ ID NO: 175178 - DNA, 25 bp, Rattus norvegicus
atatatctgacgttaagatacccaa

SEQ ID NO: 175179 - DNA, 25 bp, Rattus norvegicus
atatatctgttcagcagtacagcat

SEQ ID NO: 175180 - DNA, 25 bp, Rattus norvegicus
atatatctgttctgcagtacagcat

SEQ ID NO: 175181 - DNA, 25 bp, Rattus norvegicus
atatatctttggaattcctcccctg

SEQ ID NO: 175182 - DNA, 25 bp, Rattus norvegicus
atatatctttggtattcctcccctg

SEQ ID NO: 175183 - DNA, 25 bp, Rattus norvegicus
atatatgagcctcctcaaacgttcc

SEQ ID NO: 175184 - DNA, 25 bp, Rattus norvegicus
atatatgagcctgctcaaacgttcc

SEQ ID NO: 175185 - DNA, 25 bp, Rattus norvegicus
atatatgatcacacacgaccccact

SEQ ID NO: 175186 - DNA, 25 bp, Rattus norvegicus
atatatgatcactcacgaccccact

SEQ ID NO: 175187 - DNA, 25 bp, Rattus norvegicus
atatatgcacagacacaccctgcgg

SEQ ID NO: 175188 - DNA, 25 bp, Rattus norvegicus
atatatgcacagtcacaccctgcgg

SEQ ID NO: 175189 - DNA, 25 bp, Rattus norvegicus
atatatgcatggacgtgcacgccac

SEQ ID NO: 175190 - DNA, 25 bp, Rattus norvegicus
atatatgcatggtcgtgcacgccac

SEQ ID NO: 175191 - DNA, 25 bp, Rattus norvegicus
atatatgctggaaggcccatgccca

SEQ ID NO: 175192 - DNA, 25 bp, Rattus norvegicus
atatatgctggatggcccatgccca

SEQ ID NO: 175193 - DNA, 25 bp, Rattus norvegicus
atatatgcttgtatccttgcacctg

SEQ ID NO: 175194 - DNA, 25 bp, Rattus norvegicus
atatatgcttgtttccttgcacctg

SEQ ID NO: 175195 - DNA, 25 bp, Rattus norvegicus
atatatggaagaccccaagccacac

SEQ ID NO: 175196 - DNA, 25 bp, Rattus norvegicus
atatatggaagagcccaagccacac

SEQ ID NO: 175197 - DNA, 25 bp, Rattus norvegicus
atatatggaccgaagtctggacatc

SEQ ID NO: 175198 - DNA, 25 bp, Rattus norvegicus
atatatggaccgtagtctggacatc

SEQ ID NO: 175199 - DNA, 25 bp, Rattus norvegicus
atatatggcatcagctttggttacc

SEQ ID NO: 175200 - DNA, 25 bp, Rattus norvegicus
atatatggcatctgctttggttacc

SEQ ID NO: 175201 - DNA, 25 bp, Rattus norvegicus
atatatgtaaaacacctgccctggg

SEQ ID NO: 175202 - DNA, 25 bp, Rattus norvegicus
atatatgtaaaagacctgccctggg

SEQ ID NO: 175203 - DNA, 25 bp, Rattus norvegicus
atatatgtactcagctgaacccggt

SEQ ID NO: 175204 - DNA, 25 bp, Rattus norvegicus
atatatgtactctgctgaacccggt

SEQ ID NO: 175205 - DNA, 25 bp, Rattus norvegicus
atatatgtagtcagtatctgagttc

SEQ ID NO: 175206 - DNA, 25 bp, Rattus norvegicus
atatatgtagtctgtatctgagttc

SEQ ID NO: 175207 - DNA, 25 bp, Rattus norvegicus
atatatgtcaccaaagctttccact

SEQ ID NO: 175208 - DNA, 25 bp, Rattus norvegicus
atatatgtcacctaagctttccact

SEQ ID NO: 175209 - DNA, 25 bp, Rattus norvegicus
atatatgtctgtctaaaggtgttag

SEQ ID NO: 175210 - DNA, 25 bp, Rattus norvegicus
atatatgtctgtgtaaaggtgttag

SEQ ID NO: 175211 - DNA, 25 bp, Rattus norvegicus
atatatgtgcctagtgctctgttgg

SEQ ID NO: 175212 - DNA, 25 bp, Rattus norvegicus
atatatgtgccttgtgctctgttgg

SEQ ID NO: 175213 - DNA, 25 bp, Rattus norvegicus
atatatgtgcttaacatgtcaaagg

SEQ ID NO: 175214 - DNA, 25 bp, Rattus norvegicus
atatatgtgctttacatgtcaaagg

SEQ ID NO: 175215 - DNA, 25 bp, Rattus norvegicus
atatatgtgggcagtgtcgttccag

SEQ ID NO: 175216 - DNA, 25 bp, Rattus norvegicus
atatatgtgggcctgtctcgagttt

SEQ ID NO: 175217 - DNA, 25 bp, Rattus norvegicus
atatatgtgggcgtgtctcgagttt

SEQ ID NO: 175218 - DNA, 25 bp, Rattus norvegicus
atatatgtgggctgtgtcgttccag

SEQ ID NO: 175219 - DNA, 25 bp, Rattus norvegicus
atatatgttcttagtcctgcttctt

SEQ ID NO: 175220 - DNA, 25 bp, Rattus norvegicus
atatatgttctttgtcctgcttctt

SEQ ID NO: 175221 - DNA, 25 bp, Rattus norvegicus
atatatgttgctatctctcctagtg

SEQ ID NO: 175222 - DNA, 25 bp, Rattus norvegicus
atatatgttgctctcttaggaaaag

SEQ ID NO: 175223 - DNA, 25 bp, Rattus norvegicus
atatatgttgctgtcttaggaaaag

SEQ ID NO: 175224 - DNA, 25 bp, Rattus norvegicus
atatatgttgctttctctcctagtg

SEQ ID NO: 175225 - DNA, 25 bp, Rattus norvegicus
atatattagaatacatcctggcaag

SEQ ID NO: 175226 - DNA, 25 bp, Rattus norvegicus
atatattagaattcatcctggcaag

SEQ ID NO: 175227 - DNA, 25 bp, Rattus norvegicus
atatattcatgtctgagggtcttca

SEQ ID NO: 175228 - DNA, 25 bp, Rattus norvegicus
atatattcatgtgtgagggtcttca

SEQ ID NO: 175229 - DNA, 25 bp, Rattus norvegicus
atatattccaaaacagccagaccag

SEQ ID NO: 175230 - DNA, 25 bp, Rattus norvegicus
atatattccaaatcagccagaccag

SEQ ID NO: 175231 - DNA, 25 bp, Rattus norvegicus
atatattcctccatctcctgaatga

SEQ ID NO: 175232 - DNA, 25 bp, Rattus norvegicus
atatattcctccttctcctgaatga

SEQ ID NO: 175233 - DNA, 25 bp, Rattus norvegicus
atatattcctcgatacttttcccag

SEQ ID NO: 175234 - DNA, 25 bp, Rattus norvegicus
atatattcctcgttacttttcccag

SEQ ID NO: 175235 - DNA, 25 bp, Rattus norvegicus
atatattcctggatgtagtctcccc

SEQ ID NO: 175236 - DNA, 25 bp, Rattus norvegicus
atatattcctggttgtagtctcccc

SEQ ID NO: 175237 - DNA, 25 bp, Rattus norvegicus
atatattctgtaactggagtccgtt

SEQ ID NO: 175238 - DNA, 25 bp, Rattus norvegicus
atatattctgtatctggagtccgtt

SEQ ID NO: 175239 - DNA, 25 bp, Rattus norvegicus
atatattcttctcttctcacatgta

SEQ ID NO: 175240 - DNA, 25 bp, Rattus norvegicus
atatattcttctgttctcacatgta

SEQ ID NO: 175241 - DNA, 25 bp, Rattus norvegicus
atatattgggtcctctactccgttt

SEQ ID NO: 175242 - DNA, 25 bp, Rattus norvegicus
atatattgggtcgtctactccgttt

SEQ ID NO: 175243 - DNA, 25 bp, Rattus norvegicus
atatattggttacgcggtgccgatt

SEQ ID NO: 175244 - DNA, 25 bp, Rattus norvegicus
atatattggttaggcggtgccgatt

SEQ ID NO: 175245 - DNA, 25 bp, Rattus norvegicus
atatattgttctccatgctacctct

SEQ ID NO: 175246 - DNA, 25 bp, Rattus norvegicus
atatattgttctgcatgctacctct

SEQ ID NO: 175247 - DNA, 25 bp, Rattus norvegicus
atatattgtttaagcctctccctct

SEQ ID NO: 175248 - DNA, 25 bp, Rattus norvegicus
atatattgtttatgcctctccctct

SEQ ID NO: 175249 - DNA, 25 bp, Rattus norvegicus
atatattgtttcaacgacacggtat

SEQ ID NO: 175250 - DNA, 25 bp, Rattus norvegicus
atatattgtttctacgacacggtat

SEQ ID NO: 175251 - DNA, 25 bp, Rattus norvegicus
atatatttagacagcctttaggatt

SEQ ID NO: 175252 - DNA, 25 bp, Rattus norvegicus
atatatttagactgcctttaggatt

SEQ ID NO: 175253 - DNA, 25 bp, Rattus norvegicus
atatatttatctaaagccatgtctt

SEQ ID NO: 175254 - DNA, 25 bp, Rattus norvegicus
atatatttatcttaagccatgtctt

SEQ ID NO: 175255 - DNA, 25 bp, Rattus norvegicus
atatatttcaccaacctgcttagca

SEQ ID NO: 175256 - DNA, 25 bp, Rattus norvegicus
atatatttcacctacctgcttagca

SEQ ID NO: 175257 - DNA, 25 bp, Rattus norvegicus
atatatttctttactctgacccatc

SEQ ID NO: 175258 - DNA, 25 bp, Rattus norvegicus
atatatttcttttctctgacccatc

SEQ ID NO: 175259 - DNA, 25 bp, Rattus norvegicus
atatattttcctctcttttgcaaga

SEQ ID NO: 175260 - DNA, 25 bp, Rattus norvegicus
atatattttcctgtcttttgcaaga

SEQ ID NO: 175261 - DNA, 25 bp, Rattus norvegicus
atatatttttgtagagattctcccc

SEQ ID NO: 175262 - DNA, 25 bp, Rattus norvegicus
atatatttttgttgagattctcccc

SEQ ID NO: 175263 - DNA, 25 bp, Rattus norvegicus
atatcaaacaacctccaacaccaag

SEQ ID NO: 175264 - DNA, 25 bp, Rattus norvegicus
atatcaaacaacgtccaacaccaag

SEQ ID NO: 175265 - DNA, 25 bp, Rattus norvegicus
atatcaaacacaatggatcccacga

SEQ ID NO: 175266 - DNA, 25 bp, Rattus norvegicus
atatcaaacacattggatcccacga

SEQ ID NO: 175267 - DNA, 25 bp, Rattus norvegicus
atatcaaacagcagaccaccttttc

SEQ ID NO: 175268 - DNA, 25 bp, Rattus norvegicus
atatcaaacagctgaccaccttttc

SEQ ID NO: 175269 - DNA, 25 bp, Rattus norvegicus
atatcaaagtgcacagtttgctgta

SEQ ID NO: 175270 - DNA, 25 bp, Rattus norvegicus
atatcaaagtgctcagtttgctgta

SEQ ID NO: 175271 - DNA, 25 bp, Rattus norvegicus
atatcaaatcctccaactcgtgtta

SEQ ID NO: 175272 - DNA, 25 bp, Rattus norvegicus
atatcaaatcctgcaactcgtgtta

SEQ ID NO: 175273 - DNA, 25 bp, Rattus norvegicus
atatcaaatttaaggctgtatgcta

SEQ ID NO: 175274 - DNA, 25 bp, Rattus norvegicus
atatcaaatttatggctgtatgcta

SEQ ID NO: 175275 - DNA, 25 bp, Rattus norvegicus
atatcaacacatacctcagacacaa

SEQ ID NO: 175276 - DNA, 25 bp, Rattus norvegicus
atatcaacacattcctcagacacaa

SEQ ID NO: 175277 - DNA, 25 bp, Rattus norvegicus
atatcaaccccaaaactctgtcatt

SEQ ID NO: 175278 - DNA, 25 bp, Rattus norvegicus
atatcaaccccataactctgtcatt

SEQ ID NO: 175279 - DNA, 25 bp, Rattus norvegicus
atatcaacctaaacataacatggag

SEQ ID NO: 175280 - DNA, 25 bp, Rattus norvegicus
atatcaacctaatcataacatggag

SEQ ID NO: 175281 - DNA, 25 bp, Rattus norvegicus
atatcaacgacaacaggagtgacct

SEQ ID NO: 175282 - DNA, 25 bp, Rattus norvegicus
atatcaacgacatcaggagtgacct

SEQ ID NO: 175283 - DNA, 25 bp, Rattus norvegicus
atatcaacggctctcatttggcagg

SEQ ID NO: 175284 - DNA, 25 bp, Rattus norvegicus
atatcaacggctgtcatttggcagg

SEQ ID NO: 175285 - DNA, 25 bp, Rattus norvegicus
atatcaactgtcaccgtgacttaga

SEQ ID NO: 175286 - DNA, 25 bp, Rattus norvegicus
atatcaactgtctccgtgacttaga

SEQ ID NO: 175287 - DNA, 25 bp, Rattus norvegicus
atatcaacttgacccctttgtcttt

SEQ ID NO: 175288 - DNA, 25 bp, Rattus norvegicus
atatcaacttgagccctttgtcttt

SEQ ID NO: 175289 - DNA, 25 bp, Rattus norvegicus
atatcaagccccaacttgtctgaga

SEQ ID NO: 175290 - DNA, 25 bp, Rattus norvegicus
atatcaagcccctacttgtctgaga

SEQ ID NO: 175291 - DNA, 25 bp, Rattus norvegicus
atatcaaggcagagaccccacaggg

SEQ ID NO: 175292 - DNA, 25 bp, Rattus norvegicus
atatcaaggcagtgaccccacaggg

SEQ ID NO: 175293 - DNA, 25 bp, Rattus norvegicus
atatcaaggcatattctgtcctcag

SEQ ID NO: 175294 - DNA, 25 bp, Rattus norvegicus
atatcaaggcattttctgtcctcag

SEQ ID NO: 175295 - DNA, 25 bp, Rattus norvegicus
atatcaagtcatctctcaaagtcct

SEQ ID NO: 175296 - DNA, 25 bp, Rattus norvegicus
atatcaagtcatgtctcaaagtcct

SEQ ID NO: 175297 - DNA, 25 bp, Rattus norvegicus
atatcaagtccaccacttcagaggt

SEQ ID NO: 175298 - DNA, 25 bp, Rattus norvegicus
atatcaagtccagcacttcagaggt

SEQ ID NO: 175299 - DNA, 25 bp, Rattus norvegicus
atatcaagtcctcactcatttcctt

SEQ ID NO: 175300 - DNA, 25 bp, Rattus norvegicus
atatcaagtcctgactcatttcctt

SEQ ID NO: 175301 - DNA, 25 bp, Rattus norvegicus
atatcaattagtcccctgcatgcct

SEQ ID NO: 175302 - DNA, 25 bp, Rattus norvegicus
atatcaattagtgccctgcatgcct

SEQ ID NO: 175303 - DNA, 25 bp, Rattus norvegicus
atatcaattatgaagccaggcctgg

SEQ ID NO: 175304 - DNA, 25 bp, Rattus norvegicus
atatcaattatgtagccaggcctgg

SEQ ID NO: 175305 - DNA, 25 bp, Rattus norvegicus
atatcaattggcactgaattcattg

SEQ ID NO: 175306 - DNA, 25 bp, Rattus norvegicus
atatcaattggctctgaattcattg

SEQ ID NO: 175307 - DNA, 25 bp, Rattus norvegicus
atatcaatttccctggacccagtgt

SEQ ID NO: 175308 - DNA, 25 bp, Rattus norvegicus
atatcaatttccgtggacccagtgt

SEQ ID NO: 175309 - DNA, 25 bp, Rattus norvegicus
atatcacaaggcagatctcatcttt

SEQ ID NO: 175310 - DNA, 25 bp, Rattus norvegicus
atatcacaaggctgatctcatcttt

SEQ ID NO: 175311 - DNA, 25 bp, Rattus norvegicus
atatcacaccgtctgagtatatgga

SEQ ID NO: 175312 - DNA, 25 bp, Rattus norvegicus
atatcacaccgtgtgagtatatgga

SEQ ID NO: 175313 - DNA, 25 bp, Rattus norvegicus
atatcacaggctatgacggccaaat

SEQ ID NO: 175314 - DNA, 25 bp, Rattus norvegicus
atatcacaggctttgacggccaaat

SEQ ID NO: 175315 - DNA, 25 bp, Rattus norvegicus
atatcacaggttagatcccggtggt

SEQ ID NO: 175316 - DNA, 25 bp, Rattus norvegicus
atatcacaggtttgatcccggtggt

SEQ ID NO: 175317 - DNA, 25 bp, Rattus norvegicus
atatcacagtgtatctcttctcaac

SEQ ID NO: 175318 - DNA, 25 bp, Rattus norvegicus
atatcacagtgtttctcttctcaac

SEQ ID NO: 175319 - DNA, 25 bp, Rattus norvegicus
atatcacatacccaataggcaccac

SEQ ID NO: 175320 - DNA, 25 bp, Rattus norvegicus
atatcacataccgaataggcaccac

SEQ ID NO: 175321 - DNA, 25 bp, Rattus norvegicus
atatcaccaacaacatcaacagctc

SEQ ID NO: 175322 - DNA, 25 bp, Rattus norvegicus
atatcaccaacatcatcaacagctc

SEQ ID NO: 175323 - DNA, 25 bp, Rattus norvegicus
atatcaccatatatcattctcccag

SEQ ID NO: 175324 - DNA, 25 bp, Rattus norvegicus
atatcaccatatttcattctcccag

SEQ ID NO: 175325 - DNA, 25 bp, Rattus norvegicus
atatcacccttcattcgtgtttggt

SEQ ID NO: 175326 - DNA, 25 bp, Rattus norvegicus
atatcacccttctttcgtgtttggt

SEQ ID NO: 175327 - DNA, 25 bp, Rattus norvegicus
atatcaccgaagctcacaccatgta

SEQ ID NO: 175328 - DNA, 25 bp, Rattus norvegicus
atatcaccgaaggtcacaccatgta

SEQ ID NO: 175329 - DNA, 25 bp, Rattus norvegicus
atatcacctcttcggttcgagtatt

SEQ ID NO: 175330 - DNA, 25 bp, Rattus norvegicus
atatcacctcttgggttcgagtatt

SEQ ID NO: 175331 - DNA, 25 bp, Rattus norvegicus
atatcacctttcatgaggacctcaa

SEQ ID NO: 175332 - DNA, 25 bp, Rattus norvegicus
atatcacctttcttgaggacctcaa

SEQ ID NO: 175333 - DNA, 25 bp, Rattus norvegicus
atatcacgagagcatgtgccctctg

SEQ ID NO: 175334 - DNA, 25 bp, Rattus norvegicus
atatcacgagaggatgtgccctctg

SEQ ID NO: 175335 - DNA, 25 bp, Rattus norvegicus
atatcacggtgaactgcccctggga

SEQ ID NO: 175336 - DNA, 25 bp, Rattus norvegicus
atatcacggtgatctgcccctggga

SEQ ID NO: 175337 - DNA, 25 bp, Rattus norvegicus
atatcacgtatgaccaacttcccat

SEQ ID NO: 175338 - DNA, 25 bp, Rattus norvegicus
atatcacgtatgtccaacttcccat

SEQ ID NO: 175339 - DNA, 25 bp, Rattus norvegicus
atatcacgtgaaatcctggcccaac

SEQ ID NO: 175340 - DNA, 25 bp, Rattus norvegicus
atatcacgtgaattcctggcccaac

SEQ ID NO: 175341 - DNA, 25 bp, Rattus norvegicus
atatcactagcaaggcccggaagca

SEQ ID NO: 175342 - DNA, 25 bp, Rattus norvegicus
atatcactagcatggcccggaagca

SEQ ID NO: 175343 - DNA, 25 bp, Rattus norvegicus
atatcactatgcaattcctgaccct

SEQ ID NO: 175344 - DNA, 25 bp, Rattus norvegicus
atatcactatgctattcctgaccct

SEQ ID NO: 175345 - DNA, 25 bp, Rattus norvegicus
atatcactcactcatgatgaactaa

SEQ ID NO: 175346 - DNA, 25 bp, Rattus norvegicus
atatcactcactgatgatgaactaa

SEQ ID NO: 175347 - DNA, 25 bp, Rattus norvegicus
atatcactggaaagcgatctgtctc

SEQ ID NO: 175348 - DNA, 25 bp, Rattus norvegicus
atatcactggaatgcgatctgtctc

SEQ ID NO: 175349 - DNA, 25 bp, Rattus norvegicus
atatcactgtctatctttctgtttc

SEQ ID NO: 175350 - DNA, 25 bp, Rattus norvegicus
atatcactgtctttctttctgtttc

SEQ ID NO: 175351 - DNA, 25 bp, Rattus norvegicus
atatcacttcccaaggctggagtct

SEQ ID NO: 175352 - DNA, 25 bp, Rattus norvegicus
atatcacttccctaggctggagtct

SEQ ID NO: 175353 - DNA, 25 bp, Rattus norvegicus
atatcactttggatgactttcgtgt

SEQ ID NO: 175354 - DNA, 25 bp, Rattus norvegicus
atatcactttggttgactttcgtgt

SEQ ID NO: 175355 - DNA, 25 bp, Rattus norvegicus
atatcagactagctatggcccagga

SEQ ID NO: 175356 - DNA, 25 bp, Rattus norvegicus
atatcagactaggtatggcccagga

SEQ ID NO: 175357 - DNA, 25 bp, Rattus norvegicus
atatcagagacccttttcatcagcc

SEQ ID NO: 175358 - DNA, 25 bp, Rattus norvegicus
atatcagagaccgttttcatcagcc

SEQ ID NO: 175359 - DNA, 25 bp, Rattus norvegicus
atatcagatgtcaagcaggcattca

SEQ ID NO: 175360 - DNA, 25 bp, Rattus norvegicus
atatcagatgtctagcaggcattca

SEQ ID NO: 175361 - DNA, 25 bp, Rattus norvegicus
atatcagattctctcacccatcaag

SEQ ID NO: 175362 - DNA, 25 bp, Rattus norvegicus
atatcagattctgtcacccatcaag

SEQ ID NO: 175363 - DNA, 25 bp, Rattus norvegicus
atatcagcaccaataggagaagaaa

SEQ ID NO: 175364 - DNA, 25 bp, Rattus norvegicus
atatcagcaccattaggagaagaaa

SEQ ID NO: 175365 - DNA, 25 bp, Rattus norvegicus
atatcagcatctaccaaagcctggt

SEQ ID NO: 175366 - DNA, 25 bp, Rattus norvegicus
atatcagcatcttccaaagcctggt

SEQ ID NO: 175367 - DNA, 25 bp, Rattus norvegicus
atatcagcctacagagcgttctcaa

SEQ ID NO: 175368 - DNA, 25 bp, Rattus norvegicus
atatcagcctactgagcgttctcaa

SEQ ID NO: 175369 - DNA, 25 bp, Rattus norvegicus
atatcagcctgtctctgaatcctga

SEQ ID NO: 175370 - DNA, 25 bp, Rattus norvegicus
atatcagcctgtgtctgaatcctga

SEQ ID NO: 175371 - DNA, 25 bp, Rattus norvegicus
atatcagcgtgaagggcaccagtca

SEQ ID NO: 175372 - DNA, 25 bp, Rattus norvegicus
atatcagcgtgatgggcaccagtca

SEQ ID NO: 175373 - DNA, 25 bp, Rattus norvegicus
atatcagctctgctctggtgctggt

SEQ ID NO: 175374 - DNA, 25 bp, Rattus norvegicus
atatcagctctggtctggtgctggt

SEQ ID NO: 175375 - DNA, 25 bp, Rattus norvegicus
atatcaggattaacggacagtgcaa

SEQ ID NO: 175376 - DNA, 25 bp, Rattus norvegicus
atatcaggattatcggacagtgcaa

SEQ ID NO: 175377 - DNA, 25 bp, Rattus norvegicus
atatcaggcagcagggagctaacca

SEQ ID NO: 175378 - DNA, 25 bp, Rattus norvegicus
atatcaggcagctgggagctaacca

SEQ ID NO: 175379 - DNA, 25 bp, Rattus norvegicus
atatcagggcagcaaaacttgtact

SEQ ID NO: 175380 - DNA, 25 bp, Rattus norvegicus
atatcagggcaggaaaacttgtact

SEQ ID NO: 175381 - DNA, 25 bp, Rattus norvegicus
atatcaggtccaaggttctatttcc

SEQ ID NO: 175382 - DNA, 25 bp, Rattus norvegicus
atatcaggtccatggttctatttcc

SEQ ID NO: 175383 - DNA, 25 bp, Rattus norvegicus
atatcagtatatcagaccctccaga

SEQ ID NO: 175384 - DNA, 25 bp, Rattus norvegicus
atatcagtatatgagaccctccaga

SEQ ID NO: 175385 - DNA, 25 bp, Rattus norvegicus
atatcagtcaggctatttgtaccaa

SEQ ID NO: 175386 - DNA, 25 bp, Rattus norvegicus
atatcagtcagggtatttgtaccaa

SEQ ID NO: 175387 - DNA, 25 bp, Rattus norvegicus
atatcatcaccaccaaatttccctt

SEQ ID NO: 175388 - DNA, 25 bp, Rattus norvegicus
atatcatcaccagcaaatttccctt

SEQ ID NO: 175389 - DNA, 25 bp, Rattus norvegicus
atatcatcactacttcgcctgacat

SEQ ID NO: 175390 - DNA, 25 bp, Rattus norvegicus
atatcatcactagttcgcctgacat

SEQ ID NO: 175391 - DNA, 25 bp, Rattus norvegicus
atatcatccagaaaaaggaggtgat

SEQ ID NO: 175392 - DNA, 25 bp, Rattus norvegicus
atatcatccagataaaggaggtgat

SEQ ID NO: 175393 - DNA, 25 bp, Rattus norvegicus
atatcatccatgagtagagcttttt

SEQ ID NO: 175394 - DNA, 25 bp, Rattus norvegicus
atatcatccatgtgtagagcttttt

SEQ ID NO: 175395 - DNA, 25 bp, Rattus norvegicus
atatcatcccagcacgttggagttt

SEQ ID NO: 175396 - DNA, 25 bp, Rattus norvegicus
atatcatcccaggacgttggagttt

SEQ ID NO: 175397 - DNA, 25 bp, Rattus norvegicus
atatcatcggcaaagaatctgttgt

SEQ ID NO: 175398 - DNA, 25 bp, Rattus norvegicus
atatcatcggcatagaatctgttgt

SEQ ID NO: 175399 - DNA, 25 bp, Rattus norvegicus
atatcatctcatactgtggacatca

SEQ ID NO: 175400 - DNA, 25 bp, Rattus norvegicus
atatcatctcattctgtggacatca

SEQ ID NO: 175401 - DNA, 25 bp, Rattus norvegicus
atatcatctcttcatctccacaaga

SEQ ID NO: 175402 - DNA, 25 bp, Rattus norvegicus
atatcatctcttgatctccacaaga

SEQ ID NO: 175403 - DNA, 25 bp, Rattus norvegicus
atatcatcttcacaataacccctgc

SEQ ID NO: 175404 - DNA, 25 bp, Rattus norvegicus
atatcatcttcagaataacccctgc

SEQ ID NO: 175405 - DNA, 25 bp, Rattus norvegicus
atatcatgacttaggttttcgtggt

SEQ ID NO: 175406 - DNA, 25 bp, Rattus norvegicus
atatcatgactttggttttcgtggt

SEQ ID NO: 175407 - DNA, 25 bp, Rattus norvegicus
atatcatgcattacacaggctgcag

SEQ ID NO: 175408 - DNA, 25 bp, Rattus norvegicus
atatcatgcatttcacaggctgcag

SEQ ID NO: 175409 - DNA, 25 bp, Rattus norvegicus
atatcatggactctaccacttgcac

SEQ ID NO: 175410 - DNA, 25 bp, Rattus norvegicus
atatcatggactgtaccacttgcac

SEQ ID NO: 175411 - DNA, 25 bp, Rattus norvegicus
atatcatggccgacatctgcaaaga

SEQ ID NO: 175412 - DNA, 25 bp, Rattus norvegicus
atatcatggccgtcatctgcaaaga

SEQ ID NO: 175413 - DNA, 25 bp, Rattus norvegicus
atatcatgggctcggcttcccgtga

SEQ ID NO: 175414 - DNA, 25 bp, Rattus norvegicus
atatcatgggctgggcttcccgtga

SEQ ID NO: 175415 - DNA, 25 bp, Rattus norvegicus
atatcatggttcagtgctctcagca

SEQ ID NO: 175416 - DNA, 25 bp, Rattus norvegicus
atatcatggttctgtgctctcagca

SEQ ID NO: 175417 - DNA, 25 bp, Rattus norvegicus
atatcatgtactctagtgtttgaaa

SEQ ID NO: 175418 - DNA, 25 bp, Rattus norvegicus
atatcatgtactgtagtgtttgaaa

SEQ ID NO: 175419 - DNA, 25 bp, Rattus norvegicus
atatcatgtctgctcctctgaacag

SEQ ID NO: 175420 - DNA, 25 bp, Rattus norvegicus
atatcatgtctggtcctctgaacag

SEQ ID NO: 175421 - DNA, 25 bp, Rattus norvegicus
atatcatgtgtcattgtgaccgtat

SEQ ID NO: 175422 - DNA, 25 bp, Rattus norvegicus
atatcatgtgtctttgtgaccgtat

SEQ ID NO: 175423 - DNA, 25 bp, Rattus norvegicus
atatcattagataaagtggaccttg

SEQ ID NO: 175424 - DNA, 25 bp, Rattus norvegicus
atatcattagattaagtggaccttg

SEQ ID NO: 175425 - DNA, 25 bp, Rattus norvegicus
atatcattcctgacattcctgaaag

SEQ ID NO: 175426 - DNA, 25 bp, Rattus norvegicus
atatcattcctgtcattcctgaaag

SEQ ID NO: 175427 - DNA, 25 bp, Rattus norvegicus
atatcattggatactttgagcagaa

SEQ ID NO: 175428 - DNA, 25 bp, Rattus norvegicus
atatcattggattctttgagcagaa

SEQ ID NO: 175429 - DNA, 25 bp, Rattus norvegicus
atatcattgtttagtctccctgttg

SEQ ID NO: 175430 - DNA, 25 bp, Rattus norvegicus
atatcattgttttgtctccctgttg

SEQ ID NO: 175431 - DNA, 25 bp, Rattus norvegicus
atatcatttacacagcgggactttt

SEQ ID NO: 175432 - DNA, 25 bp, Rattus norvegicus
atatcatttacagagcgggactttt

SEQ ID NO: 175433 - DNA, 25 bp, Rattus norvegicus
atatcatttgcaagctcatacccca

SEQ ID NO: 175434 - DNA, 25 bp, Rattus norvegicus
atatcatttgcatgctcatacccca

SEQ ID NO: 175435 - DNA, 25 bp, Rattus norvegicus
atatcatttgtgaccatgtgccctt

SEQ ID NO: 175436 - DNA, 25 bp, Rattus norvegicus
atatcatttgtgatccagcctaggc

SEQ ID NO: 175437 - DNA, 25 bp, Rattus norvegicus
atatcatttgtgtccatgtgccctt

SEQ ID NO: 175438 - DNA, 25 bp, Rattus norvegicus
atatcatttgtgttccagcctaggc

SEQ ID NO: 175439 - DNA, 25 bp, Rattus norvegicus
atatccaacggtatagttcacaagg

SEQ ID NO: 175440 - DNA, 25 bp, Rattus norvegicus
atatccaacggtttagttcacaagg

SEQ ID NO: 175441 - DNA, 25 bp, Rattus norvegicus
atatccacaacacatttgccacagg

SEQ ID NO: 175442 - DNA, 25 bp, Rattus norvegicus
atatccacaacagatttgccacagg

SEQ ID NO: 175443 - DNA, 25 bp, Rattus norvegicus
atatccacaccgaatcattagcatg

SEQ ID NO: 175444 - DNA, 25 bp, Rattus norvegicus
atatccacaccgtatcattagcatg

SEQ ID NO: 175445 - DNA, 25 bp, Rattus norvegicus
atatccacagtgagttttgacagta

SEQ ID NO: 175446 - DNA, 25 bp, Rattus norvegicus
atatccacagtgtgttttgacagta

SEQ ID NO: 175447 - DNA, 25 bp, Rattus norvegicus
atatccacccagacgtgatgaccat

SEQ ID NO: 175448 - DNA, 25 bp, Rattus norvegicus
atatccacccagtcgtgatgaccat

SEQ ID NO: 175449 - DNA, 25 bp, Rattus norvegicus
atatccaccctcaggtgacacggat

SEQ ID NO: 175450 - DNA, 25 bp, Rattus norvegicus
atatccaccctctggtgacacggat

SEQ ID NO: 175451 - DNA, 25 bp, Rattus norvegicus
atatccacctatcacttcagatcaa

SEQ ID NO: 175452 - DNA, 25 bp, Rattus norvegicus
atatccacctatgacttcagatcaa

SEQ ID NO: 175453 - DNA, 25 bp, Rattus norvegicus
atatccacgatgctttggctctgtc

SEQ ID NO: 175454 - DNA, 25 bp, Rattus norvegicus
atatccacgatggtttggctctgtc

SEQ ID NO: 175455 - DNA, 25 bp, Rattus norvegicus
atatccacggagactcacacaccgg

SEQ ID NO: 175456 - DNA, 25 bp, Rattus norvegicus
atatccacggagtctcacacaccgg

SEQ ID NO: 175457 - DNA, 25 bp, Rattus norvegicus
atatccacgtacagtagctcttcag

SEQ ID NO: 175458 - DNA, 25 bp, Rattus norvegicus
atatccacgtactgtagctcttcag

SEQ ID NO: 175459 - DNA, 25 bp, Rattus norvegicus
atatccactccaccagtagcattag

SEQ ID NO: 175460 - DNA, 25 bp, Rattus norvegicus
atatccactccagcagtagcattag

SEQ ID NO: 175461 - DNA, 25 bp, Rattus norvegicus
atatccactgtaagctcagggtgta

SEQ ID NO: 175462 - DNA, 25 bp, Rattus norvegicus
atatccactgtatgctcagggtgta

SEQ ID NO: 175463 - DNA, 25 bp, Rattus norvegicus
atatccactgtgagtgtcgtaaagt

SEQ ID NO: 175464 - DNA, 25 bp, Rattus norvegicus
atatccactgtgtgtgtcgtaaagt

SEQ ID NO: 175465 - DNA, 25 bp, Rattus norvegicus
atatccacttgtctagccgaagtca

SEQ ID NO: 175466 - DNA, 25 bp, Rattus norvegicus
atatccacttgtgtagccgaagtca

SEQ ID NO: 175467 - DNA, 25 bp, Rattus norvegicus
atatccagacgaatcttccctagaa

SEQ ID NO: 175468 - DNA, 25 bp, Rattus norvegicus
atatccagacgattcttccctagaa

SEQ ID NO: 175469 - DNA, 25 bp, Rattus norvegicus
atatccagatccaacatttatttac

SEQ ID NO: 175470 - DNA, 25 bp, Rattus norvegicus
atatccagatcctacatttatttac

SEQ ID NO: 175471 - DNA, 25 bp, Rattus norvegicus
atatccaggaacatgcgccggcagc

SEQ ID NO: 175472 - DNA, 25 bp, Rattus norvegicus
atatccaggaacttgcgccggcagc

SEQ ID NO: 175473 - DNA, 25 bp, Rattus norvegicus
atatccagtactatcctgcttcaaa

SEQ ID NO: 175474 - DNA, 25 bp, Rattus norvegicus
atatccagtactttcctgcttcaaa

SEQ ID NO: 175475 - DNA, 25 bp, Rattus norvegicus
atatccagtagccactgaatgccac

SEQ ID NO: 175476 - DNA, 25 bp, Rattus norvegicus
atatccagtagcgactgaatgccac

SEQ ID NO: 175477 - DNA, 25 bp, Rattus norvegicus
atatccagtatcacatgcttgccac

SEQ ID NO: 175478 - DNA, 25 bp, Rattus norvegicus
atatccagtatctcatgcttgccac

SEQ ID NO: 175479 - DNA, 25 bp, Rattus norvegicus
atatccagtcggaggaggcaaagaa

SEQ ID NO: 175480 - DNA, 25 bp, Rattus norvegicus
atatccagtcggtggaggcaaagaa

SEQ ID NO: 175481 - DNA, 25 bp, Rattus norvegicus
atatccagtctaaacttagctcgat

SEQ ID NO: 175482 - DNA, 25 bp, Rattus norvegicus
atatccagtctacccagacacattg

SEQ ID NO: 175483 - DNA, 25 bp, Rattus norvegicus
atatccagtctagccagacacattg

SEQ ID NO: 175484 - DNA, 25 bp, Rattus norvegicus
atatccagtctatacttagctcgat

SEQ ID NO: 175485 - DNA, 25 bp, Rattus norvegicus
atatccagtggtaccctttccatta

SEQ ID NO: 175486 - DNA, 25 bp, Rattus norvegicus
atatccagtggttccctttccatta

SEQ ID NO: 175487 - DNA, 25 bp, Rattus norvegicus
atatccatagggaatgtctcccagc

SEQ ID NO: 175488 - DNA, 25 bp, Rattus norvegicus
atatccatagggtatgtctcccagc

SEQ ID NO: 175489 - DNA, 25 bp, Rattus norvegicus
atatccatcacgacagaaacctgct

SEQ ID NO: 175490 - DNA, 25 bp, Rattus norvegicus
atatccatcacgtcagaaacctgct

SEQ ID NO: 175491 - DNA, 25 bp, Rattus norvegicus
atatccatccataactatcttcgtg

SEQ ID NO: 175492 - DNA, 25 bp, Rattus norvegicus
atatccatccattactatcttcgtg

SEQ ID NO: 175493 - DNA, 25 bp, Rattus norvegicus
atatccatctagcagtaggttctac

SEQ ID NO: 175494 - DNA, 25 bp, Rattus norvegicus
atatccatctaggagtaggttctac

SEQ ID NO: 175495 - DNA, 25 bp, Rattus norvegicus
atatccatgcagacggtggtcctgt

SEQ ID NO: 175496 - DNA, 25 bp, Rattus norvegicus
atatccatgcagtcggtggtcctgt

SEQ ID NO: 175497 - DNA, 25 bp, Rattus norvegicus
atatccatgtgcatctggtcacttt

SEQ ID NO: 175498 - DNA, 25 bp, Rattus norvegicus
atatccatgtgcttctggtcacttt

SEQ ID NO: 175499 - DNA, 25 bp, Rattus norvegicus
atatccatttttccccaactttctt

SEQ ID NO: 175500 - DNA, 25 bp, Rattus norvegicus
atatccatttttgcccaactttctt

SEQ ID NO: 175501 - DNA, 25 bp, Rattus norvegicus
atatcccaaacgatgagacaccgca

SEQ ID NO: 175502 - DNA, 25 bp, Rattus norvegicus
atatcccaaacgttgagacaccgca

SEQ ID NO: 175503 - DNA, 25 bp, Rattus norvegicus
atatcccaagcaaagaggtgaattc

SEQ ID NO: 175504 - DNA, 25 bp, Rattus norvegicus
atatcccaagcatagaggtgaattc

SEQ ID NO: 175505 - DNA, 25 bp, Rattus norvegicus
atatcccacatgctgcctttgactt

SEQ ID NO: 175506 - DNA, 25 bp, Rattus norvegicus
atatcccacatggtgcctttgactt

SEQ ID NO: 175507 - DNA, 25 bp, Rattus norvegicus
atatcccagaaaccgtctcctggag

SEQ ID NO: 175508 - DNA, 25 bp, Rattus norvegicus
atatcccagaaagcgtctcctggag

SEQ ID NO: 175509 - DNA, 25 bp, Rattus norvegicus
atatcccaggacacctgagttggct

SEQ ID NO: 175510 - DNA, 25 bp, Rattus norvegicus
atatcccaggacacggtacttaatg

SEQ ID NO: 175511 - DNA, 25 bp, Rattus norvegicus
atatcccaggactcctgagttggct

SEQ ID NO: 175512 - DNA, 25 bp, Rattus norvegicus
atatcccaggactcggtacttaatg

SEQ ID NO: 175513 - DNA, 25 bp, Rattus norvegicus
atatcccaggcacggtacatagagc

SEQ ID NO: 175514 - DNA, 25 bp, Rattus norvegicus
atatcccaggcagggtacatagagc

SEQ ID NO: 175515 - DNA, 25 bp, Rattus norvegicus
atatcccagtctccaagttctagga

SEQ ID NO: 175516 - DNA, 25 bp, Rattus norvegicus
atatcccagtctgcaagttctagga

SEQ ID NO: 175517 - DNA, 25 bp, Rattus norvegicus
atatcccatcagatggccaatcttc

SEQ ID NO: 175518 - DNA, 25 bp, Rattus norvegicus
atatcccatcagttggccaatcttc

SEQ ID NO: 175519 - DNA, 25 bp, Rattus norvegicus
atatcccatgtgacaacggtgtcgg

SEQ ID NO: 175520 - DNA, 25 bp, Rattus norvegicus
atatcccatgtgtcaacggtgtcgg

SEQ ID NO: 175521 - DNA, 25 bp, Rattus norvegicus
atatccccaaacacattgtctctag

SEQ ID NO: 175522 - DNA, 25 bp, Rattus norvegicus
atatccccaaactcattgtctctag

SEQ ID NO: 175523 - DNA, 25 bp, Rattus norvegicus
atatccccaagaccgcttcagtaaa

SEQ ID NO: 175524 - DNA, 25 bp, Rattus norvegicus
atatccccaagagcgcttcagtaaa

SEQ ID NO: 175525 - DNA, 25 bp, Rattus norvegicus
atatccccaagcaccaagaatcgtg

SEQ ID NO: 175526 - DNA, 25 bp, Rattus norvegicus
atatccccaagctccaagaatcgtg

SEQ ID NO: 175527 - DNA, 25 bp, Rattus norvegicus
atatccccacagcactggtggtaga

SEQ ID NO: 175528 - DNA, 25 bp, Rattus norvegicus
atatccccacaggactggtggtaga

SEQ ID NO: 175529 - DNA, 25 bp, Rattus norvegicus
atatccccaggcctgtctgaaatga

SEQ ID NO: 175530 - DNA, 25 bp, Rattus norvegicus
atatccccaggcgtgtctgaaatga

SEQ ID NO: 175531 - DNA, 25 bp, Rattus norvegicus
atatccccgtcgatttcatttcatt

SEQ ID NO: 175532 - DNA, 25 bp, Rattus norvegicus
atatccccgtcgttttcatttcatt

SEQ ID NO: 175533 - DNA, 25 bp, Rattus norvegicus
atatcccctgggagagagtgcatgg

SEQ ID NO: 175534 - DNA, 25 bp, Rattus norvegicus
atatcccctgggtgagagtgcatgg

SEQ ID NO: 175535 - DNA, 25 bp, Rattus norvegicus
atatcccctgtcatatacattcaca

SEQ ID NO: 175536 - DNA, 25 bp, Rattus norvegicus
atatcccctgtcttatacattcaca

SEQ ID NO: 175537 - DNA, 25 bp, Rattus norvegicus
atatccctagtcacatttcctgatt

SEQ ID NO: 175538 - DNA, 25 bp, Rattus norvegicus
atatccctagtctcatttcctgatt

SEQ ID NO: 175539 - DNA, 25 bp, Rattus norvegicus
atatccctagtgattgaccaatgtt

SEQ ID NO: 175540 - DNA, 25 bp, Rattus norvegicus
atatccctagtgtttgaccaatgtt

SEQ ID NO: 175541 - DNA, 25 bp, Rattus norvegicus
atatccctcatgaatcagctcttaa

SEQ ID NO: 175542 - DNA, 25 bp, Rattus norvegicus
atatccctcatgtatcagctcttaa

SEQ ID NO: 175543 - DNA, 25 bp, Rattus norvegicus
atatccctctctaggctattgaata

SEQ ID NO: 175544 - DNA, 25 bp, Rattus norvegicus
atatccctctcttggctattgaata

SEQ ID NO: 175545 - DNA, 25 bp, Rattus norvegicus
atatccctgactacttgtgtggcaa

SEQ ID NO: 175546 - DNA, 25 bp, Rattus norvegicus
atatccctgacttcttgtgtggcaa

SEQ ID NO: 175547 - DNA, 25 bp, Rattus norvegicus
atatccctggatatcttttcaagga

SEQ ID NO: 175548 - DNA, 25 bp, Rattus norvegicus
atatccctggatttcttttcaagga

SEQ ID NO: 175549 - DNA, 25 bp, Rattus norvegicus
atatccctggtgaattttaagtgct

SEQ ID NO: 175550 - DNA, 25 bp, Rattus norvegicus
atatccctggtgtattttaagtgct

SEQ ID NO: 175551 - DNA, 25 bp, Rattus norvegicus
atatcccttgagataccacctaata

SEQ ID NO: 175552 - DNA, 25 bp, Rattus norvegicus
atatcccttgagttaccacctaata

SEQ ID NO: 175553 - DNA, 25 bp, Rattus norvegicus
atatccgcaaagacctgtacgccaa

SEQ ID NO: 175554 - DNA, 25 bp, Rattus norvegicus
atatccgcaaagtcctgtacgccaa

SEQ ID NO: 175555 - DNA, 25 bp, Rattus norvegicus
atatccgcaccaagatgggccgagt

SEQ ID NO: 175556 - DNA, 25 bp, Rattus norvegicus
atatccgcaccatgatgggccgagt

SEQ ID NO: 175557 - DNA, 25 bp, Rattus norvegicus
atatccgcttttatatctgctagat

SEQ ID NO: 175558 - DNA, 25 bp, Rattus norvegicus
atatccgcttttttatctgctagat

SEQ ID NO: 175559 - DNA, 25 bp, Rattus norvegicus
atatccggagcaaatttttccctga

SEQ ID NO: 175560 - DNA, 25 bp, Rattus norvegicus
atatccggagcatatttttccctga

SEQ ID NO: 175561 - DNA, 25 bp, Rattus norvegicus
atatccgggtggcatccttgctaaa

SEQ ID NO: 175562 - DNA, 25 bp, Rattus norvegicus
atatccgggtgggatccttgctaaa

SEQ ID NO: 175563 - DNA, 25 bp, Rattus norvegicus
atatccgtgacaccgtttgactttt

SEQ ID NO: 175564 - DNA, 25 bp, Rattus norvegicus
atatccgtgacagcgtttgactttt

SEQ ID NO: 175565 - DNA, 25 bp, Rattus norvegicus
atatccgtggttagccctcagagag

SEQ ID NO: 175566 - DNA, 25 bp, Rattus norvegicus
atatccgtggtttgccctcagagag

SEQ ID NO: 175567 - DNA, 25 bp, Rattus norvegicus
atatcctaaccaagagaagcagact

SEQ ID NO: 175568 - DNA, 25 bp, Rattus norvegicus
atatcctaaccatgagaagcagact

SEQ ID NO: 175569 - DNA, 25 bp, Rattus norvegicus
atatcctaatatcccacttttctag

SEQ ID NO: 175570 - DNA, 25 bp, Rattus norvegicus
atatcctaatatgccacttttctag

SEQ ID NO: 175571 - DNA, 25 bp, Rattus norvegicus
atatcctaatgtaaccgtatgctgt

SEQ ID NO: 175572 - DNA, 25 bp, Rattus norvegicus
atatcctaatgttaccgtatgctgt

SEQ ID NO: 175573 - DNA, 25 bp, Rattus norvegicus
atatcctacccacactgtgttcaaa

SEQ ID NO: 175574 - DNA, 25 bp, Rattus norvegicus
atatcctacccagactgtgttcaaa

SEQ ID NO: 175575 - DNA, 25 bp, Rattus norvegicus
atatcctagaggacttctgtctttt

SEQ ID NO: 175576 - DNA, 25 bp, Rattus norvegicus
atatcctagaggtcttctgtctttt

SEQ ID NO: 175577 - DNA, 25 bp, Rattus norvegicus
atatcctaggccactgctgtaataa

SEQ ID NO: 175578 - DNA, 25 bp, Rattus norvegicus
atatcctaggcctctgctgtaataa

SEQ ID NO: 175579 - DNA, 25 bp, Rattus norvegicus
atatcctaggtactgcactgtcctt

SEQ ID NO: 175580 - DNA, 25 bp, Rattus norvegicus
atatcctaggtagtgcactgtcctt

SEQ ID NO: 175581 - DNA, 25 bp, Rattus norvegicus
atatcctatcctaaacaactcctaa

SEQ ID NO: 175582 - DNA, 25 bp, Rattus norvegicus
atatcctatccttaacaactcctaa

SEQ ID NO: 175583 - DNA, 25 bp, Rattus norvegicus
atatcctatttcctttgaacccact

SEQ ID NO: 175584 - DNA, 25 bp, Rattus norvegicus
atatcctatttcgtttgaacccact

SEQ ID NO: 175585 - DNA, 25 bp, Rattus norvegicus
atatcctcaaggcaaggtcagggac

SEQ ID NO: 175586 - DNA, 25 bp, Rattus norvegicus
atatcctcaagggaaggtcagggac

SEQ ID NO: 175587 - DNA, 25 bp, Rattus norvegicus
atatcctcactcatatccatcataa

SEQ ID NO: 175588 - DNA, 25 bp, Rattus norvegicus
atatcctcactcttatccatcataa

SEQ ID NO: 175589 - DNA, 25 bp, Rattus norvegicus
atatcctcaggcatcaagatttggt

SEQ ID NO: 175590 - DNA, 25 bp, Rattus norvegicus
atatcctcaggccacgtgcacttgg

SEQ ID NO: 175591 - DNA, 25 bp, Rattus norvegicus
atatcctcaggcgacgtgcacttgg

SEQ ID NO: 175592 - DNA, 25 bp, Rattus norvegicus
atatcctcaggcttcaagatttggt

SEQ ID NO: 175593 - DNA, 25 bp, Rattus norvegicus
atatcctcagtcagggatggtgaca

SEQ ID NO: 175594 - DNA, 25 bp, Rattus norvegicus
atatcctcagtctgggatggtgaca

SEQ ID NO: 175595 - DNA, 25 bp, Rattus norvegicus
atatcctcatttaagaaccctgcca

SEQ ID NO: 175596 - DNA, 25 bp, Rattus norvegicus
atatcctcattttagaaccctgcca

SEQ ID NO: 175597 - DNA, 25 bp, Rattus norvegicus
atatcctcccacaatccaagattgg

SEQ ID NO: 175598 - DNA, 25 bp, Rattus norvegicus
atatcctcccactatccaagattgg

SEQ ID NO: 175599 - DNA, 25 bp, Rattus norvegicus
atatcctcgaaacagtgcacccagg

SEQ ID NO: 175600 - DNA, 25 bp, Rattus norvegicus
atatcctcgaaagagtgcacccagg

SEQ ID NO: 175601 - DNA, 25 bp, Rattus norvegicus
atatcctcggaacaggccagggccc

SEQ ID NO: 175602 - DNA, 25 bp, Rattus norvegicus
atatcctcggaagaggccagggccc

SEQ ID NO: 175603 - DNA, 25 bp, Rattus norvegicus
atatcctcgtataagtgccagactc

SEQ ID NO: 175604 - DNA, 25 bp, Rattus norvegicus
atatcctcgtattagtgccagactc

SEQ ID NO: 175605 - DNA, 25 bp, Rattus norvegicus
atatcctctacaaatgaccggctgg

SEQ ID NO: 175606 - DNA, 25 bp, Rattus norvegicus
atatcctctacatatgaccggctgg

SEQ ID NO: 175607 - DNA, 25 bp, Rattus norvegicus
atatcctgaccaagttgcccagaaa

SEQ ID NO: 175608 - DNA, 25 bp, Rattus norvegicus
atatcctgaccatgttgcccagaaa

SEQ ID NO: 175609 - DNA, 25 bp, Rattus norvegicus
atatcctgagcactccctgggcagg

SEQ ID NO: 175610 - DNA, 25 bp, Rattus norvegicus
atatcctgagcagtccctgggcagg

SEQ ID NO: 175611 - DNA, 25 bp, Rattus norvegicus
atatcctgcacaatgttccgaggtc

SEQ ID NO: 175612 - DNA, 25 bp, Rattus norvegicus
atatcctgcacattgttccgaggtc

SEQ ID NO: 175613 - DNA, 25 bp, Rattus norvegicus
atatcctgccttacatgaactcttg

SEQ ID NO: 175614 - DNA, 25 bp, Rattus norvegicus
atatcctgcctttcatgaactcttg

SEQ ID NO: 175615 - DNA, 25 bp, Rattus norvegicus
atatcctgcgtgacctggccattgg

SEQ ID NO: 175616 - DNA, 25 bp, Rattus norvegicus
atatcctgcgtgtcctggccattgg

SEQ ID NO: 175617 - DNA, 25 bp, Rattus norvegicus
atatcctgctaaacattcatcaccc

SEQ ID NO: 175618 - DNA, 25 bp, Rattus norvegicus
atatcctgctaatcattcatcaccc

SEQ ID NO: 175619 - DNA, 25 bp, Rattus norvegicus
atatcctggaaaccagtgccgctct

SEQ ID NO: 175620 - DNA, 25 bp, Rattus norvegicus
atatcctggaaagcagtgccgctct

SEQ ID NO: 175621 - DNA, 25 bp, Rattus norvegicus
atatcctggacaaggtagagccggg

SEQ ID NO: 175622 - DNA, 25 bp, Rattus norvegicus
atatcctggacatggtagagccggg

SEQ ID NO: 175623 - DNA, 25 bp, Rattus norvegicus
atatcctggcgaactttgtgctatc

SEQ ID NO: 175624 - DNA, 25 bp, Rattus norvegicus
atatcctggcgatctttgtgctatc

SEQ ID NO: 175625 - DNA, 25 bp, Rattus norvegicus
atatcctggtcactgtcacatttca

SEQ ID NO: 175626 - DNA, 25 bp, Rattus norvegicus
atatcctggtcagtgtcacatttca

SEQ ID NO: 175627 - DNA, 25 bp, Rattus norvegicus
atatcctgtcataggctaacatcaa

SEQ ID NO: 175628 - DNA, 25 bp, Rattus norvegicus
atatcctgtcattggctaacatcaa

SEQ ID NO: 175629 - DNA, 25 bp, Rattus norvegicus
atatcctgtcggatctttgtgggaa

SEQ ID NO: 175630 - DNA, 25 bp, Rattus norvegicus
atatcctgtcggttctttgtgggaa

SEQ ID NO: 175631 - DNA, 25 bp, Rattus norvegicus
atatcctgtgtcagaagtttgcgta

SEQ ID NO: 175632 - DNA, 25 bp, Rattus norvegicus
atatcctgtgtctgaagtttgcgta

SEQ ID NO: 175633 - DNA, 25 bp, Rattus norvegicus
atatccttacgcatcactgaacagc

SEQ ID NO: 175634 - DNA, 25 bp, Rattus norvegicus
atatccttacgcttcactgaacagc

SEQ ID NO: 175635 - DNA, 25 bp, Rattus norvegicus
atatccttacttctaatgacatcga

SEQ ID NO: 175636 - DNA, 25 bp, Rattus norvegicus
atatccttacttgtaatgacatcga

SEQ ID NO: 175637 - DNA, 25 bp, Rattus norvegicus
atatccttagcaattttgcctgctg

SEQ ID NO: 175638 - DNA, 25 bp, Rattus norvegicus
atatccttagcatttttgcctgctg

SEQ ID NO: 175639 - DNA, 25 bp, Rattus norvegicus
atatccttatttacctttgaacagt

SEQ ID NO: 175640 - DNA, 25 bp, Rattus norvegicus
atatccttattttcctttgaacagt

SEQ ID NO: 175641 - DNA, 25 bp, Rattus norvegicus
atatccttcaggctctaatgggttt

SEQ ID NO: 175642 - DNA, 25 bp, Rattus norvegicus
atatccttcagggtctaatgggttt

SEQ ID NO: 175643 - DNA, 25 bp, Rattus norvegicus
atatccttgaatacgttacatctgt

SEQ ID NO: 175644 - DNA, 25 bp, Rattus norvegicus
atatccttgaattcgttacatctgt

SEQ ID NO: 175645 - DNA, 25 bp, Rattus norvegicus
atatccttgagtatgagcttgtctg

SEQ ID NO: 175646 - DNA, 25 bp, Rattus norvegicus
atatccttgagtttgagcttgtctg

SEQ ID NO: 175647 - DNA, 25 bp, Rattus norvegicus
atatccttgcaaagcacggtgatac

SEQ ID NO: 175648 - DNA, 25 bp, Rattus norvegicus
atatccttgcaatgcacggtgatac

SEQ ID NO: 175649 - DNA, 25 bp, Rattus norvegicus
atatccttggagcacttcggtctac

SEQ ID NO: 175650 - DNA, 25 bp, Rattus norvegicus
atatccttggaggacttcggtctac

SEQ ID NO: 175651 - DNA, 25 bp, Rattus norvegicus
atatcctttataagtcctgtttgac

SEQ ID NO: 175652 - DNA, 25 bp, Rattus norvegicus
atatcctttatatgtcctgtttgac

SEQ ID NO: 175653 - DNA, 25 bp, Rattus norvegicus
atatcctttatgctctctgtgggca

SEQ ID NO: 175654 - DNA, 25 bp, Rattus norvegicus
atatcctttatggtctctgtgggca

SEQ ID NO: 175655 - DNA, 25 bp, Rattus norvegicus
atatcctttctgaattttatgtgca

SEQ ID NO: 175656 - DNA, 25 bp, Rattus norvegicus
atatcctttctgtattttatgtgca

SEQ ID NO: 175657 - DNA, 25 bp, Rattus norvegicus
atatcctttgacagtatgcctctag

SEQ ID NO: 175658 - DNA, 25 bp, Rattus norvegicus
atatcctttgactgtatgcctctag

SEQ ID NO: 175659 - DNA, 25 bp, Rattus norvegicus
atatcctttggtactactgctttcc

SEQ ID NO: 175660 - DNA, 25 bp, Rattus norvegicus
atatcctttggttctactgctttcc

SEQ ID NO: 175661 - DNA, 25 bp, Rattus norvegicus
atatcctttttaatgatcaggcatg

SEQ ID NO: 175662 - DNA, 25 bp, Rattus norvegicus
atatcctttttattgatcaggcatg

SEQ ID NO: 175663 - DNA, 25 bp, Rattus norvegicus
atatcgactggcaccttgagaagaa

SEQ ID NO: 175664 - DNA, 25 bp, Rattus norvegicus
atatcgactggctccttgagaagaa

SEQ ID NO: 175665 - DNA, 25 bp, Rattus norvegicus
atatcgagaatcctctggacatgtt

SEQ ID NO: 175666 - DNA, 25 bp, Rattus norvegicus
atatcgagaatcgtctggacatgtt

SEQ ID NO: 175667 - DNA, 25 bp, Rattus norvegicus
atatcgagtgctatctgcaaccaga

SEQ ID NO: 175668 - DNA, 25 bp, Rattus norvegicus
atatcgagtgctttctgcaaccaga

SEQ ID NO: 175669 - DNA, 25 bp, Rattus norvegicus
atatcgcaaaagagttcttgggtaa

SEQ ID NO: 175670 - DNA, 25 bp, Rattus norvegicus
atatcgcaaaagtgttcttgggtaa

SEQ ID NO: 175671 - DNA, 25 bp, Rattus norvegicus
atatcgcatgccaaattcttttata

SEQ ID NO: 175672 - DNA, 25 bp, Rattus norvegicus
atatcgcatgcctaattcttttata

SEQ ID NO: 175673 - DNA, 25 bp, Rattus norvegicus
atatcgcatgtgactcttttgactt

SEQ ID NO: 175674 - DNA, 25 bp, Rattus norvegicus
atatcgcatgtgtctcttttgactt

SEQ ID NO: 175675 - DNA, 25 bp, Rattus norvegicus
atatcgccaacaccggcactagagc

SEQ ID NO: 175676 - DNA, 25 bp, Rattus norvegicus
atatcgccaacagcggcactagagc

SEQ ID NO: 175677 - DNA, 25 bp, Rattus norvegicus
atatcgccatgtatcagctgagaga

SEQ ID NO: 175678 - DNA, 25 bp, Rattus norvegicus
atatcgccatgtttcagctgagaga

SEQ ID NO: 175679 - DNA, 25 bp, Rattus norvegicus
atatcgctagtgatcatcgttgcca

SEQ ID NO: 175680 - DNA, 25 bp, Rattus norvegicus
atatcgctagtgttcatcgttgcca

SEQ ID NO: 175681 - DNA, 25 bp, Rattus norvegicus
atatcgctgcatagtttcctcaaac

SEQ ID NO: 175682 - DNA, 25 bp, Rattus norvegicus
atatcgctgcatatatggacagact

SEQ ID NO: 175683 - DNA, 25 bp, Rattus norvegicus
atatcgctgcattgtttcctcaaac

SEQ ID NO: 175684 - DNA, 25 bp, Rattus norvegicus
atatcgctgcatttatggacagact

SEQ ID NO: 175685 - DNA, 25 bp, Rattus norvegicus
atatcgctgcgcacgtcgtcgacaa

SEQ ID NO: 175686 - DNA, 25 bp, Rattus norvegicus
atatcgctgcgctcgtcgtcgacaa

SEQ ID NO: 175687 - DNA, 25 bp, Rattus norvegicus
atatcgctgggtatgtaatcttttg

SEQ ID NO: 175688 - DNA, 25 bp, Rattus norvegicus
atatcgctgggtttgtaatcttttg

SEQ ID NO: 175689 - DNA, 25 bp, Rattus norvegicus
atatcgcttttgatttctgctaccg

SEQ ID NO: 175690 - DNA, 25 bp, Rattus norvegicus
atatcgcttttgttttctgctaccg

SEQ ID NO: 175691 - DNA, 25 bp, Rattus norvegicus
atatcggctgagattggcacccctg

SEQ ID NO: 175692 - DNA, 25 bp, Rattus norvegicus
atatcggctgagtttggcacccctg

SEQ ID NO: 175693 - DNA, 25 bp, Rattus norvegicus
atatcgggtgccatcctttggaaat

SEQ ID NO: 175694 - DNA, 25 bp, Rattus norvegicus
atatcgggtgccttcctttggaaat

SEQ ID NO: 175695 - DNA, 25 bp, Rattus norvegicus
atatcgggttcgaggactacacttc

SEQ ID NO: 175696 - DNA, 25 bp, Rattus norvegicus
atatcgggttcgtggactacacttc

SEQ ID NO: 175697 - DNA, 25 bp, Rattus norvegicus
atatcggtcataatcgtcgtatcgt

SEQ ID NO: 175698 - DNA, 25 bp, Rattus norvegicus
atatcggtcatattcgtcgtatcgt

SEQ ID NO: 175699 - DNA, 25 bp, Rattus norvegicus
atatcgtgctccagaatgcttggtt

SEQ ID NO: 175700 - DNA, 25 bp, Rattus norvegicus
atatcgtgctcctgaatgcttggtt

SEQ ID NO: 175701 - DNA, 25 bp, Rattus norvegicus
atatcgtgctttctctcggtcaagt

SEQ ID NO: 175702 - DNA, 25 bp, Rattus norvegicus
atatcgtgctttgtctcggtcaagt

SEQ ID NO: 175703 - DNA, 25 bp, Rattus norvegicus
atatcgtgtcacattattctcttta

SEQ ID NO: 175704 - DNA, 25 bp, Rattus norvegicus
atatcgtgtcactttattctcttta

SEQ ID NO: 175705 - DNA, 25 bp, Rattus norvegicus
atatcgttgagaccgtggtccagct

SEQ ID NO: 175706 - DNA, 25 bp, Rattus norvegicus
atatcgttgagagcgtggtccagct

SEQ ID NO: 175707 - DNA, 25 bp, Rattus norvegicus
atatcgttgatcatactgttcttta

SEQ ID NO: 175708 - DNA, 25 bp, Rattus norvegicus
atatcgttgatcttactgttcttta

SEQ ID NO: 175709 - DNA, 25 bp, Rattus norvegicus
atatcgtttagtagtcccattggga

SEQ ID NO: 175710 - DNA, 25 bp, Rattus norvegicus
atatcgtttagttgtcccattggga

SEQ ID NO: 175711 - DNA, 25 bp, Rattus norvegicus
atatctaaacaactcctcggcggtt

SEQ ID NO: 175712 - DNA, 25 bp, Rattus norvegicus
atatctaaacaagtcctcggcggtt

SEQ ID NO: 175713 - DNA, 25 bp, Rattus norvegicus
atatctaagccccatgtttacttaa

SEQ ID NO: 175714 - DNA, 25 bp, Rattus norvegicus
atatctaagcccgatgtttacttaa

SEQ ID NO: 175715 - DNA, 25 bp, Rattus norvegicus
atatctaaggtgctcctggctcaga

SEQ ID NO: 175716 - DNA, 25 bp, Rattus norvegicus
atatctaaggtggtcctggctcaga

SEQ ID NO: 175717 - DNA, 25 bp, Rattus norvegicus
atatctaataaaactggcagcatcc

SEQ ID NO: 175718 - DNA, 25 bp, Rattus norvegicus
atatctaataaatctggcagcatcc

SEQ ID NO: 175719 - DNA, 25 bp, Rattus norvegicus
atatctaatcttagccactgggtgg

SEQ ID NO: 175720 - DNA, 25 bp, Rattus norvegicus
atatctaatctttgccactgggtgg

SEQ ID NO: 175721 - DNA, 25 bp, Rattus norvegicus
atatctacactgacttgcttggctt

SEQ ID NO: 175722 - DNA, 25 bp, Rattus norvegicus
atatctacactgtcttgcttggctt

SEQ ID NO: 175723 - DNA, 25 bp, Rattus norvegicus
atatctacaggcaattcacatctcc

SEQ ID NO: 175724 - DNA, 25 bp, Rattus norvegicus
atatctacaggctattcacatctcc

SEQ ID NO: 175725 - DNA, 25 bp, Rattus norvegicus
atatctacatgtatctacaccgccc

SEQ ID NO: 175726 - DNA, 25 bp, Rattus norvegicus
atatctacatgtttctacaccgccc

SEQ ID NO: 175727 - DNA, 25 bp, Rattus norvegicus
atatctaccgggagcgctggagtgc

SEQ ID NO: 175728 - DNA, 25 bp, Rattus norvegicus
atatctaccgggtgcgctggagtgc

SEQ ID NO: 175729 - DNA, 25 bp, Rattus norvegicus
atatctacctgtataaccctccgta

SEQ ID NO: 175730 - DNA, 25 bp, Rattus norvegicus
atatctacctgtttaaccctccgta

SEQ ID NO: 175731 - DNA, 25 bp, Rattus norvegicus
atatctactcatcaacacccgtgga

SEQ ID NO: 175732 - DNA, 25 bp, Rattus norvegicus
atatctactcatgaacacccgtgga

SEQ ID NO: 175733 - DNA, 25 bp, Rattus norvegicus
atatctactctgaatggcttgctta

SEQ ID NO: 175734 - DNA, 25 bp, Rattus norvegicus
atatctactctgtatggcttgctta

SEQ ID NO: 175735 - DNA, 25 bp, Rattus norvegicus
atatctactggtcctgagggaaaca

SEQ ID NO: 175736 - DNA, 25 bp, Rattus norvegicus
atatctactggtgctgagggaaaca

SEQ ID NO: 175737 - DNA, 25 bp, Rattus norvegicus
atatctaggaccagccaattaggcc

SEQ ID NO: 175738 - DNA, 25 bp, Rattus norvegicus
atatctaggacctgccaattaggcc

SEQ ID NO: 175739 - DNA, 25 bp, Rattus norvegicus
atatctaggcctcatgacacatgac

SEQ ID NO: 175740 - DNA, 25 bp, Rattus norvegicus
atatctaggcctgatgacacatgac

SEQ ID NO: 175741 - DNA, 25 bp, Rattus norvegicus
atatctataacactacacaccttta

SEQ ID NO: 175742 - DNA, 25 bp, Rattus norvegicus
atatctataacagtacacaccttta

SEQ ID NO: 175743 - DNA, 25 bp, Rattus norvegicus
atatctatagcacgttctccagccc

SEQ ID NO: 175744 - DNA, 25 bp, Rattus norvegicus
atatctatagcaggttctccagccc

SEQ ID NO: 175745 - DNA, 25 bp, Rattus norvegicus
atatctatagctatgtgtatggcca

SEQ ID NO: 175746 - DNA, 25 bp, Rattus norvegicus
atatctatagctttgtgtatggcca

SEQ ID NO: 175747 - DNA, 25 bp, Rattus norvegicus
atatctatatgcctctgtctcctaa

SEQ ID NO: 175748 - DNA, 25 bp, Rattus norvegicus
atatctatatgcgtctgtctcctaa

SEQ ID NO: 175749 - DNA, 25 bp, Rattus norvegicus
atatctatctttagtcagtcgtctc

SEQ ID NO: 175750 - DNA, 25 bp, Rattus norvegicus
atatctatcttttgtcagtcgtctc

SEQ ID NO: 175751 - DNA, 25 bp, Rattus norvegicus
atatctatgtatccgagtgtactcc

SEQ ID NO: 175752 - DNA, 25 bp, Rattus norvegicus
atatctatgtatgcgagtgtactcc

SEQ ID NO: 175753 - DNA, 25 bp, Rattus norvegicus
atatctattctaactctccctttag

SEQ ID NO: 175754 - DNA, 25 bp, Rattus norvegicus
atatctattctatctctccctttag

SEQ ID NO: 175755 - DNA, 25 bp, Rattus norvegicus
atatctatttctacttatgccagcc

SEQ ID NO: 175756 - DNA, 25 bp, Rattus norvegicus
atatctatttcttcttatgccagcc

SEQ ID NO: 175757 - DNA, 25 bp, Rattus norvegicus
atatctattttcacactccactttg

SEQ ID NO: 175758 - DNA, 25 bp, Rattus norvegicus
atatctattttctcactccactttg

SEQ ID NO: 175759 - DNA, 25 bp, Rattus norvegicus
atatctcaagaacacaaacgcctta

SEQ ID NO: 175760 - DNA, 25 bp, Rattus norvegicus
atatctcaagaagacaaacgcctta

SEQ ID NO: 175761 - DNA, 25 bp, Rattus norvegicus
atatctcaagacacctatgctacac

SEQ ID NO: 175762 - DNA, 25 bp, Rattus norvegicus
atatctcaagactcctatgctacac

SEQ ID NO: 175763 - DNA, 25 bp, Rattus norvegicus
atatctcacctaaggatcgctctga

SEQ ID NO: 175764 - DNA, 25 bp, Rattus norvegicus
atatctcacctatggatcgctctga

SEQ ID NO: 175765 - DNA, 25 bp, Rattus norvegicus
atatctcagattactgcagcagaag

SEQ ID NO: 175766 - DNA, 25 bp, Rattus norvegicus
atatctcagatttctgcagcagaag

SEQ ID NO: 175767 - DNA, 25 bp, Rattus norvegicus
atatctcagtgtcggactacgacat

SEQ ID NO: 175768 - DNA, 25 bp, Rattus norvegicus
atatctcagtgtgggactacgacat

SEQ ID NO: 175769 - DNA, 25 bp, Rattus norvegicus
atatctcatcaaaagtggtgtcgtc

SEQ ID NO: 175770 - DNA, 25 bp, Rattus norvegicus
atatctcatcaatagtggtgtcgtc

SEQ ID NO: 175771 - DNA, 25 bp, Rattus norvegicus
atatctcatccccaggaaacgaaga

SEQ ID NO: 175772 - DNA, 25 bp, Rattus norvegicus
atatctcatcccgaggaaacgaaga

SEQ ID NO: 175773 - DNA, 25 bp, Rattus norvegicus
atatctcatgtcctgagacttacag

SEQ ID NO: 175774 - DNA, 25 bp, Rattus norvegicus
atatctcatgtcgtgagacttacag

SEQ ID NO: 175775 - DNA, 25 bp, Rattus norvegicus
atatctcattctcaatgctacccat

SEQ ID NO: 175776 - DNA, 25 bp, Rattus norvegicus
atatctcattctgaatgctacccat

SEQ ID NO: 175777 - DNA, 25 bp, Rattus norvegicus
atatctccaagacgtgcctatcctc

SEQ ID NO: 175778 - DNA, 25 bp, Rattus norvegicus
atatctccaagaggtgcctatcctc

SEQ ID NO: 175779 - DNA, 25 bp, Rattus norvegicus
atatctccacaaacacacaggcttt

SEQ ID NO: 175780 - DNA, 25 bp, Rattus norvegicus
atatctccacaatcacacaggcttt

SEQ ID NO: 175781 - DNA, 25 bp, Rattus norvegicus
atatctccagatcactcccttattt

SEQ ID NO: 175782 - DNA, 25 bp, Rattus norvegicus
atatctccagatgactcccttattt

SEQ ID NO: 175783 - DNA, 25 bp, Rattus norvegicus
atatctcccataaaattgccccaat

SEQ ID NO: 175784 - DNA, 25 bp, Rattus norvegicus
atatctcccatataattgccccaat

SEQ ID NO: 175785 - DNA, 25 bp, Rattus norvegicus
atatctcctctccttggttagggaa

SEQ ID NO: 175786 - DNA, 25 bp, Rattus norvegicus
atatctcctctcgttggttagggaa

SEQ ID NO: 175787 - DNA, 25 bp, Rattus norvegicus
atatctcctgctcatctgtgtacta

SEQ ID NO: 175788 - DNA, 25 bp, Rattus norvegicus
atatctcctgctgatctgtgtacta

SEQ ID NO: 175789 - DNA, 25 bp, Rattus norvegicus
atatctcctttcattacatgcatgc

SEQ ID NO: 175790 - DNA, 25 bp, Rattus norvegicus
atatctcctttctttacatgcatgc

SEQ ID NO: 175791 - DNA, 25 bp, Rattus norvegicus
atatctcgatctattgctgacactc

SEQ ID NO: 175792 - DNA, 25 bp, Rattus norvegicus
atatctcgatcttttgctgacactc

SEQ ID NO: 175793 - DNA, 25 bp, Rattus norvegicus
atatctctaggacttttcccttggt

SEQ ID NO: 175794 - DNA, 25 bp, Rattus norvegicus
atatctctaggagttttcccttggt

SEQ ID NO: 175795 - DNA, 25 bp, Rattus norvegicus
atatctctagtcatgggatccattt

SEQ ID NO: 175796 - DNA, 25 bp, Rattus norvegicus
atatctctagtcttgggatccattt

SEQ ID NO: 175797 - DNA, 25 bp, Rattus norvegicus
atatctctatacatagcctctgggc

SEQ ID NO: 175798 - DNA, 25 bp, Rattus norvegicus
atatctctatacttagcctctgggc

SEQ ID NO: 175799 - DNA, 25 bp, Rattus norvegicus
atatctctcaacatccgcagtgcaa

SEQ ID NO: 175800 - DNA, 25 bp, Rattus norvegicus
atatctctcaacttccgcagtgcaa

SEQ ID NO: 175801 - DNA, 25 bp, Rattus norvegicus
atatctctctcaacttatttgccca

SEQ ID NO: 175802 - DNA, 25 bp, Rattus norvegicus
atatctctctcatcttatttgccca

SEQ ID NO: 175803 - DNA, 25 bp, Rattus norvegicus
atatctctgaacacagggcctagcc

SEQ ID NO: 175804 - DNA, 25 bp, Rattus norvegicus
atatctctgaactcagggcctagcc

SEQ ID NO: 175805 - DNA, 25 bp, Rattus norvegicus
atatctctgccgaacgacatgactg

SEQ ID NO: 175806 - DNA, 25 bp, Rattus norvegicus
atatctctgccgtacgacatgactg

SEQ ID NO: 175807 - DNA, 25 bp, Rattus norvegicus
atatctctgtacatttaaacacata

SEQ ID NO: 175808 - DNA, 25 bp, Rattus norvegicus
atatctctgtacttttaaacacata

SEQ ID NO: 175809 - DNA, 25 bp, Rattus norvegicus
atatctctgtagcatggtgtctcct

SEQ ID NO: 175810 - DNA, 25 bp, Rattus norvegicus
atatctctgtaggatggtgtctcct

SEQ ID NO: 175811 - DNA, 25 bp, Rattus norvegicus
atatctctgtctatctctatctcta

SEQ ID NO: 175812 - DNA, 25 bp, Rattus norvegicus
atatctctgtctttctctatctcta

SEQ ID NO: 175813 - DNA, 25 bp, Rattus norvegicus
atatctctgtgcctttcacagactg

SEQ ID NO: 175814 - DNA, 25 bp, Rattus norvegicus
atatctctgtgcgtttcacagactg

SEQ ID NO: 175815 - DNA, 25 bp, Rattus norvegicus
atatctctgttcagactgtctgggc

SEQ ID NO: 175816 - DNA, 25 bp, Rattus norvegicus
atatctctgttcagtcctgtgggag

SEQ ID NO: 175817 - DNA, 25 bp, Rattus norvegicus
atatctctgttctgactgtctgggc

SEQ ID NO: 175818 - DNA, 25 bp, Rattus norvegicus
atatctctgttctgtcctgtgggag

SEQ ID NO: 175819 - DNA, 25 bp, Rattus norvegicus
atatctcttcatactctccatttga

SEQ ID NO: 175820 - DNA, 25 bp, Rattus norvegicus
atatctcttcattctctccatttga

SEQ ID NO: 175821 - DNA, 25 bp, Rattus norvegicus
atatctctttggatgtctctagcct

SEQ ID NO: 175822 - DNA, 25 bp, Rattus norvegicus
atatctctttggttgtctctagcct

SEQ ID NO: 175823 - DNA, 25 bp, Rattus norvegicus
atatctgaaaatcacatctttctca

SEQ ID NO: 175824 - DNA, 25 bp, Rattus norvegicus
atatctgaaaatgacatctttctca

SEQ ID NO: 175825 - DNA, 25 bp, Rattus norvegicus
atatctgaccaaagtgtttatagta

SEQ ID NO: 175826 - DNA, 25 bp, Rattus norvegicus
atatctgaccaatgtgtttatagta

SEQ ID NO: 175827 - DNA, 25 bp, Rattus norvegicus
atatctgagtgccttggtcttttgc

SEQ ID NO: 175828 - DNA, 25 bp, Rattus norvegicus
atatctgagtgcgttggtcttttgc

SEQ ID NO: 175829 - DNA, 25 bp, Rattus norvegicus
atatctgatctcatgtttcctgcta

SEQ ID NO: 175830 - DNA, 25 bp, Rattus norvegicus
atatctgatctcttgtttcctgcta

SEQ ID NO: 175831 - DNA, 25 bp, Rattus norvegicus
atatctgatcttatcctggatgcca

SEQ ID NO: 175832 - DNA, 25 bp, Rattus norvegicus
atatctgatcttttcctggatgcca

SEQ ID NO: 175833 - DNA, 25 bp, Rattus norvegicus
atatctgattaccttgtggtctcaa

SEQ ID NO: 175834 - DNA, 25 bp, Rattus norvegicus
atatctgattacgttgtggtctcaa

SEQ ID NO: 175835 - DNA, 25 bp, Rattus norvegicus
atatctgcactcaaaatccatgacc

SEQ ID NO: 175836 - DNA, 25 bp, Rattus norvegicus
atatctgcactctaaatccatgacc

SEQ ID NO: 175837 - DNA, 25 bp, Rattus norvegicus
atatctgcagggacttgacccacag

SEQ ID NO: 175838 - DNA, 25 bp, Rattus norvegicus
atatctgcagggtcttgacccacag

SEQ ID NO: 175839 - DNA, 25 bp, Rattus norvegicus
atatctgcatacatgccaccaagtt

SEQ ID NO: 175840 - DNA, 25 bp, Rattus norvegicus
atatctgcatacttgccaccaagtt

SEQ ID NO: 175841 - DNA, 25 bp, Rattus norvegicus
atatctgcatgcacacacagctact

SEQ ID NO: 175842 - DNA, 25 bp, Rattus norvegicus
atatctgcatgctcacacagctact

SEQ ID NO: 175843 - DNA, 25 bp, Rattus norvegicus
atatctgcatgtaatgtggaaggag

SEQ ID NO: 175844 - DNA, 25 bp, Rattus norvegicus
atatctgcatgttatgtggaaggag

SEQ ID NO: 175845 - DNA, 25 bp, Rattus norvegicus
atatctgcccatagaccaagcaggt

SEQ ID NO: 175846 - DNA, 25 bp, Rattus norvegicus
atatctgcccattgaccaagcaggt

SEQ ID NO: 175847 - DNA, 25 bp, Rattus norvegicus
atatctgcccgtacagaaccaacaa

SEQ ID NO: 175848 - DNA, 25 bp, Rattus norvegicus
atatctgcccgttcagaaccaacaa

SEQ ID NO: 175849 - DNA, 25 bp, Rattus norvegicus
atatctgccgtgcaggctgtctgaa

SEQ ID NO: 175850 - DNA, 25 bp, Rattus norvegicus
atatctgccgtggaggctgtctgaa

SEQ ID NO: 175851 - DNA, 25 bp, Rattus norvegicus
atatctgcctccagctaaaaccgat

SEQ ID NO: 175852 - DNA, 25 bp, Rattus norvegicus
atatctgcctcctgctaaaaccgat

SEQ ID NO: 175853 - DNA, 25 bp, Rattus norvegicus
atatctgcctgcctaaaggtggccc

SEQ ID NO: 175854 - DNA, 25 bp, Rattus norvegicus
atatctgcctgcgtaaaggtggccc

SEQ ID NO: 175855 - DNA, 25 bp, Rattus norvegicus
atatctgctcctcgatgcttctgtc

SEQ ID NO: 175856 - DNA, 25 bp, Rattus norvegicus
atatctgctcctggatgcttctgtc

SEQ ID NO: 175857 - DNA, 25 bp, Rattus norvegicus
atatctgctgctaactcagctgctg

SEQ ID NO: 175858 - DNA, 25 bp, Rattus norvegicus
atatctgctgcttactcagctgctg

SEQ ID NO: 175859 - DNA, 25 bp, Rattus norvegicus
atatctgcttcaagttccctataaa

SEQ ID NO: 175860 - DNA, 25 bp, Rattus norvegicus
atatctgcttcatgttccctataaa

SEQ ID NO: 175861 - DNA, 25 bp, Rattus norvegicus
atatctgggccactctaaactaaga

SEQ ID NO: 175862 - DNA, 25 bp, Rattus norvegicus
atatctgggccagtctaaactaaga

SEQ ID NO: 175863 - DNA, 25 bp, Rattus norvegicus
atatctgggtccaccctgaaagtga

SEQ ID NO: 175864 - DNA, 25 bp, Rattus norvegicus
atatctgggtcctccctgaaagtga

SEQ ID NO: 175865 - DNA, 25 bp, Rattus norvegicus
atatctggtaggatgcttcttgtgc

SEQ ID NO: 175866 - DNA, 25 bp, Rattus norvegicus
atatctggtaggttgcttcttgtgc

SEQ ID NO: 175867 - DNA, 25 bp, Rattus norvegicus
atatctggtgtaaatgtcaagacat

SEQ ID NO: 175868 - DNA, 25 bp, Rattus norvegicus
atatctggtgtatatgtcaagacat

SEQ ID NO: 175869 - DNA, 25 bp, Rattus norvegicus
atatctgtagaacccgaatgtgtga

SEQ ID NO: 175870 - DNA, 25 bp, Rattus norvegicus
atatctgtagaagccgaatgtgtga

SEQ ID NO: 175871 - DNA, 25 bp, Rattus norvegicus
atatctgtagataattttcccacta

SEQ ID NO: 175872 - DNA, 25 bp, Rattus norvegicus
atatctgtagattattttcccacta

SEQ ID NO: 175873 - DNA, 25 bp, Rattus norvegicus
atatctgtaggcatcatctttcgcc

SEQ ID NO: 175874 - DNA, 25 bp, Rattus norvegicus
atatctgtaggcttcatctttcgcc

SEQ ID NO: 175875 - DNA, 25 bp, Rattus norvegicus
atatctgtattcagcttggttaacg

SEQ ID NO: 175876 - DNA, 25 bp, Rattus norvegicus
atatctgtattctgcttggttaacg

SEQ ID NO: 175877 - DNA, 25 bp, Rattus norvegicus
atatctgtcagtactacatctatga

SEQ ID NO: 175878 - DNA, 25 bp, Rattus norvegicus
atatctgtcagttctacatctatga

SEQ ID NO: 175879 - DNA, 25 bp, Rattus norvegicus
atatctgtctctacctagtcaaagg

SEQ ID NO: 175880 - DNA, 25 bp, Rattus norvegicus
atatctgtctcttcctagtcaaagg

SEQ ID NO: 175881 - DNA, 25 bp, Rattus norvegicus
atatctgtctgtagttggcactcag

SEQ ID NO: 175882 - DNA, 25 bp, Rattus norvegicus
atatctgtctgttgttggcactcag

SEQ ID NO: 175883 - DNA, 25 bp, Rattus norvegicus
atatctgtgtccattcatgagtgac

SEQ ID NO: 175884 - DNA, 25 bp, Rattus norvegicus
atatctgtgtcctttcatgagtgac

SEQ ID NO: 175885 - DNA, 25 bp, Rattus norvegicus
atatctgttcagatttcccactgtg

SEQ ID NO: 175886 - DNA, 25 bp, Rattus norvegicus
atatctgttcagttttcccactgtg

SEQ ID NO: 175887 - DNA, 25 bp, Rattus norvegicus
atatctgttccccaatgttaggctg

SEQ ID NO: 175888 - DNA, 25 bp, Rattus norvegicus
atatctgttcccgaatgttaggctg

SEQ ID NO: 175889 - DNA, 25 bp, Rattus norvegicus
atatctgttggactctggcttggtc

SEQ ID NO: 175890 - DNA, 25 bp, Rattus norvegicus
atatctgttggagtctggcttggtc

SEQ ID NO: 175891 - DNA, 25 bp, Rattus norvegicus
atatctgtttatactttgccttcct

SEQ ID NO: 175892 - DNA, 25 bp, Rattus norvegicus
atatctgtttattctttgccttcct

SEQ ID NO: 175893 - DNA, 25 bp, Rattus norvegicus
atatcttacttgcagaggtctcaca

SEQ ID NO: 175894 - DNA, 25 bp, Rattus norvegicus
atatcttacttggagaggtctcaca

SEQ ID NO: 175895 - DNA, 25 bp, Rattus norvegicus
atatcttagtggaggtctggcagtc

SEQ ID NO: 175896 - DNA, 25 bp, Rattus norvegicus
atatcttagtggtggtctggcagtc

SEQ ID NO: 175897 - DNA, 25 bp, Rattus norvegicus
atatcttatctcctaagcacaacag

SEQ ID NO: 175898 - DNA, 25 bp, Rattus norvegicus
atatcttatctcgtaagcacaacag

SEQ ID NO: 175899 - DNA, 25 bp, Rattus norvegicus
atatcttattatccagcacccacta

SEQ ID NO: 175900 - DNA, 25 bp, Rattus norvegicus
atatcttattatgcagcacccacta

SEQ ID NO: 175901 - DNA, 25 bp, Rattus norvegicus
atatcttcaaatatctttacaacaa

SEQ ID NO: 175902 - DNA, 25 bp, Rattus norvegicus
atatcttcaaatttctttacaacaa

SEQ ID NO: 175903 - DNA, 25 bp, Rattus norvegicus
atatcttcagcaaatttccatccaa

SEQ ID NO: 175904 - DNA, 25 bp, Rattus norvegicus
atatcttcagcatatttccatccaa

SEQ ID NO: 175905 - DNA, 25 bp, Rattus norvegicus
atatcttcatcccactcatgtatga

SEQ ID NO: 175906 - DNA, 25 bp, Rattus norvegicus
atatcttcatccgactcatgtatga

SEQ ID NO: 175907 - DNA, 25 bp, Rattus norvegicus
atatcttcatgcaactagaacttct

SEQ ID NO: 175908 - DNA, 25 bp, Rattus norvegicus
atatcttcatgctactagaacttct

SEQ ID NO: 175909 - DNA, 25 bp, Rattus norvegicus
atatcttccccgatgattccgaaga

SEQ ID NO: 175910 - DNA, 25 bp, Rattus norvegicus
atatcttccccgttgattccgaaga

SEQ ID NO: 175911 - DNA, 25 bp, Rattus norvegicus
atatcttccctaccacagtggactg

SEQ ID NO: 175912 - DNA, 25 bp, Rattus norvegicus
atatcttccctagcacagtggactg

SEQ ID NO: 175913 - DNA, 25 bp, Rattus norvegicus
atatcttcgagccatcttcagaaat

SEQ ID NO: 175914 - DNA, 25 bp, Rattus norvegicus
atatcttcgagcgatcttcagaaat

SEQ ID NO: 175915 - DNA, 25 bp, Rattus norvegicus
atatcttcggttcggtgactttgga

SEQ ID NO: 175916 - DNA, 25 bp, Rattus norvegicus
atatcttcggttgggtgactttgga

SEQ ID NO: 175917 - DNA, 25 bp, Rattus norvegicus
atatcttcgtacatctcgaggcagt

SEQ ID NO: 175918 - DNA, 25 bp, Rattus norvegicus
atatcttcgtacttctcgaggcagt

SEQ ID NO: 175919 - DNA, 25 bp, Rattus norvegicus
atatcttctcccctataaccttgtt

SEQ ID NO: 175920 - DNA, 25 bp, Rattus norvegicus
atatcttctcccgtataaccttgtt

SEQ ID NO: 175921 - DNA, 25 bp, Rattus norvegicus
atatcttctgtaacatcacttggta

SEQ ID NO: 175922 - DNA, 25 bp, Rattus norvegicus
atatcttctgtaatctgtcttccgc

SEQ ID NO: 175923 - DNA, 25 bp, Rattus norvegicus
atatcttctgtatcatcacttggta

SEQ ID NO: 175924 - DNA, 25 bp, Rattus norvegicus
atatcttctgtattctgtcttccgc

SEQ ID NO: 175925 - DNA, 25 bp, Rattus norvegicus
atatcttgcattcctgcaggcaggg

SEQ ID NO: 175926 - DNA, 25 bp, Rattus norvegicus
atatcttgcattgctgcaggcaggg

SEQ ID NO: 175927 - DNA, 25 bp, Rattus norvegicus
atatcttgccttagccacttgtatg

SEQ ID NO: 175928 - DNA, 25 bp, Rattus norvegicus
atatcttgcctttgccacttgtatg

SEQ ID NO: 175929 - DNA, 25 bp, Rattus norvegicus
atatcttgctgtacaatgcctgtga

SEQ ID NO: 175930 - DNA, 25 bp, Rattus norvegicus
atatcttgctgttcaatgcctgtga

SEQ ID NO: 175931 - DNA, 25 bp, Rattus norvegicus
atatcttgggacaccccagtgtgga

SEQ ID NO: 175932 - DNA, 25 bp, Rattus norvegicus
atatcttgggactccccagtgtgga

SEQ ID NO: 175933 - DNA, 25 bp, Rattus norvegicus
atatcttgggcacacactcccgtaa

SEQ ID NO: 175934 - DNA, 25 bp, Rattus norvegicus
atatcttgggcagacactcccgtaa

SEQ ID NO: 175935 - DNA, 25 bp, Rattus norvegicus
atatcttgtggcatccagagcgctg

SEQ ID NO: 175936 - DNA, 25 bp, Rattus norvegicus
atatcttgtggcttccagagcgctg

SEQ ID NO: 175937 - DNA, 25 bp, Rattus norvegicus
atatcttgtgtgaccgagaggcaac

SEQ ID NO: 175938 - DNA, 25 bp, Rattus norvegicus
atatcttgtgtgtccgagaggcaac

SEQ ID NO: 175939 - DNA, 25 bp, Rattus norvegicus
atatcttgttctagttgagggcaac

SEQ ID NO: 175940 - DNA, 25 bp, Rattus norvegicus
atatcttgttcttgttgagggcaac

SEQ ID NO: 175941 - DNA, 25 bp, Rattus norvegicus
atatctttacttccttttctatcga

SEQ ID NO: 175942 - DNA, 25 bp, Rattus norvegicus
atatctttacttgcttttctatcga

SEQ ID NO: 175943 - DNA, 25 bp, Rattus norvegicus
atatctttatcgatcatctgcctgc

SEQ ID NO: 175944 - DNA, 25 bp, Rattus norvegicus
atatctttatcgttcatctgcctgc

SEQ ID NO: 175945 - DNA, 25 bp, Rattus norvegicus
atatctttgagacctcatctgagga

SEQ ID NO: 175946 - DNA, 25 bp, Rattus norvegicus
atatctttgagagctcatctgagga

SEQ ID NO: 175947 - DNA, 25 bp, Rattus norvegicus
atatcttttaagactcatttgccta

SEQ ID NO: 175948 - DNA, 25 bp, Rattus norvegicus
atatcttttaagtctcatttgccta

SEQ ID NO: 175949 - DNA, 25 bp, Rattus norvegicus
atatcttttcataccactgtgtaaa

SEQ ID NO: 175950 - DNA, 25 bp, Rattus norvegicus
atatcttttcattccactgtgtaaa

SEQ ID NO: 175951 - DNA, 25 bp, Rattus norvegicus
atatcttttgaaaccatgtgtgagt

SEQ ID NO: 175952 - DNA, 25 bp, Rattus norvegicus
atatcttttgaatccatgtgtgagt

SEQ ID NO: 175953 - DNA, 25 bp, Rattus norvegicus
atatcttttgtacatgtgtctatct

SEQ ID NO: 175954 - DNA, 25 bp, Rattus norvegicus
atatcttttgtagatgtgtctatct

SEQ ID NO: 175955 - DNA, 25 bp, Rattus norvegicus
atatcttttgtgctgtttgatactt

SEQ ID NO: 175956 - DNA, 25 bp, Rattus norvegicus
atatcttttgtggtgtttgatactt

SEQ ID NO: 175957 - DNA, 25 bp, Rattus norvegicus
atatctttttacaatgctgttggtt

SEQ ID NO: 175958 - DNA, 25 bp, Rattus norvegicus
atatctttttactatgctgttggtt

SEQ ID NO: 175959 - DNA, 25 bp, Rattus norvegicus
atatctttttgtcccatgtcagcat

SEQ ID NO: 175960 - DNA, 25 bp, Rattus norvegicus
atatctttttgtgccatgtcagcat

SEQ ID NO: 175961 - DNA, 25 bp, Rattus norvegicus
atatgaaaaattagaggccgtccag

SEQ ID NO: 175962 - DNA, 25 bp, Rattus norvegicus
atatgaaaaatttgaggccgtccag

SEQ ID NO: 175963 - DNA, 25 bp, Rattus norvegicus
atatgaaaacttaaccaactcttgt

SEQ ID NO: 175964 - DNA, 25 bp, Rattus norvegicus
atatgaaaactttaccaactcttgt

SEQ ID NO: 175965 - DNA, 25 bp, Rattus norvegicus
atatgaaagagcaggccctaggcct

SEQ ID NO: 175966 - DNA, 25 bp, Rattus norvegicus
atatgaaagagctggccctaggcct

SEQ ID NO: 175967 - DNA, 25 bp, Rattus norvegicus
atatgaacagcaccaagctctcggc

SEQ ID NO: 175968 - DNA, 25 bp, Rattus norvegicus
atatgaacagcagcaagctctcggc

SEQ ID NO: 175969 - DNA, 25 bp, Rattus norvegicus
atatgaacgtgccctgggaggaact

SEQ ID NO: 175970 - DNA, 25 bp, Rattus norvegicus
atatgaacgtgcgctgggaggaact

SEQ ID NO: 175971 - DNA, 25 bp, Rattus norvegicus
atatgaactgtcatctcatagccct

SEQ ID NO: 175972 - DNA, 25 bp, Rattus norvegicus
atatgaactgtcttctcatagccct

SEQ ID NO: 175973 - DNA, 25 bp, Rattus norvegicus
atatgaaggactccctgtggtggca

SEQ ID NO: 175974 - DNA, 25 bp, Rattus norvegicus
atatgaaggactgcctgtggtggca

SEQ ID NO: 175975 - DNA, 25 bp, Rattus norvegicus
atatgaagggcgctctttcttgtca

SEQ ID NO: 175976 - DNA, 25 bp, Rattus norvegicus
atatgaagggcggtctttcttgtca

SEQ ID NO: 175977 - DNA, 25 bp, Rattus norvegicus
atatgaagttccaggcaagccaggg

SEQ ID NO: 175978 - DNA, 25 bp, Rattus norvegicus
atatgaagttcctggcaagccaggg

SEQ ID NO: 175979 - DNA, 25 bp, Rattus norvegicus
atatgaatacgccaattctaccggg

SEQ ID NO: 175980 - DNA, 25 bp, Rattus norvegicus
atatgaatacgcgaattctaccggg

SEQ ID NO: 175981 - DNA, 25 bp, Rattus norvegicus
atatgaatatatatctgacattggg

SEQ ID NO: 175982 - DNA, 25 bp, Rattus norvegicus
atatgaatatatttctgacattggg

SEQ ID NO: 175983 - DNA, 25 bp, Rattus norvegicus
atatgaatgtcaactgcggcaccgc

SEQ ID NO: 175984 - DNA, 25 bp, Rattus norvegicus
atatgaatgtcatctgcggcaccgc

SEQ ID NO: 175985 - DNA, 25 bp, Rattus norvegicus
atatgaattccgaggcaccgaggga

SEQ ID NO: 175986 - DNA, 25 bp, Rattus norvegicus
atatgaattccgtggcaccgaggga

SEQ ID NO: 175987 - DNA, 25 bp, Rattus norvegicus
atatgaattgtaccgaccccagact

SEQ ID NO: 175988 - DNA, 25 bp, Rattus norvegicus
atatgaattgtagcgaccccagact

SEQ ID NO: 175989 - DNA, 25 bp, Rattus norvegicus
atatgacaatcaaccgtgggtggta

SEQ ID NO: 175990 - DNA, 25 bp, Rattus norvegicus
atatgacaatcatccgtgggtggta

SEQ ID NO: 175991 - DNA, 25 bp, Rattus norvegicus
atatgacacgttaatccagaggatc

SEQ ID NO: 175992 - DNA, 25 bp, Rattus norvegicus
atatgacacgtttatccagaggatc

SEQ ID NO: 175993 - DNA, 25 bp, Rattus norvegicus
atatgacactgtccttcgcaacaga

SEQ ID NO: 175994 - DNA, 25 bp, Rattus norvegicus
atatgacactgtgcttcgcaacaga

SEQ ID NO: 175995 - DNA, 25 bp, Rattus norvegicus
atatgacagaacaccactttgaccc

SEQ ID NO: 175996 - DNA, 25 bp, Rattus norvegicus
atatgacagaactccactttgaccc

SEQ ID NO: 175997 - DNA, 25 bp, Rattus norvegicus
atatgacagagtccacaaagccctg

SEQ ID NO: 175998 - DNA, 25 bp, Rattus norvegicus
atatgacagagtgcacaaagccctg

SEQ ID NO: 175999 - DNA, 25 bp, Rattus norvegicus
atatgaccaaagaacccactctcac

SEQ ID NO: 176000 - DNA, 25 bp, Rattus norvegicus
atatgaccaaagtacccactctcac

SEQ ID NO: 176001 - DNA, 25 bp, Rattus norvegicus
atatgaccaatcactgtgactcgct

SEQ ID NO: 176002 - DNA, 25 bp, Rattus norvegicus
atatgaccaatctctgtgactcgct

SEQ ID NO: 176003 - DNA, 25 bp, Rattus norvegicus
atatgaccactaaaaacgctgaggg

SEQ ID NO: 176004 - DNA, 25 bp, Rattus norvegicus
atatgaccactataaacgctgaggg

SEQ ID NO: 176005 - DNA, 25 bp, Rattus norvegicus
atatgacccaagaccaagttgagga

SEQ ID NO: 176006 - DNA, 25 bp, Rattus norvegicus
atatgacccaagtccaagttgagga

SEQ ID NO: 176007 - DNA, 25 bp, Rattus norvegicus
atatgaccccgtatatccctgtgtt

SEQ ID NO: 176008 - DNA, 25 bp, Rattus norvegicus
atatgaccccgtttatccctgtgtt

SEQ ID NO: 176009 - DNA, 25 bp, Rattus norvegicus
atatgaccccttcatgtcgtaagga

SEQ ID NO: 176010 - DNA, 25 bp, Rattus norvegicus
atatgaccccttgatgtcgtaagga

SEQ ID NO: 176011 - DNA, 25 bp, Rattus norvegicus
atatgacccggtattgcagtcggac

SEQ ID NO: 176012 - DNA, 25 bp, Rattus norvegicus
atatgacccggttttgcagtcggac

SEQ ID NO: 176013 - DNA, 25 bp, Rattus norvegicus
atatgaccgatcatccaatgctgag

SEQ ID NO: 176014 - DNA, 25 bp, Rattus norvegicus
atatgaccgatcttccaatgctgag

SEQ ID NO: 176015 - DNA, 25 bp, Rattus norvegicus
atatgacctgttatacaagtatcac

SEQ ID NO: 176016 - DNA, 25 bp, Rattus norvegicus
atatgacctgttttacaagtatcac

SEQ ID NO: 176017 - DNA, 25 bp, Rattus norvegicus
atatgaccttttcagccagcagcat

SEQ ID NO: 176018 - DNA, 25 bp, Rattus norvegicus
atatgaccttttgagccagcagcat

SEQ ID NO: 176019 - DNA, 25 bp, Rattus norvegicus
atatgacggactccttcgtgctgga

SEQ ID NO: 176020 - DNA, 25 bp, Rattus norvegicus
atatgacggactgcttcgtgctgga

SEQ ID NO: 176021 - DNA, 25 bp, Rattus norvegicus
atatgacggtcaactcccaattgaa

SEQ ID NO: 176022 - DNA, 25 bp, Rattus norvegicus
atatgacggtcacaggaaactttaa

SEQ ID NO: 176023 - DNA, 25 bp, Rattus norvegicus
atatgacggtcagaggaaactttaa

SEQ ID NO: 176024 - DNA, 25 bp, Rattus norvegicus
atatgacggtcatctcccaattgaa

SEQ ID NO: 176025 - DNA, 25 bp, Rattus norvegicus
atatgactatccctgtccccaattg

SEQ ID NO: 176026 - DNA, 25 bp, Rattus norvegicus
atatgactatccgtgtccccaattg

SEQ ID NO: 176027 - DNA, 25 bp, Rattus norvegicus
atatgactccaactggcacaggaaa

SEQ ID NO: 176028 - DNA, 25 bp, Rattus norvegicus
atatgactccaagtggcacaggaaa

SEQ ID NO: 176029 - DNA, 25 bp, Rattus norvegicus
atatgactcctgatcttgaactcta

SEQ ID NO: 176030 - DNA, 25 bp, Rattus norvegicus
atatgactcctgttcttgaactcta

SEQ ID NO: 176031 - DNA, 25 bp, Rattus norvegicus
atatgactctcacacaggatcaggg

SEQ ID NO: 176032 - DNA, 25 bp, Rattus norvegicus
atatgactctcagacaggatcaggg

SEQ ID NO: 176033 - DNA, 25 bp, Rattus norvegicus
atatgactgcgcagcatgtgcagac

SEQ ID NO: 176034 - DNA, 25 bp, Rattus norvegicus
atatgactgcgctgcatgtgcagac

SEQ ID NO: 176035 - DNA, 25 bp, Rattus norvegicus
atatgactgcttcctgcgtactagg

SEQ ID NO: 176036 - DNA, 25 bp, Rattus norvegicus
atatgactgcttgctgcgtactagg

SEQ ID NO: 176037 - DNA, 25 bp, Rattus norvegicus
atatgactgtccctgtgcctgaagc

SEQ ID NO: 176038 - DNA, 25 bp, Rattus norvegicus
atatgactgtccgtgtgcctgaagc

SEQ ID NO: 176039 - DNA, 25 bp, Rattus norvegicus
atatgactgtgtacattctgcttac

SEQ ID NO: 176040 - DNA, 25 bp, Rattus norvegicus
atatgactgtgttcattctgcttac

SEQ ID NO: 176041 - DNA, 25 bp, Rattus norvegicus
atatgacttactatgggccagcaag

SEQ ID NO: 176042 - DNA, 25 bp, Rattus norvegicus
atatgacttactcagggtggaccta

SEQ ID NO: 176043 - DNA, 25 bp, Rattus norvegicus
atatgacttactgagggtggaccta

SEQ ID NO: 176044 - DNA, 25 bp, Rattus norvegicus
atatgacttactttgggccagcaag

SEQ ID NO: 176045 - DNA, 25 bp, Rattus norvegicus
atatgagaacttcgtcctcgcggtc

SEQ ID NO: 176046 - DNA, 25 bp, Rattus norvegicus
atatgagaacttcttcctccctttg

SEQ ID NO: 176047 - DNA, 25 bp, Rattus norvegicus
atatgagaacttggtcctcgcggtc

SEQ ID NO: 176048 - DNA, 25 bp, Rattus norvegicus
atatgagaacttgttcctccctttg

SEQ ID NO: 176049 - DNA, 25 bp, Rattus norvegicus
atatgagactatattccacctggga

SEQ ID NO: 176050 - DNA, 25 bp, Rattus norvegicus
atatgagactattttccacctggga

SEQ ID NO: 176051 - DNA, 25 bp, Rattus norvegicus
atatgagagcccacgcctgaaataa

SEQ ID NO: 176052 - DNA, 25 bp, Rattus norvegicus
atatgagagccctcgcctgaaataa

SEQ ID NO: 176053 - DNA, 25 bp, Rattus norvegicus
atatgagagcgcatgccctggaaaa

SEQ ID NO: 176054 - DNA, 25 bp, Rattus norvegicus
atatgagagcgcttgccctggaaaa

SEQ ID NO: 176055 - DNA, 25 bp, Rattus norvegicus
atatgagagcttcggctgtttacct

SEQ ID NO: 176056 - DNA, 25 bp, Rattus norvegicus
atatgagagcttgggctgtttacct

SEQ ID NO: 176057 - DNA, 25 bp, Rattus norvegicus
atatgagatcaaccttccaccaatc

SEQ ID NO: 176058 - DNA, 25 bp, Rattus norvegicus
atatgagatcaagcttccaccaatc

SEQ ID NO: 176059 - DNA, 25 bp, Rattus norvegicus
atatgagatgctagaacactgtaca

SEQ ID NO: 176060 - DNA, 25 bp, Rattus norvegicus
atatgagatgcttgaacactgtaca

SEQ ID NO: 176061 - DNA, 25 bp, Rattus norvegicus
atatgagcactactggttcctcttg

SEQ ID NO: 176062 - DNA, 25 bp, Rattus norvegicus
atatgagcactagtggttcctcttg

SEQ ID NO: 176063 - DNA, 25 bp, Rattus norvegicus
atatgagcagcactcggctatgatt

SEQ ID NO: 176064 - DNA, 25 bp, Rattus norvegicus
atatgagcagcagtcggctatgatt

SEQ ID NO: 176065 - DNA, 25 bp, Rattus norvegicus
atatgagccaatacgttgcatctgt

SEQ ID NO: 176066 - DNA, 25 bp, Rattus norvegicus
atatgagccaattcgttgcatctgt

SEQ ID NO: 176067 - DNA, 25 bp, Rattus norvegicus
atatgagccacaagatgtccgtctc

SEQ ID NO: 176068 - DNA, 25 bp, Rattus norvegicus
atatgagccacatgatgtccgtctc

SEQ ID NO: 176069 - DNA, 25 bp, Rattus norvegicus
atatgagcgtgtcgtctctgcagga

SEQ ID NO: 176070 - DNA, 25 bp, Rattus norvegicus
atatgagcgtgtggtctctgcagga

SEQ ID NO: 176071 - DNA, 25 bp, Rattus norvegicus
atatgagctcctcctaaaacggccc

SEQ ID NO: 176072 - DNA, 25 bp, Rattus norvegicus
atatgagctcctgctaaaacggccc

SEQ ID NO: 176073 - DNA, 25 bp, Rattus norvegicus
atatgagctctaacgtgctggacag

SEQ ID NO: 176074 - DNA, 25 bp, Rattus norvegicus
atatgagctctatcgtgctggacag

SEQ ID NO: 176075 - DNA, 25 bp, Rattus norvegicus
atatgaggacctctacatgccccag

SEQ ID NO: 176076 - DNA, 25 bp, Rattus norvegicus
atatgaggacctgtacatgccccag

SEQ ID NO: 176077 - DNA, 25 bp, Rattus norvegicus
atatgaggagataacgcccctgctc

SEQ ID NO: 176078 - DNA, 25 bp, Rattus norvegicus
atatgaggagattacgcccctgctc

SEQ ID NO: 176079 - DNA, 25 bp, Rattus norvegicus
atatgaggcattccctgtgctgcct

SEQ ID NO: 176080 - DNA, 25 bp, Rattus norvegicus
atatgaggcattgcctgtgctgcct

SEQ ID NO: 176081 - DNA, 25 bp, Rattus norvegicus
atatgaggtcagagggagctcgcct

SEQ ID NO: 176082 - DNA, 25 bp, Rattus norvegicus
atatgaggtcagtgggagctcgcct

SEQ ID NO: 176083 - DNA, 25 bp, Rattus norvegicus
atatgagtagatcagcttttgctta

SEQ ID NO: 176084 - DNA, 25 bp, Rattus norvegicus
atatgagtagatgagcttttgctta

SEQ ID NO: 176085 - DNA, 25 bp, Rattus norvegicus
atatgagtctgtatcacctgggcta

SEQ ID NO: 176086 - DNA, 25 bp, Rattus norvegicus
atatgagtctgtttcacctgggcta

SEQ ID NO: 176087 - DNA, 25 bp, Rattus norvegicus
atatgagtcttcactgtgctgtgca

SEQ ID NO: 176088 - DNA, 25 bp, Rattus norvegicus
atatgagtcttctctgtgctgtgca

SEQ ID NO: 176089 - DNA, 25 bp, Rattus norvegicus
atatgataaaatactgctgctgact

SEQ ID NO: 176090 - DNA, 25 bp, Rattus norvegicus
atatgataaaattctgctgctgact

SEQ ID NO: 176091 - DNA, 25 bp, Rattus norvegicus
atatgatacaggacgggatggttcc

SEQ ID NO: 176092 - DNA, 25 bp, Rattus norvegicus
atatgatacaggtcgggatggttcc

SEQ ID NO: 176093 - DNA, 25 bp, Rattus norvegicus
atatgatagctaatcgcctttccct

SEQ ID NO: 176094 - DNA, 25 bp, Rattus norvegicus
atatgatagctattcgcctttccct

SEQ ID NO: 176095 - DNA, 25 bp, Rattus norvegicus
atatgatctagaatattcccggtag

SEQ ID NO: 176096 - DNA, 25 bp, Rattus norvegicus
atatgatctagattattcccggtag

SEQ ID NO: 176097 - DNA, 25 bp, Rattus norvegicus
atatgatctcgtagtgttttgctaa

SEQ ID NO: 176098 - DNA, 25 bp, Rattus norvegicus
atatgatctcgttgtgttttgctaa

SEQ ID NO: 176099 - DNA, 25 bp, Rattus norvegicus
atatgatgttggagtctgagtcgtc

SEQ ID NO: 176100 - DNA, 25 bp, Rattus norvegicus
atatgatgttggtgtctgagtcgtc

SEQ ID NO: 176101 - DNA, 25 bp, Rattus norvegicus
atatgatttcacaaatctcaaacag

SEQ ID NO: 176102 - DNA, 25 bp, Rattus norvegicus
atatgatttcactaatctcaaacag

SEQ ID NO: 176103 - DNA, 25 bp, Rattus norvegicus
atatgcaaaacccttttccattcca

SEQ ID NO: 176104 - DNA, 25 bp, Rattus norvegicus
atatgcaaaaccgttttccattcca

SEQ ID NO: 176105 - DNA, 25 bp, Rattus norvegicus
atatgcaaatgacgtcccaatccca

SEQ ID NO: 176106 - DNA, 25 bp, Rattus norvegicus
atatgcaaatgaggtcccaatccca

SEQ ID NO: 176107 - DNA, 25 bp, Rattus norvegicus
atatgcaacacaagcctgtctggca

SEQ ID NO: 176108 - DNA, 25 bp, Rattus norvegicus
atatgcaacacatgcctgtctggca

SEQ ID NO: 176109 - DNA, 25 bp, Rattus norvegicus
atatgcaacctccaaacttaccatt

SEQ ID NO: 176110 - DNA, 25 bp, Rattus norvegicus
atatgcaacctcgaaacttaccatt

SEQ ID NO: 176111 - DNA, 25 bp, Rattus norvegicus
atatgcaatcatacacgtgtgttat

SEQ ID NO: 176112 - DNA, 25 bp, Rattus norvegicus
atatgcaatcattcacgtgtgttat

SEQ ID NO: 176113 - DNA, 25 bp, Rattus norvegicus
atatgcaatgccactaacccataca

SEQ ID NO: 176114 - DNA, 25 bp, Rattus norvegicus
atatgcaatgccatggacctagaac

SEQ ID NO: 176115 - DNA, 25 bp, Rattus norvegicus
atatgcaatgcctctaacccataca

SEQ ID NO: 176116 - DNA, 25 bp, Rattus norvegicus
atatgcaatgccttggacctagaac

SEQ ID NO: 176117 - DNA, 25 bp, Rattus norvegicus
atatgcaatgggagtcccaggctgg

SEQ ID NO: 176118 - DNA, 25 bp, Rattus norvegicus
atatgcaatgggtgtcccaggctgg

SEQ ID NO: 176119 - DNA, 25 bp, Rattus norvegicus
atatgcacagcaacagccgttgtca

SEQ ID NO: 176120 - DNA, 25 bp, Rattus norvegicus
atatgcacagcatcagccgttgtca

SEQ ID NO: 176121 - DNA, 25 bp, Rattus norvegicus
atatgcactaaccttttttgatggc

SEQ ID NO: 176122 - DNA, 25 bp, Rattus norvegicus
atatgcactaacgttttttgatggc

SEQ ID NO: 176123 - DNA, 25 bp, Rattus norvegicus
atatgcactcacaaggctgctttta

SEQ ID NO: 176124 - DNA, 25 bp, Rattus norvegicus
atatgcactcactaggctgctttta

SEQ ID NO: 176125 - DNA, 25 bp, Rattus norvegicus
atatgcactcgcagtcattgggctt

SEQ ID NO: 176126 - DNA, 25 bp, Rattus norvegicus
atatgcactcgctgtcattgggctt

SEQ ID NO: 176127 - DNA, 25 bp, Rattus norvegicus
atatgcactgccaacatgaggctgt

SEQ ID NO: 176128 - DNA, 25 bp, Rattus norvegicus
atatgcactgcctacatgaggctgt

SEQ ID NO: 176129 - DNA, 25 bp, Rattus norvegicus
atatgcagagacaggagcctctccc

SEQ ID NO: 176130 - DNA, 25 bp, Rattus norvegicus
atatgcagagactggagcctctccc

SEQ ID NO: 176131 - DNA, 25 bp, Rattus norvegicus
atatgcagatgaaagtcagggagct

SEQ ID NO: 176132 - DNA, 25 bp, Rattus norvegicus
atatgcagatgatagtcagggagct

SEQ ID NO: 176133 - DNA, 25 bp, Rattus norvegicus
atatgcagctcaccttttgggctca

SEQ ID NO: 176134 - DNA, 25 bp, Rattus norvegicus
atatgcagctcagcttttgggctca

SEQ ID NO: 176135 - DNA, 25 bp, Rattus norvegicus
atatgcagctgcatcttggacagaa

SEQ ID NO: 176136 - DNA, 25 bp, Rattus norvegicus
atatgcagctgcttcttggacagaa

SEQ ID NO: 176137 - DNA, 25 bp, Rattus norvegicus
atatgcagcttgacctttatgtggg

SEQ ID NO: 176138 - DNA, 25 bp, Rattus norvegicus
atatgcagcttgtcctttatgtggg

SEQ ID NO: 176139 - DNA, 25 bp, Rattus norvegicus
atatgcagctttcctgattacagca

SEQ ID NO: 176140 - DNA, 25 bp, Rattus norvegicus
atatgcagctttgctgattacagca

SEQ ID NO: 176141 - DNA, 25 bp, Rattus norvegicus
atatgcaggcaaacacttgcacata

SEQ ID NO: 176142 - DNA, 25 bp, Rattus norvegicus
atatgcaggcaatcacttgcacata

SEQ ID NO: 176143 - DNA, 25 bp, Rattus norvegicus
atatgcagtgaacccttcgagccac

SEQ ID NO: 176144 - DNA, 25 bp, Rattus norvegicus
atatgcagtgaagccttcgagccac

SEQ ID NO: 176145 - DNA, 25 bp, Rattus norvegicus
atatgcagttgtaaactcttcaaag

SEQ ID NO: 176146 - DNA, 25 bp, Rattus norvegicus
atatgcagttgttaactcttcaaag

SEQ ID NO: 176147 - DNA, 25 bp, Rattus norvegicus
atatgcatccttacagtcaagcagc

SEQ ID NO: 176148 - DNA, 25 bp, Rattus norvegicus
atatgcatcctttcagtcaagcagc

SEQ ID NO: 176149 - DNA, 25 bp, Rattus norvegicus
atatgcatggaaactctccctttgg

SEQ ID NO: 176150 - DNA, 25 bp, Rattus norvegicus
atatgcatggaatctctccctttgg

SEQ ID NO: 176151 - DNA, 25 bp, Rattus norvegicus
atatgcatggtgagggcagacttca

SEQ ID NO: 176152 - DNA, 25 bp, Rattus norvegicus
atatgcatggtgtgggcagacttca

SEQ ID NO: 176153 - DNA, 25 bp, Rattus norvegicus
atatgcatgtcaacgtaacgcctag

SEQ ID NO: 176154 - DNA, 25 bp, Rattus norvegicus
atatgcatgtcatcgtaacgcctag

SEQ ID NO: 176155 - DNA, 25 bp, Rattus norvegicus
atatgcattcgtagttgctttttga

SEQ ID NO: 176156 - DNA, 25 bp, Rattus norvegicus
atatgcattcgttgttgctttttga

SEQ ID NO: 176157 - DNA, 25 bp, Rattus norvegicus
atatgcattgtaccaaggacctcag

SEQ ID NO: 176158 - DNA, 25 bp, Rattus norvegicus
atatgcattgtagcaaggacctcag

SEQ ID NO: 176159 - DNA, 25 bp, Rattus norvegicus
atatgcatttggactgtactgatca

SEQ ID NO: 176160 - DNA, 25 bp, Rattus norvegicus
atatgcatttggtctgtactgatca

SEQ ID NO: 176161 - DNA, 25 bp, Rattus norvegicus
atatgccaaggactgactgggccta

SEQ ID NO: 176162 - DNA, 25 bp, Rattus norvegicus
atatgccaaggagtgactgggccta

SEQ ID NO: 176163 - DNA, 25 bp, Rattus norvegicus
atatgccaagtacatcttcctagaa

SEQ ID NO: 176164 - DNA, 25 bp, Rattus norvegicus
atatgccaagtacttcaaccctgtg

SEQ ID NO: 176165 - DNA, 25 bp, Rattus norvegicus
atatgccaagtagatcttcctagaa

SEQ ID NO: 176166 - DNA, 25 bp, Rattus norvegicus
atatgccaagtagttcaaccctgtg

SEQ ID NO: 176167 - DNA, 25 bp, Rattus norvegicus
atatgccaagtcaactgccttacag

SEQ ID NO: 176168 - DNA, 25 bp, Rattus norvegicus
atatgccaagtctactgccttacag

SEQ ID NO: 176169 - DNA, 25 bp, Rattus norvegicus
atatgccaatttcaactgctttgag

SEQ ID NO: 176170 - DNA, 25 bp, Rattus norvegicus
atatgccaatttgaactgctttgag

SEQ ID NO: 176171 - DNA, 25 bp, Rattus norvegicus
atatgccactaaaaacgacggtgta

SEQ ID NO: 176172 - DNA, 25 bp, Rattus norvegicus
atatgccactaataacgacggtgta

SEQ ID NO: 176173 - DNA, 25 bp, Rattus norvegicus
atatgccaggttcgttgtcccagag

SEQ ID NO: 176174 - DNA, 25 bp, Rattus norvegicus
atatgccaggttggttgtcccagag

SEQ ID NO: 176175 - DNA, 25 bp, Rattus norvegicus
atatgccatagacttccttggagaa

SEQ ID NO: 176176 - DNA, 25 bp, Rattus norvegicus
atatgccatagagttccttggagaa

SEQ ID NO: 176177 - DNA, 25 bp, Rattus norvegicus
atatgccatataatgcgcctttccc

SEQ ID NO: 176178 - DNA, 25 bp, Rattus norvegicus
atatgccatatattgcgcctttccc

SEQ ID NO: 176179 - DNA, 25 bp, Rattus norvegicus
atatgccatccgaccatctgtaatg

SEQ ID NO: 176180 - DNA, 25 bp, Rattus norvegicus
atatgccatccgtccatctgtaatg

SEQ ID NO: 176181 - DNA, 25 bp, Rattus norvegicus
atatgcccaataatccagccatgtc

SEQ ID NO: 176182 - DNA, 25 bp, Rattus norvegicus
atatgcccaatattccagccatgtc

SEQ ID NO: 176183 - DNA, 25 bp, Rattus norvegicus
atatgcccattcaggaacatggcct

SEQ ID NO: 176184 - DNA, 25 bp, Rattus norvegicus
atatgcccattctggaacatggcct

SEQ ID NO: 176185 - DNA, 25 bp, Rattus norvegicus
atatgccccaacagaactacatcaa

SEQ ID NO: 176186 - DNA, 25 bp, Rattus norvegicus
atatgccccaactgaactacatcaa

SEQ ID NO: 176187 - DNA, 25 bp, Rattus norvegicus
atatgccccgtgcattctgtgtagg

SEQ ID NO: 176188 - DNA, 25 bp, Rattus norvegicus
atatgccccgtggattctgtgtagg

SEQ ID NO: 176189 - DNA, 25 bp, Rattus norvegicus
atatgccctaatcccttaagtaaaa

SEQ ID NO: 176190 - DNA, 25 bp, Rattus norvegicus
atatgccctaatgccttaagtaaaa

SEQ ID NO: 176191 - DNA, 25 bp, Rattus norvegicus
atatgccctacaaggatgctgtggt

SEQ ID NO: 176192 - DNA, 25 bp, Rattus norvegicus
atatgccctacatggatgctgtggt

SEQ ID NO: 176193 - DNA, 25 bp, Rattus norvegicus
atatgccctggtctttgttcctaca

SEQ ID NO: 176194 - DNA, 25 bp, Rattus norvegicus
atatgccctggtgtttgttcctaca

SEQ ID NO: 176195 - DNA, 25 bp, Rattus norvegicus
atatgcccttgcctggaggagtcat

SEQ ID NO: 176196 - DNA, 25 bp, Rattus norvegicus
atatgcccttgcgtggaggagtcat

SEQ ID NO: 176197 - DNA, 25 bp, Rattus norvegicus
atatgccggaggaaccagtgcgcat

SEQ ID NO: 176198 - DNA, 25 bp, Rattus norvegicus
atatgccggaggtaccagtgcgcat

SEQ ID NO: 176199 - DNA, 25 bp, Rattus norvegicus
atatgccggcatctcctcttggctg

SEQ ID NO: 176200 - DNA, 25 bp, Rattus norvegicus
atatgccggcatgtcctcttggctg

SEQ ID NO: 176201 - DNA, 25 bp, Rattus norvegicus
atatgccgggccagatatgtggcta

SEQ ID NO: 176202 - DNA, 25 bp, Rattus norvegicus
atatgccgggcctgatatgtggcta

SEQ ID NO: 176203 - DNA, 25 bp, Rattus norvegicus
atatgcctcaggagtgttttatgaa

SEQ ID NO: 176204 - DNA, 25 bp, Rattus norvegicus
atatgcctcaggtgtgttttatgaa

SEQ ID NO: 176205 - DNA, 25 bp, Rattus norvegicus
atatgcctccacaagatggctacca

SEQ ID NO: 176206 - DNA, 25 bp, Rattus norvegicus
atatgcctccactagatggctacca

SEQ ID NO: 176207 - DNA, 25 bp, Rattus norvegicus
atatgccttcttcgtcatggtcgtg

SEQ ID NO: 176208 - DNA, 25 bp, Rattus norvegicus
atatgccttcttggtcatggtcgtg

SEQ ID NO: 176209 - DNA, 25 bp, Rattus norvegicus
atatgccttgggatttcgacttttg

SEQ ID NO: 176210 - DNA, 25 bp, Rattus norvegicus
atatgccttgggttttcgacttttg

SEQ ID NO: 176211 - DNA, 25 bp, Rattus norvegicus
atatgcctttggaattgggaagtct

SEQ ID NO: 176212 - DNA, 25 bp, Rattus norvegicus
atatgcctttggtattgggaagtct

SEQ ID NO: 176213 - DNA, 25 bp, Rattus norvegicus
atatgcgaagctatcaccaaatgga

SEQ ID NO: 176214 - DNA, 25 bp, Rattus norvegicus
atatgcgaagctttcaccaaatgga

SEQ ID NO: 176215 - DNA, 25 bp, Rattus norvegicus
atatgcgactaccactggcaggtct

SEQ ID NO: 176216 - DNA, 25 bp, Rattus norvegicus
atatgcgactacgactggcaggtct

SEQ ID NO: 176217 - DNA, 25 bp, Rattus norvegicus
atatgctaccatcttgttctttata

SEQ ID NO: 176218 - DNA, 25 bp, Rattus norvegicus
atatgctaccatgttgttctttata

SEQ ID NO: 176219 - DNA, 25 bp, Rattus norvegicus
atatgctacggaaaaggccacccat

SEQ ID NO: 176220 - DNA, 25 bp, Rattus norvegicus
atatgctacggataaggccacccat

SEQ ID NO: 176221 - DNA, 25 bp, Rattus norvegicus
atatgctatacacggcctcggtcag

SEQ ID NO: 176222 - DNA, 25 bp, Rattus norvegicus
atatgctatacagggcctcggtcag

SEQ ID NO: 176223 - DNA, 25 bp, Rattus norvegicus
atatgctatagcatgtgaatttaaa

SEQ ID NO: 176224 - DNA, 25 bp, Rattus norvegicus
atatgctatagcttgtgaatttaaa

SEQ ID NO: 176225 - DNA, 25 bp, Rattus norvegicus
atatgctatgccattgaacctcggt

SEQ ID NO: 176226 - DNA, 25 bp, Rattus norvegicus
atatgctatgcctttgaacctcggt

SEQ ID NO: 176227 - DNA, 25 bp, Rattus norvegicus
atatgctcactacttggctgttgtt

SEQ ID NO: 176228 - DNA, 25 bp, Rattus norvegicus
atatgctcactagttggctgttgtt

SEQ ID NO: 176229 - DNA, 25 bp, Rattus norvegicus
atatgctcccatcctttccatatga

SEQ ID NO: 176230 - DNA, 25 bp, Rattus norvegicus
atatgctcccatgctttccatatga

SEQ ID NO: 176231 - DNA, 25 bp, Rattus norvegicus
atatgctcgtatcccattaccattt

SEQ ID NO: 176232 - DNA, 25 bp, Rattus norvegicus
atatgctcgtatgccattaccattt

SEQ ID NO: 176233 - DNA, 25 bp, Rattus norvegicus
atatgctcgtctacggtctgatcct

SEQ ID NO: 176234 - DNA, 25 bp, Rattus norvegicus
atatgctcgtcttcggtctgatcct

SEQ ID NO: 176235 - DNA, 25 bp, Rattus norvegicus
atatgctctcgtctgtaatgccaaa

SEQ ID NO: 176236 - DNA, 25 bp, Rattus norvegicus
atatgctctcgtgtgtaatgccaaa

SEQ ID NO: 176237 - DNA, 25 bp, Rattus norvegicus
atatgctctgatatcattgcggaga

SEQ ID NO: 176238 - DNA, 25 bp, Rattus norvegicus
atatgctctgatttcattgcggaga

SEQ ID NO: 176239 - DNA, 25 bp, Rattus norvegicus
atatgctgagagatcaatggcggaa

SEQ ID NO: 176240 - DNA, 25 bp, Rattus norvegicus
atatgctgagagttcaatggcggaa

SEQ ID NO: 176241 - DNA, 25 bp, Rattus norvegicus
atatgctgcgacacacgggcgagaa

SEQ ID NO: 176242 - DNA, 25 bp, Rattus norvegicus
atatgctgcgactcacgggcgagaa

SEQ ID NO: 176243 - DNA, 25 bp, Rattus norvegicus
atatgctgcttacaccatcttggga

SEQ ID NO: 176244 - DNA, 25 bp, Rattus norvegicus
atatgctgcttagaccatcttggga

SEQ ID NO: 176245 - DNA, 25 bp, Rattus norvegicus
atatgctggaatcctagcccttgct

SEQ ID NO: 176246 - DNA, 25 bp, Rattus norvegicus
atatgctggaatgctagcccttgct

SEQ ID NO: 176247 - DNA, 25 bp, Rattus norvegicus
atatgctgggagaccaactgaggaa

SEQ ID NO: 176248 - DNA, 25 bp, Rattus norvegicus
atatgctgggagtccaactgaggaa

SEQ ID NO: 176249 - DNA, 25 bp, Rattus norvegicus
atatgctgggctcctagactgaata

SEQ ID NO: 176250 - DNA, 25 bp, Rattus norvegicus
atatgctgggctgctagactgaata

SEQ ID NO: 176251 - DNA, 25 bp, Rattus norvegicus
atatgctgtgtcagtcactggtcgt

SEQ ID NO: 176252 - DNA, 25 bp, Rattus norvegicus
atatgctgtgtctgtcactggtcgt

SEQ ID NO: 176253 - DNA, 25 bp, Rattus norvegicus
atatgcttagatatgtgctacagta

SEQ ID NO: 176254 - DNA, 25 bp, Rattus norvegicus
atatgcttagatttgtgctacagta

SEQ ID NO: 176255 - DNA, 25 bp, Rattus norvegicus
atatgcttatctatgccctaggagt

SEQ ID NO: 176256 - DNA, 25 bp, Rattus norvegicus
atatgcttatctttgccctaggagt

SEQ ID NO: 176257 - DNA, 25 bp, Rattus norvegicus
atatgcttcgggagctagttgccta

SEQ ID NO: 176258 - DNA, 25 bp, Rattus norvegicus
atatgcttcgggtgctagttgccta

SEQ ID NO: 176259 - DNA, 25 bp, Rattus norvegicus
atatgcttcttgacactctgcgatg

SEQ ID NO: 176260 - DNA, 25 bp, Rattus norvegicus
atatgcttcttgtcactctgcgatg

SEQ ID NO: 176261 - DNA, 25 bp, Rattus norvegicus
atatgcttgagcacttccgggtgca

SEQ ID NO: 176262 - DNA, 25 bp, Rattus norvegicus
atatgcttgagctcttccgggtgca

SEQ ID NO: 176263 - DNA, 25 bp, Rattus norvegicus
atatgcttggttattactgtttcac

SEQ ID NO: 176264 - DNA, 25 bp, Rattus norvegicus
atatgcttggtttttactgtttcac

SEQ ID NO: 176265 - DNA, 25 bp, Rattus norvegicus
atatgcttgtttctgtgcactcaat

SEQ ID NO: 176266 - DNA, 25 bp, Rattus norvegicus
atatgcttgtttgtgtgcactcaat

SEQ ID NO: 176267 - DNA, 25 bp, Rattus norvegicus
atatgctttgctatttcggtagtat

SEQ ID NO: 176268 - DNA, 25 bp, Rattus norvegicus
atatgctttgctttttcggtagtat

SEQ ID NO: 176269 - DNA, 25 bp, Rattus norvegicus
atatggaacggcactcagcggagca

SEQ ID NO: 176270 - DNA, 25 bp, Rattus norvegicus
atatggaacggctctcagcggagca

SEQ ID NO: 176271 - DNA, 25 bp, Rattus norvegicus
atatggaagcccaacccttgtctgt

SEQ ID NO: 176272 - DNA, 25 bp, Rattus norvegicus
atatggaagccctacccttgtctgt

SEQ ID NO: 176273 - DNA, 25 bp, Rattus norvegicus
atatggaagctgatgctgtccgcat

SEQ ID NO: 176274 - DNA, 25 bp, Rattus norvegicus
atatggaagctgttgctgtccgcat

SEQ ID NO: 176275 - DNA, 25 bp, Rattus norvegicus
atatggaattccacctcagatggga

SEQ ID NO: 176276 - DNA, 25 bp, Rattus norvegicus
atatggaattcctcctcagatggga

SEQ ID NO: 176277 - DNA, 25 bp, Rattus norvegicus
atatggaattttcccctgacatttc

SEQ ID NO: 176278 - DNA, 25 bp, Rattus norvegicus
atatggaattttgccctgacatttc

SEQ ID NO: 176279 - DNA, 25 bp, Rattus norvegicus
atatggaccagcctgaatcccatgg

SEQ ID NO: 176280 - DNA, 25 bp, Rattus norvegicus
atatggaccagcgtgaatcccatgg

SEQ ID NO: 176281 - DNA, 25 bp, Rattus norvegicus
atatggacccgaatttgagacgaaa

SEQ ID NO: 176282 - DNA, 25 bp, Rattus norvegicus
atatggacccgattttgagacgaaa

SEQ ID NO: 176283 - DNA, 25 bp, Rattus norvegicus
atatggaccctaatcgacgtcttgc

SEQ ID NO: 176284 - DNA, 25 bp, Rattus norvegicus
atatggaccctattcgacgtcttgc

SEQ ID NO: 176285 - DNA, 25 bp, Rattus norvegicus
atatggacgagcctcacagcactgt

SEQ ID NO: 176286 - DNA, 25 bp, Rattus norvegicus
atatggacgagcgtcacagcactgt

SEQ ID NO: 176287 - DNA, 25 bp, Rattus norvegicus
atatggacgttaacattggtctggt

SEQ ID NO: 176288 - DNA, 25 bp, Rattus norvegicus
atatggacgttatcattggtctggt

SEQ ID NO: 176289 - DNA, 25 bp, Rattus norvegicus
atatggactaggaatctggccccgc

SEQ ID NO: 176290 - DNA, 25 bp, Rattus norvegicus
atatggactaggtatctggccccgc

SEQ ID NO: 176291 - DNA, 25 bp, Rattus norvegicus
atatggactcatctcggacctactc

SEQ ID NO: 176292 - DNA, 25 bp, Rattus norvegicus
atatggactcatgtcggacctactc

SEQ ID NO: 176293 - DNA, 25 bp, Rattus norvegicus
atatggagaccgcaactattgttat

SEQ ID NO: 176294 - DNA, 25 bp, Rattus norvegicus
atatggagaccggaactattgttat

SEQ ID NO: 176295 - DNA, 25 bp, Rattus norvegicus
atatggagaggcatccagcccacgt

SEQ ID NO: 176296 - DNA, 25 bp, Rattus norvegicus
atatggagaggcttccagcccacgt

SEQ ID NO: 176297 - DNA, 25 bp, Rattus norvegicus
atatggagccagcatattccagtcc

SEQ ID NO: 176298 - DNA, 25 bp, Rattus norvegicus
atatggagccaggatattccagtcc

SEQ ID NO: 176299 - DNA, 25 bp, Rattus norvegicus
atatggagctacaggccaccccggt

SEQ ID NO: 176300 - DNA, 25 bp, Rattus norvegicus
atatggagctactggccaccccggt

SEQ ID NO: 176301 - DNA, 25 bp, Rattus norvegicus
atatggaggcttcgctgaccctttc

SEQ ID NO: 176302 - DNA, 25 bp, Rattus norvegicus
atatggaggcttggctgaccctttc

SEQ ID NO: 176303 - DNA, 25 bp, Rattus norvegicus
atatggatatccagtttattgccaa

SEQ ID NO: 176304 - DNA, 25 bp, Rattus norvegicus
atatggatatcctgtttattgccaa

SEQ ID NO: 176305 - DNA, 25 bp, Rattus norvegicus
atatggatcaccagaggctgggtct

SEQ ID NO: 176306 - DNA, 25 bp, Rattus norvegicus
atatggatcacctgaggctgggtct

SEQ ID NO: 176307 - DNA, 25 bp, Rattus norvegicus
atatggatgatcatggcttttcgtg

SEQ ID NO: 176308 - DNA, 25 bp, Rattus norvegicus
atatggatgatcttggcttttcgtg

SEQ ID NO: 176309 - DNA, 25 bp, Rattus norvegicus
atatggatgcagacgacttgatgaa

SEQ ID NO: 176310 - DNA, 25 bp, Rattus norvegicus
atatggatgcagtcgacttgatgaa

SEQ ID NO: 176311 - DNA, 25 bp, Rattus norvegicus
atatggatgcccacagataccactg

SEQ ID NO: 176312 - DNA, 25 bp, Rattus norvegicus
atatggatgccctcagataccactg

SEQ ID NO: 176313 - DNA, 25 bp, Rattus norvegicus
atatggatgctacctgatcaccagg

SEQ ID NO: 176314 - DNA, 25 bp, Rattus norvegicus
atatggatgctagctgatcaccagg

SEQ ID NO: 176315 - DNA, 25 bp, Rattus norvegicus
atatggatggtcctttgcctttgct

SEQ ID NO: 176316 - DNA, 25 bp, Rattus norvegicus
atatggatggtcgtttgcctttgct

SEQ ID NO: 176317 - DNA, 25 bp, Rattus norvegicus
atatggcaccagacaacctcaagtt

SEQ ID NO: 176318 - DNA, 25 bp, Rattus norvegicus
atatggcaccagtcaacctcaagtt

SEQ ID NO: 176319 - DNA, 25 bp, Rattus norvegicus
atatggcactagatgctccacaaga

SEQ ID NO: 176320 - DNA, 25 bp, Rattus norvegicus
atatggcactagttgctccacaaga

SEQ ID NO: 176321 - DNA, 25 bp, Rattus norvegicus
atatggcatcttacgatttctgtat

SEQ ID NO: 176322 - DNA, 25 bp, Rattus norvegicus
atatggcatcttccgtgagaggcct

SEQ ID NO: 176323 - DNA, 25 bp, Rattus norvegicus
atatggcatcttgcgtgagaggcct

SEQ ID NO: 176324 - DNA, 25 bp, Rattus norvegicus
atatggcatctttcgatttctgtat

SEQ ID NO: 176325 - DNA, 25 bp, Rattus norvegicus
atatggccacatcgagacacattgg

SEQ ID NO: 176326 - DNA, 25 bp, Rattus norvegicus
atatggccacatggagacacattgg

SEQ ID NO: 176327 - DNA, 25 bp, Rattus norvegicus
atatggccacttacctgaccgtaga

SEQ ID NO: 176328 - DNA, 25 bp, Rattus norvegicus
atatggccacttatgtacacggtat

SEQ ID NO: 176329 - DNA, 25 bp, Rattus norvegicus
atatggccactttcctgaccgtaga

SEQ ID NO: 176330 - DNA, 25 bp, Rattus norvegicus
atatggccacttttgtacacggtat

SEQ ID NO: 176331 - DNA, 25 bp, Rattus norvegicus
atatggccagagctgctacgacttc

SEQ ID NO: 176332 - DNA, 25 bp, Rattus norvegicus
atatggccagaggtgctacgacttc

SEQ ID NO: 176333 - DNA, 25 bp, Rattus norvegicus
atatggccagcaccgatgatggcga

SEQ ID NO: 176334 - DNA, 25 bp, Rattus norvegicus
atatggccagcagcgatgatggcga

SEQ ID NO: 176335 - DNA, 25 bp, Rattus norvegicus
atatggccaggccatgactgtccgt

SEQ ID NO: 176336 - DNA, 25 bp, Rattus norvegicus
atatggccaggcgatgactgtccgt

SEQ ID NO: 176337 - DNA, 25 bp, Rattus norvegicus
atatggccatgtatgtcgagactca

SEQ ID NO: 176338 - DNA, 25 bp, Rattus norvegicus
atatggccatgtttgtcgagactca

SEQ ID NO: 176339 - DNA, 25 bp, Rattus norvegicus
atatggcccaaaacacctggcgctt

SEQ ID NO: 176340 - DNA, 25 bp, Rattus norvegicus
atatggcccaaatcacctggcgctt

SEQ ID NO: 176341 - DNA, 25 bp, Rattus norvegicus
atatggcccagacggcaaaccaaga

SEQ ID NO: 176342 - DNA, 25 bp, Rattus norvegicus
atatggcccagagggcaaaccaaga

SEQ ID NO: 176343 - DNA, 25 bp, Rattus norvegicus
atatggccccaaagtctcgggcggc

SEQ ID NO: 176344 - DNA, 25 bp, Rattus norvegicus
atatggccccaatgtctcgggcggc

SEQ ID NO: 176345 - DNA, 25 bp, Rattus norvegicus
atatggccccagatttctaaggtga

SEQ ID NO: 176346 - DNA, 25 bp, Rattus norvegicus
atatggccccagttttctaaggtga

SEQ ID NO: 176347 - DNA, 25 bp, Rattus norvegicus
atatggccgctacgtttaagagttt

SEQ ID NO: 176348 - DNA, 25 bp, Rattus norvegicus
atatggccgctaggtttaagagttt

SEQ ID NO: 176349 - DNA, 25 bp, Rattus norvegicus
atatggccggtgaccagtgcattca

SEQ ID NO: 176350 - DNA, 25 bp, Rattus norvegicus
atatggccggtgtccagtgcattca

SEQ ID NO: 176351 - DNA, 25 bp, Rattus norvegicus
atatggcggtggacccaaggacaca

SEQ ID NO: 176352 - DNA, 25 bp, Rattus norvegicus
atatggcggtggtcccaaggacaca

SEQ ID NO: 176353 - DNA, 25 bp, Rattus norvegicus
atatggctactcataccgacatggc

SEQ ID NO: 176354 - DNA, 25 bp, Rattus norvegicus
atatggctactcttaccgacatggc

SEQ ID NO: 176355 - DNA, 25 bp, Rattus norvegicus
atatggctatacctatgtgttcaat

SEQ ID NO: 176356 - DNA, 25 bp, Rattus norvegicus
atatggctatacgtatgtgttcaat

SEQ ID NO: 176357 - DNA, 25 bp, Rattus norvegicus
atatggctatgaactcggcaggcta

SEQ ID NO: 176358 - DNA, 25 bp, Rattus norvegicus
atatggctatgatctcggcaggcta

SEQ ID NO: 176359 - DNA, 25 bp, Rattus norvegicus
atatggctcccgaaatgcttgatga

SEQ ID NO: 176360 - DNA, 25 bp, Rattus norvegicus
atatggctcccgtaatgcttgatga

SEQ ID NO: 176361 - DNA, 25 bp, Rattus norvegicus
atatggctccttaggcaggcaggca

SEQ ID NO: 176362 - DNA, 25 bp, Rattus norvegicus
atatggctcctttggcaggcaggca

SEQ ID NO: 176363 - DNA, 25 bp, Rattus norvegicus
atatggctctccagacgtgtgtgtg

SEQ ID NO: 176364 - DNA, 25 bp, Rattus norvegicus
atatggctctcctgacgtgtgtgtg

SEQ ID NO: 176365 - DNA, 25 bp, Rattus norvegicus
atatggctctgaaatggctctgata

SEQ ID NO: 176366 - DNA, 25 bp, Rattus norvegicus
atatggctctgatatggctctgata

SEQ ID NO: 176367 - DNA, 25 bp, Rattus norvegicus
atatggctgaacagacaggttgaga

SEQ ID NO: 176368 - DNA, 25 bp, Rattus norvegicus
atatggctgaactgacaggttgaga

SEQ ID NO: 176369 - DNA, 25 bp, Rattus norvegicus
atatggctgcccacaagcttgggaa

SEQ ID NO: 176370 - DNA, 25 bp, Rattus norvegicus
atatggctgccctcaagcttgggaa

SEQ ID NO: 176371 - DNA, 25 bp, Rattus norvegicus
atatggctttgtattccccatgagg

SEQ ID NO: 176372 - DNA, 25 bp, Rattus norvegicus
atatggctttgttttccccatgagg

SEQ ID NO: 176373 - DNA, 25 bp, Rattus norvegicus
atatggcttttcctctaacctacta

SEQ ID NO: 176374 - DNA, 25 bp, Rattus norvegicus
atatggcttttcgtctaacctacta

SEQ ID NO: 176375 - DNA, 25 bp, Rattus norvegicus
atatggctttttcatctgttggcag

SEQ ID NO: 176376 - DNA, 25 bp, Rattus norvegicus
atatggctttttgatctgttggcag

SEQ ID NO: 176377 - DNA, 25 bp, Rattus norvegicus
atatgggacatgagaggctccctgg

SEQ ID NO: 176378 - DNA, 25 bp, Rattus norvegicus
atatgggacatgtgaggctccctgg

SEQ ID NO: 176379 - DNA, 25 bp, Rattus norvegicus
atatgggaccctcgatctaaactca

SEQ ID NO: 176380 - DNA, 25 bp, Rattus norvegicus
atatgggaccctggatctaaactca

SEQ ID NO: 176381 - DNA, 25 bp, Rattus norvegicus
atatgggagccaactccttctttgg

SEQ ID NO: 176382 - DNA, 25 bp, Rattus norvegicus
atatgggagccatctccttctttgg

SEQ ID NO: 176383 - DNA, 25 bp, Rattus norvegicus
atatgggagccgcagaactcaccct

SEQ ID NO: 176384 - DNA, 25 bp, Rattus norvegicus
atatgggagccggagaactcaccct

SEQ ID NO: 176385 - DNA, 25 bp, Rattus norvegicus
atatgggagtgtacagcctatgcaa

SEQ ID NO: 176386 - DNA, 25 bp, Rattus norvegicus
atatgggagtgttcagcctatgcaa

SEQ ID NO: 176387 - DNA, 25 bp, Rattus norvegicus
atatgggatctaatcctctctcttc

SEQ ID NO: 176388 - DNA, 25 bp, Rattus norvegicus
atatgggatctattcctctctcttc

SEQ ID NO: 176389 - DNA, 25 bp, Rattus norvegicus
atatgggccaggcttgtccctccag

SEQ ID NO: 176390 - DNA, 25 bp, Rattus norvegicus
atatgggccagggttgtccctccag

SEQ ID NO: 176391 - DNA, 25 bp, Rattus norvegicus
atatgggccctgaattgattgattc

SEQ ID NO: 176392 - DNA, 25 bp, Rattus norvegicus
atatgggccctgtattgattgattc

SEQ ID NO: 176393 - DNA, 25 bp, Rattus norvegicus
atatgggctcagagtgctgctcaaa

SEQ ID NO: 176394 - DNA, 25 bp, Rattus norvegicus
atatgggctcagtgtgctgctcaaa

SEQ ID NO: 176395 - DNA, 25 bp, Rattus norvegicus
atatgggctccaagtttgatacgac

SEQ ID NO: 176396 - DNA, 25 bp, Rattus norvegicus
atatgggctccatgtttgatacgac

SEQ ID NO: 176397 - DNA, 25 bp, Rattus norvegicus
atatgggctgtaaatttgtcctcag

SEQ ID NO: 176398 - DNA, 25 bp, Rattus norvegicus
atatgggctgtatatttgtcctcag

SEQ ID NO: 176399 - DNA, 25 bp, Rattus norvegicus
atatgggtcttcatcatggcttcct

SEQ ID NO: 176400 - DNA, 25 bp, Rattus norvegicus
atatgggtcttcttcatggcttcct

SEQ ID NO: 176401 - DNA, 25 bp, Rattus norvegicus
atatgggtgatgactgcgtgcccac

SEQ ID NO: 176402 - DNA, 25 bp, Rattus norvegicus
atatgggtgatgtctgcgtgcccac

SEQ ID NO: 176403 - DNA, 25 bp, Rattus norvegicus
atatgggtgccacagtgactgctcc

SEQ ID NO: 176404 - DNA, 25 bp, Rattus norvegicus
atatgggtgccagagtgactgctcc

SEQ ID NO: 176405 - DNA, 25 bp, Rattus norvegicus
atatgggtgcccagatactccagca

SEQ ID NO: 176406 - DNA, 25 bp, Rattus norvegicus
atatgggtgccctgatactccagca

SEQ ID NO: 176407 - DNA, 25 bp, Rattus norvegicus
atatgggtgtatagtttccctctcc

SEQ ID NO: 176408 - DNA, 25 bp, Rattus norvegicus
atatgggtgtattgtttccctctcc

SEQ ID NO: 176409 - DNA, 25 bp, Rattus norvegicus
atatgggtgtgtccatgcctctgaa

SEQ ID NO: 176410 - DNA, 25 bp, Rattus norvegicus
atatgggtgtgtgcatgcctctgaa

SEQ ID NO: 176411 - DNA, 25 bp, Rattus norvegicus
atatgggttgtcaggtgccgattcc

SEQ ID NO: 176412 - DNA, 25 bp, Rattus norvegicus
atatgggttgtctggtgccgattcc

SEQ ID NO: 176413 - DNA, 25 bp, Rattus norvegicus
atatgggttttgatgagttcgatga

SEQ ID NO: 176414 - DNA, 25 bp, Rattus norvegicus
atatgggttttgttgagttcgatga

SEQ ID NO: 176415 - DNA, 25 bp, Rattus norvegicus
atatggtagtggcacctggctctaa

SEQ ID NO: 176416 - DNA, 25 bp, Rattus norvegicus
atatggtagtgggacctggctctaa

SEQ ID NO: 176417 - DNA, 25 bp, Rattus norvegicus
atatggtcagctccccttcaaagtg

SEQ ID NO: 176418 - DNA, 25 bp, Rattus norvegicus
atatggtcagctgcccttcaaagtg

SEQ ID NO: 176419 - DNA, 25 bp, Rattus norvegicus
atatggtccagaagtcggccagcaa

SEQ ID NO: 176420 - DNA, 25 bp, Rattus norvegicus
atatggtccagatgtcggccagcaa

SEQ ID NO: 176421 - DNA, 25 bp, Rattus norvegicus
atatggtccagcagttaggcgtcat

SEQ ID NO: 176422 - DNA, 25 bp, Rattus norvegicus
atatggtccagctgttaggcgtcat

SEQ ID NO: 176423 - DNA, 25 bp, Rattus norvegicus
atatggtcccttcacagcactgaaa

SEQ ID NO: 176424 - DNA, 25 bp, Rattus norvegicus
atatggtcccttgacagcactgaaa

SEQ ID NO: 176425 - DNA, 25 bp, Rattus norvegicus
atatggtcgtctctgaaaggtctct

SEQ ID NO: 176426 - DNA, 25 bp, Rattus norvegicus
atatggtcgtctgtgaaaggtctct

SEQ ID NO: 176427 - DNA, 25 bp, Rattus norvegicus
atatggtctagtagctctctgaggc

SEQ ID NO: 176428 - DNA, 25 bp, Rattus norvegicus
atatggtctagttgctctctgaggc

SEQ ID NO: 176429 - DNA, 25 bp, Rattus norvegicus
atatggtctatccttccagagttgg

SEQ ID NO: 176430 - DNA, 25 bp, Rattus norvegicus
atatggtctatcgttccagagttgg

SEQ ID NO: 176431 - DNA, 25 bp, Rattus norvegicus
atatggtctccaaggagcactgtca

SEQ ID NO: 176432 - DNA, 25 bp, Rattus norvegicus
atatggtctccatggagcactgtca

SEQ ID NO: 176433 - DNA, 25 bp, Rattus norvegicus
atatggtctctaacctcagggtgct

SEQ ID NO: 176434 - DNA, 25 bp, Rattus norvegicus
atatggtctctatcctcagggtgct

SEQ ID NO: 176435 - DNA, 25 bp, Rattus norvegicus
atatggtgcttgcaagggctctttg

SEQ ID NO: 176436 - DNA, 25 bp, Rattus norvegicus
atatggtgcttgctctgttctgccc

SEQ ID NO: 176437 - DNA, 25 bp, Rattus norvegicus
atatggtgcttggaagggctctttg

SEQ ID NO: 176438 - DNA, 25 bp, Rattus norvegicus
atatggtgcttggtctgttctgccc

SEQ ID NO: 176439 - DNA, 25 bp, Rattus norvegicus
atatggtgggccatattccttaaca

SEQ ID NO: 176440 - DNA, 25 bp, Rattus norvegicus
atatggtgggccttattccttaaca

SEQ ID NO: 176441 - DNA, 25 bp, Rattus norvegicus
atatggtggtagatgcaggatctca

SEQ ID NO: 176442 - DNA, 25 bp, Rattus norvegicus
atatggtggtagttgcaggatctca

SEQ ID NO: 176443 - DNA, 25 bp, Rattus norvegicus
atatggtggtcaagcgtaccaaccc

SEQ ID NO: 176444 - DNA, 25 bp, Rattus norvegicus
atatggtggtcatgcgtaccaaccc

SEQ ID NO: 176445 - DNA, 25 bp, Rattus norvegicus
atatggttgttgatggactgtctcc

SEQ ID NO: 176446 - DNA, 25 bp, Rattus norvegicus
atatggttgttgttggactgtctcc

SEQ ID NO: 176447 - DNA, 25 bp, Rattus norvegicus
atatgtaaagcacttatctccgttt

SEQ ID NO: 176448 - DNA, 25 bp, Rattus norvegicus
atatgtaaagcagttatctccgttt

SEQ ID NO: 176449 - DNA, 25 bp, Rattus norvegicus
atatgtaacgctatcaaaataaggt

SEQ ID NO: 176450 - DNA, 25 bp, Rattus norvegicus
atatgtaacgctttcaaaataaggt

SEQ ID NO: 176451 - DNA, 25 bp, Rattus norvegicus
atatgtaatgcacgcgggctcgcaa

SEQ ID NO: 176452 - DNA, 25 bp, Rattus norvegicus
atatgtaatgcaggcgggctcgcaa

SEQ ID NO: 176453 - DNA, 25 bp, Rattus norvegicus
atatgtacatttctcaggccagggc

SEQ ID NO: 176454 - DNA, 25 bp, Rattus norvegicus
atatgtacatttgtcaggccagggc

SEQ ID NO: 176455 - DNA, 25 bp, Rattus norvegicus
atatgtaccattagtgcttgatttt

SEQ ID NO: 176456 - DNA, 25 bp, Rattus norvegicus
atatgtaccatttgtgcttgatttt

SEQ ID NO: 176457 - DNA, 25 bp, Rattus norvegicus
atatgtactttgagtcttaagtctc

SEQ ID NO: 176458 - DNA, 25 bp, Rattus norvegicus
atatgtactttgtgtcttaagtctc

SEQ ID NO: 176459 - DNA, 25 bp, Rattus norvegicus
atatgtagccttccatgttctcttt

SEQ ID NO: 176460 - DNA, 25 bp, Rattus norvegicus
atatgtagccttgcatgttctcttt

SEQ ID NO: 176461 - DNA, 25 bp, Rattus norvegicus
atatgtagctctacgtttgggtacg

SEQ ID NO: 176462 - DNA, 25 bp, Rattus norvegicus
atatgtagctcttcgtttgggtacg

SEQ ID NO: 176463 - DNA, 25 bp, Rattus norvegicus
atatgtagtaccaatatagaacggt

SEQ ID NO: 176464 - DNA, 25 bp, Rattus norvegicus
atatgtagtacctatatagaacggt

SEQ ID NO: 176465 - DNA, 25 bp, Rattus norvegicus
atatgtagtagtccacatttgagca

SEQ ID NO: 176466 - DNA, 25 bp, Rattus norvegicus
atatgtagtagtgcacatttgagca

SEQ ID NO: 176467 - DNA, 25 bp, Rattus norvegicus
atatgtagtcctcgcttgttcatcc

SEQ ID NO: 176468 - DNA, 25 bp, Rattus norvegicus
atatgtagtcctggcttgttcatcc

SEQ ID NO: 176469 - DNA, 25 bp, Rattus norvegicus
atatgtagtgcccatggagtgtgtt

SEQ ID NO: 176470 - DNA, 25 bp, Rattus norvegicus
atatgtagtgccgatggagtgtgtt

SEQ ID NO: 176471 - DNA, 25 bp, Rattus norvegicus
atatgtatattgaccctgcattggg

SEQ ID NO: 176472 - DNA, 25 bp, Rattus norvegicus
atatgtatattgtccctgcattggg

SEQ ID NO: 176473 - DNA, 25 bp, Rattus norvegicus
atatgtatatttacttcgctgttta

SEQ ID NO: 176474 - DNA, 25 bp, Rattus norvegicus
atatgtatattttcttcgctgttta

SEQ ID NO: 176475 - DNA, 25 bp, Rattus norvegicus
atatgtatcaatcctctatgtcaga

SEQ ID NO: 176476 - DNA, 25 bp, Rattus norvegicus
atatgtatcaatgctctatgtcaga

SEQ ID NO: 176477 - DNA, 25 bp, Rattus norvegicus
atatgtatcctgctggtggttcaca

SEQ ID NO: 176478 - DNA, 25 bp, Rattus norvegicus
atatgtatcctggtggtggttcaca

SEQ ID NO: 176479 - DNA, 25 bp, Rattus norvegicus
atatgtatccttctgagtttcaaga

SEQ ID NO: 176480 - DNA, 25 bp, Rattus norvegicus
atatgtatccttgtgagtttcaaga

SEQ ID NO: 176481 - DNA, 25 bp, Rattus norvegicus
atatgtatgaggaccctggttcagg

SEQ ID NO: 176482 - DNA, 25 bp, Rattus norvegicus
atatgtatgaggtccctggttcagg

SEQ ID NO: 176483 - DNA, 25 bp, Rattus norvegicus
atatgtatgcttactttgtgcttaa

SEQ ID NO: 176484 - DNA, 25 bp, Rattus norvegicus
atatgtatgctttctttgtgcttaa

SEQ ID NO: 176485 - DNA, 25 bp, Rattus norvegicus
atatgtatgtaacttcccctgtgca

SEQ ID NO: 176486 - DNA, 25 bp, Rattus norvegicus
atatgtatgtaagttcccctgtgca

SEQ ID NO: 176487 - DNA, 25 bp, Rattus norvegicus
atatgtattggccacatctgcactc

SEQ ID NO: 176488 - DNA, 25 bp, Rattus norvegicus
atatgtattggcgacatctgcactc

SEQ ID NO: 176489 - DNA, 25 bp, Rattus norvegicus
atatgtcaggataactaagctttct

SEQ ID NO: 176490 - DNA, 25 bp, Rattus norvegicus
atatgtcaggattactaagctttct

SEQ ID NO: 176491 - DNA, 25 bp, Rattus norvegicus
atatgtcaggcactgttgctctgga

SEQ ID NO: 176492 - DNA, 25 bp, Rattus norvegicus
atatgtcaggcagtgttgctctgga

SEQ ID NO: 176493 - DNA, 25 bp, Rattus norvegicus
atatgtcagggcagcttcccgagaa

SEQ ID NO: 176494 - DNA, 25 bp, Rattus norvegicus
atatgtcagggctgcttcccgagaa

SEQ ID NO: 176495 - DNA, 25 bp, Rattus norvegicus
atatgtcataacagtgtctcatggg

SEQ ID NO: 176496 - DNA, 25 bp, Rattus norvegicus
atatgtcataactgtgtctcatggg

SEQ ID NO: 176497 - DNA, 25 bp, Rattus norvegicus
atatgtcatcggaatcctggcatta

SEQ ID NO: 176498 - DNA, 25 bp, Rattus norvegicus
atatgtcatcggtatcctggcatta

SEQ ID NO: 176499 - DNA, 25 bp, Rattus norvegicus
atatgtcatgtcaccctgatgtatc

SEQ ID NO: 176500 - DNA, 25 bp, Rattus norvegicus
atatgtcatgtctccctgatgtatc

SEQ ID NO: 176501 - DNA, 25 bp, Rattus norvegicus
atatgtccagatcttgccgggcacc

SEQ ID NO: 176502 - DNA, 25 bp, Rattus norvegicus
atatgtccagatgttgccgggcacc

SEQ ID NO: 176503 - DNA, 25 bp, Rattus norvegicus
atatgtccatgtagtcattctggcc

SEQ ID NO: 176504 - DNA, 25 bp, Rattus norvegicus
atatgtccatgttgtcattctggcc

SEQ ID NO: 176505 - DNA, 25 bp, Rattus norvegicus
atatgtcccaacagtgtgcaacgga

SEQ ID NO: 176506 - DNA, 25 bp, Rattus norvegicus
atatgtcccaactgtgtgcaacgga

SEQ ID NO: 176507 - DNA, 25 bp, Rattus norvegicus
atatgtcccactcttggtgagacga

SEQ ID NO: 176508 - DNA, 25 bp, Rattus norvegicus
atatgtcccactgttggtgagacga

SEQ ID NO: 176509 - DNA, 25 bp, Rattus norvegicus
atatgtccgagaatacgcctttgta

SEQ ID NO: 176510 - DNA, 25 bp, Rattus norvegicus
atatgtccgagattacgcctttgta

SEQ ID NO: 176511 - DNA, 25 bp, Rattus norvegicus
atatgtccggccagtaccagtacca

SEQ ID NO: 176512 - DNA, 25 bp, Rattus norvegicus
atatgtccggcctgtaccagtacca

SEQ ID NO: 176513 - DNA, 25 bp, Rattus norvegicus
atatgtcctagtcaagtcaacgtgt

SEQ ID NO: 176514 - DNA, 25 bp, Rattus norvegicus
atatgtcctagtgaagtcaacgtgt

SEQ ID NO: 176515 - DNA, 25 bp, Rattus norvegicus
atatgtcctctgactcccctgtctg

SEQ ID NO: 176516 - DNA, 25 bp, Rattus norvegicus
atatgtcctctgtctcccctgtctg

SEQ ID NO: 176517 - DNA, 25 bp, Rattus norvegicus
atatgtcctgagacagtctgcctgt

SEQ ID NO: 176518 - DNA, 25 bp, Rattus norvegicus
atatgtcctgagtcagtctgcctgt

SEQ ID NO: 176519 - DNA, 25 bp, Rattus norvegicus
atatgtcgctatcgctatgtgttga

SEQ ID NO: 176520 - DNA, 25 bp, Rattus norvegicus
atatgtcgctatggctatgtgttga

SEQ ID NO: 176521 - DNA, 25 bp, Rattus norvegicus
atatgtcgcttcattcatgtgtgca

SEQ ID NO: 176522 - DNA, 25 bp, Rattus norvegicus
atatgtcgcttctttcatgtgtgca

SEQ ID NO: 176523 - DNA, 25 bp, Rattus norvegicus
atatgtctaactagccatttcctcc

SEQ ID NO: 176524 - DNA, 25 bp, Rattus norvegicus
atatgtctaacttgccatttcctcc

SEQ ID NO: 176525 - DNA, 25 bp, Rattus norvegicus
atatgtctacatccttggtgtccag

SEQ ID NO: 176526 - DNA, 25 bp, Rattus norvegicus
atatgtctacatgcttggtgtccag

SEQ ID NO: 176527 - DNA, 25 bp, Rattus norvegicus
atatgtctagctcacctgacgctta

SEQ ID NO: 176528 - DNA, 25 bp, Rattus norvegicus
atatgtctagctgacctgacgctta

SEQ ID NO: 176529 - DNA, 25 bp, Rattus norvegicus
atatgtctccagagcgctcatttca

SEQ ID NO: 176530 - DNA, 25 bp, Rattus norvegicus
atatgtctccagtgcgctcatttca

SEQ ID NO: 176531 - DNA, 25 bp, Rattus norvegicus
atatgtctcgagagtcatgcttcca

SEQ ID NO: 176532 - DNA, 25 bp, Rattus norvegicus
atatgtctcgagtgtcatgcttcca

SEQ ID NO: 176533 - DNA, 25 bp, Rattus norvegicus
atatgtctctttccttctatctcac

SEQ ID NO: 176534 - DNA, 25 bp, Rattus norvegicus
atatgtctctttgcttctatctcac

SEQ ID NO: 176535 - DNA, 25 bp, Rattus norvegicus
atatgtctgcgaatagttttctaac

SEQ ID NO: 176536 - DNA, 25 bp, Rattus norvegicus
atatgtctgcgattagttttctaac

SEQ ID NO: 176537 - DNA, 25 bp, Rattus norvegicus
atatgtctgctaaccggtgtacaca

SEQ ID NO: 176538 - DNA, 25 bp, Rattus norvegicus
atatgtctgctatccggtgtacaca

SEQ ID NO: 176539 - DNA, 25 bp, Rattus norvegicus
atatgtctgcttaagccttctttta

SEQ ID NO: 176540 - DNA, 25 bp, Rattus norvegicus
atatgtctgctttagccttctttta

SEQ ID NO: 176541 - DNA, 25 bp, Rattus norvegicus
atatgtctggttatgcctacggtac

SEQ ID NO: 176542 - DNA, 25 bp, Rattus norvegicus
atatgtctggttttgcctacggtac

SEQ ID NO: 176543 - DNA, 25 bp, Rattus norvegicus
atatgtctgtcaagttgggatgcca

SEQ ID NO: 176544 - DNA, 25 bp, Rattus norvegicus
atatgtctgtcatgttgggatgcca

SEQ ID NO: 176545 - DNA, 25 bp, Rattus norvegicus
atatgtctgtgaagagtgtttggct

SEQ ID NO: 176546 - DNA, 25 bp, Rattus norvegicus
atatgtctgtgatgagtgtttggct

SEQ ID NO: 176547 - DNA, 25 bp, Rattus norvegicus
atatgtctgtggactacgtgcacac

SEQ ID NO: 176548 - DNA, 25 bp, Rattus norvegicus
atatgtctgtggtctacgtgcacac

SEQ ID NO: 176549 - DNA, 25 bp, Rattus norvegicus
atatgtctgtgtcagtatcatgcct

SEQ ID NO: 176550 - DNA, 25 bp, Rattus norvegicus
atatgtctgtgtgagtatcatgcct

SEQ ID NO: 176551 - DNA, 25 bp, Rattus norvegicus
atatgtcttgctagccaggcatcca

SEQ ID NO: 176552 - DNA, 25 bp, Rattus norvegicus
atatgtcttgcttgccaggcatcca

SEQ ID NO: 176553 - DNA, 25 bp, Rattus norvegicus
atatgtcttgtacttgtcctagtca

SEQ ID NO: 176554 - DNA, 25 bp, Rattus norvegicus
atatgtcttgtagttgtcctagtca

SEQ ID NO: 176555 - DNA, 25 bp, Rattus norvegicus
atatgtctttgcattctcatcgaga

SEQ ID NO: 176556 - DNA, 25 bp, Rattus norvegicus
atatgtctttgctttctcatcgaga

SEQ ID NO: 176557 - DNA, 25 bp, Rattus norvegicus
atatgtgaatttcctgcttctgaga

SEQ ID NO: 176558 - DNA, 25 bp, Rattus norvegicus
atatgtgaatttgctgcttctgaga

SEQ ID NO: 176559 - DNA, 25 bp, Rattus norvegicus
atatgtgagggcaccactggctcag

SEQ ID NO: 176560 - DNA, 25 bp, Rattus norvegicus
atatgtgagggcctgtttctttttg

SEQ ID NO: 176561 - DNA, 25 bp, Rattus norvegicus
atatgtgagggcgtgtttctttttg

SEQ ID NO: 176562 - DNA, 25 bp, Rattus norvegicus
atatgtgagggctccactggctcag

SEQ ID NO: 176563 - DNA, 25 bp, Rattus norvegicus
atatgtgattgtactaggtctttcc

SEQ ID NO: 176564 - DNA, 25 bp, Rattus norvegicus
atatgtgattgttctaggtctttcc

SEQ ID NO: 176565 - DNA, 25 bp, Rattus norvegicus
atatgtgcaaccacagcgactgggc

SEQ ID NO: 176566 - DNA, 25 bp, Rattus norvegicus
atatgtgcaacctcagcgactgggc

SEQ ID NO: 176567 - DNA, 25 bp, Rattus norvegicus
atatgtgcaatgcagccctactctg

SEQ ID NO: 176568 - DNA, 25 bp, Rattus norvegicus
atatgtgcaatggagccctactctg

SEQ ID NO: 176569 - DNA, 25 bp, Rattus norvegicus
atatgtgcacatctctgtctcaccc

SEQ ID NO: 176570 - DNA, 25 bp, Rattus norvegicus
atatgtgcacatgtctgtctcaccc

SEQ ID NO: 176571 - DNA, 25 bp, Rattus norvegicus
atatgtgcactcagcacgcacagag

SEQ ID NO: 176572 - DNA, 25 bp, Rattus norvegicus
atatgtgcactctgcacgcacagag

SEQ ID NO: 176573 - DNA, 25 bp, Rattus norvegicus
atatgtgcatatctcctgggtttta

SEQ ID NO: 176574 - DNA, 25 bp, Rattus norvegicus
atatgtgcatatgtcctgggtttta

SEQ ID NO: 176575 - DNA, 25 bp, Rattus norvegicus
atatgtgccactctttccaactttt

SEQ ID NO: 176576 - DNA, 25 bp, Rattus norvegicus
atatgtgccactgtttccaactttt

SEQ ID NO: 176577 - DNA, 25 bp, Rattus norvegicus
atatgtgccgctccagaagctggga

SEQ ID NO: 176578 - DNA, 25 bp, Rattus norvegicus
atatgtgccgctgcagaagctggga

SEQ ID NO: 176579 - DNA, 25 bp, Rattus norvegicus
atatgtgccgtacctcaaatcctgc

SEQ ID NO: 176580 - DNA, 25 bp, Rattus norvegicus
atatgtgccgtagctcaaatcctgc

SEQ ID NO: 176581 - DNA, 25 bp, Rattus norvegicus
atatgtgcctataccttgcttggac

SEQ ID NO: 176582 - DNA, 25 bp, Rattus norvegicus
atatgtgcctattccttgcttggac

SEQ ID NO: 176583 - DNA, 25 bp, Rattus norvegicus
atatgtgcctggacacgtgttagaa

SEQ ID NO: 176584 - DNA, 25 bp, Rattus norvegicus
atatgtgcctggtcacgtgttagaa

SEQ ID NO: 176585 - DNA, 25 bp, Rattus norvegicus
atatgtggactgacttggtcttctt

SEQ ID NO: 176586 - DNA, 25 bp, Rattus norvegicus
atatgtggactgtcttggtcttctt

SEQ ID NO: 176587 - DNA, 25 bp, Rattus norvegicus
atatgtggcctgatcagagacatct

SEQ ID NO: 176588 - DNA, 25 bp, Rattus norvegicus
atatgtggcctgttcagagacatct

SEQ ID NO: 176589 - DNA, 25 bp, Rattus norvegicus
atatgtgggagcatctttgtgttca

SEQ ID NO: 176590 - DNA, 25 bp, Rattus norvegicus
atatgtgggagcttctttgtgttca

SEQ ID NO: 176591 - DNA, 25 bp, Rattus norvegicus
atatgtgggcatccatagtgttccc

SEQ ID NO: 176592 - DNA, 25 bp, Rattus norvegicus
atatgtgggcatgcatagtgttccc

SEQ ID NO: 176593 - DNA, 25 bp, Rattus norvegicus
atatgtgggcttccatggcgctacc

SEQ ID NO: 176594 - DNA, 25 bp, Rattus norvegicus
atatgtgggcttgcatggcgctacc

SEQ ID NO: 176595 - DNA, 25 bp, Rattus norvegicus
atatgtggtacactgctcgatcgca

SEQ ID NO: 176596 - DNA, 25 bp, Rattus norvegicus
atatgtggtacagtgctcgatcgca

SEQ ID NO: 176597 - DNA, 25 bp, Rattus norvegicus
atatgtggtctacagcccttggcaa

SEQ ID NO: 176598 - DNA, 25 bp, Rattus norvegicus
atatgtggtctagagcccttggcaa

SEQ ID NO: 176599 - DNA, 25 bp, Rattus norvegicus
atatgtgtacacaagctatcctgaa

SEQ ID NO: 176600 - DNA, 25 bp, Rattus norvegicus
atatgtgtacactagctatcctgaa

SEQ ID NO: 176601 - DNA, 25 bp, Rattus norvegicus
atatgtgtattcctagtctatcgta

SEQ ID NO: 176602 - DNA, 25 bp, Rattus norvegicus
atatgtgtattcgtagtctatcgta

SEQ ID NO: 176603 - DNA, 25 bp, Rattus norvegicus
atatgtgtgcacaatgggaagctgg

SEQ ID NO: 176604 - DNA, 25 bp, Rattus norvegicus
atatgtgtgcactatgggaagctgg

SEQ ID NO: 176605 - DNA, 25 bp, Rattus norvegicus
atatgtgtgcagctacccaccgaaa

SEQ ID NO: 176606 - DNA, 25 bp, Rattus norvegicus
atatgtgtgcaggtacccaccgaaa

SEQ ID NO: 176607 - DNA, 25 bp, Rattus norvegicus
atatgtgtgcccctctgtgccacac

SEQ ID NO: 176608 - DNA, 25 bp, Rattus norvegicus
atatgtgtgcccgtctgtgccacac

SEQ ID NO: 176609 - DNA, 25 bp, Rattus norvegicus
atatgtgtgctgaactaggcttcat

SEQ ID NO: 176610 - DNA, 25 bp, Rattus norvegicus
atatgtgtgctgtactaggcttcat

SEQ ID NO: 176611 - DNA, 25 bp, Rattus norvegicus
atatgtgtgtataggtttgctgtaa

SEQ ID NO: 176612 - DNA, 25 bp, Rattus norvegicus
atatgtgtgtattggtttgctgtaa

SEQ ID NO: 176613 - DNA, 25 bp, Rattus norvegicus
atatgtgtgtttaatcctttctgat

SEQ ID NO: 176614 - DNA, 25 bp, Rattus norvegicus
atatgtgtgtttattgcgtgtgggc

SEQ ID NO: 176615 - DNA, 25 bp, Rattus norvegicus
atatgtgtgtttccctttgtttaag

SEQ ID NO: 176616 - DNA, 25 bp, Rattus norvegicus
atatgtgtgtttgcctttgtttaag

SEQ ID NO: 176617 - DNA, 25 bp, Rattus norvegicus
atatgtgtgttttatcctttctgat

SEQ ID NO: 176618 - DNA, 25 bp, Rattus norvegicus
atatgtgtgttttttgcgtgtgggc

SEQ ID NO: 176619 - DNA, 25 bp, Rattus norvegicus
atatgtgttactatcctgaggcaaa

SEQ ID NO: 176620 - DNA, 25 bp, Rattus norvegicus
atatgtgttactttcctgaggcaaa

SEQ ID NO: 176621 - DNA, 25 bp, Rattus norvegicus
atatgtgttcctagaatgcagctga

SEQ ID NO: 176622 - DNA, 25 bp, Rattus norvegicus
atatgtgttccttgaatgcagctga

SEQ ID NO: 176623 - DNA, 25 bp, Rattus norvegicus
atatgttaaattcactcatcacact

SEQ ID NO: 176624 - DNA, 25 bp, Rattus norvegicus
atatgttaaattgactcatcacact

SEQ ID NO: 176625 - DNA, 25 bp, Rattus norvegicus
atatgttatatgctcctgccatggg

SEQ ID NO: 176626 - DNA, 25 bp, Rattus norvegicus
atatgttatatggtcctgccatggg

SEQ ID NO: 176627 - DNA, 25 bp, Rattus norvegicus
atatgttatcatagaggcctactct

SEQ ID NO: 176628 - DNA, 25 bp, Rattus norvegicus
atatgttatcattgaggcctactct

SEQ ID NO: 176629 - DNA, 25 bp, Rattus norvegicus
atatgttcaactccattcagcgcgc

SEQ ID NO: 176630 - DNA, 25 bp, Rattus norvegicus
atatgttcaactgcattcagcgcgc

SEQ ID NO: 176631 - DNA, 25 bp, Rattus norvegicus
atatgttcagtgatgactgcagacc

SEQ ID NO: 176632 - DNA, 25 bp, Rattus norvegicus
atatgttcagtgttgactgcagacc

SEQ ID NO: 176633 - DNA, 25 bp, Rattus norvegicus
atatgttcatctctttgctcttgta

SEQ ID NO: 176634 - DNA, 25 bp, Rattus norvegicus
atatgttcatctgtttgctcttgta

SEQ ID NO: 176635 - DNA, 25 bp, Rattus norvegicus
atatgttcattaaatctctggtata

SEQ ID NO: 176636 - DNA, 25 bp, Rattus norvegicus
atatgttcattatatctctggtata

SEQ ID NO: 176637 - DNA, 25 bp, Rattus norvegicus
atatgttccacaagctccaaaaccc

SEQ ID NO: 176638 - DNA, 25 bp, Rattus norvegicus
atatgttccacatgctccaaaaccc

SEQ ID NO: 176639 - DNA, 25 bp, Rattus norvegicus
atatgttccataattctatctctaa

SEQ ID NO: 176640 - DNA, 25 bp, Rattus norvegicus
atatgttccatatttctatctctaa

SEQ ID NO: 176641 - DNA, 25 bp, Rattus norvegicus
atatgttccctgctctgtgtctgtg

SEQ ID NO: 176642 - DNA, 25 bp, Rattus norvegicus
atatgttccctggtctgtgtctgtg

SEQ ID NO: 176643 - DNA, 25 bp, Rattus norvegicus
atatgttccggaatgcttttctgtt

SEQ ID NO: 176644 - DNA, 25 bp, Rattus norvegicus
atatgttccggattgcttttctgtt

SEQ ID NO: 176645 - DNA, 25 bp, Rattus norvegicus
atatgttctattagttaccgtaaat

SEQ ID NO: 176646 - DNA, 25 bp, Rattus norvegicus
atatgttctatttgttaccgtaaat

SEQ ID NO: 176647 - DNA, 25 bp, Rattus norvegicus
atatgttctcacacaattgccggat

SEQ ID NO: 176648 - DNA, 25 bp, Rattus norvegicus
atatgttctcactcaattgccggat

SEQ ID NO: 176649 - DNA, 25 bp, Rattus norvegicus
atatgttctgcgcaggctatgacgc

SEQ ID NO: 176650 - DNA, 25 bp, Rattus norvegicus
atatgttctgcggaggctatgacgc

SEQ ID NO: 176651 - DNA, 25 bp, Rattus norvegicus
atatgttctgttcatagtatgtgac

SEQ ID NO: 176652 - DNA, 25 bp, Rattus norvegicus
atatgttctgttgatagtatgtgac

SEQ ID NO: 176653 - DNA, 25 bp, Rattus norvegicus
atatgttgacagaggcaggctggca

SEQ ID NO: 176654 - DNA, 25 bp, Rattus norvegicus
atatgttgacagtggcaggctggca

SEQ ID NO: 176655 - DNA, 25 bp, Rattus norvegicus
atatgttggcaccttagctacttcc

SEQ ID NO: 176656 - DNA, 25 bp, Rattus norvegicus
atatgttggcacgttagctacttcc

SEQ ID NO: 176657 - DNA, 25 bp, Rattus norvegicus
atatgttggtacctgtgagggcaca

SEQ ID NO: 176658 - DNA, 25 bp, Rattus norvegicus
atatgttggtacgtgtgagggcaca

SEQ ID NO: 176659 - DNA, 25 bp, Rattus norvegicus
atatgttggtatattcatacacgtg

SEQ ID NO: 176660 - DNA, 25 bp, Rattus norvegicus
atatgttggtattttcatacacgtg

SEQ ID NO: 176661 - DNA, 25 bp, Rattus norvegicus
atatgttgtcaactggccaaagtcc

SEQ ID NO: 176662 - DNA, 25 bp, Rattus norvegicus
atatgttgtcaagtggccaaagtcc

SEQ ID NO: 176663 - DNA, 25 bp, Rattus norvegicus
atatgttgttttaatgtttgtagcc

SEQ ID NO: 176664 - DNA, 25 bp, Rattus norvegicus
atatgttgtttttatgtttgtagcc

SEQ ID NO: 176665 - DNA, 25 bp, Rattus norvegicus
atatgtttacgcagatcttgattta

SEQ ID NO: 176666 - DNA, 25 bp, Rattus norvegicus
atatgtttacgctgatcttgattta

SEQ ID NO: 176667 - DNA, 25 bp, Rattus norvegicus
atatgtttatatcccgctgatctga

SEQ ID NO: 176668 - DNA, 25 bp, Rattus norvegicus
atatgtttatatgccgctgatctga

SEQ ID NO: 176669 - DNA, 25 bp, Rattus norvegicus
atatgtttcaatacttcatccccgc

SEQ ID NO: 176670 - DNA, 25 bp, Rattus norvegicus
atatgtttcaattcttcatccccgc

SEQ ID NO: 176671 - DNA, 25 bp, Rattus norvegicus
atatgtttcatcactgcgtcaagta

SEQ ID NO: 176672 - DNA, 25 bp, Rattus norvegicus
atatgtttcatcagtagttggtctg

SEQ ID NO: 176673 - DNA, 25 bp, Rattus norvegicus
atatgtttcatctctgcgtcaagta

SEQ ID NO: 176674 - DNA, 25 bp, Rattus norvegicus
atatgtttcatctgtagttggtctg

SEQ ID NO: 176675 - DNA, 25 bp, Rattus norvegicus
atatgtttcttaatgccctgccagt

SEQ ID NO: 176676 - DNA, 25 bp, Rattus norvegicus
atatgtttcttattgccctgccagt

SEQ ID NO: 176677 - DNA, 25 bp, Rattus norvegicus
atatgtttctttacattgccacaca

SEQ ID NO: 176678 - DNA, 25 bp, Rattus norvegicus
atatgtttcttttcattgccacaca

SEQ ID NO: 176679 - DNA, 25 bp, Rattus norvegicus
atatgtttgagaagccagctggtga

SEQ ID NO: 176680 - DNA, 25 bp, Rattus norvegicus
atatgtttgagatgccagctggtga

SEQ ID NO: 176681 - DNA, 25 bp, Rattus norvegicus
atatgtttgcccctgattggatctg

SEQ ID NO: 176682 - DNA, 25 bp, Rattus norvegicus
atatgtttgcccgtgattggatctg

SEQ ID NO: 176683 - DNA, 25 bp, Rattus norvegicus
atatgtttgtgcctgttaactaaat

SEQ ID NO: 176684 - DNA, 25 bp, Rattus norvegicus
atatgtttgtgcgtgttaactaaat

SEQ ID NO: 176685 - DNA, 25 bp, Rattus norvegicus
atatgttttatcataccccatctct

SEQ ID NO: 176686 - DNA, 25 bp, Rattus norvegicus
atatgttttatcttaccccatctct

SEQ ID NO: 176687 - DNA, 25 bp, Rattus norvegicus
atatgttttcctactgcttacgttc

SEQ ID NO: 176688 - DNA, 25 bp, Rattus norvegicus
atatgttttccttctgcttacgttc

SEQ ID NO: 176689 - DNA, 25 bp, Rattus norvegicus
atattaaactctcccttaccttaca

SEQ ID NO: 176690 - DNA, 25 bp, Rattus norvegicus
atattaaactctgccttaccttaca

SEQ ID NO: 176691 - DNA, 25 bp, Rattus norvegicus
atattaaatacactggacatcctca

SEQ ID NO: 176692 - DNA, 25 bp, Rattus norvegicus
atattaaatacagtggacatcctca

SEQ ID NO: 176693 - DNA, 25 bp, Rattus norvegicus
atattaaattgaaaccaggcctggc

SEQ ID NO: 176694 - DNA, 25 bp, Rattus norvegicus
atattaaattgataccaggcctggc

SEQ ID NO: 176695 - DNA, 25 bp, Rattus norvegicus
atattaacctctcacacatgtgtga

SEQ ID NO: 176696 - DNA, 25 bp, Rattus norvegicus
atattaacctctgacacatgtgtga

SEQ ID NO: 176697 - DNA, 25 bp, Rattus norvegicus
atattaagatgactccagcccctgc

SEQ ID NO: 176698 - DNA, 25 bp, Rattus norvegicus
atattaagatgagtccagcccctgc

SEQ ID NO: 176699 - DNA, 25 bp, Rattus norvegicus
atattaagccacagcattacccttc

SEQ ID NO: 176700 - DNA, 25 bp, Rattus norvegicus
atattaagccactgcattacccttc

SEQ ID NO: 176701 - DNA, 25 bp, Rattus norvegicus
atattaaggcagctcccttggttgc

SEQ ID NO: 176702 - DNA, 25 bp, Rattus norvegicus
atattaaggcaggtcccttggttgc

SEQ ID NO: 176703 - DNA, 25 bp, Rattus norvegicus
atattaagtcttactttggtcaact

SEQ ID NO: 176704 - DNA, 25 bp, Rattus norvegicus
atattaagtctttctttggtcaact

SEQ ID NO: 176705 - DNA, 25 bp, Rattus norvegicus
atattaatagggaattctggtcctt

SEQ ID NO: 176706 - DNA, 25 bp, Rattus norvegicus
atattaatagggtattctggtcctt

SEQ ID NO: 176707 - DNA, 25 bp, Rattus norvegicus
atattaatcctgcatgctggacatg

SEQ ID NO: 176708 - DNA, 25 bp, Rattus norvegicus
atattaatcctggatgctggacatg

SEQ ID NO: 176709 - DNA, 25 bp, Rattus norvegicus
atattaatgggtctcctccacagtg

SEQ ID NO: 176710 - DNA, 25 bp, Rattus norvegicus
atattaatgggtgtcctccacagtg

SEQ ID NO: 176711 - DNA, 25 bp, Rattus norvegicus
atattacaacgccgcagcattatga

SEQ ID NO: 176712 - DNA, 25 bp, Rattus norvegicus
atattacaacgcggcagcattatga

SEQ ID NO: 176713 - DNA, 25 bp, Rattus norvegicus
atattacacaatccatgcttccagc

SEQ ID NO: 176714 - DNA, 25 bp, Rattus norvegicus
atattacacaatgcatgcttccagc

SEQ ID NO: 176715 - DNA, 25 bp, Rattus norvegicus
atattacaccctaggccagactgta

SEQ ID NO: 176716 - DNA, 25 bp, Rattus norvegicus
atattacacccttggccagactgta

SEQ ID NO: 176717 - DNA, 25 bp, Rattus norvegicus
atattacaccttcactgccatttcc

SEQ ID NO: 176718 - DNA, 25 bp, Rattus norvegicus
atattacaccttgactgccatttcc

SEQ ID NO: 176719 - DNA, 25 bp, Rattus norvegicus
atattacacggtacctcatacactt

SEQ ID NO: 176720 - DNA, 25 bp, Rattus norvegicus
atattacacggttcctcatacactt

SEQ ID NO: 176721 - DNA, 25 bp, Rattus norvegicus
atattacactatacccttccatgaa

SEQ ID NO: 176722 - DNA, 25 bp, Rattus norvegicus
atattacactattcccttccatgaa

SEQ ID NO: 176723 - DNA, 25 bp, Rattus norvegicus
atattacactgaattaagagctaac

SEQ ID NO: 176724 - DNA, 25 bp, Rattus norvegicus
atattacactgatttaagagctaac

SEQ ID NO: 176725 - DNA, 25 bp, Rattus norvegicus
atattacatgtcaactccccgaaga

SEQ ID NO: 176726 - DNA, 25 bp, Rattus norvegicus
atattacatgtctactccccgaaga

SEQ ID NO: 176727 - DNA, 25 bp, Rattus norvegicus
atattacccctcaccaaagatgact

SEQ ID NO: 176728 - DNA, 25 bp, Rattus norvegicus
atattacccctctccaaagatgact

SEQ ID NO: 176729 - DNA, 25 bp, Rattus norvegicus
atattacctgaaagactgtcaagtt

SEQ ID NO: 176730 - DNA, 25 bp, Rattus norvegicus
atattacctgaatgactgtcaagtt

SEQ ID NO: 176731 - DNA, 25 bp, Rattus norvegicus
atattactaaccatggtctttccct

SEQ ID NO: 176732 - DNA, 25 bp, Rattus norvegicus
atattactaaccttggtctttccct

SEQ ID NO: 176733 - DNA, 25 bp, Rattus norvegicus
atattactacagaagaccggagcct

SEQ ID NO: 176734 - DNA, 25 bp, Rattus norvegicus
atattactacagtagaccggagcct

SEQ ID NO: 176735 - DNA, 25 bp, Rattus norvegicus
atattactacttcctgtcttctgat

SEQ ID NO: 176736 - DNA, 25 bp, Rattus norvegicus
atattactacttgctgtcttctgat

SEQ ID NO: 176737 - DNA, 25 bp, Rattus norvegicus
atattactcagtctgctcgtagcat

SEQ ID NO: 176738 - DNA, 25 bp, Rattus norvegicus
atattactcagtgtgctcgtagcat

SEQ ID NO: 176739 - DNA, 25 bp, Rattus norvegicus
atattactcttccatattccttctg

SEQ ID NO: 176740 - DNA, 25 bp, Rattus norvegicus
atattactcttcgatattccttctg

SEQ ID NO: 176741 - DNA, 25 bp, Rattus norvegicus
atattactgcacaaactgccgtctc

SEQ ID NO: 176742 - DNA, 25 bp, Rattus norvegicus
atattactgcactaactgccgtctc

SEQ ID NO: 176743 - DNA, 25 bp, Rattus norvegicus
atattactgtggatacttgccccta

SEQ ID NO: 176744 - DNA, 25 bp, Rattus norvegicus
atattactgtggttacttgccccta

SEQ ID NO: 176745 - DNA, 25 bp, Rattus norvegicus
atattacttcttatagcccatgacg

SEQ ID NO: 176746 - DNA, 25 bp, Rattus norvegicus
atattacttcttttagcccatgacg

SEQ ID NO: 176747 - DNA, 25 bp, Rattus norvegicus
atattactttggactgtggaggaac

SEQ ID NO: 176748 - DNA, 25 bp, Rattus norvegicus
atattactttggtctgtggaggaac

SEQ ID NO: 176749 - DNA, 25 bp, Rattus norvegicus
atattagacatcctccccactgaga

SEQ ID NO: 176750 - DNA, 25 bp, Rattus norvegicus
atattagacatcgtccccactgaga

SEQ ID NO: 176751 - DNA, 25 bp, Rattus norvegicus
atattagaccttaatgactcatagg

SEQ ID NO: 176752 - DNA, 25 bp, Rattus norvegicus
atattagacctttatgactcatagg

SEQ ID NO: 176753 - DNA, 25 bp, Rattus norvegicus
atattagacggacactgctccatcc

SEQ ID NO: 176754 - DNA, 25 bp, Rattus norvegicus
atattagacggagactgctccatcc

SEQ ID NO: 176755 - DNA, 25 bp, Rattus norvegicus
atattagagcatcgccggatctccg

SEQ ID NO: 176756 - DNA, 25 bp, Rattus norvegicus
atattagagcatggccggatctccg

SEQ ID NO: 176757 - DNA, 25 bp, Rattus norvegicus
atattagccttcaagtctgtaatgg

SEQ ID NO: 176758 - DNA, 25 bp, Rattus norvegicus
atattagccttctagtctgtaatgg

SEQ ID NO: 176759 - DNA, 25 bp, Rattus norvegicus
atattaggagagatgccccagggat

SEQ ID NO: 176760 - DNA, 25 bp, Rattus norvegicus
atattaggagagttgccccagggat

SEQ ID NO: 176761 - DNA, 25 bp, Rattus norvegicus
atattaggccagcatctcactgagg

SEQ ID NO: 176762 - DNA, 25 bp, Rattus norvegicus
atattaggccaggatctcactgagg

SEQ ID NO: 176763 - DNA, 25 bp, Rattus norvegicus
atattagtgctgaggttttcggttt

SEQ ID NO: 176764 - DNA, 25 bp, Rattus norvegicus
atattagtgctgtggttttcggttt

SEQ ID NO: 176765 - DNA, 25 bp, Rattus norvegicus
atattagttggaaggaccaggcgct

SEQ ID NO: 176766 - DNA, 25 bp, Rattus norvegicus
atattagttggatggaccaggcgct

SEQ ID NO: 176767 - DNA, 25 bp, Rattus norvegicus
atattatataccacctttccacaag

SEQ ID NO: 176768 - DNA, 25 bp, Rattus norvegicus
atattatatacctcctttccacaag

SEQ ID NO: 176769 - DNA, 25 bp, Rattus norvegicus
atattatattcactccagctctaca

SEQ ID NO: 176770 - DNA, 25 bp, Rattus norvegicus
atattatattcagtccagctctaca

SEQ ID NO: 176771 - DNA, 25 bp, Rattus norvegicus
atattatcccagagtcccctgcctt

SEQ ID NO: 176772 - DNA, 25 bp, Rattus norvegicus
atattatcccagtgtcccctgcctt

SEQ ID NO: 176773 - DNA, 25 bp, Rattus norvegicus
atattatcgcacagaccagttccag

SEQ ID NO: 176774 - DNA, 25 bp, Rattus norvegicus
atattatcgcactgaccagttccag

SEQ ID NO: 176775 - DNA, 25 bp, Rattus norvegicus
atattatgcctcaagactgtcatct

SEQ ID NO: 176776 - DNA, 25 bp, Rattus norvegicus
atattatgcctctagactgtcatct

SEQ ID NO: 176777 - DNA, 25 bp, Rattus norvegicus
atattatggctaatggtcaggcggg

SEQ ID NO: 176778 - DNA, 25 bp, Rattus norvegicus
atattatggctattggtcaggcggg

SEQ ID NO: 176779 - DNA, 25 bp, Rattus norvegicus
atattattatgtcccctgtgttccc

SEQ ID NO: 176780 - DNA, 25 bp, Rattus norvegicus
atattattatgtgccctgtgttccc

SEQ ID NO: 176781 - DNA, 25 bp, Rattus norvegicus
atattattcaaaaccatcccgatgt

SEQ ID NO: 176782 - DNA, 25 bp, Rattus norvegicus
atattattcaaatccatcccgatgt

SEQ ID NO: 176783 - DNA, 25 bp, Rattus norvegicus
atattattcagtctgtgccttccca

SEQ ID NO: 176784 - DNA, 25 bp, Rattus norvegicus
atattattcagtgtgtgccttccca

SEQ ID NO: 176785 - DNA, 25 bp, Rattus norvegicus
atattattcatgagtcctcagagca

SEQ ID NO: 176786 - DNA, 25 bp, Rattus norvegicus
atattattcatgtgtcctcagagca

SEQ ID NO: 176787 - DNA, 25 bp, Rattus norvegicus
atattattctctactatgacctcct

SEQ ID NO: 176788 - DNA, 25 bp, Rattus norvegicus
atattattctcttctatgacctcct

SEQ ID NO: 176789 - DNA, 25 bp, Rattus norvegicus
atattattctgcagttgcttctgtc

SEQ ID NO: 176790 - DNA, 25 bp, Rattus norvegicus
atattattctgctgttgcttctgtc

SEQ ID NO: 176791 - DNA, 25 bp, Rattus norvegicus
atattattgtccactcagttactga

SEQ ID NO: 176792 - DNA, 25 bp, Rattus norvegicus
atattattgtcctctcagttactga

SEQ ID NO: 176793 - DNA, 25 bp, Rattus norvegicus
atattatttcctagacatagtgact

SEQ ID NO: 176794 - DNA, 25 bp, Rattus norvegicus
atattatttccttgacatagtgact

SEQ ID NO: 176795 - DNA, 25 bp, Rattus norvegicus
atattcaactatcctaacctcacag

SEQ ID NO: 176796 - DNA, 25 bp, Rattus norvegicus
atattcaactatgctaacctcacag

SEQ ID NO: 176797 - DNA, 25 bp, Rattus norvegicus
atattcaagatgatctggtcactta

SEQ ID NO: 176798 - DNA, 25 bp, Rattus norvegicus
atattcaagatgttctggtcactta

SEQ ID NO: 176799 - DNA, 25 bp, Rattus norvegicus
atattcaagcctatcatctttgttg

SEQ ID NO: 176800 - DNA, 25 bp, Rattus norvegicus
atattcaagcctttcatctttgttg

SEQ ID NO: 176801 - DNA, 25 bp, Rattus norvegicus
atattcaagtcaaccatgtccctgt

SEQ ID NO: 176802 - DNA, 25 bp, Rattus norvegicus
atattcaagtcatccatgtccctgt

SEQ ID NO: 176803 - DNA, 25 bp, Rattus norvegicus
atattcaatgaacgcctgcgacctg

SEQ ID NO: 176804 - DNA, 25 bp, Rattus norvegicus
atattcaatgaaggcctgcgacctg

SEQ ID NO: 176805 - DNA, 25 bp, Rattus norvegicus
atattcacactcagatacaatcctt

SEQ ID NO: 176806 - DNA, 25 bp, Rattus norvegicus
atattcacactctgatacaatcctt

SEQ ID NO: 176807 - DNA, 25 bp, Rattus norvegicus
atattcacatgtccacacagcgtgc

SEQ ID NO: 176808 - DNA, 25 bp, Rattus norvegicus
atattcacatgtgcacacagcgtgc

SEQ ID NO: 176809 - DNA, 25 bp, Rattus norvegicus
atattcacctatccaatcttgttct

SEQ ID NO: 176810 - DNA, 25 bp, Rattus norvegicus
atattcacctatgcaatcttgttct

SEQ ID NO: 176811 - DNA, 25 bp, Rattus norvegicus
atattcactaacattaccctggcag

SEQ ID NO: 176812 - DNA, 25 bp, Rattus norvegicus
atattcactaactttaccctggcag

SEQ ID NO: 176813 - DNA, 25 bp, Rattus norvegicus
atattcactatcagcctaaggtatg

SEQ ID NO: 176814 - DNA, 25 bp, Rattus norvegicus
atattcactatctgcctaaggtatg

SEQ ID NO: 176815 - DNA, 25 bp, Rattus norvegicus
atattcagagcgcaggccctgatct

SEQ ID NO: 176816 - DNA, 25 bp, Rattus norvegicus
atattcagagcggaggccctgatct

SEQ ID NO: 176817 - DNA, 25 bp, Rattus norvegicus
atattcagcctgcagggaaccatgt

SEQ ID NO: 176818 - DNA, 25 bp, Rattus norvegicus
atattcagcctggagggaaccatgt

SEQ ID NO: 176819 - DNA, 25 bp, Rattus norvegicus
atattcagttcactcacccaatgta

SEQ ID NO: 176820 - DNA, 25 bp, Rattus norvegicus
atattcagttcagtcacccaatgta

SEQ ID NO: 176821 - DNA, 25 bp, Rattus norvegicus
atattcatccttctctgttggccaa

SEQ ID NO: 176822 - DNA, 25 bp, Rattus norvegicus
atattcatccttgtctgttggccaa

SEQ ID NO: 176823 - DNA, 25 bp, Rattus norvegicus
atattcattctaacagttcctctag

SEQ ID NO: 176824 - DNA, 25 bp, Rattus norvegicus
atattcattctatcagttcctctag

SEQ ID NO: 176825 - DNA, 25 bp, Rattus norvegicus
atattccaaggactcatacaaagaa

SEQ ID NO: 176826 - DNA, 25 bp, Rattus norvegicus
atattccaaggagtcatacaaagaa

SEQ ID NO: 176827 - DNA, 25 bp, Rattus norvegicus
atattccaatggcagcctttcgtcc

SEQ ID NO: 176828 - DNA, 25 bp, Rattus norvegicus
atattccaatgggagcctttcgtcc

SEQ ID NO: 176829 - DNA, 25 bp, Rattus norvegicus
atattccatgcaatgccccagagga

SEQ ID NO: 176830 - DNA, 25 bp, Rattus norvegicus
atattccatgcattgccccagagga

SEQ ID NO: 176831 - DNA, 25 bp, Rattus norvegicus
atattccatgtaagatttctccaca

SEQ ID NO: 176832 - DNA, 25 bp, Rattus norvegicus
atattccatgtatgatttctccaca

SEQ ID NO: 176833 - DNA, 25 bp, Rattus norvegicus
atattcccaaggatagctgtctgat

SEQ ID NO: 176834 - DNA, 25 bp, Rattus norvegicus
atattcccaaggttagctgtctgat

SEQ ID NO: 176835 - DNA, 25 bp, Rattus norvegicus
atattcccattgacatttgctctgc

SEQ ID NO: 176836 - DNA, 25 bp, Rattus norvegicus
atattcccattgtcatttgctctgc

SEQ ID NO: 176837 - DNA, 25 bp, Rattus norvegicus
atattcccatttctatttttagtca

SEQ ID NO: 176838 - DNA, 25 bp, Rattus norvegicus
atattcccatttgtatttttagtca

SEQ ID NO: 176839 - DNA, 25 bp, Rattus norvegicus
atattcccctacatttactgacctg

SEQ ID NO: 176840 - DNA, 25 bp, Rattus norvegicus
atattcccctacttttactgacctg

SEQ ID NO: 176841 - DNA, 25 bp, Rattus norvegicus
atattcccctcacctggcaacagga

SEQ ID NO: 176842 - DNA, 25 bp, Rattus norvegicus
atattcccctcagctggcaacagga

SEQ ID NO: 176843 - DNA, 25 bp, Rattus norvegicus
atattccctggacttacaatgttta

SEQ ID NO: 176844 - DNA, 25 bp, Rattus norvegicus
atattccctggagttacaatgttta

SEQ ID NO: 176845 - DNA, 25 bp, Rattus norvegicus
atattccctgttcgttcctgtttca

SEQ ID NO: 176846 - DNA, 25 bp, Rattus norvegicus
atattccctgttggttcctgtttca

SEQ ID NO: 176847 - DNA, 25 bp, Rattus norvegicus
atattccgcactacagttgcctgta

SEQ ID NO: 176848 - DNA, 25 bp, Rattus norvegicus
atattccgcacttcagttgcctgta

SEQ ID NO: 176849 - DNA, 25 bp, Rattus norvegicus
atattccgcatgattttccactcta

SEQ ID NO: 176850 - DNA, 25 bp, Rattus norvegicus
atattccgcatgtttttccactcta

SEQ ID NO: 176851 - DNA, 25 bp, Rattus norvegicus
atattccgcgttagttcagctgctt

SEQ ID NO: 176852 - DNA, 25 bp, Rattus norvegicus
atattccgcgtttgttcagctgctt

SEQ ID NO: 176853 - DNA, 25 bp, Rattus norvegicus
atattccgtaacacaaccaggcaac

SEQ ID NO: 176854 - DNA, 25 bp, Rattus norvegicus
atattccgtaactcaaccaggcaac

SEQ ID NO: 176855 - DNA, 25 bp, Rattus norvegicus
atattcctagaaatgttgccagtgt

SEQ ID NO: 176856 - DNA, 25 bp, Rattus norvegicus
atattcctagaattgttgccagtgt

SEQ ID NO: 176857 - DNA, 25 bp, Rattus norvegicus
atattcctagatacagtttgtaagc

SEQ ID NO: 176858 - DNA, 25 bp, Rattus norvegicus
atattcctagattcagtttgtaagc

SEQ ID NO: 176859 - DNA, 25 bp, Rattus norvegicus
atattcctcagcctcatgggctaag

SEQ ID NO: 176860 - DNA, 25 bp, Rattus norvegicus
atattcctcagcgtcatgggctaag

SEQ ID NO: 176861 - DNA, 25 bp, Rattus norvegicus
atattcctcatcaactgcactttta

SEQ ID NO: 176862 - DNA, 25 bp, Rattus norvegicus
atattcctcatctactgcactttta

SEQ ID NO: 176863 - DNA, 25 bp, Rattus norvegicus
atattcctctctacgtgttctaata

SEQ ID NO: 176864 - DNA, 25 bp, Rattus norvegicus
atattcctctcttcgtgttctaata

SEQ ID NO: 176865 - DNA, 25 bp, Rattus norvegicus
atattcctgatgactgctgtgctgc

SEQ ID NO: 176866 - DNA, 25 bp, Rattus norvegicus
atattcctgatgtctgctgtgctgc

SEQ ID NO: 176867 - DNA, 25 bp, Rattus norvegicus
atattcctgcctcaggaccagttgt

SEQ ID NO: 176868 - DNA, 25 bp, Rattus norvegicus
atattcctgcctgaggaccagttgt

SEQ ID NO: 176869 - DNA, 25 bp, Rattus norvegicus
atattcctgcggcaactcccaatgg

SEQ ID NO: 176870 - DNA, 25 bp, Rattus norvegicus
atattcctgcgggaactcccaatgg

SEQ ID NO: 176871 - DNA, 25 bp, Rattus norvegicus
atattcctggatacaatttgtctgc

SEQ ID NO: 176872 - DNA, 25 bp, Rattus norvegicus
atattcctggattcaatttgtctgc

SEQ ID NO: 176873 - DNA, 25 bp, Rattus norvegicus
atattcctggccagaacctgagtca

SEQ ID NO: 176874 - DNA, 25 bp, Rattus norvegicus
atattcctggcctgaacctgagtca

SEQ ID NO: 176875 - DNA, 25 bp, Rattus norvegicus
atattcctggttatcctgtatgtca

SEQ ID NO: 176876 - DNA, 25 bp, Rattus norvegicus
atattcctggttttcctgtatgtca

SEQ ID NO: 176877 - DNA, 25 bp, Rattus norvegicus
atattccttattcccgtgtgttaca

SEQ ID NO: 176878 - DNA, 25 bp, Rattus norvegicus
atattccttattgccgtgtgttaca

SEQ ID NO: 176879 - DNA, 25 bp, Rattus norvegicus
atattccttcatattctcacttcaa

SEQ ID NO: 176880 - DNA, 25 bp, Rattus norvegicus
atattccttcattttctcacttcaa

SEQ ID NO: 176881 - DNA, 25 bp, Rattus norvegicus
atattcgaatgtcctgcacagcagc

SEQ ID NO: 176882 - DNA, 25 bp, Rattus norvegicus
atattcgaatgtgctgcacagcagc

SEQ ID NO: 176883 - DNA, 25 bp, Rattus norvegicus
atattcggaaaccttggaagccatc

SEQ ID NO: 176884 - DNA, 25 bp, Rattus norvegicus
atattcggaaacgttggaagccatc

SEQ ID NO: 176885 - DNA, 25 bp, Rattus norvegicus
atattcggaggccatgagccacact

SEQ ID NO: 176886 - DNA, 25 bp, Rattus norvegicus
atattcggaggcgatgagccacact

SEQ ID NO: 176887 - DNA, 25 bp, Rattus norvegicus
atattcgtacaactcctcttcgtca

SEQ ID NO: 176888 - DNA, 25 bp, Rattus norvegicus
atattcgtacaagtcctcttcgtca

SEQ ID NO: 176889 - DNA, 25 bp, Rattus norvegicus
atattcgtactacttcatgacccct

SEQ ID NO: 176890 - DNA, 25 bp, Rattus norvegicus
atattcgtactagttcatgacccct

SEQ ID NO: 176891 - DNA, 25 bp, Rattus norvegicus
atattcgtgccaaccttctgaaaag

SEQ ID NO: 176892 - DNA, 25 bp, Rattus norvegicus
atattcgtgccatccttctgaaaag

SEQ ID NO: 176893 - DNA, 25 bp, Rattus norvegicus
atattcgtggccaagcattctgtct

SEQ ID NO: 176894 - DNA, 25 bp, Rattus norvegicus
atattcgtggcctagcattctgtct

SEQ ID NO: 176895 - DNA, 25 bp, Rattus norvegicus
atattctacgccattattgtctgtg

SEQ ID NO: 176896 - DNA, 25 bp, Rattus norvegicus
atattctacgcctttattgtctgtg

SEQ ID NO: 176897 - DNA, 25 bp, Rattus norvegicus
atattctaggtgaagctgttccagc

SEQ ID NO: 176898 - DNA, 25 bp, Rattus norvegicus
atattctaggtgtagctgttccagc

SEQ ID NO: 176899 - DNA, 25 bp, Rattus norvegicus
atattctatcttccgtgagtctctt

SEQ ID NO: 176900 - DNA, 25 bp, Rattus norvegicus
atattctatcttgcgtgagtctctt

SEQ ID NO: 176901 - DNA, 25 bp, Rattus norvegicus
atattctcacttactgctttctgga

SEQ ID NO: 176902 - DNA, 25 bp, Rattus norvegicus
atattctcactttctgctttctgga

SEQ ID NO: 176903 - DNA, 25 bp, Rattus norvegicus
atattctcagcaacaactgtcccat

SEQ ID NO: 176904 - DNA, 25 bp, Rattus norvegicus
atattctcagcatcaactgtcccat

SEQ ID NO: 176905 - DNA, 25 bp, Rattus norvegicus
atattctcattcatgttctctctct

SEQ ID NO: 176906 - DNA, 25 bp, Rattus norvegicus
atattctcattcttgttctctctct

SEQ ID NO: 176907 - DNA, 25 bp, Rattus norvegicus
atattctccattccctacgaacttt

SEQ ID NO: 176908 - DNA, 25 bp, Rattus norvegicus
atattctccattgcctacgaacttt

SEQ ID NO: 176909 - DNA, 25 bp, Rattus norvegicus
atattctcccagctgctgttgcttc

SEQ ID NO: 176910 - DNA, 25 bp, Rattus norvegicus
atattctcccaggtgctgttgcttc

SEQ ID NO: 176911 - DNA, 25 bp, Rattus norvegicus
atattctccgaactttgaccgtttg

SEQ ID NO: 176912 - DNA, 25 bp, Rattus norvegicus
atattctccgaagtttgaccgtttg

SEQ ID NO: 176913 - DNA, 25 bp, Rattus norvegicus
atattctctacaagtcatgacccct

SEQ ID NO: 176914 - DNA, 25 bp, Rattus norvegicus
atattctctacatgtcatgacccct

SEQ ID NO: 176915 - DNA, 25 bp, Rattus norvegicus
atattctcttcccaacaggagctgc

SEQ ID NO: 176916 - DNA, 25 bp, Rattus norvegicus
atattctcttccgaacaggagctgc

SEQ ID NO: 176917 - DNA, 25 bp, Rattus norvegicus
atattctctttcaattacatactag

SEQ ID NO: 176918 - DNA, 25 bp, Rattus norvegicus
atattctctttctattacatactag

SEQ ID NO: 176919 - DNA, 25 bp, Rattus norvegicus
atattctcttttcaggttccctctc

SEQ ID NO: 176920 - DNA, 25 bp, Rattus norvegicus
atattctcttttgaggttccctctc

SEQ ID NO: 176921 - DNA, 25 bp, Rattus norvegicus
atattctgaataactgtataattac

SEQ ID NO: 176922 - DNA, 25 bp, Rattus norvegicus
atattctgaatatctgtataattac

SEQ ID NO: 176923 - DNA, 25 bp, Rattus norvegicus
atattctgacaccactgactctgat

SEQ ID NO: 176924 - DNA, 25 bp, Rattus norvegicus
atattctgacacgactgactctgat

SEQ ID NO: 176925 - DNA, 25 bp, Rattus norvegicus
atattctgagaccttaaccttcctg

SEQ ID NO: 176926 - DNA, 25 bp, Rattus norvegicus
atattctgagacgttaaccttcctg

SEQ ID NO: 176927 - DNA, 25 bp, Rattus norvegicus
atattctgagtaatccattctaagg

SEQ ID NO: 176928 - DNA, 25 bp, Rattus norvegicus
atattctgagtattccattctaagg

SEQ ID NO: 176929 - DNA, 25 bp, Rattus norvegicus
atattctgccaccaagtgcttgagt

SEQ ID NO: 176930 - DNA, 25 bp, Rattus norvegicus
atattctgccacgaagtgcttgagt

SEQ ID NO: 176931 - DNA, 25 bp, Rattus norvegicus
atattctgccataatgtccacctta

SEQ ID NO: 176932 - DNA, 25 bp, Rattus norvegicus
atattctgccatagagctgtgccct

SEQ ID NO: 176933 - DNA, 25 bp, Rattus norvegicus
atattctgccattatgtccacctta

SEQ ID NO: 176934 - DNA, 25 bp, Rattus norvegicus
atattctgccattgagctgtgccct

SEQ ID NO: 176935 - DNA, 25 bp, Rattus norvegicus
atattctgcctgacggacgcaaaga

SEQ ID NO: 176936 - DNA, 25 bp, Rattus norvegicus
atattctgcctgtcggacgcaaaga

SEQ ID NO: 176937 - DNA, 25 bp, Rattus norvegicus
atattctgtgcccatatggatgtct

SEQ ID NO: 176938 - DNA, 25 bp, Rattus norvegicus
atattctgtgccgatatggatgtct

SEQ ID NO: 176939 - DNA, 25 bp, Rattus norvegicus
atattctgtgttatcaagtctcttt

SEQ ID NO: 176940 - DNA, 25 bp, Rattus norvegicus
atattctgtgttttcaagtctcttt

SEQ ID NO: 176941 - DNA, 25 bp, Rattus norvegicus
atattcttaagccaatctgctccag

SEQ ID NO: 176942 - DNA, 25 bp, Rattus norvegicus
atattcttaagcgaatctgctccag

SEQ ID NO: 176943 - DNA, 25 bp, Rattus norvegicus
atattcttcaacaactcttcatcac

SEQ ID NO: 176944 - DNA, 25 bp, Rattus norvegicus
atattcttcaactactcttcatcac

SEQ ID NO: 176945 - DNA, 25 bp, Rattus norvegicus
atattcttcggtactgaggagcagt

SEQ ID NO: 176946 - DNA, 25 bp, Rattus norvegicus
atattcttcggttctgaggagcagt

SEQ ID NO: 176947 - DNA, 25 bp, Rattus norvegicus
atattcttcgtcataatttcacccc

SEQ ID NO: 176948 - DNA, 25 bp, Rattus norvegicus
atattcttcgtcttaatttcacccc

SEQ ID NO: 176949 - DNA, 25 bp, Rattus norvegicus
atattcttcttcagctcgtagatcc

SEQ ID NO: 176950 - DNA, 25 bp, Rattus norvegicus
atattcttcttctgctcgtagatcc

SEQ ID NO: 176951 - DNA, 25 bp, Rattus norvegicus
atattcttgagtactgccttttctg

SEQ ID NO: 176952 - DNA, 25 bp, Rattus norvegicus
atattcttgagttctgccttttctg

SEQ ID NO: 176953 - DNA, 25 bp, Rattus norvegicus
atattcttgcctattactggtacag

SEQ ID NO: 176954 - DNA, 25 bp, Rattus norvegicus
atattcttgccttttactggtacag

SEQ ID NO: 176955 - DNA, 25 bp, Rattus norvegicus
atattcttggagattgtttgcttgt

SEQ ID NO: 176956 - DNA, 25 bp, Rattus norvegicus
atattcttggagtttgtttgcttgt

SEQ ID NO: 176957 - DNA, 25 bp, Rattus norvegicus
atattctttaggctctccttttctg

SEQ ID NO: 176958 - DNA, 25 bp, Rattus norvegicus
atattctttagggtctccttttctg

SEQ ID NO: 176959 - DNA, 25 bp, Rattus norvegicus
atattctttttacatgtttcttcca

SEQ ID NO: 176960 - DNA, 25 bp, Rattus norvegicus
atattctttttagatgtttcttcca

SEQ ID NO: 176961 - DNA, 25 bp, Rattus norvegicus
atattgaaggttacccttctccttg

SEQ ID NO: 176962 - DNA, 25 bp, Rattus norvegicus
atattgaaggtttcccttctccttg

SEQ ID NO: 176963 - DNA, 25 bp, Rattus norvegicus
atattgacacatcccttctgatgga

SEQ ID NO: 176964 - DNA, 25 bp, Rattus norvegicus
atattgacacatgccttctgatgga

SEQ ID NO: 176965 - DNA, 25 bp, Rattus norvegicus
atattgacctccacctgcacaggta

SEQ ID NO: 176966 - DNA, 25 bp, Rattus norvegicus
atattgacctcctcctgcacaggta

SEQ ID NO: 176967 - DNA, 25 bp, Rattus norvegicus
atattgacctgaaagaccgtccttt

SEQ ID NO: 176968 - DNA, 25 bp, Rattus norvegicus
atattgacctgatagaccgtccttt

SEQ ID NO: 176969 - DNA, 25 bp, Rattus norvegicus
atattgactcatcggtagccgatcc

SEQ ID NO: 176970 - DNA, 25 bp, Rattus norvegicus
atattgactcatgggtagccgatcc

SEQ ID NO: 176971 - DNA, 25 bp, Rattus norvegicus
atattgacttccagcagaacacatg

SEQ ID NO: 176972 - DNA, 25 bp, Rattus norvegicus
atattgacttcctgcagaacacatg

SEQ ID NO: 176973 - DNA, 25 bp, Rattus norvegicus
atattgagcttccaccatctttttt

SEQ ID NO: 176974 - DNA, 25 bp, Rattus norvegicus
atattgagcttcgaccatctttttt

SEQ ID NO: 176975 - DNA, 25 bp, Rattus norvegicus
atattgagggtaatggcttagccat

SEQ ID NO: 176976 - DNA, 25 bp, Rattus norvegicus
atattgagggtattggcttagccat

SEQ ID NO: 176977 - DNA, 25 bp, Rattus norvegicus
atattgaggtcgcattcctgccatg

SEQ ID NO: 176978 - DNA, 25 bp, Rattus norvegicus
atattgaggtcggattcctgccatg

SEQ ID NO: 176979 - DNA, 25 bp, Rattus norvegicus
atattgaggtctcccattcaagcca

SEQ ID NO: 176980 - DNA, 25 bp, Rattus norvegicus
atattgaggtctgccattcaagcca

SEQ ID NO: 176981 - DNA, 25 bp, Rattus norvegicus
atattgagtctcatagccctactcc

SEQ ID NO: 176982 - DNA, 25 bp, Rattus norvegicus
atattgagtctcttagccctactcc

SEQ ID NO: 176983 - DNA, 25 bp, Rattus norvegicus
atattgatacaacctgcccacctag

SEQ ID NO: 176984 - DNA, 25 bp, Rattus norvegicus
atattgatacaagctgcccacctag

SEQ ID NO: 176985 - DNA, 25 bp, Rattus norvegicus
atattgatcagacggccatgcttga

SEQ ID NO: 176986 - DNA, 25 bp, Rattus norvegicus
atattgatcagagggccatgcttga

SEQ ID NO: 176987 - DNA, 25 bp, Rattus norvegicus
atattgatcggcctgtgccttacgt

SEQ ID NO: 176988 - DNA, 25 bp, Rattus norvegicus
atattgatcggcgtgtgccttacgt

SEQ ID NO: 176989 - DNA, 25 bp, Rattus norvegicus
atattgcaggcacttttctttagga

SEQ ID NO: 176990 - DNA, 25 bp, Rattus norvegicus
atattgcaggcagttttctttagga

SEQ ID NO: 176991 - DNA, 25 bp, Rattus norvegicus
atattgcagtgtcttctccctccct

SEQ ID NO: 176992 - DNA, 25 bp, Rattus norvegicus
atattgcagtgtgttctccctccct

SEQ ID NO: 176993 - DNA, 25 bp, Rattus norvegicus
atattgcataggcacttgaaagact

SEQ ID NO: 176994 - DNA, 25 bp, Rattus norvegicus
atattgcatagggacttgaaagact

SEQ ID NO: 176995 - DNA, 25 bp, Rattus norvegicus
atattgcatcttaaagccctaagag

SEQ ID NO: 176996 - DNA, 25 bp, Rattus norvegicus
atattgcatctttaagccctaagag

SEQ ID NO: 176997 - DNA, 25 bp, Rattus norvegicus
atattgccaaccacaccgaaaggtt

SEQ ID NO: 176998 - DNA, 25 bp, Rattus norvegicus
atattgccaacctcaccgaaaggtt

SEQ ID NO: 176999 - DNA, 25 bp, Rattus norvegicus
atattgccacggctgatcctatcag

SEQ ID NO: 177000 - DNA, 25 bp, Rattus norvegicus
atattgccacgggtgatcctatcag

SEQ ID NO: 177001 - DNA, 25 bp, Rattus norvegicus
atattgcccaagcacctgatcccaa

SEQ ID NO: 177002 - DNA, 25 bp, Rattus norvegicus
atattgcccaaggacctgatcccaa

SEQ ID NO: 177003 - DNA, 25 bp, Rattus norvegicus
atattgccgtagctgcatgtgtcat

SEQ ID NO: 177004 - DNA, 25 bp, Rattus norvegicus
atattgccgtaggtgcatgtgtcat

SEQ ID NO: 177005 - DNA, 25 bp, Rattus norvegicus
atattgcctaggaggccttgactca

SEQ ID NO: 177006 - DNA, 25 bp, Rattus norvegicus
atattgcctaggtggccttgactca

SEQ ID NO: 177007 - DNA, 25 bp, Rattus norvegicus
atattgcctgttctcactatcattt

SEQ ID NO: 177008 - DNA, 25 bp, Rattus norvegicus
atattgcctgttgtcactatcattt

SEQ ID NO: 177009 - DNA, 25 bp, Rattus norvegicus
atattgctaatacctgccttcctac

SEQ ID NO: 177010 - DNA, 25 bp, Rattus norvegicus
atattgctaatagctgccttcctac

SEQ ID NO: 177011 - DNA, 25 bp, Rattus norvegicus
atattgctcaccatggctagtcact

SEQ ID NO: 177012 - DNA, 25 bp, Rattus norvegicus
atattgctcaccttggctagtcact

SEQ ID NO: 177013 - DNA, 25 bp, Rattus norvegicus
atattgctccaaactactgtgttag

SEQ ID NO: 177014 - DNA, 25 bp, Rattus norvegicus
atattgctccaaactcaaacttttg

SEQ ID NO: 177015 - DNA, 25 bp, Rattus norvegicus
atattgctccaatctactgtgttag

SEQ ID NO: 177016 - DNA, 25 bp, Rattus norvegicus
atattgctccaatctcaaacttttg

SEQ ID NO: 177017 - DNA, 25 bp, Rattus norvegicus
atattgctctacagatgtgtgttct

SEQ ID NO: 177018 - DNA, 25 bp, Rattus norvegicus
atattgctctactgatgtgtgttct

SEQ ID NO: 177019 - DNA, 25 bp, Rattus norvegicus
atattgctgaggctttcacacgctg

SEQ ID NO: 177020 - DNA, 25 bp, Rattus norvegicus
atattgctgagggtttcacacgctg

SEQ ID NO: 177021 - DNA, 25 bp, Rattus norvegicus
atattgctgccaaagtggacctctc

SEQ ID NO: 177022 - DNA, 25 bp, Rattus norvegicus
atattgctgccatagtggacctctc

SEQ ID NO: 177023 - DNA, 25 bp, Rattus norvegicus
atattgctgtgaaacctgctttatg

SEQ ID NO: 177024 - DNA, 25 bp, Rattus norvegicus
atattgctgtgatacctgctttatg

SEQ ID NO: 177025 - DNA, 25 bp, Rattus norvegicus
atattgcttcttatactttttagtg

SEQ ID NO: 177026 - DNA, 25 bp, Rattus norvegicus
atattgcttcttttactttttagtg

SEQ ID NO: 177027 - DNA, 25 bp, Rattus norvegicus
atattgcttgacacctaaatccatt

SEQ ID NO: 177028 - DNA, 25 bp, Rattus norvegicus
atattgcttgactcctaaatccatt

SEQ ID NO: 177029 - DNA, 25 bp, Rattus norvegicus
atattgcttgtaatcctgtcaaaca

SEQ ID NO: 177030 - DNA, 25 bp, Rattus norvegicus
atattgcttgtattcctgtcaaaca

SEQ ID NO: 177031 - DNA, 25 bp, Rattus norvegicus
atattggaaggtcgccatatgcccc

SEQ ID NO: 177032 - DNA, 25 bp, Rattus norvegicus
atattggaaggtggccatatgcccc

SEQ ID NO: 177033 - DNA, 25 bp, Rattus norvegicus
atattggaccttatcctgtgcacaa

SEQ ID NO: 177034 - DNA, 25 bp, Rattus norvegicus
atattggaccttttcctgtgcacaa

SEQ ID NO: 177035 - DNA, 25 bp, Rattus norvegicus
atattggacgttaccatccctatac

SEQ ID NO: 177036 - DNA, 25 bp, Rattus norvegicus
atattggacgtttccatccctatac

SEQ ID NO: 177037 - DNA, 25 bp, Rattus norvegicus
atattggagccacatgtgttccctg

SEQ ID NO: 177038 - DNA, 25 bp, Rattus norvegicus
atattggagccagatgtgttccctg

SEQ ID NO: 177039 - DNA, 25 bp, Rattus norvegicus
atattggatgtcagtatgtggtcaa

SEQ ID NO: 177040 - DNA, 25 bp, Rattus norvegicus
atattggatgtctgtatgtggtcaa

SEQ ID NO: 177041 - DNA, 25 bp, Rattus norvegicus
atattggccattaattgttttgtcc

SEQ ID NO: 177042 - DNA, 25 bp, Rattus norvegicus
atattggccatttattgttttgtcc

SEQ ID NO: 177043 - DNA, 25 bp, Rattus norvegicus
atattggcccagatttctcgtcact

SEQ ID NO: 177044 - DNA, 25 bp, Rattus norvegicus
atattggcccagttttctcgtcact

SEQ ID NO: 177045 - DNA, 25 bp, Rattus norvegicus
atattggcctctagtgcagggctgc

SEQ ID NO: 177046 - DNA, 25 bp, Rattus norvegicus
atattggcctcttgtgcagggctgc

SEQ ID NO: 177047 - DNA, 25 bp, Rattus norvegicus
atattggctaagacctcagtctctc

SEQ ID NO: 177048 - DNA, 25 bp, Rattus norvegicus
atattggctaagtcctcagtctctc

SEQ ID NO: 177049 - DNA, 25 bp, Rattus norvegicus
atattggctgcaactggtatactca

SEQ ID NO: 177050 - DNA, 25 bp, Rattus norvegicus
atattggctgcatctggtatactca

SEQ ID NO: 177051 - DNA, 25 bp, Rattus norvegicus
atattggcttttcttaactttctca

SEQ ID NO: 177052 - DNA, 25 bp, Rattus norvegicus
atattggcttttgttaactttctca

SEQ ID NO: 177053 - DNA, 25 bp, Rattus norvegicus
atattgggacgaatgcagcaggatt

SEQ ID NO: 177054 - DNA, 25 bp, Rattus norvegicus
atattgggacgattgcagcaggatt

SEQ ID NO: 177055 - DNA, 25 bp, Rattus norvegicus
atattgggagccaggtcctctgagg

SEQ ID NO: 177056 - DNA, 25 bp, Rattus norvegicus
atattgggagcctggtcctctgagg

SEQ ID NO: 177057 - DNA, 25 bp, Rattus norvegicus
atattgggcaggcttgcctcaaaat

SEQ ID NO: 177058 - DNA, 25 bp, Rattus norvegicus
atattgggcagggttgcctcaaaat

SEQ ID NO: 177059 - DNA, 25 bp, Rattus norvegicus
atattgggctatatgttctctaaca

SEQ ID NO: 177060 - DNA, 25 bp, Rattus norvegicus
atattgggctatttgttctctaaca

SEQ ID NO: 177061 - DNA, 25 bp, Rattus norvegicus
atattgggctgcatgtgcttcccac

SEQ ID NO: 177062 - DNA, 25 bp, Rattus norvegicus
atattgggctgcttgtgcttcccac

SEQ ID NO: 177063 - DNA, 25 bp, Rattus norvegicus
atattgggttgtcttaatcactcag

SEQ ID NO: 177064 - DNA, 25 bp, Rattus norvegicus
atattgggttgtgttaatcactcag

SEQ ID NO: 177065 - DNA, 25 bp, Rattus norvegicus
atattggtaaagagctagtattcct

SEQ ID NO: 177066 - DNA, 25 bp, Rattus norvegicus
atattggtaaagtgctagtattcct

SEQ ID NO: 177067 - DNA, 25 bp, Rattus norvegicus
atattggtattcacactgcggtctc

SEQ ID NO: 177068 - DNA, 25 bp, Rattus norvegicus
atattggtattctcactgcggtctc

SEQ ID NO: 177069 - DNA, 25 bp, Rattus norvegicus
atattggtggtgaaatctctgccct

SEQ ID NO: 177070 - DNA, 25 bp, Rattus norvegicus
atattggtggtgtaatctctgccct

SEQ ID NO: 177071 - DNA, 25 bp, Rattus norvegicus
atattggtgtaaatgcccacgtccc

SEQ ID NO: 177072 - DNA, 25 bp, Rattus norvegicus
atattggtgtaattgcccacgtccc

SEQ ID NO: 177073 - DNA, 25 bp, Rattus norvegicus
atattggtgttcagggctgccagct

SEQ ID NO: 177074 - DNA, 25 bp, Rattus norvegicus
atattggtgttctgggctgccagct

SEQ ID NO: 177075 - DNA, 25 bp, Rattus norvegicus
atattggttaccagctttcaaccca

SEQ ID NO: 177076 - DNA, 25 bp, Rattus norvegicus
atattggttacctgctttcaaccca

SEQ ID NO: 177077 - DNA, 25 bp, Rattus norvegicus
atattggttcagaccttttgtctcc

SEQ ID NO: 177078 - DNA, 25 bp, Rattus norvegicus
atattggttcagtccttttgtctcc

SEQ ID NO: 177079 - DNA, 25 bp, Rattus norvegicus
atattgtaactgaactatcacctaa

SEQ ID NO: 177080 - DNA, 25 bp, Rattus norvegicus
atattgtaactgtactatcacctaa

SEQ ID NO: 177081 - DNA, 25 bp, Rattus norvegicus
atattgtacagaccatttccccact

SEQ ID NO: 177082 - DNA, 25 bp, Rattus norvegicus
atattgtacagagcatttccccact

SEQ ID NO: 177083 - DNA, 25 bp, Rattus norvegicus
atattgtacagcacgggacccgcgc

SEQ ID NO: 177084 - DNA, 25 bp, Rattus norvegicus
atattgtacagctcgggacccgcgc

SEQ ID NO: 177085 - DNA, 25 bp, Rattus norvegicus
atattgtagcttcagttcgtcaccc

SEQ ID NO: 177086 - DNA, 25 bp, Rattus norvegicus
atattgtagcttgagttcgtcaccc

SEQ ID NO: 177087 - DNA, 25 bp, Rattus norvegicus
atattgtagggacaggacaccagac

SEQ ID NO: 177088 - DNA, 25 bp, Rattus norvegicus
atattgtagggagaggacaccagac

SEQ ID NO: 177089 - DNA, 25 bp, Rattus norvegicus
atattgtatcgcacatttgtttgtg

SEQ ID NO: 177090 - DNA, 25 bp, Rattus norvegicus
atattgtatcgctcatttgtttgtg

SEQ ID NO: 177091 - DNA, 25 bp, Rattus norvegicus
atattgtatcttatgggttcaccat

SEQ ID NO: 177092 - DNA, 25 bp, Rattus norvegicus
atattgtatcttttgggttcaccat

SEQ ID NO: 177093 - DNA, 25 bp, Rattus norvegicus
atattgtcaaccagaaagcctccct

SEQ ID NO: 177094 - DNA, 25 bp, Rattus norvegicus
atattgtcaacctgaaagcctccct

SEQ ID NO: 177095 - DNA, 25 bp, Rattus norvegicus
atattgtcacccagatcagttccta

SEQ ID NO: 177096 - DNA, 25 bp, Rattus norvegicus
atattgtcaccctgatcagttccta

SEQ ID NO: 177097 - DNA, 25 bp, Rattus norvegicus
atattgtccactacactgtcaactg

SEQ ID NO: 177098 - DNA, 25 bp, Rattus norvegicus
atattgtccacttcactgtcaactg

SEQ ID NO: 177099 - DNA, 25 bp, Rattus norvegicus
atattgtcccaaacacacttcagtc

SEQ ID NO: 177100 - DNA, 25 bp, Rattus norvegicus
atattgtcccaatcacacttcagtc

SEQ ID NO: 177101 - DNA, 25 bp, Rattus norvegicus
atattgtcttggatacactgtttaa

SEQ ID NO: 177102 - DNA, 25 bp, Rattus norvegicus
atattgtcttggttacactgtttaa

SEQ ID NO: 177103 - DNA, 25 bp, Rattus norvegicus
atattgtctttgagttccattccac

SEQ ID NO: 177104 - DNA, 25 bp, Rattus norvegicus
atattgtctttgtgttccattccac

SEQ ID NO: 177105 - DNA, 25 bp, Rattus norvegicus
atattgtcttttatgttgcacttaa

SEQ ID NO: 177106 - DNA, 25 bp, Rattus norvegicus
atattgtcttttttgttgcacttaa

SEQ ID NO: 177107 - DNA, 25 bp, Rattus norvegicus
atattgtgcagtctttccccatatc

SEQ ID NO: 177108 - DNA, 25 bp, Rattus norvegicus
atattgtgcagtgtttccccatatc

SEQ ID NO: 177109 - DNA, 25 bp, Rattus norvegicus
atattgtgggtacatcgagcccctc

SEQ ID NO: 177110 - DNA, 25 bp, Rattus norvegicus
atattgtgggtagatcgagcccctc

SEQ ID NO: 177111 - DNA, 25 bp, Rattus norvegicus
atattgtggtgtctggccttgatgc

SEQ ID NO: 177112 - DNA, 25 bp, Rattus norvegicus
atattgtggtgtgtggccttgatgc

SEQ ID NO: 177113 - DNA, 25 bp, Rattus norvegicus
atattgtgtaccacatccgttccga

SEQ ID NO: 177114 - DNA, 25 bp, Rattus norvegicus
atattgtgtacccaggtgcactctt

SEQ ID NO: 177115 - DNA, 25 bp, Rattus norvegicus
atattgtgtaccgaggtgcactctt

SEQ ID NO: 177116 - DNA, 25 bp, Rattus norvegicus
atattgtgtacctcatccgttccga

SEQ ID NO: 177117 - DNA, 25 bp, Rattus norvegicus
atattgtgtcaccaactttccttcc

SEQ ID NO: 177118 - DNA, 25 bp, Rattus norvegicus
atattgtgtcacgaactttccttcc

SEQ ID NO: 177119 - DNA, 25 bp, Rattus norvegicus
atattgttacatatccttgtacaga

SEQ ID NO: 177120 - DNA, 25 bp, Rattus norvegicus
atattgttacatttccttgtacaga

SEQ ID NO: 177121 - DNA, 25 bp, Rattus norvegicus
atattgttagatatcctgaccaaat

SEQ ID NO: 177122 - DNA, 25 bp, Rattus norvegicus
atattgttagatttcctgaccaaat

SEQ ID NO: 177123 - DNA, 25 bp, Rattus norvegicus
atattgttcctcaatctggctcaca

SEQ ID NO: 177124 - DNA, 25 bp, Rattus norvegicus
atattgttcctctatctggctcaca

SEQ ID NO: 177125 - DNA, 25 bp, Rattus norvegicus
atattgttgatactgcatgctctta

SEQ ID NO: 177126 - DNA, 25 bp, Rattus norvegicus
atattgttgatagtgcatgctctta

SEQ ID NO: 177127 - DNA, 25 bp, Rattus norvegicus
atattgttgcctcattagtccatgg

SEQ ID NO: 177128 - DNA, 25 bp, Rattus norvegicus
atattgttgcctgattagtccatgg

SEQ ID NO: 177129 - DNA, 25 bp, Rattus norvegicus
atattgttggcgcattcgttgtggc

SEQ ID NO: 177130 - DNA, 25 bp, Rattus norvegicus
atattgttggcggattcgttgtggc

SEQ ID NO: 177131 - DNA, 25 bp, Rattus norvegicus
atattgtttctgaggagaggtcacc

SEQ ID NO: 177132 - DNA, 25 bp, Rattus norvegicus
atattgtttctgtggagaggtcacc

SEQ ID NO: 177133 - DNA, 25 bp, Rattus norvegicus
atatttaaaccaattagtgccttct

SEQ ID NO: 177134 - DNA, 25 bp, Rattus norvegicus
atatttaaaccatttagtgccttct

SEQ ID NO: 177135 - DNA, 25 bp, Rattus norvegicus
atatttaaatccaggctcccaagcc

SEQ ID NO: 177136 - DNA, 25 bp, Rattus norvegicus
atatttaaatcctggctcccaagcc

SEQ ID NO: 177137 - DNA, 25 bp, Rattus norvegicus
atatttaacttgcttcatttacatg

SEQ ID NO: 177138 - DNA, 25 bp, Rattus norvegicus
atatttaacttggttcatttacatg

SEQ ID NO: 177139 - DNA, 25 bp, Rattus norvegicus
atatttaaggcccactctgtaacct

SEQ ID NO: 177140 - DNA, 25 bp, Rattus norvegicus
atatttaaggccgactctgtaacct

SEQ ID NO: 177141 - DNA, 25 bp, Rattus norvegicus
atatttaatccaatgcctgccacta

SEQ ID NO: 177142 - DNA, 25 bp, Rattus norvegicus
atatttaatccattgcctgccacta

SEQ ID NO: 177143 - DNA, 25 bp, Rattus norvegicus
atatttaatggcctctttgtagtgt

SEQ ID NO: 177144 - DNA, 25 bp, Rattus norvegicus
atatttaatggcgtctttgtagtgt

SEQ ID NO: 177145 - DNA, 25 bp, Rattus norvegicus
atatttacaaccagacatctagagt

SEQ ID NO: 177146 - DNA, 25 bp, Rattus norvegicus
atatttacaacctgacatctagagt

SEQ ID NO: 177147 - DNA, 25 bp, Rattus norvegicus
atatttaccgtgcagctggccagac

SEQ ID NO: 177148 - DNA, 25 bp, Rattus norvegicus
atatttaccgtggagctggccagac

SEQ ID NO: 177149 - DNA, 25 bp, Rattus norvegicus
atatttacctctctcaccactattc

SEQ ID NO: 177150 - DNA, 25 bp, Rattus norvegicus
atatttacctctgtcaccactattc

SEQ ID NO: 177151 - DNA, 25 bp, Rattus norvegicus
atatttacctgacatctctgggctt

SEQ ID NO: 177152 - DNA, 25 bp, Rattus norvegicus
atatttacctgagatctctgggctt

SEQ ID NO: 177153 - DNA, 25 bp, Rattus norvegicus
atatttactaccctttatcgcacca

SEQ ID NO: 177154 - DNA, 25 bp, Rattus norvegicus
atatttactaccgtttatcgcacca

SEQ ID NO: 177155 - DNA, 25 bp, Rattus norvegicus
atatttactgctactgtgttgtctc

SEQ ID NO: 177156 - DNA, 25 bp, Rattus norvegicus
atatttactgcttctgtgttgtctc

SEQ ID NO: 177157 - DNA, 25 bp, Rattus norvegicus
atatttactgtcaagcttttgcgga

SEQ ID NO: 177158 - DNA, 25 bp, Rattus norvegicus
atatttactgtctagcttttgcgga

SEQ ID NO: 177159 - DNA, 25 bp, Rattus norvegicus
atatttagacagacacccgttggct

SEQ ID NO: 177160 - DNA, 25 bp, Rattus norvegicus
atatttagacagtcacccgttggct

SEQ ID NO: 177161 - DNA, 25 bp, Rattus norvegicus
atatttagtgtcagtgaacaacccc

SEQ ID NO: 177162 - DNA, 25 bp, Rattus norvegicus
atatttagtgtctgtgaacaacccc

SEQ ID NO: 177163 - DNA, 25 bp, Rattus norvegicus
atatttagtgtgctccactcagcag

SEQ ID NO: 177164 - DNA, 25 bp, Rattus norvegicus
atatttagtgtggtccactcagcag

SEQ ID NO: 177165 - DNA, 25 bp, Rattus norvegicus
atatttagttcgcaagacagcttcg

SEQ ID NO: 177166 - DNA, 25 bp, Rattus norvegicus
atatttagttcggaagacagcttcg

SEQ ID NO: 177167 - DNA, 25 bp, Rattus norvegicus
atatttataataccactactgttac

SEQ ID NO: 177168 - DNA, 25 bp, Rattus norvegicus
atatttataatagcactactgttac

SEQ ID NO: 177169 - DNA, 25 bp, Rattus norvegicus
atatttatacttagtccctcttgcc

SEQ ID NO: 177170 - DNA, 25 bp, Rattus norvegicus
atatttatactttgtccctcttgcc

SEQ ID NO: 177171 - DNA, 25 bp, Rattus norvegicus
atatttatagttataggactcaggg

SEQ ID NO: 177172 - DNA, 25 bp, Rattus norvegicus
atatttatagttttaggactcaggg

SEQ ID NO: 177173 - DNA, 25 bp, Rattus norvegicus
atatttatcgatctgaacctgtaca

SEQ ID NO: 177174 - DNA, 25 bp, Rattus norvegicus
atatttatcgatgtgaacctgtaca

SEQ ID NO: 177175 - DNA, 25 bp, Rattus norvegicus
atatttatgcacaattcacaaaagg

SEQ ID NO: 177176 - DNA, 25 bp, Rattus norvegicus
atatttatgcactattcacaaaagg

SEQ ID NO: 177177 - DNA, 25 bp, Rattus norvegicus
atatttatgctcagttttggtttac

SEQ ID NO: 177178 - DNA, 25 bp, Rattus norvegicus
atatttatgctctgttttggtttac

SEQ ID NO: 177179 - DNA, 25 bp, Rattus norvegicus
atatttatgtacacaagccctttat

SEQ ID NO: 177180 - DNA, 25 bp, Rattus norvegicus
atatttatgtactcaagccctttat

SEQ ID NO: 177181 - DNA, 25 bp, Rattus norvegicus
atatttatgtctacccttttgccca

SEQ ID NO: 177182 - DNA, 25 bp, Rattus norvegicus
atatttatgtcttcccttttgccca

SEQ ID NO: 177183 - DNA, 25 bp, Rattus norvegicus
atatttatgtgcagacttactttgc

SEQ ID NO: 177184 - DNA, 25 bp, Rattus norvegicus
atatttatgtgctgacttactttgc

SEQ ID NO: 177185 - DNA, 25 bp, Rattus norvegicus
atatttatgttgctcctactgcctt

SEQ ID NO: 177186 - DNA, 25 bp, Rattus norvegicus
atatttatgttggtcctactgcctt

SEQ ID NO: 177187 - DNA, 25 bp, Rattus norvegicus
atatttattaccactgatacctcag

SEQ ID NO: 177188 - DNA, 25 bp, Rattus norvegicus
atatttattacctctgatacctcag

SEQ ID NO: 177189 - DNA, 25 bp, Rattus norvegicus
atatttattgccaggttcgtgaccg

SEQ ID NO: 177190 - DNA, 25 bp, Rattus norvegicus
atatttattgcctggttcgtgaccg

SEQ ID NO: 177191 - DNA, 25 bp, Rattus norvegicus
atatttattggtctctcctgctgca

SEQ ID NO: 177192 - DNA, 25 bp, Rattus norvegicus
atatttattggtgtctcctgctgca

SEQ ID NO: 177193 - DNA, 25 bp, Rattus norvegicus
atatttatttaaagcgatgtccacc

SEQ ID NO: 177194 - DNA, 25 bp, Rattus norvegicus
atatttatttaatgcgatgtccacc

SEQ ID NO: 177195 - DNA, 25 bp, Rattus norvegicus
atatttatttcgagtgcctgtgcaa

SEQ ID NO: 177196 - DNA, 25 bp, Rattus norvegicus
atatttatttcgtgtgcctgtgcaa

SEQ ID NO: 177197 - DNA, 25 bp, Rattus norvegicus
atatttcaacagaggctccgtgggc

SEQ ID NO: 177198 - DNA, 25 bp, Rattus norvegicus
atatttcaacagtggctccgtgggc

SEQ ID NO: 177199 - DNA, 25 bp, Rattus norvegicus
atatttcaactcatataccctcaca

SEQ ID NO: 177200 - DNA, 25 bp, Rattus norvegicus
atatttcaactcttataccctcaca

SEQ ID NO: 177201 - DNA, 25 bp, Rattus norvegicus
atatttcacatcattattattgcag

SEQ ID NO: 177202 - DNA, 25 bp, Rattus norvegicus
atatttcacatctttattattgcag

SEQ ID NO: 177203 - DNA, 25 bp, Rattus norvegicus
atatttcagtagacccagtagacct

SEQ ID NO: 177204 - DNA, 25 bp, Rattus norvegicus
atatttcagtagtcccagtagacct

SEQ ID NO: 177205 - DNA, 25 bp, Rattus norvegicus
atatttccaaaacggaccagtgcaa

SEQ ID NO: 177206 - DNA, 25 bp, Rattus norvegicus
atatttccaaaagggaccagtgcaa

SEQ ID NO: 177207 - DNA, 25 bp, Rattus norvegicus
atatttccaacccaagaacctcctg

SEQ ID NO: 177208 - DNA, 25 bp, Rattus norvegicus
atatttccaaccgaagaacctcctg

SEQ ID NO: 177209 - DNA, 25 bp, Rattus norvegicus
atatttccaagtccaggtgtctaag

SEQ ID NO: 177210 - DNA, 25 bp, Rattus norvegicus
atatttccaagtgcaggtgtctaag

SEQ ID NO: 177211 - DNA, 25 bp, Rattus norvegicus
atatttccacctcactgagttgcca

SEQ ID NO: 177212 - DNA, 25 bp, Rattus norvegicus
atatttccacctgactgagttgcca

SEQ ID NO: 177213 - DNA, 25 bp, Rattus norvegicus
atatttccagtcatcgtgacacggg

SEQ ID NO: 177214 - DNA, 25 bp, Rattus norvegicus
atatttccagtcttcgtgacacggg

SEQ ID NO: 177215 - DNA, 25 bp, Rattus norvegicus
atatttccagttatctttacgtttg

SEQ ID NO: 177216 - DNA, 25 bp, Rattus norvegicus
atatttccagttttctttacgtttg

SEQ ID NO: 177217 - DNA, 25 bp, Rattus norvegicus
atatttcccatgatgctgtgttgag

SEQ ID NO: 177218 - DNA, 25 bp, Rattus norvegicus
atatttcccatgttgctgtgttgag

SEQ ID NO: 177219 - DNA, 25 bp, Rattus norvegicus
atatttccctatcatatgcatgcaa

SEQ ID NO: 177220 - DNA, 25 bp, Rattus norvegicus
atatttccctatgatatgcatgcaa

SEQ ID NO: 177221 - DNA, 25 bp, Rattus norvegicus
atatttcccttacctagatgctcaa

SEQ ID NO: 177222 - DNA, 25 bp, Rattus norvegicus
atatttcccttagctagatgctcaa

SEQ ID NO: 177223 - DNA, 25 bp, Rattus norvegicus
atatttccgtttctacatcacctcc

SEQ ID NO: 177224 - DNA, 25 bp, Rattus norvegicus
atatttccgtttgtacatcacctcc

SEQ ID NO: 177225 - DNA, 25 bp, Rattus norvegicus
atatttcctagaccacctgtgtttt

SEQ ID NO: 177226 - DNA, 25 bp, Rattus norvegicus
atatttcctagagcacctgtgtttt

SEQ ID NO: 177227 - DNA, 25 bp, Rattus norvegicus
atatttcctgatctcttccagagag

SEQ ID NO: 177228 - DNA, 25 bp, Rattus norvegicus
atatttcctgatgtcttccagagag

SEQ ID NO: 177229 - DNA, 25 bp, Rattus norvegicus
atatttcctgtgaagtttcctctca

SEQ ID NO: 177230 - DNA, 25 bp, Rattus norvegicus
atatttcctgtgctatagccctgta

SEQ ID NO: 177231 - DNA, 25 bp, Rattus norvegicus
atatttcctgtggtatagccctgta

SEQ ID NO: 177232 - DNA, 25 bp, Rattus norvegicus
atatttcctgtgtagtttcctctca

SEQ ID NO: 177233 - DNA, 25 bp, Rattus norvegicus
atatttccttctacattatcctgtg

SEQ ID NO: 177234 - DNA, 25 bp, Rattus norvegicus
atatttccttcttcattatcctgtg

SEQ ID NO: 177235 - DNA, 25 bp, Rattus norvegicus
atatttccttttctacacctgtgga

SEQ ID NO: 177236 - DNA, 25 bp, Rattus norvegicus
atatttccttttgtacacctgtgga

SEQ ID NO: 177237 - DNA, 25 bp, Rattus norvegicus
atatttcgcttcaggaggctctgat

SEQ ID NO: 177238 - DNA, 25 bp, Rattus norvegicus
atatttcgcttctggaggctctgat

SEQ ID NO: 177239 - DNA, 25 bp, Rattus norvegicus
atatttctaataacacaccgataat

SEQ ID NO: 177240 - DNA, 25 bp, Rattus norvegicus
atatttctaatatcacaccgataat

SEQ ID NO: 177241 - DNA, 25 bp, Rattus norvegicus
atatttctactgactgggctgctgc

SEQ ID NO: 177242 - DNA, 25 bp, Rattus norvegicus
atatttctactgtctgggctgctgc

SEQ ID NO: 177243 - DNA, 25 bp, Rattus norvegicus
atatttctctctatcatggtcatat

SEQ ID NO: 177244 - DNA, 25 bp, Rattus norvegicus
atatttctctctttcatggtcatat

SEQ ID NO: 177245 - DNA, 25 bp, Rattus norvegicus
atatttctgacaatggggtgatcca

SEQ ID NO: 177246 - DNA, 25 bp, Rattus norvegicus
atatttctgacattggggtgatcca

SEQ ID NO: 177247 - DNA, 25 bp, Rattus norvegicus
atatttctgatccattttctcccac

SEQ ID NO: 177248 - DNA, 25 bp, Rattus norvegicus
atatttctgatcgattttctcccac

SEQ ID NO: 177249 - DNA, 25 bp, Rattus norvegicus
atatttctgatgactccttgggcta

SEQ ID NO: 177250 - DNA, 25 bp, Rattus norvegicus
atatttctgatgtctccttgggcta

SEQ ID NO: 177251 - DNA, 25 bp, Rattus norvegicus
atatttctgcttctaatgcgggtgc

SEQ ID NO: 177252 - DNA, 25 bp, Rattus norvegicus
atatttctgcttgtaatgcgggtgc

SEQ ID NO: 177253 - DNA, 25 bp, Rattus norvegicus
atatttctgggacagaccttttcca

SEQ ID NO: 177254 - DNA, 25 bp, Rattus norvegicus
atatttctgggagagaccttttcca

SEQ ID NO: 177255 - DNA, 25 bp, Rattus norvegicus
atatttctgtagattgccagggaca

SEQ ID NO: 177256 - DNA, 25 bp, Rattus norvegicus
atatttctgtagtttgccagggaca

SEQ ID NO: 177257 - DNA, 25 bp, Rattus norvegicus
atatttctgtggaggcagcgcgcac

SEQ ID NO: 177258 - DNA, 25 bp, Rattus norvegicus
atatttctgtggtggcagcgcgcac

SEQ ID NO: 177259 - DNA, 25 bp, Rattus norvegicus
atatttcttagcaacttgtgaacag

SEQ ID NO: 177260 - DNA, 25 bp, Rattus norvegicus
atatttcttagcagatgggagacgc

SEQ ID NO: 177261 - DNA, 25 bp, Rattus norvegicus
atatttcttagctacttgtgaacag

SEQ ID NO: 177262 - DNA, 25 bp, Rattus norvegicus
atatttcttagctgatgggagacgc

SEQ ID NO: 177263 - DNA, 25 bp, Rattus norvegicus
atatttcttattctgattgtgcccg

SEQ ID NO: 177264 - DNA, 25 bp, Rattus norvegicus
atatttcttattgtgattgtgcccg

SEQ ID NO: 177265 - DNA, 25 bp, Rattus norvegicus
atatttcttcaaccttgtaggcggg

SEQ ID NO: 177266 - DNA, 25 bp, Rattus norvegicus
atatttcttcaagcttgtaggcggg

SEQ ID NO: 177267 - DNA, 25 bp, Rattus norvegicus
atatttcttcttactaattctctaa

SEQ ID NO: 177268 - DNA, 25 bp, Rattus norvegicus
atatttcttctttctaattctctaa

SEQ ID NO: 177269 - DNA, 25 bp, Rattus norvegicus
atatttcttgcaaagtccgttcctt

SEQ ID NO: 177270 - DNA, 25 bp, Rattus norvegicus
atatttcttgcatagtccgttcctt

SEQ ID NO: 177271 - DNA, 25 bp, Rattus norvegicus
atatttcttgtaaactggatgtgcc

SEQ ID NO: 177272 - DNA, 25 bp, Rattus norvegicus
atatttcttgtatactggatgtgcc

SEQ ID NO: 177273 - DNA, 25 bp, Rattus norvegicus
atatttctttatagctgagttcccc

SEQ ID NO: 177274 - DNA, 25 bp, Rattus norvegicus
atatttctttattgctgagttcccc

SEQ ID NO: 177275 - DNA, 25 bp, Rattus norvegicus
atatttgaacttatggaggccattc

SEQ ID NO: 177276 - DNA, 25 bp, Rattus norvegicus
atatttgaacttttggaggccattc

SEQ ID NO: 177277 - DNA, 25 bp, Rattus norvegicus
atatttgaagtgactgcgtcccaga

SEQ ID NO: 177278 - DNA, 25 bp, Rattus norvegicus
atatttgaagtgtctgcgtcccaga

SEQ ID NO: 177279 - DNA, 25 bp, Rattus norvegicus
atatttgaccaaagtaggcctacag

SEQ ID NO: 177280 - DNA, 25 bp, Rattus norvegicus
atatttgaccaatgtaggcctacag

SEQ ID NO: 177281 - DNA, 25 bp, Rattus norvegicus
atatttgatcagcttcctgcagcat

SEQ ID NO: 177282 - DNA, 25 bp, Rattus norvegicus
atatttgatcaggttcctgcagcat

SEQ ID NO: 177283 - DNA, 25 bp, Rattus norvegicus
atatttgatcttctctagcttgcac

SEQ ID NO: 177284 - DNA, 25 bp, Rattus norvegicus
atatttgatcttgtctagcttgcac

SEQ ID NO: 177285 - DNA, 25 bp, Rattus norvegicus
atatttgatgtgctaattgacaggt

SEQ ID NO: 177286 - DNA, 25 bp, Rattus norvegicus
atatttgatgtggtaattgacaggt

SEQ ID NO: 177287 - DNA, 25 bp, Rattus norvegicus
atatttgcatccatcccagtgacag

SEQ ID NO: 177288 - DNA, 25 bp, Rattus norvegicus
atatttgcatccttcccagtgacag

SEQ ID NO: 177289 - DNA, 25 bp, Rattus norvegicus
atatttgcatgcctggtaccagaag

SEQ ID NO: 177290 - DNA, 25 bp, Rattus norvegicus
atatttgcatgcgtggtaccagaag

SEQ ID NO: 177291 - DNA, 25 bp, Rattus norvegicus
atatttgcctccattactctgggtt

SEQ ID NO: 177292 - DNA, 25 bp, Rattus norvegicus
atatttgcctcctttactctgggtt

SEQ ID NO: 177293 - DNA, 25 bp, Rattus norvegicus
atatttgcctgcatgctgtgtgtca

SEQ ID NO: 177294 - DNA, 25 bp, Rattus norvegicus
atatttgcctgcttgctgtgtgtca

SEQ ID NO: 177295 - DNA, 25 bp, Rattus norvegicus
atatttgcgctcaatgcaagccctc

SEQ ID NO: 177296 - DNA, 25 bp, Rattus norvegicus
atatttgcgctctatgcaagccctc

SEQ ID NO: 177297 - DNA, 25 bp, Rattus norvegicus
atatttgcgtggatccagactgctc

SEQ ID NO: 177298 - DNA, 25 bp, Rattus norvegicus
atatttgcgtggttccagactgctc

SEQ ID NO: 177299 - DNA, 25 bp, Rattus norvegicus
atatttgctatgcacttgaacttta

SEQ ID NO: 177300 - DNA, 25 bp, Rattus norvegicus
atatttgctatggacttgaacttta

SEQ ID NO: 177301 - DNA, 25 bp, Rattus norvegicus
atatttgctctcatgtcattggtaa

SEQ ID NO: 177302 - DNA, 25 bp, Rattus norvegicus
atatttgctctcttgtcattggtaa

SEQ ID NO: 177303 - DNA, 25 bp, Rattus norvegicus
atatttgctgccaggaagcttctgg

SEQ ID NO: 177304 - DNA, 25 bp, Rattus norvegicus
atatttgctgcccagatgttataac

SEQ ID NO: 177305 - DNA, 25 bp, Rattus norvegicus
atatttgctgccgagatgttataac

SEQ ID NO: 177306 - DNA, 25 bp, Rattus norvegicus
atatttgctgcctggaagcttctgg

SEQ ID NO: 177307 - DNA, 25 bp, Rattus norvegicus
atatttgctttcatggaatcaggga

SEQ ID NO: 177308 - DNA, 25 bp, Rattus norvegicus
atatttgctttcttggaatcaggga

SEQ ID NO: 177309 - DNA, 25 bp, Rattus norvegicus
atatttggagtgctttcttcccgca

SEQ ID NO: 177310 - DNA, 25 bp, Rattus norvegicus
atatttggagtggtttcttcccgca

SEQ ID NO: 177311 - DNA, 25 bp, Rattus norvegicus
atatttggcacacgccatactctgt

SEQ ID NO: 177312 - DNA, 25 bp, Rattus norvegicus
atatttggcacaggccatactctgt

SEQ ID NO: 177313 - DNA, 25 bp, Rattus norvegicus
atatttggcattaatacctagagct

SEQ ID NO: 177314 - DNA, 25 bp, Rattus norvegicus
atatttggcatttatacctagagct

SEQ ID NO: 177315 - DNA, 25 bp, Rattus norvegicus
atatttggctatagtctcacaggca

SEQ ID NO: 177316 - DNA, 25 bp, Rattus norvegicus
atatttggctattgtctcacaggca

SEQ ID NO: 177317 - DNA, 25 bp, Rattus norvegicus
atatttggctggcagctgtccaaca

SEQ ID NO: 177318 - DNA, 25 bp, Rattus norvegicus
atatttggctgggagctgtccaaca

SEQ ID NO: 177319 - DNA, 25 bp, Rattus norvegicus
atatttgtaaatcgcctgtttgggc

SEQ ID NO: 177320 - DNA, 25 bp, Rattus norvegicus
atatttgtaaatggcctgtttgggc

SEQ ID NO: 177321 - DNA, 25 bp, Rattus norvegicus
atatttgtaaccctaggaattgtct

SEQ ID NO: 177322 - DNA, 25 bp, Rattus norvegicus
atatttgtaaccgtaggaattgtct

SEQ ID NO: 177323 - DNA, 25 bp, Rattus norvegicus
atatttgtaccgagggagcggctta

SEQ ID NO: 177324 - DNA, 25 bp, Rattus norvegicus
atatttgtaccgtgggagcggctta

SEQ ID NO: 177325 - DNA, 25 bp, Rattus norvegicus
atatttgtcattcccgcagcaagta

SEQ ID NO: 177326 - DNA, 25 bp, Rattus norvegicus
atatttgtcattgccgcagcaagta

SEQ ID NO: 177327 - DNA, 25 bp, Rattus norvegicus
atatttgtctctagcatcttctttc

SEQ ID NO: 177328 - DNA, 25 bp, Rattus norvegicus
atatttgtctcttgcatcttctttc

SEQ ID NO: 177329 - DNA, 25 bp, Rattus norvegicus
atatttgtcttcaagaactgggttc

SEQ ID NO: 177330 - DNA, 25 bp, Rattus norvegicus
atatttgtcttctagaactgggttc

SEQ ID NO: 177331 - DNA, 25 bp, Rattus norvegicus
atatttgtgtttacctatggtcata

SEQ ID NO: 177332 - DNA, 25 bp, Rattus norvegicus
atatttgtgttttcctatggtcata

SEQ ID NO: 177333 - DNA, 25 bp, Rattus norvegicus
atatttgttggcacctaagttgaac

SEQ ID NO: 177334 - DNA, 25 bp, Rattus norvegicus
atatttgttggctcctaagttgaac

SEQ ID NO: 177335 - DNA, 25 bp, Rattus norvegicus
atatttgtttctcgcaactgggttc

SEQ ID NO: 177336 - DNA, 25 bp, Rattus norvegicus
atatttgtttctggcaactgggttc

SEQ ID NO: 177337 - DNA, 25 bp, Rattus norvegicus
atattttaaaaaagctgggtgtagc

SEQ ID NO: 177338 - DNA, 25 bp, Rattus norvegicus
atattttaaaaatgctgggtgtagc

SEQ ID NO: 177339 - DNA, 25 bp, Rattus norvegicus
atattttaaaccacctttctgcact

SEQ ID NO: 177340 - DNA, 25 bp, Rattus norvegicus
atattttaaacctcctttctgcact

SEQ ID NO: 177341 - DNA, 25 bp, Rattus norvegicus
atattttacctgagtcctgccagct

SEQ ID NO: 177342 - DNA, 25 bp, Rattus norvegicus
atattttacctgtgtcctgccagct

SEQ ID NO: 177343 - DNA, 25 bp, Rattus norvegicus
atattttatataagcccagggttgc

SEQ ID NO: 177344 - DNA, 25 bp, Rattus norvegicus
atattttatatatgcccagggttgc

SEQ ID NO: 177345 - DNA, 25 bp, Rattus norvegicus
atattttatattagaccacgtgagt

SEQ ID NO: 177346 - DNA, 25 bp, Rattus norvegicus
atattttatatttgaccacgtgagt

SEQ ID NO: 177347 - DNA, 25 bp, Rattus norvegicus
atattttatctgagtggagtaggca

SEQ ID NO: 177348 - DNA, 25 bp, Rattus norvegicus
atattttatctgtgtggagtaggca

SEQ ID NO: 177349 - DNA, 25 bp, Rattus norvegicus
atattttcacatcgaggttggctca

SEQ ID NO: 177350 - DNA, 25 bp, Rattus norvegicus
atattttcacatggaggttggctca

SEQ ID NO: 177351 - DNA, 25 bp, Rattus norvegicus
atattttcatacatctcagtttggg

SEQ ID NO: 177352 - DNA, 25 bp, Rattus norvegicus
atattttcatacttctcagtttggg

SEQ ID NO: 177353 - DNA, 25 bp, Rattus norvegicus
atattttcatgtattcaatgtgaca

SEQ ID NO: 177354 - DNA, 25 bp, Rattus norvegicus
atattttcatgttttcaatgtgaca

SEQ ID NO: 177355 - DNA, 25 bp, Rattus norvegicus
atattttcatttccaacttcattaa

SEQ ID NO: 177356 - DNA, 25 bp, Rattus norvegicus
atattttcatttgcaacttcattaa

SEQ ID NO: 177357 - DNA, 25 bp, Rattus norvegicus
atattttccatactgctctgggcag

SEQ ID NO: 177358 - DNA, 25 bp, Rattus norvegicus
atattttccatagtgctctgggcag

SEQ ID NO: 177359 - DNA, 25 bp, Rattus norvegicus
atattttctattctctcctgtttaa

SEQ ID NO: 177360 - DNA, 25 bp, Rattus norvegicus
atattttctattgtctcctgtttaa

SEQ ID NO: 177361 - DNA, 25 bp, Rattus norvegicus
atattttctcagctggttcctggca

SEQ ID NO: 177362 - DNA, 25 bp, Rattus norvegicus
atattttctcaggtggttcctggca

SEQ ID NO: 177363 - DNA, 25 bp, Rattus norvegicus
atattttctcctcggacgagtccaa

SEQ ID NO: 177364 - DNA, 25 bp, Rattus norvegicus
atattttctcctgggacgagtccaa

SEQ ID NO: 177365 - DNA, 25 bp, Rattus norvegicus
atattttctgtgactgatcaaacca

SEQ ID NO: 177366 - DNA, 25 bp, Rattus norvegicus
atattttctgtgtctgatcaaacca

SEQ ID NO: 177367 - DNA, 25 bp, Rattus norvegicus
atattttcttacagtggtcctggca

SEQ ID NO: 177368 - DNA, 25 bp, Rattus norvegicus
atattttcttactgtggtcctggca

SEQ ID NO: 177369 - DNA, 25 bp, Rattus norvegicus
atattttctttcatgcacaggctca

SEQ ID NO: 177370 - DNA, 25 bp, Rattus norvegicus
atattttctttcttgcacaggctca

SEQ ID NO: 177371 - DNA, 25 bp, Rattus norvegicus
atattttgccagacacattagtcag

SEQ ID NO: 177372 - DNA, 25 bp, Rattus norvegicus
atattttgccagtcacattagtcag

SEQ ID NO: 177373 - DNA, 25 bp, Rattus norvegicus
atattttgccctatgatcacagcct

SEQ ID NO: 177374 - DNA, 25 bp, Rattus norvegicus
atattttgccctttgatcacagcct

SEQ ID NO: 177375 - DNA, 25 bp, Rattus norvegicus
atattttgcctaatccctgttgata

SEQ ID NO: 177376 - DNA, 25 bp, Rattus norvegicus
atattttgcctattccctgttgata

SEQ ID NO: 177377 - DNA, 25 bp, Rattus norvegicus
atattttgctctacctgacattgac

SEQ ID NO: 177378 - DNA, 25 bp, Rattus norvegicus
atattttgctcttcctgacattgac

SEQ ID NO: 177379 - DNA, 25 bp, Rattus norvegicus
atattttgcttgagtgtaagggaca

SEQ ID NO: 177380 - DNA, 25 bp, Rattus norvegicus
atattttgcttgtgtgtaagggaca

SEQ ID NO: 177381 - DNA, 25 bp, Rattus norvegicus
atattttggtacactgctgtcatgc

SEQ ID NO: 177382 - DNA, 25 bp, Rattus norvegicus
atattttggtactctgctgtcatgc

SEQ ID NO: 177383 - DNA, 25 bp, Rattus norvegicus
atattttgtaatactgcagccctcg

SEQ ID NO: 177384 - DNA, 25 bp, Rattus norvegicus
atattttgtaattctgcagccctcg

SEQ ID NO: 177385 - DNA, 25 bp, Rattus norvegicus
atattttgtataacccctatggcct

SEQ ID NO: 177386 - DNA, 25 bp, Rattus norvegicus
atattttgtatatcccctatggcct

SEQ ID NO: 177387 - DNA, 25 bp, Rattus norvegicus
atattttgtcatctaaattttccaa

SEQ ID NO: 177388 - DNA, 25 bp, Rattus norvegicus
atattttgtcatgtaaattttccaa

SEQ ID NO: 177389 - DNA, 25 bp, Rattus norvegicus
atattttgtctacctatccctgtgt

SEQ ID NO: 177390 - DNA, 25 bp, Rattus norvegicus
atattttgtctagctatccctgtgt

SEQ ID NO: 177391 - DNA, 25 bp, Rattus norvegicus
atatttttatgtctgcgtgcttctg

SEQ ID NO: 177392 - DNA, 25 bp, Rattus norvegicus
atatttttatgtgtgcgtgcttctg

SEQ ID NO: 177393 - DNA, 25 bp, Rattus norvegicus
atatttttattgaggctgcgggcgc

SEQ ID NO: 177394 - DNA, 25 bp, Rattus norvegicus
atatttttattgtggctgcgggcgc

SEQ ID NO: 177395 - DNA, 25 bp, Rattus norvegicus
atatttttcaatcttaggttctcaa

SEQ ID NO: 177396 - DNA, 25 bp, Rattus norvegicus
atatttttcaatgttaggttctcaa

SEQ ID NO: 177397 - DNA, 25 bp, Rattus norvegicus
atatttttcagtactgcctttcagg

SEQ ID NO: 177398 - DNA, 25 bp, Rattus norvegicus
atatttttcagttctgcctttcagg

SEQ ID NO: 177399 - DNA, 25 bp, Rattus norvegicus
atatttttcctactgcagtttagtt

SEQ ID NO: 177400 - DNA, 25 bp, Rattus norvegicus
atatttttcctagtgcagtttagtt

SEQ ID NO: 177401 - DNA, 25 bp, Rattus norvegicus
atatttttcgtacgcagcgtggctc

SEQ ID NO: 177402 - DNA, 25 bp, Rattus norvegicus
atatttttcgtaggcagcgtggctc

SEQ ID NO: 177403 - DNA, 25 bp, Rattus norvegicus
atatttttctgcctaatccacaaag

SEQ ID NO: 177404 - DNA, 25 bp, Rattus norvegicus
atatttttctgcgtaatccacaaag

SEQ ID NO: 177405 - DNA, 25 bp, Rattus norvegicus
atatttttgcccactattcatcttg

SEQ ID NO: 177406 - DNA, 25 bp, Rattus norvegicus
atatttttgccctctattcatcttg

SEQ ID NO: 177407 - DNA, 25 bp, Rattus norvegicus
atatttttgcttcctcacttggttg

SEQ ID NO: 177408 - DNA, 25 bp, Rattus norvegicus
atatttttgcttgctcacttggttg

SEQ ID NO: 177409 - DNA, 25 bp, Rattus norvegicus
atattttttacaagtcccagctcct

SEQ ID NO: 177410 - DNA, 25 bp, Rattus norvegicus
atattttttacatgtcccagctcct

SEQ ID NO: 177411 - DNA, 25 bp, Rattus norvegicus
atattttttcccatgaatgaggtct

SEQ ID NO: 177412 - DNA, 25 bp, Rattus norvegicus
atattttttcccttgaatgaggtct

SEQ ID NO: 177413 - DNA, 25 bp, Rattus norvegicus
atattttttgttcccatgttctctg

SEQ ID NO: 177414 - DNA, 25 bp, Rattus norvegicus
atattttttgttgccatgttctctg

SEQ ID NO: 177415 - DNA, 25 bp, Rattus norvegicus
atcaaaacaccaagtccagccttgg

SEQ ID NO: 177416 - DNA, 25 bp, Rattus norvegicus
atcaaaacaccatgtccagccttgg

SEQ ID NO: 177417 - DNA, 25 bp, Rattus norvegicus
atcaaaacctgcattcttggaccac

SEQ ID NO: 177418 - DNA, 25 bp, Rattus norvegicus
atcaaaacctgctttcttggaccac

SEQ ID NO: 177419 - DNA, 25 bp, Rattus norvegicus
atcaaaagaccgcttgcccttcacg

SEQ ID NO: 177420 - DNA, 25 bp, Rattus norvegicus
atcaaaagaccggttgcccttcacg

SEQ ID NO: 177421 - DNA, 25 bp, Rattus norvegicus
atcaaaagctcgagcctccgcctgt

SEQ ID NO: 177422 - DNA, 25 bp, Rattus norvegicus
atcaaaagctcgtgcctccgcctgt

SEQ ID NO: 177423 - DNA, 25 bp, Rattus norvegicus
atcaaaagtcttcctgtcgggttgg

SEQ ID NO: 177424 - DNA, 25 bp, Rattus norvegicus
atcaaaagtcttgctgtcgggttgg

SEQ ID NO: 177425 - DNA, 25 bp, Rattus norvegicus
atcaaacacgctaccattagagtag

SEQ ID NO: 177426 - DNA, 25 bp, Rattus norvegicus
atcaaacacgcttccattagagtag

SEQ ID NO: 177427 - DNA, 25 bp, Rattus norvegicus
atcaaacagaagcagccgtgggcaa

SEQ ID NO: 177428 - DNA, 25 bp, Rattus norvegicus
atcaaacagaaggagccgtgggcaa

SEQ ID NO: 177429 - DNA, 25 bp, Rattus norvegicus
atcaaaccaaggatcagagcccaag

SEQ ID NO: 177430 - DNA, 25 bp, Rattus norvegicus
atcaaaccaaggttcagagcccaag

SEQ ID NO: 177431 - DNA, 25 bp, Rattus norvegicus
atcaaaccatgtagtgacggccccg

SEQ ID NO: 177432 - DNA, 25 bp, Rattus norvegicus
atcaaaccatgttgtgacggccccg

SEQ ID NO: 177433 - DNA, 25 bp, Rattus norvegicus
atcaaaccccacctgtcttaaaatg

SEQ ID NO: 177434 - DNA, 25 bp, Rattus norvegicus
atcaaaccccacgtgtcttaaaatg

SEQ ID NO: 177435 - DNA, 25 bp, Rattus norvegicus
atcaaaccccggctgtaggcgagga

SEQ ID NO: 177436 - DNA, 25 bp, Rattus norvegicus
atcaaaccccgggtgtaggcgagga

SEQ ID NO: 177437 - DNA, 25 bp, Rattus norvegicus
atcaaaccgattaagcctgtcacca

SEQ ID NO: 177438 - DNA, 25 bp, Rattus norvegicus
atcaaaccgatttagcctgtcacca

SEQ ID NO: 177439 - DNA, 25 bp, Rattus norvegicus
atcaaaccgcacagtgtcactgaga

SEQ ID NO: 177440 - DNA, 25 bp, Rattus norvegicus
atcaaaccgcactgtgtcactgaga

SEQ ID NO: 177441 - DNA, 25 bp, Rattus norvegicus
atcaaacctacaatgtgaccacaaa

SEQ ID NO: 177442 - DNA, 25 bp, Rattus norvegicus
atcaaacctacattgtgaccacaaa

SEQ ID NO: 177443 - DNA, 25 bp, Rattus norvegicus
atcaaaccttctactggaccaaagc

SEQ ID NO: 177444 - DNA, 25 bp, Rattus norvegicus
atcaaaccttcttctggaccaaagc

SEQ ID NO: 177445 - DNA, 25 bp, Rattus norvegicus
atcaaacgggagacaccaggcacgg

SEQ ID NO: 177446 - DNA, 25 bp, Rattus norvegicus
atcaaacgggagtcaccaggcacgg

SEQ ID NO: 177447 - DNA, 25 bp, Rattus norvegicus
atcaaactctccaaggccgacgtgg

SEQ ID NO: 177448 - DNA, 25 bp, Rattus norvegicus
atcaaactctcctaggccgacgtgg

SEQ ID NO: 177449 - DNA, 25 bp, Rattus norvegicus
atcaaactgcccaagggcctcgggc

SEQ ID NO: 177450 - DNA, 25 bp, Rattus norvegicus
atcaaactgccctagggcctcgggc

SEQ ID NO: 177451 - DNA, 25 bp, Rattus norvegicus
atcaaactgttgcagaatcttttac

SEQ ID NO: 177452 - DNA, 25 bp, Rattus norvegicus
atcaaactgttggagaatcttttac

SEQ ID NO: 177453 - DNA, 25 bp, Rattus norvegicus
atcaaactttctcattttaggtctc

SEQ ID NO: 177454 - DNA, 25 bp, Rattus norvegicus
atcaaactttctgattttaggtctc

SEQ ID NO: 177455 - DNA, 25 bp, Rattus norvegicus
atcaaacttttcaaactctggccaa

SEQ ID NO: 177456 - DNA, 25 bp, Rattus norvegicus
atcaaacttttctaactctggccaa

SEQ ID NO: 177457 - DNA, 25 bp, Rattus norvegicus
atcaaagaaaccaaagccaccctgt

SEQ ID NO: 177458 - DNA, 25 bp, Rattus norvegicus
atcaaagaaacctaagccaccctgt

SEQ ID NO: 177459 - DNA, 25 bp, Rattus norvegicus
atcaaagacacccttgccctatagg

SEQ ID NO: 177460 - DNA, 25 bp, Rattus norvegicus
atcaaagacaccgttgccctatagg

SEQ ID NO: 177461 - DNA, 25 bp, Rattus norvegicus
atcaaagagaggctccagcttcctg

SEQ ID NO: 177462 - DNA, 25 bp, Rattus norvegicus
atcaaagagagggtccagcttcctg

SEQ ID NO: 177463 - DNA, 25 bp, Rattus norvegicus
atcaaagataaaccccagcatggtg

SEQ ID NO: 177464 - DNA, 25 bp, Rattus norvegicus
atcaaagataaagcccagcatggtg

SEQ ID NO: 177465 - DNA, 25 bp, Rattus norvegicus
atcaaagcacggcaagcctcatttc

SEQ ID NO: 177466 - DNA, 25 bp, Rattus norvegicus
atcaaagcacgggaagcctcatttc

SEQ ID NO: 177467 - DNA, 25 bp, Rattus norvegicus
atcaaagccactccagtcactgtca

SEQ ID NO: 177468 - DNA, 25 bp, Rattus norvegicus
atcaaagccactgcagtcactgtca

SEQ ID NO: 177469 - DNA, 25 bp, Rattus norvegicus
atcaaagccagaagagctgagctca

SEQ ID NO: 177470 - DNA, 25 bp, Rattus norvegicus
atcaaagccagatgagctgagctca

SEQ ID NO: 177471 - DNA, 25 bp, Rattus norvegicus
atcaaagccagcaccaaaggattgt

SEQ ID NO: 177472 - DNA, 25 bp, Rattus norvegicus
atcaaagccagctccaaaggattgt

SEQ ID NO: 177473 - DNA, 25 bp, Rattus norvegicus
atcaaagccgttcctgagcatgctg

SEQ ID NO: 177474 - DNA, 25 bp, Rattus norvegicus
atcaaagccgttgctgagcatgctg

SEQ ID NO: 177475 - DNA, 25 bp, Rattus norvegicus
atcaaagccttgctggcagtgacaa

SEQ ID NO: 177476 - DNA, 25 bp, Rattus norvegicus
atcaaagccttggtggcagtgacaa

SEQ ID NO: 177477 - DNA, 25 bp, Rattus norvegicus
atcaaagcttcccagcagatcctca

SEQ ID NO: 177478 - DNA, 25 bp, Rattus norvegicus
atcaaagcttccgagcagatcctca

SEQ ID NO: 177479 - DNA, 25 bp, Rattus norvegicus
atcaaaggaccacggagcactctcc

SEQ ID NO: 177480 - DNA, 25 bp, Rattus norvegicus
atcaaaggaccagggagcactctcc

SEQ ID NO: 177481 - DNA, 25 bp, Rattus norvegicus
atcaaaggcccactgcagacggaag

SEQ ID NO: 177482 - DNA, 25 bp, Rattus norvegicus
atcaaaggcccagtgcagacggaag

SEQ ID NO: 177483 - DNA, 25 bp, Rattus norvegicus
atcaaagggctcatttctgggcggt

SEQ ID NO: 177484 - DNA, 25 bp, Rattus norvegicus
atcaaagggctcttttctgggcggt

SEQ ID NO: 177485 - DNA, 25 bp, Rattus norvegicus
atcaaaggttttcgcttggcttagg

SEQ ID NO: 177486 - DNA, 25 bp, Rattus norvegicus
atcaaaggttttggcttggcttagg

SEQ ID NO: 177487 - DNA, 25 bp, Rattus norvegicus
atcaaagtaacaccagatcctctcc

SEQ ID NO: 177488 - DNA, 25 bp, Rattus norvegicus
atcaaagtaacagcagatcctctcc

SEQ ID NO: 177489 - DNA, 25 bp, Rattus norvegicus
atcaaagtcaagcttctgcgatccc

SEQ ID NO: 177490 - DNA, 25 bp, Rattus norvegicus
atcaaagtcaaggttctgcgatccc

SEQ ID NO: 177491 - DNA, 25 bp, Rattus norvegicus
atcaaagtcagcatcgtcctctgtg

SEQ ID NO: 177492 - DNA, 25 bp, Rattus norvegicus
atcaaagtcagcttcgtcctctgtg

SEQ ID NO: 177493 - DNA, 25 bp, Rattus norvegicus
atcaaagtgattccggctgagtaga

SEQ ID NO: 177494 - DNA, 25 bp, Rattus norvegicus
atcaaagtgattgcggctgagtaga

SEQ ID NO: 177495 - DNA, 25 bp, Rattus norvegicus
atcaaagtgggtccaaccaggttgc

SEQ ID NO: 177496 - DNA, 25 bp, Rattus norvegicus
atcaaagtgggtgcaaccaggttgc

SEQ ID NO: 177497 - DNA, 25 bp, Rattus norvegicus
atcaaagtgtggcttgtcctccgac

SEQ ID NO: 177498 - DNA, 25 bp, Rattus norvegicus
atcaaagtgtgggttgtcctccgac

SEQ ID NO: 177499 - DNA, 25 bp, Rattus norvegicus
atcaaataattcctcatggccctct

SEQ ID NO: 177500 - DNA, 25 bp, Rattus norvegicus
atcaaataattcgtcatggccctct

SEQ ID NO: 177501 - DNA, 25 bp, Rattus norvegicus
atcaaatagaggcacctgaccccta

SEQ ID NO: 177502 - DNA, 25 bp, Rattus norvegicus
atcaaatagagggacctgaccccta

SEQ ID NO: 177503 - DNA, 25 bp, Rattus norvegicus
atcaaatcagttaccttttcttaca

SEQ ID NO: 177504 - DNA, 25 bp, Rattus norvegicus
atcaaatcagtttccttttcttaca

SEQ ID NO: 177505 - DNA, 25 bp, Rattus norvegicus
atcaaatccaagacctcactcaata

SEQ ID NO: 177506 - DNA, 25 bp, Rattus norvegicus
atcaaatccaagtcctcactcaata

SEQ ID NO: 177507 - DNA, 25 bp, Rattus norvegicus
atcaaatccactatctgggtgaatc

SEQ ID NO: 177508 - DNA, 25 bp, Rattus norvegicus
atcaaatccactttctgggtgaatc

SEQ ID NO: 177509 - DNA, 25 bp, Rattus norvegicus
atcaaatccagacgctagcagttca

SEQ ID NO: 177510 - DNA, 25 bp, Rattus norvegicus
atcaaatccagaggctagcagttca

SEQ ID NO: 177511 - DNA, 25 bp, Rattus norvegicus
atcaaatccctgcaagtctgcagag

SEQ ID NO: 177512 - DNA, 25 bp, Rattus norvegicus
atcaaatccctggaagtctgcagag

SEQ ID NO: 177513 - DNA, 25 bp, Rattus norvegicus
atcaaatctgacacatctcgcttaa

SEQ ID NO: 177514 - DNA, 25 bp, Rattus norvegicus
atcaaatctgactcatctcgcttaa

SEQ ID NO: 177515 - DNA, 25 bp, Rattus norvegicus
atcaaatctttaatagcctgccatt

SEQ ID NO: 177516 - DNA, 25 bp, Rattus norvegicus
atcaaatctttattagcctgccatt

SEQ ID NO: 177517 - DNA, 25 bp, Rattus norvegicus
atcaaatttgttcctgctgggcagt

SEQ ID NO: 177518 - DNA, 25 bp, Rattus norvegicus
atcaaatttgttgctgctgggcagt

SEQ ID NO: 177519 - DNA, 25 bp, Rattus norvegicus
atcaacaaattgacacccctgcgtg

SEQ ID NO: 177520 - DNA, 25 bp, Rattus norvegicus
atcaacaaattgtcacccctgcgtg

SEQ ID NO: 177521 - DNA, 25 bp, Rattus norvegicus
atcaacaacgtgaacttctgccctt

SEQ ID NO: 177522 - DNA, 25 bp, Rattus norvegicus
atcaacaacgtgtacttctgccctt

SEQ ID NO: 177523 - DNA, 25 bp, Rattus norvegicus
atcaacaatagtctctcatttcaag

SEQ ID NO: 177524 - DNA, 25 bp, Rattus norvegicus
atcaacaatagtgtctcatttcaag

SEQ ID NO: 177525 - DNA, 25 bp, Rattus norvegicus
atcaacaccactatggagctcacag

SEQ ID NO: 177526 - DNA, 25 bp, Rattus norvegicus
atcaacaccactttggagctcacag

SEQ ID NO: 177527 - DNA, 25 bp, Rattus norvegicus
atcaacacgaaaattgccacgaggg

SEQ ID NO: 177528 - DNA, 25 bp, Rattus norvegicus
atcaacacgaaatttgccacgaggg

SEQ ID NO: 177529 - DNA, 25 bp, Rattus norvegicus
atcaacactacacttgctgctgtgg

SEQ ID NO: 177530 - DNA, 25 bp, Rattus norvegicus
atcaacactacagttgctgctgtgg

SEQ ID NO: 177531 - DNA, 25 bp, Rattus norvegicus
atcaacactgtgacagcaggctaac

SEQ ID NO: 177532 - DNA, 25 bp, Rattus norvegicus
atcaacactgtgtcagcaggctaac

SEQ ID NO: 177533 - DNA, 25 bp, Rattus norvegicus
atcaacagataccagcagctactag

SEQ ID NO: 177534 - DNA, 25 bp, Rattus norvegicus
atcaacagatacgagcagctactag

SEQ ID NO: 177535 - DNA, 25 bp, Rattus norvegicus
atcaacagcactatcacttgcatat

SEQ ID NO: 177536 - DNA, 25 bp, Rattus norvegicus
atcaacagcactttcacttgcatat

SEQ ID NO: 177537 - DNA, 25 bp, Rattus norvegicus
atcaacagccaactcgacgaattct

SEQ ID NO: 177538 - DNA, 25 bp, Rattus norvegicus
atcaacagccaagtcgacgaattct

SEQ ID NO: 177539 - DNA, 25 bp, Rattus norvegicus
atcaacagccacctgtttgcctgta

SEQ ID NO: 177540 - DNA, 25 bp, Rattus norvegicus
atcaacagccacgtgtttgcctgta

SEQ ID NO: 177541 - DNA, 25 bp, Rattus norvegicus
atcaacagggtgcttgaaatctgca

SEQ ID NO: 177542 - DNA, 25 bp, Rattus norvegicus
atcaacagggtggttgaaatctgca

SEQ ID NO: 177543 - DNA, 25 bp, Rattus norvegicus
atcaacaggtggagttcctggtcaa

SEQ ID NO: 177544 - DNA, 25 bp, Rattus norvegicus
atcaacaggtggtgttcctggtcaa

SEQ ID NO: 177545 - DNA, 25 bp, Rattus norvegicus
atcaacagtgtgcaggctgaagacc

SEQ ID NO: 177546 - DNA, 25 bp, Rattus norvegicus
atcaacagtgtggaggctgaagacc

SEQ ID NO: 177547 - DNA, 25 bp, Rattus norvegicus
atcaacataataacgcgtgcgcgcg

SEQ ID NO: 177548 - DNA, 25 bp, Rattus norvegicus
atcaacataatatcgcgtgcgcgcg

SEQ ID NO: 177549 - DNA, 25 bp, Rattus norvegicus
atcaacatcagtcaggaggccctaa

SEQ ID NO: 177550 - DNA, 25 bp, Rattus norvegicus
atcaacatcagtgaggaggccctaa

SEQ ID NO: 177551 - DNA, 25 bp, Rattus norvegicus
atcaacatcataatcagcccatcac

SEQ ID NO: 177552 - DNA, 25 bp, Rattus norvegicus
atcaacatcatattcagcccatcac

SEQ ID NO: 177553 - DNA, 25 bp, Rattus norvegicus
atcaacatccatcacctcatggtgg

SEQ ID NO: 177554 - DNA, 25 bp, Rattus norvegicus
atcaacatccatgacctcatggtgg

SEQ ID NO: 177555 - DNA, 25 bp, Rattus norvegicus
atcaacatctggctctgggttggga

SEQ ID NO: 177556 - DNA, 25 bp, Rattus norvegicus
atcaacatctgggtctgggttggga

SEQ ID NO: 177557 - DNA, 25 bp, Rattus norvegicus
atcaacatgcagatagccatcagaa

SEQ ID NO: 177558 - DNA, 25 bp, Rattus norvegicus
atcaacatgcagttagccatcagaa

SEQ ID NO: 177559 - DNA, 25 bp, Rattus norvegicus
atcaacatggagctgcctgcttgct

SEQ ID NO: 177560 - DNA, 25 bp, Rattus norvegicus
atcaacatggaggtgcctgcttgct

SEQ ID NO: 177561 - DNA, 25 bp, Rattus norvegicus
atcaacattggtactgggctggcgc

SEQ ID NO: 177562 - DNA, 25 bp, Rattus norvegicus
atcaacattggttctgggctggcgc

SEQ ID NO: 177563 - DNA, 25 bp, Rattus norvegicus
atcaacattgttaccattacccagt

SEQ ID NO: 177564 - DNA, 25 bp, Rattus norvegicus
atcaacattgtttccattacccagt

SEQ ID NO: 177565 - DNA, 25 bp, Rattus norvegicus
atcaaccagacaaaccagcagcaat

SEQ ID NO: 177566 - DNA, 25 bp, Rattus norvegicus
atcaaccagacataccagcagcaat

SEQ ID NO: 177567 - DNA, 25 bp, Rattus norvegicus
atcaaccaggatcatctcctcgaga

SEQ ID NO: 177568 - DNA, 25 bp, Rattus norvegicus
atcaaccaggatgatctcctcgaga

SEQ ID NO: 177569 - DNA, 25 bp, Rattus norvegicus
atcaacccacacaccattgtaagag

SEQ ID NO: 177570 - DNA, 25 bp, Rattus norvegicus
atcaacccacactccattgtaagag

SEQ ID NO: 177571 - DNA, 25 bp, Rattus norvegicus
atcaaccccggccatcaatgaggtg

SEQ ID NO: 177572 - DNA, 25 bp, Rattus norvegicus
atcaaccccggcgatcaatgaggtg

SEQ ID NO: 177573 - DNA, 25 bp, Rattus norvegicus
atcaacccttatcgtggccagcctt

SEQ ID NO: 177574 - DNA, 25 bp, Rattus norvegicus
atcaacccttatggtggccagcctt

SEQ ID NO: 177575 - DNA, 25 bp, Rattus norvegicus
atcaaccgaggacccatcgttcttt

SEQ ID NO: 177576 - DNA, 25 bp, Rattus norvegicus
atcaaccgaggagccatcgttcttt

SEQ ID NO: 177577 - DNA, 25 bp, Rattus norvegicus
atcaacctctgcagatctgagggtt

SEQ ID NO: 177578 - DNA, 25 bp, Rattus norvegicus
atcaacctctgctgatctgagggtt

SEQ ID NO: 177579 - DNA, 25 bp, Rattus norvegicus
atcaacctgcaactacggctgggag

SEQ ID NO: 177580 - DNA, 25 bp, Rattus norvegicus
atcaacctgcaagtacggctgggag

SEQ ID NO: 177581 - DNA, 25 bp, Rattus norvegicus
atcaacctgcagcagcgcgtggtga

SEQ ID NO: 177582 - DNA, 25 bp, Rattus norvegicus
atcaacctgcaggagcgcgtggtga

SEQ ID NO: 177583 - DNA, 25 bp, Rattus norvegicus
atcaacctgtaaagctttaagtaac

SEQ ID NO: 177584 - DNA, 25 bp, Rattus norvegicus
atcaacctgtaatgctttaagtaac

SEQ ID NO: 177585 - DNA, 25 bp, Rattus norvegicus
atcaacctgtgacatactcctcgtg

SEQ ID NO: 177586 - DNA, 25 bp, Rattus norvegicus
atcaacctgtgagatactcctcgtg

SEQ ID NO: 177587 - DNA, 25 bp, Rattus norvegicus
atcaaccttcatctgtcattccaag

SEQ ID NO: 177588 - DNA, 25 bp, Rattus norvegicus
atcaaccttcatgtgtcattccaag

SEQ ID NO: 177589 - DNA, 25 bp, Rattus norvegicus
atcaaccttgagattttcatggcac

SEQ ID NO: 177590 - DNA, 25 bp, Rattus norvegicus
atcaaccttgagtttttcatggcac

SEQ ID NO: 177591 - DNA, 25 bp, Rattus norvegicus
atcaaccttggcaccagcatgtgga

SEQ ID NO: 177592 - DNA, 25 bp, Rattus norvegicus
atcaaccttggctccagcatgtgga

SEQ ID NO: 177593 - DNA, 25 bp, Rattus norvegicus
atcaacgacctacacagagactttt

SEQ ID NO: 177594 - DNA, 25 bp, Rattus norvegicus
atcaacgacctagacagagactttt

SEQ ID NO: 177595 - DNA, 25 bp, Rattus norvegicus
atcaacgacctgctgatggtgacct

SEQ ID NO: 177596 - DNA, 25 bp, Rattus norvegicus
atcaacgacctggtgatggtgacct

SEQ ID NO: 177597 - DNA, 25 bp, Rattus norvegicus
atcaacgagtttccctccaacctgt

SEQ ID NO: 177598 - DNA, 25 bp, Rattus norvegicus
atcaacgagtttgcctccaacctgt

SEQ ID NO: 177599 - DNA, 25 bp, Rattus norvegicus
atcaacgcccggaaccagaataact

SEQ ID NO: 177600 - DNA, 25 bp, Rattus norvegicus
atcaacgcccggtaccagaataact

SEQ ID NO: 177601 - DNA, 25 bp, Rattus norvegicus
atcaacgcctacattgtctgtttta

SEQ ID NO: 177602 - DNA, 25 bp, Rattus norvegicus
atcaacgcctaccttttcagatttt

SEQ ID NO: 177603 - DNA, 25 bp, Rattus norvegicus
atcaacgcctacgttttcagatttt

SEQ ID NO: 177604 - DNA, 25 bp, Rattus norvegicus
atcaacgcctactttgtctgtttta

SEQ ID NO: 177605 - DNA, 25 bp, Rattus norvegicus
atcaacgggcgtctgctgtactatg

SEQ ID NO: 177606 - DNA, 25 bp, Rattus norvegicus
atcaacgggcgtgtgctgtactatg

SEQ ID NO: 177607 - DNA, 25 bp, Rattus norvegicus
atcaacgtggagcacgagctgcccg

SEQ ID NO: 177608 - DNA, 25 bp, Rattus norvegicus
atcaacgtggaggacgagctgcccg

SEQ ID NO: 177609 - DNA, 25 bp, Rattus norvegicus
atcaacgtggcgctggcccaggcaa

SEQ ID NO: 177610 - DNA, 25 bp, Rattus norvegicus
atcaacgtggcggtggcccaggcaa

SEQ ID NO: 177611 - DNA, 25 bp, Rattus norvegicus
atcaacgtggtgctcttcatccagc

SEQ ID NO: 177612 - DNA, 25 bp, Rattus norvegicus
atcaacgtggtggtcttcatccagc

SEQ ID NO: 177613 - DNA, 25 bp, Rattus norvegicus
atcaactaagtcaccacagggtttt

SEQ ID NO: 177614 - DNA, 25 bp, Rattus norvegicus
atcaactaagtctccacagggtttt

SEQ ID NO: 177615 - DNA, 25 bp, Rattus norvegicus
atcaactatgctcgtccagcagcag

SEQ ID NO: 177616 - DNA, 25 bp, Rattus norvegicus
atcaactatgctggtccagcagcag

SEQ ID NO: 177617 - DNA, 25 bp, Rattus norvegicus
atcaactcctgcatcttttacgaag

SEQ ID NO: 177618 - DNA, 25 bp, Rattus norvegicus
atcaactcctgcttcttttacgaag

SEQ ID NO: 177619 - DNA, 25 bp, Rattus norvegicus
atcaactcgagcaaaaccgccgtct

SEQ ID NO: 177620 - DNA, 25 bp, Rattus norvegicus
atcaactcgagctaaaccgccgtct

SEQ ID NO: 177621 - DNA, 25 bp, Rattus norvegicus
atcaactctgagcttgtcccttctg

SEQ ID NO: 177622 - DNA, 25 bp, Rattus norvegicus
atcaactctgaggttgtcccttctg

SEQ ID NO: 177623 - DNA, 25 bp, Rattus norvegicus
atcaactctgatatgttaatggctg

SEQ ID NO: 177624 - DNA, 25 bp, Rattus norvegicus
atcaactctgatttgttaatggctg

SEQ ID NO: 177625 - DNA, 25 bp, Rattus norvegicus
atcaactctgtaatagcctcccttt

SEQ ID NO: 177626 - DNA, 25 bp, Rattus norvegicus
atcaactctgtattagcctcccttt

SEQ ID NO: 177627 - DNA, 25 bp, Rattus norvegicus
atcaactgcatcatcttcaggtcat

SEQ ID NO: 177628 - DNA, 25 bp, Rattus norvegicus
atcaactgcatcttcttcaggtcat

SEQ ID NO: 177629 - DNA, 25 bp, Rattus norvegicus
atcaactgcctgaccttccagtttg

SEQ ID NO: 177630 - DNA, 25 bp, Rattus norvegicus
atcaactgcctgtccttccagtttg

SEQ ID NO: 177631 - DNA, 25 bp, Rattus norvegicus
atcaactggcttatctcactgtcga

SEQ ID NO: 177632 - DNA, 25 bp, Rattus norvegicus
atcaactggcttttctcactgtcga

SEQ ID NO: 177633 - DNA, 25 bp, Rattus norvegicus
atcaactgtaaaagtgtgcccctta

SEQ ID NO: 177634 - DNA, 25 bp, Rattus norvegicus
atcaactgtaaatgtgtgcccctta

SEQ ID NO: 177635 - DNA, 25 bp, Rattus norvegicus
atcaactgtatacgactggcagaat

SEQ ID NO: 177636 - DNA, 25 bp, Rattus norvegicus
atcaactgtataggactggcagaat

SEQ ID NO: 177637 - DNA, 25 bp, Rattus norvegicus
atcaacttcctcagttctgaatgca

SEQ ID NO: 177638 - DNA, 25 bp, Rattus norvegicus
atcaacttcctctgttctgaatgca

SEQ ID NO: 177639 - DNA, 25 bp, Rattus norvegicus
atcaactttgtaatgtgccctgtca

SEQ ID NO: 177640 - DNA, 25 bp, Rattus norvegicus
atcaactttgtattgtgccctgtca

SEQ ID NO: 177641 - DNA, 25 bp, Rattus norvegicus
atcaagaaaacaatcctttcagtgc

SEQ ID NO: 177642 - DNA, 25 bp, Rattus norvegicus
atcaagaaaacattcctttcagtgc

SEQ ID NO: 177643 - DNA, 25 bp, Rattus norvegicus
atcaagaaactgagtgcctcaggga

SEQ ID NO: 177644 - DNA, 25 bp, Rattus norvegicus
atcaagaaactgtgtgcctcaggga

SEQ ID NO: 177645 - DNA, 25 bp, Rattus norvegicus
atcaagaactgacctctacacatgc

SEQ ID NO: 177646 - DNA, 25 bp, Rattus norvegicus
atcaagaactgagctctacacatgc

SEQ ID NO: 177647 - DNA, 25 bp, Rattus norvegicus
atcaagaagattcctgtgtccatgt

SEQ ID NO: 177648 - DNA, 25 bp, Rattus norvegicus
atcaagaagattgctgtgtccatgt

SEQ ID NO: 177649 - DNA, 25 bp, Rattus norvegicus
atcaagaaggtgatcctttgctggc

SEQ ID NO: 177650 - DNA, 25 bp, Rattus norvegicus
atcaagaaggtgttcctttgctggc

SEQ ID NO: 177651 - DNA, 25 bp, Rattus norvegicus
atcaagacaatccagggccacggcc

SEQ ID NO: 177652 - DNA, 25 bp, Rattus norvegicus
atcaagacaatcgagggccacggcc

SEQ ID NO: 177653 - DNA, 25 bp, Rattus norvegicus
atcaagacagtactctatggaggca

SEQ ID NO: 177654 - DNA, 25 bp, Rattus norvegicus
atcaagacagtagtctatggaggca

SEQ ID NO: 177655 - DNA, 25 bp, Rattus norvegicus
atcaagacccgaaacgtggcagcac

SEQ ID NO: 177656 - DNA, 25 bp, Rattus norvegicus
atcaagacccgatacgtggcagcac

SEQ ID NO: 177657 - DNA, 25 bp, Rattus norvegicus
atcaagacggtgattgccttctgca

SEQ ID NO: 177658 - DNA, 25 bp, Rattus norvegicus
atcaagacggtgtttgccttctgca

SEQ ID NO: 177659 - DNA, 25 bp, Rattus norvegicus
atcaagagcatcacagctggacttt

SEQ ID NO: 177660 - DNA, 25 bp, Rattus norvegicus
atcaagagcatctcagctggacttt

SEQ ID NO: 177661 - DNA, 25 bp, Rattus norvegicus
atcaagagccctagccctaaggaca

SEQ ID NO: 177662 - DNA, 25 bp, Rattus norvegicus
atcaagagcccttgccctaaggaca

SEQ ID NO: 177663 - DNA, 25 bp, Rattus norvegicus
atcaagagctatcgcttgctgtcat

SEQ ID NO: 177664 - DNA, 25 bp, Rattus norvegicus
atcaagagctatggcttgctgtcat

SEQ ID NO: 177665 - DNA, 25 bp, Rattus norvegicus
atcaagagtttgagaccgtccggtt

SEQ ID NO: 177666 - DNA, 25 bp, Rattus norvegicus
atcaagagtttgtgaccgtccggtt

SEQ ID NO: 177667 - DNA, 25 bp, Rattus norvegicus
atcaagatacggaagctgatctgag

SEQ ID NO: 177668 - DNA, 25 bp, Rattus norvegicus
atcaagatacggtagctgatctgag

SEQ ID NO: 177669 - DNA, 25 bp, Rattus norvegicus
atcaagatatctattcgtggatcaa

SEQ ID NO: 177670 - DNA, 25 bp, Rattus norvegicus
atcaagatatcttttcgtggatcaa

SEQ ID NO: 177671 - DNA, 25 bp, Rattus norvegicus
atcaagatattgagtcagaagacca

SEQ ID NO: 177672 - DNA, 25 bp, Rattus norvegicus
atcaagatattgtgtcagaagacca

SEQ ID NO: 177673 - DNA, 25 bp, Rattus norvegicus
atcaagatcataagtggctccgaat

SEQ ID NO: 177674 - DNA, 25 bp, Rattus norvegicus
atcaagatcatatgtggctccgaat

SEQ ID NO: 177675 - DNA, 25 bp, Rattus norvegicus
atcaagatccatatctccctggtgc

SEQ ID NO: 177676 - DNA, 25 bp, Rattus norvegicus
atcaagatccatttctccctggtgc

SEQ ID NO: 177677 - DNA, 25 bp, Rattus norvegicus
atcaagatcgacaaccagaggcagc

SEQ ID NO: 177678 - DNA, 25 bp, Rattus norvegicus
atcaagatcgactaccagaggcagc

SEQ ID NO: 177679 - DNA, 25 bp, Rattus norvegicus
atcaagatgatactgtggccccttt

SEQ ID NO: 177680 - DNA, 25 bp, Rattus norvegicus
atcaagatgatagtgtggccccttt

SEQ ID NO: 177681 - DNA, 25 bp, Rattus norvegicus
atcaagatgcacagggcacccaggt

SEQ ID NO: 177682 - DNA, 25 bp, Rattus norvegicus
atcaagatgcactgggcacccaggt

SEQ ID NO: 177683 - DNA, 25 bp, Rattus norvegicus
atcaagcaccccaactatagttcgt

SEQ ID NO: 177684 - DNA, 25 bp, Rattus norvegicus
atcaagcacccctactatagttcgt

SEQ ID NO: 177685 - DNA, 25 bp, Rattus norvegicus
atcaagcagacgctggagatcctca

SEQ ID NO: 177686 - DNA, 25 bp, Rattus norvegicus
atcaagcagacggtggagatcctca

SEQ ID NO: 177687 - DNA, 25 bp, Rattus norvegicus
atcaagcagccccagtaacgacgag

SEQ ID NO: 177688 - DNA, 25 bp, Rattus norvegicus
atcaagcagcccgagtaacgacgag

SEQ ID NO: 177689 - DNA, 25 bp, Rattus norvegicus
atcaagcagctgattgaggcccgag

SEQ ID NO: 177690 - DNA, 25 bp, Rattus norvegicus
atcaagcagctgtttgaggcccgag

SEQ ID NO: 177691 - DNA, 25 bp, Rattus norvegicus
atcaagcatctgaacctagtcctgg

SEQ ID NO: 177692 - DNA, 25 bp, Rattus norvegicus
atcaagcatctgtacctagtcctgg

SEQ ID NO: 177693 - DNA, 25 bp, Rattus norvegicus
atcaagcatgaaacttctcagccaa

SEQ ID NO: 177694 - DNA, 25 bp, Rattus norvegicus
atcaagcatgaatcttctcagccaa

SEQ ID NO: 177695 - DNA, 25 bp, Rattus norvegicus
atcaagcatgagcagactcgtctac

SEQ ID NO: 177696 - DNA, 25 bp, Rattus norvegicus
atcaagcatgaggagactcgtctac

SEQ ID NO: 177697 - DNA, 25 bp, Rattus norvegicus
atcaagcatggtctcatggagttag

SEQ ID NO: 177698 - DNA, 25 bp, Rattus norvegicus
atcaagcatggtgtcatggagttag

SEQ ID NO: 177699 - DNA, 25 bp, Rattus norvegicus
atcaagccacagacggtgtgtgcgc

SEQ ID NO: 177700 - DNA, 25 bp, Rattus norvegicus
atcaagccacagtcggtgtgtgcgc

SEQ ID NO: 177701 - DNA, 25 bp, Rattus norvegicus
atcaagccacttagagacctccaca

SEQ ID NO: 177702 - DNA, 25 bp, Rattus norvegicus
atcaagccactttgagacctccaca

SEQ ID NO: 177703 - DNA, 25 bp, Rattus norvegicus
atcaagccagacatatgcctataat

SEQ ID NO: 177704 - DNA, 25 bp, Rattus norvegicus
atcaagccagacttatgcctataat

SEQ ID NO: 177705 - DNA, 25 bp, Rattus norvegicus
atcaagcccagtcgtggtcgggttt

SEQ ID NO: 177706 - DNA, 25 bp, Rattus norvegicus
atcaagcccagtggtggtcgggttt

SEQ ID NO: 177707 - DNA, 25 bp, Rattus norvegicus
atcaagcccggaccaaagcacagga

SEQ ID NO: 177708 - DNA, 25 bp, Rattus norvegicus
atcaagcccggagcaaagcacagga

SEQ ID NO: 177709 - DNA, 25 bp, Rattus norvegicus
atcaagcgtctcattggtgatcccg

SEQ ID NO: 177710 - DNA, 25 bp, Rattus norvegicus
atcaagcgtctctttggtgatcccg

SEQ ID NO: 177711 - DNA, 25 bp, Rattus norvegicus
atcaagctggtcactgttggattcc

SEQ ID NO: 177712 - DNA, 25 bp, Rattus norvegicus
atcaagctggtctctgttggattcc

SEQ ID NO: 177713 - DNA, 25 bp, Rattus norvegicus
atcaagctgttcaatgctagccctg

SEQ ID NO: 177714 - DNA, 25 bp, Rattus norvegicus
atcaagctgttctatgctagccctg

SEQ ID NO: 177715 - DNA, 25 bp, Rattus norvegicus
atcaagcttccacatcattatctct

SEQ ID NO: 177716 - DNA, 25 bp, Rattus norvegicus
atcaagcttccagatcattatctct

SEQ ID NO: 177717 - DNA, 25 bp, Rattus norvegicus
atcaagcttctgaaaatggcatcac

SEQ ID NO: 177718 - DNA, 25 bp, Rattus norvegicus
atcaagcttctgtaaatggcatcac

SEQ ID NO: 177719 - DNA, 25 bp, Rattus norvegicus
atcaaggacagaccaccagctggct

SEQ ID NO: 177720 - DNA, 25 bp, Rattus norvegicus
atcaaggacagagcaccagctggct

SEQ ID NO: 177721 - DNA, 25 bp, Rattus norvegicus
atcaaggaccatctttgtgtgtgtg

SEQ ID NO: 177722 - DNA, 25 bp, Rattus norvegicus
atcaaggaccatgtttgtgtgtgtg

SEQ ID NO: 177723 - DNA, 25 bp, Rattus norvegicus
atcaaggagtgaccctcccatgttg

SEQ ID NO: 177724 - DNA, 25 bp, Rattus norvegicus
atcaaggagtgagcctcccatgttg

SEQ ID NO: 177725 - DNA, 25 bp, Rattus norvegicus
atcaaggccctcctgaagcctcagg

SEQ ID NO: 177726 - DNA, 25 bp, Rattus norvegicus
atcaaggccctcgtgaagcctcagg

SEQ ID NO: 177727 - DNA, 25 bp, Rattus norvegicus
atcaaggcccttaagtctcgaacat

SEQ ID NO: 177728 - DNA, 25 bp, Rattus norvegicus
atcaaggccctttagtctcgaacat

SEQ ID NO: 177729 - DNA, 25 bp, Rattus norvegicus
atcaaggcgcctatcctgataatat

SEQ ID NO: 177730 - DNA, 25 bp, Rattus norvegicus
atcaaggcgcctttcctgataatat

SEQ ID NO: 177731 - DNA, 25 bp, Rattus norvegicus
atcaaggctcttctgttacatgtcc

SEQ ID NO: 177732 - DNA, 25 bp, Rattus norvegicus
atcaaggctcttgtgttacatgtcc

SEQ ID NO: 177733 - DNA, 25 bp, Rattus norvegicus
atcaaggcttaaatggtcttcttta

SEQ ID NO: 177734 - DNA, 25 bp, Rattus norvegicus
atcaaggcttaattggtcttcttta

SEQ ID NO: 177735 - DNA, 25 bp, Rattus norvegicus
atcaaggcttacctgctggagaacg

SEQ ID NO: 177736 - DNA, 25 bp, Rattus norvegicus
atcaaggcttacgtgctggagaacg

SEQ ID NO: 177737 - DNA, 25 bp, Rattus norvegicus
atcaaggcttctctgctgaggtgca

SEQ ID NO: 177738 - DNA, 25 bp, Rattus norvegicus
atcaaggcttctgtgctgaggtgca

SEQ ID NO: 177739 - DNA, 25 bp, Rattus norvegicus
atcaaggctttaagcgtaattctgc

SEQ ID NO: 177740 - DNA, 25 bp, Rattus norvegicus
atcaaggctttatgcgtaattctgc

SEQ ID NO: 177741 - DNA, 25 bp, Rattus norvegicus
atcaagggctggatcgagccgctag

SEQ ID NO: 177742 - DNA, 25 bp, Rattus norvegicus
atcaagggctggttcgagccgctag

SEQ ID NO: 177743 - DNA, 25 bp, Rattus norvegicus
atcaaggtccagaagtcctggcagg

SEQ ID NO: 177744 - DNA, 25 bp, Rattus norvegicus
atcaaggtccagtagtcctggcagg

SEQ ID NO: 177745 - DNA, 25 bp, Rattus norvegicus
atcaaggtgcccaggagtcctctga

SEQ ID NO: 177746 - DNA, 25 bp, Rattus norvegicus
atcaaggtgccctggagtcctctga

SEQ ID NO: 177747 - DNA, 25 bp, Rattus norvegicus
atcaaggttcacatcactgtcctga

SEQ ID NO: 177748 - DNA, 25 bp, Rattus norvegicus
atcaaggttcacttcactgtcctga

SEQ ID NO: 177749 - DNA, 25 bp, Rattus norvegicus
atcaaggtttatcccaggcctcata

SEQ ID NO: 177750 - DNA, 25 bp, Rattus norvegicus
atcaaggtttatgccaggcctcata

SEQ ID NO: 177751 - DNA, 25 bp, Rattus norvegicus
atcaagtacctgagaaactgcttca

SEQ ID NO: 177752 - DNA, 25 bp, Rattus norvegicus
atcaagtacctgtgaaactgcttca

SEQ ID NO: 177753 - DNA, 25 bp, Rattus norvegicus
atcaagtactgtcagctaacggtat

SEQ ID NO: 177754 - DNA, 25 bp, Rattus norvegicus
atcaagtactgtgagctaacggtat

SEQ ID NO: 177755 - DNA, 25 bp, Rattus norvegicus
atcaagtataaaacagcctgggaat

SEQ ID NO: 177756 - DNA, 25 bp, Rattus norvegicus
atcaagtataaatcagcctgggaat

SEQ ID NO: 177757 - DNA, 25 bp, Rattus norvegicus
atcaagtcagaaccagtgtccccaa

SEQ ID NO: 177758 - DNA, 25 bp, Rattus norvegicus
atcaagtcagaagcagtgtccccaa

SEQ ID NO: 177759 - DNA, 25 bp, Rattus norvegicus
atcaagtcagctacaatgcatccct

SEQ ID NO: 177760 - DNA, 25 bp, Rattus norvegicus
atcaagtcagcttcaatgcatccct

SEQ ID NO: 177761 - DNA, 25 bp, Rattus norvegicus
atcaagtcctggcaaattggctcaa

SEQ ID NO: 177762 - DNA, 25 bp, Rattus norvegicus
atcaagtcctgggaaattggctcaa

SEQ ID NO: 177763 - DNA, 25 bp, Rattus norvegicus
atcaagtcgatgattactccccatg

SEQ ID NO: 177764 - DNA, 25 bp, Rattus norvegicus
atcaagtcgatgtttactccccatg

SEQ ID NO: 177765 - DNA, 25 bp, Rattus norvegicus
atcaagtctaagacgcgatgcgctc

SEQ ID NO: 177766 - DNA, 25 bp, Rattus norvegicus
atcaagtctaagtcgcgatgcgctc

SEQ ID NO: 177767 - DNA, 25 bp, Rattus norvegicus
atcaagtcttgtcagtttgtgccct

SEQ ID NO: 177768 - DNA, 25 bp, Rattus norvegicus
atcaagtcttgtgagtttgtgccct

SEQ ID NO: 177769 - DNA, 25 bp, Rattus norvegicus
atcaagtgcctgatgagaccttcct

SEQ ID NO: 177770 - DNA, 25 bp, Rattus norvegicus
atcaagtgcctgttgagaccttcct

SEQ ID NO: 177771 - DNA, 25 bp, Rattus norvegicus
atcaagtgctcccacgcctacagga

SEQ ID NO: 177772 - DNA, 25 bp, Rattus norvegicus
atcaagtgctccgacgcctacagga

SEQ ID NO: 177773 - DNA, 25 bp, Rattus norvegicus
atcaagtgtaaactccaaccgctgc

SEQ ID NO: 177774 - DNA, 25 bp, Rattus norvegicus
atcaagtgtaaagtccaaccgctgc

SEQ ID NO: 177775 - DNA, 25 bp, Rattus norvegicus
atcaagtgtgtcaatcatgccggcc

SEQ ID NO: 177776 - DNA, 25 bp, Rattus norvegicus
atcaagtgtgtctatcatgccggcc

SEQ ID NO: 177777 - DNA, 25 bp, Rattus norvegicus
atcaagttcaggaaaattccttcct

SEQ ID NO: 177778 - DNA, 25 bp, Rattus norvegicus
atcaagttcaggtaaattccttcct

SEQ ID NO: 177779 - DNA, 25 bp, Rattus norvegicus
atcaagttccttactccttgagtgt

SEQ ID NO: 177780 - DNA, 25 bp, Rattus norvegicus
atcaagttcctttctccttgagtgt

SEQ ID NO: 177781 - DNA, 25 bp, Rattus norvegicus
atcaagttgctgctacaagcccgag

SEQ ID NO: 177782 - DNA, 25 bp, Rattus norvegicus
atcaagttgctggtacaagcccgag

SEQ ID NO: 177783 - DNA, 25 bp, Rattus norvegicus
atcaataaatcaacaccatctctct

SEQ ID NO: 177784 - DNA, 25 bp, Rattus norvegicus
atcaataaatcatcaccatctctct

SEQ ID NO: 177785 - DNA, 25 bp, Rattus norvegicus
atcaatacaacaagacaggcctgcc

SEQ ID NO: 177786 - DNA, 25 bp, Rattus norvegicus
atcaatacaacatgacaggcctgcc

SEQ ID NO: 177787 - DNA, 25 bp, Rattus norvegicus
atcaatacaactctttttccatcct

SEQ ID NO: 177788 - DNA, 25 bp, Rattus norvegicus
atcaatacaactgtttttccatcct

SEQ ID NO: 177789 - DNA, 25 bp, Rattus norvegicus
atcaatacaataacgtccctttggg

SEQ ID NO: 177790 - DNA, 25 bp, Rattus norvegicus
atcaatacaatatcgtccctttggg

SEQ ID NO: 177791 - DNA, 25 bp, Rattus norvegicus
atcaatacatggaacgagcaggcgg

SEQ ID NO: 177792 - DNA, 25 bp, Rattus norvegicus
atcaatacatggtacgagcaggcgg

SEQ ID NO: 177793 - DNA, 25 bp, Rattus norvegicus
atcaataccctgacttcctgagtat

SEQ ID NO: 177794 - DNA, 25 bp, Rattus norvegicus
atcaataccctgtcttcctgagtat

SEQ ID NO: 177795 - DNA, 25 bp, Rattus norvegicus
atcaatacctccagatttatccctg

SEQ ID NO: 177796 - DNA, 25 bp, Rattus norvegicus
atcaatacctcctgatttatccctg

SEQ ID NO: 177797 - DNA, 25 bp, Rattus norvegicus
atcaatactttcatggtgcagcaga

SEQ ID NO: 177798 - DNA, 25 bp, Rattus norvegicus
atcaatactttcttggtgcagcaga

SEQ ID NO: 177799 - DNA, 25 bp, Rattus norvegicus
atcaatagagaccatgtcacgtatt

SEQ ID NO: 177800 - DNA, 25 bp, Rattus norvegicus
atcaatagagacgatgtcacgtatt

SEQ ID NO: 177801 - DNA, 25 bp, Rattus norvegicus
atcaatagcgggaggcttttctcgc

SEQ ID NO: 177802 - DNA, 25 bp, Rattus norvegicus
atcaatagcgggtggcttttctcgc

SEQ ID NO: 177803 - DNA, 25 bp, Rattus norvegicus
atcaatataagcagaccgtcactgc

SEQ ID NO: 177804 - DNA, 25 bp, Rattus norvegicus
atcaatataagctgaccgtcactgc

SEQ ID NO: 177805 - DNA, 25 bp, Rattus norvegicus
atcaatataccaagctcttctttgc

SEQ ID NO: 177806 - DNA, 25 bp, Rattus norvegicus
atcaatataccatgctcttctttgc

SEQ ID NO: 177807 - DNA, 25 bp, Rattus norvegicus
atcaatatgatgaacggccggccgg

SEQ ID NO: 177808 - DNA, 25 bp, Rattus norvegicus
atcaatatgatgtacggccggccgg

SEQ ID NO: 177809 - DNA, 25 bp, Rattus norvegicus
atcaatcaatatcccatggatgtgg

SEQ ID NO: 177810 - DNA, 25 bp, Rattus norvegicus
atcaatcaatatgccatggatgtgg

SEQ ID NO: 177811 - DNA, 25 bp, Rattus norvegicus
atcaatcagctaagcctccattttc

SEQ ID NO: 177812 - DNA, 25 bp, Rattus norvegicus
atcaatcagctatgcctccattttc

SEQ ID NO: 177813 - DNA, 25 bp, Rattus norvegicus
atcaatcagtatatcttgcccctct

SEQ ID NO: 177814 - DNA, 25 bp, Rattus norvegicus
atcaatcagtatttcttgcccctct

SEQ ID NO: 177815 - DNA, 25 bp, Rattus norvegicus
atcaatccaggcattgctaagtgct

SEQ ID NO: 177816 - DNA, 25 bp, Rattus norvegicus
atcaatccaggctttgctaagtgct

SEQ ID NO: 177817 - DNA, 25 bp, Rattus norvegicus
atcaatcccagtattccaggtgagg

SEQ ID NO: 177818 - DNA, 25 bp, Rattus norvegicus
atcaatcccagttttccaggtgagg

SEQ ID NO: 177819 - DNA, 25 bp, Rattus norvegicus
atcaatcccgttagtcatgtgacat

SEQ ID NO: 177820 - DNA, 25 bp, Rattus norvegicus
atcaatcccgtttgtcatgtgacat

SEQ ID NO: 177821 - DNA, 25 bp, Rattus norvegicus
atcaatccgtatccaaccatttcca

SEQ ID NO: 177822 - DNA, 25 bp, Rattus norvegicus
atcaatccgtatgcaaccatttcca

SEQ ID NO: 177823 - DNA, 25 bp, Rattus norvegicus
atcaatcctaatcttagccttccta

SEQ ID NO: 177824 - DNA, 25 bp, Rattus norvegicus
atcaatcctaatgttagccttccta

SEQ ID NO: 177825 - DNA, 25 bp, Rattus norvegicus
atcaatccttatatgtacctgccct

SEQ ID NO: 177826 - DNA, 25 bp, Rattus norvegicus
atcaatccttatttgtacctgccct

SEQ ID NO: 177827 - DNA, 25 bp, Rattus norvegicus
atcaatctataaccccatcactgga

SEQ ID NO: 177828 - DNA, 25 bp, Rattus norvegicus
atcaatctataagcccatcactgga

SEQ ID NO: 177829 - DNA, 25 bp, Rattus norvegicus
atcaatctatgaagccaggcctcct

SEQ ID NO: 177830 - DNA, 25 bp, Rattus norvegicus
atcaatctatgatgccaggcctcct

SEQ ID NO: 177831 - DNA, 25 bp, Rattus norvegicus
atcaatctcatgacctcgagggaaa

SEQ ID NO: 177832 - DNA, 25 bp, Rattus norvegicus
atcaatctcatgtcctcgagggaaa

SEQ ID NO: 177833 - DNA, 25 bp, Rattus norvegicus
atcaatctgctccttctctaatatt

SEQ ID NO: 177834 - DNA, 25 bp, Rattus norvegicus
atcaatctgctcgttctctaatatt

SEQ ID NO: 177835 - DNA, 25 bp, Rattus norvegicus
atcaatctggccactgctctgacct

SEQ ID NO: 177836 - DNA, 25 bp, Rattus norvegicus
atcaatctggcctctgctctgacct

SEQ ID NO: 177837 - DNA, 25 bp, Rattus norvegicus
atcaatctggtgcaggttgtcccgg

SEQ ID NO: 177838 - DNA, 25 bp, Rattus norvegicus
atcaatctggtgcttgtgtccctac

SEQ ID NO: 177839 - DNA, 25 bp, Rattus norvegicus
atcaatctggtggaggttgtcccgg

SEQ ID NO: 177840 - DNA, 25 bp, Rattus norvegicus
atcaatctggtggttgtgtccctac

SEQ ID NO: 177841 - DNA, 25 bp, Rattus norvegicus
atcaatcttaatccagtcttccttt

SEQ ID NO: 177842 - DNA, 25 bp, Rattus norvegicus
atcaatcttaatgcagtcttccttt

SEQ ID NO: 177843 - DNA, 25 bp, Rattus norvegicus
atcaatcttcagagagttcctcctt

SEQ ID NO: 177844 - DNA, 25 bp, Rattus norvegicus
atcaatcttcagtgagttcctcctt

SEQ ID NO: 177845 - DNA, 25 bp, Rattus norvegicus
atcaatcttgtgagtaagtgctcta

SEQ ID NO: 177846 - DNA, 25 bp, Rattus norvegicus
atcaatcttgtgtgtaagtgctcta

SEQ ID NO: 177847 - DNA, 25 bp, Rattus norvegicus
atcaatgacaacatcgccatcttca

SEQ ID NO: 177848 - DNA, 25 bp, Rattus norvegicus
atcaatgacaacttcgccatcttca

SEQ ID NO: 177849 - DNA, 25 bp, Rattus norvegicus
atcaatgaccctcagattccatttt

SEQ ID NO: 177850 - DNA, 25 bp, Rattus norvegicus
atcaatgaccctgagattccatttt

SEQ ID NO: 177851 - DNA, 25 bp, Rattus norvegicus
atcaatgacgctagggtttgcacca

SEQ ID NO: 177852 - DNA, 25 bp, Rattus norvegicus
atcaatgacgcttgggtttgcacca

SEQ ID NO: 177853 - DNA, 25 bp, Rattus norvegicus
atcaatgatttcactgccctttgaa

SEQ ID NO: 177854 - DNA, 25 bp, Rattus norvegicus
atcaatgatttctctgccctttgaa

SEQ ID NO: 177855 - DNA, 25 bp, Rattus norvegicus
atcaatgccatcacgattaccctag

SEQ ID NO: 177856 - DNA, 25 bp, Rattus norvegicus
atcaatgccatctcgattaccctag

SEQ ID NO: 177857 - DNA, 25 bp, Rattus norvegicus
atcaatgcctgtatgtatctgccca

SEQ ID NO: 177858 - DNA, 25 bp, Rattus norvegicus
atcaatgcctgtttgtatctgccca

SEQ ID NO: 177859 - DNA, 25 bp, Rattus norvegicus
atcaatgctgatcgctcctgtgtgt

SEQ ID NO: 177860 - DNA, 25 bp, Rattus norvegicus
atcaatgctgatggctcctgtgtgt

SEQ ID NO: 177861 - DNA, 25 bp, Rattus norvegicus
atcaatgctgttcacctcacaatga

SEQ ID NO: 177862 - DNA, 25 bp, Rattus norvegicus
atcaatgctgttgacctcacaatga

SEQ ID NO: 177863 - DNA, 25 bp, Rattus norvegicus
atcaatggccgcacggatgcttaag

SEQ ID NO: 177864 - DNA, 25 bp, Rattus norvegicus
atcaatggccgctcggatgcttaag

SEQ ID NO: 177865 - DNA, 25 bp, Rattus norvegicus
atcaatgtatagaagcttcccctct

SEQ ID NO: 177866 - DNA, 25 bp, Rattus norvegicus
atcaatgtatagtagcttcccctct

SEQ ID NO: 177867 - DNA, 25 bp, Rattus norvegicus
atcaatgtcaggctttcctcggaga

SEQ ID NO: 177868 - DNA, 25 bp, Rattus norvegicus
atcaatgtcagggtttcctcggaga

SEQ ID NO: 177869 - DNA, 25 bp, Rattus norvegicus
atcaatgtttcgattctcctacttc

SEQ ID NO: 177870 - DNA, 25 bp, Rattus norvegicus
atcaatgtttcgtttctcctacttc

SEQ ID NO: 177871 - DNA, 25 bp, Rattus norvegicus
atcaattaattaacagtctccaggg

SEQ ID NO: 177872 - DNA, 25 bp, Rattus norvegicus
atcaattaattatcagtctccaggg

SEQ ID NO: 177873 - DNA, 25 bp, Rattus norvegicus
atcaattacaccaagctgcactatg

SEQ ID NO: 177874 - DNA, 25 bp, Rattus norvegicus
atcaattacacctagctgcactatg

SEQ ID NO: 177875 - DNA, 25 bp, Rattus norvegicus
atcaattcattgagtccccaacatt

SEQ ID NO: 177876 - DNA, 25 bp, Rattus norvegicus
atcaattcattgtgtccccaacatt

SEQ ID NO: 177877 - DNA, 25 bp, Rattus norvegicus
atcaattcttacaccatgagcactt

SEQ ID NO: 177878 - DNA, 25 bp, Rattus norvegicus
atcaattcttactccatgagcactt

SEQ ID NO: 177879 - DNA, 25 bp, Rattus norvegicus
atcaattctttccagtcccggcgcg

SEQ ID NO: 177880 - DNA, 25 bp, Rattus norvegicus
atcaattctttcgagtcccggcgcg

SEQ ID NO: 177881 - DNA, 25 bp, Rattus norvegicus
atcaattgacccaacaagcacatgt

SEQ ID NO: 177882 - DNA, 25 bp, Rattus norvegicus
atcaattgaccctacaagcacatgt

SEQ ID NO: 177883 - DNA, 25 bp, Rattus norvegicus
atcaattgctttcccaagtctgtct

SEQ ID NO: 177884 - DNA, 25 bp, Rattus norvegicus
atcaattgctttgccaagtctgtct

SEQ ID NO: 177885 - DNA, 25 bp, Rattus norvegicus
atcaatttctcaactctgggcagtg

SEQ ID NO: 177886 - DNA, 25 bp, Rattus norvegicus
atcaatttctcatctctgggcagtg

SEQ ID NO: 177887 - DNA, 25 bp, Rattus norvegicus
atcaatttggcccttggagttcgcg

SEQ ID NO: 177888 - DNA, 25 bp, Rattus norvegicus
atcaatttggccgttggagttcgcg

SEQ ID NO: 177889 - DNA, 25 bp, Rattus norvegicus
atcaatttgggcaaccaccaaccat

SEQ ID NO: 177890 - DNA, 25 bp, Rattus norvegicus
atcaatttgggctaccaccaaccat

SEQ ID NO: 177891 - DNA, 25 bp, Rattus norvegicus
atcaatttttgaccactactggaaa

SEQ ID NO: 177892 - DNA, 25 bp, Rattus norvegicus
atcaatttttgagcactactggaaa

SEQ ID NO: 177893 - DNA, 25 bp, Rattus norvegicus
atcacaaacctgctggtgttcggct

SEQ ID NO: 177894 - DNA, 25 bp, Rattus norvegicus
atcacaaacctggtggtgttcggct

SEQ ID NO: 177895 - DNA, 25 bp, Rattus norvegicus
atcacaaagtggacgctgctggaac

SEQ ID NO: 177896 - DNA, 25 bp, Rattus norvegicus
atcacaaagtggtcgctgctggaac

SEQ ID NO: 177897 - DNA, 25 bp, Rattus norvegicus
atcacaaatgaacccggctgctccg

SEQ ID NO: 177898 - DNA, 25 bp, Rattus norvegicus
atcacaaatgaagccggctgctccg

SEQ ID NO: 177899 - DNA, 25 bp, Rattus norvegicus
atcacaacagacacactgggcaggt

SEQ ID NO: 177900 - DNA, 25 bp, Rattus norvegicus
atcacaacagactcactgggcaggt

SEQ ID NO: 177901 - DNA, 25 bp, Rattus norvegicus
atcacaaccgttatggacaggaact

SEQ ID NO: 177902 - DNA, 25 bp, Rattus norvegicus
atcacaaccgttttggacaggaact

SEQ ID NO: 177903 - DNA, 25 bp, Rattus norvegicus
atcacaacggctagatgaccttcac

SEQ ID NO: 177904 - DNA, 25 bp, Rattus norvegicus
atcacaacggcttgatgaccttcac

SEQ ID NO: 177905 - DNA, 25 bp, Rattus norvegicus
atcacaactggaactctccaggcaa

SEQ ID NO: 177906 - DNA, 25 bp, Rattus norvegicus
atcacaactggatctctccaggcaa

SEQ ID NO: 177907 - DNA, 25 bp, Rattus norvegicus
atcacaactgttattcatactggaa

SEQ ID NO: 177908 - DNA, 25 bp, Rattus norvegicus
atcacaactgtttttcatactggaa

SEQ ID NO: 177909 - DNA, 25 bp, Rattus norvegicus
atcacaacttggattatctgcctaa

SEQ ID NO: 177910 - DNA, 25 bp, Rattus norvegicus
atcacaacttggtttatctgcctaa

SEQ ID NO: 177911 - DNA, 25 bp, Rattus norvegicus
atcacaagcaccaaattgggaatta

SEQ ID NO: 177912 - DNA, 25 bp, Rattus norvegicus
atcacaagcacctaattgggaatta

SEQ ID NO: 177913 - DNA, 25 bp, Rattus norvegicus
atcacaagtgaaccacagctggccc

SEQ ID NO: 177914 - DNA, 25 bp, Rattus norvegicus
atcacaagtgaagcacagctggccc

SEQ ID NO: 177915 - DNA, 25 bp, Rattus norvegicus
atcacaagtttaattctcacctgaa

SEQ ID NO: 177916 - DNA, 25 bp, Rattus norvegicus
atcacaagtttatttctcacctgaa

SEQ ID NO: 177917 - DNA, 25 bp, Rattus norvegicus
atcacaatagatcacgacgcctctg

SEQ ID NO: 177918 - DNA, 25 bp, Rattus norvegicus
atcacaatagatgacgacgcctctg

SEQ ID NO: 177919 - DNA, 25 bp, Rattus norvegicus
atcacaattagcctctgtgctgata

SEQ ID NO: 177920 - DNA, 25 bp, Rattus norvegicus
atcacaattagcgtctgtgctgata

SEQ ID NO: 177921 - DNA, 25 bp, Rattus norvegicus
atcacacaactcagccttactcaat

SEQ ID NO: 177922 - DNA, 25 bp, Rattus norvegicus
atcacacaactctgccttactcaat

SEQ ID NO: 177923 - DNA, 25 bp, Rattus norvegicus
atcacacaagtgaggctggcttaca

SEQ ID NO: 177924 - DNA, 25 bp, Rattus norvegicus
atcacacaagtgtggctggcttaca

SEQ ID NO: 177925 - DNA, 25 bp, Rattus norvegicus
atcacacaatgtcacgttctttgtc

SEQ ID NO: 177926 - DNA, 25 bp, Rattus norvegicus
atcacacaatgtgacgttctttgtc

SEQ ID NO: 177927 - DNA, 25 bp, Rattus norvegicus
atcacacactacaacctggaacagg

SEQ ID NO: 177928 - DNA, 25 bp, Rattus norvegicus
atcacacactactacctggaacagg

SEQ ID NO: 177929 - DNA, 25 bp, Rattus norvegicus
atcacacagagaatgggacttgccc

SEQ ID NO: 177930 - DNA, 25 bp, Rattus norvegicus
atcacacagagattgggacttgccc

SEQ ID NO: 177931 - DNA, 25 bp, Rattus norvegicus
atcacacagaggaactagcctgtct

SEQ ID NO: 177932 - DNA, 25 bp, Rattus norvegicus
atcacacagaggtactagcctgtct

SEQ ID NO: 177933 - DNA, 25 bp, Rattus norvegicus
atcacacagagtattgccatgggct

SEQ ID NO: 177934 - DNA, 25 bp, Rattus norvegicus
atcacacagagttttgccatgggct

SEQ ID NO: 177935 - DNA, 25 bp, Rattus norvegicus
atcacacaggagacaaggtcagctt

SEQ ID NO: 177936 - DNA, 25 bp, Rattus norvegicus
atcacacaggagtcaaggtcagctt

SEQ ID NO: 177937 - DNA, 25 bp, Rattus norvegicus
atcacacatagccattcccattttg

SEQ ID NO: 177938 - DNA, 25 bp, Rattus norvegicus
atcacacatagcgattcccattttg

SEQ ID NO: 177939 - DNA, 25 bp, Rattus norvegicus
atcacacatttcaataccctcaaac

SEQ ID NO: 177940 - DNA, 25 bp, Rattus norvegicus
atcacacatttctataccctcaaac

SEQ ID NO: 177941 - DNA, 25 bp, Rattus norvegicus
atcacaccaccactcgtatgcgaat

SEQ ID NO: 177942 - DNA, 25 bp, Rattus norvegicus
atcacaccaccagtcgtatgcgaat

SEQ ID NO: 177943 - DNA, 25 bp, Rattus norvegicus
atcacaccagacatttcgccggaga

SEQ ID NO: 177944 - DNA, 25 bp, Rattus norvegicus
atcacaccagacttttcgccggaga

SEQ ID NO: 177945 - DNA, 25 bp, Rattus norvegicus
atcacaccatgcaccggagatttaa

SEQ ID NO: 177946 - DNA, 25 bp, Rattus norvegicus
atcacaccatgctccggagatttaa

SEQ ID NO: 177947 - DNA, 25 bp, Rattus norvegicus
atcacacccttgctgtctggattat

SEQ ID NO: 177948 - DNA, 25 bp, Rattus norvegicus
atcacacccttggtgtctggattat

SEQ ID NO: 177949 - DNA, 25 bp, Rattus norvegicus
atcacaccgtttacatcttctcttt

SEQ ID NO: 177950 - DNA, 25 bp, Rattus norvegicus
atcacaccgttttcatcttctcttt

SEQ ID NO: 177951 - DNA, 25 bp, Rattus norvegicus
atcacacctcttatgtcagcatttc

SEQ ID NO: 177952 - DNA, 25 bp, Rattus norvegicus
atcacacctcttttgtcagcatttc

SEQ ID NO: 177953 - DNA, 25 bp, Rattus norvegicus
atcacacctgccatagatcaattgc

SEQ ID NO: 177954 - DNA, 25 bp, Rattus norvegicus
atcacacctgccttagatcaattgc

SEQ ID NO: 177955 - DNA, 25 bp, Rattus norvegicus
atcacacctgctcgctatctagagg

SEQ ID NO: 177956 - DNA, 25 bp, Rattus norvegicus
atcacacctgctggctatctagagg

SEQ ID NO: 177957 - DNA, 25 bp, Rattus norvegicus
atcacacctggaatactttaccatc

SEQ ID NO: 177958 - DNA, 25 bp, Rattus norvegicus
atcacacctggattactttaccatc

SEQ ID NO: 177959 - DNA, 25 bp, Rattus norvegicus
atcacacctggcactgatgtttttt

SEQ ID NO: 177960 - DNA, 25 bp, Rattus norvegicus
atcacacctggctctgatgtttttt

SEQ ID NO: 177961 - DNA, 25 bp, Rattus norvegicus
atcacacgcgagcacaggacacaca

SEQ ID NO: 177962 - DNA, 25 bp, Rattus norvegicus
atcacacgcgaggacaggacacaca

SEQ ID NO: 177963 - DNA, 25 bp, Rattus norvegicus
atcacacggcgaccttgggtacctg

SEQ ID NO: 177964 - DNA, 25 bp, Rattus norvegicus
atcacacggcgagcttgggtacctg

SEQ ID NO: 177965 - DNA, 25 bp, Rattus norvegicus
atcacacgtgttatgatctctcgtc

SEQ ID NO: 177966 - DNA, 25 bp, Rattus norvegicus
atcacacgtgttttgatctctcgtc

SEQ ID NO: 177967 - DNA, 25 bp, Rattus norvegicus
atcacacgttgtatagttcctcacc

SEQ ID NO: 177968 - DNA, 25 bp, Rattus norvegicus
atcacacgttgtttagttcctcacc

SEQ ID NO: 177969 - DNA, 25 bp, Rattus norvegicus
atcacactaacaatgtgccctcatt

SEQ ID NO: 177970 - DNA, 25 bp, Rattus norvegicus
atcacactaacattgtgccctcatt

SEQ ID NO: 177971 - DNA, 25 bp, Rattus norvegicus
atcacactacatagtctcttgtcct

SEQ ID NO: 177972 - DNA, 25 bp, Rattus norvegicus
atcacactacattgtctcttgtcct

SEQ ID NO: 177973 - DNA, 25 bp, Rattus norvegicus
atcacactactgagggaccgcgagg

SEQ ID NO: 177974 - DNA, 25 bp, Rattus norvegicus
atcacactactgtgggaccgcgagg

SEQ ID NO: 177975 - DNA, 25 bp, Rattus norvegicus
atcacactcattctttggtcatctg

SEQ ID NO: 177976 - DNA, 25 bp, Rattus norvegicus
atcacactcattgtttggtcatctg

SEQ ID NO: 177977 - DNA, 25 bp, Rattus norvegicus
atcacactgaataggacccctgatg

SEQ ID NO: 177978 - DNA, 25 bp, Rattus norvegicus
atcacactgaattggacccctgatg

SEQ ID NO: 177979 - DNA, 25 bp, Rattus norvegicus
atcacactgcagatcttacaagggc

SEQ ID NO: 177980 - DNA, 25 bp, Rattus norvegicus
atcacactgcagctattcagcagta

SEQ ID NO: 177981 - DNA, 25 bp, Rattus norvegicus
atcacactgcaggtattcagcagta

SEQ ID NO: 177982 - DNA, 25 bp, Rattus norvegicus
atcacactgcagttcttacaagggc

SEQ ID NO: 177983 - DNA, 25 bp, Rattus norvegicus
atcacactgctcattctgctaactt

SEQ ID NO: 177984 - DNA, 25 bp, Rattus norvegicus
atcacactgctctttctgctaactt

SEQ ID NO: 177985 - DNA, 25 bp, Rattus norvegicus
atcacactgctgaacatctgtcaca

SEQ ID NO: 177986 - DNA, 25 bp, Rattus norvegicus
atcacactgctgtacatctgtcaca

SEQ ID NO: 177987 - DNA, 25 bp, Rattus norvegicus
atcacactgtcactcagccagtttc

SEQ ID NO: 177988 - DNA, 25 bp, Rattus norvegicus
atcacactgtcagtcagccagtttc

SEQ ID NO: 177989 - DNA, 25 bp, Rattus norvegicus
atcacacttaaaacgttgcagcagc

SEQ ID NO: 177990 - DNA, 25 bp, Rattus norvegicus
atcacacttaaatcgttgcagcagc

SEQ ID NO: 177991 - DNA, 25 bp, Rattus norvegicus
atcacacttagtaagcatctccgtt

SEQ ID NO: 177992 - DNA, 25 bp, Rattus norvegicus
atcacacttagttagcatctccgtt

SEQ ID NO: 177993 - DNA, 25 bp, Rattus norvegicus
atcacacttcctacctggcaggatt

SEQ ID NO: 177994 - DNA, 25 bp, Rattus norvegicus
atcacacttccttcctggcaggatt

SEQ ID NO: 177995 - DNA, 25 bp, Rattus norvegicus
atcacacttgtgaagtcagacttgg

SEQ ID NO: 177996 - DNA, 25 bp, Rattus norvegicus
atcacacttgtgtagtcagacttgg

SEQ ID NO: 177997 - DNA, 25 bp, Rattus norvegicus
atcacagaaggactgtgggcagcct

SEQ ID NO: 177998 - DNA, 25 bp, Rattus norvegicus
atcacagaaggagtgtgggcagcct

SEQ ID NO: 177999 - DNA, 25 bp, Rattus norvegicus
atcacagacataatttagccctatt

SEQ ID NO: 178000 - DNA, 25 bp, Rattus norvegicus
atcacagacatattttagccctatt

SEQ ID NO: 178001 - DNA, 25 bp, Rattus norvegicus
atcacagacctcatcagtgagctct

SEQ ID NO: 178002 - DNA, 25 bp, Rattus norvegicus
atcacagacctcttcagtgagctct

SEQ ID NO: 178003 - DNA, 25 bp, Rattus norvegicus
atcacagacgtaactctagcctatg

SEQ ID NO: 178004 - DNA, 25 bp, Rattus norvegicus
atcacagacgtatctctagcctatg

SEQ ID NO: 178005 - DNA, 25 bp, Rattus norvegicus
atcacagagagactcgtgccgaatt

SEQ ID NO: 178006 - DNA, 25 bp, Rattus norvegicus
atcacagagagagtcgtgccgaatt

SEQ ID NO: 178007 - DNA, 25 bp, Rattus norvegicus
atcacagatatcaaggtcatcccct

SEQ ID NO: 178008 - DNA, 25 bp, Rattus norvegicus
atcacagatatctaggtcatcccct

SEQ ID NO: 178009 - DNA, 25 bp, Rattus norvegicus
atcacagatattcccaccttccaga

SEQ ID NO: 178010 - DNA, 25 bp, Rattus norvegicus
atcacagatattgccaccttccaga

SEQ ID NO: 178011 - DNA, 25 bp, Rattus norvegicus
atcacagatcatcgatggctttctt

SEQ ID NO: 178012 - DNA, 25 bp, Rattus norvegicus
atcacagatcatggatggctttctt

SEQ ID NO: 178013 - DNA, 25 bp, Rattus norvegicus
atcacagatctaaaggagcctgaga

SEQ ID NO: 178014 - DNA, 25 bp, Rattus norvegicus
atcacagatctataggagcctgaga

SEQ ID NO: 178015 - DNA, 25 bp, Rattus norvegicus
atcacagatgagaacgccttggcag

SEQ ID NO: 178016 - DNA, 25 bp, Rattus norvegicus
atcacagatgagtacgccttggcag

SEQ ID NO: 178017 - DNA, 25 bp, Rattus norvegicus
atcacagatgtgacttctctcctgg

SEQ ID NO: 178018 - DNA, 25 bp, Rattus norvegicus
atcacagatgtgtcttctctcctgg

SEQ ID NO: 178019 - DNA, 25 bp, Rattus norvegicus
atcacagcacctccacgaaacttga

SEQ ID NO: 178020 - DNA, 25 bp, Rattus norvegicus
atcacagcacctgcacgaaacttga

SEQ ID NO: 178021 - DNA, 25 bp, Rattus norvegicus
atcacagcagaaacaggatctcttt

SEQ ID NO: 178022 - DNA, 25 bp, Rattus norvegicus
atcacagcagaatcaggatctcttt

SEQ ID NO: 178023 - DNA, 25 bp, Rattus norvegicus
atcacagcagagcaagagtgccctt

SEQ ID NO: 178024 - DNA, 25 bp, Rattus norvegicus
atcacagcagaggaagagtgccctt

SEQ ID NO: 178025 - DNA, 25 bp, Rattus norvegicus
atcacagccaagctggtttatccga

SEQ ID NO: 178026 - DNA, 25 bp, Rattus norvegicus
atcacagccaaggtggtttatccga

SEQ ID NO: 178027 - DNA, 25 bp, Rattus norvegicus
atcacagccagaacttttgagtgtc

SEQ ID NO: 178028 - DNA, 25 bp, Rattus norvegicus
atcacagccagatcttttgagtgtc

SEQ ID NO: 178029 - DNA, 25 bp, Rattus norvegicus
atcacagcccgtcgtgaatgatgtc

SEQ ID NO: 178030 - DNA, 25 bp, Rattus norvegicus
atcacagcccgtggtgaatgatgtc

SEQ ID NO: 178031 - DNA, 25 bp, Rattus norvegicus
atcacagcgctcaccaaattatttg

SEQ ID NO: 178032 - DNA, 25 bp, Rattus norvegicus
atcacagcgctctccaaattatttg

SEQ ID NO: 178033 - DNA, 25 bp, Rattus norvegicus
atcacagctaggagccggagagata

SEQ ID NO: 178034 - DNA, 25 bp, Rattus norvegicus
atcacagctaggtgccggagagata

SEQ ID NO: 178035 - DNA, 25 bp, Rattus norvegicus
atcacagctcacctgcaggcagtta

SEQ ID NO: 178036 - DNA, 25 bp, Rattus norvegicus
atcacagctcacgtgcaggcagtta

SEQ ID NO: 178037 - DNA, 25 bp, Rattus norvegicus
atcacagctccaataatggccacag

SEQ ID NO: 178038 - DNA, 25 bp, Rattus norvegicus
atcacagctccattaatggccacag

SEQ ID NO: 178039 - DNA, 25 bp, Rattus norvegicus
atcacagctgccattcatagggttc

SEQ ID NO: 178040 - DNA, 25 bp, Rattus norvegicus
atcacagctgcctttcatagggttc

SEQ ID NO: 178041 - DNA, 25 bp, Rattus norvegicus
atcacagctttgaaaccggcaggtt

SEQ ID NO: 178042 - DNA, 25 bp, Rattus norvegicus
atcacagctttgtaaccggcaggtt

SEQ ID NO: 178043 - DNA, 25 bp, Rattus norvegicus
atcacagcttttatcccatggtatt

SEQ ID NO: 178044 - DNA, 25 bp, Rattus norvegicus
atcacagcttttcgccttgagggaa

SEQ ID NO: 178045 - DNA, 25 bp, Rattus norvegicus
atcacagcttttggccttgagggaa

SEQ ID NO: 178046 - DNA, 25 bp, Rattus norvegicus
atcacagcttttttcccatggtatt

SEQ ID NO: 178047 - DNA, 25 bp, Rattus norvegicus
atcacaggacagcttgatctcgctc

SEQ ID NO: 178048 - DNA, 25 bp, Rattus norvegicus
atcacaggacaggttgatctcgctc

SEQ ID NO: 178049 - DNA, 25 bp, Rattus norvegicus
atcacaggcagactgtcccgggcag

SEQ ID NO: 178050 - DNA, 25 bp, Rattus norvegicus
atcacaggcagagtgtcccgggcag

SEQ ID NO: 178051 - DNA, 25 bp, Rattus norvegicus
atcacaggccaactcaggctgcgga

SEQ ID NO: 178052 - DNA, 25 bp, Rattus norvegicus
atcacaggccaagtcaggctgcgga

SEQ ID NO: 178053 - DNA, 25 bp, Rattus norvegicus
atcacaggcttacgctctgactttg

SEQ ID NO: 178054 - DNA, 25 bp, Rattus norvegicus
atcacaggcttaggctctgactttg

SEQ ID NO: 178055 - DNA, 25 bp, Rattus norvegicus
atcacagggcttcacccaatcctag

SEQ ID NO: 178056 - DNA, 25 bp, Rattus norvegicus
atcacagggcttgacccaatcctag

SEQ ID NO: 178057 - DNA, 25 bp, Rattus norvegicus
atcacaggtgtgagccgtcttagcc

SEQ ID NO: 178058 - DNA, 25 bp, Rattus norvegicus
atcacaggtgtgtgccgtcttagcc

SEQ ID NO: 178059 - DNA, 25 bp, Rattus norvegicus
atcacaggtttcctgttgccagaga

SEQ ID NO: 178060 - DNA, 25 bp, Rattus norvegicus
atcacaggtttcgtgttgccagaga

SEQ ID NO: 178061 - DNA, 25 bp, Rattus norvegicus
atcacaggttttctgaacctcccac

SEQ ID NO: 178062 - DNA, 25 bp, Rattus norvegicus
atcacaggttttgtgaacctcccac

SEQ ID NO: 178063 - DNA, 25 bp, Rattus norvegicus
atcacagtacagacaggcttaagca

SEQ ID NO: 178064 - DNA, 25 bp, Rattus norvegicus
atcacagtacagtcaggcttaagca

SEQ ID NO: 178065 - DNA, 25 bp, Rattus norvegicus
atcacagtatggataagtgtatcaa

SEQ ID NO: 178066 - DNA, 25 bp, Rattus norvegicus
atcacagtatggttaagtgtatcaa

SEQ ID NO: 178067 - DNA, 25 bp, Rattus norvegicus
atcacagtcatcacccatggcaaaa

SEQ ID NO: 178068 - DNA, 25 bp, Rattus norvegicus
atcacagtcatctcccatggcaaaa

SEQ ID NO: 178069 - DNA, 25 bp, Rattus norvegicus
atcacagtctggacatgtgtgcctt

SEQ ID NO: 178070 - DNA, 25 bp, Rattus norvegicus
atcacagtctggattgttctatgaa

SEQ ID NO: 178071 - DNA, 25 bp, Rattus norvegicus
atcacagtctggtcatgtgtgcctt

SEQ ID NO: 178072 - DNA, 25 bp, Rattus norvegicus
atcacagtctggtttgttctatgaa

SEQ ID NO: 178073 - DNA, 25 bp, Rattus norvegicus
atcacagtgaatcgatggcctcttc

SEQ ID NO: 178074 - DNA, 25 bp, Rattus norvegicus
atcacagtgaatggatggcctcttc

SEQ ID NO: 178075 - DNA, 25 bp, Rattus norvegicus
atcacagtgattagtccccgatgac

SEQ ID NO: 178076 - DNA, 25 bp, Rattus norvegicus
atcacagtgatttgtccccgatgac

SEQ ID NO: 178077 - DNA, 25 bp, Rattus norvegicus
atcacagtgcagcaaggccaactct

SEQ ID NO: 178078 - DNA, 25 bp, Rattus norvegicus
atcacagtgcaggaaggccaactct

SEQ ID NO: 178079 - DNA, 25 bp, Rattus norvegicus
atcacagtgcgtcctttgcaagaac

SEQ ID NO: 178080 - DNA, 25 bp, Rattus norvegicus
atcacagtgcgtgctttgcaagaac

SEQ ID NO: 178081 - DNA, 25 bp, Rattus norvegicus
atcacagttagccattggcagttgc

SEQ ID NO: 178082 - DNA, 25 bp, Rattus norvegicus
atcacagttagcgattggcagttgc

SEQ ID NO: 178083 - DNA, 25 bp, Rattus norvegicus
atcacagttcgactttgaccccaat

SEQ ID NO: 178084 - DNA, 25 bp, Rattus norvegicus
atcacagttcgagtttgaccccaat

SEQ ID NO: 178085 - DNA, 25 bp, Rattus norvegicus
atcacagttctcagcggcactggag

SEQ ID NO: 178086 - DNA, 25 bp, Rattus norvegicus
atcacagttctctgcggcactggag

SEQ ID NO: 178087 - DNA, 25 bp, Rattus norvegicus
atcacagttgtgacaaggcatttaa

SEQ ID NO: 178088 - DNA, 25 bp, Rattus norvegicus
atcacagttgtgtcaaggcatttaa

SEQ ID NO: 178089 - DNA, 25 bp, Rattus norvegicus
atcacatagcatcaattctcccagt

SEQ ID NO: 178090 - DNA, 25 bp, Rattus norvegicus
atcacatagcatgaattctcccagt

SEQ ID NO: 178091 - DNA, 25 bp, Rattus norvegicus
atcacatagggtagatcctgggtca

SEQ ID NO: 178092 - DNA, 25 bp, Rattus norvegicus
atcacatagggttgatcctgggtca

SEQ ID NO: 178093 - DNA, 25 bp, Rattus norvegicus
atcacatcatgtcaggcagaggcac

SEQ ID NO: 178094 - DNA, 25 bp, Rattus norvegicus
atcacatcatgtgaggcagaggcac

SEQ ID NO: 178095 - DNA, 25 bp, Rattus norvegicus
atcacatccaggcttaagccactga

SEQ ID NO: 178096 - DNA, 25 bp, Rattus norvegicus
atcacatccagggttaagccactga

SEQ ID NO: 178097 - DNA, 25 bp, Rattus norvegicus
atcacatccgggatcacagtgctaa

SEQ ID NO: 178098 - DNA, 25 bp, Rattus norvegicus
atcacatccgggttcacagtgctaa

SEQ ID NO: 178099 - DNA, 25 bp, Rattus norvegicus
atcacatcctgcctaaagtgtctgg

SEQ ID NO: 178100 - DNA, 25 bp, Rattus norvegicus
atcacatcctgcgtaaagtgtctgg

SEQ ID NO: 178101 - DNA, 25 bp, Rattus norvegicus
atcacatcctgtctcttgtcacata

SEQ ID NO: 178102 - DNA, 25 bp, Rattus norvegicus
atcacatcctgtgtcttgtcacata

SEQ ID NO: 178103 - DNA, 25 bp, Rattus norvegicus
atcacatctcttaagccatttcctc

SEQ ID NO: 178104 - DNA, 25 bp, Rattus norvegicus
atcacatctctttagccatttcctc

SEQ ID NO: 178105 - DNA, 25 bp, Rattus norvegicus
atcacatctgttagatgccatctta

SEQ ID NO: 178106 - DNA, 25 bp, Rattus norvegicus
atcacatctgtttgatgccatctta

SEQ ID NO: 178107 - DNA, 25 bp, Rattus norvegicus
atcacatcttggacgagagggacta

SEQ ID NO: 178108 - DNA, 25 bp, Rattus norvegicus
atcacatcttggtcgagagggacta

SEQ ID NO: 178109 - DNA, 25 bp, Rattus norvegicus
atcacatctttcctgtggcagcaaa

SEQ ID NO: 178110 - DNA, 25 bp, Rattus norvegicus
atcacatctttcgtgtggcagcaaa

SEQ ID NO: 178111 - DNA, 25 bp, Rattus norvegicus
atcacatggagtatcacatcacggt

SEQ ID NO: 178112 - DNA, 25 bp, Rattus norvegicus
atcacatggagtttcacatcacggt

SEQ ID NO: 178113 - DNA, 25 bp, Rattus norvegicus
atcacatggcttaaagatgggcaca

SEQ ID NO: 178114 - DNA, 25 bp, Rattus norvegicus
atcacatggctttaagatgggcaca

SEQ ID NO: 178115 - DNA, 25 bp, Rattus norvegicus
atcacatgtcgcacaggctttggga

SEQ ID NO: 178116 - DNA, 25 bp, Rattus norvegicus
atcacatgtcgctcaggctttggga

SEQ ID NO: 178117 - DNA, 25 bp, Rattus norvegicus
atcacatgtcttcggctgatgccgc

SEQ ID NO: 178118 - DNA, 25 bp, Rattus norvegicus
atcacatgtcttgggctgatgccgc

SEQ ID NO: 178119 - DNA, 25 bp, Rattus norvegicus
atcacatgttgaatctgagtatttg

SEQ ID NO: 178120 - DNA, 25 bp, Rattus norvegicus
atcacatgttgattctgagtatttg

SEQ ID NO: 178121 - DNA, 25 bp, Rattus norvegicus
atcacattccaccaacttcttaaga

SEQ ID NO: 178122 - DNA, 25 bp, Rattus norvegicus
atcacattccacgaacttcttaaga

SEQ ID NO: 178123 - DNA, 25 bp, Rattus norvegicus
atcacattgccacggattaccacgc

SEQ ID NO: 178124 - DNA, 25 bp, Rattus norvegicus
atcacattgccagggattaccacgc

SEQ ID NO: 178125 - DNA, 25 bp, Rattus norvegicus
atcacattggccaaggagctttagt

SEQ ID NO: 178126 - DNA, 25 bp, Rattus norvegicus
atcacattggcctaggagctttagt

SEQ ID NO: 178127 - DNA, 25 bp, Rattus norvegicus
atcacatttactcaaccttctcagt

SEQ ID NO: 178128 - DNA, 25 bp, Rattus norvegicus
atcacatttactgaaccttctcagt

SEQ ID NO: 178129 - DNA, 25 bp, Rattus norvegicus
atcaccaacgctcagggaaacactt

SEQ ID NO: 178130 - DNA, 25 bp, Rattus norvegicus
atcaccaacgctgagggaaacactt

SEQ ID NO: 178131 - DNA, 25 bp, Rattus norvegicus
atcaccaagccccagttacagaaca

SEQ ID NO: 178132 - DNA, 25 bp, Rattus norvegicus
atcaccaagcccgagttacagaaca

SEQ ID NO: 178133 - DNA, 25 bp, Rattus norvegicus
atcaccacacagagcgcgggcggag

SEQ ID NO: 178134 - DNA, 25 bp, Rattus norvegicus
atcaccacacagtgcgcgggcggag

SEQ ID NO: 178135 - DNA, 25 bp, Rattus norvegicus
atcaccacacgcacttatcaggaac

SEQ ID NO: 178136 - DNA, 25 bp, Rattus norvegicus
atcaccacacgctcttatcaggaac

SEQ ID NO: 178137 - DNA, 25 bp, Rattus norvegicus
atcaccacattgacagctgcagtgt

SEQ ID NO: 178138 - DNA, 25 bp, Rattus norvegicus
atcaccacattgtcagctgcagtgt

SEQ ID NO: 178139 - DNA, 25 bp, Rattus norvegicus
atcaccacccttccgttttagggat

SEQ ID NO: 178140 - DNA, 25 bp, Rattus norvegicus
atcaccacccttgcgttttagggat

SEQ ID NO: 178141 - DNA, 25 bp, Rattus norvegicus
atcaccaccgcacttatttgcttgg

SEQ ID NO: 178142 - DNA, 25 bp, Rattus norvegicus
atcaccaccgcagttatttgcttgg

SEQ ID NO: 178143 - DNA, 25 bp, Rattus norvegicus
atcaccacgtatctgttttgcacat

SEQ ID NO: 178144 - DNA, 25 bp, Rattus norvegicus
atcaccacgtatgtgttttgcacat

SEQ ID NO: 178145 - DNA, 25 bp, Rattus norvegicus
atcaccactaatatcttagtttcag

SEQ ID NO: 178146 - DNA, 25 bp, Rattus norvegicus
atcaccactaatttcttagtttcag

SEQ ID NO: 178147 - DNA, 25 bp, Rattus norvegicus
atcaccactaccaaccgtcgatgta

SEQ ID NO: 178148 - DNA, 25 bp, Rattus norvegicus
atcaccactacctaccgtcgatgta

SEQ ID NO: 178149 - DNA, 25 bp, Rattus norvegicus
atcaccactcctcggaatgtagcta

SEQ ID NO: 178150 - DNA, 25 bp, Rattus norvegicus
atcaccactcctgggaatgtagcta

SEQ ID NO: 178151 - DNA, 25 bp, Rattus norvegicus
atcaccactcttcgcaggtaaagta

SEQ ID NO: 178152 - DNA, 25 bp, Rattus norvegicus
atcaccactcttggcaggtaaagta

SEQ ID NO: 178153 - DNA, 25 bp, Rattus norvegicus
atcaccactgtcacgttgacccggg

SEQ ID NO: 178154 - DNA, 25 bp, Rattus norvegicus
atcaccactgtctcgttgacccggg

SEQ ID NO: 178155 - DNA, 25 bp, Rattus norvegicus
atcaccacttttcgcctctgtttta

SEQ ID NO: 178156 - DNA, 25 bp, Rattus norvegicus
atcaccacttttggcctctgtttta

SEQ ID NO: 178157 - DNA, 25 bp, Rattus norvegicus
atcaccagacctatttcacctgtga

SEQ ID NO: 178158 - DNA, 25 bp, Rattus norvegicus
atcaccagacctttttcacctgtga

SEQ ID NO: 178159 - DNA, 25 bp, Rattus norvegicus
atcaccagctggatgatttgggcgt

SEQ ID NO: 178160 - DNA, 25 bp, Rattus norvegicus
atcaccagctggttgatttgggcgt

SEQ ID NO: 178161 - DNA, 25 bp, Rattus norvegicus
atcaccaggatcctccaaatatctt

SEQ ID NO: 178162 - DNA, 25 bp, Rattus norvegicus
atcaccaggatcgtccaaatatctt

SEQ ID NO: 178163 - DNA, 25 bp, Rattus norvegicus
atcaccagggaccatctgagggcaa

SEQ ID NO: 178164 - DNA, 25 bp, Rattus norvegicus
atcaccagggacgatctgagggcaa

SEQ ID NO: 178165 - DNA, 25 bp, Rattus norvegicus
atcaccaggttgaggagcgtgcgca

SEQ ID NO: 178166 - DNA, 25 bp, Rattus norvegicus
atcaccaggttgtggagcgtgcgca

SEQ ID NO: 178167 - DNA, 25 bp, Rattus norvegicus
atcaccagtgaaatgctttgtaaag

SEQ ID NO: 178168 - DNA, 25 bp, Rattus norvegicus
atcaccagtgaattgctttgtaaag

SEQ ID NO: 178169 - DNA, 25 bp, Rattus norvegicus
atcaccagtggcatgagtgttctgc

SEQ ID NO: 178170 - DNA, 25 bp, Rattus norvegicus
atcaccagtggcttgagtgttctgc

SEQ ID NO: 178171 - DNA, 25 bp, Rattus norvegicus
atcaccagtttcctgctggaggtgt

SEQ ID NO: 178172 - DNA, 25 bp, Rattus norvegicus
atcaccagtttcgtgctggaggtgt

SEQ ID NO: 178173 - DNA, 25 bp, Rattus norvegicus
atcaccatcaccaacaacattggct

SEQ ID NO: 178174 - DNA, 25 bp, Rattus norvegicus
atcaccatcaccactgtctcgttga

SEQ ID NO: 178175 - DNA, 25 bp, Rattus norvegicus
atcaccatcacctacaacattggct

SEQ ID NO: 178176 - DNA, 25 bp, Rattus norvegicus
atcaccatcacctctgtctcgttga

SEQ ID NO: 178177 - DNA, 25 bp, Rattus norvegicus
atcaccatcttccaggagcgagatc

SEQ ID NO: 178178 - DNA, 25 bp, Rattus norvegicus
atcaccatcttcgaggagcgagatc

SEQ ID NO: 178179 - DNA, 25 bp, Rattus norvegicus
atcaccatggagatggactcattcc

SEQ ID NO: 178180 - DNA, 25 bp, Rattus norvegicus
atcaccatggagattaggcttgcag

SEQ ID NO: 178181 - DNA, 25 bp, Rattus norvegicus
atcaccatggagttggactcattcc

SEQ ID NO: 178182 - DNA, 25 bp, Rattus norvegicus
atcaccatggagtttaggcttgcag

SEQ ID NO: 178183 - DNA, 25 bp, Rattus norvegicus
atcaccattgggaccatcggactgc

SEQ ID NO: 178184 - DNA, 25 bp, Rattus norvegicus
atcaccattgggtccatcggactgc

SEQ ID NO: 178185 - DNA, 25 bp, Rattus norvegicus
atcacccaaatcctttactgaatcc

SEQ ID NO: 178186 - DNA, 25 bp, Rattus norvegicus
atcacccaaatcgtttactgaatcc

SEQ ID NO: 178187 - DNA, 25 bp, Rattus norvegicus
atcacccactctagaattgcatctg

SEQ ID NO: 178188 - DNA, 25 bp, Rattus norvegicus
atcacccactcttgaattgcatctg

SEQ ID NO: 178189 - DNA, 25 bp, Rattus norvegicus
atcacccatcctcaattttgtttta

SEQ ID NO: 178190 - DNA, 25 bp, Rattus norvegicus
atcacccatcctgaattttgtttta

SEQ ID NO: 178191 - DNA, 25 bp, Rattus norvegicus
atcacccatcgtctgtcagctgtgt

SEQ ID NO: 178192 - DNA, 25 bp, Rattus norvegicus
atcacccatcgtgtgtcagctgtgt

SEQ ID NO: 178193 - DNA, 25 bp, Rattus norvegicus
atcacccatgtgaacgataccagga

SEQ ID NO: 178194 - DNA, 25 bp, Rattus norvegicus
atcacccatgtgaggcaccaacata

SEQ ID NO: 178195 - DNA, 25 bp, Rattus norvegicus
atcacccatgtgtacgataccagga

SEQ ID NO: 178196 - DNA, 25 bp, Rattus norvegicus
atcacccatgtgtggcaccaacata

SEQ ID NO: 178197 - DNA, 25 bp, Rattus norvegicus
atcacccattttacaatacaccatc

SEQ ID NO: 178198 - DNA, 25 bp, Rattus norvegicus
atcacccatttttcaatacaccatc

SEQ ID NO: 178199 - DNA, 25 bp, Rattus norvegicus
atcaccccagagattcttccacggt

SEQ ID NO: 178200 - DNA, 25 bp, Rattus norvegicus
atcaccccagagtttcttccacggt

SEQ ID NO: 178201 - DNA, 25 bp, Rattus norvegicus
atcaccccagttcccgaagaagcta

SEQ ID NO: 178202 - DNA, 25 bp, Rattus norvegicus
atcaccccagttgccgaagaagcta

SEQ ID NO: 178203 - DNA, 25 bp, Rattus norvegicus
atcacccccttaatgctttagagag

SEQ ID NO: 178204 - DNA, 25 bp, Rattus norvegicus
atcacccccttattgctttagagag

SEQ ID NO: 178205 - DNA, 25 bp, Rattus norvegicus
atcacccctggcaggaggcaggaca

SEQ ID NO: 178206 - DNA, 25 bp, Rattus norvegicus
atcacccctggctggaggcaggaca

SEQ ID NO: 178207 - DNA, 25 bp, Rattus norvegicus
atcaccccttctaactatacaactt

SEQ ID NO: 178208 - DNA, 25 bp, Rattus norvegicus
atcaccccttcttactatacaactt

SEQ ID NO: 178209 - DNA, 25 bp, Rattus norvegicus
atcacccgcacaatttattaccagg

SEQ ID NO: 178210 - DNA, 25 bp, Rattus norvegicus
atcacccgcacattttattaccagg

SEQ ID NO: 178211 - DNA, 25 bp, Rattus norvegicus
atcacccgggttcctgagagatgct

SEQ ID NO: 178212 - DNA, 25 bp, Rattus norvegicus
atcacccgggttgctgagagatgct

SEQ ID NO: 178213 - DNA, 25 bp, Rattus norvegicus
atcaccctaaatatccagattctgg

SEQ ID NO: 178214 - DNA, 25 bp, Rattus norvegicus
atcaccctaaatttccagattctgg

SEQ ID NO: 178215 - DNA, 25 bp, Rattus norvegicus
atcaccctctgtattaactcatact

SEQ ID NO: 178216 - DNA, 25 bp, Rattus norvegicus
atcaccctctgttttaactcatact

SEQ ID NO: 178217 - DNA, 25 bp, Rattus norvegicus
atcaccctgagacccggagtagtat

SEQ ID NO: 178218 - DNA, 25 bp, Rattus norvegicus
atcaccctgagagccggagtagtat

SEQ ID NO: 178219 - DNA, 25 bp, Rattus norvegicus
atcaccctgccccaaaagttttgag

SEQ ID NO: 178220 - DNA, 25 bp, Rattus norvegicus
atcaccctgcccgaaaagttttgag

SEQ ID NO: 178221 - DNA, 25 bp, Rattus norvegicus
atcaccctgggccaaggaattacca

SEQ ID NO: 178222 - DNA, 25 bp, Rattus norvegicus
atcaccctgggcgaaggaattacca

SEQ ID NO: 178223 - DNA, 25 bp, Rattus norvegicus
atcaccctgtgtaagggttcccaat

SEQ ID NO: 178224 - DNA, 25 bp, Rattus norvegicus
atcaccctgtgtaccagcaagattc

SEQ ID NO: 178225 - DNA, 25 bp, Rattus norvegicus
atcaccctgtgttagggttcccaat

SEQ ID NO: 178226 - DNA, 25 bp, Rattus norvegicus
atcaccctgtgttccagcaagattc

SEQ ID NO: 178227 - DNA, 25 bp, Rattus norvegicus
atcacccttccaccatagagctagg

SEQ ID NO: 178228 - DNA, 25 bp, Rattus norvegicus
atcacccttccagcatagagctagg

SEQ ID NO: 178229 - DNA, 25 bp, Rattus norvegicus
atcacccttggacagcagcagtcac

SEQ ID NO: 178230 - DNA, 25 bp, Rattus norvegicus
atcacccttggagagcagcagtcac

SEQ ID NO: 178231 - DNA, 25 bp, Rattus norvegicus
atcaccgacccaagttttacagatg

SEQ ID NO: 178232 - DNA, 25 bp, Rattus norvegicus
atcaccgacccatgttttacagatg

SEQ ID NO: 178233 - DNA, 25 bp, Rattus norvegicus
atcaccgacgtgcatgcggacaaca

SEQ ID NO: 178234 - DNA, 25 bp, Rattus norvegicus
atcaccgacgtggatgcggacaaca

SEQ ID NO: 178235 - DNA, 25 bp, Rattus norvegicus
atcaccgatgggactaaccaggcat

SEQ ID NO: 178236 - DNA, 25 bp, Rattus norvegicus
atcaccgatgggtctaaccaggcat

SEQ ID NO: 178237 - DNA, 25 bp, Rattus norvegicus
atcaccgctggtatgacgtcatctt

SEQ ID NO: 178238 - DNA, 25 bp, Rattus norvegicus
atcaccgctggtttgacgtcatctt

SEQ ID NO: 178239 - DNA, 25 bp, Rattus norvegicus
atcaccggacagaccagatctgact

SEQ ID NO: 178240 - DNA, 25 bp, Rattus norvegicus
atcaccggacagtccagatctgact

SEQ ID NO: 178241 - DNA, 25 bp, Rattus norvegicus
atcaccgggataattcagaagcaca

SEQ ID NO: 178242 - DNA, 25 bp, Rattus norvegicus
atcaccgggatatttcagaagcaca

SEQ ID NO: 178243 - DNA, 25 bp, Rattus norvegicus
atcaccgggctgatgcccgccgagt

SEQ ID NO: 178244 - DNA, 25 bp, Rattus norvegicus
atcaccgggctgttgcccgccgagt

SEQ ID NO: 178245 - DNA, 25 bp, Rattus norvegicus
atcaccgggcttatggatacgtttg

SEQ ID NO: 178246 - DNA, 25 bp, Rattus norvegicus
atcaccgggcttttggatacgtttg

SEQ ID NO: 178247 - DNA, 25 bp, Rattus norvegicus
atcaccggtctacttccaatgagca

SEQ ID NO: 178248 - DNA, 25 bp, Rattus norvegicus
atcaccggtctagttccaatgagca

SEQ ID NO: 178249 - DNA, 25 bp, Rattus norvegicus
atcaccggtgtgctcgaacagacaa

SEQ ID NO: 178250 - DNA, 25 bp, Rattus norvegicus
atcaccggtgtggtcgaacagacaa

SEQ ID NO: 178251 - DNA, 25 bp, Rattus norvegicus
atcaccgtagaacagtctcctattc

SEQ ID NO: 178252 - DNA, 25 bp, Rattus norvegicus
atcaccgtagaagagtctcctattc

SEQ ID NO: 178253 - DNA, 25 bp, Rattus norvegicus
atcaccgtcttacagtttcagggca

SEQ ID NO: 178254 - DNA, 25 bp, Rattus norvegicus
atcaccgtcttagagtttcagggca

SEQ ID NO: 178255 - DNA, 25 bp, Rattus norvegicus
atcaccgtgagtagtcttttaccat

SEQ ID NO: 178256 - DNA, 25 bp, Rattus norvegicus
atcaccgtgagttgtcttttaccat

SEQ ID NO: 178257 - DNA, 25 bp, Rattus norvegicus
atcaccgtggtgctgaacaggactg

SEQ ID NO: 178258 - DNA, 25 bp, Rattus norvegicus
atcaccgtggtggtgaacaggactg

SEQ ID NO: 178259 - DNA, 25 bp, Rattus norvegicus
atcaccgttaccagtggctctgtgt

SEQ ID NO: 178260 - DNA, 25 bp, Rattus norvegicus
atcaccgttacctgtggctctgtgt

SEQ ID NO: 178261 - DNA, 25 bp, Rattus norvegicus
atcacctacatcaacgcacatggag

SEQ ID NO: 178262 - DNA, 25 bp, Rattus norvegicus
atcacctacatctacgcacatggag

SEQ ID NO: 178263 - DNA, 25 bp, Rattus norvegicus
atcacctaccgtcgaactggagcac

SEQ ID NO: 178264 - DNA, 25 bp, Rattus norvegicus
atcacctaccgtggaactggagcac

SEQ ID NO: 178265 - DNA, 25 bp, Rattus norvegicus
atcacctacttgacgaaggcctacg

SEQ ID NO: 178266 - DNA, 25 bp, Rattus norvegicus
atcacctacttgtcgaaggcctacg

SEQ ID NO: 178267 - DNA, 25 bp, Rattus norvegicus
atcacctatggcctcagtcagctgt

SEQ ID NO: 178268 - DNA, 25 bp, Rattus norvegicus
atcacctatggcgtcagtcagctgt

SEQ ID NO: 178269 - DNA, 25 bp, Rattus norvegicus
atcacctcaaggaggctgggcgtac

SEQ ID NO: 178270 - DNA, 25 bp, Rattus norvegicus
atcacctcaaggtggctgggcgtac

SEQ ID NO: 178271 - DNA, 25 bp, Rattus norvegicus
atcacctcacagacagggcttacaa

SEQ ID NO: 178272 - DNA, 25 bp, Rattus norvegicus
atcacctcacagtcagggcttacaa

SEQ ID NO: 178273 - DNA, 25 bp, Rattus norvegicus
atcacctccatactcatagctgtat

SEQ ID NO: 178274 - DNA, 25 bp, Rattus norvegicus
atcacctccatagtcatagctgtat

SEQ ID NO: 178275 - DNA, 25 bp, Rattus norvegicus
atcacctccggaatgacttcagatc

SEQ ID NO: 178276 - DNA, 25 bp, Rattus norvegicus
atcacctccggattgacttcagatc

SEQ ID NO: 178277 - DNA, 25 bp, Rattus norvegicus
atcacctccttcagtggtcatcgga

SEQ ID NO: 178278 - DNA, 25 bp, Rattus norvegicus
atcacctccttctgtggtcatcgga

SEQ ID NO: 178279 - DNA, 25 bp, Rattus norvegicus
atcacctcctttcttcatttcaggg

SEQ ID NO: 178280 - DNA, 25 bp, Rattus norvegicus
atcacctcctttgttcatttcaggg

SEQ ID NO: 178281 - DNA, 25 bp, Rattus norvegicus
atcacctcgggcctaagaatacatt

SEQ ID NO: 178282 - DNA, 25 bp, Rattus norvegicus
atcacctcgggcgtaagaatacatt

SEQ ID NO: 178283 - DNA, 25 bp, Rattus norvegicus
atcacctcggtgcagtcgatgcggt

SEQ ID NO: 178284 - DNA, 25 bp, Rattus norvegicus
atcacctcggtggagtcgatgcggt

SEQ ID NO: 178285 - DNA, 25 bp, Rattus norvegicus
atcacctcggttcagttttcagttt

SEQ ID NO: 178286 - DNA, 25 bp, Rattus norvegicus
atcacctcggttgagttttcagttt

SEQ ID NO: 178287 - DNA, 25 bp, Rattus norvegicus
atcacctctctactgggcacctgaa

SEQ ID NO: 178288 - DNA, 25 bp, Rattus norvegicus
atcacctctctagtgggcacctgaa

SEQ ID NO: 178289 - DNA, 25 bp, Rattus norvegicus
atcacctctgacaggatcattggac

SEQ ID NO: 178290 - DNA, 25 bp, Rattus norvegicus
atcacctctgactggatcattggac

SEQ ID NO: 178291 - DNA, 25 bp, Rattus norvegicus
atcacctctgctaacgttattttca

SEQ ID NO: 178292 - DNA, 25 bp, Rattus norvegicus
atcacctctgcttacgttattttca

SEQ ID NO: 178293 - DNA, 25 bp, Rattus norvegicus
atcacctctggcactacgcaaaatg

SEQ ID NO: 178294 - DNA, 25 bp, Rattus norvegicus
atcacctctggctctacgcaaaatg

SEQ ID NO: 178295 - DNA, 25 bp, Rattus norvegicus
atcacctctgtcactcagtgctgta

SEQ ID NO: 178296 - DNA, 25 bp, Rattus norvegicus
atcacctctgtctctcagtgctgta

SEQ ID NO: 178297 - DNA, 25 bp, Rattus norvegicus
atcacctgagctaggtttttctctt

SEQ ID NO: 178298 - DNA, 25 bp, Rattus norvegicus
atcacctgagcttggtttttctctt

SEQ ID NO: 178299 - DNA, 25 bp, Rattus norvegicus
atcacctgcctgcttatgacttggg

SEQ ID NO: 178300 - DNA, 25 bp, Rattus norvegicus
atcacctgcctggttatgacttggg

SEQ ID NO: 178301 - DNA, 25 bp, Rattus norvegicus
atcacctgcttcatgtggcacataa

SEQ ID NO: 178302 - DNA, 25 bp, Rattus norvegicus
atcacctgcttcttgtggcacataa

SEQ ID NO: 178303 - DNA, 25 bp, Rattus norvegicus
atcacctggaatcgacctgttggca

SEQ ID NO: 178304 - DNA, 25 bp, Rattus norvegicus
atcacctggaatggacctgttggca

SEQ ID NO: 178305 - DNA, 25 bp, Rattus norvegicus
atcacctggaccagaactatcaagc

SEQ ID NO: 178306 - DNA, 25 bp, Rattus norvegicus
atcacctggacctgaactatcaagc

SEQ ID NO: 178307 - DNA, 25 bp, Rattus norvegicus
atcacctgggctctagtcacttgta

SEQ ID NO: 178308 - DNA, 25 bp, Rattus norvegicus
atcacctgggctgtagtcacttgta

SEQ ID NO: 178309 - DNA, 25 bp, Rattus norvegicus
atcacctgggtgacagctggtcttg

SEQ ID NO: 178310 - DNA, 25 bp, Rattus norvegicus
atcacctgggtgtcagctggtcttg

SEQ ID NO: 178311 - DNA, 25 bp, Rattus norvegicus
atcacctgtctgcactcactggttt

SEQ ID NO: 178312 - DNA, 25 bp, Rattus norvegicus
atcacctgtctggactcactggttt

SEQ ID NO: 178313 - DNA, 25 bp, Rattus norvegicus
atcacctgtggccaaaggagtgcac

SEQ ID NO: 178314 - DNA, 25 bp, Rattus norvegicus
atcacctgtggcgaaaggagtgcac

SEQ ID NO: 178315 - DNA, 25 bp, Rattus norvegicus
atcacctgtgtaccactgaagtcag

SEQ ID NO: 178316 - DNA, 25 bp, Rattus norvegicus
atcacctgtgtagcactgaagtcag

SEQ ID NO: 178317 - DNA, 25 bp, Rattus norvegicus
atcaccttatacatcacttcctgtt

SEQ ID NO: 178318 - DNA, 25 bp, Rattus norvegicus
atcaccttatacttcacttcctgtt

SEQ ID NO: 178319 - DNA, 25 bp, Rattus norvegicus
atcaccttcgctctctatggcaatg

SEQ ID NO: 178320 - DNA, 25 bp, Rattus norvegicus
atcaccttcgctgtctatggcaatg

SEQ ID NO: 178321 - DNA, 25 bp, Rattus norvegicus
atcaccttcgggaacctcaatggtt

SEQ ID NO: 178322 - DNA, 25 bp, Rattus norvegicus
atcaccttcgggtacctcaatggtt

SEQ ID NO: 178323 - DNA, 25 bp, Rattus norvegicus
atcaccttctccatgcaagatggtc

SEQ ID NO: 178324 - DNA, 25 bp, Rattus norvegicus
atcaccttctccttgcaagatggtc

SEQ ID NO: 178325 - DNA, 25 bp, Rattus norvegicus
atcaccttcttgagtcgtttactaa

SEQ ID NO: 178326 - DNA, 25 bp, Rattus norvegicus
atcaccttcttgtgtcgtttactaa

SEQ ID NO: 178327 - DNA, 25 bp, Rattus norvegicus
atcaccttgcttaggtttatctaga

SEQ ID NO: 178328 - DNA, 25 bp, Rattus norvegicus
atcaccttgctttggtttatctaga

SEQ ID NO: 178329 - DNA, 25 bp, Rattus norvegicus
atcaccttggtaagcctgggcaaca

SEQ ID NO: 178330 - DNA, 25 bp, Rattus norvegicus
atcaccttggtatgcctgggcaaca

SEQ ID NO: 178331 - DNA, 25 bp, Rattus norvegicus
atcaccttgtgaacactcactttga

SEQ ID NO: 178332 - DNA, 25 bp, Rattus norvegicus
atcaccttgtgatcactcactttga

SEQ ID NO: 178333 - DNA, 25 bp, Rattus norvegicus
atcacctttccaagtccgagctgga

SEQ ID NO: 178334 - DNA, 25 bp, Rattus norvegicus
atcacctttccatgtccgagctgga

SEQ ID NO: 178335 - DNA, 25 bp, Rattus norvegicus
atcacctttctacattcatttggag

SEQ ID NO: 178336 - DNA, 25 bp, Rattus norvegicus
atcacctttctagattcatttggag

SEQ ID NO: 178337 - DNA, 25 bp, Rattus norvegicus
atcacctttgaccaggctgacctga

SEQ ID NO: 178338 - DNA, 25 bp, Rattus norvegicus
atcacctttgacgaggctgacctga

SEQ ID NO: 178339 - DNA, 25 bp, Rattus norvegicus
atcacctttgctcggctctcactgt

SEQ ID NO: 178340 - DNA, 25 bp, Rattus norvegicus
atcacctttgctgggctctcactgt

SEQ ID NO: 178341 - DNA, 25 bp, Rattus norvegicus
atcaccttttcgagtgaaagcgcac

SEQ ID NO: 178342 - DNA, 25 bp, Rattus norvegicus
atcaccttttcgtgtgaaagcgcac

SEQ ID NO: 178343 - DNA, 25 bp, Rattus norvegicus
atcacctttttcagttgatgccgac

SEQ ID NO: 178344 - DNA, 25 bp, Rattus norvegicus
atcacctttttctgttgatgccgac

SEQ ID NO: 178345 - DNA, 25 bp, Rattus norvegicus
atcacgaccagtacaaggatggcca

SEQ ID NO: 178346 - DNA, 25 bp, Rattus norvegicus
atcacgaccagttcaaggatggcca

SEQ ID NO: 178347 - DNA, 25 bp, Rattus norvegicus
atcacgacggtgatagcttctccac

SEQ ID NO: 178348 - DNA, 25 bp, Rattus norvegicus
atcacgacggtgttagcttctccac

SEQ ID NO: 178349 - DNA, 25 bp, Rattus norvegicus
atcacgactcctccttagggtggag

SEQ ID NO: 178350 - DNA, 25 bp, Rattus norvegicus
atcacgactcctgcttagggtggag

SEQ ID NO: 178351 - DNA, 25 bp, Rattus norvegicus
atcacgatcactattcttactttcc

SEQ ID NO: 178352 - DNA, 25 bp, Rattus norvegicus
atcacgatcacttttcttactttcc

SEQ ID NO: 178353 - DNA, 25 bp, Rattus norvegicus
atcacgatcatcacgagactctgca

SEQ ID NO: 178354 - DNA, 25 bp, Rattus norvegicus
atcacgatcatctcgagactctgca

SEQ ID NO: 178355 - DNA, 25 bp, Rattus norvegicus
atcacgcagcgcctgcagtgccagg

SEQ ID NO: 178356 - DNA, 25 bp, Rattus norvegicus
atcacgcagcgcgtgcagtgccagg

SEQ ID NO: 178357 - DNA, 25 bp, Rattus norvegicus
atcacgcagggcaacccaagtctct

SEQ ID NO: 178358 - DNA, 25 bp, Rattus norvegicus
atcacgcagggctacccaagtctct

SEQ ID NO: 178359 - DNA, 25 bp, Rattus norvegicus
atcacgcattgcatcacggttttac

SEQ ID NO: 178360 - DNA, 25 bp, Rattus norvegicus
atcacgcattgcttcacggttttac

SEQ ID NO: 178361 - DNA, 25 bp, Rattus norvegicus
atcacgccgggaagccagagacctg

SEQ ID NO: 178362 - DNA, 25 bp, Rattus norvegicus
atcacgccgggatgccagagacctg

SEQ ID NO: 178363 - DNA, 25 bp, Rattus norvegicus
atcacgcctgtcatttctcatcttc

SEQ ID NO: 178364 - DNA, 25 bp, Rattus norvegicus
atcacgcctgtcttttctcatcttc

SEQ ID NO: 178365 - DNA, 25 bp, Rattus norvegicus
atcacgcgcagtcagcgctacgtgt

SEQ ID NO: 178366 - DNA, 25 bp, Rattus norvegicus
atcacgcgcagtgagcgctacgtgt

SEQ ID NO: 178367 - DNA, 25 bp, Rattus norvegicus
atcacgctaatcatctccctagaac

SEQ ID NO: 178368 - DNA, 25 bp, Rattus norvegicus
atcacgctaatcttctccctagaac

SEQ ID NO: 178369 - DNA, 25 bp, Rattus norvegicus
atcacgctcagtaccatgacacaag

SEQ ID NO: 178370 - DNA, 25 bp, Rattus norvegicus
atcacgctcagttccatgacacaag

SEQ ID NO: 178371 - DNA, 25 bp, Rattus norvegicus
atcacgctcttacaaacgccatgtc

SEQ ID NO: 178372 - DNA, 25 bp, Rattus norvegicus
atcacgctcttagaaacgccatgtc

SEQ ID NO: 178373 - DNA, 25 bp, Rattus norvegicus
atcacgctgcaccacgtctatgaga

SEQ ID NO: 178374 - DNA, 25 bp, Rattus norvegicus
atcacgctgcacgacgtctatgaga

SEQ ID NO: 178375 - DNA, 25 bp, Rattus norvegicus
atcacgctgctcaaggctggagggc

SEQ ID NO: 178376 - DNA, 25 bp, Rattus norvegicus
atcacgctgctctaggctggagggc

SEQ ID NO: 178377 - DNA, 25 bp, Rattus norvegicus
atcacgctggagctccatggagatc

SEQ ID NO: 178378 - DNA, 25 bp, Rattus norvegicus
atcacgctggaggtccatggagatc

SEQ ID NO: 178379 - DNA, 25 bp, Rattus norvegicus
atcacgctggccatggaacacacta

SEQ ID NO: 178380 - DNA, 25 bp, Rattus norvegicus
atcacgctggccttggaacacacta

SEQ ID NO: 178381 - DNA, 25 bp, Rattus norvegicus
atcacgctgtggattgatgatgcgc

SEQ ID NO: 178382 - DNA, 25 bp, Rattus norvegicus
atcacgctgtggtttgatgatgcgc

SEQ ID NO: 178383 - DNA, 25 bp, Rattus norvegicus
atcacggacatcctgagcgctgagg

SEQ ID NO: 178384 - DNA, 25 bp, Rattus norvegicus
atcacggacatcgtgagcgctgagg

SEQ ID NO: 178385 - DNA, 25 bp, Rattus norvegicus
atcacggacgctcacaaaatcgaag

SEQ ID NO: 178386 - DNA, 25 bp, Rattus norvegicus
atcacggacgctgacaaaatcgaag

SEQ ID NO: 178387 - DNA, 25 bp, Rattus norvegicus
atcacggacgtgatggctgtgtcca

SEQ ID NO: 178388 - DNA, 25 bp, Rattus norvegicus
atcacggacgtgttggctgtgtcca

SEQ ID NO: 178389 - DNA, 25 bp, Rattus norvegicus
atcacggataggcatgccacccaga

SEQ ID NO: 178390 - DNA, 25 bp, Rattus norvegicus
atcacggatagggatgccacccaga

SEQ ID NO: 178391 - DNA, 25 bp, Rattus norvegicus
atcacggcaatcatacaacttggag

SEQ ID NO: 178392 - DNA, 25 bp, Rattus norvegicus
atcacggcaatcttacaacttggag

SEQ ID NO: 178393 - DNA, 25 bp, Rattus norvegicus
atcacggcaatgcatcgggtctatt

SEQ ID NO: 178394 - DNA, 25 bp, Rattus norvegicus
atcacggcaatggatcgggtctatt

SEQ ID NO: 178395 - DNA, 25 bp, Rattus norvegicus
atcacggccatcattgttgtaacca

SEQ ID NO: 178396 - DNA, 25 bp, Rattus norvegicus
atcacggccatctttgttgtaacca

SEQ ID NO: 178397 - DNA, 25 bp, Rattus norvegicus
atcacggcctctctccgctttgatg

SEQ ID NO: 178398 - DNA, 25 bp, Rattus norvegicus
atcacggcctctgtccgctttgatg

SEQ ID NO: 178399 - DNA, 25 bp, Rattus norvegicus
atcacgggcaccacgcagaactgga

SEQ ID NO: 178400 - DNA, 25 bp, Rattus norvegicus
atcacgggcacctcgcagaactgga

SEQ ID NO: 178401 - DNA, 25 bp, Rattus norvegicus
atcacggtgctgaccatgtacttca

SEQ ID NO: 178402 - DNA, 25 bp, Rattus norvegicus
atcacggtgctgtccatgtacttca

SEQ ID NO: 178403 - DNA, 25 bp, Rattus norvegicus
atcacggtggaaatgcagcggacca

SEQ ID NO: 178404 - DNA, 25 bp, Rattus norvegicus
atcacggtggaattgcagcggacca

SEQ ID NO: 178405 - DNA, 25 bp, Rattus norvegicus
atcacggttaagcatttctcaaaat

SEQ ID NO: 178406 - DNA, 25 bp, Rattus norvegicus
atcacggttaaggatttctcaaaat

SEQ ID NO: 178407 - DNA, 25 bp, Rattus norvegicus
atcacggttcagctcggtgacatgg

SEQ ID NO: 178408 - DNA, 25 bp, Rattus norvegicus
atcacggttcaggtcggtgacatgg

SEQ ID NO: 178409 - DNA, 25 bp, Rattus norvegicus
atcacgtagagcacgagggcttcta

SEQ ID NO: 178410 - DNA, 25 bp, Rattus norvegicus
atcacgtagagctcgagggcttcta

SEQ ID NO: 178411 - DNA, 25 bp, Rattus norvegicus
atcacgtagctcctgctggtgagag

SEQ ID NO: 178412 - DNA, 25 bp, Rattus norvegicus
atcacgtagctcgtgctggtgagag

SEQ ID NO: 178413 - DNA, 25 bp, Rattus norvegicus
atcacgtaggcacctcttagaccag

SEQ ID NO: 178414 - DNA, 25 bp, Rattus norvegicus
atcacgtaggcagctcttagaccag

SEQ ID NO: 178415 - DNA, 25 bp, Rattus norvegicus
atcacgtatgtgcaagcctctggaa

SEQ ID NO: 178416 - DNA, 25 bp, Rattus norvegicus
atcacgtatgtggaagcctctggaa

SEQ ID NO: 178417 - DNA, 25 bp, Rattus norvegicus
atcacgtcatagctaccagtacaag

SEQ ID NO: 178418 - DNA, 25 bp, Rattus norvegicus
atcacgtcataggtaccagtacaag

SEQ ID NO: 178419 - DNA, 25 bp, Rattus norvegicus
atcacgtctcgtcaatactaacaaa

SEQ ID NO: 178420 - DNA, 25 bp, Rattus norvegicus
atcacgtctcgtgaatactaacaaa

SEQ ID NO: 178421 - DNA, 25 bp, Rattus norvegicus
atcacgtctgcaacgaggtggacaa

SEQ ID NO: 178422 - DNA, 25 bp, Rattus norvegicus
atcacgtctgcatcgaggtggacaa

SEQ ID NO: 178423 - DNA, 25 bp, Rattus norvegicus
atcacgtgacaacactgcctgcagg

SEQ ID NO: 178424 - DNA, 25 bp, Rattus norvegicus
atcacgtgacaagactgcctgcagg

SEQ ID NO: 178425 - DNA, 25 bp, Rattus norvegicus
atcacgtgatggagtaggatagtac

SEQ ID NO: 178426 - DNA, 25 bp, Rattus norvegicus
atcacgtgatggtgtaggatagtac

SEQ ID NO: 178427 - DNA, 25 bp, Rattus norvegicus
atcacgtgctttaacctgttgagcc

SEQ ID NO: 178428 - DNA, 25 bp, Rattus norvegicus
atcacgtgcttttacctgttgagcc

SEQ ID NO: 178429 - DNA, 25 bp, Rattus norvegicus
atcacgtgtgagagcctgatgccct

SEQ ID NO: 178430 - DNA, 25 bp, Rattus norvegicus
atcacgtgtgagtgcctgatgccct

SEQ ID NO: 178431 - DNA, 25 bp, Rattus norvegicus
atcacgttaccccacagtaaaaatg

SEQ ID NO: 178432 - DNA, 25 bp, Rattus norvegicus
atcacgttacccgacagtaaaaatg

SEQ ID NO: 178433 - DNA, 25 bp, Rattus norvegicus
atcacgttattcatcaccaggctgt

SEQ ID NO: 178434 - DNA, 25 bp, Rattus norvegicus
atcacgttattcttcaccaggctgt

SEQ ID NO: 178435 - DNA, 25 bp, Rattus norvegicus
atcacgttcgtcaatctgatcgatg

SEQ ID NO: 178436 - DNA, 25 bp, Rattus norvegicus
atcacgttcgtctatctgatcgatg

SEQ ID NO: 178437 - DNA, 25 bp, Rattus norvegicus
atcacgttgccaagtgtctcaagtg

SEQ ID NO: 178438 - DNA, 25 bp, Rattus norvegicus
atcacgttgccatgtgtctcaagtg

SEQ ID NO: 178439 - DNA, 25 bp, Rattus norvegicus
atcacgtttgtgaccaccggagtgg

SEQ ID NO: 178440 - DNA, 25 bp, Rattus norvegicus
atcacgtttgtgtccaccggagtgg

SEQ ID NO: 178441 - DNA, 25 bp, Rattus norvegicus
atcacgttttcgatctcaatctaac

SEQ ID NO: 178442 - DNA, 25 bp, Rattus norvegicus
atcacgttttcgttctcaatctaac

SEQ ID NO: 178443 - DNA, 25 bp, Rattus norvegicus
atcacgttttctcgatattcataaa

SEQ ID NO: 178444 - DNA, 25 bp, Rattus norvegicus
atcacgttttctggatattcataaa

SEQ ID NO: 178445 - DNA, 25 bp, Rattus norvegicus
atcactaaagatctccttctctggg

SEQ ID NO: 178446 - DNA, 25 bp, Rattus norvegicus
atcactaaagatgtccttctctggg

SEQ ID NO: 178447 - DNA, 25 bp, Rattus norvegicus
atcactaagtttaatttttgcctgt

SEQ ID NO: 178448 - DNA, 25 bp, Rattus norvegicus
atcactaagttttatttttgcctgt

SEQ ID NO: 178449 - DNA, 25 bp, Rattus norvegicus
atcactacaagtatgaaggcagcct

SEQ ID NO: 178450 - DNA, 25 bp, Rattus norvegicus
atcactacaagtttgaaggcagcct

SEQ ID NO: 178451 - DNA, 25 bp, Rattus norvegicus
atcactacagacattgacaaattgt

SEQ ID NO: 178452 - DNA, 25 bp, Rattus norvegicus
atcactacagactttgacaaattgt

SEQ ID NO: 178453 - DNA, 25 bp, Rattus norvegicus
atcactaccaggctgcaaattaaca

SEQ ID NO: 178454 - DNA, 25 bp, Rattus norvegicus
atcactaccagggtgcaaattaaca

SEQ ID NO: 178455 - DNA, 25 bp, Rattus norvegicus
atcactactgtacaggttttacttt

SEQ ID NO: 178456 - DNA, 25 bp, Rattus norvegicus
atcactactgtagaggttttacttt

SEQ ID NO: 178457 - DNA, 25 bp, Rattus norvegicus
atcactactgtgcatactacaagac

SEQ ID NO: 178458 - DNA, 25 bp, Rattus norvegicus
atcactactgtggatactacaagac

SEQ ID NO: 178459 - DNA, 25 bp, Rattus norvegicus
atcactaggctcacagggttcttgg

SEQ ID NO: 178460 - DNA, 25 bp, Rattus norvegicus
atcactaggctctcagggttcttgg

SEQ ID NO: 178461 - DNA, 25 bp, Rattus norvegicus
atcactagtgttagcaagccgtccc

SEQ ID NO: 178462 - DNA, 25 bp, Rattus norvegicus
atcactagtgtttgcaagccgtccc

SEQ ID NO: 178463 - DNA, 25 bp, Rattus norvegicus
atcactatattaagccagttttttg

SEQ ID NO: 178464 - DNA, 25 bp, Rattus norvegicus
atcactatattatgccagttttttg

SEQ ID NO: 178465 - DNA, 25 bp, Rattus norvegicus
atcactatgattcccaattccctgg

SEQ ID NO: 178466 - DNA, 25 bp, Rattus norvegicus
atcactatgattgccaattccctgg

SEQ ID NO: 178467 - DNA, 25 bp, Rattus norvegicus
atcactatgcatccgctcgaggaag

SEQ ID NO: 178468 - DNA, 25 bp, Rattus norvegicus
atcactatgcatgcgctcgaggaag

SEQ ID NO: 178469 - DNA, 25 bp, Rattus norvegicus
atcactcaagtgctgggctatgtcc

SEQ ID NO: 178470 - DNA, 25 bp, Rattus norvegicus
atcactcaagtggtgggctatgtcc

SEQ ID NO: 178471 - DNA, 25 bp, Rattus norvegicus
atcactcaccgacccatcattgggt

SEQ ID NO: 178472 - DNA, 25 bp, Rattus norvegicus
atcactcaccgagccatcattgggt

SEQ ID NO: 178473 - DNA, 25 bp, Rattus norvegicus
atcactcagagacggttgtcagacc

SEQ ID NO: 178474 - DNA, 25 bp, Rattus norvegicus
atcactcagagagggttgtcagacc

SEQ ID NO: 178475 - DNA, 25 bp, Rattus norvegicus
atcactcagcgcatgatggtcatag

SEQ ID NO: 178476 - DNA, 25 bp, Rattus norvegicus
atcactcagcgcttgatggtcatag

SEQ ID NO: 178477 - DNA, 25 bp, Rattus norvegicus
atcactcagtacctggatgcgggtg

SEQ ID NO: 178478 - DNA, 25 bp, Rattus norvegicus
atcactcagtacgtggatgcgggtg

SEQ ID NO: 178479 - DNA, 25 bp, Rattus norvegicus
atcactcagtgcagaagagccccag

SEQ ID NO: 178480 - DNA, 25 bp, Rattus norvegicus
atcactcagtgctgaagagccccag

SEQ ID NO: 178481 - DNA, 25 bp, Rattus norvegicus
atcactccaaatcgtgtgtggcccc

SEQ ID NO: 178482 - DNA, 25 bp, Rattus norvegicus
atcactccaaatggtgtgtggcccc

SEQ ID NO: 178483 - DNA, 25 bp, Rattus norvegicus
atcactccacttcttaactatccat

SEQ ID NO: 178484 - DNA, 25 bp, Rattus norvegicus
atcactccacttgttaactatccat

SEQ ID NO: 178485 - DNA, 25 bp, Rattus norvegicus
atcactccaggtaggcctcgagggc

SEQ ID NO: 178486 - DNA, 25 bp, Rattus norvegicus
atcactccaggttggcctcgagggc

SEQ ID NO: 178487 - DNA, 25 bp, Rattus norvegicus
atcactccatctattgtactgctgt

SEQ ID NO: 178488 - DNA, 25 bp, Rattus norvegicus
atcactccatcttttgtactgctgt

SEQ ID NO: 178489 - DNA, 25 bp, Rattus norvegicus
atcactcccagaccagtgttagtgg

SEQ ID NO: 178490 - DNA, 25 bp, Rattus norvegicus
atcactcccagagcagtgttagtgg

SEQ ID NO: 178491 - DNA, 25 bp, Rattus norvegicus
atcactcccagcagcgcaaagcgtg

SEQ ID NO: 178492 - DNA, 25 bp, Rattus norvegicus
atcactcccagctgcgcaaagcgtg

SEQ ID NO: 178493 - DNA, 25 bp, Rattus norvegicus
atcactccggttcttgaatctggtc

SEQ ID NO: 178494 - DNA, 25 bp, Rattus norvegicus
atcactccggttgttgaatctggtc

SEQ ID NO: 178495 - DNA, 25 bp, Rattus norvegicus
atcactccgtttcaatctttctttt

SEQ ID NO: 178496 - DNA, 25 bp, Rattus norvegicus
atcactccgtttgaatctttctttt

SEQ ID NO: 178497 - DNA, 25 bp, Rattus norvegicus
atcactcctattattcactttgcag

SEQ ID NO: 178498 - DNA, 25 bp, Rattus norvegicus
atcactcctatttttcactttgcag

SEQ ID NO: 178499 - DNA, 25 bp, Rattus norvegicus
atcactcctcttagcaagcagcagt

SEQ ID NO: 178500 - DNA, 25 bp, Rattus norvegicus
atcactcctctttgcaagcagcagt

SEQ ID NO: 178501 - DNA, 25 bp, Rattus norvegicus
atcactctgagtccagttcttctac

SEQ ID NO: 178502 - DNA, 25 bp, Rattus norvegicus
atcactctgagtgcagttcttctac

SEQ ID NO: 178503 - DNA, 25 bp, Rattus norvegicus
atcactctggccatgaaccgagatg

SEQ ID NO: 178504 - DNA, 25 bp, Rattus norvegicus
atcactctggccttgaaccgagatg

SEQ ID NO: 178505 - DNA, 25 bp, Rattus norvegicus
atcactctgtctacccataaaccga

SEQ ID NO: 178506 - DNA, 25 bp, Rattus norvegicus
atcactctgtcttcccataaaccga

SEQ ID NO: 178507 - DNA, 25 bp, Rattus norvegicus
atcactctgtgtactgttctctgct

SEQ ID NO: 178508 - DNA, 25 bp, Rattus norvegicus
atcactctgtgttctgttctctgct

SEQ ID NO: 178509 - DNA, 25 bp, Rattus norvegicus
atcactcttgtgcagggaacactta

SEQ ID NO: 178510 - DNA, 25 bp, Rattus norvegicus
atcactcttgtggagggaacactta

SEQ ID NO: 178511 - DNA, 25 bp, Rattus norvegicus
atcactgaaaacctggctgcttcaa

SEQ ID NO: 178512 - DNA, 25 bp, Rattus norvegicus
atcactgaaaacgtggctgcttcaa

SEQ ID NO: 178513 - DNA, 25 bp, Rattus norvegicus
atcactgaatttattatacgctaac

SEQ ID NO: 178514 - DNA, 25 bp, Rattus norvegicus
atcactgaattttttatacgctaac

SEQ ID NO: 178515 - DNA, 25 bp, Rattus norvegicus
atcactgacgtaagacaaaaccaga

SEQ ID NO: 178516 - DNA, 25 bp, Rattus norvegicus
atcactgacgtatgacaaaaccaga

SEQ ID NO: 178517 - DNA, 25 bp, Rattus norvegicus
atcactgactttcttgaactgctag

SEQ ID NO: 178518 - DNA, 25 bp, Rattus norvegicus
atcactgactttgttgaactgctag

SEQ ID NO: 178519 - DNA, 25 bp, Rattus norvegicus
atcactgagaagagcaatgtgcttt

SEQ ID NO: 178520 - DNA, 25 bp, Rattus norvegicus
atcactgagaagtgcaatgtgcttt

SEQ ID NO: 178521 - DNA, 25 bp, Rattus norvegicus
atcactgagcttatggctgggtgcc

SEQ ID NO: 178522 - DNA, 25 bp, Rattus norvegicus
atcactgagcttttggctgggtgcc

SEQ ID NO: 178523 - DNA, 25 bp, Rattus norvegicus
atcactgaggacagggagacccaga

SEQ ID NO: 178524 - DNA, 25 bp, Rattus norvegicus
atcactgaggactgggagacccaga

SEQ ID NO: 178525 - DNA, 25 bp, Rattus norvegicus
atcactgagtacatgggcaggccaa

SEQ ID NO: 178526 - DNA, 25 bp, Rattus norvegicus
atcactgagtacttgggcaggccaa

SEQ ID NO: 178527 - DNA, 25 bp, Rattus norvegicus
atcactgagtgcattgcgattcttc

SEQ ID NO: 178528 - DNA, 25 bp, Rattus norvegicus
atcactgagtgctttgcgattcttc

SEQ ID NO: 178529 - DNA, 25 bp, Rattus norvegicus
atcactgatgacatcgactgggact

SEQ ID NO: 178530 - DNA, 25 bp, Rattus norvegicus
atcactgatgacttcgactgggact

SEQ ID NO: 178531 - DNA, 25 bp, Rattus norvegicus
atcactgatgtaagactccgtcctt

SEQ ID NO: 178532 - DNA, 25 bp, Rattus norvegicus
atcactgatgtatgactccgtcctt

SEQ ID NO: 178533 - DNA, 25 bp, Rattus norvegicus
atcactgcagacatccatgctattg

SEQ ID NO: 178534 - DNA, 25 bp, Rattus norvegicus
atcactgcagacttccatgctattg

SEQ ID NO: 178535 - DNA, 25 bp, Rattus norvegicus
atcactgccaccatgagctgtggag

SEQ ID NO: 178536 - DNA, 25 bp, Rattus norvegicus
atcactgccaccttgagctgtggag

SEQ ID NO: 178537 - DNA, 25 bp, Rattus norvegicus
atcactgccatcacgaaagctactg

SEQ ID NO: 178538 - DNA, 25 bp, Rattus norvegicus
atcactgccatctcgaaagctactg

SEQ ID NO: 178539 - DNA, 25 bp, Rattus norvegicus
atcactgcccacctataagaatcat

SEQ ID NO: 178540 - DNA, 25 bp, Rattus norvegicus
atcactgcccacgtataagaatcat

SEQ ID NO: 178541 - DNA, 25 bp, Rattus norvegicus
atcactgcccctctgtttggaaata

SEQ ID NO: 178542 - DNA, 25 bp, Rattus norvegicus
atcactgcccctgtgtttggaaata

SEQ ID NO: 178543 - DNA, 25 bp, Rattus norvegicus
atcactgcccttctaacagcacaaa

SEQ ID NO: 178544 - DNA, 25 bp, Rattus norvegicus
atcactgcccttgtaacagcacaaa

SEQ ID NO: 178545 - DNA, 25 bp, Rattus norvegicus
atcactgccgggatctccatttaaa

SEQ ID NO: 178546 - DNA, 25 bp, Rattus norvegicus
atcactgccgggttctccatttaaa

SEQ ID NO: 178547 - DNA, 25 bp, Rattus norvegicus
atcactgccttcagtttgctggaaa

SEQ ID NO: 178548 - DNA, 25 bp, Rattus norvegicus
atcactgccttctgtttgctggaaa

SEQ ID NO: 178549 - DNA, 25 bp, Rattus norvegicus
atcactgctgaacttgggagccatg

SEQ ID NO: 178550 - DNA, 25 bp, Rattus norvegicus
atcactgctgaagttgggagccatg

SEQ ID NO: 178551 - DNA, 25 bp, Rattus norvegicus
atcactgctggaatatttctattta

SEQ ID NO: 178552 - DNA, 25 bp, Rattus norvegicus
atcactgctggattatttctattta

SEQ ID NO: 178553 - DNA, 25 bp, Rattus norvegicus
atcactgctggcctatacaagcttg

SEQ ID NO: 178554 - DNA, 25 bp, Rattus norvegicus
atcactgctggcgtatacaagcttg

SEQ ID NO: 178555 - DNA, 25 bp, Rattus norvegicus
atcactgctgtgatcttcttggagt

SEQ ID NO: 178556 - DNA, 25 bp, Rattus norvegicus
atcactgctgtgttcttcttggagt

SEQ ID NO: 178557 - DNA, 25 bp, Rattus norvegicus
atcactgctttgatacttctcatgg

SEQ ID NO: 178558 - DNA, 25 bp, Rattus norvegicus
atcactgctttgttacttctcatgg

SEQ ID NO: 178559 - DNA, 25 bp, Rattus norvegicus
atcactggacagaagttccttgaca

SEQ ID NO: 178560 - DNA, 25 bp, Rattus norvegicus
atcactggacagtagttccttgaca

SEQ ID NO: 178561 - DNA, 25 bp, Rattus norvegicus
atcactggctctctggacgaccact

SEQ ID NO: 178562 - DNA, 25 bp, Rattus norvegicus
atcactggctctgtggacgaccact

SEQ ID NO: 178563 - DNA, 25 bp, Rattus norvegicus
atcactgggcagatggaacaaacat

SEQ ID NO: 178564 - DNA, 25 bp, Rattus norvegicus
atcactgggcagttggaacaaacat

SEQ ID NO: 178565 - DNA, 25 bp, Rattus norvegicus
atcactggtgatcctgtatggaact

SEQ ID NO: 178566 - DNA, 25 bp, Rattus norvegicus
atcactggtgatgctgtatggaact

SEQ ID NO: 178567 - DNA, 25 bp, Rattus norvegicus
atcactggtggaagaccctgttgag

SEQ ID NO: 178568 - DNA, 25 bp, Rattus norvegicus
atcactggtggatgaccctgttgag

SEQ ID NO: 178569 - DNA, 25 bp, Rattus norvegicus
atcactggtgtgagcatgacttcct

SEQ ID NO: 178570 - DNA, 25 bp, Rattus norvegicus
atcactggtgtgtgcatgacttcct

SEQ ID NO: 178571 - DNA, 25 bp, Rattus norvegicus
atcactgtactgctgagacctgcac

SEQ ID NO: 178572 - DNA, 25 bp, Rattus norvegicus
atcactgtactggtgagacctgcac

SEQ ID NO: 178573 - DNA, 25 bp, Rattus norvegicus
atcactgtagtgaataaccttggcc

SEQ ID NO: 178574 - DNA, 25 bp, Rattus norvegicus
atcactgtagtgtataaccttggcc

SEQ ID NO: 178575 - DNA, 25 bp, Rattus norvegicus
atcactgtatctacgatgtttggaa

SEQ ID NO: 178576 - DNA, 25 bp, Rattus norvegicus
atcactgtatcttcgatgtttggaa

SEQ ID NO: 178577 - DNA, 25 bp, Rattus norvegicus
atcactgtatgtcaggtgctcccag

SEQ ID NO: 178578 - DNA, 25 bp, Rattus norvegicus
atcactgtatgtgaggtgctcccag

SEQ ID NO: 178579 - DNA, 25 bp, Rattus norvegicus
atcactgtcaaaattcctcgggcaa

SEQ ID NO: 178580 - DNA, 25 bp, Rattus norvegicus
atcactgtcaaatttcctcgggcaa

SEQ ID NO: 178581 - DNA, 25 bp, Rattus norvegicus
atcactgtcaagagaaacgaccgcg

SEQ ID NO: 178582 - DNA, 25 bp, Rattus norvegicus
atcactgtcaagtgaaacgaccgcg

SEQ ID NO: 178583 - DNA, 25 bp, Rattus norvegicus
atcactgtccaacgcactgagagct

SEQ ID NO: 178584 - DNA, 25 bp, Rattus norvegicus
atcactgtccaaggcactgagagct

SEQ ID NO: 178585 - DNA, 25 bp, Rattus norvegicus
atcactgtctgtctagtagaaccca

SEQ ID NO: 178586 - DNA, 25 bp, Rattus norvegicus
atcactgtctgtgtagtagaaccca

SEQ ID NO: 178587 - DNA, 25 bp, Rattus norvegicus
atcactgtgaatcggctttctctcc

SEQ ID NO: 178588 - DNA, 25 bp, Rattus norvegicus
atcactgtgaatgggctttctctcc

SEQ ID NO: 178589 - DNA, 25 bp, Rattus norvegicus
atcactgtgacaagcggttagccta

SEQ ID NO: 178590 - DNA, 25 bp, Rattus norvegicus
atcactgtgacatgcggttagccta

SEQ ID NO: 178591 - DNA, 25 bp, Rattus norvegicus
atcactgtgggcatttgctgttttt

SEQ ID NO: 178592 - DNA, 25 bp, Rattus norvegicus
atcactgtgggcttttgctgttttt

SEQ ID NO: 178593 - DNA, 25 bp, Rattus norvegicus
atcactgtggttagaagctgtaatc

SEQ ID NO: 178594 - DNA, 25 bp, Rattus norvegicus
atcactgtggtttgaagctgtaatc

SEQ ID NO: 178595 - DNA, 25 bp, Rattus norvegicus
atcactgtgtggatgtcaaccttac

SEQ ID NO: 178596 - DNA, 25 bp, Rattus norvegicus
atcactgtgtggttgtcaaccttac

SEQ ID NO: 178597 - DNA, 25 bp, Rattus norvegicus
atcactgtgtgtagacgtttgcctt

SEQ ID NO: 178598 - DNA, 25 bp, Rattus norvegicus
atcactgtgtgttgacgtttgcctt

SEQ ID NO: 178599 - DNA, 25 bp, Rattus norvegicus
atcactgttagacttcttcacctcc

SEQ ID NO: 178600 - DNA, 25 bp, Rattus norvegicus
atcactgttagagttcttcacctcc

SEQ ID NO: 178601 - DNA, 25 bp, Rattus norvegicus
atcactgttagtactcgaagttcaa

SEQ ID NO: 178602 - DNA, 25 bp, Rattus norvegicus
atcactgttagttctcgaagttcaa

SEQ ID NO: 178603 - DNA, 25 bp, Rattus norvegicus
atcactgttcaaagcgctgttcgag

SEQ ID NO: 178604 - DNA, 25 bp, Rattus norvegicus
atcactgttcaatgcgctgttcgag

SEQ ID NO: 178605 - DNA, 25 bp, Rattus norvegicus
atcactgttcatatgggagacctca

SEQ ID NO: 178606 - DNA, 25 bp, Rattus norvegicus
atcactgttcatttgggagacctca

SEQ ID NO: 178607 - DNA, 25 bp, Rattus norvegicus
atcactgttctgatctgtagccatg

SEQ ID NO: 178608 - DNA, 25 bp, Rattus norvegicus
atcactgttctgttctgtagccatg

SEQ ID NO: 178609 - DNA, 25 bp, Rattus norvegicus
atcactgttcttcggtcttctcttg

SEQ ID NO: 178610 - DNA, 25 bp, Rattus norvegicus
atcactgttcttgggtcttctcttg

SEQ ID NO: 178611 - DNA, 25 bp, Rattus norvegicus
atcactgtttagattctgcccgctg

SEQ ID NO: 178612 - DNA, 25 bp, Rattus norvegicus
atcactgtttagtttctgcccgctg

SEQ ID NO: 178613 - DNA, 25 bp, Rattus norvegicus
atcactgtttatctcgggtttgggc

SEQ ID NO: 178614 - DNA, 25 bp, Rattus norvegicus
atcactgtttatgtcgggtttgggc

SEQ ID NO: 178615 - DNA, 25 bp, Rattus norvegicus
atcactgtttgtccctctgtgggag

SEQ ID NO: 178616 - DNA, 25 bp, Rattus norvegicus
atcactgtttgtgcctctgtgggag

SEQ ID NO: 178617 - DNA, 25 bp, Rattus norvegicus
atcacttaaggcaggtgggtgttca

SEQ ID NO: 178618 - DNA, 25 bp, Rattus norvegicus
atcacttaaggctggtgggtgttca

SEQ ID NO: 178619 - DNA, 25 bp, Rattus norvegicus
atcacttaccttatgttcttcttgg

SEQ ID NO: 178620 - DNA, 25 bp, Rattus norvegicus
atcacttaccttttgttcttcttgg

SEQ ID NO: 178621 - DNA, 25 bp, Rattus norvegicus
atcacttagatgcacgctcgttttc

SEQ ID NO: 178622 - DNA, 25 bp, Rattus norvegicus
atcacttagatggacgctcgttttc

SEQ ID NO: 178623 - DNA, 25 bp, Rattus norvegicus
atcacttatagtcggctcatcggga

SEQ ID NO: 178624 - DNA, 25 bp, Rattus norvegicus
atcacttatagtgggctcatcggga

SEQ ID NO: 178625 - DNA, 25 bp, Rattus norvegicus
atcacttcaggcagttcccttagct

SEQ ID NO: 178626 - DNA, 25 bp, Rattus norvegicus
atcacttcaggctgttcccttagct

SEQ ID NO: 178627 - DNA, 25 bp, Rattus norvegicus
atcacttcggttcatttctttgctt

SEQ ID NO: 178628 - DNA, 25 bp, Rattus norvegicus
atcacttcggttgatttctttgctt

SEQ ID NO: 178629 - DNA, 25 bp, Rattus norvegicus
atcacttctgatcggcttggtagga

SEQ ID NO: 178630 - DNA, 25 bp, Rattus norvegicus
atcacttctgatgggcttggtagga

SEQ ID NO: 178631 - DNA, 25 bp, Rattus norvegicus
atcacttctgtgacctttgttgaaa

SEQ ID NO: 178632 - DNA, 25 bp, Rattus norvegicus
atcacttctgtgtcctttgttgaaa

SEQ ID NO: 178633 - DNA, 25 bp, Rattus norvegicus
atcacttgcaagactgttttctgaa

SEQ ID NO: 178634 - DNA, 25 bp, Rattus norvegicus
atcacttgcaagtctgttttctgaa

SEQ ID NO: 178635 - DNA, 25 bp, Rattus norvegicus
atcacttgctgcaatgtggttcact

SEQ ID NO: 178636 - DNA, 25 bp, Rattus norvegicus
atcacttgctgctatgtggttcact

SEQ ID NO: 178637 - DNA, 25 bp, Rattus norvegicus
atcacttgggaaccaggagccctgc

SEQ ID NO: 178638 - DNA, 25 bp, Rattus norvegicus
atcacttgggaagcaggagccctgc

SEQ ID NO: 178639 - DNA, 25 bp, Rattus norvegicus
atcactttaacaatccctacttcat

SEQ ID NO: 178640 - DNA, 25 bp, Rattus norvegicus
atcactttaacattccctacttcat

SEQ ID NO: 178641 - DNA, 25 bp, Rattus norvegicus
atcactttatttagtgcccaggttg

SEQ ID NO: 178642 - DNA, 25 bp, Rattus norvegicus
atcactttattttgtgcccaggttg

SEQ ID NO: 178643 - DNA, 25 bp, Rattus norvegicus
atcactttccccaatatacaccaga

SEQ ID NO: 178644 - DNA, 25 bp, Rattus norvegicus
atcactttcccctatatacaccaga

SEQ ID NO: 178645 - DNA, 25 bp, Rattus norvegicus
atcactttgagtagtacatgcccag

SEQ ID NO: 178646 - DNA, 25 bp, Rattus norvegicus
atcactttgagttgtacatgcccag

SEQ ID NO: 178647 - DNA, 25 bp, Rattus norvegicus
atcactttggcccagtctcaggaaa

SEQ ID NO: 178648 - DNA, 25 bp, Rattus norvegicus
atcactttggccctaccacgtaaga

SEQ ID NO: 178649 - DNA, 25 bp, Rattus norvegicus
atcactttggccgagtctcaggaaa

SEQ ID NO: 178650 - DNA, 25 bp, Rattus norvegicus
atcactttggccgtaccacgtaaga

SEQ ID NO: 178651 - DNA, 25 bp, Rattus norvegicus
atcactttgtgactgcatcacctag

SEQ ID NO: 178652 - DNA, 25 bp, Rattus norvegicus
atcactttgtgagtgcatcacctag

SEQ ID NO: 178653 - DNA, 25 bp, Rattus norvegicus
atcactttgtgtaatacccctgagg

SEQ ID NO: 178654 - DNA, 25 bp, Rattus norvegicus
atcactttgtgttatacccctgagg

SEQ ID NO: 178655 - DNA, 25 bp, Rattus norvegicus
atcactttgtttctcatttaccaag

SEQ ID NO: 178656 - DNA, 25 bp, Rattus norvegicus
atcactttgtttgtcatttaccaag

SEQ ID NO: 178657 - DNA, 25 bp, Rattus norvegicus
atcacttttatgacactggcttctc

SEQ ID NO: 178658 - DNA, 25 bp, Rattus norvegicus
atcacttttatgtcactggcttctc

SEQ ID NO: 178659 - DNA, 25 bp, Rattus norvegicus
atcacttttctaagcttgccttctg

SEQ ID NO: 178660 - DNA, 25 bp, Rattus norvegicus
atcacttttctatgcttgccttctg

SEQ ID NO: 178661 - DNA, 25 bp, Rattus norvegicus
atcactttttctcacacccacgtga

SEQ ID NO: 178662 - DNA, 25 bp, Rattus norvegicus
atcactttttctgacacccacgtga

SEQ ID NO: 178663 - DNA, 25 bp, Rattus norvegicus
atcagaaacatccttgcacctcgtt

SEQ ID NO: 178664 - DNA, 25 bp, Rattus norvegicus
atcagaaacatcgttgcacctcgtt

SEQ ID NO: 178665 - DNA, 25 bp, Rattus norvegicus
atcagaaagcccacctgactttaaa

SEQ ID NO: 178666 - DNA, 25 bp, Rattus norvegicus
atcagaaagccctcctgactttaaa

SEQ ID NO: 178667 - DNA, 25 bp, Rattus norvegicus
atcagaacattccttgctcagcatg

SEQ ID NO: 178668 - DNA, 25 bp, Rattus norvegicus
atcagaacattcgttgctcagcatg

SEQ ID NO: 178669 - DNA, 25 bp, Rattus norvegicus
atcagaacctgtctttgaactcata

SEQ ID NO: 178670 - DNA, 25 bp, Rattus norvegicus
atcagaacctgtgtttgaactcata

SEQ ID NO: 178671 - DNA, 25 bp, Rattus norvegicus
atcagaacgctgctcgctggagtat

SEQ ID NO: 178672 - DNA, 25 bp, Rattus norvegicus
atcagaacgctggtcgctggagtat

SEQ ID NO: 178673 - DNA, 25 bp, Rattus norvegicus
atcagaactactaaggatggctcca

SEQ ID NO: 178674 - DNA, 25 bp, Rattus norvegicus
atcagaactacttaggatggctcca

SEQ ID NO: 178675 - DNA, 25 bp, Rattus norvegicus
atcagaactggcctggttcctcact

SEQ ID NO: 178676 - DNA, 25 bp, Rattus norvegicus
atcagaactggcgtggttcctcact

SEQ ID NO: 178677 - DNA, 25 bp, Rattus norvegicus
atcagaactgtgacgctgggtgcca

SEQ ID NO: 178678 - DNA, 25 bp, Rattus norvegicus
atcagaactgtgtcgctgggtgcca

SEQ ID NO: 178679 - DNA, 25 bp, Rattus norvegicus
atcagaagaaatcccgacacccaat

SEQ ID NO: 178680 - DNA, 25 bp, Rattus norvegicus
atcagaagaaatgccgacacccaat

SEQ ID NO: 178681 - DNA, 25 bp, Rattus norvegicus
atcagaagaagccttgccagccact

SEQ ID NO: 178682 - DNA, 25 bp, Rattus norvegicus
atcagaagaagcgttgccagccact

SEQ ID NO: 178683 - DNA, 25 bp, Rattus norvegicus
atcagaagatgacagctccacaaag

SEQ ID NO: 178684 - DNA, 25 bp, Rattus norvegicus
atcagaagatgagagctccacaaag

SEQ ID NO: 178685 - DNA, 25 bp, Rattus norvegicus
atcagaagctgtatgacctggttca

SEQ ID NO: 178686 - DNA, 25 bp, Rattus norvegicus
atcagaagctgtttgacctggttca

SEQ ID NO: 178687 - DNA, 25 bp, Rattus norvegicus
atcagaagggctatacagagtctct

SEQ ID NO: 178688 - DNA, 25 bp, Rattus norvegicus
atcagaagggctttacagagtctct

SEQ ID NO: 178689 - DNA, 25 bp, Rattus norvegicus
atcagaagtgatcacgccagttgtt

SEQ ID NO: 178690 - DNA, 25 bp, Rattus norvegicus
atcagaagtgatgacgccagttgtt

SEQ ID NO: 178691 - DNA, 25 bp, Rattus norvegicus
atcagaagtgcaagtccagggcctt

SEQ ID NO: 178692 - DNA, 25 bp, Rattus norvegicus
atcagaagtgcatgtccagggcctt

SEQ ID NO: 178693 - DNA, 25 bp, Rattus norvegicus
atcagaatctctcccttcatgtgat

SEQ ID NO: 178694 - DNA, 25 bp, Rattus norvegicus
atcagaatctctgccttcatgtgat

SEQ ID NO: 178695 - DNA, 25 bp, Rattus norvegicus
atcagaatggagcagagcctcactc

SEQ ID NO: 178696 - DNA, 25 bp, Rattus norvegicus
atcagaatggaggagagcctcactc

SEQ ID NO: 178697 - DNA, 25 bp, Rattus norvegicus
atcagaattcctcccattcatgttt

SEQ ID NO: 178698 - DNA, 25 bp, Rattus norvegicus
atcagaattcctgccattcatgttt

SEQ ID NO: 178699 - DNA, 25 bp, Rattus norvegicus
atcagaattcttcagctggcagctt

SEQ ID NO: 178700 - DNA, 25 bp, Rattus norvegicus
atcagaattcttgagctggcagctt

SEQ ID NO: 178701 - DNA, 25 bp, Rattus norvegicus
atcagaattgttatttgtcttcaca

SEQ ID NO: 178702 - DNA, 25 bp, Rattus norvegicus
atcagaattgttttttgtcttcaca

SEQ ID NO: 178703 - DNA, 25 bp, Rattus norvegicus
atcagacaccacagggcttgatgcc

SEQ ID NO: 178704 - DNA, 25 bp, Rattus norvegicus
atcagacaccactgggcttgatgcc

SEQ ID NO: 178705 - DNA, 25 bp, Rattus norvegicus
atcagacaccggatgttaccacttg

SEQ ID NO: 178706 - DNA, 25 bp, Rattus norvegicus
atcagacaccggttgttaccacttg

SEQ ID NO: 178707 - DNA, 25 bp, Rattus norvegicus
atcagacactgaatctcagagccct

SEQ ID NO: 178708 - DNA, 25 bp, Rattus norvegicus
atcagacactgattctcagagccct

SEQ ID NO: 178709 - DNA, 25 bp, Rattus norvegicus
atcagacagctcactgcacctgtaa

SEQ ID NO: 178710 - DNA, 25 bp, Rattus norvegicus
atcagacagctctctgcacctgtaa

SEQ ID NO: 178711 - DNA, 25 bp, Rattus norvegicus
atcagacagctgcaacgcacacgcg

SEQ ID NO: 178712 - DNA, 25 bp, Rattus norvegicus
atcagacagctggaacgcacacgcg

SEQ ID NO: 178713 - DNA, 25 bp, Rattus norvegicus
atcagacagttcaaccgggtcagcc

SEQ ID NO: 178714 - DNA, 25 bp, Rattus norvegicus
atcagacagttctaccgggtcagcc

SEQ ID NO: 178715 - DNA, 25 bp, Rattus norvegicus
atcagacatattacctcctgtggca

SEQ ID NO: 178716 - DNA, 25 bp, Rattus norvegicus
atcagacatatttcctcctgtggca

SEQ ID NO: 178717 - DNA, 25 bp, Rattus norvegicus
atcagacattgcagaggaagccctc

SEQ ID NO: 178718 - DNA, 25 bp, Rattus norvegicus
atcagacattgctgaggaagccctc

SEQ ID NO: 178719 - DNA, 25 bp, Rattus norvegicus
atcagaccagctatggagctcttgg

SEQ ID NO: 178720 - DNA, 25 bp, Rattus norvegicus
atcagaccagctttggagctcttgg

SEQ ID NO: 178721 - DNA, 25 bp, Rattus norvegicus
atcagaccctctatagctgtgcaag

SEQ ID NO: 178722 - DNA, 25 bp, Rattus norvegicus
atcagaccctctttagctgtgcaag

SEQ ID NO: 178723 - DNA, 25 bp, Rattus norvegicus
atcagaccgatgcttgtatataccg

SEQ ID NO: 178724 - DNA, 25 bp, Rattus norvegicus
atcagaccgatggttgtatataccg

SEQ ID NO: 178725 - DNA, 25 bp, Rattus norvegicus
atcagaccgtgcaattttcatgctc

SEQ ID NO: 178726 - DNA, 25 bp, Rattus norvegicus
atcagaccgtgctattttcatgctc

SEQ ID NO: 178727 - DNA, 25 bp, Rattus norvegicus
atcagacctcggcagatggaccagg

SEQ ID NO: 178728 - DNA, 25 bp, Rattus norvegicus
atcagacctcgggagatggaccagg

SEQ ID NO: 178729 - DNA, 25 bp, Rattus norvegicus
atcagacctgagaacttgcacacat

SEQ ID NO: 178730 - DNA, 25 bp, Rattus norvegicus
atcagacctgagtacttgcacacat

SEQ ID NO: 178731 - DNA, 25 bp, Rattus norvegicus
atcagacctgatctgtttttggtga

SEQ ID NO: 178732 - DNA, 25 bp, Rattus norvegicus
atcagacctgatgtgtttttggtga

SEQ ID NO: 178733 - DNA, 25 bp, Rattus norvegicus
atcagacgctctaacataatcaagg

SEQ ID NO: 178734 - DNA, 25 bp, Rattus norvegicus
atcagacgctctagtaccagagaca

SEQ ID NO: 178735 - DNA, 25 bp, Rattus norvegicus
atcagacgctcttacataatcaagg

SEQ ID NO: 178736 - DNA, 25 bp, Rattus norvegicus
atcagacgctcttgtaccagagaca

SEQ ID NO: 178737 - DNA, 25 bp, Rattus norvegicus
atcagactcccacctgtgcatacag

SEQ ID NO: 178738 - DNA, 25 bp, Rattus norvegicus
atcagactcccagctgtgcatacag

SEQ ID NO: 178739 - DNA, 25 bp, Rattus norvegicus
atcagactgatcatttgctcacctt

SEQ ID NO: 178740 - DNA, 25 bp, Rattus norvegicus
atcagactgatcttttgctcacctt

SEQ ID NO: 178741 - DNA, 25 bp, Rattus norvegicus
atcagactgcctattcaatgcttgt

SEQ ID NO: 178742 - DNA, 25 bp, Rattus norvegicus
atcagactgccttttcaatgcttgt

SEQ ID NO: 178743 - DNA, 25 bp, Rattus norvegicus
atcagactggacatgaacttatcaa

SEQ ID NO: 178744 - DNA, 25 bp, Rattus norvegicus
atcagactggacttgaacttatcaa

SEQ ID NO: 178745 - DNA, 25 bp, Rattus norvegicus
atcagactgggaactagacttcaat

SEQ ID NO: 178746 - DNA, 25 bp, Rattus norvegicus
atcagactgggatctagacttcaat

SEQ ID NO: 178747 - DNA, 25 bp, Rattus norvegicus
atcagacttcagctttcctcagaaa

SEQ ID NO: 178748 - DNA, 25 bp, Rattus norvegicus
atcagacttcaggtttcctcagaaa

SEQ ID NO: 178749 - DNA, 25 bp, Rattus norvegicus
atcagagaacacatgaaccccagaa

SEQ ID NO: 178750 - DNA, 25 bp, Rattus norvegicus
atcagagaacacttgaaccccagaa

SEQ ID NO: 178751 - DNA, 25 bp, Rattus norvegicus
atcagagaagccataggcgggccct

SEQ ID NO: 178752 - DNA, 25 bp, Rattus norvegicus
atcagagaagccttaggcgggccct

SEQ ID NO: 178753 - DNA, 25 bp, Rattus norvegicus
atcagagacccaacctgaggtagtg

SEQ ID NO: 178754 - DNA, 25 bp, Rattus norvegicus
atcagagacccatcctgaggtagtg

SEQ ID NO: 178755 - DNA, 25 bp, Rattus norvegicus
atcagagacctaaccatagcccagg

SEQ ID NO: 178756 - DNA, 25 bp, Rattus norvegicus
atcagagacctatccatagcccagg

SEQ ID NO: 178757 - DNA, 25 bp, Rattus norvegicus
atcagagaccttaactccagctggg

SEQ ID NO: 178758 - DNA, 25 bp, Rattus norvegicus
atcagagacctttactccagctggg

SEQ ID NO: 178759 - DNA, 25 bp, Rattus norvegicus
atcagagacgcaacagtggttttcg

SEQ ID NO: 178760 - DNA, 25 bp, Rattus norvegicus
atcagagacgcatcagtggttttcg

SEQ ID NO: 178761 - DNA, 25 bp, Rattus norvegicus
atcagagagaagcaaccccctccaa

SEQ ID NO: 178762 - DNA, 25 bp, Rattus norvegicus
atcagagagaaggaaccccctccaa

SEQ ID NO: 178763 - DNA, 25 bp, Rattus norvegicus
atcagagagtctacaggagcccact

SEQ ID NO: 178764 - DNA, 25 bp, Rattus norvegicus
atcagagagtcttcaggagcccact

SEQ ID NO: 178765 - DNA, 25 bp, Rattus norvegicus
atcagagagttcacagccactttta

SEQ ID NO: 178766 - DNA, 25 bp, Rattus norvegicus
atcagagagttctcagccactttta

SEQ ID NO: 178767 - DNA, 25 bp, Rattus norvegicus
atcagagatggtcgcctcctctctt

SEQ ID NO: 178768 - DNA, 25 bp, Rattus norvegicus
atcagagatggtggcctcctctctt

SEQ ID NO: 178769 - DNA, 25 bp, Rattus norvegicus
atcagagcacttaacctttcttagc

SEQ ID NO: 178770 - DNA, 25 bp, Rattus norvegicus
atcagagcactttacctttcttagc

SEQ ID NO: 178771 - DNA, 25 bp, Rattus norvegicus
atcagagcagggatctcaggctgac

SEQ ID NO: 178772 - DNA, 25 bp, Rattus norvegicus
atcagagcagggttctcaggctgac

SEQ ID NO: 178773 - DNA, 25 bp, Rattus norvegicus
atcagagcaggtagggtacaacatc

SEQ ID NO: 178774 - DNA, 25 bp, Rattus norvegicus
atcagagcaggttgggtacaacatc

SEQ ID NO: 178775 - DNA, 25 bp, Rattus norvegicus
atcagagcattcagcaccatcaagc

SEQ ID NO: 178776 - DNA, 25 bp, Rattus norvegicus
atcagagcattctgcaccatcaagc

SEQ ID NO: 178777 - DNA, 25 bp, Rattus norvegicus
atcagagcattgaggtatgtttaca

SEQ ID NO: 178778 - DNA, 25 bp, Rattus norvegicus
atcagagcattgtggtatgtttaca

SEQ ID NO: 178779 - DNA, 25 bp, Rattus norvegicus
atcagagccaacctggccgcaaaag

SEQ ID NO: 178780 - DNA, 25 bp, Rattus norvegicus
atcagagccaacgtggccgcaaaag

SEQ ID NO: 178781 - DNA, 25 bp, Rattus norvegicus
atcagagccaggaataacggtgcat

SEQ ID NO: 178782 - DNA, 25 bp, Rattus norvegicus
atcagagccaggtataacggtgcat

SEQ ID NO: 178783 - DNA, 25 bp, Rattus norvegicus
atcagagccatcatctgtttgttaa

SEQ ID NO: 178784 - DNA, 25 bp, Rattus norvegicus
atcagagccatcttctgtttgttaa

SEQ ID NO: 178785 - DNA, 25 bp, Rattus norvegicus
atcagagcccgactggcccgagcta

SEQ ID NO: 178786 - DNA, 25 bp, Rattus norvegicus
atcagagcccgagtggcccgagcta

SEQ ID NO: 178787 - DNA, 25 bp, Rattus norvegicus
atcagagccctacgtgagccgggct

SEQ ID NO: 178788 - DNA, 25 bp, Rattus norvegicus
atcagagccctactaccttatgaag

SEQ ID NO: 178789 - DNA, 25 bp, Rattus norvegicus
atcagagccctaggtgagccgggct

SEQ ID NO: 178790 - DNA, 25 bp, Rattus norvegicus
atcagagccctagtaccttatgaag

SEQ ID NO: 178791 - DNA, 25 bp, Rattus norvegicus
atcagagctcaacatggcggcactt

SEQ ID NO: 178792 - DNA, 25 bp, Rattus norvegicus
atcagagctcaagatggcggcactt

SEQ ID NO: 178793 - DNA, 25 bp, Rattus norvegicus
atcagagctgtgaatttccctgtct

SEQ ID NO: 178794 - DNA, 25 bp, Rattus norvegicus
atcagagctgtgtatttccctgtct

SEQ ID NO: 178795 - DNA, 25 bp, Rattus norvegicus
atcagagcttgtaacagccagaccc

SEQ ID NO: 178796 - DNA, 25 bp, Rattus norvegicus
atcagagcttgttacagccagaccc

SEQ ID NO: 178797 - DNA, 25 bp, Rattus norvegicus
atcagaggacccacctgggcaagag

SEQ ID NO: 178798 - DNA, 25 bp, Rattus norvegicus
atcagaggaccctcctgggcaagag

SEQ ID NO: 178799 - DNA, 25 bp, Rattus norvegicus
atcagaggactgatcgctctgctcc

SEQ ID NO: 178800 - DNA, 25 bp, Rattus norvegicus
atcagaggactgttcgctctgctcc

SEQ ID NO: 178801 - DNA, 25 bp, Rattus norvegicus
atcagaggcgacagttgggctacca

SEQ ID NO: 178802 - DNA, 25 bp, Rattus norvegicus
atcagaggcgactgttgggctacca

SEQ ID NO: 178803 - DNA, 25 bp, Rattus norvegicus
atcagaggtcgtaccctctattttt

SEQ ID NO: 178804 - DNA, 25 bp, Rattus norvegicus
atcagaggtcgttccctctattttt

SEQ ID NO: 178805 - DNA, 25 bp, Rattus norvegicus
atcagaggtctccatatggctccag

SEQ ID NO: 178806 - DNA, 25 bp, Rattus norvegicus
atcagaggtctcgatatggctccag

SEQ ID NO: 178807 - DNA, 25 bp, Rattus norvegicus
atcagaggtggtccttttggaacaa

SEQ ID NO: 178808 - DNA, 25 bp, Rattus norvegicus
atcagaggtggtgcttttggaacaa

SEQ ID NO: 178809 - DNA, 25 bp, Rattus norvegicus
atcagaggttaaatgacttgtcttc

SEQ ID NO: 178810 - DNA, 25 bp, Rattus norvegicus
atcagaggttaattgacttgtcttc

SEQ ID NO: 178811 - DNA, 25 bp, Rattus norvegicus
atcagaggtttgaaaagacccacga

SEQ ID NO: 178812 - DNA, 25 bp, Rattus norvegicus
atcagaggtttgtaaagacccacga

SEQ ID NO: 178813 - DNA, 25 bp, Rattus norvegicus
atcagagtcacaactgtcttgtgag

SEQ ID NO: 178814 - DNA, 25 bp, Rattus norvegicus
atcagagtcacatctgtcttgtgag

SEQ ID NO: 178815 - DNA, 25 bp, Rattus norvegicus
atcagagtcctcagctttgagaggc

SEQ ID NO: 178816 - DNA, 25 bp, Rattus norvegicus
atcagagtcctctgctttgagaggc

SEQ ID NO: 178817 - DNA, 25 bp, Rattus norvegicus
atcagagtggttctccgccagggtt

SEQ ID NO: 178818 - DNA, 25 bp, Rattus norvegicus
atcagagtggttgtccgccagggtt

SEQ ID NO: 178819 - DNA, 25 bp, Rattus norvegicus
atcagatacagcatcattggagttg

SEQ ID NO: 178820 - DNA, 25 bp, Rattus norvegicus
atcagatacagcttcattggagttg

SEQ ID NO: 178821 - DNA, 25 bp, Rattus norvegicus
atcagatacaggagacagcaagaat

SEQ ID NO: 178822 - DNA, 25 bp, Rattus norvegicus
atcagatacaggtgacagcaagaat

SEQ ID NO: 178823 - DNA, 25 bp, Rattus norvegicus
atcagatacatgactctatagtgaa

SEQ ID NO: 178824 - DNA, 25 bp, Rattus norvegicus
atcagatacatgtctctatagtgaa

SEQ ID NO: 178825 - DNA, 25 bp, Rattus norvegicus
atcagatctgcaactcttgtccgtc

SEQ ID NO: 178826 - DNA, 25 bp, Rattus norvegicus
atcagatctgcatctcttgtccgtc

SEQ ID NO: 178827 - DNA, 25 bp, Rattus norvegicus
atcagatctggaaaccgagcttaga

SEQ ID NO: 178828 - DNA, 25 bp, Rattus norvegicus
atcagatctggataccgagcttaga

SEQ ID NO: 178829 - DNA, 25 bp, Rattus norvegicus
atcagatctttcatctacttgggaa

SEQ ID NO: 178830 - DNA, 25 bp, Rattus norvegicus
atcagatctttcttctacttgggaa

SEQ ID NO: 178831 - DNA, 25 bp, Rattus norvegicus
atcagatgatgccacatgtcgcctg

SEQ ID NO: 178832 - DNA, 25 bp, Rattus norvegicus
atcagatgatgcgacatgtcgcctg

SEQ ID NO: 178833 - DNA, 25 bp, Rattus norvegicus
atcagatgcctgcttgtctagcttg

SEQ ID NO: 178834 - DNA, 25 bp, Rattus norvegicus
atcagatgcctggttgtctagcttg

SEQ ID NO: 178835 - DNA, 25 bp, Rattus norvegicus
atcagatgcgcgagaacctggccca

SEQ ID NO: 178836 - DNA, 25 bp, Rattus norvegicus
atcagatgcgcgtgaacctggccca

SEQ ID NO: 178837 - DNA, 25 bp, Rattus norvegicus
atcagatgctgtccttgactgtcct

SEQ ID NO: 178838 - DNA, 25 bp, Rattus norvegicus
atcagatgctgtgcttgactgtcct

SEQ ID NO: 178839 - DNA, 25 bp, Rattus norvegicus
atcagatgtaagctctcaaccccag

SEQ ID NO: 178840 - DNA, 25 bp, Rattus norvegicus
atcagatgtaaggtctcaaccccag

SEQ ID NO: 178841 - DNA, 25 bp, Rattus norvegicus
atcagattcaacctggacccagaga

SEQ ID NO: 178842 - DNA, 25 bp, Rattus norvegicus
atcagattcaacgtggacccagaga

SEQ ID NO: 178843 - DNA, 25 bp, Rattus norvegicus
atcagattctcaaacgacggcttcg

SEQ ID NO: 178844 - DNA, 25 bp, Rattus norvegicus
atcagattctcatacgacggcttcg

SEQ ID NO: 178845 - DNA, 25 bp, Rattus norvegicus
atcagattctcgcactggagcagtg

SEQ ID NO: 178846 - DNA, 25 bp, Rattus norvegicus
atcagattctcggactggagcagtg

SEQ ID NO: 178847 - DNA, 25 bp, Rattus norvegicus
atcagattctctccttcgggttgag

SEQ ID NO: 178848 - DNA, 25 bp, Rattus norvegicus
atcagattctctgcttcgggttgag

SEQ ID NO: 178849 - DNA, 25 bp, Rattus norvegicus
atcagattgtgacactgcttccttg

SEQ ID NO: 178850 - DNA, 25 bp, Rattus norvegicus
atcagattgtgagactgcttccttg

SEQ ID NO: 178851 - DNA, 25 bp, Rattus norvegicus
atcagatttataatcatcccagtga

SEQ ID NO: 178852 - DNA, 25 bp, Rattus norvegicus
atcagatttatattcatcccagtga

SEQ ID NO: 178853 - DNA, 25 bp, Rattus norvegicus
atcagatttctcaggcaacaccaaa

SEQ ID NO: 178854 - DNA, 25 bp, Rattus norvegicus
atcagatttctcctcccatacctat

SEQ ID NO: 178855 - DNA, 25 bp, Rattus norvegicus
atcagatttctcgtcccatacctat

SEQ ID NO: 178856 - DNA, 25 bp, Rattus norvegicus
atcagatttctctggcaacaccaaa

SEQ ID NO: 178857 - DNA, 25 bp, Rattus norvegicus
atcagatttggtatatgggtgtgtc

SEQ ID NO: 178858 - DNA, 25 bp, Rattus norvegicus
atcagatttggtttatgggtgtgtc

SEQ ID NO: 178859 - DNA, 25 bp, Rattus norvegicus
atcagcaaaagccttaccatggtgg

SEQ ID NO: 178860 - DNA, 25 bp, Rattus norvegicus
atcagcaaaagcgttaccatggtgg

SEQ ID NO: 178861 - DNA, 25 bp, Rattus norvegicus
atcagcaaaagtctcatccgcaacg

SEQ ID NO: 178862 - DNA, 25 bp, Rattus norvegicus
atcagcaaaagtgtcatccgcaacg

SEQ ID NO: 178863 - DNA, 25 bp, Rattus norvegicus
atcagcaacgccagtggaaccattg

SEQ ID NO: 178864 - DNA, 25 bp, Rattus norvegicus
atcagcaacgcctgtggaaccattg

SEQ ID NO: 178865 - DNA, 25 bp, Rattus norvegicus
atcagcaactgtctgtcagcttttt

SEQ ID NO: 178866 - DNA, 25 bp, Rattus norvegicus
atcagcaactgtgtgtcagcttttt

SEQ ID NO: 178867 - DNA, 25 bp, Rattus norvegicus
atcagcaagaacatcaagccggccc

SEQ ID NO: 178868 - DNA, 25 bp, Rattus norvegicus
atcagcaagaacttcaagccggccc

SEQ ID NO: 178869 - DNA, 25 bp, Rattus norvegicus
atcagcaagaagcttcgcccagatg

SEQ ID NO: 178870 - DNA, 25 bp, Rattus norvegicus
atcagcaagaaggttcgcccagatg

SEQ ID NO: 178871 - DNA, 25 bp, Rattus norvegicus
atcagcaagctgatccctgagtagt

SEQ ID NO: 178872 - DNA, 25 bp, Rattus norvegicus
atcagcaagctgttccctgagtagt

SEQ ID NO: 178873 - DNA, 25 bp, Rattus norvegicus
atcagcaatcgcactaaatgcatta

SEQ ID NO: 178874 - DNA, 25 bp, Rattus norvegicus
atcagcaatcgctctaaatgcatta

SEQ ID NO: 178875 - DNA, 25 bp, Rattus norvegicus
atcagcaatggtactttcaatggag

SEQ ID NO: 178876 - DNA, 25 bp, Rattus norvegicus
atcagcaatggttctttcaatggag

SEQ ID NO: 178877 - DNA, 25 bp, Rattus norvegicus
atcagcacaagaataaggccagcct

SEQ ID NO: 178878 - DNA, 25 bp, Rattus norvegicus
atcagcacaagattaaggccagcct

SEQ ID NO: 178879 - DNA, 25 bp, Rattus norvegicus
atcagcacccagcttcaaagatctg

SEQ ID NO: 178880 - DNA, 25 bp, Rattus norvegicus
atcagcacccaggttcaaagatctg

SEQ ID NO: 178881 - DNA, 25 bp, Rattus norvegicus
atcagcactgtgacgcttctggaag

SEQ ID NO: 178882 - DNA, 25 bp, Rattus norvegicus
atcagcactgtgtcgcttctggaag

SEQ ID NO: 178883 - DNA, 25 bp, Rattus norvegicus
atcagcagcgtactgacgcgcttca

SEQ ID NO: 178884 - DNA, 25 bp, Rattus norvegicus
atcagcagcgtagtgacgcgcttca

SEQ ID NO: 178885 - DNA, 25 bp, Rattus norvegicus
atcagcagctggacaacatacctaa

SEQ ID NO: 178886 - DNA, 25 bp, Rattus norvegicus
atcagcagctggtcaacatacctaa

SEQ ID NO: 178887 - DNA, 25 bp, Rattus norvegicus
atcagcagtgggaagttcaccctca

SEQ ID NO: 178888 - DNA, 25 bp, Rattus norvegicus
atcagcagtgggtagttcaccctca

SEQ ID NO: 178889 - DNA, 25 bp, Rattus norvegicus
atcagcataggcactttgtttgtat

SEQ ID NO: 178890 - DNA, 25 bp, Rattus norvegicus
atcagcataggctctttgtttgtat

SEQ ID NO: 178891 - DNA, 25 bp, Rattus norvegicus
atcagcatagtaaaacacagtcagt

SEQ ID NO: 178892 - DNA, 25 bp, Rattus norvegicus
atcagcatagtataacacagtcagt

SEQ ID NO: 178893 - DNA, 25 bp, Rattus norvegicus
atcagcatcctacgcttcgtgggct

SEQ ID NO: 178894 - DNA, 25 bp, Rattus norvegicus
atcagcatcctaggcttcgtgggct

SEQ ID NO: 178895 - DNA, 25 bp, Rattus norvegicus
atcagcatcctcatcaagtctgtct

SEQ ID NO: 178896 - DNA, 25 bp, Rattus norvegicus
atcagcatcctcttcaagtctgtct

SEQ ID NO: 178897 - DNA, 25 bp, Rattus norvegicus
atcagcatctgcatcagcatgagcc

SEQ ID NO: 178898 - DNA, 25 bp, Rattus norvegicus
atcagcatctgcttcagcatgagcc

SEQ ID NO: 178899 - DNA, 25 bp, Rattus norvegicus
atcagcatcttcagcatccctggag

SEQ ID NO: 178900 - DNA, 25 bp, Rattus norvegicus
atcagcatcttctgcatccctggag

SEQ ID NO: 178901 - DNA, 25 bp, Rattus norvegicus
atcagcatctttcgggttcaccaca

SEQ ID NO: 178902 - DNA, 25 bp, Rattus norvegicus
atcagcatctttcgtaaccgctggt

SEQ ID NO: 178903 - DNA, 25 bp, Rattus norvegicus
atcagcatctttggggttcaccaca

SEQ ID NO: 178904 - DNA, 25 bp, Rattus norvegicus
atcagcatctttggtaaccgctggt

SEQ ID NO: 178905 - DNA, 25 bp, Rattus norvegicus
atcagcatgactactttattccaaa

SEQ ID NO: 178906 - DNA, 25 bp, Rattus norvegicus
atcagcatgacttctttattccaaa

SEQ ID NO: 178907 - DNA, 25 bp, Rattus norvegicus
atcagcatgcgacatgccggcacat

SEQ ID NO: 178908 - DNA, 25 bp, Rattus norvegicus
atcagcatgcgagatgccggcacat

SEQ ID NO: 178909 - DNA, 25 bp, Rattus norvegicus
atcagcatggcaaaaggcctgacca

SEQ ID NO: 178910 - DNA, 25 bp, Rattus norvegicus
atcagcatggcataaggcctgacca

SEQ ID NO: 178911 - DNA, 25 bp, Rattus norvegicus
atcagcatggcccactacgtgtctg

SEQ ID NO: 178912 - DNA, 25 bp, Rattus norvegicus
atcagcatggccgactacgtgtctg

SEQ ID NO: 178913 - DNA, 25 bp, Rattus norvegicus
atcagcatggtgatctgcataggca

SEQ ID NO: 178914 - DNA, 25 bp, Rattus norvegicus
atcagcatggtgttctgcataggca

SEQ ID NO: 178915 - DNA, 25 bp, Rattus norvegicus
atcagcattaatctctgtttcccac

SEQ ID NO: 178916 - DNA, 25 bp, Rattus norvegicus
atcagcattaatgtctgtttcccac

SEQ ID NO: 178917 - DNA, 25 bp, Rattus norvegicus
atcagcattccaccagcagcatttg

SEQ ID NO: 178918 - DNA, 25 bp, Rattus norvegicus
atcagcattccagcagcagcatttg

SEQ ID NO: 178919 - DNA, 25 bp, Rattus norvegicus
atcagcattttaagcatcccctttg

SEQ ID NO: 178920 - DNA, 25 bp, Rattus norvegicus
atcagcattttatgcatcccctttg

SEQ ID NO: 178921 - DNA, 25 bp, Rattus norvegicus
atcagccacaaaccgccacaaatag

SEQ ID NO: 178922 - DNA, 25 bp, Rattus norvegicus
atcagccacaaagcgccacaaatag

SEQ ID NO: 178923 - DNA, 25 bp, Rattus norvegicus
atcagccacctcagacgtgacaaat

SEQ ID NO: 178924 - DNA, 25 bp, Rattus norvegicus
atcagccacctctgacgtgacaaat

SEQ ID NO: 178925 - DNA, 25 bp, Rattus norvegicus
atcagccactccaaccttgagttga

SEQ ID NO: 178926 - DNA, 25 bp, Rattus norvegicus
atcagccactcctaccttgagttga

SEQ ID NO: 178927 - DNA, 25 bp, Rattus norvegicus
atcagccagaagatgccccgggaat

SEQ ID NO: 178928 - DNA, 25 bp, Rattus norvegicus
atcagccagaagttgccccgggaat

SEQ ID NO: 178929 - DNA, 25 bp, Rattus norvegicus
atcagccagagtagcaggtgggttt

SEQ ID NO: 178930 - DNA, 25 bp, Rattus norvegicus
atcagccagagttgcaggtgggttt

SEQ ID NO: 178931 - DNA, 25 bp, Rattus norvegicus
atcagccagcacagtcatgcttttg

SEQ ID NO: 178932 - DNA, 25 bp, Rattus norvegicus
atcagccagcactgtcatgcttttg

SEQ ID NO: 178933 - DNA, 25 bp, Rattus norvegicus
atcagccagggaacacattcatcgt

SEQ ID NO: 178934 - DNA, 25 bp, Rattus norvegicus
atcagccagggatcacattcatcgt

SEQ ID NO: 178935 - DNA, 25 bp, Rattus norvegicus
atcagccagtccaattttgtgtcca

SEQ ID NO: 178936 - DNA, 25 bp, Rattus norvegicus
atcagccagtcctattttgtgtcca

SEQ ID NO: 178937 - DNA, 25 bp, Rattus norvegicus
atcagccagtggatttagaggtcca

SEQ ID NO: 178938 - DNA, 25 bp, Rattus norvegicus
atcagccagtggttttagaggtcca

SEQ ID NO: 178939 - DNA, 25 bp, Rattus norvegicus
atcagccatcgacgaggcgtcttgc

SEQ ID NO: 178940 - DNA, 25 bp, Rattus norvegicus
atcagccatcgaggaggcgtcttgc

SEQ ID NO: 178941 - DNA, 25 bp, Rattus norvegicus
atcagccatctcatcttcaggaaaa

SEQ ID NO: 178942 - DNA, 25 bp, Rattus norvegicus
atcagccatctcttcttcaggaaaa

SEQ ID NO: 178943 - DNA, 25 bp, Rattus norvegicus
atcagccatgatatctgttaccttg

SEQ ID NO: 178944 - DNA, 25 bp, Rattus norvegicus
atcagccatgatttctgttaccttg

SEQ ID NO: 178945 - DNA, 25 bp, Rattus norvegicus
atcagccatgctaaatgcgcttaac

SEQ ID NO: 178946 - DNA, 25 bp, Rattus norvegicus
atcagccatgcttaatgcgcttaac

SEQ ID NO: 178947 - DNA, 25 bp, Rattus norvegicus
atcagcccaactctgcaagcggatt

SEQ ID NO: 178948 - DNA, 25 bp, Rattus norvegicus
atcagcccaactgtgcaagcggatt

SEQ ID NO: 178949 - DNA, 25 bp, Rattus norvegicus
atcagcccaggtcagagcagtcaga

SEQ ID NO: 178950 - DNA, 25 bp, Rattus norvegicus
atcagcccaggtgagagcagtcaga

SEQ ID NO: 178951 - DNA, 25 bp, Rattus norvegicus
atcagccccattataatttcctaca

SEQ ID NO: 178952 - DNA, 25 bp, Rattus norvegicus
atcagccccattttaatttcctaca

SEQ ID NO: 178953 - DNA, 25 bp, Rattus norvegicus
atcagcccgtgcaggacaggtttct

SEQ ID NO: 178954 - DNA, 25 bp, Rattus norvegicus
atcagcccgtgctggacaggtttct

SEQ ID NO: 178955 - DNA, 25 bp, Rattus norvegicus
atcagcccttctcggcatgttcaga

SEQ ID NO: 178956 - DNA, 25 bp, Rattus norvegicus
atcagcccttctgggcatgttcaga

SEQ ID NO: 178957 - DNA, 25 bp, Rattus norvegicus
atcagcccttggagtcactgagatg

SEQ ID NO: 178958 - DNA, 25 bp, Rattus norvegicus
atcagcccttggtgtcactgagatg

SEQ ID NO: 178959 - DNA, 25 bp, Rattus norvegicus
atcagccgaggccatgtccaggtgc

SEQ ID NO: 178960 - DNA, 25 bp, Rattus norvegicus
atcagccgaggcgatgtccaggtgc

SEQ ID NO: 178961 - DNA, 25 bp, Rattus norvegicus
atcagccggcaaatatgggaggagt

SEQ ID NO: 178962 - DNA, 25 bp, Rattus norvegicus
atcagccggcaattatgggaggagt

SEQ ID NO: 178963 - DNA, 25 bp, Rattus norvegicus
atcagcctcaacagctttgcggtga

SEQ ID NO: 178964 - DNA, 25 bp, Rattus norvegicus
atcagcctcaactgctttgcggtga

SEQ ID NO: 178965 - DNA, 25 bp, Rattus norvegicus
atcagcctcagtctgtctctgttct

SEQ ID NO: 178966 - DNA, 25 bp, Rattus norvegicus
atcagcctcagtgtgtctctgttct

SEQ ID NO: 178967 - DNA, 25 bp, Rattus norvegicus
atcagcctcctaatctctagagtat

SEQ ID NO: 178968 - DNA, 25 bp, Rattus norvegicus
atcagcctcctattctctagagtat

SEQ ID NO: 178969 - DNA, 25 bp, Rattus norvegicus
atcagcctcctgaagggacagtcac

SEQ ID NO: 178970 - DNA, 25 bp, Rattus norvegicus
atcagcctcctgtagggacagtcac

SEQ ID NO: 178971 - DNA, 25 bp, Rattus norvegicus
atcagcctctaccaaggagcctagg

SEQ ID NO: 178972 - DNA, 25 bp, Rattus norvegicus
atcagcctctacgaaggagcctagg

SEQ ID NO: 178973 - DNA, 25 bp, Rattus norvegicus
atcagcctctgaaattgcaactaag

SEQ ID NO: 178974 - DNA, 25 bp, Rattus norvegicus
atcagcctctgatattgcaactaag

SEQ ID NO: 178975 - DNA, 25 bp, Rattus norvegicus
atcagcctctggatttcctgttatc

SEQ ID NO: 178976 - DNA, 25 bp, Rattus norvegicus
atcagcctctggttttcctgttatc

SEQ ID NO: 178977 - DNA, 25 bp, Rattus norvegicus
atcagcctgcccaaaaggagcatta

SEQ ID NO: 178978 - DNA, 25 bp, Rattus norvegicus
atcagcctgccctaaaggagcatta

SEQ ID NO: 178979 - DNA, 25 bp, Rattus norvegicus
atcagcctgctgctagaagccgtca

SEQ ID NO: 178980 - DNA, 25 bp, Rattus norvegicus
atcagcctgctggtagaagccgtca

SEQ ID NO: 178981 - DNA, 25 bp, Rattus norvegicus
atcagcctgtcgaggacttggtcat

SEQ ID NO: 178982 - DNA, 25 bp, Rattus norvegicus
atcagcctgtcgtggacttggtcat

SEQ ID NO: 178983 - DNA, 25 bp, Rattus norvegicus
atcagcctgttcatattgtcagcca

SEQ ID NO: 178984 - DNA, 25 bp, Rattus norvegicus
atcagcctgttcttattgtcagcca

SEQ ID NO: 178985 - DNA, 25 bp, Rattus norvegicus
atcagccttcttcctgggatcagcc

SEQ ID NO: 178986 - DNA, 25 bp, Rattus norvegicus
atcagccttcttgctgggatcagcc

SEQ ID NO: 178987 - DNA, 25 bp, Rattus norvegicus
atcagccttggcagatgtccaacac

SEQ ID NO: 178988 - DNA, 25 bp, Rattus norvegicus
atcagccttggcctacctaaaacag

SEQ ID NO: 178989 - DNA, 25 bp, Rattus norvegicus
atcagccttggcgtacctaaaacag

SEQ ID NO: 178990 - DNA, 25 bp, Rattus norvegicus
atcagccttggctgatgtccaacac

SEQ ID NO: 178991 - DNA, 25 bp, Rattus norvegicus
atcagcctttgcacagaggttgttt

SEQ ID NO: 178992 - DNA, 25 bp, Rattus norvegicus
atcagcctttgctcagaggttgttt

SEQ ID NO: 178993 - DNA, 25 bp, Rattus norvegicus
atcagcgaattcacaccggcgagaa

SEQ ID NO: 178994 - DNA, 25 bp, Rattus norvegicus
atcagcgaattctcaccggcgagaa

SEQ ID NO: 178995 - DNA, 25 bp, Rattus norvegicus
atcagcgaccatattcctgtggaag

SEQ ID NO: 178996 - DNA, 25 bp, Rattus norvegicus
atcagcgaccattttcctgtggaag

SEQ ID NO: 178997 - DNA, 25 bp, Rattus norvegicus
atcagcgacctcattgtacctaaag

SEQ ID NO: 178998 - DNA, 25 bp, Rattus norvegicus
atcagcgacctctttgtacctaaag

SEQ ID NO: 178999 - DNA, 25 bp, Rattus norvegicus
atcagcgagattatccgcatgccac

SEQ ID NO: 179000 - DNA, 25 bp, Rattus norvegicus
atcagcgagattttccgcatgccac

SEQ ID NO: 179001 - DNA, 25 bp, Rattus norvegicus
atcagcgaggtcatagttacttgtt

SEQ ID NO: 179002 - DNA, 25 bp, Rattus norvegicus
atcagcgaggtcttagttacttgtt

SEQ ID NO: 179003 - DNA, 25 bp, Rattus norvegicus
atcagcgcgcttcctttgagggtga

SEQ ID NO: 179004 - DNA, 25 bp, Rattus norvegicus
atcagcgcgcttgctttgagggtga

SEQ ID NO: 179005 - DNA, 25 bp, Rattus norvegicus
atcagcgctcctctttaggcaaagt

SEQ ID NO: 179006 - DNA, 25 bp, Rattus norvegicus
atcagcgctcctgtttaggcaaagt

SEQ ID NO: 179007 - DNA, 25 bp, Rattus norvegicus
atcagcgctgctagtaaccgcgaag

SEQ ID NO: 179008 - DNA, 25 bp, Rattus norvegicus
atcagcgctgcttgtaaccgcgaag

SEQ ID NO: 179009 - DNA, 25 bp, Rattus norvegicus
atcagcgcttctctacgcagtacat

SEQ ID NO: 179010 - DNA, 25 bp, Rattus norvegicus
atcagcgcttctgtacgcagtacat

SEQ ID NO: 179011 - DNA, 25 bp, Rattus norvegicus
atcagcggcagcacagtgtgtcctg

SEQ ID NO: 179012 - DNA, 25 bp, Rattus norvegicus
atcagcggcagctcagtgtgtcctg

SEQ ID NO: 179013 - DNA, 25 bp, Rattus norvegicus
atcagcggcctgagtccagtcagca

SEQ ID NO: 179014 - DNA, 25 bp, Rattus norvegicus
atcagcggcctgtgtccagtcagca

SEQ ID NO: 179015 - DNA, 25 bp, Rattus norvegicus
atcagcggctgcatcactggtggag

SEQ ID NO: 179016 - DNA, 25 bp, Rattus norvegicus
atcagcggctgcttcactggtggag

SEQ ID NO: 179017 - DNA, 25 bp, Rattus norvegicus
atcagcgggtgaatcctgagttgac

SEQ ID NO: 179018 - DNA, 25 bp, Rattus norvegicus
atcagcgggtgattcctgagttgac

SEQ ID NO: 179019 - DNA, 25 bp, Rattus norvegicus
atcagcggtctgatactggaaggct

SEQ ID NO: 179020 - DNA, 25 bp, Rattus norvegicus
atcagcggtctgttactggaaggct

SEQ ID NO: 179021 - DNA, 25 bp, Rattus norvegicus
atcagcgtaaatacacgtgctctgt

SEQ ID NO: 179022 - DNA, 25 bp, Rattus norvegicus
atcagcgtaaattcacgtgctctgt

SEQ ID NO: 179023 - DNA, 25 bp, Rattus norvegicus
atcagcgtccgtcttcttgtgggct

SEQ ID NO: 179024 - DNA, 25 bp, Rattus norvegicus
atcagcgtccgtgttcttgtgggct

SEQ ID NO: 179025 - DNA, 25 bp, Rattus norvegicus
atcagcgtcgtcaccgtcttggtca

SEQ ID NO: 179026 - DNA, 25 bp, Rattus norvegicus
atcagcgtcgtctccgtcttggtca

SEQ ID NO: 179027 - DNA, 25 bp, Rattus norvegicus
atcagcgtgaggcaatgtgttttaa

SEQ ID NO: 179028 - DNA, 25 bp, Rattus norvegicus
atcagcgtgagggaatgtgttttaa

SEQ ID NO: 179029 - DNA, 25 bp, Rattus norvegicus
atcagcgtgctgatccttttaatac

SEQ ID NO: 179030 - DNA, 25 bp, Rattus norvegicus
atcagcgtgctgttccttttaatac

SEQ ID NO: 179031 - DNA, 25 bp, Rattus norvegicus
atcagctaacccaggcattcttgtg

SEQ ID NO: 179032 - DNA, 25 bp, Rattus norvegicus
atcagctaaccctggcattcttgtg

SEQ ID NO: 179033 - DNA, 25 bp, Rattus norvegicus
atcagctaccgcctagcggagcagc

SEQ ID NO: 179034 - DNA, 25 bp, Rattus norvegicus
atcagctaccgcgtagcggagcagc

SEQ ID NO: 179035 - DNA, 25 bp, Rattus norvegicus
atcagctacttcagtgggacttcag

SEQ ID NO: 179036 - DNA, 25 bp, Rattus norvegicus
atcagctacttctgtgggacttcag

SEQ ID NO: 179037 - DNA, 25 bp, Rattus norvegicus
atcagctatgagcaccttttctccg

SEQ ID NO: 179038 - DNA, 25 bp, Rattus norvegicus
atcagctatgaggaccttttctccg

SEQ ID NO: 179039 - DNA, 25 bp, Rattus norvegicus
atcagctatgtacttgaccttgtta

SEQ ID NO: 179040 - DNA, 25 bp, Rattus norvegicus
atcagctatgtagttgaccttgtta

SEQ ID NO: 179041 - DNA, 25 bp, Rattus norvegicus
atcagctcaaggcatccaggttggc

SEQ ID NO: 179042 - DNA, 25 bp, Rattus norvegicus
atcagctcaagggatccaggttggc

SEQ ID NO: 179043 - DNA, 25 bp, Rattus norvegicus
atcagctcacacaggcttcatgata

SEQ ID NO: 179044 - DNA, 25 bp, Rattus norvegicus
atcagctcacactggcttcatgata

SEQ ID NO: 179045 - DNA, 25 bp, Rattus norvegicus
atcagctcagagaagtcggtggccg

SEQ ID NO: 179046 - DNA, 25 bp, Rattus norvegicus
atcagctcagagtagtcggtggccg

SEQ ID NO: 179047 - DNA, 25 bp, Rattus norvegicus
atcagctcatcgatggcactgtgca

SEQ ID NO: 179048 - DNA, 25 bp, Rattus norvegicus
atcagctcatcgttggcactgtgca

SEQ ID NO: 179049 - DNA, 25 bp, Rattus norvegicus
atcagctcccacctcaagggatggg

SEQ ID NO: 179050 - DNA, 25 bp, Rattus norvegicus
atcagctcccacgtcaagggatggg

SEQ ID NO: 179051 - DNA, 25 bp, Rattus norvegicus
atcagctccctactactttatatta

SEQ ID NO: 179052 - DNA, 25 bp, Rattus norvegicus
atcagctccctagtactttatatta

SEQ ID NO: 179053 - DNA, 25 bp, Rattus norvegicus
atcagctccctcagtgtaccaaaga

SEQ ID NO: 179054 - DNA, 25 bp, Rattus norvegicus
atcagctccctccaagaactttaga

SEQ ID NO: 179055 - DNA, 25 bp, Rattus norvegicus
atcagctccctcgaagaactttaga

SEQ ID NO: 179056 - DNA, 25 bp, Rattus norvegicus
atcagctccctctgtgtaccaaaga

SEQ ID NO: 179057 - DNA, 25 bp, Rattus norvegicus
atcagctccgttcggtaacataccg

SEQ ID NO: 179058 - DNA, 25 bp, Rattus norvegicus
atcagctccgttgggtaacataccg

SEQ ID NO: 179059 - DNA, 25 bp, Rattus norvegicus
atcagctccttgagactccaaataa

SEQ ID NO: 179060 - DNA, 25 bp, Rattus norvegicus
atcagctccttgtgactccaaataa

SEQ ID NO: 179061 - DNA, 25 bp, Rattus norvegicus
atcagctcgtgtcactcaagggtta

SEQ ID NO: 179062 - DNA, 25 bp, Rattus norvegicus
atcagctcgtgtctcgcctgcttcg

SEQ ID NO: 179063 - DNA, 25 bp, Rattus norvegicus
atcagctcgtgtgactcaagggtta

SEQ ID NO: 179064 - DNA, 25 bp, Rattus norvegicus
atcagctcgtgtgtcgcctgcttcg

SEQ ID NO: 179065 - DNA, 25 bp, Rattus norvegicus
atcagctctatgacttctcagttat

SEQ ID NO: 179066 - DNA, 25 bp, Rattus norvegicus
atcagctctatgtcttctcagttat

SEQ ID NO: 179067 - DNA, 25 bp, Rattus norvegicus
atcagctctctgaaagtggaccaat

SEQ ID NO: 179068 - DNA, 25 bp, Rattus norvegicus
atcagctctctgtaagtggaccaat

SEQ ID NO: 179069 - DNA, 25 bp, Rattus norvegicus
atcagctgaaggatgcctgtcgaaa

SEQ ID NO: 179070 - DNA, 25 bp, Rattus norvegicus
atcagctgaaggttgcctgtcgaaa

SEQ ID NO: 179071 - DNA, 25 bp, Rattus norvegicus
atcagctgagctactggttccattt

SEQ ID NO: 179072 - DNA, 25 bp, Rattus norvegicus
atcagctgagcttctggttccattt

SEQ ID NO: 179073 - DNA, 25 bp, Rattus norvegicus
atcagctgaggcaagccagttggaa

SEQ ID NO: 179074 - DNA, 25 bp, Rattus norvegicus
atcagctgaggctagccagttggaa

SEQ ID NO: 179075 - DNA, 25 bp, Rattus norvegicus
atcagctgagtgagttcagcctgta

SEQ ID NO: 179076 - DNA, 25 bp, Rattus norvegicus
atcagctgagtgtgttcagcctgta

SEQ ID NO: 179077 - DNA, 25 bp, Rattus norvegicus
atcagctgcctgacgtgtaagtcac

SEQ ID NO: 179078 - DNA, 25 bp, Rattus norvegicus
atcagctgcctgtcgtgtaagtcac

SEQ ID NO: 179079 - DNA, 25 bp, Rattus norvegicus
atcagctggagtacactgtgccacc

SEQ ID NO: 179080 - DNA, 25 bp, Rattus norvegicus
atcagctggagttcactgtgccacc

SEQ ID NO: 179081 - DNA, 25 bp, Rattus norvegicus
atcagctggccacaggatccacttg

SEQ ID NO: 179082 - DNA, 25 bp, Rattus norvegicus
atcagctggccagaggatccacttg

SEQ ID NO: 179083 - DNA, 25 bp, Rattus norvegicus
atcagctgggatcgcaccactagtc

SEQ ID NO: 179084 - DNA, 25 bp, Rattus norvegicus
atcagctgggatggcaccactagtc

SEQ ID NO: 179085 - DNA, 25 bp, Rattus norvegicus
atcagctgggctctgcacagggcaa

SEQ ID NO: 179086 - DNA, 25 bp, Rattus norvegicus
atcagctgggctgtgcacagggcaa

SEQ ID NO: 179087 - DNA, 25 bp, Rattus norvegicus
atcagctgtgatccgcttggtatac

SEQ ID NO: 179088 - DNA, 25 bp, Rattus norvegicus
atcagctgtgatcggctcctgcaag

SEQ ID NO: 179089 - DNA, 25 bp, Rattus norvegicus
atcagctgtgatgcgcttggtatac

SEQ ID NO: 179090 - DNA, 25 bp, Rattus norvegicus
atcagctgtgatgggctcctgcaag

SEQ ID NO: 179091 - DNA, 25 bp, Rattus norvegicus
atcagctgtgccatcttcctctggg

SEQ ID NO: 179092 - DNA, 25 bp, Rattus norvegicus
atcagctgtgccttcttcctctggg

SEQ ID NO: 179093 - DNA, 25 bp, Rattus norvegicus
atcagctgttgcaggcagtgtctta

SEQ ID NO: 179094 - DNA, 25 bp, Rattus norvegicus
atcagctgttgctggcagtgtctta

SEQ ID NO: 179095 - DNA, 25 bp, Rattus norvegicus
atcagcttacaactgcctttgggtc

SEQ ID NO: 179096 - DNA, 25 bp, Rattus norvegicus
atcagcttacaagtgcctttgggtc

SEQ ID NO: 179097 - DNA, 25 bp, Rattus norvegicus
atcagcttacggaatggtcgtctct

SEQ ID NO: 179098 - DNA, 25 bp, Rattus norvegicus
atcagcttacggtatggtcgtctct

SEQ ID NO: 179099 - DNA, 25 bp, Rattus norvegicus
atcagcttactgattaatgcctaag

SEQ ID NO: 179100 - DNA, 25 bp, Rattus norvegicus
atcagcttactgtttaatgcctaag

SEQ ID NO: 179101 - DNA, 25 bp, Rattus norvegicus
atcagcttcggtcaacgtttgcccc

SEQ ID NO: 179102 - DNA, 25 bp, Rattus norvegicus
atcagcttcggtgaacgtttgcccc

SEQ ID NO: 179103 - DNA, 25 bp, Rattus norvegicus
atcagcttctaccacaggcaaggaa

SEQ ID NO: 179104 - DNA, 25 bp, Rattus norvegicus
atcagcttctacgacaggcaaggaa

SEQ ID NO: 179105 - DNA, 25 bp, Rattus norvegicus
atcagcttctctcatgtaaccatgt

SEQ ID NO: 179106 - DNA, 25 bp, Rattus norvegicus
atcagcttctctctgggtctctgca

SEQ ID NO: 179107 - DNA, 25 bp, Rattus norvegicus
atcagcttctctgatgtaaccatgt

SEQ ID NO: 179108 - DNA, 25 bp, Rattus norvegicus
atcagcttctctgtgggtctctgca

SEQ ID NO: 179109 - DNA, 25 bp, Rattus norvegicus
atcagcttctgcactgtctatatag

SEQ ID NO: 179110 - DNA, 25 bp, Rattus norvegicus
atcagcttctgctctgtctatatag

SEQ ID NO: 179111 - DNA, 25 bp, Rattus norvegicus
atcagcttctggacttttctcttta

SEQ ID NO: 179112 - DNA, 25 bp, Rattus norvegicus
atcagcttctggtcttttctcttta

SEQ ID NO: 179113 - DNA, 25 bp, Rattus norvegicus
atcagcttctgtaagccagtctttg

SEQ ID NO: 179114 - DNA, 25 bp, Rattus norvegicus
atcagcttctgttagccagtctttg

SEQ ID NO: 179115 - DNA, 25 bp, Rattus norvegicus
atcagcttgcctctagttgggacgt

SEQ ID NO: 179116 - DNA, 25 bp, Rattus norvegicus
atcagcttgcctgtagttgggacgt

SEQ ID NO: 179117 - DNA, 25 bp, Rattus norvegicus
atcagcttgcttacatggtcgctag

SEQ ID NO: 179118 - DNA, 25 bp, Rattus norvegicus
atcagcttgctttcatggtcgctag

SEQ ID NO: 179119 - DNA, 25 bp, Rattus norvegicus
atcagctttgataccaccttcatgt

SEQ ID NO: 179120 - DNA, 25 bp, Rattus norvegicus
atcagctttgattccaccttcatgt

SEQ ID NO: 179121 - DNA, 25 bp, Rattus norvegicus
atcagctttgccatagatgccttgg

SEQ ID NO: 179122 - DNA, 25 bp, Rattus norvegicus
atcagctttgccttagatgccttgg

SEQ ID NO: 179123 - DNA, 25 bp, Rattus norvegicus
atcaggaaatggaataaacgggctt

SEQ ID NO: 179124 - DNA, 25 bp, Rattus norvegicus
atcaggaaatggtataaacgggctt

SEQ ID NO: 179125 - DNA, 25 bp, Rattus norvegicus
atcaggaacttcatctactcgagct

SEQ ID NO: 179126 - DNA, 25 bp, Rattus norvegicus
atcaggaacttcttctactcgagct

SEQ ID NO: 179127 - DNA, 25 bp, Rattus norvegicus
atcaggaagcctctttcgcaaaaga

SEQ ID NO: 179128 - DNA, 25 bp, Rattus norvegicus
atcaggaagcctgtttcgcaaaaga

SEQ ID NO: 179129 - DNA, 25 bp, Rattus norvegicus
atcaggaaggacacatccacacctc

SEQ ID NO: 179130 - DNA, 25 bp, Rattus norvegicus
atcaggaaggactcatccacacctc

SEQ ID NO: 179131 - DNA, 25 bp, Rattus norvegicus
atcaggaagtagacacctctctcag

SEQ ID NO: 179132 - DNA, 25 bp, Rattus norvegicus
atcaggaagtagtcacctctctcag

SEQ ID NO: 179133 - DNA, 25 bp, Rattus norvegicus
atcaggacactgcagctgctcatgt

SEQ ID NO: 179134 - DNA, 25 bp, Rattus norvegicus
atcaggacactggagctgctcatgt

SEQ ID NO: 179135 - DNA, 25 bp, Rattus norvegicus
atcaggacccatcctggagctccat

SEQ ID NO: 179136 - DNA, 25 bp, Rattus norvegicus
atcaggacccatgctggagctccat

SEQ ID NO: 179137 - DNA, 25 bp, Rattus norvegicus
atcaggagaactactgggtgcatca

SEQ ID NO: 179138 - DNA, 25 bp, Rattus norvegicus
atcaggagaacttctgggtgcatca

SEQ ID NO: 179139 - DNA, 25 bp, Rattus norvegicus
atcaggagagaaatccacagacttt

SEQ ID NO: 179140 - DNA, 25 bp, Rattus norvegicus
atcaggagagaattccacagacttt

SEQ ID NO: 179141 - DNA, 25 bp, Rattus norvegicus
atcaggagcccaagttgttgtcaag

SEQ ID NO: 179142 - DNA, 25 bp, Rattus norvegicus
atcaggagcccatgttgttgtcaag

SEQ ID NO: 179143 - DNA, 25 bp, Rattus norvegicus
atcaggaggatccagttcagggcca

SEQ ID NO: 179144 - DNA, 25 bp, Rattus norvegicus
atcaggaggatcgagttcagggcca

SEQ ID NO: 179145 - DNA, 25 bp, Rattus norvegicus
atcaggagtcttctaagtcttctag

SEQ ID NO: 179146 - DNA, 25 bp, Rattus norvegicus
atcaggagtcttgtaagtcttctag

SEQ ID NO: 179147 - DNA, 25 bp, Rattus norvegicus
atcaggagtttgctcagcttctggc

SEQ ID NO: 179148 - DNA, 25 bp, Rattus norvegicus
atcaggagtttggtcagcttctggc

SEQ ID NO: 179149 - DNA, 25 bp, Rattus norvegicus
atcaggatacctcctgtacctacct

SEQ ID NO: 179150 - DNA, 25 bp, Rattus norvegicus
atcaggatacctgctgtacctacct

SEQ ID NO: 179151 - DNA, 25 bp, Rattus norvegicus
atcaggatatccaagtccccgtgaa

SEQ ID NO: 179152 - DNA, 25 bp, Rattus norvegicus
atcaggatatcctagtccccgtgaa

SEQ ID NO: 179153 - DNA, 25 bp, Rattus norvegicus
atcaggatcatcaacaggaccagct

SEQ ID NO: 179154 - DNA, 25 bp, Rattus norvegicus
atcaggatcatctacaggaccagct

SEQ ID NO: 179155 - DNA, 25 bp, Rattus norvegicus
atcaggatctaccagcgagaggact

SEQ ID NO: 179156 - DNA, 25 bp, Rattus norvegicus
atcaggatctacgagcgagaggact

SEQ ID NO: 179157 - DNA, 25 bp, Rattus norvegicus
atcaggatgagcctccttttagcag

SEQ ID NO: 179158 - DNA, 25 bp, Rattus norvegicus
atcaggatgagcgtccttttagcag

SEQ ID NO: 179159 - DNA, 25 bp, Rattus norvegicus
atcaggatgcacagaccgacccatg

SEQ ID NO: 179160 - DNA, 25 bp, Rattus norvegicus
atcaggatgcactgaccgacccatg

SEQ ID NO: 179161 - DNA, 25 bp, Rattus norvegicus
atcaggcacatgaccctgaaacctc

SEQ ID NO: 179162 - DNA, 25 bp, Rattus norvegicus
atcaggcacatgtccctgaaacctc

SEQ ID NO: 179163 - DNA, 25 bp, Rattus norvegicus
atcaggcactagatttagacgttta

SEQ ID NO: 179164 - DNA, 25 bp, Rattus norvegicus
atcaggcactagttttagacgttta

SEQ ID NO: 179165 - DNA, 25 bp, Rattus norvegicus
atcaggcactggacagggttactct

SEQ ID NO: 179166 - DNA, 25 bp, Rattus norvegicus
atcaggcactggtcagggttactct

SEQ ID NO: 179167 - DNA, 25 bp, Rattus norvegicus
atcaggcacttgctgccaggccaaa

SEQ ID NO: 179168 - DNA, 25 bp, Rattus norvegicus
atcaggcacttggtgccaggccaaa

SEQ ID NO: 179169 - DNA, 25 bp, Rattus norvegicus
atcaggcactttcacccttctaagg

SEQ ID NO: 179170 - DNA, 25 bp, Rattus norvegicus
atcaggcactttgacccttctaagg

SEQ ID NO: 179171 - DNA, 25 bp, Rattus norvegicus
atcaggcagccaacgaccgggtgac

SEQ ID NO: 179172 - DNA, 25 bp, Rattus norvegicus
atcaggcagccatcgaccgggtgac

SEQ ID NO: 179173 - DNA, 25 bp, Rattus norvegicus
atcaggcagctgatttgaggatcct

SEQ ID NO: 179174 - DNA, 25 bp, Rattus norvegicus
atcaggcagctgttttgaggatcct

SEQ ID NO: 179175 - DNA, 25 bp, Rattus norvegicus
atcaggcaggcacatggtacccaga

SEQ ID NO: 179176 - DNA, 25 bp, Rattus norvegicus
atcaggcaggcagatggtacccaga

SEQ ID NO: 179177 - DNA, 25 bp, Rattus norvegicus
atcaggcagtttacaccttggagca

SEQ ID NO: 179178 - DNA, 25 bp, Rattus norvegicus
atcaggcagttttcaccttggagca

SEQ ID NO: 179179 - DNA, 25 bp, Rattus norvegicus
atcaggcatcacctagttttccctc

SEQ ID NO: 179180 - DNA, 25 bp, Rattus norvegicus
atcaggcatcacgtagttttccctc

SEQ ID NO: 179181 - DNA, 25 bp, Rattus norvegicus
atcaggcattctaatttcttccaaa

SEQ ID NO: 179182 - DNA, 25 bp, Rattus norvegicus
atcaggcattcttatttcttccaaa

SEQ ID NO: 179183 - DNA, 25 bp, Rattus norvegicus
atcaggcattgtccctcttgaggaa

SEQ ID NO: 179184 - DNA, 25 bp, Rattus norvegicus
atcaggcattgtgcctcttgaggaa

SEQ ID NO: 179185 - DNA, 25 bp, Rattus norvegicus
atcaggccacagacatggcgcgtag

SEQ ID NO: 179186 - DNA, 25 bp, Rattus norvegicus
atcaggccacagtcatggcgcgtag

SEQ ID NO: 179187 - DNA, 25 bp, Rattus norvegicus
atcaggcccatcctgaggtgcccta

SEQ ID NO: 179188 - DNA, 25 bp, Rattus norvegicus
atcaggcccatcgtgaggtgcccta

SEQ ID NO: 179189 - DNA, 25 bp, Rattus norvegicus
atcaggcccattaacctacaatcat

SEQ ID NO: 179190 - DNA, 25 bp, Rattus norvegicus
atcaggcccatttacctacaatcat

SEQ ID NO: 179191 - DNA, 25 bp, Rattus norvegicus
atcaggccctcaaagaacattcagt

SEQ ID NO: 179192 - DNA, 25 bp, Rattus norvegicus
atcaggccctcatagaacattcagt

SEQ ID NO: 179193 - DNA, 25 bp, Rattus norvegicus
atcaggcctagacgagtccacagtc

SEQ ID NO: 179194 - DNA, 25 bp, Rattus norvegicus
atcaggcctagaggagtccacagtc

SEQ ID NO: 179195 - DNA, 25 bp, Rattus norvegicus
atcaggcctgaacttgacgtgcgca

SEQ ID NO: 179196 - DNA, 25 bp, Rattus norvegicus
atcaggcctgaagttgacgtgcgca

SEQ ID NO: 179197 - DNA, 25 bp, Rattus norvegicus
atcaggctagccacaatctcataga

SEQ ID NO: 179198 - DNA, 25 bp, Rattus norvegicus
atcaggctagcctcaatctcataga

SEQ ID NO: 179199 - DNA, 25 bp, Rattus norvegicus
atcaggctctgtacatacgcagtgt

SEQ ID NO: 179200 - DNA, 25 bp, Rattus norvegicus
atcaggctctgttcatacgcagtgt

SEQ ID NO: 179201 - DNA, 25 bp, Rattus norvegicus
atcaggctgagtcgttcgaggacta

SEQ ID NO: 179202 - DNA, 25 bp, Rattus norvegicus
atcaggctgagtggttcgaggacta

SEQ ID NO: 179203 - DNA, 25 bp, Rattus norvegicus
atcaggctgggcaacgtgccaaaag

SEQ ID NO: 179204 - DNA, 25 bp, Rattus norvegicus
atcaggctgggctacgtgccaaaag

SEQ ID NO: 179205 - DNA, 25 bp, Rattus norvegicus
atcaggctgtacactgggaccagta

SEQ ID NO: 179206 - DNA, 25 bp, Rattus norvegicus
atcaggctgtactctgggaccagta

SEQ ID NO: 179207 - DNA, 25 bp, Rattus norvegicus
atcaggctgttcattcatgtatgta

SEQ ID NO: 179208 - DNA, 25 bp, Rattus norvegicus
atcaggctgttctttcatgtatgta

SEQ ID NO: 179209 - DNA, 25 bp, Rattus norvegicus
atcaggcttccacaatagtttccag

SEQ ID NO: 179210 - DNA, 25 bp, Rattus norvegicus
atcaggcttccagaatagtttccag

SEQ ID NO: 179211 - DNA, 25 bp, Rattus norvegicus
atcaggcttgccctgtggtatcctt

SEQ ID NO: 179212 - DNA, 25 bp, Rattus norvegicus
atcaggcttgccgtgtggtatcctt

SEQ ID NO: 179213 - DNA, 25 bp, Rattus norvegicus
atcaggctttgcattagctcggaca

SEQ ID NO: 179214 - DNA, 25 bp, Rattus norvegicus
atcaggctttgctttagctcggaca

SEQ ID NO: 179215 - DNA, 25 bp, Rattus norvegicus
atcagggagcgcagcccaacaggcc

SEQ ID NO: 179216 - DNA, 25 bp, Rattus norvegicus
atcagggagcgctgcccaacaggcc

SEQ ID NO: 179217 - DNA, 25 bp, Rattus norvegicus
atcagggagggcctccttccatttt

SEQ ID NO: 179218 - DNA, 25 bp, Rattus norvegicus
atcagggagggcgtccttccatttt

SEQ ID NO: 179219 - DNA, 25 bp, Rattus norvegicus
atcagggatgcccagttgccaaggc

SEQ ID NO: 179220 - DNA, 25 bp, Rattus norvegicus
atcagggatgccgagttgccaaggc

SEQ ID NO: 179221 - DNA, 25 bp, Rattus norvegicus
atcagggccactcctttaacaggaa

SEQ ID NO: 179222 - DNA, 25 bp, Rattus norvegicus
atcagggccactgctttaacaggaa

SEQ ID NO: 179223 - DNA, 25 bp, Rattus norvegicus
atcagggcccgtccttagaatgtca

SEQ ID NO: 179224 - DNA, 25 bp, Rattus norvegicus
atcagggcccgtgcttagaatgtca

SEQ ID NO: 179225 - DNA, 25 bp, Rattus norvegicus
atcagggccttcactgtagattgct

SEQ ID NO: 179226 - DNA, 25 bp, Rattus norvegicus
atcagggccttctctgtagattgct

SEQ ID NO: 179227 - DNA, 25 bp, Rattus norvegicus
atcagggctgatattgaacttatct

SEQ ID NO: 179228 - DNA, 25 bp, Rattus norvegicus
atcagggctgattttgaacttatct

SEQ ID NO: 179229 - DNA, 25 bp, Rattus norvegicus
atcagggcttccacacagttattta

SEQ ID NO: 179230 - DNA, 25 bp, Rattus norvegicus
atcagggcttcctcacagttattta

SEQ ID NO: 179231 - DNA, 25 bp, Rattus norvegicus
atcagggtactcatgggctggatcc

SEQ ID NO: 179232 - DNA, 25 bp, Rattus norvegicus
atcagggtactcttgggctggatcc

SEQ ID NO: 179233 - DNA, 25 bp, Rattus norvegicus
atcagggtcataaaaatcattcata

SEQ ID NO: 179234 - DNA, 25 bp, Rattus norvegicus
atcagggtcatataaatcattcata

SEQ ID NO: 179235 - DNA, 25 bp, Rattus norvegicus
atcagggtgaggacagcccacgtgc

SEQ ID NO: 179236 - DNA, 25 bp, Rattus norvegicus
atcagggtgaggtcagcccacgtgc

SEQ ID NO: 179237 - DNA, 25 bp, Rattus norvegicus
atcagggtgcatattcagttctaac

SEQ ID NO: 179238 - DNA, 25 bp, Rattus norvegicus
atcagggtgcattttcagttctaac

SEQ ID NO: 179239 - DNA, 25 bp, Rattus norvegicus
atcagggtggtgaacttggtgtctt

SEQ ID NO: 179240 - DNA, 25 bp, Rattus norvegicus
atcagggtggtgtacttggtgtctt

SEQ ID NO: 179241 - DNA, 25 bp, Rattus norvegicus
atcagggtgttgatccttctagaaa

SEQ ID NO: 179242 - DNA, 25 bp, Rattus norvegicus
atcagggtgttgttccttctagaaa

SEQ ID NO: 179243 - DNA, 25 bp, Rattus norvegicus
atcagggttacacgcaacctcagtg

SEQ ID NO: 179244 - DNA, 25 bp, Rattus norvegicus
atcagggttacaggcaacctcagtg

SEQ ID NO: 179245 - DNA, 25 bp, Rattus norvegicus
atcagggttattcttggccactact

SEQ ID NO: 179246 - DNA, 25 bp, Rattus norvegicus
atcagggttattgttggccactact

SEQ ID NO: 179247 - DNA, 25 bp, Rattus norvegicus
atcagggtttctagtgcccttctgc

SEQ ID NO: 179248 - DNA, 25 bp, Rattus norvegicus
atcagggtttcttgtgcccttctgc

SEQ ID NO: 179249 - DNA, 25 bp, Rattus norvegicus
atcaggtactatccaatccaattgt

SEQ ID NO: 179250 - DNA, 25 bp, Rattus norvegicus
atcaggtactatgcaatccaattgt

SEQ ID NO: 179251 - DNA, 25 bp, Rattus norvegicus
atcaggtacttcagccttcggaaat

SEQ ID NO: 179252 - DNA, 25 bp, Rattus norvegicus
atcaggtacttctgccttcggaaat

SEQ ID NO: 179253 - DNA, 25 bp, Rattus norvegicus
atcaggtattggctgacagctccct

SEQ ID NO: 179254 - DNA, 25 bp, Rattus norvegicus
atcaggtattgggtgacagctccct

SEQ ID NO: 179255 - DNA, 25 bp, Rattus norvegicus
atcaggtcagtcattcctccagcag

SEQ ID NO: 179256 - DNA, 25 bp, Rattus norvegicus
atcaggtcagtctttcctccagcag

SEQ ID NO: 179257 - DNA, 25 bp, Rattus norvegicus
atcaggtcagtgagatagtccacaa

SEQ ID NO: 179258 - DNA, 25 bp, Rattus norvegicus
atcaggtcagtgtgatagtccacaa

SEQ ID NO: 179259 - DNA, 25 bp, Rattus norvegicus
atcaggtcatgtaagttggctgctt

SEQ ID NO: 179260 - DNA, 25 bp, Rattus norvegicus
atcaggtcatgttagttggctgctt

SEQ ID NO: 179261 - DNA, 25 bp, Rattus norvegicus
atcaggtccggaatccctggtctga

SEQ ID NO: 179262 - DNA, 25 bp, Rattus norvegicus
atcaggtccggattccctggtctga

SEQ ID NO: 179263 - DNA, 25 bp, Rattus norvegicus
atcaggtctcagaaagtgcaagaga

SEQ ID NO: 179264 - DNA, 25 bp, Rattus norvegicus
atcaggtctcagtaagtgcaagaga

SEQ ID NO: 179265 - DNA, 25 bp, Rattus norvegicus
atcaggtctgtgatggtgtctctcc

SEQ ID NO: 179266 - DNA, 25 bp, Rattus norvegicus
atcaggtctgtgttggtgtctctcc

SEQ ID NO: 179267 - DNA, 25 bp, Rattus norvegicus
atcaggtcttccaggtggtccttca

SEQ ID NO: 179268 - DNA, 25 bp, Rattus norvegicus
atcaggtcttcctggtggtccttca

SEQ ID NO: 179269 - DNA, 25 bp, Rattus norvegicus
atcaggtgccagctgatcatcagca

SEQ ID NO: 179270 - DNA, 25 bp, Rattus norvegicus
atcaggtgccaggtgatcatcagca

SEQ ID NO: 179271 - DNA, 25 bp, Rattus norvegicus
atcaggtgccctctgattgacttaa

SEQ ID NO: 179272 - DNA, 25 bp, Rattus norvegicus
atcaggtgccctgtgattgacttaa

SEQ ID NO: 179273 - DNA, 25 bp, Rattus norvegicus
atcaggtggacacttctaaaagtac

SEQ ID NO: 179274 - DNA, 25 bp, Rattus norvegicus
atcaggtggacagttctaaaagtac

SEQ ID NO: 179275 - DNA, 25 bp, Rattus norvegicus
atcaggtgggctctgcacactgtga

SEQ ID NO: 179276 - DNA, 25 bp, Rattus norvegicus
atcaggtgggctgtgcacactgtga

SEQ ID NO: 179277 - DNA, 25 bp, Rattus norvegicus
atcaggtggttcatgtctgtggcac

SEQ ID NO: 179278 - DNA, 25 bp, Rattus norvegicus
atcaggtggttcttgtctgtggcac

SEQ ID NO: 179279 - DNA, 25 bp, Rattus norvegicus
atcaggtgttggagctccagcacac

SEQ ID NO: 179280 - DNA, 25 bp, Rattus norvegicus
atcaggtgttggtgctccagcacac

SEQ ID NO: 179281 - DNA, 25 bp, Rattus norvegicus
atcaggttagatacggtgtcagtgg

SEQ ID NO: 179282 - DNA, 25 bp, Rattus norvegicus
atcaggttagattcggtgtcagtgg

SEQ ID NO: 179283 - DNA, 25 bp, Rattus norvegicus
atcaggttagggatccgttccctgt

SEQ ID NO: 179284 - DNA, 25 bp, Rattus norvegicus
atcaggttagggttccgttccctgt

SEQ ID NO: 179285 - DNA, 25 bp, Rattus norvegicus
atcaggttatttacattttcagtag

SEQ ID NO: 179286 - DNA, 25 bp, Rattus norvegicus
atcaggttattttcattttcagtag

SEQ ID NO: 179287 - DNA, 25 bp, Rattus norvegicus
atcaggttcagcatctgcaggatct

SEQ ID NO: 179288 - DNA, 25 bp, Rattus norvegicus
atcaggttcagcttctgcaggatct

SEQ ID NO: 179289 - DNA, 25 bp, Rattus norvegicus
atcaggttccttatccagataggtc

SEQ ID NO: 179290 - DNA, 25 bp, Rattus norvegicus
atcaggttccttttccagataggtc

SEQ ID NO: 179291 - DNA, 25 bp, Rattus norvegicus
atcaggttcttgagccacaggtcag

SEQ ID NO: 179292 - DNA, 25 bp, Rattus norvegicus
atcaggttcttgtgccacaggtcag

SEQ ID NO: 179293 - DNA, 25 bp, Rattus norvegicus
atcaggtttgtcctataccagaaag

SEQ ID NO: 179294 - DNA, 25 bp, Rattus norvegicus
atcaggtttgtcgtataccagaaag

SEQ ID NO: 179295 - DNA, 25 bp, Rattus norvegicus
atcagtaactgtatgctcctaattt

SEQ ID NO: 179296 - DNA, 25 bp, Rattus norvegicus
atcagtaactgtttgctcctaattt

SEQ ID NO: 179297 - DNA, 25 bp, Rattus norvegicus
atcagtaacttgctgattacaaggt

SEQ ID NO: 179298 - DNA, 25 bp, Rattus norvegicus
atcagtaacttggtgattacaaggt

SEQ ID NO: 179299 - DNA, 25 bp, Rattus norvegicus
atcagtaagattctgtacaacccca

SEQ ID NO: 179300 - DNA, 25 bp, Rattus norvegicus
atcagtaagattgtgtacaacccca

SEQ ID NO: 179301 - DNA, 25 bp, Rattus norvegicus
atcagtaaggagcagccctggcagc

SEQ ID NO: 179302 - DNA, 25 bp, Rattus norvegicus
atcagtaaggaggagccctggcagc

SEQ ID NO: 179303 - DNA, 25 bp, Rattus norvegicus
atcagtaatactccctgcttggctg

SEQ ID NO: 179304 - DNA, 25 bp, Rattus norvegicus
atcagtaatactgcctgcttggctg

SEQ ID NO: 179305 - DNA, 25 bp, Rattus norvegicus
atcagtaatgccaccagagttctca

SEQ ID NO: 179306 - DNA, 25 bp, Rattus norvegicus
atcagtaatgcctccagagttctca

SEQ ID NO: 179307 - DNA, 25 bp, Rattus norvegicus
atcagtacaaatccctcattccacg

SEQ ID NO: 179308 - DNA, 25 bp, Rattus norvegicus
atcagtacaaatgcctcattccacg

SEQ ID NO: 179309 - DNA, 25 bp, Rattus norvegicus
atcagtacaacacccttacctggag

SEQ ID NO: 179310 - DNA, 25 bp, Rattus norvegicus
atcagtacaacagccttacctggag

SEQ ID NO: 179311 - DNA, 25 bp, Rattus norvegicus
atcagtacacacattcaggtagtct

SEQ ID NO: 179312 - DNA, 25 bp, Rattus norvegicus
atcagtacacactttcaggtagtct

SEQ ID NO: 179313 - DNA, 25 bp, Rattus norvegicus
atcagtacgaccaggtgatgccagg

SEQ ID NO: 179314 - DNA, 25 bp, Rattus norvegicus
atcagtacgacctggtgatgccagg

SEQ ID NO: 179315 - DNA, 25 bp, Rattus norvegicus
atcagtactgagaagctgtcctctg

SEQ ID NO: 179316 - DNA, 25 bp, Rattus norvegicus
atcagtactgagtagctgtcctctg

SEQ ID NO: 179317 - DNA, 25 bp, Rattus norvegicus
atcagtactgggagctgtgtttccc

SEQ ID NO: 179318 - DNA, 25 bp, Rattus norvegicus
atcagtactgggtgctgtgtttccc

SEQ ID NO: 179319 - DNA, 25 bp, Rattus norvegicus
atcagtactgttagcttgaccgtga

SEQ ID NO: 179320 - DNA, 25 bp, Rattus norvegicus
atcagtactgtttgcttgaccgtga

SEQ ID NO: 179321 - DNA, 25 bp, Rattus norvegicus
atcagtagaaatattggacccttta

SEQ ID NO: 179322 - DNA, 25 bp, Rattus norvegicus
atcagtagaaattttggacccttta

SEQ ID NO: 179323 - DNA, 25 bp, Rattus norvegicus
atcagtagagcgcttttcctccgtt

SEQ ID NO: 179324 - DNA, 25 bp, Rattus norvegicus
atcagtagagcggttttcctccgtt

SEQ ID NO: 179325 - DNA, 25 bp, Rattus norvegicus
atcagtagtgtacggtatggagcaa

SEQ ID NO: 179326 - DNA, 25 bp, Rattus norvegicus
atcagtagtgtagggtatggagcaa

SEQ ID NO: 179327 - DNA, 25 bp, Rattus norvegicus
atcagtatcaaacacttaccagaag

SEQ ID NO: 179328 - DNA, 25 bp, Rattus norvegicus
atcagtatcaaagacttaccagaag

SEQ ID NO: 179329 - DNA, 25 bp, Rattus norvegicus
atcagtatcgttattgcaggattta

SEQ ID NO: 179330 - DNA, 25 bp, Rattus norvegicus
atcagtatcgtttttgcaggattta

SEQ ID NO: 179331 - DNA, 25 bp, Rattus norvegicus
atcagtatctacactctagttctcc

SEQ ID NO: 179332 - DNA, 25 bp, Rattus norvegicus
atcagtatctactctctagttctcc

SEQ ID NO: 179333 - DNA, 25 bp, Rattus norvegicus
atcagtatgactcagctgtcctgtt

SEQ ID NO: 179334 - DNA, 25 bp, Rattus norvegicus
atcagtatgactgagctgtcctgtt

SEQ ID NO: 179335 - DNA, 25 bp, Rattus norvegicus
atcagtatgtgtatatccctccaaa

SEQ ID NO: 179336 - DNA, 25 bp, Rattus norvegicus
atcagtatgtgtttatccctccaaa

SEQ ID NO: 179337 - DNA, 25 bp, Rattus norvegicus
atcagtattactctgggtcatatat

SEQ ID NO: 179338 - DNA, 25 bp, Rattus norvegicus
atcagtattactgtgggtcatatat

SEQ ID NO: 179339 - DNA, 25 bp, Rattus norvegicus
atcagtattgctcaggacctgctgg

SEQ ID NO: 179340 - DNA, 25 bp, Rattus norvegicus
atcagtattgctgaggacctgctgg

SEQ ID NO: 179341 - DNA, 25 bp, Rattus norvegicus
atcagtatttccatactgtgctccc

SEQ ID NO: 179342 - DNA, 25 bp, Rattus norvegicus
atcagtatttccttactgtgctccc

SEQ ID NO: 179343 - DNA, 25 bp, Rattus norvegicus
atcagtcaagggatcgaagaccaga

SEQ ID NO: 179344 - DNA, 25 bp, Rattus norvegicus
atcagtcaagggttcgaagaccaga

SEQ ID NO: 179345 - DNA, 25 bp, Rattus norvegicus
atcagtcaccaacagttcagccagc

SEQ ID NO: 179346 - DNA, 25 bp, Rattus norvegicus
atcagtcaccaagagttcagccagc

SEQ ID NO: 179347 - DNA, 25 bp, Rattus norvegicus
atcagtcacgtgctcctctagaagg

SEQ ID NO: 179348 - DNA, 25 bp, Rattus norvegicus
atcagtcacgtggtcctctagaagg

SEQ ID NO: 179349 - DNA, 25 bp, Rattus norvegicus
atcagtcactccaaagtgtatttct

SEQ ID NO: 179350 - DNA, 25 bp, Rattus norvegicus
atcagtcactcctaagtgtatttct

SEQ ID NO: 179351 - DNA, 25 bp, Rattus norvegicus
atcagtcactttaataccccaggta

SEQ ID NO: 179352 - DNA, 25 bp, Rattus norvegicus
atcagtcacttttataccccaggta

SEQ ID NO: 179353 - DNA, 25 bp, Rattus norvegicus
atcagtcagcaaatgttgggtccaa

SEQ ID NO: 179354 - DNA, 25 bp, Rattus norvegicus
atcagtcagcaattgttgggtccaa

SEQ ID NO: 179355 - DNA, 25 bp, Rattus norvegicus
atcagtcagcctatctgccatagag

SEQ ID NO: 179356 - DNA, 25 bp, Rattus norvegicus
atcagtcagcctttctgccatagag

SEQ ID NO: 179357 - DNA, 25 bp, Rattus norvegicus
atcagtcagctcacattcaccttta

SEQ ID NO: 179358 - DNA, 25 bp, Rattus norvegicus
atcagtcagctcactagaccatgaa

SEQ ID NO: 179359 - DNA, 25 bp, Rattus norvegicus
atcagtcagctctcattcaccttta

SEQ ID NO: 179360 - DNA, 25 bp, Rattus norvegicus
atcagtcagctctctagaccatgaa

SEQ ID NO: 179361 - DNA, 25 bp, Rattus norvegicus
atcagtcatcagaccaagaacttta

SEQ ID NO: 179362 - DNA, 25 bp, Rattus norvegicus
atcagtcatcagtccaagaacttta

SEQ ID NO: 179363 - DNA, 25 bp, Rattus norvegicus
atcagtccagagagcactgcagggt

SEQ ID NO: 179364 - DNA, 25 bp, Rattus norvegicus
atcagtccagagtgcactgcagggt

SEQ ID NO: 179365 - DNA, 25 bp, Rattus norvegicus
atcagtccctccagtgttggttttt

SEQ ID NO: 179366 - DNA, 25 bp, Rattus norvegicus
atcagtccctcctgtgttggttttt

SEQ ID NO: 179367 - DNA, 25 bp, Rattus norvegicus
atcagtcctctacagagctggctga

SEQ ID NO: 179368 - DNA, 25 bp, Rattus norvegicus
atcagtcctctagagagctggctga

SEQ ID NO: 179369 - DNA, 25 bp, Rattus norvegicus
atcagtcctcttaggttggcaatag

SEQ ID NO: 179370 - DNA, 25 bp, Rattus norvegicus
atcagtcctctttggttggcaatag

SEQ ID NO: 179371 - DNA, 25 bp, Rattus norvegicus
atcagtcctgaactatgtcctgcag

SEQ ID NO: 179372 - DNA, 25 bp, Rattus norvegicus
atcagtcctgaagtatgtcctgcag

SEQ ID NO: 179373 - DNA, 25 bp, Rattus norvegicus
atcagtcctgtcatagcgtatttct

SEQ ID NO: 179374 - DNA, 25 bp, Rattus norvegicus
atcagtcctgtcttagcgtatttct

SEQ ID NO: 179375 - DNA, 25 bp, Rattus norvegicus
atcagtcgcaatcattcagctcgct

SEQ ID NO: 179376 - DNA, 25 bp, Rattus norvegicus
atcagtcgcaatgattcagctcgct

SEQ ID NO: 179377 - DNA, 25 bp, Rattus norvegicus
atcagtctacctatttctttgagaa

SEQ ID NO: 179378 - DNA, 25 bp, Rattus norvegicus
atcagtctacctttttctttgagaa

SEQ ID NO: 179379 - DNA, 25 bp, Rattus norvegicus
atcagtctagtaacaacattcatgt

SEQ ID NO: 179380 - DNA, 25 bp, Rattus norvegicus
atcagtctagtatcaacattcatgt

SEQ ID NO: 179381 - DNA, 25 bp, Rattus norvegicus
atcagtctagtcagtctttctcttg

SEQ ID NO: 179382 - DNA, 25 bp, Rattus norvegicus
atcagtctagtctgtctttctcttg

SEQ ID NO: 179383 - DNA, 25 bp, Rattus norvegicus
atcagtctcatcagtatgcctttgg

SEQ ID NO: 179384 - DNA, 25 bp, Rattus norvegicus
atcagtctcatctgtatgcctttgg

SEQ ID NO: 179385 - DNA, 25 bp, Rattus norvegicus
atcagtctcctgagcaaatattaaa

SEQ ID NO: 179386 - DNA, 25 bp, Rattus norvegicus
atcagtctcctgagctgtgtgaaag

SEQ ID NO: 179387 - DNA, 25 bp, Rattus norvegicus
atcagtctcctgcttgtggtccaga

SEQ ID NO: 179388 - DNA, 25 bp, Rattus norvegicus
atcagtctcctggttgtggtccaga

SEQ ID NO: 179389 - DNA, 25 bp, Rattus norvegicus
atcagtctcctgtgcaaatattaaa

SEQ ID NO: 179390 - DNA, 25 bp, Rattus norvegicus
atcagtctcctgtgctgtgtgaaag

SEQ ID NO: 179391 - DNA, 25 bp, Rattus norvegicus
atcagtctgacacactattcttgga

SEQ ID NO: 179392 - DNA, 25 bp, Rattus norvegicus
atcagtctgacagactattcttgga

SEQ ID NO: 179393 - DNA, 25 bp, Rattus norvegicus
atcagtctgtcccaattgccaatag

SEQ ID NO: 179394 - DNA, 25 bp, Rattus norvegicus
atcagtctgtccctcttgtaatgtc

SEQ ID NO: 179395 - DNA, 25 bp, Rattus norvegicus
atcagtctgtccgaattgccaatag

SEQ ID NO: 179396 - DNA, 25 bp, Rattus norvegicus
atcagtctgtccgtcttgtaatgtc

SEQ ID NO: 179397 - DNA, 25 bp, Rattus norvegicus
atcagtctgtgtacgttgcatgtta

SEQ ID NO: 179398 - DNA, 25 bp, Rattus norvegicus
atcagtctgtgttcgttgcatgtta

SEQ ID NO: 179399 - DNA, 25 bp, Rattus norvegicus
atcagtcttcttagtctagtaccga

SEQ ID NO: 179400 - DNA, 25 bp, Rattus norvegicus
atcagtcttctttgtctagtaccga

SEQ ID NO: 179401 - DNA, 25 bp, Rattus norvegicus
atcagtcttgccagggagctcatac

SEQ ID NO: 179402 - DNA, 25 bp, Rattus norvegicus
atcagtcttgcctgggagctcatac

SEQ ID NO: 179403 - DNA, 25 bp, Rattus norvegicus
atcagtgaacagcaaaagctccaat

SEQ ID NO: 179404 - DNA, 25 bp, Rattus norvegicus
atcagtgaacaggaaaagctccaat

SEQ ID NO: 179405 - DNA, 25 bp, Rattus norvegicus
atcagtgaatgtcccatttacccga

SEQ ID NO: 179406 - DNA, 25 bp, Rattus norvegicus
atcagtgaatgtgccatttacccga

SEQ ID NO: 179407 - DNA, 25 bp, Rattus norvegicus
atcagtgacaggctgaacccagact

SEQ ID NO: 179408 - DNA, 25 bp, Rattus norvegicus
atcagtgacagggtgaacccagact

SEQ ID NO: 179409 - DNA, 25 bp, Rattus norvegicus
atcagtgacattctgtccagccaga

SEQ ID NO: 179410 - DNA, 25 bp, Rattus norvegicus
atcagtgacattgtgtccagccaga

SEQ ID NO: 179411 - DNA, 25 bp, Rattus norvegicus
atcagtgacgtactcctgtgaggtt

SEQ ID NO: 179412 - DNA, 25 bp, Rattus norvegicus
atcagtgacgtagtcctgtgaggtt

SEQ ID NO: 179413 - DNA, 25 bp, Rattus norvegicus
atcagtgacttgcagttggcaaaga

SEQ ID NO: 179414 - DNA, 25 bp, Rattus norvegicus
atcagtgacttggagttggcaaaga

SEQ ID NO: 179415 - DNA, 25 bp, Rattus norvegicus
atcagtgagtacacggaagccgcca

SEQ ID NO: 179416 - DNA, 25 bp, Rattus norvegicus
atcagtgagtactcggaagccgcca

SEQ ID NO: 179417 - DNA, 25 bp, Rattus norvegicus
atcagtgataagaaggcctccagga

SEQ ID NO: 179418 - DNA, 25 bp, Rattus norvegicus
atcagtgataagtaggcctccagga

SEQ ID NO: 179419 - DNA, 25 bp, Rattus norvegicus
atcagtgatccgatactgtctggaa

SEQ ID NO: 179420 - DNA, 25 bp, Rattus norvegicus
atcagtgatccgttactgtctggaa

SEQ ID NO: 179421 - DNA, 25 bp, Rattus norvegicus
atcagtgatcctacacgttgggttc

SEQ ID NO: 179422 - DNA, 25 bp, Rattus norvegicus
atcagtgatccttcacgttgggttc

SEQ ID NO: 179423 - DNA, 25 bp, Rattus norvegicus
atcagtgatggtctcccgtgaccac

SEQ ID NO: 179424 - DNA, 25 bp, Rattus norvegicus
atcagtgatggtgtcccgtgaccac

SEQ ID NO: 179425 - DNA, 25 bp, Rattus norvegicus
atcagtgattgtctcccgtggacat

SEQ ID NO: 179426 - DNA, 25 bp, Rattus norvegicus
atcagtgattgtgtcccgtggacat

SEQ ID NO: 179427 - DNA, 25 bp, Rattus norvegicus
atcagtgcagagaaaacgcatcttg

SEQ ID NO: 179428 - DNA, 25 bp, Rattus norvegicus
atcagtgcagagagtacgcgtcttt

SEQ ID NO: 179429 - DNA, 25 bp, Rattus norvegicus
atcagtgcagagtaaacgcatcttg

SEQ ID NO: 179430 - DNA, 25 bp, Rattus norvegicus
atcagtgcagagtgtacgcgtcttt

SEQ ID NO: 179431 - DNA, 25 bp, Rattus norvegicus
atcagtgcagtacctaagaatggaa

SEQ ID NO: 179432 - DNA, 25 bp, Rattus norvegicus
atcagtgcagtagctaagaatggaa

SEQ ID NO: 179433 - DNA, 25 bp, Rattus norvegicus
atcagtgcagtccttgtcaaataca

SEQ ID NO: 179434 - DNA, 25 bp, Rattus norvegicus
atcagtgcagtcgttgtcaaataca

SEQ ID NO: 179435 - DNA, 25 bp, Rattus norvegicus
atcagtgcatacctgcattgccttt

SEQ ID NO: 179436 - DNA, 25 bp, Rattus norvegicus
atcagtgcatacgtgcattgccttt

SEQ ID NO: 179437 - DNA, 25 bp, Rattus norvegicus
atcagtgcatccacctggcgaggga

SEQ ID NO: 179438 - DNA, 25 bp, Rattus norvegicus
atcagtgcatcctcctggcgaggga

SEQ ID NO: 179439 - DNA, 25 bp, Rattus norvegicus
atcagtgcccatccagaccagaggg

SEQ ID NO: 179440 - DNA, 25 bp, Rattus norvegicus
atcagtgcccatgcagaccagaggg

SEQ ID NO: 179441 - DNA, 25 bp, Rattus norvegicus
atcagtgccgcccagtgttgctgaa

SEQ ID NO: 179442 - DNA, 25 bp, Rattus norvegicus
atcagtgccgccgagtgttgctgaa

SEQ ID NO: 179443 - DNA, 25 bp, Rattus norvegicus
atcagtgcggtccagctttggagtc

SEQ ID NO: 179444 - DNA, 25 bp, Rattus norvegicus
atcagtgcggtcgagctttggagtc

SEQ ID NO: 179445 - DNA, 25 bp, Rattus norvegicus
atcagtgctctaagacttgatgctg

SEQ ID NO: 179446 - DNA, 25 bp, Rattus norvegicus
atcagtgctctaagtatgcgtccat

SEQ ID NO: 179447 - DNA, 25 bp, Rattus norvegicus
atcagtgctctatgacttgatgctg

SEQ ID NO: 179448 - DNA, 25 bp, Rattus norvegicus
atcagtgctctatgtatgcgtccat

SEQ ID NO: 179449 - DNA, 25 bp, Rattus norvegicus
atcagtgctgagcagttctgggcca

SEQ ID NO: 179450 - DNA, 25 bp, Rattus norvegicus
atcagtgctgaggagttctgggcca

SEQ ID NO: 179451 - DNA, 25 bp, Rattus norvegicus
atcagtgcttggaggctacaggctt

SEQ ID NO: 179452 - DNA, 25 bp, Rattus norvegicus
atcagtgcttggtggctacaggctt

SEQ ID NO: 179453 - DNA, 25 bp, Rattus norvegicus
atcagtggacacctagagtagacat

SEQ ID NO: 179454 - DNA, 25 bp, Rattus norvegicus
atcagtggacacgtagagtagacat

SEQ ID NO: 179455 - DNA, 25 bp, Rattus norvegicus
atcagtggagcactattcaatcaac

SEQ ID NO: 179456 - DNA, 25 bp, Rattus norvegicus
atcagtggagcagtattcaatcaac

SEQ ID NO: 179457 - DNA, 25 bp, Rattus norvegicus
atcagtggccccagttcctgaagac

SEQ ID NO: 179458 - DNA, 25 bp, Rattus norvegicus
atcagtggcccctgttcctgaagac

SEQ ID NO: 179459 - DNA, 25 bp, Rattus norvegicus
atcagtggcctaccgtgacagcgtc

SEQ ID NO: 179460 - DNA, 25 bp, Rattus norvegicus
atcagtggcctagcgtgacagcgtc

SEQ ID NO: 179461 - DNA, 25 bp, Rattus norvegicus
atcagtgggaatagtacccgcacaa

SEQ ID NO: 179462 - DNA, 25 bp, Rattus norvegicus
atcagtgggaattgtacccgcacaa

SEQ ID NO: 179463 - DNA, 25 bp, Rattus norvegicus
atcagtgggccgctgttggttctct

SEQ ID NO: 179464 - DNA, 25 bp, Rattus norvegicus
atcagtgggccggtgttggttctct

SEQ ID NO: 179465 - DNA, 25 bp, Rattus norvegicus
atcagtggtgaacgcctgttcgcca

SEQ ID NO: 179466 - DNA, 25 bp, Rattus norvegicus
atcagtggtgaaggcctgttcgcca

SEQ ID NO: 179467 - DNA, 25 bp, Rattus norvegicus
atcagtggtggacgtgcaccatctc

SEQ ID NO: 179468 - DNA, 25 bp, Rattus norvegicus
atcagtggtggaggtgcaccatctc

SEQ ID NO: 179469 - DNA, 25 bp, Rattus norvegicus
atcagtggttggagtgaccgcattc

SEQ ID NO: 179470 - DNA, 25 bp, Rattus norvegicus
atcagtggttggtgtgaccgcattc

SEQ ID NO: 179471 - DNA, 25 bp, Rattus norvegicus
atcagtgtaaacctgtgctcagtat

SEQ ID NO: 179472 - DNA, 25 bp, Rattus norvegicus
atcagtgtaaacgtgtgctcagtat

SEQ ID NO: 179473 - DNA, 25 bp, Rattus norvegicus
atcagtgtacccacagatgcaaagg

SEQ ID NO: 179474 - DNA, 25 bp, Rattus norvegicus
atcagtgtaccctcagatgcaaagg

SEQ ID NO: 179475 - DNA, 25 bp, Rattus norvegicus
atcagtgtactgacacccgaacata

SEQ ID NO: 179476 - DNA, 25 bp, Rattus norvegicus
atcagtgtactgtcacccgaacata

SEQ ID NO: 179477 - DNA, 25 bp, Rattus norvegicus
atcagtgtcatcctgctaagtccat

SEQ ID NO: 179478 - DNA, 25 bp, Rattus norvegicus
atcagtgtcatcgtgctaagtccat

SEQ ID NO: 179479 - DNA, 25 bp, Rattus norvegicus
atcagtgtccacagctgtgactcct

SEQ ID NO: 179480 - DNA, 25 bp, Rattus norvegicus
atcagtgtccactgctgtgactcct

SEQ ID NO: 179481 - DNA, 25 bp, Rattus norvegicus
atcagtgtccgtatggtacttgctg

SEQ ID NO: 179482 - DNA, 25 bp, Rattus norvegicus
atcagtgtccgtttggtacttgctg

SEQ ID NO: 179483 - DNA, 25 bp, Rattus norvegicus
atcagtgtgacactgcttacttagc

SEQ ID NO: 179484 - DNA, 25 bp, Rattus norvegicus
atcagtgtgacagtgcttacttagc

SEQ ID NO: 179485 - DNA, 25 bp, Rattus norvegicus
atcagtgtgagaactccaacccggt

SEQ ID NO: 179486 - DNA, 25 bp, Rattus norvegicus
atcagtgtgagatctccaacccggt

SEQ ID NO: 179487 - DNA, 25 bp, Rattus norvegicus
atcagtgtgcgcaggcttcttgcag

SEQ ID NO: 179488 - DNA, 25 bp, Rattus norvegicus
atcagtgtgcgctggcttcttgcag

SEQ ID NO: 179489 - DNA, 25 bp, Rattus norvegicus
atcagtgtggccaagacccaccttg

SEQ ID NO: 179490 - DNA, 25 bp, Rattus norvegicus
atcagtgtggcccttgaaccgggtc

SEQ ID NO: 179491 - DNA, 25 bp, Rattus norvegicus
atcagtgtggccgttgaaccgggtc

SEQ ID NO: 179492 - DNA, 25 bp, Rattus norvegicus
atcagtgtggcctagacccaccttg

SEQ ID NO: 179493 - DNA, 25 bp, Rattus norvegicus
atcagtgtggttctcctgttcttta

SEQ ID NO: 179494 - DNA, 25 bp, Rattus norvegicus
atcagtgtggttgtcctgttcttta

SEQ ID NO: 179495 - DNA, 25 bp, Rattus norvegicus
atcagtgtgtgcagcagatgcccct

SEQ ID NO: 179496 - DNA, 25 bp, Rattus norvegicus
atcagtgtgtgctgcagatgcccct

SEQ ID NO: 179497 - DNA, 25 bp, Rattus norvegicus
atcagtgtgttacatccaggtgctt

SEQ ID NO: 179498 - DNA, 25 bp, Rattus norvegicus
atcagtgtgttagatccaggtgctt

SEQ ID NO: 179499 - DNA, 25 bp, Rattus norvegicus
atcagtgttaacaccctgagacagg

SEQ ID NO: 179500 - DNA, 25 bp, Rattus norvegicus
atcagtgttaactccctgagacagg

SEQ ID NO: 179501 - DNA, 25 bp, Rattus norvegicus
atcagtgttcatattcgtggccaag

SEQ ID NO: 179502 - DNA, 25 bp, Rattus norvegicus
atcagtgttcattttcgtggccaag

SEQ ID NO: 179503 - DNA, 25 bp, Rattus norvegicus
atcagtgttgtgagtgcatgtgaaa

SEQ ID NO: 179504 - DNA, 25 bp, Rattus norvegicus
atcagtgttgtgtgtgcatgtgaaa

SEQ ID NO: 179505 - DNA, 25 bp, Rattus norvegicus
atcagtgttgttaagtggcttggca

SEQ ID NO: 179506 - DNA, 25 bp, Rattus norvegicus
atcagtgttgtttagtggcttggca

SEQ ID NO: 179507 - DNA, 25 bp, Rattus norvegicus
atcagtgtttatctccttgtgttaa

SEQ ID NO: 179508 - DNA, 25 bp, Rattus norvegicus
atcagtgtttatgtccttgtgttaa

SEQ ID NO: 179509 - DNA, 25 bp, Rattus norvegicus
atcagttaagcgctgcacagactca

SEQ ID NO: 179510 - DNA, 25 bp, Rattus norvegicus
atcagttaagcggtgcacagactca

SEQ ID NO: 179511 - DNA, 25 bp, Rattus norvegicus
atcagttaatagctactcgcgcaaa

SEQ ID NO: 179512 - DNA, 25 bp, Rattus norvegicus
atcagttaataggtactcgcgcaaa

SEQ ID NO: 179513 - DNA, 25 bp, Rattus norvegicus
atcagttacagaaccacttttggca

SEQ ID NO: 179514 - DNA, 25 bp, Rattus norvegicus
atcagttacagatccacttttggca

SEQ ID NO: 179515 - DNA, 25 bp, Rattus norvegicus
atcagttactgccacacccaataaa

SEQ ID NO: 179516 - DNA, 25 bp, Rattus norvegicus
atcagttactgcgacacccaataaa

SEQ ID NO: 179517 - DNA, 25 bp, Rattus norvegicus
atcagttagcaaccaatccctcttc

SEQ ID NO: 179518 - DNA, 25 bp, Rattus norvegicus
atcagttagcaagcaatccctcttc

SEQ ID NO: 179519 - DNA, 25 bp, Rattus norvegicus
atcagttccctaccagatgtatcta

SEQ ID NO: 179520 - DNA, 25 bp, Rattus norvegicus
atcagttccctagcagatgtatcta

SEQ ID NO: 179521 - DNA, 25 bp, Rattus norvegicus
atcagttcctagcagatcttgaaat

SEQ ID NO: 179522 - DNA, 25 bp, Rattus norvegicus
atcagttcctaggagatcttgaaat

SEQ ID NO: 179523 - DNA, 25 bp, Rattus norvegicus
atcagttcctgaacgttgtgaagtt

SEQ ID NO: 179524 - DNA, 25 bp, Rattus norvegicus
atcagttcctgatcgttgtgaagtt

SEQ ID NO: 179525 - DNA, 25 bp, Rattus norvegicus
atcagttcggctactccccagggca

SEQ ID NO: 179526 - DNA, 25 bp, Rattus norvegicus
atcagttcggcttctccccagggca

SEQ ID NO: 179527 - DNA, 25 bp, Rattus norvegicus
atcagttctaaactctgctggagag

SEQ ID NO: 179528 - DNA, 25 bp, Rattus norvegicus
atcagttctaaagtctgctggagag

SEQ ID NO: 179529 - DNA, 25 bp, Rattus norvegicus
atcagttctagcaggctgctgggaa

SEQ ID NO: 179530 - DNA, 25 bp, Rattus norvegicus
atcagttctagctggctgctgggaa

SEQ ID NO: 179531 - DNA, 25 bp, Rattus norvegicus
atcagttctaggaggtagttcttta

SEQ ID NO: 179532 - DNA, 25 bp, Rattus norvegicus
atcagttctaggtggtagttcttta

SEQ ID NO: 179533 - DNA, 25 bp, Rattus norvegicus
atcagttctctgacataccaagtat

SEQ ID NO: 179534 - DNA, 25 bp, Rattus norvegicus
atcagttctctgtcataccaagtat

SEQ ID NO: 179535 - DNA, 25 bp, Rattus norvegicus
atcagttcttcaaaacagtgctcac

SEQ ID NO: 179536 - DNA, 25 bp, Rattus norvegicus
atcagttcttcataacagtgctcac

SEQ ID NO: 179537 - DNA, 25 bp, Rattus norvegicus
atcagttgacttatacacatatcta

SEQ ID NO: 179538 - DNA, 25 bp, Rattus norvegicus
atcagttgacttttacacatatcta

SEQ ID NO: 179539 - DNA, 25 bp, Rattus norvegicus
atcagttgccctacatctgccagtt

SEQ ID NO: 179540 - DNA, 25 bp, Rattus norvegicus
atcagttgcccttcatctgccagtt

SEQ ID NO: 179541 - DNA, 25 bp, Rattus norvegicus
atcagttggagtccctaggtccact

SEQ ID NO: 179542 - DNA, 25 bp, Rattus norvegicus
atcagttggagtgcctaggtccact

SEQ ID NO: 179543 - DNA, 25 bp, Rattus norvegicus
atcagttggtttctccagcatcgac

SEQ ID NO: 179544 - DNA, 25 bp, Rattus norvegicus
atcagttggtttgtccagcatcgac

SEQ ID NO: 179545 - DNA, 25 bp, Rattus norvegicus
atcagttgtctccactggttctgac

SEQ ID NO: 179546 - DNA, 25 bp, Rattus norvegicus
atcagttgtctcgactggttctgac

SEQ ID NO: 179547 - DNA, 25 bp, Rattus norvegicus
atcagttgttatctacactaggcaa

SEQ ID NO: 179548 - DNA, 25 bp, Rattus norvegicus
atcagttgttatgtacactaggcaa

SEQ ID NO: 179549 - DNA, 25 bp, Rattus norvegicus
atcagtttactgcagcggatctcag

SEQ ID NO: 179550 - DNA, 25 bp, Rattus norvegicus
atcagtttactggagcggatctcag

SEQ ID NO: 179551 - DNA, 25 bp, Rattus norvegicus
atcagtttccagatagattgctaaa

SEQ ID NO: 179552 - DNA, 25 bp, Rattus norvegicus
atcagtttccagttagattgctaaa

SEQ ID NO: 179553 - DNA, 25 bp, Rattus norvegicus
atcagtttcctgcaaagccgttgag

SEQ ID NO: 179554 - DNA, 25 bp, Rattus norvegicus
atcagtttcctggaaagccgttgag

SEQ ID NO: 179555 - DNA, 25 bp, Rattus norvegicus
atcagtttctctccataatgcctag

SEQ ID NO: 179556 - DNA, 25 bp, Rattus norvegicus
atcagtttctctgcataatgcctag

SEQ ID NO: 179557 - DNA, 25 bp, Rattus norvegicus
atcagtttctttcaataacatggac

SEQ ID NO: 179558 - DNA, 25 bp, Rattus norvegicus
atcagtttctttgaataacatggac

SEQ ID NO: 179559 - DNA, 25 bp, Rattus norvegicus
atcagtttgactcggctggaacgtc

SEQ ID NO: 179560 - DNA, 25 bp, Rattus norvegicus
atcagtttgactgggctggaacgtc

SEQ ID NO: 179561 - DNA, 25 bp, Rattus norvegicus
atcagtttgcttaaggcagcttgtt

SEQ ID NO: 179562 - DNA, 25 bp, Rattus norvegicus
atcagtttgctttaggcagcttgtt

SEQ ID NO: 179563 - DNA, 25 bp, Rattus norvegicus
atcagtttggcacaagagtcgagtt

SEQ ID NO: 179564 - DNA, 25 bp, Rattus norvegicus
atcagtttggcagaagagtcgagtt

SEQ ID NO: 179565 - DNA, 25 bp, Rattus norvegicus
atcagttttctgagctgtgagggca

SEQ ID NO: 179566 - DNA, 25 bp, Rattus norvegicus
atcagttttctgtgctgtgagggca

SEQ ID NO: 179567 - DNA, 25 bp, Rattus norvegicus
atcagttttgccatctgcataggag

SEQ ID NO: 179568 - DNA, 25 bp, Rattus norvegicus
atcagttttgccttctgcataggag

SEQ ID NO: 179569 - DNA, 25 bp, Rattus norvegicus
atcagttttgtcactcatcctatcc

SEQ ID NO: 179570 - DNA, 25 bp, Rattus norvegicus
atcagttttgtctctcatcctatcc

SEQ ID NO: 179571 - DNA, 25 bp, Rattus norvegicus
atcataaaccacaaagtaagacctg

SEQ ID NO: 179572 - DNA, 25 bp, Rattus norvegicus
atcataaaccactaagtaagacctg

SEQ ID NO: 179573 - DNA, 25 bp, Rattus norvegicus
atcataaactatccctttttggata

SEQ ID NO: 179574 - DNA, 25 bp, Rattus norvegicus
atcataaactatgcctttttggata

SEQ ID NO: 179575 - DNA, 25 bp, Rattus norvegicus
atcataactccccatgccatttgag

SEQ ID NO: 179576 - DNA, 25 bp, Rattus norvegicus
atcataactcccgatgccatttgag

SEQ ID NO: 179577 - DNA, 25 bp, Rattus norvegicus
atcataactgttcttgcttggcgac

SEQ ID NO: 179578 - DNA, 25 bp, Rattus norvegicus
atcataactgttgttgcttggcgac

SEQ ID NO: 179579 - DNA, 25 bp, Rattus norvegicus
atcataagtgagagcagccaggcct

SEQ ID NO: 179580 - DNA, 25 bp, Rattus norvegicus
atcataagtgagtgcagccaggcct

SEQ ID NO: 179581 - DNA, 25 bp, Rattus norvegicus
atcataataaacatctggtcctggt

SEQ ID NO: 179582 - DNA, 25 bp, Rattus norvegicus
atcataataaacttctggtcctggt

SEQ ID NO: 179583 - DNA, 25 bp, Rattus norvegicus
atcataatctatacactgcatgctg

SEQ ID NO: 179584 - DNA, 25 bp, Rattus norvegicus
atcataatctattcactgcatgctg

SEQ ID NO: 179585 - DNA, 25 bp, Rattus norvegicus
atcataatgtgtcaagtcgctgcct

SEQ ID NO: 179586 - DNA, 25 bp, Rattus norvegicus
atcataatgtgtgaagtcgctgcct

SEQ ID NO: 179587 - DNA, 25 bp, Rattus norvegicus
atcatacactttcagggcagggccc

SEQ ID NO: 179588 - DNA, 25 bp, Rattus norvegicus
atcatacactttgagggcagggccc

SEQ ID NO: 179589 - DNA, 25 bp, Rattus norvegicus
atcataccacttactgaggcaacac

SEQ ID NO: 179590 - DNA, 25 bp, Rattus norvegicus
atcataccactttctgaggcaacac

SEQ ID NO: 179591 - DNA, 25 bp, Rattus norvegicus
atcataccatttaccccgaggagtc

SEQ ID NO: 179592 - DNA, 25 bp, Rattus norvegicus
atcataccattttccccgaggagtc

SEQ ID NO: 179593 - DNA, 25 bp, Rattus norvegicus
atcatacccatgctggagtttcccg

SEQ ID NO: 179594 - DNA, 25 bp, Rattus norvegicus
atcatacccatggtggagtttcccg

SEQ ID NO: 179595 - DNA, 25 bp, Rattus norvegicus
atcataccgggccagccgtgatagg

SEQ ID NO: 179596 - DNA, 25 bp, Rattus norvegicus
atcataccgggcgagccgtgatagg

SEQ ID NO: 179597 - DNA, 25 bp, Rattus norvegicus
atcatacctggcactgtcatgtccc

SEQ ID NO: 179598 - DNA, 25 bp, Rattus norvegicus
atcatacctggctctgtcatgtccc

SEQ ID NO: 179599 - DNA, 25 bp, Rattus norvegicus
atcatacgaacaagctccattttcc

SEQ ID NO: 179600 - DNA, 25 bp, Rattus norvegicus
atcatacgaacatgctccattttcc

SEQ ID NO: 179601 - DNA, 25 bp, Rattus norvegicus
atcatactgtgtcggtgtcctagcc

SEQ ID NO: 179602 - DNA, 25 bp, Rattus norvegicus
atcatactgtgtgggtgtcctagcc

SEQ ID NO: 179603 - DNA, 25 bp, Rattus norvegicus
atcatacttcctactgtgcacatgc

SEQ ID NO: 179604 - DNA, 25 bp, Rattus norvegicus
atcatacttccttctgtgcacatgc

SEQ ID NO: 179605 - DNA, 25 bp, Rattus norvegicus
atcatagacaaaccccggatcatcg

SEQ ID NO: 179606 - DNA, 25 bp, Rattus norvegicus
atcatagacaaagcccggatcatcg

SEQ ID NO: 179607 - DNA, 25 bp, Rattus norvegicus
atcatagcactgattggcagttgct

SEQ ID NO: 179608 - DNA, 25 bp, Rattus norvegicus
atcatagcactgtttggcagttgct

SEQ ID NO: 179609 - DNA, 25 bp, Rattus norvegicus
atcatagctattagactctcctagg

SEQ ID NO: 179610 - DNA, 25 bp, Rattus norvegicus
atcatagctatttgactctcctagg

SEQ ID NO: 179611 - DNA, 25 bp, Rattus norvegicus
atcatagctgaccacattctttctt

SEQ ID NO: 179612 - DNA, 25 bp, Rattus norvegicus
atcatagctgacgacattctttctt

SEQ ID NO: 179613 - DNA, 25 bp, Rattus norvegicus
atcatagcttcaagtcaggtctacg

SEQ ID NO: 179614 - DNA, 25 bp, Rattus norvegicus
atcatagcttcatgtcaggtctacg

SEQ ID NO: 179615 - DNA, 25 bp, Rattus norvegicus
atcatagcttgaacgatagtcttct

SEQ ID NO: 179616 - DNA, 25 bp, Rattus norvegicus
atcatagcttgatcgatagtcttct

SEQ ID NO: 179617 - DNA, 25 bp, Rattus norvegicus
atcataggcgtcaccggtgaaggca

SEQ ID NO: 179618 - DNA, 25 bp, Rattus norvegicus
atcataggcgtctccggtgaaggca

SEQ ID NO: 179619 - DNA, 25 bp, Rattus norvegicus
atcataggtgtcagtgcttctttcc

SEQ ID NO: 179620 - DNA, 25 bp, Rattus norvegicus
atcataggtgtctgtgcttctttcc

SEQ ID NO: 179621 - DNA, 25 bp, Rattus norvegicus
atcataggttacaccttcactttga

SEQ ID NO: 179622 - DNA, 25 bp, Rattus norvegicus
atcataggttactccttcactttga

SEQ ID NO: 179623 - DNA, 25 bp, Rattus norvegicus
atcatagtgtaaccaaacgtctttg

SEQ ID NO: 179624 - DNA, 25 bp, Rattus norvegicus
atcatagtgtaagcaaacgtctttg

SEQ ID NO: 179625 - DNA, 25 bp, Rattus norvegicus
atcatagtgtttccgttggccatcc

SEQ ID NO: 179626 - DNA, 25 bp, Rattus norvegicus
atcatagtgtttgcgttggccatcc

SEQ ID NO: 179627 - DNA, 25 bp, Rattus norvegicus
atcatagttgagctatttgtctgta

SEQ ID NO: 179628 - DNA, 25 bp, Rattus norvegicus
atcatagttgaggtatttgtctgta

SEQ ID NO: 179629 - DNA, 25 bp, Rattus norvegicus
atcatagttggtcaatgcctggcag

SEQ ID NO: 179630 - DNA, 25 bp, Rattus norvegicus
atcatagttggtgaatgcctggcag

SEQ ID NO: 179631 - DNA, 25 bp, Rattus norvegicus
atcatagtttgcctttacccttgtc

SEQ ID NO: 179632 - DNA, 25 bp, Rattus norvegicus
atcatagtttgcgtttacccttgtc

SEQ ID NO: 179633 - DNA, 25 bp, Rattus norvegicus
atcatataccagctgcaggacgtct

SEQ ID NO: 179634 - DNA, 25 bp, Rattus norvegicus
atcatataccaggtgcaggacgtct

SEQ ID NO: 179635 - DNA, 25 bp, Rattus norvegicus
atcatataggatccggcgatctcat

SEQ ID NO: 179636 - DNA, 25 bp, Rattus norvegicus
atcatataggatgcggcgatctcat

SEQ ID NO: 179637 - DNA, 25 bp, Rattus norvegicus
atcatatcttctaatatctctacaa

SEQ ID NO: 179638 - DNA, 25 bp, Rattus norvegicus
atcatatcttcttatatctctacaa

SEQ ID NO: 179639 - DNA, 25 bp, Rattus norvegicus
atcatatggcaactctgtgtttaac

SEQ ID NO: 179640 - DNA, 25 bp, Rattus norvegicus
atcatatggcaagtctgtgtttaac

SEQ ID NO: 179641 - DNA, 25 bp, Rattus norvegicus
atcatatgtgttactagtggcatca

SEQ ID NO: 179642 - DNA, 25 bp, Rattus norvegicus
atcatatgtgtttctagtggcatca

SEQ ID NO: 179643 - DNA, 25 bp, Rattus norvegicus
atcatattcaaccagctatccacct

SEQ ID NO: 179644 - DNA, 25 bp, Rattus norvegicus
atcatattcaacgagctatccacct

SEQ ID NO: 179645 - DNA, 25 bp, Rattus norvegicus
atcatattccatagtgtcagttaac

SEQ ID NO: 179646 - DNA, 25 bp, Rattus norvegicus
atcatattccattgtgtcagttaac

SEQ ID NO: 179647 - DNA, 25 bp, Rattus norvegicus
atcatattcccgcttgacattgacc

SEQ ID NO: 179648 - DNA, 25 bp, Rattus norvegicus
atcatattcccggttgacattgacc

SEQ ID NO: 179649 - DNA, 25 bp, Rattus norvegicus
atcatattgagcacgttcactttga

SEQ ID NO: 179650 - DNA, 25 bp, Rattus norvegicus
atcatattgagctcgttcactttga

SEQ ID NO: 179651 - DNA, 25 bp, Rattus norvegicus
atcatatttctgcaacctgggtgtt

SEQ ID NO: 179652 - DNA, 25 bp, Rattus norvegicus
atcatatttctggaacctgggtgtt

SEQ ID NO: 179653 - DNA, 25 bp, Rattus norvegicus
atcatatttggacggctcatggaca

SEQ ID NO: 179654 - DNA, 25 bp, Rattus norvegicus
atcatatttggagggctcatggaca

SEQ ID NO: 179655 - DNA, 25 bp, Rattus norvegicus
atcatcaaaggcatatcgtctgtaa

SEQ ID NO: 179656 - DNA, 25 bp, Rattus norvegicus
atcatcaaaggcttatcgtctgtaa

SEQ ID NO: 179657 - DNA, 25 bp, Rattus norvegicus
atcatcaacaggactcttagcggta

SEQ ID NO: 179658 - DNA, 25 bp, Rattus norvegicus
atcatcaacaggtctcttagcggta

SEQ ID NO: 179659 - DNA, 25 bp, Rattus norvegicus
atcatcaagcctagactagcccagt

SEQ ID NO: 179660 - DNA, 25 bp, Rattus norvegicus
atcatcaagccttgactagcccagt

SEQ ID NO: 179661 - DNA, 25 bp, Rattus norvegicus
atcatcaagtgtacctaaactgtag

SEQ ID NO: 179662 - DNA, 25 bp, Rattus norvegicus
atcatcaagtgttcctaaactgtag

SEQ ID NO: 179663 - DNA, 25 bp, Rattus norvegicus
atcatcaatcaacaacgtgccacat

SEQ ID NO: 179664 - DNA, 25 bp, Rattus norvegicus
atcatcaatcaagaacgtgccacat

SEQ ID NO: 179665 - DNA, 25 bp, Rattus norvegicus
atcatcacagatcttcggaaccagc

SEQ ID NO: 179666 - DNA, 25 bp, Rattus norvegicus
atcatcacagatgttcggaaccagc

SEQ ID NO: 179667 - DNA, 25 bp, Rattus norvegicus
atcatcaccatcctctgcatggcat

SEQ ID NO: 179668 - DNA, 25 bp, Rattus norvegicus
atcatcaccatcgtctgcatggcat

SEQ ID NO: 179669 - DNA, 25 bp, Rattus norvegicus
atcatcaccttgaataaccgcatca

SEQ ID NO: 179670 - DNA, 25 bp, Rattus norvegicus
atcatcaccttgtataaccgcatca

SEQ ID NO: 179671 - DNA, 25 bp, Rattus norvegicus
atcatcacgcataggctttcaaggg

SEQ ID NO: 179672 - DNA, 25 bp, Rattus norvegicus
atcatcacgcattggctttcaaggg

SEQ ID NO: 179673 - DNA, 25 bp, Rattus norvegicus
atcatcactactaacagctctttct

SEQ ID NO: 179674 - DNA, 25 bp, Rattus norvegicus
atcatcactacttacagctctttct

SEQ ID NO: 179675 - DNA, 25 bp, Rattus norvegicus
atcatcactgagcagatgcctgaga

SEQ ID NO: 179676 - DNA, 25 bp, Rattus norvegicus
atcatcactgaggagatgcctgaga

SEQ ID NO: 179677 - DNA, 25 bp, Rattus norvegicus
atcatcactgtgagttacggcctga

SEQ ID NO: 179678 - DNA, 25 bp, Rattus norvegicus
atcatcactgtgtgttacggcctga

SEQ ID NO: 179679 - DNA, 25 bp, Rattus norvegicus
atcatcagacctcagagcctttgtt

SEQ ID NO: 179680 - DNA, 25 bp, Rattus norvegicus
atcatcagacctgagagcctttgtt

SEQ ID NO: 179681 - DNA, 25 bp, Rattus norvegicus
atcatcagagacaccaagtagccct

SEQ ID NO: 179682 - DNA, 25 bp, Rattus norvegicus
atcatcagagactccaagtagccct

SEQ ID NO: 179683 - DNA, 25 bp, Rattus norvegicus
atcatcagcaagctggccagccaga

SEQ ID NO: 179684 - DNA, 25 bp, Rattus norvegicus
atcatcagcaaggtggccagccaga

SEQ ID NO: 179685 - DNA, 25 bp, Rattus norvegicus
atcatcaggaacaggctgtgtccct

SEQ ID NO: 179686 - DNA, 25 bp, Rattus norvegicus
atcatcaggaactggctgtgtccct

SEQ ID NO: 179687 - DNA, 25 bp, Rattus norvegicus
atcatcagtttcctgtctctgctgg

SEQ ID NO: 179688 - DNA, 25 bp, Rattus norvegicus
atcatcagtttcgtgtctctgctgg

SEQ ID NO: 179689 - DNA, 25 bp, Rattus norvegicus
atcatcatccctatgtgcatggcac

SEQ ID NO: 179690 - DNA, 25 bp, Rattus norvegicus
atcatcatccctttgtgcatggcac

SEQ ID NO: 179691 - DNA, 25 bp, Rattus norvegicus
atcatcatctgtatcgggtttcttc

SEQ ID NO: 179692 - DNA, 25 bp, Rattus norvegicus
atcatcatctgtttcgggtttcttc

SEQ ID NO: 179693 - DNA, 25 bp, Rattus norvegicus
atcatcatgctgacctgttacttct

SEQ ID NO: 179694 - DNA, 25 bp, Rattus norvegicus
atcatcatgctgtcctgttacttct

SEQ ID NO: 179695 - DNA, 25 bp, Rattus norvegicus
atcatcatgggtctgttcacgctct

SEQ ID NO: 179696 - DNA, 25 bp, Rattus norvegicus
atcatcatgggtgtgttcacgctct

SEQ ID NO: 179697 - DNA, 25 bp, Rattus norvegicus
atcatcatgtttagtgtgttcctca

SEQ ID NO: 179698 - DNA, 25 bp, Rattus norvegicus
atcatcatgttttgtgtgttcctca

SEQ ID NO: 179699 - DNA, 25 bp, Rattus norvegicus
atcatcattagccttgtggaagctg

SEQ ID NO: 179700 - DNA, 25 bp, Rattus norvegicus
atcatcattagcgttgtggaagctg

SEQ ID NO: 179701 - DNA, 25 bp, Rattus norvegicus
atcatccaacgtaggctgcatttaa

SEQ ID NO: 179702 - DNA, 25 bp, Rattus norvegicus
atcatccaacgttggctgcatttaa

SEQ ID NO: 179703 - DNA, 25 bp, Rattus norvegicus
atcatccaagatagaggctgcagct

SEQ ID NO: 179704 - DNA, 25 bp, Rattus norvegicus
atcatccaagattgaggctgcagct

SEQ ID NO: 179705 - DNA, 25 bp, Rattus norvegicus
atcatccaagccaactgactgttgt

SEQ ID NO: 179706 - DNA, 25 bp, Rattus norvegicus
atcatccaagcctactgactgttgt

SEQ ID NO: 179707 - DNA, 25 bp, Rattus norvegicus
atcatccagccaactttgtcaaaga

SEQ ID NO: 179708 - DNA, 25 bp, Rattus norvegicus
atcatccagccatctttgtcaaaga

SEQ ID NO: 179709 - DNA, 25 bp, Rattus norvegicus
atcatccaggctctcgggattccgg

SEQ ID NO: 179710 - DNA, 25 bp, Rattus norvegicus
atcatccaggctgtcgggattccgg

SEQ ID NO: 179711 - DNA, 25 bp, Rattus norvegicus
atcatccagggtctgcctagttcac

SEQ ID NO: 179712 - DNA, 25 bp, Rattus norvegicus
atcatccagggtgtgcctagttcac

SEQ ID NO: 179713 - DNA, 25 bp, Rattus norvegicus
atcatccagttcagctttcactgaa

SEQ ID NO: 179714 - DNA, 25 bp, Rattus norvegicus
atcatccagttctgctttcactgaa

SEQ ID NO: 179715 - DNA, 25 bp, Rattus norvegicus
atcatccatccgcttctgggatgca

SEQ ID NO: 179716 - DNA, 25 bp, Rattus norvegicus
atcatccatccggttctgggatgca

SEQ ID NO: 179717 - DNA, 25 bp, Rattus norvegicus
atcatcccaaacaatgcctctttga

SEQ ID NO: 179718 - DNA, 25 bp, Rattus norvegicus
atcatcccaaactatgcctctttga

SEQ ID NO: 179719 - DNA, 25 bp, Rattus norvegicus
atcatcccaatactgttggttccct

SEQ ID NO: 179720 - DNA, 25 bp, Rattus norvegicus
atcatcccaatagtgttggttccct

SEQ ID NO: 179721 - DNA, 25 bp, Rattus norvegicus
atcatcccacttcattgatgccaag

SEQ ID NO: 179722 - DNA, 25 bp, Rattus norvegicus
atcatcccacttgattgatgccaag

SEQ ID NO: 179723 - DNA, 25 bp, Rattus norvegicus
atcatccccatgagcatcagaaagg

SEQ ID NO: 179724 - DNA, 25 bp, Rattus norvegicus
atcatccccatgtgcatcagaaagg

SEQ ID NO: 179725 - DNA, 25 bp, Rattus norvegicus
atcatccccttacggactacagaga

SEQ ID NO: 179726 - DNA, 25 bp, Rattus norvegicus
atcatccccttagggactacagaga

SEQ ID NO: 179727 - DNA, 25 bp, Rattus norvegicus
atcatcccgggcagaaggtggagct

SEQ ID NO: 179728 - DNA, 25 bp, Rattus norvegicus
atcatcccgggctgaaggtggagct

SEQ ID NO: 179729 - DNA, 25 bp, Rattus norvegicus
atcatccctaagatagagcccagcc

SEQ ID NO: 179730 - DNA, 25 bp, Rattus norvegicus
atcatccctaagttagagcccagcc

SEQ ID NO: 179731 - DNA, 25 bp, Rattus norvegicus
atcatccctccaatgctggagattg

SEQ ID NO: 179732 - DNA, 25 bp, Rattus norvegicus
atcatccctccattgctggagattg

SEQ ID NO: 179733 - DNA, 25 bp, Rattus norvegicus
atcatccctggtcttaagtgttaaa

SEQ ID NO: 179734 - DNA, 25 bp, Rattus norvegicus
atcatccctggtgttaagtgttaaa

SEQ ID NO: 179735 - DNA, 25 bp, Rattus norvegicus
atcatcccttttctcaccataattg

SEQ ID NO: 179736 - DNA, 25 bp, Rattus norvegicus
atcatcccttttgtcaccataattg

SEQ ID NO: 179737 - DNA, 25 bp, Rattus norvegicus
atcatccgcctgaagagtctcaatg

SEQ ID NO: 179738 - DNA, 25 bp, Rattus norvegicus
atcatccgcctgtagagtctcaatg

SEQ ID NO: 179739 - DNA, 25 bp, Rattus norvegicus
atcatccggatgctgaggcctcgag

SEQ ID NO: 179740 - DNA, 25 bp, Rattus norvegicus
atcatccggatggtgaggcctcgag

SEQ ID NO: 179741 - DNA, 25 bp, Rattus norvegicus
atcatccggtttcgtcatccaacaa

SEQ ID NO: 179742 - DNA, 25 bp, Rattus norvegicus
atcatccggtttggtcatccaacaa

SEQ ID NO: 179743 - DNA, 25 bp, Rattus norvegicus
atcatcctaacacctttgaattcct

SEQ ID NO: 179744 - DNA, 25 bp, Rattus norvegicus
atcatcctaacagctttgaattcct

SEQ ID NO: 179745 - DNA, 25 bp, Rattus norvegicus
atcatcctcagcattgtggacatgg

SEQ ID NO: 179746 - DNA, 25 bp, Rattus norvegicus
atcatcctcagctttgtggacatgg

SEQ ID NO: 179747 - DNA, 25 bp, Rattus norvegicus
atcatcctccctatgctttactgaa

SEQ ID NO: 179748 - DNA, 25 bp, Rattus norvegicus
atcatcctccctttgctttactgaa

SEQ ID NO: 179749 - DNA, 25 bp, Rattus norvegicus
atcatcctctcacttagctgggagg

SEQ ID NO: 179750 - DNA, 25 bp, Rattus norvegicus
atcatcctctcagttagctgggagg

SEQ ID NO: 179751 - DNA, 25 bp, Rattus norvegicus
atcatcctctgcagcctctgctgag

SEQ ID NO: 179752 - DNA, 25 bp, Rattus norvegicus
atcatcctctgctgcctctgctgag

SEQ ID NO: 179753 - DNA, 25 bp, Rattus norvegicus
atcatcctgactactgaactggctg

SEQ ID NO: 179754 - DNA, 25 bp, Rattus norvegicus
atcatcctgactatggcactggcag

SEQ ID NO: 179755 - DNA, 25 bp, Rattus norvegicus
atcatcctgacttctgaactggctg

SEQ ID NO: 179756 - DNA, 25 bp, Rattus norvegicus
atcatcctgactttggcactggcag

SEQ ID NO: 179757 - DNA, 25 bp, Rattus norvegicus
atcatcctgataccattgcatctag

SEQ ID NO: 179758 - DNA, 25 bp, Rattus norvegicus
atcatcctgatagcattgcatctag

SEQ ID NO: 179759 - DNA, 25 bp, Rattus norvegicus
atcatcctgcccaaatgtgttcaga

SEQ ID NO: 179760 - DNA, 25 bp, Rattus norvegicus
atcatcctgccctaatgtgttcaga

SEQ ID NO: 179761 - DNA, 25 bp, Rattus norvegicus
atcatcctgcttctgtcttatgaga

SEQ ID NO: 179762 - DNA, 25 bp, Rattus norvegicus
atcatcctgcttgtgtcttatgaga

SEQ ID NO: 179763 - DNA, 25 bp, Rattus norvegicus
atcatcctggacaggcaggtgcaca

SEQ ID NO: 179764 - DNA, 25 bp, Rattus norvegicus
atcatcctggactggcaggtgcaca

SEQ ID NO: 179765 - DNA, 25 bp, Rattus norvegicus
atcatcctggatcccttggaacagc

SEQ ID NO: 179766 - DNA, 25 bp, Rattus norvegicus
atcatcctggatgccttggaacagc

SEQ ID NO: 179767 - DNA, 25 bp, Rattus norvegicus
atcatcctggtaatcaggccgttgg

SEQ ID NO: 179768 - DNA, 25 bp, Rattus norvegicus
atcatcctggtattcaggccgttgg

SEQ ID NO: 179769 - DNA, 25 bp, Rattus norvegicus
atcatcctgtaaaaaatgcctgttg

SEQ ID NO: 179770 - DNA, 25 bp, Rattus norvegicus
atcatcctgtaataaatgcctgttg

SEQ ID NO: 179771 - DNA, 25 bp, Rattus norvegicus
atcatcctgttactggcctatgtga

SEQ ID NO: 179772 - DNA, 25 bp, Rattus norvegicus
atcatcctgttagtggcctatgtga

SEQ ID NO: 179773 - DNA, 25 bp, Rattus norvegicus
atcatccttaatactcggtctcaac

SEQ ID NO: 179774 - DNA, 25 bp, Rattus norvegicus
atcatccttaattctcggtctcaac

SEQ ID NO: 179775 - DNA, 25 bp, Rattus norvegicus
atcatccttggtagtgtatcgtgta

SEQ ID NO: 179776 - DNA, 25 bp, Rattus norvegicus
atcatccttggttgtgtatcgtgta

SEQ ID NO: 179777 - DNA, 25 bp, Rattus norvegicus
atcatcctttgaattgccccaagtg

SEQ ID NO: 179778 - DNA, 25 bp, Rattus norvegicus
atcatcctttgatttgccccaagtg

SEQ ID NO: 179779 - DNA, 25 bp, Rattus norvegicus
atcatcctttgtactgaccattctt

SEQ ID NO: 179780 - DNA, 25 bp, Rattus norvegicus
atcatcctttgttctgaccattctt

SEQ ID NO: 179781 - DNA, 25 bp, Rattus norvegicus
atcatcgaaacccaaaaagcttact

SEQ ID NO: 179782 - DNA, 25 bp, Rattus norvegicus
atcatcgaaaccgaaaaagcttact

SEQ ID NO: 179783 - DNA, 25 bp, Rattus norvegicus
atcatcgaggagacgctcgcgctca

SEQ ID NO: 179784 - DNA, 25 bp, Rattus norvegicus
atcatcgaggagtcgctcgcgctca

SEQ ID NO: 179785 - DNA, 25 bp, Rattus norvegicus
atcatcgcagacaacctaagctggt

SEQ ID NO: 179786 - DNA, 25 bp, Rattus norvegicus
atcatcgcagactacctaagctggt

SEQ ID NO: 179787 - DNA, 25 bp, Rattus norvegicus
atcatcgcatcacacccatgtgaaa

SEQ ID NO: 179788 - DNA, 25 bp, Rattus norvegicus
atcatcgcatcagacccatgtgaaa

SEQ ID NO: 179789 - DNA, 25 bp, Rattus norvegicus
atcatcgccacaatggtctgcagtg

SEQ ID NO: 179790 - DNA, 25 bp, Rattus norvegicus
atcatcgccacattggtctgcagtg

SEQ ID NO: 179791 - DNA, 25 bp, Rattus norvegicus
atcatcgccagtcccttgaggagaa

SEQ ID NO: 179792 - DNA, 25 bp, Rattus norvegicus
atcatcgccagtgccttgaggagaa

SEQ ID NO: 179793 - DNA, 25 bp, Rattus norvegicus
atcatcgcggcgagattgacctgga

SEQ ID NO: 179794 - DNA, 25 bp, Rattus norvegicus
atcatcgcggcgtgattgacctgga

SEQ ID NO: 179795 - DNA, 25 bp, Rattus norvegicus
atcatcgcttttatctgctagccag

SEQ ID NO: 179796 - DNA, 25 bp, Rattus norvegicus
atcatcgcttttttctgctagccag

SEQ ID NO: 179797 - DNA, 25 bp, Rattus norvegicus
atcatcgtcgtcaaagggttcgtct

SEQ ID NO: 179798 - DNA, 25 bp, Rattus norvegicus
atcatcgtcgtctaagggttcgtct

SEQ ID NO: 179799 - DNA, 25 bp, Rattus norvegicus
atcatcgtctacatttccagcaaca

SEQ ID NO: 179800 - DNA, 25 bp, Rattus norvegicus
atcatcgtctacttttccagcaaca

SEQ ID NO: 179801 - DNA, 25 bp, Rattus norvegicus
atcatcgttgatacagaagccttgt

SEQ ID NO: 179802 - DNA, 25 bp, Rattus norvegicus
atcatcgttgattcagaagccttgt

SEQ ID NO: 179803 - DNA, 25 bp, Rattus norvegicus
atcatctacaccacacatggcaagt

SEQ ID NO: 179804 - DNA, 25 bp, Rattus norvegicus
atcatctacacctcacatggcaagt

SEQ ID NO: 179805 - DNA, 25 bp, Rattus norvegicus
atcatctaccccaagtacccgaaga

SEQ ID NO: 179806 - DNA, 25 bp, Rattus norvegicus
atcatctacccctagtacccgaaga

SEQ ID NO: 179807 - DNA, 25 bp, Rattus norvegicus
atcatctacctcatcctggacaaaa

SEQ ID NO: 179808 - DNA, 25 bp, Rattus norvegicus
atcatctacctcttcctggacaaaa

SEQ ID NO: 179809 - DNA, 25 bp, Rattus norvegicus
atcatctacggcaacttcaacgaga

SEQ ID NO: 179810 - DNA, 25 bp, Rattus norvegicus
atcatctacggctacttcaacgaga

SEQ ID NO: 179811 - DNA, 25 bp, Rattus norvegicus
atcatctatcacctatctacttatc

SEQ ID NO: 179812 - DNA, 25 bp, Rattus norvegicus
atcatctatcacgtatctacttatc

SEQ ID NO: 179813 - DNA, 25 bp, Rattus norvegicus
atcatctatctgaccttcctacctt

SEQ ID NO: 179814 - DNA, 25 bp, Rattus norvegicus
atcatctatctgtccttcctacctt

SEQ ID NO: 179815 - DNA, 25 bp, Rattus norvegicus
atcatctccatcactgagtcacaag

SEQ ID NO: 179816 - DNA, 25 bp, Rattus norvegicus
atcatctccatctctgagtcacaag

SEQ ID NO: 179817 - DNA, 25 bp, Rattus norvegicus
atcatctcgaatcggcccagggtct

SEQ ID NO: 179818 - DNA, 25 bp, Rattus norvegicus
atcatctcgaatgggcccagggtct

SEQ ID NO: 179819 - DNA, 25 bp, Rattus norvegicus
atcatctcgcccaggtgtgtaataa

SEQ ID NO: 179820 - DNA, 25 bp, Rattus norvegicus
atcatctcgccctggtgtgtaataa

SEQ ID NO: 179821 - DNA, 25 bp, Rattus norvegicus
atcatctcgtccacaggatgtttca

SEQ ID NO: 179822 - DNA, 25 bp, Rattus norvegicus
atcatctcgtcctcaggatgtttca

SEQ ID NO: 179823 - DNA, 25 bp, Rattus norvegicus
atcatctctcgtcgtactggtggct

SEQ ID NO: 179824 - DNA, 25 bp, Rattus norvegicus
atcatctctcgtggtactggtggct

SEQ ID NO: 179825 - DNA, 25 bp, Rattus norvegicus
atcatctctctcatagtggctttgg

SEQ ID NO: 179826 - DNA, 25 bp, Rattus norvegicus
atcatctctctcttagtggctttgg

SEQ ID NO: 179827 - DNA, 25 bp, Rattus norvegicus
atcatctctgtaaagatccatagac

SEQ ID NO: 179828 - DNA, 25 bp, Rattus norvegicus
atcatctctgtatagatccatagac

SEQ ID NO: 179829 - DNA, 25 bp, Rattus norvegicus
atcatctctgtcatcagcccaatgg

SEQ ID NO: 179830 - DNA, 25 bp, Rattus norvegicus
atcatctctgtcttcagcccaatgg

SEQ ID NO: 179831 - DNA, 25 bp, Rattus norvegicus
atcatctctgtgattggcaccagac

SEQ ID NO: 179832 - DNA, 25 bp, Rattus norvegicus
atcatctctgtgtttggcaccagac

SEQ ID NO: 179833 - DNA, 25 bp, Rattus norvegicus
atcatctctttcagctctgggttag

SEQ ID NO: 179834 - DNA, 25 bp, Rattus norvegicus
atcatctctttcagggaaaacagaa

SEQ ID NO: 179835 - DNA, 25 bp, Rattus norvegicus
atcatctctttctgctctgggttag

SEQ ID NO: 179836 - DNA, 25 bp, Rattus norvegicus
atcatctctttctgggaaaacagaa

SEQ ID NO: 179837 - DNA, 25 bp, Rattus norvegicus
atcatctgaagtcaaggtcccaccc

SEQ ID NO: 179838 - DNA, 25 bp, Rattus norvegicus
atcatctgaagtgaaggtcccaccc

SEQ ID NO: 179839 - DNA, 25 bp, Rattus norvegicus
atcatctgaatacttgtcatccagg

SEQ ID NO: 179840 - DNA, 25 bp, Rattus norvegicus
atcatctgaatagttgtcatccagg

SEQ ID NO: 179841 - DNA, 25 bp, Rattus norvegicus
atcatctgagaaatccagctcctcg

SEQ ID NO: 179842 - DNA, 25 bp, Rattus norvegicus
atcatctgagaactccaggttgggt

SEQ ID NO: 179843 - DNA, 25 bp, Rattus norvegicus
atcatctgagaagtccaggttgggt

SEQ ID NO: 179844 - DNA, 25 bp, Rattus norvegicus
atcatctgagaattccagctcctcg

SEQ ID NO: 179845 - DNA, 25 bp, Rattus norvegicus
atcatctgagagacgctgtcatgcc

SEQ ID NO: 179846 - DNA, 25 bp, Rattus norvegicus
atcatctgagagatctgcttggcta

SEQ ID NO: 179847 - DNA, 25 bp, Rattus norvegicus
atcatctgagagtcgctgtcatgcc

SEQ ID NO: 179848 - DNA, 25 bp, Rattus norvegicus
atcatctgagagttctgcttggcta

SEQ ID NO: 179849 - DNA, 25 bp, Rattus norvegicus
atcatctgagatactctgttccagc

SEQ ID NO: 179850 - DNA, 25 bp, Rattus norvegicus
atcatctgagattctctgttccagc

SEQ ID NO: 179851 - DNA, 25 bp, Rattus norvegicus
atcatctgcagcacaatttgcctgc

SEQ ID NO: 179852 - DNA, 25 bp, Rattus norvegicus
atcatctgcagctcaatttgcctgc

SEQ ID NO: 179853 - DNA, 25 bp, Rattus norvegicus
atcatctgccaaacagctggtgtca

SEQ ID NO: 179854 - DNA, 25 bp, Rattus norvegicus
atcatctgccaatcagctggtgtca

SEQ ID NO: 179855 - DNA, 25 bp, Rattus norvegicus
atcatctgccatcactctggttttt

SEQ ID NO: 179856 - DNA, 25 bp, Rattus norvegicus
atcatctgccatgactctggttttt

SEQ ID NO: 179857 - DNA, 25 bp, Rattus norvegicus
atcatctgcccaagaatcccgaaaa

SEQ ID NO: 179858 - DNA, 25 bp, Rattus norvegicus
atcatctgcccatgaatcccgaaaa

SEQ ID NO: 179859 - DNA, 25 bp, Rattus norvegicus
atcatctgggatcctctggactgga

SEQ ID NO: 179860 - DNA, 25 bp, Rattus norvegicus
atcatctgggatgctctggactgga

SEQ ID NO: 179861 - DNA, 25 bp, Rattus norvegicus
atcatctggtccagatttttgtttt

SEQ ID NO: 179862 - DNA, 25 bp, Rattus norvegicus
atcatctggtcctgatttttgtttt

SEQ ID NO: 179863 - DNA, 25 bp, Rattus norvegicus
atcatctgtctgagtggcggtgccg

SEQ ID NO: 179864 - DNA, 25 bp, Rattus norvegicus
atcatctgtctgtgtggcggtgccg

SEQ ID NO: 179865 - DNA, 25 bp, Rattus norvegicus
atcatctgtgtcatcaacgaacgga

SEQ ID NO: 179866 - DNA, 25 bp, Rattus norvegicus
atcatctgtgtcttcaacgaacgga

SEQ ID NO: 179867 - DNA, 25 bp, Rattus norvegicus
atcatcttaccacatggcacctgcg

SEQ ID NO: 179868 - DNA, 25 bp, Rattus norvegicus
atcatcttaccagatggcacctgcg

SEQ ID NO: 179869 - DNA, 25 bp, Rattus norvegicus
atcatcttcaaacttactcctgtgg

SEQ ID NO: 179870 - DNA, 25 bp, Rattus norvegicus
atcatcttcaaagttactcctgtgg

SEQ ID NO: 179871 - DNA, 25 bp, Rattus norvegicus
atcatcttcaacatcctgcctgaca

SEQ ID NO: 179872 - DNA, 25 bp, Rattus norvegicus
atcatcttcaacttcctgcctgaca

SEQ ID NO: 179873 - DNA, 25 bp, Rattus norvegicus
atcatcttcctgaaacgacctctat

SEQ ID NO: 179874 - DNA, 25 bp, Rattus norvegicus
atcatcttcctgcatcactgtggag

SEQ ID NO: 179875 - DNA, 25 bp, Rattus norvegicus
atcatcttcctgctgggcagcgtgt

SEQ ID NO: 179876 - DNA, 25 bp, Rattus norvegicus
atcatcttcctggatcactgtggag

SEQ ID NO: 179877 - DNA, 25 bp, Rattus norvegicus
atcatcttcctggtgggcagcgtgt

SEQ ID NO: 179878 - DNA, 25 bp, Rattus norvegicus
atcatcttcctgtaacgacctctat

SEQ ID NO: 179879 - DNA, 25 bp, Rattus norvegicus
atcatcttctacagtgcttgttgga

SEQ ID NO: 179880 - DNA, 25 bp, Rattus norvegicus
atcatcttctactgtgcttgttgga

SEQ ID NO: 179881 - DNA, 25 bp, Rattus norvegicus
atcatcttctgcactacacacaagt

SEQ ID NO: 179882 - DNA, 25 bp, Rattus norvegicus
atcatcttctgcatcactgtcaaat

SEQ ID NO: 179883 - DNA, 25 bp, Rattus norvegicus
atcatcttctgctctacacacaagt

SEQ ID NO: 179884 - DNA, 25 bp, Rattus norvegicus
atcatcttctgcttcactgtcaaat

SEQ ID NO: 179885 - DNA, 25 bp, Rattus norvegicus
atcatcttggcgactgtgggctaaa

SEQ ID NO: 179886 - DNA, 25 bp, Rattus norvegicus
atcatcttggcgtctgtgggctaaa

SEQ ID NO: 179887 - DNA, 25 bp, Rattus norvegicus
atcatcttgtacaccattgctttta

SEQ ID NO: 179888 - DNA, 25 bp, Rattus norvegicus
atcatcttgtactccattgctttta

SEQ ID NO: 179889 - DNA, 25 bp, Rattus norvegicus
atcatcttgtttaaatcccgtggtg

SEQ ID NO: 179890 - DNA, 25 bp, Rattus norvegicus
atcatcttgttttaatcccgtggtg

SEQ ID NO: 179891 - DNA, 25 bp, Rattus norvegicus
atcatctttgatatcttgtgttaca

SEQ ID NO: 179892 - DNA, 25 bp, Rattus norvegicus
atcatctttgatttcttgtgttaca

SEQ ID NO: 179893 - DNA, 25 bp, Rattus norvegicus
atcatctttgcccatcctgtcaggc

SEQ ID NO: 179894 - DNA, 25 bp, Rattus norvegicus
atcatctttgccgatcctgtcaggc

SEQ ID NO: 179895 - DNA, 25 bp, Rattus norvegicus
atcatgaaagtcctcagtgtgcaga

SEQ ID NO: 179896 - DNA, 25 bp, Rattus norvegicus
atcatgaaagtcgtcagtgtgcaga

SEQ ID NO: 179897 - DNA, 25 bp, Rattus norvegicus
atcatgaagggcctgctctcagaac

SEQ ID NO: 179898 - DNA, 25 bp, Rattus norvegicus
atcatgaagggcgtgctctcagaac

SEQ ID NO: 179899 - DNA, 25 bp, Rattus norvegicus
atcatgaatcccatcgggccgggcg

SEQ ID NO: 179900 - DNA, 25 bp, Rattus norvegicus
atcatgaatcccttcgggccgggcg

SEQ ID NO: 179901 - DNA, 25 bp, Rattus norvegicus
atcatgacaactcgcctgtgggagc

SEQ ID NO: 179902 - DNA, 25 bp, Rattus norvegicus
atcatgacaactggcctgtgggagc

SEQ ID NO: 179903 - DNA, 25 bp, Rattus norvegicus
atcatgacagtcctatagaacctta

SEQ ID NO: 179904 - DNA, 25 bp, Rattus norvegicus
atcatgacagtcgtatagaacctta

SEQ ID NO: 179905 - DNA, 25 bp, Rattus norvegicus
atcatgacatccaacaacaaaagtg

SEQ ID NO: 179906 - DNA, 25 bp, Rattus norvegicus
atcatgacatcctacaacaaaagtg

SEQ ID NO: 179907 - DNA, 25 bp, Rattus norvegicus
atcatgaccccgatatccttcctag

SEQ ID NO: 179908 - DNA, 25 bp, Rattus norvegicus
atcatgaccccgttatccttcctag

SEQ ID NO: 179909 - DNA, 25 bp, Rattus norvegicus
atcatgaccttgactgcggagtcca

SEQ ID NO: 179910 - DNA, 25 bp, Rattus norvegicus
atcatgaccttgtctgcggagtcca

SEQ ID NO: 179911 - DNA, 25 bp, Rattus norvegicus
atcatgacgagcagtctatgtgctt

SEQ ID NO: 179912 - DNA, 25 bp, Rattus norvegicus
atcatgacgagctgtctatgtgctt

SEQ ID NO: 179913 - DNA, 25 bp, Rattus norvegicus
atcatgacggctatgtactgtggaa

SEQ ID NO: 179914 - DNA, 25 bp, Rattus norvegicus
atcatgacggctttgtactgtggaa

SEQ ID NO: 179915 - DNA, 25 bp, Rattus norvegicus
atcatgacttcactttagcagagga

SEQ ID NO: 179916 - DNA, 25 bp, Rattus norvegicus
atcatgacttcagtttagcagagga

SEQ ID NO: 179917 - DNA, 25 bp, Rattus norvegicus
atcatgactttgacctggaggctca

SEQ ID NO: 179918 - DNA, 25 bp, Rattus norvegicus
atcatgactttgtcctggaggctca

SEQ ID NO: 179919 - DNA, 25 bp, Rattus norvegicus
atcatgagatccaccagtgggtcct

SEQ ID NO: 179920 - DNA, 25 bp, Rattus norvegicus
atcatgagatcctccagtgggtcct

SEQ ID NO: 179921 - DNA, 25 bp, Rattus norvegicus
atcatgaggtacaaaagctgccaca

SEQ ID NO: 179922 - DNA, 25 bp, Rattus norvegicus
atcatgaggtactaaagctgccaca

SEQ ID NO: 179923 - DNA, 25 bp, Rattus norvegicus
atcatgagtattcagaactgtccac

SEQ ID NO: 179924 - DNA, 25 bp, Rattus norvegicus
atcatgagtattgagaactgtccac

SEQ ID NO: 179925 - DNA, 25 bp, Rattus norvegicus
atcatgagttggaggctggcctaga

SEQ ID NO: 179926 - DNA, 25 bp, Rattus norvegicus
atcatgagttggtggctggcctaga

SEQ ID NO: 179927 - DNA, 25 bp, Rattus norvegicus
atcatgatcatcactcggtttgctg

SEQ ID NO: 179928 - DNA, 25 bp, Rattus norvegicus
atcatgatcatctctcggtttgctg

SEQ ID NO: 179929 - DNA, 25 bp, Rattus norvegicus
atcatgatctcactagtattcctct

SEQ ID NO: 179930 - DNA, 25 bp, Rattus norvegicus
atcatgatctcagtagtattcctct

SEQ ID NO: 179931 - DNA, 25 bp, Rattus norvegicus
atcatgatggatccttctggtcaca

SEQ ID NO: 179932 - DNA, 25 bp, Rattus norvegicus
atcatgatggatgcttctggtcaca

SEQ ID NO: 179933 - DNA, 25 bp, Rattus norvegicus
atcatgatgttgcaagtcactgagc

SEQ ID NO: 179934 - DNA, 25 bp, Rattus norvegicus
atcatgatgttggaagtcactgagc

SEQ ID NO: 179935 - DNA, 25 bp, Rattus norvegicus
atcatgattaaactgcgcgtgggcc

SEQ ID NO: 179936 - DNA, 25 bp, Rattus norvegicus
atcatgattaaagtgcgcgtgggcc

SEQ ID NO: 179937 - DNA, 25 bp, Rattus norvegicus
atcatgattaatcgtgcccgtgaac

SEQ ID NO: 179938 - DNA, 25 bp, Rattus norvegicus
atcatgattaatggtgcccgtgaac

SEQ ID NO: 179939 - DNA, 25 bp, Rattus norvegicus
atcatgattggcactctgacggcac

SEQ ID NO: 179940 - DNA, 25 bp, Rattus norvegicus
atcatgattggctctctgacggcac

SEQ ID NO: 179941 - DNA, 25 bp, Rattus norvegicus
atcatgcaaactatcctaggctggc

SEQ ID NO: 179942 - DNA, 25 bp, Rattus norvegicus
atcatgcaaactttcctaggctggc

SEQ ID NO: 179943 - DNA, 25 bp, Rattus norvegicus
atcatgcagccccttggcaaagagg

SEQ ID NO: 179944 - DNA, 25 bp, Rattus norvegicus
atcatgcagcccgttggcaaagagg

SEQ ID NO: 179945 - DNA, 25 bp, Rattus norvegicus
atcatgcagcttcacggctggtgag

SEQ ID NO: 179946 - DNA, 25 bp, Rattus norvegicus
atcatgcagcttgacggctggtgag

SEQ ID NO: 179947 - DNA, 25 bp, Rattus norvegicus
atcatgcaggtcagaggtccatctt

SEQ ID NO: 179948 - DNA, 25 bp, Rattus norvegicus
atcatgcaggtctgaggtccatctt

SEQ ID NO: 179949 - DNA, 25 bp, Rattus norvegicus
atcatgcatatgactgcttctgccc

SEQ ID NO: 179950 - DNA, 25 bp, Rattus norvegicus
atcatgcatatgtctgcttctgccc

SEQ ID NO: 179951 - DNA, 25 bp, Rattus norvegicus
atcatgcatcatctttacaacttgt

SEQ ID NO: 179952 - DNA, 25 bp, Rattus norvegicus
atcatgcatcatgtttacaacttgt

SEQ ID NO: 179953 - DNA, 25 bp, Rattus norvegicus
atcatgcccagccaggaatctttat

SEQ ID NO: 179954 - DNA, 25 bp, Rattus norvegicus
atcatgcccagcgaggaatctttat

SEQ ID NO: 179955 - DNA, 25 bp, Rattus norvegicus
atcatgcccagtcactgttttggtt

SEQ ID NO: 179956 - DNA, 25 bp, Rattus norvegicus
atcatgcccagtgactgttttggtt

SEQ ID NO: 179957 - DNA, 25 bp, Rattus norvegicus
atcatgccccatagatttcactgga

SEQ ID NO: 179958 - DNA, 25 bp, Rattus norvegicus
atcatgccccattgatttcactgga

SEQ ID NO: 179959 - DNA, 25 bp, Rattus norvegicus
atcatgcccctcagagaaaaactaa

SEQ ID NO: 179960 - DNA, 25 bp, Rattus norvegicus
atcatgcccctctgagaaaaactaa

SEQ ID NO: 179961 - DNA, 25 bp, Rattus norvegicus
atcatgccctaaactgatgcccagg

SEQ ID NO: 179962 - DNA, 25 bp, Rattus norvegicus
atcatgccctaatctgatgcccagg

SEQ ID NO: 179963 - DNA, 25 bp, Rattus norvegicus
atcatgcctgatccttgctactatg

SEQ ID NO: 179964 - DNA, 25 bp, Rattus norvegicus
atcatgcctgatgcttgctactatg

SEQ ID NO: 179965 - DNA, 25 bp, Rattus norvegicus
atcatgcctggtcctgggttgcttt

SEQ ID NO: 179966 - DNA, 25 bp, Rattus norvegicus
atcatgcctggtgctgggttgcttt

SEQ ID NO: 179967 - DNA, 25 bp, Rattus norvegicus
atcatgccttctaaccagggctgtt

SEQ ID NO: 179968 - DNA, 25 bp, Rattus norvegicus
atcatgccttcttaccagggctgtt

SEQ ID NO: 179969 - DNA, 25 bp, Rattus norvegicus
atcatgccttgtccccacggagcaa

SEQ ID NO: 179970 - DNA, 25 bp, Rattus norvegicus
atcatgccttgtgcccacggagcaa

SEQ ID NO: 179971 - DNA, 25 bp, Rattus norvegicus
atcatgcgggcacgaagtcagagca

SEQ ID NO: 179972 - DNA, 25 bp, Rattus norvegicus
atcatgcgggcaggaagtcagagca

SEQ ID NO: 179973 - DNA, 25 bp, Rattus norvegicus
atcatgcgtgtgcagctgtgtgcct

SEQ ID NO: 179974 - DNA, 25 bp, Rattus norvegicus
atcatgcgtgtggagctgtgtgcct

SEQ ID NO: 179975 - DNA, 25 bp, Rattus norvegicus
atcatgctaagcagccttgggcgct

SEQ ID NO: 179976 - DNA, 25 bp, Rattus norvegicus
atcatgctaagctgccttgggcgct

SEQ ID NO: 179977 - DNA, 25 bp, Rattus norvegicus
atcatgctacttcgtctaggctcag

SEQ ID NO: 179978 - DNA, 25 bp, Rattus norvegicus
atcatgctacttggtctaggctcag

SEQ ID NO: 179979 - DNA, 25 bp, Rattus norvegicus
atcatgctaggtcagcgggcccgat

SEQ ID NO: 179980 - DNA, 25 bp, Rattus norvegicus
atcatgctaggtgagcgggcccgat

SEQ ID NO: 179981 - DNA, 25 bp, Rattus norvegicus
atcatgctgcagagagacagcccct

SEQ ID NO: 179982 - DNA, 25 bp, Rattus norvegicus
atcatgctgcagtgagacagcccct

SEQ ID NO: 179983 - DNA, 25 bp, Rattus norvegicus
atcatgctggtcagctacgggctca

SEQ ID NO: 179984 - DNA, 25 bp, Rattus norvegicus
atcatgctggtctgctacgggctca

SEQ ID NO: 179985 - DNA, 25 bp, Rattus norvegicus
atcatgctggttcacatggctctga

SEQ ID NO: 179986 - DNA, 25 bp, Rattus norvegicus
atcatgctggttgacatggctctga

SEQ ID NO: 179987 - DNA, 25 bp, Rattus norvegicus
atcatgctgtccagcctcagcggga

SEQ ID NO: 179988 - DNA, 25 bp, Rattus norvegicus
atcatgctgtcctgcctcagcggga

SEQ ID NO: 179989 - DNA, 25 bp, Rattus norvegicus
atcatgctgttcaagtggtcggcta

SEQ ID NO: 179990 - DNA, 25 bp, Rattus norvegicus
atcatgctgttctagtggtcggcta

SEQ ID NO: 179991 - DNA, 25 bp, Rattus norvegicus
atcatgcttatgagcgacgcaggtc

SEQ ID NO: 179992 - DNA, 25 bp, Rattus norvegicus
atcatgcttatgtgcgacgcaggtc

SEQ ID NO: 179993 - DNA, 25 bp, Rattus norvegicus
atcatgcttcccacagcgagccttg

SEQ ID NO: 179994 - DNA, 25 bp, Rattus norvegicus
atcatgcttccctcagcgagccttg

SEQ ID NO: 179995 - DNA, 25 bp, Rattus norvegicus
atcatgcttctgctctcagcacaaa

SEQ ID NO: 179996 - DNA, 25 bp, Rattus norvegicus
atcatgcttctggtctcagcacaaa

SEQ ID NO: 179997 - DNA, 25 bp, Rattus norvegicus
atcatgcttggtcccgtgtatacaa

SEQ ID NO: 179998 - DNA, 25 bp, Rattus norvegicus
atcatgcttggtgccgtgtatacaa

SEQ ID NO: 179999 - DNA, 25 bp, Rattus norvegicus
atcatggacaaactccgctgcttcc

SEQ ID NO: 180000 - DNA, 25 bp, Rattus norvegicus
atcatggacaaagtccgctgcttcc

SEQ ID NO: 180001 - DNA, 25 bp, Rattus norvegicus
atcatggacacgagtcgcgtgcagc

SEQ ID NO: 180002 - DNA, 25 bp, Rattus norvegicus
atcatggacacgtgtcgcgtgcagc

SEQ ID NO: 180003 - DNA, 25 bp, Rattus norvegicus
atcatggagtccctacttcaatcta

SEQ ID NO: 180004 - DNA, 25 bp, Rattus norvegicus
atcatggagtccgtacttcaatcta

SEQ ID NO: 180005 - DNA, 25 bp, Rattus norvegicus
atcatggatcgcattgactgccagt

SEQ ID NO: 180006 - DNA, 25 bp, Rattus norvegicus
atcatggatcgctttgactgccagt

SEQ ID NO: 180007 - DNA, 25 bp, Rattus norvegicus
atcatggattccagacagctcctca

SEQ ID NO: 180008 - DNA, 25 bp, Rattus norvegicus
atcatggattcctgacagctcctca

SEQ ID NO: 180009 - DNA, 25 bp, Rattus norvegicus
atcatggcccaacaactagaactag

SEQ ID NO: 180010 - DNA, 25 bp, Rattus norvegicus
atcatggcccaagaactagaactag

SEQ ID NO: 180011 - DNA, 25 bp, Rattus norvegicus
atcatggcctacaccgagagcacaa

SEQ ID NO: 180012 - DNA, 25 bp, Rattus norvegicus
atcatggcctactccgagagcacaa

SEQ ID NO: 180013 - DNA, 25 bp, Rattus norvegicus
atcatggccttcctacgtgtttaac

SEQ ID NO: 180014 - DNA, 25 bp, Rattus norvegicus
atcatggccttcgtacgtgtttaac

SEQ ID NO: 180015 - DNA, 25 bp, Rattus norvegicus
atcatggctcccctttttatatctt

SEQ ID NO: 180016 - DNA, 25 bp, Rattus norvegicus
atcatggctcccgtttttatatctt

SEQ ID NO: 180017 - DNA, 25 bp, Rattus norvegicus
atcatggctctgattaaacctcctc

SEQ ID NO: 180018 - DNA, 25 bp, Rattus norvegicus
atcatggctctgtttaaacctcctc

SEQ ID NO: 180019 - DNA, 25 bp, Rattus norvegicus
atcatggctgctatttacacagagg

SEQ ID NO: 180020 - DNA, 25 bp, Rattus norvegicus
atcatggctgctttttacacagagg

SEQ ID NO: 180021 - DNA, 25 bp, Rattus norvegicus
atcatggctgtgactgtgtagtata

SEQ ID NO: 180022 - DNA, 25 bp, Rattus norvegicus
atcatggctgtgtctgtgtagtata

SEQ ID NO: 180023 - DNA, 25 bp, Rattus norvegicus
atcatggctttcaatggcgtcatcc

SEQ ID NO: 180024 - DNA, 25 bp, Rattus norvegicus
atcatggctttctatggcgtcatcc

SEQ ID NO: 180025 - DNA, 25 bp, Rattus norvegicus
atcatgggacagactcaaaccgtag

SEQ ID NO: 180026 - DNA, 25 bp, Rattus norvegicus
atcatgggacagtctcaaaccgtag

SEQ ID NO: 180027 - DNA, 25 bp, Rattus norvegicus
atcatgggagcaatttcgtcgtcct

SEQ ID NO: 180028 - DNA, 25 bp, Rattus norvegicus
atcatgggagcattttcgtcgtcct

SEQ ID NO: 180029 - DNA, 25 bp, Rattus norvegicus
atcatgggccatacgtgtagcttga

SEQ ID NO: 180030 - DNA, 25 bp, Rattus norvegicus
atcatgggccattcgtgtagcttga

SEQ ID NO: 180031 - DNA, 25 bp, Rattus norvegicus
atcatgggcctactgctgtgccatt

SEQ ID NO: 180032 - DNA, 25 bp, Rattus norvegicus
atcatgggcctagtgctgtgccatt

SEQ ID NO: 180033 - DNA, 25 bp, Rattus norvegicus
atcatgggtcatcagaaacttctta

SEQ ID NO: 180034 - DNA, 25 bp, Rattus norvegicus
atcatgggtcatgagaaacttctta

SEQ ID NO: 180035 - DNA, 25 bp, Rattus norvegicus
atcatgggtcctactggagctggga

SEQ ID NO: 180036 - DNA, 25 bp, Rattus norvegicus
atcatgggtccttctggagctggga

SEQ ID NO: 180037 - DNA, 25 bp, Rattus norvegicus
atcatggtatagactgtggccaaac

SEQ ID NO: 180038 - DNA, 25 bp, Rattus norvegicus
atcatggtatagtctgtggccaaac

SEQ ID NO: 180039 - DNA, 25 bp, Rattus norvegicus
atcatggtcaccacctagtgcgtat

SEQ ID NO: 180040 - DNA, 25 bp, Rattus norvegicus
atcatggtcacctcctagtgcgtat

SEQ ID NO: 180041 - DNA, 25 bp, Rattus norvegicus
atcatggtggaacatcttgcccctg

SEQ ID NO: 180042 - DNA, 25 bp, Rattus norvegicus
atcatggtggaagatcttgcccctg

SEQ ID NO: 180043 - DNA, 25 bp, Rattus norvegicus
atcatggtgtggacggaactgcccc

SEQ ID NO: 180044 - DNA, 25 bp, Rattus norvegicus
atcatggtgtggtcggaactgcccc

SEQ ID NO: 180045 - DNA, 25 bp, Rattus norvegicus
atcatggttcagaggatggccctac

SEQ ID NO: 180046 - DNA, 25 bp, Rattus norvegicus
atcatggttcagtggatggccctac

SEQ ID NO: 180047 - DNA, 25 bp, Rattus norvegicus
atcatgtaatgtaccgggcaccttc

SEQ ID NO: 180048 - DNA, 25 bp, Rattus norvegicus
atcatgtaatgttccgggcaccttc

SEQ ID NO: 180049 - DNA, 25 bp, Rattus norvegicus
atcatgtaatttccctattcagtgc

SEQ ID NO: 180050 - DNA, 25 bp, Rattus norvegicus
atcatgtaatttgcctattcagtgc

SEQ ID NO: 180051 - DNA, 25 bp, Rattus norvegicus
atcatgtatctgactgtagtgcttc

SEQ ID NO: 180052 - DNA, 25 bp, Rattus norvegicus
atcatgtatctgtctgtagtgcttc

SEQ ID NO: 180053 - DNA, 25 bp, Rattus norvegicus
atcatgtatgctaaggccccatttc

SEQ ID NO: 180054 - DNA, 25 bp, Rattus norvegicus
atcatgtatgcttaggccccatttc

SEQ ID NO: 180055 - DNA, 25 bp, Rattus norvegicus
atcatgtcagagcttctaggtctca

SEQ ID NO: 180056 - DNA, 25 bp, Rattus norvegicus
atcatgtcagaggttctaggtctca

SEQ ID NO: 180057 - DNA, 25 bp, Rattus norvegicus
atcatgtcagatatggcaccagagt

SEQ ID NO: 180058 - DNA, 25 bp, Rattus norvegicus
atcatgtcagatttggcaccagagt

SEQ ID NO: 180059 - DNA, 25 bp, Rattus norvegicus
atcatgtcataaacggcagtcttgc

SEQ ID NO: 180060 - DNA, 25 bp, Rattus norvegicus
atcatgtcataatcggcagtcttgc

SEQ ID NO: 180061 - DNA, 25 bp, Rattus norvegicus
atcatgtccaaactgcagcctagta

SEQ ID NO: 180062 - DNA, 25 bp, Rattus norvegicus
atcatgtccaaagtgcagcctagta

SEQ ID NO: 180063 - DNA, 25 bp, Rattus norvegicus
atcatgtccatgagtacttagagca

SEQ ID NO: 180064 - DNA, 25 bp, Rattus norvegicus
atcatgtccatgtgtacttagagca

SEQ ID NO: 180065 - DNA, 25 bp, Rattus norvegicus
atcatgtcccgcagatccagaacag

SEQ ID NO: 180066 - DNA, 25 bp, Rattus norvegicus
atcatgtcccgctgatccagaacag

SEQ ID NO: 180067 - DNA, 25 bp, Rattus norvegicus
atcatgtctcccacttatacgttca

SEQ ID NO: 180068 - DNA, 25 bp, Rattus norvegicus
atcatgtctccctcttatacgttca

SEQ ID NO: 180069 - DNA, 25 bp, Rattus norvegicus
atcatgtctgttagtgtgtctctta

SEQ ID NO: 180070 - DNA, 25 bp, Rattus norvegicus
atcatgtctgtttgtgtgtctctta

SEQ ID NO: 180071 - DNA, 25 bp, Rattus norvegicus
atcatgtgagatcagccccagcggc

SEQ ID NO: 180072 - DNA, 25 bp, Rattus norvegicus
atcatgtgagatgagccccagcggc

SEQ ID NO: 180073 - DNA, 25 bp, Rattus norvegicus
atcatgtgccacaagtgttcctggg

SEQ ID NO: 180074 - DNA, 25 bp, Rattus norvegicus
atcatgtgccactagtgttcctggg

SEQ ID NO: 180075 - DNA, 25 bp, Rattus norvegicus
atcatgtgtgctcctcgtcagaatg

SEQ ID NO: 180076 - DNA, 25 bp, Rattus norvegicus
atcatgtgtgctgctcgtcagaatg

SEQ ID NO: 180077 - DNA, 25 bp, Rattus norvegicus
atcatgttaactaggcaccgtctct

SEQ ID NO: 180078 - DNA, 25 bp, Rattus norvegicus
atcatgttaacttggcaccgtctct

SEQ ID NO: 180079 - DNA, 25 bp, Rattus norvegicus
atcatgttacctacaactttatagc

SEQ ID NO: 180080 - DNA, 25 bp, Rattus norvegicus
atcatgttaccttcaactttatagc

SEQ ID NO: 180081 - DNA, 25 bp, Rattus norvegicus
atcatgttcgagcagctgccgtgcg

SEQ ID NO: 180082 - DNA, 25 bp, Rattus norvegicus
atcatgttcgaggagctgccgtgcg

SEQ ID NO: 180083 - DNA, 25 bp, Rattus norvegicus
atcatgttgccccaggatgacctat

SEQ ID NO: 180084 - DNA, 25 bp, Rattus norvegicus
atcatgttgcccgaggatgacctat

SEQ ID NO: 180085 - DNA, 25 bp, Rattus norvegicus
atcatgtttcctccattcctggctg

SEQ ID NO: 180086 - DNA, 25 bp, Rattus norvegicus
atcatgtttcctgcattcctggctg

SEQ ID NO: 180087 - DNA, 25 bp, Rattus norvegicus
atcatgtttgtacccctgaagttca

SEQ ID NO: 180088 - DNA, 25 bp, Rattus norvegicus
atcatgtttgtagccctgaagttca

SEQ ID NO: 180089 - DNA, 25 bp, Rattus norvegicus
atcatgttttttcaaatctgttctg

SEQ ID NO: 180090 - DNA, 25 bp, Rattus norvegicus
atcatgttttttgaaatctgttctg

SEQ ID NO: 180091 - DNA, 25 bp, Rattus norvegicus
atcattaatagactgggccctccac

SEQ ID NO: 180092 - DNA, 25 bp, Rattus norvegicus
atcattaatagagtgggccctccac

SEQ ID NO: 180093 - DNA, 25 bp, Rattus norvegicus
atcattacatatcctctgacatctt

SEQ ID NO: 180094 - DNA, 25 bp, Rattus norvegicus
atcattacatatgctctgacatctt

SEQ ID NO: 180095 - DNA, 25 bp, Rattus norvegicus
atcattaccgtgatttggttctagg

SEQ ID NO: 180096 - DNA, 25 bp, Rattus norvegicus
atcattaccgtgttttggttctagg

SEQ ID NO: 180097 - DNA, 25 bp, Rattus norvegicus
atcattacctttactcaaactacct

SEQ ID NO: 180098 - DNA, 25 bp, Rattus norvegicus
atcattaccttttctcaaactacct

SEQ ID NO: 180099 - DNA, 25 bp, Rattus norvegicus
atcattaggctaaggtgttgctgct

SEQ ID NO: 180100 - DNA, 25 bp, Rattus norvegicus
atcattaggctatggtgttgctgct

SEQ ID NO: 180101 - DNA, 25 bp, Rattus norvegicus
atcattatcacacgctccagtattt

SEQ ID NO: 180102 - DNA, 25 bp, Rattus norvegicus
atcattatcacaggctccagtattt

SEQ ID NO: 180103 - DNA, 25 bp, Rattus norvegicus
atcattatcttgacctgtgacccat

SEQ ID NO: 180104 - DNA, 25 bp, Rattus norvegicus
atcattatcttgtcctgtgacccat

SEQ ID NO: 180105 - DNA, 25 bp, Rattus norvegicus
atcattatggtaaataatccaccct

SEQ ID NO: 180106 - DNA, 25 bp, Rattus norvegicus
atcattatggtatataatccaccct

SEQ ID NO: 180107 - DNA, 25 bp, Rattus norvegicus
atcattattcgaccttgcccagaac

SEQ ID NO: 180108 - DNA, 25 bp, Rattus norvegicus
atcattattcgagcttgcccagaac

SEQ ID NO: 180109 - DNA, 25 bp, Rattus norvegicus
atcattattttgaagcagcacagct

SEQ ID NO: 180110 - DNA, 25 bp, Rattus norvegicus
atcattattttgtagcagcacagct

SEQ ID NO: 180111 - DNA, 25 bp, Rattus norvegicus
atcattcaacatacatcattccagg

SEQ ID NO: 180112 - DNA, 25 bp, Rattus norvegicus
atcattcaacattcatcattccagg

SEQ ID NO: 180113 - DNA, 25 bp, Rattus norvegicus
atcattcaagacagactgctctgag

SEQ ID NO: 180114 - DNA, 25 bp, Rattus norvegicus
atcattcaagactgactgctctgag

SEQ ID NO: 180115 - DNA, 25 bp, Rattus norvegicus
atcattcactgactgttccaaggga

SEQ ID NO: 180116 - DNA, 25 bp, Rattus norvegicus
atcattcactgagtgttccaaggga

SEQ ID NO: 180117 - DNA, 25 bp, Rattus norvegicus
atcattcagcagacgagcccgtact

SEQ ID NO: 180118 - DNA, 25 bp, Rattus norvegicus
atcattcagcagtcgagcccgtact

SEQ ID NO: 180119 - DNA, 25 bp, Rattus norvegicus
atcattcaggacagcgtggtgggca

SEQ ID NO: 180120 - DNA, 25 bp, Rattus norvegicus
atcattcaggactgcgtggtgggca

SEQ ID NO: 180121 - DNA, 25 bp, Rattus norvegicus
atcattcatccaaaaccagtactag

SEQ ID NO: 180122 - DNA, 25 bp, Rattus norvegicus
atcattcatccataaccagtactag

SEQ ID NO: 180123 - DNA, 25 bp, Rattus norvegicus
atcattcatgatctgtgggcattta

SEQ ID NO: 180124 - DNA, 25 bp, Rattus norvegicus
atcattcatgatgtgtgggcattta

SEQ ID NO: 180125 - DNA, 25 bp, Rattus norvegicus
atcattcatggtcactcgctttggg

SEQ ID NO: 180126 - DNA, 25 bp, Rattus norvegicus
atcattcatggtgactcgctttggg

SEQ ID NO: 180127 - DNA, 25 bp, Rattus norvegicus
atcattcatttcctacaggctggct

SEQ ID NO: 180128 - DNA, 25 bp, Rattus norvegicus
atcattcatttcgtacaggctggct

SEQ ID NO: 180129 - DNA, 25 bp, Rattus norvegicus
atcattcatttgcttctgacctttt

SEQ ID NO: 180130 - DNA, 25 bp, Rattus norvegicus
atcattcatttggttctgacctttt

SEQ ID NO: 180131 - DNA, 25 bp, Rattus norvegicus
atcattccagatagtcatgcagaca

SEQ ID NO: 180132 - DNA, 25 bp, Rattus norvegicus
atcattccagattgtcatgcagaca

SEQ ID NO: 180133 - DNA, 25 bp, Rattus norvegicus
atcattccagccatatgtctcaatc

SEQ ID NO: 180134 - DNA, 25 bp, Rattus norvegicus
atcattccagccttatgtctcaatc

SEQ ID NO: 180135 - DNA, 25 bp, Rattus norvegicus
atcattccatgccttaatatgcttg

SEQ ID NO: 180136 - DNA, 25 bp, Rattus norvegicus
atcattccatgcgttaatatgcttg

SEQ ID NO: 180137 - DNA, 25 bp, Rattus norvegicus
atcattcccacaaggtctgacctga

SEQ ID NO: 180138 - DNA, 25 bp, Rattus norvegicus
atcattcccacatggtctgacctga

SEQ ID NO: 180139 - DNA, 25 bp, Rattus norvegicus
atcattcccagaacaacgagccatt

SEQ ID NO: 180140 - DNA, 25 bp, Rattus norvegicus
atcattcccagatcaacgagccatt

SEQ ID NO: 180141 - DNA, 25 bp, Rattus norvegicus
atcattccctgtagtgtccttagaa

SEQ ID NO: 180142 - DNA, 25 bp, Rattus norvegicus
atcattccctgttgtgtccttagaa

SEQ ID NO: 180143 - DNA, 25 bp, Rattus norvegicus
atcattccggtacttctgaagctgt

SEQ ID NO: 180144 - DNA, 25 bp, Rattus norvegicus
atcattccggtagttctgaagctgt

SEQ ID NO: 180145 - DNA, 25 bp, Rattus norvegicus
atcattctcctaacttttccattgt

SEQ ID NO: 180146 - DNA, 25 bp, Rattus norvegicus
atcattctcctatcttttccattgt

SEQ ID NO: 180147 - DNA, 25 bp, Rattus norvegicus
atcattctcctcaatacatttctca

SEQ ID NO: 180148 - DNA, 25 bp, Rattus norvegicus
atcattctcctctatacatttctca

SEQ ID NO: 180149 - DNA, 25 bp, Rattus norvegicus
atcattctcttgagagccggtgact

SEQ ID NO: 180150 - DNA, 25 bp, Rattus norvegicus
atcattctcttgtgagccggtgact

SEQ ID NO: 180151 - DNA, 25 bp, Rattus norvegicus
atcattctgagaaggcatgtaacat

SEQ ID NO: 180152 - DNA, 25 bp, Rattus norvegicus
atcattctgagatggcatgtaacat

SEQ ID NO: 180153 - DNA, 25 bp, Rattus norvegicus
atcattctgatgaagctctctgttt

SEQ ID NO: 180154 - DNA, 25 bp, Rattus norvegicus
atcattctgatgtagctctctgttt

SEQ ID NO: 180155 - DNA, 25 bp, Rattus norvegicus
atcattctggccctgttaacacaca

SEQ ID NO: 180156 - DNA, 25 bp, Rattus norvegicus
atcattctggccgtgttaacacaca

SEQ ID NO: 180157 - DNA, 25 bp, Rattus norvegicus
atcattgaactacactccagcactg

SEQ ID NO: 180158 - DNA, 25 bp, Rattus norvegicus
atcattgaactagactccagcactg

SEQ ID NO: 180159 - DNA, 25 bp, Rattus norvegicus
atcattgacaatcccaattaccagg

SEQ ID NO: 180160 - DNA, 25 bp, Rattus norvegicus
atcattgacaatgccaattaccagg

SEQ ID NO: 180161 - DNA, 25 bp, Rattus norvegicus
atcattgacctcatggctgtcagca

SEQ ID NO: 180162 - DNA, 25 bp, Rattus norvegicus
atcattgacctcttggctgtcagca

SEQ ID NO: 180163 - DNA, 25 bp, Rattus norvegicus
atcattgactatcgtacagagttca

SEQ ID NO: 180164 - DNA, 25 bp, Rattus norvegicus
atcattgactatggtacagagttca

SEQ ID NO: 180165 - DNA, 25 bp, Rattus norvegicus
atcattgagtcaatggtgttggcag

SEQ ID NO: 180166 - DNA, 25 bp, Rattus norvegicus
atcattgagtcattggtgttggcag

SEQ ID NO: 180167 - DNA, 25 bp, Rattus norvegicus
atcattgatctgagattcttttcaa

SEQ ID NO: 180168 - DNA, 25 bp, Rattus norvegicus
atcattgatctgtgattcttttcaa

SEQ ID NO: 180169 - DNA, 25 bp, Rattus norvegicus
atcattgatgatatccaggtgctgg

SEQ ID NO: 180170 - DNA, 25 bp, Rattus norvegicus
atcattgatgatttccaggtgctgg

SEQ ID NO: 180171 - DNA, 25 bp, Rattus norvegicus
atcattgatgtcctgggtgcaccgc

SEQ ID NO: 180172 - DNA, 25 bp, Rattus norvegicus
atcattgatgtcgtgggtgcaccgc

SEQ ID NO: 180173 - DNA, 25 bp, Rattus norvegicus
atcattgcaaatccctcccagtgaa

SEQ ID NO: 180174 - DNA, 25 bp, Rattus norvegicus
atcattgcaaatgcctcccagtgaa

SEQ ID NO: 180175 - DNA, 25 bp, Rattus norvegicus
atcattgcatggctaggtgttttca

SEQ ID NO: 180176 - DNA, 25 bp, Rattus norvegicus
atcattgcatgggtaggtgttttca

SEQ ID NO: 180177 - DNA, 25 bp, Rattus norvegicus
atcattgccactcaggtgggaccag

SEQ ID NO: 180178 - DNA, 25 bp, Rattus norvegicus
atcattgccactgaggtgggaccag

SEQ ID NO: 180179 - DNA, 25 bp, Rattus norvegicus
atcattgccatgagctcgctgggtg

SEQ ID NO: 180180 - DNA, 25 bp, Rattus norvegicus
atcattgccatgtgctcgctgggtg

SEQ ID NO: 180181 - DNA, 25 bp, Rattus norvegicus
atcattgcccataaatagacgcagt

SEQ ID NO: 180182 - DNA, 25 bp, Rattus norvegicus
atcattgcccattaatagacgcagt

SEQ ID NO: 180183 - DNA, 25 bp, Rattus norvegicus
atcattgcctctagcacagcaggtg

SEQ ID NO: 180184 - DNA, 25 bp, Rattus norvegicus
atcattgcctcttgcacagcaggtg

SEQ ID NO: 180185 - DNA, 25 bp, Rattus norvegicus
atcattgctcttaatgctcctcgtc

SEQ ID NO: 180186 - DNA, 25 bp, Rattus norvegicus
atcattgctctttatgctcctcgtc

SEQ ID NO: 180187 - DNA, 25 bp, Rattus norvegicus
atcattgcttttcttcagatggtaa

SEQ ID NO: 180188 - DNA, 25 bp, Rattus norvegicus
atcattgcttttgttcagatggtaa

SEQ ID NO: 180189 - DNA, 25 bp, Rattus norvegicus
atcattggctctcattctgtttaca

SEQ ID NO: 180190 - DNA, 25 bp, Rattus norvegicus
atcattggctctgattctgtttaca

SEQ ID NO: 180191 - DNA, 25 bp, Rattus norvegicus
atcattgggtctcttgtgcacacac

SEQ ID NO: 180192 - DNA, 25 bp, Rattus norvegicus
atcattgggtctgttgtgcacacac

SEQ ID NO: 180193 - DNA, 25 bp, Rattus norvegicus
atcattggtgtcatctgcttcatca

SEQ ID NO: 180194 - DNA, 25 bp, Rattus norvegicus
atcattggtgtcttctgcttcatca

SEQ ID NO: 180195 - DNA, 25 bp, Rattus norvegicus
atcattgtaaacctgtcttctgcca

SEQ ID NO: 180196 - DNA, 25 bp, Rattus norvegicus
atcattgtaaacgtgtcttctgcca

SEQ ID NO: 180197 - DNA, 25 bp, Rattus norvegicus
atcattgtagttctagccgtcatta

SEQ ID NO: 180198 - DNA, 25 bp, Rattus norvegicus
atcattgtagttgtagccgtcatta

SEQ ID NO: 180199 - DNA, 25 bp, Rattus norvegicus
atcattgtccacatcttcattgtag

SEQ ID NO: 180200 - DNA, 25 bp, Rattus norvegicus
atcattgtccacttcttcattgtag

SEQ ID NO: 180201 - DNA, 25 bp, Rattus norvegicus
atcattgtccgtcgtgcgtcctaaa

SEQ ID NO: 180202 - DNA, 25 bp, Rattus norvegicus
atcattgtccgtggtgcgtcctaaa

SEQ ID NO: 180203 - DNA, 25 bp, Rattus norvegicus
atcattgtcctccttgtgtggagat

SEQ ID NO: 180204 - DNA, 25 bp, Rattus norvegicus
atcattgtcctcgttgtgtggagat

SEQ ID NO: 180205 - DNA, 25 bp, Rattus norvegicus
atcattgtctggctcctattcaaga

SEQ ID NO: 180206 - DNA, 25 bp, Rattus norvegicus
atcattgtctgggtcctattcaaga

SEQ ID NO: 180207 - DNA, 25 bp, Rattus norvegicus
atcattgtgacaatcttcccagttg

SEQ ID NO: 180208 - DNA, 25 bp, Rattus norvegicus
atcattgtgacattcttcccagttg

SEQ ID NO: 180209 - DNA, 25 bp, Rattus norvegicus
atcattgtgccgacttccctactaa

SEQ ID NO: 180210 - DNA, 25 bp, Rattus norvegicus
atcattgtgccgtcttccctactaa

SEQ ID NO: 180211 - DNA, 25 bp, Rattus norvegicus
atcattgtgtttccctgtgctgaca

SEQ ID NO: 180212 - DNA, 25 bp, Rattus norvegicus
atcattgtgtttgcctgtgctgaca

SEQ ID NO: 180213 - DNA, 25 bp, Rattus norvegicus
atcattgttccacaatccacgacat

SEQ ID NO: 180214 - DNA, 25 bp, Rattus norvegicus
atcattgttccagaatccacgacat

SEQ ID NO: 180215 - DNA, 25 bp, Rattus norvegicus
atcattgtttgtcctaccagaggca

SEQ ID NO: 180216 - DNA, 25 bp, Rattus norvegicus
atcattgtttgtgctaccagaggca

SEQ ID NO: 180217 - DNA, 25 bp, Rattus norvegicus
atcatttacaatctcgtgagcctca

SEQ ID NO: 180218 - DNA, 25 bp, Rattus norvegicus
atcatttacaatgtcgtgagcctca

SEQ ID NO: 180219 - DNA, 25 bp, Rattus norvegicus
atcatttacagaatcctcattttaa

SEQ ID NO: 180220 - DNA, 25 bp, Rattus norvegicus
atcatttacagattcctcattttaa

SEQ ID NO: 180221 - DNA, 25 bp, Rattus norvegicus
atcatttacttcatcgtgggctcct

SEQ ID NO: 180222 - DNA, 25 bp, Rattus norvegicus
atcatttacttcttcgtgggctcct

SEQ ID NO: 180223 - DNA, 25 bp, Rattus norvegicus
atcatttagatcatcgagcccacaa

SEQ ID NO: 180224 - DNA, 25 bp, Rattus norvegicus
atcatttagatcttcgagcccacaa

SEQ ID NO: 180225 - DNA, 25 bp, Rattus norvegicus
atcatttaggacactctcagcccat

SEQ ID NO: 180226 - DNA, 25 bp, Rattus norvegicus
atcatttaggactctctcagcccat

SEQ ID NO: 180227 - DNA, 25 bp, Rattus norvegicus
atcatttataataggatgtgctcct

SEQ ID NO: 180228 - DNA, 25 bp, Rattus norvegicus
atcatttataattggatgtgctcct

SEQ ID NO: 180229 - DNA, 25 bp, Rattus norvegicus
atcatttatatgcacgtttctttaa

SEQ ID NO: 180230 - DNA, 25 bp, Rattus norvegicus
atcatttatatggacgtttctttaa

SEQ ID NO: 180231 - DNA, 25 bp, Rattus norvegicus
atcatttatttcacggagcactcac

SEQ ID NO: 180232 - DNA, 25 bp, Rattus norvegicus
atcatttatttctcggagcactcac

SEQ ID NO: 180233 - DNA, 25 bp, Rattus norvegicus
atcatttcacagcatctgggtagag

SEQ ID NO: 180234 - DNA, 25 bp, Rattus norvegicus
atcatttcacaggatctgggtagag

SEQ ID NO: 180235 - DNA, 25 bp, Rattus norvegicus
atcatttcacctcggctgaagccaa

SEQ ID NO: 180236 - DNA, 25 bp, Rattus norvegicus
atcatttcacctgggctgaagccaa

SEQ ID NO: 180237 - DNA, 25 bp, Rattus norvegicus
atcatttctgataactggccaattt

SEQ ID NO: 180238 - DNA, 25 bp, Rattus norvegicus
atcatttctgattactggccaattt

SEQ ID NO: 180239 - DNA, 25 bp, Rattus norvegicus
atcatttcttaactctgttggagaa

SEQ ID NO: 180240 - DNA, 25 bp, Rattus norvegicus
atcatttcttaagtctgttggagaa

SEQ ID NO: 180241 - DNA, 25 bp, Rattus norvegicus
atcatttcttggctcacaacttggt

SEQ ID NO: 180242 - DNA, 25 bp, Rattus norvegicus
atcatttcttgggtcacaacttggt

SEQ ID NO: 180243 - DNA, 25 bp, Rattus norvegicus
atcatttgattcctgctcaaaaggg

SEQ ID NO: 180244 - DNA, 25 bp, Rattus norvegicus
atcatttgattcgtgctcaaaaggg

SEQ ID NO: 180245 - DNA, 25 bp, Rattus norvegicus
atcatttggcctacaggttttgtgt

SEQ ID NO: 180246 - DNA, 25 bp, Rattus norvegicus
atcatttggccttcaggttttgtgt

SEQ ID NO: 180247 - DNA, 25 bp, Rattus norvegicus
atcatttgggatcttcaacacttga

SEQ ID NO: 180248 - DNA, 25 bp, Rattus norvegicus
atcatttgggatgttcaacacttga

SEQ ID NO: 180249 - DNA, 25 bp, Rattus norvegicus
atcatttgtaccagacttgctgcca

SEQ ID NO: 180250 - DNA, 25 bp, Rattus norvegicus
atcatttgtacctgacttgctgcca

SEQ ID NO: 180251 - DNA, 25 bp, Rattus norvegicus
atcatttgtgagagtggagcggccc

SEQ ID NO: 180252 - DNA, 25 bp, Rattus norvegicus
atcatttgtgagtgtggagcggccc

SEQ ID NO: 180253 - DNA, 25 bp, Rattus norvegicus
atcattttattgatccccttcttag

SEQ ID NO: 180254 - DNA, 25 bp, Rattus norvegicus
atcattttattgttccccttcttag

SEQ ID NO: 180255 - DNA, 25 bp, Rattus norvegicus
atcattttcagactcaaaagtttag

SEQ ID NO: 180256 - DNA, 25 bp, Rattus norvegicus
atcattttcagagtcaaaagtttag

SEQ ID NO: 180257 - DNA, 25 bp, Rattus norvegicus
atcattttcagtatttgtcacaaga

SEQ ID NO: 180258 - DNA, 25 bp, Rattus norvegicus
atcattttcagtttttgtcacaaga

SEQ ID NO: 180259 - DNA, 25 bp, Rattus norvegicus
atcattttccagcaacgtcgtctct

SEQ ID NO: 180260 - DNA, 25 bp, Rattus norvegicus
atcattttccaggaacgtcgtctct

SEQ ID NO: 180261 - DNA, 25 bp, Rattus norvegicus
atcattttctccagcaaacctcagt

SEQ ID NO: 180262 - DNA, 25 bp, Rattus norvegicus
atcattttctcctgcaaacctcagt

SEQ ID NO: 180263 - DNA, 25 bp, Rattus norvegicus
atcattttctcgctctctgaggtga

SEQ ID NO: 180264 - DNA, 25 bp, Rattus norvegicus
atcattttctcggtctctgaggtga

SEQ ID NO: 180265 - DNA, 25 bp, Rattus norvegicus
atcattttggtgctcactatcctcc

SEQ ID NO: 180266 - DNA, 25 bp, Rattus norvegicus
atcattttggtggtcactatcctcc

SEQ ID NO: 180267 - DNA, 25 bp, Rattus norvegicus
atcattttgtgtatttgtattctgc

SEQ ID NO: 180268 - DNA, 25 bp, Rattus norvegicus
atcattttgtgtttttgtattctgc

SEQ ID NO: 180269 - DNA, 25 bp, Rattus norvegicus
atcatttttatacccttctcaacac

SEQ ID NO: 180270 - DNA, 25 bp, Rattus norvegicus
atcatttttatagccttctcaacac

SEQ ID NO: 180271 - DNA, 25 bp, Rattus norvegicus
atcattttttccatacttctgggat

SEQ ID NO: 180272 - DNA, 25 bp, Rattus norvegicus
atcattttttccttacttctgggat

SEQ ID NO: 180273 - DNA, 25 bp, Rattus norvegicus
atccaaaaactcaccttggccttag

SEQ ID NO: 180274 - DNA, 25 bp, Rattus norvegicus
atccaaaaactctccttggccttag

SEQ ID NO: 180275 - DNA, 25 bp, Rattus norvegicus
atccaaaagaaaactgccctgccag

SEQ ID NO: 180276 - DNA, 25 bp, Rattus norvegicus
atccaaaagaaatctgccctgccag

SEQ ID NO: 180277 - DNA, 25 bp, Rattus norvegicus
atccaaacactcatcggctacagag

SEQ ID NO: 180278 - DNA, 25 bp, Rattus norvegicus
atccaaacactcttcggctacagag

SEQ ID NO: 180279 - DNA, 25 bp, Rattus norvegicus
atccaaacagcgatttacaccgatt

SEQ ID NO: 180280 - DNA, 25 bp, Rattus norvegicus
atccaaacagcgttttacaccgatt

SEQ ID NO: 180281 - DNA, 25 bp, Rattus norvegicus
atccaaacccacacagattggtgtt

SEQ ID NO: 180282 - DNA, 25 bp, Rattus norvegicus
atccaaacccactcagattggtgtt

SEQ ID NO: 180283 - DNA, 25 bp, Rattus norvegicus
atccaaacggtcagtgaagcttcaa

SEQ ID NO: 180284 - DNA, 25 bp, Rattus norvegicus
atccaaacggtctgtgaagcttcaa

SEQ ID NO: 180285 - DNA, 25 bp, Rattus norvegicus
atccaaagcatgactaaccttcaga

SEQ ID NO: 180286 - DNA, 25 bp, Rattus norvegicus
atccaaagcatgtctaaccttcaga

SEQ ID NO: 180287 - DNA, 25 bp, Rattus norvegicus
atccaaaggtctatccccacgagtt

SEQ ID NO: 180288 - DNA, 25 bp, Rattus norvegicus
atccaaaggtctttccccacgagtt

SEQ ID NO: 180289 - DNA, 25 bp, Rattus norvegicus
atccaaagtattacccatgtgcaat

SEQ ID NO: 180290 - DNA, 25 bp, Rattus norvegicus
atccaaagtatttcccatgtgcaat

SEQ ID NO: 180291 - DNA, 25 bp, Rattus norvegicus
atccaaagtctcatttttcatgatg

SEQ ID NO: 180292 - DNA, 25 bp, Rattus norvegicus
atccaaagtctcttttttcatgatg

SEQ ID NO: 180293 - DNA, 25 bp, Rattus norvegicus
atccaaatactcaaagtttacgtga

SEQ ID NO: 180294 - DNA, 25 bp, Rattus norvegicus
atccaaatactctaagtttacgtga

SEQ ID NO: 180295 - DNA, 25 bp, Rattus norvegicus
atccaaatagggacttctgcctgct

SEQ ID NO: 180296 - DNA, 25 bp, Rattus norvegicus
atccaaatagggtcttctgcctgct

SEQ ID NO: 180297 - DNA, 25 bp, Rattus norvegicus
atccaacacgtcagctgatttgcta

SEQ ID NO: 180298 - DNA, 25 bp, Rattus norvegicus
atccaacacgtctgctgatttgcta

SEQ ID NO: 180299 - DNA, 25 bp, Rattus norvegicus
atccaacagggacccacagtattta

SEQ ID NO: 180300 - DNA, 25 bp, Rattus norvegicus
atccaacagggagccacagtattta

SEQ ID NO: 180301 - DNA, 25 bp, Rattus norvegicus
atccaacatcctagaactggctggt

SEQ ID NO: 180302 - DNA, 25 bp, Rattus norvegicus
atccaacatccttgaactggctggt

SEQ ID NO: 180303 - DNA, 25 bp, Rattus norvegicus
atccaaccaaacattcgttcctgtc

SEQ ID NO: 180304 - DNA, 25 bp, Rattus norvegicus
atccaaccaaactttcgttcctgtc

SEQ ID NO: 180305 - DNA, 25 bp, Rattus norvegicus
atccaaccacgaagacttgaattta

SEQ ID NO: 180306 - DNA, 25 bp, Rattus norvegicus
atccaaccacgatgacttgaattta

SEQ ID NO: 180307 - DNA, 25 bp, Rattus norvegicus
atccaacccagccaagtttacaagg

SEQ ID NO: 180308 - DNA, 25 bp, Rattus norvegicus
atccaacccagcgaagtttacaagg

SEQ ID NO: 180309 - DNA, 25 bp, Rattus norvegicus
atccaaccctgcatacacacaaagg

SEQ ID NO: 180310 - DNA, 25 bp, Rattus norvegicus
atccaaccctgcttacacacaaagg

SEQ ID NO: 180311 - DNA, 25 bp, Rattus norvegicus
atccaacctagacttgtgaccaatt

SEQ ID NO: 180312 - DNA, 25 bp, Rattus norvegicus
atccaacctagagttgtgaccaatt

SEQ ID NO: 180313 - DNA, 25 bp, Rattus norvegicus
atccaacgaccaccataccagggta

SEQ ID NO: 180314 - DNA, 25 bp, Rattus norvegicus
atccaacgaccagcataccagggta

SEQ ID NO: 180315 - DNA, 25 bp, Rattus norvegicus
atccaactccaaatcgacaagcaga

SEQ ID NO: 180316 - DNA, 25 bp, Rattus norvegicus
atccaactccaattcgacaagcaga

SEQ ID NO: 180317 - DNA, 25 bp, Rattus norvegicus
atccaactgggaccactttaggcat

SEQ ID NO: 180318 - DNA, 25 bp, Rattus norvegicus
atccaactgggagcactttaggcat

SEQ ID NO: 180319 - DNA, 25 bp, Rattus norvegicus
atccaactgtccaggacttcacaga

SEQ ID NO: 180320 - DNA, 25 bp, Rattus norvegicus
atccaactgtcctggacttcacaga

SEQ ID NO: 180321 - DNA, 25 bp, Rattus norvegicus
atccaactgtgaagagcccatgtat

SEQ ID NO: 180322 - DNA, 25 bp, Rattus norvegicus
atccaactgtgatgagcccatgtat

SEQ ID NO: 180323 - DNA, 25 bp, Rattus norvegicus
atccaacttggccagactcagggag

SEQ ID NO: 180324 - DNA, 25 bp, Rattus norvegicus
atccaacttggcgagactcagggag

SEQ ID NO: 180325 - DNA, 25 bp, Rattus norvegicus
atccaacttttgatctgagcccaca

SEQ ID NO: 180326 - DNA, 25 bp, Rattus norvegicus
atccaacttttgttctgagcccaca

SEQ ID NO: 180327 - DNA, 25 bp, Rattus norvegicus
atccaagaggatcacgtgcccagcc

SEQ ID NO: 180328 - DNA, 25 bp, Rattus norvegicus
atccaagaggatgacgtgcccagcc

SEQ ID NO: 180329 - DNA, 25 bp, Rattus norvegicus
atccaagatagaagaggctgtactg

SEQ ID NO: 180330 - DNA, 25 bp, Rattus norvegicus
atccaagatagatgaggctgtactg

SEQ ID NO: 180331 - DNA, 25 bp, Rattus norvegicus
atccaagatcgtcgtgggtttttct

SEQ ID NO: 180332 - DNA, 25 bp, Rattus norvegicus
atccaagatcgtggtgggtttttct

SEQ ID NO: 180333 - DNA, 25 bp, Rattus norvegicus
atccaagatctacccctgtagcaat

SEQ ID NO: 180334 - DNA, 25 bp, Rattus norvegicus
atccaagatctagccctgtagcaat

SEQ ID NO: 180335 - DNA, 25 bp, Rattus norvegicus
atccaagatctgactctccaagaaa

SEQ ID NO: 180336 - DNA, 25 bp, Rattus norvegicus
atccaagatctgtctctccaagaaa

SEQ ID NO: 180337 - DNA, 25 bp, Rattus norvegicus
atccaagcacccagaacctgaggga

SEQ ID NO: 180338 - DNA, 25 bp, Rattus norvegicus
atccaagcaccctgaacctgaggga

SEQ ID NO: 180339 - DNA, 25 bp, Rattus norvegicus
atccaagcagccctgactactaggc

SEQ ID NO: 180340 - DNA, 25 bp, Rattus norvegicus
atccaagcagccgtgactactaggc

SEQ ID NO: 180341 - DNA, 25 bp, Rattus norvegicus
atccaagcaggaagttgcaggtcat

SEQ ID NO: 180342 - DNA, 25 bp, Rattus norvegicus
atccaagcaggatgttgcaggtcat

SEQ ID NO: 180343 - DNA, 25 bp, Rattus norvegicus
atccaagccaaccagatgagcattt

SEQ ID NO: 180344 - DNA, 25 bp, Rattus norvegicus
atccaagccaacgagatgagcattt

SEQ ID NO: 180345 - DNA, 25 bp, Rattus norvegicus
atccaagccatcaactgaactctaa

SEQ ID NO: 180346 - DNA, 25 bp, Rattus norvegicus
atccaagccatctactgaactctaa

SEQ ID NO: 180347 - DNA, 25 bp, Rattus norvegicus
atccaagccgcacacatatcattat

SEQ ID NO: 180348 - DNA, 25 bp, Rattus norvegicus
atccaagccgcagacatatcattat

SEQ ID NO: 180349 - DNA, 25 bp, Rattus norvegicus
atccaagccggacttgtttcttctg

SEQ ID NO: 180350 - DNA, 25 bp, Rattus norvegicus
atccaagccggagttgtttcttctg

SEQ ID NO: 180351 - DNA, 25 bp, Rattus norvegicus
atccaagctgagaggcatggctgcc

SEQ ID NO: 180352 - DNA, 25 bp, Rattus norvegicus
atccaagctgagtggcatggctgcc

SEQ ID NO: 180353 - DNA, 25 bp, Rattus norvegicus
atccaaggactgagggctgctgaca

SEQ ID NO: 180354 - DNA, 25 bp, Rattus norvegicus
atccaaggactgtgggctgctgaca

SEQ ID NO: 180355 - DNA, 25 bp, Rattus norvegicus
atccaaggacttagcgacacacatg

SEQ ID NO: 180356 - DNA, 25 bp, Rattus norvegicus
atccaaggacttcaaaaaccacgtg

SEQ ID NO: 180357 - DNA, 25 bp, Rattus norvegicus
atccaaggacttgaaaaaccacgtg

SEQ ID NO: 180358 - DNA, 25 bp, Rattus norvegicus
atccaaggactttgcgacacacatg

SEQ ID NO: 180359 - DNA, 25 bp, Rattus norvegicus
atccaaggaggacaccccaggcaca

SEQ ID NO: 180360 - DNA, 25 bp, Rattus norvegicus
atccaaggaggacttctacagcatg

SEQ ID NO: 180361 - DNA, 25 bp, Rattus norvegicus
atccaaggaggagaccccaggcaca

SEQ ID NO: 180362 - DNA, 25 bp, Rattus norvegicus
atccaaggaggagttctacagcatg

SEQ ID NO: 180363 - DNA, 25 bp, Rattus norvegicus
atccaagggactctctcatctgcaa

SEQ ID NO: 180364 - DNA, 25 bp, Rattus norvegicus
atccaagggactgtctcatctgcaa

SEQ ID NO: 180365 - DNA, 25 bp, Rattus norvegicus
atccaagggtataagactcgagcat

SEQ ID NO: 180366 - DNA, 25 bp, Rattus norvegicus
atccaagggtattagactcgagcat

SEQ ID NO: 180367 - DNA, 25 bp, Rattus norvegicus
atccaaggttacctttgtcttacat

SEQ ID NO: 180368 - DNA, 25 bp, Rattus norvegicus
atccaaggttacgtttgtcttacat

SEQ ID NO: 180369 - DNA, 25 bp, Rattus norvegicus
atccaaggttgtacatcatgctgca

SEQ ID NO: 180370 - DNA, 25 bp, Rattus norvegicus
atccaaggttgttcatcatgctgca

SEQ ID NO: 180371 - DNA, 25 bp, Rattus norvegicus
atccaagtacttcgccacagcaagt

SEQ ID NO: 180372 - DNA, 25 bp, Rattus norvegicus
atccaagtacttggccacagcaagt

SEQ ID NO: 180373 - DNA, 25 bp, Rattus norvegicus
atccaagtcattctttggctgcttc

SEQ ID NO: 180374 - DNA, 25 bp, Rattus norvegicus
atccaagtcattgtttggctgcttc

SEQ ID NO: 180375 - DNA, 25 bp, Rattus norvegicus
atccaagtcgcgcaagggcagcaaa

SEQ ID NO: 180376 - DNA, 25 bp, Rattus norvegicus
atccaagtcgcggaagggcagcaaa

SEQ ID NO: 180377 - DNA, 25 bp, Rattus norvegicus
atccaagtgaccagatacccaactc

SEQ ID NO: 180378 - DNA, 25 bp, Rattus norvegicus
atccaagtgacctgatacccaactc

SEQ ID NO: 180379 - DNA, 25 bp, Rattus norvegicus
atccaagtgctgagacctggccaga

SEQ ID NO: 180380 - DNA, 25 bp, Rattus norvegicus
atccaagtgctgtgacctggccaga

SEQ ID NO: 180381 - DNA, 25 bp, Rattus norvegicus
atccaagtggcacacggcatcaatg

SEQ ID NO: 180382 - DNA, 25 bp, Rattus norvegicus
atccaagtggcagacggcatcaatg

SEQ ID NO: 180383 - DNA, 25 bp, Rattus norvegicus
atccaagtgtttcctctgcaatcat

SEQ ID NO: 180384 - DNA, 25 bp, Rattus norvegicus
atccaagtgtttgctctgcaatcat

SEQ ID NO: 180385 - DNA, 25 bp, Rattus norvegicus
atccaagttgccagtgagtttctgt

SEQ ID NO: 180386 - DNA, 25 bp, Rattus norvegicus
atccaagttgcctgtgagtttctgt

SEQ ID NO: 180387 - DNA, 25 bp, Rattus norvegicus
atccaagtttctcgagtcccacttt

SEQ ID NO: 180388 - DNA, 25 bp, Rattus norvegicus
atccaagtttctggagtcccacttt

SEQ ID NO: 180389 - DNA, 25 bp, Rattus norvegicus
atccaatacaaacagtatccctgaa

SEQ ID NO: 180390 - DNA, 25 bp, Rattus norvegicus
atccaatacaaagagtatccctgaa

SEQ ID NO: 180391 - DNA, 25 bp, Rattus norvegicus
atccaatactcgactatgtccacag

SEQ ID NO: 180392 - DNA, 25 bp, Rattus norvegicus
atccaatactcgtctatgtccacag

SEQ ID NO: 180393 - DNA, 25 bp, Rattus norvegicus
atccaatagtagctccctggtctgt

SEQ ID NO: 180394 - DNA, 25 bp, Rattus norvegicus
atccaatagtaggtccctggtctgt

SEQ ID NO: 180395 - DNA, 25 bp, Rattus norvegicus
atccaatcacatccctgaccaaagg

SEQ ID NO: 180396 - DNA, 25 bp, Rattus norvegicus
atccaatcacatgcctgaccaaagg

SEQ ID NO: 180397 - DNA, 25 bp, Rattus norvegicus
atccaatcatcacctatttcctgag

SEQ ID NO: 180398 - DNA, 25 bp, Rattus norvegicus
atccaatcatcagctatttcctgag

SEQ ID NO: 180399 - DNA, 25 bp, Rattus norvegicus
atccaatcatgcaaccgtggcgaag

SEQ ID NO: 180400 - DNA, 25 bp, Rattus norvegicus
atccaatcatgctaccgtggcgaag

SEQ ID NO: 180401 - DNA, 25 bp, Rattus norvegicus
atccaatccaaaacggacagtgtgc

SEQ ID NO: 180402 - DNA, 25 bp, Rattus norvegicus
atccaatccaaatcggacagtgtgc

SEQ ID NO: 180403 - DNA, 25 bp, Rattus norvegicus
atccaatgacgcaagggccgtgagt

SEQ ID NO: 180404 - DNA, 25 bp, Rattus norvegicus
atccaatgacgctagggccgtgagt

SEQ ID NO: 180405 - DNA, 25 bp, Rattus norvegicus
atccaatgatcgacctggagtctaa

SEQ ID NO: 180406 - DNA, 25 bp, Rattus norvegicus
atccaatgatcgtcctggagtctaa

SEQ ID NO: 180407 - DNA, 25 bp, Rattus norvegicus
atccaatgccttaagacagctacgc

SEQ ID NO: 180408 - DNA, 25 bp, Rattus norvegicus
atccaatgccttctgttttgcaggc

SEQ ID NO: 180409 - DNA, 25 bp, Rattus norvegicus
atccaatgccttgtgttttgcaggc

SEQ ID NO: 180410 - DNA, 25 bp, Rattus norvegicus
atccaatgcctttagacagctacgc

SEQ ID NO: 180411 - DNA, 25 bp, Rattus norvegicus
atccaatgcgatccagttctgttgt

SEQ ID NO: 180412 - DNA, 25 bp, Rattus norvegicus
atccaatgcgatgcagttctgttgt

SEQ ID NO: 180413 - DNA, 25 bp, Rattus norvegicus
atccaatgctgcctggatgagcctc

SEQ ID NO: 180414 - DNA, 25 bp, Rattus norvegicus
atccaatgctgcgtggatgagcctc

SEQ ID NO: 180415 - DNA, 25 bp, Rattus norvegicus
atccaatgctgtactgtcaccttaa

SEQ ID NO: 180416 - DNA, 25 bp, Rattus norvegicus
atccaatgctgttctgtcaccttaa

SEQ ID NO: 180417 - DNA, 25 bp, Rattus norvegicus
atccaattcttcaggaaccaccttc

SEQ ID NO: 180418 - DNA, 25 bp, Rattus norvegicus
atccaattcttctggaaccaccttc

SEQ ID NO: 180419 - DNA, 25 bp, Rattus norvegicus
atccaattcttgcttttgtaacatt

SEQ ID NO: 180420 - DNA, 25 bp, Rattus norvegicus
atccaattcttggttttgtaacatt

SEQ ID NO: 180421 - DNA, 25 bp, Rattus norvegicus
atccaattgtgcacgtgcagccaag

SEQ ID NO: 180422 - DNA, 25 bp, Rattus norvegicus
atccaattgtgctcgtgcagccaag

SEQ ID NO: 180423 - DNA, 25 bp, Rattus norvegicus
atccaatttccacccaaagtgctgt

SEQ ID NO: 180424 - DNA, 25 bp, Rattus norvegicus
atccaatttccagccaaagtgctgt

SEQ ID NO: 180425 - DNA, 25 bp, Rattus norvegicus
atccaatttcttcacggtctgtggt

SEQ ID NO: 180426 - DNA, 25 bp, Rattus norvegicus
atccaatttcttgacggtctgtggt

SEQ ID NO: 180427 - DNA, 25 bp, Rattus norvegicus
atccaatttgccacaatgtatgtag

SEQ ID NO: 180428 - DNA, 25 bp, Rattus norvegicus
atccaatttgcctcaatgtatgtag

SEQ ID NO: 180429 - DNA, 25 bp, Rattus norvegicus
atccaattttagcttggcccaatta

SEQ ID NO: 180430 - DNA, 25 bp, Rattus norvegicus
atccaattttaggttggcccaatta

SEQ ID NO: 180431 - DNA, 25 bp, Rattus norvegicus
atccacaaaccccgagttgagcctt

SEQ ID NO: 180432 - DNA, 25 bp, Rattus norvegicus
atccacaaacccggagttgagcctt

SEQ ID NO: 180433 - DNA, 25 bp, Rattus norvegicus
atccacaacaatcgctccacttttg

SEQ ID NO: 180434 - DNA, 25 bp, Rattus norvegicus
atccacaacaatggctccacttttg

SEQ ID NO: 180435 - DNA, 25 bp, Rattus norvegicus
atccacaaggtcacccttatatctc

SEQ ID NO: 180436 - DNA, 25 bp, Rattus norvegicus
atccacaaggtctcccttatatctc

SEQ ID NO: 180437 - DNA, 25 bp, Rattus norvegicus
atccacacacagcagggcgtttgtt

SEQ ID NO: 180438 - DNA, 25 bp, Rattus norvegicus
atccacacacaggagggcgtttgtt

SEQ ID NO: 180439 - DNA, 25 bp, Rattus norvegicus
atccacacagatcacgctctgcttt

SEQ ID NO: 180440 - DNA, 25 bp, Rattus norvegicus
atccacacagatgacgctctgcttt

SEQ ID NO: 180441 - DNA, 25 bp, Rattus norvegicus
atccacaccttacctgttgggctgg

SEQ ID NO: 180442 - DNA, 25 bp, Rattus norvegicus
atccacaccttagctgttgggctgg

SEQ ID NO: 180443 - DNA, 25 bp, Rattus norvegicus
atccacacgttgactggtcagtcat

SEQ ID NO: 180444 - DNA, 25 bp, Rattus norvegicus
atccacacgttgtctggtcagtcat

SEQ ID NO: 180445 - DNA, 25 bp, Rattus norvegicus
atccacactgtgactggtctttctg

SEQ ID NO: 180446 - DNA, 25 bp, Rattus norvegicus
atccacactgtgtctggtctttctg

SEQ ID NO: 180447 - DNA, 25 bp, Rattus norvegicus
atccacagacatatcgctttgcttg

SEQ ID NO: 180448 - DNA, 25 bp, Rattus norvegicus
atccacagacatttcgctttgcttg

SEQ ID NO: 180449 - DNA, 25 bp, Rattus norvegicus
atccacagactcatgaagctgccac

SEQ ID NO: 180450 - DNA, 25 bp, Rattus norvegicus
atccacagactcttgaagctgccac

SEQ ID NO: 180451 - DNA, 25 bp, Rattus norvegicus
atccacagagcgatgagtgacgtgc

SEQ ID NO: 180452 - DNA, 25 bp, Rattus norvegicus
atccacagagcgttgagtgacgtgc

SEQ ID NO: 180453 - DNA, 25 bp, Rattus norvegicus
atccacagagctagtttgcggtaca

SEQ ID NO: 180454 - DNA, 25 bp, Rattus norvegicus
atccacagagcttgtttgcggtaca

SEQ ID NO: 180455 - DNA, 25 bp, Rattus norvegicus
atccacagagtgatgctgtctctac

SEQ ID NO: 180456 - DNA, 25 bp, Rattus norvegicus
atccacagagtgttgctgtctctac

SEQ ID NO: 180457 - DNA, 25 bp, Rattus norvegicus
atccacagggaacagatccacaggt

SEQ ID NO: 180458 - DNA, 25 bp, Rattus norvegicus
atccacagggaagagatccacaggt

SEQ ID NO: 180459 - DNA, 25 bp, Rattus norvegicus
atccacagttgtatgtacggttcag

SEQ ID NO: 180460 - DNA, 25 bp, Rattus norvegicus
atccacagttgtttgtacggttcag

SEQ ID NO: 180461 - DNA, 25 bp, Rattus norvegicus
atccacatagtgcttttgccctttg

SEQ ID NO: 180462 - DNA, 25 bp, Rattus norvegicus
atccacatagtggttttgccctttg

SEQ ID NO: 180463 - DNA, 25 bp, Rattus norvegicus
atccacatcatcagtcacatcggat

SEQ ID NO: 180464 - DNA, 25 bp, Rattus norvegicus
atccacatcatctgtcacatcggat

SEQ ID NO: 180465 - DNA, 25 bp, Rattus norvegicus
atccacatgcttatgtatctgcacc

SEQ ID NO: 180466 - DNA, 25 bp, Rattus norvegicus
atccacatgcttttgtatctgcacc

SEQ ID NO: 180467 - DNA, 25 bp, Rattus norvegicus
atccacatgtgtcagagcccaagtt

SEQ ID NO: 180468 - DNA, 25 bp, Rattus norvegicus
atccacatgtgtgagagcccaagtt

SEQ ID NO: 180469 - DNA, 25 bp, Rattus norvegicus
atccacattcgaatttcagtgtctg

SEQ ID NO: 180470 - DNA, 25 bp, Rattus norvegicus
atccacattcgattttcagtgtctg

SEQ ID NO: 180471 - DNA, 25 bp, Rattus norvegicus
atccaccaacatcatgggtcatcgg

SEQ ID NO: 180472 - DNA, 25 bp, Rattus norvegicus
atccaccaacatgatgggtcatcgg

SEQ ID NO: 180473 - DNA, 25 bp, Rattus norvegicus
atccaccaacttatggcttgacagt

SEQ ID NO: 180474 - DNA, 25 bp, Rattus norvegicus
atccaccaacttttggcttgacagt

SEQ ID NO: 180475 - DNA, 25 bp, Rattus norvegicus
atccaccactggattttggtccgag

SEQ ID NO: 180476 - DNA, 25 bp, Rattus norvegicus
atccaccactggtttttggtccgag

SEQ ID NO: 180477 - DNA, 25 bp, Rattus norvegicus
atccaccagccactctagaaatatg

SEQ ID NO: 180478 - DNA, 25 bp, Rattus norvegicus
atccaccagccagtctagaaatatg

SEQ ID NO: 180479 - DNA, 25 bp, Rattus norvegicus
atccacccacggcagagacttgagg

SEQ ID NO: 180480 - DNA, 25 bp, Rattus norvegicus
atccacccacgggagagacttgagg

SEQ ID NO: 180481 - DNA, 25 bp, Rattus norvegicus
atccacccagtaacttacatgttct

SEQ ID NO: 180482 - DNA, 25 bp, Rattus norvegicus
atccacccagtatcttacatgttct

SEQ ID NO: 180483 - DNA, 25 bp, Rattus norvegicus
atccacccagtgataatatgcctcg

SEQ ID NO: 180484 - DNA, 25 bp, Rattus norvegicus
atccacccagtgttaatatgcctcg

SEQ ID NO: 180485 - DNA, 25 bp, Rattus norvegicus
atccaccccagtaattctgaggagt

SEQ ID NO: 180486 - DNA, 25 bp, Rattus norvegicus
atccaccccagttattctgaggagt

SEQ ID NO: 180487 - DNA, 25 bp, Rattus norvegicus
atccacctatttaaaattgtcagtg

SEQ ID NO: 180488 - DNA, 25 bp, Rattus norvegicus
atccacctatttaccgcctttagag

SEQ ID NO: 180489 - DNA, 25 bp, Rattus norvegicus
atccacctattttaaattgtcagtg

SEQ ID NO: 180490 - DNA, 25 bp, Rattus norvegicus
atccacctattttccgcctttagag

SEQ ID NO: 180491 - DNA, 25 bp, Rattus norvegicus
atccacctccttatcttgtttgtat

SEQ ID NO: 180492 - DNA, 25 bp, Rattus norvegicus
atccacctccttttcttgtttgtat

SEQ ID NO: 180493 - DNA, 25 bp, Rattus norvegicus
atccacctcgagagatcatcctatt

SEQ ID NO: 180494 - DNA, 25 bp, Rattus norvegicus
atccacctcgagtgatcatcctatt

SEQ ID NO: 180495 - DNA, 25 bp, Rattus norvegicus
atccacctctaccactaagcagtga

SEQ ID NO: 180496 - DNA, 25 bp, Rattus norvegicus
atccacctctacgactaagcagtga

SEQ ID NO: 180497 - DNA, 25 bp, Rattus norvegicus
atccacctggagcacatcgctgaga

SEQ ID NO: 180498 - DNA, 25 bp, Rattus norvegicus
atccacctggaggacatcgctgaga

SEQ ID NO: 180499 - DNA, 25 bp, Rattus norvegicus
atccacctgtctaggccagtgaggg

SEQ ID NO: 180500 - DNA, 25 bp, Rattus norvegicus
atccacctgtcttggccagtgaggg

SEQ ID NO: 180501 - DNA, 25 bp, Rattus norvegicus
atccacctgtggacatttcgggaaa

SEQ ID NO: 180502 - DNA, 25 bp, Rattus norvegicus
atccacctgtggtcatttcgggaaa

SEQ ID NO: 180503 - DNA, 25 bp, Rattus norvegicus
atccaccttcccagggtgacatggg

SEQ ID NO: 180504 - DNA, 25 bp, Rattus norvegicus
atccaccttccctgggtgacatggg

SEQ ID NO: 180505 - DNA, 25 bp, Rattus norvegicus
atccacgcctctattggacattaaa

SEQ ID NO: 180506 - DNA, 25 bp, Rattus norvegicus
atccacgcctcttttggacattaaa

SEQ ID NO: 180507 - DNA, 25 bp, Rattus norvegicus
atccacgctggaattagttaaacca

SEQ ID NO: 180508 - DNA, 25 bp, Rattus norvegicus
atccacgctggatttagttaaacca

SEQ ID NO: 180509 - DNA, 25 bp, Rattus norvegicus
atccacggcatgcttactgtttaaa

SEQ ID NO: 180510 - DNA, 25 bp, Rattus norvegicus
atccacggcatggttactgtttaaa

SEQ ID NO: 180511 - DNA, 25 bp, Rattus norvegicus
atccacggccggatagaggcgcttt

SEQ ID NO: 180512 - DNA, 25 bp, Rattus norvegicus
atccacggccggttagaggcgcttt

SEQ ID NO: 180513 - DNA, 25 bp, Rattus norvegicus
atccacggcttcatgtgatgaccac

SEQ ID NO: 180514 - DNA, 25 bp, Rattus norvegicus
atccacggcttcttgtgatgaccac

SEQ ID NO: 180515 - DNA, 25 bp, Rattus norvegicus
atccacgtattgagccgaagggccc

SEQ ID NO: 180516 - DNA, 25 bp, Rattus norvegicus
atccacgtattgtgccgaagggccc

SEQ ID NO: 180517 - DNA, 25 bp, Rattus norvegicus
atccacgtcactcacaagtttctgt

SEQ ID NO: 180518 - DNA, 25 bp, Rattus norvegicus
atccacgtcactgacaagtttctgt

SEQ ID NO: 180519 - DNA, 25 bp, Rattus norvegicus
atccacgtgaccattcagtttgcaa

SEQ ID NO: 180520 - DNA, 25 bp, Rattus norvegicus
atccacgtgacctttcagtttgcaa

SEQ ID NO: 180521 - DNA, 25 bp, Rattus norvegicus
atccacgttctgagttgttagtgtg

SEQ ID NO: 180522 - DNA, 25 bp, Rattus norvegicus
atccacgttctgtgttgttagtgtg

SEQ ID NO: 180523 - DNA, 25 bp, Rattus norvegicus
atccactagataatcgattctttga

SEQ ID NO: 180524 - DNA, 25 bp, Rattus norvegicus
atccactagatattcgattctttga

SEQ ID NO: 180525 - DNA, 25 bp, Rattus norvegicus
atccactagattatgccagaacccg

SEQ ID NO: 180526 - DNA, 25 bp, Rattus norvegicus
atccactagattttgccagaacccg

SEQ ID NO: 180527 - DNA, 25 bp, Rattus norvegicus
atccactaggccacctgggaataga

SEQ ID NO: 180528 - DNA, 25 bp, Rattus norvegicus
atccactaggcctcctgggaataga

SEQ ID NO: 180529 - DNA, 25 bp, Rattus norvegicus
atccactataacaatttctgtccgt

SEQ ID NO: 180530 - DNA, 25 bp, Rattus norvegicus
atccactataactatttctgtccgt

SEQ ID NO: 180531 - DNA, 25 bp, Rattus norvegicus
atccactatccaatgcctgaatttg

SEQ ID NO: 180532 - DNA, 25 bp, Rattus norvegicus
atccactatccattgcctgaatttg

SEQ ID NO: 180533 - DNA, 25 bp, Rattus norvegicus
atccactatgaaacttacagggcca

SEQ ID NO: 180534 - DNA, 25 bp, Rattus norvegicus
atccactatgaatcttacagggcca

SEQ ID NO: 180535 - DNA, 25 bp, Rattus norvegicus
atccactcaatgctcagtctttaca

SEQ ID NO: 180536 - DNA, 25 bp, Rattus norvegicus
atccactcaatggtcagtctttaca

SEQ ID NO: 180537 - DNA, 25 bp, Rattus norvegicus
atccactcacaccaacaaagaacat

SEQ ID NO: 180538 - DNA, 25 bp, Rattus norvegicus
atccactcacacgaacaaagaacat

SEQ ID NO: 180539 - DNA, 25 bp, Rattus norvegicus
atccactcagggatcttaatggtgc

SEQ ID NO: 180540 - DNA, 25 bp, Rattus norvegicus
atccactcagggttcttaatggtgc

SEQ ID NO: 180541 - DNA, 25 bp, Rattus norvegicus
atccactcgcctcaagcagcttaag

SEQ ID NO: 180542 - DNA, 25 bp, Rattus norvegicus
atccactcgcctgaagcagcttaag

SEQ ID NO: 180543 - DNA, 25 bp, Rattus norvegicus
atccactcggtaaggttttcccagt

SEQ ID NO: 180544 - DNA, 25 bp, Rattus norvegicus
atccactcggtatggttttcccagt

SEQ ID NO: 180545 - DNA, 25 bp, Rattus norvegicus
atccactctaagactggcgttctag

SEQ ID NO: 180546 - DNA, 25 bp, Rattus norvegicus
atccactctaagtctggcgttctag

SEQ ID NO: 180547 - DNA, 25 bp, Rattus norvegicus
atccactctcatcttatctattatc

SEQ ID NO: 180548 - DNA, 25 bp, Rattus norvegicus
atccactctcatgttatctattatc

SEQ ID NO: 180549 - DNA, 25 bp, Rattus norvegicus
atccactctcctagcacagggtggg

SEQ ID NO: 180550 - DNA, 25 bp, Rattus norvegicus
atccactctccttgcacagggtggg

SEQ ID NO: 180551 - DNA, 25 bp, Rattus norvegicus
atccactctggaattcagaccttaa

SEQ ID NO: 180552 - DNA, 25 bp, Rattus norvegicus
atccactctggatttcagaccttaa

SEQ ID NO: 180553 - DNA, 25 bp, Rattus norvegicus
atccactcttaaagcctacttatca

SEQ ID NO: 180554 - DNA, 25 bp, Rattus norvegicus
atccactcttaatgcctacttatca

SEQ ID NO: 180555 - DNA, 25 bp, Rattus norvegicus
atccactgcccgagcgggctggtga

SEQ ID NO: 180556 - DNA, 25 bp, Rattus norvegicus
atccactgcccgtgcgggctggtga

SEQ ID NO: 180557 - DNA, 25 bp, Rattus norvegicus
atccactgtaacagtcctgtctggg

SEQ ID NO: 180558 - DNA, 25 bp, Rattus norvegicus
atccactgtaactgtcctgtctggg

SEQ ID NO: 180559 - DNA, 25 bp, Rattus norvegicus
atccactgtgatacttatgcattaa

SEQ ID NO: 180560 - DNA, 25 bp, Rattus norvegicus
atccactgtgattcttatgcattaa

SEQ ID NO: 180561 - DNA, 25 bp, Rattus norvegicus
atccactgtggcacgcagaatgttc

SEQ ID NO: 180562 - DNA, 25 bp, Rattus norvegicus
atccactgtggctcgcagaatgttc

SEQ ID NO: 180563 - DNA, 25 bp, Rattus norvegicus
atccactgtgggaccctgagagatt

SEQ ID NO: 180564 - DNA, 25 bp, Rattus norvegicus
atccactgtgggtccctgagagatt

SEQ ID NO: 180565 - DNA, 25 bp, Rattus norvegicus
atccacttaagccaatctctgcctt

SEQ ID NO: 180566 - DNA, 25 bp, Rattus norvegicus
atccacttaagcgaatctctgcctt

SEQ ID NO: 180567 - DNA, 25 bp, Rattus norvegicus
atccacttagaaagggctggtgtct

SEQ ID NO: 180568 - DNA, 25 bp, Rattus norvegicus
atccacttagaatgggctggtgtct

SEQ ID NO: 180569 - DNA, 25 bp, Rattus norvegicus
atccacttagtgcagtatatttttc

SEQ ID NO: 180570 - DNA, 25 bp, Rattus norvegicus
atccacttagtggagtatatttttc

SEQ ID NO: 180571 - DNA, 25 bp, Rattus norvegicus
atccacttctttcactgtgacgagg

SEQ ID NO: 180572 - DNA, 25 bp, Rattus norvegicus
atccacttctttgactgtgacgagg

SEQ ID NO: 180573 - DNA, 25 bp, Rattus norvegicus
atccacttgaagcagccaggcgggt

SEQ ID NO: 180574 - DNA, 25 bp, Rattus norvegicus
atccacttgaaggagccaggcgggt

SEQ ID NO: 180575 - DNA, 25 bp, Rattus norvegicus
atccacttgcaactgctgtgcttaa

SEQ ID NO: 180576 - DNA, 25 bp, Rattus norvegicus
atccacttgcaagtgctgtgcttaa

SEQ ID NO: 180577 - DNA, 25 bp, Rattus norvegicus
atccacttgtggaaaggcctttgta

SEQ ID NO: 180578 - DNA, 25 bp, Rattus norvegicus
atccacttgtggtaaggcctttgta

SEQ ID NO: 180579 - DNA, 25 bp, Rattus norvegicus
atccactttgtgagggctttgcatg

SEQ ID NO: 180580 - DNA, 25 bp, Rattus norvegicus
atccactttgtgtgggctttgcatg

SEQ ID NO: 180581 - DNA, 25 bp, Rattus norvegicus
atccagaaatgtacgttcctccttt

SEQ ID NO: 180582 - DNA, 25 bp, Rattus norvegicus
atccagaaatgttcgttcctccttt

SEQ ID NO: 180583 - DNA, 25 bp, Rattus norvegicus
atccagaactccattagcagtcatg

SEQ ID NO: 180584 - DNA, 25 bp, Rattus norvegicus
atccagaactcctttagcagtcatg

SEQ ID NO: 180585 - DNA, 25 bp, Rattus norvegicus
atccagaactttacttgcctcatta

SEQ ID NO: 180586 - DNA, 25 bp, Rattus norvegicus
atccagaacttttcttgcctcatta

SEQ ID NO: 180587 - DNA, 25 bp, Rattus norvegicus
atccagaagccgcataatcgaagcg

SEQ ID NO: 180588 - DNA, 25 bp, Rattus norvegicus
atccagaagccggataatcgaagcg

SEQ ID NO: 180589 - DNA, 25 bp, Rattus norvegicus
atccagaaggagctcaccattggtg

SEQ ID NO: 180590 - DNA, 25 bp, Rattus norvegicus
atccagaaggaggtcaccattggtg

SEQ ID NO: 180591 - DNA, 25 bp, Rattus norvegicus
atccagaaggccagtcagcccaaga

SEQ ID NO: 180592 - DNA, 25 bp, Rattus norvegicus
atccagaaggcctgtcagcccaaga

SEQ ID NO: 180593 - DNA, 25 bp, Rattus norvegicus
atccagaatggtatcgtagacgctc

SEQ ID NO: 180594 - DNA, 25 bp, Rattus norvegicus
atccagaatggtttcgtagacgctc

SEQ ID NO: 180595 - DNA, 25 bp, Rattus norvegicus
atccagacagacctgcgtggcatga

SEQ ID NO: 180596 - DNA, 25 bp, Rattus norvegicus
atccagacagacgtgcgtggcatga

SEQ ID NO: 180597 - DNA, 25 bp, Rattus norvegicus
atccagacagtaacatttcccatta

SEQ ID NO: 180598 - DNA, 25 bp, Rattus norvegicus
atccagacagtatcatttcccatta

SEQ ID NO: 180599 - DNA, 25 bp, Rattus norvegicus
atccagacagttcaagcatccagct

SEQ ID NO: 180600 - DNA, 25 bp, Rattus norvegicus
atccagacagttgaagcatccagct

SEQ ID NO: 180601 - DNA, 25 bp, Rattus norvegicus
atccagaccaatcccgggtactata

SEQ ID NO: 180602 - DNA, 25 bp, Rattus norvegicus
atccagaccaatgccgggtactata

SEQ ID NO: 180603 - DNA, 25 bp, Rattus norvegicus
atccagaccagaattttgtaaatgc

SEQ ID NO: 180604 - DNA, 25 bp, Rattus norvegicus
atccagaccagatttttgtaaatgc

SEQ ID NO: 180605 - DNA, 25 bp, Rattus norvegicus
atccagaccccgaggttcagaaaga

SEQ ID NO: 180606 - DNA, 25 bp, Rattus norvegicus
atccagaccccgagtagaaaagctc

SEQ ID NO: 180607 - DNA, 25 bp, Rattus norvegicus
atccagaccccgtggttcagaaaga

SEQ ID NO: 180608 - DNA, 25 bp, Rattus norvegicus
atccagaccccgtgtagaaaagctc

SEQ ID NO: 180609 - DNA, 25 bp, Rattus norvegicus
atccagacctggatcaacaagccag

SEQ ID NO: 180610 - DNA, 25 bp, Rattus norvegicus
atccagacctggttcaacaagccag

SEQ ID NO: 180611 - DNA, 25 bp, Rattus norvegicus
atccagactctgcttttaagattgt

SEQ ID NO: 180612 - DNA, 25 bp, Rattus norvegicus
atccagactctggttttaagattgt

SEQ ID NO: 180613 - DNA, 25 bp, Rattus norvegicus
atccagactggccaaacgttcttgt

SEQ ID NO: 180614 - DNA, 25 bp, Rattus norvegicus
atccagactggcgaaacgttcttgt

SEQ ID NO: 180615 - DNA, 25 bp, Rattus norvegicus
atccagacttctcaggctcgtggta

SEQ ID NO: 180616 - DNA, 25 bp, Rattus norvegicus
atccagacttctgaggctcgtggta

SEQ ID NO: 180617 - DNA, 25 bp, Rattus norvegicus
atccagacttggagcttggctagca

SEQ ID NO: 180618 - DNA, 25 bp, Rattus norvegicus
atccagacttggtgcttggctagca

SEQ ID NO: 180619 - DNA, 25 bp, Rattus norvegicus
atccagagagagagaccgttcttaa

SEQ ID NO: 180620 - DNA, 25 bp, Rattus norvegicus
atccagagagagtgaccgttcttaa

SEQ ID NO: 180621 - DNA, 25 bp, Rattus norvegicus
atccagagagggaccccgacgtata

SEQ ID NO: 180622 - DNA, 25 bp, Rattus norvegicus
atccagagagggtccccgacgtata

SEQ ID NO: 180623 - DNA, 25 bp, Rattus norvegicus
atccagagcagaagctgctccatca

SEQ ID NO: 180624 - DNA, 25 bp, Rattus norvegicus
atccagagcagatgctgctccatca

SEQ ID NO: 180625 - DNA, 25 bp, Rattus norvegicus
atccagagcatgacccggctagtag

SEQ ID NO: 180626 - DNA, 25 bp, Rattus norvegicus
atccagagcatgtcccggctagtag

SEQ ID NO: 180627 - DNA, 25 bp, Rattus norvegicus
atccagaggccccagccaggtggac

SEQ ID NO: 180628 - DNA, 25 bp, Rattus norvegicus
atccagaggcccgagccaggtggac

SEQ ID NO: 180629 - DNA, 25 bp, Rattus norvegicus
atccagagggaacgcctctgactcc

SEQ ID NO: 180630 - DNA, 25 bp, Rattus norvegicus
atccagagggaaggcctctgactcc

SEQ ID NO: 180631 - DNA, 25 bp, Rattus norvegicus
atccagagggcaagggttcttacca

SEQ ID NO: 180632 - DNA, 25 bp, Rattus norvegicus
atccagagggcatgggttcttacca

SEQ ID NO: 180633 - DNA, 25 bp, Rattus norvegicus
atccagagttggatcaggttgcctg

SEQ ID NO: 180634 - DNA, 25 bp, Rattus norvegicus
atccagagttggttcaggttgcctg

SEQ ID NO: 180635 - DNA, 25 bp, Rattus norvegicus
atccagatagtgactgggctctgaa

SEQ ID NO: 180636 - DNA, 25 bp, Rattus norvegicus
atccagatagtgtctgggctctgaa

SEQ ID NO: 180637 - DNA, 25 bp, Rattus norvegicus
atccagatgcgcctcgtgggagctc

SEQ ID NO: 180638 - DNA, 25 bp, Rattus norvegicus
atccagatgcgcgtcgtgggagctc

SEQ ID NO: 180639 - DNA, 25 bp, Rattus norvegicus
atccagatgctgacgagaggcctgc

SEQ ID NO: 180640 - DNA, 25 bp, Rattus norvegicus
atccagatgctgtcgagaggcctgc

SEQ ID NO: 180641 - DNA, 25 bp, Rattus norvegicus
atccagatggctacctcacaagaga

SEQ ID NO: 180642 - DNA, 25 bp, Rattus norvegicus
atccagatggcttcctcacaagaga

SEQ ID NO: 180643 - DNA, 25 bp, Rattus norvegicus
atccagcaatcaatccgtccaagat

SEQ ID NO: 180644 - DNA, 25 bp, Rattus norvegicus
atccagcaatcattccgtccaagat

SEQ ID NO: 180645 - DNA, 25 bp, Rattus norvegicus
atccagcaatttcagtgttcatgtc

SEQ ID NO: 180646 - DNA, 25 bp, Rattus norvegicus
atccagcaatttgagtgttcatgtc

SEQ ID NO: 180647 - DNA, 25 bp, Rattus norvegicus
atccagcacgataaaacacctcctt

SEQ ID NO: 180648 - DNA, 25 bp, Rattus norvegicus
atccagcacgattaaacacctcctt

SEQ ID NO: 180649 - DNA, 25 bp, Rattus norvegicus
atccagcactttccaaggaggccct

SEQ ID NO: 180650 - DNA, 25 bp, Rattus norvegicus
atccagcactttctatgaacggcca

SEQ ID NO: 180651 - DNA, 25 bp, Rattus norvegicus
atccagcactttgcaaggaggccct

SEQ ID NO: 180652 - DNA, 25 bp, Rattus norvegicus
atccagcactttgtatgaacggcca

SEQ ID NO: 180653 - DNA, 25 bp, Rattus norvegicus
atccagcagcttataagtgcctcgc

SEQ ID NO: 180654 - DNA, 25 bp, Rattus norvegicus
atccagcagcttttaagtgcctcgc

SEQ ID NO: 180655 - DNA, 25 bp, Rattus norvegicus
atccagcatctgagaagctcttccg

SEQ ID NO: 180656 - DNA, 25 bp, Rattus norvegicus
atccagcatctgtgaagctcttccg

SEQ ID NO: 180657 - DNA, 25 bp, Rattus norvegicus
atccagcattgcaatttctctgtcc

SEQ ID NO: 180658 - DNA, 25 bp, Rattus norvegicus
atccagcattgctatttctctgtcc

SEQ ID NO: 180659 - DNA, 25 bp, Rattus norvegicus
atccagcatttcatctacttttctt

SEQ ID NO: 180660 - DNA, 25 bp, Rattus norvegicus
atccagcatttcttctacttttctt

SEQ ID NO: 180661 - DNA, 25 bp, Rattus norvegicus
atccagccaggaatagccttcggga

SEQ ID NO: 180662 - DNA, 25 bp, Rattus norvegicus
atccagccaggattagccttcggga

SEQ ID NO: 180663 - DNA, 25 bp, Rattus norvegicus
atccagccaggtcacacagctgtgt

SEQ ID NO: 180664 - DNA, 25 bp, Rattus norvegicus
atccagccaggtgacacagctgtgt

SEQ ID NO: 180665 - DNA, 25 bp, Rattus norvegicus
atccagccccatctatgaggataca

SEQ ID NO: 180666 - DNA, 25 bp, Rattus norvegicus
atccagccccatgtatgaggataca

SEQ ID NO: 180667 - DNA, 25 bp, Rattus norvegicus
atccagcccctcaagtaaatatgtt

SEQ ID NO: 180668 - DNA, 25 bp, Rattus norvegicus
atccagcccctctagtaaatatgtt

SEQ ID NO: 180669 - DNA, 25 bp, Rattus norvegicus
atccagccctacagggtaggcgaca

SEQ ID NO: 180670 - DNA, 25 bp, Rattus norvegicus
atccagccctactgggtaggcgaca

SEQ ID NO: 180671 - DNA, 25 bp, Rattus norvegicus
atccagcctcacagttttgagcaca

SEQ ID NO: 180672 - DNA, 25 bp, Rattus norvegicus
atccagcctcactgttttgagcaca

SEQ ID NO: 180673 - DNA, 25 bp, Rattus norvegicus
atccagcctctcactggtgcctagg

SEQ ID NO: 180674 - DNA, 25 bp, Rattus norvegicus
atccagcctctctctggtgcctagg

SEQ ID NO: 180675 - DNA, 25 bp, Rattus norvegicus
atccagccttcactgtagaggtgac

SEQ ID NO: 180676 - DNA, 25 bp, Rattus norvegicus
atccagccttcagtgtagaggtgac

SEQ ID NO: 180677 - DNA, 25 bp, Rattus norvegicus
atccagcgaatgcatgtgctatgct

SEQ ID NO: 180678 - DNA, 25 bp, Rattus norvegicus
atccagcgaatggatgtgctatgct

SEQ ID NO: 180679 - DNA, 25 bp, Rattus norvegicus
atccagcgggccattgaggacctag

SEQ ID NO: 180680 - DNA, 25 bp, Rattus norvegicus
atccagcgggcctttgaggacctag

SEQ ID NO: 180681 - DNA, 25 bp, Rattus norvegicus
atccagcggtggagtgacagccaat

SEQ ID NO: 180682 - DNA, 25 bp, Rattus norvegicus
atccagcggtggtgtgacagccaat

SEQ ID NO: 180683 - DNA, 25 bp, Rattus norvegicus
atccagcgtggcctaacctgactta

SEQ ID NO: 180684 - DNA, 25 bp, Rattus norvegicus
atccagcgtggcgtaacctgactta

SEQ ID NO: 180685 - DNA, 25 bp, Rattus norvegicus
atccagctccagaggccatatggaa

SEQ ID NO: 180686 - DNA, 25 bp, Rattus norvegicus
atccagctccagtggccatatggaa

SEQ ID NO: 180687 - DNA, 25 bp, Rattus norvegicus
atccagctgaaaagtgattttgctt

SEQ ID NO: 180688 - DNA, 25 bp, Rattus norvegicus
atccagctgaaatgtgattttgctt

SEQ ID NO: 180689 - DNA, 25 bp, Rattus norvegicus
atccagctgcgtaagatccgagacc

SEQ ID NO: 180690 - DNA, 25 bp, Rattus norvegicus
atccagctgcgttagatccgagacc

SEQ ID NO: 180691 - DNA, 25 bp, Rattus norvegicus
atccagcttgtccactgaggagacc

SEQ ID NO: 180692 - DNA, 25 bp, Rattus norvegicus
atccagcttgtcgactgaggagacc

SEQ ID NO: 180693 - DNA, 25 bp, Rattus norvegicus
atccagcttttaatacttcttccaa

SEQ ID NO: 180694 - DNA, 25 bp, Rattus norvegicus
atccagcttttattacttcttccaa

SEQ ID NO: 180695 - DNA, 25 bp, Rattus norvegicus
atccaggaaatgctatttaccaggc

SEQ ID NO: 180696 - DNA, 25 bp, Rattus norvegicus
atccaggaaatggtatttaccaggc

SEQ ID NO: 180697 - DNA, 25 bp, Rattus norvegicus
atccaggaagatcctctgttgtccc

SEQ ID NO: 180698 - DNA, 25 bp, Rattus norvegicus
atccaggaagatgctctgttgtccc

SEQ ID NO: 180699 - DNA, 25 bp, Rattus norvegicus
atccaggacagccaatattatagag

SEQ ID NO: 180700 - DNA, 25 bp, Rattus norvegicus
atccaggacagcgaatattatagag

SEQ ID NO: 180701 - DNA, 25 bp, Rattus norvegicus
atccaggagcagctgcgtgacgtca

SEQ ID NO: 180702 - DNA, 25 bp, Rattus norvegicus
atccaggagcaggtgcgtgacgtca

SEQ ID NO: 180703 - DNA, 25 bp, Rattus norvegicus
atccaggaggccattggttatccca

SEQ ID NO: 180704 - DNA, 25 bp, Rattus norvegicus
atccaggaggcctttggttatccca

SEQ ID NO: 180705 - DNA, 25 bp, Rattus norvegicus
atccaggaggtgaaccacgccgtgg

SEQ ID NO: 180706 - DNA, 25 bp, Rattus norvegicus
atccaggaggtgtaccacgccgtgg

SEQ ID NO: 180707 - DNA, 25 bp, Rattus norvegicus
atccaggagtgcctccagtatgcag

SEQ ID NO: 180708 - DNA, 25 bp, Rattus norvegicus
atccaggagtgcgtccagtatgcag

SEQ ID NO: 180709 - DNA, 25 bp, Rattus norvegicus
atccaggagtttccgcgcggccgta

SEQ ID NO: 180710 - DNA, 25 bp, Rattus norvegicus
atccaggagtttgcgcgcggccgta

SEQ ID NO: 180711 - DNA, 25 bp, Rattus norvegicus
atccaggatcggcaaagcgttcatg

SEQ ID NO: 180712 - DNA, 25 bp, Rattus norvegicus
atccaggatcgggaaagcgttcatg

SEQ ID NO: 180713 - DNA, 25 bp, Rattus norvegicus
atccaggcaaaacatgtcttatact

SEQ ID NO: 180714 - DNA, 25 bp, Rattus norvegicus
atccaggcaaaagatgtcttatact

SEQ ID NO: 180715 - DNA, 25 bp, Rattus norvegicus
atccaggcacctcttgtgtatcatt

SEQ ID NO: 180716 - DNA, 25 bp, Rattus norvegicus
atccaggcacctgttgtgtatcatt

SEQ ID NO: 180717 - DNA, 25 bp, Rattus norvegicus
atccaggcactgattccactgaagg

SEQ ID NO: 180718 - DNA, 25 bp, Rattus norvegicus
atccaggcactgtttccactgaagg

SEQ ID NO: 180719 - DNA, 25 bp, Rattus norvegicus
atccaggccccaagtaatgaaggtg

SEQ ID NO: 180720 - DNA, 25 bp, Rattus norvegicus
atccaggccccatgtaatgaaggtg

SEQ ID NO: 180721 - DNA, 25 bp, Rattus norvegicus
atccaggcgcccacggctgagggtt

SEQ ID NO: 180722 - DNA, 25 bp, Rattus norvegicus
atccaggcgccctcggctgagggtt

SEQ ID NO: 180723 - DNA, 25 bp, Rattus norvegicus
atccaggctactactgtcatttcta

SEQ ID NO: 180724 - DNA, 25 bp, Rattus norvegicus
atccaggctacttctgtcatttcta

SEQ ID NO: 180725 - DNA, 25 bp, Rattus norvegicus
atccaggctctaacactgctaagtg

SEQ ID NO: 180726 - DNA, 25 bp, Rattus norvegicus
atccaggctctatcactgctaagtg

SEQ ID NO: 180727 - DNA, 25 bp, Rattus norvegicus
atccaggctggtattgtaagatgct

SEQ ID NO: 180728 - DNA, 25 bp, Rattus norvegicus
atccaggctggttttgtaagatgct

SEQ ID NO: 180729 - DNA, 25 bp, Rattus norvegicus
atccaggctgtgatgtccctgtatg

SEQ ID NO: 180730 - DNA, 25 bp, Rattus norvegicus
atccaggctgtgttgtccctgtatg

SEQ ID NO: 180731 - DNA, 25 bp, Rattus norvegicus
atccagggaaggatgcgctggcctt

SEQ ID NO: 180732 - DNA, 25 bp, Rattus norvegicus
atccagggaaggttgcgctggcctt

SEQ ID NO: 180733 - DNA, 25 bp, Rattus norvegicus
atccagggacacctttggcaaagca

SEQ ID NO: 180734 - DNA, 25 bp, Rattus norvegicus
atccagggacacgtttggcaaagca

SEQ ID NO: 180735 - DNA, 25 bp, Rattus norvegicus
atccagggacatcgtgtgtgtgcac

SEQ ID NO: 180736 - DNA, 25 bp, Rattus norvegicus
atccagggacatggtgtgtgtgcac

SEQ ID NO: 180737 - DNA, 25 bp, Rattus norvegicus
atccagggactgctctcacctttag

SEQ ID NO: 180738 - DNA, 25 bp, Rattus norvegicus
atccagggactggtctcacctttag

SEQ ID NO: 180739 - DNA, 25 bp, Rattus norvegicus
atccagggtcctctgtattttctgg

SEQ ID NO: 180740 - DNA, 25 bp, Rattus norvegicus
atccagggtcctgtgtattttctgg

SEQ ID NO: 180741 - DNA, 25 bp, Rattus norvegicus
atccaggtaattagaaagcccgttg

SEQ ID NO: 180742 - DNA, 25 bp, Rattus norvegicus
atccaggtaatttgaaagcccgttg

SEQ ID NO: 180743 - DNA, 25 bp, Rattus norvegicus
atccaggtagacacgagccctgttg

SEQ ID NO: 180744 - DNA, 25 bp, Rattus norvegicus
atccaggtagactcgagccctgttg

SEQ ID NO: 180745 - DNA, 25 bp, Rattus norvegicus
atccaggtatggatcactatacagt

SEQ ID NO: 180746 - DNA, 25 bp, Rattus norvegicus
atccaggtatggttcactatacagt

SEQ ID NO: 180747 - DNA, 25 bp, Rattus norvegicus
atccaggtcccactcgggtatgaac

SEQ ID NO: 180748 - DNA, 25 bp, Rattus norvegicus
atccaggtcccagtcgggtatgaac

SEQ ID NO: 180749 - DNA, 25 bp, Rattus norvegicus
atccaggtccctcttcagcaagaag

SEQ ID NO: 180750 - DNA, 25 bp, Rattus norvegicus
atccaggtccctgttcagcaagaag

SEQ ID NO: 180751 - DNA, 25 bp, Rattus norvegicus
atccaggtctgtctgtcgacttgaa

SEQ ID NO: 180752 - DNA, 25 bp, Rattus norvegicus
atccaggtctgtgtgtcgacttgaa

SEQ ID NO: 180753 - DNA, 25 bp, Rattus norvegicus
atccaggtgcttatcatgtgacatt

SEQ ID NO: 180754 - DNA, 25 bp, Rattus norvegicus
atccaggtgcttttcatgtgacatt

SEQ ID NO: 180755 - DNA, 25 bp, Rattus norvegicus
atccaggtgggaaaatgtcagtatt

SEQ ID NO: 180756 - DNA, 25 bp, Rattus norvegicus
atccaggtgggataatgtcagtatt

SEQ ID NO: 180757 - DNA, 25 bp, Rattus norvegicus
atccaggtgtgtatcactgctgcac

SEQ ID NO: 180758 - DNA, 25 bp, Rattus norvegicus
atccaggtgtgtttcactgctgcac

SEQ ID NO: 180759 - DNA, 25 bp, Rattus norvegicus
atccaggttactatcggagaactct

SEQ ID NO: 180760 - DNA, 25 bp, Rattus norvegicus
atccaggttactttcggagaactct

SEQ ID NO: 180761 - DNA, 25 bp, Rattus norvegicus
atccaggttccccaattacatgtag

SEQ ID NO: 180762 - DNA, 25 bp, Rattus norvegicus
atccaggttcccgaattacatgtag

SEQ ID NO: 180763 - DNA, 25 bp, Rattus norvegicus
atccaggttgagagaccatcagctt

SEQ ID NO: 180764 - DNA, 25 bp, Rattus norvegicus
atccaggttgagtgaccatcagctt

SEQ ID NO: 180765 - DNA, 25 bp, Rattus norvegicus
atccaggttgggatcaccagctggg

SEQ ID NO: 180766 - DNA, 25 bp, Rattus norvegicus
atccaggttgggttcaccagctggg

SEQ ID NO: 180767 - DNA, 25 bp, Rattus norvegicus
atccaggttgtgacctcctgcatga

SEQ ID NO: 180768 - DNA, 25 bp, Rattus norvegicus
atccaggttgtgtcctcctgcatga

SEQ ID NO: 180769 - DNA, 25 bp, Rattus norvegicus
atccaggtttatattgcttcttctc

SEQ ID NO: 180770 - DNA, 25 bp, Rattus norvegicus
atccaggtttattttgcttcttctc

SEQ ID NO: 180771 - DNA, 25 bp, Rattus norvegicus
atccaggtttcaacagtcagctgtg

SEQ ID NO: 180772 - DNA, 25 bp, Rattus norvegicus
atccaggtttcatcagtcagctgtg

SEQ ID NO: 180773 - DNA, 25 bp, Rattus norvegicus
atccagtatactcagctgcagaact

SEQ ID NO: 180774 - DNA, 25 bp, Rattus norvegicus
atccagtatactgagctgcagaact

SEQ ID NO: 180775 - DNA, 25 bp, Rattus norvegicus
atccagtcaactattctgcctccta

SEQ ID NO: 180776 - DNA, 25 bp, Rattus norvegicus
atccagtcaacttttctgcctccta

SEQ ID NO: 180777 - DNA, 25 bp, Rattus norvegicus
atccagtcagacaagccaaaccagc

SEQ ID NO: 180778 - DNA, 25 bp, Rattus norvegicus
atccagtcagactagccaaaccagc

SEQ ID NO: 180779 - DNA, 25 bp, Rattus norvegicus
atccagtcaggcaccattgcgtgga

SEQ ID NO: 180780 - DNA, 25 bp, Rattus norvegicus
atccagtcaggctccattgcgtgga

SEQ ID NO: 180781 - DNA, 25 bp, Rattus norvegicus
atccagtctaacattctcagcaatc

SEQ ID NO: 180782 - DNA, 25 bp, Rattus norvegicus
atccagtctaactttctcagcaatc

SEQ ID NO: 180783 - DNA, 25 bp, Rattus norvegicus
atccagtctctacgaacttcaagcc

SEQ ID NO: 180784 - DNA, 25 bp, Rattus norvegicus
atccagtctctaggaacttcaagcc

SEQ ID NO: 180785 - DNA, 25 bp, Rattus norvegicus
atccagtctctcagttatcagttgc

SEQ ID NO: 180786 - DNA, 25 bp, Rattus norvegicus
atccagtctctctgttatcagttgc

SEQ ID NO: 180787 - DNA, 25 bp, Rattus norvegicus
atccagtctggacgctgtgccctgt

SEQ ID NO: 180788 - DNA, 25 bp, Rattus norvegicus
atccagtctggaggctgtgccctgt

SEQ ID NO: 180789 - DNA, 25 bp, Rattus norvegicus
atccagtctggcctaattttgtagc

SEQ ID NO: 180790 - DNA, 25 bp, Rattus norvegicus
atccagtctggcgtaattttgtagc

SEQ ID NO: 180791 - DNA, 25 bp, Rattus norvegicus
atccagtctgttaaactgaattttg

SEQ ID NO: 180792 - DNA, 25 bp, Rattus norvegicus
atccagtctgtttaactgaattttg

SEQ ID NO: 180793 - DNA, 25 bp, Rattus norvegicus
atccagtgacgaagcttgggtgagc

SEQ ID NO: 180794 - DNA, 25 bp, Rattus norvegicus
atccagtgacgatgcttgggtgagc

SEQ ID NO: 180795 - DNA, 25 bp, Rattus norvegicus
atccagtgacggaggcaggtgctaa

SEQ ID NO: 180796 - DNA, 25 bp, Rattus norvegicus
atccagtgacggtggcaggtgctaa

SEQ ID NO: 180797 - DNA, 25 bp, Rattus norvegicus
atccagtgagagagtggttcagtac

SEQ ID NO: 180798 - DNA, 25 bp, Rattus norvegicus
atccagtgagagtgtggttcagtac

SEQ ID NO: 180799 - DNA, 25 bp, Rattus norvegicus
atccagtgcctgagatccgcagaga

SEQ ID NO: 180800 - DNA, 25 bp, Rattus norvegicus
atccagtgcctgtgatccgcagaga

SEQ ID NO: 180801 - DNA, 25 bp, Rattus norvegicus
atccagtggcagctgcatcaaggct

SEQ ID NO: 180802 - DNA, 25 bp, Rattus norvegicus
atccagtggcaggtgcatcaaggct

SEQ ID NO: 180803 - DNA, 25 bp, Rattus norvegicus
atccagtgttggacatgtctgtact

SEQ ID NO: 180804 - DNA, 25 bp, Rattus norvegicus
atccagtgttggtcatgtctgtact

SEQ ID NO: 180805 - DNA, 25 bp, Rattus norvegicus
atccagttaatgagcctgctttgtt

SEQ ID NO: 180806 - DNA, 25 bp, Rattus norvegicus
atccagttaatgtgcctgctttgtt

SEQ ID NO: 180807 - DNA, 25 bp, Rattus norvegicus
atccagttcactaactgttcaggct

SEQ ID NO: 180808 - DNA, 25 bp, Rattus norvegicus
atccagttcacttactgttcaggct

SEQ ID NO: 180809 - DNA, 25 bp, Rattus norvegicus
atccagttcattctgatcactcttg

SEQ ID NO: 180810 - DNA, 25 bp, Rattus norvegicus
atccagttcattgtgatcactcttg

SEQ ID NO: 180811 - DNA, 25 bp, Rattus norvegicus
atccagttcctgctgtacagaagcc

SEQ ID NO: 180812 - DNA, 25 bp, Rattus norvegicus
atccagttcctggtgtacagaagcc

SEQ ID NO: 180813 - DNA, 25 bp, Rattus norvegicus
atccagttctcacattgggaatccc

SEQ ID NO: 180814 - DNA, 25 bp, Rattus norvegicus
atccagttctcagattgggaatccc

SEQ ID NO: 180815 - DNA, 25 bp, Rattus norvegicus
atccagttctgtctatcatatgtgc

SEQ ID NO: 180816 - DNA, 25 bp, Rattus norvegicus
atccagttctgtgtatcatatgtgc

SEQ ID NO: 180817 - DNA, 25 bp, Rattus norvegicus
atccagttgcaaactcccagcaaag

SEQ ID NO: 180818 - DNA, 25 bp, Rattus norvegicus
atccagttgcaatctcccagcaaag

SEQ ID NO: 180819 - DNA, 25 bp, Rattus norvegicus
atccagttgtagactgagtccccac

SEQ ID NO: 180820 - DNA, 25 bp, Rattus norvegicus
atccagttgtagtctgagtccccac

SEQ ID NO: 180821 - DNA, 25 bp, Rattus norvegicus
atccagtttgtcatcgacgcagtga

SEQ ID NO: 180822 - DNA, 25 bp, Rattus norvegicus
atccagtttgtcttcgacgcagtga

SEQ ID NO: 180823 - DNA, 25 bp, Rattus norvegicus
atccataagcacaaccgacatcggt

SEQ ID NO: 180824 - DNA, 25 bp, Rattus norvegicus
atccataagcactaccgacatcggt

SEQ ID NO: 180825 - DNA, 25 bp, Rattus norvegicus
atccataattgacatccagattggg

SEQ ID NO: 180826 - DNA, 25 bp, Rattus norvegicus
atccataattgagatccagattggg

SEQ ID NO: 180827 - DNA, 25 bp, Rattus norvegicus
atccatacaaaaaagacctccctct

SEQ ID NO: 180828 - DNA, 25 bp, Rattus norvegicus
atccatacaaaatagacctccctct

SEQ ID NO: 180829 - DNA, 25 bp, Rattus norvegicus
atccatacaccccagagaactgtat

SEQ ID NO: 180830 - DNA, 25 bp, Rattus norvegicus
atccatacacccgagagaactgtat

SEQ ID NO: 180831 - DNA, 25 bp, Rattus norvegicus
atccatacccagatctcaaggcatt

SEQ ID NO: 180832 - DNA, 25 bp, Rattus norvegicus
atccatacccagttctcaaggcatt

SEQ ID NO: 180833 - DNA, 25 bp, Rattus norvegicus
atccatacctgcctgtctagggaag

SEQ ID NO: 180834 - DNA, 25 bp, Rattus norvegicus
atccatacctgcgtgtctagggaag

SEQ ID NO: 180835 - DNA, 25 bp, Rattus norvegicus
atccatactggcctggcttcttgag

SEQ ID NO: 180836 - DNA, 25 bp, Rattus norvegicus
atccatactggcgtggcttcttgag

SEQ ID NO: 180837 - DNA, 25 bp, Rattus norvegicus
atccatagaccaatcttgaccgagc

SEQ ID NO: 180838 - DNA, 25 bp, Rattus norvegicus
atccatagaccattcttgaccgagc

SEQ ID NO: 180839 - DNA, 25 bp, Rattus norvegicus
atccatagctgccatggctttctga

SEQ ID NO: 180840 - DNA, 25 bp, Rattus norvegicus
atccatagctgcgatggctttctga

SEQ ID NO: 180841 - DNA, 25 bp, Rattus norvegicus
atccatagtgtcaacgttccgggta

SEQ ID NO: 180842 - DNA, 25 bp, Rattus norvegicus
atccatagtgtctacgttccgggta

SEQ ID NO: 180843 - DNA, 25 bp, Rattus norvegicus
atccatatcatcctacgcacagaat

SEQ ID NO: 180844 - DNA, 25 bp, Rattus norvegicus
atccatatcatcgtacgcacagaat

SEQ ID NO: 180845 - DNA, 25 bp, Rattus norvegicus
atccatcaagtacaggccaagccct

SEQ ID NO: 180846 - DNA, 25 bp, Rattus norvegicus
atccatcaagtagaggccaagccct

SEQ ID NO: 180847 - DNA, 25 bp, Rattus norvegicus
atccatcatcctcctatcactagga

SEQ ID NO: 180848 - DNA, 25 bp, Rattus norvegicus
atccatcatcctgctatcactagga

SEQ ID NO: 180849 - DNA, 25 bp, Rattus norvegicus
atccatcatggacttcaaacagcta

SEQ ID NO: 180850 - DNA, 25 bp, Rattus norvegicus
atccatcatggagttcaaacagcta

SEQ ID NO: 180851 - DNA, 25 bp, Rattus norvegicus
atccatcatgtcagggaatgtctgc

SEQ ID NO: 180852 - DNA, 25 bp, Rattus norvegicus
atccatcatgtctgggaatgtctgc

SEQ ID NO: 180853 - DNA, 25 bp, Rattus norvegicus
atccatccatctcttgtgaccaagt

SEQ ID NO: 180854 - DNA, 25 bp, Rattus norvegicus
atccatccatctgttgtgaccaagt

SEQ ID NO: 180855 - DNA, 25 bp, Rattus norvegicus
atccatcccatcagcatttgtgttg

SEQ ID NO: 180856 - DNA, 25 bp, Rattus norvegicus
atccatcccatctgcatttgtgttg

SEQ ID NO: 180857 - DNA, 25 bp, Rattus norvegicus
atccatccgtgtagtgaacccagag

SEQ ID NO: 180858 - DNA, 25 bp, Rattus norvegicus
atccatccgtgttgtgaacccagag

SEQ ID NO: 180859 - DNA, 25 bp, Rattus norvegicus
atccatcctgacacttgtcttaaga

SEQ ID NO: 180860 - DNA, 25 bp, Rattus norvegicus
atccatcctgactcttgtcttaaga

SEQ ID NO: 180861 - DNA, 25 bp, Rattus norvegicus
atccatcctgccatcaagagtttcc

SEQ ID NO: 180862 - DNA, 25 bp, Rattus norvegicus
atccatcctgccttcaagagtttcc

SEQ ID NO: 180863 - DNA, 25 bp, Rattus norvegicus
atccatcctgctcttattcatgaag

SEQ ID NO: 180864 - DNA, 25 bp, Rattus norvegicus
atccatcctgctgttattcatgaag

SEQ ID NO: 180865 - DNA, 25 bp, Rattus norvegicus
atccatcgccctctggctaagaagg

SEQ ID NO: 180866 - DNA, 25 bp, Rattus norvegicus
atccatcgccctgtggctaagaagg

SEQ ID NO: 180867 - DNA, 25 bp, Rattus norvegicus
atccatcgtggaacgtgagctggaa

SEQ ID NO: 180868 - DNA, 25 bp, Rattus norvegicus
atccatcgtggatcgtgagctggaa

SEQ ID NO: 180869 - DNA, 25 bp, Rattus norvegicus
atccatctatgtcccatctgaaggt

SEQ ID NO: 180870 - DNA, 25 bp, Rattus norvegicus
atccatctatgtgccatctgaaggt

SEQ ID NO: 180871 - DNA, 25 bp, Rattus norvegicus
atccatctctttcccatagttttgg

SEQ ID NO: 180872 - DNA, 25 bp, Rattus norvegicus
atccatctctttgccatagttttgg

SEQ ID NO: 180873 - DNA, 25 bp, Rattus norvegicus
atccatctgcttatctgtactattg

SEQ ID NO: 180874 - DNA, 25 bp, Rattus norvegicus
atccatctgcttttctgtactattg

SEQ ID NO: 180875 - DNA, 25 bp, Rattus norvegicus
atccatctgttgagaccaagtgaag

SEQ ID NO: 180876 - DNA, 25 bp, Rattus norvegicus
atccatctgttgtgaccaagtgaag

SEQ ID NO: 180877 - DNA, 25 bp, Rattus norvegicus
atccatcttccaaacagacctgagg

SEQ ID NO: 180878 - DNA, 25 bp, Rattus norvegicus
atccatcttccatacagacctgagg

SEQ ID NO: 180879 - DNA, 25 bp, Rattus norvegicus
atccatcttgggaagacctggccta

SEQ ID NO: 180880 - DNA, 25 bp, Rattus norvegicus
atccatcttgggtagacctggccta

SEQ ID NO: 180881 - DNA, 25 bp, Rattus norvegicus
atccatcttttcagcttcttgtata

SEQ ID NO: 180882 - DNA, 25 bp, Rattus norvegicus
atccatcttttctgcttcttgtata

SEQ ID NO: 180883 - DNA, 25 bp, Rattus norvegicus
atccatgaagttaccccactggagg

SEQ ID NO: 180884 - DNA, 25 bp, Rattus norvegicus
atccatgaagtttccccactggagg

SEQ ID NO: 180885 - DNA, 25 bp, Rattus norvegicus
atccatgaatctctctgaccctgaa

SEQ ID NO: 180886 - DNA, 25 bp, Rattus norvegicus
atccatgaatctgtctgaccctgaa

SEQ ID NO: 180887 - DNA, 25 bp, Rattus norvegicus
atccatgaatggactcgtgctctac

SEQ ID NO: 180888 - DNA, 25 bp, Rattus norvegicus
atccatgaatggtctcgtgctctac

SEQ ID NO: 180889 - DNA, 25 bp, Rattus norvegicus
atccatgaattacgcaaacgtttac

SEQ ID NO: 180890 - DNA, 25 bp, Rattus norvegicus
atccatgaattaggcaaacgtttac

SEQ ID NO: 180891 - DNA, 25 bp, Rattus norvegicus
atccatgacctcaagctaaaaggcg

SEQ ID NO: 180892 - DNA, 25 bp, Rattus norvegicus
atccatgacctctagctaaaaggcg

SEQ ID NO: 180893 - DNA, 25 bp, Rattus norvegicus
atccatgagcatcgcttcacgcatg

SEQ ID NO: 180894 - DNA, 25 bp, Rattus norvegicus
atccatgagcatggcttcacgcatg

SEQ ID NO: 180895 - DNA, 25 bp, Rattus norvegicus
atccatgaggatctctatgaggaaa

SEQ ID NO: 180896 - DNA, 25 bp, Rattus norvegicus
atccatgaggatgtctatgaggaaa

SEQ ID NO: 180897 - DNA, 25 bp, Rattus norvegicus
atccatgcagatatgggttgtcccg

SEQ ID NO: 180898 - DNA, 25 bp, Rattus norvegicus
atccatgcagatttgggttgtcccg

SEQ ID NO: 180899 - DNA, 25 bp, Rattus norvegicus
atccatgcatatatgtttagcctac

SEQ ID NO: 180900 - DNA, 25 bp, Rattus norvegicus
atccatgcatatttgtttagcctac

SEQ ID NO: 180901 - DNA, 25 bp, Rattus norvegicus
atccatgccaacctgtctatagaaa

SEQ ID NO: 180902 - DNA, 25 bp, Rattus norvegicus
atccatgccaacgtgtctatagaaa

SEQ ID NO: 180903 - DNA, 25 bp, Rattus norvegicus
atccatgccgacacaaagttgtaag

SEQ ID NO: 180904 - DNA, 25 bp, Rattus norvegicus
atccatgccgactcaaagttgtaag

SEQ ID NO: 180905 - DNA, 25 bp, Rattus norvegicus
atccatgctactcagattatagtct

SEQ ID NO: 180906 - DNA, 25 bp, Rattus norvegicus
atccatgctactgagattatagtct

SEQ ID NO: 180907 - DNA, 25 bp, Rattus norvegicus
atccatgctggcactagaggaagct

SEQ ID NO: 180908 - DNA, 25 bp, Rattus norvegicus
atccatgctggctctagaggaagct

SEQ ID NO: 180909 - DNA, 25 bp, Rattus norvegicus
atccatgcttcccactaacaaatga

SEQ ID NO: 180910 - DNA, 25 bp, Rattus norvegicus
atccatgcttccgactaacaaatga

SEQ ID NO: 180911 - DNA, 25 bp, Rattus norvegicus
atccatgctttaaccacccagggaa

SEQ ID NO: 180912 - DNA, 25 bp, Rattus norvegicus
atccatgctttatccacccagggaa

SEQ ID NO: 180913 - DNA, 25 bp, Rattus norvegicus
atccatggaggaacatacagcttta

SEQ ID NO: 180914 - DNA, 25 bp, Rattus norvegicus
atccatggaggatcatacagcttta

SEQ ID NO: 180915 - DNA, 25 bp, Rattus norvegicus
atccatggatccagaatttcccagg

SEQ ID NO: 180916 - DNA, 25 bp, Rattus norvegicus
atccatggatcctgaatttcccagg

SEQ ID NO: 180917 - DNA, 25 bp, Rattus norvegicus
atccatggcctcatttaaccttagt

SEQ ID NO: 180918 - DNA, 25 bp, Rattus norvegicus
atccatggcctcttttaaccttagt

SEQ ID NO: 180919 - DNA, 25 bp, Rattus norvegicus
atccatggccttcttatgcttcaaa

SEQ ID NO: 180920 - DNA, 25 bp, Rattus norvegicus
atccatggccttgttatgcttcaaa

SEQ ID NO: 180921 - DNA, 25 bp, Rattus norvegicus
atccatgggagaagccgcttcgtga

SEQ ID NO: 180922 - DNA, 25 bp, Rattus norvegicus
atccatgggagatgccgcttcgtga

SEQ ID NO: 180923 - DNA, 25 bp, Rattus norvegicus
atccatgggagccaaaagcctttgc

SEQ ID NO: 180924 - DNA, 25 bp, Rattus norvegicus
atccatgggagcctacaggatctcc

SEQ ID NO: 180925 - DNA, 25 bp, Rattus norvegicus
atccatgggagcgaaaagcctttgc

SEQ ID NO: 180926 - DNA, 25 bp, Rattus norvegicus
atccatgggagcgtacaggatctcc

SEQ ID NO: 180927 - DNA, 25 bp, Rattus norvegicus
atccatggtgttactgattgtgaat

SEQ ID NO: 180928 - DNA, 25 bp, Rattus norvegicus
atccatggtgtttctgattgtgaat

SEQ ID NO: 180929 - DNA, 25 bp, Rattus norvegicus
atccatgtacacctctatgcttatt

SEQ ID NO: 180930 - DNA, 25 bp, Rattus norvegicus
atccatgtacacgtctatgcttatt

SEQ ID NO: 180931 - DNA, 25 bp, Rattus norvegicus
atccatgtactaacaagctcgttta

SEQ ID NO: 180932 - DNA, 25 bp, Rattus norvegicus
atccatgtactatcaagctcgttta

SEQ ID NO: 180933 - DNA, 25 bp, Rattus norvegicus
atccatgtattcactctgggagtca

SEQ ID NO: 180934 - DNA, 25 bp, Rattus norvegicus
atccatgtattctctctgggagtca

SEQ ID NO: 180935 - DNA, 25 bp, Rattus norvegicus
atccatgtcaggaacagtgctcaca

SEQ ID NO: 180936 - DNA, 25 bp, Rattus norvegicus
atccatgtcaggaggtccacagcta

SEQ ID NO: 180937 - DNA, 25 bp, Rattus norvegicus
atccatgtcaggtacagtgctcaca

SEQ ID NO: 180938 - DNA, 25 bp, Rattus norvegicus
atccatgtcaggtggtccacagcta

SEQ ID NO: 180939 - DNA, 25 bp, Rattus norvegicus
atccatgtctgtctagggttggcct

SEQ ID NO: 180940 - DNA, 25 bp, Rattus norvegicus
atccatgtctgtgtagggttggcct

SEQ ID NO: 180941 - DNA, 25 bp, Rattus norvegicus
atccatgtggcaccacgtgaccaaa

SEQ ID NO: 180942 - DNA, 25 bp, Rattus norvegicus
atccatgtggcagcacgtgaccaaa

SEQ ID NO: 180943 - DNA, 25 bp, Rattus norvegicus
atccatgttcgaatttctcaaaact

SEQ ID NO: 180944 - DNA, 25 bp, Rattus norvegicus
atccatgttcgattttctcaaaact

SEQ ID NO: 180945 - DNA, 25 bp, Rattus norvegicus
atccatgttggactaagactttgaa

SEQ ID NO: 180946 - DNA, 25 bp, Rattus norvegicus
atccatgttggagtaagactttgaa

SEQ ID NO: 180947 - DNA, 25 bp, Rattus norvegicus
atccatgtttggaaagccccaccct

SEQ ID NO: 180948 - DNA, 25 bp, Rattus norvegicus
atccatgtttggtaagccccaccct

SEQ ID NO: 180949 - DNA, 25 bp, Rattus norvegicus
atccattaaagcatcggcatcgttt

SEQ ID NO: 180950 - DNA, 25 bp, Rattus norvegicus
atccattaaagcttcggcatcgttt

SEQ ID NO: 180951 - DNA, 25 bp, Rattus norvegicus
atccattatgtaacctaggccagcc

SEQ ID NO: 180952 - DNA, 25 bp, Rattus norvegicus
atccattatgtatcctaggccagcc

SEQ ID NO: 180953 - DNA, 25 bp, Rattus norvegicus
atccattattttatccttcatatca

SEQ ID NO: 180954 - DNA, 25 bp, Rattus norvegicus
atccattattttttccttcatatca

SEQ ID NO: 180955 - DNA, 25 bp, Rattus norvegicus
atccattcaaagagactgtcccaat

SEQ ID NO: 180956 - DNA, 25 bp, Rattus norvegicus
atccattcaaagtgactgtcccaat

SEQ ID NO: 180957 - DNA, 25 bp, Rattus norvegicus
atccattcatccatgctacagtgtg

SEQ ID NO: 180958 - DNA, 25 bp, Rattus norvegicus
atccattcatccttgctacagtgtg

SEQ ID NO: 180959 - DNA, 25 bp, Rattus norvegicus
atccattccaggctgttgggctcaa

SEQ ID NO: 180960 - DNA, 25 bp, Rattus norvegicus
atccattccagggtgttgggctcaa

SEQ ID NO: 180961 - DNA, 25 bp, Rattus norvegicus
atccattctataactcttgttctgc

SEQ ID NO: 180962 - DNA, 25 bp, Rattus norvegicus
atccattctatatctcttgttctgc

SEQ ID NO: 180963 - DNA, 25 bp, Rattus norvegicus
atccattctgaaacactagggagac

SEQ ID NO: 180964 - DNA, 25 bp, Rattus norvegicus
atccattctgaatcactagggagac

SEQ ID NO: 180965 - DNA, 25 bp, Rattus norvegicus
atccattcttccagttcccatttaa

SEQ ID NO: 180966 - DNA, 25 bp, Rattus norvegicus
atccattcttcctgttcccatttaa

SEQ ID NO: 180967 - DNA, 25 bp, Rattus norvegicus
atccattgagttaagccccaaatcc

SEQ ID NO: 180968 - DNA, 25 bp, Rattus norvegicus
atccattgagtttagccccaaatcc

SEQ ID NO: 180969 - DNA, 25 bp, Rattus norvegicus
atccattggattatgttttgctaac

SEQ ID NO: 180970 - DNA, 25 bp, Rattus norvegicus
atccattggattttgttttgctaac

SEQ ID NO: 180971 - DNA, 25 bp, Rattus norvegicus
atccattgtttgcattaccgtgttg

SEQ ID NO: 180972 - DNA, 25 bp, Rattus norvegicus
atccattgtttggattaccgtgttg

SEQ ID NO: 180973 - DNA, 25 bp, Rattus norvegicus
atccatttccagacagtgggttgct

SEQ ID NO: 180974 - DNA, 25 bp, Rattus norvegicus
atccatttccagtcagtgggttgct

SEQ ID NO: 180975 - DNA, 25 bp, Rattus norvegicus
atccatttctataaacctcttcttc

SEQ ID NO: 180976 - DNA, 25 bp, Rattus norvegicus
atccatttctattaacctcttcttc

SEQ ID NO: 180977 - DNA, 25 bp, Rattus norvegicus
atccatttgacccaattctagcctc

SEQ ID NO: 180978 - DNA, 25 bp, Rattus norvegicus
atccatttgaccgaattctagcctc

SEQ ID NO: 180979 - DNA, 25 bp, Rattus norvegicus
atccatttgcttaatgtcatccgtt

SEQ ID NO: 180980 - DNA, 25 bp, Rattus norvegicus
atccatttgctttatgtcatccgtt

SEQ ID NO: 180981 - DNA, 25 bp, Rattus norvegicus
atccattttactacaaagcagccag

SEQ ID NO: 180982 - DNA, 25 bp, Rattus norvegicus
atccattttacttcaaagcagccag

SEQ ID NO: 180983 - DNA, 25 bp, Rattus norvegicus
atccattttctcaggaggtgtccaa

SEQ ID NO: 180984 - DNA, 25 bp, Rattus norvegicus
atccattttctctggaggtgtccaa

SEQ ID NO: 180985 - DNA, 25 bp, Rattus norvegicus
atccattttctgattcatctctaca

SEQ ID NO: 180986 - DNA, 25 bp, Rattus norvegicus
atccattttctgtttcatctctaca

SEQ ID NO: 180987 - DNA, 25 bp, Rattus norvegicus
atccattttggaccctgttcagacc

SEQ ID NO: 180988 - DNA, 25 bp, Rattus norvegicus
atccattttggagcctgttcagacc

SEQ ID NO: 180989 - DNA, 25 bp, Rattus norvegicus
atccatttttgcctttgcggctgga

SEQ ID NO: 180990 - DNA, 25 bp, Rattus norvegicus
atccatttttgcgtttgcggctgga

SEQ ID NO: 180991 - DNA, 25 bp, Rattus norvegicus
atcccaaagatcaagctgtgagagc

SEQ ID NO: 180992 - DNA, 25 bp, Rattus norvegicus
atcccaaagatctagctgtgagagc

SEQ ID NO: 180993 - DNA, 25 bp, Rattus norvegicus
atcccaacaataacctatctgtcta

SEQ ID NO: 180994 - DNA, 25 bp, Rattus norvegicus
atcccaacaatatcctatctgtcta

SEQ ID NO: 180995 - DNA, 25 bp, Rattus norvegicus
atcccaacacctagaagttctactt

SEQ ID NO: 180996 - DNA, 25 bp, Rattus norvegicus
atcccaacaccttgaagttctactt

SEQ ID NO: 180997 - DNA, 25 bp, Rattus norvegicus
atcccaacactcagtatggtagcag

SEQ ID NO: 180998 - DNA, 25 bp, Rattus norvegicus
atcccaacactctgtatggtagcag

SEQ ID NO: 180999 - DNA, 25 bp, Rattus norvegicus
atcccaaccagacgtggcacacttg

SEQ ID NO: 181000 - DNA, 25 bp, Rattus norvegicus
atcccaaccagaggtggcacacttg

SEQ ID NO: 181001 - DNA, 25 bp, Rattus norvegicus
atcccaactggacgtgcagcactgg

SEQ ID NO: 181002 - DNA, 25 bp, Rattus norvegicus
atcccaactggaggtgcagcactgg

SEQ ID NO: 181003 - DNA, 25 bp, Rattus norvegicus
atcccaactgtcagaggagtcggaa

SEQ ID NO: 181004 - DNA, 25 bp, Rattus norvegicus
atcccaactgtctgaggagtcggaa

SEQ ID NO: 181005 - DNA, 25 bp, Rattus norvegicus
atcccaagaaatagtgcggctcagc

SEQ ID NO: 181006 - DNA, 25 bp, Rattus norvegicus
atcccaagaaattgtgcggctcagc

SEQ ID NO: 181007 - DNA, 25 bp, Rattus norvegicus
atcccaagagatccaacaccttttg

SEQ ID NO: 181008 - DNA, 25 bp, Rattus norvegicus
atcccaagagatgcaacaccttttg

SEQ ID NO: 181009 - DNA, 25 bp, Rattus norvegicus
atcccaagagttccagagtccgtga

SEQ ID NO: 181010 - DNA, 25 bp, Rattus norvegicus
atcccaagagttgcagagtccgtga

SEQ ID NO: 181011 - DNA, 25 bp, Rattus norvegicus
atcccaagcacaaggccttattttc

SEQ ID NO: 181012 - DNA, 25 bp, Rattus norvegicus
atcccaagcacatggccttattttc

SEQ ID NO: 181013 - DNA, 25 bp, Rattus norvegicus
atcccaagcagtacccttctggagt

SEQ ID NO: 181014 - DNA, 25 bp, Rattus norvegicus
atcccaagcagttcccttctggagt

SEQ ID NO: 181015 - DNA, 25 bp, Rattus norvegicus
atcccaaggccgaggcagtgtaact

SEQ ID NO: 181016 - DNA, 25 bp, Rattus norvegicus
atcccaaggccgtggcagtgtaact

SEQ ID NO: 181017 - DNA, 25 bp, Rattus norvegicus
atcccaagggtcataatggcagctg

SEQ ID NO: 181018 - DNA, 25 bp, Rattus norvegicus
atcccaagggtcttaatggcagctg

SEQ ID NO: 181019 - DNA, 25 bp, Rattus norvegicus
atcccaatacacagttttgtccttg

SEQ ID NO: 181020 - DNA, 25 bp, Rattus norvegicus
atcccaatacactgttttgtccttg

SEQ ID NO: 181021 - DNA, 25 bp, Rattus norvegicus
atcccaatcagtatgttcctctaaa

SEQ ID NO: 181022 - DNA, 25 bp, Rattus norvegicus
atcccaatcagtttgttcctctaaa

SEQ ID NO: 181023 - DNA, 25 bp, Rattus norvegicus
atcccaatctctaatacccatttca

SEQ ID NO: 181024 - DNA, 25 bp, Rattus norvegicus
atcccaatctcttatacccatttca

SEQ ID NO: 181025 - DNA, 25 bp, Rattus norvegicus
atcccaatctggcttgacaggcctg

SEQ ID NO: 181026 - DNA, 25 bp, Rattus norvegicus
atcccaatctgggttgacaggcctg

SEQ ID NO: 181027 - DNA, 25 bp, Rattus norvegicus
atcccaatgctgcagaattgccact

SEQ ID NO: 181028 - DNA, 25 bp, Rattus norvegicus
atcccaatgctggagaattgccact

SEQ ID NO: 181029 - DNA, 25 bp, Rattus norvegicus
atcccaatttgaccctgtcactgaa

SEQ ID NO: 181030 - DNA, 25 bp, Rattus norvegicus
atcccaatttgagcctgtcactgaa

SEQ ID NO: 181031 - DNA, 25 bp, Rattus norvegicus
atcccacaaaagacaggcgccattc

SEQ ID NO: 181032 - DNA, 25 bp, Rattus norvegicus
atcccacaaaagtcaggcgccattc

SEQ ID NO: 181033 - DNA, 25 bp, Rattus norvegicus
atcccacagtcaaagctgttctgtt

SEQ ID NO: 181034 - DNA, 25 bp, Rattus norvegicus
atcccacagtcatagctgttctgtt

SEQ ID NO: 181035 - DNA, 25 bp, Rattus norvegicus
atcccacagtgcaccttgttagaag

SEQ ID NO: 181036 - DNA, 25 bp, Rattus norvegicus
atcccacagtgctccttgttagaag

SEQ ID NO: 181037 - DNA, 25 bp, Rattus norvegicus
atcccacatcagatgtgcgttggtg

SEQ ID NO: 181038 - DNA, 25 bp, Rattus norvegicus
atcccacatcagttgtgcgttggtg

SEQ ID NO: 181039 - DNA, 25 bp, Rattus norvegicus
atcccacatcctcagttcgttttat

SEQ ID NO: 181040 - DNA, 25 bp, Rattus norvegicus
atcccacatcctgagttcgttttat

SEQ ID NO: 181041 - DNA, 25 bp, Rattus norvegicus
atcccacatgttacgatggcgacgt

SEQ ID NO: 181042 - DNA, 25 bp, Rattus norvegicus
atcccacatgtttcgatggcgacgt

SEQ ID NO: 181043 - DNA, 25 bp, Rattus norvegicus
atcccaccaaaactcgaggcgctgt

SEQ ID NO: 181044 - DNA, 25 bp, Rattus norvegicus
atcccaccaaaagtcgaggcgctgt

SEQ ID NO: 181045 - DNA, 25 bp, Rattus norvegicus
atcccaccacaacgtatatctgtag

SEQ ID NO: 181046 - DNA, 25 bp, Rattus norvegicus
atcccaccacaaggtatatctgtag

SEQ ID NO: 181047 - DNA, 25 bp, Rattus norvegicus
atcccaccacacacactggtatata

SEQ ID NO: 181048 - DNA, 25 bp, Rattus norvegicus
atcccaccacactcactggtatata

SEQ ID NO: 181049 - DNA, 25 bp, Rattus norvegicus
atcccaccattaccctgtaaacaag

SEQ ID NO: 181050 - DNA, 25 bp, Rattus norvegicus
atcccaccattagcctgtaaacaag

SEQ ID NO: 181051 - DNA, 25 bp, Rattus norvegicus
atcccaccctttacagtggctgtgg

SEQ ID NO: 181052 - DNA, 25 bp, Rattus norvegicus
atcccacccttttcagtggctgtgg

SEQ ID NO: 181053 - DNA, 25 bp, Rattus norvegicus
atcccaccgggaagcagcaacggag

SEQ ID NO: 181054 - DNA, 25 bp, Rattus norvegicus
atcccaccgggatgcagcaacggag

SEQ ID NO: 181055 - DNA, 25 bp, Rattus norvegicus
atcccacctgcacattcttgcatat

SEQ ID NO: 181056 - DNA, 25 bp, Rattus norvegicus
atcccacctgcagattcttgcatat

SEQ ID NO: 181057 - DNA, 25 bp, Rattus norvegicus
atcccacgaccccacagtgaaggag

SEQ ID NO: 181058 - DNA, 25 bp, Rattus norvegicus
atcccacgacccgacagtgaaggag

SEQ ID NO: 181059 - DNA, 25 bp, Rattus norvegicus
atcccacgagcccacatgataaaag

SEQ ID NO: 181060 - DNA, 25 bp, Rattus norvegicus
atcccacgagccgacatgataaaag

SEQ ID NO: 181061 - DNA, 25 bp, Rattus norvegicus
atcccacgcaaacccgcattgaatt

SEQ ID NO: 181062 - DNA, 25 bp, Rattus norvegicus
atcccacgcaaagccgcattgaatt

SEQ ID NO: 181063 - DNA, 25 bp, Rattus norvegicus
atcccacgggtcctaacaatcgtag

SEQ ID NO: 181064 - DNA, 25 bp, Rattus norvegicus
atcccacgggtcgtaacaatcgtag

SEQ ID NO: 181065 - DNA, 25 bp, Rattus norvegicus
atcccacgtcgactcattggcgaag

SEQ ID NO: 181066 - DNA, 25 bp, Rattus norvegicus
atcccacgtcgagtcattggcgaag

SEQ ID NO: 181067 - DNA, 25 bp, Rattus norvegicus
atcccacgttagatgacctgacact

SEQ ID NO: 181068 - DNA, 25 bp, Rattus norvegicus
atcccacgttagttgacctgacact

SEQ ID NO: 181069 - DNA, 25 bp, Rattus norvegicus
atcccactactgagcacatactaga

SEQ ID NO: 181070 - DNA, 25 bp, Rattus norvegicus
atcccactactgtgcacatactaga

SEQ ID NO: 181071 - DNA, 25 bp, Rattus norvegicus
atcccactatgtcttatgttcctca

SEQ ID NO: 181072 - DNA, 25 bp, Rattus norvegicus
atcccactatgtgttatgttcctca

SEQ ID NO: 181073 - DNA, 25 bp, Rattus norvegicus
atcccactcatcctgacgaatgaca

SEQ ID NO: 181074 - DNA, 25 bp, Rattus norvegicus
atcccactcatcgtgacgaatgaca

SEQ ID NO: 181075 - DNA, 25 bp, Rattus norvegicus
atcccactccatagggttagagcct

SEQ ID NO: 181076 - DNA, 25 bp, Rattus norvegicus
atcccactccattgggttagagcct

SEQ ID NO: 181077 - DNA, 25 bp, Rattus norvegicus
atcccactgagcagggcctgggcgt

SEQ ID NO: 181078 - DNA, 25 bp, Rattus norvegicus
atcccactgagctgggcctgggcgt

SEQ ID NO: 181079 - DNA, 25 bp, Rattus norvegicus
atcccactgtaaaagatctggtctt

SEQ ID NO: 181080 - DNA, 25 bp, Rattus norvegicus
atcccactgtaatagatctggtctt

SEQ ID NO: 181081 - DNA, 25 bp, Rattus norvegicus
atcccactgtggatatctccttaac

SEQ ID NO: 181082 - DNA, 25 bp, Rattus norvegicus
atcccactgtggttatctccttaac

SEQ ID NO: 181083 - DNA, 25 bp, Rattus norvegicus
atcccacttacaactacaaccaatg

SEQ ID NO: 181084 - DNA, 25 bp, Rattus norvegicus
atcccacttacatctacaaccaatg

SEQ ID NO: 181085 - DNA, 25 bp, Rattus norvegicus
atcccacttgtgaataaaatcgcta

SEQ ID NO: 181086 - DNA, 25 bp, Rattus norvegicus
atcccacttgtgtataaaatcgcta

SEQ ID NO: 181087 - DNA, 25 bp, Rattus norvegicus
atcccacttttcatctggtgtgact

SEQ ID NO: 181088 - DNA, 25 bp, Rattus norvegicus
atcccacttttcttctggtgtgact

SEQ ID NO: 181089 - DNA, 25 bp, Rattus norvegicus
atcccagagcagaggacagggcttt

SEQ ID NO: 181090 - DNA, 25 bp, Rattus norvegicus
atcccagagcagtggacagggcttt

SEQ ID NO: 181091 - DNA, 25 bp, Rattus norvegicus
atcccagagctgagctgactgagag

SEQ ID NO: 181092 - DNA, 25 bp, Rattus norvegicus
atcccagagctgctggcgacgagca

SEQ ID NO: 181093 - DNA, 25 bp, Rattus norvegicus
atcccagagctggtggcgacgagca

SEQ ID NO: 181094 - DNA, 25 bp, Rattus norvegicus
atcccagagctgtgctgactgagag

SEQ ID NO: 181095 - DNA, 25 bp, Rattus norvegicus
atcccagaggaacgtgttagagtct

SEQ ID NO: 181096 - DNA, 25 bp, Rattus norvegicus
atcccagaggaaggtgttagagtct

SEQ ID NO: 181097 - DNA, 25 bp, Rattus norvegicus
atcccagaggtacaatttgccaatg

SEQ ID NO: 181098 - DNA, 25 bp, Rattus norvegicus
atcccagaggtagaatttgccaatg

SEQ ID NO: 181099 - DNA, 25 bp, Rattus norvegicus
atcccagagtccagttctacctaga

SEQ ID NO: 181100 - DNA, 25 bp, Rattus norvegicus
atcccagagtcctgttctacctaga

SEQ ID NO: 181101 - DNA, 25 bp, Rattus norvegicus
atcccagatcaccagctgatgagtg

SEQ ID NO: 181102 - DNA, 25 bp, Rattus norvegicus
atcccagatcacgagctgatgagtg

SEQ ID NO: 181103 - DNA, 25 bp, Rattus norvegicus
atcccagcaagaaccagttaccaga

SEQ ID NO: 181104 - DNA, 25 bp, Rattus norvegicus
atcccagcaagatccagttaccaga

SEQ ID NO: 181105 - DNA, 25 bp, Rattus norvegicus
atcccagcactgatgaagactttct

SEQ ID NO: 181106 - DNA, 25 bp, Rattus norvegicus
atcccagcactgatgtagcacagca

SEQ ID NO: 181107 - DNA, 25 bp, Rattus norvegicus
atcccagcactgttgaagactttct

SEQ ID NO: 181108 - DNA, 25 bp, Rattus norvegicus
atcccagcactgttgtagcacagca

SEQ ID NO: 181109 - DNA, 25 bp, Rattus norvegicus
atcccagccaggagaccattacttt

SEQ ID NO: 181110 - DNA, 25 bp, Rattus norvegicus
atcccagccaggtgaccattacttt

SEQ ID NO: 181111 - DNA, 25 bp, Rattus norvegicus
atcccagccccacgtaagctgatta

SEQ ID NO: 181112 - DNA, 25 bp, Rattus norvegicus
atcccagccccaggtaagctgatta

SEQ ID NO: 181113 - DNA, 25 bp, Rattus norvegicus
atcccagcgccaacgtagacaataa

SEQ ID NO: 181114 - DNA, 25 bp, Rattus norvegicus
atcccagcgccatcgtagacaataa

SEQ ID NO: 181115 - DNA, 25 bp, Rattus norvegicus
atcccagcgtggacgtgatgatgaa

SEQ ID NO: 181116 - DNA, 25 bp, Rattus norvegicus
atcccagcgtggtcgtgatgatgaa

SEQ ID NO: 181117 - DNA, 25 bp, Rattus norvegicus
atcccagctcctagcggaagcacat

SEQ ID NO: 181118 - DNA, 25 bp, Rattus norvegicus
atcccagctccttgcggaagcacat

SEQ ID NO: 181119 - DNA, 25 bp, Rattus norvegicus
atcccagctctgagaactgctgttg

SEQ ID NO: 181120 - DNA, 25 bp, Rattus norvegicus
atcccagctctgtgaactgctgttg

SEQ ID NO: 181121 - DNA, 25 bp, Rattus norvegicus
atcccagctgctagtcctaagttgg

SEQ ID NO: 181122 - DNA, 25 bp, Rattus norvegicus
atcccagctgcttgtcctaagttgg

SEQ ID NO: 181123 - DNA, 25 bp, Rattus norvegicus
atcccagcttggcaaggagctctgg

SEQ ID NO: 181124 - DNA, 25 bp, Rattus norvegicus
atcccagcttgggaaggagctctgg

SEQ ID NO: 181125 - DNA, 25 bp, Rattus norvegicus
atcccaggactcagtgaacagagac

SEQ ID NO: 181126 - DNA, 25 bp, Rattus norvegicus
atcccaggactctgtgaacagagac

SEQ ID NO: 181127 - DNA, 25 bp, Rattus norvegicus
atcccaggatggctttggactccct

SEQ ID NO: 181128 - DNA, 25 bp, Rattus norvegicus
atcccaggatgggtttggactccct

SEQ ID NO: 181129 - DNA, 25 bp, Rattus norvegicus
atcccaggatgtacggacttggctc

SEQ ID NO: 181130 - DNA, 25 bp, Rattus norvegicus
atcccaggatgttcggacttggctc

SEQ ID NO: 181131 - DNA, 25 bp, Rattus norvegicus
atcccaggcataaccgttgacaatg

SEQ ID NO: 181132 - DNA, 25 bp, Rattus norvegicus
atcccaggcatatccgttgacaatg

SEQ ID NO: 181133 - DNA, 25 bp, Rattus norvegicus
atcccaggcgctatcagagtgagta

SEQ ID NO: 181134 - DNA, 25 bp, Rattus norvegicus
atcccaggcgctttcagagtgagta

SEQ ID NO: 181135 - DNA, 25 bp, Rattus norvegicus
atcccaggctatactccagagtgag

SEQ ID NO: 181136 - DNA, 25 bp, Rattus norvegicus
atcccaggctattctccagagtgag

SEQ ID NO: 181137 - DNA, 25 bp, Rattus norvegicus
atcccaggctcacacattacacaag

SEQ ID NO: 181138 - DNA, 25 bp, Rattus norvegicus
atcccaggctcagacattacacaag

SEQ ID NO: 181139 - DNA, 25 bp, Rattus norvegicus
atcccaggctccatgtctgaagtgc

SEQ ID NO: 181140 - DNA, 25 bp, Rattus norvegicus
atcccaggctccttgtctgaagtgc

SEQ ID NO: 181141 - DNA, 25 bp, Rattus norvegicus
atcccaggctgtacctgagggcagt

SEQ ID NO: 181142 - DNA, 25 bp, Rattus norvegicus
atcccaggctgttcctgagggcagt

SEQ ID NO: 181143 - DNA, 25 bp, Rattus norvegicus
atcccagggcatatggtctgaacca

SEQ ID NO: 181144 - DNA, 25 bp, Rattus norvegicus
atcccagggcatttggtctgaacca

SEQ ID NO: 181145 - DNA, 25 bp, Rattus norvegicus
atcccagggtctacaacatccacag

SEQ ID NO: 181146 - DNA, 25 bp, Rattus norvegicus
atcccagggtcttcaacatccacag

SEQ ID NO: 181147 - DNA, 25 bp, Rattus norvegicus
atcccagggtttcccatgaatagcc

SEQ ID NO: 181148 - DNA, 25 bp, Rattus norvegicus
atcccagggtttgccatgaatagcc

SEQ ID NO: 181149 - DNA, 25 bp, Rattus norvegicus
atcccaggtctaaagccacaagttt

SEQ ID NO: 181150 - DNA, 25 bp, Rattus norvegicus
atcccaggtctatagccacaagttt

SEQ ID NO: 181151 - DNA, 25 bp, Rattus norvegicus
atcccaggtctgaatctcagttcca

SEQ ID NO: 181152 - DNA, 25 bp, Rattus norvegicus
atcccaggtctgtatctcagttcca

SEQ ID NO: 181153 - DNA, 25 bp, Rattus norvegicus
atcccagtacctctgcaatggtgaa

SEQ ID NO: 181154 - DNA, 25 bp, Rattus norvegicus
atcccagtacctgtgcaatggtgaa

SEQ ID NO: 181155 - DNA, 25 bp, Rattus norvegicus
atcccagtattgacccagtagtcag

SEQ ID NO: 181156 - DNA, 25 bp, Rattus norvegicus
atcccagtattgtcccagtagtcag

SEQ ID NO: 181157 - DNA, 25 bp, Rattus norvegicus
atcccagtcagaagccgtgctgtac

SEQ ID NO: 181158 - DNA, 25 bp, Rattus norvegicus
atcccagtcagatgccgtgctgtac

SEQ ID NO: 181159 - DNA, 25 bp, Rattus norvegicus
atcccagtccaacggctcttgagga

SEQ ID NO: 181160 - DNA, 25 bp, Rattus norvegicus
atcccagtccaagggctcttgagga

SEQ ID NO: 181161 - DNA, 25 bp, Rattus norvegicus
atcccagtcccacgcatcaattaag

SEQ ID NO: 181162 - DNA, 25 bp, Rattus norvegicus
atcccagtcccaggcatcaattaag

SEQ ID NO: 181163 - DNA, 25 bp, Rattus norvegicus
atcccagtcctactggtgcacacag

SEQ ID NO: 181164 - DNA, 25 bp, Rattus norvegicus
atcccagtcctagtggtgcacacag

SEQ ID NO: 181165 - DNA, 25 bp, Rattus norvegicus
atcccagtgcatcttactacagttc

SEQ ID NO: 181166 - DNA, 25 bp, Rattus norvegicus
atcccagtgcatgttactacagttc

SEQ ID NO: 181167 - DNA, 25 bp, Rattus norvegicus
atcccagtgctcaaggctgaagctg

SEQ ID NO: 181168 - DNA, 25 bp, Rattus norvegicus
atcccagtgctctaggctgaagctg

SEQ ID NO: 181169 - DNA, 25 bp, Rattus norvegicus
atcccagtggcaaagttcaccaagt

SEQ ID NO: 181170 - DNA, 25 bp, Rattus norvegicus
atcccagtggcatagttcaccaagt

SEQ ID NO: 181171 - DNA, 25 bp, Rattus norvegicus
atcccagtgggccttttttgacagc

SEQ ID NO: 181172 - DNA, 25 bp, Rattus norvegicus
atcccagtgggcgttttttgacagc

SEQ ID NO: 181173 - DNA, 25 bp, Rattus norvegicus
atcccagtgtggactgctcatggat

SEQ ID NO: 181174 - DNA, 25 bp, Rattus norvegicus
atcccagtgtggtctgctcatggat

SEQ ID NO: 181175 - DNA, 25 bp, Rattus norvegicus
atcccagttctacccaagatctaac

SEQ ID NO: 181176 - DNA, 25 bp, Rattus norvegicus
atcccagttctagccaagatctaac

SEQ ID NO: 181177 - DNA, 25 bp, Rattus norvegicus
atcccagttcttcccattatcggaa

SEQ ID NO: 181178 - DNA, 25 bp, Rattus norvegicus
atcccagttcttgccattatcggaa

SEQ ID NO: 181179 - DNA, 25 bp, Rattus norvegicus
atcccagttggaacataccaggcta

SEQ ID NO: 181180 - DNA, 25 bp, Rattus norvegicus
atcccagttggacacgatctttctt

SEQ ID NO: 181181 - DNA, 25 bp, Rattus norvegicus
atcccagttggagacgatctttctt

SEQ ID NO: 181182 - DNA, 25 bp, Rattus norvegicus
atcccagttggatcataccaggcta

SEQ ID NO: 181183 - DNA, 25 bp, Rattus norvegicus
atcccagttggtcctatctgttaac

SEQ ID NO: 181184 - DNA, 25 bp, Rattus norvegicus
atcccagttggtgctatctgttaac

SEQ ID NO: 181185 - DNA, 25 bp, Rattus norvegicus
atcccagttgtaacttgagcatccc

SEQ ID NO: 181186 - DNA, 25 bp, Rattus norvegicus
atcccagttgtatcttgagcatccc

SEQ ID NO: 181187 - DNA, 25 bp, Rattus norvegicus
atcccataaaaaacctccattccag

SEQ ID NO: 181188 - DNA, 25 bp, Rattus norvegicus
atcccataaaaatcctccattccag

SEQ ID NO: 181189 - DNA, 25 bp, Rattus norvegicus
atcccataattgactgttcacccgc

SEQ ID NO: 181190 - DNA, 25 bp, Rattus norvegicus
atcccataattgtctgttcacccgc

SEQ ID NO: 181191 - DNA, 25 bp, Rattus norvegicus
atcccatacctacgtttgatcctgc

SEQ ID NO: 181192 - DNA, 25 bp, Rattus norvegicus
atcccatacctaggtttgatcctgc

SEQ ID NO: 181193 - DNA, 25 bp, Rattus norvegicus
atcccatataacatttgcccactgt

SEQ ID NO: 181194 - DNA, 25 bp, Rattus norvegicus
atcccatataacttttgcccactgt

SEQ ID NO: 181195 - DNA, 25 bp, Rattus norvegicus
atcccatatggcagggcagtgttaa

SEQ ID NO: 181196 - DNA, 25 bp, Rattus norvegicus
atcccatatggctgggcagtgttaa

SEQ ID NO: 181197 - DNA, 25 bp, Rattus norvegicus
atcccatcaacaccttcactaaatt

SEQ ID NO: 181198 - DNA, 25 bp, Rattus norvegicus
atcccatcaacagcttcactaaatt

SEQ ID NO: 181199 - DNA, 25 bp, Rattus norvegicus
atcccatcactgatagttatccctg

SEQ ID NO: 181200 - DNA, 25 bp, Rattus norvegicus
atcccatcactgttagttatccctg

SEQ ID NO: 181201 - DNA, 25 bp, Rattus norvegicus
atcccatcgagtatctagcatctta

SEQ ID NO: 181202 - DNA, 25 bp, Rattus norvegicus
atcccatcgagtttctagcatctta

SEQ ID NO: 181203 - DNA, 25 bp, Rattus norvegicus
atcccatctacacaactaggctgag

SEQ ID NO: 181204 - DNA, 25 bp, Rattus norvegicus
atcccatctacagaactaggctgag

SEQ ID NO: 181205 - DNA, 25 bp, Rattus norvegicus
atcccatctcccactaaactgacaa

SEQ ID NO: 181206 - DNA, 25 bp, Rattus norvegicus
atcccatctccctctaaactgacaa

SEQ ID NO: 181207 - DNA, 25 bp, Rattus norvegicus
atcccatctgctagaagaccatcag

SEQ ID NO: 181208 - DNA, 25 bp, Rattus norvegicus
atcccatctgcttgaagaccatcag

SEQ ID NO: 181209 - DNA, 25 bp, Rattus norvegicus
atcccatctgtaaattctttgctcc

SEQ ID NO: 181210 - DNA, 25 bp, Rattus norvegicus
atcccatctgtatattctttgctcc

SEQ ID NO: 181211 - DNA, 25 bp, Rattus norvegicus
atcccatcttcacgtatacccagaa

SEQ ID NO: 181212 - DNA, 25 bp, Rattus norvegicus
atcccatcttcaggtatacccagaa

SEQ ID NO: 181213 - DNA, 25 bp, Rattus norvegicus
atcccatcttggagtggccagttag

SEQ ID NO: 181214 - DNA, 25 bp, Rattus norvegicus
atcccatcttggtgtggccagttag

SEQ ID NO: 181215 - DNA, 25 bp, Rattus norvegicus
atcccatgagcgaatgtgacctccg

SEQ ID NO: 181216 - DNA, 25 bp, Rattus norvegicus
atcccatgagcgtatgtgacctccg

SEQ ID NO: 181217 - DNA, 25 bp, Rattus norvegicus
atcccatgatccataggtcctctta

SEQ ID NO: 181218 - DNA, 25 bp, Rattus norvegicus
atcccatgatccttaggtcctctta

SEQ ID NO: 181219 - DNA, 25 bp, Rattus norvegicus
atcccatgccatcaagattacctat

SEQ ID NO: 181220 - DNA, 25 bp, Rattus norvegicus
atcccatgccatgaagattacctat

SEQ ID NO: 181221 - DNA, 25 bp, Rattus norvegicus
atcccatgccctcgatgattccaaa

SEQ ID NO: 181222 - DNA, 25 bp, Rattus norvegicus
atcccatgccctggatgattccaaa

SEQ ID NO: 181223 - DNA, 25 bp, Rattus norvegicus
atcccatgggtgacttctgaggcat

SEQ ID NO: 181224 - DNA, 25 bp, Rattus norvegicus
atcccatgggtgtcttctgaggcat

SEQ ID NO: 181225 - DNA, 25 bp, Rattus norvegicus
atcccatgtactaggttctaagcat

SEQ ID NO: 181226 - DNA, 25 bp, Rattus norvegicus
atcccatgtacttggttctaagcat

SEQ ID NO: 181227 - DNA, 25 bp, Rattus norvegicus
atcccatgtcctcaccatgaagaga

SEQ ID NO: 181228 - DNA, 25 bp, Rattus norvegicus
atcccatgtcctgaccatgaagaga

SEQ ID NO: 181229 - DNA, 25 bp, Rattus norvegicus
atcccattacacatgtggttgctgg

SEQ ID NO: 181230 - DNA, 25 bp, Rattus norvegicus
atcccattacacttgtggttgctgg

SEQ ID NO: 181231 - DNA, 25 bp, Rattus norvegicus
atcccattacgtatttcattgcctg

SEQ ID NO: 181232 - DNA, 25 bp, Rattus norvegicus
atcccattacgtttttcattgcctg

SEQ ID NO: 181233 - DNA, 25 bp, Rattus norvegicus
atcccattagctctgtgcactcaga

SEQ ID NO: 181234 - DNA, 25 bp, Rattus norvegicus
atcccattagctgtgtgcactcaga

SEQ ID NO: 181235 - DNA, 25 bp, Rattus norvegicus
atcccattcccacattgcacatttg

SEQ ID NO: 181236 - DNA, 25 bp, Rattus norvegicus
atcccattcccagattgcacatttg

SEQ ID NO: 181237 - DNA, 25 bp, Rattus norvegicus
atcccattccctatagcctggagta

SEQ ID NO: 181238 - DNA, 25 bp, Rattus norvegicus
atcccattccctttagcctggagta

SEQ ID NO: 181239 - DNA, 25 bp, Rattus norvegicus
atcccattggacacacattggtttg

SEQ ID NO: 181240 - DNA, 25 bp, Rattus norvegicus
atcccattggactcacattggtttg

SEQ ID NO: 181241 - DNA, 25 bp, Rattus norvegicus
atcccattggatcctctcatagatg

SEQ ID NO: 181242 - DNA, 25 bp, Rattus norvegicus
atcccattggatgctctcatagatg

SEQ ID NO: 181243 - DNA, 25 bp, Rattus norvegicus
atcccattgtctatttgtgcccaat

SEQ ID NO: 181244 - DNA, 25 bp, Rattus norvegicus
atcccattgtctttttgtgcccaat

SEQ ID NO: 181245 - DNA, 25 bp, Rattus norvegicus
atcccattgtttcttttagattcgt

SEQ ID NO: 181246 - DNA, 25 bp, Rattus norvegicus
atcccattgtttgttttagattcgt

SEQ ID NO: 181247 - DNA, 25 bp, Rattus norvegicus
atcccatttagtacggtaagtcagc

SEQ ID NO: 181248 - DNA, 25 bp, Rattus norvegicus
atcccatttagttcggtaagtcagc

SEQ ID NO: 181249 - DNA, 25 bp, Rattus norvegicus
atcccatttctgagtcccaaggttt

SEQ ID NO: 181250 - DNA, 25 bp, Rattus norvegicus
atcccatttctgtgtcccaaggttt

SEQ ID NO: 181251 - DNA, 25 bp, Rattus norvegicus
atcccatttttcatcctgatctatt

SEQ ID NO: 181252 - DNA, 25 bp, Rattus norvegicus
atcccatttttcttcctgatctatt

SEQ ID NO: 181253 - DNA, 25 bp, Rattus norvegicus
atccccaaactgatggccgctgttg

SEQ ID NO: 181254 - DNA, 25 bp, Rattus norvegicus
atccccaaactgttggccgctgttg

SEQ ID NO: 181255 - DNA, 25 bp, Rattus norvegicus
atccccaaagcgagccgtgtaaagc

SEQ ID NO: 181256 - DNA, 25 bp, Rattus norvegicus
atccccaaagcgtgccgtgtaaagc

SEQ ID NO: 181257 - DNA, 25 bp, Rattus norvegicus
atccccaaagtcagctggaccaagt

SEQ ID NO: 181258 - DNA, 25 bp, Rattus norvegicus
atccccaaagtctgctggaccaagt

SEQ ID NO: 181259 - DNA, 25 bp, Rattus norvegicus
atccccaaattgagcttttaccaag

SEQ ID NO: 181260 - DNA, 25 bp, Rattus norvegicus
atccccaaattgtgcttttaccaag

SEQ ID NO: 181261 - DNA, 25 bp, Rattus norvegicus
atccccaaccccagtaagtatgatt

SEQ ID NO: 181262 - DNA, 25 bp, Rattus norvegicus
atccccaacccctgtaagtatgatt

SEQ ID NO: 181263 - DNA, 25 bp, Rattus norvegicus
atccccaaccctaagtcatatattt

SEQ ID NO: 181264 - DNA, 25 bp, Rattus norvegicus
atccccaacccttagtcatatattt

SEQ ID NO: 181265 - DNA, 25 bp, Rattus norvegicus
atccccaagaaccagtgtgcactag

SEQ ID NO: 181266 - DNA, 25 bp, Rattus norvegicus
atccccaagaacgagtgtgcactag

SEQ ID NO: 181267 - DNA, 25 bp, Rattus norvegicus
atccccaagacacccatgcagttat

SEQ ID NO: 181268 - DNA, 25 bp, Rattus norvegicus
atccccaagacagccatgcagttat

SEQ ID NO: 181269 - DNA, 25 bp, Rattus norvegicus
atccccaagacccatacattagaac

SEQ ID NO: 181270 - DNA, 25 bp, Rattus norvegicus
atccccaagaccgatacattagaac

SEQ ID NO: 181271 - DNA, 25 bp, Rattus norvegicus
atccccaaggctatttgctttgtag

SEQ ID NO: 181272 - DNA, 25 bp, Rattus norvegicus
atccccaaggctttttgctttgtag

SEQ ID NO: 181273 - DNA, 25 bp, Rattus norvegicus
atccccaagggaattttgcacggct

SEQ ID NO: 181274 - DNA, 25 bp, Rattus norvegicus
atccccaagggatttttgcacggct

SEQ ID NO: 181275 - DNA, 25 bp, Rattus norvegicus
atccccaagggcattgtgcagctgt

SEQ ID NO: 181276 - DNA, 25 bp, Rattus norvegicus
atccccaagggctttgtgcagctgt

SEQ ID NO: 181277 - DNA, 25 bp, Rattus norvegicus
atccccaagtaacccaggacttatg

SEQ ID NO: 181278 - DNA, 25 bp, Rattus norvegicus
atccccaagtaagccaggacttatg

SEQ ID NO: 181279 - DNA, 25 bp, Rattus norvegicus
atccccaagtagatagtttttcagg

SEQ ID NO: 181280 - DNA, 25 bp, Rattus norvegicus
atccccaagtagttagtttttcagg

SEQ ID NO: 181281 - DNA, 25 bp, Rattus norvegicus
atccccaataccatttgcaggtctg

SEQ ID NO: 181282 - DNA, 25 bp, Rattus norvegicus
atccccaataccttttgcaggtctg

SEQ ID NO: 181283 - DNA, 25 bp, Rattus norvegicus
atccccacagaacggaatgatggct

SEQ ID NO: 181284 - DNA, 25 bp, Rattus norvegicus
atccccacagaagggaatgatggct

SEQ ID NO: 181285 - DNA, 25 bp, Rattus norvegicus
atccccaccccaagtgttaagaagg

SEQ ID NO: 181286 - DNA, 25 bp, Rattus norvegicus
atccccaccccatgtgttaagaagg

SEQ ID NO: 181287 - DNA, 25 bp, Rattus norvegicus
atccccaccttcagtggtaggctgt

SEQ ID NO: 181288 - DNA, 25 bp, Rattus norvegicus
atccccaccttctgtggtaggctgt

SEQ ID NO: 181289 - DNA, 25 bp, Rattus norvegicus
atccccactgctctggagttttgag

SEQ ID NO: 181290 - DNA, 25 bp, Rattus norvegicus
atccccactgctgtggagttttgag

SEQ ID NO: 181291 - DNA, 25 bp, Rattus norvegicus
atccccactgtgatttacgagcata

SEQ ID NO: 181292 - DNA, 25 bp, Rattus norvegicus
atccccactgtgttttacgagcata

SEQ ID NO: 181293 - DNA, 25 bp, Rattus norvegicus
atccccacttttcatctttgtgaga

SEQ ID NO: 181294 - DNA, 25 bp, Rattus norvegicus
atccccacttttgatctttgtgaga

SEQ ID NO: 181295 - DNA, 25 bp, Rattus norvegicus
atccccagaaagagcctcctataat

SEQ ID NO: 181296 - DNA, 25 bp, Rattus norvegicus
atccccagaaagtgcctcctataat

SEQ ID NO: 181297 - DNA, 25 bp, Rattus norvegicus
atccccagactcagtgaacttcatt

SEQ ID NO: 181298 - DNA, 25 bp, Rattus norvegicus
atccccagactctgtgaacttcatt

SEQ ID NO: 181299 - DNA, 25 bp, Rattus norvegicus
atccccagagcccaggaggagcgat

SEQ ID NO: 181300 - DNA, 25 bp, Rattus norvegicus
atccccagagccgaggaggagcgat

SEQ ID NO: 181301 - DNA, 25 bp, Rattus norvegicus
atccccagaggcatctttgtctgaa

SEQ ID NO: 181302 - DNA, 25 bp, Rattus norvegicus
atccccagaggcttctttgtctgaa

SEQ ID NO: 181303 - DNA, 25 bp, Rattus norvegicus
atccccagagggaacgtgctgttca

SEQ ID NO: 181304 - DNA, 25 bp, Rattus norvegicus
atccccagagggtacgtgctgttca

SEQ ID NO: 181305 - DNA, 25 bp, Rattus norvegicus
atccccagagttctctgacaggcga

SEQ ID NO: 181306 - DNA, 25 bp, Rattus norvegicus
atccccagagttctctgttttcaca

SEQ ID NO: 181307 - DNA, 25 bp, Rattus norvegicus
atccccagagttgtctgacaggcga

SEQ ID NO: 181308 - DNA, 25 bp, Rattus norvegicus
atccccagagttgtctgttttcaca

SEQ ID NO: 181309 - DNA, 25 bp, Rattus norvegicus
atccccagatatctgctgccaaagc

SEQ ID NO: 181310 - DNA, 25 bp, Rattus norvegicus
atccccagatatgtgctgccaaagc

SEQ ID NO: 181311 - DNA, 25 bp, Rattus norvegicus
atccccagcagtatacctgtcaatg

SEQ ID NO: 181312 - DNA, 25 bp, Rattus norvegicus
atccccagcagtttacctgtcaatg

SEQ ID NO: 181313 - DNA, 25 bp, Rattus norvegicus
atccccagcctcagaccaaggaatg

SEQ ID NO: 181314 - DNA, 25 bp, Rattus norvegicus
atccccagcctctgaccaaggaatg

SEQ ID NO: 181315 - DNA, 25 bp, Rattus norvegicus
atccccagcgggagcagcttgaaaa

SEQ ID NO: 181316 - DNA, 25 bp, Rattus norvegicus
atccccagcgggtgcagcttgaaaa

SEQ ID NO: 181317 - DNA, 25 bp, Rattus norvegicus
atccccagcgtgacagtgagcacgg

SEQ ID NO: 181318 - DNA, 25 bp, Rattus norvegicus
atccccagcgtgtcagtgagcacgg

SEQ ID NO: 181319 - DNA, 25 bp, Rattus norvegicus
atccccaggcagagatgtctaccaa

SEQ ID NO: 181320 - DNA, 25 bp, Rattus norvegicus
atccccaggcagtgatgtctaccaa

SEQ ID NO: 181321 - DNA, 25 bp, Rattus norvegicus
atccccagggaaacaccagttgact

SEQ ID NO: 181322 - DNA, 25 bp, Rattus norvegicus
atccccagggaatcaccagttgact

SEQ ID NO: 181323 - DNA, 25 bp, Rattus norvegicus
atccccagggatagtcgttctagaa

SEQ ID NO: 181324 - DNA, 25 bp, Rattus norvegicus
atccccagggatcgtttattcagac

SEQ ID NO: 181325 - DNA, 25 bp, Rattus norvegicus
atccccagggatggtttattcagac

SEQ ID NO: 181326 - DNA, 25 bp, Rattus norvegicus
atccccagggattgtcgttctagaa

SEQ ID NO: 181327 - DNA, 25 bp, Rattus norvegicus
atccccagggcactatgagaaccag

SEQ ID NO: 181328 - DNA, 25 bp, Rattus norvegicus
atccccagggcagtatgagaaccag

SEQ ID NO: 181329 - DNA, 25 bp, Rattus norvegicus
atccccagtcacagagagtctcgag

SEQ ID NO: 181330 - DNA, 25 bp, Rattus norvegicus
atccccagtcactgagagtctcgag

SEQ ID NO: 181331 - DNA, 25 bp, Rattus norvegicus
atccccagtctcagatgtgcttaaa

SEQ ID NO: 181332 - DNA, 25 bp, Rattus norvegicus
atccccagtctctgatgtgcttaaa

SEQ ID NO: 181333 - DNA, 25 bp, Rattus norvegicus
atccccagtgctaggaacagagcga

SEQ ID NO: 181334 - DNA, 25 bp, Rattus norvegicus
atccccagtgcttggaacagagcga

SEQ ID NO: 181335 - DNA, 25 bp, Rattus norvegicus
atccccagtgtcataatttccaggc

SEQ ID NO: 181336 - DNA, 25 bp, Rattus norvegicus
atccccagtgtcttaatttccaggc

SEQ ID NO: 181337 - DNA, 25 bp, Rattus norvegicus
atccccatagggagacctgcggcag

SEQ ID NO: 181338 - DNA, 25 bp, Rattus norvegicus
atccccatagggtgacctgcggcag

SEQ ID NO: 181339 - DNA, 25 bp, Rattus norvegicus
atccccatctgactcagtacatgta

SEQ ID NO: 181340 - DNA, 25 bp, Rattus norvegicus
atccccatctgagtcagtacatgta

SEQ ID NO: 181341 - DNA, 25 bp, Rattus norvegicus
atccccatctgtccaggagaacaag

SEQ ID NO: 181342 - DNA, 25 bp, Rattus norvegicus
atccccatctgtgcaggagaacaag

SEQ ID NO: 181343 - DNA, 25 bp, Rattus norvegicus
atccccatcttcaggagcaccagga

SEQ ID NO: 181344 - DNA, 25 bp, Rattus norvegicus
atccccatcttctggagcaccagga

SEQ ID NO: 181345 - DNA, 25 bp, Rattus norvegicus
atccccatgatgaaagcagtgcaca

SEQ ID NO: 181346 - DNA, 25 bp, Rattus norvegicus
atccccatgatgaacgaggtatgcc

SEQ ID NO: 181347 - DNA, 25 bp, Rattus norvegicus
atccccatgatgtaagcagtgcaca

SEQ ID NO: 181348 - DNA, 25 bp, Rattus norvegicus
atccccatgatgtacgaggtatgcc

SEQ ID NO: 181349 - DNA, 25 bp, Rattus norvegicus
atccccatgcagattggaatcatcc

SEQ ID NO: 181350 - DNA, 25 bp, Rattus norvegicus
atccccatgcagtttggaatcatcc

SEQ ID NO: 181351 - DNA, 25 bp, Rattus norvegicus
atccccatgctgaacccattaatat

SEQ ID NO: 181352 - DNA, 25 bp, Rattus norvegicus
atccccatgctgtacccattaatat

SEQ ID NO: 181353 - DNA, 25 bp, Rattus norvegicus
atccccatgggtcatttgttctgta

SEQ ID NO: 181354 - DNA, 25 bp, Rattus norvegicus
atccccatgggtgatttgttctgta

SEQ ID NO: 181355 - DNA, 25 bp, Rattus norvegicus
atccccatgtctaacctcatagttg

SEQ ID NO: 181356 - DNA, 25 bp, Rattus norvegicus
atccccatgtcttacctcatagttg

SEQ ID NO: 181357 - DNA, 25 bp, Rattus norvegicus
atccccatgtttctgccagagtcta

SEQ ID NO: 181358 - DNA, 25 bp, Rattus norvegicus
atccccatgtttgtgccagagtcta

SEQ ID NO: 181359 - DNA, 25 bp, Rattus norvegicus
atccccattgctagggactgggagc

SEQ ID NO: 181360 - DNA, 25 bp, Rattus norvegicus
atccccattgcttgggactgggagc

SEQ ID NO: 181361 - DNA, 25 bp, Rattus norvegicus
atcccccatgctcgcgtgagacgtt

SEQ ID NO: 181362 - DNA, 25 bp, Rattus norvegicus
atcccccatgctggcgtgagacgtt

SEQ ID NO: 181363 - DNA, 25 bp, Rattus norvegicus
atccccgagctgactcggagttttg

SEQ ID NO: 181364 - DNA, 25 bp, Rattus norvegicus
atccccgagctgtctcggagttttg

SEQ ID NO: 181365 - DNA, 25 bp, Rattus norvegicus
atccccgagtgtcttataatttaag

SEQ ID NO: 181366 - DNA, 25 bp, Rattus norvegicus
atccccgagtgtgttataatttaag

SEQ ID NO: 181367 - DNA, 25 bp, Rattus norvegicus
atccccgagttgatgagctacccaa

SEQ ID NO: 181368 - DNA, 25 bp, Rattus norvegicus
atccccgagttgttgagctacccaa

SEQ ID NO: 181369 - DNA, 25 bp, Rattus norvegicus
atccccgatgctaagattctgtttt

SEQ ID NO: 181370 - DNA, 25 bp, Rattus norvegicus
atccccgatgcttagattctgtttt

SEQ ID NO: 181371 - DNA, 25 bp, Rattus norvegicus
atccccgcagctcgtagccaagagt

SEQ ID NO: 181372 - DNA, 25 bp, Rattus norvegicus
atccccgcagctggtagccaagagt

SEQ ID NO: 181373 - DNA, 25 bp, Rattus norvegicus
atccccgcgtttactttctgatgta

SEQ ID NO: 181374 - DNA, 25 bp, Rattus norvegicus
atccccgcgttttctttctgatgta

SEQ ID NO: 181375 - DNA, 25 bp, Rattus norvegicus
atccccgctgagctgcttatcttga

SEQ ID NO: 181376 - DNA, 25 bp, Rattus norvegicus
atccccgctgaggtgcttatcttga

SEQ ID NO: 181377 - DNA, 25 bp, Rattus norvegicus
atccccggaaccagcgatttgagag

SEQ ID NO: 181378 - DNA, 25 bp, Rattus norvegicus
atccccggaacctgcgatttgagag

SEQ ID NO: 181379 - DNA, 25 bp, Rattus norvegicus
atccccggaatccagtgaacaaaag

SEQ ID NO: 181380 - DNA, 25 bp, Rattus norvegicus
atccccggaatcgagtgaacaaaag

SEQ ID NO: 181381 - DNA, 25 bp, Rattus norvegicus
atccccggacttctctaggcttgta

SEQ ID NO: 181382 - DNA, 25 bp, Rattus norvegicus
atccccggacttgtctaggcttgta

SEQ ID NO: 181383 - DNA, 25 bp, Rattus norvegicus
atccccggattgaaagctcctcagg

SEQ ID NO: 181384 - DNA, 25 bp, Rattus norvegicus
atccccggattgtaagctcctcagg

SEQ ID NO: 181385 - DNA, 25 bp, Rattus norvegicus
atccccggcacgaggcggccttata

SEQ ID NO: 181386 - DNA, 25 bp, Rattus norvegicus
atccccggcacgtggcggccttata

SEQ ID NO: 181387 - DNA, 25 bp, Rattus norvegicus
atccccggctccagaggagtcaggg

SEQ ID NO: 181388 - DNA, 25 bp, Rattus norvegicus
atccccggctcctgaggagtcaggg

SEQ ID NO: 181389 - DNA, 25 bp, Rattus norvegicus
atccccggtggaaggcaagattacg

SEQ ID NO: 181390 - DNA, 25 bp, Rattus norvegicus
atccccggtggatggcaagattacg

SEQ ID NO: 181391 - DNA, 25 bp, Rattus norvegicus
atccccgtatacctgtgtaagctgt

SEQ ID NO: 181392 - DNA, 25 bp, Rattus norvegicus
atccccgtatacgtgtgtaagctgt

SEQ ID NO: 181393 - DNA, 25 bp, Rattus norvegicus
atccccgtctttccattttttcatg

SEQ ID NO: 181394 - DNA, 25 bp, Rattus norvegicus
atccccgtctttgcattttttcatg

SEQ ID NO: 181395 - DNA, 25 bp, Rattus norvegicus
atccccgtgagcagagagaacccta

SEQ ID NO: 181396 - DNA, 25 bp, Rattus norvegicus
atccccgtgagctgagagaacccta

SEQ ID NO: 181397 - DNA, 25 bp, Rattus norvegicus
atccccgtttctagttgtaggcgat

SEQ ID NO: 181398 - DNA, 25 bp, Rattus norvegicus
atccccgtttcttgttgtaggcgat

SEQ ID NO: 181399 - DNA, 25 bp, Rattus norvegicus
atcccctacacacatgcactttaag

SEQ ID NO: 181400 - DNA, 25 bp, Rattus norvegicus
atcccctacacagatgcactttaag

SEQ ID NO: 181401 - DNA, 25 bp, Rattus norvegicus
atcccctacttgaggataccttgtg

SEQ ID NO: 181402 - DNA, 25 bp, Rattus norvegicus
atcccctacttgtggataccttgtg

SEQ ID NO: 181403 - DNA, 25 bp, Rattus norvegicus
atcccctagataccaaggcccagag

SEQ ID NO: 181404 - DNA, 25 bp, Rattus norvegicus
atcccctagatagcaaggcccagag

SEQ ID NO: 181405 - DNA, 25 bp, Rattus norvegicus
atcccctatttaagtcaccaagtgc

SEQ ID NO: 181406 - DNA, 25 bp, Rattus norvegicus
atcccctatttatgtcaccaagtgc

SEQ ID NO: 181407 - DNA, 25 bp, Rattus norvegicus
atcccctcaaggagctacagggcct

SEQ ID NO: 181408 - DNA, 25 bp, Rattus norvegicus
atcccctcaaggtgctacagggcct

SEQ ID NO: 181409 - DNA, 25 bp, Rattus norvegicus
atcccctcagcactgctactaagag

SEQ ID NO: 181410 - DNA, 25 bp, Rattus norvegicus
atcccctcagcagtgctactaagag

SEQ ID NO: 181411 - DNA, 25 bp, Rattus norvegicus
atcccctcaggactctttagactgt

SEQ ID NO: 181412 - DNA, 25 bp, Rattus norvegicus
atcccctcaggagtctttagactgt

SEQ ID NO: 181413 - DNA, 25 bp, Rattus norvegicus
atcccctccaaaaagccagtggctg

SEQ ID NO: 181414 - DNA, 25 bp, Rattus norvegicus
atcccctccaaatagccagtggctg

SEQ ID NO: 181415 - DNA, 25 bp, Rattus norvegicus
atcccctccttaactacatgagttt

SEQ ID NO: 181416 - DNA, 25 bp, Rattus norvegicus
atcccctccttatctacatgagttt

SEQ ID NO: 181417 - DNA, 25 bp, Rattus norvegicus
atcccctcgtgaagactgcgacttg

SEQ ID NO: 181418 - DNA, 25 bp, Rattus norvegicus
atcccctcgtgatgactgcgacttg

SEQ ID NO: 181419 - DNA, 25 bp, Rattus norvegicus
atcccctgaagtcgttacctgttca

SEQ ID NO: 181420 - DNA, 25 bp, Rattus norvegicus
atcccctgaagtggttacctgttca

SEQ ID NO: 181421 - DNA, 25 bp, Rattus norvegicus
atcccctgcctgagagtttgaaaat

SEQ ID NO: 181422 - DNA, 25 bp, Rattus norvegicus
atcccctgcctgtgagtttgaaaat

SEQ ID NO: 181423 - DNA, 25 bp, Rattus norvegicus
atcccctgcttcaaacatggtgact

SEQ ID NO: 181424 - DNA, 25 bp, Rattus norvegicus
atcccctgcttctaacatggtgact

SEQ ID NO: 181425 - DNA, 25 bp, Rattus norvegicus
atcccctggaggagagcaaatagca

SEQ ID NO: 181426 - DNA, 25 bp, Rattus norvegicus
atcccctggaggtgagcaaatagca

SEQ ID NO: 181427 - DNA, 25 bp, Rattus norvegicus
atcccctggagtaaagagttacaca

SEQ ID NO: 181428 - DNA, 25 bp, Rattus norvegicus
atcccctggagttaagagttacaca

SEQ ID NO: 181429 - DNA, 25 bp, Rattus norvegicus
atcccctggcttccagaaaatccag

SEQ ID NO: 181430 - DNA, 25 bp, Rattus norvegicus
atcccctggcttgcagaaaatccag

SEQ ID NO: 181431 - DNA, 25 bp, Rattus norvegicus
atccccttacataagcctttcaaat

SEQ ID NO: 181432 - DNA, 25 bp, Rattus norvegicus
atccccttacattagcctttcaaat

SEQ ID NO: 181433 - DNA, 25 bp, Rattus norvegicus
atccccttaggtcgttgtactgcag

SEQ ID NO: 181434 - DNA, 25 bp, Rattus norvegicus
atccccttaggtggttgtactgcag

SEQ ID NO: 181435 - DNA, 25 bp, Rattus norvegicus
atccccttctgtccacattgttgaa

SEQ ID NO: 181436 - DNA, 25 bp, Rattus norvegicus
atccccttctgtgcacattgttgaa

SEQ ID NO: 181437 - DNA, 25 bp, Rattus norvegicus
atccccttgggactagtgttataca

SEQ ID NO: 181438 - DNA, 25 bp, Rattus norvegicus
atccccttgggagtagtgttataca

SEQ ID NO: 181439 - DNA, 25 bp, Rattus norvegicus
atccccttgtacagaacttttccat

SEQ ID NO: 181440 - DNA, 25 bp, Rattus norvegicus
atccccttgtactgaacttttccat

SEQ ID NO: 181441 - DNA, 25 bp, Rattus norvegicus
atcccctttactagtctgcttgtgg

SEQ ID NO: 181442 - DNA, 25 bp, Rattus norvegicus
atcccctttacttgtctgcttgtgg

SEQ ID NO: 181443 - DNA, 25 bp, Rattus norvegicus
atcccgaagagcatgttttcaggac

SEQ ID NO: 181444 - DNA, 25 bp, Rattus norvegicus
atcccgaagagcttgttttcaggac

SEQ ID NO: 181445 - DNA, 25 bp, Rattus norvegicus
atcccgacttggaagattccacctt

SEQ ID NO: 181446 - DNA, 25 bp, Rattus norvegicus
atcccgacttggtagattccacctt

SEQ ID NO: 181447 - DNA, 25 bp, Rattus norvegicus
atcccgaggcgacagcgagctctgc

SEQ ID NO: 181448 - DNA, 25 bp, Rattus norvegicus
atcccgaggcgagagcgagctctgc

SEQ ID NO: 181449 - DNA, 25 bp, Rattus norvegicus
atcccgatccctaaacagatgttac

SEQ ID NO: 181450 - DNA, 25 bp, Rattus norvegicus
atcccgatcccttaacagatgttac

SEQ ID NO: 181451 - DNA, 25 bp, Rattus norvegicus
atcccgatggcaagagctacagcag

SEQ ID NO: 181452 - DNA, 25 bp, Rattus norvegicus
atcccgatggcatgagctacagcag

SEQ ID NO: 181453 - DNA, 25 bp, Rattus norvegicus
atcccgatgtggaacccagtcctga

SEQ ID NO: 181454 - DNA, 25 bp, Rattus norvegicus
atcccgatgtggtacccagtcctga

SEQ ID NO: 181455 - DNA, 25 bp, Rattus norvegicus
atcccgcagacgctaccttctgtat

SEQ ID NO: 181456 - DNA, 25 bp, Rattus norvegicus
atcccgcagacggtaccttctgtat

SEQ ID NO: 181457 - DNA, 25 bp, Rattus norvegicus
atcccgcagcagagacctagtattt

SEQ ID NO: 181458 - DNA, 25 bp, Rattus norvegicus
atcccgcagcagtgacctagtattt

SEQ ID NO: 181459 - DNA, 25 bp, Rattus norvegicus
atcccgcatgaccagagcaactttg

SEQ ID NO: 181460 - DNA, 25 bp, Rattus norvegicus
atcccgcatgacgagagcaactttg

SEQ ID NO: 181461 - DNA, 25 bp, Rattus norvegicus
atcccgcccaaacagcctgtgataa

SEQ ID NO: 181462 - DNA, 25 bp, Rattus norvegicus
atcccgcccaaagagcctgtgataa

SEQ ID NO: 181463 - DNA, 25 bp, Rattus norvegicus
atcccgcccaacaagaaagtcagca

SEQ ID NO: 181464 - DNA, 25 bp, Rattus norvegicus
atcccgcccaactagaaagtcagca

SEQ ID NO: 181465 - DNA, 25 bp, Rattus norvegicus
atcccgccccaaaacataggtgatg

SEQ ID NO: 181466 - DNA, 25 bp, Rattus norvegicus
atcccgccccaatacataggtgatg

SEQ ID NO: 181467 - DNA, 25 bp, Rattus norvegicus
atcccgcgtttacttttggcatcat

SEQ ID NO: 181468 - DNA, 25 bp, Rattus norvegicus
atcccgcgtttagttttggcatcat

SEQ ID NO: 181469 - DNA, 25 bp, Rattus norvegicus
atcccgctcctgctttagagaggat

SEQ ID NO: 181470 - DNA, 25 bp, Rattus norvegicus
atcccgctcctggtttagagaggat

SEQ ID NO: 181471 - DNA, 25 bp, Rattus norvegicus
atcccgctgaagaagatgcttagtt

SEQ ID NO: 181472 - DNA, 25 bp, Rattus norvegicus
atcccgctgaagtagatgcttagtt

SEQ ID NO: 181473 - DNA, 25 bp, Rattus norvegicus
atcccgctgacaacacgtggatatt

SEQ ID NO: 181474 - DNA, 25 bp, Rattus norvegicus
atcccgctgacatcacgtggatatt

SEQ ID NO: 181475 - DNA, 25 bp, Rattus norvegicus
atcccgctgatcagattagaatgaa

SEQ ID NO: 181476 - DNA, 25 bp, Rattus norvegicus
atcccgctgatctgattagaatgaa

SEQ ID NO: 181477 - DNA, 25 bp, Rattus norvegicus
atcccggagaagctggagccgttct

SEQ ID NO: 181478 - DNA, 25 bp, Rattus norvegicus
atcccggagaaggtggagccgttct

SEQ ID NO: 181479 - DNA, 25 bp, Rattus norvegicus
atcccggaggacaaaattgcctcaa

SEQ ID NO: 181480 - DNA, 25 bp, Rattus norvegicus
atcccggaggactaaattgcctcaa

SEQ ID NO: 181481 - DNA, 25 bp, Rattus norvegicus
atcccggatactcttatggcatctt

SEQ ID NO: 181482 - DNA, 25 bp, Rattus norvegicus
atcccggatactgttatggcatctt

SEQ ID NO: 181483 - DNA, 25 bp, Rattus norvegicus
atcccggcatgcagcagcggcgtgg

SEQ ID NO: 181484 - DNA, 25 bp, Rattus norvegicus
atcccggcatgctgcagcggcgtgg

SEQ ID NO: 181485 - DNA, 25 bp, Rattus norvegicus
atcccggcgctacaagtacaacttt

SEQ ID NO: 181486 - DNA, 25 bp, Rattus norvegicus
atcccggcgctagaagtacaacttt

SEQ ID NO: 181487 - DNA, 25 bp, Rattus norvegicus
atcccggctccactggacacaaaga

SEQ ID NO: 181488 - DNA, 25 bp, Rattus norvegicus
atcccggctccagtggacacaaaga

SEQ ID NO: 181489 - DNA, 25 bp, Rattus norvegicus
atcccgggagcaaaaactctcttgc

SEQ ID NO: 181490 - DNA, 25 bp, Rattus norvegicus
atcccgggagcataaactctcttgc

SEQ ID NO: 181491 - DNA, 25 bp, Rattus norvegicus
atcccgggtcagctggtccgtaatg

SEQ ID NO: 181492 - DNA, 25 bp, Rattus norvegicus
atcccgggtcaggtggtccgtaatg

SEQ ID NO: 181493 - DNA, 25 bp, Rattus norvegicus
atcccggtagcaccatcgcaggcgt

SEQ ID NO: 181494 - DNA, 25 bp, Rattus norvegicus
atcccggtagcagcatcgcaggcgt

SEQ ID NO: 181495 - DNA, 25 bp, Rattus norvegicus
atcccggtgacaatgaggctgcttc

SEQ ID NO: 181496 - DNA, 25 bp, Rattus norvegicus
atcccggtgacattgaggctgcttc

SEQ ID NO: 181497 - DNA, 25 bp, Rattus norvegicus
atcccgtcagagcagcaggcacata

SEQ ID NO: 181498 - DNA, 25 bp, Rattus norvegicus
atcccgtcagaggagcaggcacata

SEQ ID NO: 181499 - DNA, 25 bp, Rattus norvegicus
atcccgtcagccagcaacagtaaat

SEQ ID NO: 181500 - DNA, 25 bp, Rattus norvegicus
atcccgtcagcctgcaacagtaaat

SEQ ID NO: 181501 - DNA, 25 bp, Rattus norvegicus
atcccgtccagtctctgatcgaagg

SEQ ID NO: 181502 - DNA, 25 bp, Rattus norvegicus
atcccgtccagtgtctgatcgaagg

SEQ ID NO: 181503 - DNA, 25 bp, Rattus norvegicus
atcccgtcccatagctttattattc

SEQ ID NO: 181504 - DNA, 25 bp, Rattus norvegicus
atcccgtcccattgctttattattc

SEQ ID NO: 181505 - DNA, 25 bp, Rattus norvegicus
atcccgtccttgcttgggacttaga

SEQ ID NO: 181506 - DNA, 25 bp, Rattus norvegicus
atcccgtccttggttgggacttaga

SEQ ID NO: 181507 - DNA, 25 bp, Rattus norvegicus
atcccgtctggaagtatcgatgcca

SEQ ID NO: 181508 - DNA, 25 bp, Rattus norvegicus
atcccgtctggatgtatcgatgcca

SEQ ID NO: 181509 - DNA, 25 bp, Rattus norvegicus
atcccgtctgtcacgtcagtgaaca

SEQ ID NO: 181510 - DNA, 25 bp, Rattus norvegicus
atcccgtctgtctcgtcagtgaaca

SEQ ID NO: 181511 - DNA, 25 bp, Rattus norvegicus
atcccgtgacgcatttgtccagtgc

SEQ ID NO: 181512 - DNA, 25 bp, Rattus norvegicus
atcccgtgacgcttttgtccagtgc

SEQ ID NO: 181513 - DNA, 25 bp, Rattus norvegicus
atcccgtgagggagacagcctgtgc

SEQ ID NO: 181514 - DNA, 25 bp, Rattus norvegicus
atcccgtgagggtgacagcctgtgc

SEQ ID NO: 181515 - DNA, 25 bp, Rattus norvegicus
atcccgttctccatgatcagaatga

SEQ ID NO: 181516 - DNA, 25 bp, Rattus norvegicus
atcccgttctccttgatcagaatga

SEQ ID NO: 181517 - DNA, 25 bp, Rattus norvegicus
atcccgttggacctcatgatgtgct

SEQ ID NO: 181518 - DNA, 25 bp, Rattus norvegicus
atcccgttggacgtcatgatgtgct

SEQ ID NO: 181519 - DNA, 25 bp, Rattus norvegicus
atcccgttggatcatcccggagcca

SEQ ID NO: 181520 - DNA, 25 bp, Rattus norvegicus
atcccgttggatgatcccggagcca

SEQ ID NO: 181521 - DNA, 25 bp, Rattus norvegicus
atccctaaccttcactttgcttaag

SEQ ID NO: 181522 - DNA, 25 bp, Rattus norvegicus
atccctaaccttgactttgcttaag

SEQ ID NO: 181523 - DNA, 25 bp, Rattus norvegicus
atccctaagttacagcccagcctgg

SEQ ID NO: 181524 - DNA, 25 bp, Rattus norvegicus
atccctaagttagagcccagcctgg

SEQ ID NO: 181525 - DNA, 25 bp, Rattus norvegicus
atccctaccactagcttatagcagt

SEQ ID NO: 181526 - DNA, 25 bp, Rattus norvegicus
atccctaccacttgcttatagcagt

SEQ ID NO: 181527 - DNA, 25 bp, Rattus norvegicus
atccctacccggaatgtctgcgttg

SEQ ID NO: 181528 - DNA, 25 bp, Rattus norvegicus
atccctacccggtatgtctgcgttg

SEQ ID NO: 181529 - DNA, 25 bp, Rattus norvegicus
atccctactctgatagttcgtctat

SEQ ID NO: 181530 - DNA, 25 bp, Rattus norvegicus
atccctactctgttagttcgtctat

SEQ ID NO: 181531 - DNA, 25 bp, Rattus norvegicus
atccctactgtgaaatgtgttcctt

SEQ ID NO: 181532 - DNA, 25 bp, Rattus norvegicus
atccctactgtgtaatgtgttcctt

SEQ ID NO: 181533 - DNA, 25 bp, Rattus norvegicus
atccctaggaggctcaggcaggcca

SEQ ID NO: 181534 - DNA, 25 bp, Rattus norvegicus
atccctaggagggtcaggcaggcca

SEQ ID NO: 181535 - DNA, 25 bp, Rattus norvegicus
atccctaggagtcacgaaagcgtct

SEQ ID NO: 181536 - DNA, 25 bp, Rattus norvegicus
atccctaggagtgacgaaagcgtct

SEQ ID NO: 181537 - DNA, 25 bp, Rattus norvegicus
atccctatcatacttcaagtgcatg

SEQ ID NO: 181538 - DNA, 25 bp, Rattus norvegicus
atccctatcatagttcaagtgcatg

SEQ ID NO: 181539 - DNA, 25 bp, Rattus norvegicus
atccctatgcataaagtgcttcttc

SEQ ID NO: 181540 - DNA, 25 bp, Rattus norvegicus
atccctatgcattaagtgcttcttc

SEQ ID NO: 181541 - DNA, 25 bp, Rattus norvegicus
atccctattgtgaaatcctgggtca

SEQ ID NO: 181542 - DNA, 25 bp, Rattus norvegicus
atccctattgtgtaatcctgggtca

SEQ ID NO: 181543 - DNA, 25 bp, Rattus norvegicus
atccctcaaagacctcaaacagttt

SEQ ID NO: 181544 - DNA, 25 bp, Rattus norvegicus
atccctcaaagagctcaaacagttt

SEQ ID NO: 181545 - DNA, 25 bp, Rattus norvegicus
atccctcaagtcagacagtcatcac

SEQ ID NO: 181546 - DNA, 25 bp, Rattus norvegicus
atccctcaagtctgacagtcatcac

SEQ ID NO: 181547 - DNA, 25 bp, Rattus norvegicus
atccctcaatatctggcaactctgt

SEQ ID NO: 181548 - DNA, 25 bp, Rattus norvegicus
atccctcaatatgtggcaactctgt

SEQ ID NO: 181549 - DNA, 25 bp, Rattus norvegicus
atccctcacatccattattttttct

SEQ ID NO: 181550 - DNA, 25 bp, Rattus norvegicus
atccctcacatcgattattttttct

SEQ ID NO: 181551 - DNA, 25 bp, Rattus norvegicus
atccctcacgatcttgtctcatgca

SEQ ID NO: 181552 - DNA, 25 bp, Rattus norvegicus
atccctcacgatgttgtctcatgca

SEQ ID NO: 181553 - DNA, 25 bp, Rattus norvegicus
atccctcagagcctgaaggagcttt

SEQ ID NO: 181554 - DNA, 25 bp, Rattus norvegicus
atccctcagagcgtgaaggagcttt

SEQ ID NO: 181555 - DNA, 25 bp, Rattus norvegicus
atccctcaggccatttctcaggaag

SEQ ID NO: 181556 - DNA, 25 bp, Rattus norvegicus
atccctcaggccttttctcaggaag

SEQ ID NO: 181557 - DNA, 25 bp, Rattus norvegicus
atccctcagggacctcagcatgttt

SEQ ID NO: 181558 - DNA, 25 bp, Rattus norvegicus
atccctcagggagctcagcatgttt

SEQ ID NO: 181559 - DNA, 25 bp, Rattus norvegicus
atccctcaggtaaaagccacggctg

SEQ ID NO: 181560 - DNA, 25 bp, Rattus norvegicus
atccctcaggtataagccacggctg

SEQ ID NO: 181561 - DNA, 25 bp, Rattus norvegicus
atccctcaggttctagcgtacaaag

SEQ ID NO: 181562 - DNA, 25 bp, Rattus norvegicus
atccctcaggttgtagcgtacaaag

SEQ ID NO: 181563 - DNA, 25 bp, Rattus norvegicus
atccctcagtttccccaaagtgaga

SEQ ID NO: 181564 - DNA, 25 bp, Rattus norvegicus
atccctcagtttgcccaaagtgaga

SEQ ID NO: 181565 - DNA, 25 bp, Rattus norvegicus
atccctcataccattgatcgtgact

SEQ ID NO: 181566 - DNA, 25 bp, Rattus norvegicus
atccctcatacctttgatcgtgact

SEQ ID NO: 181567 - DNA, 25 bp, Rattus norvegicus
atccctcatggcctagaactgtgta

SEQ ID NO: 181568 - DNA, 25 bp, Rattus norvegicus
atccctcatggcgtagaactgtgta

SEQ ID NO: 181569 - DNA, 25 bp, Rattus norvegicus
atccctccacagatctggttgttga

SEQ ID NO: 181570 - DNA, 25 bp, Rattus norvegicus
atccctccacagttctggttgttga

SEQ ID NO: 181571 - DNA, 25 bp, Rattus norvegicus
atccctcctgacaggtactggtagt

SEQ ID NO: 181572 - DNA, 25 bp, Rattus norvegicus
atccctcctgactggtactggtagt

SEQ ID NO: 181573 - DNA, 25 bp, Rattus norvegicus
atccctcctggacagatatggtctc

SEQ ID NO: 181574 - DNA, 25 bp, Rattus norvegicus
atccctcctggagagatatggtctc

SEQ ID NO: 181575 - DNA, 25 bp, Rattus norvegicus
atccctcgctgcacacgtattgaga

SEQ ID NO: 181576 - DNA, 25 bp, Rattus norvegicus
atccctcgctgctcacgtattgaga

SEQ ID NO: 181577 - DNA, 25 bp, Rattus norvegicus
atccctctaacgaactgactatgtc

SEQ ID NO: 181578 - DNA, 25 bp, Rattus norvegicus
atccctctaacgtactgactatgtc

SEQ ID NO: 181579 - DNA, 25 bp, Rattus norvegicus
atccctctagatcgccatagcaacg

SEQ ID NO: 181580 - DNA, 25 bp, Rattus norvegicus
atccctctagatggccatagcaacg

SEQ ID NO: 181581 - DNA, 25 bp, Rattus norvegicus
atccctctccttaagcagagtcaaa

SEQ ID NO: 181582 - DNA, 25 bp, Rattus norvegicus
atccctctcctttagcagagtcaaa

SEQ ID NO: 181583 - DNA, 25 bp, Rattus norvegicus
atccctctcgttacagcaggcagta

SEQ ID NO: 181584 - DNA, 25 bp, Rattus norvegicus
atccctctcgtttcagcaggcagta

SEQ ID NO: 181585 - DNA, 25 bp, Rattus norvegicus
atccctctctagcagtttctgtcaa

SEQ ID NO: 181586 - DNA, 25 bp, Rattus norvegicus
atccctctctaggagtttctgtcaa

SEQ ID NO: 181587 - DNA, 25 bp, Rattus norvegicus
atccctctggttatatgcctctaga

SEQ ID NO: 181588 - DNA, 25 bp, Rattus norvegicus
atccctctggttttatgcctctaga

SEQ ID NO: 181589 - DNA, 25 bp, Rattus norvegicus
atccctctgtgtcctgggctgagat

SEQ ID NO: 181590 - DNA, 25 bp, Rattus norvegicus
atccctctgtgtgctgggctgagat

SEQ ID NO: 181591 - DNA, 25 bp, Rattus norvegicus
atccctcttctccatggtgacagga

SEQ ID NO: 181592 - DNA, 25 bp, Rattus norvegicus
atccctcttctcgatggtgacagga

SEQ ID NO: 181593 - DNA, 25 bp, Rattus norvegicus
atccctcttggaaagccctgtgcaa

SEQ ID NO: 181594 - DNA, 25 bp, Rattus norvegicus
atccctcttggatagccctgtgcaa

SEQ ID NO: 181595 - DNA, 25 bp, Rattus norvegicus
atccctgaactcattggacatcgag

SEQ ID NO: 181596 - DNA, 25 bp, Rattus norvegicus
atccctgaactctttggacatcgag

SEQ ID NO: 181597 - DNA, 25 bp, Rattus norvegicus
atccctgaactgcattcactgaagc

SEQ ID NO: 181598 - DNA, 25 bp, Rattus norvegicus
atccctgaactgctggtatctcctt

SEQ ID NO: 181599 - DNA, 25 bp, Rattus norvegicus
atccctgaactggattcactgaagc

SEQ ID NO: 181600 - DNA, 25 bp, Rattus norvegicus
atccctgaactggtggtatctcctt

SEQ ID NO: 181601 - DNA, 25 bp, Rattus norvegicus
atccctgaacttagcattgtctggt

SEQ ID NO: 181602 - DNA, 25 bp, Rattus norvegicus
atccctgaactttgcattgtctggt

SEQ ID NO: 181603 - DNA, 25 bp, Rattus norvegicus
atccctgaataaaactgacctcaag

SEQ ID NO: 181604 - DNA, 25 bp, Rattus norvegicus
atccctgaataatactgacctcaag

SEQ ID NO: 181605 - DNA, 25 bp, Rattus norvegicus
atccctgaattccatccagagacaa

SEQ ID NO: 181606 - DNA, 25 bp, Rattus norvegicus
atccctgaattcgatccagagacaa

SEQ ID NO: 181607 - DNA, 25 bp, Rattus norvegicus
atccctgacacacctatggaactta

SEQ ID NO: 181608 - DNA, 25 bp, Rattus norvegicus
atccctgacacagctatggaactta

SEQ ID NO: 181609 - DNA, 25 bp, Rattus norvegicus
atccctgacaccattaaactactga

SEQ ID NO: 181610 - DNA, 25 bp, Rattus norvegicus
atccctgacacctttaaactactga

SEQ ID NO: 181611 - DNA, 25 bp, Rattus norvegicus
atccctgagacccacctgatagaag

SEQ ID NO: 181612 - DNA, 25 bp, Rattus norvegicus
atccctgagacccatattggaggca

SEQ ID NO: 181613 - DNA, 25 bp, Rattus norvegicus
atccctgagaccgacctgatagaag

SEQ ID NO: 181614 - DNA, 25 bp, Rattus norvegicus
atccctgagaccgatattggaggca

SEQ ID NO: 181615 - DNA, 25 bp, Rattus norvegicus
atccctgagatgaaactgacaatta

SEQ ID NO: 181616 - DNA, 25 bp, Rattus norvegicus
atccctgagatgctgttaactgtaa

SEQ ID NO: 181617 - DNA, 25 bp, Rattus norvegicus
atccctgagatggtgttaactgtaa

SEQ ID NO: 181618 - DNA, 25 bp, Rattus norvegicus
atccctgagatgtaactgacaatta

SEQ ID NO: 181619 - DNA, 25 bp, Rattus norvegicus
atccctgagattagtcattgtacac

SEQ ID NO: 181620 - DNA, 25 bp, Rattus norvegicus
atccctgagatttgtcattgtacac

SEQ ID NO: 181621 - DNA, 25 bp, Rattus norvegicus
atccctgaggaacatgaacgagatg

SEQ ID NO: 181622 - DNA, 25 bp, Rattus norvegicus
atccctgaggaagatgaacgagatg

SEQ ID NO: 181623 - DNA, 25 bp, Rattus norvegicus
atccctgatcagcaggtcggtcaac

SEQ ID NO: 181624 - DNA, 25 bp, Rattus norvegicus
atccctgatcaggaggtcggtcaac

SEQ ID NO: 181625 - DNA, 25 bp, Rattus norvegicus
atccctgattgcaccttggatgcaa

SEQ ID NO: 181626 - DNA, 25 bp, Rattus norvegicus
atccctgattgctccttggatgcaa

SEQ ID NO: 181627 - DNA, 25 bp, Rattus norvegicus
atccctgcacctcagatgagacagg

SEQ ID NO: 181628 - DNA, 25 bp, Rattus norvegicus
atccctgcacctgagatgagacagg

SEQ ID NO: 181629 - DNA, 25 bp, Rattus norvegicus
atccctgcactgcagaggccgagac

SEQ ID NO: 181630 - DNA, 25 bp, Rattus norvegicus
atccctgcactggagaggccgagac

SEQ ID NO: 181631 - DNA, 25 bp, Rattus norvegicus
atccctgcagccaggcagtgctaaa

SEQ ID NO: 181632 - DNA, 25 bp, Rattus norvegicus
atccctgcagcctggcagtgctaaa

SEQ ID NO: 181633 - DNA, 25 bp, Rattus norvegicus
atccctgcattcaacggacactgga

SEQ ID NO: 181634 - DNA, 25 bp, Rattus norvegicus
atccctgcattctacggacactgga

SEQ ID NO: 181635 - DNA, 25 bp, Rattus norvegicus
atccctgcatttatgcaaaggccat

SEQ ID NO: 181636 - DNA, 25 bp, Rattus norvegicus
atccctgcatttttgcaaaggccat

SEQ ID NO: 181637 - DNA, 25 bp, Rattus norvegicus
atccctgcccaaatctggaataggt

SEQ ID NO: 181638 - DNA, 25 bp, Rattus norvegicus
atccctgcccaattctggaataggt

SEQ ID NO: 181639 - DNA, 25 bp, Rattus norvegicus
atccctgcctacacaacatgttgga

SEQ ID NO: 181640 - DNA, 25 bp, Rattus norvegicus
atccctgcctacactggagtctaag

SEQ ID NO: 181641 - DNA, 25 bp, Rattus norvegicus
atccctgcctactcaacatgttgga

SEQ ID NO: 181642 - DNA, 25 bp, Rattus norvegicus
atccctgcctactctggagtctaag

SEQ ID NO: 181643 - DNA, 25 bp, Rattus norvegicus
atccctgcctttcaattccatattt

SEQ ID NO: 181644 - DNA, 25 bp, Rattus norvegicus
atccctgcctttgaattccatattt

SEQ ID NO: 181645 - DNA, 25 bp, Rattus norvegicus
atccctgcggccatgcagaaagcag

SEQ ID NO: 181646 - DNA, 25 bp, Rattus norvegicus
atccctgcggccttgcagaaagcag

SEQ ID NO: 181647 - DNA, 25 bp, Rattus norvegicus
atccctgctgacaagaactacctgt

SEQ ID NO: 181648 - DNA, 25 bp, Rattus norvegicus
atccctgctgactagaactacctgt

SEQ ID NO: 181649 - DNA, 25 bp, Rattus norvegicus
atccctgctgcaaatgtttttacaa

SEQ ID NO: 181650 - DNA, 25 bp, Rattus norvegicus
atccctgctgcatatgtttttacaa

SEQ ID NO: 181651 - DNA, 25 bp, Rattus norvegicus
atccctgctggaagcggcgactgta

SEQ ID NO: 181652 - DNA, 25 bp, Rattus norvegicus
atccctgctggatgcggcgactgta

SEQ ID NO: 181653 - DNA, 25 bp, Rattus norvegicus
atccctgctggccagtcgatacgac

SEQ ID NO: 181654 - DNA, 25 bp, Rattus norvegicus
atccctgctggcgagtcgatacgac

SEQ ID NO: 181655 - DNA, 25 bp, Rattus norvegicus
atccctgctgtgcttttgttggaca

SEQ ID NO: 181656 - DNA, 25 bp, Rattus norvegicus
atccctgctgtggttttgttggaca

SEQ ID NO: 181657 - DNA, 25 bp, Rattus norvegicus
atccctggaagactcacctgataat

SEQ ID NO: 181658 - DNA, 25 bp, Rattus norvegicus
atccctggaagagtcacctgataat

SEQ ID NO: 181659 - DNA, 25 bp, Rattus norvegicus
atccctggacttagtgtgtgctgaa

SEQ ID NO: 181660 - DNA, 25 bp, Rattus norvegicus
atccctggactttgtgtgtgctgaa

SEQ ID NO: 181661 - DNA, 25 bp, Rattus norvegicus
atccctggagccatgcaaggataca

SEQ ID NO: 181662 - DNA, 25 bp, Rattus norvegicus
atccctggagccttgcaaggataca

SEQ ID NO: 181663 - DNA, 25 bp, Rattus norvegicus
atccctggagctctagtgacccatg

SEQ ID NO: 181664 - DNA, 25 bp, Rattus norvegicus
atccctggagctgtagtgacccatg

SEQ ID NO: 181665 - DNA, 25 bp, Rattus norvegicus
atccctggatcccaagagtggtgca

SEQ ID NO: 181666 - DNA, 25 bp, Rattus norvegicus
atccctggatccgaagagtggtgca

SEQ ID NO: 181667 - DNA, 25 bp, Rattus norvegicus
atccctggatctaggcaggaacggt

SEQ ID NO: 181668 - DNA, 25 bp, Rattus norvegicus
atccctggatcttggcaggaacggt

SEQ ID NO: 181669 - DNA, 25 bp, Rattus norvegicus
atccctggatttacagcaccacaat

SEQ ID NO: 181670 - DNA, 25 bp, Rattus norvegicus
atccctggattttcagcaccacaat

SEQ ID NO: 181671 - DNA, 25 bp, Rattus norvegicus
atccctggcatcactcctgagaaag

SEQ ID NO: 181672 - DNA, 25 bp, Rattus norvegicus
atccctggcatctctcctgagaaag

SEQ ID NO: 181673 - DNA, 25 bp, Rattus norvegicus
atccctggcattcgcctggtggcaa

SEQ ID NO: 181674 - DNA, 25 bp, Rattus norvegicus
atccctggcattggcctggtggcaa

SEQ ID NO: 181675 - DNA, 25 bp, Rattus norvegicus
atccctggccctacatagtggtttt

SEQ ID NO: 181676 - DNA, 25 bp, Rattus norvegicus
atccctggcccttcatagtggtttt

SEQ ID NO: 181677 - DNA, 25 bp, Rattus norvegicus
atccctggctgaactgagtggcaca

SEQ ID NO: 181678 - DNA, 25 bp, Rattus norvegicus
atccctggctgatctgagtggcaca

SEQ ID NO: 181679 - DNA, 25 bp, Rattus norvegicus
atccctgggacactcgtggttgaag

SEQ ID NO: 181680 - DNA, 25 bp, Rattus norvegicus
atccctgggacagtcgtggttgaag

SEQ ID NO: 181681 - DNA, 25 bp, Rattus norvegicus
atccctgggatcagttagctcagta

SEQ ID NO: 181682 - DNA, 25 bp, Rattus norvegicus
atccctgggatctgttagctcagta

SEQ ID NO: 181683 - DNA, 25 bp, Rattus norvegicus
atccctgggatgacctttagtgcct

SEQ ID NO: 181684 - DNA, 25 bp, Rattus norvegicus
atccctgggatgtcctttagtgcct

SEQ ID NO: 181685 - DNA, 25 bp, Rattus norvegicus
atccctgggctccattgggtttcag

SEQ ID NO: 181686 - DNA, 25 bp, Rattus norvegicus
atccctgggctcgattgggtttcag

SEQ ID NO: 181687 - DNA, 25 bp, Rattus norvegicus
atccctgggctgctgtttgcatact

SEQ ID NO: 181688 - DNA, 25 bp, Rattus norvegicus
atccctgggctggtgtttgcatact

SEQ ID NO: 181689 - DNA, 25 bp, Rattus norvegicus
atccctgggcttcacagaatggctg

SEQ ID NO: 181690 - DNA, 25 bp, Rattus norvegicus
atccctgggcttgacagaatggctg

SEQ ID NO: 181691 - DNA, 25 bp, Rattus norvegicus
atccctggtaaaatccctacagcta

SEQ ID NO: 181692 - DNA, 25 bp, Rattus norvegicus
atccctggtaaattccctacagcta

SEQ ID NO: 181693 - DNA, 25 bp, Rattus norvegicus
atccctggtcatccagaacagaacc

SEQ ID NO: 181694 - DNA, 25 bp, Rattus norvegicus
atccctggtcatgcagaacagaacc

SEQ ID NO: 181695 - DNA, 25 bp, Rattus norvegicus
atccctggttgtagacaagttctcc

SEQ ID NO: 181696 - DNA, 25 bp, Rattus norvegicus
atccctggttgttgacaagttctcc

SEQ ID NO: 181697 - DNA, 25 bp, Rattus norvegicus
atccctgtaacacatgtgccataat

SEQ ID NO: 181698 - DNA, 25 bp, Rattus norvegicus
atccctgtaacagatgtgccataat

SEQ ID NO: 181699 - DNA, 25 bp, Rattus norvegicus
atccctgtaggtatgttctgctttg

SEQ ID NO: 181700 - DNA, 25 bp, Rattus norvegicus
atccctgtaggtttgttctgctttg

SEQ ID NO: 181701 - DNA, 25 bp, Rattus norvegicus
atccctgtatccatgggcttttcag

SEQ ID NO: 181702 - DNA, 25 bp, Rattus norvegicus
atccctgtatccttgggcttttcag

SEQ ID NO: 181703 - DNA, 25 bp, Rattus norvegicus
atccctgtcagtcggaaagtacaag

SEQ ID NO: 181704 - DNA, 25 bp, Rattus norvegicus
atccctgtcagtgggaaagtacaag

SEQ ID NO: 181705 - DNA, 25 bp, Rattus norvegicus
atccctgtctgtcctattcaacagg

SEQ ID NO: 181706 - DNA, 25 bp, Rattus norvegicus
atccctgtctgtctggtttgctttt

SEQ ID NO: 181707 - DNA, 25 bp, Rattus norvegicus
atccctgtctgtgctattcaacagg

SEQ ID NO: 181708 - DNA, 25 bp, Rattus norvegicus
atccctgtctgtgtggtttgctttt

SEQ ID NO: 181709 - DNA, 25 bp, Rattus norvegicus
atccctgtgcatctgtggtcagttc

SEQ ID NO: 181710 - DNA, 25 bp, Rattus norvegicus
atccctgtgcatgtgtggtcagttc

SEQ ID NO: 181711 - DNA, 25 bp, Rattus norvegicus
atccctgtgcttctactactgataa

SEQ ID NO: 181712 - DNA, 25 bp, Rattus norvegicus
atccctgtgcttgtactactgataa

SEQ ID NO: 181713 - DNA, 25 bp, Rattus norvegicus
atccctgtggtgaacgatgtactcc

SEQ ID NO: 181714 - DNA, 25 bp, Rattus norvegicus
atccctgtggtgtacgatgtactcc

SEQ ID NO: 181715 - DNA, 25 bp, Rattus norvegicus
atccctgtgtccatcactgtgaaga

SEQ ID NO: 181716 - DNA, 25 bp, Rattus norvegicus
atccctgtgtccttcactgtgaaga

SEQ ID NO: 181717 - DNA, 25 bp, Rattus norvegicus
atccctgtgttcaaactggccagac

SEQ ID NO: 181718 - DNA, 25 bp, Rattus norvegicus
atccctgtgttctaactggccagac

SEQ ID NO: 181719 - DNA, 25 bp, Rattus norvegicus
atccctgttaagaggattccttttg

SEQ ID NO: 181720 - DNA, 25 bp, Rattus norvegicus
atccctgttaagtggattccttttg

SEQ ID NO: 181721 - DNA, 25 bp, Rattus norvegicus
atccctgttcagaagactctgcacc

SEQ ID NO: 181722 - DNA, 25 bp, Rattus norvegicus
atccctgttcagtagactctgcacc

SEQ ID NO: 181723 - DNA, 25 bp, Rattus norvegicus
atccctgttgtacctggtgtggaca

SEQ ID NO: 181724 - DNA, 25 bp, Rattus norvegicus
atccctgttgtagctggtgtggaca

SEQ ID NO: 181725 - DNA, 25 bp, Rattus norvegicus
atccctgttgttattaggctacaag

SEQ ID NO: 181726 - DNA, 25 bp, Rattus norvegicus
atccctgttgtttttaggctacaag

SEQ ID NO: 181727 - DNA, 25 bp, Rattus norvegicus
atccctgtttggaatgagcctttgg

SEQ ID NO: 181728 - DNA, 25 bp, Rattus norvegicus
atccctgtttggtatgagcctttgg

SEQ ID NO: 181729 - DNA, 25 bp, Rattus norvegicus
atcccttaagtacagcattgtccgt

SEQ ID NO: 181730 - DNA, 25 bp, Rattus norvegicus
atcccttaagtagagcattgtccgt

SEQ ID NO: 181731 - DNA, 25 bp, Rattus norvegicus
atcccttaccatacatccatgttac

SEQ ID NO: 181732 - DNA, 25 bp, Rattus norvegicus
atcccttaccattcatccatgttac

SEQ ID NO: 181733 - DNA, 25 bp, Rattus norvegicus
atcccttaccttcttgttacatcta

SEQ ID NO: 181734 - DNA, 25 bp, Rattus norvegicus
atcccttaccttgttgttacatcta

SEQ ID NO: 181735 - DNA, 25 bp, Rattus norvegicus
atcccttagctcaatgccagttcta

SEQ ID NO: 181736 - DNA, 25 bp, Rattus norvegicus
atcccttagctctatgccagttcta

SEQ ID NO: 181737 - DNA, 25 bp, Rattus norvegicus
atcccttaggtgaaggtcctgttca

SEQ ID NO: 181738 - DNA, 25 bp, Rattus norvegicus
atcccttaggtgtaggtcctgttca

SEQ ID NO: 181739 - DNA, 25 bp, Rattus norvegicus
atcccttatataaaatggcacacag

SEQ ID NO: 181740 - DNA, 25 bp, Rattus norvegicus
atcccttatatataatggcacacag

SEQ ID NO: 181741 - DNA, 25 bp, Rattus norvegicus
atcccttatcccagagatgacatca

SEQ ID NO: 181742 - DNA, 25 bp, Rattus norvegicus
atcccttatccctgagatgacatca

SEQ ID NO: 181743 - DNA, 25 bp, Rattus norvegicus
atcccttattccacaatgtttgctt

SEQ ID NO: 181744 - DNA, 25 bp, Rattus norvegicus
atcccttattcctcaatgtttgctt

SEQ ID NO: 181745 - DNA, 25 bp, Rattus norvegicus
atcccttcagatagagctcatggtg

SEQ ID NO: 181746 - DNA, 25 bp, Rattus norvegicus
atcccttcagattgagctcatggtg

SEQ ID NO: 181747 - DNA, 25 bp, Rattus norvegicus
atcccttcatccagagctgctgctg

SEQ ID NO: 181748 - DNA, 25 bp, Rattus norvegicus
atcccttcatcctgagctgctgctg

SEQ ID NO: 181749 - DNA, 25 bp, Rattus norvegicus
atcccttcctggagtgtatcaacat

SEQ ID NO: 181750 - DNA, 25 bp, Rattus norvegicus
atcccttcctggtgtgtatcaacat

SEQ ID NO: 181751 - DNA, 25 bp, Rattus norvegicus
atcccttccttaactaagccttcaa

SEQ ID NO: 181752 - DNA, 25 bp, Rattus norvegicus
atcccttccttatctaagccttcaa

SEQ ID NO: 181753 - DNA, 25 bp, Rattus norvegicus
atcccttcgcatctgggcattagaa

SEQ ID NO: 181754 - DNA, 25 bp, Rattus norvegicus
atcccttcgcatgtgggcattagaa

SEQ ID NO: 181755 - DNA, 25 bp, Rattus norvegicus
atcccttctctcagtttacaggaga

SEQ ID NO: 181756 - DNA, 25 bp, Rattus norvegicus
atcccttctctctgtttacaggaga

SEQ ID NO: 181757 - DNA, 25 bp, Rattus norvegicus
atcccttcttccatgagatctacaa

SEQ ID NO: 181758 - DNA, 25 bp, Rattus norvegicus
atcccttcttccttgagatctacaa

SEQ ID NO: 181759 - DNA, 25 bp, Rattus norvegicus
atcccttgatagacatgctctgagc

SEQ ID NO: 181760 - DNA, 25 bp, Rattus norvegicus
atcccttgatagcattaggctttga

SEQ ID NO: 181761 - DNA, 25 bp, Rattus norvegicus
atcccttgataggattaggctttga

SEQ ID NO: 181762 - DNA, 25 bp, Rattus norvegicus
atcccttgatagtcatgctctgagc

SEQ ID NO: 181763 - DNA, 25 bp, Rattus norvegicus
atcccttgctgcagaaggcttctta

SEQ ID NO: 181764 - DNA, 25 bp, Rattus norvegicus
atcccttgctgctgaaggcttctta

SEQ ID NO: 181765 - DNA, 25 bp, Rattus norvegicus
atcccttgcttgaatgttggtgtcc

SEQ ID NO: 181766 - DNA, 25 bp, Rattus norvegicus
atcccttgcttgtatgttggtgtcc

SEQ ID NO: 181767 - DNA, 25 bp, Rattus norvegicus
atcccttggcgacagtttggctcag

SEQ ID NO: 181768 - DNA, 25 bp, Rattus norvegicus
atcccttggcgagagtttggctcag

SEQ ID NO: 181769 - DNA, 25 bp, Rattus norvegicus
atcccttgggatcaacaaagcctgt

SEQ ID NO: 181770 - DNA, 25 bp, Rattus norvegicus
atcccttgggatcttaagtgctgta

SEQ ID NO: 181771 - DNA, 25 bp, Rattus norvegicus
atcccttgggatgaacaaagcctgt

SEQ ID NO: 181772 - DNA, 25 bp, Rattus norvegicus
atcccttgggatgttaagtgctgta

SEQ ID NO: 181773 - DNA, 25 bp, Rattus norvegicus
atcccttgtattctgggctccaaaa

SEQ ID NO: 181774 - DNA, 25 bp, Rattus norvegicus
atcccttgtattgtgggctccaaaa

SEQ ID NO: 181775 - DNA, 25 bp, Rattus norvegicus
atcccttgtgatcccttggacatga

SEQ ID NO: 181776 - DNA, 25 bp, Rattus norvegicus
atcccttgtgatgccttggacatga

SEQ ID NO: 181777 - DNA, 25 bp, Rattus norvegicus
atcccttgttgtagtctgttctgtg

SEQ ID NO: 181778 - DNA, 25 bp, Rattus norvegicus
atcccttgttgttgtctgttctgtg

SEQ ID NO: 181779 - DNA, 25 bp, Rattus norvegicus
atccctttagatctacaatgcgtca

SEQ ID NO: 181780 - DNA, 25 bp, Rattus norvegicus
atccctttagatgtacaatgcgtca

SEQ ID NO: 181781 - DNA, 25 bp, Rattus norvegicus
atccctttagtcacacctgttatta

SEQ ID NO: 181782 - DNA, 25 bp, Rattus norvegicus
atccctttagtctcacctgttatta

SEQ ID NO: 181783 - DNA, 25 bp, Rattus norvegicus
atccctttcatacgcaacgacctga

SEQ ID NO: 181784 - DNA, 25 bp, Rattus norvegicus
atccctttcataggcaacgacctga

SEQ ID NO: 181785 - DNA, 25 bp, Rattus norvegicus
atccctttcggtcttttgtgtctga

SEQ ID NO: 181786 - DNA, 25 bp, Rattus norvegicus
atccctttcggtgttttgtgtctga

SEQ ID NO: 181787 - DNA, 25 bp, Rattus norvegicus
atccctttctgccaactgtaaacac

SEQ ID NO: 181788 - DNA, 25 bp, Rattus norvegicus
atccctttctgcgaactgtaaacac

SEQ ID NO: 181789 - DNA, 25 bp, Rattus norvegicus
atccctttgcctagttttgtaagag

SEQ ID NO: 181790 - DNA, 25 bp, Rattus norvegicus
atccctttgccttgttttgtaagag

SEQ ID NO: 181791 - DNA, 25 bp, Rattus norvegicus
atccctttggctcacgttgtatcgg

SEQ ID NO: 181792 - DNA, 25 bp, Rattus norvegicus
atccctttggctgacgttgtatcgg

SEQ ID NO: 181793 - DNA, 25 bp, Rattus norvegicus
atccctttgtctacggtggctgcaa

SEQ ID NO: 181794 - DNA, 25 bp, Rattus norvegicus
atccctttgtcttcggtggctgcaa

SEQ ID NO: 181795 - DNA, 25 bp, Rattus norvegicus
atccctttgtgaagcacggtatcca

SEQ ID NO: 181796 - DNA, 25 bp, Rattus norvegicus
atccctttgtgaccgcaggttttga

SEQ ID NO: 181797 - DNA, 25 bp, Rattus norvegicus
atccctttgtgagcgcaggttttga

SEQ ID NO: 181798 - DNA, 25 bp, Rattus norvegicus
atccctttgtgatgcacggtatcca

SEQ ID NO: 181799 - DNA, 25 bp, Rattus norvegicus
atcccttttctaaggctggccatga

SEQ ID NO: 181800 - DNA, 25 bp, Rattus norvegicus
atcccttttctatggctggccatga

SEQ ID NO: 181801 - DNA, 25 bp, Rattus norvegicus
atccctttttcacattgtgccaatg

SEQ ID NO: 181802 - DNA, 25 bp, Rattus norvegicus
atccctttttcagattgtgccaatg

SEQ ID NO: 181803 - DNA, 25 bp, Rattus norvegicus
atccctttttgcagtgaatgcacca

SEQ ID NO: 181804 - DNA, 25 bp, Rattus norvegicus
atccctttttgctgtgaatgcacca

SEQ ID NO: 181805 - DNA, 25 bp, Rattus norvegicus
atccgaaagatcagcatgtccagag

SEQ ID NO: 181806 - DNA, 25 bp, Rattus norvegicus
atccgaaagatctgcatgtccagag

SEQ ID NO: 181807 - DNA, 25 bp, Rattus norvegicus
atccgaaggtctccaatacgttctt

SEQ ID NO: 181808 - DNA, 25 bp, Rattus norvegicus
atccgaaggtctgcaatacgttctt

SEQ ID NO: 181809 - DNA, 25 bp, Rattus norvegicus
atccgaatttagaatcctctctttt

SEQ ID NO: 181810 - DNA, 25 bp, Rattus norvegicus
atccgaatttagtatcctctctttt

SEQ ID NO: 181811 - DNA, 25 bp, Rattus norvegicus
atccgaatttcaaaagactggcctt

SEQ ID NO: 181812 - DNA, 25 bp, Rattus norvegicus
atccgaatttcataagactggcctt

SEQ ID NO: 181813 - DNA, 25 bp, Rattus norvegicus
atccgacacgctctgtctgggaatg

SEQ ID NO: 181814 - DNA, 25 bp, Rattus norvegicus
atccgacacgctgtgtctgggaatg

SEQ ID NO: 181815 - DNA, 25 bp, Rattus norvegicus
atccgacggtatctgcagctgtgtg

SEQ ID NO: 181816 - DNA, 25 bp, Rattus norvegicus
atccgacggtatgtgcagctgtgtg

SEQ ID NO: 181817 - DNA, 25 bp, Rattus norvegicus
atccgactcttccagcaaaattctg

SEQ ID NO: 181818 - DNA, 25 bp, Rattus norvegicus
atccgactcttcgagcaaaattctg

SEQ ID NO: 181819 - DNA, 25 bp, Rattus norvegicus
atccgagaactcaccctggagagaa

SEQ ID NO: 181820 - DNA, 25 bp, Rattus norvegicus
atccgagaactctccctggagagaa

SEQ ID NO: 181821 - DNA, 25 bp, Rattus norvegicus
atccgagaggccaacaagcttgcag

SEQ ID NO: 181822 - DNA, 25 bp, Rattus norvegicus
atccgagaggcctacaagcttgcag

SEQ ID NO: 181823 - DNA, 25 bp, Rattus norvegicus
atccgagagtggagcctgagcgcca

SEQ ID NO: 181824 - DNA, 25 bp, Rattus norvegicus
atccgagagtggtgcctgagcgcca

SEQ ID NO: 181825 - DNA, 25 bp, Rattus norvegicus
atccgagagttaacactgtccacct

SEQ ID NO: 181826 - DNA, 25 bp, Rattus norvegicus
atccgagagttatcactgtccacct

SEQ ID NO: 181827 - DNA, 25 bp, Rattus norvegicus
atccgagatgttatctaagggccac

SEQ ID NO: 181828 - DNA, 25 bp, Rattus norvegicus
atccgagatgttttctaagggccac

SEQ ID NO: 181829 - DNA, 25 bp, Rattus norvegicus
atccgagcactacggttcctttata

SEQ ID NO: 181830 - DNA, 25 bp, Rattus norvegicus
atccgagcactagggttcctttata

SEQ ID NO: 181831 - DNA, 25 bp, Rattus norvegicus
atccgaggagtgacttgtccagcaa

SEQ ID NO: 181832 - DNA, 25 bp, Rattus norvegicus
atccgaggagtgtcttgtccagcaa

SEQ ID NO: 181833 - DNA, 25 bp, Rattus norvegicus
atccgagtgtgtatgacacagtcgc

SEQ ID NO: 181834 - DNA, 25 bp, Rattus norvegicus
atccgagtgtgtttgacacagtcgc

SEQ ID NO: 181835 - DNA, 25 bp, Rattus norvegicus
atccgataacctcaatgctctccgt

SEQ ID NO: 181836 - DNA, 25 bp, Rattus norvegicus
atccgataacctgaatgctctccgt

SEQ ID NO: 181837 - DNA, 25 bp, Rattus norvegicus
atccgatatcctccaaatccgatat

SEQ ID NO: 181838 - DNA, 25 bp, Rattus norvegicus
atccgatatcctgcaaatccgatat

SEQ ID NO: 181839 - DNA, 25 bp, Rattus norvegicus
atccgatcatggctgagatggtcaa

SEQ ID NO: 181840 - DNA, 25 bp, Rattus norvegicus
atccgatcatgggtgagatggtcaa

SEQ ID NO: 181841 - DNA, 25 bp, Rattus norvegicus
atccgatgcattattctggtgtgtt

SEQ ID NO: 181842 - DNA, 25 bp, Rattus norvegicus
atccgatgcatttttctggtgtgtt

SEQ ID NO: 181843 - DNA, 25 bp, Rattus norvegicus
atccgatgtgtacgctaatgttttc

SEQ ID NO: 181844 - DNA, 25 bp, Rattus norvegicus
atccgatgtgtaggctaatgttttc

SEQ ID NO: 181845 - DNA, 25 bp, Rattus norvegicus
atccgattcagacatcattctctcc

SEQ ID NO: 181846 - DNA, 25 bp, Rattus norvegicus
atccgattcagagatcattctctcc

SEQ ID NO: 181847 - DNA, 25 bp, Rattus norvegicus
atccgattctttctttactggctcc

SEQ ID NO: 181848 - DNA, 25 bp, Rattus norvegicus
atccgattctttgtttactggctcc

SEQ ID NO: 181849 - DNA, 25 bp, Rattus norvegicus
atccgcaacctgaggaagtcctttg

SEQ ID NO: 181850 - DNA, 25 bp, Rattus norvegicus
atccgcaacctgtggaagtcctttg

SEQ ID NO: 181851 - DNA, 25 bp, Rattus norvegicus
atccgcaatggactatcaaagtgtt

SEQ ID NO: 181852 - DNA, 25 bp, Rattus norvegicus
atccgcaatggagtatcaaagtgtt

SEQ ID NO: 181853 - DNA, 25 bp, Rattus norvegicus
atccgcacatctccagcaggtttta

SEQ ID NO: 181854 - DNA, 25 bp, Rattus norvegicus
atccgcacatctgcagcaggtttta

SEQ ID NO: 181855 - DNA, 25 bp, Rattus norvegicus
atccgcaccgtgaatgtcttgggct

SEQ ID NO: 181856 - DNA, 25 bp, Rattus norvegicus
atccgcaccgtgtatgtcttgggct

SEQ ID NO: 181857 - DNA, 25 bp, Rattus norvegicus
atccgcactgcccatgaagaagagt

SEQ ID NO: 181858 - DNA, 25 bp, Rattus norvegicus
atccgcactgccgatgaagaagagt

SEQ ID NO: 181859 - DNA, 25 bp, Rattus norvegicus
atccgcagagagatgtccacctttg

SEQ ID NO: 181860 - DNA, 25 bp, Rattus norvegicus
atccgcagagagttgtccacctttg

SEQ ID NO: 181861 - DNA, 25 bp, Rattus norvegicus
atccgcatcactatcaacaaactta

SEQ ID NO: 181862 - DNA, 25 bp, Rattus norvegicus
atccgcatcactttcaacaaactta

SEQ ID NO: 181863 - DNA, 25 bp, Rattus norvegicus
atccgcatgagcatcgtcaaaggct

SEQ ID NO: 181864 - DNA, 25 bp, Rattus norvegicus
atccgcatgagcttcgtcaaaggct

SEQ ID NO: 181865 - DNA, 25 bp, Rattus norvegicus
atccgcatgattattccctaagtag

SEQ ID NO: 181866 - DNA, 25 bp, Rattus norvegicus
atccgcatgatttttccctaagtag

SEQ ID NO: 181867 - DNA, 25 bp, Rattus norvegicus
atccgcatgctccttggaagcgttg

SEQ ID NO: 181868 - DNA, 25 bp, Rattus norvegicus
atccgcatgctcgttggaagcgttg

SEQ ID NO: 181869 - DNA, 25 bp, Rattus norvegicus
atccgcatggctcttaacacacaga

SEQ ID NO: 181870 - DNA, 25 bp, Rattus norvegicus
atccgcatggctgttaacacacaga

SEQ ID NO: 181871 - DNA, 25 bp, Rattus norvegicus
atccgccagacacaggtagatttaa

SEQ ID NO: 181872 - DNA, 25 bp, Rattus norvegicus
atccgccagacagaggtagatttaa

SEQ ID NO: 181873 - DNA, 25 bp, Rattus norvegicus
atccgcccaggacagacgttcaagt

SEQ ID NO: 181874 - DNA, 25 bp, Rattus norvegicus
atccgcccaggagagacgttcaagt

SEQ ID NO: 181875 - DNA, 25 bp, Rattus norvegicus
atccgcccgttcagacttaaatgac

SEQ ID NO: 181876 - DNA, 25 bp, Rattus norvegicus
atccgcccgttctgacttaaatgac

SEQ ID NO: 181877 - DNA, 25 bp, Rattus norvegicus
atccgccgagtgagtgtccgtcgtc

SEQ ID NO: 181878 - DNA, 25 bp, Rattus norvegicus
atccgccgagtgtgtgtccgtcgtc

SEQ ID NO: 181879 - DNA, 25 bp, Rattus norvegicus
atccgcctcaacagggtgctcgaga

SEQ ID NO: 181880 - DNA, 25 bp, Rattus norvegicus
atccgcctcaactgggtgctcgaga

SEQ ID NO: 181881 - DNA, 25 bp, Rattus norvegicus
atccgcctggcgcttaaaggtgaga

SEQ ID NO: 181882 - DNA, 25 bp, Rattus norvegicus
atccgcctggcggttaaaggtgaga

SEQ ID NO: 181883 - DNA, 25 bp, Rattus norvegicus
atccgcgaccagcttggagtatatt

SEQ ID NO: 181884 - DNA, 25 bp, Rattus norvegicus
atccgcgaccaggttggagtatatt

SEQ ID NO: 181885 - DNA, 25 bp, Rattus norvegicus
atccgcgagactctagaaagccctg

SEQ ID NO: 181886 - DNA, 25 bp, Rattus norvegicus
atccgcgagactgtagaaagccctg

SEQ ID NO: 181887 - DNA, 25 bp, Rattus norvegicus
atccgcgattacaacgatgccgaca

SEQ ID NO: 181888 - DNA, 25 bp, Rattus norvegicus
atccgcgattactacgatgccgaca

SEQ ID NO: 181889 - DNA, 25 bp, Rattus norvegicus
atccgcggtcgcaacagaccgggct

SEQ ID NO: 181890 - DNA, 25 bp, Rattus norvegicus
atccgcggtcgctacagaccgggct

SEQ ID NO: 181891 - DNA, 25 bp, Rattus norvegicus
atccgctactatcagcagtgccttg

SEQ ID NO: 181892 - DNA, 25 bp, Rattus norvegicus
atccgctactatgagcagtgccttg

SEQ ID NO: 181893 - DNA, 25 bp, Rattus norvegicus
atccgctatgtgacctttgagcagt

SEQ ID NO: 181894 - DNA, 25 bp, Rattus norvegicus
atccgctatgtgtcctttgagcagt

SEQ ID NO: 181895 - DNA, 25 bp, Rattus norvegicus
atccgctctcgtctcttgatttgtg

SEQ ID NO: 181896 - DNA, 25 bp, Rattus norvegicus
atccgctctcgtgtcttgatttgtg

SEQ ID NO: 181897 - DNA, 25 bp, Rattus norvegicus
atccgctctgggatgtgcggtcaca

SEQ ID NO: 181898 - DNA, 25 bp, Rattus norvegicus
atccgctctgggttgtgcggtcaca

SEQ ID NO: 181899 - DNA, 25 bp, Rattus norvegicus
atccgctctgtcaccgaaagtatag

SEQ ID NO: 181900 - DNA, 25 bp, Rattus norvegicus
atccgctctgtctccgaaagtatag

SEQ ID NO: 181901 - DNA, 25 bp, Rattus norvegicus
atccgctgggctctccctgaaaaag

SEQ ID NO: 181902 - DNA, 25 bp, Rattus norvegicus
atccgctgggctgtccctgaaaaag

SEQ ID NO: 181903 - DNA, 25 bp, Rattus norvegicus
atccgctggtccaatggtgcaggca

SEQ ID NO: 181904 - DNA, 25 bp, Rattus norvegicus
atccgctggtcctatggtgcaggca

SEQ ID NO: 181905 - DNA, 25 bp, Rattus norvegicus
atccgctgtgatcgctgtggctaca

SEQ ID NO: 181906 - DNA, 25 bp, Rattus norvegicus
atccgctgtgatggctgtggctaca

SEQ ID NO: 181907 - DNA, 25 bp, Rattus norvegicus
atccgctttttacacgcttgttcag

SEQ ID NO: 181908 - DNA, 25 bp, Rattus norvegicus
atccgctttttagacgcttgttcag

SEQ ID NO: 181909 - DNA, 25 bp, Rattus norvegicus
atccggaaactaatagatcatcttg

SEQ ID NO: 181910 - DNA, 25 bp, Rattus norvegicus
atccggaaactattagatcatcttg

SEQ ID NO: 181911 - DNA, 25 bp, Rattus norvegicus
atccggacactacaccaggagctga

SEQ ID NO: 181912 - DNA, 25 bp, Rattus norvegicus
atccggacactagaccaggagctga

SEQ ID NO: 181913 - DNA, 25 bp, Rattus norvegicus
atccggacatccatacagtgagaga

SEQ ID NO: 181914 - DNA, 25 bp, Rattus norvegicus
atccggacatccttacagtgagaga

SEQ ID NO: 181915 - DNA, 25 bp, Rattus norvegicus
atccggagcagcagtcatggagcaa

SEQ ID NO: 181916 - DNA, 25 bp, Rattus norvegicus
atccggagcagctgtcatggagcaa

SEQ ID NO: 181917 - DNA, 25 bp, Rattus norvegicus
atccggagcctccaaaggcagctca

SEQ ID NO: 181918 - DNA, 25 bp, Rattus norvegicus
atccggagcctcgaaaggcagctca

SEQ ID NO: 181919 - DNA, 25 bp, Rattus norvegicus
atccggatccggacactaaaaattg

SEQ ID NO: 181920 - DNA, 25 bp, Rattus norvegicus
atccggatccggtcactaaaaattg

SEQ ID NO: 181921 - DNA, 25 bp, Rattus norvegicus
atccggatccgtctcaacagatact

SEQ ID NO: 181922 - DNA, 25 bp, Rattus norvegicus
atccggatccgtgtcaacagatact

SEQ ID NO: 181923 - DNA, 25 bp, Rattus norvegicus
atccggatggtgatttctttcttag

SEQ ID NO: 181924 - DNA, 25 bp, Rattus norvegicus
atccggatggtgttttctttcttag

SEQ ID NO: 181925 - DNA, 25 bp, Rattus norvegicus
atccggcacaagcttctgaacatgt

SEQ ID NO: 181926 - DNA, 25 bp, Rattus norvegicus
atccggcacaaggttctgaacatgt

SEQ ID NO: 181927 - DNA, 25 bp, Rattus norvegicus
atccggcagagcacagaagagcaaa

SEQ ID NO: 181928 - DNA, 25 bp, Rattus norvegicus
atccggcagagctcagaagagcaaa

SEQ ID NO: 181929 - DNA, 25 bp, Rattus norvegicus
atccggcagcagcagtacaagttct

SEQ ID NO: 181930 - DNA, 25 bp, Rattus norvegicus
atccggcagcaggagtacaagttct

SEQ ID NO: 181931 - DNA, 25 bp, Rattus norvegicus
atccggccactgagagtcagggcat

SEQ ID NO: 181932 - DNA, 25 bp, Rattus norvegicus
atccggccactgtgagtcagggcat

SEQ ID NO: 181933 - DNA, 25 bp, Rattus norvegicus
atccggcccaagattgtggtggtct

SEQ ID NO: 181934 - DNA, 25 bp, Rattus norvegicus
atccggcccaagtttgtggtggtct

SEQ ID NO: 181935 - DNA, 25 bp, Rattus norvegicus
atccggccctgcagtaacatggagg

SEQ ID NO: 181936 - DNA, 25 bp, Rattus norvegicus
atccggccctgctgtaacatggagg

SEQ ID NO: 181937 - DNA, 25 bp, Rattus norvegicus
atccggcggccgatgaatgccttta

SEQ ID NO: 181938 - DNA, 25 bp, Rattus norvegicus
atccggcggccgttgaatgccttta

SEQ ID NO: 181939 - DNA, 25 bp, Rattus norvegicus
atccggctcaagaacggtcagcgaa

SEQ ID NO: 181940 - DNA, 25 bp, Rattus norvegicus
atccggctcaagtacggtcagcgaa

SEQ ID NO: 181941 - DNA, 25 bp, Rattus norvegicus
atccggctcttcatcgtggatgcac

SEQ ID NO: 181942 - DNA, 25 bp, Rattus norvegicus
atccggctcttcttcgtggatgcac

SEQ ID NO: 181943 - DNA, 25 bp, Rattus norvegicus
atccggcttctgatacgtcaatgat

SEQ ID NO: 181944 - DNA, 25 bp, Rattus norvegicus
atccggcttctgatttgtcgattgc

SEQ ID NO: 181945 - DNA, 25 bp, Rattus norvegicus
atccggcttctgttacgtcaatgat

SEQ ID NO: 181946 - DNA, 25 bp, Rattus norvegicus
atccggcttctgttttgtcgattgc

SEQ ID NO: 181947 - DNA, 25 bp, Rattus norvegicus
atccggctttgccaacacaaaatga

SEQ ID NO: 181948 - DNA, 25 bp, Rattus norvegicus
atccggctttgcgaacacaaaatga

SEQ ID NO: 181949 - DNA, 25 bp, Rattus norvegicus
atccgggacatcaattgcctttaag

SEQ ID NO: 181950 - DNA, 25 bp, Rattus norvegicus
atccgggacatctattgcctttaag

SEQ ID NO: 181951 - DNA, 25 bp, Rattus norvegicus
atccgggacgtcagcatggagcaaa

SEQ ID NO: 181952 - DNA, 25 bp, Rattus norvegicus
atccgggacgtctgcatggagcaaa

SEQ ID NO: 181953 - DNA, 25 bp, Rattus norvegicus
atccgggcaatgactcttttcgagt

SEQ ID NO: 181954 - DNA, 25 bp, Rattus norvegicus
atccgggcaatgtctcttttcgagt

SEQ ID NO: 181955 - DNA, 25 bp, Rattus norvegicus
atccgggcacccaaggagctagtta

SEQ ID NO: 181956 - DNA, 25 bp, Rattus norvegicus
atccgggcaccctaggagctagtta

SEQ ID NO: 181957 - DNA, 25 bp, Rattus norvegicus
atccgggctctgagttcttttcgta

SEQ ID NO: 181958 - DNA, 25 bp, Rattus norvegicus
atccgggctctgtgttcttttcgta

SEQ ID NO: 181959 - DNA, 25 bp, Rattus norvegicus
atccgggctgccaaaaacatccagg

SEQ ID NO: 181960 - DNA, 25 bp, Rattus norvegicus
atccgggctgcctaaaacatccagg

SEQ ID NO: 181961 - DNA, 25 bp, Rattus norvegicus
atccgggtgctgcacccatcattgt

SEQ ID NO: 181962 - DNA, 25 bp, Rattus norvegicus
atccgggtgctggacccatcattgt

SEQ ID NO: 181963 - DNA, 25 bp, Rattus norvegicus
atccggtaatacacatcaatggcat

SEQ ID NO: 181964 - DNA, 25 bp, Rattus norvegicus
atccggtaatactcatcaatggcat

SEQ ID NO: 181965 - DNA, 25 bp, Rattus norvegicus
atccggtactagcgtgtatcgcctg

SEQ ID NO: 181966 - DNA, 25 bp, Rattus norvegicus
atccggtactagggtgtatcgcctg

SEQ ID NO: 181967 - DNA, 25 bp, Rattus norvegicus
atccggtcaacacttgctgctggtg

SEQ ID NO: 181968 - DNA, 25 bp, Rattus norvegicus
atccggtcaacagttgctgctggtg

SEQ ID NO: 181969 - DNA, 25 bp, Rattus norvegicus
atccggtctcccagcaggagcgcgg

SEQ ID NO: 181970 - DNA, 25 bp, Rattus norvegicus
atccggtctccctgcaggagcgcgg

SEQ ID NO: 181971 - DNA, 25 bp, Rattus norvegicus
atccggtgatagattccatttgcct

SEQ ID NO: 181972 - DNA, 25 bp, Rattus norvegicus
atccggtgatagtttccatttgcct

SEQ ID NO: 181973 - DNA, 25 bp, Rattus norvegicus
atccggtgcctacgaaatgggagat

SEQ ID NO: 181974 - DNA, 25 bp, Rattus norvegicus
atccggtgcctaggaaatgggagat

SEQ ID NO: 181975 - DNA, 25 bp, Rattus norvegicus
atccggtgctggcttacttgtgcag

SEQ ID NO: 181976 - DNA, 25 bp, Rattus norvegicus
atccggtgctgggttacttgtgcag

SEQ ID NO: 181977 - DNA, 25 bp, Rattus norvegicus
atccggtgttgaacttttcacaagt

SEQ ID NO: 181978 - DNA, 25 bp, Rattus norvegicus
atccggtgttgatcttttcacaagt

SEQ ID NO: 181979 - DNA, 25 bp, Rattus norvegicus
atccggttacaaatgcacttgctga

SEQ ID NO: 181980 - DNA, 25 bp, Rattus norvegicus
atccggttacaattgcacttgctga

SEQ ID NO: 181981 - DNA, 25 bp, Rattus norvegicus
atccgtatggaactgggtcccacca

SEQ ID NO: 181982 - DNA, 25 bp, Rattus norvegicus
atccgtatggaagtgggtcccacca

SEQ ID NO: 181983 - DNA, 25 bp, Rattus norvegicus
atccgtcagacaaggttgactgctt

SEQ ID NO: 181984 - DNA, 25 bp, Rattus norvegicus
atccgtcagacatggttgactgctt

SEQ ID NO: 181985 - DNA, 25 bp, Rattus norvegicus
atccgtcagtctacctcaaagatag

SEQ ID NO: 181986 - DNA, 25 bp, Rattus norvegicus
atccgtcagtcttcctcaaagatag

SEQ ID NO: 181987 - DNA, 25 bp, Rattus norvegicus
atccgtccagacatgggcagggttg

SEQ ID NO: 181988 - DNA, 25 bp, Rattus norvegicus
atccgtccagacttgggcagggttg

SEQ ID NO: 181989 - DNA, 25 bp, Rattus norvegicus
atccgtccctttcccaggcagcttg

SEQ ID NO: 181990 - DNA, 25 bp, Rattus norvegicus
atccgtccctttgccaggcagcttg

SEQ ID NO: 181991 - DNA, 25 bp, Rattus norvegicus
atccgtccgtcgcatcttaaattcg

SEQ ID NO: 181992 - DNA, 25 bp, Rattus norvegicus
atccgtccgtcggatcttaaattcg

SEQ ID NO: 181993 - DNA, 25 bp, Rattus norvegicus
atccgtccttggctcaggatttgga

SEQ ID NO: 181994 - DNA, 25 bp, Rattus norvegicus
atccgtccttgggtcaggatttgga

SEQ ID NO: 181995 - DNA, 25 bp, Rattus norvegicus
atccgtcgcaagaccatctaagtgt

SEQ ID NO: 181996 - DNA, 25 bp, Rattus norvegicus
atccgtcgcaagtccatctaagtgt

SEQ ID NO: 181997 - DNA, 25 bp, Rattus norvegicus
atccgtcttcgtctaaaggcatggt

SEQ ID NO: 181998 - DNA, 25 bp, Rattus norvegicus
atccgtcttcgtgtaaaggcatggt

SEQ ID NO: 181999 - DNA, 25 bp, Rattus norvegicus
atccgtgcgccaatgtggagatgct

SEQ ID NO: 182000 - DNA, 25 bp, Rattus norvegicus
atccgtgcgccattgtggagatgct

SEQ ID NO: 182001 - DNA, 25 bp, Rattus norvegicus
atccgtgcggtaccgagtcttggaa

SEQ ID NO: 182002 - DNA, 25 bp, Rattus norvegicus
atccgtgcggtagcgagtcttggaa

SEQ ID NO: 182003 - DNA, 25 bp, Rattus norvegicus
atccgtgctgccaaagccagtcttt

SEQ ID NO: 182004 - DNA, 25 bp, Rattus norvegicus
atccgtgctgcctaagccagtcttt

SEQ ID NO: 182005 - DNA, 25 bp, Rattus norvegicus
atccgtgctgtcctgtatttatata

SEQ ID NO: 182006 - DNA, 25 bp, Rattus norvegicus
atccgtgctgtcgtgtatttatata

SEQ ID NO: 182007 - DNA, 25 bp, Rattus norvegicus
atccgtgcttctccgctaagtggca

SEQ ID NO: 182008 - DNA, 25 bp, Rattus norvegicus
atccgtgcttctgcgctaagtggca

SEQ ID NO: 182009 - DNA, 25 bp, Rattus norvegicus
atccgtgctttgctgcaactgcata

SEQ ID NO: 182010 - DNA, 25 bp, Rattus norvegicus
atccgtgctttggtgcaactgcata

SEQ ID NO: 182011 - DNA, 25 bp, Rattus norvegicus
atccgtgtcactaatctgtctgagg

SEQ ID NO: 182012 - DNA, 25 bp, Rattus norvegicus
atccgtgtcacttatctgtctgagg

SEQ ID NO: 182013 - DNA, 25 bp, Rattus norvegicus
atccgtgtccagacacgagtgcagt

SEQ ID NO: 182014 - DNA, 25 bp, Rattus norvegicus
atccgtgtccagtcacgagtgcagt

SEQ ID NO: 182015 - DNA, 25 bp, Rattus norvegicus
atccgtgtgcccacgtatttgaata

SEQ ID NO: 182016 - DNA, 25 bp, Rattus norvegicus
atccgtgtgccctcgtatttgaata

SEQ ID NO: 182017 - DNA, 25 bp, Rattus norvegicus
atccgtgtggccatttcttgatgac

SEQ ID NO: 182018 - DNA, 25 bp, Rattus norvegicus
atccgtgtggccttttcttgatgac

SEQ ID NO: 182019 - DNA, 25 bp, Rattus norvegicus
atccgtgtgtctctggcgtatgcca

SEQ ID NO: 182020 - DNA, 25 bp, Rattus norvegicus
atccgtgtgtctgtggcgtatgcca

SEQ ID NO: 182021 - DNA, 25 bp, Rattus norvegicus
atccgtgtttctcccaagatggtgg

SEQ ID NO: 182022 - DNA, 25 bp, Rattus norvegicus
atccgtgtttctgccaagatggtgg

SEQ ID NO: 182023 - DNA, 25 bp, Rattus norvegicus
atccgttcagttctgtagctcatgt

SEQ ID NO: 182024 - DNA, 25 bp, Rattus norvegicus
atccgttcagttgtgtagctcatgt

SEQ ID NO: 182025 - DNA, 25 bp, Rattus norvegicus
atccgttcatggatggcagtcctgc

SEQ ID NO: 182026 - DNA, 25 bp, Rattus norvegicus
atccgttcatggttggcagtcctgc

SEQ ID NO: 182027 - DNA, 25 bp, Rattus norvegicus
atccgttcatttataacctctcagg

SEQ ID NO: 182028 - DNA, 25 bp, Rattus norvegicus
atccgttcatttttaacctctcagg

SEQ ID NO: 182029 - DNA, 25 bp, Rattus norvegicus
atccgttccttcagttgagcgagat

SEQ ID NO: 182030 - DNA, 25 bp, Rattus norvegicus
atccgttccttctgttgagcgagat

SEQ ID NO: 182031 - DNA, 25 bp, Rattus norvegicus
atccgttctgacagtaagtccagct

SEQ ID NO: 182032 - DNA, 25 bp, Rattus norvegicus
atccgttctgactgtaagtccagct

SEQ ID NO: 182033 - DNA, 25 bp, Rattus norvegicus
atccgttctgagattacttctgcca

SEQ ID NO: 182034 - DNA, 25 bp, Rattus norvegicus
atccgttctgagtttacttctgcca

SEQ ID NO: 182035 - DNA, 25 bp, Rattus norvegicus
atccgttcttggaagaagggctttg

SEQ ID NO: 182036 - DNA, 25 bp, Rattus norvegicus
atccgttcttggtagaagggctttg

SEQ ID NO: 182037 - DNA, 25 bp, Rattus norvegicus
atccgttgccggatccttgacgatg

SEQ ID NO: 182038 - DNA, 25 bp, Rattus norvegicus
atccgttgccggttccttgacgatg

SEQ ID NO: 182039 - DNA, 25 bp, Rattus norvegicus
atccgttgccttcccatggaaatga

SEQ ID NO: 182040 - DNA, 25 bp, Rattus norvegicus
atccgttgccttgccatggaaatga

SEQ ID NO: 182041 - DNA, 25 bp, Rattus norvegicus
atccgttgggtgaagtgctgagaca

SEQ ID NO: 182042 - DNA, 25 bp, Rattus norvegicus
atccgttgggtgtagtgctgagaca

SEQ ID NO: 182043 - DNA, 25 bp, Rattus norvegicus
atccgttggttcatcaatcaccagg

SEQ ID NO: 182044 - DNA, 25 bp, Rattus norvegicus
atccgttggttcttcaatcaccagg

SEQ ID NO: 182045 - DNA, 25 bp, Rattus norvegicus
atccgttgtggaactgacatgccgc

SEQ ID NO: 182046 - DNA, 25 bp, Rattus norvegicus
atccgttgtggatctgacatgccgc

SEQ ID NO: 182047 - DNA, 25 bp, Rattus norvegicus
atccgtttactcacccatcctgatt

SEQ ID NO: 182048 - DNA, 25 bp, Rattus norvegicus
atccgtttactctcccatcctgatt

SEQ ID NO: 182049 - DNA, 25 bp, Rattus norvegicus
atccgtttcctgactccagtattga

SEQ ID NO: 182050 - DNA, 25 bp, Rattus norvegicus
atccgtttcctgtctccagtattga

SEQ ID NO: 182051 - DNA, 25 bp, Rattus norvegicus
atccgtttctgccaataccatacaa

SEQ ID NO: 182052 - DNA, 25 bp, Rattus norvegicus
atccgtttctgcgaataccatacaa

SEQ ID NO: 182053 - DNA, 25 bp, Rattus norvegicus
atccgtttttccctagcactgctaa

SEQ ID NO: 182054 - DNA, 25 bp, Rattus norvegicus
atccgtttttccgtagcactgctaa

SEQ ID NO: 182055 - DNA, 25 bp, Rattus norvegicus
atcctaaactctcaccgggtgctgg

SEQ ID NO: 182056 - DNA, 25 bp, Rattus norvegicus
atcctaaactctgaccgggtgctgg

SEQ ID NO: 182057 - DNA, 25 bp, Rattus norvegicus
atcctaaataacacttccctttgct

SEQ ID NO: 182058 - DNA, 25 bp, Rattus norvegicus
atcctaaataactcttccctttgct

SEQ ID NO: 182059 - DNA, 25 bp, Rattus norvegicus
atcctaaatcctcgcactcaggagg

SEQ ID NO: 182060 - DNA, 25 bp, Rattus norvegicus
atcctaaatcctggcactcaggagg

SEQ ID NO: 182061 - DNA, 25 bp, Rattus norvegicus
atcctaacaagtcaggtgggtgaca

SEQ ID NO: 182062 - DNA, 25 bp, Rattus norvegicus
atcctaacaagtgaggtgggtgaca

SEQ ID NO: 182063 - DNA, 25 bp, Rattus norvegicus
atcctaacggtgctagaggctctgc

SEQ ID NO: 182064 - DNA, 25 bp, Rattus norvegicus
atcctaacggtggtagaggctctgc

SEQ ID NO: 182065 - DNA, 25 bp, Rattus norvegicus
atcctaagccacacaacctttattg

SEQ ID NO: 182066 - DNA, 25 bp, Rattus norvegicus
atcctaagccactcaacctttattg

SEQ ID NO: 182067 - DNA, 25 bp, Rattus norvegicus
atcctaagctctcaaacggtgccct

SEQ ID NO: 182068 - DNA, 25 bp, Rattus norvegicus
atcctaagctctgaaacggtgccct

SEQ ID NO: 182069 - DNA, 25 bp, Rattus norvegicus
atcctaagctgtacagggtctcact

SEQ ID NO: 182070 - DNA, 25 bp, Rattus norvegicus
atcctaagctgttcagggtctcact

SEQ ID NO: 182071 - DNA, 25 bp, Rattus norvegicus
atcctaatacagccgcgacgaacct

SEQ ID NO: 182072 - DNA, 25 bp, Rattus norvegicus
atcctaatacaggcgcgacgaacct

SEQ ID NO: 182073 - DNA, 25 bp, Rattus norvegicus
atcctaatgtgtcaagacgcttgac

SEQ ID NO: 182074 - DNA, 25 bp, Rattus norvegicus
atcctaatgtgtgaagacgcttgac

SEQ ID NO: 182075 - DNA, 25 bp, Rattus norvegicus
atcctaattatacccgcacggcatt

SEQ ID NO: 182076 - DNA, 25 bp, Rattus norvegicus
atcctaattatagccgcacggcatt

SEQ ID NO: 182077 - DNA, 25 bp, Rattus norvegicus
atcctaattgtcacaatggccttta

SEQ ID NO: 182078 - DNA, 25 bp, Rattus norvegicus
atcctaattgtctcaatggccttta

SEQ ID NO: 182079 - DNA, 25 bp, Rattus norvegicus
atcctacactcgagccgtggactgg

SEQ ID NO: 182080 - DNA, 25 bp, Rattus norvegicus
atcctacactcgtgccgtggactgg

SEQ ID NO: 182081 - DNA, 25 bp, Rattus norvegicus
atcctacagaagagtatgcccagct

SEQ ID NO: 182082 - DNA, 25 bp, Rattus norvegicus
atcctacagaagtgtatgcccagct

SEQ ID NO: 182083 - DNA, 25 bp, Rattus norvegicus
atcctacatgaacctggaccgtgaa

SEQ ID NO: 182084 - DNA, 25 bp, Rattus norvegicus
atcctacatgaagctggaccgtgaa

SEQ ID NO: 182085 - DNA, 25 bp, Rattus norvegicus
atcctaccagacagattttcggtca

SEQ ID NO: 182086 - DNA, 25 bp, Rattus norvegicus
atcctaccagactgattttcggtca

SEQ ID NO: 182087 - DNA, 25 bp, Rattus norvegicus
atcctacccagcacagcaggcagaa

SEQ ID NO: 182088 - DNA, 25 bp, Rattus norvegicus
atcctacccagctcagcaggcagaa

SEQ ID NO: 182089 - DNA, 25 bp, Rattus norvegicus
atcctacccagtagtctaaatctca

SEQ ID NO: 182090 - DNA, 25 bp, Rattus norvegicus
atcctacccagtcggcagaagatat

SEQ ID NO: 182091 - DNA, 25 bp, Rattus norvegicus
atcctacccagtgggcagaagatat

SEQ ID NO: 182092 - DNA, 25 bp, Rattus norvegicus
atcctacccagttgtctaaatctca

SEQ ID NO: 182093 - DNA, 25 bp, Rattus norvegicus
atcctacctgccaagaactcatata

SEQ ID NO: 182094 - DNA, 25 bp, Rattus norvegicus
atcctacctgcctagaactcatata

SEQ ID NO: 182095 - DNA, 25 bp, Rattus norvegicus
atcctacctgttaaccttggttcat

SEQ ID NO: 182096 - DNA, 25 bp, Rattus norvegicus
atcctacctgtttaccttggttcat

SEQ ID NO: 182097 - DNA, 25 bp, Rattus norvegicus
atcctacgagatcagctacgtaact

SEQ ID NO: 182098 - DNA, 25 bp, Rattus norvegicus
atcctacgagatgagctacgtaact

SEQ ID NO: 182099 - DNA, 25 bp, Rattus norvegicus
atcctacgccgtcgacaaggtggtc

SEQ ID NO: 182100 - DNA, 25 bp, Rattus norvegicus
atcctacgccgtggacaaggtggtc

SEQ ID NO: 182101 - DNA, 25 bp, Rattus norvegicus
atcctacttccactgtaagtctgta

SEQ ID NO: 182102 - DNA, 25 bp, Rattus norvegicus
atcctacttccagtgtaagtctgta

SEQ ID NO: 182103 - DNA, 25 bp, Rattus norvegicus
atcctagaacgtctggacggacgac

SEQ ID NO: 182104 - DNA, 25 bp, Rattus norvegicus
atcctagaacgtgtggacggacgac

SEQ ID NO: 182105 - DNA, 25 bp, Rattus norvegicus
atcctagagtcacctgtctttgcct

SEQ ID NO: 182106 - DNA, 25 bp, Rattus norvegicus
atcctagagtcagctgtctttgcct

SEQ ID NO: 182107 - DNA, 25 bp, Rattus norvegicus
atcctagattgtctcttggccctgc

SEQ ID NO: 182108 - DNA, 25 bp, Rattus norvegicus
atcctagattgtgtcttggccctgc

SEQ ID NO: 182109 - DNA, 25 bp, Rattus norvegicus
atcctagcaagaagcgggccctgtg

SEQ ID NO: 182110 - DNA, 25 bp, Rattus norvegicus
atcctagcaagatgcgggccctgtg

SEQ ID NO: 182111 - DNA, 25 bp, Rattus norvegicus
atcctagcagcccagagcatgagat

SEQ ID NO: 182112 - DNA, 25 bp, Rattus norvegicus
atcctagcagccgagagcatgagat

SEQ ID NO: 182113 - DNA, 25 bp, Rattus norvegicus
atcctagcagtgagtgaaaccgcat

SEQ ID NO: 182114 - DNA, 25 bp, Rattus norvegicus
atcctagcagtgtgtgaaaccgcat

SEQ ID NO: 182115 - DNA, 25 bp, Rattus norvegicus
atcctagcctgaacgagctgacata

SEQ ID NO: 182116 - DNA, 25 bp, Rattus norvegicus
atcctagcctgatcgagctgacata

SEQ ID NO: 182117 - DNA, 25 bp, Rattus norvegicus
atcctagcttacattttctcaattg

SEQ ID NO: 182118 - DNA, 25 bp, Rattus norvegicus
atcctagcttactttttctcaattg

SEQ ID NO: 182119 - DNA, 25 bp, Rattus norvegicus
atcctaggcaagatcactgttcaac

SEQ ID NO: 182120 - DNA, 25 bp, Rattus norvegicus
atcctaggcaagttcactgttcaac

SEQ ID NO: 182121 - DNA, 25 bp, Rattus norvegicus
atcctaggctgacgagtgacaactg

SEQ ID NO: 182122 - DNA, 25 bp, Rattus norvegicus
atcctaggctgaggagtgacaactg

SEQ ID NO: 182123 - DNA, 25 bp, Rattus norvegicus
atcctagggaggatcagggcccctg

SEQ ID NO: 182124 - DNA, 25 bp, Rattus norvegicus
atcctagggaggttcagggcccctg

SEQ ID NO: 182125 - DNA, 25 bp, Rattus norvegicus
atcctagggcagcaagggagcctca

SEQ ID NO: 182126 - DNA, 25 bp, Rattus norvegicus
atcctagggcaggaagggagcctca

SEQ ID NO: 182127 - DNA, 25 bp, Rattus norvegicus
atcctagggccgatattaaaatctt

SEQ ID NO: 182128 - DNA, 25 bp, Rattus norvegicus
atcctagggccgttattaaaatctt

SEQ ID NO: 182129 - DNA, 25 bp, Rattus norvegicus
atcctagtctttctcactgtgcaga

SEQ ID NO: 182130 - DNA, 25 bp, Rattus norvegicus
atcctagtctttgtcactgtgcaga

SEQ ID NO: 182131 - DNA, 25 bp, Rattus norvegicus
atcctagtgacaataaggtgaccta

SEQ ID NO: 182132 - DNA, 25 bp, Rattus norvegicus
atcctagtgacattaaggtgaccta

SEQ ID NO: 182133 - DNA, 25 bp, Rattus norvegicus
atcctagtgcaaagcgtctgagcct

SEQ ID NO: 182134 - DNA, 25 bp, Rattus norvegicus
atcctagtgcaatgcgtctgagcct

SEQ ID NO: 182135 - DNA, 25 bp, Rattus norvegicus
atcctagtgtctcgctcttggctcc

SEQ ID NO: 182136 - DNA, 25 bp, Rattus norvegicus
atcctagtgtctggctcttggctcc

SEQ ID NO: 182137 - DNA, 25 bp, Rattus norvegicus
atcctagtgtggcacaggtgtccta

SEQ ID NO: 182138 - DNA, 25 bp, Rattus norvegicus
atcctagtgtgggacaggtgtccta

SEQ ID NO: 182139 - DNA, 25 bp, Rattus norvegicus
atcctagttctgcaaatctaatatg

SEQ ID NO: 182140 - DNA, 25 bp, Rattus norvegicus
atcctagttctggaaatctaatatg

SEQ ID NO: 182141 - DNA, 25 bp, Rattus norvegicus
atcctatagagccaagacccgcaga

SEQ ID NO: 182142 - DNA, 25 bp, Rattus norvegicus
atcctatagagcgaagacccgcaga

SEQ ID NO: 182143 - DNA, 25 bp, Rattus norvegicus
atcctatattcaccagtctgagcac

SEQ ID NO: 182144 - DNA, 25 bp, Rattus norvegicus
atcctatattcagcagtctgagcac

SEQ ID NO: 182145 - DNA, 25 bp, Rattus norvegicus
atcctatcagtcctttttctgttca

SEQ ID NO: 182146 - DNA, 25 bp, Rattus norvegicus
atcctatcagtcgtttttctgttca

SEQ ID NO: 182147 - DNA, 25 bp, Rattus norvegicus
atcctatcatacatacctctcagtc

SEQ ID NO: 182148 - DNA, 25 bp, Rattus norvegicus
atcctatcatacttacctctcagtc

SEQ ID NO: 182149 - DNA, 25 bp, Rattus norvegicus
atcctatccatcagttacacggctt

SEQ ID NO: 182150 - DNA, 25 bp, Rattus norvegicus
atcctatccatctgttacacggctt

SEQ ID NO: 182151 - DNA, 25 bp, Rattus norvegicus
atcctatgatgtaacctactttcct

SEQ ID NO: 182152 - DNA, 25 bp, Rattus norvegicus
atcctatgatgttacctactttcct

SEQ ID NO: 182153 - DNA, 25 bp, Rattus norvegicus
atcctatgctgtaggcttctgttgc

SEQ ID NO: 182154 - DNA, 25 bp, Rattus norvegicus
atcctatgctgttggcttctgttgc

SEQ ID NO: 182155 - DNA, 25 bp, Rattus norvegicus
atcctatggactcgaaggcctgtag

SEQ ID NO: 182156 - DNA, 25 bp, Rattus norvegicus
atcctatggactggaaggcctgtag

SEQ ID NO: 182157 - DNA, 25 bp, Rattus norvegicus
atcctatggtggctctcagtgggtt

SEQ ID NO: 182158 - DNA, 25 bp, Rattus norvegicus
atcctatggtgggtctcagtgggtt

SEQ ID NO: 182159 - DNA, 25 bp, Rattus norvegicus
atcctattaattactttgctcacat

SEQ ID NO: 182160 - DNA, 25 bp, Rattus norvegicus
atcctattaatttctttgctcacat

SEQ ID NO: 182161 - DNA, 25 bp, Rattus norvegicus
atcctattccataaaggctcttcaa

SEQ ID NO: 182162 - DNA, 25 bp, Rattus norvegicus
atcctattccattaaggctcttcaa

SEQ ID NO: 182163 - DNA, 25 bp, Rattus norvegicus
atcctattgactcacactggtgtgt

SEQ ID NO: 182164 - DNA, 25 bp, Rattus norvegicus
atcctattgactgacactggtgtgt

SEQ ID NO: 182165 - DNA, 25 bp, Rattus norvegicus
atcctattgggtaaggctgctttct

SEQ ID NO: 182166 - DNA, 25 bp, Rattus norvegicus
atcctattgggttaggctgctttct

SEQ ID NO: 182167 - DNA, 25 bp, Rattus norvegicus
atcctatttggtagggcacattctc

SEQ ID NO: 182168 - DNA, 25 bp, Rattus norvegicus
atcctatttggttgggcacattctc

SEQ ID NO: 182169 - DNA, 25 bp, Rattus norvegicus
atcctcaagaggagtcgaccccgaa

SEQ ID NO: 182170 - DNA, 25 bp, Rattus norvegicus
atcctcaagaggtgtcgaccccgaa

SEQ ID NO: 182171 - DNA, 25 bp, Rattus norvegicus
atcctcaaggagctcaacctaggct

SEQ ID NO: 182172 - DNA, 25 bp, Rattus norvegicus
atcctcaaggaggtcaacctaggct

SEQ ID NO: 182173 - DNA, 25 bp, Rattus norvegicus
atcctcaagttccttagcccagaag

SEQ ID NO: 182174 - DNA, 25 bp, Rattus norvegicus
atcctcaagttcgttagcccagaag

SEQ ID NO: 182175 - DNA, 25 bp, Rattus norvegicus
atcctcacacctcggacaagacaaa

SEQ ID NO: 182176 - DNA, 25 bp, Rattus norvegicus
atcctcacacctgggacaagacaaa

SEQ ID NO: 182177 - DNA, 25 bp, Rattus norvegicus
atcctcacagctcaagagtgacctg

SEQ ID NO: 182178 - DNA, 25 bp, Rattus norvegicus
atcctcacagctgaagagtgacctg

SEQ ID NO: 182179 - DNA, 25 bp, Rattus norvegicus
atcctcacggctagcatcatttggt

SEQ ID NO: 182180 - DNA, 25 bp, Rattus norvegicus
atcctcacggcttgcatcatttggt

SEQ ID NO: 182181 - DNA, 25 bp, Rattus norvegicus
atcctcactcccaattttggtatca

SEQ ID NO: 182182 - DNA, 25 bp, Rattus norvegicus
atcctcactccctattttggtatca

SEQ ID NO: 182183 - DNA, 25 bp, Rattus norvegicus
atcctcactcctagatgatgcatgt

SEQ ID NO: 182184 - DNA, 25 bp, Rattus norvegicus
atcctcactccttgatgatgcatgt

SEQ ID NO: 182185 - DNA, 25 bp, Rattus norvegicus
atcctcactgagcacatcaggctga

SEQ ID NO: 182186 - DNA, 25 bp, Rattus norvegicus
atcctcactgaggacatcaggctga

SEQ ID NO: 182187 - DNA, 25 bp, Rattus norvegicus
atcctcactgctctgaaccctagag

SEQ ID NO: 182188 - DNA, 25 bp, Rattus norvegicus
atcctcactgctgtgaaccctagag

SEQ ID NO: 182189 - DNA, 25 bp, Rattus norvegicus
atcctcagagatcctattcttccag

SEQ ID NO: 182190 - DNA, 25 bp, Rattus norvegicus
atcctcagagatgctattcttccag

SEQ ID NO: 182191 - DNA, 25 bp, Rattus norvegicus
atcctcagagcaaagtacccgcatg

SEQ ID NO: 182192 - DNA, 25 bp, Rattus norvegicus
atcctcagagcatagtacccgcatg

SEQ ID NO: 182193 - DNA, 25 bp, Rattus norvegicus
atcctcagcactacgtaagaccagg

SEQ ID NO: 182194 - DNA, 25 bp, Rattus norvegicus
atcctcagcacttcgtaagaccagg

SEQ ID NO: 182195 - DNA, 25 bp, Rattus norvegicus
atcctcagctacaaactgcagaata

SEQ ID NO: 182196 - DNA, 25 bp, Rattus norvegicus
atcctcagctactaactgcagaata

SEQ ID NO: 182197 - DNA, 25 bp, Rattus norvegicus
atcctcagtaaaccaaaggccctgt

SEQ ID NO: 182198 - DNA, 25 bp, Rattus norvegicus
atcctcagtaaagcaaaggccctgt

SEQ ID NO: 182199 - DNA, 25 bp, Rattus norvegicus
atcctcatcctcaagagttctcgag

SEQ ID NO: 182200 - DNA, 25 bp, Rattus norvegicus
atcctcatcctctagagttctcgag

SEQ ID NO: 182201 - DNA, 25 bp, Rattus norvegicus
atcctcatcctgaaagtctgttgct

SEQ ID NO: 182202 - DNA, 25 bp, Rattus norvegicus
atcctcatcctgtaagtctgttgct

SEQ ID NO: 182203 - DNA, 25 bp, Rattus norvegicus
atcctcatctaaatacccacgttgt

SEQ ID NO: 182204 - DNA, 25 bp, Rattus norvegicus
atcctcatctaattacccacgttgt

SEQ ID NO: 182205 - DNA, 25 bp, Rattus norvegicus
atcctcatggtcagaagtctcccaa

SEQ ID NO: 182206 - DNA, 25 bp, Rattus norvegicus
atcctcatggtctgaagtctcccaa

SEQ ID NO: 182207 - DNA, 25 bp, Rattus norvegicus
atcctcatggtgaccatccccatgg

SEQ ID NO: 182208 - DNA, 25 bp, Rattus norvegicus
atcctcatggtgtccatccccatgg

SEQ ID NO: 182209 - DNA, 25 bp, Rattus norvegicus
atcctcatgttaatttttgatccct

SEQ ID NO: 182210 - DNA, 25 bp, Rattus norvegicus
atcctcatgttattttttgatccct

SEQ ID NO: 182211 - DNA, 25 bp, Rattus norvegicus
atcctcattacaccaccaattggaa

SEQ ID NO: 182212 - DNA, 25 bp, Rattus norvegicus
atcctcattacagcaccaattggaa

SEQ ID NO: 182213 - DNA, 25 bp, Rattus norvegicus
atcctcattcgtcatcggtcattag

SEQ ID NO: 182214 - DNA, 25 bp, Rattus norvegicus
atcctcattcgtgatcggtcattag

SEQ ID NO: 182215 - DNA, 25 bp, Rattus norvegicus
atcctcattggcatgcagtttgtta

SEQ ID NO: 182216 - DNA, 25 bp, Rattus norvegicus
atcctcattggcttgcagtttgtta

SEQ ID NO: 182217 - DNA, 25 bp, Rattus norvegicus
atcctcatttttagtgcttctagtt

SEQ ID NO: 182218 - DNA, 25 bp, Rattus norvegicus
atcctcattttttgtgcttctagtt

SEQ ID NO: 182219 - DNA, 25 bp, Rattus norvegicus
atcctccaagatatgagtctactag

SEQ ID NO: 182220 - DNA, 25 bp, Rattus norvegicus
atcctccaagatttgagtctactag

SEQ ID NO: 182221 - DNA, 25 bp, Rattus norvegicus
atcctccacctaactctaatgtaaa

SEQ ID NO: 182222 - DNA, 25 bp, Rattus norvegicus
atcctccacctatctctaatgtaaa

SEQ ID NO: 182223 - DNA, 25 bp, Rattus norvegicus
atcctccactgcagtctgagcagag

SEQ ID NO: 182224 - DNA, 25 bp, Rattus norvegicus
atcctccactgctgtctgagcagag

SEQ ID NO: 182225 - DNA, 25 bp, Rattus norvegicus
atcctccagatgaggctgttgatgt

SEQ ID NO: 182226 - DNA, 25 bp, Rattus norvegicus
atcctccagatgtggctgttgatgt

SEQ ID NO: 182227 - DNA, 25 bp, Rattus norvegicus
atcctccaggccaagtgcaagggtt

SEQ ID NO: 182228 - DNA, 25 bp, Rattus norvegicus
atcctccaggcctagtgcaagggtt

SEQ ID NO: 182229 - DNA, 25 bp, Rattus norvegicus
atcctccagtccctgaatatctgaa

SEQ ID NO: 182230 - DNA, 25 bp, Rattus norvegicus
atcctccagtccgtgaatatctgaa

SEQ ID NO: 182231 - DNA, 25 bp, Rattus norvegicus
atcctccagttgctactgatgtcag

SEQ ID NO: 182232 - DNA, 25 bp, Rattus norvegicus
atcctccagttggtactgatgtcag

SEQ ID NO: 182233 - DNA, 25 bp, Rattus norvegicus
atcctccatgctaacgtcttataca

SEQ ID NO: 182234 - DNA, 25 bp, Rattus norvegicus
atcctccatgcttacgtcttataca

SEQ ID NO: 182235 - DNA, 25 bp, Rattus norvegicus
atcctcccagacatttgttggctta

SEQ ID NO: 182236 - DNA, 25 bp, Rattus norvegicus
atcctcccagacctatgcaactagg

SEQ ID NO: 182237 - DNA, 25 bp, Rattus norvegicus
atcctcccagacgtatgcaactagg

SEQ ID NO: 182238 - DNA, 25 bp, Rattus norvegicus
atcctcccagacttttgttggctta

SEQ ID NO: 182239 - DNA, 25 bp, Rattus norvegicus
atcctcccagctcagttttattaga

SEQ ID NO: 182240 - DNA, 25 bp, Rattus norvegicus
atcctcccagctgagttttattaga

SEQ ID NO: 182241 - DNA, 25 bp, Rattus norvegicus
atcctccccactaaaagtctgttga

SEQ ID NO: 182242 - DNA, 25 bp, Rattus norvegicus
atcctccccacttaaagtctgttga

SEQ ID NO: 182243 - DNA, 25 bp, Rattus norvegicus
atcctccctgacaagatgattgcat

SEQ ID NO: 182244 - DNA, 25 bp, Rattus norvegicus
atcctccctgactagatgattgcat

SEQ ID NO: 182245 - DNA, 25 bp, Rattus norvegicus
atcctccctgggacagaggatggta

SEQ ID NO: 182246 - DNA, 25 bp, Rattus norvegicus
atcctccctgggtcagaggatggta

SEQ ID NO: 182247 - DNA, 25 bp, Rattus norvegicus
atcctcccttacattgctggcaata

SEQ ID NO: 182248 - DNA, 25 bp, Rattus norvegicus
atcctcccttactttgctggcaata

SEQ ID NO: 182249 - DNA, 25 bp, Rattus norvegicus
atcctcccttcgaaagctctgttag

SEQ ID NO: 182250 - DNA, 25 bp, Rattus norvegicus
atcctcccttcgtaagctctgttag

SEQ ID NO: 182251 - DNA, 25 bp, Rattus norvegicus
atcctcccttgcatgcatctgtata

SEQ ID NO: 182252 - DNA, 25 bp, Rattus norvegicus
atcctcccttgcttgcatctgtata

SEQ ID NO: 182253 - DNA, 25 bp, Rattus norvegicus
atcctccggagcaccgtatttctct

SEQ ID NO: 182254 - DNA, 25 bp, Rattus norvegicus
atcctccggagctccgtatttctct

SEQ ID NO: 182255 - DNA, 25 bp, Rattus norvegicus
atcctccgggataccctaatggaat

SEQ ID NO: 182256 - DNA, 25 bp, Rattus norvegicus
atcctccgggattccctaatggaat

SEQ ID NO: 182257 - DNA, 25 bp, Rattus norvegicus
atcctcctcaccacaatggttatag

SEQ ID NO: 182258 - DNA, 25 bp, Rattus norvegicus
atcctcctcacctcaatggttatag

SEQ ID NO: 182259 - DNA, 25 bp, Rattus norvegicus
atcctcctccagattgttctggttg

SEQ ID NO: 182260 - DNA, 25 bp, Rattus norvegicus
atcctcctccagtttgttctggttg

SEQ ID NO: 182261 - DNA, 25 bp, Rattus norvegicus
atcctcctcttgcagttgtcggaga

SEQ ID NO: 182262 - DNA, 25 bp, Rattus norvegicus
atcctcctcttggagttgtcggaga

SEQ ID NO: 182263 - DNA, 25 bp, Rattus norvegicus
atcctcctgaggcttttacaaaagt

SEQ ID NO: 182264 - DNA, 25 bp, Rattus norvegicus
atcctcctgagggttttacaaaagt

SEQ ID NO: 182265 - DNA, 25 bp, Rattus norvegicus
atcctcctgattcgtctgaacgcat

SEQ ID NO: 182266 - DNA, 25 bp, Rattus norvegicus
atcctcctgattggtctgaacgcat

SEQ ID NO: 182267 - DNA, 25 bp, Rattus norvegicus
atcctcctgcctagatactgaagaa

SEQ ID NO: 182268 - DNA, 25 bp, Rattus norvegicus
atcctcctgccttgatactgaagaa

SEQ ID NO: 182269 - DNA, 25 bp, Rattus norvegicus
atcctcctgctcattgacaagttca

SEQ ID NO: 182270 - DNA, 25 bp, Rattus norvegicus
atcctcctgctctttgacaagttca

SEQ ID NO: 182271 - DNA, 25 bp, Rattus norvegicus
atcctcctgcttaatctgaccctgg

SEQ ID NO: 182272 - DNA, 25 bp, Rattus norvegicus
atcctcctgctttatctgaccctgg

SEQ ID NO: 182273 - DNA, 25 bp, Rattus norvegicus
atcctcctgggtcccgagattacag

SEQ ID NO: 182274 - DNA, 25 bp, Rattus norvegicus
atcctcctgggtgccgagattacag

SEQ ID NO: 182275 - DNA, 25 bp, Rattus norvegicus
atcctcctgttgacaggccataaca

SEQ ID NO: 182276 - DNA, 25 bp, Rattus norvegicus
atcctcctgttgtcaggccataaca

SEQ ID NO: 182277 - DNA, 25 bp, Rattus norvegicus
atcctccttcaaagctgtgcagaaa

SEQ ID NO: 182278 - DNA, 25 bp, Rattus norvegicus
atcctccttcaatgctgtgcagaaa

SEQ ID NO: 182279 - DNA, 25 bp, Rattus norvegicus
atcctcctttgcatgtgcactatat

SEQ ID NO: 182280 - DNA, 25 bp, Rattus norvegicus
atcctcctttgcttgtgcactatat

SEQ ID NO: 182281 - DNA, 25 bp, Rattus norvegicus
atcctcgccatcatcattaatgctt

SEQ ID NO: 182282 - DNA, 25 bp, Rattus norvegicus
atcctcgccatcttcattaatgctt

SEQ ID NO: 182283 - DNA, 25 bp, Rattus norvegicus
atcctcgctcagctggctgtgaaga

SEQ ID NO: 182284 - DNA, 25 bp, Rattus norvegicus
atcctcgctcaggtggctgtgaaga

SEQ ID NO: 182285 - DNA, 25 bp, Rattus norvegicus
atcctcggcgtcagtttgaaggcaa

SEQ ID NO: 182286 - DNA, 25 bp, Rattus norvegicus
atcctcggcgtctgtttgaaggcaa

SEQ ID NO: 182287 - DNA, 25 bp, Rattus norvegicus
atcctcggctggagccgcaagaata

SEQ ID NO: 182288 - DNA, 25 bp, Rattus norvegicus
atcctcggctggtgccgcaagaata

SEQ ID NO: 182289 - DNA, 25 bp, Rattus norvegicus
atcctcgggcatcgtgaagactctt

SEQ ID NO: 182290 - DNA, 25 bp, Rattus norvegicus
atcctcgggcatggtgaagactctt

SEQ ID NO: 182291 - DNA, 25 bp, Rattus norvegicus
atcctcgtcaggaagcacaaagtga

SEQ ID NO: 182292 - DNA, 25 bp, Rattus norvegicus
atcctcgtcaggtagcacaaagtga

SEQ ID NO: 182293 - DNA, 25 bp, Rattus norvegicus
atcctcgtggagaccggaggaggta

SEQ ID NO: 182294 - DNA, 25 bp, Rattus norvegicus
atcctcgtggagtccggaggaggta

SEQ ID NO: 182295 - DNA, 25 bp, Rattus norvegicus
atcctcgtggctacgttaataagta

SEQ ID NO: 182296 - DNA, 25 bp, Rattus norvegicus
atcctcgtggcttcgttaataagta

SEQ ID NO: 182297 - DNA, 25 bp, Rattus norvegicus
atcctctacctcatgaaacagtggc

SEQ ID NO: 182298 - DNA, 25 bp, Rattus norvegicus
atcctctacctcttgaaacagtggc

SEQ ID NO: 182299 - DNA, 25 bp, Rattus norvegicus
atcctctactctactagaaggcctt

SEQ ID NO: 182300 - DNA, 25 bp, Rattus norvegicus
atcctctactcttctagaaggcctt

SEQ ID NO: 182301 - DNA, 25 bp, Rattus norvegicus
atcctctagagtaggaagctatcct

SEQ ID NO: 182302 - DNA, 25 bp, Rattus norvegicus
atcctctagagttggaagctatcct

SEQ ID NO: 182303 - DNA, 25 bp, Rattus norvegicus
atcctctcactcatcttttatacat

SEQ ID NO: 182304 - DNA, 25 bp, Rattus norvegicus
atcctctcactcttcttttatacat

SEQ ID NO: 182305 - DNA, 25 bp, Rattus norvegicus
atcctctcagcaaccagtgacaaga

SEQ ID NO: 182306 - DNA, 25 bp, Rattus norvegicus
atcctctcagcatccagtgacaaga

SEQ ID NO: 182307 - DNA, 25 bp, Rattus norvegicus
atcctctccatcattttatgcacag

SEQ ID NO: 182308 - DNA, 25 bp, Rattus norvegicus
atcctctccatctttttatgcacag

SEQ ID NO: 182309 - DNA, 25 bp, Rattus norvegicus
atcctctcccgacgttgaagttatg

SEQ ID NO: 182310 - DNA, 25 bp, Rattus norvegicus
atcctctcccgaggttgaagttatg

SEQ ID NO: 182311 - DNA, 25 bp, Rattus norvegicus
atcctctcctagcacgtggaaggaa

SEQ ID NO: 182312 - DNA, 25 bp, Rattus norvegicus
atcctctcctaggacgtggaaggaa

SEQ ID NO: 182313 - DNA, 25 bp, Rattus norvegicus
atcctctccttactcttagctcatg

SEQ ID NO: 182314 - DNA, 25 bp, Rattus norvegicus
atcctctccttagtcttagctcatg

SEQ ID NO: 182315 - DNA, 25 bp, Rattus norvegicus
atcctctctacccttgaaatcagta

SEQ ID NO: 182316 - DNA, 25 bp, Rattus norvegicus
atcctctctaccgttgaaatcagta

SEQ ID NO: 182317 - DNA, 25 bp, Rattus norvegicus
atcctctctcctatgtcattcgttt

SEQ ID NO: 182318 - DNA, 25 bp, Rattus norvegicus
atcctctctcctttgtcattcgttt

SEQ ID NO: 182319 - DNA, 25 bp, Rattus norvegicus
atcctctctggaccttctcaaagag

SEQ ID NO: 182320 - DNA, 25 bp, Rattus norvegicus
atcctctctggagcttctcaaagag

SEQ ID NO: 182321 - DNA, 25 bp, Rattus norvegicus
atcctctcttccaacattgtcagag

SEQ ID NO: 182322 - DNA, 25 bp, Rattus norvegicus
atcctctcttcctacattgtcagag

SEQ ID NO: 182323 - DNA, 25 bp, Rattus norvegicus
atcctctgacctatattttttcaca

SEQ ID NO: 182324 - DNA, 25 bp, Rattus norvegicus
atcctctgacctttattttttcaca

SEQ ID NO: 182325 - DNA, 25 bp, Rattus norvegicus
atcctctgcatcatcctgggtttag

SEQ ID NO: 182326 - DNA, 25 bp, Rattus norvegicus
atcctctgcatcttcctgggtttag

SEQ ID NO: 182327 - DNA, 25 bp, Rattus norvegicus
atcctctgccctcccagaaagtaaa

SEQ ID NO: 182328 - DNA, 25 bp, Rattus norvegicus
atcctctgccctgccagaaagtaaa

SEQ ID NO: 182329 - DNA, 25 bp, Rattus norvegicus
atcctctgcctcagtgttaatatga

SEQ ID NO: 182330 - DNA, 25 bp, Rattus norvegicus
atcctctgcctctgtgttaatatga

SEQ ID NO: 182331 - DNA, 25 bp, Rattus norvegicus
atcctctgctctctaaatcattaca

SEQ ID NO: 182332 - DNA, 25 bp, Rattus norvegicus
atcctctgctctgtaaatcattaca

SEQ ID NO: 182333 - DNA, 25 bp, Rattus norvegicus
atcctctgcttcctaactgtttaag

SEQ ID NO: 182334 - DNA, 25 bp, Rattus norvegicus
atcctctgcttcgtaactgtttaag

SEQ ID NO: 182335 - DNA, 25 bp, Rattus norvegicus
atcctctggcaactcttgtaactac

SEQ ID NO: 182336 - DNA, 25 bp, Rattus norvegicus
atcctctggcaagtcttgtaactac

SEQ ID NO: 182337 - DNA, 25 bp, Rattus norvegicus
atcctctgggcgacactggcgttag

SEQ ID NO: 182338 - DNA, 25 bp, Rattus norvegicus
atcctctgggcgtcactggcgttag

SEQ ID NO: 182339 - DNA, 25 bp, Rattus norvegicus
atcctctggtgtccatttctgtgac

SEQ ID NO: 182340 - DNA, 25 bp, Rattus norvegicus
atcctctggtgtgcatttctgtgac

SEQ ID NO: 182341 - DNA, 25 bp, Rattus norvegicus
atcctctgtctcaggttatcaacac

SEQ ID NO: 182342 - DNA, 25 bp, Rattus norvegicus
atcctctgtctctggttatcaacac

SEQ ID NO: 182343 - DNA, 25 bp, Rattus norvegicus
atcctctgttgccagggcgagtgcc

SEQ ID NO: 182344 - DNA, 25 bp, Rattus norvegicus
atcctctgttgcgagggcgagtgcc

SEQ ID NO: 182345 - DNA, 25 bp, Rattus norvegicus
atcctcttacccagcttgatgaaat

SEQ ID NO: 182346 - DNA, 25 bp, Rattus norvegicus
atcctcttaccctgcttgatgaaat

SEQ ID NO: 182347 - DNA, 25 bp, Rattus norvegicus
atcctcttacctatgcatacagtgg

SEQ ID NO: 182348 - DNA, 25 bp, Rattus norvegicus
atcctcttacctttgcatacagtgg

SEQ ID NO: 182349 - DNA, 25 bp, Rattus norvegicus
atcctcttagcccacagagacggaa

SEQ ID NO: 182350 - DNA, 25 bp, Rattus norvegicus
atcctcttagccgacagagacggaa

SEQ ID NO: 182351 - DNA, 25 bp, Rattus norvegicus
atcctcttatgactaaaaggtaacg

SEQ ID NO: 182352 - DNA, 25 bp, Rattus norvegicus
atcctcttatgagtaaaaggtaacg

SEQ ID NO: 182353 - DNA, 25 bp, Rattus norvegicus
atcctcttcactcctggattgtgtt

SEQ ID NO: 182354 - DNA, 25 bp, Rattus norvegicus
atcctcttcactgctggattgtgtt

SEQ ID NO: 182355 - DNA, 25 bp, Rattus norvegicus
atcctcttcagcctcgatgtgaaat

SEQ ID NO: 182356 - DNA, 25 bp, Rattus norvegicus
atcctcttcagcgtcgatgtgaaat

SEQ ID NO: 182357 - DNA, 25 bp, Rattus norvegicus
atcctcttctctagtgctgtctatt

SEQ ID NO: 182358 - DNA, 25 bp, Rattus norvegicus
atcctcttctcttgtgctgtctatt

SEQ ID NO: 182359 - DNA, 25 bp, Rattus norvegicus
atcctcttctgacgagcgggcgccg

SEQ ID NO: 182360 - DNA, 25 bp, Rattus norvegicus
atcctcttctgaggagcgggcgccg

SEQ ID NO: 182361 - DNA, 25 bp, Rattus norvegicus
atcctcttgattcatagctgccttt

SEQ ID NO: 182362 - DNA, 25 bp, Rattus norvegicus
atcctcttgattgatagctgccttt

SEQ ID NO: 182363 - DNA, 25 bp, Rattus norvegicus
atcctcttgcccactgctgggatta

SEQ ID NO: 182364 - DNA, 25 bp, Rattus norvegicus
atcctcttgccctctgctgggatta

SEQ ID NO: 182365 - DNA, 25 bp, Rattus norvegicus
atcctcttgctgaagctggcgttgc

SEQ ID NO: 182366 - DNA, 25 bp, Rattus norvegicus
atcctcttgctgtagctggcgttgc

SEQ ID NO: 182367 - DNA, 25 bp, Rattus norvegicus
atcctcttgtctcgcgcatgctgca

SEQ ID NO: 182368 - DNA, 25 bp, Rattus norvegicus
atcctcttgtctggcgcatgctgca

SEQ ID NO: 182369 - DNA, 25 bp, Rattus norvegicus
atcctctttggcctgctcattgaag

SEQ ID NO: 182370 - DNA, 25 bp, Rattus norvegicus
atcctctttggcgtgctcattgaag

SEQ ID NO: 182371 - DNA, 25 bp, Rattus norvegicus
atcctctttgtgatagcatctgacc

SEQ ID NO: 182372 - DNA, 25 bp, Rattus norvegicus
atcctctttgtgctgggcggcgtca

SEQ ID NO: 182373 - DNA, 25 bp, Rattus norvegicus
atcctctttgtggtgggcggcgtca

SEQ ID NO: 182374 - DNA, 25 bp, Rattus norvegicus
atcctctttgtgttagcatctgacc

SEQ ID NO: 182375 - DNA, 25 bp, Rattus norvegicus
atcctcttttctaatgtcttctgct

SEQ ID NO: 182376 - DNA, 25 bp, Rattus norvegicus
atcctcttttcttatgtcttctgct

SEQ ID NO: 182377 - DNA, 25 bp, Rattus norvegicus
atcctgaaagctccgaaaaccttgt

SEQ ID NO: 182378 - DNA, 25 bp, Rattus norvegicus
atcctgaaagctgcgaaaaccttgt

SEQ ID NO: 182379 - DNA, 25 bp, Rattus norvegicus
atcctgaacctaattttgcacttgc

SEQ ID NO: 182380 - DNA, 25 bp, Rattus norvegicus
atcctgaacctatttttgcacttgc

SEQ ID NO: 182381 - DNA, 25 bp, Rattus norvegicus
atcctgaaccttagtgccaccctga

SEQ ID NO: 182382 - DNA, 25 bp, Rattus norvegicus
atcctgaacctttgtgccaccctga

SEQ ID NO: 182383 - DNA, 25 bp, Rattus norvegicus
atcctgaatgttaatgcgccaagca

SEQ ID NO: 182384 - DNA, 25 bp, Rattus norvegicus
atcctgaatgtttatgcgccaagca

SEQ ID NO: 182385 - DNA, 25 bp, Rattus norvegicus
atcctgacacgcagatccatgcaga

SEQ ID NO: 182386 - DNA, 25 bp, Rattus norvegicus
atcctgacacgctgatccatgcaga

SEQ ID NO: 182387 - DNA, 25 bp, Rattus norvegicus
atcctgacagctactacgagctcaa

SEQ ID NO: 182388 - DNA, 25 bp, Rattus norvegicus
atcctgacagcttctacgagctcaa

SEQ ID NO: 182389 - DNA, 25 bp, Rattus norvegicus
atcctgacaggaagggagaaatgtc

SEQ ID NO: 182390 - DNA, 25 bp, Rattus norvegicus
atcctgacaggatgggagaaatgtc

SEQ ID NO: 182391 - DNA, 25 bp, Rattus norvegicus
atcctgacattgaaaacttgccttc

SEQ ID NO: 182392 - DNA, 25 bp, Rattus norvegicus
atcctgacattgtaaacttgccttc

SEQ ID NO: 182393 - DNA, 25 bp, Rattus norvegicus
atcctgaccctgagctaacaacata

SEQ ID NO: 182394 - DNA, 25 bp, Rattus norvegicus
atcctgaccctgtgctaacaacata

SEQ ID NO: 182395 - DNA, 25 bp, Rattus norvegicus
atcctgaccgtaccctggatcctgg

SEQ ID NO: 182396 - DNA, 25 bp, Rattus norvegicus
atcctgaccgtagcctggatcctgg

SEQ ID NO: 182397 - DNA, 25 bp, Rattus norvegicus
atcctgacgctgcttgaatcttctc

SEQ ID NO: 182398 - DNA, 25 bp, Rattus norvegicus
atcctgacgctggttgaatcttctc

SEQ ID NO: 182399 - DNA, 25 bp, Rattus norvegicus
atcctgactcccctggtttattcct

SEQ ID NO: 182400 - DNA, 25 bp, Rattus norvegicus
atcctgactcccgtggtttattcct

SEQ ID NO: 182401 - DNA, 25 bp, Rattus norvegicus
atcctgactgaactgtaaaccctgt

SEQ ID NO: 182402 - DNA, 25 bp, Rattus norvegicus
atcctgactgaagtgtaaaccctgt

SEQ ID NO: 182403 - DNA, 25 bp, Rattus norvegicus
atcctgagactaactcctgcagagg

SEQ ID NO: 182404 - DNA, 25 bp, Rattus norvegicus
atcctgagactatctcctgcagagg

SEQ ID NO: 182405 - DNA, 25 bp, Rattus norvegicus
atcctgagagcactatggttcctaa

SEQ ID NO: 182406 - DNA, 25 bp, Rattus norvegicus
atcctgagagcagtatggttcctaa

SEQ ID NO: 182407 - DNA, 25 bp, Rattus norvegicus
atcctgagatgtctgaaaccctgtc

SEQ ID NO: 182408 - DNA, 25 bp, Rattus norvegicus
atcctgagatgtgtgaaaccctgtc

SEQ ID NO: 182409 - DNA, 25 bp, Rattus norvegicus
atcctgagcccaaggatgcctaaca

SEQ ID NO: 182410 - DNA, 25 bp, Rattus norvegicus
atcctgagcccatggatgcctaaca

SEQ ID NO: 182411 - DNA, 25 bp, Rattus norvegicus
atcctgagctacatagagagtttaa

SEQ ID NO: 182412 - DNA, 25 bp, Rattus norvegicus
atcctgagctacttagagagtttaa

SEQ ID NO: 182413 - DNA, 25 bp, Rattus norvegicus
atcctgagctctcacttggaagaca

SEQ ID NO: 182414 - DNA, 25 bp, Rattus norvegicus
atcctgagctctgacttggaagaca

SEQ ID NO: 182415 - DNA, 25 bp, Rattus norvegicus
atcctgagctggagaatggtttcta

SEQ ID NO: 182416 - DNA, 25 bp, Rattus norvegicus
atcctgagctggtgaatggtttcta

SEQ ID NO: 182417 - DNA, 25 bp, Rattus norvegicus
atcctgaggccgagtctgtcctgga

SEQ ID NO: 182418 - DNA, 25 bp, Rattus norvegicus
atcctgaggccgtgtctgtcctgga

SEQ ID NO: 182419 - DNA, 25 bp, Rattus norvegicus
atcctgagggagacggccacagtca

SEQ ID NO: 182420 - DNA, 25 bp, Rattus norvegicus
atcctgagggagtcggccacagtca

SEQ ID NO: 182421 - DNA, 25 bp, Rattus norvegicus
atcctgagtatcaagagttagtcta

SEQ ID NO: 182422 - DNA, 25 bp, Rattus norvegicus
atcctgagtatctagagttagtcta

SEQ ID NO: 182423 - DNA, 25 bp, Rattus norvegicus
atcctgagttgaaggtcgtccctgc

SEQ ID NO: 182424 - DNA, 25 bp, Rattus norvegicus
atcctgagttgatggtcgtccctgc

SEQ ID NO: 182425 - DNA, 25 bp, Rattus norvegicus
atcctgatgtgaaggcatgtgcctt

SEQ ID NO: 182426 - DNA, 25 bp, Rattus norvegicus
atcctgatgtgatggcatgtgcctt

SEQ ID NO: 182427 - DNA, 25 bp, Rattus norvegicus
atcctgattccaatgttgctagtcc

SEQ ID NO: 182428 - DNA, 25 bp, Rattus norvegicus
atcctgattccattgttgctagtcc

SEQ ID NO: 182429 - DNA, 25 bp, Rattus norvegicus
atcctgatttctcttcggaacgtga

SEQ ID NO: 182430 - DNA, 25 bp, Rattus norvegicus
atcctgatttctgttcggaacgtga

SEQ ID NO: 182431 - DNA, 25 bp, Rattus norvegicus
atcctgcaaatgagaacgcgctggg

SEQ ID NO: 182432 - DNA, 25 bp, Rattus norvegicus
atcctgcaaatgtgaacgcgctggg

SEQ ID NO: 182433 - DNA, 25 bp, Rattus norvegicus
atcctgcacatgaagactggcccgg

SEQ ID NO: 182434 - DNA, 25 bp, Rattus norvegicus
atcctgcacatgtagactggcccgg

SEQ ID NO: 182435 - DNA, 25 bp, Rattus norvegicus
atcctgcaccaccactttaatataa

SEQ ID NO: 182436 - DNA, 25 bp, Rattus norvegicus
atcctgcaccacgactttaatataa

SEQ ID NO: 182437 - DNA, 25 bp, Rattus norvegicus
atcctgcaccgactgggccacaaaa

SEQ ID NO: 182438 - DNA, 25 bp, Rattus norvegicus
atcctgcaccgagtgggccacaaaa

SEQ ID NO: 182439 - DNA, 25 bp, Rattus norvegicus
atcctgcacctgatgctgggttcac

SEQ ID NO: 182440 - DNA, 25 bp, Rattus norvegicus
atcctgcacctgttgctgggttcac

SEQ ID NO: 182441 - DNA, 25 bp, Rattus norvegicus
atcctgcacgaccacgaggtgacgg

SEQ ID NO: 182442 - DNA, 25 bp, Rattus norvegicus
atcctgcacgacgacgaggtgacgg

SEQ ID NO: 182443 - DNA, 25 bp, Rattus norvegicus
atcctgcacggtattccatatggag

SEQ ID NO: 182444 - DNA, 25 bp, Rattus norvegicus
atcctgcacggttttccatatggag

SEQ ID NO: 182445 - DNA, 25 bp, Rattus norvegicus
atcctgcactttatccaacacgagt

SEQ ID NO: 182446 - DNA, 25 bp, Rattus norvegicus
atcctgcactttttccaacacgagt

SEQ ID NO: 182447 - DNA, 25 bp, Rattus norvegicus
atcctgcagcacctcatcgattata

SEQ ID NO: 182448 - DNA, 25 bp, Rattus norvegicus
atcctgcagcacgtcatcgattata

SEQ ID NO: 182449 - DNA, 25 bp, Rattus norvegicus
atcctgcaggctatgtcaccattga

SEQ ID NO: 182450 - DNA, 25 bp, Rattus norvegicus
atcctgcaggctttgtcaccattga

SEQ ID NO: 182451 - DNA, 25 bp, Rattus norvegicus
atcctgcagggcaatgacctggttt

SEQ ID NO: 182452 - DNA, 25 bp, Rattus norvegicus
atcctgcagggctatgacctggttt

SEQ ID NO: 182453 - DNA, 25 bp, Rattus norvegicus
atcctgcatggtacacgagggtgga

SEQ ID NO: 182454 - DNA, 25 bp, Rattus norvegicus
atcctgcatggttcacgagggtgga

SEQ ID NO: 182455 - DNA, 25 bp, Rattus norvegicus
atcctgccaccaactaggtatttgt

SEQ ID NO: 182456 - DNA, 25 bp, Rattus norvegicus
atcctgccaccatctaggtatttgt

SEQ ID NO: 182457 - DNA, 25 bp, Rattus norvegicus
atcctgccagaaactgattcagcat

SEQ ID NO: 182458 - DNA, 25 bp, Rattus norvegicus
atcctgccagaatctgattcagcat

SEQ ID NO: 182459 - DNA, 25 bp, Rattus norvegicus
atcctgcccaatctctgttacacag

SEQ ID NO: 182460 - DNA, 25 bp, Rattus norvegicus
atcctgcccaatgtctgttacacag

SEQ ID NO: 182461 - DNA, 25 bp, Rattus norvegicus
atcctgccccttattgcaaagaggt

SEQ ID NO: 182462 - DNA, 25 bp, Rattus norvegicus
atcctgcccctttttgcaaagaggt

SEQ ID NO: 182463 - DNA, 25 bp, Rattus norvegicus
atcctgccctataacatctagttga

SEQ ID NO: 182464 - DNA, 25 bp, Rattus norvegicus
atcctgccctattacatctagttga

SEQ ID NO: 182465 - DNA, 25 bp, Rattus norvegicus
atcctgcctcggaattgatcgtgtg

SEQ ID NO: 182466 - DNA, 25 bp, Rattus norvegicus
atcctgcctcggtattgatcgtgtg

SEQ ID NO: 182467 - DNA, 25 bp, Rattus norvegicus
atcctgcctgcgaccgtgtctgatt

SEQ ID NO: 182468 - DNA, 25 bp, Rattus norvegicus
atcctgcctgcgtccgtgtctgatt

SEQ ID NO: 182469 - DNA, 25 bp, Rattus norvegicus
atcctgcctgggatgctttgtgctg

SEQ ID NO: 182470 - DNA, 25 bp, Rattus norvegicus
atcctgcctgggttgctttgtgctg

SEQ ID NO: 182471 - DNA, 25 bp, Rattus norvegicus
atcctgcctgtgactcctgcgtgaa

SEQ ID NO: 182472 - DNA, 25 bp, Rattus norvegicus
atcctgcctgtgtctcctgcgtgaa

SEQ ID NO: 182473 - DNA, 25 bp, Rattus norvegicus
atcctgccttagaaatatgcctttg

SEQ ID NO: 182474 - DNA, 25 bp, Rattus norvegicus
atcctgccttagtaatatgcctttg

SEQ ID NO: 182475 - DNA, 25 bp, Rattus norvegicus
atcctgccttgaacctgacaggagt

SEQ ID NO: 182476 - DNA, 25 bp, Rattus norvegicus
atcctgccttgatcctgacaggagt

SEQ ID NO: 182477 - DNA, 25 bp, Rattus norvegicus
atcctgccttgtcctatgtgttatc

SEQ ID NO: 182478 - DNA, 25 bp, Rattus norvegicus
atcctgccttgtgctatgtgttatc

SEQ ID NO: 182479 - DNA, 25 bp, Rattus norvegicus
atcctgcgagccatctttttatttt

SEQ ID NO: 182480 - DNA, 25 bp, Rattus norvegicus
atcctgcgagccttctttttatttt

SEQ ID NO: 182481 - DNA, 25 bp, Rattus norvegicus
atcctgcgcccactgaggagcagga

SEQ ID NO: 182482 - DNA, 25 bp, Rattus norvegicus
atcctgcgcccagtgaggagcagga

SEQ ID NO: 182483 - DNA, 25 bp, Rattus norvegicus
atcctgcgctgtctcattgatatct

SEQ ID NO: 182484 - DNA, 25 bp, Rattus norvegicus
atcctgcgctgtgtcattgatatct

SEQ ID NO: 182485 - DNA, 25 bp, Rattus norvegicus
atcctgctacagattatctaagctt

SEQ ID NO: 182486 - DNA, 25 bp, Rattus norvegicus
atcctgctacagtttatctaagctt

SEQ ID NO: 182487 - DNA, 25 bp, Rattus norvegicus
atcctgctagacaacatgttccaag

SEQ ID NO: 182488 - DNA, 25 bp, Rattus norvegicus
atcctgctagactacatgttccaag

SEQ ID NO: 182489 - DNA, 25 bp, Rattus norvegicus
atcctgctccatctctctaggaaag

SEQ ID NO: 182490 - DNA, 25 bp, Rattus norvegicus
atcctgctccatgtctctaggaaag

SEQ ID NO: 182491 - DNA, 25 bp, Rattus norvegicus
atcctgctctctatactgtttactg

SEQ ID NO: 182492 - DNA, 25 bp, Rattus norvegicus
atcctgctctctttactgtttactg

SEQ ID NO: 182493 - DNA, 25 bp, Rattus norvegicus
atcctgctgcatccggattgggaga

SEQ ID NO: 182494 - DNA, 25 bp, Rattus norvegicus
atcctgctgcatgcggattgggaga

SEQ ID NO: 182495 - DNA, 25 bp, Rattus norvegicus
atcctgctggacctgagctcttgac

SEQ ID NO: 182496 - DNA, 25 bp, Rattus norvegicus
atcctgctggacgtgagctcttgac

SEQ ID NO: 182497 - DNA, 25 bp, Rattus norvegicus
atcctgctgtccaaggtgcgactgt

SEQ ID NO: 182498 - DNA, 25 bp, Rattus norvegicus
atcctgctgtcctaggtgcgactgt

SEQ ID NO: 182499 - DNA, 25 bp, Rattus norvegicus
atcctgctgtgcattgtgccagact

SEQ ID NO: 182500 - DNA, 25 bp, Rattus norvegicus
atcctgctgtgctttgtgccagact

SEQ ID NO: 182501 - DNA, 25 bp, Rattus norvegicus
atcctgctgtgtattgaggccctgc

SEQ ID NO: 182502 - DNA, 25 bp, Rattus norvegicus
atcctgctgtgttttgaggccctgc

SEQ ID NO: 182503 - DNA, 25 bp, Rattus norvegicus
atcctgcttaaccttgtggagctgc

SEQ ID NO: 182504 - DNA, 25 bp, Rattus norvegicus
atcctgcttaacgttgtggagctgc

SEQ ID NO: 182505 - DNA, 25 bp, Rattus norvegicus
atcctgcttatcatctgtgttaacc

SEQ ID NO: 182506 - DNA, 25 bp, Rattus norvegicus
atcctgcttatcttctgtgttaacc

SEQ ID NO: 182507 - DNA, 25 bp, Rattus norvegicus
atcctgcttattcaactgatgctca

SEQ ID NO: 182508 - DNA, 25 bp, Rattus norvegicus
atcctgcttattgaactgatgctca

SEQ ID NO: 182509 - DNA, 25 bp, Rattus norvegicus
atcctgcttccaaatccaacatcaa

SEQ ID NO: 182510 - DNA, 25 bp, Rattus norvegicus
atcctgcttccatatccaacatcaa

SEQ ID NO: 182511 - DNA, 25 bp, Rattus norvegicus
atcctgcttcctaaaattcttcatt

SEQ ID NO: 182512 - DNA, 25 bp, Rattus norvegicus
atcctgcttccttaaattcttcatt

SEQ ID NO: 182513 - DNA, 25 bp, Rattus norvegicus
atcctgctttggatatatctcattg

SEQ ID NO: 182514 - DNA, 25 bp, Rattus norvegicus
atcctgctttggttatatctcattg

SEQ ID NO: 182515 - DNA, 25 bp, Rattus norvegicus
atcctggaaaccagagcaagcctcg

SEQ ID NO: 182516 - DNA, 25 bp, Rattus norvegicus
atcctggaaacctgagcaagcctcg

SEQ ID NO: 182517 - DNA, 25 bp, Rattus norvegicus
atcctggaaagccatcccgagataa

SEQ ID NO: 182518 - DNA, 25 bp, Rattus norvegicus
atcctggaaagcgatcccgagataa

SEQ ID NO: 182519 - DNA, 25 bp, Rattus norvegicus
atcctggaaggccttgaccttggcg

SEQ ID NO: 182520 - DNA, 25 bp, Rattus norvegicus
atcctggaaggcgttgaccttggcg

SEQ ID NO: 182521 - DNA, 25 bp, Rattus norvegicus
atcctggacagaatcaaaccttgac

SEQ ID NO: 182522 - DNA, 25 bp, Rattus norvegicus
atcctggacagattcaaaccttgac

SEQ ID NO: 182523 - DNA, 25 bp, Rattus norvegicus
atcctggacagtacccactgctgtc

SEQ ID NO: 182524 - DNA, 25 bp, Rattus norvegicus
atcctggacagttcccactgctgtc

SEQ ID NO: 182525 - DNA, 25 bp, Rattus norvegicus
atcctggaccagcactgagagccct

SEQ ID NO: 182526 - DNA, 25 bp, Rattus norvegicus
atcctggaccaggactgagagccct

SEQ ID NO: 182527 - DNA, 25 bp, Rattus norvegicus
atcctggacgctctgtagctcttgt

SEQ ID NO: 182528 - DNA, 25 bp, Rattus norvegicus
atcctggacgctgtgtagctcttgt

SEQ ID NO: 182529 - DNA, 25 bp, Rattus norvegicus
atcctggactttccactcagcaaag

SEQ ID NO: 182530 - DNA, 25 bp, Rattus norvegicus
atcctggactttgcactcagcaaag

SEQ ID NO: 182531 - DNA, 25 bp, Rattus norvegicus
atcctggagaggacgacctgtcaca

SEQ ID NO: 182532 - DNA, 25 bp, Rattus norvegicus
atcctggagaggtcgacctgtcaca

SEQ ID NO: 182533 - DNA, 25 bp, Rattus norvegicus
atcctggagcgacctagctctcaat

SEQ ID NO: 182534 - DNA, 25 bp, Rattus norvegicus
atcctggagcgagctagctctcaat

SEQ ID NO: 182535 - DNA, 25 bp, Rattus norvegicus
atcctggagcttccggctaatgcgg

SEQ ID NO: 182536 - DNA, 25 bp, Rattus norvegicus
atcctggagcttgcggctaatgcgg

SEQ ID NO: 182537 - DNA, 25 bp, Rattus norvegicus
atcctggagtacactgtggtcctaa

SEQ ID NO: 182538 - DNA, 25 bp, Rattus norvegicus
atcctggagtactctgtggtcctaa

SEQ ID NO: 182539 - DNA, 25 bp, Rattus norvegicus
atcctggatggaactggcttcttac

SEQ ID NO: 182540 - DNA, 25 bp, Rattus norvegicus
atcctggatggatctggcttcttac

SEQ ID NO: 182541 - DNA, 25 bp, Rattus norvegicus
atcctggcaaccactggtggctaga

SEQ ID NO: 182542 - DNA, 25 bp, Rattus norvegicus
atcctggcaacctctggtggctaga

SEQ ID NO: 182543 - DNA, 25 bp, Rattus norvegicus
atcctggcaagaatcatcatgaaca

SEQ ID NO: 182544 - DNA, 25 bp, Rattus norvegicus
atcctggcaagattcatcatgaaca

SEQ ID NO: 182545 - DNA, 25 bp, Rattus norvegicus
atcctggcaggcaccagaatcagga

SEQ ID NO: 182546 - DNA, 25 bp, Rattus norvegicus
atcctggcaggctccagaatcagga

SEQ ID NO: 182547 - DNA, 25 bp, Rattus norvegicus
atcctggcctttagcttttgttata

SEQ ID NO: 182548 - DNA, 25 bp, Rattus norvegicus
atcctggccttttgcttttgttata

SEQ ID NO: 182549 - DNA, 25 bp, Rattus norvegicus
atcctggcgcctcggaaccatagtg

SEQ ID NO: 182550 - DNA, 25 bp, Rattus norvegicus
atcctggcgcctgggaaccatagtg

SEQ ID NO: 182551 - DNA, 25 bp, Rattus norvegicus
atcctggctaacaagacagtctgat

SEQ ID NO: 182552 - DNA, 25 bp, Rattus norvegicus
atcctggctaactagacagtctgat

SEQ ID NO: 182553 - DNA, 25 bp, Rattus norvegicus
atcctggctgacatgcatacttata

SEQ ID NO: 182554 - DNA, 25 bp, Rattus norvegicus
atcctggctgacttgcatacttata

SEQ ID NO: 182555 - DNA, 25 bp, Rattus norvegicus
atcctggctgatctctctctggagg

SEQ ID NO: 182556 - DNA, 25 bp, Rattus norvegicus
atcctggctgatgtctctctggagg

SEQ ID NO: 182557 - DNA, 25 bp, Rattus norvegicus
atcctggctttgctcagtcaattga

SEQ ID NO: 182558 - DNA, 25 bp, Rattus norvegicus
atcctggctttggtcagtcaattga

SEQ ID NO: 182559 - DNA, 25 bp, Rattus norvegicus
atcctgggaccaagagggctgcagt

SEQ ID NO: 182560 - DNA, 25 bp, Rattus norvegicus
atcctgggaccatgagggctgcagt

SEQ ID NO: 182561 - DNA, 25 bp, Rattus norvegicus
atcctgggacggcttccaagtcaag

SEQ ID NO: 182562 - DNA, 25 bp, Rattus norvegicus
atcctgggacgggttccaagtcaag

SEQ ID NO: 182563 - DNA, 25 bp, Rattus norvegicus
atcctgggagctcacctggatgtca

SEQ ID NO: 182564 - DNA, 25 bp, Rattus norvegicus
atcctgggagctgacctggatgtca

SEQ ID NO: 182565 - DNA, 25 bp, Rattus norvegicus
atcctgggagttctccatgtctgga

SEQ ID NO: 182566 - DNA, 25 bp, Rattus norvegicus
atcctgggagttgtccatgtctgga

SEQ ID NO: 182567 - DNA, 25 bp, Rattus norvegicus
atcctgggcctaatcagggatctgg

SEQ ID NO: 182568 - DNA, 25 bp, Rattus norvegicus
atcctgggcctattcagggatctgg

SEQ ID NO: 182569 - DNA, 25 bp, Rattus norvegicus
atcctgggccttattcaagtgcttt

SEQ ID NO: 182570 - DNA, 25 bp, Rattus norvegicus
atcctgggccttctttcatactaga

SEQ ID NO: 182571 - DNA, 25 bp, Rattus norvegicus
atcctgggccttgtttcatactaga

SEQ ID NO: 182572 - DNA, 25 bp, Rattus norvegicus
atcctgggcctttttcaagtgcttt

SEQ ID NO: 182573 - DNA, 25 bp, Rattus norvegicus
atcctgggcgcacaggtgagattat

SEQ ID NO: 182574 - DNA, 25 bp, Rattus norvegicus
atcctgggcgcagaggtgagattat

SEQ ID NO: 182575 - DNA, 25 bp, Rattus norvegicus
atcctgggctacactgaggaccagg

SEQ ID NO: 182576 - DNA, 25 bp, Rattus norvegicus
atcctgggctactctgaggaccagg

SEQ ID NO: 182577 - DNA, 25 bp, Rattus norvegicus
atcctgggtaaactgaactctggtc

SEQ ID NO: 182578 - DNA, 25 bp, Rattus norvegicus
atcctgggtaaagtgaactctggtc

SEQ ID NO: 182579 - DNA, 25 bp, Rattus norvegicus
atcctgggtgtgcatttatcgctga

SEQ ID NO: 182580 - DNA, 25 bp, Rattus norvegicus
atcctgggtgtggatttatcgctga

SEQ ID NO: 182581 - DNA, 25 bp, Rattus norvegicus
atcctggtcaatccttagaatgcta

SEQ ID NO: 182582 - DNA, 25 bp, Rattus norvegicus
atcctggtcaatgcttagaatgcta

SEQ ID NO: 182583 - DNA, 25 bp, Rattus norvegicus
atcctggtcactatcttcttttgta

SEQ ID NO: 182584 - DNA, 25 bp, Rattus norvegicus
atcctggtcactttcttcttttgta

SEQ ID NO: 182585 - DNA, 25 bp, Rattus norvegicus
atcctggtcctgaagttactgtccc

SEQ ID NO: 182586 - DNA, 25 bp, Rattus norvegicus
atcctggtcctgtagttactgtccc

SEQ ID NO: 182587 - DNA, 25 bp, Rattus norvegicus
atcctggtctgcaacatgcgtatct

SEQ ID NO: 182588 - DNA, 25 bp, Rattus norvegicus
atcctggtctgctacatgcgtatct

SEQ ID NO: 182589 - DNA, 25 bp, Rattus norvegicus
atcctggtctttaaaaagctgcttc

SEQ ID NO: 182590 - DNA, 25 bp, Rattus norvegicus
atcctggtcttttaaaagctgcttc

SEQ ID NO: 182591 - DNA, 25 bp, Rattus norvegicus
atcctggtgcccatgtgacaaatgg

SEQ ID NO: 182592 - DNA, 25 bp, Rattus norvegicus
atcctggtgcccttgtgacaaatgg

SEQ ID NO: 182593 - DNA, 25 bp, Rattus norvegicus
atcctggtggaccacatggctgaca

SEQ ID NO: 182594 - DNA, 25 bp, Rattus norvegicus
atcctggtggacgacatggctgaca

SEQ ID NO: 182595 - DNA, 25 bp, Rattus norvegicus
atcctggtggtaacctgttcacaga

SEQ ID NO: 182596 - DNA, 25 bp, Rattus norvegicus
atcctggtggtatcctgttcacaga

SEQ ID NO: 182597 - DNA, 25 bp, Rattus norvegicus
atcctggtggtgatgatcatctgct

SEQ ID NO: 182598 - DNA, 25 bp, Rattus norvegicus
atcctggtggtgttgatcatctgct

SEQ ID NO: 182599 - DNA, 25 bp, Rattus norvegicus
atcctggttgaacacccaaatcttt

SEQ ID NO: 182600 - DNA, 25 bp, Rattus norvegicus
atcctggttgaagacccaaatcttt

SEQ ID NO: 182601 - DNA, 25 bp, Rattus norvegicus
atcctggttgataggctcagtgcca

SEQ ID NO: 182602 - DNA, 25 bp, Rattus norvegicus
atcctggttgattggctcagtgcca

SEQ ID NO: 182603 - DNA, 25 bp, Rattus norvegicus
atcctggttttacaacagttccctg

SEQ ID NO: 182604 - DNA, 25 bp, Rattus norvegicus
atcctggttttagaacagttccctg

SEQ ID NO: 182605 - DNA, 25 bp, Rattus norvegicus
atcctgtaatccagagacccgggat

SEQ ID NO: 182606 - DNA, 25 bp, Rattus norvegicus
atcctgtaatcctgagacccgggat

SEQ ID NO: 182607 - DNA, 25 bp, Rattus norvegicus
atcctgtacaccactcctggaggag

SEQ ID NO: 182608 - DNA, 25 bp, Rattus norvegicus
atcctgtacacctctcctggaggag

SEQ ID NO: 182609 - DNA, 25 bp, Rattus norvegicus
atcctgtaccaactgtggacactag

SEQ ID NO: 182610 - DNA, 25 bp, Rattus norvegicus
atcctgtaccaagtgtggacactag

SEQ ID NO: 182611 - DNA, 25 bp, Rattus norvegicus
atcctgtagtgtagtccccgcaggc

SEQ ID NO: 182612 - DNA, 25 bp, Rattus norvegicus
atcctgtagtgttgtccccgcaggc

SEQ ID NO: 182613 - DNA, 25 bp, Rattus norvegicus
atcctgtatcgtatctgtttgcaaa

SEQ ID NO: 182614 - DNA, 25 bp, Rattus norvegicus
atcctgtatcgtttctgtttgcaaa

SEQ ID NO: 182615 - DNA, 25 bp, Rattus norvegicus
atcctgtcacctaggaaactccaat

SEQ ID NO: 182616 - DNA, 25 bp, Rattus norvegicus
atcctgtcaccttggaaactccaat

SEQ ID NO: 182617 - DNA, 25 bp, Rattus norvegicus
atcctgtcactcagtgctgctctga

SEQ ID NO: 182618 - DNA, 25 bp, Rattus norvegicus
atcctgtcactctgtgctgctctga

SEQ ID NO: 182619 - DNA, 25 bp, Rattus norvegicus
atcctgtcagttacatgttgccctg

SEQ ID NO: 182620 - DNA, 25 bp, Rattus norvegicus
atcctgtcagtttcatgttgccctg

SEQ ID NO: 182621 - DNA, 25 bp, Rattus norvegicus
atcctgtcatcgattccaagtgctg

SEQ ID NO: 182622 - DNA, 25 bp, Rattus norvegicus
atcctgtcatcgtttccaagtgctg

SEQ ID NO: 182623 - DNA, 25 bp, Rattus norvegicus
atcctgtccccaaacatattttcat

SEQ ID NO: 182624 - DNA, 25 bp, Rattus norvegicus
atcctgtccccatacatattttcat

SEQ ID NO: 182625 - DNA, 25 bp, Rattus norvegicus
atcctgtcccctattcaaggagatg

SEQ ID NO: 182626 - DNA, 25 bp, Rattus norvegicus
atcctgtccccttttcaaggagatg

SEQ ID NO: 182627 - DNA, 25 bp, Rattus norvegicus
atcctgtcctcaagtggattcttcc

SEQ ID NO: 182628 - DNA, 25 bp, Rattus norvegicus
atcctgtcctcatgtggattcttcc

SEQ ID NO: 182629 - DNA, 25 bp, Rattus norvegicus
atcctgtcctgtaatatttatctag

SEQ ID NO: 182630 - DNA, 25 bp, Rattus norvegicus
atcctgtcctgttatatttatctag

SEQ ID NO: 182631 - DNA, 25 bp, Rattus norvegicus
atcctgtccttgcaggcgtctgaat

SEQ ID NO: 182632 - DNA, 25 bp, Rattus norvegicus
atcctgtccttggaggcgtctgaat

SEQ ID NO: 182633 - DNA, 25 bp, Rattus norvegicus
atcctgtctgtgaccgtgacccggt

SEQ ID NO: 182634 - DNA, 25 bp, Rattus norvegicus
atcctgtctgtgagccaagcctagc

SEQ ID NO: 182635 - DNA, 25 bp, Rattus norvegicus
atcctgtctgtgtccgtgacccggt

SEQ ID NO: 182636 - DNA, 25 bp, Rattus norvegicus
atcctgtctgtgtgccaagcctagc

SEQ ID NO: 182637 - DNA, 25 bp, Rattus norvegicus
atcctgtcttaaacactaaaggctt

SEQ ID NO: 182638 - DNA, 25 bp, Rattus norvegicus
atcctgtcttaatcactaaaggctt

SEQ ID NO: 182639 - DNA, 25 bp, Rattus norvegicus
atcctgtcttccctacaacatggta

SEQ ID NO: 182640 - DNA, 25 bp, Rattus norvegicus
atcctgtcttccgtacaacatggta

SEQ ID NO: 182641 - DNA, 25 bp, Rattus norvegicus
atcctgtgactaaaaacgactcttg

SEQ ID NO: 182642 - DNA, 25 bp, Rattus norvegicus
atcctgtgactataaacgactcttg

SEQ ID NO: 182643 - DNA, 25 bp, Rattus norvegicus
atcctgtgaggcagtggcttgaacc

SEQ ID NO: 182644 - DNA, 25 bp, Rattus norvegicus
atcctgtgaggctgtggcttgaacc

SEQ ID NO: 182645 - DNA, 25 bp, Rattus norvegicus
atcctgtgcagaaggctattggccc

SEQ ID NO: 182646 - DNA, 25 bp, Rattus norvegicus
atcctgtgcagatggctattggccc

SEQ ID NO: 182647 - DNA, 25 bp, Rattus norvegicus
atcctgtgccaaaaactttgcaatg

SEQ ID NO: 182648 - DNA, 25 bp, Rattus norvegicus
atcctgtgccaataactttgcaatg

SEQ ID NO: 182649 - DNA, 25 bp, Rattus norvegicus
atcctgtgccctatctcaaaagagt

SEQ ID NO: 182650 - DNA, 25 bp, Rattus norvegicus
atcctgtgccctttctcaaaagagt

SEQ ID NO: 182651 - DNA, 25 bp, Rattus norvegicus
atcctgtggcaaacaacctgttttc

SEQ ID NO: 182652 - DNA, 25 bp, Rattus norvegicus
atcctgtggcaatcaacctgttttc

SEQ ID NO: 182653 - DNA, 25 bp, Rattus norvegicus
atcctgtggcatccatgaaactaca

SEQ ID NO: 182654 - DNA, 25 bp, Rattus norvegicus
atcctgtggcatgcatgaaactaca

SEQ ID NO: 182655 - DNA, 25 bp, Rattus norvegicus
atcctgtggtccatgtaggcaacga

SEQ ID NO: 182656 - DNA, 25 bp, Rattus norvegicus
atcctgtggtccttgtaggcaacga

SEQ ID NO: 182657 - DNA, 25 bp, Rattus norvegicus
atcctgtggtctcaagctgtcttcc

SEQ ID NO: 182658 - DNA, 25 bp, Rattus norvegicus
atcctgtggtctgaagctgtcttcc

SEQ ID NO: 182659 - DNA, 25 bp, Rattus norvegicus
atcctgtggttaaacttaagttcat

SEQ ID NO: 182660 - DNA, 25 bp, Rattus norvegicus
atcctgtggttatacttaagttcat

SEQ ID NO: 182661 - DNA, 25 bp, Rattus norvegicus
atcctgtgttctatgctaccttaaa

SEQ ID NO: 182662 - DNA, 25 bp, Rattus norvegicus
atcctgtgttctttgctaccttaaa

SEQ ID NO: 182663 - DNA, 25 bp, Rattus norvegicus
atcctgtgtttgcttcgatgaccgt

SEQ ID NO: 182664 - DNA, 25 bp, Rattus norvegicus
atcctgtgtttggttcgatgaccgt

SEQ ID NO: 182665 - DNA, 25 bp, Rattus norvegicus
atcctgttaaacatggtaggtcaca

SEQ ID NO: 182666 - DNA, 25 bp, Rattus norvegicus
atcctgttaaacttggtaggtcaca

SEQ ID NO: 182667 - DNA, 25 bp, Rattus norvegicus
atcctgttaaccacggcaaaccaag

SEQ ID NO: 182668 - DNA, 25 bp, Rattus norvegicus
atcctgttaacctcggcaaaccaag

SEQ ID NO: 182669 - DNA, 25 bp, Rattus norvegicus
atcctgttaagcctctctggcagta

SEQ ID NO: 182670 - DNA, 25 bp, Rattus norvegicus
atcctgttaagcgtctctggcagta

SEQ ID NO: 182671 - DNA, 25 bp, Rattus norvegicus
atcctgttactaagagctggccacc

SEQ ID NO: 182672 - DNA, 25 bp, Rattus norvegicus
atcctgttactatgagctggccacc

SEQ ID NO: 182673 - DNA, 25 bp, Rattus norvegicus
atcctgttactcagtgctgccctga

SEQ ID NO: 182674 - DNA, 25 bp, Rattus norvegicus
atcctgttactctgtgctgccctga

SEQ ID NO: 182675 - DNA, 25 bp, Rattus norvegicus
atcctgttcatcatgagggtcacat

SEQ ID NO: 182676 - DNA, 25 bp, Rattus norvegicus
atcctgttcatcttgagggtcacat

SEQ ID NO: 182677 - DNA, 25 bp, Rattus norvegicus
atcctgttccttaataacttaccag

SEQ ID NO: 182678 - DNA, 25 bp, Rattus norvegicus
atcctgttccttagttctttcatgt

SEQ ID NO: 182679 - DNA, 25 bp, Rattus norvegicus
atcctgttcctttataacttaccag

SEQ ID NO: 182680 - DNA, 25 bp, Rattus norvegicus
atcctgttcctttgttctttcatgt

SEQ ID NO: 182681 - DNA, 25 bp, Rattus norvegicus
atcctgttggccctcattgagggtg

SEQ ID NO: 182682 - DNA, 25 bp, Rattus norvegicus
atcctgttggccgtcattgagggtg

SEQ ID NO: 182683 - DNA, 25 bp, Rattus norvegicus
atcctgtttagaacgtctccagaaa

SEQ ID NO: 182684 - DNA, 25 bp, Rattus norvegicus
atcctgtttagatcgtctccagaaa

SEQ ID NO: 182685 - DNA, 25 bp, Rattus norvegicus
atcctgtttcaacctcactgatacc

SEQ ID NO: 182686 - DNA, 25 bp, Rattus norvegicus
atcctgtttcaagctcactgatacc

SEQ ID NO: 182687 - DNA, 25 bp, Rattus norvegicus
atcctgtttgaaaaactcttctctt

SEQ ID NO: 182688 - DNA, 25 bp, Rattus norvegicus
atcctgtttgaataactcttctctt

SEQ ID NO: 182689 - DNA, 25 bp, Rattus norvegicus
atcctgttttctccatacctataaa

SEQ ID NO: 182690 - DNA, 25 bp, Rattus norvegicus
atcctgttttctgcatacctataaa

SEQ ID NO: 182691 - DNA, 25 bp, Rattus norvegicus
atccttaacttgcaggcaccgcggg

SEQ ID NO: 182692 - DNA, 25 bp, Rattus norvegicus
atccttaacttggaggcaccgcggg

SEQ ID NO: 182693 - DNA, 25 bp, Rattus norvegicus
atccttaagaaacccagacaccaca

SEQ ID NO: 182694 - DNA, 25 bp, Rattus norvegicus
atccttaagaaagccagacaccaca

SEQ ID NO: 182695 - DNA, 25 bp, Rattus norvegicus
atccttaattcaccctagctttatg

SEQ ID NO: 182696 - DNA, 25 bp, Rattus norvegicus
atccttaattcagcctagctttatg

SEQ ID NO: 182697 - DNA, 25 bp, Rattus norvegicus
atccttacagccctctgataagtaa

SEQ ID NO: 182698 - DNA, 25 bp, Rattus norvegicus
atccttacagccgtctgataagtaa

SEQ ID NO: 182699 - DNA, 25 bp, Rattus norvegicus
atccttacagctcggccccaatgag

SEQ ID NO: 182700 - DNA, 25 bp, Rattus norvegicus
atccttacagctgggccccaatgag

SEQ ID NO: 182701 - DNA, 25 bp, Rattus norvegicus
atccttaccatcagcacggtgtggt

SEQ ID NO: 182702 - DNA, 25 bp, Rattus norvegicus
atccttaccatctgcacggtgtggt

SEQ ID NO: 182703 - DNA, 25 bp, Rattus norvegicus
atccttagcatgcttctcttgaggt

SEQ ID NO: 182704 - DNA, 25 bp, Rattus norvegicus
atccttagcatggttctcttgaggt

SEQ ID NO: 182705 - DNA, 25 bp, Rattus norvegicus
atccttagtagccttgttgtccttc

SEQ ID NO: 182706 - DNA, 25 bp, Rattus norvegicus
atccttagtagcgttgttgtccttc

SEQ ID NO: 182707 - DNA, 25 bp, Rattus norvegicus
atccttagtgatcagggaaatgcat

SEQ ID NO: 182708 - DNA, 25 bp, Rattus norvegicus
atccttagtgatgagggaaatgcat

SEQ ID NO: 182709 - DNA, 25 bp, Rattus norvegicus
atccttatattcaacgccattattg

SEQ ID NO: 182710 - DNA, 25 bp, Rattus norvegicus
atccttatattctacgccattattg

SEQ ID NO: 182711 - DNA, 25 bp, Rattus norvegicus
atccttatattgattctcctgcctc

SEQ ID NO: 182712 - DNA, 25 bp, Rattus norvegicus
atccttatattgtttctcctgcctc

SEQ ID NO: 182713 - DNA, 25 bp, Rattus norvegicus
atccttatgcatcttgtccgttgtg

SEQ ID NO: 182714 - DNA, 25 bp, Rattus norvegicus
atccttatgcatgttgtccgttgtg

SEQ ID NO: 182715 - DNA, 25 bp, Rattus norvegicus
atccttatggatctctttatatgcc

SEQ ID NO: 182716 - DNA, 25 bp, Rattus norvegicus
atccttatggatgtctttatatgcc

SEQ ID NO: 182717 - DNA, 25 bp, Rattus norvegicus
atccttatgtttaagttggtgctgc

SEQ ID NO: 182718 - DNA, 25 bp, Rattus norvegicus
atccttatgttttagttggtgctgc

SEQ ID NO: 182719 - DNA, 25 bp, Rattus norvegicus
atccttattagaagaccttctgact

SEQ ID NO: 182720 - DNA, 25 bp, Rattus norvegicus
atccttattagatgaccttctgact

SEQ ID NO: 182721 - DNA, 25 bp, Rattus norvegicus
atccttattggcctcatgcattaca

SEQ ID NO: 182722 - DNA, 25 bp, Rattus norvegicus
atccttattggcgtcatgcattaca

SEQ ID NO: 182723 - DNA, 25 bp, Rattus norvegicus
atccttcacacccagtgagactcaa

SEQ ID NO: 182724 - DNA, 25 bp, Rattus norvegicus
atccttcacaccgagtgagactcaa

SEQ ID NO: 182725 - DNA, 25 bp, Rattus norvegicus
atccttcacccacatgctcatgtgt

SEQ ID NO: 182726 - DNA, 25 bp, Rattus norvegicus
atccttcacccagatgctcatgtgt

SEQ ID NO: 182727 - DNA, 25 bp, Rattus norvegicus
atccttcacgcaaatcagctgatcg

SEQ ID NO: 182728 - DNA, 25 bp, Rattus norvegicus
atccttcacgcatatcagctgatcg

SEQ ID NO: 182729 - DNA, 25 bp, Rattus norvegicus
atccttcactgaaatctctcgtcga

SEQ ID NO: 182730 - DNA, 25 bp, Rattus norvegicus
atccttcactgatatctctcgtcga

SEQ ID NO: 182731 - DNA, 25 bp, Rattus norvegicus
atccttcagggcatgctgcagtatc

SEQ ID NO: 182732 - DNA, 25 bp, Rattus norvegicus
atccttcagggcttgctgcagtatc

SEQ ID NO: 182733 - DNA, 25 bp, Rattus norvegicus
atccttcatgctaattctttcttta

SEQ ID NO: 182734 - DNA, 25 bp, Rattus norvegicus
atccttcatgcttattctttcttta

SEQ ID NO: 182735 - DNA, 25 bp, Rattus norvegicus
atccttcatgttccagcgagtactg

SEQ ID NO: 182736 - DNA, 25 bp, Rattus norvegicus
atccttcatgttgcagcgagtactg

SEQ ID NO: 182737 - DNA, 25 bp, Rattus norvegicus
atccttcattgacctactcgcttga

SEQ ID NO: 182738 - DNA, 25 bp, Rattus norvegicus
atccttcattgagctactcgcttga

SEQ ID NO: 182739 - DNA, 25 bp, Rattus norvegicus
atccttccatgcatacagtgttcac

SEQ ID NO: 182740 - DNA, 25 bp, Rattus norvegicus
atccttccatgcttacagtgttcac

SEQ ID NO: 182741 - DNA, 25 bp, Rattus norvegicus
atccttccattcaagaactcagtct

SEQ ID NO: 182742 - DNA, 25 bp, Rattus norvegicus
atccttccattctagaactcagtct

SEQ ID NO: 182743 - DNA, 25 bp, Rattus norvegicus
atccttcccaaacaattctaccaag

SEQ ID NO: 182744 - DNA, 25 bp, Rattus norvegicus
atccttcccaaagaattctaccaag

SEQ ID NO: 182745 - DNA, 25 bp, Rattus norvegicus
atccttcccctcagtatctgtatga

SEQ ID NO: 182746 - DNA, 25 bp, Rattus norvegicus
atccttcccctctgtatctgtatga

SEQ ID NO: 182747 - DNA, 25 bp, Rattus norvegicus
atccttccctacctaatgagtttga

SEQ ID NO: 182748 - DNA, 25 bp, Rattus norvegicus
atccttccctacgtaatgagtttga

SEQ ID NO: 182749 - DNA, 25 bp, Rattus norvegicus
atccttccctatcacaagcaagaga

SEQ ID NO: 182750 - DNA, 25 bp, Rattus norvegicus
atccttccctatgacaagcaagaga

SEQ ID NO: 182751 - DNA, 25 bp, Rattus norvegicus
atccttccctgactgagacctaatg

SEQ ID NO: 182752 - DNA, 25 bp, Rattus norvegicus
atccttccctgagtgagacctaatg

SEQ ID NO: 182753 - DNA, 25 bp, Rattus norvegicus
atccttccctgtacgcatctttaga

SEQ ID NO: 182754 - DNA, 25 bp, Rattus norvegicus
atccttccctgttcgcatctttaga

SEQ ID NO: 182755 - DNA, 25 bp, Rattus norvegicus
atccttccgctgagtcactttgaaa

SEQ ID NO: 182756 - DNA, 25 bp, Rattus norvegicus
atccttccgctgtgtcactttgaaa

SEQ ID NO: 182757 - DNA, 25 bp, Rattus norvegicus
atccttcctggactattgtgtctta

SEQ ID NO: 182758 - DNA, 25 bp, Rattus norvegicus
atccttcctggagtattgtgtctta

SEQ ID NO: 182759 - DNA, 25 bp, Rattus norvegicus
atccttcctttcctaagacattgct

SEQ ID NO: 182760 - DNA, 25 bp, Rattus norvegicus
atccttcctttcgtaagacattgct

SEQ ID NO: 182761 - DNA, 25 bp, Rattus norvegicus
atccttcggtatcgagctatggctg

SEQ ID NO: 182762 - DNA, 25 bp, Rattus norvegicus
atccttcggtatggagctatggctg

SEQ ID NO: 182763 - DNA, 25 bp, Rattus norvegicus
atccttctagatagctcccagcatt

SEQ ID NO: 182764 - DNA, 25 bp, Rattus norvegicus
atccttctagattgctcccagcatt

SEQ ID NO: 182765 - DNA, 25 bp, Rattus norvegicus
atccttctcaaacagcgttgcacaa

SEQ ID NO: 182766 - DNA, 25 bp, Rattus norvegicus
atccttctcaaagagcgttgcacaa

SEQ ID NO: 182767 - DNA, 25 bp, Rattus norvegicus
atccttctcagacacacaataacct

SEQ ID NO: 182768 - DNA, 25 bp, Rattus norvegicus
atccttctcagagacacaataacct

SEQ ID NO: 182769 - DNA, 25 bp, Rattus norvegicus
atccttctcgcacagactgtttttc

SEQ ID NO: 182770 - DNA, 25 bp, Rattus norvegicus
atccttctcgcagagactgtttttc

SEQ ID NO: 182771 - DNA, 25 bp, Rattus norvegicus
atccttctcgtcatgctgattgtga

SEQ ID NO: 182772 - DNA, 25 bp, Rattus norvegicus
atccttctcgtcttgctgattgtga

SEQ ID NO: 182773 - DNA, 25 bp, Rattus norvegicus
atccttctgagtaccaggcccctgt

SEQ ID NO: 182774 - DNA, 25 bp, Rattus norvegicus
atccttctgagttccaggcccctgt

SEQ ID NO: 182775 - DNA, 25 bp, Rattus norvegicus
atccttctgataactggactgaccc

SEQ ID NO: 182776 - DNA, 25 bp, Rattus norvegicus
atccttctgatatctggactgaccc

SEQ ID NO: 182777 - DNA, 25 bp, Rattus norvegicus
atccttctggctactagtgtggcag

SEQ ID NO: 182778 - DNA, 25 bp, Rattus norvegicus
atccttctggcttctagtgtggcag

SEQ ID NO: 182779 - DNA, 25 bp, Rattus norvegicus
atccttctgtaactcccattttatg

SEQ ID NO: 182780 - DNA, 25 bp, Rattus norvegicus
atccttctgtaagtcccattttatg

SEQ ID NO: 182781 - DNA, 25 bp, Rattus norvegicus
atccttctgtctagtatgctgtgtt

SEQ ID NO: 182782 - DNA, 25 bp, Rattus norvegicus
atccttctgtcttgtatgctgtgtt

SEQ ID NO: 182783 - DNA, 25 bp, Rattus norvegicus
atccttctgtgactgctaagagcat

SEQ ID NO: 182784 - DNA, 25 bp, Rattus norvegicus
atccttctgtgagtgctaagagcat

SEQ ID NO: 182785 - DNA, 25 bp, Rattus norvegicus
atccttctgtgtacttttctctctt

SEQ ID NO: 182786 - DNA, 25 bp, Rattus norvegicus
atccttctgtgtagtgtggccctaa

SEQ ID NO: 182787 - DNA, 25 bp, Rattus norvegicus
atccttctgtgttcttttctctctt

SEQ ID NO: 182788 - DNA, 25 bp, Rattus norvegicus
atccttctgtgttgtgtggccctaa

SEQ ID NO: 182789 - DNA, 25 bp, Rattus norvegicus
atccttcttggcatgctggttctgg

SEQ ID NO: 182790 - DNA, 25 bp, Rattus norvegicus
atccttcttggcttgctggttctgg

SEQ ID NO: 182791 - DNA, 25 bp, Rattus norvegicus
atccttgagtcacggaggctgctct

SEQ ID NO: 182792 - DNA, 25 bp, Rattus norvegicus
atccttgagtcagggaggctgctct

SEQ ID NO: 182793 - DNA, 25 bp, Rattus norvegicus
atccttgagtgaccctttcttctgt

SEQ ID NO: 182794 - DNA, 25 bp, Rattus norvegicus
atccttgagtgagcctttcttctgt

SEQ ID NO: 182795 - DNA, 25 bp, Rattus norvegicus
atccttgatttaccagttctgtcca

SEQ ID NO: 182796 - DNA, 25 bp, Rattus norvegicus
atccttgatttagcagttctgtcca

SEQ ID NO: 182797 - DNA, 25 bp, Rattus norvegicus
atccttgcactaccagaagattcat

SEQ ID NO: 182798 - DNA, 25 bp, Rattus norvegicus
atccttgcactagcagaagattcat

SEQ ID NO: 182799 - DNA, 25 bp, Rattus norvegicus
atccttgcaggaacaggctggagcc

SEQ ID NO: 182800 - DNA, 25 bp, Rattus norvegicus
atccttgcaggatcaggctggagcc

SEQ ID NO: 182801 - DNA, 25 bp, Rattus norvegicus
atccttgccagaacctatgggcagc

SEQ ID NO: 182802 - DNA, 25 bp, Rattus norvegicus
atccttgccagatcctatgggcagc

SEQ ID NO: 182803 - DNA, 25 bp, Rattus norvegicus
atccttgccttcatgcaatccaagg

SEQ ID NO: 182804 - DNA, 25 bp, Rattus norvegicus
atccttgccttcattttctggcctt

SEQ ID NO: 182805 - DNA, 25 bp, Rattus norvegicus
atccttgccttcttgcaatccaagg

SEQ ID NO: 182806 - DNA, 25 bp, Rattus norvegicus
atccttgccttctttttctggcctt

SEQ ID NO: 182807 - DNA, 25 bp, Rattus norvegicus
atccttgcgatacttgagggctcca

SEQ ID NO: 182808 - DNA, 25 bp, Rattus norvegicus
atccttgcgatagttgagggctcca

SEQ ID NO: 182809 - DNA, 25 bp, Rattus norvegicus
atccttgctaaacacgctgctgaag

SEQ ID NO: 182810 - DNA, 25 bp, Rattus norvegicus
atccttgctaaagacgctgctgaag

SEQ ID NO: 182811 - DNA, 25 bp, Rattus norvegicus
atccttgctctgcacacgtaaacaa

SEQ ID NO: 182812 - DNA, 25 bp, Rattus norvegicus
atccttgctctggacacgtaaacaa

SEQ ID NO: 182813 - DNA, 25 bp, Rattus norvegicus
atccttgcttatcggtagggcggtt

SEQ ID NO: 182814 - DNA, 25 bp, Rattus norvegicus
atccttgcttatgggtagggcggtt

SEQ ID NO: 182815 - DNA, 25 bp, Rattus norvegicus
atccttggaacactttcttatccct

SEQ ID NO: 182816 - DNA, 25 bp, Rattus norvegicus
atccttggaacagtttcttatccct

SEQ ID NO: 182817 - DNA, 25 bp, Rattus norvegicus
atccttggacagaactaccttctgg

SEQ ID NO: 182818 - DNA, 25 bp, Rattus norvegicus
atccttggacagtactaccttctgg

SEQ ID NO: 182819 - DNA, 25 bp, Rattus norvegicus
atccttggaccaacgttgccttgtt

SEQ ID NO: 182820 - DNA, 25 bp, Rattus norvegicus
atccttggaccatcgttgccttgtt

SEQ ID NO: 182821 - DNA, 25 bp, Rattus norvegicus
atccttggacttcagcagagccttt

SEQ ID NO: 182822 - DNA, 25 bp, Rattus norvegicus
atccttggacttgagcagagccttt

SEQ ID NO: 182823 - DNA, 25 bp, Rattus norvegicus
atccttggaggacactggcagctgc

SEQ ID NO: 182824 - DNA, 25 bp, Rattus norvegicus
atccttggaggagactggcagctgc

SEQ ID NO: 182825 - DNA, 25 bp, Rattus norvegicus
atccttggccatctagacctagttt

SEQ ID NO: 182826 - DNA, 25 bp, Rattus norvegicus
atccttggccatgtagacctagttt

SEQ ID NO: 182827 - DNA, 25 bp, Rattus norvegicus
atccttggcctcagacaggtcagaa

SEQ ID NO: 182828 - DNA, 25 bp, Rattus norvegicus
atccttggcctctgacaggtcagaa

SEQ ID NO: 182829 - DNA, 25 bp, Rattus norvegicus
atccttggctaccatttgaggccag

SEQ ID NO: 182830 - DNA, 25 bp, Rattus norvegicus
atccttggctacgatttgaggccag

SEQ ID NO: 182831 - DNA, 25 bp, Rattus norvegicus
atccttggctgtacatccttggaag

SEQ ID NO: 182832 - DNA, 25 bp, Rattus norvegicus
atccttggctgttcatccttggaag

SEQ ID NO: 182833 - DNA, 25 bp, Rattus norvegicus
atccttggtaatatcttgagtctcg

SEQ ID NO: 182834 - DNA, 25 bp, Rattus norvegicus
atccttggtaatcttgtctctgctt

SEQ ID NO: 182835 - DNA, 25 bp, Rattus norvegicus
atccttggtaatgttgtctctgctt

SEQ ID NO: 182836 - DNA, 25 bp, Rattus norvegicus
atccttggtaatttcttgagtctcg

SEQ ID NO: 182837 - DNA, 25 bp, Rattus norvegicus
atccttggtcctctggcaagttcaa

SEQ ID NO: 182838 - DNA, 25 bp, Rattus norvegicus
atccttggtcctgtggcaagttcaa

SEQ ID NO: 182839 - DNA, 25 bp, Rattus norvegicus
atccttggttggctcgcaggctgcc

SEQ ID NO: 182840 - DNA, 25 bp, Rattus norvegicus
atccttggttgggtcgcaggctgcc

SEQ ID NO: 182841 - DNA, 25 bp, Rattus norvegicus
atccttgtaggaattcatgctgcca

SEQ ID NO: 182842 - DNA, 25 bp, Rattus norvegicus
atccttgtaggatttcatgctgcca

SEQ ID NO: 182843 - DNA, 25 bp, Rattus norvegicus
atccttgtcaaacagcgtcacgtag

SEQ ID NO: 182844 - DNA, 25 bp, Rattus norvegicus
atccttgtcaaagagcgtcacgtag

SEQ ID NO: 182845 - DNA, 25 bp, Rattus norvegicus
atccttgtcactacttcccaaattg

SEQ ID NO: 182846 - DNA, 25 bp, Rattus norvegicus
atccttgtcacttcttcccaaattg

SEQ ID NO: 182847 - DNA, 25 bp, Rattus norvegicus
atccttgtccctaagttttcacatt

SEQ ID NO: 182848 - DNA, 25 bp, Rattus norvegicus
atccttgtcccttagttttcacatt

SEQ ID NO: 182849 - DNA, 25 bp, Rattus norvegicus
atccttgtcctgaagctccggaagg

SEQ ID NO: 182850 - DNA, 25 bp, Rattus norvegicus
atccttgtcctgtagctccggaagg

SEQ ID NO: 182851 - DNA, 25 bp, Rattus norvegicus
atccttgtgaagaggctgtaagcct

SEQ ID NO: 182852 - DNA, 25 bp, Rattus norvegicus
atccttgtgaagtggctgtaagcct

SEQ ID NO: 182853 - DNA, 25 bp, Rattus norvegicus
atccttgtgcccatgaggttctgaa

SEQ ID NO: 182854 - DNA, 25 bp, Rattus norvegicus
atccttgtgcccttgaggttctgaa

SEQ ID NO: 182855 - DNA, 25 bp, Rattus norvegicus
atccttgtgtcgaaacagtaagcct

SEQ ID NO: 182856 - DNA, 25 bp, Rattus norvegicus
atccttgtgtcgtaacagtaagcct

SEQ ID NO: 182857 - DNA, 25 bp, Rattus norvegicus
atccttgtgtctatcttaggtcagg

SEQ ID NO: 182858 - DNA, 25 bp, Rattus norvegicus
atccttgtgtctttcttaggtcagg

SEQ ID NO: 182859 - DNA, 25 bp, Rattus norvegicus
atccttgtgtggcaagtcactggcc

SEQ ID NO: 182860 - DNA, 25 bp, Rattus norvegicus
atccttgtgtgggaagtcactggcc

SEQ ID NO: 182861 - DNA, 25 bp, Rattus norvegicus
atccttgtttggatcttggagcctt

SEQ ID NO: 182862 - DNA, 25 bp, Rattus norvegicus
atccttgtttggttcttggagcctt

SEQ ID NO: 182863 - DNA, 25 bp, Rattus norvegicus
atccttgttttgctggaacccattg

SEQ ID NO: 182864 - DNA, 25 bp, Rattus norvegicus
atccttgttttggtggaacccattg

SEQ ID NO: 182865 - DNA, 25 bp, Rattus norvegicus
atcctttaggatctttgggcactaa

SEQ ID NO: 182866 - DNA, 25 bp, Rattus norvegicus
atcctttaggatgtttgggcactaa

SEQ ID NO: 182867 - DNA, 25 bp, Rattus norvegicus
atcctttatgctctatgctgtccct

SEQ ID NO: 182868 - DNA, 25 bp, Rattus norvegicus
atcctttatgctgtatgctgtccct

SEQ ID NO: 182869 - DNA, 25 bp, Rattus norvegicus
atcctttcagagcaattctatgcat

SEQ ID NO: 182870 - DNA, 25 bp, Rattus norvegicus
atcctttcagaggaattctatgcat

SEQ ID NO: 182871 - DNA, 25 bp, Rattus norvegicus
atcctttcctcaccgattcggatga

SEQ ID NO: 182872 - DNA, 25 bp, Rattus norvegicus
atcctttcctcagcgattcggatga

SEQ ID NO: 182873 - DNA, 25 bp, Rattus norvegicus
atcctttcggtcactggatgtccag

SEQ ID NO: 182874 - DNA, 25 bp, Rattus norvegicus
atcctttcggtctctggatgtccag

SEQ ID NO: 182875 - DNA, 25 bp, Rattus norvegicus
atcctttctcttatgaagcatttta

SEQ ID NO: 182876 - DNA, 25 bp, Rattus norvegicus
atcctttctcttttgaagcatttta

SEQ ID NO: 182877 - DNA, 25 bp, Rattus norvegicus
atcctttctgaaaggtgttgtccga

SEQ ID NO: 182878 - DNA, 25 bp, Rattus norvegicus
atcctttctgaatggtgttgtccga

SEQ ID NO: 182879 - DNA, 25 bp, Rattus norvegicus
atcctttctgtgcttttctgccttt

SEQ ID NO: 182880 - DNA, 25 bp, Rattus norvegicus
atcctttctgtggttttctgccttt

SEQ ID NO: 182881 - DNA, 25 bp, Rattus norvegicus
atcctttcttcgatctcaacagtga

SEQ ID NO: 182882 - DNA, 25 bp, Rattus norvegicus
atcctttcttcgttctcaacagtga

SEQ ID NO: 182883 - DNA, 25 bp, Rattus norvegicus
atcctttgaggacttctgtgctgtt

SEQ ID NO: 182884 - DNA, 25 bp, Rattus norvegicus
atcctttgaggagttctgtgctgtt

SEQ ID NO: 182885 - DNA, 25 bp, Rattus norvegicus
atcctttgccctcacatatactgtg

SEQ ID NO: 182886 - DNA, 25 bp, Rattus norvegicus
atcctttgccctgacatatactgtg

SEQ ID NO: 182887 - DNA, 25 bp, Rattus norvegicus
atcctttggaaaccttcagaactaa

SEQ ID NO: 182888 - DNA, 25 bp, Rattus norvegicus
atcctttggaaagcttcagaactaa

SEQ ID NO: 182889 - DNA, 25 bp, Rattus norvegicus
atcctttgggacaatggtgctacag

SEQ ID NO: 182890 - DNA, 25 bp, Rattus norvegicus
atcctttgggactatggtgctacag

SEQ ID NO: 182891 - DNA, 25 bp, Rattus norvegicus
atcctttgggctacgtagggctcca

SEQ ID NO: 182892 - DNA, 25 bp, Rattus norvegicus
atcctttgggcttcgtagggctcca

SEQ ID NO: 182893 - DNA, 25 bp, Rattus norvegicus
atcctttgtagtaactggcttccga

SEQ ID NO: 182894 - DNA, 25 bp, Rattus norvegicus
atcctttgtagttactggcttccga

SEQ ID NO: 182895 - DNA, 25 bp, Rattus norvegicus
atcctttgtcatcctctttgtatat

SEQ ID NO: 182896 - DNA, 25 bp, Rattus norvegicus
atcctttgtcatgctctttgtatat

SEQ ID NO: 182897 - DNA, 25 bp, Rattus norvegicus
atcctttgtctccttcttttatcct

SEQ ID NO: 182898 - DNA, 25 bp, Rattus norvegicus
atcctttgtctcgttcttttatcct

SEQ ID NO: 182899 - DNA, 25 bp, Rattus norvegicus
atcctttgtgcacggtttatacaga

SEQ ID NO: 182900 - DNA, 25 bp, Rattus norvegicus
atcctttgtgcagggtttatacaga

SEQ ID NO: 182901 - DNA, 25 bp, Rattus norvegicus
atcctttgtttgactgtatgcccat

SEQ ID NO: 182902 - DNA, 25 bp, Rattus norvegicus
atcctttgtttgtctgtatgcccat

SEQ ID NO: 182903 - DNA, 25 bp, Rattus norvegicus
atccttttactgaagcgagctgtct

SEQ ID NO: 182904 - DNA, 25 bp, Rattus norvegicus
atccttttactgtagcgagctgtct

SEQ ID NO: 182905 - DNA, 25 bp, Rattus norvegicus
atccttttagccacttctagggaca

SEQ ID NO: 182906 - DNA, 25 bp, Rattus norvegicus
atccttttagcctcttctagggaca

SEQ ID NO: 182907 - DNA, 25 bp, Rattus norvegicus
atccttttcattctcctgattcagt

SEQ ID NO: 182908 - DNA, 25 bp, Rattus norvegicus
atccttttcattgtcctgattcagt

SEQ ID NO: 182909 - DNA, 25 bp, Rattus norvegicus
atccttttgaccacttctgcttttt

SEQ ID NO: 182910 - DNA, 25 bp, Rattus norvegicus
atccttttgacctcttctgcttttt

SEQ ID NO: 182911 - DNA, 25 bp, Rattus norvegicus
atccttttgcttcaggtctgtgtat

SEQ ID NO: 182912 - DNA, 25 bp, Rattus norvegicus
atccttttgcttgaggtctgtgtat

SEQ ID NO: 182913 - DNA, 25 bp, Rattus norvegicus
atccttttgtatatcattgatactg

SEQ ID NO: 182914 - DNA, 25 bp, Rattus norvegicus
atccttttgtatttcattgatactg

SEQ ID NO: 182915 - DNA, 25 bp, Rattus norvegicus
atccttttgtctctaactcggttct

SEQ ID NO: 182916 - DNA, 25 bp, Rattus norvegicus
atccttttgtctgtaactcggttct

SEQ ID NO: 182917 - DNA, 25 bp, Rattus norvegicus
atcctttttactacaggctcttgta

SEQ ID NO: 182918 - DNA, 25 bp, Rattus norvegicus
atcctttttacttcaggctcttgta

SEQ ID NO: 182919 - DNA, 25 bp, Rattus norvegicus
atcctttttcaaccatgtgtgtgcc

SEQ ID NO: 182920 - DNA, 25 bp, Rattus norvegicus
atcctttttcaagcatgtgtgtgcc

SEQ ID NO: 182921 - DNA, 25 bp, Rattus norvegicus
atcctttttctactgtcacttctag

SEQ ID NO: 182922 - DNA, 25 bp, Rattus norvegicus
atcctttttctagtgtcacttctag

SEQ ID NO: 182923 - DNA, 25 bp, Rattus norvegicus
atcgaaacatttacagctgcctgcc

SEQ ID NO: 182924 - DNA, 25 bp, Rattus norvegicus
atcgaaacattttcagctgcctgcc

SEQ ID NO: 182925 - DNA, 25 bp, Rattus norvegicus
atcgaaaccctcatccgggatatgt

SEQ ID NO: 182926 - DNA, 25 bp, Rattus norvegicus
atcgaaaccctcttccgggatatgt

SEQ ID NO: 182927 - DNA, 25 bp, Rattus norvegicus
atcgaaacctacaaaaacattgaga

SEQ ID NO: 182928 - DNA, 25 bp, Rattus norvegicus
atcgaaacctactaaaacattgaga

SEQ ID NO: 182929 - DNA, 25 bp, Rattus norvegicus
atcgaaatagtcctgttctccttgg

SEQ ID NO: 182930 - DNA, 25 bp, Rattus norvegicus
atcgaaatagtcgtgttctccttgg

SEQ ID NO: 182931 - DNA, 25 bp, Rattus norvegicus
atcgaacacataactagcctcatca

SEQ ID NO: 182932 - DNA, 25 bp, Rattus norvegicus
atcgaacacatatctagcctcatca

SEQ ID NO: 182933 - DNA, 25 bp, Rattus norvegicus
atcgaacagctacaaatgtgatgac

SEQ ID NO: 182934 - DNA, 25 bp, Rattus norvegicus
atcgaacagctagaaatgtgatgac

SEQ ID NO: 182935 - DNA, 25 bp, Rattus norvegicus
atcgaacccctaatccctggttgag

SEQ ID NO: 182936 - DNA, 25 bp, Rattus norvegicus
atcgaacccctattccctggttgag

SEQ ID NO: 182937 - DNA, 25 bp, Rattus norvegicus
atcgaacgcgcaatgggagctgcca

SEQ ID NO: 182938 - DNA, 25 bp, Rattus norvegicus
atcgaacgcgcattgggagctgcca

SEQ ID NO: 182939 - DNA, 25 bp, Rattus norvegicus
atcgaacgggccagcaccagcgcag

SEQ ID NO: 182940 - DNA, 25 bp, Rattus norvegicus
atcgaacgggcctgcaccagcgcag

SEQ ID NO: 182941 - DNA, 25 bp, Rattus norvegicus
atcgaactggacatgcgcaccattg

SEQ ID NO: 182942 - DNA, 25 bp, Rattus norvegicus
atcgaactggacttgcgcaccattg

SEQ ID NO: 182943 - DNA, 25 bp, Rattus norvegicus
atcgaagaagaaatcgcggcctccc

SEQ ID NO: 182944 - DNA, 25 bp, Rattus norvegicus
atcgaagaagaattcgcggcctccc

SEQ ID NO: 182945 - DNA, 25 bp, Rattus norvegicus
atcgaagcacacaggaggagggtca

SEQ ID NO: 182946 - DNA, 25 bp, Rattus norvegicus
atcgaagcacactggaggagggtca

SEQ ID NO: 182947 - DNA, 25 bp, Rattus norvegicus
atcgaaggcgtcaccagaagcctca

SEQ ID NO: 182948 - DNA, 25 bp, Rattus norvegicus
atcgaaggcgtctccagaagcctca

SEQ ID NO: 182949 - DNA, 25 bp, Rattus norvegicus
atcgaagtagcccagtttatatcaa

SEQ ID NO: 182950 - DNA, 25 bp, Rattus norvegicus
atcgaagtagccgagtttatatcaa

SEQ ID NO: 182951 - DNA, 25 bp, Rattus norvegicus
atcgaatactgtatgtgagccttga

SEQ ID NO: 182952 - DNA, 25 bp, Rattus norvegicus
atcgaatactgtttgtgagccttga

SEQ ID NO: 182953 - DNA, 25 bp, Rattus norvegicus
atcgaatcctttctaatactttcta

SEQ ID NO: 182954 - DNA, 25 bp, Rattus norvegicus
atcgaatcctttgtaatactttcta

SEQ ID NO: 182955 - DNA, 25 bp, Rattus norvegicus
atcgaattaacaagtctgctagcaa

SEQ ID NO: 182956 - DNA, 25 bp, Rattus norvegicus
atcgaattaacatgtctgctagcaa

SEQ ID NO: 182957 - DNA, 25 bp, Rattus norvegicus
atcgaattcttcacagcctttatca

SEQ ID NO: 182958 - DNA, 25 bp, Rattus norvegicus
atcgaattcttctcagcctttatca

SEQ ID NO: 182959 - DNA, 25 bp, Rattus norvegicus
atcgacaagtccaacatgaacccgg

SEQ ID NO: 182960 - DNA, 25 bp, Rattus norvegicus
atcgacaagtcctacatgaacccgg

SEQ ID NO: 182961 - DNA, 25 bp, Rattus norvegicus
atcgacaccttcaaattgtcccatg

SEQ ID NO: 182962 - DNA, 25 bp, Rattus norvegicus
atcgacaccttctaattgtcccatg

SEQ ID NO: 182963 - DNA, 25 bp, Rattus norvegicus
atcgacactgtcactgtgccgtatg

SEQ ID NO: 182964 - DNA, 25 bp, Rattus norvegicus
atcgacactgtctctgtgccgtatg

SEQ ID NO: 182965 - DNA, 25 bp, Rattus norvegicus
atcgacagcatcctgggccggagaa

SEQ ID NO: 182966 - DNA, 25 bp, Rattus norvegicus
atcgacagcatcgtgggccggagaa

SEQ ID NO: 182967 - DNA, 25 bp, Rattus norvegicus
atcgacatatataaggtgcgtgtac

SEQ ID NO: 182968 - DNA, 25 bp, Rattus norvegicus
atcgacatatattaggtgcgtgtac

SEQ ID NO: 182969 - DNA, 25 bp, Rattus norvegicus
atcgacatcgtcctttaaagccaga

SEQ ID NO: 182970 - DNA, 25 bp, Rattus norvegicus
atcgacatcgtcgtttaaagccaga

SEQ ID NO: 182971 - DNA, 25 bp, Rattus norvegicus
atcgacatctctatgatccttgcag

SEQ ID NO: 182972 - DNA, 25 bp, Rattus norvegicus
atcgacatctctttgatccttgcag

SEQ ID NO: 182973 - DNA, 25 bp, Rattus norvegicus
atcgacatgtggacagccggctgca

SEQ ID NO: 182974 - DNA, 25 bp, Rattus norvegicus
atcgacatgtggtcagccggctgca

SEQ ID NO: 182975 - DNA, 25 bp, Rattus norvegicus
atcgaccacctgagtgagctgctgc

SEQ ID NO: 182976 - DNA, 25 bp, Rattus norvegicus
atcgaccacctgtgtgagctgctgc

SEQ ID NO: 182977 - DNA, 25 bp, Rattus norvegicus
atcgaccaggctcctttctttgtgt

SEQ ID NO: 182978 - DNA, 25 bp, Rattus norvegicus
atcgaccaggctgctttctttgtgt

SEQ ID NO: 182979 - DNA, 25 bp, Rattus norvegicus
atcgacccggaactgcagcgagtga

SEQ ID NO: 182980 - DNA, 25 bp, Rattus norvegicus
atcgacccggaagtgcagcgagtga

SEQ ID NO: 182981 - DNA, 25 bp, Rattus norvegicus
atcgaccctcaactcagtcatagac

SEQ ID NO: 182982 - DNA, 25 bp, Rattus norvegicus
atcgaccctcaagtcagtcatagac

SEQ ID NO: 182983 - DNA, 25 bp, Rattus norvegicus
atcgaccctgggatgtacagagata

SEQ ID NO: 182984 - DNA, 25 bp, Rattus norvegicus
atcgaccctgggttgtacagagata

SEQ ID NO: 182985 - DNA, 25 bp, Rattus norvegicus
atcgaccgccagaagtgtatgaccc

SEQ ID NO: 182986 - DNA, 25 bp, Rattus norvegicus
atcgaccgccagtagtgtatgaccc

SEQ ID NO: 182987 - DNA, 25 bp, Rattus norvegicus
atcgacgccggtcgaacagcggaca

SEQ ID NO: 182988 - DNA, 25 bp, Rattus norvegicus
atcgacgccggtggaacagcggaca

SEQ ID NO: 182989 - DNA, 25 bp, Rattus norvegicus
atcgacgtgttgcaggaccttctgg

SEQ ID NO: 182990 - DNA, 25 bp, Rattus norvegicus
atcgacgtgttggaggaccttctgg

SEQ ID NO: 182991 - DNA, 25 bp, Rattus norvegicus
atcgactagacgagctgatgcgcca

SEQ ID NO: 182992 - DNA, 25 bp, Rattus norvegicus
atcgactagacgtgctgatgcgcca

SEQ ID NO: 182993 - DNA, 25 bp, Rattus norvegicus
atcgactatcggatctgtgcctgtg

SEQ ID NO: 182994 - DNA, 25 bp, Rattus norvegicus
atcgactatcggttctgtgcctgtg

SEQ ID NO: 182995 - DNA, 25 bp, Rattus norvegicus
atcgactcaaggcatgccctagtcc

SEQ ID NO: 182996 - DNA, 25 bp, Rattus norvegicus
atcgactcaagggatgccctagtcc

SEQ ID NO: 182997 - DNA, 25 bp, Rattus norvegicus
atcgactcaggtcaactagatccgg

SEQ ID NO: 182998 - DNA, 25 bp, Rattus norvegicus
atcgactcaggtgaactagatccgg

SEQ ID NO: 182999 - DNA, 25 bp, Rattus norvegicus
atcgactggaaaaaggcgccgcctt

SEQ ID NO: 183000 - DNA, 25 bp, Rattus norvegicus
atcgactggaaataggcgccgcctt

SEQ ID NO: 183001 - DNA, 25 bp, Rattus norvegicus
atcgactggattaacaaccctccaa

SEQ ID NO: 183002 - DNA, 25 bp, Rattus norvegicus
atcgactggatttacaaccctccaa

SEQ ID NO: 183003 - DNA, 25 bp, Rattus norvegicus
atcgacttcatgacccgagagacgg

SEQ ID NO: 183004 - DNA, 25 bp, Rattus norvegicus
atcgacttcatgtcccgagagacgg

SEQ ID NO: 183005 - DNA, 25 bp, Rattus norvegicus
atcgacttcggtatcagttggagtt

SEQ ID NO: 183006 - DNA, 25 bp, Rattus norvegicus
atcgacttcggtttcagttggagtt

SEQ ID NO: 183007 - DNA, 25 bp, Rattus norvegicus
atcgacttcgtaagtactttcgtgt

SEQ ID NO: 183008 - DNA, 25 bp, Rattus norvegicus
atcgacttcgtatgtactttcgtgt

SEQ ID NO: 183009 - DNA, 25 bp, Rattus norvegicus
atcgactttgacagcttcatctgct

SEQ ID NO: 183010 - DNA, 25 bp, Rattus norvegicus
atcgactttgactgcttcatctgct

SEQ ID NO: 183011 - DNA, 25 bp, Rattus norvegicus
atcgagaccttcctgctgggcgtct

SEQ ID NO: 183012 - DNA, 25 bp, Rattus norvegicus
atcgagaccttcgtgctgggcgtct

SEQ ID NO: 183013 - DNA, 25 bp, Rattus norvegicus
atcgagacgctcatccgggacatgc

SEQ ID NO: 183014 - DNA, 25 bp, Rattus norvegicus
atcgagacgctcttccgggacatgc

SEQ ID NO: 183015 - DNA, 25 bp, Rattus norvegicus
atcgagagccctatgaacacacatg

SEQ ID NO: 183016 - DNA, 25 bp, Rattus norvegicus
atcgagagccctttgaacacacatg

SEQ ID NO: 183017 - DNA, 25 bp, Rattus norvegicus
atcgagatcgcgcacggcgtctgcc

SEQ ID NO: 183018 - DNA, 25 bp, Rattus norvegicus
atcgagatcgcggacggcgtctgcc

SEQ ID NO: 183019 - DNA, 25 bp, Rattus norvegicus
atcgagatttatctccctgaggccc

SEQ ID NO: 183020 - DNA, 25 bp, Rattus norvegicus
atcgagatttatgtccctgaggccc

SEQ ID NO: 183021 - DNA, 25 bp, Rattus norvegicus
atcgagcacctacggaagcacgggc

SEQ ID NO: 183022 - DNA, 25 bp, Rattus norvegicus
atcgagcacctagggaagcacgggc

SEQ ID NO: 183023 - DNA, 25 bp, Rattus norvegicus
atcgagcagcatcatggccagcggt

SEQ ID NO: 183024 - DNA, 25 bp, Rattus norvegicus
atcgagcagcatgatggccagcggt

SEQ ID NO: 183025 - DNA, 25 bp, Rattus norvegicus
atcgagcaggtcagttcccaaatca

SEQ ID NO: 183026 - DNA, 25 bp, Rattus norvegicus
atcgagcaggtctgttcccaaatca

SEQ ID NO: 183027 - DNA, 25 bp, Rattus norvegicus
atcgagccaggcagcacagtgacgg

SEQ ID NO: 183028 - DNA, 25 bp, Rattus norvegicus
atcgagccaggctgcacagtgacgg

SEQ ID NO: 183029 - DNA, 25 bp, Rattus norvegicus
atcgagccgtcccttcgtcagcttg

SEQ ID NO: 183030 - DNA, 25 bp, Rattus norvegicus
atcgagccgtccgttcgtcagcttg

SEQ ID NO: 183031 - DNA, 25 bp, Rattus norvegicus
atcgagcgaagaaggcagcccgacc

SEQ ID NO: 183032 - DNA, 25 bp, Rattus norvegicus
atcgagcgaagatggcagcccgacc

SEQ ID NO: 183033 - DNA, 25 bp, Rattus norvegicus
atcgagctgaggaccagcatgggca

SEQ ID NO: 183034 - DNA, 25 bp, Rattus norvegicus
atcgagctgaggtccagcatgggca

SEQ ID NO: 183035 - DNA, 25 bp, Rattus norvegicus
atcgaggacctgacagaaaaggaca

SEQ ID NO: 183036 - DNA, 25 bp, Rattus norvegicus
atcgaggacctgtcagaaaaggaca

SEQ ID NO: 183037 - DNA, 25 bp, Rattus norvegicus
atcgaggagcccactgaagccagga

SEQ ID NO: 183038 - DNA, 25 bp, Rattus norvegicus
atcgaggagccctctgaagccagga

SEQ ID NO: 183039 - DNA, 25 bp, Rattus norvegicus
atcgaggatcctctccaagagaaag

SEQ ID NO: 183040 - DNA, 25 bp, Rattus norvegicus
atcgaggatcctgtccaagagaaag

SEQ ID NO: 183041 - DNA, 25 bp, Rattus norvegicus
atcgaggatggtcggtccccgtcca

SEQ ID NO: 183042 - DNA, 25 bp, Rattus norvegicus
atcgaggatggtgggtccccgtcca

SEQ ID NO: 183043 - DNA, 25 bp, Rattus norvegicus
atcgaggcccagcataggtccagca

SEQ ID NO: 183044 - DNA, 25 bp, Rattus norvegicus
atcgaggcccaggataggtccagca

SEQ ID NO: 183045 - DNA, 25 bp, Rattus norvegicus
atcgaggctctcagccatgaggcaa

SEQ ID NO: 183046 - DNA, 25 bp, Rattus norvegicus
atcgaggctctctgccatgaggcaa

SEQ ID NO: 183047 - DNA, 25 bp, Rattus norvegicus
atcgaggtctgcagtggctccgtga

SEQ ID NO: 183048 - DNA, 25 bp, Rattus norvegicus
atcgaggtctgctgtggctccgtga

SEQ ID NO: 183049 - DNA, 25 bp, Rattus norvegicus
atcgaggtgctcaacacggattcca

SEQ ID NO: 183050 - DNA, 25 bp, Rattus norvegicus
atcgaggtgctctacacggattcca

SEQ ID NO: 183051 - DNA, 25 bp, Rattus norvegicus
atcgagtctgttagggtgctttgca

SEQ ID NO: 183052 - DNA, 25 bp, Rattus norvegicus
atcgagtctgtttgggtgctttgca

SEQ ID NO: 183053 - DNA, 25 bp, Rattus norvegicus
atcgagtcttctcttgcatctttaa

SEQ ID NO: 183054 - DNA, 25 bp, Rattus norvegicus
atcgagtcttctgttgcatctttaa

SEQ ID NO: 183055 - DNA, 25 bp, Rattus norvegicus
atcgagtctttgaaccttggagtcc

SEQ ID NO: 183056 - DNA, 25 bp, Rattus norvegicus
atcgagtctttgtaccttggagtcc

SEQ ID NO: 183057 - DNA, 25 bp, Rattus norvegicus
atcgagtgcactcttttctaaccgc

SEQ ID NO: 183058 - DNA, 25 bp, Rattus norvegicus
atcgagtgcactgttttctaaccgc

SEQ ID NO: 183059 - DNA, 25 bp, Rattus norvegicus
atcgagtgcctgctggagatccctg

SEQ ID NO: 183060 - DNA, 25 bp, Rattus norvegicus
atcgagtgcctggtggagatccctg

SEQ ID NO: 183061 - DNA, 25 bp, Rattus norvegicus
atcgagtgctctattgttcagtcca

SEQ ID NO: 183062 - DNA, 25 bp, Rattus norvegicus
atcgagtgctcttttgttcagtcca

SEQ ID NO: 183063 - DNA, 25 bp, Rattus norvegicus
atcgagttcagccaatcccagaggt

SEQ ID NO: 183064 - DNA, 25 bp, Rattus norvegicus
atcgagttcagcgaatcccagaggt

SEQ ID NO: 183065 - DNA, 25 bp, Rattus norvegicus
atcgagttgctaagtccactccagt

SEQ ID NO: 183066 - DNA, 25 bp, Rattus norvegicus
atcgagttgctatgtccactccagt

SEQ ID NO: 183067 - DNA, 25 bp, Rattus norvegicus
atcgagttggcacagctggagctca

SEQ ID NO: 183068 - DNA, 25 bp, Rattus norvegicus
atcgagttggcagagctggagctca

SEQ ID NO: 183069 - DNA, 25 bp, Rattus norvegicus
atcgagtttctcatttcctttgtga

SEQ ID NO: 183070 - DNA, 25 bp, Rattus norvegicus
atcgagtttctcttttcctttgtga

SEQ ID NO: 183071 - DNA, 25 bp, Rattus norvegicus
atcgataacttgagatcagtacatc

SEQ ID NO: 183072 - DNA, 25 bp, Rattus norvegicus
atcgataacttgtgatcagtacatc

SEQ ID NO: 183073 - DNA, 25 bp, Rattus norvegicus
atcgatacagttattggctccctgc

SEQ ID NO: 183074 - DNA, 25 bp, Rattus norvegicus
atcgatacagtttttggctccctgc

SEQ ID NO: 183075 - DNA, 25 bp, Rattus norvegicus
atcgatacgatgagaggccgcgcca

SEQ ID NO: 183076 - DNA, 25 bp, Rattus norvegicus
atcgatacgatgtgaggccgcgcca

SEQ ID NO: 183077 - DNA, 25 bp, Rattus norvegicus
atcgatagcccgatccattccttag

SEQ ID NO: 183078 - DNA, 25 bp, Rattus norvegicus
atcgatagcccgttccattccttag

SEQ ID NO: 183079 - DNA, 25 bp, Rattus norvegicus
atcgatagctagactgacagactga

SEQ ID NO: 183080 - DNA, 25 bp, Rattus norvegicus
atcgatagctagtctgacagactga

SEQ ID NO: 183081 - DNA, 25 bp, Rattus norvegicus
atcgatatcaccctccacataagaa

SEQ ID NO: 183082 - DNA, 25 bp, Rattus norvegicus
atcgatatcaccgtccacataagaa

SEQ ID NO: 183083 - DNA, 25 bp, Rattus norvegicus
atcgatcagtagaggcttggttaca

SEQ ID NO: 183084 - DNA, 25 bp, Rattus norvegicus
atcgatcagtagtggcttggttaca

SEQ ID NO: 183085 - DNA, 25 bp, Rattus norvegicus
atcgatccagtccacaggcgagtca

SEQ ID NO: 183086 - DNA, 25 bp, Rattus norvegicus
atcgatccagtcgacaggcgagtca

SEQ ID NO: 183087 - DNA, 25 bp, Rattus norvegicus
atcgatcctgtgagactgctttggt

SEQ ID NO: 183088 - DNA, 25 bp, Rattus norvegicus
atcgatcctgtgtgactgctttggt

SEQ ID NO: 183089 - DNA, 25 bp, Rattus norvegicus
atcgatctacatactactcaggacc

SEQ ID NO: 183090 - DNA, 25 bp, Rattus norvegicus
atcgatctacattctactcaggacc

SEQ ID NO: 183091 - DNA, 25 bp, Rattus norvegicus
atcgatctcgtgaggcccggaagga

SEQ ID NO: 183092 - DNA, 25 bp, Rattus norvegicus
atcgatctcgtgtggcccggaagga

SEQ ID NO: 183093 - DNA, 25 bp, Rattus norvegicus
atcgatctgggtcatttcatctcta

SEQ ID NO: 183094 - DNA, 25 bp, Rattus norvegicus
atcgatctgggtgatttcatctcta

SEQ ID NO: 183095 - DNA, 25 bp, Rattus norvegicus
atcgatctggtacccgcaactttgc

SEQ ID NO: 183096 - DNA, 25 bp, Rattus norvegicus
atcgatctggtagccgcaactttgc

SEQ ID NO: 183097 - DNA, 25 bp, Rattus norvegicus
atcgatctggtgacaaaagccacag

SEQ ID NO: 183098 - DNA, 25 bp, Rattus norvegicus
atcgatctggtgtcaaaagccacag

SEQ ID NO: 183099 - DNA, 25 bp, Rattus norvegicus
atcgatctgtctctaaaatagtagc

SEQ ID NO: 183100 - DNA, 25 bp, Rattus norvegicus
atcgatctgtctgtaaaatagtagc

SEQ ID NO: 183101 - DNA, 25 bp, Rattus norvegicus
atcgatctgttccagtccttgcgaa

SEQ ID NO: 183102 - DNA, 25 bp, Rattus norvegicus
atcgatctgttcgagtccttgcgaa

SEQ ID NO: 183103 - DNA, 25 bp, Rattus norvegicus
atcgatgaatgtctgctctctgtca

SEQ ID NO: 183104 - DNA, 25 bp, Rattus norvegicus
atcgatgaatgtgtgctctctgtca

SEQ ID NO: 183105 - DNA, 25 bp, Rattus norvegicus
atcgatgacgacctggtgacggcca

SEQ ID NO: 183106 - DNA, 25 bp, Rattus norvegicus
atcgatgacgacgtggtgacggcca

SEQ ID NO: 183107 - DNA, 25 bp, Rattus norvegicus
atcgatgatgtgcagatgcccctgg

SEQ ID NO: 183108 - DNA, 25 bp, Rattus norvegicus
atcgatgatgtggagatgcccctgg

SEQ ID NO: 183109 - DNA, 25 bp, Rattus norvegicus
atcgatgccagcacagccatggaca

SEQ ID NO: 183110 - DNA, 25 bp, Rattus norvegicus
atcgatgccagctcagccatggaca

SEQ ID NO: 183111 - DNA, 25 bp, Rattus norvegicus
atcgatgctcgtaatgacagtttta

SEQ ID NO: 183112 - DNA, 25 bp, Rattus norvegicus
atcgatgctcgttatgacagtttta

SEQ ID NO: 183113 - DNA, 25 bp, Rattus norvegicus
atcgatggccttctggacagattgc

SEQ ID NO: 183114 - DNA, 25 bp, Rattus norvegicus
atcgatggccttgtggacagattgc

SEQ ID NO: 183115 - DNA, 25 bp, Rattus norvegicus
atcgatgggctcaaactagctgtga

SEQ ID NO: 183116 - DNA, 25 bp, Rattus norvegicus
atcgatgggctctaactagctgtga

SEQ ID NO: 183117 - DNA, 25 bp, Rattus norvegicus
atcgatggtgtccttcaccttactt

SEQ ID NO: 183118 - DNA, 25 bp, Rattus norvegicus
atcgatggtgtcgttcaccttactt

SEQ ID NO: 183119 - DNA, 25 bp, Rattus norvegicus
atcgatgtcatacagcggagagcca

SEQ ID NO: 183120 - DNA, 25 bp, Rattus norvegicus
atcgatgtcatagagcggagagcca

SEQ ID NO: 183121 - DNA, 25 bp, Rattus norvegicus
atcgatgtcctaaagcagccaaaaa

SEQ ID NO: 183122 - DNA, 25 bp, Rattus norvegicus
atcgatgtcctatagcagccaaaaa

SEQ ID NO: 183123 - DNA, 25 bp, Rattus norvegicus
atcgatgtgatccttgcattgcttc

SEQ ID NO: 183124 - DNA, 25 bp, Rattus norvegicus
atcgatgtgatcgttgcattgcttc

SEQ ID NO: 183125 - DNA, 25 bp, Rattus norvegicus
atcgatgtggtgagtgtcctaagac

SEQ ID NO: 183126 - DNA, 25 bp, Rattus norvegicus
atcgatgtggtgtgtgtcctaagac

SEQ ID NO: 183127 - DNA, 25 bp, Rattus norvegicus
atcgatgtgtctacgcagctcgcac

SEQ ID NO: 183128 - DNA, 25 bp, Rattus norvegicus
atcgatgtgtcttcgcagctcgcac

SEQ ID NO: 183129 - DNA, 25 bp, Rattus norvegicus
atcgatgttctcactctgagcagac

SEQ ID NO: 183130 - DNA, 25 bp, Rattus norvegicus
atcgatgttctctctctgagcagac

SEQ ID NO: 183131 - DNA, 25 bp, Rattus norvegicus
atcgatgttgtaatcacagtggctg

SEQ ID NO: 183132 - DNA, 25 bp, Rattus norvegicus
atcgatgttgtattcacagtggctg

SEQ ID NO: 183133 - DNA, 25 bp, Rattus norvegicus
atcgatgtttcgctgtagctcttcc

SEQ ID NO: 183134 - DNA, 25 bp, Rattus norvegicus
atcgatgtttcggtgtagctcttcc

SEQ ID NO: 183135 - DNA, 25 bp, Rattus norvegicus
atcgattcctttctatccactactc

SEQ ID NO: 183136 - DNA, 25 bp, Rattus norvegicus
atcgattcctttgtatccactactc

SEQ ID NO: 183137 - DNA, 25 bp, Rattus norvegicus
atcgattggcagaacacctagtccc

SEQ ID NO: 183138 - DNA, 25 bp, Rattus norvegicus
atcgattggcagtacacctagtccc

SEQ ID NO: 183139 - DNA, 25 bp, Rattus norvegicus
atcgattttaccacggatatcctgc

SEQ ID NO: 183140 - DNA, 25 bp, Rattus norvegicus
atcgattttacctcggatatcctgc

SEQ ID NO: 183141 - DNA, 25 bp, Rattus norvegicus
atcgattttgctatataaatggcgg

SEQ ID NO: 183142 - DNA, 25 bp, Rattus norvegicus
atcgattttgctttataaatggcgg

SEQ ID NO: 183143 - DNA, 25 bp, Rattus norvegicus
atcgattttgtgagctccatgctcc

SEQ ID NO: 183144 - DNA, 25 bp, Rattus norvegicus
atcgattttgtgtgctccatgctcc

SEQ ID NO: 183145 - DNA, 25 bp, Rattus norvegicus
atcgatttttctcccaagtgctctt

SEQ ID NO: 183146 - DNA, 25 bp, Rattus norvegicus
atcgatttttctgccaagtgctctt

SEQ ID NO: 183147 - DNA, 25 bp, Rattus norvegicus
atcgcaaacacaataacccttccat

SEQ ID NO: 183148 - DNA, 25 bp, Rattus norvegicus
atcgcaaacacattaacccttccat

SEQ ID NO: 183149 - DNA, 25 bp, Rattus norvegicus
atcgcaaacttgaccctgactatat

SEQ ID NO: 183150 - DNA, 25 bp, Rattus norvegicus
atcgcaaacttgtccctgactatat

SEQ ID NO: 183151 - DNA, 25 bp, Rattus norvegicus
atcgcaaatgtaagtcttctcctct

SEQ ID NO: 183152 - DNA, 25 bp, Rattus norvegicus
atcgcaaatgtatgtcttctcctct

SEQ ID NO: 183153 - DNA, 25 bp, Rattus norvegicus
atcgcaacgatcactttagcagctg

SEQ ID NO: 183154 - DNA, 25 bp, Rattus norvegicus
atcgcaacgatctctttagcagctg

SEQ ID NO: 183155 - DNA, 25 bp, Rattus norvegicus
atcgcaagaaacagtctcagcccat

SEQ ID NO: 183156 - DNA, 25 bp, Rattus norvegicus
atcgcaagaaactgtctcagcccat

SEQ ID NO: 183157 - DNA, 25 bp, Rattus norvegicus
atcgcaaggtaaacccgacggcgaa

SEQ ID NO: 183158 - DNA, 25 bp, Rattus norvegicus
atcgcaaggtaatcccgacggcgaa

SEQ ID NO: 183159 - DNA, 25 bp, Rattus norvegicus
atcgcacagagcaacacggacaact

SEQ ID NO: 183160 - DNA, 25 bp, Rattus norvegicus
atcgcacagagctacacggacaact

SEQ ID NO: 183161 - DNA, 25 bp, Rattus norvegicus
atcgcacagttaacatttcccagct

SEQ ID NO: 183162 - DNA, 25 bp, Rattus norvegicus
atcgcacagttatcatttcccagct

SEQ ID NO: 183163 - DNA, 25 bp, Rattus norvegicus
atcgcaccccacagcctggatgaag

SEQ ID NO: 183164 - DNA, 25 bp, Rattus norvegicus
atcgcaccccactgcctggatgaag

SEQ ID NO: 183165 - DNA, 25 bp, Rattus norvegicus
atcgcaccctggactatggaggaat

SEQ ID NO: 183166 - DNA, 25 bp, Rattus norvegicus
atcgcaccctggtctatggaggaat

SEQ ID NO: 183167 - DNA, 25 bp, Rattus norvegicus
atcgcacgactcatagccaaactaa

SEQ ID NO: 183168 - DNA, 25 bp, Rattus norvegicus
atcgcacgactcttagccaaactaa

SEQ ID NO: 183169 - DNA, 25 bp, Rattus norvegicus
atcgcactgagcctgacctctcggg

SEQ ID NO: 183170 - DNA, 25 bp, Rattus norvegicus
atcgcactgagcgtgacctctcggg

SEQ ID NO: 183171 - DNA, 25 bp, Rattus norvegicus
atcgcactgctcaacaacttattca

SEQ ID NO: 183172 - DNA, 25 bp, Rattus norvegicus
atcgcactgctctacaacttattca

SEQ ID NO: 183173 - DNA, 25 bp, Rattus norvegicus
atcgcagaagccatgcctctactag

SEQ ID NO: 183174 - DNA, 25 bp, Rattus norvegicus
atcgcagaagccttgcctctactag

SEQ ID NO: 183175 - DNA, 25 bp, Rattus norvegicus
atcgcagacctgacctttatggcag

SEQ ID NO: 183176 - DNA, 25 bp, Rattus norvegicus
atcgcagacctgtcctttatggcag

SEQ ID NO: 183177 - DNA, 25 bp, Rattus norvegicus
atcgcagagatgcttcggcacgccc

SEQ ID NO: 183178 - DNA, 25 bp, Rattus norvegicus
atcgcagagatggttcggcacgccc

SEQ ID NO: 183179 - DNA, 25 bp, Rattus norvegicus
atcgcagatgcgctcatcgaggtct

SEQ ID NO: 183180 - DNA, 25 bp, Rattus norvegicus
atcgcagatgcggtcatcgaggtct

SEQ ID NO: 183181 - DNA, 25 bp, Rattus norvegicus
atcgcagcacagacggcaggcatag

SEQ ID NO: 183182 - DNA, 25 bp, Rattus norvegicus
atcgcagcacagtcggcaggcatag

SEQ ID NO: 183183 - DNA, 25 bp, Rattus norvegicus
atcgcagcaccaccagagaagctgt

SEQ ID NO: 183184 - DNA, 25 bp, Rattus norvegicus
atcgcagcaccagcagagaagctgt

SEQ ID NO: 183185 - DNA, 25 bp, Rattus norvegicus
atcgcagcagagatcattgcccaag

SEQ ID NO: 183186 - DNA, 25 bp, Rattus norvegicus
atcgcagcagagttcattgcccaag

SEQ ID NO: 183187 - DNA, 25 bp, Rattus norvegicus
atcgcagctaccagaaggagttccg

SEQ ID NO: 183188 - DNA, 25 bp, Rattus norvegicus
atcgcagctacctgaaggagttccg

SEQ ID NO: 183189 - DNA, 25 bp, Rattus norvegicus
atcgcagctccaagaggaggcaggt

SEQ ID NO: 183190 - DNA, 25 bp, Rattus norvegicus
atcgcagctccatgaggaggcaggt

SEQ ID NO: 183191 - DNA, 25 bp, Rattus norvegicus
atcgcaggcgacaacttagggtcac

SEQ ID NO: 183192 - DNA, 25 bp, Rattus norvegicus
atcgcaggcgactacttagggtcac

SEQ ID NO: 183193 - DNA, 25 bp, Rattus norvegicus
atcgcagggcttccatttcgctggc

SEQ ID NO: 183194 - DNA, 25 bp, Rattus norvegicus
atcgcagggcttgcatttcgctggc

SEQ ID NO: 183195 - DNA, 25 bp, Rattus norvegicus
atcgcaggtgccatctacagtatct

SEQ ID NO: 183196 - DNA, 25 bp, Rattus norvegicus
atcgcaggtgccttctacagtatct

SEQ ID NO: 183197 - DNA, 25 bp, Rattus norvegicus
atcgcagtattgaccatcatccttg

SEQ ID NO: 183198 - DNA, 25 bp, Rattus norvegicus
atcgcagtattgtccatcatccttg

SEQ ID NO: 183199 - DNA, 25 bp, Rattus norvegicus
atcgcagtctcacttgtccttagga

SEQ ID NO: 183200 - DNA, 25 bp, Rattus norvegicus
atcgcagtctcagttgtccttagga

SEQ ID NO: 183201 - DNA, 25 bp, Rattus norvegicus
atcgcagttggacactccttctgag

SEQ ID NO: 183202 - DNA, 25 bp, Rattus norvegicus
atcgcagttggagactccttctgag

SEQ ID NO: 183203 - DNA, 25 bp, Rattus norvegicus
atcgcagtttctacctgcaatgttt

SEQ ID NO: 183204 - DNA, 25 bp, Rattus norvegicus
atcgcagtttcttcctgcaatgttt

SEQ ID NO: 183205 - DNA, 25 bp, Rattus norvegicus
atcgcatgtatgaaacctcccagaa

SEQ ID NO: 183206 - DNA, 25 bp, Rattus norvegicus
atcgcatgtatgtaacctcccagaa

SEQ ID NO: 183207 - DNA, 25 bp, Rattus norvegicus
atcgcatgtctgaatatgtctggct

SEQ ID NO: 183208 - DNA, 25 bp, Rattus norvegicus
atcgcatgtctgtatatgtctggct

SEQ ID NO: 183209 - DNA, 25 bp, Rattus norvegicus
atcgcattcatgatctgtgtgcaca

SEQ ID NO: 183210 - DNA, 25 bp, Rattus norvegicus
atcgcattcatgttctgtgtgcaca

SEQ ID NO: 183211 - DNA, 25 bp, Rattus norvegicus
atcgccaacgcgatcacgtgcgcag

SEQ ID NO: 183212 - DNA, 25 bp, Rattus norvegicus
atcgccaacgcgttcacgtgcgcag

SEQ ID NO: 183213 - DNA, 25 bp, Rattus norvegicus
atcgccaagatgcatgctactgcca

SEQ ID NO: 183214 - DNA, 25 bp, Rattus norvegicus
atcgccaagatggatgctactgcca

SEQ ID NO: 183215 - DNA, 25 bp, Rattus norvegicus
atcgccaattacagccaaacacttt

SEQ ID NO: 183216 - DNA, 25 bp, Rattus norvegicus
atcgccaattactgccaaacacttt

SEQ ID NO: 183217 - DNA, 25 bp, Rattus norvegicus
atcgccacagtgcatgatgccatcc

SEQ ID NO: 183218 - DNA, 25 bp, Rattus norvegicus
atcgccacagtggatgatgccatcc

SEQ ID NO: 183219 - DNA, 25 bp, Rattus norvegicus
atcgccactgtaagtgactttagca

SEQ ID NO: 183220 - DNA, 25 bp, Rattus norvegicus
atcgccactgtatgtgactttagca

SEQ ID NO: 183221 - DNA, 25 bp, Rattus norvegicus
atcgccacttgcagggtcaggtttt

SEQ ID NO: 183222 - DNA, 25 bp, Rattus norvegicus
atcgccacttgctgggtcaggtttt

SEQ ID NO: 183223 - DNA, 25 bp, Rattus norvegicus
atcgccagcaccatgggccgaatgt

SEQ ID NO: 183224 - DNA, 25 bp, Rattus norvegicus
atcgccagcaccttgggccgaatgt

SEQ ID NO: 183225 - DNA, 25 bp, Rattus norvegicus
atcgccagcatccttgtttacaagt

SEQ ID NO: 183226 - DNA, 25 bp, Rattus norvegicus
atcgccagcatcgttgtttacaagt

SEQ ID NO: 183227 - DNA, 25 bp, Rattus norvegicus
atcgccagcctcagtgtttgtaagc

SEQ ID NO: 183228 - DNA, 25 bp, Rattus norvegicus
atcgccagcctctgtgtttgtaagc

SEQ ID NO: 183229 - DNA, 25 bp, Rattus norvegicus
atcgccagcttcagtatgttacttc

SEQ ID NO: 183230 - DNA, 25 bp, Rattus norvegicus
atcgccagcttctgtatgttacttc

SEQ ID NO: 183231 - DNA, 25 bp, Rattus norvegicus
atcgccataggccaaggtgcatata

SEQ ID NO: 183232 - DNA, 25 bp, Rattus norvegicus
atcgccataggcgaaggtgcatata

SEQ ID NO: 183233 - DNA, 25 bp, Rattus norvegicus
atcgccatcgtgattcaggtctgca

SEQ ID NO: 183234 - DNA, 25 bp, Rattus norvegicus
atcgccatcgtgtttcaggtctgca

SEQ ID NO: 183235 - DNA, 25 bp, Rattus norvegicus
atcgccatggccattcaaagcgcgc

SEQ ID NO: 183236 - DNA, 25 bp, Rattus norvegicus
atcgccatggcctttcaaagcgcgc

SEQ ID NO: 183237 - DNA, 25 bp, Rattus norvegicus
atcgccattgacaacggaagagcag

SEQ ID NO: 183238 - DNA, 25 bp, Rattus norvegicus
atcgccattgactacggaagagcag

SEQ ID NO: 183239 - DNA, 25 bp, Rattus norvegicus
atcgcccaacatcatgctgtggtag

SEQ ID NO: 183240 - DNA, 25 bp, Rattus norvegicus
atcgcccaacatgatgctgtggtag

SEQ ID NO: 183241 - DNA, 25 bp, Rattus norvegicus
atcgccctcagcaaggccgatatgc

SEQ ID NO: 183242 - DNA, 25 bp, Rattus norvegicus
atcgccctcagctaggccgatatgc

SEQ ID NO: 183243 - DNA, 25 bp, Rattus norvegicus
atcgccctggcgaggttcaacgtag

SEQ ID NO: 183244 - DNA, 25 bp, Rattus norvegicus
atcgccctggcgtggttcaacgtag

SEQ ID NO: 183245 - DNA, 25 bp, Rattus norvegicus
atcgccctgttcattgtctgaagga

SEQ ID NO: 183246 - DNA, 25 bp, Rattus norvegicus
atcgccctgttctttgtctgaagga

SEQ ID NO: 183247 - DNA, 25 bp, Rattus norvegicus
atcgcccttgctacaggacagagtg

SEQ ID NO: 183248 - DNA, 25 bp, Rattus norvegicus
atcgcccttgcttcaggacagagtg

SEQ ID NO: 183249 - DNA, 25 bp, Rattus norvegicus
atcgccctttcaaagtcttcataaa

SEQ ID NO: 183250 - DNA, 25 bp, Rattus norvegicus
atcgccctttcatagtcttcataaa

SEQ ID NO: 183251 - DNA, 25 bp, Rattus norvegicus
atcgccgaagagagtttttggagtt

SEQ ID NO: 183252 - DNA, 25 bp, Rattus norvegicus
atcgccgaagagtgtttttggagtt

SEQ ID NO: 183253 - DNA, 25 bp, Rattus norvegicus
atcgccgagaaactggacctcaaaa

SEQ ID NO: 183254 - DNA, 25 bp, Rattus norvegicus
atcgccgagaaagtggacctcaaaa

SEQ ID NO: 183255 - DNA, 25 bp, Rattus norvegicus
atcgccgagaatcaccttgcagact

SEQ ID NO: 183256 - DNA, 25 bp, Rattus norvegicus
atcgccgagaatgaccttgcagact

SEQ ID NO: 183257 - DNA, 25 bp, Rattus norvegicus
atcgccgccgcgacaagacgacaaa

SEQ ID NO: 183258 - DNA, 25 bp, Rattus norvegicus
atcgccgccgcgtcaagacgacaaa

SEQ ID NO: 183259 - DNA, 25 bp, Rattus norvegicus
atcgccggtgccaagaggaagcctc

SEQ ID NO: 183260 - DNA, 25 bp, Rattus norvegicus
atcgccggtgcctagaggaagcctc

SEQ ID NO: 183261 - DNA, 25 bp, Rattus norvegicus
atcgccgtcctgaggatgaaggcca

SEQ ID NO: 183262 - DNA, 25 bp, Rattus norvegicus
atcgccgtcctgtggatgaaggcca

SEQ ID NO: 183263 - DNA, 25 bp, Rattus norvegicus
atcgccgtgactccctatcagaatg

SEQ ID NO: 183264 - DNA, 25 bp, Rattus norvegicus
atcgccgtgactgcctatcagaatg

SEQ ID NO: 183265 - DNA, 25 bp, Rattus norvegicus
atcgcctaccccatgatgtaaagcg

SEQ ID NO: 183266 - DNA, 25 bp, Rattus norvegicus
atcgcctaccccttgatgtaaagcg

SEQ ID NO: 183267 - DNA, 25 bp, Rattus norvegicus
atcgcctacttgatggacgtgctgg

SEQ ID NO: 183268 - DNA, 25 bp, Rattus norvegicus
atcgcctacttgttggacgtgctgg

SEQ ID NO: 183269 - DNA, 25 bp, Rattus norvegicus
atcgcctcactgaaagacgggtcat

SEQ ID NO: 183270 - DNA, 25 bp, Rattus norvegicus
atcgcctcactgtaagacgggtcat

SEQ ID NO: 183271 - DNA, 25 bp, Rattus norvegicus
atcgcctcagttcctgctgtaataa

SEQ ID NO: 183272 - DNA, 25 bp, Rattus norvegicus
atcgcctcagttgctgctgtaataa

SEQ ID NO: 183273 - DNA, 25 bp, Rattus norvegicus
atcgcctcatgacagtgcctggcac

SEQ ID NO: 183274 - DNA, 25 bp, Rattus norvegicus
atcgcctcatgagagtgcctggcac

SEQ ID NO: 183275 - DNA, 25 bp, Rattus norvegicus
atcgcctcggaacctagtttttcat

SEQ ID NO: 183276 - DNA, 25 bp, Rattus norvegicus
atcgcctcggaagctagtttttcat

SEQ ID NO: 183277 - DNA, 25 bp, Rattus norvegicus
atcgcctctgttcccaaagctgctg

SEQ ID NO: 183278 - DNA, 25 bp, Rattus norvegicus
atcgcctctgttgccaaagctgctg

SEQ ID NO: 183279 - DNA, 25 bp, Rattus norvegicus
atcgcctcttcgacttcttcaactg

SEQ ID NO: 183280 - DNA, 25 bp, Rattus norvegicus
atcgcctcttcgtcttcttcaactg

SEQ ID NO: 183281 - DNA, 25 bp, Rattus norvegicus
atcgcctgcagtcagcgtgagcaaa

SEQ ID NO: 183282 - DNA, 25 bp, Rattus norvegicus
atcgcctgcagtgagcgtgagcaaa

SEQ ID NO: 183283 - DNA, 25 bp, Rattus norvegicus
atcgcctggatacatttcctcgtgg

SEQ ID NO: 183284 - DNA, 25 bp, Rattus norvegicus
atcgcctggatagatttcctcgtgg

SEQ ID NO: 183285 - DNA, 25 bp, Rattus norvegicus
atcgcctgtaagattaagtctggaa

SEQ ID NO: 183286 - DNA, 25 bp, Rattus norvegicus
atcgcctgtaagtttaagtctggaa

SEQ ID NO: 183287 - DNA, 25 bp, Rattus norvegicus
atcgcctgttctctaaccatcaaag

SEQ ID NO: 183288 - DNA, 25 bp, Rattus norvegicus
atcgcctgttctgtaaccatcaaag

SEQ ID NO: 183289 - DNA, 25 bp, Rattus norvegicus
atcgccttcatgctttgctggactc

SEQ ID NO: 183290 - DNA, 25 bp, Rattus norvegicus
atcgccttcatggtttgctggactc

SEQ ID NO: 183291 - DNA, 25 bp, Rattus norvegicus
atcgcctttcctaggcttaagcgtt

SEQ ID NO: 183292 - DNA, 25 bp, Rattus norvegicus
atcgcctttccttggcttaagcgtt

SEQ ID NO: 183293 - DNA, 25 bp, Rattus norvegicus
atcgcctttgaaaatacagtagact

SEQ ID NO: 183294 - DNA, 25 bp, Rattus norvegicus
atcgcctttgaatatacagtagact

SEQ ID NO: 183295 - DNA, 25 bp, Rattus norvegicus
atcgcgacccgcacggcggtacacg

SEQ ID NO: 183296 - DNA, 25 bp, Rattus norvegicus
atcgcgacccgctcggcggtacacg

SEQ ID NO: 183297 - DNA, 25 bp, Rattus norvegicus
atcgcgagagtgcactttctgctac

SEQ ID NO: 183298 - DNA, 25 bp, Rattus norvegicus
atcgcgagagtggactttctgctac

SEQ ID NO: 183299 - DNA, 25 bp, Rattus norvegicus
atcgcgatccatctagcccgctggt

SEQ ID NO: 183300 - DNA, 25 bp, Rattus norvegicus
atcgcgatccatgtagcccgctggt

SEQ ID NO: 183301 - DNA, 25 bp, Rattus norvegicus
atcgcgatcgcgaggcagccaaaaa

SEQ ID NO: 183302 - DNA, 25 bp, Rattus norvegicus
atcgcgatcgcgtggcagccaaaaa

SEQ ID NO: 183303 - DNA, 25 bp, Rattus norvegicus
atcgcgcagaatcgctccgtagtga

SEQ ID NO: 183304 - DNA, 25 bp, Rattus norvegicus
atcgcgcagaatggctccgtagtga

SEQ ID NO: 183305 - DNA, 25 bp, Rattus norvegicus
atcgcgcctcagcttgtcacatttc

SEQ ID NO: 183306 - DNA, 25 bp, Rattus norvegicus
atcgcgcctcaggttgtcacatttc

SEQ ID NO: 183307 - DNA, 25 bp, Rattus norvegicus
atcgcgcgcgtcaaggagatcctgg

SEQ ID NO: 183308 - DNA, 25 bp, Rattus norvegicus
atcgcgcgcgtctaggagatcctgg

SEQ ID NO: 183309 - DNA, 25 bp, Rattus norvegicus
atcgcgctcctcagggtggtcaagt

SEQ ID NO: 183310 - DNA, 25 bp, Rattus norvegicus
atcgcgctcctctgggtggtcaagt

SEQ ID NO: 183311 - DNA, 25 bp, Rattus norvegicus
atcgcgctcttcagctatatgcagt

SEQ ID NO: 183312 - DNA, 25 bp, Rattus norvegicus
atcgcgctcttctgctatatgcagt

SEQ ID NO: 183313 - DNA, 25 bp, Rattus norvegicus
atcgcgctggtgagtggctcatcga

SEQ ID NO: 183314 - DNA, 25 bp, Rattus norvegicus
atcgcgctggtgtgtggctcatcga

SEQ ID NO: 183315 - DNA, 25 bp, Rattus norvegicus
atcgcgctgtacattggcatcatgt

SEQ ID NO: 183316 - DNA, 25 bp, Rattus norvegicus
atcgcgctgtactttggcatcatgt

SEQ ID NO: 183317 - DNA, 25 bp, Rattus norvegicus
atcgcgctgttacctggagccaagg

SEQ ID NO: 183318 - DNA, 25 bp, Rattus norvegicus
atcgcgctgttagctggagccaagg

SEQ ID NO: 183319 - DNA, 25 bp, Rattus norvegicus
atcgcggacgcgcagcctcgtagtt

SEQ ID NO: 183320 - DNA, 25 bp, Rattus norvegicus
atcgcggacgcggagcctcgtagtt

SEQ ID NO: 183321 - DNA, 25 bp, Rattus norvegicus
atcgcggatgtgacactgagggccc

SEQ ID NO: 183322 - DNA, 25 bp, Rattus norvegicus
atcgcggatgtgtcactgagggccc

SEQ ID NO: 183323 - DNA, 25 bp, Rattus norvegicus
atcgcggcactcagaggagctcgga

SEQ ID NO: 183324 - DNA, 25 bp, Rattus norvegicus
atcgcggcactctgaggagctcgga

SEQ ID NO: 183325 - DNA, 25 bp, Rattus norvegicus
atcgcggcgcgaccgtgctctatct

SEQ ID NO: 183326 - DNA, 25 bp, Rattus norvegicus
atcgcggcgcgagcgtgctctatct

SEQ ID NO: 183327 - DNA, 25 bp, Rattus norvegicus
atcgcggctgttcaataaaacttta

SEQ ID NO: 183328 - DNA, 25 bp, Rattus norvegicus
atcgcggctgttgaataaaacttta

SEQ ID NO: 183329 - DNA, 25 bp, Rattus norvegicus
atcgcggtttctcccaggatcggtt

SEQ ID NO: 183330 - DNA, 25 bp, Rattus norvegicus
atcgcggtttctgccaggatcggtt

SEQ ID NO: 183331 - DNA, 25 bp, Rattus norvegicus
atcgcgtcaggaccatttttccata

SEQ ID NO: 183332 - DNA, 25 bp, Rattus norvegicus
atcgcgtcaggagcatttttccata

SEQ ID NO: 183333 - DNA, 25 bp, Rattus norvegicus
atcgcgtcgctgcaaagtggcatat

SEQ ID NO: 183334 - DNA, 25 bp, Rattus norvegicus
atcgcgtcgctggaaagtggcatat

SEQ ID NO: 183335 - DNA, 25 bp, Rattus norvegicus
atcgcgtgactgattccaagttcca

SEQ ID NO: 183336 - DNA, 25 bp, Rattus norvegicus
atcgcgtgactgtttccaagttcca

SEQ ID NO: 183337 - DNA, 25 bp, Rattus norvegicus
atcgcgttccagcaccttgtcgaaa

SEQ ID NO: 183338 - DNA, 25 bp, Rattus norvegicus
atcgcgttccaggaccttgtcgaaa

SEQ ID NO: 183339 - DNA, 25 bp, Rattus norvegicus
atcgctaacaacagctccgaatcac

SEQ ID NO: 183340 - DNA, 25 bp, Rattus norvegicus
atcgctaacaactgctccgaatcac

SEQ ID NO: 183341 - DNA, 25 bp, Rattus norvegicus
atcgctaccatcattgtgtgcttta

SEQ ID NO: 183342 - DNA, 25 bp, Rattus norvegicus
atcgctaccatctttgtgtgcttta

SEQ ID NO: 183343 - DNA, 25 bp, Rattus norvegicus
atcgctacctaccatgtggatgcag

SEQ ID NO: 183344 - DNA, 25 bp, Rattus norvegicus
atcgctacctacgatgtggatgcag

SEQ ID NO: 183345 - DNA, 25 bp, Rattus norvegicus
atcgctatacagatggccgaccagt

SEQ ID NO: 183346 - DNA, 25 bp, Rattus norvegicus
atcgctatacagttggccgaccagt

SEQ ID NO: 183347 - DNA, 25 bp, Rattus norvegicus
atcgctcactagcagattgggttat

SEQ ID NO: 183348 - DNA, 25 bp, Rattus norvegicus
atcgctcactaggagattgggttat

SEQ ID NO: 183349 - DNA, 25 bp, Rattus norvegicus
atcgctcagcagactgtgtccttgt

SEQ ID NO: 183350 - DNA, 25 bp, Rattus norvegicus
atcgctcagcagtctgtgtccttgt

SEQ ID NO: 183351 - DNA, 25 bp, Rattus norvegicus
atcgctcagcatccggccgcggaaa

SEQ ID NO: 183352 - DNA, 25 bp, Rattus norvegicus
atcgctcagcatgcggccgcggaaa

SEQ ID NO: 183353 - DNA, 25 bp, Rattus norvegicus
atcgctcagctcagtgaacacactt

SEQ ID NO: 183354 - DNA, 25 bp, Rattus norvegicus
atcgctcagctctgtgaacacactt

SEQ ID NO: 183355 - DNA, 25 bp, Rattus norvegicus
atcgctccaaataactccttttgga

SEQ ID NO: 183356 - DNA, 25 bp, Rattus norvegicus
atcgctccaaattactccttttgga

SEQ ID NO: 183357 - DNA, 25 bp, Rattus norvegicus
atcgctcccactctgtgcatgcagt

SEQ ID NO: 183358 - DNA, 25 bp, Rattus norvegicus
atcgctcccactgtgtgcatgcagt

SEQ ID NO: 183359 - DNA, 25 bp, Rattus norvegicus
atcgctcccatcattttaatccttg

SEQ ID NO: 183360 - DNA, 25 bp, Rattus norvegicus
atcgctcccatctttttaatccttg

SEQ ID NO: 183361 - DNA, 25 bp, Rattus norvegicus
atcgctccgcagcttagagagactc

SEQ ID NO: 183362 - DNA, 25 bp, Rattus norvegicus
atcgctccgcaggttagagagactc

SEQ ID NO: 183363 - DNA, 25 bp, Rattus norvegicus
atcgctcgtctcattgagttctaca

SEQ ID NO: 183364 - DNA, 25 bp, Rattus norvegicus
atcgctcgtctctttgagttctaca

SEQ ID NO: 183365 - DNA, 25 bp, Rattus norvegicus
atcgctctacgccatcttttctaat

SEQ ID NO: 183366 - DNA, 25 bp, Rattus norvegicus
atcgctctacgcgatcttttctaat

SEQ ID NO: 183367 - DNA, 25 bp, Rattus norvegicus
atcgctctcaatcatctgcaacaag

SEQ ID NO: 183368 - DNA, 25 bp, Rattus norvegicus
atcgctctcaatgatctgcaacaag

SEQ ID NO: 183369 - DNA, 25 bp, Rattus norvegicus
atcgctctcaggaccgaagacatca

SEQ ID NO: 183370 - DNA, 25 bp, Rattus norvegicus
atcgctctcaggacttcactgaaga

SEQ ID NO: 183371 - DNA, 25 bp, Rattus norvegicus
atcgctctcaggtccgaagacatca

SEQ ID NO: 183372 - DNA, 25 bp, Rattus norvegicus
atcgctctcaggtcttcactgaaga

SEQ ID NO: 183373 - DNA, 25 bp, Rattus norvegicus
atcgctctctgtaagcaggcattga

SEQ ID NO: 183374 - DNA, 25 bp, Rattus norvegicus
atcgctctctgttagcaggcattga

SEQ ID NO: 183375 - DNA, 25 bp, Rattus norvegicus
atcgctctgattccgcgactccttg

SEQ ID NO: 183376 - DNA, 25 bp, Rattus norvegicus
atcgctctgattgcgcgactccttg

SEQ ID NO: 183377 - DNA, 25 bp, Rattus norvegicus
atcgctgaacaacaaatgaaaccaa

SEQ ID NO: 183378 - DNA, 25 bp, Rattus norvegicus
atcgctgaacaagaaatgaaaccaa

SEQ ID NO: 183379 - DNA, 25 bp, Rattus norvegicus
atcgctgaagtgctccagcagggcc

SEQ ID NO: 183380 - DNA, 25 bp, Rattus norvegicus
atcgctgaagtggtccagcagggcc

SEQ ID NO: 183381 - DNA, 25 bp, Rattus norvegicus
atcgctgacaagagtgaatcccgtg

SEQ ID NO: 183382 - DNA, 25 bp, Rattus norvegicus
atcgctgacaagtgtgaatcccgtg

SEQ ID NO: 183383 - DNA, 25 bp, Rattus norvegicus
atcgctgacgatcaagtcgccaagt

SEQ ID NO: 183384 - DNA, 25 bp, Rattus norvegicus
atcgctgacgatgaagtcgccaagt

SEQ ID NO: 183385 - DNA, 25 bp, Rattus norvegicus
atcgctgagccaccgagatcgttat

SEQ ID NO: 183386 - DNA, 25 bp, Rattus norvegicus
atcgctgagccagcgagatcgttat

SEQ ID NO: 183387 - DNA, 25 bp, Rattus norvegicus
atcgctgagctgcatgaaggtgtac

SEQ ID NO: 183388 - DNA, 25 bp, Rattus norvegicus
atcgctgagctggatgaaggtgtac

SEQ ID NO: 183389 - DNA, 25 bp, Rattus norvegicus
atcgctgaggtcattttctcttcaa

SEQ ID NO: 183390 - DNA, 25 bp, Rattus norvegicus
atcgctgaggtctttttctcttcaa

SEQ ID NO: 183391 - DNA, 25 bp, Rattus norvegicus
atcgctgcaccacttgttacagtgt

SEQ ID NO: 183392 - DNA, 25 bp, Rattus norvegicus
atcgctgcaccagttgttacagtgt

SEQ ID NO: 183393 - DNA, 25 bp, Rattus norvegicus
atcgctgcactcaattggactggaa

SEQ ID NO: 183394 - DNA, 25 bp, Rattus norvegicus
atcgctgcactctattggactggaa

SEQ ID NO: 183395 - DNA, 25 bp, Rattus norvegicus
atcgctgcacttagtcgggacacaa

SEQ ID NO: 183396 - DNA, 25 bp, Rattus norvegicus
atcgctgcactttgtcgggacacaa

SEQ ID NO: 183397 - DNA, 25 bp, Rattus norvegicus
atcgctgcataaaacacttctgttg

SEQ ID NO: 183398 - DNA, 25 bp, Rattus norvegicus
atcgctgcataatacacttctgttg

SEQ ID NO: 183399 - DNA, 25 bp, Rattus norvegicus
atcgctgccaggatatacgtaatct

SEQ ID NO: 183400 - DNA, 25 bp, Rattus norvegicus
atcgctgccaggttatacgtaatct

SEQ ID NO: 183401 - DNA, 25 bp, Rattus norvegicus
atcgctgccttcactgagaactgag

SEQ ID NO: 183402 - DNA, 25 bp, Rattus norvegicus
atcgctgccttctctgagaactgag

SEQ ID NO: 183403 - DNA, 25 bp, Rattus norvegicus
atcgctgcgggaagcgcttcgagaa

SEQ ID NO: 183404 - DNA, 25 bp, Rattus norvegicus
atcgctgcgggatgcgcttcgagaa

SEQ ID NO: 183405 - DNA, 25 bp, Rattus norvegicus
atcgctgctatcactgtatactgta

SEQ ID NO: 183406 - DNA, 25 bp, Rattus norvegicus
atcgctgctatctctgtatactgta

SEQ ID NO: 183407 - DNA, 25 bp, Rattus norvegicus
atcgctgctgagctagccatgtgat

SEQ ID NO: 183408 - DNA, 25 bp, Rattus norvegicus
atcgctgctgaggtagccatgtgat

SEQ ID NO: 183409 - DNA, 25 bp, Rattus norvegicus
atcgctgcttcgcttccgggactgc

SEQ ID NO: 183410 - DNA, 25 bp, Rattus norvegicus
atcgctgcttcggttccgggactgc

SEQ ID NO: 183411 - DNA, 25 bp, Rattus norvegicus
atcgctgcttctccaagggatttgc

SEQ ID NO: 183412 - DNA, 25 bp, Rattus norvegicus
atcgctgcttctgcaagggatttgc

SEQ ID NO: 183413 - DNA, 25 bp, Rattus norvegicus
atcgctggaagtactgctgactgaa

SEQ ID NO: 183414 - DNA, 25 bp, Rattus norvegicus
atcgctggaagttctgctgactgaa

SEQ ID NO: 183415 - DNA, 25 bp, Rattus norvegicus
atcgctggcaagagctttctgtatt

SEQ ID NO: 183416 - DNA, 25 bp, Rattus norvegicus
atcgctggcaagtgctttctgtatt

SEQ ID NO: 183417 - DNA, 25 bp, Rattus norvegicus
atcgctgggccaagtcaatgtacaa

SEQ ID NO: 183418 - DNA, 25 bp, Rattus norvegicus
atcgctgggccatgtcaatgtacaa

SEQ ID NO: 183419 - DNA, 25 bp, Rattus norvegicus
atcgctgggctgaggacctataatt

SEQ ID NO: 183420 - DNA, 25 bp, Rattus norvegicus
atcgctgggctgtggacctataatt

SEQ ID NO: 183421 - DNA, 25 bp, Rattus norvegicus
atcgctggtgtgctgacaattgccc

SEQ ID NO: 183422 - DNA, 25 bp, Rattus norvegicus
atcgctggtgtggtgacaattgccc

SEQ ID NO: 183423 - DNA, 25 bp, Rattus norvegicus
atcgctgtacataccacaaaccgtg

SEQ ID NO: 183424 - DNA, 25 bp, Rattus norvegicus
atcgctgtacattccacaaaccgtg

SEQ ID NO: 183425 - DNA, 25 bp, Rattus norvegicus
atcgctgttcttatgttacacactg

SEQ ID NO: 183426 - DNA, 25 bp, Rattus norvegicus
atcgctgttcttttgttacacactg

SEQ ID NO: 183427 - DNA, 25 bp, Rattus norvegicus
atcgctgtttgtcttagccactgtg

SEQ ID NO: 183428 - DNA, 25 bp, Rattus norvegicus
atcgctgtttgtgttagccactgtg

SEQ ID NO: 183429 - DNA, 25 bp, Rattus norvegicus
atcgcttaaagaacatcaccctgga

SEQ ID NO: 183430 - DNA, 25 bp, Rattus norvegicus
atcgcttaaagatcatcaccctgga

SEQ ID NO: 183431 - DNA, 25 bp, Rattus norvegicus
atcgcttaattcatttatcctcctc

SEQ ID NO: 183432 - DNA, 25 bp, Rattus norvegicus
atcgcttaattcttttatcctcctc

SEQ ID NO: 183433 - DNA, 25 bp, Rattus norvegicus
atcgcttccagcactacagtagtga

SEQ ID NO: 183434 - DNA, 25 bp, Rattus norvegicus
atcgcttccagctctacagtagtga

SEQ ID NO: 183435 - DNA, 25 bp, Rattus norvegicus
atcgcttcgcgccaggcccggaatt

SEQ ID NO: 183436 - DNA, 25 bp, Rattus norvegicus
atcgcttcgcgcgaggcccggaatt

SEQ ID NO: 183437 - DNA, 25 bp, Rattus norvegicus
atcgcttctagactatgagccgcaa

SEQ ID NO: 183438 - DNA, 25 bp, Rattus norvegicus
atcgcttctagagtatgagccgcaa

SEQ ID NO: 183439 - DNA, 25 bp, Rattus norvegicus
atcgctttaagtcttcagccagggc

SEQ ID NO: 183440 - DNA, 25 bp, Rattus norvegicus
atcgctttaagtgttcagccagggc

SEQ ID NO: 183441 - DNA, 25 bp, Rattus norvegicus
atcgctttatccatcaagtttctgc

SEQ ID NO: 183442 - DNA, 25 bp, Rattus norvegicus
atcgctttatccttcaagtttctgc

SEQ ID NO: 183443 - DNA, 25 bp, Rattus norvegicus
atcgctttcacgctaccacttagga

SEQ ID NO: 183444 - DNA, 25 bp, Rattus norvegicus
atcgctttcacggtaccacttagga

SEQ ID NO: 183445 - DNA, 25 bp, Rattus norvegicus
atcgctttctgaccggttaaggagc

SEQ ID NO: 183446 - DNA, 25 bp, Rattus norvegicus
atcgctttctgagcggttaaggagc

SEQ ID NO: 183447 - DNA, 25 bp, Rattus norvegicus
atcgctttgagactacggtggttaa

SEQ ID NO: 183448 - DNA, 25 bp, Rattus norvegicus
atcgctttgagagtacggtggttaa

SEQ ID NO: 183449 - DNA, 25 bp, Rattus norvegicus
atcggaactccgcacttgaggaaat

SEQ ID NO: 183450 - DNA, 25 bp, Rattus norvegicus
atcggaactccggacttgaggaaat

SEQ ID NO: 183451 - DNA, 25 bp, Rattus norvegicus
atcggacatgccaaacatctcagac

SEQ ID NO: 183452 - DNA, 25 bp, Rattus norvegicus
atcggacatgcctaacatctcagac

SEQ ID NO: 183453 - DNA, 25 bp, Rattus norvegicus
atcggacgcaggaacaagactcagt

SEQ ID NO: 183454 - DNA, 25 bp, Rattus norvegicus
atcggacgcaggtacaagactcagt

SEQ ID NO: 183455 - DNA, 25 bp, Rattus norvegicus
atcggactctgtcaagccctgcctg

SEQ ID NO: 183456 - DNA, 25 bp, Rattus norvegicus
atcggactctgtgaagccctgcctg

SEQ ID NO: 183457 - DNA, 25 bp, Rattus norvegicus
atcggagaatgtcgctttattaact

SEQ ID NO: 183458 - DNA, 25 bp, Rattus norvegicus
atcggagaatgtggctttattaact

SEQ ID NO: 183459 - DNA, 25 bp, Rattus norvegicus
atcggagacgagatcaatgagactt

SEQ ID NO: 183460 - DNA, 25 bp, Rattus norvegicus
atcggagacgagttcaatgagactt

SEQ ID NO: 183461 - DNA, 25 bp, Rattus norvegicus
atcggagcatgaccgtgttcttatt

SEQ ID NO: 183462 - DNA, 25 bp, Rattus norvegicus
atcggagcatgagcgtgttcttatt

SEQ ID NO: 183463 - DNA, 25 bp, Rattus norvegicus
atcggagcctgtctttctggagaac

SEQ ID NO: 183464 - DNA, 25 bp, Rattus norvegicus
atcggagcctgtgtttctggagaac

SEQ ID NO: 183465 - DNA, 25 bp, Rattus norvegicus
atcggaggactcattctgtggtcca

SEQ ID NO: 183466 - DNA, 25 bp, Rattus norvegicus
atcggaggactctttctgtggtcca

SEQ ID NO: 183467 - DNA, 25 bp, Rattus norvegicus
atcggaggagacatgttacgctaat

SEQ ID NO: 183468 - DNA, 25 bp, Rattus norvegicus
atcggaggagacttgttacgctaat

SEQ ID NO: 183469 - DNA, 25 bp, Rattus norvegicus
atcggaggcagcagtgggattttct

SEQ ID NO: 183470 - DNA, 25 bp, Rattus norvegicus
atcggaggcagctgtgggattttct

SEQ ID NO: 183471 - DNA, 25 bp, Rattus norvegicus
atcggagtaaggcactgaagctcgt

SEQ ID NO: 183472 - DNA, 25 bp, Rattus norvegicus
atcggagtaagggactgaagctcgt

SEQ ID NO: 183473 - DNA, 25 bp, Rattus norvegicus
atcggagtagtgctaatcagtttta

SEQ ID NO: 183474 - DNA, 25 bp, Rattus norvegicus
atcggagtagtggtaatcagtttta

SEQ ID NO: 183475 - DNA, 25 bp, Rattus norvegicus
atcggatacctgacctctaggagaa

SEQ ID NO: 183476 - DNA, 25 bp, Rattus norvegicus
atcggatacctgtcctctaggagaa

SEQ ID NO: 183477 - DNA, 25 bp, Rattus norvegicus
atcggatggagtcctcactgtgaat

SEQ ID NO: 183478 - DNA, 25 bp, Rattus norvegicus
atcggatggagtgctcactgtgaat

SEQ ID NO: 183479 - DNA, 25 bp, Rattus norvegicus
atcggatgttccatttctagctaag

SEQ ID NO: 183480 - DNA, 25 bp, Rattus norvegicus
atcggatgttccttttctagctaag

SEQ ID NO: 183481 - DNA, 25 bp, Rattus norvegicus
atcggattccgaatctgaagaatct

SEQ ID NO: 183482 - DNA, 25 bp, Rattus norvegicus
atcggattccgattctgaagaatct

SEQ ID NO: 183483 - DNA, 25 bp, Rattus norvegicus
atcggattcctgatgtgttctttgc

SEQ ID NO: 183484 - DNA, 25 bp, Rattus norvegicus
atcggattcctgttgtgttctttgc

SEQ ID NO: 183485 - DNA, 25 bp, Rattus norvegicus
atcggattgctcatggccagttcaa

SEQ ID NO: 183486 - DNA, 25 bp, Rattus norvegicus
atcggattgctcttggccagttcaa

SEQ ID NO: 183487 - DNA, 25 bp, Rattus norvegicus
atcggcaatgttatgcccgtgggca

SEQ ID NO: 183488 - DNA, 25 bp, Rattus norvegicus
atcggcaatgttttgcccgtgggca

SEQ ID NO: 183489 - DNA, 25 bp, Rattus norvegicus
atcggcaattatcagctttatactt

SEQ ID NO: 183490 - DNA, 25 bp, Rattus norvegicus
atcggcaattatgagctttatactt

SEQ ID NO: 183491 - DNA, 25 bp, Rattus norvegicus
atcggcacctatcgacttttcaaag

SEQ ID NO: 183492 - DNA, 25 bp, Rattus norvegicus
atcggcacctatggacttttcaaag

SEQ ID NO: 183493 - DNA, 25 bp, Rattus norvegicus
atcggcactacaccaagagcagcaa

SEQ ID NO: 183494 - DNA, 25 bp, Rattus norvegicus
atcggcactacagcaagagcagcaa

SEQ ID NO: 183495 - DNA, 25 bp, Rattus norvegicus
atcggcactgggagaggccccaccg

SEQ ID NO: 183496 - DNA, 25 bp, Rattus norvegicus
atcggcactgggattatctcgttca

SEQ ID NO: 183497 - DNA, 25 bp, Rattus norvegicus
atcggcactgggtgaggccccaccg

SEQ ID NO: 183498 - DNA, 25 bp, Rattus norvegicus
atcggcactgggtttatctcgttca

SEQ ID NO: 183499 - DNA, 25 bp, Rattus norvegicus
atcggcagccttcagagtatgttga

SEQ ID NO: 183500 - DNA, 25 bp, Rattus norvegicus
atcggcagccttgagagtatgttga

SEQ ID NO: 183501 - DNA, 25 bp, Rattus norvegicus
atcggcagtccccttgcacaatgat

SEQ ID NO: 183502 - DNA, 25 bp, Rattus norvegicus
atcggcagtcccgttgcacaatgat

SEQ ID NO: 183503 - DNA, 25 bp, Rattus norvegicus
atcggcagtgccacctacaaaactc

SEQ ID NO: 183504 - DNA, 25 bp, Rattus norvegicus
atcggcagtgcctcctacaaaactc

SEQ ID NO: 183505 - DNA, 25 bp, Rattus norvegicus
atcggcatacccatggatggagaga

SEQ ID NO: 183506 - DNA, 25 bp, Rattus norvegicus
atcggcatacccttggatggagaga

SEQ ID NO: 183507 - DNA, 25 bp, Rattus norvegicus
atcggcatactcaatatggtcctga

SEQ ID NO: 183508 - DNA, 25 bp, Rattus norvegicus
atcggcatactctatatggtcctga

SEQ ID NO: 183509 - DNA, 25 bp, Rattus norvegicus
atcggcatcatccttcagtacctga

SEQ ID NO: 183510 - DNA, 25 bp, Rattus norvegicus
atcggcatcatcgttcagtacctga

SEQ ID NO: 183511 - DNA, 25 bp, Rattus norvegicus
atcggcatctccctggacccaagga

SEQ ID NO: 183512 - DNA, 25 bp, Rattus norvegicus
atcggcatctccgtggacccaagga

SEQ ID NO: 183513 - DNA, 25 bp, Rattus norvegicus
atcggcatgtggctctggaacttga

SEQ ID NO: 183514 - DNA, 25 bp, Rattus norvegicus
atcggcatgtgggtctggaacttga

SEQ ID NO: 183515 - DNA, 25 bp, Rattus norvegicus
atcggcattgtaagaactctgcatt

SEQ ID NO: 183516 - DNA, 25 bp, Rattus norvegicus
atcggcattgtatgaactctgcatt

SEQ ID NO: 183517 - DNA, 25 bp, Rattus norvegicus
atcggccaacctacatgccaaggct

SEQ ID NO: 183518 - DNA, 25 bp, Rattus norvegicus
atcggccaaccttcatgccaaggct

SEQ ID NO: 183519 - DNA, 25 bp, Rattus norvegicus
atcggcccagccatgagaagtttca

SEQ ID NO: 183520 - DNA, 25 bp, Rattus norvegicus
atcggcccagccttgagaagtttca

SEQ ID NO: 183521 - DNA, 25 bp, Rattus norvegicus
atcggcccgatgatcagaatgtgct

SEQ ID NO: 183522 - DNA, 25 bp, Rattus norvegicus
atcggcccgatgttcagaatgtgct

SEQ ID NO: 183523 - DNA, 25 bp, Rattus norvegicus
atcggccctggacaacaacacaaag

SEQ ID NO: 183524 - DNA, 25 bp, Rattus norvegicus
atcggccctggagaacaacacaaag

SEQ ID NO: 183525 - DNA, 25 bp, Rattus norvegicus
atcggcccttacaacggaagctatg

SEQ ID NO: 183526 - DNA, 25 bp, Rattus norvegicus
atcggcccttactacggaagctatg

SEQ ID NO: 183527 - DNA, 25 bp, Rattus norvegicus
atcggccgaaagatcccgcagcaat

SEQ ID NO: 183528 - DNA, 25 bp, Rattus norvegicus
atcggccgaaagttcccgcagcaat

SEQ ID NO: 183529 - DNA, 25 bp, Rattus norvegicus
atcggcctaagtctggctgacctca

SEQ ID NO: 183530 - DNA, 25 bp, Rattus norvegicus
atcggcctaagtgtggctgacctca

SEQ ID NO: 183531 - DNA, 25 bp, Rattus norvegicus
atcggcctgaacactatagctgtct

SEQ ID NO: 183532 - DNA, 25 bp, Rattus norvegicus
atcggcctgaactctatagctgtct

SEQ ID NO: 183533 - DNA, 25 bp, Rattus norvegicus
atcggcctgcggcaccagataaagg

SEQ ID NO: 183534 - DNA, 25 bp, Rattus norvegicus
atcggcctgcgggaccagataaagg

SEQ ID NO: 183535 - DNA, 25 bp, Rattus norvegicus
atcggccttctgatcagttaggcaa

SEQ ID NO: 183536 - DNA, 25 bp, Rattus norvegicus
atcggccttctgttcagttaggcaa

SEQ ID NO: 183537 - DNA, 25 bp, Rattus norvegicus
atcggccttgccattgaaacatcgt

SEQ ID NO: 183538 - DNA, 25 bp, Rattus norvegicus
atcggccttgcctttgaaacatcgt

SEQ ID NO: 183539 - DNA, 25 bp, Rattus norvegicus
atcggcgaagatcacgtccaccatt

SEQ ID NO: 183540 - DNA, 25 bp, Rattus norvegicus
atcggcgaagatgacgtccaccatt

SEQ ID NO: 183541 - DNA, 25 bp, Rattus norvegicus
atcggcgaagccattttactgtctc

SEQ ID NO: 183542 - DNA, 25 bp, Rattus norvegicus
atcggcgaagcctttttactgtctc

SEQ ID NO: 183543 - DNA, 25 bp, Rattus norvegicus
atcggcgcccatcttgaagctgaaa

SEQ ID NO: 183544 - DNA, 25 bp, Rattus norvegicus
atcggcgcccatgttgaagctgaaa

SEQ ID NO: 183545 - DNA, 25 bp, Rattus norvegicus
atcggcggggccagagcttcaactg

SEQ ID NO: 183546 - DNA, 25 bp, Rattus norvegicus
atcggcggggcctgagcttcaactg

SEQ ID NO: 183547 - DNA, 25 bp, Rattus norvegicus
atcggcgtcgtgagattcgcgcaga

SEQ ID NO: 183548 - DNA, 25 bp, Rattus norvegicus
atcggcgtcgtgtgattcgcgcaga

SEQ ID NO: 183549 - DNA, 25 bp, Rattus norvegicus
atcggctacctcaagcatgttgtag

SEQ ID NO: 183550 - DNA, 25 bp, Rattus norvegicus
atcggctacctctagcatgttgtag

SEQ ID NO: 183551 - DNA, 25 bp, Rattus norvegicus
atcggctatcctcaaactgtgtagt

SEQ ID NO: 183552 - DNA, 25 bp, Rattus norvegicus
atcggctatcctgaaactgtgtagt

SEQ ID NO: 183553 - DNA, 25 bp, Rattus norvegicus
atcggctatctcatgggtgctattt

SEQ ID NO: 183554 - DNA, 25 bp, Rattus norvegicus
atcggctatctcttgggtgctattt

SEQ ID NO: 183555 - DNA, 25 bp, Rattus norvegicus
atcggctgttagctgagcaccaggc

SEQ ID NO: 183556 - DNA, 25 bp, Rattus norvegicus
atcggctgttaggtgagcaccaggc

SEQ ID NO: 183557 - DNA, 25 bp, Rattus norvegicus
atcggcttcctcatgagttctgaag

SEQ ID NO: 183558 - DNA, 25 bp, Rattus norvegicus
atcggcttcctcttgagttctgaag

SEQ ID NO: 183559 - DNA, 25 bp, Rattus norvegicus
atcgggaagactatgatcctgctcc

SEQ ID NO: 183560 - DNA, 25 bp, Rattus norvegicus
atcgggaagactttgatcctgctcc

SEQ ID NO: 183561 - DNA, 25 bp, Rattus norvegicus
atcgggaagatgagcttctccctct

SEQ ID NO: 183562 - DNA, 25 bp, Rattus norvegicus
atcgggaagatgtgcttctccctct

SEQ ID NO: 183563 - DNA, 25 bp, Rattus norvegicus
atcgggacactaactcactggttct

SEQ ID NO: 183564 - DNA, 25 bp, Rattus norvegicus
atcgggacactatctcactggttct

SEQ ID NO: 183565 - DNA, 25 bp, Rattus norvegicus
atcgggacgtaacgccagctgagca

SEQ ID NO: 183566 - DNA, 25 bp, Rattus norvegicus
atcgggacgtaaggccagctgagca

SEQ ID NO: 183567 - DNA, 25 bp, Rattus norvegicus
atcgggactctccagactgtcgctg

SEQ ID NO: 183568 - DNA, 25 bp, Rattus norvegicus
atcgggactctcgagactgtcgctg

SEQ ID NO: 183569 - DNA, 25 bp, Rattus norvegicus
atcgggactgacatacgctggcctg

SEQ ID NO: 183570 - DNA, 25 bp, Rattus norvegicus
atcgggactgacttacgctggcctg

SEQ ID NO: 183571 - DNA, 25 bp, Rattus norvegicus
atcgggagctatcagtcaggaatct

SEQ ID NO: 183572 - DNA, 25 bp, Rattus norvegicus
atcgggagctatgagtcaggaatct

SEQ ID NO: 183573 - DNA, 25 bp, Rattus norvegicus
atcgggagtacgaatgtgcaccacc

SEQ ID NO: 183574 - DNA, 25 bp, Rattus norvegicus
atcgggagtacgtatgtgcaccacc

SEQ ID NO: 183575 - DNA, 25 bp, Rattus norvegicus
atcgggatccttcatgttgagccag

SEQ ID NO: 183576 - DNA, 25 bp, Rattus norvegicus
atcgggatccttgatgttgagccag

SEQ ID NO: 183577 - DNA, 25 bp, Rattus norvegicus
atcgggcacgctattatggagcaga

SEQ ID NO: 183578 - DNA, 25 bp, Rattus norvegicus
atcgggcacgcttttatggagcaga

SEQ ID NO: 183579 - DNA, 25 bp, Rattus norvegicus
atcgggcattttcggtttaaatgtg

SEQ ID NO: 183580 - DNA, 25 bp, Rattus norvegicus
atcgggcattttgggtttaaatgtg

SEQ ID NO: 183581 - DNA, 25 bp, Rattus norvegicus
atcgggccacccagggagtctatgc

SEQ ID NO: 183582 - DNA, 25 bp, Rattus norvegicus
atcgggccaccctgggagtctatgc

SEQ ID NO: 183583 - DNA, 25 bp, Rattus norvegicus
atcgggccattcacttaatgtccaa

SEQ ID NO: 183584 - DNA, 25 bp, Rattus norvegicus
atcgggccattctcttaatgtccaa

SEQ ID NO: 183585 - DNA, 25 bp, Rattus norvegicus
atcgggcctgcacgaaaggcactgt

SEQ ID NO: 183586 - DNA, 25 bp, Rattus norvegicus
atcgggcctgcaggaaaggcactgt

SEQ ID NO: 183587 - DNA, 25 bp, Rattus norvegicus
atcgggcgcccacttgtggtgaaat

SEQ ID NO: 183588 - DNA, 25 bp, Rattus norvegicus
atcgggcgcccagttgtggtgaaat

SEQ ID NO: 183589 - DNA, 25 bp, Rattus norvegicus
atcgggcgcttcattagcggtgaca

SEQ ID NO: 183590 - DNA, 25 bp, Rattus norvegicus
atcgggcgcttctttagcggtgaca

SEQ ID NO: 183591 - DNA, 25 bp, Rattus norvegicus
atcgggctgctgagagaacccagga

SEQ ID NO: 183592 - DNA, 25 bp, Rattus norvegicus
atcgggctgctgtgagaacccagga

SEQ ID NO: 183593 - DNA, 25 bp, Rattus norvegicus
atcgggcttcccagtatgatcctga

SEQ ID NO: 183594 - DNA, 25 bp, Rattus norvegicus
atcgggcttccctgtatgatcctga

SEQ ID NO: 183595 - DNA, 25 bp, Rattus norvegicus
atcggggtcattcccaatgatatgg

SEQ ID NO: 183596 - DNA, 25 bp, Rattus norvegicus
atcggggtcattgccaatgatatgg

SEQ ID NO: 183597 - DNA, 25 bp, Rattus norvegicus
atcgggtactgtctgtgttcacaca

SEQ ID NO: 183598 - DNA, 25 bp, Rattus norvegicus
atcgggtactgtgtgtgttcacaca

SEQ ID NO: 183599 - DNA, 25 bp, Rattus norvegicus
atcgggtagtttcagtggtttcatt

SEQ ID NO: 183600 - DNA, 25 bp, Rattus norvegicus
atcgggtagtttgagtggtttcatt

SEQ ID NO: 183601 - DNA, 25 bp, Rattus norvegicus
atcgggtatctaaaactttctgtaa

SEQ ID NO: 183602 - DNA, 25 bp, Rattus norvegicus
atcgggtatctataactttctgtaa

SEQ ID NO: 183603 - DNA, 25 bp, Rattus norvegicus
atcgggtgcttacttgtgggaaatc

SEQ ID NO: 183604 - DNA, 25 bp, Rattus norvegicus
atcgggtgcttagttgtgggaaatc

SEQ ID NO: 183605 - DNA, 25 bp, Rattus norvegicus
atcgggttctgcagttgttacttgc

SEQ ID NO: 183606 - DNA, 25 bp, Rattus norvegicus
atcgggttctgctgttgttacttgc

SEQ ID NO: 183607 - DNA, 25 bp, Rattus norvegicus
atcgggtttaccagctaagctttct

SEQ ID NO: 183608 - DNA, 25 bp, Rattus norvegicus
atcgggtttacctgctaagctttct

SEQ ID NO: 183609 - DNA, 25 bp, Rattus norvegicus
atcgggtttcttctgtgctttggtt

SEQ ID NO: 183610 - DNA, 25 bp, Rattus norvegicus
atcgggtttcttgtgtgctttggtt

SEQ ID NO: 183611 - DNA, 25 bp, Rattus norvegicus
atcgggtttgcaactcctcatggtt

SEQ ID NO: 183612 - DNA, 25 bp, Rattus norvegicus
atcgggtttgcatctcctcatggtt

SEQ ID NO: 183613 - DNA, 25 bp, Rattus norvegicus
atcggtaatagcagtgccacttccc

SEQ ID NO: 183614 - DNA, 25 bp, Rattus norvegicus
atcggtaatagctgtgccacttccc

SEQ ID NO: 183615 - DNA, 25 bp, Rattus norvegicus
atcggtacgcagagcagtctctaga

SEQ ID NO: 183616 - DNA, 25 bp, Rattus norvegicus
atcggtacgcagtgcagtctctaga

SEQ ID NO: 183617 - DNA, 25 bp, Rattus norvegicus
atcggtactttgaggcatatcttcc

SEQ ID NO: 183618 - DNA, 25 bp, Rattus norvegicus
atcggtactttgtggcatatcttcc

SEQ ID NO: 183619 - DNA, 25 bp, Rattus norvegicus
atcggtagcgtgcacgatctcctac

SEQ ID NO: 183620 - DNA, 25 bp, Rattus norvegicus
atcggtagcgtggacgatctcctac

SEQ ID NO: 183621 - DNA, 25 bp, Rattus norvegicus
atcggtatcacaccagacttttcgc

SEQ ID NO: 183622 - DNA, 25 bp, Rattus norvegicus
atcggtatcacagcagacttttcgc

SEQ ID NO: 183623 - DNA, 25 bp, Rattus norvegicus
atcggtatcgccctggtgatgatct

SEQ ID NO: 183624 - DNA, 25 bp, Rattus norvegicus
atcggtatcgccgtggtgatgatct

SEQ ID NO: 183625 - DNA, 25 bp, Rattus norvegicus
atcggtatttccagcatttggtgcc

SEQ ID NO: 183626 - DNA, 25 bp, Rattus norvegicus
atcggtatttcctgcatttggtgcc

SEQ ID NO: 183627 - DNA, 25 bp, Rattus norvegicus
atcggtcaatccagctaacttccag

SEQ ID NO: 183628 - DNA, 25 bp, Rattus norvegicus
atcggtcaatcctgctaacttccag

SEQ ID NO: 183629 - DNA, 25 bp, Rattus norvegicus
atcggtcaccagcataaagagtttt

SEQ ID NO: 183630 - DNA, 25 bp, Rattus norvegicus
atcggtcaccaggataaagagtttt

SEQ ID NO: 183631 - DNA, 25 bp, Rattus norvegicus
atcggtcagtttccggtattggcct

SEQ ID NO: 183632 - DNA, 25 bp, Rattus norvegicus
atcggtcagtttgcggtattggcct

SEQ ID NO: 183633 - DNA, 25 bp, Rattus norvegicus
atcggtcatttaatgtgtactattc

SEQ ID NO: 183634 - DNA, 25 bp, Rattus norvegicus
atcggtcatttattgtgtactattc

SEQ ID NO: 183635 - DNA, 25 bp, Rattus norvegicus
atcggtccgctcaatgtgcaacaca

SEQ ID NO: 183636 - DNA, 25 bp, Rattus norvegicus
atcggtccgctctatgtgcaacaca

SEQ ID NO: 183637 - DNA, 25 bp, Rattus norvegicus
atcggtcgcttcagagcagggtcct

SEQ ID NO: 183638 - DNA, 25 bp, Rattus norvegicus
atcggtcgcttctgagcagggtcct

SEQ ID NO: 183639 - DNA, 25 bp, Rattus norvegicus
atcggtctcgttacataggagtttc

SEQ ID NO: 183640 - DNA, 25 bp, Rattus norvegicus
atcggtctcgtttcataggagtttc

SEQ ID NO: 183641 - DNA, 25 bp, Rattus norvegicus
atcggtctttggacctttgatttga

SEQ ID NO: 183642 - DNA, 25 bp, Rattus norvegicus
atcggtctttggtcctttgatttga

SEQ ID NO: 183643 - DNA, 25 bp, Rattus norvegicus
atcggtgagaccaggcggcttcttg

SEQ ID NO: 183644 - DNA, 25 bp, Rattus norvegicus
atcggtgagacctggcggcttcttg

SEQ ID NO: 183645 - DNA, 25 bp, Rattus norvegicus
atcggtgagagtctgacctctgcct

SEQ ID NO: 183646 - DNA, 25 bp, Rattus norvegicus
atcggtgagagtgtgacctctgcct

SEQ ID NO: 183647 - DNA, 25 bp, Rattus norvegicus
atcggtgccactcggactggtgtca

SEQ ID NO: 183648 - DNA, 25 bp, Rattus norvegicus
atcggtgccactgggactggtgtca

SEQ ID NO: 183649 - DNA, 25 bp, Rattus norvegicus
atcggtgctctgaaagcgagcttaa

SEQ ID NO: 183650 - DNA, 25 bp, Rattus norvegicus
atcggtgctctgtaagcgagcttaa

SEQ ID NO: 183651 - DNA, 25 bp, Rattus norvegicus
atcggtggagccagactgtgccaag

SEQ ID NO: 183652 - DNA, 25 bp, Rattus norvegicus
atcggtggagcctgactgtgccaag

SEQ ID NO: 183653 - DNA, 25 bp, Rattus norvegicus
atcggtggcccaacattaccatgaa

SEQ ID NO: 183654 - DNA, 25 bp, Rattus norvegicus
atcggtggcccatcattaccatgaa

SEQ ID NO: 183655 - DNA, 25 bp, Rattus norvegicus
atcggtggtcagagtttgaactttt

SEQ ID NO: 183656 - DNA, 25 bp, Rattus norvegicus
atcggtggtcagtgtttgaactttt

SEQ ID NO: 183657 - DNA, 25 bp, Rattus norvegicus
atcggtggtccaagtcaagtcatag

SEQ ID NO: 183658 - DNA, 25 bp, Rattus norvegicus
atcggtggtccatgtcaagtcatag

SEQ ID NO: 183659 - DNA, 25 bp, Rattus norvegicus
atcggtggtcggcattcctgaaccg

SEQ ID NO: 183660 - DNA, 25 bp, Rattus norvegicus
atcggtggtcgggattcctgaaccg

SEQ ID NO: 183661 - DNA, 25 bp, Rattus norvegicus
atcggtggttagatcggtgattctc

SEQ ID NO: 183662 - DNA, 25 bp, Rattus norvegicus
atcggtggttagttcggtgattctc

SEQ ID NO: 183663 - DNA, 25 bp, Rattus norvegicus
atcggtgtaaccctttgagaactat

SEQ ID NO: 183664 - DNA, 25 bp, Rattus norvegicus
atcggtgtaaccgtttgagaactat

SEQ ID NO: 183665 - DNA, 25 bp, Rattus norvegicus
atcggtgtgccaattaaagtcctgc

SEQ ID NO: 183666 - DNA, 25 bp, Rattus norvegicus
atcggtgtgccatttaaagtcctgc

SEQ ID NO: 183667 - DNA, 25 bp, Rattus norvegicus
atcggtgtggctattatttccaatc

SEQ ID NO: 183668 - DNA, 25 bp, Rattus norvegicus
atcggtgtggcttttatttccaatc

SEQ ID NO: 183669 - DNA, 25 bp, Rattus norvegicus
atcggtgttcataattcgctttgct

SEQ ID NO: 183670 - DNA, 25 bp, Rattus norvegicus
atcggtgttcattattcgctttgct

SEQ ID NO: 183671 - DNA, 25 bp, Rattus norvegicus
atcggtgttgccaagacgcactatg

SEQ ID NO: 183672 - DNA, 25 bp, Rattus norvegicus
atcggtgttgcctagacgcactatg

SEQ ID NO: 183673 - DNA, 25 bp, Rattus norvegicus
atcggttatactcgagcactttaat

SEQ ID NO: 183674 - DNA, 25 bp, Rattus norvegicus
atcggttatactggagcactttaat

SEQ ID NO: 183675 - DNA, 25 bp, Rattus norvegicus
atcggttcacttcctgctctggcaa

SEQ ID NO: 183676 - DNA, 25 bp, Rattus norvegicus
atcggttcacttgctgctctggcaa

SEQ ID NO: 183677 - DNA, 25 bp, Rattus norvegicus
atcggttccaagcattccaaagggt

SEQ ID NO: 183678 - DNA, 25 bp, Rattus norvegicus
atcggttccaaggattccaaagggt

SEQ ID NO: 183679 - DNA, 25 bp, Rattus norvegicus
atcggttggcatccttagatctgta

SEQ ID NO: 183680 - DNA, 25 bp, Rattus norvegicus
atcggttggcatgcttagatctgta

SEQ ID NO: 183681 - DNA, 25 bp, Rattus norvegicus
atcggttgtataaccctgtctcaat

SEQ ID NO: 183682 - DNA, 25 bp, Rattus norvegicus
atcggttgtatatccctgtctcaat

SEQ ID NO: 183683 - DNA, 25 bp, Rattus norvegicus
atcggtttcccaagtgagttgtcac

SEQ ID NO: 183684 - DNA, 25 bp, Rattus norvegicus
atcggtttcccatgtgagttgtcac

SEQ ID NO: 183685 - DNA, 25 bp, Rattus norvegicus
atcggtttctctctcctatctggta

SEQ ID NO: 183686 - DNA, 25 bp, Rattus norvegicus
atcggtttctctgtcctatctggta

SEQ ID NO: 183687 - DNA, 25 bp, Rattus norvegicus
atcgtaagagtgagtcaatggaaac

SEQ ID NO: 183688 - DNA, 25 bp, Rattus norvegicus
atcgtaagagtgtgtcaatggaaac

SEQ ID NO: 183689 - DNA, 25 bp, Rattus norvegicus
atcgtaaggtccacttttgaactga

SEQ ID NO: 183690 - DNA, 25 bp, Rattus norvegicus
atcgtaaggtcctcttttgaactga

SEQ ID NO: 183691 - DNA, 25 bp, Rattus norvegicus
atcgtacaccacattgttgacggca

SEQ ID NO: 183692 - DNA, 25 bp, Rattus norvegicus
atcgtacaccactttgttgacggca

SEQ ID NO: 183693 - DNA, 25 bp, Rattus norvegicus
atcgtacagtatacctgctcagcac

SEQ ID NO: 183694 - DNA, 25 bp, Rattus norvegicus
atcgtacagtattcctgctcagcac

SEQ ID NO: 183695 - DNA, 25 bp, Rattus norvegicus
atcgtacccactactgtgcttgtga

SEQ ID NO: 183696 - DNA, 25 bp, Rattus norvegicus
atcgtacccacttctgtgcttgtga

SEQ ID NO: 183697 - DNA, 25 bp, Rattus norvegicus
atcgtactatctcatgacattcttg

SEQ ID NO: 183698 - DNA, 25 bp, Rattus norvegicus
atcgtactatctgatgacattcttg

SEQ ID NO: 183699 - DNA, 25 bp, Rattus norvegicus
atcgtactggccattggcttgctct

SEQ ID NO: 183700 - DNA, 25 bp, Rattus norvegicus
atcgtactggcctttggcttgctct

SEQ ID NO: 183701 - DNA, 25 bp, Rattus norvegicus
atcgtagataggaccggctcaaaag

SEQ ID NO: 183702 - DNA, 25 bp, Rattus norvegicus
atcgtagataggtccggctcaaaag

SEQ ID NO: 183703 - DNA, 25 bp, Rattus norvegicus
atcgtagcctgcagacaccaaggaa

SEQ ID NO: 183704 - DNA, 25 bp, Rattus norvegicus
atcgtagcctgctgacaccaaggaa

SEQ ID NO: 183705 - DNA, 25 bp, Rattus norvegicus
atcgtatccatgagaccgaccgtgt

SEQ ID NO: 183706 - DNA, 25 bp, Rattus norvegicus
atcgtatccatgtgaccgaccgtgt

SEQ ID NO: 183707 - DNA, 25 bp, Rattus norvegicus
atcgtatccctcacgactttatcat

SEQ ID NO: 183708 - DNA, 25 bp, Rattus norvegicus
atcgtatccctctcgactttatcat

SEQ ID NO: 183709 - DNA, 25 bp, Rattus norvegicus
atcgtcaacaccatgtggtccttta

SEQ ID NO: 183710 - DNA, 25 bp, Rattus norvegicus
atcgtcaacaccttgtggtccttta

SEQ ID NO: 183711 - DNA, 25 bp, Rattus norvegicus
atcgtcaagggccaagtgtacttta

SEQ ID NO: 183712 - DNA, 25 bp, Rattus norvegicus
atcgtcaagggcgaagtgtacttta

SEQ ID NO: 183713 - DNA, 25 bp, Rattus norvegicus
atcgtcaagtgccaaagcctttttt

SEQ ID NO: 183714 - DNA, 25 bp, Rattus norvegicus
atcgtcaagtgcgaaagcctttttt

SEQ ID NO: 183715 - DNA, 25 bp, Rattus norvegicus
atcgtcacaataactttatccgtgt

SEQ ID NO: 183716 - DNA, 25 bp, Rattus norvegicus
atcgtcacaatatctttatccgtgt

SEQ ID NO: 183717 - DNA, 25 bp, Rattus norvegicus
atcgtcaccattcctcatcgagtat

SEQ ID NO: 183718 - DNA, 25 bp, Rattus norvegicus
atcgtcaccattgctcatcgagtat

SEQ ID NO: 183719 - DNA, 25 bp, Rattus norvegicus
atcgtcactctgaccctgataagag

SEQ ID NO: 183720 - DNA, 25 bp, Rattus norvegicus
atcgtcactctgtccctgataagag

SEQ ID NO: 183721 - DNA, 25 bp, Rattus norvegicus
atcgtcaggcacatcatcaaggagt

SEQ ID NO: 183722 - DNA, 25 bp, Rattus norvegicus
atcgtcaggcacttcatcaaggagt

SEQ ID NO: 183723 - DNA, 25 bp, Rattus norvegicus
atcgtcagtactcctttatgcactc

SEQ ID NO: 183724 - DNA, 25 bp, Rattus norvegicus
atcgtcagtactgctttatgcactc

SEQ ID NO: 183725 - DNA, 25 bp, Rattus norvegicus
atcgtcagtggcacatgcgtagcag

SEQ ID NO: 183726 - DNA, 25 bp, Rattus norvegicus
atcgtcagtggctcatgcgtagcag

SEQ ID NO: 183727 - DNA, 25 bp, Rattus norvegicus
atcgtcatctttccttacatctgtg

SEQ ID NO: 183728 - DNA, 25 bp, Rattus norvegicus
atcgtcatctttgcttacatctgtg

SEQ ID NO: 183729 - DNA, 25 bp, Rattus norvegicus
atcgtcatggacaacctgtagtttg

SEQ ID NO: 183730 - DNA, 25 bp, Rattus norvegicus
atcgtcatggactacctgtagtttg

SEQ ID NO: 183731 - DNA, 25 bp, Rattus norvegicus
atcgtcattgccatgatcatcttcc

SEQ ID NO: 183732 - DNA, 25 bp, Rattus norvegicus
atcgtcattgccttgatcatcttcc

SEQ ID NO: 183733 - DNA, 25 bp, Rattus norvegicus
atcgtcattggcatcagctgtggct

SEQ ID NO: 183734 - DNA, 25 bp, Rattus norvegicus
atcgtcattggcttcagctgtggct

SEQ ID NO: 183735 - DNA, 25 bp, Rattus norvegicus
atcgtccacgatagtgggtacccat

SEQ ID NO: 183736 - DNA, 25 bp, Rattus norvegicus
atcgtccacgattgtgggtacccat

SEQ ID NO: 183737 - DNA, 25 bp, Rattus norvegicus
atcgtccatggaataagtcattcac

SEQ ID NO: 183738 - DNA, 25 bp, Rattus norvegicus
atcgtccatggattaagtcattcac

SEQ ID NO: 183739 - DNA, 25 bp, Rattus norvegicus
atcgtccatgtacattctgtctggg

SEQ ID NO: 183740 - DNA, 25 bp, Rattus norvegicus
atcgtccatgtagattctgtctggg

SEQ ID NO: 183741 - DNA, 25 bp, Rattus norvegicus
atcgtcccctgactctcgaaaatgg

SEQ ID NO: 183742 - DNA, 25 bp, Rattus norvegicus
atcgtcccctgagtctcgaaaatgg

SEQ ID NO: 183743 - DNA, 25 bp, Rattus norvegicus
atcgtccggtctctctgtagaaaag

SEQ ID NO: 183744 - DNA, 25 bp, Rattus norvegicus
atcgtccggtctgtctgtagaaaag

SEQ ID NO: 183745 - DNA, 25 bp, Rattus norvegicus
atcgtcctaaatataatggctcaca

SEQ ID NO: 183746 - DNA, 25 bp, Rattus norvegicus
atcgtcctaaatttaatggctcaca

SEQ ID NO: 183747 - DNA, 25 bp, Rattus norvegicus
atcgtcctaaggctgcttgtttgct

SEQ ID NO: 183748 - DNA, 25 bp, Rattus norvegicus
atcgtcctaagggtgcttgtttgct

SEQ ID NO: 183749 - DNA, 25 bp, Rattus norvegicus
atcgtcctcctcacacaggaaagtc

SEQ ID NO: 183750 - DNA, 25 bp, Rattus norvegicus
atcgtcctcctctcacaggaaagtc

SEQ ID NO: 183751 - DNA, 25 bp, Rattus norvegicus
atcgtcctggctatgggcggtgtca

SEQ ID NO: 183752 - DNA, 25 bp, Rattus norvegicus
atcgtcctggctttgggcggtgtca

SEQ ID NO: 183753 - DNA, 25 bp, Rattus norvegicus
atcgtccttcctcaccggattaata

SEQ ID NO: 183754 - DNA, 25 bp, Rattus norvegicus
atcgtccttcctgaccggattaata

SEQ ID NO: 183755 - DNA, 25 bp, Rattus norvegicus
atcgtccttgtgattcttcttcaaa

SEQ ID NO: 183756 - DNA, 25 bp, Rattus norvegicus
atcgtccttgtgtttcttcttcaaa

SEQ ID NO: 183757 - DNA, 25 bp, Rattus norvegicus
atcgtcctttggcaggagctctggc

SEQ ID NO: 183758 - DNA, 25 bp, Rattus norvegicus
atcgtcctttgggaggagctctggc

SEQ ID NO: 183759 - DNA, 25 bp, Rattus norvegicus
atcgtcgatgccattgagctctatt

SEQ ID NO: 183760 - DNA, 25 bp, Rattus norvegicus
atcgtcgatgcctttgagctctatt

SEQ ID NO: 183761 - DNA, 25 bp, Rattus norvegicus
atcgtcgtgtgcatcgtgttcatca

SEQ ID NO: 183762 - DNA, 25 bp, Rattus norvegicus
atcgtcgtgtgcttcgtgttcatca

SEQ ID NO: 183763 - DNA, 25 bp, Rattus norvegicus
atcgtcgttaacatggaggtcctca

SEQ ID NO: 183764 - DNA, 25 bp, Rattus norvegicus
atcgtcgttaacttggaggtcctca

SEQ ID NO: 183765 - DNA, 25 bp, Rattus norvegicus
atcgtctactacctgggtcgcaagc

SEQ ID NO: 183766 - DNA, 25 bp, Rattus norvegicus
atcgtctactacgtgggtcgcaagc

SEQ ID NO: 183767 - DNA, 25 bp, Rattus norvegicus
atcgtctatttcagtcacccagggt

SEQ ID NO: 183768 - DNA, 25 bp, Rattus norvegicus
atcgtctatttctgtcacccagggt

SEQ ID NO: 183769 - DNA, 25 bp, Rattus norvegicus
atcgtctccaaacggtgaggctggc

SEQ ID NO: 183770 - DNA, 25 bp, Rattus norvegicus
atcgtctccaaagggtgaggctggc

SEQ ID NO: 183771 - DNA, 25 bp, Rattus norvegicus
atcgtctcctacagtttgcataaag

SEQ ID NO: 183772 - DNA, 25 bp, Rattus norvegicus
atcgtctcctactgtttgcataaag

SEQ ID NO: 183773 - DNA, 25 bp, Rattus norvegicus
atcgtctggacgctggtggacatca

SEQ ID NO: 183774 - DNA, 25 bp, Rattus norvegicus
atcgtctggacggtggtggacatca

SEQ ID NO: 183775 - DNA, 25 bp, Rattus norvegicus
atcgtcttctgaacaccgtctaacc

SEQ ID NO: 183776 - DNA, 25 bp, Rattus norvegicus
atcgtcttctgatcaccgtctaacc

SEQ ID NO: 183777 - DNA, 25 bp, Rattus norvegicus
atcgtctttgacatcagatacttca

SEQ ID NO: 183778 - DNA, 25 bp, Rattus norvegicus
atcgtctttgacttcagatacttca

SEQ ID NO: 183779 - DNA, 25 bp, Rattus norvegicus
atcgtgaacaccaatgttccccgcg

SEQ ID NO: 183780 - DNA, 25 bp, Rattus norvegicus
atcgtgaacacctatgttccccgcg

SEQ ID NO: 183781 - DNA, 25 bp, Rattus norvegicus
atcgtgaacccacgcttaattccca

SEQ ID NO: 183782 - DNA, 25 bp, Rattus norvegicus
atcgtgaacccaggcttaattccca

SEQ ID NO: 183783 - DNA, 25 bp, Rattus norvegicus
atcgtgaagcccaacgtagtccatt

SEQ ID NO: 183784 - DNA, 25 bp, Rattus norvegicus
atcgtgaagccctacgtagtccatt

SEQ ID NO: 183785 - DNA, 25 bp, Rattus norvegicus
atcgtgacgctgacggagaccgcag

SEQ ID NO: 183786 - DNA, 25 bp, Rattus norvegicus
atcgtgacgctgtcggagaccgcag

SEQ ID NO: 183787 - DNA, 25 bp, Rattus norvegicus
atcgtgactgggaggccatgcagac

SEQ ID NO: 183788 - DNA, 25 bp, Rattus norvegicus
atcgtgactgggtggccatgcagac

SEQ ID NO: 183789 - DNA, 25 bp, Rattus norvegicus
atcgtgagcatcattgggctctgct

SEQ ID NO: 183790 - DNA, 25 bp, Rattus norvegicus
atcgtgagcatctttgggctctgct

SEQ ID NO: 183791 - DNA, 25 bp, Rattus norvegicus
atcgtgagctggctctggctctgca

SEQ ID NO: 183792 - DNA, 25 bp, Rattus norvegicus
atcgtgagctgggtctggctctgca

SEQ ID NO: 183793 - DNA, 25 bp, Rattus norvegicus
atcgtgattcctaaggcggtggctt

SEQ ID NO: 183794 - DNA, 25 bp, Rattus norvegicus
atcgtgattccttaggcggtggctt

SEQ ID NO: 183795 - DNA, 25 bp, Rattus norvegicus
atcgtgattctaagttttgtgccaa

SEQ ID NO: 183796 - DNA, 25 bp, Rattus norvegicus
atcgtgattctatgttttgtgccaa

SEQ ID NO: 183797 - DNA, 25 bp, Rattus norvegicus
atcgtgatttacaggaactttggac

SEQ ID NO: 183798 - DNA, 25 bp, Rattus norvegicus
atcgtgatttactggaactttggac

SEQ ID NO: 183799 - DNA, 25 bp, Rattus norvegicus
atcgtgccgtgtctattcagtctat

SEQ ID NO: 183800 - DNA, 25 bp, Rattus norvegicus
atcgtgccgtgtgtattcagtctat

SEQ ID NO: 183801 - DNA, 25 bp, Rattus norvegicus
atcgtgcgtctaacagagtagccag

SEQ ID NO: 183802 - DNA, 25 bp, Rattus norvegicus
atcgtgcgtctatcagagtagccag

SEQ ID NO: 183803 - DNA, 25 bp, Rattus norvegicus
atcgtgctgacaactgtgggcctgc

SEQ ID NO: 183804 - DNA, 25 bp, Rattus norvegicus
atcgtgctgacatctgtgggcctgc

SEQ ID NO: 183805 - DNA, 25 bp, Rattus norvegicus
atcgtgctgcgtatcccggctcggt

SEQ ID NO: 183806 - DNA, 25 bp, Rattus norvegicus
atcgtgctgcgtttcccggctcggt

SEQ ID NO: 183807 - DNA, 25 bp, Rattus norvegicus
atcgtggaccgcaagtacagcatct

SEQ ID NO: 183808 - DNA, 25 bp, Rattus norvegicus
atcgtggaccgctagtacagcatct

SEQ ID NO: 183809 - DNA, 25 bp, Rattus norvegicus
atcgtggacttgacatgtgcctatg

SEQ ID NO: 183810 - DNA, 25 bp, Rattus norvegicus
atcgtggacttgtcatgtgcctatg

SEQ ID NO: 183811 - DNA, 25 bp, Rattus norvegicus
atcgtggaggctctgctcacgcaca

SEQ ID NO: 183812 - DNA, 25 bp, Rattus norvegicus
atcgtggaggctgtgctcacgcaca

SEQ ID NO: 183813 - DNA, 25 bp, Rattus norvegicus
atcgtggcaactctcccactgtgtg

SEQ ID NO: 183814 - DNA, 25 bp, Rattus norvegicus
atcgtggcaactgtcccactgtgtg

SEQ ID NO: 183815 - DNA, 25 bp, Rattus norvegicus
atcgtggcccgtagagcacttctgc

SEQ ID NO: 183816 - DNA, 25 bp, Rattus norvegicus
atcgtggcccgttgagcacttctgc

SEQ ID NO: 183817 - DNA, 25 bp, Rattus norvegicus
atcgtggctactccgggacgcttca

SEQ ID NO: 183818 - DNA, 25 bp, Rattus norvegicus
atcgtggctactgcgggacgcttca

SEQ ID NO: 183819 - DNA, 25 bp, Rattus norvegicus
atcgtgggaaccaaatggctggcca

SEQ ID NO: 183820 - DNA, 25 bp, Rattus norvegicus
atcgtgggaacctaatggctggcca

SEQ ID NO: 183821 - DNA, 25 bp, Rattus norvegicus
atcgtgggcatgagaggcaccagca

SEQ ID NO: 183822 - DNA, 25 bp, Rattus norvegicus
atcgtgggcatgtgaggcaccagca

SEQ ID NO: 183823 - DNA, 25 bp, Rattus norvegicus
atcgtgggctttacggatcctgagg

SEQ ID NO: 183824 - DNA, 25 bp, Rattus norvegicus
atcgtgggcttttcggatcctgagg

SEQ ID NO: 183825 - DNA, 25 bp, Rattus norvegicus
atcgtggggcaaagtcccatgtgct

SEQ ID NO: 183826 - DNA, 25 bp, Rattus norvegicus
atcgtggggcaatgtcccatgtgct

SEQ ID NO: 183827 - DNA, 25 bp, Rattus norvegicus
atcgtggtcacgattcctggaaaat

SEQ ID NO: 183828 - DNA, 25 bp, Rattus norvegicus
atcgtggtcacgtttcctggaaaat

SEQ ID NO: 183829 - DNA, 25 bp, Rattus norvegicus
atcgtggtcaggctgaccctccgag

SEQ ID NO: 183830 - DNA, 25 bp, Rattus norvegicus
atcgtggtcagggtgaccctccgag

SEQ ID NO: 183831 - DNA, 25 bp, Rattus norvegicus
atcgtggtgaccatccggaaccagg

SEQ ID NO: 183832 - DNA, 25 bp, Rattus norvegicus
atcgtggtgaccttccggaaccagg

SEQ ID NO: 183833 - DNA, 25 bp, Rattus norvegicus
atcgtggtgggccttctcatgttcc

SEQ ID NO: 183834 - DNA, 25 bp, Rattus norvegicus
atcgtggtgggcgttctcatgttcc

SEQ ID NO: 183835 - DNA, 25 bp, Rattus norvegicus
atcgtggttcttccctgaggtcaga

SEQ ID NO: 183836 - DNA, 25 bp, Rattus norvegicus
atcgtggttcttgcctgaggtcaga

SEQ ID NO: 183837 - DNA, 25 bp, Rattus norvegicus
atcgtgtcgtcacgtgtgcttttcc

SEQ ID NO: 183838 - DNA, 25 bp, Rattus norvegicus
atcgtgtcgtcaggtgtgcttttcc

SEQ ID NO: 183839 - DNA, 25 bp, Rattus norvegicus
atcgtgtgacatatgctttctggca

SEQ ID NO: 183840 - DNA, 25 bp, Rattus norvegicus
atcgtgtgacatttgctttctggca

SEQ ID NO: 183841 - DNA, 25 bp, Rattus norvegicus
atcgtgtgcatgatgacattgttac

SEQ ID NO: 183842 - DNA, 25 bp, Rattus norvegicus
atcgtgtgcatgttgacattgttac

SEQ ID NO: 183843 - DNA, 25 bp, Rattus norvegicus
atcgtgtgccatccttctggacgaa

SEQ ID NO: 183844 - DNA, 25 bp, Rattus norvegicus
atcgtgtgccatgcttctggacgaa

SEQ ID NO: 183845 - DNA, 25 bp, Rattus norvegicus
atcgtgtgttgccattttgtctgac

SEQ ID NO: 183846 - DNA, 25 bp, Rattus norvegicus
atcgtgtgttgcgattttgtctgac

SEQ ID NO: 183847 - DNA, 25 bp, Rattus norvegicus
atcgtgttcttgatgcctatgacag

SEQ ID NO: 183848 - DNA, 25 bp, Rattus norvegicus
atcgtgttcttgttgcctatgacag

SEQ ID NO: 183849 - DNA, 25 bp, Rattus norvegicus
atcgttaccttcacttacatcttta

SEQ ID NO: 183850 - DNA, 25 bp, Rattus norvegicus
atcgttaccttctcttacatcttta

SEQ ID NO: 183851 - DNA, 25 bp, Rattus norvegicus
atcgttagcgcgattggtcgtccat

SEQ ID NO: 183852 - DNA, 25 bp, Rattus norvegicus
atcgttagcgcgtttggtcgtccat

SEQ ID NO: 183853 - DNA, 25 bp, Rattus norvegicus
atcgttatcagtaggcagtgaattt

SEQ ID NO: 183854 - DNA, 25 bp, Rattus norvegicus
atcgttatcagttggcagtgaattt

SEQ ID NO: 183855 - DNA, 25 bp, Rattus norvegicus
atcgttattagactcttacatgagt

SEQ ID NO: 183856 - DNA, 25 bp, Rattus norvegicus
atcgttattagagtcttacatgagt

SEQ ID NO: 183857 - DNA, 25 bp, Rattus norvegicus
atcgttcaccagctagcgcgtgggc

SEQ ID NO: 183858 - DNA, 25 bp, Rattus norvegicus
atcgttcaccaggtagcgcgtgggc

SEQ ID NO: 183859 - DNA, 25 bp, Rattus norvegicus
atcgttccaacgaacagacataagc

SEQ ID NO: 183860 - DNA, 25 bp, Rattus norvegicus
atcgttccaacgtacagacataagc

SEQ ID NO: 183861 - DNA, 25 bp, Rattus norvegicus
atcgttccctcaatacacgggagaa

SEQ ID NO: 183862 - DNA, 25 bp, Rattus norvegicus
atcgttccctcattacacgggagaa

SEQ ID NO: 183863 - DNA, 25 bp, Rattus norvegicus
atcgttcctgagattactgccatga

SEQ ID NO: 183864 - DNA, 25 bp, Rattus norvegicus
atcgttcctgagtttactgccatga

SEQ ID NO: 183865 - DNA, 25 bp, Rattus norvegicus
atcgttctatgtaggtcactgcttc

SEQ ID NO: 183866 - DNA, 25 bp, Rattus norvegicus
atcgttctatgttggtcactgcttc

SEQ ID NO: 183867 - DNA, 25 bp, Rattus norvegicus
atcgttcttgtcatcagttctgtaa

SEQ ID NO: 183868 - DNA, 25 bp, Rattus norvegicus
atcgttcttgtcttcagttctgtaa

SEQ ID NO: 183869 - DNA, 25 bp, Rattus norvegicus
atcgttgagccaccagacattgtca

SEQ ID NO: 183870 - DNA, 25 bp, Rattus norvegicus
atcgttgagccagcagacattgtca

SEQ ID NO: 183871 - DNA, 25 bp, Rattus norvegicus
atcgttgcagctcactttacacatg

SEQ ID NO: 183872 - DNA, 25 bp, Rattus norvegicus
atcgttgcagctgactttacacatg

SEQ ID NO: 183873 - DNA, 25 bp, Rattus norvegicus
atcgttgcatctaccaccagaatat

SEQ ID NO: 183874 - DNA, 25 bp, Rattus norvegicus
atcgttgcatcttccaccagaatat

SEQ ID NO: 183875 - DNA, 25 bp, Rattus norvegicus
atcgttgccacgctgattttcagca

SEQ ID NO: 183876 - DNA, 25 bp, Rattus norvegicus
atcgttgccacggtgattttcagca

SEQ ID NO: 183877 - DNA, 25 bp, Rattus norvegicus
atcgttgccctgaggaatttagcac

SEQ ID NO: 183878 - DNA, 25 bp, Rattus norvegicus
atcgttgccctgtggaatttagcac

SEQ ID NO: 183879 - DNA, 25 bp, Rattus norvegicus
atcgttgcctccaggtgaggtggcc

SEQ ID NO: 183880 - DNA, 25 bp, Rattus norvegicus
atcgttgcctcctggtgaggtggcc

SEQ ID NO: 183881 - DNA, 25 bp, Rattus norvegicus
atcgttgggcatctgcaagtggcac

SEQ ID NO: 183882 - DNA, 25 bp, Rattus norvegicus
atcgttgggcatgtgcaagtggcac

SEQ ID NO: 183883 - DNA, 25 bp, Rattus norvegicus
atcgttggtttcatgctgtgcctct

SEQ ID NO: 183884 - DNA, 25 bp, Rattus norvegicus
atcgttggtttcttgctgtgcctct

SEQ ID NO: 183885 - DNA, 25 bp, Rattus norvegicus
atcgttgtccagatcatcatctggg

SEQ ID NO: 183886 - DNA, 25 bp, Rattus norvegicus
atcgttgtccagttcatcatctggg

SEQ ID NO: 183887 - DNA, 25 bp, Rattus norvegicus
atcgttgtcctcatgtgtgaattca

SEQ ID NO: 183888 - DNA, 25 bp, Rattus norvegicus
atcgttgtcctcttgtgtgaattca

SEQ ID NO: 183889 - DNA, 25 bp, Rattus norvegicus
atcgttgtccttcgtcatctacaga

SEQ ID NO: 183890 - DNA, 25 bp, Rattus norvegicus
atcgttgtccttggtcatctacaga

SEQ ID NO: 183891 - DNA, 25 bp, Rattus norvegicus
atcgtttccactcctccagaatggg

SEQ ID NO: 183892 - DNA, 25 bp, Rattus norvegicus
atcgtttccactgctccagaatggg

SEQ ID NO: 183893 - DNA, 25 bp, Rattus norvegicus
atcgtttctatcacctagcatggag

SEQ ID NO: 183894 - DNA, 25 bp, Rattus norvegicus
atcgtttctatctcctagcatggag

SEQ ID NO: 183895 - DNA, 25 bp, Rattus norvegicus
atcgtttctgctatgacgtggcttt

SEQ ID NO: 183896 - DNA, 25 bp, Rattus norvegicus
atcgtttctgctttgacgtggcttt

SEQ ID NO: 183897 - DNA, 25 bp, Rattus norvegicus
atcgtttggccaatgaatcttcgga

SEQ ID NO: 183898 - DNA, 25 bp, Rattus norvegicus
atcgtttggccattgaatcttcgga

SEQ ID NO: 183899 - DNA, 25 bp, Rattus norvegicus
atcgttttcattccttgtggtcatc

SEQ ID NO: 183900 - DNA, 25 bp, Rattus norvegicus
atcgttttcattgcttgtggtcatc

SEQ ID NO: 183901 - DNA, 25 bp, Rattus norvegicus
atcgttttcttgacacagacgtcct

SEQ ID NO: 183902 - DNA, 25 bp, Rattus norvegicus
atcgttttcttgtcacagacgtcct

SEQ ID NO: 183903 - DNA, 25 bp, Rattus norvegicus
atctaaaaagccatcctgctgcagc

SEQ ID NO: 183904 - DNA, 25 bp, Rattus norvegicus
atctaaaaagccttcctgctgcagc

SEQ ID NO: 183905 - DNA, 25 bp, Rattus norvegicus
atctaaaggactagcatgtcaaagt

SEQ ID NO: 183906 - DNA, 25 bp, Rattus norvegicus
atctaaaggacttgcatgtcaaagt

SEQ ID NO: 183907 - DNA, 25 bp, Rattus norvegicus
atctaaagtcttcgtgttttctcct

SEQ ID NO: 183908 - DNA, 25 bp, Rattus norvegicus
atctaaagtcttggtgttttctcct

SEQ ID NO: 183909 - DNA, 25 bp, Rattus norvegicus
atctaaatgtatagttagccctttt

SEQ ID NO: 183910 - DNA, 25 bp, Rattus norvegicus
atctaaatgtattgttagccctttt

SEQ ID NO: 183911 - DNA, 25 bp, Rattus norvegicus
atctaaatttctacctcctgttttg

SEQ ID NO: 183912 - DNA, 25 bp, Rattus norvegicus
atctaaatttcttcctcctgttttg

SEQ ID NO: 183913 - DNA, 25 bp, Rattus norvegicus
atctaacacctgattgggctctagc

SEQ ID NO: 183914 - DNA, 25 bp, Rattus norvegicus
atctaacacctgtttgggctctagc

SEQ ID NO: 183915 - DNA, 25 bp, Rattus norvegicus
atctaacagcttactgcacagcaag

SEQ ID NO: 183916 - DNA, 25 bp, Rattus norvegicus
atctaacagctttctgcacagcaag

SEQ ID NO: 183917 - DNA, 25 bp, Rattus norvegicus
atctaacattatacaggaacttgag

SEQ ID NO: 183918 - DNA, 25 bp, Rattus norvegicus
atctaacattattcaggaacttgag

SEQ ID NO: 183919 - DNA, 25 bp, Rattus norvegicus
atctaacattccaaagtccacatct

SEQ ID NO: 183920 - DNA, 25 bp, Rattus norvegicus
atctaacattcctaagtccacatct

SEQ ID NO: 183921 - DNA, 25 bp, Rattus norvegicus
atctaaccatggaagtaatgattca

SEQ ID NO: 183922 - DNA, 25 bp, Rattus norvegicus
atctaaccatggtagtaatgattca

SEQ ID NO: 183923 - DNA, 25 bp, Rattus norvegicus
atctaactccctcttaccaggaaga

SEQ ID NO: 183924 - DNA, 25 bp, Rattus norvegicus
atctaactccctgttaccaggaaga

SEQ ID NO: 183925 - DNA, 25 bp, Rattus norvegicus
atctaagaaagtcaccccagctagc

SEQ ID NO: 183926 - DNA, 25 bp, Rattus norvegicus
atctaagaaagtgaccccagctagc

SEQ ID NO: 183927 - DNA, 25 bp, Rattus norvegicus
atctaagaatggcagcagccccata

SEQ ID NO: 183928 - DNA, 25 bp, Rattus norvegicus
atctaagaatgggagcagccccata

SEQ ID NO: 183929 - DNA, 25 bp, Rattus norvegicus
atctaagagactccctcagtggcct

SEQ ID NO: 183930 - DNA, 25 bp, Rattus norvegicus
atctaagagactgcctcagtggcct

SEQ ID NO: 183931 - DNA, 25 bp, Rattus norvegicus
atctaagaggccactgaacgactgt

SEQ ID NO: 183932 - DNA, 25 bp, Rattus norvegicus
atctaagaggcctctgaacgactgt

SEQ ID NO: 183933 - DNA, 25 bp, Rattus norvegicus
atctaagatggtatcctcgagcaaa

SEQ ID NO: 183934 - DNA, 25 bp, Rattus norvegicus
atctaagatggtttcctcgagcaaa

SEQ ID NO: 183935 - DNA, 25 bp, Rattus norvegicus
atctaagcacttctaaccaccttcg

SEQ ID NO: 183936 - DNA, 25 bp, Rattus norvegicus
atctaagcacttgtaaccaccttcg

SEQ ID NO: 183937 - DNA, 25 bp, Rattus norvegicus
atctaagccactccagctggacagt

SEQ ID NO: 183938 - DNA, 25 bp, Rattus norvegicus
atctaagccactgcagctggacagt

SEQ ID NO: 183939 - DNA, 25 bp, Rattus norvegicus
atctaagcgattctgcaaactgata

SEQ ID NO: 183940 - DNA, 25 bp, Rattus norvegicus
atctaagcgattgtgcaaactgata

SEQ ID NO: 183941 - DNA, 25 bp, Rattus norvegicus
atctaagcggcgctatgactccggg

SEQ ID NO: 183942 - DNA, 25 bp, Rattus norvegicus
atctaagcggcggtatgactccggg

SEQ ID NO: 183943 - DNA, 25 bp, Rattus norvegicus
atctaagctcataaggtcaccaaag

SEQ ID NO: 183944 - DNA, 25 bp, Rattus norvegicus
atctaagctcattaggtcaccaaag

SEQ ID NO: 183945 - DNA, 25 bp, Rattus norvegicus
atctaaggtcagaactacaccgtat

SEQ ID NO: 183946 - DNA, 25 bp, Rattus norvegicus
atctaaggtcagtactacaccgtat

SEQ ID NO: 183947 - DNA, 25 bp, Rattus norvegicus
atctaaggtcctcgtgggctctaca

SEQ ID NO: 183948 - DNA, 25 bp, Rattus norvegicus
atctaaggtcctggtgggctctaca

SEQ ID NO: 183949 - DNA, 25 bp, Rattus norvegicus
atctaagtctccattttatcatgtg

SEQ ID NO: 183950 - DNA, 25 bp, Rattus norvegicus
atctaagtctcctttttatcatgtg

SEQ ID NO: 183951 - DNA, 25 bp, Rattus norvegicus
atctaatccatcctctacaaaacaa

SEQ ID NO: 183952 - DNA, 25 bp, Rattus norvegicus
atctaatccatcgtctacaaaacaa

SEQ ID NO: 183953 - DNA, 25 bp, Rattus norvegicus
atctaatccctacccatgaggacaa

SEQ ID NO: 183954 - DNA, 25 bp, Rattus norvegicus
atctaatccctagccatgaggacaa

SEQ ID NO: 183955 - DNA, 25 bp, Rattus norvegicus
atctaatcgtgtcgcaccctatctt

SEQ ID NO: 183956 - DNA, 25 bp, Rattus norvegicus
atctaatcgtgtggcaccctatctt

SEQ ID NO: 183957 - DNA, 25 bp, Rattus norvegicus
atctaatctcttcaaccgtactagg

SEQ ID NO: 183958 - DNA, 25 bp, Rattus norvegicus
atctaatctcttgaaccgtactagg

SEQ ID NO: 183959 - DNA, 25 bp, Rattus norvegicus
atctaatgactaccgcttctccaaa

SEQ ID NO: 183960 - DNA, 25 bp, Rattus norvegicus
atctaatgactagcgcttctccaaa

SEQ ID NO: 183961 - DNA, 25 bp, Rattus norvegicus
atctaatgcagcacgtggcttcaag

SEQ ID NO: 183962 - DNA, 25 bp, Rattus norvegicus
atctaatgcagctcgtggcttcaag

SEQ ID NO: 183963 - DNA, 25 bp, Rattus norvegicus
atctaatggccgctttccctaagct

SEQ ID NO: 183964 - DNA, 25 bp, Rattus norvegicus
atctaatggccggtttccctaagct

SEQ ID NO: 183965 - DNA, 25 bp, Rattus norvegicus
atctacaaacaacccaagcctggtc

SEQ ID NO: 183966 - DNA, 25 bp, Rattus norvegicus
atctacaaacaagccaagcctggtc

SEQ ID NO: 183967 - DNA, 25 bp, Rattus norvegicus
atctacaagacaccttctccggcgt

SEQ ID NO: 183968 - DNA, 25 bp, Rattus norvegicus
atctacaagacagcttctccggcgt

SEQ ID NO: 183969 - DNA, 25 bp, Rattus norvegicus
atctacaaggctatcaggtctgaca

SEQ ID NO: 183970 - DNA, 25 bp, Rattus norvegicus
atctacaaggctttcaggtctgaca

SEQ ID NO: 183971 - DNA, 25 bp, Rattus norvegicus
atctacaatgacactcgggccaggg

SEQ ID NO: 183972 - DNA, 25 bp, Rattus norvegicus
atctacaatgactctcgggccaggg

SEQ ID NO: 183973 - DNA, 25 bp, Rattus norvegicus
atctacacagtgattcttggcataa

SEQ ID NO: 183974 - DNA, 25 bp, Rattus norvegicus
atctacacagtgtttcttggcataa

SEQ ID NO: 183975 - DNA, 25 bp, Rattus norvegicus
atctacaccatcatcaatgccgagt

SEQ ID NO: 183976 - DNA, 25 bp, Rattus norvegicus
atctacaccatcttcaatgccgagt

SEQ ID NO: 183977 - DNA, 25 bp, Rattus norvegicus
atctacaccattaggatcagggcgt

SEQ ID NO: 183978 - DNA, 25 bp, Rattus norvegicus
atctacaccatttggatcagggcgt

SEQ ID NO: 183979 - DNA, 25 bp, Rattus norvegicus
atctacactgttcaactggtctcca

SEQ ID NO: 183980 - DNA, 25 bp, Rattus norvegicus
atctacactgttgaactggtctcca

SEQ ID NO: 183981 - DNA, 25 bp, Rattus norvegicus
atctacagaggcacacaactccatg

SEQ ID NO: 183982 - DNA, 25 bp, Rattus norvegicus
atctacagaggctcacaactccatg

SEQ ID NO: 183983 - DNA, 25 bp, Rattus norvegicus
atctacagagtgagttctgggacag

SEQ ID NO: 183984 - DNA, 25 bp, Rattus norvegicus
atctacagagtgtgttctgggacag

SEQ ID NO: 183985 - DNA, 25 bp, Rattus norvegicus
atctacagatgcacagtgccttgtg

SEQ ID NO: 183986 - DNA, 25 bp, Rattus norvegicus
atctacagatgcactcttttccaac

SEQ ID NO: 183987 - DNA, 25 bp, Rattus norvegicus
atctacagatgctcagtgccttgtg

SEQ ID NO: 183988 - DNA, 25 bp, Rattus norvegicus
atctacagatgctctcttttccaac

SEQ ID NO: 183989 - DNA, 25 bp, Rattus norvegicus
atctacagccctcctcgaggatatg

SEQ ID NO: 183990 - DNA, 25 bp, Rattus norvegicus
atctacagccctgctcgaggatatg

SEQ ID NO: 183991 - DNA, 25 bp, Rattus norvegicus
atctacaggagaagcaatgccctct

SEQ ID NO: 183992 - DNA, 25 bp, Rattus norvegicus
atctacaggagatgcaatgccctct

SEQ ID NO: 183993 - DNA, 25 bp, Rattus norvegicus
atctacagtcctaggaaccatgcct

SEQ ID NO: 183994 - DNA, 25 bp, Rattus norvegicus
atctacagtccttggaaccatgcct

SEQ ID NO: 183995 - DNA, 25 bp, Rattus norvegicus
atctacagttccaacttccttaatg

SEQ ID NO: 183996 - DNA, 25 bp, Rattus norvegicus
atctacagttcctacttccttaatg

SEQ ID NO: 183997 - DNA, 25 bp, Rattus norvegicus
atctacatagccctgggtgtcctgg

SEQ ID NO: 183998 - DNA, 25 bp, Rattus norvegicus
atctacatagccgtgggtgtcctgg

SEQ ID NO: 183999 - DNA, 25 bp, Rattus norvegicus
atctacatcacacttatttgcgcgt

SEQ ID NO: 184000 - DNA, 25 bp, Rattus norvegicus
atctacatcacagttatttgcgcgt

SEQ ID NO: 184001 - DNA, 25 bp, Rattus norvegicus
atctacatcgtactgaccaccagta

SEQ ID NO: 184002 - DNA, 25 bp, Rattus norvegicus
atctacatcgtagtgaccaccagta

SEQ ID NO: 184003 - DNA, 25 bp, Rattus norvegicus
atctacatggaacaagcaccaccct

SEQ ID NO: 184004 - DNA, 25 bp, Rattus norvegicus
atctacatggaagaagcaccaccct

SEQ ID NO: 184005 - DNA, 25 bp, Rattus norvegicus
atctacatgtacaaggaaccctggg

SEQ ID NO: 184006 - DNA, 25 bp, Rattus norvegicus
atctacatgtactaggaaccctggg

SEQ ID NO: 184007 - DNA, 25 bp, Rattus norvegicus
atctaccaactccaacatgagtatc

SEQ ID NO: 184008 - DNA, 25 bp, Rattus norvegicus
atctaccaactcgaacatgagtatc

SEQ ID NO: 184009 - DNA, 25 bp, Rattus norvegicus
atctaccacaccattgcttacttga

SEQ ID NO: 184010 - DNA, 25 bp, Rattus norvegicus
atctaccacacctttgcttacttga

SEQ ID NO: 184011 - DNA, 25 bp, Rattus norvegicus
atctaccaccgaaagtgtatccaga

SEQ ID NO: 184012 - DNA, 25 bp, Rattus norvegicus
atctaccaccgatagtgtatccaga

SEQ ID NO: 184013 - DNA, 25 bp, Rattus norvegicus
atctaccactttcccaaatctttca

SEQ ID NO: 184014 - DNA, 25 bp, Rattus norvegicus
atctaccactttgccaaatctttca

SEQ ID NO: 184015 - DNA, 25 bp, Rattus norvegicus
atctaccagttccacggactgtatg

SEQ ID NO: 184016 - DNA, 25 bp, Rattus norvegicus
atctaccagttcgacggactgtatg

SEQ ID NO: 184017 - DNA, 25 bp, Rattus norvegicus
atctaccatccaccattaattgcta

SEQ ID NO: 184018 - DNA, 25 bp, Rattus norvegicus
atctaccatccagcattaattgcta

SEQ ID NO: 184019 - DNA, 25 bp, Rattus norvegicus
atctaccattgccagatcttctgtt

SEQ ID NO: 184020 - DNA, 25 bp, Rattus norvegicus
atctaccattgcgagatcttctgtt

SEQ ID NO: 184021 - DNA, 25 bp, Rattus norvegicus
atctacccaaggcatctgcaaggtc

SEQ ID NO: 184022 - DNA, 25 bp, Rattus norvegicus
atctacccaagggatctgcaaggtc

SEQ ID NO: 184023 - DNA, 25 bp, Rattus norvegicus
atctacccagaaaggcagttgcatt

SEQ ID NO: 184024 - DNA, 25 bp, Rattus norvegicus
atctacccagaatggcagttgcatt

SEQ ID NO: 184025 - DNA, 25 bp, Rattus norvegicus
atctacccatggctacagttgacat

SEQ ID NO: 184026 - DNA, 25 bp, Rattus norvegicus
atctacccatgggtacagttgacat

SEQ ID NO: 184027 - DNA, 25 bp, Rattus norvegicus
atctacccctacattgggctgacaa

SEQ ID NO: 184028 - DNA, 25 bp, Rattus norvegicus
atctacccctactttgggctgacaa

SEQ ID NO: 184029 - DNA, 25 bp, Rattus norvegicus
atctacccctgtactcttaaatgtt

SEQ ID NO: 184030 - DNA, 25 bp, Rattus norvegicus
atctacccctgttctcttaaatgtt

SEQ ID NO: 184031 - DNA, 25 bp, Rattus norvegicus
atctaccctgtacttttacttcatt

SEQ ID NO: 184032 - DNA, 25 bp, Rattus norvegicus
atctaccctgtagttttacttcatt

SEQ ID NO: 184033 - DNA, 25 bp, Rattus norvegicus
atctaccggactccctaccggattg

SEQ ID NO: 184034 - DNA, 25 bp, Rattus norvegicus
atctaccggactgcctaccggattg

SEQ ID NO: 184035 - DNA, 25 bp, Rattus norvegicus
atctacctcgtgatctaaacggcag

SEQ ID NO: 184036 - DNA, 25 bp, Rattus norvegicus
atctacctcgtgttctaaacggcag

SEQ ID NO: 184037 - DNA, 25 bp, Rattus norvegicus
atctacctcttaaacttccatttgc

SEQ ID NO: 184038 - DNA, 25 bp, Rattus norvegicus
atctacctcttaccagaacaatata

SEQ ID NO: 184039 - DNA, 25 bp, Rattus norvegicus
atctacctcttagcagaacaatata

SEQ ID NO: 184040 - DNA, 25 bp, Rattus norvegicus
atctacctcttatacttccatttgc

SEQ ID NO: 184041 - DNA, 25 bp, Rattus norvegicus
atctacctgaacatccagaggcgca

SEQ ID NO: 184042 - DNA, 25 bp, Rattus norvegicus
atctacctgaacttccagaggcgca

SEQ ID NO: 184043 - DNA, 25 bp, Rattus norvegicus
atctacctgagaaccatttgggcca

SEQ ID NO: 184044 - DNA, 25 bp, Rattus norvegicus
atctacctgagatccatttgggcca

SEQ ID NO: 184045 - DNA, 25 bp, Rattus norvegicus
atctacctggagctcttctacctga

SEQ ID NO: 184046 - DNA, 25 bp, Rattus norvegicus
atctacctggaggtcttctacctga

SEQ ID NO: 184047 - DNA, 25 bp, Rattus norvegicus
atctaccttcacatcttttggcaaa

SEQ ID NO: 184048 - DNA, 25 bp, Rattus norvegicus
atctaccttcacttcttttggcaaa

SEQ ID NO: 184049 - DNA, 25 bp, Rattus norvegicus
atctacgagccccattttacctatt

SEQ ID NO: 184050 - DNA, 25 bp, Rattus norvegicus
atctacgagcccgattttacctatt

SEQ ID NO: 184051 - DNA, 25 bp, Rattus norvegicus
atctacgagcggcactcaggtgcgc

SEQ ID NO: 184052 - DNA, 25 bp, Rattus norvegicus
atctacgagcgggactcaggtgcgc

SEQ ID NO: 184053 - DNA, 25 bp, Rattus norvegicus
atctacgatccaatctttcactgac

SEQ ID NO: 184054 - DNA, 25 bp, Rattus norvegicus
atctacgatccattctttcactgac

SEQ ID NO: 184055 - DNA, 25 bp, Rattus norvegicus
atctacgatgagaggccattatgtt

SEQ ID NO: 184056 - DNA, 25 bp, Rattus norvegicus
atctacgatgagtggccattatgtt

SEQ ID NO: 184057 - DNA, 25 bp, Rattus norvegicus
atctacggcggcagtggcatggaac

SEQ ID NO: 184058 - DNA, 25 bp, Rattus norvegicus
atctacggcggctgtggcatggaac

SEQ ID NO: 184059 - DNA, 25 bp, Rattus norvegicus
atctacggtgtccttgaggttccaa

SEQ ID NO: 184060 - DNA, 25 bp, Rattus norvegicus
atctacggtgtcgttgaggttccaa

SEQ ID NO: 184061 - DNA, 25 bp, Rattus norvegicus
atctacgtagacactgaaagccagc

SEQ ID NO: 184062 - DNA, 25 bp, Rattus norvegicus
atctacgtagactctgaaagccagc

SEQ ID NO: 184063 - DNA, 25 bp, Rattus norvegicus
atctacgttagaatgtccatcgaac

SEQ ID NO: 184064 - DNA, 25 bp, Rattus norvegicus
atctacgttagattgtccatcgaac

SEQ ID NO: 184065 - DNA, 25 bp, Rattus norvegicus
atctactacaagctctgagcggccg

SEQ ID NO: 184066 - DNA, 25 bp, Rattus norvegicus
atctactacaaggtctgagcggccg

SEQ ID NO: 184067 - DNA, 25 bp, Rattus norvegicus
atctactcagtaaatctagcctaat

SEQ ID NO: 184068 - DNA, 25 bp, Rattus norvegicus
atctactcagtatatctagcctaat

SEQ ID NO: 184069 - DNA, 25 bp, Rattus norvegicus
atctactccacgacttcagagatgt

SEQ ID NO: 184070 - DNA, 25 bp, Rattus norvegicus
atctactccacgtcttcagagatgt

SEQ ID NO: 184071 - DNA, 25 bp, Rattus norvegicus
atctactccctcaatgtgctggagg

SEQ ID NO: 184072 - DNA, 25 bp, Rattus norvegicus
atctactccctctatgtgctggagg

SEQ ID NO: 184073 - DNA, 25 bp, Rattus norvegicus
atctactctgatacccatgaacaac

SEQ ID NO: 184074 - DNA, 25 bp, Rattus norvegicus
atctactctgattcccatgaacaac

SEQ ID NO: 184075 - DNA, 25 bp, Rattus norvegicus
atctactgaccaaactccgaagtat

SEQ ID NO: 184076 - DNA, 25 bp, Rattus norvegicus
atctactgaccatactccgaagtat

SEQ ID NO: 184077 - DNA, 25 bp, Rattus norvegicus
atctactgcctcagctgtacttaaa

SEQ ID NO: 184078 - DNA, 25 bp, Rattus norvegicus
atctactgcctctgctgtacttaaa

SEQ ID NO: 184079 - DNA, 25 bp, Rattus norvegicus
atctactgctacctgcccaaggtgg

SEQ ID NO: 184080 - DNA, 25 bp, Rattus norvegicus
atctactgctacgtgcccaaggtgg

SEQ ID NO: 184081 - DNA, 25 bp, Rattus norvegicus
atctactgtctcatgggtcagcgac

SEQ ID NO: 184082 - DNA, 25 bp, Rattus norvegicus
atctactgtctcttgggtcagcgac

SEQ ID NO: 184083 - DNA, 25 bp, Rattus norvegicus
atctacttagttatggtttgctatg

SEQ ID NO: 184084 - DNA, 25 bp, Rattus norvegicus
atctacttagttttggtttgctatg

SEQ ID NO: 184085 - DNA, 25 bp, Rattus norvegicus
atctacttccctagagaggacaccg

SEQ ID NO: 184086 - DNA, 25 bp, Rattus norvegicus
atctacttcccttgagaggacaccg

SEQ ID NO: 184087 - DNA, 25 bp, Rattus norvegicus
atctacttcctgacccaggagaaaa

SEQ ID NO: 184088 - DNA, 25 bp, Rattus norvegicus
atctacttcctgtcccaggagaaaa

SEQ ID NO: 184089 - DNA, 25 bp, Rattus norvegicus
atctacttcggcaatgggatccaac

SEQ ID NO: 184090 - DNA, 25 bp, Rattus norvegicus
atctacttcggctatgggatccaac

SEQ ID NO: 184091 - DNA, 25 bp, Rattus norvegicus
atctagaactcacttacagcactcc

SEQ ID NO: 184092 - DNA, 25 bp, Rattus norvegicus
atctagaactcagttacagcactcc

SEQ ID NO: 184093 - DNA, 25 bp, Rattus norvegicus
atctagaagctcagggcacctgtta

SEQ ID NO: 184094 - DNA, 25 bp, Rattus norvegicus
atctagaagctctgggcacctgtta

SEQ ID NO: 184095 - DNA, 25 bp, Rattus norvegicus
atctagaccagcacacaactttgac

SEQ ID NO: 184096 - DNA, 25 bp, Rattus norvegicus
atctagaccagctcacaactttgac

SEQ ID NO: 184097 - DNA, 25 bp, Rattus norvegicus
atctagacgcaccttgagctccttt

SEQ ID NO: 184098 - DNA, 25 bp, Rattus norvegicus
atctagacgcacgttgagctccttt

SEQ ID NO: 184099 - DNA, 25 bp, Rattus norvegicus
atctagactgcacgcttgtgtggca

SEQ ID NO: 184100 - DNA, 25 bp, Rattus norvegicus
atctagactgcaggcttgtgtggca

SEQ ID NO: 184101 - DNA, 25 bp, Rattus norvegicus
atctagactgtacctttccaatcct

SEQ ID NO: 184102 - DNA, 25 bp, Rattus norvegicus
atctagactgtagctttccaatcct

SEQ ID NO: 184103 - DNA, 25 bp, Rattus norvegicus
atctagagatcaccaacagtcccct

SEQ ID NO: 184104 - DNA, 25 bp, Rattus norvegicus
atctagagatcagcaacagtcccct

SEQ ID NO: 184105 - DNA, 25 bp, Rattus norvegicus
atctagagattaatggcttgcagcc

SEQ ID NO: 184106 - DNA, 25 bp, Rattus norvegicus
atctagagattattggcttgcagcc

SEQ ID NO: 184107 - DNA, 25 bp, Rattus norvegicus
atctagagttctagttcagtgtata

SEQ ID NO: 184108 - DNA, 25 bp, Rattus norvegicus
atctagagttcttgttcagtgtata

SEQ ID NO: 184109 - DNA, 25 bp, Rattus norvegicus
atctagatattccatgcattgcccc

SEQ ID NO: 184110 - DNA, 25 bp, Rattus norvegicus
atctagatattcgatgcattgcccc

SEQ ID NO: 184111 - DNA, 25 bp, Rattus norvegicus
atctagatccatcaagacctgcgat

SEQ ID NO: 184112 - DNA, 25 bp, Rattus norvegicus
atctagatccatgaagacctgcgat

SEQ ID NO: 184113 - DNA, 25 bp, Rattus norvegicus
atctagcacatcacatctggacaac

SEQ ID NO: 184114 - DNA, 25 bp, Rattus norvegicus
atctagcacatctcatctggacaac

SEQ ID NO: 184115 - DNA, 25 bp, Rattus norvegicus
atctagccagacctcctgcatgctg

SEQ ID NO: 184116 - DNA, 25 bp, Rattus norvegicus
atctagccagacgtcctgcatgctg

SEQ ID NO: 184117 - DNA, 25 bp, Rattus norvegicus
atctagccatcacaggaagccacgg

SEQ ID NO: 184118 - DNA, 25 bp, Rattus norvegicus
atctagccatcagaggaagccacgg

SEQ ID NO: 184119 - DNA, 25 bp, Rattus norvegicus
atctagccccagacatacagtgttg

SEQ ID NO: 184120 - DNA, 25 bp, Rattus norvegicus
atctagccccagtcatacagtgttg

SEQ ID NO: 184121 - DNA, 25 bp, Rattus norvegicus
atctagctagcgagggtatggaccc

SEQ ID NO: 184122 - DNA, 25 bp, Rattus norvegicus
atctagctagcgtgggtatggaccc

SEQ ID NO: 184123 - DNA, 25 bp, Rattus norvegicus
atctagctcaggaacttgggcagcc

SEQ ID NO: 184124 - DNA, 25 bp, Rattus norvegicus
atctagctcaggtacttgggcagcc

SEQ ID NO: 184125 - DNA, 25 bp, Rattus norvegicus
atctagctccccacaaagagagtgc

SEQ ID NO: 184126 - DNA, 25 bp, Rattus norvegicus
atctagctcccctcaaagagagtgc

SEQ ID NO: 184127 - DNA, 25 bp, Rattus norvegicus
atctagctgtgcatggcctgtcgtt

SEQ ID NO: 184128 - DNA, 25 bp, Rattus norvegicus
atctagctgtgcttggcctgtcgtt

SEQ ID NO: 184129 - DNA, 25 bp, Rattus norvegicus
atctagcttctcctcctttaagaaa

SEQ ID NO: 184130 - DNA, 25 bp, Rattus norvegicus
atctagcttctcgtcctttaagaaa

SEQ ID NO: 184131 - DNA, 25 bp, Rattus norvegicus
atctaggaactgctcttctttcacc

SEQ ID NO: 184132 - DNA, 25 bp, Rattus norvegicus
atctaggaactggtcttctttcacc

SEQ ID NO: 184133 - DNA, 25 bp, Rattus norvegicus
atctaggacagccagtgtaacattg

SEQ ID NO: 184134 - DNA, 25 bp, Rattus norvegicus
atctaggacagcgagtgtaacattg

SEQ ID NO: 184135 - DNA, 25 bp, Rattus norvegicus
atctaggcagtgatgccgcacatct

SEQ ID NO: 184136 - DNA, 25 bp, Rattus norvegicus
atctaggcagtgttgccgcacatct

SEQ ID NO: 184137 - DNA, 25 bp, Rattus norvegicus
atctaggccctgagcagatgggaaa

SEQ ID NO: 184138 - DNA, 25 bp, Rattus norvegicus
atctaggccctgtgcagatgggaaa

SEQ ID NO: 184139 - DNA, 25 bp, Rattus norvegicus
atctagggctcaatagcacctcttt

SEQ ID NO: 184140 - DNA, 25 bp, Rattus norvegicus
atctagggctcattagcacctcttt

SEQ ID NO: 184141 - DNA, 25 bp, Rattus norvegicus
atctagggcttcacaaactaggtgt

SEQ ID NO: 184142 - DNA, 25 bp, Rattus norvegicus
atctagggcttctcaaactaggtgt

SEQ ID NO: 184143 - DNA, 25 bp, Rattus norvegicus
atctagggtctcatacttgctaaca

SEQ ID NO: 184144 - DNA, 25 bp, Rattus norvegicus
atctagggtctcttacttgctaaca

SEQ ID NO: 184145 - DNA, 25 bp, Rattus norvegicus
atctaggtgattctcttctctcaac

SEQ ID NO: 184146 - DNA, 25 bp, Rattus norvegicus
atctaggtgattgtcttctctcaac

SEQ ID NO: 184147 - DNA, 25 bp, Rattus norvegicus
atctaggtggcaactatccagaaaa

SEQ ID NO: 184148 - DNA, 25 bp, Rattus norvegicus
atctaggtggcatctatccagaaaa

SEQ ID NO: 184149 - DNA, 25 bp, Rattus norvegicus
atctaggtgttcatctaggactctc

SEQ ID NO: 184150 - DNA, 25 bp, Rattus norvegicus
atctaggtgttcttctaggactctc

SEQ ID NO: 184151 - DNA, 25 bp, Rattus norvegicus
atctaggttcctcacacaaatctat

SEQ ID NO: 184152 - DNA, 25 bp, Rattus norvegicus
atctaggttcctgacacaaatctat

SEQ ID NO: 184153 - DNA, 25 bp, Rattus norvegicus
atctaggttgctctcactttttctt

SEQ ID NO: 184154 - DNA, 25 bp, Rattus norvegicus
atctaggttgctgtcactttttctt

SEQ ID NO: 184155 - DNA, 25 bp, Rattus norvegicus
atctagtattaaagccttcacccct

SEQ ID NO: 184156 - DNA, 25 bp, Rattus norvegicus
atctagtattaatgccttcacccct

SEQ ID NO: 184157 - DNA, 25 bp, Rattus norvegicus
atctagtccccgagagatcagggta

SEQ ID NO: 184158 - DNA, 25 bp, Rattus norvegicus
atctagtccccgtgagatcagggta

SEQ ID NO: 184159 - DNA, 25 bp, Rattus norvegicus
atctagtccgaaaagctgcactcac

SEQ ID NO: 184160 - DNA, 25 bp, Rattus norvegicus
atctagtccgaatagctgcactcac

SEQ ID NO: 184161 - DNA, 25 bp, Rattus norvegicus
atctagtcctccacaaacattgcat

SEQ ID NO: 184162 - DNA, 25 bp, Rattus norvegicus
atctagtcctcctcaaacattgcat

SEQ ID NO: 184163 - DNA, 25 bp, Rattus norvegicus
atctagtctgccatctggagtgtga

SEQ ID NO: 184164 - DNA, 25 bp, Rattus norvegicus
atctagtctgccttctggagtgtga

SEQ ID NO: 184165 - DNA, 25 bp, Rattus norvegicus
atctagtctggtaagcaaaatctgc

SEQ ID NO: 184166 - DNA, 25 bp, Rattus norvegicus
atctagtctggttagcaaaatctgc

SEQ ID NO: 184167 - DNA, 25 bp, Rattus norvegicus
atctagtgccctcccggaactgtaa

SEQ ID NO: 184168 - DNA, 25 bp, Rattus norvegicus
atctagtgccctgccggaactgtaa

SEQ ID NO: 184169 - DNA, 25 bp, Rattus norvegicus
atctagtgcctactgttgcttttat

SEQ ID NO: 184170 - DNA, 25 bp, Rattus norvegicus
atctagtgcctagtgttgcttttat

SEQ ID NO: 184171 - DNA, 25 bp, Rattus norvegicus
atctagtgccttcaccagtagctgg

SEQ ID NO: 184172 - DNA, 25 bp, Rattus norvegicus
atctagtgccttgaccagtagctgg

SEQ ID NO: 184173 - DNA, 25 bp, Rattus norvegicus
atctagtgctgtcttctcgttcttg

SEQ ID NO: 184174 - DNA, 25 bp, Rattus norvegicus
atctagtgctgtgttctcgttcttg

SEQ ID NO: 184175 - DNA, 25 bp, Rattus norvegicus
atctagttaagacagcactgtcacc

SEQ ID NO: 184176 - DNA, 25 bp, Rattus norvegicus
atctagttaagagagcactgtcacc

SEQ ID NO: 184177 - DNA, 25 bp, Rattus norvegicus
atctagttccccacaaaagtaccag

SEQ ID NO: 184178 - DNA, 25 bp, Rattus norvegicus
atctagttcccctcaaaagtaccag

SEQ ID NO: 184179 - DNA, 25 bp, Rattus norvegicus
atctagttgatcctctcaaccaggg

SEQ ID NO: 184180 - DNA, 25 bp, Rattus norvegicus
atctagttgatcgtctcaaccaggg

SEQ ID NO: 184181 - DNA, 25 bp, Rattus norvegicus
atctagtttcctacattccagcagc

SEQ ID NO: 184182 - DNA, 25 bp, Rattus norvegicus
atctagtttccttcattccagcagc

SEQ ID NO: 184183 - DNA, 25 bp, Rattus norvegicus
atctagtttctcaagcgacttcctg

SEQ ID NO: 184184 - DNA, 25 bp, Rattus norvegicus
atctagtttctctagcgacttcctg

SEQ ID NO: 184185 - DNA, 25 bp, Rattus norvegicus
atctagttttgtctggcttccagca

SEQ ID NO: 184186 - DNA, 25 bp, Rattus norvegicus
atctagttttgtgtggcttccagca

SEQ ID NO: 184187 - DNA, 25 bp, Rattus norvegicus
atctagtttttcactgcaacaggga

SEQ ID NO: 184188 - DNA, 25 bp, Rattus norvegicus
atctagtttttctctgcaacaggga

SEQ ID NO: 184189 - DNA, 25 bp, Rattus norvegicus
atctagttttttccctctatgtcta

SEQ ID NO: 184190 - DNA, 25 bp, Rattus norvegicus
atctagttttttgcctctatgtcta

SEQ ID NO: 184191 - DNA, 25 bp, Rattus norvegicus
atctatacccataccattctgtttt

SEQ ID NO: 184192 - DNA, 25 bp, Rattus norvegicus
atctatacccattccattctgtttt

SEQ ID NO: 184193 - DNA, 25 bp, Rattus norvegicus
atctatagatttccctgtttttgac

SEQ ID NO: 184194 - DNA, 25 bp, Rattus norvegicus
atctatagatttgcctgtttttgac

SEQ ID NO: 184195 - DNA, 25 bp, Rattus norvegicus
atctatagcgtgagggttgcagcca

SEQ ID NO: 184196 - DNA, 25 bp, Rattus norvegicus
atctatagcgtgtgggttgcagcca

SEQ ID NO: 184197 - DNA, 25 bp, Rattus norvegicus
atctatagctgcaagccatgctctt

SEQ ID NO: 184198 - DNA, 25 bp, Rattus norvegicus
atctatagctgctagccatgctctt

SEQ ID NO: 184199 - DNA, 25 bp, Rattus norvegicus
atctatagttacatcctgtcagaaa

SEQ ID NO: 184200 - DNA, 25 bp, Rattus norvegicus
atctatagttacttcctgtcagaaa

SEQ ID NO: 184201 - DNA, 25 bp, Rattus norvegicus
atctatatgggtcacatttgctaat

SEQ ID NO: 184202 - DNA, 25 bp, Rattus norvegicus
atctatatgggtgacatttgctaat

SEQ ID NO: 184203 - DNA, 25 bp, Rattus norvegicus
atctatatgtatatgggacagggcc

SEQ ID NO: 184204 - DNA, 25 bp, Rattus norvegicus
atctatatgtatttgggacagggcc

SEQ ID NO: 184205 - DNA, 25 bp, Rattus norvegicus
atctatattccgataccatcagcaa

SEQ ID NO: 184206 - DNA, 25 bp, Rattus norvegicus
atctatattccgttaccatcagcaa

SEQ ID NO: 184207 - DNA, 25 bp, Rattus norvegicus
atctatattgtacagggtcccggga

SEQ ID NO: 184208 - DNA, 25 bp, Rattus norvegicus
atctatattgtagagggtcccggga

SEQ ID NO: 184209 - DNA, 25 bp, Rattus norvegicus
atctatcaccccatgtcattaggtt

SEQ ID NO: 184210 - DNA, 25 bp, Rattus norvegicus
atctatcaccccttgtcattaggtt

SEQ ID NO: 184211 - DNA, 25 bp, Rattus norvegicus
atctatcagccacaagagggcagca

SEQ ID NO: 184212 - DNA, 25 bp, Rattus norvegicus
atctatcagccagaagagggcagca

SEQ ID NO: 184213 - DNA, 25 bp, Rattus norvegicus
atctatcatctcctgatggtaacat

SEQ ID NO: 184214 - DNA, 25 bp, Rattus norvegicus
atctatcatctcgtgatggtaacat

SEQ ID NO: 184215 - DNA, 25 bp, Rattus norvegicus
atctatcctcaaataccgacacttg

SEQ ID NO: 184216 - DNA, 25 bp, Rattus norvegicus
atctatcctcaattaccgacacttg

SEQ ID NO: 184217 - DNA, 25 bp, Rattus norvegicus
atctatcctctccatgacgtttttg

SEQ ID NO: 184218 - DNA, 25 bp, Rattus norvegicus
atctatcctctcgatgacgtttttg

SEQ ID NO: 184219 - DNA, 25 bp, Rattus norvegicus
atctatcggtggctttcggatgtgt

SEQ ID NO: 184220 - DNA, 25 bp, Rattus norvegicus
atctatcggtgggtttcggatgtgt

SEQ ID NO: 184221 - DNA, 25 bp, Rattus norvegicus
atctatctatcccaacgtctgacat

SEQ ID NO: 184222 - DNA, 25 bp, Rattus norvegicus
atctatctatccgaacgtctgacat

SEQ ID NO: 184223 - DNA, 25 bp, Rattus norvegicus
atctatctctaactgccaagctctg

SEQ ID NO: 184224 - DNA, 25 bp, Rattus norvegicus
atctatctctaagtgccaagctctg

SEQ ID NO: 184225 - DNA, 25 bp, Rattus norvegicus
atctatctgaagagctctctaggcc

SEQ ID NO: 184226 - DNA, 25 bp, Rattus norvegicus
atctatctgaagtgctctctaggcc

SEQ ID NO: 184227 - DNA, 25 bp, Rattus norvegicus
atctatcttttcatgtctgtttcta

SEQ ID NO: 184228 - DNA, 25 bp, Rattus norvegicus
atctatcttttcttgtctgtttcta

SEQ ID NO: 184229 - DNA, 25 bp, Rattus norvegicus
atctatgaaagaaacagctggagct

SEQ ID NO: 184230 - DNA, 25 bp, Rattus norvegicus
atctatgaaagatacagctggagct

SEQ ID NO: 184231 - DNA, 25 bp, Rattus norvegicus
atctatgacccgctggagcatgtaa

SEQ ID NO: 184232 - DNA, 25 bp, Rattus norvegicus
atctatgacccggtggagcatgtaa

SEQ ID NO: 184233 - DNA, 25 bp, Rattus norvegicus
atctatgaccttatattggcttcag

SEQ ID NO: 184234 - DNA, 25 bp, Rattus norvegicus
atctatgaccttttattggcttcag

SEQ ID NO: 184235 - DNA, 25 bp, Rattus norvegicus
atctatgagcctaattcgatatcta

SEQ ID NO: 184236 - DNA, 25 bp, Rattus norvegicus
atctatgagccttattcgatatcta

SEQ ID NO: 184237 - DNA, 25 bp, Rattus norvegicus
atctatgagtgacagcagggcccct

SEQ ID NO: 184238 - DNA, 25 bp, Rattus norvegicus
atctatgagtgagagcagggcccct

SEQ ID NO: 184239 - DNA, 25 bp, Rattus norvegicus
atctatgatgatagtctcgtgaccg

SEQ ID NO: 184240 - DNA, 25 bp, Rattus norvegicus
atctatgatgattgtctcgtgaccg

SEQ ID NO: 184241 - DNA, 25 bp, Rattus norvegicus
atctatgcagcgattgtcttttata

SEQ ID NO: 184242 - DNA, 25 bp, Rattus norvegicus
atctatgcagcgtttgtcttttata

SEQ ID NO: 184243 - DNA, 25 bp, Rattus norvegicus
atctatgcatctatgggagttgtga

SEQ ID NO: 184244 - DNA, 25 bp, Rattus norvegicus
atctatgcatctttgggagttgtga

SEQ ID NO: 184245 - DNA, 25 bp, Rattus norvegicus
atctatgccgtgatgggaaagccag

SEQ ID NO: 184246 - DNA, 25 bp, Rattus norvegicus
atctatgccgtgttgggaaagccag

SEQ ID NO: 184247 - DNA, 25 bp, Rattus norvegicus
atctatgcggagaccaggctagcct

SEQ ID NO: 184248 - DNA, 25 bp, Rattus norvegicus
atctatgcggagtccaggctagcct

SEQ ID NO: 184249 - DNA, 25 bp, Rattus norvegicus
atctatgctaatatccctgaccttc

SEQ ID NO: 184250 - DNA, 25 bp, Rattus norvegicus
atctatgctaatttccctgaccttc

SEQ ID NO: 184251 - DNA, 25 bp, Rattus norvegicus
atctatggccgtcctgtttctgcta

SEQ ID NO: 184252 - DNA, 25 bp, Rattus norvegicus
atctatggccgtgctgtttctgcta

SEQ ID NO: 184253 - DNA, 25 bp, Rattus norvegicus
atctatggctttcttacccttgttc

SEQ ID NO: 184254 - DNA, 25 bp, Rattus norvegicus
atctatggctttgttacccttgttc

SEQ ID NO: 184255 - DNA, 25 bp, Rattus norvegicus
atctatggtcctcagtatcactttg

SEQ ID NO: 184256 - DNA, 25 bp, Rattus norvegicus
atctatggtcctgagtatcactttg

SEQ ID NO: 184257 - DNA, 25 bp, Rattus norvegicus
atctatggtgtgactcatgctggat

SEQ ID NO: 184258 - DNA, 25 bp, Rattus norvegicus
atctatggtgtgtctcatgctggat

SEQ ID NO: 184259 - DNA, 25 bp, Rattus norvegicus
atctatgtatctatcagcttttcaa

SEQ ID NO: 184260 - DNA, 25 bp, Rattus norvegicus
atctatgtatctttcagcttttcaa

SEQ ID NO: 184261 - DNA, 25 bp, Rattus norvegicus
atctatgtccatcgaacgtgcccgt

SEQ ID NO: 184262 - DNA, 25 bp, Rattus norvegicus
atctatgtccatggaacgtgcccgt

SEQ ID NO: 184263 - DNA, 25 bp, Rattus norvegicus
atctatgtctgtctgatccctaaac

SEQ ID NO: 184264 - DNA, 25 bp, Rattus norvegicus
atctatgtctgtgtgatccctaaac

SEQ ID NO: 184265 - DNA, 25 bp, Rattus norvegicus
atctatgtcttccagtgatcaccta

SEQ ID NO: 184266 - DNA, 25 bp, Rattus norvegicus
atctatgtcttcgagtgatcaccta

SEQ ID NO: 184267 - DNA, 25 bp, Rattus norvegicus
atctatgtctttatgaaccggcagt

SEQ ID NO: 184268 - DNA, 25 bp, Rattus norvegicus
atctatgtctttttgaaccggcagt

SEQ ID NO: 184269 - DNA, 25 bp, Rattus norvegicus
atctatgtgggtcttacttggctgt

SEQ ID NO: 184270 - DNA, 25 bp, Rattus norvegicus
atctatgtgggtgttacttggctgt

SEQ ID NO: 184271 - DNA, 25 bp, Rattus norvegicus
atctatgttcctctgtaactgcgtc

SEQ ID NO: 184272 - DNA, 25 bp, Rattus norvegicus
atctatgttcctgtgtaactgcgtc

SEQ ID NO: 184273 - DNA, 25 bp, Rattus norvegicus
atctatgttgtacccaaaccttgtg

SEQ ID NO: 184274 - DNA, 25 bp, Rattus norvegicus
atctatgttgtagccaaaccttgtg

SEQ ID NO: 184275 - DNA, 25 bp, Rattus norvegicus
atctattaggaactgctcccgctct

SEQ ID NO: 184276 - DNA, 25 bp, Rattus norvegicus
atctattaggaagtgctcccgctct

SEQ ID NO: 184277 - DNA, 25 bp, Rattus norvegicus
atctattatcgtcggagcgctctac

SEQ ID NO: 184278 - DNA, 25 bp, Rattus norvegicus
atctattatcgtgggagcgctctac

SEQ ID NO: 184279 - DNA, 25 bp, Rattus norvegicus
atctattcacaaccagtagctcctg

SEQ ID NO: 184280 - DNA, 25 bp, Rattus norvegicus
atctattcacaagcagtagctcctg

SEQ ID NO: 184281 - DNA, 25 bp, Rattus norvegicus
atctattcccagcttcttggttggc

SEQ ID NO: 184282 - DNA, 25 bp, Rattus norvegicus
atctattcccaggttcttggttggc

SEQ ID NO: 184283 - DNA, 25 bp, Rattus norvegicus
atctattgcagtcatttctcctcaa

SEQ ID NO: 184284 - DNA, 25 bp, Rattus norvegicus
atctattgcagtgatttctcctcaa

SEQ ID NO: 184285 - DNA, 25 bp, Rattus norvegicus
atctattgttgtcgcttcttgtgta

SEQ ID NO: 184286 - DNA, 25 bp, Rattus norvegicus
atctattgttgtggcttcttgtgta

SEQ ID NO: 184287 - DNA, 25 bp, Rattus norvegicus
atctatttcactaccgtcctaaaga

SEQ ID NO: 184288 - DNA, 25 bp, Rattus norvegicus
atctatttcacttccgtcctaaaga

SEQ ID NO: 184289 - DNA, 25 bp, Rattus norvegicus
atctatttcggaccaccagtgggtc

SEQ ID NO: 184290 - DNA, 25 bp, Rattus norvegicus
atctatttcggagcaccagtgggtc

SEQ ID NO: 184291 - DNA, 25 bp, Rattus norvegicus
atctatttggttcttgtatgtgggc

SEQ ID NO: 184292 - DNA, 25 bp, Rattus norvegicus
atctatttggttgttgtatgtgggc

SEQ ID NO: 184293 - DNA, 25 bp, Rattus norvegicus
atctattttagaagccctctggaag

SEQ ID NO: 184294 - DNA, 25 bp, Rattus norvegicus
atctattttagatgccctctggaag

SEQ ID NO: 184295 - DNA, 25 bp, Rattus norvegicus
atctatttttctagaacttcctaag

SEQ ID NO: 184296 - DNA, 25 bp, Rattus norvegicus
atctatttttctctactgacatgca

SEQ ID NO: 184297 - DNA, 25 bp, Rattus norvegicus
atctatttttctgtactgacatgca

SEQ ID NO: 184298 - DNA, 25 bp, Rattus norvegicus
atctatttttcttgaacttcctaag

SEQ ID NO: 184299 - DNA, 25 bp, Rattus norvegicus
atctattttttccagccatgtcaca

SEQ ID NO: 184300 - DNA, 25 bp, Rattus norvegicus
atctattttttcgagccatgtcaca

SEQ ID NO: 184301 - DNA, 25 bp, Rattus norvegicus
atctcaaacatcatccaggatctgc

SEQ ID NO: 184302 - DNA, 25 bp, Rattus norvegicus
atctcaaacatcttccaggatctgc

SEQ ID NO: 184303 - DNA, 25 bp, Rattus norvegicus
atctcaaagtggacgcatctgcatt

SEQ ID NO: 184304 - DNA, 25 bp, Rattus norvegicus
atctcaaagtggtcgcatctgcatt

SEQ ID NO: 184305 - DNA, 25 bp, Rattus norvegicus
atctcaaatttcagtgccaacctca

SEQ ID NO: 184306 - DNA, 25 bp, Rattus norvegicus
atctcaaatttctgtgccaacctca

SEQ ID NO: 184307 - DNA, 25 bp, Rattus norvegicus
atctcaacttgcaaacatgttctca

SEQ ID NO: 184308 - DNA, 25 bp, Rattus norvegicus
atctcaacttgctaacatgttctca

SEQ ID NO: 184309 - DNA, 25 bp, Rattus norvegicus
atctcaagaaagcatcctccctgtc

SEQ ID NO: 184310 - DNA, 25 bp, Rattus norvegicus
atctcaagaaaggatcctccctgtc

SEQ ID NO: 184311 - DNA, 25 bp, Rattus norvegicus
atctcaagacttacttaggcaggaa

SEQ ID NO: 184312 - DNA, 25 bp, Rattus norvegicus
atctcaagactttcttaggcaggaa

SEQ ID NO: 184313 - DNA, 25 bp, Rattus norvegicus
atctcaagagccctatttccaatcc

SEQ ID NO: 184314 - DNA, 25 bp, Rattus norvegicus
atctcaagagccgtatttccaatcc

SEQ ID NO: 184315 - DNA, 25 bp, Rattus norvegicus
atctcaagagtgaggctatccccta

SEQ ID NO: 184316 - DNA, 25 bp, Rattus norvegicus
atctcaagagtgtggctatccccta

SEQ ID NO: 184317 - DNA, 25 bp, Rattus norvegicus
atctcaaggcctcctagaatctcgt

SEQ ID NO: 184318 - DNA, 25 bp, Rattus norvegicus
atctcaaggcctgctagaatctcgt

SEQ ID NO: 184319 - DNA, 25 bp, Rattus norvegicus
atctcaagggagaggccaccttcgt

SEQ ID NO: 184320 - DNA, 25 bp, Rattus norvegicus
atctcaagggagtggccaccttcgt

SEQ ID NO: 184321 - DNA, 25 bp, Rattus norvegicus
atctcaagggcgatgggcacacaaa

SEQ ID NO: 184322 - DNA, 25 bp, Rattus norvegicus
atctcaagggcgttgggcacacaaa

SEQ ID NO: 184323 - DNA, 25 bp, Rattus norvegicus
atctcaagggctcctaaatgtggga

SEQ ID NO: 184324 - DNA, 25 bp, Rattus norvegicus
atctcaagggctgctaaatgtggga

SEQ ID NO: 184325 - DNA, 25 bp, Rattus norvegicus
atctcaagtacaatggcctttgctg

SEQ ID NO: 184326 - DNA, 25 bp, Rattus norvegicus
atctcaagtacattggcctttgctg

SEQ ID NO: 184327 - DNA, 25 bp, Rattus norvegicus
atctcaagtcgtcgctggacaaata

SEQ ID NO: 184328 - DNA, 25 bp, Rattus norvegicus
atctcaagtcgtggctggacaaata

SEQ ID NO: 184329 - DNA, 25 bp, Rattus norvegicus
atctcaatctcacagaggccactgt

SEQ ID NO: 184330 - DNA, 25 bp, Rattus norvegicus
atctcaatctcagagaggccactgt

SEQ ID NO: 184331 - DNA, 25 bp, Rattus norvegicus
atctcaatctctacaaactcttcag

SEQ ID NO: 184332 - DNA, 25 bp, Rattus norvegicus
atctcaatctcttcaaactcttcag

SEQ ID NO: 184333 - DNA, 25 bp, Rattus norvegicus
atctcaatgcaccagaaccaattgc

SEQ ID NO: 184334 - DNA, 25 bp, Rattus norvegicus
atctcaatgcacgagaaccaattgc

SEQ ID NO: 184335 - DNA, 25 bp, Rattus norvegicus
atctcaattagtcacggtcctccgg

SEQ ID NO: 184336 - DNA, 25 bp, Rattus norvegicus
atctcaattagtgacggtcctccgg

SEQ ID NO: 184337 - DNA, 25 bp, Rattus norvegicus
atctcaattgtgattcttcatcagc

SEQ ID NO: 184338 - DNA, 25 bp, Rattus norvegicus
atctcaattgtgtttcttcatcagc

SEQ ID NO: 184339 - DNA, 25 bp, Rattus norvegicus
atctcacaaccaaccaatttacttt

SEQ ID NO: 184340 - DNA, 25 bp, Rattus norvegicus
atctcacaaccatccaatttacttt

SEQ ID NO: 184341 - DNA, 25 bp, Rattus norvegicus
atctcacaaggtatcaaagtccaca

SEQ ID NO: 184342 - DNA, 25 bp, Rattus norvegicus
atctcacaaggtttcaaagtccaca

SEQ ID NO: 184343 - DNA, 25 bp, Rattus norvegicus
atctcacagaatcttgaatatgcaa

SEQ ID NO: 184344 - DNA, 25 bp, Rattus norvegicus
atctcacagaatgttgaatatgcaa

SEQ ID NO: 184345 - DNA, 25 bp, Rattus norvegicus
atctcacaggtacttttgggtctca

SEQ ID NO: 184346 - DNA, 25 bp, Rattus norvegicus
atctcacaggtagttttgggtctca

SEQ ID NO: 184347 - DNA, 25 bp, Rattus norvegicus
atctcaccaactccgacaaatgtaa

SEQ ID NO: 184348 - DNA, 25 bp, Rattus norvegicus
atctcaccaactgcgacaaatgtaa

SEQ ID NO: 184349 - DNA, 25 bp, Rattus norvegicus
atctcaccacttcttgtgttcatag

SEQ ID NO: 184350 - DNA, 25 bp, Rattus norvegicus
atctcaccacttgttgtgttcatag

SEQ ID NO: 184351 - DNA, 25 bp, Rattus norvegicus
atctcaccatgtagaccatgtctgg

SEQ ID NO: 184352 - DNA, 25 bp, Rattus norvegicus
atctcaccatgttgaccatgtctgg

SEQ ID NO: 184353 - DNA, 25 bp, Rattus norvegicus
atctcaccatttcctgatccaaagc

SEQ ID NO: 184354 - DNA, 25 bp, Rattus norvegicus
atctcaccatttgctgatccaaagc

SEQ ID NO: 184355 - DNA, 25 bp, Rattus norvegicus
atctcacccagaagacggtttctga

SEQ ID NO: 184356 - DNA, 25 bp, Rattus norvegicus
atctcacccagaatggtccctgtga

SEQ ID NO: 184357 - DNA, 25 bp, Rattus norvegicus
atctcacccagatgacggtttctga

SEQ ID NO: 184358 - DNA, 25 bp, Rattus norvegicus
atctcacccagattggtccctgtga

SEQ ID NO: 184359 - DNA, 25 bp, Rattus norvegicus
atctcacccctccataggagagctg

SEQ ID NO: 184360 - DNA, 25 bp, Rattus norvegicus
atctcacccctcgataggagagctg

SEQ ID NO: 184361 - DNA, 25 bp, Rattus norvegicus
atctcacccctgataagcttctgtt

SEQ ID NO: 184362 - DNA, 25 bp, Rattus norvegicus
atctcacccctgttaagcttctgtt

SEQ ID NO: 184363 - DNA, 25 bp, Rattus norvegicus
atctcacccgtgatctgtgataact

SEQ ID NO: 184364 - DNA, 25 bp, Rattus norvegicus
atctcacccgtgttctgtgataact

SEQ ID NO: 184365 - DNA, 25 bp, Rattus norvegicus
atctcaccctacagtgcatggagga

SEQ ID NO: 184366 - DNA, 25 bp, Rattus norvegicus
atctcaccctactgtgcatggagga

SEQ ID NO: 184367 - DNA, 25 bp, Rattus norvegicus
atctcaccgcggaatgatgggaccc

SEQ ID NO: 184368 - DNA, 25 bp, Rattus norvegicus
atctcaccgcggtatgatgggaccc

SEQ ID NO: 184369 - DNA, 25 bp, Rattus norvegicus
atctcaccttctcttgttctggatt

SEQ ID NO: 184370 - DNA, 25 bp, Rattus norvegicus
atctcaccttctgttgttctggatt

SEQ ID NO: 184371 - DNA, 25 bp, Rattus norvegicus
atctcacgccacagctgacggtagt

SEQ ID NO: 184372 - DNA, 25 bp, Rattus norvegicus
atctcacgccactgctgacggtagt

SEQ ID NO: 184373 - DNA, 25 bp, Rattus norvegicus
atctcacgctctacaatttttcttt

SEQ ID NO: 184374 - DNA, 25 bp, Rattus norvegicus
atctcacgctcttcaatttttcttt

SEQ ID NO: 184375 - DNA, 25 bp, Rattus norvegicus
atctcacgctgacacaggtacatgt

SEQ ID NO: 184376 - DNA, 25 bp, Rattus norvegicus
atctcacgctgagacaggtacatgt

SEQ ID NO: 184377 - DNA, 25 bp, Rattus norvegicus
atctcacggtgtaagcaggactcta

SEQ ID NO: 184378 - DNA, 25 bp, Rattus norvegicus
atctcacggtgttagcaggactcta

SEQ ID NO: 184379 - DNA, 25 bp, Rattus norvegicus
atctcacgtgctcagtctccagaga

SEQ ID NO: 184380 - DNA, 25 bp, Rattus norvegicus
atctcacgtgctgagtctccagaga

SEQ ID NO: 184381 - DNA, 25 bp, Rattus norvegicus
atctcacgtgttatgtaccccaatg

SEQ ID NO: 184382 - DNA, 25 bp, Rattus norvegicus
atctcacgtgttttgtaccccaatg

SEQ ID NO: 184383 - DNA, 25 bp, Rattus norvegicus
atctcactagccctgtgtaacagaa

SEQ ID NO: 184384 - DNA, 25 bp, Rattus norvegicus
atctcactagccgtgtgtaacagaa

SEQ ID NO: 184385 - DNA, 25 bp, Rattus norvegicus
atctcactatagctacactcgggta

SEQ ID NO: 184386 - DNA, 25 bp, Rattus norvegicus
atctcactataggtacactcgggta

SEQ ID NO: 184387 - DNA, 25 bp, Rattus norvegicus
atctcactattactgtctggcttgg

SEQ ID NO: 184388 - DNA, 25 bp, Rattus norvegicus
atctcactattagtgtctggcttgg

SEQ ID NO: 184389 - DNA, 25 bp, Rattus norvegicus
atctcactcaaactggtgacaccac

SEQ ID NO: 184390 - DNA, 25 bp, Rattus norvegicus
atctcactcaaagtggtgacaccac

SEQ ID NO: 184391 - DNA, 25 bp, Rattus norvegicus
atctcactcagcaggacttggtagg

SEQ ID NO: 184392 - DNA, 25 bp, Rattus norvegicus
atctcactcagctggacttggtagg

SEQ ID NO: 184393 - DNA, 25 bp, Rattus norvegicus
atctcactctcaagccttataaatc

SEQ ID NO: 184394 - DNA, 25 bp, Rattus norvegicus
atctcactctcatgccttataaatc

SEQ ID NO: 184395 - DNA, 25 bp, Rattus norvegicus
atctcactctgcagcttcttaataa

SEQ ID NO: 184396 - DNA, 25 bp, Rattus norvegicus
atctcactctgctgcttcttaataa

SEQ ID NO: 184397 - DNA, 25 bp, Rattus norvegicus
atctcactgacaaaatttgtttcag

SEQ ID NO: 184398 - DNA, 25 bp, Rattus norvegicus
atctcactgacataatttgtttcag

SEQ ID NO: 184399 - DNA, 25 bp, Rattus norvegicus
atctcactgagcaacttagaacttt

SEQ ID NO: 184400 - DNA, 25 bp, Rattus norvegicus
atctcactgagctacttagaacttt

SEQ ID NO: 184401 - DNA, 25 bp, Rattus norvegicus
atctcactgggtctctcatgaatga

SEQ ID NO: 184402 - DNA, 25 bp, Rattus norvegicus
atctcactgggtgtctcatgaatga

SEQ ID NO: 184403 - DNA, 25 bp, Rattus norvegicus
atctcactgtcacggtagccaggac

SEQ ID NO: 184404 - DNA, 25 bp, Rattus norvegicus
atctcactgtcagggtagccaggac

SEQ ID NO: 184405 - DNA, 25 bp, Rattus norvegicus
atctcactgttgataggtcatgctc

SEQ ID NO: 184406 - DNA, 25 bp, Rattus norvegicus
atctcactgttgctgactgtgctgg

SEQ ID NO: 184407 - DNA, 25 bp, Rattus norvegicus
atctcactgttggtgactgtgctgg

SEQ ID NO: 184408 - DNA, 25 bp, Rattus norvegicus
atctcactgttgttaggtcatgctc

SEQ ID NO: 184409 - DNA, 25 bp, Rattus norvegicus
atctcactttagatagacccttcct

SEQ ID NO: 184410 - DNA, 25 bp, Rattus norvegicus
atctcactttagttagacccttcct

SEQ ID NO: 184411 - DNA, 25 bp, Rattus norvegicus
atctcacttttgattcttaggcttg

SEQ ID NO: 184412 - DNA, 25 bp, Rattus norvegicus
atctcacttttgtttcttaggcttg

SEQ ID NO: 184413 - DNA, 25 bp, Rattus norvegicus
atctcagaagtgattgtttatgcaa

SEQ ID NO: 184414 - DNA, 25 bp, Rattus norvegicus
atctcagaagtgtttgtttatgcaa

SEQ ID NO: 184415 - DNA, 25 bp, Rattus norvegicus
atctcagaatacaggcctaccacat

SEQ ID NO: 184416 - DNA, 25 bp, Rattus norvegicus
atctcagaatactggcctaccacat

SEQ ID NO: 184417 - DNA, 25 bp, Rattus norvegicus
atctcagacattataccgcttctgc

SEQ ID NO: 184418 - DNA, 25 bp, Rattus norvegicus
atctcagacattttaccgcttctgc

SEQ ID NO: 184419 - DNA, 25 bp, Rattus norvegicus
atctcagaggcacttcaccattctt

SEQ ID NO: 184420 - DNA, 25 bp, Rattus norvegicus
atctcagaggcagttcaccattctt

SEQ ID NO: 184421 - DNA, 25 bp, Rattus norvegicus
atctcagagtaactatagcagtcta

SEQ ID NO: 184422 - DNA, 25 bp, Rattus norvegicus
atctcagagtaagtatagcagtcta

SEQ ID NO: 184423 - DNA, 25 bp, Rattus norvegicus
atctcagatatgcagggtccaggga

SEQ ID NO: 184424 - DNA, 25 bp, Rattus norvegicus
atctcagatatggagggtccaggga

SEQ ID NO: 184425 - DNA, 25 bp, Rattus norvegicus
atctcagatcctcaaggcctgctta

SEQ ID NO: 184426 - DNA, 25 bp, Rattus norvegicus
atctcagatcctgaaggcctgctta

SEQ ID NO: 184427 - DNA, 25 bp, Rattus norvegicus
atctcagatgccagcaaaacaacgg

SEQ ID NO: 184428 - DNA, 25 bp, Rattus norvegicus
atctcagatgcctgcaaaacaacgg

SEQ ID NO: 184429 - DNA, 25 bp, Rattus norvegicus
atctcagcaaatccttaccacagta

SEQ ID NO: 184430 - DNA, 25 bp, Rattus norvegicus
atctcagcaaatgcttaccacagta

SEQ ID NO: 184431 - DNA, 25 bp, Rattus norvegicus
atctcagcaagccagggccacataa

SEQ ID NO: 184432 - DNA, 25 bp, Rattus norvegicus
atctcagcaagcgagggccacataa

SEQ ID NO: 184433 - DNA, 25 bp, Rattus norvegicus
atctcagcaagtccttctggtagca

SEQ ID NO: 184434 - DNA, 25 bp, Rattus norvegicus
atctcagcaagtgcttctggtagca

SEQ ID NO: 184435 - DNA, 25 bp, Rattus norvegicus
atctcagcacaccaatagggacagg

SEQ ID NO: 184436 - DNA, 25 bp, Rattus norvegicus
atctcagcacacgaatagggacagg

SEQ ID NO: 184437 - DNA, 25 bp, Rattus norvegicus
atctcagcagtgctcttgtttggaa

SEQ ID NO: 184438 - DNA, 25 bp, Rattus norvegicus
atctcagcagtggtcttgtttggaa

SEQ ID NO: 184439 - DNA, 25 bp, Rattus norvegicus
atctcagccagtcgcttgtgggcac

SEQ ID NO: 184440 - DNA, 25 bp, Rattus norvegicus
atctcagccagtggcttgtgggcac

SEQ ID NO: 184441 - DNA, 25 bp, Rattus norvegicus
atctcagcccgcctagtgatggttc

SEQ ID NO: 184442 - DNA, 25 bp, Rattus norvegicus
atctcagcccgcgtagtgatggttc

SEQ ID NO: 184443 - DNA, 25 bp, Rattus norvegicus
atctcagccgccaagataagggact

SEQ ID NO: 184444 - DNA, 25 bp, Rattus norvegicus
atctcagccgcctagataagggact

SEQ ID NO: 184445 - DNA, 25 bp, Rattus norvegicus
atctcagcgtggaactctcttgatg

SEQ ID NO: 184446 - DNA, 25 bp, Rattus norvegicus
atctcagcgtggtactctcttgatg

SEQ ID NO: 184447 - DNA, 25 bp, Rattus norvegicus
atctcagctatgagctcattggcag

SEQ ID NO: 184448 - DNA, 25 bp, Rattus norvegicus
atctcagctatgtgctcattggcag

SEQ ID NO: 184449 - DNA, 25 bp, Rattus norvegicus
atctcagctccactgtgaatagcca

SEQ ID NO: 184450 - DNA, 25 bp, Rattus norvegicus
atctcagctccagtgtgaatagcca

SEQ ID NO: 184451 - DNA, 25 bp, Rattus norvegicus
atctcagcttagactcaccaagtgc

SEQ ID NO: 184452 - DNA, 25 bp, Rattus norvegicus
atctcagcttagtctcaccaagtgc

SEQ ID NO: 184453 - DNA, 25 bp, Rattus norvegicus
atctcaggagcaaatcctggccttg

SEQ ID NO: 184454 - DNA, 25 bp, Rattus norvegicus
atctcaggagcatatcctggccttg

SEQ ID NO: 184455 - DNA, 25 bp, Rattus norvegicus
atctcaggaggcaaacttcaggttc

SEQ ID NO: 184456 - DNA, 25 bp, Rattus norvegicus
atctcaggaggctaacttcaggttc

SEQ ID NO: 184457 - DNA, 25 bp, Rattus norvegicus
atctcaggcagtagctgtcactggg

SEQ ID NO: 184458 - DNA, 25 bp, Rattus norvegicus
atctcaggcagttgctgtcactggg

SEQ ID NO: 184459 - DNA, 25 bp, Rattus norvegicus
atctcaggcctgaacatgtctatgc

SEQ ID NO: 184460 - DNA, 25 bp, Rattus norvegicus
atctcaggcctgtacatgtctatgc

SEQ ID NO: 184461 - DNA, 25 bp, Rattus norvegicus
atctcaggctagcactcagaccaag

SEQ ID NO: 184462 - DNA, 25 bp, Rattus norvegicus
atctcaggctaggactcagaccaag

SEQ ID NO: 184463 - DNA, 25 bp, Rattus norvegicus
atctcagggcctccagggactctgg

SEQ ID NO: 184464 - DNA, 25 bp, Rattus norvegicus
atctcagggcctgcagggactctgg

SEQ ID NO: 184465 - DNA, 25 bp, Rattus norvegicus
atctcagggtccctgttggcaatga

SEQ ID NO: 184466 - DNA, 25 bp, Rattus norvegicus
atctcagggtccgtgttggcaatga

SEQ ID NO: 184467 - DNA, 25 bp, Rattus norvegicus
atctcagggtctaatgcacctcatt

SEQ ID NO: 184468 - DNA, 25 bp, Rattus norvegicus
atctcagggtcttatgcacctcatt

SEQ ID NO: 184469 - DNA, 25 bp, Rattus norvegicus
atctcagggttgaatcagtcactcc

SEQ ID NO: 184470 - DNA, 25 bp, Rattus norvegicus
atctcagggttgtatcagtcactcc

SEQ ID NO: 184471 - DNA, 25 bp, Rattus norvegicus
atctcaggttggcaatgctgttggc

SEQ ID NO: 184472 - DNA, 25 bp, Rattus norvegicus
atctcaggttgggaatgctgttggc

SEQ ID NO: 184473 - DNA, 25 bp, Rattus norvegicus
atctcagtcagcatcagtggcttgt

SEQ ID NO: 184474 - DNA, 25 bp, Rattus norvegicus
atctcagtcagcttcagtggcttgt

SEQ ID NO: 184475 - DNA, 25 bp, Rattus norvegicus
atctcagtctggacccacggtaaag

SEQ ID NO: 184476 - DNA, 25 bp, Rattus norvegicus
atctcagtctggactgtaacacttc

SEQ ID NO: 184477 - DNA, 25 bp, Rattus norvegicus
atctcagtctggtcccacggtaaag

SEQ ID NO: 184478 - DNA, 25 bp, Rattus norvegicus
atctcagtctggtctgtaacacttc

SEQ ID NO: 184479 - DNA, 25 bp, Rattus norvegicus
atctcagtggccacagagtaagcca

SEQ ID NO: 184480 - DNA, 25 bp, Rattus norvegicus
atctcagtggccaccgagcaataga

SEQ ID NO: 184481 - DNA, 25 bp, Rattus norvegicus
atctcagtggcctcagagtaagcca

SEQ ID NO: 184482 - DNA, 25 bp, Rattus norvegicus
atctcagtggcctccgagcaataga

SEQ ID NO: 184483 - DNA, 25 bp, Rattus norvegicus
atctcagtggttactgtattcattc

SEQ ID NO: 184484 - DNA, 25 bp, Rattus norvegicus
atctcagtggtttctgtattcattc

SEQ ID NO: 184485 - DNA, 25 bp, Rattus norvegicus
atctcagtgtcacggactcagtcct

SEQ ID NO: 184486 - DNA, 25 bp, Rattus norvegicus
atctcagtgtcagggactcagtcct

SEQ ID NO: 184487 - DNA, 25 bp, Rattus norvegicus
atctcagttagccactctggtcaag

SEQ ID NO: 184488 - DNA, 25 bp, Rattus norvegicus
atctcagttagcgactctggtcaag

SEQ ID NO: 184489 - DNA, 25 bp, Rattus norvegicus
atctcagttgggactcctgttgaaa

SEQ ID NO: 184490 - DNA, 25 bp, Rattus norvegicus
atctcagttgggtctcctgttgaaa

SEQ ID NO: 184491 - DNA, 25 bp, Rattus norvegicus
atctcagtttatatgctccatacct

SEQ ID NO: 184492 - DNA, 25 bp, Rattus norvegicus
atctcagtttatttgctccatacct

SEQ ID NO: 184493 - DNA, 25 bp, Rattus norvegicus
atctcagtttgtaacatcgtgccat

SEQ ID NO: 184494 - DNA, 25 bp, Rattus norvegicus
atctcagtttgttacatcgtgccat

SEQ ID NO: 184495 - DNA, 25 bp, Rattus norvegicus
atctcagtttttacctcaatgttta

SEQ ID NO: 184496 - DNA, 25 bp, Rattus norvegicus
atctcagtttttcaggtgcattcct

SEQ ID NO: 184497 - DNA, 25 bp, Rattus norvegicus
atctcagtttttgaggtgcattcct

SEQ ID NO: 184498 - DNA, 25 bp, Rattus norvegicus
atctcagttttttcctcaatgttta

SEQ ID NO: 184499 - DNA, 25 bp, Rattus norvegicus
atctcataaattctgggccactctt

SEQ ID NO: 184500 - DNA, 25 bp, Rattus norvegicus
atctcataaattgtgggccactctt

SEQ ID NO: 184501 - DNA, 25 bp, Rattus norvegicus
atctcatactggcacctgcatgtac

SEQ ID NO: 184502 - DNA, 25 bp, Rattus norvegicus
atctcatactgggacctgcatgtac

SEQ ID NO: 184503 - DNA, 25 bp, Rattus norvegicus
atctcatacttgctttaatgtcctt

SEQ ID NO: 184504 - DNA, 25 bp, Rattus norvegicus
atctcatacttggtttaatgtcctt

SEQ ID NO: 184505 - DNA, 25 bp, Rattus norvegicus
atctcatattacaccatgcttttcc

SEQ ID NO: 184506 - DNA, 25 bp, Rattus norvegicus
atctcatattactccatgcttttcc

SEQ ID NO: 184507 - DNA, 25 bp, Rattus norvegicus
atctcatccattccccagggtgtag

SEQ ID NO: 184508 - DNA, 25 bp, Rattus norvegicus
atctcatccattgcccagggtgtag

SEQ ID NO: 184509 - DNA, 25 bp, Rattus norvegicus
atctcatcccaaaagcagctaaggt

SEQ ID NO: 184510 - DNA, 25 bp, Rattus norvegicus
atctcatcccaatagcagctaaggt

SEQ ID NO: 184511 - DNA, 25 bp, Rattus norvegicus
atctcatcgctgagatgtgtggacg

SEQ ID NO: 184512 - DNA, 25 bp, Rattus norvegicus
atctcatcgctgtgatgtgtggacg

SEQ ID NO: 184513 - DNA, 25 bp, Rattus norvegicus
atctcatctcctaaatgcactagca

SEQ ID NO: 184514 - DNA, 25 bp, Rattus norvegicus
atctcatctccttaatgcactagca

SEQ ID NO: 184515 - DNA, 25 bp, Rattus norvegicus
atctcatctgggaggagctgtgttc

SEQ ID NO: 184516 - DNA, 25 bp, Rattus norvegicus
atctcatctgggtggagctgtgttc

SEQ ID NO: 184517 - DNA, 25 bp, Rattus norvegicus
atctcatcttttactatccctgggt

SEQ ID NO: 184518 - DNA, 25 bp, Rattus norvegicus
atctcatctttttctatccctgggt

SEQ ID NO: 184519 - DNA, 25 bp, Rattus norvegicus
atctcatgactcacatgcccttgga

SEQ ID NO: 184520 - DNA, 25 bp, Rattus norvegicus
atctcatgactctcatgcccttgga

SEQ ID NO: 184521 - DNA, 25 bp, Rattus norvegicus
atctcatgcatgcagttctgttgta

SEQ ID NO: 184522 - DNA, 25 bp, Rattus norvegicus
atctcatgcatggagttctgttgta

SEQ ID NO: 184523 - DNA, 25 bp, Rattus norvegicus
atctcatgtcttagaaccatcaccc

SEQ ID NO: 184524 - DNA, 25 bp, Rattus norvegicus
atctcatgtctttgaaccatcaccc

SEQ ID NO: 184525 - DNA, 25 bp, Rattus norvegicus
atctcatgtgcccatgggtcatcat

SEQ ID NO: 184526 - DNA, 25 bp, Rattus norvegicus
atctcatgtgccgatgggtcatcat

SEQ ID NO: 184527 - DNA, 25 bp, Rattus norvegicus
atctcattatcaaagtctctgctct

SEQ ID NO: 184528 - DNA, 25 bp, Rattus norvegicus
atctcattatcatagtctctgctct

SEQ ID NO: 184529 - DNA, 25 bp, Rattus norvegicus
atctcattcaccagcagctttttaa

SEQ ID NO: 184530 - DNA, 25 bp, Rattus norvegicus
atctcattcacctgcagctttttaa

SEQ ID NO: 184531 - DNA, 25 bp, Rattus norvegicus
atctcattcatcagccaggtgctgg

SEQ ID NO: 184532 - DNA, 25 bp, Rattus norvegicus
atctcattcatctgccaggtgctgg

SEQ ID NO: 184533 - DNA, 25 bp, Rattus norvegicus
atctcattcgtcaggtgatgggtgg

SEQ ID NO: 184534 - DNA, 25 bp, Rattus norvegicus
atctcattcgtctggtgatgggtgg

SEQ ID NO: 184535 - DNA, 25 bp, Rattus norvegicus
atctcattctctatgtaactctggg

SEQ ID NO: 184536 - DNA, 25 bp, Rattus norvegicus
atctcattctctttgtaactctggg

SEQ ID NO: 184537 - DNA, 25 bp, Rattus norvegicus
atctcattggcacgcctcaattttc

SEQ ID NO: 184538 - DNA, 25 bp, Rattus norvegicus
atctcattggcaggcctcaattttc

SEQ ID NO: 184539 - DNA, 25 bp, Rattus norvegicus
atctcatttcggatcttttgtttat

SEQ ID NO: 184540 - DNA, 25 bp, Rattus norvegicus
atctcatttcggttcttttgtttat

SEQ ID NO: 184541 - DNA, 25 bp, Rattus norvegicus
atctcattttcaccgacccaattgt

SEQ ID NO: 184542 - DNA, 25 bp, Rattus norvegicus
atctcattttcagcgacccaattgt

SEQ ID NO: 184543 - DNA, 25 bp, Rattus norvegicus
atctccaaaagccacgtacctcgaa

SEQ ID NO: 184544 - DNA, 25 bp, Rattus norvegicus
atctccaaaagcgacgtacctcgaa

SEQ ID NO: 184545 - DNA, 25 bp, Rattus norvegicus
atctccaaagtcatgattgctactg

SEQ ID NO: 184546 - DNA, 25 bp, Rattus norvegicus
atctccaaagtcttgattgctactg

SEQ ID NO: 184547 - DNA, 25 bp, Rattus norvegicus
atctccaacagcatcgcagttacag

SEQ ID NO: 184548 - DNA, 25 bp, Rattus norvegicus
atctccaacagcttcgcagttacag

SEQ ID NO: 184549 - DNA, 25 bp, Rattus norvegicus
atctccaacatcctgcagagtggca

SEQ ID NO: 184550 - DNA, 25 bp, Rattus norvegicus
atctccaacatcgtgcagagtggca

SEQ ID NO: 184551 - DNA, 25 bp, Rattus norvegicus
atctccaaccgcaaacaagcagcag

SEQ ID NO: 184552 - DNA, 25 bp, Rattus norvegicus
atctccaaccgctaacaagcagcag

SEQ ID NO: 184553 - DNA, 25 bp, Rattus norvegicus
atctccaacgggactgctgggtaca

SEQ ID NO: 184554 - DNA, 25 bp, Rattus norvegicus
atctccaacgggtctgctgggtaca

SEQ ID NO: 184555 - DNA, 25 bp, Rattus norvegicus
atctccaagctccagaagcatcagg

SEQ ID NO: 184556 - DNA, 25 bp, Rattus norvegicus
atctccaagctcgagaagcatcagg

SEQ ID NO: 184557 - DNA, 25 bp, Rattus norvegicus
atctccaagcttacacacctgaagg

SEQ ID NO: 184558 - DNA, 25 bp, Rattus norvegicus
atctccaagctttcacacctgaagg

SEQ ID NO: 184559 - DNA, 25 bp, Rattus norvegicus
atctccaagggcaatgcattttcta

SEQ ID NO: 184560 - DNA, 25 bp, Rattus norvegicus
atctccaagggctatgcattttcta

SEQ ID NO: 184561 - DNA, 25 bp, Rattus norvegicus
atctccaagtggacagttcttttcc

SEQ ID NO: 184562 - DNA, 25 bp, Rattus norvegicus
atctccaagtggagcccattggctt

SEQ ID NO: 184563 - DNA, 25 bp, Rattus norvegicus
atctccaagtggtcagttcttttcc

SEQ ID NO: 184564 - DNA, 25 bp, Rattus norvegicus
atctccaagtggtgcccattggctt

SEQ ID NO: 184565 - DNA, 25 bp, Rattus norvegicus
atctccaatccccttagtgtgttta

SEQ ID NO: 184566 - DNA, 25 bp, Rattus norvegicus
atctccaatcccgttagtgtgttta

SEQ ID NO: 184567 - DNA, 25 bp, Rattus norvegicus
atctccacagatcacaagctaaggt

SEQ ID NO: 184568 - DNA, 25 bp, Rattus norvegicus
atctccacagatgacaagctaaggt

SEQ ID NO: 184569 - DNA, 25 bp, Rattus norvegicus
atctccaccaaaatatccaagccaa

SEQ ID NO: 184570 - DNA, 25 bp, Rattus norvegicus
atctccaccaaattatccaagccaa

SEQ ID NO: 184571 - DNA, 25 bp, Rattus norvegicus
atctccaccagcagaaaccttggca

SEQ ID NO: 184572 - DNA, 25 bp, Rattus norvegicus
atctccaccagctgaaaccttggca

SEQ ID NO: 184573 - DNA, 25 bp, Rattus norvegicus
atctccacgtacatacttaagctta

SEQ ID NO: 184574 - DNA, 25 bp, Rattus norvegicus
atctccacgtacttacttaagctta

SEQ ID NO: 184575 - DNA, 25 bp, Rattus norvegicus
atctccactgtaactgatccttcat

SEQ ID NO: 184576 - DNA, 25 bp, Rattus norvegicus
atctccactgtatctgatccttcat

SEQ ID NO: 184577 - DNA, 25 bp, Rattus norvegicus
atctccagactgagggatgtgccct

SEQ ID NO: 184578 - DNA, 25 bp, Rattus norvegicus
atctccagactgtgggatgtgccct

SEQ ID NO: 184579 - DNA, 25 bp, Rattus norvegicus
atctccagagacaccatccagaagt

SEQ ID NO: 184580 - DNA, 25 bp, Rattus norvegicus
atctccagagactccatccagaagt

SEQ ID NO: 184581 - DNA, 25 bp, Rattus norvegicus
atctccagatttactctatgtccgc

SEQ ID NO: 184582 - DNA, 25 bp, Rattus norvegicus
atctccagattttctctatgtccgc

SEQ ID NO: 184583 - DNA, 25 bp, Rattus norvegicus
atctccagcaccagtggccagattg

SEQ ID NO: 184584 - DNA, 25 bp, Rattus norvegicus
atctccagcacctgtggccagattg

SEQ ID NO: 184585 - DNA, 25 bp, Rattus norvegicus
atctccagcatcagtttaccttttg

SEQ ID NO: 184586 - DNA, 25 bp, Rattus norvegicus
atctccagcatctgtttaccttttg

SEQ ID NO: 184587 - DNA, 25 bp, Rattus norvegicus
atctccagccacagcaaggacagag

SEQ ID NO: 184588 - DNA, 25 bp, Rattus norvegicus
atctccagccactgcaaggacagag

SEQ ID NO: 184589 - DNA, 25 bp, Rattus norvegicus
atctccagccctctgatggttaatt

SEQ ID NO: 184590 - DNA, 25 bp, Rattus norvegicus
atctccagccctgtgatggttaatt

SEQ ID NO: 184591 - DNA, 25 bp, Rattus norvegicus
atctccagcgagatgcaggaacaca

SEQ ID NO: 184592 - DNA, 25 bp, Rattus norvegicus
atctccagcgagttgcaggaacaca

SEQ ID NO: 184593 - DNA, 25 bp, Rattus norvegicus
atctccaggaaacggcagcgccact

SEQ ID NO: 184594 - DNA, 25 bp, Rattus norvegicus
atctccaggaaagggcagcgccact

SEQ ID NO: 184595 - DNA, 25 bp, Rattus norvegicus
atctccaggacgagcttcgagggtt

SEQ ID NO: 184596 - DNA, 25 bp, Rattus norvegicus
atctccaggacgtgcttcgagggtt

SEQ ID NO: 184597 - DNA, 25 bp, Rattus norvegicus
atctccagggaaagtcacacggtca

SEQ ID NO: 184598 - DNA, 25 bp, Rattus norvegicus
atctccagggaatgtcacacggtca

SEQ ID NO: 184599 - DNA, 25 bp, Rattus norvegicus
atctccagggccctccgggaagtcg

SEQ ID NO: 184600 - DNA, 25 bp, Rattus norvegicus
atctccagggccgtccgggaagtcg

SEQ ID NO: 184601 - DNA, 25 bp, Rattus norvegicus
atctccagtcaacagcagagctgcc

SEQ ID NO: 184602 - DNA, 25 bp, Rattus norvegicus
atctccagtcaagagcagagctgcc

SEQ ID NO: 184603 - DNA, 25 bp, Rattus norvegicus
atctccagtgagagcaagtgctgag

SEQ ID NO: 184604 - DNA, 25 bp, Rattus norvegicus
atctccagtgagtgcaagtgctgag

SEQ ID NO: 184605 - DNA, 25 bp, Rattus norvegicus
atctccatatctctaggctgctgca

SEQ ID NO: 184606 - DNA, 25 bp, Rattus norvegicus
atctccatatctgtaggctgctgca

SEQ ID NO: 184607 - DNA, 25 bp, Rattus norvegicus
atctccatcacaaggacgcctcagg

SEQ ID NO: 184608 - DNA, 25 bp, Rattus norvegicus
atctccatcacatggacgcctcagg

SEQ ID NO: 184609 - DNA, 25 bp, Rattus norvegicus
atctccatccaacttgagcttcggg

SEQ ID NO: 184610 - DNA, 25 bp, Rattus norvegicus
atctccatccaagttgagcttcggg

SEQ ID NO: 184611 - DNA, 25 bp, Rattus norvegicus
atctccatctctaagacagttctgc

SEQ ID NO: 184612 - DNA, 25 bp, Rattus norvegicus
atctccatctctaggagctgggagc

SEQ ID NO: 184613 - DNA, 25 bp, Rattus norvegicus
atctccatctcttagacagttctgc

SEQ ID NO: 184614 - DNA, 25 bp, Rattus norvegicus
atctccatctcttggagctgggagc

SEQ ID NO: 184615 - DNA, 25 bp, Rattus norvegicus
atctccatgacaagcactgttttta

SEQ ID NO: 184616 - DNA, 25 bp, Rattus norvegicus
atctccatgacatgcactgttttta

SEQ ID NO: 184617 - DNA, 25 bp, Rattus norvegicus
atctccatgcttaccttgaatatca

SEQ ID NO: 184618 - DNA, 25 bp, Rattus norvegicus
atctccatgctttccttgaatatca

SEQ ID NO: 184619 - DNA, 25 bp, Rattus norvegicus
atctccatgtacaccctcagtaggg

SEQ ID NO: 184620 - DNA, 25 bp, Rattus norvegicus
atctccatgtactccctcagtaggg

SEQ ID NO: 184621 - DNA, 25 bp, Rattus norvegicus
atctccattaaaactgcttccaaac

SEQ ID NO: 184622 - DNA, 25 bp, Rattus norvegicus
atctccattaaatctgcttccaaac

SEQ ID NO: 184623 - DNA, 25 bp, Rattus norvegicus
atctccattagcctcacattgttaa

SEQ ID NO: 184624 - DNA, 25 bp, Rattus norvegicus
atctccattagcgtcacattgttaa

SEQ ID NO: 184625 - DNA, 25 bp, Rattus norvegicus
atctccattattactacggctgtac

SEQ ID NO: 184626 - DNA, 25 bp, Rattus norvegicus
atctccattatttctacggctgtac

SEQ ID NO: 184627 - DNA, 25 bp, Rattus norvegicus
atctccattcagcttgggctcttaa

SEQ ID NO: 184628 - DNA, 25 bp, Rattus norvegicus
atctccattcaggttgggctcttaa

SEQ ID NO: 184629 - DNA, 25 bp, Rattus norvegicus
atctccattggactggccccgatct

SEQ ID NO: 184630 - DNA, 25 bp, Rattus norvegicus
atctccattggagtggccccgatct

SEQ ID NO: 184631 - DNA, 25 bp, Rattus norvegicus
atctccattgtccactgggcacgaa

SEQ ID NO: 184632 - DNA, 25 bp, Rattus norvegicus
atctccattgtcgactgggcacgaa

SEQ ID NO: 184633 - DNA, 25 bp, Rattus norvegicus
atctccatttggagttagtgcagct

SEQ ID NO: 184634 - DNA, 25 bp, Rattus norvegicus
atctccatttggtgttagtgcagct

SEQ ID NO: 184635 - DNA, 25 bp, Rattus norvegicus
atctcccaaatgcaacttggctttg

SEQ ID NO: 184636 - DNA, 25 bp, Rattus norvegicus
atctcccaaatggaacttggctttg

SEQ ID NO: 184637 - DNA, 25 bp, Rattus norvegicus
atctcccaaccgataaccgtgtgct

SEQ ID NO: 184638 - DNA, 25 bp, Rattus norvegicus
atctcccaaccgttaaccgtgtgct

SEQ ID NO: 184639 - DNA, 25 bp, Rattus norvegicus
atctcccacccaagtggatcatgga

SEQ ID NO: 184640 - DNA, 25 bp, Rattus norvegicus
atctcccacccatgtggatcatgga

SEQ ID NO: 184641 - DNA, 25 bp, Rattus norvegicus
atctcccagcatccctgaggatgtg

SEQ ID NO: 184642 - DNA, 25 bp, Rattus norvegicus
atctcccagcatgcctgaggatgtg

SEQ ID NO: 184643 - DNA, 25 bp, Rattus norvegicus
atctcccaggtgctaaaagtctctt

SEQ ID NO: 184644 - DNA, 25 bp, Rattus norvegicus
atctcccaggtggtaaaagtctctt

SEQ ID NO: 184645 - DNA, 25 bp, Rattus norvegicus
atctcccaggttatgatgcttggct

SEQ ID NO: 184646 - DNA, 25 bp, Rattus norvegicus
atctcccaggttttgatgcttggct

SEQ ID NO: 184647 - DNA, 25 bp, Rattus norvegicus
atctcccatattacacctttgtgat

SEQ ID NO: 184648 - DNA, 25 bp, Rattus norvegicus
atctcccatatttcacctttgtgat

SEQ ID NO: 184649 - DNA, 25 bp, Rattus norvegicus
atctcccatcagagccaggacagga

SEQ ID NO: 184650 - DNA, 25 bp, Rattus norvegicus
atctcccatcagtgccaggacagga

SEQ ID NO: 184651 - DNA, 25 bp, Rattus norvegicus
atctcccatccccaggagtttggaa

SEQ ID NO: 184652 - DNA, 25 bp, Rattus norvegicus
atctcccatcccgaggagtttggaa

SEQ ID NO: 184653 - DNA, 25 bp, Rattus norvegicus
atctcccatgtcagtcttttgtgtt

SEQ ID NO: 184654 - DNA, 25 bp, Rattus norvegicus
atctcccatgtctgtcttttgtgtt

SEQ ID NO: 184655 - DNA, 25 bp, Rattus norvegicus
atctcccattttaaccagcaggttt

SEQ ID NO: 184656 - DNA, 25 bp, Rattus norvegicus
atctcccattttccgattatccagc

SEQ ID NO: 184657 - DNA, 25 bp, Rattus norvegicus
atctcccattttgcgattatccagc

SEQ ID NO: 184658 - DNA, 25 bp, Rattus norvegicus
atctcccatttttaccagcaggttt

SEQ ID NO: 184659 - DNA, 25 bp, Rattus norvegicus
atctccccaaccatcattttgattt

SEQ ID NO: 184660 - DNA, 25 bp, Rattus norvegicus
atctccccaaccttcattttgattt

SEQ ID NO: 184661 - DNA, 25 bp, Rattus norvegicus
atctccccaaggaagcactaaggaa

SEQ ID NO: 184662 - DNA, 25 bp, Rattus norvegicus
atctccccaaggtagcactaaggaa

SEQ ID NO: 184663 - DNA, 25 bp, Rattus norvegicus
atctccccaagtaaaatcatctgcc

SEQ ID NO: 184664 - DNA, 25 bp, Rattus norvegicus
atctccccaagttaaatcatctgcc

SEQ ID NO: 184665 - DNA, 25 bp, Rattus norvegicus
atctccccagagagatgtttcaaga

SEQ ID NO: 184666 - DNA, 25 bp, Rattus norvegicus
atctccccagagtgatgtttcaaga

SEQ ID NO: 184667 - DNA, 25 bp, Rattus norvegicus
atctccccagccatctttttgttgt

SEQ ID NO: 184668 - DNA, 25 bp, Rattus norvegicus
atctccccagccttctttttgttgt

SEQ ID NO: 184669 - DNA, 25 bp, Rattus norvegicus
atctccccgatactttctgagcatc

SEQ ID NO: 184670 - DNA, 25 bp, Rattus norvegicus
atctccccgatagtttctgagcatc

SEQ ID NO: 184671 - DNA, 25 bp, Rattus norvegicus
atctccccgcttcgagcagcagagg

SEQ ID NO: 184672 - DNA, 25 bp, Rattus norvegicus
atctccccgcttggagcagcagagg

SEQ ID NO: 184673 - DNA, 25 bp, Rattus norvegicus
atctccccgggacacggaaggacat

SEQ ID NO: 184674 - DNA, 25 bp, Rattus norvegicus
atctccccgggagacggaaggacat

SEQ ID NO: 184675 - DNA, 25 bp, Rattus norvegicus
atctcccctcctattttggtgattt

SEQ ID NO: 184676 - DNA, 25 bp, Rattus norvegicus
atctcccctccttttttggtgattt

SEQ ID NO: 184677 - DNA, 25 bp, Rattus norvegicus
atctccccttgacctgagtgatgag

SEQ ID NO: 184678 - DNA, 25 bp, Rattus norvegicus
atctccccttgagctgagtgatgag

SEQ ID NO: 184679 - DNA, 25 bp, Rattus norvegicus
atctcccgaaagcaaggtgtcatca

SEQ ID NO: 184680 - DNA, 25 bp, Rattus norvegicus
atctcccgaaaggaaggtgtcatca

SEQ ID NO: 184681 - DNA, 25 bp, Rattus norvegicus
atctcccgaacaccaagtgccgtaa

SEQ ID NO: 184682 - DNA, 25 bp, Rattus norvegicus
atctcccgaacagcaagtgccgtaa

SEQ ID NO: 184683 - DNA, 25 bp, Rattus norvegicus
atctcccgaatcaacttggccaagg

SEQ ID NO: 184684 - DNA, 25 bp, Rattus norvegicus
atctcccgaatctacttggccaagg

SEQ ID NO: 184685 - DNA, 25 bp, Rattus norvegicus
atctcccgcattagagcatgcttgt

SEQ ID NO: 184686 - DNA, 25 bp, Rattus norvegicus
atctcccgcatttgagcatgcttgt

SEQ ID NO: 184687 - DNA, 25 bp, Rattus norvegicus
atctcccgcttcacgtgggtcttga

SEQ ID NO: 184688 - DNA, 25 bp, Rattus norvegicus
atctcccgcttctcgtgggtcttga

SEQ ID NO: 184689 - DNA, 25 bp, Rattus norvegicus
atctccctcattccagttcaatatt

SEQ ID NO: 184690 - DNA, 25 bp, Rattus norvegicus
atctccctcattgcagttcaatatt

SEQ ID NO: 184691 - DNA, 25 bp, Rattus norvegicus
atctccctgagtcttacctttaggc

SEQ ID NO: 184692 - DNA, 25 bp, Rattus norvegicus
atctccctgagtgttacctttaggc

SEQ ID NO: 184693 - DNA, 25 bp, Rattus norvegicus
atctccctgctgaatgagcccaaca

SEQ ID NO: 184694 - DNA, 25 bp, Rattus norvegicus
atctccctgctgacagtgggtgcaa

SEQ ID NO: 184695 - DNA, 25 bp, Rattus norvegicus
atctccctgctgtatgagcccaaca

SEQ ID NO: 184696 - DNA, 25 bp, Rattus norvegicus
atctccctgctgtcagtgggtgcaa

SEQ ID NO: 184697 - DNA, 25 bp, Rattus norvegicus
atctccctggctcacgtggtagcta

SEQ ID NO: 184698 - DNA, 25 bp, Rattus norvegicus
atctccctggctgacgtggtagcta

SEQ ID NO: 184699 - DNA, 25 bp, Rattus norvegicus
atctcccttgagattcctgaggtct

SEQ ID NO: 184700 - DNA, 25 bp, Rattus norvegicus
atctcccttgagtttcctgaggtct

SEQ ID NO: 184701 - DNA, 25 bp, Rattus norvegicus
atctcccttggtctctgcccagtgg

SEQ ID NO: 184702 - DNA, 25 bp, Rattus norvegicus
atctcccttggtgtctgcccagtgg

SEQ ID NO: 184703 - DNA, 25 bp, Rattus norvegicus
atctccgaattcctagtgtgcagaa

SEQ ID NO: 184704 - DNA, 25 bp, Rattus norvegicus
atctccgaattcgtagtgtgcagaa

SEQ ID NO: 184705 - DNA, 25 bp, Rattus norvegicus
atctccgagtggctagtgtggtcta

SEQ ID NO: 184706 - DNA, 25 bp, Rattus norvegicus
atctccgagtgggtagtgtggtcta

SEQ ID NO: 184707 - DNA, 25 bp, Rattus norvegicus
atctccgatggtcagttgttggcct

SEQ ID NO: 184708 - DNA, 25 bp, Rattus norvegicus
atctccgatggtgagttgttggcct

SEQ ID NO: 184709 - DNA, 25 bp, Rattus norvegicus
atctccgcctcgaacgattggtgga

SEQ ID NO: 184710 - DNA, 25 bp, Rattus norvegicus
atctccgcctcgtacgattggtgga

SEQ ID NO: 184711 - DNA, 25 bp, Rattus norvegicus
atctccggcattccttctccgtata

SEQ ID NO: 184712 - DNA, 25 bp, Rattus norvegicus
atctccggcattgcttctccgtata

SEQ ID NO: 184713 - DNA, 25 bp, Rattus norvegicus
atctccgtagtaacaggctgtaggc

SEQ ID NO: 184714 - DNA, 25 bp, Rattus norvegicus
atctccgtagtatcaggctgtaggc

SEQ ID NO: 184715 - DNA, 25 bp, Rattus norvegicus
atctccgtgagcatgattgcctggc

SEQ ID NO: 184716 - DNA, 25 bp, Rattus norvegicus
atctccgtgagcttgattgcctggc

SEQ ID NO: 184717 - DNA, 25 bp, Rattus norvegicus
atctccgtgattcagcctcagtgca

SEQ ID NO: 184718 - DNA, 25 bp, Rattus norvegicus
atctccgtgattgagcctcagtgca

SEQ ID NO: 184719 - DNA, 25 bp, Rattus norvegicus
atctccgtgcccaaggagaacagca

SEQ ID NO: 184720 - DNA, 25 bp, Rattus norvegicus
atctccgtgccctaggagaacagca

SEQ ID NO: 184721 - DNA, 25 bp, Rattus norvegicus
atctccgtgctcatcttcgataata

SEQ ID NO: 184722 - DNA, 25 bp, Rattus norvegicus
atctccgtgctcttcttcgataata

SEQ ID NO: 184723 - DNA, 25 bp, Rattus norvegicus
atctccgtggacattgacagggccc

SEQ ID NO: 184724 - DNA, 25 bp, Rattus norvegicus
atctccgtggactttgacagggccc

SEQ ID NO: 184725 - DNA, 25 bp, Rattus norvegicus
atctcctactgtcctctctacagaa

SEQ ID NO: 184726 - DNA, 25 bp, Rattus norvegicus
atctcctactgtgctctctacagaa

SEQ ID NO: 184727 - DNA, 25 bp, Rattus norvegicus
atctcctatgtactccagggtcttt

SEQ ID NO: 184728 - DNA, 25 bp, Rattus norvegicus
atctcctatgtagtccagggtcttt

SEQ ID NO: 184729 - DNA, 25 bp, Rattus norvegicus
atctcctatgttcgctgcagaaagc

SEQ ID NO: 184730 - DNA, 25 bp, Rattus norvegicus
atctcctatgttggctgcagaaagc

SEQ ID NO: 184731 - DNA, 25 bp, Rattus norvegicus
atctcctattctcgattagtgcctt

SEQ ID NO: 184732 - DNA, 25 bp, Rattus norvegicus
atctcctattctggattagtgcctt

SEQ ID NO: 184733 - DNA, 25 bp, Rattus norvegicus
atctcctcacatacattcctttgaa

SEQ ID NO: 184734 - DNA, 25 bp, Rattus norvegicus
atctcctcacattcattcctttgaa

SEQ ID NO: 184735 - DNA, 25 bp, Rattus norvegicus
atctcctcacctcgtataacagtat

SEQ ID NO: 184736 - DNA, 25 bp, Rattus norvegicus
atctcctcacctggtataacagtat

SEQ ID NO: 184737 - DNA, 25 bp, Rattus norvegicus
atctcctcagagaggtgttatggcg

SEQ ID NO: 184738 - DNA, 25 bp, Rattus norvegicus
atctcctcagagtggtgttatggcg

SEQ ID NO: 184739 - DNA, 25 bp, Rattus norvegicus
atctcctcatatctgccttggattg

SEQ ID NO: 184740 - DNA, 25 bp, Rattus norvegicus
atctcctcatatgtgccttggattg

SEQ ID NO: 184741 - DNA, 25 bp, Rattus norvegicus
atctcctccccaaactaataacaga

SEQ ID NO: 184742 - DNA, 25 bp, Rattus norvegicus
atctcctccccatactaataacaga

SEQ ID NO: 184743 - DNA, 25 bp, Rattus norvegicus
atctcctccgagatcaaatgttgat

SEQ ID NO: 184744 - DNA, 25 bp, Rattus norvegicus
atctcctccgagttcaaatgttgat

SEQ ID NO: 184745 - DNA, 25 bp, Rattus norvegicus
atctcctccttcaagctcgagtgag

SEQ ID NO: 184746 - DNA, 25 bp, Rattus norvegicus
atctcctccttctagctcgagtgag

SEQ ID NO: 184747 - DNA, 25 bp, Rattus norvegicus
atctcctcctttactggaagctgag

SEQ ID NO: 184748 - DNA, 25 bp, Rattus norvegicus
atctcctccttttctggaagctgag

SEQ ID NO: 184749 - DNA, 25 bp, Rattus norvegicus
atctcctcggccagtgtggacagat

SEQ ID NO: 184750 - DNA, 25 bp, Rattus norvegicus
atctcctcggcctgtgtggacagat

SEQ ID NO: 184751 - DNA, 25 bp, Rattus norvegicus
atctcctctagtacagtttgtcttc

SEQ ID NO: 184752 - DNA, 25 bp, Rattus norvegicus
atctcctctagttcagtttgtcttc

SEQ ID NO: 184753 - DNA, 25 bp, Rattus norvegicus
atctcctctcatagcagccttataa

SEQ ID NO: 184754 - DNA, 25 bp, Rattus norvegicus
atctcctctcattgcagccttataa

SEQ ID NO: 184755 - DNA, 25 bp, Rattus norvegicus
atctcctctcgtatgcagatagcat

SEQ ID NO: 184756 - DNA, 25 bp, Rattus norvegicus
atctcctctcgtttgcagatagcat

SEQ ID NO: 184757 - DNA, 25 bp, Rattus norvegicus
atctcctctctcagggtgtccaggt

SEQ ID NO: 184758 - DNA, 25 bp, Rattus norvegicus
atctcctctctctgggtgtccaggt

SEQ ID NO: 184759 - DNA, 25 bp, Rattus norvegicus
atctcctctctgagcacgatagtgt

SEQ ID NO: 184760 - DNA, 25 bp, Rattus norvegicus
atctcctctctgtgcacgatagtgt

SEQ ID NO: 184761 - DNA, 25 bp, Rattus norvegicus
atctcctctgataaacgcctgtaaa

SEQ ID NO: 184762 - DNA, 25 bp, Rattus norvegicus
atctcctctgattaacgcctgtaaa

SEQ ID NO: 184763 - DNA, 25 bp, Rattus norvegicus
atctcctctggccttgttgttgttg

SEQ ID NO: 184764 - DNA, 25 bp, Rattus norvegicus
atctcctctggcgttgttgttgttg

SEQ ID NO: 184765 - DNA, 25 bp, Rattus norvegicus
atctcctctgtgatgtcctgagaga

SEQ ID NO: 184766 - DNA, 25 bp, Rattus norvegicus
atctcctctgtgttgtcctgagaga

SEQ ID NO: 184767 - DNA, 25 bp, Rattus norvegicus
atctcctgaaccatgcctactatgc

SEQ ID NO: 184768 - DNA, 25 bp, Rattus norvegicus
atctcctgaaccttgcctactatgc

SEQ ID NO: 184769 - DNA, 25 bp, Rattus norvegicus
atctcctgaatcacctgacagctag

SEQ ID NO: 184770 - DNA, 25 bp, Rattus norvegicus
atctcctgaatctcctgacagctag

SEQ ID NO: 184771 - DNA, 25 bp, Rattus norvegicus
atctcctgagaaagttcacgtccct

SEQ ID NO: 184772 - DNA, 25 bp, Rattus norvegicus
atctcctgagaatgttcacgtccct

SEQ ID NO: 184773 - DNA, 25 bp, Rattus norvegicus
atctcctgagtgagtctatgtgcct

SEQ ID NO: 184774 - DNA, 25 bp, Rattus norvegicus
atctcctgagtgtgtctatgtgcct

SEQ ID NO: 184775 - DNA, 25 bp, Rattus norvegicus
atctcctgatggaaacatttctctt

SEQ ID NO: 184776 - DNA, 25 bp, Rattus norvegicus
atctcctgatggtaacatttctctt

SEQ ID NO: 184777 - DNA, 25 bp, Rattus norvegicus
atctcctgcaggaaggtacctctga

SEQ ID NO: 184778 - DNA, 25 bp, Rattus norvegicus
atctcctgcaggtaggtacctctga

SEQ ID NO: 184779 - DNA, 25 bp, Rattus norvegicus
atctcctgcatgaattttatctaaa

SEQ ID NO: 184780 - DNA, 25 bp, Rattus norvegicus
atctcctgcatgtattttatctaaa

SEQ ID NO: 184781 - DNA, 25 bp, Rattus norvegicus
atctcctgccgcagtagctattagt

SEQ ID NO: 184782 - DNA, 25 bp, Rattus norvegicus
atctcctgccgctgtagctattagt

SEQ ID NO: 184783 - DNA, 25 bp, Rattus norvegicus
atctcctgcctgatccattagagga

SEQ ID NO: 184784 - DNA, 25 bp, Rattus norvegicus
atctcctgcctgttccattagagga

SEQ ID NO: 184785 - DNA, 25 bp, Rattus norvegicus
atctcctgctcaatgggaagtccta

SEQ ID NO: 184786 - DNA, 25 bp, Rattus norvegicus
atctcctgctcattgggaagtccta

SEQ ID NO: 184787 - DNA, 25 bp, Rattus norvegicus
atctcctgcttccaaagccaaattt

SEQ ID NO: 184788 - DNA, 25 bp, Rattus norvegicus
atctcctgcttcgaaagccaaattt

SEQ ID NO: 184789 - DNA, 25 bp, Rattus norvegicus
atctcctggaacctctagatggaca

SEQ ID NO: 184790 - DNA, 25 bp, Rattus norvegicus
atctcctggaacgtctagatggaca

SEQ ID NO: 184791 - DNA, 25 bp, Rattus norvegicus
atctcctggtccagtatgtgactag

SEQ ID NO: 184792 - DNA, 25 bp, Rattus norvegicus
atctcctggtcccttgaggcaaaag

SEQ ID NO: 184793 - DNA, 25 bp, Rattus norvegicus
atctcctggtccgttgaggcaaaag

SEQ ID NO: 184794 - DNA, 25 bp, Rattus norvegicus
atctcctggtcctgtatgtgactag

SEQ ID NO: 184795 - DNA, 25 bp, Rattus norvegicus
atctcctgtatgagccattgacttg

SEQ ID NO: 184796 - DNA, 25 bp, Rattus norvegicus
atctcctgtatgtgccattgacttg

SEQ ID NO: 184797 - DNA, 25 bp, Rattus norvegicus
atctcctgttataatccaccgactg

SEQ ID NO: 184798 - DNA, 25 bp, Rattus norvegicus
atctcctgttattatccaccgactg

SEQ ID NO: 184799 - DNA, 25 bp, Rattus norvegicus
atctcctgttttcctctcaaattta

SEQ ID NO: 184800 - DNA, 25 bp, Rattus norvegicus
atctcctgttttgctctcaaattta

SEQ ID NO: 184801 - DNA, 25 bp, Rattus norvegicus
atctccttatctactgagttcacac

SEQ ID NO: 184802 - DNA, 25 bp, Rattus norvegicus
atctccttatcttctgagttcacac

SEQ ID NO: 184803 - DNA, 25 bp, Rattus norvegicus
atctccttcctccatcaacaagata

SEQ ID NO: 184804 - DNA, 25 bp, Rattus norvegicus
atctccttcctcgatcaacaagata

SEQ ID NO: 184805 - DNA, 25 bp, Rattus norvegicus
atctccttccttaatcctggtgttg

SEQ ID NO: 184806 - DNA, 25 bp, Rattus norvegicus
atctccttcctttatcctggtgttg

SEQ ID NO: 184807 - DNA, 25 bp, Rattus norvegicus
atctccttctcaatcactgtgaaag

SEQ ID NO: 184808 - DNA, 25 bp, Rattus norvegicus
atctccttctcattcactgtgaaag

SEQ ID NO: 184809 - DNA, 25 bp, Rattus norvegicus
atctccttgaatagttccctttggg

SEQ ID NO: 184810 - DNA, 25 bp, Rattus norvegicus
atctccttgaattgttccctttggg

SEQ ID NO: 184811 - DNA, 25 bp, Rattus norvegicus
atctccttgactcagcccatgaaga

SEQ ID NO: 184812 - DNA, 25 bp, Rattus norvegicus
atctccttgactgagcccatgaaga

SEQ ID NO: 184813 - DNA, 25 bp, Rattus norvegicus
atctccttgagcaggtatcttatag

SEQ ID NO: 184814 - DNA, 25 bp, Rattus norvegicus
atctccttgagctggtatcttatag

SEQ ID NO: 184815 - DNA, 25 bp, Rattus norvegicus
atctccttgcctccttgaatgtgtg

SEQ ID NO: 184816 - DNA, 25 bp, Rattus norvegicus
atctccttgcctgcttgaatgtgtg

SEQ ID NO: 184817 - DNA, 25 bp, Rattus norvegicus
atctccttgcggaagaagtcctcga

SEQ ID NO: 184818 - DNA, 25 bp, Rattus norvegicus
atctccttgcggtagaagtcctcga

SEQ ID NO: 184819 - DNA, 25 bp, Rattus norvegicus
atctccttggagagctgactgcagc

SEQ ID NO: 184820 - DNA, 25 bp, Rattus norvegicus
atctccttggagctgattctgactc

SEQ ID NO: 184821 - DNA, 25 bp, Rattus norvegicus
atctccttggaggtgattctgactc

SEQ ID NO: 184822 - DNA, 25 bp, Rattus norvegicus
atctccttggagtgctgactgcagc

SEQ ID NO: 184823 - DNA, 25 bp, Rattus norvegicus
atctccttgtctacctcattcaaga

SEQ ID NO: 184824 - DNA, 25 bp, Rattus norvegicus
atctccttgtcttcctcattcaaga

SEQ ID NO: 184825 - DNA, 25 bp, Rattus norvegicus
atctcctttctcagcttggccaatt

SEQ ID NO: 184826 - DNA, 25 bp, Rattus norvegicus
atctcctttctctgcttggccaatt

SEQ ID NO: 184827 - DNA, 25 bp, Rattus norvegicus
atctcctttgccacagtattcaaga

SEQ ID NO: 184828 - DNA, 25 bp, Rattus norvegicus
atctcctttgcctcagtattcaaga

SEQ ID NO: 184829 - DNA, 25 bp, Rattus norvegicus
atctcctttgcgcttacttggaaat

SEQ ID NO: 184830 - DNA, 25 bp, Rattus norvegicus
atctcctttgcggttacttggaaat

SEQ ID NO: 184831 - DNA, 25 bp, Rattus norvegicus
atctcctttggacacgcctgtaaat

SEQ ID NO: 184832 - DNA, 25 bp, Rattus norvegicus
atctcctttggagacgcctgtaaat

SEQ ID NO: 184833 - DNA, 25 bp, Rattus norvegicus
atctcctttgtgaagtttgcagtta

SEQ ID NO: 184834 - DNA, 25 bp, Rattus norvegicus
atctcctttgtgtagtttgcagtta

SEQ ID NO: 184835 - DNA, 25 bp, Rattus norvegicus
atctccttttctcacttgaacactc

SEQ ID NO: 184836 - DNA, 25 bp, Rattus norvegicus
atctccttttctgacttgaacactc

SEQ ID NO: 184837 - DNA, 25 bp, Rattus norvegicus
atctcgaacccaagggcactagaga

SEQ ID NO: 184838 - DNA, 25 bp, Rattus norvegicus
atctcgaacccatgggcactagaga

SEQ ID NO: 184839 - DNA, 25 bp, Rattus norvegicus
atctcgacggtgcttttcaatacta

SEQ ID NO: 184840 - DNA, 25 bp, Rattus norvegicus
atctcgacggtggttttcaatacta

SEQ ID NO: 184841 - DNA, 25 bp, Rattus norvegicus
atctcgagagtaagtgtgggcacca

SEQ ID NO: 184842 - DNA, 25 bp, Rattus norvegicus
atctcgagagtatgtgtgggcacca

SEQ ID NO: 184843 - DNA, 25 bp, Rattus norvegicus
atctcgagctgtaaccatcccaatt

SEQ ID NO: 184844 - DNA, 25 bp, Rattus norvegicus
atctcgagctgttaccatcccaatt

SEQ ID NO: 184845 - DNA, 25 bp, Rattus norvegicus
atctcgatatccagtcatgacttat

SEQ ID NO: 184846 - DNA, 25 bp, Rattus norvegicus
atctcgatatcctgtcatgacttat

SEQ ID NO: 184847 - DNA, 25 bp, Rattus norvegicus
atctcgatggacaggccaaagcctt

SEQ ID NO: 184848 - DNA, 25 bp, Rattus norvegicus
atctcgatggactggccaaagcctt

SEQ ID NO: 184849 - DNA, 25 bp, Rattus norvegicus
atctcgatggtaacgggtctaatca

SEQ ID NO: 184850 - DNA, 25 bp, Rattus norvegicus
atctcgatggtatcgggtctaatca

SEQ ID NO: 184851 - DNA, 25 bp, Rattus norvegicus
atctcgcagagtctcattaccgttg

SEQ ID NO: 184852 - DNA, 25 bp, Rattus norvegicus
atctcgcagagtgtcattaccgttg

SEQ ID NO: 184853 - DNA, 25 bp, Rattus norvegicus
atctcgcaggcgctggaacaggtca

SEQ ID NO: 184854 - DNA, 25 bp, Rattus norvegicus
atctcgcaggcggtggaacaggtca

SEQ ID NO: 184855 - DNA, 25 bp, Rattus norvegicus
atctcgccaccaatgtagcacagga

SEQ ID NO: 184856 - DNA, 25 bp, Rattus norvegicus
atctcgccaccattgtagcacagga

SEQ ID NO: 184857 - DNA, 25 bp, Rattus norvegicus
atctcgccaggtcccatggcttgta

SEQ ID NO: 184858 - DNA, 25 bp, Rattus norvegicus
atctcgccaggtgccatggcttgta

SEQ ID NO: 184859 - DNA, 25 bp, Rattus norvegicus
atctcgcccaagcaggtgatgaact

SEQ ID NO: 184860 - DNA, 25 bp, Rattus norvegicus
atctcgcccaaggaggtgatgaact

SEQ ID NO: 184861 - DNA, 25 bp, Rattus norvegicus
atctcgctgttgctggttcacagaa

SEQ ID NO: 184862 - DNA, 25 bp, Rattus norvegicus
atctcgctgttggtggttcacagaa

SEQ ID NO: 184863 - DNA, 25 bp, Rattus norvegicus
atctcgcttctgcagcacaagaggg

SEQ ID NO: 184864 - DNA, 25 bp, Rattus norvegicus
atctcgcttctggagcacaagaggg

SEQ ID NO: 184865 - DNA, 25 bp, Rattus norvegicus
atctcgctttcaccacattgttata

SEQ ID NO: 184866 - DNA, 25 bp, Rattus norvegicus
atctcgctttcagcacattgttata

SEQ ID NO: 184867 - DNA, 25 bp, Rattus norvegicus
atctcggaagctccacgaactctag

SEQ ID NO: 184868 - DNA, 25 bp, Rattus norvegicus
atctcggaagctgcacgaactctag

SEQ ID NO: 184869 - DNA, 25 bp, Rattus norvegicus
atctcggaatgtagcttgttttttg

SEQ ID NO: 184870 - DNA, 25 bp, Rattus norvegicus
atctcggaatgttgcttgttttttg

SEQ ID NO: 184871 - DNA, 25 bp, Rattus norvegicus
atctcggaggatctggctggccact

SEQ ID NO: 184872 - DNA, 25 bp, Rattus norvegicus
atctcggaggatgtggctggccact

SEQ ID NO: 184873 - DNA, 25 bp, Rattus norvegicus
atctcggatacaatagaggcaaaga

SEQ ID NO: 184874 - DNA, 25 bp, Rattus norvegicus
atctcggatacattagaggcaaaga

SEQ ID NO: 184875 - DNA, 25 bp, Rattus norvegicus
atctcggatcccaaaagtgcatttt

SEQ ID NO: 184876 - DNA, 25 bp, Rattus norvegicus
atctcggatccctaaagtgcatttt

SEQ ID NO: 184877 - DNA, 25 bp, Rattus norvegicus
atctcggatgcaccgtattcacacg

SEQ ID NO: 184878 - DNA, 25 bp, Rattus norvegicus
atctcggatgcagcgtattcacacg

SEQ ID NO: 184879 - DNA, 25 bp, Rattus norvegicus
atctcggcagacaaccctgttgtta

SEQ ID NO: 184880 - DNA, 25 bp, Rattus norvegicus
atctcggcagactaccctgttgtta

SEQ ID NO: 184881 - DNA, 25 bp, Rattus norvegicus
atctcggcccagaatgtacacaacg

SEQ ID NO: 184882 - DNA, 25 bp, Rattus norvegicus
atctcggcccagtatgtacacaacg

SEQ ID NO: 184883 - DNA, 25 bp, Rattus norvegicus
atctcggcttcgcactccaggtaaa

SEQ ID NO: 184884 - DNA, 25 bp, Rattus norvegicus
atctcggcttcggactccaggtaaa

SEQ ID NO: 184885 - DNA, 25 bp, Rattus norvegicus
atctcgggagataggctggagtcca

SEQ ID NO: 184886 - DNA, 25 bp, Rattus norvegicus
atctcgggagattggctggagtcca

SEQ ID NO: 184887 - DNA, 25 bp, Rattus norvegicus
atctcgggagctagtgatgccagcg

SEQ ID NO: 184888 - DNA, 25 bp, Rattus norvegicus
atctcgggagcttgtgatgccagcg

SEQ ID NO: 184889 - DNA, 25 bp, Rattus norvegicus
atctcgggaggcatggaaattctgt

SEQ ID NO: 184890 - DNA, 25 bp, Rattus norvegicus
atctcgggaggcttggaaattctgt

SEQ ID NO: 184891 - DNA, 25 bp, Rattus norvegicus
atctcgggcacaccttgacagttgg

SEQ ID NO: 184892 - DNA, 25 bp, Rattus norvegicus
atctcgggcacagcttgacagttgg

SEQ ID NO: 184893 - DNA, 25 bp, Rattus norvegicus
atctcggtcaagacccgtcaagaag

SEQ ID NO: 184894 - DNA, 25 bp, Rattus norvegicus
atctcggtcaagtcccgtcaagaag

SEQ ID NO: 184895 - DNA, 25 bp, Rattus norvegicus
atctcggtcctcagctcatcgatct

SEQ ID NO: 184896 - DNA, 25 bp, Rattus norvegicus
atctcggtcctctgctcatcgatct

SEQ ID NO: 184897 - DNA, 25 bp, Rattus norvegicus
atctcggtcctgctctttagtggct

SEQ ID NO: 184898 - DNA, 25 bp, Rattus norvegicus
atctcggtcctggtctttagtggct

SEQ ID NO: 184899 - DNA, 25 bp, Rattus norvegicus
atctcggttcaaacccaagtatcca

SEQ ID NO: 184900 - DNA, 25 bp, Rattus norvegicus
atctcggttcaatcccaagtatcca

SEQ ID NO: 184901 - DNA, 25 bp, Rattus norvegicus
atctcgtaaatgaaactgcttggcg

SEQ ID NO: 184902 - DNA, 25 bp, Rattus norvegicus
atctcgtaaatgtaactgcttggcg

SEQ ID NO: 184903 - DNA, 25 bp, Rattus norvegicus
atctcgtacgagatgaagccacagt

SEQ ID NO: 184904 - DNA, 25 bp, Rattus norvegicus
atctcgtacgagttgaagccacagt

SEQ ID NO: 184905 - DNA, 25 bp, Rattus norvegicus
atctcgtagcaccaagcctttctgt

SEQ ID NO: 184906 - DNA, 25 bp, Rattus norvegicus
atctcgtagcacgaagcctttctgt

SEQ ID NO: 184907 - DNA, 25 bp, Rattus norvegicus
atctcgtatgtgagatgccctgggt

SEQ ID NO: 184908 - DNA, 25 bp, Rattus norvegicus
atctcgtatgtgtgatgccctgggt

SEQ ID NO: 184909 - DNA, 25 bp, Rattus norvegicus
atctcgtcctggattcttggcagag

SEQ ID NO: 184910 - DNA, 25 bp, Rattus norvegicus
atctcgtcctggtttcttggcagag

SEQ ID NO: 184911 - DNA, 25 bp, Rattus norvegicus
atctcgtcgcctcagcatgacagat

SEQ ID NO: 184912 - DNA, 25 bp, Rattus norvegicus
atctcgtcgcctgagcatgacagat

SEQ ID NO: 184913 - DNA, 25 bp, Rattus norvegicus
atctcgtcggagacatgttgacact

SEQ ID NO: 184914 - DNA, 25 bp, Rattus norvegicus
atctcgtcggagtcatgttgacact

SEQ ID NO: 184915 - DNA, 25 bp, Rattus norvegicus
atctcgtctgatctcggaagctaag

SEQ ID NO: 184916 - DNA, 25 bp, Rattus norvegicus
atctcgtctgatgtcggaagctaag

SEQ ID NO: 184917 - DNA, 25 bp, Rattus norvegicus
atctcgtctgtgattggtgttgcca

SEQ ID NO: 184918 - DNA, 25 bp, Rattus norvegicus
atctcgtctgtgtttggtgttgcca

SEQ ID NO: 184919 - DNA, 25 bp, Rattus norvegicus
atctcgtgctcgactggctgaacag

SEQ ID NO: 184920 - DNA, 25 bp, Rattus norvegicus
atctcgtgctcgtctggctgaacag

SEQ ID NO: 184921 - DNA, 25 bp, Rattus norvegicus
atctcgtgggccagacacctgaagc

SEQ ID NO: 184922 - DNA, 25 bp, Rattus norvegicus
atctcgtgggcctgacacctgaagc

SEQ ID NO: 184923 - DNA, 25 bp, Rattus norvegicus
atctcgtggtctccctggtaaacaa

SEQ ID NO: 184924 - DNA, 25 bp, Rattus norvegicus
atctcgtggtctgcctggtaaacaa

SEQ ID NO: 184925 - DNA, 25 bp, Rattus norvegicus
atctcgtgtgagcatagtaatcaga

SEQ ID NO: 184926 - DNA, 25 bp, Rattus norvegicus
atctcgtgtgaggatagtaatcaga

SEQ ID NO: 184927 - DNA, 25 bp, Rattus norvegicus
atctcgttagaccatcgtcttctga

SEQ ID NO: 184928 - DNA, 25 bp, Rattus norvegicus
atctcgttagacgatcgtcttctga

SEQ ID NO: 184929 - DNA, 25 bp, Rattus norvegicus
atctcgttatgtatgctactggtta

SEQ ID NO: 184930 - DNA, 25 bp, Rattus norvegicus
atctcgttatgtttgctactggtta

SEQ ID NO: 184931 - DNA, 25 bp, Rattus norvegicus
atctcgttcatcactgttgccaggg

SEQ ID NO: 184932 - DNA, 25 bp, Rattus norvegicus
atctcgttcatctctgttgccaggg

SEQ ID NO: 184933 - DNA, 25 bp, Rattus norvegicus
atctcgttccagctcattttgtggt

SEQ ID NO: 184934 - DNA, 25 bp, Rattus norvegicus
atctcgttccaggtcattttgtggt

SEQ ID NO: 184935 - DNA, 25 bp, Rattus norvegicus
atctcgttcttgaagaccagatcta

SEQ ID NO: 184936 - DNA, 25 bp, Rattus norvegicus
atctcgttcttgtagaccagatcta

SEQ ID NO: 184937 - DNA, 25 bp, Rattus norvegicus
atctcgttggttccgacctaggatg

SEQ ID NO: 184938 - DNA, 25 bp, Rattus norvegicus
atctcgttggttgcgacctaggatg

SEQ ID NO: 184939 - DNA, 25 bp, Rattus norvegicus
atctcgtttgagactaatctgggaa

SEQ ID NO: 184940 - DNA, 25 bp, Rattus norvegicus
atctcgtttgagtctaatctgggaa

SEQ ID NO: 184941 - DNA, 25 bp, Rattus norvegicus
atctctaaaacaaccatcctttcag

SEQ ID NO: 184942 - DNA, 25 bp, Rattus norvegicus
atctctaaaacatccatcctttcag

SEQ ID NO: 184943 - DNA, 25 bp, Rattus norvegicus
atctctaaactaagaggccctgcca

SEQ ID NO: 184944 - DNA, 25 bp, Rattus norvegicus
atctctaaactatgaggccctgcca

SEQ ID NO: 184945 - DNA, 25 bp, Rattus norvegicus
atctctaaaggaagaagttctgaaa

SEQ ID NO: 184946 - DNA, 25 bp, Rattus norvegicus
atctctaaaggatgaagttctgaaa

SEQ ID NO: 184947 - DNA, 25 bp, Rattus norvegicus
atctctaagcctccgatgagttgag

SEQ ID NO: 184948 - DNA, 25 bp, Rattus norvegicus
atctctaagcctgcgatgagttgag

SEQ ID NO: 184949 - DNA, 25 bp, Rattus norvegicus
atctctaagctacctttgcctgctt

SEQ ID NO: 184950 - DNA, 25 bp, Rattus norvegicus
atctctaagctagctttgcctgctt

SEQ ID NO: 184951 - DNA, 25 bp, Rattus norvegicus
atctctacagtaagattctagcgtt

SEQ ID NO: 184952 - DNA, 25 bp, Rattus norvegicus
atctctacagtatgattctagcgtt

SEQ ID NO: 184953 - DNA, 25 bp, Rattus norvegicus
atctctactcaactggccgtgatcg

SEQ ID NO: 184954 - DNA, 25 bp, Rattus norvegicus
atctctactcaagtggccgtgatcg

SEQ ID NO: 184955 - DNA, 25 bp, Rattus norvegicus
atctctagaaaacgctccctgcttg

SEQ ID NO: 184956 - DNA, 25 bp, Rattus norvegicus
atctctagaaaaggctccctgcttg

SEQ ID NO: 184957 - DNA, 25 bp, Rattus norvegicus
atctctagaccactgattctcaacc

SEQ ID NO: 184958 - DNA, 25 bp, Rattus norvegicus
atctctagaccagtgattctcaacc

SEQ ID NO: 184959 - DNA, 25 bp, Rattus norvegicus
atctctagatatccaggctccctag

SEQ ID NO: 184960 - DNA, 25 bp, Rattus norvegicus
atctctagatatgcaggctccctag

SEQ ID NO: 184961 - DNA, 25 bp, Rattus norvegicus
atctctagatttacattctgctgag

SEQ ID NO: 184962 - DNA, 25 bp, Rattus norvegicus
atctctagattttcattctgctgag

SEQ ID NO: 184963 - DNA, 25 bp, Rattus norvegicus
atctctagccataatacttccctat

SEQ ID NO: 184964 - DNA, 25 bp, Rattus norvegicus
atctctagccattatacttccctat

SEQ ID NO: 184965 - DNA, 25 bp, Rattus norvegicus
atctctagcccaattcatctgacag

SEQ ID NO: 184966 - DNA, 25 bp, Rattus norvegicus
atctctagcccatttcatctgacag

SEQ ID NO: 184967 - DNA, 25 bp, Rattus norvegicus
atctctagccggcaatgtctttttt

SEQ ID NO: 184968 - DNA, 25 bp, Rattus norvegicus
atctctagccgggaatgtctttttt

SEQ ID NO: 184969 - DNA, 25 bp, Rattus norvegicus
atctctagcctcagtgtgttgacac

SEQ ID NO: 184970 - DNA, 25 bp, Rattus norvegicus
atctctagcctctgtgtgttgacac

SEQ ID NO: 184971 - DNA, 25 bp, Rattus norvegicus
atctctagtaacctatcatttttag

SEQ ID NO: 184972 - DNA, 25 bp, Rattus norvegicus
atctctagtaacgtatcatttttag

SEQ ID NO: 184973 - DNA, 25 bp, Rattus norvegicus
atctctagtagcacatagccacttg

SEQ ID NO: 184974 - DNA, 25 bp, Rattus norvegicus
atctctagtagctcatagccacttg

SEQ ID NO: 184975 - DNA, 25 bp, Rattus norvegicus
atctctagtgttagttacagtagca

SEQ ID NO: 184976 - DNA, 25 bp, Rattus norvegicus
atctctagtgtttgttacagtagca

SEQ ID NO: 184977 - DNA, 25 bp, Rattus norvegicus
atctctatagtcacatccttgtctg

SEQ ID NO: 184978 - DNA, 25 bp, Rattus norvegicus
atctctatagtctcatccttgtctg

SEQ ID NO: 184979 - DNA, 25 bp, Rattus norvegicus
atctctatcaggaatactgcctcag

SEQ ID NO: 184980 - DNA, 25 bp, Rattus norvegicus
atctctatcaggtatactgcctcag

SEQ ID NO: 184981 - DNA, 25 bp, Rattus norvegicus
atctctatctacagccagggatgga

SEQ ID NO: 184982 - DNA, 25 bp, Rattus norvegicus
atctctatctactgccagggatgga

SEQ ID NO: 184983 - DNA, 25 bp, Rattus norvegicus
atctctatgctaatgttctcttgtc

SEQ ID NO: 184984 - DNA, 25 bp, Rattus norvegicus
atctctatgctattgttctcttgtc

SEQ ID NO: 184985 - DNA, 25 bp, Rattus norvegicus
atctctatgttgagtgatacctgta

SEQ ID NO: 184986 - DNA, 25 bp, Rattus norvegicus
atctctatgttgtgtgatacctgta

SEQ ID NO: 184987 - DNA, 25 bp, Rattus norvegicus
atctctattcaccaactgttctcag

SEQ ID NO: 184988 - DNA, 25 bp, Rattus norvegicus
atctctattcacgaactgttctcag

SEQ ID NO: 184989 - DNA, 25 bp, Rattus norvegicus
atctctcaacaaagtgtttctttat

SEQ ID NO: 184990 - DNA, 25 bp, Rattus norvegicus
atctctcaacaatgtgtttctttat

SEQ ID NO: 184991 - DNA, 25 bp, Rattus norvegicus
atctctcaagacaggcctcagattt

SEQ ID NO: 184992 - DNA, 25 bp, Rattus norvegicus
atctctcaagactggcctcagattt

SEQ ID NO: 184993 - DNA, 25 bp, Rattus norvegicus
atctctcaagatctaggacccaggg

SEQ ID NO: 184994 - DNA, 25 bp, Rattus norvegicus
atctctcaagatgtaggacccaggg

SEQ ID NO: 184995 - DNA, 25 bp, Rattus norvegicus
atctctcacaatacttcccaaggta

SEQ ID NO: 184996 - DNA, 25 bp, Rattus norvegicus
atctctcacaattcttcccaaggta

SEQ ID NO: 184997 - DNA, 25 bp, Rattus norvegicus
atctctcagaaactgcggctaccat

SEQ ID NO: 184998 - DNA, 25 bp, Rattus norvegicus
atctctcagaaagtgcggctaccat

SEQ ID NO: 184999 - DNA, 25 bp, Rattus norvegicus
atctctcagatccttgtccagtgtg

SEQ ID NO: 185000 - DNA, 25 bp, Rattus norvegicus
atctctcagatcgttgtccagtgtg

SEQ ID NO: 185001 - DNA, 25 bp, Rattus norvegicus
atctctcagcccatgattctaggaa

SEQ ID NO: 185002 - DNA, 25 bp, Rattus norvegicus
atctctcagcccttgattctaggaa

SEQ ID NO: 185003 - DNA, 25 bp, Rattus norvegicus
atctctcaggccactaacttaggaa

SEQ ID NO: 185004 - DNA, 25 bp, Rattus norvegicus
atctctcaggcctctaacttaggaa

SEQ ID NO: 185005 - DNA, 25 bp, Rattus norvegicus
atctctcagggaaaaggctcaggta

SEQ ID NO: 185006 - DNA, 25 bp, Rattus norvegicus
atctctcagggataaggctcaggta

SEQ ID NO: 185007 - DNA, 25 bp, Rattus norvegicus
atctctcaggttacggagactccga

SEQ ID NO: 185008 - DNA, 25 bp, Rattus norvegicus
atctctcaggtttcggagactccga

SEQ ID NO: 185009 - DNA, 25 bp, Rattus norvegicus
atctctcattataatttgggaagct

SEQ ID NO: 185010 - DNA, 25 bp, Rattus norvegicus
atctctcattattatttgggaagct

SEQ ID NO: 185011 - DNA, 25 bp, Rattus norvegicus
atctctcattttacatctaagccct

SEQ ID NO: 185012 - DNA, 25 bp, Rattus norvegicus
atctctcatttttcatctaagccct

SEQ ID NO: 185013 - DNA, 25 bp, Rattus norvegicus
atctctccaacccataataaatctt

SEQ ID NO: 185014 - DNA, 25 bp, Rattus norvegicus
atctctccaaccgataataaatctt

SEQ ID NO: 185015 - DNA, 25 bp, Rattus norvegicus
atctctccaaggaaccggctcagga

SEQ ID NO: 185016 - DNA, 25 bp, Rattus norvegicus
atctctccaaggtaccggctcagga

SEQ ID NO: 185017 - DNA, 25 bp, Rattus norvegicus
atctctccacacactttatgtttct

SEQ ID NO: 185018 - DNA, 25 bp, Rattus norvegicus
atctctccacactctttatgtttct

SEQ ID NO: 185019 - DNA, 25 bp, Rattus norvegicus
atctctccacttaagggttctcaaa

SEQ ID NO: 185020 - DNA, 25 bp, Rattus norvegicus
atctctccactttagggttctcaaa

SEQ ID NO: 185021 - DNA, 25 bp, Rattus norvegicus
atctctccagagacagttgtagcct

SEQ ID NO: 185022 - DNA, 25 bp, Rattus norvegicus
atctctccagagtcagttgtagcct

SEQ ID NO: 185023 - DNA, 25 bp, Rattus norvegicus
atctctccagcaatcatttttaaaa

SEQ ID NO: 185024 - DNA, 25 bp, Rattus norvegicus
atctctccagcattcatttttaaaa

SEQ ID NO: 185025 - DNA, 25 bp, Rattus norvegicus
atctctccagccagtataggattct

SEQ ID NO: 185026 - DNA, 25 bp, Rattus norvegicus
atctctccagcccagaagtcagact

SEQ ID NO: 185027 - DNA, 25 bp, Rattus norvegicus
atctctccagccgagaagtcagact

SEQ ID NO: 185028 - DNA, 25 bp, Rattus norvegicus
atctctccagcctgtataggattct

SEQ ID NO: 185029 - DNA, 25 bp, Rattus norvegicus
atctctccagctactcaaaagttct

SEQ ID NO: 185030 - DNA, 25 bp, Rattus norvegicus
atctctccagcttctcaaaagttct

SEQ ID NO: 185031 - DNA, 25 bp, Rattus norvegicus
atctctccatctcaggacttggcag

SEQ ID NO: 185032 - DNA, 25 bp, Rattus norvegicus
atctctccatctgaggacttggcag

SEQ ID NO: 185033 - DNA, 25 bp, Rattus norvegicus
atctctcccagaagctgactgctga

SEQ ID NO: 185034 - DNA, 25 bp, Rattus norvegicus
atctctcccagatgctgactgctga

SEQ ID NO: 185035 - DNA, 25 bp, Rattus norvegicus
atctctccctgcagaatcaggctca

SEQ ID NO: 185036 - DNA, 25 bp, Rattus norvegicus
atctctccctgctgaatcaggctca

SEQ ID NO: 185037 - DNA, 25 bp, Rattus norvegicus
atctctccgagaagcatgttgtgct

SEQ ID NO: 185038 - DNA, 25 bp, Rattus norvegicus
atctctccgagatgcatgttgtgct

SEQ ID NO: 185039 - DNA, 25 bp, Rattus norvegicus
atctctcctcctactttttagaatg

SEQ ID NO: 185040 - DNA, 25 bp, Rattus norvegicus
atctctcctccttctttttagaatg

SEQ ID NO: 185041 - DNA, 25 bp, Rattus norvegicus
atctctcctcgtcaaggcgtttcct

SEQ ID NO: 185042 - DNA, 25 bp, Rattus norvegicus
atctctcctcgtgaaggcgtttcct

SEQ ID NO: 185043 - DNA, 25 bp, Rattus norvegicus
atctctcctggaaggataggtggcc

SEQ ID NO: 185044 - DNA, 25 bp, Rattus norvegicus
atctctcctggatggataggtggcc

SEQ ID NO: 185045 - DNA, 25 bp, Rattus norvegicus
atctctccttccactggtagatgag

SEQ ID NO: 185046 - DNA, 25 bp, Rattus norvegicus
atctctccttcctctggtagatgag

SEQ ID NO: 185047 - DNA, 25 bp, Rattus norvegicus
atctctccttgccaaatagtctgtg

SEQ ID NO: 185048 - DNA, 25 bp, Rattus norvegicus
atctctccttgcgaaatagtctgtg

SEQ ID NO: 185049 - DNA, 25 bp, Rattus norvegicus
atctctcctttcactgtgtgatgaa

SEQ ID NO: 185050 - DNA, 25 bp, Rattus norvegicus
atctctcctttctctgtgtgatgaa

SEQ ID NO: 185051 - DNA, 25 bp, Rattus norvegicus
atctctcgagtcagctgtgcaagtt

SEQ ID NO: 185052 - DNA, 25 bp, Rattus norvegicus
atctctcgagtctgctgtgcaagtt

SEQ ID NO: 185053 - DNA, 25 bp, Rattus norvegicus
atctctcggtctatgctgtggtggt

SEQ ID NO: 185054 - DNA, 25 bp, Rattus norvegicus
atctctcggtctttgctgtggtggt

SEQ ID NO: 185055 - DNA, 25 bp, Rattus norvegicus
atctctcggtggctcaaaaccaggc

SEQ ID NO: 185056 - DNA, 25 bp, Rattus norvegicus
atctctcggtgggtcaaaaccaggc

SEQ ID NO: 185057 - DNA, 25 bp, Rattus norvegicus
atctctctaagaaggtgtccctgct

SEQ ID NO: 185058 - DNA, 25 bp, Rattus norvegicus
atctctctaagatggtgtccctgct

SEQ ID NO: 185059 - DNA, 25 bp, Rattus norvegicus
atctctctacgccacaaagtttgag

SEQ ID NO: 185060 - DNA, 25 bp, Rattus norvegicus
atctctctacgcgacaaagtttgag

SEQ ID NO: 185061 - DNA, 25 bp, Rattus norvegicus
atctctctagcacctgactaaaaac

SEQ ID NO: 185062 - DNA, 25 bp, Rattus norvegicus
atctctctagcagctgactaaaaac

SEQ ID NO: 185063 - DNA, 25 bp, Rattus norvegicus
atctctctagctccagctgtttctt

SEQ ID NO: 185064 - DNA, 25 bp, Rattus norvegicus
atctctctagctgcagctgtttctt

SEQ ID NO: 185065 - DNA, 25 bp, Rattus norvegicus
atctctctatccacttcttagtggg

SEQ ID NO: 185066 - DNA, 25 bp, Rattus norvegicus
atctctctatcctcttcttagtggg

SEQ ID NO: 185067 - DNA, 25 bp, Rattus norvegicus
atctctctcaccacaaacggaggag

SEQ ID NO: 185068 - DNA, 25 bp, Rattus norvegicus
atctctctcacctcaaacggaggag

SEQ ID NO: 185069 - DNA, 25 bp, Rattus norvegicus
atctctctcagcagactctagaagg

SEQ ID NO: 185070 - DNA, 25 bp, Rattus norvegicus
atctctctcagctgactctagaagg

SEQ ID NO: 185071 - DNA, 25 bp, Rattus norvegicus
atctctctcataatctgtctggcgg

SEQ ID NO: 185072 - DNA, 25 bp, Rattus norvegicus
atctctctcatattctgtctggcgg

SEQ ID NO: 185073 - DNA, 25 bp, Rattus norvegicus
atctctctcggtctgcatttgcaaa

SEQ ID NO: 185074 - DNA, 25 bp, Rattus norvegicus
atctctctcggtgtgcatttgcaaa

SEQ ID NO: 185075 - DNA, 25 bp, Rattus norvegicus
atctctctgagcattgtctatgtag

SEQ ID NO: 185076 - DNA, 25 bp, Rattus norvegicus
atctctctgagctttgtctatgtag

SEQ ID NO: 185077 - DNA, 25 bp, Rattus norvegicus
atctctctgattctagaccatccaa

SEQ ID NO: 185078 - DNA, 25 bp, Rattus norvegicus
atctctctgattgtagaccatccaa

SEQ ID NO: 185079 - DNA, 25 bp, Rattus norvegicus
atctctctgctgagaactgtggtga

SEQ ID NO: 185080 - DNA, 25 bp, Rattus norvegicus
atctctctgctgtgaactgtggtga

SEQ ID NO: 185081 - DNA, 25 bp, Rattus norvegicus
atctctctgtcaaactccagtgagc

SEQ ID NO: 185082 - DNA, 25 bp, Rattus norvegicus
atctctctgtcatactccagtgagc

SEQ ID NO: 185083 - DNA, 25 bp, Rattus norvegicus
atctctctgtccagggttgtctgtg

SEQ ID NO: 185084 - DNA, 25 bp, Rattus norvegicus
atctctctgtccctgtattcagagt

SEQ ID NO: 185085 - DNA, 25 bp, Rattus norvegicus
atctctctgtccgtgtattcagagt

SEQ ID NO: 185086 - DNA, 25 bp, Rattus norvegicus
atctctctgtcctgggttgtctgtg

SEQ ID NO: 185087 - DNA, 25 bp, Rattus norvegicus
atctctcttcgaaataatatgtttg

SEQ ID NO: 185088 - DNA, 25 bp, Rattus norvegicus
atctctcttcgatataatatgtttg

SEQ ID NO: 185089 - DNA, 25 bp, Rattus norvegicus
atctctcttctgacgggcactgaac

SEQ ID NO: 185090 - DNA, 25 bp, Rattus norvegicus
atctctcttctgtcgggcactgaac

SEQ ID NO: 185091 - DNA, 25 bp, Rattus norvegicus
atctctcttgagctatgtgttctta

SEQ ID NO: 185092 - DNA, 25 bp, Rattus norvegicus
atctctcttgaggtatgtgttctta

SEQ ID NO: 185093 - DNA, 25 bp, Rattus norvegicus
atctctcttgccacacagatggtta

SEQ ID NO: 185094 - DNA, 25 bp, Rattus norvegicus
atctctcttgcctcacagatggtta

SEQ ID NO: 185095 - DNA, 25 bp, Rattus norvegicus
atctctcttgtcagccagtgtgaat

SEQ ID NO: 185096 - DNA, 25 bp, Rattus norvegicus
atctctcttgtctgccagtgtgaat

SEQ ID NO: 185097 - DNA, 25 bp, Rattus norvegicus
atctctctttgtagacttgcctaac

SEQ ID NO: 185098 - DNA, 25 bp, Rattus norvegicus
atctctctttgttgacttgcctaac

SEQ ID NO: 185099 - DNA, 25 bp, Rattus norvegicus
atctctgaccaacaaagctggcctg

SEQ ID NO: 185100 - DNA, 25 bp, Rattus norvegicus
atctctgaccaagaaagctggcctg

SEQ ID NO: 185101 - DNA, 25 bp, Rattus norvegicus
atctctgaggacattcttcctactt

SEQ ID NO: 185102 - DNA, 25 bp, Rattus norvegicus
atctctgaggactttcttcctactt

SEQ ID NO: 185103 - DNA, 25 bp, Rattus norvegicus
atctctgaggtactgtgttccgcac

SEQ ID NO: 185104 - DNA, 25 bp, Rattus norvegicus
atctctgaggtagtgtgttccgcac

SEQ ID NO: 185105 - DNA, 25 bp, Rattus norvegicus
atctctgagtcacacaagctcttga

SEQ ID NO: 185106 - DNA, 25 bp, Rattus norvegicus
atctctgagtcagacaagctcttga

SEQ ID NO: 185107 - DNA, 25 bp, Rattus norvegicus
atctctgataaccttctggtgaccg

SEQ ID NO: 185108 - DNA, 25 bp, Rattus norvegicus
atctctgataacgttctggtgaccg

SEQ ID NO: 185109 - DNA, 25 bp, Rattus norvegicus
atctctgcaaacaatgcccagtttt

SEQ ID NO: 185110 - DNA, 25 bp, Rattus norvegicus
atctctgcaaactatgcccagtttt

SEQ ID NO: 185111 - DNA, 25 bp, Rattus norvegicus
atctctgcaacgcatcgtggtagaa

SEQ ID NO: 185112 - DNA, 25 bp, Rattus norvegicus
atctctgcaacggatcgtggtagaa

SEQ ID NO: 185113 - DNA, 25 bp, Rattus norvegicus
atctctgcagagactgagggatgga

SEQ ID NO: 185114 - DNA, 25 bp, Rattus norvegicus
atctctgcagagtctgagggatgga

SEQ ID NO: 185115 - DNA, 25 bp, Rattus norvegicus
atctctgccaccaaggaaggacctg

SEQ ID NO: 185116 - DNA, 25 bp, Rattus norvegicus
atctctgccaccctaaacaaagtgt

SEQ ID NO: 185117 - DNA, 25 bp, Rattus norvegicus
atctctgccaccgtaaacaaagtgt

SEQ ID NO: 185118 - DNA, 25 bp, Rattus norvegicus
atctctgccacctaggaaggacctg

SEQ ID NO: 185119 - DNA, 25 bp, Rattus norvegicus
atctctgccccaagggttttcaaaa

SEQ ID NO: 185120 - DNA, 25 bp, Rattus norvegicus
atctctgccccatgggttttcaaaa

SEQ ID NO: 185121 - DNA, 25 bp, Rattus norvegicus
atctctgccctaccaaaattgcttt

SEQ ID NO: 185122 - DNA, 25 bp, Rattus norvegicus
atctctgccctagcaaaattgcttt

SEQ ID NO: 185123 - DNA, 25 bp, Rattus norvegicus
atctctgccctcaaatcacagtgaa

SEQ ID NO: 185124 - DNA, 25 bp, Rattus norvegicus
atctctgccctctaatcacagtgaa

SEQ ID NO: 185125 - DNA, 25 bp, Rattus norvegicus
atctctgccctgagctacaatcctg

SEQ ID NO: 185126 - DNA, 25 bp, Rattus norvegicus
atctctgccctgtgctacaatcctg

SEQ ID NO: 185127 - DNA, 25 bp, Rattus norvegicus
atctctgcctccattgtatgacttt

SEQ ID NO: 185128 - DNA, 25 bp, Rattus norvegicus
atctctgcctcctttgtatgacttt

SEQ ID NO: 185129 - DNA, 25 bp, Rattus norvegicus
atctctgccttaagtcatttattat

SEQ ID NO: 185130 - DNA, 25 bp, Rattus norvegicus
atctctgccttatgtcatttattat

SEQ ID NO: 185131 - DNA, 25 bp, Rattus norvegicus
atctctgccttcaattgttttacag

SEQ ID NO: 185132 - DNA, 25 bp, Rattus norvegicus
atctctgccttctattgttttacag

SEQ ID NO: 185133 - DNA, 25 bp, Rattus norvegicus
atctctgcctttaaaccgtctattg

SEQ ID NO: 185134 - DNA, 25 bp, Rattus norvegicus
atctctgcctttaatagtcacccga

SEQ ID NO: 185135 - DNA, 25 bp, Rattus norvegicus
atctctgccttttaaccgtctattg

SEQ ID NO: 185136 - DNA, 25 bp, Rattus norvegicus
atctctgccttttatagtcacccga

SEQ ID NO: 185137 - DNA, 25 bp, Rattus norvegicus
atctctgcgttgatgcttctgttaa

SEQ ID NO: 185138 - DNA, 25 bp, Rattus norvegicus
atctctgcgttgttgcttctgttaa

SEQ ID NO: 185139 - DNA, 25 bp, Rattus norvegicus
atctctgctactatggactgacact

SEQ ID NO: 185140 - DNA, 25 bp, Rattus norvegicus
atctctgctactttggactgacact

SEQ ID NO: 185141 - DNA, 25 bp, Rattus norvegicus
atctctgctccgaaattctatttga

SEQ ID NO: 185142 - DNA, 25 bp, Rattus norvegicus
atctctgctccgaggtgcgggtccc

SEQ ID NO: 185143 - DNA, 25 bp, Rattus norvegicus
atctctgctccgtaattctatttga

SEQ ID NO: 185144 - DNA, 25 bp, Rattus norvegicus
atctctgctccgtggtgcgggtccc

SEQ ID NO: 185145 - DNA, 25 bp, Rattus norvegicus
atctctgctcctagggtagttggac

SEQ ID NO: 185146 - DNA, 25 bp, Rattus norvegicus
atctctgctccttgggtagttggac

SEQ ID NO: 185147 - DNA, 25 bp, Rattus norvegicus
atctctgctcttaggctgagttaca

SEQ ID NO: 185148 - DNA, 25 bp, Rattus norvegicus
atctctgctctttggctgagttaca

SEQ ID NO: 185149 - DNA, 25 bp, Rattus norvegicus
atctctgctgctaatgggaaattgt

SEQ ID NO: 185150 - DNA, 25 bp, Rattus norvegicus
atctctgctgcttatgggaaattgt

SEQ ID NO: 185151 - DNA, 25 bp, Rattus norvegicus
atctctgctgtcatttgttctgtca

SEQ ID NO: 185152 - DNA, 25 bp, Rattus norvegicus
atctctgctgtcttttgttctgtca

SEQ ID NO: 185153 - DNA, 25 bp, Rattus norvegicus
atctctgctgtgattttcttccctg

SEQ ID NO: 185154 - DNA, 25 bp, Rattus norvegicus
atctctgctgtgctgtcttacccag

SEQ ID NO: 185155 - DNA, 25 bp, Rattus norvegicus
atctctgctgtggtgtcttacccag

SEQ ID NO: 185156 - DNA, 25 bp, Rattus norvegicus
atctctgctgtgtttttcttccctg

SEQ ID NO: 185157 - DNA, 25 bp, Rattus norvegicus
atctctgcttccaatctatcatctt

SEQ ID NO: 185158 - DNA, 25 bp, Rattus norvegicus
atctctgcttcctatctatcatctt

SEQ ID NO: 185159 - DNA, 25 bp, Rattus norvegicus
atctctggatggaaaccattcttta

SEQ ID NO: 185160 - DNA, 25 bp, Rattus norvegicus
atctctggatggtaaccattcttta

SEQ ID NO: 185161 - DNA, 25 bp, Rattus norvegicus
atctctggatgtagagtcctgggcc

SEQ ID NO: 185162 - DNA, 25 bp, Rattus norvegicus
atctctggatgttgagtcctgggcc

SEQ ID NO: 185163 - DNA, 25 bp, Rattus norvegicus
atctctggcattcctttctgatatc

SEQ ID NO: 185164 - DNA, 25 bp, Rattus norvegicus
atctctggcattgctttctgatatc

SEQ ID NO: 185165 - DNA, 25 bp, Rattus norvegicus
atctctggcccgaaggtaagttgct

SEQ ID NO: 185166 - DNA, 25 bp, Rattus norvegicus
atctctggcccgtaggtaagttgct

SEQ ID NO: 185167 - DNA, 25 bp, Rattus norvegicus
atctctgggttcatctttgccaaaa

SEQ ID NO: 185168 - DNA, 25 bp, Rattus norvegicus
atctctgggttcttctttgccaaaa

SEQ ID NO: 185169 - DNA, 25 bp, Rattus norvegicus
atctctggtccaaacgactccagta

SEQ ID NO: 185170 - DNA, 25 bp, Rattus norvegicus
atctctggtccatacgactccagta

SEQ ID NO: 185171 - DNA, 25 bp, Rattus norvegicus
atctctggtctcatctagtactgaa

SEQ ID NO: 185172 - DNA, 25 bp, Rattus norvegicus
atctctggtctcttctagtactgaa

SEQ ID NO: 185173 - DNA, 25 bp, Rattus norvegicus
atctctggtggtcaaatacaaatgc

SEQ ID NO: 185174 - DNA, 25 bp, Rattus norvegicus
atctctggtggtgaaatacaaatgc

SEQ ID NO: 185175 - DNA, 25 bp, Rattus norvegicus
atctctggtgtcaatcgctactatg

SEQ ID NO: 185176 - DNA, 25 bp, Rattus norvegicus
atctctggtgtctatcgctactatg

SEQ ID NO: 185177 - DNA, 25 bp, Rattus norvegicus
atctctggtgtgagatgcttgctgc

SEQ ID NO: 185178 - DNA, 25 bp, Rattus norvegicus
atctctggtgtgtgatgcttgctgc

SEQ ID NO: 185179 - DNA, 25 bp, Rattus norvegicus
atctctgtaacgaaggactcctggc

SEQ ID NO: 185180 - DNA, 25 bp, Rattus norvegicus
atctctgtaacgtaggactcctggc

SEQ ID NO: 185181 - DNA, 25 bp, Rattus norvegicus
atctctgtagccattagttatccgt

SEQ ID NO: 185182 - DNA, 25 bp, Rattus norvegicus
atctctgtagcctttagttatccgt

SEQ ID NO: 185183 - DNA, 25 bp, Rattus norvegicus
atctctgtatggcttgggagcacta

SEQ ID NO: 185184 - DNA, 25 bp, Rattus norvegicus
atctctgtatgggttgggagcacta

SEQ ID NO: 185185 - DNA, 25 bp, Rattus norvegicus
atctctgtattgacagctggtacct

SEQ ID NO: 185186 - DNA, 25 bp, Rattus norvegicus
atctctgtattgtcagctggtacct

SEQ ID NO: 185187 - DNA, 25 bp, Rattus norvegicus
atctctgtccatcctaaatctccat

SEQ ID NO: 185188 - DNA, 25 bp, Rattus norvegicus
atctctgtccatgctaaatctccat

SEQ ID NO: 185189 - DNA, 25 bp, Rattus norvegicus
atctctgtcctcaccgtattggaat

SEQ ID NO: 185190 - DNA, 25 bp, Rattus norvegicus
atctctgtcctctccgtattggaat

SEQ ID NO: 185191 - DNA, 25 bp, Rattus norvegicus
atctctgtgaatactcctgacctgg

SEQ ID NO: 185192 - DNA, 25 bp, Rattus norvegicus
atctctgtgaattctcctgacctgg

SEQ ID NO: 185193 - DNA, 25 bp, Rattus norvegicus
atctctgtggagactctggaggtca

SEQ ID NO: 185194 - DNA, 25 bp, Rattus norvegicus
atctctgtggagtctctggaggtca

SEQ ID NO: 185195 - DNA, 25 bp, Rattus norvegicus
atctctgtggcaaacgtttctgttt

SEQ ID NO: 185196 - DNA, 25 bp, Rattus norvegicus
atctctgtggcatacgtttctgttt

SEQ ID NO: 185197 - DNA, 25 bp, Rattus norvegicus
atctctgttagcatactgtctgtta

SEQ ID NO: 185198 - DNA, 25 bp, Rattus norvegicus
atctctgttagcttactgtctgtta

SEQ ID NO: 185199 - DNA, 25 bp, Rattus norvegicus
atctctgttagtctttgatccataa

SEQ ID NO: 185200 - DNA, 25 bp, Rattus norvegicus
atctctgttagtgtttgatccataa

SEQ ID NO: 185201 - DNA, 25 bp, Rattus norvegicus
atctctgttctcaatgcatcgtttc

SEQ ID NO: 185202 - DNA, 25 bp, Rattus norvegicus
atctctgttctctatgcatcgtttc

SEQ ID NO: 185203 - DNA, 25 bp, Rattus norvegicus
atctctgttcttagtgtatcatgca

SEQ ID NO: 185204 - DNA, 25 bp, Rattus norvegicus
atctctgttctttgtgtatcatgca

SEQ ID NO: 185205 - DNA, 25 bp, Rattus norvegicus
atctctgttgaactgttgcatctct

SEQ ID NO: 185206 - DNA, 25 bp, Rattus norvegicus
atctctgttgaagtgttgcatctct

SEQ ID NO: 185207 - DNA, 25 bp, Rattus norvegicus
atctctgtttcccagacagctttga

SEQ ID NO: 185208 - DNA, 25 bp, Rattus norvegicus
atctctgtttccgagacagctttga

SEQ ID NO: 185209 - DNA, 25 bp, Rattus norvegicus
atctcttaagtgctctgttcctttc

SEQ ID NO: 185210 - DNA, 25 bp, Rattus norvegicus
atctcttaagtggtctgttcctttc

SEQ ID NO: 185211 - DNA, 25 bp, Rattus norvegicus
atctcttactccaataggcaccaat

SEQ ID NO: 185212 - DNA, 25 bp, Rattus norvegicus
atctcttactcctataggcaccaat

SEQ ID NO: 185213 - DNA, 25 bp, Rattus norvegicus
atctcttactttacaccctgtactg

SEQ ID NO: 185214 - DNA, 25 bp, Rattus norvegicus
atctcttacttttcaccctgtactg

SEQ ID NO: 185215 - DNA, 25 bp, Rattus norvegicus
atctcttagccaacagttctgatcc

SEQ ID NO: 185216 - DNA, 25 bp, Rattus norvegicus
atctcttagccatcagttctgatcc

SEQ ID NO: 185217 - DNA, 25 bp, Rattus norvegicus
atctcttaggcaatacatcgttgta

SEQ ID NO: 185218 - DNA, 25 bp, Rattus norvegicus
atctcttaggcattacatcgttgta

SEQ ID NO: 185219 - DNA, 25 bp, Rattus norvegicus
atctcttaggctatgtacacacagg

SEQ ID NO: 185220 - DNA, 25 bp, Rattus norvegicus
atctcttaggctttgtacacacagg

SEQ ID NO: 185221 - DNA, 25 bp, Rattus norvegicus
atctcttagtgcctctttcaatgtg

SEQ ID NO: 185222 - DNA, 25 bp, Rattus norvegicus
atctcttagtgcgtctttcaatgtg

SEQ ID NO: 185223 - DNA, 25 bp, Rattus norvegicus
atctcttattttacttttggcatga

SEQ ID NO: 185224 - DNA, 25 bp, Rattus norvegicus
atctcttatttttcttttggcatga

SEQ ID NO: 185225 - DNA, 25 bp, Rattus norvegicus
atctcttcaactctgtcgctgtgtt

SEQ ID NO: 185226 - DNA, 25 bp, Rattus norvegicus
atctcttcaactgtgtcgctgtgtt

SEQ ID NO: 185227 - DNA, 25 bp, Rattus norvegicus
atctcttcactgaaacgtggtacac

SEQ ID NO: 185228 - DNA, 25 bp, Rattus norvegicus
atctcttcactgtaacgtggtacac

SEQ ID NO: 185229 - DNA, 25 bp, Rattus norvegicus
atctcttcagtcaacgacagcttgg

SEQ ID NO: 185230 - DNA, 25 bp, Rattus norvegicus
atctcttcagtctacgacagcttgg

SEQ ID NO: 185231 - DNA, 25 bp, Rattus norvegicus
atctcttccagtctgactgttcaca

SEQ ID NO: 185232 - DNA, 25 bp, Rattus norvegicus
atctcttccagtgtgactgttcaca

SEQ ID NO: 185233 - DNA, 25 bp, Rattus norvegicus
atctcttccatacatctgcatatgt

SEQ ID NO: 185234 - DNA, 25 bp, Rattus norvegicus
atctcttccatagatctgcatatgt

SEQ ID NO: 185235 - DNA, 25 bp, Rattus norvegicus
atctcttccctactcttagtattgg

SEQ ID NO: 185236 - DNA, 25 bp, Rattus norvegicus
atctcttccctagtcttagtattgg

SEQ ID NO: 185237 - DNA, 25 bp, Rattus norvegicus
atctcttccgccagatggatggaac

SEQ ID NO: 185238 - DNA, 25 bp, Rattus norvegicus
atctcttccgcctgatggatggaac

SEQ ID NO: 185239 - DNA, 25 bp, Rattus norvegicus
atctcttcctagattatctctctgg

SEQ ID NO: 185240 - DNA, 25 bp, Rattus norvegicus
atctcttcctagtttatctctctgg

SEQ ID NO: 185241 - DNA, 25 bp, Rattus norvegicus
atctcttcctgcagggtaaaggctt

SEQ ID NO: 185242 - DNA, 25 bp, Rattus norvegicus
atctcttcctgctgggtaaaggctt

SEQ ID NO: 185243 - DNA, 25 bp, Rattus norvegicus
atctcttcctgtaatccatgtttgc

SEQ ID NO: 185244 - DNA, 25 bp, Rattus norvegicus
atctcttcctgttatccatgtttgc

SEQ ID NO: 185245 - DNA, 25 bp, Rattus norvegicus
atctcttccttcacgaagaggccaa

SEQ ID NO: 185246 - DNA, 25 bp, Rattus norvegicus
atctcttccttctcgaagaggccaa

SEQ ID NO: 185247 - DNA, 25 bp, Rattus norvegicus
atctcttcgcttccccagaattgaa

SEQ ID NO: 185248 - DNA, 25 bp, Rattus norvegicus
atctcttcgcttgcccagaattgaa

SEQ ID NO: 185249 - DNA, 25 bp, Rattus norvegicus
atctcttcgtcccagagcagttaga

SEQ ID NO: 185250 - DNA, 25 bp, Rattus norvegicus
atctcttcgtccgagagcagttaga

SEQ ID NO: 185251 - DNA, 25 bp, Rattus norvegicus
atctcttctctcatgaaatccggat

SEQ ID NO: 185252 - DNA, 25 bp, Rattus norvegicus
atctcttctctcttgaaatccggat

SEQ ID NO: 185253 - DNA, 25 bp, Rattus norvegicus
atctcttcttaaatgctggagtcag

SEQ ID NO: 185254 - DNA, 25 bp, Rattus norvegicus
atctcttcttaattgctggagtcag

SEQ ID NO: 185255 - DNA, 25 bp, Rattus norvegicus
atctcttgattcatacctttctctg

SEQ ID NO: 185256 - DNA, 25 bp, Rattus norvegicus
atctcttgattcttacctttctctg

SEQ ID NO: 185257 - DNA, 25 bp, Rattus norvegicus
atctcttgatttcctttttgctttg

SEQ ID NO: 185258 - DNA, 25 bp, Rattus norvegicus
atctcttgatttgctttttgctttg

SEQ ID NO: 185259 - DNA, 25 bp, Rattus norvegicus
atctcttgcataaccaggctctgag

SEQ ID NO: 185260 - DNA, 25 bp, Rattus norvegicus
atctcttgcatatccaggctctgag

SEQ ID NO: 185261 - DNA, 25 bp, Rattus norvegicus
atctcttgtccgacttcacaaagcg

SEQ ID NO: 185262 - DNA, 25 bp, Rattus norvegicus
atctcttgtccgtcttcacaaagcg

SEQ ID NO: 185263 - DNA, 25 bp, Rattus norvegicus
atctcttgtgaaatggaacgccccg

SEQ ID NO: 185264 - DNA, 25 bp, Rattus norvegicus
atctcttgtgaattggaacgccccg

SEQ ID NO: 185265 - DNA, 25 bp, Rattus norvegicus
atctcttgtgtgaattttcagtgac

SEQ ID NO: 185266 - DNA, 25 bp, Rattus norvegicus
atctcttgtgtgtattttcagtgac

SEQ ID NO: 185267 - DNA, 25 bp, Rattus norvegicus
atctcttgtgttattattccgtcaa

SEQ ID NO: 185268 - DNA, 25 bp, Rattus norvegicus
atctcttgtgtttttattccgtcaa

SEQ ID NO: 185269 - DNA, 25 bp, Rattus norvegicus
atctctttaaccctcagtgtctaat

SEQ ID NO: 185270 - DNA, 25 bp, Rattus norvegicus
atctctttaaccgtcagtgtctaat

SEQ ID NO: 185271 - DNA, 25 bp, Rattus norvegicus
atctctttacagaaccttacctttg

SEQ ID NO: 185272 - DNA, 25 bp, Rattus norvegicus
atctctttacagtaccttacctttg

SEQ ID NO: 185273 - DNA, 25 bp, Rattus norvegicus
atctctttccaaacctgttcttagt

SEQ ID NO: 185274 - DNA, 25 bp, Rattus norvegicus
atctctttccaatcctgttcttagt

SEQ ID NO: 185275 - DNA, 25 bp, Rattus norvegicus
atctctttccagacgagcatggtat

SEQ ID NO: 185276 - DNA, 25 bp, Rattus norvegicus
atctctttccagtcgagcatggtat

SEQ ID NO: 185277 - DNA, 25 bp, Rattus norvegicus
atctctttccatcttcttagaacag

SEQ ID NO: 185278 - DNA, 25 bp, Rattus norvegicus
atctctttccatgttcttagaacag

SEQ ID NO: 185279 - DNA, 25 bp, Rattus norvegicus
atctctttccttctagactcagtga

SEQ ID NO: 185280 - DNA, 25 bp, Rattus norvegicus
atctctttccttgtagactcagtga

SEQ ID NO: 185281 - DNA, 25 bp, Rattus norvegicus
atctctttctcacgtcacaggcaga

SEQ ID NO: 185282 - DNA, 25 bp, Rattus norvegicus
atctctttctcaggtcacaggcaga

SEQ ID NO: 185283 - DNA, 25 bp, Rattus norvegicus
atctctttgaaccttccaagtgaaa

SEQ ID NO: 185284 - DNA, 25 bp, Rattus norvegicus
atctctttgaacgttccaagtgaaa

SEQ ID NO: 185285 - DNA, 25 bp, Rattus norvegicus
atctctttgcctattatgtccgtgt

SEQ ID NO: 185286 - DNA, 25 bp, Rattus norvegicus
atctctttgccttttatgtccgtgt

SEQ ID NO: 185287 - DNA, 25 bp, Rattus norvegicus
atctctttggtacggagctccttaa

SEQ ID NO: 185288 - DNA, 25 bp, Rattus norvegicus
atctctttggtagggagctccttaa

SEQ ID NO: 185289 - DNA, 25 bp, Rattus norvegicus
atctctttggttattgccactgcat

SEQ ID NO: 185290 - DNA, 25 bp, Rattus norvegicus
atctctttggtttttgccactgcat

SEQ ID NO: 185291 - DNA, 25 bp, Rattus norvegicus
atctcttttaccaccgattcattgt

SEQ ID NO: 185292 - DNA, 25 bp, Rattus norvegicus
atctcttttacctccgattcattgt

SEQ ID NO: 185293 - DNA, 25 bp, Rattus norvegicus
atctcttttatgacccttattcaag

SEQ ID NO: 185294 - DNA, 25 bp, Rattus norvegicus
atctcttttatgtcccttattcaag

SEQ ID NO: 185295 - DNA, 25 bp, Rattus norvegicus
atctcttttccgcagaaacagcaga

SEQ ID NO: 185296 - DNA, 25 bp, Rattus norvegicus
atctcttttccggagaaacagcaga

SEQ ID NO: 185297 - DNA, 25 bp, Rattus norvegicus
atctcttttgtgcatattatcctcc

SEQ ID NO: 185298 - DNA, 25 bp, Rattus norvegicus
atctcttttgtggatattatcctcc

SEQ ID NO: 185299 - DNA, 25 bp, Rattus norvegicus
atctgaaaattcagcccgtttctct

SEQ ID NO: 185300 - DNA, 25 bp, Rattus norvegicus
atctgaaaattctgcccgtttctct

SEQ ID NO: 185301 - DNA, 25 bp, Rattus norvegicus
atctgaaaccgtccctgaagctgtt

SEQ ID NO: 185302 - DNA, 25 bp, Rattus norvegicus
atctgaaaccgtgcctgaagctgtt

SEQ ID NO: 185303 - DNA, 25 bp, Rattus norvegicus
atctgaaaccttactagcgtccgaa

SEQ ID NO: 185304 - DNA, 25 bp, Rattus norvegicus
atctgaaacctttctagcgtccgaa

SEQ ID NO: 185305 - DNA, 25 bp, Rattus norvegicus
atctgaaaggcacctctgtctgtct

SEQ ID NO: 185306 - DNA, 25 bp, Rattus norvegicus
atctgaaaggcagctctgtctgtct

SEQ ID NO: 185307 - DNA, 25 bp, Rattus norvegicus
atctgaaagtctcctcgtctgacgt

SEQ ID NO: 185308 - DNA, 25 bp, Rattus norvegicus
atctgaaagtctgctcgtctgacgt

SEQ ID NO: 185309 - DNA, 25 bp, Rattus norvegicus
atctgaaattgcagctcctgtggtt

SEQ ID NO: 185310 - DNA, 25 bp, Rattus norvegicus
atctgaaattgctgctcctgtggtt

SEQ ID NO: 185311 - DNA, 25 bp, Rattus norvegicus
atctgaacatataaccgcttttggt

SEQ ID NO: 185312 - DNA, 25 bp, Rattus norvegicus
atctgaacatattaccgcttttggt

SEQ ID NO: 185313 - DNA, 25 bp, Rattus norvegicus
atctgaacatgcaggccatttatca

SEQ ID NO: 185314 - DNA, 25 bp, Rattus norvegicus
atctgaacatgctggccatttatca

SEQ ID NO: 185315 - DNA, 25 bp, Rattus norvegicus
atctgaacccaacacccaataaagt

SEQ ID NO: 185316 - DNA, 25 bp, Rattus norvegicus
atctgaacccaagacccaataaagt

SEQ ID NO: 185317 - DNA, 25 bp, Rattus norvegicus
atctgaacccaccatgggctggaga

SEQ ID NO: 185318 - DNA, 25 bp, Rattus norvegicus
atctgaacccacgatgggctggaga

SEQ ID NO: 185319 - DNA, 25 bp, Rattus norvegicus
atctgaaccctaccttttgtagcca

SEQ ID NO: 185320 - DNA, 25 bp, Rattus norvegicus
atctgaaccctagcttttgtagcca

SEQ ID NO: 185321 - DNA, 25 bp, Rattus norvegicus
atctgaaccttcattgcagggccag

SEQ ID NO: 185322 - DNA, 25 bp, Rattus norvegicus
atctgaaccttctttgcagggccag

SEQ ID NO: 185323 - DNA, 25 bp, Rattus norvegicus
atctgaaccttgagagaagctgctc

SEQ ID NO: 185324 - DNA, 25 bp, Rattus norvegicus
atctgaaccttgcaagttcgctgca

SEQ ID NO: 185325 - DNA, 25 bp, Rattus norvegicus
atctgaaccttggaagttcgctgca

SEQ ID NO: 185326 - DNA, 25 bp, Rattus norvegicus
atctgaaccttgtgagaagctgctc

SEQ ID NO: 185327 - DNA, 25 bp, Rattus norvegicus
atctgaacctttaacctggcatgtc

SEQ ID NO: 185328 - DNA, 25 bp, Rattus norvegicus
atctgaaccttttacctggcatgtc

SEQ ID NO: 185329 - DNA, 25 bp, Rattus norvegicus
atctgaacgatgactgtctttgcat

SEQ ID NO: 185330 - DNA, 25 bp, Rattus norvegicus
atctgaacgatgtctgtctttgcat

SEQ ID NO: 185331 - DNA, 25 bp, Rattus norvegicus
atctgaacggtcacatgtctgcatg

SEQ ID NO: 185332 - DNA, 25 bp, Rattus norvegicus
atctgaacggtctcatgtctgcatg

SEQ ID NO: 185333 - DNA, 25 bp, Rattus norvegicus
atctgaactctgcagtactggccat

SEQ ID NO: 185334 - DNA, 25 bp, Rattus norvegicus
atctgaactctggagtactggccat

SEQ ID NO: 185335 - DNA, 25 bp, Rattus norvegicus
atctgaacttgcctttcttgccaaa

SEQ ID NO: 185336 - DNA, 25 bp, Rattus norvegicus
atctgaacttgcgtttcttgccaaa

SEQ ID NO: 185337 - DNA, 25 bp, Rattus norvegicus
atctgaactttacttactgcccata

SEQ ID NO: 185338 - DNA, 25 bp, Rattus norvegicus
atctgaactttagttactgcccata

SEQ ID NO: 185339 - DNA, 25 bp, Rattus norvegicus
atctgaagaaaccaccactctgttc

SEQ ID NO: 185340 - DNA, 25 bp, Rattus norvegicus
atctgaagaaacctattttgcttcc

SEQ ID NO: 185341 - DNA, 25 bp, Rattus norvegicus
atctgaagaaacgaccactctgttc

SEQ ID NO: 185342 - DNA, 25 bp, Rattus norvegicus
atctgaagaaacgtattttgcttcc

SEQ ID NO: 185343 - DNA, 25 bp, Rattus norvegicus
atctgaagaagaatacctggtcatg

SEQ ID NO: 185344 - DNA, 25 bp, Rattus norvegicus
atctgaagaagattacctggtcatg

SEQ ID NO: 185345 - DNA, 25 bp, Rattus norvegicus
atctgaagaccaaggccaatcccac

SEQ ID NO: 185346 - DNA, 25 bp, Rattus norvegicus
atctgaagaccatggccaatcccac

SEQ ID NO: 185347 - DNA, 25 bp, Rattus norvegicus
atctgaagagacatccagccaatct

SEQ ID NO: 185348 - DNA, 25 bp, Rattus norvegicus
atctgaagagacttccagccaatct

SEQ ID NO: 185349 - DNA, 25 bp, Rattus norvegicus
atctgaagagtcatggcacagtgta

SEQ ID NO: 185350 - DNA, 25 bp, Rattus norvegicus
atctgaagagtcttggcacagtgta

SEQ ID NO: 185351 - DNA, 25 bp, Rattus norvegicus
atctgaagatgtacagcaccggctt

SEQ ID NO: 185352 - DNA, 25 bp, Rattus norvegicus
atctgaagatgttcagcaccggctt

SEQ ID NO: 185353 - DNA, 25 bp, Rattus norvegicus
atctgaagcagcaacattcacccaa

SEQ ID NO: 185354 - DNA, 25 bp, Rattus norvegicus
atctgaagcagctacattcacccaa

SEQ ID NO: 185355 - DNA, 25 bp, Rattus norvegicus
atctgaagccccacatccatgaaag

SEQ ID NO: 185356 - DNA, 25 bp, Rattus norvegicus
atctgaagcccctcatccatgaaag

SEQ ID NO: 185357 - DNA, 25 bp, Rattus norvegicus
atctgaagcctaacctactgtgtga

SEQ ID NO: 185358 - DNA, 25 bp, Rattus norvegicus
atctgaagcctatcctactgtgtga

SEQ ID NO: 185359 - DNA, 25 bp, Rattus norvegicus
atctgaagcgctctagagggctttc

SEQ ID NO: 185360 - DNA, 25 bp, Rattus norvegicus
atctgaagcgctgtagagggctttc

SEQ ID NO: 185361 - DNA, 25 bp, Rattus norvegicus
atctgaagctgcagcgctggcgtaa

SEQ ID NO: 185362 - DNA, 25 bp, Rattus norvegicus
atctgaagctgcatgacaaccctct

SEQ ID NO: 185363 - DNA, 25 bp, Rattus norvegicus
atctgaagctgctgcgctggcgtaa

SEQ ID NO: 185364 - DNA, 25 bp, Rattus norvegicus
atctgaagctgcttgacaaccctct

SEQ ID NO: 185365 - DNA, 25 bp, Rattus norvegicus
atctgaagcttaccaagccctgcaa

SEQ ID NO: 185366 - DNA, 25 bp, Rattus norvegicus
atctgaagcttagcaagccctgcaa

SEQ ID NO: 185367 - DNA, 25 bp, Rattus norvegicus
atctgaagctttacacccctttgaa

SEQ ID NO: 185368 - DNA, 25 bp, Rattus norvegicus
atctgaagcttttcacccctttgaa

SEQ ID NO: 185369 - DNA, 25 bp, Rattus norvegicus
atctgaaggagtcgtccccatgtta

SEQ ID NO: 185370 - DNA, 25 bp, Rattus norvegicus
atctgaaggagtggtccccatgtta

SEQ ID NO: 185371 - DNA, 25 bp, Rattus norvegicus
atctgaaggcttacatgtgccgttt

SEQ ID NO: 185372 - DNA, 25 bp, Rattus norvegicus
atctgaaggctttcatgtgccgttt

SEQ ID NO: 185373 - DNA, 25 bp, Rattus norvegicus
atctgaagttcacattcacccttgg

SEQ ID NO: 185374 - DNA, 25 bp, Rattus norvegicus
atctgaagttcagattcacccttgg

SEQ ID NO: 185375 - DNA, 25 bp, Rattus norvegicus
atctgaatcctaatctcggtctaag

SEQ ID NO: 185376 - DNA, 25 bp, Rattus norvegicus
atctgaatcctattctcggtctaag

SEQ ID NO: 185377 - DNA, 25 bp, Rattus norvegicus
atctgaatctctcaagcagtctggg

SEQ ID NO: 185378 - DNA, 25 bp, Rattus norvegicus
atctgaatctctgaagcagtctggg

SEQ ID NO: 185379 - DNA, 25 bp, Rattus norvegicus
atctgaatgctactcttgcctagtg

SEQ ID NO: 185380 - DNA, 25 bp, Rattus norvegicus
atctgaatgctagtcttgcctagtg

SEQ ID NO: 185381 - DNA, 25 bp, Rattus norvegicus
atctgaatgctgactctaggtgtaa

SEQ ID NO: 185382 - DNA, 25 bp, Rattus norvegicus
atctgaatgctgtctctaggtgtaa

SEQ ID NO: 185383 - DNA, 25 bp, Rattus norvegicus
atctgaattcagattccattcttcg

SEQ ID NO: 185384 - DNA, 25 bp, Rattus norvegicus
atctgaattcagtttccattcttcg

SEQ ID NO: 185385 - DNA, 25 bp, Rattus norvegicus
atctgacaaggcaccacgatgagct

SEQ ID NO: 185386 - DNA, 25 bp, Rattus norvegicus
atctgacaaggctccacgatgagct

SEQ ID NO: 185387 - DNA, 25 bp, Rattus norvegicus
atctgacaagtactccactctaaga

SEQ ID NO: 185388 - DNA, 25 bp, Rattus norvegicus
atctgacaagtagtccactctaaga

SEQ ID NO: 185389 - DNA, 25 bp, Rattus norvegicus
atctgacacagaacaccgggtctat

SEQ ID NO: 185390 - DNA, 25 bp, Rattus norvegicus
atctgacacagatcaccgggtctat

SEQ ID NO: 185391 - DNA, 25 bp, Rattus norvegicus
atctgacactgaatctgcttatccc

SEQ ID NO: 185392 - DNA, 25 bp, Rattus norvegicus
atctgacactgaccagggcttttcc

SEQ ID NO: 185393 - DNA, 25 bp, Rattus norvegicus
atctgacactgagcagggcttttcc

SEQ ID NO: 185394 - DNA, 25 bp, Rattus norvegicus
atctgacactgattctgcttatccc

SEQ ID NO: 185395 - DNA, 25 bp, Rattus norvegicus
atctgacagccactggactgaggac

SEQ ID NO: 185396 - DNA, 25 bp, Rattus norvegicus
atctgacagccagtggactgaggac

SEQ ID NO: 185397 - DNA, 25 bp, Rattus norvegicus
atctgacagctgcatgcctgatgtg

SEQ ID NO: 185398 - DNA, 25 bp, Rattus norvegicus
atctgacagctggatgcctgatgtg

SEQ ID NO: 185399 - DNA, 25 bp, Rattus norvegicus
atctgacatcagaagaggctggcgc

SEQ ID NO: 185400 - DNA, 25 bp, Rattus norvegicus
atctgacatcagtagaggctggcgc

SEQ ID NO: 185401 - DNA, 25 bp, Rattus norvegicus
atctgacatcctattagcctcttct

SEQ ID NO: 185402 - DNA, 25 bp, Rattus norvegicus
atctgacatccttttagcctcttct

SEQ ID NO: 185403 - DNA, 25 bp, Rattus norvegicus
atctgaccactacatgacaataatg

SEQ ID NO: 185404 - DNA, 25 bp, Rattus norvegicus
atctgaccactagatgacaataatg

SEQ ID NO: 185405 - DNA, 25 bp, Rattus norvegicus
atctgaccaggacccatgatgtctt

SEQ ID NO: 185406 - DNA, 25 bp, Rattus norvegicus
atctgaccaggagccatgatgtctt

SEQ ID NO: 185407 - DNA, 25 bp, Rattus norvegicus
atctgaccagtcaagctgaggtatt

SEQ ID NO: 185408 - DNA, 25 bp, Rattus norvegicus
atctgaccagtctagctgaggtatt

SEQ ID NO: 185409 - DNA, 25 bp, Rattus norvegicus
atctgaccagtgaggatcctggcca

SEQ ID NO: 185410 - DNA, 25 bp, Rattus norvegicus
atctgaccagtgtggatcctggcca

SEQ ID NO: 185411 - DNA, 25 bp, Rattus norvegicus
atctgaccatgtagagacccgggat

SEQ ID NO: 185412 - DNA, 25 bp, Rattus norvegicus
atctgaccatgttgagacccgggat

SEQ ID NO: 185413 - DNA, 25 bp, Rattus norvegicus
atctgacccctgacgttgcgacagt

SEQ ID NO: 185414 - DNA, 25 bp, Rattus norvegicus
atctgacccctgtcgttgcgacagt

SEQ ID NO: 185415 - DNA, 25 bp, Rattus norvegicus
atctgacccggaaccttcaggtcgt

SEQ ID NO: 185416 - DNA, 25 bp, Rattus norvegicus
atctgacccggatccttcaggtcgt

SEQ ID NO: 185417 - DNA, 25 bp, Rattus norvegicus
atctgaccctttaaatgtttacttg

SEQ ID NO: 185418 - DNA, 25 bp, Rattus norvegicus
atctgacccttttaatgtttacttg

SEQ ID NO: 185419 - DNA, 25 bp, Rattus norvegicus
atctgaccgtctagctcgcgcgcag

SEQ ID NO: 185420 - DNA, 25 bp, Rattus norvegicus
atctgaccgtcttgctcgcgcgcag

SEQ ID NO: 185421 - DNA, 25 bp, Rattus norvegicus
atctgacctgtcattcagaatgcaa

SEQ ID NO: 185422 - DNA, 25 bp, Rattus norvegicus
atctgacctgtctttcagaatgcaa

SEQ ID NO: 185423 - DNA, 25 bp, Rattus norvegicus
atctgacgaggtcgtgtgacagcca

SEQ ID NO: 185424 - DNA, 25 bp, Rattus norvegicus
atctgacgaggtggtgtgacagcca

SEQ ID NO: 185425 - DNA, 25 bp, Rattus norvegicus
atctgacggccaactgcttagtgtt

SEQ ID NO: 185426 - DNA, 25 bp, Rattus norvegicus
atctgacggccatctgcttagtgtt

SEQ ID NO: 185427 - DNA, 25 bp, Rattus norvegicus
atctgactaattcttttccctctac

SEQ ID NO: 185428 - DNA, 25 bp, Rattus norvegicus
atctgactaattgttttccctctac

SEQ ID NO: 185429 - DNA, 25 bp, Rattus norvegicus
atctgactacatctttccactgtgc

SEQ ID NO: 185430 - DNA, 25 bp, Rattus norvegicus
atctgactacatgtttccactgtgc

SEQ ID NO: 185431 - DNA, 25 bp, Rattus norvegicus
atctgactccgtcgtgcctacagga

SEQ ID NO: 185432 - DNA, 25 bp, Rattus norvegicus
atctgactccgtggtgcctacagga

SEQ ID NO: 185433 - DNA, 25 bp, Rattus norvegicus
atctgactcctcctagggaaaatgc

SEQ ID NO: 185434 - DNA, 25 bp, Rattus norvegicus
atctgactcctcgtagggaaaatgc

SEQ ID NO: 185435 - DNA, 25 bp, Rattus norvegicus
atctgactctgacggcaaggctgga

SEQ ID NO: 185436 - DNA, 25 bp, Rattus norvegicus
atctgactctgagggcaaggctgga

SEQ ID NO: 185437 - DNA, 25 bp, Rattus norvegicus
atctgactcttgcactaccttattt

SEQ ID NO: 185438 - DNA, 25 bp, Rattus norvegicus
atctgactcttggactaccttattt

SEQ ID NO: 185439 - DNA, 25 bp, Rattus norvegicus
atctgactgcacaatacacagcctg

SEQ ID NO: 185440 - DNA, 25 bp, Rattus norvegicus
atctgactgcactatacacagcctg

SEQ ID NO: 185441 - DNA, 25 bp, Rattus norvegicus
atctgactggttatctcttaactcc

SEQ ID NO: 185442 - DNA, 25 bp, Rattus norvegicus
atctgactggttttctcttaactcc

SEQ ID NO: 185443 - DNA, 25 bp, Rattus norvegicus
atctgacttagtctccggagccgga

SEQ ID NO: 185444 - DNA, 25 bp, Rattus norvegicus
atctgacttagtgtccggagccgga

SEQ ID NO: 185445 - DNA, 25 bp, Rattus norvegicus
atctgacttcttacccacatacata

SEQ ID NO: 185446 - DNA, 25 bp, Rattus norvegicus
atctgacttctttcccacatacata

SEQ ID NO: 185447 - DNA, 25 bp, Rattus norvegicus
atctgacttgttacttatcccgtac

SEQ ID NO: 185448 - DNA, 25 bp, Rattus norvegicus
atctgacttgtttcttatcccgtac

SEQ ID NO: 185449 - DNA, 25 bp, Rattus norvegicus
atctgactttcaagcgtgctgggaa

SEQ ID NO: 185450 - DNA, 25 bp, Rattus norvegicus
atctgactttcatgcgtgctgggaa

SEQ ID NO: 185451 - DNA, 25 bp, Rattus norvegicus
atctgactttttcatcagcctaaag

SEQ ID NO: 185452 - DNA, 25 bp, Rattus norvegicus
atctgactttttgatcagcctaaag

SEQ ID NO: 185453 - DNA, 25 bp, Rattus norvegicus
atctgagaaacccagttggtgttta

SEQ ID NO: 185454 - DNA, 25 bp, Rattus norvegicus
atctgagaaaccgagttggtgttta

SEQ ID NO: 185455 - DNA, 25 bp, Rattus norvegicus
atctgagacacaaactgggtccctt

SEQ ID NO: 185456 - DNA, 25 bp, Rattus norvegicus
atctgagacacatactgggtccctt

SEQ ID NO: 185457 - DNA, 25 bp, Rattus norvegicus
atctgagacatcagacaagcgctta

SEQ ID NO: 185458 - DNA, 25 bp, Rattus norvegicus
atctgagacatctgacaagcgctta

SEQ ID NO: 185459 - DNA, 25 bp, Rattus norvegicus
atctgagacctgattggctttggaa

SEQ ID NO: 185460 - DNA, 25 bp, Rattus norvegicus
atctgagacctgtttggctttggaa

SEQ ID NO: 185461 - DNA, 25 bp, Rattus norvegicus
atctgagactcaaagcaagtcccta

SEQ ID NO: 185462 - DNA, 25 bp, Rattus norvegicus
atctgagactcatagcaagtcccta

SEQ ID NO: 185463 - DNA, 25 bp, Rattus norvegicus
atctgagagaaaccacataagtgtg

SEQ ID NO: 185464 - DNA, 25 bp, Rattus norvegicus
atctgagagaaagcacataagtgtg

SEQ ID NO: 185465 - DNA, 25 bp, Rattus norvegicus
atctgagagccaaggagcctgagac

SEQ ID NO: 185466 - DNA, 25 bp, Rattus norvegicus
atctgagagccatggagcctgagac

SEQ ID NO: 185467 - DNA, 25 bp, Rattus norvegicus
atctgagagccgatggccccagcat

SEQ ID NO: 185468 - DNA, 25 bp, Rattus norvegicus
atctgagagccgttggccccagcat

SEQ ID NO: 185469 - DNA, 25 bp, Rattus norvegicus
atctgagaggacctgcccatagcca

SEQ ID NO: 185470 - DNA, 25 bp, Rattus norvegicus
atctgagaggacgtgcccatagcca

SEQ ID NO: 185471 - DNA, 25 bp, Rattus norvegicus
atctgagaggtgctctggcttctct

SEQ ID NO: 185472 - DNA, 25 bp, Rattus norvegicus
atctgagaggtggtctggcttctct

SEQ ID NO: 185473 - DNA, 25 bp, Rattus norvegicus
atctgagagtataataggcaccatt

SEQ ID NO: 185474 - DNA, 25 bp, Rattus norvegicus
atctgagagtattataggcaccatt

SEQ ID NO: 185475 - DNA, 25 bp, Rattus norvegicus
atctgagatcctaacatacacctat

SEQ ID NO: 185476 - DNA, 25 bp, Rattus norvegicus
atctgagatccttacatacacctat

SEQ ID NO: 185477 - DNA, 25 bp, Rattus norvegicus
atctgagcagttctctgttggcttt

SEQ ID NO: 185478 - DNA, 25 bp, Rattus norvegicus
atctgagcagttgtctgttggcttt

SEQ ID NO: 185479 - DNA, 25 bp, Rattus norvegicus
atctgagccacaagggcaggctata

SEQ ID NO: 185480 - DNA, 25 bp, Rattus norvegicus
atctgagccacatgggcaggctata

SEQ ID NO: 185481 - DNA, 25 bp, Rattus norvegicus
atctgagcctccagtgagaccctgg

SEQ ID NO: 185482 - DNA, 25 bp, Rattus norvegicus
atctgagcctccattgtgtcttgag

SEQ ID NO: 185483 - DNA, 25 bp, Rattus norvegicus
atctgagcctcctgtgagaccctgg

SEQ ID NO: 185484 - DNA, 25 bp, Rattus norvegicus
atctgagcctcctttgtgtcttgag

SEQ ID NO: 185485 - DNA, 25 bp, Rattus norvegicus
atctgagcctgacatgacacctggc

SEQ ID NO: 185486 - DNA, 25 bp, Rattus norvegicus
atctgagcctgagatgacacctggc

SEQ ID NO: 185487 - DNA, 25 bp, Rattus norvegicus
atctgagccttcaagagtacctctc

SEQ ID NO: 185488 - DNA, 25 bp, Rattus norvegicus
atctgagccttctagagtacctctc

SEQ ID NO: 185489 - DNA, 25 bp, Rattus norvegicus
atctgagcgcctcgccaagtacaat

SEQ ID NO: 185490 - DNA, 25 bp, Rattus norvegicus
atctgagcgcctggccaagtacaat

SEQ ID NO: 185491 - DNA, 25 bp, Rattus norvegicus
atctgagctcaacggcaggaggact

SEQ ID NO: 185492 - DNA, 25 bp, Rattus norvegicus
atctgagctcaagggcaggaggact

SEQ ID NO: 185493 - DNA, 25 bp, Rattus norvegicus
atctgagctctgaaactccatccag

SEQ ID NO: 185494 - DNA, 25 bp, Rattus norvegicus
atctgagctctgtaactccatccag

SEQ ID NO: 185495 - DNA, 25 bp, Rattus norvegicus
atctgaggccttcaggatgggctcc

SEQ ID NO: 185496 - DNA, 25 bp, Rattus norvegicus
atctgaggccttgaggatgggctcc

SEQ ID NO: 185497 - DNA, 25 bp, Rattus norvegicus
atctgagggaatcaccaggcccatt

SEQ ID NO: 185498 - DNA, 25 bp, Rattus norvegicus
atctgagggaatgaccaggcccatt

SEQ ID NO: 185499 - DNA, 25 bp, Rattus norvegicus
atctgagggagcaccacttggacaa

SEQ ID NO: 185500 - DNA, 25 bp, Rattus norvegicus
atctgagggagctccacttggacaa

SEQ ID NO: 185501 - DNA, 25 bp, Rattus norvegicus
atctgaggtaccctctctgagtgta

SEQ ID NO: 185502 - DNA, 25 bp, Rattus norvegicus
atctgaggtaccgtctctgagtgta

SEQ ID NO: 185503 - DNA, 25 bp, Rattus norvegicus
atctgaggtctgaagtttccttttg

SEQ ID NO: 185504 - DNA, 25 bp, Rattus norvegicus
atctgaggtctgtagtttccttttg

SEQ ID NO: 185505 - DNA, 25 bp, Rattus norvegicus
atctgaggttttccaacttgtttga

SEQ ID NO: 185506 - DNA, 25 bp, Rattus norvegicus
atctgaggttttgcaacttgtttga

SEQ ID NO: 185507 - DNA, 25 bp, Rattus norvegicus
atctgagtacaccatgggcacatcc

SEQ ID NO: 185508 - DNA, 25 bp, Rattus norvegicus
atctgagtacacgatgggcacatcc

SEQ ID NO: 185509 - DNA, 25 bp, Rattus norvegicus
atctgagtcacccattggcaattaa

SEQ ID NO: 185510 - DNA, 25 bp, Rattus norvegicus
atctgagtcaccgattggcaattaa

SEQ ID NO: 185511 - DNA, 25 bp, Rattus norvegicus
atctgagtcattcaggctgctgttc

SEQ ID NO: 185512 - DNA, 25 bp, Rattus norvegicus
atctgagtcattgaggctgctgttc

SEQ ID NO: 185513 - DNA, 25 bp, Rattus norvegicus
atctgagtctacaccatgccagaga

SEQ ID NO: 185514 - DNA, 25 bp, Rattus norvegicus
atctgagtctactccatgccagaga

SEQ ID NO: 185515 - DNA, 25 bp, Rattus norvegicus
atctgagtctgcatggaatccaccc

SEQ ID NO: 185516 - DNA, 25 bp, Rattus norvegicus
atctgagtctgcttggaatccaccc

SEQ ID NO: 185517 - DNA, 25 bp, Rattus norvegicus
atctgagtgcatctttgtgtactac

SEQ ID NO: 185518 - DNA, 25 bp, Rattus norvegicus
atctgagtgcatgtttgtgtactac

SEQ ID NO: 185519 - DNA, 25 bp, Rattus norvegicus
atctgagttccaaatgtattccgca

SEQ ID NO: 185520 - DNA, 25 bp, Rattus norvegicus
atctgagttccatatgtattccgca

SEQ ID NO: 185521 - DNA, 25 bp, Rattus norvegicus
atctgataactgattaactgcttcc

SEQ ID NO: 185522 - DNA, 25 bp, Rattus norvegicus
atctgataactgtttaactgcttcc

SEQ ID NO: 185523 - DNA, 25 bp, Rattus norvegicus
atctgatactccaggccagactcag

SEQ ID NO: 185524 - DNA, 25 bp, Rattus norvegicus
atctgatactcctggccagactcag

SEQ ID NO: 185525 - DNA, 25 bp, Rattus norvegicus
atctgatagtctacacaccattgcc

SEQ ID NO: 185526 - DNA, 25 bp, Rattus norvegicus
atctgatagtcttcacaccattgcc

SEQ ID NO: 185527 - DNA, 25 bp, Rattus norvegicus
atctgatataggacacgggctcttt

SEQ ID NO: 185528 - DNA, 25 bp, Rattus norvegicus
atctgatataggtcacgggctcttt

SEQ ID NO: 185529 - DNA, 25 bp, Rattus norvegicus
atctgatcctagctgagccgagatt

SEQ ID NO: 185530 - DNA, 25 bp, Rattus norvegicus
atctgatcctaggtgagccgagatt

SEQ ID NO: 185531 - DNA, 25 bp, Rattus norvegicus
atctgatccttaatgcttccagcaa

SEQ ID NO: 185532 - DNA, 25 bp, Rattus norvegicus
atctgatccttattgcttccagcaa

SEQ ID NO: 185533 - DNA, 25 bp, Rattus norvegicus
atctgatcgcgtataagggcactaa

SEQ ID NO: 185534 - DNA, 25 bp, Rattus norvegicus
atctgatcgcgtttaagggcactaa

SEQ ID NO: 185535 - DNA, 25 bp, Rattus norvegicus
atctgatctaagcaattcctcacta

SEQ ID NO: 185536 - DNA, 25 bp, Rattus norvegicus
atctgatctaaggaattcctcacta

SEQ ID NO: 185537 - DNA, 25 bp, Rattus norvegicus
atctgatctgcgagctacacacgag

SEQ ID NO: 185538 - DNA, 25 bp, Rattus norvegicus
atctgatctgcgtgctacacacgag

SEQ ID NO: 185539 - DNA, 25 bp, Rattus norvegicus
atctgatctggtactttccttttta

SEQ ID NO: 185540 - DNA, 25 bp, Rattus norvegicus
atctgatctggttctttccttttta

SEQ ID NO: 185541 - DNA, 25 bp, Rattus norvegicus
atctgatgaattccccaccttaaag

SEQ ID NO: 185542 - DNA, 25 bp, Rattus norvegicus
atctgatgaattgcccaccttaaag

SEQ ID NO: 185543 - DNA, 25 bp, Rattus norvegicus
atctgatgactcagtgagcacctgc

SEQ ID NO: 185544 - DNA, 25 bp, Rattus norvegicus
atctgatgactctgtgagcacctgc

SEQ ID NO: 185545 - DNA, 25 bp, Rattus norvegicus
atctgatgatgtcacctgtcctgcc

SEQ ID NO: 185546 - DNA, 25 bp, Rattus norvegicus
atctgatgatgtgacctgtcctgcc

SEQ ID NO: 185547 - DNA, 25 bp, Rattus norvegicus
atctgatgcattatgttggcttccc

SEQ ID NO: 185548 - DNA, 25 bp, Rattus norvegicus
atctgatgcattttgttggcttccc

SEQ ID NO: 185549 - DNA, 25 bp, Rattus norvegicus
atctgatgctgcaacatctcagcca

SEQ ID NO: 185550 - DNA, 25 bp, Rattus norvegicus
atctgatgctgctacatctcagcca

SEQ ID NO: 185551 - DNA, 25 bp, Rattus norvegicus
atctgatggcttaggtcaccttgat

SEQ ID NO: 185552 - DNA, 25 bp, Rattus norvegicus
atctgatggctttggtcaccttgat

SEQ ID NO: 185553 - DNA, 25 bp, Rattus norvegicus
atctgattgaatatgccgtctcctg

SEQ ID NO: 185554 - DNA, 25 bp, Rattus norvegicus
atctgattgaatttgccgtctcctg

SEQ ID NO: 185555 - DNA, 25 bp, Rattus norvegicus
atctgatttcgcactgtcctgttct

SEQ ID NO: 185556 - DNA, 25 bp, Rattus norvegicus
atctgatttcgctctgtcctgttct

SEQ ID NO: 185557 - DNA, 25 bp, Rattus norvegicus
atctgatttgctatgagaccacaca

SEQ ID NO: 185558 - DNA, 25 bp, Rattus norvegicus
atctgatttgctatgctgctcactc

SEQ ID NO: 185559 - DNA, 25 bp, Rattus norvegicus
atctgatttgctttgagaccacaca

SEQ ID NO: 185560 - DNA, 25 bp, Rattus norvegicus
atctgatttgctttgctgctcactc

SEQ ID NO: 185561 - DNA, 25 bp, Rattus norvegicus
atctgcaaaccccagcagagagctg

SEQ ID NO: 185562 - DNA, 25 bp, Rattus norvegicus
atctgcaaacccgagcagagagctg

SEQ ID NO: 185563 - DNA, 25 bp, Rattus norvegicus
atctgcaaggacactggacctctgg

SEQ ID NO: 185564 - DNA, 25 bp, Rattus norvegicus
atctgcaaggactctggacctctgg

SEQ ID NO: 185565 - DNA, 25 bp, Rattus norvegicus
atctgcaagttcacagaggtcctca

SEQ ID NO: 185566 - DNA, 25 bp, Rattus norvegicus
atctgcaagttctcagaggtcctca

SEQ ID NO: 185567 - DNA, 25 bp, Rattus norvegicus
atctgcaattttctgagctattaat

SEQ ID NO: 185568 - DNA, 25 bp, Rattus norvegicus
atctgcaattttgtgagctattaat

SEQ ID NO: 185569 - DNA, 25 bp, Rattus norvegicus
atctgcacagcaccccggaagataa

SEQ ID NO: 185570 - DNA, 25 bp, Rattus norvegicus
atctgcacagcagcccggaagataa

SEQ ID NO: 185571 - DNA, 25 bp, Rattus norvegicus
atctgcacaggcagggtccaggccc

SEQ ID NO: 185572 - DNA, 25 bp, Rattus norvegicus
atctgcacaggctgggtccaggccc

SEQ ID NO: 185573 - DNA, 25 bp, Rattus norvegicus
atctgcaccaaaccgtcgaggatgt

SEQ ID NO: 185574 - DNA, 25 bp, Rattus norvegicus
atctgcaccaaagcgtcgaggatgt

SEQ ID NO: 185575 - DNA, 25 bp, Rattus norvegicus
atctgcaccctaacactcagtgctg

SEQ ID NO: 185576 - DNA, 25 bp, Rattus norvegicus
atctgcaccctatcactcagtgctg

SEQ ID NO: 185577 - DNA, 25 bp, Rattus norvegicus
atctgcacggccacagctgtgtggt

SEQ ID NO: 185578 - DNA, 25 bp, Rattus norvegicus
atctgcacggcctcagctgtgtggt

SEQ ID NO: 185579 - DNA, 25 bp, Rattus norvegicus
atctgcacgtgacggattcctgagg

SEQ ID NO: 185580 - DNA, 25 bp, Rattus norvegicus
atctgcacgtgagggattcctgagg

SEQ ID NO: 185581 - DNA, 25 bp, Rattus norvegicus
atctgcactcatccgttcattgaag

SEQ ID NO: 185582 - DNA, 25 bp, Rattus norvegicus
atctgcactcatgcgttcattgaag

SEQ ID NO: 185583 - DNA, 25 bp, Rattus norvegicus
atctgcacttggctttttctgaggg

SEQ ID NO: 185584 - DNA, 25 bp, Rattus norvegicus
atctgcacttgggtttttctgaggg

SEQ ID NO: 185585 - DNA, 25 bp, Rattus norvegicus
atctgcactttaactctcacgtaat

SEQ ID NO: 185586 - DNA, 25 bp, Rattus norvegicus
atctgcactttatctctcacgtaat

SEQ ID NO: 185587 - DNA, 25 bp, Rattus norvegicus
atctgcactttcagtttctaagagg

SEQ ID NO: 185588 - DNA, 25 bp, Rattus norvegicus
atctgcactttctgtttctaagagg

SEQ ID NO: 185589 - DNA, 25 bp, Rattus norvegicus
atctgcagaactaggctcctgggac

SEQ ID NO: 185590 - DNA, 25 bp, Rattus norvegicus
atctgcagaacttggctcctgggac

SEQ ID NO: 185591 - DNA, 25 bp, Rattus norvegicus
atctgcagacggaatctctctacat

SEQ ID NO: 185592 - DNA, 25 bp, Rattus norvegicus
atctgcagacggtatctctctacat

SEQ ID NO: 185593 - DNA, 25 bp, Rattus norvegicus
atctgcagagcgagcatcagcatgc

SEQ ID NO: 185594 - DNA, 25 bp, Rattus norvegicus
atctgcagagcgtgcatcagcatgc

SEQ ID NO: 185595 - DNA, 25 bp, Rattus norvegicus
atctgcagaggcactagcttttctc

SEQ ID NO: 185596 - DNA, 25 bp, Rattus norvegicus
atctgcagaggctctagcttttctc

SEQ ID NO: 185597 - DNA, 25 bp, Rattus norvegicus
atctgcagatatcacccctagggta

SEQ ID NO: 185598 - DNA, 25 bp, Rattus norvegicus
atctgcagatatgacccctagggta

SEQ ID NO: 185599 - DNA, 25 bp, Rattus norvegicus
atctgcagatctacccggatggcaa

SEQ ID NO: 185600 - DNA, 25 bp, Rattus norvegicus
atctgcagatcttcccggatggcaa

SEQ ID NO: 185601 - DNA, 25 bp, Rattus norvegicus
atctgcagcacgctaaggagccctc

SEQ ID NO: 185602 - DNA, 25 bp, Rattus norvegicus
atctgcagcacggtaaggagccctc

SEQ ID NO: 185603 - DNA, 25 bp, Rattus norvegicus
atctgcaggctgctttagctctagt

SEQ ID NO: 185604 - DNA, 25 bp, Rattus norvegicus
atctgcaggctggtttagctctagt

SEQ ID NO: 185605 - DNA, 25 bp, Rattus norvegicus
atctgcagggcgatgcttaactttc

SEQ ID NO: 185606 - DNA, 25 bp, Rattus norvegicus
atctgcagggcgttgcttaactttc

SEQ ID NO: 185607 - DNA, 25 bp, Rattus norvegicus
atctgcaggtccaggagggtgccaa

SEQ ID NO: 185608 - DNA, 25 bp, Rattus norvegicus
atctgcaggtcctggagggtgccaa

SEQ ID NO: 185609 - DNA, 25 bp, Rattus norvegicus
atctgcaggtgtcgtgactgcctgt

SEQ ID NO: 185610 - DNA, 25 bp, Rattus norvegicus
atctgcaggtgtggtgactgcctgt

SEQ ID NO: 185611 - DNA, 25 bp, Rattus norvegicus
atctgcagtggcatcttccggaatg

SEQ ID NO: 185612 - DNA, 25 bp, Rattus norvegicus
atctgcagtggcttcttccggaatg

SEQ ID NO: 185613 - DNA, 25 bp, Rattus norvegicus
atctgcagtttaatggttaggctcc

SEQ ID NO: 185614 - DNA, 25 bp, Rattus norvegicus
atctgcagtttattggttaggctcc

SEQ ID NO: 185615 - DNA, 25 bp, Rattus norvegicus
atctgcataccgacagaaggcgcct

SEQ ID NO: 185616 - DNA, 25 bp, Rattus norvegicus
atctgcataccgtcagaaggcgcct

SEQ ID NO: 185617 - DNA, 25 bp, Rattus norvegicus
atctgcatactcatttcttttcttc

SEQ ID NO: 185618 - DNA, 25 bp, Rattus norvegicus
atctgcatactcttttcttttcttc

SEQ ID NO: 185619 - DNA, 25 bp, Rattus norvegicus
atctgcatcattcttgtatctcccc

SEQ ID NO: 185620 - DNA, 25 bp, Rattus norvegicus
atctgcatcattgttgtatctcccc

SEQ ID NO: 185621 - DNA, 25 bp, Rattus norvegicus
atctgcatcctgaacctttgtgcca

SEQ ID NO: 185622 - DNA, 25 bp, Rattus norvegicus
atctgcatcctgtacctttgtgcca

SEQ ID NO: 185623 - DNA, 25 bp, Rattus norvegicus
atctgcatcgcacgccatgaaacaa

SEQ ID NO: 185624 - DNA, 25 bp, Rattus norvegicus
atctgcatcgcaggccatgaaacaa

SEQ ID NO: 185625 - DNA, 25 bp, Rattus norvegicus
atctgcatcggcaccaagtttgagt

SEQ ID NO: 185626 - DNA, 25 bp, Rattus norvegicus
atctgcatcggctccaagtttgagt

SEQ ID NO: 185627 - DNA, 25 bp, Rattus norvegicus
atctgcatctggaggaactccttat

SEQ ID NO: 185628 - DNA, 25 bp, Rattus norvegicus
atctgcatctggtggaactccttat

SEQ ID NO: 185629 - DNA, 25 bp, Rattus norvegicus
atctgcatcttcagctgtgactatg

SEQ ID NO: 185630 - DNA, 25 bp, Rattus norvegicus
atctgcatcttctgctgtgactatg

SEQ ID NO: 185631 - DNA, 25 bp, Rattus norvegicus
atctgcatgaccagtgccatttgta

SEQ ID NO: 185632 - DNA, 25 bp, Rattus norvegicus
atctgcatgacctgtgccatttgta

SEQ ID NO: 185633 - DNA, 25 bp, Rattus norvegicus
atctgcatgcgaaacttcagccgaa

SEQ ID NO: 185634 - DNA, 25 bp, Rattus norvegicus
atctgcatgcgatacttcagccgaa

SEQ ID NO: 185635 - DNA, 25 bp, Rattus norvegicus
atctgcatgtacatcacgttttcta

SEQ ID NO: 185636 - DNA, 25 bp, Rattus norvegicus
atctgcatgtacttcacgttttcta

SEQ ID NO: 185637 - DNA, 25 bp, Rattus norvegicus
atctgcatgtgcctgtgcatagctg

SEQ ID NO: 185638 - DNA, 25 bp, Rattus norvegicus
atctgcatgtgcgtgtgcatagctg

SEQ ID NO: 185639 - DNA, 25 bp, Rattus norvegicus
atctgcattaccaaaagcactcatg

SEQ ID NO: 185640 - DNA, 25 bp, Rattus norvegicus
atctgcattacctaaagcactcatg

SEQ ID NO: 185641 - DNA, 25 bp, Rattus norvegicus
atctgcattcctcggtgacaggtac

SEQ ID NO: 185642 - DNA, 25 bp, Rattus norvegicus
atctgcattcctgggtgacaggtac

SEQ ID NO: 185643 - DNA, 25 bp, Rattus norvegicus
atctgcattctacgtcctggtttat

SEQ ID NO: 185644 - DNA, 25 bp, Rattus norvegicus
atctgcattctaggtcctggtttat

SEQ ID NO: 185645 - DNA, 25 bp, Rattus norvegicus
atctgcattctgaatcatgtcagta

SEQ ID NO: 185646 - DNA, 25 bp, Rattus norvegicus
atctgcattctgtatcatgtcagta

SEQ ID NO: 185647 - DNA, 25 bp, Rattus norvegicus
atctgcatttcaatacctgggttct

SEQ ID NO: 185648 - DNA, 25 bp, Rattus norvegicus
atctgcatttcattacctgggttct

SEQ ID NO: 185649 - DNA, 25 bp, Rattus norvegicus
atctgcatttgtcaaactcggcctg

SEQ ID NO: 185650 - DNA, 25 bp, Rattus norvegicus
atctgcatttgtgaaactcggcctg

SEQ ID NO: 185651 - DNA, 25 bp, Rattus norvegicus
atctgcattttaatttaggtggaag

SEQ ID NO: 185652 - DNA, 25 bp, Rattus norvegicus
atctgcattttattttaggtggaag

SEQ ID NO: 185653 - DNA, 25 bp, Rattus norvegicus
atctgccaagtcattctggccattt

SEQ ID NO: 185654 - DNA, 25 bp, Rattus norvegicus
atctgccaagtctttctggccattt

SEQ ID NO: 185655 - DNA, 25 bp, Rattus norvegicus
atctgccaatggattgtgtctgttg

SEQ ID NO: 185656 - DNA, 25 bp, Rattus norvegicus
atctgccaatggtttgtgtctgttg

SEQ ID NO: 185657 - DNA, 25 bp, Rattus norvegicus
atctgccacagaccaacccaggtta

SEQ ID NO: 185658 - DNA, 25 bp, Rattus norvegicus
atctgccacagagcaacccaggtta

SEQ ID NO: 185659 - DNA, 25 bp, Rattus norvegicus
atctgccacagtacgaggtatgcat

SEQ ID NO: 185660 - DNA, 25 bp, Rattus norvegicus
atctgccacagttcgaggtatgcat

SEQ ID NO: 185661 - DNA, 25 bp, Rattus norvegicus
atctgccaccacattccatatgtgt

SEQ ID NO: 185662 - DNA, 25 bp, Rattus norvegicus
atctgccaccactttccatatgtgt

SEQ ID NO: 185663 - DNA, 25 bp, Rattus norvegicus
atctgccacctaattgaggtccaag

SEQ ID NO: 185664 - DNA, 25 bp, Rattus norvegicus
atctgccacctatttgaggtccaag

SEQ ID NO: 185665 - DNA, 25 bp, Rattus norvegicus
atctgccagttaatcttctgggcac

SEQ ID NO: 185666 - DNA, 25 bp, Rattus norvegicus
atctgccagttattcttctgggcac

SEQ ID NO: 185667 - DNA, 25 bp, Rattus norvegicus
atctgccagtttcccattgtgtagc

SEQ ID NO: 185668 - DNA, 25 bp, Rattus norvegicus
atctgccagtttgccattgtgtagc

SEQ ID NO: 185669 - DNA, 25 bp, Rattus norvegicus
atctgccatcgcctgtttgtgtaaa

SEQ ID NO: 185670 - DNA, 25 bp, Rattus norvegicus
atctgccatcgcgtgtttgtgtaaa

SEQ ID NO: 185671 - DNA, 25 bp, Rattus norvegicus
atctgccatcgtccgcgatgatata

SEQ ID NO: 185672 - DNA, 25 bp, Rattus norvegicus
atctgccatcgtgcgcgatgatata

SEQ ID NO: 185673 - DNA, 25 bp, Rattus norvegicus
atctgccatcttcagaatgattctg

SEQ ID NO: 185674 - DNA, 25 bp, Rattus norvegicus
atctgccatcttgagaatgattctg

SEQ ID NO: 185675 - DNA, 25 bp, Rattus norvegicus
atctgccattgactcagccttggtg

SEQ ID NO: 185676 - DNA, 25 bp, Rattus norvegicus
atctgccattgagtcagccttggtg

SEQ ID NO: 185677 - DNA, 25 bp, Rattus norvegicus
atctgcccagatcactttataattt

SEQ ID NO: 185678 - DNA, 25 bp, Rattus norvegicus
atctgcccagatgactttataattt

SEQ ID NO: 185679 - DNA, 25 bp, Rattus norvegicus
atctgccccaagattcctcaaagaa

SEQ ID NO: 185680 - DNA, 25 bp, Rattus norvegicus
atctgccccaagtttcctcaaagaa

SEQ ID NO: 185681 - DNA, 25 bp, Rattus norvegicus
atctgccccaggcttgggagctgac

SEQ ID NO: 185682 - DNA, 25 bp, Rattus norvegicus
atctgccccagggttgggagctgac

SEQ ID NO: 185683 - DNA, 25 bp, Rattus norvegicus
atctgcccctcaagtggagtcggat

SEQ ID NO: 185684 - DNA, 25 bp, Rattus norvegicus
atctgcccctcatgtggagtcggat

SEQ ID NO: 185685 - DNA, 25 bp, Rattus norvegicus
atctgcccctccagtgaaatcggta

SEQ ID NO: 185686 - DNA, 25 bp, Rattus norvegicus
atctgcccctcctgtgaaatcggta

SEQ ID NO: 185687 - DNA, 25 bp, Rattus norvegicus
atctgcccgtcactttggctagtga

SEQ ID NO: 185688 - DNA, 25 bp, Rattus norvegicus
atctgcccgtcagtttggctagtga

SEQ ID NO: 185689 - DNA, 25 bp, Rattus norvegicus
atctgccctacaagaccatgcaaag

SEQ ID NO: 185690 - DNA, 25 bp, Rattus norvegicus
atctgccctacatgaccatgcaaag

SEQ ID NO: 185691 - DNA, 25 bp, Rattus norvegicus
atctgccctcagatagatgttacaa

SEQ ID NO: 185692 - DNA, 25 bp, Rattus norvegicus
atctgccctcagttagatgttacaa

SEQ ID NO: 185693 - DNA, 25 bp, Rattus norvegicus
atctgccctcttcctatgcggatgg

SEQ ID NO: 185694 - DNA, 25 bp, Rattus norvegicus
atctgccctcttgctatgcggatgg

SEQ ID NO: 185695 - DNA, 25 bp, Rattus norvegicus
atctgccctgcgcaattattttctt

SEQ ID NO: 185696 - DNA, 25 bp, Rattus norvegicus
atctgccctgcggaattattttctt

SEQ ID NO: 185697 - DNA, 25 bp, Rattus norvegicus
atctgccgtgtaccatttcaggttc

SEQ ID NO: 185698 - DNA, 25 bp, Rattus norvegicus
atctgccgtgtagcatttcaggttc

SEQ ID NO: 185699 - DNA, 25 bp, Rattus norvegicus
atctgcctacatacacagtcatgtg

SEQ ID NO: 185700 - DNA, 25 bp, Rattus norvegicus
atctgcctacattcacagtcatgtg

SEQ ID NO: 185701 - DNA, 25 bp, Rattus norvegicus
atctgcctactgatgaattctatgt

SEQ ID NO: 185702 - DNA, 25 bp, Rattus norvegicus
atctgcctactgttgaattctatgt

SEQ ID NO: 185703 - DNA, 25 bp, Rattus norvegicus
atctgcctagcaattgtagtgccct

SEQ ID NO: 185704 - DNA, 25 bp, Rattus norvegicus
atctgcctagcatttgtagtgccct

SEQ ID NO: 185705 - DNA, 25 bp, Rattus norvegicus
atctgcctctaccttatgcatgcat

SEQ ID NO: 185706 - DNA, 25 bp, Rattus norvegicus
atctgcctctacgttatgcatgcat

SEQ ID NO: 185707 - DNA, 25 bp, Rattus norvegicus
atctgcctctgcatttggttccctt

SEQ ID NO: 185708 - DNA, 25 bp, Rattus norvegicus
atctgcctctgcttttggttccctt

SEQ ID NO: 185709 - DNA, 25 bp, Rattus norvegicus
atctgcctctgtcagccacacgata

SEQ ID NO: 185710 - DNA, 25 bp, Rattus norvegicus
atctgcctctgtgagccacacgata

SEQ ID NO: 185711 - DNA, 25 bp, Rattus norvegicus
atctgcctgatgctacacggtgaaa

SEQ ID NO: 185712 - DNA, 25 bp, Rattus norvegicus
atctgcctgatggtacacggtgaaa

SEQ ID NO: 185713 - DNA, 25 bp, Rattus norvegicus
atctgcctggagaactgggatcaaa

SEQ ID NO: 185714 - DNA, 25 bp, Rattus norvegicus
atctgcctggagtactgggatcaaa

SEQ ID NO: 185715 - DNA, 25 bp, Rattus norvegicus
atctgcctggctacggttgggagtc

SEQ ID NO: 185716 - DNA, 25 bp, Rattus norvegicus
atctgcctggcttcggttgggagtc

SEQ ID NO: 185717 - DNA, 25 bp, Rattus norvegicus
atctgcctgggtcacggccaagtgt

SEQ ID NO: 185718 - DNA, 25 bp, Rattus norvegicus
atctgcctgggtgacggccaagtgt

SEQ ID NO: 185719 - DNA, 25 bp, Rattus norvegicus
atctgcctgtccaaagctttacgga

SEQ ID NO: 185720 - DNA, 25 bp, Rattus norvegicus
atctgcctgtcctaagctttacgga

SEQ ID NO: 185721 - DNA, 25 bp, Rattus norvegicus
atctgcctgtgtcatatttacggta

SEQ ID NO: 185722 - DNA, 25 bp, Rattus norvegicus
atctgcctgtgtctgcatagcctca

SEQ ID NO: 185723 - DNA, 25 bp, Rattus norvegicus
atctgcctgtgtgatatttacggta

SEQ ID NO: 185724 - DNA, 25 bp, Rattus norvegicus
atctgcctgtgtgtgcatagcctca

SEQ ID NO: 185725 - DNA, 25 bp, Rattus norvegicus
atctgcctgttgcacttgcatctga

SEQ ID NO: 185726 - DNA, 25 bp, Rattus norvegicus
atctgcctgttggacttgcatctga

SEQ ID NO: 185727 - DNA, 25 bp, Rattus norvegicus
atctgccttactcctggatctaagg

SEQ ID NO: 185728 - DNA, 25 bp, Rattus norvegicus
atctgccttactgctggatctaagg

SEQ ID NO: 185729 - DNA, 25 bp, Rattus norvegicus
atctgccttcagaggtgggtactat

SEQ ID NO: 185730 - DNA, 25 bp, Rattus norvegicus
atctgccttcagtggtgggtactat

SEQ ID NO: 185731 - DNA, 25 bp, Rattus norvegicus
atctgccttcatacaggtacactgt

SEQ ID NO: 185732 - DNA, 25 bp, Rattus norvegicus
atctgccttcattcaggtacactgt

SEQ ID NO: 185733 - DNA, 25 bp, Rattus norvegicus
atctgccttccaagaccattctatt

SEQ ID NO: 185734 - DNA, 25 bp, Rattus norvegicus
atctgccttccatgaccattctatt

SEQ ID NO: 185735 - DNA, 25 bp, Rattus norvegicus
atctgccttccccaaggtgaagatt

SEQ ID NO: 185736 - DNA, 25 bp, Rattus norvegicus
atctgccttcccgaaggtgaagatt

SEQ ID NO: 185737 - DNA, 25 bp, Rattus norvegicus
atctgccttctacaactgccagttc

SEQ ID NO: 185738 - DNA, 25 bp, Rattus norvegicus
atctgccttctagaactgccagttc

SEQ ID NO: 185739 - DNA, 25 bp, Rattus norvegicus
atctgccttctcagtgcaaggagag

SEQ ID NO: 185740 - DNA, 25 bp, Rattus norvegicus
atctgccttctctgtgcaaggagag

SEQ ID NO: 185741 - DNA, 25 bp, Rattus norvegicus
atctgccttctgctctgagtcccag

SEQ ID NO: 185742 - DNA, 25 bp, Rattus norvegicus
atctgccttctggtctgagtcccag

SEQ ID NO: 185743 - DNA, 25 bp, Rattus norvegicus
atctgcctttgcaggtccattctgg

SEQ ID NO: 185744 - DNA, 25 bp, Rattus norvegicus
atctgcctttgcctggaaggactgt

SEQ ID NO: 185745 - DNA, 25 bp, Rattus norvegicus
atctgcctttgcgtggaaggactgt

SEQ ID NO: 185746 - DNA, 25 bp, Rattus norvegicus
atctgcctttgctggtccattctgg

SEQ ID NO: 185747 - DNA, 25 bp, Rattus norvegicus
atctgcgaaattatcctctccaggg

SEQ ID NO: 185748 - DNA, 25 bp, Rattus norvegicus
atctgcgaaattttcctctccaggg

SEQ ID NO: 185749 - DNA, 25 bp, Rattus norvegicus
atctgcgaaccgctgggaggttact

SEQ ID NO: 185750 - DNA, 25 bp, Rattus norvegicus
atctgcgaaccggtgggaggttact

SEQ ID NO: 185751 - DNA, 25 bp, Rattus norvegicus
atctgcgaccatctcagtgatgttt

SEQ ID NO: 185752 - DNA, 25 bp, Rattus norvegicus
atctgcgaccatgtcagtgatgttt

SEQ ID NO: 185753 - DNA, 25 bp, Rattus norvegicus
atctgcgcagtgaccagtctgttgg

SEQ ID NO: 185754 - DNA, 25 bp, Rattus norvegicus
atctgcgcagtgtccagtctgttgg

SEQ ID NO: 185755 - DNA, 25 bp, Rattus norvegicus
atctgcgccctaaaaccagttatgg

SEQ ID NO: 185756 - DNA, 25 bp, Rattus norvegicus
atctgcgccctataaccagttatgg

SEQ ID NO: 185757 - DNA, 25 bp, Rattus norvegicus
atctgcgccggtcatgtggaagact

SEQ ID NO: 185758 - DNA, 25 bp, Rattus norvegicus
atctgcgccggtgatgtggaagact

SEQ ID NO: 185759 - DNA, 25 bp, Rattus norvegicus
atctgcgcctcacctcaagagtgaa

SEQ ID NO: 185760 - DNA, 25 bp, Rattus norvegicus
atctgcgcctcagctcaagagtgaa

SEQ ID NO: 185761 - DNA, 25 bp, Rattus norvegicus
atctgcgccttgagtcagcgcgcgc

SEQ ID NO: 185762 - DNA, 25 bp, Rattus norvegicus
atctgcgccttgtgtcagcgcgcgc

SEQ ID NO: 185763 - DNA, 25 bp, Rattus norvegicus
atctgcgcctttcgtcgaaatactt

SEQ ID NO: 185764 - DNA, 25 bp, Rattus norvegicus
atctgcgcctttggtcgaaatactt

SEQ ID NO: 185765 - DNA, 25 bp, Rattus norvegicus
atctgcgcgcgaaggaagggcacct

SEQ ID NO: 185766 - DNA, 25 bp, Rattus norvegicus
atctgcgcgcgatggaagggcacct

SEQ ID NO: 185767 - DNA, 25 bp, Rattus norvegicus
atctgcgctgaaagaggactcccgg

SEQ ID NO: 185768 - DNA, 25 bp, Rattus norvegicus
atctgcgctgaatgaggactcccgg

SEQ ID NO: 185769 - DNA, 25 bp, Rattus norvegicus
atctgcgctgagatttctgatgcct

SEQ ID NO: 185770 - DNA, 25 bp, Rattus norvegicus
atctgcgctgagttttctgatgcct

SEQ ID NO: 185771 - DNA, 25 bp, Rattus norvegicus
atctgcgctgggaattgtatgacac

SEQ ID NO: 185772 - DNA, 25 bp, Rattus norvegicus
atctgcgctgggtattgtatgacac

SEQ ID NO: 185773 - DNA, 25 bp, Rattus norvegicus
atctgcgtagatcggaccttccaca

SEQ ID NO: 185774 - DNA, 25 bp, Rattus norvegicus
atctgcgtagatgggaccttccaca

SEQ ID NO: 185775 - DNA, 25 bp, Rattus norvegicus
atctgcgtcaccactgactataggt

SEQ ID NO: 185776 - DNA, 25 bp, Rattus norvegicus
atctgcgtcacctctgactataggt

SEQ ID NO: 185777 - DNA, 25 bp, Rattus norvegicus
atctgcgtctggacccaggacaact

SEQ ID NO: 185778 - DNA, 25 bp, Rattus norvegicus
atctgcgtctggtcccaggacaact

SEQ ID NO: 185779 - DNA, 25 bp, Rattus norvegicus
atctgcgtgaatcctcgctcctttt

SEQ ID NO: 185780 - DNA, 25 bp, Rattus norvegicus
atctgcgtgaatgctcgctcctttt

SEQ ID NO: 185781 - DNA, 25 bp, Rattus norvegicus
atctgcgtgtcgctggctgcatgca

SEQ ID NO: 185782 - DNA, 25 bp, Rattus norvegicus
atctgcgtgtcggtggctgcatgca

SEQ ID NO: 185783 - DNA, 25 bp, Rattus norvegicus
atctgcgttattacgcatctgagaa

SEQ ID NO: 185784 - DNA, 25 bp, Rattus norvegicus
atctgcgttatttcgcatctgagaa

SEQ ID NO: 185785 - DNA, 25 bp, Rattus norvegicus
atctgcgttgtgatcccctgtgttc

SEQ ID NO: 185786 - DNA, 25 bp, Rattus norvegicus
atctgcgttgtgttcccctgtgttc

SEQ ID NO: 185787 - DNA, 25 bp, Rattus norvegicus
atctgctaaaagagcccatggtctt

SEQ ID NO: 185788 - DNA, 25 bp, Rattus norvegicus
atctgctaaaagtgcccatggtctt

SEQ ID NO: 185789 - DNA, 25 bp, Rattus norvegicus
atctgctaacatcactatcatttca

SEQ ID NO: 185790 - DNA, 25 bp, Rattus norvegicus
atctgctaacatgactatcatttca

SEQ ID NO: 185791 - DNA, 25 bp, Rattus norvegicus
atctgctaagagattgccccatttc

SEQ ID NO: 185792 - DNA, 25 bp, Rattus norvegicus
atctgctaagagtttgccccatttc

SEQ ID NO: 185793 - DNA, 25 bp, Rattus norvegicus
atctgctacctgatgatcatccggg

SEQ ID NO: 185794 - DNA, 25 bp, Rattus norvegicus
atctgctacctgttgatcatccggg

SEQ ID NO: 185795 - DNA, 25 bp, Rattus norvegicus
atctgctaggcaagggaggactcct

SEQ ID NO: 185796 - DNA, 25 bp, Rattus norvegicus
atctgctaggcatgggaggactcct

SEQ ID NO: 185797 - DNA, 25 bp, Rattus norvegicus
atctgctatccgctatcttcaagaa

SEQ ID NO: 185798 - DNA, 25 bp, Rattus norvegicus
atctgctatccggtatcttcaagaa

SEQ ID NO: 185799 - DNA, 25 bp, Rattus norvegicus
atctgctatgctctctgcaacagaa

SEQ ID NO: 185800 - DNA, 25 bp, Rattus norvegicus
atctgctatgctgtctgcaacagaa

SEQ ID NO: 185801 - DNA, 25 bp, Rattus norvegicus
atctgctattccaatgacacctgag

SEQ ID NO: 185802 - DNA, 25 bp, Rattus norvegicus
atctgctattcctatgacacctgag

SEQ ID NO: 185803 - DNA, 25 bp, Rattus norvegicus
atctgctattgtacttgtctctgcc

SEQ ID NO: 185804 - DNA, 25 bp, Rattus norvegicus
atctgctattgttcttgtctctgcc

SEQ ID NO: 185805 - DNA, 25 bp, Rattus norvegicus
atctgctcaagtcctttgtgtgctc

SEQ ID NO: 185806 - DNA, 25 bp, Rattus norvegicus
atctgctcaagtgctttgtgtgctc

SEQ ID NO: 185807 - DNA, 25 bp, Rattus norvegicus
atctgctcatatccagtactttcct

SEQ ID NO: 185808 - DNA, 25 bp, Rattus norvegicus
atctgctcatatgcagtactttcct

SEQ ID NO: 185809 - DNA, 25 bp, Rattus norvegicus
atctgctccatgatcatctctatca

SEQ ID NO: 185810 - DNA, 25 bp, Rattus norvegicus
atctgctccatgttcatctctatca

SEQ ID NO: 185811 - DNA, 25 bp, Rattus norvegicus
atctgctcccaaacttggccaagag

SEQ ID NO: 185812 - DNA, 25 bp, Rattus norvegicus
atctgctcccaatcttggccaagag

SEQ ID NO: 185813 - DNA, 25 bp, Rattus norvegicus
atctgctcccatagttgctggatga

SEQ ID NO: 185814 - DNA, 25 bp, Rattus norvegicus
atctgctcccattgttgctggatga

SEQ ID NO: 185815 - DNA, 25 bp, Rattus norvegicus
atctgctcctggctggtgacctggc

SEQ ID NO: 185816 - DNA, 25 bp, Rattus norvegicus
atctgctcctgggtggtgacctggc

SEQ ID NO: 185817 - DNA, 25 bp, Rattus norvegicus
atctgctctgaccatggactcaatc

SEQ ID NO: 185818 - DNA, 25 bp, Rattus norvegicus
atctgctctgacgatggactcaatc

SEQ ID NO: 185819 - DNA, 25 bp, Rattus norvegicus
atctgctctgtcagttatttggtga

SEQ ID NO: 185820 - DNA, 25 bp, Rattus norvegicus
atctgctctgtctgttatttggtga

SEQ ID NO: 185821 - DNA, 25 bp, Rattus norvegicus
atctgctctttccagcatcaaatgc

SEQ ID NO: 185822 - DNA, 25 bp, Rattus norvegicus
atctgctctttcgagcatcaaatgc

SEQ ID NO: 185823 - DNA, 25 bp, Rattus norvegicus
atctgctgaaagctcactgctgctg

SEQ ID NO: 185824 - DNA, 25 bp, Rattus norvegicus
atctgctgaaaggtcactgctgctg

SEQ ID NO: 185825 - DNA, 25 bp, Rattus norvegicus
atctgctgactcaaacaagaccgtt

SEQ ID NO: 185826 - DNA, 25 bp, Rattus norvegicus
atctgctgactctaacaagaccgtt

SEQ ID NO: 185827 - DNA, 25 bp, Rattus norvegicus
atctgctgcagaaccgtggccatga

SEQ ID NO: 185828 - DNA, 25 bp, Rattus norvegicus
atctgctgcagaattcctccaggaa

SEQ ID NO: 185829 - DNA, 25 bp, Rattus norvegicus
atctgctgcagatccgtggccatga

SEQ ID NO: 185830 - DNA, 25 bp, Rattus norvegicus
atctgctgcagatttcctccaggaa

SEQ ID NO: 185831 - DNA, 25 bp, Rattus norvegicus
atctgctgccatattgtagcttgtt

SEQ ID NO: 185832 - DNA, 25 bp, Rattus norvegicus
atctgctgccatcacaaataaacat

SEQ ID NO: 185833 - DNA, 25 bp, Rattus norvegicus
atctgctgccatgacaaataaacat

SEQ ID NO: 185834 - DNA, 25 bp, Rattus norvegicus
atctgctgccattttgtagcttgtt

SEQ ID NO: 185835 - DNA, 25 bp, Rattus norvegicus
atctgctgccgccaggacctgaatg

SEQ ID NO: 185836 - DNA, 25 bp, Rattus norvegicus
atctgctgccgcgaggacctgaatg

SEQ ID NO: 185837 - DNA, 25 bp, Rattus norvegicus
atctgctgctctagagtgccttgat

SEQ ID NO: 185838 - DNA, 25 bp, Rattus norvegicus
atctgctgctcttgagtgccttgat

SEQ ID NO: 185839 - DNA, 25 bp, Rattus norvegicus
atctgctggaagagttgctgccgcg

SEQ ID NO: 185840 - DNA, 25 bp, Rattus norvegicus
atctgctggaagtgttgctgccgcg

SEQ ID NO: 185841 - DNA, 25 bp, Rattus norvegicus
atctgctggaccctcggcaaccgga

SEQ ID NO: 185842 - DNA, 25 bp, Rattus norvegicus
atctgctggaccgtcggcaaccgga

SEQ ID NO: 185843 - DNA, 25 bp, Rattus norvegicus
atctgctggcagatccagtccggaa

SEQ ID NO: 185844 - DNA, 25 bp, Rattus norvegicus
atctgctggcagttccagtccggaa

SEQ ID NO: 185845 - DNA, 25 bp, Rattus norvegicus
atctgctggtgtacctgtctcgtaa

SEQ ID NO: 185846 - DNA, 25 bp, Rattus norvegicus
atctgctggtgttcctgtctcgtaa

SEQ ID NO: 185847 - DNA, 25 bp, Rattus norvegicus
atctgctgtccactttgccaggatg

SEQ ID NO: 185848 - DNA, 25 bp, Rattus norvegicus
atctgctgtccagtttgccaggatg

SEQ ID NO: 185849 - DNA, 25 bp, Rattus norvegicus
atctgctgtgatatgtctgcatgca

SEQ ID NO: 185850 - DNA, 25 bp, Rattus norvegicus
atctgctgtgatttgtctgcatgca

SEQ ID NO: 185851 - DNA, 25 bp, Rattus norvegicus
atctgctgtgcgatgtgttgggcat

SEQ ID NO: 185852 - DNA, 25 bp, Rattus norvegicus
atctgctgtgcgttgtgttgggcat

SEQ ID NO: 185853 - DNA, 25 bp, Rattus norvegicus
atctgctgtggaataatcctgtgga

SEQ ID NO: 185854 - DNA, 25 bp, Rattus norvegicus
atctgctgtggattaatcctgtgga

SEQ ID NO: 185855 - DNA, 25 bp, Rattus norvegicus
atctgctgtgggagcatccctaaca

SEQ ID NO: 185856 - DNA, 25 bp, Rattus norvegicus
atctgctgtgggtgcatccctaaca

SEQ ID NO: 185857 - DNA, 25 bp, Rattus norvegicus
atctgctgtgtgcaattcctcgtgc

SEQ ID NO: 185858 - DNA, 25 bp, Rattus norvegicus
atctgctgtgtggaattcctcgtgc

SEQ ID NO: 185859 - DNA, 25 bp, Rattus norvegicus
atctgcttaaccatctcaggcaaga

SEQ ID NO: 185860 - DNA, 25 bp, Rattus norvegicus
atctgcttaaccttctcaggcaaga

SEQ ID NO: 185861 - DNA, 25 bp, Rattus norvegicus
atctgcttactgctttatgagttca

SEQ ID NO: 185862 - DNA, 25 bp, Rattus norvegicus
atctgcttactggtttatgagttca

SEQ ID NO: 185863 - DNA, 25 bp, Rattus norvegicus
atctgcttaggacgagtggtctgca

SEQ ID NO: 185864 - DNA, 25 bp, Rattus norvegicus
atctgcttaggaggagtggtctgca

SEQ ID NO: 185865 - DNA, 25 bp, Rattus norvegicus
atctgcttatctaggcatctgttaa

SEQ ID NO: 185866 - DNA, 25 bp, Rattus norvegicus
atctgcttatcttggcatctgttaa

SEQ ID NO: 185867 - DNA, 25 bp, Rattus norvegicus
atctgcttcaccatgtcctcatagg

SEQ ID NO: 185868 - DNA, 25 bp, Rattus norvegicus
atctgcttcaccttgtcctcatagg

SEQ ID NO: 185869 - DNA, 25 bp, Rattus norvegicus
atctgcttcagcagctacgcgtgtc

SEQ ID NO: 185870 - DNA, 25 bp, Rattus norvegicus
atctgcttcagctgctacgcgtgtc

SEQ ID NO: 185871 - DNA, 25 bp, Rattus norvegicus
atctgcttcaggctttagactatgg

SEQ ID NO: 185872 - DNA, 25 bp, Rattus norvegicus
atctgcttcagggtttagactatgg

SEQ ID NO: 185873 - DNA, 25 bp, Rattus norvegicus
atctgcttcagtattcccaattatt

SEQ ID NO: 185874 - DNA, 25 bp, Rattus norvegicus
atctgcttcagtcttgaatgctgta

SEQ ID NO: 185875 - DNA, 25 bp, Rattus norvegicus
atctgcttcagtgttgaatgctgta

SEQ ID NO: 185876 - DNA, 25 bp, Rattus norvegicus
atctgcttcagttttcccaattatt

SEQ ID NO: 185877 - DNA, 25 bp, Rattus norvegicus
atctgcttccttatttacaatgtaa

SEQ ID NO: 185878 - DNA, 25 bp, Rattus norvegicus
atctgcttccttttttacaatgtaa

SEQ ID NO: 185879 - DNA, 25 bp, Rattus norvegicus
atctgcttcgccatcatcaacgtgg

SEQ ID NO: 185880 - DNA, 25 bp, Rattus norvegicus
atctgcttcgccttcatcaacgtgg

SEQ ID NO: 185881 - DNA, 25 bp, Rattus norvegicus
atctgcttcgtgcatttgtttccca

SEQ ID NO: 185882 - DNA, 25 bp, Rattus norvegicus
atctgcttcgtggatttgtttccca

SEQ ID NO: 185883 - DNA, 25 bp, Rattus norvegicus
atctgcttctcaactatttctgcaa

SEQ ID NO: 185884 - DNA, 25 bp, Rattus norvegicus
atctgcttctcaactttccaaatga

SEQ ID NO: 185885 - DNA, 25 bp, Rattus norvegicus
atctgcttctcatctatttctgcaa

SEQ ID NO: 185886 - DNA, 25 bp, Rattus norvegicus
atctgcttctcatctttccaaatga

SEQ ID NO: 185887 - DNA, 25 bp, Rattus norvegicus
atctgcttctccacatgttttacaa

SEQ ID NO: 185888 - DNA, 25 bp, Rattus norvegicus
atctgcttctcctcatgttttacaa

SEQ ID NO: 185889 - DNA, 25 bp, Rattus norvegicus
atctgcttcttaactcgccaattgg

SEQ ID NO: 185890 - DNA, 25 bp, Rattus norvegicus
atctgcttcttatctcgccaattgg

SEQ ID NO: 185891 - DNA, 25 bp, Rattus norvegicus
atctgcttcttcctttcctaaaaga

SEQ ID NO: 185892 - DNA, 25 bp, Rattus norvegicus
atctgcttcttcgtttcctaaaaga

SEQ ID NO: 185893 - DNA, 25 bp, Rattus norvegicus
atctgcttgacccatgtggcatact

SEQ ID NO: 185894 - DNA, 25 bp, Rattus norvegicus
atctgcttgaccgatgtggcatact

SEQ ID NO: 185895 - DNA, 25 bp, Rattus norvegicus
atctgcttgctcagctctgcctaag

SEQ ID NO: 185896 - DNA, 25 bp, Rattus norvegicus
atctgcttgctctgctctgcctaag

SEQ ID NO: 185897 - DNA, 25 bp, Rattus norvegicus
atctgcttgcttcatcgttagtgga

SEQ ID NO: 185898 - DNA, 25 bp, Rattus norvegicus
atctgcttgcttgatcgttagtgga

SEQ ID NO: 185899 - DNA, 25 bp, Rattus norvegicus
atctgctttagcattcttgtaatta

SEQ ID NO: 185900 - DNA, 25 bp, Rattus norvegicus
atctgctttagctttcttgtaatta

SEQ ID NO: 185901 - DNA, 25 bp, Rattus norvegicus
atctgctttgcaagcgcgggctgat

SEQ ID NO: 185902 - DNA, 25 bp, Rattus norvegicus
atctgctttgcatgcgcgggctgat

SEQ ID NO: 185903 - DNA, 25 bp, Rattus norvegicus
atctgcttttacaagcgcaaggtgc

SEQ ID NO: 185904 - DNA, 25 bp, Rattus norvegicus
atctgcttttactagcgcaaggtgc

SEQ ID NO: 185905 - DNA, 25 bp, Rattus norvegicus
atctgcttttgcctatttgcctaac

SEQ ID NO: 185906 - DNA, 25 bp, Rattus norvegicus
atctgcttttgcgtatttgcctaac

SEQ ID NO: 185907 - DNA, 25 bp, Rattus norvegicus
atctggaaagacatttctagctgca

SEQ ID NO: 185908 - DNA, 25 bp, Rattus norvegicus
atctggaaagacttttctagctgca

SEQ ID NO: 185909 - DNA, 25 bp, Rattus norvegicus
atctggaacagcacaaggcaaacct

SEQ ID NO: 185910 - DNA, 25 bp, Rattus norvegicus
atctggaacagctcaaggcaaacct

SEQ ID NO: 185911 - DNA, 25 bp, Rattus norvegicus
atctggaacatcactggcgccaagg

SEQ ID NO: 185912 - DNA, 25 bp, Rattus norvegicus
atctggaacatctctggcgccaagg

SEQ ID NO: 185913 - DNA, 25 bp, Rattus norvegicus
atctggaacattcgcagcatctgtg

SEQ ID NO: 185914 - DNA, 25 bp, Rattus norvegicus
atctggaacattggcagcatctgtg

SEQ ID NO: 185915 - DNA, 25 bp, Rattus norvegicus
atctggaacgtgaggccttgtggct

SEQ ID NO: 185916 - DNA, 25 bp, Rattus norvegicus
atctggaacgtgtggccttgtggct

SEQ ID NO: 185917 - DNA, 25 bp, Rattus norvegicus
atctggaactacctgtggctgcttc

SEQ ID NO: 185918 - DNA, 25 bp, Rattus norvegicus
atctggaactacgtgtggctgcttc

SEQ ID NO: 185919 - DNA, 25 bp, Rattus norvegicus
atctggaaggagctctcactcacag

SEQ ID NO: 185920 - DNA, 25 bp, Rattus norvegicus
atctggaaggaggtctcactcacag

SEQ ID NO: 185921 - DNA, 25 bp, Rattus norvegicus
atctggaaggcgcttatgctgactg

SEQ ID NO: 185922 - DNA, 25 bp, Rattus norvegicus
atctggaaggcggttatgctgactg

SEQ ID NO: 185923 - DNA, 25 bp, Rattus norvegicus
atctggaatcgcaaactaccattga

SEQ ID NO: 185924 - DNA, 25 bp, Rattus norvegicus
atctggaatcgctaactaccattga

SEQ ID NO: 185925 - DNA, 25 bp, Rattus norvegicus
atctggaattttagtagcccctctc

SEQ ID NO: 185926 - DNA, 25 bp, Rattus norvegicus
atctggaatttttgtagcccctctc

SEQ ID NO: 185927 - DNA, 25 bp, Rattus norvegicus
atctggacaaggcatggcctctgca

SEQ ID NO: 185928 - DNA, 25 bp, Rattus norvegicus
atctggacaagggatggcctctgca

SEQ ID NO: 185929 - DNA, 25 bp, Rattus norvegicus
atctggacaattaacggcacatcaa

SEQ ID NO: 185930 - DNA, 25 bp, Rattus norvegicus
atctggacaatttacggcacatcaa

SEQ ID NO: 185931 - DNA, 25 bp, Rattus norvegicus
atctggacactgaccaactgcttca

SEQ ID NO: 185932 - DNA, 25 bp, Rattus norvegicus
atctggacactgtccaactgcttca

SEQ ID NO: 185933 - DNA, 25 bp, Rattus norvegicus
atctggacagtgacaatgaacatct

SEQ ID NO: 185934 - DNA, 25 bp, Rattus norvegicus
atctggacagtgtcaatgaacatct

SEQ ID NO: 185935 - DNA, 25 bp, Rattus norvegicus
atctggactggcagcctgattggct

SEQ ID NO: 185936 - DNA, 25 bp, Rattus norvegicus
atctggactggctgcctgattggct

SEQ ID NO: 185937 - DNA, 25 bp, Rattus norvegicus
atctggactgtgatcgaggaaccta

SEQ ID NO: 185938 - DNA, 25 bp, Rattus norvegicus
atctggactgtgttcgaggaaccta

SEQ ID NO: 185939 - DNA, 25 bp, Rattus norvegicus
atctggacttgcagaaatcctcggg

SEQ ID NO: 185940 - DNA, 25 bp, Rattus norvegicus
atctggacttgctgaaatcctcggg

SEQ ID NO: 185941 - DNA, 25 bp, Rattus norvegicus
atctggagcagcacctgagcgaggt

SEQ ID NO: 185942 - DNA, 25 bp, Rattus norvegicus
atctggagcagctcctgagcgaggt

SEQ ID NO: 185943 - DNA, 25 bp, Rattus norvegicus
atctggagcatcaagtgtggtcacc

SEQ ID NO: 185944 - DNA, 25 bp, Rattus norvegicus
atctggagcatctagtgtggtcacc

SEQ ID NO: 185945 - DNA, 25 bp, Rattus norvegicus
atctggagccagagcttcaacgcaa

SEQ ID NO: 185946 - DNA, 25 bp, Rattus norvegicus
atctggagccagtgcttcaacgcaa

SEQ ID NO: 185947 - DNA, 25 bp, Rattus norvegicus
atctggaggaccacgtcgttgggca

SEQ ID NO: 185948 - DNA, 25 bp, Rattus norvegicus
atctggaggacctcgtcgttgggca

SEQ ID NO: 185949 - DNA, 25 bp, Rattus norvegicus
atctggagtaaacagtggtgtcacc

SEQ ID NO: 185950 - DNA, 25 bp, Rattus norvegicus
atctggagtaaagagtggtgtcacc

SEQ ID NO: 185951 - DNA, 25 bp, Rattus norvegicus
atctggagtcagagtcatccaccga

SEQ ID NO: 185952 - DNA, 25 bp, Rattus norvegicus
atctggagtcagtgtcatccaccga

SEQ ID NO: 185953 - DNA, 25 bp, Rattus norvegicus
atctggagtcctactttccagacac

SEQ ID NO: 185954 - DNA, 25 bp, Rattus norvegicus
atctggagtccttctttccagacac

SEQ ID NO: 185955 - DNA, 25 bp, Rattus norvegicus
atctggagtctgaggttatgcccgt

SEQ ID NO: 185956 - DNA, 25 bp, Rattus norvegicus
atctggagtctgtggttatgcccgt

SEQ ID NO: 185957 - DNA, 25 bp, Rattus norvegicus
atctggatatggctgctttctgctt

SEQ ID NO: 185958 - DNA, 25 bp, Rattus norvegicus
atctggatatgggtgctttctgctt

SEQ ID NO: 185959 - DNA, 25 bp, Rattus norvegicus
atctggatcaaacgtacctcttctg

SEQ ID NO: 185960 - DNA, 25 bp, Rattus norvegicus
atctggatcaaaggtacctcttctg

SEQ ID NO: 185961 - DNA, 25 bp, Rattus norvegicus
atctggatctggacgcagtgcaaca

SEQ ID NO: 185962 - DNA, 25 bp, Rattus norvegicus
atctggatctggtcgcagtgcaaca

SEQ ID NO: 185963 - DNA, 25 bp, Rattus norvegicus
atctggatgagcagccttgctcact

SEQ ID NO: 185964 - DNA, 25 bp, Rattus norvegicus
atctggatgagccattttgcaccat

SEQ ID NO: 185965 - DNA, 25 bp, Rattus norvegicus
atctggatgagcgattttgcaccat

SEQ ID NO: 185966 - DNA, 25 bp, Rattus norvegicus
atctggatgagctgccttgctcact

SEQ ID NO: 185967 - DNA, 25 bp, Rattus norvegicus
atctggatgcagatacatttctatt

SEQ ID NO: 185968 - DNA, 25 bp, Rattus norvegicus
atctggatgcagttacatttctatt

SEQ ID NO: 185969 - DNA, 25 bp, Rattus norvegicus
atctggatggcgcttggctttctga

SEQ ID NO: 185970 - DNA, 25 bp, Rattus norvegicus
atctggatggcggttggctttctga

SEQ ID NO: 185971 - DNA, 25 bp, Rattus norvegicus
atctggattagcctctatgcacatg

SEQ ID NO: 185972 - DNA, 25 bp, Rattus norvegicus
atctggattagcgtctatgcacatg

SEQ ID NO: 185973 - DNA, 25 bp, Rattus norvegicus
atctggcaacgtccaccctggtgcg

SEQ ID NO: 185974 - DNA, 25 bp, Rattus norvegicus
atctggcaacgtgcaccctggtgcg

SEQ ID NO: 185975 - DNA, 25 bp, Rattus norvegicus
atctggcactacaggtgggcttcag

SEQ ID NO: 185976 - DNA, 25 bp, Rattus norvegicus
atctggcactactggtgggcttcag

SEQ ID NO: 185977 - DNA, 25 bp, Rattus norvegicus
atctggcactcacttcctctgggaa

SEQ ID NO: 185978 - DNA, 25 bp, Rattus norvegicus
atctggcactcagttcctctgggaa

SEQ ID NO: 185979 - DNA, 25 bp, Rattus norvegicus
atctggcactgcctaggaggttcat

SEQ ID NO: 185980 - DNA, 25 bp, Rattus norvegicus
atctggcactgcgtaggaggttcat

SEQ ID NO: 185981 - DNA, 25 bp, Rattus norvegicus
atctggcagaggaacgcctggaagc

SEQ ID NO: 185982 - DNA, 25 bp, Rattus norvegicus
atctggcagaggtacgcctggaagc

SEQ ID NO: 185983 - DNA, 25 bp, Rattus norvegicus
atctggcagggcatcgacatcgaga

SEQ ID NO: 185984 - DNA, 25 bp, Rattus norvegicus
atctggcagggcttcgacatcgaga

SEQ ID NO: 185985 - DNA, 25 bp, Rattus norvegicus
atctggcagtctcaggcagtgccat

SEQ ID NO: 185986 - DNA, 25 bp, Rattus norvegicus
atctggcagtctgaggcagtgccat

SEQ ID NO: 185987 - DNA, 25 bp, Rattus norvegicus
atctggcatcaacactgggagctcc

SEQ ID NO: 185988 - DNA, 25 bp, Rattus norvegicus
atctggcatcaagactgggagctcc

SEQ ID NO: 185989 - DNA, 25 bp, Rattus norvegicus
atctggccaaaaaccccaagagcgt

SEQ ID NO: 185990 - DNA, 25 bp, Rattus norvegicus
atctggccaaaatccccaagagcgt

SEQ ID NO: 185991 - DNA, 25 bp, Rattus norvegicus
atctggcccaaaccacgtgcatgag

SEQ ID NO: 185992 - DNA, 25 bp, Rattus norvegicus
atctggcccaaagcacgtgcatgag

SEQ ID NO: 185993 - DNA, 25 bp, Rattus norvegicus
atctggcccctcatgatgtcagagg

SEQ ID NO: 185994 - DNA, 25 bp, Rattus norvegicus
atctggcccctcttgatgtcagagg

SEQ ID NO: 185995 - DNA, 25 bp, Rattus norvegicus
atctggccggtcagtttcattttcc

SEQ ID NO: 185996 - DNA, 25 bp, Rattus norvegicus
atctggccggtctgtttcattttcc

SEQ ID NO: 185997 - DNA, 25 bp, Rattus norvegicus
atctggcctcatcgcaacatggata

SEQ ID NO: 185998 - DNA, 25 bp, Rattus norvegicus
atctggcctcatggcaacatggata

SEQ ID NO: 185999 - DNA, 25 bp, Rattus norvegicus
atctggcctcgtaatatagtgtata

SEQ ID NO: 186000 - DNA, 25 bp, Rattus norvegicus
atctggcctcgttatatagtgtata

SEQ ID NO: 186001 - DNA, 25 bp, Rattus norvegicus
atctggcctctcagggtgtgatggt

SEQ ID NO: 186002 - DNA, 25 bp, Rattus norvegicus
atctggcctctctgggtgtgatggt

SEQ ID NO: 186003 - DNA, 25 bp, Rattus norvegicus
atctggcctgatcctcatcacaggg

SEQ ID NO: 186004 - DNA, 25 bp, Rattus norvegicus
atctggcctgatgctcatcacaggg

SEQ ID NO: 186005 - DNA, 25 bp, Rattus norvegicus
atctggcctggcaatagtgagctcc

SEQ ID NO: 186006 - DNA, 25 bp, Rattus norvegicus
atctggcctggctatagtgagctcc

SEQ ID NO: 186007 - DNA, 25 bp, Rattus norvegicus
atctggccttttaggtcctatgaaa

SEQ ID NO: 186008 - DNA, 25 bp, Rattus norvegicus
atctggcctttttggtcctatgaaa

SEQ ID NO: 186009 - DNA, 25 bp, Rattus norvegicus
atctggctacctctaagctgcttgg

SEQ ID NO: 186010 - DNA, 25 bp, Rattus norvegicus
atctggctacctgtaagctgcttgg

SEQ ID NO: 186011 - DNA, 25 bp, Rattus norvegicus
atctggctactgacacctaaacgca

SEQ ID NO: 186012 - DNA, 25 bp, Rattus norvegicus
atctggctactgtcacctaaacgca

SEQ ID NO: 186013 - DNA, 25 bp, Rattus norvegicus
atctggctagtgagttttggttaaa

SEQ ID NO: 186014 - DNA, 25 bp, Rattus norvegicus
atctggctagtgtgttttggttaaa

SEQ ID NO: 186015 - DNA, 25 bp, Rattus norvegicus
atctggctccgtctatgcgtttgga

SEQ ID NO: 186016 - DNA, 25 bp, Rattus norvegicus
atctggctccgtgtatgcgtttgga

SEQ ID NO: 186017 - DNA, 25 bp, Rattus norvegicus
atctggctgatcatgcatccttaat

SEQ ID NO: 186018 - DNA, 25 bp, Rattus norvegicus
atctggctgatcttgcatccttaat

SEQ ID NO: 186019 - DNA, 25 bp, Rattus norvegicus
atctggctgccacgagggcttgttc

SEQ ID NO: 186020 - DNA, 25 bp, Rattus norvegicus
atctggctgccaggagggcttgttc

SEQ ID NO: 186021 - DNA, 25 bp, Rattus norvegicus
atctggctggacaagatctcttctg

SEQ ID NO: 186022 - DNA, 25 bp, Rattus norvegicus
atctggctggactagatctcttctg

SEQ ID NO: 186023 - DNA, 25 bp, Rattus norvegicus
atctggctggccctgtaatttaaat

SEQ ID NO: 186024 - DNA, 25 bp, Rattus norvegicus
atctggctggccgtgtaatttaaat

SEQ ID NO: 186025 - DNA, 25 bp, Rattus norvegicus
atctggctggctaggatctcatttt

SEQ ID NO: 186026 - DNA, 25 bp, Rattus norvegicus
atctggctggcttggatctcatttt

SEQ ID NO: 186027 - DNA, 25 bp, Rattus norvegicus
atctggcttcctaaaagcttaccca

SEQ ID NO: 186028 - DNA, 25 bp, Rattus norvegicus
atctggcttccttaaagcttaccca

SEQ ID NO: 186029 - DNA, 25 bp, Rattus norvegicus
atctggctttagcaccaaggcgata

SEQ ID NO: 186030 - DNA, 25 bp, Rattus norvegicus
atctggctttaggaccaaggcgata

SEQ ID NO: 186031 - DNA, 25 bp, Rattus norvegicus
atctggctttgtcctactttctaaa

SEQ ID NO: 186032 - DNA, 25 bp, Rattus norvegicus
atctggctttgtgctactttctaaa

SEQ ID NO: 186033 - DNA, 25 bp, Rattus norvegicus
atctgggaaactcagctgtctttgc

SEQ ID NO: 186034 - DNA, 25 bp, Rattus norvegicus
atctgggaaactgagctgtctttgc

SEQ ID NO: 186035 - DNA, 25 bp, Rattus norvegicus
atctgggaaatgctctttctcctca

SEQ ID NO: 186036 - DNA, 25 bp, Rattus norvegicus
atctgggaaatggtctttctcctca

SEQ ID NO: 186037 - DNA, 25 bp, Rattus norvegicus
atctgggacagaatttcctctgcaa

SEQ ID NO: 186038 - DNA, 25 bp, Rattus norvegicus
atctgggacagattttcctctgcaa

SEQ ID NO: 186039 - DNA, 25 bp, Rattus norvegicus
atctgggaccttaagtggagtctgt

SEQ ID NO: 186040 - DNA, 25 bp, Rattus norvegicus
atctgggacctttagtggagtctgt

SEQ ID NO: 186041 - DNA, 25 bp, Rattus norvegicus
atctgggactgacttgctgctgtgc

SEQ ID NO: 186042 - DNA, 25 bp, Rattus norvegicus
atctgggactgagttgctgctgtgc

SEQ ID NO: 186043 - DNA, 25 bp, Rattus norvegicus
atctgggactgtattctttcttttg

SEQ ID NO: 186044 - DNA, 25 bp, Rattus norvegicus
atctgggactgtcgatgggccttac

SEQ ID NO: 186045 - DNA, 25 bp, Rattus norvegicus
atctgggactgtggatgggccttac

SEQ ID NO: 186046 - DNA, 25 bp, Rattus norvegicus
atctgggactgttttctttcttttg

SEQ ID NO: 186047 - DNA, 25 bp, Rattus norvegicus
atctgggacttcaccgaacccgtat

SEQ ID NO: 186048 - DNA, 25 bp, Rattus norvegicus
atctgggacttctccgaacccgtat

SEQ ID NO: 186049 - DNA, 25 bp, Rattus norvegicus
atctgggatcgcagacatgtatttt

SEQ ID NO: 186050 - DNA, 25 bp, Rattus norvegicus
atctgggatcgctgacatgtatttt

SEQ ID NO: 186051 - DNA, 25 bp, Rattus norvegicus
atctgggatctgagttctggaggta

SEQ ID NO: 186052 - DNA, 25 bp, Rattus norvegicus
atctgggatctgtgttctggaggta

SEQ ID NO: 186053 - DNA, 25 bp, Rattus norvegicus
atctgggatgaccaagactccttta

SEQ ID NO: 186054 - DNA, 25 bp, Rattus norvegicus
atctgggatgacgaagactccttta

SEQ ID NO: 186055 - DNA, 25 bp, Rattus norvegicus
atctgggcaataatccgttcctgtc

SEQ ID NO: 186056 - DNA, 25 bp, Rattus norvegicus
atctgggcaatattccgttcctgtc

SEQ ID NO: 186057 - DNA, 25 bp, Rattus norvegicus
atctgggcagttatcctatggtgct

SEQ ID NO: 186058 - DNA, 25 bp, Rattus norvegicus
atctgggcagttttcctatggtgct

SEQ ID NO: 186059 - DNA, 25 bp, Rattus norvegicus
atctgggccagcacagttcatacta

SEQ ID NO: 186060 - DNA, 25 bp, Rattus norvegicus
atctgggccagctcagttcatacta

SEQ ID NO: 186061 - DNA, 25 bp, Rattus norvegicus
atctgggcccagagctttgaaatca

SEQ ID NO: 186062 - DNA, 25 bp, Rattus norvegicus
atctgggcccagtgctttgaaatca

SEQ ID NO: 186063 - DNA, 25 bp, Rattus norvegicus
atctgggcccatcacaccatcagaa

SEQ ID NO: 186064 - DNA, 25 bp, Rattus norvegicus
atctgggcccatgacaccatcagaa

SEQ ID NO: 186065 - DNA, 25 bp, Rattus norvegicus
atctgggccccacccgcaggagaaa

SEQ ID NO: 186066 - DNA, 25 bp, Rattus norvegicus
atctgggccccagccgcaggagaaa

SEQ ID NO: 186067 - DNA, 25 bp, Rattus norvegicus
atctgggccctgactctgatgatgg

SEQ ID NO: 186068 - DNA, 25 bp, Rattus norvegicus
atctgggccctgtctctgatgatgg

SEQ ID NO: 186069 - DNA, 25 bp, Rattus norvegicus
atctgggcccttaatttctatcttt

SEQ ID NO: 186070 - DNA, 25 bp, Rattus norvegicus
atctgggccctttatttctatcttt

SEQ ID NO: 186071 - DNA, 25 bp, Rattus norvegicus
atctgggccgaaaatgctctttcta

SEQ ID NO: 186072 - DNA, 25 bp, Rattus norvegicus
atctgggccgaatatgctctttcta

SEQ ID NO: 186073 - DNA, 25 bp, Rattus norvegicus
atctgggccgggagactgggcgccg

SEQ ID NO: 186074 - DNA, 25 bp, Rattus norvegicus
atctgggccgggtgactgggcgccg

SEQ ID NO: 186075 - DNA, 25 bp, Rattus norvegicus
atctgggcctccaaagatgagtgta

SEQ ID NO: 186076 - DNA, 25 bp, Rattus norvegicus
atctgggcctcctaagatgagtgta

SEQ ID NO: 186077 - DNA, 25 bp, Rattus norvegicus
atctgggctccgcttgtgaatgctt

SEQ ID NO: 186078 - DNA, 25 bp, Rattus norvegicus
atctgggctccggttgtgaatgctt

SEQ ID NO: 186079 - DNA, 25 bp, Rattus norvegicus
atctgggctgatatagttttctgca

SEQ ID NO: 186080 - DNA, 25 bp, Rattus norvegicus
atctgggctgatttagttttctgca

SEQ ID NO: 186081 - DNA, 25 bp, Rattus norvegicus
atctgggctgccaatctcacaggtg

SEQ ID NO: 186082 - DNA, 25 bp, Rattus norvegicus
atctgggctgcctatctcacaggtg

SEQ ID NO: 186083 - DNA, 25 bp, Rattus norvegicus
atctgggtagctaattatgttgaat

SEQ ID NO: 186084 - DNA, 25 bp, Rattus norvegicus
atctgggtagcttattatgttgaat

SEQ ID NO: 186085 - DNA, 25 bp, Rattus norvegicus
atctgggtcagtagccaagccccgg

SEQ ID NO: 186086 - DNA, 25 bp, Rattus norvegicus
atctgggtcagttgccaagccccgg

SEQ ID NO: 186087 - DNA, 25 bp, Rattus norvegicus
atctgggtccatctgccgggtactg

SEQ ID NO: 186088 - DNA, 25 bp, Rattus norvegicus
atctgggtccatgtgccgggtactg

SEQ ID NO: 186089 - DNA, 25 bp, Rattus norvegicus
atctgggtgacaactgcaggctcat

SEQ ID NO: 186090 - DNA, 25 bp, Rattus norvegicus
atctgggtgacatctgcaggctcat

SEQ ID NO: 186091 - DNA, 25 bp, Rattus norvegicus
atctgggtgaccaagatgggccaca

SEQ ID NO: 186092 - DNA, 25 bp, Rattus norvegicus
atctgggtgacctagatgggccaca

SEQ ID NO: 186093 - DNA, 25 bp, Rattus norvegicus
atctgggtgtacaggatgtggcctt

SEQ ID NO: 186094 - DNA, 25 bp, Rattus norvegicus
atctgggtgtactggatgtggcctt

SEQ ID NO: 186095 - DNA, 25 bp, Rattus norvegicus
atctgggtgtctcggtaataccatc

SEQ ID NO: 186096 - DNA, 25 bp, Rattus norvegicus
atctgggtgtctgggtaataccatc

SEQ ID NO: 186097 - DNA, 25 bp, Rattus norvegicus
atctgggttattatatggccgctac

SEQ ID NO: 186098 - DNA, 25 bp, Rattus norvegicus
atctgggttattttatggccgctac

SEQ ID NO: 186099 - DNA, 25 bp, Rattus norvegicus
atctgggttgacaggcctgggcccc

SEQ ID NO: 186100 - DNA, 25 bp, Rattus norvegicus
atctgggttgactggcctgggcccc

SEQ ID NO: 186101 - DNA, 25 bp, Rattus norvegicus
atctgggttgcacctgttactagca

SEQ ID NO: 186102 - DNA, 25 bp, Rattus norvegicus
atctgggttgcagctgttactagca

SEQ ID NO: 186103 - DNA, 25 bp, Rattus norvegicus
atctgggtttggcagctcacatcct

SEQ ID NO: 186104 - DNA, 25 bp, Rattus norvegicus
atctgggtttgggagctcacatcct

SEQ ID NO: 186105 - DNA, 25 bp, Rattus norvegicus
atctgggttttgcactactttggtg

SEQ ID NO: 186106 - DNA, 25 bp, Rattus norvegicus
atctgggttttggactactttggtg

SEQ ID NO: 186107 - DNA, 25 bp, Rattus norvegicus
atctggtaactaacactccactgtc

SEQ ID NO: 186108 - DNA, 25 bp, Rattus norvegicus
atctggtaactatcactccactgtc

SEQ ID NO: 186109 - DNA, 25 bp, Rattus norvegicus
atctggtaactgcattttctgtccc

SEQ ID NO: 186110 - DNA, 25 bp, Rattus norvegicus
atctggtaactggattttctgtccc

SEQ ID NO: 186111 - DNA, 25 bp, Rattus norvegicus
atctggtaagagacttcgccaccac

SEQ ID NO: 186112 - DNA, 25 bp, Rattus norvegicus
atctggtaagagtcttcgccaccac

SEQ ID NO: 186113 - DNA, 25 bp, Rattus norvegicus
atctggtactaactgccttgtgtct

SEQ ID NO: 186114 - DNA, 25 bp, Rattus norvegicus
atctggtactaagtgccttgtgtct

SEQ ID NO: 186115 - DNA, 25 bp, Rattus norvegicus
atctggtacttcattttcttgacta

SEQ ID NO: 186116 - DNA, 25 bp, Rattus norvegicus
atctggtacttctttttcttgacta

SEQ ID NO: 186117 - DNA, 25 bp, Rattus norvegicus
atctggtagcagactgtcttcatcc

SEQ ID NO: 186118 - DNA, 25 bp, Rattus norvegicus
atctggtagcagtctgtcttcatcc

SEQ ID NO: 186119 - DNA, 25 bp, Rattus norvegicus
atctggtaggtgctatctagatctt

SEQ ID NO: 186120 - DNA, 25 bp, Rattus norvegicus
atctggtaggtggtatctagatctt

SEQ ID NO: 186121 - DNA, 25 bp, Rattus norvegicus
atctggtagtccaggctcctgggta

SEQ ID NO: 186122 - DNA, 25 bp, Rattus norvegicus
atctggtagtcctggctcctgggta

SEQ ID NO: 186123 - DNA, 25 bp, Rattus norvegicus
atctggtcaccaaacatccgatact

SEQ ID NO: 186124 - DNA, 25 bp, Rattus norvegicus
atctggtcaccatacatccgatact

SEQ ID NO: 186125 - DNA, 25 bp, Rattus norvegicus
atctggtcatctcctcttcctttct

SEQ ID NO: 186126 - DNA, 25 bp, Rattus norvegicus
atctggtcatctgctcttcctttct

SEQ ID NO: 186127 - DNA, 25 bp, Rattus norvegicus
atctggtccagtaccaattcagtta

SEQ ID NO: 186128 - DNA, 25 bp, Rattus norvegicus
atctggtccagttccaattcagtta

SEQ ID NO: 186129 - DNA, 25 bp, Rattus norvegicus
atctggtccatgatccacttctcca

SEQ ID NO: 186130 - DNA, 25 bp, Rattus norvegicus
atctggtccatgttccacttctcca

SEQ ID NO: 186131 - DNA, 25 bp, Rattus norvegicus
atctggtcccgtctttctagtagaa

SEQ ID NO: 186132 - DNA, 25 bp, Rattus norvegicus
atctggtcccgtgtttctagtagaa

SEQ ID NO: 186133 - DNA, 25 bp, Rattus norvegicus
atctggtcgccactagaagagtcaa

SEQ ID NO: 186134 - DNA, 25 bp, Rattus norvegicus
atctggtcgccagtagaagagtcaa

SEQ ID NO: 186135 - DNA, 25 bp, Rattus norvegicus
atctggtctcataagagcttggcac

SEQ ID NO: 186136 - DNA, 25 bp, Rattus norvegicus
atctggtctcattagagcttggcac

SEQ ID NO: 186137 - DNA, 25 bp, Rattus norvegicus
atctggtcttctctgaactgtgtgg

SEQ ID NO: 186138 - DNA, 25 bp, Rattus norvegicus
atctggtcttctgtgaactgtgtgg

SEQ ID NO: 186139 - DNA, 25 bp, Rattus norvegicus
atctggtgaacgaccgcaggccaac

SEQ ID NO: 186140 - DNA, 25 bp, Rattus norvegicus
atctggtgaacgtccgcaggccaac

SEQ ID NO: 186141 - DNA, 25 bp, Rattus norvegicus
atctggtgaagcactgcatccttaa

SEQ ID NO: 186142 - DNA, 25 bp, Rattus norvegicus
atctggtgaagctctgcatccttaa

SEQ ID NO: 186143 - DNA, 25 bp, Rattus norvegicus
atctggtgaatactgaccctgccct

SEQ ID NO: 186144 - DNA, 25 bp, Rattus norvegicus
atctggtgaatagtgaccctgccct

SEQ ID NO: 186145 - DNA, 25 bp, Rattus norvegicus
atctggtgaccacgttcctaggata

SEQ ID NO: 186146 - DNA, 25 bp, Rattus norvegicus
atctggtgaccaggttcctaggata

SEQ ID NO: 186147 - DNA, 25 bp, Rattus norvegicus
atctggtgaccccactggaggaaac

SEQ ID NO: 186148 - DNA, 25 bp, Rattus norvegicus
atctggtgacccgactggaggaaac

SEQ ID NO: 186149 - DNA, 25 bp, Rattus norvegicus
atctggtgatttagaagcacgtgct

SEQ ID NO: 186150 - DNA, 25 bp, Rattus norvegicus
atctggtgattttgaagcacgtgct

SEQ ID NO: 186151 - DNA, 25 bp, Rattus norvegicus
atctggtgccacaccatatatagag

SEQ ID NO: 186152 - DNA, 25 bp, Rattus norvegicus
atctggtgccactccatatatagag

SEQ ID NO: 186153 - DNA, 25 bp, Rattus norvegicus
atctggtgcccacgacgactagtgt

SEQ ID NO: 186154 - DNA, 25 bp, Rattus norvegicus
atctggtgcccaggacgactagtgt

SEQ ID NO: 186155 - DNA, 25 bp, Rattus norvegicus
atctggtgccctattttaacatgca

SEQ ID NO: 186156 - DNA, 25 bp, Rattus norvegicus
atctggtgcccttttttaacatgca

SEQ ID NO: 186157 - DNA, 25 bp, Rattus norvegicus
atctggtgcttcctcaaattttaac

SEQ ID NO: 186158 - DNA, 25 bp, Rattus norvegicus
atctggtgcttcgtcaaattttaac

SEQ ID NO: 186159 - DNA, 25 bp, Rattus norvegicus
atctggtggcctatcttgtctatca

SEQ ID NO: 186160 - DNA, 25 bp, Rattus norvegicus
atctggtggcctttcttgtctatca

SEQ ID NO: 186161 - DNA, 25 bp, Rattus norvegicus
atctggtggctcaactaggtgggac

SEQ ID NO: 186162 - DNA, 25 bp, Rattus norvegicus
atctggtggctctactaggtgggac

SEQ ID NO: 186163 - DNA, 25 bp, Rattus norvegicus
atctggtgggctccggttttctgct

SEQ ID NO: 186164 - DNA, 25 bp, Rattus norvegicus
atctggtgggctgcggttttctgct

SEQ ID NO: 186165 - DNA, 25 bp, Rattus norvegicus
atctggttcaaactgcctgtcttgt

SEQ ID NO: 186166 - DNA, 25 bp, Rattus norvegicus
atctggttcaaagtgcctgtcttgt

SEQ ID NO: 186167 - DNA, 25 bp, Rattus norvegicus
atctggttcgatctctgtgaggttt

SEQ ID NO: 186168 - DNA, 25 bp, Rattus norvegicus
atctggttcgatgtctgtgaggttt

SEQ ID NO: 186169 - DNA, 25 bp, Rattus norvegicus
atctggttctagagtcaactacccc

SEQ ID NO: 186170 - DNA, 25 bp, Rattus norvegicus
atctggttctagtgtcaactacccc

SEQ ID NO: 186171 - DNA, 25 bp, Rattus norvegicus
atctggttcttacttcagggccatc

SEQ ID NO: 186172 - DNA, 25 bp, Rattus norvegicus
atctggttcttagttcagggccatc

SEQ ID NO: 186173 - DNA, 25 bp, Rattus norvegicus
atctggttgaatacaaagaccttgg

SEQ ID NO: 186174 - DNA, 25 bp, Rattus norvegicus
atctggttgaattcaaagaccttgg

SEQ ID NO: 186175 - DNA, 25 bp, Rattus norvegicus
atctggttggtcactgtgccttacg

SEQ ID NO: 186176 - DNA, 25 bp, Rattus norvegicus
atctggttggtctctgtgccttacg

SEQ ID NO: 186177 - DNA, 25 bp, Rattus norvegicus
atctggtttgtgaaggagttcctgt

SEQ ID NO: 186178 - DNA, 25 bp, Rattus norvegicus
atctggtttgtgtaggagttcctgt

SEQ ID NO: 186179 - DNA, 25 bp, Rattus norvegicus
atctggttttctcgtttcgctggtc

SEQ ID NO: 186180 - DNA, 25 bp, Rattus norvegicus
atctggttttctggtttcgctggtc

SEQ ID NO: 186181 - DNA, 25 bp, Rattus norvegicus
atctgtaaacaaactctgtgtcccg

SEQ ID NO: 186182 - DNA, 25 bp, Rattus norvegicus
atctgtaaacaatctctgtgtcccg

SEQ ID NO: 186183 - DNA, 25 bp, Rattus norvegicus
atctgtaaactaatgcatggtcatt

SEQ ID NO: 186184 - DNA, 25 bp, Rattus norvegicus
atctgtaaactattgcatggtcatt

SEQ ID NO: 186185 - DNA, 25 bp, Rattus norvegicus
atctgtaaatggatgcgtcctggca

SEQ ID NO: 186186 - DNA, 25 bp, Rattus norvegicus
atctgtaaatggttgcgtcctggca

SEQ ID NO: 186187 - DNA, 25 bp, Rattus norvegicus
atctgtaactttctccttaaccatc

SEQ ID NO: 186188 - DNA, 25 bp, Rattus norvegicus
atctgtaactttgtccttaaccatc

SEQ ID NO: 186189 - DNA, 25 bp, Rattus norvegicus
atctgtaagcaaactgggaatgtgt

SEQ ID NO: 186190 - DNA, 25 bp, Rattus norvegicus
atctgtaagcaatctgggaatgtgt

SEQ ID NO: 186191 - DNA, 25 bp, Rattus norvegicus
atctgtaatcccaacctgtgggagg

SEQ ID NO: 186192 - DNA, 25 bp, Rattus norvegicus
atctgtaatccctacctgtgggagg

SEQ ID NO: 186193 - DNA, 25 bp, Rattus norvegicus
atctgtaatctcagggaagtgggag

SEQ ID NO: 186194 - DNA, 25 bp, Rattus norvegicus
atctgtaatctctgggaagtgggag

SEQ ID NO: 186195 - DNA, 25 bp, Rattus norvegicus
atctgtaatctgagaactttctgaa

SEQ ID NO: 186196 - DNA, 25 bp, Rattus norvegicus
atctgtaatctgtgaactttctgaa

SEQ ID NO: 186197 - DNA, 25 bp, Rattus norvegicus
atctgtaattcacgttttcctcttt

SEQ ID NO: 186198 - DNA, 25 bp, Rattus norvegicus
atctgtaattcaggttttcctcttt

SEQ ID NO: 186199 - DNA, 25 bp, Rattus norvegicus
atctgtaatttcagttctgcccacc

SEQ ID NO: 186200 - DNA, 25 bp, Rattus norvegicus
atctgtaatttctgttctgcccacc

SEQ ID NO: 186201 - DNA, 25 bp, Rattus norvegicus
atctgtacagttaatattgttccag

SEQ ID NO: 186202 - DNA, 25 bp, Rattus norvegicus
atctgtacagtttatattgttccag

SEQ ID NO: 186203 - DNA, 25 bp, Rattus norvegicus
atctgtaccatgataggctgtagca

SEQ ID NO: 186204 - DNA, 25 bp, Rattus norvegicus
atctgtaccatgttaggctgtagca

SEQ ID NO: 186205 - DNA, 25 bp, Rattus norvegicus
atctgtacccttactttgcacactt

SEQ ID NO: 186206 - DNA, 25 bp, Rattus norvegicus
atctgtaccctttctttgcacactt

SEQ ID NO: 186207 - DNA, 25 bp, Rattus norvegicus
atctgtactactcctccaaatggcg

SEQ ID NO: 186208 - DNA, 25 bp, Rattus norvegicus
atctgtactactgctccaaatggcg

SEQ ID NO: 186209 - DNA, 25 bp, Rattus norvegicus
atctgtactatcagtactgcctctg

SEQ ID NO: 186210 - DNA, 25 bp, Rattus norvegicus
atctgtactatctgtactgcctctg

SEQ ID NO: 186211 - DNA, 25 bp, Rattus norvegicus
atctgtactcaaatcctgctgactt

SEQ ID NO: 186212 - DNA, 25 bp, Rattus norvegicus
atctgtactcaattcctgctgactt

SEQ ID NO: 186213 - DNA, 25 bp, Rattus norvegicus
atctgtactcagaaccagccagtgg

SEQ ID NO: 186214 - DNA, 25 bp, Rattus norvegicus
atctgtactcagtaccagccagtgg

SEQ ID NO: 186215 - DNA, 25 bp, Rattus norvegicus
atctgtactcctctcacaacctatg

SEQ ID NO: 186216 - DNA, 25 bp, Rattus norvegicus
atctgtactcctgtcacaacctatg

SEQ ID NO: 186217 - DNA, 25 bp, Rattus norvegicus
atctgtactgatcttattcactcgg

SEQ ID NO: 186218 - DNA, 25 bp, Rattus norvegicus
atctgtactgatgttattcactcgg

SEQ ID NO: 186219 - DNA, 25 bp, Rattus norvegicus
atctgtagactaagctcctgtttca

SEQ ID NO: 186220 - DNA, 25 bp, Rattus norvegicus
atctgtagactatgctcctgtttca

SEQ ID NO: 186221 - DNA, 25 bp, Rattus norvegicus
atctgtagattcagacgggatgtca

SEQ ID NO: 186222 - DNA, 25 bp, Rattus norvegicus
atctgtagattctgacgggatgtca

SEQ ID NO: 186223 - DNA, 25 bp, Rattus norvegicus
atctgtagcccgctaagtccagaga

SEQ ID NO: 186224 - DNA, 25 bp, Rattus norvegicus
atctgtagcccggtaagtccagaga

SEQ ID NO: 186225 - DNA, 25 bp, Rattus norvegicus
atctgtaggagcacttgtgggtcca

SEQ ID NO: 186226 - DNA, 25 bp, Rattus norvegicus
atctgtaggagctcttgtgggtcca

SEQ ID NO: 186227 - DNA, 25 bp, Rattus norvegicus
atctgtagggatacgtacacccgct

SEQ ID NO: 186228 - DNA, 25 bp, Rattus norvegicus
atctgtagggattcgtacacccgct

SEQ ID NO: 186229 - DNA, 25 bp, Rattus norvegicus
atctgtagtctaaagaatttccaaa

SEQ ID NO: 186230 - DNA, 25 bp, Rattus norvegicus
atctgtagtctatagaatttccaaa

SEQ ID NO: 186231 - DNA, 25 bp, Rattus norvegicus
atctgtagtgctatcctaagccgaa

SEQ ID NO: 186232 - DNA, 25 bp, Rattus norvegicus
atctgtagtgctttcctaagccgaa

SEQ ID NO: 186233 - DNA, 25 bp, Rattus norvegicus
atctgtagttcaagtgtagtttcaa

SEQ ID NO: 186234 - DNA, 25 bp, Rattus norvegicus
atctgtagttcatgtgtagtttcaa

SEQ ID NO: 186235 - DNA, 25 bp, Rattus norvegicus
atctgtataattacattaatctcaa

SEQ ID NO: 186236 - DNA, 25 bp, Rattus norvegicus
atctgtataatttcattaatctcaa

SEQ ID NO: 186237 - DNA, 25 bp, Rattus norvegicus
atctgtatatggagcctcagctcca

SEQ ID NO: 186238 - DNA, 25 bp, Rattus norvegicus
atctgtatatggtgcctcagctcca

SEQ ID NO: 186239 - DNA, 25 bp, Rattus norvegicus
atctgtatatgtcactcccttgggt

SEQ ID NO: 186240 - DNA, 25 bp, Rattus norvegicus
atctgtatatgtgactcccttgggt

SEQ ID NO: 186241 - DNA, 25 bp, Rattus norvegicus
atctgtatcggtaatttctagcaag

SEQ ID NO: 186242 - DNA, 25 bp, Rattus norvegicus
atctgtatcggttatttctagcaag

SEQ ID NO: 186243 - DNA, 25 bp, Rattus norvegicus
atctgtatctctaccctttgggtat

SEQ ID NO: 186244 - DNA, 25 bp, Rattus norvegicus
atctgtatctctatgccttgtgctc

SEQ ID NO: 186245 - DNA, 25 bp, Rattus norvegicus
atctgtatctcttccctttgggtat

SEQ ID NO: 186246 - DNA, 25 bp, Rattus norvegicus
atctgtatctctttgccttgtgctc

SEQ ID NO: 186247 - DNA, 25 bp, Rattus norvegicus
atctgtatctttcctgtgtctttta

SEQ ID NO: 186248 - DNA, 25 bp, Rattus norvegicus
atctgtatctttgctgtgtctttta

SEQ ID NO: 186249 - DNA, 25 bp, Rattus norvegicus
atctgtatgaccaaggccatgctag

SEQ ID NO: 186250 - DNA, 25 bp, Rattus norvegicus
atctgtatgacctaggccatgctag

SEQ ID NO: 186251 - DNA, 25 bp, Rattus norvegicus
atctgtatgtctctcaagtggtcca

SEQ ID NO: 186252 - DNA, 25 bp, Rattus norvegicus
atctgtatgtctgtcaagtggtcca

SEQ ID NO: 186253 - DNA, 25 bp, Rattus norvegicus
atctgtatgtgtatctcctgctata

SEQ ID NO: 186254 - DNA, 25 bp, Rattus norvegicus
atctgtatgtgtcaaatgcgtgcgc

SEQ ID NO: 186255 - DNA, 25 bp, Rattus norvegicus
atctgtatgtgtgaaatgcgtgcgc

SEQ ID NO: 186256 - DNA, 25 bp, Rattus norvegicus
atctgtatgtgtttctcctgctata

SEQ ID NO: 186257 - DNA, 25 bp, Rattus norvegicus
atctgtattactacacacctccatg

SEQ ID NO: 186258 - DNA, 25 bp, Rattus norvegicus
atctgtattacttcacacctccatg

SEQ ID NO: 186259 - DNA, 25 bp, Rattus norvegicus
atctgtattataagctagtttcaag

SEQ ID NO: 186260 - DNA, 25 bp, Rattus norvegicus
atctgtattatatgctagtttcaag

SEQ ID NO: 186261 - DNA, 25 bp, Rattus norvegicus
atctgtattctcaagtaatgggtta

SEQ ID NO: 186262 - DNA, 25 bp, Rattus norvegicus
atctgtattctctagtaatgggtta

SEQ ID NO: 186263 - DNA, 25 bp, Rattus norvegicus
atctgtattgtaaggagctgttctc

SEQ ID NO: 186264 - DNA, 25 bp, Rattus norvegicus
atctgtattgtatggagctgttctc

SEQ ID NO: 186265 - DNA, 25 bp, Rattus norvegicus
atctgtattttaacaagaccccata

SEQ ID NO: 186266 - DNA, 25 bp, Rattus norvegicus
atctgtattttatcaagaccccata

SEQ ID NO: 186267 - DNA, 25 bp, Rattus norvegicus
atctgtcaaaggatccgatgccctc

SEQ ID NO: 186268 - DNA, 25 bp, Rattus norvegicus
atctgtcaaaggttccgatgccctc

SEQ ID NO: 186269 - DNA, 25 bp, Rattus norvegicus
atctgtcacagtagtgtgctgtcat

SEQ ID NO: 186270 - DNA, 25 bp, Rattus norvegicus
atctgtcacagttgtgtgctgtcat

SEQ ID NO: 186271 - DNA, 25 bp, Rattus norvegicus
atctgtcacctaccctagccaggta

SEQ ID NO: 186272 - DNA, 25 bp, Rattus norvegicus
atctgtcacctagcctagccaggta

SEQ ID NO: 186273 - DNA, 25 bp, Rattus norvegicus
atctgtcacgtacattgcactctga

SEQ ID NO: 186274 - DNA, 25 bp, Rattus norvegicus
atctgtcacgtagattgcactctga

SEQ ID NO: 186275 - DNA, 25 bp, Rattus norvegicus
atctgtcactgacccgaggtgatgt

SEQ ID NO: 186276 - DNA, 25 bp, Rattus norvegicus
atctgtcactgagccgaggtgatgt

SEQ ID NO: 186277 - DNA, 25 bp, Rattus norvegicus
atctgtcagacaaccagagcgtgtt

SEQ ID NO: 186278 - DNA, 25 bp, Rattus norvegicus
atctgtcagacatccagagcgtgtt

SEQ ID NO: 186279 - DNA, 25 bp, Rattus norvegicus
atctgtcagctcaactacctgggag

SEQ ID NO: 186280 - DNA, 25 bp, Rattus norvegicus
atctgtcagctctactacctgggag

SEQ ID NO: 186281 - DNA, 25 bp, Rattus norvegicus
atctgtcaggttcagtagcttccac

SEQ ID NO: 186282 - DNA, 25 bp, Rattus norvegicus
atctgtcaggttgagtagcttccac

SEQ ID NO: 186283 - DNA, 25 bp, Rattus norvegicus
atctgtcagtcactctctggaccag

SEQ ID NO: 186284 - DNA, 25 bp, Rattus norvegicus
atctgtcagtcagtctctggaccag

SEQ ID NO: 186285 - DNA, 25 bp, Rattus norvegicus
atctgtcatccaccttgtactagaa

SEQ ID NO: 186286 - DNA, 25 bp, Rattus norvegicus
atctgtcatccagcttgtactagaa

SEQ ID NO: 186287 - DNA, 25 bp, Rattus norvegicus
atctgtcatcttaggtggacggcca

SEQ ID NO: 186288 - DNA, 25 bp, Rattus norvegicus
atctgtcatcttcggagccagcgca

SEQ ID NO: 186289 - DNA, 25 bp, Rattus norvegicus
atctgtcatcttgggagccagcgca

SEQ ID NO: 186290 - DNA, 25 bp, Rattus norvegicus
atctgtcatctttggtggacggcca

SEQ ID NO: 186291 - DNA, 25 bp, Rattus norvegicus
atctgtccatcaaaagagcccactg

SEQ ID NO: 186292 - DNA, 25 bp, Rattus norvegicus
atctgtccatcataagagcccactg

SEQ ID NO: 186293 - DNA, 25 bp, Rattus norvegicus
atctgtccatctcctgggcggagca

SEQ ID NO: 186294 - DNA, 25 bp, Rattus norvegicus
atctgtccatctgctgggcggagca

SEQ ID NO: 186295 - DNA, 25 bp, Rattus norvegicus
atctgtcccagaccagtggcattag

SEQ ID NO: 186296 - DNA, 25 bp, Rattus norvegicus
atctgtcccagagcagtggcattag

SEQ ID NO: 186297 - DNA, 25 bp, Rattus norvegicus
atctgtccccgccaatagaaattaa

SEQ ID NO: 186298 - DNA, 25 bp, Rattus norvegicus
atctgtccccgcgaatagaaattaa

SEQ ID NO: 186299 - DNA, 25 bp, Rattus norvegicus
atctgtccccttagctgtgaggaat

SEQ ID NO: 186300 - DNA, 25 bp, Rattus norvegicus
atctgtcccctttgctgtgaggaat

SEQ ID NO: 186301 - DNA, 25 bp, Rattus norvegicus
atctgtcccgagatgggtttggcat

SEQ ID NO: 186302 - DNA, 25 bp, Rattus norvegicus
atctgtcccgagttgggtttggcat

SEQ ID NO: 186303 - DNA, 25 bp, Rattus norvegicus
atctgtcccgttcgctaaatagctg

SEQ ID NO: 186304 - DNA, 25 bp, Rattus norvegicus
atctgtcccgttggctaaatagctg

SEQ ID NO: 186305 - DNA, 25 bp, Rattus norvegicus
atctgtccctcacctgagtggtggg

SEQ ID NO: 186306 - DNA, 25 bp, Rattus norvegicus
atctgtccctcagctgagtggtggg

SEQ ID NO: 186307 - DNA, 25 bp, Rattus norvegicus
atctgtcccttcctgtgtagaagac

SEQ ID NO: 186308 - DNA, 25 bp, Rattus norvegicus
atctgtcccttcgtgtgtagaagac

SEQ ID NO: 186309 - DNA, 25 bp, Rattus norvegicus
atctgtccggacattggtcacttca

SEQ ID NO: 186310 - DNA, 25 bp, Rattus norvegicus
atctgtccggactttggtcacttca

SEQ ID NO: 186311 - DNA, 25 bp, Rattus norvegicus
atctgtcctatgatcaagctgtgcc

SEQ ID NO: 186312 - DNA, 25 bp, Rattus norvegicus
atctgtcctatgttcaagctgtgcc

SEQ ID NO: 186313 - DNA, 25 bp, Rattus norvegicus
atctgtccttatcaccactctgttt

SEQ ID NO: 186314 - DNA, 25 bp, Rattus norvegicus
atctgtccttatgaccactctgttt

SEQ ID NO: 186315 - DNA, 25 bp, Rattus norvegicus
atctgtcctttcactcatgggtcag

SEQ ID NO: 186316 - DNA, 25 bp, Rattus norvegicus
atctgtcctttctctcatgggtcag

SEQ ID NO: 186317 - DNA, 25 bp, Rattus norvegicus
atctgtcctttgaggatcttaaggc

SEQ ID NO: 186318 - DNA, 25 bp, Rattus norvegicus
atctgtcctttgtggatcttaaggc

SEQ ID NO: 186319 - DNA, 25 bp, Rattus norvegicus
atctgtcgaatactgtgtctctgtg

SEQ ID NO: 186320 - DNA, 25 bp, Rattus norvegicus
atctgtcgaatagtgtgtctctgtg

SEQ ID NO: 186321 - DNA, 25 bp, Rattus norvegicus
atctgtcgagtgaaaccgctgtctg

SEQ ID NO: 186322 - DNA, 25 bp, Rattus norvegicus
atctgtcgagtgtaaccgctgtctg

SEQ ID NO: 186323 - DNA, 25 bp, Rattus norvegicus
atctgtcgcttgcatcttctggaaa

SEQ ID NO: 186324 - DNA, 25 bp, Rattus norvegicus
atctgtcgcttggatcttctggaaa

SEQ ID NO: 186325 - DNA, 25 bp, Rattus norvegicus
atctgtcggaatcatgggcggttcc

SEQ ID NO: 186326 - DNA, 25 bp, Rattus norvegicus
atctgtcggaatgatgggcggttcc

SEQ ID NO: 186327 - DNA, 25 bp, Rattus norvegicus
atctgtcggtgtctctactttataa

SEQ ID NO: 186328 - DNA, 25 bp, Rattus norvegicus
atctgtcggtgtgtctactttataa

SEQ ID NO: 186329 - DNA, 25 bp, Rattus norvegicus
atctgtctacagctttctccttgaa

SEQ ID NO: 186330 - DNA, 25 bp, Rattus norvegicus
atctgtctacaggtttctccttgaa

SEQ ID NO: 186331 - DNA, 25 bp, Rattus norvegicus
atctgtctcaaaacttcctggtcaa

SEQ ID NO: 186332 - DNA, 25 bp, Rattus norvegicus
atctgtctcaaatcttcctggtcaa

SEQ ID NO: 186333 - DNA, 25 bp, Rattus norvegicus
atctgtctcagtcagcggcagtcaa

SEQ ID NO: 186334 - DNA, 25 bp, Rattus norvegicus
atctgtctcagtgagcggcagtcaa

SEQ ID NO: 186335 - DNA, 25 bp, Rattus norvegicus
atctgtctccatctgaggctatgcc

SEQ ID NO: 186336 - DNA, 25 bp, Rattus norvegicus
atctgtctccatgtgaggctatgcc

SEQ ID NO: 186337 - DNA, 25 bp, Rattus norvegicus
atctgtctctgcagtgtctaaatgg

SEQ ID NO: 186338 - DNA, 25 bp, Rattus norvegicus
atctgtctctgctgtgtctaaatgg

SEQ ID NO: 186339 - DNA, 25 bp, Rattus norvegicus
atctgtctctttcggatacttgcct

SEQ ID NO: 186340 - DNA, 25 bp, Rattus norvegicus
atctgtctctttgggatacttgcct

SEQ ID NO: 186341 - DNA, 25 bp, Rattus norvegicus
atctgtctgctgcatctgtcagtac

SEQ ID NO: 186342 - DNA, 25 bp, Rattus norvegicus
atctgtctgctggatctgtcagtac

SEQ ID NO: 186343 - DNA, 25 bp, Rattus norvegicus
atctgtctggtcatctttgtgtgct

SEQ ID NO: 186344 - DNA, 25 bp, Rattus norvegicus
atctgtctggtcttctttgtgtgct

SEQ ID NO: 186345 - DNA, 25 bp, Rattus norvegicus
atctgtctgtagagcttcaaatgtg

SEQ ID NO: 186346 - DNA, 25 bp, Rattus norvegicus
atctgtctgtagtgcttcaaatgtg

SEQ ID NO: 186347 - DNA, 25 bp, Rattus norvegicus
atctgtctgtctacctatgatccaa

SEQ ID NO: 186348 - DNA, 25 bp, Rattus norvegicus
atctgtctgtcttcctatgatccaa

SEQ ID NO: 186349 - DNA, 25 bp, Rattus norvegicus
atctgtctgtgcagtaagatgacta

SEQ ID NO: 186350 - DNA, 25 bp, Rattus norvegicus
atctgtctgtgctgtaagatgacta

SEQ ID NO: 186351 - DNA, 25 bp, Rattus norvegicus
atctgtctgtggacatgtacacaca

SEQ ID NO: 186352 - DNA, 25 bp, Rattus norvegicus
atctgtctgtggagaccttgtttta

SEQ ID NO: 186353 - DNA, 25 bp, Rattus norvegicus
atctgtctgtggtcatgtacacaca

SEQ ID NO: 186354 - DNA, 25 bp, Rattus norvegicus
atctgtctgtggtgaccttgtttta

SEQ ID NO: 186355 - DNA, 25 bp, Rattus norvegicus
atctgtcttaatcagtctgggtcca

SEQ ID NO: 186356 - DNA, 25 bp, Rattus norvegicus
atctgtcttaatgagtctgggtcca

SEQ ID NO: 186357 - DNA, 25 bp, Rattus norvegicus
atctgtcttatcatttgcatgcttc

SEQ ID NO: 186358 - DNA, 25 bp, Rattus norvegicus
atctgtcttatcttttgcatgcttc

SEQ ID NO: 186359 - DNA, 25 bp, Rattus norvegicus
atctgtcttcatatccttaacttcc

SEQ ID NO: 186360 - DNA, 25 bp, Rattus norvegicus
atctgtcttcatttccttaacttcc

SEQ ID NO: 186361 - DNA, 25 bp, Rattus norvegicus
atctgtcttcctctttccagcggaa

SEQ ID NO: 186362 - DNA, 25 bp, Rattus norvegicus
atctgtcttcctgtttccagcggaa

SEQ ID NO: 186363 - DNA, 25 bp, Rattus norvegicus
atctgtcttctgatgcctgggcaga

SEQ ID NO: 186364 - DNA, 25 bp, Rattus norvegicus
atctgtcttctgttgcctgggcaga

SEQ ID NO: 186365 - DNA, 25 bp, Rattus norvegicus
atctgtgaatctatacctctgtgaa

SEQ ID NO: 186366 - DNA, 25 bp, Rattus norvegicus
atctgtgaatctttacctctgtgaa

SEQ ID NO: 186367 - DNA, 25 bp, Rattus norvegicus
atctgtgacacccatgacgtggcag

SEQ ID NO: 186368 - DNA, 25 bp, Rattus norvegicus
atctgtgacaccgatgacgtggcag

SEQ ID NO: 186369 - DNA, 25 bp, Rattus norvegicus
atctgtgacatcactttcctgctct

SEQ ID NO: 186370 - DNA, 25 bp, Rattus norvegicus
atctgtgacatctctttcctgctct

SEQ ID NO: 186371 - DNA, 25 bp, Rattus norvegicus
atctgtgactacagacatcctggat

SEQ ID NO: 186372 - DNA, 25 bp, Rattus norvegicus
atctgtgactactgacatcctggat

SEQ ID NO: 186373 - DNA, 25 bp, Rattus norvegicus
atctgtgactatagcgttgacttct

SEQ ID NO: 186374 - DNA, 25 bp, Rattus norvegicus
atctgtgactattgcgttgacttct

SEQ ID NO: 186375 - DNA, 25 bp, Rattus norvegicus
atctgtgacttcacatttttctctc

SEQ ID NO: 186376 - DNA, 25 bp, Rattus norvegicus
atctgtgacttctcatttttctctc

SEQ ID NO: 186377 - DNA, 25 bp, Rattus norvegicus
atctgtgagatcagctacctcatct

SEQ ID NO: 186378 - DNA, 25 bp, Rattus norvegicus
atctgtgagatctgctacctcatct

SEQ ID NO: 186379 - DNA, 25 bp, Rattus norvegicus
atctgtgagcacatggccgagtttc

SEQ ID NO: 186380 - DNA, 25 bp, Rattus norvegicus
atctgtgagcaccttggcgaggaaa

SEQ ID NO: 186381 - DNA, 25 bp, Rattus norvegicus
atctgtgagcacgttggcgaggaaa

SEQ ID NO: 186382 - DNA, 25 bp, Rattus norvegicus
atctgtgagcacttggccgagtttc

SEQ ID NO: 186383 - DNA, 25 bp, Rattus norvegicus
atctgtgagcttcagttttcaacta

SEQ ID NO: 186384 - DNA, 25 bp, Rattus norvegicus
atctgtgagcttgagttttcaacta

SEQ ID NO: 186385 - DNA, 25 bp, Rattus norvegicus
atctgtgagtaaccacttccttccc

SEQ ID NO: 186386 - DNA, 25 bp, Rattus norvegicus
atctgtgagtaagcacttccttccc

SEQ ID NO: 186387 - DNA, 25 bp, Rattus norvegicus
atctgtgatagaaccaaccaccacc

SEQ ID NO: 186388 - DNA, 25 bp, Rattus norvegicus
atctgtgatagatccaaccaccacc

SEQ ID NO: 186389 - DNA, 25 bp, Rattus norvegicus
atctgtgatgccatgttcagagtca

SEQ ID NO: 186390 - DNA, 25 bp, Rattus norvegicus
atctgtgatgccttgttcagagtca

SEQ ID NO: 186391 - DNA, 25 bp, Rattus norvegicus
atctgtgatttgcttctgtaggaac

SEQ ID NO: 186392 - DNA, 25 bp, Rattus norvegicus
atctgtgatttggttctgtaggaac

SEQ ID NO: 186393 - DNA, 25 bp, Rattus norvegicus
atctgtgcacagcatttctgcagag

SEQ ID NO: 186394 - DNA, 25 bp, Rattus norvegicus
atctgtgcacaggatttctgcagag

SEQ ID NO: 186395 - DNA, 25 bp, Rattus norvegicus
atctgtgcaccaagggtgagaatgt

SEQ ID NO: 186396 - DNA, 25 bp, Rattus norvegicus
atctgtgcaccatgggtgagaatgt

SEQ ID NO: 186397 - DNA, 25 bp, Rattus norvegicus
atctgtgcagagagagacccttttt

SEQ ID NO: 186398 - DNA, 25 bp, Rattus norvegicus
atctgtgcagagtgagacccttttt

SEQ ID NO: 186399 - DNA, 25 bp, Rattus norvegicus
atctgtgcagataccggatccggca

SEQ ID NO: 186400 - DNA, 25 bp, Rattus norvegicus
atctgtgcagattccggatccggca

SEQ ID NO: 186401 - DNA, 25 bp, Rattus norvegicus
atctgtgcagttccccgggagataa

SEQ ID NO: 186402 - DNA, 25 bp, Rattus norvegicus
atctgtgcagttgcccgggagataa

SEQ ID NO: 186403 - DNA, 25 bp, Rattus norvegicus
atctgtgcatataaagctggtccca

SEQ ID NO: 186404 - DNA, 25 bp, Rattus norvegicus
atctgtgcatattaagctggtccca

SEQ ID NO: 186405 - DNA, 25 bp, Rattus norvegicus
atctgtgcatcgctgtagactgacc

SEQ ID NO: 186406 - DNA, 25 bp, Rattus norvegicus
atctgtgcatcggtgtagactgacc

SEQ ID NO: 186407 - DNA, 25 bp, Rattus norvegicus
atctgtgccaccagggagtctgcta

SEQ ID NO: 186408 - DNA, 25 bp, Rattus norvegicus
atctgtgccacctgggagtctgcta

SEQ ID NO: 186409 - DNA, 25 bp, Rattus norvegicus
atctgtgccatgctttgccatgtcc

SEQ ID NO: 186410 - DNA, 25 bp, Rattus norvegicus
atctgtgccatggtttgccatgtcc

SEQ ID NO: 186411 - DNA, 25 bp, Rattus norvegicus
atctgtgccattaaagctggtgcat

SEQ ID NO: 186412 - DNA, 25 bp, Rattus norvegicus
atctgtgccattcctgctgttcatg

SEQ ID NO: 186413 - DNA, 25 bp, Rattus norvegicus
atctgtgccattgctgctgttcatg

SEQ ID NO: 186414 - DNA, 25 bp, Rattus norvegicus
atctgtgccatttaagctggtgcat

SEQ ID NO: 186415 - DNA, 25 bp, Rattus norvegicus
atctgtgccctgaactggatatgaa

SEQ ID NO: 186416 - DNA, 25 bp, Rattus norvegicus
atctgtgccctgtactggatatgaa

SEQ ID NO: 186417 - DNA, 25 bp, Rattus norvegicus
atctgtgcctgacatgcagggtgat

SEQ ID NO: 186418 - DNA, 25 bp, Rattus norvegicus
atctgtgcctgagatgcagggtgat

SEQ ID NO: 186419 - DNA, 25 bp, Rattus norvegicus
atctgtgcgcaaagtggaggtacct

SEQ ID NO: 186420 - DNA, 25 bp, Rattus norvegicus
atctgtgcgcaatgtggaggtacct

SEQ ID NO: 186421 - DNA, 25 bp, Rattus norvegicus
atctgtgctaagagtggcaggctac

SEQ ID NO: 186422 - DNA, 25 bp, Rattus norvegicus
atctgtgctaagtgtggcaggctac

SEQ ID NO: 186423 - DNA, 25 bp, Rattus norvegicus
atctgtgctcatcctgtctgttttt

SEQ ID NO: 186424 - DNA, 25 bp, Rattus norvegicus
atctgtgctcatgctgtctgttttt

SEQ ID NO: 186425 - DNA, 25 bp, Rattus norvegicus
atctgtgctcttcgtcaggccttat

SEQ ID NO: 186426 - DNA, 25 bp, Rattus norvegicus
atctgtgctcttggtcaggccttat

SEQ ID NO: 186427 - DNA, 25 bp, Rattus norvegicus
atctgtgctgaacacattcgcctcg

SEQ ID NO: 186428 - DNA, 25 bp, Rattus norvegicus
atctgtgctgaagacattcgcctcg

SEQ ID NO: 186429 - DNA, 25 bp, Rattus norvegicus
atctgtgctgttcccggaatctgtg

SEQ ID NO: 186430 - DNA, 25 bp, Rattus norvegicus
atctgtgctgttgccggaatctgtg

SEQ ID NO: 186431 - DNA, 25 bp, Rattus norvegicus
atctgtgcttcacttaggccgaaga

SEQ ID NO: 186432 - DNA, 25 bp, Rattus norvegicus
atctgtgcttcagttaggccgaaga

SEQ ID NO: 186433 - DNA, 25 bp, Rattus norvegicus
atctgtgctttcacattgttgctgt

SEQ ID NO: 186434 - DNA, 25 bp, Rattus norvegicus
atctgtgctttctcattgttgctgt

SEQ ID NO: 186435 - DNA, 25 bp, Rattus norvegicus
atctgtggacagatcctgcccagct

SEQ ID NO: 186436 - DNA, 25 bp, Rattus norvegicus
atctgtggacagttcctgcccagct

SEQ ID NO: 186437 - DNA, 25 bp, Rattus norvegicus
atctgtggacatagcctccttagca

SEQ ID NO: 186438 - DNA, 25 bp, Rattus norvegicus
atctgtggacattgcctccttagca

SEQ ID NO: 186439 - DNA, 25 bp, Rattus norvegicus
atctgtggaccactgtctgtggttc

SEQ ID NO: 186440 - DNA, 25 bp, Rattus norvegicus
atctgtggaccagtgtctgtggttc

SEQ ID NO: 186441 - DNA, 25 bp, Rattus norvegicus
atctgtggactaacgatttagggat

SEQ ID NO: 186442 - DNA, 25 bp, Rattus norvegicus
atctgtggactatcgatttagggat

SEQ ID NO: 186443 - DNA, 25 bp, Rattus norvegicus
atctgtggactgaagattgccgtct

SEQ ID NO: 186444 - DNA, 25 bp, Rattus norvegicus
atctgtggactgtagattgccgtct

SEQ ID NO: 186445 - DNA, 25 bp, Rattus norvegicus
atctgtggcaagctcttccgcgatg

SEQ ID NO: 186446 - DNA, 25 bp, Rattus norvegicus
atctgtggcaaggtcttccgcgatg

SEQ ID NO: 186447 - DNA, 25 bp, Rattus norvegicus
atctgtggcacccatatcctgtaac

SEQ ID NO: 186448 - DNA, 25 bp, Rattus norvegicus
atctgtggcaccgatatcctgtaac

SEQ ID NO: 186449 - DNA, 25 bp, Rattus norvegicus
atctgtggccaacaggctgaagtcc

SEQ ID NO: 186450 - DNA, 25 bp, Rattus norvegicus
atctgtggccaagaggctgaagtcc

SEQ ID NO: 186451 - DNA, 25 bp, Rattus norvegicus
atctgtggctccagtcttgggcagg

SEQ ID NO: 186452 - DNA, 25 bp, Rattus norvegicus
atctgtggctcctgtcttgggcagg

SEQ ID NO: 186453 - DNA, 25 bp, Rattus norvegicus
atctgtggctctaactcgtcccaag

SEQ ID NO: 186454 - DNA, 25 bp, Rattus norvegicus
atctgtggctcttactcgtcccaag

SEQ ID NO: 186455 - DNA, 25 bp, Rattus norvegicus
atctgtggcttcaatgcatcctaaa

SEQ ID NO: 186456 - DNA, 25 bp, Rattus norvegicus
atctgtggcttctatgcatcctaaa

SEQ ID NO: 186457 - DNA, 25 bp, Rattus norvegicus
atctgtgggcagagtcttgtagact

SEQ ID NO: 186458 - DNA, 25 bp, Rattus norvegicus
atctgtgggcagtgtcttgtagact

SEQ ID NO: 186459 - DNA, 25 bp, Rattus norvegicus
atctgtgggcatactgcttagagcg

SEQ ID NO: 186460 - DNA, 25 bp, Rattus norvegicus
atctgtgggcattctgcttagagcg

SEQ ID NO: 186461 - DNA, 25 bp, Rattus norvegicus
atctgtgggccacgagcatctccta

SEQ ID NO: 186462 - DNA, 25 bp, Rattus norvegicus
atctgtgggccaggagcatctccta

SEQ ID NO: 186463 - DNA, 25 bp, Rattus norvegicus
atctgtgggcgtccttttaaccctg

SEQ ID NO: 186464 - DNA, 25 bp, Rattus norvegicus
atctgtgggcgtgcttttaaccctg

SEQ ID NO: 186465 - DNA, 25 bp, Rattus norvegicus
atctgtgggtacacatagttgacta

SEQ ID NO: 186466 - DNA, 25 bp, Rattus norvegicus
atctgtgggtactcatagttgacta

SEQ ID NO: 186467 - DNA, 25 bp, Rattus norvegicus
atctgtggtatgacaaactgctttt

SEQ ID NO: 186468 - DNA, 25 bp, Rattus norvegicus
atctgtggtatgtcaaactgctttt

SEQ ID NO: 186469 - DNA, 25 bp, Rattus norvegicus
atctgtggtcatctgagctggacat

SEQ ID NO: 186470 - DNA, 25 bp, Rattus norvegicus
atctgtggtcatgtgagctggacat

SEQ ID NO: 186471 - DNA, 25 bp, Rattus norvegicus
atctgtggtgctactaggaccctag

SEQ ID NO: 186472 - DNA, 25 bp, Rattus norvegicus
atctgtggtgcttctaggaccctag

SEQ ID NO: 186473 - DNA, 25 bp, Rattus norvegicus
atctgtggtgtgctctatgccctga

SEQ ID NO: 186474 - DNA, 25 bp, Rattus norvegicus
atctgtggtgtggtctatgccctga

SEQ ID NO: 186475 - DNA, 25 bp, Rattus norvegicus
atctgtgtcaagctccagcgggtaa

SEQ ID NO: 186476 - DNA, 25 bp, Rattus norvegicus
atctgtgtcaaggtccagcgggtaa

SEQ ID NO: 186477 - DNA, 25 bp, Rattus norvegicus
atctgtgtccccataattctaataa

SEQ ID NO: 186478 - DNA, 25 bp, Rattus norvegicus
atctgtgtccccttaattctaataa

SEQ ID NO: 186479 - DNA, 25 bp, Rattus norvegicus
atctgtgtcctcctattcagctcag

SEQ ID NO: 186480 - DNA, 25 bp, Rattus norvegicus
atctgtgtcctcgtattcagctcag

SEQ ID NO: 186481 - DNA, 25 bp, Rattus norvegicus
atctgtgtccttacatgagtgactg

SEQ ID NO: 186482 - DNA, 25 bp, Rattus norvegicus
atctgtgtcctttcatgagtgactg

SEQ ID NO: 186483 - DNA, 25 bp, Rattus norvegicus
atctgtgtctctctatcattagtcc

SEQ ID NO: 186484 - DNA, 25 bp, Rattus norvegicus
atctgtgtctctgtatcattagtcc

SEQ ID NO: 186485 - DNA, 25 bp, Rattus norvegicus
atctgtgtgataaggctgtgcccta

SEQ ID NO: 186486 - DNA, 25 bp, Rattus norvegicus
atctgtgtgatatggctgtgcccta

SEQ ID NO: 186487 - DNA, 25 bp, Rattus norvegicus
atctgtgtgatgacgtcttgtgctt

SEQ ID NO: 186488 - DNA, 25 bp, Rattus norvegicus
atctgtgtgatgtcgtcttgtgctt

SEQ ID NO: 186489 - DNA, 25 bp, Rattus norvegicus
atctgtgtgcacagtatgtcgtttg

SEQ ID NO: 186490 - DNA, 25 bp, Rattus norvegicus
atctgtgtgcactgtatgtcgtttg

SEQ ID NO: 186491 - DNA, 25 bp, Rattus norvegicus
atctgtgtgctgattatcataattt

SEQ ID NO: 186492 - DNA, 25 bp, Rattus norvegicus
atctgtgtgctgtttatcataattt

SEQ ID NO: 186493 - DNA, 25 bp, Rattus norvegicus
atctgtgtggaacctgcactagggc

SEQ ID NO: 186494 - DNA, 25 bp, Rattus norvegicus
atctgtgtggaagctgcactagggc

SEQ ID NO: 186495 - DNA, 25 bp, Rattus norvegicus
atctgtgtggagattccggttccca

SEQ ID NO: 186496 - DNA, 25 bp, Rattus norvegicus
atctgtgtggagtttccggttccca

SEQ ID NO: 186497 - DNA, 25 bp, Rattus norvegicus
atctgtgtggtgattaatgctggca

SEQ ID NO: 186498 - DNA, 25 bp, Rattus norvegicus
atctgtgtggtgtttaatgctggca

SEQ ID NO: 186499 - DNA, 25 bp, Rattus norvegicus
atctgtgtgtggcattttgccgaac

SEQ ID NO: 186500 - DNA, 25 bp, Rattus norvegicus
atctgtgtgtgggattttgccgaac

SEQ ID NO: 186501 - DNA, 25 bp, Rattus norvegicus
atctgtgtgtgtcaatgtcgttacc

SEQ ID NO: 186502 - DNA, 25 bp, Rattus norvegicus
atctgtgtgtgtcttactgtcctca

SEQ ID NO: 186503 - DNA, 25 bp, Rattus norvegicus
atctgtgtgtgtgaatgtcgttacc

SEQ ID NO: 186504 - DNA, 25 bp, Rattus norvegicus
atctgtgtgtgtgttactgtcctca

SEQ ID NO: 186505 - DNA, 25 bp, Rattus norvegicus
atctgtgttaccatgtgtttccagg

SEQ ID NO: 186506 - DNA, 25 bp, Rattus norvegicus
atctgtgttaccttgtgtttccagg

SEQ ID NO: 186507 - DNA, 25 bp, Rattus norvegicus
atctgtgttagcctcagtcttcaaa

SEQ ID NO: 186508 - DNA, 25 bp, Rattus norvegicus
atctgtgttagcgtcagtcttcaaa

SEQ ID NO: 186509 - DNA, 25 bp, Rattus norvegicus
atctgtgttcacatggaaactgcaa

SEQ ID NO: 186510 - DNA, 25 bp, Rattus norvegicus
atctgtgttcacttggaaactgcaa

SEQ ID NO: 186511 - DNA, 25 bp, Rattus norvegicus
atctgtgttcatctatcttaaggcc

SEQ ID NO: 186512 - DNA, 25 bp, Rattus norvegicus
atctgtgttcatgtatcttaaggcc

SEQ ID NO: 186513 - DNA, 25 bp, Rattus norvegicus
atctgtgttctgactgtgttcgttt

SEQ ID NO: 186514 - DNA, 25 bp, Rattus norvegicus
atctgtgttctgtctgtgttcgttt

SEQ ID NO: 186515 - DNA, 25 bp, Rattus norvegicus
atctgtgtttctctcactgttctca

SEQ ID NO: 186516 - DNA, 25 bp, Rattus norvegicus
atctgtgtttctgtcactgttctca

SEQ ID NO: 186517 - DNA, 25 bp, Rattus norvegicus
atctgtgtttttacttctgtcagca

SEQ ID NO: 186518 - DNA, 25 bp, Rattus norvegicus
atctgtgttttttcttctgtcagca

SEQ ID NO: 186519 - DNA, 25 bp, Rattus norvegicus
atctgttaagacatcctgacatgcc

SEQ ID NO: 186520 - DNA, 25 bp, Rattus norvegicus
atctgttaagacttcctgacatgcc

SEQ ID NO: 186521 - DNA, 25 bp, Rattus norvegicus
atctgttaagtacctgcctcgaacc

SEQ ID NO: 186522 - DNA, 25 bp, Rattus norvegicus
atctgttaagtagctgcctcgaacc

SEQ ID NO: 186523 - DNA, 25 bp, Rattus norvegicus
atctgttaccgacattaacctcgtc

SEQ ID NO: 186524 - DNA, 25 bp, Rattus norvegicus
atctgttaccgagattaacctcgtc

SEQ ID NO: 186525 - DNA, 25 bp, Rattus norvegicus
atctgttacgtcctccgttgttggc

SEQ ID NO: 186526 - DNA, 25 bp, Rattus norvegicus
atctgttacgtcgtccgttgttggc

SEQ ID NO: 186527 - DNA, 25 bp, Rattus norvegicus
atctgttactctactactttggttc

SEQ ID NO: 186528 - DNA, 25 bp, Rattus norvegicus
atctgttactcttctactttggttc

SEQ ID NO: 186529 - DNA, 25 bp, Rattus norvegicus
atctgttagatgaggctgttttgcg

SEQ ID NO: 186530 - DNA, 25 bp, Rattus norvegicus
atctgttagatgtggctgttttgcg

SEQ ID NO: 186531 - DNA, 25 bp, Rattus norvegicus
atctgttatcttactttcgtgcatg

SEQ ID NO: 186532 - DNA, 25 bp, Rattus norvegicus
atctgttatctttctttcgtgcatg

SEQ ID NO: 186533 - DNA, 25 bp, Rattus norvegicus
atctgttatgtcctgtaacccagct

SEQ ID NO: 186534 - DNA, 25 bp, Rattus norvegicus
atctgttatgtcgtgtaacccagct

SEQ ID NO: 186535 - DNA, 25 bp, Rattus norvegicus
atctgttcaagactttctccactgg

SEQ ID NO: 186536 - DNA, 25 bp, Rattus norvegicus
atctgttcaagagtttctccactgg

SEQ ID NO: 186537 - DNA, 25 bp, Rattus norvegicus
atctgttcatctcttgttttctgca

SEQ ID NO: 186538 - DNA, 25 bp, Rattus norvegicus
atctgttcatctgttgttttctgca

SEQ ID NO: 186539 - DNA, 25 bp, Rattus norvegicus
atctgttccaccaatgcagtgggat

SEQ ID NO: 186540 - DNA, 25 bp, Rattus norvegicus
atctgttccacctatgcagtgggat

SEQ ID NO: 186541 - DNA, 25 bp, Rattus norvegicus
atctgttccacgacaggttggtttt

SEQ ID NO: 186542 - DNA, 25 bp, Rattus norvegicus
atctgttccacgtcaggttggtttt

SEQ ID NO: 186543 - DNA, 25 bp, Rattus norvegicus
atctgttccactcatctggtgtcct

SEQ ID NO: 186544 - DNA, 25 bp, Rattus norvegicus
atctgttccactgatctggtgtcct

SEQ ID NO: 186545 - DNA, 25 bp, Rattus norvegicus
atctgttccagtccttgcgaagcct

SEQ ID NO: 186546 - DNA, 25 bp, Rattus norvegicus
atctgttccagtgcttgcgaagcct

SEQ ID NO: 186547 - DNA, 25 bp, Rattus norvegicus
atctgttcccttcatgtgctaaata

SEQ ID NO: 186548 - DNA, 25 bp, Rattus norvegicus
atctgttcccttgatgtgctaaata

SEQ ID NO: 186549 - DNA, 25 bp, Rattus norvegicus
atctgttctctactctgtggacata

SEQ ID NO: 186550 - DNA, 25 bp, Rattus norvegicus
atctgttctctagtctgtggacata

SEQ ID NO: 186551 - DNA, 25 bp, Rattus norvegicus
atctgttctgcactcttcaaaggga

SEQ ID NO: 186552 - DNA, 25 bp, Rattus norvegicus
atctgttctgcagtcttcaaaggga

SEQ ID NO: 186553 - DNA, 25 bp, Rattus norvegicus
atctgttctttgagagtattccctg

SEQ ID NO: 186554 - DNA, 25 bp, Rattus norvegicus
atctgttctttgtgagtattccctg

SEQ ID NO: 186555 - DNA, 25 bp, Rattus norvegicus
atctgttgctagctccttagtttag

SEQ ID NO: 186556 - DNA, 25 bp, Rattus norvegicus
atctgttgctaggtccttagtttag

SEQ ID NO: 186557 - DNA, 25 bp, Rattus norvegicus
atctgttgctttcccaagtcttctt

SEQ ID NO: 186558 - DNA, 25 bp, Rattus norvegicus
atctgttgctttgccaagtcttctt

SEQ ID NO: 186559 - DNA, 25 bp, Rattus norvegicus
atctgttggacacttgataggacac

SEQ ID NO: 186560 - DNA, 25 bp, Rattus norvegicus
atctgttggacagttgataggacac

SEQ ID NO: 186561 - DNA, 25 bp, Rattus norvegicus
atctgttggcatcagctttgtggct

SEQ ID NO: 186562 - DNA, 25 bp, Rattus norvegicus
atctgttggcatgagctttgtggct

SEQ ID NO: 186563 - DNA, 25 bp, Rattus norvegicus
atctgttggtccaggaagcatctat

SEQ ID NO: 186564 - DNA, 25 bp, Rattus norvegicus
atctgttggtcctggaagcatctat

SEQ ID NO: 186565 - DNA, 25 bp, Rattus norvegicus
atctgttgtagcattgtctttttct

SEQ ID NO: 186566 - DNA, 25 bp, Rattus norvegicus
atctgttgtagctttgtctttttct

SEQ ID NO: 186567 - DNA, 25 bp, Rattus norvegicus
atctgttgtgctcggtcagcctata

SEQ ID NO: 186568 - DNA, 25 bp, Rattus norvegicus
atctgttgtgctgggtcagcctata

SEQ ID NO: 186569 - DNA, 25 bp, Rattus norvegicus
atctgttgtggccaatgtttgtcaa

SEQ ID NO: 186570 - DNA, 25 bp, Rattus norvegicus
atctgttgtggcgaatgtttgtcaa

SEQ ID NO: 186571 - DNA, 25 bp, Rattus norvegicus
atctgtttaattctctgtagcttgg

SEQ ID NO: 186572 - DNA, 25 bp, Rattus norvegicus
atctgtttaattgtctgtagcttgg

SEQ ID NO: 186573 - DNA, 25 bp, Rattus norvegicus
atctgtttatttctgcattctttga

SEQ ID NO: 186574 - DNA, 25 bp, Rattus norvegicus
atctgtttatttgtgcattctttga

SEQ ID NO: 186575 - DNA, 25 bp, Rattus norvegicus
atctgtttcagccatgattgtcgtt

SEQ ID NO: 186576 - DNA, 25 bp, Rattus norvegicus
atctgtttcagcgatgattgtcgtt

SEQ ID NO: 186577 - DNA, 25 bp, Rattus norvegicus
atctgtttcatcattcaacatccct

SEQ ID NO: 186578 - DNA, 25 bp, Rattus norvegicus
atctgtttcatctttcaacatccct

SEQ ID NO: 186579 - DNA, 25 bp, Rattus norvegicus
atctgtttcatgattaggtgtagtg

SEQ ID NO: 186580 - DNA, 25 bp, Rattus norvegicus
atctgtttcatgtttaggtgtagtg

SEQ ID NO: 186581 - DNA, 25 bp, Rattus norvegicus
atctgtttccagaattaatctcttc

SEQ ID NO: 186582 - DNA, 25 bp, Rattus norvegicus
atctgtttccagtattaatctcttc

SEQ ID NO: 186583 - DNA, 25 bp, Rattus norvegicus
atctgtttcggtcaagtcagactga

SEQ ID NO: 186584 - DNA, 25 bp, Rattus norvegicus
atctgtttcggtgaagtcagactga

SEQ ID NO: 186585 - DNA, 25 bp, Rattus norvegicus
atctgtttctctaccgggatggact

SEQ ID NO: 186586 - DNA, 25 bp, Rattus norvegicus
atctgtttctctatgcatcttgtaa

SEQ ID NO: 186587 - DNA, 25 bp, Rattus norvegicus
atctgtttctcttccgggatggact

SEQ ID NO: 186588 - DNA, 25 bp, Rattus norvegicus
atctgtttctctttgcatcttgtaa

SEQ ID NO: 186589 - DNA, 25 bp, Rattus norvegicus
atctgtttctgcattataccgtctt

SEQ ID NO: 186590 - DNA, 25 bp, Rattus norvegicus
atctgtttctgctttataccgtctt

SEQ ID NO: 186591 - DNA, 25 bp, Rattus norvegicus
atctgtttctgtatacaagtggcac

SEQ ID NO: 186592 - DNA, 25 bp, Rattus norvegicus
atctgtttctgtttacaagtggcac

SEQ ID NO: 186593 - DNA, 25 bp, Rattus norvegicus
atctgtttgtatatcttactataga

SEQ ID NO: 186594 - DNA, 25 bp, Rattus norvegicus
atctgtttgtatttcttactataga

SEQ ID NO: 186595 - DNA, 25 bp, Rattus norvegicus
atctgttttcagatttcccctgggt

SEQ ID NO: 186596 - DNA, 25 bp, Rattus norvegicus
atctgttttcagttttcccctgggt

SEQ ID NO: 186597 - DNA, 25 bp, Rattus norvegicus
atctgttttgaccatttccagtaaa

SEQ ID NO: 186598 - DNA, 25 bp, Rattus norvegicus
atctgttttgacgatttccagtaaa

SEQ ID NO: 186599 - DNA, 25 bp, Rattus norvegicus
atctgtttttaaatcttgtcacggg

SEQ ID NO: 186600 - DNA, 25 bp, Rattus norvegicus
atctgtttttaattcttgtcacggg

SEQ ID NO: 186601 - DNA, 25 bp, Rattus norvegicus
atctgtttttataccccactggaca

SEQ ID NO: 186602 - DNA, 25 bp, Rattus norvegicus
atctgtttttattccccactggaca

SEQ ID NO: 186603 - DNA, 25 bp, Rattus norvegicus
atctgttttttcagggcacatcaaa

SEQ ID NO: 186604 - DNA, 25 bp, Rattus norvegicus
atctgttttttctgggcacatcaaa

SEQ ID NO: 186605 - DNA, 25 bp, Rattus norvegicus
atcttaaaaaccctcatcaacccag

SEQ ID NO: 186606 - DNA, 25 bp, Rattus norvegicus
atcttaaaaaccgtcatcaacccag

SEQ ID NO: 186607 - DNA, 25 bp, Rattus norvegicus
atcttaaattcaactctgcccctgt

SEQ ID NO: 186608 - DNA, 25 bp, Rattus norvegicus
atcttaaattcatctctgcccctgt

SEQ ID NO: 186609 - DNA, 25 bp, Rattus norvegicus
atcttaagcaggatggacggcggca

SEQ ID NO: 186610 - DNA, 25 bp, Rattus norvegicus
atcttaagcaggttggacggcggca

SEQ ID NO: 186611 - DNA, 25 bp, Rattus norvegicus
atcttaatctggaccctgaatgagc

SEQ ID NO: 186612 - DNA, 25 bp, Rattus norvegicus
atcttaatctggtccctgaatgagc

SEQ ID NO: 186613 - DNA, 25 bp, Rattus norvegicus
atcttaatgataacccctatgccct

SEQ ID NO: 186614 - DNA, 25 bp, Rattus norvegicus
atcttaatgatatcccctatgccct

SEQ ID NO: 186615 - DNA, 25 bp, Rattus norvegicus
atcttaatggctcagtaatttctac

SEQ ID NO: 186616 - DNA, 25 bp, Rattus norvegicus
atcttaatggctgagtaatttctac

SEQ ID NO: 186617 - DNA, 25 bp, Rattus norvegicus
atcttaatgtgcatgttgaaccttt

SEQ ID NO: 186618 - DNA, 25 bp, Rattus norvegicus
atcttaatgtgcttgttgaaccttt

SEQ ID NO: 186619 - DNA, 25 bp, Rattus norvegicus
atcttaattgagctttgactgtgga

SEQ ID NO: 186620 - DNA, 25 bp, Rattus norvegicus
atcttaattgaggtttgactgtgga

SEQ ID NO: 186621 - DNA, 25 bp, Rattus norvegicus
atcttacatgataccttccgaggtc

SEQ ID NO: 186622 - DNA, 25 bp, Rattus norvegicus
atcttacatgattccttccgaggtc

SEQ ID NO: 186623 - DNA, 25 bp, Rattus norvegicus
atcttaccaagaagctttgcaggag

SEQ ID NO: 186624 - DNA, 25 bp, Rattus norvegicus
atcttaccaagatgctttgcaggag

SEQ ID NO: 186625 - DNA, 25 bp, Rattus norvegicus
atcttaccagatcagaaccacgtgg

SEQ ID NO: 186626 - DNA, 25 bp, Rattus norvegicus
atcttaccagatgagaaccacgtgg

SEQ ID NO: 186627 - DNA, 25 bp, Rattus norvegicus
atcttaccagtccagcagctctgtg

SEQ ID NO: 186628 - DNA, 25 bp, Rattus norvegicus
atcttaccagtcgagcagctctgtg

SEQ ID NO: 186629 - DNA, 25 bp, Rattus norvegicus
atcttaccgggtatggaagctgatt

SEQ ID NO: 186630 - DNA, 25 bp, Rattus norvegicus
atcttaccgggtttggaagctgatt

SEQ ID NO: 186631 - DNA, 25 bp, Rattus norvegicus
atcttacctccacattcactggatg

SEQ ID NO: 186632 - DNA, 25 bp, Rattus norvegicus
atcttacctccagattcactggatg

SEQ ID NO: 186633 - DNA, 25 bp, Rattus norvegicus
atcttacctcttccatgagaacaaa

SEQ ID NO: 186634 - DNA, 25 bp, Rattus norvegicus
atcttacctcttgcatgagaacaaa

SEQ ID NO: 186635 - DNA, 25 bp, Rattus norvegicus
atcttactagctccaaagaggaatc

SEQ ID NO: 186636 - DNA, 25 bp, Rattus norvegicus
atcttactagctgcaaagaggaatc

SEQ ID NO: 186637 - DNA, 25 bp, Rattus norvegicus
atcttactccttcagggtctgttaa

SEQ ID NO: 186638 - DNA, 25 bp, Rattus norvegicus
atcttactccttgagggtctgttaa

SEQ ID NO: 186639 - DNA, 25 bp, Rattus norvegicus
atcttactgctgagtttgctgacct

SEQ ID NO: 186640 - DNA, 25 bp, Rattus norvegicus
atcttactgctgtgtttgctgacct

SEQ ID NO: 186641 - DNA, 25 bp, Rattus norvegicus
atcttactgtctctgctcacactga

SEQ ID NO: 186642 - DNA, 25 bp, Rattus norvegicus
atcttactgtctgtgctcacactga

SEQ ID NO: 186643 - DNA, 25 bp, Rattus norvegicus
atcttactgtgcagagattgctcac

SEQ ID NO: 186644 - DNA, 25 bp, Rattus norvegicus
atcttactgtgctgagattgctcac

SEQ ID NO: 186645 - DNA, 25 bp, Rattus norvegicus
atcttacttcagaggcgctgtgctg

SEQ ID NO: 186646 - DNA, 25 bp, Rattus norvegicus
atcttacttcagtggcgctgtgctg

SEQ ID NO: 186647 - DNA, 25 bp, Rattus norvegicus
atcttacttcatcgaacctgtgcag

SEQ ID NO: 186648 - DNA, 25 bp, Rattus norvegicus
atcttacttcatggaacctgtgcag

SEQ ID NO: 186649 - DNA, 25 bp, Rattus norvegicus
atcttacttggcacagtttgcggct

SEQ ID NO: 186650 - DNA, 25 bp, Rattus norvegicus
atcttacttggctcagtttgcggct

SEQ ID NO: 186651 - DNA, 25 bp, Rattus norvegicus
atcttagaccctaagagctcttctt

SEQ ID NO: 186652 - DNA, 25 bp, Rattus norvegicus
atcttagacccttagagctcttctt

SEQ ID NO: 186653 - DNA, 25 bp, Rattus norvegicus
atcttagacctcagggaagctcggc

SEQ ID NO: 186654 - DNA, 25 bp, Rattus norvegicus
atcttagacctctgggaagctcggc

SEQ ID NO: 186655 - DNA, 25 bp, Rattus norvegicus
atcttagaccttaccaacgactgta

SEQ ID NO: 186656 - DNA, 25 bp, Rattus norvegicus
atcttagacctttccaacgactgta

SEQ ID NO: 186657 - DNA, 25 bp, Rattus norvegicus
atcttagagctcacaggagcccgtg

SEQ ID NO: 186658 - DNA, 25 bp, Rattus norvegicus
atcttagagctctcaggagcccgtg

SEQ ID NO: 186659 - DNA, 25 bp, Rattus norvegicus
atcttagaggtgctagtcccagtgc

SEQ ID NO: 186660 - DNA, 25 bp, Rattus norvegicus
atcttagaggtggtagtcccagtgc

SEQ ID NO: 186661 - DNA, 25 bp, Rattus norvegicus
atcttagcacttcaggataaagcag

SEQ ID NO: 186662 - DNA, 25 bp, Rattus norvegicus
atcttagcacttgaggataaagcag

SEQ ID NO: 186663 - DNA, 25 bp, Rattus norvegicus
atcttagcagtgctaccttgccaaa

SEQ ID NO: 186664 - DNA, 25 bp, Rattus norvegicus
atcttagcagtggtaccttgccaaa

SEQ ID NO: 186665 - DNA, 25 bp, Rattus norvegicus
atcttagcatatatgttctcagcaa

SEQ ID NO: 186666 - DNA, 25 bp, Rattus norvegicus
atcttagcatatttgttctcagcaa

SEQ ID NO: 186667 - DNA, 25 bp, Rattus norvegicus
atcttagcgccacggattaaccaat

SEQ ID NO: 186668 - DNA, 25 bp, Rattus norvegicus
atcttagcgccagggattaaccaat

SEQ ID NO: 186669 - DNA, 25 bp, Rattus norvegicus
atcttagcttgcagtgtccttcaca

SEQ ID NO: 186670 - DNA, 25 bp, Rattus norvegicus
atcttagcttgctgtgtccttcaca

SEQ ID NO: 186671 - DNA, 25 bp, Rattus norvegicus
atcttaggagccatgttcacctgga

SEQ ID NO: 186672 - DNA, 25 bp, Rattus norvegicus
atcttaggagccttgttcacctgga

SEQ ID NO: 186673 - DNA, 25 bp, Rattus norvegicus
atcttaggcctgaggccctaggaca

SEQ ID NO: 186674 - DNA, 25 bp, Rattus norvegicus
atcttaggcctgtggccctaggaca

SEQ ID NO: 186675 - DNA, 25 bp, Rattus norvegicus
atcttaggccttaggaaacatttca

SEQ ID NO: 186676 - DNA, 25 bp, Rattus norvegicus
atcttaggcctttggaaacatttca

SEQ ID NO: 186677 - DNA, 25 bp, Rattus norvegicus
atcttagggcggcagctcaggtcaa

SEQ ID NO: 186678 - DNA, 25 bp, Rattus norvegicus
atcttagggcgggagctcaggtcaa

SEQ ID NO: 186679 - DNA, 25 bp, Rattus norvegicus
atcttaggtccaacagactgaacta

SEQ ID NO: 186680 - DNA, 25 bp, Rattus norvegicus
atcttaggtccatcagactgaacta

SEQ ID NO: 186681 - DNA, 25 bp, Rattus norvegicus
atcttagtaggccaccagcagtaaa

SEQ ID NO: 186682 - DNA, 25 bp, Rattus norvegicus
atcttagtaggcgaccagcagtaaa

SEQ ID NO: 186683 - DNA, 25 bp, Rattus norvegicus
atcttagtagttacatgctgtgtat

SEQ ID NO: 186684 - DNA, 25 bp, Rattus norvegicus
atcttagtagtttcatgctgtgtat

SEQ ID NO: 186685 - DNA, 25 bp, Rattus norvegicus
atcttagtccacctcgacgggtagg

SEQ ID NO: 186686 - DNA, 25 bp, Rattus norvegicus
atcttagtccacgtcgacgggtagg

SEQ ID NO: 186687 - DNA, 25 bp, Rattus norvegicus
atcttagtgctgctactttccacag

SEQ ID NO: 186688 - DNA, 25 bp, Rattus norvegicus
atcttagtgctggtactttccacag

SEQ ID NO: 186689 - DNA, 25 bp, Rattus norvegicus
atcttagtgttgactggccttagca

SEQ ID NO: 186690 - DNA, 25 bp, Rattus norvegicus
atcttagtgttgattgcgtctgtct

SEQ ID NO: 186691 - DNA, 25 bp, Rattus norvegicus
atcttagtgttgtctggccttagca

SEQ ID NO: 186692 - DNA, 25 bp, Rattus norvegicus
atcttagtgttgtttgcgtctgtct

SEQ ID NO: 186693 - DNA, 25 bp, Rattus norvegicus
atcttatacatcatatcttttccat

SEQ ID NO: 186694 - DNA, 25 bp, Rattus norvegicus
atcttatacatcttatcttttccat

SEQ ID NO: 186695 - DNA, 25 bp, Rattus norvegicus
atcttatacgtgattgtcagtctgc

SEQ ID NO: 186696 - DNA, 25 bp, Rattus norvegicus
atcttatacgtgtttgtcagtctgc

SEQ ID NO: 186697 - DNA, 25 bp, Rattus norvegicus
atcttatctcaaaatggaccgccta

SEQ ID NO: 186698 - DNA, 25 bp, Rattus norvegicus
atcttatctcaatatggaccgccta

SEQ ID NO: 186699 - DNA, 25 bp, Rattus norvegicus
atcttatgaaggatctgccccagaa

SEQ ID NO: 186700 - DNA, 25 bp, Rattus norvegicus
atcttatgaaggttctgccccagaa

SEQ ID NO: 186701 - DNA, 25 bp, Rattus norvegicus
atcttatggcgactggccacccctg

SEQ ID NO: 186702 - DNA, 25 bp, Rattus norvegicus
atcttatggcgagtggccacccctg

SEQ ID NO: 186703 - DNA, 25 bp, Rattus norvegicus
atcttatggtttcctgttattctgg

SEQ ID NO: 186704 - DNA, 25 bp, Rattus norvegicus
atcttatggtttgctgttattctgg

SEQ ID NO: 186705 - DNA, 25 bp, Rattus norvegicus
atcttattctatacccagcgagtga

SEQ ID NO: 186706 - DNA, 25 bp, Rattus norvegicus
atcttattctattcccagcgagtga

SEQ ID NO: 186707 - DNA, 25 bp, Rattus norvegicus
atcttattgacgacgcttggcggga

SEQ ID NO: 186708 - DNA, 25 bp, Rattus norvegicus
atcttattgacgtcgcttggcggga

SEQ ID NO: 186709 - DNA, 25 bp, Rattus norvegicus
atcttatttattctacatacccggg

SEQ ID NO: 186710 - DNA, 25 bp, Rattus norvegicus
atcttatttattgtacatacccggg

SEQ ID NO: 186711 - DNA, 25 bp, Rattus norvegicus
atcttcaacagacacattccctggc

SEQ ID NO: 186712 - DNA, 25 bp, Rattus norvegicus
atcttcaacagagacattccctggc

SEQ ID NO: 186713 - DNA, 25 bp, Rattus norvegicus
atcttcaaccttatctagttctgta

SEQ ID NO: 186714 - DNA, 25 bp, Rattus norvegicus
atcttcaaccttttctagttctgta

SEQ ID NO: 186715 - DNA, 25 bp, Rattus norvegicus
atcttcaacttactcttgcatcctc

SEQ ID NO: 186716 - DNA, 25 bp, Rattus norvegicus
atcttcaacttagtcttgcatcctc

SEQ ID NO: 186717 - DNA, 25 bp, Rattus norvegicus
atcttcaacttcatggattcaggtt

SEQ ID NO: 186718 - DNA, 25 bp, Rattus norvegicus
atcttcaacttcttggattcaggtt

SEQ ID NO: 186719 - DNA, 25 bp, Rattus norvegicus
atcttcaaggccctgcaggtgcgca

SEQ ID NO: 186720 - DNA, 25 bp, Rattus norvegicus
atcttcaaggccgtgcaggtgcgca

SEQ ID NO: 186721 - DNA, 25 bp, Rattus norvegicus
atcttcaatgagactttcgcctttg

SEQ ID NO: 186722 - DNA, 25 bp, Rattus norvegicus
atcttcaatgagtctttcgcctttg

SEQ ID NO: 186723 - DNA, 25 bp, Rattus norvegicus
atcttcacacccaaggctggtagca

SEQ ID NO: 186724 - DNA, 25 bp, Rattus norvegicus
atcttcacaccctaggctggtagca

SEQ ID NO: 186725 - DNA, 25 bp, Rattus norvegicus
atcttcacaggcctatttcatttgt

SEQ ID NO: 186726 - DNA, 25 bp, Rattus norvegicus
atcttcacaggcgtatttcatttgt

SEQ ID NO: 186727 - DNA, 25 bp, Rattus norvegicus
atcttcaccagcagctaccggagaa

SEQ ID NO: 186728 - DNA, 25 bp, Rattus norvegicus
atcttcaccagctgctaccggagaa

SEQ ID NO: 186729 - DNA, 25 bp, Rattus norvegicus
atcttcacccaaagttggacaccgg

SEQ ID NO: 186730 - DNA, 25 bp, Rattus norvegicus
atcttcacccaatgttggacaccgg

SEQ ID NO: 186731 - DNA, 25 bp, Rattus norvegicus
atcttcacccacaggtggtactcta

SEQ ID NO: 186732 - DNA, 25 bp, Rattus norvegicus
atcttcacccactggtggtactcta

SEQ ID NO: 186733 - DNA, 25 bp, Rattus norvegicus
atcttcacccagaagcgccatgatg

SEQ ID NO: 186734 - DNA, 25 bp, Rattus norvegicus
atcttcacccagaggatggccagga

SEQ ID NO: 186735 - DNA, 25 bp, Rattus norvegicus
atcttcacccagtagcgccatgatg

SEQ ID NO: 186736 - DNA, 25 bp, Rattus norvegicus
atcttcacccagtggatggccagga

SEQ ID NO: 186737 - DNA, 25 bp, Rattus norvegicus
atcttcaccggaatccagctagtgg

SEQ ID NO: 186738 - DNA, 25 bp, Rattus norvegicus
atcttcaccggattccagctagtgg

SEQ ID NO: 186739 - DNA, 25 bp, Rattus norvegicus
atcttcacgctgacctttgtttgct

SEQ ID NO: 186740 - DNA, 25 bp, Rattus norvegicus
atcttcacgctgtcctttgtttgct

SEQ ID NO: 186741 - DNA, 25 bp, Rattus norvegicus
atcttcacgttgatggtatatctcc

SEQ ID NO: 186742 - DNA, 25 bp, Rattus norvegicus
atcttcacgttgttggtatatctcc

SEQ ID NO: 186743 - DNA, 25 bp, Rattus norvegicus
atcttcactaacctctgtcctgttt

SEQ ID NO: 186744 - DNA, 25 bp, Rattus norvegicus
atcttcactaacgtctgtcctgttt

SEQ ID NO: 186745 - DNA, 25 bp, Rattus norvegicus
atcttcactaatacattggttggca

SEQ ID NO: 186746 - DNA, 25 bp, Rattus norvegicus
atcttcactaattcattggttggca

SEQ ID NO: 186747 - DNA, 25 bp, Rattus norvegicus
atcttcactgcaactaccttcacat

SEQ ID NO: 186748 - DNA, 25 bp, Rattus norvegicus
atcttcactgcatctaccttcacat

SEQ ID NO: 186749 - DNA, 25 bp, Rattus norvegicus
atcttcactgtacaattgcccttgt

SEQ ID NO: 186750 - DNA, 25 bp, Rattus norvegicus
atcttcactgtagaattgcccttgt

SEQ ID NO: 186751 - DNA, 25 bp, Rattus norvegicus
atcttcagactgagcggcaccggga

SEQ ID NO: 186752 - DNA, 25 bp, Rattus norvegicus
atcttcagactgtgcggcaccggga

SEQ ID NO: 186753 - DNA, 25 bp, Rattus norvegicus
atcttcagatacataggagcctacg

SEQ ID NO: 186754 - DNA, 25 bp, Rattus norvegicus
atcttcagatacttaggagcctacg

SEQ ID NO: 186755 - DNA, 25 bp, Rattus norvegicus
atcttcagattccttggcactggta

SEQ ID NO: 186756 - DNA, 25 bp, Rattus norvegicus
atcttcagattcgttggcactggta

SEQ ID NO: 186757 - DNA, 25 bp, Rattus norvegicus
atcttcagcatgagccataggcctg

SEQ ID NO: 186758 - DNA, 25 bp, Rattus norvegicus
atcttcagcatgtgccataggcctg

SEQ ID NO: 186759 - DNA, 25 bp, Rattus norvegicus
atcttcagcctcaccaagggaaaca

SEQ ID NO: 186760 - DNA, 25 bp, Rattus norvegicus
atcttcagcctctccaagggaaaca

SEQ ID NO: 186761 - DNA, 25 bp, Rattus norvegicus
atcttcagcttcaccgaattcagtg

SEQ ID NO: 186762 - DNA, 25 bp, Rattus norvegicus
atcttcagcttctccgaattcagtg

SEQ ID NO: 186763 - DNA, 25 bp, Rattus norvegicus
atcttcaggcatccctggagctcag

SEQ ID NO: 186764 - DNA, 25 bp, Rattus norvegicus
atcttcaggcatgcctggagctcag

SEQ ID NO: 186765 - DNA, 25 bp, Rattus norvegicus
atcttcagggatcctgttggctcgt

SEQ ID NO: 186766 - DNA, 25 bp, Rattus norvegicus
atcttcagggatgctgttggctcgt

SEQ ID NO: 186767 - DNA, 25 bp, Rattus norvegicus
atcttcagtgacctctaacttgcta

SEQ ID NO: 186768 - DNA, 25 bp, Rattus norvegicus
atcttcagtgacgtctaacttgcta

SEQ ID NO: 186769 - DNA, 25 bp, Rattus norvegicus
atcttcatagatacacacaccacac

SEQ ID NO: 186770 - DNA, 25 bp, Rattus norvegicus
atcttcatagattcacacaccacac

SEQ ID NO: 186771 - DNA, 25 bp, Rattus norvegicus
atcttcatcatgcacatcttcaagc

SEQ ID NO: 186772 - DNA, 25 bp, Rattus norvegicus
atcttcatcatggacatcttcaagc

SEQ ID NO: 186773 - DNA, 25 bp, Rattus norvegicus
atcttcatccccaagcagagtgaaa

SEQ ID NO: 186774 - DNA, 25 bp, Rattus norvegicus
atcttcatcccctagcagagtgaaa

SEQ ID NO: 186775 - DNA, 25 bp, Rattus norvegicus
atcttcatcgtaatttcctgggcca

SEQ ID NO: 186776 - DNA, 25 bp, Rattus norvegicus
atcttcatcgtattttcctgggcca

SEQ ID NO: 186777 - DNA, 25 bp, Rattus norvegicus
atcttcatctcgcacattatatcag

SEQ ID NO: 186778 - DNA, 25 bp, Rattus norvegicus
atcttcatctcggacattatatcag

SEQ ID NO: 186779 - DNA, 25 bp, Rattus norvegicus
atcttcatctctagtgtttcatcca

SEQ ID NO: 186780 - DNA, 25 bp, Rattus norvegicus
atcttcatctcttgtgtttcatcca

SEQ ID NO: 186781 - DNA, 25 bp, Rattus norvegicus
atcttcatcttcattctggtcaagt

SEQ ID NO: 186782 - DNA, 25 bp, Rattus norvegicus
atcttcatcttctttctggtcaagt

SEQ ID NO: 186783 - DNA, 25 bp, Rattus norvegicus
atcttcatgaagacaaactcctctt

SEQ ID NO: 186784 - DNA, 25 bp, Rattus norvegicus
atcttcatgaagcgcgcgacccgcg

SEQ ID NO: 186785 - DNA, 25 bp, Rattus norvegicus
atcttcatgaagggcgcgacccgcg

SEQ ID NO: 186786 - DNA, 25 bp, Rattus norvegicus
atcttcatgaagtcaaactcctctt

SEQ ID NO: 186787 - DNA, 25 bp, Rattus norvegicus
atcttcattccccagtagtgttcat

SEQ ID NO: 186788 - DNA, 25 bp, Rattus norvegicus
atcttcattcccgagtagtgttcat

SEQ ID NO: 186789 - DNA, 25 bp, Rattus norvegicus
atcttccaaaccatatggtcctgtt

SEQ ID NO: 186790 - DNA, 25 bp, Rattus norvegicus
atcttccaaaccttatggtcctgtt

SEQ ID NO: 186791 - DNA, 25 bp, Rattus norvegicus
atcttccaaatgacttaaactgcta

SEQ ID NO: 186792 - DNA, 25 bp, Rattus norvegicus
atcttccaaatgtcttaaactgcta

SEQ ID NO: 186793 - DNA, 25 bp, Rattus norvegicus
atcttccaagccattcagacattca

SEQ ID NO: 186794 - DNA, 25 bp, Rattus norvegicus
atcttccaagcctttcagacattca

SEQ ID NO: 186795 - DNA, 25 bp, Rattus norvegicus
atcttccactggcatgtaaagagcc

SEQ ID NO: 186796 - DNA, 25 bp, Rattus norvegicus
atcttccactgggatgtaaagagcc

SEQ ID NO: 186797 - DNA, 25 bp, Rattus norvegicus
atcttccagcaccttcctagcttgg

SEQ ID NO: 186798 - DNA, 25 bp, Rattus norvegicus
atcttccagcacgttcctagcttgg

SEQ ID NO: 186799 - DNA, 25 bp, Rattus norvegicus
atcttccaggacactcgggtatcaa

SEQ ID NO: 186800 - DNA, 25 bp, Rattus norvegicus
atcttccaggactctcgggtatcaa

SEQ ID NO: 186801 - DNA, 25 bp, Rattus norvegicus
atcttccaggagaaccccgatgaga

SEQ ID NO: 186802 - DNA, 25 bp, Rattus norvegicus
atcttccaggagtaccccgatgaga

SEQ ID NO: 186803 - DNA, 25 bp, Rattus norvegicus
atcttccagtcacagcgtggccgct

SEQ ID NO: 186804 - DNA, 25 bp, Rattus norvegicus
atcttccagtcagagcgtggccgct

SEQ ID NO: 186805 - DNA, 25 bp, Rattus norvegicus
atcttccatgtcaactggttccgga

SEQ ID NO: 186806 - DNA, 25 bp, Rattus norvegicus
atcttccatgtctactggttccgga

SEQ ID NO: 186807 - DNA, 25 bp, Rattus norvegicus
atcttccatgttcgtgtaacagccc

SEQ ID NO: 186808 - DNA, 25 bp, Rattus norvegicus
atcttccatgttggtgtaacagccc

SEQ ID NO: 186809 - DNA, 25 bp, Rattus norvegicus
atcttccatttgctctacaagccac

SEQ ID NO: 186810 - DNA, 25 bp, Rattus norvegicus
atcttccatttggtctacaagccac

SEQ ID NO: 186811 - DNA, 25 bp, Rattus norvegicus
atcttcccactgaaatgttgcacct

SEQ ID NO: 186812 - DNA, 25 bp, Rattus norvegicus
atcttcccactgtaatgttgcacct

SEQ ID NO: 186813 - DNA, 25 bp, Rattus norvegicus
atcttcccacttccagagagggcag

SEQ ID NO: 186814 - DNA, 25 bp, Rattus norvegicus
atcttcccacttgcagagagggcag

SEQ ID NO: 186815 - DNA, 25 bp, Rattus norvegicus
atcttcccagccaagcagtgggatt

SEQ ID NO: 186816 - DNA, 25 bp, Rattus norvegicus
atcttcccagcctagcagtgggatt

SEQ ID NO: 186817 - DNA, 25 bp, Rattus norvegicus
atcttcccaggtaaacaaatgctaa

SEQ ID NO: 186818 - DNA, 25 bp, Rattus norvegicus
atcttcccaggttaacaaatgctaa

SEQ ID NO: 186819 - DNA, 25 bp, Rattus norvegicus
atcttcccatggagaaattctctag

SEQ ID NO: 186820 - DNA, 25 bp, Rattus norvegicus
atcttcccatggtgaaattctctag

SEQ ID NO: 186821 - DNA, 25 bp, Rattus norvegicus
atcttcccctcccatgtgggtcatg

SEQ ID NO: 186822 - DNA, 25 bp, Rattus norvegicus
atcttcccctccgatgtgggtcatg

SEQ ID NO: 186823 - DNA, 25 bp, Rattus norvegicus
atcttccctggactggactgaactg

SEQ ID NO: 186824 - DNA, 25 bp, Rattus norvegicus
atcttccctggagtggactgaactg

SEQ ID NO: 186825 - DNA, 25 bp, Rattus norvegicus
atcttccctgtccactggcagtttg

SEQ ID NO: 186826 - DNA, 25 bp, Rattus norvegicus
atcttccctgtcgactggcagtttg

SEQ ID NO: 186827 - DNA, 25 bp, Rattus norvegicus
atcttccgagaaccagagctgctgt

SEQ ID NO: 186828 - DNA, 25 bp, Rattus norvegicus
atcttccgagaagcagagctgctgt

SEQ ID NO: 186829 - DNA, 25 bp, Rattus norvegicus
atcttccgctgactgcatcttgtat

SEQ ID NO: 186830 - DNA, 25 bp, Rattus norvegicus
atcttccgctgagtgcatcttgtat

SEQ ID NO: 186831 - DNA, 25 bp, Rattus norvegicus
atcttccgggagaactcactgattg

SEQ ID NO: 186832 - DNA, 25 bp, Rattus norvegicus
atcttccgggagatctccactgatg

SEQ ID NO: 186833 - DNA, 25 bp, Rattus norvegicus
atcttccgggagcaagtgcgcctca

SEQ ID NO: 186834 - DNA, 25 bp, Rattus norvegicus
atcttccgggaggaagtgcgcctca

SEQ ID NO: 186835 - DNA, 25 bp, Rattus norvegicus
atcttccgggagtactcactgattg

SEQ ID NO: 186836 - DNA, 25 bp, Rattus norvegicus
atcttccgggagttctccactgatg

SEQ ID NO: 186837 - DNA, 25 bp, Rattus norvegicus
atcttccgtggcacatcaaattgtg

SEQ ID NO: 186838 - DNA, 25 bp, Rattus norvegicus
atcttccgtggctcatcaaattgtg

SEQ ID NO: 186839 - DNA, 25 bp, Rattus norvegicus
atcttccgtttcaactccagtacaa

SEQ ID NO: 186840 - DNA, 25 bp, Rattus norvegicus
atcttccgtttctactccagtacaa

SEQ ID NO: 186841 - DNA, 25 bp, Rattus norvegicus
atcttcctacctaagggcgtacttg

SEQ ID NO: 186842 - DNA, 25 bp, Rattus norvegicus
atcttcctaccttagggcgtacttg

SEQ ID NO: 186843 - DNA, 25 bp, Rattus norvegicus
atcttcctattgcagttctccaaag

SEQ ID NO: 186844 - DNA, 25 bp, Rattus norvegicus
atcttcctattggagttctccaaag

SEQ ID NO: 186845 - DNA, 25 bp, Rattus norvegicus
atcttcctcaaaccactgatcacta

SEQ ID NO: 186846 - DNA, 25 bp, Rattus norvegicus
atcttcctcaaagcactgatcacta

SEQ ID NO: 186847 - DNA, 25 bp, Rattus norvegicus
atcttcctcatcaacgtgctggaaa

SEQ ID NO: 186848 - DNA, 25 bp, Rattus norvegicus
atcttcctcatctacgtgctggaaa

SEQ ID NO: 186849 - DNA, 25 bp, Rattus norvegicus
atcttcctcccaccaaggtgatgag

SEQ ID NO: 186850 - DNA, 25 bp, Rattus norvegicus
atcttcctcccagcaaggtgatgag

SEQ ID NO: 186851 - DNA, 25 bp, Rattus norvegicus
atcttcctccttagctgtgtgttga

SEQ ID NO: 186852 - DNA, 25 bp, Rattus norvegicus
atcttcctcctttgctgtgtgttga

SEQ ID NO: 186853 - DNA, 25 bp, Rattus norvegicus
atcttcctctctccaaatttcaatc

SEQ ID NO: 186854 - DNA, 25 bp, Rattus norvegicus
atcttcctctctgcaaatttcaatc

SEQ ID NO: 186855 - DNA, 25 bp, Rattus norvegicus
atcttcctgaacacactgttgcgtt

SEQ ID NO: 186856 - DNA, 25 bp, Rattus norvegicus
atcttcctgaactcactgttgcgtt

SEQ ID NO: 186857 - DNA, 25 bp, Rattus norvegicus
atcttcctgagaaggccggagcaga

SEQ ID NO: 186858 - DNA, 25 bp, Rattus norvegicus
atcttcctgagatggccggagcaga

SEQ ID NO: 186859 - DNA, 25 bp, Rattus norvegicus
atcttcctgagtcggcagcttccta

SEQ ID NO: 186860 - DNA, 25 bp, Rattus norvegicus
atcttcctgagtgggcagcttccta

SEQ ID NO: 186861 - DNA, 25 bp, Rattus norvegicus
atcttcctgatgctcgtggacctgg

SEQ ID NO: 186862 - DNA, 25 bp, Rattus norvegicus
atcttcctgatggtcgtggacctgg

SEQ ID NO: 186863 - DNA, 25 bp, Rattus norvegicus
atcttcctgcgtagaatctgttgct

SEQ ID NO: 186864 - DNA, 25 bp, Rattus norvegicus
atcttcctgcgttgaatctgttgct

SEQ ID NO: 186865 - DNA, 25 bp, Rattus norvegicus
atcttcctgctcattatcatctttt

SEQ ID NO: 186866 - DNA, 25 bp, Rattus norvegicus
atcttcctgctctttatcatctttt

SEQ ID NO: 186867 - DNA, 25 bp, Rattus norvegicus
atcttcctgctgatgatcagtttgt

SEQ ID NO: 186868 - DNA, 25 bp, Rattus norvegicus
atcttcctgctgttgatcagtttgt

SEQ ID NO: 186869 - DNA, 25 bp, Rattus norvegicus
atcttcctgcttagactcggatgaa

SEQ ID NO: 186870 - DNA, 25 bp, Rattus norvegicus
atcttcctgcttcactcatgagtgg

SEQ ID NO: 186871 - DNA, 25 bp, Rattus norvegicus
atcttcctgcttgactcatgagtgg

SEQ ID NO: 186872 - DNA, 25 bp, Rattus norvegicus
atcttcctgctttgactcggatgaa

SEQ ID NO: 186873 - DNA, 25 bp, Rattus norvegicus
atcttcctggatactccaccatttt

SEQ ID NO: 186874 - DNA, 25 bp, Rattus norvegicus
atcttcctggattctccaccatttt

SEQ ID NO: 186875 - DNA, 25 bp, Rattus norvegicus
atcttcctggcactaagtcctgagg

SEQ ID NO: 186876 - DNA, 25 bp, Rattus norvegicus
atcttcctggcacttacataggagt

SEQ ID NO: 186877 - DNA, 25 bp, Rattus norvegicus
atcttcctggcagtaagtcctgagg

SEQ ID NO: 186878 - DNA, 25 bp, Rattus norvegicus
atcttcctggcagttacataggagt

SEQ ID NO: 186879 - DNA, 25 bp, Rattus norvegicus
atcttcctggctagttcaagcttga

SEQ ID NO: 186880 - DNA, 25 bp, Rattus norvegicus
atcttcctggcttgttcaagcttga

SEQ ID NO: 186881 - DNA, 25 bp, Rattus norvegicus
atcttccttattatcccctatggca

SEQ ID NO: 186882 - DNA, 25 bp, Rattus norvegicus
atcttccttattttcccctatggca

SEQ ID NO: 186883 - DNA, 25 bp, Rattus norvegicus
atcttccttccacatttctctttta

SEQ ID NO: 186884 - DNA, 25 bp, Rattus norvegicus
atcttccttccagatttctctttta

SEQ ID NO: 186885 - DNA, 25 bp, Rattus norvegicus
atcttccttctactttatctgtcaa

SEQ ID NO: 186886 - DNA, 25 bp, Rattus norvegicus
atcttccttctagtttatctgtcaa

SEQ ID NO: 186887 - DNA, 25 bp, Rattus norvegicus
atcttccttggccagcatagcatgg

SEQ ID NO: 186888 - DNA, 25 bp, Rattus norvegicus
atcttccttggcgagcatagcatgg

SEQ ID NO: 186889 - DNA, 25 bp, Rattus norvegicus
atcttccttgtgatttccattagtt

SEQ ID NO: 186890 - DNA, 25 bp, Rattus norvegicus
atcttccttgtgttttccattagtt

SEQ ID NO: 186891 - DNA, 25 bp, Rattus norvegicus
atcttcctttcaattgtgccgcatg

SEQ ID NO: 186892 - DNA, 25 bp, Rattus norvegicus
atcttcctttcatttgtgccgcatg

SEQ ID NO: 186893 - DNA, 25 bp, Rattus norvegicus
atcttcctttgcaggcccatggaaa

SEQ ID NO: 186894 - DNA, 25 bp, Rattus norvegicus
atcttcctttgctggcccatggaaa

SEQ ID NO: 186895 - DNA, 25 bp, Rattus norvegicus
atcttcgaagatccccacgtgtaaa

SEQ ID NO: 186896 - DNA, 25 bp, Rattus norvegicus
atcttcgaagatgcccacgtgtaaa

SEQ ID NO: 186897 - DNA, 25 bp, Rattus norvegicus
atcttcgaaggcatgagaaaactca

SEQ ID NO: 186898 - DNA, 25 bp, Rattus norvegicus
atcttcgaaggcttgagaaaactca

SEQ ID NO: 186899 - DNA, 25 bp, Rattus norvegicus
atcttcgacatgactctttcttcat

SEQ ID NO: 186900 - DNA, 25 bp, Rattus norvegicus
atcttcgacatgtctctttcttcat

SEQ ID NO: 186901 - DNA, 25 bp, Rattus norvegicus
atcttcgagggtcgcctgcctgcca

SEQ ID NO: 186902 - DNA, 25 bp, Rattus norvegicus
atcttcgagggtggcctgcctgcca

SEQ ID NO: 186903 - DNA, 25 bp, Rattus norvegicus
atcttcgccaacatgctgggcgtgt

SEQ ID NO: 186904 - DNA, 25 bp, Rattus norvegicus
atcttcgccaacttgctgggcgtgt

SEQ ID NO: 186905 - DNA, 25 bp, Rattus norvegicus
atcttcgccatcacggacaagttga

SEQ ID NO: 186906 - DNA, 25 bp, Rattus norvegicus
atcttcgccatctcggacaagttga

SEQ ID NO: 186907 - DNA, 25 bp, Rattus norvegicus
atcttcgcgatgctaactgagctga

SEQ ID NO: 186908 - DNA, 25 bp, Rattus norvegicus
atcttcgcgatggtaactgagctga

SEQ ID NO: 186909 - DNA, 25 bp, Rattus norvegicus
atcttcgctatcacctggttcttta

SEQ ID NO: 186910 - DNA, 25 bp, Rattus norvegicus
atcttcgctatctcctggttcttta

SEQ ID NO: 186911 - DNA, 25 bp, Rattus norvegicus
atcttcggcaagatcatccgcaaag

SEQ ID NO: 186912 - DNA, 25 bp, Rattus norvegicus
atcttcggcaagttcatccgcaaag

SEQ ID NO: 186913 - DNA, 25 bp, Rattus norvegicus
atcttcggcttcagtttcaagggcg

SEQ ID NO: 186914 - DNA, 25 bp, Rattus norvegicus
atcttcggcttctgtttcaagggcg

SEQ ID NO: 186915 - DNA, 25 bp, Rattus norvegicus
atcttcgggaagatcattcgcaagg

SEQ ID NO: 186916 - DNA, 25 bp, Rattus norvegicus
atcttcgggaagttcattcgcaagg

SEQ ID NO: 186917 - DNA, 25 bp, Rattus norvegicus
atcttcgtgggacactcagcagtgg

SEQ ID NO: 186918 - DNA, 25 bp, Rattus norvegicus
atcttcgtgggagactcagcagtgg

SEQ ID NO: 186919 - DNA, 25 bp, Rattus norvegicus
atcttcgtgtatcgcaccctgaagc

SEQ ID NO: 186920 - DNA, 25 bp, Rattus norvegicus
atcttcgtgtatggcaccctgaagc

SEQ ID NO: 186921 - DNA, 25 bp, Rattus norvegicus
atcttcgttttgatcactttgtgga

SEQ ID NO: 186922 - DNA, 25 bp, Rattus norvegicus
atcttcgttttgttcactttgtgga

SEQ ID NO: 186923 - DNA, 25 bp, Rattus norvegicus
atcttctaaaaaatcttcacttttg

SEQ ID NO: 186924 - DNA, 25 bp, Rattus norvegicus
atcttctaaaaattcttcacttttg

SEQ ID NO: 186925 - DNA, 25 bp, Rattus norvegicus
atcttctaatgtctcaccctgatta

SEQ ID NO: 186926 - DNA, 25 bp, Rattus norvegicus
atcttctaatgtgtcaccctgatta

SEQ ID NO: 186927 - DNA, 25 bp, Rattus norvegicus
atcttctacaatcccgatgacatgt

SEQ ID NO: 186928 - DNA, 25 bp, Rattus norvegicus
atcttctacaatgccgatgacatgt

SEQ ID NO: 186929 - DNA, 25 bp, Rattus norvegicus
atcttctaccgtctcataggctgag

SEQ ID NO: 186930 - DNA, 25 bp, Rattus norvegicus
atcttctaccgtgtcataggctgag

SEQ ID NO: 186931 - DNA, 25 bp, Rattus norvegicus
atcttctcaactcctttatcaaaca

SEQ ID NO: 186932 - DNA, 25 bp, Rattus norvegicus
atcttctcaactgctttatcaaaca

SEQ ID NO: 186933 - DNA, 25 bp, Rattus norvegicus
atcttctcaagcacttttgatccca

SEQ ID NO: 186934 - DNA, 25 bp, Rattus norvegicus
atcttctcaagctcttttgatccca

SEQ ID NO: 186935 - DNA, 25 bp, Rattus norvegicus
atcttctcacctattcttgtactaa

SEQ ID NO: 186936 - DNA, 25 bp, Rattus norvegicus
atcttctcaccttttcttgtactaa

SEQ ID NO: 186937 - DNA, 25 bp, Rattus norvegicus
atcttctcagaacacactacgtaca

SEQ ID NO: 186938 - DNA, 25 bp, Rattus norvegicus
atcttctcagaagacactacgtaca

SEQ ID NO: 186939 - DNA, 25 bp, Rattus norvegicus
atcttctcagtcaggcacgtgggaa

SEQ ID NO: 186940 - DNA, 25 bp, Rattus norvegicus
atcttctcagtctggcacgtgggaa

SEQ ID NO: 186941 - DNA, 25 bp, Rattus norvegicus
atcttctccagcaccaggaactaaa

SEQ ID NO: 186942 - DNA, 25 bp, Rattus norvegicus
atcttctccagctccaggaactaaa

SEQ ID NO: 186943 - DNA, 25 bp, Rattus norvegicus
atcttctcccttctctattttaaag

SEQ ID NO: 186944 - DNA, 25 bp, Rattus norvegicus
atcttctcccttgtctattttaaag

SEQ ID NO: 186945 - DNA, 25 bp, Rattus norvegicus
atcttctcctccacttgaagaagca

SEQ ID NO: 186946 - DNA, 25 bp, Rattus norvegicus
atcttctcctcctcttgaagaagca

SEQ ID NO: 186947 - DNA, 25 bp, Rattus norvegicus
atcttctcgaaaatcactgatgtca

SEQ ID NO: 186948 - DNA, 25 bp, Rattus norvegicus
atcttctcgaaattcactgatgtca

SEQ ID NO: 186949 - DNA, 25 bp, Rattus norvegicus
atcttctcgccaattggctctcagt

SEQ ID NO: 186950 - DNA, 25 bp, Rattus norvegicus
atcttctcgccatttggctctcagt

SEQ ID NO: 186951 - DNA, 25 bp, Rattus norvegicus
atcttctcgctgctgggagtggacc

SEQ ID NO: 186952 - DNA, 25 bp, Rattus norvegicus
atcttctcgctggtgggagtggacc

SEQ ID NO: 186953 - DNA, 25 bp, Rattus norvegicus
atcttctctactaatgatcatttgg

SEQ ID NO: 186954 - DNA, 25 bp, Rattus norvegicus
atcttctctacttatgatcatttgg

SEQ ID NO: 186955 - DNA, 25 bp, Rattus norvegicus
atcttctctagcatagcattgtgtg

SEQ ID NO: 186956 - DNA, 25 bp, Rattus norvegicus
atcttctctagcttagcattgtgtg

SEQ ID NO: 186957 - DNA, 25 bp, Rattus norvegicus
atcttctctattagcactaattttg

SEQ ID NO: 186958 - DNA, 25 bp, Rattus norvegicus
atcttctctatttgcactaattttg

SEQ ID NO: 186959 - DNA, 25 bp, Rattus norvegicus
atcttctctcctctggaaagctaag

SEQ ID NO: 186960 - DNA, 25 bp, Rattus norvegicus
atcttctctcctgtggaaagctaag

SEQ ID NO: 186961 - DNA, 25 bp, Rattus norvegicus
atcttctctgacagagtctagaccc

SEQ ID NO: 186962 - DNA, 25 bp, Rattus norvegicus
atcttctctgactgagtctagaccc

SEQ ID NO: 186963 - DNA, 25 bp, Rattus norvegicus
atcttctctgtcagcaccatgagag

SEQ ID NO: 186964 - DNA, 25 bp, Rattus norvegicus
atcttctctgtctgcaccatgagag

SEQ ID NO: 186965 - DNA, 25 bp, Rattus norvegicus
atcttctctgttcatcccctgacta

SEQ ID NO: 186966 - DNA, 25 bp, Rattus norvegicus
atcttctctgttgatcccctgacta

SEQ ID NO: 186967 - DNA, 25 bp, Rattus norvegicus
atcttctgaaccaagaccaactggc

SEQ ID NO: 186968 - DNA, 25 bp, Rattus norvegicus
atcttctgaacctagaccaactggc

SEQ ID NO: 186969 - DNA, 25 bp, Rattus norvegicus
atcttctgaactctgggatggacat

SEQ ID NO: 186970 - DNA, 25 bp, Rattus norvegicus
atcttctgaactgtgggatggacat

SEQ ID NO: 186971 - DNA, 25 bp, Rattus norvegicus
atcttctgaagtctccatttccatg

SEQ ID NO: 186972 - DNA, 25 bp, Rattus norvegicus
atcttctgaagtgtccatttccatg

SEQ ID NO: 186973 - DNA, 25 bp, Rattus norvegicus
atcttctgagccattgccaatgatg

SEQ ID NO: 186974 - DNA, 25 bp, Rattus norvegicus
atcttctgagcctttgccaatgatg

SEQ ID NO: 186975 - DNA, 25 bp, Rattus norvegicus
atcttctgagtgacctcactgttat

SEQ ID NO: 186976 - DNA, 25 bp, Rattus norvegicus
atcttctgagtgtcctcactgttat

SEQ ID NO: 186977 - DNA, 25 bp, Rattus norvegicus
atcttctgagttacctagcttctgg

SEQ ID NO: 186978 - DNA, 25 bp, Rattus norvegicus
atcttctgagtttcctagcttctgg

SEQ ID NO: 186979 - DNA, 25 bp, Rattus norvegicus
atcttctgatctctctaagtctgca

SEQ ID NO: 186980 - DNA, 25 bp, Rattus norvegicus
atcttctgatctgtctaagtctgca

SEQ ID NO: 186981 - DNA, 25 bp, Rattus norvegicus
atcttctgcactatcataatcggag

SEQ ID NO: 186982 - DNA, 25 bp, Rattus norvegicus
atcttctgcactttcataatcggag

SEQ ID NO: 186983 - DNA, 25 bp, Rattus norvegicus
atcttctgcaggctttgcttctggc

SEQ ID NO: 186984 - DNA, 25 bp, Rattus norvegicus
atcttctgcagggtttgcttctggc

SEQ ID NO: 186985 - DNA, 25 bp, Rattus norvegicus
atcttctgccacagttgattcatca

SEQ ID NO: 186986 - DNA, 25 bp, Rattus norvegicus
atcttctgccactgttgattcatca

SEQ ID NO: 186987 - DNA, 25 bp, Rattus norvegicus
atcttctgcccactcaaaccaagaa

SEQ ID NO: 186988 - DNA, 25 bp, Rattus norvegicus
atcttctgcccagtcaaaccaagaa

SEQ ID NO: 186989 - DNA, 25 bp, Rattus norvegicus
atcttctgccttagatcatttctgg

SEQ ID NO: 186990 - DNA, 25 bp, Rattus norvegicus
atcttctgcctttgatcatttctgg

SEQ ID NO: 186991 - DNA, 25 bp, Rattus norvegicus
atcttctggaggctgaatgtcaccc

SEQ ID NO: 186992 - DNA, 25 bp, Rattus norvegicus
atcttctggagggtgaatgtcaccc

SEQ ID NO: 186993 - DNA, 25 bp, Rattus norvegicus
atcttctggcctcggagtgaccaag

SEQ ID NO: 186994 - DNA, 25 bp, Rattus norvegicus
atcttctggcctgggagtgaccaag

SEQ ID NO: 186995 - DNA, 25 bp, Rattus norvegicus
atcttctggctactagaggcacctg

SEQ ID NO: 186996 - DNA, 25 bp, Rattus norvegicus
atcttctggctagtagaggcacctg

SEQ ID NO: 186997 - DNA, 25 bp, Rattus norvegicus
atcttctgtgtgcaatgccttggta

SEQ ID NO: 186998 - DNA, 25 bp, Rattus norvegicus
atcttctgtgtggaatgccttggta

SEQ ID NO: 186999 - DNA, 25 bp, Rattus norvegicus
atcttctgttacatcggtctgtgag

SEQ ID NO: 187000 - DNA, 25 bp, Rattus norvegicus
atcttctgttacttcggtctgtgag

SEQ ID NO: 187001 - DNA, 25 bp, Rattus norvegicus
atcttcttacgtaatccgtctggag

SEQ ID NO: 187002 - DNA, 25 bp, Rattus norvegicus
atcttcttacgttatccgtctggag

SEQ ID NO: 187003 - DNA, 25 bp, Rattus norvegicus
atcttcttagacagtgacgttcctg

SEQ ID NO: 187004 - DNA, 25 bp, Rattus norvegicus
atcttcttagactgtgacgttcctg

SEQ ID NO: 187005 - DNA, 25 bp, Rattus norvegicus
atcttcttcaagacaataagctgag

SEQ ID NO: 187006 - DNA, 25 bp, Rattus norvegicus
atcttcttcaagtcaataagctgag

SEQ ID NO: 187007 - DNA, 25 bp, Rattus norvegicus
atcttcttcattcagagacgcccaa

SEQ ID NO: 187008 - DNA, 25 bp, Rattus norvegicus
atcttcttcattgagagacgcccaa

SEQ ID NO: 187009 - DNA, 25 bp, Rattus norvegicus
atcttcttccaaatgtatgcctcgg

SEQ ID NO: 187010 - DNA, 25 bp, Rattus norvegicus
atcttcttccaattgtatgcctcgg

SEQ ID NO: 187011 - DNA, 25 bp, Rattus norvegicus
atcttcttccacctttgaaaccaga

SEQ ID NO: 187012 - DNA, 25 bp, Rattus norvegicus
atcttcttccacgtttgaaaccaga

SEQ ID NO: 187013 - DNA, 25 bp, Rattus norvegicus
atcttcttcctcagactggcagact

SEQ ID NO: 187014 - DNA, 25 bp, Rattus norvegicus
atcttcttcctctgactggcagact

SEQ ID NO: 187015 - DNA, 25 bp, Rattus norvegicus
atcttcttcctgagactcggaacct

SEQ ID NO: 187016 - DNA, 25 bp, Rattus norvegicus
atcttcttcctgtgactcggaacct

SEQ ID NO: 187017 - DNA, 25 bp, Rattus norvegicus
atcttcttctctactatgggcagta

SEQ ID NO: 187018 - DNA, 25 bp, Rattus norvegicus
atcttcttctcttctatgggcagta

SEQ ID NO: 187019 - DNA, 25 bp, Rattus norvegicus
atcttcttgacactcttttccaatg

SEQ ID NO: 187020 - DNA, 25 bp, Rattus norvegicus
atcttcttgacagtcttttccaatg

SEQ ID NO: 187021 - DNA, 25 bp, Rattus norvegicus
atcttcttggatctgagctgctatt

SEQ ID NO: 187022 - DNA, 25 bp, Rattus norvegicus
atcttcttggatgtgagctgctatt

SEQ ID NO: 187023 - DNA, 25 bp, Rattus norvegicus
atcttcttggccatcgtcctgtttc

SEQ ID NO: 187024 - DNA, 25 bp, Rattus norvegicus
atcttcttggccttcgtcctgtttc

SEQ ID NO: 187025 - DNA, 25 bp, Rattus norvegicus
atcttcttgggaatcaacactttgg

SEQ ID NO: 187026 - DNA, 25 bp, Rattus norvegicus
atcttcttgggattcaacactttgg

SEQ ID NO: 187027 - DNA, 25 bp, Rattus norvegicus
atcttctttagaagcactgctctct

SEQ ID NO: 187028 - DNA, 25 bp, Rattus norvegicus
atcttctttagatgcactgctctct

SEQ ID NO: 187029 - DNA, 25 bp, Rattus norvegicus
atcttctttattcagtttcagtcaa

SEQ ID NO: 187030 - DNA, 25 bp, Rattus norvegicus
atcttctttattgagtttcagtcaa

SEQ ID NO: 187031 - DNA, 25 bp, Rattus norvegicus
atcttctttgcgacatgcttacggc

SEQ ID NO: 187032 - DNA, 25 bp, Rattus norvegicus
atcttctttgcgtcatgcttacggc

SEQ ID NO: 187033 - DNA, 25 bp, Rattus norvegicus
atcttcttttcccaccaacaaaatg

SEQ ID NO: 187034 - DNA, 25 bp, Rattus norvegicus
atcttcttttccgaccaacaaaatg

SEQ ID NO: 187035 - DNA, 25 bp, Rattus norvegicus
atcttctttttaaatggcaaccagc

SEQ ID NO: 187036 - DNA, 25 bp, Rattus norvegicus
atcttctttttatatggcaaccagc

SEQ ID NO: 187037 - DNA, 25 bp, Rattus norvegicus
atcttgaaaaatcccaccgtccgat

SEQ ID NO: 187038 - DNA, 25 bp, Rattus norvegicus
atcttgaaaaatgccaccgtccgat

SEQ ID NO: 187039 - DNA, 25 bp, Rattus norvegicus
atcttgaaaagccaccacttatctt

SEQ ID NO: 187040 - DNA, 25 bp, Rattus norvegicus
atcttgaaaagcgaccacttatctt

SEQ ID NO: 187041 - DNA, 25 bp, Rattus norvegicus
atcttgaaactcacggcctgggtgc

SEQ ID NO: 187042 - DNA, 25 bp, Rattus norvegicus
atcttgaaactctcggcctgggtgc

SEQ ID NO: 187043 - DNA, 25 bp, Rattus norvegicus
atcttgaaactgaagtgtggacctc

SEQ ID NO: 187044 - DNA, 25 bp, Rattus norvegicus
atcttgaaactgtagtgtggacctc

SEQ ID NO: 187045 - DNA, 25 bp, Rattus norvegicus
atcttgaagctgcagactctctttc

SEQ ID NO: 187046 - DNA, 25 bp, Rattus norvegicus
atcttgaagctggagactctctttc

SEQ ID NO: 187047 - DNA, 25 bp, Rattus norvegicus
atcttgaatcccaactggcgttgct

SEQ ID NO: 187048 - DNA, 25 bp, Rattus norvegicus
atcttgaatccctactggcgttgct

SEQ ID NO: 187049 - DNA, 25 bp, Rattus norvegicus
atcttgaatgcaactttggatgaaa

SEQ ID NO: 187050 - DNA, 25 bp, Rattus norvegicus
atcttgaatgcatctttggatgaaa

SEQ ID NO: 187051 - DNA, 25 bp, Rattus norvegicus
atcttgaccgtgctaactgtgtgta

SEQ ID NO: 187052 - DNA, 25 bp, Rattus norvegicus
atcttgaccgtggtaactgtgtgta

SEQ ID NO: 187053 - DNA, 25 bp, Rattus norvegicus
atcttgacctcacccttctagttgg

SEQ ID NO: 187054 - DNA, 25 bp, Rattus norvegicus
atcttgacctcagccttctagttgg

SEQ ID NO: 187055 - DNA, 25 bp, Rattus norvegicus
atcttgaccttccagggagatgtca

SEQ ID NO: 187056 - DNA, 25 bp, Rattus norvegicus
atcttgaccttcgagggagatgtca

SEQ ID NO: 187057 - DNA, 25 bp, Rattus norvegicus
atcttgacggatccgttcagctgga

SEQ ID NO: 187058 - DNA, 25 bp, Rattus norvegicus
atcttgacggatgcgttcagctgga

SEQ ID NO: 187059 - DNA, 25 bp, Rattus norvegicus
atcttgactgagctttcattttctg

SEQ ID NO: 187060 - DNA, 25 bp, Rattus norvegicus
atcttgactgaggtttcattttctg

SEQ ID NO: 187061 - DNA, 25 bp, Rattus norvegicus
atcttgactgtcaacttctttggac

SEQ ID NO: 187062 - DNA, 25 bp, Rattus norvegicus
atcttgactgtctacttctttggac

SEQ ID NO: 187063 - DNA, 25 bp, Rattus norvegicus
atcttgagacctagtggagttccca

SEQ ID NO: 187064 - DNA, 25 bp, Rattus norvegicus
atcttgagaccttgtggagttccca

SEQ ID NO: 187065 - DNA, 25 bp, Rattus norvegicus
atcttgagacgaaaccttttggttt

SEQ ID NO: 187066 - DNA, 25 bp, Rattus norvegicus
atcttgagacgataccttttggttt

SEQ ID NO: 187067 - DNA, 25 bp, Rattus norvegicus
atcttgagagatatcccacaggcca

SEQ ID NO: 187068 - DNA, 25 bp, Rattus norvegicus
atcttgagagatttcccacaggcca

SEQ ID NO: 187069 - DNA, 25 bp, Rattus norvegicus
atcttgagcaccacgagggcttgca

SEQ ID NO: 187070 - DNA, 25 bp, Rattus norvegicus
atcttgagcacctcgagggcttgca

SEQ ID NO: 187071 - DNA, 25 bp, Rattus norvegicus
atcttgaggagcagtgctagcccca

SEQ ID NO: 187072 - DNA, 25 bp, Rattus norvegicus
atcttgaggagctgtgctagcccca

SEQ ID NO: 187073 - DNA, 25 bp, Rattus norvegicus
atcttgagggcgcatctgcttagga

SEQ ID NO: 187074 - DNA, 25 bp, Rattus norvegicus
atcttgagggcggatctgcttagga

SEQ ID NO: 187075 - DNA, 25 bp, Rattus norvegicus
atcttgagtgatctgagctgaattt

SEQ ID NO: 187076 - DNA, 25 bp, Rattus norvegicus
atcttgagtgatgtgagctgaattt

SEQ ID NO: 187077 - DNA, 25 bp, Rattus norvegicus
atcttgatagagcttacctcctggg

SEQ ID NO: 187078 - DNA, 25 bp, Rattus norvegicus
atcttgatagaggttacctcctggg

SEQ ID NO: 187079 - DNA, 25 bp, Rattus norvegicus
atcttgatccacaagggcgatctgg

SEQ ID NO: 187080 - DNA, 25 bp, Rattus norvegicus
atcttgatccactagggcgatctgg

SEQ ID NO: 187081 - DNA, 25 bp, Rattus norvegicus
atcttgatggtgactcctaaccttt

SEQ ID NO: 187082 - DNA, 25 bp, Rattus norvegicus
atcttgatggtgtctcctaaccttt

SEQ ID NO: 187083 - DNA, 25 bp, Rattus norvegicus
atcttgatgtcaatcgaggccttcc

SEQ ID NO: 187084 - DNA, 25 bp, Rattus norvegicus
atcttgatgtcattcgaggccttcc

SEQ ID NO: 187085 - DNA, 25 bp, Rattus norvegicus
atcttgattggtagctctttcttct

SEQ ID NO: 187086 - DNA, 25 bp, Rattus norvegicus
atcttgattggttgctctttcttct

SEQ ID NO: 187087 - DNA, 25 bp, Rattus norvegicus
atcttgcaagcaaatcctctttctt

SEQ ID NO: 187088 - DNA, 25 bp, Rattus norvegicus
atcttgcaagcaccagagcccacag

SEQ ID NO: 187089 - DNA, 25 bp, Rattus norvegicus
atcttgcaagcagcagagcccacag

SEQ ID NO: 187090 - DNA, 25 bp, Rattus norvegicus
atcttgcaagcatatcctctttctt

SEQ ID NO: 187091 - DNA, 25 bp, Rattus norvegicus
atcttgccactgaagtcctgtgtga

SEQ ID NO: 187092 - DNA, 25 bp, Rattus norvegicus
atcttgccactgtagtcctgtgtga

SEQ ID NO: 187093 - DNA, 25 bp, Rattus norvegicus
atcttgccagcccttaaagtttcag

SEQ ID NO: 187094 - DNA, 25 bp, Rattus norvegicus
atcttgccagccgttaaagtttcag

SEQ ID NO: 187095 - DNA, 25 bp, Rattus norvegicus
atcttgccccacctggttaagatga

SEQ ID NO: 187096 - DNA, 25 bp, Rattus norvegicus
atcttgccccacgtggttaagatga

SEQ ID NO: 187097 - DNA, 25 bp, Rattus norvegicus
atcttgccctggcaagggtcttggt

SEQ ID NO: 187098 - DNA, 25 bp, Rattus norvegicus
atcttgccctgggaagggtcttggt

SEQ ID NO: 187099 - DNA, 25 bp, Rattus norvegicus
atcttgccgaagatagccgttgcca

SEQ ID NO: 187100 - DNA, 25 bp, Rattus norvegicus
atcttgccgaagttagccgttgcca

SEQ ID NO: 187101 - DNA, 25 bp, Rattus norvegicus
atcttgccgtggataatttgtacaa

SEQ ID NO: 187102 - DNA, 25 bp, Rattus norvegicus
atcttgccgtggttaatttgtacaa

SEQ ID NO: 187103 - DNA, 25 bp, Rattus norvegicus
atcttgcctatgagaccagcatggg

SEQ ID NO: 187104 - DNA, 25 bp, Rattus norvegicus
atcttgcctatgtgaccagcatggg

SEQ ID NO: 187105 - DNA, 25 bp, Rattus norvegicus
atcttgcctggaatactagtccttc

SEQ ID NO: 187106 - DNA, 25 bp, Rattus norvegicus
atcttgcctggattactagtccttc

SEQ ID NO: 187107 - DNA, 25 bp, Rattus norvegicus
atcttgcctggtcgactggactgga

SEQ ID NO: 187108 - DNA, 25 bp, Rattus norvegicus
atcttgcctggtggactggactgga

SEQ ID NO: 187109 - DNA, 25 bp, Rattus norvegicus
atcttgccttgcctgggattttatc

SEQ ID NO: 187110 - DNA, 25 bp, Rattus norvegicus
atcttgccttgcgtgggattttatc

SEQ ID NO: 187111 - DNA, 25 bp, Rattus norvegicus
atcttgctaggcagtgtaggaggac

SEQ ID NO: 187112 - DNA, 25 bp, Rattus norvegicus
atcttgctaggctgtgtaggaggac

SEQ ID NO: 187113 - DNA, 25 bp, Rattus norvegicus
atcttgctcaggaattagtcggtat

SEQ ID NO: 187114 - DNA, 25 bp, Rattus norvegicus
atcttgctcaggtattagtcggtat

SEQ ID NO: 187115 - DNA, 25 bp, Rattus norvegicus
atcttgctccaccagattccttgag

SEQ ID NO: 187116 - DNA, 25 bp, Rattus norvegicus
atcttgctccacgagattccttgag

SEQ ID NO: 187117 - DNA, 25 bp, Rattus norvegicus
atcttgctgcataaacttaccatcc

SEQ ID NO: 187118 - DNA, 25 bp, Rattus norvegicus
atcttgctgcattaacttaccatcc

SEQ ID NO: 187119 - DNA, 25 bp, Rattus norvegicus
atcttgctgcccacattgaaacatt

SEQ ID NO: 187120 - DNA, 25 bp, Rattus norvegicus
atcttgctgccctcattgaaacatt

SEQ ID NO: 187121 - DNA, 25 bp, Rattus norvegicus
atcttgctggccctttagttttgtt

SEQ ID NO: 187122 - DNA, 25 bp, Rattus norvegicus
atcttgctggccgtttagttttgtt

SEQ ID NO: 187123 - DNA, 25 bp, Rattus norvegicus
atcttgctggctcggaatactggtc

SEQ ID NO: 187124 - DNA, 25 bp, Rattus norvegicus
atcttgctggctgggaatactggtc

SEQ ID NO: 187125 - DNA, 25 bp, Rattus norvegicus
atcttgctgggtatggcttgctcca

SEQ ID NO: 187126 - DNA, 25 bp, Rattus norvegicus
atcttgctgggtttggcttgctcca

SEQ ID NO: 187127 - DNA, 25 bp, Rattus norvegicus
atcttgcttactctttcccactgta

SEQ ID NO: 187128 - DNA, 25 bp, Rattus norvegicus
atcttgcttactgtttcccactgta

SEQ ID NO: 187129 - DNA, 25 bp, Rattus norvegicus
atcttgctttctagaaacttcttgg

SEQ ID NO: 187130 - DNA, 25 bp, Rattus norvegicus
atcttgctttcttgaaacttcttgg

SEQ ID NO: 187131 - DNA, 25 bp, Rattus norvegicus
atcttggagataatctgtctactta

SEQ ID NO: 187132 - DNA, 25 bp, Rattus norvegicus
atcttggagatattctgtctactta

SEQ ID NO: 187133 - DNA, 25 bp, Rattus norvegicus
atcttggatttgactgaggcccgct

SEQ ID NO: 187134 - DNA, 25 bp, Rattus norvegicus
atcttggatttgtctgaggcccgct

SEQ ID NO: 187135 - DNA, 25 bp, Rattus norvegicus
atcttggcaccacagcgggcctgga

SEQ ID NO: 187136 - DNA, 25 bp, Rattus norvegicus
atcttggcaccagagcgggcctgga

SEQ ID NO: 187137 - DNA, 25 bp, Rattus norvegicus
atcttggcactgatcacggctcttc

SEQ ID NO: 187138 - DNA, 25 bp, Rattus norvegicus
atcttggcactgttcacggctcttc

SEQ ID NO: 187139 - DNA, 25 bp, Rattus norvegicus
atcttggccagcaggattggttcta

SEQ ID NO: 187140 - DNA, 25 bp, Rattus norvegicus
atcttggccagctggattggttcta

SEQ ID NO: 187141 - DNA, 25 bp, Rattus norvegicus
atcttggcctatagagaacatctct

SEQ ID NO: 187142 - DNA, 25 bp, Rattus norvegicus
atcttggcctattgagaacatctct

SEQ ID NO: 187143 - DNA, 25 bp, Rattus norvegicus
atcttggctcatcaactgagggcct

SEQ ID NO: 187144 - DNA, 25 bp, Rattus norvegicus
atcttggctcatgaactgagggcct

SEQ ID NO: 187145 - DNA, 25 bp, Rattus norvegicus
atcttggctgtgaactctcatgtat

SEQ ID NO: 187146 - DNA, 25 bp, Rattus norvegicus
atcttggctgtgtactctcatgtat

SEQ ID NO: 187147 - DNA, 25 bp, Rattus norvegicus
atcttgggaagcaccttaggactta

SEQ ID NO: 187148 - DNA, 25 bp, Rattus norvegicus
atcttgggaagctccttaggactta

SEQ ID NO: 187149 - DNA, 25 bp, Rattus norvegicus
atcttgggacaaacctagcctaaag

SEQ ID NO: 187150 - DNA, 25 bp, Rattus norvegicus
atcttgggacaatcctagcctaaag

SEQ ID NO: 187151 - DNA, 25 bp, Rattus norvegicus
atcttgggacctcaaacactgcaaa

SEQ ID NO: 187152 - DNA, 25 bp, Rattus norvegicus
atcttgggacctgaaacactgcaaa

SEQ ID NO: 187153 - DNA, 25 bp, Rattus norvegicus
atcttgggagaacctctgtgctcat

SEQ ID NO: 187154 - DNA, 25 bp, Rattus norvegicus
atcttgggagaagctctgtgctcat

SEQ ID NO: 187155 - DNA, 25 bp, Rattus norvegicus
atcttgggccctagatatgctttaa

SEQ ID NO: 187156 - DNA, 25 bp, Rattus norvegicus
atcttgggcccttgatatgctttaa

SEQ ID NO: 187157 - DNA, 25 bp, Rattus norvegicus
atcttgggtctaatactctatctcc

SEQ ID NO: 187158 - DNA, 25 bp, Rattus norvegicus
atcttgggtctattactctatctcc

SEQ ID NO: 187159 - DNA, 25 bp, Rattus norvegicus
atcttgggtctgcaaagccttggcc

SEQ ID NO: 187160 - DNA, 25 bp, Rattus norvegicus
atcttgggtctggaaagccttggcc

SEQ ID NO: 187161 - DNA, 25 bp, Rattus norvegicus
atcttggtaaacctgaggctgcctg

SEQ ID NO: 187162 - DNA, 25 bp, Rattus norvegicus
atcttggtaaacgtgaggctgcctg

SEQ ID NO: 187163 - DNA, 25 bp, Rattus norvegicus
atcttggtacttctttttcctctgc

SEQ ID NO: 187164 - DNA, 25 bp, Rattus norvegicus
atcttggtacttgtttttcctctgc

SEQ ID NO: 187165 - DNA, 25 bp, Rattus norvegicus
atcttggtctcgaaaggatccgttc

SEQ ID NO: 187166 - DNA, 25 bp, Rattus norvegicus
atcttggtctcgtaaggatccgttc

SEQ ID NO: 187167 - DNA, 25 bp, Rattus norvegicus
atcttggtcttcatgctgcccacca

SEQ ID NO: 187168 - DNA, 25 bp, Rattus norvegicus
atcttggtcttcttgctgcccacca

SEQ ID NO: 187169 - DNA, 25 bp, Rattus norvegicus
atcttggtgacacaagagcccctgc

SEQ ID NO: 187170 - DNA, 25 bp, Rattus norvegicus
atcttggtgacagaagagcccctgc

SEQ ID NO: 187171 - DNA, 25 bp, Rattus norvegicus
atcttggtgagtatccggctagctg

SEQ ID NO: 187172 - DNA, 25 bp, Rattus norvegicus
atcttggtgagtttccggctagctg

SEQ ID NO: 187173 - DNA, 25 bp, Rattus norvegicus
atcttggtgattatactatagtctt

SEQ ID NO: 187174 - DNA, 25 bp, Rattus norvegicus
atcttggtgattttactatagtctt

SEQ ID NO: 187175 - DNA, 25 bp, Rattus norvegicus
atcttggtgccactcatgaaccgag

SEQ ID NO: 187176 - DNA, 25 bp, Rattus norvegicus
atcttggtgccagtcatgaaccgag

SEQ ID NO: 187177 - DNA, 25 bp, Rattus norvegicus
atcttggttctcagccagcctgagt

SEQ ID NO: 187178 - DNA, 25 bp, Rattus norvegicus
atcttggttctctgccagcctgagt

SEQ ID NO: 187179 - DNA, 25 bp, Rattus norvegicus
atcttggttttgcatggtgctggct

SEQ ID NO: 187180 - DNA, 25 bp, Rattus norvegicus
atcttggttttggatggtgctggct

SEQ ID NO: 187181 - DNA, 25 bp, Rattus norvegicus
atcttgtacctaccacagtattgtt

SEQ ID NO: 187182 - DNA, 25 bp, Rattus norvegicus
atcttgtacctagcacagtattgtt

SEQ ID NO: 187183 - DNA, 25 bp, Rattus norvegicus
atcttgtactgaccatggacatcat

SEQ ID NO: 187184 - DNA, 25 bp, Rattus norvegicus
atcttgtactgagcatggacatcat

SEQ ID NO: 187185 - DNA, 25 bp, Rattus norvegicus
atcttgtagcgaaggttctggaacc

SEQ ID NO: 187186 - DNA, 25 bp, Rattus norvegicus
atcttgtagcgatggttctggaacc

SEQ ID NO: 187187 - DNA, 25 bp, Rattus norvegicus
atcttgtatattattaagtgtgcca

SEQ ID NO: 187188 - DNA, 25 bp, Rattus norvegicus
atcttgtatatttttaagtgtgcca

SEQ ID NO: 187189 - DNA, 25 bp, Rattus norvegicus
atcttgtattatacattagttggag

SEQ ID NO: 187190 - DNA, 25 bp, Rattus norvegicus
atcttgtattattcattagttggag

SEQ ID NO: 187191 - DNA, 25 bp, Rattus norvegicus
atcttgtcaacactgcatcgtctcc

SEQ ID NO: 187192 - DNA, 25 bp, Rattus norvegicus
atcttgtcaacagtgcatcgtctcc

SEQ ID NO: 187193 - DNA, 25 bp, Rattus norvegicus
atcttgtcacaaaccacttaacgaa

SEQ ID NO: 187194 - DNA, 25 bp, Rattus norvegicus
atcttgtcacaatccacttaacgaa

SEQ ID NO: 187195 - DNA, 25 bp, Rattus norvegicus
atcttgtcacctaatctgtcaaacc

SEQ ID NO: 187196 - DNA, 25 bp, Rattus norvegicus
atcttgtcaccttatctgtcaaacc

SEQ ID NO: 187197 - DNA, 25 bp, Rattus norvegicus
atcttgtcactcactcctggaaaac

SEQ ID NO: 187198 - DNA, 25 bp, Rattus norvegicus
atcttgtcactctctcctggaaaac

SEQ ID NO: 187199 - DNA, 25 bp, Rattus norvegicus
atcttgtcacttcgactacctgtct

SEQ ID NO: 187200 - DNA, 25 bp, Rattus norvegicus
atcttgtcacttggactacctgtct

SEQ ID NO: 187201 - DNA, 25 bp, Rattus norvegicus
atcttgtcagagagccttgctccaa

SEQ ID NO: 187202 - DNA, 25 bp, Rattus norvegicus
atcttgtcagagtgccttgctccaa

SEQ ID NO: 187203 - DNA, 25 bp, Rattus norvegicus
atcttgtcaggaagctactcactgc

SEQ ID NO: 187204 - DNA, 25 bp, Rattus norvegicus
atcttgtcaggatgctactcactgc

SEQ ID NO: 187205 - DNA, 25 bp, Rattus norvegicus
atcttgtcattacccacgcaggtgc

SEQ ID NO: 187206 - DNA, 25 bp, Rattus norvegicus
atcttgtcattagccacgcaggtgc

SEQ ID NO: 187207 - DNA, 25 bp, Rattus norvegicus
atcttgtcccataacctgtttgtgt

SEQ ID NO: 187208 - DNA, 25 bp, Rattus norvegicus
atcttgtcccattacctgtttgtgt

SEQ ID NO: 187209 - DNA, 25 bp, Rattus norvegicus
atcttgtccgtgaagatgtattgcc

SEQ ID NO: 187210 - DNA, 25 bp, Rattus norvegicus
atcttgtccgtgtagatgtattgcc

SEQ ID NO: 187211 - DNA, 25 bp, Rattus norvegicus
atcttgtctgctctactggactgct

SEQ ID NO: 187212 - DNA, 25 bp, Rattus norvegicus
atcttgtctgctgtactggactgct

SEQ ID NO: 187213 - DNA, 25 bp, Rattus norvegicus
atcttgtctgtgcactgttcgacca

SEQ ID NO: 187214 - DNA, 25 bp, Rattus norvegicus
atcttgtctgtggactgttcgacca

SEQ ID NO: 187215 - DNA, 25 bp, Rattus norvegicus
atcttgtctgttatttcaggcctca

SEQ ID NO: 187216 - DNA, 25 bp, Rattus norvegicus
atcttgtctgttttttcaggcctca

SEQ ID NO: 187217 - DNA, 25 bp, Rattus norvegicus
atcttgtgctgcaccaaatgttctt

SEQ ID NO: 187218 - DNA, 25 bp, Rattus norvegicus
atcttgtgctgctccaaatgttctt

SEQ ID NO: 187219 - DNA, 25 bp, Rattus norvegicus
atcttgtggcttagacagagtcctg

SEQ ID NO: 187220 - DNA, 25 bp, Rattus norvegicus
atcttgtggctttgacagagtcctg

SEQ ID NO: 187221 - DNA, 25 bp, Rattus norvegicus
atcttgtgggccagggttcgaatcc

SEQ ID NO: 187222 - DNA, 25 bp, Rattus norvegicus
atcttgtgggcctgggttcgaatcc

SEQ ID NO: 187223 - DNA, 25 bp, Rattus norvegicus
atcttgtgtgatcattctctgcatt

SEQ ID NO: 187224 - DNA, 25 bp, Rattus norvegicus
atcttgtgtgatgattctctgcatt

SEQ ID NO: 187225 - DNA, 25 bp, Rattus norvegicus
atcttgttcagcattcttcttgcct

SEQ ID NO: 187226 - DNA, 25 bp, Rattus norvegicus
atcttgttcagctttcttcttgcct

SEQ ID NO: 187227 - DNA, 25 bp, Rattus norvegicus
atcttgttctgtcgatttttcctct

SEQ ID NO: 187228 - DNA, 25 bp, Rattus norvegicus
atcttgttctgtggatttttcctct

SEQ ID NO: 187229 - DNA, 25 bp, Rattus norvegicus
atcttgttgatgaattgactatgcc

SEQ ID NO: 187230 - DNA, 25 bp, Rattus norvegicus
atcttgttgatgtattgactatgcc

SEQ ID NO: 187231 - DNA, 25 bp, Rattus norvegicus
atcttgttgccaatggtacccaagt

SEQ ID NO: 187232 - DNA, 25 bp, Rattus norvegicus
atcttgttgccattggtacccaagt

SEQ ID NO: 187233 - DNA, 25 bp, Rattus norvegicus
atcttgtttcctacctgtcggacga

SEQ ID NO: 187234 - DNA, 25 bp, Rattus norvegicus
atcttgtttccttcctgtcggacga

SEQ ID NO: 187235 - DNA, 25 bp, Rattus norvegicus
atcttgtttgttactgtcattccca

SEQ ID NO: 187236 - DNA, 25 bp, Rattus norvegicus
atcttgtttgtttctgtcattccca

SEQ ID NO: 187237 - DNA, 25 bp, Rattus norvegicus
atcttgttttccatatgtgttgctg

SEQ ID NO: 187238 - DNA, 25 bp, Rattus norvegicus
atcttgttttccttatgtgttgctg

SEQ ID NO: 187239 - DNA, 25 bp, Rattus norvegicus
atcttgttttgtctcttccctactg

SEQ ID NO: 187240 - DNA, 25 bp, Rattus norvegicus
atcttgttttgtgtcttccctactg

SEQ ID NO: 187241 - DNA, 25 bp, Rattus norvegicus
atctttaaaactcctgtcttcctag

SEQ ID NO: 187242 - DNA, 25 bp, Rattus norvegicus
atctttaaaactgctgtcttcctag

SEQ ID NO: 187243 - DNA, 25 bp, Rattus norvegicus
atctttaagagtacgtgactggcac

SEQ ID NO: 187244 - DNA, 25 bp, Rattus norvegicus
atctttaagagttcgtgactggcac

SEQ ID NO: 187245 - DNA, 25 bp, Rattus norvegicus
atctttaaggctacgtcctcttcta

SEQ ID NO: 187246 - DNA, 25 bp, Rattus norvegicus
atctttaaggcttcgtcctcttcta

SEQ ID NO: 187247 - DNA, 25 bp, Rattus norvegicus
atctttaatcccataattttggtgg

SEQ ID NO: 187248 - DNA, 25 bp, Rattus norvegicus
atctttaatcccttaattttggtgg

SEQ ID NO: 187249 - DNA, 25 bp, Rattus norvegicus
atctttacaacacgcacagtgctga

SEQ ID NO: 187250 - DNA, 25 bp, Rattus norvegicus
atctttacaacaggcacagtgctga

SEQ ID NO: 187251 - DNA, 25 bp, Rattus norvegicus
atctttacaaggagggagtgtgtcc

SEQ ID NO: 187252 - DNA, 25 bp, Rattus norvegicus
atctttacaaggtgggagtgtgtcc

SEQ ID NO: 187253 - DNA, 25 bp, Rattus norvegicus
atctttaccgttatgtttgtataat

SEQ ID NO: 187254 - DNA, 25 bp, Rattus norvegicus
atctttaccgttttgtttgtataat

SEQ ID NO: 187255 - DNA, 25 bp, Rattus norvegicus
atctttacctcacctttagggcctc

SEQ ID NO: 187256 - DNA, 25 bp, Rattus norvegicus
atctttacctcagctttagggcctc

SEQ ID NO: 187257 - DNA, 25 bp, Rattus norvegicus
atctttacctcgattgttggtatca

SEQ ID NO: 187258 - DNA, 25 bp, Rattus norvegicus
atctttacctcgtttgttggtatca

SEQ ID NO: 187259 - DNA, 25 bp, Rattus norvegicus
atctttactcagaacaagctcctcc

SEQ ID NO: 187260 - DNA, 25 bp, Rattus norvegicus
atctttactcagcacatcctcatta

SEQ ID NO: 187261 - DNA, 25 bp, Rattus norvegicus
atctttactcaggacatcctcatta

SEQ ID NO: 187262 - DNA, 25 bp, Rattus norvegicus
atctttactcagtacaagctcctcc

SEQ ID NO: 187263 - DNA, 25 bp, Rattus norvegicus
atctttagcatgacccagttctcaa

SEQ ID NO: 187264 - DNA, 25 bp, Rattus norvegicus
atctttagcatgtcccagttctcaa

SEQ ID NO: 187265 - DNA, 25 bp, Rattus norvegicus
atctttaggatcaaccgtggtgcat

SEQ ID NO: 187266 - DNA, 25 bp, Rattus norvegicus
atctttaggatctaccgtggtgcat

SEQ ID NO: 187267 - DNA, 25 bp, Rattus norvegicus
atctttagggccaaggacacctagc

SEQ ID NO: 187268 - DNA, 25 bp, Rattus norvegicus
atctttagggcctaggacacctagc

SEQ ID NO: 187269 - DNA, 25 bp, Rattus norvegicus
atctttatcggcagggcagggtctg

SEQ ID NO: 187270 - DNA, 25 bp, Rattus norvegicus
atctttatcggctgggcagggtctg

SEQ ID NO: 187271 - DNA, 25 bp, Rattus norvegicus
atctttatgctcagtgacagccctg

SEQ ID NO: 187272 - DNA, 25 bp, Rattus norvegicus
atctttatgctctgtgacagccctg

SEQ ID NO: 187273 - DNA, 25 bp, Rattus norvegicus
atctttatgggtctagtggatggct

SEQ ID NO: 187274 - DNA, 25 bp, Rattus norvegicus
atctttatgggtgtagtggatggct

SEQ ID NO: 187275 - DNA, 25 bp, Rattus norvegicus
atctttattcttacgatatttgcag

SEQ ID NO: 187276 - DNA, 25 bp, Rattus norvegicus
atctttattctttcgatatttgcag

SEQ ID NO: 187277 - DNA, 25 bp, Rattus norvegicus
atctttcaatataccattatgcagc

SEQ ID NO: 187278 - DNA, 25 bp, Rattus norvegicus
atctttcaatattccattatgcagc

SEQ ID NO: 187279 - DNA, 25 bp, Rattus norvegicus
atctttcaccaacagaccagaggct

SEQ ID NO: 187280 - DNA, 25 bp, Rattus norvegicus
atctttcaccaagagaccagaggct

SEQ ID NO: 187281 - DNA, 25 bp, Rattus norvegicus
atctttcagcttcccagtgagaggc

SEQ ID NO: 187282 - DNA, 25 bp, Rattus norvegicus
atctttcagcttgccagtgagaggc

SEQ ID NO: 187283 - DNA, 25 bp, Rattus norvegicus
atctttcaggccatgaatctgggag

SEQ ID NO: 187284 - DNA, 25 bp, Rattus norvegicus
atctttcaggccatggatccggagg

SEQ ID NO: 187285 - DNA, 25 bp, Rattus norvegicus
atctttcaggccttgaatctgggag

SEQ ID NO: 187286 - DNA, 25 bp, Rattus norvegicus
atctttcaggccttggatccggagg

SEQ ID NO: 187287 - DNA, 25 bp, Rattus norvegicus
atctttcatgccagggacaccaagt

SEQ ID NO: 187288 - DNA, 25 bp, Rattus norvegicus
atctttcatgcctgggacaccaagt

SEQ ID NO: 187289 - DNA, 25 bp, Rattus norvegicus
atctttccaagacctgcctaaatac

SEQ ID NO: 187290 - DNA, 25 bp, Rattus norvegicus
atctttccaagagctgcctaaatac

SEQ ID NO: 187291 - DNA, 25 bp, Rattus norvegicus
atctttccaggaattccaggctcag

SEQ ID NO: 187292 - DNA, 25 bp, Rattus norvegicus
atctttccaggatttccaggctcag

SEQ ID NO: 187293 - DNA, 25 bp, Rattus norvegicus
atctttcccatgctacatttctgta

SEQ ID NO: 187294 - DNA, 25 bp, Rattus norvegicus
atctttcccatggtacatttctgta

SEQ ID NO: 187295 - DNA, 25 bp, Rattus norvegicus
atctttccgatgctacaatgaattt

SEQ ID NO: 187296 - DNA, 25 bp, Rattus norvegicus
atctttccgatggtacaatgaattt

SEQ ID NO: 187297 - DNA, 25 bp, Rattus norvegicus
atctttccgctacactgtttcttcg

SEQ ID NO: 187298 - DNA, 25 bp, Rattus norvegicus
atctttccgctagactgtttcttcg

SEQ ID NO: 187299 - DNA, 25 bp, Rattus norvegicus
atctttccggctcgctgaattttat

SEQ ID NO: 187300 - DNA, 25 bp, Rattus norvegicus
atctttccggctggctgaattttat

SEQ ID NO: 187301 - DNA, 25 bp, Rattus norvegicus
atctttccgggtctggctctctgag

SEQ ID NO: 187302 - DNA, 25 bp, Rattus norvegicus
atctttccgggtgtggctctctgag

SEQ ID NO: 187303 - DNA, 25 bp, Rattus norvegicus
atctttccgtctcctgtgaggagga

SEQ ID NO: 187304 - DNA, 25 bp, Rattus norvegicus
atctttccgtctgctgtgaggagga

SEQ ID NO: 187305 - DNA, 25 bp, Rattus norvegicus
atctttcctactagagcacccaatg

SEQ ID NO: 187306 - DNA, 25 bp, Rattus norvegicus
atctttcctacttgagcacccaatg

SEQ ID NO: 187307 - DNA, 25 bp, Rattus norvegicus
atctttcctgaaatgtctttgtaaa

SEQ ID NO: 187308 - DNA, 25 bp, Rattus norvegicus
atctttcctgaattgtctttgtaaa

SEQ ID NO: 187309 - DNA, 25 bp, Rattus norvegicus
atctttcctgagctggacgctggaa

SEQ ID NO: 187310 - DNA, 25 bp, Rattus norvegicus
atctttcctgaggtggacgctggaa

SEQ ID NO: 187311 - DNA, 25 bp, Rattus norvegicus
atctttcctgcaaagtctggcatgg

SEQ ID NO: 187312 - DNA, 25 bp, Rattus norvegicus
atctttcctgcatagtctggcatgg

SEQ ID NO: 187313 - DNA, 25 bp, Rattus norvegicus
atctttccttatcgagagtgtcctt

SEQ ID NO: 187314 - DNA, 25 bp, Rattus norvegicus
atctttccttatggagagtgtcctt

SEQ ID NO: 187315 - DNA, 25 bp, Rattus norvegicus
atctttccttttatatcccatcagt

SEQ ID NO: 187316 - DNA, 25 bp, Rattus norvegicus
atctttccttttttatcccatcagt

SEQ ID NO: 187317 - DNA, 25 bp, Rattus norvegicus
atctttcgacatcctgttttccaac

SEQ ID NO: 187318 - DNA, 25 bp, Rattus norvegicus
atctttcgacatgctgttttccaac

SEQ ID NO: 187319 - DNA, 25 bp, Rattus norvegicus
atctttcgccggcattctgacctaa

SEQ ID NO: 187320 - DNA, 25 bp, Rattus norvegicus
atctttcgccgggattctgacctaa

SEQ ID NO: 187321 - DNA, 25 bp, Rattus norvegicus
atctttcggaatcttgagctcgttc

SEQ ID NO: 187322 - DNA, 25 bp, Rattus norvegicus
atctttcggaatgttgagctcgttc

SEQ ID NO: 187323 - DNA, 25 bp, Rattus norvegicus
atctttcggtgcactggccatgtta

SEQ ID NO: 187324 - DNA, 25 bp, Rattus norvegicus
atctttcggtgctctggccatgtta

SEQ ID NO: 187325 - DNA, 25 bp, Rattus norvegicus
atctttctaagtagtggctgctgca

SEQ ID NO: 187326 - DNA, 25 bp, Rattus norvegicus
atctttctaagttgtggctgctgca

SEQ ID NO: 187327 - DNA, 25 bp, Rattus norvegicus
atctttctagtcatttctgctctta

SEQ ID NO: 187328 - DNA, 25 bp, Rattus norvegicus
atctttctagtcttttctgctctta

SEQ ID NO: 187329 - DNA, 25 bp, Rattus norvegicus
atctttctctgactgcacgtgcatt

SEQ ID NO: 187330 - DNA, 25 bp, Rattus norvegicus
atctttctctgagtgcacgtgcatt

SEQ ID NO: 187331 - DNA, 25 bp, Rattus norvegicus
atctttctctgtattcacaaggccc

SEQ ID NO: 187332 - DNA, 25 bp, Rattus norvegicus
atctttctctgttttcacaaggccc

SEQ ID NO: 187333 - DNA, 25 bp, Rattus norvegicus
atctttctcttcaacattgtccgca

SEQ ID NO: 187334 - DNA, 25 bp, Rattus norvegicus
atctttctcttctacattgtccgca

SEQ ID NO: 187335 - DNA, 25 bp, Rattus norvegicus
atctttctgcctcaagttcgactcc

SEQ ID NO: 187336 - DNA, 25 bp, Rattus norvegicus
atctttctgcctctgcttctggtag

SEQ ID NO: 187337 - DNA, 25 bp, Rattus norvegicus
atctttctgcctgaagttcgactcc

SEQ ID NO: 187338 - DNA, 25 bp, Rattus norvegicus
atctttctgcctgtgcttctggtag

SEQ ID NO: 187339 - DNA, 25 bp, Rattus norvegicus
atctttctgtacagccagcctgtag

SEQ ID NO: 187340 - DNA, 25 bp, Rattus norvegicus
atctttctgtactgccagcctgtag

SEQ ID NO: 187341 - DNA, 25 bp, Rattus norvegicus
atctttctgtggaatgtctctggac

SEQ ID NO: 187342 - DNA, 25 bp, Rattus norvegicus
atctttctgtggtatgtctctggac

SEQ ID NO: 187343 - DNA, 25 bp, Rattus norvegicus
atctttcttattaagctcctgtgta

SEQ ID NO: 187344 - DNA, 25 bp, Rattus norvegicus
atctttcttatttagctcctgtgta

SEQ ID NO: 187345 - DNA, 25 bp, Rattus norvegicus
atctttcttcaccaactgtactgct

SEQ ID NO: 187346 - DNA, 25 bp, Rattus norvegicus
atctttcttcacgaactgtactgct

SEQ ID NO: 187347 - DNA, 25 bp, Rattus norvegicus
atctttgaaatcagcacttgcccac

SEQ ID NO: 187348 - DNA, 25 bp, Rattus norvegicus
atctttgaaatctgcacttgcccac

SEQ ID NO: 187349 - DNA, 25 bp, Rattus norvegicus
atctttgaaatgactccttggtaat

SEQ ID NO: 187350 - DNA, 25 bp, Rattus norvegicus
atctttgaaatgtctccttggtaat

SEQ ID NO: 187351 - DNA, 25 bp, Rattus norvegicus
atctttgaatttcttcctacaggga

SEQ ID NO: 187352 - DNA, 25 bp, Rattus norvegicus
atctttgaatttgttcctacaggga

SEQ ID NO: 187353 - DNA, 25 bp, Rattus norvegicus
atctttgacaagatcgagtgctgct

SEQ ID NO: 187354 - DNA, 25 bp, Rattus norvegicus
atctttgacaagttcgagtgctgct

SEQ ID NO: 187355 - DNA, 25 bp, Rattus norvegicus
atctttgacaatcaactcctggagg

SEQ ID NO: 187356 - DNA, 25 bp, Rattus norvegicus
atctttgacaatgaactcctggagg

SEQ ID NO: 187357 - DNA, 25 bp, Rattus norvegicus
atctttgacagcataaatcactgat

SEQ ID NO: 187358 - DNA, 25 bp, Rattus norvegicus
atctttgacagcttaaatcactgat

SEQ ID NO: 187359 - DNA, 25 bp, Rattus norvegicus
atctttgaccaactgaacgtgacca

SEQ ID NO: 187360 - DNA, 25 bp, Rattus norvegicus
atctttgaccaagtgaacgtgacca

SEQ ID NO: 187361 - DNA, 25 bp, Rattus norvegicus
atctttgacctcacttcgattttga

SEQ ID NO: 187362 - DNA, 25 bp, Rattus norvegicus
atctttgacctctcttcgattttga

SEQ ID NO: 187363 - DNA, 25 bp, Rattus norvegicus
atctttgagcagctgctgagcgagc

SEQ ID NO: 187364 - DNA, 25 bp, Rattus norvegicus
atctttgagcaggtgctgagcgagc

SEQ ID NO: 187365 - DNA, 25 bp, Rattus norvegicus
atctttgagtccatcaagcgagctg

SEQ ID NO: 187366 - DNA, 25 bp, Rattus norvegicus
atctttgagtccttcaagcgagctg

SEQ ID NO: 187367 - DNA, 25 bp, Rattus norvegicus
atctttgagttcactcgggctatgc

SEQ ID NO: 187368 - DNA, 25 bp, Rattus norvegicus
atctttgagttctctcgggctatgc

SEQ ID NO: 187369 - DNA, 25 bp, Rattus norvegicus
atctttgatttgattacatggcccc

SEQ ID NO: 187370 - DNA, 25 bp, Rattus norvegicus
atctttgatttgtttacatggcccc

SEQ ID NO: 187371 - DNA, 25 bp, Rattus norvegicus
atctttgcaactctgggaatcttta

SEQ ID NO: 187372 - DNA, 25 bp, Rattus norvegicus
atctttgcaactgtgggaatcttta

SEQ ID NO: 187373 - DNA, 25 bp, Rattus norvegicus
atctttgcacaaatgcggagccctt

SEQ ID NO: 187374 - DNA, 25 bp, Rattus norvegicus
atctttgcacaattgcggagccctt

SEQ ID NO: 187375 - DNA, 25 bp, Rattus norvegicus
atctttgcacctaaagtctcggaac

SEQ ID NO: 187376 - DNA, 25 bp, Rattus norvegicus
atctttgcaccttaagtctcggaac

SEQ ID NO: 187377 - DNA, 25 bp, Rattus norvegicus
atctttgcagacagacatctactga

SEQ ID NO: 187378 - DNA, 25 bp, Rattus norvegicus
atctttgcagactgacatctactga

SEQ ID NO: 187379 - DNA, 25 bp, Rattus norvegicus
atctttgcagcacaggacttgttcc

SEQ ID NO: 187380 - DNA, 25 bp, Rattus norvegicus
atctttgcagcagaggacttgttcc

SEQ ID NO: 187381 - DNA, 25 bp, Rattus norvegicus
atctttgcagtacaagtggcaccaa

SEQ ID NO: 187382 - DNA, 25 bp, Rattus norvegicus
atctttgcagtacttcctgggtcta

SEQ ID NO: 187383 - DNA, 25 bp, Rattus norvegicus
atctttgcagtagaagtggcaccaa

SEQ ID NO: 187384 - DNA, 25 bp, Rattus norvegicus
atctttgcagtagttcctgggtcta

SEQ ID NO: 187385 - DNA, 25 bp, Rattus norvegicus
atctttgccatgcatgttactaggg

SEQ ID NO: 187386 - DNA, 25 bp, Rattus norvegicus
atctttgccatggatgttactaggg

SEQ ID NO: 187387 - DNA, 25 bp, Rattus norvegicus
atctttgcccatatgatagtgctga

SEQ ID NO: 187388 - DNA, 25 bp, Rattus norvegicus
atctttgcccatttgatagtgctga

SEQ ID NO: 187389 - DNA, 25 bp, Rattus norvegicus
atctttgcccgtccagagtcctggt

SEQ ID NO: 187390 - DNA, 25 bp, Rattus norvegicus
atctttgcccgtgcagagtcctggt

SEQ ID NO: 187391 - DNA, 25 bp, Rattus norvegicus
atctttgcctacagacacacttgac

SEQ ID NO: 187392 - DNA, 25 bp, Rattus norvegicus
atctttgcctactgacacacttgac

SEQ ID NO: 187393 - DNA, 25 bp, Rattus norvegicus
atctttgcctttaacatacctacct

SEQ ID NO: 187394 - DNA, 25 bp, Rattus norvegicus
atctttgccttttacatacctacct

SEQ ID NO: 187395 - DNA, 25 bp, Rattus norvegicus
atctttgcggaaagccctcacgtct

SEQ ID NO: 187396 - DNA, 25 bp, Rattus norvegicus
atctttgcggaatgccctcacgtct

SEQ ID NO: 187397 - DNA, 25 bp, Rattus norvegicus
atctttgctaaacgctgctccccaa

SEQ ID NO: 187398 - DNA, 25 bp, Rattus norvegicus
atctttgctaaaggctgctccccaa

SEQ ID NO: 187399 - DNA, 25 bp, Rattus norvegicus
atctttgctgacatgcccttataga

SEQ ID NO: 187400 - DNA, 25 bp, Rattus norvegicus
atctttgctgacttgcccttataga

SEQ ID NO: 187401 - DNA, 25 bp, Rattus norvegicus
atctttgctgggaaattcctgggca

SEQ ID NO: 187402 - DNA, 25 bp, Rattus norvegicus
atctttgctgggtaattcctgggca

SEQ ID NO: 187403 - DNA, 25 bp, Rattus norvegicus
atctttgctttgctccaggatgtca

SEQ ID NO: 187404 - DNA, 25 bp, Rattus norvegicus
atctttgctttggtccaggatgtca

SEQ ID NO: 187405 - DNA, 25 bp, Rattus norvegicus
atctttggaagaatcgtctggcaca

SEQ ID NO: 187406 - DNA, 25 bp, Rattus norvegicus
atctttggaagattcgtctggcaca

SEQ ID NO: 187407 - DNA, 25 bp, Rattus norvegicus
atctttggatttcttgttgtctttg

SEQ ID NO: 187408 - DNA, 25 bp, Rattus norvegicus
atctttggatttgttgttgtctttg

SEQ ID NO: 187409 - DNA, 25 bp, Rattus norvegicus
atctttggcaccacagacttgattg

SEQ ID NO: 187410 - DNA, 25 bp, Rattus norvegicus
atctttggcacctcagacttgattg

SEQ ID NO: 187411 - DNA, 25 bp, Rattus norvegicus
atctttggctacacaacaggattga

SEQ ID NO: 187412 - DNA, 25 bp, Rattus norvegicus
atctttggctactcaacaggattga

SEQ ID NO: 187413 - DNA, 25 bp, Rattus norvegicus
atctttggctgcattggctaagagg

SEQ ID NO: 187414 - DNA, 25 bp, Rattus norvegicus
atctttggctgctttggctaagagg

SEQ ID NO: 187415 - DNA, 25 bp, Rattus norvegicus
atctttgggtttattggctccactt

SEQ ID NO: 187416 - DNA, 25 bp, Rattus norvegicus
atctttgggttttttggctccactt

SEQ ID NO: 187417 - DNA, 25 bp, Rattus norvegicus
atctttggtttgaatgtggtttctc

SEQ ID NO: 187418 - DNA, 25 bp, Rattus norvegicus
atctttggtttgtatgtggtttctc

SEQ ID NO: 187419 - DNA, 25 bp, Rattus norvegicus
atctttgtactcatctccatttctt

SEQ ID NO: 187420 - DNA, 25 bp, Rattus norvegicus
atctttgtactcttctccatttctt

SEQ ID NO: 187421 - DNA, 25 bp, Rattus norvegicus
atctttgtcctgcatggaatgtgtc

SEQ ID NO: 187422 - DNA, 25 bp, Rattus norvegicus
atctttgtcctggatggaatgtgtc

SEQ ID NO: 187423 - DNA, 25 bp, Rattus norvegicus
atctttgtcttgctccgatacttag

SEQ ID NO: 187424 - DNA, 25 bp, Rattus norvegicus
atctttgtcttggtccgatacttag

SEQ ID NO: 187425 - DNA, 25 bp, Rattus norvegicus
atctttgtggcgatgtgtttgcctc

SEQ ID NO: 187426 - DNA, 25 bp, Rattus norvegicus
atctttgtggcgttgtgtttgcctc

SEQ ID NO: 187427 - DNA, 25 bp, Rattus norvegicus
atctttgtggctaccttgtcagaaa

SEQ ID NO: 187428 - DNA, 25 bp, Rattus norvegicus
atctttgtggcttccttgtcagaaa

SEQ ID NO: 187429 - DNA, 25 bp, Rattus norvegicus
atctttgtggtcatccttgcctgaa

SEQ ID NO: 187430 - DNA, 25 bp, Rattus norvegicus
atctttgtggtcttccttgcctgaa

SEQ ID NO: 187431 - DNA, 25 bp, Rattus norvegicus
atctttgtgtccaatcttgactggg

SEQ ID NO: 187432 - DNA, 25 bp, Rattus norvegicus
atctttgtgtcctatcttgactggg

SEQ ID NO: 187433 - DNA, 25 bp, Rattus norvegicus
atctttgttcatatgtctacctggt

SEQ ID NO: 187434 - DNA, 25 bp, Rattus norvegicus
atctttgttcatttgtctacctggt

SEQ ID NO: 187435 - DNA, 25 bp, Rattus norvegicus
atctttgttctaatcacatgcttaa

SEQ ID NO: 187436 - DNA, 25 bp, Rattus norvegicus
atctttgttctattcacatgcttaa

SEQ ID NO: 187437 - DNA, 25 bp, Rattus norvegicus
atctttgttggtcatgcatttctac

SEQ ID NO: 187438 - DNA, 25 bp, Rattus norvegicus
atctttgttggtgatgcatttctac

SEQ ID NO: 187439 - DNA, 25 bp, Rattus norvegicus
atcttttaccggcaggtgctgccgc

SEQ ID NO: 187440 - DNA, 25 bp, Rattus norvegicus
atcttttaccgggaggtgctgccgc

SEQ ID NO: 187441 - DNA, 25 bp, Rattus norvegicus
atcttttagtataccatgtcctctg

SEQ ID NO: 187442 - DNA, 25 bp, Rattus norvegicus
atcttttagtattccatgtcctctg

SEQ ID NO: 187443 - DNA, 25 bp, Rattus norvegicus
atcttttatcttaggcactgcaagg

SEQ ID NO: 187444 - DNA, 25 bp, Rattus norvegicus
atcttttatctttggcactgcaagg

SEQ ID NO: 187445 - DNA, 25 bp, Rattus norvegicus
atcttttcatctacactcggcaagg

SEQ ID NO: 187446 - DNA, 25 bp, Rattus norvegicus
atcttttcatcttcactcggcaagg

SEQ ID NO: 187447 - DNA, 25 bp, Rattus norvegicus
atcttttcccacaaacaggacctca

SEQ ID NO: 187448 - DNA, 25 bp, Rattus norvegicus
atcttttcccactaacaggacctca

SEQ ID NO: 187449 - DNA, 25 bp, Rattus norvegicus
atcttttcgcagaggcctccttaga

SEQ ID NO: 187450 - DNA, 25 bp, Rattus norvegicus
atcttttcgcagtggcctccttaga

SEQ ID NO: 187451 - DNA, 25 bp, Rattus norvegicus
atcttttcggtgatggtccagtacg

SEQ ID NO: 187452 - DNA, 25 bp, Rattus norvegicus
atcttttcggtgttggtccagtacg

SEQ ID NO: 187453 - DNA, 25 bp, Rattus norvegicus
atcttttcgtggatcaagcttgtgt

SEQ ID NO: 187454 - DNA, 25 bp, Rattus norvegicus
atcttttcgtggttcaagcttgtgt

SEQ ID NO: 187455 - DNA, 25 bp, Rattus norvegicus
atcttttctaagacattgttccctt

SEQ ID NO: 187456 - DNA, 25 bp, Rattus norvegicus
atcttttctaagtcattgttccctt

SEQ ID NO: 187457 - DNA, 25 bp, Rattus norvegicus
atcttttctatcctgtacttccaga

SEQ ID NO: 187458 - DNA, 25 bp, Rattus norvegicus
atcttttctatcgtgtacttccaga

SEQ ID NO: 187459 - DNA, 25 bp, Rattus norvegicus
atcttttctatgagtaatgcttatg

SEQ ID NO: 187460 - DNA, 25 bp, Rattus norvegicus
atcttttctatgtgtaatgcttatg

SEQ ID NO: 187461 - DNA, 25 bp, Rattus norvegicus
atcttttctctcaactaggacaggg

SEQ ID NO: 187462 - DNA, 25 bp, Rattus norvegicus
atcttttctctctactaggacaggg

SEQ ID NO: 187463 - DNA, 25 bp, Rattus norvegicus
atcttttctgacagtgttgccacgc

SEQ ID NO: 187464 - DNA, 25 bp, Rattus norvegicus
atcttttctgactgtgttgccacgc

SEQ ID NO: 187465 - DNA, 25 bp, Rattus norvegicus
atcttttctgggaaccagtgggcca

SEQ ID NO: 187466 - DNA, 25 bp, Rattus norvegicus
atcttttctgggtaccagtgggcca

SEQ ID NO: 187467 - DNA, 25 bp, Rattus norvegicus
atcttttctgtaaatacttccctga

SEQ ID NO: 187468 - DNA, 25 bp, Rattus norvegicus
atcttttctgtatatacttccctga

SEQ ID NO: 187469 - DNA, 25 bp, Rattus norvegicus
atcttttcttgtactcccatatttc

SEQ ID NO: 187470 - DNA, 25 bp, Rattus norvegicus
atcttttcttgttctcccatatttc

SEQ ID NO: 187471 - DNA, 25 bp, Rattus norvegicus
atcttttgccaaatgcatgcctgcc

SEQ ID NO: 187472 - DNA, 25 bp, Rattus norvegicus
atcttttgccaattgcatgcctgcc

SEQ ID NO: 187473 - DNA, 25 bp, Rattus norvegicus
atcttttgcgctccccaggaactga

SEQ ID NO: 187474 - DNA, 25 bp, Rattus norvegicus
atcttttgcgctgcccaggaactga

SEQ ID NO: 187475 - DNA, 25 bp, Rattus norvegicus
atcttttgtcttaatgtttcgtgcc

SEQ ID NO: 187476 - DNA, 25 bp, Rattus norvegicus
atcttttgtcttcagctccttgcta

SEQ ID NO: 187477 - DNA, 25 bp, Rattus norvegicus
atcttttgtcttgagctccttgcta

SEQ ID NO: 187478 - DNA, 25 bp, Rattus norvegicus
atcttttgtctttatgtttcgtgcc

SEQ ID NO: 187479 - DNA, 25 bp, Rattus norvegicus
atcttttgtggacatcatgccccaa

SEQ ID NO: 187480 - DNA, 25 bp, Rattus norvegicus
atcttttgtggagatcatgccccaa

SEQ ID NO: 187481 - DNA, 25 bp, Rattus norvegicus
atcttttgttagattccgcacctct

SEQ ID NO: 187482 - DNA, 25 bp, Rattus norvegicus
atcttttgttagtttccgcacctct

SEQ ID NO: 187483 - DNA, 25 bp, Rattus norvegicus
atctttttcagtactttctcctaca

SEQ ID NO: 187484 - DNA, 25 bp, Rattus norvegicus
atctttttcagttctttctcctaca

SEQ ID NO: 187485 - DNA, 25 bp, Rattus norvegicus
atctttttcatcatgatccgctgat

SEQ ID NO: 187486 - DNA, 25 bp, Rattus norvegicus
atctttttcatcttgatccgctgat

SEQ ID NO: 187487 - DNA, 25 bp, Rattus norvegicus
atctttttcattctcatcttcacgg

SEQ ID NO: 187488 - DNA, 25 bp, Rattus norvegicus
atctttttcattgtcatcttcacgg

SEQ ID NO: 187489 - DNA, 25 bp, Rattus norvegicus
atctttttctatcagcttattgtga

SEQ ID NO: 187490 - DNA, 25 bp, Rattus norvegicus
atctttttctatgagcttattgtga

SEQ ID NO: 187491 - DNA, 25 bp, Rattus norvegicus
atctttttcttcagcgcgtgcgatg

SEQ ID NO: 187492 - DNA, 25 bp, Rattus norvegicus
atctttttcttctgcgcgtgcgatg

SEQ ID NO: 187493 - DNA, 25 bp, Rattus norvegicus
atctttttcttgctccttcaggagt

SEQ ID NO: 187494 - DNA, 25 bp, Rattus norvegicus
atctttttcttggtccttcaggagt

SEQ ID NO: 187495 - DNA, 25 bp, Rattus norvegicus
atctttttgaaaaccactggcttcc

SEQ ID NO: 187496 - DNA, 25 bp, Rattus norvegicus
atctttttgaaatccactggcttcc

SEQ ID NO: 187497 - DNA, 25 bp, Rattus norvegicus
atcttttttaaaacagtggcactca

SEQ ID NO: 187498 - DNA, 25 bp, Rattus norvegicus
atcttttttaaatcagtggcactca

SEQ ID NO: 187499 - DNA, 25 bp, Rattus norvegicus
atcttttttcatactgtcaggttac

SEQ ID NO: 187500 - DNA, 25 bp, Rattus norvegicus
atcttttttcattctgtcaggttac

SEQ ID NO: 187501 - DNA, 25 bp, Rattus norvegicus
atcttttttctcctgctaagtgctt

SEQ ID NO: 187502 - DNA, 25 bp, Rattus norvegicus
atcttttttctcgtgctaagtgctt

SEQ ID NO: 187503 - DNA, 25 bp, Rattus norvegicus
atcttttttgaaagcttcctagctg

SEQ ID NO: 187504 - DNA, 25 bp, Rattus norvegicus
atcttttttgaatgcttcctagctg

SEQ ID NO: 187505 - DNA, 25 bp, Rattus norvegicus
atgaaaaaattcacacccaagagaa

SEQ ID NO: 187506 - DNA, 25 bp, Rattus norvegicus
atgaaaaaattctcacccaagagaa

SEQ ID NO: 187507 - DNA, 25 bp, Rattus norvegicus
atgaaaaactcacttggacactggg

SEQ ID NO: 187508 - DNA, 25 bp, Rattus norvegicus
atgaaaaactcagttggacactggg

SEQ ID NO: 187509 - DNA, 25 bp, Rattus norvegicus
atgaaaaatctcaccattgccacca

SEQ ID NO: 187510 - DNA, 25 bp, Rattus norvegicus
atgaaaaatctctccattgccacca

SEQ ID NO: 187511 - DNA, 25 bp, Rattus norvegicus
atgaaaacatcccagcagcatcttc

SEQ ID NO: 187512 - DNA, 25 bp, Rattus norvegicus
atgaaaacatccgagcagcatcttc

SEQ ID NO: 187513 - DNA, 25 bp, Rattus norvegicus
atgaaaacatggctggctctcgccg

SEQ ID NO: 187514 - DNA, 25 bp, Rattus norvegicus
atgaaaacatgggtggctctcgccg

SEQ ID NO: 187515 - DNA, 25 bp, Rattus norvegicus
atgaaaacctgtcaggaccctcgac

SEQ ID NO: 187516 - DNA, 25 bp, Rattus norvegicus
atgaaaacctgtgaggaccctcgac

SEQ ID NO: 187517 - DNA, 25 bp, Rattus norvegicus
atgaaaacgaggctgctctcacacc

SEQ ID NO: 187518 - DNA, 25 bp, Rattus norvegicus
atgaaaacgagggtgctctcacacc

SEQ ID NO: 187519 - DNA, 25 bp, Rattus norvegicus
atgaaaacgttcaactggcagattt

SEQ ID NO: 187520 - DNA, 25 bp, Rattus norvegicus
atgaaaacgttctactggcagattt

SEQ ID NO: 187521 - DNA, 25 bp, Rattus norvegicus
atgaaaacttaccactcacacgaag

SEQ ID NO: 187522 - DNA, 25 bp, Rattus norvegicus
atgaaaacttacgactcacacgaag

SEQ ID NO: 187523 - DNA, 25 bp, Rattus norvegicus
atgaaaagcagaccgccgacaccgg

SEQ ID NO: 187524 - DNA, 25 bp, Rattus norvegicus
atgaaaagcagagcgccgacaccgg

SEQ ID NO: 187525 - DNA, 25 bp, Rattus norvegicus
atgaaaaggatcctggtgctgctgc

SEQ ID NO: 187526 - DNA, 25 bp, Rattus norvegicus
atgaaaaggatcgtggtgctgctgc

SEQ ID NO: 187527 - DNA, 25 bp, Rattus norvegicus
atgaaaatggtcagcctacccacga

SEQ ID NO: 187528 - DNA, 25 bp, Rattus norvegicus
atgaaaatggtctgcctacccacga

SEQ ID NO: 187529 - DNA, 25 bp, Rattus norvegicus
atgaaaatgtacattccactctttt

SEQ ID NO: 187530 - DNA, 25 bp, Rattus norvegicus
atgaaaatgtactttccactctttt

SEQ ID NO: 187531 - DNA, 25 bp, Rattus norvegicus
atgaaacaagttaggtgcctccttt

SEQ ID NO: 187532 - DNA, 25 bp, Rattus norvegicus
atgaaacaagtttggtgcctccttt

SEQ ID NO: 187533 - DNA, 25 bp, Rattus norvegicus
atgaaacagcccaggttccatgtgc

SEQ ID NO: 187534 - DNA, 25 bp, Rattus norvegicus
atgaaacagccctggttccatgtgc

SEQ ID NO: 187535 - DNA, 25 bp, Rattus norvegicus
atgaaacatttcaacacctgccttg

SEQ ID NO: 187536 - DNA, 25 bp, Rattus norvegicus
atgaaacatttctacacctgccttg

SEQ ID NO: 187537 - DNA, 25 bp, Rattus norvegicus
atgaaaccaaacctctggactccgc

SEQ ID NO: 187538 - DNA, 25 bp, Rattus norvegicus
atgaaaccaaacgtctggactccgc

SEQ ID NO: 187539 - DNA, 25 bp, Rattus norvegicus
atgaaaccaactctctaccctgtga

SEQ ID NO: 187540 - DNA, 25 bp, Rattus norvegicus
atgaaaccaactgtctaccctgtga

SEQ ID NO: 187541 - DNA, 25 bp, Rattus norvegicus
atgaaaccatcaatgtgccgacttc

SEQ ID NO: 187542 - DNA, 25 bp, Rattus norvegicus
atgaaaccatcattgtgccgacttc

SEQ ID NO: 187543 - DNA, 25 bp, Rattus norvegicus
atgaaacccagcactcgaggcgcac

SEQ ID NO: 187544 - DNA, 25 bp, Rattus norvegicus
atgaaacccagctctcgaggcgcac

SEQ ID NO: 187545 - DNA, 25 bp, Rattus norvegicus
atgaaacctgctacatgtacctgtc

SEQ ID NO: 187546 - DNA, 25 bp, Rattus norvegicus
atgaaacctgcttcatgtacctgtc

SEQ ID NO: 187547 - DNA, 25 bp, Rattus norvegicus
atgaaacctttcctctgtgtctgct

SEQ ID NO: 187548 - DNA, 25 bp, Rattus norvegicus
atgaaacctttcgtctgtgtctgct

SEQ ID NO: 187549 - DNA, 25 bp, Rattus norvegicus
atgaaacgacccatcctgactgatg

SEQ ID NO: 187550 - DNA, 25 bp, Rattus norvegicus
atgaaacgacccttcctgactgatg

SEQ ID NO: 187551 - DNA, 25 bp, Rattus norvegicus
atgaaacgggatcacagcaacaata

SEQ ID NO: 187552 - DNA, 25 bp, Rattus norvegicus
atgaaacgggatgacagcaacaata

SEQ ID NO: 187553 - DNA, 25 bp, Rattus norvegicus
atgaaactaattcaggctggcagat

SEQ ID NO: 187554 - DNA, 25 bp, Rattus norvegicus
atgaaactaattgaggctggcagat

SEQ ID NO: 187555 - DNA, 25 bp, Rattus norvegicus
atgaaactagatccctgtctctcct

SEQ ID NO: 187556 - DNA, 25 bp, Rattus norvegicus
atgaaactagatgcctgtctctcct

SEQ ID NO: 187557 - DNA, 25 bp, Rattus norvegicus
atgaaactgcccctgtctagcacag

SEQ ID NO: 187558 - DNA, 25 bp, Rattus norvegicus
atgaaactgcccgtgtctagcacag

SEQ ID NO: 187559 - DNA, 25 bp, Rattus norvegicus
atgaaactgcctattcacgccgtaa

SEQ ID NO: 187560 - DNA, 25 bp, Rattus norvegicus
atgaaactgccttttcacgccgtaa

SEQ ID NO: 187561 - DNA, 25 bp, Rattus norvegicus
atgaaacttaatattgcacacttgt

SEQ ID NO: 187562 - DNA, 25 bp, Rattus norvegicus
atgaaacttaattttgcacacttgt

SEQ ID NO: 187563 - DNA, 25 bp, Rattus norvegicus
atgaaactttccagaggccaacctt

SEQ ID NO: 187564 - DNA, 25 bp, Rattus norvegicus
atgaaactttcctgaggccaacctt

SEQ ID NO: 187565 - DNA, 25 bp, Rattus norvegicus
atgaaagaaggcaccaggctccacc

SEQ ID NO: 187566 - DNA, 25 bp, Rattus norvegicus
atgaaagaaggctccaggctccacc

SEQ ID NO: 187567 - DNA, 25 bp, Rattus norvegicus
atgaaagaatacaagcgctccactc

SEQ ID NO: 187568 - DNA, 25 bp, Rattus norvegicus
atgaaagaatactagcgctccactc

SEQ ID NO: 187569 - DNA, 25 bp, Rattus norvegicus
atgaaagaccccagcttagcagcag

SEQ ID NO: 187570 - DNA, 25 bp, Rattus norvegicus
atgaaagacccctgcttagcagcag

SEQ ID NO: 187571 - DNA, 25 bp, Rattus norvegicus
atgaaagagagtccccgcatagcct

SEQ ID NO: 187572 - DNA, 25 bp, Rattus norvegicus
atgaaagagagtgcccgcatagcct

SEQ ID NO: 187573 - DNA, 25 bp, Rattus norvegicus
atgaaagagggcatacctgttgctt

SEQ ID NO: 187574 - DNA, 25 bp, Rattus norvegicus
atgaaagagggcttacctgttgctt

SEQ ID NO: 187575 - DNA, 25 bp, Rattus norvegicus
atgaaagcactcaattcctcccaaa

SEQ ID NO: 187576 - DNA, 25 bp, Rattus norvegicus
atgaaagcactctattcctcccaaa

SEQ ID NO: 187577 - DNA, 25 bp, Rattus norvegicus
atgaaagccctgaagcttacacaca

SEQ ID NO: 187578 - DNA, 25 bp, Rattus norvegicus
atgaaagccctgtagcttacacaca

SEQ ID NO: 187579 - DNA, 25 bp, Rattus norvegicus
atgaaagctgcaactctcgtgacca

SEQ ID NO: 187580 - DNA, 25 bp, Rattus norvegicus
atgaaagctgcatctctcgtgacca

SEQ ID NO: 187581 - DNA, 25 bp, Rattus norvegicus
atgaaagctgtcacgggacacccgg

SEQ ID NO: 187582 - DNA, 25 bp, Rattus norvegicus
atgaaagctgtctcgggacacccgg

SEQ ID NO: 187583 - DNA, 25 bp, Rattus norvegicus
atgaaagcttccatgataccttggg

SEQ ID NO: 187584 - DNA, 25 bp, Rattus norvegicus
atgaaagcttccttgataccttggg

SEQ ID NO: 187585 - DNA, 25 bp, Rattus norvegicus
atgaaaggcagcctggttcccagtt

SEQ ID NO: 187586 - DNA, 25 bp, Rattus norvegicus
atgaaaggcagcgtggttcccagtt

SEQ ID NO: 187587 - DNA, 25 bp, Rattus norvegicus
atgaaagggtctactccagtagctc

SEQ ID NO: 187588 - DNA, 25 bp, Rattus norvegicus
atgaaagggtcttctccagtagctc

SEQ ID NO: 187589 - DNA, 25 bp, Rattus norvegicus
atgaaaggtgctacattccctcggt

SEQ ID NO: 187590 - DNA, 25 bp, Rattus norvegicus
atgaaaggtgcttcattccctcggt

SEQ ID NO: 187591 - DNA, 25 bp, Rattus norvegicus
atgaaaggtggaaggctcctcgcaa

SEQ ID NO: 187592 - DNA, 25 bp, Rattus norvegicus
atgaaaggtggatggctcctcgcaa

SEQ ID NO: 187593 - DNA, 25 bp, Rattus norvegicus
atgaaaggttccctgctccaacagt

SEQ ID NO: 187594 - DNA, 25 bp, Rattus norvegicus
atgaaaggttccgtgctccaacagt

SEQ ID NO: 187595 - DNA, 25 bp, Rattus norvegicus
atgaaagtataaccactgccctctg

SEQ ID NO: 187596 - DNA, 25 bp, Rattus norvegicus
atgaaagtataagcactgccctctg

SEQ ID NO: 187597 - DNA, 25 bp, Rattus norvegicus
atgaaagtcacacttgagcttcccc

SEQ ID NO: 187598 - DNA, 25 bp, Rattus norvegicus
atgaaagtcacagttgagcttcccc

SEQ ID NO: 187599 - DNA, 25 bp, Rattus norvegicus
atgaaagtcactcgtctgcctttgt

SEQ ID NO: 187600 - DNA, 25 bp, Rattus norvegicus
atgaaagtcactggtctgcctttgt

SEQ ID NO: 187601 - DNA, 25 bp, Rattus norvegicus
atgaaagtcatcaacttcagagttt

SEQ ID NO: 187602 - DNA, 25 bp, Rattus norvegicus
atgaaagtcatctacttcagagttt

SEQ ID NO: 187603 - DNA, 25 bp, Rattus norvegicus
atgaaagtccacatcaactttagca

SEQ ID NO: 187604 - DNA, 25 bp, Rattus norvegicus
atgaaagtccacttcaactttagca

SEQ ID NO: 187605 - DNA, 25 bp, Rattus norvegicus
atgaaagtcgagagccccaccgaac

SEQ ID NO: 187606 - DNA, 25 bp, Rattus norvegicus
atgaaagtcgagtgccccaccgaac

SEQ ID NO: 187607 - DNA, 25 bp, Rattus norvegicus
atgaaagtgcctctgtctcaccaag

SEQ ID NO: 187608 - DNA, 25 bp, Rattus norvegicus
atgaaagtgcctgtgtctcaccaag

SEQ ID NO: 187609 - DNA, 25 bp, Rattus norvegicus
atgaaagtggaaacacctgcccgcc

SEQ ID NO: 187610 - DNA, 25 bp, Rattus norvegicus
atgaaagtggaatcacctgcccgcc

SEQ ID NO: 187611 - DNA, 25 bp, Rattus norvegicus
atgaaagtggtgctcatgcccgacg

SEQ ID NO: 187612 - DNA, 25 bp, Rattus norvegicus
atgaaagtggtggtcatgcccgacg

SEQ ID NO: 187613 - DNA, 25 bp, Rattus norvegicus
atgaaagtgtgcactcgctctgcaa

SEQ ID NO: 187614 - DNA, 25 bp, Rattus norvegicus
atgaaagtgtgctctcgctctgcaa

SEQ ID NO: 187615 - DNA, 25 bp, Rattus norvegicus
atgaaagtgttaactgcaatccaaa

SEQ ID NO: 187616 - DNA, 25 bp, Rattus norvegicus
atgaaagtgttatctgcaatccaaa

SEQ ID NO: 187617 - DNA, 25 bp, Rattus norvegicus
atgaaataaaacagcccgtgcccat

SEQ ID NO: 187618 - DNA, 25 bp, Rattus norvegicus
atgaaataaaactgcccgtgcccat

SEQ ID NO: 187619 - DNA, 25 bp, Rattus norvegicus
atgaaatacacaatccccagcgact

SEQ ID NO: 187620 - DNA, 25 bp, Rattus norvegicus
atgaaatacacattccccagcgact

SEQ ID NO: 187621 - DNA, 25 bp, Rattus norvegicus
atgaaatagcttccaggttctccgg

SEQ ID NO: 187622 - DNA, 25 bp, Rattus norvegicus
atgaaatagcttgcaggttctccgg

SEQ ID NO: 187623 - DNA, 25 bp, Rattus norvegicus
atgaaatatcctcgtctcacgcaca

SEQ ID NO: 187624 - DNA, 25 bp, Rattus norvegicus
atgaaatatcctggtctcacgcaca

SEQ ID NO: 187625 - DNA, 25 bp, Rattus norvegicus
atgaaatcatctctccatctgaaga

SEQ ID NO: 187626 - DNA, 25 bp, Rattus norvegicus
atgaaatcatctgtccatctgaaga

SEQ ID NO: 187627 - DNA, 25 bp, Rattus norvegicus
atgaaatcatggattcctgctccag

SEQ ID NO: 187628 - DNA, 25 bp, Rattus norvegicus
atgaaatcatggtttcctgctccag

SEQ ID NO: 187629 - DNA, 25 bp, Rattus norvegicus
atgaaatcatgtactcttgctggag

SEQ ID NO: 187630 - DNA, 25 bp, Rattus norvegicus
atgaaatcatgttctcttgctggag

SEQ ID NO: 187631 - DNA, 25 bp, Rattus norvegicus
atgaaatccagcagggaaacctgca

SEQ ID NO: 187632 - DNA, 25 bp, Rattus norvegicus
atgaaatccagctgggaaacctgca

SEQ ID NO: 187633 - DNA, 25 bp, Rattus norvegicus
atgaaatccaggacctcagggccct

SEQ ID NO: 187634 - DNA, 25 bp, Rattus norvegicus
atgaaatccaggtcctcagggccct

SEQ ID NO: 187635 - DNA, 25 bp, Rattus norvegicus
atgaaatgactccagacaccttacc

SEQ ID NO: 187636 - DNA, 25 bp, Rattus norvegicus
atgaaatgactcgagacaccttacc

SEQ ID NO: 187637 - DNA, 25 bp, Rattus norvegicus
atgaaatgccagctggctcccattc

SEQ ID NO: 187638 - DNA, 25 bp, Rattus norvegicus
atgaaatgccaggtggctcccattc

SEQ ID NO: 187639 - DNA, 25 bp, Rattus norvegicus
atgaaatgccttacaatgcccactc

SEQ ID NO: 187640 - DNA, 25 bp, Rattus norvegicus
atgaaatgcctttcaatgcccactc

SEQ ID NO: 187641 - DNA, 25 bp, Rattus norvegicus
atgaaatggcatatgccactcccca

SEQ ID NO: 187642 - DNA, 25 bp, Rattus norvegicus
atgaaatggcatttgccactcccca

SEQ ID NO: 187643 - DNA, 25 bp, Rattus norvegicus
atgaaatgtgcaaggctggctgata

SEQ ID NO: 187644 - DNA, 25 bp, Rattus norvegicus
atgaaatgtgcatggctggctgata

SEQ ID NO: 187645 - DNA, 25 bp, Rattus norvegicus
atgaaattcatcctggctccgctgt

SEQ ID NO: 187646 - DNA, 25 bp, Rattus norvegicus
atgaaattcatcgtggctccgctgt

SEQ ID NO: 187647 - DNA, 25 bp, Rattus norvegicus
atgaaattgagcctgaacctgagca

SEQ ID NO: 187648 - DNA, 25 bp, Rattus norvegicus
atgaaattgagcgtgaacctgagca

SEQ ID NO: 187649 - DNA, 25 bp, Rattus norvegicus
atgaaatttcccaccgagacttagt

SEQ ID NO: 187650 - DNA, 25 bp, Rattus norvegicus
atgaaatttccctccgagacttagt

SEQ ID NO: 187651 - DNA, 25 bp, Rattus norvegicus
atgaaatttctaagtgccctttttg

SEQ ID NO: 187652 - DNA, 25 bp, Rattus norvegicus
atgaaatttctatgtgccctttttg

SEQ ID NO: 187653 - DNA, 25 bp, Rattus norvegicus
atgaaatttctgatgctcctaatac

SEQ ID NO: 187654 - DNA, 25 bp, Rattus norvegicus
atgaaatttctgttgctcctaatac

SEQ ID NO: 187655 - DNA, 25 bp, Rattus norvegicus
atgaacaaacgcattcgcctgggct

SEQ ID NO: 187656 - DNA, 25 bp, Rattus norvegicus
atgaacaaacgctttcgcctgggct

SEQ ID NO: 187657 - DNA, 25 bp, Rattus norvegicus
atgaacaagcttaagatttcggcct

SEQ ID NO: 187658 - DNA, 25 bp, Rattus norvegicus
atgaacaagctttagatttcggcct

SEQ ID NO: 187659 - DNA, 25 bp, Rattus norvegicus
atgaacaaggccctgtatccttcac

SEQ ID NO: 187660 - DNA, 25 bp, Rattus norvegicus
atgaacaaggccgtgtatccttcac

SEQ ID NO: 187661 - DNA, 25 bp, Rattus norvegicus
atgaacacacaaaccaacacacagt

SEQ ID NO: 187662 - DNA, 25 bp, Rattus norvegicus
atgaacacacaatccaacacacagt

SEQ ID NO: 187663 - DNA, 25 bp, Rattus norvegicus
atgaacacaccgctagattttctcc

SEQ ID NO: 187664 - DNA, 25 bp, Rattus norvegicus
atgaacacaccggtagattttctcc

SEQ ID NO: 187665 - DNA, 25 bp, Rattus norvegicus
atgaacacccttctatgcactcaaa

SEQ ID NO: 187666 - DNA, 25 bp, Rattus norvegicus
atgaacacccttgtatgcactcaaa

SEQ ID NO: 187667 - DNA, 25 bp, Rattus norvegicus
atgaacacgtatctctcactttcag

SEQ ID NO: 187668 - DNA, 25 bp, Rattus norvegicus
atgaacacgtatgtctcactttcag

SEQ ID NO: 187669 - DNA, 25 bp, Rattus norvegicus
atgaacacttcgctgcaggagcctc

SEQ ID NO: 187670 - DNA, 25 bp, Rattus norvegicus
atgaacacttcggtgcaggagcctc

SEQ ID NO: 187671 - DNA, 25 bp, Rattus norvegicus
atgaacagcacaccactttgccaaa

SEQ ID NO: 187672 - DNA, 25 bp, Rattus norvegicus
atgaacagcacagcactttgccaaa

SEQ ID NO: 187673 - DNA, 25 bp, Rattus norvegicus
atgaacagccgacattcctttcgct

SEQ ID NO: 187674 - DNA, 25 bp, Rattus norvegicus
atgaacagccgagattcctttcgct

SEQ ID NO: 187675 - DNA, 25 bp, Rattus norvegicus
atgaacagcgaacccttaacttgaa

SEQ ID NO: 187676 - DNA, 25 bp, Rattus norvegicus
atgaacagcgaagccttaacttgaa

SEQ ID NO: 187677 - DNA, 25 bp, Rattus norvegicus
atgaacagcggcaccagaatggcgg

SEQ ID NO: 187678 - DNA, 25 bp, Rattus norvegicus
atgaacagcggctccagaatggcgg

SEQ ID NO: 187679 - DNA, 25 bp, Rattus norvegicus
atgaacagtcacacgccactgttga

SEQ ID NO: 187680 - DNA, 25 bp, Rattus norvegicus
atgaacagtcactcgccactgttga

SEQ ID NO: 187681 - DNA, 25 bp, Rattus norvegicus
atgaacagtggcctagactcctcgc

SEQ ID NO: 187682 - DNA, 25 bp, Rattus norvegicus
atgaacagtggcgtagactcctcgc

SEQ ID NO: 187683 - DNA, 25 bp, Rattus norvegicus
atgaacatacttagtgagggccaca

SEQ ID NO: 187684 - DNA, 25 bp, Rattus norvegicus
atgaacatactttgtgagggccaca

SEQ ID NO: 187685 - DNA, 25 bp, Rattus norvegicus
atgaacatcagtcccagacgcttca

SEQ ID NO: 187686 - DNA, 25 bp, Rattus norvegicus
atgaacatcagtgccagacgcttca

SEQ ID NO: 187687 - DNA, 25 bp, Rattus norvegicus
atgaacatcatgacacctgtggccc

SEQ ID NO: 187688 - DNA, 25 bp, Rattus norvegicus
atgaacatcatgtcacctgtggccc

SEQ ID NO: 187689 - DNA, 25 bp, Rattus norvegicus
atgaacatcgacatttctgccttct

SEQ ID NO: 187690 - DNA, 25 bp, Rattus norvegicus
atgaacatcgacttttctgccttct

SEQ ID NO: 187691 - DNA, 25 bp, Rattus norvegicus
atgaacatctggaaagcgcccggac

SEQ ID NO: 187692 - DNA, 25 bp, Rattus norvegicus
atgaacatctggtaagcgcccggac

SEQ ID NO: 187693 - DNA, 25 bp, Rattus norvegicus
atgaacatgaacatggctcctggaa

SEQ ID NO: 187694 - DNA, 25 bp, Rattus norvegicus
atgaacatgaacttggctcctggaa

SEQ ID NO: 187695 - DNA, 25 bp, Rattus norvegicus
atgaacatgagtctacttactgaaa

SEQ ID NO: 187696 - DNA, 25 bp, Rattus norvegicus
atgaacatgagtgtacttactgaaa

SEQ ID NO: 187697 - DNA, 25 bp, Rattus norvegicus
atgaacattctgagccttcttactt

SEQ ID NO: 187698 - DNA, 25 bp, Rattus norvegicus
atgaacattctgtgccttcttactt

SEQ ID NO: 187699 - DNA, 25 bp, Rattus norvegicus
atgaacatttacatcaccagtgaat

SEQ ID NO: 187700 - DNA, 25 bp, Rattus norvegicus
atgaacatttacttcaccagtgaat

SEQ ID NO: 187701 - DNA, 25 bp, Rattus norvegicus
atgaaccaaaggctgcgtcctgttt

SEQ ID NO: 187702 - DNA, 25 bp, Rattus norvegicus
atgaaccaaagggtgcgtcctgttt

SEQ ID NO: 187703 - DNA, 25 bp, Rattus norvegicus
atgaaccaaccgcagactcagtatt

SEQ ID NO: 187704 - DNA, 25 bp, Rattus norvegicus
atgaaccaaccggagactcagtatt

SEQ ID NO: 187705 - DNA, 25 bp, Rattus norvegicus
atgaaccaaggcagccttgttcctg

SEQ ID NO: 187706 - DNA, 25 bp, Rattus norvegicus
atgaaccaaggctgccttgttcctg

SEQ ID NO: 187707 - DNA, 25 bp, Rattus norvegicus
atgaaccaatcactgtccaaaggaa

SEQ ID NO: 187708 - DNA, 25 bp, Rattus norvegicus
atgaaccaatcagtgtccaaaggaa

SEQ ID NO: 187709 - DNA, 25 bp, Rattus norvegicus
atgaaccagaatacttcccactgtc

SEQ ID NO: 187710 - DNA, 25 bp, Rattus norvegicus
atgaaccagaattcttcccactgtc

SEQ ID NO: 187711 - DNA, 25 bp, Rattus norvegicus
atgaaccagctaatgtccaggactc

SEQ ID NO: 187712 - DNA, 25 bp, Rattus norvegicus
atgaaccagctattgtccaggactc

SEQ ID NO: 187713 - DNA, 25 bp, Rattus norvegicus
atgaaccaggacagcttctgagcgc

SEQ ID NO: 187714 - DNA, 25 bp, Rattus norvegicus
atgaaccaggactgcttctgagcgc

SEQ ID NO: 187715 - DNA, 25 bp, Rattus norvegicus
atgaaccaggttccagaggctcaca

SEQ ID NO: 187716 - DNA, 25 bp, Rattus norvegicus
atgaaccaggttgcagaggctcaca

SEQ ID NO: 187717 - DNA, 25 bp, Rattus norvegicus
atgaaccagttcacagaatccctct

SEQ ID NO: 187718 - DNA, 25 bp, Rattus norvegicus
atgaaccagttctcagaatccctct

SEQ ID NO: 187719 - DNA, 25 bp, Rattus norvegicus
atgaaccatgaactacgaactgtgt

SEQ ID NO: 187720 - DNA, 25 bp, Rattus norvegicus
atgaaccatgaagtacgaactgtgt

SEQ ID NO: 187721 - DNA, 25 bp, Rattus norvegicus
atgaaccatgtaatgcacccgacct

SEQ ID NO: 187722 - DNA, 25 bp, Rattus norvegicus
atgaaccatgtattgcacccgacct

SEQ ID NO: 187723 - DNA, 25 bp, Rattus norvegicus
atgaaccattcaatgctaccttgtt

SEQ ID NO: 187724 - DNA, 25 bp, Rattus norvegicus
atgaaccattcattgctaccttgtt

SEQ ID NO: 187725 - DNA, 25 bp, Rattus norvegicus
atgaacccactaagttttggcctta

SEQ ID NO: 187726 - DNA, 25 bp, Rattus norvegicus
atgaacccactatgttttggcctta

SEQ ID NO: 187727 - DNA, 25 bp, Rattus norvegicus
atgaacccagggaacaactcaaaat

SEQ ID NO: 187728 - DNA, 25 bp, Rattus norvegicus
atgaacccagggtacaactcaaaat

SEQ ID NO: 187729 - DNA, 25 bp, Rattus norvegicus
atgaacccaggtccttgtgtgctag

SEQ ID NO: 187730 - DNA, 25 bp, Rattus norvegicus
atgaacccaggtgcttgtgtgctag

SEQ ID NO: 187731 - DNA, 25 bp, Rattus norvegicus
atgaaccccgacatgagcaaatcaa

SEQ ID NO: 187732 - DNA, 25 bp, Rattus norvegicus
atgaaccccgacttgagcaaatcaa

SEQ ID NO: 187733 - DNA, 25 bp, Rattus norvegicus
atgaaccccgctcacattgagtctc

SEQ ID NO: 187734 - DNA, 25 bp, Rattus norvegicus
atgaaccccgctgacattgagtctc

SEQ ID NO: 187735 - DNA, 25 bp, Rattus norvegicus
atgaaccctcacatccgtgtaggtc

SEQ ID NO: 187736 - DNA, 25 bp, Rattus norvegicus
atgaaccctcacttccgtgtaggtc

SEQ ID NO: 187737 - DNA, 25 bp, Rattus norvegicus
atgaaccctcgacttctttctttct

SEQ ID NO: 187738 - DNA, 25 bp, Rattus norvegicus
atgaaccctcgagttctttctttct

SEQ ID NO: 187739 - DNA, 25 bp, Rattus norvegicus
atgaaccgactgatctgcaagagcg

SEQ ID NO: 187740 - DNA, 25 bp, Rattus norvegicus
atgaaccgactgttctgcaagagcg

SEQ ID NO: 187741 - DNA, 25 bp, Rattus norvegicus
atgaaccgatttctgggcatcctca

SEQ ID NO: 187742 - DNA, 25 bp, Rattus norvegicus
atgaaccgatttgtgggcatcctca

SEQ ID NO: 187743 - DNA, 25 bp, Rattus norvegicus
atgaaccgccaaactcagcatttaa

SEQ ID NO: 187744 - DNA, 25 bp, Rattus norvegicus
atgaaccgccaatctcagcatttaa

SEQ ID NO: 187745 - DNA, 25 bp, Rattus norvegicus
atgaaccgccgcagggtctgtacga

SEQ ID NO: 187746 - DNA, 25 bp, Rattus norvegicus
atgaaccgccgctgggtctgtacga

SEQ ID NO: 187747 - DNA, 25 bp, Rattus norvegicus
atgaaccgcttgaccccagtgaaga

SEQ ID NO: 187748 - DNA, 25 bp, Rattus norvegicus
atgaaccgcttgtccccagtgaaga

SEQ ID NO: 187749 - DNA, 25 bp, Rattus norvegicus
atgaaccggcgcaactatgagaact

SEQ ID NO: 187750 - DNA, 25 bp, Rattus norvegicus
atgaaccggcgctactatgagaact

SEQ ID NO: 187751 - DNA, 25 bp, Rattus norvegicus
atgaacctaccaaagcagacagcta

SEQ ID NO: 187752 - DNA, 25 bp, Rattus norvegicus
atgaacctaccatagcagacagcta

SEQ ID NO: 187753 - DNA, 25 bp, Rattus norvegicus
atgaacctattaatccacttgtgaa

SEQ ID NO: 187754 - DNA, 25 bp, Rattus norvegicus
atgaacctattattccacttgtgaa

SEQ ID NO: 187755 - DNA, 25 bp, Rattus norvegicus
atgaacctcaacaaatactggctgt

SEQ ID NO: 187756 - DNA, 25 bp, Rattus norvegicus
atgaacctcaactaatactggctgt

SEQ ID NO: 187757 - DNA, 25 bp, Rattus norvegicus
atgaacctcggcagccagacgatga

SEQ ID NO: 187758 - DNA, 25 bp, Rattus norvegicus
atgaacctcggctgccagacgatga

SEQ ID NO: 187759 - DNA, 25 bp, Rattus norvegicus
atgaacctgaccatgaacctcaccg

SEQ ID NO: 187760 - DNA, 25 bp, Rattus norvegicus
atgaacctgaccttgaacctcaccg

SEQ ID NO: 187761 - DNA, 25 bp, Rattus norvegicus
atgaacctgatgctggagcctgtcc

SEQ ID NO: 187762 - DNA, 25 bp, Rattus norvegicus
atgaacctgatggtggagcctgtcc

SEQ ID NO: 187763 - DNA, 25 bp, Rattus norvegicus
atgaacctgctaagcggctgacctt

SEQ ID NO: 187764 - DNA, 25 bp, Rattus norvegicus
atgaacctgctatgcggctgacctt

SEQ ID NO: 187765 - DNA, 25 bp, Rattus norvegicus
atgaacctggatcctatgttccctg

SEQ ID NO: 187766 - DNA, 25 bp, Rattus norvegicus
atgaacctggatgctatgttccctg

SEQ ID NO: 187767 - DNA, 25 bp, Rattus norvegicus
atgaacctgggtcagagcctgcatt

SEQ ID NO: 187768 - DNA, 25 bp, Rattus norvegicus
atgaacctgggtgagagcctgcatt

SEQ ID NO: 187769 - DNA, 25 bp, Rattus norvegicus
atgaacctgttcctaaccactataa

SEQ ID NO: 187770 - DNA, 25 bp, Rattus norvegicus
atgaacctgttcgtaaccactataa

SEQ ID NO: 187771 - DNA, 25 bp, Rattus norvegicus
atgaaccttgggacatttgctctgt

SEQ ID NO: 187772 - DNA, 25 bp, Rattus norvegicus
atgaaccttgggtcatttgctctgt

SEQ ID NO: 187773 - DNA, 25 bp, Rattus norvegicus
atgaaccttgtgctatagtgactcc

SEQ ID NO: 187774 - DNA, 25 bp, Rattus norvegicus
atgaaccttgtggtatagtgactcc

SEQ ID NO: 187775 - DNA, 25 bp, Rattus norvegicus
atgaacgaacacagctccaggagtc

SEQ ID NO: 187776 - DNA, 25 bp, Rattus norvegicus
atgaacgaacactgctccaggagtc

SEQ ID NO: 187777 - DNA, 25 bp, Rattus norvegicus
atgaacgaggatcacagtacagact

SEQ ID NO: 187778 - DNA, 25 bp, Rattus norvegicus
atgaacgaggatgacagtacagact

SEQ ID NO: 187779 - DNA, 25 bp, Rattus norvegicus
atgaacgaggccagctgagggctcc

SEQ ID NO: 187780 - DNA, 25 bp, Rattus norvegicus
atgaacgaggcctgctgagggctcc

SEQ ID NO: 187781 - DNA, 25 bp, Rattus norvegicus
atgaacgagtctcattcctggcggc

SEQ ID NO: 187782 - DNA, 25 bp, Rattus norvegicus
atgaacgagtctgattcctggcggc

SEQ ID NO: 187783 - DNA, 25 bp, Rattus norvegicus
atgaacgccatcaaacacctggcat

SEQ ID NO: 187784 - DNA, 25 bp, Rattus norvegicus
atgaacgccatctaacacctggcat

SEQ ID NO: 187785 - DNA, 25 bp, Rattus norvegicus
atgaacgccttgaccagtctggacg

SEQ ID NO: 187786 - DNA, 25 bp, Rattus norvegicus
atgaacgccttgtccagtctggacg

SEQ ID NO: 187787 - DNA, 25 bp, Rattus norvegicus
atgaacgggtcaactccttacacat

SEQ ID NO: 187788 - DNA, 25 bp, Rattus norvegicus
atgaacgggtcatctccttacacat

SEQ ID NO: 187789 - DNA, 25 bp, Rattus norvegicus
atgaacggtgcaaagatgcctcctt

SEQ ID NO: 187790 - DNA, 25 bp, Rattus norvegicus
atgaacggtgcatagatgcctcctt

SEQ ID NO: 187791 - DNA, 25 bp, Rattus norvegicus
atgaacgtgtacacttcccatggga

SEQ ID NO: 187792 - DNA, 25 bp, Rattus norvegicus
atgaacgtgtactcttcccatggga

SEQ ID NO: 187793 - DNA, 25 bp, Rattus norvegicus
atgaacgttgagcacgcccagcagt

SEQ ID NO: 187794 - DNA, 25 bp, Rattus norvegicus
atgaacgttgaggacgcccagcagt

SEQ ID NO: 187795 - DNA, 25 bp, Rattus norvegicus
atgaacgttgggaacctgggctctg

SEQ ID NO: 187796 - DNA, 25 bp, Rattus norvegicus
atgaacgttgggtacctgggctctg

SEQ ID NO: 187797 - DNA, 25 bp, Rattus norvegicus
atgaactaaagcagcgttaagcggc

SEQ ID NO: 187798 - DNA, 25 bp, Rattus norvegicus
atgaactaaagctgcgttaagcggc

SEQ ID NO: 187799 - DNA, 25 bp, Rattus norvegicus
atgaactaagatctcccgaggctgg

SEQ ID NO: 187800 - DNA, 25 bp, Rattus norvegicus
atgaactaagatgtcccgaggctgg

SEQ ID NO: 187801 - DNA, 25 bp, Rattus norvegicus
atgaactacccgctgatccacaggg

SEQ ID NO: 187802 - DNA, 25 bp, Rattus norvegicus
atgaactacccggtgatccacaggg

SEQ ID NO: 187803 - DNA, 25 bp, Rattus norvegicus
atgaactacttgagacctgctaacc

SEQ ID NO: 187804 - DNA, 25 bp, Rattus norvegicus
atgaactacttgtgacctgctaacc

SEQ ID NO: 187805 - DNA, 25 bp, Rattus norvegicus
atgaactagatgactcagctcccgt

SEQ ID NO: 187806 - DNA, 25 bp, Rattus norvegicus
atgaactagatgtctcagctcccgt

SEQ ID NO: 187807 - DNA, 25 bp, Rattus norvegicus
atgaactattttaacagccatcagt

SEQ ID NO: 187808 - DNA, 25 bp, Rattus norvegicus
atgaactatttttacagccatcagt

SEQ ID NO: 187809 - DNA, 25 bp, Rattus norvegicus
atgaactcaaatctcccgaatgccg

SEQ ID NO: 187810 - DNA, 25 bp, Rattus norvegicus
atgaactcaaatgtcccgaatgccg

SEQ ID NO: 187811 - DNA, 25 bp, Rattus norvegicus
atgaactcagtcagctcacatatcc

SEQ ID NO: 187812 - DNA, 25 bp, Rattus norvegicus
atgaactcagtctgctcacatatcc

SEQ ID NO: 187813 - DNA, 25 bp, Rattus norvegicus
atgaactcattcagtgcacttctgg

SEQ ID NO: 187814 - DNA, 25 bp, Rattus norvegicus
atgaactcattctgtgcacttctgg

SEQ ID NO: 187815 - DNA, 25 bp, Rattus norvegicus
atgaactcccagatgacgtcagaat

SEQ ID NO: 187816 - DNA, 25 bp, Rattus norvegicus
atgaactcccagttgacgtcagaat

SEQ ID NO: 187817 - DNA, 25 bp, Rattus norvegicus
atgaactcctggaagtcctgtgtct

SEQ ID NO: 187818 - DNA, 25 bp, Rattus norvegicus
atgaactcctggtagtcctgtgtct

SEQ ID NO: 187819 - DNA, 25 bp, Rattus norvegicus
atgaactccttgacctctcttggga

SEQ ID NO: 187820 - DNA, 25 bp, Rattus norvegicus
atgaactccttgtcctctcttggga

SEQ ID NO: 187821 - DNA, 25 bp, Rattus norvegicus
atgaactcgccacgtagctctgata

SEQ ID NO: 187822 - DNA, 25 bp, Rattus norvegicus
atgaactcgccaggtagctctgata

SEQ ID NO: 187823 - DNA, 25 bp, Rattus norvegicus
atgaactctcaccattctagaccac

SEQ ID NO: 187824 - DNA, 25 bp, Rattus norvegicus
atgaactctcacgattctagaccac

SEQ ID NO: 187825 - DNA, 25 bp, Rattus norvegicus
atgaactcttcgattgatccccagg

SEQ ID NO: 187826 - DNA, 25 bp, Rattus norvegicus
atgaactcttcgtttgatccccagg

SEQ ID NO: 187827 - DNA, 25 bp, Rattus norvegicus
atgaactctttcatgccttgggaca

SEQ ID NO: 187828 - DNA, 25 bp, Rattus norvegicus
atgaactctttccatttctaatgaa

SEQ ID NO: 187829 - DNA, 25 bp, Rattus norvegicus
atgaactctttcgatttctaatgaa

SEQ ID NO: 187830 - DNA, 25 bp, Rattus norvegicus
atgaactctttcttgccttgggaca

SEQ ID NO: 187831 - DNA, 25 bp, Rattus norvegicus
atgaactgaaacatcctgtccgagt

SEQ ID NO: 187832 - DNA, 25 bp, Rattus norvegicus
atgaactgaaacttcctgtccgagt

SEQ ID NO: 187833 - DNA, 25 bp, Rattus norvegicus
atgaactgaattaatgccttgactt

SEQ ID NO: 187834 - DNA, 25 bp, Rattus norvegicus
atgaactgaatttatgccttgactt

SEQ ID NO: 187835 - DNA, 25 bp, Rattus norvegicus
atgaactgacatatgtctccatgtt

SEQ ID NO: 187836 - DNA, 25 bp, Rattus norvegicus
atgaactgacatttgtctccatgtt

SEQ ID NO: 187837 - DNA, 25 bp, Rattus norvegicus
atgaactgagttcgaggccctcctg

SEQ ID NO: 187838 - DNA, 25 bp, Rattus norvegicus
atgaactgagttggaggccctcctg

SEQ ID NO: 187839 - DNA, 25 bp, Rattus norvegicus
atgaactgatgtaccttcatctcct

SEQ ID NO: 187840 - DNA, 25 bp, Rattus norvegicus
atgaactgatgttccttcatctcct

SEQ ID NO: 187841 - DNA, 25 bp, Rattus norvegicus
atgaactgcaaccaatccttcaggg

SEQ ID NO: 187842 - DNA, 25 bp, Rattus norvegicus
atgaactgcaacgaatccttcaggg

SEQ ID NO: 187843 - DNA, 25 bp, Rattus norvegicus
atgaactgcagcctctgagtggaca

SEQ ID NO: 187844 - DNA, 25 bp, Rattus norvegicus
atgaactgcagcgtctgagtggaca

SEQ ID NO: 187845 - DNA, 25 bp, Rattus norvegicus
atgaactggccacaaggagtatgaa

SEQ ID NO: 187846 - DNA, 25 bp, Rattus norvegicus
atgaactggccagaaggagtatgaa

SEQ ID NO: 187847 - DNA, 25 bp, Rattus norvegicus
atgaactggtgactgtccttccggc

SEQ ID NO: 187848 - DNA, 25 bp, Rattus norvegicus
atgaactggtgagtgtccttccggc

SEQ ID NO: 187849 - DNA, 25 bp, Rattus norvegicus
atgaactgtcccagagattggcccg

SEQ ID NO: 187850 - DNA, 25 bp, Rattus norvegicus
atgaactgtccctgagattggcccg

SEQ ID NO: 187851 - DNA, 25 bp, Rattus norvegicus
atgaactgtctcacactgacatctc

SEQ ID NO: 187852 - DNA, 25 bp, Rattus norvegicus
atgaactgtctctcactgacatctc

SEQ ID NO: 187853 - DNA, 25 bp, Rattus norvegicus
atgaactgtgttcgtctctgtgtgt

SEQ ID NO: 187854 - DNA, 25 bp, Rattus norvegicus
atgaactgtgttggtctctgtgtgt

SEQ ID NO: 187855 - DNA, 25 bp, Rattus norvegicus
atgaacttacagagacccgatggtc

SEQ ID NO: 187856 - DNA, 25 bp, Rattus norvegicus
atgaacttacagtgacccgatggtc

SEQ ID NO: 187857 - DNA, 25 bp, Rattus norvegicus
atgaacttatctctagcagtgccca

SEQ ID NO: 187858 - DNA, 25 bp, Rattus norvegicus
atgaacttatctgtagcagtgccca

SEQ ID NO: 187859 - DNA, 25 bp, Rattus norvegicus
atgaacttcagtctccttacagaat

SEQ ID NO: 187860 - DNA, 25 bp, Rattus norvegicus
atgaacttcagtgtccttacagaat

SEQ ID NO: 187861 - DNA, 25 bp, Rattus norvegicus
atgaacttcgtcacagtcttctgaa

SEQ ID NO: 187862 - DNA, 25 bp, Rattus norvegicus
atgaacttcgtctcagtcttctgaa

SEQ ID NO: 187863 - DNA, 25 bp, Rattus norvegicus
atgaacttctggatgtctgtcaaag

SEQ ID NO: 187864 - DNA, 25 bp, Rattus norvegicus
atgaacttctggttgtctgtcaaag

SEQ ID NO: 187865 - DNA, 25 bp, Rattus norvegicus
atgaacttctgtcctgccttcctta

SEQ ID NO: 187866 - DNA, 25 bp, Rattus norvegicus
atgaacttctgtgctgccttcctta

SEQ ID NO: 187867 - DNA, 25 bp, Rattus norvegicus
atgaacttgaacacctttatgggtt

SEQ ID NO: 187868 - DNA, 25 bp, Rattus norvegicus
atgaacttgaactcctttatgggtt

SEQ ID NO: 187869 - DNA, 25 bp, Rattus norvegicus
atgaacttgcatcggctacagcttg

SEQ ID NO: 187870 - DNA, 25 bp, Rattus norvegicus
atgaacttgcatgggctacagcttg

SEQ ID NO: 187871 - DNA, 25 bp, Rattus norvegicus
atgaacttggctcctttgtgtggaa

SEQ ID NO: 187872 - DNA, 25 bp, Rattus norvegicus
atgaacttggctgctttgtgtggaa

SEQ ID NO: 187873 - DNA, 25 bp, Rattus norvegicus
atgaacttgggacatccagccttac

SEQ ID NO: 187874 - DNA, 25 bp, Rattus norvegicus
atgaacttgggagatccagccttac

SEQ ID NO: 187875 - DNA, 25 bp, Rattus norvegicus
atgaacttggtgctatgtatgccca

SEQ ID NO: 187876 - DNA, 25 bp, Rattus norvegicus
atgaacttggtggtatgtatgccca

SEQ ID NO: 187877 - DNA, 25 bp, Rattus norvegicus
atgaacttgtctaaatgagtagcaa

SEQ ID NO: 187878 - DNA, 25 bp, Rattus norvegicus
atgaacttgtcttaatgagtagcaa

SEQ ID NO: 187879 - DNA, 25 bp, Rattus norvegicus
atgaacttgtgaagaactttgtaac

SEQ ID NO: 187880 - DNA, 25 bp, Rattus norvegicus
atgaacttgtgatgaactttgtaac

SEQ ID NO: 187881 - DNA, 25 bp, Rattus norvegicus
atgaacttgttcctgcttctctgac

SEQ ID NO: 187882 - DNA, 25 bp, Rattus norvegicus
atgaacttgttcctggcattctgca

SEQ ID NO: 187883 - DNA, 25 bp, Rattus norvegicus
atgaacttgttcgtgcttctctgac

SEQ ID NO: 187884 - DNA, 25 bp, Rattus norvegicus
atgaacttgttcgtggcattctgca

SEQ ID NO: 187885 - DNA, 25 bp, Rattus norvegicus
atgaacttgttgctgttttcccaca

SEQ ID NO: 187886 - DNA, 25 bp, Rattus norvegicus
atgaacttgttggtgttttcccaca

SEQ ID NO: 187887 - DNA, 25 bp, Rattus norvegicus
atgaactttcttcaccagctttctc

SEQ ID NO: 187888 - DNA, 25 bp, Rattus norvegicus
atgaactttcttgaccagctttctc

SEQ ID NO: 187889 - DNA, 25 bp, Rattus norvegicus
atgaactttgggagtgtctgtcccg

SEQ ID NO: 187890 - DNA, 25 bp, Rattus norvegicus
atgaactttgggtgtgtctgtcccg

SEQ ID NO: 187891 - DNA, 25 bp, Rattus norvegicus
atgaactttttgcaagcacacttgt

SEQ ID NO: 187892 - DNA, 25 bp, Rattus norvegicus
atgaactttttggaagcacacttgt

SEQ ID NO: 187893 - DNA, 25 bp, Rattus norvegicus
atgaagaaaacgcatcccttccggc

SEQ ID NO: 187894 - DNA, 25 bp, Rattus norvegicus
atgaagaaaacggatcccttccggc

SEQ ID NO: 187895 - DNA, 25 bp, Rattus norvegicus
atgaagaaactcctggcctgtgtga

SEQ ID NO: 187896 - DNA, 25 bp, Rattus norvegicus
atgaagaaactcgtggcctgtgtga

SEQ ID NO: 187897 - DNA, 25 bp, Rattus norvegicus
atgaagaacatgatgccctggaaac

SEQ ID NO: 187898 - DNA, 25 bp, Rattus norvegicus
atgaagaacatgttgccctggaaac

SEQ ID NO: 187899 - DNA, 25 bp, Rattus norvegicus
atgaagaacgaaatccttctctccc

SEQ ID NO: 187900 - DNA, 25 bp, Rattus norvegicus
atgaagaacgaattccttctctccc

SEQ ID NO: 187901 - DNA, 25 bp, Rattus norvegicus
atgaagaagcaccacccatctctac

SEQ ID NO: 187902 - DNA, 25 bp, Rattus norvegicus
atgaagaagcacgacccatctctac

SEQ ID NO: 187903 - DNA, 25 bp, Rattus norvegicus
atgaagaaggttctgtcccgcctgg

SEQ ID NO: 187904 - DNA, 25 bp, Rattus norvegicus
atgaagaaggttgtgtcccgcctgg

SEQ ID NO: 187905 - DNA, 25 bp, Rattus norvegicus
atgaagaatgcccatgtcaccgacc

SEQ ID NO: 187906 - DNA, 25 bp, Rattus norvegicus
atgaagaatgccgatgtcaccgacc

SEQ ID NO: 187907 - DNA, 25 bp, Rattus norvegicus
atgaagacacacaacctggatgagc

SEQ ID NO: 187908 - DNA, 25 bp, Rattus norvegicus
atgaagacacactacctggatgagc

SEQ ID NO: 187909 - DNA, 25 bp, Rattus norvegicus
atgaagaccagccaagtccagcgag

SEQ ID NO: 187910 - DNA, 25 bp, Rattus norvegicus
atgaagaccagcgaagtccagcgag

SEQ ID NO: 187911 - DNA, 25 bp, Rattus norvegicus
atgaagacctggacagtagcagcca

SEQ ID NO: 187912 - DNA, 25 bp, Rattus norvegicus
atgaagacctggtcagtagcagcca

SEQ ID NO: 187913 - DNA, 25 bp, Rattus norvegicus
atgaagacgctgctgctgtacgagt

SEQ ID NO: 187914 - DNA, 25 bp, Rattus norvegicus
atgaagacgctggtgctgtacgagt

SEQ ID NO: 187915 - DNA, 25 bp, Rattus norvegicus
atgaagacggcaacgcgagtggctc

SEQ ID NO: 187916 - DNA, 25 bp, Rattus norvegicus
atgaagacggcatcgcgagtggctc

SEQ ID NO: 187917 - DNA, 25 bp, Rattus norvegicus
atgaagagagctctccatggctggc

SEQ ID NO: 187918 - DNA, 25 bp, Rattus norvegicus
atgaagagagctgtccatggctggc

SEQ ID NO: 187919 - DNA, 25 bp, Rattus norvegicus
atgaagagagtcaccattcccttgc

SEQ ID NO: 187920 - DNA, 25 bp, Rattus norvegicus
atgaagagagtctccattcccttgc

SEQ ID NO: 187921 - DNA, 25 bp, Rattus norvegicus
atgaagagcacgcagccactggatc

SEQ ID NO: 187922 - DNA, 25 bp, Rattus norvegicus
atgaagagcacggagccactggatc

SEQ ID NO: 187923 - DNA, 25 bp, Rattus norvegicus
atgaagagcctcatctgaactccag

SEQ ID NO: 187924 - DNA, 25 bp, Rattus norvegicus
atgaagagcctcatgggcgggacct

SEQ ID NO: 187925 - DNA, 25 bp, Rattus norvegicus
atgaagagcctcttctgaactccag

SEQ ID NO: 187926 - DNA, 25 bp, Rattus norvegicus
atgaagagcctcttgggcgggacct

SEQ ID NO: 187927 - DNA, 25 bp, Rattus norvegicus
atgaagagctggaccacccgaaggg

SEQ ID NO: 187928 - DNA, 25 bp, Rattus norvegicus
atgaagagctggtccacccgaaggg

SEQ ID NO: 187929 - DNA, 25 bp, Rattus norvegicus
atgaagaggactatcctttccacga

SEQ ID NO: 187930 - DNA, 25 bp, Rattus norvegicus
atgaagaggactttcctttccacga

SEQ ID NO: 187931 - DNA, 25 bp, Rattus norvegicus
atgaagaggatgacgaggtgacttt

SEQ ID NO: 187932 - DNA, 25 bp, Rattus norvegicus
atgaagaggatgtcgaggtgacttt

SEQ ID NO: 187933 - DNA, 25 bp, Rattus norvegicus
atgaagaggcttattgtgcacaaaa

SEQ ID NO: 187934 - DNA, 25 bp, Rattus norvegicus
atgaagaggctttttgtgcacaaaa

SEQ ID NO: 187935 - DNA, 25 bp, Rattus norvegicus
atgaagagtaagcattggttgcccc

SEQ ID NO: 187936 - DNA, 25 bp, Rattus norvegicus
atgaagagtaaggattggttgcccc

SEQ ID NO: 187937 - DNA, 25 bp, Rattus norvegicus
atgaagagtctgaatcccaaaggaa

SEQ ID NO: 187938 - DNA, 25 bp, Rattus norvegicus
atgaagagtctgagggctccatgcc

SEQ ID NO: 187939 - DNA, 25 bp, Rattus norvegicus
atgaagagtctgctttctcaaggct

SEQ ID NO: 187940 - DNA, 25 bp, Rattus norvegicus
atgaagagtctggtttctcaaggct

SEQ ID NO: 187941 - DNA, 25 bp, Rattus norvegicus
atgaagagtctgtatcccaaaggaa

SEQ ID NO: 187942 - DNA, 25 bp, Rattus norvegicus
atgaagagtctgtgggctccatgcc

SEQ ID NO: 187943 - DNA, 25 bp, Rattus norvegicus
atgaagagtgctcgcgtctccatga

SEQ ID NO: 187944 - DNA, 25 bp, Rattus norvegicus
atgaagagtgctggcgtctccatga

SEQ ID NO: 187945 - DNA, 25 bp, Rattus norvegicus
atgaagatagttatcctccgtggac

SEQ ID NO: 187946 - DNA, 25 bp, Rattus norvegicus
atgaagatagttttcctccgtggac

SEQ ID NO: 187947 - DNA, 25 bp, Rattus norvegicus
atgaagattcttatcttggcccctt

SEQ ID NO: 187948 - DNA, 25 bp, Rattus norvegicus
atgaagattcttttcttggcccctt

SEQ ID NO: 187949 - DNA, 25 bp, Rattus norvegicus
atgaagattgatcagcttgtgtatg

SEQ ID NO: 187950 - DNA, 25 bp, Rattus norvegicus
atgaagattgatgagcttgtgtatg

SEQ ID NO: 187951 - DNA, 25 bp, Rattus norvegicus
atgaagcaacatcctgaacagtgaa

SEQ ID NO: 187952 - DNA, 25 bp, Rattus norvegicus
atgaagcaacatgctgaacagtgaa

SEQ ID NO: 187953 - DNA, 25 bp, Rattus norvegicus
atgaagcaatgacactgccctccca

SEQ ID NO: 187954 - DNA, 25 bp, Rattus norvegicus
atgaagcaatgagactgccctccca

SEQ ID NO: 187955 - DNA, 25 bp, Rattus norvegicus
atgaagcagataacccagctcctac

SEQ ID NO: 187956 - DNA, 25 bp, Rattus norvegicus
atgaagcagatatcccagctcctac

SEQ ID NO: 187957 - DNA, 25 bp, Rattus norvegicus
atgaagcatgctctgctctctctta

SEQ ID NO: 187958 - DNA, 25 bp, Rattus norvegicus
atgaagcatgctgtgctctctctta

SEQ ID NO: 187959 - DNA, 25 bp, Rattus norvegicus
atgaagcatggtactcctttttgag

SEQ ID NO: 187960 - DNA, 25 bp, Rattus norvegicus
atgaagcatggttctcctttttgag

SEQ ID NO: 187961 - DNA, 25 bp, Rattus norvegicus
atgaagccaaacctagcaccattgc

SEQ ID NO: 187962 - DNA, 25 bp, Rattus norvegicus
atgaagccaaacgtagcaccattgc

SEQ ID NO: 187963 - DNA, 25 bp, Rattus norvegicus
atgaagccaagtccggcggcgaccc

SEQ ID NO: 187964 - DNA, 25 bp, Rattus norvegicus
atgaagccaagtgcggcggcgaccc

SEQ ID NO: 187965 - DNA, 25 bp, Rattus norvegicus
atgaagccctggagaaggccctgga

SEQ ID NO: 187966 - DNA, 25 bp, Rattus norvegicus
atgaagccctggtgaaggccctgga

SEQ ID NO: 187967 - DNA, 25 bp, Rattus norvegicus
atgaagccctgtcttcaatcctcaa

SEQ ID NO: 187968 - DNA, 25 bp, Rattus norvegicus
atgaagccctgtgttcaatcctcaa

SEQ ID NO: 187969 - DNA, 25 bp, Rattus norvegicus
atgaagccgcttagacttttttgtt

SEQ ID NO: 187970 - DNA, 25 bp, Rattus norvegicus
atgaagccgctttgacttttttgtt

SEQ ID NO: 187971 - DNA, 25 bp, Rattus norvegicus
atgaagcctcatagtgactggtcca

SEQ ID NO: 187972 - DNA, 25 bp, Rattus norvegicus
atgaagcctcattgtgactggtcca

SEQ ID NO: 187973 - DNA, 25 bp, Rattus norvegicus
atgaagcctctgagcgtgtgttgat

SEQ ID NO: 187974 - DNA, 25 bp, Rattus norvegicus
atgaagcctctgtgcgtgtgttgat

SEQ ID NO: 187975 - DNA, 25 bp, Rattus norvegicus
atgaagcctgtgctggtctcctact

SEQ ID NO: 187976 - DNA, 25 bp, Rattus norvegicus
atgaagcctgtggtggtctcctact

SEQ ID NO: 187977 - DNA, 25 bp, Rattus norvegicus
atgaagccttcgagtcgtcttacca

SEQ ID NO: 187978 - DNA, 25 bp, Rattus norvegicus
atgaagccttcgtgtcgtcttacca

SEQ ID NO: 187979 - DNA, 25 bp, Rattus norvegicus
atgaagcgaaccacaggcagccagc

SEQ ID NO: 187980 - DNA, 25 bp, Rattus norvegicus
atgaagcgaacctcaggcagccagc

SEQ ID NO: 187981 - DNA, 25 bp, Rattus norvegicus
atgaagcgcaccatcaacactgtgt

SEQ ID NO: 187982 - DNA, 25 bp, Rattus norvegicus
atgaagcgcaccttcaacactgtgt

SEQ ID NO: 187983 - DNA, 25 bp, Rattus norvegicus
atgaagcgcgttccatatccgtagc

SEQ ID NO: 187984 - DNA, 25 bp, Rattus norvegicus
atgaagcgcgttgcatatccgtagc

SEQ ID NO: 187985 - DNA, 25 bp, Rattus norvegicus
atgaagcgggcccattttcagttac

SEQ ID NO: 187986 - DNA, 25 bp, Rattus norvegicus
atgaagcgggccgattttcagttac

SEQ ID NO: 187987 - DNA, 25 bp, Rattus norvegicus
atgaagctaatgctagccagatctg

SEQ ID NO: 187988 - DNA, 25 bp, Rattus norvegicus
atgaagctaatggtagccagatctg

SEQ ID NO: 187989 - DNA, 25 bp, Rattus norvegicus
atgaagctactccaagctctctttg

SEQ ID NO: 187990 - DNA, 25 bp, Rattus norvegicus
atgaagctactcgaagctctctttg

SEQ ID NO: 187991 - DNA, 25 bp, Rattus norvegicus
atgaagctatccagtcagcacccgg

SEQ ID NO: 187992 - DNA, 25 bp, Rattus norvegicus
atgaagctatcctgtcagcacccgg

SEQ ID NO: 187993 - DNA, 25 bp, Rattus norvegicus
atgaagctcaagctttgtgggcaat

SEQ ID NO: 187994 - DNA, 25 bp, Rattus norvegicus
atgaagctcaaggtttgtgggcaat

SEQ ID NO: 187995 - DNA, 25 bp, Rattus norvegicus
atgaagctcattcgccaaggtaccc

SEQ ID NO: 187996 - DNA, 25 bp, Rattus norvegicus
atgaagctcattggccaaggtaccc

SEQ ID NO: 187997 - DNA, 25 bp, Rattus norvegicus
atgaagctctggctttgctgatctg

SEQ ID NO: 187998 - DNA, 25 bp, Rattus norvegicus
atgaagctctgggtttgctgatctg

SEQ ID NO: 187999 - DNA, 25 bp, Rattus norvegicus
atgaagctctgtctggaagaccccg

SEQ ID NO: 188000 - DNA, 25 bp, Rattus norvegicus
atgaagctctgtgtggaagaccccg

SEQ ID NO: 188001 - DNA, 25 bp, Rattus norvegicus
atgaagctgaagctggctcactcct

SEQ ID NO: 188002 - DNA, 25 bp, Rattus norvegicus
atgaagctgaaggtggctcactcct

SEQ ID NO: 188003 - DNA, 25 bp, Rattus norvegicus
atgaagctgaggaagcctccgccca

SEQ ID NO: 188004 - DNA, 25 bp, Rattus norvegicus
atgaagctgaggtagcctccgccca

SEQ ID NO: 188005 - DNA, 25 bp, Rattus norvegicus
atgaagctgcatcttcagtccccat

SEQ ID NO: 188006 - DNA, 25 bp, Rattus norvegicus
atgaagctgcatgttcagtccccat

SEQ ID NO: 188007 - DNA, 25 bp, Rattus norvegicus
atgaagctgcttattccatggccac

SEQ ID NO: 188008 - DNA, 25 bp, Rattus norvegicus
atgaagctgctttttccatggccac

SEQ ID NO: 188009 - DNA, 25 bp, Rattus norvegicus
atgaagctgtcaccactgaaacctg

SEQ ID NO: 188010 - DNA, 25 bp, Rattus norvegicus
atgaagctgtcagcactgaaacctg

SEQ ID NO: 188011 - DNA, 25 bp, Rattus norvegicus
atgaagcttaccaaggccgtgcggt

SEQ ID NO: 188012 - DNA, 25 bp, Rattus norvegicus
atgaagcttacctaggccgtgcggt

SEQ ID NO: 188013 - DNA, 25 bp, Rattus norvegicus
atgaagctttacaccgaattcctgg

SEQ ID NO: 188014 - DNA, 25 bp, Rattus norvegicus
atgaagctttactccgaattcctgg

SEQ ID NO: 188015 - DNA, 25 bp, Rattus norvegicus
atgaagctttcacgccaactacctt

SEQ ID NO: 188016 - DNA, 25 bp, Rattus norvegicus
atgaagctttcaggccaactacctt

SEQ ID NO: 188017 - DNA, 25 bp, Rattus norvegicus
atgaaggacaagctgcaggctctgt

SEQ ID NO: 188018 - DNA, 25 bp, Rattus norvegicus
atgaaggacaaggtgcaggctctgt

SEQ ID NO: 188019 - DNA, 25 bp, Rattus norvegicus
atgaaggactgaaacctcgccagaa

SEQ ID NO: 188020 - DNA, 25 bp, Rattus norvegicus
atgaaggactgatacctcgccagaa

SEQ ID NO: 188021 - DNA, 25 bp, Rattus norvegicus
atgaaggagcctctctgccctggtg

SEQ ID NO: 188022 - DNA, 25 bp, Rattus norvegicus
atgaaggagcctgtctgccctggtg

SEQ ID NO: 188023 - DNA, 25 bp, Rattus norvegicus
atgaaggcaagcaactccacattcc

SEQ ID NO: 188024 - DNA, 25 bp, Rattus norvegicus
atgaaggcaagctactccacattcc

SEQ ID NO: 188025 - DNA, 25 bp, Rattus norvegicus
atgaaggcacgcaggctgtgtctca

SEQ ID NO: 188026 - DNA, 25 bp, Rattus norvegicus
atgaaggcacgctggctgtgtctca

SEQ ID NO: 188027 - DNA, 25 bp, Rattus norvegicus
atgaaggccaagcttgctcgcctgg

SEQ ID NO: 188028 - DNA, 25 bp, Rattus norvegicus
atgaaggccaaggttgctcgcctgg

SEQ ID NO: 188029 - DNA, 25 bp, Rattus norvegicus
atgaaggccatgcagtctctcaagt

SEQ ID NO: 188030 - DNA, 25 bp, Rattus norvegicus
atgaaggccatggagtctctcaagt

SEQ ID NO: 188031 - DNA, 25 bp, Rattus norvegicus
atgaaggcctgccatattcagtgca

SEQ ID NO: 188032 - DNA, 25 bp, Rattus norvegicus
atgaaggcctgcgatattcagtgca

SEQ ID NO: 188033 - DNA, 25 bp, Rattus norvegicus
atgaaggcctggctctccctttcaa

SEQ ID NO: 188034 - DNA, 25 bp, Rattus norvegicus
atgaaggcctgggtctccctttcaa

SEQ ID NO: 188035 - DNA, 25 bp, Rattus norvegicus
atgaaggccttgagccaaactgcct

SEQ ID NO: 188036 - DNA, 25 bp, Rattus norvegicus
atgaaggccttgtgccaaactgcct

SEQ ID NO: 188037 - DNA, 25 bp, Rattus norvegicus
atgaaggcctttcggcagctagctt

SEQ ID NO: 188038 - DNA, 25 bp, Rattus norvegicus
atgaaggcctttgggcagctagctt

SEQ ID NO: 188039 - DNA, 25 bp, Rattus norvegicus
atgaaggcggcaagcagacctgctc

SEQ ID NO: 188040 - DNA, 25 bp, Rattus norvegicus
atgaaggcggcatgcagacctgctc

SEQ ID NO: 188041 - DNA, 25 bp, Rattus norvegicus
atgaaggctaagacactatccatgt

SEQ ID NO: 188042 - DNA, 25 bp, Rattus norvegicus
atgaaggctaagtcactatccatgt

SEQ ID NO: 188043 - DNA, 25 bp, Rattus norvegicus
atgaaggcttacatggacccagagc

SEQ ID NO: 188044 - DNA, 25 bp, Rattus norvegicus
atgaaggcttacttggacccagagc

SEQ ID NO: 188045 - DNA, 25 bp, Rattus norvegicus
atgaagggaagacccgcgcagccct

SEQ ID NO: 188046 - DNA, 25 bp, Rattus norvegicus
atgaagggaagagccgcgcagccct

SEQ ID NO: 188047 - DNA, 25 bp, Rattus norvegicus
atgaagggcaaaaaacactgtgaaa

SEQ ID NO: 188048 - DNA, 25 bp, Rattus norvegicus
atgaagggcaaataacactgtgaaa

SEQ ID NO: 188049 - DNA, 25 bp, Rattus norvegicus
atgaagggcagtaggtactcggtcc

SEQ ID NO: 188050 - DNA, 25 bp, Rattus norvegicus
atgaagggcagttggtactcggtcc

SEQ ID NO: 188051 - DNA, 25 bp, Rattus norvegicus
atgaagggccgtcgctctcacatcg

SEQ ID NO: 188052 - DNA, 25 bp, Rattus norvegicus
atgaagggccgtggctctcacatcg

SEQ ID NO: 188053 - DNA, 25 bp, Rattus norvegicus
atgaagggctggctgcgtatttttc

SEQ ID NO: 188054 - DNA, 25 bp, Rattus norvegicus
atgaagggctgggtgcgtatttttc

SEQ ID NO: 188055 - DNA, 25 bp, Rattus norvegicus
atgaagggcttaactttccaggcac

SEQ ID NO: 188056 - DNA, 25 bp, Rattus norvegicus
atgaagggcttatctttccaggcac

SEQ ID NO: 188057 - DNA, 25 bp, Rattus norvegicus
atgaagggcttcacatcctctgagt

SEQ ID NO: 188058 - DNA, 25 bp, Rattus norvegicus
atgaagggcttctcatcctctgagt

SEQ ID NO: 188059 - DNA, 25 bp, Rattus norvegicus
atgaaggtacacattcagagatgtt

SEQ ID NO: 188060 - DNA, 25 bp, Rattus norvegicus
atgaaggtacactttcagagatgtt

SEQ ID NO: 188061 - DNA, 25 bp, Rattus norvegicus
atgaaggtctctaccgcgcctttgg

SEQ ID NO: 188062 - DNA, 25 bp, Rattus norvegicus
atgaaggtctcttccgcgcctttgg

SEQ ID NO: 188063 - DNA, 25 bp, Rattus norvegicus
atgaaggtctgaaccactgagtgta

SEQ ID NO: 188064 - DNA, 25 bp, Rattus norvegicus
atgaaggtctgatccactgagtgta

SEQ ID NO: 188065 - DNA, 25 bp, Rattus norvegicus
atgaaggtcttcagtactcggcaaa

SEQ ID NO: 188066 - DNA, 25 bp, Rattus norvegicus
atgaaggtcttctgtactcggcaaa

SEQ ID NO: 188067 - DNA, 25 bp, Rattus norvegicus
atgaaggtgccgctcacgaactgca

SEQ ID NO: 188068 - DNA, 25 bp, Rattus norvegicus
atgaaggtgccggtcacgaactgca

SEQ ID NO: 188069 - DNA, 25 bp, Rattus norvegicus
atgaaggtgcgtaccagtgacctga

SEQ ID NO: 188070 - DNA, 25 bp, Rattus norvegicus
atgaaggtgcgttccagtgacctga

SEQ ID NO: 188071 - DNA, 25 bp, Rattus norvegicus
atgaaggtgtccacgtttcacgagc

SEQ ID NO: 188072 - DNA, 25 bp, Rattus norvegicus
atgaaggtgtcctcgtttcacgagc

SEQ ID NO: 188073 - DNA, 25 bp, Rattus norvegicus
atgaaggtgtttacgaattccgtga

SEQ ID NO: 188074 - DNA, 25 bp, Rattus norvegicus
atgaaggtgttttcgaattccgtga

SEQ ID NO: 188075 - DNA, 25 bp, Rattus norvegicus
atgaaggttacactccacaggtgat

SEQ ID NO: 188076 - DNA, 25 bp, Rattus norvegicus
atgaaggttacagtccacaggtgat

SEQ ID NO: 188077 - DNA, 25 bp, Rattus norvegicus
atgaagtaggcccagcgtctcacac

SEQ ID NO: 188078 - DNA, 25 bp, Rattus norvegicus
atgaagtaggccgagcgtctcacac

SEQ ID NO: 188079 - DNA, 25 bp, Rattus norvegicus
atgaagtaggtgcatgctgccctca

SEQ ID NO: 188080 - DNA, 25 bp, Rattus norvegicus
atgaagtaggtggatgctgccctca

SEQ ID NO: 188081 - DNA, 25 bp, Rattus norvegicus
atgaagtagtgtccgccttaacagc

SEQ ID NO: 188082 - DNA, 25 bp, Rattus norvegicus
atgaagtagtgtgcgccttaacagc

SEQ ID NO: 188083 - DNA, 25 bp, Rattus norvegicus
atgaagtcagtactcctgctccatc

SEQ ID NO: 188084 - DNA, 25 bp, Rattus norvegicus
atgaagtcagtagtcctgctccatc

SEQ ID NO: 188085 - DNA, 25 bp, Rattus norvegicus
atgaagtcatatcggctgtttcctt

SEQ ID NO: 188086 - DNA, 25 bp, Rattus norvegicus
atgaagtcatatgggctgtttcctt

SEQ ID NO: 188087 - DNA, 25 bp, Rattus norvegicus
atgaagtccaaactcgctccgaggt

SEQ ID NO: 188088 - DNA, 25 bp, Rattus norvegicus
atgaagtccaaagtcgctccgaggt

SEQ ID NO: 188089 - DNA, 25 bp, Rattus norvegicus
atgaagtccaagcaggttacccaaa

SEQ ID NO: 188090 - DNA, 25 bp, Rattus norvegicus
atgaagtccaaggaggttacccaaa

SEQ ID NO: 188091 - DNA, 25 bp, Rattus norvegicus
atgaagtccaatccagccatccaag

SEQ ID NO: 188092 - DNA, 25 bp, Rattus norvegicus
atgaagtccaatgcagccatccaag

SEQ ID NO: 188093 - DNA, 25 bp, Rattus norvegicus
atgaagtcgtccatcttggcttcct

SEQ ID NO: 188094 - DNA, 25 bp, Rattus norvegicus
atgaagtcgtccttcttggcttcct

SEQ ID NO: 188095 - DNA, 25 bp, Rattus norvegicus
atgaagtctccaagtggtgcagctt

SEQ ID NO: 188096 - DNA, 25 bp, Rattus norvegicus
atgaagtctccatgtggtgcagctt

SEQ ID NO: 188097 - DNA, 25 bp, Rattus norvegicus
atgaagtctcttcaattctcccatc

SEQ ID NO: 188098 - DNA, 25 bp, Rattus norvegicus
atgaagtctcttgaattctcccatc

SEQ ID NO: 188099 - DNA, 25 bp, Rattus norvegicus
atgaagtctgcaatctactcaagaa

SEQ ID NO: 188100 - DNA, 25 bp, Rattus norvegicus
atgaagtctgcattctactcaagaa

SEQ ID NO: 188101 - DNA, 25 bp, Rattus norvegicus
atgaagtcttggctccagaaggccc

SEQ ID NO: 188102 - DNA, 25 bp, Rattus norvegicus
atgaagtcttgggtccagaaggccc

SEQ ID NO: 188103 - DNA, 25 bp, Rattus norvegicus
atgaagtcttgtcgcatgtcaacat

SEQ ID NO: 188104 - DNA, 25 bp, Rattus norvegicus
atgaagtcttgtggcatgtcaacat

SEQ ID NO: 188105 - DNA, 25 bp, Rattus norvegicus
atgaagtgacagaaggccccgtctt

SEQ ID NO: 188106 - DNA, 25 bp, Rattus norvegicus
atgaagtgacagtaggccccgtctt

SEQ ID NO: 188107 - DNA, 25 bp, Rattus norvegicus
atgaagtgcctgctgatctccctgg

SEQ ID NO: 188108 - DNA, 25 bp, Rattus norvegicus
atgaagtgcctggtgatctccctgg

SEQ ID NO: 188109 - DNA, 25 bp, Rattus norvegicus
atgaagtggagacccagtcccctga

SEQ ID NO: 188110 - DNA, 25 bp, Rattus norvegicus
atgaagtggagagccagtcccctga

SEQ ID NO: 188111 - DNA, 25 bp, Rattus norvegicus
atgaagtggatcctccaaccgtgta

SEQ ID NO: 188112 - DNA, 25 bp, Rattus norvegicus
atgaagtggatcgtccaaccgtgta

SEQ ID NO: 188113 - DNA, 25 bp, Rattus norvegicus
atgaagtgggacctgacacccgtat

SEQ ID NO: 188114 - DNA, 25 bp, Rattus norvegicus
atgaagtgggacgtgacacccgtat

SEQ ID NO: 188115 - DNA, 25 bp, Rattus norvegicus
atgaagtgtatactaccgtcttgac

SEQ ID NO: 188116 - DNA, 25 bp, Rattus norvegicus
atgaagtgtatagtaccgtcttgac

SEQ ID NO: 188117 - DNA, 25 bp, Rattus norvegicus
atgaagtgtcttagcctttgtctgt

SEQ ID NO: 188118 - DNA, 25 bp, Rattus norvegicus
atgaagtgtctttgcctttgtctgt

SEQ ID NO: 188119 - DNA, 25 bp, Rattus norvegicus
atgaagttacatatgcagcagataa

SEQ ID NO: 188120 - DNA, 25 bp, Rattus norvegicus
atgaagttacatttgcagcagataa

SEQ ID NO: 188121 - DNA, 25 bp, Rattus norvegicus
atgaagttactccatcgcaagatgt

SEQ ID NO: 188122 - DNA, 25 bp, Rattus norvegicus
atgaagttactcctcaggctgactt

SEQ ID NO: 188123 - DNA, 25 bp, Rattus norvegicus
atgaagttactcgatcgcaagatgt

SEQ ID NO: 188124 - DNA, 25 bp, Rattus norvegicus
atgaagttactcgtcaggctgactt

SEQ ID NO: 188125 - DNA, 25 bp, Rattus norvegicus
atgaagttcaaacctactggagtta

SEQ ID NO: 188126 - DNA, 25 bp, Rattus norvegicus
atgaagttcaaagctactggagtta

SEQ ID NO: 188127 - DNA, 25 bp, Rattus norvegicus
atgaagttcaatcccttcgtgactt

SEQ ID NO: 188128 - DNA, 25 bp, Rattus norvegicus
atgaagttcaatgccttcgtgactt

SEQ ID NO: 188129 - DNA, 25 bp, Rattus norvegicus
atgaagttccaacctttgcgcctga

SEQ ID NO: 188130 - DNA, 25 bp, Rattus norvegicus
atgaagttccaagctttgcgcctga

SEQ ID NO: 188131 - DNA, 25 bp, Rattus norvegicus
atgaagttccctctgctgttatcac

SEQ ID NO: 188132 - DNA, 25 bp, Rattus norvegicus
atgaagttccctgtgctgttatcac

SEQ ID NO: 188133 - DNA, 25 bp, Rattus norvegicus
atgaagttcctgcaggtccgcagag

SEQ ID NO: 188134 - DNA, 25 bp, Rattus norvegicus
atgaagttcctggaggtccgcagag

SEQ ID NO: 188135 - DNA, 25 bp, Rattus norvegicus
atgaagttctccagttccatgatcc

SEQ ID NO: 188136 - DNA, 25 bp, Rattus norvegicus
atgaagttctcctgttccatgatcc

SEQ ID NO: 188137 - DNA, 25 bp, Rattus norvegicus
atgaagttctcgctctatttcttag

SEQ ID NO: 188138 - DNA, 25 bp, Rattus norvegicus
atgaagttctcggtctatttcttag

SEQ ID NO: 188139 - DNA, 25 bp, Rattus norvegicus
atgaagttgagcctgtcgacgcccg

SEQ ID NO: 188140 - DNA, 25 bp, Rattus norvegicus
atgaagttgagcgtgtcgacgcccg

SEQ ID NO: 188141 - DNA, 25 bp, Rattus norvegicus
atgaagttgatgattcttacaacag

SEQ ID NO: 188142 - DNA, 25 bp, Rattus norvegicus
atgaagttgatgtttcttacaacag

SEQ ID NO: 188143 - DNA, 25 bp, Rattus norvegicus
atgaagttgcatccttttgcagctt

SEQ ID NO: 188144 - DNA, 25 bp, Rattus norvegicus
atgaagttgcatgcttttgcagctt

SEQ ID NO: 188145 - DNA, 25 bp, Rattus norvegicus
atgaagttgcttcgtacacgttagg

SEQ ID NO: 188146 - DNA, 25 bp, Rattus norvegicus
atgaagttgcttggtacacgttagg

SEQ ID NO: 188147 - DNA, 25 bp, Rattus norvegicus
atgaagttgggcatcgtgctcgcac

SEQ ID NO: 188148 - DNA, 25 bp, Rattus norvegicus
atgaagttgggcttcgtgctcgcac

SEQ ID NO: 188149 - DNA, 25 bp, Rattus norvegicus
atgaagtttggtactttccgtggct

SEQ ID NO: 188150 - DNA, 25 bp, Rattus norvegicus
atgaagtttggttctttccgtggct

SEQ ID NO: 188151 - DNA, 25 bp, Rattus norvegicus
atgaagtttgttctagaaagttctt

SEQ ID NO: 188152 - DNA, 25 bp, Rattus norvegicus
atgaagtttgttgtagaaagttctt

SEQ ID NO: 188153 - DNA, 25 bp, Rattus norvegicus
atgaataaacttccttcagcccagg

SEQ ID NO: 188154 - DNA, 25 bp, Rattus norvegicus
atgaataaacttgcttcagcccagg

SEQ ID NO: 188155 - DNA, 25 bp, Rattus norvegicus
atgaataagttcctcaaccctgggt

SEQ ID NO: 188156 - DNA, 25 bp, Rattus norvegicus
atgaataagttcgtcaaccctgggt

SEQ ID NO: 188157 - DNA, 25 bp, Rattus norvegicus
atgaataatgttccccttactgaga

SEQ ID NO: 188158 - DNA, 25 bp, Rattus norvegicus
atgaataatgttgcccttactgaga

SEQ ID NO: 188159 - DNA, 25 bp, Rattus norvegicus
atgaatacatctcgactagccgtgc

SEQ ID NO: 188160 - DNA, 25 bp, Rattus norvegicus
atgaatacatctggactagccgtgc

SEQ ID NO: 188161 - DNA, 25 bp, Rattus norvegicus
atgaatacatttccttagcatctca

SEQ ID NO: 188162 - DNA, 25 bp, Rattus norvegicus
atgaatacatttgcttagcatctca

SEQ ID NO: 188163 - DNA, 25 bp, Rattus norvegicus
atgaataccgatactcacctactga

SEQ ID NO: 188164 - DNA, 25 bp, Rattus norvegicus
atgaataccgattctcacctactga

SEQ ID NO: 188165 - DNA, 25 bp, Rattus norvegicus
atgaatacgggtccatcaaccacac

SEQ ID NO: 188166 - DNA, 25 bp, Rattus norvegicus
atgaatacgggtgcatcaaccacac

SEQ ID NO: 188167 - DNA, 25 bp, Rattus norvegicus
atgaatataaacacacgggtgcaat

SEQ ID NO: 188168 - DNA, 25 bp, Rattus norvegicus
atgaatataaactcacgggtgcaat

SEQ ID NO: 188169 - DNA, 25 bp, Rattus norvegicus
atgaatcaaacccagcagcttcttt

SEQ ID NO: 188170 - DNA, 25 bp, Rattus norvegicus
atgaatcaaaccgagcagcttcttt

SEQ ID NO: 188171 - DNA, 25 bp, Rattus norvegicus
atgaatcaagctaactctgacacag

SEQ ID NO: 188172 - DNA, 25 bp, Rattus norvegicus
atgaatcaagcttactctgacacag

SEQ ID NO: 188173 - DNA, 25 bp, Rattus norvegicus
atgaatcaccttcttaacacttcct

SEQ ID NO: 188174 - DNA, 25 bp, Rattus norvegicus
atgaatcaccttgttaacacttcct

SEQ ID NO: 188175 - DNA, 25 bp, Rattus norvegicus
atgaatcactggacgctgactgttc

SEQ ID NO: 188176 - DNA, 25 bp, Rattus norvegicus
atgaatcactggtcgctgactgttc

SEQ ID NO: 188177 - DNA, 25 bp, Rattus norvegicus
atgaatcatctgactgagctggccc

SEQ ID NO: 188178 - DNA, 25 bp, Rattus norvegicus
atgaatcatctgtctgagctggccc

SEQ ID NO: 188179 - DNA, 25 bp, Rattus norvegicus
atgaatcatgctactcattttgaaa

SEQ ID NO: 188180 - DNA, 25 bp, Rattus norvegicus
atgaatcatgcttctcattttgaaa

SEQ ID NO: 188181 - DNA, 25 bp, Rattus norvegicus
atgaatccaagacttcctggccgat

SEQ ID NO: 188182 - DNA, 25 bp, Rattus norvegicus
atgaatccaagagttcctggccgat

SEQ ID NO: 188183 - DNA, 25 bp, Rattus norvegicus
atgaatccatgcacacaacctgtct

SEQ ID NO: 188184 - DNA, 25 bp, Rattus norvegicus
atgaatccatgccttgccttggtac

SEQ ID NO: 188185 - DNA, 25 bp, Rattus norvegicus
atgaatccatgcgttgccttggtac

SEQ ID NO: 188186 - DNA, 25 bp, Rattus norvegicus
atgaatccatgctcacaacctgtct

SEQ ID NO: 188187 - DNA, 25 bp, Rattus norvegicus
atgaatcccatcctctgatcgtggt

SEQ ID NO: 188188 - DNA, 25 bp, Rattus norvegicus
atgaatcccatcgtctgatcgtggt

SEQ ID NO: 188189 - DNA, 25 bp, Rattus norvegicus
atgaatcccattagtcttctacaca

SEQ ID NO: 188190 - DNA, 25 bp, Rattus norvegicus
atgaatcccatttgtcttctacaca

SEQ ID NO: 188191 - DNA, 25 bp, Rattus norvegicus
atgaatcccttcattccgagctgca

SEQ ID NO: 188192 - DNA, 25 bp, Rattus norvegicus
atgaatcccttctttccgagctgca

SEQ ID NO: 188193 - DNA, 25 bp, Rattus norvegicus
atgaatcctaacctccgatcgtggt

SEQ ID NO: 188194 - DNA, 25 bp, Rattus norvegicus
atgaatcctaacgtccgatcgtggt

SEQ ID NO: 188195 - DNA, 25 bp, Rattus norvegicus
atgaatcctgagctctcctgatgtc

SEQ ID NO: 188196 - DNA, 25 bp, Rattus norvegicus
atgaatcctgaggtctcctgatgtc

SEQ ID NO: 188197 - DNA, 25 bp, Rattus norvegicus
atgaatccttccctggtgatcctgt

SEQ ID NO: 188198 - DNA, 25 bp, Rattus norvegicus
atgaatccttccgtggtgatcctgt

SEQ ID NO: 188199 - DNA, 25 bp, Rattus norvegicus
atgaatccttgtacacaactgtgag

SEQ ID NO: 188200 - DNA, 25 bp, Rattus norvegicus
atgaatccttgttcacaactgtgag

SEQ ID NO: 188201 - DNA, 25 bp, Rattus norvegicus
atgaatctactcatctgtctttacc

SEQ ID NO: 188202 - DNA, 25 bp, Rattus norvegicus
atgaatctactcttctgtctttacc

SEQ ID NO: 188203 - DNA, 25 bp, Rattus norvegicus
atgaatctccagatcaagccacact

SEQ ID NO: 188204 - DNA, 25 bp, Rattus norvegicus
atgaatctccagttcaagccacact

SEQ ID NO: 188205 - DNA, 25 bp, Rattus norvegicus
atgaatctcggtcgcttttcagctt

SEQ ID NO: 188206 - DNA, 25 bp, Rattus norvegicus
atgaatctcggtggcttttcagctt

SEQ ID NO: 188207 - DNA, 25 bp, Rattus norvegicus
atgaatctctggcttttggctccaa

SEQ ID NO: 188208 - DNA, 25 bp, Rattus norvegicus
atgaatctctgggttttggctccaa

SEQ ID NO: 188209 - DNA, 25 bp, Rattus norvegicus
atgaatctcttcctctactggataa

SEQ ID NO: 188210 - DNA, 25 bp, Rattus norvegicus
atgaatctcttcgtctactggataa

SEQ ID NO: 188211 - DNA, 25 bp, Rattus norvegicus
atgaatctctttacccctaatgttt

SEQ ID NO: 188212 - DNA, 25 bp, Rattus norvegicus
atgaatctcttttcccctaatgttt

SEQ ID NO: 188213 - DNA, 25 bp, Rattus norvegicus
atgaatctggagatgctgtccataa

SEQ ID NO: 188214 - DNA, 25 bp, Rattus norvegicus
atgaatctggagttgctgtccataa

SEQ ID NO: 188215 - DNA, 25 bp, Rattus norvegicus
atgaatctgtgcaggccatggacga

SEQ ID NO: 188216 - DNA, 25 bp, Rattus norvegicus
atgaatctgtgctggccatggacga

SEQ ID NO: 188217 - DNA, 25 bp, Rattus norvegicus
atgaatcttgggatccgtgaggagc

SEQ ID NO: 188218 - DNA, 25 bp, Rattus norvegicus
atgaatcttgggttccgtgaggagc

SEQ ID NO: 188219 - DNA, 25 bp, Rattus norvegicus
atgaatgacaaacacccaccgcgct

SEQ ID NO: 188220 - DNA, 25 bp, Rattus norvegicus
atgaatgacaaagacccaccgcgct

SEQ ID NO: 188221 - DNA, 25 bp, Rattus norvegicus
atgaatgacgcacatcatggtggct

SEQ ID NO: 188222 - DNA, 25 bp, Rattus norvegicus
atgaatgacgcagatcatggtggct

SEQ ID NO: 188223 - DNA, 25 bp, Rattus norvegicus
atgaatgacggcagtggtgcctctg

SEQ ID NO: 188224 - DNA, 25 bp, Rattus norvegicus
atgaatgacggctgtggtgcctctg

SEQ ID NO: 188225 - DNA, 25 bp, Rattus norvegicus
atgaatgactttcgccatcacagat

SEQ ID NO: 188226 - DNA, 25 bp, Rattus norvegicus
atgaatgactttggccatcacagat

SEQ ID NO: 188227 - DNA, 25 bp, Rattus norvegicus
atgaatgattcgaccgtaccaatga

SEQ ID NO: 188228 - DNA, 25 bp, Rattus norvegicus
atgaatgattcgtccgtaccaatga

SEQ ID NO: 188229 - DNA, 25 bp, Rattus norvegicus
atgaatgcaactagcctttttcatt

SEQ ID NO: 188230 - DNA, 25 bp, Rattus norvegicus
atgaatgcaacttgcctttttcatt

SEQ ID NO: 188231 - DNA, 25 bp, Rattus norvegicus
atgaatgcacaaccacacgctcctg

SEQ ID NO: 188232 - DNA, 25 bp, Rattus norvegicus
atgaatgcacaagcacacgctcctg

SEQ ID NO: 188233 - DNA, 25 bp, Rattus norvegicus
atgaatgcagtgctgctcccgcagg

SEQ ID NO: 188234 - DNA, 25 bp, Rattus norvegicus
atgaatgcagtggtgctcccgcagg

SEQ ID NO: 188235 - DNA, 25 bp, Rattus norvegicus
atgaatgccaccatcactgaggaat

SEQ ID NO: 188236 - DNA, 25 bp, Rattus norvegicus
atgaatgccaccttcactgaggaat

SEQ ID NO: 188237 - DNA, 25 bp, Rattus norvegicus
atgaatgccactaaccatgccatag

SEQ ID NO: 188238 - DNA, 25 bp, Rattus norvegicus
atgaatgccacttaccatgccatag

SEQ ID NO: 188239 - DNA, 25 bp, Rattus norvegicus
atgaatgccaggaacccaagggtat

SEQ ID NO: 188240 - DNA, 25 bp, Rattus norvegicus
atgaatgccaggtacccaagggtat

SEQ ID NO: 188241 - DNA, 25 bp, Rattus norvegicus
atgaatgccattccagccgacatgt

SEQ ID NO: 188242 - DNA, 25 bp, Rattus norvegicus
atgaatgccattgcagccgacatgt

SEQ ID NO: 188243 - DNA, 25 bp, Rattus norvegicus
atgaatgccctcatttacttcctgt

SEQ ID NO: 188244 - DNA, 25 bp, Rattus norvegicus
atgaatgccctcttttacttcctgt

SEQ ID NO: 188245 - DNA, 25 bp, Rattus norvegicus
atgaatgccgttactccgttttctt

SEQ ID NO: 188246 - DNA, 25 bp, Rattus norvegicus
atgaatgccgtttctccgttttctt

SEQ ID NO: 188247 - DNA, 25 bp, Rattus norvegicus
atgaatgcctcaaagctgcaggtga

SEQ ID NO: 188248 - DNA, 25 bp, Rattus norvegicus
atgaatgcctcatagctgcaggtga

SEQ ID NO: 188249 - DNA, 25 bp, Rattus norvegicus
atgaatgcgccactaccagttttgt

SEQ ID NO: 188250 - DNA, 25 bp, Rattus norvegicus
atgaatgcgccagtaccagttttgt

SEQ ID NO: 188251 - DNA, 25 bp, Rattus norvegicus
atgaatgcgggcaggtaccctctgc

SEQ ID NO: 188252 - DNA, 25 bp, Rattus norvegicus
atgaatgcgggctggtaccctctgc

SEQ ID NO: 188253 - DNA, 25 bp, Rattus norvegicus
atgaatgctctaacgtttgctacag

SEQ ID NO: 188254 - DNA, 25 bp, Rattus norvegicus
atgaatgctctatcgtttgctacag

SEQ ID NO: 188255 - DNA, 25 bp, Rattus norvegicus
atgaatgctgctctaagtggcaaaa

SEQ ID NO: 188256 - DNA, 25 bp, Rattus norvegicus
atgaatgctgctgtaagtggcaaaa

SEQ ID NO: 188257 - DNA, 25 bp, Rattus norvegicus
atgaatgctggcactgctgacctgt

SEQ ID NO: 188258 - DNA, 25 bp, Rattus norvegicus
atgaatgctggctctgctgacctgt

SEQ ID NO: 188259 - DNA, 25 bp, Rattus norvegicus
atgaatgctgggaggccgttctttc

SEQ ID NO: 188260 - DNA, 25 bp, Rattus norvegicus
atgaatgctgggtggccgttctttc

SEQ ID NO: 188261 - DNA, 25 bp, Rattus norvegicus
atgaatggactaaacacctcagccc

SEQ ID NO: 188262 - DNA, 25 bp, Rattus norvegicus
atgaatggactatacacctcagccc

SEQ ID NO: 188263 - DNA, 25 bp, Rattus norvegicus
atgaatggactcaaactgccttggc

SEQ ID NO: 188264 - DNA, 25 bp, Rattus norvegicus
atgaatggactctaactgccttggc

SEQ ID NO: 188265 - DNA, 25 bp, Rattus norvegicus
atgaatggcatgctcctcaatgacc

SEQ ID NO: 188266 - DNA, 25 bp, Rattus norvegicus
atgaatggcatggtcctcaatgacc

SEQ ID NO: 188267 - DNA, 25 bp, Rattus norvegicus
atgaatgggaacatctctcggcgca

SEQ ID NO: 188268 - DNA, 25 bp, Rattus norvegicus
atgaatgggaacttctctcggcgca

SEQ ID NO: 188269 - DNA, 25 bp, Rattus norvegicus
atgaatgggagacgcccttaatcct

SEQ ID NO: 188270 - DNA, 25 bp, Rattus norvegicus
atgaatgggagaggcccttaatcct

SEQ ID NO: 188271 - DNA, 25 bp, Rattus norvegicus
atgaatgggcggactggttctgcca

SEQ ID NO: 188272 - DNA, 25 bp, Rattus norvegicus
atgaatgggcggtctggttctgcca

SEQ ID NO: 188273 - DNA, 25 bp, Rattus norvegicus
atgaatgggctgctcccaggacatt

SEQ ID NO: 188274 - DNA, 25 bp, Rattus norvegicus
atgaatgggctggtcccaggacatt

SEQ ID NO: 188275 - DNA, 25 bp, Rattus norvegicus
atgaatgggcttagccgacactcgc

SEQ ID NO: 188276 - DNA, 25 bp, Rattus norvegicus
atgaatgggctttgccgacactcgc

SEQ ID NO: 188277 - DNA, 25 bp, Rattus norvegicus
atgaatggtggtatgcccatcccca

SEQ ID NO: 188278 - DNA, 25 bp, Rattus norvegicus
atgaatggtggtttgcccatcccca

SEQ ID NO: 188279 - DNA, 25 bp, Rattus norvegicus
atgaatgtacagcttctctctgctt

SEQ ID NO: 188280 - DNA, 25 bp, Rattus norvegicus
atgaatgtacaggttctctctgctt

SEQ ID NO: 188281 - DNA, 25 bp, Rattus norvegicus
atgaatgtcatgcatgggcatagct

SEQ ID NO: 188282 - DNA, 25 bp, Rattus norvegicus
atgaatgtcatggatgggcatagct

SEQ ID NO: 188283 - DNA, 25 bp, Rattus norvegicus
atgaatgtccgtccctcgcctggcg

SEQ ID NO: 188284 - DNA, 25 bp, Rattus norvegicus
atgaatgtccgtgcctcgcctggcg

SEQ ID NO: 188285 - DNA, 25 bp, Rattus norvegicus
atgaatgtcgaaaccttcctggctc

SEQ ID NO: 188286 - DNA, 25 bp, Rattus norvegicus
atgaatgtcgaatccttcctggctc

SEQ ID NO: 188287 - DNA, 25 bp, Rattus norvegicus
atgaatgtctttatggcgaacccgc

SEQ ID NO: 188288 - DNA, 25 bp, Rattus norvegicus
atgaatgtctttccctattgcacct

SEQ ID NO: 188289 - DNA, 25 bp, Rattus norvegicus
atgaatgtctttgcctattgcacct

SEQ ID NO: 188290 - DNA, 25 bp, Rattus norvegicus
atgaatgtctttttggcgaacccgc

SEQ ID NO: 188291 - DNA, 25 bp, Rattus norvegicus
atgaatgtgatgctcccactgaggc

SEQ ID NO: 188292 - DNA, 25 bp, Rattus norvegicus
atgaatgtgatggtcccactgaggc

SEQ ID NO: 188293 - DNA, 25 bp, Rattus norvegicus
atgaatgtgcacctgtgttgctcac

SEQ ID NO: 188294 - DNA, 25 bp, Rattus norvegicus
atgaatgtgcacgtgtgttgctcac

SEQ ID NO: 188295 - DNA, 25 bp, Rattus norvegicus
atgaatgtgcggcaccagcggccct

SEQ ID NO: 188296 - DNA, 25 bp, Rattus norvegicus
atgaatgtgcgggaccagcggccct

SEQ ID NO: 188297 - DNA, 25 bp, Rattus norvegicus
atgaatgtgtccctaaatcttcccc

SEQ ID NO: 188298 - DNA, 25 bp, Rattus norvegicus
atgaatgtgtccgtaaatcttcccc

SEQ ID NO: 188299 - DNA, 25 bp, Rattus norvegicus
atgaatgttcccatgaagctggtga

SEQ ID NO: 188300 - DNA, 25 bp, Rattus norvegicus
atgaatgttcccttgaagctggtga

SEQ ID NO: 188301 - DNA, 25 bp, Rattus norvegicus
atgaattacaccaatggcttcccct

SEQ ID NO: 188302 - DNA, 25 bp, Rattus norvegicus
atgaattacacctatggcttcccct

SEQ ID NO: 188303 - DNA, 25 bp, Rattus norvegicus
atgaattacattccagatctgatcg

SEQ ID NO: 188304 - DNA, 25 bp, Rattus norvegicus
atgaattacattgcagatctgatcg

SEQ ID NO: 188305 - DNA, 25 bp, Rattus norvegicus
atgaattcatcccagcaaatgctac

SEQ ID NO: 188306 - DNA, 25 bp, Rattus norvegicus
atgaattcatccgagcaaatgctac

SEQ ID NO: 188307 - DNA, 25 bp, Rattus norvegicus
atgaattccagcacatctgatgcaa

SEQ ID NO: 188308 - DNA, 25 bp, Rattus norvegicus
atgaattccagctcatctgatgcaa

SEQ ID NO: 188309 - DNA, 25 bp, Rattus norvegicus
atgaattccttcaagtggttttctt

SEQ ID NO: 188310 - DNA, 25 bp, Rattus norvegicus
atgaattccttctagtggttttctt

SEQ ID NO: 188311 - DNA, 25 bp, Rattus norvegicus
atgaattctccaagcaagctttttt

SEQ ID NO: 188312 - DNA, 25 bp, Rattus norvegicus
atgaattctccatgcaagctttttt

SEQ ID NO: 188313 - DNA, 25 bp, Rattus norvegicus
atgaattcttacagcatttgcgttt

SEQ ID NO: 188314 - DNA, 25 bp, Rattus norvegicus
atgaattcttactgcatttgcgttt

SEQ ID NO: 188315 - DNA, 25 bp, Rattus norvegicus
atgaattcttctctttattcctgct

SEQ ID NO: 188316 - DNA, 25 bp, Rattus norvegicus
atgaattcttctgtttattcctgct

SEQ ID NO: 188317 - DNA, 25 bp, Rattus norvegicus
atgaattcttttcagcttttggtgc

SEQ ID NO: 188318 - DNA, 25 bp, Rattus norvegicus
atgaattcttttgagcttttggtgc

SEQ ID NO: 188319 - DNA, 25 bp, Rattus norvegicus
atgaattgaaacatacgcgattgga

SEQ ID NO: 188320 - DNA, 25 bp, Rattus norvegicus
atgaattgaaacttacgcgattgga

SEQ ID NO: 188321 - DNA, 25 bp, Rattus norvegicus
atgaattgatggcagacctggacca

SEQ ID NO: 188322 - DNA, 25 bp, Rattus norvegicus
atgaattgatgggagacctggacca

SEQ ID NO: 188323 - DNA, 25 bp, Rattus norvegicus
atgaattggcatctgtccccacata

SEQ ID NO: 188324 - DNA, 25 bp, Rattus norvegicus
atgaattggcatgtgtccccacata

SEQ ID NO: 188325 - DNA, 25 bp, Rattus norvegicus
atgaattgtggccagctcactccag

SEQ ID NO: 188326 - DNA, 25 bp, Rattus norvegicus
atgaattgtggcgagctcactccag

SEQ ID NO: 188327 - DNA, 25 bp, Rattus norvegicus
atgaatttacgtactggctgctggc

SEQ ID NO: 188328 - DNA, 25 bp, Rattus norvegicus
atgaatttacgttctggctgctggc

SEQ ID NO: 188329 - DNA, 25 bp, Rattus norvegicus
atgaatttcagcactgtcccttaaa

SEQ ID NO: 188330 - DNA, 25 bp, Rattus norvegicus
atgaatttcagctctgtcccttaaa

SEQ ID NO: 188331 - DNA, 25 bp, Rattus norvegicus
atgaatttcaggatcatccctgtgc

SEQ ID NO: 188332 - DNA, 25 bp, Rattus norvegicus
atgaatttcaggttcatccctgtgc

SEQ ID NO: 188333 - DNA, 25 bp, Rattus norvegicus
atgaatttccttagcataacccctt

SEQ ID NO: 188334 - DNA, 25 bp, Rattus norvegicus
atgaatttcctttgcataacccctt

SEQ ID NO: 188335 - DNA, 25 bp, Rattus norvegicus
atgaatttctggactgtatggcact

SEQ ID NO: 188336 - DNA, 25 bp, Rattus norvegicus
atgaatttctggtctgtatggcact

SEQ ID NO: 188337 - DNA, 25 bp, Rattus norvegicus
atgaatttggtccagctctgttcgt

SEQ ID NO: 188338 - DNA, 25 bp, Rattus norvegicus
atgaatttggtcgagctctgttcgt

SEQ ID NO: 188339 - DNA, 25 bp, Rattus norvegicus
atgaatttgtcaatgtgtggataat

SEQ ID NO: 188340 - DNA, 25 bp, Rattus norvegicus
atgaatttgtcattgtgtggataat

SEQ ID NO: 188341 - DNA, 25 bp, Rattus norvegicus
atgaattttacaacccagactaagg

SEQ ID NO: 188342 - DNA, 25 bp, Rattus norvegicus
atgaattttacatcccagactaagg

SEQ ID NO: 188343 - DNA, 25 bp, Rattus norvegicus
atgaattttattccactgctcccca

SEQ ID NO: 188344 - DNA, 25 bp, Rattus norvegicus
atgaattttattgcactgctcccca

SEQ ID NO: 188345 - DNA, 25 bp, Rattus norvegicus
atgacaaaacccatgttgctctcct

SEQ ID NO: 188346 - DNA, 25 bp, Rattus norvegicus
atgacaaaacccttgttgctctcct

SEQ ID NO: 188347 - DNA, 25 bp, Rattus norvegicus
atgacaaaacctacagtctgtactg

SEQ ID NO: 188348 - DNA, 25 bp, Rattus norvegicus
atgacaaaaccttcagtctgtactg

SEQ ID NO: 188349 - DNA, 25 bp, Rattus norvegicus
atgacaaaagtcaggcggagcctag

SEQ ID NO: 188350 - DNA, 25 bp, Rattus norvegicus
atgacaaaagtctggcggagcctag

SEQ ID NO: 188351 - DNA, 25 bp, Rattus norvegicus
atgacaaaccctacgtctgtgacat

SEQ ID NO: 188352 - DNA, 25 bp, Rattus norvegicus
atgacaaacccttcgtctgtgacat

SEQ ID NO: 188353 - DNA, 25 bp, Rattus norvegicus
atgacaaacctcacagcatgactga

SEQ ID NO: 188354 - DNA, 25 bp, Rattus norvegicus
atgacaaacctctcagcatgactga

SEQ ID NO: 188355 - DNA, 25 bp, Rattus norvegicus
atgacaaaccttaagcctcaacttc

SEQ ID NO: 188356 - DNA, 25 bp, Rattus norvegicus
atgacaaacctttagcctcaacttc

SEQ ID NO: 188357 - DNA, 25 bp, Rattus norvegicus
atgacaaacttactccaagaccctg

SEQ ID NO: 188358 - DNA, 25 bp, Rattus norvegicus
atgacaaacttagtccaagaccctg

SEQ ID NO: 188359 - DNA, 25 bp, Rattus norvegicus
atgacaaagaaacgcgcgcaacttg

SEQ ID NO: 188360 - DNA, 25 bp, Rattus norvegicus
atgacaaagaaaggcgcgcaacttg

SEQ ID NO: 188361 - DNA, 25 bp, Rattus norvegicus
atgacaaagcctccggagtcttctg

SEQ ID NO: 188362 - DNA, 25 bp, Rattus norvegicus
atgacaaagcctgcggagtcttctg

SEQ ID NO: 188363 - DNA, 25 bp, Rattus norvegicus
atgacaaaggccctagacagctccc

SEQ ID NO: 188364 - DNA, 25 bp, Rattus norvegicus
atgacaaaggccgtagacagctccc

SEQ ID NO: 188365 - DNA, 25 bp, Rattus norvegicus
atgacaaagtgcatgaggttacaga

SEQ ID NO: 188366 - DNA, 25 bp, Rattus norvegicus
atgacaaagtgcttgaggttacaga

SEQ ID NO: 188367 - DNA, 25 bp, Rattus norvegicus
atgacaaatcgtactacagtcccca

SEQ ID NO: 188368 - DNA, 25 bp, Rattus norvegicus
atgacaaatcgttctacagtcccca

SEQ ID NO: 188369 - DNA, 25 bp, Rattus norvegicus
atgacaaatctcagtttcagccctc

SEQ ID NO: 188370 - DNA, 25 bp, Rattus norvegicus
atgacaaatctctgtttcagccctc

SEQ ID NO: 188371 - DNA, 25 bp, Rattus norvegicus
atgacaaatggcattccgcctcaag

SEQ ID NO: 188372 - DNA, 25 bp, Rattus norvegicus
atgacaaatggctttccgcctcaag

SEQ ID NO: 188373 - DNA, 25 bp, Rattus norvegicus
atgacaacagctctctctttgttca

SEQ ID NO: 188374 - DNA, 25 bp, Rattus norvegicus
atgacaacagctgtctctttgttca

SEQ ID NO: 188375 - DNA, 25 bp, Rattus norvegicus
atgacaacagtcctctacctatttt

SEQ ID NO: 188376 - DNA, 25 bp, Rattus norvegicus
atgacaacagtcgtctacctatttt

SEQ ID NO: 188377 - DNA, 25 bp, Rattus norvegicus
atgacaacatgccaggagcccgcct

SEQ ID NO: 188378 - DNA, 25 bp, Rattus norvegicus
atgacaacatgcgaggagcccgcct

SEQ ID NO: 188379 - DNA, 25 bp, Rattus norvegicus
atgacaaccatgcagcctttggaag

SEQ ID NO: 188380 - DNA, 25 bp, Rattus norvegicus
atgacaaccatgctctggaaacccg

SEQ ID NO: 188381 - DNA, 25 bp, Rattus norvegicus
atgacaaccatggagcctttggaag

SEQ ID NO: 188382 - DNA, 25 bp, Rattus norvegicus
atgacaaccatggtctggaaacccg

SEQ ID NO: 188383 - DNA, 25 bp, Rattus norvegicus
atgacaaccctcacacagacgagaa

SEQ ID NO: 188384 - DNA, 25 bp, Rattus norvegicus
atgacaaccctctcacagacgagaa

SEQ ID NO: 188385 - DNA, 25 bp, Rattus norvegicus
atgacaaccgagacagctgcttggg

SEQ ID NO: 188386 - DNA, 25 bp, Rattus norvegicus
atgacaaccgagtcagctgcttggg

SEQ ID NO: 188387 - DNA, 25 bp, Rattus norvegicus
atgacaaccgttagatactagtctt

SEQ ID NO: 188388 - DNA, 25 bp, Rattus norvegicus
atgacaaccgtttgatactagtctt

SEQ ID NO: 188389 - DNA, 25 bp, Rattus norvegicus
atgacaaccttgctgggccagtaca

SEQ ID NO: 188390 - DNA, 25 bp, Rattus norvegicus
atgacaaccttggtgggccagtaca

SEQ ID NO: 188391 - DNA, 25 bp, Rattus norvegicus
atgacaacgactatctcccctggaa

SEQ ID NO: 188392 - DNA, 25 bp, Rattus norvegicus
atgacaacgactttctcccctggaa

SEQ ID NO: 188393 - DNA, 25 bp, Rattus norvegicus
atgacaactgctacactgcggatga

SEQ ID NO: 188394 - DNA, 25 bp, Rattus norvegicus
atgacaactgcttcactgcggatga

SEQ ID NO: 188395 - DNA, 25 bp, Rattus norvegicus
atgacaactgtgctagcccagctaa

SEQ ID NO: 188396 - DNA, 25 bp, Rattus norvegicus
atgacaactgtggtagcccagctaa

SEQ ID NO: 188397 - DNA, 25 bp, Rattus norvegicus
atgacaacttccagagcctccgtca

SEQ ID NO: 188398 - DNA, 25 bp, Rattus norvegicus
atgacaacttcctgagcctccgtca

SEQ ID NO: 188399 - DNA, 25 bp, Rattus norvegicus
atgacaactttacaatctttccctc

SEQ ID NO: 188400 - DNA, 25 bp, Rattus norvegicus
atgacaactttagaatctttccctc

SEQ ID NO: 188401 - DNA, 25 bp, Rattus norvegicus
atgacaactttgccatcgtggaagg

SEQ ID NO: 188402 - DNA, 25 bp, Rattus norvegicus
atgacaactttggcatcgtggaagg

SEQ ID NO: 188403 - DNA, 25 bp, Rattus norvegicus
atgacaacttttaacatgacactgt

SEQ ID NO: 188404 - DNA, 25 bp, Rattus norvegicus
atgacaactttttacatgacactgt

SEQ ID NO: 188405 - DNA, 25 bp, Rattus norvegicus
atgacaagacacataccacattggt

SEQ ID NO: 188406 - DNA, 25 bp, Rattus norvegicus
atgacaagacacttaccacattggt

SEQ ID NO: 188407 - DNA, 25 bp, Rattus norvegicus
atgacaagactcagcccaaactgga

SEQ ID NO: 188408 - DNA, 25 bp, Rattus norvegicus
atgacaagactctgcccaaactgga

SEQ ID NO: 188409 - DNA, 25 bp, Rattus norvegicus
atgacaagatcaccgagtgctccca

SEQ ID NO: 188410 - DNA, 25 bp, Rattus norvegicus
atgacaagatcagcgagtgctccca

SEQ ID NO: 188411 - DNA, 25 bp, Rattus norvegicus
atgacaaggaggactcttctcccct

SEQ ID NO: 188412 - DNA, 25 bp, Rattus norvegicus
atgacaaggaggtctcttctcccct

SEQ ID NO: 188413 - DNA, 25 bp, Rattus norvegicus
atgacaagtctgattcgcacctatg

SEQ ID NO: 188414 - DNA, 25 bp, Rattus norvegicus
atgacaagtctgtttcgcacctatg

SEQ ID NO: 188415 - DNA, 25 bp, Rattus norvegicus
atgacaagtgccagaacaatctctg

SEQ ID NO: 188416 - DNA, 25 bp, Rattus norvegicus
atgacaagtgccagtctagacccat

SEQ ID NO: 188417 - DNA, 25 bp, Rattus norvegicus
atgacaagtgcctgaacaatctctg

SEQ ID NO: 188418 - DNA, 25 bp, Rattus norvegicus
atgacaagtgcctgtctagacccat

SEQ ID NO: 188419 - DNA, 25 bp, Rattus norvegicus
atgacaagtgctactatcccagtct

SEQ ID NO: 188420 - DNA, 25 bp, Rattus norvegicus
atgacaagtgcttctatcccagtct

SEQ ID NO: 188421 - DNA, 25 bp, Rattus norvegicus
atgacaagtggtatgtttcacgaaa

SEQ ID NO: 188422 - DNA, 25 bp, Rattus norvegicus
atgacaagtggtttgtttcacgaaa

SEQ ID NO: 188423 - DNA, 25 bp, Rattus norvegicus
atgacaatagagagcctgcccgctc

SEQ ID NO: 188424 - DNA, 25 bp, Rattus norvegicus
atgacaatagagtgcctgcccgctc

SEQ ID NO: 188425 - DNA, 25 bp, Rattus norvegicus
atgacaatcccacagtttcagaatt

SEQ ID NO: 188426 - DNA, 25 bp, Rattus norvegicus
atgacaatcccagagtttcagaatt

SEQ ID NO: 188427 - DNA, 25 bp, Rattus norvegicus
atgacaatctcaagcttccctgagt

SEQ ID NO: 188428 - DNA, 25 bp, Rattus norvegicus
atgacaatctcatgcttccctgagt

SEQ ID NO: 188429 - DNA, 25 bp, Rattus norvegicus
atgacaatgaccctcgtcttgcaga

SEQ ID NO: 188430 - DNA, 25 bp, Rattus norvegicus
atgacaatgaccgtcgtcttgcaga

SEQ ID NO: 188431 - DNA, 25 bp, Rattus norvegicus
atgacaatgtgactctcactccgaa

SEQ ID NO: 188432 - DNA, 25 bp, Rattus norvegicus
atgacaatgtgagtctcactccgaa

SEQ ID NO: 188433 - DNA, 25 bp, Rattus norvegicus
atgacaatgttgaagtaccctcccc

SEQ ID NO: 188434 - DNA, 25 bp, Rattus norvegicus
atgacaatgttgtagtaccctcccc

SEQ ID NO: 188435 - DNA, 25 bp, Rattus norvegicus
atgacacaccccacatggtggcgcg

SEQ ID NO: 188436 - DNA, 25 bp, Rattus norvegicus
atgacacacccctcatggtggcgcg

SEQ ID NO: 188437 - DNA, 25 bp, Rattus norvegicus
atgacacaccttaaatccctctggc

SEQ ID NO: 188438 - DNA, 25 bp, Rattus norvegicus
atgacacacctttaatccctctggc

SEQ ID NO: 188439 - DNA, 25 bp, Rattus norvegicus
atgacacagcagatgccatcttgaa

SEQ ID NO: 188440 - DNA, 25 bp, Rattus norvegicus
atgacacagcagttgccatcttgaa

SEQ ID NO: 188441 - DNA, 25 bp, Rattus norvegicus
atgacacagccaagaaatttttcct

SEQ ID NO: 188442 - DNA, 25 bp, Rattus norvegicus
atgacacagccatgaaatttttcct

SEQ ID NO: 188443 - DNA, 25 bp, Rattus norvegicus
atgacacagtgcaggacaatgacgt

SEQ ID NO: 188444 - DNA, 25 bp, Rattus norvegicus
atgacacagtgctggacaatgacgt

SEQ ID NO: 188445 - DNA, 25 bp, Rattus norvegicus
atgacacatgcacctctaaagctgc

SEQ ID NO: 188446 - DNA, 25 bp, Rattus norvegicus
atgacacatgcagctctaaagctgc

SEQ ID NO: 188447 - DNA, 25 bp, Rattus norvegicus
atgacaccaacaattcaggctatcg

SEQ ID NO: 188448 - DNA, 25 bp, Rattus norvegicus
atgacaccaacatttcaggctatcg

SEQ ID NO: 188449 - DNA, 25 bp, Rattus norvegicus
atgacaccagcactgattggaccgc

SEQ ID NO: 188450 - DNA, 25 bp, Rattus norvegicus
atgacaccagcagtgattggaccgc

SEQ ID NO: 188451 - DNA, 25 bp, Rattus norvegicus
atgacacccagtatgtgctcttttc

SEQ ID NO: 188452 - DNA, 25 bp, Rattus norvegicus
atgacacccagtttgtgctcttttc

SEQ ID NO: 188453 - DNA, 25 bp, Rattus norvegicus
atgacacccattcaccaggtagaaa

SEQ ID NO: 188454 - DNA, 25 bp, Rattus norvegicus
atgacacccattgaccaggtagaaa

SEQ ID NO: 188455 - DNA, 25 bp, Rattus norvegicus
atgacaccctacaatcctgtgggaa

SEQ ID NO: 188456 - DNA, 25 bp, Rattus norvegicus
atgacaccctactatcctgtgggaa

SEQ ID NO: 188457 - DNA, 25 bp, Rattus norvegicus
atgacaccctgcactgatggatgct

SEQ ID NO: 188458 - DNA, 25 bp, Rattus norvegicus
atgacaccctgcctatcattcaggt

SEQ ID NO: 188459 - DNA, 25 bp, Rattus norvegicus
atgacaccctgcgtatcattcaggt

SEQ ID NO: 188460 - DNA, 25 bp, Rattus norvegicus
atgacaccctgctctgatggatgct

SEQ ID NO: 188461 - DNA, 25 bp, Rattus norvegicus
atgacacctaccatgcagggttgtt

SEQ ID NO: 188462 - DNA, 25 bp, Rattus norvegicus
atgacacctaccttgcagggttgtt

SEQ ID NO: 188463 - DNA, 25 bp, Rattus norvegicus
atgacaccttatcctcctggcagaa

SEQ ID NO: 188464 - DNA, 25 bp, Rattus norvegicus
atgacaccttatgctcctggcagaa

SEQ ID NO: 188465 - DNA, 25 bp, Rattus norvegicus
atgacacgatctacacgggctgcga

SEQ ID NO: 188466 - DNA, 25 bp, Rattus norvegicus
atgacacgatcttcacgggctgcga

SEQ ID NO: 188467 - DNA, 25 bp, Rattus norvegicus
atgacacgcaccctgaaggtacaac

SEQ ID NO: 188468 - DNA, 25 bp, Rattus norvegicus
atgacacgcaccgtgaaggtacaac

SEQ ID NO: 188469 - DNA, 25 bp, Rattus norvegicus
atgacacgctcaacaacgaaagaaa

SEQ ID NO: 188470 - DNA, 25 bp, Rattus norvegicus
atgacacgctcatcaacgaaagaaa

SEQ ID NO: 188471 - DNA, 25 bp, Rattus norvegicus
atgacacgtcttacagatcacctta

SEQ ID NO: 188472 - DNA, 25 bp, Rattus norvegicus
atgacacgtctttcagatcacctta

SEQ ID NO: 188473 - DNA, 25 bp, Rattus norvegicus
atgacacgtgagagagcttctacct

SEQ ID NO: 188474 - DNA, 25 bp, Rattus norvegicus
atgacacgtgagtgagcttctacct

SEQ ID NO: 188475 - DNA, 25 bp, Rattus norvegicus
atgacacgtgtgatcataccatcct

SEQ ID NO: 188476 - DNA, 25 bp, Rattus norvegicus
atgacacgtgtgttcataccatcct

SEQ ID NO: 188477 - DNA, 25 bp, Rattus norvegicus
atgacactaacccttttccttgttg

SEQ ID NO: 188478 - DNA, 25 bp, Rattus norvegicus
atgacactaaccgttttccttgttg

SEQ ID NO: 188479 - DNA, 25 bp, Rattus norvegicus
atgacactaggaagccttgcacctt

SEQ ID NO: 188480 - DNA, 25 bp, Rattus norvegicus
atgacactaggatgccttgcacctt

SEQ ID NO: 188481 - DNA, 25 bp, Rattus norvegicus
atgacactcatgctatcggcatctt

SEQ ID NO: 188482 - DNA, 25 bp, Rattus norvegicus
atgacactcatggtatcggcatctt

SEQ ID NO: 188483 - DNA, 25 bp, Rattus norvegicus
atgacactcccgctatgttatctgt

SEQ ID NO: 188484 - DNA, 25 bp, Rattus norvegicus
atgacactcccggtatgttatctgt

SEQ ID NO: 188485 - DNA, 25 bp, Rattus norvegicus
atgacactctgccaggtctgagctg

SEQ ID NO: 188486 - DNA, 25 bp, Rattus norvegicus
atgacactctgcgaggtctgagctg

SEQ ID NO: 188487 - DNA, 25 bp, Rattus norvegicus
atgacactctttcgccttcctttgg

SEQ ID NO: 188488 - DNA, 25 bp, Rattus norvegicus
atgacactctttggccttcctttgg

SEQ ID NO: 188489 - DNA, 25 bp, Rattus norvegicus
atgacactgctgctgctaatgccgg

SEQ ID NO: 188490 - DNA, 25 bp, Rattus norvegicus
atgacactgctggtgctaatgccgg

SEQ ID NO: 188491 - DNA, 25 bp, Rattus norvegicus
atgacactgggtcacatcgtctaca

SEQ ID NO: 188492 - DNA, 25 bp, Rattus norvegicus
atgacactgggtgacatcgtctaca

SEQ ID NO: 188493 - DNA, 25 bp, Rattus norvegicus
atgacactttagattgctcacttat

SEQ ID NO: 188494 - DNA, 25 bp, Rattus norvegicus
atgacactttagtttgctcacttat

SEQ ID NO: 188495 - DNA, 25 bp, Rattus norvegicus
atgacagaaagcaaaccgccgccaa

SEQ ID NO: 188496 - DNA, 25 bp, Rattus norvegicus
atgacagaaagctaaccgccgccaa

SEQ ID NO: 188497 - DNA, 25 bp, Rattus norvegicus
atgacagaactaagacagggaagca

SEQ ID NO: 188498 - DNA, 25 bp, Rattus norvegicus
atgacagaactatgacagggaagca

SEQ ID NO: 188499 - DNA, 25 bp, Rattus norvegicus
atgacagaactgagcttccagcgct

SEQ ID NO: 188500 - DNA, 25 bp, Rattus norvegicus
atgacagaactgtgcttccagcgct

SEQ ID NO: 188501 - DNA, 25 bp, Rattus norvegicus
atgacagacactacctcttaggagg

SEQ ID NO: 188502 - DNA, 25 bp, Rattus norvegicus
atgacagacactaggctaaacagga

SEQ ID NO: 188503 - DNA, 25 bp, Rattus norvegicus
atgacagacacttcctcttaggagg

SEQ ID NO: 188504 - DNA, 25 bp, Rattus norvegicus
atgacagacacttggctaaacagga

SEQ ID NO: 188505 - DNA, 25 bp, Rattus norvegicus
atgacagactgaaaacaggcctaca

SEQ ID NO: 188506 - DNA, 25 bp, Rattus norvegicus
atgacagactgataacaggcctaca

SEQ ID NO: 188507 - DNA, 25 bp, Rattus norvegicus
atgacagagaatcctcctcagagcc

SEQ ID NO: 188508 - DNA, 25 bp, Rattus norvegicus
atgacagagaatgctcctcagagcc

SEQ ID NO: 188509 - DNA, 25 bp, Rattus norvegicus
atgacagagctgatgcccatcggtc

SEQ ID NO: 188510 - DNA, 25 bp, Rattus norvegicus
atgacagagctgctgtcctccaggg

SEQ ID NO: 188511 - DNA, 25 bp, Rattus norvegicus
atgacagagctggtgtcctccaggg

SEQ ID NO: 188512 - DNA, 25 bp, Rattus norvegicus
atgacagagctgttgcccatcggtc

SEQ ID NO: 188513 - DNA, 25 bp, Rattus norvegicus
atgacagagggtacacatcactggg

SEQ ID NO: 188514 - DNA, 25 bp, Rattus norvegicus
atgacagagggttcacatcactggg

SEQ ID NO: 188515 - DNA, 25 bp, Rattus norvegicus
atgacagcagccaggttggccgtgt

SEQ ID NO: 188516 - DNA, 25 bp, Rattus norvegicus
atgacagcagcctggttggccgtgt

SEQ ID NO: 188517 - DNA, 25 bp, Rattus norvegicus
atgacagcagctcctctactgacgc

SEQ ID NO: 188518 - DNA, 25 bp, Rattus norvegicus
atgacagcagctgctctactgacgc

SEQ ID NO: 188519 - DNA, 25 bp, Rattus norvegicus
atgacagcagttccagtgagggccc

SEQ ID NO: 188520 - DNA, 25 bp, Rattus norvegicus
atgacagcagttgcagtgagggccc

SEQ ID NO: 188521 - DNA, 25 bp, Rattus norvegicus
atgacagcatatatttcctttttct

SEQ ID NO: 188522 - DNA, 25 bp, Rattus norvegicus
atgacagcatatttttcctttttct

SEQ ID NO: 188523 - DNA, 25 bp, Rattus norvegicus
atgacagcatggacctaaccactgg

SEQ ID NO: 188524 - DNA, 25 bp, Rattus norvegicus
atgacagcatggtcctaaccactgg

SEQ ID NO: 188525 - DNA, 25 bp, Rattus norvegicus
atgacagcattcctgctttgttctt

SEQ ID NO: 188526 - DNA, 25 bp, Rattus norvegicus
atgacagcattcgtgctttgttctt

SEQ ID NO: 188527 - DNA, 25 bp, Rattus norvegicus
atgacagccaccacatgcttggatt

SEQ ID NO: 188528 - DNA, 25 bp, Rattus norvegicus
atgacagccacctcatgcttggatt

SEQ ID NO: 188529 - DNA, 25 bp, Rattus norvegicus
atgacagcccatatcaaggtggtgt

SEQ ID NO: 188530 - DNA, 25 bp, Rattus norvegicus
atgacagcccatttcaaggtggtgt

SEQ ID NO: 188531 - DNA, 25 bp, Rattus norvegicus
atgacagccgctcccactgcaggag

SEQ ID NO: 188532 - DNA, 25 bp, Rattus norvegicus
atgacagccgctgccactgcaggag

SEQ ID NO: 188533 - DNA, 25 bp, Rattus norvegicus
atgacagcctaaactttttaaagca

SEQ ID NO: 188534 - DNA, 25 bp, Rattus norvegicus
atgacagcctaatctttttaaagca

SEQ ID NO: 188535 - DNA, 25 bp, Rattus norvegicus
atgacagcctggatgactatggcga

SEQ ID NO: 188536 - DNA, 25 bp, Rattus norvegicus
atgacagcctggttgactatggcga

SEQ ID NO: 188537 - DNA, 25 bp, Rattus norvegicus
atgacagcctttcaaccggaggccc

SEQ ID NO: 188538 - DNA, 25 bp, Rattus norvegicus
atgacagcctttgaaccggaggccc

SEQ ID NO: 188539 - DNA, 25 bp, Rattus norvegicus
atgacagcgatgatgacccggtctt

SEQ ID NO: 188540 - DNA, 25 bp, Rattus norvegicus
atgacagcgatgttgacccggtctt

SEQ ID NO: 188541 - DNA, 25 bp, Rattus norvegicus
atgacagcgctgattttgccactga

SEQ ID NO: 188542 - DNA, 25 bp, Rattus norvegicus
atgacagcgctgtttttgccactga

SEQ ID NO: 188543 - DNA, 25 bp, Rattus norvegicus
atgacagctacaaacccatggcttc

SEQ ID NO: 188544 - DNA, 25 bp, Rattus norvegicus
atgacagctacatacccatggcttc

SEQ ID NO: 188545 - DNA, 25 bp, Rattus norvegicus
atgacagctctactttgcctttgtg

SEQ ID NO: 188546 - DNA, 25 bp, Rattus norvegicus
atgacagctctagtttgcctttgtg

SEQ ID NO: 188547 - DNA, 25 bp, Rattus norvegicus
atgacagctgtcaatgcaggcctct

SEQ ID NO: 188548 - DNA, 25 bp, Rattus norvegicus
atgacagctgtctatgcaggcctct

SEQ ID NO: 188549 - DNA, 25 bp, Rattus norvegicus
atgacagctgtgaagggctcgtgct

SEQ ID NO: 188550 - DNA, 25 bp, Rattus norvegicus
atgacagctgtgtagggctcgtgct

SEQ ID NO: 188551 - DNA, 25 bp, Rattus norvegicus
atgacagctgttattatcttattta

SEQ ID NO: 188552 - DNA, 25 bp, Rattus norvegicus
atgacagctgtttttatcttattta

SEQ ID NO: 188553 - DNA, 25 bp, Rattus norvegicus
atgacagctttcctgtgctgcttag

SEQ ID NO: 188554 - DNA, 25 bp, Rattus norvegicus
atgacagctttcgtgtgctgcttag

SEQ ID NO: 188555 - DNA, 25 bp, Rattus norvegicus
atgacagctttgactcttaaaatgg

SEQ ID NO: 188556 - DNA, 25 bp, Rattus norvegicus
atgacagctttgtctcttaaaatgg

SEQ ID NO: 188557 - DNA, 25 bp, Rattus norvegicus
atgacaggaattacccattggcggc

SEQ ID NO: 188558 - DNA, 25 bp, Rattus norvegicus
atgacaggaatttcccattggcggc

SEQ ID NO: 188559 - DNA, 25 bp, Rattus norvegicus
atgacaggacagacactttgctctc

SEQ ID NO: 188560 - DNA, 25 bp, Rattus norvegicus
atgacaggacagtcactttgctctc

SEQ ID NO: 188561 - DNA, 25 bp, Rattus norvegicus
atgacaggataacacctttatcaaa

SEQ ID NO: 188562 - DNA, 25 bp, Rattus norvegicus
atgacaggataagacctttatcaaa

SEQ ID NO: 188563 - DNA, 25 bp, Rattus norvegicus
atgacaggatctatactccatttaa

SEQ ID NO: 188564 - DNA, 25 bp, Rattus norvegicus
atgacaggatctttactccatttaa

SEQ ID NO: 188565 - DNA, 25 bp, Rattus norvegicus
atgacaggattgagcttcgcggaca

SEQ ID NO: 188566 - DNA, 25 bp, Rattus norvegicus
atgacaggattgtgcttcgcggaca

SEQ ID NO: 188567 - DNA, 25 bp, Rattus norvegicus
atgacaggtagaaggcagaagtacc

SEQ ID NO: 188568 - DNA, 25 bp, Rattus norvegicus
atgacaggtagatggcagaagtacc

SEQ ID NO: 188569 - DNA, 25 bp, Rattus norvegicus
atgacaggtgcacgccagcacacga

SEQ ID NO: 188570 - DNA, 25 bp, Rattus norvegicus
atgacaggtgcaggccagcacacga

SEQ ID NO: 188571 - DNA, 25 bp, Rattus norvegicus
atgacaggtgtgagcccgtcaaccc

SEQ ID NO: 188572 - DNA, 25 bp, Rattus norvegicus
atgacaggtgtgtgcccgtcaaccc

SEQ ID NO: 188573 - DNA, 25 bp, Rattus norvegicus
atgacagtagcccacacttcggtga

SEQ ID NO: 188574 - DNA, 25 bp, Rattus norvegicus
atgacagtagccgacacttcggtga

SEQ ID NO: 188575 - DNA, 25 bp, Rattus norvegicus
atgacagtcagcactggactaccca

SEQ ID NO: 188576 - DNA, 25 bp, Rattus norvegicus
atgacagtcagctctggactaccca

SEQ ID NO: 188577 - DNA, 25 bp, Rattus norvegicus
atgacagtctttatgggtacctgac

SEQ ID NO: 188578 - DNA, 25 bp, Rattus norvegicus
atgacagtctttttgggtacctgac

SEQ ID NO: 188579 - DNA, 25 bp, Rattus norvegicus
atgacagtgacaacgtgcccaccag

SEQ ID NO: 188580 - DNA, 25 bp, Rattus norvegicus
atgacagtgacactgccctctctac

SEQ ID NO: 188581 - DNA, 25 bp, Rattus norvegicus
atgacagtgacagtgccctctctac

SEQ ID NO: 188582 - DNA, 25 bp, Rattus norvegicus
atgacagtgacatcgtgcccaccag

SEQ ID NO: 188583 - DNA, 25 bp, Rattus norvegicus
atgacagtgactcggacatcagcgg

SEQ ID NO: 188584 - DNA, 25 bp, Rattus norvegicus
atgacagtgactgggacatcagcgg

SEQ ID NO: 188585 - DNA, 25 bp, Rattus norvegicus
atgacagtgaggacacctttgcatt

SEQ ID NO: 188586 - DNA, 25 bp, Rattus norvegicus
atgacagtgaggtcacctttgcatt

SEQ ID NO: 188587 - DNA, 25 bp, Rattus norvegicus
atgacagtgctaagcagggctttga

SEQ ID NO: 188588 - DNA, 25 bp, Rattus norvegicus
atgacagtgctatgcagggctttga

SEQ ID NO: 188589 - DNA, 25 bp, Rattus norvegicus
atgacagtgctgactcttttcctta

SEQ ID NO: 188590 - DNA, 25 bp, Rattus norvegicus
atgacagtgctgtctcttttcctta

SEQ ID NO: 188591 - DNA, 25 bp, Rattus norvegicus
atgacagtgtctctgtttgcaggtg

SEQ ID NO: 188592 - DNA, 25 bp, Rattus norvegicus
atgacagtgtctgtgtttgcaggtg

SEQ ID NO: 188593 - DNA, 25 bp, Rattus norvegicus
atgacagtgtttatcctgagcccag

SEQ ID NO: 188594 - DNA, 25 bp, Rattus norvegicus
atgacagtgtttttcctgagcccag

SEQ ID NO: 188595 - DNA, 25 bp, Rattus norvegicus
atgacagttgagagcagccggccat

SEQ ID NO: 188596 - DNA, 25 bp, Rattus norvegicus
atgacagttgagtgcagccggccat

SEQ ID NO: 188597 - DNA, 25 bp, Rattus norvegicus
atgacatagtggactgtgctcttct

SEQ ID NO: 188598 - DNA, 25 bp, Rattus norvegicus
atgacatagtggtctgtgctcttct

SEQ ID NO: 188599 - DNA, 25 bp, Rattus norvegicus
atgacatcaacactggtgcggtgga

SEQ ID NO: 188600 - DNA, 25 bp, Rattus norvegicus
atgacatcaacagtggtgcggtgga

SEQ ID NO: 188601 - DNA, 25 bp, Rattus norvegicus
atgacatcacagcagtctacctgca

SEQ ID NO: 188602 - DNA, 25 bp, Rattus norvegicus
atgacatcacaggagtctacctgca

SEQ ID NO: 188603 - DNA, 25 bp, Rattus norvegicus
atgacatcactcagctgaagctggc

SEQ ID NO: 188604 - DNA, 25 bp, Rattus norvegicus
atgacatcactctgctgaagctggc

SEQ ID NO: 188605 - DNA, 25 bp, Rattus norvegicus
atgacatcaggacccaatgcagctc

SEQ ID NO: 188606 - DNA, 25 bp, Rattus norvegicus
atgacatcaggagccaatgcagctc

SEQ ID NO: 188607 - DNA, 25 bp, Rattus norvegicus
atgacatcatttcgccttcaggttt

SEQ ID NO: 188608 - DNA, 25 bp, Rattus norvegicus
atgacatcatttggccttcaggttt

SEQ ID NO: 188609 - DNA, 25 bp, Rattus norvegicus
atgacatccatccatctgttgtgac

SEQ ID NO: 188610 - DNA, 25 bp, Rattus norvegicus
atgacatccatcgatctgttgtgac

SEQ ID NO: 188611 - DNA, 25 bp, Rattus norvegicus
atgacatccatgagaccagtgacag

SEQ ID NO: 188612 - DNA, 25 bp, Rattus norvegicus
atgacatccatgctctgatcctggg

SEQ ID NO: 188613 - DNA, 25 bp, Rattus norvegicus
atgacatccatggtctgatcctggg

SEQ ID NO: 188614 - DNA, 25 bp, Rattus norvegicus
atgacatccatgtgaccagtgacag

SEQ ID NO: 188615 - DNA, 25 bp, Rattus norvegicus
atgacatcccatacctttaatgcct

SEQ ID NO: 188616 - DNA, 25 bp, Rattus norvegicus
atgacatcccattcctttaatgcct

SEQ ID NO: 188617 - DNA, 25 bp, Rattus norvegicus
atgacatcctagctcacaatcccta

SEQ ID NO: 188618 - DNA, 25 bp, Rattus norvegicus
atgacatcctagcttgtccttgaac

SEQ ID NO: 188619 - DNA, 25 bp, Rattus norvegicus
atgacatcctaggtcacaatcccta

SEQ ID NO: 188620 - DNA, 25 bp, Rattus norvegicus
atgacatcctaggttgtccttgaac

SEQ ID NO: 188621 - DNA, 25 bp, Rattus norvegicus
atgacatccttcaggccgtggtacc

SEQ ID NO: 188622 - DNA, 25 bp, Rattus norvegicus
atgacatccttctggccgtggtacc

SEQ ID NO: 188623 - DNA, 25 bp, Rattus norvegicus
atgacatcgaacctttggccagccg

SEQ ID NO: 188624 - DNA, 25 bp, Rattus norvegicus
atgacatcgaacgtttggccagccg

SEQ ID NO: 188625 - DNA, 25 bp, Rattus norvegicus
atgacatcgtcaatgctgtggttgt

SEQ ID NO: 188626 - DNA, 25 bp, Rattus norvegicus
atgacatcgtcattgctgtggttgt

SEQ ID NO: 188627 - DNA, 25 bp, Rattus norvegicus
atgacatcgtgtacctgtgtccctt

SEQ ID NO: 188628 - DNA, 25 bp, Rattus norvegicus
atgacatcgtgttcctgtgtccctt

SEQ ID NO: 188629 - DNA, 25 bp, Rattus norvegicus
atgacatctgccaaagctgcttttt

SEQ ID NO: 188630 - DNA, 25 bp, Rattus norvegicus
atgacatctgcctaagctgcttttt

SEQ ID NO: 188631 - DNA, 25 bp, Rattus norvegicus
atgacatcttcaccactttgacata

SEQ ID NO: 188632 - DNA, 25 bp, Rattus norvegicus
atgacatcttcagcactttgacata

SEQ ID NO: 188633 - DNA, 25 bp, Rattus norvegicus
atgacatctttaaccttctcagagg

SEQ ID NO: 188634 - DNA, 25 bp, Rattus norvegicus
atgacatctttatccttctcagagg

SEQ ID NO: 188635 - DNA, 25 bp, Rattus norvegicus
atgacatgaaggatgtcctcggcaa

SEQ ID NO: 188636 - DNA, 25 bp, Rattus norvegicus
atgacatgaaggttgtcctcggcaa

SEQ ID NO: 188637 - DNA, 25 bp, Rattus norvegicus
atgacatgacaccttatactattat

SEQ ID NO: 188638 - DNA, 25 bp, Rattus norvegicus
atgacatgacacgttatactattat

SEQ ID NO: 188639 - DNA, 25 bp, Rattus norvegicus
atgacatgagctcgcagatgccgtt

SEQ ID NO: 188640 - DNA, 25 bp, Rattus norvegicus
atgacatgagctggcagatgccgtt

SEQ ID NO: 188641 - DNA, 25 bp, Rattus norvegicus
atgacatgatgcagggtgtgctgat

SEQ ID NO: 188642 - DNA, 25 bp, Rattus norvegicus
atgacatgatgctgggtgtgctgat

SEQ ID NO: 188643 - DNA, 25 bp, Rattus norvegicus
atgacatggtctcaggtcactcacc

SEQ ID NO: 188644 - DNA, 25 bp, Rattus norvegicus
atgacatggtctgaggtcactcacc

SEQ ID NO: 188645 - DNA, 25 bp, Rattus norvegicus
atgacatgtccgagtaggctctggg

SEQ ID NO: 188646 - DNA, 25 bp, Rattus norvegicus
atgacatgtccgtgtaggctctggg

SEQ ID NO: 188647 - DNA, 25 bp, Rattus norvegicus
atgacatgtctgacctgtgaccaga

SEQ ID NO: 188648 - DNA, 25 bp, Rattus norvegicus
atgacatgtctgtcctgtgaccaga

SEQ ID NO: 188649 - DNA, 25 bp, Rattus norvegicus
atgacattccctccctgtataaatt

SEQ ID NO: 188650 - DNA, 25 bp, Rattus norvegicus
atgacattccctgcctgtataaatt

SEQ ID NO: 188651 - DNA, 25 bp, Rattus norvegicus
atgacattcgaaccttttcgctata

SEQ ID NO: 188652 - DNA, 25 bp, Rattus norvegicus
atgacattcgaagcttttcgctata

SEQ ID NO: 188653 - DNA, 25 bp, Rattus norvegicus
atgacattcggcaggactggaccaa

SEQ ID NO: 188654 - DNA, 25 bp, Rattus norvegicus
atgacattcggctggactggaccaa

SEQ ID NO: 188655 - DNA, 25 bp, Rattus norvegicus
atgacattctgcattggaactgggc

SEQ ID NO: 188656 - DNA, 25 bp, Rattus norvegicus
atgacattctgctttggaactgggc

SEQ ID NO: 188657 - DNA, 25 bp, Rattus norvegicus
atgacattctggaagctctgttaat

SEQ ID NO: 188658 - DNA, 25 bp, Rattus norvegicus
atgacattctggtagctctgttaat

SEQ ID NO: 188659 - DNA, 25 bp, Rattus norvegicus
atgacattgaacacctcctgtttga

SEQ ID NO: 188660 - DNA, 25 bp, Rattus norvegicus
atgacattgaactcctcctgtttga

SEQ ID NO: 188661 - DNA, 25 bp, Rattus norvegicus
atgacattgagaaaacagcctcttg

SEQ ID NO: 188662 - DNA, 25 bp, Rattus norvegicus
atgacattgagataacagcctcttg

SEQ ID NO: 188663 - DNA, 25 bp, Rattus norvegicus
atgacattgcagctctaccgatgga

SEQ ID NO: 188664 - DNA, 25 bp, Rattus norvegicus
atgacattgcaggtctaccgatgga

SEQ ID NO: 188665 - DNA, 25 bp, Rattus norvegicus
atgacattgcccagctcatggtgct

SEQ ID NO: 188666 - DNA, 25 bp, Rattus norvegicus
atgacattgccctgctcatggtgct

SEQ ID NO: 188667 - DNA, 25 bp, Rattus norvegicus
atgacatttcacacacgcagtcggt

SEQ ID NO: 188668 - DNA, 25 bp, Rattus norvegicus
atgacatttcactcacgcagtcggt

SEQ ID NO: 188669 - DNA, 25 bp, Rattus norvegicus
atgacatttcatctgggtggtccag

SEQ ID NO: 188670 - DNA, 25 bp, Rattus norvegicus
atgacatttcatgtgggtggtccag

SEQ ID NO: 188671 - DNA, 25 bp, Rattus norvegicus
atgacatttggactgggccttgcat

SEQ ID NO: 188672 - DNA, 25 bp, Rattus norvegicus
atgacatttggagtgggccttgcat

SEQ ID NO: 188673 - DNA, 25 bp, Rattus norvegicus
atgacattttgtccttaacctggat

SEQ ID NO: 188674 - DNA, 25 bp, Rattus norvegicus
atgacattttgtgcttaacctggat

SEQ ID NO: 188675 - DNA, 25 bp, Rattus norvegicus
atgacatttttcctcagccaaacga

SEQ ID NO: 188676 - DNA, 25 bp, Rattus norvegicus
atgacatttttcgtcagccaaacga

SEQ ID NO: 188677 - DNA, 25 bp, Rattus norvegicus
atgaccaaaactctgccttgtggaa

SEQ ID NO: 188678 - DNA, 25 bp, Rattus norvegicus
atgaccaaaactgtgccttgtggaa

SEQ ID NO: 188679 - DNA, 25 bp, Rattus norvegicus
atgaccaaatacactaccacacgaa

SEQ ID NO: 188680 - DNA, 25 bp, Rattus norvegicus
atgaccaaatactctaccacacgaa

SEQ ID NO: 188681 - DNA, 25 bp, Rattus norvegicus
atgaccaaatctccagctagggctt

SEQ ID NO: 188682 - DNA, 25 bp, Rattus norvegicus
atgaccaaatctgcagctagggctt

SEQ ID NO: 188683 - DNA, 25 bp, Rattus norvegicus
atgaccaaccacatgattccctttg

SEQ ID NO: 188684 - DNA, 25 bp, Rattus norvegicus
atgaccaaccacttgattccctttg

SEQ ID NO: 188685 - DNA, 25 bp, Rattus norvegicus
atgaccaactaccatgaggcagcca

SEQ ID NO: 188686 - DNA, 25 bp, Rattus norvegicus
atgaccaactacgatgaggcagcca

SEQ ID NO: 188687 - DNA, 25 bp, Rattus norvegicus
atgaccaagaggatgggcctgaact

SEQ ID NO: 188688 - DNA, 25 bp, Rattus norvegicus
atgaccaagaggttgggcctgaact

SEQ ID NO: 188689 - DNA, 25 bp, Rattus norvegicus
atgaccaagatgacctctgcctagt

SEQ ID NO: 188690 - DNA, 25 bp, Rattus norvegicus
atgaccaagatgtcctctgcctagt

SEQ ID NO: 188691 - DNA, 25 bp, Rattus norvegicus
atgaccaaggagctcctgaagctga

SEQ ID NO: 188692 - DNA, 25 bp, Rattus norvegicus
atgaccaaggaggtcctgaagctga

SEQ ID NO: 188693 - DNA, 25 bp, Rattus norvegicus
atgaccaagttcacttcgttgacaa

SEQ ID NO: 188694 - DNA, 25 bp, Rattus norvegicus
atgaccaagttctcttcgttgacaa

SEQ ID NO: 188695 - DNA, 25 bp, Rattus norvegicus
atgaccaatggtctctgctgcacat

SEQ ID NO: 188696 - DNA, 25 bp, Rattus norvegicus
atgaccaatggtgtctgctgcacat

SEQ ID NO: 188697 - DNA, 25 bp, Rattus norvegicus
atgaccaatgtaagctgccatgtgt

SEQ ID NO: 188698 - DNA, 25 bp, Rattus norvegicus
atgaccaatgtatgctgccatgtgt

SEQ ID NO: 188699 - DNA, 25 bp, Rattus norvegicus
atgaccacaaagattgtgcctcaga

SEQ ID NO: 188700 - DNA, 25 bp, Rattus norvegicus
atgaccacaaagtttgtgcctcaga

SEQ ID NO: 188701 - DNA, 25 bp, Rattus norvegicus
atgaccacatacattctgatccaga

SEQ ID NO: 188702 - DNA, 25 bp, Rattus norvegicus
atgaccacatactttctgatccaga

SEQ ID NO: 188703 - DNA, 25 bp, Rattus norvegicus
atgaccaccagccttgcacctaatt

SEQ ID NO: 188704 - DNA, 25 bp, Rattus norvegicus
atgaccaccagcgttgcacctaatt

SEQ ID NO: 188705 - DNA, 25 bp, Rattus norvegicus
atgaccacccttcatcagaaatggg

SEQ ID NO: 188706 - DNA, 25 bp, Rattus norvegicus
atgaccacccttgatcagaaatggg

SEQ ID NO: 188707 - DNA, 25 bp, Rattus norvegicus
atgaccacctatcttgtctgcaatg

SEQ ID NO: 188708 - DNA, 25 bp, Rattus norvegicus
atgaccacctatgttgtctgcaatg

SEQ ID NO: 188709 - DNA, 25 bp, Rattus norvegicus
atgaccacctcgacacatggacagc

SEQ ID NO: 188710 - DNA, 25 bp, Rattus norvegicus
atgaccacctcgtcacatggacagc

SEQ ID NO: 188711 - DNA, 25 bp, Rattus norvegicus
atgaccacctgcactaagatggtga

SEQ ID NO: 188712 - DNA, 25 bp, Rattus norvegicus
atgaccacctgctctaagatggtga

SEQ ID NO: 188713 - DNA, 25 bp, Rattus norvegicus
atgaccacgacaaccggttatggac

SEQ ID NO: 188714 - DNA, 25 bp, Rattus norvegicus
atgaccacgacatccggttatggac

SEQ ID NO: 188715 - DNA, 25 bp, Rattus norvegicus
atgaccacgaggattcggacatctc

SEQ ID NO: 188716 - DNA, 25 bp, Rattus norvegicus
atgaccacgaggtttcggacatctc

SEQ ID NO: 188717 - DNA, 25 bp, Rattus norvegicus
atgaccacgcggagctagggtggcc

SEQ ID NO: 188718 - DNA, 25 bp, Rattus norvegicus
atgaccacgcggtgctagggtggcc

SEQ ID NO: 188719 - DNA, 25 bp, Rattus norvegicus
atgaccactacaccctacagagcag

SEQ ID NO: 188720 - DNA, 25 bp, Rattus norvegicus
atgaccactacagcctacagagcag

SEQ ID NO: 188721 - DNA, 25 bp, Rattus norvegicus
atgaccagaggacacaggacccagc

SEQ ID NO: 188722 - DNA, 25 bp, Rattus norvegicus
atgaccagaggagacaggacccagc

SEQ ID NO: 188723 - DNA, 25 bp, Rattus norvegicus
atgaccagcatgatcgtgacaaccg

SEQ ID NO: 188724 - DNA, 25 bp, Rattus norvegicus
atgaccagcatgttcgtgacaaccg

SEQ ID NO: 188725 - DNA, 25 bp, Rattus norvegicus
atgaccagcgagcttgactttctcc

SEQ ID NO: 188726 - DNA, 25 bp, Rattus norvegicus
atgaccagcgaggttgactttctcc

SEQ ID NO: 188727 - DNA, 25 bp, Rattus norvegicus
atgaccagctcaaggcctcggaggc

SEQ ID NO: 188728 - DNA, 25 bp, Rattus norvegicus
atgaccagctcatggcctcggaggc

SEQ ID NO: 188729 - DNA, 25 bp, Rattus norvegicus
atgaccagctgtctgccctttaaat

SEQ ID NO: 188730 - DNA, 25 bp, Rattus norvegicus
atgaccagctgtgtgccctttaaat

SEQ ID NO: 188731 - DNA, 25 bp, Rattus norvegicus
atgaccaggaccatggcggcatgca

SEQ ID NO: 188732 - DNA, 25 bp, Rattus norvegicus
atgaccaggaccttggcggcatgca

SEQ ID NO: 188733 - DNA, 25 bp, Rattus norvegicus
atgaccaggagcaagtgccggacct

SEQ ID NO: 188734 - DNA, 25 bp, Rattus norvegicus
atgaccaggagctagtgccggacct

SEQ ID NO: 188735 - DNA, 25 bp, Rattus norvegicus
atgaccaggatgaggctgctttgaa

SEQ ID NO: 188736 - DNA, 25 bp, Rattus norvegicus
atgaccaggatgtggctgctttgaa

SEQ ID NO: 188737 - DNA, 25 bp, Rattus norvegicus
atgaccagtgttattcaatttgaaa

SEQ ID NO: 188738 - DNA, 25 bp, Rattus norvegicus
atgaccagtgttcctgaccccagaa

SEQ ID NO: 188739 - DNA, 25 bp, Rattus norvegicus
atgaccagtgttgctgaccccagaa

SEQ ID NO: 188740 - DNA, 25 bp, Rattus norvegicus
atgaccagtgtttttcaatttgaaa

SEQ ID NO: 188741 - DNA, 25 bp, Rattus norvegicus
atgaccagttttctctgtccacata

SEQ ID NO: 188742 - DNA, 25 bp, Rattus norvegicus
atgaccagttttgtctgtccacata

SEQ ID NO: 188743 - DNA, 25 bp, Rattus norvegicus
atgaccatatacacagtagcctgaa

SEQ ID NO: 188744 - DNA, 25 bp, Rattus norvegicus
atgaccatatactcagtagcctgaa

SEQ ID NO: 188745 - DNA, 25 bp, Rattus norvegicus
atgaccatcagccagcaggagtttg

SEQ ID NO: 188746 - DNA, 25 bp, Rattus norvegicus
atgaccatcagcgagcaggagtttg

SEQ ID NO: 188747 - DNA, 25 bp, Rattus norvegicus
atgaccatcatccatccagtttcag

SEQ ID NO: 188748 - DNA, 25 bp, Rattus norvegicus
atgaccatcatcgatccagtttcag

SEQ ID NO: 188749 - DNA, 25 bp, Rattus norvegicus
atgaccatccacaacggcatgttct

SEQ ID NO: 188750 - DNA, 25 bp, Rattus norvegicus
atgaccatccactacggcatgttct

SEQ ID NO: 188751 - DNA, 25 bp, Rattus norvegicus
atgaccatccttaaagctgcagctg

SEQ ID NO: 188752 - DNA, 25 bp, Rattus norvegicus
atgaccatcctttaagctgcagctg

SEQ ID NO: 188753 - DNA, 25 bp, Rattus norvegicus
atgaccatgactctggcaccaacgg

SEQ ID NO: 188754 - DNA, 25 bp, Rattus norvegicus
atgaccatgactgtggcaccaacgg

SEQ ID NO: 188755 - DNA, 25 bp, Rattus norvegicus
atgaccatggctcccacaggacaat

SEQ ID NO: 188756 - DNA, 25 bp, Rattus norvegicus
atgaccatggctgccacaggacaat

SEQ ID NO: 188757 - DNA, 25 bp, Rattus norvegicus
atgaccatggtgcaccccaatgcag

SEQ ID NO: 188758 - DNA, 25 bp, Rattus norvegicus
atgaccatggtggaccccaatgcag

SEQ ID NO: 188759 - DNA, 25 bp, Rattus norvegicus
atgaccattaatcacattgctgtac

SEQ ID NO: 188760 - DNA, 25 bp, Rattus norvegicus
atgaccattaatgacattgctgtac

SEQ ID NO: 188761 - DNA, 25 bp, Rattus norvegicus
atgacccaaacaaagctgcagcagc

SEQ ID NO: 188762 - DNA, 25 bp, Rattus norvegicus
atgacccaaacatagctgcagcagc

SEQ ID NO: 188763 - DNA, 25 bp, Rattus norvegicus
atgacccaacatcccttttggtaat

SEQ ID NO: 188764 - DNA, 25 bp, Rattus norvegicus
atgacccaacatgccttttggtaat

SEQ ID NO: 188765 - DNA, 25 bp, Rattus norvegicus
atgacccaacttagtccttgtaggg

SEQ ID NO: 188766 - DNA, 25 bp, Rattus norvegicus
atgacccaactttgtccttgtaggg

SEQ ID NO: 188767 - DNA, 25 bp, Rattus norvegicus
atgacccacaagatctagaatgaag

SEQ ID NO: 188768 - DNA, 25 bp, Rattus norvegicus
atgacccacaagttctagaatgaag

SEQ ID NO: 188769 - DNA, 25 bp, Rattus norvegicus
atgacccacactaatttccatgagg

SEQ ID NO: 188770 - DNA, 25 bp, Rattus norvegicus
atgacccacacttatttccatgagg

SEQ ID NO: 188771 - DNA, 25 bp, Rattus norvegicus
atgacccacatgaattccagactgt

SEQ ID NO: 188772 - DNA, 25 bp, Rattus norvegicus
atgacccacatgtattccagactgt

SEQ ID NO: 188773 - DNA, 25 bp, Rattus norvegicus
atgacccaccaaaaatctttccagt

SEQ ID NO: 188774 - DNA, 25 bp, Rattus norvegicus
atgacccaccaataatctttccagt

SEQ ID NO: 188775 - DNA, 25 bp, Rattus norvegicus
atgacccacctgcagttagtgtgac

SEQ ID NO: 188776 - DNA, 25 bp, Rattus norvegicus
atgacccacctggagttagtgtgac

SEQ ID NO: 188777 - DNA, 25 bp, Rattus norvegicus
atgacccacggcatcaatgttaagg

SEQ ID NO: 188778 - DNA, 25 bp, Rattus norvegicus
atgacccacggcttcaatgttaagg

SEQ ID NO: 188779 - DNA, 25 bp, Rattus norvegicus
atgacccacgttaaatccctgagat

SEQ ID NO: 188780 - DNA, 25 bp, Rattus norvegicus
atgacccacgtttaatccctgagat

SEQ ID NO: 188781 - DNA, 25 bp, Rattus norvegicus
atgacccagcctctgggttcctgaa

SEQ ID NO: 188782 - DNA, 25 bp, Rattus norvegicus
atgacccagcctgtgggttcctgaa

SEQ ID NO: 188783 - DNA, 25 bp, Rattus norvegicus
atgacccaggcacacaagttctctc

SEQ ID NO: 188784 - DNA, 25 bp, Rattus norvegicus
atgacccaggcagacaagttctctc

SEQ ID NO: 188785 - DNA, 25 bp, Rattus norvegicus
atgacccagggcatagctcacggta

SEQ ID NO: 188786 - DNA, 25 bp, Rattus norvegicus
atgacccagggcttagctcacggta

SEQ ID NO: 188787 - DNA, 25 bp, Rattus norvegicus
atgacccatgtaccaggaagcttgt

SEQ ID NO: 188788 - DNA, 25 bp, Rattus norvegicus
atgacccatgtagcaggaagcttgt

SEQ ID NO: 188789 - DNA, 25 bp, Rattus norvegicus
atgacccatgtcatcaaccaaggga

SEQ ID NO: 188790 - DNA, 25 bp, Rattus norvegicus
atgacccatgtcttcaaccaaggga

SEQ ID NO: 188791 - DNA, 25 bp, Rattus norvegicus
atgacccattgcaaccaacatttcc

SEQ ID NO: 188792 - DNA, 25 bp, Rattus norvegicus
atgacccattgctaccaacatttcc

SEQ ID NO: 188793 - DNA, 25 bp, Rattus norvegicus
atgacccattttacctagtgcatga

SEQ ID NO: 188794 - DNA, 25 bp, Rattus norvegicus
atgacccatttttcctagtgcatga

SEQ ID NO: 188795 - DNA, 25 bp, Rattus norvegicus
atgaccccaatgatccctatgaaga

SEQ ID NO: 188796 - DNA, 25 bp, Rattus norvegicus
atgaccccaatgttccctatgaaga

SEQ ID NO: 188797 - DNA, 25 bp, Rattus norvegicus
atgaccccacagatgtagccatgac

SEQ ID NO: 188798 - DNA, 25 bp, Rattus norvegicus
atgaccccacagttgtagccatgac

SEQ ID NO: 188799 - DNA, 25 bp, Rattus norvegicus
atgaccccacccacagtgaactgag

SEQ ID NO: 188800 - DNA, 25 bp, Rattus norvegicus
atgaccccaccctcagtgaactgag

SEQ ID NO: 188801 - DNA, 25 bp, Rattus norvegicus
atgaccccactcatggtggagaacc

SEQ ID NO: 188802 - DNA, 25 bp, Rattus norvegicus
atgaccccactcttggtggagaacc

SEQ ID NO: 188803 - DNA, 25 bp, Rattus norvegicus
atgaccccagcaaccaggagaggtg

SEQ ID NO: 188804 - DNA, 25 bp, Rattus norvegicus
atgaccccagcatccaggagaggtg

SEQ ID NO: 188805 - DNA, 25 bp, Rattus norvegicus
atgaccccagccacatctaagatgt

SEQ ID NO: 188806 - DNA, 25 bp, Rattus norvegicus
atgaccccagcctcatctaagatgt

SEQ ID NO: 188807 - DNA, 25 bp, Rattus norvegicus
atgaccccagcgaggagactcttac

SEQ ID NO: 188808 - DNA, 25 bp, Rattus norvegicus
atgaccccagcgtggagactcttac

SEQ ID NO: 188809 - DNA, 25 bp, Rattus norvegicus
atgaccccagtgagtaattttccaa

SEQ ID NO: 188810 - DNA, 25 bp, Rattus norvegicus
atgaccccagtgtgtaattttccaa

SEQ ID NO: 188811 - DNA, 25 bp, Rattus norvegicus
atgaccccatacacctaggaatgtc

SEQ ID NO: 188812 - DNA, 25 bp, Rattus norvegicus
atgaccccatactcctaggaatgtc

SEQ ID NO: 188813 - DNA, 25 bp, Rattus norvegicus
atgaccccatgcctgctaatggaag

SEQ ID NO: 188814 - DNA, 25 bp, Rattus norvegicus
atgaccccatgcgtgctaatggaag

SEQ ID NO: 188815 - DNA, 25 bp, Rattus norvegicus
atgacccccagaaccaatttttgga

SEQ ID NO: 188816 - DNA, 25 bp, Rattus norvegicus
atgacccccagatccaatttttgga

SEQ ID NO: 188817 - DNA, 25 bp, Rattus norvegicus
atgaccccggtgaggtgggcaccta

SEQ ID NO: 188818 - DNA, 25 bp, Rattus norvegicus
atgaccccggtgtggtgggcaccta

SEQ ID NO: 188819 - DNA, 25 bp, Rattus norvegicus
atgaccccgtctcatggcaaggata

SEQ ID NO: 188820 - DNA, 25 bp, Rattus norvegicus
atgaccccgtctgatggcaaggata

SEQ ID NO: 188821 - DNA, 25 bp, Rattus norvegicus
atgacccctctgcttagcctggaat

SEQ ID NO: 188822 - DNA, 25 bp, Rattus norvegicus
atgacccctctggttagcctggaat

SEQ ID NO: 188823 - DNA, 25 bp, Rattus norvegicus
atgacccctgtcaatgccaggtatg

SEQ ID NO: 188824 - DNA, 25 bp, Rattus norvegicus
atgacccctgtctatgccaggtatg

SEQ ID NO: 188825 - DNA, 25 bp, Rattus norvegicus
atgacccctttcagtgcttaacaat

SEQ ID NO: 188826 - DNA, 25 bp, Rattus norvegicus
atgacccctttctgtgcttaacaat

SEQ ID NO: 188827 - DNA, 25 bp, Rattus norvegicus
atgacccgaagacaggctggctttt

SEQ ID NO: 188828 - DNA, 25 bp, Rattus norvegicus
atgacccgaagagaggctggctttt

SEQ ID NO: 188829 - DNA, 25 bp, Rattus norvegicus
atgacccgccagcatcaagaaattc

SEQ ID NO: 188830 - DNA, 25 bp, Rattus norvegicus
atgacccgccaggatcaagaaattc

SEQ ID NO: 188831 - DNA, 25 bp, Rattus norvegicus
atgacccgccgtcgtagcagggaat

SEQ ID NO: 188832 - DNA, 25 bp, Rattus norvegicus
atgacccgccgtggtagcagggaat

SEQ ID NO: 188833 - DNA, 25 bp, Rattus norvegicus
atgacccgcggtaaccagcgagagc

SEQ ID NO: 188834 - DNA, 25 bp, Rattus norvegicus
atgacccgcggttaccagcgagagc

SEQ ID NO: 188835 - DNA, 25 bp, Rattus norvegicus
atgacccgcttgagctgtatgtcta

SEQ ID NO: 188836 - DNA, 25 bp, Rattus norvegicus
atgacccgcttgtgctgtatgtcta

SEQ ID NO: 188837 - DNA, 25 bp, Rattus norvegicus
atgacccggctactagtgaaggaac

SEQ ID NO: 188838 - DNA, 25 bp, Rattus norvegicus
atgacccggctagtagtgaaggaac

SEQ ID NO: 188839 - DNA, 25 bp, Rattus norvegicus
atgacccgttttctggtgagccttg

SEQ ID NO: 188840 - DNA, 25 bp, Rattus norvegicus
atgacccgttttgtggtgagccttg

SEQ ID NO: 188841 - DNA, 25 bp, Rattus norvegicus
atgaccctagcaaggcttgaaaagc

SEQ ID NO: 188842 - DNA, 25 bp, Rattus norvegicus
atgaccctagcatggcttgaaaagc

SEQ ID NO: 188843 - DNA, 25 bp, Rattus norvegicus
atgaccctcagtcgctactgtattt

SEQ ID NO: 188844 - DNA, 25 bp, Rattus norvegicus
atgaccctcagtggctactgtattt

SEQ ID NO: 188845 - DNA, 25 bp, Rattus norvegicus
atgaccctccaacccagtaacaaat

SEQ ID NO: 188846 - DNA, 25 bp, Rattus norvegicus
atgaccctccaagccagtaacaaat

SEQ ID NO: 188847 - DNA, 25 bp, Rattus norvegicus
atgaccctccatagtgaagttttgc

SEQ ID NO: 188848 - DNA, 25 bp, Rattus norvegicus
atgaccctccattgtgaagttttgc

SEQ ID NO: 188849 - DNA, 25 bp, Rattus norvegicus
atgaccctctgaatgcctttggaag

SEQ ID NO: 188850 - DNA, 25 bp, Rattus norvegicus
atgaccctctgattgcctttggaag

SEQ ID NO: 188851 - DNA, 25 bp, Rattus norvegicus
atgaccctgaacatctgccagctcg

SEQ ID NO: 188852 - DNA, 25 bp, Rattus norvegicus
atgaccctgaacttctgccagctcg

SEQ ID NO: 188853 - DNA, 25 bp, Rattus norvegicus
atgaccctgacgatctccagtgtaa

SEQ ID NO: 188854 - DNA, 25 bp, Rattus norvegicus
atgaccctgacgttctccagtgtaa

SEQ ID NO: 188855 - DNA, 25 bp, Rattus norvegicus
atgaccctgctccttgggcaggcgt

SEQ ID NO: 188856 - DNA, 25 bp, Rattus norvegicus
atgaccctgctcgttgggcaggcgt

SEQ ID NO: 188857 - DNA, 25 bp, Rattus norvegicus
atgaccctgttgaaaaatctacatt

SEQ ID NO: 188858 - DNA, 25 bp, Rattus norvegicus
atgaccctgttgtaaaatctacatt

SEQ ID NO: 188859 - DNA, 25 bp, Rattus norvegicus
atgacccttacgaattccttcaatc

SEQ ID NO: 188860 - DNA, 25 bp, Rattus norvegicus
atgacccttacgtattccttcaatc

SEQ ID NO: 188861 - DNA, 25 bp, Rattus norvegicus
atgacccttatgaatttccctgcca

SEQ ID NO: 188862 - DNA, 25 bp, Rattus norvegicus
atgacccttatgtatttccctgcca

SEQ ID NO: 188863 - DNA, 25 bp, Rattus norvegicus
atgacccttcaaatccttttatcta

SEQ ID NO: 188864 - DNA, 25 bp, Rattus norvegicus
atgacccttcaattccttttatcta

SEQ ID NO: 188865 - DNA, 25 bp, Rattus norvegicus
atgacccttgtcaatctcaggtgtc

SEQ ID NO: 188866 - DNA, 25 bp, Rattus norvegicus
atgacccttgtctatctcaggtgtc

SEQ ID NO: 188867 - DNA, 25 bp, Rattus norvegicus
atgaccgacagaacgtagacacgcc

SEQ ID NO: 188868 - DNA, 25 bp, Rattus norvegicus
atgaccgacagatcgtagacacgcc

SEQ ID NO: 188869 - DNA, 25 bp, Rattus norvegicus
atgaccgacagcactcctgttgtaa

SEQ ID NO: 188870 - DNA, 25 bp, Rattus norvegicus
atgaccgacagctctcctgttgtaa

SEQ ID NO: 188871 - DNA, 25 bp, Rattus norvegicus
atgaccgaccgcagctgaggttcga

SEQ ID NO: 188872 - DNA, 25 bp, Rattus norvegicus
atgaccgaccgctgctgaggttcga

SEQ ID NO: 188873 - DNA, 25 bp, Rattus norvegicus
atgaccgaccttcatgttgtactca

SEQ ID NO: 188874 - DNA, 25 bp, Rattus norvegicus
atgaccgaccttgatgttgtactca

SEQ ID NO: 188875 - DNA, 25 bp, Rattus norvegicus
atgaccgacgagacacacatcttct

SEQ ID NO: 188876 - DNA, 25 bp, Rattus norvegicus
atgaccgacgagtcacacatcttct

SEQ ID NO: 188877 - DNA, 25 bp, Rattus norvegicus
atgaccgaggctctcccaagtgccg

SEQ ID NO: 188878 - DNA, 25 bp, Rattus norvegicus
atgaccgaggctgtcccaagtgccg

SEQ ID NO: 188879 - DNA, 25 bp, Rattus norvegicus
atgaccgaggtgacacgtgacatcc

SEQ ID NO: 188880 - DNA, 25 bp, Rattus norvegicus
atgaccgaggtgtcacgtgacatcc

SEQ ID NO: 188881 - DNA, 25 bp, Rattus norvegicus
atgaccgaggttagatctccttccc

SEQ ID NO: 188882 - DNA, 25 bp, Rattus norvegicus
atgaccgaggtttgatctccttccc

SEQ ID NO: 188883 - DNA, 25 bp, Rattus norvegicus
atgaccgatggacttgccgatccca

SEQ ID NO: 188884 - DNA, 25 bp, Rattus norvegicus
atgaccgatggagttgccgatccca

SEQ ID NO: 188885 - DNA, 25 bp, Rattus norvegicus
atgaccgatgtccacacttgtaagt

SEQ ID NO: 188886 - DNA, 25 bp, Rattus norvegicus
atgaccgatgtcgacacttgtaagt

SEQ ID NO: 188887 - DNA, 25 bp, Rattus norvegicus
atgaccgcaaagagttcgtgggcag

SEQ ID NO: 188888 - DNA, 25 bp, Rattus norvegicus
atgaccgcaaagtgttcgtgggcag

SEQ ID NO: 188889 - DNA, 25 bp, Rattus norvegicus
atgaccgcaagtccatgaccacagt

SEQ ID NO: 188890 - DNA, 25 bp, Rattus norvegicus
atgaccgcaagtgcatgaccacagt

SEQ ID NO: 188891 - DNA, 25 bp, Rattus norvegicus
atgaccgcaatcagtaccgttgtgg

SEQ ID NO: 188892 - DNA, 25 bp, Rattus norvegicus
atgaccgcaatctgtaccgttgtgg

SEQ ID NO: 188893 - DNA, 25 bp, Rattus norvegicus
atgaccgccggtagcaggtgatgta

SEQ ID NO: 188894 - DNA, 25 bp, Rattus norvegicus
atgaccgccggttgcaggtgatgta

SEQ ID NO: 188895 - DNA, 25 bp, Rattus norvegicus
atgaccgcttctagtgtttatctag

SEQ ID NO: 188896 - DNA, 25 bp, Rattus norvegicus
atgaccgcttcttgtgtttatctag

SEQ ID NO: 188897 - DNA, 25 bp, Rattus norvegicus
atgaccgtcgtcagttgtggacact

SEQ ID NO: 188898 - DNA, 25 bp, Rattus norvegicus
atgaccgtcgtctgttgtggacact

SEQ ID NO: 188899 - DNA, 25 bp, Rattus norvegicus
atgaccgtctctaagtcactttaga

SEQ ID NO: 188900 - DNA, 25 bp, Rattus norvegicus
atgaccgtctcttagtcactttaga

SEQ ID NO: 188901 - DNA, 25 bp, Rattus norvegicus
atgaccgtggctaggcatgagtgca

SEQ ID NO: 188902 - DNA, 25 bp, Rattus norvegicus
atgaccgtggcttggcatgagtgca

SEQ ID NO: 188903 - DNA, 25 bp, Rattus norvegicus
atgaccgtgttaacccttatgtgtt

SEQ ID NO: 188904 - DNA, 25 bp, Rattus norvegicus
atgaccgtgttatcccttatgtgtt

SEQ ID NO: 188905 - DNA, 25 bp, Rattus norvegicus
atgaccgtgttgattggcccagaga

SEQ ID NO: 188906 - DNA, 25 bp, Rattus norvegicus
atgaccgtgttgtttggcccagaga

SEQ ID NO: 188907 - DNA, 25 bp, Rattus norvegicus
atgaccgttttgaatcctgactcag

SEQ ID NO: 188908 - DNA, 25 bp, Rattus norvegicus
atgaccgttttgtatcctgactcag

SEQ ID NO: 188909 - DNA, 25 bp, Rattus norvegicus
atgacctaaccccagttgctgtttt

SEQ ID NO: 188910 - DNA, 25 bp, Rattus norvegicus
atgacctaacccgagttgctgtttt

SEQ ID NO: 188911 - DNA, 25 bp, Rattus norvegicus
atgacctaagggacacgtttgctgc

SEQ ID NO: 188912 - DNA, 25 bp, Rattus norvegicus
atgacctaagggtcacgtttgctgc

SEQ ID NO: 188913 - DNA, 25 bp, Rattus norvegicus
atgacctacacgctgttcgagtatg

SEQ ID NO: 188914 - DNA, 25 bp, Rattus norvegicus
atgacctacacggtgttcgagtatg

SEQ ID NO: 188915 - DNA, 25 bp, Rattus norvegicus
atgacctagagacttccaaaaccag

SEQ ID NO: 188916 - DNA, 25 bp, Rattus norvegicus
atgacctagagagttccaaaaccag

SEQ ID NO: 188917 - DNA, 25 bp, Rattus norvegicus
atgacctagataacccaggatgctt

SEQ ID NO: 188918 - DNA, 25 bp, Rattus norvegicus
atgacctagatatcccaggatgctt

SEQ ID NO: 188919 - DNA, 25 bp, Rattus norvegicus
atgacctagccgattggagtatcaa

SEQ ID NO: 188920 - DNA, 25 bp, Rattus norvegicus
atgacctagccgtttggagtatcaa

SEQ ID NO: 188921 - DNA, 25 bp, Rattus norvegicus
atgacctagggcagaccaacacgga

SEQ ID NO: 188922 - DNA, 25 bp, Rattus norvegicus
atgacctagggctgaccaacacgga

SEQ ID NO: 188923 - DNA, 25 bp, Rattus norvegicus
atgacctatattcggcagggttgcc

SEQ ID NO: 188924 - DNA, 25 bp, Rattus norvegicus
atgacctatattgggcagggttgcc

SEQ ID NO: 188925 - DNA, 25 bp, Rattus norvegicus
atgacctattgtatgccttggattc

SEQ ID NO: 188926 - DNA, 25 bp, Rattus norvegicus
atgacctattgtttgccttggattc

SEQ ID NO: 188927 - DNA, 25 bp, Rattus norvegicus
atgacctcaatgaggccaccaactt

SEQ ID NO: 188928 - DNA, 25 bp, Rattus norvegicus
atgacctcaatgtggccaccaactt

SEQ ID NO: 188929 - DNA, 25 bp, Rattus norvegicus
atgacctcagccatgactacagcca

SEQ ID NO: 188930 - DNA, 25 bp, Rattus norvegicus
atgacctcagccttgactacagcca

SEQ ID NO: 188931 - DNA, 25 bp, Rattus norvegicus
atgacctcaggaccctggatcagaa

SEQ ID NO: 188932 - DNA, 25 bp, Rattus norvegicus
atgacctcaggagcctggatcagaa

SEQ ID NO: 188933 - DNA, 25 bp, Rattus norvegicus
atgacctcatcgacgtggttgaagg

SEQ ID NO: 188934 - DNA, 25 bp, Rattus norvegicus
atgacctcatcgtcgtggttgaagg

SEQ ID NO: 188935 - DNA, 25 bp, Rattus norvegicus
atgacctccaagacctcttaggact

SEQ ID NO: 188936 - DNA, 25 bp, Rattus norvegicus
atgacctccaagtcctcttaggact

SEQ ID NO: 188937 - DNA, 25 bp, Rattus norvegicus
atgacctccggcagttagttgtgaa

SEQ ID NO: 188938 - DNA, 25 bp, Rattus norvegicus
atgacctccggctgttagttgtgaa

SEQ ID NO: 188939 - DNA, 25 bp, Rattus norvegicus
atgacctctaggagagctcatttac

SEQ ID NO: 188940 - DNA, 25 bp, Rattus norvegicus
atgacctctaggtgagctcatttac

SEQ ID NO: 188941 - DNA, 25 bp, Rattus norvegicus
atgacctctataaaagctgaagtgc

SEQ ID NO: 188942 - DNA, 25 bp, Rattus norvegicus
atgacctctatataagctgaagtgc

SEQ ID NO: 188943 - DNA, 25 bp, Rattus norvegicus
atgacctctcaccagtgttacacga

SEQ ID NO: 188944 - DNA, 25 bp, Rattus norvegicus
atgacctctcacgagtgttacacga

SEQ ID NO: 188945 - DNA, 25 bp, Rattus norvegicus
atgacctcttgccttcaggtattaa

SEQ ID NO: 188946 - DNA, 25 bp, Rattus norvegicus
atgacctcttgcgttcaggtattaa

SEQ ID NO: 188947 - DNA, 25 bp, Rattus norvegicus
atgacctcttgtaccttagcagtct

SEQ ID NO: 188948 - DNA, 25 bp, Rattus norvegicus
atgacctcttgtccctgaatttcat

SEQ ID NO: 188949 - DNA, 25 bp, Rattus norvegicus
atgacctcttgtgcctgaatttcat

SEQ ID NO: 188950 - DNA, 25 bp, Rattus norvegicus
atgacctcttgttccttagcagtct

SEQ ID NO: 188951 - DNA, 25 bp, Rattus norvegicus
atgacctgacttcgctaagcttttt

SEQ ID NO: 188952 - DNA, 25 bp, Rattus norvegicus
atgacctgacttggctaagcttttt

SEQ ID NO: 188953 - DNA, 25 bp, Rattus norvegicus
atgacctgagcaactgtggaaccct

SEQ ID NO: 188954 - DNA, 25 bp, Rattus norvegicus
atgacctgagcatctgtggaaccct

SEQ ID NO: 188955 - DNA, 25 bp, Rattus norvegicus
atgacctgataccatcttgtgagaa

SEQ ID NO: 188956 - DNA, 25 bp, Rattus norvegicus
atgacctgatacgatcttgtgagaa

SEQ ID NO: 188957 - DNA, 25 bp, Rattus norvegicus
atgacctgcgcaccaagttcttgct

SEQ ID NO: 188958 - DNA, 25 bp, Rattus norvegicus
atgacctgcgcagcaagttcttgct

SEQ ID NO: 188959 - DNA, 25 bp, Rattus norvegicus
atgacctggagaacctgcgagacct

SEQ ID NO: 188960 - DNA, 25 bp, Rattus norvegicus
atgacctggagatcctgcgagacct

SEQ ID NO: 188961 - DNA, 25 bp, Rattus norvegicus
atgacctggcatagtgttttcactc

SEQ ID NO: 188962 - DNA, 25 bp, Rattus norvegicus
atgacctggcattgtgttttcactc

SEQ ID NO: 188963 - DNA, 25 bp, Rattus norvegicus
atgacctggccgacgatgaggcccg

SEQ ID NO: 188964 - DNA, 25 bp, Rattus norvegicus
atgacctggccgtcgatgaggcccg

SEQ ID NO: 188965 - DNA, 25 bp, Rattus norvegicus
atgacctgggtcagtgcagcaaaca

SEQ ID NO: 188966 - DNA, 25 bp, Rattus norvegicus
atgacctgggtctgtgcagcaaaca

SEQ ID NO: 188967 - DNA, 25 bp, Rattus norvegicus
atgacctgtaagaccggtgacctaa

SEQ ID NO: 188968 - DNA, 25 bp, Rattus norvegicus
atgacctgtaagtccggtgacctaa

SEQ ID NO: 188969 - DNA, 25 bp, Rattus norvegicus
atgacctgtaccacatacatgctta

SEQ ID NO: 188970 - DNA, 25 bp, Rattus norvegicus
atgacctgtacctcatacatgctta

SEQ ID NO: 188971 - DNA, 25 bp, Rattus norvegicus
atgacctgtgcgaatgaagaaccca

SEQ ID NO: 188972 - DNA, 25 bp, Rattus norvegicus
atgacctgtgcgtatgaagaaccca

SEQ ID NO: 188973 - DNA, 25 bp, Rattus norvegicus
atgacctgtgggagtgacagtgtct

SEQ ID NO: 188974 - DNA, 25 bp, Rattus norvegicus
atgacctgtgggtgtgacagtgtct

SEQ ID NO: 188975 - DNA, 25 bp, Rattus norvegicus
atgaccttaaacactgcttccatgt

SEQ ID NO: 188976 - DNA, 25 bp, Rattus norvegicus
atgaccttaaactctgcttccatgt

SEQ ID NO: 188977 - DNA, 25 bp, Rattus norvegicus
atgaccttacaaacgtgggactgtt

SEQ ID NO: 188978 - DNA, 25 bp, Rattus norvegicus
atgaccttacaatcgtgggactgtt

SEQ ID NO: 188979 - DNA, 25 bp, Rattus norvegicus
atgaccttagatcctgcagccatga

SEQ ID NO: 188980 - DNA, 25 bp, Rattus norvegicus
atgaccttagatgctgcagccatga

SEQ ID NO: 188981 - DNA, 25 bp, Rattus norvegicus
atgaccttagtccatcagacactgc

SEQ ID NO: 188982 - DNA, 25 bp, Rattus norvegicus
atgaccttagtcgatcagacactgc

SEQ ID NO: 188983 - DNA, 25 bp, Rattus norvegicus
atgaccttcaggacagtgtcaccct

SEQ ID NO: 188984 - DNA, 25 bp, Rattus norvegicus
atgaccttcaggatcacagcagctg

SEQ ID NO: 188985 - DNA, 25 bp, Rattus norvegicus
atgaccttcaggtcagtgtcaccct

SEQ ID NO: 188986 - DNA, 25 bp, Rattus norvegicus
atgaccttcaggttcacagcagctg

SEQ ID NO: 188987 - DNA, 25 bp, Rattus norvegicus
atgaccttcatcatcgtactggcct

SEQ ID NO: 188988 - DNA, 25 bp, Rattus norvegicus
atgaccttcatcttcgtactggcct

SEQ ID NO: 188989 - DNA, 25 bp, Rattus norvegicus
atgaccttcatgaacggattcttaa

SEQ ID NO: 188990 - DNA, 25 bp, Rattus norvegicus
atgaccttcatgctgctcttggcgg

SEQ ID NO: 188991 - DNA, 25 bp, Rattus norvegicus
atgaccttcatggtgctcttggcgg

SEQ ID NO: 188992 - DNA, 25 bp, Rattus norvegicus
atgaccttcatgtacggattcttaa

SEQ ID NO: 188993 - DNA, 25 bp, Rattus norvegicus
atgaccttcgtgacatttcttctca

SEQ ID NO: 188994 - DNA, 25 bp, Rattus norvegicus
atgaccttcgtgtcatttcttctca

SEQ ID NO: 188995 - DNA, 25 bp, Rattus norvegicus
atgaccttctcgacattggatatgt

SEQ ID NO: 188996 - DNA, 25 bp, Rattus norvegicus
atgaccttctcgtcattggatatgt

SEQ ID NO: 188997 - DNA, 25 bp, Rattus norvegicus
atgaccttctgcctgggatggagct

SEQ ID NO: 188998 - DNA, 25 bp, Rattus norvegicus
atgaccttctgcgtgggatggagct

SEQ ID NO: 188999 - DNA, 25 bp, Rattus norvegicus
atgaccttctggaggcctcggctga

SEQ ID NO: 189000 - DNA, 25 bp, Rattus norvegicus
atgaccttctggtggcctcggctga

SEQ ID NO: 189001 - DNA, 25 bp, Rattus norvegicus
atgaccttctgtacggatttgctct

SEQ ID NO: 189002 - DNA, 25 bp, Rattus norvegicus
atgaccttctgttcggatttgctct

SEQ ID NO: 189003 - DNA, 25 bp, Rattus norvegicus
atgaccttctttctcctaatgtcca

SEQ ID NO: 189004 - DNA, 25 bp, Rattus norvegicus
atgaccttctttgtcctaatgtcca

SEQ ID NO: 189005 - DNA, 25 bp, Rattus norvegicus
atgaccttgaacacccagtaatggg

SEQ ID NO: 189006 - DNA, 25 bp, Rattus norvegicus
atgaccttgaacctgcctggagctc

SEQ ID NO: 189007 - DNA, 25 bp, Rattus norvegicus
atgaccttgaacgtgcctggagctc

SEQ ID NO: 189008 - DNA, 25 bp, Rattus norvegicus
atgaccttgaactcccagtaatggg

SEQ ID NO: 189009 - DNA, 25 bp, Rattus norvegicus
atgaccttgagaatccaccttatac

SEQ ID NO: 189010 - DNA, 25 bp, Rattus norvegicus
atgaccttgagattccaccttatac

SEQ ID NO: 189011 - DNA, 25 bp, Rattus norvegicus
atgaccttgccaacctggtggagaa

SEQ ID NO: 189012 - DNA, 25 bp, Rattus norvegicus
atgaccttgccatcctggtggagaa

SEQ ID NO: 189013 - DNA, 25 bp, Rattus norvegicus
atgaccttggttcggagttctgctc

SEQ ID NO: 189014 - DNA, 25 bp, Rattus norvegicus
atgaccttggttgggagttctgctc

SEQ ID NO: 189015 - DNA, 25 bp, Rattus norvegicus
atgaccttgtgaactgacctgtgaa

SEQ ID NO: 189016 - DNA, 25 bp, Rattus norvegicus
atgaccttgtgatctgacctgtgaa

SEQ ID NO: 189017 - DNA, 25 bp, Rattus norvegicus
atgaccttgtttagttgatggagac

SEQ ID NO: 189018 - DNA, 25 bp, Rattus norvegicus
atgaccttgttttgttgatggagac

SEQ ID NO: 189019 - DNA, 25 bp, Rattus norvegicus
atgacctttagtatgctatcagcaa

SEQ ID NO: 189020 - DNA, 25 bp, Rattus norvegicus
atgacctttagtttgctatcagcaa

SEQ ID NO: 189021 - DNA, 25 bp, Rattus norvegicus
atgacctttatccttttgaaatgtg

SEQ ID NO: 189022 - DNA, 25 bp, Rattus norvegicus
atgacctttatcgttttgaaatgtg

SEQ ID NO: 189023 - DNA, 25 bp, Rattus norvegicus
atgacctttgtaccaccggcagtgt

SEQ ID NO: 189024 - DNA, 25 bp, Rattus norvegicus
atgacctttgtagcaccggcagtgt

SEQ ID NO: 189025 - DNA, 25 bp, Rattus norvegicus
atgaccttttcaatgccgtgatttt

SEQ ID NO: 189026 - DNA, 25 bp, Rattus norvegicus
atgaccttttcattgccgtgatttt

SEQ ID NO: 189027 - DNA, 25 bp, Rattus norvegicus
atgacctttttcaatcacaccaagt

SEQ ID NO: 189028 - DNA, 25 bp, Rattus norvegicus
atgacctttttctatcacaccaagt

SEQ ID NO: 189029 - DNA, 25 bp, Rattus norvegicus
atgacctttttgcagtgtatcccct

SEQ ID NO: 189030 - DNA, 25 bp, Rattus norvegicus
atgacctttttggagtgtatcccct

SEQ ID NO: 189031 - DNA, 25 bp, Rattus norvegicus
atgacgaacatcacggacctcaggg

SEQ ID NO: 189032 - DNA, 25 bp, Rattus norvegicus
atgacgaacatctcggacctcaggg

SEQ ID NO: 189033 - DNA, 25 bp, Rattus norvegicus
atgacgaagatgacgatgacgatgg

SEQ ID NO: 189034 - DNA, 25 bp, Rattus norvegicus
atgacgaagatgtcgatgacgatgg

SEQ ID NO: 189035 - DNA, 25 bp, Rattus norvegicus
atgacgaaggctcgatgtcccacgt

SEQ ID NO: 189036 - DNA, 25 bp, Rattus norvegicus
atgacgaaggctggatgtcccacgt

SEQ ID NO: 189037 - DNA, 25 bp, Rattus norvegicus
atgacgacactgatgggacgactgt

SEQ ID NO: 189038 - DNA, 25 bp, Rattus norvegicus
atgacgacactgttgggacgactgt

SEQ ID NO: 189039 - DNA, 25 bp, Rattus norvegicus
atgacgacaggccagacgacccgtg

SEQ ID NO: 189040 - DNA, 25 bp, Rattus norvegicus
atgacgacaggcgagacgacccgtg

SEQ ID NO: 189041 - DNA, 25 bp, Rattus norvegicus
atgacgacgagaccgccatcgactt

SEQ ID NO: 189042 - DNA, 25 bp, Rattus norvegicus
atgacgacgagagcgccatcgactt

SEQ ID NO: 189043 - DNA, 25 bp, Rattus norvegicus
atgacgacggctacatcgaggacaa

SEQ ID NO: 189044 - DNA, 25 bp, Rattus norvegicus
atgacgacggcttcatcgaggacaa

SEQ ID NO: 189045 - DNA, 25 bp, Rattus norvegicus
atgacgactttgagactaccttctt

SEQ ID NO: 189046 - DNA, 25 bp, Rattus norvegicus
atgacgactttgtgactaccttctt

SEQ ID NO: 189047 - DNA, 25 bp, Rattus norvegicus
atgacgagattgacctcctgcactg

SEQ ID NO: 189048 - DNA, 25 bp, Rattus norvegicus
atgacgagattgtcctcctgcactg

SEQ ID NO: 189049 - DNA, 25 bp, Rattus norvegicus
atgacgagggccaagaggatgacta

SEQ ID NO: 189050 - DNA, 25 bp, Rattus norvegicus
atgacgagggcctagaggatgacta

SEQ ID NO: 189051 - DNA, 25 bp, Rattus norvegicus
atgacgatcattcccgaacagataa

SEQ ID NO: 189052 - DNA, 25 bp, Rattus norvegicus
atgacgatcattgccgaacagataa

SEQ ID NO: 189053 - DNA, 25 bp, Rattus norvegicus
atgacgatgaataactccagccccg

SEQ ID NO: 189054 - DNA, 25 bp, Rattus norvegicus
atgacgatgaattactccagccccg

SEQ ID NO: 189055 - DNA, 25 bp, Rattus norvegicus
atgacgatgctgactctgcctgggc

SEQ ID NO: 189056 - DNA, 25 bp, Rattus norvegicus
atgacgatgctgtctctgcctgggc

SEQ ID NO: 189057 - DNA, 25 bp, Rattus norvegicus
atgacgatggttccgacagcgagtc

SEQ ID NO: 189058 - DNA, 25 bp, Rattus norvegicus
atgacgatggttgcgacagcgagtc

SEQ ID NO: 189059 - DNA, 25 bp, Rattus norvegicus
atgacgatttctctgttactgaagg

SEQ ID NO: 189060 - DNA, 25 bp, Rattus norvegicus
atgacgatttctgtgttactgaagg

SEQ ID NO: 189061 - DNA, 25 bp, Rattus norvegicus
atgacgcagcgactgactgtctctt

SEQ ID NO: 189062 - DNA, 25 bp, Rattus norvegicus
atgacgcagcgagtgactgtctctt

SEQ ID NO: 189063 - DNA, 25 bp, Rattus norvegicus
atgacgcagtctctacaggcaggga

SEQ ID NO: 189064 - DNA, 25 bp, Rattus norvegicus
atgacgcagtctgtacaggcaggga

SEQ ID NO: 189065 - DNA, 25 bp, Rattus norvegicus
atgacgccaagcaagaggacgcctg

SEQ ID NO: 189066 - DNA, 25 bp, Rattus norvegicus
atgacgccaagctagaggacgcctg

SEQ ID NO: 189067 - DNA, 25 bp, Rattus norvegicus
atgacgccagaaactacgtgtgcag

SEQ ID NO: 189068 - DNA, 25 bp, Rattus norvegicus
atgacgccagaatctacgtgtgcag

SEQ ID NO: 189069 - DNA, 25 bp, Rattus norvegicus
atgacgccatcaagtcacactgtga

SEQ ID NO: 189070 - DNA, 25 bp, Rattus norvegicus
atgacgccatcatgtcacactgtga

SEQ ID NO: 189071 - DNA, 25 bp, Rattus norvegicus
atgacgccgcgaaaccgacaactaa

SEQ ID NO: 189072 - DNA, 25 bp, Rattus norvegicus
atgacgccgcgataccgacaactaa

SEQ ID NO: 189073 - DNA, 25 bp, Rattus norvegicus
atgacgcctcttctctgtggaactt

SEQ ID NO: 189074 - DNA, 25 bp, Rattus norvegicus
atgacgcctcttgtctgtggaactt

SEQ ID NO: 189075 - DNA, 25 bp, Rattus norvegicus
atgacgcgctcgctcgtggagaact

SEQ ID NO: 189076 - DNA, 25 bp, Rattus norvegicus
atgacgcgctcggtcgtggagaact

SEQ ID NO: 189077 - DNA, 25 bp, Rattus norvegicus
atgacgctcatcctgggcatcacgt

SEQ ID NO: 189078 - DNA, 25 bp, Rattus norvegicus
atgacgctcatcgtgggcatcacgt

SEQ ID NO: 189079 - DNA, 25 bp, Rattus norvegicus
atgacgctgatccttatctggcaga

SEQ ID NO: 189080 - DNA, 25 bp, Rattus norvegicus
atgacgctgatcgttatctggcaga

SEQ ID NO: 189081 - DNA, 25 bp, Rattus norvegicus
atgacgctggataaccttctagaaa

SEQ ID NO: 189082 - DNA, 25 bp, Rattus norvegicus
atgacgctggattaccttctagaaa

SEQ ID NO: 189083 - DNA, 25 bp, Rattus norvegicus
atgacgcttggtcacatcatcaccg

SEQ ID NO: 189084 - DNA, 25 bp, Rattus norvegicus
atgacgcttggtgacatcatcaccg

SEQ ID NO: 189085 - DNA, 25 bp, Rattus norvegicus
atgacggaaggactccttcaagccc

SEQ ID NO: 189086 - DNA, 25 bp, Rattus norvegicus
atgacggaaggagtccttcaagccc

SEQ ID NO: 189087 - DNA, 25 bp, Rattus norvegicus
atgacggactacacttcagagccaa

SEQ ID NO: 189088 - DNA, 25 bp, Rattus norvegicus
atgacggactactcttcagagccaa

SEQ ID NO: 189089 - DNA, 25 bp, Rattus norvegicus
atgacggaggcccacggtcccaagc

SEQ ID NO: 189090 - DNA, 25 bp, Rattus norvegicus
atgacggaggccgacggtcccaagc

SEQ ID NO: 189091 - DNA, 25 bp, Rattus norvegicus
atgacggaggtgctgcctaaccaga

SEQ ID NO: 189092 - DNA, 25 bp, Rattus norvegicus
atgacggaggtggtgcctaaccaga

SEQ ID NO: 189093 - DNA, 25 bp, Rattus norvegicus
atgacggcgactacgtggtactgaa

SEQ ID NO: 189094 - DNA, 25 bp, Rattus norvegicus
atgacggcgacttcgtggtactgaa

SEQ ID NO: 189095 - DNA, 25 bp, Rattus norvegicus
atgacggcggtcaacatgatttgta

SEQ ID NO: 189096 - DNA, 25 bp, Rattus norvegicus
atgacggcggtctacatgatttgta

SEQ ID NO: 189097 - DNA, 25 bp, Rattus norvegicus
atgacggcgtgtctctgcatgagct

SEQ ID NO: 189098 - DNA, 25 bp, Rattus norvegicus
atgacggcgtgtgtctgcatgagct

SEQ ID NO: 189099 - DNA, 25 bp, Rattus norvegicus
atgacggctatgctgtctcctacat

SEQ ID NO: 189100 - DNA, 25 bp, Rattus norvegicus
atgacggctatggtgtctcctacat

SEQ ID NO: 189101 - DNA, 25 bp, Rattus norvegicus
atgacgggcacacctctaacttagt

SEQ ID NO: 189102 - DNA, 25 bp, Rattus norvegicus
atgacgggcacagctctaacttagt

SEQ ID NO: 189103 - DNA, 25 bp, Rattus norvegicus
atgacgggcatgatttcccaacagt

SEQ ID NO: 189104 - DNA, 25 bp, Rattus norvegicus
atgacgggcatgttttcccaacagt

SEQ ID NO: 189105 - DNA, 25 bp, Rattus norvegicus
atgacgggctgcagtatcggccaga

SEQ ID NO: 189106 - DNA, 25 bp, Rattus norvegicus
atgacgggctgctgtatcggccaga

SEQ ID NO: 189107 - DNA, 25 bp, Rattus norvegicus
atgacggtaagcagttctccacgca

SEQ ID NO: 189108 - DNA, 25 bp, Rattus norvegicus
atgacggtaagctgttctccacgca

SEQ ID NO: 189109 - DNA, 25 bp, Rattus norvegicus
atgacggtccataagcctgttgaat

SEQ ID NO: 189110 - DNA, 25 bp, Rattus norvegicus
atgacggtccattagcctgttgaat

SEQ ID NO: 189111 - DNA, 25 bp, Rattus norvegicus
atgacggtgataccaagctccctga

SEQ ID NO: 189112 - DNA, 25 bp, Rattus norvegicus
atgacggtgatagcaagctccctga

SEQ ID NO: 189113 - DNA, 25 bp, Rattus norvegicus
atgacggtgcccacagctgagcatt

SEQ ID NO: 189114 - DNA, 25 bp, Rattus norvegicus
atgacggtgccctcagctgagcatt

SEQ ID NO: 189115 - DNA, 25 bp, Rattus norvegicus
atgacggtttacaagtgagctgttt

SEQ ID NO: 189116 - DNA, 25 bp, Rattus norvegicus
atgacggtttactagtgagctgttt

SEQ ID NO: 189117 - DNA, 25 bp, Rattus norvegicus
atgacggttttaaggccaccccaag

SEQ ID NO: 189118 - DNA, 25 bp, Rattus norvegicus
atgacggttttatggccaccccaag

SEQ ID NO: 189119 - DNA, 25 bp, Rattus norvegicus
atgacgtaatccctccaactgggtc

SEQ ID NO: 189120 - DNA, 25 bp, Rattus norvegicus
atgacgtaatccgtccaactgggtc

SEQ ID NO: 189121 - DNA, 25 bp, Rattus norvegicus
atgacgtacatgcttctgatgggaa

SEQ ID NO: 189122 - DNA, 25 bp, Rattus norvegicus
atgacgtacatggttctgatgggaa

SEQ ID NO: 189123 - DNA, 25 bp, Rattus norvegicus
atgacgtcaaggctatcttctttgc

SEQ ID NO: 189124 - DNA, 25 bp, Rattus norvegicus
atgacgtcaagggtatcttctttgc

SEQ ID NO: 189125 - DNA, 25 bp, Rattus norvegicus
atgacgtcacagatcctataggctt

SEQ ID NO: 189126 - DNA, 25 bp, Rattus norvegicus
atgacgtcacagttcctataggctt

SEQ ID NO: 189127 - DNA, 25 bp, Rattus norvegicus
atgacgtcagctactgtcacatagc

SEQ ID NO: 189128 - DNA, 25 bp, Rattus norvegicus
atgacgtcagcttctgtcacatagc

SEQ ID NO: 189129 - DNA, 25 bp, Rattus norvegicus
atgacgtcatctcacgtgcgaccta

SEQ ID NO: 189130 - DNA, 25 bp, Rattus norvegicus
atgacgtcatctgacgtgcgaccta

SEQ ID NO: 189131 - DNA, 25 bp, Rattus norvegicus
atgacgtcattgacccttgtgaaag

SEQ ID NO: 189132 - DNA, 25 bp, Rattus norvegicus
atgacgtcattgtcccttgtgaaag

SEQ ID NO: 189133 - DNA, 25 bp, Rattus norvegicus
atgacgtcccttcaggctggtagcc

SEQ ID NO: 189134 - DNA, 25 bp, Rattus norvegicus
atgacgtcccttgaggctggtagcc

SEQ ID NO: 189135 - DNA, 25 bp, Rattus norvegicus
atgacgtcgtccagggaggcttttg

SEQ ID NO: 189136 - DNA, 25 bp, Rattus norvegicus
atgacgtcgtcctgggaggcttttg

SEQ ID NO: 189137 - DNA, 25 bp, Rattus norvegicus
atgacgtctctgaggaagcctggga

SEQ ID NO: 189138 - DNA, 25 bp, Rattus norvegicus
atgacgtctctgtggaagcctggga

SEQ ID NO: 189139 - DNA, 25 bp, Rattus norvegicus
atgacgtctgtgagcagtgttccct

SEQ ID NO: 189140 - DNA, 25 bp, Rattus norvegicus
atgacgtctgtgtgcagtgttccct

SEQ ID NO: 189141 - DNA, 25 bp, Rattus norvegicus
atgacgtgatctacactactggtcc

SEQ ID NO: 189142 - DNA, 25 bp, Rattus norvegicus
atgacgtgatcttcactactggtcc

SEQ ID NO: 189143 - DNA, 25 bp, Rattus norvegicus
atgacgtgcagccacgacttccgag

SEQ ID NO: 189144 - DNA, 25 bp, Rattus norvegicus
atgacgtgcagcgacgacttccgag

SEQ ID NO: 189145 - DNA, 25 bp, Rattus norvegicus
atgacgtgcaggaccgtttcgaggt

SEQ ID NO: 189146 - DNA, 25 bp, Rattus norvegicus
atgacgtgcaggtccgtttcgaggt

SEQ ID NO: 189147 - DNA, 25 bp, Rattus norvegicus
atgacgtggaaacatggctgtcgca

SEQ ID NO: 189148 - DNA, 25 bp, Rattus norvegicus
atgacgtggaaagatggctgtcgca

SEQ ID NO: 189149 - DNA, 25 bp, Rattus norvegicus
atgacgttaaacacttactagatta

SEQ ID NO: 189150 - DNA, 25 bp, Rattus norvegicus
atgacgttaaactcttactagatta

SEQ ID NO: 189151 - DNA, 25 bp, Rattus norvegicus
atgacgttctggatgggcctgtgtc

SEQ ID NO: 189152 - DNA, 25 bp, Rattus norvegicus
atgacgttctggttgggcctgtgtc

SEQ ID NO: 189153 - DNA, 25 bp, Rattus norvegicus
atgactaaagtcacctgccaccaaa

SEQ ID NO: 189154 - DNA, 25 bp, Rattus norvegicus
atgactaaagtctcctgccaccaaa

SEQ ID NO: 189155 - DNA, 25 bp, Rattus norvegicus
atgactaacactattcttcgtttga

SEQ ID NO: 189156 - DNA, 25 bp, Rattus norvegicus
atgactaacacttttcttcgtttga

SEQ ID NO: 189157 - DNA, 25 bp, Rattus norvegicus
atgactaacattcctgctttcttct

SEQ ID NO: 189158 - DNA, 25 bp, Rattus norvegicus
atgactaacattgctgctttcttct

SEQ ID NO: 189159 - DNA, 25 bp, Rattus norvegicus
atgactaactggcaagcatcctctt

SEQ ID NO: 189160 - DNA, 25 bp, Rattus norvegicus
atgactaactgggaagcatcctctt

SEQ ID NO: 189161 - DNA, 25 bp, Rattus norvegicus
atgactaagtataggctggacggaa

SEQ ID NO: 189162 - DNA, 25 bp, Rattus norvegicus
atgactaagtattggctggacggaa

SEQ ID NO: 189163 - DNA, 25 bp, Rattus norvegicus
atgactacacggcacagaattctga

SEQ ID NO: 189164 - DNA, 25 bp, Rattus norvegicus
atgactacacgggacagaattctga

SEQ ID NO: 189165 - DNA, 25 bp, Rattus norvegicus
atgactacattacagtgctgtgact

SEQ ID NO: 189166 - DNA, 25 bp, Rattus norvegicus
atgactacattagagtgctgtgact

SEQ ID NO: 189167 - DNA, 25 bp, Rattus norvegicus
atgactaccggtcgtgtttcagggt

SEQ ID NO: 189168 - DNA, 25 bp, Rattus norvegicus
atgactaccggtggtgtttcagggt

SEQ ID NO: 189169 - DNA, 25 bp, Rattus norvegicus
atgactacctagaaaagcaagcttt

SEQ ID NO: 189170 - DNA, 25 bp, Rattus norvegicus
atgactacctagtaaagcaagcttt

SEQ ID NO: 189171 - DNA, 25 bp, Rattus norvegicus
atgactacctctcagattgctctaa

SEQ ID NO: 189172 - DNA, 25 bp, Rattus norvegicus
atgactacctctgagattgctctaa

SEQ ID NO: 189173 - DNA, 25 bp, Rattus norvegicus
atgactacctggatgttttctgccc

SEQ ID NO: 189174 - DNA, 25 bp, Rattus norvegicus
atgactacctggttgttttctgccc

SEQ ID NO: 189175 - DNA, 25 bp, Rattus norvegicus
atgactacgggcaaagacccaagca

SEQ ID NO: 189176 - DNA, 25 bp, Rattus norvegicus
atgactacgggctaagacccaagca

SEQ ID NO: 189177 - DNA, 25 bp, Rattus norvegicus
atgactacgtctacgactggaacat

SEQ ID NO: 189178 - DNA, 25 bp, Rattus norvegicus
atgactacgtcttcgactggaacat

SEQ ID NO: 189179 - DNA, 25 bp, Rattus norvegicus
atgactactcacaagagcgggtacc

SEQ ID NO: 189180 - DNA, 25 bp, Rattus norvegicus
atgactactcactagagcgggtacc

SEQ ID NO: 189181 - DNA, 25 bp, Rattus norvegicus
atgactactcccattattgctggaa

SEQ ID NO: 189182 - DNA, 25 bp, Rattus norvegicus
atgactactccctttattgctggaa

SEQ ID NO: 189183 - DNA, 25 bp, Rattus norvegicus
atgactaggaccctggccctggctg

SEQ ID NO: 189184 - DNA, 25 bp, Rattus norvegicus
atgactaggaccgtggccctggctg

SEQ ID NO: 189185 - DNA, 25 bp, Rattus norvegicus
atgactatccctctccccaattggt

SEQ ID NO: 189186 - DNA, 25 bp, Rattus norvegicus
atgactatccctgtccccaattggt

SEQ ID NO: 189187 - DNA, 25 bp, Rattus norvegicus
atgactatccggaggagccccttaa

SEQ ID NO: 189188 - DNA, 25 bp, Rattus norvegicus
atgactatccggtggagccccttaa

SEQ ID NO: 189189 - DNA, 25 bp, Rattus norvegicus
atgactatctcactactacatccaa

SEQ ID NO: 189190 - DNA, 25 bp, Rattus norvegicus
atgactatctcagtactacatccaa

SEQ ID NO: 189191 - DNA, 25 bp, Rattus norvegicus
atgactatctctagagccctgctat

SEQ ID NO: 189192 - DNA, 25 bp, Rattus norvegicus
atgactatctcttgagccctgctat

SEQ ID NO: 189193 - DNA, 25 bp, Rattus norvegicus
atgactatggcccagctgtggactg

SEQ ID NO: 189194 - DNA, 25 bp, Rattus norvegicus
atgactatggccgagctgtggactg

SEQ ID NO: 189195 - DNA, 25 bp, Rattus norvegicus
atgactattaccatgtttccttaac

SEQ ID NO: 189196 - DNA, 25 bp, Rattus norvegicus
atgactattaccttgtttccttaac

SEQ ID NO: 189197 - DNA, 25 bp, Rattus norvegicus
atgactattcggatgggccttgcac

SEQ ID NO: 189198 - DNA, 25 bp, Rattus norvegicus
atgactattcggttgggccttgcac

SEQ ID NO: 189199 - DNA, 25 bp, Rattus norvegicus
atgactattgggattttgctgttgc

SEQ ID NO: 189200 - DNA, 25 bp, Rattus norvegicus
atgactattgggtttttgctgttgc

SEQ ID NO: 189201 - DNA, 25 bp, Rattus norvegicus
atgactatttagatcacctttctat

SEQ ID NO: 189202 - DNA, 25 bp, Rattus norvegicus
atgactatttagttcacctttctat

SEQ ID NO: 189203 - DNA, 25 bp, Rattus norvegicus
atgactatttctaccagcgtgggtg

SEQ ID NO: 189204 - DNA, 25 bp, Rattus norvegicus
atgactatttcttccagcgtgggtg

SEQ ID NO: 189205 - DNA, 25 bp, Rattus norvegicus
atgactcaaagcatcggagccgtga

SEQ ID NO: 189206 - DNA, 25 bp, Rattus norvegicus
atgactcaaagcttcggagccgtga

SEQ ID NO: 189207 - DNA, 25 bp, Rattus norvegicus
atgactcaacacagatccaggcgcc

SEQ ID NO: 189208 - DNA, 25 bp, Rattus norvegicus
atgactcaacactgatccaggcgcc

SEQ ID NO: 189209 - DNA, 25 bp, Rattus norvegicus
atgactcaagcacccacagtgggtc

SEQ ID NO: 189210 - DNA, 25 bp, Rattus norvegicus
atgactcaagcagccacagtgggtc

SEQ ID NO: 189211 - DNA, 25 bp, Rattus norvegicus
atgactcactcacagaagccaggct

SEQ ID NO: 189212 - DNA, 25 bp, Rattus norvegicus
atgactcactcagagaagccaggct

SEQ ID NO: 189213 - DNA, 25 bp, Rattus norvegicus
atgactcagactacactagatcctt

SEQ ID NO: 189214 - DNA, 25 bp, Rattus norvegicus
atgactcagacttcactagatcctt

SEQ ID NO: 189215 - DNA, 25 bp, Rattus norvegicus
atgactcagtaaagtctctccagtc

SEQ ID NO: 189216 - DNA, 25 bp, Rattus norvegicus
atgactcagtaatgtctctccagtc

SEQ ID NO: 189217 - DNA, 25 bp, Rattus norvegicus
atgactcagtgaccattgcctccac

SEQ ID NO: 189218 - DNA, 25 bp, Rattus norvegicus
atgactcagtgagcattgcctccac

SEQ ID NO: 189219 - DNA, 25 bp, Rattus norvegicus
atgactcatttgaccgtgaggccag

SEQ ID NO: 189220 - DNA, 25 bp, Rattus norvegicus
atgactcatttgtccgtgaggccag

SEQ ID NO: 189221 - DNA, 25 bp, Rattus norvegicus
atgactccaaaacccaggtgaccaa

SEQ ID NO: 189222 - DNA, 25 bp, Rattus norvegicus
atgactccaaaagccaggtgaccaa

SEQ ID NO: 189223 - DNA, 25 bp, Rattus norvegicus
atgactccaaccaacagatgactgt

SEQ ID NO: 189224 - DNA, 25 bp, Rattus norvegicus
atgactccaacctacagatgactgt

SEQ ID NO: 189225 - DNA, 25 bp, Rattus norvegicus
atgactccacacatacatttggatg

SEQ ID NO: 189226 - DNA, 25 bp, Rattus norvegicus
atgactccacacttacatttggatg

SEQ ID NO: 189227 - DNA, 25 bp, Rattus norvegicus
atgactccacagcacagctttttct

SEQ ID NO: 189228 - DNA, 25 bp, Rattus norvegicus
atgactccacaggacagctttttct

SEQ ID NO: 189229 - DNA, 25 bp, Rattus norvegicus
atgactccagagcttacaaaaatta

SEQ ID NO: 189230 - DNA, 25 bp, Rattus norvegicus
atgactccagaggttacaaaaatta

SEQ ID NO: 189231 - DNA, 25 bp, Rattus norvegicus
atgactccatcactactgtgtgtag

SEQ ID NO: 189232 - DNA, 25 bp, Rattus norvegicus
atgactccatcagtactgtgtgtag

SEQ ID NO: 189233 - DNA, 25 bp, Rattus norvegicus
atgactccattcctccaagagaata

SEQ ID NO: 189234 - DNA, 25 bp, Rattus norvegicus
atgactccattcgtccaagagaata

SEQ ID NO: 189235 - DNA, 25 bp, Rattus norvegicus
atgactcccaaaattctacatccac

SEQ ID NO: 189236 - DNA, 25 bp, Rattus norvegicus
atgactcccaaatttctacatccac

SEQ ID NO: 189237 - DNA, 25 bp, Rattus norvegicus
atgactcccaggactttgcagtgct

SEQ ID NO: 189238 - DNA, 25 bp, Rattus norvegicus
atgactcccaggtctttgcagtgct

SEQ ID NO: 189239 - DNA, 25 bp, Rattus norvegicus
atgactcccatcaagttgctggtgc

SEQ ID NO: 189240 - DNA, 25 bp, Rattus norvegicus
atgactcccatctagttgctggtgc

SEQ ID NO: 189241 - DNA, 25 bp, Rattus norvegicus
atgactcccctgagaagtttggtcc

SEQ ID NO: 189242 - DNA, 25 bp, Rattus norvegicus
atgactcccctgtgaagtttggtcc

SEQ ID NO: 189243 - DNA, 25 bp, Rattus norvegicus
atgactcccggcagtgcttttatta

SEQ ID NO: 189244 - DNA, 25 bp, Rattus norvegicus
atgactcccggctgtgcttttatta

SEQ ID NO: 189245 - DNA, 25 bp, Rattus norvegicus
atgactccctctccaacaacaggaa

SEQ ID NO: 189246 - DNA, 25 bp, Rattus norvegicus
atgactccctctgcaacaacaggaa

SEQ ID NO: 189247 - DNA, 25 bp, Rattus norvegicus
atgactcccttaattctggaagtca

SEQ ID NO: 189248 - DNA, 25 bp, Rattus norvegicus
atgactcccttatttctggaagtca

SEQ ID NO: 189249 - DNA, 25 bp, Rattus norvegicus
atgactccgatcacattctcaatga

SEQ ID NO: 189250 - DNA, 25 bp, Rattus norvegicus
atgactccgatctcattctcaatga

SEQ ID NO: 189251 - DNA, 25 bp, Rattus norvegicus
atgactccggtaactttaaactgct

SEQ ID NO: 189252 - DNA, 25 bp, Rattus norvegicus
atgactccggtatctttaaactgct

SEQ ID NO: 189253 - DNA, 25 bp, Rattus norvegicus
atgactcctacaagctgtctgagac

SEQ ID NO: 189254 - DNA, 25 bp, Rattus norvegicus
atgactcctacatgctgtctgagac

SEQ ID NO: 189255 - DNA, 25 bp, Rattus norvegicus
atgactcctaggacccatgggcaga

SEQ ID NO: 189256 - DNA, 25 bp, Rattus norvegicus
atgactcctaggtcccatgggcaga

SEQ ID NO: 189257 - DNA, 25 bp, Rattus norvegicus
atgactcctccactaatggactgat

SEQ ID NO: 189258 - DNA, 25 bp, Rattus norvegicus
atgactcctccactgaattgctaaa

SEQ ID NO: 189259 - DNA, 25 bp, Rattus norvegicus
atgactcctccagtaatggactgat

SEQ ID NO: 189260 - DNA, 25 bp, Rattus norvegicus
atgactcctccagtgaattgctaaa

SEQ ID NO: 189261 - DNA, 25 bp, Rattus norvegicus
atgactcctgtgagtggatgacaca

SEQ ID NO: 189262 - DNA, 25 bp, Rattus norvegicus
atgactcctgtgtgtggatgacaca

SEQ ID NO: 189263 - DNA, 25 bp, Rattus norvegicus
atgactccttagctggagagttaaa

SEQ ID NO: 189264 - DNA, 25 bp, Rattus norvegicus
atgactccttaggtggagagttaaa

SEQ ID NO: 189265 - DNA, 25 bp, Rattus norvegicus
atgactccttgtatgtcttgacagc

SEQ ID NO: 189266 - DNA, 25 bp, Rattus norvegicus
atgactccttgtttgtcttgacagc

SEQ ID NO: 189267 - DNA, 25 bp, Rattus norvegicus
atgactcgaagcactagttttctag

SEQ ID NO: 189268 - DNA, 25 bp, Rattus norvegicus
atgactcgaagctctagttttctag

SEQ ID NO: 189269 - DNA, 25 bp, Rattus norvegicus
atgactcggtcaagttcgcgcggcg

SEQ ID NO: 189270 - DNA, 25 bp, Rattus norvegicus
atgactcggtcatgttcgcgcggcg

SEQ ID NO: 189271 - DNA, 25 bp, Rattus norvegicus
atgactcggtttacattccattgcg

SEQ ID NO: 189272 - DNA, 25 bp, Rattus norvegicus
atgactcggttttcattccattgcg

SEQ ID NO: 189273 - DNA, 25 bp, Rattus norvegicus
atgactcgtacacgttcttttgcag

SEQ ID NO: 189274 - DNA, 25 bp, Rattus norvegicus
atgactcgtacaggttcttttgcag

SEQ ID NO: 189275 - DNA, 25 bp, Rattus norvegicus
atgactctaccacgttgacacttgt

SEQ ID NO: 189276 - DNA, 25 bp, Rattus norvegicus
atgactctaccaggttgacacttgt

SEQ ID NO: 189277 - DNA, 25 bp, Rattus norvegicus
atgactctatacatctcttcttctt

SEQ ID NO: 189278 - DNA, 25 bp, Rattus norvegicus
atgactctatacttctcttcttctt

SEQ ID NO: 189279 - DNA, 25 bp, Rattus norvegicus
atgactctatgtctggagaaggaac

SEQ ID NO: 189280 - DNA, 25 bp, Rattus norvegicus
atgactctatgtgtggagaaggaac

SEQ ID NO: 189281 - DNA, 25 bp, Rattus norvegicus
atgactctccatatgggactttgcc

SEQ ID NO: 189282 - DNA, 25 bp, Rattus norvegicus
atgactctccatttgggactttgcc

SEQ ID NO: 189283 - DNA, 25 bp, Rattus norvegicus
atgactctccgcacgttggtggtca

SEQ ID NO: 189284 - DNA, 25 bp, Rattus norvegicus
atgactctccgctcgttggtggtca

SEQ ID NO: 189285 - DNA, 25 bp, Rattus norvegicus
atgactctgaagacagcgctggctc

SEQ ID NO: 189286 - DNA, 25 bp, Rattus norvegicus
atgactctgaagtcagcgctggctc

SEQ ID NO: 189287 - DNA, 25 bp, Rattus norvegicus
atgactctgattctctcttgatttt

SEQ ID NO: 189288 - DNA, 25 bp, Rattus norvegicus
atgactctgattgtctcttgatttt

SEQ ID NO: 189289 - DNA, 25 bp, Rattus norvegicus
atgactctgccaaggtgtcacgggc

SEQ ID NO: 189290 - DNA, 25 bp, Rattus norvegicus
atgactctgccatggtgtcacgggc

SEQ ID NO: 189291 - DNA, 25 bp, Rattus norvegicus
atgactctgctgaggagggcgacct

SEQ ID NO: 189292 - DNA, 25 bp, Rattus norvegicus
atgactctgctgtggagggcgacct

SEQ ID NO: 189293 - DNA, 25 bp, Rattus norvegicus
atgactctggtcaccccaaagtgag

SEQ ID NO: 189294 - DNA, 25 bp, Rattus norvegicus
atgactctggtctccccaaagtgag

SEQ ID NO: 189295 - DNA, 25 bp, Rattus norvegicus
atgactcttggtcccacagtagttg

SEQ ID NO: 189296 - DNA, 25 bp, Rattus norvegicus
atgactcttggtgccacagtagttg

SEQ ID NO: 189297 - DNA, 25 bp, Rattus norvegicus
atgactcttgtcaacttagcgtgct

SEQ ID NO: 189298 - DNA, 25 bp, Rattus norvegicus
atgactcttgtctacttagcgtgct

SEQ ID NO: 189299 - DNA, 25 bp, Rattus norvegicus
atgactcttgtgaggataatttttt

SEQ ID NO: 189300 - DNA, 25 bp, Rattus norvegicus
atgactcttgtgtggataatttttt

SEQ ID NO: 189301 - DNA, 25 bp, Rattus norvegicus
atgactgaaaacactgtgcgtgtgc

SEQ ID NO: 189302 - DNA, 25 bp, Rattus norvegicus
atgactgaaaactctgtgcgtgtgc

SEQ ID NO: 189303 - DNA, 25 bp, Rattus norvegicus
atgactgaaagtcggccagcacgcc

SEQ ID NO: 189304 - DNA, 25 bp, Rattus norvegicus
atgactgaaagtgggccagcacgcc

SEQ ID NO: 189305 - DNA, 25 bp, Rattus norvegicus
atgactgaagcacttcctgcgctgg

SEQ ID NO: 189306 - DNA, 25 bp, Rattus norvegicus
atgactgaagcagttcctgcgctgg

SEQ ID NO: 189307 - DNA, 25 bp, Rattus norvegicus
atgactgaaggtatggcagcagcac

SEQ ID NO: 189308 - DNA, 25 bp, Rattus norvegicus
atgactgaaggtttggcagcagcac

SEQ ID NO: 189309 - DNA, 25 bp, Rattus norvegicus
atgactgaattcaagcgcggcctgc

SEQ ID NO: 189310 - DNA, 25 bp, Rattus norvegicus
atgactgaattctagcgcggcctgc
